United States Patent 7,888,497 (BIOINFORMATICALLY DETECTABLE GROUP OF NOVEL REGULATORY OLIGONUCLEOTIDES AND USES THEREOF) - sequence listing, part 14

SEQ ID NO: 550503 - DNA, 21 bp, Homo sapiens
aacgtagtcggcacagcctgg

SEQ ID NO: 550504 - DNA, 13 bp, Homo sapiens
aacgtattttaaa

SEQ ID NO: 550505 - DNA, 12 bp, Homo sapiens
aacgtattttga

SEQ ID NO: 550506 - DNA, 19 bp, Homo sapiens
aacgtctttttaagccttt

SEQ ID NO: 550507 - DNA, 23 bp, Homo sapiens
aacgtgatgtgctcatcagaaac

SEQ ID NO: 550508 - DNA, 18 bp, Homo sapiens
aactaatgacaagtgact

SEQ ID NO: 550509 - DNA, 13 bp, Homo sapiens
aactaatgagttt

SEQ ID NO: 550510 - DNA, 18 bp, Homo sapiens
aactaggaaggcacttct

SEQ ID NO: 550511 - DNA, 23 bp, Homo sapiens
aactatatgtacagctctcccct

SEQ ID NO: 550512 - DNA, 15 bp, Homo sapiens
aactattgggtgaat

SEQ ID NO: 550513 - DNA, 13 bp, Homo sapiens
aattatcattgtt

SEQ ID NO: 550514 - DNA, 14 bp, Homo sapiens
aattattgattgct

SEQ ID NO: 550515 - DNA, 13 bp, Homo sapiens
aattcaaacctaa

SEQ ID NO: 550516 - DNA, 19 bp, Homo sapiens
aattcaattcatagaataa

SEQ ID NO: 550517 - DNA, 15 bp, Homo sapiens
aattcagataatggt

SEQ ID NO: 550518 - DNA, 17 bp, Homo sapiens
aattcattaaaaacatt

SEQ ID NO: 550519 - DNA, 13 bp, Homo sapiens
aattccaaagatc

SEQ ID NO: 550520 - DNA, 17 bp, Homo sapiens
aattccaaagatctgaa

SEQ ID NO: 550521 - DNA, 18 bp, Homo sapiens
aattccagggaaccagag

SEQ ID NO: 550522 - DNA, 12 bp, Homo sapiens
aattcctatgaa

SEQ ID NO: 550523 - DNA, 18 bp, Homo sapiens
aattctaatggtaacttt

SEQ ID NO: 550524 - DNA, 22 bp, Homo sapiens
aattctaatggtaacttttgta

SEQ ID NO: 550525 - DNA, 23 bp, Homo sapiens
aattcttattccatattagaaaa

SEQ ID NO: 550526 - DNA, 17 bp, Homo sapiens
aattgaagagagatata

SEQ ID NO: 550527 - DNA, 14 bp, Homo sapiens
aattgagctagaaa

SEQ ID NO: 550528 - DNA, 15 bp, Homo sapiens
aattgaggttaggaa

SEQ ID NO: 550529 - DNA, 14 bp, Homo sapiens
aattgatgttgatg

SEQ ID NO: 550530 - DNA, 21 bp, Homo sapiens
aattgatttttaaacagcagg

SEQ ID NO: 550531 - DNA, 14 bp, Homo sapiens
aattgcttctctaa

SEQ ID NO: 550532 - DNA, 23 bp, Homo sapiens
aattggccagaggaaatctgaat

SEQ ID NO: 550533 - DNA, 23 bp, Homo sapiens
aattggcttgtttaaggttcttg

SEQ ID NO: 550534 - DNA, 15 bp, Homo sapiens
aattggtaccttgca

SEQ ID NO: 550535 - DNA, 13 bp, Homo sapiens
aattggtttaaac

SEQ ID NO: 550536 - DNA, 17 bp, Homo sapiens
aattggtttaaactttt

SEQ ID NO: 550537 - DNA, 18 bp, Homo sapiens
aattggtttaaactttta

SEQ ID NO: 550538 - DNA, 19 bp, Homo sapiens
aattggtttaaacttttat

SEQ ID NO: 550539 - DNA, 12 bp, Homo sapiens
aattgtatatat

SEQ ID NO: 550540 - DNA, 15 bp, Homo sapiens
aattgtatatatatg

SEQ ID NO: 550541 - DNA, 18 bp, Homo sapiens
aattgtatatatatgtga

SEQ ID NO: 550542 - DNA, 21 bp, Homo sapiens
aattgtatatatatgtgaact

SEQ ID NO: 550543 - DNA, 19 bp, Homo sapiens
aattgtgctccaaatgtct

SEQ ID NO: 550544 - DNA, 15 bp, Homo sapiens
aatttaagcacaaaa

SEQ ID NO: 550545 - DNA, 21 bp, Homo sapiens
aatttaagtcattttcatgtg

SEQ ID NO: 550546 - DNA, 18 bp, Homo sapiens
aatttaccacaggatgca

SEQ ID NO: 550547 - DNA, 23 bp, Homo sapiens
aatttaccacaggatgcatatta

SEQ ID NO: 550548 - DNA, 19 bp, Homo sapiens
aatttagtgtatatgtgat

SEQ ID NO: 550549 - DNA, 21 bp, Homo sapiens
aatttattgaggaaaaatatg

SEQ ID NO: 550550 - DNA, 23 bp, Homo sapiens
aatttattgaggaaaaatatgtg

SEQ ID NO: 550551 - DNA, 14 bp, Homo sapiens
aatttattgcacaa

SEQ ID NO: 550552 - DNA, 15 bp, Homo sapiens
aatttcaaaagacat

SEQ ID NO: 550553 - DNA, 17 bp, Homo sapiens
aatttcaagcttatttt

SEQ ID NO: 550554 - DNA, 20 bp, Homo sapiens
aatttcaagcttattttgga

SEQ ID NO: 550555 - DNA, 17 bp, Homo sapiens
aatttcttgcaatttga

SEQ ID NO: 550556 - DNA, 12 bp, Homo sapiens
aatttgaaacat

SEQ ID NO: 550557 - DNA, 15 bp, Homo sapiens
aatttgaaacattgc

SEQ ID NO: 550558 - DNA, 19 bp, Homo sapiens
aatttggggctacttatat

SEQ ID NO: 550559 - DNA, 14 bp, Homo sapiens
aatttgtctttgga

SEQ ID NO: 550560 - DNA, 20 bp, Homo sapiens
aatttgttaattcctatgaa

SEQ ID NO: 550561 - DNA, 21 bp, Homo sapiens
aatttgttaattcctatgaag

SEQ ID NO: 550562 - DNA, 16 bp, Homo sapiens
aatttgttctgtgcaa

SEQ ID NO: 550563 - DNA, 23 bp, Homo sapiens
aattttaagctaggaaaagaaat

SEQ ID NO: 550564 - DNA, 22 bp, Homo sapiens
aattttattaaaagagtagaaa

SEQ ID NO: 550565 - DNA, 13 bp, Homo sapiens
aattttattgctg

SEQ ID NO: 550566 - DNA, 20 bp, Homo sapiens
aattttcagatttgcacaaa

SEQ ID NO: 550567 - DNA, 19 bp, Homo sapiens
aattttcattttacagtta

SEQ ID NO: 550568 - DNA, 21 bp, Homo sapiens
aattttgtctgccccaagttt

SEQ ID NO: 550569 - DNA, 22 bp, Homo sapiens
aattttgtctgccccaagtttt

SEQ ID NO: 550570 - DNA, 12 bp, Homo sapiens
aattttgtttta

SEQ ID NO: 550571 - DNA, 19 bp, Homo sapiens
aatttttaagtgtcagact

SEQ ID NO: 550572 - DNA, 23 bp, Homo sapiens
aatttttcagctctctgtataaa

SEQ ID NO: 550573 - DNA, 14 bp, Homo sapiens
aatttttcatattt

SEQ ID NO: 550574 - DNA, 12 bp, Homo sapiens
aatttttctgta

SEQ ID NO: 550575 - DNA, 12 bp, Homo sapiens
acaaaaacacaa

SEQ ID NO: 550576 - DNA, 15 bp, Homo sapiens
acaaaaacacaaata

SEQ ID NO: 550577 - DNA, 13 bp, Homo sapiens
acaaaaactaaaa

SEQ ID NO: 550578 - DNA, 20 bp, Homo sapiens
acaaaaagataccttaaaat

SEQ ID NO: 550579 - DNA, 22 bp, Homo sapiens
acaaaatataaagcatctaaac

SEQ ID NO: 550580 - DNA, 23 bp, Homo sapiens
acaaaatataaagcatctaaact

SEQ ID NO: 550581 - DNA, 17 bp, Homo sapiens
acaaaatgtaactgtta

SEQ ID NO: 550582 - DNA, 20 bp, Homo sapiens
acaaaatgtaactgttacca

SEQ ID NO: 550583 - DNA, 23 bp, Homo sapiens
acaaaatgtaactgttaccattg

SEQ ID NO: 550584 - DNA, 23 bp, Homo sapiens
acaaaatgtgtgcttggaaaatg

SEQ ID NO: 550585 - DNA, 13 bp, Homo sapiens
acaaacaaaagca

SEQ ID NO: 550586 - DNA, 18 bp, Homo sapiens
acaaacaagctaggtgct

SEQ ID NO: 550587 - DNA, 18 bp, Homo sapiens
acaaaccctttaaatggg

SEQ ID NO: 550588 - DNA, 16 bp, Homo sapiens
acaaactgcacatgat

SEQ ID NO: 550589 - DNA, 16 bp, Homo sapiens
acaaaggctgtattca

SEQ ID NO: 550590 - DNA, 14 bp, Homo sapiens
acaaatacacatac

SEQ ID NO: 550591 - DNA, 15 bp, Homo sapiens
acaaatacacataca

SEQ ID NO: 550592 - DNA, 20 bp, Homo sapiens
acaaatacacatacatatat

SEQ ID NO: 550593 - DNA, 23 bp, Homo sapiens
acaaatagtaggcaagatggcac

SEQ ID NO: 550594 - DNA, 12 bp, Homo sapiens
acaaatattaaa

SEQ ID NO: 550595 - DNA, 20 bp, Homo sapiens
acaaatattaaaaagtcttt

SEQ ID NO: 550596 - DNA, 21 bp, Homo sapiens
acaaatgattgcttttaaaat

SEQ ID NO: 550597 - DNA, 12 bp, Homo sapiens
acaaatgtgtga

SEQ ID NO: 550598 - DNA, 19 bp, Homo sapiens
acaacaccagcaacattat

SEQ ID NO: 550599 - DNA, 12 bp, Homo sapiens
acaacagcccag

SEQ ID NO: 550600 - DNA, 14 bp, Homo sapiens
acaacataaaatta

SEQ ID NO: 550601 - DNA, 15 bp, Homo sapiens
acaaccatgttcttg

SEQ ID NO: 550602 - DNA, 16 bp, Homo sapiens
acaaccatgttcttga

SEQ ID NO: 550603 - DNA, 13 bp, Homo sapiens
acaacccccagct

SEQ ID NO: 550604 - DNA, 16 bp, Homo sapiens
acaacgagccttttca

SEQ ID NO: 550605 - DNA, 20 bp, Homo sapiens
acaacgcataggaaaagaat

SEQ ID NO: 550606 - DNA, 18 bp, Homo sapiens
acaacttttttttctttt

SEQ ID NO: 550607 - DNA, 20 bp, Homo sapiens
acaacttttttttctttttt

SEQ ID NO: 550608 - DNA, 17 bp, Homo sapiens
acaagaataaaggcagc

SEQ ID NO: 550609 - DNA, 19 bp, Homo sapiens
acaagactgtaaattccaa

SEQ ID NO: 550610 - DNA, 22 bp, Homo sapiens
acaagactgtaaattccaaaga

SEQ ID NO: 550611 - DNA, 13 bp, Homo sapiens
acaagcagacaca

SEQ ID NO: 550612 - DNA, 14 bp, Homo sapiens
acaagcagacacac

SEQ ID NO: 550613 - DNA, 22 bp, Homo sapiens
acaagcagacacacacatatat

SEQ ID NO: 550614 - DNA, 19 bp, Homo sapiens
acaagcatataaaatggca

SEQ ID NO: 550615 - DNA, 16 bp, Homo sapiens
acaagcctcagcaaac

SEQ ID NO: 550616 - DNA, 17 bp, Homo sapiens
acaagctaggtgctaat

SEQ ID NO: 550617 - DNA, 22 bp, Homo sapiens
acaagctaggtgctaattaata

SEQ ID NO: 550618 - DNA, 10 bp, Homo sapiens
acaaggactc

SEQ ID NO: 550619 - DNA, 15 bp, Homo sapiens
acaaggcaaaaacaa

SEQ ID NO: 550620 - DNA, 22 bp, Homo sapiens
acaaggttgctggcatttgctg

SEQ ID NO: 550621 - DNA, 17 bp, Homo sapiens
acaataagaaacagttt

SEQ ID NO: 550622 - DNA, 14 bp, Homo sapiens
acaataagccactg

SEQ ID NO: 550623 - DNA, 18 bp, Homo sapiens
acaatatataaaaatata

SEQ ID NO: 550624 - DNA, 14 bp, Homo sapiens
acaatatttctgat

SEQ ID NO: 550625 - DNA, 14 bp, Homo sapiens
acaatatttgtgtg

SEQ ID NO: 550626 - DNA, 18 bp, Homo sapiens
acaatatttgtgtgctaa

SEQ ID NO: 550627 - DNA, 15 bp, Homo sapiens
acaatgaatgtatat

SEQ ID NO: 550628 - DNA, 11 bp, Homo sapiens
acaatgtcttg

SEQ ID NO: 550629 - DNA, 23 bp, Homo sapiens
acaattataaactcattttgctt

SEQ ID NO: 550630 - DNA, 19 bp, Homo sapiens
acaattcaaagaatcacct

SEQ ID NO: 550631 - DNA, 16 bp, Homo sapiens
acaattctaatggtaa

SEQ ID NO: 550632 - DNA, 17 bp, Homo sapiens
acaattctaatggtaac

SEQ ID NO: 550633 - DNA, 20 bp, Homo sapiens
acaattctaatggtaacttt

SEQ ID NO: 550634 - DNA, 15 bp, Homo sapiens
acaatttacttttaa

SEQ ID NO: 550635 - DNA, 18 bp, Homo sapiens
acaatttacttttaataa

SEQ ID NO: 550636 - DNA, 16 bp, Homo sapiens
acaatttgttaattcc

SEQ ID NO: 550637 - DNA, 15 bp, Homo sapiens
acaattttcagattt

SEQ ID NO: 550638 - DNA, 20 bp, Homo sapiens
acaattttcagatttgcaca

SEQ ID NO: 550639 - DNA, 16 bp, Homo sapiens
acacaaattatgctaa

SEQ ID NO: 550640 - DNA, 19 bp, Homo sapiens
acacaagcagacacacaca

SEQ ID NO: 550641 - DNA, 18 bp, Homo sapiens
acacaatcagaccaagga

SEQ ID NO: 550642 - DNA, 13 bp, Homo sapiens
acacacacacacg

SEQ ID NO: 550643 - DNA, 13 bp, Homo sapiens
acacacacacgca

SEQ ID NO: 550644 - DNA, 14 bp, Homo sapiens
acacacacacgcac

SEQ ID NO: 550645 - DNA, 15 bp, Homo sapiens
acacacacacgcaga

SEQ ID NO: 550646 - DNA, 13 bp, Homo sapiens
acacacacagaca

SEQ ID NO: 550647 - DNA, 14 bp, Homo sapiens
acacacacagatgt

SEQ ID NO: 550648 - DNA, 13 bp, Homo sapiens
acacacacatata

SEQ ID NO: 550649 - DNA, 19 bp, Homo sapiens
acacacacgcacgcacaca

SEQ ID NO: 550650 - DNA, 21 bp, Homo sapiens
acacacacgcacgcacacaca

SEQ ID NO: 550651 - DNA, 15 bp, Homo sapiens
accctgtcaaacatt

SEQ ID NO: 550652 - DNA, 18 bp, Homo sapiens
accctgtcaaacattagt

SEQ ID NO: 550653 - DNA, 17 bp, Homo sapiens
accctgttttgagccct

SEQ ID NO: 550654 - DNA, 18 bp, Homo sapiens
accctgttttgagccctg

SEQ ID NO: 550655 - DNA, 11 bp, Homo sapiens
accgacaagca

SEQ ID NO: 550656 - DNA, 19 bp, Homo sapiens
accgaccaactccagactt

SEQ ID NO: 550657 - DNA, 22 bp, Homo sapiens
accgactagacacacaaagcag

SEQ ID NO: 550658 - DNA, 17 bp, Homo sapiens
accgagtgtggagctgc

SEQ ID NO: 550659 - DNA, 23 bp, Homo sapiens
accgggagcctgcgtggcctggg

SEQ ID NO: 550660 - DNA, 15 bp, Homo sapiens
accgtgtttgtctct

SEQ ID NO: 550661 - DNA, 18 bp, Homo sapiens
accgtgtttgtctcttct

SEQ ID NO: 550662 - DNA, 17 bp, Homo sapiens
accgtttagtcatatct

SEQ ID NO: 550663 - DNA, 14 bp, Homo sapiens
acctaaaagtatta

SEQ ID NO: 550664 - DNA, 14 bp, Homo sapiens
acctaaccagggcc

SEQ ID NO: 550665 - DNA, 13 bp, Homo sapiens
acctacagaatac

SEQ ID NO: 550666 - DNA, 12 bp, Homo sapiens
acctagaaaaca

SEQ ID NO: 550667 - DNA, 22 bp, Homo sapiens
acctataatgtgtgtatgtgta

SEQ ID NO: 550668 - DNA, 23 bp, Homo sapiens
acctattcaagaagatagttgta

SEQ ID NO: 550669 - DNA, 16 bp, Homo sapiens
acctccaactggatgt

SEQ ID NO: 550670 - DNA, 14 bp, Homo sapiens
acctccccaggccg

SEQ ID NO: 550671 - DNA, 14 bp, Homo sapiens
acctccccctcctt

SEQ ID NO: 550672 - DNA, 16 bp, Homo sapiens
acctccccctccttcc

SEQ ID NO: 550673 - DNA, 22 bp, Homo sapiens
acctccccctccttcccagctg

SEQ ID NO: 550674 - DNA, 18 bp, Homo sapiens
acctcccctggtcctgca

SEQ ID NO: 550675 - DNA, 13 bp, Homo sapiens
acctcctctcctg

SEQ ID NO: 550676 - DNA, 19 bp, Homo sapiens
acctcctttaccctcatct

SEQ ID NO: 550677 - DNA, 15 bp, Homo sapiens
acctctagccctgcc

SEQ ID NO: 550678 - DNA, 16 bp, Homo sapiens
acctgaacaaaccctt

SEQ ID NO: 550679 - DNA, 18 bp, Homo sapiens
acctgacagcaaacacag

SEQ ID NO: 550680 - DNA, 19 bp, Homo sapiens
acctgacagcaaacacagt

SEQ ID NO: 550681 - DNA, 15 bp, Homo sapiens
acctgcagctccctc

SEQ ID NO: 550682 - DNA, 16 bp, Homo sapiens
acctgcccggcccagg

SEQ ID NO: 550683 - DNA, 19 bp, Homo sapiens
acctgcccggcccaggagc

SEQ ID NO: 550684 - DNA, 22 bp, Homo sapiens
acctgcctctgaactgctgctg

SEQ ID NO: 550685 - DNA, 13 bp, Homo sapiens
acctgctctgctg

SEQ ID NO: 550686 - DNA, 14 bp, Homo sapiens
acctgctctgctga

SEQ ID NO: 550687 - DNA, 16 bp, Homo sapiens
acctgcttccccaaag

SEQ ID NO: 550688 - DNA, 22 bp, Homo sapiens
acctgcttctcagcgcaacagc

SEQ ID NO: 550689 - DNA, 15 bp, Homo sapiens
acctggaaatgaatg

SEQ ID NO: 550690 - DNA, 18 bp, Homo sapiens
acctggaagccctctctg

SEQ ID NO: 550691 - DNA, 12 bp, Homo sapiens
acctggccctgg

SEQ ID NO: 550692 - DNA, 13 bp, Homo sapiens
acctggccctggg

SEQ ID NO: 550693 - DNA, 19 bp, Homo sapiens
acctggccctggggcctgt

SEQ ID NO: 550694 - DNA, 18 bp, Homo sapiens
acctgggagatgctggga

SEQ ID NO: 550695 - DNA, 22 bp, Homo sapiens
acctgggccctggttcccccag

SEQ ID NO: 550696 - DNA, 20 bp, Homo sapiens
acctgtaatagcctcacctt

SEQ ID NO: 550697 - DNA, 13 bp, Homo sapiens
acctgtacacaca

SEQ ID NO: 550698 - DNA, 15 bp, Homo sapiens
acctgtacacacaca

SEQ ID NO: 550699 - DNA, 16 bp, Homo sapiens
acctgtacacacacag

SEQ ID NO: 550700 - DNA, 23 bp, Homo sapiens
acctgtacacacacagacacaca

SEQ ID NO: 550701 - DNA, 14 bp, Homo sapiens
acctgtactggaga

SEQ ID NO: 550702 - DNA, 16 bp, Homo sapiens
acctgtaggtctatga

SEQ ID NO: 550703 - DNA, 13 bp, Homo sapiens
acctgtctgctcc

SEQ ID NO: 550704 - DNA, 14 bp, Homo sapiens
acctgtctgctcca

SEQ ID NO: 550705 - DNA, 21 bp, Homo sapiens
acctgtgagctgcaccaggta

SEQ ID NO: 550706 - DNA, 23 bp, Homo sapiens
acctgtgagctgcaccaggtaga

SEQ ID NO: 550707 - DNA, 16 bp, Homo sapiens
acctgttgtctgaaac

SEQ ID NO: 550708 - DNA, 14 bp, Homo sapiens
accttaaaatttga

SEQ ID NO: 550709 - DNA, 21 bp, Homo sapiens
accttaaaatttgaaacattg

SEQ ID NO: 550710 - DNA, 20 bp, Homo sapiens
accttaaattagtacagcac

SEQ ID NO: 550711 - DNA, 15 bp, Homo sapiens
accttcatccagatt

SEQ ID NO: 550712 - DNA, 17 bp, Homo sapiens
accttccctagttcttt

SEQ ID NO: 550713 - DNA, 22 bp, Homo sapiens
accttcccttctacaaggactc

SEQ ID NO: 550714 - DNA, 18 bp, Homo sapiens
accttctgtcgtccccag

SEQ ID NO: 550715 - DNA, 20 bp, Homo sapiens
accttctgtcgtccccagac

SEQ ID NO: 550716 - DNA, 21 bp, Homo sapiens
accttctgtcgtccccagacc

SEQ ID NO: 550717 - DNA, 22 bp, Homo sapiens
accttctgtcgtccccagacca

SEQ ID NO: 550718 - DNA, 14 bp, Homo sapiens
accttgcacacatc

SEQ ID NO: 550719 - DNA, 13 bp, Homo sapiens
accttgcatttca

SEQ ID NO: 550720 - DNA, 22 bp, Homo sapiens
acctttaatcaggtcctgctca

SEQ ID NO: 550721 - DNA, 13 bp, Homo sapiens
acctttataggat

SEQ ID NO: 550722 - DNA, 15 bp, Homo sapiens
acctttggaattgtg

SEQ ID NO: 550723 - DNA, 16 bp, Homo sapiens
acctttggaattgtgc

SEQ ID NO: 550724 - DNA, 18 bp, Homo sapiens
acctttggcttaattcca

SEQ ID NO: 550725 - DNA, 18 bp, Homo sapiens
acctttgggttctttctg

SEQ ID NO: 550726 - DNA, 13 bp, Homo sapiens
acgagccttttca

SEQ ID NO: 550727 - DNA, 15 bp, Homo sapiens
acgcaattgtatata

SEQ ID NO: 550728 - DNA, 13 bp, Homo sapiens
acgcacacacaca

SEQ ID NO: 550729 - DNA, 21 bp, Homo sapiens
acgcacacacacgcaaataca

SEQ ID NO: 550730 - DNA, 17 bp, Homo sapiens
acgcacgcacccacacc

SEQ ID NO: 550731 - DNA, 15 bp, Homo sapiens
acgcagacacacaca

SEQ ID NO: 550732 - DNA, 15 bp, Homo sapiens
acgcagggagaccct

SEQ ID NO: 550733 - DNA, 17 bp, Homo sapiens
acgcagggagaccctgg

SEQ ID NO: 550734 - DNA, 12 bp, Homo sapiens
acgccacatccc

SEQ ID NO: 550735 - DNA, 17 bp, Homo sapiens
acgccagggaccccaga

SEQ ID NO: 550736 - DNA, 16 bp, Homo sapiens
acgcctgcttttgcaa

SEQ ID NO: 550737 - DNA, 18 bp, Homo sapiens
acggaagccccctcttcc

SEQ ID NO: 550738 - DNA, 20 bp, Homo sapiens
acggagcggattgcaaagca

SEQ ID NO: 550739 - DNA, 19 bp, Homo sapiens
acggggacacggcctctgg

SEQ ID NO: 550740 - DNA, 17 bp, Homo sapiens
acggggccagcatccat

SEQ ID NO: 550741 - DNA, 15 bp, Homo sapiens
acgtatatataaaca

SEQ ID NO: 550742 - DNA, 14 bp, Homo sapiens
acgtattttaaaag

SEQ ID NO: 550743 - DNA, 19 bp, Homo sapiens
acgtctttttaagcctttg

SEQ ID NO: 550744 - DNA, 17 bp, Homo sapiens
acgtgaagataccataa

SEQ ID NO: 550745 - DNA, 21 bp, Homo sapiens
acgtgatgtgctcatcagaaa

SEQ ID NO: 550746 - DNA, 20 bp, Homo sapiens
acgtgggcggcagagaggac

SEQ ID NO: 550747 - DNA, 14 bp, Homo sapiens
acgtggggcagcac

SEQ ID NO: 550748 - DNA, 22 bp, Homo sapiens
acgtgggtcttcagggggccag

SEQ ID NO: 550749 - DNA, 13 bp, Homo sapiens
acgtgtatatgag

SEQ ID NO: 550750 - DNA, 12 bp, Homo sapiens
acgtgtgaggat

SEQ ID NO: 550751 - DNA, 16 bp, Homo sapiens
acgttgggacagggag

SEQ ID NO: 550752 - DNA, 17 bp, Homo sapiens
acgtttcttctttctag

SEQ ID NO: 550753 - DNA, 17 bp, Homo sapiens
actaaaaatacaaacaa

SEQ ID NO: 550754 - DNA, 14 bp, Homo sapiens
actaaaatatgtct

SEQ ID NO: 550755 - DNA, 11 bp, Homo sapiens
actaaacattt

SEQ ID NO: 550756 - DNA, 13 bp, Homo sapiens
actaaacatttcc

SEQ ID NO: 550757 - DNA, 16 bp, Homo sapiens
actaaacatttccttt

SEQ ID NO: 550758 - DNA, 13 bp, Homo sapiens
actaaatgttaaa

SEQ ID NO: 550759 - DNA, 14 bp, Homo sapiens
actaaatgttaaag

SEQ ID NO: 550760 - DNA, 13 bp, Homo sapiens
actaacttctaaa

SEQ ID NO: 550761 - DNA, 17 bp, Homo sapiens
actaacttctaaaactg

SEQ ID NO: 550762 - DNA, 22 bp, Homo sapiens
actaacttctaaaactgtactt

SEQ ID NO: 550763 - DNA, 21 bp, Homo sapiens
actaagatcggttaacaaata

SEQ ID NO: 550764 - DNA, 15 bp, Homo sapiens
actaaggagaaatga

SEQ ID NO: 550765 - DNA, 15 bp, Homo sapiens
actaagtctcttttt

SEQ ID NO: 550766 - DNA, 17 bp, Homo sapiens
actaatgacaagtgact

SEQ ID NO: 550767 - DNA, 15 bp, Homo sapiens
actacaaaaccgttt

SEQ ID NO: 550768 - DNA, 14 bp, Homo sapiens
actacatctgatat

SEQ ID NO: 550769 - DNA, 16 bp, Homo sapiens
actacctcctctcctg

SEQ ID NO: 550770 - DNA, 19 bp, Homo sapiens
actacctttggcttaattc

SEQ ID NO: 550771 - DNA, 14 bp, Homo sapiens
actactgaataaat

SEQ ID NO: 550772 - DNA, 14 bp, Homo sapiens
actacttagcactt

SEQ ID NO: 550773 - DNA, 13 bp, Homo sapiens
actagacacacaa

SEQ ID NO: 550774 - DNA, 22 bp, Homo sapiens
actagacattattttgtatgga

SEQ ID NO: 550775 - DNA, 14 bp, Homo sapiens
actagataaaatgt

SEQ ID NO: 550776 - DNA, 16 bp, Homo sapiens
actaggttcaattccc

SEQ ID NO: 550777 - DNA, 17 bp, Homo sapiens
actatatacatgtgtgt

SEQ ID NO: 550778 - DNA, 21 bp, Homo sapiens
actatatacatgtgtgtatat

SEQ ID NO: 550779 - DNA, 15 bp, Homo sapiens
actatatgtttacac

SEQ ID NO: 550780 - DNA, 16 bp, Homo sapiens
actatcagcagcggca

SEQ ID NO: 550781 - DNA, 18 bp, Homo sapiens
actatggaagccacatca

SEQ ID NO: 550782 - DNA, 19 bp, Homo sapiens
actatggaagccacatcac

SEQ ID NO: 550783 - DNA, 18 bp, Homo sapiens
actatggtatatattttg

SEQ ID NO: 550784 - DNA, 15 bp, Homo sapiens
actattgggtgaata

SEQ ID NO: 550785 - DNA, 19 bp, Homo sapiens
actcaatgtgtgccgagcc

SEQ ID NO: 550786 - DNA, 16 bp, Homo sapiens
actcagaagtccagag

SEQ ID NO: 550787 - DNA, 19 bp, Homo sapiens
actcagagcagtctgtgac

SEQ ID NO: 550788 - DNA, 12 bp, Homo sapiens
actcaggcccac

SEQ ID NO: 550789 - DNA, 14 bp, Homo sapiens
actcaggcccacat

SEQ ID NO: 550790 - DNA, 15 bp, Homo sapiens
agcacagtatttaac

SEQ ID NO: 550791 - DNA, 17 bp, Homo sapiens
agcacagtatttaacat

SEQ ID NO: 550792 - DNA, 16 bp, Homo sapiens
agcacatgcttagctt

SEQ ID NO: 550793 - DNA, 22 bp, Homo sapiens
agcacatgcttagcttatcttt

SEQ ID NO: 550794 - DNA, 15 bp, Homo sapiens
agcaccaccctcctt

SEQ ID NO: 550795 - DNA, 18 bp, Homo sapiens
agcaccaccctccttccc

SEQ ID NO: 550796 - DNA, 23 bp, Homo sapiens
agcactaggttcaattccctgaa

SEQ ID NO: 550797 - DNA, 20 bp, Homo sapiens
agcactcctccctgatgtac

SEQ ID NO: 550798 - DNA, 16 bp, Homo sapiens
agcactggatggagct

SEQ ID NO: 550799 - DNA, 19 bp, Homo sapiens
agcacttcagggcagattt

SEQ ID NO: 550800 - DNA, 18 bp, Homo sapiens
agcacttccttgccagtc

SEQ ID NO: 550801 - DNA, 20 bp, Homo sapiens
agcacttccttgccagtctt

SEQ ID NO: 550802 - DNA, 20 bp, Homo sapiens
agcagaaaaacaggcacagg

SEQ ID NO: 550803 - DNA, 15 bp, Homo sapiens
agcagacacacacat

SEQ ID NO: 550804 - DNA, 22 bp, Homo sapiens
agcagacacacacatatataca

SEQ ID NO: 550805 - DNA, 12 bp, Homo sapiens
agcagagtttac

SEQ ID NO: 550806 - DNA, 17 bp, Homo sapiens
agcagatccacctgcac

SEQ ID NO: 550807 - DNA, 17 bp, Homo sapiens
agcagatgacccctccc

SEQ ID NO: 550808 - DNA, 16 bp, Homo sapiens
agcagcaaaaatataa

SEQ ID NO: 550809 - DNA, 18 bp, Homo sapiens
agcagcaaggtcttgctc

SEQ ID NO: 550810 - DNA, 20 bp, Homo sapiens
agcagcagtttgtgatctgt

SEQ ID NO: 550811 - DNA, 21 bp, Homo sapiens
agcagctagaaagagaaaaag

SEQ ID NO: 550812 - DNA, 10 bp, Homo sapiens
agcaggaggc

SEQ ID NO: 550813 - DNA, 16 bp, Homo sapiens
agcaggttaaatgttt

SEQ ID NO: 550814 - DNA, 15 bp, Homo sapiens
agcagtccctgagac

SEQ ID NO: 550815 - DNA, 20 bp, Homo sapiens
agcagtcttatgcttccaga

SEQ ID NO: 550816 - DNA, 22 bp, Homo sapiens
agcagtcttatgcttccagaaa

SEQ ID NO: 550817 - DNA, 21 bp, Homo sapiens
agcagtgatattctttgttaa

SEQ ID NO: 550818 - DNA, 12 bp, Homo sapiens
agcagtggcaaa

SEQ ID NO: 550819 - DNA, 20 bp, Homo sapiens
agcagttggccaagcagaaa

SEQ ID NO: 550820 - DNA, 12 bp, Homo sapiens
agcagtttcaat

SEQ ID NO: 550821 - DNA, 20 bp, Homo sapiens
agcagtttcaataaagtttg

SEQ ID NO: 550822 - DNA, 19 bp, Homo sapiens
agcatataaaatggcaaca

SEQ ID NO: 550823 - DNA, 17 bp, Homo sapiens
agcatatatataaaata

SEQ ID NO: 550824 - DNA, 19 bp, Homo sapiens
agcatatatataaaataca

SEQ ID NO: 550825 - DNA, 22 bp, Homo sapiens
agcatatatataaaatacacgt

SEQ ID NO: 550826 - DNA, 22 bp, Homo sapiens
agcatctaaactttaatatgta

SEQ ID NO: 550827 - DNA, 16 bp, Homo sapiens
agcatgaacagtgcac

SEQ ID NO: 550828 - DNA, 21 bp, Homo sapiens
agcatgctccctcatgcagat

SEQ ID NO: 550829 - DNA, 22 bp, Homo sapiens
agcatggctcattctgcaatga

SEQ ID NO: 550830 - DNA, 20 bp, Homo sapiens
agcattggggatgtttttct

SEQ ID NO: 550831 - DNA, 23 bp, Homo sapiens
agcatttccaacaccacagacac

SEQ ID NO: 550832 - DNA, 21 bp, Homo sapiens
agccacatagagtgactccaa

SEQ ID NO: 550833 - DNA, 14 bp, Homo sapiens
agccaccagatgtg

SEQ ID NO: 550834 - DNA, 18 bp, Homo sapiens
agccagaactctgtgtcc

SEQ ID NO: 550835 - DNA, 23 bp, Homo sapiens
agccagctccctgaatctgacca

SEQ ID NO: 550836 - DNA, 11 bp, Homo sapiens
agccaggaggg

SEQ ID NO: 550837 - DNA, 17 bp, Homo sapiens
agccaggggtggggatg

SEQ ID NO: 550838 - DNA, 15 bp, Homo sapiens
agccagtcttaacat

SEQ ID NO: 550839 - DNA, 20 bp, Homo sapiens
agccattctggcactttaat

SEQ ID NO: 550840 - DNA, 23 bp, Homo sapiens
agccattctggcactttaatgat

SEQ ID NO: 550841 - DNA, 14 bp, Homo sapiens
agcccactgcctgg

SEQ ID NO: 550842 - DNA, 12 bp, Homo sapiens
agcccaggaggg

SEQ ID NO: 550843 - DNA, 21 bp, Homo sapiens
agcccatgtggagtcagcctc

SEQ ID NO: 550844 - DNA, 21 bp, Homo sapiens
agccccagcgagtctggagac

SEQ ID NO: 550845 - DNA, 16 bp, Homo sapiens
agccccctcttcctcc

SEQ ID NO: 550846 - DNA, 16 bp, Homo sapiens
agccccctggcccctc

SEQ ID NO: 550847 - DNA, 15 bp, Homo sapiens
agcccctccctcctc

SEQ ID NO: 550848 - DNA, 18 bp, Homo sapiens
agcccctccctcctctga

SEQ ID NO: 550849 - DNA, 21 bp, Homo sapiens
agcccctctccccgcagtgtt

SEQ ID NO: 550850 - DNA, 15 bp, Homo sapiens
agccctgcagagcac

SEQ ID NO: 550851 - DNA, 12 bp, Homo sapiens
agccctgctccc

SEQ ID NO: 550852 - DNA, 14 bp, Homo sapiens
agccctgctccctc

SEQ ID NO: 550853 - DNA, 22 bp, Homo sapiens
agccctggggtttccacacagg

SEQ ID NO: 550854 - DNA, 22 bp, Homo sapiens
agccctgtatcgtattcacctt

SEQ ID NO: 550855 - DNA, 18 bp, Homo sapiens
agccgagctctcctgggc

SEQ ID NO: 550856 - DNA, 22 bp, Homo sapiens
agccgcggtgcccaaccacact

SEQ ID NO: 550857 - DNA, 19 bp, Homo sapiens
agccggcgtggcaaatata

SEQ ID NO: 550858 - DNA, 16 bp, Homo sapiens
agccgtaaaaactgaa

SEQ ID NO: 550859 - DNA, 22 bp, Homo sapiens
agcctaccggcaatttccggcc

SEQ ID NO: 550860 - DNA, 15 bp, Homo sapiens
agcctatctctcttc

SEQ ID NO: 550861 - DNA, 16 bp, Homo sapiens
agcctcacccctgcag

SEQ ID NO: 550862 - DNA, 18 bp, Homo sapiens
agcctcacccctgcaggc

SEQ ID NO: 550863 - DNA, 17 bp, Homo sapiens
agcctcactgatatatt

SEQ ID NO: 550864 - DNA, 13 bp, Homo sapiens
agcctcctgctga

SEQ ID NO: 550865 - DNA, 14 bp, Homo sapiens
agcctcttctgcca

SEQ ID NO: 550866 - DNA, 22 bp, Homo sapiens
agcctcttgaatgcttaaatga

SEQ ID NO: 550867 - DNA, 13 bp, Homo sapiens
agcctctttccct

SEQ ID NO: 550868 - DNA, 21 bp, Homo sapiens
agcctctttcccttccagttt

SEQ ID NO: 550869 - DNA, 14 bp, Homo sapiens
agcctgacagccag

SEQ ID NO: 550870 - DNA, 14 bp, Homo sapiens
agcctgccccagcg

SEQ ID NO: 550871 - DNA, 17 bp, Homo sapiens
agcctgcgtggcctggg

SEQ ID NO: 550872 - DNA, 15 bp, Homo sapiens
agcctgcgtggctga

SEQ ID NO: 550873 - DNA, 16 bp, Homo sapiens
agcctgcgtggctgac

SEQ ID NO: 550874 - DNA, 15 bp, Homo sapiens
agcctgctccttccc

SEQ ID NO: 550875 - DNA, 17 bp, Homo sapiens
agccttaagtcttactg

SEQ ID NO: 550876 - DNA, 22 bp, Homo sapiens
agccttaagtcttactgttttg

SEQ ID NO: 550877 - DNA, 17 bp, Homo sapiens
agccttgatttgttctt

SEQ ID NO: 550878 - DNA, 20 bp, Homo sapiens
agccttgatttgttcttaca

SEQ ID NO: 550879 - DNA, 12 bp, Homo sapiens
agcctttgaagt

SEQ ID NO: 550880 - DNA, 13 bp, Homo sapiens
agcgacagagcag

SEQ ID NO: 550881 - DNA, 16 bp, Homo sapiens
agcgagtctggagacc

SEQ ID NO: 550882 - DNA, 14 bp, Homo sapiens
agcgcagctgcatt

SEQ ID NO: 550883 - DNA, 11 bp, Homo sapiens
agcgctccctt

SEQ ID NO: 550884 - DNA, 19 bp, Homo sapiens
agcggctcaagcccaggag

SEQ ID NO: 550885 - DNA, 21 bp, Homo sapiens
agcggtaccaatgcagaactc

SEQ ID NO: 550886 - DNA, 15 bp, Homo sapiens
agcgtagtgcagcag

SEQ ID NO: 550887 - DNA, 14 bp, Homo sapiens
agcgttgttttgtg

SEQ ID NO: 550888 - DNA, 15 bp, Homo sapiens
agctaaaacacttct

SEQ ID NO: 550889 - DNA, 21 bp, Homo sapiens
agctaaaataaaccagactca

SEQ ID NO: 550890 - DNA, 19 bp, Homo sapiens
agctacccaaaagagaaaa

SEQ ID NO: 550891 - DNA, 18 bp, Homo sapiens
agctactccggaggctga

SEQ ID NO: 550892 - DNA, 17 bp, Homo sapiens
agctacttaagagaaat

SEQ ID NO: 550893 - DNA, 19 bp, Homo sapiens
agctacttaagagaaatgg

SEQ ID NO: 550894 - DNA, 13 bp, Homo sapiens
agctagaaagaga

SEQ ID NO: 550895 - DNA, 21 bp, Homo sapiens
agctagaaagagaaaaagccc

SEQ ID NO: 550896 - DNA, 16 bp, Homo sapiens
agctaggaacaaatct

SEQ ID NO: 550897 - DNA, 21 bp, Homo sapiens
agctaggaacaaatcttcctg

SEQ ID NO: 550898 - DNA, 23 bp, Homo sapiens
agctaggaacaaatcttcctggt

SEQ ID NO: 550899 - DNA, 19 bp, Homo sapiens
agctataaaagcccatgct

SEQ ID NO: 550900 - DNA, 22 bp, Homo sapiens
agctataaaagcccatgcttaa

SEQ ID NO: 550901 - DNA, 18 bp, Homo sapiens
agctatatttaagtattc

SEQ ID NO: 550902 - DNA, 15 bp, Homo sapiens
agctatggacaattt

SEQ ID NO: 550903 - DNA, 20 bp, Homo sapiens
agctatggacagcattgcca

SEQ ID NO: 550904 - DNA, 14 bp, Homo sapiens
agctcaaggctgca

SEQ ID NO: 550905 - DNA, 20 bp, Homo sapiens
agctcaattgttaatgtgat

SEQ ID NO: 550906 - DNA, 14 bp, Homo sapiens
agctcagcacagcc

SEQ ID NO: 550907 - DNA, 17 bp, Homo sapiens
agctcagcacagcctca

SEQ ID NO: 550908 - DNA, 20 bp, Homo sapiens
agctcaggaagaagagatgc

SEQ ID NO: 550909 - DNA, 21 bp, Homo sapiens
agctcaggaagaagagatgca

SEQ ID NO: 550910 - DNA, 21 bp, Homo sapiens
agctcccaggacgcagggaga

SEQ ID NO: 550911 - DNA, 14 bp, Homo sapiens
agctccccccacct

SEQ ID NO: 550912 - DNA, 15 bp, Homo sapiens
agctccccccacctc

SEQ ID NO: 550913 - DNA, 18 bp, Homo sapiens
agctcccgctccgggctc

SEQ ID NO: 550914 - DNA, 18 bp, Homo sapiens
agctccttttccagagca

SEQ ID NO: 550915 - DNA, 19 bp, Homo sapiens
agctcgtagaaacaagaca

SEQ ID NO: 550916 - DNA, 22 bp, Homo sapiens
agctctcccctcccttgtcctt

SEQ ID NO: 550917 - DNA, 20 bp, Homo sapiens
agctctcccctgcgcaggcc

SEQ ID NO: 550918 - DNA, 14 bp, Homo sapiens
agctctcctgggcc

SEQ ID NO: 550919 - DNA, 19 bp, Homo sapiens
agctctgagatcctggagt

SEQ ID NO: 550920 - DNA, 16 bp, Homo sapiens
agctcttcctccccag

SEQ ID NO: 550921 - DNA, 17 bp, Homo sapiens
agctcttcctccccagg

SEQ ID NO: 550922 - DNA, 22 bp, Homo sapiens
agctcttcctggacaggccagg

SEQ ID NO: 550923 - DNA, 13 bp, Homo sapiens
agctgaagagctg

SEQ ID NO: 550924 - DNA, 14 bp, Homo sapiens
agctgagctggcct

SEQ ID NO: 550925 - DNA, 15 bp, Homo sapiens
agctgagtgagctga

SEQ ID NO: 550926 - DNA, 14 bp, Homo sapiens
agtgagagcagatg

SEQ ID NO: 550927 - DNA, 17 bp, Homo sapiens
agtgaggtcctgggggc

SEQ ID NO: 550928 - DNA, 17 bp, Homo sapiens
agtgatattctttgtta

SEQ ID NO: 550929 - DNA, 14 bp, Homo sapiens
agtgatgtttttat

SEQ ID NO: 550930 - DNA, 17 bp, Homo sapiens
agtgatttgtaaaacag

SEQ ID NO: 550931 - DNA, 16 bp, Homo sapiens
agtgcacacagaaata

SEQ ID NO: 550932 - DNA, 19 bp, Homo sapiens
agtgcacacagaaatatat

SEQ ID NO: 550933 - DNA, 22 bp, Homo sapiens
agtgcattcattcatcctctta

SEQ ID NO: 550934 - DNA, 18 bp, Homo sapiens
agtgccaaaataaagtct

SEQ ID NO: 550935 - DNA, 14 bp, Homo sapiens
agtgcccatgtgta

SEQ ID NO: 550936 - DNA, 15 bp, Homo sapiens
agtgcccatgtgtat

SEQ ID NO: 550937 - DNA, 23 bp, Homo sapiens
agtgccccgtctacagctccccc

SEQ ID NO: 550938 - DNA, 17 bp, Homo sapiens
agtgcgtggcccaccag

SEQ ID NO: 550939 - DNA, 16 bp, Homo sapiens
agtgctaagagcctct

SEQ ID NO: 550940 - DNA, 18 bp, Homo sapiens
agtgctaagagcctctgg

SEQ ID NO: 550941 - DNA, 17 bp, Homo sapiens
agtgctatatatataaa

SEQ ID NO: 550942 - DNA, 23 bp, Homo sapiens
agtgctatatatataaatatttg

SEQ ID NO: 550943 - DNA, 21 bp, Homo sapiens
agtgctcacacaatcagacca

SEQ ID NO: 550944 - DNA, 21 bp, Homo sapiens
agtgcttgaggccaaatgagt

SEQ ID NO: 550945 - DNA, 16 bp, Homo sapiens
agtggaccctgaaatg

SEQ ID NO: 550946 - DNA, 19 bp, Homo sapiens
agtggaccctgaaatgtgt

SEQ ID NO: 550947 - DNA, 21 bp, Homo sapiens
agtggaccctgaaatgtgtgt

SEQ ID NO: 550948 - DNA, 13 bp, Homo sapiens
agtggactgtatt

SEQ ID NO: 550949 - DNA, 15 bp, Homo sapiens
agtggactgtatttc

SEQ ID NO: 550950 - DNA, 18 bp, Homo sapiens
agtggatcactcaccatt

SEQ ID NO: 550951 - DNA, 20 bp, Homo sapiens
agtggatccagcttcactgt

SEQ ID NO: 550952 - DNA, 14 bp, Homo sapiens
agtggatggaatat

SEQ ID NO: 550953 - DNA, 21 bp, Homo sapiens
agtggcacctgtctgctccag

SEQ ID NO: 550954 - DNA, 13 bp, Homo sapiens
agtggcagtattg

SEQ ID NO: 550955 - DNA, 15 bp, Homo sapiens
agtggcttcagcccc

SEQ ID NO: 550956 - DNA, 16 bp, Homo sapiens
agtggcttcagcccct

SEQ ID NO: 550957 - DNA, 20 bp, Homo sapiens
agtgggtgggacacagagac

SEQ ID NO: 550958 - DNA, 22 bp, Homo sapiens
agtggtccacattctgctgccc

SEQ ID NO: 550959 - DNA, 12 bp, Homo sapiens
agtgtaccatta

SEQ ID NO: 550960 - DNA, 16 bp, Homo sapiens
agtgtactggatttaa

SEQ ID NO: 550961 - DNA, 13 bp, Homo sapiens
agtgtatatgtga

SEQ ID NO: 550962 - DNA, 23 bp, Homo sapiens
agtgtatatgtgattttcaaata

SEQ ID NO: 550963 - DNA, 15 bp, Homo sapiens
agtgtccccaggggc

SEQ ID NO: 550964 - DNA, 16 bp, Homo sapiens
agtgtccccaggggca

SEQ ID NO: 550965 - DNA, 19 bp, Homo sapiens
agtgtccccaggggcacac

SEQ ID NO: 550966 - DNA, 23 bp, Homo sapiens
agtgtccccaggggcacacttcc

SEQ ID NO: 550967 - DNA, 13 bp, Homo sapiens
agtgtctgtaaat

SEQ ID NO: 550968 - DNA, 20 bp, Homo sapiens
agtgtgaattgcaaaaccca

SEQ ID NO: 550969 - DNA, 17 bp, Homo sapiens
agtgttataaaatctgt

SEQ ID NO: 550970 - DNA, 23 bp, Homo sapiens
agtgttataaaatctgtattgct

SEQ ID NO: 550971 - DNA, 15 bp, Homo sapiens
agtgttcagaaaaaa

SEQ ID NO: 550972 - DNA, 18 bp, Homo sapiens
agtgttcccttctggctg

SEQ ID NO: 550973 - DNA, 18 bp, Homo sapiens
agtgttctgttacaaaat

SEQ ID NO: 550974 - DNA, 15 bp, Homo sapiens
agtgtttactttaaa

SEQ ID NO: 550975 - DNA, 17 bp, Homo sapiens
agtgtttactttaaatc

SEQ ID NO: 550976 - DNA, 20 bp, Homo sapiens
agtgtttcacagtgtctgta

SEQ ID NO: 550977 - DNA, 12 bp, Homo sapiens
agtgtttgctgc

SEQ ID NO: 550978 - DNA, 19 bp, Homo sapiens
agttaataacagctccttt

SEQ ID NO: 550979 - DNA, 23 bp, Homo sapiens
agttaatctttgaaaactcatac

SEQ ID NO: 550980 - DNA, 19 bp, Homo sapiens
agttacagtggcagtattg

SEQ ID NO: 550981 - DNA, 22 bp, Homo sapiens
agttacagtggcagtattgaca

SEQ ID NO: 550982 - DNA, 16 bp, Homo sapiens
agttactacctcctct

SEQ ID NO: 550983 - DNA, 21 bp, Homo sapiens
agttactacctcctctcctga

SEQ ID NO: 550984 - DNA, 22 bp, Homo sapiens
agttactttccaattctccttt

SEQ ID NO: 550985 - DNA, 23 bp, Homo sapiens
agttactttccaattctccttta

SEQ ID NO: 550986 - DNA, 14 bp, Homo sapiens
agttacttttcctt

SEQ ID NO: 550987 - DNA, 18 bp, Homo sapiens
agttacttttccttgcat

SEQ ID NO: 550988 - DNA, 21 bp, Homo sapiens
agttatccagagggttgtgat

SEQ ID NO: 550989 - DNA, 16 bp, Homo sapiens
agttatcctttgtgag

SEQ ID NO: 550990 - DNA, 14 bp, Homo sapiens
agttatgttaaaat

SEQ ID NO: 550991 - DNA, 20 bp, Homo sapiens
agttcaaagtcatgatgttt

SEQ ID NO: 550992 - DNA, 18 bp, Homo sapiens
agttcaagaccagcctgg

SEQ ID NO: 550993 - DNA, 18 bp, Homo sapiens
agttcatcccagccccaa

SEQ ID NO: 550994 - DNA, 15 bp, Homo sapiens
agttcatcccttctc

SEQ ID NO: 550995 - DNA, 16 bp, Homo sapiens
agttcattcatattac

SEQ ID NO: 550996 - DNA, 19 bp, Homo sapiens
agttcccatttccttgtct

SEQ ID NO: 550997 - DNA, 16 bp, Homo sapiens
agttccctcagccctc

SEQ ID NO: 550998 - DNA, 17 bp, Homo sapiens
agttccctcagccctca

SEQ ID NO: 550999 - DNA, 18 bp, Homo sapiens
agttcccttgattcaaat

SEQ ID NO: 551000 - DNA, 21 bp, Homo sapiens
agttctgcctctgatgtattt

SEQ ID NO: 551001 - DNA, 17 bp, Homo sapiens
agttgactctgctcttg

SEQ ID NO: 551002 - DNA, 19 bp, Homo sapiens
agttggaaacactaaatgt

SEQ ID NO: 551003 - DNA, 23 bp, Homo sapiens
agttggagttcattcatattaca

SEQ ID NO: 551004 - DNA, 19 bp, Homo sapiens
agttggcacatttcatgag

SEQ ID NO: 551005 - DNA, 23 bp, Homo sapiens
agttggttttgcatgtctgcatg

SEQ ID NO: 551006 - DNA, 18 bp, Homo sapiens
agttgtatgatctgtgcc

SEQ ID NO: 551007 - DNA, 18 bp, Homo sapiens
agttgtgatctgttgtaa

SEQ ID NO: 551008 - DNA, 21 bp, Homo sapiens
agtttaaaaatcagaaagaca

SEQ ID NO: 551009 - DNA, 17 bp, Homo sapiens
agtttagagaaatacat

SEQ ID NO: 551010 - DNA, 21 bp, Homo sapiens
agtttagatttcaagaaaaaa

SEQ ID NO: 551011 - DNA, 12 bp, Homo sapiens
agtttatgtttt

SEQ ID NO: 551012 - DNA, 16 bp, Homo sapiens
agtttatgttttggtc

SEQ ID NO: 551013 - DNA, 21 bp, Homo sapiens
agtttattccagagctgccag

SEQ ID NO: 551014 - DNA, 16 bp, Homo sapiens
agtttcaataaagttt

SEQ ID NO: 551015 - DNA, 21 bp, Homo sapiens
agtttcaataaagtttgatct

SEQ ID NO: 551016 - DNA, 23 bp, Homo sapiens
agtttcaataaagtttgatcttc

SEQ ID NO: 551017 - DNA, 14 bp, Homo sapiens
agtttgatcttcct

SEQ ID NO: 551018 - DNA, 22 bp, Homo sapiens
agtttgatcttcctctgctaaa

SEQ ID NO: 551019 - DNA, 20 bp, Homo sapiens
agtttgccccgttctgtttg

SEQ ID NO: 551020 - DNA, 18 bp, Homo sapiens
agtttgtttctttgaatt

SEQ ID NO: 551021 - DNA, 20 bp, Homo sapiens
agttttattttctaaagtac

SEQ ID NO: 551022 - DNA, 21 bp, Homo sapiens
agttttattttctaaagtact

SEQ ID NO: 551023 - DNA, 20 bp, Homo sapiens
agttttgtgaaatttttcat

SEQ ID NO: 551024 - DNA, 21 bp, Homo sapiens
agttttgtgaaatttttcata

SEQ ID NO: 551025 - DNA, 20 bp, Homo sapiens
agtttttatacctgtacaca

SEQ ID NO: 551026 - DNA, 18 bp, Homo sapiens
ataaaaaaaatgaaatgt

SEQ ID NO: 551027 - DNA, 16 bp, Homo sapiens
ataaaaaaagaaaaaa

SEQ ID NO: 551028 - DNA, 14 bp, Homo sapiens
ataaaaaataataa

SEQ ID NO: 551029 - DNA, 13 bp, Homo sapiens
ataaaaataatta

SEQ ID NO: 551030 - DNA, 13 bp, Homo sapiens
ataaaacattatg

SEQ ID NO: 551031 - DNA, 22 bp, Homo sapiens
ataaaacattatgctccagaaa

SEQ ID NO: 551032 - DNA, 15 bp, Homo sapiens
ataaaaccagaaaga

SEQ ID NO: 551033 - DNA, 18 bp, Homo sapiens
ataaaagaaatgcacaat

SEQ ID NO: 551034 - DNA, 22 bp, Homo sapiens
ataaaagaaatgcacaatgtct

SEQ ID NO: 551035 - DNA, 17 bp, Homo sapiens
ataaaatcccattgtat

SEQ ID NO: 551036 - DNA, 20 bp, Homo sapiens
ataaaatcccattgtattta

SEQ ID NO: 551037 - DNA, 22 bp, Homo sapiens
ataaaattaaaatttaacatct

SEQ ID NO: 551038 - DNA, 13 bp, Homo sapiens
ataaaattagaaa

SEQ ID NO: 551039 - DNA, 16 bp, Homo sapiens
ataaaattagaaagca

SEQ ID NO: 551040 - DNA, 18 bp, Homo sapiens
ataaacacagattatttg

SEQ ID NO: 551041 - DNA, 13 bp, Homo sapiens
ataaaccaaagga

SEQ ID NO: 551042 - DNA, 16 bp, Homo sapiens
ataaaccaaaggacat

SEQ ID NO: 551043 - DNA, 22 bp, Homo sapiens
ataaagcttttgcatagaataa

SEQ ID NO: 551044 - DNA, 12 bp, Homo sapiens
ataaaggaggaa

SEQ ID NO: 551045 - DNA, 18 bp, Homo sapiens
ataaaggaggaatcagac

SEQ ID NO: 551046 - DNA, 22 bp, Homo sapiens
ataaagtatgaatatttcattt

SEQ ID NO: 551047 - DNA, 23 bp, Homo sapiens
ataaagtatgaatatttcatttt

SEQ ID NO: 551048 - DNA, 15 bp, Homo sapiens
ataaagtctgtcatg

SEQ ID NO: 551049 - DNA, 14 bp, Homo sapiens
ataaatggaaatca

SEQ ID NO: 551050 - DNA, 14 bp, Homo sapiens
ataaatgttaatat

SEQ ID NO: 551051 - DNA, 18 bp, Homo sapiens
ataaattttgtacatttt

SEQ ID NO: 551052 - DNA, 22 bp, Homo sapiens
ataaatttttaagtgtcagact

SEQ ID NO: 551053 - DNA, 12 bp, Homo sapiens
ataacaagaaaa

SEQ ID NO: 551054 - DNA, 13 bp, Homo sapiens
ataacagctcctt

SEQ ID NO: 551055 - DNA, 17 bp, Homo sapiens
ataacagctcctttatt

SEQ ID NO: 551056 - DNA, 17 bp, Homo sapiens
ataacattgtaaatgat

SEQ ID NO: 551057 - DNA, 13 bp, Homo sapiens
ataacattgtatg

SEQ ID NO: 551058 - DNA, 15 bp, Homo sapiens
ataacattgtatgtt

SEQ ID NO: 551059 - DNA, 18 bp, Homo sapiens
ataacattgtatgttaat

SEQ ID NO: 551060 - DNA, 24 bp, Homo sapiens
ataaccctgaatcagaggcagaga

SEQ ID NO: 551061 - DNA, 20 bp, Homo sapiens
ataacttacaagactgtaaa

SEQ ID NO: 551062 - DNA, 21 bp, Homo sapiens
atgcaatccttacaaatgatt

SEQ ID NO: 551063 - DNA, 16 bp, Homo sapiens
atgcaattcatcccag

SEQ ID NO: 551064 - DNA, 19 bp, Homo sapiens
atgcaatttacttggaatt

SEQ ID NO: 551065 - DNA, 13 bp, Homo sapiens
atgcacacacaca

SEQ ID NO: 551066 - DNA, 16 bp, Homo sapiens
atgcacacacacacac

SEQ ID NO: 551067 - DNA, 18 bp, Homo sapiens
atgcacccgcatgtacaa

SEQ ID NO: 551068 - DNA, 23 bp, Homo sapiens
atgcacccgcatgtacaaaaaca

SEQ ID NO: 551069 - DNA, 18 bp, Homo sapiens
atgcactatatgtttaca

SEQ ID NO: 551070 - DNA, 23 bp, Homo sapiens
atgcactatatgtttacacaatt

SEQ ID NO: 551071 - DNA, 17 bp, Homo sapiens
atgcactcttttgagca

SEQ ID NO: 551072 - DNA, 15 bp, Homo sapiens
atgcagctcttcctg

SEQ ID NO: 551073 - DNA, 16 bp, Homo sapiens
atgcagctcttcctgg

SEQ ID NO: 551074 - DNA, 22 bp, Homo sapiens
atgcaggtctgattcccagaaa

SEQ ID NO: 551075 - DNA, 19 bp, Homo sapiens
atgcataataatcctgcaa

SEQ ID NO: 551076 - DNA, 23 bp, Homo sapiens
atgcataataatcctgcaaagta

SEQ ID NO: 551077 - DNA, 15 bp, Homo sapiens
atgcatatatatgta

SEQ ID NO: 551078 - DNA, 21 bp, Homo sapiens
atgcatattaaagaaagtcat

SEQ ID NO: 551079 - DNA, 15 bp, Homo sapiens
atgcatgctttccat

SEQ ID NO: 551080 - DNA, 20 bp, Homo sapiens
atgcatgctttccatatttt

SEQ ID NO: 551081 - DNA, 20 bp, Homo sapiens
atgcatttaagttgtaaacg

SEQ ID NO: 551082 - DNA, 21 bp, Homo sapiens
atgccagaaggaatcttctca

SEQ ID NO: 551083 - DNA, 21 bp, Homo sapiens
atgccctccctgctgccaggc

SEQ ID NO: 551084 - DNA, 19 bp, Homo sapiens
atgcctgctctttggcctg

SEQ ID NO: 551085 - DNA, 21 bp, Homo sapiens
atgccttttgtagctgtcatg

SEQ ID NO: 551086 - DNA, 16 bp, Homo sapiens
atgcgatgtcatattt

SEQ ID NO: 551087 - DNA, 14 bp, Homo sapiens
atgcgcaaatacaa

SEQ ID NO: 551088 - DNA, 16 bp, Homo sapiens
atgctacaaaatgtgt

SEQ ID NO: 551089 - DNA, 18 bp, Homo sapiens
atgctacaaaatgtgtgc

SEQ ID NO: 551090 - DNA, 21 bp, Homo sapiens
atgctctttcccacccagcct

SEQ ID NO: 551091 - DNA, 22 bp, Homo sapiens
atgctctttcccacccagcctg

SEQ ID NO: 551092 - DNA, 23 bp, Homo sapiens
atgctctttcccacccagcctgg

SEQ ID NO: 551093 - DNA, 11 bp, Homo sapiens
atgctgcccct

SEQ ID NO: 551094 - DNA, 16 bp, Homo sapiens
atgctgcccctgcctt

SEQ ID NO: 551095 - DNA, 14 bp, Homo sapiens
atgctgctgagcac

SEQ ID NO: 551096 - DNA, 14 bp, Homo sapiens
atgctgttcattga

SEQ ID NO: 551097 - DNA, 18 bp, Homo sapiens
atgcttagcttatctttc

SEQ ID NO: 551098 - DNA, 22 bp, Homo sapiens
atgcttccagaaacacccacag

SEQ ID NO: 551099 - DNA, 16 bp, Homo sapiens
atgctttccatatttt

SEQ ID NO: 551100 - DNA, 22 bp, Homo sapiens
atgctttgtcttcagcctctcc

SEQ ID NO: 551101 - DNA, 12 bp, Homo sapiens
atggaaatccac

SEQ ID NO: 551102 - DNA, 15 bp, Homo sapiens
atggaagacaaatac

SEQ ID NO: 551103 - DNA, 16 bp, Homo sapiens
atggaagacaaataca

SEQ ID NO: 551104 - DNA, 21 bp, Homo sapiens
atggaattggtttaaactttt

SEQ ID NO: 551105 - DNA, 15 bp, Homo sapiens
atggagtagagtcag

SEQ ID NO: 551106 - DNA, 20 bp, Homo sapiens
atggagtccagacctgggcc

SEQ ID NO: 551107 - DNA, 18 bp, Homo sapiens
atggattcccctggacat

SEQ ID NO: 551108 - DNA, 16 bp, Homo sapiens
atggcaatgttttgct

SEQ ID NO: 551109 - DNA, 20 bp, Homo sapiens
atggcaatgttttgcttttg

SEQ ID NO: 551110 - DNA, 15 bp, Homo sapiens
atggcacagggcatg

SEQ ID NO: 551111 - DNA, 21 bp, Homo sapiens
atggcacagggcatgaaatga

SEQ ID NO: 551112 - DNA, 20 bp, Homo sapiens
atggcaccctgcaccaggcc

SEQ ID NO: 551113 - DNA, 16 bp, Homo sapiens
atggcatttagcacag

SEQ ID NO: 551114 - DNA, 14 bp, Homo sapiens
atggccctgtagct

SEQ ID NO: 551115 - DNA, 19 bp, Homo sapiens
atggccctgtagctctgaa

SEQ ID NO: 551116 - DNA, 13 bp, Homo sapiens
atggcgcacccgg

SEQ ID NO: 551117 - DNA, 14 bp, Homo sapiens
atggggagacaaag

SEQ ID NO: 551118 - DNA, 23 bp, Homo sapiens
atggggagtattatggaaatcca

SEQ ID NO: 551119 - DNA, 13 bp, Homo sapiens
atggggttgggct

SEQ ID NO: 551120 - DNA, 24 bp, Homo sapiens
atggggttgggctctgcgtcccac

SEQ ID NO: 551121 - DNA, 15 bp, Homo sapiens
atgggtgatatcctg

SEQ ID NO: 551122 - DNA, 15 bp, Homo sapiens
atggtagactgtgac

SEQ ID NO: 551123 - DNA, 13 bp, Homo sapiens
atggtatatattt

SEQ ID NO: 551124 - DNA, 14 bp, Homo sapiens
atggtctaatgttt

SEQ ID NO: 551125 - DNA, 13 bp, Homo sapiens
atggtgcaatttg

SEQ ID NO: 551126 - DNA, 16 bp, Homo sapiens
atggtgctgggtcctt

SEQ ID NO: 551127 - DNA, 19 bp, Homo sapiens
atggtggttgtttcttcca

SEQ ID NO: 551128 - DNA, 21 bp, Homo sapiens
atggttacctctgcataaata

SEQ ID NO: 551129 - DNA, 18 bp, Homo sapiens
atgtaaactttaacttcc

SEQ ID NO: 551130 - DNA, 12 bp, Homo sapiens
atgtaaatgaag

SEQ ID NO: 551131 - DNA, 13 bp, Homo sapiens
atgtaaatgaagt

SEQ ID NO: 551132 - DNA, 14 bp, Homo sapiens
atgtaactgctctt

SEQ ID NO: 551133 - DNA, 14 bp, Homo sapiens
atgtaactgttacc

SEQ ID NO: 551134 - DNA, 17 bp, Homo sapiens
atgtaactgttaccatt

SEQ ID NO: 551135 - DNA, 21 bp, Homo sapiens
atgtaactgttaccattggaa

SEQ ID NO: 551136 - DNA, 23 bp, Homo sapiens
atgtaactgttaccattggaaat

SEQ ID NO: 551137 - DNA, 19 bp, Homo sapiens
atgtaacttgttgcagact

SEQ ID NO: 551138 - DNA, 18 bp, Homo sapiens
atgtacaaaaacacaaat

SEQ ID NO: 551139 - DNA, 19 bp, Homo sapiens
atgtacaaaaacacaaata

SEQ ID NO: 551140 - DNA, 20 bp, Homo sapiens
atgtacaaaaacacaaatac

SEQ ID NO: 551141 - DNA, 14 bp, Homo sapiens
atgtacccagccta

SEQ ID NO: 551142 - DNA, 17 bp, Homo sapiens
atgtagactatatacat

SEQ ID NO: 551143 - DNA, 20 bp, Homo sapiens
atgtagcaaaccctgtcaaa

SEQ ID NO: 551144 - DNA, 15 bp, Homo sapiens
atgtatacgcacgca

SEQ ID NO: 551145 - DNA, 16 bp, Homo sapiens
atgtatacgcacgcac

SEQ ID NO: 551146 - DNA, 20 bp, Homo sapiens
atgtatacgcacgcacccac

SEQ ID NO: 551147 - DNA, 16 bp, Homo sapiens
atgtatagtatttgaa

SEQ ID NO: 551148 - DNA, 13 bp, Homo sapiens
atgtatatacaca

SEQ ID NO: 551149 - DNA, 18 bp, Homo sapiens
atgtatatacacatatac

SEQ ID NO: 551150 - DNA, 17 bp, Homo sapiens
atgtatgcataataatc

SEQ ID NO: 551151 - DNA, 22 bp, Homo sapiens
atgtatgtgtatatgtttatac

SEQ ID NO: 551152 - DNA, 19 bp, Homo sapiens
atgtatgtttacactgtca

SEQ ID NO: 551153 - DNA, 17 bp, Homo sapiens
atgtattttatgtatgt

SEQ ID NO: 551154 - DNA, 20 bp, Homo sapiens
atgtattttatgtatgttta

SEQ ID NO: 551155 - DNA, 15 bp, Homo sapiens
atgtattttgtgagt

SEQ ID NO: 551156 - DNA, 23 bp, Homo sapiens
atgtcactgttataaattttgta

SEQ ID NO: 551157 - DNA, 16 bp, Homo sapiens
atgtccctttcttctc

SEQ ID NO: 551158 - DNA, 12 bp, Homo sapiens
atgtcgcacaat

SEQ ID NO: 551159 - DNA, 14 bp, Homo sapiens
atgtcgcacaatgt

SEQ ID NO: 551160 - DNA, 16 bp, Homo sapiens
atgtcgcacaatgttt

SEQ ID NO: 551161 - DNA, 15 bp, Homo sapiens
atgtctcatgtttta

SEQ ID NO: 551162 - DNA, 15 bp, Homo sapiens
atgtcttggtacttg

SEQ ID NO: 551163 - DNA, 18 bp, Homo sapiens
atgtctttctccaaagtt

SEQ ID NO: 551164 - DNA, 22 bp, Homo sapiens
atgtctttctccaaagttatcc

SEQ ID NO: 551165 - DNA, 17 bp, Homo sapiens
atgtctttctcctctgg

SEQ ID NO: 551166 - DNA, 22 bp, Homo sapiens
atgtgaactttctcagcatata

SEQ ID NO: 551167 - DNA, 13 bp, Homo sapiens
atgtgaattacta

SEQ ID NO: 551168 - DNA, 14 bp, Homo sapiens
atgtgaattactaa

SEQ ID NO: 551169 - DNA, 20 bp, Homo sapiens
atgtgaattactaacttcta

SEQ ID NO: 551170 - DNA, 19 bp, Homo sapiens
atgtgacatgcgggctggg

SEQ ID NO: 551171 - DNA, 11 bp, Homo sapiens
atgtgacattt

SEQ ID NO: 551172 - DNA, 19 bp, Homo sapiens
atgtgacatttgtcatttt

SEQ ID NO: 551173 - DNA, 21 bp, Homo sapiens
atgtgatggatggcacaatga

SEQ ID NO: 551174 - DNA, 15 bp, Homo sapiens
atgtgattcaaaaga

SEQ ID NO: 551175 - DNA, 12 bp, Homo sapiens
atgtgcccccag

SEQ ID NO: 551176 - DNA, 16 bp, Homo sapiens
atgtgctgctgtggca

SEQ ID NO: 551177 - DNA, 17 bp, Homo sapiens
atgtggaaaactcacag

SEQ ID NO: 551178 - DNA, 14 bp, Homo sapiens
atgtggacatgcac

SEQ ID NO: 551179 - DNA, 15 bp, Homo sapiens
atgtggacatgcacc

SEQ ID NO: 551180 - DNA, 19 bp, Homo sapiens
atgtggagtcagcctcgca

SEQ ID NO: 551181 - DNA, 22 bp, Homo sapiens
atgtgtaaaattggattattac

SEQ ID NO: 551182 - DNA, 15 bp, Homo sapiens
atgtgtaatttttct

SEQ ID NO: 551183 - DNA, 15 bp, Homo sapiens
atgtgtatatataca

SEQ ID NO: 551184 - DNA, 16 bp, Homo sapiens
atgtgtatatatacat

SEQ ID NO: 551185 - DNA, 17 bp, Homo sapiens
atgtgtgcatgtgtgta

SEQ ID NO: 551186 - DNA, 21 bp, Homo sapiens
atgtgtgtataagtgcacaca

SEQ ID NO: 551187 - DNA, 23 bp, Homo sapiens
atgtgtgtataagtgcacacaga

SEQ ID NO: 551188 - DNA, 14 bp, Homo sapiens
atgtgtgtatatat

SEQ ID NO: 551189 - DNA, 22 bp, Homo sapiens
atgtgttgctctccattctttt

SEQ ID NO: 551190 - DNA, 13 bp, Homo sapiens
atgttaaagatgt

SEQ ID NO: 551191 - DNA, 15 bp, Homo sapiens
atgttaaagatgtag

SEQ ID NO: 551192 - DNA, 18 bp, Homo sapiens
atgttaaagatgtagcaa

SEQ ID NO: 551193 - DNA, 19 bp, Homo sapiens
atgttaatagaaaatatat

SEQ ID NO: 551194 - DNA, 14 bp, Homo sapiens
atgttatatttttc

SEQ ID NO: 551195 - DNA, 23 bp, Homo sapiens
atgttatatttttcttaaaaagt

SEQ ID NO: 551196 - DNA, 14 bp, Homo sapiens
atgttatttctctg

SEQ ID NO: 551197 - DNA, 19 bp, Homo sapiens
atgttcacgcaacttgaaa

SEQ ID NO: 551198 - DNA, 16 bp, Homo sapiens
atgttcatcaattccc

SEQ ID NO: 551199 - DNA, 16 bp, Homo sapiens
attttactgtcttaat

SEQ ID NO: 551200 - DNA, 23 bp, Homo sapiens
attttactgtcttaattaagtaa

SEQ ID NO: 551201 - DNA, 16 bp, Homo sapiens
attttagctaatttag

SEQ ID NO: 551202 - DNA, 21 bp, Homo sapiens
attttagttttattttctaaa

SEQ ID NO: 551203 - DNA, 22 bp, Homo sapiens
attttagttttattttctaaag

SEQ ID NO: 551204 - DNA, 13 bp, Homo sapiens
attttataagcac

SEQ ID NO: 551205 - DNA, 12 bp, Homo sapiens
attttatgtatg

SEQ ID NO: 551206 - DNA, 18 bp, Homo sapiens
attttatgttgacatttg

SEQ ID NO: 551207 - DNA, 19 bp, Homo sapiens
attttatgttgacatttgt

SEQ ID NO: 551208 - DNA, 21 bp, Homo sapiens
attttatgtttaaaatggcat

SEQ ID NO: 551209 - DNA, 13 bp, Homo sapiens
attttcaaagaga

SEQ ID NO: 551210 - DNA, 20 bp, Homo sapiens
attttcaaatatgtaaactt

SEQ ID NO: 551211 - DNA, 12 bp, Homo sapiens
attttcagattt

SEQ ID NO: 551212 - DNA, 16 bp, Homo sapiens
attttcagatttgcac

SEQ ID NO: 551213 - DNA, 21 bp, Homo sapiens
attttcagctcaattgttaat

SEQ ID NO: 551214 - DNA, 13 bp, Homo sapiens
attttcattagca

SEQ ID NO: 551215 - DNA, 14 bp, Homo sapiens
attttcattagcaa

SEQ ID NO: 551216 - DNA, 15 bp, Homo sapiens
attttcattagcaaa

SEQ ID NO: 551217 - DNA, 16 bp, Homo sapiens
attttcattagcaaaa

SEQ ID NO: 551218 - DNA, 17 bp, Homo sapiens
attttcattagcaaaaa

SEQ ID NO: 551219 - DNA, 22 bp, Homo sapiens
attttccagggcaatcaatgtt

SEQ ID NO: 551220 - DNA, 17 bp, Homo sapiens
attttcctttatgtgat

SEQ ID NO: 551221 - DNA, 18 bp, Homo sapiens
attttctagaaatgttta

SEQ ID NO: 551222 - DNA, 16 bp, Homo sapiens
attttctgaaactaat

SEQ ID NO: 551223 - DNA, 19 bp, Homo sapiens
attttctgaaactaatgaa

SEQ ID NO: 551224 - DNA, 17 bp, Homo sapiens
attttctgagtagcata

SEQ ID NO: 551225 - DNA, 18 bp, Homo sapiens
attttctgagtagcatat

SEQ ID NO: 551226 - DNA, 22 bp, Homo sapiens
attttctggggctcctcacata

SEQ ID NO: 551227 - DNA, 23 bp, Homo sapiens
attttgctaagtaaatctcttct

SEQ ID NO: 551228 - DNA, 16 bp, Homo sapiens
attttggacgtgtgag

SEQ ID NO: 551229 - DNA, 17 bp, Homo sapiens
attttggagagatagga

SEQ ID NO: 551230 - DNA, 19 bp, Homo sapiens
attttggagagataggaag

SEQ ID NO: 551231 - DNA, 20 bp, Homo sapiens
attttggagagataggaagg

SEQ ID NO: 551232 - DNA, 17 bp, Homo sapiens
attttggtgtctttctc

SEQ ID NO: 551233 - DNA, 13 bp, Homo sapiens
attttgtatgcaa

SEQ ID NO: 551234 - DNA, 20 bp, Homo sapiens
attttgtatgcaagcagttt

SEQ ID NO: 551235 - DNA, 17 bp, Homo sapiens
attttgtcactgctgta

SEQ ID NO: 551236 - DNA, 19 bp, Homo sapiens
attttgtcactgctgtaaa

SEQ ID NO: 551237 - DNA, 20 bp, Homo sapiens
attttgtctgccccaagttt

SEQ ID NO: 551238 - DNA, 15 bp, Homo sapiens
attttgtgagtttgt

SEQ ID NO: 551239 - DNA, 20 bp, Homo sapiens
atttttaaaggaaaaatcat

SEQ ID NO: 551240 - DNA, 16 bp, Homo sapiens
atttttagcctgtgtc

SEQ ID NO: 551241 - DNA, 20 bp, Homo sapiens
atttttcagctctctgtata

SEQ ID NO: 551242 - DNA, 21 bp, Homo sapiens
atttttcattacctgtagctt

SEQ ID NO: 551243 - DNA, 18 bp, Homo sapiens
atttttctactgctcttt

SEQ ID NO: 551244 - DNA, 18 bp, Homo sapiens
attttttggtattggcca

SEQ ID NO: 551245 - DNA, 13 bp, Homo sapiens
attttttgtctgt

SEQ ID NO: 551246 - DNA, 23 bp, Homo sapiens
attttttgtctgtgataacagag

SEQ ID NO: 551247 - DNA, 13 bp, Homo sapiens
atttttttaagca

SEQ ID NO: 551248 - DNA, 21 bp, Homo sapiens
atttttttccttacataaaca

SEQ ID NO: 551249 - DNA, 15 bp, Homo sapiens
caaaaaaagttgtat

SEQ ID NO: 551250 - DNA, 22 bp, Homo sapiens
caaaaaaagttgtatgatctgt

SEQ ID NO: 551251 - DNA, 16 bp, Homo sapiens
caaaaaaatccagaaa

SEQ ID NO: 551252 - DNA, 12 bp, Homo sapiens
caaaaacacaaa

SEQ ID NO: 551253 - DNA, 23 bp, Homo sapiens
caaaaagataccttaaaatttga

SEQ ID NO: 551254 - DNA, 20 bp, Homo sapiens
caaaaatctgaagattgttt

SEQ ID NO: 551255 - DNA, 21 bp, Homo sapiens
caaaaatctgaagattgttta

SEQ ID NO: 551256 - DNA, 16 bp, Homo sapiens
caaaagacatgttgta

SEQ ID NO: 551257 - DNA, 14 bp, Homo sapiens
caaaagagaaaaaa

SEQ ID NO: 551258 - DNA, 14 bp, Homo sapiens
caaaaggatgattt

SEQ ID NO: 551259 - DNA, 19 bp, Homo sapiens
caaaaggcttgcagaactt

SEQ ID NO: 551260 - DNA, 16 bp, Homo sapiens
caaaagtatcgggggc

SEQ ID NO: 551261 - DNA, 21 bp, Homo sapiens
caaaataaaaagtgacacagc

SEQ ID NO: 551262 - DNA, 20 bp, Homo sapiens
caaaataaaaccagaaagag

SEQ ID NO: 551263 - DNA, 19 bp, Homo sapiens
caaaataaagtctgtcatg

SEQ ID NO: 551264 - DNA, 22 bp, Homo sapiens
caaaatacatgatgatttcaga

SEQ ID NO: 551265 - DNA, 18 bp, Homo sapiens
caaaatattatgttatga

SEQ ID NO: 551266 - DNA, 19 bp, Homo sapiens
caaaatattatgttatgaa

SEQ ID NO: 551267 - DNA, 21 bp, Homo sapiens
caaaatattatgttatgaaaa

SEQ ID NO: 551268 - DNA, 15 bp, Homo sapiens
caaaatgattgtctt

SEQ ID NO: 551269 - DNA, 23 bp, Homo sapiens
caaaattttataagcaaatttca

SEQ ID NO: 551270 - DNA, 20 bp, Homo sapiens
caaacaagcatataaaatgg

SEQ ID NO: 551271 - DNA, 12 bp, Homo sapiens
caaacatagaca

SEQ ID NO: 551272 - DNA, 15 bp, Homo sapiens
caaacatagacagat

SEQ ID NO: 551273 - DNA, 18 bp, Homo sapiens
caaacatggatacttcct

SEQ ID NO: 551274 - DNA, 14 bp, Homo sapiens
caaacattaatgtt

SEQ ID NO: 551275 - DNA, 17 bp, Homo sapiens
caaacattaatgttgat

SEQ ID NO: 551276 - DNA, 20 bp, Homo sapiens
caaaccaatttgttctgtgc

SEQ ID NO: 551277 - DNA, 19 bp, Homo sapiens
caaacccccattctgtcct

SEQ ID NO: 551278 - DNA, 13 bp, Homo sapiens
caaacctaagttg

SEQ ID NO: 551279 - DNA, 13 bp, Homo sapiens
caaacctttcccc

SEQ ID NO: 551280 - DNA, 13 bp, Homo sapiens
caaacttcagaaa

SEQ ID NO: 551281 - DNA, 22 bp, Homo sapiens
caaagaatcacctaattaattt

SEQ ID NO: 551282 - DNA, 16 bp, Homo sapiens
caaagacaaatagtag

SEQ ID NO: 551283 - DNA, 22 bp, Homo sapiens
caaagacttcatttaacactga

SEQ ID NO: 551284 - DNA, 23 bp, Homo sapiens
caaagagatgggccttttcttga

SEQ ID NO: 551285 - DNA, 13 bp, Homo sapiens
caaagagtagaac

SEQ ID NO: 551286 - DNA, 14 bp, Homo sapiens
caaagatcaaaata

SEQ ID NO: 551287 - DNA, 11 bp, Homo sapiens
caaagcacatg

SEQ ID NO: 551288 - DNA, 23 bp, Homo sapiens
caaagcacatgcttagcttatct

SEQ ID NO: 551289 - DNA, 19 bp, Homo sapiens
caaagcagagtgaaattca

SEQ ID NO: 551290 - DNA, 21 bp, Homo sapiens
caaagcagtggagcccaggag

SEQ ID NO: 551291 - DNA, 11 bp, Homo sapiens
caaagccctcc

SEQ ID NO: 551292 - DNA, 18 bp, Homo sapiens
caaagctatttaagtgga

SEQ ID NO: 551293 - DNA, 11 bp, Homo sapiens
caaagctcata

SEQ ID NO: 551294 - DNA, 18 bp, Homo sapiens
caaagctgttcttcctgg

SEQ ID NO: 551295 - DNA, 16 bp, Homo sapiens
caaaggagctttctca

SEQ ID NO: 551296 - DNA, 22 bp, Homo sapiens
caaagggggaggagaagaaaat

SEQ ID NO: 551297 - DNA, 17 bp, Homo sapiens
caaagtacaggtacttt

SEQ ID NO: 551298 - DNA, 16 bp, Homo sapiens
caaagtaccacactga

SEQ ID NO: 551299 - DNA, 13 bp, Homo sapiens
caaataaccctga

SEQ ID NO: 551300 - DNA, 15 bp, Homo sapiens
caaatacaaaatgat

SEQ ID NO: 551301 - DNA, 16 bp, Homo sapiens
caaatacaaaatgatt

SEQ ID NO: 551302 - DNA, 12 bp, Homo sapiens
caaatacacata

SEQ ID NO: 551303 - DNA, 16 bp, Homo sapiens
caaatacacatacata

SEQ ID NO: 551304 - DNA, 17 bp, Homo sapiens
caaatatgtaaacttta

SEQ ID NO: 551305 - DNA, 19 bp, Homo sapiens
caaatatgtaaactttaac

SEQ ID NO: 551306 - DNA, 19 bp, Homo sapiens
caaatattaaaaagtcttt

SEQ ID NO: 551307 - DNA, 22 bp, Homo sapiens
caaatattaaaaagtcttttaa

SEQ ID NO: 551308 - DNA, 16 bp, Homo sapiens
caaatattttgtcact

SEQ ID NO: 551309 - DNA, 19 bp, Homo sapiens
caaatattttgtcactgct

SEQ ID NO: 551310 - DNA, 23 bp, Homo sapiens
caaatccaacgcttttcccacct

SEQ ID NO: 551311 - DNA, 22 bp, Homo sapiens
caaatctcaaaagatctcctgt

SEQ ID NO: 551312 - DNA, 13 bp, Homo sapiens
caaatctgtctgc

SEQ ID NO: 551313 - DNA, 22 bp, Homo sapiens
caaatcttcctggtcgaaagtt

SEQ ID NO: 551314 - DNA, 12 bp, Homo sapiens
caaatgattgct

SEQ ID NO: 551315 - DNA, 14 bp, Homo sapiens
caaatgattgcttt

SEQ ID NO: 551316 - DNA, 20 bp, Homo sapiens
caaatgattgcttttaaaat

SEQ ID NO: 551317 - DNA, 18 bp, Homo sapiens
caaatggagttggagttc

SEQ ID NO: 551318 - DNA, 24 bp, Homo sapiens
caaatggtacaaaaccacagtgta

SEQ ID NO: 551319 - DNA, 20 bp, Homo sapiens
caaatggtggttgtttcttc

SEQ ID NO: 551320 - DNA, 23 bp, Homo sapiens
caaatgtacatctcccctttgct

SEQ ID NO: 551321 - DNA, 17 bp, Homo sapiens
caaatgtctactgaagc

SEQ ID NO: 551322 - DNA, 21 bp, Homo sapiens
caaatgtgtcttgtattatca

SEQ ID NO: 551323 - DNA, 11 bp, Homo sapiens
caaatgtgtga

SEQ ID NO: 551324 - DNA, 16 bp, Homo sapiens
caaattaatgtgtaaa

SEQ ID NO: 551325 - DNA, 17 bp, Homo sapiens
caaattaatgtgtaaaa

SEQ ID NO: 551326 - DNA, 22 bp, Homo sapiens
caaattaatgtgtaaaattgga

SEQ ID NO: 551327 - DNA, 17 bp, Homo sapiens
caaatttcaaaagacat

SEQ ID NO: 551328 - DNA, 18 bp, Homo sapiens
caaattttccttcctgtt

SEQ ID NO: 551329 - DNA, 17 bp, Homo sapiens
caacaaactgcacatga

SEQ ID NO: 551330 - DNA, 13 bp, Homo sapiens
caacaacatccat

SEQ ID NO: 551331 - DNA, 19 bp, Homo sapiens
caacaagaataaaggcagc

SEQ ID NO: 551332 - DNA, 13 bp, Homo sapiens
caacaccacagac

SEQ ID NO: 551333 - DNA, 20 bp, Homo sapiens
caacaccacagacacacaca

SEQ ID NO: 551334 - DNA, 19 bp, Homo sapiens
caacagaaacatgccagaa

SEQ ID NO: 551335 - DNA, 16 bp, Homo sapiens
cacttgaccttctgtc

SEQ ID NO: 551336 - DNA, 17 bp, Homo sapiens
cacttgtcggctccagt

SEQ ID NO: 551337 - DNA, 17 bp, Homo sapiens
cactttcccacactgtg

SEQ ID NO: 551338 - DNA, 16 bp, Homo sapiens
cactttgggaggctga

SEQ ID NO: 551339 - DNA, 17 bp, Homo sapiens
cacttttccagtatttt

SEQ ID NO: 551340 - DNA, 19 bp, Homo sapiens
cagaaacatgccagaagga

SEQ ID NO: 551341 - DNA, 19 bp, Homo sapiens
cagaaacccggcttcctgt

SEQ ID NO: 551342 - DNA, 20 bp, Homo sapiens
cagaaacccggcttcctgtg

SEQ ID NO: 551343 - DNA, 17 bp, Homo sapiens
cagaaacgccacatccc

SEQ ID NO: 551344 - DNA, 17 bp, Homo sapiens
cagaaatatatatacat

SEQ ID NO: 551345 - DNA, 22 bp, Homo sapiens
cagaaatgccgctgtgtccccg

SEQ ID NO: 551346 - DNA, 17 bp, Homo sapiens
cagaaatgtccctttct

SEQ ID NO: 551347 - DNA, 11 bp, Homo sapiens
cagaaattggt

SEQ ID NO: 551348 - DNA, 20 bp, Homo sapiens
cagaaattggtaccttgcac

SEQ ID NO: 551349 - DNA, 23 bp, Homo sapiens
cagaaattggtaccttgcacaca

SEQ ID NO: 551350 - DNA, 22 bp, Homo sapiens
cagaacactttgctaggagata

SEQ ID NO: 551351 - DNA, 13 bp, Homo sapiens
cagaaccaattca

SEQ ID NO: 551352 - DNA, 18 bp, Homo sapiens
cagaaccattcactggca

SEQ ID NO: 551353 - DNA, 21 bp, Homo sapiens
cagaacctaaaagtattattc

SEQ ID NO: 551354 - DNA, 15 bp, Homo sapiens
cagaactctgcctgc

SEQ ID NO: 551355 - DNA, 18 bp, Homo sapiens
cagaactctgcctgccct

SEQ ID NO: 551356 - DNA, 14 bp, Homo sapiens
cagaactctgtgtc

SEQ ID NO: 551357 - DNA, 21 bp, Homo sapiens
cagaacttgaagcctgctcct

SEQ ID NO: 551358 - DNA, 14 bp, Homo sapiens
cagaagcagcagct

SEQ ID NO: 551359 - DNA, 22 bp, Homo sapiens
cagaagcagcagctagaaagag

SEQ ID NO: 551360 - DNA, 16 bp, Homo sapiens
cagaagcagttgcaat

SEQ ID NO: 551361 - DNA, 12 bp, Homo sapiens
cagaaggctcct

SEQ ID NO: 551362 - DNA, 16 bp, Homo sapiens
cagaaggctcctgccc

SEQ ID NO: 551363 - DNA, 17 bp, Homo sapiens
cagaaggctcctgcccc

SEQ ID NO: 551364 - DNA, 19 bp, Homo sapiens
cagaaggctcctgccccca

SEQ ID NO: 551365 - DNA, 21 bp, Homo sapiens
cagaagggagctggctccagc

SEQ ID NO: 551366 - DNA, 13 bp, Homo sapiens
cagaattggaaaa

SEQ ID NO: 551367 - DNA, 17 bp, Homo sapiens
cagaattggaaaagact

SEQ ID NO: 551368 - DNA, 17 bp, Homo sapiens
cagacaacagcccaggc

SEQ ID NO: 551369 - DNA, 14 bp, Homo sapiens
cagacaatcttctg

SEQ ID NO: 551370 - DNA, 22 bp, Homo sapiens
cagacaattctaatggtaactt

SEQ ID NO: 551371 - DNA, 12 bp, Homo sapiens
cagacacacaca

SEQ ID NO: 551372 - DNA, 15 bp, Homo sapiens
cagacacacacacgc

SEQ ID NO: 551373 - DNA, 21 bp, Homo sapiens
cagacacacacacgcacgcac

SEQ ID NO: 551374 - DNA, 13 bp, Homo sapiens
cagacacacacat

SEQ ID NO: 551375 - DNA, 19 bp, Homo sapiens
cagacacacacatatatac

SEQ ID NO: 551376 - DNA, 13 bp, Homo sapiens
cagacactcctgg

SEQ ID NO: 551377 - DNA, 15 bp, Homo sapiens
cagacactcctgggg

SEQ ID NO: 551378 - DNA, 13 bp, Homo sapiens
cagaccactgtct

SEQ ID NO: 551379 - DNA, 13 bp, Homo sapiens
cagaccagtagtg

SEQ ID NO: 551380 - DNA, 18 bp, Homo sapiens
cagaccagtagtgaccaa

SEQ ID NO: 551381 - DNA, 20 bp, Homo sapiens
cagaccagtagtgaccaatc

SEQ ID NO: 551382 - DNA, 16 bp, Homo sapiens
cagacctgggccctgg

SEQ ID NO: 551383 - DNA, 22 bp, Homo sapiens
cagactatccattttacacttg

SEQ ID NO: 551384 - DNA, 18 bp, Homo sapiens
cagactggtgttaatgag

SEQ ID NO: 551385 - DNA, 18 bp, Homo sapiens
cagagaatatcaagatga

SEQ ID NO: 551386 - DNA, 17 bp, Homo sapiens
cagagaggacgtgggcg

SEQ ID NO: 551387 - DNA, 21 bp, Homo sapiens
cagagaggacgtgggcggcag

SEQ ID NO: 551388 - DNA, 12 bp, Homo sapiens
cagagcacagcc

SEQ ID NO: 551389 - DNA, 21 bp, Homo sapiens
cagagcacagccaatctccag

SEQ ID NO: 551390 - DNA, 17 bp, Homo sapiens
cagagcattccagtcag

SEQ ID NO: 551391 - DNA, 18 bp, Homo sapiens
cagagcattccagtcagg

SEQ ID NO: 551392 - DNA, 21 bp, Homo sapiens
cagagcatttccaacaccaca

SEQ ID NO: 551393 - DNA, 14 bp, Homo sapiens
cagagcccagaccc

SEQ ID NO: 551394 - DNA, 15 bp, Homo sapiens
cagagccctgctccc

SEQ ID NO: 551395 - DNA, 23 bp, Homo sapiens
cagagccgtaaaaactgaagttc

SEQ ID NO: 551396 - DNA, 22 bp, Homo sapiens
cagagcctgcagggtgacctgc

SEQ ID NO: 551397 - DNA, 14 bp, Homo sapiens
cagagcctgcccca

SEQ ID NO: 551398 - DNA, 17 bp, Homo sapiens
cagagcctgccccagcg

SEQ ID NO: 551399 - DNA, 16 bp, Homo sapiens
cagagcgatgtgttct

SEQ ID NO: 551400 - DNA, 23 bp, Homo sapiens
cagagcgatgtgttctttgtacc

SEQ ID NO: 551401 - DNA, 13 bp, Homo sapiens
cagagctcagcac

SEQ ID NO: 551402 - DNA, 15 bp, Homo sapiens
cagagctcccaggac

SEQ ID NO: 551403 - DNA, 22 bp, Homo sapiens
cagagctcccaggacgcaggga

SEQ ID NO: 551404 - DNA, 13 bp, Homo sapiens
cagagctgccagt

SEQ ID NO: 551405 - DNA, 18 bp, Homo sapiens
cagaggaggcgaggaggc

SEQ ID NO: 551406 - DNA, 19 bp, Homo sapiens
cagaggagggatagagacg

SEQ ID NO: 551407 - DNA, 22 bp, Homo sapiens
cagaggagggatagagacgcag

SEQ ID NO: 551408 - DNA, 21 bp, Homo sapiens
cagaggcctcctgtggcctgc

SEQ ID NO: 551409 - DNA, 17 bp, Homo sapiens
cagaggggcggggccag

SEQ ID NO: 551410 - DNA, 20 bp, Homo sapiens
cagaggggcggggccaggat

SEQ ID NO: 551411 - DNA, 17 bp, Homo sapiens
cagagggttgtgatttt

SEQ ID NO: 551412 - DNA, 16 bp, Homo sapiens
cagagtcaagctgatg

SEQ ID NO: 551413 - DNA, 16 bp, Homo sapiens
cagagtgaaattcaat

SEQ ID NO: 551414 - DNA, 15 bp, Homo sapiens
cagagtgaagagtga

SEQ ID NO: 551415 - DNA, 20 bp, Homo sapiens
cagagtgatttgtaaaacag

SEQ ID NO: 551416 - DNA, 22 bp, Homo sapiens
cagagtgatttgtaaaacagtg

SEQ ID NO: 551417 - DNA, 18 bp, Homo sapiens
cagataattctggaccag

SEQ ID NO: 551418 - DNA, 21 bp, Homo sapiens
cagataattctggaccagaga

SEQ ID NO: 551419 - DNA, 22 bp, Homo sapiens
cagatagtatacacatcataaa

SEQ ID NO: 551420 - DNA, 20 bp, Homo sapiens
cagatccacctgcacaaaca

SEQ ID NO: 551421 - DNA, 15 bp, Homo sapiens
cagatccaggaacac

SEQ ID NO: 551422 - DNA, 16 bp, Homo sapiens
cagatccaggaacaca

SEQ ID NO: 551423 - DNA, 23 bp, Homo sapiens
cagatccaggaacacatgcacac

SEQ ID NO: 551424 - DNA, 13 bp, Homo sapiens
cagatccatcggt

SEQ ID NO: 551425 - DNA, 13 bp, Homo sapiens
cagatgaaggaaa

SEQ ID NO: 551426 - DNA, 13 bp, Homo sapiens
cagatgacccctc

SEQ ID NO: 551427 - DNA, 18 bp, Homo sapiens
cagatgacccctccccta

SEQ ID NO: 551428 - DNA, 16 bp, Homo sapiens
cagatgacccctgccc

SEQ ID NO: 551429 - DNA, 19 bp, Homo sapiens
cagatgacccctgcccaga

SEQ ID NO: 551430 - DNA, 19 bp, Homo sapiens
cagatgaggtgaaaaggcc

SEQ ID NO: 551431 - DNA, 12 bp, Homo sapiens
cagatgcagctc

SEQ ID NO: 551432 - DNA, 19 bp, Homo sapiens
cagatgcagctcttcctgg

SEQ ID NO: 551433 - DNA, 23 bp, Homo sapiens
cagatgcagctcttcctggacag

SEQ ID NO: 551434 - DNA, 21 bp, Homo sapiens
cagatgggcaaggcctttggc

SEQ ID NO: 551435 - DNA, 19 bp, Homo sapiens
cagatgtggacatgcaccc

SEQ ID NO: 551436 - DNA, 21 bp, Homo sapiens
cagatgtggacatgcacccgc

SEQ ID NO: 551437 - DNA, 22 bp, Homo sapiens
cagatgtggacatgcacccgca

SEQ ID NO: 551438 - DNA, 21 bp, Homo sapiens
cagattcctttggccactgta

SEQ ID NO: 551439 - DNA, 20 bp, Homo sapiens
cagattctaggacctgtgtc

SEQ ID NO: 551440 - DNA, 12 bp, Homo sapiens
cagatttgcaac

SEQ ID NO: 551441 - DNA, 20 bp, Homo sapiens
cagatttgcacaaaaagata

SEQ ID NO: 551442 - DNA, 22 bp, Homo sapiens
cagattttagttttattttcta

SEQ ID NO: 551443 - DNA, 18 bp, Homo sapiens
cagcaaaaatataaaata

SEQ ID NO: 551444 - DNA, 12 bp, Homo sapiens
cagcaaacacag

SEQ ID NO: 551445 - DNA, 15 bp, Homo sapiens
cagcaaacccaaaga

SEQ ID NO: 551446 - DNA, 14 bp, Homo sapiens
cagcaacacagagc

SEQ ID NO: 551447 - DNA, 22 bp, Homo sapiens
cagcaacattataatggccctg

SEQ ID NO: 551448 - DNA, 20 bp, Homo sapiens
cagcaaggcgctaacttgct

SEQ ID NO: 551449 - DNA, 18 bp, Homo sapiens
cagcaaggtcttgctctc

SEQ ID NO: 551450 - DNA, 24 bp, Homo sapiens
cagcacatagggttcccacgaagc

SEQ ID NO: 551451 - DNA, 17 bp, Homo sapiens
cagcagatccacctgca

SEQ ID NO: 551452 - DNA, 20 bp, Homo sapiens
cagcagatccacctgcacaa

SEQ ID NO: 551453 - DNA, 23 bp, Homo sapiens
cagcagatccacctgcacaaaca

SEQ ID NO: 551454 - DNA, 13 bp, Homo sapiens
cagcagctgaagc

SEQ ID NO: 551455 - DNA, 12 bp, Homo sapiens
cagcagcttcac

SEQ ID NO: 551456 - DNA, 17 bp, Homo sapiens
cagcagcttcaccagag

SEQ ID NO: 551457 - DNA, 18 bp, Homo sapiens
cagcagcttcaccagagc

SEQ ID NO: 551458 - DNA, 11 bp, Homo sapiens
cagcaggcagc

SEQ ID NO: 551459 - DNA, 15 bp, Homo sapiens
cagcaggcagccttg

SEQ ID NO: 551460 - DNA, 19 bp, Homo sapiens
cagcaggcagccttggcgg

SEQ ID NO: 551461 - DNA, 15 bp, Homo sapiens
cagcagggcagtagc

SEQ ID NO: 551462 - DNA, 17 bp, Homo sapiens
cagcagtcttatgcttc

SEQ ID NO: 551463 - DNA, 19 bp, Homo sapiens
cagcagtcttatgcttcca

SEQ ID NO: 551464 - DNA, 20 bp, Homo sapiens
cagcagtcttatgcttccag

SEQ ID NO: 551465 - DNA, 21 bp, Homo sapiens
cagcagttttcttttaatttt

SEQ ID NO: 551466 - DNA, 13 bp, Homo sapiens
cagcatatatata

SEQ ID NO: 551467 - DNA, 24 bp, Homo sapiens
cagcatctggaagagctaggcagg

SEQ ID NO: 551468 - DNA, 22 bp, Homo sapiens
cagcatggcatccaagactctt

SEQ ID NO: 551469 - DNA, 13 bp, Homo sapiens
cagcatgtctcag

SEQ ID NO: 551470 - DNA, 18 bp, Homo sapiens
cagccaatctccaggctc

SEQ ID NO: 551471 - DNA, 17 bp, Homo sapiens
catttctctctccagtc

SEQ ID NO: 551472 - DNA, 14 bp, Homo sapiens
catttctctttcaa

SEQ ID NO: 551473 - DNA, 15 bp, Homo sapiens
catttctctttcaaa

SEQ ID NO: 551474 - DNA, 18 bp, Homo sapiens
catttctgccttttgttc

SEQ ID NO: 551475 - DNA, 21 bp, Homo sapiens
catttgctgcatttcaagtta

SEQ ID NO: 551476 - DNA, 23 bp, Homo sapiens
catttggtacacacttgaccttc

SEQ ID NO: 551477 - DNA, 21 bp, Homo sapiens
cattttacacttgctttattt

SEQ ID NO: 551478 - DNA, 15 bp, Homo sapiens
cattttgaaatattc

SEQ ID NO: 551479 - DNA, 15 bp, Homo sapiens
cattttgagaacatt

SEQ ID NO: 551480 - DNA, 16 bp, Homo sapiens
cattttgagaacattc

SEQ ID NO: 551481 - DNA, 20 bp, Homo sapiens
cattttgcagctatggacaa

SEQ ID NO: 551482 - DNA, 22 bp, Homo sapiens
cattttggtgtctttctctttt

SEQ ID NO: 551483 - DNA, 16 bp, Homo sapiens
catttttagcctgtgt

SEQ ID NO: 551484 - DNA, 21 bp, Homo sapiens
catttttttttttgtttctga

SEQ ID NO: 551485 - DNA, 12 bp, Homo sapiens
ccaaaactgctc

SEQ ID NO: 551486 - DNA, 18 bp, Homo sapiens
ccaaaagtatcgggggct

SEQ ID NO: 551487 - DNA, 12 bp, Homo sapiens
ccaaacattaat

SEQ ID NO: 551488 - DNA, 18 bp, Homo sapiens
ccaaacattaatgttgat

SEQ ID NO: 551489 - DNA, 22 bp, Homo sapiens
ccaaacattaatgttgatttct

SEQ ID NO: 551490 - DNA, 14 bp, Homo sapiens
ccaaacctggagat

SEQ ID NO: 551491 - DNA, 14 bp, Homo sapiens
ccaaagacaaatag

SEQ ID NO: 551492 - DNA, 20 bp, Homo sapiens
ccaaagcacatgcttagctt

SEQ ID NO: 551493 - DNA, 17 bp, Homo sapiens
ccaaagtgacctaccca

SEQ ID NO: 551494 - DNA, 18 bp, Homo sapiens
ccaaatatcaccaggact

SEQ ID NO: 551495 - DNA, 22 bp, Homo sapiens
ccaaatcctgggcatccccagc

SEQ ID NO: 551496 - DNA, 14 bp, Homo sapiens
ccaaatggtacaaa

SEQ ID NO: 551497 - DNA, 18 bp, Homo sapiens
ccaacaccacagacacac

SEQ ID NO: 551498 - DNA, 21 bp, Homo sapiens
ccaaccacacttgtcggctcc

SEQ ID NO: 551499 - DNA, 19 bp, Homo sapiens
ccaacccaaacctggagat

SEQ ID NO: 551500 - DNA, 20 bp, Homo sapiens
ccaacgtggggcagcacaga

SEQ ID NO: 551501 - DNA, 19 bp, Homo sapiens
ccaactttcaagaacttgt

SEQ ID NO: 551502 - DNA, 16 bp, Homo sapiens
ccaagagtccaagcca

SEQ ID NO: 551503 - DNA, 22 bp, Homo sapiens
ccaagcccagcctatctctctt

SEQ ID NO: 551504 - DNA, 12 bp, Homo sapiens
ccaagctgagga

SEQ ID NO: 551505 - DNA, 13 bp, Homo sapiens
ccaagctgaggag

SEQ ID NO: 551506 - DNA, 20 bp, Homo sapiens
ccaagctgaggaggtgctgc

SEQ ID NO: 551507 - DNA, 20 bp, Homo sapiens
ccaaggaacaagacccccag

SEQ ID NO: 551508 - DNA, 20 bp, Homo sapiens
ccaaggccccctgcctgccc

SEQ ID NO: 551509 - DNA, 21 bp, Homo sapiens
ccaaggccccctgcctgccct

SEQ ID NO: 551510 - DNA, 19 bp, Homo sapiens
ccaaggggtcccctccagg

SEQ ID NO: 551511 - DNA, 22 bp, Homo sapiens
ccaagtggagcctgacagccag

SEQ ID NO: 551512 - DNA, 19 bp, Homo sapiens
ccaagttatgcatccccat

SEQ ID NO: 551513 - DNA, 12 bp, Homo sapiens
ccaagttttgtg

SEQ ID NO: 551514 - DNA, 16 bp, Homo sapiens
ccaagttttgtgaaat

SEQ ID NO: 551515 - DNA, 17 bp, Homo sapiens
ccaagttttgtgaaatt

SEQ ID NO: 551516 - DNA, 22 bp, Homo sapiens
ccaagttttgtgaaatttttca

SEQ ID NO: 551517 - DNA, 19 bp, Homo sapiens
ccaataaaggaggaatcag

SEQ ID NO: 551518 - DNA, 22 bp, Homo sapiens
ccaataaaggaggaatcagacc

SEQ ID NO: 551519 - DNA, 22 bp, Homo sapiens
ccaatcagtagcttaagaaaaa

SEQ ID NO: 551520 - DNA, 15 bp, Homo sapiens
ccaatccctgatccc

SEQ ID NO: 551521 - DNA, 14 bp, Homo sapiens
ccaatgcagaactc

SEQ ID NO: 551522 - DNA, 14 bp, Homo sapiens
ccaattctccttta

SEQ ID NO: 551523 - DNA, 15 bp, Homo sapiens
ccaatttcttccttc

SEQ ID NO: 551524 - DNA, 14 bp, Homo sapiens
ccaatttgttctgt

SEQ ID NO: 551525 - DNA, 14 bp, Homo sapiens
ccacacacacaaaa

SEQ ID NO: 551526 - DNA, 13 bp, Homo sapiens
ccacacaccccaa

SEQ ID NO: 551527 - DNA, 20 bp, Homo sapiens
ccacacatttcactgtctgt

SEQ ID NO: 551528 - DNA, 13 bp, Homo sapiens
ccacaccagcccc

SEQ ID NO: 551529 - DNA, 15 bp, Homo sapiens
ccacaccctacagca

SEQ ID NO: 551530 - DNA, 16 bp, Homo sapiens
ccacaccctacagcag

SEQ ID NO: 551531 - DNA, 18 bp, Homo sapiens
ccacaccctacagcagat

SEQ ID NO: 551532 - DNA, 21 bp, Homo sapiens
ccacaccctacagcagatcca

SEQ ID NO: 551533 - DNA, 13 bp, Homo sapiens
ccacactgagttc

SEQ ID NO: 551534 - DNA, 12 bp, Homo sapiens
ccacagacacac

SEQ ID NO: 551535 - DNA, 19 bp, Homo sapiens
ccacagtctcccccaccct

SEQ ID NO: 551536 - DNA, 21 bp, Homo sapiens
ccacagtgtaccattaaaata

SEQ ID NO: 551537 - DNA, 19 bp, Homo sapiens
ccacatcactattgggccc

SEQ ID NO: 551538 - DNA, 16 bp, Homo sapiens
ccacatctctgaaagc

SEQ ID NO: 551539 - DNA, 20 bp, Homo sapiens
ccacattctgctgcccccag

SEQ ID NO: 551540 - DNA, 21 bp, Homo sapiens
ccacattctgctgcccccaga

SEQ ID NO: 551541 - DNA, 15 bp, Homo sapiens
ccacattgcccacac

SEQ ID NO: 551542 - DNA, 16 bp, Homo sapiens
ccacccaaagcagtgg

SEQ ID NO: 551543 - DNA, 15 bp, Homo sapiens
ccacccaagcaggag

SEQ ID NO: 551544 - DNA, 17 bp, Homo sapiens
ccacccaagcaggaggc

SEQ ID NO: 551545 - DNA, 17 bp, Homo sapiens
ccacccccgggtgcctg

SEQ ID NO: 551546 - DNA, 17 bp, Homo sapiens
ccacccggttcagtgtt

SEQ ID NO: 551547 - DNA, 13 bp, Homo sapiens
ccacctccccagg

SEQ ID NO: 551548 - DNA, 14 bp, Homo sapiens
ccacctgctctgct

SEQ ID NO: 551549 - DNA, 20 bp, Homo sapiens
ccacctggaagccctctctg

SEQ ID NO: 551550 - DNA, 12 bp, Homo sapiens
ccaccttccctt

SEQ ID NO: 551551 - DNA, 16 bp, Homo sapiens
ccacgagagcgcagca

SEQ ID NO: 551552 - DNA, 21 bp, Homo sapiens
ccacgccctcattacggctcc

SEQ ID NO: 551553 - DNA, 17 bp, Homo sapiens
ccacgtgcgtgttttct

SEQ ID NO: 551554 - DNA, 14 bp, Homo sapiens
ccacgttcacccct

SEQ ID NO: 551555 - DNA, 15 bp, Homo sapiens
ccacgttcacccctc

SEQ ID NO: 551556 - DNA, 13 bp, Homo sapiens
ccactaattttgt

SEQ ID NO: 551557 - DNA, 19 bp, Homo sapiens
ccactaattttgttttaaa

SEQ ID NO: 551558 - DNA, 13 bp, Homo sapiens
ccactacaggccc

SEQ ID NO: 551559 - DNA, 20 bp, Homo sapiens
ccactagaggggcacccacc

SEQ ID NO: 551560 - DNA, 14 bp, Homo sapiens
ccactccaagccag

SEQ ID NO: 551561 - DNA, 11 bp, Homo sapiens
ccactcttctc

SEQ ID NO: 551562 - DNA, 16 bp, Homo sapiens
ccactgaatctgtaca

SEQ ID NO: 551563 - DNA, 14 bp, Homo sapiens
ccactgcccctgca

SEQ ID NO: 551564 - DNA, 17 bp, Homo sapiens
ccactggctgtgggctc

SEQ ID NO: 551565 - DNA, 21 bp, Homo sapiens
ccactggctgtgggctccctt

SEQ ID NO: 551566 - DNA, 15 bp, Homo sapiens
ccactgtatttgtta

SEQ ID NO: 551567 - DNA, 12 bp, Homo sapiens
ccacttttccag

SEQ ID NO: 551568 - DNA, 17 bp, Homo sapiens
ccacttttccagtattt

SEQ ID NO: 551569 - DNA, 18 bp, Homo sapiens
ccagaaatgccgctgtgt

SEQ ID NO: 551570 - DNA, 16 bp, Homo sapiens
ccagaactctgcctgc

SEQ ID NO: 551571 - DNA, 20 bp, Homo sapiens
ccagaactctgcctgccctt

SEQ ID NO: 551572 - DNA, 15 bp, Homo sapiens
ccagaactcttcctc

SEQ ID NO: 551573 - DNA, 13 bp, Homo sapiens
ccagaagcagcag

SEQ ID NO: 551574 - DNA, 14 bp, Homo sapiens
ccagaagcagcagc

SEQ ID NO: 551575 - DNA, 18 bp, Homo sapiens
ccagaagctcaaggctgc

SEQ ID NO: 551576 - DNA, 20 bp, Homo sapiens
ccagaagctcaaggctgcag

SEQ ID NO: 551577 - DNA, 17 bp, Homo sapiens
ccagaaggaatcttctc

SEQ ID NO: 551578 - DNA, 16 bp, Homo sapiens
ccagaagtagctttgc

SEQ ID NO: 551579 - DNA, 18 bp, Homo sapiens
ccagacaacagcccaggc

SEQ ID NO: 551580 - DNA, 12 bp, Homo sapiens
ccagacacaaac

SEQ ID NO: 551581 - DNA, 17 bp, Homo sapiens
ccagaccagtagtgacc

SEQ ID NO: 551582 - DNA, 12 bp, Homo sapiens
ccagaccccatc

SEQ ID NO: 551583 - DNA, 17 bp, Homo sapiens
ccagaccccatccagcc

SEQ ID NO: 551584 - DNA, 17 bp, Homo sapiens
ccagacttgggagcttt

SEQ ID NO: 551585 - DNA, 16 bp, Homo sapiens
ccagagcagagtttac

SEQ ID NO: 551586 - DNA, 18 bp, Homo sapiens
ccagagcatttccaacac

SEQ ID NO: 551587 - DNA, 16 bp, Homo sapiens
ccagagctcccaggac

SEQ ID NO: 551588 - DNA, 17 bp, Homo sapiens
ccagagctcccaggacg

SEQ ID NO: 551589 - DNA, 17 bp, Homo sapiens
ccagaggaacctgaggc

SEQ ID NO: 551590 - DNA, 19 bp, Homo sapiens
ccagaggggcggggccagg

SEQ ID NO: 551591 - DNA, 21 bp, Homo sapiens
ccagaggggcggggccaggat

SEQ ID NO: 551592 - DNA, 16 bp, Homo sapiens
ccagaggtgagggagg

SEQ ID NO: 551593 - DNA, 17 bp, Homo sapiens
ccagaggtgagggaggc

SEQ ID NO: 551594 - DNA, 13 bp, Homo sapiens
ccagatcagccag

SEQ ID NO: 551595 - DNA, 15 bp, Homo sapiens
ccagatccaggaaca

SEQ ID NO: 551596 - DNA, 15 bp, Homo sapiens
ccagatgaaggaaag

SEQ ID NO: 551597 - DNA, 22 bp, Homo sapiens
ccagatgatccttgcacagaca

SEQ ID NO: 551598 - DNA, 19 bp, Homo sapiens
ccagattcacttctgaatt

SEQ ID NO: 551599 - DNA, 20 bp, Homo sapiens
ccagcaccaccctccttccc

SEQ ID NO: 551600 - DNA, 15 bp, Homo sapiens
ccagcacccccacgc

SEQ ID NO: 551601 - DNA, 23 bp, Homo sapiens
ccagcaggcgtcaccatccacct

SEQ ID NO: 551602 - DNA, 16 bp, Homo sapiens
ccagcccagaggccga

SEQ ID NO: 551603 - DNA, 19 bp, Homo sapiens
ccagccccaccctgttttg

SEQ ID NO: 551604 - DNA, 15 bp, Homo sapiens
ccagcccttcctctg

SEQ ID NO: 551605 - DNA, 14 bp, Homo sapiens
ccagcctctttccc

SEQ ID NO: 551606 - DNA, 21 bp, Homo sapiens
ccagcctggaaacctgtctga

SEQ ID NO: 551607 - DNA, 17 bp, Homo sapiens
ccagcgagtctggagac

SEQ ID NO: 551608 - DNA, 14 bp, Homo sapiens
ccagctctcccctg

SEQ ID NO: 551609 - DNA, 16 bp, Homo sapiens
cctggagatggggaga

SEQ ID NO: 551610 - DNA, 14 bp, Homo sapiens
cctggagcccggca

SEQ ID NO: 551611 - DNA, 13 bp, Homo sapiens
cctggcaggcagg

SEQ ID NO: 551612 - DNA, 21 bp, Homo sapiens
cctggcaggcaggggccctgc

SEQ ID NO: 551613 - DNA, 12 bp, Homo sapiens
cctggcagggca

SEQ ID NO: 551614 - DNA, 22 bp, Homo sapiens
cctggcagggcaggcagagctc

SEQ ID NO: 551615 - DNA, 13 bp, Homo sapiens
cctggccagacca

SEQ ID NO: 551616 - DNA, 18 bp, Homo sapiens
cctggcccctcccacatc

SEQ ID NO: 551617 - DNA, 17 bp, Homo sapiens
cctggcctgtctcggaa

SEQ ID NO: 551618 - DNA, 13 bp, Homo sapiens
cctggcctgtctg

SEQ ID NO: 551619 - DNA, 13 bp, Homo sapiens
cctggcttcctta

SEQ ID NO: 551620 - DNA, 15 bp, Homo sapiens
cctggcttccttact

SEQ ID NO: 551621 - DNA, 17 bp, Homo sapiens
cctgggagatgctggga

SEQ ID NO: 551622 - DNA, 18 bp, Homo sapiens
cctgggataggggcagag

SEQ ID NO: 551623 - DNA, 14 bp, Homo sapiens
cctgggcatcccca

SEQ ID NO: 551624 - DNA, 23 bp, Homo sapiens
cctgggcatgcccagcccctggt

SEQ ID NO: 551625 - DNA, 21 bp, Homo sapiens
cctgggccagggtctcgtcag

SEQ ID NO: 551626 - DNA, 19 bp, Homo sapiens
cctgggggccccaggatgg

SEQ ID NO: 551627 - DNA, 19 bp, Homo sapiens
cctgggggcctgacctccc

SEQ ID NO: 551628 - DNA, 13 bp, Homo sapiens
cctgggggctgct

SEQ ID NO: 551629 - DNA, 16 bp, Homo sapiens
cctgggggctgctgca

SEQ ID NO: 551630 - DNA, 18 bp, Homo sapiens
cctgggggctgctgcact

SEQ ID NO: 551631 - DNA, 19 bp, Homo sapiens
cctgggggctgctgcactg

SEQ ID NO: 551632 - DNA, 15 bp, Homo sapiens
cctgggggctggagc

SEQ ID NO: 551633 - DNA, 21 bp, Homo sapiens
cctggggtttccacacaggcc

SEQ ID NO: 551634 - DNA, 21 bp, Homo sapiens
cctgggtaacaaagtgagacc

SEQ ID NO: 551635 - DNA, 14 bp, Homo sapiens
cctggtcctgcact

SEQ ID NO: 551636 - DNA, 18 bp, Homo sapiens
cctggtctcctgccccca

SEQ ID NO: 551637 - DNA, 19 bp, Homo sapiens
cctggtctcctgcccccac

SEQ ID NO: 551638 - DNA, 20 bp, Homo sapiens
cctggttccggaatcctgtc

SEQ ID NO: 551639 - DNA, 21 bp, Homo sapiens
cctggttccggaatcctgtcc

SEQ ID NO: 551640 - DNA, 19 bp, Homo sapiens
cctgtaatagcctcacctt

SEQ ID NO: 551641 - DNA, 21 bp, Homo sapiens
cctgtacaaaagggacatgaa

SEQ ID NO: 551642 - DNA, 19 bp, Homo sapiens
cctgtattcctgacctccg

SEQ ID NO: 551643 - DNA, 14 bp, Homo sapiens
cctgtcaaacatta

SEQ ID NO: 551644 - DNA, 21 bp, Homo sapiens
cctgtctctacaaaaaaaatc

SEQ ID NO: 551645 - DNA, 18 bp, Homo sapiens
cctgtgaccggggtcctg

SEQ ID NO: 551646 - DNA, 20 bp, Homo sapiens
cctgtgaccggggtcctgag

SEQ ID NO: 551647 - DNA, 16 bp, Homo sapiens
cctgtggcctgccagt

SEQ ID NO: 551648 - DNA, 17 bp, Homo sapiens
cctgtgtcagtttatgt

SEQ ID NO: 551649 - DNA, 21 bp, Homo sapiens
cctgttacctaattagagcag

SEQ ID NO: 551650 - DNA, 14 bp, Homo sapiens
cctgttctgtgtct

SEQ ID NO: 551651 - DNA, 17 bp, Homo sapiens
cctgttgtctgaaacat

SEQ ID NO: 551652 - DNA, 18 bp, Homo sapiens
ccttaaaaaaaaaaatga

SEQ ID NO: 551653 - DNA, 18 bp, Homo sapiens
ccttaaaatttgaaacat

SEQ ID NO: 551654 - DNA, 20 bp, Homo sapiens
ccttaacttactatttagat

SEQ ID NO: 551655 - DNA, 14 bp, Homo sapiens
ccttaagctgcagg

SEQ ID NO: 551656 - DNA, 17 bp, Homo sapiens
ccttacaaatgattgct

SEQ ID NO: 551657 - DNA, 20 bp, Homo sapiens
ccttaggggtaattggtaat

SEQ ID NO: 551658 - DNA, 16 bp, Homo sapiens
ccttagggttttctct

SEQ ID NO: 551659 - DNA, 15 bp, Homo sapiens
ccttatctagctgca

SEQ ID NO: 551660 - DNA, 14 bp, Homo sapiens
ccttcaacaaggct

SEQ ID NO: 551661 - DNA, 17 bp, Homo sapiens
ccttcagtttttgtgtt

SEQ ID NO: 551662 - DNA, 22 bp, Homo sapiens
ccttccacagttatcttagctg

SEQ ID NO: 551663 - DNA, 17 bp, Homo sapiens
ccttccacctctgggag

SEQ ID NO: 551664 - DNA, 24 bp, Homo sapiens
ccttccaggcgtagggccagggct

SEQ ID NO: 551665 - DNA, 22 bp, Homo sapiens
ccttcccactctgtcgagcctg

SEQ ID NO: 551666 - DNA, 18 bp, Homo sapiens
ccttcccagctgcccctc

SEQ ID NO: 551667 - DNA, 15 bp, Homo sapiens
ccttccccttccttc

SEQ ID NO: 551668 - DNA, 20 bp, Homo sapiens
ccttccctagttctttgcat

SEQ ID NO: 551669 - DNA, 21 bp, Homo sapiens
ccttccctgacactgtctgct

SEQ ID NO: 551670 - DNA, 23 bp, Homo sapiens
ccttcctccatcctcctccttcc

SEQ ID NO: 551671 - DNA, 14 bp, Homo sapiens
ccttctacctgcag

SEQ ID NO: 551672 - DNA, 16 bp, Homo sapiens
ccttctctatatcatg

SEQ ID NO: 551673 - DNA, 12 bp, Homo sapiens
ccttctcttcca

SEQ ID NO: 551674 - DNA, 14 bp, Homo sapiens
ccttctcttccagg

SEQ ID NO: 551675 - DNA, 17 bp, Homo sapiens
ccttctgtcgtccccag

SEQ ID NO: 551676 - DNA, 18 bp, Homo sapiens
ccttctgtcgtccccaga

SEQ ID NO: 551677 - DNA, 21 bp, Homo sapiens
ccttctgtcgtccccagacca

SEQ ID NO: 551678 - DNA, 17 bp, Homo sapiens
ccttctgttgatgctgt

SEQ ID NO: 551679 - DNA, 20 bp, Homo sapiens
ccttgaggacctccacctgg

SEQ ID NO: 551680 - DNA, 21 bp, Homo sapiens
ccttgaggacctccacctggg

SEQ ID NO: 551681 - DNA, 15 bp, Homo sapiens
ccttgcatacaaaca

SEQ ID NO: 551682 - DNA, 23 bp, Homo sapiens
ccttgcccactcctgctctgctc

SEQ ID NO: 551683 - DNA, 21 bp, Homo sapiens
ccttgcgcttttgctggtcac

SEQ ID NO: 551684 - DNA, 22 bp, Homo sapiens
ccttggacggggacacggcctc

SEQ ID NO: 551685 - DNA, 15 bp, Homo sapiens
ccttgggctctgctg

SEQ ID NO: 551686 - DNA, 22 bp, Homo sapiens
ccttgggctgggacttcttacc

SEQ ID NO: 551687 - DNA, 23 bp, Homo sapiens
ccttgtaggtattacatccctgg

SEQ ID NO: 551688 - DNA, 20 bp, Homo sapiens
cctttaatcaggtcctgctc

SEQ ID NO: 551689 - DNA, 21 bp, Homo sapiens
cctttaatcaggtcctgctca

SEQ ID NO: 551690 - DNA, 16 bp, Homo sapiens
cctttaccctcatctg

SEQ ID NO: 551691 - DNA, 20 bp, Homo sapiens
cctttatcatgtgtttctgt

SEQ ID NO: 551692 - DNA, 18 bp, Homo sapiens
cctttcacttctttccct

SEQ ID NO: 551693 - DNA, 22 bp, Homo sapiens
cctttcacttctttcccttcct

SEQ ID NO: 551694 - DNA, 17 bp, Homo sapiens
cctttcagatgaccttt

SEQ ID NO: 551695 - DNA, 15 bp, Homo sapiens
cctttcttcctcatt

SEQ ID NO: 551696 - DNA, 17 bp, Homo sapiens
cctttcttctcccccat

SEQ ID NO: 551697 - DNA, 13 bp, Homo sapiens
cctttgtcctcct

SEQ ID NO: 551698 - DNA, 18 bp, Homo sapiens
cctttgtgagcctatgat

SEQ ID NO: 551699 - DNA, 19 bp, Homo sapiens
ccttttgtagctgtcatgg

SEQ ID NO: 551700 - DNA, 11 bp, Homo sapiens
ccttttgtgtt

SEQ ID NO: 551701 - DNA, 12 bp, Homo sapiens
cgaaaatcattg

SEQ ID NO: 551702 - DNA, 23 bp, Homo sapiens
cgaaaggcgagtccaggagctca

SEQ ID NO: 551703 - DNA, 16 bp, Homo sapiens
cgaaagttagtaggat

SEQ ID NO: 551704 - DNA, 18 bp, Homo sapiens
cgaagaactaataaatgg

SEQ ID NO: 551705 - DNA, 19 bp, Homo sapiens
cgaaggtctctctggctct

SEQ ID NO: 551706 - DNA, 13 bp, Homo sapiens
cgaagtttgcaac

SEQ ID NO: 551707 - DNA, 19 bp, Homo sapiens
cgaagtttgcaacctttat

SEQ ID NO: 551708 - DNA, 20 bp, Homo sapiens
cgaatggagtccagacctgg

SEQ ID NO: 551709 - DNA, 16 bp, Homo sapiens
cgactagacacacaaa

SEQ ID NO: 551710 - DNA, 20 bp, Homo sapiens
cgactagacacacaaagcag

SEQ ID NO: 551711 - DNA, 19 bp, Homo sapiens
cgagccgagctctcctggg

SEQ ID NO: 551712 - DNA, 22 bp, Homo sapiens
cgaggacagcaatgcagagagg

SEQ ID NO: 551713 - DNA, 14 bp, Homo sapiens
cgaggacccatgaa

SEQ ID NO: 551714 - DNA, 13 bp, Homo sapiens
cgagtctggagac

SEQ ID NO: 551715 - DNA, 20 bp, Homo sapiens
cgagtctggagaccaggact

SEQ ID NO: 551716 - DNA, 15 bp, Homo sapiens
cgagtgtggagctgc

SEQ ID NO: 551717 - DNA, 21 bp, Homo sapiens
cgagtgtggagctgcttccag

SEQ ID NO: 551718 - DNA, 17 bp, Homo sapiens
cgagtgtgtttcatcct

SEQ ID NO: 551719 - DNA, 16 bp, Homo sapiens
cgcaattgtatatata

SEQ ID NO: 551720 - DNA, 20 bp, Homo sapiens
cgcaattgtatatatatgtg

SEQ ID NO: 551721 - DNA, 13 bp, Homo sapiens
cgcacccggcagc

SEQ ID NO: 551722 - DNA, 13 bp, Homo sapiens
cgcacgcacacac

SEQ ID NO: 551723 - DNA, 14 bp, Homo sapiens
cgcacgcacccaca

SEQ ID NO: 551724 - DNA, 18 bp, Homo sapiens
cgcagcatccgaccaggt

SEQ ID NO: 551725 - DNA, 20 bp, Homo sapiens
cgcaggccctccgcggggga

SEQ ID NO: 551726 - DNA, 16 bp, Homo sapiens
cgcaggcctccctgcc

SEQ ID NO: 551727 - DNA, 17 bp, Homo sapiens
cgcataggaaaagaatc

SEQ ID NO: 551728 - DNA, 18 bp, Homo sapiens
cgcatgtacaaaaacaca

SEQ ID NO: 551729 - DNA, 22 bp, Homo sapiens
cgcatgtacaaaaacacaaata

SEQ ID NO: 551730 - DNA, 16 bp, Homo sapiens
cgccagggaccccaga

SEQ ID NO: 551731 - DNA, 19 bp, Homo sapiens
cgccagggaccccagaatc

SEQ ID NO: 551732 - DNA, 20 bp, Homo sapiens
cgccttccacctctgggagc

SEQ ID NO: 551733 - DNA, 17 bp, Homo sapiens
cgccttctacctgcagg

SEQ ID NO: 551734 - DNA, 14 bp, Homo sapiens
cgcgggggacagga

SEQ ID NO: 551735 - DNA, 19 bp, Homo sapiens
cgctaacttgcttaaatgt

SEQ ID NO: 551736 - DNA, 20 bp, Homo sapiens
cgctaacttgcttaaatgtg

SEQ ID NO: 551737 - DNA, 14 bp, Homo sapiens
cgctatcttcacat

SEQ ID NO: 551738 - DNA, 18 bp, Homo sapiens
cgctctgccatcagcccc

SEQ ID NO: 551739 - DNA, 10 bp, Homo sapiens
cgctggcccc

SEQ ID NO: 551740 - DNA, 16 bp, Homo sapiens
cgctggcccccactgg

SEQ ID NO: 551741 - DNA, 17 bp, Homo sapiens
cgctggcccccactggc

SEQ ID NO: 551742 - DNA, 18 bp, Homo sapiens
cgctggcccccactggct

SEQ ID NO: 551743 - DNA, 20 bp, Homo sapiens
cgctggcccccactggctgt

SEQ ID NO: 551744 - DNA, 11 bp, Homo sapiens
cgcttcacagg

SEQ ID NO: 551745 - DNA, 20 bp, Homo sapiens
ctccttcccactcttctcat

SEQ ID NO: 551746 - DNA, 18 bp, Homo sapiens
ctccttcccagctgcccc

SEQ ID NO: 551747 - DNA, 19 bp, Homo sapiens
ctccttcccagctgcccct

SEQ ID NO: 551748 - DNA, 22 bp, Homo sapiens
ctccttcccagctgcccctccc

SEQ ID NO: 551749 - DNA, 16 bp, Homo sapiens
ctccttgggctgggac

SEQ ID NO: 551750 - DNA, 18 bp, Homo sapiens
ctcctttaccctcatctg

SEQ ID NO: 551751 - DNA, 16 bp, Homo sapiens
ctccttttccagagca

SEQ ID NO: 551752 - DNA, 17 bp, Homo sapiens
ctccttttccagagcat

SEQ ID NO: 551753 - DNA, 13 bp, Homo sapiens
ctccttttcccaa

SEQ ID NO: 551754 - DNA, 17 bp, Homo sapiens
ctcgatgttcatggaat

SEQ ID NO: 551755 - DNA, 20 bp, Homo sapiens
ctcgccttcggcctctcttg

SEQ ID NO: 551756 - DNA, 23 bp, Homo sapiens
ctcgccttcggcctctcttggaa

SEQ ID NO: 551757 - DNA, 21 bp, Homo sapiens
ctcgctggcccccactggctg

SEQ ID NO: 551758 - DNA, 16 bp, Homo sapiens
ctcggagttcttcttg

SEQ ID NO: 551759 - DNA, 23 bp, Homo sapiens
ctcggcagcccttccaaactctt

SEQ ID NO: 551760 - DNA, 15 bp, Homo sapiens
ctcggggcaggaagt

SEQ ID NO: 551761 - DNA, 18 bp, Homo sapiens
ctcgtcaggaggtgcctg

SEQ ID NO: 551762 - DNA, 16 bp, Homo sapiens
ctctaactgtgcaaag

SEQ ID NO: 551763 - DNA, 19 bp, Homo sapiens
ctctaagatgttatatttt

SEQ ID NO: 551764 - DNA, 23 bp, Homo sapiens
ctctaagatgttatatttttctt

SEQ ID NO: 551765 - DNA, 15 bp, Homo sapiens
ctctacccctttctt

SEQ ID NO: 551766 - DNA, 16 bp, Homo sapiens
ctctacccctttcttc

SEQ ID NO: 551767 - DNA, 22 bp, Homo sapiens
ctctagaaaaaagaaaagtgtt

SEQ ID NO: 551768 - DNA, 18 bp, Homo sapiens
ctctagagaagtggactg

SEQ ID NO: 551769 - DNA, 21 bp, Homo sapiens
ctctagccggagtgacagagt

SEQ ID NO: 551770 - DNA, 15 bp, Homo sapiens
ctctatcctgggctt

SEQ ID NO: 551771 - DNA, 19 bp, Homo sapiens
ctctatgccccaaatatag

SEQ ID NO: 551772 - DNA, 17 bp, Homo sapiens
ctctatttccccctttc

SEQ ID NO: 551773 - DNA, 18 bp, Homo sapiens
ctctcatccttttctcct

SEQ ID NO: 551774 - DNA, 19 bp, Homo sapiens
ctctcatgctgcccctgcc

SEQ ID NO: 551775 - DNA, 16 bp, Homo sapiens
ctctcattcccaggca

SEQ ID NO: 551776 - DNA, 14 bp, Homo sapiens
ctctccaggcacca

SEQ ID NO: 551777 - DNA, 13 bp, Homo sapiens
ctctcccaactct

SEQ ID NO: 551778 - DNA, 14 bp, Homo sapiens
ctctcccaactctt

SEQ ID NO: 551779 - DNA, 13 bp, Homo sapiens
ctctcctgggcca

SEQ ID NO: 551780 - DNA, 13 bp, Homo sapiens
ctctcgcacacct

SEQ ID NO: 551781 - DNA, 15 bp, Homo sapiens
ctctctaacctcctt

SEQ ID NO: 551782 - DNA, 18 bp, Homo sapiens
ctctctaacctcctttac

SEQ ID NO: 551783 - DNA, 17 bp, Homo sapiens
ctctctccagtcttcca

SEQ ID NO: 551784 - DNA, 14 bp, Homo sapiens
ctctctgctctgac

SEQ ID NO: 551785 - DNA, 12 bp, Homo sapiens
ctctctggctct

SEQ ID NO: 551786 - DNA, 16 bp, Homo sapiens
ctctctgtataaacat

SEQ ID NO: 551787 - DNA, 17 bp, Homo sapiens
ctctcttggaactgcac

SEQ ID NO: 551788 - DNA, 20 bp, Homo sapiens
ctctcttggaactgcaccac

SEQ ID NO: 551789 - DNA, 14 bp, Homo sapiens
ctctgaactgctgc

SEQ ID NO: 551790 - DNA, 18 bp, Homo sapiens
ctctgaactgctgctggt

SEQ ID NO: 551791 - DNA, 17 bp, Homo sapiens
ctctgaatgctatttgt

SEQ ID NO: 551792 - DNA, 18 bp, Homo sapiens
ctctgaatgctatttgtg

SEQ ID NO: 551793 - DNA, 19 bp, Homo sapiens
ctctgaatgctatttgtgt

SEQ ID NO: 551794 - DNA, 14 bp, Homo sapiens
ctctgaattttaaa

SEQ ID NO: 551795 - DNA, 16 bp, Homo sapiens
ctctgagatcctggag

SEQ ID NO: 551796 - DNA, 13 bp, Homo sapiens
ctctgagtcctca

SEQ ID NO: 551797 - DNA, 18 bp, Homo sapiens
ctctgatgtaaatgaagt

SEQ ID NO: 551798 - DNA, 15 bp, Homo sapiens
ctctgattctatgta

SEQ ID NO: 551799 - DNA, 13 bp, Homo sapiens
ctctgccatcagc

SEQ ID NO: 551800 - DNA, 16 bp, Homo sapiens
ctctgccatcagcccc

SEQ ID NO: 551801 - DNA, 17 bp, Homo sapiens
ctctgccatcagcccct

SEQ ID NO: 551802 - DNA, 22 bp, Homo sapiens
ctctgcccagcttttcattgct

SEQ ID NO: 551803 - DNA, 14 bp, Homo sapiens
ctctgccttccagg

SEQ ID NO: 551804 - DNA, 20 bp, Homo sapiens
ctctgcgtcccactgagtct

SEQ ID NO: 551805 - DNA, 17 bp, Homo sapiens
ctctgctaaattgatgt

SEQ ID NO: 551806 - DNA, 20 bp, Homo sapiens
ctctgctaaattgatgttga

SEQ ID NO: 551807 - DNA, 12 bp, Homo sapiens
ctctgctccccc

SEQ ID NO: 551808 - DNA, 11 bp, Homo sapiens
ctctgctctga

SEQ ID NO: 551809 - DNA, 14 bp, Homo sapiens
ctctggctctagga

SEQ ID NO: 551810 - DNA, 18 bp, Homo sapiens
ctctgtataaacattaaa

SEQ ID NO: 551811 - DNA, 13 bp, Homo sapiens
ctctgtggggcca

SEQ ID NO: 551812 - DNA, 18 bp, Homo sapiens
ctcttagtctaggtcctt

SEQ ID NO: 551813 - DNA, 14 bp, Homo sapiens
ctcttccaggcagc

SEQ ID NO: 551814 - DNA, 15 bp, Homo sapiens
ctcttccaggcagcc

SEQ ID NO: 551815 - DNA, 21 bp, Homo sapiens
ctcttccctggtaagaaaaag

SEQ ID NO: 551816 - DNA, 14 bp, Homo sapiens
ctcttcctccccag

SEQ ID NO: 551817 - DNA, 16 bp, Homo sapiens
ctcttcctccccagga

SEQ ID NO: 551818 - DNA, 17 bp, Homo sapiens
ctcttctccccttccat

SEQ ID NO: 551819 - DNA, 14 bp, Homo sapiens
ctcttctctctgct

SEQ ID NO: 551820 - DNA, 17 bp, Homo sapiens
ctcttctctctgctctg

SEQ ID NO: 551821 - DNA, 14 bp, Homo sapiens
ctcttctggaatgg

SEQ ID NO: 551822 - DNA, 11 bp, Homo sapiens
ctcttcttcct

SEQ ID NO: 551823 - DNA, 12 bp, Homo sapiens
ctcttcttcctt

SEQ ID NO: 551824 - DNA, 15 bp, Homo sapiens
ctcttgggcaatatt

SEQ ID NO: 551825 - DNA, 16 bp, Homo sapiens
ctcttgggcaatattc

SEQ ID NO: 551826 - DNA, 13 bp, Homo sapiens
ctcttgtttctcc

SEQ ID NO: 551827 - DNA, 17 bp, Homo sapiens
ctctttcccttccagtt

SEQ ID NO: 551828 - DNA, 17 bp, Homo sapiens
ctctttcggaaatgatt

SEQ ID NO: 551829 - DNA, 15 bp, Homo sapiens
ctctttcttcctttc

SEQ ID NO: 551830 - DNA, 17 bp, Homo sapiens
ctctttcttcctttcta

SEQ ID NO: 551831 - DNA, 13 bp, Homo sapiens
ctctttggaaata

SEQ ID NO: 551832 - DNA, 14 bp, Homo sapiens
ctcttttgctctct

SEQ ID NO: 551833 - DNA, 15 bp, Homo sapiens
ctcttttttacaaag

SEQ ID NO: 551834 - DNA, 19 bp, Homo sapiens
ctgaaaactggaataagaa

SEQ ID NO: 551835 - DNA, 21 bp, Homo sapiens
ctgaaaactggaataagaagc

SEQ ID NO: 551836 - DNA, 22 bp, Homo sapiens
ctgaaaactggaataagaagca

SEQ ID NO: 551837 - DNA, 16 bp, Homo sapiens
ctgaaagcaacagctg

SEQ ID NO: 551838 - DNA, 17 bp, Homo sapiens
ctgaaagcaacagctgg

SEQ ID NO: 551839 - DNA, 16 bp, Homo sapiens
ctgaaagcacaggaga

SEQ ID NO: 551840 - DNA, 20 bp, Homo sapiens
ctgaaatgtgtgtgatgtga

SEQ ID NO: 551841 - DNA, 14 bp, Homo sapiens
ctgaaatgtttcca

SEQ ID NO: 551842 - DNA, 22 bp, Homo sapiens
ctgaacactgaagtcagttctc

SEQ ID NO: 551843 - DNA, 13 bp, Homo sapiens
ctgaacctgtctt

SEQ ID NO: 551844 - DNA, 16 bp, Homo sapiens
ctgaacctgtcttttg

SEQ ID NO: 551845 - DNA, 21 bp, Homo sapiens
ctgaactcctgccatagtctt

SEQ ID NO: 551846 - DNA, 15 bp, Homo sapiens
ctgaactgctgctgg

SEQ ID NO: 551847 - DNA, 16 bp, Homo sapiens
ctgaactgctgctggt

SEQ ID NO: 551848 - DNA, 18 bp, Homo sapiens
ctgaactgctgctggtca

SEQ ID NO: 551849 - DNA, 19 bp, Homo sapiens
ctgaacttttcaaaataaa

SEQ ID NO: 551850 - DNA, 20 bp, Homo sapiens
ctgaacttttcaaaataaag

SEQ ID NO: 551851 - DNA, 21 bp, Homo sapiens
ctgaacttttcaaaataaagc

SEQ ID NO: 551852 - DNA, 22 bp, Homo sapiens
ctgaagagacagttatttatag

SEQ ID NO: 551853 - DNA, 22 bp, Homo sapiens
ctgaagattgtttatctagatg

SEQ ID NO: 551854 - DNA, 16 bp, Homo sapiens
ctgaagcagagtcaag

SEQ ID NO: 551855 - DNA, 13 bp, Homo sapiens
ctgaagccagctc

SEQ ID NO: 551856 - DNA, 14 bp, Homo sapiens
ctgaagccagctcc

SEQ ID NO: 551857 - DNA, 14 bp, Homo sapiens
ctgaataaatcatg

SEQ ID NO: 551858 - DNA, 22 bp, Homo sapiens
ctgaatttggggctacttatat

SEQ ID NO: 551859 - DNA, 18 bp, Homo sapiens
ctgacagaatctctgaat

SEQ ID NO: 551860 - DNA, 17 bp, Homo sapiens
ctgacagcaaacacagt

SEQ ID NO: 551861 - DNA, 15 bp, Homo sapiens
ctgacagccagaact

SEQ ID NO: 551862 - DNA, 16 bp, Homo sapiens
ctgacagccagaactc

SEQ ID NO: 551863 - DNA, 22 bp, Homo sapiens
ctgacatatttcataagcacat

SEQ ID NO: 551864 - DNA, 16 bp, Homo sapiens
ctgaccacagacactc

SEQ ID NO: 551865 - DNA, 19 bp, Homo sapiens
ctgacccccctcaggaccc

SEQ ID NO: 551866 - DNA, 18 bp, Homo sapiens
ctgacctccccctccttc

SEQ ID NO: 551867 - DNA, 15 bp, Homo sapiens
ctgagaagcctcatg

SEQ ID NO: 551868 - DNA, 22 bp, Homo sapiens
ctgagaagcctcatgggagtca

SEQ ID NO: 551869 - DNA, 16 bp, Homo sapiens
ctgagaccatttaaca

SEQ ID NO: 551870 - DNA, 22 bp, Homo sapiens
ctgagaccatttaacatgcaac

SEQ ID NO: 551871 - DNA, 19 bp, Homo sapiens
ctgagagaggctaaaatgt

SEQ ID NO: 551872 - DNA, 21 bp, Homo sapiens
ctgagagaggctaaaatgttt

SEQ ID NO: 551873 - DNA, 15 bp, Homo sapiens
ctgagagcagaatga

SEQ ID NO: 551874 - DNA, 20 bp, Homo sapiens
ctgagatgcctggtgagcat

SEQ ID NO: 551875 - DNA, 22 bp, Homo sapiens
ctgagcagtgatattctttgtt

SEQ ID NO: 551876 - DNA, 14 bp, Homo sapiens
ctgagccttctgag

SEQ ID NO: 551877 - DNA, 15 bp, Homo sapiens
ctgagccttctgagc

SEQ ID NO: 551878 - DNA, 17 bp, Homo sapiens
ctgagccttctgagctg

SEQ ID NO: 551879 - DNA, 13 bp, Homo sapiens
ctgagctctgacc

SEQ ID NO: 551880 - DNA, 16 bp, Homo sapiens
ctgagctggcctctca

SEQ ID NO: 551881 - DNA, 14 bp, Homo sapiens
ctgaggacaaggaa

SEQ ID NO: 551882 - DNA, 19 bp, Homo sapiens
ctgaggacatggcttctga

SEQ ID NO: 551883 - DNA, 12 bp, Homo sapiens
cttggaaaatgt

SEQ ID NO: 551884 - DNA, 21 bp, Homo sapiens
cttggaacagtgtttacttta

SEQ ID NO: 551885 - DNA, 16 bp, Homo sapiens
cttggaactgcaccac

SEQ ID NO: 551886 - DNA, 14 bp, Homo sapiens
cttggacggggaca

SEQ ID NO: 551887 - DNA, 17 bp, Homo sapiens
cttggcaccaataaagg

SEQ ID NO: 551888 - DNA, 19 bp, Homo sapiens
cttggcaccaataaaggag

SEQ ID NO: 551889 - DNA, 23 bp, Homo sapiens
cttggcaggtaggaatattatat

SEQ ID NO: 551890 - DNA, 16 bp, Homo sapiens
cttggctcagacacct

SEQ ID NO: 551891 - DNA, 16 bp, Homo sapiens
cttgggatgggcacag

SEQ ID NO: 551892 - DNA, 19 bp, Homo sapiens
cttgggatgggcacaggct

SEQ ID NO: 551893 - DNA, 22 bp, Homo sapiens
cttggggtcaggttgacaggag

SEQ ID NO: 551894 - DNA, 18 bp, Homo sapiens
cttggtacttgctgctat

SEQ ID NO: 551895 - DNA, 19 bp, Homo sapiens
cttggtacttgctgctatt

SEQ ID NO: 551896 - DNA, 23 bp, Homo sapiens
cttggtcacaaagctatttaagt

SEQ ID NO: 551897 - DNA, 21 bp, Homo sapiens
cttggtttccatcaaagccct

SEQ ID NO: 551898 - DNA, 14 bp, Homo sapiens
cttgtaatgtaact

SEQ ID NO: 551899 - DNA, 15 bp, Homo sapiens
cttgtaatgtaactg

SEQ ID NO: 551900 - DNA, 18 bp, Homo sapiens
cttgtataaatgtatata

SEQ ID NO: 551901 - DNA, 19 bp, Homo sapiens
cttgtataaatgtatatac

SEQ ID NO: 551902 - DNA, 23 bp, Homo sapiens
cttgtataaatgtatatacacat

SEQ ID NO: 551903 - DNA, 14 bp, Homo sapiens
cttgtctaaagatc

SEQ ID NO: 551904 - DNA, 11 bp, Homo sapiens
cttgtcttaaa

SEQ ID NO: 551905 - DNA, 18 bp, Homo sapiens
cttgtcttaaataaaaga

SEQ ID NO: 551906 - DNA, 22 bp, Homo sapiens
cttgtggctccacacacacaaa

SEQ ID NO: 551907 - DNA, 18 bp, Homo sapiens
cttgtgtaatttcctgct

SEQ ID NO: 551908 - DNA, 21 bp, Homo sapiens
cttgtgtaatttcctgctcct

SEQ ID NO: 551909 - DNA, 22 bp, Homo sapiens
cttgttatgttgtaatattttg

SEQ ID NO: 551910 - DNA, 13 bp, Homo sapiens
cttgttcttccaa

SEQ ID NO: 551911 - DNA, 16 bp, Homo sapiens
cttgttgtttcttgcc

SEQ ID NO: 551912 - DNA, 13 bp, Homo sapiens
cttgttttgcttc

SEQ ID NO: 551913 - DNA, 14 bp, Homo sapiens
cttgttttgcttcc

SEQ ID NO: 551914 - DNA, 23 bp, Homo sapiens
cttgttttgcttcccctcccccc

SEQ ID NO: 551915 - DNA, 16 bp, Homo sapiens
ctttaaaaaaatccca

SEQ ID NO: 551916 - DNA, 20 bp, Homo sapiens
ctttaaatccttaatggcct

SEQ ID NO: 551917 - DNA, 15 bp, Homo sapiens
ctttaaatggggacg

SEQ ID NO: 551918 - DNA, 14 bp, Homo sapiens
ctttaaattgtgga

SEQ ID NO: 551919 - DNA, 19 bp, Homo sapiens
ctttaatatactccttaaa

SEQ ID NO: 551920 - DNA, 22 bp, Homo sapiens
ctttacagtcttttgtgtctgt

SEQ ID NO: 551921 - DNA, 19 bp, Homo sapiens
ctttaccatagcttaagaa

SEQ ID NO: 551922 - DNA, 14 bp, Homo sapiens
ctttagaaaaggca

SEQ ID NO: 551923 - DNA, 16 bp, Homo sapiens
ctttagaacaacataa

SEQ ID NO: 551924 - DNA, 18 bp, Homo sapiens
ctttagaacaacataaaa

SEQ ID NO: 551925 - DNA, 22 bp, Homo sapiens
ctttagaatagttaaattggct

SEQ ID NO: 551926 - DNA, 14 bp, Homo sapiens
ctttagagaagatg

SEQ ID NO: 551927 - DNA, 15 bp, Homo sapiens
ctttaggattgaagt

SEQ ID NO: 551928 - DNA, 19 bp, Homo sapiens
ctttaggtaaaaagcttaa

SEQ ID NO: 551929 - DNA, 23 bp, Homo sapiens
ctttaggtagtagaatctcagca

SEQ ID NO: 551930 - DNA, 19 bp, Homo sapiens
ctttataggataactgatg

SEQ ID NO: 551931 - DNA, 17 bp, Homo sapiens
ctttatattttgttgtt

SEQ ID NO: 551932 - DNA, 17 bp, Homo sapiens
ctttatcatgtgtttct

SEQ ID NO: 551933 - DNA, 21 bp, Homo sapiens
ctttatctaccaactttcaag

SEQ ID NO: 551934 - DNA, 16 bp, Homo sapiens
ctttatctcaacggaa

SEQ ID NO: 551935 - DNA, 14 bp, Homo sapiens
ctttatgtattctc

SEQ ID NO: 551936 - DNA, 18 bp, Homo sapiens
ctttatgtgatgtaacta

SEQ ID NO: 551937 - DNA, 14 bp, Homo sapiens
ctttatttctgtca

SEQ ID NO: 551938 - DNA, 13 bp, Homo sapiens
ctttcaagaactt

SEQ ID NO: 551939 - DNA, 13 bp, Homo sapiens
ctttcacttcttt

SEQ ID NO: 551940 - DNA, 14 bp, Homo sapiens
ctttcacttctttc

SEQ ID NO: 551941 - DNA, 20 bp, Homo sapiens
ctttcacttctttcccttcc

SEQ ID NO: 551942 - DNA, 14 bp, Homo sapiens
ctttcagcaggcag

SEQ ID NO: 551943 - DNA, 15 bp, Homo sapiens
ctttccatttctctc

SEQ ID NO: 551944 - DNA, 14 bp, Homo sapiens
ctttcccacactgt

SEQ ID NO: 551945 - DNA, 19 bp, Homo sapiens
ctttcccaccgccctccct

SEQ ID NO: 551946 - DNA, 14 bp, Homo sapiens
ctttcccttcctcc

SEQ ID NO: 551947 - DNA, 14 bp, Homo sapiens
ctttcctgtgccag

SEQ ID NO: 551948 - DNA, 16 bp, Homo sapiens
ctttccttcctctcat

SEQ ID NO: 551949 - DNA, 20 bp, Homo sapiens
ctttctccaaagttatccag

SEQ ID NO: 551950 - DNA, 19 bp, Homo sapiens
ctttctggggtttttctgt

SEQ ID NO: 551951 - DNA, 13 bp, Homo sapiens
ctttcttcctttc

SEQ ID NO: 551952 - DNA, 14 bp, Homo sapiens
ctttcttcctttct

SEQ ID NO: 551953 - DNA, 14 bp, Homo sapiens
ctttcttcttccca

SEQ ID NO: 551954 - DNA, 21 bp, Homo sapiens
ctttgaattttcattttacag

SEQ ID NO: 551955 - DNA, 17 bp, Homo sapiens
ctttgattcacatgttt

SEQ ID NO: 551956 - DNA, 22 bp, Homo sapiens
ctttgattcacatgttttcaaa

SEQ ID NO: 551957 - DNA, 14 bp, Homo sapiens
ctttgcacgtgctg

SEQ ID NO: 551958 - DNA, 20 bp, Homo sapiens
ctttggaaatagcatgacag

SEQ ID NO: 551959 - DNA, 16 bp, Homo sapiens
ctttggaaggtgacac

SEQ ID NO: 551960 - DNA, 16 bp, Homo sapiens
ctttgggcagatttgc

SEQ ID NO: 551961 - DNA, 19 bp, Homo sapiens
ctttgggcagatttgcaac

SEQ ID NO: 551962 - DNA, 15 bp, Homo sapiens
ctttgtaagagcaaa

SEQ ID NO: 551963 - DNA, 12 bp, Homo sapiens
ctttgtataaat

SEQ ID NO: 551964 - DNA, 13 bp, Homo sapiens
ctttgtataaatt

SEQ ID NO: 551965 - DNA, 14 bp, Homo sapiens
ctttgtataaattt

SEQ ID NO: 551966 - DNA, 22 bp, Homo sapiens
ctttgtcctaagagatttatct

SEQ ID NO: 551967 - DNA, 16 bp, Homo sapiens
ctttgtcctcctgctg

SEQ ID NO: 551968 - DNA, 18 bp, Homo sapiens
ctttgtctaagaaacatt

SEQ ID NO: 551969 - DNA, 19 bp, Homo sapiens
ctttgtctaagaaacattg

SEQ ID NO: 551970 - DNA, 20 bp, Homo sapiens
ctttgtctaagaaacattgg

SEQ ID NO: 551971 - DNA, 23 bp, Homo sapiens
ctttgtctaagaaacattggaag

SEQ ID NO: 551972 - DNA, 13 bp, Homo sapiens
ctttgttaattta

SEQ ID NO: 551973 - DNA, 15 bp, Homo sapiens
ctttgttaatttgga

SEQ ID NO: 551974 - DNA, 18 bp, Homo sapiens
ctttgttttttgttttca

SEQ ID NO: 551975 - DNA, 21 bp, Homo sapiens
ctttgtttttttttcctgtcc

SEQ ID NO: 551976 - DNA, 15 bp, Homo sapiens
cttttaaaaagtatt

SEQ ID NO: 551977 - DNA, 23 bp, Homo sapiens
cttttaaaaagtattgccaaaca

SEQ ID NO: 551978 - DNA, 14 bp, Homo sapiens
cttttaataaagta

SEQ ID NO: 551979 - DNA, 11 bp, Homo sapiens
cttttaatttt

SEQ ID NO: 551980 - DNA, 14 bp, Homo sapiens
cttttagtttttct

SEQ ID NO: 551981 - DNA, 22 bp, Homo sapiens
cttttataaaaaaaatgaaatg

SEQ ID NO: 551982 - DNA, 22 bp, Homo sapiens
cttttatgcgcaaatacaaaat

SEQ ID NO: 551983 - DNA, 17 bp, Homo sapiens
cttttattgtataatta

SEQ ID NO: 551984 - DNA, 16 bp, Homo sapiens
cttttccaacatacaa

SEQ ID NO: 551985 - DNA, 22 bp, Homo sapiens
cttttccaacatacaatttact

SEQ ID NO: 551986 - DNA, 16 bp, Homo sapiens
cttttccaacccatga

SEQ ID NO: 551987 - DNA, 21 bp, Homo sapiens
cttttccagagcattccagtc

SEQ ID NO: 551988 - DNA, 18 bp, Homo sapiens
cttttcccacctctttgg

SEQ ID NO: 551989 - DNA, 22 bp, Homo sapiens
cttttccctcggagttcttctt

SEQ ID NO: 551990 - DNA, 17 bp, Homo sapiens
cttttcctcgcttcttt

SEQ ID NO: 551991 - DNA, 15 bp, Homo sapiens
cttttccttgcatac

SEQ ID NO: 551992 - DNA, 22 bp, Homo sapiens
cttttctaaactaggctccttc

SEQ ID NO: 551993 - DNA, 17 bp, Homo sapiens
cttttgaaaagaccaag

SEQ ID NO: 551994 - DNA, 23 bp, Homo sapiens
cttttgcatagaataatgaagat

SEQ ID NO: 551995 - DNA, 14 bp, Homo sapiens
cttttgctctctca

SEQ ID NO: 551996 - DNA, 15 bp, Homo sapiens
cttttgggaaatgct

SEQ ID NO: 551997 - DNA, 21 bp, Homo sapiens
cttttgtagtcttatgaatag

SEQ ID NO: 551998 - DNA, 22 bp, Homo sapiens
cttttgtagtcttatgaataga

SEQ ID NO: 551999 - DNA, 16 bp, Homo sapiens
cttttgtgccaggagt

SEQ ID NO: 552000 - DNA, 14 bp, Homo sapiens
cttttgtgttccaa

SEQ ID NO: 552001 - DNA, 16 bp, Homo sapiens
cttttgttcatttcat

SEQ ID NO: 552002 - DNA, 22 bp, Homo sapiens
cttttgttcatttcatcctttc

SEQ ID NO: 552003 - DNA, 15 bp, Homo sapiens
cttttgttttgcttt

SEQ ID NO: 552004 - DNA, 15 bp, Homo sapiens
ctttttaacctctgt

SEQ ID NO: 552005 - DNA, 16 bp, Homo sapiens
ctttttaacctctgtt

SEQ ID NO: 552006 - DNA, 22 bp, Homo sapiens
cttttttaattgaaagggacaa

SEQ ID NO: 552007 - DNA, 13 bp, Homo sapiens
cttttttacaaag

SEQ ID NO: 552008 - DNA, 15 bp, Homo sapiens
cttttttatatcttg

SEQ ID NO: 552009 - DNA, 15 bp, Homo sapiens
cttttttttttaagt

SEQ ID NO: 552010 - DNA, 22 bp, Homo sapiens
cttttttttttaagtgaaattt

SEQ ID NO: 552011 - DNA, 11 bp, Homo sapiens
gaaaaaattag

SEQ ID NO: 552012 - DNA, 20 bp, Homo sapiens
gaaaaactcaaccaaatggt

SEQ ID NO: 552013 - DNA, 12 bp, Homo sapiens
gaaaaatatgtg

SEQ ID NO: 552014 - DNA, 14 bp, Homo sapiens
gaaaaatatgtgaa

SEQ ID NO: 552015 - DNA, 15 bp, Homo sapiens
gaaaaatcagttttt

SEQ ID NO: 552016 - DNA, 19 bp, Homo sapiens
gaaaaatttctggcaaata

SEQ ID NO: 552017 - DNA, 17 bp, Homo sapiens
gaaaacacccagggaac

SEQ ID NO: 552018 - DNA, 20 bp, Homo sapiens
gaaaacagaaattggtacct

SEQ ID NO: 552019 - DNA, 14 bp, Homo sapiens
gaaaacatctcctt

SEQ ID NO: 552020 - DNA, 13 bp, Homo sapiens
gatatgatccaga

SEQ ID NO: 552021 - DNA, 13 bp, Homo sapiens
gatatgtctttaa

SEQ ID NO: 552022 - DNA, 15 bp, Homo sapiens
gatatgtctttaaaa

SEQ ID NO: 552023 - DNA, 18 bp, Homo sapiens
gatattctttgttaattt

SEQ ID NO: 552024 - DNA, 15 bp, Homo sapiens
gatattgtatctcct

SEQ ID NO: 552025 - DNA, 19 bp, Homo sapiens
gatattgtatctcctttaa

SEQ ID NO: 552026 - DNA, 12 bp, Homo sapiens
gatatttcctaa

SEQ ID NO: 552027 - DNA, 17 bp, Homo sapiens
gatatttcctaaggcat

SEQ ID NO: 552028 - DNA, 17 bp, Homo sapiens
gatcaaaataaaaagtg

SEQ ID NO: 552029 - DNA, 22 bp, Homo sapiens
gatcaaaataaaaagtgacaca

SEQ ID NO: 552030 - DNA, 19 bp, Homo sapiens
gatcaaggagggagaaagg

SEQ ID NO: 552031 - DNA, 21 bp, Homo sapiens
gatcacatgcccctcttagaa

SEQ ID NO: 552032 - DNA, 15 bp, Homo sapiens
gatcactgaactttt

SEQ ID NO: 552033 - DNA, 19 bp, Homo sapiens
gatcactgaacttttcaaa

SEQ ID NO: 552034 - DNA, 18 bp, Homo sapiens
gatcattatcttcatgtt

SEQ ID NO: 552035 - DNA, 19 bp, Homo sapiens
gatccaggaagcatgagtg

SEQ ID NO: 552036 - DNA, 19 bp, Homo sapiens
gatcccttccacctgctct

SEQ ID NO: 552037 - DNA, 20 bp, Homo sapiens
gatcccttccacctgctctg

SEQ ID NO: 552038 - DNA, 23 bp, Homo sapiens
gatcccttccacctgctctgctg

SEQ ID NO: 552039 - DNA, 16 bp, Homo sapiens
gatccgccctgggctc

SEQ ID NO: 552040 - DNA, 17 bp, Homo sapiens
gatccgccctgggctct

SEQ ID NO: 552041 - DNA, 14 bp, Homo sapiens
gatctgaggacaag

SEQ ID NO: 552042 - DNA, 12 bp, Homo sapiens
gatctgttgtaa

SEQ ID NO: 552043 - DNA, 17 bp, Homo sapiens
gatcttcctctgctaaa

SEQ ID NO: 552044 - DNA, 18 bp, Homo sapiens
gatcttcctctgctaaat

SEQ ID NO: 552045 - DNA, 22 bp, Homo sapiens
gatctttgttttttgttttcat

SEQ ID NO: 552046 - DNA, 22 bp, Homo sapiens
gatctttttttaagtgttctgt

SEQ ID NO: 552047 - DNA, 14 bp, Homo sapiens
gatgaagaaattta

SEQ ID NO: 552048 - DNA, 12 bp, Homo sapiens
gatgaagaccct

SEQ ID NO: 552049 - DNA, 23 bp, Homo sapiens
gatgaagaccctatctcccacaa

SEQ ID NO: 552050 - DNA, 21 bp, Homo sapiens
gatgaggctggataggagagg

SEQ ID NO: 552051 - DNA, 13 bp, Homo sapiens
gatgatgttctga

SEQ ID NO: 552052 - DNA, 18 bp, Homo sapiens
gatgcaatccttacaaat

SEQ ID NO: 552053 - DNA, 19 bp, Homo sapiens
gatgcaatccttacaaatg

SEQ ID NO: 552054 - DNA, 22 bp, Homo sapiens
gatgcgagcgctatcttcacat

SEQ ID NO: 552055 - DNA, 12 bp, Homo sapiens
gatgctctttcc

SEQ ID NO: 552056 - DNA, 13 bp, Homo sapiens
gatgctctttccc

SEQ ID NO: 552057 - DNA, 14 bp, Homo sapiens
gatgctctttccca

SEQ ID NO: 552058 - DNA, 14 bp, Homo sapiens
gatggagctggagg

SEQ ID NO: 552059 - DNA, 13 bp, Homo sapiens
gatggcacaatga

SEQ ID NO: 552060 - DNA, 15 bp, Homo sapiens
gatggcgcacccggc

SEQ ID NO: 552061 - DNA, 19 bp, Homo sapiens
gatggcgtgtcccctgcct

SEQ ID NO: 552062 - DNA, 22 bp, Homo sapiens
gatggcgtgtcccctgcctgtg

SEQ ID NO: 552063 - DNA, 17 bp, Homo sapiens
gatgggaacagtaaaga

SEQ ID NO: 552064 - DNA, 19 bp, Homo sapiens
gatgggcacaggctgcccc

SEQ ID NO: 552065 - DNA, 17 bp, Homo sapiens
gatggggttgggctctg

SEQ ID NO: 552066 - DNA, 14 bp, Homo sapiens
gatgtaagaagccc

SEQ ID NO: 552067 - DNA, 13 bp, Homo sapiens
gatgtatgtgtat

SEQ ID NO: 552068 - DNA, 21 bp, Homo sapiens
gatgtattttgtgagtttgtt

SEQ ID NO: 552069 - DNA, 14 bp, Homo sapiens
gatgtggacatgca

SEQ ID NO: 552070 - DNA, 16 bp, Homo sapiens
gatgtggacatgcacc

SEQ ID NO: 552071 - DNA, 19 bp, Homo sapiens
gatgtggatggaggtgatg

SEQ ID NO: 552072 - DNA, 13 bp, Homo sapiens
gatgtgtaatttt

SEQ ID NO: 552073 - DNA, 19 bp, Homo sapiens
gatgtgtaatttttctgta

SEQ ID NO: 552074 - DNA, 21 bp, Homo sapiens
gatgtgtccgtgaaagttgtg

SEQ ID NO: 552075 - DNA, 19 bp, Homo sapiens
gatgttaacagtattttaa

SEQ ID NO: 552076 - DNA, 20 bp, Homo sapiens
gatgttatatttttcttaaa

SEQ ID NO: 552077 - DNA, 15 bp, Homo sapiens
gatgttcatggaatt

SEQ ID NO: 552078 - DNA, 15 bp, Homo sapiens
gatgtttttaaaatc

SEQ ID NO: 552079 - DNA, 17 bp, Homo sapiens
gatgtttttaaaatctt

SEQ ID NO: 552080 - DNA, 20 bp, Homo sapiens
gattaactgaaataaaaaat

SEQ ID NO: 552081 - DNA, 14 bp, Homo sapiens
gattacctgaaagc

SEQ ID NO: 552082 - DNA, 22 bp, Homo sapiens
gattattactacaaaaccgttt

SEQ ID NO: 552083 - DNA, 14 bp, Homo sapiens
gattattttcatta

SEQ ID NO: 552084 - DNA, 13 bp, Homo sapiens
gattcacatgttt

SEQ ID NO: 552085 - DNA, 22 bp, Homo sapiens
gattcacatgttttcaaatgga

SEQ ID NO: 552086 - DNA, 21 bp, Homo sapiens
gattccccggagctgggaagg

SEQ ID NO: 552087 - DNA, 18 bp, Homo sapiens
gattctatgtaacttgtt

SEQ ID NO: 552088 - DNA, 15 bp, Homo sapiens
gattctcaccagctg

SEQ ID NO: 552089 - DNA, 20 bp, Homo sapiens
gattgatttacctttggaat

SEQ ID NO: 552090 - DNA, 21 bp, Homo sapiens
gattgctttgcattactgtcc

SEQ ID NO: 552091 - DNA, 17 bp, Homo sapiens
gattggtttctcttctc

SEQ ID NO: 552092 - DNA, 22 bp, Homo sapiens
gatttcaagaaaaaataaatgg

SEQ ID NO: 552093 - DNA, 14 bp, Homo sapiens
gatttcacaaatat

SEQ ID NO: 552094 - DNA, 18 bp, Homo sapiens
gatttccaagtaatataa

SEQ ID NO: 552095 - DNA, 15 bp, Homo sapiens
gatttcccttcttct

SEQ ID NO: 552096 - DNA, 15 bp, Homo sapiens
gatttctagttattt

SEQ ID NO: 552097 - DNA, 13 bp, Homo sapiens
gattttatgttga

SEQ ID NO: 552098 - DNA, 20 bp, Homo sapiens
gattttatgttgacatttgt

SEQ ID NO: 552099 - DNA, 23 bp, Homo sapiens
gattttatgtttaaaatggcatt

SEQ ID NO: 552100 - DNA, 20 bp, Homo sapiens
gattttcaaatatgtaaact

SEQ ID NO: 552101 - DNA, 14 bp, Homo sapiens
gatttttgttgatt

SEQ ID NO: 552102 - DNA, 13 bp, Homo sapiens
gcaaaaatataaa

SEQ ID NO: 552103 - DNA, 16 bp, Homo sapiens
gcaaaaatataaaata

SEQ ID NO: 552104 - DNA, 20 bp, Homo sapiens
gcaaaccaacaagaataaag

SEQ ID NO: 552105 - DNA, 14 bp, Homo sapiens
gcaaacccaaagat

SEQ ID NO: 552106 - DNA, 15 bp, Homo sapiens
gcaaaccctgtcaaa

SEQ ID NO: 552107 - DNA, 20 bp, Homo sapiens
gcaaaccctgtcaaacatta

SEQ ID NO: 552108 - DNA, 14 bp, Homo sapiens
gcaaactctctaaa

SEQ ID NO: 552109 - DNA, 16 bp, Homo sapiens
gcaaactgaggcagca

SEQ ID NO: 552110 - DNA, 17 bp, Homo sapiens
gcaaactgaggcagcat

SEQ ID NO: 552111 - DNA, 12 bp, Homo sapiens
gcaaagatcaaa

SEQ ID NO: 552112 - DNA, 16 bp, Homo sapiens
gcaaagatcaaaataa

SEQ ID NO: 552113 - DNA, 12 bp, Homo sapiens
gcaaagctgttc

SEQ ID NO: 552114 - DNA, 14 bp, Homo sapiens
gcaaaggagggcaa

SEQ ID NO: 552115 - DNA, 23 bp, Homo sapiens
gcaaagggggaggagaagaaaat

SEQ ID NO: 552116 - DNA, 20 bp, Homo sapiens
gcaaagtacaggtactttgt

SEQ ID NO: 552117 - DNA, 22 bp, Homo sapiens
gcaaatacaaaatgattgtctt

SEQ ID NO: 552118 - DNA, 11 bp, Homo sapiens
gcaaatataaa

SEQ ID NO: 552119 - DNA, 14 bp, Homo sapiens
gcaaatataaaact

SEQ ID NO: 552120 - DNA, 23 bp, Homo sapiens
gcaaatggtggttgtttcttcca

SEQ ID NO: 552121 - DNA, 14 bp, Homo sapiens
gcaaattaatgtgt

SEQ ID NO: 552122 - DNA, 22 bp, Homo sapiens
gcaaatttcaaaagacatgttg

SEQ ID NO: 552123 - DNA, 15 bp, Homo sapiens
gcaacaattttcaga

SEQ ID NO: 552124 - DNA, 14 bp, Homo sapiens
gcaacagcaaatta

SEQ ID NO: 552125 - DNA, 19 bp, Homo sapiens
gcaacagctggacaccccc

SEQ ID NO: 552126 - DNA, 15 bp, Homo sapiens
gcaacttgaaattat

SEQ ID NO: 552127 - DNA, 16 bp, Homo sapiens
gcaacttttccaacat

SEQ ID NO: 552128 - DNA, 22 bp, Homo sapiens
gcaagatggcacagggcatgaa

SEQ ID NO: 552129 - DNA, 14 bp, Homo sapiens
gcaagcagtttcaa

SEQ ID NO: 552130 - DNA, 14 bp, Homo sapiens
gcaaggaaggacac

SEQ ID NO: 552131 - DNA, 16 bp, Homo sapiens
gcaaggcgctaacttg

SEQ ID NO: 552132 - DNA, 18 bp, Homo sapiens
gcaaggtcttgctctcct

SEQ ID NO: 552133 - DNA, 13 bp, Homo sapiens
gcaagtcacagaa

SEQ ID NO: 552134 - DNA, 16 bp, Homo sapiens
gcaagtcctgcaacca

SEQ ID NO: 552135 - DNA, 17 bp, Homo sapiens
gcaatatattttgtatg

SEQ ID NO: 552136 - DNA, 19 bp, Homo sapiens
gcaatatattttgtatgca

SEQ ID NO: 552137 - DNA, 13 bp, Homo sapiens
gcaatccttacaa

SEQ ID NO: 552138 - DNA, 14 bp, Homo sapiens
gcaatccttacaaa

SEQ ID NO: 552139 - DNA, 16 bp, Homo sapiens
gcaatccttacaaatg

SEQ ID NO: 552140 - DNA, 18 bp, Homo sapiens
gcaattgtatatatatgt

SEQ ID NO: 552141 - DNA, 22 bp, Homo sapiens
gcaattgtatatatatgtgaac

SEQ ID NO: 552142 - DNA, 19 bp, Homo sapiens
gcacaaaaaatttaagaga

SEQ ID NO: 552143 - DNA, 14 bp, Homo sapiens
gcacaatgtcttgg

SEQ ID NO: 552144 - DNA, 20 bp, Homo sapiens
gcacacaactgtggtcccag

SEQ ID NO: 552145 - DNA, 19 bp, Homo sapiens
gcacacacacgcaaataca

SEQ ID NO: 552146 - DNA, 22 bp, Homo sapiens
gcacacagaaatatatatacat

SEQ ID NO: 552147 - DNA, 14 bp, Homo sapiens
gcacacagtcacct

SEQ ID NO: 552148 - DNA, 17 bp, Homo sapiens
gcacacatcatctgtaa

SEQ ID NO: 552149 - DNA, 20 bp, Homo sapiens
gcacacatcatctgtaagct

SEQ ID NO: 552150 - DNA, 18 bp, Homo sapiens
gcacagacgtccctccac

SEQ ID NO: 552151 - DNA, 17 bp, Homo sapiens
gcacagagagggggcca

SEQ ID NO: 552152 - DNA, 18 bp, Homo sapiens
gcacagccaatctccagg

SEQ ID NO: 552153 - DNA, 13 bp, Homo sapiens
gcacaggctgccc

SEQ ID NO: 552154 - DNA, 18 bp, Homo sapiens
gcacaggctgccccaccc

SEQ ID NO: 552155 - DNA, 19 bp, Homo sapiens
gcacaggctgccccacccc

SEQ ID NO: 552156 - DNA, 11 bp, Homo sapiens
gcacagtattt

SEQ ID NO: 552157 - DNA, 14 bp, Homo sapiens
gcacagtcaggttg

SEQ ID NO: 552158 - DNA, 14 bp, Homo sapiens
gcggtatccagagg

SEQ ID NO: 552159 - DNA, 17 bp, Homo sapiens
gcgtagggccagggctc

SEQ ID NO: 552160 - DNA, 15 bp, Homo sapiens
gcgtcatctggtcct

SEQ ID NO: 552161 - DNA, 17 bp, Homo sapiens
gcgtggcccaccaggcc

SEQ ID NO: 552162 - DNA, 12 bp, Homo sapiens
gcgtggcctggg

SEQ ID NO: 552163 - DNA, 13 bp, Homo sapiens
gctaaaatgtttt

SEQ ID NO: 552164 - DNA, 17 bp, Homo sapiens
gctaaaatgttttcagc

SEQ ID NO: 552165 - DNA, 22 bp, Homo sapiens
gctaaacgtgtatgtttttcag

SEQ ID NO: 552166 - DNA, 20 bp, Homo sapiens
gctaaattgatgttgatgca

SEQ ID NO: 552167 - DNA, 23 bp, Homo sapiens
gctaaattgatgttgatgcaatc

SEQ ID NO: 552168 - DNA, 20 bp, Homo sapiens
gctaacttgcttaaatgtga

SEQ ID NO: 552169 - DNA, 16 bp, Homo sapiens
gctaagcctgatgatg

SEQ ID NO: 552170 - DNA, 19 bp, Homo sapiens
gctaagtaaatctcttctg

SEQ ID NO: 552171 - DNA, 21 bp, Homo sapiens
gctaagtccagctctcccctg

SEQ ID NO: 552172 - DNA, 22 bp, Homo sapiens
gctaagtctttcccaatctcta

SEQ ID NO: 552173 - DNA, 17 bp, Homo sapiens
gctaagttgtcttacac

SEQ ID NO: 552174 - DNA, 14 bp, Homo sapiens
gctaattaaaaagt

SEQ ID NO: 552175 - DNA, 20 bp, Homo sapiens
gctacttcctgcctggtctc

SEQ ID NO: 552176 - DNA, 15 bp, Homo sapiens
gctagaaagagaaaa

SEQ ID NO: 552177 - DNA, 23 bp, Homo sapiens
gctagaaagagaaaaagccctct

SEQ ID NO: 552178 - DNA, 20 bp, Homo sapiens
gctagaggccatggaggcag

SEQ ID NO: 552179 - DNA, 24 bp, Homo sapiens
gctagaggccatggaggcagtagg

SEQ ID NO: 552180 - DNA, 14 bp, Homo sapiens
gctagcacagctcc

SEQ ID NO: 552181 - DNA, 19 bp, Homo sapiens
gctaggcagggtgtctgcc

SEQ ID NO: 552182 - DNA, 11 bp, Homo sapiens
gctatatatat

SEQ ID NO: 552183 - DNA, 13 bp, Homo sapiens
gctatatatataa

SEQ ID NO: 552184 - DNA, 17 bp, Homo sapiens
gctatgctgttcattga

SEQ ID NO: 552185 - DNA, 12 bp, Homo sapiens
gctatgtcattt

SEQ ID NO: 552186 - DNA, 21 bp, Homo sapiens
gctatgtctcatgttttatat

SEQ ID NO: 552187 - DNA, 11 bp, Homo sapiens
gctatttaagt

SEQ ID NO: 552188 - DNA, 20 bp, Homo sapiens
gctatttaagtggactgtat

SEQ ID NO: 552189 - DNA, 16 bp, Homo sapiens
gctattttactgtctt

SEQ ID NO: 552190 - DNA, 17 bp, Homo sapiens
gctcaagcccaggaggg

SEQ ID NO: 552191 - DNA, 18 bp, Homo sapiens
gctcacacaatcagacca

SEQ ID NO: 552192 - DNA, 16 bp, Homo sapiens
gctcagagtgaagagt

SEQ ID NO: 552193 - DNA, 14 bp, Homo sapiens
gctcagcacagcct

SEQ ID NO: 552194 - DNA, 18 bp, Homo sapiens
gctcagcagtgagagcag

SEQ ID NO: 552195 - DNA, 20 bp, Homo sapiens
gctcataatggaaaaaaaga

SEQ ID NO: 552196 - DNA, 16 bp, Homo sapiens
gctcattgtggccagt

SEQ ID NO: 552197 - DNA, 11 bp, Homo sapiens
gctccagcctg

SEQ ID NO: 552198 - DNA, 15 bp, Homo sapiens
gctccaggcagcacc

SEQ ID NO: 552199 - DNA, 22 bp, Homo sapiens
gctccaggcagcacccaggttt

SEQ ID NO: 552200 - DNA, 18 bp, Homo sapiens
gctccagtccccagaact

SEQ ID NO: 552201 - DNA, 18 bp, Homo sapiens
gctccatccttctcccca

SEQ ID NO: 552202 - DNA, 19 bp, Homo sapiens
gctcccactgcccctgcac

SEQ ID NO: 552203 - DNA, 14 bp, Homo sapiens
gctcccaggacgca

SEQ ID NO: 552204 - DNA, 23 bp, Homo sapiens
gctcccagggtcctgggggctgc

SEQ ID NO: 552205 - DNA, 20 bp, Homo sapiens
gctcccccagctccccccac

SEQ ID NO: 552206 - DNA, 13 bp, Homo sapiens
gctcccccttttc

SEQ ID NO: 552207 - DNA, 17 bp, Homo sapiens
gctccctcaaagaggca

SEQ ID NO: 552208 - DNA, 17 bp, Homo sapiens
gctccctccctcccaga

SEQ ID NO: 552209 - DNA, 21 bp, Homo sapiens
gctccctccctcccagatcca

SEQ ID NO: 552210 - DNA, 14 bp, Homo sapiens
gctcccttcctccc

SEQ ID NO: 552211 - DNA, 14 bp, Homo sapiens
gctcctcacatagc

SEQ ID NO: 552212 - DNA, 16 bp, Homo sapiens
gctcctcggccagagc

SEQ ID NO: 552213 - DNA, 17 bp, Homo sapiens
gctcctcggccagagct

SEQ ID NO: 552214 - DNA, 15 bp, Homo sapiens
gctcctgctcattgt

SEQ ID NO: 552215 - DNA, 22 bp, Homo sapiens
gctcctgctcattgtggccagt

SEQ ID NO: 552216 - DNA, 19 bp, Homo sapiens
gctccttagggttttctct

SEQ ID NO: 552217 - DNA, 22 bp, Homo sapiens
gctccttcaacaaggcttgctg

SEQ ID NO: 552218 - DNA, 16 bp, Homo sapiens
gctcgatgcagacagg

SEQ ID NO: 552219 - DNA, 22 bp, Homo sapiens
gctctcctgggccagggtctcg

SEQ ID NO: 552220 - DNA, 19 bp, Homo sapiens
gctctctgtactaaggaga

SEQ ID NO: 552221 - DNA, 14 bp, Homo sapiens
gctctgacaaagct

SEQ ID NO: 552222 - DNA, 16 bp, Homo sapiens
gctctgcgtcccactg

SEQ ID NO: 552223 - DNA, 23 bp, Homo sapiens
gctctgctgtgggcacaggtcag

SEQ ID NO: 552224 - DNA, 11 bp, Homo sapiens
gctctggcagg

SEQ ID NO: 552225 - DNA, 14 bp, Homo sapiens
gctctggcaggtgg

SEQ ID NO: 552226 - DNA, 17 bp, Homo sapiens
gctctggcaggtggcca

SEQ ID NO: 552227 - DNA, 22 bp, Homo sapiens
gctctggcaggtggccagggct

SEQ ID NO: 552228 - DNA, 22 bp, Homo sapiens
gctcttcctggacaggccaggt

SEQ ID NO: 552229 - DNA, 23 bp, Homo sapiens
gctcttgggcaatattctctgta

SEQ ID NO: 552230 - DNA, 22 bp, Homo sapiens
gctctttcccacccagcctggg

SEQ ID NO: 552231 - DNA, 13 bp, Homo sapiens
gctgaagccagct

SEQ ID NO: 552232 - DNA, 15 bp, Homo sapiens
gctgaagccagctcc

SEQ ID NO: 552233 - DNA, 16 bp, Homo sapiens
gctgagctctgacctg

SEQ ID NO: 552234 - DNA, 19 bp, Homo sapiens
gctgagctctgacctgccc

SEQ ID NO: 552235 - DNA, 14 bp, Homo sapiens
gctgagctggccta

SEQ ID NO: 552236 - DNA, 15 bp, Homo sapiens
gctgagtccgacctg

SEQ ID NO: 552237 - DNA, 15 bp, Homo sapiens
gctgagtggtccaca

SEQ ID NO: 552238 - DNA, 20 bp, Homo sapiens
gctgcacagctggccaccat

SEQ ID NO: 552239 - DNA, 14 bp, Homo sapiens
gctgcactgccctc

SEQ ID NO: 552240 - DNA, 12 bp, Homo sapiens
gctgcagagcct

SEQ ID NO: 552241 - DNA, 15 bp, Homo sapiens
gctgcagagcctgca

SEQ ID NO: 552242 - DNA, 15 bp, Homo sapiens
gctgcagattccttt

SEQ ID NO: 552243 - DNA, 16 bp, Homo sapiens
gctgccaggctcccac

SEQ ID NO: 552244 - DNA, 17 bp, Homo sapiens
gctgcccacacacccca

SEQ ID NO: 552245 - DNA, 20 bp, Homo sapiens
gctgccccacccctccatga

SEQ ID NO: 552246 - DNA, 14 bp, Homo sapiens
gctgcccctccctg

SEQ ID NO: 552247 - DNA, 22 bp, Homo sapiens
gctgccgtgcacggggccagca

SEQ ID NO: 552248 - DNA, 20 bp, Homo sapiens
gctgcctgtggtgaggtcct

SEQ ID NO: 552249 - DNA, 21 bp, Homo sapiens
gctgctcctcggccagagctc

SEQ ID NO: 552250 - DNA, 14 bp, Homo sapiens
gctgctgcacagct

SEQ ID NO: 552251 - DNA, 12 bp, Homo sapiens
gctgctgctctg

SEQ ID NO: 552252 - DNA, 14 bp, Homo sapiens
gctgcttccagttg

SEQ ID NO: 552253 - DNA, 22 bp, Homo sapiens
gctggacacccccttggtgctc

SEQ ID NO: 552254 - DNA, 22 bp, Homo sapiens
gctggagatacttggtcacagc

SEQ ID NO: 552255 - DNA, 18 bp, Homo sapiens
gctggatataatgtattt

SEQ ID NO: 552256 - DNA, 16 bp, Homo sapiens
gctggatattttacta

SEQ ID NO: 552257 - DNA, 18 bp, Homo sapiens
gctggcaggagacactgg

SEQ ID NO: 552258 - DNA, 21 bp, Homo sapiens
gctggcaggagacactggtct

SEQ ID NO: 552259 - DNA, 15 bp, Homo sapiens
gctggcccccactgg

SEQ ID NO: 552260 - DNA, 20 bp, Homo sapiens
gctggcctggggtcaggccg

SEQ ID NO: 552261 - DNA, 15 bp, Homo sapiens
gctggctccagcctg

SEQ ID NO: 552262 - DNA, 19 bp, Homo sapiens
gctggcttctccctggact

SEQ ID NO: 552263 - DNA, 17 bp, Homo sapiens
gctgggacgctctgctg

SEQ ID NO: 552264 - DNA, 22 bp, Homo sapiens
gctgggacttcttacccaaagc

SEQ ID NO: 552265 - DNA, 12 bp, Homo sapiens
gctgggcagctg

SEQ ID NO: 552266 - DNA, 20 bp, Homo sapiens
gctgggggcagcctgcgtgg

SEQ ID NO: 552267 - DNA, 21 bp, Homo sapiens
gctgggggcagcctgcgtggc

SEQ ID NO: 552268 - DNA, 12 bp, Homo sapiens
gctggtcacccc

SEQ ID NO: 552269 - DNA, 23 bp, Homo sapiens
gctggtcacccccacccccgggt

SEQ ID NO: 552270 - DNA, 20 bp, Homo sapiens
gctggtcacttcttctgtcc

SEQ ID NO: 552271 - DNA, 21 bp, Homo sapiens
gctggtcacttcttctgtcca

SEQ ID NO: 552272 - DNA, 20 bp, Homo sapiens
gctgtaaaagcaagtcctgc

SEQ ID NO: 552273 - DNA, 14 bp, Homo sapiens
gctgtaaagcaaaa

SEQ ID NO: 552274 - DNA, 21 bp, Homo sapiens
gctgtaaagcaaaatatttgt

SEQ ID NO: 552275 - DNA, 16 bp, Homo sapiens
gctgtaaataaaaata

SEQ ID NO: 552276 - DNA, 19 bp, Homo sapiens
gctgtaagacggccttgga

SEQ ID NO: 552277 - DNA, 20 bp, Homo sapiens
gctgtcatggtgcaatttgt

SEQ ID NO: 552278 - DNA, 15 bp, Homo sapiens
gctgtcattgcttct

SEQ ID NO: 552279 - DNA, 14 bp, Homo sapiens
gctgtctgtggctt

SEQ ID NO: 552280 - DNA, 14 bp, Homo sapiens
gctgtgaaatgact

SEQ ID NO: 552281 - DNA, 20 bp, Homo sapiens
gctgtgaaatgactgcatca

SEQ ID NO: 552282 - DNA, 16 bp, Homo sapiens
gctgtggggagctggt

SEQ ID NO: 552283 - DNA, 14 bp, Homo sapiens
gctgtgtttgctcc

SEQ ID NO: 552284 - DNA, 16 bp, Homo sapiens
gctgttcattgatgac

SEQ ID NO: 552285 - DNA, 15 bp, Homo sapiens
gctgttgaccaggca

SEQ ID NO: 552286 - DNA, 14 bp, Homo sapiens
gctgttgtctcttc

SEQ ID NO: 552287 - DNA, 12 bp, Homo sapiens
gcttaaatgtga

SEQ ID NO: 552288 - DNA, 13 bp, Homo sapiens
gcttaaatgtgaa

SEQ ID NO: 552289 - DNA, 17 bp, Homo sapiens
gcttaaatgtgaattac

SEQ ID NO: 552290 - DNA, 23 bp, Homo sapiens
gcttaaatgtgaattactaactt

SEQ ID NO: 552291 - DNA, 13 bp, Homo sapiens
gcttaagaagtat

SEQ ID NO: 552292 - DNA, 13 bp, Homo sapiens
gcttaattccaat

SEQ ID NO: 552293 - DNA, 17 bp, Homo sapiens
gcttagcgttctgtttc

SEQ ID NO: 552294 - DNA, 12 bp, Homo sapiens
gcttcacttctg

SEQ ID NO: 552295 - DNA, 22 bp, Homo sapiens
ggggcctagtggcttcagcccc

SEQ ID NO: 552296 - DNA, 16 bp, Homo sapiens
ggggcctgaggctcct

SEQ ID NO: 552297 - DNA, 13 bp, Homo sapiens
ggggcggggccag

SEQ ID NO: 552298 - DNA, 21 bp, Homo sapiens
ggggctgctgcactgccctcc

SEQ ID NO: 552299 - DNA, 16 bp, Homo sapiens
ggggctggggcaggag

SEQ ID NO: 552300 - DNA, 22 bp, Homo sapiens
ggggcttttgtgccaggagtgg

SEQ ID NO: 552301 - DNA, 14 bp, Homo sapiens
gggggccaggtgca

SEQ ID NO: 552302 - DNA, 22 bp, Homo sapiens
gggggcctgaaagcaacagctg

SEQ ID NO: 552303 - DNA, 13 bp, Homo sapiens
ggggggcagagcc

SEQ ID NO: 552304 - DNA, 16 bp, Homo sapiens
ggggtggtacttggca

SEQ ID NO: 552305 - DNA, 17 bp, Homo sapiens
gggtaacaaagtgagac

SEQ ID NO: 552306 - DNA, 22 bp, Homo sapiens
gggtaagggactccagaagcag

SEQ ID NO: 552307 - DNA, 22 bp, Homo sapiens
gggtaccactgaatctgtacag

SEQ ID NO: 552308 - DNA, 16 bp, Homo sapiens
gggtaggaatgggtat

SEQ ID NO: 552309 - DNA, 16 bp, Homo sapiens
gggtatcatgcttcta

SEQ ID NO: 552310 - DNA, 14 bp, Homo sapiens
gggtcagaagagag

SEQ ID NO: 552311 - DNA, 15 bp, Homo sapiens
gggtcaggccacggc

SEQ ID NO: 552312 - DNA, 18 bp, Homo sapiens
gggtcaggccgggcagag

SEQ ID NO: 552313 - DNA, 21 bp, Homo sapiens
gggtcaggccgggcagagcac

SEQ ID NO: 552314 - DNA, 22 bp, Homo sapiens
gggtcggcgccttctacctgca

SEQ ID NO: 552315 - DNA, 10 bp, Homo sapiens
gggtctgtga

SEQ ID NO: 552316 - DNA, 19 bp, Homo sapiens
gggtgaagagaaccgagca

SEQ ID NO: 552317 - DNA, 17 bp, Homo sapiens
gggtgcagcatctggaa

SEQ ID NO: 552318 - DNA, 14 bp, Homo sapiens
gggtggtacttggc

SEQ ID NO: 552319 - DNA, 18 bp, Homo sapiens
gggtggtacttggcacca

SEQ ID NO: 552320 - DNA, 15 bp, Homo sapiens
gggttttgcctctgc

SEQ ID NO: 552321 - DNA, 10 bp, Homo sapiens
gggtttttct

SEQ ID NO: 552322 - DNA, 15 bp, Homo sapiens
ggtaacttttgtagt

SEQ ID NO: 552323 - DNA, 16 bp, Homo sapiens
ggtaagggactccaga

SEQ ID NO: 552324 - DNA, 20 bp, Homo sapiens
ggtaagggactccagaagca

SEQ ID NO: 552325 - DNA, 14 bp, Homo sapiens
ggtacacacttgac

SEQ ID NO: 552326 - DNA, 23 bp, Homo sapiens
ggtaccttgcacacatcatctgt

SEQ ID NO: 552327 - DNA, 24 bp, Homo sapiens
ggtaccttgcacacatcatctgta

SEQ ID NO: 552328 - DNA, 20 bp, Homo sapiens
ggtagaatgaccttgtaatg

SEQ ID NO: 552329 - DNA, 21 bp, Homo sapiens
ggtaggaatattatatttgga

SEQ ID NO: 552330 - DNA, 19 bp, Homo sapiens
ggtatatccttttctgtgt

SEQ ID NO: 552331 - DNA, 21 bp, Homo sapiens
ggtatatccttttctgtgttt

SEQ ID NO: 552332 - DNA, 17 bp, Homo sapiens
ggtcacagccaggcgct

SEQ ID NO: 552333 - DNA, 16 bp, Homo sapiens
ggtcaggccacggcag

SEQ ID NO: 552334 - DNA, 16 bp, Homo sapiens
ggtcatcccggggcca

SEQ ID NO: 552335 - DNA, 18 bp, Homo sapiens
ggtcatgatgctctttcc

SEQ ID NO: 552336 - DNA, 21 bp, Homo sapiens
ggtcatttccatgtatgcata

SEQ ID NO: 552337 - DNA, 10 bp, Homo sapiens
ggtccacatt

SEQ ID NO: 552338 - DNA, 12 bp, Homo sapiens
ggtccaggagat

SEQ ID NO: 552339 - DNA, 15 bp, Homo sapiens
ggtccatagctgtgg

SEQ ID NO: 552340 - DNA, 22 bp, Homo sapiens
ggtcccagctacaggggaggct

SEQ ID NO: 552341 - DNA, 19 bp, Homo sapiens
ggtcccgggtgccccccat

SEQ ID NO: 552342 - DNA, 18 bp, Homo sapiens
ggtcctgaggctggggct

SEQ ID NO: 552343 - DNA, 16 bp, Homo sapiens
ggtcctgggggcctga

SEQ ID NO: 552344 - DNA, 22 bp, Homo sapiens
ggtcctgggggctgctgcactg

SEQ ID NO: 552345 - DNA, 19 bp, Homo sapiens
ggtcttcagggggccaggt

SEQ ID NO: 552346 - DNA, 18 bp, Homo sapiens
ggtgacactgctccctga

SEQ ID NO: 552347 - DNA, 21 bp, Homo sapiens
ggtgacctctagccctgcccg

SEQ ID NO: 552348 - DNA, 17 bp, Homo sapiens
ggtgagtcctccagaac

SEQ ID NO: 552349 - DNA, 12 bp, Homo sapiens
ggtgcaggcagg

SEQ ID NO: 552350 - DNA, 16 bp, Homo sapiens
ggtgccatcagtgccc

SEQ ID NO: 552351 - DNA, 21 bp, Homo sapiens
ggtgcccagactcaaggcctc

SEQ ID NO: 552352 - DNA, 19 bp, Homo sapiens
ggtgccccccatgccctcc

SEQ ID NO: 552353 - DNA, 21 bp, Homo sapiens
ggtggcatcattccaggcccg

SEQ ID NO: 552354 - DNA, 16 bp, Homo sapiens
ggtgggcacctataat

SEQ ID NO: 552355 - DNA, 15 bp, Homo sapiens
ggtgggggggcagag

SEQ ID NO: 552356 - DNA, 15 bp, Homo sapiens
ggtggtacttggcac

SEQ ID NO: 552357 - DNA, 22 bp, Homo sapiens
ggtgtgagggcagtgcaaggag

SEQ ID NO: 552358 - DNA, 12 bp, Homo sapiens
ggtgttaatgag

SEQ ID NO: 552359 - DNA, 13 bp, Homo sapiens
ggttaaaactgtc

SEQ ID NO: 552360 - DNA, 18 bp, Homo sapiens
ggttcaattccctgaagg

SEQ ID NO: 552361 - DNA, 19 bp, Homo sapiens
ggttcccccaggaccctga

SEQ ID NO: 552362 - DNA, 20 bp, Homo sapiens
ggttgtaaatactttgtcct

SEQ ID NO: 552363 - DNA, 12 bp, Homo sapiens
ggtttaaacttt

SEQ ID NO: 552364 - DNA, 18 bp, Homo sapiens
ggtttccacacaggccca

SEQ ID NO: 552365 - DNA, 19 bp, Homo sapiens
ggtttccatcaaagccctc

SEQ ID NO: 552366 - DNA, 14 bp, Homo sapiens
ggtttggctcctgc

SEQ ID NO: 552367 - DNA, 18 bp, Homo sapiens
ggtttttatttctccttt

SEQ ID NO: 552368 - DNA, 13 bp, Homo sapiens
gtaaaaactgaag

SEQ ID NO: 552369 - DNA, 22 bp, Homo sapiens
gtaaaaactgaagttctgcctc

SEQ ID NO: 552370 - DNA, 13 bp, Homo sapiens
gtaaaattggatt

SEQ ID NO: 552371 - DNA, 15 bp, Homo sapiens
gtaaactttaacttc

SEQ ID NO: 552372 - DNA, 14 bp, Homo sapiens
gtaaactttgaaat

SEQ ID NO: 552373 - DNA, 16 bp, Homo sapiens
gtaaagatattgtatc

SEQ ID NO: 552374 - DNA, 14 bp, Homo sapiens
gtaaagcaaaatat

SEQ ID NO: 552375 - DNA, 14 bp, Homo sapiens
gtaaataaaaatag

SEQ ID NO: 552376 - DNA, 19 bp, Homo sapiens
gtaaatcaagaccaaagag

SEQ ID NO: 552377 - DNA, 16 bp, Homo sapiens
gtaaatgtcttcatgt

SEQ ID NO: 552378 - DNA, 14 bp, Homo sapiens
gtaaattaggaggc

SEQ ID NO: 552379 - DNA, 17 bp, Homo sapiens
gtaaattccaaagatct

SEQ ID NO: 552380 - DNA, 14 bp, Homo sapiens
gtaacagtttaaaa

SEQ ID NO: 552381 - DNA, 22 bp, Homo sapiens
gtaactgccattttttgtctgt

SEQ ID NO: 552382 - DNA, 23 bp, Homo sapiens
gtaactgccattttttgtctgtg

SEQ ID NO: 552383 - DNA, 21 bp, Homo sapiens
gtaactgttaccattggaaat

SEQ ID NO: 552384 - DNA, 14 bp, Homo sapiens
gtaacttgtcttaa

SEQ ID NO: 552385 - DNA, 22 bp, Homo sapiens
gtaacttttgtagtcttatgaa

SEQ ID NO: 552386 - DNA, 21 bp, Homo sapiens
gtaagaagcccgatccacatt

SEQ ID NO: 552387 - DNA, 17 bp, Homo sapiens
gtaagacttgattggtt

SEQ ID NO: 552388 - DNA, 16 bp, Homo sapiens
gtaagagcaaaagcct

SEQ ID NO: 552389 - DNA, 21 bp, Homo sapiens
gtaagggactccagaagcagc

SEQ ID NO: 552390 - DNA, 15 bp, Homo sapiens
gtaatagcctcacct

SEQ ID NO: 552391 - DNA, 20 bp, Homo sapiens
gtaatataatggaagagaaa

SEQ ID NO: 552392 - DNA, 19 bp, Homo sapiens
gtaatgtaactgctcttgg

SEQ ID NO: 552393 - DNA, 22 bp, Homo sapiens
gtaattcttattccatattaga

SEQ ID NO: 552394 - DNA, 14 bp, Homo sapiens
gtaatttataaaat

SEQ ID NO: 552395 - DNA, 18 bp, Homo sapiens
gtaatttcctgctcctcc

SEQ ID NO: 552396 - DNA, 21 bp, Homo sapiens
gtaatttttctgtatagacag

SEQ ID NO: 552397 - DNA, 17 bp, Homo sapiens
gtacaaaaacacaaata

SEQ ID NO: 552398 - DNA, 16 bp, Homo sapiens
gtacaaaagggacatg

SEQ ID NO: 552399 - DNA, 12 bp, Homo sapiens
gtacacacacag

SEQ ID NO: 552400 - DNA, 14 bp, Homo sapiens
gtacacacacagac

SEQ ID NO: 552401 - DNA, 14 bp, Homo sapiens
gtacacacttgacc

SEQ ID NO: 552402 - DNA, 20 bp, Homo sapiens
gtacagagccgtaaaaactg

SEQ ID NO: 552403 - DNA, 20 bp, Homo sapiens
gtacaggtcatctgctggga

SEQ ID NO: 552404 - DNA, 21 bp, Homo sapiens
gtacagttgggaaaatatgtc

SEQ ID NO: 552405 - DNA, 21 bp, Homo sapiens
gtacatgtggaaaactcacag

SEQ ID NO: 552406 - DNA, 15 bp, Homo sapiens
gtacatttatgtgtg

SEQ ID NO: 552407 - DNA, 16 bp, Homo sapiens
gtaccaaaaaagaaag

SEQ ID NO: 552408 - DNA, 22 bp, Homo sapiens
gtaccaatgcagaactcccaag

SEQ ID NO: 552409 - DNA, 23 bp, Homo sapiens
gtaccttgcacacatcatctgta

SEQ ID NO: 552410 - DNA, 15 bp, Homo sapiens
gtactaaacatttcc

SEQ ID NO: 552411 - DNA, 23 bp, Homo sapiens
gtactaaacatttcctttttcta

SEQ ID NO: 552412 - DNA, 20 bp, Homo sapiens
gtactatggaagccacatca

SEQ ID NO: 552413 - DNA, 20 bp, Homo sapiens
gtactctaatatacagtgtg

SEQ ID NO: 552414 - DNA, 20 bp, Homo sapiens
gtacttgatttttcaaagac

SEQ ID NO: 552415 - DNA, 21 bp, Homo sapiens
gtacttgatttttcaaagact

SEQ ID NO: 552416 - DNA, 18 bp, Homo sapiens
gtacttgctgctatttta

SEQ ID NO: 552417 - DNA, 18 bp, Homo sapiens
gtacttggcaccaataaa

SEQ ID NO: 552418 - DNA, 19 bp, Homo sapiens
gtacttggcaccaataaag

SEQ ID NO: 552419 - DNA, 21 bp, Homo sapiens
gtacttggcaccaataaagga

SEQ ID NO: 552420 - DNA, 20 bp, Homo sapiens
gtactttgtctaagaaacat

SEQ ID NO: 552421 - DNA, 17 bp, Homo sapiens
gtagaactttaaaagaa

SEQ ID NO: 552422 - DNA, 18 bp, Homo sapiens
gtagaatgaccttgtaat

SEQ ID NO: 552423 - DNA, 20 bp, Homo sapiens
gtagaatgaccttgtaatgt

SEQ ID NO: 552424 - DNA, 23 bp, Homo sapiens
gtagaatgaccttgtaatgtaac

SEQ ID NO: 552425 - DNA, 18 bp, Homo sapiens
gtagactggcctgaacca

SEQ ID NO: 552426 - DNA, 18 bp, Homo sapiens
gtagcaaaccctgtcaaa

SEQ ID NO: 552427 - DNA, 23 bp, Homo sapiens
gtagcaaaccctgtcaaacatta

SEQ ID NO: 552428 - DNA, 22 bp, Homo sapiens
gtagccttgatttgttcttaca

SEQ ID NO: 552429 - DNA, 16 bp, Homo sapiens
gtagctcgtgtgctta

SEQ ID NO: 552430 - DNA, 15 bp, Homo sapiens
gtagctgtggggagc

SEQ ID NO: 552431 - DNA, 21 bp, Homo sapiens
gtgttatttattgctacttcc

SEQ ID NO: 552432 - DNA, 23 bp, Homo sapiens
gtgttctgtgaatagcagtggca

SEQ ID NO: 552433 - DNA, 12 bp, Homo sapiens
gtgttctgtggc

SEQ ID NO: 552434 - DNA, 15 bp, Homo sapiens
gtgttctgttacaaa

SEQ ID NO: 552435 - DNA, 17 bp, Homo sapiens
gtgtttcatccttccca

SEQ ID NO: 552436 - DNA, 19 bp, Homo sapiens
gtgtttgctccccttcccc

SEQ ID NO: 552437 - DNA, 13 bp, Homo sapiens
gttaaagatgtag

SEQ ID NO: 552438 - DNA, 17 bp, Homo sapiens
gttaaatgttttgtaaa

SEQ ID NO: 552439 - DNA, 22 bp, Homo sapiens
gttaaatgttttgtaaactttg

SEQ ID NO: 552440 - DNA, 13 bp, Homo sapiens
gttaacagtattt

SEQ ID NO: 552441 - DNA, 13 bp, Homo sapiens
gttaacattgttg

SEQ ID NO: 552442 - DNA, 22 bp, Homo sapiens
gttaagcacaaccatgttcttg

SEQ ID NO: 552443 - DNA, 18 bp, Homo sapiens
gttaataacagctccttt

SEQ ID NO: 552444 - DNA, 20 bp, Homo sapiens
gttaatgagtatatgtaaca

SEQ ID NO: 552445 - DNA, 15 bp, Homo sapiens
gttaattcctatgaa

SEQ ID NO: 552446 - DNA, 16 bp, Homo sapiens
gttaattcctatgaag

SEQ ID NO: 552447 - DNA, 23 bp, Homo sapiens
gttaatttcttgcaatttgaagg

SEQ ID NO: 552448 - DNA, 12 bp, Homo sapiens
gttaatttggac

SEQ ID NO: 552449 - DNA, 16 bp, Homo sapiens
gttacaaaatgtaact

SEQ ID NO: 552450 - DNA, 12 bp, Homo sapiens
gttacagctgaa

SEQ ID NO: 552451 - DNA, 16 bp, Homo sapiens
gttacagtggcagtat

SEQ ID NO: 552452 - DNA, 14 bp, Homo sapiens
gttaccattggaaa

SEQ ID NO: 552453 - DNA, 19 bp, Homo sapiens
gttaccattggaaatttca

SEQ ID NO: 552454 - DNA, 14 bp, Homo sapiens
gttaggcagtataa

SEQ ID NO: 552455 - DNA, 19 bp, Homo sapiens
gttaggccaaagacaaata

SEQ ID NO: 552456 - DNA, 15 bp, Homo sapiens
gttatagtgcaatat

SEQ ID NO: 552457 - DNA, 17 bp, Homo sapiens
gttatagtgcaatatat

SEQ ID NO: 552458 - DNA, 13 bp, Homo sapiens
gttatgcatcccc

SEQ ID NO: 552459 - DNA, 14 bp, Homo sapiens
gttatgcatcccca

SEQ ID NO: 552460 - DNA, 12 bp, Homo sapiens
gttatgttgtaa

SEQ ID NO: 552461 - DNA, 22 bp, Homo sapiens
gttatgttgtaatattttgctg

SEQ ID NO: 552462 - DNA, 21 bp, Homo sapiens
gttattcaataactattgctg

SEQ ID NO: 552463 - DNA, 19 bp, Homo sapiens
gttattgagagagatgtgt

SEQ ID NO: 552464 - DNA, 21 bp, Homo sapiens
gttattgagagagatgtgtaa

SEQ ID NO: 552465 - DNA, 18 bp, Homo sapiens
gttcaatgctacaaaatg

SEQ ID NO: 552466 - DNA, 15 bp, Homo sapiens
gttcaattccctgaa

SEQ ID NO: 552467 - DNA, 17 bp, Homo sapiens
gttcaattccctgaagg

SEQ ID NO: 552468 - DNA, 16 bp, Homo sapiens
gttcaatttcagaaac

SEQ ID NO: 552469 - DNA, 14 bp, Homo sapiens
gttcacccctccac

SEQ ID NO: 552470 - DNA, 16 bp, Homo sapiens
gttcacgtgactcctc

SEQ ID NO: 552471 - DNA, 20 bp, Homo sapiens
gttcacgtgactcctcaatt

SEQ ID NO: 552472 - DNA, 19 bp, Homo sapiens
gttcagcatggcatccaag

SEQ ID NO: 552473 - DNA, 18 bp, Homo sapiens
gttcatcccttctcttcc

SEQ ID NO: 552474 - DNA, 12 bp, Homo sapiens
gttcatgaatac

SEQ ID NO: 552475 - DNA, 13 bp, Homo sapiens
gttcatggaattg

SEQ ID NO: 552476 - DNA, 19 bp, Homo sapiens
gttcccccaggaccctgag

SEQ ID NO: 552477 - DNA, 22 bp, Homo sapiens
gttccggaatcctgtcctcagc

SEQ ID NO: 552478 - DNA, 21 bp, Homo sapiens
gttctctctactggtcctctt

SEQ ID NO: 552479 - DNA, 12 bp, Homo sapiens
gttctctttgga

SEQ ID NO: 552480 - DNA, 20 bp, Homo sapiens
gttctgcctctgatgtattt

SEQ ID NO: 552481 - DNA, 17 bp, Homo sapiens
gttctgtgtctgctgta

SEQ ID NO: 552482 - DNA, 18 bp, Homo sapiens
gttctgttacaaaatgta

SEQ ID NO: 552483 - DNA, 21 bp, Homo sapiens
gttctgttacaaaatgtaact

SEQ ID NO: 552484 - DNA, 22 bp, Homo sapiens
gttctgttacaaaatgtaactg

SEQ ID NO: 552485 - DNA, 23 bp, Homo sapiens
gttcttaaaaatgcatttaagtt

SEQ ID NO: 552486 - DNA, 15 bp, Homo sapiens
gttcttccaaagcag

SEQ ID NO: 552487 - DNA, 21 bp, Homo sapiens
gttcttgcagtcatcagaagt

SEQ ID NO: 552488 - DNA, 12 bp, Homo sapiens
gttctttctggg

SEQ ID NO: 552489 - DNA, 12 bp, Homo sapiens
gttctttgtgta

SEQ ID NO: 552490 - DNA, 12 bp, Homo sapiens
gttgacatttgt

SEQ ID NO: 552491 - DNA, 18 bp, Homo sapiens
gttgagaggacactcccg

SEQ ID NO: 552492 - DNA, 21 bp, Homo sapiens
gttgcccagcctctttccctt

SEQ ID NO: 552493 - DNA, 18 bp, Homo sapiens
gttggcagatgcagctct

SEQ ID NO: 552494 - DNA, 20 bp, Homo sapiens
gttggttttgcatgtctgca

SEQ ID NO: 552495 - DNA, 22 bp, Homo sapiens
gttgtaaacgtctttttaagcc

SEQ ID NO: 552496 - DNA, 23 bp, Homo sapiens
gttgtaaagatattgtatctcct

SEQ ID NO: 552497 - DNA, 14 bp, Homo sapiens
gttgtctcttctcc

SEQ ID NO: 552498 - DNA, 18 bp, Homo sapiens
gttgtgattccccggagc

SEQ ID NO: 552499 - DNA, 22 bp, Homo sapiens
gttgtgattccccggagctggg

SEQ ID NO: 552500 - DNA, 23 bp, Homo sapiens
gttgtgattccccggagctggga

SEQ ID NO: 552501 - DNA, 20 bp, Homo sapiens
gttgtgtgggtttactctgt

SEQ ID NO: 552502 - DNA, 13 bp, Homo sapiens
gttgtttcttcca

SEQ ID NO: 552503 - DNA, 14 bp, Homo sapiens
gttgttttgtggat

SEQ ID NO: 552504 - DNA, 18 bp, Homo sapiens
gtttaaaaatcagaaaga

SEQ ID NO: 552505 - DNA, 13 bp, Homo sapiens
gtttaaactttta

SEQ ID NO: 552506 - DNA, 21 bp, Homo sapiens
gtttaacagaaaaatgaaatt

SEQ ID NO: 552507 - DNA, 12 bp, Homo sapiens
gtttaagcagaa

SEQ ID NO: 552508 - DNA, 19 bp, Homo sapiens
gtttaagcagaattggaaa

SEQ ID NO: 552509 - DNA, 12 bp, Homo sapiens
gtttactctgtg

SEQ ID NO: 552510 - DNA, 22 bp, Homo sapiens
gtttatcgccctggcaggcagg

SEQ ID NO: 552511 - DNA, 15 bp, Homo sapiens
gtttatctagatgta

SEQ ID NO: 552512 - DNA, 17 bp, Homo sapiens
gtttatctagatgtaaa

SEQ ID NO: 552513 - DNA, 15 bp, Homo sapiens
gtttattccagagct

SEQ ID NO: 552514 - DNA, 16 bp, Homo sapiens
gtttcaaaaatctgaa

SEQ ID NO: 552515 - DNA, 14 bp, Homo sapiens
gtttcaataaagtt

SEQ ID NO: 552516 - DNA, 20 bp, Homo sapiens
gtttcacagtgtctgtaaat

SEQ ID NO: 552517 - DNA, 22 bp, Homo sapiens
gtttcacagtgtctgtaaatca

SEQ ID NO: 552518 - DNA, 15 bp, Homo sapiens
gtttcactgttcatg

SEQ ID NO: 552519 - DNA, 16 bp, Homo sapiens
gtttccacacaggccc

SEQ ID NO: 552520 - DNA, 23 bp, Homo sapiens
gtttccacacaggcccatgccct

SEQ ID NO: 552521 - DNA, 19 bp, Homo sapiens
gtttccagctaagcctgat

SEQ ID NO: 552522 - DNA, 22 bp, Homo sapiens
gtttccaggcatgaccctggag

SEQ ID NO: 552523 - DNA, 21 bp, Homo sapiens
gtttctcttctccccttccat

SEQ ID NO: 552524 - DNA, 17 bp, Homo sapiens
gtttctgagaaaagaac

SEQ ID NO: 552525 - DNA, 17 bp, Homo sapiens
gtttctttgaattttca

SEQ ID NO: 552526 - DNA, 21 bp, Homo sapiens
gtttgatttgtcactgcttca

SEQ ID NO: 552527 - DNA, 23 bp, Homo sapiens
gtttgctccccttccccttcctt

SEQ ID NO: 552528 - DNA, 16 bp, Homo sapiens
gtttggttttaaaata

SEQ ID NO: 552529 - DNA, 15 bp, Homo sapiens
gtttgtcctttatgt

SEQ ID NO: 552530 - DNA, 20 bp, Homo sapiens
gtttgtttctgttgttcact

SEQ ID NO: 552531 - DNA, 16 bp, Homo sapiens
gttttaaaatactgta

SEQ ID NO: 552532 - DNA, 18 bp, Homo sapiens
gttttaaaatactgtaga

SEQ ID NO: 552533 - DNA, 13 bp, Homo sapiens
gttttagtttaaa

SEQ ID NO: 552534 - DNA, 20 bp, Homo sapiens
gttttccccaattatcctcc

SEQ ID NO: 552535 - DNA, 22 bp, Homo sapiens
gttttcggtgccatcagtgccc

SEQ ID NO: 552536 - DNA, 16 bp, Homo sapiens
gttttcttttaatttt

SEQ ID NO: 552537 - DNA, 22 bp, Homo sapiens
gttttgcactcttgtttctccc

SEQ ID NO: 552538 - DNA, 16 bp, Homo sapiens
gttttggtccactttt

SEQ ID NO: 552539 - DNA, 21 bp, Homo sapiens
gttttggtccacttttccagt

SEQ ID NO: 552540 - DNA, 14 bp, Homo sapiens
gttttgtgaaattt

SEQ ID NO: 552541 - DNA, 18 bp, Homo sapiens
gttttgttgcactgaagt

SEQ ID NO: 552542 - DNA, 20 bp, Homo sapiens
gtttttaaaatcttattaaa

SEQ ID NO: 552543 - DNA, 16 bp, Homo sapiens
gtttttatttctcctt

SEQ ID NO: 552544 - DNA, 17 bp, Homo sapiens
gtttttatttctccttt

SEQ ID NO: 552545 - DNA, 19 bp, Homo sapiens
gtttttgtttttgttttgt

SEQ ID NO: 552546 - DNA, 9 bp, Homo sapiens
gttttttga

SEQ ID NO: 552547 - DNA, 16 bp, Homo sapiens
gttttttgaagtgttg

SEQ ID NO: 552548 - DNA, 19 bp, Homo sapiens
gtttttttttcctgtcctt

SEQ ID NO: 552549 - DNA, 14 bp, Homo sapiens
taaaaaaaaagttg

SEQ ID NO: 552550 - DNA, 11 bp, Homo sapiens
taaaaaaagaa

SEQ ID NO: 552551 - DNA, 14 bp, Homo sapiens
taaaaaaagaaaaa

SEQ ID NO: 552552 - DNA, 21 bp, Homo sapiens
taaaaaaatcccatttatgca

SEQ ID NO: 552553 - DNA, 17 bp, Homo sapiens
taaaaaataataataca

SEQ ID NO: 552554 - DNA, 19 bp, Homo sapiens
taaaaaataataatacaag

SEQ ID NO: 552555 - DNA, 15 bp, Homo sapiens
taaaaacaaaaggca

SEQ ID NO: 552556 - DNA, 12 bp, Homo sapiens
taaaaacatttt

SEQ ID NO: 552557 - DNA, 20 bp, Homo sapiens
taaaaacatttttttaagca

SEQ ID NO: 552558 - DNA, 16 bp, Homo sapiens
taaaaactactgaata

SEQ ID NO: 552559 - DNA, 15 bp, Homo sapiens
taaaaactgaagttc

SEQ ID NO: 552560 - DNA, 20 bp, Homo sapiens
taaaaagtattgccaaacat

SEQ ID NO: 552561 - DNA, 15 bp, Homo sapiens
taaaaagtgacacag

SEQ ID NO: 552562 - DNA, 17 bp, Homo sapiens
taaaaagtgacacagca

SEQ ID NO: 552563 - DNA, 16 bp, Homo sapiens
taaaaatagctataaa

SEQ ID NO: 552564 - DNA, 13 bp, Homo sapiens
taaaaatatatat

SEQ ID NO: 552565 - DNA, 22 bp, Homo sapiens
taaaaatatatatagtgctata

SEQ ID NO: 552566 - DNA, 20 bp, Homo sapiens
taaaacattatagattttca

SEQ ID NO: 552567 - DNA, 23 bp, Homo sapiens
taaaacatttcatgtatttcttt

SEQ ID NO: 552568 - DNA, 12 bp, Homo sapiens
tacataaacatc

SEQ ID NO: 552569 - DNA, 13 bp, Homo sapiens
tacataaacatca

SEQ ID NO: 552570 - DNA, 19 bp, Homo sapiens
tacataacaagaaaatcaa

SEQ ID NO: 552571 - DNA, 15 bp, Homo sapiens
tacatatgataaatt

SEQ ID NO: 552572 - DNA, 13 bp, Homo sapiens
tacatctgatatc

SEQ ID NO: 552573 - DNA, 15 bp, Homo sapiens
tacatgatgatttca

SEQ ID NO: 552574 - DNA, 21 bp, Homo sapiens
tacatgtggaaaactcacaga

SEQ ID NO: 552575 - DNA, 13 bp, Homo sapiens
tacatgtgggagc

SEQ ID NO: 552576 - DNA, 12 bp, Homo sapiens
tacatgtgtgta

SEQ ID NO: 552577 - DNA, 21 bp, Homo sapiens
tacattctcagtttttcttaa

SEQ ID NO: 552578 - DNA, 20 bp, Homo sapiens
tacatttatgtgtgaagcaa

SEQ ID NO: 552579 - DNA, 22 bp, Homo sapiens
tacattttgcagctatggacaa

SEQ ID NO: 552580 - DNA, 15 bp, Homo sapiens
taccaaaaaagaaag

SEQ ID NO: 552581 - DNA, 16 bp, Homo sapiens
taccaaaaaagaaagt

SEQ ID NO: 552582 - DNA, 20 bp, Homo sapiens
taccaaagctgctgcacagc

SEQ ID NO: 552583 - DNA, 19 bp, Homo sapiens
taccaaagtgacctaccca

SEQ ID NO: 552584 - DNA, 14 bp, Homo sapiens
taccaatgccaaga

SEQ ID NO: 552585 - DNA, 16 bp, Homo sapiens
taccacactgagttct

SEQ ID NO: 552586 - DNA, 14 bp, Homo sapiens
taccacaggatgca

SEQ ID NO: 552587 - DNA, 18 bp, Homo sapiens
taccacggcctcctttcc

SEQ ID NO: 552588 - DNA, 19 bp, Homo sapiens
taccacggcctcctttccg

SEQ ID NO: 552589 - DNA, 15 bp, Homo sapiens
taccactaattttgt

SEQ ID NO: 552590 - DNA, 11 bp, Homo sapiens
taccactgaat

SEQ ID NO: 552591 - DNA, 16 bp, Homo sapiens
taccactgaatctgta

SEQ ID NO: 552592 - DNA, 22 bp, Homo sapiens
taccatactcatttctaaaaga

SEQ ID NO: 552593 - DNA, 20 bp, Homo sapiens
taccatagcttaagaagtat

SEQ ID NO: 552594 - DNA, 16 bp, Homo sapiens
taccatcggtcagcag

SEQ ID NO: 552595 - DNA, 13 bp, Homo sapiens
taccattaaaata

SEQ ID NO: 552596 - DNA, 14 bp, Homo sapiens
taccattaaaatat

SEQ ID NO: 552597 - DNA, 17 bp, Homo sapiens
taccattggaaatttca

SEQ ID NO: 552598 - DNA, 19 bp, Homo sapiens
taccatttccgtaattctt

SEQ ID NO: 552599 - DNA, 20 bp, Homo sapiens
taccatttccgtaattctta

SEQ ID NO: 552600 - DNA, 15 bp, Homo sapiens
taccattttgaaata

SEQ ID NO: 552601 - DNA, 14 bp, Homo sapiens
tacccaaagcacat

SEQ ID NO: 552602 - DNA, 23 bp, Homo sapiens
tacccctcccggccctgcctgct

SEQ ID NO: 552603 - DNA, 14 bp, Homo sapiens
tacccttctttcca

SEQ ID NO: 552604 - DNA, 22 bp, Homo sapiens
tacctattcaagaagatagttg

SEQ ID NO: 552605 - DNA, 20 bp, Homo sapiens
tacctctaactgtgcaaagc

SEQ ID NO: 552606 - DNA, 20 bp, Homo sapiens
tacctgcgcttgttttaaag

SEQ ID NO: 552607 - DNA, 19 bp, Homo sapiens
tacctggagaagaatggct

SEQ ID NO: 552608 - DNA, 17 bp, Homo sapiens
tacctgggtccccagcc

SEQ ID NO: 552609 - DNA, 23 bp, Homo sapiens
tacctgtaatagcctcaccttcc

SEQ ID NO: 552610 - DNA, 15 bp, Homo sapiens
taccttaaaatttga

SEQ ID NO: 552611 - DNA, 22 bp, Homo sapiens
taccttaaaatttgaaacattg

SEQ ID NO: 552612 - DNA, 18 bp, Homo sapiens
taccttctgatgaagttg

SEQ ID NO: 552613 - DNA, 20 bp, Homo sapiens
taccttctgatgaagttgta

SEQ ID NO: 552614 - DNA, 14 bp, Homo sapiens
taccttttctcttc

SEQ ID NO: 552615 - DNA, 20 bp, Homo sapiens
tacgagcaagcttttacaac

SEQ ID NO: 552616 - DNA, 15 bp, Homo sapiens
tacgcaattgtatat

SEQ ID NO: 552617 - DNA, 12 bp, Homo sapiens
tacgcacgcacc

SEQ ID NO: 552618 - DNA, 13 bp, Homo sapiens
tacgttttctgca

SEQ ID NO: 552619 - DNA, 15 bp, Homo sapiens
tactaaaaatacaaa

SEQ ID NO: 552620 - DNA, 18 bp, Homo sapiens
tactaaaaatacaaacaa

SEQ ID NO: 552621 - DNA, 14 bp, Homo sapiens
tactaaaatatgca

SEQ ID NO: 552622 - DNA, 16 bp, Homo sapiens
tactaacagtaactgc

SEQ ID NO: 552623 - DNA, 12 bp, Homo sapiens
tactaacttcta

SEQ ID NO: 552624 - DNA, 15 bp, Homo sapiens
tactaccaatgccaa

SEQ ID NO: 552625 - DNA, 15 bp, Homo sapiens
tactacctcctctcc

SEQ ID NO: 552626 - DNA, 20 bp, Homo sapiens
tactactgaccagacaagct

SEQ ID NO: 552627 - DNA, 16 bp, Homo sapiens
tactagaaccttctaa

SEQ ID NO: 552628 - DNA, 23 bp, Homo sapiens
tactagcttttcaaacaagaatg

SEQ ID NO: 552629 - DNA, 15 bp, Homo sapiens
tactatggaagccac

SEQ ID NO: 552630 - DNA, 18 bp, Homo sapiens
tactatggtgtgttgtat

SEQ ID NO: 552631 - DNA, 18 bp, Homo sapiens
tactcatttctaaaagaa

SEQ ID NO: 552632 - DNA, 19 bp, Homo sapiens
tactctaaggtaaaaccat

SEQ ID NO: 552633 - DNA, 15 bp, Homo sapiens
tactctgtgctaagt

SEQ ID NO: 552634 - DNA, 16 bp, Homo sapiens
tactcttctctctgct

SEQ ID NO: 552635 - DNA, 17 bp, Homo sapiens
tactgaataaatcatgt

SEQ ID NO: 552636 - DNA, 17 bp, Homo sapiens
tactgaccagacaagct

SEQ ID NO: 552637 - DNA, 21 bp, Homo sapiens
tactgagcagtgatattcttt

SEQ ID NO: 552638 - DNA, 14 bp, Homo sapiens
tactgcctccccca

SEQ ID NO: 552639 - DNA, 13 bp, Homo sapiens
tactgtcttaatt

SEQ ID NO: 552640 - DNA, 14 bp, Homo sapiens
tactgttcctttca

SEQ ID NO: 552641 - DNA, 18 bp, Homo sapiens
tactgttcctttcagatg

SEQ ID NO: 552642 - DNA, 21 bp, Homo sapiens
tactgtttaagacacttccgt

SEQ ID NO: 552643 - DNA, 16 bp, Homo sapiens
tacttaagagaaatgg

SEQ ID NO: 552644 - DNA, 17 bp, Homo sapiens
tacttatttataacatt

SEQ ID NO: 552645 - DNA, 16 bp, Homo sapiens
tacttgatttttcaaa

SEQ ID NO: 552646 - DNA, 13 bp, Homo sapiens
tacttggcaccaa

SEQ ID NO: 552647 - DNA, 15 bp, Homo sapiens
tacttggcaccaata

SEQ ID NO: 552648 - DNA, 18 bp, Homo sapiens
tacttggcaccaataaag

SEQ ID NO: 552649 - DNA, 20 bp, Homo sapiens
tacttggcaccaataaagga

SEQ ID NO: 552650 - DNA, 15 bp, Homo sapiens
tacttggtcacagcc

SEQ ID NO: 552651 - DNA, 15 bp, Homo sapiens
tactttccaattctc

SEQ ID NO: 552652 - DNA, 17 bp, Homo sapiens
tactttgtctaagaaac

SEQ ID NO: 552653 - DNA, 19 bp, Homo sapiens
tactttgtctaagaaacat

SEQ ID NO: 552654 - DNA, 20 bp, Homo sapiens
tactttgtctaagaaacatt

SEQ ID NO: 552655 - DNA, 21 bp, Homo sapiens
tactttgtctaagaaacattg

SEQ ID NO: 552656 - DNA, 14 bp, Homo sapiens
tactttgttaattt

SEQ ID NO: 552657 - DNA, 16 bp, Homo sapiens
tactttgttaatttat

SEQ ID NO: 552658 - DNA, 22 bp, Homo sapiens
tacttttccttgcatacaaaca

SEQ ID NO: 552659 - DNA, 19 bp, Homo sapiens
tagaaaacatttggcagaa

SEQ ID NO: 552660 - DNA, 20 bp, Homo sapiens
tagaaaataaatacaagttt

SEQ ID NO: 552661 - DNA, 19 bp, Homo sapiens
tagaaagtgttctgttaca

SEQ ID NO: 552662 - DNA, 15 bp, Homo sapiens
tagaacaacataaaa

SEQ ID NO: 552663 - DNA, 13 bp, Homo sapiens
tagaaccttctaa

SEQ ID NO: 552664 - DNA, 16 bp, Homo sapiens
tagaagaatgcatgct

SEQ ID NO: 552665 - DNA, 21 bp, Homo sapiens
tagaaggaaaacctagaaaac

SEQ ID NO: 552666 - DNA, 19 bp, Homo sapiens
tagaataatgaagatcttt

SEQ ID NO: 552667 - DNA, 17 bp, Homo sapiens
tagaatcaagtctgtga

SEQ ID NO: 552668 - DNA, 18 bp, Homo sapiens
tagaatcaagtctgtgaa

SEQ ID NO: 552669 - DNA, 21 bp, Homo sapiens
tagaatgaccttgtaatgtaa

SEQ ID NO: 552670 - DNA, 14 bp, Homo sapiens
tagaatgttttcct

SEQ ID NO: 552671 - DNA, 15 bp, Homo sapiens
tagacacacaaagca

SEQ ID NO: 552672 - DNA, 21 bp, Homo sapiens
tagacagatgtggacatgcac

SEQ ID NO: 552673 - DNA, 18 bp, Homo sapiens
tagacataaattgtaatt

SEQ ID NO: 552674 - DNA, 21 bp, Homo sapiens
tagacattattttgtatggaa

SEQ ID NO: 552675 - DNA, 19 bp, Homo sapiens
tagacctgttctttccatc

SEQ ID NO: 552676 - DNA, 21 bp, Homo sapiens
tagacttcagggagtcagctg

SEQ ID NO: 552677 - DNA, 20 bp, Homo sapiens
tagaggcatgggcttgctgt

SEQ ID NO: 552678 - DNA, 16 bp, Homo sapiens
tagaggctatgaagaa

SEQ ID NO: 552679 - DNA, 20 bp, Homo sapiens
tagagtatattgaaaagaaa

SEQ ID NO: 552680 - DNA, 21 bp, Homo sapiens
tagagtatattgaaaagaaaa

SEQ ID NO: 552681 - DNA, 19 bp, Homo sapiens
tagagtccaacgtggggca

SEQ ID NO: 552682 - DNA, 16 bp, Homo sapiens
tagagttctattagaa

SEQ ID NO: 552683 - DNA, 20 bp, Homo sapiens
tagataccattttgaaatat

SEQ ID NO: 552684 - DNA, 16 bp, Homo sapiens
tagatatgagaaatat

SEQ ID NO: 552685 - DNA, 21 bp, Homo sapiens
tagcaaaaaaagttgtatgat

SEQ ID NO: 552686 - DNA, 21 bp, Homo sapiens
tagcaaaccctgtcaaacatt

SEQ ID NO: 552687 - DNA, 13 bp, Homo sapiens
tagcacagctccc

SEQ ID NO: 552688 - DNA, 21 bp, Homo sapiens
tagcacagtatttaacattct

SEQ ID NO: 552689 - DNA, 20 bp, Homo sapiens
tagcacttccttgccagtct

SEQ ID NO: 552690 - DNA, 21 bp, Homo sapiens
tagcacttccttgccagtctt

SEQ ID NO: 552691 - DNA, 21 bp, Homo sapiens
tagcagcaaaaatataaaata

SEQ ID NO: 552692 - DNA, 18 bp, Homo sapiens
tagcagtggcaaaatatt

SEQ ID NO: 552693 - DNA, 18 bp, Homo sapiens
tagcatatataattttat

SEQ ID NO: 552694 - DNA, 22 bp, Homo sapiens
tagcatatatgtgtccatttcc

SEQ ID NO: 552695 - DNA, 20 bp, Homo sapiens
tagccaacggccccagcttc

SEQ ID NO: 552696 - DNA, 21 bp, Homo sapiens
tagccaacggccccagcttct

SEQ ID NO: 552697 - DNA, 21 bp, Homo sapiens
tagccccaacccaaacctgga

SEQ ID NO: 552698 - DNA, 20 bp, Homo sapiens
tagcgaaaggcgagtccagg

SEQ ID NO: 552699 - DNA, 13 bp, Homo sapiens
tagcgttcccaac

SEQ ID NO: 552700 - DNA, 19 bp, Homo sapiens
tagctacccaaaagagaaa

SEQ ID NO: 552701 - DNA, 17 bp, Homo sapiens
tagctctgaatgctatt

SEQ ID NO: 552702 - DNA, 18 bp, Homo sapiens
tagctcttcctccccagg

SEQ ID NO: 552703 - DNA, 22 bp, Homo sapiens
tagctgtcatggtgcaatttgt

SEQ ID NO: 552704 - DNA, 15 bp, Homo sapiens
tagcttaagaaaaaa

SEQ ID NO: 552705 - DNA, 18 bp, Homo sapiens
tcaaacattagtacttta

SEQ ID NO: 552706 - DNA, 15 bp, Homo sapiens
tcaaaccaatttctt

SEQ ID NO: 552707 - DNA, 18 bp, Homo sapiens
tcaaaccaatttcttcct

SEQ ID NO: 552708 - DNA, 20 bp, Homo sapiens
tcaaagacttcatttaacac

SEQ ID NO: 552709 - DNA, 23 bp, Homo sapiens
tcaaagacttcatttaacactga

SEQ ID NO: 552710 - DNA, 20 bp, Homo sapiens
tcaaagagatgggccttttc

SEQ ID NO: 552711 - DNA, 23 bp, Homo sapiens
tcaaagagatgggccttttcttg

SEQ ID NO: 552712 - DNA, 16 bp, Homo sapiens
tcaaaggagctttctc

SEQ ID NO: 552713 - DNA, 17 bp, Homo sapiens
tcaaagtcatgatgttt

SEQ ID NO: 552714 - DNA, 19 bp, Homo sapiens
tcaaagtcatgatgttttt

SEQ ID NO: 552715 - DNA, 21 bp, Homo sapiens
tcaaagtcatgatgtttttaa

SEQ ID NO: 552716 - DNA, 11 bp, Homo sapiens
tcaaatatgta

SEQ ID NO: 552717 - DNA, 14 bp, Homo sapiens
tcaaatatgtaaac

SEQ ID NO: 552718 - DNA, 16 bp, Homo sapiens
tcaaatatgtaaactt

SEQ ID NO: 552719 - DNA, 13 bp, Homo sapiens
tcaaatgtacatc

SEQ ID NO: 552720 - DNA, 20 bp, Homo sapiens
tcaacaaggcttgctgcaga

SEQ ID NO: 552721 - DNA, 13 bp, Homo sapiens
tcaacatgtgtga

SEQ ID NO: 552722 - DNA, 16 bp, Homo sapiens
tcaagaaaaaataaat

SEQ ID NO: 552723 - DNA, 17 bp, Homo sapiens
tcaagaaagccagtctt

SEQ ID NO: 552724 - DNA, 14 bp, Homo sapiens
tcaagaacttgttt

SEQ ID NO: 552725 - DNA, 18 bp, Homo sapiens
tcaagaagatagttgtaa

SEQ ID NO: 552726 - DNA, 19 bp, Homo sapiens
tcaagcagaaaaacaggca

SEQ ID NO: 552727 - DNA, 18 bp, Homo sapiens
tcaagctccatcttattt

SEQ ID NO: 552728 - DNA, 14 bp, Homo sapiens
tcaagcttattttg

SEQ ID NO: 552729 - DNA, 20 bp, Homo sapiens
tcaaggagggagaaaggcaa

SEQ ID NO: 552730 - DNA, 21 bp, Homo sapiens
tcaagggctttcctgtgccag

SEQ ID NO: 552731 - DNA, 12 bp, Homo sapiens
tcaagtctgtga

SEQ ID NO: 552732 - DNA, 22 bp, Homo sapiens
tcaagtggcaaagctgttcttc

SEQ ID NO: 552733 - DNA, 16 bp, Homo sapiens
tcaagttgcacactca

SEQ ID NO: 552734 - DNA, 13 bp, Homo sapiens
tcaataaagtttg

SEQ ID NO: 552735 - DNA, 16 bp, Homo sapiens
tcaataacagccgctc

SEQ ID NO: 552736 - DNA, 21 bp, Homo sapiens
tcaataacagccgctccagag

SEQ ID NO: 552737 - DNA, 16 bp, Homo sapiens
tcaatctcgtatagaa

SEQ ID NO: 552738 - DNA, 17 bp, Homo sapiens
tcaatctcgtatagaag

SEQ ID NO: 552739 - DNA, 18 bp, Homo sapiens
tcaatctcgtatagaagt

SEQ ID NO: 552740 - DNA, 21 bp, Homo sapiens
tcaatctcgtatagaagtctt

SEQ ID NO: 552741 - DNA, 16 bp, Homo sapiens
tcaatgctacaaaatg

SEQ ID NO: 552742 - DNA, 21 bp, Homo sapiens
tcaatgttcacgcaacttgaa

SEQ ID NO: 552743 - DNA, 12 bp, Homo sapiens
tcaattacagag

SEQ ID NO: 552744 - DNA, 13 bp, Homo sapiens
tcaattcattgtg

SEQ ID NO: 552745 - DNA, 15 bp, Homo sapiens
tcaattgttaatgtg

SEQ ID NO: 552746 - DNA, 23 bp, Homo sapiens
tcaatttattgcacaaaatataa

SEQ ID NO: 552747 - DNA, 19 bp, Homo sapiens
tcaatttcaattttgtctg

SEQ ID NO: 552748 - DNA, 18 bp, Homo sapiens
tcacaaagctatttaagt

SEQ ID NO: 552749 - DNA, 14 bp, Homo sapiens
tcacaaatattaaa

SEQ ID NO: 552750 - DNA, 16 bp, Homo sapiens
tcacacaatcagacca

SEQ ID NO: 552751 - DNA, 20 bp, Homo sapiens
tcacacaatcagaccaagga

SEQ ID NO: 552752 - DNA, 17 bp, Homo sapiens
tcacaccactgccattt

SEQ ID NO: 552753 - DNA, 16 bp, Homo sapiens
tcacactctcttctta

SEQ ID NO: 552754 - DNA, 22 bp, Homo sapiens
tcacagccaggcgctagcacag

SEQ ID NO: 552755 - DNA, 18 bp, Homo sapiens
tcacaggtgtggtgtaat

SEQ ID NO: 552756 - DNA, 19 bp, Homo sapiens
tcacaggtgtggtgtaatt

SEQ ID NO: 552757 - DNA, 15 bp, Homo sapiens
tcacagtgtctgtaa

SEQ ID NO: 552758 - DNA, 19 bp, Homo sapiens
tcacagtgtctgtaaatca

SEQ ID NO: 552759 - DNA, 20 bp, Homo sapiens
tcacagtgtctgtaaatcaa

SEQ ID NO: 552760 - DNA, 15 bp, Homo sapiens
tcacatcccacccca

SEQ ID NO: 552761 - DNA, 18 bp, Homo sapiens
tcacatgcccctcttaga

SEQ ID NO: 552762 - DNA, 20 bp, Homo sapiens
tcacatgcccctcttagaag

SEQ ID NO: 552763 - DNA, 12 bp, Homo sapiens
tcacatgttttc

SEQ ID NO: 552764 - DNA, 17 bp, Homo sapiens
tcacatgttttcaaatg

SEQ ID NO: 552765 - DNA, 15 bp, Homo sapiens
tcaccagtacattct

SEQ ID NO: 552766 - DNA, 21 bp, Homo sapiens
tcaccagtacattctcagttt

SEQ ID NO: 552767 - DNA, 20 bp, Homo sapiens
tcacccgtacaggcaattcc

SEQ ID NO: 552768 - DNA, 23 bp, Homo sapiens
tcaccgagaggaaaaaggcttct

SEQ ID NO: 552769 - DNA, 13 bp, Homo sapiens
tcacctctgtaat

SEQ ID NO: 552770 - DNA, 15 bp, Homo sapiens
tcacctgcttctctg

SEQ ID NO: 552771 - DNA, 22 bp, Homo sapiens
tcacctgcttctctgcccagct

SEQ ID NO: 552772 - DNA, 23 bp, Homo sapiens
tcacctgcttctctgcccagctt

SEQ ID NO: 552773 - DNA, 13 bp, Homo sapiens
tcaccttgcattt

SEQ ID NO: 552774 - DNA, 17 bp, Homo sapiens
tcacgtcataggaagtt

SEQ ID NO: 552775 - DNA, 19 bp, Homo sapiens
tcactattgggcccccagg

SEQ ID NO: 552776 - DNA, 16 bp, Homo sapiens
tcactcactgtcaatg

SEQ ID NO: 552777 - DNA, 15 bp, Homo sapiens
tcactctaagatgtt

SEQ ID NO: 552778 - DNA, 17 bp, Homo sapiens
tcactctaagatgttat

SEQ ID NO: 552779 - DNA, 21 bp, Homo sapiens
tcactctaagatgttatattt

SEQ ID NO: 552780 - DNA, 17 bp, Homo sapiens
tcactgaacttttcaaa

SEQ ID NO: 552781 - DNA, 13 bp, Homo sapiens
tcactgctgtaaa

SEQ ID NO: 552782 - DNA, 22 bp, Homo sapiens
tcactgctgtaaagcaaaatat

SEQ ID NO: 552783 - DNA, 16 bp, Homo sapiens
tcactggcatctttgc

SEQ ID NO: 552784 - DNA, 14 bp, Homo sapiens
tcactgtcaatgat

SEQ ID NO: 552785 - DNA, 15 bp, Homo sapiens
tcactgttataaatt

SEQ ID NO: 552786 - DNA, 19 bp, Homo sapiens
tcacttctttcccttcctc

SEQ ID NO: 552787 - DNA, 15 bp, Homo sapiens
tcactttatttcatt

SEQ ID NO: 552788 - DNA, 17 bp, Homo sapiens
tcactttgcaaagacag

SEQ ID NO: 552789 - DNA, 21 bp, Homo sapiens
tcagaaaagcacctcttgaag

SEQ ID NO: 552790 - DNA, 19 bp, Homo sapiens
tcagaaacccggcttcctg

SEQ ID NO: 552791 - DNA, 20 bp, Homo sapiens
tcagaaagacattcttagtt

SEQ ID NO: 552792 - DNA, 15 bp, Homo sapiens
tcagaagtccagagt

SEQ ID NO: 552793 - DNA, 14 bp, Homo sapiens
tcagaatctttcct

SEQ ID NO: 552794 - DNA, 15 bp, Homo sapiens
tcagaatctttcctt

SEQ ID NO: 552795 - DNA, 19 bp, Homo sapiens
tcagacacaaacaaacaag

SEQ ID NO: 552796 - DNA, 17 bp, Homo sapiens
tcagacacctagactct

SEQ ID NO: 552797 - DNA, 14 bp, Homo sapiens
tcagaccaaggaac

SEQ ID NO: 552798 - DNA, 15 bp, Homo sapiens
tcagagaaaacttca

SEQ ID NO: 552799 - DNA, 20 bp, Homo sapiens
tcagagaaattatgttttca

SEQ ID NO: 552800 - DNA, 17 bp, Homo sapiens
tcagataatggtaattt

SEQ ID NO: 552801 - DNA, 15 bp, Homo sapiens
tcagatcttcttttg

SEQ ID NO: 552802 - DNA, 16 bp, Homo sapiens
tcagatgcctcagagg

SEQ ID NO: 552803 - DNA, 20 bp, Homo sapiens
tcagatttgcacaaaaagat

SEQ ID NO: 552804 - DNA, 17 bp, Homo sapiens
tcagcaaacccaaagat

SEQ ID NO: 552805 - DNA, 19 bp, Homo sapiens
tcagcaaacccaaagatgt

SEQ ID NO: 552806 - DNA, 17 bp, Homo sapiens
tcagcagcggcagcagc

SEQ ID NO: 552807 - DNA, 13 bp, Homo sapiens
tcagcaggcagcc

SEQ ID NO: 552808 - DNA, 12 bp, Homo sapiens
tcagcatatata

SEQ ID NO: 552809 - DNA, 21 bp, Homo sapiens
tcagcatatatataaaataca

SEQ ID NO: 552810 - DNA, 19 bp, Homo sapiens
tcagcccaatccctgatcc

SEQ ID NO: 552811 - DNA, 18 bp, Homo sapiens
tcagcccctgctgctcct

SEQ ID NO: 552812 - DNA, 23 bp, Homo sapiens
tcagcctcgcaggcctccctgcc

SEQ ID NO: 552813 - DNA, 21 bp, Homo sapiens
tcagctaggaacaaatcttcc

SEQ ID NO: 552814 - DNA, 14 bp, Homo sapiens
tcagctcaattgtt

SEQ ID NO: 552815 - DNA, 15 bp, Homo sapiens
tcagctctctgtata

SEQ ID NO: 552816 - DNA, 14 bp, Homo sapiens
tcagcttcttaata

SEQ ID NO: 552817 - DNA, 22 bp, Homo sapiens
tcaggaaaggaagatgtaagaa

SEQ ID NO: 552818 - DNA, 16 bp, Homo sapiens
tcaggaagaagagatg

SEQ ID NO: 552819 - DNA, 18 bp, Homo sapiens
tcaggaccccatctgctg

SEQ ID NO: 552820 - DNA, 18 bp, Homo sapiens
tcaggaccctcgctggcc

SEQ ID NO: 552821 - DNA, 19 bp, Homo sapiens
tcaggaggcagtggcttgg

SEQ ID NO: 552822 - DNA, 17 bp, Homo sapiens
tcaggccacggcagcct

SEQ ID NO: 552823 - DNA, 20 bp, Homo sapiens
tcaggccgggcagagcacag

SEQ ID NO: 552824 - DNA, 20 bp, Homo sapiens
tcagggaagataagttggaa

SEQ ID NO: 552825 - DNA, 15 bp, Homo sapiens
tcagggagccctggg

SEQ ID NO: 552826 - DNA, 14 bp, Homo sapiens
tcagggcagatttt

SEQ ID NO: 552827 - DNA, 18 bp, Homo sapiens
tcagggcagattttagtt

SEQ ID NO: 552828 - DNA, 13 bp, Homo sapiens
tcagggggccagg

SEQ ID NO: 552829 - DNA, 14 bp, Homo sapiens
tcaggtcctgctca

SEQ ID NO: 552830 - DNA, 14 bp, Homo sapiens
tcaggtgaaaatgt

SEQ ID NO: 552831 - DNA, 19 bp, Homo sapiens
tcaggttaggcagtataaa

SEQ ID NO: 552832 - DNA, 23 bp, Homo sapiens
tcaggttaggcagtataaagaat

SEQ ID NO: 552833 - DNA, 21 bp, Homo sapiens
tcaggtttccggctactgaca

SEQ ID NO: 552834 - DNA, 16 bp, Homo sapiens
tcagtaaacctgtctg

SEQ ID NO: 552835 - DNA, 17 bp, Homo sapiens
tcagtagcttaagaaaa

SEQ ID NO: 552836 - DNA, 23 bp, Homo sapiens
tcagtcgcctttcagcaggcagc

SEQ ID NO: 552837 - DNA, 17 bp, Homo sapiens
tcagtgcccatgtgtat

SEQ ID NO: 552838 - DNA, 21 bp, Homo sapiens
tcagttacagtggcagtattg

SEQ ID NO: 552839 - DNA, 23 bp, Homo sapiens
tcagttattgtccctggcttcct

SEQ ID NO: 552840 - DNA, 20 bp, Homo sapiens
tcagttcaaagtcatgatgt

SEQ ID NO: 552841 - DNA, 22 bp, Homo sapiens
tcagttcaaagtcatgatgttt

SEQ ID NO: 552842 - DNA, 14 bp, Homo sapiens
tctcttctgtgttt

SEQ ID NO: 552843 - DNA, 18 bp, Homo sapiens
tctctttcttcctttcta

SEQ ID NO: 552844 - DNA, 22 bp, Homo sapiens
tctgaaaaccccatttgctttc

SEQ ID NO: 552845 - DNA, 14 bp, Homo sapiens
tctgaaaactggaa

SEQ ID NO: 552846 - DNA, 13 bp, Homo sapiens
tctgaaactaatg

SEQ ID NO: 552847 - DNA, 15 bp, Homo sapiens
tctgaaactaatgaa

SEQ ID NO: 552848 - DNA, 14 bp, Homo sapiens
tctgaactgctgct

SEQ ID NO: 552849 - DNA, 14 bp, Homo sapiens
tctgaccacagaca

SEQ ID NO: 552850 - DNA, 15 bp, Homo sapiens
tctgaccacagacac

SEQ ID NO: 552851 - DNA, 19 bp, Homo sapiens
tctgaccacagacactcct

SEQ ID NO: 552852 - DNA, 22 bp, Homo sapiens
tctgacctgcccccgctctgcc

SEQ ID NO: 552853 - DNA, 16 bp, Homo sapiens
tctgactcttccccag

SEQ ID NO: 552854 - DNA, 22 bp, Homo sapiens
tctgagagaggctaaaatgttt

SEQ ID NO: 552855 - DNA, 16 bp, Homo sapiens
tctgagagcaaactgg

SEQ ID NO: 552856 - DNA, 16 bp, Homo sapiens
tctgagctggcctctc

SEQ ID NO: 552857 - DNA, 12 bp, Homo sapiens
tctgaggacaag

SEQ ID NO: 552858 - DNA, 12 bp, Homo sapiens
tctgagtcctca

SEQ ID NO: 552859 - DNA, 21 bp, Homo sapiens
tctgatacttatttataacat

SEQ ID NO: 552860 - DNA, 16 bp, Homo sapiens
tctgatgaagttgtac

SEQ ID NO: 552861 - DNA, 17 bp, Homo sapiens
tctgcagtcatctcccc

SEQ ID NO: 552862 - DNA, 14 bp, Homo sapiens
tctgcagtgttctg

SEQ ID NO: 552863 - DNA, 18 bp, Homo sapiens
tctgcagtgttctgtgaa

SEQ ID NO: 552864 - DNA, 21 bp, Homo sapiens
tctgcattttctgaaactaat

SEQ ID NO: 552865 - DNA, 15 bp, Homo sapiens
tctgccatcagcccc

SEQ ID NO: 552866 - DNA, 19 bp, Homo sapiens
tctgccatgaactggaggc

SEQ ID NO: 552867 - DNA, 22 bp, Homo sapiens
tctgccccaagttttgtgaaat

SEQ ID NO: 552868 - DNA, 19 bp, Homo sapiens
tctgccctcccttcttgtg

SEQ ID NO: 552869 - DNA, 21 bp, Homo sapiens
tctgcctgaggggcagcctgc

SEQ ID NO: 552870 - DNA, 12 bp, Homo sapiens
tctgcctgccct

SEQ ID NO: 552871 - DNA, 16 bp, Homo sapiens
tctgcctgtcaagttt

SEQ ID NO: 552872 - DNA, 13 bp, Homo sapiens
tctgccttccagg

SEQ ID NO: 552873 - DNA, 21 bp, Homo sapiens
tctgccttttgttcatttcat

SEQ ID NO: 552874 - DNA, 17 bp, Homo sapiens
tctgctaaattgatgtt

SEQ ID NO: 552875 - DNA, 20 bp, Homo sapiens
tctgctaaattgatgttgat

SEQ ID NO: 552876 - DNA, 14 bp, Homo sapiens
tctgctccagctct

SEQ ID NO: 552877 - DNA, 16 bp, Homo sapiens
tctgctcccccttttc

SEQ ID NO: 552878 - DNA, 19 bp, Homo sapiens
tctgctgagctctgacctg

SEQ ID NO: 552879 - DNA, 13 bp, Homo sapiens
tctgctgccccca

SEQ ID NO: 552880 - DNA, 22 bp, Homo sapiens
tctgctgtaagacggccttgga

SEQ ID NO: 552881 - DNA, 23 bp, Homo sapiens
tctgctgtgggcacaggtcaggc

SEQ ID NO: 552882 - DNA, 16 bp, Homo sapiens
tctggagaccaggact

SEQ ID NO: 552883 - DNA, 22 bp, Homo sapiens
tctggaggggagctctgtctgt

SEQ ID NO: 552884 - DNA, 21 bp, Homo sapiens
tctggccccacaccagcccca

SEQ ID NO: 552885 - DNA, 17 bp, Homo sapiens
tctgggaatgtatagta

SEQ ID NO: 552886 - DNA, 13 bp, Homo sapiens
tctggggagctcc

SEQ ID NO: 552887 - DNA, 17 bp, Homo sapiens
tctggtgtctaataaac

SEQ ID NO: 552888 - DNA, 17 bp, Homo sapiens
tctgtaactattgggtg

SEQ ID NO: 552889 - DNA, 15 bp, Homo sapiens
tctgtaatttttcag

SEQ ID NO: 552890 - DNA, 17 bp, Homo sapiens
tctgtacagatcaagaa

SEQ ID NO: 552891 - DNA, 17 bp, Homo sapiens
tctgtactaaacatttc

SEQ ID NO: 552892 - DNA, 14 bp, Homo sapiens
tctgtcaatgaaaa

SEQ ID NO: 552893 - DNA, 21 bp, Homo sapiens
tctgtcatctaccttttctct

SEQ ID NO: 552894 - DNA, 13 bp, Homo sapiens
tctgtcatttctc

SEQ ID NO: 552895 - DNA, 19 bp, Homo sapiens
tctgtcatttctctttcaa

SEQ ID NO: 552896 - DNA, 18 bp, Homo sapiens
tctgtcccagttaactgt

SEQ ID NO: 552897 - DNA, 17 bp, Homo sapiens
tctgtccccgagccgag

SEQ ID NO: 552898 - DNA, 20 bp, Homo sapiens
tctgtccccgagccgagctc

SEQ ID NO: 552899 - DNA, 21 bp, Homo sapiens
tctgtccttccaacctgttca

SEQ ID NO: 552900 - DNA, 14 bp, Homo sapiens
tctgtcgtccccag

SEQ ID NO: 552901 - DNA, 20 bp, Homo sapiens
tctgtcgtccccagaccagt

SEQ ID NO: 552902 - DNA, 21 bp, Homo sapiens
tctgtcgtccccagaccagta

SEQ ID NO: 552903 - DNA, 18 bp, Homo sapiens
tctgtctctcttttgctc

SEQ ID NO: 552904 - DNA, 14 bp, Homo sapiens
tctgtgaagagcaa

SEQ ID NO: 552905 - DNA, 17 bp, Homo sapiens
tctgtgaatagcagtgg

SEQ ID NO: 552906 - DNA, 21 bp, Homo sapiens
tctgtgaatagcagtggcaaa

SEQ ID NO: 552907 - DNA, 22 bp, Homo sapiens
tctgtgaatagcagtggcaaaa

SEQ ID NO: 552908 - DNA, 21 bp, Homo sapiens
tctgtggcttcccatgtcttt

SEQ ID NO: 552909 - DNA, 17 bp, Homo sapiens
tctgttacaaaatgtaa

SEQ ID NO: 552910 - DNA, 14 bp, Homo sapiens
tctgttcaggaagt

SEQ ID NO: 552911 - DNA, 22 bp, Homo sapiens
tctgttcaggaagtccttatct

SEQ ID NO: 552912 - DNA, 22 bp, Homo sapiens
tctgttttcaatctcgtataga

SEQ ID NO: 552913 - DNA, 20 bp, Homo sapiens
tcttaaaaattatctttaaa

SEQ ID NO: 552914 - DNA, 13 bp, Homo sapiens
tcttaaaacacta

SEQ ID NO: 552915 - DNA, 13 bp, Homo sapiens
tcttaaataaaag

SEQ ID NO: 552916 - DNA, 18 bp, Homo sapiens
tcttaatataactgcctt

SEQ ID NO: 552917 - DNA, 16 bp, Homo sapiens
tcttaatattcagaga

SEQ ID NO: 552918 - DNA, 21 bp, Homo sapiens
tcttaattaagtaaactaatg

SEQ ID NO: 552919 - DNA, 13 bp, Homo sapiens
tcttacccaaagc

SEQ ID NO: 552920 - DNA, 17 bp, Homo sapiens
tcttaccgacaagcaca

SEQ ID NO: 552921 - DNA, 22 bp, Homo sapiens
tcttaccgacaagcacagtcag

SEQ ID NO: 552922 - DNA, 20 bp, Homo sapiens
tcttacctgtaatagcctca

SEQ ID NO: 552923 - DNA, 14 bp, Homo sapiens
tcttactttgttaa

SEQ ID NO: 552924 - DNA, 16 bp, Homo sapiens
tcttataacattgtat

SEQ ID NO: 552925 - DNA, 12 bp, Homo sapiens
tcttatatagca

SEQ ID NO: 552926 - DNA, 16 bp, Homo sapiens
tcttatcctccaccgt

SEQ ID NO: 552927 - DNA, 12 bp, Homo sapiens
tcttatgaatag

SEQ ID NO: 552928 - DNA, 16 bp, Homo sapiens
tcttatgaatagacat

SEQ ID NO: 552929 - DNA, 22 bp, Homo sapiens
tcttatgaatagacataaattg

SEQ ID NO: 552930 - DNA, 13 bp, Homo sapiens
tcttatgcttcca

SEQ ID NO: 552931 - DNA, 15 bp, Homo sapiens
tcttattaaagtttc

SEQ ID NO: 552932 - DNA, 21 bp, Homo sapiens
tcttattaaagtttcaaaaat

SEQ ID NO: 552933 - DNA, 16 bp, Homo sapiens
tcttcatgaaatgcta

SEQ ID NO: 552934 - DNA, 22 bp, Homo sapiens
tcttccaacatgtgatgtgttg

SEQ ID NO: 552935 - DNA, 14 bp, Homo sapiens
tcttcccatggtgc

SEQ ID NO: 552936 - DNA, 20 bp, Homo sapiens
tcttccctggtaagaaaaag

SEQ ID NO: 552937 - DNA, 16 bp, Homo sapiens
tcttcctactcttctc

SEQ ID NO: 552938 - DNA, 21 bp, Homo sapiens
tcttcctccctgggggcccca

SEQ ID NO: 552939 - DNA, 21 bp, Homo sapiens
tcttcctctgctaaattgatg

SEQ ID NO: 552940 - DNA, 14 bp, Homo sapiens
tcttcctcttacct

SEQ ID NO: 552941 - DNA, 19 bp, Homo sapiens
tcttcctggacaggccagg

SEQ ID NO: 552942 - DNA, 21 bp, Homo sapiens
tcttcctggtcgaaagttagt

SEQ ID NO: 552943 - DNA, 16 bp, Homo sapiens
tcttcctggtgaccct

SEQ ID NO: 552944 - DNA, 16 bp, Homo sapiens
tcttctcccccatcct

SEQ ID NO: 552945 - DNA, 12 bp, Homo sapiens
tcttctctctgc

SEQ ID NO: 552946 - DNA, 15 bp, Homo sapiens
tcttctctctgtgct

SEQ ID NO: 552947 - DNA, 13 bp, Homo sapiens
tcttctgccaaga

SEQ ID NO: 552948 - DNA, 12 bp, Homo sapiens
tcttctggaatg

SEQ ID NO: 552949 - DNA, 14 bp, Homo sapiens
tcttctgtcatcta

SEQ ID NO: 552950 - DNA, 20 bp, Homo sapiens
tcttcttttgggaggatttg

SEQ ID NO: 552951 - DNA, 21 bp, Homo sapiens
tcttcttttgggaggatttga

SEQ ID NO: 552952 - DNA, 18 bp, Homo sapiens
tcttgaatgcttaaatga

SEQ ID NO: 552953 - DNA, 22 bp, Homo sapiens
tcttgaatggcaatgttttgct

SEQ ID NO: 552954 - DNA, 23 bp, Homo sapiens
tcttgaatggcaatgttttgctt

SEQ ID NO: 552955 - DNA, 20 bp, Homo sapiens
tcttgcacagtcactgctct

SEQ ID NO: 552956 - DNA, 21 bp, Homo sapiens
tcttgcctgaactcctgccat

SEQ ID NO: 552957 - DNA, 12 bp, Homo sapiens
tcttgctctcct

SEQ ID NO: 552958 - DNA, 16 bp, Homo sapiens
tcttggaactgcacca

SEQ ID NO: 552959 - DNA, 14 bp, Homo sapiens
tcttgtttctcccg

SEQ ID NO: 552960 - DNA, 16 bp, Homo sapiens
tctttagaaaaggcat

SEQ ID NO: 552961 - DNA, 22 bp, Homo sapiens
tctttagaacaacataaaatta

SEQ ID NO: 552962 - DNA, 14 bp, Homo sapiens
tctttcccttcctc

SEQ ID NO: 552963 - DNA, 14 bp, Homo sapiens
tctttccttcctct

SEQ ID NO: 552964 - DNA, 16 bp, Homo sapiens
tctttccttcctctca

SEQ ID NO: 552965 - DNA, 13 bp, Homo sapiens
tctttctctttta

SEQ ID NO: 552966 - DNA, 14 bp, Homo sapiens
tctttcttcctttc

SEQ ID NO: 552967 - DNA, 13 bp, Homo sapiens
tctttgaattttc

SEQ ID NO: 552968 - DNA, 14 bp, Homo sapiens
tctttgaattttca

SEQ ID NO: 552969 - DNA, 21 bp, Homo sapiens
tctttgaattttcattttaca

SEQ ID NO: 552970 - DNA, 21 bp, Homo sapiens
tctttgcccccaaacccccat

SEQ ID NO: 552971 - DNA, 15 bp, Homo sapiens
tctttgccctttact

SEQ ID NO: 552972 - DNA, 15 bp, Homo sapiens
tctttggaaaattca

SEQ ID NO: 552973 - DNA, 12 bp, Homo sapiens
tctttggaaata

SEQ ID NO: 552974 - DNA, 15 bp, Homo sapiens
tctttgtaagagcaa

SEQ ID NO: 552975 - DNA, 13 bp, Homo sapiens
tcttttaaaaagt

SEQ ID NO: 552976 - DNA, 24 bp, Homo sapiens
tcttttataaaaaaaatgaaatgt

SEQ ID NO: 552977 - DNA, 21 bp, Homo sapiens
tcttttcatggagtagagtca

SEQ ID NO: 552978 - DNA, 15 bp, Homo sapiens
tcttttgaaaactca

SEQ ID NO: 552979 - DNA, 18 bp, Homo sapiens
tcttttgttttttgaagt

SEQ ID NO: 552980 - DNA, 11 bp, Homo sapiens
tgcataataat

SEQ ID NO: 552981 - DNA, 23 bp, Homo sapiens
tgcataataatcctgcaaagtac

SEQ ID NO: 552982 - DNA, 16 bp, Homo sapiens
tgcataatatgcatat

SEQ ID NO: 552983 - DNA, 17 bp, Homo sapiens
tgcataatatgcatata

SEQ ID NO: 552984 - DNA, 18 bp, Homo sapiens
tgcataatatgcatatat

SEQ ID NO: 552985 - DNA, 20 bp, Homo sapiens
tgcatacaaacaagcatata

SEQ ID NO: 552986 - DNA, 22 bp, Homo sapiens
tgcatagaataatgaagatctt

SEQ ID NO: 552987 - DNA, 22 bp, Homo sapiens
tgcatagtaaatgtagttcata

SEQ ID NO: 552988 - DNA, 17 bp, Homo sapiens
tgcatatatatgtatat

SEQ ID NO: 552989 - DNA, 20 bp, Homo sapiens
tgcatcagtattaatactaa

SEQ ID NO: 552990 - DNA, 15 bp, Homo sapiens
tgcatcccacagcca

SEQ ID NO: 552991 - DNA, 14 bp, Homo sapiens
tgcatgctttccat

SEQ ID NO: 552992 - DNA, 15 bp, Homo sapiens
tgcatgtcgcacaat

SEQ ID NO: 552993 - DNA, 14 bp, Homo sapiens
tgcatgtctgcatg

SEQ ID NO: 552994 - DNA, 11 bp, Homo sapiens
tgcatgtgtgt

SEQ ID NO: 552995 - DNA, 13 bp, Homo sapiens
tgcatgtgtgtat

SEQ ID NO: 552996 - DNA, 14 bp, Homo sapiens
tgcatgtgtgtata

SEQ ID NO: 552997 - DNA, 15 bp, Homo sapiens
tgcatgtgtgtataa

SEQ ID NO: 552998 - DNA, 18 bp, Homo sapiens
tgcattcattcatcctct

SEQ ID NO: 552999 - DNA, 17 bp, Homo sapiens
tgcattgggtgatcatt

SEQ ID NO: 553000 - DNA, 14 bp, Homo sapiens
tgcatttaagttgt

SEQ ID NO: 553001 - DNA, 16 bp, Homo sapiens
tgcatttaagttgtaa

SEQ ID NO: 553002 - DNA, 17 bp, Homo sapiens
tgcatttaagttgtaaa

SEQ ID NO: 553003 - DNA, 19 bp, Homo sapiens
tgcatttaagttgtaaacg

SEQ ID NO: 553004 - DNA, 19 bp, Homo sapiens
tgcattttctgaaactaat

SEQ ID NO: 553005 - DNA, 22 bp, Homo sapiens
tgcattttctgaaactaatgaa

SEQ ID NO: 553006 - DNA, 20 bp, Homo sapiens
tgccaaaataaagtctgtca

SEQ ID NO: 553007 - DNA, 22 bp, Homo sapiens
tgccaaaataaagtctgtcatg

SEQ ID NO: 553008 - DNA, 23 bp, Homo sapiens
tgccaaaataaagtctgtcatgc

SEQ ID NO: 553009 - DNA, 19 bp, Homo sapiens
tgccaaacattaatgttga

SEQ ID NO: 553010 - DNA, 16 bp, Homo sapiens
tgccaaatcctgggca

SEQ ID NO: 553011 - DNA, 23 bp, Homo sapiens
tgccaaatcctgggcatccccag

SEQ ID NO: 553012 - DNA, 19 bp, Homo sapiens
tgccagcatacattttctg

SEQ ID NO: 553013 - DNA, 15 bp, Homo sapiens
tgccagcccagaggc

SEQ ID NO: 553014 - DNA, 17 bp, Homo sapiens
tgccaggaaaagaaaaa

SEQ ID NO: 553015 - DNA, 23 bp, Homo sapiens
tgccaggaaaagaaaaatttctg

SEQ ID NO: 553016 - DNA, 23 bp, Homo sapiens
tgccagtaacacaggccaccctg

SEQ ID NO: 553017 - DNA, 16 bp, Homo sapiens
tgccagtggggcctga

SEQ ID NO: 553018 - DNA, 17 bp, Homo sapiens
tgccatagtcttaactg

SEQ ID NO: 553019 - DNA, 15 bp, Homo sapiens
tgccatcagcccctg

SEQ ID NO: 553020 - DNA, 19 bp, Homo sapiens
tgccatgaactggaggcca

SEQ ID NO: 553021 - DNA, 22 bp, Homo sapiens
tgccatgaactggaggccagga

SEQ ID NO: 553022 - DNA, 17 bp, Homo sapiens
tgccatttcctcctggg

SEQ ID NO: 553023 - DNA, 16 bp, Homo sapiens
tgcccacacaccccaa

SEQ ID NO: 553024 - DNA, 18 bp, Homo sapiens
tgcccactcctgctctgc

SEQ ID NO: 553025 - DNA, 20 bp, Homo sapiens
tgcccactcctgctctgctc

SEQ ID NO: 553026 - DNA, 16 bp, Homo sapiens
tgcccagatcagccag

SEQ ID NO: 553027 - DNA, 16 bp, Homo sapiens
tgcccagcctctttcc

SEQ ID NO: 553028 - DNA, 23 bp, Homo sapiens
tgcccagcctctttcccttccag

SEQ ID NO: 553029 - DNA, 17 bp, Homo sapiens
tgcccagggatttgtcc

SEQ ID NO: 553030 - DNA, 14 bp, Homo sapiens
tgcccatgctgggc

SEQ ID NO: 553031 - DNA, 13 bp, Homo sapiens
tgcccatgtgtat

SEQ ID NO: 553032 - DNA, 17 bp, Homo sapiens
tgccccactacaggccc

SEQ ID NO: 553033 - DNA, 22 bp, Homo sapiens
tgcccccacacctggccctggg

SEQ ID NO: 553034 - DNA, 15 bp, Homo sapiens
tgccccccatgccct

SEQ ID NO: 553035 - DNA, 17 bp, Homo sapiens
tgccccccatgccctcc

SEQ ID NO: 553036 - DNA, 23 bp, Homo sapiens
tgcccccgctctgccatcagccc

SEQ ID NO: 553037 - DNA, 19 bp, Homo sapiens
tgccccgtctacagctccc

SEQ ID NO: 553038 - DNA, 20 bp, Homo sapiens
tgccccgtctacagctcccc

SEQ ID NO: 553039 - DNA, 18 bp, Homo sapiens
tgcccctgcacctgcttc

SEQ ID NO: 553040 - DNA, 20 bp, Homo sapiens
tgcccctgcacctgcttctc

SEQ ID NO: 553041 - DNA, 19 bp, Homo sapiens
tgccctcaaaatctttaga

SEQ ID NO: 553042 - DNA, 15 bp, Homo sapiens
tgccctccctgctgc

SEQ ID NO: 553043 - DNA, 17 bp, Homo sapiens
tgccctccctgctgcca

SEQ ID NO: 553044 - DNA, 20 bp, Homo sapiens
tgccctccctgctgccaggc

SEQ ID NO: 553045 - DNA, 15 bp, Homo sapiens
tgccctccgcccttc

SEQ ID NO: 553046 - DNA, 15 bp, Homo sapiens
tgcccttcactgtca

SEQ ID NO: 553047 - DNA, 17 bp, Homo sapiens
tgccctttgtcctcctg

SEQ ID NO: 553048 - DNA, 20 bp, Homo sapiens
tgccctttgtcctcctgctg

SEQ ID NO: 553049 - DNA, 16 bp, Homo sapiens
tgccgagcccttgccc

SEQ ID NO: 553050 - DNA, 13 bp, Homo sapiens
tgccgctgtgtcc

SEQ ID NO: 553051 - DNA, 22 bp, Homo sapiens
tgccgctgtgtccccgcgggca

SEQ ID NO: 553052 - DNA, 21 bp, Homo sapiens
tgccggtcttgacagctcagt

SEQ ID NO: 553053 - DNA, 19 bp, Homo sapiens
tgccgtgcacggggccagc

SEQ ID NO: 553054 - DNA, 14 bp, Homo sapiens
tgccgtggcaactg

SEQ ID NO: 553055 - DNA, 19 bp, Homo sapiens
tgcctctgaactgctgctg

SEQ ID NO: 553056 - DNA, 23 bp, Homo sapiens
tgcctctgattctatgtaacttg

SEQ ID NO: 553057 - DNA, 16 bp, Homo sapiens
tgcctctgcccttggg

SEQ ID NO: 553058 - DNA, 18 bp, Homo sapiens
tgcctgaggggcagcctg

SEQ ID NO: 553059 - DNA, 22 bp, Homo sapiens
tgcctgaggggcagcctgcctt

SEQ ID NO: 553060 - DNA, 15 bp, Homo sapiens
tgcctgccctttgtc

SEQ ID NO: 553061 - DNA, 23 bp, Homo sapiens
tgcctgctctttggcctgatgac

SEQ ID NO: 553062 - DNA, 14 bp, Homo sapiens
tgcctgctttagaa

SEQ ID NO: 553063 - DNA, 17 bp, Homo sapiens
tgcctgtgaccggggtc

SEQ ID NO: 553064 - DNA, 20 bp, Homo sapiens
tgcctgtgaccggggtcctg

SEQ ID NO: 553065 - DNA, 23 bp, Homo sapiens
tgcctgtgaccggggtcctgagg

SEQ ID NO: 553066 - DNA, 22 bp, Homo sapiens
tgccttccaggcgtagggccag

SEQ ID NO: 553067 - DNA, 23 bp, Homo sapiens
tgccttccaggcgtagggccagg

SEQ ID NO: 553068 - DNA, 19 bp, Homo sapiens
tgccttgcccactcctgct

SEQ ID NO: 553069 - DNA, 20 bp, Homo sapiens
tgccttttgtagctgtcatg

SEQ ID NO: 553070 - DNA, 15 bp, Homo sapiens
tgcgcataggcctgc

SEQ ID NO: 553071 - DNA, 13 bp, Homo sapiens
tgcgggctgggca

SEQ ID NO: 553072 - DNA, 14 bp, Homo sapiens
tgcgggctgggcag

SEQ ID NO: 553073 - DNA, 17 bp, Homo sapiens
tgcgtggctgacccccc

SEQ ID NO: 553074 - DNA, 16 bp, Homo sapiens
tgctaaacgtgtatgt

SEQ ID NO: 553075 - DNA, 16 bp, Homo sapiens
tgctaagaatttttta

SEQ ID NO: 553076 - DNA, 16 bp, Homo sapiens
tgctacaaaatgtgtg

SEQ ID NO: 553077 - DNA, 16 bp, Homo sapiens
tgctatatatataaat

SEQ ID NO: 553078 - DNA, 17 bp, Homo sapiens
tgctatgtcatttcatg

SEQ ID NO: 553079 - DNA, 13 bp, Homo sapiens
tgctcacacaatc

SEQ ID NO: 553080 - DNA, 19 bp, Homo sapiens
tgctcacacaatcagacca

SEQ ID NO: 553081 - DNA, 17 bp, Homo sapiens
tgctcagagtgaagagt

SEQ ID NO: 553082 - DNA, 18 bp, Homo sapiens
tgctccaaatgtctactg

SEQ ID NO: 553083 - DNA, 13 bp, Homo sapiens
tgctccagctctg

SEQ ID NO: 553084 - DNA, 15 bp, Homo sapiens
tgctcccccttttcc

SEQ ID NO: 553085 - DNA, 21 bp, Homo sapiens
tgctccctccgggtcttccta

SEQ ID NO: 553086 - DNA, 22 bp, Homo sapiens
tgctcctcggccagagctccca

SEQ ID NO: 553087 - DNA, 14 bp, Homo sapiens
tgctctacatctcg

SEQ ID NO: 553088 - DNA, 16 bp, Homo sapiens
tgctctccattctttt

SEQ ID NO: 553089 - DNA, 18 bp, Homo sapiens
tgctctccattcttttaa

SEQ ID NO: 553090 - DNA, 12 bp, Homo sapiens
tgctctgagagc

SEQ ID NO: 553091 - DNA, 14 bp, Homo sapiens
tgctctgctcgcct

SEQ ID NO: 553092 - DNA, 10 bp, Homo sapiens
tgctctgctg

SEQ ID NO: 553093 - DNA, 16 bp, Homo sapiens
tgctgaagtccggaac

SEQ ID NO: 553094 - DNA, 21 bp, Homo sapiens
tgctgactgggactcccagct

SEQ ID NO: 553095 - DNA, 16 bp, Homo sapiens
tgctgccaggctccca

SEQ ID NO: 553096 - DNA, 20 bp, Homo sapiens
tgctgccagtaccagcccca

SEQ ID NO: 553097 - DNA, 17 bp, Homo sapiens
tgctgccccacaacaca

SEQ ID NO: 553098 - DNA, 19 bp, Homo sapiens
tgctgctattttactgtct

SEQ ID NO: 553099 - DNA, 20 bp, Homo sapiens
tgctgctcctcggccagagc

SEQ ID NO: 553100 - DNA, 23 bp, Homo sapiens
tgctgctcctcggccagagctcc

SEQ ID NO: 553101 - DNA, 22 bp, Homo sapiens
tgctggtgggcttgtcatagcc

SEQ ID NO: 553102 - DNA, 20 bp, Homo sapiens
tgctgtaaagcaaaatattt

SEQ ID NO: 553103 - DNA, 16 bp, Homo sapiens
tgctgtaagacggcct

SEQ ID NO: 553104 - DNA, 15 bp, Homo sapiens
tgctgtattcccata

SEQ ID NO: 553105 - DNA, 13 bp, Homo sapiens
tgcttaaatgtga

SEQ ID NO: 553106 - DNA, 14 bp, Homo sapiens
tgcttaaatgtgaa

SEQ ID NO: 553107 - DNA, 16 bp, Homo sapiens
tgcttaaatgtgaatt

SEQ ID NO: 553108 - DNA, 20 bp, Homo sapiens
tgcttaattacaatatttct

SEQ ID NO: 553109 - DNA, 21 bp, Homo sapiens
tgcttccagttggactgtggc

SEQ ID NO: 553110 - DNA, 16 bp, Homo sapiens
tgcttctactccatgg

SEQ ID NO: 553111 - DNA, 23 bp, Homo sapiens
tgcttctactccatggtgaactg

SEQ ID NO: 553112 - DNA, 14 bp, Homo sapiens
tgcttctcatcccc

SEQ ID NO: 553113 - DNA, 14 bp, Homo sapiens
tgcttgttcttcct

SEQ ID NO: 553114 - DNA, 14 bp, Homo sapiens
tgctttatttttca

SEQ ID NO: 553115 - DNA, 14 bp, Homo sapiens
tgctttccatattt

SEQ ID NO: 553116 - DNA, 16 bp, Homo sapiens
tgtctaagaaacattg

SEQ ID NO: 553117 - DNA, 19 bp, Homo sapiens
tgtctaagaaacattggaa

SEQ ID NO: 553118 - DNA, 15 bp, Homo sapiens
tgtctcaaaataaaa

SEQ ID NO: 553119 - DNA, 21 bp, Homo sapiens
tgtctcaaaataaaaccagaa

SEQ ID NO: 553120 - DNA, 21 bp, Homo sapiens
tgtctcctctatcctgggctt

SEQ ID NO: 553121 - DNA, 18 bp, Homo sapiens
tgtctctcttttgctctc

SEQ ID NO: 553122 - DNA, 14 bp, Homo sapiens
tgtctcttctcctt

SEQ ID NO: 553123 - DNA, 12 bp, Homo sapiens
tgtctcttctgg

SEQ ID NO: 553124 - DNA, 22 bp, Homo sapiens
tgtctgccccaagttttgtgaa

SEQ ID NO: 553125 - DNA, 16 bp, Homo sapiens
tgtctgctccagctct

SEQ ID NO: 553126 - DNA, 21 bp, Homo sapiens
tgtctgctggtcacttcttct

SEQ ID NO: 553127 - DNA, 14 bp, Homo sapiens
tgtcttaaataaaa

SEQ ID NO: 553128 - DNA, 19 bp, Homo sapiens
tgtcttaaataaaagaaat

SEQ ID NO: 553129 - DNA, 13 bp, Homo sapiens
tgtcttaattaag

SEQ ID NO: 553130 - DNA, 18 bp, Homo sapiens
tgtcttaattaagtaaac

SEQ ID NO: 553131 - DNA, 20 bp, Homo sapiens
tgtcttctctaacaccttgt

SEQ ID NO: 553132 - DNA, 16 bp, Homo sapiens
tgtcttgtattatcat

SEQ ID NO: 553133 - DNA, 17 bp, Homo sapiens
tgtctttctccaaagtt

SEQ ID NO: 553134 - DNA, 13 bp, Homo sapiens
tgtcttttgtcat

SEQ ID NO: 553135 - DNA, 15 bp, Homo sapiens
tgtgaaagtctcctg

SEQ ID NO: 553136 - DNA, 20 bp, Homo sapiens
tgtgaaagtgccaaaataaa

SEQ ID NO: 553137 - DNA, 17 bp, Homo sapiens
tgtgaaatttttcatat

SEQ ID NO: 553138 - DNA, 15 bp, Homo sapiens
tgtgaactaatgaca

SEQ ID NO: 553139 - DNA, 16 bp, Homo sapiens
tgtgaattactaactt

SEQ ID NO: 553140 - DNA, 20 bp, Homo sapiens
tgtgacatctctattcccca

SEQ ID NO: 553141 - DNA, 17 bp, Homo sapiens
tgtgacatgcgggctgg

SEQ ID NO: 553142 - DNA, 10 bp, Homo sapiens
tgtgacattt

SEQ ID NO: 553143 - DNA, 21 bp, Homo sapiens
tgtgacatttgtcattttcat

SEQ ID NO: 553144 - DNA, 14 bp, Homo sapiens
tgtgaccttctcta

SEQ ID NO: 553145 - DNA, 16 bp, Homo sapiens
tgtgactctaaattct

SEQ ID NO: 553146 - DNA, 15 bp, Homo sapiens
tgtgagctgcaccag

SEQ ID NO: 553147 - DNA, 16 bp, Homo sapiens
tgtgagctgctgccat

SEQ ID NO: 553148 - DNA, 12 bp, Homo sapiens
tgtgaggcagga

SEQ ID NO: 553149 - DNA, 12 bp, Homo sapiens
tgtgagggcagt

SEQ ID NO: 553150 - DNA, 15 bp, Homo sapiens
tgtgagggcagtgca

SEQ ID NO: 553151 - DNA, 21 bp, Homo sapiens
tgtgagtttgtttctttgaat

SEQ ID NO: 553152 - DNA, 16 bp, Homo sapiens
tgtgatctgtccttcc

SEQ ID NO: 553153 - DNA, 16 bp, Homo sapiens
tgtgatgtgacatttg

SEQ ID NO: 553154 - DNA, 16 bp, Homo sapiens
tgtgatgtgttgctct

SEQ ID NO: 553155 - DNA, 23 bp, Homo sapiens
tgtgattttcaaatatgtaaact

SEQ ID NO: 553156 - DNA, 14 bp, Homo sapiens
tgtgcatgtgtgta

SEQ ID NO: 553157 - DNA, 15 bp, Homo sapiens
tgtgcatgtgtgtat

SEQ ID NO: 553158 - DNA, 18 bp, Homo sapiens
tgtgcatgtgtgtataag

SEQ ID NO: 553159 - DNA, 12 bp, Homo sapiens
tgtgccaggagt

SEQ ID NO: 553160 - DNA, 22 bp, Homo sapiens
tgtgccaggagtgggtgggaca

SEQ ID NO: 553161 - DNA, 19 bp, Homo sapiens
tgtgccaggtgaaggaggc

SEQ ID NO: 553162 - DNA, 13 bp, Homo sapiens
tgtgccccttccc

SEQ ID NO: 553163 - DNA, 14 bp, Homo sapiens
tgtgccccttcccc

SEQ ID NO: 553164 - DNA, 18 bp, Homo sapiens
tgtgccccttccccatgc

SEQ ID NO: 553165 - DNA, 22 bp, Homo sapiens
tgtgcgcataggcctgctttgt

SEQ ID NO: 553166 - DNA, 15 bp, Homo sapiens
tgtgctccaaatgtc

SEQ ID NO: 553167 - DNA, 17 bp, Homo sapiens
tgtgctgggttattcag

SEQ ID NO: 553168 - DNA, 16 bp, Homo sapiens
tgtgcttatgtcattt

SEQ ID NO: 553169 - DNA, 17 bp, Homo sapiens
tgtggacatgcacccgc

SEQ ID NO: 553170 - DNA, 15 bp, Homo sapiens
tgtggagctgcttcc

SEQ ID NO: 553171 - DNA, 19 bp, Homo sapiens
tgtggagctgcttccagtt

SEQ ID NO: 553172 - DNA, 23 bp, Homo sapiens
tgtggatggaggtgatgaaaacc

SEQ ID NO: 553173 - DNA, 19 bp, Homo sapiens
tgtggcctttatctcaacg

SEQ ID NO: 553174 - DNA, 21 bp, Homo sapiens
tgtggctaaatgcctaataaa

SEQ ID NO: 553175 - DNA, 13 bp, Homo sapiens
tgtgggctccctt

SEQ ID NO: 553176 - DNA, 13 bp, Homo sapiens
tgtggggccacac

SEQ ID NO: 553177 - DNA, 22 bp, Homo sapiens
tgtggtgaggtcctgtcctggc

SEQ ID NO: 553178 - DNA, 13 bp, Homo sapiens
tgtggtgtaattt

SEQ ID NO: 553179 - DNA, 15 bp, Homo sapiens
tgtgtaatttttctg

SEQ ID NO: 553180 - DNA, 13 bp, Homo sapiens
tgtgtacaaaata

SEQ ID NO: 553181 - DNA, 17 bp, Homo sapiens
tgtgtataagtgcacac

SEQ ID NO: 553182 - DNA, 23 bp, Homo sapiens
tgtgtatatatgtgtatatatac

SEQ ID NO: 553183 - DNA, 20 bp, Homo sapiens
tgtgtatggaagacaaatac

SEQ ID NO: 553184 - DNA, 21 bp, Homo sapiens
tgtgtatggaagacaaataca

SEQ ID NO: 553185 - DNA, 23 bp, Homo sapiens
tgtgtatggaagacaaatacaca

SEQ ID NO: 553186 - DNA, 22 bp, Homo sapiens
tgtgtccgtgaaagttgtgatc

SEQ ID NO: 553187 - DNA, 23 bp, Homo sapiens
tgtgtctccagctgattttaact

SEQ ID NO: 553188 - DNA, 12 bp, Homo sapiens
tgtgtctgctgt

SEQ ID NO: 553189 - DNA, 23 bp, Homo sapiens
tgtgtgaagatcacgttccttcc

SEQ ID NO: 553190 - DNA, 18 bp, Homo sapiens
tgtgtgagtttgctggtt

SEQ ID NO: 553191 - DNA, 14 bp, Homo sapiens
tgtgtgatgtgaca

SEQ ID NO: 553192 - DNA, 17 bp, Homo sapiens
tgtgtgatgtgacattt

SEQ ID NO: 553193 - DNA, 14 bp, Homo sapiens
tgtgtgcatgtgtg

SEQ ID NO: 553194 - DNA, 18 bp, Homo sapiens
tgtgtgccgagcccttgc

SEQ ID NO: 553195 - DNA, 21 bp, Homo sapiens
tgtgtgggtttactctgtgct

SEQ ID NO: 553196 - DNA, 16 bp, Homo sapiens
tgtgtgtgagtttgct

SEQ ID NO: 553197 - DNA, 14 bp, Homo sapiens
tgtgtgtgatgtga

SEQ ID NO: 553198 - DNA, 15 bp, Homo sapiens
tgtgtgtgatgtgac

SEQ ID NO: 553199 - DNA, 20 bp, Homo sapiens
tgtgttgctctccattcttt

SEQ ID NO: 553200 - DNA, 16 bp, Homo sapiens
tgtgtttgctcccctt

SEQ ID NO: 553201 - DNA, 23 bp, Homo sapiens
tgtgttttcttcgtggattgttt

SEQ ID NO: 553202 - DNA, 18 bp, Homo sapiens
tgttaaagatgtagcaaa

SEQ ID NO: 553203 - DNA, 15 bp, Homo sapiens
tgttaaataaggcct

SEQ ID NO: 553204 - DNA, 14 bp, Homo sapiens
tgttaacagtattt

SEQ ID NO: 553205 - DNA, 17 bp, Homo sapiens
tgttaatgagtatatgt

SEQ ID NO: 553206 - DNA, 20 bp, Homo sapiens
tgttaatgagtatatgtaac

SEQ ID NO: 553207 - DNA, 12 bp, Homo sapiens
tgttaatgtgat

SEQ ID NO: 553208 - DNA, 14 bp, Homo sapiens
tgttaatgtgatgg

SEQ ID NO: 553209 - DNA, 16 bp, Homo sapiens
tgttaatttcttgcaa

SEQ ID NO: 553210 - DNA, 22 bp, Homo sapiens
tgttaatttcttgcaatttgaa

SEQ ID NO: 553211 - DNA, 15 bp, Homo sapiens
tgttaatttggacca

SEQ ID NO: 553212 - DNA, 16 bp, Homo sapiens
tgttacaaaatgtaac

SEQ ID NO: 553213 - DNA, 19 bp, Homo sapiens
tgttacaaaatgtaactgt

SEQ ID NO: 553214 - DNA, 23 bp, Homo sapiens
tgttacaaaatgtaactgttacc

SEQ ID NO: 553215 - DNA, 17 bp, Homo sapiens
tgttacataacaagaaa

SEQ ID NO: 553216 - DNA, 18 bp, Homo sapiens
tgttaccattggaaattt

SEQ ID NO: 553217 - DNA, 19 bp, Homo sapiens
tgttaggccaaagacaaat

SEQ ID NO: 553218 - DNA, 13 bp, Homo sapiens
tgttataaaatct

SEQ ID NO: 553219 - DNA, 14 bp, Homo sapiens
tgttataaaatctg

SEQ ID NO: 553220 - DNA, 15 bp, Homo sapiens
tgttataaattttgt

SEQ ID NO: 553221 - DNA, 18 bp, Homo sapiens
tgttataaattttgtaca

SEQ ID NO: 553222 - DNA, 19 bp, Homo sapiens
tgttataaattttgtacat

SEQ ID NO: 553223 - DNA, 14 bp, Homo sapiens
tgttatatttttct

SEQ ID NO: 553224 - DNA, 19 bp, Homo sapiens
tgttattcaataactattg

SEQ ID NO: 553225 - DNA, 21 bp, Homo sapiens
tgttattcaataactattgct

SEQ ID NO: 553226 - DNA, 14 bp, Homo sapiens
tgttcaatttcaga

SEQ ID NO: 553227 - DNA, 18 bp, Homo sapiens
tgttcacgcaacttgaaa

SEQ ID NO: 553228 - DNA, 18 bp, Homo sapiens
tgttcacgtgactcctca

SEQ ID NO: 553229 - DNA, 14 bp, Homo sapiens
tgttcagaaaagca

SEQ ID NO: 553230 - DNA, 15 bp, Homo sapiens
tgttcagaaaagcac

SEQ ID NO: 553231 - DNA, 16 bp, Homo sapiens
tgttctgacagcattt

SEQ ID NO: 553232 - DNA, 16 bp, Homo sapiens
tgttctgtgtctgctg

SEQ ID NO: 553233 - DNA, 18 bp, Homo sapiens
tgttctgtgtctgctgta

SEQ ID NO: 553234 - DNA, 13 bp, Homo sapiens
tgttctgttacaa

SEQ ID NO: 553235 - DNA, 23 bp, Homo sapiens
tgttctgttacaaaatgtaactg

SEQ ID NO: 553236 - DNA, 11 bp, Homo sapiens
tgttcttccag

SEQ ID NO: 553237 - DNA, 22 bp, Homo sapiens
tgttcttccagttactttccaa

SEQ ID NO: 553238 - DNA, 12 bp, Homo sapiens
tgttcttcctgg

SEQ ID NO: 553239 - DNA, 21 bp, Homo sapiens
tgttcttgagcagctgaattg

SEQ ID NO: 553240 - DNA, 17 bp, Homo sapiens
tgttgacatccaagctt

SEQ ID NO: 553241 - DNA, 23 bp, Homo sapiens
tgttgatgcaatccttacaaatg

SEQ ID NO: 553242 - DNA, 19 bp, Homo sapiens
tgttgatttctagttattt

SEQ ID NO: 553243 - DNA, 19 bp, Homo sapiens
tgttgcactgaagtttgat

SEQ ID NO: 553244 - DNA, 23 bp, Homo sapiens
tgttgcactgaagtttgataaat

SEQ ID NO: 553245 - DNA, 15 bp, Homo sapiens
tgttgtaaattagga

SEQ ID NO: 553246 - DNA, 15 bp, Homo sapiens
tgttgtctcttctcc

SEQ ID NO: 553247 - DNA, 20 bp, Homo sapiens
tgtttaaaatggcatttagc

SEQ ID NO: 553248 - DNA, 17 bp, Homo sapiens
tgtttaataaagcgaaa

SEQ ID NO: 553249 - DNA, 13 bp, Homo sapiens
tgtttacacaatt

SEQ ID NO: 553250 - DNA, 14 bp, Homo sapiens
tgtttactttaaat

SEQ ID NO: 553251 - DNA, 22 bp, Homo sapiens
tgtttatctagatgtaaatttt

SEQ ID NO: 553252 - DNA, 19 bp, Homo sapiens
tgtttcacagtgtctgtaa

SEQ ID NO: 553253 - DNA, 23 bp, Homo sapiens
ttccctccctgctgtcattgctt

SEQ ID NO: 553254 - DNA, 17 bp, Homo sapiens
ttccctcgtctttccca

SEQ ID NO: 553255 - DNA, 21 bp, Homo sapiens
ttccctgacactgtctgctgc

SEQ ID NO: 553256 - DNA, 16 bp, Homo sapiens
ttccctggtaagaaaa

SEQ ID NO: 553257 - DNA, 18 bp, Homo sapiens
ttccctggtaagaaaaag

SEQ ID NO: 553258 - DNA, 22 bp, Homo sapiens
ttccctggtaagaaaaagcaaa

SEQ ID NO: 553259 - DNA, 17 bp, Homo sapiens
ttcccttgattcaaata

SEQ ID NO: 553260 - DNA, 14 bp, Homo sapiens
ttccgtcacatccc

SEQ ID NO: 553261 - DNA, 13 bp, Homo sapiens
ttcctaaggcatg

SEQ ID NO: 553262 - DNA, 12 bp, Homo sapiens
ttcctactcttc

SEQ ID NO: 553263 - DNA, 17 bp, Homo sapiens
ttcctactcttctctct

SEQ ID NO: 553264 - DNA, 22 bp, Homo sapiens
ttcctactcttctctctgctct

SEQ ID NO: 553265 - DNA, 18 bp, Homo sapiens
ttcctagttcatcccttc

SEQ ID NO: 553266 - DNA, 18 bp, Homo sapiens
ttcctataccatttccgt

SEQ ID NO: 553267 - DNA, 24 bp, Homo sapiens
ttcctccatcctcctccttcctag

SEQ ID NO: 553268 - DNA, 21 bp, Homo sapiens
ttcctccccaggacttggtct

SEQ ID NO: 553269 - DNA, 22 bp, Homo sapiens
ttcctccccaggacttggtctt

SEQ ID NO: 553270 - DNA, 16 bp, Homo sapiens
ttcctctgctaaattg

SEQ ID NO: 553271 - DNA, 22 bp, Homo sapiens
ttcctctgctaaattgatgttg

SEQ ID NO: 553272 - DNA, 11 bp, Homo sapiens
ttcctctgctc

SEQ ID NO: 553273 - DNA, 12 bp, Homo sapiens
ttcctctgctcc

SEQ ID NO: 553274 - DNA, 19 bp, Homo sapiens
ttcctcttaatgtctcaaa

SEQ ID NO: 553275 - DNA, 23 bp, Homo sapiens
ttcctgccccatcacttacagaa

SEQ ID NO: 553276 - DNA, 15 bp, Homo sapiens
ttcctgcctggtctc

SEQ ID NO: 553277 - DNA, 16 bp, Homo sapiens
ttcctgctcctccagt

SEQ ID NO: 553278 - DNA, 22 bp, Homo sapiens
ttcctgctcctccagtacaata

SEQ ID NO: 553279 - DNA, 18 bp, Homo sapiens
ttcctggacaggccaggt

SEQ ID NO: 553280 - DNA, 23 bp, Homo sapiens
ttcctgtccttctctcacctcct

SEQ ID NO: 553281 - DNA, 24 bp, Homo sapiens
ttcctgtccttctctcacctccta

SEQ ID NO: 553282 - DNA, 16 bp, Homo sapiens
ttcctgtgccaggtga

SEQ ID NO: 553283 - DNA, 16 bp, Homo sapiens
ttcctgttctgtgtct

SEQ ID NO: 553284 - DNA, 12 bp, Homo sapiens
ttccttccacag

SEQ ID NO: 553285 - DNA, 14 bp, Homo sapiens
ttccttcctgttct

SEQ ID NO: 553286 - DNA, 20 bp, Homo sapiens
ttccttgaggggagccagga

SEQ ID NO: 553287 - DNA, 22 bp, Homo sapiens
ttccttgaggggagccaggagg

SEQ ID NO: 553288 - DNA, 20 bp, Homo sapiens
ttcctttggccactgtattt

SEQ ID NO: 553289 - DNA, 15 bp, Homo sapiens
ttcgccccattttct

SEQ ID NO: 553290 - DNA, 20 bp, Homo sapiens
ttcgccgtggctgcggcacc

SEQ ID NO: 553291 - DNA, 21 bp, Homo sapiens
ttcgccgtggctgcggcaccc

SEQ ID NO: 553292 - DNA, 19 bp, Homo sapiens
ttcggaccgaaggtgacag

SEQ ID NO: 553293 - DNA, 13 bp, Homo sapiens
ttctaaaactgta

SEQ ID NO: 553294 - DNA, 20 bp, Homo sapiens
ttctaaaactgtactttgat

SEQ ID NO: 553295 - DNA, 19 bp, Homo sapiens
ttctaaactaggctccttc

SEQ ID NO: 553296 - DNA, 13 bp, Homo sapiens
ttctaaagtactg

SEQ ID NO: 553297 - DNA, 17 bp, Homo sapiens
ttctaaagtactgagca

SEQ ID NO: 553298 - DNA, 18 bp, Homo sapiens
ttctaacataagtaagac

SEQ ID NO: 553299 - DNA, 17 bp, Homo sapiens
ttctaagtgtttcacag

SEQ ID NO: 553300 - DNA, 14 bp, Homo sapiens
ttctaatggtaact

SEQ ID NO: 553301 - DNA, 15 bp, Homo sapiens
ttctaatggtaactt

SEQ ID NO: 553302 - DNA, 16 bp, Homo sapiens
ttctaatggtaacttt

SEQ ID NO: 553303 - DNA, 20 bp, Homo sapiens
ttctaatggtaacttttgta

SEQ ID NO: 553304 - DNA, 17 bp, Homo sapiens
ttctactttaaattgtg

SEQ ID NO: 553305 - DNA, 16 bp, Homo sapiens
ttctagatatgagaaa

SEQ ID NO: 553306 - DNA, 16 bp, Homo sapiens
ttctatccatctcctg

SEQ ID NO: 553307 - DNA, 14 bp, Homo sapiens
ttctatgtaacttg

SEQ ID NO: 553308 - DNA, 15 bp, Homo sapiens
ttctatgtaacttgt

SEQ ID NO: 553309 - DNA, 23 bp, Homo sapiens
ttctatgtaacttgttgcagact

SEQ ID NO: 553310 - DNA, 15 bp, Homo sapiens
ttctcagaagtgaaa

SEQ ID NO: 553311 - DNA, 16 bp, Homo sapiens
ttctcagcatatatat

SEQ ID NO: 553312 - DNA, 12 bp, Homo sapiens
ttctctaaaaca

SEQ ID NO: 553313 - DNA, 21 bp, Homo sapiens
ttctctgcccagcttttcatt

SEQ ID NO: 553314 - DNA, 18 bp, Homo sapiens
ttctctgtacatattagc

SEQ ID NO: 553315 - DNA, 16 bp, Homo sapiens
ttctcttcattttccc

SEQ ID NO: 553316 - DNA, 23 bp, Homo sapiens
ttctcttctccccttccatttct

SEQ ID NO: 553317 - DNA, 19 bp, Homo sapiens
ttctcttggacattgtaaa

SEQ ID NO: 553318 - DNA, 23 bp, Homo sapiens
ttctctttggaaatagcatgaca

SEQ ID NO: 553319 - DNA, 22 bp, Homo sapiens
ttctgaagttatatttcctata

SEQ ID NO: 553320 - DNA, 14 bp, Homo sapiens
ttctgactcttccc

SEQ ID NO: 553321 - DNA, 13 bp, Homo sapiens
ttctgcagaaaat

SEQ ID NO: 553322 - DNA, 16 bp, Homo sapiens
ttctgcctctgatgta

SEQ ID NO: 553323 - DNA, 19 bp, Homo sapiens
ttctggcaaatattttgtc

SEQ ID NO: 553324 - DNA, 15 bp, Homo sapiens
ttctggggtttttct

SEQ ID NO: 553325 - DNA, 16 bp, Homo sapiens
ttctgtactaaacatt

SEQ ID NO: 553326 - DNA, 17 bp, Homo sapiens
ttctgtactaaacattt

SEQ ID NO: 553327 - DNA, 21 bp, Homo sapiens
ttctgtactaaacatttcctt

SEQ ID NO: 553328 - DNA, 14 bp, Homo sapiens
ttctgtcaatgaaa

SEQ ID NO: 553329 - DNA, 22 bp, Homo sapiens
ttctgtcgtccccagaccagta

SEQ ID NO: 553330 - DNA, 16 bp, Homo sapiens
ttctgtgaatagcagt

SEQ ID NO: 553331 - DNA, 16 bp, Homo sapiens
ttctgtgtctgctgta

SEQ ID NO: 553332 - DNA, 13 bp, Homo sapiens
ttctgtgtgaaga

SEQ ID NO: 553333 - DNA, 15 bp, Homo sapiens
ttctgttacaaaatg

SEQ ID NO: 553334 - DNA, 14 bp, Homo sapiens
ttcttaaaaatgca

SEQ ID NO: 553335 - DNA, 14 bp, Homo sapiens
ttcttaaaacacta

SEQ ID NO: 553336 - DNA, 18 bp, Homo sapiens
ttcttaatatatagcatt

SEQ ID NO: 553337 - DNA, 16 bp, Homo sapiens
ttcttacccaaagcac

SEQ ID NO: 553338 - DNA, 14 bp, Homo sapiens
ttcttccaacatgt

SEQ ID NO: 553339 - DNA, 11 bp, Homo sapiens
ttcttccttcc

SEQ ID NO: 553340 - DNA, 17 bp, Homo sapiens
ttcttctcccccatcct

SEQ ID NO: 553341 - DNA, 14 bp, Homo sapiens
ttcttctgaggcct

SEQ ID NO: 553342 - DNA, 13 bp, Homo sapiens
ttcttctttctag

SEQ ID NO: 553343 - DNA, 14 bp, Homo sapiens
ttcttctttctaga

SEQ ID NO: 553344 - DNA, 15 bp, Homo sapiens
ttcttctttctagag

SEQ ID NO: 553345 - DNA, 18 bp, Homo sapiens
ttcttgcctgaactcctg

SEQ ID NO: 553346 - DNA, 19 bp, Homo sapiens
ttctttagaacaacataaa

SEQ ID NO: 553347 - DNA, 23 bp, Homo sapiens
ttctttcaagggctttcctgtgc

SEQ ID NO: 553348 - DNA, 15 bp, Homo sapiens
ttctttgaattttca

SEQ ID NO: 553349 - DNA, 16 bp, Homo sapiens
ttctttgaattttcat

SEQ ID NO: 553350 - DNA, 18 bp, Homo sapiens
ttctttgaattttcattt

SEQ ID NO: 553351 - DNA, 22 bp, Homo sapiens
ttctttgaattttcattttaca

SEQ ID NO: 553352 - DNA, 23 bp, Homo sapiens
ttctttgttaatttggaccattt

SEQ ID NO: 553353 - DNA, 13 bp, Homo sapiens
ttcttttaatttt

SEQ ID NO: 553354 - DNA, 21 bp, Homo sapiens
ttcttttataaaaaaaatgaa

SEQ ID NO: 553355 - DNA, 22 bp, Homo sapiens
ttcttttgttttttgaagtgtt

SEQ ID NO: 553356 - DNA, 14 bp, Homo sapiens
ttgaaaatgtcact

SEQ ID NO: 553357 - DNA, 16 bp, Homo sapiens
ttgaaaatgtcactgt

SEQ ID NO: 553358 - DNA, 12 bp, Homo sapiens
ttgaaactgtat

SEQ ID NO: 553359 - DNA, 17 bp, Homo sapiens
ttgaaactgtatttact

SEQ ID NO: 553360 - DNA, 21 bp, Homo sapiens
ttgaaactgtatttacttgtt

SEQ ID NO: 553361 - DNA, 17 bp, Homo sapiens
ttgaaagggacaagtat

SEQ ID NO: 553362 - DNA, 22 bp, Homo sapiens
ttgaaatatatggtctaatgtt

SEQ ID NO: 553363 - DNA, 19 bp, Homo sapiens
ttgaaattatatctgtggt

SEQ ID NO: 553364 - DNA, 20 bp, Homo sapiens
ttgaagacctaaccagggcc

SEQ ID NO: 553365 - DNA, 13 bp, Homo sapiens
ttgaagcctgctc

SEQ ID NO: 553366 - DNA, 16 bp, Homo sapiens
ttgaagcctgctcctt

SEQ ID NO: 553367 - DNA, 19 bp, Homo sapiens
ttgaagcctgctccttccc

SEQ ID NO: 553368 - DNA, 15 bp, Homo sapiens
ttgaagtcatgctcc

SEQ ID NO: 553369 - DNA, 22 bp, Homo sapiens
ttgaagtgcctctgattctatg

SEQ ID NO: 553370 - DNA, 12 bp, Homo sapiens
ttgaattttcat

SEQ ID NO: 553371 - DNA, 14 bp, Homo sapiens
ttgaattttcattt

SEQ ID NO: 553372 - DNA, 15 bp, Homo sapiens
ttgaattttcatttt

SEQ ID NO: 553373 - DNA, 17 bp, Homo sapiens
ttgaattttcattttac

SEQ ID NO: 553374 - DNA, 20 bp, Homo sapiens
ttgacaataagaaacagttt

SEQ ID NO: 553375 - DNA, 23 bp, Homo sapiens
ttgacaataagaaacagtttaac

SEQ ID NO: 553376 - DNA, 13 bp, Homo sapiens
ttgaccctgaaat

SEQ ID NO: 553377 - DNA, 18 bp, Homo sapiens
ttgaccctgaaatatttt

SEQ ID NO: 553378 - DNA, 22 bp, Homo sapiens
ttgaccttctgtcgtccccaga

SEQ ID NO: 553379 - DNA, 15 bp, Homo sapiens
ttgacgtttcttctt

SEQ ID NO: 553380 - DNA, 19 bp, Homo sapiens
ttgacgtttcttctttcta

SEQ ID NO: 553381 - DNA, 20 bp, Homo sapiens
ttgacgtttcttctttctag

SEQ ID NO: 553382 - DNA, 21 bp, Homo sapiens
ttgagaacattccctggaatt

SEQ ID NO: 553383 - DNA, 22 bp, Homo sapiens
ttgagaacattccctggaattg

SEQ ID NO: 553384 - DNA, 13 bp, Homo sapiens
ttgagagagatgt

SEQ ID NO: 553385 - DNA, 18 bp, Homo sapiens
ttgagagagatgtgtaat

SEQ ID NO: 553386 - DNA, 21 bp, Homo sapiens
ttgagagagatgtgtaatttt

SEQ ID NO: 553387 - DNA, 22 bp, Homo sapiens
ttgagagagatgtgtaattttt

SEQ ID NO: 553388 - DNA, 22 bp, Homo sapiens
ttgagcagtaaatgtatattga

SEQ ID NO: 553389 - DNA, 15 bp, Homo sapiens
ttgaggaaaaatatg

SEQ ID NO: 553390 - DNA, 18 bp, Homo sapiens
ttttgttcttaaaaatgc

SEQ ID NO: 553391 - DNA, 15 bp, Homo sapiens
ttttgttgattaaaa

SEQ ID NO: 553392 - DNA, 11 bp, Homo sapiens
ttttgttgcac

SEQ ID NO: 553393 - DNA, 13 bp, Homo sapiens
ttttgttgcactg

SEQ ID NO: 553394 - DNA, 15 bp, Homo sapiens
ttttgttttgttgca

SEQ ID NO: 553395 - DNA, 16 bp, Homo sapiens
ttttgttttttgagtc

SEQ ID NO: 553396 - DNA, 13 bp, Homo sapiens
tttttaaaatctt

SEQ ID NO: 553397 - DNA, 15 bp, Homo sapiens
tttttaagcctttga

SEQ ID NO: 553398 - DNA, 20 bp, Homo sapiens
tttttaagcctttgaagtgc

SEQ ID NO: 553399 - DNA, 15 bp, Homo sapiens
tttttcaaagacttc

SEQ ID NO: 553400 - DNA, 14 bp, Homo sapiens
tttttcagttcaaa

SEQ ID NO: 553401 - DNA, 12 bp, Homo sapiens
tttttcatattt

SEQ ID NO: 553402 - DNA, 18 bp, Homo sapiens
tttttcattgtgttttct

SEQ ID NO: 553403 - DNA, 12 bp, Homo sapiens
tttttcctacca

SEQ ID NO: 553404 - DNA, 20 bp, Homo sapiens
tttttccttacataaacatc

SEQ ID NO: 553405 - DNA, 21 bp, Homo sapiens
tttttcttaatatatagcatt

SEQ ID NO: 553406 - DNA, 20 bp, Homo sapiens
tttttgtttctgagaaaaga

SEQ ID NO: 553407 - DNA, 18 bp, Homo sapiens
tttttgttttgttgcact

SEQ ID NO: 553408 - DNA, 13 bp, Homo sapiens
ttttttaaaagaa

SEQ ID NO: 553409 - DNA, 14 bp, Homo sapiens
ttttttccttacat

SEQ ID NO: 553410 - DNA, 12 bp, Homo sapiens
ttttttctttca

SEQ ID NO: 553411 - DNA, 13 bp, Homo sapiens
ttttttgaagtgt

SEQ ID NO: 553412 - DNA, 13 bp, Homo sapiens
ttttttgtctgtg

SEQ ID NO: 553413 - DNA, 12 bp, Homo sapiens
tttttttaagca

SEQ ID NO: 553414 - DNA, 12 bp, Homo sapiens
tttttttaagtg

SEQ ID NO: 553415 - DNA, 11 bp, Homo sapiens
tttttttcctt

SEQ ID NO: 553416 - DNA, 13 bp, Homo sapiens
ctgtggcctcagg

SEQ ID NO: 553417 - DNA, 14 bp, Homo sapiens
ctgtggcctgccag

SEQ ID NO: 553418 - DNA, 22 bp, Homo sapiens
ctgtggctggtactttctgtac

SEQ ID NO: 553419 - DNA, 14 bp, Homo sapiens
ctgtgggctccctt

SEQ ID NO: 553420 - DNA, 13 bp, Homo sapiens
ctgtggggagctg

SEQ ID NO: 553421 - DNA, 22 bp, Homo sapiens
ctgtggggagctggtgggggca

SEQ ID NO: 553422 - DNA, 23 bp, Homo sapiens
ctgtgtagtagctcgtgtgctta

SEQ ID NO: 553423 - DNA, 15 bp, Homo sapiens
ctgtgtcagtttatg

SEQ ID NO: 553424 - DNA, 20 bp, Homo sapiens
ctgtgtcagtttatgttttg

SEQ ID NO: 553425 - DNA, 14 bp, Homo sapiens
ctgtgtctgctgta

SEQ ID NO: 553426 - DNA, 23 bp, Homo sapiens
ctgtgtttctagttgcattttca

SEQ ID NO: 553427 - DNA, 19 bp, Homo sapiens
ctgtgtttgctccccttcc

SEQ ID NO: 553428 - DNA, 22 bp, Homo sapiens
ctgtgtttgctccccttcccct

SEQ ID NO: 553429 - DNA, 11 bp, Homo sapiens
ctgttacaaaa

SEQ ID NO: 553430 - DNA, 18 bp, Homo sapiens
ctgttacaaaatgtaact

SEQ ID NO: 553431 - DNA, 19 bp, Homo sapiens
ctgttacaaaatgtaactg

SEQ ID NO: 553432 - DNA, 22 bp, Homo sapiens
ctgttacaaaatgtaactgtta

SEQ ID NO: 553433 - DNA, 21 bp, Homo sapiens
ctgttacataacaagaaaatc

SEQ ID NO: 553434 - DNA, 23 bp, Homo sapiens
ctgttacataacaagaaaatcaa

SEQ ID NO: 553435 - DNA, 16 bp, Homo sapiens
ctgttaccattggaaa

SEQ ID NO: 553436 - DNA, 17 bp, Homo sapiens
ctgttaccattggaaat

SEQ ID NO: 553437 - DNA, 21 bp, Homo sapiens
ctgttaccattggaaatttca

SEQ ID NO: 553438 - DNA, 22 bp, Homo sapiens
ctgttaccattggaaatttcac

SEQ ID NO: 553439 - DNA, 21 bp, Homo sapiens
ctgttcacgtgactcctcaat

SEQ ID NO: 553440 - DNA, 13 bp, Homo sapiens
ctgttctgtgtct

SEQ ID NO: 553441 - DNA, 14 bp, Homo sapiens
ctgttctgtgtctg

SEQ ID NO: 553442 - DNA, 23 bp, Homo sapiens
ctgttgacatccaagcttccttt

SEQ ID NO: 553443 - DNA, 21 bp, Homo sapiens
ctgttgtaatatcagttacag

SEQ ID NO: 553444 - DNA, 18 bp, Homo sapiens
ctgttgtctcttctcctt

SEQ ID NO: 553445 - DNA, 18 bp, Homo sapiens
ctgtttaagacacttccg

SEQ ID NO: 553446 - DNA, 14 bp, Homo sapiens
cttaaaaatgcatt

SEQ ID NO: 553447 - DNA, 16 bp, Homo sapiens
cttaaaaatgcattta

SEQ ID NO: 553448 - DNA, 20 bp, Homo sapiens
cttaaaaatgcatttaagtt

SEQ ID NO: 553449 - DNA, 20 bp, Homo sapiens
cttaaaaattatctttaaaa

SEQ ID NO: 553450 - DNA, 15 bp, Homo sapiens
cttaaaatttgaaac

SEQ ID NO: 553451 - DNA, 16 bp, Homo sapiens
cttaaaatttgaaaca

SEQ ID NO: 553452 - DNA, 20 bp, Homo sapiens
cttctgtcgtccccagacca

SEQ ID NO: 553453 - DNA, 19 bp, Homo sapiens
cttctgttttcaatctcgt

SEQ ID NO: 553454 - DNA, 19 bp, Homo sapiens
cttcttctgtccaagcaga

SEQ ID NO: 553455 - DNA, 21 bp, Homo sapiens
cttcttctgtccaagcagatt

SEQ ID NO: 553456 - DNA, 23 bp, Homo sapiens
cttctttcccttcctccatcctc

SEQ ID NO: 553457 - DNA, 13 bp, Homo sapiens
cttctttcctctt

SEQ ID NO: 553458 - DNA, 14 bp, Homo sapiens
cttgaaaagtgtgt

SEQ ID NO: 553459 - DNA, 17 bp, Homo sapiens
cttgaaattatatctgt

SEQ ID NO: 553460 - DNA, 15 bp, Homo sapiens
cttgaacccaggagg

SEQ ID NO: 553461 - DNA, 14 bp, Homo sapiens
cttgaagaactgac

SEQ ID NO: 553462 - DNA, 15 bp, Homo sapiens
cttgaagcctgctcc

SEQ ID NO: 553463 - DNA, 23 bp, Homo sapiens
cttgaatggcaatgttttgcttt

SEQ ID NO: 553464 - DNA, 18 bp, Homo sapiens
cttgacctcactcagaag

SEQ ID NO: 553465 - DNA, 16 bp, Homo sapiens
cttgacctgctgaagt

SEQ ID NO: 553466 - DNA, 15 bp, Homo sapiens
cttgacgtttcttct

SEQ ID NO: 553467 - DNA, 22 bp, Homo sapiens
cttgaggacctccacctgggag

SEQ ID NO: 553468 - DNA, 24 bp, Homo sapiens
cttgaggacctccacctgggagat

SEQ ID NO: 553469 - DNA, 17 bp, Homo sapiens
cttgaggccaaatgagt

SEQ ID NO: 553470 - DNA, 20 bp, Homo sapiens
cttgaggccaaatgagttcc

SEQ ID NO: 553471 - DNA, 17 bp, Homo sapiens
cttgaggggagccagga

SEQ ID NO: 553472 - DNA, 16 bp, Homo sapiens
cttgcaatttgaaggt

SEQ ID NO: 553473 - DNA, 13 bp, Homo sapiens
cttgcacacatca

SEQ ID NO: 553474 - DNA, 19 bp, Homo sapiens
cttgcacacatcatctgta

SEQ ID NO: 553475 - DNA, 18 bp, Homo sapiens
cttgcactctcttggctg

SEQ ID NO: 553476 - DNA, 16 bp, Homo sapiens
cttgcagtcatcagaa

SEQ ID NO: 553477 - DNA, 16 bp, Homo sapiens
cttgcagttatgttat

SEQ ID NO: 553478 - DNA, 17 bp, Homo sapiens
cttgcagttatgttatc

SEQ ID NO: 553479 - DNA, 12 bp, Homo sapiens
cttgccagtctt

SEQ ID NO: 553480 - DNA, 22 bp, Homo sapiens
cttgcccactcctgctctgctc

SEQ ID NO: 553481 - DNA, 19 bp, Homo sapiens
cttttgtagtcttatgaat

SEQ ID NO: 553482 - DNA, 17 bp, Homo sapiens
cttttgttttttgaagt

SEQ ID NO: 553483 - DNA, 18 bp, Homo sapiens
cttttgttttttgaagtg

SEQ ID NO: 553484 - DNA, 21 bp, Homo sapiens
cttttgttttttgaagtgttg

SEQ ID NO: 553485 - DNA, 20 bp, Homo sapiens
ctttttttaagtgttctgtg

SEQ ID NO: 553486 - DNA, 22 bp, Homo sapiens
ctttttttaagtgttctgtggc

SEQ ID NO: 553487 - DNA, 11 bp, Homo sapiens
gaaaaaaaaga

SEQ ID NO: 553488 - DNA, 17 bp, Homo sapiens
gaaaaaaaagtgtctca

SEQ ID NO: 553489 - DNA, 22 bp, Homo sapiens
gaaaaaaccgtgtttgtctctt

SEQ ID NO: 553490 - DNA, 16 bp, Homo sapiens
gaaaaagcaaaaggca

SEQ ID NO: 553491 - DNA, 16 bp, Homo sapiens
gaaaaagccctcttca

SEQ ID NO: 553492 - DNA, 16 bp, Homo sapiens
gaaaaatatgtgaagg

SEQ ID NO: 553493 - DNA, 18 bp, Homo sapiens
gaaaaatgaaatttaagc

SEQ ID NO: 553494 - DNA, 13 bp, Homo sapiens
gaaaacagaaatt

SEQ ID NO: 553495 - DNA, 15 bp, Homo sapiens
gaaaacagaaattgg

SEQ ID NO: 553496 - DNA, 15 bp, Homo sapiens
gaaaaccccttccca

SEQ ID NO: 553497 - DNA, 22 bp, Homo sapiens
gaaaaccctcgatgttcatgga

SEQ ID NO: 553498 - DNA, 13 bp, Homo sapiens
gaaaacctagaaa

SEQ ID NO: 553499 - DNA, 15 bp, Homo sapiens
gaaaagaaaaagaag

SEQ ID NO: 553500 - DNA, 21 bp, Homo sapiens
gaaaagaaatctatagaaagt

SEQ ID NO: 553501 - DNA, 22 bp, Homo sapiens
gaaaagaaatctatagaaagtg

SEQ ID NO: 553502 - DNA, 19 bp, Homo sapiens
gaaaaggaagggcaggaaa

SEQ ID NO: 553503 - DNA, 16 bp, Homo sapiens
gctgggacgctctgct

SEQ ID NO: 553504 - DNA, 19 bp, Homo sapiens
gctgggacttcttacccaa

SEQ ID NO: 553505 - DNA, 19 bp, Homo sapiens
gctgggcaacatgcctgct

SEQ ID NO: 553506 - DNA, 13 bp, Homo sapiens
gctgggcagctgt

SEQ ID NO: 553507 - DNA, 13 bp, Homo sapiens
gctgggctcccgt

SEQ ID NO: 553508 - DNA, 19 bp, Homo sapiens
gctgtaaataaaaatagct

SEQ ID NO: 553509 - DNA, 15 bp, Homo sapiens
gctgtctgtggcttc

SEQ ID NO: 553510 - DNA, 19 bp, Homo sapiens
gctgtgctctcaccagctg

SEQ ID NO: 553511 - DNA, 19 bp, Homo sapiens
gctgtggcatcaggaaagg

SEQ ID NO: 553512 - DNA, 12 bp, Homo sapiens
gctgtgggctcc

SEQ ID NO: 553513 - DNA, 14 bp, Homo sapiens
gctgtgggctccct

SEQ ID NO: 553514 - DNA, 15 bp, Homo sapiens
gctgtgggctccctt

SEQ ID NO: 553515 - DNA, 16 bp, Homo sapiens
gctgtgggctcccttc

SEQ ID NO: 553516 - DNA, 18 bp, Homo sapiens
gctgtgggctcccttcct

SEQ ID NO: 553517 - DNA, 12 bp, Homo sapiens
gctgttcttcct

SEQ ID NO: 553518 - DNA, 13 bp, Homo sapiens
gctgttgaccagg

SEQ ID NO: 553519 - DNA, 19 bp, Homo sapiens
gctgtttggttttaaaata

SEQ ID NO: 553520 - DNA, 14 bp, Homo sapiens
gcttaaatgtgaat

SEQ ID NO: 553521 - DNA, 23 bp, Homo sapiens
gcttacctgttgtctgaaacata

SEQ ID NO: 553522 - DNA, 21 bp, Homo sapiens
gcttactacatgtgggagctt

SEQ ID NO: 553523 - DNA, 18 bp, Homo sapiens
gcttagaggcatgggctt

SEQ ID NO: 553524 - DNA, 23 bp, Homo sapiens
gcttagtatctcatcaacaaaga

SEQ ID NO: 553525 - DNA, 14 bp, Homo sapiens
gcttcaccagagca

SEQ ID NO: 553526 - DNA, 21 bp, Homo sapiens
gcttcacttctgactcttccc

SEQ ID NO: 553527 - DNA, 13 bp, Homo sapiens
gcttcagcccctg

SEQ ID NO: 553528 - DNA, 19 bp, Homo sapiens
gcttccagtctcactgaca

SEQ ID NO: 553529 - DNA, 23 bp, Homo sapiens
gcttcctgtgctaagtctttccc

SEQ ID NO: 553530 - DNA, 14 bp, Homo sapiens
gcttctcatcccca

SEQ ID NO: 553531 - DNA, 23 bp, Homo sapiens
gcttctccacaacctcctcctcc

SEQ ID NO: 553532 - DNA, 17 bp, Homo sapiens
gcttctccctggactct

SEQ ID NO: 553533 - DNA, 17 bp, Homo sapiens
gcttctctgctgagaag

SEQ ID NO: 553534 - DNA, 19 bp, Homo sapiens
gcttcttaatataactgcc

SEQ ID NO: 553535 - DNA, 19 bp, Homo sapiens
gcttgaggccaaatgagtt

SEQ ID NO: 553536 - DNA, 14 bp, Homo sapiens
gcttgatgctgttt

SEQ ID NO: 553537 - DNA, 23 bp, Homo sapiens
gcttggaaaatgttctgacagca

SEQ ID NO: 553538 - DNA, 16 bp, Homo sapiens
gcttgtcatagccagt

SEQ ID NO: 553539 - DNA, 22 bp, Homo sapiens
gcttgtgtaatttcctgctcct

SEQ ID NO: 553540 - DNA, 22 bp, Homo sapiens
gcttgttcttcctcttacctgt

SEQ ID NO: 553541 - DNA, 20 bp, Homo sapiens
gcttgtttaaggttcttgct

SEQ ID NO: 553542 - DNA, 15 bp, Homo sapiens
gctttaaagtgtaat

SEQ ID NO: 553543 - DNA, 21 bp, Homo sapiens
gctttactctgaatttccagt

SEQ ID NO: 553544 - DNA, 16 bp, Homo sapiens
gctttaggattgaagt

SEQ ID NO: 553545 - DNA, 14 bp, Homo sapiens
gctttccatatttt

SEQ ID NO: 553546 - DNA, 21 bp, Homo sapiens
gctttccatatttttttcctt

SEQ ID NO: 553547 - DNA, 21 bp, Homo sapiens
gctttcctgatgttggtatct

SEQ ID NO: 553548 - DNA, 13 bp, Homo sapiens
gctttcctgtgcc

SEQ ID NO: 553549 - DNA, 23 bp, Homo sapiens
gctttctaaagccacgctgtgtc

SEQ ID NO: 553550 - DNA, 21 bp, Homo sapiens
gcttttaggagaattcacaga

SEQ ID NO: 553551 - DNA, 15 bp, Homo sapiens
gcttttagtttttct

SEQ ID NO: 553552 - DNA, 19 bp, Homo sapiens
gcttttagtttttctgtcc

SEQ ID NO: 553553 - DNA, 16 bp, Homo sapiens
gcttttccaacccatg

SEQ ID NO: 553554 - DNA, 23 bp, Homo sapiens
gcttttccaacccatgagtgcta

SEQ ID NO: 553555 - DNA, 20 bp, Homo sapiens
ggagctggctccagcctgga

SEQ ID NO: 553556 - DNA, 12 bp, Homo sapiens
ggagctggtggg

SEQ ID NO: 553557 - DNA, 23 bp, Homo sapiens
ggagctttctcaatgtcttccca

SEQ ID NO: 553558 - DNA, 14 bp, Homo sapiens
ggaggagagcctgg

SEQ ID NO: 553559 - DNA, 15 bp, Homo sapiens
ggaggagagcctggt

SEQ ID NO: 553560 - DNA, 17 bp, Homo sapiens
ggaggcacacagctgca

SEQ ID NO: 553561 - DNA, 14 bp, Homo sapiens
ggaggcctgaaatg

SEQ ID NO: 553562 - DNA, 16 bp, Homo sapiens
ggaggctccaggcagc

SEQ ID NO: 553563 - DNA, 21 bp, Homo sapiens
ggaggctgagacgcaaggatc

SEQ ID NO: 553564 - DNA, 12 bp, Homo sapiens
ggaggggagctc

SEQ ID NO: 553565 - DNA, 19 bp, Homo sapiens
ggaggggtggtacttggca

SEQ ID NO: 553566 - DNA, 17 bp, Homo sapiens
ggaggttggagggaaag

SEQ ID NO: 553567 - DNA, 20 bp, Homo sapiens
ggagtagtgaagactccaga

SEQ ID NO: 553568 - DNA, 17 bp, Homo sapiens
ggagtattatggaaatc

SEQ ID NO: 553569 - DNA, 22 bp, Homo sapiens
ggagtccagacctgggccctgg

SEQ ID NO: 553570 - DNA, 17 bp, Homo sapiens
ggagtgggtctggagga

SEQ ID NO: 553571 - DNA, 13 bp, Homo sapiens
ggatacttcctgg

SEQ ID NO: 553572 - DNA, 20 bp, Homo sapiens
ggatagctcttcctccccag

SEQ ID NO: 553573 - DNA, 16 bp, Homo sapiens
ggatataatgtatttt

SEQ ID NO: 553574 - DNA, 12 bp, Homo sapiens
ggatgggcacag

SEQ ID NO: 553575 - DNA, 15 bp, Homo sapiens
ggatgggcacaggct

SEQ ID NO: 553576 - DNA, 23 bp, Homo sapiens
ggattgctttgcattactgtccc

SEQ ID NO: 553577 - DNA, 16 bp, Homo sapiens
ggattttatgttgaca

SEQ ID NO: 553578 - DNA, 13 bp, Homo sapiens
ggcaaaaacaaag

SEQ ID NO: 553579 - DNA, 19 bp, Homo sapiens
ggcaaatattttgtcactg

SEQ ID NO: 553580 - DNA, 16 bp, Homo sapiens
ggcaacagagtgagac

SEQ ID NO: 553581 - DNA, 18 bp, Homo sapiens
ggcaatattctctgtaca

SEQ ID NO: 553582 - DNA, 12 bp, Homo sapiens
ggcacagcctgg

SEQ ID NO: 553583 - DNA, 22 bp, Homo sapiens
ggcacaggctgccccacccctc

SEQ ID NO: 553584 - DNA, 13 bp, Homo sapiens
ggcaccaataaag

SEQ ID NO: 553585 - DNA, 19 bp, Homo sapiens
ggcaccaataaaggaggaa

SEQ ID NO: 553586 - DNA, 20 bp, Homo sapiens
ggcaccaataaaggaggaat

SEQ ID NO: 553587 - DNA, 14 bp, Homo sapiens
ggcaccatctccct

SEQ ID NO: 553588 - DNA, 21 bp, Homo sapiens
ggcacccaccagttgctgctg

SEQ ID NO: 553589 - DNA, 13 bp, Homo sapiens
ggcacttctgcct

SEQ ID NO: 553590 - DNA, 15 bp, Homo sapiens
ggcacttctgcctga

SEQ ID NO: 553591 - DNA, 20 bp, Homo sapiens
ggcagaggttgcagtgagct

SEQ ID NO: 553592 - DNA, 21 bp, Homo sapiens
ggcagatgcagctcttcctgg

SEQ ID NO: 553593 - DNA, 14 bp, Homo sapiens
ggcagcagcagcag

SEQ ID NO: 553594 - DNA, 13 bp, Homo sapiens
ggcagccccccag

SEQ ID NO: 553595 - DNA, 23 bp, Homo sapiens
ggcagccccccagtgtccccagg

SEQ ID NO: 553596 - DNA, 19 bp, Homo sapiens
ggcagcctactagggacct

SEQ ID NO: 553597 - DNA, 22 bp, Homo sapiens
ggcagcctgcgtggctgacccc

SEQ ID NO: 553598 - DNA, 19 bp, Homo sapiens
ggcaggggccctgcagctc

SEQ ID NO: 553599 - DNA, 21 bp, Homo sapiens
ggcaggggccctgcagctctc

SEQ ID NO: 553600 - DNA, 15 bp, Homo sapiens
ggcaggggtggagga

SEQ ID NO: 553601 - DNA, 23 bp, Homo sapiens
ggcaggggtggaggagagcctgg

SEQ ID NO: 553602 - DNA, 19 bp, Homo sapiens
ggcagggtgtctgccccct

SEQ ID NO: 553603 - DNA, 19 bp, Homo sapiens
ggcaggtgacagtgaggtc

SEQ ID NO: 553604 - DNA, 14 bp, Homo sapiens
ggcaggtggccagg

SEQ ID NO: 553605 - DNA, 23 bp, Homo sapiens
ggcagtggcttggagcagaggtg

SEQ ID NO: 553606 - DNA, 16 bp, Homo sapiens
ggcagttgcccagcct

SEQ ID NO: 553607 - DNA, 12 bp, Homo sapiens
ggcatcattcca

SEQ ID NO: 553608 - DNA, 16 bp, Homo sapiens
ggcatccccagccccc

SEQ ID NO: 553609 - DNA, 19 bp, Homo sapiens
ggcatccccagccccctgg

SEQ ID NO: 553610 - DNA, 18 bp, Homo sapiens
ggcatccttgaggacctc

SEQ ID NO: 553611 - DNA, 20 bp, Homo sapiens
ggcatctttgctatggggac

SEQ ID NO: 553612 - DNA, 17 bp, Homo sapiens
ggcatgaaatgaacaca

SEQ ID NO: 553613 - DNA, 21 bp, Homo sapiens
ggcatgaccctggagcccggc

SEQ ID NO: 553614 - DNA, 21 bp, Homo sapiens
ggcatgtggcctttatctcaa

SEQ ID NO: 553615 - DNA, 19 bp, Homo sapiens
ggcatttagcacagtattt

SEQ ID NO: 553616 - DNA, 15 bp, Homo sapiens
ggccaaagacaaata

SEQ ID NO: 553617 - DNA, 23 bp, Homo sapiens
ggccaagaggtttggctcctgcc

SEQ ID NO: 553618 - DNA, 15 bp, Homo sapiens
ggccagaagtagctt

SEQ ID NO: 553619 - DNA, 17 bp, Homo sapiens
ggccagggctctggcag

SEQ ID NO: 553620 - DNA, 19 bp, Homo sapiens
ggccagggtctcgtcagga

SEQ ID NO: 553621 - DNA, 22 bp, Homo sapiens
ggccatcagcaccacgtgccaa

SEQ ID NO: 553622 - DNA, 18 bp, Homo sapiens
ggccatggaagctggcag

SEQ ID NO: 553623 - DNA, 21 bp, Homo sapiens
ggcccacattgcccacacctg

SEQ ID NO: 553624 - DNA, 20 bp, Homo sapiens
ggcccacccaagcaggaggc

SEQ ID NO: 553625 - DNA, 10 bp, Homo sapiens
ggcccaggag

SEQ ID NO: 553626 - DNA, 11 bp, Homo sapiens
ggcccaggagc

SEQ ID NO: 553627 - DNA, 14 bp, Homo sapiens
ggcccaggagcgca

SEQ ID NO: 553628 - DNA, 13 bp, Homo sapiens
ggccccacctgca

SEQ ID NO: 553629 - DNA, 19 bp, Homo sapiens
ggccccagcttctcagctc

SEQ ID NO: 553630 - DNA, 22 bp, Homo sapiens
ggcccccaggtctgatctgggt

SEQ ID NO: 553631 - DNA, 13 bp, Homo sapiens
ggccccctgcctg

SEQ ID NO: 553632 - DNA, 12 bp, Homo sapiens
ggccctgcagct

SEQ ID NO: 553633 - DNA, 15 bp, Homo sapiens
ggccctggggcctgt

SEQ ID NO: 553634 - DNA, 22 bp, Homo sapiens
ggccctggttcccccaggaccc

SEQ ID NO: 553635 - DNA, 20 bp, Homo sapiens
ggcccttcccaacctcccct

SEQ ID NO: 553636 - DNA, 16 bp, Homo sapiens
ggccgatggggcagtc

SEQ ID NO: 553637 - DNA, 14 bp, Homo sapiens
ggccggcctggggc

SEQ ID NO: 553638 - DNA, 14 bp, Homo sapiens
ggccgggctggctt

SEQ ID NO: 553639 - DNA, 21 bp, Homo sapiens
ggccgggctggcttctccctg

SEQ ID NO: 553640 - DNA, 16 bp, Homo sapiens
ggccgtggctgcccac

SEQ ID NO: 553641 - DNA, 21 bp, Homo sapiens
ggcctagtggcttcagcccct

SEQ ID NO: 553642 - DNA, 23 bp, Homo sapiens
ggcctagtggcttcagcccctgg

SEQ ID NO: 553643 - DNA, 12 bp, Homo sapiens
ggcctccctgcc

SEQ ID NO: 553644 - DNA, 15 bp, Homo sapiens
ggcctccctgccagt

SEQ ID NO: 553645 - DNA, 22 bp, Homo sapiens
ggcctctcttggaactgcacca

SEQ ID NO: 553646 - DNA, 16 bp, Homo sapiens
ggcctgaaagcaacag

SEQ ID NO: 553647 - DNA, 22 bp, Homo sapiens
ggcctgaaagcaacagctggac

SEQ ID NO: 553648 - DNA, 21 bp, Homo sapiens
ggcctgaaatgtttccaggca

SEQ ID NO: 553649 - DNA, 16 bp, Homo sapiens
ggcctgacctccccct

SEQ ID NO: 553650 - DNA, 15 bp, Homo sapiens
ggcctggccagacca

SEQ ID NO: 553651 - DNA, 13 bp, Homo sapiens
ggcctgtctgtga

SEQ ID NO: 553652 - DNA, 22 bp, Homo sapiens
ggcctgtctgtgaagagcaaga

SEQ ID NO: 553653 - DNA, 20 bp, Homo sapiens
ggccttcacaatctgtcagt

SEQ ID NO: 553654 - DNA, 19 bp, Homo sapiens
ggcgcacccggcagccccc

SEQ ID NO: 553655 - DNA, 20 bp, Homo sapiens
ggcgcacccggcagcccccc

SEQ ID NO: 553656 - DNA, 23 bp, Homo sapiens
ggcgctaacttgcttaaatgtga

SEQ ID NO: 553657 - DNA, 13 bp, Homo sapiens
ggcggggccagga

SEQ ID NO: 553658 - DNA, 16 bp, Homo sapiens
ggcggggccaggatgg

SEQ ID NO: 553659 - DNA, 15 bp, Homo sapiens
ggcggtatccagagg

SEQ ID NO: 553660 - DNA, 17 bp, Homo sapiens
ggcggtatccagaggtg

SEQ ID NO: 553661 - DNA, 21 bp, Homo sapiens
ggcggtatccagaggtgaggg

SEQ ID NO: 553662 - DNA, 14 bp, Homo sapiens
ggcgtagggccagg

SEQ ID NO: 553663 - DNA, 21 bp, Homo sapiens
ggcgtccctgagggcccttcc

SEQ ID NO: 553664 - DNA, 18 bp, Homo sapiens
ggctaaaatgttttcagc

SEQ ID NO: 553665 - DNA, 15 bp, Homo sapiens
ggctaagtccagctc

SEQ ID NO: 553666 - DNA, 17 bp, Homo sapiens
ggctcaagcccaggagg

SEQ ID NO: 553667 - DNA, 18 bp, Homo sapiens
ggctcaagcccaggaggg

SEQ ID NO: 553668 - DNA, 14 bp, Homo sapiens
ggctccacacacac

SEQ ID NO: 553669 - DNA, 14 bp, Homo sapiens
ggctccaggcagca

SEQ ID NO: 553670 - DNA, 21 bp, Homo sapiens
ggctccatccttctccccaag

SEQ ID NO: 553671 - DNA, 13 bp, Homo sapiens
ggctccatgccag

SEQ ID NO: 553672 - DNA, 14 bp, Homo sapiens
ggctccatgccagc

SEQ ID NO: 553673 - DNA, 17 bp, Homo sapiens
ggctccctccctcccag

SEQ ID NO: 553674 - DNA, 22 bp, Homo sapiens
ggctccctccctcccagatcca

SEQ ID NO: 553675 - DNA, 22 bp, Homo sapiens
ccatttagtcctcaccttctgt

SEQ ID NO: 553676 - DNA, 21 bp, Homo sapiens
ccatttcagtaaacctgtctg

SEQ ID NO: 553677 - DNA, 20 bp, Homo sapiens
ccatttccttgtctaaagat

SEQ ID NO: 553678 - DNA, 13 bp, Homo sapiens
ccatttctgcctt

SEQ ID NO: 553679 - DNA, 14 bp, Homo sapiens
ccatttctgccttt

SEQ ID NO: 553680 - DNA, 11 bp, Homo sapiens
ccattttcctg

SEQ ID NO: 553681 - DNA, 13 bp, Homo sapiens
ccattttcctgca

SEQ ID NO: 553682 - DNA, 23 bp, Homo sapiens
ctgaaaactggaataagaagcaa

SEQ ID NO: 553683 - DNA, 15 bp, Homo sapiens
ctgaaactaatgaaa

SEQ ID NO: 553684 - DNA, 18 bp, Homo sapiens
ctgaaagcaacagctgga

SEQ ID NO: 553685 - DNA, 18 bp, Homo sapiens
ctgaaatgtgtgtgatgt

SEQ ID NO: 553686 - DNA, 19 bp, Homo sapiens
ctgaaatgtgtgtgatgtg

SEQ ID NO: 553687 - DNA, 22 bp, Homo sapiens
ctgaacagatgacccctgccca

SEQ ID NO: 553688 - DNA, 13 bp, Homo sapiens
ctgaactgctgct

SEQ ID NO: 553689 - DNA, 18 bp, Homo sapiens
ctgaacttttcaaaataa

SEQ ID NO: 553690 - DNA, 22 bp, Homo sapiens
ctgaacttttcaaaataaagct

SEQ ID NO: 553691 - DNA, 21 bp, Homo sapiens
ctgaagcttcactcactgtca

SEQ ID NO: 553692 - DNA, 14 bp, Homo sapiens
ctgaagttatattt

SEQ ID NO: 553693 - DNA, 17 bp, Homo sapiens
ctgaagttatatttcct

SEQ ID NO: 553694 - DNA, 19 bp, Homo sapiens
ctgaagttctgcctctgat

SEQ ID NO: 553695 - DNA, 12 bp, Homo sapiens
ctgaataaatca

SEQ ID NO: 553696 - DNA, 17 bp, Homo sapiens
ctgaatctgaccacaga

SEQ ID NO: 553697 - DNA, 22 bp, Homo sapiens
ctgaatctgaccacagacactc

SEQ ID NO: 553698 - DNA, 12 bp, Homo sapiens
ctgaatctgtac

SEQ ID NO: 553699 - DNA, 18 bp, Homo sapiens
ctgaatgctatttgtgta

SEQ ID NO: 553700 - DNA, 20 bp, Homo sapiens
ctgaatttggggctacttat

SEQ ID NO: 553701 - DNA, 17 bp, Homo sapiens
ctgacaatactgtatgt

SEQ ID NO: 553702 - DNA, 15 bp, Homo sapiens
ctgacaccttttcag

SEQ ID NO: 553703 - DNA, 15 bp, Homo sapiens
ctgacagcaaacaca

SEQ ID NO: 553704 - DNA, 17 bp, Homo sapiens
ctgacatatttcataag

SEQ ID NO: 553705 - DNA, 18 bp, Homo sapiens
ctgaccacagacactcct

SEQ ID NO: 553706 - DNA, 20 bp, Homo sapiens
ctgaccacagacactcctgg

SEQ ID NO: 553707 - DNA, 23 bp, Homo sapiens
ctgacccccctcaggaccctcgc

SEQ ID NO: 553708 - DNA, 14 bp, Homo sapiens
ctgacctccccctc

SEQ ID NO: 553709 - DNA, 21 bp, Homo sapiens
ctgacctccccctccttccca

SEQ ID NO: 553710 - DNA, 16 bp, Homo sapiens
ctgacctccgccatcc

SEQ ID NO: 553711 - DNA, 23 bp, Homo sapiens
ctgacctgcccccgctctgccat

SEQ ID NO: 553712 - DNA, 14 bp, Homo sapiens
ctgactcttcccca

SEQ ID NO: 553713 - DNA, 13 bp, Homo sapiens
ctgactgacatga

SEQ ID NO: 553714 - DNA, 19 bp, Homo sapiens
ctgactgggactcccagct

SEQ ID NO: 553715 - DNA, 14 bp, Homo sapiens
ctgactgggccagg

SEQ ID NO: 553716 - DNA, 13 bp, Homo sapiens
ctgagaaaagaac

SEQ ID NO: 553717 - DNA, 19 bp, Homo sapiens
ctgagaagcctcatgggag

SEQ ID NO: 553718 - DNA, 17 bp, Homo sapiens
ctgagacgcaaggatca

SEQ ID NO: 553719 - DNA, 20 bp, Homo sapiens
ctgagagaggctaaaatgtt

SEQ ID NO: 553720 - DNA, 23 bp, Homo sapiens
ctgagagaggctaaaatgttttc

SEQ ID NO: 553721 - DNA, 21 bp, Homo sapiens
ctgagatgagaggggagagct

SEQ ID NO: 553722 - DNA, 18 bp, Homo sapiens
ctgagcacatctcttcat

SEQ ID NO: 553723 - DNA, 17 bp, Homo sapiens
ctgagcagtgatattct

SEQ ID NO: 553724 - DNA, 13 bp, Homo sapiens
ctgagccttctga

SEQ ID NO: 553725 - DNA, 14 bp, Homo sapiens
ctgagctggcctct

SEQ ID NO: 553726 - DNA, 17 bp, Homo sapiens
ctgagctggcctctcac

SEQ ID NO: 553727 - DNA, 23 bp, Homo sapiens
ctgaggaggccttgggctctgct

SEQ ID NO: 553728 - DNA, 15 bp, Homo sapiens
ctgaggcaggagaat

SEQ ID NO: 553729 - DNA, 16 bp, Homo sapiens
ctgaggggcagcctgc

SEQ ID NO: 553730 - DNA, 14 bp, Homo sapiens
ctgagggtttccac

SEQ ID NO: 553731 - DNA, 13 bp, Homo sapiens
ctgagtacaaatg

SEQ ID NO: 553732 - DNA, 21 bp, Homo sapiens
ctgagtctcattcctctgtcc

SEQ ID NO: 553733 - DNA, 23 bp, Homo sapiens
ctgagtggtccacattctgctgc

SEQ ID NO: 553734 - DNA, 21 bp, Homo sapiens
ctgatatccaacagaaagcat

SEQ ID NO: 553735 - DNA, 11 bp, Homo sapiens
ctgctgccagt

SEQ ID NO: 553736 - DNA, 16 bp, Homo sapiens
ctgctgccatgaactg

SEQ ID NO: 553737 - DNA, 16 bp, Homo sapiens
ctgctgcctcaggaat

SEQ ID NO: 553738 - DNA, 17 bp, Homo sapiens
ctgctgctcctcggcca

SEQ ID NO: 553739 - DNA, 19 bp, Homo sapiens
ctgctgtaaagcaaaatat

SEQ ID NO: 553740 - DNA, 16 bp, Homo sapiens
ctgctgtcattgcttc

SEQ ID NO: 553741 - DNA, 23 bp, Homo sapiens
ctgcttagtatctcatcaacaaa

SEQ ID NO: 553742 - DNA, 16 bp, Homo sapiens
ctgcttagtgtccctt

SEQ ID NO: 553743 - DNA, 22 bp, Homo sapiens
ctgcttccagttggactgtggc

SEQ ID NO: 553744 - DNA, 23 bp, Homo sapiens
ctgctttagaatgttttccttct

SEQ ID NO: 553745 - DNA, 24 bp, Homo sapiens
ctgcttttaggagaattcacagaa

SEQ ID NO: 553746 - DNA, 18 bp, Homo sapiens
ctggaaaaaaaaaaatat

SEQ ID NO: 553747 - DNA, 21 bp, Homo sapiens
ctggaataagaagcaaataaa

SEQ ID NO: 553748 - DNA, 21 bp, Homo sapiens
ctggaatcattgtccagagct

SEQ ID NO: 553749 - DNA, 21 bp, Homo sapiens
ctggaattgccacataattca

SEQ ID NO: 553750 - DNA, 19 bp, Homo sapiens
ctggacctttgggttcttt

SEQ ID NO: 553751 - DNA, 22 bp, Homo sapiens
ctggacctttgggttctttctg

SEQ ID NO: 553752 - DNA, 18 bp, Homo sapiens
ctggactctgtggggcca

SEQ ID NO: 553753 - DNA, 18 bp, Homo sapiens
ctggagcccggcagtgca

SEQ ID NO: 553754 - DNA, 20 bp, Homo sapiens
ctggaggacctgcccggtgg

SEQ ID NO: 553755 - DNA, 21 bp, Homo sapiens
ctggaggggagctctgtctgt

SEQ ID NO: 553756 - DNA, 14 bp, Homo sapiens
ctggataatttgta

SEQ ID NO: 553757 - DNA, 21 bp, Homo sapiens
ctggatataatgtattttcag

SEQ ID NO: 553758 - DNA, 16 bp, Homo sapiens
ctggatggagctggag

SEQ ID NO: 553759 - DNA, 12 bp, Homo sapiens
ctggatttaact

SEQ ID NO: 553760 - DNA, 15 bp, Homo sapiens
ctggcaaatattttg

SEQ ID NO: 553761 - DNA, 19 bp, Homo sapiens
ctggcaaatattttgtcac

SEQ ID NO: 553762 - DNA, 13 bp, Homo sapiens
ctggcaggagaca

SEQ ID NO: 553763 - DNA, 21 bp, Homo sapiens
ctggcaggagacactggtctc

SEQ ID NO: 553764 - DNA, 23 bp, Homo sapiens
ctggcaggagacactggtctcag

SEQ ID NO: 553765 - DNA, 12 bp, Homo sapiens
ctggcaggcagg

SEQ ID NO: 553766 - DNA, 13 bp, Homo sapiens
ctggcaggcaggg

SEQ ID NO: 553767 - DNA, 21 bp, Homo sapiens
ctggcaggcaggggccctgca

SEQ ID NO: 553768 - DNA, 23 bp, Homo sapiens
ctggcaggcaggggccctgcagc

SEQ ID NO: 553769 - DNA, 13 bp, Homo sapiens
ctggcagggcagg

SEQ ID NO: 553770 - DNA, 20 bp, Homo sapiens
ctggcagggcaggcagagct

SEQ ID NO: 553771 - DNA, 21 bp, Homo sapiens
ctggcagggcaggcagagctc

SEQ ID NO: 553772 - DNA, 16 bp, Homo sapiens
ctggcaggtggccagg

SEQ ID NO: 553773 - DNA, 18 bp, Homo sapiens
ctggcaggtggccagggc

SEQ ID NO: 553774 - DNA, 21 bp, Homo sapiens
ctggcaggtggccagggctcc

SEQ ID NO: 553775 - DNA, 22 bp, Homo sapiens
ctggcagtggcctccttttggt

SEQ ID NO: 553776 - DNA, 12 bp, Homo sapiens
ctggccccacac

SEQ ID NO: 553777 - DNA, 17 bp, Homo sapiens
ctggccccacaccagcc

SEQ ID NO: 553778 - DNA, 14 bp, Homo sapiens
ctggccctggggcc

SEQ ID NO: 553779 - DNA, 21 bp, Homo sapiens
ctggcccttgcttacctctca

SEQ ID NO: 553780 - DNA, 21 bp, Homo sapiens
ctggcctgaaccacaggagag

SEQ ID NO: 553781 - DNA, 13 bp, Homo sapiens
ctggctccagcct

SEQ ID NO: 553782 - DNA, 17 bp, Homo sapiens
ctggctcccagggtcct

SEQ ID NO: 553783 - DNA, 21 bp, Homo sapiens
ctggctgtgggctcccttcct

SEQ ID NO: 553784 - DNA, 22 bp, Homo sapiens
ctggctgtgggctcccttcctc

SEQ ID NO: 553785 - DNA, 14 bp, Homo sapiens
ctggcttctccctg

SEQ ID NO: 553786 - DNA, 20 bp, Homo sapiens
ctggcttctccctggactct

SEQ ID NO: 553787 - DNA, 14 bp, Homo sapiens
ctgggaatgtatag

SEQ ID NO: 553788 - DNA, 22 bp, Homo sapiens
ctgggaccctcggggcaggaag

SEQ ID NO: 553789 - DNA, 16 bp, Homo sapiens
ctgggacttcttaccc

SEQ ID NO: 553790 - DNA, 21 bp, Homo sapiens
ctgggacttcttacccaaagc

SEQ ID NO: 553791 - DNA, 14 bp, Homo sapiens
ctgggagagtgagg

SEQ ID NO: 553792 - DNA, 19 bp, Homo sapiens
ctgggcatccccagccccc

SEQ ID NO: 553793 - DNA, 22 bp, Homo sapiens
ctgggcatccccagccccctgg

SEQ ID NO: 553794 - DNA, 23 bp, Homo sapiens
ctgggcccacccaagcaggaggc

SEQ ID NO: 553795 - DNA, 12 bp, Homo sapiens
ctgggccctggt

SEQ ID NO: 553796 - DNA, 20 bp, Homo sapiens
ctgggcttttgttttgcttt

SEQ ID NO: 553797 - DNA, 13 bp, Homo sapiens
ctggggaagcaaa

SEQ ID NO: 553798 - DNA, 19 bp, Homo sapiens
ctggggagaccgagtgtgg

SEQ ID NO: 553799 - DNA, 23 bp, Homo sapiens
ctggggcaggaggggagtgaggc

SEQ ID NO: 553800 - DNA, 20 bp, Homo sapiens
ctggggcttttgtgccagga

SEQ ID NO: 553801 - DNA, 23 bp, Homo sapiens
ctgggggcagcctgcgtggctga

SEQ ID NO: 553802 - DNA, 18 bp, Homo sapiens
ctggggggatatttccta

SEQ ID NO: 553803 - DNA, 21 bp, Homo sapiens
ctggggtcaggccgggcagag

SEQ ID NO: 553804 - DNA, 13 bp, Homo sapiens
ctggggtctgtga

SEQ ID NO: 553805 - DNA, 16 bp, Homo sapiens
ctgggttattcagaac

SEQ ID NO: 553806 - DNA, 17 bp, Homo sapiens
ctggtaagaaaaagcaa

SEQ ID NO: 553807 - DNA, 23 bp, Homo sapiens
ctggtaagaaaaagcaaaaggca

SEQ ID NO: 553808 - DNA, 14 bp, Homo sapiens
ctggtactttctgt

SEQ ID NO: 553809 - DNA, 22 bp, Homo sapiens
ctggtcactgccatggaggcac

SEQ ID NO: 553810 - DNA, 16 bp, Homo sapiens
ctggtcacttcttctg

SEQ ID NO: 553811 - DNA, 12 bp, Homo sapiens
ctggtcctgcac

SEQ ID NO: 553812 - DNA, 18 bp, Homo sapiens
ctggtctcctgcccccac

SEQ ID NO: 553813 - DNA, 15 bp, Homo sapiens
ctggttcccccagga

SEQ ID NO: 553814 - DNA, 19 bp, Homo sapiens
ctggttcccccaggaccct

SEQ ID NO: 553815 - DNA, 17 bp, Homo sapiens
ctggttccggaatcctg

SEQ ID NO: 553816 - DNA, 20 bp, Homo sapiens
ctgtaaaatacatggtatct

SEQ ID NO: 553817 - DNA, 18 bp, Homo sapiens
ctgtaaatcaagaccaaa

SEQ ID NO: 553818 - DNA, 15 bp, Homo sapiens
ctgtaaattccaaag

SEQ ID NO: 553819 - DNA, 18 bp, Homo sapiens
ctgtaacagttctttttg

SEQ ID NO: 553820 - DNA, 15 bp, Homo sapiens
ctgtaacgtgtgctg

SEQ ID NO: 553821 - DNA, 17 bp, Homo sapiens
ctgtaatagcctcacct

SEQ ID NO: 553822 - DNA, 15 bp, Homo sapiens
ctgtacacacacaga

SEQ ID NO: 553823 - DNA, 17 bp, Homo sapiens
ctgtacacacacagaca

SEQ ID NO: 553824 - DNA, 20 bp, Homo sapiens
ctgtacacacacagacacac

SEQ ID NO: 553825 - DNA, 23 bp, Homo sapiens
ctgtacacacacagacacacaag

SEQ ID NO: 553826 - DNA, 21 bp, Homo sapiens
ctgtacagagccgtaaaaact

SEQ ID NO: 553827 - DNA, 16 bp, Homo sapiens
ctgtacagatcaagaa

SEQ ID NO: 553828 - DNA, 15 bp, Homo sapiens
ctgtactaaacattt

SEQ ID NO: 553829 - DNA, 16 bp, Homo sapiens
ctgtactaaacatttc

SEQ ID NO: 553830 - DNA, 19 bp, Homo sapiens
ctgtactaaggagaaatga

SEQ ID NO: 553831 - DNA, 15 bp, Homo sapiens
ctgtactggagagca

SEQ ID NO: 553832 - DNA, 20 bp, Homo sapiens
ctgtacttgatttttcaaag

SEQ ID NO: 553833 - DNA, 19 bp, Homo sapiens
ctgtactttgattcacatg

SEQ ID NO: 553834 - DNA, 21 bp, Homo sapiens
ctgtactttgattcacatgtt

SEQ ID NO: 553835 - DNA, 24 bp, Homo sapiens
ctgtactttgattcacatgttttc

SEQ ID NO: 553836 - DNA, 16 bp, Homo sapiens
ctgtagataattaacc

SEQ ID NO: 553837 - DNA, 16 bp, Homo sapiens
ctgtatacgtttcaaa

SEQ ID NO: 553838 - DNA, 21 bp, Homo sapiens
ctgtatagacaggagaagaaa

SEQ ID NO: 553839 - DNA, 19 bp, Homo sapiens
ctgtattgttacagctgaa

SEQ ID NO: 553840 - DNA, 20 bp, Homo sapiens
ctgtatttacttgttatgtt

SEQ ID NO: 553841 - DNA, 23 bp, Homo sapiens
ctgtcaaacattagtactttata

SEQ ID NO: 553842 - DNA, 19 bp, Homo sapiens
ctgtcaatgattattttca

SEQ ID NO: 553843 - DNA, 19 bp, Homo sapiens
ctgtcacccgatcgccagc

SEQ ID NO: 553844 - DNA, 19 bp, Homo sapiens
ctgtcagttctaacctcct

SEQ ID NO: 553845 - DNA, 17 bp, Homo sapiens
ctgtcatggtgcaattt

SEQ ID NO: 553846 - DNA, 19 bp, Homo sapiens
ctgtcatggtgcaatttgt

SEQ ID NO: 553847 - DNA, 22 bp, Homo sapiens
ctgtcatggtgcaatttgtctt

SEQ ID NO: 553848 - DNA, 21 bp, Homo sapiens
ctgtcatgtgcgaacacagtg

SEQ ID NO: 553849 - DNA, 17 bp, Homo sapiens
ctgtcatttctctttca

SEQ ID NO: 553850 - DNA, 15 bp, Homo sapiens
ctgtccaagcagatt

SEQ ID NO: 553851 - DNA, 17 bp, Homo sapiens
ctgtcccggagctcagg

SEQ ID NO: 553852 - DNA, 21 bp, Homo sapiens
ctgtcccggagctcaggccct

SEQ ID NO: 553853 - DNA, 20 bp, Homo sapiens
ctgtccttctctcacctcct

SEQ ID NO: 553854 - DNA, 23 bp, Homo sapiens
ctgtcgagcctgggggctggagc

SEQ ID NO: 553855 - DNA, 14 bp, Homo sapiens
ctgtcgtccccaga

SEQ ID NO: 553856 - DNA, 20 bp, Homo sapiens
ctgtcgtccccagaccagta

SEQ ID NO: 553857 - DNA, 16 bp, Homo sapiens
ctgtctagcacttcct

SEQ ID NO: 553858 - DNA, 21 bp, Homo sapiens
ctgtctagcacttccttgcca

SEQ ID NO: 553859 - DNA, 19 bp, Homo sapiens
ctgtctctcttttgctctc

SEQ ID NO: 553860 - DNA, 16 bp, Homo sapiens
ctgtctgtctggtcca

SEQ ID NO: 553861 - DNA, 16 bp, Homo sapiens
ctgtgaaatgactgca

SEQ ID NO: 553862 - DNA, 16 bp, Homo sapiens
ctgtgaactaatgaca

SEQ ID NO: 553863 - DNA, 14 bp, Homo sapiens
ctgtgaccggggtc

SEQ ID NO: 553864 - DNA, 15 bp, Homo sapiens
ctgtgaccggggtcc

SEQ ID NO: 553865 - DNA, 23 bp, Homo sapiens
ctgtgaccggggtcctgaggctg

SEQ ID NO: 553866 - DNA, 13 bp, Homo sapiens
ctgtgagctgcac

SEQ ID NO: 553867 - DNA, 20 bp, Homo sapiens
ctgtgaggaaagcacacagt

SEQ ID NO: 553868 - DNA, 22 bp, Homo sapiens
ctgtgagtgacatcggttcagg

SEQ ID NO: 553869 - DNA, 12 bp, Homo sapiens
ctgtgataacag

SEQ ID NO: 553870 - DNA, 23 bp, Homo sapiens
ctgtgcagaagggagctggctcc

SEQ ID NO: 553871 - DNA, 14 bp, Homo sapiens
ctgtgccagcccag

SEQ ID NO: 553872 - DNA, 14 bp, Homo sapiens
ctgtgccaggtgaa

SEQ ID NO: 553873 - DNA, 18 bp, Homo sapiens
ctgtgctaagttgtctta

SEQ ID NO: 553874 - DNA, 22 bp, Homo sapiens
ctgtgctggtgggggcctcttt

SEQ ID NO: 553875 - DNA, 16 bp, Homo sapiens
gaatcaagtctgtgaa

SEQ ID NO: 553876 - DNA, 23 bp, Homo sapiens
gaatcacctaattaatttcagta

SEQ ID NO: 553877 - DNA, 15 bp, Homo sapiens
gaatcagaggcagag

SEQ ID NO: 553878 - DNA, 23 bp, Homo sapiens
gaatctcctttggaaggtgacac

SEQ ID NO: 553879 - DNA, 11 bp, Homo sapiens
gaatcttctca

SEQ ID NO: 553880 - DNA, 20 bp, Homo sapiens
gaatcttctcatcttttatc

SEQ ID NO: 553881 - DNA, 15 bp, Homo sapiens
gaatgaccttgtaat

SEQ ID NO: 553882 - DNA, 18 bp, Homo sapiens
gaatgaccttgtaatgta

SEQ ID NO: 553883 - DNA, 18 bp, Homo sapiens
gaatgcatgctttccata

SEQ ID NO: 553884 - DNA, 21 bp, Homo sapiens
gaatgcatgctttccatattt

SEQ ID NO: 553885 - DNA, 13 bp, Homo sapiens
gaatggctttcaa

SEQ ID NO: 553886 - DNA, 15 bp, Homo sapiens
gaattactaacttct

SEQ ID NO: 553887 - DNA, 18 bp, Homo sapiens
gaattactaacttctaaa

SEQ ID NO: 553888 - DNA, 20 bp, Homo sapiens
gaattggccagaggaaatct

SEQ ID NO: 553889 - DNA, 19 bp, Homo sapiens
gagatactcttctgcctcc

SEQ ID NO: 553890 - DNA, 17 bp, Homo sapiens
gagatgagaggggagag

SEQ ID NO: 553891 - DNA, 14 bp, Homo sapiens
gagatgaggctgga

SEQ ID NO: 553892 - DNA, 17 bp, Homo sapiens
gagattggaaaaaatta

SEQ ID NO: 553893 - DNA, 20 bp, Homo sapiens
gagatttctggatggtggtg

SEQ ID NO: 553894 - DNA, 14 bp, Homo sapiens
gagcaaagatcaaa

SEQ ID NO: 553895 - DNA, 15 bp, Homo sapiens
gagcaagagagcagc

SEQ ID NO: 553896 - DNA, 13 bp, Homo sapiens
gagcacatggccc

SEQ ID NO: 553897 - DNA, 21 bp, Homo sapiens
gagcagcaaggtcttgctctc

SEQ ID NO: 553898 - DNA, 20 bp, Homo sapiens
gagcagtgatattctttgtt

SEQ ID NO: 553899 - DNA, 14 bp, Homo sapiens
gagcattacaggca

SEQ ID NO: 553900 - DNA, 22 bp, Homo sapiens
gagcattataatcaccagggcc

SEQ ID NO: 553901 - DNA, 12 bp, Homo sapiens
gagccaggaggg

SEQ ID NO: 553902 - DNA, 21 bp, Homo sapiens
gagcccagaagctcaaggctg

SEQ ID NO: 553903 - DNA, 21 bp, Homo sapiens
gagcccggcagtgcaccccct

SEQ ID NO: 553904 - DNA, 14 bp, Homo sapiens
gagccctgctccct

SEQ ID NO: 553905 - DNA, 22 bp, Homo sapiens
gagccctggggtttccacacag

SEQ ID NO: 553906 - DNA, 18 bp, Homo sapiens
gagcccttgcccatgctg

SEQ ID NO: 553907 - DNA, 15 bp, Homo sapiens
gagccgagctctcct

SEQ ID NO: 553908 - DNA, 18 bp, Homo sapiens
gagccgagctctcctggg

SEQ ID NO: 553909 - DNA, 15 bp, Homo sapiens
gagcctgacagccag

SEQ ID NO: 553910 - DNA, 16 bp, Homo sapiens
gagcctgacagccaga

SEQ ID NO: 553911 - DNA, 15 bp, Homo sapiens
gagcgacagagcagt

SEQ ID NO: 553912 - DNA, 17 bp, Homo sapiens
gagcgttcaccagtgac

SEQ ID NO: 553913 - DNA, 23 bp, Homo sapiens
gagctatatttaagtattcaaga

SEQ ID NO: 553914 - DNA, 14 bp, Homo sapiens
gagctcagcacagc

SEQ ID NO: 553915 - DNA, 15 bp, Homo sapiens
gagctcccaggacgc

SEQ ID NO: 553916 - DNA, 17 bp, Homo sapiens
gagctccccccaggtct

SEQ ID NO: 553917 - DNA, 12 bp, Homo sapiens
gagctcctggcc

SEQ ID NO: 553918 - DNA, 17 bp, Homo sapiens
gagctctcctgggccag

SEQ ID NO: 553919 - DNA, 17 bp, Homo sapiens
gagctctgacctgcccc

SEQ ID NO: 553920 - DNA, 16 bp, Homo sapiens
gagctgcaccaggtag

SEQ ID NO: 553921 - DNA, 21 bp, Homo sapiens
gagctgccagtggggcctgag

SEQ ID NO: 553922 - DNA, 14 bp, Homo sapiens
gagctggctccagc

SEQ ID NO: 553923 - DNA, 19 bp, Homo sapiens
gagctggctccagcctgga

SEQ ID NO: 553924 - DNA, 17 bp, Homo sapiens
gagctttctcaatgtct

SEQ ID NO: 553925 - DNA, 14 bp, Homo sapiens
gaggaaaaatatgt

SEQ ID NO: 553926 - DNA, 20 bp, Homo sapiens
gaggaaagcacagaggcctc

SEQ ID NO: 553927 - DNA, 22 bp, Homo sapiens
gaggaaagcacagaggcctcct

SEQ ID NO: 553928 - DNA, 13 bp, Homo sapiens
gaggaatcagacc

SEQ ID NO: 553929 - DNA, 16 bp, Homo sapiens
gaggacatggcttctg

SEQ ID NO: 553930 - DNA, 17 bp, Homo sapiens
gaggacctccacctggg

SEQ ID NO: 553931 - DNA, 22 bp, Homo sapiens
gaggacctccacctgggagatg

SEQ ID NO: 553932 - DNA, 15 bp, Homo sapiens
gaggacgtgggcggc

SEQ ID NO: 553933 - DNA, 16 bp, Homo sapiens
gaggacgtgggcggca

SEQ ID NO: 553934 - DNA, 18 bp, Homo sapiens
gaggagactcaggcccac

SEQ ID NO: 553935 - DNA, 22 bp, Homo sapiens
gaggagactcaggcccacattg

SEQ ID NO: 553936 - DNA, 15 bp, Homo sapiens
gaggaggtgctgcag

SEQ ID NO: 553937 - DNA, 15 bp, Homo sapiens
gaggcagttgcccag

SEQ ID NO: 553938 - DNA, 18 bp, Homo sapiens
gaggcagttgcccagcct

SEQ ID NO: 553939 - DNA, 20 bp, Homo sapiens
gaggccttgggctctgctga

SEQ ID NO: 553940 - DNA, 23 bp, Homo sapiens
gaggctccatccttctccccaag

SEQ ID NO: 553941 - DNA, 17 bp, Homo sapiens
gaggctcgtgcatgtaa

SEQ ID NO: 553942 - DNA, 15 bp, Homo sapiens
gaggctgaggcagga

SEQ ID NO: 553943 - DNA, 20 bp, Homo sapiens
gaggctgggacgctctgctg

SEQ ID NO: 553944 - DNA, 17 bp, Homo sapiens
gaggcttatatttgtgt

SEQ ID NO: 553945 - DNA, 12 bp, Homo sapiens
gagggctgcaga

SEQ ID NO: 553946 - DNA, 17 bp, Homo sapiens
gaggggagccaggaggg

SEQ ID NO: 553947 - DNA, 17 bp, Homo sapiens
gaggggcggggccagga

SEQ ID NO: 553948 - DNA, 20 bp, Homo sapiens
gagggggccacctccccagg

SEQ ID NO: 553949 - DNA, 18 bp, Homo sapiens
gaggggtggtacttggca

SEQ ID NO: 553950 - DNA, 22 bp, Homo sapiens
gaggggtggtacttggcaccaa

SEQ ID NO: 553951 - DNA, 19 bp, Homo sapiens
gagggtaataaccagacac

SEQ ID NO: 553952 - DNA, 22 bp, Homo sapiens
gaggtcatcccggggccatgga

SEQ ID NO: 553953 - DNA, 24 bp, Homo sapiens
gaggtcatcccggggccatggaag

SEQ ID NO: 553954 - DNA, 20 bp, Homo sapiens
gaggtcccaaggttctgggt

SEQ ID NO: 553955 - DNA, 14 bp, Homo sapiens
gaggtcctgggggc

SEQ ID NO: 553956 - DNA, 16 bp, Homo sapiens
gaggtcctgggggcct

SEQ ID NO: 553957 - DNA, 18 bp, Homo sapiens
gaggtcctgggggcctga

SEQ ID NO: 553958 - DNA, 23 bp, Homo sapiens
gaggtcctgggggcctgacctcc

SEQ ID NO: 553959 - DNA, 22 bp, Homo sapiens
gaggtcctgtcctggctcccag

SEQ ID NO: 553960 - DNA, 17 bp, Homo sapiens
gaggtgagggaggcctg

SEQ ID NO: 553961 - DNA, 22 bp, Homo sapiens
gaggtgcctgagagcagaatga

SEQ ID NO: 553962 - DNA, 18 bp, Homo sapiens
gagtaattgcatttgctt

SEQ ID NO: 553963 - DNA, 14 bp, Homo sapiens
gagtacaaatgtgt

SEQ ID NO: 553964 - DNA, 23 bp, Homo sapiens
gagtagccccaacccaaacctgg

SEQ ID NO: 553965 - DNA, 19 bp, Homo sapiens
gagtatacaatatataaaa

SEQ ID NO: 553966 - DNA, 12 bp, Homo sapiens
gagtcaggagaa

SEQ ID NO: 553967 - DNA, 13 bp, Homo sapiens
gagtccagacctg

SEQ ID NO: 553968 - DNA, 18 bp, Homo sapiens
gagtccaggagctcagga

SEQ ID NO: 553969 - DNA, 22 bp, Homo sapiens
gagtccgacctggcctgtctgt

SEQ ID NO: 553970 - DNA, 19 bp, Homo sapiens
gagtctggagaccaggact

SEQ ID NO: 553971 - DNA, 20 bp, Homo sapiens
gagtctggagaccaggactc

SEQ ID NO: 553972 - DNA, 15 bp, Homo sapiens
gagtgaagagtgaag

SEQ ID NO: 553973 - DNA, 20 bp, Homo sapiens
gagtgaagagtgaagagcat

SEQ ID NO: 553974 - DNA, 20 bp, Homo sapiens
gagtgaggatatgagtagcc

SEQ ID NO: 553975 - DNA, 22 bp, Homo sapiens
gagtgatttgtaaaacagtggt

SEQ ID NO: 553976 - DNA, 19 bp, Homo sapiens
gagtgctaagagcctctgg

SEQ ID NO: 553977 - DNA, 21 bp, Homo sapiens
gagtgggtgggacacagagac

SEQ ID NO: 553978 - DNA, 16 bp, Homo sapiens
gagttcattcatatta

SEQ ID NO: 553979 - DNA, 23 bp, Homo sapiens
gagtttgctggttgtaaatactt

SEQ ID NO: 553980 - DNA, 18 bp, Homo sapiens
gagtttgtttctttgaat

SEQ ID NO: 553981 - DNA, 19 bp, Homo sapiens
gataaaatcccattgtatt

SEQ ID NO: 553982 - DNA, 17 bp, Homo sapiens
gataaatagtgttattg

SEQ ID NO: 553983 - DNA, 15 bp, Homo sapiens
gataactgatggcaa

SEQ ID NO: 553984 - DNA, 22 bp, Homo sapiens
gataactgatggcaatattaag

SEQ ID NO: 553985 - DNA, 14 bp, Homo sapiens
gataattaaatgaa

SEQ ID NO: 553986 - DNA, 17 bp, Homo sapiens
gataattaaatgaaata

SEQ ID NO: 553987 - DNA, 21 bp, Homo sapiens
gataccttaaaatttgaaaca

SEQ ID NO: 553988 - DNA, 22 bp, Homo sapiens
gatacgagttttggccgggtgc

SEQ ID NO: 553989 - DNA, 15 bp, Homo sapiens
gatacttcctgggtc

SEQ ID NO: 553990 - DNA, 22 bp, Homo sapiens
gatacttggtcacagccaggcg

SEQ ID NO: 553991 - DNA, 17 bp, Homo sapiens
gataggaaggtcatttc

SEQ ID NO: 553992 - DNA, 14 bp, Homo sapiens
gatataatgtattt

SEQ ID NO: 553993 - DNA, 14 bp, Homo sapiens
gatatatctgaaaa

SEQ ID NO: 553994 - DNA, 22 bp, Homo sapiens
gatatgagaaatataaaaataa

SEQ ID NO: 553995 - DNA, 22 bp, Homo sapiens
gatatgagtatacaatatataa

SEQ ID NO: 553996 - DNA, 18 bp, Homo sapiens
gatatgcctgctctttgg

SEQ ID NO: 553997 - DNA, 20 bp, Homo sapiens
gatcaaaataaaaagtgaca

SEQ ID NO: 553998 - DNA, 14 bp, Homo sapiens
gatcaaatgtacat

SEQ ID NO: 553999 - DNA, 15 bp, Homo sapiens
gatcaaggagggaga

SEQ ID NO: 554000 - DNA, 16 bp, Homo sapiens
gatcactgaacttttc

SEQ ID NO: 554001 - DNA, 20 bp, Homo sapiens
gatcattggtatctgatatc

SEQ ID NO: 554002 - DNA, 16 bp, Homo sapiens
gatccacctgcacaaa

SEQ ID NO: 554003 - DNA, 19 bp, Homo sapiens
gatccacctgcacaaacat

SEQ ID NO: 554004 - DNA, 20 bp, Homo sapiens
gatccaggaacacatgcaca

SEQ ID NO: 554005 - DNA, 22 bp, Homo sapiens
gatccaggaacacatgcacaca

SEQ ID NO: 554006 - DNA, 19 bp, Homo sapiens
gatcctaactgaagagaca

SEQ ID NO: 554007 - DNA, 16 bp, Homo sapiens
gatcggttaacaaata

SEQ ID NO: 554008 - DNA, 17 bp, Homo sapiens
gatcggttaacaaataa

SEQ ID NO: 554009 - DNA, 20 bp, Homo sapiens
gatctccaactctctctgtg

SEQ ID NO: 554010 - DNA, 12 bp, Homo sapiens
gatctcctgtgc

SEQ ID NO: 554011 - DNA, 16 bp, Homo sapiens
gatctcctgtgcacct

SEQ ID NO: 554012 - DNA, 14 bp, Homo sapiens
gatctgtccttcca

SEQ ID NO: 554013 - DNA, 17 bp, Homo sapiens
gatctgttgtaatatca

SEQ ID NO: 554014 - DNA, 16 bp, Homo sapiens
gatctttttttaagtg

SEQ ID NO: 554015 - DNA, 18 bp, Homo sapiens
gatgaccaattttaactt

SEQ ID NO: 554016 - DNA, 14 bp, Homo sapiens
gatgacccctgccc

SEQ ID NO: 554017 - DNA, 12 bp, Homo sapiens
gatgatccttgc

SEQ ID NO: 554018 - DNA, 12 bp, Homo sapiens
gatgatttcaga

SEQ ID NO: 554019 - DNA, 20 bp, Homo sapiens
gatgcactatatgtttacac

SEQ ID NO: 554020 - DNA, 22 bp, Homo sapiens
gatgcactatatgtttacacaa

SEQ ID NO: 554021 - DNA, 16 bp, Homo sapiens
gatgcagctcttcctg

SEQ ID NO: 554022 - DNA, 15 bp, Homo sapiens
gatgcatattaaaga

SEQ ID NO: 554023 - DNA, 17 bp, Homo sapiens
gatggatggcacaatga

SEQ ID NO: 554024 - DNA, 17 bp, Homo sapiens
gatggcacaatgaatgt

SEQ ID NO: 554025 - DNA, 20 bp, Homo sapiens
attgtcttttgtcatgtggc

SEQ ID NO: 554026 - DNA, 16 bp, Homo sapiens
attgtgctccaaatgt

SEQ ID NO: 554027 - DNA, 18 bp, Homo sapiens
attgtgctccaaatgtct

SEQ ID NO: 554028 - DNA, 19 bp, Homo sapiens
attgtgctccaaatgtcta

SEQ ID NO: 554029 - DNA, 19 bp, Homo sapiens
attgttaattgctgaggca

SEQ ID NO: 554030 - DNA, 16 bp, Homo sapiens
attgttccagagacaa

SEQ ID NO: 554031 - DNA, 16 bp, Homo sapiens
attgtttatctagatg

SEQ ID NO: 554032 - DNA, 22 bp, Homo sapiens
attgtttatctagatgtaaatt

SEQ ID NO: 554033 - DNA, 20 bp, Homo sapiens
atttaaaaacaaaaggcaat

SEQ ID NO: 554034 - DNA, 14 bp, Homo sapiens
atttaaaacatttc

SEQ ID NO: 554035 - DNA, 23 bp, Homo sapiens
atttaaaacatttcatgtatttc

SEQ ID NO: 554036 - DNA, 21 bp, Homo sapiens
atttaagtggactgtatttcg

SEQ ID NO: 554037 - DNA, 12 bp, Homo sapiens
atttaagttgta

SEQ ID NO: 554038 - DNA, 13 bp, Homo sapiens
atttaagttgtaa

SEQ ID NO: 554039 - DNA, 20 bp, Homo sapiens
atttacagtctctttcttcc

SEQ ID NO: 554040 - DNA, 19 bp, Homo sapiens
atttaccagggatgtagat

SEQ ID NO: 554041 - DNA, 13 bp, Homo sapiens
atttacctttgga

SEQ ID NO: 554042 - DNA, 15 bp, Homo sapiens
atttactaacagtaa

SEQ ID NO: 554043 - DNA, 13 bp, Homo sapiens
atttacttttaat

SEQ ID NO: 554044 - DNA, 12 bp, Homo sapiens
atttagcacagt

SEQ ID NO: 554045 - DNA, 13 bp, Homo sapiens
atttagcacagta

SEQ ID NO: 554046 - DNA, 15 bp, Homo sapiens
atttagcacagtatt

SEQ ID NO: 554047 - DNA, 20 bp, Homo sapiens
atttagcacagtatttaaca

SEQ ID NO: 554048 - DNA, 22 bp, Homo sapiens
atttagcacagtatttaacatt

SEQ ID NO: 554049 - DNA, 12 bp, Homo sapiens
atttatctttat

SEQ ID NO: 554050 - DNA, 17 bp, Homo sapiens
atttatgaagcagattt

SEQ ID NO: 554051 - DNA, 15 bp, Homo sapiens
atttatgtgtgaagc

SEQ ID NO: 554052 - DNA, 14 bp, Homo sapiens
atttattctaatta

SEQ ID NO: 554053 - DNA, 11 bp, Homo sapiens
atttattctgg

SEQ ID NO: 554054 - DNA, 22 bp, Homo sapiens
atttattctgggaatgtatagt

SEQ ID NO: 554055 - DNA, 13 bp, Homo sapiens
atttattgcacaa

SEQ ID NO: 554056 - DNA, 14 bp, Homo sapiens
atttattgcacaaa

SEQ ID NO: 554057 - DNA, 18 bp, Homo sapiens
atttattgctacttcctg

SEQ ID NO: 554058 - DNA, 22 bp, Homo sapiens
atttattttaaaaaatgaaaat

SEQ ID NO: 554059 - DNA, 13 bp, Homo sapiens
atttcaaaagaca

SEQ ID NO: 554060 - DNA, 16 bp, Homo sapiens
atttcaaaagacatgt

SEQ ID NO: 554061 - DNA, 13 bp, Homo sapiens
atttcaagaaaaa

SEQ ID NO: 554062 - DNA, 21 bp, Homo sapiens
atttcaagaaaaaataaatgg

SEQ ID NO: 554063 - DNA, 22 bp, Homo sapiens
atttcaagaaaaaataaatgga

SEQ ID NO: 554064 - DNA, 23 bp, Homo sapiens
atttcaagaaaaaataaatggaa

SEQ ID NO: 554065 - DNA, 21 bp, Homo sapiens
atttcaagcttattttggaga

SEQ ID NO: 554066 - DNA, 14 bp, Homo sapiens
atttcaatcactga

SEQ ID NO: 554067 - DNA, 14 bp, Homo sapiens
atttcactgtctgt

SEQ ID NO: 554068 - DNA, 18 bp, Homo sapiens
atttcagctgtgagcttt

SEQ ID NO: 554069 - DNA, 19 bp, Homo sapiens
atttcagtaaacctgtctg

SEQ ID NO: 554070 - DNA, 20 bp, Homo sapiens
atttcagtaaacctgtctga

SEQ ID NO: 554071 - DNA, 21 bp, Homo sapiens
atttcagttattgtccctggc

SEQ ID NO: 554072 - DNA, 16 bp, Homo sapiens
atttcattttttgcat

SEQ ID NO: 554073 - DNA, 20 bp, Homo sapiens
atttccaacaccacagacac

SEQ ID NO: 554074 - DNA, 21 bp, Homo sapiens
atttccaacaccacagacaca

SEQ ID NO: 554075 - DNA, 21 bp, Homo sapiens
atttccatggattcccctgga

SEQ ID NO: 554076 - DNA, 14 bp, Homo sapiens
atttccatgtatgc

SEQ ID NO: 554077 - DNA, 17 bp, Homo sapiens
atttccccctttcttcc

SEQ ID NO: 554078 - DNA, 18 bp, Homo sapiens
atttccccctttcttcct

SEQ ID NO: 554079 - DNA, 16 bp, Homo sapiens
atttccgtaattctta

SEQ ID NO: 554080 - DNA, 14 bp, Homo sapiens
atttcctaaggcat

SEQ ID NO: 554081 - DNA, 15 bp, Homo sapiens
atttcctgctcctcc

SEQ ID NO: 554082 - DNA, 19 bp, Homo sapiens
atttcctgtacaatcatga

SEQ ID NO: 554083 - DNA, 23 bp, Homo sapiens
atttcctgtacaatcatgaacag

SEQ ID NO: 554084 - DNA, 19 bp, Homo sapiens
atttcctttttctatttta

SEQ ID NO: 554085 - DNA, 14 bp, Homo sapiens
atttcgaagtttgc

SEQ ID NO: 554086 - DNA, 21 bp, Homo sapiens
atttctaactctgatgtaaat

SEQ ID NO: 554087 - DNA, 23 bp, Homo sapiens
atttctagatatgagaaatataa

SEQ ID NO: 554088 - DNA, 15 bp, Homo sapiens
atttctagttattta

SEQ ID NO: 554089 - DNA, 20 bp, Homo sapiens
atttctccttttgtgttcca

SEQ ID NO: 554090 - DNA, 18 bp, Homo sapiens
atttctctctccagtctt

SEQ ID NO: 554091 - DNA, 15 bp, Homo sapiens
atttctcttaagtac

SEQ ID NO: 554092 - DNA, 20 bp, Homo sapiens
atttctggcaaatattttgt

SEQ ID NO: 554093 - DNA, 18 bp, Homo sapiens
atttctgtgtcctgtttt

SEQ ID NO: 554094 - DNA, 14 bp, Homo sapiens
atttcttgcaattt

SEQ ID NO: 554095 - DNA, 22 bp, Homo sapiens
atttcttgcaatttgaaggtac

SEQ ID NO: 554096 - DNA, 21 bp, Homo sapiens
atttctttagaacaacataaa

SEQ ID NO: 554097 - DNA, 22 bp, Homo sapiens
atttctttagaacaacataaaa

SEQ ID NO: 554098 - DNA, 17 bp, Homo sapiens
atttgaaaacagaaatt

SEQ ID NO: 554099 - DNA, 19 bp, Homo sapiens
atttgaaaacagaaattgg

SEQ ID NO: 554100 - DNA, 13 bp, Homo sapiens
atttgaaacattg

SEQ ID NO: 554101 - DNA, 21 bp, Homo sapiens
atttgatgtaagttactgaca

SEQ ID NO: 554102 - DNA, 17 bp, Homo sapiens
atttgcaacagcaaatt

SEQ ID NO: 554103 - DNA, 19 bp, Homo sapiens
atttgctcataagtaaatg

SEQ ID NO: 554104 - DNA, 20 bp, Homo sapiens
atttgctcataagtaaatgt

SEQ ID NO: 554105 - DNA, 20 bp, Homo sapiens
atttgctttcttttctccca

SEQ ID NO: 554106 - DNA, 14 bp, Homo sapiens
atttggaccatttt

SEQ ID NO: 554107 - DNA, 18 bp, Homo sapiens
atttggaccattttcctg

SEQ ID NO: 554108 - DNA, 22 bp, Homo sapiens
atttggggctacttatattctg

SEQ ID NO: 554109 - DNA, 16 bp, Homo sapiens
atttgtaccatttcag

SEQ ID NO: 554110 - DNA, 22 bp, Homo sapiens
atttgtgctgggttattcagaa

SEQ ID NO: 554111 - DNA, 16 bp, Homo sapiens
atttgtgtaactgaaa

SEQ ID NO: 554112 - DNA, 20 bp, Homo sapiens
atttgtgtgctaaacgtgta

SEQ ID NO: 554113 - DNA, 23 bp, Homo sapiens
atttgttaatttcttgcaatttg

SEQ ID NO: 554114 - DNA, 13 bp, Homo sapiens
atttgttcttaca

SEQ ID NO: 554115 - DNA, 18 bp, Homo sapiens
atttgttgattctctcca

SEQ ID NO: 554116 - DNA, 14 bp, Homo sapiens
attttaaaaaatga

SEQ ID NO: 554117 - DNA, 23 bp, Homo sapiens
attttaaaacttcatctgtctgt

SEQ ID NO: 554118 - DNA, 16 bp, Homo sapiens
attttaagctaggaaa

SEQ ID NO: 554119 - DNA, 19 bp, Homo sapiens
attttaagctaggaaaaga

SEQ ID NO: 554120 - DNA, 23 bp, Homo sapiens
attttaagctaggaaaagaaatc

SEQ ID NO: 554121 - DNA, 13 bp, Homo sapiens
attttaatttcaa

SEQ ID NO: 554122 - DNA, 12 bp, Homo sapiens
attttacacttg

SEQ ID NO: 554123 - DNA, 13 bp, Homo sapiens
attttactgtctt

SEQ ID NO: 554124 - DNA, 20 bp, Homo sapiens
attttactgtcttaattaag

SEQ ID NO: 554125 - DNA, 15 bp, Homo sapiens
attttagctaattta

SEQ ID NO: 554126 - DNA, 19 bp, Homo sapiens
attttataagcaaatttca

SEQ ID NO: 554127 - DNA, 18 bp, Homo sapiens
attttataagcacagaca

SEQ ID NO: 554128 - DNA, 23 bp, Homo sapiens
attttatgtatgtttacactgtc

SEQ ID NO: 554129 - DNA, 14 bp, Homo sapiens
attttatgttgaca

SEQ ID NO: 554130 - DNA, 13 bp, Homo sapiens
attttattgaata

SEQ ID NO: 554131 - DNA, 16 bp, Homo sapiens
attttcaaatatgtaa

SEQ ID NO: 554132 - DNA, 16 bp, Homo sapiens
attttcaagtggaaac

SEQ ID NO: 554133 - DNA, 20 bp, Homo sapiens
attttcaagtggaaaccttg

SEQ ID NO: 554134 - DNA, 13 bp, Homo sapiens
attttcagatttg

SEQ ID NO: 554135 - DNA, 11 bp, Homo sapiens
attttcatgtt

SEQ ID NO: 554136 - DNA, 16 bp, Homo sapiens
attttcattacaatgg

SEQ ID NO: 554137 - DNA, 22 bp, Homo sapiens
attttcattagcaaaaaaagtt

SEQ ID NO: 554138 - DNA, 16 bp, Homo sapiens
attttcatttctaaca

SEQ ID NO: 554139 - DNA, 14 bp, Homo sapiens
attttcattttaca

SEQ ID NO: 554140 - DNA, 20 bp, Homo sapiens
attttctaaagtactgagca

SEQ ID NO: 554141 - DNA, 14 bp, Homo sapiens
attttctactttaa

SEQ ID NO: 554142 - DNA, 15 bp, Homo sapiens
attttctgaaactaa

SEQ ID NO: 554143 - DNA, 14 bp, Homo sapiens
attttgtacatttt

SEQ ID NO: 554144 - DNA, 23 bp, Homo sapiens
attttgtatgcaagcagtttcaa

SEQ ID NO: 554145 - DNA, 19 bp, Homo sapiens
attttgtgagtttgtttct

SEQ ID NO: 554146 - DNA, 23 bp, Homo sapiens
attttgtgagtttgtttctttga

SEQ ID NO: 554147 - DNA, 18 bp, Homo sapiens
attttgttttaaactgtg

SEQ ID NO: 554148 - DNA, 14 bp, Homo sapiens
atttttaagtgtca

SEQ ID NO: 554149 - DNA, 22 bp, Homo sapiens
atttttagcctgtgtcattgcc

SEQ ID NO: 554150 - DNA, 12 bp, Homo sapiens
atttttcaaggc

SEQ ID NO: 554151 - DNA, 14 bp, Homo sapiens
atttttcaaggcat

SEQ ID NO: 554152 - DNA, 16 bp, Homo sapiens
aggagctttctcaatg

SEQ ID NO: 554153 - DNA, 12 bp, Homo sapiens
aggaggaatcag

SEQ ID NO: 554154 - DNA, 15 bp, Homo sapiens
aggaggaatcagacc

SEQ ID NO: 554155 - DNA, 16 bp, Homo sapiens
aggaggagacagtcag

SEQ ID NO: 554156 - DNA, 21 bp, Homo sapiens
aggaggagacagtcaggaagc

SEQ ID NO: 554157 - DNA, 20 bp, Homo sapiens
aggaggccttgggctctgct

SEQ ID NO: 554158 - DNA, 17 bp, Homo sapiens
aggaggctccaggcagc

SEQ ID NO: 554159 - DNA, 23 bp, Homo sapiens
aggaggctccatccttctcccca

SEQ ID NO: 554160 - DNA, 21 bp, Homo sapiens
aggaggctgggacgctctgct

SEQ ID NO: 554161 - DNA, 21 bp, Homo sapiens
aggagtcccactccaagccag

SEQ ID NO: 554162 - DNA, 22 bp, Homo sapiens
aggagtcccactccaagccagc

SEQ ID NO: 554163 - DNA, 20 bp, Homo sapiens
aggagtgcgtggcccaccag

SEQ ID NO: 554164 - DNA, 22 bp, Homo sapiens
aggataactgatggcaatatta

SEQ ID NO: 554165 - DNA, 22 bp, Homo sapiens
aggatagctcttcctccccagg

SEQ ID NO: 554166 - DNA, 19 bp, Homo sapiens
aggatctgaggacaaggaa

SEQ ID NO: 554167 - DNA, 19 bp, Homo sapiens
aggatgggggagaggggga

SEQ ID NO: 554168 - DNA, 14 bp, Homo sapiens
aggatgtatgtgta

SEQ ID NO: 554169 - DNA, 22 bp, Homo sapiens
aggatgtggatggaggtgatga

SEQ ID NO: 554170 - DNA, 15 bp, Homo sapiens
aggcaaaaacaaaga

SEQ ID NO: 554171 - DNA, 21 bp, Homo sapiens
aggcaaaccaatttgttctgt

SEQ ID NO: 554172 - DNA, 19 bp, Homo sapiens
aggcacactgagcaagttt

SEQ ID NO: 554173 - DNA, 17 bp, Homo sapiens
aggcacctagcaattcc

SEQ ID NO: 554174 - DNA, 21 bp, Homo sapiens
aggcagggaggctctgtgtgt

SEQ ID NO: 554175 - DNA, 22 bp, Homo sapiens
aggcaggggccctgcagctctc

SEQ ID NO: 554176 - DNA, 19 bp, Homo sapiens
aggcagggtgtctgccccc

SEQ ID NO: 554177 - DNA, 23 bp, Homo sapiens
aggcagtaggacaaggtgcaggc

SEQ ID NO: 554178 - DNA, 19 bp, Homo sapiens
aggcagttgcccagcctct

SEQ ID NO: 554179 - DNA, 15 bp, Homo sapiens
aggccaaagacaaat

SEQ ID NO: 554180 - DNA, 14 bp, Homo sapiens
aggccaacagcatt

SEQ ID NO: 554181 - DNA, 21 bp, Homo sapiens
aggccaagagtttgagaccaa

SEQ ID NO: 554182 - DNA, 20 bp, Homo sapiens
aggccacatccacagtctcc

SEQ ID NO: 554183 - DNA, 13 bp, Homo sapiens
aggccacggcagc

SEQ ID NO: 554184 - DNA, 19 bp, Homo sapiens
aggccgggcagagcacagc

SEQ ID NO: 554185 - DNA, 12 bp, Homo sapiens
aggccgtggctg

SEQ ID NO: 554186 - DNA, 20 bp, Homo sapiens
aggccgtggctgcccacaca

SEQ ID NO: 554187 - DNA, 21 bp, Homo sapiens
aggccgttgccgctgatgttt

SEQ ID NO: 554188 - DNA, 17 bp, Homo sapiens
aggcctccctgccagta

SEQ ID NO: 554189 - DNA, 22 bp, Homo sapiens
aggcctcctgtggcctgccagt

SEQ ID NO: 554190 - DNA, 23 bp, Homo sapiens
aggcctgaaatgtttccaggcat

SEQ ID NO: 554191 - DNA, 23 bp, Homo sapiens
aggcctgaatccaaaagaaaaac

SEQ ID NO: 554192 - DNA, 19 bp, Homo sapiens
aggcctgctttgtctcctc

SEQ ID NO: 554193 - DNA, 17 bp, Homo sapiens
aggcggtatccagaggt

SEQ ID NO: 554194 - DNA, 18 bp, Homo sapiens
aggcggtatccagaggtg

SEQ ID NO: 554195 - DNA, 19 bp, Homo sapiens
aggcgtagggccagggctc

SEQ ID NO: 554196 - DNA, 12 bp, Homo sapiens
aggctaaaatgt

SEQ ID NO: 554197 - DNA, 13 bp, Homo sapiens
aggctaaaatgtt

SEQ ID NO: 554198 - DNA, 16 bp, Homo sapiens
aggctaatacaggaaa

SEQ ID NO: 554199 - DNA, 13 bp, Homo sapiens
aggctccaggcag

SEQ ID NO: 554200 - DNA, 20 bp, Homo sapiens
aggctccatccttctcccca

SEQ ID NO: 554201 - DNA, 22 bp, Homo sapiens
aggctccatccttctccccaag

SEQ ID NO: 554202 - DNA, 17 bp, Homo sapiens
aggctcccactgcccct

SEQ ID NO: 554203 - DNA, 18 bp, Homo sapiens
aggctcccactgcccctg

SEQ ID NO: 554204 - DNA, 20 bp, Homo sapiens
aggctcccactgcccctgca

SEQ ID NO: 554205 - DNA, 18 bp, Homo sapiens
aggctccctccctcccag

SEQ ID NO: 554206 - DNA, 19 bp, Homo sapiens
aggctccctccctcccaga

SEQ ID NO: 554207 - DNA, 13 bp, Homo sapiens
aggctcctgcccc

SEQ ID NO: 554208 - DNA, 20 bp, Homo sapiens
aggctccttcaacaaggctt

SEQ ID NO: 554209 - DNA, 17 bp, Homo sapiens
aggctctgtgtgttaaa

SEQ ID NO: 554210 - DNA, 14 bp, Homo sapiens
aggctgccccaccc

SEQ ID NO: 554211 - DNA, 16 bp, Homo sapiens
aggctggataggagag

SEQ ID NO: 554212 - DNA, 19 bp, Homo sapiens
aggctgggacgctctgctg

SEQ ID NO: 554213 - DNA, 19 bp, Homo sapiens
aggcttaggcctatagatt

SEQ ID NO: 554214 - DNA, 22 bp, Homo sapiens
aggcttatatttgtgtaatttt

SEQ ID NO: 554215 - DNA, 18 bp, Homo sapiens
aggcttcaatttattgca

SEQ ID NO: 554216 - DNA, 15 bp, Homo sapiens
aggcttgctgcagat

SEQ ID NO: 554217 - DNA, 21 bp, Homo sapiens
aggcttgtgtaatttcctgct

SEQ ID NO: 554218 - DNA, 15 bp, Homo sapiens
agggaaccagagcga

SEQ ID NO: 554219 - DNA, 18 bp, Homo sapiens
agggaagataagttggaa

SEQ ID NO: 554220 - DNA, 21 bp, Homo sapiens
agggaagataagttggaaaca

SEQ ID NO: 554221 - DNA, 17 bp, Homo sapiens
agggaccgggagcctgc

SEQ ID NO: 554222 - DNA, 13 bp, Homo sapiens
agggacctgggga

SEQ ID NO: 554223 - DNA, 14 bp, Homo sapiens
agggacctggggaa

SEQ ID NO: 554224 - DNA, 16 bp, Homo sapiens
agggacctggggaagc

SEQ ID NO: 554225 - DNA, 19 bp, Homo sapiens
agggactccagaagcagca

SEQ ID NO: 554226 - DNA, 21 bp, Homo sapiens
caagttggtcttactttgtta

SEQ ID NO: 554227 - DNA, 12 bp, Homo sapiens
caagtttgaaca

SEQ ID NO: 554228 - DNA, 13 bp, Homo sapiens
caagttttgtgaa

SEQ ID NO: 554229 - DNA, 14 bp, Homo sapiens
caagttttgtgaaa

SEQ ID NO: 554230 - DNA, 16 bp, Homo sapiens
caagttttgtgaaatt

SEQ ID NO: 554231 - DNA, 18 bp, Homo sapiens
caagttttgtgaaatttt

SEQ ID NO: 554232 - DNA, 21 bp, Homo sapiens
caagttttgtgaaatttttca

SEQ ID NO: 554233 - DNA, 23 bp, Homo sapiens
caagtttttatacctgtacacac

SEQ ID NO: 554234 - DNA, 20 bp, Homo sapiens
caataaactcagtcaaatgt

SEQ ID NO: 554235 - DNA, 14 bp, Homo sapiens
caataaaggaggaa

SEQ ID NO: 554236 - DNA, 18 bp, Homo sapiens
caataaagtttgatcttc

SEQ ID NO: 554237 - DNA, 21 bp, Homo sapiens
caataaagtttgatcttcctc

SEQ ID NO: 554238 - DNA, 21 bp, Homo sapiens
caataagaaacagtttaacag

SEQ ID NO: 554239 - DNA, 22 bp, Homo sapiens
caataagaaacagtttaacaga

SEQ ID NO: 554240 - DNA, 23 bp, Homo sapiens
caataagaaacagtttaacagaa

SEQ ID NO: 554241 - DNA, 17 bp, Homo sapiens
caatattctctgtacat

SEQ ID NO: 554242 - DNA, 22 bp, Homo sapiens
caatattctctgtacatattag

SEQ ID NO: 554243 - DNA, 19 bp, Homo sapiens
caatcaccttgcatttcaa

SEQ ID NO: 554244 - DNA, 19 bp, Homo sapiens
caatcatgaacagctctga

SEQ ID NO: 554245 - DNA, 20 bp, Homo sapiens
caatccccataatgcttctt

SEQ ID NO: 554246 - DNA, 12 bp, Homo sapiens
caatccttacaa

SEQ ID NO: 554247 - DNA, 14 bp, Homo sapiens
caatccttacaaat

SEQ ID NO: 554248 - DNA, 16 bp, Homo sapiens
caatccttacaaatga

SEQ ID NO: 554249 - DNA, 22 bp, Homo sapiens
caatctcgtatagaagtcttca

SEQ ID NO: 554250 - DNA, 19 bp, Homo sapiens
caatctctacccctttctt

SEQ ID NO: 554251 - DNA, 14 bp, Homo sapiens
caatctgtcagttc

SEQ ID NO: 554252 - DNA, 14 bp, Homo sapiens
caatgaatgtatat

SEQ ID NO: 554253 - DNA, 15 bp, Homo sapiens
caatgattattttca

SEQ ID NO: 554254 - DNA, 18 bp, Homo sapiens
caatgcacatccattccc

SEQ ID NO: 554255 - DNA, 14 bp, Homo sapiens
caatgccaagataa

SEQ ID NO: 554256 - DNA, 23 bp, Homo sapiens
caatggtgaactgtcattacaga

SEQ ID NO: 554257 - DNA, 23 bp, Homo sapiens
caatgtcttggtacttgctgcta

SEQ ID NO: 554258 - DNA, 15 bp, Homo sapiens
caattactttagaaa

SEQ ID NO: 554259 - DNA, 14 bp, Homo sapiens
caattcattgtgta

SEQ ID NO: 554260 - DNA, 18 bp, Homo sapiens
caattctaatggtaactt

SEQ ID NO: 554261 - DNA, 13 bp, Homo sapiens
caattgtatatat

SEQ ID NO: 554262 - DNA, 16 bp, Homo sapiens
caattgtatatatatg

SEQ ID NO: 554263 - DNA, 22 bp, Homo sapiens
caatttaccacaggatgcatat

SEQ ID NO: 554264 - DNA, 16 bp, Homo sapiens
caatttattgcacaaa

SEQ ID NO: 554265 - DNA, 14 bp, Homo sapiens
caatttcttccttc

SEQ ID NO: 554266 - DNA, 12 bp, Homo sapiens
caatttgaaggt

SEQ ID NO: 554267 - DNA, 18 bp, Homo sapiens
caatttgttaattcctat

SEQ ID NO: 554268 - DNA, 21 bp, Homo sapiens
caatttgttaattcctatgaa

SEQ ID NO: 554269 - DNA, 17 bp, Homo sapiens
cacaaacatagacagat

SEQ ID NO: 554270 - DNA, 16 bp, Homo sapiens
cacaaagctatttaag

SEQ ID NO: 554271 - DNA, 17 bp, Homo sapiens
cacaaccatgttcttga

SEQ ID NO: 554272 - DNA, 15 bp, Homo sapiens
cacaacccccagctc

SEQ ID NO: 554273 - DNA, 16 bp, Homo sapiens
cacaacccccagctcc

SEQ ID NO: 554274 - DNA, 17 bp, Homo sapiens
cacaacccccagctccc

SEQ ID NO: 554275 - DNA, 13 bp, Homo sapiens
cacaagcagacac

SEQ ID NO: 554276 - DNA, 18 bp, Homo sapiens
cacaagcagacacacaca

SEQ ID NO: 554277 - DNA, 13 bp, Homo sapiens
cacacaaaaaaag

SEQ ID NO: 554278 - DNA, 15 bp, Homo sapiens
cacacaaaaaaagac

SEQ ID NO: 554279 - DNA, 19 bp, Homo sapiens
cacacaaaaaaagacctgt

SEQ ID NO: 554280 - DNA, 13 bp, Homo sapiens
cacacacacacac

SEQ ID NO: 554281 - DNA, 15 bp, Homo sapiens
cacacacacacacat

SEQ ID NO: 554282 - DNA, 14 bp, Homo sapiens
cacacacacacgca

SEQ ID NO: 554283 - DNA, 16 bp, Homo sapiens
cacacacacacgcaga

SEQ ID NO: 554284 - DNA, 14 bp, Homo sapiens
cacacacacatata

SEQ ID NO: 554285 - DNA, 16 bp, Homo sapiens
cacacacacatatatg

SEQ ID NO: 554286 - DNA, 14 bp, Homo sapiens
cacacacacgcacg

SEQ ID NO: 554287 - DNA, 13 bp, Homo sapiens
cacacacacgcag

SEQ ID NO: 554288 - DNA, 11 bp, Homo sapiens
cacacacatat

SEQ ID NO: 554289 - DNA, 15 bp, Homo sapiens
cacacacgcacgcac

SEQ ID NO: 554290 - DNA, 14 bp, Homo sapiens
cacacagacacaca

SEQ ID NO: 554291 - DNA, 21 bp, Homo sapiens
cacacatcatctgtaagctgt

SEQ ID NO: 554292 - DNA, 16 bp, Homo sapiens
cacacatttcactgtc

SEQ ID NO: 554293 - DNA, 20 bp, Homo sapiens
cacaccacgcgtcacccaac

SEQ ID NO: 554294 - DNA, 16 bp, Homo sapiens
cacaccctacagcaga

SEQ ID NO: 554295 - DNA, 21 bp, Homo sapiens
cacaccctacagcagatccac

SEQ ID NO: 554296 - DNA, 12 bp, Homo sapiens
cacacctggccc

SEQ ID NO: 554297 - DNA, 14 bp, Homo sapiens
cacacctggccctg

SEQ ID NO: 554298 - DNA, 17 bp, Homo sapiens
cacacctggccctgggg

SEQ ID NO: 554299 - DNA, 14 bp, Homo sapiens
cacacgcacgcaca

SEQ ID NO: 554300 - DNA, 17 bp, Homo sapiens
cacacgcagacacacac

SEQ ID NO: 554301 - DNA, 14 bp, Homo sapiens
cacactgagttcta

SEQ ID NO: 554302 - DNA, 12 bp, Homo sapiens
cacacttcccct

SEQ ID NO: 554303 - DNA, 12 bp, Homo sapiens
cacagaaatata

SEQ ID NO: 554304 - DNA, 20 bp, Homo sapiens
cacagaaatatatatacata

SEQ ID NO: 554305 - DNA, 23 bp, Homo sapiens
cacagaaatatatatacatatgt

SEQ ID NO: 554306 - DNA, 21 bp, Homo sapiens
cacagaacctactgttccttt

SEQ ID NO: 554307 - DNA, 22 bp, Homo sapiens
cacagaacctactgttcctttc

SEQ ID NO: 554308 - DNA, 21 bp, Homo sapiens
cacagacaattctaatggtaa

SEQ ID NO: 554309 - DNA, 12 bp, Homo sapiens
cacagacacaca

SEQ ID NO: 554310 - DNA, 19 bp, Homo sapiens
cacagagacccccgtgcca

SEQ ID NO: 554311 - DNA, 19 bp, Homo sapiens
cacagatgggcaaggcctt

SEQ ID NO: 554312 - DNA, 15 bp, Homo sapiens
cacagcagcttcacc

SEQ ID NO: 554313 - DNA, 19 bp, Homo sapiens
cacagcagcttcaccagag

SEQ ID NO: 554314 - DNA, 21 bp, Homo sapiens
cacagccaatctccaggctcc

SEQ ID NO: 554315 - DNA, 15 bp, Homo sapiens
cagacgtccctccac

SEQ ID NO: 554316 - DNA, 18 bp, Homo sapiens
cagactatccattttaca

SEQ ID NO: 554317 - DNA, 15 bp, Homo sapiens
cagactggtgttaat

SEQ ID NO: 554318 - DNA, 16 bp, Homo sapiens
cagactggtgttaatg

SEQ ID NO: 554319 - DNA, 19 bp, Homo sapiens
cagactggtgttaatgagt

SEQ ID NO: 554320 - DNA, 22 bp, Homo sapiens
cagactggtgttaatgagtata

SEQ ID NO: 554321 - DNA, 20 bp, Homo sapiens
cagagagcttagcctggagc

SEQ ID NO: 554322 - DNA, 18 bp, Homo sapiens
cagagaggacgtgggcgg

SEQ ID NO: 554323 - DNA, 20 bp, Homo sapiens
cagagagggggccacctccc

SEQ ID NO: 554324 - DNA, 15 bp, Homo sapiens
cagagattgcttctc

SEQ ID NO: 554325 - DNA, 14 bp, Homo sapiens
cagagcacagccaa

SEQ ID NO: 554326 - DNA, 21 bp, Homo sapiens
cagagcactaggttcaattcc

SEQ ID NO: 554327 - DNA, 22 bp, Homo sapiens
cagagcactaggttcaattccc

SEQ ID NO: 554328 - DNA, 19 bp, Homo sapiens
cagagcagttgagaggaca

SEQ ID NO: 554329 - DNA, 19 bp, Homo sapiens
cagagcattccagtcaggc

SEQ ID NO: 554330 - DNA, 20 bp, Homo sapiens
cagagcattccagtcaggct

SEQ ID NO: 554331 - DNA, 21 bp, Homo sapiens
cagagcattccagtcaggctc

SEQ ID NO: 554332 - DNA, 22 bp, Homo sapiens
cagagcattccagtcaggctct

SEQ ID NO: 554333 - DNA, 17 bp, Homo sapiens
cagagccctgctccctc

SEQ ID NO: 554334 - DNA, 21 bp, Homo sapiens
cagagccgtaaaaactgaagt

SEQ ID NO: 554335 - DNA, 13 bp, Homo sapiens
cagagcctgcagg

SEQ ID NO: 554336 - DNA, 21 bp, Homo sapiens
cagagcctgcagggtgacctg

SEQ ID NO: 554337 - DNA, 15 bp, Homo sapiens
cagagcctgccccag

SEQ ID NO: 554338 - DNA, 21 bp, Homo sapiens
cagagcgtggctgtgctctca

SEQ ID NO: 554339 - DNA, 19 bp, Homo sapiens
cagagctcagcacagcctc

SEQ ID NO: 554340 - DNA, 16 bp, Homo sapiens
cagagctcccaggacg

SEQ ID NO: 554341 - DNA, 17 bp, Homo sapiens
cagagctcccaggacgc

SEQ ID NO: 554342 - DNA, 12 bp, Homo sapiens
cagagctgccag

SEQ ID NO: 554343 - DNA, 23 bp, Homo sapiens
cagaggaaatctgaatgtattat

SEQ ID NO: 554344 - DNA, 23 bp, Homo sapiens
cagaggacacctgtactggagag

SEQ ID NO: 554345 - DNA, 12 bp, Homo sapiens
cagaggcctcct

SEQ ID NO: 554346 - DNA, 13 bp, Homo sapiens
cagaggcctcctg

SEQ ID NO: 554347 - DNA, 18 bp, Homo sapiens
cagaggggcggggccagg

SEQ ID NO: 554348 - DNA, 14 bp, Homo sapiens
cagaggtgagggag

SEQ ID NO: 554349 - DNA, 18 bp, Homo sapiens
cagaggttgcagtgagct

SEQ ID NO: 554350 - DNA, 23 bp, Homo sapiens
cagagtcctggtttcctcagcct

SEQ ID NO: 554351 - DNA, 16 bp, Homo sapiens
cagagtgatttgtaaa

SEQ ID NO: 554352 - DNA, 13 bp, Homo sapiens
cagataatggtaa

SEQ ID NO: 554353 - DNA, 16 bp, Homo sapiens
cagataatggtaattt

SEQ ID NO: 554354 - DNA, 17 bp, Homo sapiens
cagataatggtaattta

SEQ ID NO: 554355 - DNA, 15 bp, Homo sapiens
cagataattctggac

SEQ ID NO: 554356 - DNA, 21 bp, Homo sapiens
cagataccatactcatttcta

SEQ ID NO: 554357 - DNA, 18 bp, Homo sapiens
cagatactactgaccaga

SEQ ID NO: 554358 - DNA, 17 bp, Homo sapiens
cagatccacctgcacaa

SEQ ID NO: 554359 - DNA, 18 bp, Homo sapiens
cagatccacctgcacaaa

SEQ ID NO: 554360 - DNA, 19 bp, Homo sapiens
cagatccacctgcacaaac

SEQ ID NO: 554361 - DNA, 17 bp, Homo sapiens
cagatccaggaacacat

SEQ ID NO: 554362 - DNA, 18 bp, Homo sapiens
cagatgacccctgcccag

SEQ ID NO: 554363 - DNA, 16 bp, Homo sapiens
cagatgagtcctcggt

SEQ ID NO: 554364 - DNA, 18 bp, Homo sapiens
cagatgcagctcttcctg

SEQ ID NO: 554365 - DNA, 20 bp, Homo sapiens
cagatgtaagaagcccgatc

SEQ ID NO: 554366 - DNA, 17 bp, Homo sapiens
cagatgtggacatgcac

SEQ ID NO: 554367 - DNA, 18 bp, Homo sapiens
cagatgtggacatgcacc

SEQ ID NO: 554368 - DNA, 20 bp, Homo sapiens
cagatgtgggctttgatttc

SEQ ID NO: 554369 - DNA, 20 bp, Homo sapiens
cagattcctttggccactgt

SEQ ID NO: 554370 - DNA, 15 bp, Homo sapiens
cagattggattttat

SEQ ID NO: 554371 - DNA, 12 bp, Homo sapiens
cagattttagtt

SEQ ID NO: 554372 - DNA, 13 bp, Homo sapiens
cagattttagttt

SEQ ID NO: 554373 - DNA, 17 bp, Homo sapiens
cagattttagttttatt

SEQ ID NO: 554374 - DNA, 14 bp, Homo sapiens
cagcaaaaatataa

SEQ ID NO: 554375 - DNA, 15 bp, Homo sapiens
cagcaaaaatataaa

SEQ ID NO: 554376 - DNA, 13 bp, Homo sapiens
cagcaaacacagt

SEQ ID NO: 554377 - DNA, 14 bp, Homo sapiens
cagcaaacacagtc

SEQ ID NO: 554378 - DNA, 16 bp, Homo sapiens
cagcaaacccaaagat

SEQ ID NO: 554379 - DNA, 18 bp, Homo sapiens
cagcaaacccaaagatgt

SEQ ID NO: 554380 - DNA, 21 bp, Homo sapiens
cagcaaacccaaagatgttaa

SEQ ID NO: 554381 - DNA, 23 bp, Homo sapiens
cagcaaacccaaagatgttaaca

SEQ ID NO: 554382 - DNA, 16 bp, Homo sapiens
cagcaaattaatgtgt

SEQ ID NO: 554383 - DNA, 20 bp, Homo sapiens
cagcaagccgaatagctgat

SEQ ID NO: 554384 - DNA, 18 bp, Homo sapiens
cagcaaggcgctaacttg

SEQ ID NO: 554385 - DNA, 13 bp, Homo sapiens
cagcacagcctca

SEQ ID NO: 554386 - DNA, 14 bp, Homo sapiens
cagcacagcctcac

SEQ ID NO: 554387 - DNA, 17 bp, Homo sapiens
cagcaccaccctccttc

SEQ ID NO: 554388 - DNA, 14 bp, Homo sapiens
cagcacccccacgc

SEQ ID NO: 554389 - DNA, 13 bp, Homo sapiens
cagcagatccacc

SEQ ID NO: 554390 - DNA, 12 bp, Homo sapiens
cagcagcagcag

SEQ ID NO: 554391 - DNA, 14 bp, Homo sapiens
cagcagcagcagca

SEQ ID NO: 554392 - DNA, 20 bp, Homo sapiens
cagcagctgaagccagctcc

SEQ ID NO: 554393 - DNA, 20 bp, Homo sapiens
cagcagtttgtgatctgtcc

SEQ ID NO: 554394 - DNA, 11 bp, Homo sapiens
cagcatatata

SEQ ID NO: 554395 - DNA, 23 bp, Homo sapiens
cagcattggcctggccagaccag

SEQ ID NO: 554396 - DNA, 12 bp, Homo sapiens
cagccagaactc

SEQ ID NO: 554397 - DNA, 22 bp, Homo sapiens
cagcccaggcatctccttgggc

SEQ ID NO: 554398 - DNA, 21 bp, Homo sapiens
cagccccccagtgtccccagg

SEQ ID NO: 554399 - DNA, 13 bp, Homo sapiens
cagccccctggcc

SEQ ID NO: 554400 - DNA, 13 bp, Homo sapiens
cagcccctgctgc

SEQ ID NO: 554401 - DNA, 15 bp, Homo sapiens
cagcccctgctgctc

SEQ ID NO: 554402 - DNA, 16 bp, Homo sapiens
cagcccttccaaactc

SEQ ID NO: 554403 - DNA, 23 bp, Homo sapiens
cagcccttcctctgctccccctt

SEQ ID NO: 554404 - DNA, 18 bp, Homo sapiens
cagccgctccagagtcag

SEQ ID NO: 554405 - DNA, 20 bp, Homo sapiens
cagccggcgtggcaaatata

SEQ ID NO: 554406 - DNA, 18 bp, Homo sapiens
cagcctcacccctgcagg

SEQ ID NO: 554407 - DNA, 19 bp, Homo sapiens
cagcctcgcaggcctccct

SEQ ID NO: 554408 - DNA, 13 bp, Homo sapiens
cagcctctgggcc

SEQ ID NO: 554409 - DNA, 12 bp, Homo sapiens
cagcctcttgaa

SEQ ID NO: 554410 - DNA, 19 bp, Homo sapiens
cagcctctttcccttccag

SEQ ID NO: 554411 - DNA, 20 bp, Homo sapiens
cagcctctttcccttccagt

SEQ ID NO: 554412 - DNA, 21 bp, Homo sapiens
cagcctgccttgcccactcct

SEQ ID NO: 554413 - DNA, 15 bp, Homo sapiens
cagcctgcgtggctg

SEQ ID NO: 554414 - DNA, 16 bp, Homo sapiens
cagcctgcgtggctga

SEQ ID NO: 554415 - DNA, 17 bp, Homo sapiens
cagcctgcgtggctgac

SEQ ID NO: 554416 - DNA, 19 bp, Homo sapiens
cagcctggaaacctgtctg

SEQ ID NO: 554417 - DNA, 16 bp, Homo sapiens
cagcgagtctggagac

SEQ ID NO: 554418 - DNA, 20 bp, Homo sapiens
cagcgagtctggagaccagg

SEQ ID NO: 554419 - DNA, 17 bp, Homo sapiens
cagctaagcctgatgat

SEQ ID NO: 554420 - DNA, 19 bp, Homo sapiens
cagctaagcctgatgatgg

SEQ ID NO: 554421 - DNA, 20 bp, Homo sapiens
cagctacttaagagaaatgg

SEQ ID NO: 554422 - DNA, 21 bp, Homo sapiens
cagctaggaacaaatcttcct

SEQ ID NO: 554423 - DNA, 18 bp, Homo sapiens
cagctcagcattgtgtac

SEQ ID NO: 554424 - DNA, 14 bp, Homo sapiens
cagctcccccagct

SEQ ID NO: 554425 - DNA, 14 bp, Homo sapiens
cagctcccttctgt

SEQ ID NO: 554426 - DNA, 20 bp, Homo sapiens
cagctccttttccagagcat

SEQ ID NO: 554427 - DNA, 19 bp, Homo sapiens
cagctctcatgctgcccct

SEQ ID NO: 554428 - DNA, 13 bp, Homo sapiens
cagctctgagatc

SEQ ID NO: 554429 - DNA, 12 bp, Homo sapiens
cagctcttcctg

SEQ ID NO: 554430 - DNA, 17 bp, Homo sapiens
cagctgaagccagctcc

SEQ ID NO: 554431 - DNA, 20 bp, Homo sapiens
cagctgaagccagctccctg

SEQ ID NO: 554432 - DNA, 18 bp, Homo sapiens
cagctgagccttctgagc

SEQ ID NO: 554433 - DNA, 15 bp, Homo sapiens
cagctgagctggcct

SEQ ID NO: 554434 - DNA, 15 bp, Homo sapiens
cagctgcagagacag

SEQ ID NO: 554435 - DNA, 12 bp, Homo sapiens
cagctgcccctc

SEQ ID NO: 554436 - DNA, 16 bp, Homo sapiens
cagctgcccctccctg

SEQ ID NO: 554437 - DNA, 20 bp, Homo sapiens
cagctggacacccccttggt

SEQ ID NO: 554438 - DNA, 23 bp, Homo sapiens
cagctgtgtccggcccagttttg

SEQ ID NO: 554439 - DNA, 24 bp, Homo sapiens
cagctgtttctagagttcctacca

SEQ ID NO: 554440 - DNA, 14 bp, Homo sapiens
cagcttcacttctg

SEQ ID NO: 554441 - DNA, 16 bp, Homo sapiens
cagcttcacttctgac

SEQ ID NO: 554442 - DNA, 22 bp, Homo sapiens
cagcttcacttctgactcttcc

SEQ ID NO: 554443 - DNA, 18 bp, Homo sapiens
cagctttacacacacaga

SEQ ID NO: 554444 - DNA, 16 bp, Homo sapiens
cagctttcagggacag

SEQ ID NO: 554445 - DNA, 13 bp, Homo sapiens
cagctttccagta

SEQ ID NO: 554446 - DNA, 15 bp, Homo sapiens
cagcttttcattgct

SEQ ID NO: 554447 - DNA, 20 bp, Homo sapiens
cagcttttcattgctgtgac

SEQ ID NO: 554448 - DNA, 22 bp, Homo sapiens
caggaaatatctgtgaaggact

SEQ ID NO: 554449 - DNA, 16 bp, Homo sapiens
caggaacacatgcaca

SEQ ID NO: 554450 - DNA, 17 bp, Homo sapiens
caggaacacatgcacac

SEQ ID NO: 554451 - DNA, 19 bp, Homo sapiens
caggaacccttacagtaga

SEQ ID NO: 554452 - DNA, 16 bp, Homo sapiens
caggaaggaaacagat

SEQ ID NO: 554453 - DNA, 13 bp, Homo sapiens
caggaagtccctg

SEQ ID NO: 554454 - DNA, 16 bp, Homo sapiens
caggaagtccctgaga

SEQ ID NO: 554455 - DNA, 22 bp, Homo sapiens
caggaccccatctgctgagctc

SEQ ID NO: 554456 - DNA, 15 bp, Homo sapiens
caggaccctcgctgg

SEQ ID NO: 554457 - DNA, 15 bp, Homo sapiens
caccctgtgcagaag

SEQ ID NO: 554458 - DNA, 13 bp, Homo sapiens
cacccttgttcca

SEQ ID NO: 554459 - DNA, 12 bp, Homo sapiens
caccgaccaact

SEQ ID NO: 554460 - DNA, 18 bp, Homo sapiens
caccgaccaactccagac

SEQ ID NO: 554461 - DNA, 20 bp, Homo sapiens
caccgactagacacacaaag

SEQ ID NO: 554462 - DNA, 22 bp, Homo sapiens
cacctaaagcctaccctattct

SEQ ID NO: 554463 - DNA, 20 bp, Homo sapiens
cacctagcaattccatcacc

SEQ ID NO: 554464 - DNA, 14 bp, Homo sapiens
cacctgcacaaaca

SEQ ID NO: 554465 - DNA, 15 bp, Homo sapiens
cacctgcacaaacat

SEQ ID NO: 554466 - DNA, 15 bp, Homo sapiens
cacctgcagctccct

SEQ ID NO: 554467 - DNA, 20 bp, Homo sapiens
cacctgcccggcccaggagc

SEQ ID NO: 554468 - DNA, 13 bp, Homo sapiens
cacctgcctctga

SEQ ID NO: 554469 - DNA, 15 bp, Homo sapiens
cacctgcctctgaac

SEQ ID NO: 554470 - DNA, 17 bp, Homo sapiens
cacctgcctctgaactg

SEQ ID NO: 554471 - DNA, 20 bp, Homo sapiens
cacctgcctctgaactgctg

SEQ ID NO: 554472 - DNA, 21 bp, Homo sapiens
cacctgcctctgaactgctgc

SEQ ID NO: 554473 - DNA, 13 bp, Homo sapiens
cacctgctctgct

SEQ ID NO: 554474 - DNA, 19 bp, Homo sapiens
cacctgcttctctgcccag

SEQ ID NO: 554475 - DNA, 14 bp, Homo sapiens
cacctggccctggg

SEQ ID NO: 554476 - DNA, 17 bp, Homo sapiens
cacctgggagatgctgg

SEQ ID NO: 554477 - DNA, 18 bp, Homo sapiens
cacctgggagatgctggg

SEQ ID NO: 554478 - DNA, 19 bp, Homo sapiens
cacctgggagatgctggga

SEQ ID NO: 554479 - DNA, 18 bp, Homo sapiens
cacctgggcgtcatctgg

SEQ ID NO: 554480 - DNA, 14 bp, Homo sapiens
cacctgtactggag

SEQ ID NO: 554481 - DNA, 14 bp, Homo sapiens
cacctgtctgctcc

SEQ ID NO: 554482 - DNA, 21 bp, Homo sapiens
cacctgtctgctccagctctg

SEQ ID NO: 554483 - DNA, 23 bp, Homo sapiens
cacctgtctgctccagctctggc

SEQ ID NO: 554484 - DNA, 15 bp, Homo sapiens
cacgcaacttgaaat

SEQ ID NO: 554485 - DNA, 14 bp, Homo sapiens
cacgcacacacaca

SEQ ID NO: 554486 - DNA, 13 bp, Homo sapiens
cacgcacccacac

SEQ ID NO: 554487 - DNA, 14 bp, Homo sapiens
cacgcacccacacc

SEQ ID NO: 554488 - DNA, 23 bp, Homo sapiens
cacgcacccacaccctacagcag

SEQ ID NO: 554489 - DNA, 15 bp, Homo sapiens
cacgcacgcacacac

SEQ ID NO: 554490 - DNA, 14 bp, Homo sapiens
cacgcagacacaca

SEQ ID NO: 554491 - DNA, 16 bp, Homo sapiens
cacgcagacacacaca

SEQ ID NO: 554492 - DNA, 21 bp, Homo sapiens
cacgctgtgtccctcaattac

SEQ ID NO: 554493 - DNA, 22 bp, Homo sapiens
cacggagcggattgcaaagcaa

SEQ ID NO: 554494 - DNA, 13 bp, Homo sapiens
cacggcctctggg

SEQ ID NO: 554495 - DNA, 20 bp, Homo sapiens
cacgtagtagggtcaggcca

SEQ ID NO: 554496 - DNA, 21 bp, Homo sapiens
cacgtagtagggtcaggccac

SEQ ID NO: 554497 - DNA, 23 bp, Homo sapiens
cacgtagtagggtcaggccacgg

SEQ ID NO: 554498 - DNA, 13 bp, Homo sapiens
cactaaatgttaa

SEQ ID NO: 554499 - DNA, 14 bp, Homo sapiens
cactaaatgttaaa

SEQ ID NO: 554500 - DNA, 23 bp, Homo sapiens
cactaaatgttaaagatgtagca

SEQ ID NO: 554501 - DNA, 20 bp, Homo sapiens
cactaagtctcttttttaca

SEQ ID NO: 554502 - DNA, 22 bp, Homo sapiens
cactaccaaaggacacttatcc

SEQ ID NO: 554503 - DNA, 14 bp, Homo sapiens
cactccccacatcc

SEQ ID NO: 554504 - DNA, 14 bp, Homo sapiens
cactcctgctctgc

SEQ ID NO: 554505 - DNA, 17 bp, Homo sapiens
cactctcttcttactgt

SEQ ID NO: 554506 - DNA, 18 bp, Homo sapiens
cactctgtcgagcctggg

SEQ ID NO: 554507 - DNA, 14 bp, Homo sapiens
cactcttgtttctc

SEQ ID NO: 554508 - DNA, 15 bp, Homo sapiens
cactgaacttttcaa

SEQ ID NO: 554509 - DNA, 16 bp, Homo sapiens
cactgaacttttcaaa

SEQ ID NO: 554510 - DNA, 14 bp, Homo sapiens
cactgaagagtatg

SEQ ID NO: 554511 - DNA, 19 bp, Homo sapiens
cactgagtacaaatgtgtg

SEQ ID NO: 554512 - DNA, 16 bp, Homo sapiens
cactgagtctcattcc

SEQ ID NO: 554513 - DNA, 20 bp, Homo sapiens
cactgagtctcattcctctg

SEQ ID NO: 554514 - DNA, 19 bp, Homo sapiens
cactgccatggaggcacac

SEQ ID NO: 554515 - DNA, 16 bp, Homo sapiens
cactgctgtaaagcaa

SEQ ID NO: 554516 - DNA, 21 bp, Homo sapiens
cactgctgtaaagcaaaatat

SEQ ID NO: 554517 - DNA, 16 bp, Homo sapiens
cactggcatctttgct

SEQ ID NO: 554518 - DNA, 20 bp, Homo sapiens
cactggctgtgggctccctt

SEQ ID NO: 554519 - DNA, 20 bp, Homo sapiens
cactggtctcagaggaggga

SEQ ID NO: 554520 - DNA, 15 bp, Homo sapiens
cactgtatttgttaa

SEQ ID NO: 554521 - DNA, 20 bp, Homo sapiens
cactgtatttgttaatttct

SEQ ID NO: 554522 - DNA, 22 bp, Homo sapiens
cactgtcatgtgcgaacacagt

SEQ ID NO: 554523 - DNA, 23 bp, Homo sapiens
cactgtcatgtgcgaacacagtg

SEQ ID NO: 554524 - DNA, 13 bp, Homo sapiens
cactgtctgctgc

SEQ ID NO: 554525 - DNA, 18 bp, Homo sapiens
cactgtctgtctggtcca

SEQ ID NO: 554526 - DNA, 12 bp, Homo sapiens
cactgttataaa

SEQ ID NO: 554527 - DNA, 15 bp, Homo sapiens
cactgttataaattt

SEQ ID NO: 554528 - DNA, 19 bp, Homo sapiens
cactgttataaattttgta

SEQ ID NO: 554529 - DNA, 18 bp, Homo sapiens
cacttcagggcagatttt

SEQ ID NO: 554530 - DNA, 23 bp, Homo sapiens
cacttcagggcagattttagttt

SEQ ID NO: 554531 - DNA, 17 bp, Homo sapiens
cacttctgactcttccc

SEQ ID NO: 554532 - DNA, 14 bp, Homo sapiens
cacttcttctgtcc

SEQ ID NO: 554533 - DNA, 15 bp, Homo sapiens
cacttcttctgtcca

SEQ ID NO: 554534 - DNA, 16 bp, Homo sapiens
cacttcttctgtccaa

SEQ ID NO: 554535 - DNA, 17 bp, Homo sapiens
cacttctttcccttcct

SEQ ID NO: 554536 - DNA, 12 bp, Homo sapiens
cacttgaaaagt

SEQ ID NO: 554537 - DNA, 18 bp, Homo sapiens
cacttgcccctgttacct

SEQ ID NO: 554538 - DNA, 15 bp, Homo sapiens
cacttgtataaatgt

SEQ ID NO: 554539 - DNA, 19 bp, Homo sapiens
cacttgtataaatgtatat

SEQ ID NO: 554540 - DNA, 19 bp, Homo sapiens
caggaccctcgctggcccc

SEQ ID NO: 554541 - DNA, 21 bp, Homo sapiens
caggaccctcgctggccccca

SEQ ID NO: 554542 - DNA, 16 bp, Homo sapiens
caggacgcagggagac

SEQ ID NO: 554543 - DNA, 17 bp, Homo sapiens
caggacgcagggagacc

SEQ ID NO: 554544 - DNA, 15 bp, Homo sapiens
caggactctgccttc

SEQ ID NO: 554545 - DNA, 23 bp, Homo sapiens
caggacttggtcttttttctggg

SEQ ID NO: 554546 - DNA, 16 bp, Homo sapiens
caggagaagaaagaac

SEQ ID NO: 554547 - DNA, 23 bp, Homo sapiens
caggagacactggtctcagagga

SEQ ID NO: 554548 - DNA, 16 bp, Homo sapiens
caggagatgaggctgg

SEQ ID NO: 554549 - DNA, 17 bp, Homo sapiens
caggagatgaggctgga

SEQ ID NO: 554550 - DNA, 16 bp, Homo sapiens
caggagcgcagctgca

SEQ ID NO: 554551 - DNA, 22 bp, Homo sapiens
caggagcgctcccttgacctgc

SEQ ID NO: 554552 - DNA, 14 bp, Homo sapiens
caggaggcagaagg

SEQ ID NO: 554553 - DNA, 20 bp, Homo sapiens
caggaggcagaggttgcagt

SEQ ID NO: 554554 - DNA, 19 bp, Homo sapiens
caggaggcagtggcttgga

SEQ ID NO: 554555 - DNA, 22 bp, Homo sapiens
caggaggggagtgaggcaggtg

SEQ ID NO: 554556 - DNA, 17 bp, Homo sapiens
caggaggttggagggaa

SEQ ID NO: 554557 - DNA, 24 bp, Homo sapiens
caggagtgggtgggacacagagac

SEQ ID NO: 554558 - DNA, 22 bp, Homo sapiens
caggatagctcttcctccccag

SEQ ID NO: 554559 - DNA, 12 bp, Homo sapiens
caggatgcatat

SEQ ID NO: 554560 - DNA, 16 bp, Homo sapiens
caggatgcatattaaa

SEQ ID NO: 554561 - DNA, 19 bp, Homo sapiens
caggattctcaccagctgt

SEQ ID NO: 554562 - DNA, 22 bp, Homo sapiens
caggattctcaccagctgtgtc

SEQ ID NO: 554563 - DNA, 12 bp, Homo sapiens
caggcaattccg

SEQ ID NO: 554564 - DNA, 19 bp, Homo sapiens
caggcacctagcaattcca

SEQ ID NO: 554565 - DNA, 15 bp, Homo sapiens
caggcacggaggctc

SEQ ID NO: 554566 - DNA, 16 bp, Homo sapiens
caggcacggaggctcg

SEQ ID NO: 554567 - DNA, 16 bp, Homo sapiens
caggcaggggccctgc

SEQ ID NO: 554568 - DNA, 23 bp, Homo sapiens
caggcaggtgtgaacatggggga

SEQ ID NO: 554569 - DNA, 15 bp, Homo sapiens
caggcatctccttgg

SEQ ID NO: 554570 - DNA, 16 bp, Homo sapiens
caggcatgaccctgga

SEQ ID NO: 554571 - DNA, 15 bp, Homo sapiens
caggccaccctgtgc

SEQ ID NO: 554572 - DNA, 16 bp, Homo sapiens
caggccaccctgtgca

SEQ ID NO: 554573 - DNA, 18 bp, Homo sapiens
caggcccatgccctccgt

SEQ ID NO: 554574 - DNA, 20 bp, Homo sapiens
caggcccgaaggtctctctg

SEQ ID NO: 554575 - DNA, 12 bp, Homo sapiens
caggccctccgc

SEQ ID NO: 554576 - DNA, 17 bp, Homo sapiens
caggccgtggctgccca

SEQ ID NO: 554577 - DNA, 20 bp, Homo sapiens
caggcgctagcacagctccc

SEQ ID NO: 554578 - DNA, 15 bp, Homo sapiens
caggcggtatccaga

SEQ ID NO: 554579 - DNA, 17 bp, Homo sapiens
caggcggtatccagagg

SEQ ID NO: 554580 - DNA, 18 bp, Homo sapiens
caggcgtagggccagggc

SEQ ID NO: 554581 - DNA, 22 bp, Homo sapiens
caggcgtagggccagggctctg

SEQ ID NO: 554582 - DNA, 16 bp, Homo sapiens
caggctaatacaggaa

SEQ ID NO: 554583 - DNA, 23 bp, Homo sapiens
caggctaatgttggcagatgcag

SEQ ID NO: 554584 - DNA, 12 bp, Homo sapiens
cagggaaggagg

SEQ ID NO: 554585 - DNA, 14 bp, Homo sapiens
cagggaccccagaa

SEQ ID NO: 554586 - DNA, 15 bp, Homo sapiens
cagggaccccagaat

SEQ ID NO: 554587 - DNA, 13 bp, Homo sapiens
cagggagaccctg

SEQ ID NO: 554588 - DNA, 22 bp, Homo sapiens
cagggagccctggggtttccac

SEQ ID NO: 554589 - DNA, 19 bp, Homo sapiens
cagggatgctatctcgcta

SEQ ID NO: 554590 - DNA, 22 bp, Homo sapiens
cagggcaataaaatgaccatgg

SEQ ID NO: 554591 - DNA, 17 bp, Homo sapiens
cagggcaatcaatgttc

SEQ ID NO: 554592 - DNA, 16 bp, Homo sapiens
cagggcaggcagagct

SEQ ID NO: 554593 - DNA, 19 bp, Homo sapiens
cagggccagaagtagcttt

SEQ ID NO: 554594 - DNA, 22 bp, Homo sapiens
cagggctccacgggggcctagt

SEQ ID NO: 554595 - DNA, 21 bp, Homo sapiens
cagggctctggcaggtggcca

SEQ ID NO: 554596 - DNA, 20 bp, Homo sapiens
cagggctggggcagcctctg

SEQ ID NO: 554597 - DNA, 14 bp, Homo sapiens
caggggaggctgag

SEQ ID NO: 554598 - DNA, 19 bp, Homo sapiens
caggggaggctgagacgca

SEQ ID NO: 554599 - DNA, 17 bp, Homo sapiens
caggggagggggcaaag

SEQ ID NO: 554600 - DNA, 15 bp, Homo sapiens
caggggccctgcagc

SEQ ID NO: 554601 - DNA, 16 bp, Homo sapiens
caggggccctgcagct

SEQ ID NO: 554602 - DNA, 18 bp, Homo sapiens
caggggccctgcagctct

SEQ ID NO: 554603 - DNA, 18 bp, Homo sapiens
caggggctccatgccagc

SEQ ID NO: 554604 - DNA, 11 bp, Homo sapiens
cagggggccag

SEQ ID NO: 554605 - DNA, 13 bp, Homo sapiens
caggggtggagga

SEQ ID NO: 554606 - DNA, 22 bp, Homo sapiens
caggggtggaggagagcctggt

SEQ ID NO: 554607 - DNA, 18 bp, Homo sapiens
cagggtctcgtcaggagg

SEQ ID NO: 554608 - DNA, 19 bp, Homo sapiens
cagggtctcgtcaggaggt

SEQ ID NO: 554609 - DNA, 16 bp, Homo sapiens
cagggtgtctgccccc

SEQ ID NO: 554610 - DNA, 20 bp, Homo sapiens
cagggtgtgagcgccacatc

SEQ ID NO: 554611 - DNA, 12 bp, Homo sapiens
caggtactttgt

SEQ ID NO: 554612 - DNA, 15 bp, Homo sapiens
caggtaggaatatta

SEQ ID NO: 554613 - DNA, 17 bp, Homo sapiens
caggtcatctgctggga

SEQ ID NO: 554614 - DNA, 12 bp, Homo sapiens
caggtcctgctc

SEQ ID NO: 554615 - DNA, 16 bp, Homo sapiens
caggtctgatctgggt

SEQ ID NO: 554616 - DNA, 17 bp, Homo sapiens
caggtctgatctgggtt

SEQ ID NO: 554617 - DNA, 22 bp, Homo sapiens
caggtctgattcccagaaatac

SEQ ID NO: 554618 - DNA, 13 bp, Homo sapiens
caggtgaaaatgt

SEQ ID NO: 554619 - DNA, 23 bp, Homo sapiens
caggtgaaggaggctccaggcag

SEQ ID NO: 554620 - DNA, 19 bp, Homo sapiens
caggtgacagtgaggtcct

SEQ ID NO: 554621 - DNA, 20 bp, Homo sapiens
caggtgacagtgaggtcctg

SEQ ID NO: 554622 - DNA, 21 bp, Homo sapiens
caggtgacagtgaggtcctgg

SEQ ID NO: 554623 - DNA, 16 bp, Homo sapiens
caggtgcccctctctc

SEQ ID NO: 554624 - DNA, 12 bp, Homo sapiens
caggtggccagg

SEQ ID NO: 554625 - DNA, 20 bp, Homo sapiens
caggtgtggtgtaatttata

SEQ ID NO: 554626 - DNA, 13 bp, Homo sapiens
caggttaaatgtt

SEQ ID NO: 554627 - DNA, 14 bp, Homo sapiens
caggttaaatgttt

SEQ ID NO: 554628 - DNA, 22 bp, Homo sapiens
caggttaggcagtataaagaat

SEQ ID NO: 554629 - DNA, 23 bp, Homo sapiens
caggttaggcagtataaagaata

SEQ ID NO: 554630 - DNA, 23 bp, Homo sapiens
caggttgaagacctaaccagggc

SEQ ID NO: 554631 - DNA, 11 bp, Homo sapiens
caggttgacag

SEQ ID NO: 554632 - DNA, 13 bp, Homo sapiens
cagtaaacctgtc

SEQ ID NO: 554633 - DNA, 17 bp, Homo sapiens
cagtaaacttagagttt

SEQ ID NO: 554634 - DNA, 20 bp, Homo sapiens
cagtacaataaataaaagaa

SEQ ID NO: 554635 - DNA, 21 bp, Homo sapiens
cagtacattctcagtttttct

SEQ ID NO: 554636 - DNA, 13 bp, Homo sapiens
cagtagctgtggg

SEQ ID NO: 554637 - DNA, 22 bp, Homo sapiens
cagtagctgtggggagctggtg

SEQ ID NO: 554638 - DNA, 22 bp, Homo sapiens
cagtaggacaaggtgcaggcag

SEQ ID NO: 554639 - DNA, 21 bp, Homo sapiens
cagtataaagaataggacttg

SEQ ID NO: 554640 - DNA, 19 bp, Homo sapiens
cagtattaatactaaaata

SEQ ID NO: 554641 - DNA, 22 bp, Homo sapiens
cagtattaatactaaaatatgt

SEQ ID NO: 554642 - DNA, 23 bp, Homo sapiens
cagtattttagtggaccctgaaa

SEQ ID NO: 554643 - DNA, 12 bp, Homo sapiens
cagtcactgctc

SEQ ID NO: 554644 - DNA, 18 bp, Homo sapiens
cagtcaggctctctgggc

SEQ ID NO: 554645 - DNA, 16 bp, Homo sapiens
cagtcccaatgcacat

SEQ ID NO: 554646 - DNA, 13 bp, Homo sapiens
cagtccccagaac

SEQ ID NO: 554647 - DNA, 15 bp, Homo sapiens
cagtccccagaactc

SEQ ID NO: 554648 - DNA, 21 bp, Homo sapiens
cagtccccagaactctgcctg

SEQ ID NO: 554649 - DNA, 22 bp, Homo sapiens
cagtcgcctttcagcaggcagc

SEQ ID NO: 554650 - DNA, 19 bp, Homo sapiens
cagtctcccccacccttgt

SEQ ID NO: 554651 - DNA, 17 bp, Homo sapiens
cagtctctttcttcctt

SEQ ID NO: 554652 - DNA, 18 bp, Homo sapiens
cagtctctttcttccttt

SEQ ID NO: 554653 - DNA, 16 bp, Homo sapiens
cagtcttatgcttcca

SEQ ID NO: 554654 - DNA, 18 bp, Homo sapiens
cagtcttatgcttccaga

SEQ ID NO: 554655 - DNA, 20 bp, Homo sapiens
cagtcttatgcttccagaaa

SEQ ID NO: 554656 - DNA, 11 bp, Homo sapiens
cagtcttccac

SEQ ID NO: 554657 - DNA, 16 bp, Homo sapiens
cagtcttccacctgga

SEQ ID NO: 554658 - DNA, 18 bp, Homo sapiens
cagtcttccacctggaag

SEQ ID NO: 554659 - DNA, 13 bp, Homo sapiens
cagtgagagcaga

SEQ ID NO: 554660 - DNA, 17 bp, Homo sapiens
cagtgaggtcctggggg

SEQ ID NO: 554661 - DNA, 12 bp, Homo sapiens
cagtgatattct

SEQ ID NO: 554662 - DNA, 14 bp, Homo sapiens
cagtgatattcttt

SEQ ID NO: 554663 - DNA, 18 bp, Homo sapiens
cagtgatattctttgtta

SEQ ID NO: 554664 - DNA, 22 bp, Homo sapiens
cagtgatattctttgttaattt

SEQ ID NO: 554665 - DNA, 17 bp, Homo sapiens
cagtgcccatgtgtatg

SEQ ID NO: 554666 - DNA, 22 bp, Homo sapiens
cagtgccccgtctacagctccc

SEQ ID NO: 554667 - DNA, 16 bp, Homo sapiens
cagtggagcccaggag

SEQ ID NO: 554668 - DNA, 21 bp, Homo sapiens
cagtggcaaaatattatgtta

SEQ ID NO: 554669 - DNA, 24 bp, Homo sapiens
cagtggcaaaatattatgttatga

SEQ ID NO: 554670 - DNA, 14 bp, Homo sapiens
cagtggcagtattg

SEQ ID NO: 554671 - DNA, 20 bp, Homo sapiens
cagtggcttggagcagaggt

SEQ ID NO: 554672 - DNA, 15 bp, Homo sapiens
cagtgtaccattaaa

SEQ ID NO: 554673 - DNA, 13 bp, Homo sapiens
cagtgtccccagg

SEQ ID NO: 554674 - DNA, 15 bp, Homo sapiens
cagtgtctgtaaatc

SEQ ID NO: 554675 - DNA, 16 bp, Homo sapiens
cagtgttataaaatct

SEQ ID NO: 554676 - DNA, 17 bp, Homo sapiens
cagtgttctgtgaatag

SEQ ID NO: 554677 - DNA, 17 bp, Homo sapiens
cagtgtttactttaaat

SEQ ID NO: 554678 - DNA, 18 bp, Homo sapiens
cagtgtttactttaaatc

SEQ ID NO: 554679 - DNA, 16 bp, Homo sapiens
cagttaagaagccctg

SEQ ID NO: 554680 - DNA, 13 bp, Homo sapiens
cagttacagtggc

SEQ ID NO: 554681 - DNA, 13 bp, Homo sapiens
catcagcccctgc

SEQ ID NO: 554682 - DNA, 18 bp, Homo sapiens
catcagcccctgctgctc

SEQ ID NO: 554683 - DNA, 21 bp, Homo sapiens
catcagcccctgctgctcctc

SEQ ID NO: 554684 - DNA, 13 bp, Homo sapiens
catcatagaaact

SEQ ID NO: 554685 - DNA, 13 bp, Homo sapiens
catcatctgtaag

SEQ ID NO: 554686 - DNA, 14 bp, Homo sapiens
catccacagtctcc

SEQ ID NO: 554687 - DNA, 15 bp, Homo sapiens
catccaccttccctt

SEQ ID NO: 554688 - DNA, 16 bp, Homo sapiens
catccaccttcccttc

SEQ ID NO: 554689 - DNA, 21 bp, Homo sapiens
catccatgcggccggcctggg

SEQ ID NO: 554690 - DNA, 18 bp, Homo sapiens
catccattcccaagaaat

SEQ ID NO: 554691 - DNA, 13 bp, Homo sapiens
catcccagcccca

SEQ ID NO: 554692 - DNA, 22 bp, Homo sapiens
catcccggggccatggaagctg

SEQ ID NO: 554693 - DNA, 15 bp, Homo sapiens
catccctcctgcttt

SEQ ID NO: 554694 - DNA, 15 bp, Homo sapiens
catcccttctcttcc

SEQ ID NO: 554695 - DNA, 16 bp, Homo sapiens
catccgaccaggttgt

SEQ ID NO: 554696 - DNA, 22 bp, Homo sapiens
catccgtaccatcggtcagcag

SEQ ID NO: 554697 - DNA, 13 bp, Homo sapiens
catcctccagggc

SEQ ID NO: 554698 - DNA, 16 bp, Homo sapiens
catcctcctccttcct

SEQ ID NO: 554699 - DNA, 18 bp, Homo sapiens
catcctcctccttcctag

SEQ ID NO: 554700 - DNA, 16 bp, Homo sapiens
catccttcccactctg

SEQ ID NO: 554701 - DNA, 17 bp, Homo sapiens
catccttcccactctgt

SEQ ID NO: 554702 - DNA, 17 bp, Homo sapiens
catccttctccccaagg

SEQ ID NO: 554703 - DNA, 17 bp, Homo sapiens
catccttttctcctatc

SEQ ID NO: 554704 - DNA, 18 bp, Homo sapiens
catccttttctcctatct

SEQ ID NO: 554705 - DNA, 20 bp, Homo sapiens
catcgaaaattcatttcaca

SEQ ID NO: 554706 - DNA, 16 bp, Homo sapiens
catcgcaagtcacaga

SEQ ID NO: 554707 - DNA, 12 bp, Homo sapiens
catctaaacttt

SEQ ID NO: 554708 - DNA, 15 bp, Homo sapiens
catctaaatattatg

SEQ ID NO: 554709 - DNA, 16 bp, Homo sapiens
catctaccttttctct

SEQ ID NO: 554710 - DNA, 22 bp, Homo sapiens
catctctactaaaaatacaaac

SEQ ID NO: 554711 - DNA, 20 bp, Homo sapiens
catctgcagtgttctgtgaa

SEQ ID NO: 554712 - DNA, 22 bp, Homo sapiens
catctggaaaataaaaggtcta

SEQ ID NO: 554713 - DNA, 15 bp, Homo sapiens
catctgtaagctgtt

SEQ ID NO: 554714 - DNA, 15 bp, Homo sapiens
catctgtctggaggg

SEQ ID NO: 554715 - DNA, 16 bp, Homo sapiens
catctgtctggagggg

SEQ ID NO: 554716 - DNA, 23 bp, Homo sapiens
catctgtctggaggggagctctg

SEQ ID NO: 554717 - DNA, 13 bp, Homo sapiens
catgaacagctct

SEQ ID NO: 554718 - DNA, 19 bp, Homo sapiens
catgaacagctctgagatc

SEQ ID NO: 554719 - DNA, 15 bp, Homo sapiens
catgacccgtacaca

SEQ ID NO: 554720 - DNA, 15 bp, Homo sapiens
catgaggttctctct

SEQ ID NO: 554721 - DNA, 20 bp, Homo sapiens
catgagtgctaagagcctct

SEQ ID NO: 554722 - DNA, 20 bp, Homo sapiens
catgatgtttttaaaatctt

SEQ ID NO: 554723 - DNA, 22 bp, Homo sapiens
catgatgtttttaaaatcttat

SEQ ID NO: 554724 - DNA, 12 bp, Homo sapiens
catgatttcaca

SEQ ID NO: 554725 - DNA, 14 bp, Homo sapiens
catgatttcacaaa

SEQ ID NO: 554726 - DNA, 16 bp, Homo sapiens
catgatttcacaaata

SEQ ID NO: 554727 - DNA, 18 bp, Homo sapiens
catgatttcacaaatatt

SEQ ID NO: 554728 - DNA, 17 bp, Homo sapiens
catgcaattcatcccag

SEQ ID NO: 554729 - DNA, 14 bp, Homo sapiens
catgcacacacaca

SEQ ID NO: 554730 - DNA, 15 bp, Homo sapiens
catgcacacacacac

SEQ ID NO: 554731 - DNA, 16 bp, Homo sapiens
catgcacacacacaca

SEQ ID NO: 554732 - DNA, 19 bp, Homo sapiens
catgcacccgcatgtacaa

SEQ ID NO: 554733 - DNA, 21 bp, Homo sapiens
catgcagatagtatacacatc

SEQ ID NO: 554734 - DNA, 22 bp, Homo sapiens
catgccagaaggaatcttctca

SEQ ID NO: 554735 - DNA, 19 bp, Homo sapiens
catgcggccggcctggggc

SEQ ID NO: 554736 - DNA, 15 bp, Homo sapiens
catgctcccctgtgc

SEQ ID NO: 554737 - DNA, 16 bp, Homo sapiens
catgctcccctgtgcc

SEQ ID NO: 554738 - DNA, 18 bp, Homo sapiens
catgctcccctgtgccag

SEQ ID NO: 554739 - DNA, 19 bp, Homo sapiens
catgctccctcatgcagat

SEQ ID NO: 554740 - DNA, 18 bp, Homo sapiens
catgcttagcttatcttt

SEQ ID NO: 554741 - DNA, 16 bp, Homo sapiens
catgctttccatattt

SEQ ID NO: 554742 - DNA, 12 bp, Homo sapiens
catggaagctgg

SEQ ID NO: 554743 - DNA, 19 bp, Homo sapiens
catggaggcacacagctgc

SEQ ID NO: 554744 - DNA, 18 bp, Homo sapiens
catggatacttcctgggt

SEQ ID NO: 554745 - DNA, 21 bp, Homo sapiens
catggatttctgtcttctcta

SEQ ID NO: 554746 - DNA, 18 bp, Homo sapiens
catggcagcatgcgatgt

SEQ ID NO: 554747 - DNA, 19 bp, Homo sapiens
catggcgaaaacatctcct

SEQ ID NO: 554748 - DNA, 21 bp, Homo sapiens
catggcgaaaacatctcctta

SEQ ID NO: 554749 - DNA, 22 bp, Homo sapiens
catggcttctgaacctgtcttt

SEQ ID NO: 554750 - DNA, 17 bp, Homo sapiens
catgggagtcagggagc

SEQ ID NO: 554751 - DNA, 23 bp, Homo sapiens
catgggagtcagggagccctggg

SEQ ID NO: 554752 - DNA, 19 bp, Homo sapiens
catgggggaacaatgagca

SEQ ID NO: 554753 - DNA, 15 bp, Homo sapiens
catggtagactgtga

SEQ ID NO: 554754 - DNA, 17 bp, Homo sapiens
catggtagactgtgaca

SEQ ID NO: 554755 - DNA, 14 bp, Homo sapiens
catggtccattctc

SEQ ID NO: 554756 - DNA, 15 bp, Homo sapiens
catggtgaactgaag

SEQ ID NO: 554757 - DNA, 23 bp, Homo sapiens
catggtgaactgaagcagagtca

SEQ ID NO: 554758 - DNA, 16 bp, Homo sapiens
catggtgcaatttgtc

SEQ ID NO: 554759 - DNA, 15 bp, Homo sapiens
catgtatttctttag

SEQ ID NO: 554760 - DNA, 16 bp, Homo sapiens
catgtcctatgtgtga

SEQ ID NO: 554761 - DNA, 14 bp, Homo sapiens
catgtcctgtgtca

SEQ ID NO: 554762 - DNA, 15 bp, Homo sapiens
catgtcctgtgtcag

SEQ ID NO: 554763 - DNA, 19 bp, Homo sapiens
catgtcctgtgtcagttta

SEQ ID NO: 554764 - DNA, 21 bp, Homo sapiens
catgtctttctccaaagttat

SEQ ID NO: 554765 - DNA, 20 bp, Homo sapiens
catgtgagctgctgccatga

SEQ ID NO: 554766 - DNA, 16 bp, Homo sapiens
catgtgcgaacacagt

SEQ ID NO: 554767 - DNA, 17 bp, Homo sapiens
catgtgctgctgtggca

SEQ ID NO: 554768 - DNA, 15 bp, Homo sapiens
catgtggagtcagcc

SEQ ID NO: 554769 - DNA, 18 bp, Homo sapiens
catgtggagtcagcctcg

SEQ ID NO: 554770 - DNA, 17 bp, Homo sapiens
catgtggcctttatctc

SEQ ID NO: 554771 - DNA, 23 bp, Homo sapiens
catgtggcctttatctcaacgga

SEQ ID NO: 554772 - DNA, 24 bp, Homo sapiens
catgtggcctttatctcaacggaa

SEQ ID NO: 554773 - DNA, 23 bp, Homo sapiens
catgtgtatggaagacaaataca

SEQ ID NO: 554774 - DNA, 14 bp, Homo sapiens
catgtgtgtataag

SEQ ID NO: 554775 - DNA, 19 bp, Homo sapiens
catgtgtgtgagtttgctg

SEQ ID NO: 554776 - DNA, 18 bp, Homo sapiens
cattaaaatatgcactaa

SEQ ID NO: 554777 - DNA, 12 bp, Homo sapiens
cattaaagagcc

SEQ ID NO: 554778 - DNA, 13 bp, Homo sapiens
cattaatgttgat

SEQ ID NO: 554779 - DNA, 13 bp, Homo sapiens
cattacaatggaa

SEQ ID NO: 554780 - DNA, 16 bp, Homo sapiens
cattagcaaaaaaagt

SEQ ID NO: 554781 - DNA, 19 bp, Homo sapiens
cattagcaaaaaaagttgt

SEQ ID NO: 554782 - DNA, 15 bp, Homo sapiens
cattagtactttata

SEQ ID NO: 554783 - DNA, 13 bp, Homo sapiens
cattatgtgtgca

SEQ ID NO: 554784 - DNA, 20 bp, Homo sapiens
cattatgtgtgcatgtgtgt

SEQ ID NO: 554785 - DNA, 14 bp, Homo sapiens
cattattttgtatg

SEQ ID NO: 554786 - DNA, 16 bp, Homo sapiens
cattcactggcaaatg

SEQ ID NO: 554787 - DNA, 17 bp, Homo sapiens
cattcatattacaatat

SEQ ID NO: 554788 - DNA, 14 bp, Homo sapiens
cattcatcctctta

SEQ ID NO: 554789 - DNA, 15 bp, Homo sapiens
cattcatcctcttat

SEQ ID NO: 554790 - DNA, 12 bp, Homo sapiens
cattccaggccc

SEQ ID NO: 554791 - DNA, 17 bp, Homo sapiens
cattccaggcccgaagc

SEQ ID NO: 554792 - DNA, 16 bp, Homo sapiens
cattccagtcaggctc

SEQ ID NO: 554793 - DNA, 23 bp, Homo sapiens
cattcgggccccacctgcagctc

SEQ ID NO: 554794 - DNA, 16 bp, Homo sapiens
cattctcaagggacgt

SEQ ID NO: 554795 - DNA, 22 bp, Homo sapiens
cattctcaagggacgtcctcca

SEQ ID NO: 554796 - DNA, 20 bp, Homo sapiens
cattctgctgcccccagacc

SEQ ID NO: 554797 - DNA, 14 bp, Homo sapiens
cattgaagagagag

SEQ ID NO: 554798 - DNA, 15 bp, Homo sapiens
cattgaagagagagc

SEQ ID NO: 554799 - DNA, 16 bp, Homo sapiens
cattgcccacacctgc

SEQ ID NO: 554800 - DNA, 17 bp, Homo sapiens
cattgcttttaaaacta

SEQ ID NO: 554801 - DNA, 13 bp, Homo sapiens
cattggaaatttc

SEQ ID NO: 554802 - DNA, 16 bp, Homo sapiens
cattggaaatttcacg

SEQ ID NO: 554803 - DNA, 17 bp, Homo sapiens
cattgggccatgtttaa

SEQ ID NO: 554804 - DNA, 11 bp, Homo sapiens
cattgtatgtt

SEQ ID NO: 554805 - DNA, 16 bp, Homo sapiens
cattgtatttaaaaca

SEQ ID NO: 554806 - DNA, 19 bp, Homo sapiens
cattgtatttaaaacattt

SEQ ID NO: 554807 - DNA, 14 bp, Homo sapiens
cattgtccagagct

SEQ ID NO: 554808 - DNA, 18 bp, Homo sapiens
cattgtccagagctgctt

SEQ ID NO: 554809 - DNA, 21 bp, Homo sapiens
cattgtggccagtttagagtt

SEQ ID NO: 554810 - DNA, 15 bp, Homo sapiens
cattgttcagaaaag

SEQ ID NO: 554811 - DNA, 15 bp, Homo sapiens
cattgtttgtccttt

SEQ ID NO: 554812 - DNA, 16 bp, Homo sapiens
catttaagttgtaaac

SEQ ID NO: 554813 - DNA, 19 bp, Homo sapiens
catttacagtctctttctt

SEQ ID NO: 554814 - DNA, 19 bp, Homo sapiens
ccacctgcccggcccagga

SEQ ID NO: 554815 - DNA, 21 bp, Homo sapiens
ccacctgcccggcccaggagc

SEQ ID NO: 554816 - DNA, 22 bp, Homo sapiens
ccacctgcccggcccaggagcg

SEQ ID NO: 554817 - DNA, 15 bp, Homo sapiens
ccacctgctctgctg

SEQ ID NO: 554818 - DNA, 18 bp, Homo sapiens
ccacctgggagatgctgg

SEQ ID NO: 554819 - DNA, 21 bp, Homo sapiens
ccacctgggagatgctgggac

SEQ ID NO: 554820 - DNA, 15 bp, Homo sapiens
ccacgagagcgcagc

SEQ ID NO: 554821 - DNA, 23 bp, Homo sapiens
ccacgccctcattacggctcctc

SEQ ID NO: 554822 - DNA, 18 bp, Homo sapiens
ccacgggggcctagtggc

SEQ ID NO: 554823 - DNA, 20 bp, Homo sapiens
ccacgtgccaaggagctcag

SEQ ID NO: 554824 - DNA, 17 bp, Homo sapiens
ccacgttcacccctcca

SEQ ID NO: 554825 - DNA, 13 bp, Homo sapiens
ccactccattccc

SEQ ID NO: 554826 - DNA, 14 bp, Homo sapiens
ccactccattccca

SEQ ID NO: 554827 - DNA, 16 bp, Homo sapiens
ccactcctgctctgct

SEQ ID NO: 554828 - DNA, 11 bp, Homo sapiens
ccactggctgt

SEQ ID NO: 554829 - DNA, 15 bp, Homo sapiens
ccactggctgtgggc

SEQ ID NO: 554830 - DNA, 19 bp, Homo sapiens
ccactggctgtgggctccc

SEQ ID NO: 554831 - DNA, 22 bp, Homo sapiens
ccactggctgtgggctcccttc

SEQ ID NO: 554832 - DNA, 21 bp, Homo sapiens
ccactggggtggcctgactcc

SEQ ID NO: 554833 - DNA, 19 bp, Homo sapiens
ccactgtatttgttaattt

SEQ ID NO: 554834 - DNA, 22 bp, Homo sapiens
ccactgtctccacccaccttga

SEQ ID NO: 554835 - DNA, 17 bp, Homo sapiens
ccactttaagagagaaa

SEQ ID NO: 554836 - DNA, 14 bp, Homo sapiens
ccactttcccacac

SEQ ID NO: 554837 - DNA, 17 bp, Homo sapiens
ccactttgtataaattt

SEQ ID NO: 554838 - DNA, 14 bp, Homo sapiens
ccagaaagaggaat

SEQ ID NO: 554839 - DNA, 18 bp, Homo sapiens
ccagaaagaggaataaaa

SEQ ID NO: 554840 - DNA, 16 bp, Homo sapiens
ccagaaatacaacaga

SEQ ID NO: 554841 - DNA, 19 bp, Homo sapiens
ccagaaatgccgctgtgtc

SEQ ID NO: 554842 - DNA, 19 bp, Homo sapiens
ccagaactctgcctgccct

SEQ ID NO: 554843 - DNA, 24 bp, Homo sapiens
ccagaactcttcctccaaggacag

SEQ ID NO: 554844 - DNA, 20 bp, Homo sapiens
ccagaagccacccaaagcag

SEQ ID NO: 554845 - DNA, 17 bp, Homo sapiens
ccagacaacagcccagg

SEQ ID NO: 554846 - DNA, 15 bp, Homo sapiens
ccagacaagctgttg

SEQ ID NO: 554847 - DNA, 18 bp, Homo sapiens
ccagacacaaactgccaa

SEQ ID NO: 554848 - DNA, 14 bp, Homo sapiens
ccagaccagtagtg

SEQ ID NO: 554849 - DNA, 15 bp, Homo sapiens
ccagaccagtagtga

SEQ ID NO: 554850 - DNA, 19 bp, Homo sapiens
ccagaccagtagtgaccaa

SEQ ID NO: 554851 - DNA, 13 bp, Homo sapiens
ccagacctgggcc

SEQ ID NO: 554852 - DNA, 21 bp, Homo sapiens
ccagacctgggccctggttcc

SEQ ID NO: 554853 - DNA, 15 bp, Homo sapiens
ccagagcagagttta

SEQ ID NO: 554854 - DNA, 18 bp, Homo sapiens
ccagagcattccagtcag

SEQ ID NO: 554855 - DNA, 19 bp, Homo sapiens
ccagagcattccagtcagg

SEQ ID NO: 554856 - DNA, 21 bp, Homo sapiens
ccagagcattccagtcaggct

SEQ ID NO: 554857 - DNA, 21 bp, Homo sapiens
ccagagcatttccaacaccac

SEQ ID NO: 554858 - DNA, 13 bp, Homo sapiens
aaaaagcaacttt

SEQ ID NO: 554859 - DNA, 12 bp, Homo sapiens
aaaaagtattgc

SEQ ID NO: 554860 - DNA, 12 bp, Homo sapiens
aaaaagtgtctc

SEQ ID NO: 554861 - DNA, 16 bp, Homo sapiens
aaaaagtgtctcaaag

SEQ ID NO: 554862 - DNA, 23 bp, Homo sapiens
aaaaagttgtatgatctgtgcct

SEQ ID NO: 554863 - DNA, 13 bp, Homo sapiens
aaaaatatgtgaa

SEQ ID NO: 554864 - DNA, 18 bp, Homo sapiens
aaaaatcaaaaaattatc

SEQ ID NO: 554865 - DNA, 13 bp, Homo sapiens
aaaaatcagtttt

SEQ ID NO: 554866 - DNA, 14 bp, Homo sapiens
aaaaatccagaaac

SEQ ID NO: 554867 - DNA, 20 bp, Homo sapiens
aaaaatctgaagattgttta

SEQ ID NO: 554868 - DNA, 23 bp, Homo sapiens
aaaaatctgaagattgtttatct

SEQ ID NO: 554869 - DNA, 22 bp, Homo sapiens
aaaaatgcatttaagttgtaaa

SEQ ID NO: 554870 - DNA, 19 bp, Homo sapiens
aaaaattgaagagagatat

SEQ ID NO: 554871 - DNA, 23 bp, Homo sapiens
aaaacaaaatccttgccttcaaa

SEQ ID NO: 554872 - DNA, 20 bp, Homo sapiens
aaaacattgaagagagagct

SEQ ID NO: 554873 - DNA, 22 bp, Homo sapiens
aaaacattgaagagagagctga

SEQ ID NO: 554874 - DNA, 16 bp, Homo sapiens
aaaacatttcatgtat

SEQ ID NO: 554875 - DNA, 17 bp, Homo sapiens
aaaaccattctgcttgg

SEQ ID NO: 554876 - DNA, 18 bp, Homo sapiens
aaaacggttaaaactgtc

SEQ ID NO: 554877 - DNA, 22 bp, Homo sapiens
aaaactactgaataaatcatgt

SEQ ID NO: 554878 - DNA, 16 bp, Homo sapiens
aaaactatcagcagcg

SEQ ID NO: 554879 - DNA, 23 bp, Homo sapiens
aaaactcaaccaaatggtacaaa

SEQ ID NO: 554880 - DNA, 15 bp, Homo sapiens
aaaactgtactttga

SEQ ID NO: 554881 - DNA, 17 bp, Homo sapiens
aaaagactaagatcggt

SEQ ID NO: 554882 - DNA, 22 bp, Homo sapiens
aaaagataccttaaaatttgaa

SEQ ID NO: 554883 - DNA, 19 bp, Homo sapiens
aaaagcggggttcaatgct

SEQ ID NO: 554884 - DNA, 17 bp, Homo sapiens
aaaagcttccctccctg

SEQ ID NO: 554885 - DNA, 13 bp, Homo sapiens
aaaagggagaata

SEQ ID NO: 554886 - DNA, 14 bp, Homo sapiens
aaaagtattgccaa

SEQ ID NO: 554887 - DNA, 16 bp, Homo sapiens
aaaagtattgccaaac

SEQ ID NO: 554888 - DNA, 13 bp, Homo sapiens
aaaagtgacacag

SEQ ID NO: 554889 - DNA, 15 bp, Homo sapiens
aaaagtgacacagca

SEQ ID NO: 554890 - DNA, 17 bp, Homo sapiens
aaaagtgtctcaaagga

SEQ ID NO: 554891 - DNA, 16 bp, Homo sapiens
aaaagttcttaaaaca

SEQ ID NO: 554892 - DNA, 15 bp, Homo sapiens
aaaagttggtatttt

SEQ ID NO: 554893 - DNA, 21 bp, Homo sapiens
aaaagttggtattttataagc

SEQ ID NO: 554894 - DNA, 19 bp, Homo sapiens
aaaataaaaccagaaagag

SEQ ID NO: 554895 - DNA, 12 bp, Homo sapiens
aaaataaagctt

SEQ ID NO: 554896 - DNA, 13 bp, Homo sapiens
aaaataaagtctg

SEQ ID NO: 554897 - DNA, 15 bp, Homo sapiens
aaaataaatggaaat

SEQ ID NO: 554898 - DNA, 22 bp, Homo sapiens
aaaatataaaatagttgtccat

SEQ ID NO: 554899 - DNA, 20 bp, Homo sapiens
aaaatatatatagtgctata

SEQ ID NO: 554900 - DNA, 21 bp, Homo sapiens
aaaatatccaagcccagccta

SEQ ID NO: 554901 - DNA, 23 bp, Homo sapiens
aaaatatgtctcgctagtgatgt

SEQ ID NO: 554902 - DNA, 18 bp, Homo sapiens
aaaatatgtgaaggacct

SEQ ID NO: 554903 - DNA, 13 bp, Homo sapiens
aaaatattatgtt

SEQ ID NO: 554904 - DNA, 17 bp, Homo sapiens
aaaatattatgttatga

SEQ ID NO: 554905 - DNA, 16 bp, Homo sapiens
aaaatcaaagctgagg

SEQ ID NO: 554906 - DNA, 15 bp, Homo sapiens
aaaatctgaagattg

SEQ ID NO: 554907 - DNA, 16 bp, Homo sapiens
aaaatctgaagattgt

SEQ ID NO: 554908 - DNA, 22 bp, Homo sapiens
aaaatctgaagattgtttatct

SEQ ID NO: 554909 - DNA, 16 bp, Homo sapiens
aaaatcttattaaagt

SEQ ID NO: 554910 - DNA, 21 bp, Homo sapiens
aaaatcttattaaagtttcaa

SEQ ID NO: 554911 - DNA, 23 bp, Homo sapiens
aaaatcttattaaagtttcaaaa

SEQ ID NO: 554912 - DNA, 9 bp, Homo sapiens
aaaatgaaa

SEQ ID NO: 554913 - DNA, 20 bp, Homo sapiens
aaaatgagggtctcactgct

SEQ ID NO: 554914 - DNA, 17 bp, Homo sapiens
aaaatgattgtcttttt

SEQ ID NO: 554915 - DNA, 23 bp, Homo sapiens
aaaatgcagccttaaacagtgtc

SEQ ID NO: 554916 - DNA, 21 bp, Homo sapiens
aaaatgcggcactatttctga

SEQ ID NO: 554917 - DNA, 16 bp, Homo sapiens
aaaatggcatttagca

SEQ ID NO: 554918 - DNA, 17 bp, Homo sapiens
aaaatggcatttagcac

SEQ ID NO: 554919 - DNA, 19 bp, Homo sapiens
aaaatggcatttagcacag

SEQ ID NO: 554920 - DNA, 12 bp, Homo sapiens
aaaatgtaactg

SEQ ID NO: 554921 - DNA, 13 bp, Homo sapiens
aaaatgtaactgt

SEQ ID NO: 554922 - DNA, 15 bp, Homo sapiens
aaaatgtaactgtta

SEQ ID NO: 554923 - DNA, 19 bp, Homo sapiens
aaaatgtcactgttataaa

SEQ ID NO: 554924 - DNA, 12 bp, Homo sapiens
aaaatgttttca

SEQ ID NO: 554925 - DNA, 16 bp, Homo sapiens
aaaattatctttaaaa

SEQ ID NO: 554926 - DNA, 22 bp, Homo sapiens
aaaattatctttaaaacttact

SEQ ID NO: 554927 - DNA, 22 bp, Homo sapiens
aaaattgaagagagatatatct

SEQ ID NO: 554928 - DNA, 21 bp, Homo sapiens
aaaatttaacatctgcagtgt

SEQ ID NO: 554929 - DNA, 22 bp, Homo sapiens
aaaatttctggcaaatattttg

SEQ ID NO: 554930 - DNA, 13 bp, Homo sapiens
aaaatttgaaaca

SEQ ID NO: 554931 - DNA, 16 bp, Homo sapiens
aaaatttgaaacattg

SEQ ID NO: 554932 - DNA, 12 bp, Homo sapiens
aaacaagaatgt

SEQ ID NO: 554933 - DNA, 20 bp, Homo sapiens
aaacaagcatataaaatggc

SEQ ID NO: 554934 - DNA, 19 bp, Homo sapiens
aaacaaggggctgttacat

SEQ ID NO: 554935 - DNA, 23 bp, Homo sapiens
aaacacctgacagcccctccctc

SEQ ID NO: 554936 - DNA, 16 bp, Homo sapiens
aaacactaaatgttaa

SEQ ID NO: 554937 - DNA, 15 bp, Homo sapiens
aaacagaaattggta

SEQ ID NO: 554938 - DNA, 13 bp, Homo sapiens
aaacagataccat

SEQ ID NO: 554939 - DNA, 18 bp, Homo sapiens
aaacatggatacttcctg

SEQ ID NO: 554940 - DNA, 22 bp, Homo sapiens
aaacatggatacttcctgggtc

SEQ ID NO: 554941 - DNA, 16 bp, Homo sapiens
aaacattaaatgtctt

SEQ ID NO: 554942 - DNA, 16 bp, Homo sapiens
aaacattaatgttgat

SEQ ID NO: 554943 - DNA, 13 bp, Homo sapiens
aaacattgctttt

SEQ ID NO: 554944 - DNA, 17 bp, Homo sapiens
aaacattggaagcaggt

SEQ ID NO: 554945 - DNA, 22 bp, Homo sapiens
aaacattggaagcaggttaaat

SEQ ID NO: 554946 - DNA, 20 bp, Homo sapiens
aaacatttcctttttctatt

SEQ ID NO: 554947 - DNA, 21 bp, Homo sapiens
aaacatttcctttttctattt

SEQ ID NO: 554948 - DNA, 14 bp, Homo sapiens
aaaccaatttcttc

SEQ ID NO: 554949 - DNA, 13 bp, Homo sapiens
aaacccaaagatg

SEQ ID NO: 554950 - DNA, 17 bp, Homo sapiens
aaacccaatcagatgcc

SEQ ID NO: 554951 - DNA, 12 bp, Homo sapiens
aaacccctgaca

SEQ ID NO: 554952 - DNA, 20 bp, Homo sapiens
aaaccctttaaatggggacg

SEQ ID NO: 554953 - DNA, 17 bp, Homo sapiens
aaaccgaggacccatga

SEQ ID NO: 554954 - DNA, 13 bp, Homo sapiens
aaaccgtgtttgt

SEQ ID NO: 554955 - DNA, 19 bp, Homo sapiens
aaacgacaaatctgtctgc

SEQ ID NO: 554956 - DNA, 17 bp, Homo sapiens
aaacggaatgaccttgg

SEQ ID NO: 554957 - DNA, 13 bp, Homo sapiens
aaactaagaatca

SEQ ID NO: 554958 - DNA, 18 bp, Homo sapiens
aaactactgaataaatca

SEQ ID NO: 554959 - DNA, 15 bp, Homo sapiens
aaactagaaaaggaa

SEQ ID NO: 554960 - DNA, 17 bp, Homo sapiens
aaactcaaccaaatggt

SEQ ID NO: 554961 - DNA, 18 bp, Homo sapiens
aaactcatacagtggtat

SEQ ID NO: 554962 - DNA, 22 bp, Homo sapiens
aaactgcacatgatttcacaaa

SEQ ID NO: 554963 - DNA, 15 bp, Homo sapiens
aaactgtactttgat

SEQ ID NO: 554964 - DNA, 18 bp, Homo sapiens
aaactgtatttacttgtt

SEQ ID NO: 554965 - DNA, 23 bp, Homo sapiens
aaacttactatggtatatatttt

SEQ ID NO: 554966 - DNA, 16 bp, Homo sapiens
aaacttgttcttccaa

SEQ ID NO: 554967 - DNA, 14 bp, Homo sapiens
aaactttaatatgt

SEQ ID NO: 554968 - DNA, 18 bp, Homo sapiens
aaacttttatgcgcaaat

SEQ ID NO: 554969 - DNA, 21 bp, Homo sapiens
aaacttttatgcgcaaataca

SEQ ID NO: 554970 - DNA, 22 bp, Homo sapiens
aaagaaattagggctctaattt

SEQ ID NO: 554971 - DNA, 18 bp, Homo sapiens
aaagaactatcttcatct

SEQ ID NO: 554972 - DNA, 22 bp, Homo sapiens
aaagaactatcttcatctgaga

SEQ ID NO: 554973 - DNA, 19 bp, Homo sapiens
aaagaataggacttgtttt

SEQ ID NO: 554974 - DNA, 13 bp, Homo sapiens
aaagaatattcag

SEQ ID NO: 554975 - DNA, 13 bp, Homo sapiens
aaagactaagatc

SEQ ID NO: 554976 - DNA, 19 bp, Homo sapiens
aaagagatgggccttttct

SEQ ID NO: 554977 - DNA, 19 bp, Homo sapiens
aaagagcaggatagctctt

SEQ ID NO: 554978 - DNA, 16 bp, Homo sapiens
aaagataccttaaaat

SEQ ID NO: 554979 - DNA, 22 bp, Homo sapiens
aaagataccttaaaatttgaaa

SEQ ID NO: 554980 - DNA, 18 bp, Homo sapiens
aaagatattgtatctcct

SEQ ID NO: 554981 - DNA, 20 bp, Homo sapiens
aaagatattgtatctccttt

SEQ ID NO: 554982 - DNA, 15 bp, Homo sapiens
aaagatcaaaataaa

SEQ ID NO: 554983 - DNA, 14 bp, Homo sapiens
aactttgaaatata

SEQ ID NO: 554984 - DNA, 16 bp, Homo sapiens
aactttgaaatatatg

SEQ ID NO: 554985 - DNA, 15 bp, Homo sapiens
aacttttcaaaataa

SEQ ID NO: 554986 - DNA, 19 bp, Homo sapiens
aacttttcaaaataaagct

SEQ ID NO: 554987 - DNA, 16 bp, Homo sapiens
aacttttttttctttt

SEQ ID NO: 554988 - DNA, 16 bp, Homo sapiens
aagaaaaatcagtttt

SEQ ID NO: 554989 - DNA, 18 bp, Homo sapiens
aagaaaaatcagtttttg

SEQ ID NO: 554990 - DNA, 12 bp, Homo sapiens
aagaaaaatttc

SEQ ID NO: 554991 - DNA, 16 bp, Homo sapiens
aagaaacagataccat

SEQ ID NO: 554992 - DNA, 16 bp, Homo sapiens
aagaaacagtttaaca

SEQ ID NO: 554993 - DNA, 17 bp, Homo sapiens
aagaaacattggaagca

SEQ ID NO: 554994 - DNA, 19 bp, Homo sapiens
aagaaagccagtcttaaca

SEQ ID NO: 554995 - DNA, 14 bp, Homo sapiens
aagaaatctataga

SEQ ID NO: 554996 - DNA, 19 bp, Homo sapiens
aagaaatgcacaatgtctt

SEQ ID NO: 554997 - DNA, 23 bp, Homo sapiens
aagaaattccatacttctctcag

SEQ ID NO: 554998 - DNA, 22 bp, Homo sapiens
aagaacactggacctttgggtt

SEQ ID NO: 554999 - DNA, 15 bp, Homo sapiens
aagaacttgtttaat

SEQ ID NO: 555000 - DNA, 17 bp, Homo sapiens
aagaatattcagagaat

SEQ ID NO: 555001 - DNA, 23 bp, Homo sapiens
aagaatctctatgccctgttaaa

SEQ ID NO: 555002 - DNA, 15 bp, Homo sapiens
aagaatgcatgcttt

SEQ ID NO: 555003 - DNA, 20 bp, Homo sapiens
aagaattttttattttttgg

SEQ ID NO: 555004 - DNA, 18 bp, Homo sapiens
aagacaaatacacataca

SEQ ID NO: 555005 - DNA, 13 bp, Homo sapiens
aagacaaatagta

SEQ ID NO: 555006 - DNA, 18 bp, Homo sapiens
aagacatgttgtaaatta

SEQ ID NO: 555007 - DNA, 14 bp, Homo sapiens
aagaccagcctggc

SEQ ID NO: 555008 - DNA, 15 bp, Homo sapiens
aagacccgagctggg

SEQ ID NO: 555009 - DNA, 13 bp, Homo sapiens
aagacctctgtga

SEQ ID NO: 555010 - DNA, 13 bp, Homo sapiens
aagactccagaaa

SEQ ID NO: 555011 - DNA, 20 bp, Homo sapiens
aagactgatgaagaaattta

SEQ ID NO: 555012 - DNA, 18 bp, Homo sapiens
aagactgtaaattccaaa

SEQ ID NO: 555013 - DNA, 23 bp, Homo sapiens
aagactgtaaattccaaagatct

SEQ ID NO: 555014 - DNA, 13 bp, Homo sapiens
aagacttcaaatg

SEQ ID NO: 555015 - DNA, 22 bp, Homo sapiens
aagacttcaaatgttattcaat

SEQ ID NO: 555016 - DNA, 16 bp, Homo sapiens
aagagaaaaagccctc

SEQ ID NO: 555017 - DNA, 14 bp, Homo sapiens
aagagagagctgag

SEQ ID NO: 555018 - DNA, 12 bp, Homo sapiens
aagagatgcact

SEQ ID NO: 555019 - DNA, 23 bp, Homo sapiens
aagagattttatgtttaaaatgg

SEQ ID NO: 555020 - DNA, 16 bp, Homo sapiens
aagagctaggcagggt

SEQ ID NO: 555021 - DNA, 22 bp, Homo sapiens
aagagctaggcagggtgtctgc

SEQ ID NO: 555022 - DNA, 19 bp, Homo sapiens
aagaggaaaatattgacaa

SEQ ID NO: 555023 - DNA, 21 bp, Homo sapiens
aagaggtttggctcctgccca

SEQ ID NO: 555024 - DNA, 17 bp, Homo sapiens
aagagtaacacttgaaa

SEQ ID NO: 555025 - DNA, 21 bp, Homo sapiens
aagagtagaaaaggattgctt

SEQ ID NO: 555026 - DNA, 14 bp, Homo sapiens
aagagtgaagagca

SEQ ID NO: 555027 - DNA, 14 bp, Homo sapiens
aagataccttaaaa

SEQ ID NO: 555028 - DNA, 16 bp, Homo sapiens
aagataccttaaaatt

SEQ ID NO: 555029 - DNA, 23 bp, Homo sapiens
aagatagttgtaaagatattgta

SEQ ID NO: 555030 - DNA, 17 bp, Homo sapiens
aagatattgtatctcct

SEQ ID NO: 555031 - DNA, 21 bp, Homo sapiens
aagatattgtatctcctttaa

SEQ ID NO: 555032 - DNA, 21 bp, Homo sapiens
aagatcaaaataaaaagtgac

SEQ ID NO: 555033 - DNA, 18 bp, Homo sapiens
aagatcggttaacaaata

SEQ ID NO: 555034 - DNA, 18 bp, Homo sapiens
aagatgctgctgagcaca

SEQ ID NO: 555035 - DNA, 20 bp, Homo sapiens
aagatgctgctgagcacatc

SEQ ID NO: 555036 - DNA, 22 bp, Homo sapiens
aagatgctgctgagcacatctc

SEQ ID NO: 555037 - DNA, 18 bp, Homo sapiens
aagatgtagcaaaccctg

SEQ ID NO: 555038 - DNA, 22 bp, Homo sapiens
aagatgttaacagtattttaag

SEQ ID NO: 555039 - DNA, 14 bp, Homo sapiens
aagatgttatattt

SEQ ID NO: 555040 - DNA, 19 bp, Homo sapiens
aagattgtttatctagatg

SEQ ID NO: 555041 - DNA, 22 bp, Homo sapiens
aagattgtttatctagatgtaa

SEQ ID NO: 555042 - DNA, 18 bp, Homo sapiens
aagcaaaaacgaaagctg

SEQ ID NO: 555043 - DNA, 12 bp, Homo sapiens
aagcaaaaggca

SEQ ID NO: 555044 - DNA, 11 bp, Homo sapiens
aagcaaaatat

SEQ ID NO: 555045 - DNA, 15 bp, Homo sapiens
aagcaaaatatttgt

SEQ ID NO: 555046 - DNA, 18 bp, Homo sapiens
aagcaaaatatttgtgaa

SEQ ID NO: 555047 - DNA, 13 bp, Homo sapiens
aagcaaataaata

SEQ ID NO: 555048 - DNA, 14 bp, Homo sapiens
aagcaaataaatat

SEQ ID NO: 555049 - DNA, 12 bp, Homo sapiens
acagcttagaat

SEQ ID NO: 555050 - DNA, 17 bp, Homo sapiens
acaggaacacccagccc

SEQ ID NO: 555051 - DNA, 14 bp, Homo sapiens
acaggagacactgt

SEQ ID NO: 555052 - DNA, 15 bp, Homo sapiens
acaggaggttggagg

SEQ ID NO: 555053 - DNA, 13 bp, Homo sapiens
acaggatgcatat

SEQ ID NO: 555054 - DNA, 16 bp, Homo sapiens
acaggatgcatattaa

SEQ ID NO: 555055 - DNA, 16 bp, Homo sapiens
acaggatggtctctgc

SEQ ID NO: 555056 - DNA, 15 bp, Homo sapiens
acaggattagacagt

SEQ ID NO: 555057 - DNA, 12 bp, Homo sapiens
acaggcaattcc

SEQ ID NO: 555058 - DNA, 21 bp, Homo sapiens
acaggccaccctgtgcagaag

SEQ ID NO: 555059 - DNA, 16 bp, Homo sapiens
acaggcccatgccctc

SEQ ID NO: 555060 - DNA, 12 bp, Homo sapiens
acaggctgcccc

SEQ ID NO: 555061 - DNA, 20 bp, Homo sapiens
acaggctgccccacccctcc

SEQ ID NO: 555062 - DNA, 16 bp, Homo sapiens
acagggcatgaaatga

SEQ ID NO: 555063 - DNA, 16 bp, Homo sapiens
acagggggccagaaca

SEQ ID NO: 555064 - DNA, 16 bp, Homo sapiens
acaggtgtggtgtaat

SEQ ID NO: 555065 - DNA, 21 bp, Homo sapiens
acaggtgtggtgtaatttata

SEQ ID NO: 555066 - DNA, 17 bp, Homo sapiens
acagtaaagaaagcaga

SEQ ID NO: 555067 - DNA, 13 bp, Homo sapiens
acagtaatcagtt

SEQ ID NO: 555068 - DNA, 14 bp, Homo sapiens
acagtatttaacat

SEQ ID NO: 555069 - DNA, 14 bp, Homo sapiens
acagtcactgctct

SEQ ID NO: 555070 - DNA, 16 bp, Homo sapiens
acagtcaggttgaaga

SEQ ID NO: 555071 - DNA, 13 bp, Homo sapiens
acagtctccccca

SEQ ID NO: 555072 - DNA, 18 bp, Homo sapiens
acagtctctttcttcctt

SEQ ID NO: 555073 - DNA, 19 bp, Homo sapiens
acagtctctttcttccttt

SEQ ID NO: 555074 - DNA, 22 bp, Homo sapiens
acagtctctttcttcctttcta

SEQ ID NO: 555075 - DNA, 20 bp, Homo sapiens
acagtgaggtcctgggggcc

SEQ ID NO: 555076 - DNA, 14 bp, Homo sapiens
acagtgtctgtaaa

SEQ ID NO: 555077 - DNA, 13 bp, Homo sapiens
acagttacttttc

SEQ ID NO: 555078 - DNA, 15 bp, Homo sapiens
acagttacttttcct

SEQ ID NO: 555079 - DNA, 16 bp, Homo sapiens
acagttacttttcctt

SEQ ID NO: 555080 - DNA, 21 bp, Homo sapiens
acagtttaaaaaaaaagttgg

SEQ ID NO: 555081 - DNA, 16 bp, Homo sapiens
acagtttgatgtcatt

SEQ ID NO: 555082 - DNA, 11 bp, Homo sapiens
acataaacatc

SEQ ID NO: 555083 - DNA, 13 bp, Homo sapiens
acataaattgtaa

SEQ ID NO: 555084 - DNA, 15 bp, Homo sapiens
acataaattgtaatt

SEQ ID NO: 555085 - DNA, 23 bp, Homo sapiens
acataaattgtaatttgggaaca

SEQ ID NO: 555086 - DNA, 13 bp, Homo sapiens
acataacaagaaa

SEQ ID NO: 555087 - DNA, 14 bp, Homo sapiens
acataattcattaa

SEQ ID NO: 555088 - DNA, 17 bp, Homo sapiens
acatacaatttactttt

SEQ ID NO: 555089 - DNA, 21 bp, Homo sapiens
acatacacttgtataaatgta

SEQ ID NO: 555090 - DNA, 13 bp, Homo sapiens
acatacatatata

SEQ ID NO: 555091 - DNA, 14 bp, Homo sapiens
acatagacagatgt

SEQ ID NO: 555092 - DNA, 23 bp, Homo sapiens
acatagttctccagttgtatgga

SEQ ID NO: 555093 - DNA, 23 bp, Homo sapiens
acatatacctataatgtgtgtat

SEQ ID NO: 555094 - DNA, 13 bp, Homo sapiens
acatatatacatt

SEQ ID NO: 555095 - DNA, 22 bp, Homo sapiens
acatatatgtatacgcacgcac

SEQ ID NO: 555096 - DNA, 17 bp, Homo sapiens
acatatgtagactatat

SEQ ID NO: 555097 - DNA, 18 bp, Homo sapiens
acatcatctgtaagctgt

SEQ ID NO: 555098 - DNA, 19 bp, Homo sapiens
acatcatctgtaagctgtt

SEQ ID NO: 555099 - DNA, 21 bp, Homo sapiens
acatcccaccccatcctccag

SEQ ID NO: 555100 - DNA, 15 bp, Homo sapiens
acatctccttagaaa

SEQ ID NO: 555101 - DNA, 23 bp, Homo sapiens
acatctctgtaaaaagcaggtga

SEQ ID NO: 555102 - DNA, 12 bp, Homo sapiens
acatctcttcat

SEQ ID NO: 555103 - DNA, 22 bp, Homo sapiens
acatctgatatcaggaaatatc

SEQ ID NO: 555104 - DNA, 22 bp, Homo sapiens
acatctggaaaataaaaggtct

SEQ ID NO: 555105 - DNA, 11 bp, Homo sapiens
acatcttccac

SEQ ID NO: 555106 - DNA, 13 bp, Homo sapiens
acatgatttcaca

SEQ ID NO: 555107 - DNA, 14 bp, Homo sapiens
acatgatttcacaa

SEQ ID NO: 555108 - DNA, 15 bp, Homo sapiens
acatgatttcacaaa

SEQ ID NO: 555109 - DNA, 22 bp, Homo sapiens
acatgatttcacaaatattaaa

SEQ ID NO: 555110 - DNA, 14 bp, Homo sapiens
acatgcacacacac

SEQ ID NO: 555111 - DNA, 17 bp, Homo sapiens
acatgcacacacacaca

SEQ ID NO: 555112 - DNA, 13 bp, Homo sapiens
acatgcacccgca

SEQ ID NO: 555113 - DNA, 22 bp, Homo sapiens
acatgccagaaggaatcttctc

SEQ ID NO: 555114 - DNA, 21 bp, Homo sapiens
acatgcccctcttagaagaaa

SEQ ID NO: 555115 - DNA, 14 bp, Homo sapiens
acatgcgggctggg

SEQ ID NO: 555116 - DNA, 22 bp, Homo sapiens
acatgcgggctgggcagctgtt

SEQ ID NO: 555117 - DNA, 21 bp, Homo sapiens
acatgctgtactaaaatatgc

SEQ ID NO: 555118 - DNA, 13 bp, Homo sapiens
acatgcttagctt

SEQ ID NO: 555119 - DNA, 23 bp, Homo sapiens
acatgcttagcttatctttcttt

SEQ ID NO: 555120 - DNA, 19 bp, Homo sapiens
acatgtggaaaactcacag

SEQ ID NO: 555121 - DNA, 23 bp, Homo sapiens
acatgtgtgtatatatgtgtata

SEQ ID NO: 555122 - DNA, 21 bp, Homo sapiens
acatgttgtaaattaggaggc

SEQ ID NO: 555123 - DNA, 13 bp, Homo sapiens
acattaatgttga

SEQ ID NO: 555124 - DNA, 17 bp, Homo sapiens
acattaatgttgatttc

SEQ ID NO: 555125 - DNA, 22 bp, Homo sapiens
acattaatgttgatttctagtt

SEQ ID NO: 555126 - DNA, 19 bp, Homo sapiens
acattagtactttatagaa

SEQ ID NO: 555127 - DNA, 22 bp, Homo sapiens
acattagtactttatagaagaa

SEQ ID NO: 555128 - DNA, 17 bp, Homo sapiens
acattatgtgtgcatgt

SEQ ID NO: 555129 - DNA, 20 bp, Homo sapiens
acattatgtgtgcatgtgtg

SEQ ID NO: 555130 - DNA, 16 bp, Homo sapiens
acattgaaactgtatt

SEQ ID NO: 555131 - DNA, 20 bp, Homo sapiens
acattgcataagtggaccca

SEQ ID NO: 555132 - DNA, 17 bp, Homo sapiens
acattgcccacacctgc

SEQ ID NO: 555133 - DNA, 15 bp, Homo sapiens
acattgcttttaaaa

SEQ ID NO: 555134 - DNA, 17 bp, Homo sapiens
acattgcttttaaaact

SEQ ID NO: 555135 - DNA, 18 bp, Homo sapiens
acattgcttttaaaacta

SEQ ID NO: 555136 - DNA, 15 bp, Homo sapiens
acattggaagcaggt

SEQ ID NO: 555137 - DNA, 15 bp, Homo sapiens
acattgttgctccct

SEQ ID NO: 555138 - DNA, 21 bp, Homo sapiens
acatttcatgtatttctttag

SEQ ID NO: 555139 - DNA, 23 bp, Homo sapiens
acatttgtttggttatagtgcaa

SEQ ID NO: 555140 - DNA, 20 bp, Homo sapiens
acattttgcagctatggaca

SEQ ID NO: 555141 - DNA, 16 bp, Homo sapiens
acatttttgatcaaat

SEQ ID NO: 555142 - DNA, 18 bp, Homo sapiens
accaaaaaaatccagaaa

SEQ ID NO: 555143 - DNA, 20 bp, Homo sapiens
accaaagctgctgcacagct

SEQ ID NO: 555144 - DNA, 17 bp, Homo sapiens
accaaaggacattatgt

SEQ ID NO: 555145 - DNA, 21 bp, Homo sapiens
accaaaggacattatgtgtgc

SEQ ID NO: 555146 - DNA, 21 bp, Homo sapiens
accaaatatcaccaggactgt

SEQ ID NO: 555147 - DNA, 20 bp, Homo sapiens
accaactttcaagaacttgt

SEQ ID NO: 555148 - DNA, 20 bp, Homo sapiens
accaaggtagaatgaccttg

SEQ ID NO: 555149 - DNA, 23 bp, Homo sapiens
accaaggtagaatgaccttgtaa

SEQ ID NO: 555150 - DNA, 16 bp, Homo sapiens
accaatgccaagataa

SEQ ID NO: 555151 - DNA, 18 bp, Homo sapiens
accaattcactttagagt

SEQ ID NO: 555152 - DNA, 13 bp, Homo sapiens
accaatttcttcc

SEQ ID NO: 555153 - DNA, 15 bp, Homo sapiens
accaatttcttcctt

SEQ ID NO: 555154 - DNA, 22 bp, Homo sapiens
accaatttcttccttccacagt

SEQ ID NO: 555155 - DNA, 21 bp, Homo sapiens
accacacatttcactgtctgt

SEQ ID NO: 555156 - DNA, 14 bp, Homo sapiens
accacactgagttc

SEQ ID NO: 555157 - DNA, 15 bp, Homo sapiens
accacagacactcct

SEQ ID NO: 555158 - DNA, 18 bp, Homo sapiens
accacagacactcctggg

SEQ ID NO: 555159 - DNA, 15 bp, Homo sapiens
accacagctcctttt

SEQ ID NO: 555160 - DNA, 22 bp, Homo sapiens
accacctgcccggcccaggagc

SEQ ID NO: 555161 - DNA, 14 bp, Homo sapiens
accactaattttgt

SEQ ID NO: 555162 - DNA, 14 bp, Homo sapiens
accactgaatctgt

SEQ ID NO: 555163 - DNA, 12 bp, Homo sapiens
accactgtctcc

SEQ ID NO: 555164 - DNA, 15 bp, Homo sapiens
accactttcccacac

SEQ ID NO: 555165 - DNA, 13 bp, Homo sapiens
accagaaagagga

SEQ ID NO: 555166 - DNA, 21 bp, Homo sapiens
accagaaagaggaataaaatg

SEQ ID NO: 555167 - DNA, 14 bp, Homo sapiens
accagacaagctgt

SEQ ID NO: 555168 - DNA, 20 bp, Homo sapiens
accagagcatttccaacacc

SEQ ID NO: 555169 - DNA, 20 bp, Homo sapiens
accagcctggccaacatggt

SEQ ID NO: 555170 - DNA, 20 bp, Homo sapiens
accaggactctgccttccag

SEQ ID NO: 555171 - DNA, 15 bp, Homo sapiens
accaggcacctcccc

SEQ ID NO: 555172 - DNA, 17 bp, Homo sapiens
accagtacattctcagt

SEQ ID NO: 555173 - DNA, 11 bp, Homo sapiens
accagtagtga

SEQ ID NO: 555174 - DNA, 12 bp, Homo sapiens
accagtagtgac

SEQ ID NO: 555175 - DNA, 15 bp, Homo sapiens
accagtagtgaccaa

SEQ ID NO: 555176 - DNA, 16 bp, Homo sapiens
accagtagtgaccaat

SEQ ID NO: 555177 - DNA, 17 bp, Homo sapiens
accagttccctcagccc

SEQ ID NO: 555178 - DNA, 21 bp, Homo sapiens
accagttccctcagccctcat

SEQ ID NO: 555179 - DNA, 15 bp, Homo sapiens
accagttgctgctgc

SEQ ID NO: 555180 - DNA, 19 bp, Homo sapiens
accatactcatttctaaaa

SEQ ID NO: 555181 - DNA, 19 bp, Homo sapiens
accatccaccttcccttct

SEQ ID NO: 555182 - DNA, 16 bp, Homo sapiens
aatctatagaaagtgt

SEQ ID NO: 555183 - DNA, 18 bp, Homo sapiens
aatctatagaaagtgttc

SEQ ID NO: 555184 - DNA, 20 bp, Homo sapiens
aatctcagcactttgtttca

SEQ ID NO: 555185 - DNA, 21 bp, Homo sapiens
aatctcctttggaaggtgaca

SEQ ID NO: 555186 - DNA, 19 bp, Homo sapiens
aatctctacccctttcttc

SEQ ID NO: 555187 - DNA, 17 bp, Homo sapiens
aatctgaagattgttta

SEQ ID NO: 555188 - DNA, 18 bp, Homo sapiens
aatctgaagattgtttat

SEQ ID NO: 555189 - DNA, 21 bp, Homo sapiens
aatctgaagattgtttatcta

SEQ ID NO: 555190 - DNA, 16 bp, Homo sapiens
aatctgaccacagaca

SEQ ID NO: 555191 - DNA, 18 bp, Homo sapiens
aatctgaccacagacact

SEQ ID NO: 555192 - DNA, 23 bp, Homo sapiens
aatctgtctgctggtcacttctt

SEQ ID NO: 555193 - DNA, 14 bp, Homo sapiens
aatcttattaaagt

SEQ ID NO: 555194 - DNA, 15 bp, Homo sapiens
aatcttattaaagtt

SEQ ID NO: 555195 - DNA, 14 bp, Homo sapiens
aatgaaatgtttta

SEQ ID NO: 555196 - DNA, 16 bp, Homo sapiens
aatgaaatttaagcac

SEQ ID NO: 555197 - DNA, 20 bp, Homo sapiens
aatgaacacaaattatgcta

SEQ ID NO: 555198 - DNA, 15 bp, Homo sapiens
aatgaagatctttgt

SEQ ID NO: 555199 - DNA, 18 bp, Homo sapiens
aatgacaagtgacttatt

SEQ ID NO: 555200 - DNA, 13 bp, Homo sapiens
aatgaccttgtaa

SEQ ID NO: 555201 - DNA, 16 bp, Homo sapiens
aatgaccttgtaatgt

SEQ ID NO: 555202 - DNA, 21 bp, Homo sapiens
aatgaccttgtaatgtaactg

SEQ ID NO: 555203 - DNA, 13 bp, Homo sapiens
aatgagacagcag

SEQ ID NO: 555204 - DNA, 17 bp, Homo sapiens
aatgagtatatgtaaca

SEQ ID NO: 555205 - DNA, 20 bp, Homo sapiens
aatgagtatatgtaacagtt

SEQ ID NO: 555206 - DNA, 20 bp, Homo sapiens
aatgagtttccagctaagcc

SEQ ID NO: 555207 - DNA, 15 bp, Homo sapiens
aatgagtttctttta

SEQ ID NO: 555208 - DNA, 15 bp, Homo sapiens
aatgataaaatccca

SEQ ID NO: 555209 - DNA, 16 bp, Homo sapiens
aatgatatgtctttaa

SEQ ID NO: 555210 - DNA, 23 bp, Homo sapiens
aatgattattttcattacaatgg

SEQ ID NO: 555211 - DNA, 17 bp, Homo sapiens
aatgcacatccattccc

SEQ ID NO: 555212 - DNA, 12 bp, Homo sapiens
aatgcatttaag

SEQ ID NO: 555213 - DNA, 13 bp, Homo sapiens
aatgccaagataa

SEQ ID NO: 555214 - DNA, 14 bp, Homo sapiens
aatgcccttcactg

SEQ ID NO: 555215 - DNA, 20 bp, Homo sapiens
aatgctacaaaatgtgtgct

SEQ ID NO: 555216 - DNA, 21 bp, Homo sapiens
aatgctatttgtgtaactgaa

SEQ ID NO: 555217 - DNA, 19 bp, Homo sapiens
aatgcttctttcctcttaa

SEQ ID NO: 555218 - DNA, 14 bp, Homo sapiens
aatggaagagaaat

SEQ ID NO: 555219 - DNA, 13 bp, Homo sapiens
aatggagttggag

SEQ ID NO: 555220 - DNA, 21 bp, Homo sapiens
aatggagttggagttcattca

SEQ ID NO: 555221 - DNA, 16 bp, Homo sapiens
aatggcaagttttgat

SEQ ID NO: 555222 - DNA, 21 bp, Homo sapiens
aatggcatctcgttgtaagta

SEQ ID NO: 555223 - DNA, 17 bp, Homo sapiens
aatggcatttagcacag

SEQ ID NO: 555224 - DNA, 21 bp, Homo sapiens
aatggcatttagcacagtatt

SEQ ID NO: 555225 - DNA, 23 bp, Homo sapiens
aatggcatttagcacagtattta

SEQ ID NO: 555226 - DNA, 15 bp, Homo sapiens
aatggcctcttaaaa

SEQ ID NO: 555227 - DNA, 14 bp, Homo sapiens
aatggtaatttagt

SEQ ID NO: 555228 - DNA, 19 bp, Homo sapiens
aatggtaatttagtgtata

SEQ ID NO: 555229 - DNA, 16 bp, Homo sapiens
aatgtaactgctcttg

SEQ ID NO: 555230 - DNA, 22 bp, Homo sapiens
aatgtaactgttaccattggaa

SEQ ID NO: 555231 - DNA, 17 bp, Homo sapiens
aatgtatagtatttgaa

SEQ ID NO: 555232 - DNA, 20 bp, Homo sapiens
acaagctgttgaccaggcac

SEQ ID NO: 555233 - DNA, 22 bp, Homo sapiens
acaaggcttgctgcagatacta

SEQ ID NO: 555234 - DNA, 23 bp, Homo sapiens
acaagggaaaataaaaaaagaaa

SEQ ID NO: 555235 - DNA, 18 bp, Homo sapiens
acaaggggctgttacata

SEQ ID NO: 555236 - DNA, 21 bp, Homo sapiens
acaagttttcataagcacact

SEQ ID NO: 555237 - DNA, 21 bp, Homo sapiens
acaataagaaacagtttaaca

SEQ ID NO: 555238 - DNA, 22 bp, Homo sapiens
acaataagaaacagtttaacag

SEQ ID NO: 555239 - DNA, 10 bp, Homo sapiens
acaatatata

SEQ ID NO: 555240 - DNA, 15 bp, Homo sapiens
acaatatataaaaat

SEQ ID NO: 555241 - DNA, 21 bp, Homo sapiens
acaatcagaccaaggaacaag

SEQ ID NO: 555242 - DNA, 17 bp, Homo sapiens
acaatcatctattgagt

SEQ ID NO: 555243 - DNA, 19 bp, Homo sapiens
acaatcatgaacagctctg

SEQ ID NO: 555244 - DNA, 21 bp, Homo sapiens
acaatcatgaacagctctgag

SEQ ID NO: 555245 - DNA, 12 bp, Homo sapiens
acaatcttctgt

SEQ ID NO: 555246 - DNA, 14 bp, Homo sapiens
acaatgaatgtata

SEQ ID NO: 555247 - DNA, 21 bp, Homo sapiens
acaatgaatgtatattttgtg

SEQ ID NO: 555248 - DNA, 13 bp, Homo sapiens
acaatgtttgatg

SEQ ID NO: 555249 - DNA, 15 bp, Homo sapiens
acaattaattcatcc

SEQ ID NO: 555250 - DNA, 12 bp, Homo sapiens
acaattataaac

SEQ ID NO: 555251 - DNA, 13 bp, Homo sapiens
acaattctaatgg

SEQ ID NO: 555252 - DNA, 19 bp, Homo sapiens
acaattctaatggtaactt

SEQ ID NO: 555253 - DNA, 23 bp, Homo sapiens
acaattctaatggtaacttttgt

SEQ ID NO: 555254 - DNA, 22 bp, Homo sapiens
acaatttacttttaataaagta

SEQ ID NO: 555255 - DNA, 14 bp, Homo sapiens
acaatttgttaatt

SEQ ID NO: 555256 - DNA, 18 bp, Homo sapiens
acaattttcagatttgca

SEQ ID NO: 555257 - DNA, 21 bp, Homo sapiens
acaattttcagatttgcacaa

SEQ ID NO: 555258 - DNA, 13 bp, Homo sapiens
acacaaatacgga

SEQ ID NO: 555259 - DNA, 21 bp, Homo sapiens
acacaaattatgctaagaatt

SEQ ID NO: 555260 - DNA, 22 bp, Homo sapiens
acacaaattatgctaagaattt

SEQ ID NO: 555261 - DNA, 17 bp, Homo sapiens
acacaagcagacacaca

SEQ ID NO: 555262 - DNA, 20 bp, Homo sapiens
acacaagcagacacacacat

SEQ ID NO: 555263 - DNA, 22 bp, Homo sapiens
acacaagcagacacacacatat

SEQ ID NO: 555264 - DNA, 14 bp, Homo sapiens
acacaatcagacca

SEQ ID NO: 555265 - DNA, 13 bp, Homo sapiens
acacacaaagcag

SEQ ID NO: 555266 - DNA, 15 bp, Homo sapiens
acacacacacacaca

SEQ ID NO: 555267 - DNA, 16 bp, Homo sapiens
acacacacacacacgc

SEQ ID NO: 555268 - DNA, 15 bp, Homo sapiens
acacacacacacata

SEQ ID NO: 555269 - DNA, 16 bp, Homo sapiens
acacacacacacatat

SEQ ID NO: 555270 - DNA, 14 bp, Homo sapiens
acacacacacacgc

SEQ ID NO: 555271 - DNA, 14 bp, Homo sapiens
acacacacacatat

SEQ ID NO: 555272 - DNA, 14 bp, Homo sapiens
acacacacatatat

SEQ ID NO: 555273 - DNA, 12 bp, Homo sapiens
acacacacgcag

SEQ ID NO: 555274 - DNA, 20 bp, Homo sapiens
acacacacgcagacacacac

SEQ ID NO: 555275 - DNA, 13 bp, Homo sapiens
acacacatatata

SEQ ID NO: 555276 - DNA, 19 bp, Homo sapiens
acacacgcagacacacaca

SEQ ID NO: 555277 - DNA, 14 bp, Homo sapiens
acacagattatttg

SEQ ID NO: 555278 - DNA, 16 bp, Homo sapiens
acacaggccaccctgt

SEQ ID NO: 555279 - DNA, 11 bp, Homo sapiens
acacaggccca

SEQ ID NO: 555280 - DNA, 16 bp, Homo sapiens
acacaggcccatgccc

SEQ ID NO: 555281 - DNA, 14 bp, Homo sapiens
acacatacatatat

SEQ ID NO: 555282 - DNA, 16 bp, Homo sapiens
acacatatatacatac

SEQ ID NO: 555283 - DNA, 20 bp, Homo sapiens
acacatcataaacaaagagt

SEQ ID NO: 555284 - DNA, 14 bp, Homo sapiens
acacatcatctgta

SEQ ID NO: 555285 - DNA, 17 bp, Homo sapiens
acacattgaaactgtat

SEQ ID NO: 555286 - DNA, 22 bp, Homo sapiens
acacattgaaactgtatttact

SEQ ID NO: 555287 - DNA, 19 bp, Homo sapiens
acaccaaaaaaatccagaa

SEQ ID NO: 555288 - DNA, 14 bp, Homo sapiens
acaccacagacaca

SEQ ID NO: 555289 - DNA, 17 bp, Homo sapiens
acaccactttcccacac

SEQ ID NO: 555290 - DNA, 21 bp, Homo sapiens
acacctagactctaaaactat

SEQ ID NO: 555291 - DNA, 17 bp, Homo sapiens
acacctgcctctgaact

SEQ ID NO: 555292 - DNA, 14 bp, Homo sapiens
acacctggccctgg

SEQ ID NO: 555293 - DNA, 15 bp, Homo sapiens
acacctggccctggg

SEQ ID NO: 555294 - DNA, 19 bp, Homo sapiens
acacctggccctggggcct

SEQ ID NO: 555295 - DNA, 18 bp, Homo sapiens
acacgcacgcacacacac

SEQ ID NO: 555296 - DNA, 17 bp, Homo sapiens
acacgcagacacacaca

SEQ ID NO: 555297 - DNA, 13 bp, Homo sapiens
acacgtgtatatg

SEQ ID NO: 555298 - DNA, 13 bp, Homo sapiens
acactaaatgtta

SEQ ID NO: 555299 - DNA, 19 bp, Homo sapiens
acactaaatgttaaagatg

SEQ ID NO: 555300 - DNA, 17 bp, Homo sapiens
acactgaagtcagttct

SEQ ID NO: 555301 - DNA, 15 bp, Homo sapiens
acactgagtgaaata

SEQ ID NO: 555302 - DNA, 19 bp, Homo sapiens
acactgtgaactaatgaca

SEQ ID NO: 555303 - DNA, 20 bp, Homo sapiens
acacttgctttatttttcat

SEQ ID NO: 555304 - DNA, 20 bp, Homo sapiens
acacttgtataaatgtatat

SEQ ID NO: 555305 - DNA, 16 bp, Homo sapiens
acagaaagcatagacg

SEQ ID NO: 555306 - DNA, 14 bp, Homo sapiens
acagaaatatatat

SEQ ID NO: 555307 - DNA, 18 bp, Homo sapiens
acagaaatatatatacat

SEQ ID NO: 555308 - DNA, 15 bp, Homo sapiens
acagaacactttgct

SEQ ID NO: 555309 - DNA, 23 bp, Homo sapiens
acagaaccaattcactttagagt

SEQ ID NO: 555310 - DNA, 20 bp, Homo sapiens
acagaacctactgttccttt

SEQ ID NO: 555311 - DNA, 13 bp, Homo sapiens
acagaactccctt

SEQ ID NO: 555312 - DNA, 16 bp, Homo sapiens
acagaaggctcctgcc

SEQ ID NO: 555313 - DNA, 19 bp, Homo sapiens
acagaaggctcctgccccc

SEQ ID NO: 555314 - DNA, 20 bp, Homo sapiens
acagacaattctaatggtaa

SEQ ID NO: 555315 - DNA, 17 bp, Homo sapiens
acagacacacacacgca

SEQ ID NO: 555316 - DNA, 22 bp, Homo sapiens
acagacacacacacgcacgcac

SEQ ID NO: 555317 - DNA, 23 bp, Homo sapiens
acagacacacacacgcacgcaca

SEQ ID NO: 555318 - DNA, 15 bp, Homo sapiens
acagacactcctggg

SEQ ID NO: 555319 - DNA, 22 bp, Homo sapiens
acagacgcctgcttttgcaaat

SEQ ID NO: 555320 - DNA, 15 bp, Homo sapiens
acagacgtccctcca

SEQ ID NO: 555321 - DNA, 13 bp, Homo sapiens
acagagatgtctc

SEQ ID NO: 555322 - DNA, 15 bp, Homo sapiens
acagagatgtctctt

SEQ ID NO: 555323 - DNA, 20 bp, Homo sapiens
acagagcactaggttcaatt

SEQ ID NO: 555324 - DNA, 12 bp, Homo sapiens
acagagcctgcc

SEQ ID NO: 555325 - DNA, 17 bp, Homo sapiens
acagagcgacagagcag

SEQ ID NO: 555326 - DNA, 20 bp, Homo sapiens
acagagggtaggaatgggta

SEQ ID NO: 555327 - DNA, 14 bp, Homo sapiens
acagatcaagaaaa

SEQ ID NO: 555328 - DNA, 18 bp, Homo sapiens
acagatgacccctgccca

SEQ ID NO: 555329 - DNA, 21 bp, Homo sapiens
acagattggattttatgttga

SEQ ID NO: 555330 - DNA, 12 bp, Homo sapiens
acagcaaacaca

SEQ ID NO: 555331 - DNA, 20 bp, Homo sapiens
acagcaaacacagtcactgt

SEQ ID NO: 555332 - DNA, 20 bp, Homo sapiens
acagcagatccacctgcaca

SEQ ID NO: 555333 - DNA, 20 bp, Homo sapiens
acagcagctgaagccagctc

SEQ ID NO: 555334 - DNA, 12 bp, Homo sapiens
acagcagcttca

SEQ ID NO: 555335 - DNA, 17 bp, Homo sapiens
acagcagcttcaccaga

SEQ ID NO: 555336 - DNA, 17 bp, Homo sapiens
accatctaggatgattt

SEQ ID NO: 555337 - DNA, 20 bp, Homo sapiens
accattaaaatatgcactaa

SEQ ID NO: 555338 - DNA, 14 bp, Homo sapiens
accattggaaattt

SEQ ID NO: 555339 - DNA, 15 bp, Homo sapiens
accattggaaatttc

SEQ ID NO: 555340 - DNA, 19 bp, Homo sapiens
accatttccgtaattctta

SEQ ID NO: 555341 - DNA, 12 bp, Homo sapiens
accattttcctg

SEQ ID NO: 555342 - DNA, 15 bp, Homo sapiens
accattttcctgcat

SEQ ID NO: 555343 - DNA, 15 bp, Homo sapiens
acccaaaagagaaaa

SEQ ID NO: 555344 - DNA, 14 bp, Homo sapiens
acccaaagcacatg

SEQ ID NO: 555345 - DNA, 15 bp, Homo sapiens
acccaatcagatgcc

SEQ ID NO: 555346 - DNA, 23 bp, Homo sapiens
acccacaccctacagcagatcca

SEQ ID NO: 555347 - DNA, 22 bp, Homo sapiens
acccatgagtgctaagagcctc

SEQ ID NO: 555348 - DNA, 13 bp, Homo sapiens
accccatccagcc

SEQ ID NO: 555349 - DNA, 20 bp, Homo sapiens
accccatccagccaggggtg

SEQ ID NO: 555350 - DNA, 18 bp, Homo sapiens
accccatttgctttcttt

SEQ ID NO: 555351 - DNA, 13 bp, Homo sapiens
acccccagctccc

SEQ ID NO: 555352 - DNA, 12 bp, Homo sapiens
acccccccagct

SEQ ID NO: 555353 - DNA, 16 bp, Homo sapiens
acccccgggtgcctgt

SEQ ID NO: 555354 - DNA, 15 bp, Homo sapiens
acccccgtgccaaat

SEQ ID NO: 555355 - DNA, 22 bp, Homo sapiens
acccccgtgccaaatcctgggc

SEQ ID NO: 555356 - DNA, 18 bp, Homo sapiens
acccctcccggccctgcc

SEQ ID NO: 555357 - DNA, 16 bp, Homo sapiens
acccctgcccagatca

SEQ ID NO: 555358 - DNA, 17 bp, Homo sapiens
accccttcccattccat

SEQ ID NO: 555359 - DNA, 14 bp, Homo sapiens
acccctttcttctc

SEQ ID NO: 555360 - DNA, 22 bp, Homo sapiens
acccgcatgtacaaaaacacaa

SEQ ID NO: 555361 - DNA, 14 bp, Homo sapiens
acccggttcagtgt

SEQ ID NO: 555362 - DNA, 14 bp, Homo sapiens
acccgtacacacca

SEQ ID NO: 555363 - DNA, 12 bp, Homo sapiens
accctacagcag

SEQ ID NO: 555364 - DNA, 13 bp, Homo sapiens
accctacagcaga

SEQ ID NO: 555365 - DNA, 18 bp, Homo sapiens
accctagctttatatttt

SEQ ID NO: 555366 - DNA, 12 bp, Homo sapiens
accctatctccc

SEQ ID NO: 555367 - DNA, 16 bp, Homo sapiens
accctatctcccacaa

SEQ ID NO: 555368 - DNA, 19 bp, Homo sapiens
accctatgccttttgtagc

SEQ ID NO: 555369 - DNA, 21 bp, Homo sapiens
accctattctatccatctcct

SEQ ID NO: 555370 - DNA, 11 bp, Homo sapiens
accctccttcc

SEQ ID NO: 555371 - DNA, 12 bp, Homo sapiens
accctcgctggc

SEQ ID NO: 555372 - DNA, 15 bp, Homo sapiens
accctcgctggcccc

SEQ ID NO: 555373 - DNA, 16 bp, Homo sapiens
accctcgctggccccc

SEQ ID NO: 555374 - DNA, 18 bp, Homo sapiens
accctcggggcaggaagt

SEQ ID NO: 555375 - DNA, 16 bp, Homo sapiens
accctgcccagcctga

SEQ ID NO: 555376 - DNA, 16 bp, Homo sapiens
accctgtcaaacatta

SEQ ID NO: 555377 - DNA, 20 bp, Homo sapiens
acccttctttccatttctct

SEQ ID NO: 555378 - DNA, 13 bp, Homo sapiens
accgaaggtgaca

SEQ ID NO: 555379 - DNA, 14 bp, Homo sapiens
accgaaggtgacag

SEQ ID NO: 555380 - DNA, 12 bp, Homo sapiens
accgaccaactc

SEQ ID NO: 555381 - DNA, 16 bp, Homo sapiens
accgaccaactccaga

SEQ ID NO: 555382 - DNA, 21 bp, Homo sapiens
accgagaggaaaaaggcttct

SEQ ID NO: 555383 - DNA, 15 bp, Homo sapiens
accgagcaaagatca

SEQ ID NO: 555384 - DNA, 17 bp, Homo sapiens
accgagcaaagatcaaa

SEQ ID NO: 555385 - DNA, 12 bp, Homo sapiens
accgaggaccca

SEQ ID NO: 555386 - DNA, 18 bp, Homo sapiens
accggcaatttccggcca

SEQ ID NO: 555387 - DNA, 19 bp, Homo sapiens
accgggagcctgcgtggcc

SEQ ID NO: 555388 - DNA, 23 bp, Homo sapiens
accggggtcctgaggctggggct

SEQ ID NO: 555389 - DNA, 19 bp, Homo sapiens
accgtgtttgtctcttctg

SEQ ID NO: 555390 - DNA, 21 bp, Homo sapiens
acctaaagcctaccctattct

SEQ ID NO: 555391 - DNA, 15 bp, Homo sapiens
acctaattaatttca

SEQ ID NO: 555392 - DNA, 22 bp, Homo sapiens
acctacagaatactagccagag

SEQ ID NO: 555393 - DNA, 16 bp, Homo sapiens
acctactgttcctttc

SEQ ID NO: 555394 - DNA, 17 bp, Homo sapiens
acctactgttcctttca

SEQ ID NO: 555395 - DNA, 18 bp, Homo sapiens
acctactgttcctttcag

SEQ ID NO: 555396 - DNA, 15 bp, Homo sapiens
acctataatgtgtgt

SEQ ID NO: 555397 - DNA, 22 bp, Homo sapiens
acctattgctgtaaataaaaat

SEQ ID NO: 555398 - DNA, 14 bp, Homo sapiens
acctccacctggga

SEQ ID NO: 555399 - DNA, 13 bp, Homo sapiens
acctccccaggcc

SEQ ID NO: 555400 - DNA, 19 bp, Homo sapiens
acctccccaggccgtggct

SEQ ID NO: 555401 - DNA, 11 bp, Homo sapiens
acctcccccac

SEQ ID NO: 555402 - DNA, 15 bp, Homo sapiens
acctccccctccttc

SEQ ID NO: 555403 - DNA, 21 bp, Homo sapiens
acctccccctccttcccagct

SEQ ID NO: 555404 - DNA, 16 bp, Homo sapiens
acctcccctggtcctg

SEQ ID NO: 555405 - DNA, 14 bp, Homo sapiens
acctctgggagctg

SEQ ID NO: 555406 - DNA, 15 bp, Homo sapiens
acctgaacaaaccct

SEQ ID NO: 555407 - DNA, 20 bp, Homo sapiens
acctgaacaaaccctttaaa

SEQ ID NO: 555408 - DNA, 17 bp, Homo sapiens
acctgacagcaaacaca

SEQ ID NO: 555409 - DNA, 17 bp, Homo sapiens
acctgacagcccctccc

SEQ ID NO: 555410 - DNA, 15 bp, Homo sapiens
acctgaggcctgaag

SEQ ID NO: 555411 - DNA, 15 bp, Homo sapiens
acctgcacaaacata

SEQ ID NO: 555412 - DNA, 20 bp, Homo sapiens
acctgcacaaacatagacag

SEQ ID NO: 555413 - DNA, 19 bp, Homo sapiens
acctgcaggactcgggcta

SEQ ID NO: 555414 - DNA, 15 bp, Homo sapiens
acctgcccccgctct

SEQ ID NO: 555415 - DNA, 18 bp, Homo sapiens
acctgcccggcccaggag

SEQ ID NO: 555416 - DNA, 20 bp, Homo sapiens
acctgcccggcccaggagcg

SEQ ID NO: 555417 - DNA, 23 bp, Homo sapiens
acctgccctgggcatgcccagcc

SEQ ID NO: 555418 - DNA, 21 bp, Homo sapiens
acctgcctctgaactgctgct

SEQ ID NO: 555419 - DNA, 12 bp, Homo sapiens
acctgctctgct

SEQ ID NO: 555420 - DNA, 15 bp, Homo sapiens
acctgcttctctgcc

SEQ ID NO: 555421 - DNA, 16 bp, Homo sapiens
acctggccctggggcc

SEQ ID NO: 555422 - DNA, 17 bp, Homo sapiens
acctggccctggggcct

SEQ ID NO: 555423 - DNA, 18 bp, Homo sapiens
acctggccctggggcctg

SEQ ID NO: 555424 - DNA, 15 bp, Homo sapiens
acctggcctgtctgt

SEQ ID NO: 555425 - DNA, 15 bp, Homo sapiens
acctgggacagggag

SEQ ID NO: 555426 - DNA, 17 bp, Homo sapiens
acctgggagatgctggg

SEQ ID NO: 555427 - DNA, 14 bp, Homo sapiens
acctgggccctggt

SEQ ID NO: 555428 - DNA, 22 bp, Homo sapiens
acctggttccggaatcctgtcc

SEQ ID NO: 555429 - DNA, 14 bp, Homo sapiens
acctgtacacacac

SEQ ID NO: 555430 - DNA, 20 bp, Homo sapiens
acctgtacacacacagacac

SEQ ID NO: 555431 - DNA, 15 bp, Homo sapiens
acctgtactggagag

SEQ ID NO: 555432 - DNA, 19 bp, Homo sapiens
acctgtctgctccagctct

SEQ ID NO: 555433 - DNA, 20 bp, Homo sapiens
acctgtctgctccagctctg

SEQ ID NO: 555434 - DNA, 15 bp, Homo sapiens
acctgtcttttggga

SEQ ID NO: 555435 - DNA, 15 bp, Homo sapiens
accttaaaatttgaa

SEQ ID NO: 555436 - DNA, 17 bp, Homo sapiens
accttaaaatttgaaac

SEQ ID NO: 555437 - DNA, 16 bp, Homo sapiens
accttaccaagttggt

SEQ ID NO: 555438 - DNA, 19 bp, Homo sapiens
accttcactctaagatgtt

SEQ ID NO: 555439 - DNA, 19 bp, Homo sapiens
accttcagtttttgtgttt

SEQ ID NO: 555440 - DNA, 14 bp, Homo sapiens
accttcatccagat

SEQ ID NO: 555441 - DNA, 19 bp, Homo sapiens
accttctgatgaagttgta

SEQ ID NO: 555442 - DNA, 16 bp, Homo sapiens
accttctgtcgtcccc

SEQ ID NO: 555443 - DNA, 17 bp, Homo sapiens
accttgacgtttcttct

SEQ ID NO: 555444 - DNA, 21 bp, Homo sapiens
accttgcattttagctaattt

SEQ ID NO: 555445 - DNA, 23 bp, Homo sapiens
accttggcgcgcagcccgggaga

SEQ ID NO: 555446 - DNA, 15 bp, Homo sapiens
accttgtaatgtaac

SEQ ID NO: 555447 - DNA, 22 bp, Homo sapiens
accttgtaatgtaactgctctt

SEQ ID NO: 555448 - DNA, 19 bp, Homo sapiens
acctttataggataactga

SEQ ID NO: 555449 - DNA, 12 bp, Homo sapiens
acctttggaatt

SEQ ID NO: 555450 - DNA, 19 bp, Homo sapiens
acctttgggttctttctgg

SEQ ID NO: 555451 - DNA, 11 bp, Homo sapiens
accttttctct

SEQ ID NO: 555452 - DNA, 21 bp, Homo sapiens
acgcaattgtatatatatgtg

SEQ ID NO: 555453 - DNA, 23 bp, Homo sapiens
acgcaattgtatatatatgtgaa

SEQ ID NO: 555454 - DNA, 14 bp, Homo sapiens
acgcacacacacaa

SEQ ID NO: 555455 - DNA, 22 bp, Homo sapiens
acgcacccacaccctacagcag

SEQ ID NO: 555456 - DNA, 23 bp, Homo sapiens
acgcacccacaccctacagcaga

SEQ ID NO: 555457 - DNA, 11 bp, Homo sapiens
acgcacgcaca

SEQ ID NO: 555458 - DNA, 13 bp, Homo sapiens
acgcacgcaccca

SEQ ID NO: 555459 - DNA, 15 bp, Homo sapiens
acgcacgcacccaca

SEQ ID NO: 555460 - DNA, 12 bp, Homo sapiens
acgcagatgagt

SEQ ID NO: 555461 - DNA, 16 bp, Homo sapiens
acgcagggagaccctg

SEQ ID NO: 555462 - DNA, 11 bp, Homo sapiens
acgctctgctg

SEQ ID NO: 555463 - DNA, 21 bp, Homo sapiens
acggagcggattgcaaagcaa

SEQ ID NO: 555464 - DNA, 20 bp, Homo sapiens
acggccccagcttctcagct

SEQ ID NO: 555465 - DNA, 13 bp, Homo sapiens
acggcctcctttc

SEQ ID NO: 555466 - DNA, 13 bp, Homo sapiens
acggcctctgggg

SEQ ID NO: 555467 - DNA, 14 bp, Homo sapiens
agacctgggccctg

SEQ ID NO: 555468 - DNA, 19 bp, Homo sapiens
agacgcctgcttttgcaaa

SEQ ID NO: 555469 - DNA, 14 bp, Homo sapiens
agactatatacatg

SEQ ID NO: 555470 - DNA, 21 bp, Homo sapiens
agactcaaggcctccagccac

SEQ ID NO: 555471 - DNA, 20 bp, Homo sapiens
agactggcctgaaccacagg

SEQ ID NO: 555472 - DNA, 14 bp, Homo sapiens
agactgtaaattcc

SEQ ID NO: 555473 - DNA, 15 bp, Homo sapiens
agactgtaaattcca

SEQ ID NO: 555474 - DNA, 19 bp, Homo sapiens
agactgtaaattccaaaga

SEQ ID NO: 555475 - DNA, 15 bp, Homo sapiens
agacttctgttttca

SEQ ID NO: 555476 - DNA, 14 bp, Homo sapiens
agagaaatctgaaa

SEQ ID NO: 555477 - DNA, 12 bp, Homo sapiens
agagaaatgaaa

SEQ ID NO: 555478 - DNA, 13 bp, Homo sapiens
agagaaatggcaa

SEQ ID NO: 555479 - DNA, 17 bp, Homo sapiens
agagagcttagcctgga

SEQ ID NO: 555480 - DNA, 18 bp, Homo sapiens
agagaggacgtgggcggc

SEQ ID NO: 555481 - DNA, 18 bp, Homo sapiens
agagaggctaaaatgttt

SEQ ID NO: 555482 - DNA, 15 bp, Homo sapiens
agagagggcatagga

SEQ ID NO: 555483 - DNA, 23 bp, Homo sapiens
agagagggtgagtcctccagaac

SEQ ID NO: 555484 - DNA, 13 bp, Homo sapiens
agagatattggaa

SEQ ID NO: 555485 - DNA, 16 bp, Homo sapiens
agagatccaggaagca

SEQ ID NO: 555486 - DNA, 14 bp, Homo sapiens
agagatgtgtaatt

SEQ ID NO: 555487 - DNA, 13 bp, Homo sapiens
agagatttatctt

SEQ ID NO: 555488 - DNA, 14 bp, Homo sapiens
agagattttatgtt

SEQ ID NO: 555489 - DNA, 18 bp, Homo sapiens
agagcaaaagcctcagaa

SEQ ID NO: 555490 - DNA, 15 bp, Homo sapiens
agagcacaaacttca

SEQ ID NO: 555491 - DNA, 20 bp, Homo sapiens
agagcagagaagtacaggtc

SEQ ID NO: 555492 - DNA, 12 bp, Homo sapiens
agagcagcaagg

SEQ ID NO: 555493 - DNA, 19 bp, Homo sapiens
agagcagttgagaggacac

SEQ ID NO: 555494 - DNA, 21 bp, Homo sapiens
agagcagttggccaagcagaa

SEQ ID NO: 555495 - DNA, 18 bp, Homo sapiens
agagcattccagtcaggc

SEQ ID NO: 555496 - DNA, 22 bp, Homo sapiens
agagcatttggtacacacttga

SEQ ID NO: 555497 - DNA, 22 bp, Homo sapiens
agagccattctggcactttaat

SEQ ID NO: 555498 - DNA, 17 bp, Homo sapiens
agagccgtaaaaactga

SEQ ID NO: 555499 - DNA, 13 bp, Homo sapiens
agagcctgcccca

SEQ ID NO: 555500 - DNA, 20 bp, Homo sapiens
agagcctggttgcccaggga

SEQ ID NO: 555501 - DNA, 15 bp, Homo sapiens
agagcgacagagcag

SEQ ID NO: 555502 - DNA, 17 bp, Homo sapiens
agagcgatgtgttcttt

SEQ ID NO: 555503 - DNA, 14 bp, Homo sapiens
agagctaggcaggg

SEQ ID NO: 555504 - DNA, 23 bp, Homo sapiens
agagctatggacagcattgccag

SEQ ID NO: 555505 - DNA, 16 bp, Homo sapiens
agagctcagcacagcc

SEQ ID NO: 555506 - DNA, 17 bp, Homo sapiens
agagctcagcacagcct

SEQ ID NO: 555507 - DNA, 11 bp, Homo sapiens
agagctcccag

SEQ ID NO: 555508 - DNA, 18 bp, Homo sapiens
agagctcccaggacgcag

SEQ ID NO: 555509 - DNA, 14 bp, Homo sapiens
agagctccccatgg

SEQ ID NO: 555510 - DNA, 12 bp, Homo sapiens
agagctgaacag

SEQ ID NO: 555511 - DNA, 15 bp, Homo sapiens
agagcttagcctgga

SEQ ID NO: 555512 - DNA, 17 bp, Homo sapiens
agaggaagagtgcaaaa

SEQ ID NO: 555513 - DNA, 23 bp, Homo sapiens
agaggacacctgtactggagagc

SEQ ID NO: 555514 - DNA, 14 bp, Homo sapiens
agaggacgtgggcg

SEQ ID NO: 555515 - DNA, 19 bp, Homo sapiens
agaggagggatagagacgc

SEQ ID NO: 555516 - DNA, 13 bp, Homo sapiens
agaggcagagacc

SEQ ID NO: 555517 - DNA, 21 bp, Homo sapiens
agaggcagagacctcctgatg

SEQ ID NO: 555518 - DNA, 22 bp, Homo sapiens
agaggcagttgcccagcctctt

SEQ ID NO: 555519 - DNA, 16 bp, Homo sapiens
agaggctaaaatgttt

SEQ ID NO: 555520 - DNA, 19 bp, Homo sapiens
agagggccatgcaattcat

SEQ ID NO: 555521 - DNA, 16 bp, Homo sapiens
agaggggcggggccag

SEQ ID NO: 555522 - DNA, 17 bp, Homo sapiens
agaggtgagggaggcct

SEQ ID NO: 555523 - DNA, 15 bp, Homo sapiens
agagtatggattgaa

SEQ ID NO: 555524 - DNA, 15 bp, Homo sapiens
agagtcaagctgatg

SEQ ID NO: 555525 - DNA, 17 bp, Homo sapiens
agagtgaaattcaattc

SEQ ID NO: 555526 - DNA, 12 bp, Homo sapiens
agagtgaagagt

SEQ ID NO: 555527 - DNA, 14 bp, Homo sapiens
agagtgaagagtga

SEQ ID NO: 555528 - DNA, 12 bp, Homo sapiens
agagttccttct

SEQ ID NO: 555529 - DNA, 23 bp, Homo sapiens
agagtttagctgtaacagttctt

SEQ ID NO: 555530 - DNA, 12 bp, Homo sapiens
agataaaatgta

SEQ ID NO: 555531 - DNA, 15 bp, Homo sapiens
agataagttggaaac

SEQ ID NO: 555532 - DNA, 16 bp, Homo sapiens
agataagttggaaaca

SEQ ID NO: 555533 - DNA, 12 bp, Homo sapiens
agataatggtaa

SEQ ID NO: 555534 - DNA, 15 bp, Homo sapiens
agataccattttgaa

SEQ ID NO: 555535 - DNA, 21 bp, Homo sapiens
agatacttggtcacagccagg

SEQ ID NO: 555536 - DNA, 22 bp, Homo sapiens
agatacttggtcacagccaggc

SEQ ID NO: 555537 - DNA, 15 bp, Homo sapiens
agatatatctgaaaa

SEQ ID NO: 555538 - DNA, 20 bp, Homo sapiens
agatatatctgaaaactgga

SEQ ID NO: 555539 - DNA, 21 bp, Homo sapiens
agatatgagaaatataaaaat

SEQ ID NO: 555540 - DNA, 16 bp, Homo sapiens
agatcaaaataaaaag

SEQ ID NO: 555541 - DNA, 16 bp, Homo sapiens
agatcactgaactttt

SEQ ID NO: 555542 - DNA, 18 bp, Homo sapiens
agatcactgaacttttca

SEQ ID NO: 555543 - DNA, 21 bp, Homo sapiens
agatcactgaacttttcaaaa

SEQ ID NO: 555544 - DNA, 23 bp, Homo sapiens
agatccatcggtttatactattt

SEQ ID NO: 555545 - DNA, 21 bp, Homo sapiens
agatccgccctgggctctggg

SEQ ID NO: 555546 - DNA, 13 bp, Homo sapiens
agatcctggagtg

SEQ ID NO: 555547 - DNA, 18 bp, Homo sapiens
agatcggttaacaaataa

SEQ ID NO: 555548 - DNA, 17 bp, Homo sapiens
agatctcctgtgcacct

SEQ ID NO: 555549 - DNA, 14 bp, Homo sapiens
agatcttcttttgg

SEQ ID NO: 555550 - DNA, 20 bp, Homo sapiens
agatgaaagctgtttcattt

SEQ ID NO: 555551 - DNA, 14 bp, Homo sapiens
agatgacccctccc

SEQ ID NO: 555552 - DNA, 23 bp, Homo sapiens
agatgacccctgcccagatcagc

SEQ ID NO: 555553 - DNA, 15 bp, Homo sapiens
agatgaccttttgga

SEQ ID NO: 555554 - DNA, 15 bp, Homo sapiens
agatgaggctggata

SEQ ID NO: 555555 - DNA, 22 bp, Homo sapiens
agatgaggctggataggagagg

SEQ ID NO: 555556 - DNA, 18 bp, Homo sapiens
agatgatccttgcacaga

SEQ ID NO: 555557 - DNA, 21 bp, Homo sapiens
agatgattctggctgaaaaag

SEQ ID NO: 555558 - DNA, 22 bp, Homo sapiens
agatgcactatatgtttacaca

SEQ ID NO: 555559 - DNA, 14 bp, Homo sapiens
agatgcagctcttc

SEQ ID NO: 555560 - DNA, 16 bp, Homo sapiens
agatgccattcataga

SEQ ID NO: 555561 - DNA, 17 bp, Homo sapiens
agatggatatgaccagt

SEQ ID NO: 555562 - DNA, 16 bp, Homo sapiens
agatggcacagggcat

SEQ ID NO: 555563 - DNA, 22 bp, Homo sapiens
agatggcacagggcatgaaatg

SEQ ID NO: 555564 - DNA, 19 bp, Homo sapiens
aaagctgtttcatttgtgt

SEQ ID NO: 555565 - DNA, 20 bp, Homo sapiens
aaagcttccctccctgctgt

SEQ ID NO: 555566 - DNA, 21 bp, Homo sapiens
aaaggagctttctcaatgtct

SEQ ID NO: 555567 - DNA, 16 bp, Homo sapiens
aaaggatgatttaaca

SEQ ID NO: 555568 - DNA, 14 bp, Homo sapiens
aaaggcctctgtcc

SEQ ID NO: 555569 - DNA, 16 bp, Homo sapiens
aaaggcttcttggctt

SEQ ID NO: 555570 - DNA, 19 bp, Homo sapiens
aaaggcttgagtctggata

SEQ ID NO: 555571 - DNA, 19 bp, Homo sapiens
aaaggtttcactgttcatg

SEQ ID NO: 555572 - DNA, 22 bp, Homo sapiens
aaaggtttcactgttcatgaat

SEQ ID NO: 555573 - DNA, 16 bp, Homo sapiens
aaagtacaggtacttt

SEQ ID NO: 555574 - DNA, 16 bp, Homo sapiens
aaagtaccacactgag

SEQ ID NO: 555575 - DNA, 21 bp, Homo sapiens
aaagtactgagcagtgatatt

SEQ ID NO: 555576 - DNA, 20 bp, Homo sapiens
aaagtatcgggggctggggc

SEQ ID NO: 555577 - DNA, 17 bp, Homo sapiens
aaagtcatgatgttttt

SEQ ID NO: 555578 - DNA, 18 bp, Homo sapiens
aaagtcatgatgttttta

SEQ ID NO: 555579 - DNA, 21 bp, Homo sapiens
aaagtcatgatgtttttaaaa

SEQ ID NO: 555580 - DNA, 18 bp, Homo sapiens
aaagtcttgaatgttgaa

SEQ ID NO: 555581 - DNA, 16 bp, Homo sapiens
aaagtcttttaaaaag

SEQ ID NO: 555582 - DNA, 21 bp, Homo sapiens
aaagtcttttaaaaagtattg

SEQ ID NO: 555583 - DNA, 18 bp, Homo sapiens
aaagtggcacctgtctgc

SEQ ID NO: 555584 - DNA, 15 bp, Homo sapiens
aaagtgtaataatat

SEQ ID NO: 555585 - DNA, 18 bp, Homo sapiens
aaagtgtctcaaaggagc

SEQ ID NO: 555586 - DNA, 16 bp, Homo sapiens
aaagtgttctgttaca

SEQ ID NO: 555587 - DNA, 20 bp, Homo sapiens
aaagttaaacgtgatgtgct

SEQ ID NO: 555588 - DNA, 15 bp, Homo sapiens
aaagttggtatttta

SEQ ID NO: 555589 - DNA, 19 bp, Homo sapiens
aaagttggtattttataag

SEQ ID NO: 555590 - DNA, 21 bp, Homo sapiens
aaagttggtattttataagca

SEQ ID NO: 555591 - DNA, 20 bp, Homo sapiens
aaagtttcaaaaatctgaag

SEQ ID NO: 555592 - DNA, 24 bp, Homo sapiens
aaagtttgatcttcctctgctaaa

SEQ ID NO: 555593 - DNA, 18 bp, Homo sapiens
aaataaaaaaagaaaaaa

SEQ ID NO: 555594 - DNA, 20 bp, Homo sapiens
aaataaaaagtgacacagca

SEQ ID NO: 555595 - DNA, 14 bp, Homo sapiens
aaataaaaccagaa

SEQ ID NO: 555596 - DNA, 14 bp, Homo sapiens
aaataaaagaaaga

SEQ ID NO: 555597 - DNA, 20 bp, Homo sapiens
aaataaaagaaatgcacaat

SEQ ID NO: 555598 - DNA, 22 bp, Homo sapiens
aaataaaccaaaggacattatg

SEQ ID NO: 555599 - DNA, 18 bp, Homo sapiens
aaataaagcttttgcata

SEQ ID NO: 555600 - DNA, 18 bp, Homo sapiens
aaataaagtctgtcatgc

SEQ ID NO: 555601 - DNA, 15 bp, Homo sapiens
aaataaatacaagtt

SEQ ID NO: 555602 - DNA, 12 bp, Homo sapiens
aaataaatatca

SEQ ID NO: 555603 - DNA, 20 bp, Homo sapiens
aaataacaacttttttttct

SEQ ID NO: 555604 - DNA, 19 bp, Homo sapiens
aaataaccctgaatcagag

SEQ ID NO: 555605 - DNA, 13 bp, Homo sapiens
aaataattaaaac

SEQ ID NO: 555606 - DNA, 18 bp, Homo sapiens
aaatacaagtttgaacag

SEQ ID NO: 555607 - DNA, 13 bp, Homo sapiens
aaatacacataca

SEQ ID NO: 555608 - DNA, 16 bp, Homo sapiens
aaatacacatacatat

SEQ ID NO: 555609 - DNA, 15 bp, Homo sapiens
aaatacacgtgtata

SEQ ID NO: 555610 - DNA, 17 bp, Homo sapiens
aaatacacgtgtatatg

SEQ ID NO: 555611 - DNA, 18 bp, Homo sapiens
aaatacacgtgtatatga

SEQ ID NO: 555612 - DNA, 14 bp, Homo sapiens
aaatacatgatgat

SEQ ID NO: 555613 - DNA, 14 bp, Homo sapiens
aaatactgtagata

SEQ ID NO: 555614 - DNA, 16 bp, Homo sapiens
aaatactgtagataat

SEQ ID NO: 555615 - DNA, 20 bp, Homo sapiens
aaatactgtagataattaac

SEQ ID NO: 555616 - DNA, 12 bp, Homo sapiens
aaatactttgtc

SEQ ID NO: 555617 - DNA, 13 bp, Homo sapiens
aaatagctataaa

SEQ ID NO: 555618 - DNA, 13 bp, Homo sapiens
aaatagtaggcaa

SEQ ID NO: 555619 - DNA, 18 bp, Homo sapiens
aaatagtgtgtccatgca

SEQ ID NO: 555620 - DNA, 14 bp, Homo sapiens
aaatagttcccttt

SEQ ID NO: 555621 - DNA, 12 bp, Homo sapiens
aaatataaaaat

SEQ ID NO: 555622 - DNA, 20 bp, Homo sapiens
aaatataaagcatctaaact

SEQ ID NO: 555623 - DNA, 10 bp, Homo sapiens
aaatatagcg

SEQ ID NO: 555624 - DNA, 14 bp, Homo sapiens
aaatatatatacat

SEQ ID NO: 555625 - DNA, 13 bp, Homo sapiens
aaatatgcactaa

SEQ ID NO: 555626 - DNA, 21 bp, Homo sapiens
aaatatgcactaagtctcttt

SEQ ID NO: 555627 - DNA, 12 bp, Homo sapiens
aaatatgtaaac

SEQ ID NO: 555628 - DNA, 22 bp, Homo sapiens
aaatattaaaaagtcttttaaa

SEQ ID NO: 555629 - DNA, 14 bp, Homo sapiens
aaatattagcaaag

SEQ ID NO: 555630 - DNA, 17 bp, Homo sapiens
aaatattatgttatgaa

SEQ ID NO: 555631 - DNA, 16 bp, Homo sapiens
aaatattttctacttt

SEQ ID NO: 555632 - DNA, 20 bp, Homo sapiens
aaatattttgtcactgctgt

SEQ ID NO: 555633 - DNA, 21 bp, Homo sapiens
aaatatttttttttctttcag

SEQ ID NO: 555634 - DNA, 17 bp, Homo sapiens
aaatcaagaccaaagag

SEQ ID NO: 555635 - DNA, 17 bp, Homo sapiens
aaatcagtttttgttct

SEQ ID NO: 555636 - DNA, 23 bp, Homo sapiens
aaatcctgggcatccccagcccc

SEQ ID NO: 555637 - DNA, 15 bp, Homo sapiens
aaatctatagaaagt

SEQ ID NO: 555638 - DNA, 11 bp, Homo sapiens
aaatctcatac

SEQ ID NO: 555639 - DNA, 18 bp, Homo sapiens
aaatctgaagattgttta

SEQ ID NO: 555640 - DNA, 20 bp, Homo sapiens
aaatctgaagattgtttatc

SEQ ID NO: 555641 - DNA, 14 bp, Homo sapiens
aaatctgtctgctg

SEQ ID NO: 555642 - DNA, 22 bp, Homo sapiens
aaatcttattaaagtttcaaaa

SEQ ID NO: 555643 - DNA, 12 bp, Homo sapiens
aaatgaaatgtt

SEQ ID NO: 555644 - DNA, 21 bp, Homo sapiens
aaatgaaatgttttaaggctt

SEQ ID NO: 555645 - DNA, 13 bp, Homo sapiens
aaatgaacacaaa

SEQ ID NO: 555646 - DNA, 15 bp, Homo sapiens
aaatgaacacaaatt

SEQ ID NO: 555647 - DNA, 19 bp, Homo sapiens
aaatgatatgtctttaaaa

SEQ ID NO: 555648 - DNA, 13 bp, Homo sapiens
aaatgattcactt

SEQ ID NO: 555649 - DNA, 16 bp, Homo sapiens
aaatgattgcttttaa

SEQ ID NO: 555650 - DNA, 17 bp, Homo sapiens
aaatgattgcttttaaa

SEQ ID NO: 555651 - DNA, 20 bp, Homo sapiens
aaatgattgcttttaaaatt

SEQ ID NO: 555652 - DNA, 22 bp, Homo sapiens
aaatgattgcttttaaaatttt

SEQ ID NO: 555653 - DNA, 16 bp, Homo sapiens
aaatgattgtcttttt

SEQ ID NO: 555654 - DNA, 18 bp, Homo sapiens
aaatgattgtctttttcc

SEQ ID NO: 555655 - DNA, 16 bp, Homo sapiens
aaatgcatttaagttg

SEQ ID NO: 555656 - DNA, 20 bp, Homo sapiens
aaatgcatttaagttgtaaa

SEQ ID NO: 555657 - DNA, 22 bp, Homo sapiens
aaatgcatttaagttgtaaacg

SEQ ID NO: 555658 - DNA, 15 bp, Homo sapiens
aaatgcctaataaac

SEQ ID NO: 555659 - DNA, 17 bp, Homo sapiens
aaatgctatgtcatttc

SEQ ID NO: 555660 - DNA, 19 bp, Homo sapiens
aaatgctatgtcatttcat

SEQ ID NO: 555661 - DNA, 21 bp, Homo sapiens
aaatgctgatttaaacttctt

SEQ ID NO: 555662 - DNA, 19 bp, Homo sapiens
aaatggactacagtagctc

SEQ ID NO: 555663 - DNA, 23 bp, Homo sapiens
aaatggagttggagttcattcat

SEQ ID NO: 555664 - DNA, 20 bp, Homo sapiens
aaatggcaacaaactgcaca

SEQ ID NO: 555665 - DNA, 16 bp, Homo sapiens
aaatggcatttagcac

SEQ ID NO: 555666 - DNA, 11 bp, Homo sapiens
aaatgtaactg

SEQ ID NO: 555667 - DNA, 14 bp, Homo sapiens
aaatgtaactgtta

SEQ ID NO: 555668 - DNA, 18 bp, Homo sapiens
aaatgtaactgttaccat

SEQ ID NO: 555669 - DNA, 11 bp, Homo sapiens
aaatgtacatc

SEQ ID NO: 555670 - DNA, 13 bp, Homo sapiens
aaatgtagttcat

SEQ ID NO: 555671 - DNA, 14 bp, Homo sapiens
aaatgtatatacac

SEQ ID NO: 555672 - DNA, 22 bp, Homo sapiens
aaatgtatatacacatatacct

SEQ ID NO: 555673 - DNA, 21 bp, Homo sapiens
aaatgtatgttggtttagcgt

SEQ ID NO: 555674 - DNA, 17 bp, Homo sapiens
aaatgtcactgttataa

SEQ ID NO: 555675 - DNA, 19 bp, Homo sapiens
aaatgtcactgttataaat

SEQ ID NO: 555676 - DNA, 14 bp, Homo sapiens
aaatgtctactgaa

SEQ ID NO: 555677 - DNA, 21 bp, Homo sapiens
aacgaaagctgggcaacatgc

SEQ ID NO: 555678 - DNA, 17 bp, Homo sapiens
aacgacaaatctgtctg

SEQ ID NO: 555679 - DNA, 18 bp, Homo sapiens
aacgacaaatctgtctgc

SEQ ID NO: 555680 - DNA, 21 bp, Homo sapiens
aacgagccttttcacccttct

SEQ ID NO: 555681 - DNA, 21 bp, Homo sapiens
aacgatagcctagctttctaa

SEQ ID NO: 555682 - DNA, 17 bp, Homo sapiens
aacgatcatatctgtat

SEQ ID NO: 555683 - DNA, 15 bp, Homo sapiens
aacgatttaatttat

SEQ ID NO: 555684 - DNA, 14 bp, Homo sapiens
aacggccccagctt

SEQ ID NO: 555685 - DNA, 21 bp, Homo sapiens
aacgtctttttaagcctttga

SEQ ID NO: 555686 - DNA, 18 bp, Homo sapiens
aacgtggggcagcacaga

SEQ ID NO: 555687 - DNA, 22 bp, Homo sapiens
aacgtgtatgtttttcagttca

SEQ ID NO: 555688 - DNA, 18 bp, Homo sapiens
aactaagcagtccctgag

SEQ ID NO: 555689 - DNA, 23 bp, Homo sapiens
aactaagcagtccctgagaccat

SEQ ID NO: 555690 - DNA, 16 bp, Homo sapiens
aactaattaaactgat

SEQ ID NO: 555691 - DNA, 15 bp, Homo sapiens
aactactgaataaat

SEQ ID NO: 555692 - DNA, 12 bp, Homo sapiens
aactcatacagt

SEQ ID NO: 555693 - DNA, 12 bp, Homo sapiens
aactccttacag

SEQ ID NO: 555694 - DNA, 13 bp, Homo sapiens
aactctgatgtaa

SEQ ID NO: 555695 - DNA, 21 bp, Homo sapiens
aactctgatgtaaatgaagta

SEQ ID NO: 555696 - DNA, 13 bp, Homo sapiens
aactgaagagaca

SEQ ID NO: 555697 - DNA, 13 bp, Homo sapiens
aactgaagcagag

SEQ ID NO: 555698 - DNA, 15 bp, Homo sapiens
aactgaagcagagtc

SEQ ID NO: 555699 - DNA, 18 bp, Homo sapiens
aactgatggcaatattaa

SEQ ID NO: 555700 - DNA, 20 bp, Homo sapiens
aactgcacatgatttcacaa

SEQ ID NO: 555701 - DNA, 21 bp, Homo sapiens
aactgcacatgatttcacaaa

SEQ ID NO: 555702 - DNA, 18 bp, Homo sapiens
aactgccattttttgtct

SEQ ID NO: 555703 - DNA, 17 bp, Homo sapiens
aactgccttaaaacttt

SEQ ID NO: 555704 - DNA, 13 bp, Homo sapiens
aactgctcctcct

SEQ ID NO: 555705 - DNA, 14 bp, Homo sapiens
aactggaataagaa

SEQ ID NO: 555706 - DNA, 13 bp, Homo sapiens
aactgtactttga

SEQ ID NO: 555707 - DNA, 15 bp, Homo sapiens
aactgtactttgatt

SEQ ID NO: 555708 - DNA, 20 bp, Homo sapiens
aactgtactttgattcacat

SEQ ID NO: 555709 - DNA, 22 bp, Homo sapiens
aactgtactttgattcacatgt

SEQ ID NO: 555710 - DNA, 11 bp, Homo sapiens
aactgtattta

SEQ ID NO: 555711 - DNA, 14 bp, Homo sapiens
aactgttaccattg

SEQ ID NO: 555712 - DNA, 18 bp, Homo sapiens
aactgttaccattggaaa

SEQ ID NO: 555713 - DNA, 19 bp, Homo sapiens
aacttacaagactgtaaat

SEQ ID NO: 555714 - DNA, 20 bp, Homo sapiens
aacttactatggtatatatt

SEQ ID NO: 555715 - DNA, 23 bp, Homo sapiens
aacttagtgtctctatttatgag

SEQ ID NO: 555716 - DNA, 22 bp, Homo sapiens
aacttccactttgtataaattt

SEQ ID NO: 555717 - DNA, 15 bp, Homo sapiens
aacttctaaaactgt

SEQ ID NO: 555718 - DNA, 18 bp, Homo sapiens
aacttgaagcctgctcct

SEQ ID NO: 555719 - DNA, 14 bp, Homo sapiens
aacttgcttaaatg

SEQ ID NO: 555720 - DNA, 16 bp, Homo sapiens
aacttgcttaaatgtg

SEQ ID NO: 555721 - DNA, 17 bp, Homo sapiens
aacttgcttaaatgtga

SEQ ID NO: 555722 - DNA, 19 bp, Homo sapiens
aacttgcttaaatgtgaat

SEQ ID NO: 555723 - DNA, 20 bp, Homo sapiens
aacttgcttaaatgtgaatt

SEQ ID NO: 555724 - DNA, 12 bp, Homo sapiens
aacttgtcttaa

SEQ ID NO: 555725 - DNA, 16 bp, Homo sapiens
aacttgtttaataaag

SEQ ID NO: 555726 - DNA, 19 bp, Homo sapiens
aactttaatatgtatttta

SEQ ID NO: 555727 - DNA, 16 bp, Homo sapiens
aactttctcagcatat

SEQ ID NO: 555728 - DNA, 20 bp, Homo sapiens
gggtcggcgccttctacctg

SEQ ID NO: 555729 - DNA, 14 bp, Homo sapiens
gggtcttaggatgt

SEQ ID NO: 555730 - DNA, 20 bp, Homo sapiens
gggtcttcagggggccaggt

SEQ ID NO: 555731 - DNA, 11 bp, Homo sapiens
gggtcttccta

SEQ ID NO: 555732 - DNA, 18 bp, Homo sapiens
gggtgagtcctccagaac

SEQ ID NO: 555733 - DNA, 16 bp, Homo sapiens
gggtgccccccatgcc

SEQ ID NO: 555734 - DNA, 15 bp, Homo sapiens
gggtggaggagagcc

SEQ ID NO: 555735 - DNA, 20 bp, Homo sapiens
gggtggcatcattccaggcc

SEQ ID NO: 555736 - DNA, 13 bp, Homo sapiens
gggtgggacacag

SEQ ID NO: 555737 - DNA, 16 bp, Homo sapiens
gggtgggacacagaga

SEQ ID NO: 555738 - DNA, 11 bp, Homo sapiens
gggtggggatg

SEQ ID NO: 555739 - DNA, 16 bp, Homo sapiens
gggtttccacacaggc

SEQ ID NO: 555740 - DNA, 17 bp, Homo sapiens
gggtttccacacaggcc

SEQ ID NO: 555741 - DNA, 18 bp, Homo sapiens
gggtttccacacaggccc

SEQ ID NO: 555742 - DNA, 21 bp, Homo sapiens
ggtaaactgatgctttcagat

SEQ ID NO: 555743 - DNA, 17 bp, Homo sapiens
ggtaacttgctgtgaaa

SEQ ID NO: 555744 - DNA, 12 bp, Homo sapiens
ggtaagaaaaag

SEQ ID NO: 555745 - DNA, 15 bp, Homo sapiens
ggtaatcatattaga

SEQ ID NO: 555746 - DNA, 16 bp, Homo sapiens
ggtaccaaaaaagaaa

SEQ ID NO: 555747 - DNA, 13 bp, Homo sapiens
ggtaccactgaat

SEQ ID NO: 555748 - DNA, 20 bp, Homo sapiens
ggtaccactgaatctgtaca

SEQ ID NO: 555749 - DNA, 21 bp, Homo sapiens
ggtacttctgtgttgtgattc

SEQ ID NO: 555750 - DNA, 18 bp, Homo sapiens
ggtagtagaatctcagca

SEQ ID NO: 555751 - DNA, 16 bp, Homo sapiens
ggtatacctctaactg

SEQ ID NO: 555752 - DNA, 14 bp, Homo sapiens
ggtatccagaggtg

SEQ ID NO: 555753 - DNA, 20 bp, Homo sapiens
ggtatctgatgatgttctga

SEQ ID NO: 555754 - DNA, 12 bp, Homo sapiens
ggtatgatcatt

SEQ ID NO: 555755 - DNA, 15 bp, Homo sapiens
ggtcactgccatgga

SEQ ID NO: 555756 - DNA, 17 bp, Homo sapiens
ggtcagaagagagggtg

SEQ ID NO: 555757 - DNA, 17 bp, Homo sapiens
ggtcaggccgggcagag

SEQ ID NO: 555758 - DNA, 19 bp, Homo sapiens
ggtcagtgttataaaatct

SEQ ID NO: 555759 - DNA, 23 bp, Homo sapiens
ggtcatattcataccttctgatg

SEQ ID NO: 555760 - DNA, 22 bp, Homo sapiens
ggtcatcccggggccatggaag

SEQ ID NO: 555761 - DNA, 18 bp, Homo sapiens
ggtcatctgctgggatct

SEQ ID NO: 555762 - DNA, 20 bp, Homo sapiens
ggtcatttccatgtatgcat

SEQ ID NO: 555763 - DNA, 20 bp, Homo sapiens
ggtccacattctgctgcccc

SEQ ID NO: 555764 - DNA, 21 bp, Homo sapiens
ggtccaggagatgaggctgga

SEQ ID NO: 555765 - DNA, 19 bp, Homo sapiens
ggtccccagcccttcctct

SEQ ID NO: 555766 - DNA, 22 bp, Homo sapiens
ggtccccagcccttcctctgct

SEQ ID NO: 555767 - DNA, 21 bp, Homo sapiens
gccttttgttcatttcatcct

SEQ ID NO: 555768 - DNA, 11 bp, Homo sapiens
gcgaacacagt

SEQ ID NO: 555769 - DNA, 13 bp, Homo sapiens
gcgacagagcagt

SEQ ID NO: 555770 - DNA, 12 bp, Homo sapiens
gcgcacccggca

SEQ ID NO: 555771 - DNA, 22 bp, Homo sapiens
gcgcagctgcatttggggtggg

SEQ ID NO: 555772 - DNA, 11 bp, Homo sapiens
gcgcaggccct

SEQ ID NO: 555773 - DNA, 15 bp, Homo sapiens
gcgctaacttgctta

SEQ ID NO: 555774 - DNA, 21 bp, Homo sapiens
gcgctagcacagctcccttct

SEQ ID NO: 555775 - DNA, 17 bp, Homo sapiens
gcgcttttgctggtcac

SEQ ID NO: 555776 - DNA, 12 bp, Homo sapiens
gcgtaggagaga

SEQ ID NO: 555777 - DNA, 20 bp, Homo sapiens
gcgtagggccagggctctgg

SEQ ID NO: 555778 - DNA, 19 bp, Homo sapiens
gcgtagtgcagcagggcag

SEQ ID NO: 555779 - DNA, 14 bp, Homo sapiens
gcgtcatctggtcc

SEQ ID NO: 555780 - DNA, 19 bp, Homo sapiens
gcgtccctgagggcccttc

SEQ ID NO: 555781 - DNA, 13 bp, Homo sapiens
gcgtgaaacacaa

SEQ ID NO: 555782 - DNA, 17 bp, Homo sapiens
gcgtggcaaatataaaa

SEQ ID NO: 555783 - DNA, 15 bp, Homo sapiens
gctaaaatgttttca

SEQ ID NO: 555784 - DNA, 16 bp, Homo sapiens
gctaaaatgttttcag

SEQ ID NO: 555785 - DNA, 18 bp, Homo sapiens
gctaaacgtgtatgtttt

SEQ ID NO: 555786 - DNA, 19 bp, Homo sapiens
gctaaacgtgtatgttttt

SEQ ID NO: 555787 - DNA, 18 bp, Homo sapiens
gctaaatgcctaataaac

SEQ ID NO: 555788 - DNA, 19 bp, Homo sapiens
gctaaatgcctaataaaca

SEQ ID NO: 555789 - DNA, 17 bp, Homo sapiens
gctaaattgatgttgat

SEQ ID NO: 555790 - DNA, 21 bp, Homo sapiens
gctaaattgatgttgatgcaa

SEQ ID NO: 555791 - DNA, 14 bp, Homo sapiens
gctaagaatttttt

SEQ ID NO: 555792 - DNA, 15 bp, Homo sapiens
gctaagagcctctgg

SEQ ID NO: 555793 - DNA, 22 bp, Homo sapiens
gctaagataattaaatgaaata

SEQ ID NO: 555794 - DNA, 14 bp, Homo sapiens
gctaatacaggaaa

SEQ ID NO: 555795 - DNA, 16 bp, Homo sapiens
gctacaaaatgtgtgc

SEQ ID NO: 555796 - DNA, 16 bp, Homo sapiens
gctacaatttgttaat

SEQ ID NO: 555797 - DNA, 17 bp, Homo sapiens
gctacagtagctgtggg

SEQ ID NO: 555798 - DNA, 15 bp, Homo sapiens
gctacccaaaagaga

SEQ ID NO: 555799 - DNA, 16 bp, Homo sapiens
gctacccaaaagagaa

SEQ ID NO: 555800 - DNA, 23 bp, Homo sapiens
gctacccaaaagagaaaaaaaat

SEQ ID NO: 555801 - DNA, 14 bp, Homo sapiens
gctactccggaggc

SEQ ID NO: 555802 - DNA, 16 bp, Homo sapiens
gctacttaagagaaat

SEQ ID NO: 555803 - DNA, 21 bp, Homo sapiens
gctacttcctgcctggtctcc

SEQ ID NO: 555804 - DNA, 14 bp, Homo sapiens
gctaggaacaaatc

SEQ ID NO: 555805 - DNA, 14 bp, Homo sapiens
gctataaaagccca

SEQ ID NO: 555806 - DNA, 21 bp, Homo sapiens
gctatatttaagtattcaaga

SEQ ID NO: 555807 - DNA, 22 bp, Homo sapiens
gctatatttaagtattcaagaa

SEQ ID NO: 555808 - DNA, 14 bp, Homo sapiens
gctatggacaattt

SEQ ID NO: 555809 - DNA, 19 bp, Homo sapiens
gctatggacaatttaccac

SEQ ID NO: 555810 - DNA, 22 bp, Homo sapiens
gctatggacaatttaccacagg

SEQ ID NO: 555811 - DNA, 16 bp, Homo sapiens
gctatgtcatttcatg

SEQ ID NO: 555812 - DNA, 22 bp, Homo sapiens
tccttgaggggagccaggaggg

SEQ ID NO: 555813 - DNA, 13 bp, Homo sapiens
tccttgtcagttg

SEQ ID NO: 555814 - DNA, 20 bp, Homo sapiens
tccttgtctaaagatctttt

SEQ ID NO: 555815 - DNA, 21 bp, Homo sapiens
tccttgtcttggcagcctact

SEQ ID NO: 555816 - DNA, 21 bp, Homo sapiens
tccttgttgtttcttgcctga

SEQ ID NO: 555817 - DNA, 16 bp, Homo sapiens
tcctttaccctcatct

SEQ ID NO: 555818 - DNA, 15 bp, Homo sapiens
tcctttatgtattct

SEQ ID NO: 555819 - DNA, 15 bp, Homo sapiens
tcctttatgtgatgt

SEQ ID NO: 555820 - DNA, 13 bp, Homo sapiens
tccttttccagag

SEQ ID NO: 555821 - DNA, 16 bp, Homo sapiens
tccttttgtatcctcc

SEQ ID NO: 555822 - DNA, 15 bp, Homo sapiens
tcgaaaattcatttc

SEQ ID NO: 555823 - DNA, 21 bp, Homo sapiens
tcgaaaattcatttcacatta

SEQ ID NO: 555824 - DNA, 19 bp, Homo sapiens
tcgagctccccccaggtct

SEQ ID NO: 555825 - DNA, 15 bp, Homo sapiens
tcgaggacagcaatg

SEQ ID NO: 555826 - DNA, 19 bp, Homo sapiens
tcgccccattttctttaca

SEQ ID NO: 555827 - DNA, 17 bp, Homo sapiens
tcgcctcggatcagctg

SEQ ID NO: 555828 - DNA, 14 bp, Homo sapiens
tcgcctttcagcag

SEQ ID NO: 555829 - DNA, 14 bp, Homo sapiens
tcggatcagctgag

SEQ ID NO: 555830 - DNA, 19 bp, Homo sapiens
tcggatcagctgagccttc

SEQ ID NO: 555831 - DNA, 20 bp, Homo sapiens
tcggcgccttctacctgcag

SEQ ID NO: 555832 - DNA, 23 bp, Homo sapiens
tcgggaagaaggacttcctgcta

SEQ ID NO: 555833 - DNA, 15 bp, Homo sapiens
tcgggccccacctgc

SEQ ID NO: 555834 - DNA, 20 bp, Homo sapiens
tcgggctaagtccagctctc

SEQ ID NO: 555835 - DNA, 14 bp, Homo sapiens
tcggggcaggaagt

SEQ ID NO: 555836 - DNA, 20 bp, Homo sapiens
tcggttaacaaataacaact

SEQ ID NO: 555837 - DNA, 14 bp, Homo sapiens
tcggttcaggagga

SEQ ID NO: 555838 - DNA, 15 bp, Homo sapiens
tcgtattcaccttca

SEQ ID NO: 555839 - DNA, 13 bp, Homo sapiens
tcgtccccagacc

SEQ ID NO: 555840 - DNA, 22 bp, Homo sapiens
tcgtccccagaccagtagtgac

SEQ ID NO: 555841 - DNA, 18 bp, Homo sapiens
tcgtcgagctccccccag

SEQ ID NO: 555842 - DNA, 18 bp, Homo sapiens
tctaaaactgtactttga

SEQ ID NO: 555843 - DNA, 22 bp, Homo sapiens
tctaaaactgtactttgattca

SEQ ID NO: 555844 - DNA, 16 bp, Homo sapiens
tctaaactggtacaat

SEQ ID NO: 555845 - DNA, 19 bp, Homo sapiens
tctaaactggtacaatttt

SEQ ID NO: 555846 - DNA, 22 bp, Homo sapiens
tctaaagatctttttttaagtg

SEQ ID NO: 555847 - DNA, 21 bp, Homo sapiens
tctaaatctgtccaactgaga

SEQ ID NO: 555848 - DNA, 20 bp, Homo sapiens
tctaaccacagctccttttc

SEQ ID NO: 555849 - DNA, 22 bp, Homo sapiens
tctaaccacagctccttttcca

SEQ ID NO: 555850 - DNA, 20 bp, Homo sapiens
tctaactctgatgtaaatga

SEQ ID NO: 555851 - DNA, 14 bp, Homo sapiens
tctaagaaacattg

SEQ ID NO: 555852 - DNA, 18 bp, Homo sapiens
tctaagatgttatatttt

SEQ ID NO: 555853 - DNA, 14 bp, Homo sapiens
tctaagtgtttgct

SEQ ID NO: 555854 - DNA, 16 bp, Homo sapiens
tctaatccatgtgctg

SEQ ID NO: 555855 - DNA, 14 bp, Homo sapiens
tctaatggtaactt

SEQ ID NO: 555856 - DNA, 16 bp, Homo sapiens
tctaatggtaactttt

SEQ ID NO: 555857 - DNA, 16 bp, Homo sapiens
tctacaatacaacaca

SEQ ID NO: 555858 - DNA, 13 bp, Homo sapiens
tctacccctttct

SEQ ID NO: 555859 - DNA, 18 bp, Homo sapiens
tctacccctttcttctcg

SEQ ID NO: 555860 - DNA, 15 bp, Homo sapiens
tctacctgcaggact

SEQ ID NO: 555861 - DNA, 20 bp, Homo sapiens
tctactccatggtgaactga

SEQ ID NO: 555862 - DNA, 19 bp, Homo sapiens
tctactttaaattgtggat

SEQ ID NO: 555863 - DNA, 18 bp, Homo sapiens
tctagagcagttggccaa

SEQ ID NO: 555864 - DNA, 15 bp, Homo sapiens
tctagatatgagaaa

SEQ ID NO: 555865 - DNA, 11 bp, Homo sapiens
tctagatgtaa

SEQ ID NO: 555866 - DNA, 16 bp, Homo sapiens
tctagatgtaaatttt

SEQ ID NO: 555867 - DNA, 22 bp, Homo sapiens
tctaggacccccagtgctcaca

SEQ ID NO: 555868 - DNA, 15 bp, Homo sapiens
tctaggacctgtgtc

SEQ ID NO: 555869 - DNA, 16 bp, Homo sapiens
tctagttatttattct

SEQ ID NO: 555870 - DNA, 22 bp, Homo sapiens
tctatagaaagtgttctgttac

SEQ ID NO: 555871 - DNA, 24 bp, Homo sapiens
tctatagaaagtgttctgttacaa

SEQ ID NO: 555872 - DNA, 21 bp, Homo sapiens
tctatcagttatcctttgtga

SEQ ID NO: 555873 - DNA, 16 bp, Homo sapiens
tctgtcgtccccagac

SEQ ID NO: 555874 - DNA, 19 bp, Homo sapiens
tctgtcgtccccagaccag

SEQ ID NO: 555875 - DNA, 21 bp, Homo sapiens
tctgtctctcttttgctctct

SEQ ID NO: 555876 - DNA, 21 bp, Homo sapiens
tctgtgaaagtctcctgtatc

SEQ ID NO: 555877 - DNA, 20 bp, Homo sapiens
tctgtgaaggacttggtgat

SEQ ID NO: 555878 - DNA, 13 bp, Homo sapiens
tctgtgaatagca

SEQ ID NO: 555879 - DNA, 14 bp, Homo sapiens
tctgtgataacaga

SEQ ID NO: 555880 - DNA, 14 bp, Homo sapiens
tctgtggggccaca

SEQ ID NO: 555881 - DNA, 15 bp, Homo sapiens
tctgtggggccacac

SEQ ID NO: 555882 - DNA, 23 bp, Homo sapiens
tctgtgtagtagctcgtgtgctt

SEQ ID NO: 555883 - DNA, 12 bp, Homo sapiens
tctgttacaaaa

SEQ ID NO: 555884 - DNA, 16 bp, Homo sapiens
tctgttacaaaatgta

SEQ ID NO: 555885 - DNA, 23 bp, Homo sapiens
tctgttgggtggcatcattccag

SEQ ID NO: 555886 - DNA, 11 bp, Homo sapiens
tctgttgtaat

SEQ ID NO: 555887 - DNA, 13 bp, Homo sapiens
tctgttgttcact

SEQ ID NO: 555888 - DNA, 18 bp, Homo sapiens
tctgtttaaaatttgtgc

SEQ ID NO: 555889 - DNA, 13 bp, Homo sapiens
tcttaaaaagtaa

SEQ ID NO: 555890 - DNA, 14 bp, Homo sapiens
tcttaaaaatgcat

SEQ ID NO: 555891 - DNA, 17 bp, Homo sapiens
tcttaaaaatgcattta

SEQ ID NO: 555892 - DNA, 19 bp, Homo sapiens
tcttaaaaatgcatttaag

SEQ ID NO: 555893 - DNA, 13 bp, Homo sapiens
tcttaaaaattat

SEQ ID NO: 555894 - DNA, 14 bp, Homo sapiens
tcttaaaacactaa

SEQ ID NO: 555895 - DNA, 19 bp, Homo sapiens
tcttaaataaaagaaatgc

SEQ ID NO: 555896 - DNA, 19 bp, Homo sapiens
tcttaatataactgcctta

SEQ ID NO: 555897 - DNA, 15 bp, Homo sapiens
tcttaatgtctcaaa

SEQ ID NO: 555898 - DNA, 18 bp, Homo sapiens
tcttaatgtctcaaaata

SEQ ID NO: 555899 - DNA, 18 bp, Homo sapiens
tcttaattaagtaaacta

SEQ ID NO: 555900 - DNA, 14 bp, Homo sapiens
tcttacccaaagca

SEQ ID NO: 555901 - DNA, 15 bp, Homo sapiens
tcttaccgacaagca

SEQ ID NO: 555902 - DNA, 14 bp, Homo sapiens
tcttactgtatttg

SEQ ID NO: 555903 - DNA, 17 bp, Homo sapiens
tcttactgttttgtgcg

SEQ ID NO: 555904 - DNA, 18 bp, Homo sapiens
tcttactttgttaattta

SEQ ID NO: 555905 - DNA, 22 bp, Homo sapiens
tcttagctggatataatgtatt

SEQ ID NO: 555906 - DNA, 16 bp, Homo sapiens
tcttagcttttctgca

SEQ ID NO: 555907 - DNA, 22 bp, Homo sapiens
tcttagttaatctttgaaaact

SEQ ID NO: 555908 - DNA, 18 bp, Homo sapiens
tcttataacattgtatgt

SEQ ID NO: 555909 - DNA, 19 bp, Homo sapiens
tcttataacattgtatgtt

SEQ ID NO: 555910 - DNA, 22 bp, Homo sapiens
tcttatatagcagcaaaaatat

SEQ ID NO: 555911 - DNA, 17 bp, Homo sapiens
tcttatgcttccagaaa

SEQ ID NO: 555912 - DNA, 20 bp, Homo sapiens
tcttatgcttccagaaacac

SEQ ID NO: 555913 - DNA, 14 bp, Homo sapiens
tcttattaaagttt

SEQ ID NO: 555914 - DNA, 16 bp, Homo sapiens
tcttattaaagtttca

SEQ ID NO: 555915 - DNA, 19 bp, Homo sapiens
tcttattaaagtttcaaaa

SEQ ID NO: 555916 - DNA, 18 bp, Homo sapiens
tcttattccatattagaa

SEQ ID NO: 555917 - DNA, 19 bp, Homo sapiens
tcttattccatattagaaa

SEQ ID NO: 555918 - DNA, 14 bp, Homo sapiens
tcttcaacatgtgt

SEQ ID NO: 555919 - DNA, 15 bp, Homo sapiens
tcttcagggggccag

SEQ ID NO: 555920 - DNA, 13 bp, Homo sapiens
tcttcatgaaatg

SEQ ID NO: 555921 - DNA, 16 bp, Homo sapiens
tcttcatgttcccact

SEQ ID NO: 555922 - DNA, 19 bp, Homo sapiens
tcttcatgttcccacttca

SEQ ID NO: 555923 - DNA, 23 bp, Homo sapiens
tcttcatgttgatgtgtccgtga

SEQ ID NO: 555924 - DNA, 17 bp, Homo sapiens
tcttccaacatgtgatg

SEQ ID NO: 555925 - DNA, 18 bp, Homo sapiens
tcttccaacatgtgatgt

SEQ ID NO: 555926 - DNA, 24 bp, Homo sapiens
tcttccaacatgtgatgtgttgct

SEQ ID NO: 555927 - DNA, 14 bp, Homo sapiens
tcttcccccaccac

SEQ ID NO: 555928 - DNA, 22 bp, Homo sapiens
tcttcctactcttctctctgct

SEQ ID NO: 555929 - DNA, 17 bp, Homo sapiens
tcttcctccctgggggc

SEQ ID NO: 555930 - DNA, 16 bp, Homo sapiens
tcttcgtggattgttt

SEQ ID NO: 555931 - DNA, 15 bp, Homo sapiens
tcttctacttcttgt

SEQ ID NO: 555932 - DNA, 18 bp, Homo sapiens
tcttctcatcttttatct

SEQ ID NO: 555933 - DNA, 13 bp, Homo sapiens
tcttctcccccat

SEQ ID NO: 555934 - DNA, 21 bp, Homo sapiens
tcttctccccttccatttctg

SEQ ID NO: 555935 - DNA, 12 bp, Homo sapiens
tcttctgtccaa

SEQ ID NO: 555936 - DNA, 14 bp, Homo sapiens
tcttcttttgggag

SEQ ID NO: 555937 - DNA, 20 bp, Homo sapiens
tcttgacagagcctgcccca

SEQ ID NO: 555938 - DNA, 23 bp, Homo sapiens
tcttgagcagctgaattggctgc

SEQ ID NO: 555939 - DNA, 14 bp, Homo sapiens
tcttgcaatttgaa

SEQ ID NO: 555940 - DNA, 17 bp, Homo sapiens
tcttgcaatttgaaggt

SEQ ID NO: 555941 - DNA, 15 bp, Homo sapiens
tcttggtatgatcat

SEQ ID NO: 555942 - DNA, 21 bp, Homo sapiens
tcttggtcacaaagctattta

SEQ ID NO: 555943 - DNA, 15 bp, Homo sapiens
tctttagaaaaggca

SEQ ID NO: 555944 - DNA, 18 bp, Homo sapiens
tctttcaagggctttcct

SEQ ID NO: 555945 - DNA, 21 bp, Homo sapiens
tctttcaagggctttcctgtg

SEQ ID NO: 555946 - DNA, 15 bp, Homo sapiens
tctttccatttctct

SEQ ID NO: 555947 - DNA, 16 bp, Homo sapiens
tctttcccttcctcca

SEQ ID NO: 555948 - DNA, 17 bp, Homo sapiens
tctttcccttcctccat

SEQ ID NO: 555949 - DNA, 13 bp, Homo sapiens
tctttctagagca

SEQ ID NO: 555950 - DNA, 17 bp, Homo sapiens
tctttctccaaagttat

SEQ ID NO: 555951 - DNA, 23 bp, Homo sapiens
tctttctggggggatatttccta

SEQ ID NO: 555952 - DNA, 12 bp, Homo sapiens
tctttcttcctt

SEQ ID NO: 555953 - DNA, 15 bp, Homo sapiens
tctttcttcctttct

SEQ ID NO: 555954 - DNA, 16 bp, Homo sapiens
tctttcttcctttcta

SEQ ID NO: 555955 - DNA, 12 bp, Homo sapiens
tctttctttcca

SEQ ID NO: 555956 - DNA, 15 bp, Homo sapiens
tctttgaattttcat

SEQ ID NO: 555957 - DNA, 19 bp, Homo sapiens
tctttgaattttcatttta

SEQ ID NO: 555958 - DNA, 16 bp, Homo sapiens
tctttggaaatagcat

SEQ ID NO: 555959 - DNA, 17 bp, Homo sapiens
tctttggaaatagcatg

SEQ ID NO: 555960 - DNA, 23 bp, Homo sapiens
tctttgttttttgttttcattaa

SEQ ID NO: 555961 - DNA, 22 bp, Homo sapiens
tcttttataaaaaaaatgaaat

SEQ ID NO: 555962 - DNA, 13 bp, Homo sapiens
tcttttcctcgct

SEQ ID NO: 555963 - DNA, 19 bp, Homo sapiens
tcttttgggaggatttgat

SEQ ID NO: 555964 - DNA, 15 bp, Homo sapiens
tcttttttctgggtc

SEQ ID NO: 555965 - DNA, 22 bp, Homo sapiens
tctttttttaagtgttctgtgg

SEQ ID NO: 555966 - DNA, 21 bp, Homo sapiens
tgaaaacagaaattggtacct

SEQ ID NO: 555967 - DNA, 22 bp, Homo sapiens
tgaaaaccctcgatgttcatgg

SEQ ID NO: 555968 - DNA, 16 bp, Homo sapiens
tgaaaactaagttctc

SEQ ID NO: 555969 - DNA, 16 bp, Homo sapiens
tgaaaactcatcggga

SEQ ID NO: 555970 - DNA, 23 bp, Homo sapiens
tgaaaactggaataagaagcaaa

SEQ ID NO: 555971 - DNA, 17 bp, Homo sapiens
tgaaaagaaaaagaaga

SEQ ID NO: 555972 - DNA, 14 bp, Homo sapiens
tgaaaatgtcactg

SEQ ID NO: 555973 - DNA, 13 bp, Homo sapiens
tgaaaattcaaca

SEQ ID NO: 555974 - DNA, 17 bp, Homo sapiens
tgaaactgacttgctgt

SEQ ID NO: 555975 - DNA, 20 bp, Homo sapiens
tgaaactgtatttacttgtt

SEQ ID NO: 555976 - DNA, 15 bp, Homo sapiens
tgaaagacagtaaag

SEQ ID NO: 555977 - DNA, 22 bp, Homo sapiens
tgaaagcaacagctggacaccc

SEQ ID NO: 555978 - DNA, 11 bp, Homo sapiens
tgaaagcacag

SEQ ID NO: 555979 - DNA, 15 bp, Homo sapiens
tgaaagctgtttcat

SEQ ID NO: 555980 - DNA, 20 bp, Homo sapiens
tgaaagtctcctgtatcatt

SEQ ID NO: 555981 - DNA, 17 bp, Homo sapiens
tgaaagttgtgatctgt

SEQ ID NO: 555982 - DNA, 16 bp, Homo sapiens
tgaaatattttctact

SEQ ID NO: 555983 - DNA, 17 bp, Homo sapiens
tgaaatgctatgtcatt

SEQ ID NO: 555984 - DNA, 18 bp, Homo sapiens
tgaaatgctatgtcattt

SEQ ID NO: 555985 - DNA, 20 bp, Homo sapiens
tgaaatgctatgtcatttca

SEQ ID NO: 555986 - DNA, 21 bp, Homo sapiens
tgaaatggatagattgtttta

SEQ ID NO: 555987 - DNA, 17 bp, Homo sapiens
tgaaatgtgtgtgatgt

SEQ ID NO: 555988 - DNA, 20 bp, Homo sapiens
tgaaatgtgtgtgatgtgac

SEQ ID NO: 555989 - DNA, 21 bp, Homo sapiens
tgaaatgtgtgtgatgtgaca

SEQ ID NO: 555990 - DNA, 18 bp, Homo sapiens
tgaaatgtttccaggcat

SEQ ID NO: 555991 - DNA, 18 bp, Homo sapiens
tgaaatgttttaaggctt

SEQ ID NO: 555992 - DNA, 23 bp, Homo sapiens
tgaaattcaattcatagaataac

SEQ ID NO: 555993 - DNA, 13 bp, Homo sapiens
tgaaatttaagca

SEQ ID NO: 555994 - DNA, 13 bp, Homo sapiens
tgaaatttattga

SEQ ID NO: 555995 - DNA, 12 bp, Homo sapiens
tgaaatttttca

SEQ ID NO: 555996 - DNA, 18 bp, Homo sapiens
aagtattgccaaacatta

SEQ ID NO: 555997 - DNA, 14 bp, Homo sapiens
aagtcacagaaaat

SEQ ID NO: 555998 - DNA, 20 bp, Homo sapiens
aagtcaccactccattccca

SEQ ID NO: 555999 - DNA, 22 bp, Homo sapiens
aagtcactgcaaaaccaggttt

SEQ ID NO: 556000 - DNA, 19 bp, Homo sapiens
aagtcatagtttttttctt

SEQ ID NO: 556001 - DNA, 17 bp, Homo sapiens
aagtcatgatgttttta

SEQ ID NO: 556002 - DNA, 18 bp, Homo sapiens
aagtctcttttttacaaa

SEQ ID NO: 556003 - DNA, 14 bp, Homo sapiens
aagtcttcatgaaa

SEQ ID NO: 556004 - DNA, 17 bp, Homo sapiens
aagtcttttaaaaagta

SEQ ID NO: 556005 - DNA, 12 bp, Homo sapiens
aagtgaaaaaga

SEQ ID NO: 556006 - DNA, 20 bp, Homo sapiens
aagtgaaaaagacttcaaat

SEQ ID NO: 556007 - DNA, 12 bp, Homo sapiens
aagtgaaattta

SEQ ID NO: 556008 - DNA, 20 bp, Homo sapiens
aagtgaaatttattgaggaa

SEQ ID NO: 556009 - DNA, 24 bp, Homo sapiens
aagtgacacagcagcttcaccaga

SEQ ID NO: 556010 - DNA, 21 bp, Homo sapiens
aagtgcacacagaaatatata

SEQ ID NO: 556011 - DNA, 19 bp, Homo sapiens
aagtgcctctgattctatg

SEQ ID NO: 556012 - DNA, 13 bp, Homo sapiens
aagtggcaaagct

SEQ ID NO: 556013 - DNA, 19 bp, Homo sapiens
aagtggcaaagctgttctt

SEQ ID NO: 556014 - DNA, 23 bp, Homo sapiens
aagtggcaaagctgttcttcctg

SEQ ID NO: 556015 - DNA, 21 bp, Homo sapiens
aagtggcacctgtctgctcca

SEQ ID NO: 556016 - DNA, 20 bp, Homo sapiens
aagtgttctgttacaaaatg

SEQ ID NO: 556017 - DNA, 13 bp, Homo sapiens
aagtgtttcacag

SEQ ID NO: 556018 - DNA, 16 bp, Homo sapiens
aagttagcctttatct

SEQ ID NO: 556019 - DNA, 15 bp, Homo sapiens
aagttagtaggatat

SEQ ID NO: 556020 - DNA, 16 bp, Homo sapiens
aagttagtaggatatg

SEQ ID NO: 556021 - DNA, 19 bp, Homo sapiens
aagttagtaggatatgcct

SEQ ID NO: 556022 - DNA, 23 bp, Homo sapiens
aagttatatttcctataccattt

SEQ ID NO: 556023 - DNA, 16 bp, Homo sapiens
aagttcttaaaacact

SEQ ID NO: 556024 - DNA, 15 bp, Homo sapiens
aagttgctgcagatt

SEQ ID NO: 556025 - DNA, 15 bp, Homo sapiens
aagttggaaacacta

SEQ ID NO: 556026 - DNA, 17 bp, Homo sapiens
aagttggtcttactttg

SEQ ID NO: 556027 - DNA, 23 bp, Homo sapiens
aagttggtcttactttgttaatt

SEQ ID NO: 556028 - DNA, 12 bp, Homo sapiens
aagttgtaaacg

SEQ ID NO: 556029 - DNA, 20 bp, Homo sapiens
aagttgtaaacgtcttttta

SEQ ID NO: 556030 - DNA, 21 bp, Homo sapiens
aagttgtaaacgtctttttaa

SEQ ID NO: 556031 - DNA, 22 bp, Homo sapiens
aagttgtaaacgtctttttaag

SEQ ID NO: 556032 - DNA, 19 bp, Homo sapiens
aagttgtgatctgttgtaa

SEQ ID NO: 556033 - DNA, 22 bp, Homo sapiens
aagttgtgatctgttgtaatat

SEQ ID NO: 556034 - DNA, 15 bp, Homo sapiens
aagtttaaagaagag

SEQ ID NO: 556035 - DNA, 16 bp, Homo sapiens
aagtttcaaaaatctg

SEQ ID NO: 556036 - DNA, 17 bp, Homo sapiens
aagtttcaaaaatctga

SEQ ID NO: 556037 - DNA, 18 bp, Homo sapiens
aagtttgatcttcctctg

SEQ ID NO: 556038 - DNA, 11 bp, Homo sapiens
aagttttgtga

SEQ ID NO: 556039 - DNA, 13 bp, Homo sapiens
aagttttgtgaaa

SEQ ID NO: 556040 - DNA, 14 bp, Homo sapiens
aagttttgtgaaat

SEQ ID NO: 556041 - DNA, 19 bp, Homo sapiens
aagttttgtgaaatttttc

SEQ ID NO: 556042 - DNA, 13 bp, Homo sapiens
aataaaaagtgac

SEQ ID NO: 556043 - DNA, 24 bp, Homo sapiens
aataaaaatagctataaatagtga

SEQ ID NO: 556044 - DNA, 21 bp, Homo sapiens
aataaagccttgtgatcactt

SEQ ID NO: 556045 - DNA, 15 bp, Homo sapiens
aataaagcttttgca

SEQ ID NO: 556046 - DNA, 15 bp, Homo sapiens
aataaagtttgatct

SEQ ID NO: 556047 - DNA, 15 bp, Homo sapiens
aataaatggaaatca

SEQ ID NO: 556048 - DNA, 22 bp, Homo sapiens
aataaatggactacagtagctc

SEQ ID NO: 556049 - DNA, 13 bp, Homo sapiens
aataacagccgct

SEQ ID NO: 556050 - DNA, 13 bp, Homo sapiens
aataacagctcct

SEQ ID NO: 556051 - DNA, 19 bp, Homo sapiens
aataacttacaagactgta

SEQ ID NO: 556052 - DNA, 23 bp, Homo sapiens
aataacttacaagactgtaaatt

SEQ ID NO: 556053 - DNA, 15 bp, Homo sapiens
aataagttcccattt

SEQ ID NO: 556054 - DNA, 15 bp, Homo sapiens
aataatgaagatctt

SEQ ID NO: 556055 - DNA, 22 bp, Homo sapiens
aatacaacacattgaaactgta

SEQ ID NO: 556056 - DNA, 16 bp, Homo sapiens
aatacacgtgtatatg

SEQ ID NO: 556057 - DNA, 16 bp, Homo sapiens
aatacaggaaacaaga

SEQ ID NO: 556058 - DNA, 12 bp, Homo sapiens
aatacatgcctt

SEQ ID NO: 556059 - DNA, 17 bp, Homo sapiens
aatacatgttgtaaatg

SEQ ID NO: 556060 - DNA, 14 bp, Homo sapiens
aatactaaaatatg

SEQ ID NO: 556061 - DNA, 13 bp, Homo sapiens
aatactagccaga

SEQ ID NO: 556062 - DNA, 14 bp, Homo sapiens
aatactagccagag

SEQ ID NO: 556063 - DNA, 14 bp, Homo sapiens
aatacttcttttta

SEQ ID NO: 556064 - DNA, 12 bp, Homo sapiens
aatagaaaatat

SEQ ID NO: 556065 - DNA, 19 bp, Homo sapiens
aatagacataaattgtaat

SEQ ID NO: 556066 - DNA, 20 bp, Homo sapiens
aatagacataaattgtaatt

SEQ ID NO: 556067 - DNA, 21 bp, Homo sapiens
aatagtaggcaagatggcaca

SEQ ID NO: 556068 - DNA, 21 bp, Homo sapiens
aatagtgaaaattttattgaa

SEQ ID NO: 556069 - DNA, 22 bp, Homo sapiens
aatagtgttattgagagagatg

SEQ ID NO: 556070 - DNA, 23 bp, Homo sapiens
aatagtgttattgagagagatgt

SEQ ID NO: 556071 - DNA, 21 bp, Homo sapiens
aatataaagcatctaaacttt

SEQ ID NO: 556072 - DNA, 13 bp, Homo sapiens
aatataactgcct

SEQ ID NO: 556073 - DNA, 21 bp, Homo sapiens
aatatactcaagtttcaggta

SEQ ID NO: 556074 - DNA, 19 bp, Homo sapiens
aatatactccttaaaaatg

SEQ ID NO: 556075 - DNA, 12 bp, Homo sapiens
aatatatataca

SEQ ID NO: 556076 - DNA, 13 bp, Homo sapiens
aatatatatacat

SEQ ID NO: 556077 - DNA, 19 bp, Homo sapiens
aatatatggtctaatgttt

SEQ ID NO: 556078 - DNA, 18 bp, Homo sapiens
aatatatttgcataatat

SEQ ID NO: 556079 - DNA, 22 bp, Homo sapiens
aatatcatccccaaatgtgtct

SEQ ID NO: 556080 - DNA, 17 bp, Homo sapiens
aatatctgtgaaggact

SEQ ID NO: 556081 - DNA, 21 bp, Homo sapiens
aatatgattttttaaaagaaa

SEQ ID NO: 556082 - DNA, 17 bp, Homo sapiens
aatatgcactaagtctc

SEQ ID NO: 556083 - DNA, 16 bp, Homo sapiens
aatatgcatatatatg

SEQ ID NO: 556084 - DNA, 17 bp, Homo sapiens
aatatgcatatatatgt

SEQ ID NO: 556085 - DNA, 11 bp, Homo sapiens
taactgctctt

SEQ ID NO: 556086 - DNA, 16 bp, Homo sapiens
taactgctcttgggca

SEQ ID NO: 556087 - DNA, 19 bp, Homo sapiens
taactgctcttgggcaata

SEQ ID NO: 556088 - DNA, 11 bp, Homo sapiens
taactgttacc

SEQ ID NO: 556089 - DNA, 19 bp, Homo sapiens
taactgttaccattggaaa

SEQ ID NO: 556090 - DNA, 20 bp, Homo sapiens
taacttacaagactgtaaat

SEQ ID NO: 556091 - DNA, 20 bp, Homo sapiens
taacttctaaaactgtactt

SEQ ID NO: 556092 - DNA, 20 bp, Homo sapiens
taacttgctgtgaaatgact

SEQ ID NO: 556093 - DNA, 13 bp, Homo sapiens
taacttgcttaaa

SEQ ID NO: 556094 - DNA, 16 bp, Homo sapiens
taacttgcttaaatgt

SEQ ID NO: 556095 - DNA, 14 bp, Homo sapiens
taacttgtcttaaa

SEQ ID NO: 556096 - DNA, 13 bp, Homo sapiens
taacttttgtagt

SEQ ID NO: 556097 - DNA, 15 bp, Homo sapiens
taacttttgtagtct

SEQ ID NO: 556098 - DNA, 20 bp, Homo sapiens
taacttttgtagtcttatga

SEQ ID NO: 556099 - DNA, 15 bp, Homo sapiens
taagaaacattggaa

SEQ ID NO: 556100 - DNA, 16 bp, Homo sapiens
taagaaacattggaag

SEQ ID NO: 556101 - DNA, 14 bp, Homo sapiens
taagaagcaaataa

SEQ ID NO: 556102 - DNA, 14 bp, Homo sapiens
taagacacttccgt

SEQ ID NO: 556103 - DNA, 21 bp, Homo sapiens
taagactctgtctcaaaaata

SEQ ID NO: 556104 - DNA, 18 bp, Homo sapiens
taagagagaaatctgaaa

SEQ ID NO: 556105 - DNA, 15 bp, Homo sapiens
tagcagtggcaaaat

SEQ ID NO: 556106 - DNA, 17 bp, Homo sapiens
tagcagtggcaaaatat

SEQ ID NO: 556107 - DNA, 23 bp, Homo sapiens
tagccaaatgactgaaagcactg

SEQ ID NO: 556108 - DNA, 18 bp, Homo sapiens
tagccaacggccccagct

SEQ ID NO: 556109 - DNA, 22 bp, Homo sapiens
tagccccaacccaaacctggag

SEQ ID NO: 556110 - DNA, 23 bp, Homo sapiens
tagcccctctccccgcagtgttt

SEQ ID NO: 556111 - DNA, 20 bp, Homo sapiens
tagcctggagcacctttcct

SEQ ID NO: 556112 - DNA, 23 bp, Homo sapiens
tagccttgatttgttcttacagt

SEQ ID NO: 556113 - DNA, 20 bp, Homo sapiens
tagcgacaacagattggatt

SEQ ID NO: 556114 - DNA, 18 bp, Homo sapiens
tagctctgaatgctattt

SEQ ID NO: 556115 - DNA, 19 bp, Homo sapiens
tagctctgaatgctatttg

SEQ ID NO: 556116 - DNA, 17 bp, Homo sapiens
tagctgacagaatctct

SEQ ID NO: 556117 - DNA, 16 bp, Homo sapiens
tagctgtcatggtgca

SEQ ID NO: 556118 - DNA, 21 bp, Homo sapiens
tagctgtcatggtgcaatttg

SEQ ID NO: 556119 - DNA, 18 bp, Homo sapiens
tagctgtggggagctggt

SEQ ID NO: 556120 - DNA, 14 bp, Homo sapiens
tagcttaagaaaaa

SEQ ID NO: 556121 - DNA, 14 bp, Homo sapiens
tagcttatctttct

SEQ ID NO: 556122 - DNA, 18 bp, Homo sapiens
tagcttatctttctttcc

SEQ ID NO: 556123 - DNA, 16 bp, Homo sapiens
taggaaaagaaatcta

SEQ ID NO: 556124 - DNA, 21 bp, Homo sapiens
taggaaaagaaatctatagaa

SEQ ID NO: 556125 - DNA, 22 bp, Homo sapiens
taggaaaagaaatctatagaaa

SEQ ID NO: 556126 - DNA, 21 bp, Homo sapiens
taggaaagcctcactgatata

SEQ ID NO: 556127 - DNA, 14 bp, Homo sapiens
taggaacaaatctt

SEQ ID NO: 556128 - DNA, 16 bp, Homo sapiens
taggaacaaatcttcc

SEQ ID NO: 556129 - DNA, 16 bp, Homo sapiens
taggaaggtcatttcc

SEQ ID NO: 556130 - DNA, 14 bp, Homo sapiens
taggaatattatat

SEQ ID NO: 556131 - DNA, 19 bp, Homo sapiens
taggacaagggaaaataaa

SEQ ID NO: 556132 - DNA, 19 bp, Homo sapiens
taggacaaggtgcaggcag

SEQ ID NO: 556133 - DNA, 22 bp, Homo sapiens
taggacccccagtgctcacaca

SEQ ID NO: 556134 - DNA, 17 bp, Homo sapiens
taggacttgtttttgtt

SEQ ID NO: 556135 - DNA, 21 bp, Homo sapiens
taggatctgaggacaaggaaa

SEQ ID NO: 556136 - DNA, 13 bp, Homo sapiens
taggattgaagtg

SEQ ID NO: 556137 - DNA, 22 bp, Homo sapiens
tatctttctttccatttacagt

SEQ ID NO: 556138 - DNA, 15 bp, Homo sapiens
tatgaagcagattta

SEQ ID NO: 556139 - DNA, 21 bp, Homo sapiens
tatgaagcagatttatttttg

SEQ ID NO: 556140 - DNA, 16 bp, Homo sapiens
tatgaagttggcacat

SEQ ID NO: 556141 - DNA, 18 bp, Homo sapiens
tatgaagttggcacattt

SEQ ID NO: 556142 - DNA, 15 bp, Homo sapiens
tatgaatagacataa

SEQ ID NO: 556143 - DNA, 20 bp, Homo sapiens
tatgaatagacataaattgt

SEQ ID NO: 556144 - DNA, 18 bp, Homo sapiens
tatgagactgtgtttcta

SEQ ID NO: 556145 - DNA, 19 bp, Homo sapiens
tatgagactgtgtttctag

SEQ ID NO: 556146 - DNA, 20 bp, Homo sapiens
tatgagatcactgaactttt

SEQ ID NO: 556147 - DNA, 20 bp, Homo sapiens
tatgagtatacaatatataa

SEQ ID NO: 556148 - DNA, 21 bp, Homo sapiens
tatgatattccccatttcctg

SEQ ID NO: 556149 - DNA, 15 bp, Homo sapiens
tatgatccagagcag

SEQ ID NO: 556150 - DNA, 17 bp, Homo sapiens
tatgattttttaaaaga

SEQ ID NO: 556151 - DNA, 21 bp, Homo sapiens
tatgattttttaaaagaaatt

SEQ ID NO: 556152 - DNA, 17 bp, Homo sapiens
tatgcaagcagtttcaa

SEQ ID NO: 556153 - DNA, 17 bp, Homo sapiens
tatgcactaagtctctt

SEQ ID NO: 556154 - DNA, 18 bp, Homo sapiens
tatgcactaagtctcttt

SEQ ID NO: 556155 - DNA, 24 bp, Homo sapiens
tatgcataataatcctgcaaagta

SEQ ID NO: 556156 - DNA, 16 bp, Homo sapiens
tatgcatccccatccc

SEQ ID NO: 556157 - DNA, 23 bp, Homo sapiens
tatgcatccccatccccatgccc

SEQ ID NO: 556158 - DNA, 16 bp, Homo sapiens
tatgctgtaaaagcaa

SEQ ID NO: 556159 - DNA, 14 bp, Homo sapiens
tatgcttccagaaa

SEQ ID NO: 556160 - DNA, 15 bp, Homo sapiens
tatggaagccacatc

SEQ ID NO: 556161 - DNA, 19 bp, Homo sapiens
tatggaaggtggagcgttc

SEQ ID NO: 556162 - DNA, 13 bp, Homo sapiens
tatggcaagcaac

SEQ ID NO: 556163 - DNA, 21 bp, Homo sapiens
tatggtcaatcccaaaagtca

SEQ ID NO: 556164 - DNA, 18 bp, Homo sapiens
tatgtaaactttaacttc

SEQ ID NO: 556165 - DNA, 18 bp, Homo sapiens
tatgtaacagtttaaaaa

SEQ ID NO: 556166 - DNA, 17 bp, Homo sapiens
tatgtagactatataca

SEQ ID NO: 556167 - DNA, 16 bp, Homo sapiens
tatgtatacgcacgca

SEQ ID NO: 556168 - DNA, 22 bp, Homo sapiens
tatgtatgtttacactgtcaaa

SEQ ID NO: 556169 - DNA, 13 bp, Homo sapiens
tatgtcatttcat

SEQ ID NO: 556170 - DNA, 12 bp, Homo sapiens
tatgtctttaaa

SEQ ID NO: 556171 - DNA, 16 bp, Homo sapiens
tatgtgaactttctca

SEQ ID NO: 556172 - DNA, 14 bp, Homo sapiens
tatgtgatgtaact

SEQ ID NO: 556173 - DNA, 15 bp, Homo sapiens
tatgtgattttcaaa

SEQ ID NO: 556174 - DNA, 19 bp, Homo sapiens
tatgtgattttcaaatatg

SEQ ID NO: 556175 - DNA, 21 bp, Homo sapiens
tatgtgtatatatacatacac

SEQ ID NO: 556176 - DNA, 18 bp, Homo sapiens
tatgtgtatatgtttata

SEQ ID NO: 556177 - DNA, 22 bp, Homo sapiens
tatgtgtatatgtttatacaca

SEQ ID NO: 556178 - DNA, 22 bp, Homo sapiens
tatgtgtccatttccttatgct

SEQ ID NO: 556179 - DNA, 17 bp, Homo sapiens
tatgtgtgcatgtgtgt

SEQ ID NO: 556180 - DNA, 20 bp, Homo sapiens
tatgtgtgcatgtgtgtata

SEQ ID NO: 556181 - DNA, 15 bp, Homo sapiens
tatgttatgaaaacc

SEQ ID NO: 556182 - DNA, 15 bp, Homo sapiens
tatgttgacatttgt

SEQ ID NO: 556183 - DNA, 16 bp, Homo sapiens
tatgttgacatttgtt

SEQ ID NO: 556184 - DNA, 16 bp, Homo sapiens
tatgtttaaaatggca

SEQ ID NO: 556185 - DNA, 19 bp, Homo sapiens
tatgtttaaaatggcattt

SEQ ID NO: 556186 - DNA, 15 bp, Homo sapiens
tatgtttacactgtc

SEQ ID NO: 556187 - DNA, 14 bp, Homo sapiens
tatgtttatacaca

SEQ ID NO: 556188 - DNA, 17 bp, Homo sapiens
tatgtttatacacacag

SEQ ID NO: 556189 - DNA, 13 bp, Homo sapiens
tattaaaaagtct

SEQ ID NO: 556190 - DNA, 14 bp, Homo sapiens
tattaaaaagtctt

SEQ ID NO: 556191 - DNA, 17 bp, Homo sapiens
tattaaaaagtctttta

SEQ ID NO: 556192 - DNA, 19 bp, Homo sapiens
tattaaaaagtcttttaaa

SEQ ID NO: 556193 - DNA, 22 bp, Homo sapiens
tattaaaaagtcttttaaaaag

SEQ ID NO: 556194 - DNA, 21 bp, Homo sapiens
tattaatggaaacatgctgta

SEQ ID NO: 556195 - DNA, 23 bp, Homo sapiens
tattaccagattcacttctgaat

SEQ ID NO: 556196 - DNA, 19 bp, Homo sapiens
tattagaaaactttgttag

SEQ ID NO: 556197 - DNA, 23 bp, Homo sapiens
tattagacttctgttttcaatct

SEQ ID NO: 556198 - DNA, 23 bp, Homo sapiens
tattagcgacaacagattggatt

SEQ ID NO: 556199 - DNA, 11 bp, Homo sapiens
tattatatttg

SEQ ID NO: 556200 - DNA, 12 bp, Homo sapiens
tattatatttgg

SEQ ID NO: 556201 - DNA, 14 bp, Homo sapiens
tattatatttggat

SEQ ID NO: 556202 - DNA, 16 bp, Homo sapiens
tattatatttggatgc

SEQ ID NO: 556203 - DNA, 15 bp, Homo sapiens
tattatggaaatcca

SEQ ID NO: 556204 - DNA, 17 bp, Homo sapiens
tattatgttatgaaaac

SEQ ID NO: 556205 - DNA, 15 bp, Homo sapiens
tattcaaaccaattt

SEQ ID NO: 556206 - DNA, 21 bp, Homo sapiens
tattcaaaccaatttcttcct

SEQ ID NO: 556207 - DNA, 15 bp, Homo sapiens
tattcaccttcagtt

SEQ ID NO: 556208 - DNA, 14 bp, Homo sapiens
tattcagagaaaac

SEQ ID NO: 556209 - DNA, 22 bp, Homo sapiens
tattcagcaaggcgctaacttg

SEQ ID NO: 556210 - DNA, 23 bp, Homo sapiens
tattccatattagaaaactttgt

SEQ ID NO: 556211 - DNA, 17 bp, Homo sapiens
tattcccaaatctcaaa

SEQ ID NO: 556212 - DNA, 19 bp, Homo sapiens
tattccccaccctcccctt

SEQ ID NO: 556213 - DNA, 22 bp, Homo sapiens
tattccccaccctccccttccc

SEQ ID NO: 556214 - DNA, 22 bp, Homo sapiens
tattccccatttcctgtacaat

SEQ ID NO: 556215 - DNA, 17 bp, Homo sapiens
tattctttgttaatttg

SEQ ID NO: 556216 - DNA, 20 bp, Homo sapiens
tattgaaaatgtcactgtta

SEQ ID NO: 556217 - DNA, 13 bp, Homo sapiens
tattgaagaaaca

SEQ ID NO: 556218 - DNA, 14 bp, Homo sapiens
tattgaatataatg

SEQ ID NO: 556219 - DNA, 16 bp, Homo sapiens
tattgagagagatgtg

SEQ ID NO: 556220 - DNA, 15 bp, Homo sapiens
tattgaggaaaaata

SEQ ID NO: 556221 - DNA, 19 bp, Homo sapiens
tattgaggaaaaatatgtg

SEQ ID NO: 556222 - DNA, 22 bp, Homo sapiens
tattgccaaacattaatgttga

SEQ ID NO: 556223 - DNA, 18 bp, Homo sapiens
tattgctacttcctgcct

SEQ ID NO: 556224 - DNA, 18 bp, Homo sapiens
tattgctggaatctacta

SEQ ID NO: 556225 - DNA, 14 bp, Homo sapiens
tattgctgtaaata

SEQ ID NO: 556226 - DNA, 20 bp, Homo sapiens
tattggccataagcaacaat

SEQ ID NO: 556227 - DNA, 19 bp, Homo sapiens
tattggtatatccttttct

SEQ ID NO: 556228 - DNA, 21 bp, Homo sapiens
tattgtccctggcttccttac

SEQ ID NO: 556229 - DNA, 14 bp, Homo sapiens
tatttaaaacattt

SEQ ID NO: 556230 - DNA, 12 bp, Homo sapiens
tatttaacattc

SEQ ID NO: 556231 - DNA, 16 bp, Homo sapiens
tatttaagtattcaag

SEQ ID NO: 556232 - DNA, 16 bp, Homo sapiens
tccagaaatgtccctt

SEQ ID NO: 556233 - DNA, 22 bp, Homo sapiens
tccagaaatgtccctttcttct

SEQ ID NO: 556234 - DNA, 18 bp, Homo sapiens
tccagaactcttcctcca

SEQ ID NO: 556235 - DNA, 12 bp, Homo sapiens
tccagaagcagc

SEQ ID NO: 556236 - DNA, 16 bp, Homo sapiens
tccagacctgggccct

SEQ ID NO: 556237 - DNA, 17 bp, Homo sapiens
tccagacctgggccctg

SEQ ID NO: 556238 - DNA, 20 bp, Homo sapiens
tccagagcattccagtcagg

SEQ ID NO: 556239 - DNA, 13 bp, Homo sapiens
tccagagctgcca

SEQ ID NO: 556240 - DNA, 15 bp, Homo sapiens
tccagagctgccagt

SEQ ID NO: 556241 - DNA, 13 bp, Homo sapiens
tccagaggtgagg

SEQ ID NO: 556242 - DNA, 16 bp, Homo sapiens
tccagatgaaggaaag

SEQ ID NO: 556243 - DNA, 22 bp, Homo sapiens
tccagctaagcctgatgatgga

SEQ ID NO: 556244 - DNA, 22 bp, Homo sapiens
tccagctgattttaactttttt

SEQ ID NO: 556245 - DNA, 20 bp, Homo sapiens
tccagcttcactgtcatgtg

SEQ ID NO: 556246 - DNA, 22 bp, Homo sapiens
tccaggaacacatgcacacaca

SEQ ID NO: 556247 - DNA, 10 bp, Homo sapiens
tccaggagat

SEQ ID NO: 556248 - DNA, 12 bp, Homo sapiens
tccaggagctca

SEQ ID NO: 556249 - DNA, 15 bp, Homo sapiens
tccaggagctcagga

SEQ ID NO: 556250 - DNA, 18 bp, Homo sapiens
tccaggagctcaggaaga

SEQ ID NO: 556251 - DNA, 15 bp, Homo sapiens
tccaggcaccatctc

SEQ ID NO: 556252 - DNA, 21 bp, Homo sapiens
tccaggcatgaccctggagcc

SEQ ID NO: 556253 - DNA, 22 bp, Homo sapiens
tccaggcgtagggccagggctc

SEQ ID NO: 556254 - DNA, 13 bp, Homo sapiens
tccaggctccctc

SEQ ID NO: 556255 - DNA, 21 bp, Homo sapiens
tccaggctccctccctcccag

SEQ ID NO: 556256 - DNA, 22 bp, Homo sapiens
tccaggctccctccctcccaga

SEQ ID NO: 556257 - DNA, 14 bp, Homo sapiens
tccagtattttagt

SEQ ID NO: 556258 - DNA, 13 bp, Homo sapiens
tccagtcaggctc

SEQ ID NO: 556259 - DNA, 14 bp, Homo sapiens
tccagtccccagaa

SEQ ID NO: 556260 - DNA, 16 bp, Homo sapiens
tccagtccccagaact

SEQ ID NO: 556261 - DNA, 16 bp, Homo sapiens
tccagtctcactgaca

SEQ ID NO: 556262 - DNA, 21 bp, Homo sapiens
tccagtctcactgacacagga

SEQ ID NO: 556263 - DNA, 13 bp, Homo sapiens
tccagtcttccac

SEQ ID NO: 556264 - DNA, 19 bp, Homo sapiens
tccagtcttccacctggaa

SEQ ID NO: 556265 - DNA, 16 bp, Homo sapiens
tccagtgctgctccct

SEQ ID NO: 556266 - DNA, 16 bp, Homo sapiens
tccagttactttccaa

SEQ ID NO: 556267 - DNA, 21 bp, Homo sapiens
tccagttagagtcttcatctg

SEQ ID NO: 556268 - DNA, 17 bp, Homo sapiens
tccagttctgatgaggc

SEQ ID NO: 556269 - DNA, 12 bp, Homo sapiens
tccatattttca

SEQ ID NO: 556270 - DNA, 18 bp, Homo sapiens
tccatatttttttcctta

SEQ ID NO: 556271 - DNA, 23 bp, Homo sapiens
tccatatttttttccttacataa

SEQ ID NO: 556272 - DNA, 20 bp, Homo sapiens
tccatgattccaagggccca

SEQ ID NO: 556273 - DNA, 21 bp, Homo sapiens
tccatgattccaagggcccag

SEQ ID NO: 556274 - DNA, 22 bp, Homo sapiens
tccatggtgaactgaagcagag

SEQ ID NO: 556275 - DNA, 19 bp, Homo sapiens
tccatttacagtctctttc

SEQ ID NO: 556276 - DNA, 18 bp, Homo sapiens
tccatttctctctccagt

SEQ ID NO: 556277 - DNA, 17 bp, Homo sapiens
tcccaaccctgcccagc

SEQ ID NO: 556278 - DNA, 22 bp, Homo sapiens
tcccaaccctgcccagcctgat

SEQ ID NO: 556279 - DNA, 16 bp, Homo sapiens
tcccaacctcccctgg

SEQ ID NO: 556280 - DNA, 20 bp, Homo sapiens
tcccaacctcccctggtcct

SEQ ID NO: 556281 - DNA, 13 bp, Homo sapiens
tcccaagaaatgc

SEQ ID NO: 556282 - DNA, 20 bp, Homo sapiens
tcccaatctctacccctttc

SEQ ID NO: 556283 - DNA, 21 bp, Homo sapiens
tcccaatctctacccctttct

SEQ ID NO: 556284 - DNA, 22 bp, Homo sapiens
tcccaatctctacccctttctt

SEQ ID NO: 556285 - DNA, 14 bp, Homo sapiens
tcccaatgcacatc

SEQ ID NO: 556286 - DNA, 20 bp, Homo sapiens
tcccaatgcacatccattcc

SEQ ID NO: 556287 - DNA, 22 bp, Homo sapiens
tcccaatgcacatccattccca

SEQ ID NO: 556288 - DNA, 21 bp, Homo sapiens
tcccacaaataagttcccatt

SEQ ID NO: 556289 - DNA, 14 bp, Homo sapiens
tcccacactgtgaa

SEQ ID NO: 556290 - DNA, 15 bp, Homo sapiens
tcccacatcccccgt

SEQ ID NO: 556291 - DNA, 17 bp, Homo sapiens
tcccacatcccccgtgt

SEQ ID NO: 556292 - DNA, 18 bp, Homo sapiens
tcccaccccatcctccag

SEQ ID NO: 556293 - DNA, 14 bp, Homo sapiens
tcccacccgtggtg

SEQ ID NO: 556294 - DNA, 15 bp, Homo sapiens
tcccacctctttgga

SEQ ID NO: 556295 - DNA, 14 bp, Homo sapiens
tcccactccaagcc

SEQ ID NO: 556296 - DNA, 13 bp, Homo sapiens
tcccactcttctc

SEQ ID NO: 556297 - DNA, 19 bp, Homo sapiens
tcccactgcccctgcacct

SEQ ID NO: 556298 - DNA, 14 bp, Homo sapiens
tcccagctacaggg

SEQ ID NO: 556299 - DNA, 14 bp, Homo sapiens
tcccagctgcccct

SEQ ID NO: 556300 - DNA, 17 bp, Homo sapiens
tcccagctgcccctccc

SEQ ID NO: 556301 - DNA, 22 bp, Homo sapiens
tcccaggacgcagggagaccct

SEQ ID NO: 556302 - DNA, 21 bp, Homo sapiens
tcccatattggcatggatttc

SEQ ID NO: 556303 - DNA, 20 bp, Homo sapiens
tcccatcgtctcggccttca

SEQ ID NO: 556304 - DNA, 21 bp, Homo sapiens
tcccatctttttaacctctgt

SEQ ID NO: 556305 - DNA, 20 bp, Homo sapiens
tcccatggtagactgtgaca

SEQ ID NO: 556306 - DNA, 21 bp, Homo sapiens
tcccattgtatttaaaacatt

SEQ ID NO: 556307 - DNA, 20 bp, Homo sapiens
tccccaaaggccaacagcat

SEQ ID NO: 556308 - DNA, 21 bp, Homo sapiens
tccccaaaggccaacagcatt

SEQ ID NO: 556309 - DNA, 23 bp, Homo sapiens
tccccaaggccccctgcctgccc

SEQ ID NO: 556310 - DNA, 21 bp, Homo sapiens
tccccagaactctgcctgccc

SEQ ID NO: 556311 - DNA, 13 bp, Homo sapiens
tccccagaccagt

SEQ ID NO: 556312 - DNA, 22 bp, Homo sapiens
tccccagaccagtagtgaccaa

SEQ ID NO: 556313 - DNA, 23 bp, Homo sapiens
tccccagaccagtagtgaccaat

SEQ ID NO: 556314 - DNA, 22 bp, Homo sapiens
tccccagccccctggcccctcc

SEQ ID NO: 556315 - DNA, 20 bp, Homo sapiens
tccccagcccttcctctgct

SEQ ID NO: 556316 - DNA, 23 bp, Homo sapiens
tccccaggccgtggctgcccaca

SEQ ID NO: 556317 - DNA, 17 bp, Homo sapiens
tccccataatgcttctt

SEQ ID NO: 556318 - DNA, 18 bp, Homo sapiens
tccccatccccatgccct

SEQ ID NO: 556319 - DNA, 15 bp, Homo sapiens
tccccatttcctgta

SEQ ID NO: 556320 - DNA, 19 bp, Homo sapiens
tcccccacagtttgatgtc

SEQ ID NO: 556321 - DNA, 20 bp, Homo sapiens
tcccccgcaatgtgccccca

SEQ ID NO: 556322 - DNA, 19 bp, Homo sapiens
tccccctccttcccagctg

SEQ ID NO: 556323 - DNA, 20 bp, Homo sapiens
tccccctccttcccagctgc

SEQ ID NO: 556324 - DNA, 21 bp, Homo sapiens
tccccctttcttcctcattcc

SEQ ID NO: 556325 - DNA, 14 bp, Homo sapiens
tcccctccaggagt

SEQ ID NO: 556326 - DNA, 20 bp, Homo sapiens
tcccctcccttgtccttgaa

SEQ ID NO: 556327 - DNA, 14 bp, Homo sapiens
tcccctggtcctgc

SEQ ID NO: 556328 - DNA, 17 bp, Homo sapiens
tcccctggtcctgcact

SEQ ID NO: 556329 - DNA, 18 bp, Homo sapiens
tcccctggtcctgcactg

SEQ ID NO: 556330 - DNA, 20 bp, Homo sapiens
tcccctggtcctgcactgtc

SEQ ID NO: 556331 - DNA, 20 bp, Homo sapiens
tccccttgggatgggcacag

SEQ ID NO: 556332 - DNA, 16 bp, Homo sapiens
tcccgaatggagtcca

SEQ ID NO: 556333 - DNA, 14 bp, Homo sapiens
tcccgacctcttag

SEQ ID NO: 556334 - DNA, 13 bp, Homo sapiens
tcccggggccatg

SEQ ID NO: 556335 - DNA, 19 bp, Homo sapiens
tcccgtggctttgtgctta

SEQ ID NO: 556336 - DNA, 16 bp, Homo sapiens
tccctcagccctcatt

SEQ ID NO: 556337 - DNA, 17 bp, Homo sapiens
tccctcagccctcatta

SEQ ID NO: 556338 - DNA, 18 bp, Homo sapiens
tccctcagccctcattaa

SEQ ID NO: 556339 - DNA, 18 bp, Homo sapiens
tccctccacgttcacccc

SEQ ID NO: 556340 - DNA, 19 bp, Homo sapiens
tccctccacgttcacccct

SEQ ID NO: 556341 - DNA, 18 bp, Homo sapiens
tccctccgggtcttccta

SEQ ID NO: 556342 - DNA, 23 bp, Homo sapiens
tccctgaatctgaccacagacac

SEQ ID NO: 556343 - DNA, 21 bp, Homo sapiens
tccctgagaagcctcatggga

SEQ ID NO: 556344 - DNA, 19 bp, Homo sapiens
tccctgagggcccttccca

SEQ ID NO: 556345 - DNA, 21 bp, Homo sapiens
tccctgagggcccttcccaac

SEQ ID NO: 556346 - DNA, 23 bp, Homo sapiens
tccctgagggcccttcccaacct

SEQ ID NO: 556347 - DNA, 14 bp, Homo sapiens
tccctgatcccttc

SEQ ID NO: 556348 - DNA, 15 bp, Homo sapiens
tccctgatcccttcc

SEQ ID NO: 556349 - DNA, 12 bp, Homo sapiens
tccctgatgtac

SEQ ID NO: 556350 - DNA, 22 bp, Homo sapiens
tccctgctgccaggctcccact

SEQ ID NO: 556351 - DNA, 13 bp, Homo sapiens
tccctggactctg

SEQ ID NO: 556352 - DNA, 15 bp, Homo sapiens
tccctggcttcctta

SEQ ID NO: 556353 - DNA, 15 bp, Homo sapiens
tccctgggggcccca

SEQ ID NO: 556354 - DNA, 13 bp, Homo sapiens
tccctgtcatagt

SEQ ID NO: 556355 - DNA, 15 bp, Homo sapiens
tcccttccacctgct

SEQ ID NO: 556356 - DNA, 20 bp, Homo sapiens
tcccttccacctgctctgct

SEQ ID NO: 556357 - DNA, 21 bp, Homo sapiens
tcccttccacctgctctgctg

SEQ ID NO: 556358 - DNA, 19 bp, Homo sapiens
tcccttccagtttattcca

SEQ ID NO: 556359 - DNA, 22 bp, Homo sapiens
tcccttccagtttattccagag

SEQ ID NO: 556360 - DNA, 23 bp, Homo sapiens
tcccttccagtttattccagagc

SEQ ID NO: 556361 - DNA, 17 bp, Homo sapiens
tcccttctacaaggact

SEQ ID NO: 556362 - DNA, 20 bp, Homo sapiens
tcccttctacaaggactcca

SEQ ID NO: 556363 - DNA, 16 bp, Homo sapiens
tcccttcttgtgccct

SEQ ID NO: 556364 - DNA, 13 bp, Homo sapiens
tccgagtgtgttt

SEQ ID NO: 556365 - DNA, 13 bp, Homo sapiens
tccgcctctgtcc

SEQ ID NO: 556366 - DNA, 18 bp, Homo sapiens
tccggaatcctgtcctca

SEQ ID NO: 556367 - DNA, 22 bp, Homo sapiens
tccggaatcctgtcctcagctt

SEQ ID NO: 556368 - DNA, 16 bp, Homo sapiens
tgaactgctgctggtc

SEQ ID NO: 556369 - DNA, 16 bp, Homo sapiens
tgaactggaggccagg

SEQ ID NO: 556370 - DNA, 21 bp, Homo sapiens
tgaactttctcagcatatata

SEQ ID NO: 556371 - DNA, 12 bp, Homo sapiens
tgaacttttcaa

SEQ ID NO: 556372 - DNA, 21 bp, Homo sapiens
tgaagaccctatctcccacaa

SEQ ID NO: 556373 - DNA, 17 bp, Homo sapiens
tgaagacctaaccaggg

SEQ ID NO: 556374 - DNA, 19 bp, Homo sapiens
tgaagacctaaccagggcc

SEQ ID NO: 556375 - DNA, 13 bp, Homo sapiens
tgaagactccaga

SEQ ID NO: 556376 - DNA, 17 bp, Homo sapiens
tgaagagctggggagaa

SEQ ID NO: 556377 - DNA, 18 bp, Homo sapiens
tgaagagctggggagaat

SEQ ID NO: 556378 - DNA, 17 bp, Homo sapiens
tgaagagtgaagagcat

SEQ ID NO: 556379 - DNA, 18 bp, Homo sapiens
tgaagatgggggcctctt

SEQ ID NO: 556380 - DNA, 13 bp, Homo sapiens
tgaagattgttta

SEQ ID NO: 556381 - DNA, 22 bp, Homo sapiens
tgaagattgtttatctagatgt

SEQ ID NO: 556382 - DNA, 12 bp, Homo sapiens
tgaagcagagtc

SEQ ID NO: 556383 - DNA, 13 bp, Homo sapiens
tgaagcagagtca

SEQ ID NO: 556384 - DNA, 21 bp, Homo sapiens
tgaagcagagtcaagctgatg

SEQ ID NO: 556385 - DNA, 16 bp, Homo sapiens
tgaagccagctccctg

SEQ ID NO: 556386 - DNA, 13 bp, Homo sapiens
tgaagcctgctcc

SEQ ID NO: 556387 - DNA, 15 bp, Homo sapiens
tgaagcctgctcctt

SEQ ID NO: 556388 - DNA, 14 bp, Homo sapiens
tgaagctaaaacac

SEQ ID NO: 556389 - DNA, 15 bp, Homo sapiens
tgaagctaaaacact

SEQ ID NO: 556390 - DNA, 19 bp, Homo sapiens
tgaaggaggctccaggcag

SEQ ID NO: 556391 - DNA, 20 bp, Homo sapiens
tgaaggaggctccaggcagc

SEQ ID NO: 556392 - DNA, 18 bp, Homo sapiens
tgaagtaacttgtcttaa

SEQ ID NO: 556393 - DNA, 19 bp, Homo sapiens
tgaagtaacttgtcttaaa

SEQ ID NO: 556394 - DNA, 22 bp, Homo sapiens
tgaagtcatgctcccctgtgcc

SEQ ID NO: 556395 - DNA, 13 bp, Homo sapiens
tgaagtccggaac

SEQ ID NO: 556396 - DNA, 17 bp, Homo sapiens
tgaagtctgtattgtaa

SEQ ID NO: 556397 - DNA, 10 bp, Homo sapiens
tgaagtgttg

SEQ ID NO: 556398 - DNA, 22 bp, Homo sapiens
tgaagttctgcctctgatgtat

SEQ ID NO: 556399 - DNA, 14 bp, Homo sapiens
tgaagttggcacat

SEQ ID NO: 556400 - DNA, 22 bp, Homo sapiens
tgaagtttgataaatagtgtta

SEQ ID NO: 556401 - DNA, 21 bp, Homo sapiens
tgaatagcagtggcaaaatat

SEQ ID NO: 556402 - DNA, 13 bp, Homo sapiens
tgaatatttcatt

SEQ ID NO: 556403 - DNA, 19 bp, Homo sapiens
tgaatatttcattttgaga

SEQ ID NO: 556404 - DNA, 15 bp, Homo sapiens
tgaatcagaggcaga

SEQ ID NO: 556405 - DNA, 18 bp, Homo sapiens
tgaatctgaccacagaca

SEQ ID NO: 556406 - DNA, 12 bp, Homo sapiens
tgaatctgtaca

SEQ ID NO: 556407 - DNA, 12 bp, Homo sapiens
tgaatgctattt

SEQ ID NO: 556408 - DNA, 22 bp, Homo sapiens
tgaatgctatttgtgtaactga

SEQ ID NO: 556409 - DNA, 19 bp, Homo sapiens
tgaatgcttaaatgatcaa

SEQ ID NO: 556410 - DNA, 19 bp, Homo sapiens
tgaatggcaatgttttgct

SEQ ID NO: 556411 - DNA, 23 bp, Homo sapiens
tgaatggcatctcgttgtaagta

SEQ ID NO: 556412 - DNA, 15 bp, Homo sapiens
tgaatgtatattttg

SEQ ID NO: 556413 - DNA, 16 bp, Homo sapiens
tgaattactaacttct

SEQ ID NO: 556414 - DNA, 19 bp, Homo sapiens
tgaatttagtgagatttac

SEQ ID NO: 556415 - DNA, 19 bp, Homo sapiens
tgaattttcattttacagt

SEQ ID NO: 556416 - DNA, 12 bp, Homo sapiens
tgacaacatttt

SEQ ID NO: 556417 - DNA, 19 bp, Homo sapiens
tgacaagcctcagcaaacc

SEQ ID NO: 556418 - DNA, 21 bp, Homo sapiens
tgacaagtgacttatttgctc

SEQ ID NO: 556419 - DNA, 16 bp, Homo sapiens
tgacactgctccctga

SEQ ID NO: 556420 - DNA, 18 bp, Homo sapiens
tgacactgtctgctgccc

SEQ ID NO: 556421 - DNA, 20 bp, Homo sapiens
tgacagagcctgccccagcg

SEQ ID NO: 556422 - DNA, 23 bp, Homo sapiens
tgacagagcctgccccagcgctg

SEQ ID NO: 556423 - DNA, 16 bp, Homo sapiens
tgacagcaaacacagt

SEQ ID NO: 556424 - DNA, 19 bp, Homo sapiens
tgacagcaaacacagtcac

SEQ ID NO: 556425 - DNA, 12 bp, Homo sapiens
tgacaggctgtt

SEQ ID NO: 556426 - DNA, 14 bp, Homo sapiens
tgacatatttcata

SEQ ID NO: 556427 - DNA, 17 bp, Homo sapiens
tgacatccaagcttcct

SEQ ID NO: 556428 - DNA, 22 bp, Homo sapiens
tgacatctctattccccaccct

SEQ ID NO: 556429 - DNA, 18 bp, Homo sapiens
tgacatgcgggctgggca

SEQ ID NO: 556430 - DNA, 19 bp, Homo sapiens
tgacatttagtccctcaag

SEQ ID NO: 556431 - DNA, 13 bp, Homo sapiens
tgacatttgtcat

SEQ ID NO: 556432 - DNA, 14 bp, Homo sapiens
tgacatttgtcatt

SEQ ID NO: 556433 - DNA, 17 bp, Homo sapiens
tgacatttgtcattttc

SEQ ID NO: 556434 - DNA, 18 bp, Homo sapiens
tgacatttgtcattttca

SEQ ID NO: 556435 - DNA, 13 bp, Homo sapiens
tgaccataaaatt

SEQ ID NO: 556436 - DNA, 19 bp, Homo sapiens
tgacccccccagcttcact

SEQ ID NO: 556437 - DNA, 20 bp, Homo sapiens
tgaccctgaaatattttcta

SEQ ID NO: 556438 - DNA, 16 bp, Homo sapiens
tgaccctggagcccgg

SEQ ID NO: 556439 - DNA, 20 bp, Homo sapiens
tgaccgacagctttccagta

SEQ ID NO: 556440 - DNA, 17 bp, Homo sapiens
tgacctcaatttcaatt

SEQ ID NO: 556441 - DNA, 13 bp, Homo sapiens
tgacctccccctc

SEQ ID NO: 556442 - DNA, 19 bp, Homo sapiens
tgacctccccctccttccc

SEQ ID NO: 556443 - DNA, 19 bp, Homo sapiens
tgacctccgccatccaccc

SEQ ID NO: 556444 - DNA, 19 bp, Homo sapiens
tgacctctagccctgcccg

SEQ ID NO: 556445 - DNA, 20 bp, Homo sapiens
tgacctggaaggcccagcac

SEQ ID NO: 556446 - DNA, 13 bp, Homo sapiens
tgaccttgtaatg

SEQ ID NO: 556447 - DNA, 16 bp, Homo sapiens
tgaccttgtaatgtaa

SEQ ID NO: 556448 - DNA, 14 bp, Homo sapiens
tgacgtttcttctt

SEQ ID NO: 556449 - DNA, 14 bp, Homo sapiens
tgactcaaagatga

SEQ ID NO: 556450 - DNA, 21 bp, Homo sapiens
tgactcaaagatgaaagctgt

SEQ ID NO: 556451 - DNA, 18 bp, Homo sapiens
tgactcccccagtcccct

SEQ ID NO: 556452 - DNA, 18 bp, Homo sapiens
tgactgggactcccagct

SEQ ID NO: 556453 - DNA, 16 bp, Homo sapiens
tgactttcctatgaca

SEQ ID NO: 556454 - DNA, 20 bp, Homo sapiens
tgactttggagacgatgctt

SEQ ID NO: 556455 - DNA, 18 bp, Homo sapiens
tgagaaatataaaaataa

SEQ ID NO: 556456 - DNA, 22 bp, Homo sapiens
tgagaatgagggcgtgaaacac

SEQ ID NO: 556457 - DNA, 15 bp, Homo sapiens
tgagacagcagtctt

SEQ ID NO: 556458 - DNA, 16 bp, Homo sapiens
tgagactgtttattac

SEQ ID NO: 556459 - DNA, 16 bp, Homo sapiens
tgagagaagagagtat

SEQ ID NO: 556460 - DNA, 14 bp, Homo sapiens
tgagagagatgtgt

SEQ ID NO: 556461 - DNA, 14 bp, Homo sapiens
tgagagcagcctct

SEQ ID NO: 556462 - DNA, 16 bp, Homo sapiens
tgagaggacactcccg

SEQ ID NO: 556463 - DNA, 22 bp, Homo sapiens
tgagagttccttctcacttaga

SEQ ID NO: 556464 - DNA, 23 bp, Homo sapiens
tgagatcctggagtgatatgatc

SEQ ID NO: 556465 - DNA, 15 bp, Homo sapiens
tgagatctttctaaa

SEQ ID NO: 556466 - DNA, 18 bp, Homo sapiens
tgagattggaaaaaatta

SEQ ID NO: 556467 - DNA, 20 bp, Homo sapiens
tgagattggaaaaaattaga

SEQ ID NO: 556468 - DNA, 23 bp, Homo sapiens
tgagatttaccagggatgtagat

SEQ ID NO: 556469 - DNA, 13 bp, Homo sapiens
tgagcagctgaat

SEQ ID NO: 556470 - DNA, 20 bp, Homo sapiens
tgagcagtgatattctttgt

SEQ ID NO: 556471 - DNA, 16 bp, Homo sapiens
tgagcattacaggcaa

SEQ ID NO: 556472 - DNA, 23 bp, Homo sapiens
tgagcccagaagctcaaggctgc

SEQ ID NO: 556473 - DNA, 24 bp, Homo sapiens
tgagcccttcggaggaccagggct

SEQ ID NO: 556474 - DNA, 18 bp, Homo sapiens
tgagctacagaacacttt

SEQ ID NO: 556475 - DNA, 18 bp, Homo sapiens
tgagctcctgctcattgt

SEQ ID NO: 556476 - DNA, 18 bp, Homo sapiens
tgagctctgacctgcccc

SEQ ID NO: 556477 - DNA, 23 bp, Homo sapiens
tgagctctgacctgcccccgctc

SEQ ID NO: 556478 - DNA, 16 bp, Homo sapiens
tgaggaaaaatatgtg

SEQ ID NO: 556479 - DNA, 14 bp, Homo sapiens
tgaggaaagcacac

SEQ ID NO: 556480 - DNA, 15 bp, Homo sapiens
tgaggacctccacct

SEQ ID NO: 556481 - DNA, 16 bp, Homo sapiens
tgaggacctccacctg

SEQ ID NO: 556482 - DNA, 22 bp, Homo sapiens
tgaggacctccacctgggagat

SEQ ID NO: 556483 - DNA, 21 bp, Homo sapiens
tgaggaggccttgggctctgc

SEQ ID NO: 556484 - DNA, 23 bp, Homo sapiens
tgaggaggccttgggctctgctg

SEQ ID NO: 556485 - DNA, 16 bp, Homo sapiens
tgaggaggtgctgcag

SEQ ID NO: 556486 - DNA, 14 bp, Homo sapiens
tgaggatgtatgtg

SEQ ID NO: 556487 - DNA, 16 bp, Homo sapiens
tgaggatgtatgtgta

SEQ ID NO: 556488 - DNA, 15 bp, Homo sapiens
tgaggcaggagaatc

SEQ ID NO: 556489 - DNA, 18 bp, Homo sapiens
tgaggcaggtgacagtga

SEQ ID NO: 556490 - DNA, 20 bp, Homo sapiens
tgaggcaggtgacagtgagg

SEQ ID NO: 556491 - DNA, 22 bp, Homo sapiens
tgaggctggataggagaggaaa

SEQ ID NO: 556492 - DNA, 17 bp, Homo sapiens
tgagggcaggaggctcc

SEQ ID NO: 556493 - DNA, 14 bp, Homo sapiens
tgaggggagccagg

SEQ ID NO: 556494 - DNA, 15 bp, Homo sapiens
tgaggggagccagga

SEQ ID NO: 556495 - DNA, 18 bp, Homo sapiens
tgaggggcagcctgcctt

SEQ ID NO: 556496 - DNA, 15 bp, Homo sapiens
tgagggtttccacct

SEQ ID NO: 556497 - DNA, 13 bp, Homo sapiens
tgaggtcatcccg

SEQ ID NO: 556498 - DNA, 22 bp, Homo sapiens
tgaggtcatcccggggccatgg

SEQ ID NO: 556499 - DNA, 21 bp, Homo sapiens
tgaggtcctgggggcctgacc

SEQ ID NO: 556500 - DNA, 18 bp, Homo sapiens
tgaggtggcatggtccat

SEQ ID NO: 556501 - DNA, 20 bp, Homo sapiens
tgagtcctcattgttcagaa

SEQ ID NO: 556502 - DNA, 17 bp, Homo sapiens
tgagtcctccagaactc

SEQ ID NO: 556503 - DNA, 23 bp, Homo sapiens
tgagtcctccagaactcttcctc

SEQ ID NO: 556504 - DNA, 12 bp, Homo sapiens
tgtgcttgttct

SEQ ID NO: 556505 - DNA, 16 bp, Homo sapiens
tgtgcttgttcttcct

SEQ ID NO: 556506 - DNA, 12 bp, Homo sapiens
tgtggacatgca

SEQ ID NO: 556507 - DNA, 13 bp, Homo sapiens
tgtggacatgcac

SEQ ID NO: 556508 - DNA, 11 bp, Homo sapiens
tgtggagctgc

SEQ ID NO: 556509 - DNA, 13 bp, Homo sapiens
tgtggataagaaa

SEQ ID NO: 556510 - DNA, 14 bp, Homo sapiens
tgtggcctgccagt

SEQ ID NO: 556511 - DNA, 12 bp, Homo sapiens
tgtggcttctgg

SEQ ID NO: 556512 - DNA, 16 bp, Homo sapiens
tgtggtgttgaggctt

SEQ ID NO: 556513 - DNA, 12 bp, Homo sapiens
tgtgtaaaattg

SEQ ID NO: 556514 - DNA, 21 bp, Homo sapiens
tgtgtaaaattggattattac

SEQ ID NO: 556515 - DNA, 15 bp, Homo sapiens
tgtgtaactgaaagg

SEQ ID NO: 556516 - DNA, 21 bp, Homo sapiens
tgtgtaatttcctgctcctcc

SEQ ID NO: 556517 - DNA, 12 bp, Homo sapiens
tgtgtaattttt

SEQ ID NO: 556518 - DNA, 17 bp, Homo sapiens
tgtgtaatttttctgta

SEQ ID NO: 556519 - DNA, 21 bp, Homo sapiens
tgtgtagtagctcgtgtgctt

SEQ ID NO: 556520 - DNA, 23 bp, Homo sapiens
tgtgtatatgtttatacacacag

SEQ ID NO: 556521 - DNA, 22 bp, Homo sapiens
tgtgtatgagactgtgtttcta

SEQ ID NO: 556522 - DNA, 23 bp, Homo sapiens
tgtgtatgagactgtgtttctag

SEQ ID NO: 556523 - DNA, 15 bp, Homo sapiens
tgtgtcagtttatgt

SEQ ID NO: 556524 - DNA, 15 bp, Homo sapiens
tgtgtccggcccagt

SEQ ID NO: 556525 - DNA, 18 bp, Homo sapiens
tgtgtcctttggtactat

SEQ ID NO: 556526 - DNA, 16 bp, Homo sapiens
tgtgtctccagctgat

SEQ ID NO: 556527 - DNA, 18 bp, Homo sapiens
tgtgtctccagctgattt

SEQ ID NO: 556528 - DNA, 19 bp, Homo sapiens
tgtgtcttgtattatcata

SEQ ID NO: 556529 - DNA, 19 bp, Homo sapiens
tgtgtgatgtgacatttgt

SEQ ID NO: 556530 - DNA, 14 bp, Homo sapiens
tgtgtgcagagctg

SEQ ID NO: 556531 - DNA, 17 bp, Homo sapiens
tgtgtgcagagctgaag

SEQ ID NO: 556532 - DNA, 19 bp, Homo sapiens
tgtgtgcatgtgtgtataa

SEQ ID NO: 556533 - DNA, 15 bp, Homo sapiens
tgtgtgtatatatgt

SEQ ID NO: 556534 - DNA, 22 bp, Homo sapiens
tgtgtgtatatatgtgtatata

SEQ ID NO: 556535 - DNA, 13 bp, Homo sapiens
tgtgtgtgatgtg

SEQ ID NO: 556536 - DNA, 18 bp, Homo sapiens
tgtgtgtgatgtgacatt

SEQ ID NO: 556537 - DNA, 18 bp, Homo sapiens
tgtgttgccactttccaa

SEQ ID NO: 556538 - DNA, 18 bp, Homo sapiens
tgtgtttgaattgatttt

SEQ ID NO: 556539 - DNA, 22 bp, Homo sapiens
tgttaaaatgagggtctcactg

SEQ ID NO: 556540 - DNA, 19 bp, Homo sapiens
tgttaaagatgtagcaaac

SEQ ID NO: 556541 - DNA, 21 bp, Homo sapiens
tgttaatgagtatatgtaaca

SEQ ID NO: 556542 - DNA, 17 bp, Homo sapiens
tgttaatgtgatggatg

SEQ ID NO: 556543 - DNA, 16 bp, Homo sapiens
tgttaattcctatgaa

SEQ ID NO: 556544 - DNA, 13 bp, Homo sapiens
tgttaatttatct

SEQ ID NO: 556545 - DNA, 22 bp, Homo sapiens
tgttaatttggaccattttcct

SEQ ID NO: 556546 - DNA, 14 bp, Homo sapiens
tgttacaaaatgta

SEQ ID NO: 556547 - DNA, 18 bp, Homo sapiens
tgttacaaaatgtaactg

SEQ ID NO: 556548 - DNA, 21 bp, Homo sapiens
tgttacaaaatgtaactgtta

SEQ ID NO: 556549 - DNA, 16 bp, Homo sapiens
tgttaccattggaaat

SEQ ID NO: 556550 - DNA, 17 bp, Homo sapiens
tgttaccattggaaatt

SEQ ID NO: 556551 - DNA, 20 bp, Homo sapiens
tgttacctaattagagcaga

SEQ ID NO: 556552 - DNA, 18 bp, Homo sapiens
tgttagagtccaacgtgg

SEQ ID NO: 556553 - DNA, 21 bp, Homo sapiens
tgttaggccaaagacaaatag

SEQ ID NO: 556554 - DNA, 17 bp, Homo sapiens
tgttcacgcaacttgaa

SEQ ID NO: 556555 - DNA, 15 bp, Homo sapiens
tgttcacgtgactcc

SEQ ID NO: 556556 - DNA, 19 bp, Homo sapiens
tgttcacgtgactcctcaa

SEQ ID NO: 556557 - DNA, 18 bp, Homo sapiens
tgttcaggaagtccttat

SEQ ID NO: 556558 - DNA, 14 bp, Homo sapiens
tgttctgtgaatag

SEQ ID NO: 556559 - DNA, 12 bp, Homo sapiens
tgttctgtgcaa

SEQ ID NO: 556560 - DNA, 14 bp, Homo sapiens
tgttctgttacaaa

SEQ ID NO: 556561 - DNA, 19 bp, Homo sapiens
tgttctgttacaaaatgta

SEQ ID NO: 556562 - DNA, 16 bp, Homo sapiens
tgttcttaaaaatgca

SEQ ID NO: 556563 - DNA, 19 bp, Homo sapiens
tgttcttaaaaatgcattt

SEQ ID NO: 556564 - DNA, 16 bp, Homo sapiens
tgttcttccaaagcag

SEQ ID NO: 556565 - DNA, 17 bp, Homo sapiens
tgttcttccaaagcaga

SEQ ID NO: 556566 - DNA, 21 bp, Homo sapiens
tgttcttccagttactttcca

SEQ ID NO: 556567 - DNA, 14 bp, Homo sapiens
tgttcttgagcagc

SEQ ID NO: 556568 - DNA, 19 bp, Homo sapiens
tgttgacatccaagcttcc

SEQ ID NO: 556569 - DNA, 16 bp, Homo sapiens
tgttgatgctgtattc

SEQ ID NO: 556570 - DNA, 13 bp, Homo sapiens
tgttgcactgaag

SEQ ID NO: 556571 - DNA, 22 bp, Homo sapiens
tgttgcactgaagtttgataaa

SEQ ID NO: 556572 - DNA, 12 bp, Homo sapiens
tgttgcagactg

SEQ ID NO: 556573 - DNA, 18 bp, Homo sapiens
tgttgcagactggtgtta

SEQ ID NO: 556574 - DNA, 16 bp, Homo sapiens
tgttgccactttccaa

SEQ ID NO: 556575 - DNA, 20 bp, Homo sapiens
tgttgctcagagtgaagagt

SEQ ID NO: 556576 - DNA, 15 bp, Homo sapiens
tgttgctctccattc

SEQ ID NO: 556577 - DNA, 23 bp, Homo sapiens
tgttggcagatgcagctcttcct

SEQ ID NO: 556578 - DNA, 15 bp, Homo sapiens
tgttgtaatatcagt

SEQ ID NO: 556579 - DNA, 17 bp, Homo sapiens
tgttgtaatatcagtta

SEQ ID NO: 556580 - DNA, 21 bp, Homo sapiens
tgttgtaatatcagttacagt

SEQ ID NO: 556581 - DNA, 22 bp, Homo sapiens
tgttgtaatattttgctgctga

SEQ ID NO: 556582 - DNA, 17 bp, Homo sapiens
tgttgtctcttctcctt

SEQ ID NO: 556583 - DNA, 17 bp, Homo sapiens
tgttgtctgaaacatag

SEQ ID NO: 556584 - DNA, 13 bp, Homo sapiens
ttactgtcttaat

SEQ ID NO: 556585 - DNA, 18 bp, Homo sapiens
ttactgtcttaattaagt

SEQ ID NO: 556586 - DNA, 13 bp, Homo sapiens
ttactttagaaaa

SEQ ID NO: 556587 - DNA, 19 bp, Homo sapiens
ttactttgttaatttatct

SEQ ID NO: 556588 - DNA, 22 bp, Homo sapiens
ttacttttaataaagtatgaat

SEQ ID NO: 556589 - DNA, 12 bp, Homo sapiens
ttagaaaaggca

SEQ ID NO: 556590 - DNA, 15 bp, Homo sapiens
ttagaacaacataaa

SEQ ID NO: 556591 - DNA, 17 bp, Homo sapiens
ttagaagaaatatgagc

SEQ ID NO: 556592 - DNA, 24 bp, Homo sapiens
ttagagacagagcgacagagcagt

SEQ ID NO: 556593 - DNA, 19 bp, Homo sapiens
ttagatttcaagaaaaaat

SEQ ID NO: 556594 - DNA, 17 bp, Homo sapiens
ttagcacagtatttaac

SEQ ID NO: 556595 - DNA, 19 bp, Homo sapiens
ttagcacagtatttaacat

SEQ ID NO: 556596 - DNA, 21 bp, Homo sapiens
ttagcacttcagggcagattt

SEQ ID NO: 556597 - DNA, 15 bp, Homo sapiens
ttagcagaatcaaaa

SEQ ID NO: 556598 - DNA, 23 bp, Homo sapiens
ttagcctggagcacctttccttc

SEQ ID NO: 556599 - DNA, 14 bp, Homo sapiens
ttagcttttctgca

SEQ ID NO: 556600 - DNA, 17 bp, Homo sapiens
ttaggaggctcaacaat

SEQ ID NO: 556601 - DNA, 15 bp, Homo sapiens
ttaggccaaagacaa

SEQ ID NO: 556602 - DNA, 18 bp, Homo sapiens
ttaggccaaagacaaata

SEQ ID NO: 556603 - DNA, 19 bp, Homo sapiens
ttaggccaaagacaaatag

SEQ ID NO: 556604 - DNA, 19 bp, Homo sapiens
ttaggtagtagaatctcag

SEQ ID NO: 556605 - DNA, 12 bp, Homo sapiens
ttagtactttat

SEQ ID NO: 556606 - DNA, 13 bp, Homo sapiens
ttagtactttata

SEQ ID NO: 556607 - DNA, 21 bp, Homo sapiens
ttagtactttatagaagaatg

SEQ ID NO: 556608 - DNA, 16 bp, Homo sapiens
ttagtaggatatgcct

SEQ ID NO: 556609 - DNA, 13 bp, Homo sapiens
ttagtcctcacct

SEQ ID NO: 556610 - DNA, 14 bp, Homo sapiens
ttagtcctcacctt

SEQ ID NO: 556611 - DNA, 19 bp, Homo sapiens
ttagtcctcaccttctgtt

SEQ ID NO: 556612 - DNA, 15 bp, Homo sapiens
ttagtgcttggctca

SEQ ID NO: 556613 - DNA, 12 bp, Homo sapiens
ttagtgtgattg

SEQ ID NO: 556614 - DNA, 23 bp, Homo sapiens
ttagttaatctttgaaaactcat

SEQ ID NO: 556615 - DNA, 22 bp, Homo sapiens
ttagttactacctcctctcctg

SEQ ID NO: 556616 - DNA, 17 bp, Homo sapiens
ttagttttattttctaa

SEQ ID NO: 556617 - DNA, 14 bp, Homo sapiens
ttagttttgctttt

SEQ ID NO: 556618 - DNA, 19 bp, Homo sapiens
ttataaaaaaaatgaaatg

SEQ ID NO: 556619 - DNA, 15 bp, Homo sapiens
ttataaaatctgtat

SEQ ID NO: 556620 - DNA, 19 bp, Homo sapiens
ttataaattttgtacattt

SEQ ID NO: 556621 - DNA, 17 bp, Homo sapiens
ttataacattgtaaatg

SEQ ID NO: 556622 - DNA, 17 bp, Homo sapiens
ttataacattgtatgtt

SEQ ID NO: 556623 - DNA, 23 bp, Homo sapiens
ttataagcaaatttcaaaagaca

SEQ ID NO: 556624 - DNA, 20 bp, Homo sapiens
ttataagcacagacaattct

SEQ ID NO: 556625 - DNA, 14 bp, Homo sapiens
ttataatcaccagg

SEQ ID NO: 556626 - DNA, 16 bp, Homo sapiens
ttatacagattttcta

SEQ ID NO: 556627 - DNA, 22 bp, Homo sapiens
ttatagaagaatgcatgctttc

SEQ ID NO: 556628 - DNA, 15 bp, Homo sapiens
ttataggataactga

SEQ ID NO: 556629 - DNA, 15 bp, Homo sapiens
ttatagtgcaatata

SEQ ID NO: 556630 - DNA, 21 bp, Homo sapiens
ttatatgattaaattatcatt

SEQ ID NO: 556631 - DNA, 15 bp, Homo sapiens
ttatatttttaaagg

SEQ ID NO: 556632 - DNA, 22 bp, Homo sapiens
ttatcagctacttaagagaaat

SEQ ID NO: 556633 - DNA, 17 bp, Homo sapiens
ttatctaccaactttca

SEQ ID NO: 556634 - DNA, 20 bp, Homo sapiens
ttatctaccaactttcaaga

SEQ ID NO: 556635 - DNA, 14 bp, Homo sapiens
ttatctagatgtaa

SEQ ID NO: 556636 - DNA, 17 bp, Homo sapiens
ttatctagatgtaaatt

SEQ ID NO: 556637 - DNA, 19 bp, Homo sapiens
ttatctagatgtaaatttt

SEQ ID NO: 556638 - DNA, 16 bp, Homo sapiens
ttatcttagctggata

SEQ ID NO: 556639 - DNA, 17 bp, Homo sapiens
ttatctttatacagatt

SEQ ID NO: 556640 - DNA, 21 bp, Homo sapiens
ttatgaatagacataaattgt

SEQ ID NO: 556641 - DNA, 22 bp, Homo sapiens
ttatgaatagacataaattgta

SEQ ID NO: 556642 - DNA, 19 bp, Homo sapiens
ttatgagatcactgaactt

SEQ ID NO: 556643 - DNA, 21 bp, Homo sapiens
ttatgcgcaaatacaaaatga

SEQ ID NO: 556644 - DNA, 10 bp, Homo sapiens
ttatgctaag

SEQ ID NO: 556645 - DNA, 15 bp, Homo sapiens
ttatgctaagaattt

SEQ ID NO: 556646 - DNA, 15 bp, Homo sapiens
ttatggctttgtgct

SEQ ID NO: 556647 - DNA, 22 bp, Homo sapiens
ttatggtcaatcccaaaagtca

SEQ ID NO: 556648 - DNA, 13 bp, Homo sapiens
ttatgtgatgtaa

SEQ ID NO: 556649 - DNA, 18 bp, Homo sapiens
ttatgtgtgcatgtgtgt

SEQ ID NO: 556650 - DNA, 21 bp, Homo sapiens
ttatgtgtgcatgtgtgtata

SEQ ID NO: 556651 - DNA, 12 bp, Homo sapiens
ttatgttaaaat

SEQ ID NO: 556652 - DNA, 14 bp, Homo sapiens
ttatgttgacattt

SEQ ID NO: 556653 - DNA, 17 bp, Homo sapiens
ttatgttgacatttgtt

SEQ ID NO: 556654 - DNA, 22 bp, Homo sapiens
ttctgttacaaaatgtaactgt

SEQ ID NO: 556655 - DNA, 13 bp, Homo sapiens
ttcttaaaaagta

SEQ ID NO: 556656 - DNA, 17 bp, Homo sapiens
ttcttaaaaatgcattt

SEQ ID NO: 556657 - DNA, 18 bp, Homo sapiens
ttcttaaaaatgcattta

SEQ ID NO: 556658 - DNA, 17 bp, Homo sapiens
ttcttacccaaagcaca

SEQ ID NO: 556659 - DNA, 11 bp, Homo sapiens
ttcttccagtt

SEQ ID NO: 556660 - DNA, 12 bp, Homo sapiens
ttcttccagtta

SEQ ID NO: 556661 - DNA, 22 bp, Homo sapiens
ttcttccagttactttccaatt

SEQ ID NO: 556662 - DNA, 15 bp, Homo sapiens
ttcttcctcattccc

SEQ ID NO: 556663 - DNA, 12 bp, Homo sapiens
ttcttccttcca

SEQ ID NO: 556664 - DNA, 16 bp, Homo sapiens
ttcttctctctgtgct

SEQ ID NO: 556665 - DNA, 17 bp, Homo sapiens
ttcttgcaatttgaagg

SEQ ID NO: 556666 - DNA, 16 bp, Homo sapiens
ttcttggtatgatcat

SEQ ID NO: 556667 - DNA, 16 bp, Homo sapiens
ttcttgttttgcttcc

SEQ ID NO: 556668 - DNA, 20 bp, Homo sapiens
ttctttaaagttcttctaag

SEQ ID NO: 556669 - DNA, 11 bp, Homo sapiens
ttctttacaaa

SEQ ID NO: 556670 - DNA, 19 bp, Homo sapiens
ttctttcaagggctttcct

SEQ ID NO: 556671 - DNA, 14 bp, Homo sapiens
ttctttcccttcct

SEQ ID NO: 556672 - DNA, 14 bp, Homo sapiens
ttctttgcccttta

SEQ ID NO: 556673 - DNA, 17 bp, Homo sapiens
ttctttttgatcatctt

SEQ ID NO: 556674 - DNA, 17 bp, Homo sapiens
ttcttttttaattgaaa

SEQ ID NO: 556675 - DNA, 19 bp, Homo sapiens
ttgaaaatgtcactgttat

SEQ ID NO: 556676 - DNA, 12 bp, Homo sapiens
ttgaaacattgc

SEQ ID NO: 556677 - DNA, 14 bp, Homo sapiens
ttgaaacattgctt

SEQ ID NO: 556678 - DNA, 19 bp, Homo sapiens
ttgaaacattgcttttaaa

SEQ ID NO: 556679 - DNA, 13 bp, Homo sapiens
ttgaaactgtatt

SEQ ID NO: 556680 - DNA, 20 bp, Homo sapiens
ttgaaaggagaaaaaaaaag

SEQ ID NO: 556681 - DNA, 18 bp, Homo sapiens
ttgaaagggacaagtatc

SEQ ID NO: 556682 - DNA, 20 bp, Homo sapiens
ttgaaatatatggtctaatg

SEQ ID NO: 556683 - DNA, 23 bp, Homo sapiens
ttgaaatatatggtctaatgttt

SEQ ID NO: 556684 - DNA, 17 bp, Homo sapiens
ttgaagagagagctgag

SEQ ID NO: 556685 - DNA, 16 bp, Homo sapiens
ttgaagctaaaacact

SEQ ID NO: 556686 - DNA, 21 bp, Homo sapiens
ttgaagtgcctctgattctat

SEQ ID NO: 556687 - DNA, 16 bp, Homo sapiens
ttgaatgcttaaatga

SEQ ID NO: 556688 - DNA, 16 bp, Homo sapiens
ttgaattttcatttta

SEQ ID NO: 556689 - DNA, 14 bp, Homo sapiens
ttgacaataagaaa

SEQ ID NO: 556690 - DNA, 17 bp, Homo sapiens
ttgacagagcctgcccc

SEQ ID NO: 556691 - DNA, 23 bp, Homo sapiens
ttgacagagcctgccccagcgct

SEQ ID NO: 556692 - DNA, 20 bp, Homo sapiens
ttgaccctgaaatattttct

SEQ ID NO: 556693 - DNA, 15 bp, Homo sapiens
ttgaccgacagcttt

SEQ ID NO: 556694 - DNA, 23 bp, Homo sapiens
ttgaccttctgtcgtccccagac

SEQ ID NO: 556695 - DNA, 14 bp, Homo sapiens
ttgagagagatgtg

SEQ ID NO: 556696 - DNA, 15 bp, Homo sapiens
ttgagagagatgtgt

SEQ ID NO: 556697 - DNA, 23 bp, Homo sapiens
ttgagagagatgtgtaatttttc

SEQ ID NO: 556698 - DNA, 15 bp, Homo sapiens
ttgagagcagcctct

SEQ ID NO: 556699 - DNA, 21 bp, Homo sapiens
ttgaggaaaaatatgtgaagg

SEQ ID NO: 556700 - DNA, 15 bp, Homo sapiens
ttgaggccaaatgag

SEQ ID NO: 556701 - DNA, 13 bp, Homo sapiens
ttgataaatagtg

SEQ ID NO: 556702 - DNA, 16 bp, Homo sapiens
ttgatatgagtataca

SEQ ID NO: 556703 - DNA, 15 bp, Homo sapiens
ttgatcaaatgtaca

SEQ ID NO: 556704 - DNA, 16 bp, Homo sapiens
ttgatcaaatgtacat

SEQ ID NO: 556705 - DNA, 17 bp, Homo sapiens
ttgatgcaatccttaca

SEQ ID NO: 556706 - DNA, 19 bp, Homo sapiens
ttgatggtagaaattttat

SEQ ID NO: 556707 - DNA, 21 bp, Homo sapiens
ttgatggtcagacacaaacaa

SEQ ID NO: 556708 - DNA, 19 bp, Homo sapiens
ttgatgtaagttactgaca

SEQ ID NO: 556709 - DNA, 16 bp, Homo sapiens
ttgatgtccccaaagt

SEQ ID NO: 556710 - DNA, 15 bp, Homo sapiens
ttgatgttgatgcaa

SEQ ID NO: 556711 - DNA, 13 bp, Homo sapiens
ttgattctctcca

SEQ ID NO: 556712 - DNA, 17 bp, Homo sapiens
ttgatttacctttggaa

SEQ ID NO: 556713 - DNA, 17 bp, Homo sapiens
ttgatttcccttcttct

SEQ ID NO: 556714 - DNA, 19 bp, Homo sapiens
ttgcaaataacttacaaga

SEQ ID NO: 556715 - DNA, 16 bp, Homo sapiens
ttgcaacagcaaatta

SEQ ID NO: 556716 - DNA, 23 bp, Homo sapiens
ttgcaataaactcagtcaaatgt

SEQ ID NO: 556717 - DNA, 20 bp, Homo sapiens
ttgcacacatcatctgtaag

SEQ ID NO: 556718 - DNA, 21 bp, Homo sapiens
ttgcactattgagtcttcatg

SEQ ID NO: 556719 - DNA, 16 bp, Homo sapiens
ttgcactgaagtttga

SEQ ID NO: 556720 - DNA, 20 bp, Homo sapiens
ttgcagctatggacaattta

SEQ ID NO: 556721 - DNA, 13 bp, Homo sapiens
ttgcagtaaagtt

SEQ ID NO: 556722 - DNA, 15 bp, Homo sapiens
ttgcagtgagctgag

SEQ ID NO: 556723 - DNA, 20 bp, Homo sapiens
ttgcatcacctctgtaattt

SEQ ID NO: 556724 - DNA, 15 bp, Homo sapiens
ttgcatcagtattaa

SEQ ID NO: 556725 - DNA, 23 bp, Homo sapiens
ttgcatcagtattaatactaaaa

SEQ ID NO: 556726 - DNA, 16 bp, Homo sapiens
ttgcatgtcgcacaat

SEQ ID NO: 556727 - DNA, 17 bp, Homo sapiens
ttgcatgtcgcacaatg

SEQ ID NO: 556728 - DNA, 19 bp, Homo sapiens
ttgcatgtcgcacaatgtt

SEQ ID NO: 556729 - DNA, 19 bp, Homo sapiens
ttgccaaacattaatgttg

SEQ ID NO: 556730 - DNA, 15 bp, Homo sapiens
ttgccacataattca

SEQ ID NO: 556731 - DNA, 18 bp, Homo sapiens
ttgccacataattcatta

SEQ ID NO: 556732 - DNA, 18 bp, Homo sapiens
ttgcccacacctgcctct

SEQ ID NO: 556733 - DNA, 22 bp, Homo sapiens
ttgccctttacttgtctttctg

SEQ ID NO: 556734 - DNA, 22 bp, Homo sapiens
ttgctaccaaaaactagacatt

SEQ ID NO: 556735 - DNA, 23 bp, Homo sapiens
ttgctaccacggcctcctttccg

SEQ ID NO: 556736 - DNA, 16 bp, Homo sapiens
ttgctccccttcccct

SEQ ID NO: 556737 - DNA, 21 bp, Homo sapiens
ttgctccccttccccttcctt

SEQ ID NO: 556738 - DNA, 11 bp, Homo sapiens
ttgctctctca

SEQ ID NO: 556739 - DNA, 18 bp, Homo sapiens
ttgctctctcattcccag

SEQ ID NO: 556740 - DNA, 12 bp, Homo sapiens
ttttcaaggcat

SEQ ID NO: 556741 - DNA, 23 bp, Homo sapiens
ttttcacaggtgtggtgtaattt

SEQ ID NO: 556742 - DNA, 17 bp, Homo sapiens
ttttcacccttctactc

SEQ ID NO: 556743 - DNA, 14 bp, Homo sapiens
ttttcagatttgca

SEQ ID NO: 556744 - DNA, 23 bp, Homo sapiens
ttttcagctaggaacaaatcttc

SEQ ID NO: 556745 - DNA, 16 bp, Homo sapiens
ttttcatattttaatt

SEQ ID NO: 556746 - DNA, 22 bp, Homo sapiens
ttttcattagcaaaaaaagttg

SEQ ID NO: 556747 - DNA, 13 bp, Homo sapiens
ttttcattttaca

SEQ ID NO: 556748 - DNA, 21 bp, Homo sapiens
ttttccaacccatgagtgcta

SEQ ID NO: 556749 - DNA, 22 bp, Homo sapiens
ttttcctatgactcaaagatga

SEQ ID NO: 556750 - DNA, 17 bp, Homo sapiens
ttttcctcgcttctttc

SEQ ID NO: 556751 - DNA, 15 bp, Homo sapiens
ttttccttacataaa

SEQ ID NO: 556752 - DNA, 15 bp, Homo sapiens
ttttctgaaactaat

SEQ ID NO: 556753 - DNA, 22 bp, Homo sapiens
ttttctttacaaacaaaagcat

SEQ ID NO: 556754 - DNA, 20 bp, Homo sapiens
ttttcttttgttttttgaag

SEQ ID NO: 556755 - DNA, 19 bp, Homo sapiens
ttttcttttttaattgaaa

SEQ ID NO: 556756 - DNA, 10 bp, Homo sapiens
ttttgcaaat

SEQ ID NO: 556757 - DNA, 15 bp, Homo sapiens
ttttgcatgtctgca

SEQ ID NO: 556758 - DNA, 11 bp, Homo sapiens
ttttgcttttg

SEQ ID NO: 556759 - DNA, 13 bp, Homo sapiens
ttttgtacatttt

SEQ ID NO: 556760 - DNA, 13 bp, Homo sapiens
ttttgtatgcaag

SEQ ID NO: 556761 - DNA, 20 bp, Homo sapiens
ttttgtgaaatttttcatat

SEQ ID NO: 556762 - DNA, 14 bp, Homo sapiens
ttttgtgagtttgt

SEQ ID NO: 556763 - DNA, 19 bp, Homo sapiens
ttttgttcttaaaaatgca

SEQ ID NO: 556764 - DNA, 14 bp, Homo sapiens
ttttgttgattaaa

SEQ ID NO: 556765 - DNA, 15 bp, Homo sapiens
ttttgttgcactgaa

SEQ ID NO: 556766 - DNA, 18 bp, Homo sapiens
ttttgttgcactgaagtt

SEQ ID NO: 556767 - DNA, 12 bp, Homo sapiens
tttttaaaatct

SEQ ID NO: 556768 - DNA, 14 bp, Homo sapiens
tttttaaaatctta

SEQ ID NO: 556769 - DNA, 19 bp, Homo sapiens
tttttaaaatcttattaaa

SEQ ID NO: 556770 - DNA, 15 bp, Homo sapiens
tttttaagtgaaatt

SEQ ID NO: 556771 - DNA, 16 bp, Homo sapiens
tttttaagtgaaattt

SEQ ID NO: 556772 - DNA, 15 bp, Homo sapiens
tttttaagtgttctg

SEQ ID NO: 556773 - DNA, 13 bp, Homo sapiens
tttttcagttcaa

SEQ ID NO: 556774 - DNA, 16 bp, Homo sapiens
tttttcagttcaaagt

SEQ ID NO: 556775 - DNA, 22 bp, Homo sapiens
tttttcctatgaccataaaatt

SEQ ID NO: 556776 - DNA, 14 bp, Homo sapiens
tttttcctgtcctt

SEQ ID NO: 556777 - DNA, 11 bp, Homo sapiens
tttttctgtat

SEQ ID NO: 556778 - DNA, 18 bp, Homo sapiens
tttttgatcaaatgtaca

SEQ ID NO: 556779 - DNA, 15 bp, Homo sapiens
tttttgttcttaaaa

SEQ ID NO: 556780 - DNA, 17 bp, Homo sapiens
ttttttaagtgttctgt

SEQ ID NO: 556781 - DNA, 13 bp, Homo sapiens
ttttttacaaagg

SEQ ID NO: 556782 - DNA, 20 bp, Homo sapiens
ttttttccttacataaacat

SEQ ID NO: 556783 - DNA, 14 bp, Homo sapiens
ttttttgtctgtga

SEQ ID NO: 556784 - DNA, 12 bp, Homo sapiens
tttttttcctta

SEQ ID NO: 556785 - DNA, 13 bp, Homo sapiens
aacagcccaggca

SEQ ID NO: 556786 - DNA, 15 bp, Homo sapiens
aacagccgctccaga

SEQ ID NO: 556787 - DNA, 11 bp, Homo sapiens
aacagctcctt

SEQ ID NO: 556788 - DNA, 14 bp, Homo sapiens
aacagctctgagat

SEQ ID NO: 556789 - DNA, 19 bp, Homo sapiens
aacagctctgagatcctgg

SEQ ID NO: 556790 - DNA, 19 bp, Homo sapiens
aacaggattagacagtcaa

SEQ ID NO: 556791 - DNA, 14 bp, Homo sapiens
aacaggcacaggct

SEQ ID NO: 556792 - DNA, 12 bp, Homo sapiens
aacagtaactgc

SEQ ID NO: 556793 - DNA, 13 bp, Homo sapiens
aacagtaactgcc

SEQ ID NO: 556794 - DNA, 14 bp, Homo sapiens
aacagtaatcagtt

SEQ ID NO: 556795 - DNA, 18 bp, Homo sapiens
aacagtattttaagaagt

SEQ ID NO: 556796 - DNA, 20 bp, Homo sapiens
aacagtattttaagaagttg

SEQ ID NO: 556797 - DNA, 23 bp, Homo sapiens
aacagtattttaagaagttgctg

SEQ ID NO: 556798 - DNA, 22 bp, Homo sapiens
aacataaaaactactgaataaa

SEQ ID NO: 556799 - DNA, 22 bp, Homo sapiens
aacatcaggttaggcagtataa

SEQ ID NO: 556800 - DNA, 17 bp, Homo sapiens
aacatccatgtcctatg

SEQ ID NO: 556801 - DNA, 19 bp, Homo sapiens
aacatctgcagtgttctgt

SEQ ID NO: 556802 - DNA, 22 bp, Homo sapiens
aacatctgcagtgttctgtgaa

SEQ ID NO: 556803 - DNA, 15 bp, Homo sapiens
aacattaaatgtctt

SEQ ID NO: 556804 - DNA, 14 bp, Homo sapiens
aacattaatgttga

SEQ ID NO: 556805 - DNA, 15 bp, Homo sapiens
aacattaatgttgat

SEQ ID NO: 556806 - DNA, 17 bp, Homo sapiens
aacattaatgttgattt

SEQ ID NO: 556807 - DNA, 19 bp, Homo sapiens
aacattaatgttgatttct

SEQ ID NO: 556808 - DNA, 16 bp, Homo sapiens
aacattagtactttat

SEQ ID NO: 556809 - DNA, 15 bp, Homo sapiens
aacattctatttcaa

SEQ ID NO: 556810 - DNA, 19 bp, Homo sapiens
aacattgcttttaaaacta

SEQ ID NO: 556811 - DNA, 16 bp, Homo sapiens
aacattggaagcaggt

SEQ ID NO: 556812 - DNA, 24 bp, Homo sapiens
aacattggaagcaggttaaatgtt

SEQ ID NO: 556813 - DNA, 14 bp, Homo sapiens
aacattgtatgtta

SEQ ID NO: 556814 - DNA, 20 bp, Homo sapiens
aacattgttgctccctgtga

SEQ ID NO: 556815 - DNA, 23 bp, Homo sapiens
aacatttcatgtatttctttaga

SEQ ID NO: 556816 - DNA, 20 bp, Homo sapiens
aaccaaggtagaatgacctt

SEQ ID NO: 556817 - DNA, 16 bp, Homo sapiens
aaccaatttcttcctt

SEQ ID NO: 556818 - DNA, 18 bp, Homo sapiens
aaccacagctccttttcc

SEQ ID NO: 556819 - DNA, 22 bp, Homo sapiens
aaccagtttagatttcaagaaa

SEQ ID NO: 556820 - DNA, 18 bp, Homo sapiens
aacccaaagatgttaaca

SEQ ID NO: 556821 - DNA, 22 bp, Homo sapiens
aaccctcgatgttcatggaatt

SEQ ID NO: 556822 - DNA, 15 bp, Homo sapiens
aaccctgaatcagag

SEQ ID NO: 556823 - DNA, 17 bp, Homo sapiens
aaccctgtcaaacatta

SEQ ID NO: 556824 - DNA, 19 bp, Homo sapiens
aaccctgtcaaacattagt

SEQ ID NO: 556825 - DNA, 15 bp, Homo sapiens
aaccgagcaaagatc

SEQ ID NO: 556826 - DNA, 17 bp, Homo sapiens
aaccgagcaaagatcaa

SEQ ID NO: 556827 - DNA, 22 bp, Homo sapiens
aaccgagcaaagatcaaaataa

SEQ ID NO: 556828 - DNA, 21 bp, Homo sapiens
aaccgtgtttgtctcttctgg

SEQ ID NO: 556829 - DNA, 17 bp, Homo sapiens
aacctaaaagtattatt

SEQ ID NO: 556830 - DNA, 18 bp, Homo sapiens
aacctactgttcctttca

SEQ ID NO: 556831 - DNA, 18 bp, Homo sapiens
aacctcccctggtcctgc

SEQ ID NO: 556832 - DNA, 19 bp, Homo sapiens
aacctgacagcaaacacag

SEQ ID NO: 556833 - DNA, 21 bp, Homo sapiens
aacctgacagcaaacacagtc

SEQ ID NO: 556834 - DNA, 16 bp, Homo sapiens
aacctgtcttttggga

SEQ ID NO: 556835 - DNA, 21 bp, Homo sapiens
aacctttataggataactgat

SEQ ID NO: 556836 - DNA, 13 bp, Homo sapiens
aacctttccccca

SEQ ID NO: 556837 - DNA, 20 bp, Homo sapiens
aacgaccgtcttttgaaaac

SEQ ID NO: 556838 - DNA, 14 bp, Homo sapiens
aacgtctttttaag

SEQ ID NO: 556839 - DNA, 23 bp, Homo sapiens
aacgtctttttaagcctttgaag

SEQ ID NO: 556840 - DNA, 12 bp, Homo sapiens
aacgtgctgact

SEQ ID NO: 556841 - DNA, 22 bp, Homo sapiens
aacgtggggcagcacagagagg

SEQ ID NO: 556842 - DNA, 14 bp, Homo sapiens
aacgtgtatgtttt

SEQ ID NO: 556843 - DNA, 16 bp, Homo sapiens
aacgtgtgctgtgttt

SEQ ID NO: 556844 - DNA, 12 bp, Homo sapiens
aactaatgagtt

SEQ ID NO: 556845 - DNA, 22 bp, Homo sapiens
aactagcaaaaggatgatttaa

SEQ ID NO: 556846 - DNA, 13 bp, Homo sapiens
aactatatgtaca

SEQ ID NO: 556847 - DNA, 17 bp, Homo sapiens
aactatgtttaaagtaa

SEQ ID NO: 556848 - DNA, 20 bp, Homo sapiens
aactattgggtgaatatggt

SEQ ID NO: 556849 - DNA, 17 bp, Homo sapiens
aactcattttgcttgtg

SEQ ID NO: 556850 - DNA, 21 bp, Homo sapiens
aactccaacttagtgtctcta

SEQ ID NO: 556851 - DNA, 15 bp, Homo sapiens
aactccagacttggg

SEQ ID NO: 556852 - DNA, 14 bp, Homo sapiens
aactcccttcaaaa

SEQ ID NO: 556853 - DNA, 20 bp, Homo sapiens
aactctaagtgtttgctgca

SEQ ID NO: 556854 - DNA, 22 bp, Homo sapiens
aactctgatgtaaatgaagtaa

SEQ ID NO: 556855 - DNA, 14 bp, Homo sapiens
aactgatgctttca

SEQ ID NO: 556856 - DNA, 16 bp, Homo sapiens
aactgatgctttcaga

SEQ ID NO: 556857 - DNA, 19 bp, Homo sapiens
aactgatggcaatattaag

SEQ ID NO: 556858 - DNA, 16 bp, Homo sapiens
aactgcacatgatttc

SEQ ID NO: 556859 - DNA, 17 bp, Homo sapiens
aactgcacatgatttca

SEQ ID NO: 556860 - DNA, 19 bp, Homo sapiens
aactgcacatgatttcaca

SEQ ID NO: 556861 - DNA, 23 bp, Homo sapiens
aactgcacatgatttcacaaata

SEQ ID NO: 556862 - DNA, 22 bp, Homo sapiens
aactgcaccaccgaccaactcc

SEQ ID NO: 556863 - DNA, 19 bp, Homo sapiens
aactgctcttgggcaatat

SEQ ID NO: 556864 - DNA, 15 bp, Homo sapiens
aactggaataagaag

SEQ ID NO: 556865 - DNA, 18 bp, Homo sapiens
aactgtactttgattcac

SEQ ID NO: 556866 - DNA, 16 bp, Homo sapiens
aactgtatttacttgt

SEQ ID NO: 556867 - DNA, 15 bp, Homo sapiens
aactgtcattacaga

SEQ ID NO: 556868 - DNA, 19 bp, Homo sapiens
aactgtctagcacttcctt

SEQ ID NO: 556869 - DNA, 23 bp, Homo sapiens
aactgtgcaaagcagagtgaaat

SEQ ID NO: 556870 - DNA, 17 bp, Homo sapiens
aactgttaccattggaa

SEQ ID NO: 556871 - DNA, 19 bp, Homo sapiens
aactgttaccattggaaat

SEQ ID NO: 556872 - DNA, 21 bp, Homo sapiens
aacttacaagactgtaaattc

SEQ ID NO: 556873 - DNA, 15 bp, Homo sapiens
aacttagagcttttt

SEQ ID NO: 556874 - DNA, 18 bp, Homo sapiens
aacttagtgtctctattt

SEQ ID NO: 556875 - DNA, 22 bp, Homo sapiens
aacttagtgtctctatttatga

SEQ ID NO: 556876 - DNA, 18 bp, Homo sapiens
aacttcagaaacccggct

SEQ ID NO: 556877 - DNA, 12 bp, Homo sapiens
aacttcaggaaa

SEQ ID NO: 556878 - DNA, 16 bp, Homo sapiens
aacttccactttgtat

SEQ ID NO: 556879 - DNA, 19 bp, Homo sapiens
aacttccactttgtataaa

SEQ ID NO: 556880 - DNA, 16 bp, Homo sapiens
aacttctaaaactgta

SEQ ID NO: 556881 - DNA, 15 bp, Homo sapiens
aacttgcttaaatgt

SEQ ID NO: 556882 - DNA, 19 bp, Homo sapiens
aacttgttcttccaaagca

SEQ ID NO: 556883 - DNA, 14 bp, Homo sapiens
aactttaatatgta

SEQ ID NO: 556884 - DNA, 19 bp, Homo sapiens
aactttcaagaacttgttt

SEQ ID NO: 556885 - DNA, 21 bp, Homo sapiens
aactttcaagaacttgtttaa

SEQ ID NO: 556886 - DNA, 11 bp, Homo sapiens
aactttgaaat

SEQ ID NO: 556887 - DNA, 19 bp, Homo sapiens
aacttttatgcgcaaatac

SEQ ID NO: 556888 - DNA, 11 bp, Homo sapiens
aacttttcaaa

SEQ ID NO: 556889 - DNA, 13 bp, Homo sapiens
aacttttcaaaat

SEQ ID NO: 556890 - DNA, 18 bp, Homo sapiens
aacttttcaaaataaagc

SEQ ID NO: 556891 - DNA, 11 bp, Homo sapiens
aacttttgtag

SEQ ID NO: 556892 - DNA, 15 bp, Homo sapiens
aacttttgtagtctt

SEQ ID NO: 556893 - DNA, 16 bp, Homo sapiens
aacttttgtagtctta

SEQ ID NO: 556894 - DNA, 13 bp, Homo sapiens
aagaaaaagcaaa

SEQ ID NO: 556895 - DNA, 17 bp, Homo sapiens
aagaaaaagcaaaaggc

SEQ ID NO: 556896 - DNA, 22 bp, Homo sapiens
aagaaaagttcttaaaacacta

SEQ ID NO: 556897 - DNA, 11 bp, Homo sapiens
aagaaacattg

SEQ ID NO: 556898 - DNA, 16 bp, Homo sapiens
aagtaatataatggaa

SEQ ID NO: 556899 - DNA, 20 bp, Homo sapiens
aagtacaggtcatctgctgg

SEQ ID NO: 556900 - DNA, 14 bp, Homo sapiens
aagtaccacactga

SEQ ID NO: 556901 - DNA, 15 bp, Homo sapiens
aagtaccacactgag

SEQ ID NO: 556902 - DNA, 16 bp, Homo sapiens
aagtactgagcagtga

SEQ ID NO: 556903 - DNA, 23 bp, Homo sapiens
aagtagacttcatttttcctaac

SEQ ID NO: 556904 - DNA, 16 bp, Homo sapiens
aagtatcatctaaata

SEQ ID NO: 556905 - DNA, 21 bp, Homo sapiens
aagtatcatctaaatattatg

SEQ ID NO: 556906 - DNA, 21 bp, Homo sapiens
aagtatcgggggctggggcag

SEQ ID NO: 556907 - DNA, 15 bp, Homo sapiens
aagtcattttcatgt

SEQ ID NO: 556908 - DNA, 17 bp, Homo sapiens
aagtccagctctcccct

SEQ ID NO: 556909 - DNA, 16 bp, Homo sapiens
aagtctcttttttaca

SEQ ID NO: 556910 - DNA, 13 bp, Homo sapiens
aagtcttcatgaa

SEQ ID NO: 556911 - DNA, 22 bp, Homo sapiens
aagtcttcatgaaatgctatgt

SEQ ID NO: 556912 - DNA, 11 bp, Homo sapiens
aagtctttccc

SEQ ID NO: 556913 - DNA, 16 bp, Homo sapiens
aagtcttttaaaaagt

SEQ ID NO: 556914 - DNA, 19 bp, Homo sapiens
aagtcttttaaaaagtatt

SEQ ID NO: 556915 - DNA, 11 bp, Homo sapiens
aagtgaaattt

SEQ ID NO: 556916 - DNA, 15 bp, Homo sapiens
aagtgaaatttattg

SEQ ID NO: 556917 - DNA, 17 bp, Homo sapiens
aagtgcacacagaaata

SEQ ID NO: 556918 - DNA, 20 bp, Homo sapiens
aagtgcacacagaaatatat

SEQ ID NO: 556919 - DNA, 19 bp, Homo sapiens
aagtgccaaaataaagtct

SEQ ID NO: 556920 - DNA, 21 bp, Homo sapiens
aagtgcctctgattctatgta

SEQ ID NO: 556921 - DNA, 22 bp, Homo sapiens
aagtgcctctgattctatgtaa

SEQ ID NO: 556922 - DNA, 13 bp, Homo sapiens
aagtggactgtat

SEQ ID NO: 556923 - DNA, 13 bp, Homo sapiens
aagtggcacctgt

SEQ ID NO: 556924 - DNA, 17 bp, Homo sapiens
aagtggcacctgtctgc

SEQ ID NO: 556925 - DNA, 18 bp, Homo sapiens
aagtggcacctgtctgct

SEQ ID NO: 556926 - DNA, 15 bp, Homo sapiens
aagtgtaataatatg

SEQ ID NO: 556927 - DNA, 16 bp, Homo sapiens
aagtgtaataatatga

SEQ ID NO: 556928 - DNA, 16 bp, Homo sapiens
aagtgttctgttacaa

SEQ ID NO: 556929 - DNA, 17 bp, Homo sapiens
aagtgttctgttacaaa

SEQ ID NO: 556930 - DNA, 21 bp, Homo sapiens
aagtgttctgttacaaaatgt

SEQ ID NO: 556931 - DNA, 22 bp, Homo sapiens
aagtgttctgttacaaaatgta

SEQ ID NO: 556932 - DNA, 23 bp, Homo sapiens
aagtgttctgttacaaaatgtaa

SEQ ID NO: 556933 - DNA, 17 bp, Homo sapiens
aagtgtttcacagtgtc

SEQ ID NO: 556934 - DNA, 18 bp, Homo sapiens
aagttagatgttttagtt

SEQ ID NO: 556935 - DNA, 17 bp, Homo sapiens
aagttagcctttatcta

SEQ ID NO: 556936 - DNA, 21 bp, Homo sapiens
aagttagcctttatctaccaa

SEQ ID NO: 556937 - DNA, 22 bp, Homo sapiens
aagttctgcctctgatgtattt

SEQ ID NO: 556938 - DNA, 14 bp, Homo sapiens
aagttcttaaaaca

SEQ ID NO: 556939 - DNA, 20 bp, Homo sapiens
aagttggaaacactaaatgt

SEQ ID NO: 556940 - DNA, 22 bp, Homo sapiens
aagttgtatgatctgtgccttt

SEQ ID NO: 556941 - DNA, 18 bp, Homo sapiens
aagttgtgatctgttgta

SEQ ID NO: 556942 - DNA, 13 bp, Homo sapiens
aagtttaaagaag

SEQ ID NO: 556943 - DNA, 17 bp, Homo sapiens
aaaaagtgacacagcag

SEQ ID NO: 556944 - DNA, 17 bp, Homo sapiens
aaaaagttggtatttta

SEQ ID NO: 556945 - DNA, 21 bp, Homo sapiens
aaaaagttgtatgatctgtgc

SEQ ID NO: 556946 - DNA, 16 bp, Homo sapiens
aaaaatcagaaagaca

SEQ ID NO: 556947 - DNA, 20 bp, Homo sapiens
aaaaatcagtttttgttctt

SEQ ID NO: 556948 - DNA, 13 bp, Homo sapiens
aaaaatctgaaga

SEQ ID NO: 556949 - DNA, 17 bp, Homo sapiens
aaaaatgaaatttaagc

SEQ ID NO: 556950 - DNA, 19 bp, Homo sapiens
aaaaatgaaatttaagcac

SEQ ID NO: 556951 - DNA, 10 bp, Homo sapiens
aaaaatgcat

SEQ ID NO: 556952 - DNA, 21 bp, Homo sapiens
aaaaatgcatttaagttgtaa

SEQ ID NO: 556953 - DNA, 20 bp, Homo sapiens
aaaaattatctttaaaactt

SEQ ID NO: 556954 - DNA, 20 bp, Homo sapiens
aaaacagggtgggcaaactc

SEQ ID NO: 556955 - DNA, 11 bp, Homo sapiens
aaaacatttca

SEQ ID NO: 556956 - DNA, 18 bp, Homo sapiens
aaaacatttcatgtattt

SEQ ID NO: 556957 - DNA, 18 bp, Homo sapiens
aaaacatttggcagaaaa

SEQ ID NO: 556958 - DNA, 11 bp, Homo sapiens
aaaacattttt

SEQ ID NO: 556959 - DNA, 15 bp, Homo sapiens
aaaaccagaaagagg

SEQ ID NO: 556960 - DNA, 21 bp, Homo sapiens
aaaaccgtgtttgtctcttct

SEQ ID NO: 556961 - DNA, 23 bp, Homo sapiens
aaaaccgtgtttgtctcttctgg

SEQ ID NO: 556962 - DNA, 16 bp, Homo sapiens
aaaacggttaaaactg

SEQ ID NO: 556963 - DNA, 14 bp, Homo sapiens
aaaactacttagca

SEQ ID NO: 556964 - DNA, 19 bp, Homo sapiens
aaaactcaaccaaatggta

SEQ ID NO: 556965 - DNA, 22 bp, Homo sapiens
aaaactgctcctcctcctgtat

SEQ ID NO: 556966 - DNA, 17 bp, Homo sapiens
aaaactggaataagaag

SEQ ID NO: 556967 - DNA, 21 bp, Homo sapiens
aaaactggaataagaagcaaa

SEQ ID NO: 556968 - DNA, 17 bp, Homo sapiens
aaaactttgttaggcca

SEQ ID NO: 556969 - DNA, 9 bp, Homo sapiens
aaaagaaaa

SEQ ID NO: 556970 - DNA, 11 bp, Homo sapiens
aaaagaaaaac

SEQ ID NO: 556971 - DNA, 17 bp, Homo sapiens
aaaagataccttaaaat

SEQ ID NO: 556972 - DNA, 16 bp, Homo sapiens
aaaagcacctcttgaa

SEQ ID NO: 556973 - DNA, 15 bp, Homo sapiens
aaaagcccatgctta

SEQ ID NO: 556974 - DNA, 22 bp, Homo sapiens
aaaagtatcgggggctggggca

SEQ ID NO: 556975 - DNA, 19 bp, Homo sapiens
aaaagtcttttaaaaagta

SEQ ID NO: 556976 - DNA, 17 bp, Homo sapiens
aaaagtgacacagcagc

SEQ ID NO: 556977 - DNA, 14 bp, Homo sapiens
aaaagttggtattt

SEQ ID NO: 556978 - DNA, 16 bp, Homo sapiens
aaaagttggtatttta

SEQ ID NO: 556979 - DNA, 22 bp, Homo sapiens
aaaataaaaagtgacacagcag

SEQ ID NO: 556980 - DNA, 20 bp, Homo sapiens
aaaataaaccaaaggacatt

SEQ ID NO: 556981 - DNA, 11 bp, Homo sapiens
aaaataaagct

SEQ ID NO: 556982 - DNA, 18 bp, Homo sapiens
aaaataaagcttttgcat

SEQ ID NO: 556983 - DNA, 17 bp, Homo sapiens
aaaataaagtctgtcat

SEQ ID NO: 556984 - DNA, 22 bp, Homo sapiens
aaaataaatacaagtttgaaca

SEQ ID NO: 556985 - DNA, 15 bp, Homo sapiens
aaaatagttcccttt

SEQ ID NO: 556986 - DNA, 13 bp, Homo sapiens
aaaatataaaata

SEQ ID NO: 556987 - DNA, 14 bp, Homo sapiens
aaaatatttgtgaa

SEQ ID NO: 556988 - DNA, 17 bp, Homo sapiens
aaaatatttttttttct

SEQ ID NO: 556989 - DNA, 12 bp, Homo sapiens
aaaatcagtttt

SEQ ID NO: 556990 - DNA, 21 bp, Homo sapiens
aaaatcagtttttgttcttaa

SEQ ID NO: 556991 - DNA, 21 bp, Homo sapiens
aaaatccagaaacttgttctt

SEQ ID NO: 556992 - DNA, 22 bp, Homo sapiens
aaaatccagaaacttgttcttc

SEQ ID NO: 556993 - DNA, 22 bp, Homo sapiens
aaaatcccattgtatttaaaac

SEQ ID NO: 556994 - DNA, 13 bp, Homo sapiens
aaaatctgaagat

SEQ ID NO: 556995 - DNA, 14 bp, Homo sapiens
aaaatctgaagatt

SEQ ID NO: 556996 - DNA, 20 bp, Homo sapiens
aaaatgattgtctttttcct

SEQ ID NO: 556997 - DNA, 13 bp, Homo sapiens
aaaatgcatttaa

SEQ ID NO: 556998 - DNA, 15 bp, Homo sapiens
aaaatgcatttaagt

SEQ ID NO: 556999 - DNA, 18 bp, Homo sapiens
aaaatgcatttaagttgt

SEQ ID NO: 557000 - DNA, 15 bp, Homo sapiens
aaaatgcttgaccct

SEQ ID NO: 557001 - DNA, 19 bp, Homo sapiens
aaaatggcaacaaactgca

SEQ ID NO: 557002 - DNA, 15 bp, Homo sapiens
aaaatggcatttagc

SEQ ID NO: 557003 - DNA, 18 bp, Homo sapiens
aaaatggcatttagcaca

SEQ ID NO: 557004 - DNA, 18 bp, Homo sapiens
aaaatgtaactgttacca

SEQ ID NO: 557005 - DNA, 15 bp, Homo sapiens
aaaatgtcactgtta

SEQ ID NO: 557006 - DNA, 22 bp, Homo sapiens
aaaatgtcactgttataaattt

SEQ ID NO: 557007 - DNA, 19 bp, Homo sapiens
aaaatgtgtgcttggaaaa

SEQ ID NO: 557008 - DNA, 22 bp, Homo sapiens
aaaatgttcatcaattcccatt

SEQ ID NO: 557009 - DNA, 19 bp, Homo sapiens
aaaattattgattgctttt

SEQ ID NO: 557010 - DNA, 14 bp, Homo sapiens
aaaattcatttcac

SEQ ID NO: 557011 - DNA, 15 bp, Homo sapiens
aaaattcctatctca

SEQ ID NO: 557012 - DNA, 15 bp, Homo sapiens
aaaatttaacatctg

SEQ ID NO: 557013 - DNA, 12 bp, Homo sapiens
aaaatttgaaac

SEQ ID NO: 557014 - DNA, 14 bp, Homo sapiens
aaaatttgaaacat

SEQ ID NO: 557015 - DNA, 15 bp, Homo sapiens
aaaatttgaaacatt

SEQ ID NO: 557016 - DNA, 13 bp, Homo sapiens
aaaattttaagct

SEQ ID NO: 557017 - DNA, 13 bp, Homo sapiens
aaaattttataag

SEQ ID NO: 557018 - DNA, 19 bp, Homo sapiens
aaaattttattgaatataa

SEQ ID NO: 557019 - DNA, 15 bp, Homo sapiens
aaacaagcatataaa

SEQ ID NO: 557020 - DNA, 20 bp, Homo sapiens
aaacaaggggctgttacata

SEQ ID NO: 557021 - DNA, 13 bp, Homo sapiens
aaacaattcaaag

SEQ ID NO: 557022 - DNA, 22 bp, Homo sapiens
aaacacaaatacggaagtaaac

SEQ ID NO: 557023 - DNA, 15 bp, Homo sapiens
aaacactaaatgtta

SEQ ID NO: 557024 - DNA, 19 bp, Homo sapiens
aaacactaaatgttaaaga

SEQ ID NO: 557025 - DNA, 14 bp, Homo sapiens
aaacagataccata

SEQ ID NO: 557026 - DNA, 14 bp, Homo sapiens
aaacagatgctctg

SEQ ID NO: 557027 - DNA, 15 bp, Homo sapiens
aaacaggcacaggct

SEQ ID NO: 557028 - DNA, 14 bp, Homo sapiens
aaacatagacagat

SEQ ID NO: 557029 - DNA, 21 bp, Homo sapiens
aaacatagacagatgtggaca

SEQ ID NO: 557030 - DNA, 13 bp, Homo sapiens
aaacatctcctta

SEQ ID NO: 557031 - DNA, 15 bp, Homo sapiens
aaacattaaatgtct

SEQ ID NO: 557032 - DNA, 24 bp, Homo sapiens
aaacattaatgttgatttctagtt

SEQ ID NO: 557033 - DNA, 17 bp, Homo sapiens
aaacattagtactttat

SEQ ID NO: 557034 - DNA, 13 bp, Homo sapiens
aaaccaaaggaca

SEQ ID NO: 557035 - DNA, 16 bp, Homo sapiens
aaaccaatttcttcct

SEQ ID NO: 557036 - DNA, 17 bp, Homo sapiens
aaaccaatttcttcctt

SEQ ID NO: 557037 - DNA, 18 bp, Homo sapiens
aaaccaatttcttccttc

SEQ ID NO: 557038 - DNA, 20 bp, Homo sapiens
aaaccaatttcttccttcca

SEQ ID NO: 557039 - DNA, 12 bp, Homo sapiens
aaacccaaagat

SEQ ID NO: 557040 - DNA, 14 bp, Homo sapiens
aaacccaaagatgt

SEQ ID NO: 557041 - DNA, 23 bp, Homo sapiens
aaacccaagttatgcatccccat

SEQ ID NO: 557042 - DNA, 17 bp, Homo sapiens
aaaccctgtcaaacatt

SEQ ID NO: 557043 - DNA, 20 bp, Homo sapiens
aaaccgaggacccatgaaac

SEQ ID NO: 557044 - DNA, 21 bp, Homo sapiens
aaaccgtgtttgtctcttctg

SEQ ID NO: 557045 - DNA, 17 bp, Homo sapiens
aaacctgaacaaaccct

SEQ ID NO: 557046 - DNA, 11 bp, Homo sapiens
aaacctggaga

SEQ ID NO: 557047 - DNA, 12 bp, Homo sapiens
aaacctggagat

SEQ ID NO: 557048 - DNA, 19 bp, Homo sapiens
aaaccttgctgctatgctg

SEQ ID NO: 557049 - DNA, 12 bp, Homo sapiens
aaacctttcccc

SEQ ID NO: 557050 - DNA, 17 bp, Homo sapiens
aaacgtctttttaagcc

SEQ ID NO: 557051 - DNA, 16 bp, Homo sapiens
aaacgtgtatgttttt

SEQ ID NO: 557052 - DNA, 20 bp, Homo sapiens
aaacgtgtatgtttttcagt

SEQ ID NO: 557053 - DNA, 16 bp, Homo sapiens
aaactactgaataaat

SEQ ID NO: 557054 - DNA, 17 bp, Homo sapiens
aaactatcagcagcggc

SEQ ID NO: 557055 - DNA, 22 bp, Homo sapiens
aaactcaaccaaatggtacaaa

SEQ ID NO: 557056 - DNA, 12 bp, Homo sapiens
aaactgcacatg

SEQ ID NO: 557057 - DNA, 17 bp, Homo sapiens
aaactgcacatgatttc

SEQ ID NO: 557058 - DNA, 20 bp, Homo sapiens
aaactgcacatgatttcaca

SEQ ID NO: 557059 - DNA, 14 bp, Homo sapiens
aaactgtactttga

SEQ ID NO: 557060 - DNA, 18 bp, Homo sapiens
aaactgtactttgattca

SEQ ID NO: 557061 - DNA, 20 bp, Homo sapiens
aaactgtactttgattcaca

SEQ ID NO: 557062 - DNA, 22 bp, Homo sapiens
aaactgtactttgattcacatg

SEQ ID NO: 557063 - DNA, 20 bp, Homo sapiens
aaactgtatttacttgttat

SEQ ID NO: 557064 - DNA, 12 bp, Homo sapiens
aaacttcagaga

SEQ ID NO: 557065 - DNA, 18 bp, Homo sapiens
aaacttcagagaaattat

SEQ ID NO: 557066 - DNA, 19 bp, Homo sapiens
aaacttcagagaaattatg

SEQ ID NO: 557067 - DNA, 15 bp, Homo sapiens
aaagaaatctataga

SEQ ID NO: 557068 - DNA, 15 bp, Homo sapiens
aaagaaatgcacaat

SEQ ID NO: 557069 - DNA, 17 bp, Homo sapiens
aaagaaatgcacaatgt

SEQ ID NO: 557070 - DNA, 16 bp, Homo sapiens
aaagaactatcttcat

SEQ ID NO: 557071 - DNA, 18 bp, Homo sapiens
aaagacaaatagtaggca

SEQ ID NO: 557072 - DNA, 14 bp, Homo sapiens
aaagacatgaaatt

SEQ ID NO: 557073 - DNA, 12 bp, Homo sapiens
aaagagaaaaaa

SEQ ID NO: 557074 - DNA, 12 bp, Homo sapiens
aaagagcaggat

SEQ ID NO: 557075 - DNA, 17 bp, Homo sapiens
aaagataccttaaaatt

SEQ ID NO: 557076 - DNA, 15 bp, Homo sapiens
aactttaatatgtat

SEQ ID NO: 557077 - DNA, 16 bp, Homo sapiens
aactttaatatgtatt

SEQ ID NO: 557078 - DNA, 17 bp, Homo sapiens
aactttctcagcatata

SEQ ID NO: 557079 - DNA, 18 bp, Homo sapiens
aactttctcagcatatat

SEQ ID NO: 557080 - DNA, 19 bp, Homo sapiens
aactttctcagcatatata

SEQ ID NO: 557081 - DNA, 21 bp, Homo sapiens
aactttctcagcatatatata

SEQ ID NO: 557082 - DNA, 20 bp, Homo sapiens
aactttgttaggccaaagac

SEQ ID NO: 557083 - DNA, 21 bp, Homo sapiens
aacttttccaacatacaattt

SEQ ID NO: 557084 - DNA, 21 bp, Homo sapiens
aacttttgtagtcttatgaat

SEQ ID NO: 557085 - DNA, 17 bp, Homo sapiens
aacttttttttcttttt

SEQ ID NO: 557086 - DNA, 18 bp, Homo sapiens
aacttttttttctttttt

SEQ ID NO: 557087 - DNA, 13 bp, Homo sapiens
aagaaaaatttct

SEQ ID NO: 557088 - DNA, 15 bp, Homo sapiens
aagaaaaatttctgg

SEQ ID NO: 557089 - DNA, 18 bp, Homo sapiens
aagaaaagttcttaaaac

SEQ ID NO: 557090 - DNA, 21 bp, Homo sapiens
aagaaaagttcttaaaacact

SEQ ID NO: 557091 - DNA, 13 bp, Homo sapiens
aagaaagcagaat

SEQ ID NO: 557092 - DNA, 21 bp, Homo sapiens
aagaacaattgtccatggtct

SEQ ID NO: 557093 - DNA, 14 bp, Homo sapiens
aagaactatcttca

SEQ ID NO: 557094 - DNA, 12 bp, Homo sapiens
aagaacttgttt

SEQ ID NO: 557095 - DNA, 14 bp, Homo sapiens
aagaacttgtttaa

SEQ ID NO: 557096 - DNA, 12 bp, Homo sapiens
aagaagagatgc

SEQ ID NO: 557097 - DNA, 16 bp, Homo sapiens
aagaagcaaataaata

SEQ ID NO: 557098 - DNA, 19 bp, Homo sapiens
aagaagcccgatccacatt

SEQ ID NO: 557099 - DNA, 21 bp, Homo sapiens
aagaataggacttgtttttgt

SEQ ID NO: 557100 - DNA, 22 bp, Homo sapiens
aagaatattcagagaatatcaa

SEQ ID NO: 557101 - DNA, 14 bp, Homo sapiens
aagaattttttatt

SEQ ID NO: 557102 - DNA, 16 bp, Homo sapiens
aagaattttttatttt

SEQ ID NO: 557103 - DNA, 14 bp, Homo sapiens
aagacaaatacaca

SEQ ID NO: 557104 - DNA, 15 bp, Homo sapiens
aagacaaatacacat

SEQ ID NO: 557105 - DNA, 23 bp, Homo sapiens
aagacacaggggacacccagaaa

SEQ ID NO: 557106 - DNA, 19 bp, Homo sapiens
aagacatgttgtaaattag

SEQ ID NO: 557107 - DNA, 19 bp, Homo sapiens
aagaccctatctcccacaa

SEQ ID NO: 557108 - DNA, 14 bp, Homo sapiens
aagactccagaaat

SEQ ID NO: 557109 - DNA, 20 bp, Homo sapiens
aagacttcatttaacactga

SEQ ID NO: 557110 - DNA, 15 bp, Homo sapiens
aagagaaaaagccct

SEQ ID NO: 557111 - DNA, 11 bp, Homo sapiens
aagagaaatct

SEQ ID NO: 557112 - DNA, 16 bp, Homo sapiens
aagagaaccgagcaaa

SEQ ID NO: 557113 - DNA, 21 bp, Homo sapiens
aagagaaccgagcaaagatca

SEQ ID NO: 557114 - DNA, 20 bp, Homo sapiens
aagagagatatatctgaaaa

SEQ ID NO: 557115 - DNA, 14 bp, Homo sapiens
aagagatttatctt

SEQ ID NO: 557116 - DNA, 18 bp, Homo sapiens
aagagattttatgtttaa

SEQ ID NO: 557117 - DNA, 21 bp, Homo sapiens
aagagcaggatagctcttcct

SEQ ID NO: 557118 - DNA, 13 bp, Homo sapiens
aagagctaggcag

SEQ ID NO: 557119 - DNA, 22 bp, Homo sapiens
aagaggcagttgcccagcctct

SEQ ID NO: 557120 - DNA, 19 bp, Homo sapiens
aagagtaacacttgaaaag

SEQ ID NO: 557121 - DNA, 20 bp, Homo sapiens
aagagtaacacttgaaaagt

SEQ ID NO: 557122 - DNA, 13 bp, Homo sapiens
aagagtagaaaag

SEQ ID NO: 557123 - DNA, 15 bp, Homo sapiens
aagagtgaagagcat

SEQ ID NO: 557124 - DNA, 16 bp, Homo sapiens
aagagtgaagagcatt

SEQ ID NO: 557125 - DNA, 14 bp, Homo sapiens
aagagtgatgcctg

SEQ ID NO: 557126 - DNA, 19 bp, Homo sapiens
aagagtttgccttataaat

SEQ ID NO: 557127 - DNA, 21 bp, Homo sapiens
aagataattaaatgaaatact

SEQ ID NO: 557128 - DNA, 17 bp, Homo sapiens
aagataccttaaaattt

SEQ ID NO: 557129 - DNA, 20 bp, Homo sapiens
aagataccttaaaatttgaa

SEQ ID NO: 557130 - DNA, 23 bp, Homo sapiens
aagataccttaaaatttgaaaca

SEQ ID NO: 557131 - DNA, 22 bp, Homo sapiens
aagatattgtatctcctttaat

SEQ ID NO: 557132 - DNA, 18 bp, Homo sapiens
aagatctttttttaagtg

SEQ ID NO: 557133 - DNA, 22 bp, Homo sapiens
aagatgaatggtctggcaatat

SEQ ID NO: 557134 - DNA, 14 bp, Homo sapiens
aagatgctgctgag

SEQ ID NO: 557135 - DNA, 15 bp, Homo sapiens
aagatgtaagaagct

SEQ ID NO: 557136 - DNA, 18 bp, Homo sapiens
aagatgttaacagtattt

SEQ ID NO: 557137 - DNA, 20 bp, Homo sapiens
aagattgaagctaaaacact

SEQ ID NO: 557138 - DNA, 13 bp, Homo sapiens
aagattgtttatc

SEQ ID NO: 557139 - DNA, 15 bp, Homo sapiens
aagattgtttatcta

SEQ ID NO: 557140 - DNA, 20 bp, Homo sapiens
aagcaaaaacgaaagctggg

SEQ ID NO: 557141 - DNA, 12 bp, Homo sapiens
aagcaaaatatt

SEQ ID NO: 557142 - DNA, 16 bp, Homo sapiens
aagcaaataaatatca

SEQ ID NO: 557143 - DNA, 20 bp, Homo sapiens
aagcaaatttcaaaagacat

SEQ ID NO: 557144 - DNA, 22 bp, Homo sapiens
aagcaaatttcaaaagacatgt

SEQ ID NO: 557145 - DNA, 20 bp, Homo sapiens
aagcaaatttctagatatga

SEQ ID NO: 557146 - DNA, 12 bp, Homo sapiens
aagcaacaattt

SEQ ID NO: 557147 - DNA, 13 bp, Homo sapiens
aagcaacaatttt

SEQ ID NO: 557148 - DNA, 22 bp, Homo sapiens
aagcaacaattttcagatttgc

SEQ ID NO: 557149 - DNA, 14 bp, Homo sapiens
aagcaacagctgga

SEQ ID NO: 557150 - DNA, 16 bp, Homo sapiens
aagcaacagctggaca

SEQ ID NO: 557151 - DNA, 23 bp, Homo sapiens
aagcaagaccatggggtggaagg

SEQ ID NO: 557152 - DNA, 19 bp, Homo sapiens
aagcacaaaaaatttaaga

SEQ ID NO: 557153 - DNA, 19 bp, Homo sapiens
aagcacagacaattctaat

SEQ ID NO: 557154 - DNA, 22 bp, Homo sapiens
aagcacagacaattctaatggt

SEQ ID NO: 557155 - DNA, 17 bp, Homo sapiens
aagcacatgcttagctt

SEQ ID NO: 557156 - DNA, 21 bp, Homo sapiens
aagcacctcttgaagaactga

SEQ ID NO: 557157 - DNA, 20 bp, Homo sapiens
aagcagacacacacatatat

SEQ ID NO: 557158 - DNA, 22 bp, Homo sapiens
aagcagcagctagaaagagaaa

SEQ ID NO: 557159 - DNA, 14 bp, Homo sapiens
aagcaggttaaatg

SEQ ID NO: 557160 - DNA, 15 bp, Homo sapiens
aagcaggttaaatgt

SEQ ID NO: 557161 - DNA, 18 bp, Homo sapiens
aagcaggttaaatgtttt

SEQ ID NO: 557162 - DNA, 21 bp, Homo sapiens
aagcaggttaaatgttttgta

SEQ ID NO: 557163 - DNA, 16 bp, Homo sapiens
aagcatagacgtctca

SEQ ID NO: 557164 - DNA, 17 bp, Homo sapiens
aagcatataaaatggca

SEQ ID NO: 557165 - DNA, 20 bp, Homo sapiens
aagcatctaaactttaatat

SEQ ID NO: 557166 - DNA, 16 bp, Homo sapiens
aagcctgctccttccc

SEQ ID NO: 557167 - DNA, 12 bp, Homo sapiens
aagcctttgaag

SEQ ID NO: 557168 - DNA, 14 bp, Homo sapiens
aagcgaaaaactca

SEQ ID NO: 557169 - DNA, 13 bp, Homo sapiens
aagctaaaacact

SEQ ID NO: 557170 - DNA, 19 bp, Homo sapiens
aagctaggaaaagaaatct

SEQ ID NO: 557171 - DNA, 23 bp, Homo sapiens
aagctaggaaaagaaatctatag

SEQ ID NO: 557172 - DNA, 15 bp, Homo sapiens
aagctaggtgctaat

SEQ ID NO: 557173 - DNA, 14 bp, Homo sapiens
ttccatgtatgcat

SEQ ID NO: 557174 - DNA, 15 bp, Homo sapiens
ttcccaaatctcaaa

SEQ ID NO: 557175 - DNA, 21 bp, Homo sapiens
ttcccaacctcccctggtcct

SEQ ID NO: 557176 - DNA, 14 bp, Homo sapiens
ttcccactcttctc

SEQ ID NO: 557177 - DNA, 20 bp, Homo sapiens
ttcccattgcatcacctctg

SEQ ID NO: 557178 - DNA, 22 bp, Homo sapiens
ttccccttgggatgggcacagg

SEQ ID NO: 557179 - DNA, 18 bp, Homo sapiens
ttccctcagccctcatta

SEQ ID NO: 557180 - DNA, 14 bp, Homo sapiens
ttccctctctcact

SEQ ID NO: 557181 - DNA, 15 bp, Homo sapiens
ttccctgacactgtc

SEQ ID NO: 557182 - DNA, 22 bp, Homo sapiens
ttccctgacactgtctgctgcc

SEQ ID NO: 557183 - DNA, 14 bp, Homo sapiens
ttcccttcctccat

SEQ ID NO: 557184 - DNA, 19 bp, Homo sapiens
ttccgtcacatcccacccc

SEQ ID NO: 557185 - DNA, 15 bp, Homo sapiens
ttcctaaggcatgtg

SEQ ID NO: 557186 - DNA, 19 bp, Homo sapiens
ttcctactcttctctctgc

SEQ ID NO: 557187 - DNA, 21 bp, Homo sapiens
ttcctactcttctctctgctc

SEQ ID NO: 557188 - DNA, 21 bp, Homo sapiens
ttcctatgaagttggcacatt

SEQ ID NO: 557189 - DNA, 14 bp, Homo sapiens
ttcctccatcctcc

SEQ ID NO: 557190 - DNA, 15 bp, Homo sapiens
ttcctccctgggggc

SEQ ID NO: 557191 - DNA, 15 bp, Homo sapiens
ttcctcgcttctttc

SEQ ID NO: 557192 - DNA, 14 bp, Homo sapiens
ttcctctgctcccc

SEQ ID NO: 557193 - DNA, 15 bp, Homo sapiens
ttcctgaactcccag

SEQ ID NO: 557194 - DNA, 16 bp, Homo sapiens
ttcctgattggtttct

SEQ ID NO: 557195 - DNA, 20 bp, Homo sapiens
ttcctgattggtttctcttc

SEQ ID NO: 557196 - DNA, 15 bp, Homo sapiens
ttcctgctacagtag

SEQ ID NO: 557197 - DNA, 22 bp, Homo sapiens
ttcctgtgctaagtctttccca

SEQ ID NO: 557198 - DNA, 13 bp, Homo sapiens
ttcctgtttcaag

SEQ ID NO: 557199 - DNA, 19 bp, Homo sapiens
ttccttccacagttatctt

SEQ ID NO: 557200 - DNA, 20 bp, Homo sapiens
ttccttctttgccctttact

SEQ ID NO: 557201 - DNA, 23 bp, Homo sapiens
ttccttgaggggagccaggaggg

SEQ ID NO: 557202 - DNA, 14 bp, Homo sapiens
ttccttgccagtct

SEQ ID NO: 557203 - DNA, 15 bp, Homo sapiens
ttccttgccagtctt

SEQ ID NO: 557204 - DNA, 15 bp, Homo sapiens
ttcctttttctattt

SEQ ID NO: 557205 - DNA, 14 bp, Homo sapiens
ttcgccgtggctgc

SEQ ID NO: 557206 - DNA, 11 bp, Homo sapiens
ttcgggaagaa

SEQ ID NO: 557207 - DNA, 13 bp, Homo sapiens
ttctaaaagaata

SEQ ID NO: 557208 - DNA, 20 bp, Homo sapiens
ttctaaactaggctccttca

SEQ ID NO: 557209 - DNA, 20 bp, Homo sapiens
ttctaaagccacgctgtgtc

SEQ ID NO: 557210 - DNA, 20 bp, Homo sapiens
ttggaacaacgcataggaaa

SEQ ID NO: 557211 - DNA, 19 bp, Homo sapiens
ttggaacagtaatcagttt

SEQ ID NO: 557212 - DNA, 22 bp, Homo sapiens
ttggacggggacacggcctctg

SEQ ID NO: 557213 - DNA, 16 bp, Homo sapiens
ttggagttcattcata

SEQ ID NO: 557214 - DNA, 21 bp, Homo sapiens
ttggagttcattcatattaca

SEQ ID NO: 557215 - DNA, 13 bp, Homo sapiens
ttggattttatgt

SEQ ID NO: 557216 - DNA, 24 bp, Homo sapiens
ttggattttatgttgacatttgtt

SEQ ID NO: 557217 - DNA, 15 bp, Homo sapiens
ttggcaccaataaag

SEQ ID NO: 557218 - DNA, 21 bp, Homo sapiens
ttggcagatgcagctcttcct

SEQ ID NO: 557219 - DNA, 20 bp, Homo sapiens
ttggcaggtaggaatattat

SEQ ID NO: 557220 - DNA, 19 bp, Homo sapiens
ttggcatggatttctgtct

SEQ ID NO: 557221 - DNA, 21 bp, Homo sapiens
ttggccataagcaacaatttt

SEQ ID NO: 557222 - DNA, 19 bp, Homo sapiens
ttggctgccaagagtccaa

SEQ ID NO: 557223 - DNA, 12 bp, Homo sapiens
ttgggaggctga

SEQ ID NO: 557224 - DNA, 20 bp, Homo sapiens
ttgggctgggacttcttacc

SEQ ID NO: 557225 - DNA, 16 bp, Homo sapiens
ttggggatgtttttct

SEQ ID NO: 557226 - DNA, 15 bp, Homo sapiens
ttgggtgatcattca

SEQ ID NO: 557227 - DNA, 17 bp, Homo sapiens
ttggtaacttgctgtga

SEQ ID NO: 557228 - DNA, 17 bp, Homo sapiens
ttggtatatccttttct

SEQ ID NO: 557229 - DNA, 14 bp, Homo sapiens
ttggtctctatttc

SEQ ID NO: 557230 - DNA, 18 bp, Homo sapiens
ttggtgggtgaaaggaat

SEQ ID NO: 557231 - DNA, 20 bp, Homo sapiens
ttggttatagtgcaatatat

SEQ ID NO: 557232 - DNA, 16 bp, Homo sapiens
ttggtttctcttctcc

SEQ ID NO: 557233 - DNA, 16 bp, Homo sapiens
ttggtttgtgggtcca

SEQ ID NO: 557234 - DNA, 13 bp, Homo sapiens
ttgtaaacgtctt

SEQ ID NO: 557235 - DNA, 18 bp, Homo sapiens
ttgtaaactttgaaatat

SEQ ID NO: 557236 - DNA, 19 bp, Homo sapiens
ttgtaaactttgaaatata

SEQ ID NO: 557237 - DNA, 19 bp, Homo sapiens
ttgtaaagatattgtatct

SEQ ID NO: 557238 - DNA, 20 bp, Homo sapiens
ttgtaaagatattgtatctc

SEQ ID NO: 557239 - DNA, 23 bp, Homo sapiens
ttgtaaagatattgtatctcctt

SEQ ID NO: 557240 - DNA, 20 bp, Homo sapiens
ttgtaaattaggaggctcaa

SEQ ID NO: 557241 - DNA, 20 bp, Homo sapiens
ttgtaatttgggaacataaa

SEQ ID NO: 557242 - DNA, 23 bp, Homo sapiens
ttgtacatttttgatcaaatgta

SEQ ID NO: 557243 - DNA, 21 bp, Homo sapiens
ttgtagtcttatgaatagaca

SEQ ID NO: 557244 - DNA, 22 bp, Homo sapiens
ttgtataaatgtatatacacat

SEQ ID NO: 557245 - DNA, 18 bp, Homo sapiens
ttgtataagatgctgctg

SEQ ID NO: 557246 - DNA, 15 bp, Homo sapiens
ttgtataattatgaa

SEQ ID NO: 557247 - DNA, 14 bp, Homo sapiens
ttgtatatatatgt

SEQ ID NO: 557248 - DNA, 15 bp, Homo sapiens
ttgtatatatatgtg

SEQ ID NO: 557249 - DNA, 16 bp, Homo sapiens
ttgtatatatatgtga

SEQ ID NO: 557250 - DNA, 22 bp, Homo sapiens
ttgtatgcaagcagtttcaata

SEQ ID NO: 557251 - DNA, 24 bp, Homo sapiens
ttgtatgcaagcagtttcaataaa

SEQ ID NO: 557252 - DNA, 19 bp, Homo sapiens
ttgtatttaaaacatttca

SEQ ID NO: 557253 - DNA, 22 bp, Homo sapiens
ttgtatttaaaacatttcatgt

SEQ ID NO: 557254 - DNA, 15 bp, Homo sapiens
ttgtcacctgcttct

SEQ ID NO: 557255 - DNA, 14 bp, Homo sapiens
ttgtcactgcttca

SEQ ID NO: 557256 - DNA, 14 bp, Homo sapiens
ttgtcattttcatt

SEQ ID NO: 557257 - DNA, 19 bp, Homo sapiens
ttgtcattttcattagcaa

SEQ ID NO: 557258 - DNA, 20 bp, Homo sapiens
ttgtcattttcattagcaaa

SEQ ID NO: 557259 - DNA, 18 bp, Homo sapiens
ttgtccagagctgcttcc

SEQ ID NO: 557260 - DNA, 19 bp, Homo sapiens
ttgtcctcctgctgccagt

SEQ ID NO: 557261 - DNA, 16 bp, Homo sapiens
ttgtcctttatgtatt

SEQ ID NO: 557262 - DNA, 17 bp, Homo sapiens
ttgtcctttatgtattc

SEQ ID NO: 557263 - DNA, 15 bp, Homo sapiens
ttgtctgaaacatag

SEQ ID NO: 557264 - DNA, 20 bp, Homo sapiens
ttgtctgccccaagttttgt

SEQ ID NO: 557265 - DNA, 21 bp, Homo sapiens
ttgtctgccccaagttttgtg

SEQ ID NO: 557266 - DNA, 15 bp, Homo sapiens
ttgtgaaatttttca

SEQ ID NO: 557267 - DNA, 19 bp, Homo sapiens
ttgtgaaatttttcatatt

SEQ ID NO: 557268 - DNA, 23 bp, Homo sapiens
ttgtgaaatttttcatattttaa

SEQ ID NO: 557269 - DNA, 22 bp, Homo sapiens
ttgtgagtttgtttctttgaat

SEQ ID NO: 557270 - DNA, 14 bp, Homo sapiens
ttgtgatctgtcct

SEQ ID NO: 557271 - DNA, 13 bp, Homo sapiens
ttgtgatctgttg

SEQ ID NO: 557272 - DNA, 15 bp, Homo sapiens
ttgtggataagaaaa

SEQ ID NO: 557273 - DNA, 20 bp, Homo sapiens
ttgtgtaatttcctgctcct

SEQ ID NO: 557274 - DNA, 17 bp, Homo sapiens
ttgtgtgggtttactct

SEQ ID NO: 557275 - DNA, 17 bp, Homo sapiens
ttgttaatgtgatggat

SEQ ID NO: 557276 - DNA, 17 bp, Homo sapiens
ttgttaattcctatgaa

SEQ ID NO: 557277 - DNA, 20 bp, Homo sapiens
ttgttaatttatctgttgtc

SEQ ID NO: 557278 - DNA, 12 bp, Homo sapiens
ttgttaatttct

SEQ ID NO: 557279 - DNA, 22 bp, Homo sapiens
ttgttaatttcttgcaatttga

SEQ ID NO: 557280 - DNA, 13 bp, Homo sapiens
ttgttaatttgga

SEQ ID NO: 557281 - DNA, 21 bp, Homo sapiens
ttgttaggccaaagacaaata

SEQ ID NO: 557282 - DNA, 21 bp, Homo sapiens
ttgttcatttcatcctttcac

SEQ ID NO: 557283 - DNA, 12 bp, Homo sapiens
ttgttccagaga

SEQ ID NO: 557284 - DNA, 11 bp, Homo sapiens
ttgttccagtt

SEQ ID NO: 557285 - DNA, 12 bp, Homo sapiens
ttgttcttacag

SEQ ID NO: 557286 - DNA, 14 bp, Homo sapiens
ttgttcttccaaag

SEQ ID NO: 557287 - DNA, 18 bp, Homo sapiens
ttgttcttccaaagcaga

SEQ ID NO: 557288 - DNA, 14 bp, Homo sapiens
ttgttgcactgaag

SEQ ID NO: 557289 - DNA, 21 bp, Homo sapiens
ttgtttggttatagtgcaata

SEQ ID NO: 557290 - DNA, 16 bp, Homo sapiens
ttgttttgcttcccct

SEQ ID NO: 557291 - DNA, 12 bp, Homo sapiens
ttgttttttcat

SEQ ID NO: 557292 - DNA, 12 bp, Homo sapiens
tttaaaacattt

SEQ ID NO: 557293 - DNA, 16 bp, Homo sapiens
tttaaaacatttcatg

SEQ ID NO: 557294 - DNA, 16 bp, Homo sapiens
tttaaaactacttagc

SEQ ID NO: 557295 - DNA, 16 bp, Homo sapiens
tttaaaagaaatttat

SEQ ID NO: 557296 - DNA, 12 bp, Homo sapiens
tttaaaatactg

SEQ ID NO: 557297 - DNA, 15 bp, Homo sapiens
tttaaaatactgtag

SEQ ID NO: 557298 - DNA, 17 bp, Homo sapiens
tttaaaatactgtagat

SEQ ID NO: 557299 - DNA, 16 bp, Homo sapiens
tttaaaatcttattaa

SEQ ID NO: 557300 - DNA, 13 bp, Homo sapiens
tttaaacaaatgg

SEQ ID NO: 557301 - DNA, 21 bp, Homo sapiens
tttaaagaaaagttcttaaaa

SEQ ID NO: 557302 - DNA, 15 bp, Homo sapiens
tttaaattgtggatg

SEQ ID NO: 557303 - DNA, 11 bp, Homo sapiens
tttaacagaaa

SEQ ID NO: 557304 - DNA, 18 bp, Homo sapiens
tttaacagaaaaatgaaa

SEQ ID NO: 557305 - DNA, 23 bp, Homo sapiens
tttaacattcttggtcacaaagc

SEQ ID NO: 557306 - DNA, 12 bp, Homo sapiens
tttaacttttga

SEQ ID NO: 557307 - DNA, 13 bp, Homo sapiens
tttaagagagaaa

SEQ ID NO: 557308 - DNA, 14 bp, Homo sapiens
tttaagagatttta

SEQ ID NO: 557309 - DNA, 14 bp, Homo sapiens
tttaagcagaattg

SEQ ID NO: 557310 - DNA, 18 bp, Homo sapiens
tttaagcagaattggaaa

SEQ ID NO: 557311 - DNA, 18 bp, Homo sapiens
tttaagcctttgaagtgc

SEQ ID NO: 557312 - DNA, 20 bp, Homo sapiens
tttaagcctttgaagtgcct

SEQ ID NO: 557313 - DNA, 20 bp, Homo sapiens
tttaagctaggaaaagaaat

SEQ ID NO: 557314 - DNA, 23 bp, Homo sapiens
tttaagctaggaaaagaaatcta

SEQ ID NO: 557315 - DNA, 18 bp, Homo sapiens
tttaagtgtactggattt

SEQ ID NO: 557316 - DNA, 12 bp, Homo sapiens
tttaagttgtaa

SEQ ID NO: 557317 - DNA, 16 bp, Homo sapiens
tttaatatactcctta

SEQ ID NO: 557318 - DNA, 14 bp, Homo sapiens
tttaatatgtattt

SEQ ID NO: 557319 - DNA, 23 bp, Homo sapiens
tttaatttcaagcttattttgga

SEQ ID NO: 557320 - DNA, 21 bp, Homo sapiens
tttacagagatgtctcttata

SEQ ID NO: 557321 - DNA, 18 bp, Homo sapiens
tttacagctttacacaca

SEQ ID NO: 557322 - DNA, 22 bp, Homo sapiens
tttacagtctctttcttccttt

SEQ ID NO: 557323 - DNA, 17 bp, Homo sapiens
tttactaacagtaactg

SEQ ID NO: 557324 - DNA, 19 bp, Homo sapiens
ttataacattgtatgttaa

SEQ ID NO: 557325 - DNA, 22 bp, Homo sapiens
ttataagcacagacaattctaa

SEQ ID NO: 557326 - DNA, 19 bp, Homo sapiens
ttataatggccctgtagct

SEQ ID NO: 557327 - DNA, 16 bp, Homo sapiens
ttatacctgtacacac

SEQ ID NO: 557328 - DNA, 14 bp, Homo sapiens
ttatacctgttgct

SEQ ID NO: 557329 - DNA, 12 bp, Homo sapiens
ttatagaagaat

SEQ ID NO: 557330 - DNA, 15 bp, Homo sapiens
ttatagaagaatgca

SEQ ID NO: 557331 - DNA, 14 bp, Homo sapiens
ttatagtgcaatat

SEQ ID NO: 557332 - DNA, 19 bp, Homo sapiens
ttatagtgcaatatatttt

SEQ ID NO: 557333 - DNA, 22 bp, Homo sapiens
ttatagtgcaatatattttgta

SEQ ID NO: 557334 - DNA, 14 bp, Homo sapiens
ttatatatatatct

SEQ ID NO: 557335 - DNA, 17 bp, Homo sapiens
ttatatcagactgcttt

SEQ ID NO: 557336 - DNA, 22 bp, Homo sapiens
ttatatctgtggtcttcaaatt

SEQ ID NO: 557337 - DNA, 18 bp, Homo sapiens
ttatattcccaaatctca

SEQ ID NO: 557338 - DNA, 15 bp, Homo sapiens
ttatatttggatgca

SEQ ID NO: 557339 - DNA, 16 bp, Homo sapiens
ttatatttttcttaaa

SEQ ID NO: 557340 - DNA, 17 bp, Homo sapiens
ttatatttttcttaaaa

SEQ ID NO: 557341 - DNA, 20 bp, Homo sapiens
ttatctaactatatgtacag

SEQ ID NO: 557342 - DNA, 23 bp, Homo sapiens
ttatctaactatatgtacagctc

SEQ ID NO: 557343 - DNA, 14 bp, Homo sapiens
ttatctaccaactt

SEQ ID NO: 557344 - DNA, 18 bp, Homo sapiens
ttatctaccaactttcaa

SEQ ID NO: 557345 - DNA, 16 bp, Homo sapiens
ttatctagatgtaaat

SEQ ID NO: 557346 - DNA, 18 bp, Homo sapiens
ttatctagatgtaaattt

SEQ ID NO: 557347 - DNA, 14 bp, Homo sapiens
ttatctagctgcat

SEQ ID NO: 557348 - DNA, 14 bp, Homo sapiens
ttatctcaacggaa

SEQ ID NO: 557349 - DNA, 12 bp, Homo sapiens
ttatcttagctg

SEQ ID NO: 557350 - DNA, 12 bp, Homo sapiens
ttatctttaaaa

SEQ ID NO: 557351 - DNA, 15 bp, Homo sapiens
ttatctttctttcca

SEQ ID NO: 557352 - DNA, 23 bp, Homo sapiens
ttatgaagatgggggcctctttc

SEQ ID NO: 557353 - DNA, 13 bp, Homo sapiens
ttatgaagcagat

SEQ ID NO: 557354 - DNA, 17 bp, Homo sapiens
ttatgaatagacataaa

SEQ ID NO: 557355 - DNA, 19 bp, Homo sapiens
ttatgaatagacataaatt

SEQ ID NO: 557356 - DNA, 20 bp, Homo sapiens
ttatgagatcactgaacttt

SEQ ID NO: 557357 - DNA, 16 bp, Homo sapiens
ttatgagggtactgtg

SEQ ID NO: 557358 - DNA, 18 bp, Homo sapiens
ttatgatcaaaagtgatt

SEQ ID NO: 557359 - DNA, 20 bp, Homo sapiens
ttatgcgcaaatacaaaatg

SEQ ID NO: 557360 - DNA, 18 bp, Homo sapiens
ttatgctgtaaaagcaag

SEQ ID NO: 557361 - DNA, 10 bp, Homo sapiens
ttatgttgac

SEQ ID NO: 557362 - DNA, 23 bp, Homo sapiens
ttatgttttggtccacttttcca

SEQ ID NO: 557363 - DNA, 18 bp, Homo sapiens
ttattaccagattcactt

SEQ ID NO: 557364 - DNA, 16 bp, Homo sapiens
ttattatttgcacaga

SEQ ID NO: 557365 - DNA, 21 bp, Homo sapiens
ttattcaaaccaatttcttcc

SEQ ID NO: 557366 - DNA, 19 bp, Homo sapiens
ttattccatattagaaaac

SEQ ID NO: 557367 - DNA, 19 bp, Homo sapiens
ttattctgggaatgtatag

SEQ ID NO: 557368 - DNA, 13 bp, Homo sapiens
ttattgaagaaac

SEQ ID NO: 557369 - DNA, 22 bp, Homo sapiens
ttattgaagaaacagataccat

SEQ ID NO: 557370 - DNA, 22 bp, Homo sapiens
ttaagcacaaaaaatttaagag

SEQ ID NO: 557371 - DNA, 17 bp, Homo sapiens
ttaagcagaattggaaa

SEQ ID NO: 557372 - DNA, 22 bp, Homo sapiens
ttaagcagaattggaaaagact

SEQ ID NO: 557373 - DNA, 15 bp, Homo sapiens
ttaagcctttgaagt

SEQ ID NO: 557374 - DNA, 15 bp, Homo sapiens
ttaaggccacatcca

SEQ ID NO: 557375 - DNA, 19 bp, Homo sapiens
ttaagtaaactaatgagtt

SEQ ID NO: 557376 - DNA, 15 bp, Homo sapiens
ttaagtattcaagaa

SEQ ID NO: 557377 - DNA, 15 bp, Homo sapiens
ttaagtcttactgtt

SEQ ID NO: 557378 - DNA, 18 bp, Homo sapiens
ttaagtggactgtatttc

SEQ ID NO: 557379 - DNA, 16 bp, Homo sapiens
ttaagtgttctgtggc

SEQ ID NO: 557380 - DNA, 16 bp, Homo sapiens
ttaagttgtaaacgtc

SEQ ID NO: 557381 - DNA, 17 bp, Homo sapiens
ttaagttgtaaacgtct

SEQ ID NO: 557382 - DNA, 19 bp, Homo sapiens
ttaagttgtaaacgtcttt

SEQ ID NO: 557383 - DNA, 16 bp, Homo sapiens
ttaataacagctcctt

SEQ ID NO: 557384 - DNA, 21 bp, Homo sapiens
ttaataattagaaacaccaaa

SEQ ID NO: 557385 - DNA, 15 bp, Homo sapiens
ttaatataactgcct

SEQ ID NO: 557386 - DNA, 16 bp, Homo sapiens
ttaatatactccttaa

SEQ ID NO: 557387 - DNA, 15 bp, Homo sapiens
ttaatgagtatatgt

SEQ ID NO: 557388 - DNA, 14 bp, Homo sapiens
ttaatgataaaatc

SEQ ID NO: 557389 - DNA, 17 bp, Homo sapiens
ttaatgataaaatccca

SEQ ID NO: 557390 - DNA, 18 bp, Homo sapiens
ttaatggaaacatgctgt

SEQ ID NO: 557391 - DNA, 15 bp, Homo sapiens
ttaatggtctaaaaa

SEQ ID NO: 557392 - DNA, 13 bp, Homo sapiens
ttaatgtctcaaa

SEQ ID NO: 557393 - DNA, 20 bp, Homo sapiens
ttaatgtgatggatggcaca

SEQ ID NO: 557394 - DNA, 23 bp, Homo sapiens
ttaatgtgatggatggcacaatg

SEQ ID NO: 557395 - DNA, 12 bp, Homo sapiens
ttaatgtgtaaa

SEQ ID NO: 557396 - DNA, 18 bp, Homo sapiens
ttaatttcttgcaatttg

SEQ ID NO: 557397 - DNA, 21 bp, Homo sapiens
ttaatttggaccattttcctg

SEQ ID NO: 557398 - DNA, 18 bp, Homo sapiens
ttacaaaggctgtattca

SEQ ID NO: 557399 - DNA, 20 bp, Homo sapiens
ttacaaatgattgcttttaa

SEQ ID NO: 557400 - DNA, 23 bp, Homo sapiens
ttacaaatgattgcttttaaaat

SEQ ID NO: 557401 - DNA, 15 bp, Homo sapiens
ttacaagactgtaaa

SEQ ID NO: 557402 - DNA, 16 bp, Homo sapiens
ttacaagactgtaaat

SEQ ID NO: 557403 - DNA, 17 bp, Homo sapiens
ttacaagactgtaaatt

SEQ ID NO: 557404 - DNA, 13 bp, Homo sapiens
ttacaatatttgt

SEQ ID NO: 557405 - DNA, 15 bp, Homo sapiens
ttacaatatttgtgt

SEQ ID NO: 557406 - DNA, 23 bp, Homo sapiens
ttacacttctcaaatgctactca

SEQ ID NO: 557407 - DNA, 14 bp, Homo sapiens
ttacacttgcttta

SEQ ID NO: 557408 - DNA, 17 bp, Homo sapiens
ttacaggtaccagttct

SEQ ID NO: 557409 - DNA, 14 bp, Homo sapiens
ttacagtggcagta

SEQ ID NO: 557410 - DNA, 17 bp, Homo sapiens
ttacagtggcagtattg

SEQ ID NO: 557411 - DNA, 20 bp, Homo sapiens
ttacagtggcagtattgaca

SEQ ID NO: 557412 - DNA, 13 bp, Homo sapiens
ttacagttacttt

SEQ ID NO: 557413 - DNA, 16 bp, Homo sapiens
ttacagttacttttcc

SEQ ID NO: 557414 - DNA, 14 bp, Homo sapiens
ttacataaacatca

SEQ ID NO: 557415 - DNA, 18 bp, Homo sapiens
ttacataaacatcaggtt

SEQ ID NO: 557416 - DNA, 20 bp, Homo sapiens
ttaccgacaagcacagtcag

SEQ ID NO: 557417 - DNA, 21 bp, Homo sapiens
ttacctaagagccacaataag

SEQ ID NO: 557418 - DNA, 17 bp, Homo sapiens
ttacctattgctgtaaa

SEQ ID NO: 557419 - DNA, 11 bp, Homo sapiens
ttacctgaaag

SEQ ID NO: 557420 - DNA, 20 bp, Homo sapiens
ttactaacagtaactgccat

SEQ ID NO: 557421 - DNA, 17 bp, Homo sapiens
ttactaacttctaaaac

SEQ ID NO: 557422 - DNA, 19 bp, Homo sapiens
ttactaacttctaaaactg

SEQ ID NO: 557423 - DNA, 15 bp, Homo sapiens
ttactagcttttcaa

SEQ ID NO: 557424 - DNA, 12 bp, Homo sapiens
ttactgtcttaa

SEQ ID NO: 557425 - DNA, 15 bp, Homo sapiens
ttactgtcttaatta

SEQ ID NO: 557426 - DNA, 21 bp, Homo sapiens
ttacttgtctttctggggttt

SEQ ID NO: 557427 - DNA, 17 bp, Homo sapiens
ttacttttaataaagta

SEQ ID NO: 557428 - DNA, 19 bp, Homo sapiens
ttacttttccttgcataca

SEQ ID NO: 557429 - DNA, 14 bp, Homo sapiens
ttagaacaacataa

SEQ ID NO: 557430 - DNA, 18 bp, Homo sapiens
ttagaatcaagtctgtga

SEQ ID NO: 557431 - DNA, 17 bp, Homo sapiens
ttagacttctgttttca

SEQ ID NO: 557432 - DNA, 18 bp, Homo sapiens
ttagacttctgttttcaa

SEQ ID NO: 557433 - DNA, 19 bp, Homo sapiens
ttagacttctgttttcaat

SEQ ID NO: 557434 - DNA, 22 bp, Homo sapiens
ttagagctttttttttttaatt

SEQ ID NO: 557435 - DNA, 20 bp, Homo sapiens
ttagagttattttgtgtcct

SEQ ID NO: 557436 - DNA, 14 bp, Homo sapiens
ttagcaaaaaaagt

SEQ ID NO: 557437 - DNA, 13 bp, Homo sapiens
ttagcacagtatt

SEQ ID NO: 557438 - DNA, 15 bp, Homo sapiens
ttagcgacaacagat

SEQ ID NO: 557439 - DNA, 23 bp, Homo sapiens
ttagcgacaacagattggatttt

SEQ ID NO: 557440 - DNA, 20 bp, Homo sapiens
ttagcgttgttttgtggata

SEQ ID NO: 557441 - DNA, 18 bp, Homo sapiens
ttaggaggctcaacaata

SEQ ID NO: 557442 - DNA, 20 bp, Homo sapiens
ttaggcagtataaagaatag

SEQ ID NO: 557443 - DNA, 18 bp, Homo sapiens
ttaggcatggttttgggc

SEQ ID NO: 557444 - DNA, 23 bp, Homo sapiens
ttaggtagtagaatctcagcact

SEQ ID NO: 557445 - DNA, 14 bp, Homo sapiens
ttaggtgtctgtcc

SEQ ID NO: 557446 - DNA, 12 bp, Homo sapiens
ttaggttaacat

SEQ ID NO: 557447 - DNA, 16 bp, Homo sapiens
ttagtactttatagaa

SEQ ID NO: 557448 - DNA, 19 bp, Homo sapiens
ttagtaggatatgcctgct

SEQ ID NO: 557449 - DNA, 13 bp, Homo sapiens
ttagtgtatatgt

SEQ ID NO: 557450 - DNA, 21 bp, Homo sapiens
ttagtgtctctatttatgaga

SEQ ID NO: 557451 - DNA, 15 bp, Homo sapiens
ttagtttttctgtcc

SEQ ID NO: 557452 - DNA, 17 bp, Homo sapiens
ttataaattttgtacat

SEQ ID NO: 557453 - DNA, 20 bp, Homo sapiens
ttataaattttgtacatttt

SEQ ID NO: 557454 - DNA, 14 bp, Homo sapiens
ttataacattgtaa

SEQ ID NO: 557455 - DNA, 15 bp, Homo sapiens
ttataacattgtaaa

SEQ ID NO: 557456 - DNA, 17 bp, Homo sapiens
tgtggagctgcttccag

SEQ ID NO: 557457 - DNA, 18 bp, Homo sapiens
tgtggagctgcttccagt

SEQ ID NO: 557458 - DNA, 23 bp, Homo sapiens
tgtggagggctgcagagcctgca

SEQ ID NO: 557459 - DNA, 18 bp, Homo sapiens
tgtggataagaaaaatgc

SEQ ID NO: 557460 - DNA, 19 bp, Homo sapiens
tgtggataagaaaaatgct

SEQ ID NO: 557461 - DNA, 17 bp, Homo sapiens
tgtggcatcaggaaagg

SEQ ID NO: 557462 - DNA, 20 bp, Homo sapiens
tgtggctccacacacacaaa

SEQ ID NO: 557463 - DNA, 17 bp, Homo sapiens
tgtggctcctcccgaaa

SEQ ID NO: 557464 - DNA, 16 bp, Homo sapiens
tgtggctgatttacta

SEQ ID NO: 557465 - DNA, 12 bp, Homo sapiens
tgtggggccaca

SEQ ID NO: 557466 - DNA, 19 bp, Homo sapiens
tgtgggtttactctgtgct

SEQ ID NO: 557467 - DNA, 14 bp, Homo sapiens
tgtggtgtaattta

SEQ ID NO: 557468 - DNA, 19 bp, Homo sapiens
tgtgtaatttttctgtata

SEQ ID NO: 557469 - DNA, 13 bp, Homo sapiens
tgtgtatatatac

SEQ ID NO: 557470 - DNA, 20 bp, Homo sapiens
tgtgtatatgtttatacaca

SEQ ID NO: 557471 - DNA, 21 bp, Homo sapiens
tgtgtatatgtttatacacac

SEQ ID NO: 557472 - DNA, 12 bp, Homo sapiens
tgtgtatgagac

SEQ ID NO: 557473 - DNA, 12 bp, Homo sapiens
tgtgtatgtgta

SEQ ID NO: 557474 - DNA, 17 bp, Homo sapiens
tgtgtatttttcaaggc

SEQ ID NO: 557475 - DNA, 19 bp, Homo sapiens
tgtgtcagtttatgttttg

SEQ ID NO: 557476 - DNA, 16 bp, Homo sapiens
tgtgtcctttaaaaaa

SEQ ID NO: 557477 - DNA, 18 bp, Homo sapiens
tgtgtctgtcatttctct

SEQ ID NO: 557478 - DNA, 16 bp, Homo sapiens
tgtgtcttgtattatc

SEQ ID NO: 557479 - DNA, 20 bp, Homo sapiens
tgtgtgccgagcccttgccc

SEQ ID NO: 557480 - DNA, 21 bp, Homo sapiens
tgtgtgccgagcccttgccca

SEQ ID NO: 557481 - DNA, 22 bp, Homo sapiens
tgtgtgccgagcccttgcccat

SEQ ID NO: 557482 - DNA, 18 bp, Homo sapiens
tgtgtgggtttactctgt

SEQ ID NO: 557483 - DNA, 14 bp, Homo sapiens
tgtgtgtatatatg

SEQ ID NO: 557484 - DNA, 14 bp, Homo sapiens
tgtgttattcgtga

SEQ ID NO: 557485 - DNA, 20 bp, Homo sapiens
tgtgttccaaacatgaggtt

SEQ ID NO: 557486 - DNA, 16 bp, Homo sapiens
tgtgttttcttcgtgg

SEQ ID NO: 557487 - DNA, 19 bp, Homo sapiens
tgtgttttcttcgtggatt

SEQ ID NO: 557488 - DNA, 12 bp, Homo sapiens
tgttaaaatgag

SEQ ID NO: 557489 - DNA, 13 bp, Homo sapiens
tgttaaagatgta

SEQ ID NO: 557490 - DNA, 15 bp, Homo sapiens
tgttaacagtatttt

SEQ ID NO: 557491 - DNA, 20 bp, Homo sapiens
tgttaacagtattttaagaa

SEQ ID NO: 557492 - DNA, 15 bp, Homo sapiens
tgttaatttcttgca

SEQ ID NO: 557493 - DNA, 23 bp, Homo sapiens
tgttaccattggaaatttcacgt

SEQ ID NO: 557494 - DNA, 16 bp, Homo sapiens
tgttataaattttgta

SEQ ID NO: 557495 - DNA, 21 bp, Homo sapiens
tgttataaattttgtacattt

SEQ ID NO: 557496 - DNA, 20 bp, Homo sapiens
tgttatcattcttataacat

SEQ ID NO: 557497 - DNA, 13 bp, Homo sapiens
tgttatgttgtaa

SEQ ID NO: 557498 - DNA, 20 bp, Homo sapiens
tgttattcaataactattgc

SEQ ID NO: 557499 - DNA, 12 bp, Homo sapiens
tgttcagaaaaa

SEQ ID NO: 557500 - DNA, 14 bp, Homo sapiens
tgttcagtcacttg

SEQ ID NO: 557501 - DNA, 16 bp, Homo sapiens
tgttctgttacaaaat

SEQ ID NO: 557502 - DNA, 10 bp, Homo sapiens
tgttcttcca

SEQ ID NO: 557503 - DNA, 11 bp, Homo sapiens
tgttcttccaa

SEQ ID NO: 557504 - DNA, 20 bp, Homo sapiens
tgttcttccaaagcagagag

SEQ ID NO: 557505 - DNA, 21 bp, Homo sapiens
tgttgaccaggcacctcccct

SEQ ID NO: 557506 - DNA, 22 bp, Homo sapiens
tgttgaggcttatatttgtgta

SEQ ID NO: 557507 - DNA, 22 bp, Homo sapiens
tgttgatgcaatccttacaaat

SEQ ID NO: 557508 - DNA, 13 bp, Homo sapiens
tgttgattaaaac

SEQ ID NO: 557509 - DNA, 14 bp, Homo sapiens
tgttgattctctcc

SEQ ID NO: 557510 - DNA, 11 bp, Homo sapiens
tgttgatttct

SEQ ID NO: 557511 - DNA, 14 bp, Homo sapiens
tgttgatttctagt

SEQ ID NO: 557512 - DNA, 15 bp, Homo sapiens
tgttgatttctagtt

SEQ ID NO: 557513 - DNA, 16 bp, Homo sapiens
tgttgatttctagtta

SEQ ID NO: 557514 - DNA, 18 bp, Homo sapiens
tgttgatttctagttatt

SEQ ID NO: 557515 - DNA, 15 bp, Homo sapiens
tgttgcactgaagtt

SEQ ID NO: 557516 - DNA, 18 bp, Homo sapiens
tgttgccactttccaagt

SEQ ID NO: 557517 - DNA, 14 bp, Homo sapiens
tgttgctccctgtg

SEQ ID NO: 557518 - DNA, 23 bp, Homo sapiens
tgttgggaaaaaggcctctgtcc

SEQ ID NO: 557519 - DNA, 15 bp, Homo sapiens
tgttgtaatattttg

SEQ ID NO: 557520 - DNA, 15 bp, Homo sapiens
tgttgtatctttgta

SEQ ID NO: 557521 - DNA, 13 bp, Homo sapiens
tgtttaagcagaa

SEQ ID NO: 557522 - DNA, 19 bp, Homo sapiens
tgtttaagcagaattggaa

SEQ ID NO: 557523 - DNA, 14 bp, Homo sapiens
tgtttacactgtca

SEQ ID NO: 557524 - DNA, 16 bp, Homo sapiens
tgtttatctagatgta

SEQ ID NO: 557525 - DNA, 15 bp, Homo sapiens
tgtttcatccttccc

SEQ ID NO: 557526 - DNA, 23 bp, Homo sapiens
tgtttccaggcatgaccctggag

SEQ ID NO: 557527 - DNA, 17 bp, Homo sapiens
tgtttctgagaaaagaa

SEQ ID NO: 557528 - DNA, 11 bp, Homo sapiens
tgtttctgggg

SEQ ID NO: 557529 - DNA, 13 bp, Homo sapiens
tgtttctttgaat

SEQ ID NO: 557530 - DNA, 19 bp, Homo sapiens
tgtttgatgtccccaaagt

SEQ ID NO: 557531 - DNA, 14 bp, Homo sapiens
tgtttggttatagt

SEQ ID NO: 557532 - DNA, 18 bp, Homo sapiens
tgtttggttatagtgcaa

SEQ ID NO: 557533 - DNA, 14 bp, Homo sapiens
tctccacccacctt

SEQ ID NO: 557534 - DNA, 17 bp, Homo sapiens
tctccaggcaccatctc

SEQ ID NO: 557535 - DNA, 13 bp, Homo sapiens
tctcccccaccct

SEQ ID NO: 557536 - DNA, 21 bp, Homo sapiens
tctcccccacccttgttccag

SEQ ID NO: 557537 - DNA, 21 bp, Homo sapiens
tctccccttccatttctgcct

SEQ ID NO: 557538 - DNA, 23 bp, Homo sapiens
tctccctggactctgtggggcca

SEQ ID NO: 557539 - DNA, 16 bp, Homo sapiens
tctcctgcccccacac

SEQ ID NO: 557540 - DNA, 15 bp, Homo sapiens
tctcctgtatcattt

SEQ ID NO: 557541 - DNA, 16 bp, Homo sapiens
tctccttgggctggga

SEQ ID NO: 557542 - DNA, 14 bp, Homo sapiens
tctcgcacacctct

SEQ ID NO: 557543 - DNA, 16 bp, Homo sapiens
tctctacccctttctt

SEQ ID NO: 557544 - DNA, 22 bp, Homo sapiens
tctctactaaaaatacaaacaa

SEQ ID NO: 557545 - DNA, 20 bp, Homo sapiens
tctctccatcagaggacacc

SEQ ID NO: 557546 - DNA, 21 bp, Homo sapiens
tctctctatttccccctttct

SEQ ID NO: 557547 - DNA, 11 bp, Homo sapiens
tctctctggct

SEQ ID NO: 557548 - DNA, 19 bp, Homo sapiens
tctctgcccagcttttcat

SEQ ID NO: 557549 - DNA, 22 bp, Homo sapiens
tctctggctctaggacccccag

SEQ ID NO: 557550 - DNA, 14 bp, Homo sapiens
tctctgtacatatt

SEQ ID NO: 557551 - DNA, 16 bp, Homo sapiens
tctctgtataaacatt

SEQ ID NO: 557552 - DNA, 19 bp, Homo sapiens
tctcttcatgcgcagtccc

SEQ ID NO: 557553 - DNA, 21 bp, Homo sapiens
tctcttctccccttccatttc

SEQ ID NO: 557554 - DNA, 12 bp, Homo sapiens
tctcttctcctt

SEQ ID NO: 557555 - DNA, 13 bp, Homo sapiens
tctcttctgtgtt

SEQ ID NO: 557556 - DNA, 18 bp, Homo sapiens
tctcttggaactgcacca

SEQ ID NO: 557557 - DNA, 15 bp, Homo sapiens
tctctttcttccttt

SEQ ID NO: 557558 - DNA, 17 bp, Homo sapiens
tctctttcttcctttct

SEQ ID NO: 557559 - DNA, 14 bp, Homo sapiens
tctctttggaaata

SEQ ID NO: 557560 - DNA, 23 bp, Homo sapiens
tctgaaagcacaggagacactgt

SEQ ID NO: 557561 - DNA, 16 bp, Homo sapiens
tctgaactgctgctgg

SEQ ID NO: 557562 - DNA, 19 bp, Homo sapiens
tctgaatgtattatcctgt

SEQ ID NO: 557563 - DNA, 14 bp, Homo sapiens
tctgaattccaagt

SEQ ID NO: 557564 - DNA, 16 bp, Homo sapiens
tctgaccacagacact

SEQ ID NO: 557565 - DNA, 23 bp, Homo sapiens
tctgacctgcccccgctctgcca

SEQ ID NO: 557566 - DNA, 15 bp, Homo sapiens
tctgacgggatttgt

SEQ ID NO: 557567 - DNA, 13 bp, Homo sapiens
tctgactgacatg

SEQ ID NO: 557568 - DNA, 9 bp, Homo sapiens
tctgagaaa

SEQ ID NO: 557569 - DNA, 15 bp, Homo sapiens
tctgagagcaaactg

SEQ ID NO: 557570 - DNA, 12 bp, Homo sapiens
tctgatatcagg

SEQ ID NO: 557571 - DNA, 22 bp, Homo sapiens
tctgatatcaggaaatatctgt

SEQ ID NO: 557572 - DNA, 23 bp, Homo sapiens
tctgatctgggttttgcctctgc

SEQ ID NO: 557573 - DNA, 16 bp, Homo sapiens
tctgatgatgttctga

SEQ ID NO: 557574 - DNA, 18 bp, Homo sapiens
tctgatgatgttctgaaa

SEQ ID NO: 557575 - DNA, 14 bp, Homo sapiens
tctgatgtaaatga

SEQ ID NO: 557576 - DNA, 21 bp, Homo sapiens
tctgatgtattttgtgagttt

SEQ ID NO: 557577 - DNA, 15 bp, Homo sapiens
tctgattctatgtaa

SEQ ID NO: 557578 - DNA, 18 bp, Homo sapiens
tctgattctatgtaactt

SEQ ID NO: 557579 - DNA, 17 bp, Homo sapiens
tctgcagtgttctgtga

SEQ ID NO: 557580 - DNA, 23 bp, Homo sapiens
tctgcagtgttctgtgaatagca

SEQ ID NO: 557581 - DNA, 17 bp, Homo sapiens
tctgcccagcttttcat

SEQ ID NO: 557582 - DNA, 12 bp, Homo sapiens
tctgcccttggg

SEQ ID NO: 557583 - DNA, 20 bp, Homo sapiens
tctgcctctgatgtattttg

SEQ ID NO: 557584 - DNA, 13 bp, Homo sapiens
tctgcgtcccact

SEQ ID NO: 557585 - DNA, 21 bp, Homo sapiens
tctgctaaattgatgttgatg

SEQ ID NO: 557586 - DNA, 15 bp, Homo sapiens
tctgctccagctctg

SEQ ID NO: 557587 - DNA, 20 bp, Homo sapiens
tctgctcccccttttccctc

SEQ ID NO: 557588 - DNA, 13 bp, Homo sapiens
tctgctcttgcat

SEQ ID NO: 557589 - DNA, 22 bp, Homo sapiens
tctgctgatgacccccccagct

SEQ ID NO: 557590 - DNA, 18 bp, Homo sapiens
tctggaaaaaaaaaaata

SEQ ID NO: 557591 - DNA, 19 bp, Homo sapiens
tctggaaaaaaaaaaatat

SEQ ID NO: 557592 - DNA, 19 bp, Homo sapiens
tctggaagggagggcttca

SEQ ID NO: 557593 - DNA, 20 bp, Homo sapiens
tctggagaccaggactctgc

SEQ ID NO: 557594 - DNA, 17 bp, Homo sapiens
tctggaggacctgcccg

SEQ ID NO: 557595 - DNA, 13 bp, Homo sapiens
tctggcaaatatt

SEQ ID NO: 557596 - DNA, 23 bp, Homo sapiens
tctggcccttgcttacctctcag

SEQ ID NO: 557597 - DNA, 17 bp, Homo sapiens
tctggggagctcctggc

SEQ ID NO: 557598 - DNA, 22 bp, Homo sapiens
tctgtaagctgtttggttttaa

SEQ ID NO: 557599 - DNA, 23 bp, Homo sapiens
tctgtaagctgtttggttttaaa

SEQ ID NO: 557600 - DNA, 12 bp, Homo sapiens
tctgtacatatt

SEQ ID NO: 557601 - DNA, 21 bp, Homo sapiens
tctgtacatgtggaaaactca

SEQ ID NO: 557602 - DNA, 22 bp, Homo sapiens
tctgtataaacattaaatgtct

SEQ ID NO: 557603 - DNA, 23 bp, Homo sapiens
tctgtataaacattaaatgtctt

SEQ ID NO: 557604 - DNA, 15 bp, Homo sapiens
tctgtcatgccaaaa

SEQ ID NO: 557605 - DNA, 19 bp, Homo sapiens
tctgtccaactgagaagta

SEQ ID NO: 557606 - DNA, 24 bp, Homo sapiens
tctgtccccgagccgagctctcct

SEQ ID NO: 557607 - DNA, 13 bp, Homo sapiens
tctgtctgctggt

SEQ ID NO: 557608 - DNA, 13 bp, Homo sapiens
tctgtctggtcca

SEQ ID NO: 557609 - DNA, 22 bp, Homo sapiens
tctgtgaaagtctcctgtatca

SEQ ID NO: 557610 - DNA, 17 bp, Homo sapiens
tctgtgaggaaagcaca

SEQ ID NO: 557611 - DNA, 20 bp, Homo sapiens
tctgtgaggaaagcacacag

SEQ ID NO: 557612 - DNA, 17 bp, Homo sapiens
tctgtggctgatttact

SEQ ID NO: 557613 - DNA, 12 bp, Homo sapiens
tctgtgtctgct

SEQ ID NO: 557614 - DNA, 14 bp, Homo sapiens
tctgtgtctgctgt

SEQ ID NO: 557615 - DNA, 20 bp, Homo sapiens
tctgtgtttacagagatgtc

SEQ ID NO: 557616 - DNA, 14 bp, Homo sapiens
tctgttacaaaatg

SEQ ID NO: 557617 - DNA, 20 bp, Homo sapiens
tctgttacaaaatgtaactg

SEQ ID NO: 557618 - DNA, 16 bp, Homo sapiens
tctgttgtaatatcag

SEQ ID NO: 557619 - DNA, 18 bp, Homo sapiens
tcttaaaaatgcatttaa

SEQ ID NO: 557620 - DNA, 20 bp, Homo sapiens
tcttaaaaatgcatttaagt

SEQ ID NO: 557621 - DNA, 18 bp, Homo sapiens
tcttaaaaattatcttta

SEQ ID NO: 557622 - DNA, 12 bp, Homo sapiens
tcttaaaacact

SEQ ID NO: 557623 - DNA, 20 bp, Homo sapiens
tcttaatattcagagaaaac

SEQ ID NO: 557624 - DNA, 14 bp, Homo sapiens
tcttaattaagtaa

SEQ ID NO: 557625 - DNA, 17 bp, Homo sapiens
tcttacccaaagcacat

SEQ ID NO: 557626 - DNA, 13 bp, Homo sapiens
tcttactgttttg

SEQ ID NO: 557627 - DNA, 16 bp, Homo sapiens
tcttactgttttgtgc

SEQ ID NO: 557628 - DNA, 15 bp, Homo sapiens
tcttactttgttaat

SEQ ID NO: 557629 - DNA, 16 bp, Homo sapiens
tcttactttgttaatt

SEQ ID NO: 557630 - DNA, 23 bp, Homo sapiens
tcttactttgttaatttatctgt

SEQ ID NO: 557631 - DNA, 13 bp, Homo sapiens
tcttagctggata

SEQ ID NO: 557632 - DNA, 20 bp, Homo sapiens
tcttagctggatataatgta

SEQ ID NO: 557633 - DNA, 17 bp, Homo sapiens
tcttagtctaggtcctt

SEQ ID NO: 557634 - DNA, 12 bp, Homo sapiens
tcttattaaagt

SEQ ID NO: 557635 - DNA, 18 bp, Homo sapiens
tcttattaaagtttcaaa

SEQ ID NO: 557636 - DNA, 20 bp, Homo sapiens
tcttattaaagtttcaaaaa

SEQ ID NO: 557637 - DNA, 15 bp, Homo sapiens
tcttcaacatgtgtg

SEQ ID NO: 557638 - DNA, 16 bp, Homo sapiens
tcttcaacatgtgtga

SEQ ID NO: 557639 - DNA, 21 bp, Homo sapiens
tcttccaaagcagagagcatt

SEQ ID NO: 557640 - DNA, 13 bp, Homo sapiens
tcttccacctgga

SEQ ID NO: 557641 - DNA, 14 bp, Homo sapiens
tcttccacctggaa

SEQ ID NO: 557642 - DNA, 13 bp, Homo sapiens
tcttccaggcagc

SEQ ID NO: 557643 - DNA, 18 bp, Homo sapiens
tcttccagttactttcca

SEQ ID NO: 557644 - DNA, 19 bp, Homo sapiens
tcttccagttactttccaa

SEQ ID NO: 557645 - DNA, 16 bp, Homo sapiens
tcttcctccaaggaca

SEQ ID NO: 557646 - DNA, 20 bp, Homo sapiens
tgtatatacacatataccta

SEQ ID NO: 557647 - DNA, 20 bp, Homo sapiens
tgtatatatacatacacttg

SEQ ID NO: 557648 - DNA, 14 bp, Homo sapiens
tgtatatatgtgta

SEQ ID NO: 557649 - DNA, 18 bp, Homo sapiens
tgtatatatgtgtatata

SEQ ID NO: 557650 - DNA, 19 bp, Homo sapiens
tgtatatgtttatacacac

SEQ ID NO: 557651 - DNA, 21 bp, Homo sapiens
tgtatattgatgtaactgtgt

SEQ ID NO: 557652 - DNA, 19 bp, Homo sapiens
tgtatcctccattgtatct

SEQ ID NO: 557653 - DNA, 19 bp, Homo sapiens
tgtatgagactgtgtttct

SEQ ID NO: 557654 - DNA, 16 bp, Homo sapiens
tgtatgatctgtgcct

SEQ ID NO: 557655 - DNA, 12 bp, Homo sapiens
tgtatgtgtata

SEQ ID NO: 557656 - DNA, 14 bp, Homo sapiens
tgtatgtttacact

SEQ ID NO: 557657 - DNA, 18 bp, Homo sapiens
tgtatgtttacactgtca

SEQ ID NO: 557658 - DNA, 13 bp, Homo sapiens
tgtatgtttttca

SEQ ID NO: 557659 - DNA, 18 bp, Homo sapiens
tgtatgtttttcagttca

SEQ ID NO: 557660 - DNA, 21 bp, Homo sapiens
tgtatgtttttcagttcaaag

SEQ ID NO: 557661 - DNA, 13 bp, Homo sapiens
tgtatttgttaat

SEQ ID NO: 557662 - DNA, 14 bp, Homo sapiens
tgtatttgttaatt

SEQ ID NO: 557663 - DNA, 14 bp, Homo sapiens
tgtattttatgtat

SEQ ID NO: 557664 - DNA, 19 bp, Homo sapiens
tgtattttatgtatgttta

SEQ ID NO: 557665 - DNA, 12 bp, Homo sapiens
tgtcaaacatta

SEQ ID NO: 557666 - DNA, 19 bp, Homo sapiens
tgtcaagtttttatacctg

SEQ ID NO: 557667 - DNA, 18 bp, Homo sapiens
tgtcaccaccctgctcat

SEQ ID NO: 557668 - DNA, 20 bp, Homo sapiens
tgtcacccgatcgccagcaa

SEQ ID NO: 557669 - DNA, 18 bp, Homo sapiens
tgtcacctgcttctctgc

SEQ ID NO: 557670 - DNA, 14 bp, Homo sapiens
tgtcactgctgtaa

SEQ ID NO: 557671 - DNA, 17 bp, Homo sapiens
tgtcactgctgtaaagc

SEQ ID NO: 557672 - DNA, 12 bp, Homo sapiens
tgtcactgttat

SEQ ID NO: 557673 - DNA, 15 bp, Homo sapiens
tgtcactgttataaa

SEQ ID NO: 557674 - DNA, 16 bp, Homo sapiens
tgtcactgttataaat

SEQ ID NO: 557675 - DNA, 16 bp, Homo sapiens
tgtcagtcgtgttgct

SEQ ID NO: 557676 - DNA, 17 bp, Homo sapiens
tgtcagtcgtgttgctt

SEQ ID NO: 557677 - DNA, 14 bp, Homo sapiens
tgtcagtttatgtt

SEQ ID NO: 557678 - DNA, 16 bp, Homo sapiens
tgtcagtttatgtttt

SEQ ID NO: 557679 - DNA, 13 bp, Homo sapiens
tgtcatagccagt

SEQ ID NO: 557680 - DNA, 15 bp, Homo sapiens
tgtcatggtgcaatt

SEQ ID NO: 557681 - DNA, 16 bp, Homo sapiens
tgtcatggtgcaattt

SEQ ID NO: 557682 - DNA, 18 bp, Homo sapiens
tgtcatggtgcaatttgt

SEQ ID NO: 557683 - DNA, 19 bp, Homo sapiens
tgtcatgtgcgaacacagt

SEQ ID NO: 557684 - DNA, 14 bp, Homo sapiens
tgtcattaatgtgt

SEQ ID NO: 557685 - DNA, 15 bp, Homo sapiens
tgtcattaatgtgtt

SEQ ID NO: 557686 - DNA, 17 bp, Homo sapiens
tgtcattgcttcttctg

SEQ ID NO: 557687 - DNA, 17 bp, Homo sapiens
tgtcatttctctttcaa

SEQ ID NO: 557688 - DNA, 18 bp, Homo sapiens
tgtcatttctctttcaaa

SEQ ID NO: 557689 - DNA, 19 bp, Homo sapiens
tgtcattttcattagcaaa

SEQ ID NO: 557690 - DNA, 18 bp, Homo sapiens
tgtccaaacttaacagat

SEQ ID NO: 557691 - DNA, 22 bp, Homo sapiens
tgtcccatgtgagctgctgcca

SEQ ID NO: 557692 - DNA, 17 bp, Homo sapiens
tgtccccaggggcacac

SEQ ID NO: 557693 - DNA, 22 bp, Homo sapiens
tgtccccgagccgagctctcct

SEQ ID NO: 557694 - DNA, 20 bp, Homo sapiens
tgtcccggagctcaggccct

SEQ ID NO: 557695 - DNA, 16 bp, Homo sapiens
tgtccctggcttcctt

SEQ ID NO: 557696 - DNA, 12 bp, Homo sapiens
tgtcccttcccc

SEQ ID NO: 557697 - DNA, 16 bp, Homo sapiens
tgtcctaagagattta

SEQ ID NO: 557698 - DNA, 20 bp, Homo sapiens
tgtcctaagagatttatctt

SEQ ID NO: 557699 - DNA, 21 bp, Homo sapiens
tgtcctaagagatttatcttt

SEQ ID NO: 557700 - DNA, 14 bp, Homo sapiens
tgtcctcctgctgc

SEQ ID NO: 557701 - DNA, 14 bp, Homo sapiens
tgtcctggctccca

SEQ ID NO: 557702 - DNA, 21 bp, Homo sapiens
tgtcctgtgtcagtttatgtt

SEQ ID NO: 557703 - DNA, 18 bp, Homo sapiens
tgtccttctctcacctcc

SEQ ID NO: 557704 - DNA, 19 bp, Homo sapiens
tgtccttctctcacctcct

SEQ ID NO: 557705 - DNA, 21 bp, Homo sapiens
tgtccttctctcacctcctaa

SEQ ID NO: 557706 - DNA, 19 bp, Homo sapiens
tgtcctttatgtattctct

SEQ ID NO: 557707 - DNA, 13 bp, Homo sapiens
tgtcgcacaatgt

SEQ ID NO: 557708 - DNA, 12 bp, Homo sapiens
tgtcggctccag

SEQ ID NO: 557709 - DNA, 16 bp, Homo sapiens
tgtcgtccccagacca

SEQ ID NO: 557710 - DNA, 21 bp, Homo sapiens
tgtctaaagatctttttttaa

SEQ ID NO: 557711 - DNA, 14 bp, Homo sapiens
tgtctaagaaacat

SEQ ID NO: 557712 - DNA, 12 bp, Homo sapiens
tgtctactgaag

SEQ ID NO: 557713 - DNA, 16 bp, Homo sapiens
tataaatgtatataca

SEQ ID NO: 557714 - DNA, 20 bp, Homo sapiens
tataaatgtatatacacata

SEQ ID NO: 557715 - DNA, 17 bp, Homo sapiens
tataaattttgtacatt

SEQ ID NO: 557716 - DNA, 17 bp, Homo sapiens
tataacattgtaaatga

SEQ ID NO: 557717 - DNA, 20 bp, Homo sapiens
tataactgccttaaaacttt

SEQ ID NO: 557718 - DNA, 22 bp, Homo sapiens
tataagcacagacaattctaat

SEQ ID NO: 557719 - DNA, 23 bp, Homo sapiens
tataagtgcacacagaaatatat

SEQ ID NO: 557720 - DNA, 16 bp, Homo sapiens
tataatcaccagggcc

SEQ ID NO: 557721 - DNA, 21 bp, Homo sapiens
tataatggaagagaaatctca

SEQ ID NO: 557722 - DNA, 12 bp, Homo sapiens
tataatgtgtgt

SEQ ID NO: 557723 - DNA, 15 bp, Homo sapiens
tatacaatatataaa

SEQ ID NO: 557724 - DNA, 18 bp, Homo sapiens
tatacaatatataaaaat

SEQ ID NO: 557725 - DNA, 22 bp, Homo sapiens
tatacatacgcaattgtatata

SEQ ID NO: 557726 - DNA, 15 bp, Homo sapiens
tatacatatgtagac

SEQ ID NO: 557727 - DNA, 17 bp, Homo sapiens
taaataaaaattatgtc

SEQ ID NO: 557728 - DNA, 19 bp, Homo sapiens
taaataatcatacacagaa

SEQ ID NO: 557729 - DNA, 15 bp, Homo sapiens
taaatagtgttattg

SEQ ID NO: 557730 - DNA, 21 bp, Homo sapiens
taaatatactcaagtttcagg

SEQ ID NO: 557731 - DNA, 22 bp, Homo sapiens
taaatatttggtctctatttca

SEQ ID NO: 557732 - DNA, 16 bp, Homo sapiens
taaatcaattcattgt

SEQ ID NO: 557733 - DNA, 17 bp, Homo sapiens
taaatcaattcattgtg

SEQ ID NO: 557734 - DNA, 19 bp, Homo sapiens
taaatcgtaacaagcaata

SEQ ID NO: 557735 - DNA, 16 bp, Homo sapiens
taaatctaaattaact

SEQ ID NO: 557736 - DNA, 22 bp, Homo sapiens
taaatgaagtaacttgtcttaa

SEQ ID NO: 557737 - DNA, 19 bp, Homo sapiens
taaatgatatgtctttaaa

SEQ ID NO: 557738 - DNA, 18 bp, Homo sapiens
taaatggggagacaaagg

SEQ ID NO: 557739 - DNA, 14 bp, Homo sapiens
taaatgtatataca

SEQ ID NO: 557740 - DNA, 14 bp, Homo sapiens
taaatgtatattga

SEQ ID NO: 557741 - DNA, 19 bp, Homo sapiens
taaatgtatattgatgtaa

SEQ ID NO: 557742 - DNA, 13 bp, Homo sapiens
taaatgtgaatta

SEQ ID NO: 557743 - DNA, 14 bp, Homo sapiens
taaatgttaaagat

SEQ ID NO: 557744 - DNA, 21 bp, Homo sapiens
taaatgttaaagatgtagcaa

SEQ ID NO: 557745 - DNA, 22 bp, Homo sapiens
taaatgttaaagatgtagcaaa

SEQ ID NO: 557746 - DNA, 19 bp, Homo sapiens
taaatgttttgtaaacttt

SEQ ID NO: 557747 - DNA, 22 bp, Homo sapiens
taaatgttttgtaaactttgaa

SEQ ID NO: 557748 - DNA, 15 bp, Homo sapiens
taaattaacttctat

SEQ ID NO: 557749 - DNA, 22 bp, Homo sapiens
taaattaggaggctcaacaata

SEQ ID NO: 557750 - DNA, 12 bp, Homo sapiens
taaattatcatt

SEQ ID NO: 557751 - DNA, 17 bp, Homo sapiens
taaattatcattgtttg

SEQ ID NO: 557752 - DNA, 14 bp, Homo sapiens
taaattccaaagat

SEQ ID NO: 557753 - DNA, 20 bp, Homo sapiens
taaattccaaagatctgaat

SEQ ID NO: 557754 - DNA, 12 bp, Homo sapiens
taaattgatgtt

SEQ ID NO: 557755 - DNA, 13 bp, Homo sapiens
taaattgatgttg

SEQ ID NO: 557756 - DNA, 13 bp, Homo sapiens
taaattgtaattt

SEQ ID NO: 557757 - DNA, 18 bp, Homo sapiens
taacaaataacaactttt

SEQ ID NO: 557758 - DNA, 15 bp, Homo sapiens
taacaagaaaatcaa

SEQ ID NO: 557759 - DNA, 15 bp, Homo sapiens
taacagccgctccag

SEQ ID NO: 557760 - DNA, 16 bp, Homo sapiens
taacagccgctccaga

SEQ ID NO: 557761 - DNA, 18 bp, Homo sapiens
taacagccgctccagagt

SEQ ID NO: 557762 - DNA, 14 bp, Homo sapiens
taacagtaactgcc

SEQ ID NO: 557763 - DNA, 16 bp, Homo sapiens
taacagtaactgccat

SEQ ID NO: 557764 - DNA, 19 bp, Homo sapiens
taacagtaactgccatttt

SEQ ID NO: 557765 - DNA, 18 bp, Homo sapiens
taacattatattcccaaa

SEQ ID NO: 557766 - DNA, 17 bp, Homo sapiens
taacattgtaaatgata

SEQ ID NO: 557767 - DNA, 14 bp, Homo sapiens
taacattgtatgtt

SEQ ID NO: 557768 - DNA, 16 bp, Homo sapiens
taaccagacacaaact

SEQ ID NO: 557769 - DNA, 16 bp, Homo sapiens
taaccagggccagaag

SEQ ID NO: 557770 - DNA, 19 bp, Homo sapiens
taaccctgaatcagaggca

SEQ ID NO: 557771 - DNA, 17 bp, Homo sapiens
taactctgatgtaaatg

SEQ ID NO: 557772 - DNA, 12 bp, Homo sapiens
taactgctcttg

SEQ ID NO: 557773 - DNA, 23 bp, Homo sapiens
taactgctcttgggcaatattct

SEQ ID NO: 557774 - DNA, 23 bp, Homo sapiens
taactgtcctttttcttccctta

SEQ ID NO: 557775 - DNA, 18 bp, Homo sapiens
taactgtgcaaagcagag

SEQ ID NO: 557776 - DNA, 15 bp, Homo sapiens
taactgtgtcatttg

SEQ ID NO: 557777 - DNA, 13 bp, Homo sapiens
taactgttaccat

SEQ ID NO: 557778 - DNA, 18 bp, Homo sapiens
taactgttaccattggaa

SEQ ID NO: 557779 - DNA, 12 bp, Homo sapiens
taacttctaaaa

SEQ ID NO: 557780 - DNA, 14 bp, Homo sapiens
taacttctaaaact

SEQ ID NO: 557781 - DNA, 15 bp, Homo sapiens
taacttctaaaactg

SEQ ID NO: 557782 - DNA, 14 bp, Homo sapiens
taacttgctgtgaa

SEQ ID NO: 557783 - DNA, 15 bp, Homo sapiens
taacttgctgtgaaa

SEQ ID NO: 557784 - DNA, 17 bp, Homo sapiens
taacttgtcttaaataa

SEQ ID NO: 557785 - DNA, 21 bp, Homo sapiens
taacttttgtagtcttatgaa

SEQ ID NO: 557786 - DNA, 12 bp, Homo sapiens
taagaaacattg

SEQ ID NO: 557787 - DNA, 15 bp, Homo sapiens
taagaattttttatt

SEQ ID NO: 557788 - DNA, 23 bp, Homo sapiens
taagaattttttattttttggta

SEQ ID NO: 557789 - DNA, 23 bp, Homo sapiens
taagacagacgcctgcttttgca

SEQ ID NO: 557790 - DNA, 15 bp, Homo sapiens
taagagaaatggcaa

SEQ ID NO: 557791 - DNA, 12 bp, Homo sapiens
taagagagaaat

SEQ ID NO: 557792 - DNA, 11 bp, Homo sapiens
taagagattta

SEQ ID NO: 557793 - DNA, 21 bp, Homo sapiens
taagagatttatctttataca

SEQ ID NO: 557794 - DNA, 15 bp, Homo sapiens
taagagattttatgt

SEQ ID NO: 557795 - DNA, 16 bp, Homo sapiens
taagagattttatgtt

SEQ ID NO: 557796 - DNA, 18 bp, Homo sapiens
taagataattaaatgaaa

SEQ ID NO: 557797 - DNA, 20 bp, Homo sapiens
taagataattaaatgaaata

SEQ ID NO: 557798 - DNA, 22 bp, Homo sapiens
taagataattaaatgaaatact

SEQ ID NO: 557799 - DNA, 16 bp, Homo sapiens
taagatcggttaacaa

SEQ ID NO: 557800 - DNA, 17 bp, Homo sapiens
taagatcggttaacaaa

SEQ ID NO: 557801 - DNA, 14 bp, Homo sapiens
taagatgttatatt

SEQ ID NO: 557802 - DNA, 22 bp, Homo sapiens
taagatgttatatttttcttaa

SEQ ID NO: 557803 - DNA, 17 bp, Homo sapiens
taagattgaagctaaaa

SEQ ID NO: 557804 - DNA, 13 bp, Homo sapiens
taagcaaatttca

SEQ ID NO: 557805 - DNA, 18 bp, Homo sapiens
taagcaaatttcaaaaga

SEQ ID NO: 557806 - DNA, 18 bp, Homo sapiens
taagcaacacttggaaca

SEQ ID NO: 557807 - DNA, 11 bp, Homo sapiens
taagcacaaaa

SEQ ID NO: 557808 - DNA, 19 bp, Homo sapiens
taagcacaaccatgttctt

SEQ ID NO: 557809 - DNA, 20 bp, Homo sapiens
taagcacagacaattctaat

SEQ ID NO: 557810 - DNA, 21 bp, Homo sapiens
taagcagaattggaaaagact

SEQ ID NO: 557811 - DNA, 12 bp, Homo sapiens
taagcagtccct

SEQ ID NO: 557812 - DNA, 17 bp, Homo sapiens
taagccactggtatctg

SEQ ID NO: 557813 - DNA, 17 bp, Homo sapiens
taagctaggaaaagaaa

SEQ ID NO: 557814 - DNA, 22 bp, Homo sapiens
taagctaggaaaagaaatctat

SEQ ID NO: 557815 - DNA, 13 bp, Homo sapiens
taaggacttcctg

SEQ ID NO: 557816 - DNA, 19 bp, Homo sapiens
taagggactccagaagcag

SEQ ID NO: 557817 - DNA, 20 bp, Homo sapiens
taagggactccagaagcagc

SEQ ID NO: 557818 - DNA, 14 bp, Homo sapiens
taagtaaactaatg

SEQ ID NO: 557819 - DNA, 16 bp, Homo sapiens
taagtaaatctcttct

SEQ ID NO: 557820 - DNA, 22 bp, Homo sapiens
taagtaaatctcttctgtgttt

SEQ ID NO: 557821 - DNA, 14 bp, Homo sapiens
taagtaaatgtctt

SEQ ID NO: 557822 - DNA, 17 bp, Homo sapiens
taagtccagctctcccc

SEQ ID NO: 557823 - DNA, 19 bp, Homo sapiens
taagtctcttttttacaaa

SEQ ID NO: 557824 - DNA, 11 bp, Homo sapiens
taagtgaaatt

SEQ ID NO: 557825 - DNA, 14 bp, Homo sapiens
taagtgaataataa

SEQ ID NO: 557826 - DNA, 17 bp, Homo sapiens
taagtgcacacagaaat

SEQ ID NO: 557827 - DNA, 18 bp, Homo sapiens
taagtgcacacagaaata

SEQ ID NO: 557828 - DNA, 23 bp, Homo sapiens
taagtgcttgaggccaaatgagt

SEQ ID NO: 557829 - DNA, 17 bp, Homo sapiens
gtagactatatacatgt

SEQ ID NO: 557830 - DNA, 15 bp, Homo sapiens
gtagaggtttaaaga

SEQ ID NO: 557831 - DNA, 17 bp, Homo sapiens
gtagagtatattgaaaa

SEQ ID NO: 557832 - DNA, 21 bp, Homo sapiens
gtagagtatattgaaaagaaa

SEQ ID NO: 557833 - DNA, 15 bp, Homo sapiens
gtagatgcttgctct

SEQ ID NO: 557834 - DNA, 20 bp, Homo sapiens
gtagcaaaccctgtcaaaca

SEQ ID NO: 557835 - DNA, 17 bp, Homo sapiens
gtagcaaatgagacagc

SEQ ID NO: 557836 - DNA, 15 bp, Homo sapiens
gtagctgtcatggtg

SEQ ID NO: 557837 - DNA, 14 bp, Homo sapiens
gtagctgtggggag

SEQ ID NO: 557838 - DNA, 16 bp, Homo sapiens
gtagctgtggggagct

SEQ ID NO: 557839 - DNA, 17 bp, Homo sapiens
gtagctgtggggagctg

SEQ ID NO: 557840 - DNA, 18 bp, Homo sapiens
gtagctgtggggagctgg

SEQ ID NO: 557841 - DNA, 16 bp, Homo sapiens
gtaggaatattatatt

SEQ ID NO: 557842 - DNA, 20 bp, Homo sapiens
gtaggaatattatatttgga

SEQ ID NO: 557843 - DNA, 18 bp, Homo sapiens
gtagggctctgacaaagc

SEQ ID NO: 557844 - DNA, 19 bp, Homo sapiens
gtagtgaagactccagaaa

SEQ ID NO: 557845 - DNA, 11 bp, Homo sapiens
gtagtgaccaa

SEQ ID NO: 557846 - DNA, 16 bp, Homo sapiens
gtagtgaccaatcggg

SEQ ID NO: 557847 - DNA, 17 bp, Homo sapiens
gtagtgttcagaaaaaa

SEQ ID NO: 557848 - DNA, 13 bp, Homo sapiens
gtataaacattaa

SEQ ID NO: 557849 - DNA, 21 bp, Homo sapiens
gtataaatgtatatacacata

SEQ ID NO: 557850 - DNA, 16 bp, Homo sapiens
gtataaatttttaagt

SEQ ID NO: 557851 - DNA, 21 bp, Homo sapiens
gtataagatgctgctgagcac

SEQ ID NO: 557852 - DNA, 14 bp, Homo sapiens
gtatacaatatata

SEQ ID NO: 557853 - DNA, 15 bp, Homo sapiens
gtatacaatatataa

SEQ ID NO: 557854 - DNA, 17 bp, Homo sapiens
gtatacaatatataaaa

SEQ ID NO: 557855 - DNA, 17 bp, Homo sapiens
gtatagaagtcttcatg

SEQ ID NO: 557856 - DNA, 18 bp, Homo sapiens
gtatagtatttgaaaaca

SEQ ID NO: 557857 - DNA, 13 bp, Homo sapiens
gtatatacacata

SEQ ID NO: 557858 - DNA, 14 bp, Homo sapiens
gtatatacacatat

SEQ ID NO: 557859 - DNA, 13 bp, Homo sapiens
gtatatatacata

SEQ ID NO: 557860 - DNA, 13 bp, Homo sapiens
gtatatatgtgta

SEQ ID NO: 557861 - DNA, 20 bp, Homo sapiens
gtatatgaggatgtatgtgt

SEQ ID NO: 557862 - DNA, 12 bp, Homo sapiens
gtatatgtaaca

SEQ ID NO: 557863 - DNA, 15 bp, Homo sapiens
gtatatgtttataca

SEQ ID NO: 557864 - DNA, 20 bp, Homo sapiens
gtatatgtttatacacacag

SEQ ID NO: 557865 - DNA, 18 bp, Homo sapiens
gtatccactgtttattca

SEQ ID NO: 557866 - DNA, 11 bp, Homo sapiens
gtatcgggggc

SEQ ID NO: 557867 - DNA, 20 bp, Homo sapiens
gtatcgggggctggggcagg

SEQ ID NO: 557868 - DNA, 22 bp, Homo sapiens
gtatggaagacaaatacacata

SEQ ID NO: 557869 - DNA, 17 bp, Homo sapiens
gtatgtttacactgtca

SEQ ID NO: 557870 - DNA, 23 bp, Homo sapiens
gtattcagcaaggcgctaacttg

SEQ ID NO: 557871 - DNA, 17 bp, Homo sapiens
gtattgacaataagaaa

SEQ ID NO: 557872 - DNA, 18 bp, Homo sapiens
gtattgacaataagaaac

SEQ ID NO: 557873 - DNA, 17 bp, Homo sapiens
gtattgccaaacattaa

SEQ ID NO: 557874 - DNA, 23 bp, Homo sapiens
gtattgccaaacattaatgttga

SEQ ID NO: 557875 - DNA, 13 bp, Homo sapiens
gtatttacttgtt

SEQ ID NO: 557876 - DNA, 22 bp, Homo sapiens
gtatttacttgttatgttgtaa

SEQ ID NO: 557877 - DNA, 23 bp, Homo sapiens
gtatttctttagaacaacataaa

SEQ ID NO: 557878 - DNA, 13 bp, Homo sapiens
gtatttgttaatt

SEQ ID NO: 557879 - DNA, 17 bp, Homo sapiens
gtatttgttaatttctt

SEQ ID NO: 557880 - DNA, 15 bp, Homo sapiens
gtattttaaaagcca

SEQ ID NO: 557881 - DNA, 23 bp, Homo sapiens
gtattttagtggaccctgaaatg

SEQ ID NO: 557882 - DNA, 23 bp, Homo sapiens
gtattttataagcacagacaatt

SEQ ID NO: 557883 - DNA, 15 bp, Homo sapiens
gtattttatgtatgt

SEQ ID NO: 557884 - DNA, 12 bp, Homo sapiens
gtcaagaaaagc

SEQ ID NO: 557885 - DNA, 22 bp, Homo sapiens
gtcaagtggcaaagctgttctt

SEQ ID NO: 557886 - DNA, 16 bp, Homo sapiens
gtcaagtttttatacc

SEQ ID NO: 557887 - DNA, 16 bp, Homo sapiens
gtcacaaagctattta

SEQ ID NO: 557888 - DNA, 14 bp, Homo sapiens
gtcacctgcttctc

SEQ ID NO: 557889 - DNA, 16 bp, Homo sapiens
gtcacctgcttctctg

SEQ ID NO: 557890 - DNA, 21 bp, Homo sapiens
gttgaagacctaaccagggcc

SEQ ID NO: 557891 - DNA, 20 bp, Homo sapiens
gttgaggaaagcacagaggc

SEQ ID NO: 557892 - DNA, 12 bp, Homo sapiens
gttgatgcaatc

SEQ ID NO: 557893 - DNA, 13 bp, Homo sapiens
gttgcactgaagt

SEQ ID NO: 557894 - DNA, 21 bp, Homo sapiens
gttgcactgaagtttgataaa

SEQ ID NO: 557895 - DNA, 22 bp, Homo sapiens
gttgcagactggtgttaatgag

SEQ ID NO: 557896 - DNA, 18 bp, Homo sapiens
gttgcccagcctctttcc

SEQ ID NO: 557897 - DNA, 20 bp, Homo sapiens
gttgcccagcctctttccct

SEQ ID NO: 557898 - DNA, 22 bp, Homo sapiens
gttgcccagcctctttcccttc

SEQ ID NO: 557899 - DNA, 14 bp, Homo sapiens
gttgctgcagattc

SEQ ID NO: 557900 - DNA, 14 bp, Homo sapiens
gttggaaacactaa

SEQ ID NO: 557901 - DNA, 13 bp, Homo sapiens
gttggactgtggc

SEQ ID NO: 557902 - DNA, 17 bp, Homo sapiens
gttggactgtggcctca

SEQ ID NO: 557903 - DNA, 16 bp, Homo sapiens
gttggccaagcagaaa

SEQ ID NO: 557904 - DNA, 19 bp, Homo sapiens
gttggtcttactttgttaa

SEQ ID NO: 557905 - DNA, 19 bp, Homo sapiens
gttgtaatattttgctgct

SEQ ID NO: 557906 - DNA, 14 bp, Homo sapiens
gttgtatgatctgt

SEQ ID NO: 557907 - DNA, 18 bp, Homo sapiens
gttgtccatattttcaca

SEQ ID NO: 557908 - DNA, 13 bp, Homo sapiens
gttgtgctgcctg

SEQ ID NO: 557909 - DNA, 18 bp, Homo sapiens
gttgttttttcattgtgt

SEQ ID NO: 557910 - DNA, 15 bp, Homo sapiens
gtttaaaaatcagaa

SEQ ID NO: 557911 - DNA, 16 bp, Homo sapiens
gtttaaaaatcagaaa

SEQ ID NO: 557912 - DNA, 14 bp, Homo sapiens
gtttaaacttttat

SEQ ID NO: 557913 - DNA, 19 bp, Homo sapiens
gtttaaacttttatgcgca

SEQ ID NO: 557914 - DNA, 18 bp, Homo sapiens
gtttaagcagaattggaa

SEQ ID NO: 557915 - DNA, 14 bp, Homo sapiens
gtttatacacacag

SEQ ID NO: 557916 - DNA, 14 bp, Homo sapiens
gtttcaaaaatctg

SEQ ID NO: 557917 - DNA, 15 bp, Homo sapiens
gtttcatccttccca

SEQ ID NO: 557918 - DNA, 20 bp, Homo sapiens
gtttccacacaggcccatgc

SEQ ID NO: 557919 - DNA, 22 bp, Homo sapiens
gtttccagctaagcctgatgat

SEQ ID NO: 557920 - DNA, 16 bp, Homo sapiens
gtttccaggcatgacc

SEQ ID NO: 557921 - DNA, 19 bp, Homo sapiens
gtttccaggcatgaccctg

SEQ ID NO: 557922 - DNA, 19 bp, Homo sapiens
gtttccatcaaagccctcc

SEQ ID NO: 557923 - DNA, 14 bp, Homo sapiens
gtttcttctttcta

SEQ ID NO: 557924 - DNA, 19 bp, Homo sapiens
gtttctttgaattttcatt

SEQ ID NO: 557925 - DNA, 20 bp, Homo sapiens
gtttctttgaattttcattt

SEQ ID NO: 557926 - DNA, 21 bp, Homo sapiens
gtttctttgaattttcatttt

SEQ ID NO: 557927 - DNA, 14 bp, Homo sapiens
gtttgataaatagt

SEQ ID NO: 557928 - DNA, 21 bp, Homo sapiens
gtttgatcttcctctgctaaa

SEQ ID NO: 557929 - DNA, 18 bp, Homo sapiens
gtttgatgtccccaaagt

SEQ ID NO: 557930 - DNA, 19 bp, Homo sapiens
gtttgccccgttctgtttg

SEQ ID NO: 557931 - DNA, 22 bp, Homo sapiens
gtttgctccccttccccttcct

SEQ ID NO: 557932 - DNA, 17 bp, Homo sapiens
gtttgtcctttatgtat

SEQ ID NO: 557933 - DNA, 14 bp, Homo sapiens
gtttgtctcttctg

SEQ ID NO: 557934 - DNA, 15 bp, Homo sapiens
gtttgtctcttctgg

SEQ ID NO: 557935 - DNA, 16 bp, Homo sapiens
gtttgtttctttgaat

SEQ ID NO: 557936 - DNA, 19 bp, Homo sapiens
gttttaaaatactgtagat

SEQ ID NO: 557937 - DNA, 20 bp, Homo sapiens
gttttattttctaaagtact

SEQ ID NO: 557938 - DNA, 14 bp, Homo sapiens
gttttcaaatggag

SEQ ID NO: 557939 - DNA, 14 bp, Homo sapiens
gttttgatatgagt

SEQ ID NO: 557940 - DNA, 16 bp, Homo sapiens
gttttgcatgtctgca

SEQ ID NO: 557941 - DNA, 18 bp, Homo sapiens
gttttgtgaaatttttca

SEQ ID NO: 557942 - DNA, 19 bp, Homo sapiens
gttttgttgcactgaagtt

SEQ ID NO: 557943 - DNA, 16 bp, Homo sapiens
gttttgttttttgagt

SEQ ID NO: 557944 - DNA, 13 bp, Homo sapiens
gtttttaaaatct

SEQ ID NO: 557945 - DNA, 19 bp, Homo sapiens
gtttttatacctgtacaca

SEQ ID NO: 557946 - DNA, 19 bp, Homo sapiens
gtttttatgatatccctga

SEQ ID NO: 557947 - DNA, 20 bp, Homo sapiens
gtttttatgatatccctgat

SEQ ID NO: 557948 - DNA, 12 bp, Homo sapiens
gtttttcagttc

SEQ ID NO: 557949 - DNA, 20 bp, Homo sapiens
gtttttcagttcaaagtcat

SEQ ID NO: 557950 - DNA, 14 bp, Homo sapiens
gtttttgttttgtt

SEQ ID NO: 557951 - DNA, 17 bp, Homo sapiens
gtttttgttttgttgca

SEQ ID NO: 557952 - DNA, 20 bp, Homo sapiens
gtttttttttcctgtccttc

SEQ ID NO: 557953 - DNA, 15 bp, Homo sapiens
taaaaaaaaaaatga

SEQ ID NO: 557954 - DNA, 15 bp, Homo sapiens
taaaaaaaaagttgg

SEQ ID NO: 557955 - DNA, 17 bp, Homo sapiens
taaaaaaaatgaaatgt

SEQ ID NO: 557956 - DNA, 10 bp, Homo sapiens
taaaaaaaga

SEQ ID NO: 557957 - DNA, 21 bp, Homo sapiens
taaaaactactgaataaatca

SEQ ID NO: 557958 - DNA, 14 bp, Homo sapiens
taaaaactgaagtt

SEQ ID NO: 557959 - DNA, 21 bp, Homo sapiens
taaaaagtattgccaaacatt

SEQ ID NO: 557960 - DNA, 14 bp, Homo sapiens
taaaaagtctttta

SEQ ID NO: 557961 - DNA, 12 bp, Homo sapiens
taaaaagttaat

SEQ ID NO: 557962 - DNA, 14 bp, Homo sapiens
taaaaatacaaaca

SEQ ID NO: 557963 - DNA, 21 bp, Homo sapiens
taaaaatagctataaatagtg

SEQ ID NO: 557964 - DNA, 22 bp, Homo sapiens
taaaaatcagaaagacattctt

SEQ ID NO: 557965 - DNA, 13 bp, Homo sapiens
taaaaatgcattt

SEQ ID NO: 557966 - DNA, 14 bp, Homo sapiens
taaaaatgcattta

SEQ ID NO: 557967 - DNA, 18 bp, Homo sapiens
taaaaatgcatttaagtt

SEQ ID NO: 557968 - DNA, 20 bp, Homo sapiens
taaaaatgcatttaagttgt

SEQ ID NO: 557969 - DNA, 22 bp, Homo sapiens
taaaaatgcatttaagttgtaa

SEQ ID NO: 557970 - DNA, 12 bp, Homo sapiens
taaaacaaaatc

SEQ ID NO: 557971 - DNA, 22 bp, Homo sapiens
taaaacatttcatgtatttctt

SEQ ID NO: 557972 - DNA, 16 bp, Homo sapiens
taaaaccagaaagagg

SEQ ID NO: 557973 - DNA, 22 bp, Homo sapiens
taaaactgtactttgattcaca

SEQ ID NO: 557974 - DNA, 17 bp, Homo sapiens
taaaacttactatggta

SEQ ID NO: 557975 - DNA, 20 bp, Homo sapiens
taaaagaaatgcacaatgtc

SEQ ID NO: 557976 - DNA, 21 bp, Homo sapiens
taaaagaaatgcacaatgtct

SEQ ID NO: 557977 - DNA, 23 bp, Homo sapiens
taaaagaaatgcacaatgtcttg

SEQ ID NO: 557978 - DNA, 15 bp, Homo sapiens
taaaagaaatttatt

SEQ ID NO: 557979 - DNA, 20 bp, Homo sapiens
taaaatacatggtatctctt

SEQ ID NO: 557980 - DNA, 12 bp, Homo sapiens
taaaatactgta

SEQ ID NO: 557981 - DNA, 17 bp, Homo sapiens
taaaatactgtagataa

SEQ ID NO: 557982 - DNA, 14 bp, Homo sapiens
taaaatatgcacta

SEQ ID NO: 557983 - DNA, 17 bp, Homo sapiens
taaaatcccattgtatt

SEQ ID NO: 557984 - DNA, 16 bp, Homo sapiens
ggcctggccagaccag

SEQ ID NO: 557985 - DNA, 17 bp, Homo sapiens
ggcctggggccgggctg

SEQ ID NO: 557986 - DNA, 22 bp, Homo sapiens
ggcctggggctgccgtgcacgg

SEQ ID NO: 557987 - DNA, 19 bp, Homo sapiens
ggcctgtacaaaagggaca

SEQ ID NO: 557988 - DNA, 19 bp, Homo sapiens
ggcgagttctctttggaaa

SEQ ID NO: 557989 - DNA, 20 bp, Homo sapiens
ggcgccttctacctgcagga

SEQ ID NO: 557990 - DNA, 21 bp, Homo sapiens
ggcgctagaggccatggaggc

SEQ ID NO: 557991 - DNA, 19 bp, Homo sapiens
ggcgctagcacagctccct

SEQ ID NO: 557992 - DNA, 18 bp, Homo sapiens
ggcgtagggccagggctc

SEQ ID NO: 557993 - DNA, 19 bp, Homo sapiens
ggcgtagggccagggctct

SEQ ID NO: 557994 - DNA, 21 bp, Homo sapiens
ggcgtagggccagggctctgg

SEQ ID NO: 557995 - DNA, 14 bp, Homo sapiens
ggcgtgaaacacaa

SEQ ID NO: 557996 - DNA, 16 bp, Homo sapiens
ggcgtggcaaatataa

SEQ ID NO: 557997 - DNA, 19 bp, Homo sapiens
ggctcagtgtaggtcccaa

SEQ ID NO: 557998 - DNA, 22 bp, Homo sapiens
ggctccacacacacaaaaaaag

SEQ ID NO: 557999 - DNA, 23 bp, Homo sapiens
ggctccacacacacaaaaaaaga

SEQ ID NO: 558000 - DNA, 15 bp, Homo sapiens
ggctccacgggggcc

SEQ ID NO: 558001 - DNA, 22 bp, Homo sapiens
ggctccacgggggcctagtggc

SEQ ID NO: 558002 - DNA, 15 bp, Homo sapiens
ggctccagtccccag

SEQ ID NO: 558003 - DNA, 22 bp, Homo sapiens
ggctcccaaaacacctgacagc

SEQ ID NO: 558004 - DNA, 22 bp, Homo sapiens
ggctcccgtgtatctggacact

SEQ ID NO: 558005 - DNA, 23 bp, Homo sapiens
ggctccctccctcccagatccag

SEQ ID NO: 558006 - DNA, 13 bp, Homo sapiens
ggctcctcaccac

SEQ ID NO: 558007 - DNA, 12 bp, Homo sapiens
ggctcctgccca

SEQ ID NO: 558008 - DNA, 15 bp, Homo sapiens
ggctcctgcccccat

SEQ ID NO: 558009 - DNA, 18 bp, Homo sapiens
ggctctgggttcgggaag

SEQ ID NO: 558010 - DNA, 13 bp, Homo sapiens
ggctgacccccct

SEQ ID NO: 558011 - DNA, 19 bp, Homo sapiens
ggctgcccacacaccccaa

SEQ ID NO: 558012 - DNA, 19 bp, Homo sapiens
ggctgctgcactgccctcc

SEQ ID NO: 558013 - DNA, 14 bp, Homo sapiens
ggctggataggaga

SEQ ID NO: 558014 - DNA, 16 bp, Homo sapiens
ggctggggcaggaggg

SEQ ID NO: 558015 - DNA, 14 bp, Homo sapiens
ggctgtgggctccc

SEQ ID NO: 558016 - DNA, 16 bp, Homo sapiens
ggctgtgggctccctt

SEQ ID NO: 558017 - DNA, 22 bp, Homo sapiens
ggcttactacatgtgggagctt

SEQ ID NO: 558018 - DNA, 14 bp, Homo sapiens
ggcttcagcccctg

SEQ ID NO: 558019 - DNA, 15 bp, Homo sapiens
ggcttgcactctctt

SEQ ID NO: 558020 - DNA, 17 bp, Homo sapiens
ggcttttgtgccaggag

SEQ ID NO: 558021 - DNA, 17 bp, Homo sapiens
ggcttttgttttgcttt

SEQ ID NO: 558022 - DNA, 22 bp, Homo sapiens
gggaaaataaaaaaagaaaaaa

SEQ ID NO: 558023 - DNA, 18 bp, Homo sapiens
gggaaatgctgatttaaa

SEQ ID NO: 558024 - DNA, 21 bp, Homo sapiens
gggaacagtaaagaaagcaga

SEQ ID NO: 558025 - DNA, 19 bp, Homo sapiens
gggacacacttagctggag

SEQ ID NO: 558026 - DNA, 20 bp, Homo sapiens
gggacaggaacacccagccc

SEQ ID NO: 558027 - DNA, 23 bp, Homo sapiens
gggacagggaggtgtgaggcagg

SEQ ID NO: 558028 - DNA, 21 bp, Homo sapiens
gggagagatctccaactctct

SEQ ID NO: 558029 - DNA, 12 bp, Homo sapiens
gggagagctgaa

SEQ ID NO: 558030 - DNA, 12 bp, Homo sapiens
gggagagtgagg

SEQ ID NO: 558031 - DNA, 14 bp, Homo sapiens
gggagatccgccct

SEQ ID NO: 558032 - DNA, 22 bp, Homo sapiens
gggagatccgccctgggctctg

SEQ ID NO: 558033 - DNA, 19 bp, Homo sapiens
gggagcctgcgtggcctgg

SEQ ID NO: 558034 - DNA, 11 bp, Homo sapiens
gggagctcctg

SEQ ID NO: 558035 - DNA, 22 bp, Homo sapiens
gggagctggctccagcctggaa

SEQ ID NO: 558036 - DNA, 12 bp, Homo sapiens
gggaggagaaga

SEQ ID NO: 558037 - DNA, 17 bp, Homo sapiens
gggaggagactcaggcc

SEQ ID NO: 558038 - DNA, 12 bp, Homo sapiens
gggaggctgaga

SEQ ID NO: 558039 - DNA, 13 bp, Homo sapiens
gggatatttccta

SEQ ID NO: 558040 - DNA, 13 bp, Homo sapiens
gggatgtttttct

SEQ ID NO: 558041 - DNA, 23 bp, Homo sapiens
gggatttgttgattctctccatt

SEQ ID NO: 558042 - DNA, 23 bp, Homo sapiens
gggcaatattctctgtacatatt

SEQ ID NO: 558043 - DNA, 19 bp, Homo sapiens
gggcagtgacgtgagtggg

SEQ ID NO: 558044 - DNA, 16 bp, Homo sapiens
gggcatccccagcccc

SEQ ID NO: 558045 - DNA, 21 bp, Homo sapiens
gggccatcgcaagtcacagaa

SEQ ID NO: 558046 - DNA, 11 bp, Homo sapiens
gggcccagagg

SEQ ID NO: 558047 - DNA, 22 bp, Homo sapiens
gggcccagaggggcggggccag

SEQ ID NO: 558048 - DNA, 12 bp, Homo sapiens
gggccccacctg

SEQ ID NO: 558049 - DNA, 21 bp, Homo sapiens
gggccctgcagctctcatgct

SEQ ID NO: 558050 - DNA, 18 bp, Homo sapiens
gggccctggttcccccag

SEQ ID NO: 558051 - DNA, 22 bp, Homo sapiens
gggcctagtggcttcagcccct

SEQ ID NO: 558052 - DNA, 22 bp, Homo sapiens
gggcctgaaagcaacagctgga

SEQ ID NO: 558053 - DNA, 19 bp, Homo sapiens
ggacacttatccacgagag

SEQ ID NO: 558054 - DNA, 16 bp, Homo sapiens
ggacaggaacacccag

SEQ ID NO: 558055 - DNA, 20 bp, Homo sapiens
ggacaggaacacccagcccc

SEQ ID NO: 558056 - DNA, 13 bp, Homo sapiens
ggacaggcaggtg

SEQ ID NO: 558057 - DNA, 22 bp, Homo sapiens
ggacagtggagtgcaaaaggct

SEQ ID NO: 558058 - DNA, 13 bp, Homo sapiens
ggaccagagactt

SEQ ID NO: 558059 - DNA, 16 bp, Homo sapiens
ggacccatgaaacagc

SEQ ID NO: 558060 - DNA, 17 bp, Homo sapiens
ggaccccatctgctgag

SEQ ID NO: 558061 - DNA, 18 bp, Homo sapiens
ggaccctcgctggccccc

SEQ ID NO: 558062 - DNA, 16 bp, Homo sapiens
ggaccctgaaatgtgt

SEQ ID NO: 558063 - DNA, 23 bp, Homo sapiens
ggaccctgagggtttccaccttg

SEQ ID NO: 558064 - DNA, 19 bp, Homo sapiens
ggacctccacctgggagat

SEQ ID NO: 558065 - DNA, 13 bp, Homo sapiens
ggacgctctgctg

SEQ ID NO: 558066 - DNA, 16 bp, Homo sapiens
ggactccagaagcagc

SEQ ID NO: 558067 - DNA, 22 bp, Homo sapiens
ggactcgggctaagtccagctc

SEQ ID NO: 558068 - DNA, 16 bp, Homo sapiens
ggactctgccttccag

SEQ ID NO: 558069 - DNA, 13 bp, Homo sapiens
ggactctgtgggg

SEQ ID NO: 558070 - DNA, 19 bp, Homo sapiens
ggactctgtggggccacac

SEQ ID NO: 558071 - DNA, 12 bp, Homo sapiens
ggactgtggcct

SEQ ID NO: 558072 - DNA, 22 bp, Homo sapiens
ggactgtggcctcaggaggcag

SEQ ID NO: 558073 - DNA, 14 bp, Homo sapiens
ggagaagaatggct

SEQ ID NO: 558074 - DNA, 15 bp, Homo sapiens
ggagactcaggccca

SEQ ID NO: 558075 - DNA, 12 bp, Homo sapiens
ggagagcctggt

SEQ ID NO: 558076 - DNA, 12 bp, Homo sapiens
ggagagtgaggt

SEQ ID NO: 558077 - DNA, 14 bp, Homo sapiens
ggagatccgccctg

SEQ ID NO: 558078 - DNA, 12 bp, Homo sapiens
ggagcccaggag

SEQ ID NO: 558079 - DNA, 13 bp, Homo sapiens
ggagcccaggagt

SEQ ID NO: 558080 - DNA, 16 bp, Homo sapiens
ggagcctgacagccag

SEQ ID NO: 558081 - DNA, 17 bp, Homo sapiens
ggagcctgacagccaga

SEQ ID NO: 558082 - DNA, 23 bp, Homo sapiens
ggagcctgcgtggcctggggctg

SEQ ID NO: 558083 - DNA, 18 bp, Homo sapiens
ggagctttctcaatgtct

SEQ ID NO: 558084 - DNA, 19 bp, Homo sapiens
ggagctttctcaatgtctt

SEQ ID NO: 558085 - DNA, 13 bp, Homo sapiens
ggaggaatcagac

SEQ ID NO: 558086 - DNA, 22 bp, Homo sapiens
ggaggaccagggctggggcagc

SEQ ID NO: 558087 - DNA, 15 bp, Homo sapiens
ggaggagacagtcag

SEQ ID NO: 558088 - DNA, 15 bp, Homo sapiens
ggaggagactcaggc

SEQ ID NO: 558089 - DNA, 16 bp, Homo sapiens
ggaggagactcaggcc

SEQ ID NO: 558090 - DNA, 16 bp, Homo sapiens
ggaggcacacagctgc

SEQ ID NO: 558091 - DNA, 17 bp, Homo sapiens
ggaggcagtggcttgga

SEQ ID NO: 558092 - DNA, 20 bp, Homo sapiens
ggaggctgagatgggaggat

SEQ ID NO: 558093 - DNA, 15 bp, Homo sapiens
ggaggctgaggcagg

SEQ ID NO: 558094 - DNA, 18 bp, Homo sapiens
ggaggggaacgtgctgac

SEQ ID NO: 558095 - DNA, 17 bp, Homo sapiens
ggaggtgtgaggcagga

SEQ ID NO: 558096 - DNA, 15 bp, Homo sapiens
ggagtccagacctgg

SEQ ID NO: 558097 - DNA, 18 bp, Homo sapiens
ggagtccagacctgggcc

SEQ ID NO: 558098 - DNA, 21 bp, Homo sapiens
ggagttcaagaccagcctggc

SEQ ID NO: 558099 - DNA, 19 bp, Homo sapiens
ggagttcattcatattaca

SEQ ID NO: 558100 - DNA, 18 bp, Homo sapiens
ggataactgatggcaata

SEQ ID NO: 558101 - DNA, 16 bp, Homo sapiens
ggataatatatttgca

SEQ ID NO: 558102 - DNA, 14 bp, Homo sapiens
ggatatgagtagcc

SEQ ID NO: 558103 - DNA, 21 bp, Homo sapiens
ggatctgaggacaaggaaatt

SEQ ID NO: 558104 - DNA, 11 bp, Homo sapiens
ggatgcatatt

SEQ ID NO: 558105 - DNA, 14 bp, Homo sapiens
ggatggagctggag

SEQ ID NO: 558106 - DNA, 14 bp, Homo sapiens
ggatggcacaatga

SEQ ID NO: 558107 - DNA, 20 bp, Homo sapiens
ggatggggttgggctctgcg

SEQ ID NO: 558108 - DNA, 14 bp, Homo sapiens
ggatggtggtgcat

SEQ ID NO: 558109 - DNA, 13 bp, Homo sapiens
ggatgtatgtgta

SEQ ID NO: 558110 - DNA, 12 bp, Homo sapiens
ggatgtcccttc

SEQ ID NO: 558111 - DNA, 22 bp, Homo sapiens
ggattcccgtggctttgtgctt

SEQ ID NO: 558112 - DNA, 23 bp, Homo sapiens
ggattcctaatcactcagagcag

SEQ ID NO: 558113 - DNA, 14 bp, Homo sapiens
ggattgaggatgaa

SEQ ID NO: 558114 - DNA, 20 bp, Homo sapiens
ggcaaaccaatttgttctgt

SEQ ID NO: 558115 - DNA, 17 bp, Homo sapiens
ggcaaactgaggcagca

SEQ ID NO: 558116 - DNA, 23 bp, Homo sapiens
gcctgcgtggcctggggctgccg

SEQ ID NO: 558117 - DNA, 14 bp, Homo sapiens
gcctgcgtggctga

SEQ ID NO: 558118 - DNA, 22 bp, Homo sapiens
gcctgctttagaatgttttcct

SEQ ID NO: 558119 - DNA, 15 bp, Homo sapiens
gcctgcttttgcaaa

SEQ ID NO: 558120 - DNA, 17 bp, Homo sapiens
gcctggaaacctgtctg

SEQ ID NO: 558121 - DNA, 13 bp, Homo sapiens
gcctggggctgcc

SEQ ID NO: 558122 - DNA, 14 bp, Homo sapiens
gcctggggctgccg

SEQ ID NO: 558123 - DNA, 14 bp, Homo sapiens
gcctggggtcaggc

SEQ ID NO: 558124 - DNA, 18 bp, Homo sapiens
gcctggtcgccttccacc

SEQ ID NO: 558125 - DNA, 12 bp, Homo sapiens
gcctggtctcct

SEQ ID NO: 558126 - DNA, 12 bp, Homo sapiens
gccttaaaactt

SEQ ID NO: 558127 - DNA, 19 bp, Homo sapiens
gccttaaacagtgtccagg

SEQ ID NO: 558128 - DNA, 22 bp, Homo sapiens
gccttcacaatctgtcagttct

SEQ ID NO: 558129 - DNA, 12 bp, Homo sapiens
gccttccaggcg

SEQ ID NO: 558130 - DNA, 15 bp, Homo sapiens
gccttctacctgcag

SEQ ID NO: 558131 - DNA, 14 bp, Homo sapiens
gccttctcccctcc

SEQ ID NO: 558132 - DNA, 19 bp, Homo sapiens
gccttgatttgttcttaca

SEQ ID NO: 558133 - DNA, 18 bp, Homo sapiens
gccttgcccactcctgct

SEQ ID NO: 558134 - DNA, 16 bp, Homo sapiens
gccttgggctctgctg

SEQ ID NO: 558135 - DNA, 22 bp, Homo sapiens
gcctttatctaccaactttcaa

SEQ ID NO: 558136 - DNA, 17 bp, Homo sapiens
gcctttcagcaggcagc

SEQ ID NO: 558137 - DNA, 18 bp, Homo sapiens
gcctttcagcaggcagcc

SEQ ID NO: 558138 - DNA, 11 bp, Homo sapiens
gcctttgaagt

SEQ ID NO: 558139 - DNA, 21 bp, Homo sapiens
gcgagtctggagaccaggact

SEQ ID NO: 558140 - DNA, 13 bp, Homo sapiens
gcgcaaaactgaa

SEQ ID NO: 558141 - DNA, 16 bp, Homo sapiens
gcgcaaatacaaaatg

SEQ ID NO: 558142 - DNA, 12 bp, Homo sapiens
gcgcaggccctc

SEQ ID NO: 558143 - DNA, 18 bp, Homo sapiens
gcgccttctacctgcagg

SEQ ID NO: 558144 - DNA, 19 bp, Homo sapiens
gcgccttctacctgcagga

SEQ ID NO: 558145 - DNA, 19 bp, Homo sapiens
gcgctcccttgacctgctg

SEQ ID NO: 558146 - DNA, 14 bp, Homo sapiens
gcggccggcctggg

SEQ ID NO: 558147 - DNA, 17 bp, Homo sapiens
gcggccggcctggggcc

SEQ ID NO: 558148 - DNA, 19 bp, Homo sapiens
gcggccggcctggggccgg

SEQ ID NO: 558149 - DNA, 23 bp, Homo sapiens
gcggccggcctggggccgggctg

SEQ ID NO: 558150 - DNA, 19 bp, Homo sapiens
gcggctccagccccagaca

SEQ ID NO: 558151 - DNA, 14 bp, Homo sapiens
gcgggctgggcagc

SEQ ID NO: 558152 - DNA, 13 bp, Homo sapiens
gcggtatccagag

SEQ ID NO: 558153 - DNA, 18 bp, Homo sapiens
gcggtttatcgccctggc

SEQ ID NO: 558154 - DNA, 13 bp, Homo sapiens
gcgtagggccagg

SEQ ID NO: 558155 - DNA, 20 bp, Homo sapiens
gcgtccctgagggcccttcc

SEQ ID NO: 558156 - DNA, 22 bp, Homo sapiens
gcgtggcccaccaggcccccct

SEQ ID NO: 558157 - DNA, 15 bp, Homo sapiens
gcgtggcctggggct

SEQ ID NO: 558158 - DNA, 12 bp, Homo sapiens
gctaaaatgttt

SEQ ID NO: 558159 - DNA, 14 bp, Homo sapiens
gctaaaatgttttc

SEQ ID NO: 558160 - DNA, 18 bp, Homo sapiens
gctaaattgatgttgatg

SEQ ID NO: 558161 - DNA, 19 bp, Homo sapiens
gctaacttgcttaaatgtg

SEQ ID NO: 558162 - DNA, 19 bp, Homo sapiens
gctaagagcctctggaagg

SEQ ID NO: 558163 - DNA, 16 bp, Homo sapiens
gctaaggacaggcagg

SEQ ID NO: 558164 - DNA, 20 bp, Homo sapiens
gctaatacaggaaacaagag

SEQ ID NO: 558165 - DNA, 16 bp, Homo sapiens
gctacaggggaggctg

SEQ ID NO: 558166 - DNA, 19 bp, Homo sapiens
gctacccaaaagagaaaaa

SEQ ID NO: 558167 - DNA, 19 bp, Homo sapiens
gctactcgtgagcgccagt

SEQ ID NO: 558168 - DNA, 21 bp, Homo sapiens
gctacttaagagaaatggcaa

SEQ ID NO: 558169 - DNA, 17 bp, Homo sapiens
gctacttatattctgca

SEQ ID NO: 558170 - DNA, 17 bp, Homo sapiens
gctacttcctgcctggt

SEQ ID NO: 558171 - DNA, 21 bp, Homo sapiens
gctagaaagagaaaaagccct

SEQ ID NO: 558172 - DNA, 22 bp, Homo sapiens
gctaggcagggtgtctgccccc

SEQ ID NO: 558173 - DNA, 19 bp, Homo sapiens
gctaggtgctaattaataa

SEQ ID NO: 558174 - DNA, 17 bp, Homo sapiens
gctagtgatgtttttat

SEQ ID NO: 558175 - DNA, 18 bp, Homo sapiens
gctataaatagtgaaaat

SEQ ID NO: 558176 - DNA, 14 bp, Homo sapiens
gctatatatataaa

SEQ ID NO: 558177 - DNA, 16 bp, Homo sapiens
gctatatatataaata

SEQ ID NO: 558178 - DNA, 14 bp, Homo sapiens
gctatgaagaaaac

SEQ ID NO: 558179 - DNA, 15 bp, Homo sapiens
gctatggcctgtgcg

SEQ ID NO: 558180 - DNA, 17 bp, Homo sapiens
gctatgtcatttcatgt

SEQ ID NO: 558181 - DNA, 16 bp, Homo sapiens
gctatgtctcatgttt

SEQ ID NO: 558182 - DNA, 16 bp, Homo sapiens
gctcaacaataaaaca

SEQ ID NO: 558183 - DNA, 14 bp, Homo sapiens
gctcaattgttaat

SEQ ID NO: 558184 - DNA, 19 bp, Homo sapiens
gctcagagtgaagagtgaa

SEQ ID NO: 558185 - DNA, 21 bp, Homo sapiens
gctcagagtgaagagtgaaga

SEQ ID NO: 558186 - DNA, 22 bp, Homo sapiens
gctcagcacagcctcacccctg

SEQ ID NO: 558187 - DNA, 12 bp, Homo sapiens
gctccaggcagc

SEQ ID NO: 558188 - DNA, 13 bp, Homo sapiens
gctccatccttct

SEQ ID NO: 558189 - DNA, 15 bp, Homo sapiens
gctcccactgcccct

SEQ ID NO: 558190 - DNA, 18 bp, Homo sapiens
gctcccactgcccctgca

SEQ ID NO: 558191 - DNA, 22 bp, Homo sapiens
gctcccaggacgcagggagacc

SEQ ID NO: 558192 - DNA, 17 bp, Homo sapiens
gctcccccttttccctc

SEQ ID NO: 558193 - DNA, 20 bp, Homo sapiens
gctccccttccccttccttc

SEQ ID NO: 558194 - DNA, 16 bp, Homo sapiens
gctccctccctcccag

SEQ ID NO: 558195 - DNA, 20 bp, Homo sapiens
gctccctccgggtcttccta

SEQ ID NO: 558196 - DNA, 21 bp, Homo sapiens
gctccctgaatctgaccacag

SEQ ID NO: 558197 - DNA, 23 bp, Homo sapiens
gctccggcgtgtgttcagtgtta

SEQ ID NO: 558198 - DNA, 15 bp, Homo sapiens
gctccgggctccgac

SEQ ID NO: 558199 - DNA, 17 bp, Homo sapiens
gctcctccagtacaata

SEQ ID NO: 558200 - DNA, 18 bp, Homo sapiens
gctcctcggccagagctc

SEQ ID NO: 558201 - DNA, 11 bp, Homo sapiens
gctcctgccca

SEQ ID NO: 558202 - DNA, 14 bp, Homo sapiens
gctcctgcccccat

SEQ ID NO: 558203 - DNA, 18 bp, Homo sapiens
gctccttttccagagcat

SEQ ID NO: 558204 - DNA, 17 bp, Homo sapiens
gctctcatgctgcccct

SEQ ID NO: 558205 - DNA, 20 bp, Homo sapiens
gctctcccctcccttgtcct

SEQ ID NO: 558206 - DNA, 20 bp, Homo sapiens
gctctcccctgcgcaggccc

SEQ ID NO: 558207 - DNA, 21 bp, Homo sapiens
gctctcccctgcgcaggccct

SEQ ID NO: 558208 - DNA, 20 bp, Homo sapiens
gctctcctaggtagccccct

SEQ ID NO: 558209 - DNA, 19 bp, Homo sapiens
gctctcgcacacctctgca

SEQ ID NO: 558210 - DNA, 18 bp, Homo sapiens
gctctctgtataaacatt

SEQ ID NO: 558211 - DNA, 20 bp, Homo sapiens
gctctgaatgctatttgtgt

SEQ ID NO: 558212 - DNA, 17 bp, Homo sapiens
gctctgagatcctggag

SEQ ID NO: 558213 - DNA, 19 bp, Homo sapiens
gctctgccatcagcccctg

SEQ ID NO: 558214 - DNA, 14 bp, Homo sapiens
gctctgggttcggg

SEQ ID NO: 558215 - DNA, 15 bp, Homo sapiens
gctctgtgtgttaaa

SEQ ID NO: 558216 - DNA, 19 bp, Homo sapiens
gctctgtgtgttaaaatga

SEQ ID NO: 558217 - DNA, 15 bp, Homo sapiens
gctgaagagtgagga

SEQ ID NO: 558218 - DNA, 11 bp, Homo sapiens
gctgaagccag

SEQ ID NO: 558219 - DNA, 19 bp, Homo sapiens
gctgacccccctcaggacc

SEQ ID NO: 558220 - DNA, 21 bp, Homo sapiens
gctgagaaggcaaactgaggc

SEQ ID NO: 558221 - DNA, 19 bp, Homo sapiens
gctgagatgggaggatcac

SEQ ID NO: 558222 - DNA, 15 bp, Homo sapiens
gctgagtgagctgaa

SEQ ID NO: 558223 - DNA, 21 bp, Homo sapiens
gctgatgacccccccagcttc

SEQ ID NO: 558224 - DNA, 19 bp, Homo sapiens
gctgatttactaacagtaa

SEQ ID NO: 558225 - DNA, 15 bp, Homo sapiens
gctgcaccaggtaga

SEQ ID NO: 558226 - DNA, 18 bp, Homo sapiens
gctgcagagacagagagg

SEQ ID NO: 558227 - DNA, 16 bp, Homo sapiens
gctgcaggaatcaaaa

SEQ ID NO: 558228 - DNA, 15 bp, Homo sapiens
gctgccaggctccca

SEQ ID NO: 558229 - DNA, 10 bp, Homo sapiens
gctgccagta

SEQ ID NO: 558230 - DNA, 15 bp, Homo sapiens
gctgccagtaccagc

SEQ ID NO: 558231 - DNA, 17 bp, Homo sapiens
gctgccagtaccagccc

SEQ ID NO: 558232 - DNA, 21 bp, Homo sapiens
gctgcccccagaccccatcca

SEQ ID NO: 558233 - DNA, 18 bp, Homo sapiens
gctgcccctccctgccag

SEQ ID NO: 558234 - DNA, 22 bp, Homo sapiens
gctgcccctccctgccagcacc

SEQ ID NO: 558235 - DNA, 20 bp, Homo sapiens
gctgccgtgcacggggccag

SEQ ID NO: 558236 - DNA, 14 bp, Homo sapiens
gctgctatgctgtt

SEQ ID NO: 558237 - DNA, 19 bp, Homo sapiens
gctgctcctcggccagagc

SEQ ID NO: 558238 - DNA, 20 bp, Homo sapiens
gctgctcctcggccagagct

SEQ ID NO: 558239 - DNA, 23 bp, Homo sapiens
gctgctgagcacatctcttcatg

SEQ ID NO: 558240 - DNA, 13 bp, Homo sapiens
gctgctgcacagc

SEQ ID NO: 558241 - DNA, 22 bp, Homo sapiens
gctgctgcacagctggccacca

SEQ ID NO: 558242 - DNA, 14 bp, Homo sapiens
gctggacaccccct

SEQ ID NO: 558243 - DNA, 17 bp, Homo sapiens
gctggatataatgtatt

SEQ ID NO: 558244 - DNA, 14 bp, Homo sapiens
gctggctccagcct

SEQ ID NO: 558245 - DNA, 15 bp, Homo sapiens
gctggcttctccctg

SEQ ID NO: 558246 - DNA, 16 bp, Homo sapiens
gctggcttctccctgg

SEQ ID NO: 558247 - DNA, 12 bp, Homo sapiens
gctgggaccctc

SEQ ID NO: 558248 - DNA, 17 bp, Homo sapiens
gctgggacttcttaccc

SEQ ID NO: 558249 - DNA, 23 bp, Homo sapiens
gctgggacttcttacccaaagca

SEQ ID NO: 558250 - DNA, 20 bp, Homo sapiens
gctgggcccacccaagcagg

SEQ ID NO: 558251 - DNA, 18 bp, Homo sapiens
gctggggcttttgtgcca

SEQ ID NO: 558252 - DNA, 22 bp, Homo sapiens
gctgggggcagcctgcgtggct

SEQ ID NO: 558253 - DNA, 14 bp, Homo sapiens
gctgggtcccgggt

SEQ ID NO: 558254 - DNA, 17 bp, Homo sapiens
gctgggtcccgggtgcc

SEQ ID NO: 558255 - DNA, 13 bp, Homo sapiens
gctggtcactgcc

SEQ ID NO: 558256 - DNA, 14 bp, Homo sapiens
gctggtcacttctt

SEQ ID NO: 558257 - DNA, 22 bp, Homo sapiens
gctggtcacttcttctgtccaa

SEQ ID NO: 558258 - DNA, 19 bp, Homo sapiens
gcatgtacaaaaacacaaa

SEQ ID NO: 558259 - DNA, 22 bp, Homo sapiens
gcatgtcccatgtgagctgctg

SEQ ID NO: 558260 - DNA, 16 bp, Homo sapiens
gcatgtcgcacaatgt

SEQ ID NO: 558261 - DNA, 11 bp, Homo sapiens
gcatgtctgca

SEQ ID NO: 558262 - DNA, 20 bp, Homo sapiens
gcatgtggcctttatctcaa

SEQ ID NO: 558263 - DNA, 12 bp, Homo sapiens
gcatgtgtgtat

SEQ ID NO: 558264 - DNA, 13 bp, Homo sapiens
gcatgtgtgtata

SEQ ID NO: 558265 - DNA, 13 bp, Homo sapiens
gcattacaggcaa

SEQ ID NO: 558266 - DNA, 14 bp, Homo sapiens
gcattctctctcca

SEQ ID NO: 558267 - DNA, 19 bp, Homo sapiens
gcattggggatgtttttct

SEQ ID NO: 558268 - DNA, 18 bp, Homo sapiens
gcatttagcacagtattt

SEQ ID NO: 558269 - DNA, 23 bp, Homo sapiens
gcatttccaacaccacagacaca

SEQ ID NO: 558270 - DNA, 13 bp, Homo sapiens
gcattttctgaaa

SEQ ID NO: 558271 - DNA, 12 bp, Homo sapiens
gccaaacattaa

SEQ ID NO: 558272 - DNA, 23 bp, Homo sapiens
gccaaacattaatgttgatttct

SEQ ID NO: 558273 - DNA, 20 bp, Homo sapiens
gccaaatcctgggcatcccc

SEQ ID NO: 558274 - DNA, 15 bp, Homo sapiens
gccaagaattagatt

SEQ ID NO: 558275 - DNA, 22 bp, Homo sapiens
gccaagaggtttggctcctgcc

SEQ ID NO: 558276 - DNA, 22 bp, Homo sapiens
gccaatctccaggctccctccc

SEQ ID NO: 558277 - DNA, 13 bp, Homo sapiens
gccaccctgtgca

SEQ ID NO: 558278 - DNA, 23 bp, Homo sapiens
gccacctcctctgttcttggaac

SEQ ID NO: 558279 - DNA, 14 bp, Homo sapiens
gccacggcagccta

SEQ ID NO: 558280 - DNA, 14 bp, Homo sapiens
gccactaaggtcag

SEQ ID NO: 558281 - DNA, 15 bp, Homo sapiens
gccactttaagagag

SEQ ID NO: 558282 - DNA, 17 bp, Homo sapiens
gccactttaagagagaa

SEQ ID NO: 558283 - DNA, 22 bp, Homo sapiens
gccactttaagagagaaatctg

SEQ ID NO: 558284 - DNA, 16 bp, Homo sapiens
gccagaactctgtgtc

SEQ ID NO: 558285 - DNA, 16 bp, Homo sapiens
gccagaagtagctttg

SEQ ID NO: 558286 - DNA, 18 bp, Homo sapiens
gccagagctcccaggacg

SEQ ID NO: 558287 - DNA, 17 bp, Homo sapiens
gccagcaacacagagca

SEQ ID NO: 558288 - DNA, 16 bp, Homo sapiens
gccaggagtgggtggg

SEQ ID NO: 558289 - DNA, 17 bp, Homo sapiens
gccaggcacggaggctc

SEQ ID NO: 558290 - DNA, 16 bp, Homo sapiens
gccagggaccccagaa

SEQ ID NO: 558291 - DNA, 15 bp, Homo sapiens
gccagggctccacgg

SEQ ID NO: 558292 - DNA, 22 bp, Homo sapiens
gccaggggaggttacaggtacc

SEQ ID NO: 558293 - DNA, 23 bp, Homo sapiens
gccataagcaacaattttcagat

SEQ ID NO: 558294 - DNA, 19 bp, Homo sapiens
gccatatattttctgagta

SEQ ID NO: 558295 - DNA, 20 bp, Homo sapiens
gccatcagcccctgctgctc

SEQ ID NO: 558296 - DNA, 12 bp, Homo sapiens
gccatgaactgt

SEQ ID NO: 558297 - DNA, 18 bp, Homo sapiens
gccatggaggcacacagc

SEQ ID NO: 558298 - DNA, 13 bp, Homo sapiens
gccatggaggcag

SEQ ID NO: 558299 - DNA, 15 bp, Homo sapiens
gccattctggcactt

SEQ ID NO: 558300 - DNA, 19 bp, Homo sapiens
gcccaaacctttcccccat

SEQ ID NO: 558301 - DNA, 13 bp, Homo sapiens
gcccaacaggggc

SEQ ID NO: 558302 - DNA, 22 bp, Homo sapiens
gcccacatccggggccagctcc

SEQ ID NO: 558303 - DNA, 17 bp, Homo sapiens
gcccacattgcccacac

SEQ ID NO: 558304 - DNA, 13 bp, Homo sapiens
gcccactcctgct

SEQ ID NO: 558305 - DNA, 16 bp, Homo sapiens
gcccactcctgctctg

SEQ ID NO: 558306 - DNA, 19 bp, Homo sapiens
gcccactcctgctctgctc

SEQ ID NO: 558307 - DNA, 21 bp, Homo sapiens
gcccagaggggcggggccagg

SEQ ID NO: 558308 - DNA, 18 bp, Homo sapiens
gcccagcccctggtggtg

SEQ ID NO: 558309 - DNA, 21 bp, Homo sapiens
gcccagcctctttcccttcca

SEQ ID NO: 558310 - DNA, 23 bp, Homo sapiens
gcccagcttttcattgctgtgac

SEQ ID NO: 558311 - DNA, 19 bp, Homo sapiens
gcccaggagcgcagctgca

SEQ ID NO: 558312 - DNA, 22 bp, Homo sapiens
gcccatgccctccgtcctggca

SEQ ID NO: 558313 - DNA, 19 bp, Homo sapiens
gcccatgtggagtcagcct

SEQ ID NO: 558314 - DNA, 17 bp, Homo sapiens
gcccatgtgtatggaag

SEQ ID NO: 558315 - DNA, 21 bp, Homo sapiens
gccccaaatatagcgttccca

SEQ ID NO: 558316 - DNA, 18 bp, Homo sapiens
gccccaacccaaacctgg

SEQ ID NO: 558317 - DNA, 20 bp, Homo sapiens
gccccaacccaaacctggag

SEQ ID NO: 558318 - DNA, 15 bp, Homo sapiens
gccccacaccagccc

SEQ ID NO: 558319 - DNA, 13 bp, Homo sapiens
gccccacccctcc

SEQ ID NO: 558320 - DNA, 18 bp, Homo sapiens
gccccacctgcagctccc

SEQ ID NO: 558321 - DNA, 18 bp, Homo sapiens
gccccagaaatgccgctg

SEQ ID NO: 558322 - DNA, 19 bp, Homo sapiens
gccccagaaatgccgctgt

SEQ ID NO: 558323 - DNA, 24 bp, Homo sapiens
gccccagaaatgccgctgtgtccc

SEQ ID NO: 558324 - DNA, 21 bp, Homo sapiens
gccccagcgagtctggagacc

SEQ ID NO: 558325 - DNA, 23 bp, Homo sapiens
gccccagcgctgacgtgtcagga

SEQ ID NO: 558326 - DNA, 16 bp, Homo sapiens
gccccattttctttac

SEQ ID NO: 558327 - DNA, 23 bp, Homo sapiens
gcccccacacctggccctggggc

SEQ ID NO: 558328 - DNA, 14 bp, Homo sapiens
gccccccatgccct

SEQ ID NO: 558329 - DNA, 16 bp, Homo sapiens
gccccctggcccctcc

SEQ ID NO: 558330 - DNA, 18 bp, Homo sapiens
gccccgtctacagctccc

SEQ ID NO: 558331 - DNA, 18 bp, Homo sapiens
gcccctcccacatccccc

SEQ ID NO: 558332 - DNA, 19 bp, Homo sapiens
gcccctgcacctgcttctc

SEQ ID NO: 558333 - DNA, 21 bp, Homo sapiens
gcccctgctgctcctcggcca

SEQ ID NO: 558334 - DNA, 23 bp, Homo sapiens
gcccctgctgctcctcggccaga

SEQ ID NO: 558335 - DNA, 22 bp, Homo sapiens
gcccctgttacctaattagagc

SEQ ID NO: 558336 - DNA, 14 bp, Homo sapiens
gccccttccccatg

SEQ ID NO: 558337 - DNA, 17 bp, Homo sapiens
gcccggcagtgcacccc

SEQ ID NO: 558338 - DNA, 14 bp, Homo sapiens
gcccggcccaggag

SEQ ID NO: 558339 - DNA, 15 bp, Homo sapiens
gcccggcccaggagc

SEQ ID NO: 558340 - DNA, 17 bp, Homo sapiens
gcccgggagatccgccc

SEQ ID NO: 558341 - DNA, 22 bp, Homo sapiens
gcccgggagatccgccctgggc

SEQ ID NO: 558342 - DNA, 19 bp, Homo sapiens
gcccggtgggggggcagag

SEQ ID NO: 558343 - DNA, 22 bp, Homo sapiens
gcccgtggtgaggttgtgctgc

SEQ ID NO: 558344 - DNA, 19 bp, Homo sapiens
gccctccctccccagctcc

SEQ ID NO: 558345 - DNA, 15 bp, Homo sapiens
gccctccgcccttcc

SEQ ID NO: 558346 - DNA, 17 bp, Homo sapiens
gccctccgcgggggaca

SEQ ID NO: 558347 - DNA, 15 bp, Homo sapiens
gccctcttcaatccc

SEQ ID NO: 558348 - DNA, 16 bp, Homo sapiens
gccctgaggaggcctt

SEQ ID NO: 558349 - DNA, 14 bp, Homo sapiens
gccctgggctctgg

SEQ ID NO: 558350 - DNA, 17 bp, Homo sapiens
gccctgggctctgggtt

SEQ ID NO: 558351 - DNA, 17 bp, Homo sapiens
gccctggttcccccagg

SEQ ID NO: 558352 - DNA, 15 bp, Homo sapiens
gccctgtagctctga

SEQ ID NO: 558353 - DNA, 13 bp, Homo sapiens
gacctgctgaagt

SEQ ID NO: 558354 - DNA, 20 bp, Homo sapiens
gacctgctgaagtccggaac

SEQ ID NO: 558355 - DNA, 16 bp, Homo sapiens
gacctgggccctggtt

SEQ ID NO: 558356 - DNA, 22 bp, Homo sapiens
gaccttagatttggtgaacaac

SEQ ID NO: 558357 - DNA, 22 bp, Homo sapiens
gaccttcactctaagatgttat

SEQ ID NO: 558358 - DNA, 18 bp, Homo sapiens
gaccttctgtcgtcccca

SEQ ID NO: 558359 - DNA, 15 bp, Homo sapiens
gaccttgtaatgtaa

SEQ ID NO: 558360 - DNA, 17 bp, Homo sapiens
gaccttgtaatgtaact

SEQ ID NO: 558361 - DNA, 18 bp, Homo sapiens
gaccttgtaatgtaactg

SEQ ID NO: 558362 - DNA, 22 bp, Homo sapiens
gacgcagggagaccctgggaga

SEQ ID NO: 558363 - DNA, 14 bp, Homo sapiens
gactagacacacaa

SEQ ID NO: 558364 - DNA, 16 bp, Homo sapiens
gactagacacacaaag

SEQ ID NO: 558365 - DNA, 19 bp, Homo sapiens
gactagacacacaaagcag

SEQ ID NO: 558366 - DNA, 13 bp, Homo sapiens
gactatatacatg

SEQ ID NO: 558367 - DNA, 23 bp, Homo sapiens
gactatatacatgtgtgtatata

SEQ ID NO: 558368 - DNA, 13 bp, Homo sapiens
gactcaggcccac

SEQ ID NO: 558369 - DNA, 23 bp, Homo sapiens
gactcaggcccacattgcccaca

SEQ ID NO: 558370 - DNA, 23 bp, Homo sapiens
gactcgggctaagtccagctctc

SEQ ID NO: 558371 - DNA, 21 bp, Homo sapiens
gactctaaattctttatttct

SEQ ID NO: 558372 - DNA, 23 bp, Homo sapiens
gactctaaattctttatttctgt

SEQ ID NO: 558373 - DNA, 15 bp, Homo sapiens
gacttaactttaact

SEQ ID NO: 558374 - DNA, 22 bp, Homo sapiens
gacttcagggagtcagctgttt

SEQ ID NO: 558375 - DNA, 21 bp, Homo sapiens
gacttcctgattggtttctct

SEQ ID NO: 558376 - DNA, 14 bp, Homo sapiens
gacttctgttttca

SEQ ID NO: 558377 - DNA, 16 bp, Homo sapiens
gacttctgttttcaat

SEQ ID NO: 558378 - DNA, 18 bp, Homo sapiens
gacttctgttttcaatct

SEQ ID NO: 558379 - DNA, 23 bp, Homo sapiens
gacttctgttttcaatctcgtat

SEQ ID NO: 558380 - DNA, 17 bp, Homo sapiens
gacttcttacccaaagc

SEQ ID NO: 558381 - DNA, 18 bp, Homo sapiens
gacttgtgcacaggcaga

SEQ ID NO: 558382 - DNA, 19 bp, Homo sapiens
gacttgtgcacaggcagag

SEQ ID NO: 558383 - DNA, 21 bp, Homo sapiens
gacttttataacattttgaga

SEQ ID NO: 558384 - DNA, 13 bp, Homo sapiens
gagaaaaagccct

SEQ ID NO: 558385 - DNA, 15 bp, Homo sapiens
gagaaaaagccctct

SEQ ID NO: 558386 - DNA, 16 bp, Homo sapiens
gagaaaacttcagaga

SEQ ID NO: 558387 - DNA, 19 bp, Homo sapiens
gagaacattccctggaatt

SEQ ID NO: 558388 - DNA, 18 bp, Homo sapiens
gagaagaaaatgttcttc

SEQ ID NO: 558389 - DNA, 20 bp, Homo sapiens
gagaataaaattcctatctc

SEQ ID NO: 558390 - DNA, 13 bp, Homo sapiens
gagacactggtct

SEQ ID NO: 558391 - DNA, 15 bp, Homo sapiens
gagacactggtctca

SEQ ID NO: 558392 - DNA, 19 bp, Homo sapiens
gagacactggtctcagagg

SEQ ID NO: 558393 - DNA, 15 bp, Homo sapiens
gagacagtcaggaag

SEQ ID NO: 558394 - DNA, 12 bp, Homo sapiens
gagaccaggact

SEQ ID NO: 558395 - DNA, 12 bp, Homo sapiens
gagactcaggcc

SEQ ID NO: 558396 - DNA, 16 bp, Homo sapiens
gagactcaggcccaca

SEQ ID NO: 558397 - DNA, 15 bp, Homo sapiens
gagagaacagggatg

SEQ ID NO: 558398 - DNA, 20 bp, Homo sapiens
gagagagctgagtgagctga

SEQ ID NO: 558399 - DNA, 17 bp, Homo sapiens
gagagatatatctgaaa

SEQ ID NO: 558400 - DNA, 18 bp, Homo sapiens
gagagatgtgtaattttt

SEQ ID NO: 558401 - DNA, 22 bp, Homo sapiens
gagagcattataatcaccaggg

SEQ ID NO: 558402 - DNA, 18 bp, Homo sapiens
gagagggggccacctccc

SEQ ID NO: 558403 - DNA, 15 bp, Homo sapiens
gagagtatggtgctg

SEQ ID NO: 558404 - DNA, 14 bp, Homo sapiens
gagagtttagctgt

SEQ ID NO: 558405 - DNA, 22 bp, Homo sapiens
gagataggaaggtcatttccat

SEQ ID NO: 558406 - DNA, 15 bp, Homo sapiens
gagatccgccctggg

SEQ ID NO: 558407 - DNA, 23 bp, Homo sapiens
gagatccgccctgggctctgggt

SEQ ID NO: 558408 - DNA, 23 bp, Homo sapiens
gagatgcactatatgtttacaca

SEQ ID NO: 558409 - DNA, 20 bp, Homo sapiens
gagatgtatttctaaatgtt

SEQ ID NO: 558410 - DNA, 12 bp, Homo sapiens
gagatgtctctt

SEQ ID NO: 558411 - DNA, 20 bp, Homo sapiens
gagatgtgtaatttttctgt

SEQ ID NO: 558412 - DNA, 19 bp, Homo sapiens
gagattggaaaaaattaga

SEQ ID NO: 558413 - DNA, 22 bp, Homo sapiens
gagcaaagatcaaaataaaaag

SEQ ID NO: 558414 - DNA, 12 bp, Homo sapiens
gagcagagagct

SEQ ID NO: 558415 - DNA, 22 bp, Homo sapiens
gagcagatgaggtgaaaaggcc

SEQ ID NO: 558416 - DNA, 18 bp, Homo sapiens
gagcaggatagctcttcc

SEQ ID NO: 558417 - DNA, 20 bp, Homo sapiens
gagcagttggccaagcagaa

SEQ ID NO: 558418 - DNA, 21 bp, Homo sapiens
gagcagttggccaagcagaaa

SEQ ID NO: 558419 - DNA, 15 bp, Homo sapiens
gagcatgaagataaa

SEQ ID NO: 558420 - DNA, 13 bp, Homo sapiens
gagcattccagtc

SEQ ID NO: 558421 - DNA, 21 bp, Homo sapiens
gagcattggggatgtttttct

SEQ ID NO: 558422 - DNA, 21 bp, Homo sapiens
gagcccaggagtcccactcca

SEQ ID NO: 558423 - DNA, 23 bp, Homo sapiens
gagccctggggtttccacacagg

SEQ ID NO: 558424 - DNA, 16 bp, Homo sapiens
gagccgagctctcctg

SEQ ID NO: 558425 - DNA, 11 bp, Homo sapiens
gagcctatgat

SEQ ID NO: 558426 - DNA, 20 bp, Homo sapiens
gagcctcttctgccaagaga

SEQ ID NO: 558427 - DNA, 19 bp, Homo sapiens
gagcctgacagccagaact

SEQ ID NO: 558428 - DNA, 13 bp, Homo sapiens
gagcctgccccag

SEQ ID NO: 558429 - DNA, 17 bp, Homo sapiens
gagcctgcgtggcctgg

SEQ ID NO: 558430 - DNA, 13 bp, Homo sapiens
gagcgcagctgca

SEQ ID NO: 558431 - DNA, 18 bp, Homo sapiens
gagcggattgcaaagcaa

SEQ ID NO: 558432 - DNA, 17 bp, Homo sapiens
gagctcagcacagcctc

SEQ ID NO: 558433 - DNA, 22 bp, Homo sapiens
gagctcagcacagcctcacccc

SEQ ID NO: 558434 - DNA, 14 bp, Homo sapiens
gagctcccaggacg

SEQ ID NO: 558435 - DNA, 23 bp, Homo sapiens
gagctcctgctcattgtggccag

SEQ ID NO: 558436 - DNA, 11 bp, Homo sapiens
gagctcctggc

SEQ ID NO: 558437 - DNA, 14 bp, Homo sapiens
gagctcctggccag

SEQ ID NO: 558438 - DNA, 16 bp, Homo sapiens
gagctctcctgggcca

SEQ ID NO: 558439 - DNA, 15 bp, Homo sapiens
gagctgctgcatgag

SEQ ID NO: 558440 - DNA, 15 bp, Homo sapiens
gagctgctgccatga

SEQ ID NO: 558441 - DNA, 21 bp, Homo sapiens
gagctggacagtggagtgcaa

SEQ ID NO: 558442 - DNA, 21 bp, Homo sapiens
gagctggcctattttggacgt

SEQ ID NO: 558443 - DNA, 21 bp, Homo sapiens
gagctgggaggagaggtccac

SEQ ID NO: 558444 - DNA, 18 bp, Homo sapiens
gagctttctcaatgtctt

SEQ ID NO: 558445 - DNA, 22 bp, Homo sapiens
gagctttctcaatgtcttccca

SEQ ID NO: 558446 - DNA, 19 bp, Homo sapiens
gaggaaagcacagaggcct

SEQ ID NO: 558447 - DNA, 13 bp, Homo sapiens
gaggacagcaatg

SEQ ID NO: 558448 - DNA, 20 bp, Homo sapiens
gaggacccatgaaacagcag

SEQ ID NO: 558449 - DNA, 22 bp, Homo sapiens
gaggacccatgaaacagcagct

SEQ ID NO: 558450 - DNA, 16 bp, Homo sapiens
gaggacctccacctgg

SEQ ID NO: 558451 - DNA, 20 bp, Homo sapiens
gaggacgtgggcggcagaga

SEQ ID NO: 558452 - DNA, 22 bp, Homo sapiens
gaggacgtgggcggcagagagg

SEQ ID NO: 558453 - DNA, 14 bp, Homo sapiens
gaggagaagaaaat

SEQ ID NO: 558454 - DNA, 14 bp, Homo sapiens
gaggagagcctggt

SEQ ID NO: 558455 - DNA, 22 bp, Homo sapiens
gaggaggccttgggctctgctg

SEQ ID NO: 558456 - DNA, 16 bp, Homo sapiens
gaggatgtatgtgtat

SEQ ID NO: 558457 - DNA, 21 bp, Homo sapiens
gaggatgtctttctcctctgg

SEQ ID NO: 558458 - DNA, 18 bp, Homo sapiens
gaggatttgatgtaagtt

SEQ ID NO: 558459 - DNA, 24 bp, Homo sapiens
gaggcacacagctgcagagacaga

SEQ ID NO: 558460 - DNA, 14 bp, Homo sapiens
gaggctaaaatgtt

SEQ ID NO: 558461 - DNA, 16 bp, Homo sapiens
gaggctaaaatgtttt

SEQ ID NO: 558462 - DNA, 15 bp, Homo sapiens
gaggctcaacaataa

SEQ ID NO: 558463 - DNA, 15 bp, Homo sapiens
gaggctccaggcagc

SEQ ID NO: 558464 - DNA, 22 bp, Homo sapiens
gaggctccatccttctccccaa

SEQ ID NO: 558465 - DNA, 18 bp, Homo sapiens
gaggctgggacgctctgc

SEQ ID NO: 558466 - DNA, 13 bp, Homo sapiens
gaggcttccagtc

SEQ ID NO: 558467 - DNA, 22 bp, Homo sapiens
gagggaaagccttaagctgcag

SEQ ID NO: 558468 - DNA, 17 bp, Homo sapiens
gagggagcacaaccccc

SEQ ID NO: 558469 - DNA, 17 bp, Homo sapiens
gagggatagagacgcag

SEQ ID NO: 558470 - DNA, 16 bp, Homo sapiens
gagggctgcagagcct

SEQ ID NO: 558471 - DNA, 23 bp, Homo sapiens
gaggggatgtgtgtgtgcagagc

SEQ ID NO: 558472 - DNA, 13 bp, Homo sapiens
gagggggcaaagg

SEQ ID NO: 558473 - DNA, 19 bp, Homo sapiens
gagggtgagtcctccagaa

SEQ ID NO: 558474 - DNA, 19 bp, Homo sapiens
gaggtaccaaaaaagaaag

SEQ ID NO: 558475 - DNA, 19 bp, Homo sapiens
gaggtcatcccggggccat

SEQ ID NO: 558476 - DNA, 13 bp, Homo sapiens
gaggtcctggggg

SEQ ID NO: 558477 - DNA, 15 bp, Homo sapiens
gaggtgaaaaggcca

SEQ ID NO: 558478 - DNA, 16 bp, Homo sapiens
gaggtgaaaaggccaa

SEQ ID NO: 558479 - DNA, 17 bp, Homo sapiens
gaggtgaaaaggccaag

SEQ ID NO: 558480 - DNA, 17 bp, Homo sapiens
gaggttaggaacccggc

SEQ ID NO: 558481 - DNA, 20 bp, Homo sapiens
gagtaacacttgaaaagtgt

SEQ ID NO: 558482 - DNA, 13 bp, Homo sapiens
gagtacaaatgtg

SEQ ID NO: 558483 - DNA, 17 bp, Homo sapiens
gagtagaggtttaaaga

SEQ ID NO: 558484 - DNA, 13 bp, Homo sapiens
gagtagatgcttg

SEQ ID NO: 558485 - DNA, 17 bp, Homo sapiens
gagtagcaaggaaggac

SEQ ID NO: 558486 - DNA, 16 bp, Homo sapiens
gagtatatgtaacagt

SEQ ID NO: 558487 - DNA, 18 bp, Homo sapiens
gagtcaagctgatgaagt

SEQ ID NO: 558488 - DNA, 15 bp, Homo sapiens
gagtcagctgtttct

SEQ ID NO: 558489 - DNA, 19 bp, Homo sapiens
gagtcagggagccctgggg

SEQ ID NO: 558490 - DNA, 20 bp, Homo sapiens
gagtcagtgcccatgtgtat

SEQ ID NO: 558491 - DNA, 20 bp, Homo sapiens
gagtccaacgtggggcagca

SEQ ID NO: 558492 - DNA, 21 bp, Homo sapiens
gagtcctcattgttcagaaaa

SEQ ID NO: 558493 - DNA, 15 bp, Homo sapiens
gagtcctccagaact

SEQ ID NO: 558494 - DNA, 20 bp, Homo sapiens
ctttctgtactaaacatttc

SEQ ID NO: 558495 - DNA, 17 bp, Homo sapiens
ctttcttcctcattccc

SEQ ID NO: 558496 - DNA, 12 bp, Homo sapiens
ctttcttccttt

SEQ ID NO: 558497 - DNA, 15 bp, Homo sapiens
ctttcttcctttcta

SEQ ID NO: 558498 - DNA, 12 bp, Homo sapiens
ctttcttctccc

SEQ ID NO: 558499 - DNA, 23 bp, Homo sapiens
ctttgaaatatatggtctaatgt

SEQ ID NO: 558500 - DNA, 19 bp, Homo sapiens
ctttgaagtgcctctgatt

SEQ ID NO: 558501 - DNA, 15 bp, Homo sapiens
ctttgaattttcatt

SEQ ID NO: 558502 - DNA, 18 bp, Homo sapiens
ctttgaattttcatttta

SEQ ID NO: 558503 - DNA, 15 bp, Homo sapiens
ctttgattcacatgt

SEQ ID NO: 558504 - DNA, 21 bp, Homo sapiens
ctttgattcacatgttttcaa

SEQ ID NO: 558505 - DNA, 12 bp, Homo sapiens
ctttgatttcca

SEQ ID NO: 558506 - DNA, 20 bp, Homo sapiens
ctttgatttccaagtaatat

SEQ ID NO: 558507 - DNA, 22 bp, Homo sapiens
ctttgcacgtgctgtttgctgt

SEQ ID NO: 558508 - DNA, 21 bp, Homo sapiens
ctttgccctttacttgtcttt

SEQ ID NO: 558509 - DNA, 21 bp, Homo sapiens
ctttgctatggggacattcca

SEQ ID NO: 558510 - DNA, 21 bp, Homo sapiens
ctttggaattgtgctccaaat

SEQ ID NO: 558511 - DNA, 17 bp, Homo sapiens
ctttggccactgtattt

SEQ ID NO: 558512 - DNA, 21 bp, Homo sapiens
ctttggcttaattccaatcat

SEQ ID NO: 558513 - DNA, 13 bp, Homo sapiens
ctttgggaggctg

SEQ ID NO: 558514 - DNA, 14 bp, Homo sapiens
ctttgggaggctga

SEQ ID NO: 558515 - DNA, 18 bp, Homo sapiens
ctttgggcagatttgcaa

SEQ ID NO: 558516 - DNA, 16 bp, Homo sapiens
ctttgtataaattttt

SEQ ID NO: 558517 - DNA, 15 bp, Homo sapiens
ctttgtcctcctgct

SEQ ID NO: 558518 - DNA, 18 bp, Homo sapiens
ctttgtcctcctgctgcc

SEQ ID NO: 558519 - DNA, 21 bp, Homo sapiens
ctttgtctaagaaacattgga

SEQ ID NO: 558520 - DNA, 17 bp, Homo sapiens
ctttgtgagcctatgat

SEQ ID NO: 558521 - DNA, 14 bp, Homo sapiens
ctttgtgcttgttc

SEQ ID NO: 558522 - DNA, 22 bp, Homo sapiens
ctttgttttttgttttcattaa

SEQ ID NO: 558523 - DNA, 16 bp, Homo sapiens
ctttgtttttttttcc

SEQ ID NO: 558524 - DNA, 19 bp, Homo sapiens
cttttaaaaagtattgcca

SEQ ID NO: 558525 - DNA, 21 bp, Homo sapiens
cttttaaaaagtattgccaaa

SEQ ID NO: 558526 - DNA, 14 bp, Homo sapiens
cttttaaaactact

SEQ ID NO: 558527 - DNA, 20 bp, Homo sapiens
cttttaggagaattcacaga

SEQ ID NO: 558528 - DNA, 20 bp, Homo sapiens
cttttagtttttctgtccct

SEQ ID NO: 558529 - DNA, 13 bp, Homo sapiens
cttttataaaaaa

SEQ ID NO: 558530 - DNA, 21 bp, Homo sapiens
cttttatgcgcaaatacaaaa

SEQ ID NO: 558531 - DNA, 18 bp, Homo sapiens
cttttcaaaataaagctt

SEQ ID NO: 558532 - DNA, 17 bp, Homo sapiens
cttttcacccttctact

SEQ ID NO: 558533 - DNA, 18 bp, Homo sapiens
cttttcacccttctactc

SEQ ID NO: 558534 - DNA, 21 bp, Homo sapiens
cttttcacctccaactggatg

SEQ ID NO: 558535 - DNA, 14 bp, Homo sapiens
cttttccagagcat

SEQ ID NO: 558536 - DNA, 18 bp, Homo sapiens
cttttccagtattttagt

SEQ ID NO: 558537 - DNA, 20 bp, Homo sapiens
cttttccttgcatacaaaca

SEQ ID NO: 558538 - DNA, 16 bp, Homo sapiens
cttttcgccgtggctg

SEQ ID NO: 558539 - DNA, 14 bp, Homo sapiens
cttttctcccatat

SEQ ID NO: 558540 - DNA, 13 bp, Homo sapiens
cttttctgtgttt

SEQ ID NO: 558541 - DNA, 19 bp, Homo sapiens
cttttgaaaagaccaagac

SEQ ID NO: 558542 - DNA, 15 bp, Homo sapiens
cttttgagcagtaaa

SEQ ID NO: 558543 - DNA, 19 bp, Homo sapiens
cttttgcatagaataatga

SEQ ID NO: 558544 - DNA, 22 bp, Homo sapiens
cttttgctcgatgcagacaggg

SEQ ID NO: 558545 - DNA, 20 bp, Homo sapiens
cttttgctctctcattccca

SEQ ID NO: 558546 - DNA, 21 bp, Homo sapiens
cttttgggaggatttgatgta

SEQ ID NO: 558547 - DNA, 21 bp, Homo sapiens
cttttggttcctcacatatta

SEQ ID NO: 558548 - DNA, 19 bp, Homo sapiens
cttttgtagctgtcatggt

SEQ ID NO: 558549 - DNA, 17 bp, Homo sapiens
cttttgtagtcttatga

SEQ ID NO: 558550 - DNA, 18 bp, Homo sapiens
cttttgtagtcttatgaa

SEQ ID NO: 558551 - DNA, 14 bp, Homo sapiens
cttttgtatcctcc

SEQ ID NO: 558552 - DNA, 18 bp, Homo sapiens
cttttgttcatttcatcc

SEQ ID NO: 558553 - DNA, 19 bp, Homo sapiens
cttttgttcatttcatcct

SEQ ID NO: 558554 - DNA, 14 bp, Homo sapiens
cttttgttttgctt

SEQ ID NO: 558555 - DNA, 13 bp, Homo sapiens
cttttgttttttg

SEQ ID NO: 558556 - DNA, 15 bp, Homo sapiens
cttttttctgggtct

SEQ ID NO: 558557 - DNA, 13 bp, Homo sapiens
ctttttttaagtg

SEQ ID NO: 558558 - DNA, 16 bp, Homo sapiens
gaaaaaaaagaaaaaa

SEQ ID NO: 558559 - DNA, 20 bp, Homo sapiens
gaaaaaaaagtgtctcaaag

SEQ ID NO: 558560 - DNA, 15 bp, Homo sapiens
gaaaaatatgtgaag

SEQ ID NO: 558561 - DNA, 13 bp, Homo sapiens
gaaaaatcagttt

SEQ ID NO: 558562 - DNA, 16 bp, Homo sapiens
gaaaaatcagtttttg

SEQ ID NO: 558563 - DNA, 21 bp, Homo sapiens
gaaaaatcataaccaccctag

SEQ ID NO: 558564 - DNA, 15 bp, Homo sapiens
gaaaaatttctggca

SEQ ID NO: 558565 - DNA, 21 bp, Homo sapiens
gaaaaatttctggcaaatatt

SEQ ID NO: 558566 - DNA, 23 bp, Homo sapiens
gaaaaatttctggcaaatatttt

SEQ ID NO: 558567 - DNA, 14 bp, Homo sapiens
gaaaacagaaattg

SEQ ID NO: 558568 - DNA, 18 bp, Homo sapiens
gaaaacgatttaatttat

SEQ ID NO: 558569 - DNA, 12 bp, Homo sapiens
gaaaactaagtt

SEQ ID NO: 558570 - DNA, 21 bp, Homo sapiens
gaaaactcatcgggagtgaat

SEQ ID NO: 558571 - DNA, 17 bp, Homo sapiens
gaaaactggaataagaa

SEQ ID NO: 558572 - DNA, 23 bp, Homo sapiens
gaaaacttcagagaaattatgtt

SEQ ID NO: 558573 - DNA, 13 bp, Homo sapiens
gaaaagaaaaaga

SEQ ID NO: 558574 - DNA, 13 bp, Homo sapiens
gaaaagaaatcta

SEQ ID NO: 558575 - DNA, 17 bp, Homo sapiens
gaaaagactaagatcgg

SEQ ID NO: 558576 - DNA, 16 bp, Homo sapiens
gaaaaggccaagaggt

SEQ ID NO: 558577 - DNA, 19 bp, Homo sapiens
gaaaagttcttaaaacact

SEQ ID NO: 558578 - DNA, 15 bp, Homo sapiens
gaaaatatatttgca

SEQ ID NO: 558579 - DNA, 23 bp, Homo sapiens
gaaaatatgtccatatctaacca

SEQ ID NO: 558580 - DNA, 12 bp, Homo sapiens
gaaaatgtcact

SEQ ID NO: 558581 - DNA, 16 bp, Homo sapiens
gaaaatgtcactgtta

SEQ ID NO: 558582 - DNA, 19 bp, Homo sapiens
gaaaattttattgaatata

SEQ ID NO: 558583 - DNA, 24 bp, Homo sapiens
gaaacaaagcatttgactttctgt

SEQ ID NO: 558584 - DNA, 17 bp, Homo sapiens
gaaacacccacaggcat

SEQ ID NO: 558585 - DNA, 16 bp, Homo sapiens
gaaacactaaatgtta

SEQ ID NO: 558586 - DNA, 19 bp, Homo sapiens
gaaacactaaatgttaaag

SEQ ID NO: 558587 - DNA, 19 bp, Homo sapiens
gaaacagcagctgaagcca

SEQ ID NO: 558588 - DNA, 15 bp, Homo sapiens
gaaacagtttaacag

SEQ ID NO: 558589 - DNA, 15 bp, Homo sapiens
gaaacatcatagaaa

SEQ ID NO: 558590 - DNA, 13 bp, Homo sapiens
gaaacattgcttt

SEQ ID NO: 558591 - DNA, 17 bp, Homo sapiens
gaaacattgcttttaaa

SEQ ID NO: 558592 - DNA, 14 bp, Homo sapiens
gaaacattggaagc

SEQ ID NO: 558593 - DNA, 17 bp, Homo sapiens
gaaacccctgacacctt

SEQ ID NO: 558594 - DNA, 17 bp, Homo sapiens
gaaacctacagaatact

SEQ ID NO: 558595 - DNA, 17 bp, Homo sapiens
gaaacggaatgaccttg

SEQ ID NO: 558596 - DNA, 16 bp, Homo sapiens
gaaactgacttgctgt

SEQ ID NO: 558597 - DNA, 22 bp, Homo sapiens
gaaactgtctagcacttccttg

SEQ ID NO: 558598 - DNA, 20 bp, Homo sapiens
gaaagaactatcttcatctg

SEQ ID NO: 558599 - DNA, 13 bp, Homo sapiens
gaaagcaacagct

SEQ ID NO: 558600 - DNA, 17 bp, Homo sapiens
gaaagccaaattttatt

SEQ ID NO: 558601 - DNA, 14 bp, Homo sapiens
gaaagccagtctta

SEQ ID NO: 558602 - DNA, 18 bp, Homo sapiens
gaaagccttaagctgcag

SEQ ID NO: 558603 - DNA, 17 bp, Homo sapiens
gaaagctgtttcatttg

SEQ ID NO: 558604 - DNA, 14 bp, Homo sapiens
gaaagggacaagta

SEQ ID NO: 558605 - DNA, 22 bp, Homo sapiens
gaaaggggctagcactggatgg

SEQ ID NO: 558606 - DNA, 13 bp, Homo sapiens
gaaagtgccaaaa

SEQ ID NO: 558607 - DNA, 13 bp, Homo sapiens
gaaagtgttctgt

SEQ ID NO: 558608 - DNA, 15 bp, Homo sapiens
gaaagtgttctgtta

SEQ ID NO: 558609 - DNA, 16 bp, Homo sapiens
gaaagtgttctgttac

SEQ ID NO: 558610 - DNA, 17 bp, Homo sapiens
gaaagttgtgatctgtt

SEQ ID NO: 558611 - DNA, 15 bp, Homo sapiens
gaaataaatgcccca

SEQ ID NO: 558612 - DNA, 18 bp, Homo sapiens
gaaatatatatacatatg

SEQ ID NO: 558613 - DNA, 19 bp, Homo sapiens
gaaatattttctactttaa

SEQ ID NO: 558614 - DNA, 18 bp, Homo sapiens
gaaatcatcgaaaattca

SEQ ID NO: 558615 - DNA, 17 bp, Homo sapiens
gaaatgattgagagcag

SEQ ID NO: 558616 - DNA, 16 bp, Homo sapiens
gaaatgcacaatgtct

SEQ ID NO: 558617 - DNA, 20 bp, Homo sapiens
gaaatggatagattgtttta

SEQ ID NO: 558618 - DNA, 20 bp, Homo sapiens
gaaatgtgtgtgatgtgaca

SEQ ID NO: 558619 - DNA, 13 bp, Homo sapiens
gaaattatatctg

SEQ ID NO: 558620 - DNA, 19 bp, Homo sapiens
gaaattatatctgtggtct

SEQ ID NO: 558621 - DNA, 19 bp, Homo sapiens
gaaattcaattcatagaat

SEQ ID NO: 558622 - DNA, 21 bp, Homo sapiens
gaaattggtaccttgcacaca

SEQ ID NO: 558623 - DNA, 21 bp, Homo sapiens
gaaatttatgaagcagattta

SEQ ID NO: 558624 - DNA, 21 bp, Homo sapiens
gaaatttattgaggaaaaata

SEQ ID NO: 558625 - DNA, 12 bp, Homo sapiens
gaaatttcacgt

SEQ ID NO: 558626 - DNA, 16 bp, Homo sapiens
gaaatttcacgtcata

SEQ ID NO: 558627 - DNA, 12 bp, Homo sapiens
gaaatttttcat

SEQ ID NO: 558628 - DNA, 13 bp, Homo sapiens
gaaatttttcata

SEQ ID NO: 558629 - DNA, 19 bp, Homo sapiens
gaaatttttcatattttaa

SEQ ID NO: 558630 - DNA, 14 bp, Homo sapiens
gaacaacataaaat

SEQ ID NO: 558631 - DNA, 21 bp, Homo sapiens
gacccccagtgctcacacaat

SEQ ID NO: 558632 - DNA, 19 bp, Homo sapiens
gacccctcccctaatgcct

SEQ ID NO: 558633 - DNA, 23 bp, Homo sapiens
gacccctgcccagatcagccaga

SEQ ID NO: 558634 - DNA, 17 bp, Homo sapiens
gaccctatctcccacaa

SEQ ID NO: 558635 - DNA, 20 bp, Homo sapiens
gaccctcgctggcccccact

SEQ ID NO: 558636 - DNA, 21 bp, Homo sapiens
gaccctcgctggcccccactg

SEQ ID NO: 558637 - DNA, 19 bp, Homo sapiens
gaccctcggggcaggaagt

SEQ ID NO: 558638 - DNA, 21 bp, Homo sapiens
gaccctgggagagtgaggtca

SEQ ID NO: 558639 - DNA, 16 bp, Homo sapiens
gaccgagtgtggagct

SEQ ID NO: 558640 - DNA, 14 bp, Homo sapiens
gacctccccctcct

SEQ ID NO: 558641 - DNA, 16 bp, Homo sapiens
gacctccccctccttc

SEQ ID NO: 558642 - DNA, 17 bp, Homo sapiens
gacctccccctccttcc

SEQ ID NO: 558643 - DNA, 18 bp, Homo sapiens
gacctctagccctgcccg

SEQ ID NO: 558644 - DNA, 20 bp, Homo sapiens
ctgtataaacattaaatgtc

SEQ ID NO: 558645 - DNA, 21 bp, Homo sapiens
ctgtataaacattaaatgtct

SEQ ID NO: 558646 - DNA, 16 bp, Homo sapiens
ctgtatctgacatatt

SEQ ID NO: 558647 - DNA, 18 bp, Homo sapiens
ctgtattcccatatcaaa

SEQ ID NO: 558648 - DNA, 14 bp, Homo sapiens
ctgtattgtaacta

SEQ ID NO: 558649 - DNA, 18 bp, Homo sapiens
ctgtatttgttaatttct

SEQ ID NO: 558650 - DNA, 20 bp, Homo sapiens
ctgtatttgttaatttcttg

SEQ ID NO: 558651 - DNA, 13 bp, Homo sapiens
ctgtcaaacatta

SEQ ID NO: 558652 - DNA, 15 bp, Homo sapiens
ctgtcaaacattagt

SEQ ID NO: 558653 - DNA, 21 bp, Homo sapiens
ctgtcaaacattagtacttta

SEQ ID NO: 558654 - DNA, 23 bp, Homo sapiens
ctgtcaccaccctgctcatccac

SEQ ID NO: 558655 - DNA, 15 bp, Homo sapiens
ctgtcaggaggcaga

SEQ ID NO: 558656 - DNA, 13 bp, Homo sapiens
cttccaggcagcc

SEQ ID NO: 558657 - DNA, 19 bp, Homo sapiens
cttccagttactttccaat

SEQ ID NO: 558658 - DNA, 19 bp, Homo sapiens
cttccagtttattccagag

SEQ ID NO: 558659 - DNA, 20 bp, Homo sapiens
cttccatttctgccttttgt

SEQ ID NO: 558660 - DNA, 22 bp, Homo sapiens
cttcccaacctcccctggtcct

SEQ ID NO: 558661 - DNA, 13 bp, Homo sapiens
cttcccactctgt

SEQ ID NO: 558662 - DNA, 21 bp, Homo sapiens
cttcccagctgcccctccctg

SEQ ID NO: 558663 - DNA, 13 bp, Homo sapiens
cttccccatgctc

SEQ ID NO: 558664 - DNA, 14 bp, Homo sapiens
cttccccttccttc

SEQ ID NO: 558665 - DNA, 13 bp, Homo sapiens
cttccctccctgc

SEQ ID NO: 558666 - DNA, 23 bp, Homo sapiens
cttccctgacactgtctgctgcc

SEQ ID NO: 558667 - DNA, 16 bp, Homo sapiens
cttcctactcttctct

SEQ ID NO: 558668 - DNA, 24 bp, Homo sapiens
cttcctagttcatcccttctcttc

SEQ ID NO: 558669 - DNA, 14 bp, Homo sapiens
cttcctccctgggg

SEQ ID NO: 558670 - DNA, 21 bp, Homo sapiens
cttcctctcatccttttctcc

SEQ ID NO: 558671 - DNA, 14 bp, Homo sapiens
cttcctctgctaaa

SEQ ID NO: 558672 - DNA, 14 bp, Homo sapiens
cttcctctgctccc

SEQ ID NO: 558673 - DNA, 20 bp, Homo sapiens
cttcctgattggtttctctt

SEQ ID NO: 558674 - DNA, 22 bp, Homo sapiens
cttcctgattggtttctcttct

SEQ ID NO: 558675 - DNA, 17 bp, Homo sapiens
cttcctgcctggtctcc

SEQ ID NO: 558676 - DNA, 16 bp, Homo sapiens
cttccttctttgccct

SEQ ID NO: 558677 - DNA, 11 bp, Homo sapiens
cttcctttcta

SEQ ID NO: 558678 - DNA, 22 bp, Homo sapiens
cttcctttctaatcctatctgg

SEQ ID NO: 558679 - DNA, 16 bp, Homo sapiens
cttcgaggacagcaat

SEQ ID NO: 558680 - DNA, 16 bp, Homo sapiens
cttcggaggaccaggg

SEQ ID NO: 558681 - DNA, 19 bp, Homo sapiens
cttctaaaactgtactttg

SEQ ID NO: 558682 - DNA, 21 bp, Homo sapiens
cttctaatccatgtgctgctg

SEQ ID NO: 558683 - DNA, 22 bp, Homo sapiens
cttctacttacacatcttccac

SEQ ID NO: 558684 - DNA, 17 bp, Homo sapiens
cttctcatcttgacaga

SEQ ID NO: 558685 - DNA, 14 bp, Homo sapiens
cttctcatctttta

SEQ ID NO: 558686 - DNA, 15 bp, Homo sapiens
cttctccccttccat

SEQ ID NO: 558687 - DNA, 19 bp, Homo sapiens
cttctccccttccatttct

SEQ ID NO: 558688 - DNA, 16 bp, Homo sapiens
cttctccctggactct

SEQ ID NO: 558689 - DNA, 16 bp, Homo sapiens
cttctctaaaacagca

SEQ ID NO: 558690 - DNA, 15 bp, Homo sapiens
cttctctcacctcct

SEQ ID NO: 558691 - DNA, 18 bp, Homo sapiens
cttctctcacctcctaaa

SEQ ID NO: 558692 - DNA, 14 bp, Homo sapiens
cttctctctgctct

SEQ ID NO: 558693 - DNA, 14 bp, Homo sapiens
cttctgccaagaga

SEQ ID NO: 558694 - DNA, 16 bp, Homo sapiens
cttctgtcatctacct

SEQ ID NO: 558695 - DNA, 18 bp, Homo sapiens
cttctgtcgtccccagac

SEQ ID NO: 558696 - DNA, 16 bp, Homo sapiens
cttctgttttcaatct

SEQ ID NO: 558697 - DNA, 18 bp, Homo sapiens
cttcttaatataactgcc

SEQ ID NO: 558698 - DNA, 13 bp, Homo sapiens
cttcttctgtcca

SEQ ID NO: 558699 - DNA, 22 bp, Homo sapiens
cttcttgaatggcaatgttttg

SEQ ID NO: 558700 - DNA, 12 bp, Homo sapiens
cttctttccatt

SEQ ID NO: 558701 - DNA, 14 bp, Homo sapiens
cttctttcctctta

SEQ ID NO: 558702 - DNA, 12 bp, Homo sapiens
cttctttgccct

SEQ ID NO: 558703 - DNA, 21 bp, Homo sapiens
cttcttttgggaggatttgat

SEQ ID NO: 558704 - DNA, 13 bp, Homo sapiens
cttgaaagtagga

SEQ ID NO: 558705 - DNA, 24 bp, Homo sapiens
cttgaaattatatctgtggtcttc

SEQ ID NO: 558706 - DNA, 20 bp, Homo sapiens
cttgaagcctgctccttccc

SEQ ID NO: 558707 - DNA, 21 bp, Homo sapiens
cttgaccttctgtcgtcccca

SEQ ID NO: 558708 - DNA, 14 bp, Homo sapiens
cttgagcagctgaa

SEQ ID NO: 558709 - DNA, 19 bp, Homo sapiens
cttgaggacctccacctgg

SEQ ID NO: 558710 - DNA, 16 bp, Homo sapiens
cttgaggccaaatgag

SEQ ID NO: 558711 - DNA, 16 bp, Homo sapiens
cttgaggggagccagg

SEQ ID NO: 558712 - DNA, 16 bp, Homo sapiens
cttgatggtcagacac

SEQ ID NO: 558713 - DNA, 14 bp, Homo sapiens
cttgattcaaataa

SEQ ID NO: 558714 - DNA, 13 bp, Homo sapiens
cttgcaatttgaa

SEQ ID NO: 558715 - DNA, 14 bp, Homo sapiens
cttgcacacatcat

SEQ ID NO: 558716 - DNA, 18 bp, Homo sapiens
cttgcacacatcatctgt

SEQ ID NO: 558717 - DNA, 20 bp, Homo sapiens
cttgcacacatcatctgtaa

SEQ ID NO: 558718 - DNA, 23 bp, Homo sapiens
cttgcacagtcactgctcttcag

SEQ ID NO: 558719 - DNA, 17 bp, Homo sapiens
cttgcactctcttggct

SEQ ID NO: 558720 - DNA, 17 bp, Homo sapiens
cttgcagtcatcagaag

SEQ ID NO: 558721 - DNA, 14 bp, Homo sapiens
cttgcatacaaaca

SEQ ID NO: 558722 - DNA, 21 bp, Homo sapiens
cttgcatagtaaatgtagttc

SEQ ID NO: 558723 - DNA, 16 bp, Homo sapiens
cttgcattttagctaa

SEQ ID NO: 558724 - DNA, 16 bp, Homo sapiens
cttgcccactcctgct

SEQ ID NO: 558725 - DNA, 19 bp, Homo sapiens
cttggacggggacacggcc

SEQ ID NO: 558726 - DNA, 23 bp, Homo sapiens
cttggacggggacacggcctctg

SEQ ID NO: 558727 - DNA, 15 bp, Homo sapiens
cttggcaccaataaa

SEQ ID NO: 558728 - DNA, 14 bp, Homo sapiens
cttggcagcctact

SEQ ID NO: 558729 - DNA, 19 bp, Homo sapiens
cttggctcagacacctaga

SEQ ID NO: 558730 - DNA, 22 bp, Homo sapiens
cttgggagctttaaagagcagg

SEQ ID NO: 558731 - DNA, 20 bp, Homo sapiens
cttgggatgggcacaggctg

SEQ ID NO: 558732 - DNA, 13 bp, Homo sapiens
cttgggcaatatt

SEQ ID NO: 558733 - DNA, 15 bp, Homo sapiens
cttgggcaatattct

SEQ ID NO: 558734 - DNA, 20 bp, Homo sapiens
cttgggcaatattctctgta

SEQ ID NO: 558735 - DNA, 22 bp, Homo sapiens
cttgggcaatattctctgtaca

SEQ ID NO: 558736 - DNA, 14 bp, Homo sapiens
cttgggctctgctg

SEQ ID NO: 558737 - DNA, 12 bp, Homo sapiens
cttgggctggga

SEQ ID NO: 558738 - DNA, 13 bp, Homo sapiens
cttggggtcaggt

SEQ ID NO: 558739 - DNA, 20 bp, Homo sapiens
cttggtcttttttctgggtc

SEQ ID NO: 558740 - DNA, 20 bp, Homo sapiens
cttggtgattacctgaaagc

SEQ ID NO: 558741 - DNA, 22 bp, Homo sapiens
cttggtttccatcaaagccctc

SEQ ID NO: 558742 - DNA, 13 bp, Homo sapiens
cttgtataaatgt

SEQ ID NO: 558743 - DNA, 17 bp, Homo sapiens
cttgtataaatgtatat

SEQ ID NO: 558744 - DNA, 21 bp, Homo sapiens
cttgtataaatgtatatacac

SEQ ID NO: 558745 - DNA, 14 bp, Homo sapiens
cttgtcggctccag

SEQ ID NO: 558746 - DNA, 15 bp, Homo sapiens
cttgtctttctgggg

SEQ ID NO: 558747 - DNA, 16 bp, Homo sapiens
cttgtgcacaggcaga

SEQ ID NO: 558748 - DNA, 17 bp, Homo sapiens
cttgtgtaatttcctgc

SEQ ID NO: 558749 - DNA, 19 bp, Homo sapiens
cttgtgtaatttcctgctc

SEQ ID NO: 558750 - DNA, 14 bp, Homo sapiens
cttgttatgttgta

SEQ ID NO: 558751 - DNA, 15 bp, Homo sapiens
cttgttatgttgtaa

SEQ ID NO: 558752 - DNA, 12 bp, Homo sapiens
cttgttcttcct

SEQ ID NO: 558753 - DNA, 23 bp, Homo sapiens
cttgttgcagactggtgttaatg

SEQ ID NO: 558754 - DNA, 15 bp, Homo sapiens
cttgttgtttcttgc

SEQ ID NO: 558755 - DNA, 20 bp, Homo sapiens
cttgtttaaggttcttgctg

SEQ ID NO: 558756 - DNA, 12 bp, Homo sapiens
cttgtttctccc

SEQ ID NO: 558757 - DNA, 23 bp, Homo sapiens
cttgtttttgtttttgttttgtt

SEQ ID NO: 558758 - DNA, 23 bp, Homo sapiens
ctttaaaatgattcacttttatt

SEQ ID NO: 558759 - DNA, 18 bp, Homo sapiens
ctttaacttccactttgt

SEQ ID NO: 558760 - DNA, 21 bp, Homo sapiens
ctttaatatactccttaaaaa

SEQ ID NO: 558761 - DNA, 15 bp, Homo sapiens
ctttaatatgtattt

SEQ ID NO: 558762 - DNA, 19 bp, Homo sapiens
ctttaatcaggtcctgctc

SEQ ID NO: 558763 - DNA, 15 bp, Homo sapiens
ctttaatgataaaat

SEQ ID NO: 558764 - DNA, 17 bp, Homo sapiens
ctttaccctcatctgtc

SEQ ID NO: 558765 - DNA, 18 bp, Homo sapiens
ctttacttgtctttctgg

SEQ ID NO: 558766 - DNA, 20 bp, Homo sapiens
ctttacttgtctttctgggg

SEQ ID NO: 558767 - DNA, 14 bp, Homo sapiens
ctttagaacaacat

SEQ ID NO: 558768 - DNA, 21 bp, Homo sapiens
ctttagaatgttttccttcta

SEQ ID NO: 558769 - DNA, 22 bp, Homo sapiens
ctttagagtgactaaaaggaaa

SEQ ID NO: 558770 - DNA, 12 bp, Homo sapiens
ctttatattttg

SEQ ID NO: 558771 - DNA, 19 bp, Homo sapiens
ctttatctaccaactttca

SEQ ID NO: 558772 - DNA, 12 bp, Homo sapiens
ctttatgtattc

SEQ ID NO: 558773 - DNA, 12 bp, Homo sapiens
ctttatttttca

SEQ ID NO: 558774 - DNA, 20 bp, Homo sapiens
ctttatttttcattacctgt

SEQ ID NO: 558775 - DNA, 15 bp, Homo sapiens
ctttcacttctttcc

SEQ ID NO: 558776 - DNA, 18 bp, Homo sapiens
ctttcacttctttccctt

SEQ ID NO: 558777 - DNA, 21 bp, Homo sapiens
ctttcacttctttcccttcct

SEQ ID NO: 558778 - DNA, 15 bp, Homo sapiens
ctttcagcaggcagc

SEQ ID NO: 558779 - DNA, 18 bp, Homo sapiens
ctttcagcaggcagcctt

SEQ ID NO: 558780 - DNA, 17 bp, Homo sapiens
ctttccaattctccttt

SEQ ID NO: 558781 - DNA, 15 bp, Homo sapiens
ctttccagtgctgct

SEQ ID NO: 558782 - DNA, 15 bp, Homo sapiens
ctttcccaaaggcat

SEQ ID NO: 558783 - DNA, 15 bp, Homo sapiens
ctttcccttcctcca

SEQ ID NO: 558784 - DNA, 23 bp, Homo sapiens
ctttcctgatgttggtatctaag

SEQ ID NO: 558785 - DNA, 15 bp, Homo sapiens
ctttcctgtgccagg

SEQ ID NO: 558786 - DNA, 14 bp, Homo sapiens
ctttccttcctctc

SEQ ID NO: 558787 - DNA, 14 bp, Homo sapiens
ctttctcaatgtct

SEQ ID NO: 558788 - DNA, 16 bp, Homo sapiens
ctttctcttggacatt

SEQ ID NO: 558789 - DNA, 20 bp, Homo sapiens
ctttctcttggacattgtaa

SEQ ID NO: 558790 - DNA, 20 bp, Homo sapiens
ctttctggggtttttctgtt

SEQ ID NO: 558791 - DNA, 15 bp, Homo sapiens
ctgccatcagcccct

SEQ ID NO: 558792 - DNA, 21 bp, Homo sapiens
ctgccatcagcccctgctgct

SEQ ID NO: 558793 - DNA, 22 bp, Homo sapiens
ctgccatcagcccctgctgctc

SEQ ID NO: 558794 - DNA, 15 bp, Homo sapiens
ctgccatgaactgga

SEQ ID NO: 558795 - DNA, 21 bp, Homo sapiens
ctgccatggaggcacacagct

SEQ ID NO: 558796 - DNA, 23 bp, Homo sapiens
ctgccatggaggcacacagctgc

SEQ ID NO: 558797 - DNA, 20 bp, Homo sapiens
ctgcccagatcagccagaag

SEQ ID NO: 558798 - DNA, 20 bp, Homo sapiens
ctgcccagcttttcattgct

SEQ ID NO: 558799 - DNA, 18 bp, Homo sapiens
ctgccccatcacttacag

SEQ ID NO: 558800 - DNA, 20 bp, Homo sapiens
ctgccccatcacttacagaa

SEQ ID NO: 558801 - DNA, 14 bp, Homo sapiens
ctgcccccacacct

SEQ ID NO: 558802 - DNA, 17 bp, Homo sapiens
ctgcccccacacctggc

SEQ ID NO: 558803 - DNA, 17 bp, Homo sapiens
ctgcccccgctctgcca

SEQ ID NO: 558804 - DNA, 12 bp, Homo sapiens
ctgcccctgcct

SEQ ID NO: 558805 - DNA, 22 bp, Homo sapiens
ctgcccctgccttggggtcagg

SEQ ID NO: 558806 - DNA, 23 bp, Homo sapiens
ctgcccggtgggggggcagagcc

SEQ ID NO: 558807 - DNA, 23 bp, Homo sapiens
ctgccctttgtcctcctgctgcc

SEQ ID NO: 558808 - DNA, 18 bp, Homo sapiens
ctgccgtgcacggggcca

SEQ ID NO: 558809 - DNA, 11 bp, Homo sapiens
ctgcctgccct

SEQ ID NO: 558810 - DNA, 23 bp, Homo sapiens
ctgcctgccctttgtcctcctgc

SEQ ID NO: 558811 - DNA, 17 bp, Homo sapiens
ctgcctggtctcctgcc

SEQ ID NO: 558812 - DNA, 14 bp, Homo sapiens
ctgcctgtgagtga

SEQ ID NO: 558813 - DNA, 18 bp, Homo sapiens
ctgccttgcccactcctg

SEQ ID NO: 558814 - DNA, 22 bp, Homo sapiens
ctgccttggggtcaggttgaca

SEQ ID NO: 558815 - DNA, 19 bp, Homo sapiens
ctgcgcactgagtacaaat

SEQ ID NO: 558816 - DNA, 13 bp, Homo sapiens
ctgcgcaggccct

SEQ ID NO: 558817 - DNA, 13 bp, Homo sapiens
ctgcgtcccactg

SEQ ID NO: 558818 - DNA, 15 bp, Homo sapiens
ctgcgtggcctgggg

SEQ ID NO: 558819 - DNA, 19 bp, Homo sapiens
ctgctaaattgatgttgat

SEQ ID NO: 558820 - DNA, 13 bp, Homo sapiens
ctgctattttact

SEQ ID NO: 558821 - DNA, 17 bp, Homo sapiens
ctgctattttactgtct

SEQ ID NO: 558822 - DNA, 20 bp, Homo sapiens
ctgctattttactgtcttaa

SEQ ID NO: 558823 - DNA, 21 bp, Homo sapiens
ctgctattttactgtcttaat

SEQ ID NO: 558824 - DNA, 19 bp, Homo sapiens
ctgctccagctctggcatg

SEQ ID NO: 558825 - DNA, 17 bp, Homo sapiens
ctgctcccccttttccc

SEQ ID NO: 558826 - DNA, 18 bp, Homo sapiens
ctgctcccccttttccct

SEQ ID NO: 558827 - DNA, 23 bp, Homo sapiens
ctgctcctccagtacaataaata

SEQ ID NO: 558828 - DNA, 19 bp, Homo sapiens
ctgctcctcggccagagct

SEQ ID NO: 558829 - DNA, 12 bp, Homo sapiens
ctgctccttccc

SEQ ID NO: 558830 - DNA, 14 bp, Homo sapiens
ctgctccttccctt

SEQ ID NO: 558831 - DNA, 17 bp, Homo sapiens
ctgctccttcccttgct

SEQ ID NO: 558832 - DNA, 11 bp, Homo sapiens
ctgctctgctc

SEQ ID NO: 558833 - DNA, 15 bp, Homo sapiens
ctgctctgctcgcct

SEQ ID NO: 558834 - DNA, 21 bp, Homo sapiens
ctgctgagctctgacctgccc

SEQ ID NO: 558835 - DNA, 13 bp, Homo sapiens
ctgctgcacagct

SEQ ID NO: 558836 - DNA, 21 bp, Homo sapiens
ctgctgcacagctggccacca

SEQ ID NO: 558837 - DNA, 17 bp, Homo sapiens
ctgctgcactgccctcc

SEQ ID NO: 558838 - DNA, 18 bp, Homo sapiens
ctgctgcactgccctccg

SEQ ID NO: 558839 - DNA, 16 bp, Homo sapiens
ctgctgctcctcggcc

SEQ ID NO: 558840 - DNA, 20 bp, Homo sapiens
ctgctgctcctcggccagag

SEQ ID NO: 558841 - DNA, 22 bp, Homo sapiens
ctgctgctcctcggccagagct

SEQ ID NO: 558842 - DNA, 13 bp, Homo sapiens
ctgctgctggtca

SEQ ID NO: 558843 - DNA, 18 bp, Homo sapiens
ctgctgctggtcaccccc

SEQ ID NO: 558844 - DNA, 15 bp, Homo sapiens
ctgctggtcaccccc

SEQ ID NO: 558845 - DNA, 17 bp, Homo sapiens
ctgctggtcacttcttc

SEQ ID NO: 558846 - DNA, 19 bp, Homo sapiens
ctgctggtcacttcttctg

SEQ ID NO: 558847 - DNA, 21 bp, Homo sapiens
ctgctgtaagacggccttgga

SEQ ID NO: 558848 - DNA, 22 bp, Homo sapiens
ctgctgtgggcacaggtcaggc

SEQ ID NO: 558849 - DNA, 12 bp, Homo sapiens
ctgcttagtgtc

SEQ ID NO: 558850 - DNA, 19 bp, Homo sapiens
ctggaaaataaaaggtcta

SEQ ID NO: 558851 - DNA, 17 bp, Homo sapiens
ctggaagagctaggcag

SEQ ID NO: 558852 - DNA, 19 bp, Homo sapiens
ctggaataagaagcaaata

SEQ ID NO: 558853 - DNA, 17 bp, Homo sapiens
ctggacacccccttggt

SEQ ID NO: 558854 - DNA, 20 bp, Homo sapiens
ctggactctgtggggccaca

SEQ ID NO: 558855 - DNA, 18 bp, Homo sapiens
ctggagaccaggactctg

SEQ ID NO: 558856 - DNA, 20 bp, Homo sapiens
ctggagaccaggactctgcc

SEQ ID NO: 558857 - DNA, 13 bp, Homo sapiens
ctggagagcaaca

SEQ ID NO: 558858 - DNA, 18 bp, Homo sapiens
ctggagatggggagaaac

SEQ ID NO: 558859 - DNA, 19 bp, Homo sapiens
ctggagcccggcagtgcac

SEQ ID NO: 558860 - DNA, 15 bp, Homo sapiens
ctggataatttgtat

SEQ ID NO: 558861 - DNA, 16 bp, Homo sapiens
ctggatataatgtatt

SEQ ID NO: 558862 - DNA, 15 bp, Homo sapiens
ctggatggagctgga

SEQ ID NO: 558863 - DNA, 12 bp, Homo sapiens
ctggcagggcag

SEQ ID NO: 558864 - DNA, 15 bp, Homo sapiens
ctggcagggcaggca

SEQ ID NO: 558865 - DNA, 17 bp, Homo sapiens
ctggcagggcaggcaga

SEQ ID NO: 558866 - DNA, 22 bp, Homo sapiens
ctggcagggcaggcagagctca

SEQ ID NO: 558867 - DNA, 19 bp, Homo sapiens
ctggcaggtggccagggct

SEQ ID NO: 558868 - DNA, 14 bp, Homo sapiens
ctggcatctttgct

SEQ ID NO: 558869 - DNA, 22 bp, Homo sapiens
ctggcatctttgctatggggac

SEQ ID NO: 558870 - DNA, 13 bp, Homo sapiens
ctggcccccactg

SEQ ID NO: 558871 - DNA, 15 bp, Homo sapiens
ctggcccctcccaca

SEQ ID NO: 558872 - DNA, 13 bp, Homo sapiens
ctggccctggggc

SEQ ID NO: 558873 - DNA, 17 bp, Homo sapiens
ctggccctggggcctgt

SEQ ID NO: 558874 - DNA, 13 bp, Homo sapiens
ctggcctctcact

SEQ ID NO: 558875 - DNA, 18 bp, Homo sapiens
ctggcctgtctgtgaaga

SEQ ID NO: 558876 - DNA, 16 bp, Homo sapiens
ctggctctaggacccc

SEQ ID NO: 558877 - DNA, 20 bp, Homo sapiens
ctggctctaggacccccagt

SEQ ID NO: 558878 - DNA, 16 bp, Homo sapiens
ctggctgtgggctccc

SEQ ID NO: 558879 - DNA, 18 bp, Homo sapiens
ctggctgtgggctccctt

SEQ ID NO: 558880 - DNA, 19 bp, Homo sapiens
ctggcttagcgttctgttt

SEQ ID NO: 558881 - DNA, 16 bp, Homo sapiens
ctggcttctccctgga

SEQ ID NO: 558882 - DNA, 19 bp, Homo sapiens
ctgggaatgtatagtattt

SEQ ID NO: 558883 - DNA, 20 bp, Homo sapiens
ctgggaatgtatagtatttg

SEQ ID NO: 558884 - DNA, 21 bp, Homo sapiens
ctgggaatgtatagtatttga

SEQ ID NO: 558885 - DNA, 23 bp, Homo sapiens
ctgggaccctcggggcaggaagt

SEQ ID NO: 558886 - DNA, 16 bp, Homo sapiens
ctgggagatgctggga

SEQ ID NO: 558887 - DNA, 17 bp, Homo sapiens
ctgggataggggcagag

SEQ ID NO: 558888 - DNA, 12 bp, Homo sapiens
ctgggcagctgt

SEQ ID NO: 558889 - DNA, 21 bp, Homo sapiens
ctgggcagctgttagagtcca

SEQ ID NO: 558890 - DNA, 15 bp, Homo sapiens
ctgggcatccccagc

SEQ ID NO: 558891 - DNA, 14 bp, Homo sapiens
ctgggccagggtct

SEQ ID NO: 558892 - DNA, 15 bp, Homo sapiens
ctgggcccacatccg

SEQ ID NO: 558893 - DNA, 18 bp, Homo sapiens
ctgggcccacccaagcag

SEQ ID NO: 558894 - DNA, 21 bp, Homo sapiens
ctgggcccacccaagcaggag

SEQ ID NO: 558895 - DNA, 21 bp, Homo sapiens
ctgggcttttgttttgctttt

SEQ ID NO: 558896 - DNA, 12 bp, Homo sapiens
ctggggagctcc

SEQ ID NO: 558897 - DNA, 14 bp, Homo sapiens
ctggggagctcctg

SEQ ID NO: 558898 - DNA, 14 bp, Homo sapiens
ctggggcagcctct

SEQ ID NO: 558899 - DNA, 17 bp, Homo sapiens
ctggggcttttgtgcca

SEQ ID NO: 558900 - DNA, 19 bp, Homo sapiens
ctggggcttttgtgccagg

SEQ ID NO: 558901 - DNA, 22 bp, Homo sapiens
ctggggcttttgtgccaggagt

SEQ ID NO: 558902 - DNA, 12 bp, Homo sapiens
ctgggggcctga

SEQ ID NO: 558903 - DNA, 15 bp, Homo sapiens
ctgggggcctgacct

SEQ ID NO: 558904 - DNA, 22 bp, Homo sapiens
ctgggggcctgacctccccctc

SEQ ID NO: 558905 - DNA, 12 bp, Homo sapiens
ctgggggctgct

SEQ ID NO: 558906 - DNA, 16 bp, Homo sapiens
ctgggggctgctgcac

SEQ ID NO: 558907 - DNA, 24 bp, Homo sapiens
ctggggtttccacacaggcccatg

SEQ ID NO: 558908 - DNA, 22 bp, Homo sapiens
ctgggtgcaggagcgctccctt

SEQ ID NO: 558909 - DNA, 15 bp, Homo sapiens
ctgggttattcagaa

SEQ ID NO: 558910 - DNA, 15 bp, Homo sapiens
ctggtactttctgta

SEQ ID NO: 558911 - DNA, 17 bp, Homo sapiens
ctggtactttctgtact

SEQ ID NO: 558912 - DNA, 14 bp, Homo sapiens
ctggtcactgccat

SEQ ID NO: 558913 - DNA, 17 bp, Homo sapiens
ctggtcacttcttctgt

SEQ ID NO: 558914 - DNA, 14 bp, Homo sapiens
ctggtcctgcactg

SEQ ID NO: 558915 - DNA, 15 bp, Homo sapiens
ctggtcctgcactgt

SEQ ID NO: 558916 - DNA, 20 bp, Homo sapiens
ctggtgggccttaacatccc

SEQ ID NO: 558917 - DNA, 23 bp, Homo sapiens
ctggtgttaatgagtatatgtaa

SEQ ID NO: 558918 - DNA, 21 bp, Homo sapiens
ctggttcccccaggaccctga

SEQ ID NO: 558919 - DNA, 18 bp, Homo sapiens
ctggttccggaatcctgt

SEQ ID NO: 558920 - DNA, 16 bp, Homo sapiens
ctggtttcctcagcct

SEQ ID NO: 558921 - DNA, 18 bp, Homo sapiens
ctgtaaataaaaatagct

SEQ ID NO: 558922 - DNA, 19 bp, Homo sapiens
ctgtaaattccaaagatct

SEQ ID NO: 558923 - DNA, 14 bp, Homo sapiens
ctgtaacagttctt

SEQ ID NO: 558924 - DNA, 23 bp, Homo sapiens
ctgtaataaataaatatactcaa

SEQ ID NO: 558925 - DNA, 22 bp, Homo sapiens
ctgtacaaaagggacatgaaat

SEQ ID NO: 558926 - DNA, 22 bp, Homo sapiens
ctgtacaatcatgaacagctct

SEQ ID NO: 558927 - DNA, 12 bp, Homo sapiens
ctgtacacacac

SEQ ID NO: 558928 - DNA, 14 bp, Homo sapiens
ctgtacacacacag

SEQ ID NO: 558929 - DNA, 19 bp, Homo sapiens
ctgtacacacacagacaca

SEQ ID NO: 558930 - DNA, 17 bp, Homo sapiens
ctgtactggagagcaac

SEQ ID NO: 558931 - DNA, 18 bp, Homo sapiens
ctgtactggagagcaaca

SEQ ID NO: 558932 - DNA, 19 bp, Homo sapiens
ctgtagctctgaatgctat

SEQ ID NO: 558933 - DNA, 16 bp, Homo sapiens
ctctatcctgggcttt

SEQ ID NO: 558934 - DNA, 20 bp, Homo sapiens
ctctattccccaccctcccc

SEQ ID NO: 558935 - DNA, 15 bp, Homo sapiens
ctctatttcattttt

SEQ ID NO: 558936 - DNA, 22 bp, Homo sapiens
ctctatttccccctttcttcct

SEQ ID NO: 558937 - DNA, 23 bp, Homo sapiens
ctctatttccccctttcttcctc

SEQ ID NO: 558938 - DNA, 12 bp, Homo sapiens
ctctcacctcct

SEQ ID NO: 558939 - DNA, 16 bp, Homo sapiens
ctctcatgctgcccct

SEQ ID NO: 558940 - DNA, 22 bp, Homo sapiens
ctctcatgctgcccctgccttg

SEQ ID NO: 558941 - DNA, 12 bp, Homo sapiens
ctctcattccca

SEQ ID NO: 558942 - DNA, 14 bp, Homo sapiens
ctctcattcccagg

SEQ ID NO: 558943 - DNA, 14 bp, Homo sapiens
ctctcccctccctt

SEQ ID NO: 558944 - DNA, 19 bp, Homo sapiens
ctctcccctgcgcaggccc

SEQ ID NO: 558945 - DNA, 20 bp, Homo sapiens
ctctcccctgcgcaggccct

SEQ ID NO: 558946 - DNA, 17 bp, Homo sapiens
ctctcctgggccagggt

SEQ ID NO: 558947 - DNA, 16 bp, Homo sapiens
ctctctaacctccttt

SEQ ID NO: 558948 - DNA, 22 bp, Homo sapiens
ctctctatttccccctttcttc

SEQ ID NO: 558949 - DNA, 14 bp, Homo sapiens
ctctctcattccca

SEQ ID NO: 558950 - DNA, 20 bp, Homo sapiens
ctctctccagtcttccacct

SEQ ID NO: 558951 - DNA, 12 bp, Homo sapiens
ctctctccatca

SEQ ID NO: 558952 - DNA, 13 bp, Homo sapiens
ctctctggctcta

SEQ ID NO: 558953 - DNA, 17 bp, Homo sapiens
ctctctgggctgactgg

SEQ ID NO: 558954 - DNA, 18 bp, Homo sapiens
ctctctgtataaacatta

SEQ ID NO: 558955 - DNA, 19 bp, Homo sapiens
ctctctgtgtccgtgtgga

SEQ ID NO: 558956 - DNA, 13 bp, Homo sapiens
ctctcttcttact

SEQ ID NO: 558957 - DNA, 19 bp, Homo sapiens
ctctcttggaactgcacca

SEQ ID NO: 558958 - DNA, 15 bp, Homo sapiens
ctctgaactgctgct

SEQ ID NO: 558959 - DNA, 12 bp, Homo sapiens
ctctgaattcca

SEQ ID NO: 558960 - DNA, 18 bp, Homo sapiens
ctctgaattccaagtaga

SEQ ID NO: 558961 - DNA, 16 bp, Homo sapiens
ctctgatgtattttgt

SEQ ID NO: 558962 - DNA, 19 bp, Homo sapiens
ctctgccatgaactggagg

SEQ ID NO: 558963 - DNA, 13 bp, Homo sapiens
ctctgcccagctt

SEQ ID NO: 558964 - DNA, 13 bp, Homo sapiens
ctctgcccttggg

SEQ ID NO: 558965 - DNA, 13 bp, Homo sapiens
ctctgctcttgca

SEQ ID NO: 558966 - DNA, 22 bp, Homo sapiens
ctctgctgtgggcacaggtcag

SEQ ID NO: 558967 - DNA, 21 bp, Homo sapiens
ctctggcaggtggccagggct

SEQ ID NO: 558968 - DNA, 23 bp, Homo sapiens
ctctggcaggtggccagggctcc

SEQ ID NO: 558969 - DNA, 15 bp, Homo sapiens
ctctggctctaggac

SEQ ID NO: 558970 - DNA, 21 bp, Homo sapiens
ctctggggagaccgagtgtgg

SEQ ID NO: 558971 - DNA, 16 bp, Homo sapiens
ctctgtacatattagc

SEQ ID NO: 558972 - DNA, 13 bp, Homo sapiens
ctctgtataaaca

SEQ ID NO: 558973 - DNA, 16 bp, Homo sapiens
ctctgtgtgttaaaat

SEQ ID NO: 558974 - DNA, 22 bp, Homo sapiens
ctcttaaaaattatctttaaaa

SEQ ID NO: 558975 - DNA, 22 bp, Homo sapiens
ctcttacctgtaatagcctcac

SEQ ID NO: 558976 - DNA, 17 bp, Homo sapiens
ctcttagcttttctgca

SEQ ID NO: 558977 - DNA, 15 bp, Homo sapiens
ctcttcctggacagg

SEQ ID NO: 558978 - DNA, 19 bp, Homo sapiens
ctcttcctggacaggccag

SEQ ID NO: 558979 - DNA, 20 bp, Homo sapiens
ctcttctccccttccatttc

SEQ ID NO: 558980 - DNA, 21 bp, Homo sapiens
ctcttctccccttccatttct

SEQ ID NO: 558981 - DNA, 16 bp, Homo sapiens
ctcttgaatgcttaaa

SEQ ID NO: 558982 - DNA, 16 bp, Homo sapiens
ctcttggaactgcacc

SEQ ID NO: 558983 - DNA, 17 bp, Homo sapiens
ctctttatgatctggcc

SEQ ID NO: 558984 - DNA, 17 bp, Homo sapiens
ctctttcccacccagcc

SEQ ID NO: 558985 - DNA, 18 bp, Homo sapiens
ctctttcccacccagcct

SEQ ID NO: 558986 - DNA, 20 bp, Homo sapiens
ctctttcccacccagcctgg

SEQ ID NO: 558987 - DNA, 15 bp, Homo sapiens
ctctttcggaaatga

SEQ ID NO: 558988 - DNA, 13 bp, Homo sapiens
ctctttcttcctt

SEQ ID NO: 558989 - DNA, 18 bp, Homo sapiens
ctctttggaaatagcatg

SEQ ID NO: 558990 - DNA, 16 bp, Homo sapiens
ctcttttagatattgt

SEQ ID NO: 558991 - DNA, 17 bp, Homo sapiens
ctcttttgctctctcat

SEQ ID NO: 558992 - DNA, 22 bp, Homo sapiens
ctcttttgctctctcattccca

SEQ ID NO: 558993 - DNA, 13 bp, Homo sapiens
ctgaaaactggaa

SEQ ID NO: 558994 - DNA, 14 bp, Homo sapiens
ctgaaagcaacagc

SEQ ID NO: 558995 - DNA, 21 bp, Homo sapiens
ctgaaagcaacagctggacac

SEQ ID NO: 558996 - DNA, 13 bp, Homo sapiens
ctgaaatgtgtgt

SEQ ID NO: 558997 - DNA, 17 bp, Homo sapiens
ctgaaatgtgtgtgatg

SEQ ID NO: 558998 - DNA, 19 bp, Homo sapiens
ctgaaatgtttccaggcat

SEQ ID NO: 558999 - DNA, 18 bp, Homo sapiens
ctgaacaaaccctttaaa

SEQ ID NO: 559000 - DNA, 20 bp, Homo sapiens
ctgaacaaaccctttaaatg

SEQ ID NO: 559001 - DNA, 14 bp, Homo sapiens
ctgaacaaagagag

SEQ ID NO: 559002 - DNA, 14 bp, Homo sapiens
ctgaacttttcaaa

SEQ ID NO: 559003 - DNA, 15 bp, Homo sapiens
ctgaacttttcaaaa

SEQ ID NO: 559004 - DNA, 14 bp, Homo sapiens
ctgaagcagagtca

SEQ ID NO: 559005 - DNA, 20 bp, Homo sapiens
ctgaagcagagtcaagctga

SEQ ID NO: 559006 - DNA, 12 bp, Homo sapiens
ctgaagccagct

SEQ ID NO: 559007 - DNA, 17 bp, Homo sapiens
ctgaagccagctccctg

SEQ ID NO: 559008 - DNA, 18 bp, Homo sapiens
ctgaagccagctccctga

SEQ ID NO: 559009 - DNA, 19 bp, Homo sapiens
ctgaagcttaaccgaagaa

SEQ ID NO: 559010 - DNA, 14 bp, Homo sapiens
ctgaagtcagttct

SEQ ID NO: 559011 - DNA, 13 bp, Homo sapiens
ctgaagtttgata

SEQ ID NO: 559012 - DNA, 21 bp, Homo sapiens
ctgaagtttgataaatagtgt

SEQ ID NO: 559013 - DNA, 15 bp, Homo sapiens
ctgaatcagaggcag

SEQ ID NO: 559014 - DNA, 17 bp, Homo sapiens
ctgaatcagaggcagag

SEQ ID NO: 559015 - DNA, 17 bp, Homo sapiens
ctgaatccaaaagaaaa

SEQ ID NO: 559016 - DNA, 19 bp, Homo sapiens
ctgaatctgaccacagaca

SEQ ID NO: 559017 - DNA, 21 bp, Homo sapiens
ctgaatctgaccacagacact

SEQ ID NO: 559018 - DNA, 14 bp, Homo sapiens
ctgaatctgtacag

SEQ ID NO: 559019 - DNA, 15 bp, Homo sapiens
ctgaatctgtacaga

SEQ ID NO: 559020 - DNA, 20 bp, Homo sapiens
ctgaatgctatttgtgtaac

SEQ ID NO: 559021 - DNA, 23 bp, Homo sapiens
ctgaatgctatttgtgtaactga

SEQ ID NO: 559022 - DNA, 18 bp, Homo sapiens
ctgaatgtattatcctgt

SEQ ID NO: 559023 - DNA, 19 bp, Homo sapiens
ctgacagcaaacacagtca

SEQ ID NO: 559024 - DNA, 21 bp, Homo sapiens
ctgacatatttcataagcaca

SEQ ID NO: 559025 - DNA, 15 bp, Homo sapiens
ctgaccacagacact

SEQ ID NO: 559026 - DNA, 19 bp, Homo sapiens
ctgaccacagacactcctg

SEQ ID NO: 559027 - DNA, 22 bp, Homo sapiens
ctgaccacagacactcctgggg

SEQ ID NO: 559028 - DNA, 15 bp, Homo sapiens
ctgacccccctcagg

SEQ ID NO: 559029 - DNA, 20 bp, Homo sapiens
ctgacccccctcaggaccct

SEQ ID NO: 559030 - DNA, 16 bp, Homo sapiens
ctgacctccccctcct

SEQ ID NO: 559031 - DNA, 22 bp, Homo sapiens
ctgacctccccctccttcccag

SEQ ID NO: 559032 - DNA, 17 bp, Homo sapiens
ctgacctccgccatcca

SEQ ID NO: 559033 - DNA, 19 bp, Homo sapiens
ctgacctccgccatccacc

SEQ ID NO: 559034 - DNA, 24 bp, Homo sapiens
ctgacctgcccccgctctgccatc

SEQ ID NO: 559035 - DNA, 15 bp, Homo sapiens
ctgactgggccaggg

SEQ ID NO: 559036 - DNA, 18 bp, Homo sapiens
ctgacttaactttaactt

SEQ ID NO: 559037 - DNA, 22 bp, Homo sapiens
ctgacttaactttaacttttga

SEQ ID NO: 559038 - DNA, 10 bp, Homo sapiens
ctgagaaaag

SEQ ID NO: 559039 - DNA, 15 bp, Homo sapiens
ctgagatcctggagt

SEQ ID NO: 559040 - DNA, 13 bp, Homo sapiens
ctgagctggccta

SEQ ID NO: 559041 - DNA, 14 bp, Homo sapiens
ctgaggaggtgctg

SEQ ID NO: 559042 - DNA, 13 bp, Homo sapiens
ctgaggctggggc

SEQ ID NO: 559043 - DNA, 15 bp, Homo sapiens
ctgaggctggggctt

SEQ ID NO: 559044 - DNA, 16 bp, Homo sapiens
ctgagggcccttccca

SEQ ID NO: 559045 - DNA, 15 bp, Homo sapiens
ctgaggggcagcctg

SEQ ID NO: 559046 - DNA, 21 bp, Homo sapiens
ctgaggttgggagaggtgcac

SEQ ID NO: 559047 - DNA, 22 bp, Homo sapiens
ctgagtcctcattgttcagaaa

SEQ ID NO: 559048 - DNA, 14 bp, Homo sapiens
ctgagtctcattcc

SEQ ID NO: 559049 - DNA, 13 bp, Homo sapiens
ctgagtgaaatat

SEQ ID NO: 559050 - DNA, 16 bp, Homo sapiens
ctgagtgagctgaaga

SEQ ID NO: 559051 - DNA, 22 bp, Homo sapiens
ctgagtggtccacattctgctg

SEQ ID NO: 559052 - DNA, 14 bp, Homo sapiens
ctgatatatttaaa

SEQ ID NO: 559053 - DNA, 19 bp, Homo sapiens
ctgatatctgtttgcttct

SEQ ID NO: 559054 - DNA, 20 bp, Homo sapiens
ctgatccctgatcccttcca

SEQ ID NO: 559055 - DNA, 15 bp, Homo sapiens
ctgatgatgttctga

SEQ ID NO: 559056 - DNA, 18 bp, Homo sapiens
ctgatgggtatcatgctt

SEQ ID NO: 559057 - DNA, 15 bp, Homo sapiens
ctgatgtaaatgaag

SEQ ID NO: 559058 - DNA, 16 bp, Homo sapiens
ctgattctatgtaact

SEQ ID NO: 559059 - DNA, 17 bp, Homo sapiens
ctgattctatgtaactt

SEQ ID NO: 559060 - DNA, 16 bp, Homo sapiens
ctgattggtttctctt

SEQ ID NO: 559061 - DNA, 15 bp, Homo sapiens
ctgatttactaacag

SEQ ID NO: 559062 - DNA, 13 bp, Homo sapiens
ctgcaccaggcca

SEQ ID NO: 559063 - DNA, 16 bp, Homo sapiens
ctgcaccaggccatca

SEQ ID NO: 559064 - DNA, 14 bp, Homo sapiens
ctgcacctgcttct

SEQ ID NO: 559065 - DNA, 13 bp, Homo sapiens
ctgcactgccctc

SEQ ID NO: 559066 - DNA, 22 bp, Homo sapiens
ctgcagagcacaaacttcagaa

SEQ ID NO: 559067 - DNA, 15 bp, Homo sapiens
ctgcagagcctgcag

SEQ ID NO: 559068 - DNA, 19 bp, Homo sapiens
ctgcagctccctcaaagag

SEQ ID NO: 559069 - DNA, 23 bp, Homo sapiens
ctgcagctccctcaaagaggcag

SEQ ID NO: 559070 - DNA, 20 bp, Homo sapiens
ctgcaggaatcaaaaattga

SEQ ID NO: 559071 - DNA, 17 bp, Homo sapiens
ctgcaggccacttacct

SEQ ID NO: 559072 - DNA, 20 bp, Homo sapiens
ctgcaggcggtatccagagg

SEQ ID NO: 559073 - DNA, 21 bp, Homo sapiens
ctgcaggcggtatccagaggt

SEQ ID NO: 559074 - DNA, 21 bp, Homo sapiens
ctgcagtgttctgtgaatagc

SEQ ID NO: 559075 - DNA, 18 bp, Homo sapiens
ctatttccccctttcttc

SEQ ID NO: 559076 - DNA, 19 bp, Homo sapiens
ctatttccccctttcttcc

SEQ ID NO: 559077 - DNA, 21 bp, Homo sapiens
ctatttccccctttcttcctc

SEQ ID NO: 559078 - DNA, 15 bp, Homo sapiens
ctattttactgtctt

SEQ ID NO: 559079 - DNA, 23 bp, Homo sapiens
ctattttactgtcttaattaagt

SEQ ID NO: 559080 - DNA, 14 bp, Homo sapiens
ctcaaaagatctcc

SEQ ID NO: 559081 - DNA, 17 bp, Homo sapiens
ctcaaaataaaaccaga

SEQ ID NO: 559082 - DNA, 18 bp, Homo sapiens
ctcaaagatgaaagctgt

SEQ ID NO: 559083 - DNA, 22 bp, Homo sapiens
ctcaaagatgaaagctgtttca

SEQ ID NO: 559084 - DNA, 12 bp, Homo sapiens
ctcaatttcaat

SEQ ID NO: 559085 - DNA, 22 bp, Homo sapiens
ctcacacaatcagaccaaggaa

SEQ ID NO: 559086 - DNA, 15 bp, Homo sapiens
ctcacatattattgg

SEQ ID NO: 559087 - DNA, 19 bp, Homo sapiens
ctcaccagctgctgctctg

SEQ ID NO: 559088 - DNA, 13 bp, Homo sapiens
ctcaccagctgtg

SEQ ID NO: 559089 - DNA, 14 bp, Homo sapiens
ctcaccttctgttt

SEQ ID NO: 559090 - DNA, 15 bp, Homo sapiens
ctcacgttacaggga

SEQ ID NO: 559091 - DNA, 20 bp, Homo sapiens
ctcactcagaagtccagagt

SEQ ID NO: 559092 - DNA, 18 bp, Homo sapiens
ctcactccccacatccca

SEQ ID NO: 559093 - DNA, 15 bp, Homo sapiens
ctcactgacacagga

SEQ ID NO: 559094 - DNA, 14 bp, Homo sapiens
ctcagaaagggatt

SEQ ID NO: 559095 - DNA, 22 bp, Homo sapiens
ctcagaagtgaaaaagacttca

SEQ ID NO: 559096 - DNA, 19 bp, Homo sapiens
ctcagaatctttccttcct

SEQ ID NO: 559097 - DNA, 15 bp, Homo sapiens
ctcagagcacagcca

SEQ ID NO: 559098 - DNA, 21 bp, Homo sapiens
ctcagagggtagccttgattt

SEQ ID NO: 559099 - DNA, 15 bp, Homo sapiens
ctcagagtgaagagt

SEQ ID NO: 559100 - DNA, 17 bp, Homo sapiens
ctcagagtgaagagtga

SEQ ID NO: 559101 - DNA, 17 bp, Homo sapiens
ctcagcaaacccaaaga

SEQ ID NO: 559102 - DNA, 12 bp, Homo sapiens
ctcagcacagcc

SEQ ID NO: 559103 - DNA, 18 bp, Homo sapiens
aatttacttttaataaag

SEQ ID NO: 559104 - DNA, 14 bp, Homo sapiens
aatttagtgtatat

SEQ ID NO: 559105 - DNA, 17 bp, Homo sapiens
aatttagtgtatatgtg

SEQ ID NO: 559106 - DNA, 15 bp, Homo sapiens
aatttatctgttgtc

SEQ ID NO: 559107 - DNA, 19 bp, Homo sapiens
aatttattacttgttgcaa

SEQ ID NO: 559108 - DNA, 22 bp, Homo sapiens
aatttattgaggaaaaatatgt

SEQ ID NO: 559109 - DNA, 15 bp, Homo sapiens
aatttattgcacaaa

SEQ ID NO: 559110 - DNA, 13 bp, Homo sapiens
aatttcaagctta

SEQ ID NO: 559111 - DNA, 21 bp, Homo sapiens
aatttcacgtcataggaagtt

SEQ ID NO: 559112 - DNA, 19 bp, Homo sapiens
aatttcagaaactaagaat

SEQ ID NO: 559113 - DNA, 16 bp, Homo sapiens
aatttcagtaagatca

SEQ ID NO: 559114 - DNA, 20 bp, Homo sapiens
aatttctagatatgagaaat

SEQ ID NO: 559115 - DNA, 16 bp, Homo sapiens
aatttctggcaaatat

SEQ ID NO: 559116 - DNA, 23 bp, Homo sapiens
aatttctggcaaatattttgtca

SEQ ID NO: 559117 - DNA, 19 bp, Homo sapiens
aatttcttgcaatttgaag

SEQ ID NO: 559118 - DNA, 20 bp, Homo sapiens
aatttcttgcaatttgaagg

SEQ ID NO: 559119 - DNA, 14 bp, Homo sapiens
aatttgaaacattg

SEQ ID NO: 559120 - DNA, 21 bp, Homo sapiens
aatttgaaacattgcttttaa

SEQ ID NO: 559121 - DNA, 20 bp, Homo sapiens
aatttgcactttcaggaaca

SEQ ID NO: 559122 - DNA, 19 bp, Homo sapiens
aatttggaccattttcctg

SEQ ID NO: 559123 - DNA, 16 bp, Homo sapiens
aatttgggaacataaa

SEQ ID NO: 559124 - DNA, 17 bp, Homo sapiens
aatttgggaacataaaa

SEQ ID NO: 559125 - DNA, 17 bp, Homo sapiens
aatttgtaccatttcag

SEQ ID NO: 559126 - DNA, 12 bp, Homo sapiens
aatttgtctttg

SEQ ID NO: 559127 - DNA, 20 bp, Homo sapiens
aatttgtgcatcagaaaatg

SEQ ID NO: 559128 - DNA, 15 bp, Homo sapiens
aatttgtgctgggtt

SEQ ID NO: 559129 - DNA, 18 bp, Homo sapiens
aattttaagctaggaaaa

SEQ ID NO: 559130 - DNA, 21 bp, Homo sapiens
aattttataaggacttcctga

SEQ ID NO: 559131 - DNA, 13 bp, Homo sapiens
aattttcagattt

SEQ ID NO: 559132 - DNA, 14 bp, Homo sapiens
aattttcagatttg

SEQ ID NO: 559133 - DNA, 15 bp, Homo sapiens
aattttcattttaca

SEQ ID NO: 559134 - DNA, 16 bp, Homo sapiens
aattttcattttacag

SEQ ID NO: 559135 - DNA, 14 bp, Homo sapiens
aatttttctgtata

SEQ ID NO: 559136 - DNA, 21 bp, Homo sapiens
aatttttctgtatagacagga

SEQ ID NO: 559137 - DNA, 21 bp, Homo sapiens
acaaaagcattcggagggagg

SEQ ID NO: 559138 - DNA, 10 bp, Homo sapiens
acaaaaggca

SEQ ID NO: 559139 - DNA, 20 bp, Homo sapiens
acaaaatccttgccttcaaa

SEQ ID NO: 559140 - DNA, 13 bp, Homo sapiens
acaaaatgtaact

SEQ ID NO: 559141 - DNA, 16 bp, Homo sapiens
acaaaatgtaactgtt

SEQ ID NO: 559142 - DNA, 13 bp, Homo sapiens
acaaacaaacaag

SEQ ID NO: 559143 - DNA, 18 bp, Homo sapiens
acaaacaattaactgagc

SEQ ID NO: 559144 - DNA, 21 bp, Homo sapiens
acaaacatagacagatgtgga

SEQ ID NO: 559145 - DNA, 20 bp, Homo sapiens
acaaactgcacatgatttca

SEQ ID NO: 559146 - DNA, 12 bp, Homo sapiens
acaaagaaatat

SEQ ID NO: 559147 - DNA, 15 bp, Homo sapiens
acaaagctatttaag

SEQ ID NO: 559148 - DNA, 19 bp, Homo sapiens
acaaaggctgtattcagca

SEQ ID NO: 559149 - DNA, 23 bp, Homo sapiens
acaaataacaacttttttttctt

SEQ ID NO: 559150 - DNA, 12 bp, Homo sapiens
acaaatacacat

SEQ ID NO: 559151 - DNA, 22 bp, Homo sapiens
acaaatagtaggcaagatggca

SEQ ID NO: 559152 - DNA, 15 bp, Homo sapiens
acaaatgattgcttt

SEQ ID NO: 559153 - DNA, 16 bp, Homo sapiens
acaaatgattgctttt

SEQ ID NO: 559154 - DNA, 11 bp, Homo sapiens
acaaatgtgtg

SEQ ID NO: 559155 - DNA, 18 bp, Homo sapiens
acaaattatgctaagaat

SEQ ID NO: 559156 - DNA, 18 bp, Homo sapiens
acaacacattgaaactgt

SEQ ID NO: 559157 - DNA, 18 bp, Homo sapiens
acaacagattggatttta

SEQ ID NO: 559158 - DNA, 22 bp, Homo sapiens
acaacataaaattaaaatttaa

SEQ ID NO: 559159 - DNA, 17 bp, Homo sapiens
acaacatccatgtccta

SEQ ID NO: 559160 - DNA, 23 bp, Homo sapiens
acaacatccatgtcctatgtgtg

SEQ ID NO: 559161 - DNA, 23 bp, Homo sapiens
acaaccatgttcttgagcagctg

SEQ ID NO: 559162 - DNA, 17 bp, Homo sapiens
cgtccctgagggccctt

SEQ ID NO: 559163 - DNA, 18 bp, Homo sapiens
cgtccctgagggcccttc

SEQ ID NO: 559164 - DNA, 19 bp, Homo sapiens
cgtccctgagggcccttcc

SEQ ID NO: 559165 - DNA, 17 bp, Homo sapiens
cgtgaaagttgtgatct

SEQ ID NO: 559166 - DNA, 22 bp, Homo sapiens
cgtggaatgcccttcactgtca

SEQ ID NO: 559167 - DNA, 17 bp, Homo sapiens
cgtggcaactgtggaag

SEQ ID NO: 559168 - DNA, 19 bp, Homo sapiens
cgtggctgacccccctcag

SEQ ID NO: 559169 - DNA, 21 bp, Homo sapiens
cgtggctgcccacacacccca

SEQ ID NO: 559170 - DNA, 23 bp, Homo sapiens
cgtgggagtatgttatttctctg

SEQ ID NO: 559171 - DNA, 22 bp, Homo sapiens
cgtgggtcttcagggggccagg

SEQ ID NO: 559172 - DNA, 21 bp, Homo sapiens
cgtggttgggaacacagcatt

SEQ ID NO: 559173 - DNA, 21 bp, Homo sapiens
cgttgtgtgggtttactctgt

SEQ ID NO: 559174 - DNA, 14 bp, Homo sapiens
cgttgttttgtgga

SEQ ID NO: 559175 - DNA, 16 bp, Homo sapiens
cgttgttttgtggata

SEQ ID NO: 559176 - DNA, 19 bp, Homo sapiens
cgttgttttgtggataaga

SEQ ID NO: 559177 - DNA, 13 bp, Homo sapiens
ctaaaactgtact

SEQ ID NO: 559178 - DNA, 11 bp, Homo sapiens
ctaaacatttc

SEQ ID NO: 559179 - DNA, 12 bp, Homo sapiens
ctaaacatttcc

SEQ ID NO: 559180 - DNA, 14 bp, Homo sapiens
ctaaacatttcctt

SEQ ID NO: 559181 - DNA, 19 bp, Homo sapiens
ctaaacgtgtatgtttttc

SEQ ID NO: 559182 - DNA, 22 bp, Homo sapiens
ctaaacgtgtatgtttttcagt

SEQ ID NO: 559183 - DNA, 17 bp, Homo sapiens
ctaaactttaatatgta

SEQ ID NO: 559184 - DNA, 12 bp, Homo sapiens
ctaaatattatg

SEQ ID NO: 559185 - DNA, 14 bp, Homo sapiens
ctaaatattatgcc

SEQ ID NO: 559186 - DNA, 17 bp, Homo sapiens
ctaaatgcctaataaac

SEQ ID NO: 559187 - DNA, 19 bp, Homo sapiens
ctaaatgcctaataaacaa

SEQ ID NO: 559188 - DNA, 13 bp, Homo sapiens
ctaaatgttaaag

SEQ ID NO: 559189 - DNA, 17 bp, Homo sapiens
ctaaatgttaaagatgt

SEQ ID NO: 559190 - DNA, 16 bp, Homo sapiens
ctaaattgatgttgat

SEQ ID NO: 559191 - DNA, 17 bp, Homo sapiens
ctaaattgatgttgatg

SEQ ID NO: 559192 - DNA, 15 bp, Homo sapiens
ctaactctgatgtaa

SEQ ID NO: 559193 - DNA, 16 bp, Homo sapiens
ctaactctgatgtaaa

SEQ ID NO: 559194 - DNA, 15 bp, Homo sapiens
ctaactgtgcaaagc

SEQ ID NO: 559195 - DNA, 20 bp, Homo sapiens
caggaacacccagccccagc

SEQ ID NO: 559196 - DNA, 16 bp, Homo sapiens
caggaagaagagatgc

SEQ ID NO: 559197 - DNA, 18 bp, Homo sapiens
caggaagcctcctgctga

SEQ ID NO: 559198 - DNA, 22 bp, Homo sapiens
caggaatatgcatcccacagcc

SEQ ID NO: 559199 - DNA, 12 bp, Homo sapiens
caggaccccatc

SEQ ID NO: 559200 - DNA, 13 bp, Homo sapiens
caggaccccatct

SEQ ID NO: 559201 - DNA, 20 bp, Homo sapiens
caggaccccatctgctgagc

SEQ ID NO: 559202 - DNA, 15 bp, Homo sapiens
caggacgcagggaga

SEQ ID NO: 559203 - DNA, 18 bp, Homo sapiens
caggactctgccttccag

SEQ ID NO: 559204 - DNA, 19 bp, Homo sapiens
caggactctgccttccagg

SEQ ID NO: 559205 - DNA, 16 bp, Homo sapiens
caggagacactggtct

SEQ ID NO: 559206 - DNA, 22 bp, Homo sapiens
caggagacactggtctcagagg

SEQ ID NO: 559207 - DNA, 18 bp, Homo sapiens
caggagaggatggcccag

SEQ ID NO: 559208 - DNA, 13 bp, Homo sapiens
caggaggagacag

SEQ ID NO: 559209 - DNA, 14 bp, Homo sapiens
caggaggagacagt

SEQ ID NO: 559210 - DNA, 14 bp, Homo sapiens
caggaggcagtggc

SEQ ID NO: 559211 - DNA, 22 bp, Homo sapiens
caggaggcagtggcttggagca

SEQ ID NO: 559212 - DNA, 17 bp, Homo sapiens
caggaggctccatcctt

SEQ ID NO: 559213 - DNA, 21 bp, Homo sapiens
caggaggctccatccttctcc

SEQ ID NO: 559214 - DNA, 15 bp, Homo sapiens
caggagggagcagag

SEQ ID NO: 559215 - DNA, 14 bp, Homo sapiens
caggaggtgcctga

SEQ ID NO: 559216 - DNA, 15 bp, Homo sapiens
caggaggtgcctgag

SEQ ID NO: 559217 - DNA, 15 bp, Homo sapiens
caggagtagtgaaga

SEQ ID NO: 559218 - DNA, 22 bp, Homo sapiens
caggagtagtgaagactccaga

SEQ ID NO: 559219 - DNA, 23 bp, Homo sapiens
caggagtagtgaagactccagaa

SEQ ID NO: 559220 - DNA, 20 bp, Homo sapiens
caggagtgggtgggacacag

SEQ ID NO: 559221 - DNA, 22 bp, Homo sapiens
caggagtgggtgggacacagag

SEQ ID NO: 559222 - DNA, 15 bp, Homo sapiens
caggatgcatattaa

SEQ ID NO: 559223 - DNA, 17 bp, Homo sapiens
caggatgcatattaaag

SEQ ID NO: 559224 - DNA, 20 bp, Homo sapiens
caggatggcgtgtcccctgc

SEQ ID NO: 559225 - DNA, 21 bp, Homo sapiens
caggatggcgtgtcccctgcc

SEQ ID NO: 559226 - DNA, 17 bp, Homo sapiens
caggcagagctcagcac

SEQ ID NO: 559227 - DNA, 19 bp, Homo sapiens
caggcagagctcagcacag

SEQ ID NO: 559228 - DNA, 17 bp, Homo sapiens
caggcaggggccctgca

SEQ ID NO: 559229 - DNA, 12 bp, Homo sapiens
caggcatctcct

SEQ ID NO: 559230 - DNA, 14 bp, Homo sapiens
caggcatctccttg

SEQ ID NO: 559231 - DNA, 18 bp, Homo sapiens
caggcatctccttgggct

SEQ ID NO: 559232 - DNA, 19 bp, Homo sapiens
caggcatgaccctggagcc

SEQ ID NO: 559233 - DNA, 22 bp, Homo sapiens
caggcatgtcccatgtgagctg

SEQ ID NO: 559234 - DNA, 17 bp, Homo sapiens
caggccacggcagccta

SEQ ID NO: 559235 - DNA, 13 bp, Homo sapiens
caggccgggcaga

SEQ ID NO: 559236 - DNA, 16 bp, Homo sapiens
caggcctccctgccag

SEQ ID NO: 559237 - DNA, 17 bp, Homo sapiens
caggcctccctgccagt

SEQ ID NO: 559238 - DNA, 18 bp, Homo sapiens
caggcctccctgccagta

SEQ ID NO: 559239 - DNA, 16 bp, Homo sapiens
caggcgctagcacagc

SEQ ID NO: 559240 - DNA, 16 bp, Homo sapiens
caggcggtatccagag

SEQ ID NO: 559241 - DNA, 15 bp, Homo sapiens
caggcgtagggccag

SEQ ID NO: 559242 - DNA, 17 bp, Homo sapiens
caggcgtagggccaggg

SEQ ID NO: 559243 - DNA, 21 bp, Homo sapiens
caggcgtagggccagggctct

SEQ ID NO: 559244 - DNA, 16 bp, Homo sapiens
cagttatcctttgtga

SEQ ID NO: 559245 - DNA, 17 bp, Homo sapiens
cagttatcctttgtgag

SEQ ID NO: 559246 - DNA, 20 bp, Homo sapiens
cagttgagaggacactcccg

SEQ ID NO: 559247 - DNA, 16 bp, Homo sapiens
cagttggactgtggcc

SEQ ID NO: 559248 - DNA, 21 bp, Homo sapiens
cagttggttttgcatgtctgc

SEQ ID NO: 559249 - DNA, 22 bp, Homo sapiens
cagttgtaacattctatttcaa

SEQ ID NO: 559250 - DNA, 12 bp, Homo sapiens
cagtttaacaga

SEQ ID NO: 559251 - DNA, 13 bp, Homo sapiens
cagtttaacagaa

SEQ ID NO: 559252 - DNA, 19 bp, Homo sapiens
cagtttaacagaaaaatga

SEQ ID NO: 559253 - DNA, 14 bp, Homo sapiens
cagtttatgttttg

SEQ ID NO: 559254 - DNA, 19 bp, Homo sapiens
cagtttatgttttggtcca

SEQ ID NO: 559255 - DNA, 18 bp, Homo sapiens
cagtttattccagagctg

SEQ ID NO: 559256 - DNA, 20 bp, Homo sapiens
cagtttcaataaagtttgat

SEQ ID NO: 559257 - DNA, 15 bp, Homo sapiens
cagtttttcttaata

SEQ ID NO: 559258 - DNA, 14 bp, Homo sapiens
cagtttttgttctt

SEQ ID NO: 559259 - DNA, 15 bp, Homo sapiens
cagtttttgttctta

SEQ ID NO: 559260 - DNA, 19 bp, Homo sapiens
cagtttttgttcttaaaaa

SEQ ID NO: 559261 - DNA, 15 bp, Homo sapiens
cataaaattaaaatt

SEQ ID NO: 559262 - DNA, 19 bp, Homo sapiens
cataaaattaaaatttaac

SEQ ID NO: 559263 - DNA, 14 bp, Homo sapiens
cataaacaaagagt

SEQ ID NO: 559264 - DNA, 15 bp, Homo sapiens
cataaacaaagagta

SEQ ID NO: 559265 - DNA, 18 bp, Homo sapiens
cataaatcaattcattgt

SEQ ID NO: 559266 - DNA, 21 bp, Homo sapiens
cataaatcaattcattgtgta

SEQ ID NO: 559267 - DNA, 16 bp, Homo sapiens
cataaattgtaatttg

SEQ ID NO: 559268 - DNA, 17 bp, Homo sapiens
cataagcaacaattttc

SEQ ID NO: 559269 - DNA, 16 bp, Homo sapiens
cataagtaaatgtctt

SEQ ID NO: 559270 - DNA, 18 bp, Homo sapiens
cataagttagatgtttta

SEQ ID NO: 559271 - DNA, 20 bp, Homo sapiens
cataatatgcatatatatgt

SEQ ID NO: 559272 - DNA, 13 bp, Homo sapiens
cataattcattaa

SEQ ID NO: 559273 - DNA, 13 bp, Homo sapiens
catacaatttact

SEQ ID NO: 559274 - DNA, 18 bp, Homo sapiens
catacacttgtataaatg

SEQ ID NO: 559275 - DNA, 16 bp, Homo sapiens
catacatatatacatt

SEQ ID NO: 559276 - DNA, 20 bp, Homo sapiens
catactcatttctaaaagaa

SEQ ID NO: 559277 - DNA, 14 bp, Homo sapiens
catagaataatgaa

SEQ ID NO: 559278 - DNA, 23 bp, Homo sapiens
catagagtgactccaagaacaat

SEQ ID NO: 559279 - DNA, 21 bp, Homo sapiens
catagataccattttgaaata

SEQ ID NO: 559280 - DNA, 22 bp, Homo sapiens
catagctacccaaaagagaaaa

SEQ ID NO: 559281 - DNA, 13 bp, Homo sapiens
cataggaaaagaa

SEQ ID NO: 559282 - DNA, 17 bp, Homo sapiens
catataaaatggcaaca

SEQ ID NO: 559283 - DNA, 12 bp, Homo sapiens
tcctatgtgtga

SEQ ID NO: 559284 - DNA, 12 bp, Homo sapiens
tcctcacatagc

SEQ ID NO: 559285 - DNA, 10 bp, Homo sapiens
tcctccagaa

SEQ ID NO: 559286 - DNA, 12 bp, Homo sapiens
tcctccagaact

SEQ ID NO: 559287 - DNA, 16 bp, Homo sapiens
tcctccagaactcttc

SEQ ID NO: 559288 - DNA, 18 bp, Homo sapiens
tcctccagaactcttcct

SEQ ID NO: 559289 - DNA, 21 bp, Homo sapiens
tcctccagaactcttcctcca

SEQ ID NO: 559290 - DNA, 15 bp, Homo sapiens
tcctccagtacaata

SEQ ID NO: 559291 - DNA, 22 bp, Homo sapiens
tcctcccaaaagtatcgggggc

SEQ ID NO: 559292 - DNA, 17 bp, Homo sapiens
tcctccctgatgtacag

SEQ ID NO: 559293 - DNA, 18 bp, Homo sapiens
tcctcctccttcctagtt

SEQ ID NO: 559294 - DNA, 16 bp, Homo sapiens
tcctcctgtattcctg

SEQ ID NO: 559295 - DNA, 18 bp, Homo sapiens
tcctcggccagagctccc

SEQ ID NO: 559296 - DNA, 23 bp, Homo sapiens
tcctctcctctgccctcccttct

SEQ ID NO: 559297 - DNA, 16 bp, Homo sapiens
tcctctctaacctcct

SEQ ID NO: 559298 - DNA, 18 bp, Homo sapiens
tcctctgctaaattgatg

SEQ ID NO: 559299 - DNA, 19 bp, Homo sapiens
tcctctgctaaattgatgt

SEQ ID NO: 559300 - DNA, 20 bp, Homo sapiens
tcctctgctcccccttttcc

SEQ ID NO: 559301 - DNA, 16 bp, Homo sapiens
tcctctgtccccgagc

SEQ ID NO: 559302 - DNA, 16 bp, Homo sapiens
tcctgacctccgccat

SEQ ID NO: 559303 - DNA, 14 bp, Homo sapiens
tcctgagtctgcct

SEQ ID NO: 559304 - DNA, 20 bp, Homo sapiens
tcctgattggtttctcttct

SEQ ID NO: 559305 - DNA, 20 bp, Homo sapiens
tcctgcaaccaaactcccat

SEQ ID NO: 559306 - DNA, 14 bp, Homo sapiens
tcctgcactgtccc

SEQ ID NO: 559307 - DNA, 16 bp, Homo sapiens
tcctgcccccacacct

SEQ ID NO: 559308 - DNA, 19 bp, Homo sapiens
tcctgcccccacacctggc

SEQ ID NO: 559309 - DNA, 20 bp, Homo sapiens
tcctgcccccacacctggcc

SEQ ID NO: 559310 - DNA, 21 bp, Homo sapiens
tcctgcccccacacctggccc

SEQ ID NO: 559311 - DNA, 22 bp, Homo sapiens
tcctgcccccacacctggccct

SEQ ID NO: 559312 - DNA, 14 bp, Homo sapiens
tcctgcctggtctc

SEQ ID NO: 559313 - DNA, 21 bp, Homo sapiens
tcctgcctggtctcctgcccc

SEQ ID NO: 559314 - DNA, 13 bp, Homo sapiens
tcctgctcagcag

SEQ ID NO: 559315 - DNA, 11 bp, Homo sapiens
tcctgctctgc

SEQ ID NO: 559316 - DNA, 12 bp, Homo sapiens
tcctgctctgct

SEQ ID NO: 559317 - DNA, 14 bp, Homo sapiens
tcctggagtgatat

SEQ ID NO: 559318 - DNA, 14 bp, Homo sapiens
tcctggcagggcag

SEQ ID NO: 559319 - DNA, 19 bp, Homo sapiens
tcctggcagggcaggcaga

SEQ ID NO: 559320 - DNA, 23 bp, Homo sapiens
tcctggcagggcaggcagagctc

SEQ ID NO: 559321 - DNA, 15 bp, Homo sapiens
tcctggctcccaggg

SEQ ID NO: 559322 - DNA, 15 bp, Homo sapiens
tcctgggccagggtc

SEQ ID NO: 559323 - DNA, 16 bp, Homo sapiens
tcctgggccagggtct

SEQ ID NO: 559324 - DNA, 23 bp, Homo sapiens
tcctgggccagggtctcgtcagg

SEQ ID NO: 559325 - DNA, 20 bp, Homo sapiens
tcctgggcttttgttttgct

SEQ ID NO: 559326 - DNA, 11 bp, Homo sapiens
tcctgggggcc

SEQ ID NO: 559327 - DNA, 17 bp, Homo sapiens
tcctgggggcctgacct

SEQ ID NO: 559328 - DNA, 17 bp, Homo sapiens
tcctggtttcctcagcc

SEQ ID NO: 559329 - DNA, 18 bp, Homo sapiens
tcctggtttcctcagcct

SEQ ID NO: 559330 - DNA, 14 bp, Homo sapiens
tcctgtcttatcct

SEQ ID NO: 559331 - DNA, 19 bp, Homo sapiens
tcctgtgctaagtctttcc

SEQ ID NO: 559332 - DNA, 19 bp, Homo sapiens
tcctgtggcctgccagtca

SEQ ID NO: 559333 - DNA, 17 bp, Homo sapiens
tccttaaaaatgtatgt

SEQ ID NO: 559334 - DNA, 16 bp, Homo sapiens
tccttagaaaagccat

SEQ ID NO: 559335 - DNA, 20 bp, Homo sapiens
tccttagaatactgtattgt

SEQ ID NO: 559336 - DNA, 15 bp, Homo sapiens
tccttatctagctgc

SEQ ID NO: 559337 - DNA, 19 bp, Homo sapiens
tccttcaacaaggcttgct

SEQ ID NO: 559338 - DNA, 21 bp, Homo sapiens
tccttcaacaaggcttgctgc

SEQ ID NO: 559339 - DNA, 15 bp, Homo sapiens
tccttcactccctgt

SEQ ID NO: 559340 - DNA, 13 bp, Homo sapiens
tccttcccagctg

SEQ ID NO: 559341 - DNA, 18 bp, Homo sapiens
tccttcccagctgcccct

SEQ ID NO: 559342 - DNA, 14 bp, Homo sapiens
tccttctacttaca

SEQ ID NO: 559343 - DNA, 20 bp, Homo sapiens
tccttctctcacctcctaaa

SEQ ID NO: 559344 - DNA, 16 bp, Homo sapiens
tccttgaggacctcca

SEQ ID NO: 559345 - DNA, 19 bp, Homo sapiens
tccttgaggacctccacct

SEQ ID NO: 559346 - DNA, 23 bp, Homo sapiens
tccttgaggacctccacctggga

SEQ ID NO: 559347 - DNA, 15 bp, Homo sapiens
tccttgccttcaaac

SEQ ID NO: 559348 - DNA, 17 bp, Homo sapiens
tcctttaccctcatctg

SEQ ID NO: 559349 - DNA, 13 bp, Homo sapiens
tcctttatgtatt

SEQ ID NO: 559350 - DNA, 19 bp, Homo sapiens
tcctttgtgagcctatgat

SEQ ID NO: 559351 - DNA, 19 bp, Homo sapiens
tcctttgtttttttttcct

SEQ ID NO: 559352 - DNA, 23 bp, Homo sapiens
tccttttccagagcattccagtc

SEQ ID NO: 559353 - DNA, 12 bp, Homo sapiens
tccttttgtgtt

SEQ ID NO: 559354 - DNA, 13 bp, Homo sapiens
tccttttgtgttc

SEQ ID NO: 559355 - DNA, 16 bp, Homo sapiens
tccttttgtgttccaa

SEQ ID NO: 559356 - DNA, 19 bp, Homo sapiens
tcgaaaattcatttcacat

SEQ ID NO: 559357 - DNA, 24 bp, Homo sapiens
tcgaaaattcatttcacattaatg

SEQ ID NO: 559358 - DNA, 22 bp, Homo sapiens
tcgacgcccgagttagcctcac

SEQ ID NO: 559359 - DNA, 16 bp, Homo sapiens
tcgagtggcccaacag

SEQ ID NO: 559360 - DNA, 18 bp, Homo sapiens
tcgcaagtcacagaaaat

SEQ ID NO: 559361 - DNA, 19 bp, Homo sapiens
tcgcaagtcacagaaaatg

SEQ ID NO: 559362 - DNA, 15 bp, Homo sapiens
tcgcacaatgtttga

SEQ ID NO: 559363 - DNA, 15 bp, Homo sapiens
tcgccccattttctt

SEQ ID NO: 559364 - DNA, 13 bp, Homo sapiens
tcgccctggcagg

SEQ ID NO: 559365 - DNA, 19 bp, Homo sapiens
tcgcctttcagcaggcagc

SEQ ID NO: 559366 - DNA, 22 bp, Homo sapiens
tcgctggatggcggaagctgct

SEQ ID NO: 559367 - DNA, 15 bp, Homo sapiens
tcgctggcccccact

SEQ ID NO: 559368 - DNA, 17 bp, Homo sapiens
tcgctggcccccactgg

SEQ ID NO: 559369 - DNA, 20 bp, Homo sapiens
tcggaacctgtgagctgcac

SEQ ID NO: 559370 - DNA, 13 bp, Homo sapiens
tcggcacagcctg

SEQ ID NO: 559371 - DNA, 12 bp, Homo sapiens
tcggccagagct

SEQ ID NO: 559372 - DNA, 12 bp, Homo sapiens
tcgggagtagca

SEQ ID NO: 559373 - DNA, 21 bp, Homo sapiens
tcggtaaaccgaggacccatg

SEQ ID NO: 559374 - DNA, 17 bp, Homo sapiens
tcggtgccatcagtgcc

SEQ ID NO: 559375 - DNA, 15 bp, Homo sapiens
tcggttaacaaataa

SEQ ID NO: 559376 - DNA, 11 bp, Homo sapiens
tcgtccccaga

SEQ ID NO: 559377 - DNA, 12 bp, Homo sapiens
tcgtccccagac

SEQ ID NO: 559378 - DNA, 15 bp, Homo sapiens
tcgtctttcccaaag

SEQ ID NO: 559379 - DNA, 14 bp, Homo sapiens
tcgtggattgtttt

SEQ ID NO: 559380 - DNA, 22 bp, Homo sapiens
tctaaaaataaaccaaaggaca

SEQ ID NO: 559381 - DNA, 15 bp, Homo sapiens
tctaaaactgtactt

SEQ ID NO: 559382 - DNA, 17 bp, Homo sapiens
tctaaactggtacaatt

SEQ ID NO: 559383 - DNA, 22 bp, Homo sapiens
tctaaaggtttcactgttcatg

SEQ ID NO: 559384 - DNA, 12 bp, Homo sapiens
tctaaatattat

SEQ ID NO: 559385 - DNA, 17 bp, Homo sapiens
tctaaattctttatttc

SEQ ID NO: 559386 - DNA, 19 bp, Homo sapiens
tctaacataagtaagactt

SEQ ID NO: 559387 - DNA, 17 bp, Homo sapiens
tctaaccacagctcctt

SEQ ID NO: 559388 - DNA, 19 bp, Homo sapiens
tctaaccacagctcctttt

SEQ ID NO: 559389 - DNA, 13 bp, Homo sapiens
tctaaccagtgat

SEQ ID NO: 559390 - DNA, 13 bp, Homo sapiens
tctaacctccttt

SEQ ID NO: 559391 - DNA, 23 bp, Homo sapiens
tctaagaaacattggaagcaggt

SEQ ID NO: 559392 - DNA, 16 bp, Homo sapiens
tctaagatgttatatt

SEQ ID NO: 559393 - DNA, 21 bp, Homo sapiens
tctaagatgttatatttttct

SEQ ID NO: 559394 - DNA, 23 bp, Homo sapiens
tctaagatgttatatttttctta

SEQ ID NO: 559395 - DNA, 23 bp, Homo sapiens
tctaagtagagtatattgaaaag

SEQ ID NO: 559396 - DNA, 13 bp, Homo sapiens
tctaatggtaact

SEQ ID NO: 559397 - DNA, 21 bp, Homo sapiens
tctaatggtaacttttgtagt

SEQ ID NO: 559398 - DNA, 18 bp, Homo sapiens
tctaatgtttaagcagaa

SEQ ID NO: 559399 - DNA, 20 bp, Homo sapiens
tctacaaaaaaaatcaaaaa

SEQ ID NO: 559400 - DNA, 22 bp, Homo sapiens
tctacaaggactccattggatc

SEQ ID NO: 559401 - DNA, 14 bp, Homo sapiens
tctaccaactttca

SEQ ID NO: 559402 - DNA, 22 bp, Homo sapiens
tctacccctcccggccctgcct

SEQ ID NO: 559403 - DNA, 14 bp, Homo sapiens
tctacccctttctt

SEQ ID NO: 559404 - DNA, 19 bp, Homo sapiens
tcaatcccaaaagtcacca

SEQ ID NO: 559405 - DNA, 14 bp, Homo sapiens
tcaatgtcttccca

SEQ ID NO: 559406 - DNA, 15 bp, Homo sapiens
tcaatgtcttcccac

SEQ ID NO: 559407 - DNA, 18 bp, Homo sapiens
tcaattcatagaataaca

SEQ ID NO: 559408 - DNA, 16 bp, Homo sapiens
tcaatttattgcacaa

SEQ ID NO: 559409 - DNA, 17 bp, Homo sapiens
tcaatttattgcacaaa

SEQ ID NO: 559410 - DNA, 15 bp, Homo sapiens
tcacaaatattaaaa

SEQ ID NO: 559411 - DNA, 21 bp, Homo sapiens
tcacaaatattaaaaagtctt

SEQ ID NO: 559412 - DNA, 23 bp, Homo sapiens
tcacaaatattaaaaagtctttt

SEQ ID NO: 559413 - DNA, 13 bp, Homo sapiens
tcacacctgcaga

SEQ ID NO: 559414 - DNA, 19 bp, Homo sapiens
tcacactctcttcttactg

SEQ ID NO: 559415 - DNA, 23 bp, Homo sapiens
tcacagaacctactgttcctttc

SEQ ID NO: 559416 - DNA, 17 bp, Homo sapiens
tcacatagctacccaaa

SEQ ID NO: 559417 - DNA, 14 bp, Homo sapiens
tcacatgttttcaa

SEQ ID NO: 559418 - DNA, 18 bp, Homo sapiens
tcacatgttttcaaatgg

SEQ ID NO: 559419 - DNA, 16 bp, Homo sapiens
tcacattaatggtcta

SEQ ID NO: 559420 - DNA, 18 bp, Homo sapiens
tcaccagctgctgctctg

SEQ ID NO: 559421 - DNA, 19 bp, Homo sapiens
tcaccagtgacctggaagg

SEQ ID NO: 559422 - DNA, 18 bp, Homo sapiens
tcaccatccaccttccct

SEQ ID NO: 559423 - DNA, 17 bp, Homo sapiens
tcacccctccacccttg

SEQ ID NO: 559424 - DNA, 21 bp, Homo sapiens
tcacccgatcgccagcaaaac

SEQ ID NO: 559425 - DNA, 17 bp, Homo sapiens
tcaccgtcacaataaaa

SEQ ID NO: 559426 - DNA, 16 bp, Homo sapiens
tcacctaattaatttc

SEQ ID NO: 559427 - DNA, 16 bp, Homo sapiens
tcactattcagaagac

SEQ ID NO: 559428 - DNA, 14 bp, Homo sapiens
tcactcagagcagt

SEQ ID NO: 559429 - DNA, 16 bp, Homo sapiens
tcactctaagatgtta

SEQ ID NO: 559430 - DNA, 14 bp, Homo sapiens
tcactgaacttttc

SEQ ID NO: 559431 - DNA, 14 bp, Homo sapiens
tcactgtctgtctg

SEQ ID NO: 559432 - DNA, 16 bp, Homo sapiens
tcactgttataaattt

SEQ ID NO: 559433 - DNA, 19 bp, Homo sapiens
tcactgttataaattttgt

SEQ ID NO: 559434 - DNA, 21 bp, Homo sapiens
tcactgttataaattttgtac

SEQ ID NO: 559435 - DNA, 14 bp, Homo sapiens
tcactgttcatgaa

SEQ ID NO: 559436 - DNA, 20 bp, Homo sapiens
tcacttacagaaccaattca

SEQ ID NO: 559437 - DNA, 23 bp, Homo sapiens
tcacttacagaaccaattcactt

SEQ ID NO: 559438 - DNA, 12 bp, Homo sapiens
tcacttctgaat

SEQ ID NO: 559439 - DNA, 13 bp, Homo sapiens
tcacttctttccc

SEQ ID NO: 559440 - DNA, 14 bp, Homo sapiens
tcacttctttccct

SEQ ID NO: 559441 - DNA, 22 bp, Homo sapiens
tcacttctttcccttcctccat

SEQ ID NO: 559442 - DNA, 16 bp, Homo sapiens
tcacttttattgtata

SEQ ID NO: 559443 - DNA, 14 bp, Homo sapiens
tcagaagtgaaaaa

SEQ ID NO: 559444 - DNA, 18 bp, Homo sapiens
tcagaagtgaaaaagact

SEQ ID NO: 559445 - DNA, 21 bp, Homo sapiens
tcagaatctttccttcctctc

SEQ ID NO: 559446 - DNA, 13 bp, Homo sapiens
tcagacacaaaca

SEQ ID NO: 559447 - DNA, 15 bp, Homo sapiens
tcagacacctagact

SEQ ID NO: 559448 - DNA, 19 bp, Homo sapiens
tcagacacctagactctaa

SEQ ID NO: 559449 - DNA, 16 bp, Homo sapiens
tcagaccaaggaacaa

SEQ ID NO: 559450 - DNA, 16 bp, Homo sapiens
tcagactgctttgaga

SEQ ID NO: 559451 - DNA, 18 bp, Homo sapiens
tcagagcacagccaatct

SEQ ID NO: 559452 - DNA, 18 bp, Homo sapiens
tcagaggcagagacctcc

SEQ ID NO: 559453 - DNA, 18 bp, Homo sapiens
tcagagtgaagagtgaag

SEQ ID NO: 559454 - DNA, 22 bp, Homo sapiens
tcagagtgaagagtgaagagca

SEQ ID NO: 559455 - DNA, 14 bp, Homo sapiens
tcagatcttctttt

SEQ ID NO: 559456 - DNA, 16 bp, Homo sapiens
tcagatttgcacaaaa

SEQ ID NO: 559457 - DNA, 19 bp, Homo sapiens
tcagatttgcacaaaaaga

SEQ ID NO: 559458 - DNA, 13 bp, Homo sapiens
tcagatttgtata

SEQ ID NO: 559459 - DNA, 20 bp, Homo sapiens
tcagcaaggcgctaacttgc

SEQ ID NO: 559460 - DNA, 12 bp, Homo sapiens
tcagcaggcagc

SEQ ID NO: 559461 - DNA, 15 bp, Homo sapiens
tcagcaggcagcctt

SEQ ID NO: 559462 - DNA, 17 bp, Homo sapiens
tcagcagtgagagcaga

SEQ ID NO: 559463 - DNA, 22 bp, Homo sapiens
tcagccggcgtggcaaatataa

SEQ ID NO: 559464 - DNA, 19 bp, Homo sapiens
tcagctacttaagagaaat

SEQ ID NO: 559465 - DNA, 22 bp, Homo sapiens
tcagctcagcattgtgtacaaa

SEQ ID NO: 559466 - DNA, 14 bp, Homo sapiens
tcagctgagccttc

SEQ ID NO: 559467 - DNA, 18 bp, Homo sapiens
tcagctgagccttctgag

SEQ ID NO: 559468 - DNA, 14 bp, Homo sapiens
tcaggaagaagaga

SEQ ID NO: 559469 - DNA, 20 bp, Homo sapiens
tcaggaagaagagatgcact

SEQ ID NO: 559470 - DNA, 20 bp, Homo sapiens
tcaggaagcctcctgctgag

SEQ ID NO: 559471 - DNA, 22 bp, Homo sapiens
tcaggaatatgcatcccacagc

SEQ ID NO: 559472 - DNA, 22 bp, Homo sapiens
tcaggaccctcgctggccccca

SEQ ID NO: 559473 - DNA, 18 bp, Homo sapiens
tcaggaggagacagtcag

SEQ ID NO: 559474 - DNA, 23 bp, Homo sapiens
tcaggaggagacagtcaggaagc

SEQ ID NO: 559475 - DNA, 14 bp, Homo sapiens
tcaggccacggcag

SEQ ID NO: 559476 - DNA, 18 bp, Homo sapiens
tcaggccgggcagagcac

SEQ ID NO: 559477 - DNA, 15 bp, Homo sapiens
tcaggctctctgggc

SEQ ID NO: 559478 - DNA, 17 bp, Homo sapiens
tcaggctctctgggctg

SEQ ID NO: 559479 - DNA, 16 bp, Homo sapiens
tcagggaagataagtt

SEQ ID NO: 559480 - DNA, 13 bp, Homo sapiens
tcaggtgaaaatg

SEQ ID NO: 559481 - DNA, 18 bp, Homo sapiens
tcaggtgaaaatgttcat

SEQ ID NO: 559482 - DNA, 21 bp, Homo sapiens
tcagtattaatactaaaatat

SEQ ID NO: 559483 - DNA, 19 bp, Homo sapiens
tcagtgcccatgtgtatgg

SEQ ID NO: 559484 - DNA, 18 bp, Homo sapiens
tcagtgttataaaatctg

SEQ ID NO: 559485 - DNA, 12 bp, Homo sapiens
tcagttcaaagt

SEQ ID NO: 559486 - DNA, 15 bp, Homo sapiens
tcagtttttcttaat

SEQ ID NO: 559487 - DNA, 15 bp, Homo sapiens
tcagtttttgttctt

SEQ ID NO: 559488 - DNA, 22 bp, Homo sapiens
tcataagttagatgttttagtt

SEQ ID NO: 559489 - DNA, 22 bp, Homo sapiens
tcatacacagaaatcctaacat

SEQ ID NO: 559490 - DNA, 23 bp, Homo sapiens
tcataccttctgatgaagttgta

SEQ ID NO: 559491 - DNA, 13 bp, Homo sapiens
tcatagaataaca

SEQ ID NO: 559492 - DNA, 23 bp, Homo sapiens
tcatatctgtatgcctcatttta

SEQ ID NO: 559493 - DNA, 21 bp, Homo sapiens
tcatattgctaccaaaaacta

SEQ ID NO: 559494 - DNA, 20 bp, Homo sapiens
tcatattttcctttatgtga

SEQ ID NO: 559495 - DNA, 18 bp, Homo sapiens
tcatcaacaaagaaatat

SEQ ID NO: 559496 - DNA, 12 bp, Homo sapiens
tcatcaattccc

SEQ ID NO: 559497 - DNA, 19 bp, Homo sapiens
tcatccccaaatgtgtctt

SEQ ID NO: 559498 - DNA, 17 bp, Homo sapiens
tcatcctgccttcatgg

SEQ ID NO: 559499 - DNA, 23 bp, Homo sapiens
tcatcctgccttcatggaactca

SEQ ID NO: 559500 - DNA, 13 bp, Homo sapiens
tcatccttcccac

SEQ ID NO: 559501 - DNA, 20 bp, Homo sapiens
tcatcctttcacttctttcc

SEQ ID NO: 559502 - DNA, 13 bp, Homo sapiens
tcatccttttctc

SEQ ID NO: 559503 - DNA, 19 bp, Homo sapiens
tcatcgaaaattcatttca

SEQ ID NO: 559504 - DNA, 17 bp, Homo sapiens
tcatctaccttttctct

SEQ ID NO: 559505 - DNA, 11 bp, Homo sapiens
tcatctgtaag

SEQ ID NO: 559506 - DNA, 16 bp, Homo sapiens
tcatctgtaagctgtt

SEQ ID NO: 559507 - DNA, 21 bp, Homo sapiens
tcatcttgacagagcctgccc

SEQ ID NO: 559508 - DNA, 14 bp, Homo sapiens
tcatcttttatcta

SEQ ID NO: 559509 - DNA, 18 bp, Homo sapiens
tcatgatgctctttccca

SEQ ID NO: 559510 - DNA, 23 bp, Homo sapiens
tcatgatgctctttcccacccag

SEQ ID NO: 559511 - DNA, 21 bp, Homo sapiens
tcatgatgtttttaaaatctt

SEQ ID NO: 559512 - DNA, 13 bp, Homo sapiens
tcatgctgcccct

SEQ ID NO: 559513 - DNA, 18 bp, Homo sapiens
tcatgctgcccctgcctt

SEQ ID NO: 559514 - DNA, 13 bp, Homo sapiens
tcatgctttaaag

SEQ ID NO: 559515 - DNA, 22 bp, Homo sapiens
tcatgctttaaagtgtaataat

SEQ ID NO: 559516 - DNA, 20 bp, Homo sapiens
tcatggaattggtttaaact

SEQ ID NO: 559517 - DNA, 19 bp, Homo sapiens
tcatgggagtcagggagcc

SEQ ID NO: 559518 - DNA, 22 bp, Homo sapiens
tcatgggagtcagggagccctg

SEQ ID NO: 559519 - DNA, 14 bp, Homo sapiens
tcatggtgcaattt

SEQ ID NO: 559520 - DNA, 19 bp, Homo sapiens
tcatggtgcaatttgtctt

SEQ ID NO: 559521 - DNA, 13 bp, Homo sapiens
tcatgtatttctt

SEQ ID NO: 559522 - DNA, 14 bp, Homo sapiens
tcatgtatttcttt

SEQ ID NO: 559523 - DNA, 18 bp, Homo sapiens
tcatgtcctgtgtcagtt

SEQ ID NO: 559524 - DNA, 19 bp, Homo sapiens
tcatgtcctgtgtcagttt

SEQ ID NO: 559525 - DNA, 19 bp, Homo sapiens
tcatgttcccacttcaaaa

SEQ ID NO: 559526 - DNA, 23 bp, Homo sapiens
tcattaaactaattaaactgatg

SEQ ID NO: 559527 - DNA, 22 bp, Homo sapiens
tcattaaccttatcataaattc

SEQ ID NO: 559528 - DNA, 17 bp, Homo sapiens
tcattagcaaaaaaagt

SEQ ID NO: 559529 - DNA, 23 bp, Homo sapiens
tcattcaccagtacattctcagt

SEQ ID NO: 559530 - DNA, 20 bp, Homo sapiens
tcattccctcgtctttccca

SEQ ID NO: 559531 - DNA, 23 bp, Homo sapiens
tcattctgcaatgagccatgagt

SEQ ID NO: 559532 - DNA, 23 bp, Homo sapiens
tcattgtgtatgagactgtgttt

SEQ ID NO: 559533 - DNA, 15 bp, Homo sapiens
tcattgttaaagtaa

SEQ ID NO: 559534 - DNA, 20 bp, Homo sapiens
tcattgtttgtcctttatgt

SEQ ID NO: 559535 - DNA, 20 bp, Homo sapiens
tcatttattttaaaaaatga

SEQ ID NO: 559536 - DNA, 18 bp, Homo sapiens
tcatttcatcctttcact

SEQ ID NO: 559537 - DNA, 20 bp, Homo sapiens
tcatttcatgtcctgtgtca

SEQ ID NO: 559538 - DNA, 19 bp, Homo sapiens
tcagcatatatataaaata

SEQ ID NO: 559539 - DNA, 18 bp, Homo sapiens
tcagcatgtctcagattg

SEQ ID NO: 559540 - DNA, 21 bp, Homo sapiens
tcagccagaagccacccaaag

SEQ ID NO: 559541 - DNA, 21 bp, Homo sapiens
tcagcccaatccctgatccct

SEQ ID NO: 559542 - DNA, 21 bp, Homo sapiens
tcagcccctgctgctcctcgg

SEQ ID NO: 559543 - DNA, 19 bp, Homo sapiens
tcagctaggaacaaatctt

SEQ ID NO: 559544 - DNA, 23 bp, Homo sapiens
tcagctcaattgttaatgtgatg

SEQ ID NO: 559545 - DNA, 14 bp, Homo sapiens
tcagctctctgtat

SEQ ID NO: 559546 - DNA, 12 bp, Homo sapiens
tcagctgagcct

SEQ ID NO: 559547 - DNA, 17 bp, Homo sapiens
tcagctgtctgtggctt

SEQ ID NO: 559548 - DNA, 18 bp, Homo sapiens
tcaggaaatatctgtgaa

SEQ ID NO: 559549 - DNA, 13 bp, Homo sapiens
tcaggaacactct

SEQ ID NO: 559550 - DNA, 18 bp, Homo sapiens
tcaggaagcctcctgctg

SEQ ID NO: 559551 - DNA, 23 bp, Homo sapiens
tcaggaatatgcatcccacagcc

SEQ ID NO: 559552 - DNA, 15 bp, Homo sapiens
tcaggaccccatctg

SEQ ID NO: 559553 - DNA, 19 bp, Homo sapiens
tcaggaccccatctgctga

SEQ ID NO: 559554 - DNA, 20 bp, Homo sapiens
tcaggaccccatctgctgag

SEQ ID NO: 559555 - DNA, 21 bp, Homo sapiens
tcaggaccccatctgctgagc

SEQ ID NO: 559556 - DNA, 23 bp, Homo sapiens
tcaggaccccatctgctgagctc

SEQ ID NO: 559557 - DNA, 19 bp, Homo sapiens
tcaggaccctcgctggccc

SEQ ID NO: 559558 - DNA, 21 bp, Homo sapiens
tcaggaccctcgctggccccc

SEQ ID NO: 559559 - DNA, 15 bp, Homo sapiens
tcaggagaaacccct

SEQ ID NO: 559560 - DNA, 19 bp, Homo sapiens
tcaggaggagacagtcagg

SEQ ID NO: 559561 - DNA, 13 bp, Homo sapiens
tcaggaggcagtg

SEQ ID NO: 559562 - DNA, 20 bp, Homo sapiens
tcaggaggcagtggcttgga

SEQ ID NO: 559563 - DNA, 15 bp, Homo sapiens
tcaggaggtgcctga

SEQ ID NO: 559564 - DNA, 22 bp, Homo sapiens
tcaggaggtgcctgagagcaga

SEQ ID NO: 559565 - DNA, 23 bp, Homo sapiens
tcaggcaggcacctagcaattcc

SEQ ID NO: 559566 - DNA, 22 bp, Homo sapiens
tcaggcatttttgtaatgagcc

SEQ ID NO: 559567 - DNA, 16 bp, Homo sapiens
tcaggccacggcagcc

SEQ ID NO: 559568 - DNA, 19 bp, Homo sapiens
tcaggcccacattgcccac

SEQ ID NO: 559569 - DNA, 14 bp, Homo sapiens
tcagggagccctgg

SEQ ID NO: 559570 - DNA, 12 bp, Homo sapiens
tcagggggccag

SEQ ID NO: 559571 - DNA, 16 bp, Homo sapiens
tcaggtcctgctcagc

SEQ ID NO: 559572 - DNA, 16 bp, Homo sapiens
tcagtgcccatgtgta

SEQ ID NO: 559573 - DNA, 18 bp, Homo sapiens
tcagtgcccatgtgtatg

SEQ ID NO: 559574 - DNA, 17 bp, Homo sapiens
tcagtgctagcttattt

SEQ ID NO: 559575 - DNA, 20 bp, Homo sapiens
tcagtgtactctgagtcctc

SEQ ID NO: 559576 - DNA, 15 bp, Homo sapiens
tcagtgttataaaat

SEQ ID NO: 559577 - DNA, 15 bp, Homo sapiens
tcagtgtttctgggg

SEQ ID NO: 559578 - DNA, 13 bp, Homo sapiens
tcagttacagtgg

SEQ ID NO: 559579 - DNA, 14 bp, Homo sapiens
tcagttacagtggc

SEQ ID NO: 559580 - DNA, 22 bp, Homo sapiens
tcagttaggattaggtttagaa

SEQ ID NO: 559581 - DNA, 17 bp, Homo sapiens
tcagttatcctttgtga

SEQ ID NO: 559582 - DNA, 13 bp, Homo sapiens
tcagttcaaagtc

SEQ ID NO: 559583 - DNA, 21 bp, Homo sapiens
tcagttcaaagtcatgatgtt

SEQ ID NO: 559584 - DNA, 15 bp, Homo sapiens
tcagtttatgttttg

SEQ ID NO: 559585 - DNA, 18 bp, Homo sapiens
tcagtttttgttcttaaa

SEQ ID NO: 559586 - DNA, 19 bp, Homo sapiens
tcagtttttgttcttaaaa

SEQ ID NO: 559587 - DNA, 13 bp, Homo sapiens
tcataagcacact

SEQ ID NO: 559588 - DNA, 11 bp, Homo sapiens
tcatacacaga

SEQ ID NO: 559589 - DNA, 14 bp, Homo sapiens
tcatacacagaaat

SEQ ID NO: 559590 - DNA, 22 bp, Homo sapiens
tcatacagtggtattgctagtt

SEQ ID NO: 559591 - DNA, 14 bp, Homo sapiens
tcatagataccatt

SEQ ID NO: 559592 - DNA, 15 bp, Homo sapiens
tcatagataccattt

SEQ ID NO: 559593 - DNA, 20 bp, Homo sapiens
tcatatcctctcgttcagtt

SEQ ID NO: 559594 - DNA, 13 bp, Homo sapiens
tcatattacaata

SEQ ID NO: 559595 - DNA, 18 bp, Homo sapiens
tcatattagacttctgtt

SEQ ID NO: 559596 - DNA, 20 bp, Homo sapiens
tcatattagacttctgtttt

SEQ ID NO: 559597 - DNA, 22 bp, Homo sapiens
tcatattcataccttctgatga

SEQ ID NO: 559598 - DNA, 13 bp, Homo sapiens
tcatattctcaga

SEQ ID NO: 559599 - DNA, 21 bp, Homo sapiens
tcatattggtatatccttttc

SEQ ID NO: 559600 - DNA, 16 bp, Homo sapiens
tcatattttaatttca

SEQ ID NO: 559601 - DNA, 15 bp, Homo sapiens
tcatcaattcccatt

SEQ ID NO: 559602 - DNA, 22 bp, Homo sapiens
tcatcagaagtggtaggaaagc

SEQ ID NO: 559603 - DNA, 13 bp, Homo sapiens
tcatcccagcccc

SEQ ID NO: 559604 - DNA, 14 bp, Homo sapiens
tcatcccagcccca

SEQ ID NO: 559605 - DNA, 14 bp, Homo sapiens
tcatccccagtccc

SEQ ID NO: 559606 - DNA, 21 bp, Homo sapiens
tcatcccgacctcttagaaaa

SEQ ID NO: 559607 - DNA, 18 bp, Homo sapiens
tcatcccggggccatgga

SEQ ID NO: 559608 - DNA, 22 bp, Homo sapiens
tcatcctttcacttctttccct

SEQ ID NO: 559609 - DNA, 23 bp, Homo sapiens
tcatcctttcacttctttccctt

SEQ ID NO: 559610 - DNA, 14 bp, Homo sapiens
tcatccttttctcc

SEQ ID NO: 559611 - DNA, 19 bp, Homo sapiens
tcatccttttctcctatct

SEQ ID NO: 559612 - DNA, 23 bp, Homo sapiens
tcatctgagagaggctaaaatgt

SEQ ID NO: 559613 - DNA, 20 bp, Homo sapiens
tcatgaaatgctatgtcatt

SEQ ID NO: 559614 - DNA, 15 bp, Homo sapiens
tcatgaacagctctg

SEQ ID NO: 559615 - DNA, 16 bp, Homo sapiens
tcatgaacagctctga

SEQ ID NO: 559616 - DNA, 16 bp, Homo sapiens
tcatgatgctctttcc

SEQ ID NO: 559617 - DNA, 13 bp, Homo sapiens
tcatgatgttttt

SEQ ID NO: 559618 - DNA, 17 bp, Homo sapiens
tcatgcgcagtccccag

SEQ ID NO: 559619 - DNA, 19 bp, Homo sapiens
tcatgctcccctgtgccag

SEQ ID NO: 559620 - DNA, 20 bp, Homo sapiens
tcatgctttaaagtgtaata

SEQ ID NO: 559621 - DNA, 18 bp, Homo sapiens
tcatgggagtcagggagc

SEQ ID NO: 559622 - DNA, 18 bp, Homo sapiens
tcatggtgcaatttgtct

SEQ ID NO: 559623 - DNA, 15 bp, Homo sapiens
tcatgtatttcttta

SEQ ID NO: 559624 - DNA, 16 bp, Homo sapiens
tcatgtcctgtgtcag

SEQ ID NO: 559625 - DNA, 12 bp, Homo sapiens
tcatgttgatgt

SEQ ID NO: 559626 - DNA, 15 bp, Homo sapiens
tcatgttttatatga

SEQ ID NO: 559627 - DNA, 12 bp, Homo sapiens
tcattagcaaaa

SEQ ID NO: 559628 - DNA, 17 bp, Homo sapiens
tcattagctgtgatttt

SEQ ID NO: 559629 - DNA, 12 bp, Homo sapiens
tcattcatatta

SEQ ID NO: 559630 - DNA, 15 bp, Homo sapiens
tcattcatattacaa

SEQ ID NO: 559631 - DNA, 18 bp, Homo sapiens
tcattcgggccccacctg

SEQ ID NO: 559632 - DNA, 14 bp, Homo sapiens
tcattgcttcttct

SEQ ID NO: 559633 - DNA, 22 bp, Homo sapiens
tcattgggccatgtttaagtgt

SEQ ID NO: 559634 - DNA, 14 bp, Homo sapiens
tcattgtgttttct

SEQ ID NO: 559635 - DNA, 19 bp, Homo sapiens
tcattgtgttttcttcgtg

SEQ ID NO: 559636 - DNA, 21 bp, Homo sapiens
tcattgtgttttcttcgtgga

SEQ ID NO: 559637 - DNA, 21 bp, Homo sapiens
tcatttaacactgagtgaaat

SEQ ID NO: 559638 - DNA, 19 bp, Homo sapiens
tcatttcacattaatggtc

SEQ ID NO: 559639 - DNA, 15 bp, Homo sapiens
tcatttcatgtcctg

SEQ ID NO: 559640 - DNA, 23 bp, Homo sapiens
tcatttcatgtcctgtgtcagtt

SEQ ID NO: 559641 - DNA, 21 bp, Homo sapiens
tcatttccatgtatgcataat

SEQ ID NO: 559642 - DNA, 13 bp, Homo sapiens
tcatttctaaaag

SEQ ID NO: 559643 - DNA, 23 bp, Homo sapiens
tcatttgtgtcagcatgtctcag

SEQ ID NO: 559644 - DNA, 14 bp, Homo sapiens
tcattttacagtta

SEQ ID NO: 559645 - DNA, 19 bp, Homo sapiens
tcattttacagttactttt

SEQ ID NO: 559646 - DNA, 18 bp, Homo sapiens
tccaaacttaacagatca

SEQ ID NO: 559647 - DNA, 16 bp, Homo sapiens
tccaaggacagaaggc

SEQ ID NO: 559648 - DNA, 23 bp, Homo sapiens
tccaaggacagaaggctcctgcc

SEQ ID NO: 559649 - DNA, 13 bp, Homo sapiens
tccaagggcccag

SEQ ID NO: 559650 - DNA, 14 bp, Homo sapiens
tccaagtcactgca

SEQ ID NO: 559651 - DNA, 15 bp, Homo sapiens
tccaataattgactg

SEQ ID NO: 559652 - DNA, 13 bp, Homo sapiens
tccaattctcctt

SEQ ID NO: 559653 - DNA, 15 bp, Homo sapiens
tccaattctccttta

SEQ ID NO: 559654 - DNA, 14 bp, Homo sapiens
tccacacacacaaa

SEQ ID NO: 559655 - DNA, 18 bp, Homo sapiens
tccacacacacaaaaaaa

SEQ ID NO: 559656 - DNA, 22 bp, Homo sapiens
tccacacaggcccatgccctcc

SEQ ID NO: 559657 - DNA, 15 bp, Homo sapiens
tccacagttatctta

SEQ ID NO: 559658 - DNA, 19 bp, Homo sapiens
tccacagttatcttagctg

SEQ ID NO: 559659 - DNA, 18 bp, Homo sapiens
tccacctgcacaaacata

SEQ ID NO: 559660 - DNA, 14 bp, Homo sapiens
tccacctgctctgc

SEQ ID NO: 559661 - DNA, 23 bp, Homo sapiens
tccacctgggagatgctgggacc

SEQ ID NO: 559662 - DNA, 17 bp, Homo sapiens
tccactggggtggcctg

SEQ ID NO: 559663 - DNA, 16 bp, Homo sapiens
tccacttcccttagaa

SEQ ID NO: 559664 - DNA, 12 bp, Homo sapiens
tccactttgtat

SEQ ID NO: 559665 - DNA, 17 bp, Homo sapiens
tccactttgtataaatt

SEQ ID NO: 559666 - DNA, 18 bp, Homo sapiens
tccacttttccagtattt

SEQ ID NO: 559667 - DNA, 13 bp, Homo sapiens
aaaaaaaaatatg

SEQ ID NO: 559668 - DNA, 13 bp, Homo sapiens
aaaaaaaatatga

SEQ ID NO: 559669 - DNA, 14 bp, Homo sapiens
aaaaaaatatgaga

SEQ ID NO: 559670 - DNA, 12 bp, Homo sapiens
aaaaaagaaagt

SEQ ID NO: 559671 - DNA, 22 bp, Homo sapiens
aaaaaccgtgtttgtctcttct

SEQ ID NO: 559672 - DNA, 18 bp, Homo sapiens
aaaaactcaaccaaatgg

SEQ ID NO: 559673 - DNA, 14 bp, Homo sapiens
aaattgatgttgat

SEQ ID NO: 559674 - DNA, 18 bp, Homo sapiens
aaattgatgttgatgcaa

SEQ ID NO: 559675 - DNA, 19 bp, Homo sapiens
aaattgtcacctgcttctc

SEQ ID NO: 559676 - DNA, 18 bp, Homo sapiens
aaattgtcttttgtcatg

SEQ ID NO: 559677 - DNA, 14 bp, Homo sapiens
aaattgtggatgaa

SEQ ID NO: 559678 - DNA, 16 bp, Homo sapiens
aaatttattgaggaaa

SEQ ID NO: 559679 - DNA, 19 bp, Homo sapiens
aaatttattgaggaaaaat

SEQ ID NO: 559680 - DNA, 16 bp, Homo sapiens
aaatttcaaaagacat

SEQ ID NO: 559681 - DNA, 14 bp, Homo sapiens
aaatttgaaacatt

SEQ ID NO: 559682 - DNA, 11 bp, Homo sapiens
aaattttgtac

SEQ ID NO: 559683 - DNA, 15 bp, Homo sapiens
aaattttgtacattt

SEQ ID NO: 559684 - DNA, 16 bp, Homo sapiens
aaattttgtacatttt

SEQ ID NO: 559685 - DNA, 13 bp, Homo sapiens
aaatttttcatat

SEQ ID NO: 559686 - DNA, 14 bp, Homo sapiens
aaatttttcatatt

SEQ ID NO: 559687 - DNA, 21 bp, Homo sapiens
aacaaacatggatacttcctg

SEQ ID NO: 559688 - DNA, 21 bp, Homo sapiens
aacaaactgcacatgatttca

SEQ ID NO: 559689 - DNA, 22 bp, Homo sapiens
aacaaagcatttgactttctgt

SEQ ID NO: 559690 - DNA, 13 bp, Homo sapiens
aacaaatcttcct

SEQ ID NO: 559691 - DNA, 14 bp, Homo sapiens
aacaaatcttcctg

SEQ ID NO: 559692 - DNA, 16 bp, Homo sapiens
aacaacataaaattaa

SEQ ID NO: 559693 - DNA, 15 bp, Homo sapiens
aacaacttttttttc

SEQ ID NO: 559694 - DNA, 17 bp, Homo sapiens
aacaagatcattatctt

SEQ ID NO: 559695 - DNA, 16 bp, Homo sapiens
aacaagcatataaaat

SEQ ID NO: 559696 - DNA, 14 bp, Homo sapiens
aacaagctaggtgc

SEQ ID NO: 559697 - DNA, 16 bp, Homo sapiens
aacaaggcttgctgca

SEQ ID NO: 559698 - DNA, 19 bp, Homo sapiens
aacaaggggctgttacata

SEQ ID NO: 559699 - DNA, 17 bp, Homo sapiens
aacaataaaacattatg

SEQ ID NO: 559700 - DNA, 20 bp, Homo sapiens
aacaattcaaagaatcacct

SEQ ID NO: 559701 - DNA, 14 bp, Homo sapiens
aacaattttcagat

SEQ ID NO: 559702 - DNA, 13 bp, Homo sapiens
aacacagattatt

SEQ ID NO: 559703 - DNA, 16 bp, Homo sapiens
aacacatgcacacaca

SEQ ID NO: 559704 - DNA, 22 bp, Homo sapiens
aacaccaaaaaaatccagaaac

SEQ ID NO: 559705 - DNA, 13 bp, Homo sapiens
aacacccagcccc

SEQ ID NO: 559706 - DNA, 15 bp, Homo sapiens
aacacccagccccag

SEQ ID NO: 559707 - DNA, 17 bp, Homo sapiens
aacaccttcatccagat

SEQ ID NO: 559708 - DNA, 13 bp, Homo sapiens
aacactaaatgtt

SEQ ID NO: 559709 - DNA, 18 bp, Homo sapiens
aacactaaatgttaaaga

SEQ ID NO: 559710 - DNA, 21 bp, Homo sapiens
aacactaaatgttaaagatgt

SEQ ID NO: 559711 - DNA, 22 bp, Homo sapiens
aacactaaatgttaaagatgta

SEQ ID NO: 559712 - DNA, 17 bp, Homo sapiens
aacactttgctaggaga

SEQ ID NO: 559713 - DNA, 14 bp, Homo sapiens
aacagaaattggta

SEQ ID NO: 559714 - DNA, 22 bp, Homo sapiens
aacagataccatactcatttct

SEQ ID NO: 559715 - DNA, 16 bp, Homo sapiens
aacagattggatttta

SEQ ID NO: 559716 - DNA, 17 bp, Homo sapiens
aacagattggattttat

SEQ ID NO: 559717 - DNA, 18 bp, Homo sapiens
aacagatttaagcaagac

SEQ ID NO: 559718 - DNA, 21 bp, Homo sapiens
aacagatttaagcaagaccat

SEQ ID NO: 559719 - DNA, 17 bp, Homo sapiens
aacagcaaattaatgtg

SEQ ID NO: 559720 - DNA, 22 bp, Homo sapiens
aacagcaaattaatgtgtaaaa

SEQ ID NO: 559721 - DNA, 18 bp, Homo sapiens
aacagcattggcctggcc

SEQ ID NO: 559722 - DNA, 16 bp, Homo sapiens
aacagctctgagatcc

SEQ ID NO: 559723 - DNA, 14 bp, Homo sapiens
aacagctggacacc

SEQ ID NO: 559724 - DNA, 21 bp, Homo sapiens
aacagctggacacccccttgg

SEQ ID NO: 559725 - DNA, 22 bp, Homo sapiens
aacagctggacacccccttggt

SEQ ID NO: 559726 - DNA, 23 bp, Homo sapiens
aacagctggacacccccttggtg

SEQ ID NO: 559727 - DNA, 17 bp, Homo sapiens
aacagtaactgccattt

SEQ ID NO: 559728 - DNA, 15 bp, Homo sapiens
aacagtattttaaga

SEQ ID NO: 559729 - DNA, 16 bp, Homo sapiens
aacagtgtttacttta

SEQ ID NO: 559730 - DNA, 12 bp, Homo sapiens
aacagtttaaaa

SEQ ID NO: 559731 - DNA, 22 bp, Homo sapiens
aacagtttaaaaaaaaagttgg

SEQ ID NO: 559732 - DNA, 12 bp, Homo sapiens
aacataaaatta

SEQ ID NO: 559733 - DNA, 16 bp, Homo sapiens
aacatacaatttactt

SEQ ID NO: 559734 - DNA, 18 bp, Homo sapiens
aacatacaatttactttt

SEQ ID NO: 559735 - DNA, 23 bp, Homo sapiens
aacatacaatttacttttaataa

SEQ ID NO: 559736 - DNA, 14 bp, Homo sapiens
aacatgtgatgtgt

SEQ ID NO: 559737 - DNA, 15 bp, Homo sapiens
aacatgtgatgtgtt

SEQ ID NO: 559738 - DNA, 12 bp, Homo sapiens
aacattaatgtt

SEQ ID NO: 559739 - DNA, 20 bp, Homo sapiens
aacattaatgttgatttcta

SEQ ID NO: 559740 - DNA, 16 bp, Homo sapiens
aacattccctggaatt

SEQ ID NO: 559741 - DNA, 17 bp, Homo sapiens
aacattccctggaattg

SEQ ID NO: 559742 - DNA, 14 bp, Homo sapiens
aacattctatttca

SEQ ID NO: 559743 - DNA, 15 bp, Homo sapiens
aacattgcttttaaa

SEQ ID NO: 559744 - DNA, 13 bp, Homo sapiens
aacattgtatgtt

SEQ ID NO: 559745 - DNA, 14 bp, Homo sapiens
aacatttccttttt

SEQ ID NO: 559746 - DNA, 22 bp, Homo sapiens
aacatttctaactctgatgtaa

SEQ ID NO: 559747 - DNA, 16 bp, Homo sapiens
aaccaaaggacattat

SEQ ID NO: 559748 - DNA, 18 bp, Homo sapiens
aaccaaaggacattatgt

SEQ ID NO: 559749 - DNA, 19 bp, Homo sapiens
aaccaagctataaaagccc

SEQ ID NO: 559750 - DNA, 22 bp, Homo sapiens
aaccaaggtagaatgaccttgt

SEQ ID NO: 559751 - DNA, 12 bp, Homo sapiens
aaccaatttctt

SEQ ID NO: 559752 - DNA, 19 bp, Homo sapiens
aaccacagctccttttcca

SEQ ID NO: 559753 - DNA, 22 bp, Homo sapiens
aaccacagtgtaccattaaaat

SEQ ID NO: 559754 - DNA, 12 bp, Homo sapiens
aaccagacacaa

SEQ ID NO: 559755 - DNA, 14 bp, Homo sapiens
aacccaaacctgga

SEQ ID NO: 559756 - DNA, 16 bp, Homo sapiens
aacccaaacctggaga

SEQ ID NO: 559757 - DNA, 15 bp, Homo sapiens
aacccaaggcaatga

SEQ ID NO: 559758 - DNA, 23 bp, Homo sapiens
aacccatgagtgctaagagcctc

SEQ ID NO: 559759 - DNA, 12 bp, Homo sapiens
aacccccagctc

SEQ ID NO: 559760 - DNA, 19 bp, Homo sapiens
aacccctgacaccttttca

SEQ ID NO: 559761 - DNA, 19 bp, Homo sapiens
aaccctatgccttttgtag

SEQ ID NO: 559762 - DNA, 18 bp, Homo sapiens
aacctaaaagtattattc

SEQ ID NO: 559763 - DNA, 19 bp, Homo sapiens
aacctcctttaccctcatc

SEQ ID NO: 559764 - DNA, 17 bp, Homo sapiens
aacctcttagcttttct

SEQ ID NO: 559765 - DNA, 20 bp, Homo sapiens
aaagatcaaaataaaaagtg

SEQ ID NO: 559766 - DNA, 20 bp, Homo sapiens
aaagatctttttttaagtgt

SEQ ID NO: 559767 - DNA, 12 bp, Homo sapiens
aaagatgtagca

SEQ ID NO: 559768 - DNA, 14 bp, Homo sapiens
aaagatgtagcaaa

SEQ ID NO: 559769 - DNA, 14 bp, Homo sapiens
aaagatgttaacag

SEQ ID NO: 559770 - DNA, 18 bp, Homo sapiens
aaagcaaaatatttgtga

SEQ ID NO: 559771 - DNA, 23 bp, Homo sapiens
aaagcacatgcttagcttatctt

SEQ ID NO: 559772 - DNA, 22 bp, Homo sapiens
aaagcactcctccctgatgtac

SEQ ID NO: 559773 - DNA, 18 bp, Homo sapiens
aaagcagagtgaaattca

SEQ ID NO: 559774 - DNA, 19 bp, Homo sapiens
aaagcagagtgaaattcaa

SEQ ID NO: 559775 - DNA, 20 bp, Homo sapiens
aaagcagagtgaaattcaat

SEQ ID NO: 559776 - DNA, 21 bp, Homo sapiens
aaagcagagtgaaattcaatt

SEQ ID NO: 559777 - DNA, 17 bp, Homo sapiens
aaagcatgccaatttct

SEQ ID NO: 559778 - DNA, 12 bp, Homo sapiens
aaagccctccct

SEQ ID NO: 559779 - DNA, 17 bp, Homo sapiens
aaagctgctgcacagct

SEQ ID NO: 559780 - DNA, 13 bp, Homo sapiens
aaagctgttcttc

SEQ ID NO: 559781 - DNA, 14 bp, Homo sapiens
aaagctgttcttcc

SEQ ID NO: 559782 - DNA, 19 bp, Homo sapiens
aagcaactaggccttcagt

SEQ ID NO: 559783 - DNA, 16 bp, Homo sapiens
aagcacagacaattct

SEQ ID NO: 559784 - DNA, 20 bp, Homo sapiens
aagcacagacaattctaatg

SEQ ID NO: 559785 - DNA, 18 bp, Homo sapiens
aagcacctcttgaagaac

SEQ ID NO: 559786 - DNA, 19 bp, Homo sapiens
aagcacctcttgaagaact

SEQ ID NO: 559787 - DNA, 23 bp, Homo sapiens
aagcactcctccctgatgtacag

SEQ ID NO: 559788 - DNA, 14 bp, Homo sapiens
aagcagaattggaa

SEQ ID NO: 559789 - DNA, 16 bp, Homo sapiens
aagcagaattggaaaa

SEQ ID NO: 559790 - DNA, 14 bp, Homo sapiens
aagcagacacacac

SEQ ID NO: 559791 - DNA, 16 bp, Homo sapiens
aagcagacacacacat

SEQ ID NO: 559792 - DNA, 17 bp, Homo sapiens
aagcagacacacacata

SEQ ID NO: 559793 - DNA, 19 bp, Homo sapiens
aagcagagtcaagctgatg

SEQ ID NO: 559794 - DNA, 13 bp, Homo sapiens
aagcagcagctag

SEQ ID NO: 559795 - DNA, 18 bp, Homo sapiens
aagcagcagctagaaaga

SEQ ID NO: 559796 - DNA, 19 bp, Homo sapiens
aagcagcagctagaaagag

SEQ ID NO: 559797 - DNA, 19 bp, Homo sapiens
aagcagtttcaataaagtt

SEQ ID NO: 559798 - DNA, 20 bp, Homo sapiens
aagcagtttcaataaagttt

SEQ ID NO: 559799 - DNA, 14 bp, Homo sapiens
aagcatataaaatg

SEQ ID NO: 559800 - DNA, 15 bp, Homo sapiens
aagcatataaaatgg

SEQ ID NO: 559801 - DNA, 12 bp, Homo sapiens
aagcatctaaac

SEQ ID NO: 559802 - DNA, 17 bp, Homo sapiens
aagcatctaaactttaa

SEQ ID NO: 559803 - DNA, 16 bp, Homo sapiens
aagcatgccaatttct

SEQ ID NO: 559804 - DNA, 19 bp, Homo sapiens
aagcatgccaatttctctt

SEQ ID NO: 559805 - DNA, 13 bp, Homo sapiens
aagccacatagag

SEQ ID NO: 559806 - DNA, 16 bp, Homo sapiens
aagccaccgggagatt

SEQ ID NO: 559807 - DNA, 23 bp, Homo sapiens
aagcctcatgggagtcagggagc

SEQ ID NO: 559808 - DNA, 15 bp, Homo sapiens
aagcctcctgctgag

SEQ ID NO: 559809 - DNA, 14 bp, Homo sapiens
aagctaaaacactt

SEQ ID NO: 559810 - DNA, 17 bp, Homo sapiens
aagctaaaatgaaaaat

SEQ ID NO: 559811 - DNA, 19 bp, Homo sapiens
aagctgaggaggtgctgca

SEQ ID NO: 559812 - DNA, 22 bp, Homo sapiens
aagctgagttaggtgtctgtcc

SEQ ID NO: 559813 - DNA, 16 bp, Homo sapiens
aagctgctgcacagct

SEQ ID NO: 559814 - DNA, 12 bp, Homo sapiens
aagctggcagga

SEQ ID NO: 559815 - DNA, 15 bp, Homo sapiens
aagctggcaggagac

SEQ ID NO: 559816 - DNA, 15 bp, Homo sapiens
aagctgttcttcctg

SEQ ID NO: 559817 - DNA, 16 bp, Homo sapiens
aagctgttcttcctgg

SEQ ID NO: 559818 - DNA, 21 bp, Homo sapiens
aagctgtttggttttaaaata

SEQ ID NO: 559819 - DNA, 23 bp, Homo sapiens
aagcttcctttgtttttttttcc

SEQ ID NO: 559820 - DNA, 19 bp, Homo sapiens
aaggaattttgctaagtaa

SEQ ID NO: 559821 - DNA, 17 bp, Homo sapiens
aaggactagacgcatat

SEQ ID NO: 559822 - DNA, 22 bp, Homo sapiens
aaggacttcctgattggtttct

SEQ ID NO: 559823 - DNA, 24 bp, Homo sapiens
aaggacttcctgctacagtagctg

SEQ ID NO: 559824 - DNA, 14 bp, Homo sapiens
aaggacttggtgat

SEQ ID NO: 559825 - DNA, 12 bp, Homo sapiens
aaggagaaatga

SEQ ID NO: 559826 - DNA, 14 bp, Homo sapiens
aaggagctttctca

SEQ ID NO: 559827 - DNA, 14 bp, Homo sapiens
aaggcaaaaacaaa

SEQ ID NO: 559828 - DNA, 18 bp, Homo sapiens
aaggcagctgttgtctct

SEQ ID NO: 559829 - DNA, 22 bp, Homo sapiens
aaggcagctgttgtctcttctc

SEQ ID NO: 559830 - DNA, 21 bp, Homo sapiens
aaggccaacagcattggcctg

SEQ ID NO: 559831 - DNA, 18 bp, Homo sapiens
aaggcgctaacttgctta

SEQ ID NO: 559832 - DNA, 13 bp, Homo sapiens
aaggctgccaggg

SEQ ID NO: 559833 - DNA, 20 bp, Homo sapiens
aaggcttaggcctatagatt

SEQ ID NO: 559834 - DNA, 23 bp, Homo sapiens
aaggcttcaatttattgcacaaa

SEQ ID NO: 559835 - DNA, 15 bp, Homo sapiens
aaggcttgctgcaga

SEQ ID NO: 559836 - DNA, 18 bp, Homo sapiens
aagggactccagaagcag

SEQ ID NO: 559837 - DNA, 20 bp, Homo sapiens
aagggagaataaaattccta

SEQ ID NO: 559838 - DNA, 23 bp, Homo sapiens
aagggagaataaaattcctatct

SEQ ID NO: 559839 - DNA, 18 bp, Homo sapiens
aagggagctggctccagc

SEQ ID NO: 559840 - DNA, 21 bp, Homo sapiens
aaggggaatctggaggtagcc

SEQ ID NO: 559841 - DNA, 21 bp, Homo sapiens
aaggtacgagtagaggtttaa

SEQ ID NO: 559842 - DNA, 19 bp, Homo sapiens
aaggtagaatgaccttgta

SEQ ID NO: 559843 - DNA, 15 bp, Homo sapiens
aaggtctctctggct

SEQ ID NO: 559844 - DNA, 18 bp, Homo sapiens
aaggtctctctggctcta

SEQ ID NO: 559845 - DNA, 21 bp, Homo sapiens
aaggtctgtggctcctcccga

SEQ ID NO: 559846 - DNA, 17 bp, Homo sapiens
aagtaaactaatgagtt

SEQ ID NO: 559847 - DNA, 23 bp, Homo sapiens
aagtaatataatggaagagaaat

SEQ ID NO: 559848 - DNA, 17 bp, Homo sapiens
aagtagagtatattgaa

SEQ ID NO: 559849 - DNA, 21 bp, Homo sapiens
aagtagcaaatgagacagcag

SEQ ID NO: 559850 - DNA, 22 bp, Homo sapiens
aagtatccctgatttattctgg

SEQ ID NO: 559851 - DNA, 16 bp, Homo sapiens
aagtattattcaaacc

SEQ ID NO: 559852 - DNA, 19 bp, Homo sapiens
aagtcaccactccattccc

SEQ ID NO: 559853 - DNA, 18 bp, Homo sapiens
aagtcatgatgtttttaa

SEQ ID NO: 559854 - DNA, 21 bp, Homo sapiens
aagtcatgatgtttttaaaat

SEQ ID NO: 559855 - DNA, 15 bp, Homo sapiens
aagtcatgctcccct

SEQ ID NO: 559856 - DNA, 15 bp, Homo sapiens
aagtccagctctccc

SEQ ID NO: 559857 - DNA, 21 bp, Homo sapiens
aatgtatagtatttgaaaaca

SEQ ID NO: 559858 - DNA, 13 bp, Homo sapiens
aatgtatatacac

SEQ ID NO: 559859 - DNA, 21 bp, Homo sapiens
aatgtatatacacatatacct

SEQ ID NO: 559860 - DNA, 15 bp, Homo sapiens
aatgtattatcctgt

SEQ ID NO: 559861 - DNA, 15 bp, Homo sapiens
aatgtctactgaagc

SEQ ID NO: 559862 - DNA, 15 bp, Homo sapiens
aatgtctcaaaataa

SEQ ID NO: 559863 - DNA, 21 bp, Homo sapiens
aatgtcttcatgttgatgtgt

SEQ ID NO: 559864 - DNA, 22 bp, Homo sapiens
aatgtgatggatggcacaatga

SEQ ID NO: 559865 - DNA, 23 bp, Homo sapiens
aatgtgatggatggcacaatgaa

SEQ ID NO: 559866 - DNA, 22 bp, Homo sapiens
aatgtgtatttttcaaggcatt

SEQ ID NO: 559867 - DNA, 12 bp, Homo sapiens
aatgtgtgtatg

SEQ ID NO: 559868 - DNA, 13 bp, Homo sapiens
aatgtgtgtatgt

SEQ ID NO: 559869 - DNA, 18 bp, Homo sapiens
aatgtgtgtatgtgtatt

SEQ ID NO: 559870 - DNA, 14 bp, Homo sapiens
aatgttaaagatgt

SEQ ID NO: 559871 - DNA, 19 bp, Homo sapiens
aatgttaaagatgtagcaa

SEQ ID NO: 559872 - DNA, 16 bp, Homo sapiens
aatgttgaagaactca

SEQ ID NO: 559873 - DNA, 16 bp, Homo sapiens
aatgttgatttctagt

SEQ ID NO: 559874 - DNA, 20 bp, Homo sapiens
aatgttgatttctagttatt

SEQ ID NO: 559875 - DNA, 21 bp, Homo sapiens
aatgtttaagcagaattggaa

SEQ ID NO: 559876 - DNA, 14 bp, Homo sapiens
aatgttttgtaaac

SEQ ID NO: 559877 - DNA, 15 bp, Homo sapiens
aatgttttgtaaact

SEQ ID NO: 559878 - DNA, 18 bp, Homo sapiens
aatgttttgtaaactttg

SEQ ID NO: 559879 - DNA, 20 bp, Homo sapiens
aatgttttgtaaactttgaa

SEQ ID NO: 559880 - DNA, 16 bp, Homo sapiens
aattaaaatttaacat

SEQ ID NO: 559881 - DNA, 15 bp, Homo sapiens
aattaaactgatggg

SEQ ID NO: 559882 - DNA, 15 bp, Homo sapiens
aattaaatgaaatac

SEQ ID NO: 559883 - DNA, 16 bp, Homo sapiens
aattaaatgaaatact

SEQ ID NO: 559884 - DNA, 17 bp, Homo sapiens
aattaaatgaaatactt

SEQ ID NO: 559885 - DNA, 12 bp, Homo sapiens
aattaagacaag

SEQ ID NO: 559886 - DNA, 23 bp, Homo sapiens
aattaagattgaagctaaaacac

SEQ ID NO: 559887 - DNA, 16 bp, Homo sapiens
aattaaggaaatgtta

SEQ ID NO: 559888 - DNA, 12 bp, Homo sapiens
aattaagtaaac

SEQ ID NO: 559889 - DNA, 18 bp, Homo sapiens
aattaatgtgtaaaattg

SEQ ID NO: 559890 - DNA, 19 bp, Homo sapiens
aattaatgtgtaaaattgg

SEQ ID NO: 559891 - DNA, 12 bp, Homo sapiens
aattaatttcag

SEQ ID NO: 559892 - DNA, 19 bp, Homo sapiens
aattacctaagagccacaa

SEQ ID NO: 559893 - DNA, 17 bp, Homo sapiens
aattactaacttctaaa

SEQ ID NO: 559894 - DNA, 14 bp, Homo sapiens
aattaggttaacat

SEQ ID NO: 559895 - DNA, 13 bp, Homo sapiens
aattatctttaaa

SEQ ID NO: 559896 - DNA, 20 bp, Homo sapiens
aattatgaagccctaagtaa

SEQ ID NO: 559897 - DNA, 17 bp, Homo sapiens
aattattgattgctttt

SEQ ID NO: 559898 - DNA, 16 bp, Homo sapiens
aattcagataatggta

SEQ ID NO: 559899 - DNA, 18 bp, Homo sapiens
aattcagataatggtaat

SEQ ID NO: 559900 - DNA, 15 bp, Homo sapiens
aattcatttcacatt

SEQ ID NO: 559901 - DNA, 17 bp, Homo sapiens
aattccatacttctctc

SEQ ID NO: 559902 - DNA, 20 bp, Homo sapiens
aattccatacttctctcaga

SEQ ID NO: 559903 - DNA, 15 bp, Homo sapiens
aattctaatggtaac

SEQ ID NO: 559904 - DNA, 17 bp, Homo sapiens
aattctcagaagtgaaa

SEQ ID NO: 559905 - DNA, 15 bp, Homo sapiens
aattctgaagttata

SEQ ID NO: 559906 - DNA, 18 bp, Homo sapiens
aattctgaagttatattt

SEQ ID NO: 559907 - DNA, 19 bp, Homo sapiens
aattctgaagttatatttc

SEQ ID NO: 559908 - DNA, 21 bp, Homo sapiens
aattctgaagttatatttcct

SEQ ID NO: 559909 - DNA, 15 bp, Homo sapiens
aattgaaagggacaa

SEQ ID NO: 559910 - DNA, 19 bp, Homo sapiens
aattgaaagggacaagtat

SEQ ID NO: 559911 - DNA, 13 bp, Homo sapiens
aattgatgttgat

SEQ ID NO: 559912 - DNA, 15 bp, Homo sapiens
aattgcttctctaaa

SEQ ID NO: 559913 - DNA, 21 bp, Homo sapiens
aattgcttctctaaaacagca

SEQ ID NO: 559914 - DNA, 16 bp, Homo sapiens
aattggtaattacctg

SEQ ID NO: 559915 - DNA, 16 bp, Homo sapiens
aattgtaatttgggaa

SEQ ID NO: 559916 - DNA, 14 bp, Homo sapiens
aattgtatatatat

SEQ ID NO: 559917 - DNA, 17 bp, Homo sapiens
aattgtatatatatgtg

SEQ ID NO: 559918 - DNA, 20 bp, Homo sapiens
aattgtatatatatgtgaac

SEQ ID NO: 559919 - DNA, 20 bp, Homo sapiens
aattgtcttttgtcatgtgg

SEQ ID NO: 559920 - DNA, 17 bp, Homo sapiens
aattgtgctccaaatgt

SEQ ID NO: 559921 - DNA, 18 bp, Homo sapiens
aattgtgctccaaatgtc

SEQ ID NO: 559922 - DNA, 11 bp, Homo sapiens
aattgtggatg

SEQ ID NO: 559923 - DNA, 15 bp, Homo sapiens
aattgttaatgtgat

SEQ ID NO: 559924 - DNA, 16 bp, Homo sapiens
aattgttaatgtgatg

SEQ ID NO: 559925 - DNA, 21 bp, Homo sapiens
aatttaacatctgcagtgttc

SEQ ID NO: 559926 - DNA, 14 bp, Homo sapiens
aatttaagcacaaa

SEQ ID NO: 559927 - DNA, 21 bp, Homo sapiens
aatttagtggatggaatatca

SEQ ID NO: 559928 - DNA, 14 bp, Homo sapiens
aatttataaaatta

SEQ ID NO: 559929 - DNA, 18 bp, Homo sapiens
aatttataaaattagaaa

SEQ ID NO: 559930 - DNA, 12 bp, Homo sapiens
aatttatctgtt

SEQ ID NO: 559931 - DNA, 14 bp, Homo sapiens
aatttatctgttgt

SEQ ID NO: 559932 - DNA, 19 bp, Homo sapiens
aatttatgaagcagattta

SEQ ID NO: 559933 - DNA, 19 bp, Homo sapiens
aatttattgaggaaaaata

SEQ ID NO: 559934 - DNA, 16 bp, Homo sapiens
aatttattgcacaaaa

SEQ ID NO: 559935 - DNA, 17 bp, Homo sapiens
aatttcaaaagacatgt

SEQ ID NO: 559936 - DNA, 22 bp, Homo sapiens
aatttcaagcttattttggaga

SEQ ID NO: 559937 - DNA, 12 bp, Homo sapiens
aatttcctgctc

SEQ ID NO: 559938 - DNA, 23 bp, Homo sapiens
aatttctcttaagtactgaaata

SEQ ID NO: 559939 - DNA, 13 bp, Homo sapiens
aatttctggcaaa

SEQ ID NO: 559940 - DNA, 21 bp, Homo sapiens
aatttctggcaaatattttgt

SEQ ID NO: 559941 - DNA, 16 bp, Homo sapiens
aatttcttgcaatttg

SEQ ID NO: 559942 - DNA, 15 bp, Homo sapiens
aatttgtctttggaa

SEQ ID NO: 559943 - DNA, 14 bp, Homo sapiens
aatttgttaattcc

SEQ ID NO: 559944 - DNA, 21 bp, Homo sapiens
aattttataagcaaatttcaa

SEQ ID NO: 559945 - DNA, 13 bp, Homo sapiens
aattttcatttta

SEQ ID NO: 559946 - DNA, 14 bp, Homo sapiens
aattttgtacattt

SEQ ID NO: 559947 - DNA, 20 bp, Homo sapiens
aattttgttttaaactgtga

SEQ ID NO: 559948 - DNA, 13 bp, Homo sapiens
aatttttaagtgt

SEQ ID NO: 559949 - DNA, 15 bp, Homo sapiens
aatttttaagtgtca

SEQ ID NO: 559950 - DNA, 20 bp, Homo sapiens
aatttttcagctctctgtat

SEQ ID NO: 559951 - DNA, 13 bp, Homo sapiens
aatttttctgtat

SEQ ID NO: 559952 - DNA, 14 bp, Homo sapiens
acaaaaacacaaat

SEQ ID NO: 559953 - DNA, 22 bp, Homo sapiens
acaaaaccacagtgtaccatta

SEQ ID NO: 559954 - DNA, 15 bp, Homo sapiens
acaaaatgattgtct

SEQ ID NO: 559955 - DNA, 14 bp, Homo sapiens
acaaaatgtaactg

SEQ ID NO: 559956 - DNA, 22 bp, Homo sapiens
acaaaatgtgtgcttggaaaat

SEQ ID NO: 559957 - DNA, 11 bp, Homo sapiens
acaaacaaaag

SEQ ID NO: 559958 - DNA, 14 bp, Homo sapiens
acaaacagatgctc

SEQ ID NO: 559959 - DNA, 14 bp, Homo sapiens
acaaacatagacag

SEQ ID NO: 559960 - DNA, 15 bp, Homo sapiens
acaaacatagacaga

SEQ ID NO: 559961 - DNA, 22 bp, Homo sapiens
acaaacatggatacttcctggg

SEQ ID NO: 559962 - DNA, 15 bp, Homo sapiens
acaaaccctttaaat

SEQ ID NO: 559963 - DNA, 14 bp, Homo sapiens
acaaactgcacatg

SEQ ID NO: 559964 - DNA, 21 bp, Homo sapiens
acaaactgcacatgatttcac

SEQ ID NO: 559965 - DNA, 23 bp, Homo sapiens
acaaactgcacatgatttcacaa

SEQ ID NO: 559966 - DNA, 16 bp, Homo sapiens
acaaagctatttaagt

SEQ ID NO: 559967 - DNA, 17 bp, Homo sapiens
acaaagctatttaagtg

SEQ ID NO: 559968 - DNA, 19 bp, Homo sapiens
acaaagctatttaagtgga

SEQ ID NO: 559969 - DNA, 20 bp, Homo sapiens
acaaaggctgtattcagcaa

SEQ ID NO: 559970 - DNA, 14 bp, Homo sapiens
acaaataacaactt

SEQ ID NO: 559971 - DNA, 11 bp, Homo sapiens
acaaatacaca

SEQ ID NO: 559972 - DNA, 16 bp, Homo sapiens
acaaatacacatacat

SEQ ID NO: 559973 - DNA, 15 bp, Homo sapiens
acaaatacactttat

SEQ ID NO: 559974 - DNA, 16 bp, Homo sapiens
acaaatacactttatt

SEQ ID NO: 559975 - DNA, 17 bp, Homo sapiens
acaaatagtaggcaaga

SEQ ID NO: 559976 - DNA, 19 bp, Homo sapiens
acaaatagtaggcaagatg

SEQ ID NO: 559977 - DNA, 21 bp, Homo sapiens
acaaatagtaggcaagatggc

SEQ ID NO: 559978 - DNA, 16 bp, Homo sapiens
acaaatattaaaaagt

SEQ ID NO: 559979 - DNA, 20 bp, Homo sapiens
acaaatatttctagacactt

SEQ ID NO: 559980 - DNA, 14 bp, Homo sapiens
acaaatctgtctgc

SEQ ID NO: 559981 - DNA, 22 bp, Homo sapiens
acaaatggcttgttcagtcact

SEQ ID NO: 559982 - DNA, 19 bp, Homo sapiens
acaacagaagttatatttt

SEQ ID NO: 559983 - DNA, 20 bp, Homo sapiens
acaacagattggattttatg

SEQ ID NO: 559984 - DNA, 22 bp, Homo sapiens
acaacagattggattttatgtt

SEQ ID NO: 559985 - DNA, 23 bp, Homo sapiens
acaacagattggattttatgttg

SEQ ID NO: 559986 - DNA, 19 bp, Homo sapiens
acaacatccatgtcctatg

SEQ ID NO: 559987 - DNA, 22 bp, Homo sapiens
acaacccaaggcaatgatatgg

SEQ ID NO: 559988 - DNA, 22 bp, Homo sapiens
acagcagtcttatgcttccaga

SEQ ID NO: 559989 - DNA, 14 bp, Homo sapiens
acagcattggcctg

SEQ ID NO: 559990 - DNA, 19 bp, Homo sapiens
acagcatttcagctgtgag

SEQ ID NO: 559991 - DNA, 21 bp, Homo sapiens
acagccaatctccaggctccc

SEQ ID NO: 559992 - DNA, 18 bp, Homo sapiens
acagcccctccctcctct

SEQ ID NO: 559993 - DNA, 18 bp, Homo sapiens
acagcctcacccctgcag

SEQ ID NO: 559994 - DNA, 14 bp, Homo sapiens
acagctaccaccct

SEQ ID NO: 559995 - DNA, 16 bp, Homo sapiens
acagctcccccagctc

SEQ ID NO: 559996 - DNA, 13 bp, Homo sapiens
acagctggccacc

SEQ ID NO: 559997 - DNA, 21 bp, Homo sapiens
aagtccagctctcccctgcgc

SEQ ID NO: 559998 - DNA, 14 bp, Homo sapiens
aagtctctttttta

SEQ ID NO: 559999 - DNA, 15 bp, Homo sapiens
aagtctcttttttac

SEQ ID NO: 560000 - DNA, 12 bp, Homo sapiens
aagtctgtcatg

SEQ ID NO: 560001 - DNA, 18 bp, Homo sapiens
aagtcttcatgaaatgct

SEQ ID NO: 560002 - DNA, 19 bp, Homo sapiens
aagtcttcatgaaatgcta

SEQ ID NO: 560003 - DNA, 20 bp, Homo sapiens
aagtcttttaaaaagtattg

SEQ ID NO: 560004 - DNA, 10 bp, Homo sapiens
aagtgaaatt

SEQ ID NO: 560005 - DNA, 12 bp, Homo sapiens
aagtgacttatt

SEQ ID NO: 560006 - DNA, 18 bp, Homo sapiens
aagtgcacacagaaatat

SEQ ID NO: 560007 - DNA, 23 bp, Homo sapiens
aagtgcacacagaaatatatata

SEQ ID NO: 560008 - DNA, 12 bp, Homo sapiens
aagtggacccag

SEQ ID NO: 560009 - DNA, 14 bp, Homo sapiens
aagtggactggagg

SEQ ID NO: 560010 - DNA, 14 bp, Homo sapiens
aagtggactgtatt

SEQ ID NO: 560011 - DNA, 22 bp, Homo sapiens
aagtggcaaagctgttcttcct

SEQ ID NO: 560012 - DNA, 20 bp, Homo sapiens
aagtgttctgtggctgattt

SEQ ID NO: 560013 - DNA, 19 bp, Homo sapiens
aagtgttctgttacaaaat

SEQ ID NO: 560014 - DNA, 23 bp, Homo sapiens
aagtgttggggtttggttttgtt

SEQ ID NO: 560015 - DNA, 19 bp, Homo sapiens
aagttaataacagctcctt

SEQ ID NO: 560016 - DNA, 14 bp, Homo sapiens
aagttatatttcct

SEQ ID NO: 560017 - DNA, 22 bp, Homo sapiens
aagttatatttcctataccatt

SEQ ID NO: 560018 - DNA, 16 bp, Homo sapiens
aagttatgcatcccca

SEQ ID NO: 560019 - DNA, 15 bp, Homo sapiens
aagttctgcctctga

SEQ ID NO: 560020 - DNA, 17 bp, Homo sapiens
aagttctgcctctgatg

SEQ ID NO: 560021 - DNA, 21 bp, Homo sapiens
aagttgactctgctcttgcat

SEQ ID NO: 560022 - DNA, 19 bp, Homo sapiens
aagttggaaacactaaatg

SEQ ID NO: 560023 - DNA, 21 bp, Homo sapiens
aagttggaaacactaaatgtt

SEQ ID NO: 560024 - DNA, 22 bp, Homo sapiens
aagttggaaacactaaatgtta

SEQ ID NO: 560025 - DNA, 17 bp, Homo sapiens
aagttggcacatttcat

SEQ ID NO: 560026 - DNA, 19 bp, Homo sapiens
aagttggcacatttcatga

SEQ ID NO: 560027 - DNA, 18 bp, Homo sapiens
aagttggtcttactttgt

SEQ ID NO: 560028 - DNA, 19 bp, Homo sapiens
aagttggtcttactttgtt

SEQ ID NO: 560029 - DNA, 20 bp, Homo sapiens
aagttggtcttactttgtta

SEQ ID NO: 560030 - DNA, 15 bp, Homo sapiens
aagttgtaaacgtct

SEQ ID NO: 560031 - DNA, 17 bp, Homo sapiens
aagttgtgatctgttgt

SEQ ID NO: 560032 - DNA, 15 bp, Homo sapiens
aagtttcaaaaatct

SEQ ID NO: 560033 - DNA, 21 bp, Homo sapiens
aagtttcaaaaatctgaagat

SEQ ID NO: 560034 - DNA, 13 bp, Homo sapiens
aagtttgaacagg

SEQ ID NO: 560035 - DNA, 23 bp, Homo sapiens
aagtttgatcttcctctgctaaa

SEQ ID NO: 560036 - DNA, 15 bp, Homo sapiens
aagtttgcaaccttt

SEQ ID NO: 560037 - DNA, 12 bp, Homo sapiens
aagttttgtgaa

SEQ ID NO: 560038 - DNA, 16 bp, Homo sapiens
aagttttgtgaaattt

SEQ ID NO: 560039 - DNA, 18 bp, Homo sapiens
aagttttgtgaaattttt

SEQ ID NO: 560040 - DNA, 20 bp, Homo sapiens
aagttttgtgaaatttttca

SEQ ID NO: 560041 - DNA, 20 bp, Homo sapiens
aataaaaagtgacacagcag

SEQ ID NO: 560042 - DNA, 13 bp, Homo sapiens
aataaaaggtcta

SEQ ID NO: 560043 - DNA, 15 bp, Homo sapiens
aataaaattcctatc

SEQ ID NO: 560044 - DNA, 18 bp, Homo sapiens
aataaaattcctatctca

SEQ ID NO: 560045 - DNA, 16 bp, Homo sapiens
aataaaccaaaggaca

SEQ ID NO: 560046 - DNA, 18 bp, Homo sapiens
aataaagcttttgcatag

SEQ ID NO: 560047 - DNA, 18 bp, Homo sapiens
aataaaggaggaatcaga

SEQ ID NO: 560048 - DNA, 18 bp, Homo sapiens
aataaagtttgatcttcc

SEQ ID NO: 560049 - DNA, 13 bp, Homo sapiens
aataaatatactc

SEQ ID NO: 560050 - DNA, 21 bp, Homo sapiens
aataattaaaacaaaatcctt

SEQ ID NO: 560051 - DNA, 11 bp, Homo sapiens
aatacaaaatg

SEQ ID NO: 560052 - DNA, 18 bp, Homo sapiens
aatacaacagaagttata

SEQ ID NO: 560053 - DNA, 13 bp, Homo sapiens
aatacacatacat

SEQ ID NO: 560054 - DNA, 17 bp, Homo sapiens
aatacacgtgtatatga

SEQ ID NO: 560055 - DNA, 20 bp, Homo sapiens
aatacacgtgtatatgagga

SEQ ID NO: 560056 - DNA, 17 bp, Homo sapiens
aatacatgatgatttca

SEQ ID NO: 560057 - DNA, 18 bp, Homo sapiens
aatacatgttgtaaatgg

SEQ ID NO: 560058 - DNA, 17 bp, Homo sapiens
aatacctgacctcacag

SEQ ID NO: 560059 - DNA, 18 bp, Homo sapiens
aatactgtattgttacag

SEQ ID NO: 560060 - DNA, 23 bp, Homo sapiens
aatactgtattgttacagctgaa

SEQ ID NO: 560061 - DNA, 23 bp, Homo sapiens
aatactttgtcctaagagattta

SEQ ID NO: 560062 - DNA, 12 bp, Homo sapiens
aatagacataaa

SEQ ID NO: 560063 - DNA, 14 bp, Homo sapiens
aatagacataaatt

SEQ ID NO: 560064 - DNA, 17 bp, Homo sapiens
aatagacataaattgta

SEQ ID NO: 560065 - DNA, 14 bp, Homo sapiens
aataggacttgttt

SEQ ID NO: 560066 - DNA, 22 bp, Homo sapiens
aatagtcttttgcatgtcgcac

SEQ ID NO: 560067 - DNA, 13 bp, Homo sapiens
aatagtgaaaatt

SEQ ID NO: 560068 - DNA, 18 bp, Homo sapiens
aatagttgtccatatttt

SEQ ID NO: 560069 - DNA, 21 bp, Homo sapiens
aatagttgtccatattttcac

SEQ ID NO: 560070 - DNA, 13 bp, Homo sapiens
aatataaaatagt

SEQ ID NO: 560071 - DNA, 22 bp, Homo sapiens
aatataaaatagttgtccatat

SEQ ID NO: 560072 - DNA, 23 bp, Homo sapiens
aatataatggaagagaaatctca

SEQ ID NO: 560073 - DNA, 20 bp, Homo sapiens
aatataatggcctcttaaaa

SEQ ID NO: 560074 - DNA, 17 bp, Homo sapiens
aatatacagtgtgtagt

SEQ ID NO: 560075 - DNA, 15 bp, Homo sapiens
aatatactccttaaa

SEQ ID NO: 560076 - DNA, 16 bp, Homo sapiens
aatatataaaaatata

SEQ ID NO: 560077 - DNA, 17 bp, Homo sapiens
aatatataaaaatatat

SEQ ID NO: 560078 - DNA, 19 bp, Homo sapiens
aatatataaaaatatatat

SEQ ID NO: 560079 - DNA, 14 bp, Homo sapiens
aatatatatacata

SEQ ID NO: 560080 - DNA, 15 bp, Homo sapiens
aatatatatacatat

SEQ ID NO: 560081 - DNA, 16 bp, Homo sapiens
aatatatatacatatg

SEQ ID NO: 560082 - DNA, 17 bp, Homo sapiens
aatatatatacatatgt

SEQ ID NO: 560083 - DNA, 22 bp, Homo sapiens
aatatatatagtgctatatata

SEQ ID NO: 560084 - DNA, 17 bp, Homo sapiens
aatatatggtctaatgt

SEQ ID NO: 560085 - DNA, 18 bp, Homo sapiens
aatatatggtctaatgtt

SEQ ID NO: 560086 - DNA, 13 bp, Homo sapiens
aatatattttgta

SEQ ID NO: 560087 - DNA, 17 bp, Homo sapiens
aatatattttgtatgca

SEQ ID NO: 560088 - DNA, 15 bp, Homo sapiens
aatatcagttacagt

SEQ ID NO: 560089 - DNA, 17 bp, Homo sapiens
aatatcagttacagtgg

SEQ ID NO: 560090 - DNA, 22 bp, Homo sapiens
aatatcagttacagtggcagta

SEQ ID NO: 560091 - DNA, 16 bp, Homo sapiens
aatatccgtgccagga

SEQ ID NO: 560092 - DNA, 20 bp, Homo sapiens
aatatgattttttaaaagaa

SEQ ID NO: 560093 - DNA, 23 bp, Homo sapiens
aatatgattttttaaaagaaatt

SEQ ID NO: 560094 - DNA, 15 bp, Homo sapiens
aatatgcatatatat

SEQ ID NO: 560095 - DNA, 21 bp, Homo sapiens
aatatgcatatatatgtatat

SEQ ID NO: 560096 - DNA, 23 bp, Homo sapiens
aatatgcatatatatgtatattt

SEQ ID NO: 560097 - DNA, 18 bp, Homo sapiens
aatatgcatcccacagcc

SEQ ID NO: 560098 - DNA, 12 bp, Homo sapiens
aatatgtaaact

SEQ ID NO: 560099 - DNA, 15 bp, Homo sapiens
aatatgtaaacttta

SEQ ID NO: 560100 - DNA, 17 bp, Homo sapiens
aatatgtaaactttaac

SEQ ID NO: 560101 - DNA, 12 bp, Homo sapiens
aatatgtatttt

SEQ ID NO: 560102 - DNA, 19 bp, Homo sapiens
aatatgtccatatctaacc

SEQ ID NO: 560103 - DNA, 11 bp, Homo sapiens
aatatgtgaag

SEQ ID NO: 560104 - DNA, 13 bp, Homo sapiens
aatattaaaaagt

SEQ ID NO: 560105 - DNA, 20 bp, Homo sapiens
aatattaaaaagtcttttaa

SEQ ID NO: 560106 - DNA, 17 bp, Homo sapiens
aatattaatggaaacat

SEQ ID NO: 560107 - DNA, 13 bp, Homo sapiens
aatattatatttg

SEQ ID NO: 560108 - DNA, 21 bp, Homo sapiens
aatattgaaaatgtcactgtt

SEQ ID NO: 560109 - DNA, 21 bp, Homo sapiens
aatatttggtctctatttcat

SEQ ID NO: 560110 - DNA, 20 bp, Homo sapiens
aatattttgctgctgaattt

SEQ ID NO: 560111 - DNA, 11 bp, Homo sapiens
aatattttgtc

SEQ ID NO: 560112 - DNA, 13 bp, Homo sapiens
aatattttgtcac

SEQ ID NO: 560113 - DNA, 16 bp, Homo sapiens
aatcaaaaaattatct

SEQ ID NO: 560114 - DNA, 23 bp, Homo sapiens
aatcaataacagccgctccagag

SEQ ID NO: 560115 - DNA, 23 bp, Homo sapiens
aatcacaagaacaaatacacttt

SEQ ID NO: 560116 - DNA, 20 bp, Homo sapiens
aatcacctaattaatttcag

SEQ ID NO: 560117 - DNA, 15 bp, Homo sapiens
aatcactcagagcag

SEQ ID NO: 560118 - DNA, 16 bp, Homo sapiens
aatcactcagagcagt

SEQ ID NO: 560119 - DNA, 13 bp, Homo sapiens
aatcagaaagaca

SEQ ID NO: 560120 - DNA, 18 bp, Homo sapiens
aatcagaccaaggaacaa

SEQ ID NO: 560121 - DNA, 15 bp, Homo sapiens
aatcagaggcagaga

SEQ ID NO: 560122 - DNA, 21 bp, Homo sapiens
aatcagtagcttaagaaaaaa

SEQ ID NO: 560123 - DNA, 13 bp, Homo sapiens
aatcagtttttgt

SEQ ID NO: 560124 - DNA, 17 bp, Homo sapiens
aatcatcgaaaattcat

SEQ ID NO: 560125 - DNA, 12 bp, Homo sapiens
aatcatctattg

SEQ ID NO: 560126 - DNA, 21 bp, Homo sapiens
aatcatgaacagctctgagat

SEQ ID NO: 560127 - DNA, 22 bp, Homo sapiens
aatcatgaacagctctgagatc

SEQ ID NO: 560128 - DNA, 23 bp, Homo sapiens
aatcatgaacagctctgagatcc

SEQ ID NO: 560129 - DNA, 18 bp, Homo sapiens
aatcccattgtatttaaa

SEQ ID NO: 560130 - DNA, 20 bp, Homo sapiens
aatccgaagggaattaaaaa

SEQ ID NO: 560131 - DNA, 21 bp, Homo sapiens
aatcctatctggggagctcct

SEQ ID NO: 560132 - DNA, 23 bp, Homo sapiens
aatcctatctggggagctcctgg

SEQ ID NO: 560133 - DNA, 21 bp, Homo sapiens
aatcctgggcatccccagccc

SEQ ID NO: 560134 - DNA, 15 bp, Homo sapiens
aatcctgtcctcagc

SEQ ID NO: 560135 - DNA, 21 bp, Homo sapiens
aatcctgtcctcagcttctta

SEQ ID NO: 560136 - DNA, 12 bp, Homo sapiens
aatctaaattaa

SEQ ID NO: 560137 - DNA, 14 bp, Homo sapiens
aatctaaattaact

SEQ ID NO: 560138 - DNA, 14 bp, Homo sapiens
aatctatagaaagt

SEQ ID NO: 560139 - DNA, 21 bp, Homo sapiens
actaagtctcttttttacaaa

SEQ ID NO: 560140 - DNA, 23 bp, Homo sapiens
actaagtctcttttttacaaagg

SEQ ID NO: 560141 - DNA, 13 bp, Homo sapiens
actaataaatgga

SEQ ID NO: 560142 - DNA, 17 bp, Homo sapiens
actaattttgttttaaa

SEQ ID NO: 560143 - DNA, 22 bp, Homo sapiens
actaattttgttttaaactgtg

SEQ ID NO: 560144 - DNA, 21 bp, Homo sapiens
actacaaaaccgtttagtcat

SEQ ID NO: 560145 - DNA, 11 bp, Homo sapiens
actacaggccc

SEQ ID NO: 560146 - DNA, 18 bp, Homo sapiens
actacatctgatatcagg

SEQ ID NO: 560147 - DNA, 15 bp, Homo sapiens
actaccaaaggacac

SEQ ID NO: 560148 - DNA, 17 bp, Homo sapiens
actacctcctctcctga

SEQ ID NO: 560149 - DNA, 10 bp, Homo sapiens
actactgaat

SEQ ID NO: 560150 - DNA, 19 bp, Homo sapiens
actacttgatggtcagaca

SEQ ID NO: 560151 - DNA, 18 bp, Homo sapiens
actagacacacaaagcag

SEQ ID NO: 560152 - DNA, 21 bp, Homo sapiens
actagacacacaaagcagttg

SEQ ID NO: 560153 - DNA, 21 bp, Homo sapiens
actagccaacggccccagctt

SEQ ID NO: 560154 - DNA, 23 bp, Homo sapiens
actagccaacggccccagcttct

SEQ ID NO: 560155 - DNA, 16 bp, Homo sapiens
actagcttttcaaaca

SEQ ID NO: 560156 - DNA, 13 bp, Homo sapiens
actagggacctgg

SEQ ID NO: 560157 - DNA, 13 bp, Homo sapiens
actatatacatgt

SEQ ID NO: 560158 - DNA, 14 bp, Homo sapiens
actatatgtttaca

SEQ ID NO: 560159 - DNA, 16 bp, Homo sapiens
actatatgtttacaca

SEQ ID NO: 560160 - DNA, 18 bp, Homo sapiens
actatatgtttacacaat

SEQ ID NO: 560161 - DNA, 19 bp, Homo sapiens
actatccattttacacttg

SEQ ID NO: 560162 - DNA, 16 bp, Homo sapiens
actatggaagccacat

SEQ ID NO: 560163 - DNA, 20 bp, Homo sapiens
actatggtatatattttgaa

SEQ ID NO: 560164 - DNA, 22 bp, Homo sapiens
actatggtatatattttgaaag

SEQ ID NO: 560165 - DNA, 19 bp, Homo sapiens
actattcagaagacacaga

SEQ ID NO: 560166 - DNA, 18 bp, Homo sapiens
actatttattaaaaccat

SEQ ID NO: 560167 - DNA, 21 bp, Homo sapiens
actcaaagatgaaagctgttt

SEQ ID NO: 560168 - DNA, 15 bp, Homo sapiens
actcaaccaaatggt

SEQ ID NO: 560169 - DNA, 13 bp, Homo sapiens
actcaaggcctcc

SEQ ID NO: 560170 - DNA, 14 bp, Homo sapiens
actcactgtcaatg

SEQ ID NO: 560171 - DNA, 15 bp, Homo sapiens
actcaggcccacatt

SEQ ID NO: 560172 - DNA, 14 bp, Homo sapiens
actcagtcaaatgt

SEQ ID NO: 560173 - DNA, 17 bp, Homo sapiens
actcatcgggagtgaat

SEQ ID NO: 560174 - DNA, 14 bp, Homo sapiens
actcatttctaaaa

SEQ ID NO: 560175 - DNA, 18 bp, Homo sapiens
actcatttctaaaagaat

SEQ ID NO: 560176 - DNA, 19 bp, Homo sapiens
actcatttctaaaagaata

SEQ ID NO: 560177 - DNA, 12 bp, Homo sapiens
actcattttgct

SEQ ID NO: 560178 - DNA, 20 bp, Homo sapiens
actccagaaatgtccctttc

SEQ ID NO: 560179 - DNA, 13 bp, Homo sapiens
actccagaagcag

SEQ ID NO: 560180 - DNA, 14 bp, Homo sapiens
actccagaagcagc

SEQ ID NO: 560181 - DNA, 16 bp, Homo sapiens
actccagaagcagcag

SEQ ID NO: 560182 - DNA, 18 bp, Homo sapiens
actccattcccaactaga

SEQ ID NO: 560183 - DNA, 10 bp, Homo sapiens
actcctgctc

SEQ ID NO: 560184 - DNA, 13 bp, Homo sapiens
actcctgctctgc

SEQ ID NO: 560185 - DNA, 17 bp, Homo sapiens
actcctggggggcctga

SEQ ID NO: 560186 - DNA, 15 bp, Homo sapiens
actcgtgagcgccag

SEQ ID NO: 560187 - DNA, 13 bp, Homo sapiens
actctaagatgtt

SEQ ID NO: 560188 - DNA, 23 bp, Homo sapiens
actctaagtgtttgctgcaattt

SEQ ID NO: 560189 - DNA, 15 bp, Homo sapiens
actctctaaactggt

SEQ ID NO: 560190 - DNA, 14 bp, Homo sapiens
actctctctgtgtc

SEQ ID NO: 560191 - DNA, 20 bp, Homo sapiens
actctcttcttactgtattt

SEQ ID NO: 560192 - DNA, 14 bp, Homo sapiens
actctgatgtaaat

SEQ ID NO: 560193 - DNA, 17 bp, Homo sapiens
actctgatgtaaatgaa

SEQ ID NO: 560194 - DNA, 23 bp, Homo sapiens
actctgcctgtcaagtttttata

SEQ ID NO: 560195 - DNA, 14 bp, Homo sapiens
actctgccttccag

SEQ ID NO: 560196 - DNA, 16 bp, Homo sapiens
actctgccttccaggc

SEQ ID NO: 560197 - DNA, 14 bp, Homo sapiens
actctgctcttgca

SEQ ID NO: 560198 - DNA, 14 bp, Homo sapiens
actcttctctctgc

SEQ ID NO: 560199 - DNA, 17 bp, Homo sapiens
actcttctctctgctct

SEQ ID NO: 560200 - DNA, 23 bp, Homo sapiens
actcttttgagcagtaaatgtat

SEQ ID NO: 560201 - DNA, 12 bp, Homo sapiens
actgaagcagag

SEQ ID NO: 560202 - DNA, 15 bp, Homo sapiens
actgaagtttgataa

SEQ ID NO: 560203 - DNA, 19 bp, Homo sapiens
actgaagtttgataaatag

SEQ ID NO: 560204 - DNA, 22 bp, Homo sapiens
actgaagtttgataaatagtgt

SEQ ID NO: 560205 - DNA, 23 bp, Homo sapiens
actgaagtttgataaatagtgtt

SEQ ID NO: 560206 - DNA, 13 bp, Homo sapiens
actgaataaatca

SEQ ID NO: 560207 - DNA, 16 bp, Homo sapiens
actgaataaatcatgt

SEQ ID NO: 560208 - DNA, 17 bp, Homo sapiens
actgaataaatcatgtg

SEQ ID NO: 560209 - DNA, 14 bp, Homo sapiens
actgaatctgtaca

SEQ ID NO: 560210 - DNA, 17 bp, Homo sapiens
actgagtacaaatgtgt

SEQ ID NO: 560211 - DNA, 14 bp, Homo sapiens
actgagtgaaatat

SEQ ID NO: 560212 - DNA, 18 bp, Homo sapiens
actgagtgaaatattact

SEQ ID NO: 560213 - DNA, 19 bp, Homo sapiens
actgagttagaatgttgaa

SEQ ID NO: 560214 - DNA, 15 bp, Homo sapiens
actgcacatgatttc

SEQ ID NO: 560215 - DNA, 20 bp, Homo sapiens
actgcacatgatttcacaaa

SEQ ID NO: 560216 - DNA, 15 bp, Homo sapiens
actgcaccaccgacc

SEQ ID NO: 560217 - DNA, 18 bp, Homo sapiens
actgcactctagccggag

SEQ ID NO: 560218 - DNA, 21 bp, Homo sapiens
actgccatggaggcacacagc

SEQ ID NO: 560219 - DNA, 19 bp, Homo sapiens
actgccatttcctcctggg

SEQ ID NO: 560220 - DNA, 18 bp, Homo sapiens
actgccctccgcccttcc

SEQ ID NO: 560221 - DNA, 13 bp, Homo sapiens
actgcctccccca

SEQ ID NO: 560222 - DNA, 13 bp, Homo sapiens
actgctgtaaagc

SEQ ID NO: 560223 - DNA, 21 bp, Homo sapiens
actggctgtgggctcccttcc

SEQ ID NO: 560224 - DNA, 13 bp, Homo sapiens
actggtgttaatg

SEQ ID NO: 560225 - DNA, 16 bp, Homo sapiens
actggtgttaatgagt

SEQ ID NO: 560226 - DNA, 19 bp, Homo sapiens
actgtacttgatttttcaa

SEQ ID NO: 560227 - DNA, 20 bp, Homo sapiens
actgtactttgattcacatg

SEQ ID NO: 560228 - DNA, 15 bp, Homo sapiens
actgtatttacttgt

SEQ ID NO: 560229 - DNA, 20 bp, Homo sapiens
actgtatttacttgttatgt

SEQ ID NO: 560230 - DNA, 14 bp, Homo sapiens
actgtatttgttaa

SEQ ID NO: 560231 - DNA, 17 bp, Homo sapiens
actgtatttgttaattt

SEQ ID NO: 560232 - DNA, 20 bp, Homo sapiens
actgtcatgtgcgaacacag

SEQ ID NO: 560233 - DNA, 19 bp, Homo sapiens
actgtcccggagctcaggc

SEQ ID NO: 560234 - DNA, 22 bp, Homo sapiens
actgtcccggagctcaggccct

SEQ ID NO: 560235 - DNA, 14 bp, Homo sapiens
actgtcttaattaa

SEQ ID NO: 560236 - DNA, 16 bp, Homo sapiens
actgtgcaaagcagag

SEQ ID NO: 560237 - DNA, 15 bp, Homo sapiens
actgtggcctcagga

SEQ ID NO: 560238 - DNA, 16 bp, Homo sapiens
actgtggctggtactt

SEQ ID NO: 560239 - DNA, 21 bp, Homo sapiens
actgtggtcccagctacaggg

SEQ ID NO: 560240 - DNA, 17 bp, Homo sapiens
actgttaccattggaaa

SEQ ID NO: 560241 - DNA, 18 bp, Homo sapiens
actgttaccattggaaat

SEQ ID NO: 560242 - DNA, 16 bp, Homo sapiens
actgttcctttcagat

SEQ ID NO: 560243 - DNA, 16 bp, Homo sapiens
actgtttaagacactt

SEQ ID NO: 560244 - DNA, 16 bp, Homo sapiens
actgtttattcaacaa

SEQ ID NO: 560245 - DNA, 21 bp, Homo sapiens
actgttttgtgcggtgtgtct

SEQ ID NO: 560246 - DNA, 14 bp, Homo sapiens
acttaacagatcac

SEQ ID NO: 560247 - DNA, 14 bp, Homo sapiens
acttaagagaaatg

SEQ ID NO: 560248 - DNA, 17 bp, Homo sapiens
acttaagagaaatggca

SEQ ID NO: 560249 - DNA, 20 bp, Homo sapiens
acttacaagactgtaaattc

SEQ ID NO: 560250 - DNA, 22 bp, Homo sapiens
acttacagagcgtggctgtgct

SEQ ID NO: 560251 - DNA, 18 bp, Homo sapiens
agaatctcagcactttgt

SEQ ID NO: 560252 - DNA, 23 bp, Homo sapiens
agaatctcctttggaaggtgaca

SEQ ID NO: 560253 - DNA, 15 bp, Homo sapiens
agaatgaccttgtaa

SEQ ID NO: 560254 - DNA, 22 bp, Homo sapiens
agaatgaccttgtaatgtaact

SEQ ID NO: 560255 - DNA, 20 bp, Homo sapiens
agaatgagggcgtgaaacac

SEQ ID NO: 560256 - DNA, 16 bp, Homo sapiens
agaatgcatgctttcc

SEQ ID NO: 560257 - DNA, 18 bp, Homo sapiens
agaatgcatgctttccat

SEQ ID NO: 560258 - DNA, 23 bp, Homo sapiens
agaatgcatgctttccatatttt

SEQ ID NO: 560259 - DNA, 17 bp, Homo sapiens
agaatggggctgggccc

SEQ ID NO: 560260 - DNA, 16 bp, Homo sapiens
agaatgttttccttct

SEQ ID NO: 560261 - DNA, 18 bp, Homo sapiens
agaattggaaaagactaa

SEQ ID NO: 560262 - DNA, 12 bp, Homo sapiens
agacaaatacac

SEQ ID NO: 560263 - DNA, 16 bp, Homo sapiens
agacaaatacacatac

SEQ ID NO: 560264 - DNA, 13 bp, Homo sapiens
agacaacagccca

SEQ ID NO: 560265 - DNA, 12 bp, Homo sapiens
agacaattctaa

SEQ ID NO: 560266 - DNA, 13 bp, Homo sapiens
agacaattctaat

SEQ ID NO: 560267 - DNA, 14 bp, Homo sapiens
agacacacaaagca

SEQ ID NO: 560268 - DNA, 22 bp, Homo sapiens
agacacacaagcagacacacac

SEQ ID NO: 560269 - DNA, 11 bp, Homo sapiens
agacacacaca

SEQ ID NO: 560270 - DNA, 14 bp, Homo sapiens
agacacacacacac

SEQ ID NO: 560271 - DNA, 22 bp, Homo sapiens
agacacacacacgcacgcacac

SEQ ID NO: 560272 - DNA, 13 bp, Homo sapiens
agacacaggggac

SEQ ID NO: 560273 - DNA, 20 bp, Homo sapiens
agacacttccgtcacatccc

SEQ ID NO: 560274 - DNA, 22 bp, Homo sapiens
agacactttttctttacaaaca

SEQ ID NO: 560275 - DNA, 19 bp, Homo sapiens
agacagagcgacagagcag

SEQ ID NO: 560276 - DNA, 15 bp, Homo sapiens
agacagatgtggaca

SEQ ID NO: 560277 - DNA, 13 bp, Homo sapiens
agacagcaaaaaa

SEQ ID NO: 560278 - DNA, 15 bp, Homo sapiens
agacagtcaggaagc

SEQ ID NO: 560279 - DNA, 21 bp, Homo sapiens
agacagtcaggaagcctcctg

SEQ ID NO: 560280 - DNA, 20 bp, Homo sapiens
agacagttggttttgcatgt

SEQ ID NO: 560281 - DNA, 17 bp, Homo sapiens
agacatgttgtaaatta

SEQ ID NO: 560282 - DNA, 15 bp, Homo sapiens
agacattcttagtta

SEQ ID NO: 560283 - DNA, 14 bp, Homo sapiens
agaccaggactctg

SEQ ID NO: 560284 - DNA, 16 bp, Homo sapiens
agaccaggtgacctta

SEQ ID NO: 560285 - DNA, 16 bp, Homo sapiens
agaccagtagtgacca

SEQ ID NO: 560286 - DNA, 18 bp, Homo sapiens
agaccagtagtgaccaat

SEQ ID NO: 560287 - DNA, 14 bp, Homo sapiens
agaccctatctccc

SEQ ID NO: 560288 - DNA, 12 bp, Homo sapiens
agacctaaccag

SEQ ID NO: 560289 - DNA, 17 bp, Homo sapiens
agacctaaccagggcca

SEQ ID NO: 560290 - DNA, 14 bp, Homo sapiens
agccttaagctgca

SEQ ID NO: 560291 - DNA, 20 bp, Homo sapiens
agccttagctctcccaactc

SEQ ID NO: 560292 - DNA, 23 bp, Homo sapiens
agccttgtgatcactttctgaaa

SEQ ID NO: 560293 - DNA, 17 bp, Homo sapiens
agccttttcacccttct

SEQ ID NO: 560294 - DNA, 17 bp, Homo sapiens
agcgacaacagattgga

SEQ ID NO: 560295 - DNA, 16 bp, Homo sapiens
agcggattgcaaagca

SEQ ID NO: 560296 - DNA, 19 bp, Homo sapiens
agcggtaccaatgcagaac

SEQ ID NO: 560297 - DNA, 15 bp, Homo sapiens
agctaagcctgatga

SEQ ID NO: 560298 - DNA, 13 bp, Homo sapiens
agctacagaacac

SEQ ID NO: 560299 - DNA, 19 bp, Homo sapiens
agctactccggaggctgag

SEQ ID NO: 560300 - DNA, 15 bp, Homo sapiens
agctacttaagagaa

SEQ ID NO: 560301 - DNA, 21 bp, Homo sapiens
agctacttaagagaaatggca

SEQ ID NO: 560302 - DNA, 14 bp, Homo sapiens
agctagaaatcaca

SEQ ID NO: 560303 - DNA, 17 bp, Homo sapiens
agctaggaaaagaaatc

SEQ ID NO: 560304 - DNA, 20 bp, Homo sapiens
agctaggaaaagaaatctat

SEQ ID NO: 560305 - DNA, 15 bp, Homo sapiens
agctaggaacaaatc

SEQ ID NO: 560306 - DNA, 15 bp, Homo sapiens
agctataaaagccca

SEQ ID NO: 560307 - DNA, 21 bp, Homo sapiens
agctatttaagtggactgtat

SEQ ID NO: 560308 - DNA, 22 bp, Homo sapiens
agctatttaagtggactgtatt

SEQ ID NO: 560309 - DNA, 21 bp, Homo sapiens
agctcaattgttaatgtgatg

SEQ ID NO: 560310 - DNA, 16 bp, Homo sapiens
agctcagcacagcctc

SEQ ID NO: 560311 - DNA, 16 bp, Homo sapiens
agctcaggaagaagag

SEQ ID NO: 560312 - DNA, 16 bp, Homo sapiens
agctcaggccctggtg

SEQ ID NO: 560313 - DNA, 15 bp, Homo sapiens
agctcccccagctcc

SEQ ID NO: 560314 - DNA, 18 bp, Homo sapiens
agctccctgaatctgacc

SEQ ID NO: 560315 - DNA, 19 bp, Homo sapiens
agctccctgaatctgacca

SEQ ID NO: 560316 - DNA, 23 bp, Homo sapiens
agctccctgaatctgaccacaga

SEQ ID NO: 560317 - DNA, 16 bp, Homo sapiens
agctccgcctctgtcc

SEQ ID NO: 560318 - DNA, 18 bp, Homo sapiens
agctcctgctcattgtgg

SEQ ID NO: 560319 - DNA, 14 bp, Homo sapiens
agctcctggccagg

SEQ ID NO: 560320 - DNA, 16 bp, Homo sapiens
agctcgtagaaacaag

SEQ ID NO: 560321 - DNA, 13 bp, Homo sapiens
agctcgtgtgctt

SEQ ID NO: 560322 - DNA, 17 bp, Homo sapiens
agctcgtgtgcttagaa

SEQ ID NO: 560323 - DNA, 18 bp, Homo sapiens
agctcgtgtgcttagaaa

SEQ ID NO: 560324 - DNA, 21 bp, Homo sapiens
agctcgtgtgcttagaaacct

SEQ ID NO: 560325 - DNA, 22 bp, Homo sapiens
agctctcatgctgcccctgcct

SEQ ID NO: 560326 - DNA, 15 bp, Homo sapiens
agctctcctgggcca

SEQ ID NO: 560327 - DNA, 18 bp, Homo sapiens
agctctcctgggccaggg

SEQ ID NO: 560328 - DNA, 22 bp, Homo sapiens
agctctcctgggccagggtctc

SEQ ID NO: 560329 - DNA, 21 bp, Homo sapiens
agctctctgtataaacattaa

SEQ ID NO: 560330 - DNA, 16 bp, Homo sapiens
agctctgacctgcccc

SEQ ID NO: 560331 - DNA, 17 bp, Homo sapiens
agctctgagatcctgga

SEQ ID NO: 560332 - DNA, 12 bp, Homo sapiens
agctctgtctgt

SEQ ID NO: 560333 - DNA, 14 bp, Homo sapiens
agctctgtctgtcc

SEQ ID NO: 560334 - DNA, 19 bp, Homo sapiens
agctcttcctccccaggac

SEQ ID NO: 560335 - DNA, 15 bp, Homo sapiens
agctgagccttctga

SEQ ID NO: 560336 - DNA, 20 bp, Homo sapiens
agctgatgtgttgccacttt

SEQ ID NO: 560337 - DNA, 15 bp, Homo sapiens
agctgcagagacaga

SEQ ID NO: 560338 - DNA, 17 bp, Homo sapiens
agctgcaggaatcaaaa

SEQ ID NO: 560339 - DNA, 20 bp, Homo sapiens
agctgcaggaatcaaaaatt

SEQ ID NO: 560340 - DNA, 23 bp, Homo sapiens
agctgcaggaatcaaaaattgaa

SEQ ID NO: 560341 - DNA, 17 bp, Homo sapiens
agctgcatatcttcatc

SEQ ID NO: 560342 - DNA, 16 bp, Homo sapiens
agctgcccctccctgc

SEQ ID NO: 560343 - DNA, 19 bp, Homo sapiens
agctgcttccagttggact

SEQ ID NO: 560344 - DNA, 15 bp, Homo sapiens
agctggcaggagaca

SEQ ID NO: 560345 - DNA, 16 bp, Homo sapiens
agctggcctctcactg

SEQ ID NO: 560346 - DNA, 16 bp, Homo sapiens
agctgtctgtggcttc

SEQ ID NO: 560347 - DNA, 15 bp, Homo sapiens
agctgttgaccaggc

SEQ ID NO: 560348 - DNA, 18 bp, Homo sapiens
agctgttgaccaggcacc

SEQ ID NO: 560349 - DNA, 16 bp, Homo sapiens
agctgttgtctcttct

SEQ ID NO: 560350 - DNA, 19 bp, Homo sapiens
agctgttgtctcttctcct

SEQ ID NO: 560351 - DNA, 17 bp, Homo sapiens
agctgtttggttttaaa

SEQ ID NO: 560352 - DNA, 19 bp, Homo sapiens
agctgtttggttttaaaat

SEQ ID NO: 560353 - DNA, 23 bp, Homo sapiens
agctgtttggttttaaaatactg

SEQ ID NO: 560354 - DNA, 24 bp, Homo sapiens
agctgtttggttttaaaatactgt

SEQ ID NO: 560355 - DNA, 18 bp, Homo sapiens
agcttatctttctttcca

SEQ ID NO: 560356 - DNA, 22 bp, Homo sapiens
agcttatctttctttccattta

SEQ ID NO: 560357 - DNA, 15 bp, Homo sapiens
agcttcaccagagca

SEQ ID NO: 560358 - DNA, 14 bp, Homo sapiens
agcttcacttctga

SEQ ID NO: 560359 - DNA, 16 bp, Homo sapiens
agcttccctccctgct

SEQ ID NO: 560360 - DNA, 23 bp, Homo sapiens
agcttcctttgtttttttttcct

SEQ ID NO: 560361 - DNA, 21 bp, Homo sapiens
agcttcttaatataactgcct

SEQ ID NO: 560362 - DNA, 22 bp, Homo sapiens
agcttcttaatataactgcctt

SEQ ID NO: 560363 - DNA, 15 bp, Homo sapiens
agctttaaagagcag

SEQ ID NO: 560364 - DNA, 12 bp, Homo sapiens
agctttctcaat

SEQ ID NO: 560365 - DNA, 16 bp, Homo sapiens
agctttgggcagattt

SEQ ID NO: 560366 - DNA, 19 bp, Homo sapiens
agctttgggcagatttgca

SEQ ID NO: 560367 - DNA, 12 bp, Homo sapiens
agcttttcaaac

SEQ ID NO: 560368 - DNA, 16 bp, Homo sapiens
agcttttcaaacaaga

SEQ ID NO: 560369 - DNA, 14 bp, Homo sapiens
aggaaaaatatgtg

SEQ ID NO: 560370 - DNA, 15 bp, Homo sapiens
aggaaaaatatgtga

SEQ ID NO: 560371 - DNA, 15 bp, Homo sapiens
aggaaaagaaatcta

SEQ ID NO: 560372 - DNA, 16 bp, Homo sapiens
aggaaaagaaatctat

SEQ ID NO: 560373 - DNA, 17 bp, Homo sapiens
aggaaaagaatctcctt

SEQ ID NO: 560374 - DNA, 21 bp, Homo sapiens
aggaaaaggcttgagtctgga

SEQ ID NO: 560375 - DNA, 22 bp, Homo sapiens
aggaaagtggcacctgtctgct

SEQ ID NO: 560376 - DNA, 16 bp, Homo sapiens
aggaaatatctgtgaa

SEQ ID NO: 560377 - DNA, 21 bp, Homo sapiens
aggaaatatctgtgaaggact

SEQ ID NO: 560378 - DNA, 17 bp, Homo sapiens
aggaaatctgaatgtat

SEQ ID NO: 560379 - DNA, 16 bp, Homo sapiens
aggaacaaatcttcct

SEQ ID NO: 560380 - DNA, 17 bp, Homo sapiens
aggaacaagacccccag

SEQ ID NO: 560381 - DNA, 18 bp, Homo sapiens
aggaacaagacccccagg

SEQ ID NO: 560382 - DNA, 16 bp, Homo sapiens
aggaacacccagcccc

SEQ ID NO: 560383 - DNA, 17 bp, Homo sapiens
aggaacacccagcccca

SEQ ID NO: 560384 - DNA, 17 bp, Homo sapiens
aggaagaagagatgcac

SEQ ID NO: 560385 - DNA, 18 bp, Homo sapiens
aggaagcctcctgctgag

SEQ ID NO: 560386 - DNA, 14 bp, Homo sapiens
aggaaggaaacaga

SEQ ID NO: 560387 - DNA, 16 bp, Homo sapiens
aggaaggaaacagatt

SEQ ID NO: 560388 - DNA, 15 bp, Homo sapiens
aggaagggcaggaaa

SEQ ID NO: 560389 - DNA, 14 bp, Homo sapiens
aggaaggtcatttc

SEQ ID NO: 560390 - DNA, 16 bp, Homo sapiens
aggaaggtcatttcca

SEQ ID NO: 560391 - DNA, 22 bp, Homo sapiens
aggaatattatatttggatgca

SEQ ID NO: 560392 - DNA, 17 bp, Homo sapiens
aggaatcaaaaattgaa

SEQ ID NO: 560393 - DNA, 18 bp, Homo sapiens
aggacaaggtgcaggcag

SEQ ID NO: 560394 - DNA, 18 bp, Homo sapiens
aggacacctgtactggag

SEQ ID NO: 560395 - DNA, 20 bp, Homo sapiens
aggacacctgtactggagag

SEQ ID NO: 560396 - DNA, 22 bp, Homo sapiens
aggacagaaggctcctgccccc

SEQ ID NO: 560397 - DNA, 20 bp, Homo sapiens
aggacccatgaaacagcagc

SEQ ID NO: 560398 - DNA, 16 bp, Homo sapiens
aggaccctcgctggcc

SEQ ID NO: 560399 - DNA, 13 bp, Homo sapiens
aggacctccacct

SEQ ID NO: 560400 - DNA, 16 bp, Homo sapiens
aggacctccacctggg

SEQ ID NO: 560401 - DNA, 13 bp, Homo sapiens
aggacctgtgtcc

SEQ ID NO: 560402 - DNA, 20 bp, Homo sapiens
aggacgcagggagaccctgg

SEQ ID NO: 560403 - DNA, 17 bp, Homo sapiens
aggacgcttcacaggac

SEQ ID NO: 560404 - DNA, 13 bp, Homo sapiens
aggactctgcctt

SEQ ID NO: 560405 - DNA, 20 bp, Homo sapiens
aggagaatcgcttgaaccca

SEQ ID NO: 560406 - DNA, 21 bp, Homo sapiens
aggagacactggtctcagagg

SEQ ID NO: 560407 - DNA, 19 bp, Homo sapiens
aggagacagtcaggaagcc

SEQ ID NO: 560408 - DNA, 12 bp, Homo sapiens
aggagagcctgg

SEQ ID NO: 560409 - DNA, 13 bp, Homo sapiens
aggagagcctggt

SEQ ID NO: 560410 - DNA, 23 bp, Homo sapiens
aggagatgaggctggataggaga

SEQ ID NO: 560411 - DNA, 18 bp, Homo sapiens
aggagatggagttatgag

SEQ ID NO: 560412 - DNA, 14 bp, Homo sapiens
aggagcgctccctt

SEQ ID NO: 560413 - DNA, 17 bp, Homo sapiens
aggtattacatccctgg

SEQ ID NO: 560414 - DNA, 17 bp, Homo sapiens
aggtcatcccggggcca

SEQ ID NO: 560415 - DNA, 21 bp, Homo sapiens
aggtcatttccatgtatgcat

SEQ ID NO: 560416 - DNA, 19 bp, Homo sapiens
aggtcctgctcagcagtga

SEQ ID NO: 560417 - DNA, 21 bp, Homo sapiens
aggtcctgggggcctgacctc

SEQ ID NO: 560418 - DNA, 22 bp, Homo sapiens
aggtctgtggctcctcccgaaa

SEQ ID NO: 560419 - DNA, 13 bp, Homo sapiens
aggtgaaagaaaa

SEQ ID NO: 560420 - DNA, 13 bp, Homo sapiens
aggtgaaggaggc

SEQ ID NO: 560421 - DNA, 15 bp, Homo sapiens
aggtgagggaggcct

SEQ ID NO: 560422 - DNA, 23 bp, Homo sapiens
aggtgcacagacgtccctccacg

SEQ ID NO: 560423 - DNA, 20 bp, Homo sapiens
aggtgcacttggggcacagg

SEQ ID NO: 560424 - DNA, 22 bp, Homo sapiens
aggtgcacttggggcacaggga

SEQ ID NO: 560425 - DNA, 23 bp, Homo sapiens
aggtgcacttggggcacagggag

SEQ ID NO: 560426 - DNA, 15 bp, Homo sapiens
aggtgcaggcaggct

SEQ ID NO: 560427 - DNA, 16 bp, Homo sapiens
aggtgcctgagagcag

SEQ ID NO: 560428 - DNA, 17 bp, Homo sapiens
aggtgcctgagagcaga

SEQ ID NO: 560429 - DNA, 22 bp, Homo sapiens
aggtggagcgttcaccagtgac

SEQ ID NO: 560430 - DNA, 15 bp, Homo sapiens
aggtggccagggctc

SEQ ID NO: 560431 - DNA, 17 bp, Homo sapiens
aggtggccagggctcca

SEQ ID NO: 560432 - DNA, 20 bp, Homo sapiens
aggtggccagggctccacgg

SEQ ID NO: 560433 - DNA, 21 bp, Homo sapiens
aggtggtgggcattctctctc

SEQ ID NO: 560434 - DNA, 21 bp, Homo sapiens
aggtgtggtgtaatttataaa

SEQ ID NO: 560435 - DNA, 13 bp, Homo sapiens
aggttaaatgttt

SEQ ID NO: 560436 - DNA, 20 bp, Homo sapiens
aggttctctctactggtcct

SEQ ID NO: 560437 - DNA, 13 bp, Homo sapiens
aggttctttgtgt

SEQ ID NO: 560438 - DNA, 15 bp, Homo sapiens
aggttgacaggaggt

SEQ ID NO: 560439 - DNA, 20 bp, Homo sapiens
aggtttagaatcaagtctgt

SEQ ID NO: 560440 - DNA, 22 bp, Homo sapiens
aggtttagaatcaagtctgtga

SEQ ID NO: 560441 - DNA, 17 bp, Homo sapiens
aggtttcactgttcatg

SEQ ID NO: 560442 - DNA, 16 bp, Homo sapiens
aggtttggctcctgcc

SEQ ID NO: 560443 - DNA, 15 bp, Homo sapiens
agtaaacctgtctga

SEQ ID NO: 560444 - DNA, 19 bp, Homo sapiens
agtaaatgtagttcatact

SEQ ID NO: 560445 - DNA, 20 bp, Homo sapiens
agtaaatgtgattcacctct

SEQ ID NO: 560446 - DNA, 17 bp, Homo sapiens
agtaattgcatttgctt

SEQ ID NO: 560447 - DNA, 22 bp, Homo sapiens
agtaattgcatttgcttttgta

SEQ ID NO: 560448 - DNA, 16 bp, Homo sapiens
agtaattgttccagag

SEQ ID NO: 560449 - DNA, 11 bp, Homo sapiens
agtacaaatgt

SEQ ID NO: 560450 - DNA, 14 bp, Homo sapiens
agtacaataaataa

SEQ ID NO: 560451 - DNA, 16 bp, Homo sapiens
agtacaggtactttgt

SEQ ID NO: 560452 - DNA, 21 bp, Homo sapiens
agtacaggtcatctgctggga

SEQ ID NO: 560453 - DNA, 13 bp, Homo sapiens
agtaccacactga

SEQ ID NO: 560454 - DNA, 13 bp, Homo sapiens
agtactttataga

SEQ ID NO: 560455 - DNA, 19 bp, Homo sapiens
agtactttatagaagaatg

SEQ ID NO: 560456 - DNA, 16 bp, Homo sapiens
agtagaggtttaaaga

SEQ ID NO: 560457 - DNA, 18 bp, Homo sapiens
agtagaggtttaaagaaa

SEQ ID NO: 560458 - DNA, 19 bp, Homo sapiens
agtagagtatattgaaaag

SEQ ID NO: 560459 - DNA, 13 bp, Homo sapiens
agtagctgtgggg

SEQ ID NO: 560460 - DNA, 17 bp, Homo sapiens
agtagcttaagaaaaaa

SEQ ID NO: 560461 - DNA, 20 bp, Homo sapiens
agtaggatatgcctgctctt

SEQ ID NO: 560462 - DNA, 15 bp, Homo sapiens
agtaggcaagatggc

SEQ ID NO: 560463 - DNA, 13 bp, Homo sapiens
agtagggtcaggc

SEQ ID NO: 560464 - DNA, 13 bp, Homo sapiens
agtagtgaccaat

SEQ ID NO: 560465 - DNA, 16 bp, Homo sapiens
agtatacaatatataa

SEQ ID NO: 560466 - DNA, 20 bp, Homo sapiens
agtatacacatcataaacaa

SEQ ID NO: 560467 - DNA, 22 bp, Homo sapiens
agtatctcatcaacaaagaaat

SEQ ID NO: 560468 - DNA, 12 bp, Homo sapiens
agtatgaatatt

SEQ ID NO: 560469 - DNA, 16 bp, Homo sapiens
agtatgaatatttcat

SEQ ID NO: 560470 - DNA, 14 bp, Homo sapiens
agtattgccaaaca

SEQ ID NO: 560471 - DNA, 12 bp, Homo sapiens
agtatttaacat

SEQ ID NO: 560472 - DNA, 17 bp, Homo sapiens
agtatttgaaaacagaa

SEQ ID NO: 560473 - DNA, 18 bp, Homo sapiens
agtatttgaaaacagaaa

SEQ ID NO: 560474 - DNA, 21 bp, Homo sapiens
agtatttgaaaacagaaattg

SEQ ID NO: 560475 - DNA, 21 bp, Homo sapiens
agtattttagtggaccctgaa

SEQ ID NO: 560476 - DNA, 22 bp, Homo sapiens
agtcaaatgtaatgtggcttct

SEQ ID NO: 560477 - DNA, 14 bp, Homo sapiens
agtcagatttgtat

SEQ ID NO: 560478 - DNA, 23 bp, Homo sapiens
agtcagcctcgcaggcctccctg

SEQ ID NO: 560479 - DNA, 22 bp, Homo sapiens
agtcagtcgcctttcagcaggc

SEQ ID NO: 560480 - DNA, 23 bp, Homo sapiens
agtcagtcgcctttcagcaggca

SEQ ID NO: 560481 - DNA, 19 bp, Homo sapiens
agtcagtgcccatgtgtat

SEQ ID NO: 560482 - DNA, 21 bp, Homo sapiens
agtcagtgcccatgtgtatgg

SEQ ID NO: 560483 - DNA, 21 bp, Homo sapiens
agtcagtgtactctgagtcct

SEQ ID NO: 560484 - DNA, 11 bp, Homo sapiens
agtcatctccc

SEQ ID NO: 560485 - DNA, 13 bp, Homo sapiens
agtcatgatgttt

SEQ ID NO: 560486 - DNA, 17 bp, Homo sapiens
agtcatgatgtttttaa

SEQ ID NO: 560487 - DNA, 20 bp, Homo sapiens
agtcatgatgtttttaaaat

SEQ ID NO: 560488 - DNA, 22 bp, Homo sapiens
agtcatgatgtttttaaaatct

SEQ ID NO: 560489 - DNA, 13 bp, Homo sapiens
agtcatgctcccc

SEQ ID NO: 560490 - DNA, 14 bp, Homo sapiens
agtcatgctcccct

SEQ ID NO: 560491 - DNA, 19 bp, Homo sapiens
agtcatgctcccctgtgcc

SEQ ID NO: 560492 - DNA, 23 bp, Homo sapiens
agtcatgctcccctgtgccagcc

SEQ ID NO: 560493 - DNA, 15 bp, Homo sapiens
agtcatttattttaa

SEQ ID NO: 560494 - DNA, 16 bp, Homo sapiens
agtcatttattttaaa

SEQ ID NO: 560495 - DNA, 19 bp, Homo sapiens
agtccaacgtggggcagca

SEQ ID NO: 560496 - DNA, 22 bp, Homo sapiens
agtccaaggggtcccctccagg

SEQ ID NO: 560497 - DNA, 13 bp, Homo sapiens
agtccagacctgg

SEQ ID NO: 560498 - DNA, 19 bp, Homo sapiens
agtccagacctgggccctg

SEQ ID NO: 560499 - DNA, 14 bp, Homo sapiens
agtccagctctccc

SEQ ID NO: 560500 - DNA, 20 bp, Homo sapiens
agtccagctctcccctgcgc

SEQ ID NO: 560501 - DNA, 23 bp, Homo sapiens
agtccagctctcccctgcgcagg

SEQ ID NO: 560502 - DNA, 18 bp, Homo sapiens
agtcccactccaagccag

SEQ ID NO: 560503 - DNA, 21 bp, Homo sapiens
agtccctcaagccaccagatg

SEQ ID NO: 560504 - DNA, 18 bp, Homo sapiens
agtccctgagaagcctca

SEQ ID NO: 560505 - DNA, 19 bp, Homo sapiens
agtcctcaccttctgtttt

SEQ ID NO: 560506 - DNA, 17 bp, Homo sapiens
agtcctcattgttcaga

SEQ ID NO: 560507 - DNA, 18 bp, Homo sapiens
ataaagcttttgcataga

SEQ ID NO: 560508 - DNA, 15 bp, Homo sapiens
ataaaggaggaatca

SEQ ID NO: 560509 - DNA, 16 bp, Homo sapiens
ataaagtatgaatatt

SEQ ID NO: 560510 - DNA, 21 bp, Homo sapiens
ataaagtatgaatatttcatt

SEQ ID NO: 560511 - DNA, 12 bp, Homo sapiens
ataaagtttgat

SEQ ID NO: 560512 - DNA, 16 bp, Homo sapiens
ataaataaaagaaaga

SEQ ID NO: 560513 - DNA, 15 bp, Homo sapiens
ataaataaataaata

SEQ ID NO: 560514 - DNA, 22 bp, Homo sapiens
ataaatagtgaaaattttattg

SEQ ID NO: 560515 - DNA, 18 bp, Homo sapiens
ataaatcttccaaagttt

SEQ ID NO: 560516 - DNA, 13 bp, Homo sapiens
ataaatggaaatc

SEQ ID NO: 560517 - DNA, 15 bp, Homo sapiens
ataaatggaaatcat

SEQ ID NO: 560518 - DNA, 17 bp, Homo sapiens
ataaatggactacagta

SEQ ID NO: 560519 - DNA, 16 bp, Homo sapiens
ataaatgtatatacac

SEQ ID NO: 560520 - DNA, 17 bp, Homo sapiens
ataaatgtatatacaca

SEQ ID NO: 560521 - DNA, 20 bp, Homo sapiens
ataaatgtatatacacatat

SEQ ID NO: 560522 - DNA, 14 bp, Homo sapiens
ataaattgtaattt

SEQ ID NO: 560523 - DNA, 14 bp, Homo sapiens
ataaattttgtaca

SEQ ID NO: 560524 - DNA, 16 bp, Homo sapiens
ataaattttgtacatt

SEQ ID NO: 560525 - DNA, 14 bp, Homo sapiens
ataaatttttaagt

SEQ ID NO: 560526 - DNA, 13 bp, Homo sapiens
ataacaagaaaat

SEQ ID NO: 560527 - DNA, 16 bp, Homo sapiens
ataacagccgctccag

SEQ ID NO: 560528 - DNA, 17 bp, Homo sapiens
ataacagccgctccaga

SEQ ID NO: 560529 - DNA, 15 bp, Homo sapiens
ataacagctccttta

SEQ ID NO: 560530 - DNA, 13 bp, Homo sapiens
ataacattgtaaa

SEQ ID NO: 560531 - DNA, 12 bp, Homo sapiens
ataacattgtat

SEQ ID NO: 560532 - DNA, 14 bp, Homo sapiens
ataacattgtatgt

SEQ ID NO: 560533 - DNA, 16 bp, Homo sapiens
ataacattttgagaaa

SEQ ID NO: 560534 - DNA, 13 bp, Homo sapiens
ataactattgctg

SEQ ID NO: 560535 - DNA, 16 bp, Homo sapiens
ataactgatggcaata

SEQ ID NO: 560536 - DNA, 14 bp, Homo sapiens
ataagaagcaaata

SEQ ID NO: 560537 - DNA, 22 bp, Homo sapiens
ataagcaaatttcaaaagacat

SEQ ID NO: 560538 - DNA, 18 bp, Homo sapiens
ataagcaacaattttcag

SEQ ID NO: 560539 - DNA, 21 bp, Homo sapiens
atatcaggaaatatctgtgaa

SEQ ID NO: 560540 - DNA, 20 bp, Homo sapiens
atatcatccccaaatgtgtc

SEQ ID NO: 560541 - DNA, 18 bp, Homo sapiens
atatctaaatctgtccaa

SEQ ID NO: 560542 - DNA, 15 bp, Homo sapiens
atatctatcagagta

SEQ ID NO: 560543 - DNA, 16 bp, Homo sapiens
atatctgaaaactgga

SEQ ID NO: 560544 - DNA, 23 bp, Homo sapiens
atatctgaaaactggaataagaa

SEQ ID NO: 560545 - DNA, 20 bp, Homo sapiens
atatctgtacagatcaagaa

SEQ ID NO: 560546 - DNA, 22 bp, Homo sapiens
atatcttggcaggtaggaatat

SEQ ID NO: 560547 - DNA, 14 bp, Homo sapiens
atatgagattggaa

SEQ ID NO: 560548 - DNA, 22 bp, Homo sapiens
atatgagattggaaaaaattag

SEQ ID NO: 560549 - DNA, 19 bp, Homo sapiens
atatgaggatgtatgtgta

SEQ ID NO: 560550 - DNA, 14 bp, Homo sapiens
atatgagtatacaa

SEQ ID NO: 560551 - DNA, 15 bp, Homo sapiens
atatgagtatacaat

SEQ ID NO: 560552 - DNA, 18 bp, Homo sapiens
atatgagtatacaatata

SEQ ID NO: 560553 - DNA, 20 bp, Homo sapiens
atatgagtatacaatatata

SEQ ID NO: 560554 - DNA, 20 bp, Homo sapiens
atatgatccagagcagagtt

SEQ ID NO: 560555 - DNA, 18 bp, Homo sapiens
atatgattttttaaaaga

SEQ ID NO: 560556 - DNA, 19 bp, Homo sapiens
atatgcactaagtctcttt

SEQ ID NO: 560557 - DNA, 13 bp, Homo sapiens
atatgcatatata

SEQ ID NO: 560558 - DNA, 17 bp, Homo sapiens
atatgcatatatatgta

SEQ ID NO: 560559 - DNA, 17 bp, Homo sapiens
atatgcatcccacagcc

SEQ ID NO: 560560 - DNA, 15 bp, Homo sapiens
atatgcctgctcttt

SEQ ID NO: 560561 - DNA, 17 bp, Homo sapiens
atatggtctaatgttta

SEQ ID NO: 560562 - DNA, 14 bp, Homo sapiens
atatgtaaacttta

SEQ ID NO: 560563 - DNA, 15 bp, Homo sapiens
atatgtaaactttaa

SEQ ID NO: 560564 - DNA, 15 bp, Homo sapiens
atatgtacagctctc

SEQ ID NO: 560565 - DNA, 23 bp, Homo sapiens
atatgtagactatatacatgtgt

SEQ ID NO: 560566 - DNA, 16 bp, Homo sapiens
atatgtatacgcacgc

SEQ ID NO: 560567 - DNA, 22 bp, Homo sapiens
atatgtattttatgtatgttta

SEQ ID NO: 560568 - DNA, 21 bp, Homo sapiens
atatgtctcgctagtgatgtt

SEQ ID NO: 560569 - DNA, 15 bp, Homo sapiens
atatgtgattttcaa

SEQ ID NO: 560570 - DNA, 16 bp, Homo sapiens
atatgtgtatatatac

SEQ ID NO: 560571 - DNA, 19 bp, Homo sapiens
atatgtgtatatatacata

SEQ ID NO: 560572 - DNA, 13 bp, Homo sapiens
atatgtttacaca

SEQ ID NO: 560573 - DNA, 16 bp, Homo sapiens
atatgtttacacaatt

SEQ ID NO: 560574 - DNA, 17 bp, Homo sapiens
atatgtttatacacaca

SEQ ID NO: 560575 - DNA, 12 bp, Homo sapiens
atattaaaaagt

SEQ ID NO: 560576 - DNA, 13 bp, Homo sapiens
atattaaaaagtc

SEQ ID NO: 560577 - DNA, 12 bp, Homo sapiens
atattaagacag

SEQ ID NO: 560578 - DNA, 22 bp, Homo sapiens
atattaagacagacgcctgctt

SEQ ID NO: 560579 - DNA, 13 bp, Homo sapiens
atattacaatatt

SEQ ID NO: 560580 - DNA, 15 bp, Homo sapiens
atattacaatatttg

SEQ ID NO: 560581 - DNA, 23 bp, Homo sapiens
atattactctgcctgtcaagttt

SEQ ID NO: 560582 - DNA, 15 bp, Homo sapiens
atattagaaaacttt

SEQ ID NO: 560583 - DNA, 16 bp, Homo sapiens
atattagaaaactttg

SEQ ID NO: 560584 - DNA, 20 bp, Homo sapiens
atattagaaaactttgttag

SEQ ID NO: 560585 - DNA, 15 bp, Homo sapiens
atattagacttctgt

SEQ ID NO: 560586 - DNA, 12 bp, Homo sapiens
atattatatttg

SEQ ID NO: 560587 - DNA, 22 bp, Homo sapiens
atattatatttggatgcagagt

SEQ ID NO: 560588 - DNA, 14 bp, Homo sapiens
atattcagagaata

SEQ ID NO: 560589 - DNA, 20 bp, Homo sapiens
atattctttgttaatttgga

SEQ ID NO: 560590 - DNA, 15 bp, Homo sapiens
atattgaaaatgtca

SEQ ID NO: 560591 - DNA, 16 bp, Homo sapiens
atattgaaaatgtcac

SEQ ID NO: 560592 - DNA, 22 bp, Homo sapiens
atattgaaaatgtcactgttat

SEQ ID NO: 560593 - DNA, 14 bp, Homo sapiens
atattgatgtaact

SEQ ID NO: 560594 - DNA, 21 bp, Homo sapiens
atattggtatatccttttctg

SEQ ID NO: 560595 - DNA, 15 bp, Homo sapiens
atatttaagtattca

SEQ ID NO: 560596 - DNA, 10 bp, Homo sapiens
atatttccta

SEQ ID NO: 560597 - DNA, 23 bp, Homo sapiens
atatttcctaaggcatgtggcct

SEQ ID NO: 560598 - DNA, 22 bp, Homo sapiens
atatttcctataccatttccgt

SEQ ID NO: 560599 - DNA, 21 bp, Homo sapiens
atatttgcataatatgcatat

SEQ ID NO: 560600 - DNA, 15 bp, Homo sapiens
atattttaatttcaa

SEQ ID NO: 560601 - DNA, 18 bp, Homo sapiens
atattttcctttatgtga

SEQ ID NO: 560602 - DNA, 19 bp, Homo sapiens
atattttgctgctgaattt

SEQ ID NO: 560603 - DNA, 22 bp, Homo sapiens
atattttgtatgcaagcagttt

SEQ ID NO: 560604 - DNA, 13 bp, Homo sapiens
atatttttcttaa

SEQ ID NO: 560605 - DNA, 17 bp, Homo sapiens
atatttttcttaaaaag

SEQ ID NO: 560606 - DNA, 14 bp, Homo sapiens
atatttttttcctt

SEQ ID NO: 560607 - DNA, 22 bp, Homo sapiens
atatttttttccttacataaac

SEQ ID NO: 560608 - DNA, 13 bp, Homo sapiens
atcaaaatgacct

SEQ ID NO: 560609 - DNA, 15 bp, Homo sapiens
atcaaggagggagaa

SEQ ID NO: 560610 - DNA, 21 bp, Homo sapiens
atcaatctttagaaaaggcat

SEQ ID NO: 560611 - DNA, 21 bp, Homo sapiens
atcaatgttcacgcaacttga

SEQ ID NO: 560612 - DNA, 22 bp, Homo sapiens
atcaatgttcacgcaacttgaa

SEQ ID NO: 560613 - DNA, 23 bp, Homo sapiens
atcaatgttcacgcaacttgaaa

SEQ ID NO: 560614 - DNA, 19 bp, Homo sapiens
atcaattcattgtgtatga

SEQ ID NO: 560615 - DNA, 16 bp, Homo sapiens
atcacatgcccctctt

SEQ ID NO: 560616 - DNA, 21 bp, Homo sapiens
atcactattcagaagacacag

SEQ ID NO: 560617 - DNA, 23 bp, Homo sapiens
atcactattcagaagacacagag

SEQ ID NO: 560618 - DNA, 17 bp, Homo sapiens
atcagaaagacattctt

SEQ ID NO: 560619 - DNA, 20 bp, Homo sapiens
atcagaaagacattcttagt

SEQ ID NO: 560620 - DNA, 17 bp, Homo sapiens
atcagaagtatatctgt

SEQ ID NO: 560621 - DNA, 14 bp, Homo sapiens
atcagaggacacct

SEQ ID NO: 560622 - DNA, 16 bp, Homo sapiens
atcagatcttcttttg

SEQ ID NO: 560623 - DNA, 22 bp, Homo sapiens
atcaggaaaggaagatgtaaga

SEQ ID NO: 560624 - DNA, 23 bp, Homo sapiens
atcaggaaatatctgtgaaggac

SEQ ID NO: 560625 - DNA, 17 bp, Homo sapiens
atcaggttaggcagtat

SEQ ID NO: 560626 - DNA, 15 bp, Homo sapiens
atcagtattaatact

SEQ ID NO: 560627 - DNA, 17 bp, Homo sapiens
atcagtattaatactaa

SEQ ID NO: 560628 - DNA, 23 bp, Homo sapiens
atcagtattaatactaaaatatg

SEQ ID NO: 560629 - DNA, 17 bp, Homo sapiens
atcagttacagtggcag

SEQ ID NO: 560630 - DNA, 14 bp, Homo sapiens
atcagtttttgttc

SEQ ID NO: 560631 - DNA, 23 bp, Homo sapiens
atcatattggtatatccttttct

SEQ ID NO: 560632 - DNA, 18 bp, Homo sapiens
atcatccccaaatgtgtc

SEQ ID NO: 560633 - DNA, 16 bp, Homo sapiens
atcatctaaatattat

SEQ ID NO: 560634 - DNA, 22 bp, Homo sapiens
atcatgtggcctaatattgaaa

SEQ ID NO: 560635 - DNA, 20 bp, Homo sapiens
atcattggtatctgatatct

SEQ ID NO: 560636 - DNA, 21 bp, Homo sapiens
atcattgtttgtcctttatgt

SEQ ID NO: 560637 - DNA, 15 bp, Homo sapiens
atccaagcccagcct

SEQ ID NO: 560638 - DNA, 17 bp, Homo sapiens
atccacctgcacaaaca

SEQ ID NO: 560639 - DNA, 13 bp, Homo sapiens
atccagagcagag

SEQ ID NO: 560640 - DNA, 21 bp, Homo sapiens
atccagaggtgagggaggcct

SEQ ID NO: 560641 - DNA, 13 bp, Homo sapiens
atccaggaacaca

SEQ ID NO: 560642 - DNA, 15 bp, Homo sapiens
atccaggaacacatg

SEQ ID NO: 560643 - DNA, 20 bp, Homo sapiens
atccaggaacacatgcacac

SEQ ID NO: 560644 - DNA, 13 bp, Homo sapiens
atccatcagtgcc

SEQ ID NO: 560645 - DNA, 19 bp, Homo sapiens
atccatgtgctgctgtggc

SEQ ID NO: 560646 - DNA, 14 bp, Homo sapiens
atccattttacact

SEQ ID NO: 560647 - DNA, 21 bp, Homo sapiens
atccattttacacttgcttta

SEQ ID NO: 560648 - DNA, 13 bp, Homo sapiens
atcccaaaagtca

SEQ ID NO: 560649 - DNA, 14 bp, Homo sapiens
atcccacagccagt

SEQ ID NO: 560650 - DNA, 18 bp, Homo sapiens
atcccaccccatcctcca

SEQ ID NO: 560651 - DNA, 17 bp, Homo sapiens
atcccattgtatttaaa

SEQ ID NO: 560652 - DNA, 16 bp, Homo sapiens
atccccaaatgtgtct

SEQ ID NO: 560653 - DNA, 23 bp, Homo sapiens
atccccagccccctggcccctcc

SEQ ID NO: 560654 - DNA, 22 bp, Homo sapiens
atcccccgtgtattcaggaccc

SEQ ID NO: 560655 - DNA, 14 bp, Homo sapiens
atcccgtgctttta

SEQ ID NO: 560656 - DNA, 22 bp, Homo sapiens
atcccttccacctgctctgctg

SEQ ID NO: 560657 - DNA, 15 bp, Homo sapiens
atcccttctcttcca

SEQ ID NO: 560658 - DNA, 17 bp, Homo sapiens
atcccttctcttccagg

SEQ ID NO: 560659 - DNA, 18 bp, Homo sapiens
atccttacaaatgattgc

SEQ ID NO: 560660 - DNA, 15 bp, Homo sapiens
atccttctccccaag

SEQ ID NO: 560661 - DNA, 19 bp, Homo sapiens
atcctttcacttctttccc

SEQ ID NO: 560662 - DNA, 12 bp, Homo sapiens
atcgaaaattca

SEQ ID NO: 560663 - DNA, 18 bp, Homo sapiens
atcgccctggcaggcagg

SEQ ID NO: 560664 - DNA, 13 bp, Homo sapiens
atcgggagtagca

SEQ ID NO: 560665 - DNA, 13 bp, Homo sapiens
atcggtcagcagg

SEQ ID NO: 560666 - DNA, 16 bp, Homo sapiens
atcggttaacaaataa

SEQ ID NO: 560667 - DNA, 21 bp, Homo sapiens
atctaaactttaatatgtatt

SEQ ID NO: 560668 - DNA, 13 bp, Homo sapiens
atctaaatattat

SEQ ID NO: 560669 - DNA, 14 bp, Homo sapiens
atctactagaacct

SEQ ID NO: 560670 - DNA, 19 bp, Homo sapiens
atctactagaaccttctaa

SEQ ID NO: 560671 - DNA, 14 bp, Homo sapiens
atctagatgtaaat

SEQ ID NO: 560672 - DNA, 14 bp, Homo sapiens
atctatagaaagtg

SEQ ID NO: 560673 - DNA, 22 bp, Homo sapiens
atctatagaaagtgttctgtta

SEQ ID NO: 560674 - DNA, 23 bp, Homo sapiens
atctatagaaagtgttctgttac

SEQ ID NO: 560675 - DNA, 10 bp, Homo sapiens
atctcagcac

SEQ ID NO: 560676 - DNA, 16 bp, Homo sapiens
atctccaggctccctc

SEQ ID NO: 560677 - DNA, 13 bp, Homo sapiens
atctcctcactga

SEQ ID NO: 560678 - DNA, 16 bp, Homo sapiens
atctccttagaaaagc

SEQ ID NO: 560679 - DNA, 20 bp, Homo sapiens
atctcctttggaaggtgaca

SEQ ID NO: 560680 - DNA, 19 bp, Homo sapiens
atctcgtatagaagtcttc

SEQ ID NO: 560681 - DNA, 18 bp, Homo sapiens
atctcgtatggatttcta

SEQ ID NO: 560682 - DNA, 14 bp, Homo sapiens
atctctaccccttt

SEQ ID NO: 560683 - DNA, 20 bp, Homo sapiens
atctctacccctttcttctc

SEQ ID NO: 560684 - DNA, 20 bp, Homo sapiens
atctctactaaaaatacaaa

SEQ ID NO: 560685 - DNA, 13 bp, Homo sapiens
atctctgaaagca

SEQ ID NO: 560686 - DNA, 13 bp, Homo sapiens
atctcttcttcct

SEQ ID NO: 560687 - DNA, 18 bp, Homo sapiens
atctgaggacaaggaaat

SEQ ID NO: 560688 - DNA, 22 bp, Homo sapiens
atctgatatcaggaaatatctg

SEQ ID NO: 560689 - DNA, 17 bp, Homo sapiens
atctgcaagaacactgg

SEQ ID NO: 560690 - DNA, 13 bp, Homo sapiens
atctggaagagct

SEQ ID NO: 560691 - DNA, 14 bp, Homo sapiens
atctggggagctcc

SEQ ID NO: 560692 - DNA, 18 bp, Homo sapiens
atctggggagctcctggc

SEQ ID NO: 560693 - DNA, 21 bp, Homo sapiens
atctggggagctcctggccag

SEQ ID NO: 560694 - DNA, 15 bp, Homo sapiens
atctgtaagctgttt

SEQ ID NO: 560695 - DNA, 17 bp, Homo sapiens
atctgtaagctgtttgg

SEQ ID NO: 560696 - DNA, 11 bp, Homo sapiens
atctgttgtaa

SEQ ID NO: 560697 - DNA, 13 bp, Homo sapiens
atctgttgtaata

SEQ ID NO: 560698 - DNA, 15 bp, Homo sapiens
atctgttgtaatatc

SEQ ID NO: 560699 - DNA, 15 bp, Homo sapiens
atctgtttgcttcta

SEQ ID NO: 560700 - DNA, 14 bp, Homo sapiens
atcttattaaagtt

SEQ ID NO: 560701 - DNA, 15 bp, Homo sapiens
atcttattaaagttt

SEQ ID NO: 560702 - DNA, 18 bp, Homo sapiens
atcttattaaagtttcaa

SEQ ID NO: 560703 - DNA, 20 bp, Homo sapiens
atcttattaaagtttcaaaa

SEQ ID NO: 560704 - DNA, 22 bp, Homo sapiens
atcttattaaagtttcaaaaat

SEQ ID NO: 560705 - DNA, 20 bp, Homo sapiens
atcttcctctgctaaattga

SEQ ID NO: 560706 - DNA, 18 bp, Homo sapiens
atcttcctggtcgaaagt

SEQ ID NO: 560707 - DNA, 19 bp, Homo sapiens
atcttcctggtcgaaagtt

SEQ ID NO: 560708 - DNA, 23 bp, Homo sapiens
atcttcctggtcgaaagttagta

SEQ ID NO: 560709 - DNA, 13 bp, Homo sapiens
atctttccttcct

SEQ ID NO: 560710 - DNA, 17 bp, Homo sapiens
atctttgaaaactcata

SEQ ID NO: 560711 - DNA, 19 bp, Homo sapiens
atgaaaaccaccctatcat

SEQ ID NO: 560712 - DNA, 15 bp, Homo sapiens
atgaaacagcagctg

SEQ ID NO: 560713 - DNA, 22 bp, Homo sapiens
atgaaacagcagctgaagccag

SEQ ID NO: 560714 - DNA, 21 bp, Homo sapiens
atgaaagctgtttcatttgtg

SEQ ID NO: 560715 - DNA, 14 bp, Homo sapiens
atgaaatgaacaca

SEQ ID NO: 560716 - DNA, 23 bp, Homo sapiens
atgaaatgctatgtcatttcatg

SEQ ID NO: 560717 - DNA, 17 bp, Homo sapiens
atgaaatttaagcacaa

SEQ ID NO: 560718 - DNA, 13 bp, Homo sapiens
atgaacagctctg

SEQ ID NO: 560719 - DNA, 14 bp, Homo sapiens
atgaacagctctga

SEQ ID NO: 560720 - DNA, 16 bp, Homo sapiens
atgaacagctctgaga

SEQ ID NO: 560721 - DNA, 20 bp, Homo sapiens
atgaacagctctgagatcct

SEQ ID NO: 560722 - DNA, 23 bp, Homo sapiens
atgaacagctctgagatcctgga

SEQ ID NO: 560723 - DNA, 22 bp, Homo sapiens
atgaactcaggtttccggctac

SEQ ID NO: 560724 - DNA, 21 bp, Homo sapiens
atgaagttggcacatttcatg

SEQ ID NO: 560725 - DNA, 17 bp, Homo sapiens
atgaatacgagcaagct

SEQ ID NO: 560726 - DNA, 16 bp, Homo sapiens
atgaatagacataaat

SEQ ID NO: 560727 - DNA, 19 bp, Homo sapiens
atgaatagacataaattgt

SEQ ID NO: 560728 - DNA, 14 bp, Homo sapiens
atgaatatttcatt

SEQ ID NO: 560729 - DNA, 20 bp, Homo sapiens
atgaatatttcattttgaga

SEQ ID NO: 560730 - DNA, 14 bp, Homo sapiens
atgacaagtgactt

SEQ ID NO: 560731 - DNA, 13 bp, Homo sapiens
atgaccaatttta

SEQ ID NO: 560732 - DNA, 17 bp, Homo sapiens
atgaccaattttaactt

SEQ ID NO: 560733 - DNA, 13 bp, Homo sapiens
atgacccccccag

SEQ ID NO: 560734 - DNA, 16 bp, Homo sapiens
atgacccgtacacacc

SEQ ID NO: 560735 - DNA, 19 bp, Homo sapiens
atgaccttgtaatgtaact

SEQ ID NO: 560736 - DNA, 15 bp, Homo sapiens
atgactcaaagatga

SEQ ID NO: 560737 - DNA, 16 bp, Homo sapiens
atgactgaaagcactg

SEQ ID NO: 560738 - DNA, 19 bp, Homo sapiens
atgagattggaaaaaatta

SEQ ID NO: 560739 - DNA, 19 bp, Homo sapiens
atgagctcctgctcattgt

SEQ ID NO: 560740 - DNA, 17 bp, Homo sapiens
atgaggatgtatgtgta

SEQ ID NO: 560741 - DNA, 22 bp, Homo sapiens
atgaggggaaagggagaagggt

SEQ ID NO: 560742 - DNA, 19 bp, Homo sapiens
atgagtatatgtaacagtt

SEQ ID NO: 560743 - DNA, 23 bp, Homo sapiens
atgagtatatgtaacagtttaaa

SEQ ID NO: 560744 - DNA, 15 bp, Homo sapiens
atgatatgtctttaa

SEQ ID NO: 560745 - DNA, 23 bp, Homo sapiens
atgatcaaggagggagaaaggca

SEQ ID NO: 560746 - DNA, 17 bp, Homo sapiens
atgatccagagcagagt

SEQ ID NO: 560747 - DNA, 12 bp, Homo sapiens
atgatgttctga

SEQ ID NO: 560748 - DNA, 17 bp, Homo sapiens
atgatgttctgaaatgg

SEQ ID NO: 560749 - DNA, 20 bp, Homo sapiens
atgatgtttttaaaatctta

SEQ ID NO: 560750 - DNA, 21 bp, Homo sapiens
atgatgtttttaaaatcttat

SEQ ID NO: 560751 - DNA, 14 bp, Homo sapiens
atgattgcttttaa

SEQ ID NO: 560752 - DNA, 15 bp, Homo sapiens
atgattgcttttaaa

SEQ ID NO: 560753 - DNA, 17 bp, Homo sapiens
atgattgcttttaaaat

SEQ ID NO: 560754 - DNA, 12 bp, Homo sapiens
atgatttaacat

SEQ ID NO: 560755 - DNA, 13 bp, Homo sapiens
atgatttaacatt

SEQ ID NO: 560756 - DNA, 17 bp, Homo sapiens
atgatttcacaaatatt

SEQ ID NO: 560757 - DNA, 23 bp, Homo sapiens
atgatttcacaaatattaaaaag

SEQ ID NO: 560758 - DNA, 19 bp, Homo sapiens
atgattttttaaaagaaat

SEQ ID NO: 560759 - DNA, 17 bp, Homo sapiens
atgcaatttacttggaa

SEQ ID NO: 560760 - DNA, 21 bp, Homo sapiens
atgcacatccattcccaagaa

SEQ ID NO: 560761 - DNA, 19 bp, Homo sapiens
atgcacccgcatgtacaaa

SEQ ID NO: 560762 - DNA, 20 bp, Homo sapiens
atgcactatatgtttacaca

SEQ ID NO: 560763 - DNA, 14 bp, Homo sapiens
atgcagctcttcct

SEQ ID NO: 560764 - DNA, 17 bp, Homo sapiens
atgcaggcaggtgtgaa

SEQ ID NO: 560765 - DNA, 21 bp, Homo sapiens
atgcataataatcctgcaaag

SEQ ID NO: 560766 - DNA, 18 bp, Homo sapiens
atgcatgcactcttttga

SEQ ID NO: 560767 - DNA, 19 bp, Homo sapiens
atgcatgctttccatattt

SEQ ID NO: 560768 - DNA, 18 bp, Homo sapiens
atgcatttaagttgtaaa

SEQ ID NO: 560769 - DNA, 22 bp, Homo sapiens
atgccagaaggaatcttctcat

SEQ ID NO: 560770 - DNA, 14 bp, Homo sapiens
atgccccaaatata

SEQ ID NO: 560771 - DNA, 19 bp, Homo sapiens
atgccctccctgctgccag

SEQ ID NO: 560772 - DNA, 16 bp, Homo sapiens
atgcctgcggagttgt

SEQ ID NO: 560773 - DNA, 12 bp, Homo sapiens
atgcctgctctt

SEQ ID NO: 560774 - DNA, 17 bp, Homo sapiens
atgcctggtgagcatta

SEQ ID NO: 560775 - DNA, 22 bp, Homo sapiens
atgcctttatttctgtatctga

SEQ ID NO: 560776 - DNA, 19 bp, Homo sapiens
atgcctttctagcaattgc

SEQ ID NO: 560777 - DNA, 18 bp, Homo sapiens
atgccttttgtagctgtc

SEQ ID NO: 560778 - DNA, 19 bp, Homo sapiens
atgccttttgtagctgtca

SEQ ID NO: 560779 - DNA, 13 bp, Homo sapiens
atgcggccggcct

SEQ ID NO: 560780 - DNA, 19 bp, Homo sapiens
atgcgggctgggcagctgt

SEQ ID NO: 560781 - DNA, 13 bp, Homo sapiens
atgctaagaattt

SEQ ID NO: 560782 - DNA, 16 bp, Homo sapiens
atgctaagaatttttt

SEQ ID NO: 560783 - DNA, 16 bp, Homo sapiens
atgctactcagtatat

SEQ ID NO: 560784 - DNA, 18 bp, Homo sapiens
atgctatctcgctagcca

SEQ ID NO: 560785 - DNA, 19 bp, Homo sapiens
atgctatctcgctagccat

SEQ ID NO: 560786 - DNA, 19 bp, Homo sapiens
atttttctcagtttgtata

SEQ ID NO: 560787 - DNA, 14 bp, Homo sapiens
attttttaaaagaa

SEQ ID NO: 560788 - DNA, 18 bp, Homo sapiens
attttttgcatcagtatt

SEQ ID NO: 560789 - DNA, 16 bp, Homo sapiens
attttttgtctgtgat

SEQ ID NO: 560790 - DNA, 19 bp, Homo sapiens
atttttttccttacataaa

SEQ ID NO: 560791 - DNA, 15 bp, Homo sapiens
attttttttcttcca

SEQ ID NO: 560792 - DNA, 16 bp, Homo sapiens
atttttttttctttca

SEQ ID NO: 560793 - DNA, 21 bp, Homo sapiens
caaaaaaagcaacttttccaa

SEQ ID NO: 560794 - DNA, 12 bp, Homo sapiens
caaaaaaagttg

SEQ ID NO: 560795 - DNA, 14 bp, Homo sapiens
caaaaaaagttgta

SEQ ID NO: 560796 - DNA, 16 bp, Homo sapiens
caaaaaaagttgtatg

SEQ ID NO: 560797 - DNA, 18 bp, Homo sapiens
caaaaaaagttgtatgat

SEQ ID NO: 560798 - DNA, 21 bp, Homo sapiens
caaaaaaagttgtatgatctg

SEQ ID NO: 560799 - DNA, 15 bp, Homo sapiens
caaaaaatttaagag

SEQ ID NO: 560800 - DNA, 17 bp, Homo sapiens
caaaaacgaaagctggg

SEQ ID NO: 560801 - DNA, 14 bp, Homo sapiens
atgctatgtcattt

SEQ ID NO: 560802 - DNA, 16 bp, Homo sapiens
atgctcccctgtgcca

SEQ ID NO: 560803 - DNA, 17 bp, Homo sapiens
atgctcccctgtgccag

SEQ ID NO: 560804 - DNA, 12 bp, Homo sapiens
atgctctttccc

SEQ ID NO: 560805 - DNA, 15 bp, Homo sapiens
atgctctttcccacc

SEQ ID NO: 560806 - DNA, 14 bp, Homo sapiens
atgctgggaccctc

SEQ ID NO: 560807 - DNA, 17 bp, Homo sapiens
atgctgtactaaaatat

SEQ ID NO: 560808 - DNA, 21 bp, Homo sapiens
atgcttagcttatctttcttt

SEQ ID NO: 560809 - DNA, 23 bp, Homo sapiens
atgcttagcttatctttctttcc

SEQ ID NO: 560810 - DNA, 13 bp, Homo sapiens
atgcttccagaaa

SEQ ID NO: 560811 - DNA, 14 bp, Homo sapiens
atgcttccagaaac

SEQ ID NO: 560812 - DNA, 23 bp, Homo sapiens
atggaactcagctgtctgtggct

SEQ ID NO: 560813 - DNA, 22 bp, Homo sapiens
atggaagacaaatacacataca

SEQ ID NO: 560814 - DNA, 15 bp, Homo sapiens
atggaagagaaatct

SEQ ID NO: 560815 - DNA, 15 bp, Homo sapiens
atggaagccacatca

SEQ ID NO: 560816 - DNA, 19 bp, Homo sapiens
atggaagggccttctccac

SEQ ID NO: 560817 - DNA, 21 bp, Homo sapiens
atggactacagtagctcacgt

SEQ ID NO: 560818 - DNA, 15 bp, Homo sapiens
atggagcctcttctg

SEQ ID NO: 560819 - DNA, 17 bp, Homo sapiens
atggaggagagtgttta

SEQ ID NO: 560820 - DNA, 12 bp, Homo sapiens
atggaggcacac

SEQ ID NO: 560821 - DNA, 19 bp, Homo sapiens
atggaggcacacagctgca

SEQ ID NO: 560822 - DNA, 20 bp, Homo sapiens
atggagtagagtcaggagaa

SEQ ID NO: 560823 - DNA, 18 bp, Homo sapiens
atggagttggagttcatt

SEQ ID NO: 560824 - DNA, 23 bp, Homo sapiens
atggagttggagttcattcatat

SEQ ID NO: 560825 - DNA, 17 bp, Homo sapiens
atggatacttcctgggt

SEQ ID NO: 560826 - DNA, 14 bp, Homo sapiens
atggatagattgtt

SEQ ID NO: 560827 - DNA, 20 bp, Homo sapiens
atggatttctgtcttctcta

SEQ ID NO: 560828 - DNA, 17 bp, Homo sapiens
atggcaacaaactgcac

SEQ ID NO: 560829 - DNA, 20 bp, Homo sapiens
atggcaacaaactgcacatg

SEQ ID NO: 560830 - DNA, 23 bp, Homo sapiens
atggcaagttttgatatgagtat

SEQ ID NO: 560831 - DNA, 14 bp, Homo sapiens
atggcacaatgaat

SEQ ID NO: 560832 - DNA, 18 bp, Homo sapiens
atggcacaatgaatgtat

SEQ ID NO: 560833 - DNA, 20 bp, Homo sapiens
atggcacagggcatgaaatg

SEQ ID NO: 560834 - DNA, 15 bp, Homo sapiens
atggcccccagaggc

SEQ ID NO: 560835 - DNA, 19 bp, Homo sapiens
atggcctcttaaaaattat

SEQ ID NO: 560836 - DNA, 19 bp, Homo sapiens
atgggagtcagggagccct

SEQ ID NO: 560837 - DNA, 13 bp, Homo sapiens
atgggcacaggct

SEQ ID NO: 560838 - DNA, 17 bp, Homo sapiens
atggggctttcctgatg

SEQ ID NO: 560839 - DNA, 15 bp, Homo sapiens
atgggggaacaatga

SEQ ID NO: 560840 - DNA, 13 bp, Homo sapiens
atgggggagaggg

SEQ ID NO: 560841 - DNA, 16 bp, Homo sapiens
atggggttgggctctg

SEQ ID NO: 560842 - DNA, 19 bp, Homo sapiens
atgggtatacctctaactg

SEQ ID NO: 560843 - DNA, 18 bp, Homo sapiens
atgggtatcatgcttcta

SEQ ID NO: 560844 - DNA, 15 bp, Homo sapiens
atggtaatcatatta

SEQ ID NO: 560845 - DNA, 20 bp, Homo sapiens
atggtaatttagtgtatatg

SEQ ID NO: 560846 - DNA, 18 bp, Homo sapiens
atggtagaaattttatct

SEQ ID NO: 560847 - DNA, 23 bp, Homo sapiens
atggtagaaattttatctcttct

SEQ ID NO: 560848 - DNA, 17 bp, Homo sapiens
atggtatatattttgaa

SEQ ID NO: 560849 - DNA, 18 bp, Homo sapiens
atggtcagacacaaacaa

SEQ ID NO: 560850 - DNA, 16 bp, Homo sapiens
atggtctaatgtttaa

SEQ ID NO: 560851 - DNA, 20 bp, Homo sapiens
atggtctggcaatattctgt

SEQ ID NO: 560852 - DNA, 20 bp, Homo sapiens
atggtgaactgaagcagagt

SEQ ID NO: 560853 - DNA, 18 bp, Homo sapiens
atggtgcaatttgtcttt

SEQ ID NO: 560854 - DNA, 16 bp, Homo sapiens
atgtaaactttaactt

SEQ ID NO: 560855 - DNA, 22 bp, Homo sapiens
atgtaaactttaacttccactt

SEQ ID NO: 560856 - DNA, 14 bp, Homo sapiens
atgtaacagtttaa

SEQ ID NO: 560857 - DNA, 15 bp, Homo sapiens
atgtaacagtttaaa

SEQ ID NO: 560858 - DNA, 13 bp, Homo sapiens
atgtaactgttac

SEQ ID NO: 560859 - DNA, 22 bp, Homo sapiens
atgtaactgttaccattggaaa

SEQ ID NO: 560860 - DNA, 15 bp, Homo sapiens
atgtaacttgttgca

SEQ ID NO: 560861 - DNA, 13 bp, Homo sapiens
atgtaagaagccc

SEQ ID NO: 560862 - DNA, 15 bp, Homo sapiens
atgtacaaaaacaca

SEQ ID NO: 560863 - DNA, 16 bp, Homo sapiens
atgtacaaaaacacaa

SEQ ID NO: 560864 - DNA, 23 bp, Homo sapiens
atgtacatctcccctttgctaac

SEQ ID NO: 560865 - DNA, 19 bp, Homo sapiens
atgtagactatatacatgt

SEQ ID NO: 560866 - DNA, 19 bp, Homo sapiens
atgtagattaaggtgatgt

SEQ ID NO: 560867 - DNA, 23 bp, Homo sapiens
atgtagcaaaccctgtcaaacat

SEQ ID NO: 560868 - DNA, 21 bp, Homo sapiens
atgtatacgcacgcacccaca

SEQ ID NO: 560869 - DNA, 14 bp, Homo sapiens
atgtatagtatttg

SEQ ID NO: 560870 - DNA, 17 bp, Homo sapiens
atgtatagtatttgaaa

SEQ ID NO: 560871 - DNA, 15 bp, Homo sapiens
atgtatatacacata

SEQ ID NO: 560872 - DNA, 13 bp, Homo sapiens
atgtatgcataat

SEQ ID NO: 560873 - DNA, 15 bp, Homo sapiens
atgtattctcttcta

SEQ ID NO: 560874 - DNA, 22 bp, Homo sapiens
atgtatttctttagaacaacat

SEQ ID NO: 560875 - DNA, 23 bp, Homo sapiens
atgtatttctttagaacaacata

SEQ ID NO: 560876 - DNA, 14 bp, Homo sapiens
atgtattttatgta

SEQ ID NO: 560877 - DNA, 15 bp, Homo sapiens
atgtcactgttataa

SEQ ID NO: 560878 - DNA, 16 bp, Homo sapiens
atgtcattaatgtgtt

SEQ ID NO: 560879 - DNA, 21 bp, Homo sapiens
atgtccaaacttaacagatca

SEQ ID NO: 560880 - DNA, 23 bp, Homo sapiens
atgtccccaaagtaccacactga

SEQ ID NO: 560881 - DNA, 21 bp, Homo sapiens
atgtcctgtgtcagtttatgt

SEQ ID NO: 560882 - DNA, 13 bp, Homo sapiens
atgtctactgaag

SEQ ID NO: 560883 - DNA, 22 bp, Homo sapiens
atgtctgtaataaataaatata

SEQ ID NO: 560884 - DNA, 15 bp, Homo sapiens
atgtctttaaaatga

SEQ ID NO: 560885 - DNA, 16 bp, Homo sapiens
atgtctttaaaatgat

SEQ ID NO: 560886 - DNA, 16 bp, Homo sapiens
atgtgaactttctcag

SEQ ID NO: 560887 - DNA, 21 bp, Homo sapiens
atgtgaactttctcagcatat

SEQ ID NO: 560888 - DNA, 16 bp, Homo sapiens
atgtgaattactaact

SEQ ID NO: 560889 - DNA, 22 bp, Homo sapiens
atgtgaattactaacttctaaa

SEQ ID NO: 560890 - DNA, 13 bp, Homo sapiens
atgtgacatttgt

SEQ ID NO: 560891 - DNA, 15 bp, Homo sapiens
atgtgacatttgtca

SEQ ID NO: 560892 - DNA, 18 bp, Homo sapiens
atgtgacatttgtcattt

SEQ ID NO: 560893 - DNA, 23 bp, Homo sapiens
atgtgacatttgtcattttcatt

SEQ ID NO: 560894 - DNA, 15 bp, Homo sapiens
atgtgagctgctgcc

SEQ ID NO: 560895 - DNA, 16 bp, Homo sapiens
atgtgatggatggcac

SEQ ID NO: 560896 - DNA, 19 bp, Homo sapiens
atgtgatggatggcacaat

SEQ ID NO: 560897 - DNA, 13 bp, Homo sapiens
atgtgatgtaact

SEQ ID NO: 560898 - DNA, 14 bp, Homo sapiens
atgtgattttcaaa

SEQ ID NO: 560899 - DNA, 18 bp, Homo sapiens
atgtgattttcaaatatg

SEQ ID NO: 560900 - DNA, 19 bp, Homo sapiens
atgtgattttcaaatatgt

SEQ ID NO: 560901 - DNA, 13 bp, Homo sapiens
atgtggacatgca

SEQ ID NO: 560902 - DNA, 18 bp, Homo sapiens
atgtggatggaggtgatg

SEQ ID NO: 560903 - DNA, 16 bp, Homo sapiens
atgtggcctaatattg

SEQ ID NO: 560904 - DNA, 17 bp, Homo sapiens
atgtggcctaatattga

SEQ ID NO: 560905 - DNA, 13 bp, Homo sapiens
atgtgtaaaattg

SEQ ID NO: 560906 - DNA, 12 bp, Homo sapiens
atgtgtaatttt

SEQ ID NO: 560907 - DNA, 20 bp, Homo sapiens
atgtgtaatttttctgtata

SEQ ID NO: 560908 - DNA, 22 bp, Homo sapiens
atgtgtaatttttctgtataga

SEQ ID NO: 560909 - DNA, 17 bp, Homo sapiens
atgtgtatatatacata

SEQ ID NO: 560910 - DNA, 20 bp, Homo sapiens
atgtgtatatgtttatacac

SEQ ID NO: 560911 - DNA, 21 bp, Homo sapiens
atgtgtatatgtttatacaca

SEQ ID NO: 560912 - DNA, 23 bp, Homo sapiens
atgtgtatatgtttatacacaca

SEQ ID NO: 560913 - DNA, 18 bp, Homo sapiens
atgtgtgtatatatgtgt

SEQ ID NO: 560914 - DNA, 20 bp, Homo sapiens
atgtgtgtatatatgtgtat

SEQ ID NO: 560915 - DNA, 16 bp, Homo sapiens
atgtgtgtatgtgtat

SEQ ID NO: 560916 - DNA, 18 bp, Homo sapiens
atgtgtgtgatgtgacat

SEQ ID NO: 560917 - DNA, 19 bp, Homo sapiens
atgtgttgccactttccaa

SEQ ID NO: 560918 - DNA, 15 bp, Homo sapiens
atgtgttgctctcca

SEQ ID NO: 560919 - DNA, 16 bp, Homo sapiens
atgttaacagtatttt

SEQ ID NO: 560920 - DNA, 15 bp, Homo sapiens
atgttcccacttcaa

SEQ ID NO: 560921 - DNA, 19 bp, Homo sapiens
atgttctgacagcatttca

SEQ ID NO: 560922 - DNA, 13 bp, Homo sapiens
atgttcttccagt

SEQ ID NO: 560923 - DNA, 13 bp, Homo sapiens
atgttgacatttg

SEQ ID NO: 560924 - DNA, 14 bp, Homo sapiens
atgttgacatttgt

SEQ ID NO: 560925 - DNA, 14 bp, Homo sapiens
atgttgatgcaatc

SEQ ID NO: 560926 - DNA, 21 bp, Homo sapiens
atgttgatgcaatccttacaa

SEQ ID NO: 560927 - DNA, 13 bp, Homo sapiens
atgttgatttcta

SEQ ID NO: 560928 - DNA, 16 bp, Homo sapiens
atgttgtaatattttg

SEQ ID NO: 560929 - DNA, 22 bp, Homo sapiens
atgtttaaaatggcatttagca

SEQ ID NO: 560930 - DNA, 14 bp, Homo sapiens
atgtttaaagtaat

SEQ ID NO: 560931 - DNA, 21 bp, Homo sapiens
atgtttaaagtaattgttcca

SEQ ID NO: 560932 - DNA, 21 bp, Homo sapiens
atgtttaagcagaattggaaa

SEQ ID NO: 560933 - DNA, 23 bp, Homo sapiens
atgtttccaggcatgaccctgga

SEQ ID NO: 560934 - DNA, 12 bp, Homo sapiens
atgtttgatgtc

SEQ ID NO: 560935 - DNA, 13 bp, Homo sapiens
atgttttcaaatg

SEQ ID NO: 560936 - DNA, 15 bp, Homo sapiens
atgttttcaaatgga

SEQ ID NO: 560937 - DNA, 19 bp, Homo sapiens
atgttttcagctaggaaca

SEQ ID NO: 560938 - DNA, 17 bp, Homo sapiens
atgttttggtccacttt

SEQ ID NO: 560939 - DNA, 22 bp, Homo sapiens
atgttttggtccacttttccag

SEQ ID NO: 560940 - DNA, 16 bp, Homo sapiens
atgttttgtaaacttt

SEQ ID NO: 560941 - DNA, 21 bp, Homo sapiens
atgttttgtaaactttgaaat

SEQ ID NO: 560942 - DNA, 15 bp, Homo sapiens
atgtttttaaaatct

SEQ ID NO: 560943 - DNA, 20 bp, Homo sapiens
caaaaagataccttaaaatt

SEQ ID NO: 560944 - DNA, 22 bp, Homo sapiens
caaaaagataccttaaaatttg

SEQ ID NO: 560945 - DNA, 15 bp, Homo sapiens
caaaaatataaaata

SEQ ID NO: 560946 - DNA, 15 bp, Homo sapiens
caaaaatctgaagat

SEQ ID NO: 560947 - DNA, 20 bp, Homo sapiens
caaaacacctgacagcccct

SEQ ID NO: 560948 - DNA, 12 bp, Homo sapiens
caaaactgctcc

SEQ ID NO: 560949 - DNA, 12 bp, Homo sapiens
caaaagaaaaac

SEQ ID NO: 560950 - DNA, 12 bp, Homo sapiens
caaaagagaaaa

SEQ ID NO: 560951 - DNA, 21 bp, Homo sapiens
caaaaggcatttcccaccctg

SEQ ID NO: 560952 - DNA, 17 bp, Homo sapiens
caaaagtatcgggggct

SEQ ID NO: 560953 - DNA, 18 bp, Homo sapiens
caaaagtatcgggggctg

SEQ ID NO: 560954 - DNA, 19 bp, Homo sapiens
caaaataaaaagtgacaca

SEQ ID NO: 560955 - DNA, 18 bp, Homo sapiens
caaaataaagtctgtcat

SEQ ID NO: 560956 - DNA, 20 bp, Homo sapiens
caaaataaagtctgtcatgc

SEQ ID NO: 560957 - DNA, 16 bp, Homo sapiens
caaaatgattgtcttt

SEQ ID NO: 560958 - DNA, 14 bp, Homo sapiens
caaaatgtaactgt

SEQ ID NO: 560959 - DNA, 15 bp, Homo sapiens
caaaatgtaactgtt

SEQ ID NO: 560960 - DNA, 18 bp, Homo sapiens
caaacaagcatataaaat

SEQ ID NO: 560961 - DNA, 21 bp, Homo sapiens
caaacaaggggctgttacata

SEQ ID NO: 560962 - DNA, 19 bp, Homo sapiens
caaacatgaggttctctct

SEQ ID NO: 560963 - DNA, 21 bp, Homo sapiens
caaacattaatgttgatttct

SEQ ID NO: 560964 - DNA, 15 bp, Homo sapiens
caaacattagtactt

SEQ ID NO: 560965 - DNA, 18 bp, Homo sapiens
caaacattagtactttat

SEQ ID NO: 560966 - DNA, 19 bp, Homo sapiens
caaacattagtactttata

SEQ ID NO: 560967 - DNA, 13 bp, Homo sapiens
caaacccaaagat

SEQ ID NO: 560968 - DNA, 14 bp, Homo sapiens
caaacccaaagatg

SEQ ID NO: 560969 - DNA, 13 bp, Homo sapiens
caaaccctgtcaa

SEQ ID NO: 560970 - DNA, 12 bp, Homo sapiens
caaacctggaga

SEQ ID NO: 560971 - DNA, 14 bp, Homo sapiens
caaacgaaatggct

SEQ ID NO: 560972 - DNA, 18 bp, Homo sapiens
caaactgcacatgatttc

SEQ ID NO: 560973 - DNA, 14 bp, Homo sapiens
caaagacaaatagt

SEQ ID NO: 560974 - DNA, 23 bp, Homo sapiens
caaagacaaatagtaggcaagat

SEQ ID NO: 560975 - DNA, 20 bp, Homo sapiens
caaagacttcatttaacact

SEQ ID NO: 560976 - DNA, 11 bp, Homo sapiens
caaagagatgg

SEQ ID NO: 560977 - DNA, 15 bp, Homo sapiens
caaagatcaaaataa

SEQ ID NO: 560978 - DNA, 18 bp, Homo sapiens
caaagatcaaaataaaaa

SEQ ID NO: 560979 - DNA, 19 bp, Homo sapiens
caaagcacatgcttagctt

SEQ ID NO: 560980 - DNA, 22 bp, Homo sapiens
caaagcacatgcttagcttatc

SEQ ID NO: 560981 - DNA, 21 bp, Homo sapiens
caaagcagagtgaaattcaat

SEQ ID NO: 560982 - DNA, 16 bp, Homo sapiens
caaagccctccctgtc

SEQ ID NO: 560983 - DNA, 17 bp, Homo sapiens
caaagctgttcttcctg

SEQ ID NO: 560984 - DNA, 20 bp, Homo sapiens
caaagcttcccgattaactg

SEQ ID NO: 560985 - DNA, 17 bp, Homo sapiens
caaaggacattatgtgt

SEQ ID NO: 560986 - DNA, 18 bp, Homo sapiens
caaaggacattatgtgtg

SEQ ID NO: 560987 - DNA, 22 bp, Homo sapiens
caaaggagctttctcaatgtct

SEQ ID NO: 560988 - DNA, 16 bp, Homo sapiens
caaaggccaacagcat

SEQ ID NO: 560989 - DNA, 13 bp, Homo sapiens
caaaggtcttttt

SEQ ID NO: 560990 - DNA, 20 bp, Homo sapiens
caaaggtctttttaaaccag

SEQ ID NO: 560991 - DNA, 19 bp, Homo sapiens
caaagtacaggtactttgt

SEQ ID NO: 560992 - DNA, 20 bp, Homo sapiens
caaagtacaggtactttgtc

SEQ ID NO: 560993 - DNA, 17 bp, Homo sapiens
caaagtcatgatgtttt

SEQ ID NO: 560994 - DNA, 22 bp, Homo sapiens
caaagtcatgatgtttttaaaa

SEQ ID NO: 560995 - DNA, 21 bp, Homo sapiens
caaagttaaacgtgatgtgct

SEQ ID NO: 560996 - DNA, 13 bp, Homo sapiens
caaagttatccag

SEQ ID NO: 560997 - DNA, 16 bp, Homo sapiens
caaataacaacttttt

SEQ ID NO: 560998 - DNA, 15 bp, Homo sapiens
caaatattttgtcac

SEQ ID NO: 560999 - DNA, 21 bp, Homo sapiens
caaatattttgtcactgctgt

SEQ ID NO: 561000 - DNA, 22 bp, Homo sapiens
caaatcctgggcatccccagcc

SEQ ID NO: 561001 - DNA, 13 bp, Homo sapiens
caaatcttcctgg

SEQ ID NO: 561002 - DNA, 15 bp, Homo sapiens
caaatgattgctttt

SEQ ID NO: 561003 - DNA, 22 bp, Homo sapiens
caaatgattgcttttaaaattt

SEQ ID NO: 561004 - DNA, 15 bp, Homo sapiens
caaatgctactcagt

SEQ ID NO: 561005 - DNA, 16 bp, Homo sapiens
caaatgctactcagta

SEQ ID NO: 561006 - DNA, 19 bp, Homo sapiens
caaatggagttggagttca

SEQ ID NO: 561007 - DNA, 21 bp, Homo sapiens
caaatggtggttgtttcttcc

SEQ ID NO: 561008 - DNA, 13 bp, Homo sapiens
caaatgtacatct

SEQ ID NO: 561009 - DNA, 21 bp, Homo sapiens
caaatgttattcaataactat

SEQ ID NO: 561010 - DNA, 15 bp, Homo sapiens
caaattaatgtgtaa

SEQ ID NO: 561011 - DNA, 20 bp, Homo sapiens
caaattatgctaagaatttt

SEQ ID NO: 561012 - DNA, 21 bp, Homo sapiens
caaattgtcacctgcttctct

SEQ ID NO: 561013 - DNA, 19 bp, Homo sapiens
caacaaactcaaaatgtgg

SEQ ID NO: 561014 - DNA, 22 bp, Homo sapiens
caacaaactgcacatgatttca

SEQ ID NO: 561015 - DNA, 14 bp, Homo sapiens
caacaaagaaatat

SEQ ID NO: 561016 - DNA, 18 bp, Homo sapiens
caacaagaataaaggcag

SEQ ID NO: 561017 - DNA, 16 bp, Homo sapiens
caacaaggcaaaaaca

SEQ ID NO: 561018 - DNA, 19 bp, Homo sapiens
caacaaggcttgctgcaga

SEQ ID NO: 561019 - DNA, 12 bp, Homo sapiens
caacaattttca

SEQ ID NO: 561020 - DNA, 18 bp, Homo sapiens
caacaattttcagatttg

SEQ ID NO: 561021 - DNA, 19 bp, Homo sapiens
caacaattttcagatttgc

SEQ ID NO: 561022 - DNA, 17 bp, Homo sapiens
caacacattgaaactgt

SEQ ID NO: 561023 - DNA, 12 bp, Homo sapiens
caacaccacaga

SEQ ID NO: 561024 - DNA, 18 bp, Homo sapiens
caacaccacagacacaca

SEQ ID NO: 561025 - DNA, 19 bp, Homo sapiens
caacaccacagacacacac

SEQ ID NO: 561026 - DNA, 14 bp, Homo sapiens
caacagcaaattaa

SEQ ID NO: 561027 - DNA, 22 bp, Homo sapiens
caacagcaaattaatgtgtaaa

SEQ ID NO: 561028 - DNA, 14 bp, Homo sapiens
caacatacaattta

SEQ ID NO: 561029 - DNA, 9 bp, Homo sapiens
caacatgtg

SEQ ID NO: 561030 - DNA, 21 bp, Homo sapiens
caaccacacttgtcggctcca

SEQ ID NO: 561031 - DNA, 13 bp, Homo sapiens
caaccatgttctt

SEQ ID NO: 561032 - DNA, 18 bp, Homo sapiens
caacccaaacctggagat

SEQ ID NO: 561033 - DNA, 15 bp, Homo sapiens
caacccccagctccc

SEQ ID NO: 561034 - DNA, 21 bp, Homo sapiens
caacctcccctggtcctgcac

SEQ ID NO: 561035 - DNA, 16 bp, Homo sapiens
caacctgacagcaaac

SEQ ID NO: 561036 - DNA, 23 bp, Homo sapiens
caacctgacagcaaacacagtca

SEQ ID NO: 561037 - DNA, 21 bp, Homo sapiens
caacctgttcacgtgactcct

SEQ ID NO: 561038 - DNA, 12 bp, Homo sapiens
caacctttatag

SEQ ID NO: 561039 - DNA, 17 bp, Homo sapiens
cacagcctcatcagtat

SEQ ID NO: 561040 - DNA, 13 bp, Homo sapiens
cacagctcccttc

SEQ ID NO: 561041 - DNA, 22 bp, Homo sapiens
cacagctccttttccagagcat

SEQ ID NO: 561042 - DNA, 21 bp, Homo sapiens
cacaggagacactgtgctata

SEQ ID NO: 561043 - DNA, 19 bp, Homo sapiens
cacaggatggtctctgcca

SEQ ID NO: 561044 - DNA, 18 bp, Homo sapiens
cacaggccaccctgtgca

SEQ ID NO: 561045 - DNA, 13 bp, Homo sapiens
cacaggctgcccc

SEQ ID NO: 561046 - DNA, 19 bp, Homo sapiens
cacaggctgccccacccct

SEQ ID NO: 561047 - DNA, 19 bp, Homo sapiens
cacagtgtaccattaaaat

SEQ ID NO: 561048 - DNA, 21 bp, Homo sapiens
cacagtgtaccattaaaatat

SEQ ID NO: 561049 - DNA, 16 bp, Homo sapiens
cacagtgtctgtaaat

SEQ ID NO: 561050 - DNA, 19 bp, Homo sapiens
cacagtgtctgtaaatcaa

SEQ ID NO: 561051 - DNA, 20 bp, Homo sapiens
cacagtttgatgtcattaat

SEQ ID NO: 561052 - DNA, 23 bp, Homo sapiens
cacatagctacccaaaagagaaa

SEQ ID NO: 561053 - DNA, 20 bp, Homo sapiens
cacatagttctccagttgta

SEQ ID NO: 561054 - DNA, 18 bp, Homo sapiens
cacatatacctataatgt

SEQ ID NO: 561055 - DNA, 23 bp, Homo sapiens
cacatcactattgggcccccagg

SEQ ID NO: 561056 - DNA, 14 bp, Homo sapiens
cacatcatctgtaa

SEQ ID NO: 561057 - DNA, 13 bp, Homo sapiens
cacatccattccc

SEQ ID NO: 561058 - DNA, 22 bp, Homo sapiens
cacatccattcccaagaaatgc

SEQ ID NO: 561059 - DNA, 13 bp, Homo sapiens
cacatcccacccc

SEQ ID NO: 561060 - DNA, 20 bp, Homo sapiens
cacatccggggccagctccg

SEQ ID NO: 561061 - DNA, 21 bp, Homo sapiens
cacatctctgaaagcacagga

SEQ ID NO: 561062 - DNA, 14 bp, Homo sapiens
cacatcttccacag

SEQ ID NO: 561063 - DNA, 14 bp, Homo sapiens
cacatgatttcaca

SEQ ID NO: 561064 - DNA, 19 bp, Homo sapiens
cacatgatttcacaaatat

SEQ ID NO: 561065 - DNA, 14 bp, Homo sapiens
cacatgcacacaca

SEQ ID NO: 561066 - DNA, 14 bp, Homo sapiens
cacatgcccctctt

SEQ ID NO: 561067 - DNA, 19 bp, Homo sapiens
cacatgcccctcttagaag

SEQ ID NO: 561068 - DNA, 22 bp, Homo sapiens
cacatgtgagcatgtcacttcc

SEQ ID NO: 561069 - DNA, 16 bp, Homo sapiens
cacattgaaactgtat

SEQ ID NO: 561070 - DNA, 19 bp, Homo sapiens
cacattgaaactgtattta

SEQ ID NO: 561071 - DNA, 21 bp, Homo sapiens
cacattgcccacacctgcctc

SEQ ID NO: 561072 - DNA, 16 bp, Homo sapiens
cacatttcactgtctg

SEQ ID NO: 561073 - DNA, 12 bp, Homo sapiens
caccacagacac

SEQ ID NO: 561074 - DNA, 15 bp, Homo sapiens
caccacagacacaca

SEQ ID NO: 561075 - DNA, 13 bp, Homo sapiens
caccactccattc

SEQ ID NO: 561076 - DNA, 15 bp, Homo sapiens
caccactccattccc

SEQ ID NO: 561077 - DNA, 16 bp, Homo sapiens
caccactccattccca

SEQ ID NO: 561078 - DNA, 15 bp, Homo sapiens
caccaggccatcagc

SEQ ID NO: 561079 - DNA, 22 bp, Homo sapiens
caccagggccaaaagcttccct

SEQ ID NO: 561080 - DNA, 17 bp, Homo sapiens
caccagttgctgctgcc

SEQ ID NO: 561081 - DNA, 22 bp, Homo sapiens
cacccaccttgacgtttcttct

SEQ ID NO: 561082 - DNA, 14 bp, Homo sapiens
cacccagccccagc

SEQ ID NO: 561083 - DNA, 18 bp, Homo sapiens
cacccagccccagcgagt

SEQ ID NO: 561084 - DNA, 23 bp, Homo sapiens
cacccagccccagcgagtctgga

SEQ ID NO: 561085 - DNA, 21 bp, Homo sapiens
cacccagggaactaggaaggc

SEQ ID NO: 561086 - DNA, 12 bp, Homo sapiens
cacccccttggt

SEQ ID NO: 561087 - DNA, 21 bp, Homo sapiens
cacccggcagccccccagtgt

SEQ ID NO: 561088 - DNA, 17 bp, Homo sapiens
cacccgtggtggctcaa

SEQ ID NO: 561089 - DNA, 13 bp, Homo sapiens
caccctacagcag

SEQ ID NO: 561090 - DNA, 19 bp, Homo sapiens
caccctacagcagatccac

SEQ ID NO: 561091 - DNA, 21 bp, Homo sapiens
caccctagctttatattttgt

SEQ ID NO: 561092 - DNA, 23 bp, Homo sapiens
agatggcacagggcatgaaatga

SEQ ID NO: 561093 - DNA, 21 bp, Homo sapiens
agatggcgcacccggcagccc

SEQ ID NO: 561094 - DNA, 23 bp, Homo sapiens
agatggcgcacccggcagccccc

SEQ ID NO: 561095 - DNA, 18 bp, Homo sapiens
agatgggggcctctttca

SEQ ID NO: 561096 - DNA, 17 bp, Homo sapiens
agatgtaagaagctaaa

SEQ ID NO: 561097 - DNA, 15 bp, Homo sapiens
agatgtggacatgca

SEQ ID NO: 561098 - DNA, 17 bp, Homo sapiens
agatgtggacatgcacc

SEQ ID NO: 561099 - DNA, 19 bp, Homo sapiens
agatgttaacagtatttta

SEQ ID NO: 561100 - DNA, 15 bp, Homo sapiens
agatgttttagttta

SEQ ID NO: 561101 - DNA, 17 bp, Homo sapiens
agattcccagcttccag

SEQ ID NO: 561102 - DNA, 20 bp, Homo sapiens
agattcccagcttccagatg

SEQ ID NO: 561103 - DNA, 20 bp, Homo sapiens
agattctaggacctgtgtcc

SEQ ID NO: 561104 - DNA, 19 bp, Homo sapiens
agattgaagctaaaacact

SEQ ID NO: 561105 - DNA, 22 bp, Homo sapiens
agattgaccttaccaagttggt

SEQ ID NO: 561106 - DNA, 15 bp, Homo sapiens
agattggattttatg

SEQ ID NO: 561107 - DNA, 17 bp, Homo sapiens
agattggattttatgtt

SEQ ID NO: 561108 - DNA, 15 bp, Homo sapiens
agattgggtgccagc

SEQ ID NO: 561109 - DNA, 19 bp, Homo sapiens
agattgtttatctagatgt

SEQ ID NO: 561110 - DNA, 21 bp, Homo sapiens
agattgtttatctagatgtaa

SEQ ID NO: 561111 - DNA, 18 bp, Homo sapiens
agatttcaagaaaaaata

SEQ ID NO: 561112 - DNA, 20 bp, Homo sapiens
agattttaaaacttcatctg

SEQ ID NO: 561113 - DNA, 15 bp, Homo sapiens
agattttagttttat

SEQ ID NO: 561114 - DNA, 19 bp, Homo sapiens
agattttatgtttaaaatg

SEQ ID NO: 561115 - DNA, 18 bp, Homo sapiens
agcaaaaaaagttgtatg

SEQ ID NO: 561116 - DNA, 13 bp, Homo sapiens
agcaaaaggatga

SEQ ID NO: 561117 - DNA, 11 bp, Homo sapiens
agcaaaaggca

SEQ ID NO: 561118 - DNA, 18 bp, Homo sapiens
agcaaaatatttgtgaaa

SEQ ID NO: 561119 - DNA, 21 bp, Homo sapiens
agcaaaatatttgtgaaagtg

SEQ ID NO: 561120 - DNA, 14 bp, Homo sapiens
agcaaacccaaaga

SEQ ID NO: 561121 - DNA, 20 bp, Homo sapiens
agcaaacccaaagatgttaa

SEQ ID NO: 561122 - DNA, 17 bp, Homo sapiens
agcaaaccctgtcaaac

SEQ ID NO: 561123 - DNA, 21 bp, Homo sapiens
agcaaaccctgtcaaacatta

SEQ ID NO: 561124 - DNA, 12 bp, Homo sapiens
agcaaagatcaa

SEQ ID NO: 561125 - DNA, 14 bp, Homo sapiens
agcaaagatcaaaa

SEQ ID NO: 561126 - DNA, 24 bp, Homo sapiens
agcaaatttcaaaagacatgttgt

SEQ ID NO: 561127 - DNA, 21 bp, Homo sapiens
agcaaatttctagatatgaga

SEQ ID NO: 561128 - DNA, 11 bp, Homo sapiens
agcaacacttg

SEQ ID NO: 561129 - DNA, 15 bp, Homo sapiens
agcaacagctggaca

SEQ ID NO: 561130 - DNA, 22 bp, Homo sapiens
agcaacattataatggccctgt

SEQ ID NO: 561131 - DNA, 23 bp, Homo sapiens
agcaagagagcagcaaggtcttg

SEQ ID NO: 561132 - DNA, 14 bp, Homo sapiens
agcaaggaaggaca

SEQ ID NO: 561133 - DNA, 20 bp, Homo sapiens
agcaaggcgctaacttgctt

SEQ ID NO: 561134 - DNA, 18 bp, Homo sapiens
agcacaaaaaatttaaga

SEQ ID NO: 561135 - DNA, 14 bp, Homo sapiens
agcacaacccccag

SEQ ID NO: 561136 - DNA, 22 bp, Homo sapiens
agcacagacaattctaatggta

SEQ ID NO: 561137 - DNA, 20 bp, Homo sapiens
cacttgtataaatgtatata

SEQ ID NO: 561138 - DNA, 21 bp, Homo sapiens
cacttgtcggctccagtcccc

SEQ ID NO: 561139 - DNA, 15 bp, Homo sapiens
cactttaatgataaa

SEQ ID NO: 561140 - DNA, 17 bp, Homo sapiens
cactttaatgataaaat

SEQ ID NO: 561141 - DNA, 14 bp, Homo sapiens
cactttccaagtca

SEQ ID NO: 561142 - DNA, 13 bp, Homo sapiens
cactttcccacac

SEQ ID NO: 561143 - DNA, 21 bp, Homo sapiens
cactttgtataaatttttaag

SEQ ID NO: 561144 - DNA, 22 bp, Homo sapiens
cactttgtataaatttttaagt

SEQ ID NO: 561145 - DNA, 20 bp, Homo sapiens
cactttttctttacaaacaa

SEQ ID NO: 561146 - DNA, 14 bp, Homo sapiens
cagaaaaaaaagtg

SEQ ID NO: 561147 - DNA, 20 bp, Homo sapiens
cagaaaaacaggcacaggct

SEQ ID NO: 561148 - DNA, 18 bp, Homo sapiens
cagaaaaatgaaatttaa

SEQ ID NO: 561149 - DNA, 21 bp, Homo sapiens
cagaaaaatgaaatttaagca

SEQ ID NO: 561150 - DNA, 16 bp, Homo sapiens
cagaaaagcacctctt

SEQ ID NO: 561151 - DNA, 15 bp, Homo sapiens
cagaaacacccacag

SEQ ID NO: 561152 - DNA, 19 bp, Homo sapiens
cagaaacacccacaggcat

SEQ ID NO: 561153 - DNA, 16 bp, Homo sapiens
cagaaacttgttcttc

SEQ ID NO: 561154 - DNA, 11 bp, Homo sapiens
cagaaagacat

SEQ ID NO: 561155 - DNA, 21 bp, Homo sapiens
cagaaagaggaataaaatgat

SEQ ID NO: 561156 - DNA, 22 bp, Homo sapiens
cagaaagaggaataaaatgatt

SEQ ID NO: 561157 - DNA, 13 bp, Homo sapiens
cagaaatatatat

SEQ ID NO: 561158 - DNA, 20 bp, Homo sapiens
cagaaatatatatacatatg

SEQ ID NO: 561159 - DNA, 19 bp, Homo sapiens
cagaaatgccgctgtgtcc

SEQ ID NO: 561160 - DNA, 23 bp, Homo sapiens
cagaaatgccgctgtgtccccgc

SEQ ID NO: 561161 - DNA, 16 bp, Homo sapiens
cagaaatgtccctttc

SEQ ID NO: 561162 - DNA, 17 bp, Homo sapiens
cagaaattggtaccttg

SEQ ID NO: 561163 - DNA, 19 bp, Homo sapiens
cagaaattggtaccttgca

SEQ ID NO: 561164 - DNA, 21 bp, Homo sapiens
cagaaattggtaccttgcaca

SEQ ID NO: 561165 - DNA, 18 bp, Homo sapiens
cagaacactttgctagga

SEQ ID NO: 561166 - DNA, 18 bp, Homo sapiens
cagaacctactgttcctt

SEQ ID NO: 561167 - DNA, 19 bp, Homo sapiens
cagaacctactgttccttt

SEQ ID NO: 561168 - DNA, 13 bp, Homo sapiens
cagaactcccttc

SEQ ID NO: 561169 - DNA, 22 bp, Homo sapiens
cagaactctgcctgccctttgt

SEQ ID NO: 561170 - DNA, 13 bp, Homo sapiens
cagaactctgtgt

SEQ ID NO: 561171 - DNA, 15 bp, Homo sapiens
cagaactcttcctcc

SEQ ID NO: 561172 - DNA, 18 bp, Homo sapiens
cagaacttgaagcctgct

SEQ ID NO: 561173 - DNA, 19 bp, Homo sapiens
cagaacttgaagcctgctc

SEQ ID NO: 561174 - DNA, 19 bp, Homo sapiens
cagaagaagacagcaaaaa

SEQ ID NO: 561175 - DNA, 13 bp, Homo sapiens
cagaagacacaga

SEQ ID NO: 561176 - DNA, 21 bp, Homo sapiens
cagaagcagcagctagaaaga

SEQ ID NO: 561177 - DNA, 19 bp, Homo sapiens
cagaagggagctggctcca

SEQ ID NO: 561178 - DNA, 16 bp, Homo sapiens
cagaagtagctttgca

SEQ ID NO: 561179 - DNA, 14 bp, Homo sapiens
cagaattggaaaag

SEQ ID NO: 561180 - DNA, 15 bp, Homo sapiens
cagacaattctaatg

SEQ ID NO: 561181 - DNA, 11 bp, Homo sapiens
cagacacacac

SEQ ID NO: 561182 - DNA, 14 bp, Homo sapiens
cagacacacacaca

SEQ ID NO: 561183 - DNA, 16 bp, Homo sapiens
cagacacacacacgca

SEQ ID NO: 561184 - DNA, 14 bp, Homo sapiens
cagacacacacata

SEQ ID NO: 561185 - DNA, 20 bp, Homo sapiens
cagacacacacatatataca

SEQ ID NO: 561186 - DNA, 14 bp, Homo sapiens
cagacactcctggg

SEQ ID NO: 561187 - DNA, 20 bp, Homo sapiens
cagacattgacaagcacgca

SEQ ID NO: 561188 - DNA, 15 bp, Homo sapiens
cagaccactgtctcc

SEQ ID NO: 561189 - DNA, 16 bp, Homo sapiens
cagaccagtagtgacc

SEQ ID NO: 561190 - DNA, 20 bp, Homo sapiens
cagaccccatccagccaggg

SEQ ID NO: 561191 - DNA, 21 bp, Homo sapiens
cagaccccatccagccagggg

SEQ ID NO: 561192 - DNA, 14 bp, Homo sapiens
cagaccctggagga

SEQ ID NO: 561193 - DNA, 14 bp, Homo sapiens
cagacctgggccct

SEQ ID NO: 561194 - DNA, 15 bp, Homo sapiens
cagacctgggccctg

SEQ ID NO: 561195 - DNA, 18 bp, Homo sapiens
cagacctgggccctggtt

SEQ ID NO: 561196 - DNA, 17 bp, Homo sapiens
cttgcccatgctgggct

SEQ ID NO: 561197 - DNA, 19 bp, Homo sapiens
cttgcgcttttgctggtca

SEQ ID NO: 561198 - DNA, 14 bp, Homo sapiens
cttgctgctatttt

SEQ ID NO: 561199 - DNA, 19 bp, Homo sapiens
cttgctgctattttactgt

SEQ ID NO: 561200 - DNA, 14 bp, Homo sapiens
cttgcttaaatgtg

SEQ ID NO: 561201 - DNA, 15 bp, Homo sapiens
cttgcttaaatgtga

SEQ ID NO: 561202 - DNA, 15 bp, Homo sapiens
cttgcttacctctca

SEQ ID NO: 561203 - DNA, 15 bp, Homo sapiens
cttggagcagaggtg

SEQ ID NO: 561204 - DNA, 14 bp, Homo sapiens
cttggcaccaataa

SEQ ID NO: 561205 - DNA, 21 bp, Homo sapiens
cttggcaccaataaaggagga

SEQ ID NO: 561206 - DNA, 20 bp, Homo sapiens
cttggctcagacacctagac

SEQ ID NO: 561207 - DNA, 21 bp, Homo sapiens
cttgggcaatattctctgtac

SEQ ID NO: 561208 - DNA, 13 bp, Homo sapiens
cttgggctctgct

SEQ ID NO: 561209 - DNA, 22 bp, Homo sapiens
cttgggctgggacttcttaccc

SEQ ID NO: 561210 - DNA, 20 bp, Homo sapiens
cttggtacttgctgctattt

SEQ ID NO: 561211 - DNA, 17 bp, Homo sapiens
cttggtcacagccaggc

SEQ ID NO: 561212 - DNA, 19 bp, Homo sapiens
cttggtcttttttctgggt

SEQ ID NO: 561213 - DNA, 21 bp, Homo sapiens
cttggtgcggggttaacacct

SEQ ID NO: 561214 - DNA, 16 bp, Homo sapiens
cttggtttccatcaaa

SEQ ID NO: 561215 - DNA, 13 bp, Homo sapiens
cttgtaatgtaac

SEQ ID NO: 561216 - DNA, 20 bp, Homo sapiens
cttgtaatgtaactgctctt

SEQ ID NO: 561217 - DNA, 15 bp, Homo sapiens
cttgtgcacaggcag

SEQ ID NO: 561218 - DNA, 18 bp, Homo sapiens
cttgtgcacaggcagagc

SEQ ID NO: 561219 - DNA, 22 bp, Homo sapiens
cttgtgcacaggcagagcccag

SEQ ID NO: 561220 - DNA, 23 bp, Homo sapiens
cttgttatgttgtaatattttgc

SEQ ID NO: 561221 - DNA, 22 bp, Homo sapiens
cttgttcagtcacttgtttgtg

SEQ ID NO: 561222 - DNA, 18 bp, Homo sapiens
cttgttcttccaaagcag

SEQ ID NO: 561223 - DNA, 13 bp, Homo sapiens
cttgttcttcctc

SEQ ID NO: 561224 - DNA, 18 bp, Homo sapiens
cttgttgcagactggtgt

SEQ ID NO: 561225 - DNA, 15 bp, Homo sapiens
cttgttttgcttccc

SEQ ID NO: 561226 - DNA, 17 bp, Homo sapiens
cttgtttttgtttttgt

SEQ ID NO: 561227 - DNA, 17 bp, Homo sapiens
ctttaaagtgtaataat

SEQ ID NO: 561228 - DNA, 19 bp, Homo sapiens
ctttaaagtgtaataatat

SEQ ID NO: 561229 - DNA, 21 bp, Homo sapiens
ctttaaagtgtaataatatga

SEQ ID NO: 561230 - DNA, 18 bp, Homo sapiens
ctttaaattgtggatgaa

SEQ ID NO: 561231 - DNA, 19 bp, Homo sapiens
ctttaacttccactttgta

SEQ ID NO: 561232 - DNA, 21 bp, Homo sapiens
ctttaacttccactttgtata

SEQ ID NO: 561233 - DNA, 17 bp, Homo sapiens
ctttaagagagaaatct

SEQ ID NO: 561234 - DNA, 14 bp, Homo sapiens
ctttaatatgtatt

SEQ ID NO: 561235 - DNA, 15 bp, Homo sapiens
ctttaccctcatctg

SEQ ID NO: 561236 - DNA, 20 bp, Homo sapiens
ctttaccctcatctgtctgg

SEQ ID NO: 561237 - DNA, 15 bp, Homo sapiens
ctttagaaaaggcat

SEQ ID NO: 561238 - DNA, 13 bp, Homo sapiens
ctttagaacaaca

SEQ ID NO: 561239 - DNA, 19 bp, Homo sapiens
ctttagaacaacataaaat

SEQ ID NO: 561240 - DNA, 23 bp, Homo sapiens
ctttagaacaacataaaattaaa

SEQ ID NO: 561241 - DNA, 23 bp, Homo sapiens
ctttagaatgttttccttctact

SEQ ID NO: 561242 - DNA, 17 bp, Homo sapiens
ctttagagtgactaaaa

SEQ ID NO: 561243 - DNA, 15 bp, Homo sapiens
ctttatacagatttt

SEQ ID NO: 561244 - DNA, 18 bp, Homo sapiens
ctttatcatgtgtttctg

SEQ ID NO: 561245 - DNA, 19 bp, Homo sapiens
ctttatcatgtgtttctgt

SEQ ID NO: 561246 - DNA, 20 bp, Homo sapiens
ctttatctaccaactttcaa

SEQ ID NO: 561247 - DNA, 15 bp, Homo sapiens
ctttatgtattctct

SEQ ID NO: 561248 - DNA, 16 bp, Homo sapiens
ctttatttttcattac

SEQ ID NO: 561249 - DNA, 16 bp, Homo sapiens
ctttcaagaacttgtt

SEQ ID NO: 561250 - DNA, 17 bp, Homo sapiens
ctttcaagaacttgttt

SEQ ID NO: 561251 - DNA, 19 bp, Homo sapiens
ctttcaagggctttcctgt

SEQ ID NO: 561252 - DNA, 16 bp, Homo sapiens
ctttcacttctttccc

SEQ ID NO: 561253 - DNA, 15 bp, Homo sapiens
ctttccaattctcct

SEQ ID NO: 561254 - DNA, 15 bp, Homo sapiens
ctttccatttacagt

SEQ ID NO: 561255 - DNA, 14 bp, Homo sapiens
ctttccatttctct

SEQ ID NO: 561256 - DNA, 11 bp, Homo sapiens
ctttcccacac

SEQ ID NO: 561257 - DNA, 17 bp, Homo sapiens
ctttcccacccagcctg

SEQ ID NO: 561258 - DNA, 19 bp, Homo sapiens
ctttcccacccagcctggg

SEQ ID NO: 561259 - DNA, 13 bp, Homo sapiens
ctttcccttccag

SEQ ID NO: 561260 - DNA, 13 bp, Homo sapiens
ctttcctgtgcca

SEQ ID NO: 561261 - DNA, 22 bp, Homo sapiens
ctttctaatcctatctggggag

SEQ ID NO: 561262 - DNA, 21 bp, Homo sapiens
ctttctagagcagttggccaa

SEQ ID NO: 561263 - DNA, 17 bp, Homo sapiens
ctttctcaatgtcttcc

SEQ ID NO: 561264 - DNA, 14 bp, Homo sapiens
ctttctcagcatat

SEQ ID NO: 561265 - DNA, 19 bp, Homo sapiens
ctttctcagcatatatata

SEQ ID NO: 561266 - DNA, 14 bp, Homo sapiens
ctttctccaaagtt

SEQ ID NO: 561267 - DNA, 23 bp, Homo sapiens
ctttctggggggatatttcctaa

SEQ ID NO: 561268 - DNA, 18 bp, Homo sapiens
ctttctggggtttttctg

SEQ ID NO: 561269 - DNA, 17 bp, Homo sapiens
ctttctgttatctagaa

SEQ ID NO: 561270 - DNA, 11 bp, Homo sapiens
ctttcttcctc

SEQ ID NO: 561271 - DNA, 12 bp, Homo sapiens
ctttcttcctca

SEQ ID NO: 561272 - DNA, 11 bp, Homo sapiens
ctttcttcctt

SEQ ID NO: 561273 - DNA, 19 bp, Homo sapiens
ctttgaaaactcatacagt

SEQ ID NO: 561274 - DNA, 21 bp, Homo sapiens
ctttgaagtgcctctgattct

SEQ ID NO: 561275 - DNA, 13 bp, Homo sapiens
ctttgaattttca

SEQ ID NO: 561276 - DNA, 14 bp, Homo sapiens
ctttgaattttcat

SEQ ID NO: 561277 - DNA, 19 bp, Homo sapiens
ctttgaattttcattttac

SEQ ID NO: 561278 - DNA, 20 bp, Homo sapiens
ctttgaattttcattttaca

SEQ ID NO: 561279 - DNA, 16 bp, Homo sapiens
ctttgattcacatgtt

SEQ ID NO: 561280 - DNA, 23 bp, Homo sapiens
ctttgcccccaaacccccattct

SEQ ID NO: 561281 - DNA, 16 bp, Homo sapiens
ctttggaaatagcatg

SEQ ID NO: 561282 - DNA, 22 bp, Homo sapiens
ctttggccactgtatttgttaa

SEQ ID NO: 561283 - DNA, 22 bp, Homo sapiens
ctttggcctgatgaccaatttt

SEQ ID NO: 561284 - DNA, 16 bp, Homo sapiens
ctttggcttaattcca

SEQ ID NO: 561285 - DNA, 19 bp, Homo sapiens
ctttgggttctttctgggg

SEQ ID NO: 561286 - DNA, 20 bp, Homo sapiens
ctttgtcctaagagatttat

SEQ ID NO: 561287 - DNA, 17 bp, Homo sapiens
ctttgtcctcctgctgc

SEQ ID NO: 561288 - DNA, 21 bp, Homo sapiens
ctttgtcctcctgctgccagt

SEQ ID NO: 561289 - DNA, 17 bp, Homo sapiens
ctttgtctaagaaacat

SEQ ID NO: 561290 - DNA, 19 bp, Homo sapiens
ctttgtctcctctatcctg

SEQ ID NO: 561291 - DNA, 11 bp, Homo sapiens
ctttgtgctta

SEQ ID NO: 561292 - DNA, 16 bp, Homo sapiens
cttttaaaaagtattg

SEQ ID NO: 561293 - DNA, 23 bp, Homo sapiens
cttttaataaagtatgaatattt

SEQ ID NO: 561294 - DNA, 20 bp, Homo sapiens
cttttataaaaaaaatgaaa

SEQ ID NO: 561295 - DNA, 21 bp, Homo sapiens
cttttataaaaaaaatgaaat

SEQ ID NO: 561296 - DNA, 13 bp, Homo sapiens
cttttcaaaataa

SEQ ID NO: 561297 - DNA, 14 bp, Homo sapiens
cttttcaaaataaa

SEQ ID NO: 561298 - DNA, 17 bp, Homo sapiens
cttttcaaaataaagct

SEQ ID NO: 561299 - DNA, 18 bp, Homo sapiens
cttttcaaacaagaatgt

SEQ ID NO: 561300 - DNA, 20 bp, Homo sapiens
cttttccaacatacaattta

SEQ ID NO: 561301 - DNA, 18 bp, Homo sapiens
cttttcctcgcttctttc

SEQ ID NO: 561302 - DNA, 19 bp, Homo sapiens
cttttcctcgcttctttca

SEQ ID NO: 561303 - DNA, 20 bp, Homo sapiens
cttttcctcgcttctttcaa

SEQ ID NO: 561304 - DNA, 18 bp, Homo sapiens
cttttctgtgtttacaga

SEQ ID NO: 561305 - DNA, 22 bp, Homo sapiens
cttttgaaaagaccaagacttt

SEQ ID NO: 561306 - DNA, 11 bp, Homo sapiens
cttttgcaaat

SEQ ID NO: 561307 - DNA, 16 bp, Homo sapiens
cttttgcaaataactt

SEQ ID NO: 561308 - DNA, 21 bp, Homo sapiens
cttttgcatgtcgcacaatgt

SEQ ID NO: 561309 - DNA, 13 bp, Homo sapiens
gaaaatatatttg

SEQ ID NO: 561310 - DNA, 14 bp, Homo sapiens
gaaaatgttcatca

SEQ ID NO: 561311 - DNA, 15 bp, Homo sapiens
gaaaatgttcttcca

SEQ ID NO: 561312 - DNA, 12 bp, Homo sapiens
gaaaattcaaca

SEQ ID NO: 561313 - DNA, 18 bp, Homo sapiens
gaaaattcagataatggt

SEQ ID NO: 561314 - DNA, 22 bp, Homo sapiens
gaaacaagaggtaccaaaaaag

SEQ ID NO: 561315 - DNA, 14 bp, Homo sapiens
gaaacaatttctgt

SEQ ID NO: 561316 - DNA, 16 bp, Homo sapiens
gaaacaccaaaaaaat

SEQ ID NO: 561317 - DNA, 17 bp, Homo sapiens
gaaacactaaatgttaa

SEQ ID NO: 561318 - DNA, 15 bp, Homo sapiens
gaaacagataccata

SEQ ID NO: 561319 - DNA, 14 bp, Homo sapiens
gaaacagcagctga

SEQ ID NO: 561320 - DNA, 22 bp, Homo sapiens
gaaacagcttgatgctgtttct

SEQ ID NO: 561321 - DNA, 18 bp, Homo sapiens
gaaacattgcttttaaaa

SEQ ID NO: 561322 - DNA, 15 bp, Homo sapiens
gaaacccaagttatg

SEQ ID NO: 561323 - DNA, 17 bp, Homo sapiens
gaaacccggcttcctgt

SEQ ID NO: 561324 - DNA, 12 bp, Homo sapiens
gaaactgtattt

SEQ ID NO: 561325 - DNA, 22 bp, Homo sapiens
gaaacttgttcttccaaagcag

SEQ ID NO: 561326 - DNA, 16 bp, Homo sapiens
gaaagaactatcttca

SEQ ID NO: 561327 - DNA, 13 bp, Homo sapiens
gaaagagaaaaag

SEQ ID NO: 561328 - DNA, 11 bp, Homo sapiens
gaaagaggaat

SEQ ID NO: 561329 - DNA, 22 bp, Homo sapiens
gaaagagggtaataaccagaca

SEQ ID NO: 561330 - DNA, 16 bp, Homo sapiens
gaaagcaacagctgga

SEQ ID NO: 561331 - DNA, 20 bp, Homo sapiens
gaaagcacagaggcctcctg

SEQ ID NO: 561332 - DNA, 23 bp, Homo sapiens
gaaagcactcctccctgatgtac

SEQ ID NO: 561333 - DNA, 15 bp, Homo sapiens
gaaagccagtcttaa

SEQ ID NO: 561334 - DNA, 19 bp, Homo sapiens
gaaagccttaagctgcagg

SEQ ID NO: 561335 - DNA, 20 bp, Homo sapiens
gaaagctgtttcatttgtgt

SEQ ID NO: 561336 - DNA, 21 bp, Homo sapiens
gaaaggaagatgtaagaagct

SEQ ID NO: 561337 - DNA, 14 bp, Homo sapiens
gaaagtgttctgtt

SEQ ID NO: 561338 - DNA, 17 bp, Homo sapiens
gaaagtgttctgttaca

SEQ ID NO: 561339 - DNA, 19 bp, Homo sapiens
gaaagtgttctgttacaaa

SEQ ID NO: 561340 - DNA, 22 bp, Homo sapiens
gaaatatatggtctaatgttta

SEQ ID NO: 561341 - DNA, 19 bp, Homo sapiens
gaaatattactctgcctgt

SEQ ID NO: 561342 - DNA, 17 bp, Homo sapiens
gaaatattcacaaggtt

SEQ ID NO: 561343 - DNA, 14 bp, Homo sapiens
gaaatctatagaaa

SEQ ID NO: 561344 - DNA, 15 bp, Homo sapiens
gaaatctctttgccc

SEQ ID NO: 561345 - DNA, 17 bp, Homo sapiens
gaaatgaacacaaatta

SEQ ID NO: 561346 - DNA, 17 bp, Homo sapiens
gaaatgcacaatgtctt

SEQ ID NO: 561347 - DNA, 18 bp, Homo sapiens
gaaatgctatgtcatttc

SEQ ID NO: 561348 - DNA, 19 bp, Homo sapiens
gaaatgctatgtcatttca

SEQ ID NO: 561349 - DNA, 22 bp, Homo sapiens
gaaatgctatgtcatttcatgt

SEQ ID NO: 561350 - DNA, 17 bp, Homo sapiens
gaaatgtccctttcttc

SEQ ID NO: 561351 - DNA, 20 bp, Homo sapiens
gaaatgtccctttcttctcc

SEQ ID NO: 561352 - DNA, 23 bp, Homo sapiens
gaaatgtgtgtgatgtgacattt

SEQ ID NO: 561353 - DNA, 15 bp, Homo sapiens
gaaattatatctgtg

SEQ ID NO: 561354 - DNA, 16 bp, Homo sapiens
gaaattcaattcatag

SEQ ID NO: 561355 - DNA, 14 bp, Homo sapiens
gaaattcctcagca

SEQ ID NO: 561356 - DNA, 22 bp, Homo sapiens
gaaattcgccccattttcttta

SEQ ID NO: 561357 - DNA, 16 bp, Homo sapiens
gaaattggtaccttgc

SEQ ID NO: 561358 - DNA, 20 bp, Homo sapiens
gaaattggtaccttgcacac

SEQ ID NO: 561359 - DNA, 13 bp, Homo sapiens
gaaatttaagcac

SEQ ID NO: 561360 - DNA, 11 bp, Homo sapiens
gaaatttcacg

SEQ ID NO: 561361 - DNA, 15 bp, Homo sapiens
gaaatttttcatatt

SEQ ID NO: 561362 - DNA, 16 bp, Homo sapiens
gaaatttttcatattt

SEQ ID NO: 561363 - DNA, 14 bp, Homo sapiens
gaacaaatcttcct

SEQ ID NO: 561364 - DNA, 22 bp, Homo sapiens
gaacaaatgcttttccaaccca

SEQ ID NO: 561365 - DNA, 16 bp, Homo sapiens
gaacaacataaaatta

SEQ ID NO: 561366 - DNA, 17 bp, Homo sapiens
gaacaacataaaattaa

SEQ ID NO: 561367 - DNA, 19 bp, Homo sapiens
gaacaacataaaattaaaa

SEQ ID NO: 561368 - DNA, 13 bp, Homo sapiens
gaacacatgcaca

SEQ ID NO: 561369 - DNA, 16 bp, Homo sapiens
gaacagctctgagatc

SEQ ID NO: 561370 - DNA, 21 bp, Homo sapiens
gaacagctctgagatcctgga

SEQ ID NO: 561371 - DNA, 22 bp, Homo sapiens
gaacagctctgagatcctggag

SEQ ID NO: 561372 - DNA, 21 bp, Homo sapiens
gaacagtaaagaaagcagaat

SEQ ID NO: 561373 - DNA, 18 bp, Homo sapiens
gaacagtgtttactttaa

SEQ ID NO: 561374 - DNA, 18 bp, Homo sapiens
gaacatgacccgtacaca

SEQ ID NO: 561375 - DNA, 20 bp, Homo sapiens
gaacatgggggaacaatgag

SEQ ID NO: 561376 - DNA, 22 bp, Homo sapiens
gaaccagagcgatgtgttcttt

SEQ ID NO: 561377 - DNA, 22 bp, Homo sapiens
gaaccatagttgacagttccaa

SEQ ID NO: 561378 - DNA, 14 bp, Homo sapiens
gaacccaggaggca

SEQ ID NO: 561379 - DNA, 22 bp, Homo sapiens
gaaccccctcaccacctgcccg

SEQ ID NO: 561380 - DNA, 17 bp, Homo sapiens
gaacctactgttccttt

SEQ ID NO: 561381 - DNA, 12 bp, Homo sapiens
gaactcttcctc

SEQ ID NO: 561382 - DNA, 14 bp, Homo sapiens
gaactgaagcagag

SEQ ID NO: 561383 - DNA, 15 bp, Homo sapiens
gaactgctgctggtc

SEQ ID NO: 561384 - DNA, 20 bp, Homo sapiens
gaagaaagaactatcttcat

SEQ ID NO: 561385 - DNA, 14 bp, Homo sapiens
gaagaagagatgca

SEQ ID NO: 561386 - DNA, 14 bp, Homo sapiens
gaagacaaatacac

SEQ ID NO: 561387 - DNA, 18 bp, Homo sapiens
gaagacaaatacacatac

SEQ ID NO: 561388 - DNA, 23 bp, Homo sapiens
gaagacaaatacacatacatata

SEQ ID NO: 561389 - DNA, 13 bp, Homo sapiens
gaagacagcaaaa

SEQ ID NO: 561390 - DNA, 23 bp, Homo sapiens
gaagagagatatatctgaaaact

SEQ ID NO: 561391 - DNA, 19 bp, Homo sapiens
gaagagagtatggtgctgg

SEQ ID NO: 561392 - DNA, 16 bp, Homo sapiens
gaagagatgcactata

SEQ ID NO: 561393 - DNA, 15 bp, Homo sapiens
gaagagctggggaga

SEQ ID NO: 561394 - DNA, 14 bp, Homo sapiens
gaagagtatggatt

SEQ ID NO: 561395 - DNA, 17 bp, Homo sapiens
gaagatctttgggcata

SEQ ID NO: 561396 - DNA, 24 bp, Homo sapiens
gaagatgcgagcgctatcttcaca

SEQ ID NO: 561397 - DNA, 19 bp, Homo sapiens
gaagcaaaaacgaaagctg

SEQ ID NO: 561398 - DNA, 21 bp, Homo sapiens
gaagcaaaaacgaaagctggg

SEQ ID NO: 561399 - DNA, 15 bp, Homo sapiens
gaagcaggttaaatg

SEQ ID NO: 561400 - DNA, 18 bp, Homo sapiens
gaagcatgaacagtgcac

SEQ ID NO: 561401 - DNA, 17 bp, Homo sapiens
gaagccacccaaagcag

SEQ ID NO: 561402 - DNA, 16 bp, Homo sapiens
gaagccagctccctga

SEQ ID NO: 561403 - DNA, 20 bp, Homo sapiens
gaagcctcctgctgagtggt

SEQ ID NO: 561404 - DNA, 13 bp, Homo sapiens
gaagctaaaacac

SEQ ID NO: 561405 - DNA, 15 bp, Homo sapiens
gaagctggcaggaga

SEQ ID NO: 561406 - DNA, 21 bp, Homo sapiens
gaaggagatggagttatgagg

SEQ ID NO: 561407 - DNA, 18 bp, Homo sapiens
gaaggaggctccaggcag

SEQ ID NO: 561408 - DNA, 19 bp, Homo sapiens
gaaggaggctccaggcagc

SEQ ID NO: 561409 - DNA, 20 bp, Homo sapiens
gaaggaggctccaggcagca

SEQ ID NO: 561410 - DNA, 18 bp, Homo sapiens
gaaggcaaactgaggcag

SEQ ID NO: 561411 - DNA, 14 bp, Homo sapiens
gaaggcccagcacc

SEQ ID NO: 561412 - DNA, 21 bp, Homo sapiens
gaagggaccgggagcctgcgt

SEQ ID NO: 561413 - DNA, 14 bp, Homo sapiens
gaagggtggatgtc

SEQ ID NO: 561414 - DNA, 14 bp, Homo sapiens
gaaggtcatttcca

SEQ ID NO: 561415 - DNA, 20 bp, Homo sapiens
gaagtacaggtcatctgctg

SEQ ID NO: 561416 - DNA, 22 bp, Homo sapiens
gaagttagcctttatctaccaa

SEQ ID NO: 561417 - DNA, 21 bp, Homo sapiens
gaagttatatttcctatacca

SEQ ID NO: 561418 - DNA, 18 bp, Homo sapiens
gaagttctgcctctgatg

SEQ ID NO: 561419 - DNA, 19 bp, Homo sapiens
gaagtttgataaatagtgt

SEQ ID NO: 561420 - DNA, 14 bp, Homo sapiens
gaataaaggcagct

SEQ ID NO: 561421 - DNA, 18 bp, Homo sapiens
gaataaaggcagctgttg

SEQ ID NO: 561422 - DNA, 15 bp, Homo sapiens
gaataatgaagatct

SEQ ID NO: 561423 - DNA, 13 bp, Homo sapiens
gaatactgtattg

SEQ ID NO: 561424 - DNA, 18 bp, Homo sapiens
gaatagacataaattgta

SEQ ID NO: 561425 - DNA, 21 bp, Homo sapiens
gaatagcagtggcaaaatatt

SEQ ID NO: 561426 - DNA, 21 bp, Homo sapiens
gaataggacttgtttttgttt

SEQ ID NO: 561427 - DNA, 20 bp, Homo sapiens
gaatatccgtgccaggaaaa

SEQ ID NO: 561428 - DNA, 20 bp, Homo sapiens
gaatattcagagaatatcaa

SEQ ID NO: 561429 - DNA, 21 bp, Homo sapiens
gaatttggggctacttatatt

SEQ ID NO: 561430 - DNA, 17 bp, Homo sapiens
gaatttgtgaacagcag

SEQ ID NO: 561431 - DNA, 13 bp, Homo sapiens
gaattttcatttt

SEQ ID NO: 561432 - DNA, 16 bp, Homo sapiens
gaattttcattttaca

SEQ ID NO: 561433 - DNA, 13 bp, Homo sapiens
gacaaatacacat

SEQ ID NO: 561434 - DNA, 22 bp, Homo sapiens
gacaaatacacatacatatata

SEQ ID NO: 561435 - DNA, 15 bp, Homo sapiens
gacaaatagtaggca

SEQ ID NO: 561436 - DNA, 19 bp, Homo sapiens
gacaacagattggatttta

SEQ ID NO: 561437 - DNA, 15 bp, Homo sapiens
gacaagcacagtcag

SEQ ID NO: 561438 - DNA, 20 bp, Homo sapiens
gacaagctgttgaccaggca

SEQ ID NO: 561439 - DNA, 22 bp, Homo sapiens
gacaagggaaaataaaaaaaga

SEQ ID NO: 561440 - DNA, 17 bp, Homo sapiens
gacaaggtgcaggcagg

SEQ ID NO: 561441 - DNA, 21 bp, Homo sapiens
gacaagtgacttatttgctca

SEQ ID NO: 561442 - DNA, 21 bp, Homo sapiens
gacaataagaaacagtttaac

SEQ ID NO: 561443 - DNA, 19 bp, Homo sapiens
gacaatactgtatgtcgtc

SEQ ID NO: 561444 - DNA, 15 bp, Homo sapiens
gacaattctaatggt

SEQ ID NO: 561445 - DNA, 21 bp, Homo sapiens
gacacacaagcagacacacac

SEQ ID NO: 561446 - DNA, 21 bp, Homo sapiens
gacacacacacacacacacat

SEQ ID NO: 561447 - DNA, 13 bp, Homo sapiens
gacacacacacgc

SEQ ID NO: 561448 - DNA, 19 bp, Homo sapiens
gacacacacacgcacgcac

SEQ ID NO: 561449 - DNA, 13 bp, Homo sapiens
gacacacacatat

SEQ ID NO: 561450 - DNA, 17 bp, Homo sapiens
gacacacacatatatac

SEQ ID NO: 561451 - DNA, 20 bp, Homo sapiens
gacacacacatatatacata

SEQ ID NO: 561452 - DNA, 21 bp, Homo sapiens
gacacagcagcttcaccagag

SEQ ID NO: 561453 - DNA, 19 bp, Homo sapiens
gacacagctgagctggcct

SEQ ID NO: 561454 - DNA, 22 bp, Homo sapiens
gacacaggggacacccagaaac

SEQ ID NO: 561455 - DNA, 16 bp, Homo sapiens
gacacctgtactggag

SEQ ID NO: 561456 - DNA, 17 bp, Homo sapiens
gacacctgtactggaga

SEQ ID NO: 561457 - DNA, 18 bp, Homo sapiens
gacacctgtactggagag

SEQ ID NO: 561458 - DNA, 14 bp, Homo sapiens
gacactttttcttt

SEQ ID NO: 561459 - DNA, 14 bp, Homo sapiens
gacagaaggctcct

SEQ ID NO: 561460 - DNA, 19 bp, Homo sapiens
gacagaaggctcctgcccc

SEQ ID NO: 561461 - DNA, 20 bp, Homo sapiens
gacagaaggctcctgccccc

SEQ ID NO: 561462 - DNA, 15 bp, Homo sapiens
gacagagcctgcccc

SEQ ID NO: 561463 - DNA, 21 bp, Homo sapiens
gacagagcctgccccagcgct

SEQ ID NO: 561464 - DNA, 22 bp, Homo sapiens
gacagcaaaaaaagcaactttt

SEQ ID NO: 561465 - DNA, 16 bp, Homo sapiens
gacagcaaacacagtc

SEQ ID NO: 561466 - DNA, 21 bp, Homo sapiens
gacaggaacacccagccccag

SEQ ID NO: 561467 - DNA, 16 bp, Homo sapiens
gacagtcaaggagtgg

SEQ ID NO: 561468 - DNA, 17 bp, Homo sapiens
gacagtcaaggagtggc

SEQ ID NO: 561469 - DNA, 19 bp, Homo sapiens
gacagtcaggaagcctcct

SEQ ID NO: 561470 - DNA, 20 bp, Homo sapiens
gacagtgaggtcctgggggc

SEQ ID NO: 561471 - DNA, 18 bp, Homo sapiens
gacagttcattcagggcc

SEQ ID NO: 561472 - DNA, 19 bp, Homo sapiens
gacagttcattcagggccg

SEQ ID NO: 561473 - DNA, 13 bp, Homo sapiens
gacataaattgta

SEQ ID NO: 561474 - DNA, 15 bp, Homo sapiens
gacatattcccatgg

SEQ ID NO: 561475 - DNA, 21 bp, Homo sapiens
gacatgcacccgcatgtacaa

SEQ ID NO: 561476 - DNA, 22 bp, Homo sapiens
gacattatgtgtgcatgtgtgt

SEQ ID NO: 561477 - DNA, 23 bp, Homo sapiens
gacattatgtgtgcatgtgtgta

SEQ ID NO: 561478 - DNA, 13 bp, Homo sapiens
gacattgtaaacg

SEQ ID NO: 561479 - DNA, 19 bp, Homo sapiens
gacatttgtcattttcatt

SEQ ID NO: 561480 - DNA, 13 bp, Homo sapiens
gacatttgtttgg

SEQ ID NO: 561481 - DNA, 21 bp, Homo sapiens
gaccaacgatcctatgagaga

SEQ ID NO: 561482 - DNA, 22 bp, Homo sapiens
gaccaaggaacaagacccccag

SEQ ID NO: 561483 - DNA, 18 bp, Homo sapiens
gaccaatcgggagtagca

SEQ ID NO: 561484 - DNA, 17 bp, Homo sapiens
gaccagacaagctgttg

SEQ ID NO: 561485 - DNA, 20 bp, Homo sapiens
gaccagcctggccaacatgg

SEQ ID NO: 561486 - DNA, 18 bp, Homo sapiens
gaccaggactctgccttc

SEQ ID NO: 561487 - DNA, 18 bp, Homo sapiens
gaccagggctggggcagc

SEQ ID NO: 561488 - DNA, 17 bp, Homo sapiens
gaccagtagtgaccaat

SEQ ID NO: 561489 - DNA, 19 bp, Homo sapiens
gaccatctggaattggttt

SEQ ID NO: 561490 - DNA, 18 bp, Homo sapiens
gaccatttagtcctcacc

SEQ ID NO: 561491 - DNA, 20 bp, Homo sapiens
gaccatttagtcctcacctt

SEQ ID NO: 561492 - DNA, 19 bp, Homo sapiens
gaccattttcctgcattgg

SEQ ID NO: 561493 - DNA, 19 bp, Homo sapiens
gacccatgaaacagcagct

SEQ ID NO: 561494 - DNA, 18 bp, Homo sapiens
gaccccatccagccaggg

SEQ ID NO: 561495 - DNA, 17 bp, Homo sapiens
gaccccatctgctgagc

SEQ ID NO: 561496 - DNA, 12 bp, Homo sapiens
gacccctgccca

SEQ ID NO: 561497 - DNA, 18 bp, Homo sapiens
gaccctcggggcaggaag

SEQ ID NO: 561498 - DNA, 13 bp, Homo sapiens
gaccctgaaatgt

SEQ ID NO: 561499 - DNA, 16 bp, Homo sapiens
gaccctgaaatgtgtg

SEQ ID NO: 561500 - DNA, 20 bp, Homo sapiens
gaccctgaaatgtgtgtgat

SEQ ID NO: 561501 - DNA, 16 bp, Homo sapiens
gaccctggagcccggc

SEQ ID NO: 561502 - DNA, 18 bp, Homo sapiens
gaccctggagcccggcag

SEQ ID NO: 561503 - DNA, 23 bp, Homo sapiens
gaccctggagcccggcagtgcac

SEQ ID NO: 561504 - DNA, 12 bp, Homo sapiens
gaccggggtcct

SEQ ID NO: 561505 - DNA, 17 bp, Homo sapiens
gaccggggtcctgaggc

SEQ ID NO: 561506 - DNA, 19 bp, Homo sapiens
gacctaaccagggccagaa

SEQ ID NO: 561507 - DNA, 20 bp, Homo sapiens
gacctccctgtctctacaaa

SEQ ID NO: 561508 - DNA, 13 bp, Homo sapiens
gacctcttagaaa

SEQ ID NO: 561509 - DNA, 15 bp, Homo sapiens
gacctcttagaaaat

SEQ ID NO: 561510 - DNA, 19 bp, Homo sapiens
gacctgaggacatggcttc

SEQ ID NO: 561511 - DNA, 22 bp, Homo sapiens
gacctgaggacatggcttctga

SEQ ID NO: 561512 - DNA, 14 bp, Homo sapiens
gacctgggccctgg

SEQ ID NO: 561513 - DNA, 15 bp, Homo sapiens
gacctgggccctggt

SEQ ID NO: 561514 - DNA, 13 bp, Homo sapiens
gacctggtcaggg

SEQ ID NO: 561515 - DNA, 20 bp, Homo sapiens
gaccttcactctaagatgtt

SEQ ID NO: 561516 - DNA, 20 bp, Homo sapiens
gaccttctgtcgtccccaga

SEQ ID NO: 561517 - DNA, 20 bp, Homo sapiens
gaccttgtaatgtaactgct

SEQ ID NO: 561518 - DNA, 17 bp, Homo sapiens
gacctttgggttctttc

SEQ ID NO: 561519 - DNA, 18 bp, Homo sapiens
gacctttgggttctttct

SEQ ID NO: 561520 - DNA, 12 bp, Homo sapiens
gacgcagggaga

SEQ ID NO: 561521 - DNA, 21 bp, Homo sapiens
gacgcagggagaccctgggag

SEQ ID NO: 561522 - DNA, 13 bp, Homo sapiens
gacgctctgctgt

SEQ ID NO: 561523 - DNA, 22 bp, Homo sapiens
gacgctctgctgtgggcacagg

SEQ ID NO: 561524 - DNA, 19 bp, Homo sapiens
gacggggacacggcctctg

SEQ ID NO: 561525 - DNA, 19 bp, Homo sapiens
gacgtgagtggggaggaga

SEQ ID NO: 561526 - DNA, 22 bp, Homo sapiens
gactaagatcggttaacaaata

SEQ ID NO: 561527 - DNA, 22 bp, Homo sapiens
gactatccattttacacttgct

SEQ ID NO: 561528 - DNA, 17 bp, Homo sapiens
gactccaagaacaattg

SEQ ID NO: 561529 - DNA, 18 bp, Homo sapiens
gactccagaagcagcagc

SEQ ID NO: 561530 - DNA, 21 bp, Homo sapiens
gactcgggctaagtccagctc

SEQ ID NO: 561531 - DNA, 15 bp, Homo sapiens
gactctgccttccag

SEQ ID NO: 561532 - DNA, 17 bp, Homo sapiens
gactctgtggggccaca

SEQ ID NO: 561533 - DNA, 14 bp, Homo sapiens
gactggtgttaatg

SEQ ID NO: 561534 - DNA, 17 bp, Homo sapiens
gactgtaaattccaaag

SEQ ID NO: 561535 - DNA, 19 bp, Homo sapiens
gacttcatttaacactgag

SEQ ID NO: 561536 - DNA, 21 bp, Homo sapiens
gacttcctgctacagtagctg

SEQ ID NO: 561537 - DNA, 18 bp, Homo sapiens
gacttcttacccaaagca

SEQ ID NO: 561538 - DNA, 20 bp, Homo sapiens
gacttcttacccaaagcaca

SEQ ID NO: 561539 - DNA, 21 bp, Homo sapiens
gacttggtgattacctgaaag

SEQ ID NO: 561540 - DNA, 14 bp, Homo sapiens
gacttgtttttgtt

SEQ ID NO: 561541 - DNA, 16 bp, Homo sapiens
gactttcctatgacac

SEQ ID NO: 561542 - DNA, 20 bp, Homo sapiens
gacttttgtctgatcaagtg

SEQ ID NO: 561543 - DNA, 24 bp, Homo sapiens
gagaaaaaaaaagccactaaggtc

SEQ ID NO: 561544 - DNA, 20 bp, Homo sapiens
gagaaccgagcaaagatcaa

SEQ ID NO: 561545 - DNA, 11 bp, Homo sapiens
gagaagaaaat

SEQ ID NO: 561546 - DNA, 22 bp, Homo sapiens
gagaatgagggcgtgaaacaca

SEQ ID NO: 561547 - DNA, 22 bp, Homo sapiens
gagacagagaggacgtgggcgg

SEQ ID NO: 561548 - DNA, 18 bp, Homo sapiens
gagacagttatttatagt

SEQ ID NO: 561549 - DNA, 23 bp, Homo sapiens
gagaccgagtgtggagctgcttc

SEQ ID NO: 561550 - DNA, 19 bp, Homo sapiens
gagagaggctaaaatgttt

SEQ ID NO: 561551 - DNA, 14 bp, Homo sapiens
gagagatatatctg

SEQ ID NO: 561552 - DNA, 16 bp, Homo sapiens
gagagatctccaactc

SEQ ID NO: 561553 - DNA, 19 bp, Homo sapiens
gagagatgtgtaatttttc

SEQ ID NO: 561554 - DNA, 21 bp, Homo sapiens
gagagcagagaagtacaggtc

SEQ ID NO: 561555 - DNA, 17 bp, Homo sapiens
gatggcgtgtcccctgc

SEQ ID NO: 561556 - DNA, 20 bp, Homo sapiens
gatggcgtgtcccctgcctg

SEQ ID NO: 561557 - DNA, 12 bp, Homo sapiens
gatgggcacagg

SEQ ID NO: 561558 - DNA, 13 bp, Homo sapiens
gatgggcacaggc

SEQ ID NO: 561559 - DNA, 17 bp, Homo sapiens
gatgtaagaagcccgat

SEQ ID NO: 561560 - DNA, 21 bp, Homo sapiens
gatgtagcaaaccctgtcaaa

SEQ ID NO: 561561 - DNA, 15 bp, Homo sapiens
gatgtatgtgtatat

SEQ ID NO: 561562 - DNA, 18 bp, Homo sapiens
gatgtatttctaaatgtt

SEQ ID NO: 561563 - DNA, 16 bp, Homo sapiens
gatgtattttgtgagt

SEQ ID NO: 561564 - DNA, 14 bp, Homo sapiens
gatgtgagaaaacc

SEQ ID NO: 561565 - DNA, 15 bp, Homo sapiens
gatgtggacatgcac

SEQ ID NO: 561566 - DNA, 17 bp, Homo sapiens
gatgtgtaatttttctg

SEQ ID NO: 561567 - DNA, 17 bp, Homo sapiens
gatgttaacagtatttt

SEQ ID NO: 561568 - DNA, 18 bp, Homo sapiens
gatgttcatggaattggt

SEQ ID NO: 561569 - DNA, 14 bp, Homo sapiens
gatgttgatgcaat

SEQ ID NO: 561570 - DNA, 21 bp, Homo sapiens
gatgttgatgcaatccttaca

SEQ ID NO: 561571 - DNA, 20 bp, Homo sapiens
gattaaattatcattgtttg

SEQ ID NO: 561572 - DNA, 17 bp, Homo sapiens
gattaaggtgatgtgat

SEQ ID NO: 561573 - DNA, 17 bp, Homo sapiens
gattacctgaaagccct

SEQ ID NO: 561574 - DNA, 21 bp, Homo sapiens
gattcaaataaccctgaatca

SEQ ID NO: 561575 - DNA, 18 bp, Homo sapiens
gattcacatgttttcaaa

SEQ ID NO: 561576 - DNA, 19 bp, Homo sapiens
gattcacatgttttcaaat

SEQ ID NO: 561577 - DNA, 20 bp, Homo sapiens
gattcacatgttttcaaatg

SEQ ID NO: 561578 - DNA, 16 bp, Homo sapiens
gattccccggagctgg

SEQ ID NO: 561579 - DNA, 21 bp, Homo sapiens
gattcccgtggctttgtgctt

SEQ ID NO: 561580 - DNA, 18 bp, Homo sapiens
gattcgtggtcttttcct

SEQ ID NO: 561581 - DNA, 20 bp, Homo sapiens
gattcttgttttgcttcccc

SEQ ID NO: 561582 - DNA, 21 bp, Homo sapiens
gattcttgttttgcttcccct

SEQ ID NO: 561583 - DNA, 15 bp, Homo sapiens
gattctttagagaag

SEQ ID NO: 561584 - DNA, 19 bp, Homo sapiens
gattgccggtcttgacagc

SEQ ID NO: 561585 - DNA, 16 bp, Homo sapiens
gattgcgcaaaactga

SEQ ID NO: 561586 - DNA, 13 bp, Homo sapiens
gattgcttttaaa

SEQ ID NO: 561587 - DNA, 22 bp, Homo sapiens
gattggattttatgttgacatt

SEQ ID NO: 561588 - DNA, 15 bp, Homo sapiens
gattggtttctcttc

SEQ ID NO: 561589 - DNA, 16 bp, Homo sapiens
gattggtttctcttct

SEQ ID NO: 561590 - DNA, 21 bp, Homo sapiens
gattggtttctcttctcccct

SEQ ID NO: 561591 - DNA, 17 bp, Homo sapiens
gatttacctttggaatt

SEQ ID NO: 561592 - DNA, 11 bp, Homo sapiens
gatttatcttt

SEQ ID NO: 561593 - DNA, 12 bp, Homo sapiens
gatttatcttta

SEQ ID NO: 561594 - DNA, 15 bp, Homo sapiens
gatttatctttatac

SEQ ID NO: 561595 - DNA, 18 bp, Homo sapiens
gatttatctttatacaga

SEQ ID NO: 561596 - DNA, 13 bp, Homo sapiens
gatttcacaaata

SEQ ID NO: 561597 - DNA, 12 bp, Homo sapiens
gatttcagaaac

SEQ ID NO: 561598 - DNA, 13 bp, Homo sapiens
gatttcagatgta

SEQ ID NO: 561599 - DNA, 15 bp, Homo sapiens
gatttccaagtaata

SEQ ID NO: 561600 - DNA, 15 bp, Homo sapiens
gatttggtgaacaac

SEQ ID NO: 561601 - DNA, 16 bp, Homo sapiens
gatttgtaaaacagtg

SEQ ID NO: 561602 - DNA, 17 bp, Homo sapiens
gatttgtcactgcttca

SEQ ID NO: 561603 - DNA, 23 bp, Homo sapiens
gatttgttttcttcaacatgtgt

SEQ ID NO: 561604 - DNA, 22 bp, Homo sapiens
gattttagttttattttctaaa

SEQ ID NO: 561605 - DNA, 18 bp, Homo sapiens
gattttatgttgacattt

SEQ ID NO: 561606 - DNA, 21 bp, Homo sapiens
gattttatgtttaaaatggca

SEQ ID NO: 561607 - DNA, 16 bp, Homo sapiens
gattttcaaatatgta

SEQ ID NO: 561608 - DNA, 21 bp, Homo sapiens
gattttcaaatatgtaaactt

SEQ ID NO: 561609 - DNA, 22 bp, Homo sapiens
gattttcaaatatgtaaacttt

SEQ ID NO: 561610 - DNA, 17 bp, Homo sapiens
gatttttcaaagacttc

SEQ ID NO: 561611 - DNA, 16 bp, Homo sapiens
gattttttaaaagaaa

SEQ ID NO: 561612 - DNA, 17 bp, Homo sapiens
gattttttaaaagaaat

SEQ ID NO: 561613 - DNA, 17 bp, Homo sapiens
gcaaaaaaagttgtatg

SEQ ID NO: 561614 - DNA, 18 bp, Homo sapiens
gcaaaaaaagttgtatga

SEQ ID NO: 561615 - DNA, 17 bp, Homo sapiens
gcaaaaacgaaagctgg

SEQ ID NO: 561616 - DNA, 21 bp, Homo sapiens
gcaaaaccaggttttgttccg

SEQ ID NO: 561617 - DNA, 16 bp, Homo sapiens
gcaaaagcctcagaaa

SEQ ID NO: 561618 - DNA, 18 bp, Homo sapiens
gcaaaatacatgatgatt

SEQ ID NO: 561619 - DNA, 19 bp, Homo sapiens
gcaaaccctgtcaaacatt

SEQ ID NO: 561620 - DNA, 18 bp, Homo sapiens
gcaaagctgttcttcctg

SEQ ID NO: 561621 - DNA, 19 bp, Homo sapiens
gcaaagctgttcttcctgg

SEQ ID NO: 561622 - DNA, 16 bp, Homo sapiens
gcaaatacaaaatgat

SEQ ID NO: 561623 - DNA, 16 bp, Homo sapiens
gcaaatttcaaaagac

SEQ ID NO: 561624 - DNA, 23 bp, Homo sapiens
gcaaatttcaaaagacatgttgt

SEQ ID NO: 561625 - DNA, 24 bp, Homo sapiens
gcaaatttctagatatgagaaata

SEQ ID NO: 561626 - DNA, 22 bp, Homo sapiens
gcaacaaactgcacatgatttc

SEQ ID NO: 561627 - DNA, 14 bp, Homo sapiens
gcaacaattttcag

SEQ ID NO: 561628 - DNA, 18 bp, Homo sapiens
gcaacctgacagcaaaca

SEQ ID NO: 561629 - DNA, 20 bp, Homo sapiens
gcaacctgacagcaaacaca

SEQ ID NO: 561630 - DNA, 22 bp, Homo sapiens
gcaacctgacagcaaacacagt

SEQ ID NO: 561631 - DNA, 19 bp, Homo sapiens
gcaacttgaaattatatct

SEQ ID NO: 561632 - DNA, 16 bp, Homo sapiens
gcaagattgatgtttc

SEQ ID NO: 561633 - DNA, 15 bp, Homo sapiens
gcaagcagtttcaat

SEQ ID NO: 561634 - DNA, 22 bp, Homo sapiens
gcaagcagtttcaataaagttt

SEQ ID NO: 561635 - DNA, 20 bp, Homo sapiens
gcaaggcgctaacttgctta

SEQ ID NO: 561636 - DNA, 15 bp, Homo sapiens
gcaataaactcagtc

SEQ ID NO: 561637 - DNA, 12 bp, Homo sapiens
gcaatatatttt

SEQ ID NO: 561638 - DNA, 15 bp, Homo sapiens
gcaatgttttgcttt

SEQ ID NO: 561639 - DNA, 16 bp, Homo sapiens
gcaatttacttggaat

SEQ ID NO: 561640 - DNA, 12 bp, Homo sapiens
gcaatttgtctt

SEQ ID NO: 561641 - DNA, 23 bp, Homo sapiens
gcaattttataaggacttcctga

SEQ ID NO: 561642 - DNA, 23 bp, Homo sapiens
gcacaaaaagataccttaaaatt

SEQ ID NO: 561643 - DNA, 20 bp, Homo sapiens
gcacaaacttcagaaacccg

SEQ ID NO: 561644 - DNA, 14 bp, Homo sapiens
gcacaatgaatgta

SEQ ID NO: 561645 - DNA, 12 bp, Homo sapiens
gcacaatgtctt

SEQ ID NO: 561646 - DNA, 17 bp, Homo sapiens
gcacaatgtttgatgtc

SEQ ID NO: 561647 - DNA, 10 bp, Homo sapiens
gcacacacac

SEQ ID NO: 561648 - DNA, 23 bp, Homo sapiens
gcacacacacacacacacacacg

SEQ ID NO: 561649 - DNA, 13 bp, Homo sapiens
gcacacagaaata

SEQ ID NO: 561650 - DNA, 19 bp, Homo sapiens
gcacacttccccttgggat

SEQ ID NO: 561651 - DNA, 11 bp, Homo sapiens
gcacagaagag

SEQ ID NO: 561652 - DNA, 23 bp, Homo sapiens
gcacagacaattctaatggtaac

SEQ ID NO: 561653 - DNA, 23 bp, Homo sapiens
gcacagagagggggccacctccc

SEQ ID NO: 561654 - DNA, 16 bp, Homo sapiens
gcacagccaatctcca

SEQ ID NO: 561655 - DNA, 20 bp, Homo sapiens
gcacagcctcacccctgcag

SEQ ID NO: 561656 - DNA, 20 bp, Homo sapiens
gcacagctcccttctgttga

SEQ ID NO: 561657 - DNA, 18 bp, Homo sapiens
gcacagctttcctgggtc

SEQ ID NO: 561658 - DNA, 11 bp, Homo sapiens
gcacaggcaga

SEQ ID NO: 561659 - DNA, 18 bp, Homo sapiens
gcacaggctcagtgtagg

SEQ ID NO: 561660 - DNA, 16 bp, Homo sapiens
gcacagggcatgaaat

SEQ ID NO: 561661 - DNA, 22 bp, Homo sapiens
gcacagggcatgaaatgaacac

SEQ ID NO: 561662 - DNA, 16 bp, Homo sapiens
gcacagtcactgctct

SEQ ID NO: 561663 - DNA, 15 bp, Homo sapiens
gcacataccaaagct

SEQ ID NO: 561664 - DNA, 15 bp, Homo sapiens
gcacatccattccca

SEQ ID NO: 561665 - DNA, 23 bp, Homo sapiens
gcacatccattcccaagaaatgc

SEQ ID NO: 561666 - DNA, 20 bp, Homo sapiens
gcacatgatttcacaaatat

SEQ ID NO: 561667 - DNA, 21 bp, Homo sapiens
gcaccaataaaggaggaatca

SEQ ID NO: 561668 - DNA, 13 bp, Homo sapiens
gcaccaccctcct

SEQ ID NO: 561669 - DNA, 21 bp, Homo sapiens
gcaccaccgaccaactccaga

SEQ ID NO: 561670 - DNA, 15 bp, Homo sapiens
gcaccacgtgccaag

SEQ ID NO: 561671 - DNA, 13 bp, Homo sapiens
gcacccacaccct

SEQ ID NO: 561672 - DNA, 23 bp, Homo sapiens
gcacccacaccctacagcagatc

SEQ ID NO: 561673 - DNA, 16 bp, Homo sapiens
gcacccgcatgtacaa

SEQ ID NO: 561674 - DNA, 12 bp, Homo sapiens
gcacctgcttct

SEQ ID NO: 561675 - DNA, 18 bp, Homo sapiens
gcacctgtctgctccagc

SEQ ID NO: 561676 - DNA, 22 bp, Homo sapiens
gcacctttccttcaagccagca

SEQ ID NO: 561677 - DNA, 16 bp, Homo sapiens
gcacgcacacacacaa

SEQ ID NO: 561678 - DNA, 20 bp, Homo sapiens
gcacgtagtagggtcaggcc

SEQ ID NO: 561679 - DNA, 19 bp, Homo sapiens
gcactaagtctctttttta

SEQ ID NO: 561680 - DNA, 23 bp, Homo sapiens
gcactaagtctcttttttacaaa

SEQ ID NO: 561681 - DNA, 14 bp, Homo sapiens
gcactctagccgga

SEQ ID NO: 561682 - DNA, 9 bp, Homo sapiens
gcactgaag

SEQ ID NO: 561683 - DNA, 22 bp, Homo sapiens
gcactgatatatttaaaaacaa

SEQ ID NO: 561684 - DNA, 13 bp, Homo sapiens
gcactgccctccg

SEQ ID NO: 561685 - DNA, 20 bp, Homo sapiens
gcactgccctccgcccttcc

SEQ ID NO: 561686 - DNA, 19 bp, Homo sapiens
gcactggatggagctggag

SEQ ID NO: 561687 - DNA, 19 bp, Homo sapiens
gcacttcagggcagatttt

SEQ ID NO: 561688 - DNA, 21 bp, Homo sapiens
gcagaggttgcagtgagctga

SEQ ID NO: 561689 - DNA, 15 bp, Homo sapiens
gcagagtcaagctga

SEQ ID NO: 561690 - DNA, 22 bp, Homo sapiens
gcagagtcaagctgatgaagtt

SEQ ID NO: 561691 - DNA, 19 bp, Homo sapiens
gcagataattctggaccag

SEQ ID NO: 561692 - DNA, 19 bp, Homo sapiens
gcagatccacctgcacaaa

SEQ ID NO: 561693 - DNA, 16 bp, Homo sapiens
gcagatttcagatgta

SEQ ID NO: 561694 - DNA, 14 bp, Homo sapiens
gcagcaaaaatata

SEQ ID NO: 561695 - DNA, 15 bp, Homo sapiens
gcagcaaaaatataa

SEQ ID NO: 561696 - DNA, 21 bp, Homo sapiens
gcagcacccaggttttgcact

SEQ ID NO: 561697 - DNA, 17 bp, Homo sapiens
gcagcagcagcagcagt

SEQ ID NO: 561698 - DNA, 22 bp, Homo sapiens
gcagccccaaattgtcacctgc

SEQ ID NO: 561699 - DNA, 23 bp, Homo sapiens
gcagccccccagtgtccccaggg

SEQ ID NO: 561700 - DNA, 23 bp, Homo sapiens
gcagcccgggagatccgccctgg

SEQ ID NO: 561701 - DNA, 23 bp, Homo sapiens
gcagcctactagggacctgggga

SEQ ID NO: 561702 - DNA, 14 bp, Homo sapiens
gcagcctcttgaat

SEQ ID NO: 561703 - DNA, 12 bp, Homo sapiens
gcagctccctca

SEQ ID NO: 561704 - DNA, 12 bp, Homo sapiens
gcagctcttcct

SEQ ID NO: 561705 - DNA, 19 bp, Homo sapiens
gcagctgcatttggggtgg

SEQ ID NO: 561706 - DNA, 20 bp, Homo sapiens
gcagctgcatttggggtggg

SEQ ID NO: 561707 - DNA, 14 bp, Homo sapiens
gcagcttcaccaga

SEQ ID NO: 561708 - DNA, 15 bp, Homo sapiens
gcaggaagtccctga

SEQ ID NO: 561709 - DNA, 22 bp, Homo sapiens
gcaggagacactggtctcagag

SEQ ID NO: 561710 - DNA, 14 bp, Homo sapiens
gcaggatgggggag

SEQ ID NO: 561711 - DNA, 18 bp, Homo sapiens
gcaggcagagctcagcac

SEQ ID NO: 561712 - DNA, 23 bp, Homo sapiens
gcaggcagagctcagcacagcct

SEQ ID NO: 561713 - DNA, 9 bp, Homo sapiens
gcaggcagc

SEQ ID NO: 561714 - DNA, 12 bp, Homo sapiens
gcaggcaggctg

SEQ ID NO: 561715 - DNA, 18 bp, Homo sapiens
gcaggcctccctgccagt

SEQ ID NO: 561716 - DNA, 22 bp, Homo sapiens
gcagggaggctctgtgtgttaa

SEQ ID NO: 561717 - DNA, 19 bp, Homo sapiens
gcaggggccctgcagctct

SEQ ID NO: 561718 - DNA, 23 bp, Homo sapiens
gcaggggtggaggagagcctggt

SEQ ID NO: 561719 - DNA, 15 bp, Homo sapiens
gcaggtgacagtgag

SEQ ID NO: 561720 - DNA, 16 bp, Homo sapiens
gcaggtgacagtgagg

SEQ ID NO: 561721 - DNA, 21 bp, Homo sapiens
gcaggtgcccctctctccatc

SEQ ID NO: 561722 - DNA, 16 bp, Homo sapiens
gcaggtggccagggct

SEQ ID NO: 561723 - DNA, 22 bp, Homo sapiens
gcaggttgtgtgtgtgtgcagt

SEQ ID NO: 561724 - DNA, 18 bp, Homo sapiens
gcagtaggggagagagca

SEQ ID NO: 561725 - DNA, 14 bp, Homo sapiens
gcagtcatcagaag

SEQ ID NO: 561726 - DNA, 19 bp, Homo sapiens
gcagtcttatgcttccaga

SEQ ID NO: 561727 - DNA, 22 bp, Homo sapiens
gcagtcttatgcttccagaaac

SEQ ID NO: 561728 - DNA, 18 bp, Homo sapiens
gcagtgatattctttgtt

SEQ ID NO: 561729 - DNA, 16 bp, Homo sapiens
gcagtgcaaggaggga

SEQ ID NO: 561730 - DNA, 14 bp, Homo sapiens
gcagtggcaaaata

SEQ ID NO: 561731 - DNA, 15 bp, Homo sapiens
gcagtggcaaaatat

SEQ ID NO: 561732 - DNA, 16 bp, Homo sapiens
gcagtggcaaaatatt

SEQ ID NO: 561733 - DNA, 21 bp, Homo sapiens
gcagttgagaggacactcccg

SEQ ID NO: 561734 - DNA, 23 bp, Homo sapiens
gcagttgcccagcctctttccct

SEQ ID NO: 561735 - DNA, 12 bp, Homo sapiens
gcagtttcaata

SEQ ID NO: 561736 - DNA, 17 bp, Homo sapiens
gcagtttcaataaagtt

SEQ ID NO: 561737 - DNA, 19 bp, Homo sapiens
gcataatatgcatatatat

SEQ ID NO: 561738 - DNA, 16 bp, Homo sapiens
gcatacattttctggt

SEQ ID NO: 561739 - DNA, 19 bp, Homo sapiens
gcatatatataaaatacac

SEQ ID NO: 561740 - DNA, 22 bp, Homo sapiens
gcatatatataaaatacacgtg

SEQ ID NO: 561741 - DNA, 12 bp, Homo sapiens
gcatatatatgt

SEQ ID NO: 561742 - DNA, 14 bp, Homo sapiens
gcatattaaagaaa

SEQ ID NO: 561743 - DNA, 15 bp, Homo sapiens
gcatcacctctgtaa

SEQ ID NO: 561744 - DNA, 16 bp, Homo sapiens
gcatcccacagccagt

SEQ ID NO: 561745 - DNA, 18 bp, Homo sapiens
gcatccccagccccctgg

SEQ ID NO: 561746 - DNA, 14 bp, Homo sapiens
gcatccgtgtattt

SEQ ID NO: 561747 - DNA, 22 bp, Homo sapiens
gcatccttgaggacctccacct

SEQ ID NO: 561748 - DNA, 16 bp, Homo sapiens
gcatctaaactttaat

SEQ ID NO: 561749 - DNA, 20 bp, Homo sapiens
gcatctaaactttaatatgt

SEQ ID NO: 561750 - DNA, 16 bp, Homo sapiens
gcatgaaaattgtgtt

SEQ ID NO: 561751 - DNA, 18 bp, Homo sapiens
gcatgaaatgaacacaaa

SEQ ID NO: 561752 - DNA, 15 bp, Homo sapiens
gcatgaacagtgcac

SEQ ID NO: 561753 - DNA, 12 bp, Homo sapiens
gcatgaccctgg

SEQ ID NO: 561754 - DNA, 13 bp, Homo sapiens
gcatgaccctgga

SEQ ID NO: 561755 - DNA, 22 bp, Homo sapiens
gcatgagtggacgtcagaagaa

SEQ ID NO: 561756 - DNA, 19 bp, Homo sapiens
gcatgccgagtgccccaga

SEQ ID NO: 561757 - DNA, 15 bp, Homo sapiens
gcatggatttctgtc

SEQ ID NO: 561758 - DNA, 15 bp, Homo sapiens
gcatggtccattctc

SEQ ID NO: 561759 - DNA, 17 bp, Homo sapiens
gcatgtacaaaaacaca

SEQ ID NO: 561760 - DNA, 18 bp, Homo sapiens
gcatgtacaaaaacacaa

SEQ ID NO: 561761 - DNA, 21 bp, Homo sapiens
gcatgtacaaaaacacaaata

SEQ ID NO: 561762 - DNA, 11 bp, Homo sapiens
gcatgtgtgta

SEQ ID NO: 561763 - DNA, 22 bp, Homo sapiens
gcatttaagttgtaaacgtctt

SEQ ID NO: 561764 - DNA, 13 bp, Homo sapiens
gcatttagcacag

SEQ ID NO: 561765 - DNA, 23 bp, Homo sapiens
gcatttagcacagtatttaacat

SEQ ID NO: 561766 - DNA, 15 bp, Homo sapiens
gcatttcccaccctg

SEQ ID NO: 561767 - DNA, 21 bp, Homo sapiens
gcatttggtacacacttgacc

SEQ ID NO: 561768 - DNA, 17 bp, Homo sapiens
gcattttctgaaactaa

SEQ ID NO: 561769 - DNA, 21 bp, Homo sapiens
gcattttctgaaactaatgaa

SEQ ID NO: 561770 - DNA, 20 bp, Homo sapiens
gccaaaagcttccctccctg

SEQ ID NO: 561771 - DNA, 13 bp, Homo sapiens
gccaaaataaagt

SEQ ID NO: 561772 - DNA, 15 bp, Homo sapiens
gccaaaataaagtct

SEQ ID NO: 561773 - DNA, 11 bp, Homo sapiens
gccaaacatta

SEQ ID NO: 561774 - DNA, 19 bp, Homo sapiens
gccaaacattaatgttgat

SEQ ID NO: 561775 - DNA, 15 bp, Homo sapiens
gccaaagacaaatag

SEQ ID NO: 561776 - DNA, 16 bp, Homo sapiens
gccaaatcctgggcat

SEQ ID NO: 561777 - DNA, 21 bp, Homo sapiens
gccaaatcctgggcatcccca

SEQ ID NO: 561778 - DNA, 20 bp, Homo sapiens
gccaaatgagttcccttgat

SEQ ID NO: 561779 - DNA, 18 bp, Homo sapiens
gccaacggccccagcttc

SEQ ID NO: 561780 - DNA, 21 bp, Homo sapiens
gccaagctgaggaggtgctgc

SEQ ID NO: 561781 - DNA, 16 bp, Homo sapiens
gccaatctccaggctc

SEQ ID NO: 561782 - DNA, 14 bp, Homo sapiens
gccacatcccccaa

SEQ ID NO: 561783 - DNA, 21 bp, Homo sapiens
gccaccagatgtgacagtgtt

SEQ ID NO: 561784 - DNA, 12 bp, Homo sapiens
gccaccctgtgc

SEQ ID NO: 561785 - DNA, 13 bp, Homo sapiens
gccacggcagcct

SEQ ID NO: 561786 - DNA, 16 bp, Homo sapiens
gccactgtatttgtta

SEQ ID NO: 561787 - DNA, 19 bp, Homo sapiens
gccactgtatttgttaatt

SEQ ID NO: 561788 - DNA, 16 bp, Homo sapiens
gccacttatttccatg

SEQ ID NO: 561789 - DNA, 19 bp, Homo sapiens
gccactttaagagagaaat

SEQ ID NO: 561790 - DNA, 13 bp, Homo sapiens
gccactttccaag

SEQ ID NO: 561791 - DNA, 16 bp, Homo sapiens
gccagcaacacagagc

SEQ ID NO: 561792 - DNA, 20 bp, Homo sapiens
gccagctgcaggaatcaaaa

SEQ ID NO: 561793 - DNA, 22 bp, Homo sapiens
gccagggaccccagaatcatgt

SEQ ID NO: 561794 - DNA, 14 bp, Homo sapiens
gcccccagacccca

SEQ ID NO: 561795 - DNA, 16 bp, Homo sapiens
gccccccatgccctcc

SEQ ID NO: 561796 - DNA, 17 bp, Homo sapiens
gccccctcttccctggt

SEQ ID NO: 561797 - DNA, 13 bp, Homo sapiens
gccccctgcctgc

SEQ ID NO: 561798 - DNA, 15 bp, Homo sapiens
gccccctggcccctc

SEQ ID NO: 561799 - DNA, 19 bp, Homo sapiens
gccccctggcccctcccac

SEQ ID NO: 561800 - DNA, 21 bp, Homo sapiens
gccccgtctacagctccccca

SEQ ID NO: 561801 - DNA, 17 bp, Homo sapiens
gcccctcccacatcccc

SEQ ID NO: 561802 - DNA, 15 bp, Homo sapiens
gcccctccctcctct

SEQ ID NO: 561803 - DNA, 14 bp, Homo sapiens
gcccctctctccat

SEQ ID NO: 561804 - DNA, 21 bp, Homo sapiens
gcccctgccttggggtcaggt

SEQ ID NO: 561805 - DNA, 13 bp, Homo sapiens
gcccctgctgctc

SEQ ID NO: 561806 - DNA, 19 bp, Homo sapiens
gcccctggtggtgggggct

SEQ ID NO: 561807 - DNA, 24 bp, Homo sapiens
gcccgaagcatgaacagtgcacct

SEQ ID NO: 561808 - DNA, 18 bp, Homo sapiens
gcccggcagtgcaccccc

SEQ ID NO: 561809 - DNA, 13 bp, Homo sapiens
gcccggcccagga

SEQ ID NO: 561810 - DNA, 16 bp, Homo sapiens
gccctccctgctgcca

SEQ ID NO: 561811 - DNA, 18 bp, Homo sapiens
gccctccctgctgccagg

SEQ ID NO: 561812 - DNA, 22 bp, Homo sapiens
gccctccgcgggggacaggaac

SEQ ID NO: 561813 - DNA, 23 bp, Homo sapiens
gccctccgcgggggacaggaaca

SEQ ID NO: 561814 - DNA, 21 bp, Homo sapiens
gccctccgtcctggcagggca

SEQ ID NO: 561815 - DNA, 11 bp, Homo sapiens
gccctcttcaa

SEQ ID NO: 561816 - DNA, 16 bp, Homo sapiens
gccctggcaggcaggg

SEQ ID NO: 561817 - DNA, 13 bp, Homo sapiens
gccctggggcctg

SEQ ID NO: 561818 - DNA, 15 bp, Homo sapiens
gccctggggcctgta

SEQ ID NO: 561819 - DNA, 15 bp, Homo sapiens
gccctgtcaggaggc

SEQ ID NO: 561820 - DNA, 20 bp, Homo sapiens
gcccttcccaacctcccctg

SEQ ID NO: 561821 - DNA, 17 bp, Homo sapiens
gcccttcctctgctccc

SEQ ID NO: 561822 - DNA, 20 bp, Homo sapiens
gccctttacttgtctttctg

SEQ ID NO: 561823 - DNA, 23 bp, Homo sapiens
gccctttacttgtctttctgggg

SEQ ID NO: 561824 - DNA, 15 bp, Homo sapiens
gccgaatagctgatg

SEQ ID NO: 561825 - DNA, 21 bp, Homo sapiens
gccgagcccttgcccatgctg

SEQ ID NO: 561826 - DNA, 19 bp, Homo sapiens
gccgagctctcctgggcca

SEQ ID NO: 561827 - DNA, 20 bp, Homo sapiens
gccgagctctcctgggccag

SEQ ID NO: 561828 - DNA, 22 bp, Homo sapiens
gccgagctctcctgggccaggg

SEQ ID NO: 561829 - DNA, 14 bp, Homo sapiens
gccggcctggggcc

SEQ ID NO: 561830 - DNA, 23 bp, Homo sapiens
gccggcgtggcaaatataaaact

SEQ ID NO: 561831 - DNA, 14 bp, Homo sapiens
gccgggcagagcac

SEQ ID NO: 561832 - DNA, 18 bp, Homo sapiens
gccgggctggcttctccc

SEQ ID NO: 561833 - DNA, 20 bp, Homo sapiens
gccgggctggcttctccctg

SEQ ID NO: 561834 - DNA, 15 bp, Homo sapiens
gcctaatattgaaaa

SEQ ID NO: 561835 - DNA, 18 bp, Homo sapiens
gcctagtggcttcagccc

SEQ ID NO: 561836 - DNA, 23 bp, Homo sapiens
gcctagtggcttcagcccctggg

SEQ ID NO: 561837 - DNA, 16 bp, Homo sapiens
gcctatcctaagagct

SEQ ID NO: 561838 - DNA, 14 bp, Homo sapiens
gcctcacccctgca

SEQ ID NO: 561839 - DNA, 15 bp, Homo sapiens
gcctcacccctgcag

SEQ ID NO: 561840 - DNA, 22 bp, Homo sapiens
gcctcactgatatattttccag

SEQ ID NO: 561841 - DNA, 16 bp, Homo sapiens
gcctcagaaagggatt

SEQ ID NO: 561842 - DNA, 21 bp, Homo sapiens
gcctcagcaaacccaaagatg

SEQ ID NO: 561843 - DNA, 22 bp, Homo sapiens
gcctcagcaaacccaaagatgt

SEQ ID NO: 561844 - DNA, 16 bp, Homo sapiens
gcctcaggaggcagtg

SEQ ID NO: 561845 - DNA, 23 bp, Homo sapiens
gcctctccaggcaccatctccct

SEQ ID NO: 561846 - DNA, 19 bp, Homo sapiens
gcctctgaactgctgctgg

SEQ ID NO: 561847 - DNA, 20 bp, Homo sapiens
gcctctgattctatgtaact

SEQ ID NO: 561848 - DNA, 22 bp, Homo sapiens
gcctctgattctatgtaacttg

SEQ ID NO: 561849 - DNA, 11 bp, Homo sapiens
gcctctgccct

SEQ ID NO: 561850 - DNA, 23 bp, Homo sapiens
gcctctggggagaccgagtgtgg

SEQ ID NO: 561851 - DNA, 22 bp, Homo sapiens
gcctctgtcccggaagagtcat

SEQ ID NO: 561852 - DNA, 15 bp, Homo sapiens
gcctctgtcctcgct

SEQ ID NO: 561853 - DNA, 13 bp, Homo sapiens
gcctcttaaaaat

SEQ ID NO: 561854 - DNA, 17 bp, Homo sapiens
gcctgaaagcaacagct

SEQ ID NO: 561855 - DNA, 17 bp, Homo sapiens
gcctgacagccagaact

SEQ ID NO: 561856 - DNA, 20 bp, Homo sapiens
gcctgacctccccctccttc

SEQ ID NO: 561857 - DNA, 14 bp, Homo sapiens
gcctgactccccca

SEQ ID NO: 561858 - DNA, 15 bp, Homo sapiens
gcctgactcccccag

SEQ ID NO: 561859 - DNA, 23 bp, Homo sapiens
gcctgactcccccagtccccttc

SEQ ID NO: 561860 - DNA, 13 bp, Homo sapiens
gcctgagagcaga

SEQ ID NO: 561861 - DNA, 17 bp, Homo sapiens
gcctgagagcagaatga

SEQ ID NO: 561862 - DNA, 13 bp, Homo sapiens
gcctgaggctcct

SEQ ID NO: 561863 - DNA, 13 bp, Homo sapiens
gcctgccctgtca

SEQ ID NO: 561864 - DNA, 19 bp, Homo sapiens
gcctgccctgtcaggaggc

SEQ ID NO: 561865 - DNA, 22 bp, Homo sapiens
gcctgccttgcccactcctgct

SEQ ID NO: 561866 - DNA, 14 bp, Homo sapiens
gcctgcgtggcctg

SEQ ID NO: 561867 - DNA, 14 bp, Homo sapiens
gcctgctccttccc

SEQ ID NO: 561868 - DNA, 15 bp, Homo sapiens
gcctgctccttccct

SEQ ID NO: 561869 - DNA, 20 bp, Homo sapiens
gcctgctccttcccttgcta

SEQ ID NO: 561870 - DNA, 17 bp, Homo sapiens
gcctgctttgtctcctc

SEQ ID NO: 561871 - DNA, 18 bp, Homo sapiens
gcctggaaacctgtctga

SEQ ID NO: 561872 - DNA, 14 bp, Homo sapiens
gcctggccagacca

SEQ ID NO: 561873 - DNA, 15 bp, Homo sapiens
gcctggccagaccag

SEQ ID NO: 561874 - DNA, 15 bp, Homo sapiens
gcctggggctgccgt

SEQ ID NO: 561875 - DNA, 16 bp, Homo sapiens
gcctggtctcctgccc

SEQ ID NO: 561876 - DNA, 20 bp, Homo sapiens
gcctgtctcggaacctgtga

SEQ ID NO: 561877 - DNA, 19 bp, Homo sapiens
gcctgtctgtgaagagcaa

SEQ ID NO: 561878 - DNA, 16 bp, Homo sapiens
gccttaaaactttaat

SEQ ID NO: 561879 - DNA, 19 bp, Homo sapiens
gccttaacatccctcctgc

SEQ ID NO: 561880 - DNA, 14 bp, Homo sapiens
gccttaagctgcag

SEQ ID NO: 561881 - DNA, 13 bp, Homo sapiens
gccttccacctct

SEQ ID NO: 561882 - DNA, 17 bp, Homo sapiens
gccttctacctgcagga

SEQ ID NO: 561883 - DNA, 20 bp, Homo sapiens
gccttctacctgcaggactc

SEQ ID NO: 561884 - DNA, 13 bp, Homo sapiens
gccttctcccctc

SEQ ID NO: 561885 - DNA, 17 bp, Homo sapiens
gccttgggctctgctga

SEQ ID NO: 561886 - DNA, 21 bp, Homo sapiens
gcctttatctaccaactttca

SEQ ID NO: 561887 - DNA, 18 bp, Homo sapiens
gcctttgaagtgcctctg

SEQ ID NO: 561888 - DNA, 12 bp, Homo sapiens
gccttttgtagc

SEQ ID NO: 561889 - DNA, 13 bp, Homo sapiens
gccttttgtagct

SEQ ID NO: 561890 - DNA, 17 bp, Homo sapiens
gccttttgtagctgtca

SEQ ID NO: 561891 - DNA, 17 bp, Homo sapiens
gcttttcccacctcttt

SEQ ID NO: 561892 - DNA, 13 bp, Homo sapiens
gcttttgcaaata

SEQ ID NO: 561893 - DNA, 21 bp, Homo sapiens
gcttttgctggtcactgccat

SEQ ID NO: 561894 - DNA, 22 bp, Homo sapiens
gcttttgctggtcactgccatg

SEQ ID NO: 561895 - DNA, 16 bp, Homo sapiens
gcttttgttttgcttt

SEQ ID NO: 561896 - DNA, 13 bp, Homo sapiens
ggaaaaaggcttc

SEQ ID NO: 561897 - DNA, 12 bp, Homo sapiens
ggaaaaatatgt

SEQ ID NO: 561898 - DNA, 17 bp, Homo sapiens
ggaaaacacccagggaa

SEQ ID NO: 561899 - DNA, 14 bp, Homo sapiens
ggaaaagaaatcta

SEQ ID NO: 561900 - DNA, 20 bp, Homo sapiens
ggaaaaggcttgagtctgga

SEQ ID NO: 561901 - DNA, 16 bp, Homo sapiens
ggaaacactaaatgtt

SEQ ID NO: 561902 - DNA, 23 bp, Homo sapiens
ggaaacactaaatgttaaagatg

SEQ ID NO: 561903 - DNA, 12 bp, Homo sapiens
ggaaagcacaga

SEQ ID NO: 561904 - DNA, 14 bp, Homo sapiens
ggaaatatctgtga

SEQ ID NO: 561905 - DNA, 12 bp, Homo sapiens
ggaaatttcacg

SEQ ID NO: 561906 - DNA, 17 bp, Homo sapiens
ggaacacccagccccag

SEQ ID NO: 561907 - DNA, 12 bp, Homo sapiens
ggaacataaaaa

SEQ ID NO: 561908 - DNA, 19 bp, Homo sapiens
ggaacctgaggcctgaagg

SEQ ID NO: 561909 - DNA, 18 bp, Homo sapiens
ggaacctgtgagctgcac

SEQ ID NO: 561910 - DNA, 15 bp, Homo sapiens
ggaagacctcaagaa

SEQ ID NO: 561911 - DNA, 16 bp, Homo sapiens
ggaagataagttggaa

SEQ ID NO: 561912 - DNA, 22 bp, Homo sapiens
ggaagcaggttaaatgttttgt

SEQ ID NO: 561913 - DNA, 17 bp, Homo sapiens
ggaagcctcctgctgag

SEQ ID NO: 561914 - DNA, 19 bp, Homo sapiens
ggaagcctcctgctgagtg

SEQ ID NO: 561915 - DNA, 20 bp, Homo sapiens
ggaagctggcaggagacact

SEQ ID NO: 561916 - DNA, 18 bp, Homo sapiens
ggaaggcacttctgcctg

SEQ ID NO: 561917 - DNA, 14 bp, Homo sapiens
ggaaggcccagcac

SEQ ID NO: 561918 - DNA, 15 bp, Homo sapiens
ggaaggcccagcacc

SEQ ID NO: 561919 - DNA, 16 bp, Homo sapiens
ggaagggcaggaaatg

SEQ ID NO: 561920 - DNA, 19 bp, Homo sapiens
ggaagtaaacctgaacaaa

SEQ ID NO: 561921 - DNA, 23 bp, Homo sapiens
ggaagtaaacctgaacaaaccct

SEQ ID NO: 561922 - DNA, 15 bp, Homo sapiens
ggaatattatatttg

SEQ ID NO: 561923 - DNA, 14 bp, Homo sapiens
ggaatcctgtcctc

SEQ ID NO: 561924 - DNA, 23 bp, Homo sapiens
ggaatcttctcatcttttatcta

SEQ ID NO: 561925 - DNA, 19 bp, Homo sapiens
ggaatgcccttcactgtca

SEQ ID NO: 561926 - DNA, 23 bp, Homo sapiens
ggaatgtatagtatttgaaaaca

SEQ ID NO: 561927 - DNA, 14 bp, Homo sapiens
ggaattaaaaagaa

SEQ ID NO: 561928 - DNA, 21 bp, Homo sapiens
ggaattgtgctccaaatgtct

SEQ ID NO: 561929 - DNA, 17 bp, Homo sapiens
ggacaatttaccacagg

SEQ ID NO: 561930 - DNA, 18 bp, Homo sapiens
ggacacctgtactggaga

SEQ ID NO: 561931 - DNA, 18 bp, Homo sapiens
ggacacggcctctgggga

SEQ ID NO: 561932 - DNA, 22 bp, Homo sapiens
ggacacttatccacgagagcgc

SEQ ID NO: 561933 - DNA, 20 bp, Homo sapiens
ggacagaaggctcctgcccc

SEQ ID NO: 561934 - DNA, 17 bp, Homo sapiens
ggacaggaacacccagc

SEQ ID NO: 561935 - DNA, 23 bp, Homo sapiens
ggacaggaacacccagccccagc

SEQ ID NO: 561936 - DNA, 15 bp, Homo sapiens
ggacatgcacccgca

SEQ ID NO: 561937 - DNA, 21 bp, Homo sapiens
ggacatgcacccgcatgtaca

SEQ ID NO: 561938 - DNA, 23 bp, Homo sapiens
ggacatgcacccgcatgtacaaa

SEQ ID NO: 561939 - DNA, 11 bp, Homo sapiens
ggaccagagac

SEQ ID NO: 561940 - DNA, 16 bp, Homo sapiens
ggaccattttcctgca

SEQ ID NO: 561941 - DNA, 11 bp, Homo sapiens
ggacccagctg

SEQ ID NO: 561942 - DNA, 18 bp, Homo sapiens
ggacccatgaaacagcag

SEQ ID NO: 561943 - DNA, 21 bp, Homo sapiens
ggacccatgaaacagcagctg

SEQ ID NO: 561944 - DNA, 22 bp, Homo sapiens
ggacccatgaaacagcagctga

SEQ ID NO: 561945 - DNA, 16 bp, Homo sapiens
ggaccccatctgctga

SEQ ID NO: 561946 - DNA, 23 bp, Homo sapiens
ggaccccatctgctgagctctga

SEQ ID NO: 561947 - DNA, 19 bp, Homo sapiens
ggaccctcggggcaggaag

SEQ ID NO: 561948 - DNA, 16 bp, Homo sapiens
ggaccgaaggtgacag

SEQ ID NO: 561949 - DNA, 13 bp, Homo sapiens
ggacgcagggaga

SEQ ID NO: 561950 - DNA, 14 bp, Homo sapiens
ggacgcagggagac

SEQ ID NO: 561951 - DNA, 13 bp, Homo sapiens
ggactctgccttc

SEQ ID NO: 561952 - DNA, 19 bp, Homo sapiens
ggactctgccttccaggcg

SEQ ID NO: 561953 - DNA, 21 bp, Homo sapiens
ggactttcttttcgccgtggc

SEQ ID NO: 561954 - DNA, 23 bp, Homo sapiens
ggactttcttttcgccgtggctg

SEQ ID NO: 561955 - DNA, 12 bp, Homo sapiens
ggagaagaaaat

SEQ ID NO: 561956 - DNA, 13 bp, Homo sapiens
ggagaccaggact

SEQ ID NO: 561957 - DNA, 16 bp, Homo sapiens
ggagaccaggactctg

SEQ ID NO: 561958 - DNA, 17 bp, Homo sapiens
ggagaccaggactctgc

SEQ ID NO: 561959 - DNA, 19 bp, Homo sapiens
ggagaccctgggagagtga

SEQ ID NO: 561960 - DNA, 14 bp, Homo sapiens
ggagactcaggccc

SEQ ID NO: 561961 - DNA, 21 bp, Homo sapiens
ggagagtgaggtcatcccggg

SEQ ID NO: 561962 - DNA, 21 bp, Homo sapiens
ggagatccgccctgggctctg

SEQ ID NO: 561963 - DNA, 16 bp, Homo sapiens
ggagatgaggctggat

SEQ ID NO: 561964 - DNA, 16 bp, Homo sapiens
ggagatggggagaaac

SEQ ID NO: 561965 - DNA, 15 bp, Homo sapiens
ggagctcctggccag

SEQ ID NO: 561966 - DNA, 18 bp, Homo sapiens
ggagctcctggccaggat

SEQ ID NO: 561967 - DNA, 13 bp, Homo sapiens
ggagctgcttcca

SEQ ID NO: 561968 - DNA, 14 bp, Homo sapiens
ggagctggagggtc

SEQ ID NO: 561969 - DNA, 18 bp, Homo sapiens
ggagctggctccagcctg

SEQ ID NO: 561970 - DNA, 13 bp, Homo sapiens
ggctcccttcctc

SEQ ID NO: 561971 - DNA, 12 bp, Homo sapiens
ggctcctgcccc

SEQ ID NO: 561972 - DNA, 13 bp, Homo sapiens
ggctctaatttcc

SEQ ID NO: 561973 - DNA, 18 bp, Homo sapiens
ggctctggcaggtggcca

SEQ ID NO: 561974 - DNA, 19 bp, Homo sapiens
ggctctgtgtgttaaaatg

SEQ ID NO: 561975 - DNA, 14 bp, Homo sapiens
ggctgactgggcca

SEQ ID NO: 561976 - DNA, 16 bp, Homo sapiens
ggctgactgggccagg

SEQ ID NO: 561977 - DNA, 18 bp, Homo sapiens
ggctgaggcaggagaatc

SEQ ID NO: 561978 - DNA, 15 bp, Homo sapiens
ggctgcagagcctgc

SEQ ID NO: 561979 - DNA, 17 bp, Homo sapiens
ggctgcccacacacccc

SEQ ID NO: 561980 - DNA, 21 bp, Homo sapiens
ggctggcttctccctggactc

SEQ ID NO: 561981 - DNA, 17 bp, Homo sapiens
ggctgggacttcttacc

SEQ ID NO: 561982 - DNA, 11 bp, Homo sapiens
ggctgggctac

SEQ ID NO: 561983 - DNA, 12 bp, Homo sapiens
ggctggggcagc

SEQ ID NO: 561984 - DNA, 20 bp, Homo sapiens
ggctggggcagcctctgggc

SEQ ID NO: 561985 - DNA, 23 bp, Homo sapiens
ggctggggcagcctctgggccca

SEQ ID NO: 561986 - DNA, 22 bp, Homo sapiens
ggctggggcttttgtgccagga

SEQ ID NO: 561987 - DNA, 22 bp, Homo sapiens
ggctgtgggctcccttcctccc

SEQ ID NO: 561988 - DNA, 21 bp, Homo sapiens
ggcttcaatttattgcacaaa

SEQ ID NO: 561989 - DNA, 13 bp, Homo sapiens
ggcttgctgcaga

SEQ ID NO: 561990 - DNA, 16 bp, Homo sapiens
ggcttttctcccagct

SEQ ID NO: 561991 - DNA, 23 bp, Homo sapiens
gggaacagtaaagaaagcagaat

SEQ ID NO: 561992 - DNA, 18 bp, Homo sapiens
gggaaggagatggagtta

SEQ ID NO: 561993 - DNA, 12 bp, Homo sapiens
gggacacagaga

SEQ ID NO: 561994 - DNA, 16 bp, Homo sapiens
gggacacggcctctgg

SEQ ID NO: 561995 - DNA, 20 bp, Homo sapiens
gggacacggcctctggggag

SEQ ID NO: 561996 - DNA, 16 bp, Homo sapiens
gggactccagaagcag

SEQ ID NO: 561997 - DNA, 12 bp, Homo sapiens
gggactgtgaag

SEQ ID NO: 561998 - DNA, 12 bp, Homo sapiens
gggagaccctgg

SEQ ID NO: 561999 - DNA, 17 bp, Homo sapiens
gggagaccctgggagag

SEQ ID NO: 562000 - DNA, 13 bp, Homo sapiens
gggagagtgaggt

SEQ ID NO: 562001 - DNA, 24 bp, Homo sapiens
gggagcctgcgtggcctggggctg

SEQ ID NO: 562002 - DNA, 11 bp, Homo sapiens
gggagctggag

SEQ ID NO: 562003 - DNA, 15 bp, Homo sapiens
gggaggagactcagg

SEQ ID NO: 562004 - DNA, 15 bp, Homo sapiens
gggataggggcagag

SEQ ID NO: 562005 - DNA, 21 bp, Homo sapiens
gggatgctatctcgctagcca

SEQ ID NO: 562006 - DNA, 13 bp, Homo sapiens
gggatgggcacag

SEQ ID NO: 562007 - DNA, 16 bp, Homo sapiens
gggcaatattctctgt

SEQ ID NO: 562008 - DNA, 19 bp, Homo sapiens
gggcaatattctctgtaca

SEQ ID NO: 562009 - DNA, 13 bp, Homo sapiens
gggcacaggctgc

SEQ ID NO: 562010 - DNA, 13 bp, Homo sapiens
gggcacaggtcag

SEQ ID NO: 562011 - DNA, 15 bp, Homo sapiens
gggcacaggtcaggc

SEQ ID NO: 562012 - DNA, 14 bp, Homo sapiens
gggcagagcacagc

SEQ ID NO: 562013 - DNA, 14 bp, Homo sapiens
gggcagcctgcctt

SEQ ID NO: 562014 - DNA, 19 bp, Homo sapiens
gggcagcctgcgtggctga

SEQ ID NO: 562015 - DNA, 19 bp, Homo sapiens
gggcaggatgggggagagg

SEQ ID NO: 562016 - DNA, 18 bp, Homo sapiens
gggcatccttgaggacct

SEQ ID NO: 562017 - DNA, 13 bp, Homo sapiens
gggcattctctct

SEQ ID NO: 562018 - DNA, 20 bp, Homo sapiens
gggccaaaagcttccctccc

SEQ ID NO: 562019 - DNA, 15 bp, Homo sapiens
gggccacctccccag

SEQ ID NO: 562020 - DNA, 16 bp, Homo sapiens
gggccacctccccagg

SEQ ID NO: 562021 - DNA, 17 bp, Homo sapiens
gggccacctccccaggc

SEQ ID NO: 562022 - DNA, 22 bp, Homo sapiens
gggccccacctgcagctccctc

SEQ ID NO: 562023 - DNA, 22 bp, Homo sapiens
gggccctggttcccccaggacc

SEQ ID NO: 562024 - DNA, 20 bp, Homo sapiens
gggcccttcccaacctcccc

SEQ ID NO: 562025 - DNA, 17 bp, Homo sapiens
gggcctgaggctcctta

SEQ ID NO: 562026 - DNA, 20 bp, Homo sapiens
gggcctgtacaaaagggaca

SEQ ID NO: 562027 - DNA, 23 bp, Homo sapiens
gggcctgtacaaaagggacatga

SEQ ID NO: 562028 - DNA, 17 bp, Homo sapiens
gggccttaacatccctc

SEQ ID NO: 562029 - DNA, 13 bp, Homo sapiens
gggctcccttcct

SEQ ID NO: 562030 - DNA, 16 bp, Homo sapiens
gggctgactgggccag

SEQ ID NO: 562031 - DNA, 14 bp, Homo sapiens
gggcttcagccagt

SEQ ID NO: 562032 - DNA, 17 bp, Homo sapiens
gggcttgtcatagccag

SEQ ID NO: 562033 - DNA, 21 bp, Homo sapiens
gggctttcctgtgccaggtga

SEQ ID NO: 562034 - DNA, 18 bp, Homo sapiens
ggggacacggcctctggg

SEQ ID NO: 562035 - DNA, 19 bp, Homo sapiens
ggggacaggaacacccagc

SEQ ID NO: 562036 - DNA, 13 bp, Homo sapiens
ggggagaggggga

SEQ ID NO: 562037 - DNA, 14 bp, Homo sapiens
ggggatatttccta

SEQ ID NO: 562038 - DNA, 17 bp, Homo sapiens
ggggcacacttcccctt

SEQ ID NO: 562039 - DNA, 12 bp, Homo sapiens
ggggcaggaagt

SEQ ID NO: 562040 - DNA, 23 bp, Homo sapiens
ggggcaggaagtccctgagaagc

SEQ ID NO: 562041 - DNA, 20 bp, Homo sapiens
ggggccaggatggcgtgtcc

SEQ ID NO: 562042 - DNA, 18 bp, Homo sapiens
ggggccgggctggcttct

SEQ ID NO: 562043 - DNA, 23 bp, Homo sapiens
ggggccgggctggcttctccctg

SEQ ID NO: 562044 - DNA, 20 bp, Homo sapiens
ggggcctgaaagcaacagct

SEQ ID NO: 562045 - DNA, 12 bp, Homo sapiens
ggggctggggca

SEQ ID NO: 562046 - DNA, 17 bp, Homo sapiens
ggggctggggcaggagg

SEQ ID NO: 562047 - DNA, 14 bp, Homo sapiens
gggggaacaatgag

SEQ ID NO: 562048 - DNA, 13 bp, Homo sapiens
gggggacaggaac

SEQ ID NO: 562049 - DNA, 14 bp, Homo sapiens
gggggagaggggga

SEQ ID NO: 562050 - DNA, 22 bp, Homo sapiens
ggggtcaggccgggcagagcac

SEQ ID NO: 562051 - DNA, 20 bp, Homo sapiens
ggggtcaggggagacgaggc

SEQ ID NO: 562052 - DNA, 16 bp, Homo sapiens
ggggtcctgaggctgg

SEQ ID NO: 562053 - DNA, 23 bp, Homo sapiens
gggtaagggactccagaagcagc

SEQ ID NO: 562054 - DNA, 21 bp, Homo sapiens
gggtcaggccacggcagccta

SEQ ID NO: 562055 - DNA, 21 bp, Homo sapiens
gggtcaggggagacgaggcca

SEQ ID NO: 562056 - DNA, 23 bp, Homo sapiens
ggtccccagcccttcctctgctc

SEQ ID NO: 562057 - DNA, 16 bp, Homo sapiens
ggtcccctccaggagt

SEQ ID NO: 562058 - DNA, 20 bp, Homo sapiens
ggtcccgtctggctccagcc

SEQ ID NO: 562059 - DNA, 17 bp, Homo sapiens
ggtcctgaggctggggc

SEQ ID NO: 562060 - DNA, 13 bp, Homo sapiens
ggtcctgctcagc

SEQ ID NO: 562061 - DNA, 17 bp, Homo sapiens
ggtcctgggggctgctg

SEQ ID NO: 562062 - DNA, 23 bp, Homo sapiens
ggtctcagaggagggatagagac

SEQ ID NO: 562063 - DNA, 23 bp, Homo sapiens
ggtctctgccatgaactggaggc

SEQ ID NO: 562064 - DNA, 19 bp, Homo sapiens
ggtctgctgcctcaggaat

SEQ ID NO: 562065 - DNA, 16 bp, Homo sapiens
ggtcttactttgttaa

SEQ ID NO: 562066 - DNA, 21 bp, Homo sapiens
ggtcttactttgttaatttat

SEQ ID NO: 562067 - DNA, 20 bp, Homo sapiens
ggtcttaggatgtctgtaat

SEQ ID NO: 562068 - DNA, 17 bp, Homo sapiens
ggtcttcctactcttct

SEQ ID NO: 562069 - DNA, 20 bp, Homo sapiens
ggtgaactgaagcagagtca

SEQ ID NO: 562070 - DNA, 14 bp, Homo sapiens
ggtgaaggaggctc

SEQ ID NO: 562071 - DNA, 23 bp, Homo sapiens
ggtgaaggaggctccaggcagca

SEQ ID NO: 562072 - DNA, 18 bp, Homo sapiens
ggtgaatatggtggaaaa

SEQ ID NO: 562073 - DNA, 15 bp, Homo sapiens
ggtgagtcctccaga

SEQ ID NO: 562074 - DNA, 16 bp, Homo sapiens
ggtgattacctgaaag

SEQ ID NO: 562075 - DNA, 20 bp, Homo sapiens
ggtgcacagacgtccctcca

SEQ ID NO: 562076 - DNA, 23 bp, Homo sapiens
ggtgcacttggggcacagggaga

SEQ ID NO: 562077 - DNA, 13 bp, Homo sapiens
ggtggccagggct

SEQ ID NO: 562078 - DNA, 14 bp, Homo sapiens
ggtggccagggctc

SEQ ID NO: 562079 - DNA, 22 bp, Homo sapiens
ggtggcgctagaggccatggag

SEQ ID NO: 562080 - DNA, 14 bp, Homo sapiens
ggtgggacacagag

SEQ ID NO: 562081 - DNA, 21 bp, Homo sapiens
ggtgggagcacagctttcctg

SEQ ID NO: 562082 - DNA, 22 bp, Homo sapiens
ggtgggcttgtcatagccagtg

SEQ ID NO: 562083 - DNA, 19 bp, Homo sapiens
ggtgggggggcagagccct

SEQ ID NO: 562084 - DNA, 14 bp, Homo sapiens
ggtgtctttctctt

SEQ ID NO: 562085 - DNA, 21 bp, Homo sapiens
ggttaacaaataacaactttt

SEQ ID NO: 562086 - DNA, 22 bp, Homo sapiens
ggtttactctgtgctaagttgt

SEQ ID NO: 562087 - DNA, 23 bp, Homo sapiens
ggtttagcgttgttttgtggata

SEQ ID NO: 562088 - DNA, 16 bp, Homo sapiens
ggtttccacacaggcc

SEQ ID NO: 562089 - DNA, 13 bp, Homo sapiens
ggtttctcttctc

SEQ ID NO: 562090 - DNA, 21 bp, Homo sapiens
ggttttgcactcttgtttctc

SEQ ID NO: 562091 - DNA, 17 bp, Homo sapiens
ggttttgcatgtctgca

SEQ ID NO: 562092 - DNA, 15 bp, Homo sapiens
gtaaaaactgaagtt

SEQ ID NO: 562093 - DNA, 14 bp, Homo sapiens
gtaaacctgtctga

SEQ ID NO: 562094 - DNA, 23 bp, Homo sapiens
gtaaactaatgagtttcttttat

SEQ ID NO: 562095 - DNA, 16 bp, Homo sapiens
gtaaactttgaaatat

SEQ ID NO: 562096 - DNA, 15 bp, Homo sapiens
gtaaagatattgtat

SEQ ID NO: 562097 - DNA, 19 bp, Homo sapiens
gtaaatactttgtcctaag

SEQ ID NO: 562098 - DNA, 23 bp, Homo sapiens
gtaaatgaagtaacttgtcttaa

SEQ ID NO: 562099 - DNA, 15 bp, Homo sapiens
gtaaatgatatgtct

SEQ ID NO: 562100 - DNA, 15 bp, Homo sapiens
gtaaatgtagttcat

SEQ ID NO: 562101 - DNA, 18 bp, Homo sapiens
gtaaattccaaagatctg

SEQ ID NO: 562102 - DNA, 18 bp, Homo sapiens
gtaacgtgtgctgtgttt

SEQ ID NO: 562103 - DNA, 12 bp, Homo sapiens
gtaacttttgta

SEQ ID NO: 562104 - DNA, 21 bp, Homo sapiens
gtaagcggctcaagcccagga

SEQ ID NO: 562105 - DNA, 18 bp, Homo sapiens
gtaagctgtttggtttta

SEQ ID NO: 562106 - DNA, 21 bp, Homo sapiens
gtaagctgtttggttttaaaa

SEQ ID NO: 562107 - DNA, 22 bp, Homo sapiens
gtaagctgtttggttttaaaat

SEQ ID NO: 562108 - DNA, 22 bp, Homo sapiens
gtaatataatggaagagaaatc

SEQ ID NO: 562109 - DNA, 20 bp, Homo sapiens
gtaatatcagttacagtggc

SEQ ID NO: 562110 - DNA, 14 bp, Homo sapiens
gtaatcccagcact

SEQ ID NO: 562111 - DNA, 14 bp, Homo sapiens
gtaatgtaactgct

SEQ ID NO: 562112 - DNA, 12 bp, Homo sapiens
gtaattggtaat

SEQ ID NO: 562113 - DNA, 18 bp, Homo sapiens
gtaattggtaattacctg

SEQ ID NO: 562114 - DNA, 13 bp, Homo sapiens
gtaatttagtgta

SEQ ID NO: 562115 - DNA, 19 bp, Homo sapiens
gtaatttgggaacataaaa

SEQ ID NO: 562116 - DNA, 13 bp, Homo sapiens
gtaatttttctgt

SEQ ID NO: 562117 - DNA, 15 bp, Homo sapiens
gtaatttttctgtat

SEQ ID NO: 562118 - DNA, 13 bp, Homo sapiens
gtacaaaaacaca

SEQ ID NO: 562119 - DNA, 14 bp, Homo sapiens
gtacaaaaacacaa

SEQ ID NO: 562120 - DNA, 15 bp, Homo sapiens
gtacaaaaacacaaa

SEQ ID NO: 562121 - DNA, 14 bp, Homo sapiens
gtacaaacccagat

SEQ ID NO: 562122 - DNA, 12 bp, Homo sapiens
gtacaaatgtgt

SEQ ID NO: 562123 - DNA, 17 bp, Homo sapiens
gtacaataaataaaaga

SEQ ID NO: 562124 - DNA, 13 bp, Homo sapiens
gtacaatcatgaa

SEQ ID NO: 562125 - DNA, 22 bp, Homo sapiens
gtacaatcatgaacagctctga

SEQ ID NO: 562126 - DNA, 20 bp, Homo sapiens
gtacacacttgaccttctgt

SEQ ID NO: 562127 - DNA, 19 bp, Homo sapiens
gtacaccactttcccacac

SEQ ID NO: 562128 - DNA, 12 bp, Homo sapiens
gtacagatcaag

SEQ ID NO: 562129 - DNA, 22 bp, Homo sapiens
gtacagcactttcttcttccca

SEQ ID NO: 562130 - DNA, 18 bp, Homo sapiens
gtacaggtcatctgctgg

SEQ ID NO: 562131 - DNA, 20 bp, Homo sapiens
gtacagttgggaaaatatgt

SEQ ID NO: 562132 - DNA, 15 bp, Homo sapiens
gtacattctcagttt

SEQ ID NO: 562133 - DNA, 14 bp, Homo sapiens
gtacatttatgtgt

SEQ ID NO: 562134 - DNA, 21 bp, Homo sapiens
gtacatttttgatcaaatgta

SEQ ID NO: 562135 - DNA, 22 bp, Homo sapiens
gtacatttttgatcaaatgtac

SEQ ID NO: 562136 - DNA, 16 bp, Homo sapiens
gtaccacactgagttc

SEQ ID NO: 562137 - DNA, 17 bp, Homo sapiens
gtaccactgaatctgta

SEQ ID NO: 562138 - DNA, 16 bp, Homo sapiens
gtaccagccccaccct

SEQ ID NO: 562139 - DNA, 21 bp, Homo sapiens
gtaccagttctttaagaagat

SEQ ID NO: 562140 - DNA, 14 bp, Homo sapiens
gtaccattaaaata

SEQ ID NO: 562141 - DNA, 16 bp, Homo sapiens
gtacctgggtccccag

SEQ ID NO: 562142 - DNA, 16 bp, Homo sapiens
gtactatggaagccac

SEQ ID NO: 562143 - DNA, 15 bp, Homo sapiens
gtactctgagtcctc

SEQ ID NO: 562144 - DNA, 19 bp, Homo sapiens
gtactctgagtcctcattg

SEQ ID NO: 562145 - DNA, 21 bp, Homo sapiens
gtacttgctgctattttactg

SEQ ID NO: 562146 - DNA, 15 bp, Homo sapiens
gtacttggcaccaat

SEQ ID NO: 562147 - DNA, 22 bp, Homo sapiens
gtactttatagaagaatgcatg

SEQ ID NO: 562148 - DNA, 15 bp, Homo sapiens
gtactttgattcaca

SEQ ID NO: 562149 - DNA, 23 bp, Homo sapiens
gtactttgattcacatgttttca

SEQ ID NO: 562150 - DNA, 22 bp, Homo sapiens
gtagaaattttatctcttcttc

SEQ ID NO: 562151 - DNA, 16 bp, Homo sapiens
gtagaacgccagggac

SEQ ID NO: 562152 - DNA, 15 bp, Homo sapiens
gtagaatctcagcac

SEQ ID NO: 562153 - DNA, 15 bp, Homo sapiens
gtagactatatacat

SEQ ID NO: 562154 - DNA, 13 bp, Homo sapiens
gtagactgtgaca

SEQ ID NO: 562155 - DNA, 15 bp, Homo sapiens
gtagagtcaggagaa

SEQ ID NO: 562156 - DNA, 17 bp, Homo sapiens
gtagcaaggaaggacac

SEQ ID NO: 562157 - DNA, 15 bp, Homo sapiens
gtagccccctcttcc

SEQ ID NO: 562158 - DNA, 19 bp, Homo sapiens
gtagccccctcttccctgg

SEQ ID NO: 562159 - DNA, 16 bp, Homo sapiens
taactctgatgtaaat

SEQ ID NO: 562160 - DNA, 19 bp, Homo sapiens
taactctgatgtaaatgaa

SEQ ID NO: 562161 - DNA, 17 bp, Homo sapiens
taactgatggcaatatt

SEQ ID NO: 562162 - DNA, 18 bp, Homo sapiens
taactgccattttttgtc

SEQ ID NO: 562163 - DNA, 22 bp, Homo sapiens
taactgccattttttgtctgtg

SEQ ID NO: 562164 - DNA, 13 bp, Homo sapiens
taactgtggtgtt

SEQ ID NO: 562165 - DNA, 14 bp, Homo sapiens
taactgttaccatt

SEQ ID NO: 562166 - DNA, 15 bp, Homo sapiens
taactgttaccattg

SEQ ID NO: 562167 - DNA, 17 bp, Homo sapiens
taacttacaagactgta

SEQ ID NO: 562168 - DNA, 19 bp, Homo sapiens
taacttacaagactgtaaa

SEQ ID NO: 562169 - DNA, 16 bp, Homo sapiens
taacttactatttaga

SEQ ID NO: 562170 - DNA, 17 bp, Homo sapiens
taacttccactttgtat

SEQ ID NO: 562171 - DNA, 18 bp, Homo sapiens
taacttccactttgtata

SEQ ID NO: 562172 - DNA, 21 bp, Homo sapiens
taacttccactttgtataaat

SEQ ID NO: 562173 - DNA, 23 bp, Homo sapiens
taacttctaaaactgtactttga

SEQ ID NO: 562174 - DNA, 16 bp, Homo sapiens
taacttgctgtgaaat

SEQ ID NO: 562175 - DNA, 19 bp, Homo sapiens
taacttgctgtgaaatgac

SEQ ID NO: 562176 - DNA, 19 bp, Homo sapiens
taacttgcttaaatgtgaa

SEQ ID NO: 562177 - DNA, 20 bp, Homo sapiens
taacttgcttaaatgtgaat

SEQ ID NO: 562178 - DNA, 16 bp, Homo sapiens
taacttgttgcagact

SEQ ID NO: 562179 - DNA, 22 bp, Homo sapiens
taacttttgtagtcttatgaat

SEQ ID NO: 562180 - DNA, 21 bp, Homo sapiens
taagaaacattggaagcaggt

SEQ ID NO: 562181 - DNA, 15 bp, Homo sapiens
taagagatttatctt

SEQ ID NO: 562182 - DNA, 14 bp, Homo sapiens
taagagattttatg

SEQ ID NO: 562183 - DNA, 21 bp, Homo sapiens
taagatgttatatttttctta

SEQ ID NO: 562184 - DNA, 20 bp, Homo sapiens
taagcaaatttcaaaagaca

SEQ ID NO: 562185 - DNA, 18 bp, Homo sapiens
taagcaacaattttcaga

SEQ ID NO: 562186 - DNA, 20 bp, Homo sapiens
taagcacaaccatgttcttg

SEQ ID NO: 562187 - DNA, 21 bp, Homo sapiens
taagcacaaccatgttcttga

SEQ ID NO: 562188 - DNA, 15 bp, Homo sapiens
taagcctttgaagtg

SEQ ID NO: 562189 - DNA, 20 bp, Homo sapiens
taagcggctcaagcccagga

SEQ ID NO: 562190 - DNA, 20 bp, Homo sapiens
taagctaggaaaagaaatct

SEQ ID NO: 562191 - DNA, 21 bp, Homo sapiens
taatttagtgtatatgtgatt

SEQ ID NO: 562192 - DNA, 13 bp, Homo sapiens
taatttataaaat

SEQ ID NO: 562193 - DNA, 16 bp, Homo sapiens
taatttcttgcaattt

SEQ ID NO: 562194 - DNA, 21 bp, Homo sapiens
taatttgtataagatgctgct

SEQ ID NO: 562195 - DNA, 22 bp, Homo sapiens
taatttgtgcatcagaaaatgc

SEQ ID NO: 562196 - DNA, 13 bp, Homo sapiens
taattttgtttta

SEQ ID NO: 562197 - DNA, 19 bp, Homo sapiens
taattttgttttaaactgt

SEQ ID NO: 562198 - DNA, 21 bp, Homo sapiens
taattttgttttaaactgtga

SEQ ID NO: 562199 - DNA, 11 bp, Homo sapiens
taatttttcct

SEQ ID NO: 562200 - DNA, 14 bp, Homo sapiens
taatttttctgtat

SEQ ID NO: 562201 - DNA, 15 bp, Homo sapiens
taatttttctgtata

SEQ ID NO: 562202 - DNA, 16 bp, Homo sapiens
tacaaaaacacaaata

SEQ ID NO: 562203 - DNA, 18 bp, Homo sapiens
tacaaaatgtaactgtta

SEQ ID NO: 562204 - DNA, 17 bp, Homo sapiens
tacaaacaagcatataa

SEQ ID NO: 562205 - DNA, 18 bp, Homo sapiens
tacaaacaagcatataaa

SEQ ID NO: 562206 - DNA, 16 bp, Homo sapiens
tacaagactgtaaatt

SEQ ID NO: 562207 - DNA, 14 bp, Homo sapiens
tacaagtttgaaca

SEQ ID NO: 562208 - DNA, 13 bp, Homo sapiens
tacaatatataaa

SEQ ID NO: 562209 - DNA, 13 bp, Homo sapiens
tacacacacagac

SEQ ID NO: 562210 - DNA, 14 bp, Homo sapiens
tacacacacagaca

SEQ ID NO: 562211 - DNA, 16 bp, Homo sapiens
tacacacacagatgtg

SEQ ID NO: 562212 - DNA, 15 bp, Homo sapiens
tacacatacatatat

SEQ ID NO: 562213 - DNA, 20 bp, Homo sapiens
tacacatacatatatacatt

SEQ ID NO: 562214 - DNA, 14 bp, Homo sapiens
tacacatataccta

SEQ ID NO: 562215 - DNA, 18 bp, Homo sapiens
tacaccactttcccacac

SEQ ID NO: 562216 - DNA, 15 bp, Homo sapiens
tacacgtgtatatga

SEQ ID NO: 562217 - DNA, 19 bp, Homo sapiens
tacacttgctttatttttc

SEQ ID NO: 562218 - DNA, 17 bp, Homo sapiens
tacacttgtataaatgt

SEQ ID NO: 562219 - DNA, 18 bp, Homo sapiens
tacacttgtataaatgta

SEQ ID NO: 562220 - DNA, 19 bp, Homo sapiens
tacacttgtataaatgtat

SEQ ID NO: 562221 - DNA, 22 bp, Homo sapiens
tacagagatgtctcttatatct

SEQ ID NO: 562222 - DNA, 22 bp, Homo sapiens
tacagagccgtaaaaactgaag

SEQ ID NO: 562223 - DNA, 21 bp, Homo sapiens
tacagagggtaggaatgggta

SEQ ID NO: 562224 - DNA, 22 bp, Homo sapiens
tacagcagatccacctgcacaa

SEQ ID NO: 562225 - DNA, 14 bp, Homo sapiens
tacagctcccccag

SEQ ID NO: 562226 - DNA, 17 bp, Homo sapiens
tacagctcccccagctc

SEQ ID NO: 562227 - DNA, 20 bp, Homo sapiens
tacagctcccccagctcccc

SEQ ID NO: 562228 - DNA, 22 bp, Homo sapiens
tacagctctcccctcccttgtc

SEQ ID NO: 562229 - DNA, 20 bp, Homo sapiens
tacagctttacacacacaga

SEQ ID NO: 562230 - DNA, 14 bp, Homo sapiens
tacaggcaattccg

SEQ ID NO: 562231 - DNA, 16 bp, Homo sapiens
tacaggtaccagttct

SEQ ID NO: 562232 - DNA, 20 bp, Homo sapiens
tacagtctctttcttccttt

SEQ ID NO: 562233 - DNA, 17 bp, Homo sapiens
tacagtggcagtattga

SEQ ID NO: 562234 - DNA, 15 bp, Homo sapiens
tacagttacttttcc

SEQ ID NO: 562235 - DNA, 13 bp, Homo sapiens
tacataacaagaa

SEQ ID NO: 562236 - DNA, 18 bp, Homo sapiens
tacataacaagaaaatca

SEQ ID NO: 562237 - DNA, 18 bp, Homo sapiens
tacatacgcaattgtata

SEQ ID NO: 562238 - DNA, 17 bp, Homo sapiens
tacatatgtagactata

SEQ ID NO: 562239 - DNA, 19 bp, Homo sapiens
tacatatgtagactatata

SEQ ID NO: 562240 - DNA, 22 bp, Homo sapiens
tacatatgtagactatatacat

SEQ ID NO: 562241 - DNA, 23 bp, Homo sapiens
tacatatgtagactatatacatg

SEQ ID NO: 562242 - DNA, 21 bp, Homo sapiens
tacatattagcgacaacagat

SEQ ID NO: 562243 - DNA, 20 bp, Homo sapiens
tacatctgatatcaggaaat

SEQ ID NO: 562244 - DNA, 22 bp, Homo sapiens
tacatgcctttccagtgctgct

SEQ ID NO: 562245 - DNA, 19 bp, Homo sapiens
tacatgtgtgtatatatgt

SEQ ID NO: 562246 - DNA, 16 bp, Homo sapiens
tacatgttgtaaatgg

SEQ ID NO: 562247 - DNA, 15 bp, Homo sapiens
tacattctcagtttt

SEQ ID NO: 562248 - DNA, 17 bp, Homo sapiens
tacattctcagtttttc

SEQ ID NO: 562249 - DNA, 14 bp, Homo sapiens
tacatttcgatgtt

SEQ ID NO: 562250 - DNA, 14 bp, Homo sapiens
tacattttctggtg

SEQ ID NO: 562251 - DNA, 21 bp, Homo sapiens
tacattttgcagctatggaca

SEQ ID NO: 562252 - DNA, 18 bp, Homo sapiens
tacatttttgatcaaatg

SEQ ID NO: 562253 - DNA, 13 bp, Homo sapiens
taccaactttcaa

SEQ ID NO: 562254 - DNA, 17 bp, Homo sapiens
taccacaggatgcatat

SEQ ID NO: 562255 - DNA, 18 bp, Homo sapiens
taccacaggatgcatatt

SEQ ID NO: 562256 - DNA, 20 bp, Homo sapiens
taccagattcacttctgaat

SEQ ID NO: 562257 - DNA, 17 bp, Homo sapiens
taccatcggtcagcagg

SEQ ID NO: 562258 - DNA, 21 bp, Homo sapiens
taccattaaaatatgcactaa

SEQ ID NO: 562259 - DNA, 19 bp, Homo sapiens
taccattggaaatttcacg

SEQ ID NO: 562260 - DNA, 15 bp, Homo sapiens
tacccaaaagagaaa

SEQ ID NO: 562261 - DNA, 23 bp, Homo sapiens
tacccaaagcacatgcttagctt

SEQ ID NO: 562262 - DNA, 22 bp, Homo sapiens
tacccctcccggccctgcctgc

SEQ ID NO: 562263 - DNA, 13 bp, Homo sapiens
tagtactttatag

SEQ ID NO: 562264 - DNA, 15 bp, Homo sapiens
tagtactttatagaa

SEQ ID NO: 562265 - DNA, 21 bp, Homo sapiens
tagtactttatagaagaatgc

SEQ ID NO: 562266 - DNA, 17 bp, Homo sapiens
tagtagaatctcagcac

SEQ ID NO: 562267 - DNA, 22 bp, Homo sapiens
tagtagaatctcagcactttgt

SEQ ID NO: 562268 - DNA, 21 bp, Homo sapiens
tagtaggatatgcctgctctt

SEQ ID NO: 562269 - DNA, 17 bp, Homo sapiens
tagtatttgaaaacaga

SEQ ID NO: 562270 - DNA, 13 bp, Homo sapiens
tagtcatttattt

SEQ ID NO: 562271 - DNA, 13 bp, Homo sapiens
tagtcttatgaat

SEQ ID NO: 562272 - DNA, 15 bp, Homo sapiens
tagtcttatgaatag

SEQ ID NO: 562273 - DNA, 20 bp, Homo sapiens
tagtcttatgaatagacata

SEQ ID NO: 562274 - DNA, 23 bp, Homo sapiens
tagtcttatgaatagacataaat

SEQ ID NO: 562275 - DNA, 18 bp, Homo sapiens
tagtgaaaattttattga

SEQ ID NO: 562276 - DNA, 16 bp, Homo sapiens
tagtgcaatatatttt

SEQ ID NO: 562277 - DNA, 14 bp, Homo sapiens
tagtgctatatata

SEQ ID NO: 562278 - DNA, 21 bp, Homo sapiens
tagtgctatatatataaatat

SEQ ID NO: 562279 - DNA, 17 bp, Homo sapiens
tagtggaccctgaaatg

SEQ ID NO: 562280 - DNA, 17 bp, Homo sapiens
tagtggcttcagcccct

SEQ ID NO: 562281 - DNA, 15 bp, Homo sapiens
tagtgtatatgtgat

SEQ ID NO: 562282 - DNA, 15 bp, Homo sapiens
tagtgtcccttacct

SEQ ID NO: 562283 - DNA, 20 bp, Homo sapiens
tagtgtcccttacctggctt

SEQ ID NO: 562284 - DNA, 16 bp, Homo sapiens
tagtgttcagaaaaaa

SEQ ID NO: 562285 - DNA, 15 bp, Homo sapiens
tagttccctttgcca

SEQ ID NO: 562286 - DNA, 18 bp, Homo sapiens
tagttgaggaaagcacag

SEQ ID NO: 562287 - DNA, 13 bp, Homo sapiens
tagttgtaaagat

SEQ ID NO: 562288 - DNA, 11 bp, Homo sapiens
tataaaaataa

SEQ ID NO: 562289 - DNA, 13 bp, Homo sapiens
tataaaaatatat

SEQ ID NO: 562290 - DNA, 21 bp, Homo sapiens
tataaaatacacgtgtatatg

SEQ ID NO: 562291 - DNA, 14 bp, Homo sapiens
tataaaatctgtat

SEQ ID NO: 562292 - DNA, 22 bp, Homo sapiens
tataaaatggcaacaaactgca

SEQ ID NO: 562293 - DNA, 19 bp, Homo sapiens
tataaacagaactcccttc

SEQ ID NO: 562294 - DNA, 16 bp, Homo sapiens
tataaagcatctaaac

SEQ ID NO: 562295 - DNA, 18 bp, Homo sapiens
tataaatgtatatacaca

SEQ ID NO: 562296 - DNA, 13 bp, Homo sapiens
tataaattttgta

SEQ ID NO: 562297 - DNA, 19 bp, Homo sapiens
tataaattttgtacatttt

SEQ ID NO: 562298 - DNA, 16 bp, Homo sapiens
tataaatttttaagtg

SEQ ID NO: 562299 - DNA, 19 bp, Homo sapiens
tataacattgtaaatgata

SEQ ID NO: 562300 - DNA, 13 bp, Homo sapiens
tataacattgtat

SEQ ID NO: 562301 - DNA, 22 bp, Homo sapiens
tataagcaaatttcaaaagaca

SEQ ID NO: 562302 - DNA, 16 bp, Homo sapiens
tataaggacttcctga

SEQ ID NO: 562303 - DNA, 18 bp, Homo sapiens
tataatggcctcttaaaa

SEQ ID NO: 562304 - DNA, 23 bp, Homo sapiens
tataatgtattttcagctcaatt

SEQ ID NO: 562305 - DNA, 13 bp, Homo sapiens
tataatgtgtgta

SEQ ID NO: 562306 - DNA, 19 bp, Homo sapiens
tataatgtgtgtatgtgta

SEQ ID NO: 562307 - DNA, 19 bp, Homo sapiens
tataattttattgctggaa

SEQ ID NO: 562308 - DNA, 13 bp, Homo sapiens
tatacaatatata

SEQ ID NO: 562309 - DNA, 12 bp, Homo sapiens
tatacagatttt

SEQ ID NO: 562310 - DNA, 15 bp, Homo sapiens
tatacatacacttgt

SEQ ID NO: 562311 - DNA, 19 bp, Homo sapiens
tatacatacacttgtataa

SEQ ID NO: 562312 - DNA, 20 bp, Homo sapiens
tatacatacacttgtataaa

SEQ ID NO: 562313 - DNA, 13 bp, Homo sapiens
tatacatacgcaa

SEQ ID NO: 562314 - DNA, 20 bp, Homo sapiens
tatacatacgcaattgtata

SEQ ID NO: 562315 - DNA, 23 bp, Homo sapiens
tatacatacgcaattgtatatat

SEQ ID NO: 562316 - DNA, 13 bp, Homo sapiens
tatacatatgtag

SEQ ID NO: 562317 - DNA, 23 bp, Homo sapiens
tatacatatgtagactatataca

SEQ ID NO: 562318 - DNA, 14 bp, Homo sapiens
tatacatgtgtgta

SEQ ID NO: 562319 - DNA, 15 bp, Homo sapiens
tatacatgtgtgtat

SEQ ID NO: 562320 - DNA, 18 bp, Homo sapiens
tatacatgtgtgtatata

SEQ ID NO: 562321 - DNA, 17 bp, Homo sapiens
tataccatttccgtaat

SEQ ID NO: 562322 - DNA, 15 bp, Homo sapiens
tatacctataatgtg

SEQ ID NO: 562323 - DNA, 18 bp, Homo sapiens
tatacctataatgtgtgt

SEQ ID NO: 562324 - DNA, 19 bp, Homo sapiens
tatacctataatgtgtgta

SEQ ID NO: 562325 - DNA, 21 bp, Homo sapiens
tatacctataatgtgtgtatg

SEQ ID NO: 562326 - DNA, 18 bp, Homo sapiens
tatacctctaactgtgca

SEQ ID NO: 562327 - DNA, 15 bp, Homo sapiens
tatactcaagtttca

SEQ ID NO: 562328 - DNA, 19 bp, Homo sapiens
tatactccttaaaaatgta

SEQ ID NO: 562329 - DNA, 12 bp, Homo sapiens
tatagaaagtgt

SEQ ID NO: 562330 - DNA, 21 bp, Homo sapiens
tatagaaagtgttctgttaca

SEQ ID NO: 562331 - DNA, 13 bp, Homo sapiens
tatagaagaatgc

SEQ ID NO: 562332 - DNA, 21 bp, Homo sapiens
tatagaagtcttcatgaaatg

SEQ ID NO: 562333 - DNA, 21 bp, Homo sapiens
tatagacaggagaagaaagaa

SEQ ID NO: 562334 - DNA, 16 bp, Homo sapiens
tatagagttcatccca

SEQ ID NO: 562335 - DNA, 14 bp, Homo sapiens
tatagattgattta

SEQ ID NO: 562336 - DNA, 23 bp, Homo sapiens
tatagattgatttacctttggaa

SEQ ID NO: 562337 - DNA, 20 bp, Homo sapiens
tatagcagcaaaaatataaa

SEQ ID NO: 562338 - DNA, 21 bp, Homo sapiens
tatagcagcaaaaatataaaa

SEQ ID NO: 562339 - DNA, 11 bp, Homo sapiens
tatagtatttg

SEQ ID NO: 562340 - DNA, 14 bp, Homo sapiens
tatagtatttgaaa

SEQ ID NO: 562341 - DNA, 22 bp, Homo sapiens
tatagtatttgaaaacagaaat

SEQ ID NO: 562342 - DNA, 22 bp, Homo sapiens
tatagtcatttattttaaaaaa

SEQ ID NO: 562343 - DNA, 16 bp, Homo sapiens
tatagtgcaatatatt

SEQ ID NO: 562344 - DNA, 20 bp, Homo sapiens
tatagtgctatatatataaa

SEQ ID NO: 562345 - DNA, 18 bp, Homo sapiens
tatataaaaatatatata

SEQ ID NO: 562346 - DNA, 22 bp, Homo sapiens
tatataaaagtttaaagaagag

SEQ ID NO: 562347 - DNA, 20 bp, Homo sapiens
tatataaaatacacgtgtat

SEQ ID NO: 562348 - DNA, 23 bp, Homo sapiens
tatatacatacacttgtataaat

SEQ ID NO: 562349 - DNA, 12 bp, Homo sapiens
tatatacatacg

SEQ ID NO: 562350 - DNA, 14 bp, Homo sapiens
tatatacatatgta

SEQ ID NO: 562351 - DNA, 16 bp, Homo sapiens
tatatacatatgtaga

SEQ ID NO: 562352 - DNA, 18 bp, Homo sapiens
tatatagcagcaaaaata

SEQ ID NO: 562353 - DNA, 20 bp, Homo sapiens
tatatataaaatacacgtgt

SEQ ID NO: 562354 - DNA, 22 bp, Homo sapiens
tatatataaaatacacgtgtat

SEQ ID NO: 562355 - DNA, 13 bp, Homo sapiens
tatatataaacag

SEQ ID NO: 562356 - DNA, 13 bp, Homo sapiens
tatatatacatat

SEQ ID NO: 562357 - DNA, 14 bp, Homo sapiens
tatatatataaata

SEQ ID NO: 562358 - DNA, 13 bp, Homo sapiens
tatatatatgtga

SEQ ID NO: 562359 - DNA, 14 bp, Homo sapiens
tatatatatgtgaa

SEQ ID NO: 562360 - DNA, 13 bp, Homo sapiens
tatatatgtgaac

SEQ ID NO: 562361 - DNA, 12 bp, Homo sapiens
tatatatgtgta

SEQ ID NO: 562362 - DNA, 17 bp, Homo sapiens
tatatattttgaaagga

SEQ ID NO: 562363 - DNA, 15 bp, Homo sapiens
tatatcagactgctt

SEQ ID NO: 562364 - DNA, 21 bp, Homo sapiens
tatatcagactgctttgagaa

SEQ ID NO: 562365 - DNA, 19 bp, Homo sapiens
tatatctaaatctgtccaa

SEQ ID NO: 562366 - DNA, 18 bp, Homo sapiens
tatatctgaaaactggaa

SEQ ID NO: 562367 - DNA, 15 bp, Homo sapiens
tatatgaggatgtat

SEQ ID NO: 562368 - DNA, 15 bp, Homo sapiens
tatatggtctaatgt

SEQ ID NO: 562369 - DNA, 17 bp, Homo sapiens
tatatggtctaatgttt

SEQ ID NO: 562370 - DNA, 15 bp, Homo sapiens
tatatgtaacagttt

SEQ ID NO: 562371 - DNA, 19 bp, Homo sapiens
tatatgtaacagtttaaaa

SEQ ID NO: 562372 - DNA, 12 bp, Homo sapiens
tatatgtatatt

SEQ ID NO: 562373 - DNA, 16 bp, Homo sapiens
tatatgtgaactttct

SEQ ID NO: 562374 - DNA, 14 bp, Homo sapiens
tatatgtgtatata

SEQ ID NO: 562375 - DNA, 19 bp, Homo sapiens
tatatgtgtatatatacat

SEQ ID NO: 562376 - DNA, 16 bp, Homo sapiens
tatatgtttatacaca

SEQ ID NO: 562377 - DNA, 17 bp, Homo sapiens
tatatgtttatacacac

SEQ ID NO: 562378 - DNA, 23 bp, Homo sapiens
tatattgaaaagaaaaagaagag

SEQ ID NO: 562379 - DNA, 18 bp, Homo sapiens
tatatttcctataccatt

SEQ ID NO: 562380 - DNA, 21 bp, Homo sapiens
tatatttcctataccatttcc

SEQ ID NO: 562381 - DNA, 22 bp, Homo sapiens
tatatttcctataccatttccg

SEQ ID NO: 562382 - DNA, 15 bp, Homo sapiens
tatattttgaaagga

SEQ ID NO: 562383 - DNA, 15 bp, Homo sapiens
tatattttgtatgca

SEQ ID NO: 562384 - DNA, 21 bp, Homo sapiens
tatattttgtgttattcgtga

SEQ ID NO: 562385 - DNA, 20 bp, Homo sapiens
tatatttttcttaaaaagta

SEQ ID NO: 562386 - DNA, 18 bp, Homo sapiens
tatcagaagtatatctgt

SEQ ID NO: 562387 - DNA, 18 bp, Homo sapiens
tatcagctacttaagaga

SEQ ID NO: 562388 - DNA, 17 bp, Homo sapiens
tatcagttacagtggca

SEQ ID NO: 562389 - DNA, 12 bp, Homo sapiens
tatcatctaaat

SEQ ID NO: 562390 - DNA, 19 bp, Homo sapiens
tatcatgcttctactccat

SEQ ID NO: 562391 - DNA, 23 bp, Homo sapiens
tatcatgctttaaagtgtaataa

SEQ ID NO: 562392 - DNA, 16 bp, Homo sapiens
tatcattcttataaca

SEQ ID NO: 562393 - DNA, 22 bp, Homo sapiens
tatcattcttataacattgtat

SEQ ID NO: 562394 - DNA, 16 bp, Homo sapiens
tatcctgtgtgtgtct

SEQ ID NO: 562395 - DNA, 17 bp, Homo sapiens
tatcctgtgtgtgtcta

SEQ ID NO: 562396 - DNA, 19 bp, Homo sapiens
tatcgccctggcaggcagg

SEQ ID NO: 562397 - DNA, 15 bp, Homo sapiens
tatctaaccagtgat

SEQ ID NO: 562398 - DNA, 19 bp, Homo sapiens
tatctaaccagtgattcga

SEQ ID NO: 562399 - DNA, 16 bp, Homo sapiens
tatctaatcagatctt

SEQ ID NO: 562400 - DNA, 16 bp, Homo sapiens
tatctaccaactttca

SEQ ID NO: 562401 - DNA, 12 bp, Homo sapiens
tatctcccacaa

SEQ ID NO: 562402 - DNA, 17 bp, Homo sapiens
tatctcgctagccatat

SEQ ID NO: 562403 - DNA, 12 bp, Homo sapiens
tatctgaaaact

SEQ ID NO: 562404 - DNA, 16 bp, Homo sapiens
tatctgtgaaggactt

SEQ ID NO: 562405 - DNA, 14 bp, Homo sapiens
tatcttcacatagt

SEQ ID NO: 562406 - DNA, 10 bp, Homo sapiens
tatcttcatc

SEQ ID NO: 562407 - DNA, 14 bp, Homo sapiens
tatctttctttcca

SEQ ID NO: 562408 - DNA, 15 bp, Homo sapiens
tatctttctttccat

SEQ ID NO: 562409 - DNA, 17 bp, Homo sapiens
tatctttctttccattt

SEQ ID NO: 562410 - DNA, 22 bp, Homo sapiens
tatgaaaaccctcgatgttcat

SEQ ID NO: 562411 - DNA, 23 bp, Homo sapiens
tatgaagccctaagtaaatctaa

SEQ ID NO: 562412 - DNA, 22 bp, Homo sapiens
tatgaagttggcacatttcatg

SEQ ID NO: 562413 - DNA, 19 bp, Homo sapiens
tatgaatagacataaattg

SEQ ID NO: 562414 - DNA, 23 bp, Homo sapiens
tatgaatagacataaattgtaat

SEQ ID NO: 562415 - DNA, 12 bp, Homo sapiens
tatgaatatttc

SEQ ID NO: 562416 - DNA, 19 bp, Homo sapiens
tatgaatatttcattttga

SEQ ID NO: 562417 - DNA, 20 bp, Homo sapiens
tatgaatatttcattttgag

SEQ ID NO: 562418 - DNA, 20 bp, Homo sapiens
tatgagaaatataaaaataa

SEQ ID NO: 562419 - DNA, 20 bp, Homo sapiens
tatgagattggaaaaaatta

SEQ ID NO: 562420 - DNA, 22 bp, Homo sapiens
tatgagattggaaaaaattaga

SEQ ID NO: 562421 - DNA, 23 bp, Homo sapiens
tatgagattggaaaaaattagac

SEQ ID NO: 562422 - DNA, 16 bp, Homo sapiens
tatgagcatgctccct

SEQ ID NO: 562423 - DNA, 19 bp, Homo sapiens
tatgaggatgtatgtgtat

SEQ ID NO: 562424 - DNA, 22 bp, Homo sapiens
tatgatattccccatttcctgt

SEQ ID NO: 562425 - DNA, 18 bp, Homo sapiens
tatgatccagagcagagt

SEQ ID NO: 562426 - DNA, 20 bp, Homo sapiens
tatgatccagagcagagttt

SEQ ID NO: 562427 - DNA, 22 bp, Homo sapiens
tatgattaaattatcattgttt

SEQ ID NO: 562428 - DNA, 20 bp, Homo sapiens
tatgattttttaaaagaaat

SEQ ID NO: 562429 - DNA, 16 bp, Homo sapiens
tatgcaagcagtttca

SEQ ID NO: 562430 - DNA, 16 bp, Homo sapiens
tatgcactaagtctct

SEQ ID NO: 562431 - DNA, 15 bp, Homo sapiens
tatgcatatatatgt

SEQ ID NO: 562432 - DNA, 16 bp, Homo sapiens
tatgcatatatatgta

SEQ ID NO: 562433 - DNA, 18 bp, Homo sapiens
tatgcatcccacagccag

SEQ ID NO: 562434 - DNA, 21 bp, Homo sapiens
tatgccttttgtagctgtcat

SEQ ID NO: 562435 - DNA, 19 bp, Homo sapiens
tatgcgcaaatacaaaatg

SEQ ID NO: 562436 - DNA, 21 bp, Homo sapiens
tatgcgcaaatacaaaatgat

SEQ ID NO: 562437 - DNA, 23 bp, Homo sapiens
tatgcttccagaaacacccacag

SEQ ID NO: 562438 - DNA, 15 bp, Homo sapiens
tatggaagacaaata

SEQ ID NO: 562439 - DNA, 21 bp, Homo sapiens
tatggaagacaaatacacata

SEQ ID NO: 562440 - DNA, 19 bp, Homo sapiens
tatggacaatttaccacag

SEQ ID NO: 562441 - DNA, 15 bp, Homo sapiens
tatggctttgtgctt

SEQ ID NO: 562442 - DNA, 17 bp, Homo sapiens
tatggtctaatgtttaa

SEQ ID NO: 562443 - DNA, 16 bp, Homo sapiens
tatgtaacagtttaaa

SEQ ID NO: 562444 - DNA, 15 bp, Homo sapiens
tatgtcatttcatgt

SEQ ID NO: 562445 - DNA, 16 bp, Homo sapiens
tatgtcatttcatgtc

SEQ ID NO: 562446 - DNA, 15 bp, Homo sapiens
tatgtctcatgtttt

SEQ ID NO: 562447 - DNA, 19 bp, Homo sapiens
tatgtctcgctagtgatgt

SEQ ID NO: 562448 - DNA, 22 bp, Homo sapiens
tatgtgaactttctcagcatat

SEQ ID NO: 562449 - DNA, 22 bp, Homo sapiens
tatgtgattttcaaatatgtaa

SEQ ID NO: 562450 - DNA, 19 bp, Homo sapiens
tatgtgccccttccccatg

SEQ ID NO: 562451 - DNA, 22 bp, Homo sapiens
tatgtgtatatatacatacact

SEQ ID NO: 562452 - DNA, 12 bp, Homo sapiens
tatgtgtatatg

SEQ ID NO: 562453 - DNA, 13 bp, Homo sapiens
tatgtgtatatgt

SEQ ID NO: 562454 - DNA, 16 bp, Homo sapiens
tatgtgtccatttcct

SEQ ID NO: 562455 - DNA, 13 bp, Homo sapiens
tatgtgtgcatgt

SEQ ID NO: 562456 - DNA, 21 bp, Homo sapiens
tatgtgtgcatgtgtgtataa

SEQ ID NO: 562457 - DNA, 13 bp, Homo sapiens
tatgttgacattt

SEQ ID NO: 562458 - DNA, 16 bp, Homo sapiens
tatgtttacactgtca

SEQ ID NO: 562459 - DNA, 15 bp, Homo sapiens
tatgtttatacacac

SEQ ID NO: 562460 - DNA, 16 bp, Homo sapiens
tatgtttatacacaca

SEQ ID NO: 562461 - DNA, 12 bp, Homo sapiens
tatgttttggtc

SEQ ID NO: 562462 - DNA, 15 bp, Homo sapiens
tatgtttttcagttc

SEQ ID NO: 562463 - DNA, 18 bp, Homo sapiens
tatgtttttcagttcaaa

SEQ ID NO: 562464 - DNA, 19 bp, Homo sapiens
tatgtttttcagttcaaag

SEQ ID NO: 562465 - DNA, 15 bp, Homo sapiens
tattaaaaagtcttt

SEQ ID NO: 562466 - DNA, 13 bp, Homo sapiens
tattaaagtttca

SEQ ID NO: 562467 - DNA, 15 bp, Homo sapiens
tattaaagtttcaaa

SEQ ID NO: 562468 - DNA, 16 bp, Homo sapiens
tattaaagtttcaaaa

SEQ ID NO: 562469 - DNA, 19 bp, Homo sapiens
tattaatataaccataaat

SEQ ID NO: 562470 - DNA, 12 bp, Homo sapiens
tattacaatatt

SEQ ID NO: 562471 - DNA, 14 bp, Homo sapiens
tattacaatatttg

SEQ ID NO: 562472 - DNA, 17 bp, Homo sapiens
tattagaaaactttgtt

SEQ ID NO: 562473 - DNA, 20 bp, Homo sapiens
tattagacttctgttttcaa

SEQ ID NO: 562474 - DNA, 15 bp, Homo sapiens
tattataatcaaagc

SEQ ID NO: 562475 - DNA, 13 bp, Homo sapiens
tattatatttgga

SEQ ID NO: 562476 - DNA, 16 bp, Homo sapiens
tattatgccttgagaa

SEQ ID NO: 562477 - DNA, 23 bp, Homo sapiens
tattcaaaccaatttcttccttc

SEQ ID NO: 562478 - DNA, 13 bp, Homo sapiens
tattcaggacccc

SEQ ID NO: 562479 - DNA, 24 bp, Homo sapiens
tattcaggaccccatctgctgagc

SEQ ID NO: 562480 - DNA, 17 bp, Homo sapiens
tattccagagctgccag

SEQ ID NO: 562481 - DNA, 14 bp, Homo sapiens
tattccatattaga

SEQ ID NO: 562482 - DNA, 23 bp, Homo sapiens
tattcccatggtagactgtgaca

SEQ ID NO: 562483 - DNA, 13 bp, Homo sapiens
tattctctgtaca

SEQ ID NO: 562484 - DNA, 14 bp, Homo sapiens
tattctctgtacat

SEQ ID NO: 562485 - DNA, 12 bp, Homo sapiens
tattctttgtta

SEQ ID NO: 562486 - DNA, 15 bp, Homo sapiens
tattctttgttaatt

SEQ ID NO: 562487 - DNA, 14 bp, Homo sapiens
tattgaaaagaaaa

SEQ ID NO: 562488 - DNA, 20 bp, Homo sapiens
tattgaaaagaaaaagaaga

SEQ ID NO: 562489 - DNA, 14 bp, Homo sapiens
tattgaaaatgtca

SEQ ID NO: 562490 - DNA, 22 bp, Homo sapiens
tattgaagaaacagataccata

SEQ ID NO: 562491 - DNA, 17 bp, Homo sapiens
tattgacaataagaaac

SEQ ID NO: 562492 - DNA, 19 bp, Homo sapiens
tattgagagagatgtgtaa

SEQ ID NO: 562493 - DNA, 17 bp, Homo sapiens
tattgaggaaaaatatg

SEQ ID NO: 562494 - DNA, 21 bp, Homo sapiens
tattgaggaaaaatatgtgaa

SEQ ID NO: 562495 - DNA, 22 bp, Homo sapiens
tattgaggaaaaatatgtgaag

SEQ ID NO: 562496 - DNA, 14 bp, Homo sapiens
tattgagtgtacat

SEQ ID NO: 562497 - DNA, 19 bp, Homo sapiens
tattgccaaacattaatgt

SEQ ID NO: 562498 - DNA, 19 bp, Homo sapiens
tattgctgtaaataaaaat

SEQ ID NO: 562499 - DNA, 22 bp, Homo sapiens
tattgctgtaaataaaaatagc

SEQ ID NO: 562500 - DNA, 14 bp, Homo sapiens
tattggtatatcct

SEQ ID NO: 562501 - DNA, 17 bp, Homo sapiens
tattggtatatcctttt

SEQ ID NO: 562502 - DNA, 20 bp, Homo sapiens
tattgtccctggcttcctta

SEQ ID NO: 562503 - DNA, 22 bp, Homo sapiens
tattgtccctggcttccttact

SEQ ID NO: 562504 - DNA, 17 bp, Homo sapiens
tatttaaaacatttcat

SEQ ID NO: 562505 - DNA, 22 bp, Homo sapiens
tatttaaaacatttcatgtatt

SEQ ID NO: 562506 - DNA, 15 bp, Homo sapiens
tatttaacattcttg

SEQ ID NO: 562507 - DNA, 14 bp, Homo sapiens
tatttaccaagatt

SEQ ID NO: 562508 - DNA, 12 bp, Homo sapiens
tatttacttgtt

SEQ ID NO: 562509 - DNA, 16 bp, Homo sapiens
tatttatagtcattta

SEQ ID NO: 562510 - DNA, 22 bp, Homo sapiens
tatttatgagatcactgaactt

SEQ ID NO: 562511 - DNA, 22 bp, Homo sapiens
tatttcattcgggccccacctg

SEQ ID NO: 562512 - DNA, 18 bp, Homo sapiens
tatttcattttttgcatc

SEQ ID NO: 562513 - DNA, 15 bp, Homo sapiens
tatttccccctttct

SEQ ID NO: 562514 - DNA, 20 bp, Homo sapiens
tatttccccctttcttcctc

SEQ ID NO: 562515 - DNA, 17 bp, Homo sapiens
tatttcctataccattt

SEQ ID NO: 562516 - DNA, 19 bp, Homo sapiens
tatttcctataccatttcc

SEQ ID NO: 562517 - DNA, 14 bp, Homo sapiens
tatttctaaatgtt

SEQ ID NO: 562518 - DNA, 12 bp, Homo sapiens
tatttctccttt

SEQ ID NO: 562519 - DNA, 15 bp, Homo sapiens
tatttctccttttgt

SEQ ID NO: 562520 - DNA, 17 bp, Homo sapiens
tatttctgtatctgaca

SEQ ID NO: 562521 - DNA, 20 bp, Homo sapiens
tatttctgtcattcaaatgg

SEQ ID NO: 562522 - DNA, 19 bp, Homo sapiens
tatttgaaaacagaaattg

SEQ ID NO: 562523 - DNA, 20 bp, Homo sapiens
tatttgaaaacagaaattgg

SEQ ID NO: 562524 - DNA, 18 bp, Homo sapiens
tatttgcataatatgcat

SEQ ID NO: 562525 - DNA, 15 bp, Homo sapiens
tatttgctaattaaa

SEQ ID NO: 562526 - DNA, 23 bp, Homo sapiens
tatttgctaattaaaaagttaat

SEQ ID NO: 562527 - DNA, 17 bp, Homo sapiens
tatttgctcataagtaa

SEQ ID NO: 562528 - DNA, 15 bp, Homo sapiens
tccagaaacttgttc

SEQ ID NO: 562529 - DNA, 16 bp, Homo sapiens
tccagaactcttcctc

SEQ ID NO: 562530 - DNA, 14 bp, Homo sapiens
tccagaagcagcag

SEQ ID NO: 562531 - DNA, 15 bp, Homo sapiens
tccagacctgggccc

SEQ ID NO: 562532 - DNA, 15 bp, Homo sapiens
tccagagcagagttt

SEQ ID NO: 562533 - DNA, 23 bp, Homo sapiens
tccagagcagagtttacgggtct

SEQ ID NO: 562534 - DNA, 12 bp, Homo sapiens
tccagagcattc

SEQ ID NO: 562535 - DNA, 23 bp, Homo sapiens
tccagatgatccttgcacagaca

SEQ ID NO: 562536 - DNA, 15 bp, Homo sapiens
tccagattcccagct

SEQ ID NO: 562537 - DNA, 19 bp, Homo sapiens
tccagctaagcctgatgat

SEQ ID NO: 562538 - DNA, 15 bp, Homo sapiens
tccagctctcccctg

SEQ ID NO: 562539 - DNA, 15 bp, Homo sapiens
tccagctctggcatg

SEQ ID NO: 562540 - DNA, 17 bp, Homo sapiens
tccaggaacacatgcac

SEQ ID NO: 562541 - DNA, 19 bp, Homo sapiens
tccaggaacacatgcacac

SEQ ID NO: 562542 - DNA, 21 bp, Homo sapiens
tccaggagctcaggaagaaga

SEQ ID NO: 562543 - DNA, 12 bp, Homo sapiens
tccaggcagcac

SEQ ID NO: 562544 - DNA, 11 bp, Homo sapiens
tccaggcagcc

SEQ ID NO: 562545 - DNA, 22 bp, Homo sapiens
tccaggcatgaccctggagccc

SEQ ID NO: 562546 - DNA, 16 bp, Homo sapiens
tccaggcgtagggcca

SEQ ID NO: 562547 - DNA, 12 bp, Homo sapiens
tccagtccccag

SEQ ID NO: 562548 - DNA, 15 bp, Homo sapiens
tccagttctgatgag

SEQ ID NO: 562549 - DNA, 17 bp, Homo sapiens
tccagttggactgtggc

SEQ ID NO: 562550 - DNA, 22 bp, Homo sapiens
tccagttggactgtggcctcag

SEQ ID NO: 562551 - DNA, 15 bp, Homo sapiens
tccagtttattccag

SEQ ID NO: 562552 - DNA, 15 bp, Homo sapiens
tccatagctgtggtg

SEQ ID NO: 562553 - DNA, 15 bp, Homo sapiens
tccatattagaaaac

SEQ ID NO: 562554 - DNA, 18 bp, Homo sapiens
tccatattagaaaacttt

SEQ ID NO: 562555 - DNA, 13 bp, Homo sapiens
tccatattttcac

SEQ ID NO: 562556 - DNA, 16 bp, Homo sapiens
tccatatttttttcct

SEQ ID NO: 562557 - DNA, 22 bp, Homo sapiens
tccatatttttttccttacata

SEQ ID NO: 562558 - DNA, 19 bp, Homo sapiens
tccatcaaagccctccctg

SEQ ID NO: 562559 - DNA, 15 bp, Homo sapiens
tccatccttctcccc

SEQ ID NO: 562560 - DNA, 22 bp, Homo sapiens
tccatgattccaagggcccaga

SEQ ID NO: 562561 - DNA, 23 bp, Homo sapiens
tccatgattccaagggcccagag

SEQ ID NO: 562562 - DNA, 16 bp, Homo sapiens
tccatggtgaactgaa

SEQ ID NO: 562563 - DNA, 20 bp, Homo sapiens
tccatgtatgcataataatc

SEQ ID NO: 562564 - DNA, 17 bp, Homo sapiens
tccatgtgctgctgtgg

SEQ ID NO: 562565 - DNA, 10 bp, Homo sapiens
tccattccca

SEQ ID NO: 562566 - DNA, 20 bp, Homo sapiens
tccattcccaactagacatt

SEQ ID NO: 562567 - DNA, 18 bp, Homo sapiens
tccatttacagtctcttt

SEQ ID NO: 562568 - DNA, 17 bp, Homo sapiens
tccatttccttatgctg

SEQ ID NO: 562569 - DNA, 12 bp, Homo sapiens
tccatttctctc

SEQ ID NO: 562570 - DNA, 16 bp, Homo sapiens
tccatttctctctcca

SEQ ID NO: 562571 - DNA, 12 bp, Homo sapiens
tcccaaaggcat

SEQ ID NO: 562572 - DNA, 23 bp, Homo sapiens
tcccaacctcccctggtcctgca

SEQ ID NO: 562573 - DNA, 23 bp, Homo sapiens
tcccaatctctacccctttcttc

SEQ ID NO: 562574 - DNA, 21 bp, Homo sapiens
tacccttctttccatttctct

SEQ ID NO: 562575 - DNA, 15 bp, Homo sapiens
tacctaattagagca

SEQ ID NO: 562576 - DNA, 14 bp, Homo sapiens
tacctataatgtgt

SEQ ID NO: 562577 - DNA, 20 bp, Homo sapiens
tacctgaaagcccttctcaa

SEQ ID NO: 562578 - DNA, 16 bp, Homo sapiens
tacctgcgcttgtttt

SEQ ID NO: 562579 - DNA, 23 bp, Homo sapiens
tacctggagaagaatggctttca

SEQ ID NO: 562580 - DNA, 16 bp, Homo sapiens
tacctgtacacacaca

SEQ ID NO: 562581 - DNA, 18 bp, Homo sapiens
tacctgtagctttgggca

SEQ ID NO: 562582 - DNA, 19 bp, Homo sapiens
tacctgttgtctgaaacat

SEQ ID NO: 562583 - DNA, 16 bp, Homo sapiens
taccttaaaatttgaa

SEQ ID NO: 562584 - DNA, 18 bp, Homo sapiens
taccttaaaatttgaaac

SEQ ID NO: 562585 - DNA, 21 bp, Homo sapiens
taccttaaattagtacagcac

SEQ ID NO: 562586 - DNA, 19 bp, Homo sapiens
taccttctgatgaagttgt

SEQ ID NO: 562587 - DNA, 23 bp, Homo sapiens
taccttgcacacatcatctgtaa

SEQ ID NO: 562588 - DNA, 21 bp, Homo sapiens
tacgagtagaggtttaaagaa

SEQ ID NO: 562589 - DNA, 16 bp, Homo sapiens
tacgcaattgtatata

SEQ ID NO: 562590 - DNA, 16 bp, Homo sapiens
tactaaaatatgcagg

SEQ ID NO: 562591 - DNA, 12 bp, Homo sapiens
tactaacagtaa

SEQ ID NO: 562592 - DNA, 18 bp, Homo sapiens
tactaacttctaaaactg

SEQ ID NO: 562593 - DNA, 16 bp, Homo sapiens
tactaaggagaaatga

SEQ ID NO: 562594 - DNA, 18 bp, Homo sapiens
tactacatgtgggagctt

SEQ ID NO: 562595 - DNA, 17 bp, Homo sapiens
tactacctcctctcctg

SEQ ID NO: 562596 - DNA, 16 bp, Homo sapiens
tactactgaccagaca

SEQ ID NO: 562597 - DNA, 19 bp, Homo sapiens
tactatggaagccacatca

SEQ ID NO: 562598 - DNA, 20 bp, Homo sapiens
tactatggaagccacatcac

SEQ ID NO: 562599 - DNA, 20 bp, Homo sapiens
tactatggtatatattttga

SEQ ID NO: 562600 - DNA, 16 bp, Homo sapiens
tactcaagtttcaggt

SEQ ID NO: 562601 - DNA, 11 bp, Homo sapiens
tactcatttct

SEQ ID NO: 562602 - DNA, 17 bp, Homo sapiens
tactctaaggtaaaacc

SEQ ID NO: 562603 - DNA, 13 bp, Homo sapiens
tactctaatatac

SEQ ID NO: 562604 - DNA, 20 bp, Homo sapiens
tactctatgccccaaatata

SEQ ID NO: 562605 - DNA, 19 bp, Homo sapiens
tactctgcctgtcaagttt

SEQ ID NO: 562606 - DNA, 13 bp, Homo sapiens
tactcttctctct

SEQ ID NO: 562607 - DNA, 17 bp, Homo sapiens
tactcttctctctgctc

SEQ ID NO: 562608 - DNA, 18 bp, Homo sapiens
tactgagcagtgatattc

SEQ ID NO: 562609 - DNA, 12 bp, Homo sapiens
tactgtcttaat

SEQ ID NO: 562610 - DNA, 19 bp, Homo sapiens
tactgtcttaattaagtaa

SEQ ID NO: 562611 - DNA, 20 bp, Homo sapiens
tactgtcttaattaagtaaa

SEQ ID NO: 562612 - DNA, 18 bp, Homo sapiens
tactgtggctggtacttt

SEQ ID NO: 562613 - DNA, 19 bp, Homo sapiens
tactgtggctggtactttc

SEQ ID NO: 562614 - DNA, 13 bp, Homo sapiens
tactgttcctttc

SEQ ID NO: 562615 - DNA, 16 bp, Homo sapiens
tactgttcctttcaga

SEQ ID NO: 562616 - DNA, 19 bp, Homo sapiens
tactgttcctttcagatga

SEQ ID NO: 562617 - DNA, 15 bp, Homo sapiens
tacttaagagaaatg

SEQ ID NO: 562618 - DNA, 18 bp, Homo sapiens
tacttaagagaaatggca

SEQ ID NO: 562619 - DNA, 21 bp, Homo sapiens
tacttagcacttggcctgaga

SEQ ID NO: 562620 - DNA, 14 bp, Homo sapiens
tacttatattctgc

SEQ ID NO: 562621 - DNA, 20 bp, Homo sapiens
tacttatttataacattgta

SEQ ID NO: 562622 - DNA, 17 bp, Homo sapiens
tacttggcaccaataaa

SEQ ID NO: 562623 - DNA, 19 bp, Homo sapiens
tacttggtcacagccaggc

SEQ ID NO: 562624 - DNA, 17 bp, Homo sapiens
tacttgttatgttgtaa

SEQ ID NO: 562625 - DNA, 16 bp, Homo sapiens
tactttaaattgtgga

SEQ ID NO: 562626 - DNA, 13 bp, Homo sapiens
tactttatagaag

SEQ ID NO: 562627 - DNA, 18 bp, Homo sapiens
tactttatagaagaatgc

SEQ ID NO: 562628 - DNA, 17 bp, Homo sapiens
tactttccaattctcct

SEQ ID NO: 562629 - DNA, 12 bp, Homo sapiens
tactttctgtac

SEQ ID NO: 562630 - DNA, 12 bp, Homo sapiens
tactttgattca

SEQ ID NO: 562631 - DNA, 17 bp, Homo sapiens
tactttgattcacatgt

SEQ ID NO: 562632 - DNA, 21 bp, Homo sapiens
tacttttaataaagtatgaat

SEQ ID NO: 562633 - DNA, 11 bp, Homo sapiens
tacttttcctt

SEQ ID NO: 562634 - DNA, 13 bp, Homo sapiens
tagaaaactttgt

SEQ ID NO: 562635 - DNA, 14 bp, Homo sapiens
tagaaaactttgtt

SEQ ID NO: 562636 - DNA, 16 bp, Homo sapiens
tagaaaataaatacaa

SEQ ID NO: 562637 - DNA, 17 bp, Homo sapiens
tagaaaataaatacaag

SEQ ID NO: 562638 - DNA, 15 bp, Homo sapiens
tagaaaatatatttg

SEQ ID NO: 562639 - DNA, 16 bp, Homo sapiens
tagaaagtgttctgtt

SEQ ID NO: 562640 - DNA, 21 bp, Homo sapiens
tagaaagtgttctgttacaaa

SEQ ID NO: 562641 - DNA, 15 bp, Homo sapiens
tagaaattaagattg

SEQ ID NO: 562642 - DNA, 23 bp, Homo sapiens
tagaacgccagggaccccagaat

SEQ ID NO: 562643 - DNA, 14 bp, Homo sapiens
tagaagaatgcatg

SEQ ID NO: 562644 - DNA, 15 bp, Homo sapiens
tagaagtcttcatga

SEQ ID NO: 562645 - DNA, 22 bp, Homo sapiens
tagaagtcttcatgaaatgcta

SEQ ID NO: 562646 - DNA, 24 bp, Homo sapiens
tagaagtcttcatgaaatgctatg

SEQ ID NO: 562647 - DNA, 20 bp, Homo sapiens
tagaatactgtattgttaca

SEQ ID NO: 562648 - DNA, 15 bp, Homo sapiens
tagaatgaccttgta

SEQ ID NO: 562649 - DNA, 17 bp, Homo sapiens
tagaatgaccttgtaat

SEQ ID NO: 562650 - DNA, 12 bp, Homo sapiens
tagacacacaaa

SEQ ID NO: 562651 - DNA, 22 bp, Homo sapiens
tagacagatgtggacatgcacc

SEQ ID NO: 562652 - DNA, 19 bp, Homo sapiens
tagacaggagaagaaagaa

SEQ ID NO: 562653 - DNA, 23 bp, Homo sapiens
tagactatatacatgtgtgtata

SEQ ID NO: 562654 - DNA, 20 bp, Homo sapiens
tagactggcctgaaccacag

SEQ ID NO: 562655 - DNA, 15 bp, Homo sapiens
tagacttctgttttc

SEQ ID NO: 562656 - DNA, 16 bp, Homo sapiens
tagacttctgttttca

SEQ ID NO: 562657 - DNA, 14 bp, Homo sapiens
tagagatattggaa

SEQ ID NO: 562658 - DNA, 17 bp, Homo sapiens
tagagggtccagtcttc

SEQ ID NO: 562659 - DNA, 13 bp, Homo sapiens
tagaggtttaaag

SEQ ID NO: 562660 - DNA, 19 bp, Homo sapiens
tagaggtttaaagaaaaat

SEQ ID NO: 562661 - DNA, 22 bp, Homo sapiens
tagagtccaacgtggggcagca

SEQ ID NO: 562662 - DNA, 14 bp, Homo sapiens
tagagttcatccca

SEQ ID NO: 562663 - DNA, 17 bp, Homo sapiens
tagataccattttgaaa

SEQ ID NO: 562664 - DNA, 21 bp, Homo sapiens
tagatcccacgttgatgtctg

SEQ ID NO: 562665 - DNA, 14 bp, Homo sapiens
tagatgtaaatttt

SEQ ID NO: 562666 - DNA, 18 bp, Homo sapiens
tagattgttttagagtta

SEQ ID NO: 562667 - DNA, 14 bp, Homo sapiens
tagattttcatgtt

SEQ ID NO: 562668 - DNA, 23 bp, Homo sapiens
tagcaaaaaaagttgtatgatct

SEQ ID NO: 562669 - DNA, 20 bp, Homo sapiens
tagcaaaccctgtcaaacat

SEQ ID NO: 562670 - DNA, 16 bp, Homo sapiens
tagcaattccatcacc

SEQ ID NO: 562671 - DNA, 13 bp, Homo sapiens
tagcacagtattt

SEQ ID NO: 562672 - DNA, 14 bp, Homo sapiens
tagcacagtattta

SEQ ID NO: 562673 - DNA, 17 bp, Homo sapiens
tagcacagtatttaaca

SEQ ID NO: 562674 - DNA, 18 bp, Homo sapiens
tagcacagtatttaacat

SEQ ID NO: 562675 - DNA, 19 bp, Homo sapiens
tagcacagtatttaacatt

SEQ ID NO: 562676 - DNA, 21 bp, Homo sapiens
tagcacttcagggcagatttt

SEQ ID NO: 562677 - DNA, 20 bp, Homo sapiens
tagcagaatcaaaatgacct

SEQ ID NO: 562678 - DNA, 16 bp, Homo sapiens
tagcagtggcaaaata

SEQ ID NO: 562679 - DNA, 14 bp, Homo sapiens
tagcatgacaggct

SEQ ID NO: 562680 - DNA, 22 bp, Homo sapiens
tagcatttatggtaatcatatt

SEQ ID NO: 562681 - DNA, 14 bp, Homo sapiens
tagccccctcttcc

SEQ ID NO: 562682 - DNA, 12 bp, Homo sapiens
tagccctgcccg

SEQ ID NO: 562683 - DNA, 19 bp, Homo sapiens
tagccggagtgacagagta

SEQ ID NO: 562684 - DNA, 16 bp, Homo sapiens
tagccttgatttgttc

SEQ ID NO: 562685 - DNA, 19 bp, Homo sapiens
tagcgacaacagattggat

SEQ ID NO: 562686 - DNA, 18 bp, Homo sapiens
tagcgttcccaacaacat

SEQ ID NO: 562687 - DNA, 18 bp, Homo sapiens
tagcgttgttttgtggat

SEQ ID NO: 562688 - DNA, 20 bp, Homo sapiens
tagctacccaaaagagaaaa

SEQ ID NO: 562689 - DNA, 15 bp, Homo sapiens
tagctataaatagtg

SEQ ID NO: 562690 - DNA, 14 bp, Homo sapiens
tagctcgtgtgctt

SEQ ID NO: 562691 - DNA, 15 bp, Homo sapiens
tagctcgtgtgctta

SEQ ID NO: 562692 - DNA, 19 bp, Homo sapiens
tagctggatataatgtatt

SEQ ID NO: 562693 - DNA, 17 bp, Homo sapiens
tagctgtggggagctgg

SEQ ID NO: 562694 - DNA, 12 bp, Homo sapiens
tagcttaagaaa

SEQ ID NO: 562695 - DNA, 12 bp, Homo sapiens
tagcttatcttt

SEQ ID NO: 562696 - DNA, 17 bp, Homo sapiens
tagcttatctttctttc

SEQ ID NO: 562697 - DNA, 19 bp, Homo sapiens
tagcttatctttctttcca

SEQ ID NO: 562698 - DNA, 14 bp, Homo sapiens
tagcttgcacaaca

SEQ ID NO: 562699 - DNA, 15 bp, Homo sapiens
taggaaaagaaatct

SEQ ID NO: 562700 - DNA, 13 bp, Homo sapiens
taggaacaaatct

SEQ ID NO: 562701 - DNA, 14 bp, Homo sapiens
taggaaggtcattt

SEQ ID NO: 562702 - DNA, 18 bp, Homo sapiens
taggaaggtcatttccat

SEQ ID NO: 562703 - DNA, 19 bp, Homo sapiens
taggaaggtcatttccatg

SEQ ID NO: 562704 - DNA, 13 bp, Homo sapiens
taggaatattata

SEQ ID NO: 562705 - DNA, 15 bp, Homo sapiens
taggaatattatatt

SEQ ID NO: 562706 - DNA, 18 bp, Homo sapiens
taggaatattatatttgg

SEQ ID NO: 562707 - DNA, 23 bp, Homo sapiens
taggacatctctgtaaaaagcag

SEQ ID NO: 562708 - DNA, 21 bp, Homo sapiens
taggatatgcctgctctttgg

SEQ ID NO: 562709 - DNA, 15 bp, Homo sapiens
taggatgtctgtaat

SEQ ID NO: 562710 - DNA, 21 bp, Homo sapiens
tagggaatgagagttccttct

SEQ ID NO: 562711 - DNA, 16 bp, Homo sapiens
tagggacctggggaag

SEQ ID NO: 562712 - DNA, 14 bp, Homo sapiens
tagggccagggctc

SEQ ID NO: 562713 - DNA, 17 bp, Homo sapiens
tagggctctaatttcct

SEQ ID NO: 562714 - DNA, 20 bp, Homo sapiens
taggggagagagcagagaag

SEQ ID NO: 562715 - DNA, 17 bp, Homo sapiens
taggggtaccactgaat

SEQ ID NO: 562716 - DNA, 16 bp, Homo sapiens
taggtgctaattaata

SEQ ID NO: 562717 - DNA, 15 bp, Homo sapiens
gctatgtctcatgtt

SEQ ID NO: 562718 - DNA, 21 bp, Homo sapiens
gctatttaagtggactgtatt

SEQ ID NO: 562719 - DNA, 13 bp, Homo sapiens
gctatttgtgtaa

SEQ ID NO: 562720 - DNA, 17 bp, Homo sapiens
gctattttactgtctta

SEQ ID NO: 562721 - DNA, 19 bp, Homo sapiens
gctcaattgttaatgtgat

SEQ ID NO: 562722 - DNA, 19 bp, Homo sapiens
gctcacacaatcagaccaa

SEQ ID NO: 562723 - DNA, 15 bp, Homo sapiens
gctcagagtgaagag

SEQ ID NO: 562724 - DNA, 19 bp, Homo sapiens
gctcataagtaaatgtctt

SEQ ID NO: 562725 - DNA, 15 bp, Homo sapiens
gctcatcagaaacaa

SEQ ID NO: 562726 - DNA, 22 bp, Homo sapiens
gctcatcagaaacaatttctgt

SEQ ID NO: 562727 - DNA, 16 bp, Homo sapiens
gctccacacacacaaa

SEQ ID NO: 562728 - DNA, 20 bp, Homo sapiens
gctccaggcagcacccaggt

SEQ ID NO: 562729 - DNA, 14 bp, Homo sapiens
gctccatcttattt

SEQ ID NO: 562730 - DNA, 12 bp, Homo sapiens
gctcccactgcc

SEQ ID NO: 562731 - DNA, 20 bp, Homo sapiens
gctcccaggacgcagggaga

SEQ ID NO: 562732 - DNA, 22 bp, Homo sapiens
gctccccatggctcctcaccac

SEQ ID NO: 562733 - DNA, 14 bp, Homo sapiens
gctcccccagctcc

SEQ ID NO: 562734 - DNA, 11 bp, Homo sapiens
gctccccccag

SEQ ID NO: 562735 - DNA, 16 bp, Homo sapiens
gctccccttccccttc

SEQ ID NO: 562736 - DNA, 17 bp, Homo sapiens
gctccctcatgcagata

SEQ ID NO: 562737 - DNA, 22 bp, Homo sapiens
gctccctgtgacaaaattttat

SEQ ID NO: 562738 - DNA, 18 bp, Homo sapiens
gctcccttgacctgctga

SEQ ID NO: 562739 - DNA, 22 bp, Homo sapiens
gctccgacttgtgcacaggcag

SEQ ID NO: 562740 - DNA, 13 bp, Homo sapiens
gctcctcccgaaa

SEQ ID NO: 562741 - DNA, 22 bp, Homo sapiens
gctcctcggccagagctcccag

SEQ ID NO: 562742 - DNA, 11 bp, Homo sapiens
gctcctgcccc

SEQ ID NO: 562743 - DNA, 23 bp, Homo sapiens
gctcctggccaggataatatatt

SEQ ID NO: 562744 - DNA, 21 bp, Homo sapiens
gctccttagggttttctctct

SEQ ID NO: 562745 - DNA, 19 bp, Homo sapiens
gctccttcccttgctacca

SEQ ID NO: 562746 - DNA, 17 bp, Homo sapiens
gctcgatgcagacaggg

SEQ ID NO: 562747 - DNA, 21 bp, Homo sapiens
gctcggccaggcacggaggct

SEQ ID NO: 562748 - DNA, 22 bp, Homo sapiens
gctcggccaggcacggaggctc

SEQ ID NO: 562749 - DNA, 14 bp, Homo sapiens
gctcgtgcatgtaa

SEQ ID NO: 562750 - DNA, 16 bp, Homo sapiens
gctctaggacccccag

SEQ ID NO: 562751 - DNA, 16 bp, Homo sapiens
gctctcccctcccttg

SEQ ID NO: 562752 - DNA, 13 bp, Homo sapiens
gctctcccctgcg

SEQ ID NO: 562753 - DNA, 14 bp, Homo sapiens
gctctcccctgcgc

SEQ ID NO: 562754 - DNA, 17 bp, Homo sapiens
gctctcccctgcgcagg

SEQ ID NO: 562755 - DNA, 19 bp, Homo sapiens
gctctcccctgcgcaggcc

SEQ ID NO: 562756 - DNA, 23 bp, Homo sapiens
gctctcccctgcgcaggccctcc

SEQ ID NO: 562757 - DNA, 14 bp, Homo sapiens
gctctcctgggcca

SEQ ID NO: 562758 - DNA, 15 bp, Homo sapiens
gctctcctgggccag

SEQ ID NO: 562759 - DNA, 16 bp, Homo sapiens
gctctcctgggccagg

SEQ ID NO: 562760 - DNA, 20 bp, Homo sapiens
gctctcctgggccagggtct

SEQ ID NO: 562761 - DNA, 20 bp, Homo sapiens
gctctctcattcccaggcac

SEQ ID NO: 562762 - DNA, 18 bp, Homo sapiens
gctctctgtactaaggag

SEQ ID NO: 562763 - DNA, 12 bp, Homo sapiens
gctctgacctgc

SEQ ID NO: 562764 - DNA, 18 bp, Homo sapiens
gctctgacctgcccccgc

SEQ ID NO: 562765 - DNA, 22 bp, Homo sapiens
gctctgagagcaaactggcttg

SEQ ID NO: 562766 - DNA, 14 bp, Homo sapiens
gctctgccatcagc

SEQ ID NO: 562767 - DNA, 17 bp, Homo sapiens
gctctgccatcagcccc

SEQ ID NO: 562768 - DNA, 18 bp, Homo sapiens
gctctgccatcagcccct

SEQ ID NO: 562769 - DNA, 20 bp, Homo sapiens
gctctgccatcagcccctgc

SEQ ID NO: 562770 - DNA, 21 bp, Homo sapiens
gctctgccatcagcccctgct

SEQ ID NO: 562771 - DNA, 22 bp, Homo sapiens
gctcttgcatagtaaatgtagt

SEQ ID NO: 562772 - DNA, 20 bp, Homo sapiens
gctctttcccacccagcctg

SEQ ID NO: 562773 - DNA, 24 bp, Homo sapiens
gctctttggcctgatgaccaattt

SEQ ID NO: 562774 - DNA, 22 bp, Homo sapiens
gctgaattgagctagaaatcac

SEQ ID NO: 562775 - DNA, 13 bp, Homo sapiens
gctgacccccctc

SEQ ID NO: 562776 - DNA, 21 bp, Homo sapiens
gctgacccccctcaggaccct

SEQ ID NO: 562777 - DNA, 20 bp, Homo sapiens
gctgactgggactcccagct

SEQ ID NO: 562778 - DNA, 23 bp, Homo sapiens
gctgagacgcaaggatcacttga

SEQ ID NO: 562779 - DNA, 16 bp, Homo sapiens
gctgagccttctgagc

SEQ ID NO: 562780 - DNA, 18 bp, Homo sapiens
gctgagctctgacctgcc

SEQ ID NO: 562781 - DNA, 16 bp, Homo sapiens
gctgagtggtccacat

SEQ ID NO: 562782 - DNA, 14 bp, Homo sapiens
gctgatctaaaaat

SEQ ID NO: 562783 - DNA, 18 bp, Homo sapiens
gctgatttactaacagta

SEQ ID NO: 562784 - DNA, 15 bp, Homo sapiens
gctgcaggaatcaaa

SEQ ID NO: 562785 - DNA, 21 bp, Homo sapiens
gctgcaggaatcaaaaattga

SEQ ID NO: 562786 - DNA, 22 bp, Homo sapiens
gctgcaggaatcaaaaattgaa

SEQ ID NO: 562787 - DNA, 22 bp, Homo sapiens
gctgcatggcacataccaaagc

SEQ ID NO: 562788 - DNA, 23 bp, Homo sapiens
gctgcatggcacataccaaagct

SEQ ID NO: 562789 - DNA, 14 bp, Homo sapiens
gctgcatttcaagt

SEQ ID NO: 562790 - DNA, 18 bp, Homo sapiens
gctgccaggctcccactg

SEQ ID NO: 562791 - DNA, 19 bp, Homo sapiens
gctgccccactacaggccc

SEQ ID NO: 562792 - DNA, 13 bp, Homo sapiens
gctgcccctgcct

SEQ ID NO: 562793 - DNA, 14 bp, Homo sapiens
gctgcccctgcctt

SEQ ID NO: 562794 - DNA, 19 bp, Homo sapiens
gctgccgtgcacggggcca

SEQ ID NO: 562795 - DNA, 21 bp, Homo sapiens
gctgccgtgcacggggccagc

SEQ ID NO: 562796 - DNA, 14 bp, Homo sapiens
gctgcggcaccctt

SEQ ID NO: 562797 - DNA, 15 bp, Homo sapiens
gctgcggcacccttg

SEQ ID NO: 562798 - DNA, 17 bp, Homo sapiens
gctgctgcactgccctc

SEQ ID NO: 562799 - DNA, 15 bp, Homo sapiens
gctgctgtggcatca

SEQ ID NO: 562800 - DNA, 23 bp, Homo sapiens
gctggcaggagacactggtctca

SEQ ID NO: 562801 - DNA, 12 bp, Homo sapiens
gctggcccccac

SEQ ID NO: 562802 - DNA, 14 bp, Homo sapiens
gctggcccccactg

SEQ ID NO: 562803 - DNA, 17 bp, Homo sapiens
gctggcccccactggct

SEQ ID NO: 562804 - DNA, 19 bp, Homo sapiens
gctggcccccactggctgt

SEQ ID NO: 562805 - DNA, 24 bp, Homo sapiens
gctggcccccactggctgtgggct

SEQ ID NO: 562806 - DNA, 12 bp, Homo sapiens
gtataaattttt

SEQ ID NO: 562807 - DNA, 20 bp, Homo sapiens
gtataaatttttaagtgtca

SEQ ID NO: 562808 - DNA, 13 bp, Homo sapiens
gtataattatgaa

SEQ ID NO: 562809 - DNA, 19 bp, Homo sapiens
gtatacaatatataaaaat

SEQ ID NO: 562810 - DNA, 17 bp, Homo sapiens
gtatacctctaactgtg

SEQ ID NO: 562811 - DNA, 18 bp, Homo sapiens
gtatacgcacgcacccac

SEQ ID NO: 562812 - DNA, 18 bp, Homo sapiens
gtatagaagtcttcatga

SEQ ID NO: 562813 - DNA, 16 bp, Homo sapiens
gtatagacaggagaag

SEQ ID NO: 562814 - DNA, 13 bp, Homo sapiens
gtatagtatttga

SEQ ID NO: 562815 - DNA, 16 bp, Homo sapiens
gtatagtatttgaaaa

SEQ ID NO: 562816 - DNA, 12 bp, Homo sapiens
gtatatacacat

SEQ ID NO: 562817 - DNA, 16 bp, Homo sapiens
gtatatacacatatac

SEQ ID NO: 562818 - DNA, 23 bp, Homo sapiens
gtatatatgtgtatatatacata

SEQ ID NO: 562819 - DNA, 18 bp, Homo sapiens
gtatatattttgaaagga

SEQ ID NO: 562820 - DNA, 15 bp, Homo sapiens
gtatatgtaacagtt

SEQ ID NO: 562821 - DNA, 18 bp, Homo sapiens
gtatatgtgattttcaaa

SEQ ID NO: 562822 - DNA, 22 bp, Homo sapiens
gtatatgtgattttcaaatatg

SEQ ID NO: 562823 - DNA, 16 bp, Homo sapiens
gtatatgtttatacac

SEQ ID NO: 562824 - DNA, 17 bp, Homo sapiens
gtatatgtttatacaca

SEQ ID NO: 562825 - DNA, 21 bp, Homo sapiens
gtatatgtttatacacacagg

SEQ ID NO: 562826 - DNA, 23 bp, Homo sapiens
gtatattgaaaagaaaaagaaga

SEQ ID NO: 562827 - DNA, 19 bp, Homo sapiens
gtatattgcacaattataa

SEQ ID NO: 562828 - DNA, 14 bp, Homo sapiens
gtatcatgcttcta

SEQ ID NO: 562829 - DNA, 12 bp, Homo sapiens
gtatccagaggt

SEQ ID NO: 562830 - DNA, 13 bp, Homo sapiens
gtatccagaggtg

SEQ ID NO: 562831 - DNA, 16 bp, Homo sapiens
gtatccagaggtgagg

SEQ ID NO: 562832 - DNA, 14 bp, Homo sapiens
gtatctcctttaat

SEQ ID NO: 562833 - DNA, 23 bp, Homo sapiens
gtatctgatatctgtttgcttct

SEQ ID NO: 562834 - DNA, 19 bp, Homo sapiens
gtatctgatgatgttctga

SEQ ID NO: 562835 - DNA, 20 bp, Homo sapiens
gtatggaaggtggagcgttc

SEQ ID NO: 562836 - DNA, 15 bp, Homo sapiens
gtatggtgctgggtc

SEQ ID NO: 562837 - DNA, 11 bp, Homo sapiens
gtatgtgtata

SEQ ID NO: 562838 - DNA, 12 bp, Homo sapiens
gtatgtgtatat

SEQ ID NO: 562839 - DNA, 14 bp, Homo sapiens
gtatgtttttcagt

SEQ ID NO: 562840 - DNA, 21 bp, Homo sapiens
gtatgtttttcagttcaaagt

SEQ ID NO: 562841 - DNA, 14 bp, Homo sapiens
gtattaatactaaa

SEQ ID NO: 562842 - DNA, 16 bp, Homo sapiens
gtattaatactaaaat

SEQ ID NO: 562843 - DNA, 12 bp, Homo sapiens
gtattatcataa

SEQ ID NO: 562844 - DNA, 14 bp, Homo sapiens
gtattatcataagt

SEQ ID NO: 562845 - DNA, 18 bp, Homo sapiens
gtattcaggaccccatct

SEQ ID NO: 562846 - DNA, 16 bp, Homo sapiens
gtattgacaataagaa

SEQ ID NO: 562847 - DNA, 24 bp, Homo sapiens
gtattgccaaacattaatgttgat

SEQ ID NO: 562848 - DNA, 16 bp, Homo sapiens
gtattgctagtttaaa

SEQ ID NO: 562849 - DNA, 11 bp, Homo sapiens
gtatttaacat

SEQ ID NO: 562850 - DNA, 18 bp, Homo sapiens
gtatttattgaagaaaca

SEQ ID NO: 562851 - DNA, 16 bp, Homo sapiens
gtatttcggctatgtc

SEQ ID NO: 562852 - DNA, 19 bp, Homo sapiens
gtatttgaaaacagaaatt

SEQ ID NO: 562853 - DNA, 20 bp, Homo sapiens
gtatttggctgggctacaat

SEQ ID NO: 562854 - DNA, 20 bp, Homo sapiens
gtatttggtaacttgctgtg

SEQ ID NO: 562855 - DNA, 14 bp, Homo sapiens
gtattttataagca

SEQ ID NO: 562856 - DNA, 16 bp, Homo sapiens
gtattttgatcagtgt

SEQ ID NO: 562857 - DNA, 21 bp, Homo sapiens
gtattttgtgagtttgtttct

SEQ ID NO: 562858 - DNA, 19 bp, Homo sapiens
gtcaaacattagtacttta

SEQ ID NO: 562859 - DNA, 15 bp, Homo sapiens
gtcaaggagtggctt

SEQ ID NO: 562860 - DNA, 20 bp, Homo sapiens
gtcaagtggcaaagctgttc

SEQ ID NO: 562861 - DNA, 13 bp, Homo sapiens
gtcaatgaaaagc

SEQ ID NO: 562862 - DNA, 12 bp, Homo sapiens
gtcacagccagg

SEQ ID NO: 562863 - DNA, 13 bp, Homo sapiens
gtcacagccaggc

SEQ ID NO: 562864 - DNA, 14 bp, Homo sapiens
gtcacccatgacag

SEQ ID NO: 562865 - DNA, 13 bp, Homo sapiens
gtcacctgcttct

SEQ ID NO: 562866 - DNA, 16 bp, Homo sapiens
gtcactgttataaatt

SEQ ID NO: 562867 - DNA, 17 bp, Homo sapiens
gtcactgttataaattt

SEQ ID NO: 562868 - DNA, 21 bp, Homo sapiens
gtcactgttataaattttgta

SEQ ID NO: 562869 - DNA, 20 bp, Homo sapiens
gtcagacacaaacaaacaag

SEQ ID NO: 562870 - DNA, 15 bp, Homo sapiens
gtcagcatgtctcag

SEQ ID NO: 562871 - DNA, 23 bp, Homo sapiens
gtcagcctcgcaggcctccctgc

SEQ ID NO: 562872 - DNA, 22 bp, Homo sapiens
gtcagctgtttctagagttcct

SEQ ID NO: 562873 - DNA, 12 bp, Homo sapiens
gtcaggccacgg

SEQ ID NO: 562874 - DNA, 14 bp, Homo sapiens
gtcaggccacggca

SEQ ID NO: 562875 - DNA, 15 bp, Homo sapiens
gtcaggccgggcaga

SEQ ID NO: 562876 - DNA, 22 bp, Homo sapiens
gtcaggccgggcagagcacagc

SEQ ID NO: 562877 - DNA, 14 bp, Homo sapiens
gtcaggctctctgg

SEQ ID NO: 562878 - DNA, 13 bp, Homo sapiens
gtcagggagccct

SEQ ID NO: 562879 - DNA, 16 bp, Homo sapiens
gtcagggagccctggg

SEQ ID NO: 562880 - DNA, 14 bp, Homo sapiens
gtcagtcgcctttc

SEQ ID NO: 562881 - DNA, 15 bp, Homo sapiens
gtcagtcgtgttgct

SEQ ID NO: 562882 - DNA, 16 bp, Homo sapiens
gtcagtgtactctgag

SEQ ID NO: 562883 - DNA, 16 bp, Homo sapiens
gtcataggaagttagc

SEQ ID NO: 562884 - DNA, 19 bp, Homo sapiens
gtcatgatgctctttccca

SEQ ID NO: 562885 - DNA, 15 bp, Homo sapiens
gtcatgatgttttta

SEQ ID NO: 562886 - DNA, 15 bp, Homo sapiens
gtcatgctcccctgt

SEQ ID NO: 562887 - DNA, 23 bp, Homo sapiens
gtcatgctcccctgtgccagccc

SEQ ID NO: 562888 - DNA, 14 bp, Homo sapiens
gtcattaatgtgtt

SEQ ID NO: 562889 - DNA, 14 bp, Homo sapiens
gtcattgcttcttc

SEQ ID NO: 562890 - DNA, 18 bp, Homo sapiens
gtcatttccatgtatgca

SEQ ID NO: 562891 - DNA, 16 bp, Homo sapiens
gtcatttctctttcaa

SEQ ID NO: 562892 - DNA, 11 bp, Homo sapiens
gtcattttcat

SEQ ID NO: 562893 - DNA, 22 bp, Homo sapiens
gtccaaggggtcccctccagga

SEQ ID NO: 562894 - DNA, 23 bp, Homo sapiens
gtccacgtgcgtgttttctgact

SEQ ID NO: 562895 - DNA, 14 bp, Homo sapiens
gtccacttttccag

SEQ ID NO: 562896 - DNA, 20 bp, Homo sapiens
gtccagacctgggccctggt

SEQ ID NO: 562897 - DNA, 17 bp, Homo sapiens
gtccagagctgcttccc

SEQ ID NO: 562898 - DNA, 18 bp, Homo sapiens
gtccagctctcccctgcg

SEQ ID NO: 562899 - DNA, 16 bp, Homo sapiens
gtccatattttcacag

SEQ ID NO: 562900 - DNA, 20 bp, Homo sapiens
gtcccaaccctgcccagcct

SEQ ID NO: 562901 - DNA, 13 bp, Homo sapiens
gtcccactccaag

SEQ ID NO: 562902 - DNA, 22 bp, Homo sapiens
gtcccatgtgagctgctgccat

SEQ ID NO: 562903 - DNA, 22 bp, Homo sapiens
gtccccagaccagtagtgacca

SEQ ID NO: 562904 - DNA, 23 bp, Homo sapiens
gtccccaggggcacacttcccct

SEQ ID NO: 562905 - DNA, 19 bp, Homo sapiens
gtcccggagctcaggccct

SEQ ID NO: 562906 - DNA, 23 bp, Homo sapiens
gtcccgggtgccccccatgccct

SEQ ID NO: 562907 - DNA, 21 bp, Homo sapiens
gtccctccacgttcacccctc

SEQ ID NO: 562908 - DNA, 18 bp, Homo sapiens
gtccctgagaagcctcat

SEQ ID NO: 562909 - DNA, 20 bp, Homo sapiens
gtccctgagggcccttccca

SEQ ID NO: 562910 - DNA, 18 bp, Homo sapiens
gtcctaagagatttatct

SEQ ID NO: 562911 - DNA, 20 bp, Homo sapiens
gtcctaagagatttatcttt

SEQ ID NO: 562912 - DNA, 16 bp, Homo sapiens
gtcctagttgttcagc

SEQ ID NO: 562913 - DNA, 13 bp, Homo sapiens
gtcctatgtgtga

SEQ ID NO: 562914 - DNA, 13 bp, Homo sapiens
gtcctcagcttct

SEQ ID NO: 562915 - DNA, 17 bp, Homo sapiens
gtcctcagcttcttaat

SEQ ID NO: 562916 - DNA, 19 bp, Homo sapiens
gtcctcattgttcagaaaa

SEQ ID NO: 562917 - DNA, 13 bp, Homo sapiens
gtcctccagaact

SEQ ID NO: 562918 - DNA, 20 bp, Homo sapiens
gtcctccagaactcttcctc

SEQ ID NO: 562919 - DNA, 15 bp, Homo sapiens
gtcctcctgctgcca

SEQ ID NO: 562920 - DNA, 17 bp, Homo sapiens
gtcctcctgctgccagt

SEQ ID NO: 562921 - DNA, 23 bp, Homo sapiens
gtcctggcagggcaggcagagct

SEQ ID NO: 562922 - DNA, 14 bp, Homo sapiens
gtcctgggggcctg

SEQ ID NO: 562923 - DNA, 15 bp, Homo sapiens
gtcctgggggcctga

SEQ ID NO: 562924 - DNA, 14 bp, Homo sapiens
gtcctgggggctgc

SEQ ID NO: 562925 - DNA, 15 bp, Homo sapiens
gtcctgggggctgct

SEQ ID NO: 562926 - DNA, 20 bp, Homo sapiens
gtcctgggggctgctgcact

SEQ ID NO: 562927 - DNA, 18 bp, Homo sapiens
gtcctggtttcctcagcc

SEQ ID NO: 562928 - DNA, 21 bp, Homo sapiens
gtcctgtcctggctcccaggg

SEQ ID NO: 562929 - DNA, 18 bp, Homo sapiens
gtccttctctcacctcct

SEQ ID NO: 562930 - DNA, 13 bp, Homo sapiens
gtcctttatgtat

SEQ ID NO: 562931 - DNA, 19 bp, Homo sapiens
tggcacctgtctgctccag

SEQ ID NO: 562932 - DNA, 23 bp, Homo sapiens
tggcacctgtctgctccagctct

SEQ ID NO: 562933 - DNA, 16 bp, Homo sapiens
tggcactttaatgata

SEQ ID NO: 562934 - DNA, 13 bp, Homo sapiens
tggcagatgcagc

SEQ ID NO: 562935 - DNA, 20 bp, Homo sapiens
tggcaggagacactggtctc

SEQ ID NO: 562936 - DNA, 20 bp, Homo sapiens
tggcagggcaggcagagctc

SEQ ID NO: 562937 - DNA, 22 bp, Homo sapiens
tggcaggggtggaggagagcct

SEQ ID NO: 562938 - DNA, 20 bp, Homo sapiens
tggcaggtaggaatattata

SEQ ID NO: 562939 - DNA, 16 bp, Homo sapiens
tggcaggtggccaggg

SEQ ID NO: 562940 - DNA, 17 bp, Homo sapiens
tggcaggtggccagggc

SEQ ID NO: 562941 - DNA, 16 bp, Homo sapiens
tggcatttagcacagt

SEQ ID NO: 562942 - DNA, 19 bp, Homo sapiens
tggcatttagcacagtatt

SEQ ID NO: 562943 - DNA, 21 bp, Homo sapiens
tggccagaggaaatctgaatg

SEQ ID NO: 562944 - DNA, 20 bp, Homo sapiens
tggcccaacatacgcactgg

SEQ ID NO: 562945 - DNA, 18 bp, Homo sapiens
tggccccacaccagcccc

SEQ ID NO: 562946 - DNA, 15 bp, Homo sapiens
tggcccccactggct

SEQ ID NO: 562947 - DNA, 21 bp, Homo sapiens
tggcccccactggctgtgggc

SEQ ID NO: 562948 - DNA, 17 bp, Homo sapiens
tggcccctcccacatcc

SEQ ID NO: 562949 - DNA, 15 bp, Homo sapiens
tggccctggggcctg

SEQ ID NO: 562950 - DNA, 23 bp, Homo sapiens
tggcctattttggacgtgtgagg

SEQ ID NO: 562951 - DNA, 20 bp, Homo sapiens
tggcctgaaccacaggagag

SEQ ID NO: 562952 - DNA, 14 bp, Homo sapiens
tggcctgactcccc

SEQ ID NO: 562953 - DNA, 17 bp, Homo sapiens
tggcctgactcccccag

SEQ ID NO: 562954 - DNA, 20 bp, Homo sapiens
tggcctggggctgccgtgca

SEQ ID NO: 562955 - DNA, 15 bp, Homo sapiens
tggcgcacccggcag

SEQ ID NO: 562956 - DNA, 19 bp, Homo sapiens
tggcgcacccggcagcccc

SEQ ID NO: 562957 - DNA, 18 bp, Homo sapiens
tggctccacacacacaaa

SEQ ID NO: 562958 - DNA, 18 bp, Homo sapiens
tggctcccagggtcctgg

SEQ ID NO: 562959 - DNA, 15 bp, Homo sapiens
tggctcctcccgaaa

SEQ ID NO: 562960 - DNA, 13 bp, Homo sapiens
tggctcctgccca

SEQ ID NO: 562961 - DNA, 15 bp, Homo sapiens
tggctgacccccctc

SEQ ID NO: 562962 - DNA, 21 bp, Homo sapiens
tggctgatttactaacagtaa

SEQ ID NO: 562963 - DNA, 13 bp, Homo sapiens
tggctgccaagag

SEQ ID NO: 562964 - DNA, 13 bp, Homo sapiens
tggctgtgggctc

SEQ ID NO: 562965 - DNA, 15 bp, Homo sapiens
tggctgtgggctccc

SEQ ID NO: 562966 - DNA, 11 bp, Homo sapiens
tggcttaattc

SEQ ID NO: 562967 - DNA, 20 bp, Homo sapiens
tggcttactacatgtgggag

SEQ ID NO: 562968 - DNA, 23 bp, Homo sapiens
tggcttactacatgtgggagctt

SEQ ID NO: 562969 - DNA, 18 bp, Homo sapiens
tggcttagcgttctgttt

SEQ ID NO: 562970 - DNA, 14 bp, Homo sapiens
tggcttcagcccct

SEQ ID NO: 562971 - DNA, 15 bp, Homo sapiens
tggcttggagcagag

SEQ ID NO: 562972 - DNA, 16 bp, Homo sapiens
tggctttccagtcata

SEQ ID NO: 562973 - DNA, 14 bp, Homo sapiens
tggctttgtgctta

SEQ ID NO: 562974 - DNA, 22 bp, Homo sapiens
tgggaccctcggggcaggaagt

SEQ ID NO: 562975 - DNA, 20 bp, Homo sapiens
tgggacttcttacccaaagc

SEQ ID NO: 562976 - DNA, 14 bp, Homo sapiens
tgggagatgctggg

SEQ ID NO: 562977 - DNA, 19 bp, Homo sapiens
tgggagctttaaagagcag

SEQ ID NO: 562978 - DNA, 21 bp, Homo sapiens
tgggagctttaaagagcagga

SEQ ID NO: 562979 - DNA, 17 bp, Homo sapiens
tgggatgggcacaggct

SEQ ID NO: 562980 - DNA, 19 bp, Homo sapiens
tgggatgggcacaggctgc

SEQ ID NO: 562981 - DNA, 16 bp, Homo sapiens
tgggcaaggcctttgg

SEQ ID NO: 562982 - DNA, 21 bp, Homo sapiens
tgggcaatattctctgtacat

SEQ ID NO: 562983 - DNA, 21 bp, Homo sapiens
tgggcacaggctgccccaccc

SEQ ID NO: 562984 - DNA, 17 bp, Homo sapiens
tgggcacctataatacc

SEQ ID NO: 562985 - DNA, 15 bp, Homo sapiens
tgggcggcagagagg

SEQ ID NO: 562986 - DNA, 15 bp, Homo sapiens
tgggctcccttcctc

SEQ ID NO: 562987 - DNA, 13 bp, Homo sapiens
tgggctctgctga

SEQ ID NO: 562988 - DNA, 15 bp, Homo sapiens
tgggctctgctgagt

SEQ ID NO: 562989 - DNA, 16 bp, Homo sapiens
tgggctttgatttcca

SEQ ID NO: 562990 - DNA, 14 bp, Homo sapiens
tggggacgcagatg

SEQ ID NO: 562991 - DNA, 18 bp, Homo sapiens
tggggagctcctggccag

SEQ ID NO: 562992 - DNA, 23 bp, Homo sapiens
tggggaggagactcaggcccaca

SEQ ID NO: 562993 - DNA, 13 bp, Homo sapiens
tggggcagcacag

SEQ ID NO: 562994 - DNA, 16 bp, Homo sapiens
tggggcagcacagaga

SEQ ID NO: 562995 - DNA, 18 bp, Homo sapiens
tggggctgggcccaccca

SEQ ID NO: 562996 - DNA, 17 bp, Homo sapiens
tgggggcagcctgcgtg

SEQ ID NO: 562997 - DNA, 22 bp, Homo sapiens
tgggggcagcctgcgtggctga

SEQ ID NO: 562998 - DNA, 11 bp, Homo sapiens
tgggggctgct

SEQ ID NO: 562999 - DNA, 20 bp, Homo sapiens
tggggggcaggatgggggag

SEQ ID NO: 563000 - DNA, 20 bp, Homo sapiens
tggggtcaggccgggcagag

SEQ ID NO: 563001 - DNA, 17 bp, Homo sapiens
tggggttgggctctgcg

SEQ ID NO: 563002 - DNA, 21 bp, Homo sapiens
tggggtttccacacaggccca

SEQ ID NO: 563003 - DNA, 19 bp, Homo sapiens
tgggtatacctctaactgt

SEQ ID NO: 563004 - DNA, 12 bp, Homo sapiens
tgggtccaggag

SEQ ID NO: 563005 - DNA, 13 bp, Homo sapiens
tgggtccaggaga

SEQ ID NO: 563006 - DNA, 16 bp, Homo sapiens
tgggtccccagccctt

SEQ ID NO: 563007 - DNA, 22 bp, Homo sapiens
tgggtcttcagggggccaggtg

SEQ ID NO: 563008 - DNA, 21 bp, Homo sapiens
tgggtgaatatggtggaaaat

SEQ ID NO: 563009 - DNA, 14 bp, Homo sapiens
tgggtgcaggagcg

SEQ ID NO: 563010 - DNA, 14 bp, Homo sapiens
tgggtgggacacag

SEQ ID NO: 563011 - DNA, 15 bp, Homo sapiens
tgggtttactctgtg

SEQ ID NO: 563012 - DNA, 15 bp, Homo sapiens
tgggttttgcctctg

SEQ ID NO: 563013 - DNA, 16 bp, Homo sapiens
tggtaacttgctgtga

SEQ ID NO: 563014 - DNA, 18 bp, Homo sapiens
tggtaacttttgtagtct

SEQ ID NO: 563015 - DNA, 12 bp, Homo sapiens
tggtaagaaaaa

SEQ ID NO: 563016 - DNA, 17 bp, Homo sapiens
tggtaagaaaaagcaaa

SEQ ID NO: 563017 - DNA, 14 bp, Homo sapiens
tggtaatcatatta

SEQ ID NO: 563018 - DNA, 20 bp, Homo sapiens
tggtaatttagtgtatatgt

SEQ ID NO: 563019 - DNA, 15 bp, Homo sapiens
tggtaccttgcacac

SEQ ID NO: 563020 - DNA, 17 bp, Homo sapiens
tggtacttgctgctatt

SEQ ID NO: 563021 - DNA, 12 bp, Homo sapiens
tggtacttggca

SEQ ID NO: 563022 - DNA, 17 bp, Homo sapiens
tggtagttgaggaaagc

SEQ ID NO: 563023 - DNA, 21 bp, Homo sapiens
tggtatgtgacatgcgggctg

SEQ ID NO: 563024 - DNA, 23 bp, Homo sapiens
tggtattggccataagcaacaat

SEQ ID NO: 563025 - DNA, 17 bp, Homo sapiens
tggtattttataagcac

SEQ ID NO: 563026 - DNA, 22 bp, Homo sapiens
tggtattttataagcacagaca

SEQ ID NO: 563027 - DNA, 22 bp, Homo sapiens
tggtcactgccatggaggcaca

SEQ ID NO: 563028 - DNA, 12 bp, Homo sapiens
tggtcctgcact

SEQ ID NO: 563029 - DNA, 18 bp, Homo sapiens
tggtctaaaaataaacca

SEQ ID NO: 563030 - DNA, 16 bp, Homo sapiens
tggtctcagaggaggg

SEQ ID NO: 563031 - DNA, 14 bp, Homo sapiens
tggtctcctgcccc

SEQ ID NO: 563032 - DNA, 17 bp, Homo sapiens
tggtctcctgcccccac

SEQ ID NO: 563033 - DNA, 19 bp, Homo sapiens
tggtcttgtttaatatttg

SEQ ID NO: 563034 - DNA, 12 bp, Homo sapiens
tggtcttttcct

SEQ ID NO: 563035 - DNA, 17 bp, Homo sapiens
tggtcttttcctcgctt

SEQ ID NO: 563036 - DNA, 18 bp, Homo sapiens
tggtgaactgaagcagag

SEQ ID NO: 563037 - DNA, 19 bp, Homo sapiens
tggtgaggttgtgctgcct

SEQ ID NO: 563038 - DNA, 13 bp, Homo sapiens
tggtgcaatttgt

SEQ ID NO: 563039 - DNA, 17 bp, Homo sapiens
tggtgggcattctctct

SEQ ID NO: 563040 - DNA, 22 bp, Homo sapiens
tggtgggcccagaccactgtct

SEQ ID NO: 563041 - DNA, 23 bp, Homo sapiens
tggtgggcttgtcatagccagtg

SEQ ID NO: 563042 - DNA, 16 bp, Homo sapiens
tggttacctattgctg

SEQ ID NO: 563043 - DNA, 19 bp, Homo sapiens
tggttacctattgctgtaa

SEQ ID NO: 563044 - DNA, 14 bp, Homo sapiens
tggttatagtgcaa

SEQ ID NO: 563045 - DNA, 18 bp, Homo sapiens
tggttatagtgcaatata

SEQ ID NO: 563046 - DNA, 19 bp, Homo sapiens
tggttatagtgcaatatat

SEQ ID NO: 563047 - DNA, 20 bp, Homo sapiens
tggttatagtgcaatatatt

SEQ ID NO: 563048 - DNA, 22 bp, Homo sapiens
tggttccacaatcatctattga

SEQ ID NO: 563049 - DNA, 21 bp, Homo sapiens
tggttcccccaggaccctgag

SEQ ID NO: 563050 - DNA, 15 bp, Homo sapiens
tggtttaaactttta

SEQ ID NO: 563051 - DNA, 15 bp, Homo sapiens
tggtttctcttctcc

SEQ ID NO: 563052 - DNA, 14 bp, Homo sapiens
tggttttaaaatac

SEQ ID NO: 563053 - DNA, 21 bp, Homo sapiens
tggttttaaaatactgtagat

SEQ ID NO: 563054 - DNA, 21 bp, Homo sapiens
tggtttttttttttttttaaa

SEQ ID NO: 563055 - DNA, 12 bp, Homo sapiens
tgtaaaagcaag

SEQ ID NO: 563056 - DNA, 22 bp, Homo sapiens
tgtaaacgtctttttaagcctt

SEQ ID NO: 563057 - DNA, 12 bp, Homo sapiens
tgtaaactttga

SEQ ID NO: 563058 - DNA, 16 bp, Homo sapiens
tgtgcatgtgtgtata

SEQ ID NO: 563059 - DNA, 17 bp, Homo sapiens
tgtgcatgtgtgtataa

SEQ ID NO: 563060 - DNA, 16 bp, Homo sapiens
tgtgcccccagacgca

SEQ ID NO: 563061 - DNA, 22 bp, Homo sapiens
tgtgcccccagacgcacgtggg

SEQ ID NO: 563062 - DNA, 15 bp, Homo sapiens
tgtgccccttcccca

SEQ ID NO: 563063 - DNA, 21 bp, Homo sapiens
tgtgccccttccccatgctca

SEQ ID NO: 563064 - DNA, 16 bp, Homo sapiens
tgtgcccgtggtgagg

SEQ ID NO: 563065 - DNA, 13 bp, Homo sapiens
tgtgcgaacacag

SEQ ID NO: 563066 - DNA, 19 bp, Homo sapiens
tgtgcgcataggcctgctt

SEQ ID NO: 563067 - DNA, 16 bp, Homo sapiens
tgtgctaagtctttcc

SEQ ID NO: 563068 - DNA, 16 bp, Homo sapiens
tgtgctaagttgtctt

SEQ ID NO: 563069 - DNA, 14 bp, Homo sapiens
tgtgctccaaatgt

SEQ ID NO: 563070 - DNA, 16 bp, Homo sapiens
tgtgctccaaatgtct

SEQ ID NO: 563071 - DNA, 23 bp, Homo sapiens
tgtgctccaaatgtctactgaag

SEQ ID NO: 563072 - DNA, 16 bp, Homo sapiens
tgtgctctcaccagct

SEQ ID NO: 563073 - DNA, 15 bp, Homo sapiens
tgtgctgctgtggca

SEQ ID NO: 563074 - DNA, 18 bp, Homo sapiens
tgtgctgctgtggcatca

SEQ ID NO: 563075 - DNA, 19 bp, Homo sapiens
tgtgctgtgtttgctcccc

SEQ ID NO: 563076 - DNA, 20 bp, Homo sapiens
tgtgctgtgtttgctcccct

SEQ ID NO: 563077 - DNA, 15 bp, Homo sapiens
tgtggacatgcaccc

SEQ ID NO: 563078 - DNA, 22 bp, Homo sapiens
tgtggagtcagcctcgcaggcc

SEQ ID NO: 563079 - DNA, 20 bp, Homo sapiens
tgtggataagaaaaatgctt

SEQ ID NO: 563080 - DNA, 12 bp, Homo sapiens
tgtggctccaca

SEQ ID NO: 563081 - DNA, 23 bp, Homo sapiens
tgtgggccatcgcaagtcacaga

SEQ ID NO: 563082 - DNA, 14 bp, Homo sapiens
tgtgggctcccttc

SEQ ID NO: 563083 - DNA, 13 bp, Homo sapiens
tgtggggagctgg

SEQ ID NO: 563084 - DNA, 14 bp, Homo sapiens
tgtggggagctggt

SEQ ID NO: 563085 - DNA, 20 bp, Homo sapiens
tgtgggtttactctgtgcta

SEQ ID NO: 563086 - DNA, 23 bp, Homo sapiens
tgtggtgaggtcctgtcctggct

SEQ ID NO: 563087 - DNA, 20 bp, Homo sapiens
tgtggtgtaatttataaaat

SEQ ID NO: 563088 - DNA, 14 bp, Homo sapiens
tgtgtaatttttct

SEQ ID NO: 563089 - DNA, 14 bp, Homo sapiens
tgtgtatatataca

SEQ ID NO: 563090 - DNA, 15 bp, Homo sapiens
tgtgtatatatacat

SEQ ID NO: 563091 - DNA, 16 bp, Homo sapiens
tgtgtatatatacata

SEQ ID NO: 563092 - DNA, 18 bp, Homo sapiens
tgtgtatatatgtgtata

SEQ ID NO: 563093 - DNA, 12 bp, Homo sapiens
tgtgtatatgtt

SEQ ID NO: 563094 - DNA, 16 bp, Homo sapiens
tgtgtatgtgtattta

SEQ ID NO: 563095 - DNA, 23 bp, Homo sapiens
tgtgtatttcagttattgtccct

SEQ ID NO: 563096 - DNA, 13 bp, Homo sapiens
tgtgtcagtttat

SEQ ID NO: 563097 - DNA, 18 bp, Homo sapiens
tgtgtcagtttatgtttt

SEQ ID NO: 563098 - DNA, 20 bp, Homo sapiens
tgtgtcagtttatgttttgg

SEQ ID NO: 563099 - DNA, 23 bp, Homo sapiens
tgtgtccgtgaaagttgtgatct

SEQ ID NO: 563100 - DNA, 10 bp, Homo sapiens
tgtgtccttt

SEQ ID NO: 563101 - DNA, 15 bp, Homo sapiens
tgtgtgatgtgacat

SEQ ID NO: 563102 - DNA, 17 bp, Homo sapiens
tgtgtgctaaacgtgta

SEQ ID NO: 563103 - DNA, 19 bp, Homo sapiens
tgtgtgtctaggtagagat

SEQ ID NO: 563104 - DNA, 13 bp, Homo sapiens
tgtgtgtgagttt

SEQ ID NO: 563105 - DNA, 22 bp, Homo sapiens
tgtgttattcgtgaatagtctt

SEQ ID NO: 563106 - DNA, 17 bp, Homo sapiens
tgtgtttacagagatgt

SEQ ID NO: 563107 - DNA, 22 bp, Homo sapiens
tgttaaaattatacctgttgct

SEQ ID NO: 563108 - DNA, 14 bp, Homo sapiens
tgttaaagatgtag

SEQ ID NO: 563109 - DNA, 16 bp, Homo sapiens
tgttaacagtatttta

SEQ ID NO: 563110 - DNA, 22 bp, Homo sapiens
tgttaataaagtgcactgccac

SEQ ID NO: 563111 - DNA, 22 bp, Homo sapiens
tgttaatgagtatatgtaacag

SEQ ID NO: 563112 - DNA, 18 bp, Homo sapiens
tgttaatttcttgcaatt

SEQ ID NO: 563113 - DNA, 23 bp, Homo sapiens
tgttaatttcttgcaatttgaag

SEQ ID NO: 563114 - DNA, 15 bp, Homo sapiens
tgttacaaaatgtaa

SEQ ID NO: 563115 - DNA, 17 bp, Homo sapiens
tgttacaaaatgtaact

SEQ ID NO: 563116 - DNA, 22 bp, Homo sapiens
tgttacataacaagaaaatcaa

SEQ ID NO: 563117 - DNA, 23 bp, Homo sapiens
tgttagagtccaacgtggggcag

SEQ ID NO: 563118 - DNA, 17 bp, Homo sapiens
tgttataaaatctgtat

SEQ ID NO: 563119 - DNA, 20 bp, Homo sapiens
tgttataaaatctgtattgc

SEQ ID NO: 563120 - DNA, 21 bp, Homo sapiens
tgttataaaatctgtattgct

SEQ ID NO: 563121 - DNA, 12 bp, Homo sapiens
tgttataaattt

SEQ ID NO: 563122 - DNA, 20 bp, Homo sapiens
tgttataaattttgtacatt

SEQ ID NO: 563123 - DNA, 16 bp, Homo sapiens
tgttatatttttctta

SEQ ID NO: 563124 - DNA, 18 bp, Homo sapiens
tgttatatttttcttaaa

SEQ ID NO: 563125 - DNA, 13 bp, Homo sapiens
tgttatgaaaacc

SEQ ID NO: 563126 - DNA, 17 bp, Homo sapiens
tgttattcgtgaatagt

SEQ ID NO: 563127 - DNA, 20 bp, Homo sapiens
tgttattgagagagatgtgt

SEQ ID NO: 563128 - DNA, 15 bp, Homo sapiens
tgttcagaaaaaagg

SEQ ID NO: 563129 - DNA, 12 bp, Homo sapiens
tgttcagtgtta

SEQ ID NO: 563130 - DNA, 10 bp, Homo sapiens
tgttccagtt

SEQ ID NO: 563131 - DNA, 13 bp, Homo sapiens
tgttctgtgcaac

SEQ ID NO: 563132 - DNA, 11 bp, Homo sapiens
tgttctgtggc

SEQ ID NO: 563133 - DNA, 17 bp, Homo sapiens
tgttctgtgtctgctgt

SEQ ID NO: 563134 - DNA, 15 bp, Homo sapiens
tgttctgttacaaaa

SEQ ID NO: 563135 - DNA, 18 bp, Homo sapiens
tgttctgttacaaaatgt

SEQ ID NO: 563136 - DNA, 22 bp, Homo sapiens
tgttctgttacaaaatgtaact

SEQ ID NO: 563137 - DNA, 17 bp, Homo sapiens
tgttcttaaaaatgcat

SEQ ID NO: 563138 - DNA, 20 bp, Homo sapiens
tgttcttaaaaatgcattta

SEQ ID NO: 563139 - DNA, 13 bp, Homo sapiens
tgttcttccagtt

SEQ ID NO: 563140 - DNA, 16 bp, Homo sapiens
tgttcttgagcagctg

SEQ ID NO: 563141 - DNA, 15 bp, Homo sapiens
tgttgacatttgttt

SEQ ID NO: 563142 - DNA, 22 bp, Homo sapiens
tgttgaccaggcacctcccctc

SEQ ID NO: 563143 - DNA, 20 bp, Homo sapiens
tgttgatgcaatccttacaa

SEQ ID NO: 563144 - DNA, 21 bp, Homo sapiens
tgttgatgcaatccttacaaa

SEQ ID NO: 563145 - DNA, 14 bp, Homo sapiens
tgttgattaaaaca

SEQ ID NO: 563146 - DNA, 20 bp, Homo sapiens
tgttgatttctagttattta

SEQ ID NO: 563147 - DNA, 15 bp, Homo sapiens
tgttggcagatgcag

SEQ ID NO: 563148 - DNA, 13 bp, Homo sapiens
tgttgggaaaaag

SEQ ID NO: 563149 - DNA, 19 bp, Homo sapiens
tgttggtttagcgttgttt

SEQ ID NO: 563150 - DNA, 13 bp, Homo sapiens
tgttgtaaattag

SEQ ID NO: 563151 - DNA, 17 bp, Homo sapiens
tgttgtaatattttgct

SEQ ID NO: 563152 - DNA, 20 bp, Homo sapiens
tgttgtaatattttgctgct

SEQ ID NO: 563153 - DNA, 13 bp, Homo sapiens
tgttgtctcttct

SEQ ID NO: 563154 - DNA, 17 bp, Homo sapiens
tgtttaagacacttccg

SEQ ID NO: 563155 - DNA, 18 bp, Homo sapiens
tgtttaagacacttccgt

SEQ ID NO: 563156 - DNA, 19 bp, Homo sapiens
tgtttaagacacttccgtc

SEQ ID NO: 563157 - DNA, 14 bp, Homo sapiens
tgtttaagcagaat

SEQ ID NO: 563158 - DNA, 18 bp, Homo sapiens
tgtttaagcagaattgga

SEQ ID NO: 563159 - DNA, 21 bp, Homo sapiens
ttccggaatcctgtcctcagc

SEQ ID NO: 563160 - DNA, 19 bp, Homo sapiens
ttcctaacaggattagaca

SEQ ID NO: 563161 - DNA, 12 bp, Homo sapiens
ttcctaaggcat

SEQ ID NO: 563162 - DNA, 20 bp, Homo sapiens
ttcctaatcactcagagcag

SEQ ID NO: 563163 - DNA, 15 bp, Homo sapiens
ttcctactcttctct

SEQ ID NO: 563164 - DNA, 20 bp, Homo sapiens
ttcctactcttctctctgct

SEQ ID NO: 563165 - DNA, 22 bp, Homo sapiens
ttcctagttcatcccttctctt

SEQ ID NO: 563166 - DNA, 20 bp, Homo sapiens
ttcctatgaagttggcacat

SEQ ID NO: 563167 - DNA, 19 bp, Homo sapiens
ttcctatgactcaaagatg

SEQ ID NO: 563168 - DNA, 20 bp, Homo sapiens
ttcctatgactcaaagatga

SEQ ID NO: 563169 - DNA, 21 bp, Homo sapiens
ttcctatgactcaaagatgaa

SEQ ID NO: 563170 - DNA, 19 bp, Homo sapiens
ttcctccctgggggcccca

SEQ ID NO: 563171 - DNA, 14 bp, Homo sapiens
ttcctctgctaaat

SEQ ID NO: 563172 - DNA, 17 bp, Homo sapiens
ttcctctgctaaattga

SEQ ID NO: 563173 - DNA, 21 bp, Homo sapiens
ttcctctgctcccccttttcc

SEQ ID NO: 563174 - DNA, 16 bp, Homo sapiens
ttcctcttacctgtaa

SEQ ID NO: 563175 - DNA, 20 bp, Homo sapiens
ttcctgacctccgccatcca

SEQ ID NO: 563176 - DNA, 19 bp, Homo sapiens
ttcctgattggtttctctt

SEQ ID NO: 563177 - DNA, 16 bp, Homo sapiens
ttcctgcctggtctcc

SEQ ID NO: 563178 - DNA, 17 bp, Homo sapiens
ttcctgcctggtctcct

SEQ ID NO: 563179 - DNA, 22 bp, Homo sapiens
ttcctgcctggtctcctgcccc

SEQ ID NO: 563180 - DNA, 18 bp, Homo sapiens
ttcctgctacagtagctg

SEQ ID NO: 563181 - DNA, 14 bp, Homo sapiens
ttcctgtgccaggt

SEQ ID NO: 563182 - DNA, 16 bp, Homo sapiens
ttcctgttaagtgaat

SEQ ID NO: 563183 - DNA, 16 bp, Homo sapiens
ttccttacataaacat

SEQ ID NO: 563184 - DNA, 17 bp, Homo sapiens
ttccttacataaacatc

SEQ ID NO: 563185 - DNA, 17 bp, Homo sapiens
ttccttctcacttagaa

SEQ ID NO: 563186 - DNA, 15 bp, Homo sapiens
ttccttctttgccct

SEQ ID NO: 563187 - DNA, 13 bp, Homo sapiens
ttccttgcataca

SEQ ID NO: 563188 - DNA, 17 bp, Homo sapiens
ttccttgcatacaaaca

SEQ ID NO: 563189 - DNA, 14 bp, Homo sapiens
ttcctttcagatga

SEQ ID NO: 563190 - DNA, 21 bp, Homo sapiens
ttcctttggccactgtatttg

SEQ ID NO: 563191 - DNA, 17 bp, Homo sapiens
ttcctttttctatttta

SEQ ID NO: 563192 - DNA, 22 bp, Homo sapiens
ttcgaagtttgcaacctttata

SEQ ID NO: 563193 - DNA, 18 bp, Homo sapiens
ttcggctatgtctcatgt

SEQ ID NO: 563194 - DNA, 12 bp, Homo sapiens
ttctaaaactgt

SEQ ID NO: 563195 - DNA, 18 bp, Homo sapiens
ttctaaaactgtactttg

SEQ ID NO: 563196 - DNA, 19 bp, Homo sapiens
ttctaaaactgtactttga

SEQ ID NO: 563197 - DNA, 16 bp, Homo sapiens
ttctaactctgatgta

SEQ ID NO: 563198 - DNA, 17 bp, Homo sapiens
ttctaactctgatgtaa

SEQ ID NO: 563199 - DNA, 14 bp, Homo sapiens
ttctaagtgtttca

SEQ ID NO: 563200 - DNA, 22 bp, Homo sapiens
ttctacaaggactccattggat

SEQ ID NO: 563201 - DNA, 18 bp, Homo sapiens
ttctactgttcaatttca

SEQ ID NO: 563202 - DNA, 16 bp, Homo sapiens
ttctaggacctgtgtc

SEQ ID NO: 563203 - DNA, 20 bp, Homo sapiens
ttctatcagttatcctttgt

SEQ ID NO: 563204 - DNA, 16 bp, Homo sapiens
ttctatgtaacttgtt

SEQ ID NO: 563205 - DNA, 23 bp, Homo sapiens
ttctattttaccactaattttgt

SEQ ID NO: 563206 - DNA, 21 bp, Homo sapiens
ttctcaagggacgtcctccaa

SEQ ID NO: 563207 - DNA, 22 bp, Homo sapiens
ttctcagaagtgaaaaagactt

SEQ ID NO: 563208 - DNA, 15 bp, Homo sapiens
ttctcagtttgtata

SEQ ID NO: 563209 - DNA, 14 bp, Homo sapiens
ttctcagtttttct

SEQ ID NO: 563210 - DNA, 18 bp, Homo sapiens
ttctcagtttttcttaat

SEQ ID NO: 563211 - DNA, 17 bp, Homo sapiens
ttctcatcttttatcta

SEQ ID NO: 563212 - DNA, 13 bp, Homo sapiens
ttctctcacctcc

SEQ ID NO: 563213 - DNA, 21 bp, Homo sapiens
ttgcatcagtattaatactaa

SEQ ID NO: 563214 - DNA, 13 bp, Homo sapiens
ttgccaaacatta

SEQ ID NO: 563215 - DNA, 20 bp, Homo sapiens
ttgccaaacattaatgttga

SEQ ID NO: 563216 - DNA, 15 bp, Homo sapiens
ttgcccactcctgct

SEQ ID NO: 563217 - DNA, 21 bp, Homo sapiens
ttgcccactcctgctctgctc

SEQ ID NO: 563218 - DNA, 12 bp, Homo sapiens
ttgcccagcctc

SEQ ID NO: 563219 - DNA, 17 bp, Homo sapiens
ttgcctctgcccttggg

SEQ ID NO: 563220 - DNA, 19 bp, Homo sapiens
ttgcctgaactcctgccat

SEQ ID NO: 563221 - DNA, 19 bp, Homo sapiens
ttgctaagataattaaatg

SEQ ID NO: 563222 - DNA, 22 bp, Homo sapiens
ttgctaagataattaaatgaaa

SEQ ID NO: 563223 - DNA, 17 bp, Homo sapiens
ttgctaagtaaatctct

SEQ ID NO: 563224 - DNA, 16 bp, Homo sapiens
ttgctaattaaaaagt

SEQ ID NO: 563225 - DNA, 22 bp, Homo sapiens
ttgctacttcctgcctggtctc

SEQ ID NO: 563226 - DNA, 23 bp, Homo sapiens
ttgctcagagtgaagagtgaaga

SEQ ID NO: 563227 - DNA, 20 bp, Homo sapiens
ttgctccccttccccttcct

SEQ ID NO: 563228 - DNA, 19 bp, Homo sapiens
ttgctctctcattcccagg

SEQ ID NO: 563229 - DNA, 19 bp, Homo sapiens
ttgctggaatctactagaa

SEQ ID NO: 563230 - DNA, 22 bp, Homo sapiens
ttgctggttgtaaatactttgt

SEQ ID NO: 563231 - DNA, 12 bp, Homo sapiens
ttgctgtgaaat

SEQ ID NO: 563232 - DNA, 17 bp, Homo sapiens
ttgctgtgaaatgactg

SEQ ID NO: 563233 - DNA, 19 bp, Homo sapiens
ttgctgtgacagtgatggc

SEQ ID NO: 563234 - DNA, 13 bp, Homo sapiens
ttgcttaaatgtg

SEQ ID NO: 563235 - DNA, 16 bp, Homo sapiens
ttgcttaaatgtgaat

SEQ ID NO: 563236 - DNA, 18 bp, Homo sapiens
ttgctttatttttcatta

SEQ ID NO: 563237 - DNA, 15 bp, Homo sapiens
ttgctttcttttctc

SEQ ID NO: 563238 - DNA, 15 bp, Homo sapiens
ttgcttttaaaattt

SEQ ID NO: 563239 - DNA, 18 bp, Homo sapiens
ttgcttttaaaattttaa

SEQ ID NO: 563240 - DNA, 20 bp, Homo sapiens
ttggaaaacgatttaattta

SEQ ID NO: 563241 - DNA, 22 bp, Homo sapiens
ttggaaaatgttctgacagcat

SEQ ID NO: 563242 - DNA, 17 bp, Homo sapiens
ttggaaacactaaatgt

SEQ ID NO: 563243 - DNA, 21 bp, Homo sapiens
ttggaaacactaaatgttaaa

SEQ ID NO: 563244 - DNA, 13 bp, Homo sapiens
ttggaaatttcac

SEQ ID NO: 563245 - DNA, 20 bp, Homo sapiens
ttggaacagtaatcagtttg

SEQ ID NO: 563246 - DNA, 18 bp, Homo sapiens
ttggaagcaggttaaatg

SEQ ID NO: 563247 - DNA, 16 bp, Homo sapiens
ttggactgtggcctca

SEQ ID NO: 563248 - DNA, 11 bp, Homo sapiens
ttggagcattg

SEQ ID NO: 563249 - DNA, 14 bp, Homo sapiens
ttggagttcattca

SEQ ID NO: 563250 - DNA, 17 bp, Homo sapiens
ttggattttatgttgac

SEQ ID NO: 563251 - DNA, 21 bp, Homo sapiens
ttggcaccaataaaggaggaa

SEQ ID NO: 563252 - DNA, 16 bp, Homo sapiens
ttggcagatgcagctc

SEQ ID NO: 563253 - DNA, 21 bp, Homo sapiens
ttggcaggggtggaggagagc

SEQ ID NO: 563254 - DNA, 15 bp, Homo sapiens
ttggccaagcagaaa

SEQ ID NO: 563255 - DNA, 23 bp, Homo sapiens
ttggcctgagatgcctggtgagc

SEQ ID NO: 563256 - DNA, 21 bp, Homo sapiens
tttactctatgccccaaatat

SEQ ID NO: 563257 - DNA, 16 bp, Homo sapiens
tttactgtcttaatta

SEQ ID NO: 563258 - DNA, 21 bp, Homo sapiens
tttactgtcttaattaagtaa

SEQ ID NO: 563259 - DNA, 14 bp, Homo sapiens
tttactttaaatcc

SEQ ID NO: 563260 - DNA, 19 bp, Homo sapiens
tttagaatcaagtctgtga

SEQ ID NO: 563261 - DNA, 12 bp, Homo sapiens
tttagatttcaa

SEQ ID NO: 563262 - DNA, 15 bp, Homo sapiens
tttagcacagtattt

SEQ ID NO: 563263 - DNA, 17 bp, Homo sapiens
tttagcacagtatttaa

SEQ ID NO: 563264 - DNA, 16 bp, Homo sapiens
tttagtcctcaccttc

SEQ ID NO: 563265 - DNA, 19 bp, Homo sapiens
tttagtggaccctgaaatg

SEQ ID NO: 563266 - DNA, 21 bp, Homo sapiens
tttagtggaccctgaaatgtg

SEQ ID NO: 563267 - DNA, 15 bp, Homo sapiens
tttagtgtatatgtg

SEQ ID NO: 563268 - DNA, 22 bp, Homo sapiens
tttagtgtatatgtgattttca

SEQ ID NO: 563269 - DNA, 13 bp, Homo sapiens
tttagttttattt

SEQ ID NO: 563270 - DNA, 17 bp, Homo sapiens
tttagttttattttcta

SEQ ID NO: 563271 - DNA, 14 bp, Homo sapiens
tttagttttgcttt

SEQ ID NO: 563272 - DNA, 12 bp, Homo sapiens
tttagtttttct

SEQ ID NO: 563273 - DNA, 20 bp, Homo sapiens
tttataacattgtaaatgat

SEQ ID NO: 563274 - DNA, 17 bp, Homo sapiens
tttataagcaaatttca

SEQ ID NO: 563275 - DNA, 23 bp, Homo sapiens
tttataagcaaatttcaaaagac

SEQ ID NO: 563276 - DNA, 18 bp, Homo sapiens
tttataagcacagacaat

SEQ ID NO: 563277 - DNA, 18 bp, Homo sapiens
tttatacctgtacacaca

SEQ ID NO: 563278 - DNA, 16 bp, Homo sapiens
tttataggataactga

SEQ ID NO: 563279 - DNA, 15 bp, Homo sapiens
tttatatatatatct

SEQ ID NO: 563280 - DNA, 20 bp, Homo sapiens
tttatgcgcaaatacaaaat

SEQ ID NO: 563281 - DNA, 18 bp, Homo sapiens
tttatggtaatcatatta

SEQ ID NO: 563282 - DNA, 16 bp, Homo sapiens
tttatgtatgtttaca

SEQ ID NO: 563283 - DNA, 12 bp, Homo sapiens
tttatgtattct

SEQ ID NO: 563284 - DNA, 17 bp, Homo sapiens
tttatgttgacatttgt

SEQ ID NO: 563285 - DNA, 18 bp, Homo sapiens
tttatgttgacatttgtt

SEQ ID NO: 563286 - DNA, 15 bp, Homo sapiens
tttatgtttaaaatg

SEQ ID NO: 563287 - DNA, 13 bp, Homo sapiens
tttatgttttggt

SEQ ID NO: 563288 - DNA, 15 bp, Homo sapiens
tctggcaatattctg

SEQ ID NO: 563289 - DNA, 20 bp, Homo sapiens
tctggcaggtggccagggct

SEQ ID NO: 563290 - DNA, 16 bp, Homo sapiens
tctggctaaggacagg

SEQ ID NO: 563291 - DNA, 14 bp, Homo sapiens
tctgggaatgtata

SEQ ID NO: 563292 - DNA, 14 bp, Homo sapiens
tctgggagctggag

SEQ ID NO: 563293 - DNA, 15 bp, Homo sapiens
tctggggagctcctg

SEQ ID NO: 563294 - DNA, 17 bp, Homo sapiens
tctggggagctggacag

SEQ ID NO: 563295 - DNA, 19 bp, Homo sapiens
tctgggggactagaacaca

SEQ ID NO: 563296 - DNA, 19 bp, Homo sapiens
tctggggggatatttccta

SEQ ID NO: 563297 - DNA, 22 bp, Homo sapiens
tctgggtgcaggagcgctccct

SEQ ID NO: 563298 - DNA, 23 bp, Homo sapiens
tctgtaatcacactctcttctta

SEQ ID NO: 563299 - DNA, 22 bp, Homo sapiens
tctgtactaaacatttcctttt

SEQ ID NO: 563300 - DNA, 21 bp, Homo sapiens
tctgtataaacattaaatgtc

SEQ ID NO: 563301 - DNA, 23 bp, Homo sapiens
tctgtatagacaggagaagaaag

SEQ ID NO: 563302 - DNA, 13 bp, Homo sapiens
tctgtattgctaa

SEQ ID NO: 563303 - DNA, 12 bp, Homo sapiens
tctgtcagttct

SEQ ID NO: 563304 - DNA, 18 bp, Homo sapiens
tctgtccaactgagaagt

SEQ ID NO: 563305 - DNA, 22 bp, Homo sapiens
tctgtccttccaacctgttcac

SEQ ID NO: 563306 - DNA, 15 bp, Homo sapiens
tctgtcgtccccaga

SEQ ID NO: 563307 - DNA, 17 bp, Homo sapiens
aaatactgtagataatt

SEQ ID NO: 563308 - DNA, 13 bp, Homo sapiens
aaatacttgacaa

SEQ ID NO: 563309 - DNA, 14 bp, Homo sapiens
aaatagctataaat

SEQ ID NO: 563310 - DNA, 21 bp, Homo sapiens
aaatagctataaatagtgaaa

SEQ ID NO: 563311 - DNA, 13 bp, Homo sapiens
aaatagtgaaaat

SEQ ID NO: 563312 - DNA, 13 bp, Homo sapiens
aaatagttccctt

SEQ ID NO: 563313 - DNA, 16 bp, Homo sapiens
aaatagttgtccatat

SEQ ID NO: 563314 - DNA, 20 bp, Homo sapiens
acctccccaggccgtggctg

SEQ ID NO: 563315 - DNA, 16 bp, Homo sapiens
acctcccccactccca

SEQ ID NO: 563316 - DNA, 20 bp, Homo sapiens
acctccctgtctctacaaaa

SEQ ID NO: 563317 - DNA, 14 bp, Homo sapiens
acctcctctcctga

SEQ ID NO: 563318 - DNA, 18 bp, Homo sapiens
acctcctttaccctcatc

SEQ ID NO: 563319 - DNA, 16 bp, Homo sapiens
acctctaactgtgcaa

SEQ ID NO: 563320 - DNA, 17 bp, Homo sapiens
acctctaactgtgcaaa

SEQ ID NO: 563321 - DNA, 16 bp, Homo sapiens
acctctagccctgccc

SEQ ID NO: 563322 - DNA, 18 bp, Homo sapiens
acctctagccctgcccgg

SEQ ID NO: 563323 - DNA, 13 bp, Homo sapiens
acctctgggagct

SEQ ID NO: 563324 - DNA, 21 bp, Homo sapiens
acctctgtgaggaaagcacac

SEQ ID NO: 563325 - DNA, 14 bp, Homo sapiens
acctcttagaaaat

SEQ ID NO: 563326 - DNA, 17 bp, Homo sapiens
acctcttagcttttctg

SEQ ID NO: 563327 - DNA, 16 bp, Homo sapiens
acctgaaaattcaaca

SEQ ID NO: 563328 - DNA, 22 bp, Homo sapiens
acctgaaagcccttctcaagac

SEQ ID NO: 563329 - DNA, 20 bp, Homo sapiens
acctgaggacatggcttctg

SEQ ID NO: 563330 - DNA, 13 bp, Homo sapiens
acctgcacaaaca

SEQ ID NO: 563331 - DNA, 14 bp, Homo sapiens
acctgcacaaacat

SEQ ID NO: 563332 - DNA, 17 bp, Homo sapiens
acctgcagattctagga

SEQ ID NO: 563333 - DNA, 18 bp, Homo sapiens
acctgcaggactcgggct

SEQ ID NO: 563334 - DNA, 19 bp, Homo sapiens
acctgcccccgctctgcca

SEQ ID NO: 563335 - DNA, 17 bp, Homo sapiens
acctgcccggcccagga

SEQ ID NO: 563336 - DNA, 22 bp, Homo sapiens
acctgcccggcccaggagcgca

SEQ ID NO: 563337 - DNA, 23 bp, Homo sapiens
acctgcctctgaactgctgctgg

SEQ ID NO: 563338 - DNA, 21 bp, Homo sapiens
acctgcttccccaaaggccaa

SEQ ID NO: 563339 - DNA, 18 bp, Homo sapiens
acctggaaggcccagcac

SEQ ID NO: 563340 - DNA, 19 bp, Homo sapiens
acctggaaggcccagcacc

SEQ ID NO: 563341 - DNA, 21 bp, Homo sapiens
acctggccctggggcctgtac

SEQ ID NO: 563342 - DNA, 16 bp, Homo sapiens
acctgggacagggagc

SEQ ID NO: 563343 - DNA, 22 bp, Homo sapiens
acctgggagatgctgggaccct

SEQ ID NO: 563344 - DNA, 13 bp, Homo sapiens
acctgggccctgg

SEQ ID NO: 563345 - DNA, 17 bp, Homo sapiens
acctgtacacacacaga

SEQ ID NO: 563346 - DNA, 11 bp, Homo sapiens
acctgtctgct

SEQ ID NO: 563347 - DNA, 14 bp, Homo sapiens
accttcactctaag

SEQ ID NO: 563348 - DNA, 20 bp, Homo sapiens
accttcactctaagatgtta

SEQ ID NO: 563349 - DNA, 22 bp, Homo sapiens
accttcactctaagatgttata

SEQ ID NO: 563350 - DNA, 20 bp, Homo sapiens
accttctaatccatgtgctg

SEQ ID NO: 563351 - DNA, 23 bp, Homo sapiens
accttctaatccatgtgctgctg

SEQ ID NO: 563352 - DNA, 16 bp, Homo sapiens
accttctctatatcat

SEQ ID NO: 563353 - DNA, 20 bp, Homo sapiens
accttgacgtttcttctttc

SEQ ID NO: 563354 - DNA, 16 bp, Homo sapiens
accttgcacacatcat

SEQ ID NO: 563355 - DNA, 16 bp, Homo sapiens
accttgtaatgtaact

SEQ ID NO: 563356 - DNA, 15 bp, Homo sapiens
acctttggcttaatt

SEQ ID NO: 563357 - DNA, 22 bp, Homo sapiens
acgaccgtcttttgaaaactca

SEQ ID NO: 563358 - DNA, 21 bp, Homo sapiens
acgagtagaggtttaaagaaa

SEQ ID NO: 563359 - DNA, 17 bp, Homo sapiens
acgatagcctagctttc

SEQ ID NO: 563360 - DNA, 20 bp, Homo sapiens
acgatagcctagctttctaa

SEQ ID NO: 563361 - DNA, 21 bp, Homo sapiens
acgatagcctagctttctaaa

SEQ ID NO: 563362 - DNA, 13 bp, Homo sapiens
acgatttaattta

SEQ ID NO: 563363 - DNA, 14 bp, Homo sapiens
acgcaattgtatat

SEQ ID NO: 563364 - DNA, 20 bp, Homo sapiens
acgcaattgtatatatatgt

SEQ ID NO: 563365 - DNA, 14 bp, Homo sapiens
acgcacccacaccc

SEQ ID NO: 563366 - DNA, 15 bp, Homo sapiens
acgcacccacaccct

SEQ ID NO: 563367 - DNA, 13 bp, Homo sapiens
acgcacgcacaca

SEQ ID NO: 563368 - DNA, 16 bp, Homo sapiens
acgcacgcacccacac

SEQ ID NO: 563369 - DNA, 19 bp, Homo sapiens
acgcacgtgggtcttcagg

SEQ ID NO: 563370 - DNA, 14 bp, Homo sapiens
acgcagacacacac

SEQ ID NO: 563371 - DNA, 20 bp, Homo sapiens
acgcagggagaccctgggag

SEQ ID NO: 563372 - DNA, 16 bp, Homo sapiens
acgcataggaaaagaa

SEQ ID NO: 563373 - DNA, 11 bp, Homo sapiens
acgccagggac

SEQ ID NO: 563374 - DNA, 19 bp, Homo sapiens
acggagcggattgcaaagc

SEQ ID NO: 563375 - DNA, 18 bp, Homo sapiens
acggccccagcttctcag

SEQ ID NO: 563376 - DNA, 14 bp, Homo sapiens
acggggacacggcc

SEQ ID NO: 563377 - DNA, 15 bp, Homo sapiens
acggggccagcatcc

SEQ ID NO: 563378 - DNA, 22 bp, Homo sapiens
acgtattttgatcagtgttaca

SEQ ID NO: 563379 - DNA, 22 bp, Homo sapiens
acgtccctccacgttcacccct

SEQ ID NO: 563380 - DNA, 15 bp, Homo sapiens
acgtctttttaagcc

SEQ ID NO: 563381 - DNA, 19 bp, Homo sapiens
acgtggggcagcacagaga

SEQ ID NO: 563382 - DNA, 20 bp, Homo sapiens
acgtggggcagcacagagag

SEQ ID NO: 563383 - DNA, 22 bp, Homo sapiens
acgtgtatatgaggatgtatgt

SEQ ID NO: 563384 - DNA, 11 bp, Homo sapiens
acgtgtatgtt

SEQ ID NO: 563385 - DNA, 16 bp, Homo sapiens
acgtgtatgtttttca

SEQ ID NO: 563386 - DNA, 23 bp, Homo sapiens
acgtgtatgtttttcagttcaaa

SEQ ID NO: 563387 - DNA, 13 bp, Homo sapiens
acgttcacccctc

SEQ ID NO: 563388 - DNA, 14 bp, Homo sapiens
acgttttctgcaat

SEQ ID NO: 563389 - DNA, 17 bp, Homo sapiens
actaagaatcatcctca

SEQ ID NO: 563390 - DNA, 20 bp, Homo sapiens
actaagatcggttaacaaat

SEQ ID NO: 563391 - DNA, 22 bp, Homo sapiens
actaagatcggttaacaaataa

SEQ ID NO: 563392 - DNA, 18 bp, Homo sapiens
actaagtctcttttttac

SEQ ID NO: 563393 - DNA, 19 bp, Homo sapiens
actaagtctcttttttaca

SEQ ID NO: 563394 - DNA, 20 bp, Homo sapiens
actaagtctcttttttacaa

SEQ ID NO: 563395 - DNA, 22 bp, Homo sapiens
actaagtctcttttttacaaag

SEQ ID NO: 563396 - DNA, 21 bp, Homo sapiens
actaatgacaagtgacttatt

SEQ ID NO: 563397 - DNA, 20 bp, Homo sapiens
actaattttgttttaaactg

SEQ ID NO: 563398 - DNA, 23 bp, Homo sapiens
actaattttgttttaaactgtga

SEQ ID NO: 563399 - DNA, 21 bp, Homo sapiens
agccgagctctcctgggccag

SEQ ID NO: 563400 - DNA, 22 bp, Homo sapiens
agccgagctctcctgggccagg

SEQ ID NO: 563401 - DNA, 21 bp, Homo sapiens
agccggcgtggcaaatataaa

SEQ ID NO: 563402 - DNA, 17 bp, Homo sapiens
agccgtaaaaactgaag

SEQ ID NO: 563403 - DNA, 20 bp, Homo sapiens
agccgtaaaaactgaagttc

SEQ ID NO: 563404 - DNA, 19 bp, Homo sapiens
agcctactagggacctggg

SEQ ID NO: 563405 - DNA, 21 bp, Homo sapiens
agcctactagggacctgggga

SEQ ID NO: 563406 - DNA, 20 bp, Homo sapiens
agcctatgatattccccatt

SEQ ID NO: 563407 - DNA, 20 bp, Homo sapiens
agcctcacccggtgacctct

SEQ ID NO: 563408 - DNA, 13 bp, Homo sapiens
agcctcactgata

SEQ ID NO: 563409 - DNA, 19 bp, Homo sapiens
agcctcagcaaacccaaag

SEQ ID NO: 563410 - DNA, 21 bp, Homo sapiens
agcctcagcaaacccaaagat

SEQ ID NO: 563411 - DNA, 19 bp, Homo sapiens
agcctcatgggagtcaggg

SEQ ID NO: 563412 - DNA, 23 bp, Homo sapiens
agcctcgcaggcctccctgccag

SEQ ID NO: 563413 - DNA, 20 bp, Homo sapiens
agcctcttctgccaagagag

SEQ ID NO: 563414 - DNA, 20 bp, Homo sapiens
agcctctttcccttccagtt

SEQ ID NO: 563415 - DNA, 17 bp, Homo sapiens
agcctgatgatggaagg

SEQ ID NO: 563416 - DNA, 15 bp, Homo sapiens
agcctgccttgccca

SEQ ID NO: 563417 - DNA, 11 bp, Homo sapiens
agcctgctcct

SEQ ID NO: 563418 - DNA, 14 bp, Homo sapiens
agcctgctccttcc

SEQ ID NO: 563419 - DNA, 16 bp, Homo sapiens
agcctgctccttccct

SEQ ID NO: 563420 - DNA, 17 bp, Homo sapiens
agcctgctccttccctt

SEQ ID NO: 563421 - DNA, 11 bp, Homo sapiens
agcctgtgtca

SEQ ID NO: 563422 - DNA, 19 bp, Homo sapiens
agccttctgagctggcctc

SEQ ID NO: 563423 - DNA, 16 bp, Homo sapiens
agcctttgaagtgcct

SEQ ID NO: 563424 - DNA, 15 bp, Homo sapiens
agcgagtctggagac

SEQ ID NO: 563425 - DNA, 17 bp, Homo sapiens
agcgagtctggagacca

SEQ ID NO: 563426 - DNA, 18 bp, Homo sapiens
agcgagtctggagaccag

SEQ ID NO: 563427 - DNA, 21 bp, Homo sapiens
agcgagtctggagaccaggac

SEQ ID NO: 563428 - DNA, 22 bp, Homo sapiens
agcgctgacgtgtcaggaaaac

SEQ ID NO: 563429 - DNA, 17 bp, Homo sapiens
agcgtagtgcagcaggg

SEQ ID NO: 563430 - DNA, 17 bp, Homo sapiens
agctaagcctgatgatg

SEQ ID NO: 563431 - DNA, 17 bp, Homo sapiens
agctacaggggaggctg

SEQ ID NO: 563432 - DNA, 18 bp, Homo sapiens
agctacaggggaggctga

SEQ ID NO: 563433 - DNA, 16 bp, Homo sapiens
agctacccaaaagaga

SEQ ID NO: 563434 - DNA, 18 bp, Homo sapiens
agctacttaagagaaatg

SEQ ID NO: 563435 - DNA, 12 bp, Homo sapiens
agctaggcaggg

SEQ ID NO: 563436 - DNA, 13 bp, Homo sapiens
agctaggcagggt

SEQ ID NO: 563437 - DNA, 21 bp, Homo sapiens
agctataaaagcccatgctta

SEQ ID NO: 563438 - DNA, 12 bp, Homo sapiens
agctataaatag

SEQ ID NO: 563439 - DNA, 22 bp, Homo sapiens
agctatatttaagtattcaaga

SEQ ID NO: 563440 - DNA, 22 bp, Homo sapiens
agctatcaatcaccttgcattt

SEQ ID NO: 563441 - DNA, 23 bp, Homo sapiens
agctatttaagtggactgtattt

SEQ ID NO: 563442 - DNA, 15 bp, Homo sapiens
agctcaaggctgcag

SEQ ID NO: 563443 - DNA, 16 bp, Homo sapiens
agctcaattgttaatg

SEQ ID NO: 563444 - DNA, 14 bp, Homo sapiens
agctcccccagctc

SEQ ID NO: 563445 - DNA, 21 bp, Homo sapiens
agctcctccttgtcttggcag

SEQ ID NO: 563446 - DNA, 14 bp, Homo sapiens
agctccttttccag

SEQ ID NO: 563447 - DNA, 19 bp, Homo sapiens
agctccttttccagagcat

SEQ ID NO: 563448 - DNA, 14 bp, Homo sapiens
agctcgtgtgctta

SEQ ID NO: 563449 - DNA, 13 bp, Homo sapiens
agctctcccctgc

SEQ ID NO: 563450 - DNA, 21 bp, Homo sapiens
agctctcccctgcgcaggccc

SEQ ID NO: 563451 - DNA, 22 bp, Homo sapiens
agctctcccctgcgcaggccct

SEQ ID NO: 563452 - DNA, 16 bp, Homo sapiens
agctctcctgggccag

SEQ ID NO: 563453 - DNA, 21 bp, Homo sapiens
agctctcctgggccagggtct

SEQ ID NO: 563454 - DNA, 17 bp, Homo sapiens
agctctctgtataaaca

SEQ ID NO: 563455 - DNA, 18 bp, Homo sapiens
agctctgaatgctatttg

SEQ ID NO: 563456 - DNA, 19 bp, Homo sapiens
agctctgaatgctatttgt

SEQ ID NO: 563457 - DNA, 23 bp, Homo sapiens
agctgaagagtgaggatatgagt

SEQ ID NO: 563458 - DNA, 12 bp, Homo sapiens
agctgaagccag

SEQ ID NO: 563459 - DNA, 16 bp, Homo sapiens
agctgaagccagctcc

SEQ ID NO: 563460 - DNA, 13 bp, Homo sapiens
agctgagctggcc

SEQ ID NO: 563461 - DNA, 12 bp, Homo sapiens
agctgctgccat

SEQ ID NO: 563462 - DNA, 13 bp, Homo sapiens
agctgctgctctg

SEQ ID NO: 563463 - DNA, 19 bp, Homo sapiens
agctggacacccccttggt

SEQ ID NO: 563464 - DNA, 15 bp, Homo sapiens
agctggctccagcct

SEQ ID NO: 563465 - DNA, 17 bp, Homo sapiens
agctggctccagcctgg

SEQ ID NO: 563466 - DNA, 18 bp, Homo sapiens
agctggctccagcctgga

SEQ ID NO: 563467 - DNA, 15 bp, Homo sapiens
agctgggaccagtac

SEQ ID NO: 563468 - DNA, 16 bp, Homo sapiens
agctgtaacagttctt

SEQ ID NO: 563469 - DNA, 17 bp, Homo sapiens
agctgtaacagttcttt

SEQ ID NO: 563470 - DNA, 13 bp, Homo sapiens
agctgttcttcct

SEQ ID NO: 563471 - DNA, 15 bp, Homo sapiens
agctgttcttcctgg

SEQ ID NO: 563472 - DNA, 14 bp, Homo sapiens
agctgttgaccagg

SEQ ID NO: 563473 - DNA, 16 bp, Homo sapiens
agctgttgaccaggca

SEQ ID NO: 563474 - DNA, 17 bp, Homo sapiens
agctgttgtctcttctc

SEQ ID NO: 563475 - DNA, 19 bp, Homo sapiens
agctgtttcatttgtgtca

SEQ ID NO: 563476 - DNA, 20 bp, Homo sapiens
agctgtttggttttaaaata

SEQ ID NO: 563477 - DNA, 16 bp, Homo sapiens
agcttatctttctttc

SEQ ID NO: 563478 - DNA, 23 bp, Homo sapiens
agcttcacttctgactcttcccc

SEQ ID NO: 563479 - DNA, 23 bp, Homo sapiens
agcttcttaatataactgcctta

SEQ ID NO: 563480 - DNA, 20 bp, Homo sapiens
agctttacacacacagatgt

SEQ ID NO: 563481 - DNA, 20 bp, Homo sapiens
agctttctcaatgtcttccc

SEQ ID NO: 563482 - DNA, 16 bp, Homo sapiens
agctttctgatactta

SEQ ID NO: 563483 - DNA, 20 bp, Homo sapiens
agcttttcaaacaagaatgt

SEQ ID NO: 563484 - DNA, 14 bp, Homo sapiens
agcttttcattgct

SEQ ID NO: 563485 - DNA, 22 bp, Homo sapiens
agctttttttttttaattttgt

SEQ ID NO: 563486 - DNA, 13 bp, Homo sapiens
aggaaaaatatgt

SEQ ID NO: 563487 - DNA, 16 bp, Homo sapiens
aggaaaaatatgtgaa

SEQ ID NO: 563488 - DNA, 12 bp, Homo sapiens
aggaaaagaaat

SEQ ID NO: 563489 - DNA, 16 bp, Homo sapiens
aggaaagcctcactga

SEQ ID NO: 563490 - DNA, 13 bp, Homo sapiens
aggaaatatctgt

SEQ ID NO: 563491 - DNA, 22 bp, Homo sapiens
aggaaatatctgtgaaggactt

SEQ ID NO: 563492 - DNA, 16 bp, Homo sapiens
aggaaatctgaatgta

SEQ ID NO: 563493 - DNA, 14 bp, Homo sapiens
aggaacaaatcttc

SEQ ID NO: 563494 - DNA, 13 bp, Homo sapiens
aggaacaagaccc

SEQ ID NO: 563495 - DNA, 13 bp, Homo sapiens
aggaacacatgca

SEQ ID NO: 563496 - DNA, 19 bp, Homo sapiens
aggaacacatgcacacaca

SEQ ID NO: 563497 - DNA, 20 bp, Homo sapiens
aggaacacatgcacacacac

SEQ ID NO: 563498 - DNA, 13 bp, Homo sapiens
aggaacacccagc

SEQ ID NO: 563499 - DNA, 17 bp, Homo sapiens
aggaagacctcaagaaa

SEQ ID NO: 563500 - DNA, 18 bp, Homo sapiens
aggaaggtcatttccatg

SEQ ID NO: 563501 - DNA, 13 bp, Homo sapiens
aggaattttgcta

SEQ ID NO: 563502 - DNA, 19 bp, Homo sapiens
aggacaaggtgcaggcagg

SEQ ID NO: 563503 - DNA, 19 bp, Homo sapiens
aggacacctgtactggaga

SEQ ID NO: 563504 - DNA, 14 bp, Homo sapiens
agaagcagcagcta

SEQ ID NO: 563505 - DNA, 23 bp, Homo sapiens
agaagcagcagctagaaagagaa

SEQ ID NO: 563506 - DNA, 18 bp, Homo sapiens
agaagggagctggctcca

SEQ ID NO: 563507 - DNA, 23 bp, Homo sapiens
agaagtatccctgatttattctg

SEQ ID NO: 563508 - DNA, 13 bp, Homo sapiens
agaagtcttcatg

SEQ ID NO: 563509 - DNA, 16 bp, Homo sapiens
agaagtcttcatgaaa

SEQ ID NO: 563510 - DNA, 19 bp, Homo sapiens
agaataaaattcctatctc

SEQ ID NO: 563511 - DNA, 18 bp, Homo sapiens
agaataatgaagatcttt

SEQ ID NO: 563512 - DNA, 15 bp, Homo sapiens
agaataggacttgtt

SEQ ID NO: 563513 - DNA, 21 bp, Homo sapiens
agaataggacttgtttttgtt

SEQ ID NO: 563514 - DNA, 20 bp, Homo sapiens
agaatagttaaattggcttg

SEQ ID NO: 563515 - DNA, 22 bp, Homo sapiens
agaatcacctaattaatttcag

SEQ ID NO: 563516 - DNA, 21 bp, Homo sapiens
agaatcatgtgcgtcagtcca

SEQ ID NO: 563517 - DNA, 14 bp, Homo sapiens
agaatgaccttgta

SEQ ID NO: 563518 - DNA, 16 bp, Homo sapiens
agaatgaccttgtaat

SEQ ID NO: 563519 - DNA, 17 bp, Homo sapiens
agaatgaccttgtaatg

SEQ ID NO: 563520 - DNA, 23 bp, Homo sapiens
agaatgaccttgtaatgtaactg

SEQ ID NO: 563521 - DNA, 21 bp, Homo sapiens
agaatgagggcgtgaaacaca

SEQ ID NO: 563522 - DNA, 22 bp, Homo sapiens
agaatgagggcgtgaaacacaa

SEQ ID NO: 563523 - DNA, 23 bp, Homo sapiens
agaatgagggcgtgaaacacaat

SEQ ID NO: 563524 - DNA, 16 bp, Homo sapiens
agaatggctttcaata

SEQ ID NO: 563525 - DNA, 14 bp, Homo sapiens
agaatgttttcctt

SEQ ID NO: 563526 - DNA, 21 bp, Homo sapiens
agaattgatttcccttcttct

SEQ ID NO: 563527 - DNA, 12 bp, Homo sapiens
agaattggaaaa

SEQ ID NO: 563528 - DNA, 13 bp, Homo sapiens
agacaaatacaca

SEQ ID NO: 563529 - DNA, 14 bp, Homo sapiens
agacaaatacacat

SEQ ID NO: 563530 - DNA, 12 bp, Homo sapiens
agacaaatagta

SEQ ID NO: 563531 - DNA, 16 bp, Homo sapiens
agacaacagcccaggc

SEQ ID NO: 563532 - DNA, 21 bp, Homo sapiens
agacaagtctagtggaaccaa

SEQ ID NO: 563533 - DNA, 16 bp, Homo sapiens
agacaattctaatggt

SEQ ID NO: 563534 - DNA, 20 bp, Homo sapiens
agacacaaacaaacaagcta

SEQ ID NO: 563535 - DNA, 14 bp, Homo sapiens
agacacacacacgc

SEQ ID NO: 563536 - DNA, 15 bp, Homo sapiens
agacacacacacgca

SEQ ID NO: 563537 - DNA, 16 bp, Homo sapiens
agacacacacacgcac

SEQ ID NO: 563538 - DNA, 20 bp, Homo sapiens
agacacacacacgcacgcac

SEQ ID NO: 563539 - DNA, 21 bp, Homo sapiens
agacacacacacgcacgcaca

SEQ ID NO: 563540 - DNA, 14 bp, Homo sapiens
agacacacacatat

SEQ ID NO: 563541 - DNA, 19 bp, Homo sapiens
agacacacacatatataca

SEQ ID NO: 563542 - DNA, 20 bp, Homo sapiens
agacacacacatatatacat

SEQ ID NO: 563543 - DNA, 21 bp, Homo sapiens
agacacacacatatatacata

SEQ ID NO: 563544 - DNA, 17 bp, Homo sapiens
agacactggtctcagag

SEQ ID NO: 563545 - DNA, 18 bp, Homo sapiens
agacactggtctcagagg

SEQ ID NO: 563546 - DNA, 19 bp, Homo sapiens
agacactggtctcagagga

SEQ ID NO: 563547 - DNA, 13 bp, Homo sapiens
agacacttccgtc

SEQ ID NO: 563548 - DNA, 18 bp, Homo sapiens
agacagacgcctgctttt

SEQ ID NO: 563549 - DNA, 16 bp, Homo sapiens
agacagatgtggacat

SEQ ID NO: 563550 - DNA, 18 bp, Homo sapiens
agacagatgtggacatgc

SEQ ID NO: 563551 - DNA, 19 bp, Homo sapiens
agacagatgtggacatgca

SEQ ID NO: 563552 - DNA, 20 bp, Homo sapiens
agacagatgtggacatgcac

SEQ ID NO: 563553 - DNA, 20 bp, Homo sapiens
agacagtcaaggagtggctt

SEQ ID NO: 563554 - DNA, 15 bp, Homo sapiens
agacataaattgtaa

SEQ ID NO: 563555 - DNA, 17 bp, Homo sapiens
agacataaattgtaatt

SEQ ID NO: 563556 - DNA, 18 bp, Homo sapiens
agaccaaggaacaagacc

SEQ ID NO: 563557 - DNA, 16 bp, Homo sapiens
agaccaggactctgcc

SEQ ID NO: 563558 - DNA, 18 bp, Homo sapiens
agaccaggactctgcctt

SEQ ID NO: 563559 - DNA, 15 bp, Homo sapiens
agaccagtagtgacc

SEQ ID NO: 563560 - DNA, 17 bp, Homo sapiens
agaccagtagtgaccaa

SEQ ID NO: 563561 - DNA, 12 bp, Homo sapiens
agacccccagga

SEQ ID NO: 563562 - DNA, 18 bp, Homo sapiens
agaccctatctcccacaa

SEQ ID NO: 563563 - DNA, 19 bp, Homo sapiens
agaccgagtgtggagctgc

SEQ ID NO: 563564 - DNA, 16 bp, Homo sapiens
agacctaaccagggcc

SEQ ID NO: 563565 - DNA, 18 bp, Homo sapiens
agacctcctgatgtcttg

SEQ ID NO: 563566 - DNA, 22 bp, Homo sapiens
agactaagatcggttaacaaat

SEQ ID NO: 563567 - DNA, 13 bp, Homo sapiens
agactatatacat

SEQ ID NO: 563568 - DNA, 15 bp, Homo sapiens
agactatatacatgt

SEQ ID NO: 563569 - DNA, 17 bp, Homo sapiens
agactatatacatgtgt

SEQ ID NO: 563570 - DNA, 20 bp, Homo sapiens
agactatatacatgtgtgta

SEQ ID NO: 563571 - DNA, 13 bp, Homo sapiens
agactcaggccca

SEQ ID NO: 563572 - DNA, 22 bp, Homo sapiens
agactccagaaatgtccctttc

SEQ ID NO: 563573 - DNA, 15 bp, Homo sapiens
agactggtgttaatg

SEQ ID NO: 563574 - DNA, 18 bp, Homo sapiens
agactggtgttaatgagt

SEQ ID NO: 563575 - DNA, 19 bp, Homo sapiens
agactggtgttaatgagta

SEQ ID NO: 563576 - DNA, 20 bp, Homo sapiens
agactgtaaattccaaagat

SEQ ID NO: 563577 - DNA, 14 bp, Homo sapiens
agacttcatttaac

SEQ ID NO: 563578 - DNA, 17 bp, Homo sapiens
agacttcatttttccta

SEQ ID NO: 563579 - DNA, 13 bp, Homo sapiens
agacttctgtttt

SEQ ID NO: 563580 - DNA, 17 bp, Homo sapiens
agacttctgttttcaat

SEQ ID NO: 563581 - DNA, 17 bp, Homo sapiens
agagaaaaagccctctt

SEQ ID NO: 563582 - DNA, 11 bp, Homo sapiens
agagaaatctc

SEQ ID NO: 563583 - DNA, 15 bp, Homo sapiens
agagaaccgagcaaa

SEQ ID NO: 563584 - DNA, 20 bp, Homo sapiens
agagaaccgagcaaagatca

SEQ ID NO: 563585 - DNA, 14 bp, Homo sapiens
agagacccccgtgc

SEQ ID NO: 563586 - DNA, 15 bp, Homo sapiens
agagagcagagaagt

SEQ ID NO: 563587 - DNA, 19 bp, Homo sapiens
agagagctgagtgagctga

SEQ ID NO: 563588 - DNA, 19 bp, Homo sapiens
agagaggctaaaatgtttt

SEQ ID NO: 563589 - DNA, 14 bp, Homo sapiens
agagagggggccac

SEQ ID NO: 563590 - DNA, 22 bp, Homo sapiens
agagataggaaggtcatttcca

SEQ ID NO: 563591 - DNA, 23 bp, Homo sapiens
agagatctccaactctctctgtg

SEQ ID NO: 563592 - DNA, 14 bp, Homo sapiens
agagatttatcttt

SEQ ID NO: 563593 - DNA, 16 bp, Homo sapiens
agagattttatgttta

SEQ ID NO: 563594 - DNA, 21 bp, Homo sapiens
agagcacagccaatctccagg

SEQ ID NO: 563595 - DNA, 16 bp, Homo sapiens
agagcagcctcttgaa

SEQ ID NO: 563596 - DNA, 23 bp, Homo sapiens
agagcattataatcaccagggcc

SEQ ID NO: 563597 - DNA, 16 bp, Homo sapiens
agagcattccagtcag

SEQ ID NO: 563598 - DNA, 17 bp, Homo sapiens
agagcattccagtcagg

SEQ ID NO: 563599 - DNA, 18 bp, Homo sapiens
atggcatttagcacagta

SEQ ID NO: 563600 - DNA, 17 bp, Homo sapiens
atggccctgtagctctg

SEQ ID NO: 563601 - DNA, 15 bp, Homo sapiens
atggcgtgtcccctg

SEQ ID NO: 563602 - DNA, 23 bp, Homo sapiens
atgggaacagtaaagaaagcaga

SEQ ID NO: 563603 - DNA, 16 bp, Homo sapiens
atgggagtcagggagc

SEQ ID NO: 563604 - DNA, 19 bp, Homo sapiens
atgggcacaggctgcccca

SEQ ID NO: 563605 - DNA, 21 bp, Homo sapiens
atgggcacaggctgccccacc

SEQ ID NO: 563606 - DNA, 13 bp, Homo sapiens
atggggacgcaga

SEQ ID NO: 563607 - DNA, 14 bp, Homo sapiens
atggggttgggctc

SEQ ID NO: 563608 - DNA, 18 bp, Homo sapiens
atggggttgggctctgcg

SEQ ID NO: 563609 - DNA, 22 bp, Homo sapiens
atggtaatttagtgtatatgtg

SEQ ID NO: 563610 - DNA, 16 bp, Homo sapiens
atggtagactgtgaca

SEQ ID NO: 563611 - DNA, 16 bp, Homo sapiens
atggtcagacacaaac

SEQ ID NO: 563612 - DNA, 14 bp, Homo sapiens
atggtctaaaaata

SEQ ID NO: 563613 - DNA, 16 bp, Homo sapiens
atggtgaactgtcatt

SEQ ID NO: 563614 - DNA, 15 bp, Homo sapiens
atggtgcaatttgtc

SEQ ID NO: 563615 - DNA, 16 bp, Homo sapiens
atggtgcaatttgtct

SEQ ID NO: 563616 - DNA, 12 bp, Homo sapiens
atgtaaacttta

SEQ ID NO: 563617 - DNA, 15 bp, Homo sapiens
atgtaactgctcttg

SEQ ID NO: 563618 - DNA, 20 bp, Homo sapiens
atgtaactgctcttgggcaa

SEQ ID NO: 563619 - DNA, 13 bp, Homo sapiens
atgtaacttgttg

SEQ ID NO: 563620 - DNA, 20 bp, Homo sapiens
atgtaacttgttgcagactg

SEQ ID NO: 563621 - DNA, 13 bp, Homo sapiens
atgtacagctctc

SEQ ID NO: 563622 - DNA, 16 bp, Homo sapiens
atgtagactatataca

SEQ ID NO: 563623 - DNA, 21 bp, Homo sapiens
atgtagactatatacatgtgt

SEQ ID NO: 563624 - DNA, 22 bp, Homo sapiens
atgtagattaaggtgatgtgat

SEQ ID NO: 563625 - DNA, 14 bp, Homo sapiens
atgtagttcatact

SEQ ID NO: 563626 - DNA, 17 bp, Homo sapiens
atgtatacgcacgcacc

SEQ ID NO: 563627 - DNA, 20 bp, Homo sapiens
atgtatagtatttgaaaaca

SEQ ID NO: 563628 - DNA, 12 bp, Homo sapiens
atgtatatacac

SEQ ID NO: 563629 - DNA, 16 bp, Homo sapiens
atgtatatacacatat

SEQ ID NO: 563630 - DNA, 17 bp, Homo sapiens
atgtatatacacatata

SEQ ID NO: 563631 - DNA, 14 bp, Homo sapiens
atgtatatttacca

SEQ ID NO: 563632 - DNA, 12 bp, Homo sapiens
atgtatgtgtat

SEQ ID NO: 563633 - DNA, 13 bp, Homo sapiens
atgtatgtgtata

SEQ ID NO: 563634 - DNA, 14 bp, Homo sapiens
atgtatgtgtatat

SEQ ID NO: 563635 - DNA, 23 bp, Homo sapiens
atgtattatcctgtgtgtgtcta

SEQ ID NO: 563636 - DNA, 13 bp, Homo sapiens
atgtatttcttta

SEQ ID NO: 563637 - DNA, 15 bp, Homo sapiens
atgtattttatgtat

SEQ ID NO: 563638 - DNA, 18 bp, Homo sapiens
atgtattttcagctcaat

SEQ ID NO: 563639 - DNA, 12 bp, Homo sapiens
atgtattttgtg

SEQ ID NO: 563640 - DNA, 16 bp, Homo sapiens
atgtattttgtgagtt

SEQ ID NO: 563641 - DNA, 19 bp, Homo sapiens
atgtattttgtgagtttgt

SEQ ID NO: 563642 - DNA, 20 bp, Homo sapiens
atgtattttgtgagtttgtt

SEQ ID NO: 563643 - DNA, 23 bp, Homo sapiens
atgtattttgtgagtttgtttct

SEQ ID NO: 563644 - DNA, 17 bp, Homo sapiens
atgtcactgttataaat

SEQ ID NO: 563645 - DNA, 18 bp, Homo sapiens
atgtcactgttataaatt

SEQ ID NO: 563646 - DNA, 21 bp, Homo sapiens
atgtcatattttcctttatgt

SEQ ID NO: 563647 - DNA, 17 bp, Homo sapiens
atgtcattaatgtgttg

SEQ ID NO: 563648 - DNA, 13 bp, Homo sapiens
atgtcctatgtgt

SEQ ID NO: 563649 - DNA, 15 bp, Homo sapiens
atgtcctatgtgtga

SEQ ID NO: 563650 - DNA, 20 bp, Homo sapiens
atgtcctgtgtcagtttatg

SEQ ID NO: 563651 - DNA, 13 bp, Homo sapiens
atgtcgcacaatg

SEQ ID NO: 563652 - DNA, 18 bp, Homo sapiens
atgtcgtcgagctccccc

SEQ ID NO: 563653 - DNA, 13 bp, Homo sapiens
atgtctcatgttt

SEQ ID NO: 563654 - DNA, 15 bp, Homo sapiens
atgtctcgctagtga

SEQ ID NO: 563655 - DNA, 19 bp, Homo sapiens
atgtcttcatgttgatgtg

SEQ ID NO: 563656 - DNA, 16 bp, Homo sapiens
atgtcttggtttccat

SEQ ID NO: 563657 - DNA, 13 bp, Homo sapiens
atgtctttaaaat

SEQ ID NO: 563658 - DNA, 19 bp, Homo sapiens
atgtgaactttctcagcat

SEQ ID NO: 563659 - DNA, 17 bp, Homo sapiens
atgtgaattactaactt

SEQ ID NO: 563660 - DNA, 18 bp, Homo sapiens
atgtgaattactaacttc

SEQ ID NO: 563661 - DNA, 21 bp, Homo sapiens
atgtgaattactaacttctaa

SEQ ID NO: 563662 - DNA, 14 bp, Homo sapiens
atgtgacatttgtc

SEQ ID NO: 563663 - DNA, 16 bp, Homo sapiens
atgtgagctgctgcca

SEQ ID NO: 563664 - DNA, 19 bp, Homo sapiens
atgtgagctgctgccatga

SEQ ID NO: 563665 - DNA, 23 bp, Homo sapiens
atgtgatggatggcacaatgaat

SEQ ID NO: 563666 - DNA, 14 bp, Homo sapiens
atgtgcccccagac

SEQ ID NO: 563667 - DNA, 15 bp, Homo sapiens
atgtgcgaacacagt

SEQ ID NO: 563668 - DNA, 19 bp, Homo sapiens
atgtgcgaacacagtgaca

SEQ ID NO: 563669 - DNA, 16 bp, Homo sapiens
atgtggacatgcaccc

SEQ ID NO: 563670 - DNA, 18 bp, Homo sapiens
atgtggcctaatattgaa

SEQ ID NO: 563671 - DNA, 19 bp, Homo sapiens
atgtggtcgttagagacag

SEQ ID NO: 563672 - DNA, 14 bp, Homo sapiens
atgtgtaaaattgg

SEQ ID NO: 563673 - DNA, 23 bp, Homo sapiens
atgtgtaaaattggattattact

SEQ ID NO: 563674 - DNA, 12 bp, Homo sapiens
atgtgtatggaa

SEQ ID NO: 563675 - DNA, 22 bp, Homo sapiens
atgtgtatggaagacaaataca

SEQ ID NO: 563676 - DNA, 16 bp, Homo sapiens
atgtgtgcatgtgtgt

SEQ ID NO: 563677 - DNA, 13 bp, Homo sapiens
atgtgtgtataag

SEQ ID NO: 563678 - DNA, 12 bp, Homo sapiens
atgtgtgtatat

SEQ ID NO: 563679 - DNA, 15 bp, Homo sapiens
atgtgtgtatatatg

SEQ ID NO: 563680 - DNA, 14 bp, Homo sapiens
atgtgtgtatgtgt

SEQ ID NO: 563681 - DNA, 13 bp, Homo sapiens
atgtgtgtgatgt

SEQ ID NO: 563682 - DNA, 14 bp, Homo sapiens
atgtgttctttgta

SEQ ID NO: 563683 - DNA, 13 bp, Homo sapiens
atgtgttgccact

SEQ ID NO: 563684 - DNA, 19 bp, Homo sapiens
atgttaattgatagaataa

SEQ ID NO: 563685 - DNA, 11 bp, Homo sapiens
atgttatgaaa

SEQ ID NO: 563686 - DNA, 16 bp, Homo sapiens
atgttattcaataact

SEQ ID NO: 563687 - DNA, 14 bp, Homo sapiens
atgttcatggaatt

SEQ ID NO: 563688 - DNA, 15 bp, Homo sapiens
atgttcatggaattg

SEQ ID NO: 563689 - DNA, 14 bp, Homo sapiens
atgttctgaaatgg

SEQ ID NO: 563690 - DNA, 19 bp, Homo sapiens
atgttcttgcagtcatcag

SEQ ID NO: 563691 - DNA, 16 bp, Homo sapiens
atgttgacatttgttt

SEQ ID NO: 563692 - DNA, 15 bp, Homo sapiens
atgttgatttctagt

SEQ ID NO: 563693 - DNA, 20 bp, Homo sapiens
atgttggcagatgcagctct

SEQ ID NO: 563694 - DNA, 13 bp, Homo sapiens
atgtttaaaatgg

SEQ ID NO: 563695 - DNA, 15 bp, Homo sapiens
atgtttaaaatggca

SEQ ID NO: 563696 - DNA, 20 bp, Homo sapiens
atgtttaagcagaattggaa

SEQ ID NO: 563697 - DNA, 14 bp, Homo sapiens
atgtttatacacac

SEQ ID NO: 563698 - DNA, 16 bp, Homo sapiens
atgtttatacacacag

SEQ ID NO: 563699 - DNA, 17 bp, Homo sapiens
atgtttatacacacagg

SEQ ID NO: 563700 - DNA, 20 bp, Homo sapiens
atgttttagtttaaaaatca

SEQ ID NO: 563701 - DNA, 12 bp, Homo sapiens
atgttttcaaat

SEQ ID NO: 563702 - DNA, 15 bp, Homo sapiens
atgttttgtaaactt

SEQ ID NO: 563703 - DNA, 13 bp, Homo sapiens
atgtttttaaaat

SEQ ID NO: 563704 - DNA, 17 bp, Homo sapiens
atgtttttaaaatctta

SEQ ID NO: 563705 - DNA, 16 bp, Homo sapiens
atgtttttatgatatc

SEQ ID NO: 563706 - DNA, 13 bp, Homo sapiens
atgtttttcagtt

SEQ ID NO: 563707 - DNA, 19 bp, Homo sapiens
atgtttttcagttcaaagt

SEQ ID NO: 563708 - DNA, 13 bp, Homo sapiens
attaaaaacattt

SEQ ID NO: 563709 - DNA, 14 bp, Homo sapiens
attaaaaagtcttt

SEQ ID NO: 563710 - DNA, 15 bp, Homo sapiens
attaaaaagttaatc

SEQ ID NO: 563711 - DNA, 17 bp, Homo sapiens
attaaaaagttaatctt

SEQ ID NO: 563712 - DNA, 15 bp, Homo sapiens
attaaaatttaacat

SEQ ID NO: 563713 - DNA, 17 bp, Homo sapiens
attaaaatttaacatct

SEQ ID NO: 563714 - DNA, 16 bp, Homo sapiens
attaaagaaagtcata

SEQ ID NO: 563715 - DNA, 20 bp, Homo sapiens
attaaagagccattctggca

SEQ ID NO: 563716 - DNA, 13 bp, Homo sapiens
attaaagtttcaa

SEQ ID NO: 563717 - DNA, 20 bp, Homo sapiens
attaaagtttcaaaaatctg

SEQ ID NO: 563718 - DNA, 15 bp, Homo sapiens
attaaattatcattg

SEQ ID NO: 563719 - DNA, 17 bp, Homo sapiens
attaaggtgatgtgatt

SEQ ID NO: 563720 - DNA, 18 bp, Homo sapiens
attaagtaaactaatgag

SEQ ID NO: 563721 - DNA, 13 bp, Homo sapiens
attaatgtgtaaa

SEQ ID NO: 563722 - DNA, 12 bp, Homo sapiens
attaatgtgttg

SEQ ID NO: 563723 - DNA, 15 bp, Homo sapiens
attacaatggaaaca

SEQ ID NO: 563724 - DNA, 23 bp, Homo sapiens
attacagagggtaggaatgggta

SEQ ID NO: 563725 - DNA, 22 bp, Homo sapiens
attacctgaaagcccttctcaa

SEQ ID NO: 563726 - DNA, 15 bp, Homo sapiens
attacctgtagcttt

SEQ ID NO: 563727 - DNA, 14 bp, Homo sapiens
attactaacttcta

SEQ ID NO: 563728 - DNA, 15 bp, Homo sapiens
attactaacttctaa

SEQ ID NO: 563729 - DNA, 17 bp, Homo sapiens
attactagataaaatgt

SEQ ID NO: 563730 - DNA, 12 bp, Homo sapiens
attactgtcccc

SEQ ID NO: 563731 - DNA, 16 bp, Homo sapiens
attagaaaactttgtt

SEQ ID NO: 563732 - DNA, 16 bp, Homo sapiens
attagacttctgtttt

SEQ ID NO: 563733 - DNA, 19 bp, Homo sapiens
attagacttctgttttcaa

SEQ ID NO: 563734 - DNA, 20 bp, Homo sapiens
attagacttctgttttcaat

SEQ ID NO: 563735 - DNA, 18 bp, Homo sapiens
attagcaaaaaaagttgt

SEQ ID NO: 563736 - DNA, 19 bp, Homo sapiens
attagcaaaaaaagttgta

SEQ ID NO: 563737 - DNA, 17 bp, Homo sapiens
attaggaggctcaacaa

SEQ ID NO: 563738 - DNA, 16 bp, Homo sapiens
attaggcatggttttg

SEQ ID NO: 563739 - DNA, 17 bp, Homo sapiens
attagggctctaatttc

SEQ ID NO: 563740 - DNA, 18 bp, Homo sapiens
attaggttaacattgttg

SEQ ID NO: 563741 - DNA, 19 bp, Homo sapiens
attataaactcattttgct

SEQ ID NO: 563742 - DNA, 18 bp, Homo sapiens
attatatcagactgcttt

SEQ ID NO: 563743 - DNA, 18 bp, Homo sapiens
attatatctgtggtcttc

SEQ ID NO: 563744 - DNA, 16 bp, Homo sapiens
atctgaagattgttta

SEQ ID NO: 563745 - DNA, 20 bp, Homo sapiens
atctgaagcttcactcactg

SEQ ID NO: 563746 - DNA, 20 bp, Homo sapiens
atctgaatgtattatcctgt

SEQ ID NO: 563747 - DNA, 12 bp, Homo sapiens
atctgaccacag

SEQ ID NO: 563748 - DNA, 21 bp, Homo sapiens
atctgagagaggctaaaatgt

SEQ ID NO: 563749 - DNA, 22 bp, Homo sapiens
atctgagagaggctaaaatgtt

SEQ ID NO: 563750 - DNA, 23 bp, Homo sapiens
atctgagagaggctaaaatgttt

SEQ ID NO: 563751 - DNA, 13 bp, Homo sapiens
atctgatatcagg

SEQ ID NO: 563752 - DNA, 17 bp, Homo sapiens
atctgcagtgttctgtg

SEQ ID NO: 563753 - DNA, 20 bp, Homo sapiens
atctgcagtgttctgtgaat

SEQ ID NO: 563754 - DNA, 15 bp, Homo sapiens
atctgctgagctctg

SEQ ID NO: 563755 - DNA, 20 bp, Homo sapiens
atctggaaaaaaaaaaatat

SEQ ID NO: 563756 - DNA, 21 bp, Homo sapiens
atctggaagagctaggcaggg

SEQ ID NO: 563757 - DNA, 12 bp, Homo sapiens
atctgtaagctg

SEQ ID NO: 563758 - DNA, 23 bp, Homo sapiens
atctgtctgctggtcacttcttc

SEQ ID NO: 563759 - DNA, 15 bp, Homo sapiens
atctgtctggagggg

SEQ ID NO: 563760 - DNA, 18 bp, Homo sapiens
atctgttgtaatatcagt

SEQ ID NO: 563761 - DNA, 19 bp, Homo sapiens
atctgttgtaatatcagtt

SEQ ID NO: 563762 - DNA, 20 bp, Homo sapiens
atctgttgtaatatcagtta

SEQ ID NO: 563763 - DNA, 23 bp, Homo sapiens
atctgttgtaatatcagttacag

SEQ ID NO: 563764 - DNA, 14 bp, Homo sapiens
atctgtttgcttct

SEQ ID NO: 563765 - DNA, 17 bp, Homo sapiens
atctgtttgcttctaaa

SEQ ID NO: 563766 - DNA, 19 bp, Homo sapiens
atcttattaaagtttcaaa

SEQ ID NO: 563767 - DNA, 12 bp, Homo sapiens
atcttcacatag

SEQ ID NO: 563768 - DNA, 19 bp, Homo sapiens
atcttcacatagttctcca

SEQ ID NO: 563769 - DNA, 23 bp, Homo sapiens
atcttcatctgagagaggctaaa

SEQ ID NO: 563770 - DNA, 21 bp, Homo sapiens
atcttcttttgggaggatttg

SEQ ID NO: 563771 - DNA, 12 bp, Homo sapiens
atcttggcaggg

SEQ ID NO: 563772 - DNA, 20 bp, Homo sapiens
atcttggcaggtaggaatat

SEQ ID NO: 563773 - DNA, 19 bp, Homo sapiens
atctttatacagattttct

SEQ ID NO: 563774 - DNA, 15 bp, Homo sapiens
atctttttttaagtg

SEQ ID NO: 563775 - DNA, 21 bp, Homo sapiens
atgaaaaatagtgtgtccatg

SEQ ID NO: 563776 - DNA, 21 bp, Homo sapiens
atgaaaaccctcgatgttcat

SEQ ID NO: 563777 - DNA, 22 bp, Homo sapiens
atgaaaaccctcgatgttcatg

SEQ ID NO: 563778 - DNA, 12 bp, Homo sapiens
atgaaacagcag

SEQ ID NO: 563779 - DNA, 13 bp, Homo sapiens
atgaaagctgttt

SEQ ID NO: 563780 - DNA, 17 bp, Homo sapiens
atgaaataaatgcccca

SEQ ID NO: 563781 - DNA, 19 bp, Homo sapiens
atgaaatacttgacaacat

SEQ ID NO: 563782 - DNA, 16 bp, Homo sapiens
atgaaatgaacacaaa

SEQ ID NO: 563783 - DNA, 14 bp, Homo sapiens
atgaaatttaagca

SEQ ID NO: 563784 - DNA, 14 bp, Homo sapiens
atgaacacaaatta

SEQ ID NO: 563785 - DNA, 13 bp, Homo sapiens
atgaacagtgcac

SEQ ID NO: 563786 - DNA, 12 bp, Homo sapiens
atgaactggagg

SEQ ID NO: 563787 - DNA, 18 bp, Homo sapiens
atgaactggaggccagga

SEQ ID NO: 563788 - DNA, 19 bp, Homo sapiens
atgaactggaggccaggaa

SEQ ID NO: 563789 - DNA, 15 bp, Homo sapiens
atgaagatctttgtt

SEQ ID NO: 563790 - DNA, 19 bp, Homo sapiens
atgaagttaagcacaacca

SEQ ID NO: 563791 - DNA, 23 bp, Homo sapiens
atgaataattgaggttaggaacc

SEQ ID NO: 563792 - DNA, 22 bp, Homo sapiens
atgaatagacataaattgtaat

SEQ ID NO: 563793 - DNA, 23 bp, Homo sapiens
atgaatagacataaattgtaatt

SEQ ID NO: 563794 - DNA, 15 bp, Homo sapiens
atgaatatttcattt

SEQ ID NO: 563795 - DNA, 16 bp, Homo sapiens
atgaatgtatattttg

SEQ ID NO: 563796 - DNA, 17 bp, Homo sapiens
atgacaggctgttcagc

SEQ ID NO: 563797 - DNA, 17 bp, Homo sapiens
atgagagttccttctca

SEQ ID NO: 563798 - DNA, 13 bp, Homo sapiens
atgagatcactga

SEQ ID NO: 563799 - DNA, 17 bp, Homo sapiens
atgagatcactgaactt

SEQ ID NO: 563800 - DNA, 18 bp, Homo sapiens
atgagatcactgaacttt

SEQ ID NO: 563801 - DNA, 23 bp, Homo sapiens
atgagatcactgaacttttcaaa

SEQ ID NO: 563802 - DNA, 16 bp, Homo sapiens
atgagatctttctaaa

SEQ ID NO: 563803 - DNA, 22 bp, Homo sapiens
atgagattggaaaaaattagac

SEQ ID NO: 563804 - DNA, 17 bp, Homo sapiens
atgagcatgctccctca

SEQ ID NO: 563805 - DNA, 18 bp, Homo sapiens
atgagcatgctccctcat

SEQ ID NO: 563806 - DNA, 20 bp, Homo sapiens
atgagctcctgctcattgtg

SEQ ID NO: 563807 - DNA, 19 bp, Homo sapiens
atgaggctggataggagag

SEQ ID NO: 563808 - DNA, 20 bp, Homo sapiens
atgaggctggataggagagg

SEQ ID NO: 563809 - DNA, 19 bp, Homo sapiens
atgagggcgtgaaacacaa

SEQ ID NO: 563810 - DNA, 20 bp, Homo sapiens
atgagggcgtgaaacacaat

SEQ ID NO: 563811 - DNA, 16 bp, Homo sapiens
atgagggtctcactgc

SEQ ID NO: 563812 - DNA, 14 bp, Homo sapiens
atgagtatatgtaa

SEQ ID NO: 563813 - DNA, 15 bp, Homo sapiens
atgagtatatgtaac

SEQ ID NO: 563814 - DNA, 21 bp, Homo sapiens
atgagtgctaagagcctctgg

SEQ ID NO: 563815 - DNA, 21 bp, Homo sapiens
atgataaaatcccattgtatt

SEQ ID NO: 563816 - DNA, 20 bp, Homo sapiens
atgatatgtctttaaaatga

SEQ ID NO: 563817 - DNA, 15 bp, Homo sapiens
atgatcaaggaggga

SEQ ID NO: 563818 - DNA, 14 bp, Homo sapiens
atgatccagagcag

SEQ ID NO: 563819 - DNA, 16 bp, Homo sapiens
atgatccttgcacaga

SEQ ID NO: 563820 - DNA, 23 bp, Homo sapiens
atgatctgtgccttttttatatc

SEQ ID NO: 563821 - DNA, 14 bp, Homo sapiens
atgatgatttcaga

SEQ ID NO: 563822 - DNA, 22 bp, Homo sapiens
atgatggaagggccttctccac

SEQ ID NO: 563823 - DNA, 13 bp, Homo sapiens
atgatgtttttaa

SEQ ID NO: 563824 - DNA, 19 bp, Homo sapiens
atgattaaattatcattgt

SEQ ID NO: 563825 - DNA, 15 bp, Homo sapiens
atgattattttcatt

SEQ ID NO: 563826 - DNA, 17 bp, Homo sapiens
atgattcacttttattg

SEQ ID NO: 563827 - DNA, 21 bp, Homo sapiens
atgattccaagggcccagagg

SEQ ID NO: 563828 - DNA, 14 bp, Homo sapiens
atgattgagagcag

SEQ ID NO: 563829 - DNA, 12 bp, Homo sapiens
atgattgtcttt

SEQ ID NO: 563830 - DNA, 13 bp, Homo sapiens
atgatttcagaaa

SEQ ID NO: 563831 - DNA, 14 bp, Homo sapiens
atgatttcagaaac

SEQ ID NO: 563832 - DNA, 16 bp, Homo sapiens
atgatttcagaaacaa

SEQ ID NO: 563833 - DNA, 19 bp, Homo sapiens
atgcaacttgattcttgtg

SEQ ID NO: 563834 - DNA, 15 bp, Homo sapiens
atgcaagcagtttca

SEQ ID NO: 563835 - DNA, 19 bp, Homo sapiens
atgcaatccttacaaatga

SEQ ID NO: 563836 - DNA, 16 bp, Homo sapiens
atgcacaatgtcttgg

SEQ ID NO: 563837 - DNA, 12 bp, Homo sapiens
atgcacacacac

SEQ ID NO: 563838 - DNA, 14 bp, Homo sapiens
atgcacacacacac

SEQ ID NO: 563839 - DNA, 15 bp, Homo sapiens
atgcacacacacaca

SEQ ID NO: 563840 - DNA, 20 bp, Homo sapiens
atgcactaagtctctttttt

SEQ ID NO: 563841 - DNA, 20 bp, Homo sapiens
atgcagagttcagggaagat

SEQ ID NO: 563842 - DNA, 12 bp, Homo sapiens
atgcatatatat

SEQ ID NO: 563843 - DNA, 14 bp, Homo sapiens
atgcatatatatgt

SEQ ID NO: 563844 - DNA, 16 bp, Homo sapiens
atgcatatatatgtat

SEQ ID NO: 563845 - DNA, 21 bp, Homo sapiens
atgcatgctttccatattttt

SEQ ID NO: 563846 - DNA, 19 bp, Homo sapiens
atgcatttaagttgtaaac

SEQ ID NO: 563847 - DNA, 23 bp, Homo sapiens
atgcatttaagttgtaaacgtct

SEQ ID NO: 563848 - DNA, 16 bp, Homo sapiens
atgccacctcctctgt

SEQ ID NO: 563849 - DNA, 20 bp, Homo sapiens
atgccagtccagatgtgcct

SEQ ID NO: 563850 - DNA, 12 bp, Homo sapiens
atgcccttcact

SEQ ID NO: 563851 - DNA, 13 bp, Homo sapiens
atgcctaataaac

SEQ ID NO: 563852 - DNA, 16 bp, Homo sapiens
atgcctcattttattc

SEQ ID NO: 563853 - DNA, 12 bp, Homo sapiens
atgccttttgta

SEQ ID NO: 563854 - DNA, 13 bp, Homo sapiens
atgccttttgtag

SEQ ID NO: 563855 - DNA, 22 bp, Homo sapiens
atgccttttgtagctgtcatgg

SEQ ID NO: 563856 - DNA, 21 bp, Homo sapiens
atgctatctcgctagccatat

SEQ ID NO: 563857 - DNA, 17 bp, Homo sapiens
atgctatgtcatttcat

SEQ ID NO: 563858 - DNA, 16 bp, Homo sapiens
atgctcagctcagcat

SEQ ID NO: 563859 - DNA, 15 bp, Homo sapiens
atgctgctgagcaca

SEQ ID NO: 563860 - DNA, 22 bp, Homo sapiens
atgctgctgagcacatctcttc

SEQ ID NO: 563861 - DNA, 15 bp, Homo sapiens
atgctgggctcccgt

SEQ ID NO: 563862 - DNA, 16 bp, Homo sapiens
atgctgtaaaagcaag

SEQ ID NO: 563863 - DNA, 18 bp, Homo sapiens
atgcttaaataaaaatta

SEQ ID NO: 563864 - DNA, 23 bp, Homo sapiens
atgcttaagcatccgtgtatttg

SEQ ID NO: 563865 - DNA, 15 bp, Homo sapiens
atgcttagcttatct

SEQ ID NO: 563866 - DNA, 15 bp, Homo sapiens
atgctttccatattt

SEQ ID NO: 563867 - DNA, 11 bp, Homo sapiens
atggaaatcca

SEQ ID NO: 563868 - DNA, 18 bp, Homo sapiens
atggaagacaaatacaca

SEQ ID NO: 563869 - DNA, 13 bp, Homo sapiens
atggaagagaaat

SEQ ID NO: 563870 - DNA, 23 bp, Homo sapiens
atggaagctggcaggagacactg

SEQ ID NO: 563871 - DNA, 18 bp, Homo sapiens
atggaatatcagaagtat

SEQ ID NO: 563872 - DNA, 20 bp, Homo sapiens
atggaattggtttaaacttt

SEQ ID NO: 563873 - DNA, 22 bp, Homo sapiens
atggaattggtttaaactttta

SEQ ID NO: 563874 - DNA, 16 bp, Homo sapiens
atggacaatttaccac

SEQ ID NO: 563875 - DNA, 18 bp, Homo sapiens
atggacagcattgccagt

SEQ ID NO: 563876 - DNA, 18 bp, Homo sapiens
atggaggtgatgaaaacc

SEQ ID NO: 563877 - DNA, 17 bp, Homo sapiens
atggagtccagacctgg

SEQ ID NO: 563878 - DNA, 14 bp, Homo sapiens
atggatggcacaat

SEQ ID NO: 563879 - DNA, 14 bp, Homo sapiens
atggcaacaaactg

SEQ ID NO: 563880 - DNA, 19 bp, Homo sapiens
atggcaacaaactgcacat

SEQ ID NO: 563881 - DNA, 17 bp, Homo sapiens
atattaaaaagtctttt

SEQ ID NO: 563882 - DNA, 20 bp, Homo sapiens
atattaaaaagtcttttaaa

SEQ ID NO: 563883 - DNA, 17 bp, Homo sapiens
atattacaatatttgtg

SEQ ID NO: 563884 - DNA, 21 bp, Homo sapiens
atattactctgcctgtcaagt

SEQ ID NO: 563885 - DNA, 17 bp, Homo sapiens
atattagaaaactttgt

SEQ ID NO: 563886 - DNA, 16 bp, Homo sapiens
atattagacttctgtt

SEQ ID NO: 563887 - DNA, 20 bp, Homo sapiens
atattagacttctgttttca

SEQ ID NO: 563888 - DNA, 19 bp, Homo sapiens
atattagcgacaacagatt

SEQ ID NO: 563889 - DNA, 13 bp, Homo sapiens
atattatatcaga

SEQ ID NO: 563890 - DNA, 13 bp, Homo sapiens
atattatatttgg

SEQ ID NO: 563891 - DNA, 14 bp, Homo sapiens
atattatatttgga

SEQ ID NO: 563892 - DNA, 15 bp, Homo sapiens
atattatatttggat

SEQ ID NO: 563893 - DNA, 20 bp, Homo sapiens
atattatgccttgagaatga

SEQ ID NO: 563894 - DNA, 23 bp, Homo sapiens
atattattggtcaagaaaagcat

SEQ ID NO: 563895 - DNA, 14 bp, Homo sapiens
atattcccatggta

SEQ ID NO: 563896 - DNA, 19 bp, Homo sapiens
atattccccatttcctgta

SEQ ID NO: 563897 - DNA, 13 bp, Homo sapiens
atattctctgtac

SEQ ID NO: 563898 - DNA, 19 bp, Homo sapiens
atattctctgtacatatta

SEQ ID NO: 563899 - DNA, 17 bp, Homo sapiens
atattgaaaatgtcact

SEQ ID NO: 563900 - DNA, 19 bp, Homo sapiens
atattgaaaatgtcactgt

SEQ ID NO: 563901 - DNA, 21 bp, Homo sapiens
atattgacaagtttaaaggct

SEQ ID NO: 563902 - DNA, 18 bp, Homo sapiens
atattgatgtaactgtgt

SEQ ID NO: 563903 - DNA, 13 bp, Homo sapiens
atatttaaagtct

SEQ ID NO: 563904 - DNA, 19 bp, Homo sapiens
atatttaagtattcaagaa

SEQ ID NO: 563905 - DNA, 15 bp, Homo sapiens
atatttcattttgag

SEQ ID NO: 563906 - DNA, 16 bp, Homo sapiens
atatttcattttgaga

SEQ ID NO: 563907 - DNA, 17 bp, Homo sapiens
atatttcctaaggcatg

SEQ ID NO: 563908 - DNA, 23 bp, Homo sapiens
atatttcctataccatttccgta

SEQ ID NO: 563909 - DNA, 20 bp, Homo sapiens
atatttgcataatatgcata

SEQ ID NO: 563910 - DNA, 20 bp, Homo sapiens
atatttggatgcagagttca

SEQ ID NO: 563911 - DNA, 11 bp, Homo sapiens
atatttgtgta

SEQ ID NO: 563912 - DNA, 22 bp, Homo sapiens
atatttgtgtgctaaacgtgta

SEQ ID NO: 563913 - DNA, 23 bp, Homo sapiens
atatttgtgtgctaaacgtgtat

SEQ ID NO: 563914 - DNA, 16 bp, Homo sapiens
atattttaatttcaag

SEQ ID NO: 563915 - DNA, 19 bp, Homo sapiens
atattttctgagtagcata

SEQ ID NO: 563916 - DNA, 14 bp, Homo sapiens
atattttgtatgca

SEQ ID NO: 563917 - DNA, 16 bp, Homo sapiens
atattttgtatgcaag

SEQ ID NO: 563918 - DNA, 17 bp, Homo sapiens
atattttgtatgcaagc

SEQ ID NO: 563919 - DNA, 13 bp, Homo sapiens
atattttgtcact

SEQ ID NO: 563920 - DNA, 15 bp, Homo sapiens
atattttgtcactgc

SEQ ID NO: 563921 - DNA, 22 bp, Homo sapiens
atattttgtcactgctgtaaag

SEQ ID NO: 563922 - DNA, 23 bp, Homo sapiens
atatttttaaaggaaaaatcata

SEQ ID NO: 563923 - DNA, 14 bp, Homo sapiens
atatttttcttaaa

SEQ ID NO: 563924 - DNA, 21 bp, Homo sapiens
atatttttttccttacataaa

SEQ ID NO: 563925 - DNA, 19 bp, Homo sapiens
atcaaaaattgaagagaga

SEQ ID NO: 563926 - DNA, 15 bp, Homo sapiens
atcaacaaagaaata

SEQ ID NO: 563927 - DNA, 21 bp, Homo sapiens
atcaagaaaaaaagggagaat

SEQ ID NO: 563928 - DNA, 14 bp, Homo sapiens
atcaagaccaaaga

SEQ ID NO: 563929 - DNA, 14 bp, Homo sapiens
atcaagtctgtgaa

SEQ ID NO: 563930 - DNA, 17 bp, Homo sapiens
atcacctaattaatttc

SEQ ID NO: 563931 - DNA, 18 bp, Homo sapiens
atcactcagagcagtctg

SEQ ID NO: 563932 - DNA, 14 bp, Homo sapiens
atcactgaactttt

SEQ ID NO: 563933 - DNA, 15 bp, Homo sapiens
atcactgaacttttc

SEQ ID NO: 563934 - DNA, 13 bp, Homo sapiens
atcagaaagacat

SEQ ID NO: 563935 - DNA, 19 bp, Homo sapiens
atcagaaagacattcttag

SEQ ID NO: 563936 - DNA, 15 bp, Homo sapiens
atcagatcttctttt

SEQ ID NO: 563937 - DNA, 19 bp, Homo sapiens
atcagcagcggcagcagca

SEQ ID NO: 563938 - DNA, 19 bp, Homo sapiens
atcagctacttaagagaaa

SEQ ID NO: 563939 - DNA, 20 bp, Homo sapiens
atcagctacttaagagaaat

SEQ ID NO: 563940 - DNA, 21 bp, Homo sapiens
atcagctacttaagagaaatg

SEQ ID NO: 563941 - DNA, 22 bp, Homo sapiens
atcagctacttaagagaaatgg

SEQ ID NO: 563942 - DNA, 18 bp, Homo sapiens
atcaggtaaactgatgct

SEQ ID NO: 563943 - DNA, 13 bp, Homo sapiens
atcaggtcctgct

SEQ ID NO: 563944 - DNA, 14 bp, Homo sapiens
atcaggtcctgctc

SEQ ID NO: 563945 - DNA, 19 bp, Homo sapiens
atcaggtcctgctcagcag

SEQ ID NO: 563946 - DNA, 21 bp, Homo sapiens
atcagtcttaatattcagaga

SEQ ID NO: 563947 - DNA, 22 bp, Homo sapiens
atcagttacagtggcagtattg

SEQ ID NO: 563948 - DNA, 17 bp, Homo sapiens
atcagttatcctttgtg

SEQ ID NO: 563949 - DNA, 18 bp, Homo sapiens
atcagttatcctttgtga

SEQ ID NO: 563950 - DNA, 22 bp, Homo sapiens
atcagttatcctttgtgagcct

SEQ ID NO: 563951 - DNA, 19 bp, Homo sapiens
atcagtttttgttcttaaa

SEQ ID NO: 563952 - DNA, 20 bp, Homo sapiens
atcatcgaaaattcatttca

SEQ ID NO: 563953 - DNA, 14 bp, Homo sapiens
atcatctgtaagct

SEQ ID NO: 563954 - DNA, 19 bp, Homo sapiens
atcatgaacagctctgaga

SEQ ID NO: 563955 - DNA, 22 bp, Homo sapiens
atcatgctttaaagtgtaataa

SEQ ID NO: 563956 - DNA, 13 bp, Homo sapiens
atcatgtgtttct

SEQ ID NO: 563957 - DNA, 15 bp, Homo sapiens
atcattcttataaca

SEQ ID NO: 563958 - DNA, 22 bp, Homo sapiens
atcattggtatctgatatctgt

SEQ ID NO: 563959 - DNA, 14 bp, Homo sapiens
atcattgtccagag

SEQ ID NO: 563960 - DNA, 19 bp, Homo sapiens
atcattgtttgtcctttat

SEQ ID NO: 563961 - DNA, 14 bp, Homo sapiens
atccaaaagaaaaa

SEQ ID NO: 563962 - DNA, 15 bp, Homo sapiens
atccaaaagaaaaac

SEQ ID NO: 563963 - DNA, 13 bp, Homo sapiens
atccacctgcaca

SEQ ID NO: 563964 - DNA, 14 bp, Homo sapiens
atccagagcagagt

SEQ ID NO: 563965 - DNA, 22 bp, Homo sapiens
atccagaggtgagggaggcctg

SEQ ID NO: 563966 - DNA, 14 bp, Homo sapiens
atccagccaggggt

SEQ ID NO: 563967 - DNA, 15 bp, Homo sapiens
atccatcagtgccaa

SEQ ID NO: 563968 - DNA, 20 bp, Homo sapiens
atccatgcggccggcctggg

SEQ ID NO: 563969 - DNA, 18 bp, Homo sapiens
atccatgtcctatgtgtg

SEQ ID NO: 563970 - DNA, 12 bp, Homo sapiens
atcccacagcca

SEQ ID NO: 563971 - DNA, 18 bp, Homo sapiens
atcccattgtatttaaaa

SEQ ID NO: 563972 - DNA, 20 bp, Homo sapiens
atcccattgtatttaaaaca

SEQ ID NO: 563973 - DNA, 15 bp, Homo sapiens
atcccggggccatgg

SEQ ID NO: 563974 - DNA, 21 bp, Homo sapiens
atcccggggccatggaagctg

SEQ ID NO: 563975 - DNA, 22 bp, Homo sapiens
atcccggggccatggaagctgg

SEQ ID NO: 563976 - DNA, 19 bp, Homo sapiens
atccctgatcctaactgaa

SEQ ID NO: 563977 - DNA, 14 bp, Homo sapiens
atcccttctcttcc

SEQ ID NO: 563978 - DNA, 21 bp, Homo sapiens
atcccttctcttccaggcagc

SEQ ID NO: 563979 - DNA, 15 bp, Homo sapiens
atccgaagggaatta

SEQ ID NO: 563980 - DNA, 17 bp, Homo sapiens
atccgccctgggctctg

SEQ ID NO: 563981 - DNA, 18 bp, Homo sapiens
atccgccctgggctctgg

SEQ ID NO: 563982 - DNA, 20 bp, Homo sapiens
atccgccctgggctctgggt

SEQ ID NO: 563983 - DNA, 22 bp, Homo sapiens
atccgtgtatttggctgggcta

SEQ ID NO: 563984 - DNA, 24 bp, Homo sapiens
atcctacgagtaattgcatttgct

SEQ ID NO: 563985 - DNA, 23 bp, Homo sapiens
atcctagcactttgggaggctga

SEQ ID NO: 563986 - DNA, 23 bp, Homo sapiens
atcctatctggggagctcctggc

SEQ ID NO: 563987 - DNA, 17 bp, Homo sapiens
atcctgccttcatggaa

SEQ ID NO: 563988 - DNA, 21 bp, Homo sapiens
atcctgggcttttgttttgct

SEQ ID NO: 563989 - DNA, 12 bp, Homo sapiens
atccttacaaat

SEQ ID NO: 563990 - DNA, 21 bp, Homo sapiens
atccttacaaatgattgcttt

SEQ ID NO: 563991 - DNA, 12 bp, Homo sapiens
atccttgcacag

SEQ ID NO: 563992 - DNA, 18 bp, Homo sapiens
atcctttcacttctttcc

SEQ ID NO: 563993 - DNA, 20 bp, Homo sapiens
atcctttgtgagcctatgat

SEQ ID NO: 563994 - DNA, 12 bp, Homo sapiens
atccttttctcc

SEQ ID NO: 563995 - DNA, 16 bp, Homo sapiens
atcgaaaattcatttc

SEQ ID NO: 563996 - DNA, 15 bp, Homo sapiens
atcgcaagtcacaga

SEQ ID NO: 563997 - DNA, 19 bp, Homo sapiens
atcgggagtagcaaggaag

SEQ ID NO: 563998 - DNA, 16 bp, Homo sapiens
atctaaactttaatat

SEQ ID NO: 563999 - DNA, 16 bp, Homo sapiens
atctaaattaacttct

SEQ ID NO: 564000 - DNA, 15 bp, Homo sapiens
atctaccaactttca

SEQ ID NO: 564001 - DNA, 16 bp, Homo sapiens
atctaccaactttcaa

SEQ ID NO: 564002 - DNA, 16 bp, Homo sapiens
atctaccttttctctt

SEQ ID NO: 564003 - DNA, 15 bp, Homo sapiens
atctatagaaagtgt

SEQ ID NO: 564004 - DNA, 16 bp, Homo sapiens
atctatagaaagtgtt

SEQ ID NO: 564005 - DNA, 16 bp, Homo sapiens
atctatctaatcagat

SEQ ID NO: 564006 - DNA, 16 bp, Homo sapiens
atctcatcaacaaaga

SEQ ID NO: 564007 - DNA, 22 bp, Homo sapiens
atctcccctcctggcgagttct

SEQ ID NO: 564008 - DNA, 15 bp, Homo sapiens
atctcccctttgcta

SEQ ID NO: 564009 - DNA, 12 bp, Homo sapiens
atctcccttcct

SEQ ID NO: 564010 - DNA, 13 bp, Homo sapiens
atctcctggtgtt

SEQ ID NO: 564011 - DNA, 21 bp, Homo sapiens
atctcctgtgcacctgacttt

SEQ ID NO: 564012 - DNA, 15 bp, Homo sapiens
atctccttgggctgg

SEQ ID NO: 564013 - DNA, 15 bp, Homo sapiens
atctcgtatagaagt

SEQ ID NO: 564014 - DNA, 17 bp, Homo sapiens
atctctacccctttctt

SEQ ID NO: 564015 - DNA, 12 bp, Homo sapiens
atctctgtaaaa

SEQ ID NO: 564016 - DNA, 14 bp, Homo sapiens
atctgaaaactgga

SEQ ID NO: 564017 - DNA, 15 bp, Homo sapiens
atctgaaaactggaa

SEQ ID NO: 564018 - DNA, 22 bp, Homo sapiens
aggttgaagacctaaccagggc

SEQ ID NO: 564019 - DNA, 17 bp, Homo sapiens
aggttggagtgcattca

SEQ ID NO: 564020 - DNA, 15 bp, Homo sapiens
aggttgtgctgcctg

SEQ ID NO: 564021 - DNA, 14 bp, Homo sapiens
aggtttggctcctg

SEQ ID NO: 564022 - DNA, 18 bp, Homo sapiens
aggtttggctcctgccca

SEQ ID NO: 564023 - DNA, 20 bp, Homo sapiens
aggtttggctcctgcccact

SEQ ID NO: 564024 - DNA, 19 bp, Homo sapiens
agtaaactaatgagtttct

SEQ ID NO: 564025 - DNA, 16 bp, Homo sapiens
agtaaagaaagcagaa

SEQ ID NO: 564026 - DNA, 16 bp, Homo sapiens
agtaaatctcttctgt

SEQ ID NO: 564027 - DNA, 18 bp, Homo sapiens
agtaaatctcttctgtgt

SEQ ID NO: 564028 - DNA, 12 bp, Homo sapiens
agtaaatgtagt

SEQ ID NO: 564029 - DNA, 15 bp, Homo sapiens
agtaaatgtagttca

SEQ ID NO: 564030 - DNA, 19 bp, Homo sapiens
agtaacacttgaaaagtgt

SEQ ID NO: 564031 - DNA, 18 bp, Homo sapiens
agtaactgccattttttg

SEQ ID NO: 564032 - DNA, 20 bp, Homo sapiens
agtaacttgtcttaaataaa

SEQ ID NO: 564033 - DNA, 21 bp, Homo sapiens
agtaagcggctcaagcccagg

SEQ ID NO: 564034 - DNA, 11 bp, Homo sapiens
agtaatataat

SEQ ID NO: 564035 - DNA, 13 bp, Homo sapiens
agtacaaatgtgt

SEQ ID NO: 564036 - DNA, 15 bp, Homo sapiens
agtacaataaataaa

SEQ ID NO: 564037 - DNA, 13 bp, Homo sapiens
agtacattctcag

SEQ ID NO: 564038 - DNA, 16 bp, Homo sapiens
agtacattctcagttt

SEQ ID NO: 564039 - DNA, 15 bp, Homo sapiens
agtaccacactgagt

SEQ ID NO: 564040 - DNA, 21 bp, Homo sapiens
agtacctgggtccccagccct

SEQ ID NO: 564041 - DNA, 16 bp, Homo sapiens
agtactctaatataca

SEQ ID NO: 564042 - DNA, 18 bp, Homo sapiens
agtactctaatatacagt

SEQ ID NO: 564043 - DNA, 13 bp, Homo sapiens
agtagaatctcag

SEQ ID NO: 564044 - DNA, 15 bp, Homo sapiens
agtagaatctcagca

SEQ ID NO: 564045 - DNA, 16 bp, Homo sapiens
agtagaatctcagcac

SEQ ID NO: 564046 - DNA, 20 bp, Homo sapiens
agtagaggtttaaagaaaaa

SEQ ID NO: 564047 - DNA, 15 bp, Homo sapiens
agtagagtatattga

SEQ ID NO: 564048 - DNA, 16 bp, Homo sapiens
agtagcaaggaaggac

SEQ ID NO: 564049 - DNA, 17 bp, Homo sapiens
agtagcaaggaaggaca

SEQ ID NO: 564050 - DNA, 20 bp, Homo sapiens
agtagctttgcacttttcta

SEQ ID NO: 564051 - DNA, 23 bp, Homo sapiens
agtaggatatagcgaaaggcgag

SEQ ID NO: 564052 - DNA, 19 bp, Homo sapiens
agtaggggtaccactgaat

SEQ ID NO: 564053 - DNA, 20 bp, Homo sapiens
agtaggggtaccactgaatc

SEQ ID NO: 564054 - DNA, 20 bp, Homo sapiens
agtaggtcgttttaaaaaca

SEQ ID NO: 564055 - DNA, 14 bp, Homo sapiens
agtataaagaatag

SEQ ID NO: 564056 - DNA, 15 bp, Homo sapiens
agtatacaatatata

SEQ ID NO: 564057 - DNA, 17 bp, Homo sapiens
agtatacaatatataaa

SEQ ID NO: 564058 - DNA, 13 bp, Homo sapiens
agtatatgtaaca

SEQ ID NO: 564059 - DNA, 14 bp, Homo sapiens
agtatatgtaacag

SEQ ID NO: 564060 - DNA, 13 bp, Homo sapiens
agtatcatctaaa

SEQ ID NO: 564061 - DNA, 20 bp, Homo sapiens
agtatcatctaaatattatg

SEQ ID NO: 564062 - DNA, 10 bp, Homo sapiens
agtatctcat

SEQ ID NO: 564063 - DNA, 17 bp, Homo sapiens
agtatgaatatttcatt

SEQ ID NO: 564064 - DNA, 23 bp, Homo sapiens
agtattcaagaaagccagtctta

SEQ ID NO: 564065 - DNA, 13 bp, Homo sapiens
agtattgacaata

SEQ ID NO: 564066 - DNA, 17 bp, Homo sapiens
agtattgccaaacatta

SEQ ID NO: 564067 - DNA, 18 bp, Homo sapiens
agtattgccaaacattaa

SEQ ID NO: 564068 - DNA, 13 bp, Homo sapiens
agtatttaacatt

SEQ ID NO: 564069 - DNA, 15 bp, Homo sapiens
agtatttaacattct

SEQ ID NO: 564070 - DNA, 12 bp, Homo sapiens
agtatttgaaaa

SEQ ID NO: 564071 - DNA, 13 bp, Homo sapiens
agtatttgaaaac

SEQ ID NO: 564072 - DNA, 16 bp, Homo sapiens
agtcaaggagtggctt

SEQ ID NO: 564073 - DNA, 19 bp, Homo sapiens
agtcaccactccattccca

SEQ ID NO: 564074 - DNA, 18 bp, Homo sapiens
agtcactgcaaaaccagg

SEQ ID NO: 564075 - DNA, 20 bp, Homo sapiens
agtcaggaagcctcctgctg

SEQ ID NO: 564076 - DNA, 15 bp, Homo sapiens
agtcagggagccctg

SEQ ID NO: 564077 - DNA, 16 bp, Homo sapiens
agtcagggagccctgg

SEQ ID NO: 564078 - DNA, 17 bp, Homo sapiens
agtcataccaactttag

SEQ ID NO: 564079 - DNA, 19 bp, Homo sapiens
agtcatctcccctcctggc

SEQ ID NO: 564080 - DNA, 18 bp, Homo sapiens
agtcatgatgtttttaaa

SEQ ID NO: 564081 - DNA, 22 bp, Homo sapiens
agtcatttattttaaaaaatga

SEQ ID NO: 564082 - DNA, 15 bp, Homo sapiens
agtcattttcatgtg

SEQ ID NO: 564083 - DNA, 21 bp, Homo sapiens
agtcattttcatgtgtgtgag

SEQ ID NO: 564084 - DNA, 18 bp, Homo sapiens
agtccaacgtggggcagc

SEQ ID NO: 564085 - DNA, 20 bp, Homo sapiens
agtccaacgtggggcagcac

SEQ ID NO: 564086 - DNA, 15 bp, Homo sapiens
agtccagacctgggc

SEQ ID NO: 564087 - DNA, 16 bp, Homo sapiens
agtccagacctgggcc

SEQ ID NO: 564088 - DNA, 14 bp, Homo sapiens
agtccccagaactc

SEQ ID NO: 564089 - DNA, 23 bp, Homo sapiens
agtccctgagaagcctcatggga

SEQ ID NO: 564090 - DNA, 14 bp, Homo sapiens
agtcctccagaact

SEQ ID NO: 564091 - DNA, 22 bp, Homo sapiens
agtcctccagaactcttcctcc

SEQ ID NO: 564092 - DNA, 16 bp, Homo sapiens
agtccttatctagctg

SEQ ID NO: 564093 - DNA, 18 bp, Homo sapiens
agtccttatctagctgca

SEQ ID NO: 564094 - DNA, 22 bp, Homo sapiens
agtcgcctttcagcaggcagcc

SEQ ID NO: 564095 - DNA, 16 bp, Homo sapiens
agtctcctgtatcatt

SEQ ID NO: 564096 - DNA, 20 bp, Homo sapiens
agtctctttcttcctttcta

SEQ ID NO: 564097 - DNA, 16 bp, Homo sapiens
agtctcttttttacaa

SEQ ID NO: 564098 - DNA, 18 bp, Homo sapiens
agtctcttttttacaaag

SEQ ID NO: 564099 - DNA, 19 bp, Homo sapiens
agtctggagaccaggactc

SEQ ID NO: 564100 - DNA, 17 bp, Homo sapiens
agtcttaacatttctaa

SEQ ID NO: 564101 - DNA, 14 bp, Homo sapiens
agtcttaactggtc

SEQ ID NO: 564102 - DNA, 16 bp, Homo sapiens
agtcttatgcttccag

SEQ ID NO: 564103 - DNA, 18 bp, Homo sapiens
agtcttcatgttcccact

SEQ ID NO: 564104 - DNA, 15 bp, Homo sapiens
agtcttccacctgga

SEQ ID NO: 564105 - DNA, 16 bp, Homo sapiens
agtcttccacctggaa

SEQ ID NO: 564106 - DNA, 11 bp, Homo sapiens
agtcttttaaa

SEQ ID NO: 564107 - DNA, 15 bp, Homo sapiens
agtcttttgcatgtc

SEQ ID NO: 564108 - DNA, 17 bp, Homo sapiens
agtcttttttttttaag

SEQ ID NO: 564109 - DNA, 18 bp, Homo sapiens
agtcttttttttttaagt

SEQ ID NO: 564110 - DNA, 19 bp, Homo sapiens
agtgaaaaagacttcaaat

SEQ ID NO: 564111 - DNA, 20 bp, Homo sapiens
agtgaaaaagacttcaaatg

SEQ ID NO: 564112 - DNA, 23 bp, Homo sapiens
agtgaaaaagacttcaaatgtta

SEQ ID NO: 564113 - DNA, 15 bp, Homo sapiens
agtgaaattcaattc

SEQ ID NO: 564114 - DNA, 15 bp, Homo sapiens
agtgaagactccaga

SEQ ID NO: 564115 - DNA, 21 bp, Homo sapiens
agtgaagagcatttggtacac

SEQ ID NO: 564116 - DNA, 22 bp, Homo sapiens
agtgaagccagctgcaggaatc

SEQ ID NO: 564117 - DNA, 20 bp, Homo sapiens
agtgaatgagtttccagcta

SEQ ID NO: 564118 - DNA, 13 bp, Homo sapiens
agtgacagagtaa

SEQ ID NO: 564119 - DNA, 17 bp, Homo sapiens
agtgacatcggttcagg

SEQ ID NO: 564120 - DNA, 17 bp, Homo sapiens
agtgacatttcaatcac

SEQ ID NO: 564121 - DNA, 18 bp, Homo sapiens
agtgaccattgcatgccg

SEQ ID NO: 564122 - DNA, 22 bp, Homo sapiens
agtgacctggaaggcccagcac

SEQ ID NO: 564123 - DNA, 19 bp, Homo sapiens
agtgatatgatccagagca

SEQ ID NO: 564124 - DNA, 12 bp, Homo sapiens
agtgatattctt

SEQ ID NO: 564125 - DNA, 19 bp, Homo sapiens
agtgatattctttgttaat

SEQ ID NO: 564126 - DNA, 20 bp, Homo sapiens
agtgatattctttgttaatt

SEQ ID NO: 564127 - DNA, 23 bp, Homo sapiens
agtgcaaaaggcttgcagaactt

SEQ ID NO: 564128 - DNA, 15 bp, Homo sapiens
agtgcaatatatttt

SEQ ID NO: 564129 - DNA, 21 bp, Homo sapiens
agtgcaatatattttgtatgc

SEQ ID NO: 564130 - DNA, 23 bp, Homo sapiens
agtgccaaaataaagtctgtcat

SEQ ID NO: 564131 - DNA, 16 bp, Homo sapiens
agtgcccatgtgtatg

SEQ ID NO: 564132 - DNA, 20 bp, Homo sapiens
agtgccccagaaatgccgct

SEQ ID NO: 564133 - DNA, 21 bp, Homo sapiens
agtgccccgtctacagctccc

SEQ ID NO: 564134 - DNA, 22 bp, Homo sapiens
agtgcctctgattctatgtaac

SEQ ID NO: 564135 - DNA, 13 bp, Homo sapiens
agtgcgtggccca

SEQ ID NO: 564136 - DNA, 19 bp, Homo sapiens
agtgctaagagcctctgga

SEQ ID NO: 564137 - DNA, 16 bp, Homo sapiens
agtgctatatatataa

SEQ ID NO: 564138 - DNA, 22 bp, Homo sapiens
agtgctatatatataaatattt

SEQ ID NO: 564139 - DNA, 14 bp, Homo sapiens
agtgcttgaggcca

SEQ ID NO: 564140 - DNA, 16 bp, Homo sapiens
caccagggccaaaagc

SEQ ID NO: 564141 - DNA, 20 bp, Homo sapiens
caccaggtagaacgccaggg

SEQ ID NO: 564142 - DNA, 13 bp, Homo sapiens
caccagtacattc

SEQ ID NO: 564143 - DNA, 22 bp, Homo sapiens
caccagtacattctcagttttt

SEQ ID NO: 564144 - DNA, 14 bp, Homo sapiens
caccagtgacctgg

SEQ ID NO: 564145 - DNA, 18 bp, Homo sapiens
caccatccaccttccctt

SEQ ID NO: 564146 - DNA, 16 bp, Homo sapiens
cacccaagcaggaggc

SEQ ID NO: 564147 - DNA, 16 bp, Homo sapiens
cacccacaccctacag

SEQ ID NO: 564148 - DNA, 15 bp, Homo sapiens
cacccacaggcatgt

SEQ ID NO: 564149 - DNA, 13 bp, Homo sapiens
cacccagccccag

SEQ ID NO: 564150 - DNA, 15 bp, Homo sapiens
cacccagccccagcg

SEQ ID NO: 564151 - DNA, 11 bp, Homo sapiens
cacccagcctg

SEQ ID NO: 564152 - DNA, 12 bp, Homo sapiens
cacccagcctgg

SEQ ID NO: 564153 - DNA, 15 bp, Homo sapiens
cacccccgggtgcct

SEQ ID NO: 564154 - DNA, 13 bp, Homo sapiens
cacccctgcaggc

SEQ ID NO: 564155 - DNA, 15 bp, Homo sapiens
cacccgcatgtacaa

SEQ ID NO: 564156 - DNA, 18 bp, Homo sapiens
caccctacagcagatcca

SEQ ID NO: 564157 - DNA, 12 bp, Homo sapiens
caccctccttcc

SEQ ID NO: 564158 - DNA, 13 bp, Homo sapiens
caccctccttccc

SEQ ID NO: 564159 - DNA, 14 bp, Homo sapiens
caccctccttccca

SEQ ID NO: 564160 - DNA, 22 bp, Homo sapiens
caccctccttcccactcttctc

SEQ ID NO: 564161 - DNA, 23 bp, Homo sapiens
caccctccttcccactcttctca

SEQ ID NO: 564162 - DNA, 21 bp, Homo sapiens
caccctgaacaacgagccttt

SEQ ID NO: 564163 - DNA, 22 bp, Homo sapiens
caccgagaggaaaaaggcttct

SEQ ID NO: 564164 - DNA, 23 bp, Homo sapiens
caccgccctccctccccagctcc

SEQ ID NO: 564165 - DNA, 17 bp, Homo sapiens
cacctcattccagtcaa

SEQ ID NO: 564166 - DNA, 21 bp, Homo sapiens
cacctccccaggccgtggctg

SEQ ID NO: 564167 - DNA, 13 bp, Homo sapiens
cacctctgtaatt

SEQ ID NO: 564168 - DNA, 14 bp, Homo sapiens
cacctgcagctccc

SEQ ID NO: 564169 - DNA, 21 bp, Homo sapiens
cacctgcccggcccaggagcg

SEQ ID NO: 564170 - DNA, 14 bp, Homo sapiens
cacctgctctgctg

SEQ ID NO: 564171 - DNA, 11 bp, Homo sapiens
cacctggccct

SEQ ID NO: 564172 - DNA, 16 bp, Homo sapiens
cacctggccctggggc

SEQ ID NO: 564173 - DNA, 19 bp, Homo sapiens
cacctggccctggggcctg

SEQ ID NO: 564174 - DNA, 16 bp, Homo sapiens
cacctgggagatgctg

SEQ ID NO: 564175 - DNA, 16 bp, Homo sapiens
cacctggttccggaat

SEQ ID NO: 564176 - DNA, 20 bp, Homo sapiens
cacctggttccggaatcctg

SEQ ID NO: 564177 - DNA, 21 bp, Homo sapiens
cacctggttccggaatcctgt

SEQ ID NO: 564178 - DNA, 23 bp, Homo sapiens
cacctggttccggaatcctgtcc

SEQ ID NO: 564179 - DNA, 15 bp, Homo sapiens
cacctgtactggaga

SEQ ID NO: 564180 - DNA, 16 bp, Homo sapiens
cacctgtactggagag

SEQ ID NO: 564181 - DNA, 21 bp, Homo sapiens
caccttccctagttctttgca

SEQ ID NO: 564182 - DNA, 21 bp, Homo sapiens
caccttcccttctacaaggac

SEQ ID NO: 564183 - DNA, 18 bp, Homo sapiens
cacgagtcagtcgccttt

SEQ ID NO: 564184 - DNA, 13 bp, Homo sapiens
cacgcacacacac

SEQ ID NO: 564185 - DNA, 15 bp, Homo sapiens
cacgcacacacacaa

SEQ ID NO: 564186 - DNA, 13 bp, Homo sapiens
cacgcacgcacac

SEQ ID NO: 564187 - DNA, 14 bp, Homo sapiens
cacgcacgcacaca

SEQ ID NO: 564188 - DNA, 19 bp, Homo sapiens
cacggcctctggggagacc

SEQ ID NO: 564189 - DNA, 19 bp, Homo sapiens
cacgtagtagggtcaggcc

SEQ ID NO: 564190 - DNA, 12 bp, Homo sapiens
cactaaatgtta

SEQ ID NO: 564191 - DNA, 16 bp, Homo sapiens
cactaaatgttaaaga

SEQ ID NO: 564192 - DNA, 19 bp, Homo sapiens
cactaaatgttaaagatgt

SEQ ID NO: 564193 - DNA, 20 bp, Homo sapiens
cactaaatgttaaagatgta

SEQ ID NO: 564194 - DNA, 21 bp, Homo sapiens
cactaagtctcttttttacaa

SEQ ID NO: 564195 - DNA, 21 bp, Homo sapiens
cactcagagcagtctgtgact

SEQ ID NO: 564196 - DNA, 15 bp, Homo sapiens
cactccattcccaac

SEQ ID NO: 564197 - DNA, 18 bp, Homo sapiens
cactcctccctgatgtac

SEQ ID NO: 564198 - DNA, 11 bp, Homo sapiens
cactcctgctc

SEQ ID NO: 564199 - DNA, 15 bp, Homo sapiens
cactcctgctctgct

SEQ ID NO: 564200 - DNA, 23 bp, Homo sapiens
cactgaacttttcaaaataaagc

SEQ ID NO: 564201 - DNA, 15 bp, Homo sapiens
cactgaatccctgta

SEQ ID NO: 564202 - DNA, 17 bp, Homo sapiens
cactgaatctgtacaga

SEQ ID NO: 564203 - DNA, 15 bp, Homo sapiens
cactgagtacaaatg

SEQ ID NO: 564204 - DNA, 21 bp, Homo sapiens
cactgagtacaaatgtgtgac

SEQ ID NO: 564205 - DNA, 17 bp, Homo sapiens
cactgagtgaaatatta

SEQ ID NO: 564206 - DNA, 16 bp, Homo sapiens
cactgatatatttaaa

SEQ ID NO: 564207 - DNA, 18 bp, Homo sapiens
cactgatatattttccag

SEQ ID NO: 564208 - DNA, 20 bp, Homo sapiens
cactgccatttcctcctggg

SEQ ID NO: 564209 - DNA, 14 bp, Homo sapiens
cactgccctccgcc

SEQ ID NO: 564210 - DNA, 20 bp, Homo sapiens
cactgccctccgcccttccc

SEQ ID NO: 564211 - DNA, 21 bp, Homo sapiens
cactgccctccgcccttccct

SEQ ID NO: 564212 - DNA, 23 bp, Homo sapiens
cactgcctccccaaggccccctg

SEQ ID NO: 564213 - DNA, 13 bp, Homo sapiens
cactggctgtggg

SEQ ID NO: 564214 - DNA, 14 bp, Homo sapiens
cactggctgtgggc

SEQ ID NO: 564215 - DNA, 18 bp, Homo sapiens
cactggctgtgggctccc

SEQ ID NO: 564216 - DNA, 14 bp, Homo sapiens
cactggtctcagag

SEQ ID NO: 564217 - DNA, 16 bp, Homo sapiens
cactggtctcagagga

SEQ ID NO: 564218 - DNA, 17 bp, Homo sapiens
cactggtctcagaggag

SEQ ID NO: 564219 - DNA, 18 bp, Homo sapiens
cactggtgtatgaaatga

SEQ ID NO: 564220 - DNA, 13 bp, Homo sapiens
cactgtatttgtt

SEQ ID NO: 564221 - DNA, 14 bp, Homo sapiens
cactgtatttgtta

SEQ ID NO: 564222 - DNA, 14 bp, Homo sapiens
cactgtctgctgcc

SEQ ID NO: 564223 - DNA, 10 bp, Homo sapiens
cactgtctgt

SEQ ID NO: 564224 - DNA, 14 bp, Homo sapiens
cactgtgctataaa

SEQ ID NO: 564225 - DNA, 13 bp, Homo sapiens
cacttatttccat

SEQ ID NO: 564226 - DNA, 21 bp, Homo sapiens
cacttcagggcagattttagt

SEQ ID NO: 564227 - DNA, 18 bp, Homo sapiens
cacttccctgcttaaatt

SEQ ID NO: 564228 - DNA, 17 bp, Homo sapiens
cacttccgtcacatccc

SEQ ID NO: 564229 - DNA, 12 bp, Homo sapiens
cacttcttctgt

SEQ ID NO: 564230 - DNA, 20 bp, Homo sapiens
cacttcttctgtccaagcag

SEQ ID NO: 564231 - DNA, 13 bp, Homo sapiens
cacttctttccct

SEQ ID NO: 564232 - DNA, 15 bp, Homo sapiens
cacttctttcccttc

SEQ ID NO: 564233 - DNA, 21 bp, Homo sapiens
cacttctttcccttcctccat

SEQ ID NO: 564234 - DNA, 15 bp, Homo sapiens
cacttgaccttctgt

SEQ ID NO: 564235 - DNA, 12 bp, Homo sapiens
cactttaatgat

SEQ ID NO: 564236 - DNA, 16 bp, Homo sapiens
cactttgtataaattt

SEQ ID NO: 564237 - DNA, 18 bp, Homo sapiens
cactttgtataaattttt

SEQ ID NO: 564238 - DNA, 22 bp, Homo sapiens
cactttgtttcatattctcaga

SEQ ID NO: 564239 - DNA, 19 bp, Homo sapiens
cacttttattgtataatta

SEQ ID NO: 564240 - DNA, 16 bp, Homo sapiens
cacttttccagtattt

SEQ ID NO: 564241 - DNA, 21 bp, Homo sapiens
cactttttctttacaaacaaa

SEQ ID NO: 564242 - DNA, 12 bp, Homo sapiens
cagaaaaaaggt

SEQ ID NO: 564243 - DNA, 22 bp, Homo sapiens
cagaaaaaaggttctttgtgta

SEQ ID NO: 564244 - DNA, 19 bp, Homo sapiens
cagaaaacggttaaaactg

SEQ ID NO: 564245 - DNA, 20 bp, Homo sapiens
cagaaaacggttaaaactgt

SEQ ID NO: 564246 - DNA, 11 bp, Homo sapiens
cagaaaagcac

SEQ ID NO: 564247 - DNA, 18 bp, Homo sapiens
cagaaacacccacaggca

SEQ ID NO: 564248 - DNA, 22 bp, Homo sapiens
cagaaacccggcttcctgtgct

SEQ ID NO: 564249 - DNA, 18 bp, Homo sapiens
cagaaacttgttcttcca

SEQ ID NO: 564250 - DNA, 15 bp, Homo sapiens
cagaaatacaacaga

SEQ ID NO: 564251 - DNA, 19 bp, Homo sapiens
cagaaatatatatacatat

SEQ ID NO: 564252 - DNA, 22 bp, Homo sapiens
cagaaatatatatacatatgta

SEQ ID NO: 564253 - DNA, 22 bp, Homo sapiens
cagaaatgtccctttcttctcc

SEQ ID NO: 564254 - DNA, 13 bp, Homo sapiens
cagaaattcgccc

SEQ ID NO: 564255 - DNA, 15 bp, Homo sapiens
cagaaattggtacct

SEQ ID NO: 564256 - DNA, 19 bp, Homo sapiens
cagaaccattcactggcaa

SEQ ID NO: 564257 - DNA, 21 bp, Homo sapiens
cagaaccattcactggcaaat

SEQ ID NO: 564258 - DNA, 14 bp, Homo sapiens
cagaactcccttca

SEQ ID NO: 564259 - DNA, 22 bp, Homo sapiens
cagaactcttcctccaaggaca

SEQ ID NO: 564260 - DNA, 20 bp, Homo sapiens
cagaacttgaagcctgctcc

SEQ ID NO: 564261 - DNA, 17 bp, Homo sapiens
cagaagaagacagcaaa

SEQ ID NO: 564262 - DNA, 19 bp, Homo sapiens
cagaagccacccaaagcag

SEQ ID NO: 564263 - DNA, 19 bp, Homo sapiens
cagaagctcaaggctgcag

SEQ ID NO: 564264 - DNA, 17 bp, Homo sapiens
cagaaggaatcttctca

SEQ ID NO: 564265 - DNA, 15 bp, Homo sapiens
cagaaggctcctgcc

SEQ ID NO: 564266 - DNA, 16 bp, Homo sapiens
cagaagtccagagtct

SEQ ID NO: 564267 - DNA, 14 bp, Homo sapiens
cagaagtgaaaaag

SEQ ID NO: 564268 - DNA, 17 bp, Homo sapiens
cagaagtgaaaaagact

SEQ ID NO: 564269 - DNA, 18 bp, Homo sapiens
cagaagttatatttttaa

SEQ ID NO: 564270 - DNA, 15 bp, Homo sapiens
cagacaagctgttga

SEQ ID NO: 564271 - DNA, 15 bp, Homo sapiens
cagacacacacacac

SEQ ID NO: 564272 - DNA, 23 bp, Homo sapiens
cagacacacacacacacacacat

SEQ ID NO: 564273 - DNA, 14 bp, Homo sapiens
cagacacacacacg

SEQ ID NO: 564274 - DNA, 22 bp, Homo sapiens
cagacacacacacgcacgcaca

SEQ ID NO: 564275 - DNA, 15 bp, Homo sapiens
cagaccaggtgacct

SEQ ID NO: 564276 - DNA, 14 bp, Homo sapiens
cagaccagtagtga

SEQ ID NO: 564277 - DNA, 17 bp, Homo sapiens
cagaccagtagtgacca

SEQ ID NO: 564278 - DNA, 19 bp, Homo sapiens
cagaccagtagtgaccaat

SEQ ID NO: 564279 - DNA, 13 bp, Homo sapiens
cagacctgggccc

SEQ ID NO: 564280 - DNA, 17 bp, Homo sapiens
cagacctgggccctggt

SEQ ID NO: 564281 - DNA, 20 bp, Homo sapiens
cagacgcctgcttttgcaaa

SEQ ID NO: 564282 - DNA, 20 bp, Homo sapiens
cagactatccattttacact

SEQ ID NO: 564283 - DNA, 16 bp, Homo sapiens
cacagtgacacgtttg

SEQ ID NO: 564284 - DNA, 15 bp, Homo sapiens
cacagtgtctgtaaa

SEQ ID NO: 564285 - DNA, 20 bp, Homo sapiens
cacagtgtctgtaaatcaag

SEQ ID NO: 564286 - DNA, 21 bp, Homo sapiens
cacagtgtctgtaaatcaaga

SEQ ID NO: 564287 - DNA, 17 bp, Homo sapiens
cacagttatcttagctg

SEQ ID NO: 564288 - DNA, 15 bp, Homo sapiens
cacatacatatatac

SEQ ID NO: 564289 - DNA, 15 bp, Homo sapiens
cacatagactgtgcg

SEQ ID NO: 564290 - DNA, 14 bp, Homo sapiens
cacatatacctata

SEQ ID NO: 564291 - DNA, 23 bp, Homo sapiens
cacatatacctataatgtgtgta

SEQ ID NO: 564292 - DNA, 15 bp, Homo sapiens
cacatatatacatac

SEQ ID NO: 564293 - DNA, 18 bp, Homo sapiens
cacatatatacatacgca

SEQ ID NO: 564294 - DNA, 14 bp, Homo sapiens
cacatatatgtata

SEQ ID NO: 564295 - DNA, 16 bp, Homo sapiens
cacatattattggtca

SEQ ID NO: 564296 - DNA, 19 bp, Homo sapiens
cacatcataaacaaagagt

SEQ ID NO: 564297 - DNA, 21 bp, Homo sapiens
cacatcccaccccatcctcca

SEQ ID NO: 564298 - DNA, 12 bp, Homo sapiens
cacatgatttca

SEQ ID NO: 564299 - DNA, 16 bp, Homo sapiens
cacatgatttcacaaa

SEQ ID NO: 564300 - DNA, 17 bp, Homo sapiens
cacatgatttcacaaat

SEQ ID NO: 564301 - DNA, 15 bp, Homo sapiens
cacatgcacacacac

SEQ ID NO: 564302 - DNA, 13 bp, Homo sapiens
cacatgttttcaa

SEQ ID NO: 564303 - DNA, 14 bp, Homo sapiens
cacatgttttcaaa

SEQ ID NO: 564304 - DNA, 15 bp, Homo sapiens
cacatgttttcaaat

SEQ ID NO: 564305 - DNA, 18 bp, Homo sapiens
cacattaatggtctaaaa

SEQ ID NO: 564306 - DNA, 17 bp, Homo sapiens
cacattgaaactgtatt

SEQ ID NO: 564307 - DNA, 17 bp, Homo sapiens
cacattgcccacacctg

SEQ ID NO: 564308 - DNA, 18 bp, Homo sapiens
cacatttctcaacaaggc

SEQ ID NO: 564309 - DNA, 20 bp, Homo sapiens
caccaataaaggaggaatca

SEQ ID NO: 564310 - DNA, 14 bp, Homo sapiens
caccacagacacac

SEQ ID NO: 564311 - DNA, 21 bp, Homo sapiens
caccacagacacacacacgca

SEQ ID NO: 564312 - DNA, 17 bp, Homo sapiens
caccaccctccttccca

SEQ ID NO: 564313 - DNA, 20 bp, Homo sapiens
caccaccctgctcatccact

SEQ ID NO: 564314 - DNA, 20 bp, Homo sapiens
caccaccgaccaactccaga

SEQ ID NO: 564315 - DNA, 23 bp, Homo sapiens
caccacctgcccggcccaggagc

SEQ ID NO: 564316 - DNA, 14 bp, Homo sapiens
caccactccattcc

SEQ ID NO: 564317 - DNA, 16 bp, Homo sapiens
caccactttcccacac

SEQ ID NO: 564318 - DNA, 21 bp, Homo sapiens
caccagagcatttccaacacc

SEQ ID NO: 564319 - DNA, 14 bp, Homo sapiens
caccagctgtgtcc

SEQ ID NO: 564320 - DNA, 17 bp, Homo sapiens
actgcactctagccgga

SEQ ID NO: 564321 - DNA, 12 bp, Homo sapiens
actgccattttt

SEQ ID NO: 564322 - DNA, 22 bp, Homo sapiens
actgccattttttgtctgtgat

SEQ ID NO: 564323 - DNA, 22 bp, Homo sapiens
actgcccctgcacctgcttctc

SEQ ID NO: 564324 - DNA, 18 bp, Homo sapiens
actgcctcccccagggtc

SEQ ID NO: 564325 - DNA, 14 bp, Homo sapiens
actgcctggaaagc

SEQ ID NO: 564326 - DNA, 14 bp, Homo sapiens
actgccttaaaact

SEQ ID NO: 564327 - DNA, 17 bp, Homo sapiens
actgcgaggttgtttta

SEQ ID NO: 564328 - DNA, 21 bp, Homo sapiens
actgcgaggttgttttaaagt

SEQ ID NO: 564329 - DNA, 19 bp, Homo sapiens
actgctcttgggcaatatt

SEQ ID NO: 564330 - DNA, 22 bp, Homo sapiens
actgctcttgggcaatattctc

SEQ ID NO: 564331 - DNA, 22 bp, Homo sapiens
actgctgtaaagcaaaatattt

SEQ ID NO: 564332 - DNA, 23 bp, Homo sapiens
actggaataagaagcaaataaat

SEQ ID NO: 564333 - DNA, 22 bp, Homo sapiens
actggacctttgggttctttct

SEQ ID NO: 564334 - DNA, 16 bp, Homo sapiens
actggctgtgggctcc

SEQ ID NO: 564335 - DNA, 17 bp, Homo sapiens
actggctgtgggctccc

SEQ ID NO: 564336 - DNA, 19 bp, Homo sapiens
actggctgtgggctccctt

SEQ ID NO: 564337 - DNA, 22 bp, Homo sapiens
actggctgtgggctcccttcct

SEQ ID NO: 564338 - DNA, 23 bp, Homo sapiens
actggcttgaattggtgacattt

SEQ ID NO: 564339 - DNA, 15 bp, Homo sapiens
actgggccaggggag

SEQ ID NO: 564340 - DNA, 13 bp, Homo sapiens
actggtggaagga

SEQ ID NO: 564341 - DNA, 14 bp, Homo sapiens
actggtgttaatga

SEQ ID NO: 564342 - DNA, 18 bp, Homo sapiens
actggtgttaatgagtat

SEQ ID NO: 564343 - DNA, 22 bp, Homo sapiens
actggtgttaatgagtatatgt

SEQ ID NO: 564344 - DNA, 17 bp, Homo sapiens
actgtaaaatacttctt

SEQ ID NO: 564345 - DNA, 16 bp, Homo sapiens
actgtaaattccaaag

SEQ ID NO: 564346 - DNA, 23 bp, Homo sapiens
actgtagataattaaccaaggta

SEQ ID NO: 564347 - DNA, 16 bp, Homo sapiens
actgtatttgttaatt

SEQ ID NO: 564348 - DNA, 24 bp, Homo sapiens
actgtctagcacttccttgccagt

SEQ ID NO: 564349 - DNA, 20 bp, Homo sapiens
actgtgacacagctgagctg

SEQ ID NO: 564350 - DNA, 14 bp, Homo sapiens
actgtgacatctct

SEQ ID NO: 564351 - DNA, 22 bp, Homo sapiens
actgtgcgcataggcctgcttt

SEQ ID NO: 564352 - DNA, 22 bp, Homo sapiens
actgttaccattggaaatttca

SEQ ID NO: 564353 - DNA, 13 bp, Homo sapiens
actgttataaatt

SEQ ID NO: 564354 - DNA, 16 bp, Homo sapiens
actgttataaattttg

SEQ ID NO: 564355 - DNA, 12 bp, Homo sapiens
actgttcaattt

SEQ ID NO: 564356 - DNA, 20 bp, Homo sapiens
actgtttattaccagattca

SEQ ID NO: 564357 - DNA, 15 bp, Homo sapiens
acttaactttaactt

SEQ ID NO: 564358 - DNA, 12 bp, Homo sapiens
acttaagagaaa

SEQ ID NO: 564359 - DNA, 13 bp, Homo sapiens
acttaagagaaat

SEQ ID NO: 564360 - DNA, 15 bp, Homo sapiens
acttaagagaaatgg

SEQ ID NO: 564361 - DNA, 16 bp, Homo sapiens
acttacaagactgtaa

SEQ ID NO: 564362 - DNA, 22 bp, Homo sapiens
acttagagctttttttttttaa

SEQ ID NO: 564363 - DNA, 19 bp, Homo sapiens
acttagctggagatgtctc

SEQ ID NO: 564364 - DNA, 18 bp, Homo sapiens
acttagtgtctctattta

SEQ ID NO: 564365 - DNA, 22 bp, Homo sapiens
acttatattctgcagaaaatta

SEQ ID NO: 564366 - DNA, 23 bp, Homo sapiens
acttatttgctcataagtaaatg

SEQ ID NO: 564367 - DNA, 23 bp, Homo sapiens
acttcagaaacccggcttcctgt

SEQ ID NO: 564368 - DNA, 19 bp, Homo sapiens
acttcagggcagattttag

SEQ ID NO: 564369 - DNA, 22 bp, Homo sapiens
acttcctgattggtttctcttc

SEQ ID NO: 564370 - DNA, 23 bp, Homo sapiens
acttcctgattggtttctcttct

SEQ ID NO: 564371 - DNA, 21 bp, Homo sapiens
acttcctgcctggtctcctgc

SEQ ID NO: 564372 - DNA, 20 bp, Homo sapiens
acttcctgctacagtagctg

SEQ ID NO: 564373 - DNA, 14 bp, Homo sapiens
acttccttgccagt

SEQ ID NO: 564374 - DNA, 16 bp, Homo sapiens
acttctaaaactgtac

SEQ ID NO: 564375 - DNA, 18 bp, Homo sapiens
acttctactgttcaattt

SEQ ID NO: 564376 - DNA, 22 bp, Homo sapiens
acttctattttcaagtggaaac

SEQ ID NO: 564377 - DNA, 15 bp, Homo sapiens
acttctcaaatgcta

SEQ ID NO: 564378 - DNA, 18 bp, Homo sapiens
acttctttcccttcctcc

SEQ ID NO: 564379 - DNA, 14 bp, Homo sapiens
acttgaagcctgct

SEQ ID NO: 564380 - DNA, 16 bp, Homo sapiens
acttgaagcctgctcc

SEQ ID NO: 564381 - DNA, 19 bp, Homo sapiens
acttgaagcctgctccttc

SEQ ID NO: 564382 - DNA, 20 bp, Homo sapiens
acttgaagcctgctccttcc

SEQ ID NO: 564383 - DNA, 13 bp, Homo sapiens
acttgattcttgt

SEQ ID NO: 564384 - DNA, 16 bp, Homo sapiens
acttgctgtgaaatga

SEQ ID NO: 564385 - DNA, 14 bp, Homo sapiens
acttgcttaaatgt

SEQ ID NO: 564386 - DNA, 16 bp, Homo sapiens
acttgcttaaatgtga

SEQ ID NO: 564387 - DNA, 18 bp, Homo sapiens
acttgcttaaatgtgaat

SEQ ID NO: 564388 - DNA, 17 bp, Homo sapiens
acttgctttatttttca

SEQ ID NO: 564389 - DNA, 21 bp, Homo sapiens
acttgctttatttttcattac

SEQ ID NO: 564390 - DNA, 15 bp, Homo sapiens
acttggaacagtgtt

SEQ ID NO: 564391 - DNA, 18 bp, Homo sapiens
acttggcaccaataaagg

SEQ ID NO: 564392 - DNA, 21 bp, Homo sapiens
acttggtcttttttctgggtc

SEQ ID NO: 564393 - DNA, 19 bp, Homo sapiens
acttgtcttaaataaaaga

SEQ ID NO: 564394 - DNA, 14 bp, Homo sapiens
acttgtctttctgg

SEQ ID NO: 564395 - DNA, 17 bp, Homo sapiens
acttgtgcacaggcaga

SEQ ID NO: 564396 - DNA, 14 bp, Homo sapiens
acttgtttaataaa

SEQ ID NO: 564397 - DNA, 19 bp, Homo sapiens
actttaacttccactttgt

SEQ ID NO: 564398 - DNA, 17 bp, Homo sapiens
actttaacttttgaaaa

SEQ ID NO: 564399 - DNA, 14 bp, Homo sapiens
actttaagagagaa

SEQ ID NO: 564400 - DNA, 16 bp, Homo sapiens
actttaagagagaaat

SEQ ID NO: 564401 - DNA, 17 bp, Homo sapiens
actttaagagagaaatc

SEQ ID NO: 564402 - DNA, 23 bp, Homo sapiens
actttaagagagaaatctgaaaa

SEQ ID NO: 564403 - DNA, 12 bp, Homo sapiens
actttaatgata

SEQ ID NO: 564404 - DNA, 18 bp, Homo sapiens
actttatagaagaatgca

SEQ ID NO: 564405 - DNA, 17 bp, Homo sapiens
actttccaattctcctt

SEQ ID NO: 564406 - DNA, 15 bp, Homo sapiens
actttcccacactgt

SEQ ID NO: 564407 - DNA, 17 bp, Homo sapiens
actttctgtactaaaca

SEQ ID NO: 564408 - DNA, 22 bp, Homo sapiens
actttctgtactaaacatttcc

SEQ ID NO: 564409 - DNA, 22 bp, Homo sapiens
cagagacaaatatttctagaca

SEQ ID NO: 564410 - DNA, 14 bp, Homo sapiens
cagagacagagagg

SEQ ID NO: 564411 - DNA, 15 bp, Homo sapiens
cagagacccccgtgc

SEQ ID NO: 564412 - DNA, 12 bp, Homo sapiens
cagagagcatta

SEQ ID NO: 564413 - DNA, 19 bp, Homo sapiens
cagagcacaaacttcagaa

SEQ ID NO: 564414 - DNA, 20 bp, Homo sapiens
cagagccgtaaaaactgaag

SEQ ID NO: 564415 - DNA, 13 bp, Homo sapiens
cagagcctgcccc

SEQ ID NO: 564416 - DNA, 19 bp, Homo sapiens
cagagcctgccccagcgct

SEQ ID NO: 564417 - DNA, 16 bp, Homo sapiens
cagagcgacagagcag

SEQ ID NO: 564418 - DNA, 17 bp, Homo sapiens
cagagcgatgtgttctt

SEQ ID NO: 564419 - DNA, 21 bp, Homo sapiens
cagagcgatgtgttctttgta

SEQ ID NO: 564420 - DNA, 22 bp, Homo sapiens
cagagcgatgtgttctttgtac

SEQ ID NO: 564421 - DNA, 13 bp, Homo sapiens
cagagctcccagg

SEQ ID NO: 564422 - DNA, 14 bp, Homo sapiens
cagagctcccagga

SEQ ID NO: 564423 - DNA, 20 bp, Homo sapiens
cagagctcccaggacgcagg

SEQ ID NO: 564424 - DNA, 12 bp, Homo sapiens
cagagctgaaga

SEQ ID NO: 564425 - DNA, 22 bp, Homo sapiens
cagaggacacctgtactggaga

SEQ ID NO: 564426 - DNA, 16 bp, Homo sapiens
cagaggcctcctgtgg

SEQ ID NO: 564427 - DNA, 19 bp, Homo sapiens
cagaggtgagggaggcctg

SEQ ID NO: 564428 - DNA, 20 bp, Homo sapiens
cagagtctagcgtagtgcag

SEQ ID NO: 564429 - DNA, 19 bp, Homo sapiens
cagagtgaaattcaattca

SEQ ID NO: 564430 - DNA, 14 bp, Homo sapiens
cagagtgaagagtg

SEQ ID NO: 564431 - DNA, 17 bp, Homo sapiens
cagagtgaagagtgaag

SEQ ID NO: 564432 - DNA, 18 bp, Homo sapiens
cagagtgaagagtgaaga

SEQ ID NO: 564433 - DNA, 19 bp, Homo sapiens
cagagtgaagagtgaagag

SEQ ID NO: 564434 - DNA, 22 bp, Homo sapiens
cagatactactgaccagacaag

SEQ ID NO: 564435 - DNA, 17 bp, Homo sapiens
cagatcacatgcccctc

SEQ ID NO: 564436 - DNA, 23 bp, Homo sapiens
cagatcacatgcccctcttagaa

SEQ ID NO: 564437 - DNA, 13 bp, Homo sapiens
cagatcagccaga

SEQ ID NO: 564438 - DNA, 14 bp, Homo sapiens
cagatccacctgca

SEQ ID NO: 564439 - DNA, 18 bp, Homo sapiens
cagatccaggaacacatg

SEQ ID NO: 564440 - DNA, 14 bp, Homo sapiens
cagatcttcttttg

SEQ ID NO: 564441 - DNA, 19 bp, Homo sapiens
cagatgatccttgcacaga

SEQ ID NO: 564442 - DNA, 21 bp, Homo sapiens
cagatgatccttgcacagaca

SEQ ID NO: 564443 - DNA, 14 bp, Homo sapiens
cagatgcagctctt

SEQ ID NO: 564444 - DNA, 15 bp, Homo sapiens
cagatgcagctcttc

SEQ ID NO: 564445 - DNA, 12 bp, Homo sapiens
cagatgctctga

SEQ ID NO: 564446 - DNA, 13 bp, Homo sapiens
cagatgctctgag

SEQ ID NO: 564447 - DNA, 20 bp, Homo sapiens
cagatgggaacagtaaagaa

SEQ ID NO: 564448 - DNA, 17 bp, Homo sapiens
cagattcacttctgaat

SEQ ID NO: 564449 - DNA, 21 bp, Homo sapiens
cagattcctgccccatcactt

SEQ ID NO: 564450 - DNA, 19 bp, Homo sapiens
cagattcgtggtcttttcc

SEQ ID NO: 564451 - DNA, 21 bp, Homo sapiens
cagattcgtggtcttttcctc

SEQ ID NO: 564452 - DNA, 19 bp, Homo sapiens
cagatttatttttgaaaca

SEQ ID NO: 564453 - DNA, 22 bp, Homo sapiens
cagatttgcaacagcaaattaa

SEQ ID NO: 564454 - DNA, 14 bp, Homo sapiens
cagatttgcacaaa

SEQ ID NO: 564455 - DNA, 17 bp, Homo sapiens
cagatttgcacaaaaag

SEQ ID NO: 564456 - DNA, 13 bp, Homo sapiens
cagatttgtataa

SEQ ID NO: 564457 - DNA, 20 bp, Homo sapiens
cagcaaaaaaagcaactttt

SEQ ID NO: 564458 - DNA, 15 bp, Homo sapiens
cagcaaacacagtca

SEQ ID NO: 564459 - DNA, 16 bp, Homo sapiens
cagcaaacacagtcac

SEQ ID NO: 564460 - DNA, 19 bp, Homo sapiens
cagcaaggcgctaacttgc

SEQ ID NO: 564461 - DNA, 15 bp, Homo sapiens
cagcaaggtcttgct

SEQ ID NO: 564462 - DNA, 13 bp, Homo sapiens
cagcacagagagg

SEQ ID NO: 564463 - DNA, 16 bp, Homo sapiens
cagcacagcctcaccc

SEQ ID NO: 564464 - DNA, 19 bp, Homo sapiens
cagcactttcttcttccca

SEQ ID NO: 564465 - DNA, 23 bp, Homo sapiens
cagcagaattgaccgacagcttt

SEQ ID NO: 564466 - DNA, 12 bp, Homo sapiens
cagcagatccac

SEQ ID NO: 564467 - DNA, 16 bp, Homo sapiens
cagcagatccacctgc

SEQ ID NO: 564468 - DNA, 19 bp, Homo sapiens
cagcagcagtttgtgatct

SEQ ID NO: 564469 - DNA, 18 bp, Homo sapiens
cagcagcggcagcagcag

SEQ ID NO: 564470 - DNA, 18 bp, Homo sapiens
cagcagctagaaagagaa

SEQ ID NO: 564471 - DNA, 19 bp, Homo sapiens
cagcagctagaaagagaaa

SEQ ID NO: 564472 - DNA, 21 bp, Homo sapiens
cagcagctgaagccagctccc

SEQ ID NO: 564473 - DNA, 16 bp, Homo sapiens
cagcagcttcaccaga

SEQ ID NO: 564474 - DNA, 12 bp, Homo sapiens
cagcaggcagcc

SEQ ID NO: 564475 - DNA, 21 bp, Homo sapiens
cagcagtcttatgcttccaga

SEQ ID NO: 564476 - DNA, 22 bp, Homo sapiens
cagcagtcttatgcttccagaa

SEQ ID NO: 564477 - DNA, 20 bp, Homo sapiens
cagcatatatataaaataca

SEQ ID NO: 564478 - DNA, 14 bp, Homo sapiens
cagcatctggaaga

SEQ ID NO: 564479 - DNA, 13 bp, Homo sapiens
cagcattggcctg

SEQ ID NO: 564480 - DNA, 22 bp, Homo sapiens
cagcattggcctggccagacca

SEQ ID NO: 564481 - DNA, 12 bp, Homo sapiens
cagcatttcaag

SEQ ID NO: 564482 - DNA, 23 bp, Homo sapiens
cagccagaagccacccaaagcag

SEQ ID NO: 564483 - DNA, 17 bp, Homo sapiens
cagccagtttagagaaa

SEQ ID NO: 564484 - DNA, 18 bp, Homo sapiens
cagccagtttagagaaat

SEQ ID NO: 564485 - DNA, 18 bp, Homo sapiens
cagccataggccctttca

SEQ ID NO: 564486 - DNA, 17 bp, Homo sapiens
cagcccaatccctgatc

SEQ ID NO: 564487 - DNA, 22 bp, Homo sapiens
cagcccagaggccgagagctat

SEQ ID NO: 564488 - DNA, 19 bp, Homo sapiens
cagcccaggcatctccttg

SEQ ID NO: 564489 - DNA, 20 bp, Homo sapiens
cagcccaggcatctccttgg

SEQ ID NO: 564490 - DNA, 22 bp, Homo sapiens
cagccccaaattgtcacctgct

SEQ ID NO: 564491 - DNA, 17 bp, Homo sapiens
cagccccaccctgtttt

SEQ ID NO: 564492 - DNA, 14 bp, Homo sapiens
cagccccccagtgt

SEQ ID NO: 564493 - DNA, 12 bp, Homo sapiens
cagccccctggc

SEQ ID NO: 564494 - DNA, 16 bp, Homo sapiens
cagccccctggcccct

SEQ ID NO: 564495 - DNA, 13 bp, Homo sapiens
cagcccctggggt

SEQ ID NO: 564496 - DNA, 22 bp, Homo sapiens
cagcccgggagatccgccctgg

SEQ ID NO: 564497 - DNA, 19 bp, Homo sapiens
cagccctcattaaactaat

SEQ ID NO: 564498 - DNA, 17 bp, Homo sapiens
cagcccttcctctgctc

SEQ ID NO: 564499 - DNA, 13 bp, Homo sapiens
cagccgctccaga

SEQ ID NO: 564500 - DNA, 14 bp, Homo sapiens
cagccgctccagag

SEQ ID NO: 564501 - DNA, 16 bp, Homo sapiens
cagcctcacccctgca

SEQ ID NO: 564502 - DNA, 21 bp, Homo sapiens
cagcctcgcaggcctccctgc

SEQ ID NO: 564503 - DNA, 22 bp, Homo sapiens
cagcctcgcaggcctccctgcc

SEQ ID NO: 564504 - DNA, 14 bp, Homo sapiens
cagcctgcgtggct

SEQ ID NO: 564505 - DNA, 19 bp, Homo sapiens
cagcctgcgtggctgaccc

SEQ ID NO: 564506 - DNA, 23 bp, Homo sapiens
cagcctgcgtggctgacccccct

SEQ ID NO: 564507 - DNA, 20 bp, Homo sapiens
cagcctgggataggggcaga

SEQ ID NO: 564508 - DNA, 19 bp, Homo sapiens
cagcctggtcgccttccac

SEQ ID NO: 564509 - DNA, 20 bp, Homo sapiens
cagccttaaacagtgtccag

SEQ ID NO: 564510 - DNA, 12 bp, Homo sapiens
cagcgagtctgg

SEQ ID NO: 564511 - DNA, 17 bp, Homo sapiens
cagcgagtctggagacc

SEQ ID NO: 564512 - DNA, 23 bp, Homo sapiens
cagcgcaacagctgtgtgtgccc

SEQ ID NO: 564513 - DNA, 15 bp, Homo sapiens
cagctaagcctgatg

SEQ ID NO: 564514 - DNA, 15 bp, Homo sapiens
cagctactccggagg

SEQ ID NO: 564515 - DNA, 17 bp, Homo sapiens
cagctacttaagagaaa

SEQ ID NO: 564516 - DNA, 14 bp, Homo sapiens
cagctagaaagaga

SEQ ID NO: 564517 - DNA, 16 bp, Homo sapiens
cagctagaaagagaaa

SEQ ID NO: 564518 - DNA, 19 bp, Homo sapiens
cagctaggaacaaatcttc

SEQ ID NO: 564519 - DNA, 16 bp, Homo sapiens
cagctcccccagctcc

SEQ ID NO: 564520 - DNA, 17 bp, Homo sapiens
cagctcccttctgttga

SEQ ID NO: 564521 - DNA, 17 bp, Homo sapiens
cagctccgcctctgtcc

SEQ ID NO: 564522 - DNA, 22 bp, Homo sapiens
cagctccggcgtgtgttcagtg

SEQ ID NO: 564523 - DNA, 13 bp, Homo sapiens
cagctccttttcc

SEQ ID NO: 564524 - DNA, 22 bp, Homo sapiens
cagctcgctggatggcggaagc

SEQ ID NO: 564525 - DNA, 23 bp, Homo sapiens
cagctctcatgctgcccctgcct

SEQ ID NO: 564526 - DNA, 17 bp, Homo sapiens
cagctctcccctccctt

SEQ ID NO: 564527 - DNA, 16 bp, Homo sapiens
cagctctcccctgcgc

SEQ ID NO: 564528 - DNA, 19 bp, Homo sapiens
cagctctcccctgcgcagg

SEQ ID NO: 564529 - DNA, 19 bp, Homo sapiens
cagctctgagatcctggag

SEQ ID NO: 564530 - DNA, 18 bp, Homo sapiens
cagctctggcatggctag

SEQ ID NO: 564531 - DNA, 23 bp, Homo sapiens
cagctcttcctggacaggccagg

SEQ ID NO: 564532 - DNA, 13 bp, Homo sapiens
cagctgaagccag

SEQ ID NO: 564533 - DNA, 15 bp, Homo sapiens
cagctgaagccagct

SEQ ID NO: 564534 - DNA, 15 bp, Homo sapiens
cagctgagccttctg

SEQ ID NO: 564535 - DNA, 17 bp, Homo sapiens
cagctgagccttctgag

SEQ ID NO: 564536 - DNA, 16 bp, Homo sapiens
cagctgcagagacaga

SEQ ID NO: 564537 - DNA, 15 bp, Homo sapiens
cagctgcaggaatca

SEQ ID NO: 564538 - DNA, 15 bp, Homo sapiens
cagctgcatggcaca

SEQ ID NO: 564539 - DNA, 20 bp, Homo sapiens
cagctgcatggcacatacca

SEQ ID NO: 564540 - DNA, 14 bp, Homo sapiens
cagctggacacccc

SEQ ID NO: 564541 - DNA, 19 bp, Homo sapiens
cagctggccaccatggcac

SEQ ID NO: 564542 - DNA, 14 bp, Homo sapiens
cagctgtctgtggc

SEQ ID NO: 564543 - DNA, 16 bp, Homo sapiens
cagctgtctgtggctt

SEQ ID NO: 564544 - DNA, 14 bp, Homo sapiens
cagctgtgagcttt

SEQ ID NO: 564545 - DNA, 19 bp, Homo sapiens
cagctgttgtctcttctcc

SEQ ID NO: 564546 - DNA, 21 bp, Homo sapiens
cagctgttgtctcttctcctt

SEQ ID NO: 564547 - DNA, 15 bp, Homo sapiens
cagcttcacttctga

SEQ ID NO: 564548 - DNA, 13 bp, Homo sapiens
cagcttccagatg

SEQ ID NO: 564549 - DNA, 20 bp, Homo sapiens
cagcttccagatgatccttg

SEQ ID NO: 564550 - DNA, 16 bp, Homo sapiens
caggaaaacacccagg

SEQ ID NO: 564551 - DNA, 19 bp, Homo sapiens
caggaaaacacccagggaa

SEQ ID NO: 564552 - DNA, 14 bp, Homo sapiens
caggaaaagaaaaa

SEQ ID NO: 564553 - DNA, 15 bp, Homo sapiens
caggaaaagaaaaat

SEQ ID NO: 564554 - DNA, 21 bp, Homo sapiens
caggaaagtggcacctgtctg

SEQ ID NO: 564555 - DNA, 22 bp, Homo sapiens
caggaaagtggcacctgtctgc

SEQ ID NO: 564556 - DNA, 23 bp, Homo sapiens
caggaaatatctgtgaaggactt

SEQ ID NO: 564557 - DNA, 18 bp, Homo sapiens
caggaacacatgcacaca

SEQ ID NO: 564558 - DNA, 19 bp, Homo sapiens
caggaacacatgcacacac

SEQ ID NO: 564559 - DNA, 13 bp, Homo sapiens
caggaagaagaga

SEQ ID NO: 564560 - DNA, 14 bp, Homo sapiens
caggaagcctcctg

SEQ ID NO: 564561 - DNA, 14 bp, Homo sapiens
caggaagtccctga

SEQ ID NO: 564562 - DNA, 21 bp, Homo sapiens
caggaagtccttatctagctg

SEQ ID NO: 564563 - DNA, 17 bp, Homo sapiens
caggaccccatctgctg

SEQ ID NO: 564564 - DNA, 18 bp, Homo sapiens
caggaccccatctgctga

SEQ ID NO: 564565 - DNA, 22 bp, Homo sapiens
caggaccctcgctggcccccac

SEQ ID NO: 564566 - DNA, 13 bp, Homo sapiens
caggaccctgagg

SEQ ID NO: 564567 - DNA, 21 bp, Homo sapiens
caggactcgggctaagtccag

SEQ ID NO: 564568 - DNA, 12 bp, Homo sapiens
caggagaagaaa

SEQ ID NO: 564569 - DNA, 19 bp, Homo sapiens
caggagaagaaagaactat

SEQ ID NO: 564570 - DNA, 13 bp, Homo sapiens
caggagacactgg

SEQ ID NO: 564571 - DNA, 20 bp, Homo sapiens
caggagacactggtctcaga

SEQ ID NO: 564572 - DNA, 21 bp, Homo sapiens
caggagacactggtctcagag

SEQ ID NO: 564573 - DNA, 15 bp, Homo sapiens
caggagctcaggaag

SEQ ID NO: 564574 - DNA, 23 bp, Homo sapiens
caggaggctccatccttctcccc

SEQ ID NO: 564575 - DNA, 21 bp, Homo sapiens
caggaggctgggacgctctgc

SEQ ID NO: 564576 - DNA, 13 bp, Homo sapiens
caggaggggagtg

SEQ ID NO: 564577 - DNA, 13 bp, Homo sapiens
caggaggtgcctg

SEQ ID NO: 564578 - DNA, 16 bp, Homo sapiens
caggaggtgcctgaga

SEQ ID NO: 564579 - DNA, 19 bp, Homo sapiens
caggaggtgcctgagagca

SEQ ID NO: 564580 - DNA, 20 bp, Homo sapiens
caggaggtgcctgagagcag

SEQ ID NO: 564581 - DNA, 18 bp, Homo sapiens
caggagtgggtgggacac

SEQ ID NO: 564582 - DNA, 23 bp, Homo sapiens
caggagttcaagaccagcctggc

SEQ ID NO: 564583 - DNA, 19 bp, Homo sapiens
caggataatatatttgcag

SEQ ID NO: 564584 - DNA, 20 bp, Homo sapiens
caggataatatatttgcaga

SEQ ID NO: 564585 - DNA, 18 bp, Homo sapiens
caggatgcatattaaaga

SEQ ID NO: 564586 - DNA, 18 bp, Homo sapiens
caggatggcgtgtcccct

SEQ ID NO: 564587 - DNA, 21 bp, Homo sapiens
caggatgggggagagggggag

SEQ ID NO: 564588 - DNA, 11 bp, Homo sapiens
caggcactctc

SEQ ID NO: 564589 - DNA, 14 bp, Homo sapiens
caggcagagcccag

SEQ ID NO: 564590 - DNA, 18 bp, Homo sapiens
caggcaggggccctgcag

SEQ ID NO: 564591 - DNA, 20 bp, Homo sapiens
caggcaggggccctgcagct

SEQ ID NO: 564592 - DNA, 23 bp, Homo sapiens
caggcaggggccctgcagctctc

SEQ ID NO: 564593 - DNA, 13 bp, Homo sapiens
caggcatctcctt

SEQ ID NO: 564594 - DNA, 14 bp, Homo sapiens
caggcatgaccctg

SEQ ID NO: 564595 - DNA, 18 bp, Homo sapiens
caggcatgaccctggagc

SEQ ID NO: 564596 - DNA, 17 bp, Homo sapiens
caggcccatgccctccg

SEQ ID NO: 564597 - DNA, 14 bp, Homo sapiens
caggcccccctgtc

SEQ ID NO: 564598 - DNA, 22 bp, Homo sapiens
caggcccgaaggtctctctggc

SEQ ID NO: 564599 - DNA, 17 bp, Homo sapiens
caggccgggcagagcac

SEQ ID NO: 564600 - DNA, 15 bp, Homo sapiens
caggccgtggctgcc

SEQ ID NO: 564601 - DNA, 22 bp, Homo sapiens
caggcgctagcacagctccctt

SEQ ID NO: 564602 - DNA, 19 bp, Homo sapiens
caggcggtatccagaggtg

SEQ ID NO: 564603 - DNA, 19 bp, Homo sapiens
caggcgtagggccagggct

SEQ ID NO: 564604 - DNA, 20 bp, Homo sapiens
caggcgtagggccagggctc

SEQ ID NO: 564605 - DNA, 19 bp, Homo sapiens
caggctccctccctcccag

SEQ ID NO: 564606 - DNA, 20 bp, Homo sapiens
caggctccctccctcccaga

SEQ ID NO: 564607 - DNA, 21 bp, Homo sapiens
caggctggcctggggtcaggc

SEQ ID NO: 564608 - DNA, 19 bp, Homo sapiens
cagggaactaggaaggcac

SEQ ID NO: 564609 - DNA, 21 bp, Homo sapiens
cagggacttcaggatcaagtc

SEQ ID NO: 564610 - DNA, 16 bp, Homo sapiens
cagggagaccctggga

SEQ ID NO: 564611 - DNA, 15 bp, Homo sapiens
cagggagccctgggg

SEQ ID NO: 564612 - DNA, 20 bp, Homo sapiens
cagggaggtgtgaggcagga

SEQ ID NO: 564613 - DNA, 21 bp, Homo sapiens
cagggcaggcagagctcagca

SEQ ID NO: 564614 - DNA, 24 bp, Homo sapiens
cagggcatgaaatgaacacaaatt

SEQ ID NO: 564615 - DNA, 21 bp, Homo sapiens
cagggctccacgggggcctag

SEQ ID NO: 564616 - DNA, 23 bp, Homo sapiens
cagggctccacgggggcctagtg

SEQ ID NO: 564617 - DNA, 19 bp, Homo sapiens
cagggctctggcaggtggc

SEQ ID NO: 564618 - DNA, 17 bp, Homo sapiens
caggggagacgaggcca

SEQ ID NO: 564619 - DNA, 13 bp, Homo sapiens
cagggggccaggt

SEQ ID NO: 564620 - DNA, 16 bp, Homo sapiens
cagggggccaggtgca

SEQ ID NO: 564621 - DNA, 22 bp, Homo sapiens
cagggtcctgggggctgctgca

SEQ ID NO: 564622 - DNA, 15 bp, Homo sapiens
cagggtctcgtcagg

SEQ ID NO: 564623 - DNA, 16 bp, Homo sapiens
cagggtctcgtcagga

SEQ ID NO: 564624 - DNA, 23 bp, Homo sapiens
cagggtgtctgccccctcctgag

SEQ ID NO: 564625 - DNA, 17 bp, Homo sapiens
caggtagaacgccaggg

SEQ ID NO: 564626 - DNA, 21 bp, Homo sapiens
caggtagaacgccagggaccc

SEQ ID NO: 564627 - DNA, 21 bp, Homo sapiens
caggtatctgatgatgttctg

SEQ ID NO: 564628 - DNA, 13 bp, Homo sapiens
caggtcctgctca

SEQ ID NO: 564629 - DNA, 17 bp, Homo sapiens
caggtgaaaatgttcat

SEQ ID NO: 564630 - DNA, 14 bp, Homo sapiens
caggtggccagggc

SEQ ID NO: 564631 - DNA, 16 bp, Homo sapiens
caggtggccagggctc

SEQ ID NO: 564632 - DNA, 16 bp, Homo sapiens
caggtgtgagggcagt

SEQ ID NO: 564633 - DNA, 16 bp, Homo sapiens
caggttgacaggaggt

SEQ ID NO: 564634 - DNA, 16 bp, Homo sapiens
cagtaaacctgtctga

SEQ ID NO: 564635 - DNA, 14 bp, Homo sapiens
cagtaaatgtatat

SEQ ID NO: 564636 - DNA, 20 bp, Homo sapiens
cagttggactgtggcctcag

SEQ ID NO: 564637 - DNA, 18 bp, Homo sapiens
cagttgggaaaatatgtc

SEQ ID NO: 564638 - DNA, 11 bp, Homo sapiens
cagtttaacag

SEQ ID NO: 564639 - DNA, 15 bp, Homo sapiens
cagtttagagttcta

SEQ ID NO: 564640 - DNA, 22 bp, Homo sapiens
cagtttattccagagctgccag

SEQ ID NO: 564641 - DNA, 17 bp, Homo sapiens
cagtttcaataaagttt

SEQ ID NO: 564642 - DNA, 11 bp, Homo sapiens
cagtttccaag

SEQ ID NO: 564643 - DNA, 12 bp, Homo sapiens
cagtttgtgatc

SEQ ID NO: 564644 - DNA, 13 bp, Homo sapiens
cagtttttcttaa

SEQ ID NO: 564645 - DNA, 19 bp, Homo sapiens
cagtttttcttaatatata

SEQ ID NO: 564646 - DNA, 13 bp, Homo sapiens
cagtttttgtgtt

SEQ ID NO: 564647 - DNA, 13 bp, Homo sapiens
cataaattgtaat

SEQ ID NO: 564648 - DNA, 15 bp, Homo sapiens
cataaattgtaattt

SEQ ID NO: 564649 - DNA, 17 bp, Homo sapiens
cataaattgtaatttgg

SEQ ID NO: 564650 - DNA, 21 bp, Homo sapiens
cataaattgtaatttgggaac

SEQ ID NO: 564651 - DNA, 17 bp, Homo sapiens
cataaccgcacagacat

SEQ ID NO: 564652 - DNA, 13 bp, Homo sapiens
cataagtaaatgt

SEQ ID NO: 564653 - DNA, 18 bp, Homo sapiens
cataagtaaatgtcttca

SEQ ID NO: 564654 - DNA, 21 bp, Homo sapiens
cataagtaagacttgattggt

SEQ ID NO: 564655 - DNA, 16 bp, Homo sapiens
cataatatgcatatat

SEQ ID NO: 564656 - DNA, 19 bp, Homo sapiens
cataatatgcatatatatg

SEQ ID NO: 564657 - DNA, 21 bp, Homo sapiens
cataatatgcatatatatgta

SEQ ID NO: 564658 - DNA, 13 bp, Homo sapiens
cataatgcttctt

SEQ ID NO: 564659 - DNA, 21 bp, Homo sapiens
cataattcattaaaaacattt

SEQ ID NO: 564660 - DNA, 17 bp, Homo sapiens
cataattctgaagttat

SEQ ID NO: 564661 - DNA, 22 bp, Homo sapiens
cataattctgaagttatatttc

SEQ ID NO: 564662 - DNA, 17 bp, Homo sapiens
catacaaacaagcatat

SEQ ID NO: 564663 - DNA, 16 bp, Homo sapiens
catacaatttactttt

SEQ ID NO: 564664 - DNA, 20 bp, Homo sapiens
catacacagaaatcctaaca

SEQ ID NO: 564665 - DNA, 19 bp, Homo sapiens
catacacttgtataaatgt

SEQ ID NO: 564666 - DNA, 20 bp, Homo sapiens
catacacttgtataaatgta

SEQ ID NO: 564667 - DNA, 21 bp, Homo sapiens
catacacttgtataaatgtat

SEQ ID NO: 564668 - DNA, 22 bp, Homo sapiens
cataccaaagctgctgcacagc

SEQ ID NO: 564669 - DNA, 15 bp, Homo sapiens
catacgcactgggca

SEQ ID NO: 564670 - DNA, 18 bp, Homo sapiens
catactcatttctaaaag

SEQ ID NO: 564671 - DNA, 12 bp, Homo sapiens
catagaataaca

SEQ ID NO: 564672 - DNA, 18 bp, Homo sapiens
catagaataacaactgct

SEQ ID NO: 564673 - DNA, 20 bp, Homo sapiens
catagaataacaactgctgg

SEQ ID NO: 564674 - DNA, 18 bp, Homo sapiens
catagataccattttgaa

SEQ ID NO: 564675 - DNA, 20 bp, Homo sapiens
catagataccattttgaaat

SEQ ID NO: 564676 - DNA, 22 bp, Homo sapiens
catagataccattttgaaatat

SEQ ID NO: 564677 - DNA, 20 bp, Homo sapiens
catagatagatcccacgttg

SEQ ID NO: 564678 - DNA, 20 bp, Homo sapiens
cataggaagttagcctttat

SEQ ID NO: 564679 - DNA, 16 bp, Homo sapiens
cataggcctgctttgt

SEQ ID NO: 564680 - DNA, 18 bp, Homo sapiens
catataaaatggcaacaa

SEQ ID NO: 564681 - DNA, 18 bp, Homo sapiens
catatacctataatgtgt

SEQ ID NO: 564682 - DNA, 20 bp, Homo sapiens
catatatataaaatacacgt

SEQ ID NO: 564683 - DNA, 23 bp, Homo sapiens
catattaaaatctgatgtaacaa

SEQ ID NO: 564684 - DNA, 18 bp, Homo sapiens
catattaaagaaagtcat

SEQ ID NO: 564685 - DNA, 15 bp, Homo sapiens
catattacaatattt

SEQ ID NO: 564686 - DNA, 16 bp, Homo sapiens
catattacaatatttg

SEQ ID NO: 564687 - DNA, 17 bp, Homo sapiens
catattacaatatttgt

SEQ ID NO: 564688 - DNA, 16 bp, Homo sapiens
catattagaaaacttt

SEQ ID NO: 564689 - DNA, 17 bp, Homo sapiens
catattagaaaactttg

SEQ ID NO: 564690 - DNA, 19 bp, Homo sapiens
catattagaaaactttgtt

SEQ ID NO: 564691 - DNA, 20 bp, Homo sapiens
catattagaaaactttgtta

SEQ ID NO: 564692 - DNA, 21 bp, Homo sapiens
catattagacttctgttttca

SEQ ID NO: 564693 - DNA, 20 bp, Homo sapiens
catattagaggggaaaagct

SEQ ID NO: 564694 - DNA, 14 bp, Homo sapiens
catattatatcaga

SEQ ID NO: 564695 - DNA, 16 bp, Homo sapiens
catattatatcagact

SEQ ID NO: 564696 - DNA, 14 bp, Homo sapiens
catatttcataagc

SEQ ID NO: 564697 - DNA, 16 bp, Homo sapiens
catattttaatttcaa

SEQ ID NO: 564698 - DNA, 19 bp, Homo sapiens
catattttcctttatgtga

SEQ ID NO: 564699 - DNA, 12 bp, Homo sapiens
catcaaagccct

SEQ ID NO: 564700 - DNA, 14 bp, Homo sapiens
catcaaagccctcc

SEQ ID NO: 564701 - DNA, 14 bp, Homo sapiens
catcacttacagaa

SEQ ID NO: 564702 - DNA, 14 bp, Homo sapiens
catcagaagtggta

SEQ ID NO: 564703 - DNA, 17 bp, Homo sapiens
catcagcccctgctgct

SEQ ID NO: 564704 - DNA, 20 bp, Homo sapiens
catcagtattaatactaaaa

SEQ ID NO: 564705 - DNA, 12 bp, Homo sapiens
catcagtgccaa

SEQ ID NO: 564706 - DNA, 21 bp, Homo sapiens
catcataaacaaagagtagaa

SEQ ID NO: 564707 - DNA, 14 bp, Homo sapiens
catccaccttccct

SEQ ID NO: 564708 - DNA, 16 bp, Homo sapiens
catccatgtcctatgt

SEQ ID NO: 564709 - DNA, 18 bp, Homo sapiens
catccatgtcctatgtgt

SEQ ID NO: 564710 - DNA, 13 bp, Homo sapiens
catcccacagcca

SEQ ID NO: 564711 - DNA, 16 bp, Homo sapiens
catcccagccccaatt

SEQ ID NO: 564712 - DNA, 12 bp, Homo sapiens
catccccagccc

SEQ ID NO: 564713 - DNA, 12 bp, Homo sapiens
catccccatccc

SEQ ID NO: 564714 - DNA, 16 bp, Homo sapiens
catcccttctcttcca

SEQ ID NO: 564715 - DNA, 22 bp, Homo sapiens
catcccttctcttccaggcagc

SEQ ID NO: 564716 - DNA, 23 bp, Homo sapiens
catcccttctcttccaggcagcc

SEQ ID NO: 564717 - DNA, 18 bp, Homo sapiens
catccggggccagctccg

SEQ ID NO: 564718 - DNA, 14 bp, Homo sapiens
ccagctccccccac

SEQ ID NO: 564719 - DNA, 22 bp, Homo sapiens
ccagctccctgaatctgaccac

SEQ ID NO: 564720 - DNA, 20 bp, Homo sapiens
ccagctgcaggaatcaaaaa

SEQ ID NO: 564721 - DNA, 15 bp, Homo sapiens
ccagctgctgctctg

SEQ ID NO: 564722 - DNA, 15 bp, Homo sapiens
ccagcttcacttctg

SEQ ID NO: 564723 - DNA, 19 bp, Homo sapiens
ccagcttcacttctgactc

SEQ ID NO: 564724 - DNA, 20 bp, Homo sapiens
ccagcttcacttctgactct

SEQ ID NO: 564725 - DNA, 16 bp, Homo sapiens
ccagcttttcattgct

SEQ ID NO: 564726 - DNA, 14 bp, Homo sapiens
ccaggaacacatgc

SEQ ID NO: 564727 - DNA, 17 bp, Homo sapiens
ccaggaacacatgcaca

SEQ ID NO: 564728 - DNA, 14 bp, Homo sapiens
ccaggaaggaaaca

SEQ ID NO: 564729 - DNA, 17 bp, Homo sapiens
ccaggaaggaaacagat

SEQ ID NO: 564730 - DNA, 21 bp, Homo sapiens
ccaggactctgccttccaggc

SEQ ID NO: 564731 - DNA, 16 bp, Homo sapiens
ccaggacttggtcttt

SEQ ID NO: 564732 - DNA, 19 bp, Homo sapiens
ccaggagatgaggctggat

SEQ ID NO: 564733 - DNA, 13 bp, Homo sapiens
ccaggcacctccc

SEQ ID NO: 564734 - DNA, 18 bp, Homo sapiens
ccaggcacggaggctcgt

SEQ ID NO: 564735 - DNA, 15 bp, Homo sapiens
ccaggcagcacccag

SEQ ID NO: 564736 - DNA, 16 bp, Homo sapiens
ccaggcatctccttgg

SEQ ID NO: 564737 - DNA, 20 bp, Homo sapiens
ccaggcatctccttgggctg

SEQ ID NO: 564738 - DNA, 15 bp, Homo sapiens
ccaggcccccctgtc

SEQ ID NO: 564739 - DNA, 16 bp, Homo sapiens
ccaggcccccctgtca

SEQ ID NO: 564740 - DNA, 14 bp, Homo sapiens
ccaggccgtggctg

SEQ ID NO: 564741 - DNA, 17 bp, Homo sapiens
ccaggcgtagggccagg

SEQ ID NO: 564742 - DNA, 19 bp, Homo sapiens
ccaggcgtagggccagggc

SEQ ID NO: 564743 - DNA, 22 bp, Homo sapiens
ccagggatttgtccttggggac

SEQ ID NO: 564744 - DNA, 13 bp, Homo sapiens
ccagggccaaaag

SEQ ID NO: 564745 - DNA, 13 bp, Homo sapiens
ccagggccagaag

SEQ ID NO: 564746 - DNA, 14 bp, Homo sapiens
ccagggctctggca

SEQ ID NO: 564747 - DNA, 12 bp, Homo sapiens
ccaggggcacac

SEQ ID NO: 564748 - DNA, 22 bp, Homo sapiens
ccaggtatctgatgatgttctg

SEQ ID NO: 564749 - DNA, 23 bp, Homo sapiens
ccaggtatctgatgatgttctga

SEQ ID NO: 564750 - DNA, 16 bp, Homo sapiens
ccaggtctgatctggg

SEQ ID NO: 564751 - DNA, 20 bp, Homo sapiens
ccaggtgaaggaggctccag

SEQ ID NO: 564752 - DNA, 21 bp, Homo sapiens
ccaggtgaaggaggctccagg

SEQ ID NO: 564753 - DNA, 16 bp, Homo sapiens
ccaggtgcacagacgt

SEQ ID NO: 564754 - DNA, 18 bp, Homo sapiens
ccaggttttgcactcttg

SEQ ID NO: 564755 - DNA, 23 bp, Homo sapiens
ccaggttttgttccgcccagtgg

SEQ ID NO: 564756 - DNA, 17 bp, Homo sapiens
ccagtacaataaataaa

SEQ ID NO: 564757 - DNA, 14 bp, Homo sapiens
ccagtcaggctctc

SEQ ID NO: 564758 - DNA, 18 bp, Homo sapiens
ccagtccccttcccgtga

SEQ ID NO: 564759 - DNA, 23 bp, Homo sapiens
ccagtgacctggaaggcccagca

SEQ ID NO: 564760 - DNA, 13 bp, Homo sapiens
ccagtgctcacac

SEQ ID NO: 564761 - DNA, 21 bp, Homo sapiens
ccagtggggcctgaggctcct

SEQ ID NO: 564762 - DNA, 13 bp, Homo sapiens
ccagtgtccccag

SEQ ID NO: 564763 - DNA, 17 bp, Homo sapiens
ccagtgtccccaggggc

SEQ ID NO: 564764 - DNA, 14 bp, Homo sapiens
ccagttggactgtg

SEQ ID NO: 564765 - DNA, 20 bp, Homo sapiens
ccagttggactgtggcctca

SEQ ID NO: 564766 - DNA, 21 bp, Homo sapiens
ccagttggactgtggcctcag

SEQ ID NO: 564767 - DNA, 11 bp, Homo sapiens
ccataaatcaa

SEQ ID NO: 564768 - DNA, 19 bp, Homo sapiens
ccataaatcaattcattgt

SEQ ID NO: 564769 - DNA, 23 bp, Homo sapiens
ccataatgcttctttcctcttaa

SEQ ID NO: 564770 - DNA, 14 bp, Homo sapiens
ccatacttctctca

SEQ ID NO: 564771 - DNA, 18 bp, Homo sapiens
ccatagttgacagttcca

SEQ ID NO: 564772 - DNA, 21 bp, Homo sapiens
ccatatcaaaagacacagggg

SEQ ID NO: 564773 - DNA, 17 bp, Homo sapiens
ccatatttttttcctta

SEQ ID NO: 564774 - DNA, 22 bp, Homo sapiens
ccatatttttttccttacataa

SEQ ID NO: 564775 - DNA, 22 bp, Homo sapiens
ccatcaaagccctccctgtctg

SEQ ID NO: 564776 - DNA, 18 bp, Homo sapiens
ccatcaagttgcacactc

SEQ ID NO: 564777 - DNA, 12 bp, Homo sapiens
ccatcagcccaa

SEQ ID NO: 564778 - DNA, 16 bp, Homo sapiens
ccatcagcccctgctg

SEQ ID NO: 564779 - DNA, 17 bp, Homo sapiens
ccatcagcccctgctgc

SEQ ID NO: 564780 - DNA, 19 bp, Homo sapiens
ccatcagcccctgctgctc

SEQ ID NO: 564781 - DNA, 18 bp, Homo sapiens
ccatcctcctccttccta

SEQ ID NO: 564782 - DNA, 18 bp, Homo sapiens
ccatgaaacagcagctga

SEQ ID NO: 564783 - DNA, 19 bp, Homo sapiens
ccatgagtgtgggccatcg

SEQ ID NO: 564784 - DNA, 19 bp, Homo sapiens
ccatgattccaagggccca

SEQ ID NO: 564785 - DNA, 17 bp, Homo sapiens
ccatgcaattcatccca

SEQ ID NO: 564786 - DNA, 17 bp, Homo sapiens
ccatgccctccctgctg

SEQ ID NO: 564787 - DNA, 12 bp, Homo sapiens
ccatgccctccg

SEQ ID NO: 564788 - DNA, 21 bp, Homo sapiens
ccatggaagctggcaggagac

SEQ ID NO: 564789 - DNA, 22 bp, Homo sapiens
ccatggaagctggcaggagaca

SEQ ID NO: 564790 - DNA, 19 bp, Homo sapiens
cctgcctgccctgtcagga

SEQ ID NO: 564791 - DNA, 17 bp, Homo sapiens
cctgcgcaggccctccg

SEQ ID NO: 564792 - DNA, 17 bp, Homo sapiens
cctgcgtggcctggggc

SEQ ID NO: 564793 - DNA, 19 bp, Homo sapiens
cctgcgtggcctggggctg

SEQ ID NO: 564794 - DNA, 19 bp, Homo sapiens
cctgcgtggctgacccccc

SEQ ID NO: 564795 - DNA, 19 bp, Homo sapiens
cctgctacagtagctgtgg

SEQ ID NO: 564796 - DNA, 13 bp, Homo sapiens
cctgctcatccac

SEQ ID NO: 564797 - DNA, 17 bp, Homo sapiens
cctgctcattgtggcca

SEQ ID NO: 564798 - DNA, 18 bp, Homo sapiens
cctgctcattgtggccag

SEQ ID NO: 564799 - DNA, 22 bp, Homo sapiens
cctgctccctccgggtcttcct

SEQ ID NO: 564800 - DNA, 11 bp, Homo sapiens
cctgctcctcc

SEQ ID NO: 564801 - DNA, 13 bp, Homo sapiens
cctgctccttccc

SEQ ID NO: 564802 - DNA, 16 bp, Homo sapiens
cctgctccttcccttg

SEQ ID NO: 564803 - DNA, 16 bp, Homo sapiens
cctgctgagtggtcca

SEQ ID NO: 564804 - DNA, 23 bp, Homo sapiens
cctgctgagtggtccacattctg

SEQ ID NO: 564805 - DNA, 19 bp, Homo sapiens
cctgctgccagtaccagcc

SEQ ID NO: 564806 - DNA, 21 bp, Homo sapiens
cctgctgccagtaccagcccc

SEQ ID NO: 564807 - DNA, 16 bp, Homo sapiens
cctgctgctcctcggc

SEQ ID NO: 564808 - DNA, 21 bp, Homo sapiens
cctgctgctcctcggccagag

SEQ ID NO: 564809 - DNA, 15 bp, Homo sapiens
cctgcttctctgccc

SEQ ID NO: 564810 - DNA, 23 bp, Homo sapiens
cctgctttagaatgttttccttc

SEQ ID NO: 564811 - DNA, 22 bp, Homo sapiens
cctgctttgtctcctctatcct

SEQ ID NO: 564812 - DNA, 20 bp, Homo sapiens
cctgcttttaggagaattca

SEQ ID NO: 564813 - DNA, 13 bp, Homo sapiens
cctgcttttgcaa

SEQ ID NO: 564814 - DNA, 13 bp, Homo sapiens
cctggaaagccct

SEQ ID NO: 564815 - DNA, 12 bp, Homo sapiens
cctggcaggcag

SEQ ID NO: 564816 - DNA, 15 bp, Homo sapiens
cctggcaggcagggg

SEQ ID NO: 564817 - DNA, 23 bp, Homo sapiens
cctggcaggcaggggccctgcag

SEQ ID NO: 564818 - DNA, 14 bp, Homo sapiens
cctggccaacatgg

SEQ ID NO: 564819 - DNA, 19 bp, Homo sapiens
cctggcccctcccacatcc

SEQ ID NO: 564820 - DNA, 15 bp, Homo sapiens
cctggccctggggcc

SEQ ID NO: 564821 - DNA, 20 bp, Homo sapiens
cctggccctggggcctgtac

SEQ ID NO: 564822 - DNA, 14 bp, Homo sapiens
cctgggagatgctg

SEQ ID NO: 564823 - DNA, 21 bp, Homo sapiens
cctgggcaacagagtgagacc

SEQ ID NO: 564824 - DNA, 19 bp, Homo sapiens
cctgggcatccccagcccc

SEQ ID NO: 564825 - DNA, 21 bp, Homo sapiens
cctgggcatccccagccccct

SEQ ID NO: 564826 - DNA, 22 bp, Homo sapiens
cctgggcatccccagccccctg

SEQ ID NO: 564827 - DNA, 13 bp, Homo sapiens
cctgggccagggt

SEQ ID NO: 564828 - DNA, 14 bp, Homo sapiens
cctgggccagggtc

SEQ ID NO: 564829 - DNA, 23 bp, Homo sapiens
cctgggccagggtctcgtcagga

SEQ ID NO: 564830 - DNA, 12 bp, Homo sapiens
cctgggccctgg

SEQ ID NO: 564831 - DNA, 15 bp, Homo sapiens
cctgggggcctgacc

SEQ ID NO: 564832 - DNA, 17 bp, Homo sapiens
cctgggggcctgacctc

SEQ ID NO: 564833 - DNA, 22 bp, Homo sapiens
cctgggggcctgacctccccct

SEQ ID NO: 564834 - DNA, 23 bp, Homo sapiens
cctgggggctgctgcactgccct

SEQ ID NO: 564835 - DNA, 18 bp, Homo sapiens
cctggggggcctgaaagc

SEQ ID NO: 564836 - DNA, 23 bp, Homo sapiens
cctggggggcctgaaagcaacag

SEQ ID NO: 564837 - DNA, 16 bp, Homo sapiens
cctggggtacttctgt

SEQ ID NO: 564838 - DNA, 20 bp, Homo sapiens
cctggggtcaggccgggcag

SEQ ID NO: 564839 - DNA, 22 bp, Homo sapiens
cctggggtcaggccgggcagag

SEQ ID NO: 564840 - DNA, 15 bp, Homo sapiens
cctgggtccccagcc

SEQ ID NO: 564841 - DNA, 19 bp, Homo sapiens
cctggtaagaaaaagcaaa

SEQ ID NO: 564842 - DNA, 21 bp, Homo sapiens
cctggtcgccttccacctctg

SEQ ID NO: 564843 - DNA, 16 bp, Homo sapiens
cctggttcccccagga

SEQ ID NO: 564844 - DNA, 20 bp, Homo sapiens
cctggttcccccaggaccct

SEQ ID NO: 564845 - DNA, 21 bp, Homo sapiens
cctggttcccccaggaccctg

SEQ ID NO: 564846 - DNA, 13 bp, Homo sapiens
cctgtacacacac

SEQ ID NO: 564847 - DNA, 14 bp, Homo sapiens
cctgtacacacaca

SEQ ID NO: 564848 - DNA, 23 bp, Homo sapiens
cctgtacacacacagacacacaa

SEQ ID NO: 564849 - DNA, 13 bp, Homo sapiens
cctgtactggaga

SEQ ID NO: 564850 - DNA, 13 bp, Homo sapiens
cctgtcaaacatt

SEQ ID NO: 564851 - DNA, 22 bp, Homo sapiens
cctgtcaaacattagtacttta

SEQ ID NO: 564852 - DNA, 13 bp, Homo sapiens
cctgtcaggaggc

SEQ ID NO: 564853 - DNA, 19 bp, Homo sapiens
cctgtctgaatgtacctgt

SEQ ID NO: 564854 - DNA, 14 bp, Homo sapiens
cctgtctgctccag

SEQ ID NO: 564855 - DNA, 19 bp, Homo sapiens
cctgtctgtgaagagcaag

SEQ ID NO: 564856 - DNA, 17 bp, Homo sapiens
cctgtcttatcctccac

SEQ ID NO: 564857 - DNA, 22 bp, Homo sapiens
cctgtcttatcctccaccgtct

SEQ ID NO: 564858 - DNA, 14 bp, Homo sapiens
cctgtgacaaaatt

SEQ ID NO: 564859 - DNA, 16 bp, Homo sapiens
cctgtgaccggggtcc

SEQ ID NO: 564860 - DNA, 22 bp, Homo sapiens
cctgtgaccggggtcctgaggc

SEQ ID NO: 564861 - DNA, 15 bp, Homo sapiens
cctgtgccagcccag

SEQ ID NO: 564862 - DNA, 12 bp, Homo sapiens
cctgtgccaggt

SEQ ID NO: 564863 - DNA, 19 bp, Homo sapiens
cctgtgctaagtctttccc

SEQ ID NO: 564864 - DNA, 13 bp, Homo sapiens
cctgttctgtgtc

SEQ ID NO: 564865 - DNA, 18 bp, Homo sapiens
cctgttctgtgtctgctg

SEQ ID NO: 564866 - DNA, 16 bp, Homo sapiens
cctgttttgagccctg

SEQ ID NO: 564867 - DNA, 15 bp, Homo sapiens
ccttaaaatttgaaa

SEQ ID NO: 564868 - DNA, 16 bp, Homo sapiens
ccttaaaatttgaaac

SEQ ID NO: 564869 - DNA, 17 bp, Homo sapiens
ccttaaaatttgaaaca

SEQ ID NO: 564870 - DNA, 15 bp, Homo sapiens
ccttaagctgcagga

SEQ ID NO: 564871 - DNA, 19 bp, Homo sapiens
ccttaatggccttaattaa

SEQ ID NO: 564872 - DNA, 23 bp, Homo sapiens
ccttacaaatgattgcttttaaa

SEQ ID NO: 564873 - DNA, 16 bp, Homo sapiens
ccttatcataaattca

SEQ ID NO: 564874 - DNA, 16 bp, Homo sapiens
ccttccaacctgttca

SEQ ID NO: 564875 - DNA, 18 bp, Homo sapiens
ccttccacagttatctta

SEQ ID NO: 564876 - DNA, 15 bp, Homo sapiens
ccttccacctgctct

SEQ ID NO: 564877 - DNA, 18 bp, Homo sapiens
ccttccacctgctctgct

SEQ ID NO: 564878 - DNA, 22 bp, Homo sapiens
ccttccaggcgtagggccaggg

SEQ ID NO: 564879 - DNA, 18 bp, Homo sapiens
ccttcccactcttctcat

SEQ ID NO: 564880 - DNA, 16 bp, Homo sapiens
ccttcccagctgcccc

SEQ ID NO: 564881 - DNA, 22 bp, Homo sapiens
ccttcccagctgcccctccctg

SEQ ID NO: 564882 - DNA, 21 bp, Homo sapiens
ccttcctagttcatcccttct

SEQ ID NO: 564883 - DNA, 21 bp, Homo sapiens
ccttcctccatcctcctcctt

SEQ ID NO: 564884 - DNA, 23 bp, Homo sapiens
ccatggaagctggcaggagacac

SEQ ID NO: 564885 - DNA, 22 bp, Homo sapiens
ccatggagtgggtctggaggac

SEQ ID NO: 564886 - DNA, 16 bp, Homo sapiens
ccatggattcccctgg

SEQ ID NO: 564887 - DNA, 16 bp, Homo sapiens
ccatggtagactgtga

SEQ ID NO: 564888 - DNA, 15 bp, Homo sapiens
ccatgtatgcataat

SEQ ID NO: 564889 - DNA, 17 bp, Homo sapiens
ccatgtcctatgtgtga

SEQ ID NO: 564890 - DNA, 21 bp, Homo sapiens
ccatgtctttctccaaagtta

SEQ ID NO: 564891 - DNA, 15 bp, Homo sapiens
ccatgtgctgctgtg

SEQ ID NO: 564892 - DNA, 18 bp, Homo sapiens
ccattaaaatatgcacta

SEQ ID NO: 564893 - DNA, 11 bp, Homo sapiens
ccattggaaat

SEQ ID NO: 564894 - DNA, 20 bp, Homo sapiens
ccattgtatttaaaacattt

SEQ ID NO: 564895 - DNA, 20 bp, Homo sapiens
ccatttacagtctctttctt

SEQ ID NO: 564896 - DNA, 22 bp, Homo sapiens
ccatttcagtaaacctgtctga

SEQ ID NO: 564897 - DNA, 13 bp, Homo sapiens
ccatttccttatg

SEQ ID NO: 564898 - DNA, 17 bp, Homo sapiens
ccatttccttatgctgt

SEQ ID NO: 564899 - DNA, 15 bp, Homo sapiens
cccaaacctttcccc

SEQ ID NO: 564900 - DNA, 15 bp, Homo sapiens
cccaaagcacatgct

SEQ ID NO: 564901 - DNA, 19 bp, Homo sapiens
cccaaggccccctgcctgc

SEQ ID NO: 564902 - DNA, 22 bp, Homo sapiens
cccaaggttctgggtgcaggag

SEQ ID NO: 564903 - DNA, 17 bp, Homo sapiens
cccaagttttgtgaaat

SEQ ID NO: 564904 - DNA, 12 bp, Homo sapiens
cccaatccctga

SEQ ID NO: 564905 - DNA, 21 bp, Homo sapiens
cccaatctctacccctttctt

SEQ ID NO: 564906 - DNA, 19 bp, Homo sapiens
cccaattatcctccttcac

SEQ ID NO: 564907 - DNA, 17 bp, Homo sapiens
cccacaccctacagcag

SEQ ID NO: 564908 - DNA, 14 bp, Homo sapiens
cccacacctggccc

SEQ ID NO: 564909 - DNA, 19 bp, Homo sapiens
cccacacctggccctgggg

SEQ ID NO: 564910 - DNA, 14 bp, Homo sapiens
cccaccagttgctg

SEQ ID NO: 564911 - DNA, 18 bp, Homo sapiens
cccaccagttgctgctgc

SEQ ID NO: 564912 - DNA, 13 bp, Homo sapiens
cccaccccatcct

SEQ ID NO: 564913 - DNA, 18 bp, Homo sapiens
cccacccccgggtgcctg

SEQ ID NO: 564914 - DNA, 21 bp, Homo sapiens
cccacccccgggtgcctgtga

SEQ ID NO: 564915 - DNA, 15 bp, Homo sapiens
cccaccctccccttc

SEQ ID NO: 564916 - DNA, 18 bp, Homo sapiens
cccactcctgctctgctc

SEQ ID NO: 564917 - DNA, 17 bp, Homo sapiens
cccagaaatgccgctgt

SEQ ID NO: 564918 - DNA, 20 bp, Homo sapiens
cccagaaatgccgctgtgtc

SEQ ID NO: 564919 - DNA, 15 bp, Homo sapiens
cccagaccagtagtg

SEQ ID NO: 564920 - DNA, 21 bp, Homo sapiens
cccagaccagtagtgaccaat

SEQ ID NO: 564921 - DNA, 21 bp, Homo sapiens
cccagaccccatccagccagg

SEQ ID NO: 564922 - DNA, 17 bp, Homo sapiens
cccagaccctggaggaa

SEQ ID NO: 564923 - DNA, 15 bp, Homo sapiens
cccagcactttggga

SEQ ID NO: 564924 - DNA, 14 bp, Homo sapiens
cccagccccagcga

SEQ ID NO: 564925 - DNA, 21 bp, Homo sapiens
cccagccccagcgagtctgga

SEQ ID NO: 564926 - DNA, 13 bp, Homo sapiens
cccagccccctgg

SEQ ID NO: 564927 - DNA, 18 bp, Homo sapiens
cccagccccctggcccct

SEQ ID NO: 564928 - DNA, 17 bp, Homo sapiens
cccagcccctggtggtg

SEQ ID NO: 564929 - DNA, 15 bp, Homo sapiens
cccagcctctttccc

SEQ ID NO: 564930 - DNA, 21 bp, Homo sapiens
cccagcgctgacgtgtcagga

SEQ ID NO: 564931 - DNA, 21 bp, Homo sapiens
cccagctgcccctccctgcca

SEQ ID NO: 564932 - DNA, 17 bp, Homo sapiens
cccagcttcacttctga

SEQ ID NO: 564933 - DNA, 17 bp, Homo sapiens
cccaggaaggaaacaga

SEQ ID NO: 564934 - DNA, 13 bp, Homo sapiens
cccaggaccctga

SEQ ID NO: 564935 - DNA, 15 bp, Homo sapiens
cccaggaccctgagg

SEQ ID NO: 564936 - DNA, 15 bp, Homo sapiens
cccaggacgcaggga

SEQ ID NO: 564937 - DNA, 14 bp, Homo sapiens
cccaggagcgcagc

SEQ ID NO: 564938 - DNA, 15 bp, Homo sapiens
cccaggccgtggctg

SEQ ID NO: 564939 - DNA, 20 bp, Homo sapiens
cccaggggcacacttcccct

SEQ ID NO: 564940 - DNA, 13 bp, Homo sapiens
cccagggtcctgg

SEQ ID NO: 564941 - DNA, 16 bp, Homo sapiens
cccagtgctcacacaa

SEQ ID NO: 564942 - DNA, 15 bp, Homo sapiens
cccagtgtccccagg

SEQ ID NO: 564943 - DNA, 20 bp, Homo sapiens
cccagtgtccccaggggcac

SEQ ID NO: 564944 - DNA, 19 bp, Homo sapiens
cccatcgtctcggccttca

SEQ ID NO: 564945 - DNA, 16 bp, Homo sapiens
cccatgaaacagcagc

SEQ ID NO: 564946 - DNA, 20 bp, Homo sapiens
cccatgccctccctgctgcc

SEQ ID NO: 564947 - DNA, 18 bp, Homo sapiens
cccatgctgggctcccgt

SEQ ID NO: 564948 - DNA, 14 bp, Homo sapiens
cccatgtgagctgc

SEQ ID NO: 564949 - DNA, 12 bp, Homo sapiens
cccatgtgtatg

SEQ ID NO: 564950 - DNA, 21 bp, Homo sapiens
cccattgtatttaaaacattt

SEQ ID NO: 564951 - DNA, 18 bp, Homo sapiens
cccatttccttgtctaaa

SEQ ID NO: 564952 - DNA, 18 bp, Homo sapiens
ccccaaaggccaacagca

SEQ ID NO: 564953 - DNA, 23 bp, Homo sapiens
ccccacccccgggtgcctgtgac

SEQ ID NO: 564954 - DNA, 14 bp, Homo sapiens
ccccacgccctcat

SEQ ID NO: 564955 - DNA, 24 bp, Homo sapiens
ccccagacaacagcccaggcatct

SEQ ID NO: 564956 - DNA, 13 bp, Homo sapiens
ccccagaccagta

SEQ ID NO: 564957 - DNA, 18 bp, Homo sapiens
ccccagaccagtagtgac

SEQ ID NO: 564958 - DNA, 20 bp, Homo sapiens
ccccagaccagtagtgacca

SEQ ID NO: 564959 - DNA, 18 bp, Homo sapiens
ccccagccccctggcccc

SEQ ID NO: 564960 - DNA, 19 bp, Homo sapiens
ccccagcgagtctggagac

SEQ ID NO: 564961 - DNA, 21 bp, Homo sapiens
ccccagcttctcagctcgctg

SEQ ID NO: 564962 - DNA, 11 bp, Homo sapiens
ccccaggaagg

SEQ ID NO: 564963 - DNA, 14 bp, Homo sapiens
ccccaggggcacac

SEQ ID NO: 564964 - DNA, 20 bp, Homo sapiens
ccccaggtctgatctgggtt

SEQ ID NO: 564965 - DNA, 17 bp, Homo sapiens
ccccatccagccagggg

SEQ ID NO: 564966 - DNA, 13 bp, Homo sapiens
ccccatctgctga

SEQ ID NO: 564967 - DNA, 15 bp, Homo sapiens
ccccatgccctccct

SEQ ID NO: 564968 - DNA, 14 bp, Homo sapiens
ccccatttcctgta

SEQ ID NO: 564969 - DNA, 20 bp, Homo sapiens
ccccatttgctttcttttct

SEQ ID NO: 564970 - DNA, 18 bp, Homo sapiens
ccccattttctttacagt

SEQ ID NO: 564971 - DNA, 18 bp, Homo sapiens
cccccacacctggccctg

SEQ ID NO: 564972 - DNA, 12 bp, Homo sapiens
cccccagctccc

SEQ ID NO: 564973 - DNA, 22 bp, Homo sapiens
cccccagtgctcacacaatcag

SEQ ID NO: 564974 - DNA, 20 bp, Homo sapiens
cccccgctctgccatcagcc

SEQ ID NO: 564975 - DNA, 21 bp, Homo sapiens
ccccctcaccacctgcccggc

SEQ ID NO: 564976 - DNA, 20 bp, Homo sapiens
ccccctcaggaccctcgctg

SEQ ID NO: 564977 - DNA, 22 bp, Homo sapiens
ccccctcaggaccctcgctggc

SEQ ID NO: 564978 - DNA, 12 bp, Homo sapiens
ccccctccttcc

SEQ ID NO: 564979 - DNA, 22 bp, Homo sapiens
ccccgagccgagctctcctggg

SEQ ID NO: 564980 - DNA, 18 bp, Homo sapiens
ccccgcagtgtttgtgtg

SEQ ID NO: 564981 - DNA, 22 bp, Homo sapiens
ccccggagctgggaaggtcccg

SEQ ID NO: 564982 - DNA, 18 bp, Homo sapiens
cccctaatgcctgcggag

SEQ ID NO: 564983 - DNA, 14 bp, Homo sapiens
cccctcaggaccct

SEQ ID NO: 564984 - DNA, 22 bp, Homo sapiens
cccctcaggaccctcgctggcc

SEQ ID NO: 564985 - DNA, 16 bp, Homo sapiens
cccctccttcccagct

SEQ ID NO: 564986 - DNA, 15 bp, Homo sapiens
cccctgcgcaggccc

SEQ ID NO: 564987 - DNA, 17 bp, Homo sapiens
cccctgcgcaggccctc

SEQ ID NO: 564988 - DNA, 15 bp, Homo sapiens
cccctggtcctgcac

SEQ ID NO: 564989 - DNA, 11 bp, Homo sapiens
ccccttcccat

SEQ ID NO: 564990 - DNA, 13 bp, Homo sapiens
cccctttcttcct

SEQ ID NO: 564991 - DNA, 15 bp, Homo sapiens
cccctttcttcctca

SEQ ID NO: 564992 - DNA, 22 bp, Homo sapiens
cccgaaggttatggtcaatccc

SEQ ID NO: 564993 - DNA, 19 bp, Homo sapiens
cccgagccgagctctcctg

SEQ ID NO: 564994 - DNA, 15 bp, Homo sapiens
cccgatcgccagcaa

SEQ ID NO: 564995 - DNA, 18 bp, Homo sapiens
cccgcatgtacaaaaaca

SEQ ID NO: 564996 - DNA, 19 bp, Homo sapiens
cccgcccaaacctttcccc

SEQ ID NO: 564997 - DNA, 11 bp, Homo sapiens
cccggagctgg

SEQ ID NO: 564998 - DNA, 20 bp, Homo sapiens
cccggagctgggaaggtccc

SEQ ID NO: 564999 - DNA, 12 bp, Homo sapiens
cccggcagcccc

SEQ ID NO: 565000 - DNA, 15 bp, Homo sapiens
cccggcttcctgtgc

SEQ ID NO: 565001 - DNA, 14 bp, Homo sapiens
cccgggtgcctgtg

SEQ ID NO: 565002 - DNA, 13 bp, Homo sapiens
cccgtgacctggt

SEQ ID NO: 565003 - DNA, 15 bp, Homo sapiens
cccgtgacctggtca

SEQ ID NO: 565004 - DNA, 16 bp, Homo sapiens
cccgtgacctggtcag

SEQ ID NO: 565005 - DNA, 17 bp, Homo sapiens
ccctcagccctcattaa

SEQ ID NO: 565006 - DNA, 20 bp, Homo sapiens
ccctcaggaccctcgctggc

SEQ ID NO: 565007 - DNA, 19 bp, Homo sapiens
ccctcattacggctcctct

SEQ ID NO: 565008 - DNA, 23 bp, Homo sapiens
ccctccatgattccaagggccca

SEQ ID NO: 565009 - DNA, 13 bp, Homo sapiens
ccctccctcccag

SEQ ID NO: 565010 - DNA, 15 bp, Homo sapiens
ccctccctcccagat

SEQ ID NO: 565011 - DNA, 14 bp, Homo sapiens
ccctccgcccttcc

SEQ ID NO: 565012 - DNA, 17 bp, Homo sapiens
ccctccgggtcttccta

SEQ ID NO: 565013 - DNA, 23 bp, Homo sapiens
ccctcctggcgagttctctttgg

SEQ ID NO: 565014 - DNA, 19 bp, Homo sapiens
ccctccttcccagctgccc

SEQ ID NO: 565015 - DNA, 13 bp, Homo sapiens
ccctcgctggccc

SEQ ID NO: 565016 - DNA, 17 bp, Homo sapiens
ccctcgctggcccccac

SEQ ID NO: 565017 - DNA, 18 bp, Homo sapiens
ccctcgctggcccccact

SEQ ID NO: 565018 - DNA, 20 bp, Homo sapiens
ccctcgctggcccccactgg

SEQ ID NO: 565019 - DNA, 23 bp, Homo sapiens
ccctcgctggcccccactggctg

SEQ ID NO: 565020 - DNA, 18 bp, Homo sapiens
ccctcggagttcttcttg

SEQ ID NO: 565021 - DNA, 16 bp, Homo sapiens
ccctcggggcaggaag

SEQ ID NO: 565022 - DNA, 15 bp, Homo sapiens
ccctcgtctttccca

SEQ ID NO: 565023 - DNA, 22 bp, Homo sapiens
ccctctctggctaaggacaggc

SEQ ID NO: 565024 - DNA, 22 bp, Homo sapiens
ccctcttagaagaaatatgagc

SEQ ID NO: 565025 - DNA, 11 bp, Homo sapiens
ccctcttcaat

SEQ ID NO: 565026 - DNA, 12 bp, Homo sapiens
aacacatgcaca

SEQ ID NO: 565027 - DNA, 13 bp, Homo sapiens
aacacatgcacac

SEQ ID NO: 565028 - DNA, 14 bp, Homo sapiens
aacacatgcacaca

SEQ ID NO: 565029 - DNA, 18 bp, Homo sapiens
aacacattgaaactgtat

SEQ ID NO: 565030 - DNA, 20 bp, Homo sapiens
aacacattgaaactgtattt

SEQ ID NO: 565031 - DNA, 18 bp, Homo sapiens
aacaccacagacacacac

SEQ ID NO: 565032 - DNA, 19 bp, Homo sapiens
aacaccacagacacacaca

SEQ ID NO: 565033 - DNA, 23 bp, Homo sapiens
aacaccacagacacacacacgca

SEQ ID NO: 565034 - DNA, 21 bp, Homo sapiens
aacaccagcaacattataatg

SEQ ID NO: 565035 - DNA, 15 bp, Homo sapiens
aacacctgacagccc

SEQ ID NO: 565036 - DNA, 19 bp, Homo sapiens
aacactaaatgttaaagat

SEQ ID NO: 565037 - DNA, 12 bp, Homo sapiens
aacagaaattgg

SEQ ID NO: 565038 - DNA, 13 bp, Homo sapiens
aacagaaattggt

SEQ ID NO: 565039 - DNA, 15 bp, Homo sapiens
aacagaaattggtac

SEQ ID NO: 565040 - DNA, 23 bp, Homo sapiens
aacagatcacatgcccctcttag

SEQ ID NO: 565041 - DNA, 19 bp, Homo sapiens
aacagatgacccctgccca

SEQ ID NO: 565042 - DNA, 18 bp, Homo sapiens
aacagcaaattaatgtgt

SEQ ID NO: 565043 - DNA, 23 bp, Homo sapiens
aacagcaaattaatgtgtaaaat

SEQ ID NO: 565044 - DNA, 22 bp, Homo sapiens
aacagcattggcctggccagac

SEQ ID NO: 565045 - DNA, 14 bp, Homo sapiens
aagtttcaaaaatc

SEQ ID NO: 565046 - DNA, 17 bp, Homo sapiens
aagtttgataaatagtg

SEQ ID NO: 565047 - DNA, 12 bp, Homo sapiens
aagtttgatctt

SEQ ID NO: 565048 - DNA, 15 bp, Homo sapiens
aagtttgatcttcct

SEQ ID NO: 565049 - DNA, 17 bp, Homo sapiens
aagtttgcaacctttat

SEQ ID NO: 565050 - DNA, 18 bp, Homo sapiens
aagtttgcaacctttata

SEQ ID NO: 565051 - DNA, 15 bp, Homo sapiens
aagttttgtgaaatt

SEQ ID NO: 565052 - DNA, 14 bp, Homo sapiens
aagtttttatacct

SEQ ID NO: 565053 - DNA, 19 bp, Homo sapiens
aataaaaagtgacacagca

SEQ ID NO: 565054 - DNA, 11 bp, Homo sapiens
aataaaaatag

SEQ ID NO: 565055 - DNA, 13 bp, Homo sapiens
aataaaaatagct

SEQ ID NO: 565056 - DNA, 14 bp, Homo sapiens
aataaaacattatg

SEQ ID NO: 565057 - DNA, 13 bp, Homo sapiens
aataaaaccagaa

SEQ ID NO: 565058 - DNA, 19 bp, Homo sapiens
aataaaagaaatgcacaat

SEQ ID NO: 565059 - DNA, 13 bp, Homo sapiens
aataaaattccta

SEQ ID NO: 565060 - DNA, 21 bp, Homo sapiens
aataaaccaaaggacattatg

SEQ ID NO: 565061 - DNA, 16 bp, Homo sapiens
aataaagtctgtcatg

SEQ ID NO: 565062 - DNA, 12 bp, Homo sapiens
aataaagtttga

SEQ ID NO: 565063 - DNA, 21 bp, Homo sapiens
aataaatacaagtttgaacag

SEQ ID NO: 565064 - DNA, 14 bp, Homo sapiens
aataacagctcctt

SEQ ID NO: 565065 - DNA, 17 bp, Homo sapiens
aataacttacaagactg

SEQ ID NO: 565066 - DNA, 19 bp, Homo sapiens
aataagaaacagtttaaca

SEQ ID NO: 565067 - DNA, 20 bp, Homo sapiens
aataagaaacagtttaacag

SEQ ID NO: 565068 - DNA, 15 bp, Homo sapiens
aataagaagcaaata

SEQ ID NO: 565069 - DNA, 13 bp, Homo sapiens
aataatatgattt

SEQ ID NO: 565070 - DNA, 14 bp, Homo sapiens
aataatcctgcaaa

SEQ ID NO: 565071 - DNA, 19 bp, Homo sapiens
aataatgaagatctttgtt

SEQ ID NO: 565072 - DNA, 12 bp, Homo sapiens
aataattaaaac

SEQ ID NO: 565073 - DNA, 20 bp, Homo sapiens
aataattaggttaacattgt

SEQ ID NO: 565074 - DNA, 22 bp, Homo sapiens
aataattaggttaacattgttg

SEQ ID NO: 565075 - DNA, 11 bp, Homo sapiens
aatacaaacaa

SEQ ID NO: 565076 - DNA, 19 bp, Homo sapiens
aatacaagtttgaacaggc

SEQ ID NO: 565077 - DNA, 16 bp, Homo sapiens
aatacacatacatata

SEQ ID NO: 565078 - DNA, 17 bp, Homo sapiens
aatacacatacatatat

SEQ ID NO: 565079 - DNA, 14 bp, Homo sapiens
aatacacgtgtata

SEQ ID NO: 565080 - DNA, 13 bp, Homo sapiens
aatacactttatt

SEQ ID NO: 565081 - DNA, 19 bp, Homo sapiens
aatacctgacctcacagag

SEQ ID NO: 565082 - DNA, 15 bp, Homo sapiens
aatactaaaatatgt

SEQ ID NO: 565083 - DNA, 12 bp, Homo sapiens
aatactgtattg

SEQ ID NO: 565084 - DNA, 15 bp, Homo sapiens
aatacttgacaacat

SEQ ID NO: 565085 - DNA, 19 bp, Homo sapiens
aatacttgacaacattttt

SEQ ID NO: 565086 - DNA, 22 bp, Homo sapiens
aatactttgtcctaagagattt

SEQ ID NO: 565087 - DNA, 15 bp, Homo sapiens
aatagaaaatatatt

SEQ ID NO: 565088 - DNA, 16 bp, Homo sapiens
aatagacataaattgt

SEQ ID NO: 565089 - DNA, 15 bp, Homo sapiens
aatagcagtggcaaa

SEQ ID NO: 565090 - DNA, 19 bp, Homo sapiens
aatagcagtggcaaaatat

SEQ ID NO: 565091 - DNA, 19 bp, Homo sapiens
aatagcatgacaggctgtt

SEQ ID NO: 565092 - DNA, 18 bp, Homo sapiens
aatagctataaatagtga

SEQ ID NO: 565093 - DNA, 13 bp, Homo sapiens
aataggcttgtgt

SEQ ID NO: 565094 - DNA, 13 bp, Homo sapiens
aatagtaggcaag

SEQ ID NO: 565095 - DNA, 19 bp, Homo sapiens
aatagtgaaaattttattg

SEQ ID NO: 565096 - DNA, 16 bp, Homo sapiens
aatataaaaataatta

SEQ ID NO: 565097 - DNA, 17 bp, Homo sapiens
aatataaaaataattaa

SEQ ID NO: 565098 - DNA, 16 bp, Homo sapiens
aatataaagcatctaa

SEQ ID NO: 565099 - DNA, 17 bp, Homo sapiens
aatataaagcatctaaa

SEQ ID NO: 565100 - DNA, 12 bp, Homo sapiens
aatatataaaaa

SEQ ID NO: 565101 - DNA, 14 bp, Homo sapiens
aatatatagcattt

SEQ ID NO: 565102 - DNA, 20 bp, Homo sapiens
aatatatataaataaatgtt

SEQ ID NO: 565103 - DNA, 19 bp, Homo sapiens
aatatatatacatatgtag

SEQ ID NO: 565104 - DNA, 20 bp, Homo sapiens
aatatatggtctaatgttta

SEQ ID NO: 565105 - DNA, 14 bp, Homo sapiens
aatatatttgcaga

SEQ ID NO: 565106 - DNA, 23 bp, Homo sapiens
aatatatttgcataatatgcata

SEQ ID NO: 565107 - DNA, 20 bp, Homo sapiens
aatatattttgtatgcaagc

SEQ ID NO: 565108 - DNA, 16 bp, Homo sapiens
aatatcagttacagtg

SEQ ID NO: 565109 - DNA, 15 bp, Homo sapiens
aatatgagattggaa

SEQ ID NO: 565110 - DNA, 22 bp, Homo sapiens
aatatgattttttaaaagaaat

SEQ ID NO: 565111 - DNA, 14 bp, Homo sapiens
aatatgcatatata

SEQ ID NO: 565112 - DNA, 19 bp, Homo sapiens
aatatgcatatatatgtat

SEQ ID NO: 565113 - DNA, 16 bp, Homo sapiens
aatatgtaaactttaa

SEQ ID NO: 565114 - DNA, 20 bp, Homo sapiens
aatatgtattttatgtatgt

SEQ ID NO: 565115 - DNA, 21 bp, Homo sapiens
aatatgtattttatgtatgtt

SEQ ID NO: 565116 - DNA, 22 bp, Homo sapiens
aatatgtctcgctagtgatgtt

SEQ ID NO: 565117 - DNA, 21 bp, Homo sapiens
aatatgtgaaggaccttcact

SEQ ID NO: 565118 - DNA, 21 bp, Homo sapiens
aatattaaaaagtcttttaaa

SEQ ID NO: 565119 - DNA, 19 bp, Homo sapiens
aatattatatttggatgca

SEQ ID NO: 565120 - DNA, 17 bp, Homo sapiens
aatattatgttatgaaa

SEQ ID NO: 565121 - DNA, 18 bp, Homo sapiens
aatattatgttatgaaaa

SEQ ID NO: 565122 - DNA, 15 bp, Homo sapiens
aatattctctgtaca

SEQ ID NO: 565123 - DNA, 18 bp, Homo sapiens
aatattctctgtacatat

SEQ ID NO: 565124 - DNA, 16 bp, Homo sapiens
aatattgaaaatgtca

SEQ ID NO: 565125 - DNA, 18 bp, Homo sapiens
aatattgaaaatgtcact

SEQ ID NO: 565126 - DNA, 21 bp, Homo sapiens
aatatttgtgtgctaaacgtg

SEQ ID NO: 565127 - DNA, 17 bp, Homo sapiens
aatattttgtcactgct

SEQ ID NO: 565128 - DNA, 17 bp, Homo sapiens
aatcaaaaattgaagag

SEQ ID NO: 565129 - DNA, 16 bp, Homo sapiens
aatcaagaccaaagag

SEQ ID NO: 565130 - DNA, 19 bp, Homo sapiens
aatcaagaccaaagagcct

SEQ ID NO: 565131 - DNA, 18 bp, Homo sapiens
aatcagatgcctcagagg

SEQ ID NO: 565132 - DNA, 18 bp, Homo sapiens
aatcagtttttgttctta

SEQ ID NO: 565133 - DNA, 23 bp, Homo sapiens
aatcagtttttgttcttaaaaat

SEQ ID NO: 565134 - DNA, 13 bp, Homo sapiens
aaaaaaaagttgg

SEQ ID NO: 565135 - DNA, 12 bp, Homo sapiens
aaaaaaagttgg

SEQ ID NO: 565136 - DNA, 12 bp, Homo sapiens
aaaaaaagttgt

SEQ ID NO: 565137 - DNA, 12 bp, Homo sapiens
aaaaaaatcaaa

SEQ ID NO: 565138 - DNA, 14 bp, Homo sapiens
aaaaaagcaacttt

SEQ ID NO: 565139 - DNA, 20 bp, Homo sapiens
aaaaaagttggtattttata

SEQ ID NO: 565140 - DNA, 13 bp, Homo sapiens
aaaaaatatgaga

SEQ ID NO: 565141 - DNA, 13 bp, Homo sapiens
aaaaacacaaata

SEQ ID NO: 565142 - DNA, 17 bp, Homo sapiens
aaaaacaggcacaggct

SEQ ID NO: 565143 - DNA, 16 bp, Homo sapiens
aaaaacatttttttaa

SEQ ID NO: 565144 - DNA, 20 bp, Homo sapiens
aaaaagcttaaacattgcct

SEQ ID NO: 565145 - DNA, 21 bp, Homo sapiens
aaaaaggccagtggaaattca

SEQ ID NO: 565146 - DNA, 16 bp, Homo sapiens
aaaaagtattgccaaa

SEQ ID NO: 565147 - DNA, 16 bp, Homo sapiens
aaattaacttctattt

SEQ ID NO: 565148 - DNA, 20 bp, Homo sapiens
aaattaacttctattttcaa

SEQ ID NO: 565149 - DNA, 14 bp, Homo sapiens
aaattaatgtgtaa

SEQ ID NO: 565150 - DNA, 20 bp, Homo sapiens
aaattaatgtgtaaaattgg

SEQ ID NO: 565151 - DNA, 22 bp, Homo sapiens
aaattaggaggctcaacaataa

SEQ ID NO: 565152 - DNA, 18 bp, Homo sapiens
aaattatacctgttgctt

SEQ ID NO: 565153 - DNA, 14 bp, Homo sapiens
aaattatctttaaa

SEQ ID NO: 565154 - DNA, 16 bp, Homo sapiens
aaattcagataatggt

SEQ ID NO: 565155 - DNA, 22 bp, Homo sapiens
aaattcagataatggtaattta

SEQ ID NO: 565156 - DNA, 13 bp, Homo sapiens
aaattccaaagat

SEQ ID NO: 565157 - DNA, 16 bp, Homo sapiens
aaattccaaagatctg

SEQ ID NO: 565158 - DNA, 18 bp, Homo sapiens
aaattcgccccattttct

SEQ ID NO: 565159 - DNA, 15 bp, Homo sapiens
aaattctttatttct

SEQ ID NO: 565160 - DNA, 12 bp, Homo sapiens
aaattgaagaga

SEQ ID NO: 565161 - DNA, 15 bp, Homo sapiens
aaattgatgttgatg

SEQ ID NO: 565162 - DNA, 16 bp, Homo sapiens
aaattggtaccttgca

SEQ ID NO: 565163 - DNA, 20 bp, Homo sapiens
aaattggtaccttgcacaca

SEQ ID NO: 565164 - DNA, 21 bp, Homo sapiens
aaattgtcttttgtcatgtgg

SEQ ID NO: 565165 - DNA, 11 bp, Homo sapiens
aaattgtggat

SEQ ID NO: 565166 - DNA, 12 bp, Homo sapiens
aaattgtggatg

SEQ ID NO: 565167 - DNA, 13 bp, Homo sapiens
aaattgtggatga

SEQ ID NO: 565168 - DNA, 22 bp, Homo sapiens
aaatttaacatctgcagtgttc

SEQ ID NO: 565169 - DNA, 12 bp, Homo sapiens
aaatttaagcac

SEQ ID NO: 565170 - DNA, 20 bp, Homo sapiens
aaatttattgaggaaaaata

SEQ ID NO: 565171 - DNA, 13 bp, Homo sapiens
aaatttcaaaaga

SEQ ID NO: 565172 - DNA, 19 bp, Homo sapiens
aaatttcaaaagacatgtt

SEQ ID NO: 565173 - DNA, 21 bp, Homo sapiens
aaatttcaaaagacatgttgt

SEQ ID NO: 565174 - DNA, 20 bp, Homo sapiens
aaatttctagatatgagaaa

SEQ ID NO: 565175 - DNA, 20 bp, Homo sapiens
aaattttatctcttcttcct

SEQ ID NO: 565176 - DNA, 19 bp, Homo sapiens
aaattttattgaatataat

SEQ ID NO: 565177 - DNA, 12 bp, Homo sapiens
aaatttttcata

SEQ ID NO: 565178 - DNA, 19 bp, Homo sapiens
aaatttttcatattttaat

SEQ ID NO: 565179 - DNA, 21 bp, Homo sapiens
aacaaaatccttgccttcaaa

SEQ ID NO: 565180 - DNA, 14 bp, Homo sapiens
aacaaacagatgct

SEQ ID NO: 565181 - DNA, 17 bp, Homo sapiens
aacaaacagatgctctg

SEQ ID NO: 565182 - DNA, 13 bp, Homo sapiens
aacaaagaaatat

SEQ ID NO: 565183 - DNA, 19 bp, Homo sapiens
aacaacataaaattaaaat

SEQ ID NO: 565184 - DNA, 23 bp, Homo sapiens
aacaagaataaaggcagctgttg

SEQ ID NO: 565185 - DNA, 16 bp, Homo sapiens
aacaattttcagattt

SEQ ID NO: 565186 - DNA, 21 bp, Homo sapiens
aacaattttcagatttgcaca

SEQ ID NO: 565187 - DNA, 23 bp, Homo sapiens
aacaattttcagatttgcacaaa

SEQ ID NO: 565188 - DNA, 12 bp, Homo sapiens
aacacacctggt

SEQ ID NO: 565189 - DNA, 11 bp, Homo sapiens
aacacatgcac

SEQ ID NO: 565190 - DNA, 22 bp, Homo sapiens
aacacattgaaactgtatttac

SEQ ID NO: 565191 - DNA, 13 bp, Homo sapiens
aacaccacagaca

SEQ ID NO: 565192 - DNA, 14 bp, Homo sapiens
aacaccacagacac

SEQ ID NO: 565193 - DNA, 15 bp, Homo sapiens
aacaccacagacaca

SEQ ID NO: 565194 - DNA, 17 bp, Homo sapiens
aacaccacagacacaca

SEQ ID NO: 565195 - DNA, 15 bp, Homo sapiens
aacacccacaggcat

SEQ ID NO: 565196 - DNA, 14 bp, Homo sapiens
aacactaaatgtta

SEQ ID NO: 565197 - DNA, 15 bp, Homo sapiens
aacactaaatgttaa

SEQ ID NO: 565198 - DNA, 19 bp, Homo sapiens
aacacttggaacagtgttt

SEQ ID NO: 565199 - DNA, 20 bp, Homo sapiens
aacagaaaaatgaaatttaa

SEQ ID NO: 565200 - DNA, 14 bp, Homo sapiens
aacagaaagcatag

SEQ ID NO: 565201 - DNA, 22 bp, Homo sapiens
aacagaaattggtaccttgcac

SEQ ID NO: 565202 - DNA, 15 bp, Homo sapiens
aacagaactcccttc

SEQ ID NO: 565203 - DNA, 18 bp, Homo sapiens
aacagatgacccctgccc

SEQ ID NO: 565204 - DNA, 23 bp, Homo sapiens
aacagattggattttatgttgac

SEQ ID NO: 565205 - DNA, 13 bp, Homo sapiens
aacagcaaattaa

SEQ ID NO: 565206 - DNA, 19 bp, Homo sapiens
aacagcaaattaatgtgta

SEQ ID NO: 565207 - DNA, 18 bp, Homo sapiens
aacagcagctgaagccag

SEQ ID NO: 565208 - DNA, 15 bp, Homo sapiens
aacagcaggttgtgt

SEQ ID NO: 565209 - DNA, 22 bp, Homo sapiens
aacagcccaggcatctccttgg

SEQ ID NO: 565210 - DNA, 23 bp, Homo sapiens
aacagctctgagatcctggagtg

SEQ ID NO: 565211 - DNA, 16 bp, Homo sapiens
aacaggattagacagt

SEQ ID NO: 565212 - DNA, 19 bp, Homo sapiens
aacagtaaagaaagcagaa

SEQ ID NO: 565213 - DNA, 14 bp, Homo sapiens
aacagtattttaag

SEQ ID NO: 565214 - DNA, 16 bp, Homo sapiens
aacagtattttaagaa

SEQ ID NO: 565215 - DNA, 23 bp, Homo sapiens
aacagtgcacctgggacagggag

SEQ ID NO: 565216 - DNA, 13 bp, Homo sapiens
aacagtttaaaaa

SEQ ID NO: 565217 - DNA, 20 bp, Homo sapiens
aacatacaatttacttttaa

SEQ ID NO: 565218 - DNA, 21 bp, Homo sapiens
aacatcatagaaactgtctag

SEQ ID NO: 565219 - DNA, 21 bp, Homo sapiens
aacatctgcagtgttctgtga

SEQ ID NO: 565220 - DNA, 23 bp, Homo sapiens
aacatctgcagtgttctgtgaat

SEQ ID NO: 565221 - DNA, 19 bp, Homo sapiens
aacatgacccgtacacacc

SEQ ID NO: 565222 - DNA, 17 bp, Homo sapiens
aacatgaggttctctct

SEQ ID NO: 565223 - DNA, 11 bp, Homo sapiens
aacatgtgtga

SEQ ID NO: 565224 - DNA, 12 bp, Homo sapiens
aacattaaatgt

SEQ ID NO: 565225 - DNA, 14 bp, Homo sapiens
aacattaaatgtct

SEQ ID NO: 565226 - DNA, 18 bp, Homo sapiens
aacattaaatgtcttata

SEQ ID NO: 565227 - DNA, 23 bp, Homo sapiens
aacattaaatgtcttatatagca

SEQ ID NO: 565228 - DNA, 15 bp, Homo sapiens
aacattagtacttta

SEQ ID NO: 565229 - DNA, 17 bp, Homo sapiens
aacattagtactttata

SEQ ID NO: 565230 - DNA, 18 bp, Homo sapiens
aacattgccttatattgg

SEQ ID NO: 565231 - DNA, 14 bp, Homo sapiens
aacattgcttttaa

SEQ ID NO: 565232 - DNA, 17 bp, Homo sapiens
aacattgcttttaaaac

SEQ ID NO: 565233 - DNA, 15 bp, Homo sapiens
aacattgtatgttaa

SEQ ID NO: 565234 - DNA, 19 bp, Homo sapiens
aacattgttgctccctgtg

SEQ ID NO: 565235 - DNA, 12 bp, Homo sapiens
aacatttcatgt

SEQ ID NO: 565236 - DNA, 13 bp, Homo sapiens
aacatttcatgta

SEQ ID NO: 565237 - DNA, 16 bp, Homo sapiens
aacatttttttaagca

SEQ ID NO: 565238 - DNA, 17 bp, Homo sapiens
aacatttttttaagcaa

SEQ ID NO: 565239 - DNA, 22 bp, Homo sapiens
aacatttttttaagcaacactt

SEQ ID NO: 565240 - DNA, 13 bp, Homo sapiens
aaccaaaggacat

SEQ ID NO: 565241 - DNA, 17 bp, Homo sapiens
aaccaattcactttaga

SEQ ID NO: 565242 - DNA, 17 bp, Homo sapiens
aaccaatttcttccttc

SEQ ID NO: 565243 - DNA, 19 bp, Homo sapiens
aaccaatttcttccttcca

SEQ ID NO: 565244 - DNA, 15 bp, Homo sapiens
aaccaatttgttctg

SEQ ID NO: 565245 - DNA, 13 bp, Homo sapiens
aaccacagctcct

SEQ ID NO: 565246 - DNA, 13 bp, Homo sapiens
aaccagaaagagg

SEQ ID NO: 565247 - DNA, 14 bp, Homo sapiens
aaccatgttcttga

SEQ ID NO: 565248 - DNA, 22 bp, Homo sapiens
aaccatgttcttgagcagctga

SEQ ID NO: 565249 - DNA, 11 bp, Homo sapiens
aacccaaagat

SEQ ID NO: 565250 - DNA, 12 bp, Homo sapiens
aacccaaagatg

SEQ ID NO: 565251 - DNA, 17 bp, Homo sapiens
aacccaaagatgttaac

SEQ ID NO: 565252 - DNA, 12 bp, Homo sapiens
aaccccttccca

SEQ ID NO: 565253 - DNA, 16 bp, Homo sapiens
aacccggcttcctgtg

SEQ ID NO: 565254 - DNA, 18 bp, Homo sapiens
aaccctatgccttttgta

SEQ ID NO: 565255 - DNA, 14 bp, Homo sapiens
aaccctgcccagcc

SEQ ID NO: 565256 - DNA, 23 bp, Homo sapiens
aaccctgtcaaacattagtactt

SEQ ID NO: 565257 - DNA, 11 bp, Homo sapiens
aacccttacag

SEQ ID NO: 565258 - DNA, 16 bp, Homo sapiens
aaccgaggacccatga

SEQ ID NO: 565259 - DNA, 17 bp, Homo sapiens
aacctactgttcctttc

SEQ ID NO: 565260 - DNA, 17 bp, Homo sapiens
aacctcccctggtcctg

SEQ ID NO: 565261 - DNA, 19 bp, Homo sapiens
aacctcccctggtcctgca

SEQ ID NO: 565262 - DNA, 11 bp, Homo sapiens
aacctggagat

SEQ ID NO: 565263 - DNA, 17 bp, Homo sapiens
aacctggagatggggag

SEQ ID NO: 565264 - DNA, 11 bp, Homo sapiens
aacctgtctga

SEQ ID NO: 565265 - DNA, 14 bp, Homo sapiens
aacctgtcttttgg

SEQ ID NO: 565266 - DNA, 11 bp, Homo sapiens
aacctttcccc

SEQ ID NO: 565267 - DNA, 14 bp, Homo sapiens
aacgaaaatcattg

SEQ ID NO: 565268 - DNA, 13 bp, Homo sapiens
aacgaaagctggg

SEQ ID NO: 565269 - DNA, 17 bp, Homo sapiens
aacgaccgtcttttgaa

SEQ ID NO: 565270 - DNA, 17 bp, Homo sapiens
aacggccccagcttctc

SEQ ID NO: 565271 - DNA, 13 bp, Homo sapiens
aacggttaaaact

SEQ ID NO: 565272 - DNA, 14 bp, Homo sapiens
aacggttaaaactg

SEQ ID NO: 565273 - DNA, 15 bp, Homo sapiens
aacgtctttttaagc

SEQ ID NO: 565274 - DNA, 22 bp, Homo sapiens
aacgtctttttaagcctttgaa

SEQ ID NO: 565275 - DNA, 17 bp, Homo sapiens
aacgtggggcagcacag

SEQ ID NO: 565276 - DNA, 20 bp, Homo sapiens
aacgtgtatgtttttcagtt

SEQ ID NO: 565277 - DNA, 23 bp, Homo sapiens
aatcttcctggtcgaaagttagt

SEQ ID NO: 565278 - DNA, 17 bp, Homo sapiens
aatctttagaaaaggca

SEQ ID NO: 565279 - DNA, 21 bp, Homo sapiens
aatgaaaataagtgaataata

SEQ ID NO: 565280 - DNA, 16 bp, Homo sapiens
aatgaaatacttgaca

SEQ ID NO: 565281 - DNA, 22 bp, Homo sapiens
aatgaaatacttgacaacattt

SEQ ID NO: 565282 - DNA, 13 bp, Homo sapiens
aatgaaatgtttt

SEQ ID NO: 565283 - DNA, 14 bp, Homo sapiens
aatgaacacaaatt

SEQ ID NO: 565284 - DNA, 21 bp, Homo sapiens
aatgaagatctttgttttttg

SEQ ID NO: 565285 - DNA, 22 bp, Homo sapiens
aatgacaagtgacttatttgct

SEQ ID NO: 565286 - DNA, 19 bp, Homo sapiens
aatgaccttgtaatgtaac

SEQ ID NO: 565287 - DNA, 22 bp, Homo sapiens
aatgaccttgtaatgtaactgc

SEQ ID NO: 565288 - DNA, 22 bp, Homo sapiens
aatgagacagcagtcttatgct

SEQ ID NO: 565289 - DNA, 18 bp, Homo sapiens
aatgagcaatatctgcta

SEQ ID NO: 565290 - DNA, 19 bp, Homo sapiens
aatgagggcgtgaaacaca

SEQ ID NO: 565291 - DNA, 22 bp, Homo sapiens
aatgagggcgtgaaacacaata

SEQ ID NO: 565292 - DNA, 23 bp, Homo sapiens
aatgagggcgtgaaacacaatat

SEQ ID NO: 565293 - DNA, 21 bp, Homo sapiens
aatgataaaatcccattgtat

SEQ ID NO: 565294 - DNA, 16 bp, Homo sapiens
aatgattaatacctga

SEQ ID NO: 565295 - DNA, 14 bp, Homo sapiens
aatgattattttca

SEQ ID NO: 565296 - DNA, 18 bp, Homo sapiens
aatgattattttcattac

SEQ ID NO: 565297 - DNA, 19 bp, Homo sapiens
aatgattattttcattaca

SEQ ID NO: 565298 - DNA, 19 bp, Homo sapiens
aatgattcacttttattgt

SEQ ID NO: 565299 - DNA, 15 bp, Homo sapiens
aatgattgcttttaa

SEQ ID NO: 565300 - DNA, 17 bp, Homo sapiens
aatgcacaatgtcttgg

SEQ ID NO: 565301 - DNA, 18 bp, Homo sapiens
aatgcacatccattccca

SEQ ID NO: 565302 - DNA, 16 bp, Homo sapiens
aatgcatgctttccat

SEQ ID NO: 565303 - DNA, 18 bp, Homo sapiens
aatgcatgctttccatat

SEQ ID NO: 565304 - DNA, 20 bp, Homo sapiens
aatgcatgctttccatattt

SEQ ID NO: 565305 - DNA, 17 bp, Homo sapiens
aatgcatttaagttgta

SEQ ID NO: 565306 - DNA, 18 bp, Homo sapiens
aatgcatttaagttgtaa

SEQ ID NO: 565307 - DNA, 20 bp, Homo sapiens
aatgcatttaagttgtaaac

SEQ ID NO: 565308 - DNA, 16 bp, Homo sapiens
aatgctatgtcatttc

SEQ ID NO: 565309 - DNA, 18 bp, Homo sapiens
aatgctatgtcatttcat

SEQ ID NO: 565310 - DNA, 16 bp, Homo sapiens
aatgctatttgtgtaa

SEQ ID NO: 565311 - DNA, 13 bp, Homo sapiens
aatgctgatttaa

SEQ ID NO: 565312 - DNA, 14 bp, Homo sapiens
aatgcttaaatgat

SEQ ID NO: 565313 - DNA, 16 bp, Homo sapiens
aatggaagagaaatct

SEQ ID NO: 565314 - DNA, 18 bp, Homo sapiens
aatggaagagaaatctca

SEQ ID NO: 565315 - DNA, 17 bp, Homo sapiens
aatggcaacaaactgca

SEQ ID NO: 565316 - DNA, 20 bp, Homo sapiens
aatggcaatgttttgctttt

SEQ ID NO: 565317 - DNA, 18 bp, Homo sapiens
aatggcatttagcacagt

SEQ ID NO: 565318 - DNA, 18 bp, Homo sapiens
aatggccttaattaattc

SEQ ID NO: 565319 - DNA, 15 bp, Homo sapiens
aatggggacgcagat

SEQ ID NO: 565320 - DNA, 13 bp, Homo sapiens
aatggtaactttt

SEQ ID NO: 565321 - DNA, 14 bp, Homo sapiens
aatggtaacttttg

SEQ ID NO: 565322 - DNA, 15 bp, Homo sapiens
aatggtaacttttgt

SEQ ID NO: 565323 - DNA, 17 bp, Homo sapiens
aatggtaacttttgtag

SEQ ID NO: 565324 - DNA, 21 bp, Homo sapiens
aatggtaacttttgtagtctt

SEQ ID NO: 565325 - DNA, 13 bp, Homo sapiens
aatggtaatttag

SEQ ID NO: 565326 - DNA, 15 bp, Homo sapiens
aatggtaatttagtg

SEQ ID NO: 565327 - DNA, 22 bp, Homo sapiens
aatggtacaaaaccacagtgta

SEQ ID NO: 565328 - DNA, 21 bp, Homo sapiens
aatggtcccaattaagaaatt

SEQ ID NO: 565329 - DNA, 18 bp, Homo sapiens
aatggtctaaaaataaac

SEQ ID NO: 565330 - DNA, 13 bp, Homo sapiens
aatggtctggcaa

SEQ ID NO: 565331 - DNA, 22 bp, Homo sapiens
aatggtgaactgtcattacaga

SEQ ID NO: 565332 - DNA, 11 bp, Homo sapiens
aatgtaactgc

SEQ ID NO: 565333 - DNA, 13 bp, Homo sapiens
aatgtaactgtta

SEQ ID NO: 565334 - DNA, 23 bp, Homo sapiens
aatgtacatctcccctttgctaa

SEQ ID NO: 565335 - DNA, 14 bp, Homo sapiens
aatgtatagtattt

SEQ ID NO: 565336 - DNA, 15 bp, Homo sapiens
aatgtatagtatttg

SEQ ID NO: 565337 - DNA, 19 bp, Homo sapiens
aatgtatagtatttgaaaa

SEQ ID NO: 565338 - DNA, 22 bp, Homo sapiens
aatgtatagtatttgaaaacag

SEQ ID NO: 565339 - DNA, 14 bp, Homo sapiens
aatgtatatacaca

SEQ ID NO: 565340 - DNA, 13 bp, Homo sapiens
aatgtcactgtta

SEQ ID NO: 565341 - DNA, 17 bp, Homo sapiens
aatgtcactgttataaa

SEQ ID NO: 565342 - DNA, 19 bp, Homo sapiens
aatgtcactgttataaatt

SEQ ID NO: 565343 - DNA, 21 bp, Homo sapiens
aatgtcactgttataaatttt

SEQ ID NO: 565344 - DNA, 12 bp, Homo sapiens
aatgtgaattac

SEQ ID NO: 565345 - DNA, 14 bp, Homo sapiens
aatgtgtaaaattg

SEQ ID NO: 565346 - DNA, 16 bp, Homo sapiens
aatgtgtgcttggaaa

SEQ ID NO: 565347 - DNA, 20 bp, Homo sapiens
aatgttaaagatgtagcaaa

SEQ ID NO: 565348 - DNA, 12 bp, Homo sapiens
aatgttcttcca

SEQ ID NO: 565349 - DNA, 14 bp, Homo sapiens
aatgttcttccagt

SEQ ID NO: 565350 - DNA, 23 bp, Homo sapiens
aatgttgaagaactcatgtgatt

SEQ ID NO: 565351 - DNA, 14 bp, Homo sapiens
aatgttgatttcta

SEQ ID NO: 565352 - DNA, 15 bp, Homo sapiens
aatgttgatttctag

SEQ ID NO: 565353 - DNA, 17 bp, Homo sapiens
aatgttgatttctagtt

SEQ ID NO: 565354 - DNA, 18 bp, Homo sapiens
aatgttgatttctagtta

SEQ ID NO: 565355 - DNA, 20 bp, Homo sapiens
aatgtttaagcagaattgga

SEQ ID NO: 565356 - DNA, 13 bp, Homo sapiens
aatgtttgatgtc

SEQ ID NO: 565357 - DNA, 14 bp, Homo sapiens
aatgttttgctttt

SEQ ID NO: 565358 - DNA, 20 bp, Homo sapiens
ccgctagagcagcccaaatt

SEQ ID NO: 565359 - DNA, 14 bp, Homo sapiens
ccggagctgggaag

SEQ ID NO: 565360 - DNA, 17 bp, Homo sapiens
ccggcagccccccagtg

SEQ ID NO: 565361 - DNA, 19 bp, Homo sapiens
ccggcatgccgagtgcccc

SEQ ID NO: 565362 - DNA, 14 bp, Homo sapiens
ccggcccagttttg

SEQ ID NO: 565363 - DNA, 21 bp, Homo sapiens
ccgggagatccgccctgggct

SEQ ID NO: 565364 - DNA, 18 bp, Homo sapiens
ccggggtcctgaggctgg

SEQ ID NO: 565365 - DNA, 15 bp, Homo sapiens
ccgggtgcctgtgac

SEQ ID NO: 565366 - DNA, 16 bp, Homo sapiens
ccgggtgcctgtgacc

SEQ ID NO: 565367 - DNA, 18 bp, Homo sapiens
ccggtgacctctagccct

SEQ ID NO: 565368 - DNA, 16 bp, Homo sapiens
ccggtgggggggcaga

SEQ ID NO: 565369 - DNA, 16 bp, Homo sapiens
ccgtaaaaactgaagt

SEQ ID NO: 565370 - DNA, 13 bp, Homo sapiens
ccgtcacatccca

SEQ ID NO: 565371 - DNA, 16 bp, Homo sapiens
ccgtcctggcagggca

SEQ ID NO: 565372 - DNA, 21 bp, Homo sapiens
ccgtcctggcagggcaggcag

SEQ ID NO: 565373 - DNA, 13 bp, Homo sapiens
ccgtgcacggggc

SEQ ID NO: 565374 - DNA, 19 bp, Homo sapiens
ccgtgccaaatcctgggca

SEQ ID NO: 565375 - DNA, 23 bp, Homo sapiens
ccgtgtattcaggaccccatctg

SEQ ID NO: 565376 - DNA, 23 bp, Homo sapiens
ccgtgtggagggctgcagagcct

SEQ ID NO: 565377 - DNA, 19 bp, Homo sapiens
ccgtgtttgtctcttctgg

SEQ ID NO: 565378 - DNA, 23 bp, Homo sapiens
ccgttgtgtgggtttactctgtg

SEQ ID NO: 565379 - DNA, 21 bp, Homo sapiens
ccgtttgatttgtcactgctt

SEQ ID NO: 565380 - DNA, 23 bp, Homo sapiens
ccgtttgatttgtcactgcttca

SEQ ID NO: 565381 - DNA, 16 bp, Homo sapiens
cctaagagatttatct

SEQ ID NO: 565382 - DNA, 13 bp, Homo sapiens
cctaatattgaaa

SEQ ID NO: 565383 - DNA, 15 bp, Homo sapiens
cctacagcagatcca

SEQ ID NO: 565384 - DNA, 21 bp, Homo sapiens
cctacagcagatccacctgca

SEQ ID NO: 565385 - DNA, 20 bp, Homo sapiens
cctactcttctctctgctct

SEQ ID NO: 565386 - DNA, 21 bp, Homo sapiens
cctactcttctctctgctctg

SEQ ID NO: 565387 - DNA, 14 bp, Homo sapiens
cctactgttccttt

SEQ ID NO: 565388 - DNA, 15 bp, Homo sapiens
cctactgttcctttc

SEQ ID NO: 565389 - DNA, 16 bp, Homo sapiens
cctactgttcctttca

SEQ ID NO: 565390 - DNA, 16 bp, Homo sapiens
cctaggtagccccctc

SEQ ID NO: 565391 - DNA, 19 bp, Homo sapiens
cctagtggcttcagcccct

SEQ ID NO: 565392 - DNA, 18 bp, Homo sapiens
cctagttcatcccttctc

SEQ ID NO: 565393 - DNA, 21 bp, Homo sapiens
cctagttcatcccttctcttc

SEQ ID NO: 565394 - DNA, 22 bp, Homo sapiens
cctagttcatcccttctcttcc

SEQ ID NO: 565395 - DNA, 17 bp, Homo sapiens
cctataatgtgtgtatg

SEQ ID NO: 565396 - DNA, 19 bp, Homo sapiens
cctataatgtgtgtatgtg

SEQ ID NO: 565397 - DNA, 12 bp, Homo sapiens
cctataccattt

SEQ ID NO: 565398 - DNA, 23 bp, Homo sapiens
cctataccatttccgtaattctt

SEQ ID NO: 565399 - DNA, 22 bp, Homo sapiens
cctatgaagttggcacatttca

SEQ ID NO: 565400 - DNA, 18 bp, Homo sapiens
cctatgactcaaagatga

SEQ ID NO: 565401 - DNA, 16 bp, Homo sapiens
cctatgccttttgtag

SEQ ID NO: 565402 - DNA, 21 bp, Homo sapiens
cctattgctgtaaataaaaat

SEQ ID NO: 565403 - DNA, 23 bp, Homo sapiens
cctattgctgtaaataaaaatag

SEQ ID NO: 565404 - DNA, 16 bp, Homo sapiens
cctcacccctgcaggc

SEQ ID NO: 565405 - DNA, 12 bp, Homo sapiens
cctcagccctca

SEQ ID NO: 565406 - DNA, 13 bp, Homo sapiens
cctcaggaccctc

SEQ ID NO: 565407 - DNA, 13 bp, Homo sapiens
cctcaggaggcag

SEQ ID NO: 565408 - DNA, 23 bp, Homo sapiens
cctcatcagtatttggacttttt

SEQ ID NO: 565409 - DNA, 19 bp, Homo sapiens
cctcatcccgacctcttag

SEQ ID NO: 565410 - DNA, 14 bp, Homo sapiens
cctcatctgtctgg

SEQ ID NO: 565411 - DNA, 13 bp, Homo sapiens
cctcatgggagtc

SEQ ID NO: 565412 - DNA, 22 bp, Homo sapiens
cctcattccctcgtctttccca

SEQ ID NO: 565413 - DNA, 14 bp, Homo sapiens
cctccaactggatg

SEQ ID NO: 565414 - DNA, 18 bp, Homo sapiens
cctccacctgggagatgc

SEQ ID NO: 565415 - DNA, 22 bp, Homo sapiens
cctccacctgggagatgctggg

SEQ ID NO: 565416 - DNA, 12 bp, Homo sapiens
cctccagaactc

SEQ ID NO: 565417 - DNA, 17 bp, Homo sapiens
cctccagaactcttcct

SEQ ID NO: 565418 - DNA, 18 bp, Homo sapiens
cctccagaactcttcctc

SEQ ID NO: 565419 - DNA, 20 bp, Homo sapiens
cctccagaactcttcctcca

SEQ ID NO: 565420 - DNA, 16 bp, Homo sapiens
cctccagttctgatga

SEQ ID NO: 565421 - DNA, 19 bp, Homo sapiens
cctccatcctcctccttcc

SEQ ID NO: 565422 - DNA, 17 bp, Homo sapiens
cctccatgattccaagg

SEQ ID NO: 565423 - DNA, 22 bp, Homo sapiens
cctccccaaggccccctgcctg

SEQ ID NO: 565424 - DNA, 12 bp, Homo sapiens
cctccccctcct

SEQ ID NO: 565425 - DNA, 19 bp, Homo sapiens
cctcccctggtcctgcact

SEQ ID NO: 565426 - DNA, 14 bp, Homo sapiens
cctccccttcccag

SEQ ID NO: 565427 - DNA, 12 bp, Homo sapiens
cctccctcccag

SEQ ID NO: 565428 - DNA, 17 bp, Homo sapiens
cctccctcccagatcca

SEQ ID NO: 565429 - DNA, 14 bp, Homo sapiens
cctcccttgtcctt

SEQ ID NO: 565430 - DNA, 13 bp, Homo sapiens
cctccgcccttcc

SEQ ID NO: 565431 - DNA, 16 bp, Homo sapiens
cctccgtcctggcagg

SEQ ID NO: 565432 - DNA, 23 bp, Homo sapiens
cctccgtcctggcagggcaggca

SEQ ID NO: 565433 - DNA, 15 bp, Homo sapiens
cctcctgatgtcttg

SEQ ID NO: 565434 - DNA, 16 bp, Homo sapiens
cctcctgctgccagta

SEQ ID NO: 565435 - DNA, 18 bp, Homo sapiens
cctcctgtggcctgccag

SEQ ID NO: 565436 - DNA, 14 bp, Homo sapiens
cctccttcccagct

SEQ ID NO: 565437 - DNA, 20 bp, Homo sapiens
cctccttgtcttggcagcct

SEQ ID NO: 565438 - DNA, 23 bp, Homo sapiens
cctcgatgttcatggaattggtt

SEQ ID NO: 565439 - DNA, 21 bp, Homo sapiens
cctcgcaggcctccctgccag

SEQ ID NO: 565440 - DNA, 12 bp, Homo sapiens
cctcgctggccc

SEQ ID NO: 565441 - DNA, 18 bp, Homo sapiens
cctcgctggcccccactg

SEQ ID NO: 565442 - DNA, 22 bp, Homo sapiens
cctcgctggcccccactggctg

SEQ ID NO: 565443 - DNA, 15 bp, Homo sapiens
cctcggccagagctc

SEQ ID NO: 565444 - DNA, 15 bp, Homo sapiens
ccttcctgttctgtg

SEQ ID NO: 565445 - DNA, 20 bp, Homo sapiens
ccttcctgttctgtgtctgc

SEQ ID NO: 565446 - DNA, 22 bp, Homo sapiens
ccttctaatccatgtgctgctg

SEQ ID NO: 565447 - DNA, 16 bp, Homo sapiens
ccttctacctgcagga

SEQ ID NO: 565448 - DNA, 23 bp, Homo sapiens
ccttctacttacacatcttccac

SEQ ID NO: 565449 - DNA, 17 bp, Homo sapiens
ccttctctcacctccta

SEQ ID NO: 565450 - DNA, 18 bp, Homo sapiens
ccttctctcacctcctaa

SEQ ID NO: 565451 - DNA, 13 bp, Homo sapiens
ccttctcttccag

SEQ ID NO: 565452 - DNA, 17 bp, Homo sapiens
ccttctcttccaggcag

SEQ ID NO: 565453 - DNA, 18 bp, Homo sapiens
ccttctcttccaggcagc

SEQ ID NO: 565454 - DNA, 19 bp, Homo sapiens
ccttctcttccaggcagcc

SEQ ID NO: 565455 - DNA, 19 bp, Homo sapiens
ccttctgagctggcctctc

SEQ ID NO: 565456 - DNA, 14 bp, Homo sapiens
ccttctgtcgtccc

SEQ ID NO: 565457 - DNA, 15 bp, Homo sapiens
ccttctgtcgtcccc

SEQ ID NO: 565458 - DNA, 23 bp, Homo sapiens
ccttctgtcgtccccagaccagt

SEQ ID NO: 565459 - DNA, 21 bp, Homo sapiens
ccttgagaatgagggcgtgaa

SEQ ID NO: 565460 - DNA, 19 bp, Homo sapiens
ccttgaggacctccacctg

SEQ ID NO: 565461 - DNA, 21 bp, Homo sapiens
ccttgaggggagccaggaggg

SEQ ID NO: 565462 - DNA, 15 bp, Homo sapiens
ccttgatttgttctt

SEQ ID NO: 565463 - DNA, 17 bp, Homo sapiens
ccttgcacacatcatct

SEQ ID NO: 565464 - DNA, 21 bp, Homo sapiens
ccttgcattttagctaattta

SEQ ID NO: 565465 - DNA, 21 bp, Homo sapiens
ccttgcccactcctgctctgc

SEQ ID NO: 565466 - DNA, 22 bp, Homo sapiens
ccttgcccactcctgctctgct

SEQ ID NO: 565467 - DNA, 16 bp, Homo sapiens
ccttgcttacctctca

SEQ ID NO: 565468 - DNA, 16 bp, Homo sapiens
ccttggcgcgcagccc

SEQ ID NO: 565469 - DNA, 21 bp, Homo sapiens
ccttgggatgggcacaggctg

SEQ ID NO: 565470 - DNA, 20 bp, Homo sapiens
ccttgtgatcactttctgaa

SEQ ID NO: 565471 - DNA, 13 bp, Homo sapiens
ccttgttccagtt

SEQ ID NO: 565472 - DNA, 17 bp, Homo sapiens
ccttgttgtttcttgcc

SEQ ID NO: 565473 - DNA, 19 bp, Homo sapiens
cctttaatcaggtcctgct

SEQ ID NO: 565474 - DNA, 18 bp, Homo sapiens
cctttaccctcatctgtc

SEQ ID NO: 565475 - DNA, 18 bp, Homo sapiens
cctttatcatgtgtttct

SEQ ID NO: 565476 - DNA, 13 bp, Homo sapiens
cctttatgtattc

SEQ ID NO: 565477 - DNA, 12 bp, Homo sapiens
cctttatgtgat

SEQ ID NO: 565478 - DNA, 16 bp, Homo sapiens
cctttatttctgtatc

SEQ ID NO: 565479 - DNA, 18 bp, Homo sapiens
cctttatttctgtatctg

SEQ ID NO: 565480 - DNA, 17 bp, Homo sapiens
cctttcacttctttccc

SEQ ID NO: 565481 - DNA, 17 bp, Homo sapiens
cctttcagcaggcagcc

SEQ ID NO: 565482 - DNA, 14 bp, Homo sapiens
atcctcctccttcc

SEQ ID NO: 565483 - DNA, 16 bp, Homo sapiens
atcctgggcatcccca

SEQ ID NO: 565484 - DNA, 20 bp, Homo sapiens
atcctgggcatccccagccc

SEQ ID NO: 565485 - DNA, 22 bp, Homo sapiens
atcctgggcttttgttttgctt

SEQ ID NO: 565486 - DNA, 17 bp, Homo sapiens
atcctgtcctcagcttc

SEQ ID NO: 565487 - DNA, 18 bp, Homo sapiens
atcctgtcctcagcttct

SEQ ID NO: 565488 - DNA, 17 bp, Homo sapiens
atccttaatggccttaa

SEQ ID NO: 565489 - DNA, 16 bp, Homo sapiens
atccttacaaatgatt

SEQ ID NO: 565490 - DNA, 15 bp, Homo sapiens
atccttgtcagttgt

SEQ ID NO: 565491 - DNA, 16 bp, Homo sapiens
atccttttctcctatc

SEQ ID NO: 565492 - DNA, 12 bp, Homo sapiens
atccttttctgt

SEQ ID NO: 565493 - DNA, 17 bp, Homo sapiens
atcgaaaattcatttca

SEQ ID NO: 565494 - DNA, 17 bp, Homo sapiens
atcgcaagtcacagaaa

SEQ ID NO: 565495 - DNA, 14 bp, Homo sapiens
atcgggagtagcaa

SEQ ID NO: 565496 - DNA, 15 bp, Homo sapiens
atcgggggctggggc

SEQ ID NO: 565497 - DNA, 18 bp, Homo sapiens
atctaaactttaatatgt

SEQ ID NO: 565498 - DNA, 14 bp, Homo sapiens
atctaaatattatg

SEQ ID NO: 565499 - DNA, 16 bp, Homo sapiens
atctaaatctgtccaa

SEQ ID NO: 565500 - DNA, 19 bp, Homo sapiens
atctaaattaacttctatt

SEQ ID NO: 565501 - DNA, 12 bp, Homo sapiens
atctaccaactt

SEQ ID NO: 565502 - DNA, 18 bp, Homo sapiens
atctaccaactttcaaga

SEQ ID NO: 565503 - DNA, 19 bp, Homo sapiens
atctaccaactttcaagaa

SEQ ID NO: 565504 - DNA, 15 bp, Homo sapiens
atctagatgtaaatt

SEQ ID NO: 565505 - DNA, 13 bp, Homo sapiens
atctatagaaagt

SEQ ID NO: 565506 - DNA, 17 bp, Homo sapiens
atctatagaaagtgttc

SEQ ID NO: 565507 - DNA, 14 bp, Homo sapiens
atctatcagagtat

SEQ ID NO: 565508 - DNA, 19 bp, Homo sapiens
atctatctaatcagatctt

SEQ ID NO: 565509 - DNA, 21 bp, Homo sapiens
atctcaaaagatctcctgtgc

SEQ ID NO: 565510 - DNA, 19 bp, Homo sapiens
atctcctggtgttctgcag

SEQ ID NO: 565511 - DNA, 16 bp, Homo sapiens
atctctacccctttct

SEQ ID NO: 565512 - DNA, 11 bp, Homo sapiens
atctctgaaag

SEQ ID NO: 565513 - DNA, 14 bp, Homo sapiens
atctcttcttcctt

SEQ ID NO: 565514 - DNA, 13 bp, Homo sapiens
atctgaagattgt

SEQ ID NO: 565515 - DNA, 20 bp, Homo sapiens
atctgaagattgtttatcta

SEQ ID NO: 565516 - DNA, 23 bp, Homo sapiens
atctgaagcttcactcactgtca

SEQ ID NO: 565517 - DNA, 17 bp, Homo sapiens
atctgacatatttcata

SEQ ID NO: 565518 - DNA, 15 bp, Homo sapiens
atctgaccacagaca

SEQ ID NO: 565519 - DNA, 16 bp, Homo sapiens
atctgaccacagacac

SEQ ID NO: 565520 - DNA, 17 bp, Homo sapiens
atctgaccacagacact

SEQ ID NO: 565521 - DNA, 20 bp, Homo sapiens
atctgatatcaggaaatatc

SEQ ID NO: 565522 - DNA, 19 bp, Homo sapiens
atctgatgatgttctgaaa

SEQ ID NO: 565523 - DNA, 18 bp, Homo sapiens
atctgcagtgttctgtga

SEQ ID NO: 565524 - DNA, 21 bp, Homo sapiens
atctgcagtgttctgtgaata

SEQ ID NO: 565525 - DNA, 14 bp, Homo sapiens
atctgctgggatct

SEQ ID NO: 565526 - DNA, 21 bp, Homo sapiens
atctggaattggtttagccca

SEQ ID NO: 565527 - DNA, 17 bp, Homo sapiens
atctggggagctcctgg

SEQ ID NO: 565528 - DNA, 19 bp, Homo sapiens
atctgggttttgcctctgc

SEQ ID NO: 565529 - DNA, 14 bp, Homo sapiens
atctgtaagctgtt

SEQ ID NO: 565530 - DNA, 13 bp, Homo sapiens
atctgtatgcctc

SEQ ID NO: 565531 - DNA, 12 bp, Homo sapiens
atctgtcagttc

SEQ ID NO: 565532 - DNA, 11 bp, Homo sapiens
atctgtctgct

SEQ ID NO: 565533 - DNA, 14 bp, Homo sapiens
atctgtctgctggt

SEQ ID NO: 565534 - DNA, 14 bp, Homo sapiens
atctgtctggaggg

SEQ ID NO: 565535 - DNA, 16 bp, Homo sapiens
atctgtggtcttcaaa

SEQ ID NO: 565536 - DNA, 13 bp, Homo sapiens
atcttattaaagt

SEQ ID NO: 565537 - DNA, 16 bp, Homo sapiens
atcttattaaagtttc

SEQ ID NO: 565538 - DNA, 23 bp, Homo sapiens
atcttattaaagtttcaaaaatc

SEQ ID NO: 565539 - DNA, 14 bp, Homo sapiens
atcttcctctgcta

SEQ ID NO: 565540 - DNA, 16 bp, Homo sapiens
atcttcctctgctaaa

SEQ ID NO: 565541 - DNA, 18 bp, Homo sapiens
atcttcctctgctaaatt

SEQ ID NO: 565542 - DNA, 20 bp, Homo sapiens
atcttcctggtcgaaagtta

SEQ ID NO: 565543 - DNA, 14 bp, Homo sapiens
atcttctcatcttt

SEQ ID NO: 565544 - DNA, 15 bp, Homo sapiens
atcttcttttgggag

SEQ ID NO: 565545 - DNA, 14 bp, Homo sapiens
atcttgacagagcc

SEQ ID NO: 565546 - DNA, 18 bp, Homo sapiens
atcttggcaggtaggaat

SEQ ID NO: 565547 - DNA, 19 bp, Homo sapiens
atcttggcaggtaggaata

SEQ ID NO: 565548 - DNA, 16 bp, Homo sapiens
atctttatacagattt

SEQ ID NO: 565549 - DNA, 13 bp, Homo sapiens
atctttctttcca

SEQ ID NO: 565550 - DNA, 14 bp, Homo sapiens
atctttctttccat

SEQ ID NO: 565551 - DNA, 19 bp, Homo sapiens
atctttgaaaactcataca

SEQ ID NO: 565552 - DNA, 21 bp, Homo sapiens
atctttttaacctctgttcag

SEQ ID NO: 565553 - DNA, 16 bp, Homo sapiens
atctttttttaagtgt

SEQ ID NO: 565554 - DNA, 13 bp, Homo sapiens
atgaaacagcagc

SEQ ID NO: 565555 - DNA, 14 bp, Homo sapiens
atgaaatgctatgt

SEQ ID NO: 565556 - DNA, 22 bp, Homo sapiens
atgaaatgctatgtcatttcat

SEQ ID NO: 565557 - DNA, 16 bp, Homo sapiens
atgaaatttaagcaca

SEQ ID NO: 565558 - DNA, 15 bp, Homo sapiens
atgaacacaaattat

SEQ ID NO: 565559 - DNA, 16 bp, Homo sapiens
atgaacacaaattatg

SEQ ID NO: 565560 - DNA, 20 bp, Homo sapiens
atgaacacaaattatgctaa

SEQ ID NO: 565561 - DNA, 17 bp, Homo sapiens
atgaacagctctgagat

SEQ ID NO: 565562 - DNA, 14 bp, Homo sapiens
atgaagatctttgt

SEQ ID NO: 565563 - DNA, 20 bp, Homo sapiens
atgaagccctaagtaaatct

SEQ ID NO: 565564 - DNA, 19 bp, Homo sapiens
atgaagtaacttgtcttaa

SEQ ID NO: 565565 - DNA, 21 bp, Homo sapiens
atgaagtaacttgtcttaaat

SEQ ID NO: 565566 - DNA, 19 bp, Homo sapiens
atgaagttggcacatttca

SEQ ID NO: 565567 - DNA, 19 bp, Homo sapiens
atgaatgtatattttgtgt

SEQ ID NO: 565568 - DNA, 15 bp, Homo sapiens
atgacaggctgttca

SEQ ID NO: 565569 - DNA, 23 bp, Homo sapiens
atgaccaaatatcaccaggactg

SEQ ID NO: 565570 - DNA, 20 bp, Homo sapiens
atgaccaattttaacttaga

SEQ ID NO: 565571 - DNA, 16 bp, Homo sapiens
atgacccccccagctt

SEQ ID NO: 565572 - DNA, 11 bp, Homo sapiens
atgacccctcc

SEQ ID NO: 565573 - DNA, 14 bp, Homo sapiens
atgacccctgccca

SEQ ID NO: 565574 - DNA, 20 bp, Homo sapiens
atgaccttgtaatgtaactg

SEQ ID NO: 565575 - DNA, 13 bp, Homo sapiens
atgactcaaagat

SEQ ID NO: 565576 - DNA, 14 bp, Homo sapiens
atgactcaaagatg

SEQ ID NO: 565577 - DNA, 16 bp, Homo sapiens
atgagaaatataaaaa

SEQ ID NO: 565578 - DNA, 19 bp, Homo sapiens
atgagaaatataaaaataa

SEQ ID NO: 565579 - DNA, 14 bp, Homo sapiens
atgagactgtttat

SEQ ID NO: 565580 - DNA, 15 bp, Homo sapiens
atgagagttccttct

SEQ ID NO: 565581 - DNA, 19 bp, Homo sapiens
atgagatcactgaactttt

SEQ ID NO: 565582 - DNA, 20 bp, Homo sapiens
atgagatcactgaacttttc

SEQ ID NO: 565583 - DNA, 17 bp, Homo sapiens
atgagcaatatctgcta

SEQ ID NO: 565584 - DNA, 18 bp, Homo sapiens
atgaggatgtatgtgtat

SEQ ID NO: 565585 - DNA, 14 bp, Homo sapiens
atgaggctggatag

SEQ ID NO: 565586 - DNA, 14 bp, Homo sapiens
atgaggttctctct

SEQ ID NO: 565587 - DNA, 17 bp, Homo sapiens
atgagtatacaatatat

SEQ ID NO: 565588 - DNA, 18 bp, Homo sapiens
atgagtatacaatatata

SEQ ID NO: 565589 - DNA, 21 bp, Homo sapiens
atgagtatacaatatataaaa

SEQ ID NO: 565590 - DNA, 23 bp, Homo sapiens
atgagtatacaatatataaaaat

SEQ ID NO: 565591 - DNA, 15 bp, Homo sapiens
atgagtcacttactt

SEQ ID NO: 565592 - DNA, 20 bp, Homo sapiens
atgagtgctaagagcctctg

SEQ ID NO: 565593 - DNA, 22 bp, Homo sapiens
atgataaaatcccattgtattt

SEQ ID NO: 565594 - DNA, 15 bp, Homo sapiens
atgatacttggtcct

SEQ ID NO: 565595 - DNA, 19 bp, Homo sapiens
atgatattccccatttcct

SEQ ID NO: 565596 - DNA, 20 bp, Homo sapiens
atgatattccccatttcctg

SEQ ID NO: 565597 - DNA, 16 bp, Homo sapiens
atgatcaaggagggag

SEQ ID NO: 565598 - DNA, 18 bp, Homo sapiens
atgatcaaggagggagaa

SEQ ID NO: 565599 - DNA, 19 bp, Homo sapiens
atgatccagagcagagttt

SEQ ID NO: 565600 - DNA, 17 bp, Homo sapiens
atgatgtttttaaaatc

SEQ ID NO: 565601 - DNA, 18 bp, Homo sapiens
atgatgtttttaaaatct

SEQ ID NO: 565602 - DNA, 18 bp, Homo sapiens
atgattattttcattaca

SEQ ID NO: 565603 - DNA, 21 bp, Homo sapiens
atgattcacttttattgtata

SEQ ID NO: 565604 - DNA, 15 bp, Homo sapiens
atgattgagagcagc

SEQ ID NO: 565605 - DNA, 13 bp, Homo sapiens
atgattgctttta

SEQ ID NO: 565606 - DNA, 13 bp, Homo sapiens
atgattgtctttt

SEQ ID NO: 565607 - DNA, 12 bp, Homo sapiens
atgatttcacaa

SEQ ID NO: 565608 - DNA, 13 bp, Homo sapiens
atgatttcacaaa

SEQ ID NO: 565609 - DNA, 14 bp, Homo sapiens
atgatttcacaaat

SEQ ID NO: 565610 - DNA, 18 bp, Homo sapiens
atgatttcacaaatatta

SEQ ID NO: 565611 - DNA, 22 bp, Homo sapiens
atgatttcacaaatattaaaaa

SEQ ID NO: 565612 - DNA, 15 bp, Homo sapiens
atgatttcagaaaca

SEQ ID NO: 565613 - DNA, 13 bp, Homo sapiens
atgcaagcagttt

SEQ ID NO: 565614 - DNA, 15 bp, Homo sapiens
atgcacaatgtcttg

SEQ ID NO: 565615 - DNA, 17 bp, Homo sapiens
atgcacatccattccca

SEQ ID NO: 565616 - DNA, 15 bp, Homo sapiens
atgcactatatgttt

SEQ ID NO: 565617 - DNA, 16 bp, Homo sapiens
atgcatcccacagcca

SEQ ID NO: 565618 - DNA, 16 bp, Homo sapiens
atgcatgctttccata

SEQ ID NO: 565619 - DNA, 17 bp, Homo sapiens
atgcatgctttccatat

SEQ ID NO: 565620 - DNA, 17 bp, Homo sapiens
atgcatttaagttgtaa

SEQ ID NO: 565621 - DNA, 20 bp, Homo sapiens
atgcccagcccctggtggtg

SEQ ID NO: 565622 - DNA, 15 bp, Homo sapiens
atgccccaaatatag

SEQ ID NO: 565623 - DNA, 16 bp, Homo sapiens
atgccctccctgctgc

SEQ ID NO: 565624 - DNA, 14 bp, Homo sapiens
atgccgctgtgtcc

SEQ ID NO: 565625 - DNA, 16 bp, Homo sapiens
atgccgctgtgtcccc

SEQ ID NO: 565626 - DNA, 17 bp, Homo sapiens
aggctgcagtgagccaa

SEQ ID NO: 565627 - DNA, 21 bp, Homo sapiens
aggctgccaggggatttcgaa

SEQ ID NO: 565628 - DNA, 17 bp, Homo sapiens
aggctgccccacccctc

SEQ ID NO: 565629 - DNA, 17 bp, Homo sapiens
aggctggataggagagg

SEQ ID NO: 565630 - DNA, 21 bp, Homo sapiens
aggctggggcttttgtgccag

SEQ ID NO: 565631 - DNA, 16 bp, Homo sapiens
aggctgtattcagcaa

SEQ ID NO: 565632 - DNA, 22 bp, Homo sapiens
aggcttcaatttattgcacaaa

SEQ ID NO: 565633 - DNA, 12 bp, Homo sapiens
aggcttctccac

SEQ ID NO: 565634 - DNA, 23 bp, Homo sapiens
agggaaaataaaaaaagaaaaaa

SEQ ID NO: 565635 - DNA, 16 bp, Homo sapiens
agggaactaggaaggc

SEQ ID NO: 565636 - DNA, 17 bp, Homo sapiens
agggaagataagttgga

SEQ ID NO: 565637 - DNA, 19 bp, Homo sapiens
agggaaggggggtcagaag

SEQ ID NO: 565638 - DNA, 20 bp, Homo sapiens
agggaatgagagttccttct

SEQ ID NO: 565639 - DNA, 21 bp, Homo sapiens
agggactccagaagcagcagc

SEQ ID NO: 565640 - DNA, 21 bp, Homo sapiens
agggagctggctccagcctgg

SEQ ID NO: 565641 - DNA, 18 bp, Homo sapiens
agggaggctctgtgtgtt

SEQ ID NO: 565642 - DNA, 14 bp, Homo sapiens
agggagtcagctgt

SEQ ID NO: 565643 - DNA, 16 bp, Homo sapiens
agggatagagacgcag

SEQ ID NO: 565644 - DNA, 23 bp, Homo sapiens
agggatgctatctcgctagccat

SEQ ID NO: 565645 - DNA, 16 bp, Homo sapiens
agggcagattttagtt

SEQ ID NO: 565646 - DNA, 14 bp, Homo sapiens
agggcatgaaatga

SEQ ID NO: 565647 - DNA, 18 bp, Homo sapiens
agggccaaaagcttccct

SEQ ID NO: 565648 - DNA, 13 bp, Homo sapiens
agggccagggctc

SEQ ID NO: 565649 - DNA, 23 bp, Homo sapiens
agggcccagaggggcggggccag

SEQ ID NO: 565650 - DNA, 16 bp, Homo sapiens
agggcgtgaaacacaa

SEQ ID NO: 565651 - DNA, 17 bp, Homo sapiens
agggctccacgggggcc

SEQ ID NO: 565652 - DNA, 22 bp, Homo sapiens
agggctctggcaggtggccagg

SEQ ID NO: 565653 - DNA, 15 bp, Homo sapiens
agggctgcagagcct

SEQ ID NO: 565654 - DNA, 22 bp, Homo sapiens
aggggagagagcagagaagtac

SEQ ID NO: 565655 - DNA, 17 bp, Homo sapiens
aggggagggggcaaagg

SEQ ID NO: 565656 - DNA, 13 bp, Homo sapiens
aggggcagcctgc

SEQ ID NO: 565657 - DNA, 14 bp, Homo sapiens
aggggcagcctgcc

SEQ ID NO: 565658 - DNA, 14 bp, Homo sapiens
aggggcggggccag

SEQ ID NO: 565659 - DNA, 16 bp, Homo sapiens
aggggctccatgccag

SEQ ID NO: 565660 - DNA, 19 bp, Homo sapiens
agggggccacctccccagg

SEQ ID NO: 565661 - DNA, 23 bp, Homo sapiens
agggtcctgggggctgctgcact

SEQ ID NO: 565662 - DNA, 17 bp, Homo sapiens
agggtgacctgcttccc

SEQ ID NO: 565663 - DNA, 12 bp, Homo sapiens
agggtgagccca

SEQ ID NO: 565664 - DNA, 21 bp, Homo sapiens
agggtgagtcctccagaactc

SEQ ID NO: 565665 - DNA, 14 bp, Homo sapiens
agggtgcctggact

SEQ ID NO: 565666 - DNA, 17 bp, Homo sapiens
agggtttccaccttggc

SEQ ID NO: 565667 - DNA, 16 bp, Homo sapiens
aggtaaactgatgctt

SEQ ID NO: 565668 - DNA, 21 bp, Homo sapiens
aggtacgagtagaggtttaaa

SEQ ID NO: 565669 - DNA, 21 bp, Homo sapiens
aggtcattaaggccacatcca

SEQ ID NO: 565670 - DNA, 18 bp, Homo sapiens
aggtcccgaatggagtcc

SEQ ID NO: 565671 - DNA, 13 bp, Homo sapiens
aggtcctgtcctg

SEQ ID NO: 565672 - DNA, 15 bp, Homo sapiens
aggtcctgtcctggc

SEQ ID NO: 565673 - DNA, 21 bp, Homo sapiens
aggtcgttttaaaaacaaaaa

SEQ ID NO: 565674 - DNA, 20 bp, Homo sapiens
aggtctctctggctctagga

SEQ ID NO: 565675 - DNA, 15 bp, Homo sapiens
aggtcttgctctcct

SEQ ID NO: 565676 - DNA, 23 bp, Homo sapiens
aggtcttgctctcctaggtagcc

SEQ ID NO: 565677 - DNA, 13 bp, Homo sapiens
aggtgaaaatgtt

SEQ ID NO: 565678 - DNA, 19 bp, Homo sapiens
aggtgaaggaggctccagg

SEQ ID NO: 565679 - DNA, 18 bp, Homo sapiens
aggtgacagtgaggtcct

SEQ ID NO: 565680 - DNA, 17 bp, Homo sapiens
aggtgagggaggcctga

SEQ ID NO: 565681 - DNA, 22 bp, Homo sapiens
aggtgcacagacgtccctccac

SEQ ID NO: 565682 - DNA, 15 bp, Homo sapiens
aggtgggtgtctgcg

SEQ ID NO: 565683 - DNA, 12 bp, Homo sapiens
aggttaaatgtt

SEQ ID NO: 565684 - DNA, 17 bp, Homo sapiens
aggttaaatgttttgta

SEQ ID NO: 565685 - DNA, 19 bp, Homo sapiens
aggttaaatgttttgtaaa

SEQ ID NO: 565686 - DNA, 21 bp, Homo sapiens
aggttaggcagtataaagaat

SEQ ID NO: 565687 - DNA, 13 bp, Homo sapiens
aggttcttgctgc

SEQ ID NO: 565688 - DNA, 20 bp, Homo sapiens
aggttgaagacctaaccagg

SEQ ID NO: 565689 - DNA, 23 bp, Homo sapiens
aggttgaagacctaaccagggcc

SEQ ID NO: 565690 - DNA, 18 bp, Homo sapiens
aggttgcagtgagctgag

SEQ ID NO: 565691 - DNA, 18 bp, Homo sapiens
aggttgctggcatttgct

SEQ ID NO: 565692 - DNA, 17 bp, Homo sapiens
agtaaatctaaattaac

SEQ ID NO: 565693 - DNA, 14 bp, Homo sapiens
agtaaatctcttct

SEQ ID NO: 565694 - DNA, 15 bp, Homo sapiens
agtaaatctcttctg

SEQ ID NO: 565695 - DNA, 16 bp, Homo sapiens
agtaaatgtatattga

SEQ ID NO: 565696 - DNA, 13 bp, Homo sapiens
agtaaatgtcttc

SEQ ID NO: 565697 - DNA, 14 bp, Homo sapiens
agtaacacaggcca

SEQ ID NO: 565698 - DNA, 18 bp, Homo sapiens
agtaacacttgaaaagtg

SEQ ID NO: 565699 - DNA, 15 bp, Homo sapiens
agtaacttgtcttaa

SEQ ID NO: 565700 - DNA, 16 bp, Homo sapiens
agtaattgcatttgct

SEQ ID NO: 565701 - DNA, 18 bp, Homo sapiens
agtaattgcatttgcttt

SEQ ID NO: 565702 - DNA, 16 bp, Homo sapiens
agtacaaatgtgtgac

SEQ ID NO: 565703 - DNA, 17 bp, Homo sapiens
agtacaggtactttgtc

SEQ ID NO: 565704 - DNA, 17 bp, Homo sapiens
agtacattctcagtttt

SEQ ID NO: 565705 - DNA, 17 bp, Homo sapiens
agtaccacactgagttc

SEQ ID NO: 565706 - DNA, 19 bp, Homo sapiens
agtacctgggtccccagcc

SEQ ID NO: 565707 - DNA, 23 bp, Homo sapiens
agtactgagcagtgatattcttt

SEQ ID NO: 565708 - DNA, 16 bp, Homo sapiens
agtactttatagaaga

SEQ ID NO: 565709 - DNA, 17 bp, Homo sapiens
agtactttatagaagaa

SEQ ID NO: 565710 - DNA, 14 bp, Homo sapiens
agtagaattgattt

SEQ ID NO: 565711 - DNA, 15 bp, Homo sapiens
agtagaggtttaaag

SEQ ID NO: 565712 - DNA, 16 bp, Homo sapiens
agtagagtcaggagaa

SEQ ID NO: 565713 - DNA, 17 bp, Homo sapiens
agtagagtcaggagaaa

SEQ ID NO: 565714 - DNA, 20 bp, Homo sapiens
agtagcaaatgagacagcag

SEQ ID NO: 565715 - DNA, 18 bp, Homo sapiens
agtagcaaggaaggacac

SEQ ID NO: 565716 - DNA, 22 bp, Homo sapiens
agtagccccaacccaaacctgg

SEQ ID NO: 565717 - DNA, 19 bp, Homo sapiens
agtagcggtaccaatgcag

SEQ ID NO: 565718 - DNA, 16 bp, Homo sapiens
agtagctcgtgtgctt

SEQ ID NO: 565719 - DNA, 19 bp, Homo sapiens
agtagctgtggggagctgg

SEQ ID NO: 565720 - DNA, 18 bp, Homo sapiens
agtagtgaagactccaga

SEQ ID NO: 565721 - DNA, 19 bp, Homo sapiens
agtagtgaagactccagaa

SEQ ID NO: 565722 - DNA, 12 bp, Homo sapiens
agtagtgaccaa

SEQ ID NO: 565723 - DNA, 19 bp, Homo sapiens
agtatacaatatataaaaa

SEQ ID NO: 565724 - DNA, 23 bp, Homo sapiens
agtatacaatatataaaaatata

SEQ ID NO: 565725 - DNA, 21 bp, Homo sapiens
agtatacacatcataaacaaa

SEQ ID NO: 565726 - DNA, 22 bp, Homo sapiens
agtatacacatcataaacaaag

SEQ ID NO: 565727 - DNA, 19 bp, Homo sapiens
agtatatagccttaagtct

SEQ ID NO: 565728 - DNA, 12 bp, Homo sapiens
agtatatgtaac

SEQ ID NO: 565729 - DNA, 15 bp, Homo sapiens
agtatatgtaacagt

SEQ ID NO: 565730 - DNA, 17 bp, Homo sapiens
agtatatgtaacagttt

SEQ ID NO: 565731 - DNA, 20 bp, Homo sapiens
agtatatgtaacagtttaaa

SEQ ID NO: 565732 - DNA, 15 bp, Homo sapiens
agtatattgaaaaga

SEQ ID NO: 565733 - DNA, 16 bp, Homo sapiens
agtatattgaaaagaa

SEQ ID NO: 565734 - DNA, 15 bp, Homo sapiens
agtattgccaaacat

SEQ ID NO: 565735 - DNA, 22 bp, Homo sapiens
agtatttgaaaacagaaattgg

SEQ ID NO: 565736 - DNA, 22 bp, Homo sapiens
agtattttaagaagttgctgca

SEQ ID NO: 565737 - DNA, 12 bp, Homo sapiens
agtattttagtg

SEQ ID NO: 565738 - DNA, 16 bp, Homo sapiens
agtcaagctgatgaag

SEQ ID NO: 565739 - DNA, 18 bp, Homo sapiens
agtcaccactccattccc

SEQ ID NO: 565740 - DNA, 16 bp, Homo sapiens
agtcagcctcgcaggc

SEQ ID NO: 565741 - DNA, 19 bp, Homo sapiens
agtcaggaagcctcctgct

SEQ ID NO: 565742 - DNA, 17 bp, Homo sapiens
agtcaggctctctgggc

SEQ ID NO: 565743 - DNA, 20 bp, Homo sapiens
agtcagtgcccatgtgtatg

SEQ ID NO: 565744 - DNA, 15 bp, Homo sapiens
agtcagtgtactctg

SEQ ID NO: 565745 - DNA, 15 bp, Homo sapiens
agtcatctcccctcc

SEQ ID NO: 565746 - DNA, 21 bp, Homo sapiens
agtcatgatgtttttaaaatc

SEQ ID NO: 565747 - DNA, 23 bp, Homo sapiens
agtcatgatgtttttaaaatctt

SEQ ID NO: 565748 - DNA, 23 bp, Homo sapiens
agtccaacgtggggcagcacaga

SEQ ID NO: 565749 - DNA, 21 bp, Homo sapiens
agtccagacctgggccctggt

SEQ ID NO: 565750 - DNA, 13 bp, Homo sapiens
agtccagctctcc

SEQ ID NO: 565751 - DNA, 15 bp, Homo sapiens
agtccagctctcccc

SEQ ID NO: 565752 - DNA, 16 bp, Homo sapiens
agtccagctctcccct

SEQ ID NO: 565753 - DNA, 17 bp, Homo sapiens
agtccagctctcccctg

SEQ ID NO: 565754 - DNA, 14 bp, Homo sapiens
agtccaggagctca

SEQ ID NO: 565755 - DNA, 19 bp, Homo sapiens
agtcccactccaagccagc

SEQ ID NO: 565756 - DNA, 20 bp, Homo sapiens
agtccgacctggcctgtctg

SEQ ID NO: 565757 - DNA, 21 bp, Homo sapiens
agtccgacctggcctgtctgt

SEQ ID NO: 565758 - DNA, 18 bp, Homo sapiens
agtcctcattgttcagaa

SEQ ID NO: 565759 - DNA, 12 bp, Homo sapiens
agtcctccagaa

SEQ ID NO: 565760 - DNA, 19 bp, Homo sapiens
agtcctccagaactcttcc

SEQ ID NO: 565761 - DNA, 20 bp, Homo sapiens
agtcctccagaactcttcct

SEQ ID NO: 565762 - DNA, 16 bp, Homo sapiens
atatatggtctaatgt

SEQ ID NO: 565763 - DNA, 14 bp, Homo sapiens
atatatgtatattt

SEQ ID NO: 565764 - DNA, 19 bp, Homo sapiens
atatatgtgaactttctca

SEQ ID NO: 565765 - DNA, 21 bp, Homo sapiens
atatatgtgaactttctcagc

SEQ ID NO: 565766 - DNA, 22 bp, Homo sapiens
atatatttgcataatatgcata

SEQ ID NO: 565767 - DNA, 18 bp, Homo sapiens
atatattttgaaaggaga

SEQ ID NO: 565768 - DNA, 13 bp, Homo sapiens
atatattttgtat

SEQ ID NO: 565769 - DNA, 19 bp, Homo sapiens
atatattttgtatgcaagc

SEQ ID NO: 565770 - DNA, 22 bp, Homo sapiens
atatattttgtatgcaagcagt

SEQ ID NO: 565771 - DNA, 17 bp, Homo sapiens
atatcaaaagacacagg

SEQ ID NO: 565772 - DNA, 19 bp, Homo sapiens
atatcaccaggactgttac

SEQ ID NO: 565773 - DNA, 20 bp, Homo sapiens
atatcaggaaatatctgtga

SEQ ID NO: 565774 - DNA, 16 bp, Homo sapiens
atatcagttacagtgg

SEQ ID NO: 565775 - DNA, 17 bp, Homo sapiens
atatctgaaaactggaa

SEQ ID NO: 565776 - DNA, 18 bp, Homo sapiens
atatctgtggtcttcaaa

SEQ ID NO: 565777 - DNA, 15 bp, Homo sapiens
atatcttggcaggta

SEQ ID NO: 565778 - DNA, 18 bp, Homo sapiens
atatgagattggaaaaaa

SEQ ID NO: 565779 - DNA, 16 bp, Homo sapiens
atatgaggatgtatgt

SEQ ID NO: 565780 - DNA, 17 bp, Homo sapiens
atatgaggatgtatgtg

SEQ ID NO: 565781 - DNA, 20 bp, Homo sapiens
atatgaggatgtatgtgtat

SEQ ID NO: 565782 - DNA, 21 bp, Homo sapiens
atatgaggatgtatgtgtata

SEQ ID NO: 565783 - DNA, 22 bp, Homo sapiens
atatgagtatacaatatataaa

SEQ ID NO: 565784 - DNA, 16 bp, Homo sapiens
atatgattaaattatc

SEQ ID NO: 565785 - DNA, 22 bp, Homo sapiens
atatgattttttaaaagaaatt

SEQ ID NO: 565786 - DNA, 14 bp, Homo sapiens
atatgcatatatat

SEQ ID NO: 565787 - DNA, 19 bp, Homo sapiens
atatgcatatatatgtata

SEQ ID NO: 565788 - DNA, 14 bp, Homo sapiens
atatggtctaatgt

SEQ ID NO: 565789 - DNA, 13 bp, Homo sapiens
atatggtggaaaa

SEQ ID NO: 565790 - DNA, 18 bp, Homo sapiens
atatgtaacagtttaaaa

SEQ ID NO: 565791 - DNA, 18 bp, Homo sapiens
atatgtagactatataca

SEQ ID NO: 565792 - DNA, 20 bp, Homo sapiens
atatgtagactatatacatg

SEQ ID NO: 565793 - DNA, 13 bp, Homo sapiens
atatgtattttat

SEQ ID NO: 565794 - DNA, 19 bp, Homo sapiens
atatgtattttatgtatgt

SEQ ID NO: 565795 - DNA, 20 bp, Homo sapiens
atatgtctcgctagtgatgt

SEQ ID NO: 565796 - DNA, 13 bp, Homo sapiens
atatgtctttaaa

SEQ ID NO: 565797 - DNA, 14 bp, Homo sapiens
atatgtctttaaaa

SEQ ID NO: 565798 - DNA, 20 bp, Homo sapiens
atatgtgattttcaaatatg

SEQ ID NO: 565799 - DNA, 20 bp, Homo sapiens
atatgtgtatatatacatac

SEQ ID NO: 565800 - DNA, 15 bp, Homo sapiens
atatgtttatacaca

SEQ ID NO: 565801 - DNA, 18 bp, Homo sapiens
atatgtttatacacacag

SEQ ID NO: 565802 - DNA, 15 bp, Homo sapiens
atattaaaaagtctt

SEQ ID NO: 565803 - DNA, 19 bp, Homo sapiens
atattaaaaagtcttttaa

SEQ ID NO: 565804 - DNA, 18 bp, Homo sapiens
atattaaagaaagtcata

SEQ ID NO: 565805 - DNA, 14 bp, Homo sapiens
atattagaaaactt

SEQ ID NO: 565806 - DNA, 22 bp, Homo sapiens
atattagacttctgttttcaat

SEQ ID NO: 565807 - DNA, 22 bp, Homo sapiens
atattagcgacaacagattgga

SEQ ID NO: 565808 - DNA, 16 bp, Homo sapiens
atattatatttggatg

SEQ ID NO: 565809 - DNA, 14 bp, Homo sapiens
atattatgttatga

SEQ ID NO: 565810 - DNA, 17 bp, Homo sapiens
atattcagagaatatca

SEQ ID NO: 565811 - DNA, 14 bp, Homo sapiens
atattctctgtaca

SEQ ID NO: 565812 - DNA, 16 bp, Homo sapiens
atattctctgtacata

SEQ ID NO: 565813 - DNA, 16 bp, Homo sapiens
atattctgcagaaaat

SEQ ID NO: 565814 - DNA, 20 bp, Homo sapiens
atattgaaaatgtcactgtt

SEQ ID NO: 565815 - DNA, 17 bp, Homo sapiens
atattgcacaattataa

SEQ ID NO: 565816 - DNA, 16 bp, Homo sapiens
atattgctaccaaaaa

SEQ ID NO: 565817 - DNA, 17 bp, Homo sapiens
atattggcatggatttc

SEQ ID NO: 565818 - DNA, 12 bp, Homo sapiens
atattgtatctc

SEQ ID NO: 565819 - DNA, 19 bp, Homo sapiens
atatttaaaaacaaaaggc

SEQ ID NO: 565820 - DNA, 22 bp, Homo sapiens
atatttaaaaacaaaaggcaat

SEQ ID NO: 565821 - DNA, 18 bp, Homo sapiens
atatttcctataccattt

SEQ ID NO: 565822 - DNA, 15 bp, Homo sapiens
atatttgcataatat

SEQ ID NO: 565823 - DNA, 12 bp, Homo sapiens
atatttgtgaaa

SEQ ID NO: 565824 - DNA, 17 bp, Homo sapiens
atattttaatttcaagc

SEQ ID NO: 565825 - DNA, 15 bp, Homo sapiens
atattttcaaagaga

SEQ ID NO: 565826 - DNA, 21 bp, Homo sapiens
atattttcctttatgtgatgt

SEQ ID NO: 565827 - DNA, 12 bp, Homo sapiens
atattttgaaag

SEQ ID NO: 565828 - DNA, 13 bp, Homo sapiens
atattttgctgct

SEQ ID NO: 565829 - DNA, 18 bp, Homo sapiens
atattttgtcactgctgt

SEQ ID NO: 565830 - DNA, 21 bp, Homo sapiens
atattttgtcactgctgtaaa

SEQ ID NO: 565831 - DNA, 19 bp, Homo sapiens
atatttttcttaaaaagta

SEQ ID NO: 565832 - DNA, 17 bp, Homo sapiens
atatttttttccttaca

SEQ ID NO: 565833 - DNA, 19 bp, Homo sapiens
atatttttttccttacata

SEQ ID NO: 565834 - DNA, 12 bp, Homo sapiens
atcaaagccctc

SEQ ID NO: 565835 - DNA, 14 bp, Homo sapiens
atcaaagctcataa

SEQ ID NO: 565836 - DNA, 16 bp, Homo sapiens
atcaaagtagcaaatg

SEQ ID NO: 565837 - DNA, 14 bp, Homo sapiens
atcaaatgtacatc

SEQ ID NO: 565838 - DNA, 13 bp, Homo sapiens
atcaactcatgtt

SEQ ID NO: 565839 - DNA, 13 bp, Homo sapiens
atcaagtctgtga

SEQ ID NO: 565840 - DNA, 18 bp, Homo sapiens
atcaataacagccgctcc

SEQ ID NO: 565841 - DNA, 22 bp, Homo sapiens
atcaataacagccgctccagag

SEQ ID NO: 565842 - DNA, 15 bp, Homo sapiens
atcaatctttagaaa

SEQ ID NO: 565843 - DNA, 14 bp, Homo sapiens
atcaattcattgtg

SEQ ID NO: 565844 - DNA, 21 bp, Homo sapiens
atcacatgcccctcttagaag

SEQ ID NO: 565845 - DNA, 20 bp, Homo sapiens
atcacctaattaatttcagt

SEQ ID NO: 565846 - DNA, 20 bp, Homo sapiens
atcacctctgtaatttttca

SEQ ID NO: 565847 - DNA, 22 bp, Homo sapiens
atcactattcagaagacacaga

SEQ ID NO: 565848 - DNA, 19 bp, Homo sapiens
atcactattgggcccccag

SEQ ID NO: 565849 - DNA, 12 bp, Homo sapiens
atcactcaccat

SEQ ID NO: 565850 - DNA, 14 bp, Homo sapiens
atcactcagagcag

SEQ ID NO: 565851 - DNA, 21 bp, Homo sapiens
atcactgaacttttcaaaata

SEQ ID NO: 565852 - DNA, 22 bp, Homo sapiens
atcagaagtatatctgtacaga

SEQ ID NO: 565853 - DNA, 13 bp, Homo sapiens
atcagcccctgct

SEQ ID NO: 565854 - DNA, 14 bp, Homo sapiens
atcagcccctgctg

SEQ ID NO: 565855 - DNA, 17 bp, Homo sapiens
atcagcccctgctgctc

SEQ ID NO: 565856 - DNA, 18 bp, Homo sapiens
atcagctacttaagagaa

SEQ ID NO: 565857 - DNA, 22 bp, Homo sapiens
atcagtattaatactaaaatat

SEQ ID NO: 565858 - DNA, 21 bp, Homo sapiens
atcagtatttggactttttaa

SEQ ID NO: 565859 - DNA, 15 bp, Homo sapiens
atcagttatcctttg

SEQ ID NO: 565860 - DNA, 19 bp, Homo sapiens
atcagttatcctttgtgag

SEQ ID NO: 565861 - DNA, 21 bp, Homo sapiens
atcagttatcctttgtgagcc

SEQ ID NO: 565862 - DNA, 20 bp, Homo sapiens
atcagtttttgttcttaaaa

SEQ ID NO: 565863 - DNA, 16 bp, Homo sapiens
atcatatctgtatgcc

SEQ ID NO: 565864 - DNA, 16 bp, Homo sapiens
atcatctgtaagctgt

SEQ ID NO: 565865 - DNA, 17 bp, Homo sapiens
atcatctgtaagctgtt

SEQ ID NO: 565866 - DNA, 18 bp, Homo sapiens
atcatgtgcgtcagtcca

SEQ ID NO: 565867 - DNA, 17 bp, Homo sapiens
atcatgtgtttctgtgt

SEQ ID NO: 565868 - DNA, 17 bp, Homo sapiens
atcattatcttcatgtt

SEQ ID NO: 565869 - DNA, 19 bp, Homo sapiens
atcattggtatctgatatc

SEQ ID NO: 565870 - DNA, 16 bp, Homo sapiens
atcattgtccagagct

SEQ ID NO: 565871 - DNA, 12 bp, Homo sapiens
atccaaaagaaa

SEQ ID NO: 565872 - DNA, 18 bp, Homo sapiens
atccaacagaaagcatag

SEQ ID NO: 565873 - DNA, 20 bp, Homo sapiens
atccacagtctcccccaccc

SEQ ID NO: 565874 - DNA, 19 bp, Homo sapiens
atccacctgcacaaacata

SEQ ID NO: 565875 - DNA, 21 bp, Homo sapiens
atccaccttcccttctacaag

SEQ ID NO: 565876 - DNA, 20 bp, Homo sapiens
atccagaaacttgttcttcc

SEQ ID NO: 565877 - DNA, 21 bp, Homo sapiens
atccagaaacttgttcttcca

SEQ ID NO: 565878 - DNA, 15 bp, Homo sapiens
atccagccaggggtg

SEQ ID NO: 565879 - DNA, 20 bp, Homo sapiens
atgtgaaggaccttcactct

SEQ ID NO: 565880 - DNA, 23 bp, Homo sapiens
atgtgaagggaaggaagaggaag

SEQ ID NO: 565881 - DNA, 22 bp, Homo sapiens
atgtgacatttgtcattttcat

SEQ ID NO: 565882 - DNA, 23 bp, Homo sapiens
atgtgagctgctgccatgaactg

SEQ ID NO: 565883 - DNA, 18 bp, Homo sapiens
atgtgatggatggcacaa

SEQ ID NO: 565884 - DNA, 20 bp, Homo sapiens
atgtgatggatggcacaatg

SEQ ID NO: 565885 - DNA, 14 bp, Homo sapiens
atgtgccccttccc

SEQ ID NO: 565886 - DNA, 14 bp, Homo sapiens
atgtgcgaacacag

SEQ ID NO: 565887 - DNA, 16 bp, Homo sapiens
atgtgctcatcagaaa

SEQ ID NO: 565888 - DNA, 17 bp, Homo sapiens
atgtgctcatcagaaac

SEQ ID NO: 565889 - DNA, 14 bp, Homo sapiens
atgtgctgctgtgg

SEQ ID NO: 565890 - DNA, 17 bp, Homo sapiens
atgtggacatgcacccg

SEQ ID NO: 565891 - DNA, 23 bp, Homo sapiens
atgtggtcgttagagacagagcg

SEQ ID NO: 565892 - DNA, 18 bp, Homo sapiens
atgtgtaatttttctgta

SEQ ID NO: 565893 - DNA, 19 bp, Homo sapiens
atgtgtaatttttctgtat

SEQ ID NO: 565894 - DNA, 19 bp, Homo sapiens
atgtgtatatatacataca

SEQ ID NO: 565895 - DNA, 23 bp, Homo sapiens
atgtgtatatatacatacacttg

SEQ ID NO: 565896 - DNA, 20 bp, Homo sapiens
atgtgtatttttcaaggcat

SEQ ID NO: 565897 - DNA, 21 bp, Homo sapiens
atgtgtatttttcaaggcatt

SEQ ID NO: 565898 - DNA, 15 bp, Homo sapiens
atgtgtccatttcct

SEQ ID NO: 565899 - DNA, 20 bp, Homo sapiens
atgtgtccgtgaaagttgtg

SEQ ID NO: 565900 - DNA, 16 bp, Homo sapiens
atgtgtcttgtattat

SEQ ID NO: 565901 - DNA, 18 bp, Homo sapiens
atgtgtgcatgtgtgtat

SEQ ID NO: 565902 - DNA, 20 bp, Homo sapiens
atgtgtgcatgtgtgtataa

SEQ ID NO: 565903 - DNA, 19 bp, Homo sapiens
atgtgtgtgatgtgacatt

SEQ ID NO: 565904 - DNA, 20 bp, Homo sapiens
atgtgtgtgatgtgacattt

SEQ ID NO: 565905 - DNA, 17 bp, Homo sapiens
atgttaaagatgtagca

SEQ ID NO: 565906 - DNA, 20 bp, Homo sapiens
atgttaaagatgtagcaaac

SEQ ID NO: 565907 - DNA, 21 bp, Homo sapiens
atgttaatagaaaatatattt

SEQ ID NO: 565908 - DNA, 20 bp, Homo sapiens
atgttatatttttcttaaaa

SEQ ID NO: 565909 - DNA, 16 bp, Homo sapiens
atgttatcattcttat

SEQ ID NO: 565910 - DNA, 17 bp, Homo sapiens
atgttcacgcaacttga

SEQ ID NO: 565911 - DNA, 11 bp, Homo sapiens
atgttcttcca

SEQ ID NO: 565912 - DNA, 12 bp, Homo sapiens
atgttgacattt

SEQ ID NO: 565913 - DNA, 19 bp, Homo sapiens
atgttggcagatgcagctc

SEQ ID NO: 565914 - DNA, 21 bp, Homo sapiens
atgttggcagatgcagctctt

SEQ ID NO: 565915 - DNA, 22 bp, Homo sapiens
atgttgtaaattaggaggctca

SEQ ID NO: 565916 - DNA, 12 bp, Homo sapiens
atgttgtaatat

SEQ ID NO: 565917 - DNA, 16 bp, Homo sapiens
atgtttaaaatggcat

SEQ ID NO: 565918 - DNA, 18 bp, Homo sapiens
atgtttaaagtaattgtt

SEQ ID NO: 565919 - DNA, 19 bp, Homo sapiens
agcaaaaacgaaagctggg

SEQ ID NO: 565920 - DNA, 16 bp, Homo sapiens
agcaaaaatataaaat

SEQ ID NO: 565921 - DNA, 14 bp, Homo sapiens
agcaaaatatttgt

SEQ ID NO: 565922 - DNA, 17 bp, Homo sapiens
agcaaacccaaagatgt

SEQ ID NO: 565923 - DNA, 16 bp, Homo sapiens
agcaaaccctgtcaaa

SEQ ID NO: 565924 - DNA, 13 bp, Homo sapiens
agcaaagatcaaa

SEQ ID NO: 565925 - DNA, 15 bp, Homo sapiens
agcaaagatcaaaat

SEQ ID NO: 565926 - DNA, 20 bp, Homo sapiens
agcaaagcatgccaatttct

SEQ ID NO: 565927 - DNA, 18 bp, Homo sapiens
agcaaattaatgtgtaaa

SEQ ID NO: 565928 - DNA, 18 bp, Homo sapiens
agcaaatttcaaaagaca

SEQ ID NO: 565929 - DNA, 19 bp, Homo sapiens
agcaaatttcaaaagacat

SEQ ID NO: 565930 - DNA, 16 bp, Homo sapiens
agcaacacttggaaca

SEQ ID NO: 565931 - DNA, 17 bp, Homo sapiens
agcaacagctggacacc

SEQ ID NO: 565932 - DNA, 16 bp, Homo sapiens
agcaactaggccttca

SEQ ID NO: 565933 - DNA, 22 bp, Homo sapiens
agcaacttttccaacatacaat

SEQ ID NO: 565934 - DNA, 23 bp, Homo sapiens
agcaagcttttacaacagtgctg

SEQ ID NO: 565935 - DNA, 13 bp, Homo sapiens
agcaaggaaggac

SEQ ID NO: 565936 - DNA, 19 bp, Homo sapiens
agcacaaccatgttcttga

SEQ ID NO: 565937 - DNA, 19 bp, Homo sapiens
agctccggcgtgtgttcag

SEQ ID NO: 565938 - DNA, 22 bp, Homo sapiens
agctcctccttgtcttggcagc

SEQ ID NO: 565939 - DNA, 16 bp, Homo sapiens
agctcctgctcattgt

SEQ ID NO: 565940 - DNA, 13 bp, Homo sapiens
agctcctggccag

SEQ ID NO: 565941 - DNA, 14 bp, Homo sapiens
agctcgtagaaaca

SEQ ID NO: 565942 - DNA, 12 bp, Homo sapiens
agctctcccctg

SEQ ID NO: 565943 - DNA, 19 bp, Homo sapiens
agctctcccctgcgcaggc

SEQ ID NO: 565944 - DNA, 23 bp, Homo sapiens
agctctcccctgcgcaggccctc

SEQ ID NO: 565945 - DNA, 12 bp, Homo sapiens
agctctctgtat

SEQ ID NO: 565946 - DNA, 18 bp, Homo sapiens
agctctctgtataaacat

SEQ ID NO: 565947 - DNA, 19 bp, Homo sapiens
agctctctgtataaacatt

SEQ ID NO: 565948 - DNA, 21 bp, Homo sapiens
agctctgacctgcccccgctc

SEQ ID NO: 565949 - DNA, 12 bp, Homo sapiens
agctcttcctgg

SEQ ID NO: 565950 - DNA, 20 bp, Homo sapiens
agctcttcctggacaggcca

SEQ ID NO: 565951 - DNA, 22 bp, Homo sapiens
agctgaacagatgacccctgcc

SEQ ID NO: 565952 - DNA, 15 bp, Homo sapiens
agctgaagagctggg

SEQ ID NO: 565953 - DNA, 17 bp, Homo sapiens
agctgaagccagctccc

SEQ ID NO: 565954 - DNA, 18 bp, Homo sapiens
agctgcagagacagagag

SEQ ID NO: 565955 - DNA, 16 bp, Homo sapiens
agctgcaggaatcaaa

SEQ ID NO: 565956 - DNA, 22 bp, Homo sapiens
agctgcaggaatcaaaaattga

SEQ ID NO: 565957 - DNA, 18 bp, Homo sapiens
agctgcatttggggtggg

SEQ ID NO: 565958 - DNA, 21 bp, Homo sapiens
agctgctactcgtgagcgcca

SEQ ID NO: 565959 - DNA, 14 bp, Homo sapiens
agctgctgcacagc

SEQ ID NO: 565960 - DNA, 14 bp, Homo sapiens
agctgcttccagtt

SEQ ID NO: 565961 - DNA, 16 bp, Homo sapiens
agctggctccagcctg

SEQ ID NO: 565962 - DNA, 18 bp, Homo sapiens
agctgtcatggtgcaatt

SEQ ID NO: 565963 - DNA, 19 bp, Homo sapiens
agctgtcatggtgcaattt

SEQ ID NO: 565964 - DNA, 15 bp, Homo sapiens
agctgtggggagctg

SEQ ID NO: 565965 - DNA, 17 bp, Homo sapiens
agctgtggggagctggt

SEQ ID NO: 565966 - DNA, 14 bp, Homo sapiens
agctgttcttcctg

SEQ ID NO: 565967 - DNA, 13 bp, Homo sapiens
agctgttgaccag

SEQ ID NO: 565968 - DNA, 20 bp, Homo sapiens
agctgttgtctcttctcctt

SEQ ID NO: 565969 - DNA, 17 bp, Homo sapiens
agcttatctttctttcc

SEQ ID NO: 565970 - DNA, 13 bp, Homo sapiens
agcttcacttctg

SEQ ID NO: 565971 - DNA, 18 bp, Homo sapiens
agcttccctccctgctgt

SEQ ID NO: 565972 - DNA, 12 bp, Homo sapiens
agctttcctggg

SEQ ID NO: 565973 - DNA, 19 bp, Homo sapiens
agctttcctgggtctggat

SEQ ID NO: 565974 - DNA, 17 bp, Homo sapiens
agctttctcaatgtctt

SEQ ID NO: 565975 - DNA, 21 bp, Homo sapiens
agctttctcaatgtcttccca

SEQ ID NO: 565976 - DNA, 21 bp, Homo sapiens
agcttttgcatagaataatga

SEQ ID NO: 565977 - DNA, 17 bp, Homo sapiens
aggaaaagaaaaatttc

SEQ ID NO: 565978 - DNA, 14 bp, Homo sapiens
aggaaaaggcttga

SEQ ID NO: 565979 - DNA, 13 bp, Homo sapiens
aggaaagcacaga

SEQ ID NO: 565980 - DNA, 20 bp, Homo sapiens
aggaaagcctcactgatata

SEQ ID NO: 565981 - DNA, 13 bp, Homo sapiens
aggaacaaatctt

SEQ ID NO: 565982 - DNA, 22 bp, Homo sapiens
aggaacaagacccccaggaagg

SEQ ID NO: 565983 - DNA, 14 bp, Homo sapiens
aggaacacatgcac

SEQ ID NO: 565984 - DNA, 16 bp, Homo sapiens
aggaacacatgcacac

SEQ ID NO: 565985 - DNA, 18 bp, Homo sapiens
aggaacacatgcacacac

SEQ ID NO: 565986 - DNA, 14 bp, Homo sapiens
aggaacacccagcc

SEQ ID NO: 565987 - DNA, 23 bp, Homo sapiens
aggaaccatagttgacagttcca

SEQ ID NO: 565988 - DNA, 16 bp, Homo sapiens
aggaagcctcctgctg

SEQ ID NO: 565989 - DNA, 22 bp, Homo sapiens
aggaatatgcatcccacagcca

SEQ ID NO: 565990 - DNA, 17 bp, Homo sapiens
aggaatattatatttgg

SEQ ID NO: 565991 - DNA, 20 bp, Homo sapiens
aggaatattatatttggatg

SEQ ID NO: 565992 - DNA, 12 bp, Homo sapiens
aggacaaggaaa

SEQ ID NO: 565993 - DNA, 18 bp, Homo sapiens
aggacaaggaaattcctc

SEQ ID NO: 565994 - DNA, 20 bp, Homo sapiens
aggacaaggtgcaggcaggc

SEQ ID NO: 565995 - DNA, 20 bp, Homo sapiens
aggacaggaaagtggcacct

SEQ ID NO: 565996 - DNA, 16 bp, Homo sapiens
aggacatctctgtaaa

SEQ ID NO: 565997 - DNA, 14 bp, Homo sapiens
aggacatggcttct

SEQ ID NO: 565998 - DNA, 21 bp, Homo sapiens
aggacatggcttctgaacctg

SEQ ID NO: 565999 - DNA, 17 bp, Homo sapiens
aggaccccatctgctga

SEQ ID NO: 566000 - DNA, 22 bp, Homo sapiens
aggaccccatctgctgagctct

SEQ ID NO: 566001 - DNA, 18 bp, Homo sapiens
aggaccctcgctggcccc

SEQ ID NO: 566002 - DNA, 19 bp, Homo sapiens
aggaccctcgctggccccc

SEQ ID NO: 566003 - DNA, 19 bp, Homo sapiens
aggacctccacctgggaga

SEQ ID NO: 566004 - DNA, 12 bp, Homo sapiens
aggacctgcccg

SEQ ID NO: 566005 - DNA, 18 bp, Homo sapiens
aggacgcagggagaccct

SEQ ID NO: 566006 - DNA, 19 bp, Homo sapiens
aggacgcagggagaccctg

SEQ ID NO: 566007 - DNA, 20 bp, Homo sapiens
aggacgcttcacaggacagg

SEQ ID NO: 566008 - DNA, 14 bp, Homo sapiens
aggacgtgggcggc

SEQ ID NO: 566009 - DNA, 23 bp, Homo sapiens
aggacttcctgctacagtagctg

SEQ ID NO: 566010 - DNA, 14 bp, Homo sapiens
aggacttggtcttt

SEQ ID NO: 566011 - DNA, 20 bp, Homo sapiens
aggacttggtcttttttctg

SEQ ID NO: 566012 - DNA, 22 bp, Homo sapiens
aggagacactgtgctataaatc

SEQ ID NO: 566013 - DNA, 18 bp, Homo sapiens
aggagacagtcaggaagc

SEQ ID NO: 566014 - DNA, 14 bp, Homo sapiens
aggagactcaggcc

SEQ ID NO: 566015 - DNA, 19 bp, Homo sapiens
aggagactcaggcccacat

SEQ ID NO: 566016 - DNA, 16 bp, Homo sapiens
aggagaggatggccca

SEQ ID NO: 566017 - DNA, 16 bp, Homo sapiens
aggagatgaggctgga

SEQ ID NO: 566018 - DNA, 17 bp, Homo sapiens
aggagatgaggctggat

SEQ ID NO: 566019 - DNA, 13 bp, Homo sapiens
aggagctgggccc

SEQ ID NO: 566020 - DNA, 15 bp, Homo sapiens
aggagctttctcaat

SEQ ID NO: 566021 - DNA, 21 bp, Homo sapiens
aggaggccttgggctctgctg

SEQ ID NO: 566022 - DNA, 20 bp, Homo sapiens
aggaggctccatccttctcc

SEQ ID NO: 566023 - DNA, 19 bp, Homo sapiens
aggaggttggagggaaagc

SEQ ID NO: 566024 - DNA, 22 bp, Homo sapiens
aggagtcagtgcccatgtgtat

SEQ ID NO: 566025 - DNA, 23 bp, Homo sapiens
aggagtcccactccaagccagca

SEQ ID NO: 566026 - DNA, 21 bp, Homo sapiens
aggagtgaaacatcatagaaa

SEQ ID NO: 566027 - DNA, 14 bp, Homo sapiens
aggatatgcctgct

SEQ ID NO: 566028 - DNA, 12 bp, Homo sapiens
aggatgcatatt

SEQ ID NO: 566029 - DNA, 18 bp, Homo sapiens
aggatggcgtgtcccctg

SEQ ID NO: 566030 - DNA, 16 bp, Homo sapiens
aggatgggggagaggg

SEQ ID NO: 566031 - DNA, 20 bp, Homo sapiens
aggattctcaccagctgtgt

SEQ ID NO: 566032 - DNA, 22 bp, Homo sapiens
aggattctcaccagctgtgtcc

SEQ ID NO: 566033 - DNA, 20 bp, Homo sapiens
aggcaaaccaatttgttctg

SEQ ID NO: 566034 - DNA, 18 bp, Homo sapiens
aggcaaactgaggcagca

SEQ ID NO: 566035 - DNA, 16 bp, Homo sapiens
aggcaagattgatgtt

SEQ ID NO: 566036 - DNA, 15 bp, Homo sapiens
aggcacttctgcctg

SEQ ID NO: 566037 - DNA, 13 bp, Homo sapiens
aggcagctgttgt

SEQ ID NO: 566038 - DNA, 21 bp, Homo sapiens
aggcaggggccctgcagctct

SEQ ID NO: 566039 - DNA, 15 bp, Homo sapiens
aggcagggtgtctgc

SEQ ID NO: 566040 - DNA, 21 bp, Homo sapiens
aggcaggtgcccctctctcca

SEQ ID NO: 566041 - DNA, 16 bp, Homo sapiens
aggcagtataaagaat

SEQ ID NO: 566042 - DNA, 13 bp, Homo sapiens
aggcatgaccctg

SEQ ID NO: 566043 - DNA, 14 bp, Homo sapiens
aggcatgaccctgg

SEQ ID NO: 566044 - DNA, 16 bp, Homo sapiens
aggcatgggcttgctg

SEQ ID NO: 566045 - DNA, 13 bp, Homo sapiens
aggccaaagacaa

SEQ ID NO: 566046 - DNA, 13 bp, Homo sapiens
aggccaagaggtt

SEQ ID NO: 566047 - DNA, 14 bp, Homo sapiens
aggccaagaggttt

SEQ ID NO: 566048 - DNA, 15 bp, Homo sapiens
aggccaagctgagga

SEQ ID NO: 566049 - DNA, 20 bp, Homo sapiens
aggccaccctgtgcagaagg

SEQ ID NO: 566050 - DNA, 16 bp, Homo sapiens
aggccatggaggcagt

SEQ ID NO: 566051 - DNA, 12 bp, Homo sapiens
aggcccagcacc

SEQ ID NO: 566052 - DNA, 15 bp, Homo sapiens
aggccccctgcctgc

SEQ ID NO: 566053 - DNA, 22 bp, Homo sapiens
aggcccgaaggtctctctggct

SEQ ID NO: 566054 - DNA, 21 bp, Homo sapiens
aggcctcctgtggcctgccag

SEQ ID NO: 566055 - DNA, 18 bp, Homo sapiens
aggcctgaaatgtttcca

SEQ ID NO: 566056 - DNA, 20 bp, Homo sapiens
aggcctgctttgtctcctct

SEQ ID NO: 566057 - DNA, 15 bp, Homo sapiens
aggcgctagcacagc

SEQ ID NO: 566058 - DNA, 13 bp, Homo sapiens
aggcgtagggcca

SEQ ID NO: 566059 - DNA, 21 bp, Homo sapiens
aggcgtagggccagggctctg

SEQ ID NO: 566060 - DNA, 19 bp, Homo sapiens
aggcgtcaccatccacctt

SEQ ID NO: 566061 - DNA, 15 bp, Homo sapiens
aggctaaaatgtttt

SEQ ID NO: 566062 - DNA, 17 bp, Homo sapiens
aggctaaaatgttttca

SEQ ID NO: 566063 - DNA, 18 bp, Homo sapiens
aggctaaaatgttttcag

SEQ ID NO: 566064 - DNA, 19 bp, Homo sapiens
aggctaaaatgttttcagc

SEQ ID NO: 566065 - DNA, 15 bp, Homo sapiens
aggctcaacaataaa

SEQ ID NO: 566066 - DNA, 19 bp, Homo sapiens
aggctcaacaataaaacat

SEQ ID NO: 566067 - DNA, 14 bp, Homo sapiens
aggctccaggcagc

SEQ ID NO: 566068 - DNA, 18 bp, Homo sapiens
aggctctgtgtgttaaaa

SEQ ID NO: 566069 - DNA, 13 bp, Homo sapiens
aatttgaaacatt

SEQ ID NO: 566070 - DNA, 13 bp, Homo sapiens
aatttgaaggtac

SEQ ID NO: 566071 - DNA, 16 bp, Homo sapiens
aatttgtctttggaaa

SEQ ID NO: 566072 - DNA, 12 bp, Homo sapiens
aatttgttctgt

SEQ ID NO: 566073 - DNA, 17 bp, Homo sapiens
aattttcagatttgcac

SEQ ID NO: 566074 - DNA, 18 bp, Homo sapiens
aattttcagatttgcaca

SEQ ID NO: 566075 - DNA, 10 bp, Homo sapiens
aattttcatt

SEQ ID NO: 566076 - DNA, 12 bp, Homo sapiens
aattttcatttt

SEQ ID NO: 566077 - DNA, 12 bp, Homo sapiens
aattttgtacat

SEQ ID NO: 566078 - DNA, 15 bp, Homo sapiens
aattttgttttaaac

SEQ ID NO: 566079 - DNA, 21 bp, Homo sapiens
aatttttcagctctctgtata

SEQ ID NO: 566080 - DNA, 13 bp, Homo sapiens
aatttttcatatt

SEQ ID NO: 566081 - DNA, 20 bp, Homo sapiens
aatttttctcagtttgtata

SEQ ID NO: 566082 - DNA, 18 bp, Homo sapiens
aatttttctgtatagaca

SEQ ID NO: 566083 - DNA, 23 bp, Homo sapiens
aatttttggtgggtgaaaggaat

SEQ ID NO: 566084 - DNA, 16 bp, Homo sapiens
acaaaaacacaaatac

SEQ ID NO: 566085 - DNA, 15 bp, Homo sapiens
acaaaaccacagtgt

SEQ ID NO: 566086 - DNA, 18 bp, Homo sapiens
acaaaaccgtttagtcat

SEQ ID NO: 566087 - DNA, 12 bp, Homo sapiens
acaaaatgtaac

SEQ ID NO: 566088 - DNA, 21 bp, Homo sapiens
acaaaatgtgtgcttggaaaa

SEQ ID NO: 566089 - DNA, 14 bp, Homo sapiens
acaaacaaaagcat

SEQ ID NO: 566090 - DNA, 14 bp, Homo sapiens
acaaacaaacaagc

SEQ ID NO: 566091 - DNA, 14 bp, Homo sapiens
acaaacaagcatat

SEQ ID NO: 566092 - DNA, 16 bp, Homo sapiens
acaaacatagacagat

SEQ ID NO: 566093 - DNA, 17 bp, Homo sapiens
acaaacatagacagatg

SEQ ID NO: 566094 - DNA, 18 bp, Homo sapiens
acaaacatagacagatgt

SEQ ID NO: 566095 - DNA, 23 bp, Homo sapiens
acaaacatagacagatgtggaca

SEQ ID NO: 566096 - DNA, 19 bp, Homo sapiens
acaaactgcacatgatttc

SEQ ID NO: 566097 - DNA, 20 bp, Homo sapiens
acaaagagcgttgaagttga

SEQ ID NO: 566098 - DNA, 15 bp, Homo sapiens
acaaataacaacttt

SEQ ID NO: 566099 - DNA, 22 bp, Homo sapiens
acaaataacaacttttttttct

SEQ ID NO: 566100 - DNA, 23 bp, Homo sapiens
acaaataagttcccatttccttg

SEQ ID NO: 566101 - DNA, 18 bp, Homo sapiens
acaaatattaaaaagtct

SEQ ID NO: 566102 - DNA, 18 bp, Homo sapiens
acaaatgattgcttttaa

SEQ ID NO: 566103 - DNA, 19 bp, Homo sapiens
acaaatgattgcttttaaa

SEQ ID NO: 566104 - DNA, 20 bp, Homo sapiens
acaaatgcttttccaaccca

SEQ ID NO: 566105 - DNA, 23 bp, Homo sapiens
acaaatgcttttccaacccatga

SEQ ID NO: 566106 - DNA, 13 bp, Homo sapiens
acaaatgtgtgac

SEQ ID NO: 566107 - DNA, 14 bp, Homo sapiens
acaaatgtgtgact

SEQ ID NO: 566108 - DNA, 21 bp, Homo sapiens
acaaattatgctaagaatttt

SEQ ID NO: 566109 - DNA, 16 bp, Homo sapiens
acaacacattgaaact

SEQ ID NO: 566110 - DNA, 13 bp, Homo sapiens
acaacagattgga

SEQ ID NO: 566111 - DNA, 16 bp, Homo sapiens
acaacatccatgtcct

SEQ ID NO: 566112 - DNA, 22 bp, Homo sapiens
acaacatccatgtcctatgtgt

SEQ ID NO: 566113 - DNA, 20 bp, Homo sapiens
acaacatcctcagaaccatt

SEQ ID NO: 566114 - DNA, 13 bp, Homo sapiens
acaacccaaggca

SEQ ID NO: 566115 - DNA, 14 bp, Homo sapiens
acaacccccagctc

SEQ ID NO: 566116 - DNA, 20 bp, Homo sapiens
acaactttcactttgcaaag

SEQ ID NO: 566117 - DNA, 18 bp, Homo sapiens
acaagaataaaggcagct

SEQ ID NO: 566118 - DNA, 18 bp, Homo sapiens
acaagacccccaggaagg

SEQ ID NO: 566119 - DNA, 14 bp, Homo sapiens
acaagactgtaaat

SEQ ID NO: 566120 - DNA, 16 bp, Homo sapiens
acaagactgtaaattc

SEQ ID NO: 566121 - DNA, 16 bp, Homo sapiens
acaagcagacacacac

SEQ ID NO: 566122 - DNA, 15 bp, Homo sapiens
acaagcatataaaat

SEQ ID NO: 566123 - DNA, 9 bp, Homo sapiens
acaaggact

SEQ ID NO: 566124 - DNA, 17 bp, Homo sapiens
acaaggcttgctgcaga

SEQ ID NO: 566125 - DNA, 15 bp, Homo sapiens
acaaggtgcaggcag

SEQ ID NO: 566126 - DNA, 15 bp, Homo sapiens
acaagtatcatctaa

SEQ ID NO: 566127 - DNA, 18 bp, Homo sapiens
acaagtatcatctaaata

SEQ ID NO: 566128 - DNA, 23 bp, Homo sapiens
acaagtatcatctaaatattatg

SEQ ID NO: 566129 - DNA, 15 bp, Homo sapiens
acaagtttgaacagg

SEQ ID NO: 566130 - DNA, 16 bp, Homo sapiens
acaagtttgaacaggc

SEQ ID NO: 566131 - DNA, 15 bp, Homo sapiens
acaataaaacattat

SEQ ID NO: 566132 - DNA, 14 bp, Homo sapiens
acaatatcatcccc

SEQ ID NO: 566133 - DNA, 12 bp, Homo sapiens
acaatatttgtg

SEQ ID NO: 566134 - DNA, 22 bp, Homo sapiens
acaatcatgaacagctctgaga

SEQ ID NO: 566135 - DNA, 16 bp, Homo sapiens
acaatctatggcaagc

SEQ ID NO: 566136 - DNA, 13 bp, Homo sapiens
acaatgaatgtat

SEQ ID NO: 566137 - DNA, 17 bp, Homo sapiens
acaatgtttgatgtccc

SEQ ID NO: 566138 - DNA, 23 bp, Homo sapiens
acaatgtttgatgtccccaaagt

SEQ ID NO: 566139 - DNA, 14 bp, Homo sapiens
acaattctaatggt

SEQ ID NO: 566140 - DNA, 19 bp, Homo sapiens
acaattgtccatggtctca

SEQ ID NO: 566141 - DNA, 21 bp, Homo sapiens
acaatttacttttaataaagt

SEQ ID NO: 566142 - DNA, 13 bp, Homo sapiens
acaatttctgtgt

SEQ ID NO: 566143 - DNA, 13 bp, Homo sapiens
acaattttcagat

SEQ ID NO: 566144 - DNA, 16 bp, Homo sapiens
actcaaagatgaaagc

SEQ ID NO: 566145 - DNA, 21 bp, Homo sapiens
actcaaccaaatggtacaaaa

SEQ ID NO: 566146 - DNA, 16 bp, Homo sapiens
actcagagcacagcca

SEQ ID NO: 566147 - DNA, 12 bp, Homo sapiens
actcagagcagt

SEQ ID NO: 566148 - DNA, 18 bp, Homo sapiens
actcagctgtctgtggct

SEQ ID NO: 566149 - DNA, 20 bp, Homo sapiens
actcagctttctttaaagtt

SEQ ID NO: 566150 - DNA, 17 bp, Homo sapiens
actcatacagtggtatt

SEQ ID NO: 566151 - DNA, 21 bp, Homo sapiens
actcatacagtggtattgcta

SEQ ID NO: 566152 - DNA, 13 bp, Homo sapiens
actcatgtgattt

SEQ ID NO: 566153 - DNA, 20 bp, Homo sapiens
actccaacttagtgtctcta

SEQ ID NO: 566154 - DNA, 17 bp, Homo sapiens
actccatggtgaactga

SEQ ID NO: 566155 - DNA, 23 bp, Homo sapiens
actccatggtgaactgaagcaga

SEQ ID NO: 566156 - DNA, 14 bp, Homo sapiens
actccattcccaac

SEQ ID NO: 566157 - DNA, 22 bp, Homo sapiens
actccattcccaactagacatt

SEQ ID NO: 566158 - DNA, 20 bp, Homo sapiens
actccccacatcccatcgtc

SEQ ID NO: 566159 - DNA, 19 bp, Homo sapiens
actcctcaattccagggaa

SEQ ID NO: 566160 - DNA, 16 bp, Homo sapiens
actcctgctctgctcg

SEQ ID NO: 566161 - DNA, 20 bp, Homo sapiens
actccttaaaaatgtatgtt

SEQ ID NO: 566162 - DNA, 23 bp, Homo sapiens
actctaaattctttatttctgtc

SEQ ID NO: 566163 - DNA, 14 bp, Homo sapiens
actctaagatgtta

SEQ ID NO: 566164 - DNA, 16 bp, Homo sapiens
actctaagtgtttgct

SEQ ID NO: 566165 - DNA, 19 bp, Homo sapiens
actctatgccccaaatata

SEQ ID NO: 566166 - DNA, 14 bp, Homo sapiens
actctcttcttact

SEQ ID NO: 566167 - DNA, 13 bp, Homo sapiens
actctgagtcctc

SEQ ID NO: 566168 - DNA, 12 bp, Homo sapiens
actctgatgtaa

SEQ ID NO: 566169 - DNA, 19 bp, Homo sapiens
actctgatgtaaatgaagt

SEQ ID NO: 566170 - DNA, 16 bp, Homo sapiens
actctgcctgcccttt

SEQ ID NO: 566171 - DNA, 21 bp, Homo sapiens
actctgtcgagcctgggggct

SEQ ID NO: 566172 - DNA, 14 bp, Homo sapiens
actctgtggggcca

SEQ ID NO: 566173 - DNA, 13 bp, Homo sapiens
actcttctctctg

SEQ ID NO: 566174 - DNA, 18 bp, Homo sapiens
actcttttgagcagtaaa

SEQ ID NO: 566175 - DNA, 16 bp, Homo sapiens
actgaagcagagtcaa

SEQ ID NO: 566176 - DNA, 23 bp, Homo sapiens
actgaagcttaaccgaagaacta

SEQ ID NO: 566177 - DNA, 16 bp, Homo sapiens
actgagcagtgatatt

SEQ ID NO: 566178 - DNA, 15 bp, Homo sapiens
actgagtacaaatgt

SEQ ID NO: 566179 - DNA, 16 bp, Homo sapiens
actgagtacaaatgtg

SEQ ID NO: 566180 - DNA, 13 bp, Homo sapiens
actgagtgaaata

SEQ ID NO: 566181 - DNA, 17 bp, Homo sapiens
actgagtgaaatattac

SEQ ID NO: 566182 - DNA, 19 bp, Homo sapiens
actgatatatttaaaaaca

SEQ ID NO: 566183 - DNA, 22 bp, Homo sapiens
actgcacatgatttcacaaata

SEQ ID NO: 566184 - DNA, 22 bp, Homo sapiens
actgcaccaccgaccaactcca

SEQ ID NO: 566185 - DNA, 16 bp, Homo sapiens
actgcataaatgaata

SEQ ID NO: 566186 - DNA, 18 bp, Homo sapiens
actgccatggaggcacac

SEQ ID NO: 566187 - DNA, 14 bp, Homo sapiens
actgccattttttg

SEQ ID NO: 566188 - DNA, 21 bp, Homo sapiens
actgcccctgcacctgcttct

SEQ ID NO: 566189 - DNA, 21 bp, Homo sapiens
actgcctccccaaggccccct

SEQ ID NO: 566190 - DNA, 13 bp, Homo sapiens
actgctcctcctc

SEQ ID NO: 566191 - DNA, 17 bp, Homo sapiens
actgctgtaaagcaaaa

SEQ ID NO: 566192 - DNA, 19 bp, Homo sapiens
actgctgtaaagcaaaata

SEQ ID NO: 566193 - DNA, 14 bp, Homo sapiens
actggagagcaaca

SEQ ID NO: 566194 - DNA, 13 bp, Homo sapiens
actggaggccagg

SEQ ID NO: 566195 - DNA, 15 bp, Homo sapiens
actggtctcagagga

SEQ ID NO: 566196 - DNA, 15 bp, Homo sapiens
actggtgttaatgag

SEQ ID NO: 566197 - DNA, 17 bp, Homo sapiens
actgtaaattccaaaga

SEQ ID NO: 566198 - DNA, 18 bp, Homo sapiens
actgtaaattccaaagat

SEQ ID NO: 566199 - DNA, 20 bp, Homo sapiens
actgtaaattccaaagatct

SEQ ID NO: 566200 - DNA, 22 bp, Homo sapiens
actgtacttgatttttcaaaga

SEQ ID NO: 566201 - DNA, 23 bp, Homo sapiens
actgtacttgatttttcaaagac

SEQ ID NO: 566202 - DNA, 13 bp, Homo sapiens
actgtactttgat

SEQ ID NO: 566203 - DNA, 19 bp, Homo sapiens
actgtctagcacttccttg

SEQ ID NO: 566204 - DNA, 21 bp, Homo sapiens
actgtctagcacttccttgcc

SEQ ID NO: 566205 - DNA, 12 bp, Homo sapiens
actgtctgtctg

SEQ ID NO: 566206 - DNA, 17 bp, Homo sapiens
actgtcttaattaagta

SEQ ID NO: 566207 - DNA, 19 bp, Homo sapiens
actgtcttaattaagtaaa

SEQ ID NO: 566208 - DNA, 17 bp, Homo sapiens
actgtgacacagctgag

SEQ ID NO: 566209 - DNA, 18 bp, Homo sapiens
actgtggcctcaggaggc

SEQ ID NO: 566210 - DNA, 12 bp, Homo sapiens
actgtgtttcta

SEQ ID NO: 566211 - DNA, 21 bp, Homo sapiens
actgtgtttctagttgcattt

SEQ ID NO: 566212 - DNA, 19 bp, Homo sapiens
actgttaccattggaaatt

SEQ ID NO: 566213 - DNA, 21 bp, Homo sapiens
actgttaccattggaaatttc

SEQ ID NO: 566214 - DNA, 14 bp, Homo sapiens
actgttataaattt

SEQ ID NO: 566215 - DNA, 17 bp, Homo sapiens
actgttataaattttgt

SEQ ID NO: 566216 - DNA, 20 bp, Homo sapiens
actgttcatgaatacgtaaa

SEQ ID NO: 566217 - DNA, 18 bp, Homo sapiens
acttacaagactgtaaat

SEQ ID NO: 566218 - DNA, 22 bp, Homo sapiens
acttacaagactgtaaattcca

SEQ ID NO: 566219 - DNA, 20 bp, Homo sapiens
acttacagaaccaattcact

SEQ ID NO: 566220 - DNA, 22 bp, Homo sapiens
acttacagaaccaattcacttt

SEQ ID NO: 566221 - DNA, 23 bp, Homo sapiens
acttagagctttttttttttaat

SEQ ID NO: 566222 - DNA, 22 bp, Homo sapiens
acttagcacttcagggcagatt

SEQ ID NO: 566223 - DNA, 19 bp, Homo sapiens
acttcaaaacaaacagatg

SEQ ID NO: 566224 - DNA, 22 bp, Homo sapiens
acttcagaaacccggcttcctg

SEQ ID NO: 566225 - DNA, 17 bp, Homo sapiens
acttcagggcagatttt

SEQ ID NO: 566226 - DNA, 20 bp, Homo sapiens
acttcagggcagattttagt

SEQ ID NO: 566227 - DNA, 13 bp, Homo sapiens
acttcatttaaca

SEQ ID NO: 566228 - DNA, 21 bp, Homo sapiens
acttctaaaactgtactttga

SEQ ID NO: 566229 - DNA, 23 bp, Homo sapiens
acttctaaaactgtactttgatt

SEQ ID NO: 566230 - DNA, 21 bp, Homo sapiens
acttctcaaatgctactcagt

SEQ ID NO: 566231 - DNA, 16 bp, Homo sapiens
acttctgttttcaatc

SEQ ID NO: 566232 - DNA, 21 bp, Homo sapiens
acttcttacccaaagcacatg

SEQ ID NO: 566233 - DNA, 16 bp, Homo sapiens
acttcttgtgctttac

SEQ ID NO: 566234 - DNA, 17 bp, Homo sapiens
acttctttcccttcctc

SEQ ID NO: 566235 - DNA, 16 bp, Homo sapiens
acttgaaattatatct

SEQ ID NO: 566236 - DNA, 23 bp, Homo sapiens
acttgaccttctgtcgtccccag

SEQ ID NO: 566237 - DNA, 19 bp, Homo sapiens
actttgtctaagaaacatt

SEQ ID NO: 566238 - DNA, 17 bp, Homo sapiens
actttgttaatttatct

SEQ ID NO: 566239 - DNA, 22 bp, Homo sapiens
actttgttaatttatctgttgt

SEQ ID NO: 566240 - DNA, 13 bp, Homo sapiens
acttttaataaag

SEQ ID NO: 566241 - DNA, 18 bp, Homo sapiens
acttttaataaagtatga

SEQ ID NO: 566242 - DNA, 15 bp, Homo sapiens
acttttattgtataa

SEQ ID NO: 566243 - DNA, 16 bp, Homo sapiens
acttttcaaaataaag

SEQ ID NO: 566244 - DNA, 21 bp, Homo sapiens
acttttccaacatacaattta

SEQ ID NO: 566245 - DNA, 23 bp, Homo sapiens
acttttccaacatacaatttact

SEQ ID NO: 566246 - DNA, 22 bp, Homo sapiens
acttttccttgcatacaaacaa

SEQ ID NO: 566247 - DNA, 22 bp, Homo sapiens
acttttgaaaagaccaagactt

SEQ ID NO: 566248 - DNA, 19 bp, Homo sapiens
acttttgtagtcttatgaa

SEQ ID NO: 566249 - DNA, 23 bp, Homo sapiens
acttttgtagtcttatgaataga

SEQ ID NO: 566250 - DNA, 14 bp, Homo sapiens
agaaaaaaaagaaa

SEQ ID NO: 566251 - DNA, 17 bp, Homo sapiens
agaaaaaaagggagaat

SEQ ID NO: 566252 - DNA, 13 bp, Homo sapiens
agaaaaaataaat

SEQ ID NO: 566253 - DNA, 22 bp, Homo sapiens
agaaaaatttctggcaaatatt

SEQ ID NO: 566254 - DNA, 20 bp, Homo sapiens
agaaaacggttaaaactgtc

SEQ ID NO: 566255 - DNA, 20 bp, Homo sapiens
agaaaagttcttaaaacact

SEQ ID NO: 566256 - DNA, 17 bp, Homo sapiens
agaaaataaatacaagt

SEQ ID NO: 566257 - DNA, 18 bp, Homo sapiens
agaaacacccacaggcat

SEQ ID NO: 566258 - DNA, 15 bp, Homo sapiens
agaaacagataccat

SEQ ID NO: 566259 - DNA, 16 bp, Homo sapiens
agaaacagataccata

SEQ ID NO: 566260 - DNA, 17 bp, Homo sapiens
agaaacagtttaacaga

SEQ ID NO: 566261 - DNA, 14 bp, Homo sapiens
agaaacccctgaca

SEQ ID NO: 566262 - DNA, 22 bp, Homo sapiens
agaaacccctgacaccttttca

SEQ ID NO: 566263 - DNA, 17 bp, Homo sapiens
agaaactgtctagcact

SEQ ID NO: 566264 - DNA, 23 bp, Homo sapiens
agaaacttgttcttccaaagcag

SEQ ID NO: 566265 - DNA, 15 bp, Homo sapiens
agaaagaggaataaa

SEQ ID NO: 566266 - DNA, 20 bp, Homo sapiens
agaaagccagtcttaacatt

SEQ ID NO: 566267 - DNA, 20 bp, Homo sapiens
agaaaggggctagcactgga

SEQ ID NO: 566268 - DNA, 14 bp, Homo sapiens
agaaagtgttctgt

SEQ ID NO: 566269 - DNA, 20 bp, Homo sapiens
agaaagtgttctgttacaaa

SEQ ID NO: 566270 - DNA, 20 bp, Homo sapiens
agaaatacatgttgtaaatg

SEQ ID NO: 566271 - DNA, 17 bp, Homo sapiens
agaaatataaaaataat

SEQ ID NO: 566272 - DNA, 13 bp, Homo sapiens
agaaatatatata

SEQ ID NO: 566273 - DNA, 15 bp, Homo sapiens
agaaatatatataca

SEQ ID NO: 566274 - DNA, 16 bp, Homo sapiens
agaaatatatatacat

SEQ ID NO: 566275 - DNA, 19 bp, Homo sapiens
agaaatatatatacatatg

SEQ ID NO: 566276 - DNA, 21 bp, Homo sapiens
agaaatcctaacattatattc

SEQ ID NO: 566277 - DNA, 19 bp, Homo sapiens
agaaatgcacaatgtcttg

SEQ ID NO: 566278 - DNA, 19 bp, Homo sapiens
agaaattagggctctaatt

SEQ ID NO: 566279 - DNA, 20 bp, Homo sapiens
agaaattagggctctaattt

SEQ ID NO: 566280 - DNA, 21 bp, Homo sapiens
agaaattagggctctaatttc

SEQ ID NO: 566281 - DNA, 23 bp, Homo sapiens
agaaattagggctctaatttcct

SEQ ID NO: 566282 - DNA, 19 bp, Homo sapiens
agaaattggtaccttgcac

SEQ ID NO: 566283 - DNA, 21 bp, Homo sapiens
agaaattggtaccttgcacac

SEQ ID NO: 566284 - DNA, 23 bp, Homo sapiens
agaaattggtaccttgcacacat

SEQ ID NO: 566285 - DNA, 19 bp, Homo sapiens
agaaatttatgaagcagat

SEQ ID NO: 566286 - DNA, 20 bp, Homo sapiens
agaaatttatgaagcagatt

SEQ ID NO: 566287 - DNA, 22 bp, Homo sapiens
agaaatttatgaagcagattta

SEQ ID NO: 566288 - DNA, 15 bp, Homo sapiens
agaaattttatctct

SEQ ID NO: 566289 - DNA, 16 bp, Homo sapiens
agaacaacataaaatt

SEQ ID NO: 566290 - DNA, 13 bp, Homo sapiens
agaacagggatgc

SEQ ID NO: 566291 - DNA, 16 bp, Homo sapiens
agaaccaattcacttt

SEQ ID NO: 566292 - DNA, 15 bp, Homo sapiens
agaaccgagcaaaga

SEQ ID NO: 566293 - DNA, 16 bp, Homo sapiens
agaaccgagcaaagat

SEQ ID NO: 566294 - DNA, 18 bp, Homo sapiens
agaaccgagcaaagatca

SEQ ID NO: 566295 - DNA, 20 bp, Homo sapiens
agaaccgagcaaagatcaaa

SEQ ID NO: 566296 - DNA, 20 bp, Homo sapiens
agaacctactgttcctttca

SEQ ID NO: 566297 - DNA, 20 bp, Homo sapiens
agaacgtattttaaaagcca

SEQ ID NO: 566298 - DNA, 14 bp, Homo sapiens
agaactctgcctgc

SEQ ID NO: 566299 - DNA, 12 bp, Homo sapiens
agaactcttcct

SEQ ID NO: 566300 - DNA, 18 bp, Homo sapiens
agaactgacttcctgaac

SEQ ID NO: 566301 - DNA, 22 bp, Homo sapiens
agaacttgaagcctgctccttc

SEQ ID NO: 566302 - DNA, 12 bp, Homo sapiens
agaacttgttta

SEQ ID NO: 566303 - DNA, 13 bp, Homo sapiens
agaagaatggctt

SEQ ID NO: 566304 - DNA, 14 bp, Homo sapiens
agaagaatggcttt

SEQ ID NO: 566305 - DNA, 19 bp, Homo sapiens
agaagagtaacacttgaaa

SEQ ID NO: 566306 - DNA, 20 bp, Homo sapiens
agaagatagttgtaaagata

SEQ ID NO: 566307 - DNA, 20 bp, Homo sapiens
agaagcagcagctagaaaga

SEQ ID NO: 566308 - DNA, 17 bp, Homo sapiens
agaagccacccaaagca

SEQ ID NO: 566309 - DNA, 18 bp, Homo sapiens
agaagccacccaaagcag

SEQ ID NO: 566310 - DNA, 17 bp, Homo sapiens
agaaggacttcctgcta

SEQ ID NO: 566311 - DNA, 20 bp, Homo sapiens
agaaggacttcctgctacag

SEQ ID NO: 566312 - DNA, 23 bp, Homo sapiens
agaaggcaaactgaggcagcatg

SEQ ID NO: 566313 - DNA, 13 bp, Homo sapiens
agaagggagtgaa

SEQ ID NO: 566314 - DNA, 14 bp, Homo sapiens
agaaggtaaataat

SEQ ID NO: 566315 - DNA, 19 bp, Homo sapiens
agaagtcttcatgaaatgc

SEQ ID NO: 566316 - DNA, 16 bp, Homo sapiens
agaagtgaaaaagact

SEQ ID NO: 566317 - DNA, 17 bp, Homo sapiens
agaagtggactggagga

SEQ ID NO: 566318 - DNA, 14 bp, Homo sapiens
agaataaaattcct

SEQ ID NO: 566319 - DNA, 18 bp, Homo sapiens
agaataaaattcctatct

SEQ ID NO: 566320 - DNA, 15 bp, Homo sapiens
agaataaaggcagct

SEQ ID NO: 566321 - DNA, 16 bp, Homo sapiens
agaataggacttgttt

SEQ ID NO: 566322 - DNA, 12 bp, Homo sapiens
agaatctttcct

SEQ ID NO: 566323 - DNA, 19 bp, Homo sapiens
agaatctttccttcctctc

SEQ ID NO: 566324 - DNA, 13 bp, Homo sapiens
agaatgaccttgt

SEQ ID NO: 566325 - DNA, 20 bp, Homo sapiens
agaatgaccttgtaatgtaa

SEQ ID NO: 566326 - DNA, 21 bp, Homo sapiens
agaatgaccttgtaatgtaac

SEQ ID NO: 566327 - DNA, 17 bp, Homo sapiens
agaatgagggcgtgaaa

SEQ ID NO: 566328 - DNA, 23 bp, Homo sapiens
agaatggctttcaataccctttt

SEQ ID NO: 566329 - DNA, 15 bp, Homo sapiens
agacaaatacacata

SEQ ID NO: 566330 - DNA, 17 bp, Homo sapiens
agacaaatagtaggcaa

SEQ ID NO: 566331 - DNA, 15 bp, Homo sapiens
agacaacagcccagg

SEQ ID NO: 566332 - DNA, 17 bp, Homo sapiens
agacaacagcccaggca

SEQ ID NO: 566333 - DNA, 13 bp, Homo sapiens
agacaatcttctg

SEQ ID NO: 566334 - DNA, 15 bp, Homo sapiens
agacaatcttctgtt

SEQ ID NO: 566335 - DNA, 17 bp, Homo sapiens
agacaattctaatggta

SEQ ID NO: 566336 - DNA, 19 bp, Homo sapiens
agacaattctaatggtaac

SEQ ID NO: 566337 - DNA, 21 bp, Homo sapiens
agacacacaagcagacacaca

SEQ ID NO: 566338 - DNA, 17 bp, Homo sapiens
attctttatttctgtca

SEQ ID NO: 566339 - DNA, 21 bp, Homo sapiens
attctttatttctgtcattca

SEQ ID NO: 566340 - DNA, 13 bp, Homo sapiens
attgaaaatgtca

SEQ ID NO: 566341 - DNA, 15 bp, Homo sapiens
attgaaaatgtcact

SEQ ID NO: 566342 - DNA, 16 bp, Homo sapiens
attgaaaatgtcactg

SEQ ID NO: 566343 - DNA, 18 bp, Homo sapiens
attgaaaatgtcactgtt

SEQ ID NO: 566344 - DNA, 13 bp, Homo sapiens
attgaaactgtat

SEQ ID NO: 566345 - DNA, 17 bp, Homo sapiens
attgaaactgtatttac

SEQ ID NO: 566346 - DNA, 17 bp, Homo sapiens
attgaaagggacaagta

SEQ ID NO: 566347 - DNA, 18 bp, Homo sapiens
attgaaagggacaagtat

SEQ ID NO: 566348 - DNA, 14 bp, Homo sapiens
attgaagaaacaga

SEQ ID NO: 566349 - DNA, 15 bp, Homo sapiens
attgaagaaacagat

SEQ ID NO: 566350 - DNA, 17 bp, Homo sapiens
attgaagaaacagatac

SEQ ID NO: 566351 - DNA, 12 bp, Homo sapiens
attgacaagttt

SEQ ID NO: 566352 - DNA, 14 bp, Homo sapiens
attgacaagtttaa

SEQ ID NO: 566353 - DNA, 18 bp, Homo sapiens
attgacaataagaaacag

SEQ ID NO: 566354 - DNA, 21 bp, Homo sapiens
attgaccgacagctttccagt

SEQ ID NO: 566355 - DNA, 21 bp, Homo sapiens
attgagagagatgtgtaattt

SEQ ID NO: 566356 - DNA, 16 bp, Homo sapiens
attgagctagaaatca

SEQ ID NO: 566357 - DNA, 22 bp, Homo sapiens
attgagtcattttatatatgaa

SEQ ID NO: 566358 - DNA, 13 bp, Homo sapiens
attgagtgtacat

SEQ ID NO: 566359 - DNA, 13 bp, Homo sapiens
attgatagaataa

SEQ ID NO: 566360 - DNA, 13 bp, Homo sapiens
attgatgttgatg

SEQ ID NO: 566361 - DNA, 18 bp, Homo sapiens
attgatttcccttcttct

SEQ ID NO: 566362 - DNA, 13 bp, Homo sapiens
attgcaaagcaaa

SEQ ID NO: 566363 - DNA, 22 bp, Homo sapiens
attgcatcacctctgtaatttt

SEQ ID NO: 566364 - DNA, 21 bp, Homo sapiens
attgccaaacattaatgttga

SEQ ID NO: 566365 - DNA, 22 bp, Homo sapiens
attgccatattaaaatctgatg

SEQ ID NO: 566366 - DNA, 21 bp, Homo sapiens
attgcccacacctgcctctga

SEQ ID NO: 566367 - DNA, 23 bp, Homo sapiens
attgccttatattggatcaggaa

SEQ ID NO: 566368 - DNA, 14 bp, Homo sapiens
attgctgtaaataa

SEQ ID NO: 566369 - DNA, 20 bp, Homo sapiens
attgctgtaaataaaaatag

SEQ ID NO: 566370 - DNA, 14 bp, Homo sapiens
attgcttctctaaa

SEQ ID NO: 566371 - DNA, 10 bp, Homo sapiens
attgcttctt

SEQ ID NO: 566372 - DNA, 21 bp, Homo sapiens
attgcttttaaaattttaagc

SEQ ID NO: 566373 - DNA, 15 bp, Homo sapiens
attggaaaaaattag

SEQ ID NO: 566374 - DNA, 14 bp, Homo sapiens
attggatcaggaac

SEQ ID NO: 566375 - DNA, 17 bp, Homo sapiens
attggattttatgttga

SEQ ID NO: 566376 - DNA, 21 bp, Homo sapiens
attggattttatgttgacatt

SEQ ID NO: 566377 - DNA, 18 bp, Homo sapiens
attggcatggatttctgt

SEQ ID NO: 566378 - DNA, 21 bp, Homo sapiens
attggcatggatttctgtctt

SEQ ID NO: 566379 - DNA, 12 bp, Homo sapiens
attggcttgttt

SEQ ID NO: 566380 - DNA, 15 bp, Homo sapiens
attggtaccttgcac

SEQ ID NO: 566381 - DNA, 16 bp, Homo sapiens
attggtttctcttctc

SEQ ID NO: 566382 - DNA, 19 bp, Homo sapiens
attgtatatatatgtgaac

SEQ ID NO: 566383 - DNA, 20 bp, Homo sapiens
attgtatatatatgtgaact

SEQ ID NO: 566384 - DNA, 14 bp, Homo sapiens
attgtatctccttt

SEQ ID NO: 566385 - DNA, 13 bp, Homo sapiens
attgtccagagct

SEQ ID NO: 566386 - DNA, 23 bp, Homo sapiens
caaataacttacaagactgtaaa

SEQ ID NO: 566387 - DNA, 22 bp, Homo sapiens
caaatacaaaatgattgtcttt

SEQ ID NO: 566388 - DNA, 11 bp, Homo sapiens
caaatacacat

SEQ ID NO: 566389 - DNA, 18 bp, Homo sapiens
caaatacacatacatata

SEQ ID NO: 566390 - DNA, 20 bp, Homo sapiens
caaatacacatacatatata

SEQ ID NO: 566391 - DNA, 14 bp, Homo sapiens
caaatacatgcctt

SEQ ID NO: 566392 - DNA, 17 bp, Homo sapiens
caaatataaaacttaca

SEQ ID NO: 566393 - DNA, 19 bp, Homo sapiens
caaatatagcgttcccaac

SEQ ID NO: 566394 - DNA, 14 bp, Homo sapiens
caaatatgtaaact

SEQ ID NO: 566395 - DNA, 15 bp, Homo sapiens
caaatatgtaaactt

SEQ ID NO: 566396 - DNA, 16 bp, Homo sapiens
caaatatgtaaacttt

SEQ ID NO: 566397 - DNA, 18 bp, Homo sapiens
caaatatgtaaactttaa

SEQ ID NO: 566398 - DNA, 19 bp, Homo sapiens
caaatatttctagacactt

SEQ ID NO: 566399 - DNA, 14 bp, Homo sapiens
caaatctgtctgct

SEQ ID NO: 566400 - DNA, 17 bp, Homo sapiens
caaatgattgcttttaa

SEQ ID NO: 566401 - DNA, 18 bp, Homo sapiens
caaatgattgcttttaaa

SEQ ID NO: 566402 - DNA, 19 bp, Homo sapiens
caaatgattgcttttaaaa

SEQ ID NO: 566403 - DNA, 21 bp, Homo sapiens
caaatgattgcttttaaaatt

SEQ ID NO: 566404 - DNA, 23 bp, Homo sapiens
caaatgattgcttttaaaatttt

SEQ ID NO: 566405 - DNA, 13 bp, Homo sapiens
caaatgcttttcc

SEQ ID NO: 566406 - DNA, 19 bp, Homo sapiens
caaatgcttttccaaccca

SEQ ID NO: 566407 - DNA, 13 bp, Homo sapiens
caaatggtacaaa

SEQ ID NO: 566408 - DNA, 15 bp, Homo sapiens
caaatggtacaaaac

SEQ ID NO: 566409 - DNA, 23 bp, Homo sapiens
caaatggtggttgtttcttccaa

SEQ ID NO: 566410 - DNA, 12 bp, Homo sapiens
caaatgtacatc

SEQ ID NO: 566411 - DNA, 17 bp, Homo sapiens
caaatgtacccagccta

SEQ ID NO: 566412 - DNA, 20 bp, Homo sapiens
caaatgtgtcttgtattatc

SEQ ID NO: 566413 - DNA, 13 bp, Homo sapiens
caaattaatgtgt

SEQ ID NO: 566414 - DNA, 19 bp, Homo sapiens
caaattatgctaagaattt

SEQ ID NO: 566415 - DNA, 21 bp, Homo sapiens
caaattatgctaagaattttt

SEQ ID NO: 566416 - DNA, 16 bp, Homo sapiens
caaatttcaaaagaca

SEQ ID NO: 566417 - DNA, 21 bp, Homo sapiens
caaattttattaaaagagtag

SEQ ID NO: 566418 - DNA, 16 bp, Homo sapiens
caacaaactgcacatg

SEQ ID NO: 566419 - DNA, 14 bp, Homo sapiens
caacaataaaacat

SEQ ID NO: 566420 - DNA, 15 bp, Homo sapiens
caacaattttcagat

SEQ ID NO: 566421 - DNA, 18 bp, Homo sapiens
caacacattgaaactgta

SEQ ID NO: 566422 - DNA, 19 bp, Homo sapiens
caacacattgaaactgtat

SEQ ID NO: 566423 - DNA, 20 bp, Homo sapiens
caacacattgaaactgtatt

SEQ ID NO: 566424 - DNA, 20 bp, Homo sapiens
caacagattggattttatgt

SEQ ID NO: 566425 - DNA, 17 bp, Homo sapiens
caacagctggacacccc

SEQ ID NO: 566426 - DNA, 15 bp, Homo sapiens
caacatacaatttac

SEQ ID NO: 566427 - DNA, 13 bp, Homo sapiens
caacatgtgatgt

SEQ ID NO: 566428 - DNA, 14 bp, Homo sapiens
caacatgtgtgact

SEQ ID NO: 566429 - DNA, 14 bp, Homo sapiens
caacatttgctttt

SEQ ID NO: 566430 - DNA, 16 bp, Homo sapiens
caacccccagctcccg

SEQ ID NO: 566431 - DNA, 17 bp, Homo sapiens
caacctcccctggtcct

SEQ ID NO: 566432 - DNA, 20 bp, Homo sapiens
caacctgacagcaaacacag

SEQ ID NO: 566433 - DNA, 21 bp, Homo sapiens
caacctgacagcaaacacagt

SEQ ID NO: 566434 - DNA, 17 bp, Homo sapiens
caacgagccttttcacc

SEQ ID NO: 566435 - DNA, 13 bp, Homo sapiens
caactctgactgt

SEQ ID NO: 566436 - DNA, 23 bp, Homo sapiens
caacttgaaattatatctgtggt

SEQ ID NO: 566437 - DNA, 22 bp, Homo sapiens
caacttttccaacatacaattt

SEQ ID NO: 566438 - DNA, 16 bp, Homo sapiens
caagaacactggacct

SEQ ID NO: 566439 - DNA, 15 bp, Homo sapiens
caagaacttgtttaa

SEQ ID NO: 566440 - DNA, 15 bp, Homo sapiens
caagaataaaggcag

SEQ ID NO: 566441 - DNA, 17 bp, Homo sapiens
caagaataaaggcagct

SEQ ID NO: 566442 - DNA, 21 bp, Homo sapiens
caagaataaaggcagctgttg

SEQ ID NO: 566443 - DNA, 13 bp, Homo sapiens
caagaccaaagag

SEQ ID NO: 566444 - DNA, 15 bp, Homo sapiens
caagaccagcctggc

SEQ ID NO: 566445 - DNA, 15 bp, Homo sapiens
caagacccccaggaa

SEQ ID NO: 566446 - DNA, 22 bp, Homo sapiens
caagactctttatgatctggcc

SEQ ID NO: 566447 - DNA, 14 bp, Homo sapiens
caagactgtaaatt

SEQ ID NO: 566448 - DNA, 13 bp, Homo sapiens
caatttactttta

SEQ ID NO: 566449 - DNA, 19 bp, Homo sapiens
caatttcaattttgtctgt

SEQ ID NO: 566450 - DNA, 15 bp, Homo sapiens
caatttcagaaacta

SEQ ID NO: 566451 - DNA, 13 bp, Homo sapiens
cacaaaaaattta

SEQ ID NO: 566452 - DNA, 22 bp, Homo sapiens
cacaaaaagataccttaaaatt

SEQ ID NO: 566453 - DNA, 14 bp, Homo sapiens
cacaaacaaacaag

SEQ ID NO: 566454 - DNA, 19 bp, Homo sapiens
cacaaacaaacaagctagg

SEQ ID NO: 566455 - DNA, 14 bp, Homo sapiens
cacaaacatagaca

SEQ ID NO: 566456 - DNA, 21 bp, Homo sapiens
cacaaacatagacagatgtgg

SEQ ID NO: 566457 - DNA, 20 bp, Homo sapiens
cacaaagctatttaagtgga

SEQ ID NO: 566458 - DNA, 22 bp, Homo sapiens
cacaaagctatttaagtggact

SEQ ID NO: 566459 - DNA, 17 bp, Homo sapiens
cacaaatattaaaaagt

SEQ ID NO: 566460 - DNA, 20 bp, Homo sapiens
cacaaatattaaaaagtctt

SEQ ID NO: 566461 - DNA, 20 bp, Homo sapiens
cacaagcagacacacacata

SEQ ID NO: 566462 - DNA, 13 bp, Homo sapiens
cacaatgaatgta

SEQ ID NO: 566463 - DNA, 11 bp, Homo sapiens
cacaatgtctt

SEQ ID NO: 566464 - DNA, 12 bp, Homo sapiens
cacaatgtcttg

SEQ ID NO: 566465 - DNA, 12 bp, Homo sapiens
cacacaaagcag

SEQ ID NO: 566466 - DNA, 17 bp, Homo sapiens
cacacacaaaaaaagac

SEQ ID NO: 566467 - DNA, 16 bp, Homo sapiens
cacacacacacacacg

SEQ ID NO: 566468 - DNA, 14 bp, Homo sapiens
cacacacacacacg

SEQ ID NO: 566469 - DNA, 15 bp, Homo sapiens
cacacacacacacgc

SEQ ID NO: 566470 - DNA, 12 bp, Homo sapiens
cacacacacacg

SEQ ID NO: 566471 - DNA, 13 bp, Homo sapiens
cacacacacgcac

SEQ ID NO: 566472 - DNA, 14 bp, Homo sapiens
cacacacagacaca

SEQ ID NO: 566473 - DNA, 16 bp, Homo sapiens
cacacacgcacgcaca

SEQ ID NO: 566474 - DNA, 19 bp, Homo sapiens
cacacacgcacgcacacac

SEQ ID NO: 566475 - DNA, 23 bp, Homo sapiens
cacacacgcacgcacacacacaa

SEQ ID NO: 566476 - DNA, 14 bp, Homo sapiens
cacacagaaatata

SEQ ID NO: 566477 - DNA, 17 bp, Homo sapiens
cacacagacacacaagc

SEQ ID NO: 566478 - DNA, 16 bp, Homo sapiens
cacacatatatacata

SEQ ID NO: 566479 - DNA, 21 bp, Homo sapiens
cacacatatatgtatacgcac

SEQ ID NO: 566480 - DNA, 14 bp, Homo sapiens
cacacatttcactg

SEQ ID NO: 566481 - DNA, 19 bp, Homo sapiens
cacacatttcactgtctgt

SEQ ID NO: 566482 - DNA, 20 bp, Homo sapiens
cacaccctacagcagatcca

SEQ ID NO: 566483 - DNA, 23 bp, Homo sapiens
cacaccctacagcagatccacct

SEQ ID NO: 566484 - DNA, 18 bp, Homo sapiens
cacacctgcctctgaact

SEQ ID NO: 566485 - DNA, 13 bp, Homo sapiens
cacacgcagacac

SEQ ID NO: 566486 - DNA, 15 bp, Homo sapiens
cacacgcagacacac

SEQ ID NO: 566487 - DNA, 16 bp, Homo sapiens
cacacgcagacacaca

SEQ ID NO: 566488 - DNA, 18 bp, Homo sapiens
cacacgcagacacacaca

SEQ ID NO: 566489 - DNA, 12 bp, Homo sapiens
cacacttagctg

SEQ ID NO: 566490 - DNA, 16 bp, Homo sapiens
cacacttagctggaga

SEQ ID NO: 566491 - DNA, 12 bp, Homo sapiens
cacacttgacct

SEQ ID NO: 566492 - DNA, 17 bp, Homo sapiens
cacacttgtcggctcca

SEQ ID NO: 566493 - DNA, 15 bp, Homo sapiens
cacagaaatatatat

SEQ ID NO: 566494 - DNA, 18 bp, Homo sapiens
cacagacacacacacgca

SEQ ID NO: 566495 - DNA, 22 bp, Homo sapiens
cacagacacacacacgcacgca

SEQ ID NO: 566496 - DNA, 22 bp, Homo sapiens
cacagagagggggccacctccc

SEQ ID NO: 566497 - DNA, 22 bp, Homo sapiens
cacagatgtgggctttgatttc

SEQ ID NO: 566498 - DNA, 18 bp, Homo sapiens
cacagcagcttcaccaga

SEQ ID NO: 566499 - DNA, 21 bp, Homo sapiens
cacagcagcttcaccagagca

SEQ ID NO: 566500 - DNA, 22 bp, Homo sapiens
cacagcagcttcaccagagcat

SEQ ID NO: 566501 - DNA, 19 bp, Homo sapiens
cacagcctcacccctgcag

SEQ ID NO: 566502 - DNA, 20 bp, Homo sapiens
cacagcctcacccctgcagg

SEQ ID NO: 566503 - DNA, 21 bp, Homo sapiens
cacagcctcacccctgcaggc

SEQ ID NO: 566504 - DNA, 17 bp, Homo sapiens
cacagctgagctggcct

SEQ ID NO: 566505 - DNA, 19 bp, Homo sapiens
cacagctgcagagacagag

SEQ ID NO: 566506 - DNA, 15 bp, Homo sapiens
cacagctggccacca

SEQ ID NO: 566507 - DNA, 20 bp, Homo sapiens
cacaggatgcatattaaaga

SEQ ID NO: 566508 - DNA, 20 bp, Homo sapiens
cacaggatggtctctgccat

SEQ ID NO: 566509 - DNA, 12 bp, Homo sapiens
cacaggctgccc

SEQ ID NO: 566510 - DNA, 14 bp, Homo sapiens
cacaggctgcccca

SEQ ID NO: 566511 - DNA, 19 bp, Homo sapiens
cacaggtgtggtgtaattt

SEQ ID NO: 566512 - DNA, 14 bp, Homo sapiens
cacagtctccccca

SEQ ID NO: 566513 - DNA, 17 bp, Homo sapiens
cacagtgtaccattaaa

SEQ ID NO: 566514 - DNA, 22 bp, Homo sapiens
cacagtgtaccattaaaatatg

SEQ ID NO: 566515 - DNA, 23 bp, Homo sapiens
cacataattcattaaaaacattt

SEQ ID NO: 566516 - DNA, 16 bp, Homo sapiens
cacatagactgtgcgc

SEQ ID NO: 566517 - DNA, 22 bp, Homo sapiens
cacatagctacccaaaagagaa

SEQ ID NO: 566518 - DNA, 18 bp, Homo sapiens
cagacaacagcccaggca

SEQ ID NO: 566519 - DNA, 19 bp, Homo sapiens
cagacaagctgttgaccag

SEQ ID NO: 566520 - DNA, 15 bp, Homo sapiens
cagacaatcttctgt

SEQ ID NO: 566521 - DNA, 14 bp, Homo sapiens
cagacaattctaat

SEQ ID NO: 566522 - DNA, 19 bp, Homo sapiens
cagacaattctaatggtaa

SEQ ID NO: 566523 - DNA, 23 bp, Homo sapiens
cagacaattctaatggtaacttt

SEQ ID NO: 566524 - DNA, 13 bp, Homo sapiens
cagacacaaacaa

SEQ ID NO: 566525 - DNA, 13 bp, Homo sapiens
cagacacacacac

SEQ ID NO: 566526 - DNA, 17 bp, Homo sapiens
cagacacacacacgcac

SEQ ID NO: 566527 - DNA, 18 bp, Homo sapiens
cagacacacacacgcacg

SEQ ID NO: 566528 - DNA, 15 bp, Homo sapiens
cagacacacacatat

SEQ ID NO: 566529 - DNA, 14 bp, Homo sapiens
cagacacctagact

SEQ ID NO: 566530 - DNA, 18 bp, Homo sapiens
cagacagggggccagaac

SEQ ID NO: 566531 - DNA, 15 bp, Homo sapiens
cagaccagtagtgac

SEQ ID NO: 566532 - DNA, 13 bp, Homo sapiens
cagaccccatcca

SEQ ID NO: 566533 - DNA, 17 bp, Homo sapiens
cagaccccatccagcca

SEQ ID NO: 566534 - DNA, 19 bp, Homo sapiens
cagacctgggccctggttc

SEQ ID NO: 566535 - DNA, 17 bp, Homo sapiens
cagacgcacgtgggtct

SEQ ID NO: 566536 - DNA, 17 bp, Homo sapiens
cagactggtgttaatga

SEQ ID NO: 566537 - DNA, 20 bp, Homo sapiens
cagactggtgttaatgagta

SEQ ID NO: 566538 - DNA, 21 bp, Homo sapiens
cagactggtgttaatgagtat

SEQ ID NO: 566539 - DNA, 23 bp, Homo sapiens
cagacttgggagctttaaagagc

SEQ ID NO: 566540 - DNA, 17 bp, Homo sapiens
cagagaaattatgtttt

SEQ ID NO: 566541 - DNA, 17 bp, Homo sapiens
cagagaagtacaggtca

SEQ ID NO: 566542 - DNA, 16 bp, Homo sapiens
cagagacagagaggac

SEQ ID NO: 566543 - DNA, 16 bp, Homo sapiens
cagagacctcctgatg

SEQ ID NO: 566544 - DNA, 16 bp, Homo sapiens
cagagaggacgtgggc

SEQ ID NO: 566545 - DNA, 15 bp, Homo sapiens
cagagagggggccac

SEQ ID NO: 566546 - DNA, 22 bp, Homo sapiens
cagagagggggccacctcccca

SEQ ID NO: 566547 - DNA, 16 bp, Homo sapiens
cagagattgcttctca

SEQ ID NO: 566548 - DNA, 17 bp, Homo sapiens
cagagcacagccaatct

SEQ ID NO: 566549 - DNA, 18 bp, Homo sapiens
cagagcacagccaatctc

SEQ ID NO: 566550 - DNA, 12 bp, Homo sapiens
cagagcagtctg

SEQ ID NO: 566551 - DNA, 20 bp, Homo sapiens
cagagcccagaccctggagg

SEQ ID NO: 566552 - DNA, 10 bp, Homo sapiens
cagagccctg

SEQ ID NO: 566553 - DNA, 14 bp, Homo sapiens
cagagccctgctcc

SEQ ID NO: 566554 - DNA, 17 bp, Homo sapiens
cagagcctgcagggtga

SEQ ID NO: 566555 - DNA, 18 bp, Homo sapiens
cagagctcagcacagcct

SEQ ID NO: 566556 - DNA, 23 bp, Homo sapiens
cagagctcctccttgtcttggca

SEQ ID NO: 566557 - DNA, 16 bp, Homo sapiens
cagagctgcttccccg

SEQ ID NO: 566558 - DNA, 21 bp, Homo sapiens
cagaggggcggggccaggatg

SEQ ID NO: 566559 - DNA, 13 bp, Homo sapiens
cagagtgaagagt

SEQ ID NO: 566560 - DNA, 17 bp, Homo sapiens
cagataattctggacca

SEQ ID NO: 566561 - DNA, 21 bp, Homo sapiens
cagatcacatgcccctcttag

SEQ ID NO: 566562 - DNA, 15 bp, Homo sapiens
cagatcagccagaag

SEQ ID NO: 566563 - DNA, 16 bp, Homo sapiens
cagatccacctgcaca

SEQ ID NO: 566564 - DNA, 9 bp, Homo sapiens
cagatccag

SEQ ID NO: 566565 - DNA, 19 bp, Homo sapiens
cagatccaggaacacatgc

SEQ ID NO: 566566 - DNA, 20 bp, Homo sapiens
cagatccaggaacacatgca

SEQ ID NO: 566567 - DNA, 21 bp, Homo sapiens
cagatccaggaacacatgcac

SEQ ID NO: 566568 - DNA, 22 bp, Homo sapiens
cagatccaggaacacatgcaca

SEQ ID NO: 566569 - DNA, 17 bp, Homo sapiens
cagatgaaggaaaggaa

SEQ ID NO: 566570 - DNA, 14 bp, Homo sapiens
cagatgacccctcc

SEQ ID NO: 566571 - DNA, 17 bp, Homo sapiens
cagatgacccctgccca

SEQ ID NO: 566572 - DNA, 23 bp, Homo sapiens
cagatgacccctgcccagatcag

SEQ ID NO: 566573 - DNA, 15 bp, Homo sapiens
cagatgatccttgca

SEQ ID NO: 566574 - DNA, 22 bp, Homo sapiens
cagatgatccttgcacagacaa

SEQ ID NO: 566575 - DNA, 13 bp, Homo sapiens
ccaccagttgctg

SEQ ID NO: 566576 - DNA, 14 bp, Homo sapiens
ccaccagttgctgc

SEQ ID NO: 566577 - DNA, 13 bp, Homo sapiens
ccacccaaagcag

SEQ ID NO: 566578 - DNA, 14 bp, Homo sapiens
ccaccctccttccc

SEQ ID NO: 566579 - DNA, 20 bp, Homo sapiens
ccaccctgctcatccactct

SEQ ID NO: 566580 - DNA, 23 bp, Homo sapiens
ccacctccccaggccgtggctgc

SEQ ID NO: 566581 - DNA, 14 bp, Homo sapiens
ccacctgcacaaac

SEQ ID NO: 566582 - DNA, 15 bp, Homo sapiens
ccacctgcacaaaca

SEQ ID NO: 566583 - DNA, 17 bp, Homo sapiens
ccacctgcacaaacata

SEQ ID NO: 566584 - DNA, 12 bp, Homo sapiens
ccacctgcagct

SEQ ID NO: 566585 - DNA, 24 bp, Homo sapiens
ccacctgcccggcccaggagcgca

SEQ ID NO: 566586 - DNA, 14 bp, Homo sapiens
ccacctggaagccc

SEQ ID NO: 566587 - DNA, 12 bp, Homo sapiens
ccacctgggaga

SEQ ID NO: 566588 - DNA, 13 bp, Homo sapiens
ccacctgggagat

SEQ ID NO: 566589 - DNA, 15 bp, Homo sapiens
ccacctgggagatgc

SEQ ID NO: 566590 - DNA, 21 bp, Homo sapiens
ccactagaggggcacccacca

SEQ ID NO: 566591 - DNA, 13 bp, Homo sapiens
ccactcctgctct

SEQ ID NO: 566592 - DNA, 17 bp, Homo sapiens
ccactcctgctctgctc

SEQ ID NO: 566593 - DNA, 14 bp, Homo sapiens
ccactggctgtggg

SEQ ID NO: 566594 - DNA, 16 bp, Homo sapiens
ccactggctgtgggct

SEQ ID NO: 566595 - DNA, 20 bp, Homo sapiens
ccactggctgtgggctccct

SEQ ID NO: 566596 - DNA, 19 bp, Homo sapiens
ccactggtgtatgaaatga

SEQ ID NO: 566597 - DNA, 19 bp, Homo sapiens
ccactgtctccacccacct

SEQ ID NO: 566598 - DNA, 14 bp, Homo sapiens
ccacttcaaaacaa

SEQ ID NO: 566599 - DNA, 15 bp, Homo sapiens
ccacttcaaaacaaa

SEQ ID NO: 566600 - DNA, 18 bp, Homo sapiens
ccactttgtataaatttt

SEQ ID NO: 566601 - DNA, 16 bp, Homo sapiens
ccatgtgagctgctgc

SEQ ID NO: 566602 - DNA, 19 bp, Homo sapiens
ccatgtgagctgctgccat

SEQ ID NO: 566603 - DNA, 20 bp, Homo sapiens
ccatgtgagctgctgccatg

SEQ ID NO: 566604 - DNA, 22 bp, Homo sapiens
ccatgtgagctgctgccatgaa

SEQ ID NO: 566605 - DNA, 20 bp, Homo sapiens
ccattctggcactttaatga

SEQ ID NO: 566606 - DNA, 18 bp, Homo sapiens
ccatttagtcctcacctt

SEQ ID NO: 566607 - DNA, 12 bp, Homo sapiens
ccatttcctgta

SEQ ID NO: 566608 - DNA, 13 bp, Homo sapiens
ccatttcctgtac

SEQ ID NO: 566609 - DNA, 13 bp, Homo sapiens
ccattttctttac

SEQ ID NO: 566610 - DNA, 14 bp, Homo sapiens
ccattttgaaatat

SEQ ID NO: 566611 - DNA, 13 bp, Homo sapiens
cccaaacctggag

SEQ ID NO: 566612 - DNA, 15 bp, Homo sapiens
cccaaacctggagat

SEQ ID NO: 566613 - DNA, 13 bp, Homo sapiens
cccaaagcacatg

SEQ ID NO: 566614 - DNA, 18 bp, Homo sapiens
cccaaaggccaacagcat

SEQ ID NO: 566615 - DNA, 22 bp, Homo sapiens
cccaaagtaccacactgagttc

SEQ ID NO: 566616 - DNA, 21 bp, Homo sapiens
cccaaattgtcacctgcttct

SEQ ID NO: 566617 - DNA, 18 bp, Homo sapiens
cccaaccctgcccagcct

SEQ ID NO: 566618 - DNA, 20 bp, Homo sapiens
cccaacctcccctggtcctg

SEQ ID NO: 566619 - DNA, 11 bp, Homo sapiens
ccctgggagag

SEQ ID NO: 566620 - DNA, 16 bp, Homo sapiens
ccctgggagagtgagg

SEQ ID NO: 566621 - DNA, 18 bp, Homo sapiens
ccctgggcatgcccagcc

SEQ ID NO: 566622 - DNA, 18 bp, Homo sapiens
ccctggttcccccaggac

SEQ ID NO: 566623 - DNA, 21 bp, Homo sapiens
ccctggttcccccaggaccct

SEQ ID NO: 566624 - DNA, 14 bp, Homo sapiens
ccctgtcaggaggc

SEQ ID NO: 566625 - DNA, 19 bp, Homo sapiens
ccctgtctgtctgtctctc

SEQ ID NO: 566626 - DNA, 21 bp, Homo sapiens
ccctgtgcagaagggagctgg

SEQ ID NO: 566627 - DNA, 18 bp, Homo sapiens
cccttccagtttattcca

SEQ ID NO: 566628 - DNA, 16 bp, Homo sapiens
cccttcctctgctccc

SEQ ID NO: 566629 - DNA, 12 bp, Homo sapiens
cccttctcttcc

SEQ ID NO: 566630 - DNA, 17 bp, Homo sapiens
cccttctcttccaggca

SEQ ID NO: 566631 - DNA, 12 bp, Homo sapiens
cccttgacctgc

SEQ ID NO: 566632 - DNA, 22 bp, Homo sapiens
cccttgggatgggcacaggctg

SEQ ID NO: 566633 - DNA, 23 bp, Homo sapiens
cccttggggaaatgctatcagaa

SEQ ID NO: 566634 - DNA, 12 bp, Homo sapiens
cccttgttccag

SEQ ID NO: 566635 - DNA, 23 bp, Homo sapiens
ccctttacttgtctttctggggt

SEQ ID NO: 566636 - DNA, 17 bp, Homo sapiens
ccctttgtcctcctgct

SEQ ID NO: 566637 - DNA, 20 bp, Homo sapiens
ccgaaggtctctctggctct

SEQ ID NO: 566638 - DNA, 18 bp, Homo sapiens
ccgacctggcctgtctgt

SEQ ID NO: 566639 - DNA, 14 bp, Homo sapiens
ccgactagacacac

SEQ ID NO: 566640 - DNA, 18 bp, Homo sapiens
ccgacttgtgcacaggca

SEQ ID NO: 566641 - DNA, 19 bp, Homo sapiens
ccgacttgtgcacaggcag

SEQ ID NO: 566642 - DNA, 15 bp, Homo sapiens
ccgagcaaagatcaa

SEQ ID NO: 566643 - DNA, 17 bp, Homo sapiens
ccgagctctcctgggcc

SEQ ID NO: 566644 - DNA, 14 bp, Homo sapiens
ccgaggacccatga

SEQ ID NO: 566645 - DNA, 18 bp, Homo sapiens
ccgagtgtggagctgctt

SEQ ID NO: 566646 - DNA, 23 bp, Homo sapiens
ccgagtgtgtttcatccttccca

SEQ ID NO: 566647 - DNA, 13 bp, Homo sapiens
ccgatccacattg

SEQ ID NO: 566648 - DNA, 21 bp, Homo sapiens
ccgcaatgtgcccccagacgc

SEQ ID NO: 566649 - DNA, 16 bp, Homo sapiens
ccgcagtgtttgtgtg

SEQ ID NO: 566650 - DNA, 16 bp, Homo sapiens
ccgccctgggctctgg

SEQ ID NO: 566651 - DNA, 19 bp, Homo sapiens
ccggaatcctgtcctcagc

SEQ ID NO: 566652 - DNA, 22 bp, Homo sapiens
ccggaatcctgtcctcagcttc

SEQ ID NO: 566653 - DNA, 12 bp, Homo sapiens
ccggcagccccc

SEQ ID NO: 566654 - DNA, 14 bp, Homo sapiens
ccggcatgccgagt

SEQ ID NO: 566655 - DNA, 23 bp, Homo sapiens
ccgggagatccgccctgggctct

SEQ ID NO: 566656 - DNA, 20 bp, Homo sapiens
ccgggagcctgcgtggcctg

SEQ ID NO: 566657 - DNA, 13 bp, Homo sapiens
ccgggcagagcac

SEQ ID NO: 566658 - DNA, 20 bp, Homo sapiens
ccgggctggcttctccctgg

SEQ ID NO: 566659 - DNA, 12 bp, Homo sapiens
ccggggccatgg

SEQ ID NO: 566660 - DNA, 19 bp, Homo sapiens
ccggggccatggaagctgg

SEQ ID NO: 566661 - DNA, 23 bp, Homo sapiens
ccgggtgccccccatgccctccc

SEQ ID NO: 566662 - DNA, 17 bp, Homo sapiens
ccggtgggggggcagag

SEQ ID NO: 566663 - DNA, 21 bp, Homo sapiens
ccggtgggggggcagagccct

SEQ ID NO: 566664 - DNA, 19 bp, Homo sapiens
ccgtaccatcggtcagcag

SEQ ID NO: 566665 - DNA, 17 bp, Homo sapiens
ccgtcctggcagggcag

SEQ ID NO: 566666 - DNA, 22 bp, Homo sapiens
ccgtctacagctcccccagctc

SEQ ID NO: 566667 - DNA, 14 bp, Homo sapiens
ccgtgaaagttgtg

SEQ ID NO: 566668 - DNA, 12 bp, Homo sapiens
ccgtgagccctt

SEQ ID NO: 566669 - DNA, 18 bp, Homo sapiens
ccgtgcacggggccagca

SEQ ID NO: 566670 - DNA, 21 bp, Homo sapiens
ccgtgcttttaaggaaaggca

SEQ ID NO: 566671 - DNA, 14 bp, Homo sapiens
ccgtggctgcggca

SEQ ID NO: 566672 - DNA, 20 bp, Homo sapiens
ccgtgtggagggctgcagag

SEQ ID NO: 566673 - DNA, 18 bp, Homo sapiens
cctaaccagggccagaag

SEQ ID NO: 566674 - DNA, 17 bp, Homo sapiens
cctaagagatttatctt

SEQ ID NO: 566675 - DNA, 11 bp, Homo sapiens
cctaaggcatg

SEQ ID NO: 566676 - DNA, 17 bp, Homo sapiens
cctaatattgaaaatgt

SEQ ID NO: 566677 - DNA, 20 bp, Homo sapiens
cctaatattgaaaatgtcac

SEQ ID NO: 566678 - DNA, 17 bp, Homo sapiens
cctaattaatttcagta

SEQ ID NO: 566679 - DNA, 14 bp, Homo sapiens
cctaattagagcag

SEQ ID NO: 566680 - DNA, 14 bp, Homo sapiens
cctacagcagatcc

SEQ ID NO: 566681 - DNA, 16 bp, Homo sapiens
cctacagcagatccac

SEQ ID NO: 566682 - DNA, 23 bp, Homo sapiens
cctacagcagatccacctgcaca

SEQ ID NO: 566683 - DNA, 19 bp, Homo sapiens
cctactcttctctctgctc

SEQ ID NO: 566684 - DNA, 17 bp, Homo sapiens
cctactgttcctttcag

SEQ ID NO: 566685 - DNA, 13 bp, Homo sapiens
cctagcaattcca

SEQ ID NO: 566686 - DNA, 21 bp, Homo sapiens
cctagcactttgggaggctga

SEQ ID NO: 566687 - DNA, 20 bp, Homo sapiens
cctaggtagccccctcttcc

SEQ ID NO: 566688 - DNA, 18 bp, Homo sapiens
cctagtggcttcagcccc

SEQ ID NO: 566689 - DNA, 22 bp, Homo sapiens
cctagttctttgcattcgtcct

SEQ ID NO: 566690 - DNA, 14 bp, Homo sapiens
cctataatgtgtgt

SEQ ID NO: 566691 - DNA, 16 bp, Homo sapiens
cctataatgtgtgtat

SEQ ID NO: 566692 - DNA, 14 bp, Homo sapiens
cctatctcccacaa

SEQ ID NO: 566693 - DNA, 16 bp, Homo sapiens
cctatgaccataaaat

SEQ ID NO: 566694 - DNA, 15 bp, Homo sapiens
cctatgagagaagag

SEQ ID NO: 566695 - DNA, 21 bp, Homo sapiens
cctattctatccatctcctgg

SEQ ID NO: 566696 - DNA, 20 bp, Homo sapiens
cctattttggacgtgtgagg

SEQ ID NO: 566697 - DNA, 12 bp, Homo sapiens
cctcaagaaaaa

SEQ ID NO: 566698 - DNA, 12 bp, Homo sapiens
cctcaatttcaa

SEQ ID NO: 566699 - DNA, 15 bp, Homo sapiens
cctcacccctgcagg

SEQ ID NO: 566700 - DNA, 20 bp, Homo sapiens
cctcagcaaacccaaagatg

SEQ ID NO: 566701 - DNA, 23 bp, Homo sapiens
cctcaggaccctcgctggccccc

SEQ ID NO: 566702 - DNA, 19 bp, Homo sapiens
cctcattacggctcctctc

SEQ ID NO: 566703 - DNA, 21 bp, Homo sapiens
cctcattccctcgtctttccc

SEQ ID NO: 566704 - DNA, 17 bp, Homo sapiens
cctccacctgggagatg

SEQ ID NO: 566705 - DNA, 17 bp, Homo sapiens
cctccacgttcacccct

SEQ ID NO: 566706 - DNA, 18 bp, Homo sapiens
cctccacgttcacccctc

SEQ ID NO: 566707 - DNA, 19 bp, Homo sapiens
cctccagttctgatgaggc

SEQ ID NO: 566708 - DNA, 18 bp, Homo sapiens
cctccatcctcctccttc

SEQ ID NO: 566709 - DNA, 19 bp, Homo sapiens
cctccatgattccaagggc

SEQ ID NO: 566710 - DNA, 22 bp, Homo sapiens
cctccatgattccaagggccca

SEQ ID NO: 566711 - DNA, 15 bp, Homo sapiens
cctcccacatccccc

SEQ ID NO: 566712 - DNA, 23 bp, Homo sapiens
cctccccaaggccccctgcctgc

SEQ ID NO: 566713 - DNA, 12 bp, Homo sapiens
cctccccaggac

SEQ ID NO: 566714 - DNA, 13 bp, Homo sapiens
cctccccaggccg

SEQ ID NO: 566715 - DNA, 14 bp, Homo sapiens
cctccccctccttc

SEQ ID NO: 566716 - DNA, 15 bp, Homo sapiens
cctccccctccttcc

SEQ ID NO: 566717 - DNA, 16 bp, Homo sapiens
cctccccctccttccc

SEQ ID NO: 566718 - DNA, 18 bp, Homo sapiens
cctcccctggtcctgcac

SEQ ID NO: 566719 - DNA, 13 bp, Homo sapiens
cctccctcccaga

SEQ ID NO: 566720 - DNA, 15 bp, Homo sapiens
cctccctcccagatc

SEQ ID NO: 566721 - DNA, 14 bp, Homo sapiens
cctccctgatgtac

SEQ ID NO: 566722 - DNA, 13 bp, Homo sapiens
cctccctgctgcc

SEQ ID NO: 566723 - DNA, 14 bp, Homo sapiens
cctcccttcttgtg

SEQ ID NO: 566724 - DNA, 21 bp, Homo sapiens
cctccctttttaaacaaatgg

SEQ ID NO: 566725 - DNA, 15 bp, Homo sapiens
cctccgccatccacc

SEQ ID NO: 566726 - DNA, 14 bp, Homo sapiens
cctccgcccttccc

SEQ ID NO: 566727 - DNA, 14 bp, Homo sapiens
cctcctccttccta

SEQ ID NO: 566728 - DNA, 15 bp, Homo sapiens
cctcctccttcctag

SEQ ID NO: 566729 - DNA, 22 bp, Homo sapiens
cctcctgagttgaagtcatgct

SEQ ID NO: 566730 - DNA, 14 bp, Homo sapiens
cctcctgctgccag

SEQ ID NO: 566731 - DNA, 19 bp, Homo sapiens
cctcctgctgccagtacca

SEQ ID NO: 566732 - DNA, 14 bp, Homo sapiens
cctcctgtggcctg

SEQ ID NO: 566733 - DNA, 12 bp, Homo sapiens
cctccttcccac

SEQ ID NO: 566734 - DNA, 21 bp, Homo sapiens
cctccttcccagctgcccctc

SEQ ID NO: 566735 - DNA, 17 bp, Homo sapiens
cctcctttaccctcatc

SEQ ID NO: 566736 - DNA, 20 bp, Homo sapiens
cctccttttggttcctcaca

SEQ ID NO: 566737 - DNA, 16 bp, Homo sapiens
cctcgaactcctggca

SEQ ID NO: 566738 - DNA, 22 bp, Homo sapiens
cctcgcaggcctccctgccagt

SEQ ID NO: 566739 - DNA, 13 bp, Homo sapiens
cctcgctggcccc

SEQ ID NO: 566740 - DNA, 14 bp, Homo sapiens
cctcgctggccccc

SEQ ID NO: 566741 - DNA, 17 bp, Homo sapiens
cctcgctggcccccact

SEQ ID NO: 566742 - DNA, 15 bp, Homo sapiens
cctcggatcagctga

SEQ ID NO: 566743 - DNA, 13 bp, Homo sapiens
cctcggccagagc

SEQ ID NO: 566744 - DNA, 22 bp, Homo sapiens
cctcggggcaggaagtccctga

SEQ ID NO: 566745 - DNA, 22 bp, Homo sapiens
cctctaaaactagaaaaggaag

SEQ ID NO: 566746 - DNA, 13 bp, Homo sapiens
cctctctaacctc

SEQ ID NO: 566747 - DNA, 17 bp, Homo sapiens
cctctctaacctccttt

SEQ ID NO: 566748 - DNA, 19 bp, Homo sapiens
cctctctaacctcctttac

SEQ ID NO: 566749 - DNA, 19 bp, Homo sapiens
cctctgaactgctgctggt

SEQ ID NO: 566750 - DNA, 20 bp, Homo sapiens
cctctgaactgctgctggtc

SEQ ID NO: 566751 - DNA, 21 bp, Homo sapiens
cctctgatgtattttgtgagt

SEQ ID NO: 566752 - DNA, 19 bp, Homo sapiens
cctctgattctatgtaact

SEQ ID NO: 566753 - DNA, 22 bp, Homo sapiens
cctctgattctatgtaacttgt

SEQ ID NO: 566754 - DNA, 16 bp, Homo sapiens
cctctgcataaatatt

SEQ ID NO: 566755 - DNA, 22 bp, Homo sapiens
cctctgctaaattgatgttgat

SEQ ID NO: 566756 - DNA, 18 bp, Homo sapiens
cctctggaagggagggct

SEQ ID NO: 566757 - DNA, 14 bp, Homo sapiens
cctcttagaagaaa

SEQ ID NO: 566758 - DNA, 18 bp, Homo sapiens
cctcttagcttttctgca

SEQ ID NO: 566759 - DNA, 21 bp, Homo sapiens
cctcttgaatgcttaaatgat

SEQ ID NO: 566760 - DNA, 15 bp, Homo sapiens
cctgaaagcaacagc

SEQ ID NO: 566761 - DNA, 12 bp, Homo sapiens
ctaagaaacatt

SEQ ID NO: 566762 - DNA, 11 bp, Homo sapiens
ctaagagattt

SEQ ID NO: 566763 - DNA, 17 bp, Homo sapiens
ctaagagatttatcttt

SEQ ID NO: 566764 - DNA, 16 bp, Homo sapiens
ctaagagccacaataa

SEQ ID NO: 566765 - DNA, 17 bp, Homo sapiens
ctaagataattaaatga

SEQ ID NO: 566766 - DNA, 17 bp, Homo sapiens
ctaagatcggttaacaa

SEQ ID NO: 566767 - DNA, 20 bp, Homo sapiens
ctaagatgttatatttttct

SEQ ID NO: 566768 - DNA, 13 bp, Homo sapiens
ctaaggagaaatg

SEQ ID NO: 566769 - DNA, 23 bp, Homo sapiens
ctaagtagagtatattgaaaaga

SEQ ID NO: 566770 - DNA, 14 bp, Homo sapiens
ctaagtccagctct

SEQ ID NO: 566771 - DNA, 21 bp, Homo sapiens
ctaatattgaaaatgtcactg

SEQ ID NO: 566772 - DNA, 17 bp, Homo sapiens
ctaatcctatctgggga

SEQ ID NO: 566773 - DNA, 22 bp, Homo sapiens
ctaatgagtttcttttataaaa

SEQ ID NO: 566774 - DNA, 16 bp, Homo sapiens
ctaatgcctcttcatt

SEQ ID NO: 566775 - DNA, 13 bp, Homo sapiens
ctaatggtaactt

SEQ ID NO: 566776 - DNA, 14 bp, Homo sapiens
ctaatggtaacttt

SEQ ID NO: 566777 - DNA, 17 bp, Homo sapiens
ctaatggtaacttttgt

SEQ ID NO: 566778 - DNA, 20 bp, Homo sapiens
ctaatgtttaagcagaattg

SEQ ID NO: 566779 - DNA, 14 bp, Homo sapiens
ctaattaatttcag

SEQ ID NO: 566780 - DNA, 17 bp, Homo sapiens
ctaattaatttcagtaa

SEQ ID NO: 566781 - DNA, 20 bp, Homo sapiens
ctaattttgttttaaactgt

SEQ ID NO: 566782 - DNA, 21 bp, Homo sapiens
ctacaaggactccattggatc

SEQ ID NO: 566783 - DNA, 15 bp, Homo sapiens
ctacagcagatccac

SEQ ID NO: 566784 - DNA, 14 bp, Homo sapiens
ctacagctccccca

SEQ ID NO: 566785 - DNA, 15 bp, Homo sapiens
ctacagtagctgtgg

SEQ ID NO: 566786 - DNA, 17 bp, Homo sapiens
ctacatctgatatcagg

SEQ ID NO: 566787 - DNA, 19 bp, Homo sapiens
ctaccacggcctcctttcc

SEQ ID NO: 566788 - DNA, 16 bp, Homo sapiens
ctacccctttcttctc

SEQ ID NO: 566789 - DNA, 15 bp, Homo sapiens
ctacctcctctcctg

SEQ ID NO: 566790 - DNA, 20 bp, Homo sapiens
ctacctttggcttaattcca

SEQ ID NO: 566791 - DNA, 23 bp, Homo sapiens
ctacgagtaattgcatttgcttt

SEQ ID NO: 566792 - DNA, 15 bp, Homo sapiens
ctactaaaaatacaa

SEQ ID NO: 566793 - DNA, 23 bp, Homo sapiens
ctactccggaggctgaggcagga

SEQ ID NO: 566794 - DNA, 17 bp, Homo sapiens
ctactcttctctctgct

SEQ ID NO: 566795 - DNA, 11 bp, Homo sapiens
ctactgaataa

SEQ ID NO: 566796 - DNA, 12 bp, Homo sapiens
ctactgaataaa

SEQ ID NO: 566797 - DNA, 14 bp, Homo sapiens
ctactgttcctttc

SEQ ID NO: 566798 - DNA, 13 bp, Homo sapiens
ctacttaagagaa

SEQ ID NO: 566799 - DNA, 15 bp, Homo sapiens
ctacttatattctgc

SEQ ID NO: 566800 - DNA, 14 bp, Homo sapiens
ctacttcctgcctg

SEQ ID NO: 566801 - DNA, 12 bp, Homo sapiens
ctactttaaatt

SEQ ID NO: 566802 - DNA, 15 bp, Homo sapiens
ctactttaaattgtg

SEQ ID NO: 566803 - DNA, 18 bp, Homo sapiens
ctactttaaattgtggat

SEQ ID NO: 566804 - DNA, 14 bp, Homo sapiens
ctagaaagagaaaa

SEQ ID NO: 566805 - DNA, 23 bp, Homo sapiens
ctagaaagagaaaaagccctctt

SEQ ID NO: 566806 - DNA, 12 bp, Homo sapiens
ctagacacacaa

SEQ ID NO: 566807 - DNA, 23 bp, Homo sapiens
ctagagcagttggccaagcagaa

SEQ ID NO: 566808 - DNA, 14 bp, Homo sapiens
ctagcacttccttg

SEQ ID NO: 566809 - DNA, 20 bp, Homo sapiens
ctagcactttgggaggctga

SEQ ID NO: 566810 - DNA, 17 bp, Homo sapiens
ctagccatatattttct

SEQ ID NO: 566811 - DNA, 19 bp, Homo sapiens
ctaggaaaagaaatctata

SEQ ID NO: 566812 - DNA, 16 bp, Homo sapiens
ctaggaacaaatcttc

SEQ ID NO: 566813 - DNA, 22 bp, Homo sapiens
ctaggaaggcacttctgcctga

SEQ ID NO: 566814 - DNA, 19 bp, Homo sapiens
ctaggcagggtgtctgccc

SEQ ID NO: 566815 - DNA, 15 bp, Homo sapiens
ctaggttcaattccc

SEQ ID NO: 566816 - DNA, 21 bp, Homo sapiens
ctagtaggggtaccactgaat

SEQ ID NO: 566817 - DNA, 19 bp, Homo sapiens
ctagtgatgtttttatgat

SEQ ID NO: 566818 - DNA, 13 bp, Homo sapiens
ctagttatttatt

SEQ ID NO: 566819 - DNA, 19 bp, Homo sapiens
ctagttatttattctggga

SEQ ID NO: 566820 - DNA, 18 bp, Homo sapiens
ctagttcatcccttctct

SEQ ID NO: 566821 - DNA, 19 bp, Homo sapiens
ctagttcatcccttctctt

SEQ ID NO: 566822 - DNA, 12 bp, Homo sapiens
ctagttgcattt

SEQ ID NO: 566823 - DNA, 16 bp, Homo sapiens
ctataatgtgtgtatg

SEQ ID NO: 566824 - DNA, 19 bp, Homo sapiens
ctatagaaagtgttctgtt

SEQ ID NO: 566825 - DNA, 20 bp, Homo sapiens
ctatagaaagtgttctgtta

SEQ ID NO: 566826 - DNA, 18 bp, Homo sapiens
ctatagattgatttacct

SEQ ID NO: 566827 - DNA, 20 bp, Homo sapiens
ctatagattgatttaccttt

SEQ ID NO: 566828 - DNA, 11 bp, Homo sapiens
ctatatacatg

SEQ ID NO: 566829 - DNA, 16 bp, Homo sapiens
ctatatacatgtgtgt

SEQ ID NO: 566830 - DNA, 19 bp, Homo sapiens
ctatatacatgtgtgtata

SEQ ID NO: 566831 - DNA, 17 bp, Homo sapiens
ctatatgtttacacaat

SEQ ID NO: 566832 - DNA, 14 bp, Homo sapiens
ctatatttaagtat

SEQ ID NO: 566833 - DNA, 16 bp, Homo sapiens
ctatatttaagtattc

SEQ ID NO: 566834 - DNA, 18 bp, Homo sapiens
ctatcagagtatccactg

SEQ ID NO: 566835 - DNA, 19 bp, Homo sapiens
ctatcagttatcctttgtg

SEQ ID NO: 566836 - DNA, 17 bp, Homo sapiens
ctatcctgggcttttgt

SEQ ID NO: 566837 - DNA, 21 bp, Homo sapiens
ctatctaatcagatcttcttt

SEQ ID NO: 566838 - DNA, 13 bp, Homo sapiens
ctatctcccacaa

SEQ ID NO: 566839 - DNA, 14 bp, Homo sapiens
ctatctggaaaaaa

SEQ ID NO: 566840 - DNA, 18 bp, Homo sapiens
ctatgacactcatcaggt

SEQ ID NO: 566841 - DNA, 19 bp, Homo sapiens
ctatgatgtccaaacttaa

SEQ ID NO: 566842 - DNA, 17 bp, Homo sapiens
ctatgccccaaatatag

SEQ ID NO: 566843 - DNA, 20 bp, Homo sapiens
ctatgctcataactgtgtca

SEQ ID NO: 566844 - DNA, 15 bp, Homo sapiens
ctatgctggacatta

SEQ ID NO: 566845 - DNA, 22 bp, Homo sapiens
ctatggtgtaatcatgaaggag

SEQ ID NO: 566846 - DNA, 14 bp, Homo sapiens
ctatgtaacttgtt

SEQ ID NO: 566847 - DNA, 13 bp, Homo sapiens
ctatgtcatttca

SEQ ID NO: 566848 - DNA, 14 bp, Homo sapiens
ctatgtcatttcat

SEQ ID NO: 566849 - DNA, 14 bp, Homo sapiens
ctatgtgtgtgctt

SEQ ID NO: 566850 - DNA, 21 bp, Homo sapiens
ctattagcttactgattaact

SEQ ID NO: 566851 - DNA, 11 bp, Homo sapiens
ctatttaagtg

SEQ ID NO: 566852 - DNA, 22 bp, Homo sapiens
ctatttaagtggactgtatttc

SEQ ID NO: 566853 - DNA, 20 bp, Homo sapiens
ctatttgtgtaactgaaagg

SEQ ID NO: 566854 - DNA, 18 bp, Homo sapiens
ctattttactgtcttaat

SEQ ID NO: 566855 - DNA, 17 bp, Homo sapiens
ctcaaaggagctttctc

SEQ ID NO: 566856 - DNA, 12 bp, Homo sapiens
ctcaacaataaa

SEQ ID NO: 566857 - DNA, 14 bp, Homo sapiens
ctcaaccaaatggt

SEQ ID NO: 566858 - DNA, 15 bp, Homo sapiens
ctcaagcccaggagg

SEQ ID NO: 566859 - DNA, 14 bp, Homo sapiens
ctcaaggcctccag

SEQ ID NO: 566860 - DNA, 12 bp, Homo sapiens
ctcaaggctgca

SEQ ID NO: 566861 - DNA, 14 bp, Homo sapiens
ctcaatgtcttccc

SEQ ID NO: 566862 - DNA, 20 bp, Homo sapiens
ctcacgttacagggaaggag

SEQ ID NO: 566863 - DNA, 21 bp, Homo sapiens
ctcactcagaagtccagagtc

SEQ ID NO: 566864 - DNA, 22 bp, Homo sapiens
ctcactgatatattttccaggg

SEQ ID NO: 566865 - DNA, 13 bp, Homo sapiens
ctcactgcctccc

SEQ ID NO: 566866 - DNA, 16 bp, Homo sapiens
ctcagacacctagact

SEQ ID NO: 566867 - DNA, 14 bp, Homo sapiens
ctcagagtgaagag

SEQ ID NO: 566868 - DNA, 18 bp, Homo sapiens
ctcagagtgaagagtgaa

SEQ ID NO: 566869 - DNA, 21 bp, Homo sapiens
ctcagagtgaagagtgaagag

SEQ ID NO: 566870 - DNA, 23 bp, Homo sapiens
ctcagagtgaagagtgaagagca

SEQ ID NO: 566871 - DNA, 20 bp, Homo sapiens
ctcagcaaacccaaagatgt

SEQ ID NO: 566872 - DNA, 14 bp, Homo sapiens
ctcagcatatatat

SEQ ID NO: 566873 - DNA, 17 bp, Homo sapiens
ctcaggaagaagagatg

SEQ ID NO: 566874 - DNA, 14 bp, Homo sapiens
ctcaggaccctcgc

SEQ ID NO: 566875 - DNA, 19 bp, Homo sapiens
ctcaggaccctcgctggcc

SEQ ID NO: 566876 - DNA, 10 bp, Homo sapiens
ctcaggccca

SEQ ID NO: 566877 - DNA, 15 bp, Homo sapiens
ctcaggcccacattg

SEQ ID NO: 566878 - DNA, 14 bp, Homo sapiens
ctcagtttttctta

SEQ ID NO: 566879 - DNA, 17 bp, Homo sapiens
ctcataagtaaatgtct

SEQ ID NO: 566880 - DNA, 14 bp, Homo sapiens
ctcatcaacaaaga

SEQ ID NO: 566881 - DNA, 15 bp, Homo sapiens
ctcatcaacaaagaa

SEQ ID NO: 566882 - DNA, 16 bp, Homo sapiens
ctcatccccagtccca

SEQ ID NO: 566883 - DNA, 16 bp, Homo sapiens
ctcatcccgacctctt

SEQ ID NO: 566884 - DNA, 15 bp, Homo sapiens
ctcatcgggagtgaa

SEQ ID NO: 566885 - DNA, 21 bp, Homo sapiens
ctcatcttgacagagcctgcc

SEQ ID NO: 566886 - DNA, 18 bp, Homo sapiens
ctcatgctgcccctgcct

SEQ ID NO: 566887 - DNA, 19 bp, Homo sapiens
ctcatgctgcccctgcctt

SEQ ID NO: 566888 - DNA, 22 bp, Homo sapiens
ctcatgggagtcagggagccct

SEQ ID NO: 566889 - DNA, 14 bp, Homo sapiens
ctcatgtgatttac

SEQ ID NO: 566890 - DNA, 23 bp, Homo sapiens
ctcattaggcatggttttgggct

SEQ ID NO: 566891 - DNA, 22 bp, Homo sapiens
ctcattgttcagaaaagcacct

SEQ ID NO: 566892 - DNA, 23 bp, Homo sapiens
ctcatttttttttttgtttctga

SEQ ID NO: 566893 - DNA, 13 bp, Homo sapiens
ctccacctgggag

SEQ ID NO: 566894 - DNA, 13 bp, Homo sapiens
ctccacgggggcc

SEQ ID NO: 566895 - DNA, 18 bp, Homo sapiens
ctccacgggggcctagtg

SEQ ID NO: 566896 - DNA, 20 bp, Homo sapiens
ctccacgttcacccctccac

SEQ ID NO: 566897 - DNA, 16 bp, Homo sapiens
ctccacttcatccaga

SEQ ID NO: 566898 - DNA, 20 bp, Homo sapiens
ctccagaaatgtccctttct

SEQ ID NO: 566899 - DNA, 17 bp, Homo sapiens
ctccagaactcttcctc

SEQ ID NO: 566900 - DNA, 13 bp, Homo sapiens
ctccagaagcagc

SEQ ID NO: 566901 - DNA, 15 bp, Homo sapiens
ctccagaagcagcag

SEQ ID NO: 566902 - DNA, 18 bp, Homo sapiens
ctccagccacttatttcc

SEQ ID NO: 566903 - DNA, 23 bp, Homo sapiens
ctccagcctggaaacctgtctga

SEQ ID NO: 566904 - DNA, 22 bp, Homo sapiens
ctccagctctggcatggctagg

SEQ ID NO: 566905 - DNA, 16 bp, Homo sapiens
ctccaggcaccatctc

SEQ ID NO: 566906 - DNA, 22 bp, Homo sapiens
ctccaggctccctccctcccag

SEQ ID NO: 566907 - DNA, 16 bp, Homo sapiens
ctccagtcttccacct

SEQ ID NO: 566908 - DNA, 19 bp, Homo sapiens
ctccatcctcctccttcct

SEQ ID NO: 566909 - DNA, 17 bp, Homo sapiens
ctccatccttctcccca

SEQ ID NO: 566910 - DNA, 22 bp, Homo sapiens
ctccatgattccaagggcccag

SEQ ID NO: 566911 - DNA, 21 bp, Homo sapiens
ctccattttggtgtctttctc

SEQ ID NO: 566912 - DNA, 23 bp, Homo sapiens
ctcccaggacgcagggagaccct

SEQ ID NO: 566913 - DNA, 16 bp, Homo sapiens
ctcccagggtcctggg

SEQ ID NO: 566914 - DNA, 14 bp, Homo sapiens
ttgctgcagattcc

SEQ ID NO: 566915 - DNA, 15 bp, Homo sapiens
ttgctgtaaataaaa

SEQ ID NO: 566916 - DNA, 23 bp, Homo sapiens
ttgctgtaaataaaaatagctat

SEQ ID NO: 566917 - DNA, 20 bp, Homo sapiens
ttgcttaaatgtgaattact

SEQ ID NO: 566918 - DNA, 24 bp, Homo sapiens
ttgcttaaatgtgaattactaact

SEQ ID NO: 566919 - DNA, 17 bp, Homo sapiens
ttgcttttaaaactact

SEQ ID NO: 566920 - DNA, 21 bp, Homo sapiens
ttgcttttaaaactacttagc

SEQ ID NO: 566921 - DNA, 13 bp, Homo sapiens
ttgcttttaaaat

SEQ ID NO: 566922 - DNA, 14 bp, Homo sapiens
ttggaaacactaaa

SEQ ID NO: 566923 - DNA, 18 bp, Homo sapiens
ttggaaacactaaatgtt

SEQ ID NO: 566924 - DNA, 20 bp, Homo sapiens
ttggaaacactaaatgttaa

SEQ ID NO: 566925 - DNA, 14 bp, Homo sapiens
ttggaacagtgttt

SEQ ID NO: 566926 - DNA, 13 bp, Homo sapiens
ttggaactgcacc

SEQ ID NO: 566927 - DNA, 20 bp, Homo sapiens
ttggaagcaggttaaatgtt

SEQ ID NO: 566928 - DNA, 21 bp, Homo sapiens
ttggaagcaggttaaatgttt

SEQ ID NO: 566929 - DNA, 14 bp, Homo sapiens
ttggaaggtgacac

SEQ ID NO: 566930 - DNA, 14 bp, Homo sapiens
ttggaatttgctta

SEQ ID NO: 566931 - DNA, 14 bp, Homo sapiens
ttggaccattttcc

SEQ ID NO: 566932 - DNA, 19 bp, Homo sapiens
ttggactgtggcctcagga

SEQ ID NO: 566933 - DNA, 19 bp, Homo sapiens
ttggagttcattcatatta

SEQ ID NO: 566934 - DNA, 22 bp, Homo sapiens
ttggagttcattcatattacaa

SEQ ID NO: 566935 - DNA, 20 bp, Homo sapiens
ttggattttatgttgacatt

SEQ ID NO: 566936 - DNA, 22 bp, Homo sapiens
ttggcagatgcagctcttcctg

SEQ ID NO: 566937 - DNA, 19 bp, Homo sapiens
ttggcaggtaggaatatta

SEQ ID NO: 566938 - DNA, 14 bp, Homo sapiens
ttggccactgtatt

SEQ ID NO: 566939 - DNA, 16 bp, Homo sapiens
ttggccactgtatttg

SEQ ID NO: 566940 - DNA, 22 bp, Homo sapiens
ttggctcctgcccactgatagc

SEQ ID NO: 566941 - DNA, 23 bp, Homo sapiens
ttgggaacataaaaactactgaa

SEQ ID NO: 566942 - DNA, 13 bp, Homo sapiens
ttgggatgggcac

SEQ ID NO: 566943 - DNA, 19 bp, Homo sapiens
ttgggtaagggactccaga

SEQ ID NO: 566944 - DNA, 21 bp, Homo sapiens
ttgggtgaatatggtggaaaa

SEQ ID NO: 566945 - DNA, 21 bp, Homo sapiens
ttggtaccctggacagtgcct

SEQ ID NO: 566946 - DNA, 14 bp, Homo sapiens
ttggtaccttgcac

SEQ ID NO: 566947 - DNA, 16 bp, Homo sapiens
ttggtaccttgcacac

SEQ ID NO: 566948 - DNA, 12 bp, Homo sapiens
ttggtattttat

SEQ ID NO: 566949 - DNA, 16 bp, Homo sapiens
ttggtattttataagc

SEQ ID NO: 566950 - DNA, 20 bp, Homo sapiens
ttggtcacaaagctatttaa

SEQ ID NO: 566951 - DNA, 22 bp, Homo sapiens
ttggtcacaaagctatttaagt

SEQ ID NO: 566952 - DNA, 14 bp, Homo sapiens
ttggtccacttttc

SEQ ID NO: 566953 - DNA, 17 bp, Homo sapiens
ttggtcttactttgtta

SEQ ID NO: 566954 - DNA, 22 bp, Homo sapiens
ttggtcttactttgttaattta

SEQ ID NO: 566955 - DNA, 14 bp, Homo sapiens
ttggtttaaacttt

SEQ ID NO: 566956 - DNA, 13 bp, Homo sapiens
ttggttttaaaat

SEQ ID NO: 566957 - DNA, 16 bp, Homo sapiens
ttggttttaaaatact

SEQ ID NO: 566958 - DNA, 19 bp, Homo sapiens
ttggtttttatttctcctt

SEQ ID NO: 566959 - DNA, 13 bp, Homo sapiens
ttgtaaaacagtg

SEQ ID NO: 566960 - DNA, 15 bp, Homo sapiens
ttgtaaacgtctttt

SEQ ID NO: 566961 - DNA, 16 bp, Homo sapiens
tgccattcatagagag

SEQ ID NO: 566962 - DNA, 17 bp, Homo sapiens
tgccattttttgtctgt

SEQ ID NO: 566963 - DNA, 14 bp, Homo sapiens
tgcccactcctgct

SEQ ID NO: 566964 - DNA, 19 bp, Homo sapiens
tgcccagcccctggtggtg

SEQ ID NO: 566965 - DNA, 19 bp, Homo sapiens
tgcccagcttttcattgct

SEQ ID NO: 566966 - DNA, 17 bp, Homo sapiens
tgcccatgctgggctcc

SEQ ID NO: 566967 - DNA, 23 bp, Homo sapiens
tgccccaaatggattcctgtttc

SEQ ID NO: 566968 - DNA, 19 bp, Homo sapiens
tgccccccatgccctccct

SEQ ID NO: 566969 - DNA, 13 bp, Homo sapiens
tgcccctgcacct

SEQ ID NO: 566970 - DNA, 18 bp, Homo sapiens
tgccccttccccatgctc

SEQ ID NO: 566971 - DNA, 19 bp, Homo sapiens
tgccccttccccatgctca

SEQ ID NO: 566972 - DNA, 17 bp, Homo sapiens
tgcccggcccaggagcg

SEQ ID NO: 566973 - DNA, 23 bp, Homo sapiens
tgcccgtggtgaggttgtgctgc

SEQ ID NO: 566974 - DNA, 22 bp, Homo sapiens
tgccctcactgcctctttgcag

SEQ ID NO: 566975 - DNA, 14 bp, Homo sapiens
tgccctccctgctg

SEQ ID NO: 566976 - DNA, 16 bp, Homo sapiens
tgccctccctgctgcc

SEQ ID NO: 566977 - DNA, 18 bp, Homo sapiens
tgccctccgtcctggcag

SEQ ID NO: 566978 - DNA, 19 bp, Homo sapiens
tgccctttgtcctcctgct

SEQ ID NO: 566979 - DNA, 17 bp, Homo sapiens
tgcctaactccttacag

SEQ ID NO: 566980 - DNA, 20 bp, Homo sapiens
tgcctctgaactgctgctgg

SEQ ID NO: 566981 - DNA, 19 bp, Homo sapiens
tgcctctgatgtattttgt

SEQ ID NO: 566982 - DNA, 20 bp, Homo sapiens
tgcctctgattctatgtaac

SEQ ID NO: 566983 - DNA, 14 bp, Homo sapiens
tgcctcttcattct

SEQ ID NO: 566984 - DNA, 10 bp, Homo sapiens
tgcctgccct

SEQ ID NO: 566985 - DNA, 20 bp, Homo sapiens
tgcctgccctgtcaggaggc

SEQ ID NO: 566986 - DNA, 13 bp, Homo sapiens
tgcctgccctttg

SEQ ID NO: 566987 - DNA, 21 bp, Homo sapiens
tgcctgccctttgtcctcctg

SEQ ID NO: 566988 - DNA, 21 bp, Homo sapiens
tgcctggggtgtaatgagctc

SEQ ID NO: 566989 - DNA, 14 bp, Homo sapiens
tgcctgtggtgagg

SEQ ID NO: 566990 - DNA, 20 bp, Homo sapiens
tgcctgtggtgaggtcctgt

SEQ ID NO: 566991 - DNA, 24 bp, Homo sapiens
tgccttcatggaactcagctgtct

SEQ ID NO: 566992 - DNA, 21 bp, Homo sapiens
tgccttccaggcgtagggcca

SEQ ID NO: 566993 - DNA, 14 bp, Homo sapiens
tgccttgagaatga

SEQ ID NO: 566994 - DNA, 20 bp, Homo sapiens
tgcctttccagtgctgctcc

SEQ ID NO: 566995 - DNA, 21 bp, Homo sapiens
tgcgaacacagtgacacgttt

SEQ ID NO: 566996 - DNA, 21 bp, Homo sapiens
tgcgcaaatacaaaatgattg

SEQ ID NO: 566997 - DNA, 21 bp, Homo sapiens
tgcgcactgagtacaaatgtg

SEQ ID NO: 566998 - DNA, 15 bp, Homo sapiens
tgcggccggcctggg

SEQ ID NO: 566999 - DNA, 18 bp, Homo sapiens
tgcggccggcctggggcc

SEQ ID NO: 567000 - DNA, 16 bp, Homo sapiens
tgcgggctgggcagct

SEQ ID NO: 567001 - DNA, 17 bp, Homo sapiens
tgcgggctgggcagctg

SEQ ID NO: 567002 - DNA, 13 bp, Homo sapiens
tgcggtgtgtctc

SEQ ID NO: 567003 - DNA, 20 bp, Homo sapiens
tgcgtggaatgcccttcact

SEQ ID NO: 567004 - DNA, 15 bp, Homo sapiens
tgctaaacgtgtatg

SEQ ID NO: 567005 - DNA, 19 bp, Homo sapiens
tgctaaacgtgtatgtttt

SEQ ID NO: 567006 - DNA, 22 bp, Homo sapiens
tgctaaacgtgtatgtttttca

SEQ ID NO: 567007 - DNA, 16 bp, Homo sapiens
tgctaaattgatgttg

SEQ ID NO: 567008 - DNA, 18 bp, Homo sapiens
tgctaaattgatgttgat

SEQ ID NO: 567009 - DNA, 21 bp, Homo sapiens
tgctaaattgatgttgatgca

SEQ ID NO: 567010 - DNA, 14 bp, Homo sapiens
tgctaaccttttca

SEQ ID NO: 567011 - DNA, 19 bp, Homo sapiens
tgctaagaattttttattt

SEQ ID NO: 567012 - DNA, 20 bp, Homo sapiens
tgctaagaattttttatttt

SEQ ID NO: 567013 - DNA, 18 bp, Homo sapiens
tgctaagagcctctggaa

SEQ ID NO: 567014 - DNA, 15 bp, Homo sapiens
tgctaagtctttccc

SEQ ID NO: 567015 - DNA, 18 bp, Homo sapiens
tgctacagtagctgtggg

SEQ ID NO: 567016 - DNA, 18 bp, Homo sapiens
tgctaccacggcctcctt

SEQ ID NO: 567017 - DNA, 17 bp, Homo sapiens
tgctatatatataaata

SEQ ID NO: 567018 - DNA, 12 bp, Homo sapiens
tgctatggggac

SEQ ID NO: 567019 - DNA, 15 bp, Homo sapiens
tgctatttgtgtaac

SEQ ID NO: 567020 - DNA, 18 bp, Homo sapiens
tgctatttgtgtaactga

SEQ ID NO: 567021 - DNA, 12 bp, Homo sapiens
tgctattttact

SEQ ID NO: 567022 - DNA, 14 bp, Homo sapiens
tgctcacacaatca

SEQ ID NO: 567023 - DNA, 18 bp, Homo sapiens
tgctcagagtgaagagtg

SEQ ID NO: 567024 - DNA, 22 bp, Homo sapiens
tgctcagagtgaagagtgaaga

SEQ ID NO: 567025 - DNA, 20 bp, Homo sapiens
tgctcagcagtgagagcaga

SEQ ID NO: 567026 - DNA, 17 bp, Homo sapiens
tgctcataagtaaatgt

SEQ ID NO: 567027 - DNA, 15 bp, Homo sapiens
tgctcattgtggcca

SEQ ID NO: 567028 - DNA, 13 bp, Homo sapiens
tgctccaaatgtc

SEQ ID NO: 567029 - DNA, 14 bp, Homo sapiens
tgctccaaatgtct

SEQ ID NO: 567030 - DNA, 19 bp, Homo sapiens
tgctccagctctggcatgg

SEQ ID NO: 567031 - DNA, 16 bp, Homo sapiens
tgctcctcggccagag

SEQ ID NO: 567032 - DNA, 19 bp, Homo sapiens
tgctcctcggccagagctc

SEQ ID NO: 567033 - DNA, 23 bp, Homo sapiens
tgctcctcggccagagctcccag

SEQ ID NO: 567034 - DNA, 16 bp, Homo sapiens
tgctccttcccttgct

SEQ ID NO: 567035 - DNA, 24 bp, Homo sapiens
tgctcgccttcggcctctcttgga

SEQ ID NO: 567036 - DNA, 16 bp, Homo sapiens
tgctctctcattccca

SEQ ID NO: 567037 - DNA, 20 bp, Homo sapiens
tgctctctcattcccaggca

SEQ ID NO: 567038 - DNA, 17 bp, Homo sapiens
tgctcttgggcaatatt

SEQ ID NO: 567039 - DNA, 21 bp, Homo sapiens
tgctcttgggcaatattctct

SEQ ID NO: 567040 - DNA, 20 bp, Homo sapiens
tgctctttcccacccagcct

SEQ ID NO: 567041 - DNA, 20 bp, Homo sapiens
tgctgagtccgacctggcct

SEQ ID NO: 567042 - DNA, 23 bp, Homo sapiens
tgctgatgacccccccagcttca

SEQ ID NO: 567043 - DNA, 16 bp, Homo sapiens
tgctgcccccagaccc

SEQ ID NO: 567044 - DNA, 15 bp, Homo sapiens
tgctgcccctgcctt

SEQ ID NO: 567045 - DNA, 13 bp, Homo sapiens
tgctggctctgct

SEQ ID NO: 567046 - DNA, 15 bp, Homo sapiens
tgctgggaccctcgg

SEQ ID NO: 567047 - DNA, 16 bp, Homo sapiens
tgctgtaaataaaaat

SEQ ID NO: 567048 - DNA, 18 bp, Homo sapiens
tgctgtaaataaaaatag

SEQ ID NO: 567049 - DNA, 14 bp, Homo sapiens
tgctgtcattgctt

SEQ ID NO: 567050 - DNA, 21 bp, Homo sapiens
tgctgtcattgcttcttctga

SEQ ID NO: 567051 - DNA, 24 bp, Homo sapiens
tgctgtcattgcttcttctgaggc

SEQ ID NO: 567052 - DNA, 15 bp, Homo sapiens
tgctgtgaaatgact

SEQ ID NO: 567053 - DNA, 16 bp, Homo sapiens
tgctgtgaaatgactg

SEQ ID NO: 567054 - DNA, 13 bp, Homo sapiens
tgctgtggcatca

SEQ ID NO: 567055 - DNA, 13 bp, Homo sapiens
tgctgtgtttgct

SEQ ID NO: 567056 - DNA, 16 bp, Homo sapiens
tgcttagcttatcttt

SEQ ID NO: 567057 - DNA, 20 bp, Homo sapiens
tgcttagtgtcccttacctg

SEQ ID NO: 567058 - DNA, 16 bp, Homo sapiens
tgcttatgtcatttct

SEQ ID NO: 567059 - DNA, 13 bp, Homo sapiens
tgcttccagaaac

SEQ ID NO: 567060 - DNA, 22 bp, Homo sapiens
tgcttcctgtcttatcctccac

SEQ ID NO: 567061 - DNA, 15 bp, Homo sapiens
tgcttctactccatg

SEQ ID NO: 567062 - DNA, 17 bp, Homo sapiens
tgctttaaagtgtaata

SEQ ID NO: 567063 - DNA, 18 bp, Homo sapiens
tgctttaggattgaagtg

SEQ ID NO: 567064 - DNA, 18 bp, Homo sapiens
tgctttatttttcattac

SEQ ID NO: 567065 - DNA, 14 bp, Homo sapiens
tgctttgcattact

SEQ ID NO: 567066 - DNA, 16 bp, Homo sapiens
tgctttgtctcctcta

SEQ ID NO: 567067 - DNA, 10 bp, Homo sapiens
tgcttttaaa

SEQ ID NO: 567068 - DNA, 17 bp, Homo sapiens
tgcttttaaaactactt

SEQ ID NO: 567069 - DNA, 13 bp, Homo sapiens
tgcttttaaaatt

SEQ ID NO: 567070 - DNA, 17 bp, Homo sapiens
tgcttttaaaattttaa

SEQ ID NO: 567071 - DNA, 17 bp, Homo sapiens
tggaaaataaaaggtct

SEQ ID NO: 567072 - DNA, 18 bp, Homo sapiens
tggaaacactaaatgtta

SEQ ID NO: 567073 - DNA, 20 bp, Homo sapiens
tggaaacactaaatgttaaa

SEQ ID NO: 567074 - DNA, 23 bp, Homo sapiens
tggaaacactaaatgttaaagat

SEQ ID NO: 567075 - DNA, 19 bp, Homo sapiens
tggaaacctgtctgaggtt

SEQ ID NO: 567076 - DNA, 12 bp, Homo sapiens
tggaaatttcac

SEQ ID NO: 567077 - DNA, 14 bp, Homo sapiens
tggaacagtgttta

SEQ ID NO: 567078 - DNA, 21 bp, Homo sapiens
tggaacagtgtttactttaaa

SEQ ID NO: 567079 - DNA, 15 bp, Homo sapiens
tggaagacaaataca

SEQ ID NO: 567080 - DNA, 18 bp, Homo sapiens
tggaagacaaatacacat

SEQ ID NO: 567081 - DNA, 13 bp, Homo sapiens
tggaagagaaatc

SEQ ID NO: 567082 - DNA, 18 bp, Homo sapiens
tggaagagctaggcaggg

SEQ ID NO: 567083 - DNA, 18 bp, Homo sapiens
tggaagcaggttaaatgt

SEQ ID NO: 567084 - DNA, 20 bp, Homo sapiens
tggaatcattgtccagagct

SEQ ID NO: 567085 - DNA, 14 bp, Homo sapiens
tggaattgccacat

SEQ ID NO: 567086 - DNA, 22 bp, Homo sapiens
tggaattgccacataattcatt

SEQ ID NO: 567087 - DNA, 13 bp, Homo sapiens
tggaattggttta

SEQ ID NO: 567088 - DNA, 19 bp, Homo sapiens
tggaattggtttaaacttt

SEQ ID NO: 567089 - DNA, 20 bp, Homo sapiens
tggaattgtgctccaaatgt

SEQ ID NO: 567090 - DNA, 22 bp, Homo sapiens
tggaattgtgctccaaatgtct

SEQ ID NO: 567091 - DNA, 23 bp, Homo sapiens
tggaattgtgctccaaatgtcta

SEQ ID NO: 567092 - DNA, 14 bp, Homo sapiens
tggacatgcacccg

SEQ ID NO: 567093 - DNA, 14 bp, Homo sapiens
tggaccagttccct

SEQ ID NO: 567094 - DNA, 24 bp, Homo sapiens
tggaccagttccctcagccctcat

SEQ ID NO: 567095 - DNA, 14 bp, Homo sapiens
tggaccattttcct

SEQ ID NO: 567096 - DNA, 15 bp, Homo sapiens
tggaccctgaaatgt

SEQ ID NO: 567097 - DNA, 18 bp, Homo sapiens
tggaccctgaaatgtgtg

SEQ ID NO: 567098 - DNA, 15 bp, Homo sapiens
tgtcccttacctggc

SEQ ID NO: 567099 - DNA, 15 bp, Homo sapiens
tgtccctttcttctc

SEQ ID NO: 567100 - DNA, 16 bp, Homo sapiens
tgtccctttcttctcc

SEQ ID NO: 567101 - DNA, 19 bp, Homo sapiens
tgtccgtgaaagttgtgat

SEQ ID NO: 567102 - DNA, 22 bp, Homo sapiens
tgtcctatgtgtgactctaaat

SEQ ID NO: 567103 - DNA, 14 bp, Homo sapiens
tgtcctcagcttct

SEQ ID NO: 567104 - DNA, 17 bp, Homo sapiens
tgtcctcctgctgccag

SEQ ID NO: 567105 - DNA, 16 bp, Homo sapiens
tgtcctgtgtcagttt

SEQ ID NO: 567106 - DNA, 17 bp, Homo sapiens
tgtcctgtgtcagttta

SEQ ID NO: 567107 - DNA, 18 bp, Homo sapiens
tgtcctgtgtcagtttat

SEQ ID NO: 567108 - DNA, 19 bp, Homo sapiens
tgtcctgtgtcagtttatg

SEQ ID NO: 567109 - DNA, 13 bp, Homo sapiens
tgtcctttatgta

SEQ ID NO: 567110 - DNA, 17 bp, Homo sapiens
tgtcctttatgtattct

SEQ ID NO: 567111 - DNA, 18 bp, Homo sapiens
tgtcgatgagactgttta

SEQ ID NO: 567112 - DNA, 17 bp, Homo sapiens
tgtcggctccagtcccc

SEQ ID NO: 567113 - DNA, 14 bp, Homo sapiens
tgtcgtccccagac

SEQ ID NO: 567114 - DNA, 15 bp, Homo sapiens
tgtcgtccccagacc

SEQ ID NO: 567115 - DNA, 12 bp, Homo sapiens
tgtctaaagatc

SEQ ID NO: 567116 - DNA, 18 bp, Homo sapiens
tgtctcaaaggagctttc

SEQ ID NO: 567117 - DNA, 19 bp, Homo sapiens
tgtctcaaaggagctttct

SEQ ID NO: 567118 - DNA, 12 bp, Homo sapiens
tgtctcagattg

SEQ ID NO: 567119 - DNA, 19 bp, Homo sapiens
tgtctcggaacctgtgagc

SEQ ID NO: 567120 - DNA, 13 bp, Homo sapiens
tgtctcttctcct

SEQ ID NO: 567121 - DNA, 15 bp, Homo sapiens
tgtctgaaacataga

SEQ ID NO: 567122 - DNA, 14 bp, Homo sapiens
tgtctgtaaatcaa

SEQ ID NO: 567123 - DNA, 16 bp, Homo sapiens
tgtctgtaaatcaaga

SEQ ID NO: 567124 - DNA, 23 bp, Homo sapiens
tgtctgtaatcacactctcttct

SEQ ID NO: 567125 - DNA, 14 bp, Homo sapiens
tgtctgtcatttct

SEQ ID NO: 567126 - DNA, 21 bp, Homo sapiens
tgtcttaattaagtaaactaa

SEQ ID NO: 567127 - DNA, 15 bp, Homo sapiens
tgtcttcatgttgat

SEQ ID NO: 567128 - DNA, 11 bp, Homo sapiens
tgtctttaaaa

SEQ ID NO: 567129 - DNA, 19 bp, Homo sapiens
tgtctttctccaaagttat

SEQ ID NO: 567130 - DNA, 14 bp, Homo sapiens
tgtctttttcctat

SEQ ID NO: 567131 - DNA, 16 bp, Homo sapiens
tgtctttttcctatga

SEQ ID NO: 567132 - DNA, 15 bp, Homo sapiens
tgtgaaatttttcat

SEQ ID NO: 567133 - DNA, 14 bp, Homo sapiens
tgtgaactatgttt

SEQ ID NO: 567134 - DNA, 17 bp, Homo sapiens
tgtgaactttctcagca

SEQ ID NO: 567135 - DNA, 19 bp, Homo sapiens
tgtgaactttctcagcata

SEQ ID NO: 567136 - DNA, 16 bp, Homo sapiens
tgtgaaggaccttcac

SEQ ID NO: 567137 - DNA, 18 bp, Homo sapiens
tgtgaaggaccttcactc

SEQ ID NO: 567138 - DNA, 14 bp, Homo sapiens
tgtgaagggaagga

SEQ ID NO: 567139 - DNA, 20 bp, Homo sapiens
tgtgaattactaacttctaa

SEQ ID NO: 567140 - DNA, 18 bp, Homo sapiens
tgtgacatttgtcatttt

SEQ ID NO: 567141 - DNA, 16 bp, Homo sapiens
tgtgaccggggtcctg

SEQ ID NO: 567142 - DNA, 20 bp, Homo sapiens
tgtgagctgcaccaggtaga

SEQ ID NO: 567143 - DNA, 19 bp, Homo sapiens
tgtgatgtgacatttgtca

SEQ ID NO: 567144 - DNA, 13 bp, Homo sapiens
tgtgattttcaaa

SEQ ID NO: 567145 - DNA, 17 bp, Homo sapiens
tgtgcaaagcagagtga

SEQ ID NO: 567146 - DNA, 12 bp, Homo sapiens
tgtgcacaggca

SEQ ID NO: 567147 - DNA, 18 bp, Homo sapiens
tgtgcacctgactttgga

SEQ ID NO: 567148 - DNA, 23 bp, Homo sapiens
tgtgcccttaaaaccaaacccta

SEQ ID NO: 567149 - DNA, 14 bp, Homo sapiens
tgtgcgaacacagt

SEQ ID NO: 567150 - DNA, 23 bp, Homo sapiens
tgtgcgaacacagtgacacgttt

SEQ ID NO: 567151 - DNA, 21 bp, Homo sapiens
tgtgctaaacgtgtatgtttt

SEQ ID NO: 567152 - DNA, 16 bp, Homo sapiens
tgtgctcatcagaaac

SEQ ID NO: 567153 - DNA, 15 bp, Homo sapiens
tgtgctgtgtttgct

SEQ ID NO: 567154 - DNA, 14 bp, Homo sapiens
ttatgttgtaatat

SEQ ID NO: 567155 - DNA, 18 bp, Homo sapiens
ttatgttgtaatattttg

SEQ ID NO: 567156 - DNA, 14 bp, Homo sapiens
ttatgtttaaaatg

SEQ ID NO: 567157 - DNA, 18 bp, Homo sapiens
ttatgtttaaaatggcat

SEQ ID NO: 567158 - DNA, 17 bp, Homo sapiens
ttattaaagtttcaaaa

SEQ ID NO: 567159 - DNA, 17 bp, Homo sapiens
ttattccatattagaaa

SEQ ID NO: 567160 - DNA, 22 bp, Homo sapiens
ttattgagagagatgtgtaatt

SEQ ID NO: 567161 - DNA, 15 bp, Homo sapiens
ttatttctgtatctg

SEQ ID NO: 567162 - DNA, 12 bp, Homo sapiens
ttatttctgtca

SEQ ID NO: 567163 - DNA, 15 bp, Homo sapiens
ttatttgtcagtgta

SEQ ID NO: 567164 - DNA, 14 bp, Homo sapiens
ttattttcattaca

SEQ ID NO: 567165 - DNA, 12 bp, Homo sapiens
ttattttctaaa

SEQ ID NO: 567166 - DNA, 12 bp, Homo sapiens
ttcaaaaatctg

SEQ ID NO: 567167 - DNA, 16 bp, Homo sapiens
ttcaaaaatctgaaga

SEQ ID NO: 567168 - DNA, 21 bp, Homo sapiens
ttcaaaaatctgaagattgtt

SEQ ID NO: 567169 - DNA, 22 bp, Homo sapiens
ttcaaaaatctgaagattgttt

SEQ ID NO: 567170 - DNA, 23 bp, Homo sapiens
ttcaaaacaaacagatgctctga

SEQ ID NO: 567171 - DNA, 14 bp, Homo sapiens
ttcaaaagacatgt

SEQ ID NO: 567172 - DNA, 14 bp, Homo sapiens
ttcaaacaagaatg

SEQ ID NO: 567173 - DNA, 15 bp, Homo sapiens
ttcaaacaagaatgt

SEQ ID NO: 567174 - DNA, 21 bp, Homo sapiens
ttcaaaccaatttcttccttc

SEQ ID NO: 567175 - DNA, 20 bp, Homo sapiens
ttcaaagacttcatttaaca

SEQ ID NO: 567176 - DNA, 15 bp, Homo sapiens
ttcaaataaccctga

SEQ ID NO: 567177 - DNA, 19 bp, Homo sapiens
ttcaaataaccctgaatca

SEQ ID NO: 567178 - DNA, 16 bp, Homo sapiens
ttcaaatatgtaaact

SEQ ID NO: 567179 - DNA, 18 bp, Homo sapiens
ttcaaatatgtaaacttt

SEQ ID NO: 567180 - DNA, 17 bp, Homo sapiens
ttcaaatggagttggag

SEQ ID NO: 567181 - DNA, 17 bp, Homo sapiens
ttcaagaccagcctggc

SEQ ID NO: 567182 - DNA, 14 bp, Homo sapiens
ttcaaggcatttat

SEQ ID NO: 567183 - DNA, 18 bp, Homo sapiens
ttcaataaagtttgatct

SEQ ID NO: 567184 - DNA, 19 bp, Homo sapiens
ttcaataaagtttgatctt

SEQ ID NO: 567185 - DNA, 17 bp, Homo sapiens
ttcaattcatagaataa

SEQ ID NO: 567186 - DNA, 17 bp, Homo sapiens
ttcaatttattgcacaa

SEQ ID NO: 567187 - DNA, 20 bp, Homo sapiens
ttcaatttattgcacaaaat

SEQ ID NO: 567188 - DNA, 14 bp, Homo sapiens
ttcacacctgcaga

SEQ ID NO: 567189 - DNA, 16 bp, Homo sapiens
ttcacagtgtctgtaa

SEQ ID NO: 567190 - DNA, 20 bp, Homo sapiens
ttcacatgttttcaaatgga

SEQ ID NO: 567191 - DNA, 23 bp, Homo sapiens
ttcaccagtacattctcagtttt

SEQ ID NO: 567192 - DNA, 14 bp, Homo sapiens
ttcactcactgtca

SEQ ID NO: 567193 - DNA, 19 bp, Homo sapiens
ttcactcactgtcaatgat

SEQ ID NO: 567194 - DNA, 15 bp, Homo sapiens
ttcacttctttccct

SEQ ID NO: 567195 - DNA, 20 bp, Homo sapiens
ttcagaaacccggcttcctg

SEQ ID NO: 567196 - DNA, 16 bp, Homo sapiens
ttcagataatggtaat

SEQ ID NO: 567197 - DNA, 17 bp, Homo sapiens
ttcagatgaccttttgg

SEQ ID NO: 567198 - DNA, 16 bp, Homo sapiens
ttcagatttgcacaaa

SEQ ID NO: 567199 - DNA, 17 bp, Homo sapiens
ttcagatttgcacaaaa

SEQ ID NO: 567200 - DNA, 18 bp, Homo sapiens
ttcagatttgcacaaaaa

SEQ ID NO: 567201 - DNA, 13 bp, Homo sapiens
ttcagcaggcagc

SEQ ID NO: 567202 - DNA, 14 bp, Homo sapiens
ttcagctaggaaca

SEQ ID NO: 567203 - DNA, 18 bp, Homo sapiens
ttcagctcaattgttaat

SEQ ID NO: 567204 - DNA, 15 bp, Homo sapiens
ttcagctctctgtat

SEQ ID NO: 567205 - DNA, 19 bp, Homo sapiens
ttcaggaaagcagcagttt

SEQ ID NO: 567206 - DNA, 20 bp, Homo sapiens
ttcaggaggagacagtcagg

SEQ ID NO: 567207 - DNA, 16 bp, Homo sapiens
ttcagggcagatttta

SEQ ID NO: 567208 - DNA, 20 bp, Homo sapiens
ttcagggcagattttagttt

SEQ ID NO: 567209 - DNA, 15 bp, Homo sapiens
ttcaggtgaaaatgt

SEQ ID NO: 567210 - DNA, 17 bp, Homo sapiens
ttcagttcaaagtcatg

SEQ ID NO: 567211 - DNA, 16 bp, Homo sapiens
ttcagtttttgtgttt

SEQ ID NO: 567212 - DNA, 22 bp, Homo sapiens
ttcatagacgcaaccttaactt

SEQ ID NO: 567213 - DNA, 16 bp, Homo sapiens
ttcatattacaatatt

SEQ ID NO: 567214 - DNA, 13 bp, Homo sapiens
ttcatcccagccc

SEQ ID NO: 567215 - DNA, 16 bp, Homo sapiens
ttcatcccagccccaa

SEQ ID NO: 567216 - DNA, 18 bp, Homo sapiens
ttcatcccttctcttcca

SEQ ID NO: 567217 - DNA, 17 bp, Homo sapiens
ttcatccttcccactct

SEQ ID NO: 567218 - DNA, 20 bp, Homo sapiens
ttcatcctttcacttctttc

SEQ ID NO: 567219 - DNA, 18 bp, Homo sapiens
gttcaatttcagaaacta

SEQ ID NO: 567220 - DNA, 15 bp, Homo sapiens
gttcacacctgcaga

SEQ ID NO: 567221 - DNA, 15 bp, Homo sapiens
gttcacgcaacttga

SEQ ID NO: 567222 - DNA, 21 bp, Homo sapiens
gttcagaaaaaaggttctttg

SEQ ID NO: 567223 - DNA, 22 bp, Homo sapiens
gttcagaaaagcacctcttgaa

SEQ ID NO: 567224 - DNA, 23 bp, Homo sapiens
gttcagggaagataagttggaaa

SEQ ID NO: 567225 - DNA, 16 bp, Homo sapiens
gttcatcccagcccca

SEQ ID NO: 567226 - DNA, 19 bp, Homo sapiens
gttcatcccttctcttcca

SEQ ID NO: 567227 - DNA, 20 bp, Homo sapiens
gttcatcccttctcttccag

SEQ ID NO: 567228 - DNA, 16 bp, Homo sapiens
gttcattcatattaca

SEQ ID NO: 567229 - DNA, 17 bp, Homo sapiens
gttcattcatattacaa

SEQ ID NO: 567230 - DNA, 20 bp, Homo sapiens
gttcccccaggaccctgagg

SEQ ID NO: 567231 - DNA, 20 bp, Homo sapiens
gttctatcagttatcctttg

SEQ ID NO: 567232 - DNA, 14 bp, Homo sapiens
gttctctttggaaa

SEQ ID NO: 567233 - DNA, 13 bp, Homo sapiens
gttctgaaatgga

SEQ ID NO: 567234 - DNA, 13 bp, Homo sapiens
gttctgcagtcat

SEQ ID NO: 567235 - DNA, 13 bp, Homo sapiens
gttctgtgaatag

SEQ ID NO: 567236 - DNA, 21 bp, Homo sapiens
gttctgtgaatagcagtggca

SEQ ID NO: 567237 - DNA, 11 bp, Homo sapiens
gttctgtgtct

SEQ ID NO: 567238 - DNA, 15 bp, Homo sapiens
gttctgtgtctgctg

SEQ ID NO: 567239 - DNA, 13 bp, Homo sapiens
gttctgttacaaa

SEQ ID NO: 567240 - DNA, 14 bp, Homo sapiens
gttctgttacaaaa

SEQ ID NO: 567241 - DNA, 19 bp, Homo sapiens
gttctgttacaaaatgtaa

SEQ ID NO: 567242 - DNA, 16 bp, Homo sapiens
gttcttcctcttacct

SEQ ID NO: 567243 - DNA, 18 bp, Homo sapiens
gttcttcctcttacctgt

SEQ ID NO: 567244 - DNA, 15 bp, Homo sapiens
gttctttctgggggg

SEQ ID NO: 567245 - DNA, 13 bp, Homo sapiens
gttctttgtacct

SEQ ID NO: 567246 - DNA, 14 bp, Homo sapiens
gttgagaggacact

SEQ ID NO: 567247 - DNA, 24 bp, Homo sapiens
gttgatgcaatccttacaaatgat

SEQ ID NO: 567248 - DNA, 13 bp, Homo sapiens
gttgattctctcc

SEQ ID NO: 567249 - DNA, 14 bp, Homo sapiens
gttgattctctcca

SEQ ID NO: 567250 - DNA, 16 bp, Homo sapiens
gttgatttctagttat

SEQ ID NO: 567251 - DNA, 22 bp, Homo sapiens
gttgatttctagttatttattc

SEQ ID NO: 567252 - DNA, 16 bp, Homo sapiens
gttgcagtgagctgag

SEQ ID NO: 567253 - DNA, 23 bp, Homo sapiens
gttgctcagagtgaagagtgaag

SEQ ID NO: 567254 - DNA, 19 bp, Homo sapiens
gttgcttacggtttctttg

SEQ ID NO: 567255 - DNA, 15 bp, Homo sapiens
gttggaaacactaaa

SEQ ID NO: 567256 - DNA, 18 bp, Homo sapiens
gttggaaacactaaatgt

SEQ ID NO: 567257 - DNA, 19 bp, Homo sapiens
gttggaaacactaaatgtt

SEQ ID NO: 567258 - DNA, 20 bp, Homo sapiens
gttggaaacactaaatgtta

SEQ ID NO: 567259 - DNA, 22 bp, Homo sapiens
gttggaaacactaaatgttaaa

SEQ ID NO: 567260 - DNA, 14 bp, Homo sapiens
gttggactgtggcc

SEQ ID NO: 567261 - DNA, 15 bp, Homo sapiens
gttggactgtggcct

SEQ ID NO: 567262 - DNA, 20 bp, Homo sapiens
gttggagttcattcatatta

SEQ ID NO: 567263 - DNA, 23 bp, Homo sapiens
gttggcagatgcagctcttcctg

SEQ ID NO: 567264 - DNA, 22 bp, Homo sapiens
gttggtcttactttgttaattt

SEQ ID NO: 567265 - DNA, 18 bp, Homo sapiens
gttggttacctattgctg

SEQ ID NO: 567266 - DNA, 12 bp, Homo sapiens
gttgtaaagata

SEQ ID NO: 567267 - DNA, 17 bp, Homo sapiens
gttgtaaagatattgta

SEQ ID NO: 567268 - DNA, 23 bp, Homo sapiens
gttgtaatatcagttacagtggc

SEQ ID NO: 567269 - DNA, 17 bp, Homo sapiens
gttgtccccttcctctc

SEQ ID NO: 567270 - DNA, 12 bp, Homo sapiens
gttgtctcttct

SEQ ID NO: 567271 - DNA, 17 bp, Homo sapiens
gttgtctcttctcctta

SEQ ID NO: 567272 - DNA, 14 bp, Homo sapiens
gttgtctgaaacat

SEQ ID NO: 567273 - DNA, 15 bp, Homo sapiens
gttgttagtttcttt

SEQ ID NO: 567274 - DNA, 13 bp, Homo sapiens
gttgttttgtgga

SEQ ID NO: 567275 - DNA, 15 bp, Homo sapiens
gtttaaaaaaaaagt

SEQ ID NO: 567276 - DNA, 22 bp, Homo sapiens
gtttaaaaaaaaagttggtatt

SEQ ID NO: 567277 - DNA, 19 bp, Homo sapiens
gtttaaaagtcacataaaa

SEQ ID NO: 567278 - DNA, 13 bp, Homo sapiens
gtttaaaatgtgt

SEQ ID NO: 567279 - DNA, 12 bp, Homo sapiens
gtttaaagaaga

SEQ ID NO: 567280 - DNA, 15 bp, Homo sapiens
gtttacactgtcaaa

SEQ ID NO: 567281 - DNA, 21 bp, Homo sapiens
gtttagaatcaagtctgtgaa

SEQ ID NO: 567282 - DNA, 14 bp, Homo sapiens
gtttagatttcaag

SEQ ID NO: 567283 - DNA, 18 bp, Homo sapiens
gtttatctagatgtaaat

SEQ ID NO: 567284 - DNA, 20 bp, Homo sapiens
gtttattccagagctgccag

SEQ ID NO: 567285 - DNA, 13 bp, Homo sapiens
gtttcaaaaatct

SEQ ID NO: 567286 - DNA, 12 bp, Homo sapiens
gtttcaataaag

SEQ ID NO: 567287 - DNA, 17 bp, Homo sapiens
gtttcaataaagtttga

SEQ ID NO: 567288 - DNA, 18 bp, Homo sapiens
gtttcaataaagtttgat

SEQ ID NO: 567289 - DNA, 17 bp, Homo sapiens
gtttcatccttcccact

SEQ ID NO: 567290 - DNA, 14 bp, Homo sapiens
gtttccacacaggc

SEQ ID NO: 567291 - DNA, 15 bp, Homo sapiens
gtttccacacaggcc

SEQ ID NO: 567292 - DNA, 17 bp, Homo sapiens
gtttccacacaggccca

SEQ ID NO: 567293 - DNA, 19 bp, Homo sapiens
gtttccacacaggcccatg

SEQ ID NO: 567294 - DNA, 20 bp, Homo sapiens
gtttccaggcatgaccctgg

SEQ ID NO: 567295 - DNA, 18 bp, Homo sapiens
gtttccatcaaagccctc

SEQ ID NO: 567296 - DNA, 21 bp, Homo sapiens
gtttccttgaggggagccagg

SEQ ID NO: 567297 - DNA, 13 bp, Homo sapiens
gtttctgagaaaa

SEQ ID NO: 567298 - DNA, 12 bp, Homo sapiens
gtttctttgaat

SEQ ID NO: 567299 - DNA, 23 bp, Homo sapiens
gtttcttttataaaaaaaatgaa

SEQ ID NO: 567300 - DNA, 15 bp, Homo sapiens
gtttgataaatagtg

SEQ ID NO: 567301 - DNA, 13 bp, Homo sapiens
gtttgatcttcct

SEQ ID NO: 567302 - DNA, 22 bp, Homo sapiens
gtttgatcttcctctgctaaat

SEQ ID NO: 567303 - DNA, 20 bp, Homo sapiens
gtttgatgtcattaatgtgt

SEQ ID NO: 567304 - DNA, 14 bp, Homo sapiens
gtttgccccgttct

SEQ ID NO: 567305 - DNA, 14 bp, Homo sapiens
gtttgctccccttc

SEQ ID NO: 567306 - DNA, 13 bp, Homo sapiens
gtttgcttctaaa

SEQ ID NO: 567307 - DNA, 19 bp, Homo sapiens
gtttgcttctaaaggtttc

SEQ ID NO: 567308 - DNA, 17 bp, Homo sapiens
gtttggttttaaaatac

SEQ ID NO: 567309 - DNA, 14 bp, Homo sapiens
gtttggtttttatt

SEQ ID NO: 567310 - DNA, 22 bp, Homo sapiens
gtttggtttttatttctccttt

SEQ ID NO: 567311 - DNA, 13 bp, Homo sapiens
gtttgtctcttct

SEQ ID NO: 567312 - DNA, 13 bp, Homo sapiens
gttttatatgatt

SEQ ID NO: 567313 - DNA, 21 bp, Homo sapiens
gttttattttctaaagtactg

SEQ ID NO: 567314 - DNA, 13 bp, Homo sapiens
gttttcaaatgga

SEQ ID NO: 567315 - DNA, 16 bp, Homo sapiens
gttttcaaatggagtt

SEQ ID NO: 567316 - DNA, 13 bp, Homo sapiens
gttttctctctat

SEQ ID NO: 567317 - DNA, 12 bp, Homo sapiens
gttttgagccct

SEQ ID NO: 567318 - DNA, 16 bp, Homo sapiens
gttttgatatgagtat

SEQ ID NO: 567319 - DNA, 16 bp, Homo sapiens
gttttgcctctgccct

SEQ ID NO: 567320 - DNA, 20 bp, Homo sapiens
gttttgcctctgcccttggg

SEQ ID NO: 567321 - DNA, 16 bp, Homo sapiens
gttttgtaaactttga

SEQ ID NO: 567322 - DNA, 21 bp, Homo sapiens
gttttgtaaactttgaaatat

SEQ ID NO: 567323 - DNA, 19 bp, Homo sapiens
gttttgtgaaatttttcat

SEQ ID NO: 567324 - DNA, 20 bp, Homo sapiens
gttttgtgaaatttttcata

SEQ ID NO: 567325 - DNA, 10 bp, Homo sapiens
gttttgttgc

SEQ ID NO: 567326 - DNA, 15 bp, Homo sapiens
gtttttaaaatctta

SEQ ID NO: 567327 - DNA, 22 bp, Homo sapiens
gtttttatacctgtacacacac

SEQ ID NO: 567328 - DNA, 23 bp, Homo sapiens
gtttttatacctgtacacacaca

SEQ ID NO: 567329 - DNA, 13 bp, Homo sapiens
taaaaaaaatgaa

SEQ ID NO: 567330 - DNA, 20 bp, Homo sapiens
taaaaaaaatgaaatgtttt

SEQ ID NO: 567331 - DNA, 15 bp, Homo sapiens
taaaaaaagaaaaaa

SEQ ID NO: 567332 - DNA, 15 bp, Homo sapiens
taaaaaatgaaaata

SEQ ID NO: 567333 - DNA, 16 bp, Homo sapiens
taaaaactgaagttct

SEQ ID NO: 567334 - DNA, 13 bp, Homo sapiens
taaaaagtattgc

SEQ ID NO: 567335 - DNA, 16 bp, Homo sapiens
taaaaagtcttttaaa

SEQ ID NO: 567336 - DNA, 18 bp, Homo sapiens
taaaaagtgacacagcag

SEQ ID NO: 567337 - DNA, 12 bp, Homo sapiens
taaaaatgcatt

SEQ ID NO: 567338 - DNA, 18 bp, Homo sapiens
taaaaattatctttaaaa

SEQ ID NO: 567339 - DNA, 21 bp, Homo sapiens
taaaacagtggttgttttttc

SEQ ID NO: 567340 - DNA, 14 bp, Homo sapiens
taaaacatttcatg

SEQ ID NO: 567341 - DNA, 16 bp, Homo sapiens
taaaacatttcatgta

SEQ ID NO: 567342 - DNA, 20 bp, Homo sapiens
taaaacatttcatgtatttc

SEQ ID NO: 567343 - DNA, 22 bp, Homo sapiens
taaaaccaaaccctatgccttt

SEQ ID NO: 567344 - DNA, 14 bp, Homo sapiens
taaaactgtacttt

SEQ ID NO: 567345 - DNA, 15 bp, Homo sapiens
taaaactgtactttg

SEQ ID NO: 567346 - DNA, 16 bp, Homo sapiens
taaaactgtactttga

SEQ ID NO: 567347 - DNA, 17 bp, Homo sapiens
taaaactgtactttgat

SEQ ID NO: 567348 - DNA, 18 bp, Homo sapiens
taaaacttactatggtat

SEQ ID NO: 567349 - DNA, 13 bp, Homo sapiens
gagctgcttcccc

SEQ ID NO: 567350 - DNA, 20 bp, Homo sapiens
gagctggggagaatggggct

SEQ ID NO: 567351 - DNA, 20 bp, Homo sapiens
gagctttctcaatgtcttcc

SEQ ID NO: 567352 - DNA, 21 bp, Homo sapiens
gaggaaaaggcttgagtctgg

SEQ ID NO: 567353 - DNA, 19 bp, Homo sapiens
gaggaagagtgcaaaacat

SEQ ID NO: 567354 - DNA, 20 bp, Homo sapiens
gaggacacctgtactggaga

SEQ ID NO: 567355 - DNA, 21 bp, Homo sapiens
gaggacacctgtactggagag

SEQ ID NO: 567356 - DNA, 13 bp, Homo sapiens
gaggacactcccg

SEQ ID NO: 567357 - DNA, 13 bp, Homo sapiens
gaggaccagggct

SEQ ID NO: 567358 - DNA, 21 bp, Homo sapiens
gaggacccatgaaacagcagc

SEQ ID NO: 567359 - DNA, 21 bp, Homo sapiens
gaggacctccacctgggagat

SEQ ID NO: 567360 - DNA, 23 bp, Homo sapiens
gaggactgttgacatccaagctt

SEQ ID NO: 567361 - DNA, 14 bp, Homo sapiens
gaggagacagtcag

SEQ ID NO: 567362 - DNA, 20 bp, Homo sapiens
gaggagggatagagacgcag

SEQ ID NO: 567363 - DNA, 14 bp, Homo sapiens
gaggatggcccagg

SEQ ID NO: 567364 - DNA, 12 bp, Homo sapiens
gaggatgtatgt

SEQ ID NO: 567365 - DNA, 13 bp, Homo sapiens
gaggatgtatgtg

SEQ ID NO: 567366 - DNA, 18 bp, Homo sapiens
gaggatgtatgtgtatat

SEQ ID NO: 567367 - DNA, 19 bp, Homo sapiens
gaggatttgatgtaagtta

SEQ ID NO: 567368 - DNA, 16 bp, Homo sapiens
gaggcagtggcttgga

SEQ ID NO: 567369 - DNA, 21 bp, Homo sapiens
gaggcagttgcccagcctctt

SEQ ID NO: 567370 - DNA, 14 bp, Homo sapiens
gaggccaaatgagt

SEQ ID NO: 567371 - DNA, 23 bp, Homo sapiens
gaggcctcctgtggcctgccagt

SEQ ID NO: 567372 - DNA, 22 bp, Homo sapiens
gaggcctgaaatgtttccaggc

SEQ ID NO: 567373 - DNA, 19 bp, Homo sapiens
gaggccttgggctctgctg

SEQ ID NO: 567374 - DNA, 18 bp, Homo sapiens
gaggctaaaatgttttca

SEQ ID NO: 567375 - DNA, 20 bp, Homo sapiens
gaggctggataggagaggaa

SEQ ID NO: 567376 - DNA, 21 bp, Homo sapiens
gaggctggggcttttgtgcca

SEQ ID NO: 567377 - DNA, 16 bp, Homo sapiens
gagggcccttcccaac

SEQ ID NO: 567378 - DNA, 14 bp, Homo sapiens
gaggggagccagga

SEQ ID NO: 567379 - DNA, 21 bp, Homo sapiens
gaggggatgtgtgtgtgcaga

SEQ ID NO: 567380 - DNA, 18 bp, Homo sapiens
gagggggccacctcccca

SEQ ID NO: 567381 - DNA, 22 bp, Homo sapiens
gagggggccacctccccaggcc

SEQ ID NO: 567382 - DNA, 13 bp, Homo sapiens
gaggggtggtact

SEQ ID NO: 567383 - DNA, 19 bp, Homo sapiens
gaggggtggtacttggcac

SEQ ID NO: 567384 - DNA, 21 bp, Homo sapiens
gaggtcctgggggcctgacct

SEQ ID NO: 567385 - DNA, 18 bp, Homo sapiens
gaggtgagggaggcctga

SEQ ID NO: 567386 - DNA, 21 bp, Homo sapiens
gaggttacaggtaccagttct

SEQ ID NO: 567387 - DNA, 15 bp, Homo sapiens
gagtaacacttgaaa

SEQ ID NO: 567388 - DNA, 23 bp, Homo sapiens
gagtagatgcttgctcttgggaa

SEQ ID NO: 567389 - DNA, 18 bp, Homo sapiens
gagtagcaaggaaggaca

SEQ ID NO: 567390 - DNA, 18 bp, Homo sapiens
gagtatacaatatataaa

SEQ ID NO: 567391 - DNA, 18 bp, Homo sapiens
gagtatattgaaaagaaa

SEQ ID NO: 567392 - DNA, 17 bp, Homo sapiens
gagtatggtgctgggtc

SEQ ID NO: 567393 - DNA, 16 bp, Homo sapiens
gagtcagctgtttcta

SEQ ID NO: 567394 - DNA, 16 bp, Homo sapiens
gagtcagggagccctg

SEQ ID NO: 567395 - DNA, 18 bp, Homo sapiens
gagtcagggagccctggg

SEQ ID NO: 567396 - DNA, 22 bp, Homo sapiens
gagtcagtgcccatgtgtatgg

SEQ ID NO: 567397 - DNA, 21 bp, Homo sapiens
gagtccagacctgggccctgg

SEQ ID NO: 567398 - DNA, 14 bp, Homo sapiens
gagtcctccagaac

SEQ ID NO: 567399 - DNA, 20 bp, Homo sapiens
gagtcctggtttcctcagcc

SEQ ID NO: 567400 - DNA, 17 bp, Homo sapiens
gagtctcattcctctgt

SEQ ID NO: 567401 - DNA, 15 bp, Homo sapiens
gagtctggagaccag

SEQ ID NO: 567402 - DNA, 18 bp, Homo sapiens
gagtctggagaccaggac

SEQ ID NO: 567403 - DNA, 13 bp, Homo sapiens
gagtgaaatatta

SEQ ID NO: 567404 - DNA, 14 bp, Homo sapiens
gagtgacagagtaa

SEQ ID NO: 567405 - DNA, 19 bp, Homo sapiens
gagtgacatcggttcagga

SEQ ID NO: 567406 - DNA, 17 bp, Homo sapiens
gagtgaggcaggtgaca

SEQ ID NO: 567407 - DNA, 20 bp, Homo sapiens
gagtgaggtcatcccggggc

SEQ ID NO: 567408 - DNA, 20 bp, Homo sapiens
gagtgatttgtaaaacagtg

SEQ ID NO: 567409 - DNA, 13 bp, Homo sapiens
gagttccttctca

SEQ ID NO: 567410 - DNA, 22 bp, Homo sapiens
gataacagagtgatttgtaaaa

SEQ ID NO: 567411 - DNA, 17 bp, Homo sapiens
gataaccatagcatagg

SEQ ID NO: 567412 - DNA, 18 bp, Homo sapiens
gataatggtaatttagtg

SEQ ID NO: 567413 - DNA, 18 bp, Homo sapiens
gataattaaatgaaatac

SEQ ID NO: 567414 - DNA, 19 bp, Homo sapiens
gataattaaatgaaatact

SEQ ID NO: 567415 - DNA, 17 bp, Homo sapiens
gatactgcctcccccag

SEQ ID NO: 567416 - DNA, 14 bp, Homo sapiens
gatacttggtcctt

SEQ ID NO: 567417 - DNA, 18 bp, Homo sapiens
gataggaaggtcatttcc

SEQ ID NO: 567418 - DNA, 23 bp, Homo sapiens
gataggaaggtcatttccatgta

SEQ ID NO: 567419 - DNA, 13 bp, Homo sapiens
gataggagaggaa

SEQ ID NO: 567420 - DNA, 17 bp, Homo sapiens
gatataatgtattttca

SEQ ID NO: 567421 - DNA, 18 bp, Homo sapiens
gatatatctgaaaactgg

SEQ ID NO: 567422 - DNA, 19 bp, Homo sapiens
gtcttcctactcttctctc

SEQ ID NO: 567423 - DNA, 22 bp, Homo sapiens
gtcttcctactcttctctctgc

SEQ ID NO: 567424 - DNA, 21 bp, Homo sapiens
gtcttggtacttgctgctatt

SEQ ID NO: 567425 - DNA, 10 bp, Homo sapiens
gtctttccca

SEQ ID NO: 567426 - DNA, 12 bp, Homo sapiens
gtctttctgggg

SEQ ID NO: 567427 - DNA, 14 bp, Homo sapiens
gtcttttaaaaagt

SEQ ID NO: 567428 - DNA, 19 bp, Homo sapiens
gtcttttaaaaagtattgc

SEQ ID NO: 567429 - DNA, 14 bp, Homo sapiens
gtctttttcctatg

SEQ ID NO: 567430 - DNA, 16 bp, Homo sapiens
gtcttttttctgggtc

SEQ ID NO: 567431 - DNA, 23 bp, Homo sapiens
gtcttttttttttaagtgaaatt

SEQ ID NO: 567432 - DNA, 13 bp, Homo sapiens
gtgaaacacaata

SEQ ID NO: 567433 - DNA, 16 bp, Homo sapiens
gtgaaattcaattcat

SEQ ID NO: 567434 - DNA, 18 bp, Homo sapiens
gtgaaatttttcatattt

SEQ ID NO: 567435 - DNA, 21 bp, Homo sapiens
gtgaacttggtgcctaatgtt

SEQ ID NO: 567436 - DNA, 19 bp, Homo sapiens
gtgaactttctcagcatat

SEQ ID NO: 567437 - DNA, 14 bp, Homo sapiens
gtgaagactccaga

SEQ ID NO: 567438 - DNA, 16 bp, Homo sapiens
gtgaagagcaagagag

SEQ ID NO: 567439 - DNA, 16 bp, Homo sapiens
gtgaaggaggctccag

SEQ ID NO: 567440 - DNA, 17 bp, Homo sapiens
gtgaaggaggctccagg

SEQ ID NO: 567441 - DNA, 21 bp, Homo sapiens
gtgaatagcagtggcaaaata

SEQ ID NO: 567442 - DNA, 18 bp, Homo sapiens
gtgaattactaacttcta

SEQ ID NO: 567443 - DNA, 19 bp, Homo sapiens
gtgaattactaacttctaa

SEQ ID NO: 567444 - DNA, 20 bp, Homo sapiens
gtgacaaaattttataagca

SEQ ID NO: 567445 - DNA, 22 bp, Homo sapiens
gtgacacagcagcttcaccaga

SEQ ID NO: 567446 - DNA, 20 bp, Homo sapiens
gtgacatctctattccccac

SEQ ID NO: 567447 - DNA, 17 bp, Homo sapiens
gtgacatttgtcatttt

SEQ ID NO: 567448 - DNA, 19 bp, Homo sapiens
gtgacatttgtcattttca

SEQ ID NO: 567449 - DNA, 23 bp, Homo sapiens
gtgacatttgtcattttcattag

SEQ ID NO: 567450 - DNA, 20 bp, Homo sapiens
gtgaccaatcgggagtagca

SEQ ID NO: 567451 - DNA, 13 bp, Homo sapiens
gtgaccggggtcc

SEQ ID NO: 567452 - DNA, 15 bp, Homo sapiens
gtgaccggggtcctg

SEQ ID NO: 567453 - DNA, 16 bp, Homo sapiens
gtgagaggaaatgttg

SEQ ID NO: 567454 - DNA, 15 bp, Homo sapiens
gtgagggaggcctga

SEQ ID NO: 567455 - DNA, 17 bp, Homo sapiens
gtgagtcctccagaact

SEQ ID NO: 567456 - DNA, 12 bp, Homo sapiens
gtgagtttgttt

SEQ ID NO: 567457 - DNA, 23 bp, Homo sapiens
gtgatattctttgttaatttgga

SEQ ID NO: 567458 - DNA, 23 bp, Homo sapiens
gtgatcactttctgaaattcaca

SEQ ID NO: 567459 - DNA, 13 bp, Homo sapiens
gtgatctgtcctt

SEQ ID NO: 567460 - DNA, 21 bp, Homo sapiens
gtgatctgttgtaatatcagt

SEQ ID NO: 567461 - DNA, 18 bp, Homo sapiens
gtgatggatggcacaatg

SEQ ID NO: 567462 - DNA, 13 bp, Homo sapiens
gtgatgtgacatt

SEQ ID NO: 567463 - DNA, 20 bp, Homo sapiens
gtgcaatatattttgtatgc

SEQ ID NO: 567464 - DNA, 23 bp, Homo sapiens
gtgcaatatattttgtatgcaag

SEQ ID NO: 567465 - DNA, 13 bp, Homo sapiens
gtgcaatttgtct

SEQ ID NO: 567466 - DNA, 11 bp, Homo sapiens
gtgcacacaga

SEQ ID NO: 567467 - DNA, 18 bp, Homo sapiens
gtgcagacaatcttctgt

SEQ ID NO: 567468 - DNA, 18 bp, Homo sapiens
gtgcaggcaggctggcct

SEQ ID NO: 567469 - DNA, 15 bp, Homo sapiens
gtgcatcagaaaatg

SEQ ID NO: 567470 - DNA, 12 bp, Homo sapiens
gtgccaaaataa

SEQ ID NO: 567471 - DNA, 15 bp, Homo sapiens
gtgccaaatcctggg

SEQ ID NO: 567472 - DNA, 17 bp, Homo sapiens
gtgccaaatcctgggca

SEQ ID NO: 567473 - DNA, 14 bp, Homo sapiens
gtgccagcccagag

SEQ ID NO: 567474 - DNA, 18 bp, Homo sapiens
gtgccagcccagaggccg

SEQ ID NO: 567475 - DNA, 16 bp, Homo sapiens
gtgcccatgtgtatgg

SEQ ID NO: 567476 - DNA, 17 bp, Homo sapiens
gtgcccatgtgtatgga

SEQ ID NO: 567477 - DNA, 19 bp, Homo sapiens
gtgccccccatgccctccc

SEQ ID NO: 567478 - DNA, 22 bp, Homo sapiens
gtgcctgtgaccggggtcctga

SEQ ID NO: 567479 - DNA, 16 bp, Homo sapiens
gtgctaagtctttccc

SEQ ID NO: 567480 - DNA, 16 bp, Homo sapiens
gtgctaattaataaag

SEQ ID NO: 567481 - DNA, 20 bp, Homo sapiens
gtgctcgccttcggcctctc

SEQ ID NO: 567482 - DNA, 21 bp, Homo sapiens
gtgcttatgtcatttcttctc

SEQ ID NO: 567483 - DNA, 20 bp, Homo sapiens
gtgcttgaggccaaatgagt

SEQ ID NO: 567484 - DNA, 16 bp, Homo sapiens
gtggaaaactcacaga

SEQ ID NO: 567485 - DNA, 12 bp, Homo sapiens
gtggacatgcac

SEQ ID NO: 567486 - DNA, 15 bp, Homo sapiens
gtggagcccaggagt

SEQ ID NO: 567487 - DNA, 21 bp, Homo sapiens
gtggagcctgacagccagaac

SEQ ID NO: 567488 - DNA, 23 bp, Homo sapiens
gtggagcctgacagccagaactc

SEQ ID NO: 567489 - DNA, 16 bp, Homo sapiens
gtggaggagagcctgg

SEQ ID NO: 567490 - DNA, 11 bp, Homo sapiens
gtggagggctg

SEQ ID NO: 567491 - DNA, 15 bp, Homo sapiens
gtggcaaatataaaa

SEQ ID NO: 567492 - DNA, 17 bp, Homo sapiens
gtggcacacaactgtgg

SEQ ID NO: 567493 - DNA, 13 bp, Homo sapiens
gtggcctgccagt

SEQ ID NO: 567494 - DNA, 14 bp, Homo sapiens
gtggcctggggctg

SEQ ID NO: 567495 - DNA, 20 bp, Homo sapiens
gtggctcaagtctggcccca

SEQ ID NO: 567496 - DNA, 15 bp, Homo sapiens
gtggctgacccccct

SEQ ID NO: 567497 - DNA, 18 bp, Homo sapiens
gtggcttggagcagaggt

SEQ ID NO: 567498 - DNA, 14 bp, Homo sapiens
gtgggacacagaga

SEQ ID NO: 567499 - DNA, 15 bp, Homo sapiens
gtgggacacagagac

SEQ ID NO: 567500 - DNA, 19 bp, Homo sapiens
gtgggagcacagctttcct

SEQ ID NO: 567501 - DNA, 21 bp, Homo sapiens
gtgggagtagttggagcattg

SEQ ID NO: 567502 - DNA, 12 bp, Homo sapiens
gtggggaggaga

SEQ ID NO: 567503 - DNA, 15 bp, Homo sapiens
gtgggggggcagagc

SEQ ID NO: 567504 - DNA, 17 bp, Homo sapiens
gtgggtccaggagatga

SEQ ID NO: 567505 - DNA, 21 bp, Homo sapiens
gtgggtcttcagggggccagg

SEQ ID NO: 567506 - DNA, 14 bp, Homo sapiens
gtggtacttggcac

SEQ ID NO: 567507 - DNA, 22 bp, Homo sapiens
gtggtccacattctgctgcccc

SEQ ID NO: 567508 - DNA, 23 bp, Homo sapiens
gtggtcttcaaattgtcttttgt

SEQ ID NO: 567509 - DNA, 14 bp, Homo sapiens
gtggtcttttcctc

SEQ ID NO: 567510 - DNA, 14 bp, Homo sapiens
gtggtgaggtcctg

SEQ ID NO: 567511 - DNA, 22 bp, Homo sapiens
gtggtgaggtcctgtcctggct

SEQ ID NO: 567512 - DNA, 21 bp, Homo sapiens
gtggtgggcattctctctcca

SEQ ID NO: 567513 - DNA, 21 bp, Homo sapiens
gtgtaaaattggattattact

SEQ ID NO: 567514 - DNA, 17 bp, Homo sapiens
gtgtaatttataaaatt

SEQ ID NO: 567515 - DNA, 16 bp, Homo sapiens
gtgtaatttttctgta

SEQ ID NO: 567516 - DNA, 17 bp, Homo sapiens
gtgtacatttatgtgtg

SEQ ID NO: 567517 - DNA, 15 bp, Homo sapiens
gtgtaccattaaaat

SEQ ID NO: 567518 - DNA, 13 bp, Homo sapiens
gtgtatatataca

SEQ ID NO: 567519 - DNA, 14 bp, Homo sapiens
gtgtatatatacat

SEQ ID NO: 567520 - DNA, 22 bp, Homo sapiens
gtgtatatgaggatgtatgtgt

SEQ ID NO: 567521 - DNA, 18 bp, Homo sapiens
gtgtatatgtttatacac

SEQ ID NO: 567522 - DNA, 18 bp, Homo sapiens
gtgtatggaagacaaata

SEQ ID NO: 567523 - DNA, 15 bp, Homo sapiens
gtgtatgtttttcag

SEQ ID NO: 567524 - DNA, 21 bp, Homo sapiens
gtgtatgtttttcagttcaaa

SEQ ID NO: 567525 - DNA, 23 bp, Homo sapiens
gtgtcatttggctttccagtcat

SEQ ID NO: 567526 - DNA, 18 bp, Homo sapiens
gtgtctgtcatttctctt

SEQ ID NO: 567527 - DNA, 12 bp, Homo sapiens
gtgtggagctgc

SEQ ID NO: 567528 - DNA, 13 bp, Homo sapiens
gtgtggagggctg

SEQ ID NO: 567529 - DNA, 17 bp, Homo sapiens
gtgtgggtttactctgt

SEQ ID NO: 567530 - DNA, 24 bp, Homo sapiens
gtgttattgagagagatgtgtaat

SEQ ID NO: 567531 - DNA, 14 bp, Homo sapiens
gtgttcagaaaaaa

SEQ ID NO: 567532 - DNA, 13 bp, Homo sapiens
gtgttctgttaca

SEQ ID NO: 567533 - DNA, 14 bp, Homo sapiens
gtgtttacagagat

SEQ ID NO: 567534 - DNA, 16 bp, Homo sapiens
gtgtttactttaaatc

SEQ ID NO: 567535 - DNA, 17 bp, Homo sapiens
gtgtttgaattgatttt

SEQ ID NO: 567536 - DNA, 12 bp, Homo sapiens
gttaaaactgtc

SEQ ID NO: 567537 - DNA, 12 bp, Homo sapiens
gttaacaaataa

SEQ ID NO: 567538 - DNA, 20 bp, Homo sapiens
gttaattctcagaagtgaaa

SEQ ID NO: 567539 - DNA, 17 bp, Homo sapiens
gttaatttcttgcaatt

SEQ ID NO: 567540 - DNA, 18 bp, Homo sapiens
gttaatttcttgcaattt

SEQ ID NO: 567541 - DNA, 20 bp, Homo sapiens
gttaatttggaccattttcc

SEQ ID NO: 567542 - DNA, 22 bp, Homo sapiens
gttaatttggaccattttcctg

SEQ ID NO: 567543 - DNA, 13 bp, Homo sapiens
gttacaaaatgta

SEQ ID NO: 567544 - DNA, 17 bp, Homo sapiens
gttacaaaatgtaactg

SEQ ID NO: 567545 - DNA, 18 bp, Homo sapiens
gttacaaaatgtaactgt

SEQ ID NO: 567546 - DNA, 10 bp, Homo sapiens
gttacctaat

SEQ ID NO: 567547 - DNA, 20 bp, Homo sapiens
gttactttccaattctcctt

SEQ ID NO: 567548 - DNA, 14 bp, Homo sapiens
gttacttttccttg

SEQ ID NO: 567549 - DNA, 15 bp, Homo sapiens
gttaggaacccggca

SEQ ID NO: 567550 - DNA, 22 bp, Homo sapiens
gttaggaacccggcatgccgag

SEQ ID NO: 567551 - DNA, 21 bp, Homo sapiens
gttataaaatctgtattgcta

SEQ ID NO: 567552 - DNA, 14 bp, Homo sapiens
gttataaattttgt

SEQ ID NO: 567553 - DNA, 16 bp, Homo sapiens
gttatagtgcaatata

SEQ ID NO: 567554 - DNA, 21 bp, Homo sapiens
gttatatttttcttaaaaagt

SEQ ID NO: 567555 - DNA, 23 bp, Homo sapiens
gttatatttttcttaaaaagtaa

SEQ ID NO: 567556 - DNA, 23 bp, Homo sapiens
gttatcctttgtgagcctatgat

SEQ ID NO: 567557 - DNA, 20 bp, Homo sapiens
gttattgagagagatgtgta

SEQ ID NO: 567558 - DNA, 14 bp, Homo sapiens
gtatccagaggtga

SEQ ID NO: 567559 - DNA, 17 bp, Homo sapiens
gtatcgtattcaccttc

SEQ ID NO: 567560 - DNA, 22 bp, Homo sapiens
gtatctgacatatttcataagc

SEQ ID NO: 567561 - DNA, 23 bp, Homo sapiens
gtatctgatgatgttctgaaatg

SEQ ID NO: 567562 - DNA, 16 bp, Homo sapiens
gtatgaatatttcatt

SEQ ID NO: 567563 - DNA, 22 bp, Homo sapiens
gtatgaatatttcattttgaga

SEQ ID NO: 567564 - DNA, 18 bp, Homo sapiens
gtatgcaagcagtttcaa

SEQ ID NO: 567565 - DNA, 16 bp, Homo sapiens
gtatgtgtatatgttt

SEQ ID NO: 567566 - DNA, 14 bp, Homo sapiens
gtatgttaatagaa

SEQ ID NO: 567567 - DNA, 14 bp, Homo sapiens
gtatgtttacactg

SEQ ID NO: 567568 - DNA, 13 bp, Homo sapiens
gtatgtttttcag

SEQ ID NO: 567569 - DNA, 20 bp, Homo sapiens
gtatgtttttcagttcaaag

SEQ ID NO: 567570 - DNA, 15 bp, Homo sapiens
gtattaatactaaaa

SEQ ID NO: 567571 - DNA, 19 bp, Homo sapiens
gtattaatactaaaatatg

SEQ ID NO: 567572 - DNA, 22 bp, Homo sapiens
gtattaatactaaaatatgtct

SEQ ID NO: 567573 - DNA, 13 bp, Homo sapiens
gtattcaagaaag

SEQ ID NO: 567574 - DNA, 17 bp, Homo sapiens
gtattcaagaaagccag

SEQ ID NO: 567575 - DNA, 13 bp, Homo sapiens
gtattcaggaccc

SEQ ID NO: 567576 - DNA, 21 bp, Homo sapiens
gtattcaggaccccatctgct

SEQ ID NO: 567577 - DNA, 15 bp, Homo sapiens
gtattgccaaacatt

SEQ ID NO: 567578 - DNA, 13 bp, Homo sapiens
gtatttaaaacat

SEQ ID NO: 567579 - DNA, 15 bp, Homo sapiens
gtatttaaaacattt

SEQ ID NO: 567580 - DNA, 17 bp, Homo sapiens
gtatttcggctatgtct

SEQ ID NO: 567581 - DNA, 18 bp, Homo sapiens
gtatttcggctatgtctc

SEQ ID NO: 567582 - DNA, 14 bp, Homo sapiens
gtatttctttagaa

SEQ ID NO: 567583 - DNA, 15 bp, Homo sapiens
gtatttgttaatttc

SEQ ID NO: 567584 - DNA, 13 bp, Homo sapiens
gtattttatgtat

SEQ ID NO: 567585 - DNA, 11 bp, Homo sapiens
gtcaaacatta

SEQ ID NO: 567586 - DNA, 13 bp, Homo sapiens
gtcaagcagaaaa

SEQ ID NO: 567587 - DNA, 14 bp, Homo sapiens
gtcaagtggcaaag

SEQ ID NO: 567588 - DNA, 13 bp, Homo sapiens
gtcaagtttttat

SEQ ID NO: 567589 - DNA, 15 bp, Homo sapiens
gtcaagtttttatac

SEQ ID NO: 567590 - DNA, 17 bp, Homo sapiens
gtcaatcccaaaagtca

SEQ ID NO: 567591 - DNA, 20 bp, Homo sapiens
gtcaatcccaaaagtcacca

SEQ ID NO: 567592 - DNA, 17 bp, Homo sapiens
gtcaccaccctgctcat

SEQ ID NO: 567593 - DNA, 18 bp, Homo sapiens
gtcaccactccattccca

SEQ ID NO: 567594 - DNA, 17 bp, Homo sapiens
gtcactgctgtaaagca

SEQ ID NO: 567595 - DNA, 22 bp, Homo sapiens
gtcactgttataaattttgtac

SEQ ID NO: 567596 - DNA, 14 bp, Homo sapiens
gtcacttcttctgt

SEQ ID NO: 567597 - DNA, 19 bp, Homo sapiens
gtcacttcttctgtccaag

SEQ ID NO: 567598 - DNA, 22 bp, Homo sapiens
gtcagaagagagggtgagtcct

SEQ ID NO: 567599 - DNA, 16 bp, Homo sapiens
gtcagcctcgcaggcc

SEQ ID NO: 567600 - DNA, 15 bp, Homo sapiens
gtcaggaggcagaag

SEQ ID NO: 567601 - DNA, 14 bp, Homo sapiens
gtcaggccgggcag

SEQ ID NO: 567602 - DNA, 19 bp, Homo sapiens
gtcaggccgggcagagcac

SEQ ID NO: 567603 - DNA, 20 bp, Homo sapiens
gtcaggctaatgttggcaga

SEQ ID NO: 567604 - DNA, 16 bp, Homo sapiens
gtcaggctctctgggc

SEQ ID NO: 567605 - DNA, 19 bp, Homo sapiens
gtcaggctctctgggctga

SEQ ID NO: 567606 - DNA, 18 bp, Homo sapiens
gtcaggttgacaggaggt

SEQ ID NO: 567607 - DNA, 19 bp, Homo sapiens
gtcagtgcccatgtgtatg

SEQ ID NO: 567608 - DNA, 19 bp, Homo sapiens
gtcagtgtactctgagtcc

SEQ ID NO: 567609 - DNA, 16 bp, Homo sapiens
gtcagtgtagatcaac

SEQ ID NO: 567610 - DNA, 20 bp, Homo sapiens
gtcatagtttttttcttttt

SEQ ID NO: 567611 - DNA, 17 bp, Homo sapiens
gtcatattttcctttat

SEQ ID NO: 567612 - DNA, 18 bp, Homo sapiens
gtcatcccggggccatgg

SEQ ID NO: 567613 - DNA, 13 bp, Homo sapiens
gtcatgatgtttt

SEQ ID NO: 567614 - DNA, 14 bp, Homo sapiens
gtcatgatgttttt

SEQ ID NO: 567615 - DNA, 16 bp, Homo sapiens
gtcatgatgtttttaa

SEQ ID NO: 567616 - DNA, 22 bp, Homo sapiens
gtcatgatgtttttaaaatctt

SEQ ID NO: 567617 - DNA, 19 bp, Homo sapiens
gtcatgctcccctgtgcca

SEQ ID NO: 567618 - DNA, 20 bp, Homo sapiens
gtcatgctcccctgtgccag

SEQ ID NO: 567619 - DNA, 17 bp, Homo sapiens
gtcatggtgcaatttgt

SEQ ID NO: 567620 - DNA, 19 bp, Homo sapiens
gtcatgtgcgaacacagtg

SEQ ID NO: 567621 - DNA, 18 bp, Homo sapiens
gtcatgttggtaccctgg

SEQ ID NO: 567622 - DNA, 12 bp, Homo sapiens
gtcattgcttct

SEQ ID NO: 567623 - DNA, 16 bp, Homo sapiens
gtcattgcttcttctg

SEQ ID NO: 567624 - DNA, 21 bp, Homo sapiens
gtcatttattttaaaaaatga

SEQ ID NO: 567625 - DNA, 12 bp, Homo sapiens
gtcatttctctt

SEQ ID NO: 567626 - DNA, 13 bp, Homo sapiens
gtcattttcatta

SEQ ID NO: 567627 - DNA, 16 bp, Homo sapiens
gtccacattctgctgc

SEQ ID NO: 567628 - DNA, 16 bp, Homo sapiens
gtccacgtgcgtgttt

SEQ ID NO: 567629 - DNA, 21 bp, Homo sapiens
gtccactggggtggcctgact

SEQ ID NO: 567630 - DNA, 15 bp, Homo sapiens
gtccacttttccagt

SEQ ID NO: 567631 - DNA, 19 bp, Homo sapiens
gtccacttttccagtattt

SEQ ID NO: 567632 - DNA, 22 bp, Homo sapiens
gtccacttttccagtattttag

SEQ ID NO: 567633 - DNA, 14 bp, Homo sapiens
gtccagacctgggc

SEQ ID NO: 567634 - DNA, 18 bp, Homo sapiens
gtccagacctgggccctg

SEQ ID NO: 567635 - DNA, 13 bp, Homo sapiens
gtccagagctgct

SEQ ID NO: 567636 - DNA, 12 bp, Homo sapiens
gtccagctctcc

SEQ ID NO: 567637 - DNA, 15 bp, Homo sapiens
gtccaggagctcagg

SEQ ID NO: 567638 - DNA, 16 bp, Homo sapiens
gtccatagctgtggtg

SEQ ID NO: 567639 - DNA, 13 bp, Homo sapiens
gtccattctcaag

SEQ ID NO: 567640 - DNA, 18 bp, Homo sapiens
gtcccaaggttctgggtg

SEQ ID NO: 567641 - DNA, 17 bp, Homo sapiens
gtcccatgtgagctgct

SEQ ID NO: 567642 - DNA, 20 bp, Homo sapiens
gtcccatgtgagctgctgcc

SEQ ID NO: 567643 - DNA, 11 bp, Homo sapiens
gtccccaaagt

SEQ ID NO: 567644 - DNA, 16 bp, Homo sapiens
gtccccagaccagtag

SEQ ID NO: 567645 - DNA, 21 bp, Homo sapiens
gtccccagaccagtagtgacc

SEQ ID NO: 567646 - DNA, 22 bp, Homo sapiens
gtccccagcccttcctctgctc

SEQ ID NO: 567647 - DNA, 15 bp, Homo sapiens
gtccctgagggccct

SEQ ID NO: 567648 - DNA, 18 bp, Homo sapiens
gtccctgagggcccttcc

SEQ ID NO: 567649 - DNA, 16 bp, Homo sapiens
gtccctggcttcctta

SEQ ID NO: 567650 - DNA, 20 bp, Homo sapiens
gtccctttcttctcccccat

SEQ ID NO: 567651 - DNA, 20 bp, Homo sapiens
gtccgacctggcctgtctgt

SEQ ID NO: 567652 - DNA, 17 bp, Homo sapiens
gtcctagacttcaggga

SEQ ID NO: 567653 - DNA, 17 bp, Homo sapiens
gtcctcattgttcagaa

SEQ ID NO: 567654 - DNA, 23 bp, Homo sapiens
gtcctcattgttcagaaaagcac

SEQ ID NO: 567655 - DNA, 14 bp, Homo sapiens
gtcctcctgctgcc

SEQ ID NO: 567656 - DNA, 16 bp, Homo sapiens
gtcctcctgctgccag

SEQ ID NO: 567657 - DNA, 13 bp, Homo sapiens
gtcctgcactgtc

SEQ ID NO: 567658 - DNA, 15 bp, Homo sapiens
gtcctgctcagcagt

SEQ ID NO: 567659 - DNA, 14 bp, Homo sapiens
gtcctggcagggca

SEQ ID NO: 567660 - DNA, 11 bp, Homo sapiens
gtcctgggggc

SEQ ID NO: 567661 - DNA, 17 bp, Homo sapiens
gtcctgtcctggctccc

SEQ ID NO: 567662 - DNA, 17 bp, Homo sapiens
gtcctgtgtcagtttat

SEQ ID NO: 567663 - DNA, 16 bp, Homo sapiens
gtccttatctagctgc

SEQ ID NO: 567664 - DNA, 18 bp, Homo sapiens
gtccttccaacctgttca

SEQ ID NO: 567665 - DNA, 18 bp, Homo sapiens
gtccttggggacatctca

SEQ ID NO: 567666 - DNA, 21 bp, Homo sapiens
gtcgagcctgggggctggagc

SEQ ID NO: 567667 - DNA, 22 bp, Homo sapiens
gtcggctccagtccccagaact

SEQ ID NO: 567668 - DNA, 13 bp, Homo sapiens
gtcgtccccagac

SEQ ID NO: 567669 - DNA, 15 bp, Homo sapiens
gtcgttttaaaaaca

SEQ ID NO: 567670 - DNA, 11 bp, Homo sapiens
gtctaaagatc

SEQ ID NO: 567671 - DNA, 19 bp, Homo sapiens
gtctaagaaacattggaag

SEQ ID NO: 567672 - DNA, 17 bp, Homo sapiens
gtctacagctcccccag

SEQ ID NO: 567673 - DNA, 18 bp, Homo sapiens
gtctacctgaaaattcaa

SEQ ID NO: 567674 - DNA, 21 bp, Homo sapiens
gtctagcgtagtgcagcaggg

SEQ ID NO: 567675 - DNA, 17 bp, Homo sapiens
gtctcagaatctttcct

SEQ ID NO: 567676 - DNA, 13 bp, Homo sapiens
gtctcatgtttta

SEQ ID NO: 567677 - DNA, 13 bp, Homo sapiens
gtctcgtcaggag

SEQ ID NO: 567678 - DNA, 15 bp, Homo sapiens
gtctcgtcaggaggt

SEQ ID NO: 567679 - DNA, 15 bp, Homo sapiens
gtctcttttttacaa

SEQ ID NO: 567680 - DNA, 14 bp, Homo sapiens
gtctgatctgggtt

SEQ ID NO: 567681 - DNA, 15 bp, Homo sapiens
gtctgccccctcctg

SEQ ID NO: 567682 - DNA, 22 bp, Homo sapiens
gtctggagaccaggactctgcc

SEQ ID NO: 567683 - DNA, 23 bp, Homo sapiens
gtctggagaccaggactctgcct

SEQ ID NO: 567684 - DNA, 23 bp, Homo sapiens
gtctggaggggagctctgtctgt

SEQ ID NO: 567685 - DNA, 16 bp, Homo sapiens
gtctggataatttgta

SEQ ID NO: 567686 - DNA, 22 bp, Homo sapiens
gtctggattcccgtggctttgt

SEQ ID NO: 567687 - DNA, 14 bp, Homo sapiens
gtctgtcatttctc

SEQ ID NO: 567688 - DNA, 17 bp, Homo sapiens
gtctgtccgtgttattt

SEQ ID NO: 567689 - DNA, 21 bp, Homo sapiens
gtctgtctctcttttgctctc

SEQ ID NO: 567690 - DNA, 21 bp, Homo sapiens
gtctgtgaaagtctcctgtat

SEQ ID NO: 567691 - DNA, 19 bp, Homo sapiens
gtctgtggctcctcccgaa

SEQ ID NO: 567692 - DNA, 20 bp, Homo sapiens
gtcttaaataaaagaaatgc

SEQ ID NO: 567693 - DNA, 15 bp, Homo sapiens
gtcttaattaagtaa

SEQ ID NO: 567694 - DNA, 13 bp, Homo sapiens
gtcttactttgtt

SEQ ID NO: 567695 - DNA, 16 bp, Homo sapiens
gtcttactttgttaat

SEQ ID NO: 567696 - DNA, 21 bp, Homo sapiens
gtcttactttgttaatttatc

SEQ ID NO: 567697 - DNA, 18 bp, Homo sapiens
gtcttaggatgtctgtaa

SEQ ID NO: 567698 - DNA, 14 bp, Homo sapiens
gtcttatgcttcca

SEQ ID NO: 567699 - DNA, 16 bp, Homo sapiens
gtcttcatgaaatgct

SEQ ID NO: 567700 - DNA, 17 bp, Homo sapiens
gtcttcatgttcccact

SEQ ID NO: 567701 - DNA, 17 bp, Homo sapiens
gctcaaggctgcagtga

SEQ ID NO: 567702 - DNA, 17 bp, Homo sapiens
gctcagagtgaagagtg

SEQ ID NO: 567703 - DNA, 21 bp, Homo sapiens
gctcagcacagcctcacccct

SEQ ID NO: 567704 - DNA, 15 bp, Homo sapiens
gctcagcattgtgta

SEQ ID NO: 567705 - DNA, 16 bp, Homo sapiens
gctcaggaagaagaga

SEQ ID NO: 567706 - DNA, 18 bp, Homo sapiens
gctcaggaagaagagatg

SEQ ID NO: 567707 - DNA, 17 bp, Homo sapiens
gctccacacacacaaaa

SEQ ID NO: 567708 - DNA, 20 bp, Homo sapiens
gctccacgggggcctagtgg

SEQ ID NO: 567709 - DNA, 21 bp, Homo sapiens
gctccacgggggcctagtggc

SEQ ID NO: 567710 - DNA, 15 bp, Homo sapiens
gctccatccttctcc

SEQ ID NO: 567711 - DNA, 17 bp, Homo sapiens
gctccatccttctcccc

SEQ ID NO: 567712 - DNA, 19 bp, Homo sapiens
gctccatccttctccccaa

SEQ ID NO: 567713 - DNA, 13 bp, Homo sapiens
gctcccaggacgc

SEQ ID NO: 567714 - DNA, 14 bp, Homo sapiens
gctcccagggtcct

SEQ ID NO: 567715 - DNA, 13 bp, Homo sapiens
gctcccccagctc

SEQ ID NO: 567716 - DNA, 13 bp, Homo sapiens
gctccccttcccc

SEQ ID NO: 567717 - DNA, 16 bp, Homo sapiens
gctccctcaaagaggc

SEQ ID NO: 567718 - DNA, 19 bp, Homo sapiens
gctccctcaaagaggcagt

SEQ ID NO: 567719 - DNA, 18 bp, Homo sapiens
gctccctccctcccagat

SEQ ID NO: 567720 - DNA, 22 bp, Homo sapiens
gctccctccctcccagatccag

SEQ ID NO: 567721 - DNA, 22 bp, Homo sapiens
gctccctgaatctgaccacaga

SEQ ID NO: 567722 - DNA, 23 bp, Homo sapiens
gctccgacttgtgcacaggcaga

SEQ ID NO: 567723 - DNA, 22 bp, Homo sapiens
gctccggcgtgtgttcagtgtt

SEQ ID NO: 567724 - DNA, 15 bp, Homo sapiens
gctcctcggccagag

SEQ ID NO: 567725 - DNA, 21 bp, Homo sapiens
gctcctcggccagagctccca

SEQ ID NO: 567726 - DNA, 23 bp, Homo sapiens
gctcctcggccagagctcccagg

SEQ ID NO: 567727 - DNA, 24 bp, Homo sapiens
gctcctcggccagagctcccagga

SEQ ID NO: 567728 - DNA, 22 bp, Homo sapiens
gctccttagggttttctctcta

SEQ ID NO: 567729 - DNA, 21 bp, Homo sapiens
gctccttcaacaaggcttgct

SEQ ID NO: 567730 - DNA, 15 bp, Homo sapiens
gctccttcccttgct

SEQ ID NO: 567731 - DNA, 22 bp, Homo sapiens
gctcgccttcggcctctcttgg

SEQ ID NO: 567732 - DNA, 23 bp, Homo sapiens
gctcgccttcggcctctcttgga

SEQ ID NO: 567733 - DNA, 13 bp, Homo sapiens
gctcgtgcatgta

SEQ ID NO: 567734 - DNA, 17 bp, Homo sapiens
gctctaggacccccagt

SEQ ID NO: 567735 - DNA, 18 bp, Homo sapiens
ggcgagtccaggagctca

SEQ ID NO: 567736 - DNA, 23 bp, Homo sapiens
ggcgagtccaggagctcaggaag

SEQ ID NO: 567737 - DNA, 18 bp, Homo sapiens
ggcgcacccggcagcccc

SEQ ID NO: 567738 - DNA, 15 bp, Homo sapiens
ggcgcgcagcccggg

SEQ ID NO: 567739 - DNA, 13 bp, Homo sapiens
ggcgtagggccag

SEQ ID NO: 567740 - DNA, 20 bp, Homo sapiens
ggcgtagggccagggctctg

SEQ ID NO: 567741 - DNA, 23 bp, Homo sapiens
ggcgtcaccatccaccttccctt

SEQ ID NO: 567742 - DNA, 15 bp, Homo sapiens
ggcgtgaaacacaat

SEQ ID NO: 567743 - DNA, 14 bp, Homo sapiens
ggcgtgtcccctgc

SEQ ID NO: 567744 - DNA, 20 bp, Homo sapiens
ggctaaatgcctaataaaca

SEQ ID NO: 567745 - DNA, 17 bp, Homo sapiens
ggctaagtccagctctc

SEQ ID NO: 567746 - DNA, 17 bp, Homo sapiens
ggctacccgtgagccct

SEQ ID NO: 567747 - DNA, 16 bp, Homo sapiens
ggctcagacacctaga

SEQ ID NO: 567748 - DNA, 12 bp, Homo sapiens
ggctccatgcca

SEQ ID NO: 567749 - DNA, 19 bp, Homo sapiens
ggctcccactgcccctgca

SEQ ID NO: 567750 - DNA, 21 bp, Homo sapiens
ggctcctctctaacctccttt

SEQ ID NO: 567751 - DNA, 22 bp, Homo sapiens
ggctccttagggttttctctct

SEQ ID NO: 567752 - DNA, 16 bp, Homo sapiens
ggctctctgggctgac

SEQ ID NO: 567753 - DNA, 19 bp, Homo sapiens
ggctctgacaaagcttccc

SEQ ID NO: 567754 - DNA, 20 bp, Homo sapiens
ggctctgacaaagcttcccg

SEQ ID NO: 567755 - DNA, 17 bp, Homo sapiens
ggctctgcgtcccactg

SEQ ID NO: 567756 - DNA, 20 bp, Homo sapiens
ggctctggcaggtggccagg

SEQ ID NO: 567757 - DNA, 23 bp, Homo sapiens
ggctctggcaggtggccagggct

SEQ ID NO: 567758 - DNA, 13 bp, Homo sapiens
ggctgcagagcct

SEQ ID NO: 567759 - DNA, 15 bp, Homo sapiens
ggctgccccacccct

SEQ ID NO: 567760 - DNA, 17 bp, Homo sapiens
ggctgccccacccctcc

SEQ ID NO: 567761 - DNA, 20 bp, Homo sapiens
ggctgccgtgcacggggcca

SEQ ID NO: 567762 - DNA, 19 bp, Homo sapiens
ggctggataggagaggaaa

SEQ ID NO: 567763 - DNA, 23 bp, Homo sapiens
ggctgggacttcttacccaaagc

SEQ ID NO: 567764 - DNA, 13 bp, Homo sapiens
ggctgggcagctg

SEQ ID NO: 567765 - DNA, 14 bp, Homo sapiens
ggctggggcagcct

SEQ ID NO: 567766 - DNA, 15 bp, Homo sapiens
ggctgtgggctccct

SEQ ID NO: 567767 - DNA, 18 bp, Homo sapiens
ggctgtgggctcccttcc

SEQ ID NO: 567768 - DNA, 20 bp, Homo sapiens
ggcttagcgttctgtttcac

SEQ ID NO: 567769 - DNA, 16 bp, Homo sapiens
ggcttatatttgtgta

SEQ ID NO: 567770 - DNA, 13 bp, Homo sapiens
ggcttcagccagt

SEQ ID NO: 567771 - DNA, 12 bp, Homo sapiens
ggcttcagcccc

SEQ ID NO: 567772 - DNA, 22 bp, Homo sapiens
ggcttcagggtgggagtagttg

SEQ ID NO: 567773 - DNA, 10 bp, Homo sapiens
ggcttcctgt

SEQ ID NO: 567774 - DNA, 17 bp, Homo sapiens
ggcttctccctggactc

SEQ ID NO: 567775 - DNA, 20 bp, Homo sapiens
ggcttctccctggactctgt

SEQ ID NO: 567776 - DNA, 22 bp, Homo sapiens
ggcttctctgctgagaaggcaa

SEQ ID NO: 567777 - DNA, 15 bp, Homo sapiens
ggcttgagtctggat

SEQ ID NO: 567778 - DNA, 19 bp, Homo sapiens
ggctttcctgtgccaggtg

SEQ ID NO: 567779 - DNA, 21 bp, Homo sapiens
gggaaagccttaagctgcagg

SEQ ID NO: 567780 - DNA, 22 bp, Homo sapiens
gggaagcaaaaacgaaagctgg

SEQ ID NO: 567781 - DNA, 22 bp, Homo sapiens
gggaaggaagaggaagagtgca

SEQ ID NO: 567782 - DNA, 18 bp, Homo sapiens
gggaaggggggtcagaag

SEQ ID NO: 567783 - DNA, 17 bp, Homo sapiens
gggaattaaaaagaaga

SEQ ID NO: 567784 - DNA, 22 bp, Homo sapiens
gggaattaaaaagaagatgaat

SEQ ID NO: 567785 - DNA, 14 bp, Homo sapiens
gggacacagagacc

SEQ ID NO: 567786 - DNA, 22 bp, Homo sapiens
gggacatgaaataaatgcccca

SEQ ID NO: 567787 - DNA, 11 bp, Homo sapiens
gggagacaaag

SEQ ID NO: 567788 - DNA, 16 bp, Homo sapiens
gggagaccctgggaga

SEQ ID NO: 567789 - DNA, 20 bp, Homo sapiens
gggagatccgccctgggctc

SEQ ID NO: 567790 - DNA, 23 bp, Homo sapiens
gggagatccgccctgggctctgg

SEQ ID NO: 567791 - DNA, 13 bp, Homo sapiens
gggagccaggagg

SEQ ID NO: 567792 - DNA, 16 bp, Homo sapiens
gggagctcctggccag

SEQ ID NO: 567793 - DNA, 14 bp, Homo sapiens
gggagctctgtctg

SEQ ID NO: 567794 - DNA, 11 bp, Homo sapiens
gggaggctgag

SEQ ID NO: 567795 - DNA, 15 bp, Homo sapiens
gggaggggtggtact

SEQ ID NO: 567796 - DNA, 18 bp, Homo sapiens
gggaggggtggtacttgg

SEQ ID NO: 567797 - DNA, 20 bp, Homo sapiens
gggaggggtggtacttggca

SEQ ID NO: 567798 - DNA, 21 bp, Homo sapiens
gggagtagcaaggaaggacac

SEQ ID NO: 567799 - DNA, 21 bp, Homo sapiens
gggatatttcctaaggcatgt

SEQ ID NO: 567800 - DNA, 15 bp, Homo sapiens
gggatgggcacaggc

SEQ ID NO: 567801 - DNA, 22 bp, Homo sapiens
gggatgtgtgtgtgcagagctg

SEQ ID NO: 567802 - DNA, 18 bp, Homo sapiens
gggcacctataataccag

SEQ ID NO: 567803 - DNA, 19 bp, Homo sapiens
gggcagctgttagagtcca

SEQ ID NO: 567804 - DNA, 17 bp, Homo sapiens
gggcatccccagccccc

SEQ ID NO: 567805 - DNA, 18 bp, Homo sapiens
gggcattctctctccaag

SEQ ID NO: 567806 - DNA, 22 bp, Homo sapiens
gggccacctccccaggccgtgg

SEQ ID NO: 567807 - DNA, 12 bp, Homo sapiens
gggccagggctc

SEQ ID NO: 567808 - DNA, 19 bp, Homo sapiens
gggccatggaagctggcag

SEQ ID NO: 567809 - DNA, 21 bp, Homo sapiens
gggcccacccaagcaggaggc

SEQ ID NO: 567810 - DNA, 12 bp, Homo sapiens
gggcccagaggg

SEQ ID NO: 567811 - DNA, 14 bp, Homo sapiens
gggccctgcagctc

SEQ ID NO: 567812 - DNA, 22 bp, Homo sapiens
gggccgggctggcttctccctg

SEQ ID NO: 567813 - DNA, 23 bp, Homo sapiens
gggcctagtggcttcagcccctg

SEQ ID NO: 567814 - DNA, 18 bp, Homo sapiens
gggcctgaaagcaacagc

SEQ ID NO: 567815 - DNA, 19 bp, Homo sapiens
gggcctgacctccccctcc

SEQ ID NO: 567816 - DNA, 18 bp, Homo sapiens
gggcctgaggctccttag

SEQ ID NO: 567817 - DNA, 20 bp, Homo sapiens
gggctacccgtgagcccttc

SEQ ID NO: 567818 - DNA, 13 bp, Homo sapiens
gggctagcactgg

SEQ ID NO: 567819 - DNA, 21 bp, Homo sapiens
gggctccacttcatccagatg

SEQ ID NO: 567820 - DNA, 13 bp, Homo sapiens
gggctctgcgtcc

SEQ ID NO: 567821 - DNA, 20 bp, Homo sapiens
gggctgactgggccagggga

SEQ ID NO: 567822 - DNA, 15 bp, Homo sapiens
gggctgcagagcctg

SEQ ID NO: 567823 - DNA, 21 bp, Homo sapiens
gggctgccgtgcacggggcca

SEQ ID NO: 567824 - DNA, 16 bp, Homo sapiens
gggctgctgcactgcc

SEQ ID NO: 567825 - DNA, 13 bp, Homo sapiens
gggctgggcagct

SEQ ID NO: 567826 - DNA, 22 bp, Homo sapiens
gggctgggcccacccaagcagg

SEQ ID NO: 567827 - DNA, 22 bp, Homo sapiens
gggctggggcaggaggggagtg

SEQ ID NO: 567828 - DNA, 13 bp, Homo sapiens
ggggagctcctgg

SEQ ID NO: 567829 - DNA, 13 bp, Homo sapiens
ggggcacagggag

SEQ ID NO: 567830 - DNA, 12 bp, Homo sapiens
ggggcagcctct

SEQ ID NO: 567831 - DNA, 21 bp, Homo sapiens
ggggcctgacctccccctcct

SEQ ID NO: 567832 - DNA, 18 bp, Homo sapiens
ggggctggggcaggaggg

SEQ ID NO: 567833 - DNA, 17 bp, Homo sapiens
gggggccacctccccag

SEQ ID NO: 567834 - DNA, 18 bp, Homo sapiens
gggggcctgacctccccc

SEQ ID NO: 567835 - DNA, 13 bp, Homo sapiens
gggggctggggca

SEQ ID NO: 567836 - DNA, 18 bp, Homo sapiens
ggggtcccctccaggagt

SEQ ID NO: 567837 - DNA, 20 bp, Homo sapiens
ggggtggtacttggcaccaa

SEQ ID NO: 567838 - DNA, 18 bp, Homo sapiens
ggggtttccacacaggcc

SEQ ID NO: 567839 - DNA, 19 bp, Homo sapiens
ggggtttccacacaggccc

SEQ ID NO: 567840 - DNA, 17 bp, Homo sapiens
gggtcaggccacggcag

SEQ ID NO: 567841 - DNA, 17 bp, Homo sapiens
gggtcaggccgggcaga

SEQ ID NO: 567842 - DNA, 18 bp, Homo sapiens
gggtcaggttgacaggag

SEQ ID NO: 567843 - DNA, 19 bp, Homo sapiens
gggtcaggttgacaggagg

SEQ ID NO: 567844 - DNA, 20 bp, Homo sapiens
gggtcaggttgacaggaggt

SEQ ID NO: 567845 - DNA, 17 bp, Homo sapiens
gggtcatattcatacct

SEQ ID NO: 567846 - DNA, 17 bp, Homo sapiens
gggtcccctccaggagt

SEQ ID NO: 567847 - DNA, 12 bp, Homo sapiens
gggtgacctgct

SEQ ID NO: 567848 - DNA, 19 bp, Homo sapiens
gggtggaggagagcctggt

SEQ ID NO: 567849 - DNA, 13 bp, Homo sapiens
gggttcgggaaga

SEQ ID NO: 567850 - DNA, 12 bp, Homo sapiens
gggttttctctc

SEQ ID NO: 567851 - DNA, 13 bp, Homo sapiens
ggtaaatattttc

SEQ ID NO: 567852 - DNA, 17 bp, Homo sapiens
ggtaccaaaaaagaaag

SEQ ID NO: 567853 - DNA, 12 bp, Homo sapiens
ggtaccttgcac

SEQ ID NO: 567854 - DNA, 14 bp, Homo sapiens
ggtagaacgccagg

SEQ ID NO: 567855 - DNA, 14 bp, Homo sapiens
ggtagggctctgac

SEQ ID NO: 567856 - DNA, 19 bp, Homo sapiens
ggtagtagaatctcagcac

SEQ ID NO: 567857 - DNA, 12 bp, Homo sapiens
ggtatccagagg

SEQ ID NO: 567858 - DNA, 13 bp, Homo sapiens
ggtcaatcccaaa

SEQ ID NO: 567859 - DNA, 13 bp, Homo sapiens
ggtcacagccagg

SEQ ID NO: 567860 - DNA, 14 bp, Homo sapiens
ggtcacagccaggc

SEQ ID NO: 567861 - DNA, 14 bp, Homo sapiens
ggtcacccccaccc

SEQ ID NO: 567862 - DNA, 19 bp, Homo sapiens
ggtcaggttgacaggaggt

SEQ ID NO: 567863 - DNA, 19 bp, Homo sapiens
ggtcatgatgctctttccc

SEQ ID NO: 567864 - DNA, 20 bp, Homo sapiens
ggtcatgatgctctttccca

SEQ ID NO: 567865 - DNA, 20 bp, Homo sapiens
ggtcattaaggccacatcca

SEQ ID NO: 567866 - DNA, 17 bp, Homo sapiens
ggtccacattctgctgc

SEQ ID NO: 567867 - DNA, 20 bp, Homo sapiens
ggtccacttttccagtattt

SEQ ID NO: 567868 - DNA, 21 bp, Homo sapiens
ggtcccgaatggagtccagac

SEQ ID NO: 567869 - DNA, 21 bp, Homo sapiens
ggtccgagtgtgtttcatcct

SEQ ID NO: 567870 - DNA, 21 bp, Homo sapiens
ggtcctgggggcctgacctcc

SEQ ID NO: 567871 - DNA, 21 bp, Homo sapiens
ggtcgttttaaaaacaaaaat

SEQ ID NO: 567872 - DNA, 13 bp, Homo sapiens
ggtctaatgttta

SEQ ID NO: 567873 - DNA, 15 bp, Homo sapiens
ggtctcagaggaggg

SEQ ID NO: 567874 - DNA, 13 bp, Homo sapiens
ggtctctctggct

SEQ ID NO: 567875 - DNA, 14 bp, Homo sapiens
ggtctggaggacct

SEQ ID NO: 567876 - DNA, 21 bp, Homo sapiens
ggtctgtggctcctcccgaaa

SEQ ID NO: 567877 - DNA, 18 bp, Homo sapiens
ggtcttactttgttaatt

SEQ ID NO: 567878 - DNA, 10 bp, Homo sapiens
ggtcttccta

SEQ ID NO: 567879 - DNA, 15 bp, Homo sapiens
ggtctttttaaacca

SEQ ID NO: 567880 - DNA, 15 bp, Homo sapiens
ggtgaactgaagcag

SEQ ID NO: 567881 - DNA, 17 bp, Homo sapiens
ggtgaactgaagcagag

SEQ ID NO: 567882 - DNA, 18 bp, Homo sapiens
ggtgaaggaggctccagg

SEQ ID NO: 567883 - DNA, 22 bp, Homo sapiens
ggtgaaggaggctccaggcagc

SEQ ID NO: 567884 - DNA, 23 bp, Homo sapiens
ggtgacagtgaggtcctgggggc

SEQ ID NO: 567885 - DNA, 15 bp, Homo sapiens
ggtgagggaggcctg

SEQ ID NO: 567886 - DNA, 22 bp, Homo sapiens
ggtgccccccatgccctccctg

SEQ ID NO: 567887 - DNA, 15 bp, Homo sapiens
ggtgcctgagagcag

SEQ ID NO: 567888 - DNA, 17 bp, Homo sapiens
ggtgctaattaataaag

SEQ ID NO: 567889 - DNA, 10 bp, Homo sapiens
ggtgctttcc

SEQ ID NO: 567890 - DNA, 21 bp, Homo sapiens
ggtgggcccagaccactgtct

SEQ ID NO: 567891 - DNA, 22 bp, Homo sapiens
ggtggtaaatattttcaaagag

SEQ ID NO: 567892 - DNA, 18 bp, Homo sapiens
ggtgtaatcatgaaggag

SEQ ID NO: 567893 - DNA, 15 bp, Homo sapiens
ggtgtctttctcttt

SEQ ID NO: 567894 - DNA, 19 bp, Homo sapiens
ggtgtgaggacataaatct

SEQ ID NO: 567895 - DNA, 16 bp, Homo sapiens
ggtgtgaggcaggaga

SEQ ID NO: 567896 - DNA, 11 bp, Homo sapiens
ggttaaaactg

SEQ ID NO: 567897 - DNA, 13 bp, Homo sapiens
ggttaaatgtttt

SEQ ID NO: 567898 - DNA, 14 bp, Homo sapiens
ggttaaatgttttg

SEQ ID NO: 567899 - DNA, 17 bp, Homo sapiens
ggttatagtgcaatata

SEQ ID NO: 567900 - DNA, 15 bp, Homo sapiens
ggttcagtgtttctg

SEQ ID NO: 567901 - DNA, 13 bp, Homo sapiens
ggttcccccagga

SEQ ID NO: 567902 - DNA, 21 bp, Homo sapiens
ggttccggaatcctgtcctca

SEQ ID NO: 567903 - DNA, 13 bp, Homo sapiens
ggttctttgtgta

SEQ ID NO: 567904 - DNA, 14 bp, Homo sapiens
ggttgacaggaggt

SEQ ID NO: 567905 - DNA, 12 bp, Homo sapiens
ggtttactctgt

SEQ ID NO: 567906 - DNA, 15 bp, Homo sapiens
ggtttctcttctccc

SEQ ID NO: 567907 - DNA, 19 bp, Homo sapiens
ggtttggttttgttttttg

SEQ ID NO: 567908 - DNA, 19 bp, Homo sapiens
ggtttgtgggtccaggaga

SEQ ID NO: 567909 - DNA, 12 bp, Homo sapiens
ggttttaaaata

SEQ ID NO: 567910 - DNA, 14 bp, Homo sapiens
gtaaaaactgaagt

SEQ ID NO: 567911 - DNA, 15 bp, Homo sapiens
gtaaacctgaacaaa

SEQ ID NO: 567912 - DNA, 22 bp, Homo sapiens
gtaaatattttcaaagagatgg

SEQ ID NO: 567913 - DNA, 19 bp, Homo sapiens
gtaaatctcttctgtgttt

SEQ ID NO: 567914 - DNA, 16 bp, Homo sapiens
gtaaattccaaagatc

SEQ ID NO: 567915 - DNA, 22 bp, Homo sapiens
gtaactgctcttgggcaatatt

SEQ ID NO: 567916 - DNA, 12 bp, Homo sapiens
gtaactgttacc

SEQ ID NO: 567917 - DNA, 17 bp, Homo sapiens
gtaactgttaccattgg

SEQ ID NO: 567918 - DNA, 20 bp, Homo sapiens
gtaactgttaccattggaaa

SEQ ID NO: 567919 - DNA, 24 bp, Homo sapiens
gtaagggactccagaagcagcagc

SEQ ID NO: 567920 - DNA, 16 bp, Homo sapiens
gtaatagcctcacctt

SEQ ID NO: 567921 - DNA, 18 bp, Homo sapiens
gtaatatcagttacagtg

SEQ ID NO: 567922 - DNA, 15 bp, Homo sapiens
gtaatcatattagac

SEQ ID NO: 567923 - DNA, 16 bp, Homo sapiens
gtaattacctggagaa

SEQ ID NO: 567924 - DNA, 17 bp, Homo sapiens
gtaattacctggagaag

SEQ ID NO: 567925 - DNA, 21 bp, Homo sapiens
gtaattgttccagagacaaat

SEQ ID NO: 567926 - DNA, 15 bp, Homo sapiens
gtaatttataaaatt

SEQ ID NO: 567927 - DNA, 14 bp, Homo sapiens
gtacaaaagggaca

SEQ ID NO: 567928 - DNA, 11 bp, Homo sapiens
gtacacacaca

SEQ ID NO: 567929 - DNA, 15 bp, Homo sapiens
gtacacacacagaca

SEQ ID NO: 567930 - DNA, 19 bp, Homo sapiens
gtacacacacagacacaca

SEQ ID NO: 567931 - DNA, 16 bp, Homo sapiens
gtacagatcaagaaaa

SEQ ID NO: 567932 - DNA, 14 bp, Homo sapiens
gtacaggtactttg

SEQ ID NO: 567933 - DNA, 15 bp, Homo sapiens
gtacaggtactttgt

SEQ ID NO: 567934 - DNA, 16 bp, Homo sapiens
gtacaggtactttgtc

SEQ ID NO: 567935 - DNA, 21 bp, Homo sapiens
gtacatctcccctttgctaac

SEQ ID NO: 567936 - DNA, 23 bp, Homo sapiens
gtacatttttgatcaaatgtaca

SEQ ID NO: 567937 - DNA, 24 bp, Homo sapiens
gtacatttttgatcaaatgtacat

SEQ ID NO: 567938 - DNA, 18 bp, Homo sapiens
gtaccactgaatctgtac

SEQ ID NO: 567939 - DNA, 19 bp, Homo sapiens
gtaccactgaatctgtaca

SEQ ID NO: 567940 - DNA, 15 bp, Homo sapiens
gtaccattaaaatat

SEQ ID NO: 567941 - DNA, 16 bp, Homo sapiens
gtaccattaaaatatg

SEQ ID NO: 567942 - DNA, 18 bp, Homo sapiens
gtaccattaaaatatgca

SEQ ID NO: 567943 - DNA, 13 bp, Homo sapiens
gtactaaacattt

SEQ ID NO: 567944 - DNA, 18 bp, Homo sapiens
gtactaaacatttccttt

SEQ ID NO: 567945 - DNA, 17 bp, Homo sapiens
gtactaaggagaaatga

SEQ ID NO: 567946 - DNA, 18 bp, Homo sapiens
gtactctgagtcctcatt

SEQ ID NO: 567947 - DNA, 14 bp, Homo sapiens
gtactggatttaac

SEQ ID NO: 567948 - DNA, 20 bp, Homo sapiens
gtactttctgtactaaacat

SEQ ID NO: 567949 - DNA, 16 bp, Homo sapiens
gtactttgattcacat

SEQ ID NO: 567950 - DNA, 17 bp, Homo sapiens
gtactttgattcacatg

SEQ ID NO: 567951 - DNA, 20 bp, Homo sapiens
gtactttgattcacatgttt

SEQ ID NO: 567952 - DNA, 21 bp, Homo sapiens
gtactttgattcacatgtttt

SEQ ID NO: 567953 - DNA, 23 bp, Homo sapiens
gtactttgtctaagaaacattgg

SEQ ID NO: 567954 - DNA, 20 bp, Homo sapiens
gtagaaattttatctcttct

SEQ ID NO: 567955 - DNA, 22 bp, Homo sapiens
gtagaacgccagggaccccaga

SEQ ID NO: 567956 - DNA, 16 bp, Homo sapiens
gtagactatatacatg

SEQ ID NO: 567957 - DNA, 16 bp, Homo sapiens
gtagagtcaggagaaa

SEQ ID NO: 567958 - DNA, 17 bp, Homo sapiens
gtagagtcctaggacat

SEQ ID NO: 567959 - DNA, 21 bp, Homo sapiens
gtagcaaaccctgtcaaacat

SEQ ID NO: 567960 - DNA, 15 bp, Homo sapiens
gtagcaaggaaggac

SEQ ID NO: 567961 - DNA, 13 bp, Homo sapiens
gtagcatatataa

SEQ ID NO: 567962 - DNA, 17 bp, Homo sapiens
gtagctcgtgtgcttag

SEQ ID NO: 567963 - DNA, 19 bp, Homo sapiens
gtagctgtggggagctggt

SEQ ID NO: 567964 - DNA, 15 bp, Homo sapiens
gtagcttaagaaaaa

SEQ ID NO: 567965 - DNA, 11 bp, Homo sapiens
gtagctttgca

SEQ ID NO: 567966 - DNA, 13 bp, Homo sapiens
gtagctttgcact

SEQ ID NO: 567967 - DNA, 19 bp, Homo sapiens
gtagctttgggcagatttg

SEQ ID NO: 567968 - DNA, 19 bp, Homo sapiens
gtaggaatattatatttgg

SEQ ID NO: 567969 - DNA, 20 bp, Homo sapiens
gtaggacaaggtgcaggcag

SEQ ID NO: 567970 - DNA, 22 bp, Homo sapiens
gtaggatatgcctgctctttgg

SEQ ID NO: 567971 - DNA, 18 bp, Homo sapiens
gtaggcaagatggcacag

SEQ ID NO: 567972 - DNA, 15 bp, Homo sapiens
gtagggccagggctc

SEQ ID NO: 567973 - DNA, 16 bp, Homo sapiens
gtagggccagggctct

SEQ ID NO: 567974 - DNA, 18 bp, Homo sapiens
gtaggggtaccactgaat

SEQ ID NO: 567975 - DNA, 22 bp, Homo sapiens
gtagggtcaggccacggcagcc

SEQ ID NO: 567976 - DNA, 17 bp, Homo sapiens
gtagtagaatctcagca

SEQ ID NO: 567977 - DNA, 20 bp, Homo sapiens
gtagttgaggaaagcacaga

SEQ ID NO: 567978 - DNA, 11 bp, Homo sapiens
gtataaacatt

SEQ ID NO: 567979 - DNA, 22 bp, Homo sapiens
gtataaagaataggacttgttt

SEQ ID NO: 567980 - DNA, 17 bp, Homo sapiens
gtataaatttttaagtg

SEQ ID NO: 567981 - DNA, 17 bp, Homo sapiens
gtataagtgcacacaga

SEQ ID NO: 567982 - DNA, 18 bp, Homo sapiens
gtatacaatatataaaaa

SEQ ID NO: 567983 - DNA, 21 bp, Homo sapiens
gtatagaagtcttcatgaaat

SEQ ID NO: 567984 - DNA, 21 bp, Homo sapiens
gtatagacaggagaagaaaga

SEQ ID NO: 567985 - DNA, 14 bp, Homo sapiens
gtatagtatttgaa

SEQ ID NO: 567986 - DNA, 15 bp, Homo sapiens
gtatagtatttgaaa

SEQ ID NO: 567987 - DNA, 18 bp, Homo sapiens
gtatatacacatatacct

SEQ ID NO: 567988 - DNA, 23 bp, Homo sapiens
gtatatataaacagaactccctt

SEQ ID NO: 567989 - DNA, 11 bp, Homo sapiens
gtatatataca

SEQ ID NO: 567990 - DNA, 15 bp, Homo sapiens
gtatatatacataca

SEQ ID NO: 567991 - DNA, 13 bp, Homo sapiens
gtatatatatgtg

SEQ ID NO: 567992 - DNA, 14 bp, Homo sapiens
gtatatattttgaa

SEQ ID NO: 567993 - DNA, 20 bp, Homo sapiens
gtatatccttttctgtgttt

SEQ ID NO: 567994 - DNA, 23 bp, Homo sapiens
gtatatgaggatgtatgtgtata

SEQ ID NO: 567995 - DNA, 19 bp, Homo sapiens
gtatatgtttatacacaca

SEQ ID NO: 567996 - DNA, 22 bp, Homo sapiens
gtatatgtttatacacacagga

SEQ ID NO: 567997 - DNA, 18 bp, Homo sapiens
gtatattgaaaagaaaaa

SEQ ID NO: 567998 - DNA, 19 bp, Homo sapiens
gtatcatctaaatattatg

SEQ ID NO: 567999 - DNA, 17 bp, Homo sapiens
ctccccaaggccccctg

SEQ ID NO: 568000 - DNA, 21 bp, Homo sapiens
ctccccaaggccccctgcctg

SEQ ID NO: 568001 - DNA, 22 bp, Homo sapiens
ctccccaaggtctgtggctcct

SEQ ID NO: 568002 - DNA, 18 bp, Homo sapiens
ctccccaggacttggtct

SEQ ID NO: 568003 - DNA, 19 bp, Homo sapiens
ctccccaggacttggtctt

SEQ ID NO: 568004 - DNA, 15 bp, Homo sapiens
ctccccctccttccc

SEQ ID NO: 568005 - DNA, 17 bp, Homo sapiens
ctccccctccttcccag

SEQ ID NO: 568006 - DNA, 13 bp, Homo sapiens
ctcccctccaagt

SEQ ID NO: 568007 - DNA, 15 bp, Homo sapiens
ctcccctggtcctgc

SEQ ID NO: 568008 - DNA, 23 bp, Homo sapiens
ctcccctgtgccagcccagaggc

SEQ ID NO: 568009 - DNA, 19 bp, Homo sapiens
ctccccttccccttccttc

SEQ ID NO: 568010 - DNA, 23 bp, Homo sapiens
ctcccgcccaaacctttccccca

SEQ ID NO: 568011 - DNA, 16 bp, Homo sapiens
ctcccggccctgcctg

SEQ ID NO: 568012 - DNA, 18 bp, Homo sapiens
ctcccggccctgcctgct

SEQ ID NO: 568013 - DNA, 18 bp, Homo sapiens
ctccctccgggtcttcct

SEQ ID NO: 568014 - DNA, 21 bp, Homo sapiens
ctccctgaatctgaccacaga

SEQ ID NO: 568015 - DNA, 22 bp, Homo sapiens
ctccctgaatctgaccacagac

SEQ ID NO: 568016 - DNA, 13 bp, Homo sapiens
ctccctgctgcca

SEQ ID NO: 568017 - DNA, 18 bp, Homo sapiens
ctccctggactctgtggg

SEQ ID NO: 568018 - DNA, 14 bp, Homo sapiens
ctccctgtctgtct

SEQ ID NO: 568019 - DNA, 15 bp, Homo sapiens
ctcccttgacctgct

SEQ ID NO: 568020 - DNA, 17 bp, Homo sapiens
ctcccttgacctgctga

SEQ ID NO: 568021 - DNA, 13 bp, Homo sapiens
ctccgcgggggac

SEQ ID NO: 568022 - DNA, 20 bp, Homo sapiens
ctccgcgggggacaggaaca

SEQ ID NO: 568023 - DNA, 17 bp, Homo sapiens
ctcctaaagtagacttc

SEQ ID NO: 568024 - DNA, 22 bp, Homo sapiens
ctcctaagcaactaggccttca

SEQ ID NO: 568025 - DNA, 23 bp, Homo sapiens
ctcctaggtagccccctcttccc

SEQ ID NO: 568026 - DNA, 15 bp, Homo sapiens
ctcctcccgaaaccc

SEQ ID NO: 568027 - DNA, 15 bp, Homo sapiens
ctcctccctgatgta

SEQ ID NO: 568028 - DNA, 16 bp, Homo sapiens
ctcctccctgatgtac

SEQ ID NO: 568029 - DNA, 19 bp, Homo sapiens
ctcctccctgatgtacagt

SEQ ID NO: 568030 - DNA, 13 bp, Homo sapiens
ctcctcctccagt

SEQ ID NO: 568031 - DNA, 17 bp, Homo sapiens
ctcctcggccagagctc

SEQ ID NO: 568032 - DNA, 21 bp, Homo sapiens
ctcctcggccagagctcccag

SEQ ID NO: 568033 - DNA, 17 bp, Homo sapiens
ctcctctatcctgggct

SEQ ID NO: 568034 - DNA, 17 bp, Homo sapiens
ctcctgcccccacacct

SEQ ID NO: 568035 - DNA, 22 bp, Homo sapiens
ctcctgcccccacacctggccc

SEQ ID NO: 568036 - DNA, 13 bp, Homo sapiens
ctcctgctgagtg

SEQ ID NO: 568037 - DNA, 20 bp, Homo sapiens
ctcctgctgagtggtccaca

SEQ ID NO: 568038 - DNA, 21 bp, Homo sapiens
ctcctggcgagttctctttgg

SEQ ID NO: 568039 - DNA, 16 bp, Homo sapiens
ctcctgggccagggtc

SEQ ID NO: 568040 - DNA, 17 bp, Homo sapiens
ctcctgggccagggtct

SEQ ID NO: 568041 - DNA, 20 bp, Homo sapiens
ctcctgtggcctgccagtca

SEQ ID NO: 568042 - DNA, 16 bp, Homo sapiens
ctccttaaaaatgtat

SEQ ID NO: 568043 - DNA, 22 bp, Homo sapiens
ctccttaaaaatgtatgttggt

SEQ ID NO: 568044 - DNA, 20 bp, Homo sapiens
ctccttagggttttctctct

SEQ ID NO: 568045 - DNA, 10 bp, Homo sapiens
ctccttccca

SEQ ID NO: 568046 - DNA, 19 bp, Homo sapiens
ctccttcccactcttctca

SEQ ID NO: 568047 - DNA, 20 bp, Homo sapiens
ctccttcctagttcatccct

SEQ ID NO: 568048 - DNA, 21 bp, Homo sapiens
ctcctttaccctcatctgtct

SEQ ID NO: 568049 - DNA, 18 bp, Homo sapiens
ctcctttggaaggtgaca

SEQ ID NO: 568050 - DNA, 19 bp, Homo sapiens
ctccttttccagagcattc

SEQ ID NO: 568051 - DNA, 23 bp, Homo sapiens
ctcgcactacatctgatatcagg

SEQ ID NO: 568052 - DNA, 18 bp, Homo sapiens
ctcgcaggcctccctgcc

SEQ ID NO: 568053 - DNA, 14 bp, Homo sapiens
ctcgccttcggcct

SEQ ID NO: 568054 - DNA, 17 bp, Homo sapiens
ctcgctggcccccactg

SEQ ID NO: 568055 - DNA, 23 bp, Homo sapiens
ctcggaacctgtgagctgcacca

SEQ ID NO: 568056 - DNA, 15 bp, Homo sapiens
ctcggagttcttctt

SEQ ID NO: 568057 - DNA, 21 bp, Homo sapiens
ctcggcaactaagcagtccct

SEQ ID NO: 568058 - DNA, 18 bp, Homo sapiens
ctcggccagagctcccag

SEQ ID NO: 568059 - DNA, 23 bp, Homo sapiens
ctcgtatagaagtcttcatgaaa

SEQ ID NO: 568060 - DNA, 16 bp, Homo sapiens
ctcgtcaggaggtgcc

SEQ ID NO: 568061 - DNA, 13 bp, Homo sapiens
ctcgtctttccca

SEQ ID NO: 568062 - DNA, 14 bp, Homo sapiens
ctcgtgcatgtaat

SEQ ID NO: 568063 - DNA, 20 bp, Homo sapiens
ctctaactgtgcaaagcaga

SEQ ID NO: 568064 - DNA, 12 bp, Homo sapiens
ctctaagatgtt

SEQ ID NO: 568065 - DNA, 17 bp, Homo sapiens
ctctaagatgttatatt

SEQ ID NO: 568066 - DNA, 13 bp, Homo sapiens
ctctacccctttc

SEQ ID NO: 568067 - DNA, 14 bp, Homo sapiens
ctctacccctttct

SEQ ID NO: 568068 - DNA, 20 bp, Homo sapiens
ctctactaatgcctcttcat

SEQ ID NO: 568069 - DNA, 23 bp, Homo sapiens
ctctagagaagtggactggagga

SEQ ID NO: 568070 - DNA, 16 bp, Homo sapiens
ctctagccctgcccgg

SEQ ID NO: 568071 - DNA, 15 bp, Homo sapiens
ctctaggacccccag

SEQ ID NO: 568072 - DNA, 16 bp, Homo sapiens
ctctatgccccaaata

SEQ ID NO: 568073 - DNA, 18 bp, Homo sapiens
ctctatttccccctttct

SEQ ID NO: 568074 - DNA, 18 bp, Homo sapiens
ctctccagtcttccacct

SEQ ID NO: 568075 - DNA, 21 bp, Homo sapiens
ctctccagtcttccacctgga

SEQ ID NO: 568076 - DNA, 22 bp, Homo sapiens
ctctccagtcttccacctggaa

SEQ ID NO: 568077 - DNA, 18 bp, Homo sapiens
ctctccattcttttaaat

SEQ ID NO: 568078 - DNA, 22 bp, Homo sapiens
ctctccattttggtgtctttct

SEQ ID NO: 568079 - DNA, 15 bp, Homo sapiens
ctctcccctcccttg

SEQ ID NO: 568080 - DNA, 16 bp, Homo sapiens
ctctcccctcccttgt

SEQ ID NO: 568081 - DNA, 17 bp, Homo sapiens
ctctcccctgcgcaggc

SEQ ID NO: 568082 - DNA, 18 bp, Homo sapiens
ctctcctgggccagggtc

SEQ ID NO: 568083 - DNA, 15 bp, Homo sapiens
ctctcgcacacctct

SEQ ID NO: 568084 - DNA, 21 bp, Homo sapiens
ctctctaaactggtacaattt

SEQ ID NO: 568085 - DNA, 21 bp, Homo sapiens
ctctctccatcagaggacacc

SEQ ID NO: 568086 - DNA, 15 bp, Homo sapiens
ctctctgtataaaca

SEQ ID NO: 568087 - DNA, 20 bp, Homo sapiens
ctctctgtataaacattaaa

SEQ ID NO: 568088 - DNA, 15 bp, Homo sapiens
ctctcttcttactgt

SEQ ID NO: 568089 - DNA, 18 bp, Homo sapiens
ctctcttggaactgcacc

SEQ ID NO: 568090 - DNA, 17 bp, Homo sapiens
ctctgaactgctgctgg

SEQ ID NO: 568091 - DNA, 13 bp, Homo sapiens
ctctgacaaagct

SEQ ID NO: 568092 - DNA, 23 bp, Homo sapiens
ctctgacctgcccccgctctgcc

SEQ ID NO: 568093 - DNA, 14 bp, Homo sapiens
ctctgagtcctcat

SEQ ID NO: 568094 - DNA, 13 bp, Homo sapiens
ctctgattctatg

SEQ ID NO: 568095 - DNA, 16 bp, Homo sapiens
ctctgattctatgtaa

SEQ ID NO: 568096 - DNA, 19 bp, Homo sapiens
ctctgattctatgtaactt

SEQ ID NO: 568097 - DNA, 20 bp, Homo sapiens
ctctgattctatgtaacttg

SEQ ID NO: 568098 - DNA, 21 bp, Homo sapiens
ctctgattctatgtaacttgt

SEQ ID NO: 568099 - DNA, 12 bp, Homo sapiens
ctctgcaggcca

SEQ ID NO: 568100 - DNA, 14 bp, Homo sapiens
ctctgccatcagcc

SEQ ID NO: 568101 - DNA, 20 bp, Homo sapiens
ctctgccatgaactggaggc

SEQ ID NO: 568102 - DNA, 14 bp, Homo sapiens
ctctgcccagcttt

SEQ ID NO: 568103 - DNA, 20 bp, Homo sapiens
ctctgccctcccttcttgtg

SEQ ID NO: 568104 - DNA, 13 bp, Homo sapiens
ctctgccttccag

SEQ ID NO: 568105 - DNA, 15 bp, Homo sapiens
ctctgccttccaggc

SEQ ID NO: 568106 - DNA, 17 bp, Homo sapiens
ctctgccttccaggcgt

SEQ ID NO: 568107 - DNA, 17 bp, Homo sapiens
ctctgcgtcccactgag

SEQ ID NO: 568108 - DNA, 13 bp, Homo sapiens
ctctgctaaattg

SEQ ID NO: 568109 - DNA, 13 bp, Homo sapiens
ctctgctccccct

SEQ ID NO: 568110 - DNA, 16 bp, Homo sapiens
ctctgctccccctttt

SEQ ID NO: 568111 - DNA, 16 bp, Homo sapiens
ctctggcaggtggcca

SEQ ID NO: 568112 - DNA, 20 bp, Homo sapiens
ctctggcaggtggccagggc

SEQ ID NO: 568113 - DNA, 18 bp, Homo sapiens
ctctggctctaggacccc

SEQ ID NO: 568114 - DNA, 21 bp, Homo sapiens
ctctggctctaggacccccag

SEQ ID NO: 568115 - DNA, 15 bp, Homo sapiens
ctctgtccccgagcc

SEQ ID NO: 568116 - DNA, 19 bp, Homo sapiens
ctctgtctcaaaaataaat

SEQ ID NO: 568117 - DNA, 19 bp, Homo sapiens
ctctgtgctaagttgtctt

SEQ ID NO: 568118 - DNA, 20 bp, Homo sapiens
ctctgtgctaagttgtctta

SEQ ID NO: 568119 - DNA, 16 bp, Homo sapiens
ctctgtggggccacac

SEQ ID NO: 568120 - DNA, 21 bp, Homo sapiens
ctcttaatgtctcaaaataaa

SEQ ID NO: 568121 - DNA, 15 bp, Homo sapiens
ctcttcaatccccat

SEQ ID NO: 568122 - DNA, 22 bp, Homo sapiens
ctcttcatgcgcagtccccagg

SEQ ID NO: 568123 - DNA, 13 bp, Homo sapiens
ctcttccaggcag

SEQ ID NO: 568124 - DNA, 21 bp, Homo sapiens
ctcttctacaatacaacacat

SEQ ID NO: 568125 - DNA, 16 bp, Homo sapiens
ctcttctccccttcca

SEQ ID NO: 568126 - DNA, 12 bp, Homo sapiens
ctcttctgtgtt

SEQ ID NO: 568127 - DNA, 21 bp, Homo sapiens
ctcttcttactgtatttggga

SEQ ID NO: 568128 - DNA, 19 bp, Homo sapiens
ctcttgaatgcttaaatga

SEQ ID NO: 568129 - DNA, 20 bp, Homo sapiens
ctcttgcacagtcactgctc

SEQ ID NO: 568130 - DNA, 21 bp, Homo sapiens
ctcttgcacagtcactgctct

SEQ ID NO: 568131 - DNA, 20 bp, Homo sapiens
ctcttgggcaatattctctg

SEQ ID NO: 568132 - DNA, 22 bp, Homo sapiens
ctcttgggcaatattctctgta

SEQ ID NO: 568133 - DNA, 15 bp, Homo sapiens
ctctttcccacccag

SEQ ID NO: 568134 - DNA, 19 bp, Homo sapiens
ctctttcccacccagcctg

SEQ ID NO: 568135 - DNA, 10 bp, Homo sapiens
ctctttccct

SEQ ID NO: 568136 - DNA, 23 bp, Homo sapiens
ctctttcccttccagtttattcc

SEQ ID NO: 568137 - DNA, 12 bp, Homo sapiens
ctctttcttcct

SEQ ID NO: 568138 - DNA, 14 bp, Homo sapiens
ctctttcttccttt

SEQ ID NO: 568139 - DNA, 16 bp, Homo sapiens
ctctttcttcctttct

SEQ ID NO: 568140 - DNA, 23 bp, Homo sapiens
cttttgggaggatttgatgtaag

SEQ ID NO: 568141 - DNA, 22 bp, Homo sapiens
cttttggtttgtgggtccagga

SEQ ID NO: 568142 - DNA, 12 bp, Homo sapiens
cttttgtagctg

SEQ ID NO: 568143 - DNA, 15 bp, Homo sapiens
cttttgtagctgtca

SEQ ID NO: 568144 - DNA, 17 bp, Homo sapiens
cttttgtcatgtggcta

SEQ ID NO: 568145 - DNA, 15 bp, Homo sapiens
cttttgtgccaggag

SEQ ID NO: 568146 - DNA, 19 bp, Homo sapiens
cttttgttttttgaagtgt

SEQ ID NO: 568147 - DNA, 19 bp, Homo sapiens
ctttttaaacaaatggctt

SEQ ID NO: 568148 - DNA, 19 bp, Homo sapiens
ctttttaagcctttgaagt

SEQ ID NO: 568149 - DNA, 17 bp, Homo sapiens
cttttttaattgaaagg

SEQ ID NO: 568150 - DNA, 14 bp, Homo sapiens
cttttttatatctt

SEQ ID NO: 568151 - DNA, 14 bp, Homo sapiens
cttttttctgggtc

SEQ ID NO: 568152 - DNA, 14 bp, Homo sapiens
ctttttttaagtgt

SEQ ID NO: 568153 - DNA, 21 bp, Homo sapiens
cttttttttttaagtgaaatt

SEQ ID NO: 568154 - DNA, 17 bp, Homo sapiens
gaaaaaaagggagaata

SEQ ID NO: 568155 - DNA, 13 bp, Homo sapiens
gaaaaatatgtga

SEQ ID NO: 568156 - DNA, 14 bp, Homo sapiens
gaaaaatcagtttt

SEQ ID NO: 568157 - DNA, 15 bp, Homo sapiens
gaaaacatctcctta

SEQ ID NO: 568158 - DNA, 19 bp, Homo sapiens
gaaaacatctccttagaaa

SEQ ID NO: 568159 - DNA, 17 bp, Homo sapiens
gaaaacggttaaaactg

SEQ ID NO: 568160 - DNA, 11 bp, Homo sapiens
gaaaactttgt

SEQ ID NO: 568161 - DNA, 13 bp, Homo sapiens
gaaaactttgtta

SEQ ID NO: 568162 - DNA, 16 bp, Homo sapiens
gaaaactttgttaggc

SEQ ID NO: 568163 - DNA, 16 bp, Homo sapiens
gaaaagaaaaatttct

SEQ ID NO: 568164 - DNA, 19 bp, Homo sapiens
gaaaagaacgtattttaaa

SEQ ID NO: 568165 - DNA, 17 bp, Homo sapiens
gaaaagcacctcttgaa

SEQ ID NO: 568166 - DNA, 19 bp, Homo sapiens
gaaaataaaaaaagaaaaa

SEQ ID NO: 568167 - DNA, 19 bp, Homo sapiens
gaaaataagtgaataataa

SEQ ID NO: 568168 - DNA, 16 bp, Homo sapiens
gaaaatagttcccttt

SEQ ID NO: 568169 - DNA, 20 bp, Homo sapiens
gaaaatgtcactgttataaa

SEQ ID NO: 568170 - DNA, 17 bp, Homo sapiens
gaaaattaaggaaatgt

SEQ ID NO: 568171 - DNA, 16 bp, Homo sapiens
gaaaattcatttcaca

SEQ ID NO: 568172 - DNA, 22 bp, Homo sapiens
gaaaattcatttcacattaatg

SEQ ID NO: 568173 - DNA, 23 bp, Homo sapiens
gaaacaccaaaaaaatccagaaa

SEQ ID NO: 568174 - DNA, 15 bp, Homo sapiens
gaaacactaaatgtt

SEQ ID NO: 568175 - DNA, 21 bp, Homo sapiens
gaaacagataccatactcatt

SEQ ID NO: 568176 - DNA, 14 bp, Homo sapiens
gaaacagtttaaca

SEQ ID NO: 568177 - DNA, 21 bp, Homo sapiens
gaaacattgcttttaaaacta

SEQ ID NO: 568178 - DNA, 13 bp, Homo sapiens
gaaacattggaag

SEQ ID NO: 568179 - DNA, 18 bp, Homo sapiens
gaaacccggcttcctgtg

SEQ ID NO: 568180 - DNA, 13 bp, Homo sapiens
gaaacctgtctga

SEQ ID NO: 568181 - DNA, 17 bp, Homo sapiens
gaaagaactatcttcat

SEQ ID NO: 568182 - DNA, 21 bp, Homo sapiens
gaaagaactatcttcatctga

SEQ ID NO: 568183 - DNA, 12 bp, Homo sapiens
gaaagacagtaa

SEQ ID NO: 568184 - DNA, 22 bp, Homo sapiens
gaaagaggaataaaatgattaa

SEQ ID NO: 568185 - DNA, 16 bp, Homo sapiens
gaaagcacaggagaca

SEQ ID NO: 568186 - DNA, 19 bp, Homo sapiens
gaaagccagtcttaacatt

SEQ ID NO: 568187 - DNA, 15 bp, Homo sapiens
gaaagctgtttcatt

SEQ ID NO: 568188 - DNA, 18 bp, Homo sapiens
gaaagtgccaaaataaag

SEQ ID NO: 568189 - DNA, 18 bp, Homo sapiens
gaaagtgttctgttacaa

SEQ ID NO: 568190 - DNA, 21 bp, Homo sapiens
gaaagtgttctgttacaaaat

SEQ ID NO: 568191 - DNA, 20 bp, Homo sapiens
gaaatacttgacaacatttt

SEQ ID NO: 568192 - DNA, 16 bp, Homo sapiens
gaaatataaaaataat

SEQ ID NO: 568193 - DNA, 16 bp, Homo sapiens
gaaatatatatacata

SEQ ID NO: 568194 - DNA, 19 bp, Homo sapiens
gaaatatatatacatatgt

SEQ ID NO: 568195 - DNA, 23 bp, Homo sapiens
gaaatatatggtctaatgtttaa

SEQ ID NO: 568196 - DNA, 19 bp, Homo sapiens
gaaatctatagaaagtgtt

SEQ ID NO: 568197 - DNA, 23 bp, Homo sapiens
gaaatctatagaaagtgttctgt

SEQ ID NO: 568198 - DNA, 14 bp, Homo sapiens
gaaatgaacacaaa

SEQ ID NO: 568199 - DNA, 21 bp, Homo sapiens
gaaatgattgagagcagcctc

SEQ ID NO: 568200 - DNA, 17 bp, Homo sapiens
gaaatgctatgtcattt

SEQ ID NO: 568201 - DNA, 22 bp, Homo sapiens
gaaatgctgatttaaacttctt

SEQ ID NO: 568202 - DNA, 16 bp, Homo sapiens
gaaatgtccctttctt

SEQ ID NO: 568203 - DNA, 16 bp, Homo sapiens
gaaatgtgtgtgatgt

SEQ ID NO: 568204 - DNA, 19 bp, Homo sapiens
gaaatgtgtgtgatgtgac

SEQ ID NO: 568205 - DNA, 21 bp, Homo sapiens
gaaatgtgtgtgatgtgacat

SEQ ID NO: 568206 - DNA, 17 bp, Homo sapiens
gaaattcaattcataga

SEQ ID NO: 568207 - DNA, 19 bp, Homo sapiens
gaaattcgccccattttct

SEQ ID NO: 568208 - DNA, 22 bp, Homo sapiens
gaaatttaagcacaaaaaattt

SEQ ID NO: 568209 - DNA, 22 bp, Homo sapiens
gaaatttattgaggaaaaatat

SEQ ID NO: 568210 - DNA, 15 bp, Homo sapiens
gaaattttatctctt

SEQ ID NO: 568211 - DNA, 17 bp, Homo sapiens
gaaatttttcatatttt

SEQ ID NO: 568212 - DNA, 13 bp, Homo sapiens
gaacaaatcttcc

SEQ ID NO: 568213 - DNA, 19 bp, Homo sapiens
gaacaagacccccaggaag

SEQ ID NO: 568214 - DNA, 13 bp, Homo sapiens
gaacacagtgaca

SEQ ID NO: 568215 - DNA, 12 bp, Homo sapiens
gaacacatgcac

SEQ ID NO: 568216 - DNA, 14 bp, Homo sapiens
gaacacatgcacac

SEQ ID NO: 568217 - DNA, 15 bp, Homo sapiens
gaacacatgcacaca

SEQ ID NO: 568218 - DNA, 18 bp, Homo sapiens
gaacacatgcacacacac

SEQ ID NO: 568219 - DNA, 13 bp, Homo sapiens
gaacacccagccc

SEQ ID NO: 568220 - DNA, 14 bp, Homo sapiens
gaacacccagcccc

SEQ ID NO: 568221 - DNA, 17 bp, Homo sapiens
gaacagctctgagatcc

SEQ ID NO: 568222 - DNA, 20 bp, Homo sapiens
gaacagtaaagaaagcagaa

SEQ ID NO: 568223 - DNA, 18 bp, Homo sapiens
gaacagtgcacctgggac

SEQ ID NO: 568224 - DNA, 24 bp, Homo sapiens
gaacagtgtttactttaaatcctt

SEQ ID NO: 568225 - DNA, 23 bp, Homo sapiens
gaacatgaaaacagaaaacggtt

SEQ ID NO: 568226 - DNA, 18 bp, Homo sapiens
gaacattccctggaattg

SEQ ID NO: 568227 - DNA, 13 bp, Homo sapiens
gaacgccagggac

SEQ ID NO: 568228 - DNA, 23 bp, Homo sapiens
gaacgtagtcggcacagcctggt

SEQ ID NO: 568229 - DNA, 12 bp, Homo sapiens
gaactatcttca

SEQ ID NO: 568230 - DNA, 13 bp, Homo sapiens
gaactatcttcat

SEQ ID NO: 568231 - DNA, 14 bp, Homo sapiens
gaactatcttcatc

SEQ ID NO: 568232 - DNA, 20 bp, Homo sapiens
gaactcagctgtctgtggct

SEQ ID NO: 568233 - DNA, 17 bp, Homo sapiens
gaactcctgccatagtc

SEQ ID NO: 568234 - DNA, 16 bp, Homo sapiens
gaactctgcctgccct

SEQ ID NO: 568235 - DNA, 17 bp, Homo sapiens
gaactgaagcagagtca

SEQ ID NO: 568236 - DNA, 11 bp, Homo sapiens
gaactgcacca

SEQ ID NO: 568237 - DNA, 13 bp, Homo sapiens
gaactgctgctgg

SEQ ID NO: 568238 - DNA, 19 bp, Homo sapiens
gaacttgaagcctgctcct

SEQ ID NO: 568239 - DNA, 21 bp, Homo sapiens
gaacttgaagcctgctccttc

SEQ ID NO: 568240 - DNA, 23 bp, Homo sapiens
gaactttctcagcatatatataa

SEQ ID NO: 568241 - DNA, 13 bp, Homo sapiens
gaacttttcaaaa

SEQ ID NO: 568242 - DNA, 20 bp, Homo sapiens
gaacttttcaaaataaagct

SEQ ID NO: 568243 - DNA, 13 bp, Homo sapiens
gaagaactaataa

SEQ ID NO: 568244 - DNA, 17 bp, Homo sapiens
gaagaactcatgtgatt

SEQ ID NO: 568245 - DNA, 16 bp, Homo sapiens
gaagaactgacttcct

SEQ ID NO: 568246 - DNA, 20 bp, Homo sapiens
gaagaatgcatgctttccat

SEQ ID NO: 568247 - DNA, 12 bp, Homo sapiens
gaagaatggctt

SEQ ID NO: 568248 - DNA, 15 bp, Homo sapiens
gaagaatggctttca

SEQ ID NO: 568249 - DNA, 14 bp, Homo sapiens
gaagaattggcaga

SEQ ID NO: 568250 - DNA, 20 bp, Homo sapiens
gaagacctaaccagggccag

SEQ ID NO: 568251 - DNA, 15 bp, Homo sapiens
gaagactccagaaat

SEQ ID NO: 568252 - DNA, 15 bp, Homo sapiens
gaagagagagctgag

SEQ ID NO: 568253 - DNA, 19 bp, Homo sapiens
gaagagagatatatctgaa

SEQ ID NO: 568254 - DNA, 17 bp, Homo sapiens
gaagagtgaagagcatt

SEQ ID NO: 568255 - DNA, 16 bp, Homo sapiens
gaagatctttgttttt

SEQ ID NO: 568256 - DNA, 22 bp, Homo sapiens
gaagatgaatggtctggcaata

SEQ ID NO: 568257 - DNA, 18 bp, Homo sapiens
gaagatggatatgaccag

SEQ ID NO: 568258 - DNA, 16 bp, Homo sapiens
gaagcaggttaaatgt

SEQ ID NO: 568259 - DNA, 17 bp, Homo sapiens
gaagcaggttaaatgtt

SEQ ID NO: 568260 - DNA, 19 bp, Homo sapiens
gaagcaggttaaatgtttt

SEQ ID NO: 568261 - DNA, 16 bp, Homo sapiens
gaagccaccgggagat

SEQ ID NO: 568262 - DNA, 19 bp, Homo sapiens
gaagccctaagtaaatcta

SEQ ID NO: 568263 - DNA, 17 bp, Homo sapiens
gaagcctcatgggagtc

SEQ ID NO: 568264 - DNA, 15 bp, Homo sapiens
gaagctcaaggctgc

SEQ ID NO: 568265 - DNA, 22 bp, Homo sapiens
gaagctggcaggagacactggt

SEQ ID NO: 568266 - DNA, 13 bp, Homo sapiens
gaaggacttcctg

SEQ ID NO: 568267 - DNA, 24 bp, Homo sapiens
gaaggcaaactgaggcagcatgca

SEQ ID NO: 568268 - DNA, 23 bp, Homo sapiens
gaaggcccagcaccaccctcctt

SEQ ID NO: 568269 - DNA, 17 bp, Homo sapiens
gaagggagtgaaaacct

SEQ ID NO: 568270 - DNA, 18 bp, Homo sapiens
gaaggtctctctggctct

SEQ ID NO: 568271 - DNA, 11 bp, Homo sapiens
gaaggtgacag

SEQ ID NO: 568272 - DNA, 17 bp, Homo sapiens
gaagtaacttgtcttaa

SEQ ID NO: 568273 - DNA, 18 bp, Homo sapiens
gaagtggctggaaagagt

SEQ ID NO: 568274 - DNA, 18 bp, Homo sapiens
gaagtggtaggaaagcct

SEQ ID NO: 568275 - DNA, 11 bp, Homo sapiens
gaagttagcct

SEQ ID NO: 568276 - DNA, 17 bp, Homo sapiens
gaagttctgcctctgat

SEQ ID NO: 568277 - DNA, 14 bp, Homo sapiens
gaagttggcacatt

SEQ ID NO: 568278 - DNA, 15 bp, Homo sapiens
gaagtttgataaata

SEQ ID NO: 568279 - DNA, 16 bp, Homo sapiens
gaagtttgataaatag

SEQ ID NO: 568280 - DNA, 20 bp, Homo sapiens
gaagtttgataaatagtgtt

SEQ ID NO: 568281 - DNA, 14 bp, Homo sapiens
gaataaaattccta

SEQ ID NO: 568282 - DNA, 21 bp, Homo sapiens
gaataacaactgctgggaata

SEQ ID NO: 568283 - DNA, 22 bp, Homo sapiens
gaataataattaggttaacatt

SEQ ID NO: 568284 - DNA, 24 bp, Homo sapiens
gaatactgtattgttacagctgaa

SEQ ID NO: 568285 - DNA, 20 bp, Homo sapiens
gaatagacataaattgtaat

SEQ ID NO: 568286 - DNA, 20 bp, Homo sapiens
gaatagcagtggcaaaatat

SEQ ID NO: 568287 - DNA, 18 bp, Homo sapiens
gaataggacttgtttttg

SEQ ID NO: 568288 - DNA, 19 bp, Homo sapiens
gaataggacttgtttttgt

SEQ ID NO: 568289 - DNA, 21 bp, Homo sapiens
gaatatcagaagtatatctgt

SEQ ID NO: 568290 - DNA, 19 bp, Homo sapiens
gaatatgcatcccacagcc

SEQ ID NO: 568291 - DNA, 13 bp, Homo sapiens
gaatattatattt

SEQ ID NO: 568292 - DNA, 19 bp, Homo sapiens
gaatattatatttggatgc

SEQ ID NO: 568293 - DNA, 15 bp, Homo sapiens
gaatcaaaaattgaa

SEQ ID NO: 568294 - DNA, 21 bp, Homo sapiens
gaatcaaaaattgaagagaga

SEQ ID NO: 568295 - DNA, 18 bp, Homo sapiens
gaatcacctaattaattt

SEQ ID NO: 568296 - DNA, 19 bp, Homo sapiens
gaatcattgtccagagctg

SEQ ID NO: 568297 - DNA, 17 bp, Homo sapiens
gaatccaaaagaaaaac

SEQ ID NO: 568298 - DNA, 15 bp, Homo sapiens
gaatccgaagggaat

SEQ ID NO: 568299 - DNA, 22 bp, Homo sapiens
gaatcctgtcctcagcttctta

SEQ ID NO: 568300 - DNA, 12 bp, Homo sapiens
gaatctcagcac

SEQ ID NO: 568301 - DNA, 17 bp, Homo sapiens
gaatctgaccacagaca

SEQ ID NO: 568302 - DNA, 17 bp, Homo sapiens
gaatgagagttccttct

SEQ ID NO: 568303 - DNA, 20 bp, Homo sapiens
gaatgagggcgtgaaacaca

SEQ ID NO: 568304 - DNA, 21 bp, Homo sapiens
gaatgagggcgtgaaacacaa

SEQ ID NO: 568305 - DNA, 22 bp, Homo sapiens
gaatgagggcgtgaaacacaat

SEQ ID NO: 568306 - DNA, 19 bp, Homo sapiens
gaatggagtccagacctgg

SEQ ID NO: 568307 - DNA, 17 bp, Homo sapiens
gaatgtatagtatttga

SEQ ID NO: 568308 - DNA, 22 bp, Homo sapiens
gaatgtatagtatttgaaaaca

SEQ ID NO: 568309 - DNA, 14 bp, Homo sapiens
gaattactaacttc

SEQ ID NO: 568310 - DNA, 16 bp, Homo sapiens
gaattactaacttcta

SEQ ID NO: 568311 - DNA, 20 bp, Homo sapiens
gaattgatttcccttcttct

SEQ ID NO: 568312 - DNA, 21 bp, Homo sapiens
gaattgccacataattcatta

SEQ ID NO: 568313 - DNA, 16 bp, Homo sapiens
gaattggcagaagcag

SEQ ID NO: 568314 - DNA, 18 bp, Homo sapiens
gaattggctgccaagagt

SEQ ID NO: 568315 - DNA, 15 bp, Homo sapiens
gaattggtttaaact

SEQ ID NO: 568316 - DNA, 20 bp, Homo sapiens
gaattggtttaaacttttat

SEQ ID NO: 568317 - DNA, 16 bp, Homo sapiens
gaattgtgctccaaat

SEQ ID NO: 568318 - DNA, 22 bp, Homo sapiens
gaattgtgctccaaatgtctac

SEQ ID NO: 568319 - DNA, 11 bp, Homo sapiens
gaattttcatt

SEQ ID NO: 568320 - DNA, 14 bp, Homo sapiens
gaattttcatttta

SEQ ID NO: 568321 - DNA, 14 bp, Homo sapiens
gacaaatctgtctg

SEQ ID NO: 568322 - DNA, 15 bp, Homo sapiens
gacaaatctgtctgc

SEQ ID NO: 568323 - DNA, 15 bp, Homo sapiens
gacaacagcccaggc

SEQ ID NO: 568324 - DNA, 16 bp, Homo sapiens
gacaaggtgcaggcag

SEQ ID NO: 568325 - DNA, 13 bp, Homo sapiens
gacaatcttctgt

SEQ ID NO: 568326 - DNA, 21 bp, Homo sapiens
gacaattctaatggtaacttt

SEQ ID NO: 568327 - DNA, 22 bp, Homo sapiens
gacaattctaatggtaactttt

SEQ ID NO: 568328 - DNA, 12 bp, Homo sapiens
gacacacacaca

SEQ ID NO: 568329 - DNA, 23 bp, Homo sapiens
gacacacacacacacacacatat

SEQ ID NO: 568330 - DNA, 14 bp, Homo sapiens
gacacacacacgca

SEQ ID NO: 568331 - DNA, 20 bp, Homo sapiens
gacacacacacgcacgcaca

SEQ ID NO: 568332 - DNA, 23 bp, Homo sapiens
gacacagcagcttcaccagagca

SEQ ID NO: 568333 - DNA, 22 bp, Homo sapiens
gacacctagactctaaaactat

SEQ ID NO: 568334 - DNA, 15 bp, Homo sapiens
gacacggcctctggg

SEQ ID NO: 568335 - DNA, 22 bp, Homo sapiens
gacacggcctctggggagaccg

SEQ ID NO: 568336 - DNA, 18 bp, Homo sapiens
gacactggtctcagagga

SEQ ID NO: 568337 - DNA, 14 bp, Homo sapiens
gacactgtctgctg

SEQ ID NO: 568338 - DNA, 20 bp, Homo sapiens
gacacttccgtcacatccca

SEQ ID NO: 568339 - DNA, 22 bp, Homo sapiens
gacagacgcctgcttttgcaaa

SEQ ID NO: 568340 - DNA, 23 bp, Homo sapiens
gacagacgcctgcttttgcaaat

SEQ ID NO: 568341 - DNA, 18 bp, Homo sapiens
gacagagaggacgtgggc

SEQ ID NO: 568342 - DNA, 19 bp, Homo sapiens
gacagagaggacgtgggcg

SEQ ID NO: 568343 - DNA, 18 bp, Homo sapiens
gacagagcgacagagcag

SEQ ID NO: 568344 - DNA, 19 bp, Homo sapiens
gacagatgtggacatgcac

SEQ ID NO: 568345 - DNA, 20 bp, Homo sapiens
gacagatgtggacatgcacc

SEQ ID NO: 568346 - DNA, 23 bp, Homo sapiens
gacagcaaaaaaagcaacttttc

SEQ ID NO: 568347 - DNA, 23 bp, Homo sapiens
gacagcttagaattatttgcact

SEQ ID NO: 568348 - DNA, 20 bp, Homo sapiens
gacagctttcccctcatttt

SEQ ID NO: 568349 - DNA, 18 bp, Homo sapiens
gacaggaacacccagccc

SEQ ID NO: 568350 - DNA, 19 bp, Homo sapiens
gacaggaacacccagcccc

SEQ ID NO: 568351 - DNA, 22 bp, Homo sapiens
gacaggaacacccagccccagc

SEQ ID NO: 568352 - DNA, 15 bp, Homo sapiens
gacaggccaggtggt

SEQ ID NO: 568353 - DNA, 19 bp, Homo sapiens
gacagtcaaggagtggctt

SEQ ID NO: 568354 - DNA, 22 bp, Homo sapiens
gacagtcaaggagtggcttact

SEQ ID NO: 568355 - DNA, 14 bp, Homo sapiens
gacagtcaggaagc

SEQ ID NO: 568356 - DNA, 19 bp, Homo sapiens
gacagtgaggtcctggggg

SEQ ID NO: 568357 - DNA, 15 bp, Homo sapiens
gacataaattgtaat

SEQ ID NO: 568358 - DNA, 16 bp, Homo sapiens
gacataaattgtaatt

SEQ ID NO: 568359 - DNA, 16 bp, Homo sapiens
gacatccaagcttcct

SEQ ID NO: 568360 - DNA, 17 bp, Homo sapiens
gacatccaagcttcctt

SEQ ID NO: 568361 - DNA, 15 bp, Homo sapiens
gacatcggttcagga

SEQ ID NO: 568362 - DNA, 13 bp, Homo sapiens
gacatctctgtaa

SEQ ID NO: 568363 - DNA, 20 bp, Homo sapiens
gacatgcacccgcatgtaca

SEQ ID NO: 568364 - DNA, 22 bp, Homo sapiens
gacatgcgggctgggcagctgt

SEQ ID NO: 568365 - DNA, 18 bp, Homo sapiens
gacatggcttctgaacct

SEQ ID NO: 568366 - DNA, 16 bp, Homo sapiens
gacattatgtgtgcat

SEQ ID NO: 568367 - DNA, 20 bp, Homo sapiens
gacattatgtgtgcatgtgt

SEQ ID NO: 568368 - DNA, 21 bp, Homo sapiens
gacattatgtgtgcatgtgtg

SEQ ID NO: 568369 - DNA, 21 bp, Homo sapiens
gacatttcaatcactgaaaat

SEQ ID NO: 568370 - DNA, 15 bp, Homo sapiens
gacatttgtcatttt

SEQ ID NO: 568371 - DNA, 17 bp, Homo sapiens
gacatttgtcattttca

SEQ ID NO: 568372 - DNA, 15 bp, Homo sapiens
gaccaactccagact

SEQ ID NO: 568373 - DNA, 13 bp, Homo sapiens
gaccagtagtgac

SEQ ID NO: 568374 - DNA, 13 bp, Homo sapiens
gaccatttaacat

SEQ ID NO: 568375 - DNA, 11 bp, Homo sapiens
gaccattttcc

SEQ ID NO: 568376 - DNA, 17 bp, Homo sapiens
gaccccatccagccagg

SEQ ID NO: 568377 - DNA, 14 bp, Homo sapiens
gaccctcgctggcc

SEQ ID NO: 568378 - DNA, 16 bp, Homo sapiens
gaccctcgctggcccc

SEQ ID NO: 568379 - DNA, 18 bp, Homo sapiens
gaccctcgctggccccca

SEQ ID NO: 568380 - DNA, 19 bp, Homo sapiens
gaccctcgctggcccccac

SEQ ID NO: 568381 - DNA, 15 bp, Homo sapiens
gaccctcggggcagg

SEQ ID NO: 568382 - DNA, 14 bp, Homo sapiens
gaccctgaaatgtg

SEQ ID NO: 568383 - DNA, 15 bp, Homo sapiens
gaccctgaaatgtgt

SEQ ID NO: 568384 - DNA, 12 bp, Homo sapiens
gaccctgggaga

SEQ ID NO: 568385 - DNA, 18 bp, Homo sapiens
gaccctgggagagtgagg

SEQ ID NO: 568386 - DNA, 18 bp, Homo sapiens
gaccgagtgtggagctgc

SEQ ID NO: 568387 - DNA, 14 bp, Homo sapiens
gaccgggagcctgc

SEQ ID NO: 568388 - DNA, 23 bp, Homo sapiens
gaccgggagcctgcgtggcctgg

SEQ ID NO: 568389 - DNA, 22 bp, Homo sapiens
gacctaaccagggccagaagta

SEQ ID NO: 568390 - DNA, 13 bp, Homo sapiens
gacctagggcctc

SEQ ID NO: 568391 - DNA, 20 bp, Homo sapiens
gacctccacctgggagatgc

SEQ ID NO: 568392 - DNA, 19 bp, Homo sapiens
gacctccccctccttccca

SEQ ID NO: 568393 - DNA, 14 bp, Homo sapiens
gacctcctgatgtc

SEQ ID NO: 568394 - DNA, 17 bp, Homo sapiens
gacctcctgatgtcttg

SEQ ID NO: 568395 - DNA, 19 bp, Homo sapiens
gacctgcccccgctctgcc

SEQ ID NO: 568396 - DNA, 15 bp, Homo sapiens
gacctggcctgtctg

SEQ ID NO: 568397 - DNA, 19 bp, Homo sapiens
gaccttcactctaagatgt

SEQ ID NO: 568398 - DNA, 14 bp, Homo sapiens
gaccttctgtcgtc

SEQ ID NO: 568399 - DNA, 19 bp, Homo sapiens
gaccttctgtcgtccccag

SEQ ID NO: 568400 - DNA, 21 bp, Homo sapiens
gaccttctgtcgtccccagac

SEQ ID NO: 568401 - DNA, 19 bp, Homo sapiens
gacctttgggttctttctg

SEQ ID NO: 568402 - DNA, 17 bp, Homo sapiens
gacgcagggagaccctg

SEQ ID NO: 568403 - DNA, 20 bp, Homo sapiens
gacgcagggagaccctggga

SEQ ID NO: 568404 - DNA, 18 bp, Homo sapiens
gacgcttcacaggacagg

SEQ ID NO: 568405 - DNA, 22 bp, Homo sapiens
gacgtccctccacgttcacccc

SEQ ID NO: 568406 - DNA, 15 bp, Homo sapiens
gacgtgagtggggag

SEQ ID NO: 568407 - DNA, 16 bp, Homo sapiens
gacgtttcttctttct

SEQ ID NO: 568408 - DNA, 16 bp, Homo sapiens
gactatatacatgtgt

SEQ ID NO: 568409 - DNA, 21 bp, Homo sapiens
gactatatacatgtgtgtata

SEQ ID NO: 568410 - DNA, 22 bp, Homo sapiens
gactatatacatgtgtgtatat

SEQ ID NO: 568411 - DNA, 13 bp, Homo sapiens
gactcaaagatga

SEQ ID NO: 568412 - DNA, 22 bp, Homo sapiens
gactccagaaatgtccctttct

SEQ ID NO: 568413 - DNA, 17 bp, Homo sapiens
gactccagaagcagcag

SEQ ID NO: 568414 - DNA, 22 bp, Homo sapiens
gactcccccagtccccttcccg

SEQ ID NO: 568415 - DNA, 20 bp, Homo sapiens
gactcctcaattccagggaa

SEQ ID NO: 568416 - DNA, 17 bp, Homo sapiens
gactctgccttccaggc

SEQ ID NO: 568417 - DNA, 16 bp, Homo sapiens
gactctgctcttgcat

SEQ ID NO: 568418 - DNA, 18 bp, Homo sapiens
gactgtaaattccaaaga

SEQ ID NO: 568419 - DNA, 19 bp, Homo sapiens
gactgtaaattccaaagat

SEQ ID NO: 568420 - DNA, 16 bp, Homo sapiens
gactgtggcctcagga

SEQ ID NO: 568421 - DNA, 19 bp, Homo sapiens
gactgtggcctcaggaggc

SEQ ID NO: 568422 - DNA, 19 bp, Homo sapiens
gattcccgtggctttgtgc

SEQ ID NO: 568423 - DNA, 22 bp, Homo sapiens
gattcccgtggctttgtgctta

SEQ ID NO: 568424 - DNA, 22 bp, Homo sapiens
gattcctaatcactcagagcag

SEQ ID NO: 568425 - DNA, 23 bp, Homo sapiens
gattcgtggtcttttcctcgctt

SEQ ID NO: 568426 - DNA, 13 bp, Homo sapiens
gattctaggacct

SEQ ID NO: 568427 - DNA, 17 bp, Homo sapiens
gattctatgtaacttgt

SEQ ID NO: 568428 - DNA, 15 bp, Homo sapiens
gattcttgtgattga

SEQ ID NO: 568429 - DNA, 16 bp, Homo sapiens
gattcttgttttgctt

SEQ ID NO: 568430 - DNA, 21 bp, Homo sapiens
gattgatttacctttggaatt

SEQ ID NO: 568431 - DNA, 16 bp, Homo sapiens
gattgcttttaaaatt

SEQ ID NO: 568432 - DNA, 18 bp, Homo sapiens
gattgcttttaaaatttt

SEQ ID NO: 568433 - DNA, 21 bp, Homo sapiens
gattgtttatctagatgtaaa

SEQ ID NO: 568434 - DNA, 15 bp, Homo sapiens
gatttactaacagta

SEQ ID NO: 568435 - DNA, 15 bp, Homo sapiens
gatttcacaaatatt

SEQ ID NO: 568436 - DNA, 19 bp, Homo sapiens
gatttcacaaatattaaaa

SEQ ID NO: 568437 - DNA, 20 bp, Homo sapiens
gatttccaagtaatataatg

SEQ ID NO: 568438 - DNA, 22 bp, Homo sapiens
gatttcccttcttctgtcatct

SEQ ID NO: 568439 - DNA, 14 bp, Homo sapiens
gatttctaagtgtt

SEQ ID NO: 568440 - DNA, 20 bp, Homo sapiens
gatttctagttatttattct

SEQ ID NO: 568441 - DNA, 18 bp, Homo sapiens
gatttgtaaaacagtggt

SEQ ID NO: 568442 - DNA, 17 bp, Homo sapiens
gatttgttgattctctc

SEQ ID NO: 568443 - DNA, 19 bp, Homo sapiens
gattttagttttattttct

SEQ ID NO: 568444 - DNA, 11 bp, Homo sapiens
gattttatgtt

SEQ ID NO: 568445 - DNA, 16 bp, Homo sapiens
gattttatgttgacat

SEQ ID NO: 568446 - DNA, 12 bp, Homo sapiens
gattttcaaata

SEQ ID NO: 568447 - DNA, 17 bp, Homo sapiens
gattttctagaaatgtt

SEQ ID NO: 568448 - DNA, 14 bp, Homo sapiens
gcaaaaatataaaa

SEQ ID NO: 568449 - DNA, 21 bp, Homo sapiens
gcaaaatacatgatgatttca

SEQ ID NO: 568450 - DNA, 18 bp, Homo sapiens
gcaaaatattatgttatg

SEQ ID NO: 568451 - DNA, 16 bp, Homo sapiens
gcaaaatatttgtgaa

SEQ ID NO: 568452 - DNA, 17 bp, Homo sapiens
gcaaaatatttgtgaaa

SEQ ID NO: 568453 - DNA, 11 bp, Homo sapiens
gcaaacacagt

SEQ ID NO: 568454 - DNA, 15 bp, Homo sapiens
gcaaacccaaagatg

SEQ ID NO: 568455 - DNA, 17 bp, Homo sapiens
gcaaacccaaagatgtt

SEQ ID NO: 568456 - DNA, 19 bp, Homo sapiens
gcaaacccaaagatgttaa

SEQ ID NO: 568457 - DNA, 15 bp, Homo sapiens
gcaaagatcaaaata

SEQ ID NO: 568458 - DNA, 17 bp, Homo sapiens
gcaaagctgttcttcct

SEQ ID NO: 568459 - DNA, 19 bp, Homo sapiens
gcaaagtacaggtactttg

SEQ ID NO: 568460 - DNA, 15 bp, Homo sapiens
gcaaatacaaaatga

SEQ ID NO: 568461 - DNA, 17 bp, Homo sapiens
gcaaatattttgtcact

SEQ ID NO: 568462 - DNA, 15 bp, Homo sapiens
gcaaattaatgtgta

SEQ ID NO: 568463 - DNA, 18 bp, Homo sapiens
gcaaattaatgtgtaaaa

SEQ ID NO: 568464 - DNA, 12 bp, Homo sapiens
gcaaatttcaaa

SEQ ID NO: 568465 - DNA, 20 bp, Homo sapiens
gcaaatttcaaaagacatgt

SEQ ID NO: 568466 - DNA, 21 bp, Homo sapiens
gcaacaaactgcacatgattt

SEQ ID NO: 568467 - DNA, 23 bp, Homo sapiens
gcaacaaactgcacatgatttca

SEQ ID NO: 568468 - DNA, 21 bp, Homo sapiens
gcaacacttggaacagtgttt

SEQ ID NO: 568469 - DNA, 15 bp, Homo sapiens
gcaacagcaaattaa

SEQ ID NO: 568470 - DNA, 15 bp, Homo sapiens
gcaacagctggacac

SEQ ID NO: 568471 - DNA, 16 bp, Homo sapiens
gcaacagctgtgtgtg

SEQ ID NO: 568472 - DNA, 21 bp, Homo sapiens
gcaacctgacagcaaacacag

SEQ ID NO: 568473 - DNA, 23 bp, Homo sapiens
gcaacttttccaacatacaattt

SEQ ID NO: 568474 - DNA, 21 bp, Homo sapiens
gcaagaccatggggtggaagg

SEQ ID NO: 568475 - DNA, 19 bp, Homo sapiens
gcaagatggcacagggcat

SEQ ID NO: 568476 - DNA, 18 bp, Homo sapiens
gcaaggcgctaacttgct

SEQ ID NO: 568477 - DNA, 18 bp, Homo sapiens
gcaatatattttgtatgc

SEQ ID NO: 568478 - DNA, 20 bp, Homo sapiens
gcaatatattttgtatgcaa

SEQ ID NO: 568479 - DNA, 14 bp, Homo sapiens
gcaatattctctgt

SEQ ID NO: 568480 - DNA, 17 bp, Homo sapiens
gcaatattctctgtaca

SEQ ID NO: 568481 - DNA, 19 bp, Homo sapiens
gcaatattctctgtacata

SEQ ID NO: 568482 - DNA, 21 bp, Homo sapiens
gcaatattctctgtacatatt

SEQ ID NO: 568483 - DNA, 19 bp, Homo sapiens
gcaatccttacaaatgatt

SEQ ID NO: 568484 - DNA, 11 bp, Homo sapiens
gcaattcaact

SEQ ID NO: 568485 - DNA, 14 bp, Homo sapiens
gcaattcatcccag

SEQ ID NO: 568486 - DNA, 21 bp, Homo sapiens
gcaattgcttctctaaaacag

SEQ ID NO: 568487 - DNA, 12 bp, Homo sapiens
gcaatttgaagg

SEQ ID NO: 568488 - DNA, 15 bp, Homo sapiens
gcacaaaaaatttaa

SEQ ID NO: 568489 - DNA, 21 bp, Homo sapiens
gcacaaaatataaagcatcta

SEQ ID NO: 568490 - DNA, 14 bp, Homo sapiens
gcacaaacatagac

SEQ ID NO: 568491 - DNA, 17 bp, Homo sapiens
gcacaaacatagacaga

SEQ ID NO: 568492 - DNA, 18 bp, Homo sapiens
gcacaaacatagacagat

SEQ ID NO: 568493 - DNA, 18 bp, Homo sapiens
gcacaaccatgttcttga

SEQ ID NO: 568494 - DNA, 17 bp, Homo sapiens
gcacaacccccagctcc

SEQ ID NO: 568495 - DNA, 15 bp, Homo sapiens
gcacaatgaatgtat

SEQ ID NO: 568496 - DNA, 17 bp, Homo sapiens
gcacaatgaatgtatat

SEQ ID NO: 568497 - DNA, 12 bp, Homo sapiens
gcacaattataa

SEQ ID NO: 568498 - DNA, 17 bp, Homo sapiens
gcacacagaaatatata

SEQ ID NO: 568499 - DNA, 18 bp, Homo sapiens
gcacacagaaatatatat

SEQ ID NO: 568500 - DNA, 23 bp, Homo sapiens
gcacacagaaatatatatacata

SEQ ID NO: 568501 - DNA, 19 bp, Homo sapiens
gcacacagctgcagagaca

SEQ ID NO: 568502 - DNA, 15 bp, Homo sapiens
gcacacatcatctgt

SEQ ID NO: 568503 - DNA, 16 bp, Homo sapiens
gcagcctactagggac

SEQ ID NO: 568504 - DNA, 20 bp, Homo sapiens
gcagccttaaacagtgtcca

SEQ ID NO: 568505 - DNA, 21 bp, Homo sapiens
gcagccttaaacagtgtccag

SEQ ID NO: 568506 - DNA, 14 bp, Homo sapiens
gcagctgaagccag

SEQ ID NO: 568507 - DNA, 14 bp, Homo sapiens
gcagctgttagagt

SEQ ID NO: 568508 - DNA, 18 bp, Homo sapiens
gcagctgttgtctcttct

SEQ ID NO: 568509 - DNA, 19 bp, Homo sapiens
gcagctgttgtctcttctc

SEQ ID NO: 568510 - DNA, 17 bp, Homo sapiens
gcaggaagtccctgaga

SEQ ID NO: 568511 - DNA, 14 bp, Homo sapiens
gcaggagacactgg

SEQ ID NO: 568512 - DNA, 23 bp, Homo sapiens
gcaggagacactggtctcagagg

SEQ ID NO: 568513 - DNA, 18 bp, Homo sapiens
gcaggatgggggagaggg

SEQ ID NO: 568514 - DNA, 20 bp, Homo sapiens
gcaggcacctagcaattcca

SEQ ID NO: 568515 - DNA, 22 bp, Homo sapiens
gcaggccctccgcgggggacag

SEQ ID NO: 568516 - DNA, 23 bp, Homo sapiens
gcaggccctccgcgggggacagg

SEQ ID NO: 568517 - DNA, 19 bp, Homo sapiens
gcaggcggtatccagaggt

SEQ ID NO: 568518 - DNA, 20 bp, Homo sapiens
gcaggcggtatccagaggtg

SEQ ID NO: 568519 - DNA, 16 bp, Homo sapiens
gcagggagaccctggg

SEQ ID NO: 568520 - DNA, 18 bp, Homo sapiens
gcagggagaccctgggag

SEQ ID NO: 568521 - DNA, 18 bp, Homo sapiens
gcagggcaggcagagctc

SEQ ID NO: 568522 - DNA, 12 bp, Homo sapiens
gcaggtggccag

SEQ ID NO: 568523 - DNA, 18 bp, Homo sapiens
gcaggtggccagggctcc

SEQ ID NO: 568524 - DNA, 18 bp, Homo sapiens
gcaggtgtgagggcagtg

SEQ ID NO: 568525 - DNA, 15 bp, Homo sapiens
gcaggttaaatgttt

SEQ ID NO: 568526 - DNA, 18 bp, Homo sapiens
gcaggttaaatgttttgt

SEQ ID NO: 568527 - DNA, 20 bp, Homo sapiens
gcagtataaagaataggact

SEQ ID NO: 568528 - DNA, 18 bp, Homo sapiens
gcagtcttatgcttccag

SEQ ID NO: 568529 - DNA, 17 bp, Homo sapiens
gcagtgacgtgagtggg

SEQ ID NO: 568530 - DNA, 15 bp, Homo sapiens
gcagtgatgtggtgg

SEQ ID NO: 568531 - DNA, 19 bp, Homo sapiens
gcagtgcaccccctaaaga

SEQ ID NO: 568532 - DNA, 16 bp, Homo sapiens
gcagtggagcccagga

SEQ ID NO: 568533 - DNA, 20 bp, Homo sapiens
gcagtttcaataaagtttga

SEQ ID NO: 568534 - DNA, 15 bp, Homo sapiens
gcataatatgcatat

SEQ ID NO: 568535 - DNA, 23 bp, Homo sapiens
gcataattctgaagttatatttc

SEQ ID NO: 568536 - DNA, 23 bp, Homo sapiens
gcataggcctgctttgtctcctc

SEQ ID NO: 568537 - DNA, 13 bp, Homo sapiens
gcatcccacagcc

SEQ ID NO: 568538 - DNA, 14 bp, Homo sapiens
gcatcccacagcca

SEQ ID NO: 568539 - DNA, 16 bp, Homo sapiens
gcatgaaatgaacaca

SEQ ID NO: 568540 - DNA, 13 bp, Homo sapiens
gcatgaagataaa

SEQ ID NO: 568541 - DNA, 23 bp, Homo sapiens
gcatgagtgctggatattttact

SEQ ID NO: 568542 - DNA, 15 bp, Homo sapiens
gcatgctccctcatg

SEQ ID NO: 568543 - DNA, 19 bp, Homo sapiens
gcatgctccctcatgcaga

SEQ ID NO: 568544 - DNA, 20 bp, Homo sapiens
gcatgctccctcatgcagat

SEQ ID NO: 568545 - DNA, 14 bp, Homo sapiens
gcatgtcgcacaat

SEQ ID NO: 568546 - DNA, 15 bp, Homo sapiens
gcatgtcgcacaatg

SEQ ID NO: 568547 - DNA, 17 bp, Homo sapiens
gcattccagtcaggctc

SEQ ID NO: 568548 - DNA, 23 bp, Homo sapiens
gcattgccagtaacacaggccac

SEQ ID NO: 568549 - DNA, 17 bp, Homo sapiens
gcatttaagttgtaaac

SEQ ID NO: 568550 - DNA, 18 bp, Homo sapiens
gcatttatggtaatcata

SEQ ID NO: 568551 - DNA, 20 bp, Homo sapiens
gcatttatggtaatcatatt

SEQ ID NO: 568552 - DNA, 23 bp, Homo sapiens
gcatttatggtaatcatattaga

SEQ ID NO: 568553 - DNA, 21 bp, Homo sapiens
gcatttccaacaccacagaca

SEQ ID NO: 568554 - DNA, 23 bp, Homo sapiens
gcatttggggtggggggcaggat

SEQ ID NO: 568555 - DNA, 23 bp, Homo sapiens
gcattttctgaaactaatgaaag

SEQ ID NO: 568556 - DNA, 22 bp, Homo sapiens
gccaaatcctgggcatccccag

SEQ ID NO: 568557 - DNA, 11 bp, Homo sapiens
gccaaatgagt

SEQ ID NO: 568558 - DNA, 21 bp, Homo sapiens
gccaagaggtttggctcctgc

SEQ ID NO: 568559 - DNA, 13 bp, Homo sapiens
gccaagctgagga

SEQ ID NO: 568560 - DNA, 15 bp, Homo sapiens
gccacctccccaggc

SEQ ID NO: 568561 - DNA, 18 bp, Homo sapiens
gccactgtatttgttaat

SEQ ID NO: 568562 - DNA, 18 bp, Homo sapiens
gccactttccaagtcact

SEQ ID NO: 568563 - DNA, 19 bp, Homo sapiens
gccagaaggaatcttctca

SEQ ID NO: 568564 - DNA, 17 bp, Homo sapiens
gccagaccaggtgacct

SEQ ID NO: 568565 - DNA, 13 bp, Homo sapiens
gccagagctccca

SEQ ID NO: 568566 - DNA, 20 bp, Homo sapiens
gccagcaaaacttagatgtg

SEQ ID NO: 568567 - DNA, 21 bp, Homo sapiens
gccagcacccccacgccctca

SEQ ID NO: 568568 - DNA, 22 bp, Homo sapiens
gccaggagtgggtgggacacag

SEQ ID NO: 568569 - DNA, 17 bp, Homo sapiens
gccaggatggcgtgtcc

SEQ ID NO: 568570 - DNA, 22 bp, Homo sapiens
gccaggatggcgtgtcccctgc

SEQ ID NO: 568571 - DNA, 13 bp, Homo sapiens
gccagggctctgg

SEQ ID NO: 568572 - DNA, 14 bp, Homo sapiens
gccagggctctggc

SEQ ID NO: 568573 - DNA, 20 bp, Homo sapiens
gccatcagcaccacgtgcca

SEQ ID NO: 568574 - DNA, 17 bp, Homo sapiens
gccatcagcccctgctg

SEQ ID NO: 568575 - DNA, 18 bp, Homo sapiens
gccatcagcccctgctgc

SEQ ID NO: 568576 - DNA, 19 bp, Homo sapiens
gccatcagcccctgctgct

SEQ ID NO: 568577 - DNA, 14 bp, Homo sapiens
gccatgcaattcat

SEQ ID NO: 568578 - DNA, 16 bp, Homo sapiens
gccatggaggcacaca

SEQ ID NO: 568579 - DNA, 22 bp, Homo sapiens
gccattctggcactttaatgat

SEQ ID NO: 568580 - DNA, 14 bp, Homo sapiens
gcccaaatttttct

SEQ ID NO: 568581 - DNA, 22 bp, Homo sapiens
gcccaacaggggctccatgcca

SEQ ID NO: 568582 - DNA, 12 bp, Homo sapiens
gcccacacctgc

SEQ ID NO: 568583 - DNA, 17 bp, Homo sapiens
gcccacacctgcctctg

SEQ ID NO: 568584 - DNA, 21 bp, Homo sapiens
gcccacattgcccacacctgc

SEQ ID NO: 568585 - DNA, 19 bp, Homo sapiens
gcccacccaagcaggaggc

SEQ ID NO: 568586 - DNA, 14 bp, Homo sapiens
gcccagaccctgga

SEQ ID NO: 568587 - DNA, 20 bp, Homo sapiens
gcccagaggggcggggccag

SEQ ID NO: 568588 - DNA, 15 bp, Homo sapiens
gcccagcctctttcc

SEQ ID NO: 568589 - DNA, 17 bp, Homo sapiens
gcccagggatttgtcct

SEQ ID NO: 568590 - DNA, 13 bp, Homo sapiens
gccgctccagagt

SEQ ID NO: 568591 - DNA, 16 bp, Homo sapiens
gccgctgtgtccccgc

SEQ ID NO: 568592 - DNA, 21 bp, Homo sapiens
gccgggctacccgtgagccct

SEQ ID NO: 568593 - DNA, 17 bp, Homo sapiens
gccgggctggcttctcc

SEQ ID NO: 568594 - DNA, 17 bp, Homo sapiens
gccgtgcacggggccag

SEQ ID NO: 568595 - DNA, 18 bp, Homo sapiens
gccgtggctgcggcaccc

SEQ ID NO: 568596 - DNA, 15 bp, Homo sapiens
gcctaataaacaatt

SEQ ID NO: 568597 - DNA, 18 bp, Homo sapiens
gcctactagggacctggg

SEQ ID NO: 568598 - DNA, 22 bp, Homo sapiens
gcctactagggacctggggaag

SEQ ID NO: 568599 - DNA, 15 bp, Homo sapiens
gcctatagattgatt

SEQ ID NO: 568600 - DNA, 20 bp, Homo sapiens
gcctatagattgatttacct

SEQ ID NO: 568601 - DNA, 22 bp, Homo sapiens
gcctcaccttccctagttcttt

SEQ ID NO: 568602 - DNA, 16 bp, Homo sapiens
gcctcctgctgagtgg

SEQ ID NO: 568603 - DNA, 20 bp, Homo sapiens
gcctcctgctgagtggtcca

SEQ ID NO: 568604 - DNA, 22 bp, Homo sapiens
gcctcctgctgagtggtccaca

SEQ ID NO: 568605 - DNA, 14 bp, Homo sapiens
gcctcctgtggcct

SEQ ID NO: 568606 - DNA, 14 bp, Homo sapiens
gcctccttttggtt

SEQ ID NO: 568607 - DNA, 19 bp, Homo sapiens
gcctcgcaggcctccctgc

SEQ ID NO: 568608 - DNA, 16 bp, Homo sapiens
gcctctccaggcacca

SEQ ID NO: 568609 - DNA, 20 bp, Homo sapiens
gcctctcttggaactgcacc

SEQ ID NO: 568610 - DNA, 20 bp, Homo sapiens
gcctctgaactgctgctggt

SEQ ID NO: 568611 - DNA, 14 bp, Homo sapiens
gcctcttaaaaatt

SEQ ID NO: 568612 - DNA, 22 bp, Homo sapiens
gcctcttaaaaattatctttaa

SEQ ID NO: 568613 - DNA, 14 bp, Homo sapiens
gcctctttcccttc

SEQ ID NO: 568614 - DNA, 15 bp, Homo sapiens
gcctgaaagcaacag

SEQ ID NO: 568615 - DNA, 18 bp, Homo sapiens
gcctgaaatgtttccagg

SEQ ID NO: 568616 - DNA, 22 bp, Homo sapiens
gcctgaaatgtttccaggcatg

SEQ ID NO: 568617 - DNA, 17 bp, Homo sapiens
gcctgaactcctgccat

SEQ ID NO: 568618 - DNA, 16 bp, Homo sapiens
gcctgccctttgtcct

SEQ ID NO: 568619 - DNA, 22 bp, Homo sapiens
gcctgccctttgtcctcctgct

SEQ ID NO: 568620 - DNA, 16 bp, Homo sapiens
gcctgcgtggcctggg

SEQ ID NO: 568621 - DNA, 16 bp, Homo sapiens
gcctgcgtggctgacc

SEQ ID NO: 568622 - DNA, 17 bp, Homo sapiens
gcctgcgtggctgaccc

SEQ ID NO: 568623 - DNA, 12 bp, Homo sapiens
gcctgctccttc

SEQ ID NO: 568624 - DNA, 13 bp, Homo sapiens
gcctgctccttcc

SEQ ID NO: 568625 - DNA, 16 bp, Homo sapiens
gcctgcttttgcaaat

SEQ ID NO: 568626 - DNA, 16 bp, Homo sapiens
gcctgtcgatgagact

SEQ ID NO: 568627 - DNA, 19 bp, Homo sapiens
gcctgtgaccggggtcctg

SEQ ID NO: 568628 - DNA, 13 bp, Homo sapiens
gcctgtgagtgac

SEQ ID NO: 568629 - DNA, 14 bp, Homo sapiens
gcctgtgagtgaca

SEQ ID NO: 568630 - DNA, 13 bp, Homo sapiens
gccttaaaacttt

SEQ ID NO: 568631 - DNA, 16 bp, Homo sapiens
gccttaagtcttactg

SEQ ID NO: 568632 - DNA, 23 bp, Homo sapiens
gccttgcccactcctgctctgct

SEQ ID NO: 568633 - DNA, 15 bp, Homo sapiens
gccttgggctctgct

SEQ ID NO: 568634 - DNA, 17 bp, Homo sapiens
gccttggggtcaggttg

SEQ ID NO: 568635 - DNA, 16 bp, Homo sapiens
gcctttcagcaggcag

SEQ ID NO: 568636 - DNA, 17 bp, Homo sapiens
gcctttccagtgctgct

SEQ ID NO: 568637 - DNA, 23 bp, Homo sapiens
gcgaaaaactcaaccaaatggta

SEQ ID NO: 568638 - DNA, 12 bp, Homo sapiens
gcgaacacagtg

SEQ ID NO: 568639 - DNA, 12 bp, Homo sapiens
gcgacagagcag

SEQ ID NO: 568640 - DNA, 18 bp, Homo sapiens
gcgacaggagtatttttt

SEQ ID NO: 568641 - DNA, 17 bp, Homo sapiens
gcgagtccaggagctca

SEQ ID NO: 568642 - DNA, 12 bp, Homo sapiens
gcgagtctggag

SEQ ID NO: 568643 - DNA, 22 bp, Homo sapiens
gcgatgtgttctttgtacctgt

SEQ ID NO: 568644 - DNA, 15 bp, Homo sapiens
gcgcacccggcagcc

SEQ ID NO: 568645 - DNA, 20 bp, Homo sapiens
gcgccttctacctgcaggac

SEQ ID NO: 568646 - DNA, 21 bp, Homo sapiens
gcgctaacttgcttaaatgtg

SEQ ID NO: 568647 - DNA, 12 bp, Homo sapiens
gcggcagagagg

SEQ ID NO: 568648 - DNA, 18 bp, Homo sapiens
gcggccggcctggggccg

SEQ ID NO: 568649 - DNA, 19 bp, Homo sapiens
gcgggcagtgacgtgagtg

SEQ ID NO: 568650 - DNA, 16 bp, Homo sapiens
gcgggctgggcagctg

SEQ ID NO: 568651 - DNA, 23 bp, Homo sapiens
gcgggtcatattcataccttctg

SEQ ID NO: 568652 - DNA, 18 bp, Homo sapiens
gcggtgcccaaccacact

SEQ ID NO: 568653 - DNA, 16 bp, Homo sapiens
gcgtagggccagggct

SEQ ID NO: 568654 - DNA, 14 bp, Homo sapiens
gcgtgaaacacaat

SEQ ID NO: 568655 - DNA, 17 bp, Homo sapiens
gcgtggcctggggctgc

SEQ ID NO: 568656 - DNA, 17 bp, Homo sapiens
gcgttcaccagtgacct

SEQ ID NO: 568657 - DNA, 17 bp, Homo sapiens
gcgttgttttgtggata

SEQ ID NO: 568658 - DNA, 21 bp, Homo sapiens
gcgttgttttgtggataagaa

SEQ ID NO: 568659 - DNA, 23 bp, Homo sapiens
gctaaacgtgtatgtttttcagt

SEQ ID NO: 568660 - DNA, 19 bp, Homo sapiens
gctaaccttttcacctcca

SEQ ID NO: 568661 - DNA, 18 bp, Homo sapiens
gctaacttgcttaaatgt

SEQ ID NO: 568662 - DNA, 22 bp, Homo sapiens
gctaacttgcttaaatgtgaat

SEQ ID NO: 568663 - DNA, 23 bp, Homo sapiens
gctaagataattaaatgaaatac

SEQ ID NO: 568664 - DNA, 18 bp, Homo sapiens
gctaagtaaatctcttct

SEQ ID NO: 568665 - DNA, 15 bp, Homo sapiens
gctaagtccagctct

SEQ ID NO: 568666 - DNA, 14 bp, Homo sapiens
gctaagtctttccc

SEQ ID NO: 568667 - DNA, 23 bp, Homo sapiens
gctaagttgtcttacacttctca

SEQ ID NO: 568668 - DNA, 15 bp, Homo sapiens
gctaattaaaaagtt

SEQ ID NO: 568669 - DNA, 17 bp, Homo sapiens
gctacaggggaggctga

SEQ ID NO: 568670 - DNA, 18 bp, Homo sapiens
gctacagtagctgtgggg

SEQ ID NO: 568671 - DNA, 16 bp, Homo sapiens
gctacccgtgagccct

SEQ ID NO: 568672 - DNA, 13 bp, Homo sapiens
gctacttaagaga

SEQ ID NO: 568673 - DNA, 23 bp, Homo sapiens
gctagagcagcccaaatttttct

SEQ ID NO: 568674 - DNA, 15 bp, Homo sapiens
gctagcacagctccc

SEQ ID NO: 568675 - DNA, 14 bp, Homo sapiens
gctagccatatatt

SEQ ID NO: 568676 - DNA, 20 bp, Homo sapiens
gctaggcagggtgtctgccc

SEQ ID NO: 568677 - DNA, 16 bp, Homo sapiens
gctataaatagtgaaa

SEQ ID NO: 568678 - DNA, 15 bp, Homo sapiens
gctatatatataaat

SEQ ID NO: 568679 - DNA, 19 bp, Homo sapiens
gctatatatataaatattt

SEQ ID NO: 568680 - DNA, 15 bp, Homo sapiens
gctatatttaagtat

SEQ ID NO: 568681 - DNA, 12 bp, Homo sapiens
gctatttaagtg

SEQ ID NO: 568682 - DNA, 22 bp, Homo sapiens
gctatttaagtggactgtattt

SEQ ID NO: 568683 - DNA, 18 bp, Homo sapiens
gctattttactgtcttaa

SEQ ID NO: 568684 - DNA, 16 bp, Homo sapiens
gctcaagcccaggagg

SEQ ID NO: 568685 - DNA, 15 bp, Homo sapiens
tcatttctaaaagaa

SEQ ID NO: 568686 - DNA, 17 bp, Homo sapiens
tcattttcattagcaaa

SEQ ID NO: 568687 - DNA, 15 bp, Homo sapiens
tcattttgagaacat

SEQ ID NO: 568688 - DNA, 13 bp, Homo sapiens
tccaaaagaaaaa

SEQ ID NO: 568689 - DNA, 12 bp, Homo sapiens
tccaaatgtcta

SEQ ID NO: 568690 - DNA, 19 bp, Homo sapiens
tccaacaccacagacacac

SEQ ID NO: 568691 - DNA, 20 bp, Homo sapiens
tccaacaccacagacacaca

SEQ ID NO: 568692 - DNA, 13 bp, Homo sapiens
cagatgcagctct

SEQ ID NO: 568693 - DNA, 17 bp, Homo sapiens
cagatgcagctcttcct

SEQ ID NO: 568694 - DNA, 15 bp, Homo sapiens
cagatgcctcagagg

SEQ ID NO: 568695 - DNA, 14 bp, Homo sapiens
cagatgctctgaga

SEQ ID NO: 568696 - DNA, 14 bp, Homo sapiens
cagattcacttctg

SEQ ID NO: 568697 - DNA, 14 bp, Homo sapiens
cagattcctttggc

SEQ ID NO: 568698 - DNA, 12 bp, Homo sapiens
cagattggattt

SEQ ID NO: 568699 - DNA, 21 bp, Homo sapiens
cagattggattttatgttgac

SEQ ID NO: 568700 - DNA, 23 bp, Homo sapiens
cagattggattttatgttgacat

SEQ ID NO: 568701 - DNA, 18 bp, Homo sapiens
cagatttaagcaagacca

SEQ ID NO: 568702 - DNA, 22 bp, Homo sapiens
cagatttaagcaagaccatggg

SEQ ID NO: 568703 - DNA, 17 bp, Homo sapiens
cagatttgcaacagcaa

SEQ ID NO: 568704 - DNA, 13 bp, Homo sapiens
cagatttgcacaa

SEQ ID NO: 568705 - DNA, 15 bp, Homo sapiens
cagattttagtttta

SEQ ID NO: 568706 - DNA, 17 bp, Homo sapiens
cagcaaacccaaagatg

SEQ ID NO: 568707 - DNA, 22 bp, Homo sapiens
cagcaaacccaaagatgttaac

SEQ ID NO: 568708 - DNA, 18 bp, Homo sapiens
cagcaaattaatgtgtaa

SEQ ID NO: 568709 - DNA, 16 bp, Homo sapiens
cagcaaggtcttgctc

SEQ ID NO: 568710 - DNA, 12 bp, Homo sapiens
cagcacagagag

SEQ ID NO: 568711 - DNA, 17 bp, Homo sapiens
cagcacagagagggggc

SEQ ID NO: 568712 - DNA, 20 bp, Homo sapiens
cagcacagagagggggccac

SEQ ID NO: 568713 - DNA, 19 bp, Homo sapiens
cagcaccaccctccttccc

SEQ ID NO: 568714 - DNA, 19 bp, Homo sapiens
cagcagatccacctgcaca

SEQ ID NO: 568715 - DNA, 19 bp, Homo sapiens
cagcagcggcagcagcagc

SEQ ID NO: 568716 - DNA, 13 bp, Homo sapiens
cagcaggcagcct

SEQ ID NO: 568717 - DNA, 11 bp, Homo sapiens
cagcagggcag

SEQ ID NO: 568718 - DNA, 24 bp, Homo sapiens
cagcaggttgtgtgtgtgtgcagt

SEQ ID NO: 568719 - DNA, 16 bp, Homo sapiens
cagcagtgagagcaga

SEQ ID NO: 568720 - DNA, 19 bp, Homo sapiens
cagcatacattttctggtg

SEQ ID NO: 568721 - DNA, 12 bp, Homo sapiens
cagcatatatat

SEQ ID NO: 568722 - DNA, 18 bp, Homo sapiens
cagcatgcgatgtcatat

SEQ ID NO: 568723 - DNA, 15 bp, Homo sapiens
cagcatggcatccaa

SEQ ID NO: 568724 - DNA, 15 bp, Homo sapiens
cagccaatctccagg

SEQ ID NO: 568725 - DNA, 20 bp, Homo sapiens
cagccaatctccaggctccc

SEQ ID NO: 568726 - DNA, 22 bp, Homo sapiens
cagccaatctccaggctccctc

SEQ ID NO: 568727 - DNA, 16 bp, Homo sapiens
cagccagaactctgtg

SEQ ID NO: 568728 - DNA, 21 bp, Homo sapiens
cagccataggccctttcagtg

SEQ ID NO: 568729 - DNA, 16 bp, Homo sapiens
cagcccaatccctgat

SEQ ID NO: 568730 - DNA, 18 bp, Homo sapiens
cagcccaggcatctcctt

SEQ ID NO: 568731 - DNA, 14 bp, Homo sapiens
cagccccaccctgt

SEQ ID NO: 568732 - DNA, 21 bp, Homo sapiens
cagccccagacaacagcccag

SEQ ID NO: 568733 - DNA, 23 bp, Homo sapiens
cagccccagacaacagcccaggc

SEQ ID NO: 568734 - DNA, 19 bp, Homo sapiens
cagccccagcgagtctgga

SEQ ID NO: 568735 - DNA, 23 bp, Homo sapiens
cagccccagcgagtctggagacc

SEQ ID NO: 568736 - DNA, 18 bp, Homo sapiens
cagcccctccctcctctg

SEQ ID NO: 568737 - DNA, 14 bp, Homo sapiens
cagcccctgctgct

SEQ ID NO: 568738 - DNA, 23 bp, Homo sapiens
cagcccctgctgctcctcggcca

SEQ ID NO: 568739 - DNA, 23 bp, Homo sapiens
cagcccgggagatccgccctggg

SEQ ID NO: 568740 - DNA, 13 bp, Homo sapiens
cagcccttcctct

SEQ ID NO: 568741 - DNA, 16 bp, Homo sapiens
cagcccttcctctgct

SEQ ID NO: 568742 - DNA, 18 bp, Homo sapiens
cagcccttcctctgctcc

SEQ ID NO: 568743 - DNA, 19 bp, Homo sapiens
cagcccttcctctgctccc

SEQ ID NO: 568744 - DNA, 20 bp, Homo sapiens
cagcctactagggacctggg

SEQ ID NO: 568745 - DNA, 13 bp, Homo sapiens
cagcctcatcagt

SEQ ID NO: 568746 - DNA, 23 bp, Homo sapiens
cagcctctccaggcaccatctcc

SEQ ID NO: 568747 - DNA, 16 bp, Homo sapiens
cagcctctttcccttc

SEQ ID NO: 568748 - DNA, 18 bp, Homo sapiens
cagcctgcgtggctgacc

SEQ ID NO: 568749 - DNA, 21 bp, Homo sapiens
cagcctgcgtggctgaccccc

SEQ ID NO: 568750 - DNA, 21 bp, Homo sapiens
cagcctgggataggggcagag

SEQ ID NO: 568751 - DNA, 21 bp, Homo sapiens
cagccttagctctcccaactc

SEQ ID NO: 568752 - DNA, 20 bp, Homo sapiens
cagctacaggggaggctgag

SEQ ID NO: 568753 - DNA, 15 bp, Homo sapiens
cagctagaaagagaa

SEQ ID NO: 568754 - DNA, 17 bp, Homo sapiens
cagctaggaacaaatct

SEQ ID NO: 568755 - DNA, 17 bp, Homo sapiens
cagctcagcattgtgta

SEQ ID NO: 568756 - DNA, 15 bp, Homo sapiens
cagctcccccagctc

SEQ ID NO: 568757 - DNA, 23 bp, Homo sapiens
cagctcccgctccgggctccgac

SEQ ID NO: 568758 - DNA, 21 bp, Homo sapiens
cagctccctcaaagaggcagt

SEQ ID NO: 568759 - DNA, 16 bp, Homo sapiens
cagctccttttccaga

SEQ ID NO: 568760 - DNA, 21 bp, Homo sapiens
cagctccttttccagagcatt

SEQ ID NO: 568761 - DNA, 13 bp, Homo sapiens
cagctctctgtat

SEQ ID NO: 568762 - DNA, 16 bp, Homo sapiens
cagctctctgtataaa

SEQ ID NO: 568763 - DNA, 14 bp, Homo sapiens
cagctctggcatgg

SEQ ID NO: 568764 - DNA, 13 bp, Homo sapiens
cagctcttcctgg

SEQ ID NO: 568765 - DNA, 18 bp, Homo sapiens
cagctgaagccagctccc

SEQ ID NO: 568766 - DNA, 21 bp, Homo sapiens
cagctgaagccagctccctga

SEQ ID NO: 568767 - DNA, 14 bp, Homo sapiens
cagctgcatggcac

SEQ ID NO: 568768 - DNA, 16 bp, Homo sapiens
cagctggacaccccct

SEQ ID NO: 568769 - DNA, 22 bp, Homo sapiens
cagctgttagagtccaacgtgg

SEQ ID NO: 568770 - DNA, 17 bp, Homo sapiens
cagctgttgtctcttct

SEQ ID NO: 568771 - DNA, 14 bp, Homo sapiens
cagcttcaccagag

SEQ ID NO: 568772 - DNA, 22 bp, Homo sapiens
cagcttcttaatataactgcct

SEQ ID NO: 568773 - DNA, 19 bp, Homo sapiens
caggaaaagaaaaatttct

SEQ ID NO: 568774 - DNA, 15 bp, Homo sapiens
caggaaaggaagatg

SEQ ID NO: 568775 - DNA, 21 bp, Homo sapiens
caggaacacatgcacacacac

SEQ ID NO: 568776 - DNA, 18 bp, Homo sapiens
caggaacacccagcccca

SEQ ID NO: 568777 - DNA, 21 bp, Homo sapiens
caggctcccactgcccctgca

SEQ ID NO: 568778 - DNA, 12 bp, Homo sapiens
caggctccctcc

SEQ ID NO: 568779 - DNA, 23 bp, Homo sapiens
caggctccctccctcccagatcc

SEQ ID NO: 568780 - DNA, 16 bp, Homo sapiens
caggctctctgggctg

SEQ ID NO: 568781 - DNA, 11 bp, Homo sapiens
caggctgcccc

SEQ ID NO: 568782 - DNA, 13 bp, Homo sapiens
caggctgccccac

SEQ ID NO: 568783 - DNA, 18 bp, Homo sapiens
caggctgccccacccctc

SEQ ID NO: 568784 - DNA, 19 bp, Homo sapiens
cagggaagataagttggaa

SEQ ID NO: 568785 - DNA, 14 bp, Homo sapiens
cagggagaccctgg

SEQ ID NO: 568786 - DNA, 19 bp, Homo sapiens
cagggagaccctgggagag

SEQ ID NO: 568787 - DNA, 22 bp, Homo sapiens
cagggagaccctgggagagtga

SEQ ID NO: 568788 - DNA, 13 bp, Homo sapiens
cagggagccctgg

SEQ ID NO: 568789 - DNA, 23 bp, Homo sapiens
cagggaggtgtgaggcaggagag

SEQ ID NO: 568790 - DNA, 22 bp, Homo sapiens
cagggcagattttagttttatt

SEQ ID NO: 568791 - DNA, 14 bp, Homo sapiens
cagggcatgaaatg

SEQ ID NO: 568792 - DNA, 19 bp, Homo sapiens
cagggccgatggggcagtc

SEQ ID NO: 568793 - DNA, 18 bp, Homo sapiens
cagggctctggcaggtgg

SEQ ID NO: 568794 - DNA, 19 bp, Homo sapiens
cagggctggggcagcctct

SEQ ID NO: 568795 - DNA, 16 bp, Homo sapiens
caggggacacccagaa

SEQ ID NO: 568796 - DNA, 12 bp, Homo sapiens
caggggaggctg

SEQ ID NO: 568797 - DNA, 13 bp, Homo sapiens
caggggaggctga

SEQ ID NO: 568798 - DNA, 12 bp, Homo sapiens
caggggcacact

SEQ ID NO: 568799 - DNA, 17 bp, Homo sapiens
caggggccctgcagctc

SEQ ID NO: 568800 - DNA, 18 bp, Homo sapiens
caggggtggaggagagcc

SEQ ID NO: 568801 - DNA, 19 bp, Homo sapiens
cagggtcctgggggctgct

SEQ ID NO: 568802 - DNA, 21 bp, Homo sapiens
cagggtcctgggggctgctgc

SEQ ID NO: 568803 - DNA, 14 bp, Homo sapiens
cagggtgacctgct

SEQ ID NO: 568804 - DNA, 18 bp, Homo sapiens
cagggtgagcccatgtgg

SEQ ID NO: 568805 - DNA, 24 bp, Homo sapiens
cagggtgtctgccccctcctgagt

SEQ ID NO: 568806 - DNA, 15 bp, Homo sapiens
caggtaccagttctt

SEQ ID NO: 568807 - DNA, 13 bp, Homo sapiens
caggtaggaatat

SEQ ID NO: 568808 - DNA, 23 bp, Homo sapiens
caggtaggaatattatatttgga

SEQ ID NO: 568809 - DNA, 17 bp, Homo sapiens
caggtcctgctcagcag

SEQ ID NO: 568810 - DNA, 20 bp, Homo sapiens
caggtctcagaatctttcct

SEQ ID NO: 568811 - DNA, 18 bp, Homo sapiens
caggtgaaggaggctcca

SEQ ID NO: 568812 - DNA, 15 bp, Homo sapiens
caggtgcacagacgt

SEQ ID NO: 568813 - DNA, 22 bp, Homo sapiens
caggtgcccctctctccatcag

SEQ ID NO: 568814 - DNA, 17 bp, Homo sapiens
caggtggccagggctcc

SEQ ID NO: 568815 - DNA, 19 bp, Homo sapiens
caggtggccagggctccac

SEQ ID NO: 568816 - DNA, 21 bp, Homo sapiens
caggtggccagggctccacgg

SEQ ID NO: 568817 - DNA, 16 bp, Homo sapiens
caggtgggtgtctgcg

SEQ ID NO: 568818 - DNA, 20 bp, Homo sapiens
caggtgtgagggcagtgcaa

SEQ ID NO: 568819 - DNA, 16 bp, Homo sapiens
caggttaaatgttttg

SEQ ID NO: 568820 - DNA, 22 bp, Homo sapiens
caggttgaagacctaaccaggg

SEQ ID NO: 568821 - DNA, 14 bp, Homo sapiens
caggttttgcactc

SEQ ID NO: 568822 - DNA, 18 bp, Homo sapiens
cagtaaagaaagcagaat

SEQ ID NO: 568823 - DNA, 22 bp, Homo sapiens
cagtaacacatagactgtgcgc

SEQ ID NO: 568824 - DNA, 14 bp, Homo sapiens
cagtaactgccatt

SEQ ID NO: 568825 - DNA, 19 bp, Homo sapiens
cagtacattctcagttttt

SEQ ID NO: 568826 - DNA, 19 bp, Homo sapiens
cagtacccatggggctagg

SEQ ID NO: 568827 - DNA, 18 bp, Homo sapiens
cagtagcttaagaaaaaa

SEQ ID NO: 568828 - DNA, 13 bp, Homo sapiens
cagtagtgaccaa

SEQ ID NO: 568829 - DNA, 14 bp, Homo sapiens
cagtataaagaata

SEQ ID NO: 568830 - DNA, 15 bp, Homo sapiens
cagtataaagaatag

SEQ ID NO: 568831 - DNA, 18 bp, Homo sapiens
cagtataaagaataggac

SEQ ID NO: 568832 - DNA, 19 bp, Homo sapiens
cagtattgacaataagaaa

SEQ ID NO: 568833 - DNA, 15 bp, Homo sapiens
cagtattttagtgga

SEQ ID NO: 568834 - DNA, 15 bp, Homo sapiens
cagtcaaggagtggc

SEQ ID NO: 568835 - DNA, 12 bp, Homo sapiens
cagtcaggaagc

SEQ ID NO: 568836 - DNA, 21 bp, Homo sapiens
cagtcaggaagcctcctgctg

SEQ ID NO: 568837 - DNA, 22 bp, Homo sapiens
cagtcaggaagcctcctgctga

SEQ ID NO: 568838 - DNA, 15 bp, Homo sapiens
cagtcatctcccctc

SEQ ID NO: 568839 - DNA, 14 bp, Homo sapiens
cagtccccttcccg

SEQ ID NO: 568840 - DNA, 22 bp, Homo sapiens
cagtccccttcccgtgacctgg

SEQ ID NO: 568841 - DNA, 23 bp, Homo sapiens
cagtccctgagaccatttaacat

SEQ ID NO: 568842 - DNA, 23 bp, Homo sapiens
cagtcgcctttcagcaggcagcc

SEQ ID NO: 568843 - DNA, 10 bp, Homo sapiens
cagtctcaca

SEQ ID NO: 568844 - DNA, 20 bp, Homo sapiens
cagtctcacatttctcaaca

SEQ ID NO: 568845 - DNA, 15 bp, Homo sapiens
cagtctctttcttcc

SEQ ID NO: 568846 - DNA, 21 bp, Homo sapiens
cagtctctttcttcctttcta

SEQ ID NO: 568847 - DNA, 19 bp, Homo sapiens
cagtcttaatattcagaga

SEQ ID NO: 568848 - DNA, 17 bp, Homo sapiens
cagtcttatgcttccag

SEQ ID NO: 568849 - DNA, 20 bp, Homo sapiens
cagtgacctggaaggcccag

SEQ ID NO: 568850 - DNA, 15 bp, Homo sapiens
cagtgagagcagatg

SEQ ID NO: 568851 - DNA, 14 bp, Homo sapiens
cagtgagctggaga

SEQ ID NO: 568852 - DNA, 15 bp, Homo sapiens
cagtgatattctttg

SEQ ID NO: 568853 - DNA, 20 bp, Homo sapiens
cagtgattcgagctatattt

SEQ ID NO: 568854 - DNA, 15 bp, Homo sapiens
cagtgcacctgggac

SEQ ID NO: 568855 - DNA, 15 bp, Homo sapiens
cagtgctcacacaat

SEQ ID NO: 568856 - DNA, 18 bp, Homo sapiens
cagtggaaattcaggtga

SEQ ID NO: 568857 - DNA, 14 bp, Homo sapiens
cagtggcaaaatat

SEQ ID NO: 568858 - DNA, 17 bp, Homo sapiens
cagtggcttggagcaga

SEQ ID NO: 568859 - DNA, 21 bp, Homo sapiens
cagtggcttggagcagaggtg

SEQ ID NO: 568860 - DNA, 20 bp, Homo sapiens
cagtggggcctgaggctcct

SEQ ID NO: 568861 - DNA, 22 bp, Homo sapiens
cagtgtaccattaaaatatgca

SEQ ID NO: 568862 - DNA, 17 bp, Homo sapiens
cagtgtccccaggggca

SEQ ID NO: 568863 - DNA, 20 bp, Homo sapiens
cagtgtccccaggggcacac

SEQ ID NO: 568864 - DNA, 15 bp, Homo sapiens
cagtgtgtagtttgt

SEQ ID NO: 568865 - DNA, 15 bp, Homo sapiens
cagtgtttactttaa

SEQ ID NO: 568866 - DNA, 14 bp, Homo sapiens
cagtgtttctgggg

SEQ ID NO: 568867 - DNA, 19 bp, Homo sapiens
cagttacagtggcagtatt

SEQ ID NO: 568868 - DNA, 20 bp, Homo sapiens
cagttacagtggcagtattg

SEQ ID NO: 568869 - DNA, 23 bp, Homo sapiens
cagttactttccaattctccttt

SEQ ID NO: 568870 - DNA, 20 bp, Homo sapiens
catggtgcaatttgtctttg

SEQ ID NO: 568871 - DNA, 15 bp, Homo sapiens
catgtcctatgtgtg

SEQ ID NO: 568872 - DNA, 14 bp, Homo sapiens
catgtcgcacaatg

SEQ ID NO: 568873 - DNA, 15 bp, Homo sapiens
catgtcgcacaatgt

SEQ ID NO: 568874 - DNA, 17 bp, Homo sapiens
catgtgcgaacacagtg

SEQ ID NO: 568875 - DNA, 19 bp, Homo sapiens
catgtggcctaatattgaa

SEQ ID NO: 568876 - DNA, 13 bp, Homo sapiens
catgtgtatggaa

SEQ ID NO: 568877 - DNA, 15 bp, Homo sapiens
catgtgtgtatatat

SEQ ID NO: 568878 - DNA, 16 bp, Homo sapiens
catgtgtgtatatatg

SEQ ID NO: 568879 - DNA, 18 bp, Homo sapiens
catgtgtgtatatatgtg

SEQ ID NO: 568880 - DNA, 15 bp, Homo sapiens
catgtgtgtgagttt

SEQ ID NO: 568881 - DNA, 21 bp, Homo sapiens
catgttcccacttcaaaacaa

SEQ ID NO: 568882 - DNA, 16 bp, Homo sapiens
catgttcttgcagtca

SEQ ID NO: 568883 - DNA, 17 bp, Homo sapiens
catgttggtaccctgga

SEQ ID NO: 568884 - DNA, 20 bp, Homo sapiens
catgttttcaaatggagttg

SEQ ID NO: 568885 - DNA, 22 bp, Homo sapiens
catgttttcaaatggagttgga

SEQ ID NO: 568886 - DNA, 14 bp, Homo sapiens
cattaaaaacattt

SEQ ID NO: 568887 - DNA, 15 bp, Homo sapiens
cattaaaaacatttt

SEQ ID NO: 568888 - DNA, 14 bp, Homo sapiens
cattaaagagccat

SEQ ID NO: 568889 - DNA, 17 bp, Homo sapiens
cattaaggccacatcca

SEQ ID NO: 568890 - DNA, 16 bp, Homo sapiens
cattaatgttgatttc

SEQ ID NO: 568891 - DNA, 17 bp, Homo sapiens
cattaatgttgatttct

SEQ ID NO: 568892 - DNA, 15 bp, Homo sapiens
cattacggctcctct

SEQ ID NO: 568893 - DNA, 13 bp, Homo sapiens
cattactgtcccc

SEQ ID NO: 568894 - DNA, 20 bp, Homo sapiens
cattagcaaaaaaagttgta

SEQ ID NO: 568895 - DNA, 14 bp, Homo sapiens
cattagcccactgc

SEQ ID NO: 568896 - DNA, 19 bp, Homo sapiens
cattatagattttcatgtt

SEQ ID NO: 568897 - DNA, 16 bp, Homo sapiens
cattatggctttgtgc

SEQ ID NO: 568898 - DNA, 17 bp, Homo sapiens
cattatggctttgtgct

SEQ ID NO: 568899 - DNA, 20 bp, Homo sapiens
cattatggctttgtgcttgt

SEQ ID NO: 568900 - DNA, 19 bp, Homo sapiens
cattatgtgtgcatgtgtg

SEQ ID NO: 568901 - DNA, 18 bp, Homo sapiens
cattcatattacaatatt

SEQ ID NO: 568902 - DNA, 16 bp, Homo sapiens
gagaggacgtgggcgg

SEQ ID NO: 568903 - DNA, 20 bp, Homo sapiens
gagaggctaaaatgttttca

SEQ ID NO: 568904 - DNA, 21 bp, Homo sapiens
gagaggctaaaatgttttcag

SEQ ID NO: 568905 - DNA, 22 bp, Homo sapiens
gagagtgaggtcatcccggggc

SEQ ID NO: 568906 - DNA, 10 bp, Homo sapiens
aaaaaaactg

SEQ ID NO: 568907 - DNA, 11 bp, Homo sapiens
aaaaaaagaaa

SEQ ID NO: 568908 - DNA, 12 bp, Homo sapiens
aaaaaagttgta

SEQ ID NO: 568909 - DNA, 20 bp, Homo sapiens
aaaaactactgaataaatca

SEQ ID NO: 568910 - DNA, 12 bp, Homo sapiens
aaaaactgaagt

SEQ ID NO: 568911 - DNA, 13 bp, Homo sapiens
aaaaactgaagtt

SEQ ID NO: 568912 - DNA, 14 bp, Homo sapiens
aaaaagacttcaaa

SEQ ID NO: 568913 - DNA, 17 bp, Homo sapiens
aaaaagataccttaaaa

SEQ ID NO: 568914 - DNA, 20 bp, Homo sapiens
aaaaagtattgccaaacatt

SEQ ID NO: 568915 - DNA, 15 bp, Homo sapiens
aaaaagtcttttaaa

SEQ ID NO: 568916 - DNA, 13 bp, Homo sapiens
aaaaagtgacaca

SEQ ID NO: 568917 - DNA, 16 bp, Homo sapiens
aaaaagtgacacagca

SEQ ID NO: 568918 - DNA, 19 bp, Homo sapiens
aaaaagtgacacagcagct

SEQ ID NO: 568919 - DNA, 20 bp, Homo sapiens
aaaaagtgacacagcagctt

SEQ ID NO: 568920 - DNA, 20 bp, Homo sapiens
aaaaagttggtattttataa

SEQ ID NO: 568921 - DNA, 23 bp, Homo sapiens
aaaaagttggtattttataagca

SEQ ID NO: 568922 - DNA, 18 bp, Homo sapiens
aaaaatagctataaatag

SEQ ID NO: 568923 - DNA, 23 bp, Homo sapiens
aaaaatatgtgaaggaccttcac

SEQ ID NO: 568924 - DNA, 15 bp, Homo sapiens
aaaaatcagtttttg

SEQ ID NO: 568925 - DNA, 21 bp, Homo sapiens
aaaaatctgaagattgtttat

SEQ ID NO: 568926 - DNA, 10 bp, Homo sapiens
aaaaatgaaa

SEQ ID NO: 568927 - DNA, 15 bp, Homo sapiens
aaaaatgcatttaag

SEQ ID NO: 568928 - DNA, 18 bp, Homo sapiens
aaaaatgcatttaagttg

SEQ ID NO: 568929 - DNA, 16 bp, Homo sapiens
aaaaatgcttgaccct

SEQ ID NO: 568930 - DNA, 13 bp, Homo sapiens
aaaaatgtatgtt

SEQ ID NO: 568931 - DNA, 16 bp, Homo sapiens
aaaaattatctttaaa

SEQ ID NO: 568932 - DNA, 19 bp, Homo sapiens
aaaaattattgattgcttt

SEQ ID NO: 568933 - DNA, 12 bp, Homo sapiens
aaaaatttaaga

SEQ ID NO: 568934 - DNA, 20 bp, Homo sapiens
aaaaatttctggcaaatatt

SEQ ID NO: 568935 - DNA, 23 bp, Homo sapiens
aaaaatttctggcaaatattttg

SEQ ID NO: 568936 - DNA, 14 bp, Homo sapiens
aaaacaaaatcctt

SEQ ID NO: 568937 - DNA, 13 bp, Homo sapiens
aaaacagaaattg

SEQ ID NO: 568938 - DNA, 15 bp, Homo sapiens
aaaacagaaattggt

SEQ ID NO: 568939 - DNA, 22 bp, Homo sapiens
aaaacagccataggccctttca

SEQ ID NO: 568940 - DNA, 15 bp, Homo sapiens
aaaacatttttttaa

SEQ ID NO: 568941 - DNA, 18 bp, Homo sapiens
aaaacatttttttaagca

SEQ ID NO: 568942 - DNA, 18 bp, Homo sapiens
aaaaccctcgatgttcat

SEQ ID NO: 568943 - DNA, 19 bp, Homo sapiens
aaaaccctcgatgttcatg

SEQ ID NO: 568944 - DNA, 15 bp, Homo sapiens
aaaacgatttaattt

SEQ ID NO: 568945 - DNA, 17 bp, Homo sapiens
aaaacgatttaatttat

SEQ ID NO: 568946 - DNA, 15 bp, Homo sapiens
aaaactactgaataa

SEQ ID NO: 568947 - DNA, 17 bp, Homo sapiens
aaaactacttagcactt

SEQ ID NO: 568948 - DNA, 19 bp, Homo sapiens
aaaactgtactttgattca

SEQ ID NO: 568949 - DNA, 22 bp, Homo sapiens
aaaactgtactttgattcacat

SEQ ID NO: 568950 - DNA, 11 bp, Homo sapiens
aaaactttgtt

SEQ ID NO: 568951 - DNA, 11 bp, Homo sapiens
aaaagaaaaaa

SEQ ID NO: 568952 - DNA, 12 bp, Homo sapiens
aaaagaaaaaga

SEQ ID NO: 568953 - DNA, 21 bp, Homo sapiens
aaaagaaaaatttctggcaaa

SEQ ID NO: 568954 - DNA, 12 bp, Homo sapiens
aaaagaaatcta

SEQ ID NO: 568955 - DNA, 14 bp, Homo sapiens
aaaagaatattcag

SEQ ID NO: 568956 - DNA, 21 bp, Homo sapiens
aaaagaatattcagagaatat

SEQ ID NO: 568957 - DNA, 12 bp, Homo sapiens
aaaagacatgtt

SEQ ID NO: 568958 - DNA, 18 bp, Homo sapiens
aaaagacatgttgtaaat

SEQ ID NO: 568959 - DNA, 14 bp, Homo sapiens
aaaagaccaagact

SEQ ID NO: 568960 - DNA, 15 bp, Homo sapiens
aaaagaccaagactt

SEQ ID NO: 568961 - DNA, 16 bp, Homo sapiens
aaaagaccaagacttt

SEQ ID NO: 568962 - DNA, 13 bp, Homo sapiens
aaaagcaactttt

SEQ ID NO: 568963 - DNA, 18 bp, Homo sapiens
aaaagcccatgcttaaat

SEQ ID NO: 568964 - DNA, 14 bp, Homo sapiens
aaaagggacatgaa

SEQ ID NO: 568965 - DNA, 18 bp, Homo sapiens
aaaagtcttttaaaaagt

SEQ ID NO: 568966 - DNA, 14 bp, Homo sapiens
aaaagtgacacagc

SEQ ID NO: 568967 - DNA, 15 bp, Homo sapiens
aaaagtgtctcaaag

SEQ ID NO: 568968 - DNA, 21 bp, Homo sapiens
aaaagtgtctcaaaggagctt

SEQ ID NO: 568969 - DNA, 15 bp, Homo sapiens
aaaagttcttaaaac

SEQ ID NO: 568970 - DNA, 21 bp, Homo sapiens
aaaataaaaagtgacacagca

SEQ ID NO: 568971 - DNA, 11 bp, Homo sapiens
aaaataaatgg

SEQ ID NO: 568972 - DNA, 13 bp, Homo sapiens
aaaataagtgaat

SEQ ID NO: 568973 - DNA, 19 bp, Homo sapiens
aaaatacacgtgtatatga

SEQ ID NO: 568974 - DNA, 11 bp, Homo sapiens
aaaatactgta

SEQ ID NO: 568975 - DNA, 12 bp, Homo sapiens
aaaatacttctt

SEQ ID NO: 568976 - DNA, 16 bp, Homo sapiens
aaaatagctataaata

SEQ ID NO: 568977 - DNA, 13 bp, Homo sapiens
aaaatatatatag

SEQ ID NO: 568978 - DNA, 19 bp, Homo sapiens
aaaatatatatagtgctat

SEQ ID NO: 568979 - DNA, 24 bp, Homo sapiens
aaaatatgaaattataatgcaata

SEQ ID NO: 568980 - DNA, 19 bp, Homo sapiens
aaaatatgagattggaaaa

SEQ ID NO: 568981 - DNA, 14 bp, Homo sapiens
aaaatatgcactaa

SEQ ID NO: 568982 - DNA, 13 bp, Homo sapiens
aaaatatgtctcg

SEQ ID NO: 568983 - DNA, 23 bp, Homo sapiens
aaaatatttgtgaaagtgccaaa

SEQ ID NO: 568984 - DNA, 16 bp, Homo sapiens
aaaatcagaaagacat

SEQ ID NO: 568985 - DNA, 20 bp, Homo sapiens
aaaatcagaaagacattctt

SEQ ID NO: 568986 - DNA, 20 bp, Homo sapiens
aaaatcagtttttgttctta

SEQ ID NO: 568987 - DNA, 12 bp, Homo sapiens
aaaatccagaaa

SEQ ID NO: 568988 - DNA, 12 bp, Homo sapiens
aaaatcttatta

SEQ ID NO: 568989 - DNA, 18 bp, Homo sapiens
aaaatcttattaaagttt

SEQ ID NO: 568990 - DNA, 17 bp, Homo sapiens
aaaatgaaaataagtga

SEQ ID NO: 568991 - DNA, 15 bp, Homo sapiens
aaaatgaaatgtttt

SEQ ID NO: 568992 - DNA, 16 bp, Homo sapiens
aaaatgaaatgtttta

SEQ ID NO: 568993 - DNA, 17 bp, Homo sapiens
aaaatgaaatttaagca

SEQ ID NO: 568994 - DNA, 20 bp, Homo sapiens
aaaatgaaatttaagcacaa

SEQ ID NO: 568995 - DNA, 19 bp, Homo sapiens
aaaatgagggtctcactgc

SEQ ID NO: 568996 - DNA, 21 bp, Homo sapiens
aaaatgagggtctcactgctt

SEQ ID NO: 568997 - DNA, 20 bp, Homo sapiens
aaaatgcatttaagttgtaa

SEQ ID NO: 568998 - DNA, 20 bp, Homo sapiens
aaaatgcttgaccctgaaat

SEQ ID NO: 568999 - DNA, 12 bp, Homo sapiens
aaaatggcattt

SEQ ID NO: 569000 - DNA, 16 bp, Homo sapiens
aaaatgtaactgttac

SEQ ID NO: 569001 - DNA, 12 bp, Homo sapiens
aaaatgtatgtt

SEQ ID NO: 569002 - DNA, 13 bp, Homo sapiens
aaaatgtcactgt

SEQ ID NO: 569003 - DNA, 16 bp, Homo sapiens
aaaatgtcactgttat

SEQ ID NO: 569004 - DNA, 21 bp, Homo sapiens
aaaatgtcactgttataaatt

SEQ ID NO: 569005 - DNA, 15 bp, Homo sapiens
aaaatgtgtgcttgg

SEQ ID NO: 569006 - DNA, 18 bp, Homo sapiens
aaaatgtgtgcttggaaa

SEQ ID NO: 569007 - DNA, 14 bp, Homo sapiens
aaaatgttttcagc

SEQ ID NO: 569008 - DNA, 16 bp, Homo sapiens
aaaattaaaatttaac

SEQ ID NO: 569009 - DNA, 20 bp, Homo sapiens
aaaattaagacaagcctggc

SEQ ID NO: 569010 - DNA, 16 bp, Homo sapiens
aaaattaaggaaatgt

SEQ ID NO: 569011 - DNA, 14 bp, Homo sapiens
aaaattatctttaa

SEQ ID NO: 569012 - DNA, 13 bp, Homo sapiens
aaaattcatttca

SEQ ID NO: 569013 - DNA, 16 bp, Homo sapiens
aaaattcatttcacat

SEQ ID NO: 569014 - DNA, 14 bp, Homo sapiens
aaaatttaacatct

SEQ ID NO: 569015 - DNA, 18 bp, Homo sapiens
aaaatttctggcaaatat

SEQ ID NO: 569016 - DNA, 23 bp, Homo sapiens
aaaatttctggcaaatattttgt

SEQ ID NO: 569017 - DNA, 17 bp, Homo sapiens
aaaatttgaaacattgc

SEQ ID NO: 569018 - DNA, 15 bp, Homo sapiens
aaaattttataagca

SEQ ID NO: 569019 - DNA, 12 bp, Homo sapiens
aaacaagcatat

SEQ ID NO: 569020 - DNA, 13 bp, Homo sapiens
aaacactaaatgt

SEQ ID NO: 569021 - DNA, 14 bp, Homo sapiens
aaacactaaatgtt

SEQ ID NO: 569022 - DNA, 17 bp, Homo sapiens
aaacactaaatgttaaa

SEQ ID NO: 569023 - DNA, 20 bp, Homo sapiens
aaacactaaatgttaaagat

SEQ ID NO: 569024 - DNA, 21 bp, Homo sapiens
aaacactaaatgttaaagatg

SEQ ID NO: 569025 - DNA, 22 bp, Homo sapiens
aaacactaaatgttaaagatgt

SEQ ID NO: 569026 - DNA, 14 bp, Homo sapiens
aaacagaaattggt

SEQ ID NO: 569027 - DNA, 15 bp, Homo sapiens
aaacagaactccctt

SEQ ID NO: 569028 - DNA, 19 bp, Homo sapiens
aaacagataccatactcat

SEQ ID NO: 569029 - DNA, 22 bp, Homo sapiens
aaacagatttaagcaagaccat

SEQ ID NO: 569030 - DNA, 11 bp, Homo sapiens
aaacagcagct

SEQ ID NO: 569031 - DNA, 13 bp, Homo sapiens
aaacagcagctga

SEQ ID NO: 569032 - DNA, 13 bp, Homo sapiens
aaacagtttaaca

SEQ ID NO: 569033 - DNA, 14 bp, Homo sapiens
aaacattaatgttg

SEQ ID NO: 569034 - DNA, 15 bp, Homo sapiens
aaacattaatgttga

SEQ ID NO: 569035 - DNA, 19 bp, Homo sapiens
aaacattaatgttgatttc

SEQ ID NO: 569036 - DNA, 20 bp, Homo sapiens
aaacattaatgttgatttct

SEQ ID NO: 569037 - DNA, 14 bp, Homo sapiens
aaacattagtactt

SEQ ID NO: 569038 - DNA, 21 bp, Homo sapiens
aaacattagtactttatagaa

SEQ ID NO: 569039 - DNA, 20 bp, Homo sapiens
aaacattatagattttcatg

SEQ ID NO: 569040 - DNA, 13 bp, Homo sapiens
aaacattggaagc

SEQ ID NO: 569041 - DNA, 15 bp, Homo sapiens
aaacatttcatgtat

SEQ ID NO: 569042 - DNA, 19 bp, Homo sapiens
aaacatttcctttttctat

SEQ ID NO: 569043 - DNA, 17 bp, Homo sapiens
aactcaaccaaatggta

SEQ ID NO: 569044 - DNA, 19 bp, Homo sapiens
aactcaaccaaatggtaca

SEQ ID NO: 569045 - DNA, 17 bp, Homo sapiens
aactcagagcacagcca

SEQ ID NO: 569046 - DNA, 12 bp, Homo sapiens
aactctgcctgc

SEQ ID NO: 569047 - DNA, 11 bp, Homo sapiens
aactcttcctc

SEQ ID NO: 569048 - DNA, 14 bp, Homo sapiens
aactgaagagacag

SEQ ID NO: 569049 - DNA, 15 bp, Homo sapiens
aactgaagagacagt

SEQ ID NO: 569050 - DNA, 13 bp, Homo sapiens
aactgaagttctg

SEQ ID NO: 569051 - DNA, 15 bp, Homo sapiens
aactgatggcaatat

SEQ ID NO: 569052 - DNA, 18 bp, Homo sapiens
aactgcacatgatttcac

SEQ ID NO: 569053 - DNA, 20 bp, Homo sapiens
aactgctcttgggcaatatt

SEQ ID NO: 569054 - DNA, 23 bp, Homo sapiens
aactgctcttgggcaatattctc

SEQ ID NO: 569055 - DNA, 12 bp, Homo sapiens
aactgctgctgg

SEQ ID NO: 569056 - DNA, 15 bp, Homo sapiens
aactgtaaaatactt

SEQ ID NO: 569057 - DNA, 17 bp, Homo sapiens
aactgtatttacttgtt

SEQ ID NO: 569058 - DNA, 22 bp, Homo sapiens
aactgtgagccgtccaagtcag

SEQ ID NO: 569059 - DNA, 23 bp, Homo sapiens
aactgttaccattggaaatttca

SEQ ID NO: 569060 - DNA, 15 bp, Homo sapiens
aacttagtgtctcta

SEQ ID NO: 569061 - DNA, 19 bp, Homo sapiens
aacttagtgtctctattta

SEQ ID NO: 569062 - DNA, 16 bp, Homo sapiens
aacttcatctgtctgt

SEQ ID NO: 569063 - DNA, 23 bp, Homo sapiens
aacttccactttgtataaatttt

SEQ ID NO: 569064 - DNA, 19 bp, Homo sapiens
aacttgaaattatatctgt

SEQ ID NO: 569065 - DNA, 14 bp, Homo sapiens
aacttgattcttgt

SEQ ID NO: 569066 - DNA, 12 bp, Homo sapiens
aacttgctgtga

SEQ ID NO: 569067 - DNA, 15 bp, Homo sapiens
aacttgctgtgaaat

SEQ ID NO: 569068 - DNA, 21 bp, Homo sapiens
aacttgcttaaatgtgaatta

SEQ ID NO: 569069 - DNA, 17 bp, Homo sapiens
aacttgtcttaaataaa

SEQ ID NO: 569070 - DNA, 20 bp, Homo sapiens
aacttgttcttccaaagcag

SEQ ID NO: 569071 - DNA, 12 bp, Homo sapiens
aactttaatatg

SEQ ID NO: 569072 - DNA, 21 bp, Homo sapiens
aactttagcagaatcaaaatg

SEQ ID NO: 569073 - DNA, 16 bp, Homo sapiens
aactttcaagaacttg

SEQ ID NO: 569074 - DNA, 15 bp, Homo sapiens
aactttctcagcata

SEQ ID NO: 569075 - DNA, 13 bp, Homo sapiens
aactttgaaatat

SEQ ID NO: 569076 - DNA, 17 bp, Homo sapiens
aacttttcaaaataaag

SEQ ID NO: 569077 - DNA, 20 bp, Homo sapiens
aacttttccaacatacaatt

SEQ ID NO: 569078 - DNA, 14 bp, Homo sapiens
aacttttgtagtct

SEQ ID NO: 569079 - DNA, 20 bp, Homo sapiens
aacttttgtagtcttatgaa

SEQ ID NO: 569080 - DNA, 23 bp, Homo sapiens
aagaaaaaaccgtgtttgtctct

SEQ ID NO: 569081 - DNA, 14 bp, Homo sapiens
aagaaaaagaagag

SEQ ID NO: 569082 - DNA, 17 bp, Homo sapiens
aagaaacagtttaacag

SEQ ID NO: 569083 - DNA, 14 bp, Homo sapiens
aagaaacattggaa

SEQ ID NO: 569084 - DNA, 16 bp, Homo sapiens
aagaaatctatagaaa

SEQ ID NO: 569085 - DNA, 13 bp, Homo sapiens
aagaaatgcacaa

SEQ ID NO: 569086 - DNA, 14 bp, Homo sapiens
aagaaatgcacaat

SEQ ID NO: 569087 - DNA, 16 bp, Homo sapiens
aagaaatgcacaatgt

SEQ ID NO: 569088 - DNA, 21 bp, Homo sapiens
aagaaattagggctctaattt

SEQ ID NO: 569089 - DNA, 21 bp, Homo sapiens
aagaaattccatacttctctc

SEQ ID NO: 569090 - DNA, 15 bp, Homo sapiens
aagaaatttattact

SEQ ID NO: 569091 - DNA, 16 bp, Homo sapiens
aagaactatcttcatc

SEQ ID NO: 569092 - DNA, 16 bp, Homo sapiens
aagaagccctgcagag

SEQ ID NO: 569093 - DNA, 18 bp, Homo sapiens
aagaagccctgcagagca

SEQ ID NO: 569094 - DNA, 19 bp, Homo sapiens
aagaagctaaaatgaaaaa

SEQ ID NO: 569095 - DNA, 13 bp, Homo sapiens
aagaataggactt

SEQ ID NO: 569096 - DNA, 17 bp, Homo sapiens
aagaataggacttgttt

SEQ ID NO: 569097 - DNA, 22 bp, Homo sapiens
aagaataggacttgtttttgtt

SEQ ID NO: 569098 - DNA, 21 bp, Homo sapiens
aagaatattcagagaatatca

SEQ ID NO: 569099 - DNA, 21 bp, Homo sapiens
aagaatcacctaattaatttc

SEQ ID NO: 569100 - DNA, 20 bp, Homo sapiens
aagaatgcatgctttccata

SEQ ID NO: 569101 - DNA, 16 bp, Homo sapiens
aagacatgttgtaaat

SEQ ID NO: 569102 - DNA, 12 bp, Homo sapiens
aagaccaaagag

SEQ ID NO: 569103 - DNA, 21 bp, Homo sapiens
aagaccaagacttttgtctga

SEQ ID NO: 569104 - DNA, 22 bp, Homo sapiens
aagaccatttagtcctcacctt

SEQ ID NO: 569105 - DNA, 16 bp, Homo sapiens
aagacccccaggaagg

SEQ ID NO: 569106 - DNA, 22 bp, Homo sapiens
aagacctaaccagggccagaag

SEQ ID NO: 569107 - DNA, 21 bp, Homo sapiens
aagactgtaaattccaaagat

SEQ ID NO: 569108 - DNA, 19 bp, Homo sapiens
aagacttcatttaacactg

SEQ ID NO: 569109 - DNA, 17 bp, Homo sapiens
aagagaaaaagccctct

SEQ ID NO: 569110 - DNA, 14 bp, Homo sapiens
aagagaaatctcat

SEQ ID NO: 569111 - DNA, 11 bp, Homo sapiens
aagagagaaat

SEQ ID NO: 569112 - DNA, 13 bp, Homo sapiens
aagagagaaatct

SEQ ID NO: 569113 - DNA, 16 bp, Homo sapiens
aagagagatatatctg

SEQ ID NO: 569114 - DNA, 17 bp, Homo sapiens
aagagagatatatctga

SEQ ID NO: 569115 - DNA, 21 bp, Homo sapiens
aagagagggccatgcaattca

SEQ ID NO: 569116 - DNA, 22 bp, Homo sapiens
aagagagggccatgcaattcat

SEQ ID NO: 569117 - DNA, 19 bp, Homo sapiens
aagagattttatgtttaaa

SEQ ID NO: 569118 - DNA, 22 bp, Homo sapiens
aagagcaggatagctcttcctc

SEQ ID NO: 569119 - DNA, 12 bp, Homo sapiens
aagagcctctgg

SEQ ID NO: 569120 - DNA, 13 bp, Homo sapiens
aagagcctctgga

SEQ ID NO: 569121 - DNA, 16 bp, Homo sapiens
aagagcctctggaagg

SEQ ID NO: 569122 - DNA, 19 bp, Homo sapiens
aagaggtaccaaaaaagaa

SEQ ID NO: 569123 - DNA, 21 bp, Homo sapiens
aagaggtaccaaaaaagaaag

SEQ ID NO: 569124 - DNA, 23 bp, Homo sapiens
aagagtaacacttgaaaagtgtg

SEQ ID NO: 569125 - DNA, 20 bp, Homo sapiens
aagagtgaagagcatttggt

SEQ ID NO: 569126 - DNA, 16 bp, Homo sapiens
aagagtgatgcctggg

SEQ ID NO: 569127 - DNA, 17 bp, Homo sapiens
aagagtgcaaaacattg

SEQ ID NO: 569128 - DNA, 15 bp, Homo sapiens
aagataagttggaaa

SEQ ID NO: 569129 - DNA, 19 bp, Homo sapiens
aagataagttggaaacact

SEQ ID NO: 569130 - DNA, 22 bp, Homo sapiens
aagataagttggaaacactaaa

SEQ ID NO: 569131 - DNA, 19 bp, Homo sapiens
aagataattaaatgaaata

SEQ ID NO: 569132 - DNA, 18 bp, Homo sapiens
aagataccttaaaatttg

SEQ ID NO: 569133 - DNA, 21 bp, Homo sapiens
aagataccttaaaatttgaaa

SEQ ID NO: 569134 - DNA, 18 bp, Homo sapiens
aagatagttgtaaagata

SEQ ID NO: 569135 - DNA, 17 bp, Homo sapiens
aagatcaaaataaaaag

SEQ ID NO: 569136 - DNA, 21 bp, Homo sapiens
aagatcattatcttcatgttt

SEQ ID NO: 569137 - DNA, 19 bp, Homo sapiens
aagatcggttaacaaataa

SEQ ID NO: 569138 - DNA, 16 bp, Homo sapiens
aagatctcctgtgcac

SEQ ID NO: 569139 - DNA, 16 bp, Homo sapiens
aagatctttttttaag

SEQ ID NO: 569140 - DNA, 17 bp, Homo sapiens
aagatctttttttaagt

SEQ ID NO: 569141 - DNA, 22 bp, Homo sapiens
aagatctttttttaagtgttct

SEQ ID NO: 569142 - DNA, 23 bp, Homo sapiens
aagatgctgctgagcacatctct

SEQ ID NO: 569143 - DNA, 14 bp, Homo sapiens
aagatgtagcaaac

SEQ ID NO: 569144 - DNA, 23 bp, Homo sapiens
aagatgtagcaaaccctgtcaaa

SEQ ID NO: 569145 - DNA, 12 bp, Homo sapiens
aagatgttatat

SEQ ID NO: 569146 - DNA, 18 bp, Homo sapiens
aagatgttatatttttct

SEQ ID NO: 569147 - DNA, 17 bp, Homo sapiens
aagattgatgtttcctt

SEQ ID NO: 569148 - DNA, 20 bp, Homo sapiens
aagattgtttatctagatgt

SEQ ID NO: 569149 - DNA, 13 bp, Homo sapiens
aagcaaatttcaa

SEQ ID NO: 569150 - DNA, 17 bp, Homo sapiens
aagcaacaattttcaga

SEQ ID NO: 569151 - DNA, 18 bp, Homo sapiens
aagcaacaattttcagat

SEQ ID NO: 569152 - DNA, 20 bp, Homo sapiens
aagcaacaattttcagattt

SEQ ID NO: 569153 - DNA, 13 bp, Homo sapiens
aagcaacagctgg

SEQ ID NO: 569154 - DNA, 22 bp, Homo sapiens
aagcaacagctggacaccccct

SEQ ID NO: 569155 - DNA, 16 bp, Homo sapiens
aagcaacttttccaac

SEQ ID NO: 569156 - DNA, 18 bp, Homo sapiens
aagcacaggagacactgt

SEQ ID NO: 569157 - DNA, 13 bp, Homo sapiens
aagcacagtcagg

SEQ ID NO: 569158 - DNA, 21 bp, Homo sapiens
aagcagaattggaaaagacta

SEQ ID NO: 569159 - DNA, 15 bp, Homo sapiens
aagcagacacacaca

SEQ ID NO: 569160 - DNA, 22 bp, Homo sapiens
aagcagacacacacatatatac

SEQ ID NO: 569161 - DNA, 22 bp, Homo sapiens
aagcagagtcaagctgatgaag

SEQ ID NO: 569162 - DNA, 16 bp, Homo sapiens
aagcaggttaaatgtt

SEQ ID NO: 569163 - DNA, 17 bp, Homo sapiens
aagcaggttaaatgttt

SEQ ID NO: 569164 - DNA, 13 bp, Homo sapiens
aagcagtttcaat

SEQ ID NO: 569165 - DNA, 14 bp, Homo sapiens
aagcagtttcaata

SEQ ID NO: 569166 - DNA, 22 bp, Homo sapiens
aagcagtttcaataaagtttga

SEQ ID NO: 569167 - DNA, 13 bp, Homo sapiens
aagcatataaaat

SEQ ID NO: 569168 - DNA, 12 bp, Homo sapiens
aagcatgaacag

SEQ ID NO: 569169 - DNA, 20 bp, Homo sapiens
aagcatgaacagtgcacctg

SEQ ID NO: 569170 - DNA, 21 bp, Homo sapiens
aagcatggctcattctgcaat

SEQ ID NO: 569171 - DNA, 14 bp, Homo sapiens
aagccaccagatgt

SEQ ID NO: 569172 - DNA, 19 bp, Homo sapiens
aagccacgctgtgtccctc

SEQ ID NO: 569173 - DNA, 22 bp, Homo sapiens
aagcccagcctatctctcttct

SEQ ID NO: 569174 - DNA, 13 bp, Homo sapiens
aagcccaggaggg

SEQ ID NO: 569175 - DNA, 17 bp, Homo sapiens
aagccccctcttcctcc

SEQ ID NO: 569176 - DNA, 17 bp, Homo sapiens
aagccctccctgtctgt

SEQ ID NO: 569177 - DNA, 21 bp, Homo sapiens
aagcccttctcaagaccgagt

SEQ ID NO: 569178 - DNA, 22 bp, Homo sapiens
aagcctcagcaaacccaaagat

SEQ ID NO: 569179 - DNA, 17 bp, Homo sapiens
aagccttaagctgcagg

SEQ ID NO: 569180 - DNA, 20 bp, Homo sapiens
aatatgcactaagtctcttt

SEQ ID NO: 569181 - DNA, 22 bp, Homo sapiens
aatatgcactaagtctcttttt

SEQ ID NO: 569182 - DNA, 17 bp, Homo sapiens
aatatgcatcccacagc

SEQ ID NO: 569183 - DNA, 20 bp, Homo sapiens
aatatgcatcccacagccag

SEQ ID NO: 569184 - DNA, 15 bp, Homo sapiens
aatatggtggaaaat

SEQ ID NO: 569185 - DNA, 11 bp, Homo sapiens
aatatgtattt

SEQ ID NO: 569186 - DNA, 19 bp, Homo sapiens
aatatgtgaaggaccttca

SEQ ID NO: 569187 - DNA, 16 bp, Homo sapiens
aatattaaaaagtctt

SEQ ID NO: 569188 - DNA, 17 bp, Homo sapiens
aatattaaaaagtcttt

SEQ ID NO: 569189 - DNA, 18 bp, Homo sapiens
aatattaatggaaacatg

SEQ ID NO: 569190 - DNA, 15 bp, Homo sapiens
aatattatgttatga

SEQ ID NO: 569191 - DNA, 16 bp, Homo sapiens
aatattatgttatgaa

SEQ ID NO: 569192 - DNA, 17 bp, Homo sapiens
aatattcagagaaaact

SEQ ID NO: 569193 - DNA, 14 bp, Homo sapiens
aatattctctgtac

SEQ ID NO: 569194 - DNA, 17 bp, Homo sapiens
aatattctctgtacata

SEQ ID NO: 569195 - DNA, 21 bp, Homo sapiens
aatattctctgtacatattag

SEQ ID NO: 569196 - DNA, 14 bp, Homo sapiens
aatattctgtaact

SEQ ID NO: 569197 - DNA, 19 bp, Homo sapiens
aatatttcattttgagaac

SEQ ID NO: 569198 - DNA, 14 bp, Homo sapiens
aatatttgtgaaag

SEQ ID NO: 569199 - DNA, 19 bp, Homo sapiens
aatatttgtgaaagtgcca

SEQ ID NO: 569200 - DNA, 21 bp, Homo sapiens
aatatttgtgaaagtgccaaa

SEQ ID NO: 569201 - DNA, 17 bp, Homo sapiens
aatatttgtgtgctaaa

SEQ ID NO: 569202 - DNA, 14 bp, Homo sapiens
aatattttgctgct

SEQ ID NO: 569203 - DNA, 14 bp, Homo sapiens
aatattttgtcact

SEQ ID NO: 569204 - DNA, 19 bp, Homo sapiens
aatattttgtcactgctgt

SEQ ID NO: 569205 - DNA, 13 bp, Homo sapiens
aatcaaaaaatta

SEQ ID NO: 569206 - DNA, 18 bp, Homo sapiens
aatcaagtctgtgaaagt

SEQ ID NO: 569207 - DNA, 20 bp, Homo sapiens
aatcaagtctgtgaaagtct

SEQ ID NO: 569208 - DNA, 17 bp, Homo sapiens
aatcaataacagccgct

SEQ ID NO: 569209 - DNA, 19 bp, Homo sapiens
aatcacctaattaatttca

SEQ ID NO: 569210 - DNA, 17 bp, Homo sapiens
aatcacgaggtcaggag

SEQ ID NO: 569211 - DNA, 18 bp, Homo sapiens
aatcaggtcctgctcagc

SEQ ID NO: 569212 - DNA, 17 bp, Homo sapiens
aatcatgaacagctctg

SEQ ID NO: 569213 - DNA, 19 bp, Homo sapiens
aatcatgaacagctctgag

SEQ ID NO: 569214 - DNA, 19 bp, Homo sapiens
aatccagaaacttgttctt

SEQ ID NO: 569215 - DNA, 19 bp, Homo sapiens
aatccatcagtgccaaact

SEQ ID NO: 569216 - DNA, 19 bp, Homo sapiens
aatccatgtgctgctgtgg

SEQ ID NO: 569217 - DNA, 15 bp, Homo sapiens
aatcccattgtattt

SEQ ID NO: 569218 - DNA, 22 bp, Homo sapiens
aatcctatctggggagctcctg

SEQ ID NO: 569219 - DNA, 16 bp, Homo sapiens
aatccttgccttcaaa

SEQ ID NO: 569220 - DNA, 22 bp, Homo sapiens
aatctctatgccctgttaaatg

SEQ ID NO: 569221 - DNA, 14 bp, Homo sapiens
aatctgaagattgt

SEQ ID NO: 569222 - DNA, 15 bp, Homo sapiens
aatctgatctgagtg

SEQ ID NO: 569223 - DNA, 22 bp, Homo sapiens
aatctgtctgctggtcacttct

SEQ ID NO: 569224 - DNA, 13 bp, Homo sapiens
aatcttattaaag

SEQ ID NO: 569225 - DNA, 19 bp, Homo sapiens
aatcttattaaagtttcaa

SEQ ID NO: 569226 - DNA, 20 bp, Homo sapiens
aatcttattaaagtttcaaa

SEQ ID NO: 569227 - DNA, 19 bp, Homo sapiens
aatcttcctggtcgaaagt

SEQ ID NO: 569228 - DNA, 21 bp, Homo sapiens
aatcttcctggtcgaaagtta

SEQ ID NO: 569229 - DNA, 17 bp, Homo sapiens
aatcttctcatctttta

SEQ ID NO: 569230 - DNA, 15 bp, Homo sapiens
aatgaaaataagtga

SEQ ID NO: 569231 - DNA, 15 bp, Homo sapiens
aatgaaatttaagca

SEQ ID NO: 569232 - DNA, 17 bp, Homo sapiens
aatgaaatttaagcaca

SEQ ID NO: 569233 - DNA, 18 bp, Homo sapiens
aatgaaatttaagcacaa

SEQ ID NO: 569234 - DNA, 21 bp, Homo sapiens
aatgaagtaacttgtcttaaa

SEQ ID NO: 569235 - DNA, 14 bp, Homo sapiens
aatgaatgtatatt

SEQ ID NO: 569236 - DNA, 18 bp, Homo sapiens
aatgaccttgtaatgtaa

SEQ ID NO: 569237 - DNA, 20 bp, Homo sapiens
aatgaccttgtaatgtaact

SEQ ID NO: 569238 - DNA, 17 bp, Homo sapiens
aatgagggcgtgaaaca

SEQ ID NO: 569239 - DNA, 18 bp, Homo sapiens
aatgagggcgtgaaacac

SEQ ID NO: 569240 - DNA, 20 bp, Homo sapiens
aatgagggcgtgaaacacaa

SEQ ID NO: 569241 - DNA, 18 bp, Homo sapiens
aatgagggtctcactgct

SEQ ID NO: 569242 - DNA, 16 bp, Homo sapiens
aatgagtatatgtaac

SEQ ID NO: 569243 - DNA, 21 bp, Homo sapiens
aatgagtatatgtaacagttt

SEQ ID NO: 569244 - DNA, 12 bp, Homo sapiens
aatgataaaatc

SEQ ID NO: 569245 - DNA, 21 bp, Homo sapiens
aatgatatgtctttaaaatga

SEQ ID NO: 569246 - DNA, 21 bp, Homo sapiens
aatgattattttcattacaat

SEQ ID NO: 569247 - DNA, 12 bp, Homo sapiens
aatgattgcttt

SEQ ID NO: 569248 - DNA, 20 bp, Homo sapiens
aatgattgcttttaaaattt

SEQ ID NO: 569249 - DNA, 15 bp, Homo sapiens
aatgcacaatgtctt

SEQ ID NO: 569250 - DNA, 16 bp, Homo sapiens
aatgcacaatgtcttg

SEQ ID NO: 569251 - DNA, 16 bp, Homo sapiens
aatgcacatccattcc

SEQ ID NO: 569252 - DNA, 16 bp, Homo sapiens
aatgcatttaagttgt

SEQ ID NO: 569253 - DNA, 17 bp, Homo sapiens
aatgccaagataattca

SEQ ID NO: 569254 - DNA, 21 bp, Homo sapiens
aatgcctttctagcaattgct

SEQ ID NO: 569255 - DNA, 21 bp, Homo sapiens
aatgctatgtcatttcatgtc

SEQ ID NO: 569256 - DNA, 18 bp, Homo sapiens
aatgcttgaccctgaaat

SEQ ID NO: 569257 - DNA, 23 bp, Homo sapiens
aatggaaaaaaagactgatgaag

SEQ ID NO: 569258 - DNA, 22 bp, Homo sapiens
aatggaaatcatcgaaaattca

SEQ ID NO: 569259 - DNA, 19 bp, Homo sapiens
aatggagttggagttcatt

SEQ ID NO: 569260 - DNA, 14 bp, Homo sapiens
aatggcaacaaact

SEQ ID NO: 569261 - DNA, 13 bp, Homo sapiens
aatggcctcttaa

SEQ ID NO: 569262 - DNA, 20 bp, Homo sapiens
aatggcctcttaaaaattat

SEQ ID NO: 569263 - DNA, 16 bp, Homo sapiens
aatggccttaattaat

SEQ ID NO: 569264 - DNA, 24 bp, Homo sapiens
aatgggtatacctctaactgtgca

SEQ ID NO: 569265 - DNA, 12 bp, Homo sapiens
aatggtaacttt

SEQ ID NO: 569266 - DNA, 16 bp, Homo sapiens
aatggtaacttttgta

SEQ ID NO: 569267 - DNA, 16 bp, Homo sapiens
aatggtaatttagtgt

SEQ ID NO: 569268 - DNA, 18 bp, Homo sapiens
aatggtcccaattaagaa

SEQ ID NO: 569269 - DNA, 15 bp, Homo sapiens
aatggtctggcaata

SEQ ID NO: 569270 - DNA, 21 bp, Homo sapiens
aatggtggttgtttcttccaa

SEQ ID NO: 569271 - DNA, 15 bp, Homo sapiens
aatgtaactgctctt

SEQ ID NO: 569272 - DNA, 20 bp, Homo sapiens
aatgtaactgttaccattgg

SEQ ID NO: 569273 - DNA, 23 bp, Homo sapiens
aatgtaactgttaccattggaaa

SEQ ID NO: 569274 - DNA, 16 bp, Homo sapiens
aatgtatagtatttga

SEQ ID NO: 569275 - DNA, 15 bp, Homo sapiens
aatgtatatacacat

SEQ ID NO: 569276 - DNA, 19 bp, Homo sapiens
aatgtatatacacatatac

SEQ ID NO: 569277 - DNA, 17 bp, Homo sapiens
aatgtatattgatgtaa

SEQ ID NO: 569278 - DNA, 20 bp, Homo sapiens
aatgtattttcagctcaatt

SEQ ID NO: 569279 - DNA, 14 bp, Homo sapiens
aatgtcactgttat

SEQ ID NO: 569280 - DNA, 22 bp, Homo sapiens
aatgtcactgttataaattttg

SEQ ID NO: 569281 - DNA, 19 bp, Homo sapiens
aatgtcttggtacttgctg

SEQ ID NO: 569282 - DNA, 13 bp, Homo sapiens
aatgtgcccccag

SEQ ID NO: 569283 - DNA, 16 bp, Homo sapiens
aatgtgtaaaattgga

SEQ ID NO: 569284 - DNA, 17 bp, Homo sapiens
aatgtgtcttgtattat

SEQ ID NO: 569285 - DNA, 21 bp, Homo sapiens
aatgtgtcttgtattatcata

SEQ ID NO: 569286 - DNA, 21 bp, Homo sapiens
aatgtgtgtatgtgtatttat

SEQ ID NO: 569287 - DNA, 16 bp, Homo sapiens
aatgtgtgtgatgtga

SEQ ID NO: 569288 - DNA, 21 bp, Homo sapiens
aatgttaaagatgtagcaaac

SEQ ID NO: 569289 - DNA, 19 bp, Homo sapiens
aatgttcacgcaacttgaa

SEQ ID NO: 569290 - DNA, 12 bp, Homo sapiens
aatgttgatttc

SEQ ID NO: 569291 - DNA, 13 bp, Homo sapiens
aatgttgatttct

SEQ ID NO: 569292 - DNA, 22 bp, Homo sapiens
aatgttgatttctagttattta

SEQ ID NO: 569293 - DNA, 20 bp, Homo sapiens
aatgttggcagatgcagctc

SEQ ID NO: 569294 - DNA, 22 bp, Homo sapiens
aatgtttaagcagaattggaaa

SEQ ID NO: 569295 - DNA, 13 bp, Homo sapiens
aatgtttccaggc

SEQ ID NO: 569296 - DNA, 14 bp, Homo sapiens
aatgtttccaggca

SEQ ID NO: 569297 - DNA, 21 bp, Homo sapiens
aatgtttccaggcatgaccct

SEQ ID NO: 569298 - DNA, 13 bp, Homo sapiens
aatgttttgtaaa

SEQ ID NO: 569299 - DNA, 17 bp, Homo sapiens
aatgttttgtaaacttt

SEQ ID NO: 569300 - DNA, 19 bp, Homo sapiens
aatgttttgtaaactttga

SEQ ID NO: 569301 - DNA, 21 bp, Homo sapiens
aatgttttgtaaactttgaaa

SEQ ID NO: 569302 - DNA, 20 bp, Homo sapiens
aattaaccaaggtagaatga

SEQ ID NO: 569303 - DNA, 16 bp, Homo sapiens
aattaagaaattccat

SEQ ID NO: 569304 - DNA, 16 bp, Homo sapiens
aattaatgtgtaaaat

SEQ ID NO: 569305 - DNA, 20 bp, Homo sapiens
aattaatgtgtaaaattgga

SEQ ID NO: 569306 - DNA, 16 bp, Homo sapiens
aattacaatatttctg

SEQ ID NO: 569307 - DNA, 20 bp, Homo sapiens
aattactaacttctaaaact

SEQ ID NO: 569308 - DNA, 21 bp, Homo sapiens
aattactaacttctaaaactg

SEQ ID NO: 569309 - DNA, 13 bp, Homo sapiens
aattagattttaa

SEQ ID NO: 569310 - DNA, 19 bp, Homo sapiens
aattagggctctaatttcc

SEQ ID NO: 569311 - DNA, 20 bp, Homo sapiens
aattagggctctaatttcct

SEQ ID NO: 569312 - DNA, 15 bp, Homo sapiens
aattaggttaacatt

SEQ ID NO: 569313 - DNA, 20 bp, Homo sapiens
aattataaactcattttgct

SEQ ID NO: 569314 - DNA, 12 bp, Homo sapiens
aattatatctgt

SEQ ID NO: 569315 - DNA, 21 bp, Homo sapiens
aattatatctgtggtcttcaa

SEQ ID NO: 569316 - DNA, 21 bp, Homo sapiens
acacacacgcagacacacaca

SEQ ID NO: 569317 - DNA, 21 bp, Homo sapiens
acacacatatatacatacgca

SEQ ID NO: 569318 - DNA, 18 bp, Homo sapiens
acacacatatatgtatac

SEQ ID NO: 569319 - DNA, 10 bp, Homo sapiens
acacacgcag

SEQ ID NO: 569320 - DNA, 14 bp, Homo sapiens
acacacgcagacac

SEQ ID NO: 569321 - DNA, 15 bp, Homo sapiens
acacacgcagacaca

SEQ ID NO: 569322 - DNA, 16 bp, Homo sapiens
acacacgcagacacac

SEQ ID NO: 569323 - DNA, 12 bp, Homo sapiens
acacagaaatat

SEQ ID NO: 569324 - DNA, 14 bp, Homo sapiens
acacagaaatatat

SEQ ID NO: 569325 - DNA, 16 bp, Homo sapiens
acacagaaatatatat

SEQ ID NO: 569326 - DNA, 15 bp, Homo sapiens
acacagattatttgt

SEQ ID NO: 569327 - DNA, 22 bp, Homo sapiens
acacagcagcttcaccagagca

SEQ ID NO: 569328 - DNA, 19 bp, Homo sapiens
acacagctgcagagacaga

SEQ ID NO: 569329 - DNA, 21 bp, Homo sapiens
acacaggggacacccagaaac

SEQ ID NO: 569330 - DNA, 19 bp, Homo sapiens
acacatacatatatacatt

SEQ ID NO: 569331 - DNA, 21 bp, Homo sapiens
acacatatacctataatgtgt

SEQ ID NO: 569332 - DNA, 13 bp, Homo sapiens
acacatgcacaca

SEQ ID NO: 569333 - DNA, 14 bp, Homo sapiens
acacatgcacacac

SEQ ID NO: 569334 - DNA, 19 bp, Homo sapiens
acacattgaaactgtattt

SEQ ID NO: 569335 - DNA, 12 bp, Homo sapiens
acaccacagaca

SEQ ID NO: 569336 - DNA, 13 bp, Homo sapiens
acaccacagacac

SEQ ID NO: 569337 - DNA, 17 bp, Homo sapiens
acaccacagacacacac

SEQ ID NO: 569338 - DNA, 21 bp, Homo sapiens
acaccacagacacacacacgc

SEQ ID NO: 569339 - DNA, 16 bp, Homo sapiens
acacccccttggtgct

SEQ ID NO: 569340 - DNA, 19 bp, Homo sapiens
acaccctacagcagatcca

SEQ ID NO: 569341 - DNA, 19 bp, Homo sapiens
acacctgcagattctagga

SEQ ID NO: 569342 - DNA, 17 bp, Homo sapiens
acacctgccctgggcat

SEQ ID NO: 569343 - DNA, 15 bp, Homo sapiens
acacctgtactggag

SEQ ID NO: 569344 - DNA, 16 bp, Homo sapiens
acacctgtactggaga

SEQ ID NO: 569345 - DNA, 16 bp, Homo sapiens
acaccttcatccagat

SEQ ID NO: 569346 - DNA, 13 bp, Homo sapiens
acacgcacgcaca

SEQ ID NO: 569347 - DNA, 14 bp, Homo sapiens
acacgcagacacac

SEQ ID NO: 569348 - DNA, 23 bp, Homo sapiens
acacggagcggattgcaaagcaa

SEQ ID NO: 569349 - DNA, 14 bp, Homo sapiens
acacgtgtatatga

SEQ ID NO: 569350 - DNA, 15 bp, Homo sapiens
acacgttggagtata

SEQ ID NO: 569351 - DNA, 22 bp, Homo sapiens
acactctcttcttactgtattt

SEQ ID NO: 569352 - DNA, 20 bp, Homo sapiens
acactctgaattccaagtag

SEQ ID NO: 569353 - DNA, 13 bp, Homo sapiens
acactgagtgaaa

SEQ ID NO: 569354 - DNA, 20 bp, Homo sapiens
acactgagttctatcagtta

SEQ ID NO: 569355 - DNA, 16 bp, Homo sapiens
acactggtctcagagg

SEQ ID NO: 569356 - DNA, 16 bp, Homo sapiens
acactgtctgctgccc

SEQ ID NO: 569357 - DNA, 21 bp, Homo sapiens
acactgtgacatctctattcc

SEQ ID NO: 569358 - DNA, 15 bp, Homo sapiens
acactgtgctataaa

SEQ ID NO: 569359 - DNA, 12 bp, Homo sapiens
acacttgcttta

SEQ ID NO: 569360 - DNA, 18 bp, Homo sapiens
acacttggaacagtgttt

SEQ ID NO: 569361 - DNA, 17 bp, Homo sapiens
acacttgtataaatgta

SEQ ID NO: 569362 - DNA, 14 bp, Homo sapiens
acacttgtcggctc

SEQ ID NO: 569363 - DNA, 23 bp, Homo sapiens
acagaaattggtaccttgcacac

SEQ ID NO: 569364 - DNA, 22 bp, Homo sapiens
acagaacctactgttcctttca

SEQ ID NO: 569365 - DNA, 18 bp, Homo sapiens
acagaaggctcctgcccc

SEQ ID NO: 569366 - DNA, 15 bp, Homo sapiens
acagacaattctaat

SEQ ID NO: 569367 - DNA, 22 bp, Homo sapiens
acagacaattctaatggtaact

SEQ ID NO: 569368 - DNA, 12 bp, Homo sapiens
acagacacacac

SEQ ID NO: 569369 - DNA, 14 bp, Homo sapiens
acagacacacacac

SEQ ID NO: 569370 - DNA, 15 bp, Homo sapiens
acagacacacacacg

SEQ ID NO: 569371 - DNA, 15 bp, Homo sapiens
acagagcctgcccca

SEQ ID NO: 569372 - DNA, 19 bp, Homo sapiens
acagatcacatgcccctct

SEQ ID NO: 569373 - DNA, 21 bp, Homo sapiens
acagatgtggacatgcacccg

SEQ ID NO: 569374 - DNA, 22 bp, Homo sapiens
acagatgtgggctttgatttcc

SEQ ID NO: 569375 - DNA, 13 bp, Homo sapiens
acagattatttgt

SEQ ID NO: 569376 - DNA, 22 bp, Homo sapiens
acagattggattttatgttgac

SEQ ID NO: 569377 - DNA, 16 bp, Homo sapiens
acagatttaagcaaga

SEQ ID NO: 569378 - DNA, 19 bp, Homo sapiens
acagcaaattaatgtgtaa

SEQ ID NO: 569379 - DNA, 20 bp, Homo sapiens
acagcaaattaatgtgtaaa

SEQ ID NO: 569380 - DNA, 16 bp, Homo sapiens
acagcagatccacctg

SEQ ID NO: 569381 - DNA, 18 bp, Homo sapiens
acagcagatccacctgca

SEQ ID NO: 569382 - DNA, 21 bp, Homo sapiens
acagcagatccacctgcacaa

SEQ ID NO: 569383 - DNA, 16 bp, Homo sapiens
acagcagcttcaccag

SEQ ID NO: 569384 - DNA, 18 bp, Homo sapiens
acagcagcttcaccagag

SEQ ID NO: 569385 - DNA, 18 bp, Homo sapiens
acagcattggcctggcca

SEQ ID NO: 569386 - DNA, 20 bp, Homo sapiens
acagccaatctccaggctcc

SEQ ID NO: 569387 - DNA, 22 bp, Homo sapiens
acagccagtttagagaaataca

SEQ ID NO: 569388 - DNA, 20 bp, Homo sapiens
acagcccaggcatctccttg

SEQ ID NO: 569389 - DNA, 13 bp, Homo sapiens
acagccgctccag

SEQ ID NO: 569390 - DNA, 14 bp, Homo sapiens
acagccgctccaga

SEQ ID NO: 569391 - DNA, 15 bp, Homo sapiens
acagccgctccagag

SEQ ID NO: 569392 - DNA, 19 bp, Homo sapiens
acagcctcacccctgcagg

SEQ ID NO: 569393 - DNA, 16 bp, Homo sapiens
acagctaccaccctta

SEQ ID NO: 569394 - DNA, 12 bp, Homo sapiens
acagctccccca

SEQ ID NO: 569395 - DNA, 12 bp, Homo sapiens
acagctccttta

SEQ ID NO: 569396 - DNA, 21 bp, Homo sapiens
acagctccttttccagagcat

SEQ ID NO: 569397 - DNA, 14 bp, Homo sapiens
acagctctgagatc

SEQ ID NO: 569398 - DNA, 19 bp, Homo sapiens
acagctgaaagacagtaaa

SEQ ID NO: 569399 - DNA, 21 bp, Homo sapiens
acagctggacacccccttggt

SEQ ID NO: 569400 - DNA, 18 bp, Homo sapiens
acagcttgatgctgtttc

SEQ ID NO: 569401 - DNA, 18 bp, Homo sapiens
acaggaacacccagcccc

SEQ ID NO: 569402 - DNA, 15 bp, Homo sapiens
acaggatgcatatta

SEQ ID NO: 569403 - DNA, 19 bp, Homo sapiens
acaggatgcatattaaaga

SEQ ID NO: 569404 - DNA, 22 bp, Homo sapiens
acaggatgcatattaaagaaag

SEQ ID NO: 569405 - DNA, 17 bp, Homo sapiens
acaggatggtctctgcc

SEQ ID NO: 569406 - DNA, 13 bp, Homo sapiens
acaggcaattccg

SEQ ID NO: 569407 - DNA, 16 bp, Homo sapiens
acaggccaccctgtgc

SEQ ID NO: 569408 - DNA, 19 bp, Homo sapiens
acaggccaccctgtgcaga

SEQ ID NO: 569409 - DNA, 14 bp, Homo sapiens
acaggggaggctga

SEQ ID NO: 569410 - DNA, 16 bp, Homo sapiens
acaggggaggctgaga

SEQ ID NO: 569411 - DNA, 15 bp, Homo sapiens
acaggtaccagttct

SEQ ID NO: 569412 - DNA, 17 bp, Homo sapiens
acaggtgtggtgtaatt

SEQ ID NO: 569413 - DNA, 15 bp, Homo sapiens
acagtattttaagaa

SEQ ID NO: 569414 - DNA, 22 bp, Homo sapiens
acagtattttaagaagttgctg

SEQ ID NO: 569415 - DNA, 17 bp, Homo sapiens
acagtcaaggagtggct

SEQ ID NO: 569416 - DNA, 16 bp, Homo sapiens
acagtctctttcttcc

SEQ ID NO: 569417 - DNA, 17 bp, Homo sapiens
acagtctctttcttcct

SEQ ID NO: 569418 - DNA, 20 bp, Homo sapiens
acagtcttttgtgtctgtca

SEQ ID NO: 569419 - DNA, 15 bp, Homo sapiens
acagtgaggtcctgg

SEQ ID NO: 569420 - DNA, 18 bp, Homo sapiens
acagtgaggtcctggggg

SEQ ID NO: 569421 - DNA, 19 bp, Homo sapiens
acagtgaggtcctgggggc

SEQ ID NO: 569422 - DNA, 23 bp, Homo sapiens
acagtgtaccattaaaatatgca

SEQ ID NO: 569423 - DNA, 21 bp, Homo sapiens
acagttaaatgagaacatgaa

SEQ ID NO: 569424 - DNA, 14 bp, Homo sapiens
acagttacttttcc

SEQ ID NO: 569425 - DNA, 23 bp, Homo sapiens
acagttacttttccttgcataca

SEQ ID NO: 569426 - DNA, 12 bp, Homo sapiens
acagttatctta

SEQ ID NO: 569427 - DNA, 23 bp, Homo sapiens
acagttggttttgcatgtctgca

SEQ ID NO: 569428 - DNA, 12 bp, Homo sapiens
acagtttaaaaa

SEQ ID NO: 569429 - DNA, 18 bp, Homo sapiens
acagtttaacagaaaaat

SEQ ID NO: 569430 - DNA, 18 bp, Homo sapiens
acataaaaactactgaat

SEQ ID NO: 569431 - DNA, 14 bp, Homo sapiens
acataaattgtaat

SEQ ID NO: 569432 - DNA, 16 bp, Homo sapiens
acataaattgtaattt

SEQ ID NO: 569433 - DNA, 12 bp, Homo sapiens
acatacaattta

SEQ ID NO: 569434 - DNA, 13 bp, Homo sapiens
acatacaatttac

SEQ ID NO: 569435 - DNA, 14 bp, Homo sapiens
acatacatatatac

SEQ ID NO: 569436 - DNA, 18 bp, Homo sapiens
acatacgcaattgtatat

SEQ ID NO: 569437 - DNA, 19 bp, Homo sapiens
acatacgcaattgtatata

SEQ ID NO: 569438 - DNA, 23 bp, Homo sapiens
acatacgcaattgtatatatatg

SEQ ID NO: 569439 - DNA, 18 bp, Homo sapiens
acatagacagatgtggac

SEQ ID NO: 569440 - DNA, 22 bp, Homo sapiens
acatagagtgactccaagaaca

SEQ ID NO: 569441 - DNA, 21 bp, Homo sapiens
acatatacctataatgtgtgt

SEQ ID NO: 569442 - DNA, 13 bp, Homo sapiens
acatatatacata

SEQ ID NO: 569443 - DNA, 14 bp, Homo sapiens
acatatatacattt

SEQ ID NO: 569444 - DNA, 18 bp, Homo sapiens
acatatatgtatacgcac

SEQ ID NO: 569445 - DNA, 20 bp, Homo sapiens
acatatgtagactatataca

SEQ ID NO: 569446 - DNA, 20 bp, Homo sapiens
acatattagcgacaacagat

SEQ ID NO: 569447 - DNA, 23 bp, Homo sapiens
acatattattggtcaagaaaagc

SEQ ID NO: 569448 - DNA, 22 bp, Homo sapiens
acatattcccatggtagactgt

SEQ ID NO: 569449 - DNA, 22 bp, Homo sapiens
acatatttcataagcacatcca

SEQ ID NO: 569450 - DNA, 20 bp, Homo sapiens
acatcactattgggccccca

SEQ ID NO: 569451 - DNA, 20 bp, Homo sapiens
acatcaggttaggcagtata

SEQ ID NO: 569452 - DNA, 13 bp, Homo sapiens
acatcatctgtaa

SEQ ID NO: 569453 - DNA, 23 bp, Homo sapiens
actcaggtttccggctactgaca

SEQ ID NO: 569454 - DNA, 14 bp, Homo sapiens
actcatgttaattg

SEQ ID NO: 569455 - DNA, 17 bp, Homo sapiens
actcatttctaaaagaa

SEQ ID NO: 569456 - DNA, 14 bp, Homo sapiens
actcattttgcttg

SEQ ID NO: 569457 - DNA, 17 bp, Homo sapiens
actccaagaacaattgt

SEQ ID NO: 569458 - DNA, 15 bp, Homo sapiens
actccagacttggga

SEQ ID NO: 569459 - DNA, 19 bp, Homo sapiens
actccagtgttcccttctg

SEQ ID NO: 569460 - DNA, 19 bp, Homo sapiens
actccatggtgaactgaag

SEQ ID NO: 569461 - DNA, 15 bp, Homo sapiens
actcccatcagccca

SEQ ID NO: 569462 - DNA, 22 bp, Homo sapiens
actcctagtaggggtaccactg

SEQ ID NO: 569463 - DNA, 16 bp, Homo sapiens
actcctccctgatgta

SEQ ID NO: 569464 - DNA, 17 bp, Homo sapiens
actcctccctgatgtac

SEQ ID NO: 569465 - DNA, 15 bp, Homo sapiens
actcctgctctgctc

SEQ ID NO: 569466 - DNA, 20 bp, Homo sapiens
actcgggctaagtccagctc

SEQ ID NO: 569467 - DNA, 17 bp, Homo sapiens
actctaaattctttatt

SEQ ID NO: 569468 - DNA, 19 bp, Homo sapiens
actctaagatgttatattt

SEQ ID NO: 569469 - DNA, 15 bp, Homo sapiens
actctaatatacagt

SEQ ID NO: 569470 - DNA, 16 bp, Homo sapiens
actctatgccccaaat

SEQ ID NO: 569471 - DNA, 21 bp, Homo sapiens
actctatgccccaaatatagc

SEQ ID NO: 569472 - DNA, 19 bp, Homo sapiens
actctctaaactggtacaa

SEQ ID NO: 569473 - DNA, 17 bp, Homo sapiens
actctgagtcctcattg

SEQ ID NO: 569474 - DNA, 14 bp, Homo sapiens
actctggactttct

SEQ ID NO: 569475 - DNA, 14 bp, Homo sapiens
actcttccctctct

SEQ ID NO: 569476 - DNA, 17 bp, Homo sapiens
actcttcctccaaggac

SEQ ID NO: 569477 - DNA, 20 bp, Homo sapiens
actcttcctccaaggacaga

SEQ ID NO: 569478 - DNA, 18 bp, Homo sapiens
actcttctctctgctctg

SEQ ID NO: 569479 - DNA, 19 bp, Homo sapiens
actcttctctctgctctga

SEQ ID NO: 569480 - DNA, 23 bp, Homo sapiens
actgaaaatgtgctctacatctc

SEQ ID NO: 569481 - DNA, 19 bp, Homo sapiens
actgaaaggttgcactcta

SEQ ID NO: 569482 - DNA, 15 bp, Homo sapiens
actgaacttttcaaa

SEQ ID NO: 569483 - DNA, 19 bp, Homo sapiens
actgaacttttcaaaataa

SEQ ID NO: 569484 - DNA, 13 bp, Homo sapiens
actgaagcagagt

SEQ ID NO: 569485 - DNA, 15 bp, Homo sapiens
actgaagcagagtca

SEQ ID NO: 569486 - DNA, 12 bp, Homo sapiens
actgaagcttaa

SEQ ID NO: 569487 - DNA, 21 bp, Homo sapiens
actgaagttctgcctctgatg

SEQ ID NO: 569488 - DNA, 12 bp, Homo sapiens
actgaagtttga

SEQ ID NO: 569489 - DNA, 18 bp, Homo sapiens
actgaagtttgataaata

SEQ ID NO: 569490 - DNA, 13 bp, Homo sapiens
actgaatctgtac

SEQ ID NO: 569491 - DNA, 15 bp, Homo sapiens
actgacaagcctcag

SEQ ID NO: 569492 - DNA, 14 bp, Homo sapiens
actgaccagacaag

SEQ ID NO: 569493 - DNA, 18 bp, Homo sapiens
actgactaggattctgca

SEQ ID NO: 569494 - DNA, 18 bp, Homo sapiens
actgagcatagtggtggg

SEQ ID NO: 569495 - DNA, 22 bp, Homo sapiens
actgagtctcattcctctgtcc

SEQ ID NO: 569496 - DNA, 20 bp, Homo sapiens
actgatgaagaaatttatga

SEQ ID NO: 569497 - DNA, 22 bp, Homo sapiens
actgatgggtatcatgcttcta

SEQ ID NO: 569498 - DNA, 16 bp, Homo sapiens
actgcacatgatttca

SEQ ID NO: 569499 - DNA, 17 bp, Homo sapiens
actgcacatgatttcac

SEQ ID NO: 569500 - DNA, 19 bp, Homo sapiens
actgcacatgatttcacaa

SEQ ID NO: 569501 - DNA, 23 bp, Homo sapiens
actgcccctgcacctgcttctca

SEQ ID NO: 569502 - DNA, 15 bp, Homo sapiens
actgccttaaaactt

SEQ ID NO: 569503 - DNA, 16 bp, Homo sapiens
actgccttaaaacttt

SEQ ID NO: 569504 - DNA, 14 bp, Homo sapiens
actgctttgagaaa

SEQ ID NO: 569505 - DNA, 15 bp, Homo sapiens
actggaggagctggg

SEQ ID NO: 569506 - DNA, 13 bp, Homo sapiens
actggctgtgggc

SEQ ID NO: 569507 - DNA, 20 bp, Homo sapiens
actggctgtgggctcccttc

SEQ ID NO: 569508 - DNA, 12 bp, Homo sapiens
actggtctcaga

SEQ ID NO: 569509 - DNA, 14 bp, Homo sapiens
actggtctcagagg

SEQ ID NO: 569510 - DNA, 17 bp, Homo sapiens
actggtgtatgaaatga

SEQ ID NO: 569511 - DNA, 17 bp, Homo sapiens
actggtgttaatgagta

SEQ ID NO: 569512 - DNA, 16 bp, Homo sapiens
actgtactttgattca

SEQ ID NO: 569513 - DNA, 22 bp, Homo sapiens
actgtactttgattcacatgtt

SEQ ID NO: 569514 - DNA, 23 bp, Homo sapiens
actgtactttgattcacatgttt

SEQ ID NO: 569515 - DNA, 22 bp, Homo sapiens
actgtatttcggctatgtctca

SEQ ID NO: 569516 - DNA, 11 bp, Homo sapiens
actgtatttgt

SEQ ID NO: 569517 - DNA, 15 bp, Homo sapiens
actgtatttgttaat

SEQ ID NO: 569518 - DNA, 21 bp, Homo sapiens
actgtcatgtgcgaacacagt

SEQ ID NO: 569519 - DNA, 23 bp, Homo sapiens
actgtcccggagctcaggccctg

SEQ ID NO: 569520 - DNA, 17 bp, Homo sapiens
actgtctagcacttcct

SEQ ID NO: 569521 - DNA, 18 bp, Homo sapiens
actgtctagcacttcctt

SEQ ID NO: 569522 - DNA, 10 bp, Homo sapiens
actgtcttaa

SEQ ID NO: 569523 - DNA, 11 bp, Homo sapiens
actgtcttaat

SEQ ID NO: 569524 - DNA, 13 bp, Homo sapiens
actgtgcaaagca

SEQ ID NO: 569525 - DNA, 13 bp, Homo sapiens
actgtggcctcag

SEQ ID NO: 569526 - DNA, 14 bp, Homo sapiens
actgtggcctcagg

SEQ ID NO: 569527 - DNA, 13 bp, Homo sapiens
actgttaccattg

SEQ ID NO: 569528 - DNA, 16 bp, Homo sapiens
actgttaccattggaa

SEQ ID NO: 569529 - DNA, 18 bp, Homo sapiens
actgttataaattttgta

SEQ ID NO: 569530 - DNA, 22 bp, Homo sapiens
actgttataaattttgtacatt

SEQ ID NO: 569531 - DNA, 23 bp, Homo sapiens
actgttataaattttgtacattt

SEQ ID NO: 569532 - DNA, 15 bp, Homo sapiens
actgttcctttcaga

SEQ ID NO: 569533 - DNA, 13 bp, Homo sapiens
actgttttgtgcg

SEQ ID NO: 569534 - DNA, 22 bp, Homo sapiens
acttagaatccgaagggaatta

SEQ ID NO: 569535 - DNA, 17 bp, Homo sapiens
acttagtgtctctattt

SEQ ID NO: 569536 - DNA, 21 bp, Homo sapiens
acttagtgtctctatttatga

SEQ ID NO: 569537 - DNA, 17 bp, Homo sapiens
acttatttataacattg

SEQ ID NO: 569538 - DNA, 13 bp, Homo sapiens
acttatttccatg

SEQ ID NO: 569539 - DNA, 18 bp, Homo sapiens
acttcagggcagatttta

SEQ ID NO: 569540 - DNA, 21 bp, Homo sapiens
acttcagggcagattttagtt

SEQ ID NO: 569541 - DNA, 17 bp, Homo sapiens
acttcatttaacactga

SEQ ID NO: 569542 - DNA, 19 bp, Homo sapiens
acttccactttgtataaat

SEQ ID NO: 569543 - DNA, 16 bp, Homo sapiens
acttccgtcacatccc

SEQ ID NO: 569544 - DNA, 21 bp, Homo sapiens
acttcctgattggtttctctt

SEQ ID NO: 569545 - DNA, 14 bp, Homo sapiens
acttcctgcctggt

SEQ ID NO: 569546 - DNA, 16 bp, Homo sapiens
acttcctgcctggtct

SEQ ID NO: 569547 - DNA, 17 bp, Homo sapiens
acttcctgcctggtctc

SEQ ID NO: 569548 - DNA, 18 bp, Homo sapiens
acttcctgcctggtctcc

SEQ ID NO: 569549 - DNA, 15 bp, Homo sapiens
acttctaaaactgta

SEQ ID NO: 569550 - DNA, 19 bp, Homo sapiens
acttctaaaactgtacttt

SEQ ID NO: 569551 - DNA, 22 bp, Homo sapiens
acttctaaaactgtactttgat

SEQ ID NO: 569552 - DNA, 16 bp, Homo sapiens
acttctgactcttccc

SEQ ID NO: 569553 - DNA, 18 bp, Homo sapiens
acttctgactcttcccca

SEQ ID NO: 569554 - DNA, 23 bp, Homo sapiens
acttctgcctgaggggcagcctg

SEQ ID NO: 569555 - DNA, 17 bp, Homo sapiens
acttctgttttcaatct

SEQ ID NO: 569556 - DNA, 14 bp, Homo sapiens
acttcttacccaaa

SEQ ID NO: 569557 - DNA, 12 bp, Homo sapiens
acttctttccct

SEQ ID NO: 569558 - DNA, 16 bp, Homo sapiens
acttgatggtcagaca

SEQ ID NO: 569559 - DNA, 22 bp, Homo sapiens
acttgatggtcagacacaaaca

SEQ ID NO: 569560 - DNA, 19 bp, Homo sapiens
acttgattggtttaaaagt

SEQ ID NO: 569561 - DNA, 17 bp, Homo sapiens
acttgatttttcaaaga

SEQ ID NO: 569562 - DNA, 15 bp, Homo sapiens
acttgctgctatttt

SEQ ID NO: 569563 - DNA, 10 bp, Homo sapiens
acttggcacc

SEQ ID NO: 569564 - DNA, 13 bp, Homo sapiens
acttggcaccaat

SEQ ID NO: 569565 - DNA, 14 bp, Homo sapiens
acttggcaccaata

SEQ ID NO: 569566 - DNA, 17 bp, Homo sapiens
acttggcaccaataaag

SEQ ID NO: 569567 - DNA, 20 bp, Homo sapiens
acttggtcacagccaggcgc

SEQ ID NO: 569568 - DNA, 21 bp, Homo sapiens
acttggtgcggggttaacacc

SEQ ID NO: 569569 - DNA, 19 bp, Homo sapiens
acttgtataaatgtatata

SEQ ID NO: 569570 - DNA, 20 bp, Homo sapiens
acttgtataaatgtatatac

SEQ ID NO: 569571 - DNA, 21 bp, Homo sapiens
acttgtataaatgtatataca

SEQ ID NO: 569572 - DNA, 16 bp, Homo sapiens
acttgttatgttgtaa

SEQ ID NO: 569573 - DNA, 13 bp, Homo sapiens
acttgttcttcca

SEQ ID NO: 569574 - DNA, 19 bp, Homo sapiens
acttgttgcagactggtgt

SEQ ID NO: 569575 - DNA, 22 bp, Homo sapiens
acttgttgcagactggtgttaa

SEQ ID NO: 569576 - DNA, 23 bp, Homo sapiens
actttagagtgactaaaaggaaa

SEQ ID NO: 569577 - DNA, 24 bp, Homo sapiens
actttaggtagtagaatctcagca

SEQ ID NO: 569578 - DNA, 16 bp, Homo sapiens
actttcaagaacttgt

SEQ ID NO: 569579 - DNA, 14 bp, Homo sapiens
actttcctatgaca

SEQ ID NO: 569580 - DNA, 18 bp, Homo sapiens
actttctcagcatatata

SEQ ID NO: 569581 - DNA, 17 bp, Homo sapiens
actttctcttggacatt

SEQ ID NO: 569582 - DNA, 19 bp, Homo sapiens
actttctgtactaaacatt

SEQ ID NO: 569583 - DNA, 20 bp, Homo sapiens
actttctgtactaaacattt

SEQ ID NO: 569584 - DNA, 18 bp, Homo sapiens
actttgattcacatgttt

SEQ ID NO: 569585 - DNA, 16 bp, Homo sapiens
actttgtataaatttt

SEQ ID NO: 569586 - DNA, 17 bp, Homo sapiens
actttgtataaattttt

SEQ ID NO: 569587 - DNA, 18 bp, Homo sapiens
actttgtcctaagagatt

SEQ ID NO: 569588 - DNA, 20 bp, Homo sapiens
actttgtctaagaaacattg

SEQ ID NO: 569589 - DNA, 15 bp, Homo sapiens
actttgttaatttat

SEQ ID NO: 569590 - DNA, 21 bp, Homo sapiens
agagaaccgagcaaagatcaa

SEQ ID NO: 569591 - DNA, 21 bp, Homo sapiens
agagaagatggatatgaccag

SEQ ID NO: 569592 - DNA, 22 bp, Homo sapiens
agagaagtggactggaggagct

SEQ ID NO: 569593 - DNA, 15 bp, Homo sapiens
agagaattaaacgaa

SEQ ID NO: 569594 - DNA, 22 bp, Homo sapiens
agagacagttatttatagtcat

SEQ ID NO: 569595 - DNA, 12 bp, Homo sapiens
agagagaaatct

SEQ ID NO: 569596 - DNA, 18 bp, Homo sapiens
agagagatgtgtaatttt

SEQ ID NO: 569597 - DNA, 19 bp, Homo sapiens
agagagatgtgtaattttt

SEQ ID NO: 569598 - DNA, 16 bp, Homo sapiens
agagagctcatcatca

SEQ ID NO: 569599 - DNA, 21 bp, Homo sapiens
agagagctcatcatcagtctt

SEQ ID NO: 569600 - DNA, 17 bp, Homo sapiens
agagaggctaaaatgtt

SEQ ID NO: 569601 - DNA, 20 bp, Homo sapiens
agagagggccatgcaattca

SEQ ID NO: 569602 - DNA, 19 bp, Homo sapiens
agagagggggccacctccc

SEQ ID NO: 569603 - DNA, 22 bp, Homo sapiens
agagagggtgagtcctccagaa

SEQ ID NO: 569604 - DNA, 16 bp, Homo sapiens
agagagtatggtgctg

SEQ ID NO: 569605 - DNA, 20 bp, Homo sapiens
agagataggaaggtcatttc

SEQ ID NO: 569606 - DNA, 14 bp, Homo sapiens
agagatatatctga

SEQ ID NO: 569607 - DNA, 19 bp, Homo sapiens
agagatatatctgaaaact

SEQ ID NO: 569608 - DNA, 23 bp, Homo sapiens
agagatatatctgaaaactggaa

SEQ ID NO: 569609 - DNA, 16 bp, Homo sapiens
agagatctccaactct

SEQ ID NO: 569610 - DNA, 20 bp, Homo sapiens
agagatgcactatatgttta

SEQ ID NO: 569611 - DNA, 13 bp, Homo sapiens
agagatgtgtaat

SEQ ID NO: 569612 - DNA, 21 bp, Homo sapiens
agagcaaaagcctcagaaagg

SEQ ID NO: 569613 - DNA, 13 bp, Homo sapiens
agagcaagagagc

SEQ ID NO: 569614 - DNA, 16 bp, Homo sapiens
agagcaagagagcagc

SEQ ID NO: 569615 - DNA, 20 bp, Homo sapiens
agagcaagagagcagcaagg

SEQ ID NO: 569616 - DNA, 14 bp, Homo sapiens
agagcacaaacttc

SEQ ID NO: 569617 - DNA, 18 bp, Homo sapiens
agagcacaaacttcagaa

SEQ ID NO: 569618 - DNA, 21 bp, Homo sapiens
agagcactaggttcaattccc

SEQ ID NO: 569619 - DNA, 19 bp, Homo sapiens
agagcagcaaggtcttgct

SEQ ID NO: 569620 - DNA, 15 bp, Homo sapiens
agagcaggatagctc

SEQ ID NO: 569621 - DNA, 18 bp, Homo sapiens
agagcaggatagctcttc

SEQ ID NO: 569622 - DNA, 19 bp, Homo sapiens
agagcaggatagctcttcc

SEQ ID NO: 569623 - DNA, 23 bp, Homo sapiens
agagcaggatagctcttcctccc

SEQ ID NO: 569624 - DNA, 19 bp, Homo sapiens
agagcattccagtcaggct

SEQ ID NO: 569625 - DNA, 20 bp, Homo sapiens
agagcatttccaacaccaca

SEQ ID NO: 569626 - DNA, 14 bp, Homo sapiens
agagccacaataag

SEQ ID NO: 569627 - DNA, 14 bp, Homo sapiens
agagccgtaaaaac

SEQ ID NO: 569628 - DNA, 13 bp, Homo sapiens
agagcctctggaa

SEQ ID NO: 569629 - DNA, 20 bp, Homo sapiens
agagcgtggctgtgctctca

SEQ ID NO: 569630 - DNA, 15 bp, Homo sapiens
agagcgttgaagttg

SEQ ID NO: 569631 - DNA, 12 bp, Homo sapiens
agagctcccagg

SEQ ID NO: 569632 - DNA, 23 bp, Homo sapiens
agagctcctccttgtcttggcag

SEQ ID NO: 569633 - DNA, 15 bp, Homo sapiens
agagctgagtgagct

SEQ ID NO: 569634 - DNA, 18 bp, Homo sapiens
agagcttagcctggagca

SEQ ID NO: 569635 - DNA, 16 bp, Homo sapiens
agaggaataaaatgat

SEQ ID NO: 569636 - DNA, 21 bp, Homo sapiens
agaggaataaaatgattaagt

SEQ ID NO: 569637 - DNA, 21 bp, Homo sapiens
agaggcatgggcttgctgtgg

SEQ ID NO: 569638 - DNA, 17 bp, Homo sapiens
agagggcagagcacatg

SEQ ID NO: 569639 - DNA, 19 bp, Homo sapiens
agaggggaaaagctgaaca

SEQ ID NO: 569640 - DNA, 15 bp, Homo sapiens
agaggggcggggcca

SEQ ID NO: 569641 - DNA, 17 bp, Homo sapiens
agaggggcggggccagg

SEQ ID NO: 569642 - DNA, 18 bp, Homo sapiens
agaggggcggggccagga

SEQ ID NO: 569643 - DNA, 12 bp, Homo sapiens
agagggggccac

SEQ ID NO: 569644 - DNA, 16 bp, Homo sapiens
agaggtgcacttgggg

SEQ ID NO: 569645 - DNA, 18 bp, Homo sapiens
agagtatggtgctgggtc

SEQ ID NO: 569646 - DNA, 14 bp, Homo sapiens
agagtcaggagaaa

SEQ ID NO: 569647 - DNA, 19 bp, Homo sapiens
agagtcaggagaaacccct

SEQ ID NO: 569648 - DNA, 22 bp, Homo sapiens
agagtcctggtttcctcagcct

SEQ ID NO: 569649 - DNA, 13 bp, Homo sapiens
agagtgaagagca

SEQ ID NO: 569650 - DNA, 18 bp, Homo sapiens
agagtgatttgtaaaaca

SEQ ID NO: 569651 - DNA, 14 bp, Homo sapiens
agagtgcaaaacat

SEQ ID NO: 569652 - DNA, 16 bp, Homo sapiens
agagttcagggaagat

SEQ ID NO: 569653 - DNA, 18 bp, Homo sapiens
agagttcagggaagataa

SEQ ID NO: 569654 - DNA, 22 bp, Homo sapiens
agagtttagctgtaacagttct

SEQ ID NO: 569655 - DNA, 19 bp, Homo sapiens
agagtttcgtggcttcagg

SEQ ID NO: 569656 - DNA, 14 bp, Homo sapiens
agataagttggaaa

SEQ ID NO: 569657 - DNA, 20 bp, Homo sapiens
agataagttggaaacactaa

SEQ ID NO: 569658 - DNA, 14 bp, Homo sapiens
agataatggtaatt

SEQ ID NO: 569659 - DNA, 18 bp, Homo sapiens
agataatggtaatttagt

SEQ ID NO: 569660 - DNA, 18 bp, Homo sapiens
agataattaaatgaaata

SEQ ID NO: 569661 - DNA, 20 bp, Homo sapiens
agataattctggaccagaga

SEQ ID NO: 569662 - DNA, 20 bp, Homo sapiens
agataccttaaaatttgaaa

SEQ ID NO: 569663 - DNA, 22 bp, Homo sapiens
agataccttaaaatttgaaaca

SEQ ID NO: 569664 - DNA, 17 bp, Homo sapiens
agatagttgtaaagata

SEQ ID NO: 569665 - DNA, 17 bp, Homo sapiens
agatcaaaataaaaagt

SEQ ID NO: 569666 - DNA, 15 bp, Homo sapiens
agatcacatgcccct

SEQ ID NO: 569667 - DNA, 19 bp, Homo sapiens
agatcattatcttcatgtt

SEQ ID NO: 569668 - DNA, 22 bp, Homo sapiens
agatccacctgcacaaacatag

SEQ ID NO: 569669 - DNA, 23 bp, Homo sapiens
agatccacctgcacaaacataga

SEQ ID NO: 569670 - DNA, 10 bp, Homo sapiens
agatccagga

SEQ ID NO: 569671 - DNA, 19 bp, Homo sapiens
agatccaggaacacatgca

SEQ ID NO: 569672 - DNA, 17 bp, Homo sapiens
agatccgccctgggctc

SEQ ID NO: 569673 - DNA, 24 bp, Homo sapiens
agatcctggagtgatatgatccag

SEQ ID NO: 569674 - DNA, 15 bp, Homo sapiens
agatcggttaacaaa

SEQ ID NO: 569675 - DNA, 23 bp, Homo sapiens
agatgagaggggagagctgaaca

SEQ ID NO: 569676 - DNA, 13 bp, Homo sapiens
agatgaggctgga

SEQ ID NO: 569677 - DNA, 12 bp, Homo sapiens
agatgattctgg

SEQ ID NO: 569678 - DNA, 13 bp, Homo sapiens
agatgcagctctt

SEQ ID NO: 569679 - DNA, 16 bp, Homo sapiens
agatgcagctcttcct

SEQ ID NO: 569680 - DNA, 17 bp, Homo sapiens
agatgcagctcttcctg

SEQ ID NO: 569681 - DNA, 19 bp, Homo sapiens
agatgcttgctcttgggaa

SEQ ID NO: 569682 - DNA, 19 bp, Homo sapiens
agatggcgcacccggcagc

SEQ ID NO: 569683 - DNA, 22 bp, Homo sapiens
agatggcgcacccggcagcccc

SEQ ID NO: 569684 - DNA, 19 bp, Homo sapiens
agatgggcaaggcctttgg

SEQ ID NO: 569685 - DNA, 21 bp, Homo sapiens
agatgtagcaaaccctgtcaa

SEQ ID NO: 569686 - DNA, 16 bp, Homo sapiens
agatgtggacatgcac

SEQ ID NO: 569687 - DNA, 13 bp, Homo sapiens
agatgttaacagt

SEQ ID NO: 569688 - DNA, 16 bp, Homo sapiens
agatgttaacagtatt

SEQ ID NO: 569689 - DNA, 18 bp, Homo sapiens
agattaaggtgatgtgat

SEQ ID NO: 569690 - DNA, 21 bp, Homo sapiens
agattgatttacctttggaat

SEQ ID NO: 569691 - DNA, 23 bp, Homo sapiens
agattggattttatgttgacatt

SEQ ID NO: 569692 - DNA, 15 bp, Homo sapiens
agatttaagcaagac

SEQ ID NO: 569693 - DNA, 17 bp, Homo sapiens
agatttatctttataca

SEQ ID NO: 569694 - DNA, 18 bp, Homo sapiens
agatttatctttatacag

SEQ ID NO: 569695 - DNA, 17 bp, Homo sapiens
agatttgcaacagcaaa

SEQ ID NO: 569696 - DNA, 14 bp, Homo sapiens
agatttgcacaaaa

SEQ ID NO: 569697 - DNA, 15 bp, Homo sapiens
agatttgcacaaaaa

SEQ ID NO: 569698 - DNA, 20 bp, Homo sapiens
agattttagttttattttct

SEQ ID NO: 569699 - DNA, 23 bp, Homo sapiens
agattttagttttattttctaaa

SEQ ID NO: 569700 - DNA, 23 bp, Homo sapiens
agcaaaaaaagcaacttttccaa

SEQ ID NO: 569701 - DNA, 15 bp, Homo sapiens
agcaaaaaaagttgt

SEQ ID NO: 569702 - DNA, 20 bp, Homo sapiens
agcaaaaaaagttgtatgat

SEQ ID NO: 569703 - DNA, 12 bp, Homo sapiens
agcaaaaggcat

SEQ ID NO: 569704 - DNA, 15 bp, Homo sapiens
agcaaacccaaagat

SEQ ID NO: 569705 - DNA, 16 bp, Homo sapiens
agcaaacccaaagatg

SEQ ID NO: 569706 - DNA, 20 bp, Homo sapiens
agcaaaccctgtcaaacatt

SEQ ID NO: 569707 - DNA, 19 bp, Homo sapiens
agcaaactgaagcccacag

SEQ ID NO: 569708 - DNA, 14 bp, Homo sapiens
agcaaatttcaaaa

SEQ ID NO: 569709 - DNA, 14 bp, Homo sapiens
agcaacaattttca

SEQ ID NO: 569710 - DNA, 17 bp, Homo sapiens
agcaacaattttcagat

SEQ ID NO: 569711 - DNA, 14 bp, Homo sapiens
agcaacagctggac

SEQ ID NO: 569712 - DNA, 23 bp, Homo sapiens
agcaagaccatggggtggaagga

SEQ ID NO: 569713 - DNA, 18 bp, Homo sapiens
agcaagagagcagcaagg

SEQ ID NO: 569714 - DNA, 15 bp, Homo sapiens
agcaaggaaggacac

SEQ ID NO: 569715 - DNA, 17 bp, Homo sapiens
agcaaggcgctaacttg

SEQ ID NO: 569716 - DNA, 19 bp, Homo sapiens
agcaaggtcttgctctcct

SEQ ID NO: 569717 - DNA, 20 bp, Homo sapiens
agcaaggtcttgctctccta

SEQ ID NO: 569718 - DNA, 19 bp, Homo sapiens
agcacaacccccagctccc

SEQ ID NO: 569719 - DNA, 19 bp, Homo sapiens
agcacagagagggggccac

SEQ ID NO: 569720 - DNA, 20 bp, Homo sapiens
agcacagagagggggccacc

SEQ ID NO: 569721 - DNA, 23 bp, Homo sapiens
agcacagagagggggccacctcc

SEQ ID NO: 569722 - DNA, 17 bp, Homo sapiens
agcacagcctcacccct

SEQ ID NO: 569723 - DNA, 22 bp, Homo sapiens
agcacagcctcacccctgcagg

SEQ ID NO: 569724 - DNA, 16 bp, Homo sapiens
agcacagctcccttct

SEQ ID NO: 569725 - DNA, 15 bp, Homo sapiens
agcacagctttcctg

SEQ ID NO: 569726 - DNA, 17 bp, Homo sapiens
agctgcagagacagaga

SEQ ID NO: 569727 - DNA, 19 bp, Homo sapiens
agctgcagagacagagagg

SEQ ID NO: 569728 - DNA, 14 bp, Homo sapiens
agctgcatggcaca

SEQ ID NO: 569729 - DNA, 13 bp, Homo sapiens
agctgcccctccc

SEQ ID NO: 569730 - DNA, 15 bp, Homo sapiens
agctgctgcacagct

SEQ ID NO: 569731 - DNA, 17 bp, Homo sapiens
agctggatataatgtat

SEQ ID NO: 569732 - DNA, 19 bp, Homo sapiens
agctggcaggagacactgg

SEQ ID NO: 569733 - DNA, 22 bp, Homo sapiens
agctggcctctcactgcctccc

SEQ ID NO: 569734 - DNA, 12 bp, Homo sapiens
agctggctccag

SEQ ID NO: 569735 - DNA, 15 bp, Homo sapiens
agctgtaacagttct

SEQ ID NO: 569736 - DNA, 21 bp, Homo sapiens
agctgtcatggtgcaatttgt

SEQ ID NO: 569737 - DNA, 12 bp, Homo sapiens
agctgtgatttt

SEQ ID NO: 569738 - DNA, 16 bp, Homo sapiens
agctgtggggagctgg

SEQ ID NO: 569739 - DNA, 20 bp, Homo sapiens
agctgtgtccggcccagttt

SEQ ID NO: 569740 - DNA, 21 bp, Homo sapiens
agctgttgtctcttctcctta

SEQ ID NO: 569741 - DNA, 19 bp, Homo sapiens
agcttaaccgaagaactaa

SEQ ID NO: 569742 - DNA, 14 bp, Homo sapiens
agcttaagaaaaaa

SEQ ID NO: 569743 - DNA, 19 bp, Homo sapiens
agcttaagaagtatccctg

SEQ ID NO: 569744 - DNA, 18 bp, Homo sapiens
agcttagaattatttgca

SEQ ID NO: 569745 - DNA, 15 bp, Homo sapiens
agcttatctttcttt

SEQ ID NO: 569746 - DNA, 20 bp, Homo sapiens
agcttattttggagagatag

SEQ ID NO: 569747 - DNA, 12 bp, Homo sapiens
agcttccctccc

SEQ ID NO: 569748 - DNA, 15 bp, Homo sapiens
agcttccctccctgc

SEQ ID NO: 569749 - DNA, 20 bp, Homo sapiens
agcttcttaatataactgcc

SEQ ID NO: 569750 - DNA, 17 bp, Homo sapiens
agcttgatgctgtttct

SEQ ID NO: 569751 - DNA, 13 bp, Homo sapiens
agctttacacaca

SEQ ID NO: 569752 - DNA, 15 bp, Homo sapiens
agctttcctgggtct

SEQ ID NO: 569753 - DNA, 15 bp, Homo sapiens
agctttctaaagcca

SEQ ID NO: 569754 - DNA, 11 bp, Homo sapiens
agctttctcaa

SEQ ID NO: 569755 - DNA, 14 bp, Homo sapiens
agctttctcaatgt

SEQ ID NO: 569756 - DNA, 18 bp, Homo sapiens
agctttctcaatgtcttc

SEQ ID NO: 569757 - DNA, 20 bp, Homo sapiens
agctttgggcagatttgcaa

SEQ ID NO: 569758 - DNA, 21 bp, Homo sapiens
agctttgggcagatttgcaac

SEQ ID NO: 569759 - DNA, 15 bp, Homo sapiens
agcttttgcatagaa

SEQ ID NO: 569760 - DNA, 18 bp, Homo sapiens
agcttttgcatagaataa

SEQ ID NO: 569761 - DNA, 17 bp, Homo sapiens
aggaaaaatatgtgaag

SEQ ID NO: 569762 - DNA, 14 bp, Homo sapiens
aggaaaagaaatct

SEQ ID NO: 569763 - DNA, 17 bp, Homo sapiens
aggaaaagaaatctata

SEQ ID NO: 569764 - DNA, 13 bp, Homo sapiens
aggaaagaaaagg

SEQ ID NO: 569765 - DNA, 18 bp, Homo sapiens
aggaaaggaagacctcaa

SEQ ID NO: 569766 - DNA, 15 bp, Homo sapiens
aggaacaaatcttcc

SEQ ID NO: 569767 - DNA, 17 bp, Homo sapiens
aggaacaaatcttcctg

SEQ ID NO: 569768 - DNA, 15 bp, Homo sapiens
aggaacacatgcaca

SEQ ID NO: 569769 - DNA, 15 bp, Homo sapiens
aggaacactctgaat

SEQ ID NO: 569770 - DNA, 20 bp, Homo sapiens
aggaacatgacccgtacaca

SEQ ID NO: 569771 - DNA, 22 bp, Homo sapiens
aggaacatgacccgtacacacc

SEQ ID NO: 569772 - DNA, 16 bp, Homo sapiens
aggaagcatgagtgct

SEQ ID NO: 569773 - DNA, 15 bp, Homo sapiens
aggaaggcacttctg

SEQ ID NO: 569774 - DNA, 13 bp, Homo sapiens
aggaagtccctga

SEQ ID NO: 569775 - DNA, 20 bp, Homo sapiens
aggaagtccctgagaagcct

SEQ ID NO: 569776 - DNA, 23 bp, Homo sapiens
aggaagtccttatctagctgcat

SEQ ID NO: 569777 - DNA, 14 bp, Homo sapiens
aggaatattatatt

SEQ ID NO: 569778 - DNA, 19 bp, Homo sapiens
aggaatattatatttggat

SEQ ID NO: 569779 - DNA, 23 bp, Homo sapiens
aggacaaggtgcaggcaggctgg

SEQ ID NO: 569780 - DNA, 22 bp, Homo sapiens
aggacacctgtactggagagca

SEQ ID NO: 569781 - DNA, 12 bp, Homo sapiens
aggacactcccg

SEQ ID NO: 569782 - DNA, 16 bp, Homo sapiens
aggacagaaggctcct

SEQ ID NO: 569783 - DNA, 14 bp, Homo sapiens
aggacaggcaggtg

SEQ ID NO: 569784 - DNA, 16 bp, Homo sapiens
aggacattatgtgtgc

SEQ ID NO: 569785 - DNA, 12 bp, Homo sapiens
aggaccagggct

SEQ ID NO: 569786 - DNA, 22 bp, Homo sapiens
aggacccatgaaacagcagctg

SEQ ID NO: 569787 - DNA, 16 bp, Homo sapiens
aggaccccatctgctg

SEQ ID NO: 569788 - DNA, 19 bp, Homo sapiens
aggaccctgagggtttcca

SEQ ID NO: 569789 - DNA, 20 bp, Homo sapiens
aggacctccacctgggagat

SEQ ID NO: 569790 - DNA, 23 bp, Homo sapiens
aggaccttcactctaagatgtta

SEQ ID NO: 569791 - DNA, 19 bp, Homo sapiens
aggacgcttcacaggacag

SEQ ID NO: 569792 - DNA, 20 bp, Homo sapiens
aggacgtgggcggcagagag

SEQ ID NO: 569793 - DNA, 21 bp, Homo sapiens
aggactccattggatctgcaa

SEQ ID NO: 569794 - DNA, 23 bp, Homo sapiens
aggactcgggctaagtccagctc

SEQ ID NO: 569795 - DNA, 21 bp, Homo sapiens
aggactctcacgatatgcaag

SEQ ID NO: 569796 - DNA, 19 bp, Homo sapiens
aggactctgccttccaggc

SEQ ID NO: 569797 - DNA, 21 bp, Homo sapiens
aggactctgccttccaggcgt

SEQ ID NO: 569798 - DNA, 22 bp, Homo sapiens
aggacttcctgctacagtagct

SEQ ID NO: 569799 - DNA, 16 bp, Homo sapiens
aggagactcaggccca

SEQ ID NO: 569800 - DNA, 19 bp, Homo sapiens
aggagctcaggaagaagag

SEQ ID NO: 569801 - DNA, 19 bp, Homo sapiens
aggagctgggggcagcctg

SEQ ID NO: 569802 - DNA, 19 bp, Homo sapiens
aggagctttctcaatgtct

SEQ ID NO: 569803 - DNA, 20 bp, Homo sapiens
aggaggcagtggcttggagc

SEQ ID NO: 569804 - DNA, 18 bp, Homo sapiens
aggaggctccaggcagca

SEQ ID NO: 569805 - DNA, 22 bp, Homo sapiens
aggaggctgggacgctctgctg

SEQ ID NO: 569806 - DNA, 16 bp, Homo sapiens
aggagggatagagacg

SEQ ID NO: 569807 - DNA, 21 bp, Homo sapiens
aggagttcaagaccagcctgg

SEQ ID NO: 569808 - DNA, 17 bp, Homo sapiens
aggatatgcctgctctt

SEQ ID NO: 569809 - DNA, 17 bp, Homo sapiens
aggatgcatattaaaga

SEQ ID NO: 569810 - DNA, 15 bp, Homo sapiens
aggatgtatgtgtat

SEQ ID NO: 569811 - DNA, 16 bp, Homo sapiens
aggatgtggatggagg

SEQ ID NO: 569812 - DNA, 18 bp, Homo sapiens
aggattctcaccagctgt

SEQ ID NO: 569813 - DNA, 11 bp, Homo sapiens
aggatttgatg

SEQ ID NO: 569814 - DNA, 10 bp, Homo sapiens
aggcaatgat

SEQ ID NO: 569815 - DNA, 14 bp, Homo sapiens
aggcacacagctgc

SEQ ID NO: 569816 - DNA, 23 bp, Homo sapiens
aggcacacagctgcagagacaga

SEQ ID NO: 569817 - DNA, 14 bp, Homo sapiens
aggcaccatctccc

SEQ ID NO: 569818 - DNA, 21 bp, Homo sapiens
aggcagagctcagcacagcct

SEQ ID NO: 569819 - DNA, 20 bp, Homo sapiens
aggcagctgttgtctcttct

SEQ ID NO: 569820 - DNA, 17 bp, Homo sapiens
aggcaggggccctgcag

SEQ ID NO: 569821 - DNA, 18 bp, Homo sapiens
aggcaggggccctgcagc

SEQ ID NO: 569822 - DNA, 19 bp, Homo sapiens
aggcaggggccctgcagct

SEQ ID NO: 569823 - DNA, 20 bp, Homo sapiens
aggcaggggccctgcagctc

SEQ ID NO: 569824 - DNA, 17 bp, Homo sapiens
aggcaggtgacagtgag

SEQ ID NO: 569825 - DNA, 23 bp, Homo sapiens
aggcagtggcttggagcagaggt

SEQ ID NO: 569826 - DNA, 21 bp, Homo sapiens
aggcatgaccctggagcccgg

SEQ ID NO: 569827 - DNA, 14 bp, Homo sapiens
aggcatgtggcctt

SEQ ID NO: 569828 - DNA, 16 bp, Homo sapiens
aggcatttttgtaatg

SEQ ID NO: 569829 - DNA, 23 bp, Homo sapiens
aggcatttttgtaatgagccatt

SEQ ID NO: 569830 - DNA, 21 bp, Homo sapiens
aggccaagaggtttggctcct

SEQ ID NO: 569831 - DNA, 19 bp, Homo sapiens
aggcccacattgcccacac

SEQ ID NO: 569832 - DNA, 21 bp, Homo sapiens
aggcccgaaggtctctctggc

SEQ ID NO: 569833 - DNA, 13 bp, Homo sapiens
aggccgggcagag

SEQ ID NO: 569834 - DNA, 16 bp, Homo sapiens
aggccgggcagagcac

SEQ ID NO: 569835 - DNA, 16 bp, Homo sapiens
aggcctccctgccagt

SEQ ID NO: 569836 - DNA, 19 bp, Homo sapiens
aggcctgaaatgtttccag

SEQ ID NO: 569837 - DNA, 21 bp, Homo sapiens
aggcctgaaatgtttccaggc

SEQ ID NO: 569838 - DNA, 22 bp, Homo sapiens
aggcctgaaatgtttccaggca

SEQ ID NO: 569839 - DNA, 18 bp, Homo sapiens
aggccttgggctctgctg

SEQ ID NO: 569840 - DNA, 19 bp, Homo sapiens
aggccttgggctctgctga

SEQ ID NO: 569841 - DNA, 13 bp, Homo sapiens
aggcgctaacttg

SEQ ID NO: 569842 - DNA, 15 bp, Homo sapiens
aggcgctaacttgct

SEQ ID NO: 569843 - DNA, 23 bp, Homo sapiens
aggcgctaacttgcttaaatgtg

SEQ ID NO: 569844 - DNA, 14 bp, Homo sapiens
aggcgtagggccag

SEQ ID NO: 569845 - DNA, 15 bp, Homo sapiens
aggcgtagggccagg

SEQ ID NO: 569846 - DNA, 17 bp, Homo sapiens
aggcgtagggccagggc

SEQ ID NO: 569847 - DNA, 18 bp, Homo sapiens
aggcgtagggccagggct

SEQ ID NO: 569848 - DNA, 22 bp, Homo sapiens
aggcgtagggccagggctctgg

SEQ ID NO: 569849 - DNA, 22 bp, Homo sapiens
aggctaatgttggcagatgcag

SEQ ID NO: 569850 - DNA, 17 bp, Homo sapiens
aggctccatccttctcc

SEQ ID NO: 569851 - DNA, 23 bp, Homo sapiens
aggctccctccctcccagatcca

SEQ ID NO: 569852 - DNA, 22 bp, Homo sapiens
aggctccttagggttttctctc

SEQ ID NO: 569853 - DNA, 22 bp, Homo sapiens
aggctctgtgtgttaaaatgag

SEQ ID NO: 569854 - DNA, 20 bp, Homo sapiens
aggctgccccacccctccat

SEQ ID NO: 569855 - DNA, 20 bp, Homo sapiens
aggctggataggagaggaaa

SEQ ID NO: 569856 - DNA, 18 bp, Homo sapiens
aggctgggacgctctgct

SEQ ID NO: 569857 - DNA, 14 bp, Homo sapiens
aggcttatatttgt

SEQ ID NO: 569858 - DNA, 12 bp, Homo sapiens
aggcttgcagaa

SEQ ID NO: 569859 - DNA, 22 bp, Homo sapiens
agggaaaataaaaaaagaaaaa

SEQ ID NO: 569860 - DNA, 13 bp, Homo sapiens
agggaaccagagc

SEQ ID NO: 569861 - DNA, 21 bp, Homo sapiens
agggaatgagagttccttctc

SEQ ID NO: 569862 - DNA, 11 bp, Homo sapiens
ataagaaaaat

SEQ ID NO: 569863 - DNA, 13 bp, Homo sapiens
ataagaaacagtt

SEQ ID NO: 569864 - DNA, 16 bp, Homo sapiens
ataagaaacagtttaa

SEQ ID NO: 569865 - DNA, 18 bp, Homo sapiens
ataagaaacagtttaaca

SEQ ID NO: 569866 - DNA, 19 bp, Homo sapiens
ataagaaacagtttaacag

SEQ ID NO: 569867 - DNA, 14 bp, Homo sapiens
ataagcaaatttca

SEQ ID NO: 569868 - DNA, 15 bp, Homo sapiens
ataagcaaatttcaa

SEQ ID NO: 569869 - DNA, 19 bp, Homo sapiens
ataagcaaatttcaaaaga

SEQ ID NO: 569870 - DNA, 19 bp, Homo sapiens
ataagcaacaattttcaga

SEQ ID NO: 569871 - DNA, 20 bp, Homo sapiens
ataagcaacaattttcagat

SEQ ID NO: 569872 - DNA, 21 bp, Homo sapiens
ataagcacagacaattctaat

SEQ ID NO: 569873 - DNA, 15 bp, Homo sapiens
ataaggacttcctga

SEQ ID NO: 569874 - DNA, 16 bp, Homo sapiens
ataagtaaatgtcttc

SEQ ID NO: 569875 - DNA, 20 bp, Homo sapiens
ataagtgcacacagaaatat

SEQ ID NO: 569876 - DNA, 21 bp, Homo sapiens
ataagtgcacacagaaatata

SEQ ID NO: 569877 - DNA, 16 bp, Homo sapiens
ataagttggaaacact

SEQ ID NO: 569878 - DNA, 17 bp, Homo sapiens
ataagttggaaacacta

SEQ ID NO: 569879 - DNA, 23 bp, Homo sapiens
ataagttggaaacactaaatgtt

SEQ ID NO: 569880 - DNA, 12 bp, Homo sapiens
ataataatacaa

SEQ ID NO: 569881 - DNA, 12 bp, Homo sapiens
ataatatatttg

SEQ ID NO: 569882 - DNA, 14 bp, Homo sapiens
ataatatatttgca

SEQ ID NO: 569883 - DNA, 17 bp, Homo sapiens
ataatatatttgcagat

SEQ ID NO: 569884 - DNA, 16 bp, Homo sapiens
ataatcaaagctcata

SEQ ID NO: 569885 - DNA, 18 bp, Homo sapiens
ataatggaaaaaaagact

SEQ ID NO: 569886 - DNA, 16 bp, Homo sapiens
ataatggaagagaaat

SEQ ID NO: 569887 - DNA, 17 bp, Homo sapiens
ataatggaagagaaatc

SEQ ID NO: 569888 - DNA, 14 bp, Homo sapiens
ataatggccctgta

SEQ ID NO: 569889 - DNA, 17 bp, Homo sapiens
ataatggcctcttaaaa

SEQ ID NO: 569890 - DNA, 23 bp, Homo sapiens
ataatggcctcttaaaaattatc

SEQ ID NO: 569891 - DNA, 14 bp, Homo sapiens
ataatggtaattta

SEQ ID NO: 569892 - DNA, 17 bp, Homo sapiens
ataatgtattttcagct

SEQ ID NO: 569893 - DNA, 13 bp, Homo sapiens
ataatgtgtgtat

SEQ ID NO: 569894 - DNA, 14 bp, Homo sapiens
ataatgtgtgtatg

SEQ ID NO: 569895 - DNA, 19 bp, Homo sapiens
ataatgtgtgtatgtgtat

SEQ ID NO: 569896 - DNA, 13 bp, Homo sapiens
ataattaaaacaa

SEQ ID NO: 569897 - DNA, 16 bp, Homo sapiens
ataattaaatgaaata

SEQ ID NO: 569898 - DNA, 19 bp, Homo sapiens
ataattcattaaaaacatt

SEQ ID NO: 569899 - DNA, 18 bp, Homo sapiens
ataattctgaagttatat

SEQ ID NO: 569900 - DNA, 19 bp, Homo sapiens
ataattctgaagttatatt

SEQ ID NO: 569901 - DNA, 20 bp, Homo sapiens
ataattgactggtggaagga

SEQ ID NO: 569902 - DNA, 21 bp, Homo sapiens
atacaatatataaaaatatat

SEQ ID NO: 569903 - DNA, 13 bp, Homo sapiens
atacaatttactt

SEQ ID NO: 569904 - DNA, 16 bp, Homo sapiens
atacaatttactttta

SEQ ID NO: 569905 - DNA, 13 bp, Homo sapiens
atacacacaggag

SEQ ID NO: 569906 - DNA, 14 bp, Homo sapiens
atacacatacatat

SEQ ID NO: 569907 - DNA, 21 bp, Homo sapiens
atacacatatacctataatgt

SEQ ID NO: 569908 - DNA, 16 bp, Homo sapiens
atacacgtgtatatga

SEQ ID NO: 569909 - DNA, 13 bp, Homo sapiens
atacactttatta

SEQ ID NO: 569910 - DNA, 22 bp, Homo sapiens
atacatacacttgtataaatgt

SEQ ID NO: 569911 - DNA, 20 bp, Homo sapiens
atacatacgcaattgtatat

SEQ ID NO: 569912 - DNA, 16 bp, Homo sapiens
atacatatatacattt

SEQ ID NO: 569913 - DNA, 18 bp, Homo sapiens
atacatatgtagactata

SEQ ID NO: 569914 - DNA, 12 bp, Homo sapiens
atacatgtgtgt

SEQ ID NO: 569915 - DNA, 13 bp, Homo sapiens
atacatgtgtgta

SEQ ID NO: 569916 - DNA, 14 bp, Homo sapiens
atacatgtgtgtat

SEQ ID NO: 569917 - DNA, 13 bp, Homo sapiens
atacattttgcag

SEQ ID NO: 569918 - DNA, 20 bp, Homo sapiens
ataccaaagctgctgcacag

SEQ ID NO: 569919 - DNA, 13 bp, Homo sapiens
atacctataatgt

SEQ ID NO: 569920 - DNA, 19 bp, Homo sapiens
atacctataatgtgtgtat

SEQ ID NO: 569921 - DNA, 14 bp, Homo sapiens
atacctctaactgt

SEQ ID NO: 569922 - DNA, 17 bp, Homo sapiens
atacctctaactgtgca

SEQ ID NO: 569923 - DNA, 16 bp, Homo sapiens
atacctgtacacacac

SEQ ID NO: 569924 - DNA, 18 bp, Homo sapiens
atacctgtacacacacag

SEQ ID NO: 569925 - DNA, 21 bp, Homo sapiens
atacctgtacacacacagaca

SEQ ID NO: 569926 - DNA, 17 bp, Homo sapiens
ataccttaaaatttgaa

SEQ ID NO: 569927 - DNA, 14 bp, Homo sapiens
atacgcaattgtat

SEQ ID NO: 569928 - DNA, 12 bp, Homo sapiens
atactaaaatat

SEQ ID NO: 569929 - DNA, 18 bp, Homo sapiens
atactagccagagctcct

SEQ ID NO: 569930 - DNA, 19 bp, Homo sapiens
atactcatttctaaaagaa

SEQ ID NO: 569931 - DNA, 21 bp, Homo sapiens
atactcatttctaaaagaata

SEQ ID NO: 569932 - DNA, 22 bp, Homo sapiens
atactcatttctaaaagaatat

SEQ ID NO: 569933 - DNA, 22 bp, Homo sapiens
atactccttaaaaatgtatgtt

SEQ ID NO: 569934 - DNA, 15 bp, Homo sapiens
atactgcctccccca

SEQ ID NO: 569935 - DNA, 20 bp, Homo sapiens
atacttatttataacattgt

SEQ ID NO: 569936 - DNA, 14 bp, Homo sapiens
atacttggtcctta

SEQ ID NO: 569937 - DNA, 18 bp, Homo sapiens
atactttgtcctaagaga

SEQ ID NO: 569938 - DNA, 15 bp, Homo sapiens
atagaaagtgttctg

SEQ ID NO: 569939 - DNA, 20 bp, Homo sapiens
atagaaagtgttctgttaca

SEQ ID NO: 569940 - DNA, 13 bp, Homo sapiens
atagaagaatgca

SEQ ID NO: 569941 - DNA, 17 bp, Homo sapiens
atagaagaatgcatgct

SEQ ID NO: 569942 - DNA, 13 bp, Homo sapiens
atagaagtcttca

SEQ ID NO: 569943 - DNA, 15 bp, Homo sapiens
atagaagtcttcatg

SEQ ID NO: 569944 - DNA, 17 bp, Homo sapiens
atagaagtcttcatgaa

SEQ ID NO: 569945 - DNA, 19 bp, Homo sapiens
atagaagtcttcatgaaat

SEQ ID NO: 569946 - DNA, 20 bp, Homo sapiens
atagaataatgaagatcttt

SEQ ID NO: 569947 - DNA, 17 bp, Homo sapiens
atagacagatgtggaca

SEQ ID NO: 569948 - DNA, 19 bp, Homo sapiens
atagacagatgtggacatg

SEQ ID NO: 569949 - DNA, 23 bp, Homo sapiens
atagacagatgtggacatgcacc

SEQ ID NO: 569950 - DNA, 22 bp, Homo sapiens
atagacaggagaagaaagaact

SEQ ID NO: 569951 - DNA, 15 bp, Homo sapiens
atagacataaattgt

SEQ ID NO: 569952 - DNA, 17 bp, Homo sapiens
atagacataaattgtaa

SEQ ID NO: 569953 - DNA, 20 bp, Homo sapiens
atagacataaattgtaattt

SEQ ID NO: 569954 - DNA, 21 bp, Homo sapiens
atagacataaattgtaatttg

SEQ ID NO: 569955 - DNA, 22 bp, Homo sapiens
atagacataaattgtaatttgg

SEQ ID NO: 569956 - DNA, 19 bp, Homo sapiens
atagacgcaaccttaactt

SEQ ID NO: 569957 - DNA, 17 bp, Homo sapiens
atagataccattttgaa

SEQ ID NO: 569958 - DNA, 22 bp, Homo sapiens
atagataccattttgaaatatt

SEQ ID NO: 569959 - DNA, 21 bp, Homo sapiens
atagatcccacgttgatgtct

SEQ ID NO: 569960 - DNA, 23 bp, Homo sapiens
atagattgatttacctttggaat

SEQ ID NO: 569961 - DNA, 17 bp, Homo sapiens
atagcagtggcaaaata

SEQ ID NO: 569962 - DNA, 21 bp, Homo sapiens
atagcagtggcaaaatattat

SEQ ID NO: 569963 - DNA, 15 bp, Homo sapiens
atagcccctctcccc

SEQ ID NO: 569964 - DNA, 14 bp, Homo sapiens
atagcctagctttc

SEQ ID NO: 569965 - DNA, 17 bp, Homo sapiens
atagcctcaccttccct

SEQ ID NO: 569966 - DNA, 16 bp, Homo sapiens
atagctacccaaaaga

SEQ ID NO: 569967 - DNA, 14 bp, Homo sapiens
atagctataaatag

SEQ ID NO: 569968 - DNA, 17 bp, Homo sapiens
atagctataaatagtga

SEQ ID NO: 569969 - DNA, 21 bp, Homo sapiens
atagctcttcctccccaggac

SEQ ID NO: 569970 - DNA, 17 bp, Homo sapiens
ataggaaggtcatttcc

SEQ ID NO: 569971 - DNA, 15 bp, Homo sapiens
ataggacttgttttt

SEQ ID NO: 569972 - DNA, 16 bp, Homo sapiens
ataggacttgtttttg

SEQ ID NO: 569973 - DNA, 21 bp, Homo sapiens
ataggatctgaggacaaggaa

SEQ ID NO: 569974 - DNA, 14 bp, Homo sapiens
atagtaaatgtagt

SEQ ID NO: 569975 - DNA, 16 bp, Homo sapiens
atagtaaatgtagttc

SEQ ID NO: 569976 - DNA, 15 bp, Homo sapiens
atagtatacacatca

SEQ ID NO: 569977 - DNA, 17 bp, Homo sapiens
atagtcttttgcatgtc

SEQ ID NO: 569978 - DNA, 15 bp, Homo sapiens
atagtgcaatatatt

SEQ ID NO: 569979 - DNA, 15 bp, Homo sapiens
atagtgctatatata

SEQ ID NO: 569980 - DNA, 19 bp, Homo sapiens
atagtgctatatatataaa

SEQ ID NO: 569981 - DNA, 15 bp, Homo sapiens
atagttgtaaagata

SEQ ID NO: 569982 - DNA, 19 bp, Homo sapiens
atagttgtccatattttca

SEQ ID NO: 569983 - DNA, 13 bp, Homo sapiens
atataaaaataat

SEQ ID NO: 569984 - DNA, 20 bp, Homo sapiens
atataaaaataattaaaaca

SEQ ID NO: 569985 - DNA, 22 bp, Homo sapiens
atataaaaataattaaaacaaa

SEQ ID NO: 569986 - DNA, 14 bp, Homo sapiens
atataaaaatatat

SEQ ID NO: 569987 - DNA, 17 bp, Homo sapiens
atataaaaatatatata

SEQ ID NO: 569988 - DNA, 15 bp, Homo sapiens
atataaaatacacgt

SEQ ID NO: 569989 - DNA, 14 bp, Homo sapiens
atataaaatggcaa

SEQ ID NO: 569990 - DNA, 19 bp, Homo sapiens
atataaaatggcaacaaac

SEQ ID NO: 569991 - DNA, 13 bp, Homo sapiens
atataatgtattt

SEQ ID NO: 569992 - DNA, 16 bp, Homo sapiens
atatacagtgtgtagt

SEQ ID NO: 569993 - DNA, 21 bp, Homo sapiens
atatacatacgcaattgtata

SEQ ID NO: 569994 - DNA, 13 bp, Homo sapiens
atatacatgtgtg

SEQ ID NO: 569995 - DNA, 18 bp, Homo sapiens
atatacatgtgtgtatat

SEQ ID NO: 569996 - DNA, 17 bp, Homo sapiens
atatacctataatgtgt

SEQ ID NO: 569997 - DNA, 20 bp, Homo sapiens
atatacctataatgtgtgta

SEQ ID NO: 569998 - DNA, 17 bp, Homo sapiens
atatagcagcaaaaata

SEQ ID NO: 569999 - DNA, 20 bp, Homo sapiens
atatagcagcaaaaatataa

SEQ ID NO: 570000 - DNA, 22 bp, Homo sapiens
atcccacgttgatgtctgaacg

SEQ ID NO: 570001 - DNA, 23 bp, Homo sapiens
atcccatcgtctcggccttcaca

SEQ ID NO: 570002 - DNA, 21 bp, Homo sapiens
atccccaaatgtgtcttgtat

SEQ ID NO: 570003 - DNA, 14 bp, Homo sapiens
atccccagtcccaa

SEQ ID NO: 570004 - DNA, 15 bp, Homo sapiens
atccctgatcccttc

SEQ ID NO: 570005 - DNA, 14 bp, Homo sapiens
atcccttccacctg

SEQ ID NO: 570006 - DNA, 16 bp, Homo sapiens
atcccttccacctgct

SEQ ID NO: 570007 - DNA, 22 bp, Homo sapiens
atcccttctcttccaggcagcc

SEQ ID NO: 570008 - DNA, 13 bp, Homo sapiens
atccgaagggaat

SEQ ID NO: 570009 - DNA, 17 bp, Homo sapiens
atccggggccagctccg

SEQ ID NO: 570010 - DNA, 20 bp, Homo sapiens
atccgtgtatttggctgggc

SEQ ID NO: 570011 - DNA, 18 bp, Homo sapiens
atcctaactgaagagaca

SEQ ID NO: 570012 - DNA, 19 bp, Homo sapiens
atcctatctggggagctcc

SEQ ID NO: 570013 - DNA, 21 bp, Homo sapiens
atcctatctggggagctcctg

SEQ ID NO: 570014 - DNA, 17 bp, Homo sapiens
atcctcctccttcctag

SEQ ID NO: 570015 - DNA, 18 bp, Homo sapiens
atcctcctccttcctagt

SEQ ID NO: 570016 - DNA, 23 bp, Homo sapiens
atcctgtgctatgctggacatta

SEQ ID NO: 570017 - DNA, 17 bp, Homo sapiens
atcctgtgtgtgtctag

SEQ ID NO: 570018 - DNA, 14 bp, Homo sapiens
atccttacaaatga

SEQ ID NO: 570019 - DNA, 12 bp, Homo sapiens
atccttcccact

SEQ ID NO: 570020 - DNA, 11 bp, Homo sapiens
atccttctccc

SEQ ID NO: 570021 - DNA, 22 bp, Homo sapiens
atccttgaggacctccacctgg

SEQ ID NO: 570022 - DNA, 20 bp, Homo sapiens
atcctttcacttctttccct

SEQ ID NO: 570023 - DNA, 22 bp, Homo sapiens
atcctttcacttctttcccttc

SEQ ID NO: 570024 - DNA, 16 bp, Homo sapiens
atccttttctgtgttt

SEQ ID NO: 570025 - DNA, 20 bp, Homo sapiens
atcgcaagtcacagaaaatg

SEQ ID NO: 570026 - DNA, 14 bp, Homo sapiens
atcgccagcaaaac

SEQ ID NO: 570027 - DNA, 15 bp, Homo sapiens
atcggttaacaaata

SEQ ID NO: 570028 - DNA, 23 bp, Homo sapiens
atcggttaacaaataacaacttt

SEQ ID NO: 570029 - DNA, 16 bp, Homo sapiens
atcgtattcaccttca

SEQ ID NO: 570030 - DNA, 22 bp, Homo sapiens
atctaaactttaatatgtattt

SEQ ID NO: 570031 - DNA, 17 bp, Homo sapiens
atctaccaactttcaag

SEQ ID NO: 570032 - DNA, 13 bp, Homo sapiens
atctagatgtaaa

SEQ ID NO: 570033 - DNA, 17 bp, Homo sapiens
atctagatgtaaatttt

SEQ ID NO: 570034 - DNA, 23 bp, Homo sapiens
atctcaaaagatctcctgtgcac

SEQ ID NO: 570035 - DNA, 17 bp, Homo sapiens
atctcctggtgttctgc

SEQ ID NO: 570036 - DNA, 13 bp, Homo sapiens
atctcgctagcca

SEQ ID NO: 570037 - DNA, 21 bp, Homo sapiens
atctctatgccctgttaaatg

SEQ ID NO: 570038 - DNA, 17 bp, Homo sapiens
atctctattccccaccc

SEQ ID NO: 570039 - DNA, 13 bp, Homo sapiens
atctcttctgtgt

SEQ ID NO: 570040 - DNA, 13 bp, Homo sapiens
atctgaaaactgg

SEQ ID NO: 570041 - DNA, 14 bp, Homo sapiens
atctgaagattgtt

SEQ ID NO: 570042 - DNA, 15 bp, Homo sapiens
atctgaagattgttt

SEQ ID NO: 570043 - DNA, 21 bp, Homo sapiens
atctgaagattgtttatctag

SEQ ID NO: 570044 - DNA, 17 bp, Homo sapiens
atctgatctgagtgaga

SEQ ID NO: 570045 - DNA, 16 bp, Homo sapiens
atctgatgatgttctg

SEQ ID NO: 570046 - DNA, 17 bp, Homo sapiens
atctgatgatgttctga

SEQ ID NO: 570047 - DNA, 15 bp, Homo sapiens
atctgcagtgttctg

SEQ ID NO: 570048 - DNA, 23 bp, Homo sapiens
atctgcagtgttctgtgaatagc

SEQ ID NO: 570049 - DNA, 18 bp, Homo sapiens
atctgctgagctctgacc

SEQ ID NO: 570050 - DNA, 20 bp, Homo sapiens
atctgctgagctctgacctg

SEQ ID NO: 570051 - DNA, 15 bp, Homo sapiens
atctggggagctcct

SEQ ID NO: 570052 - DNA, 16 bp, Homo sapiens
atctggggagctcctg

SEQ ID NO: 570053 - DNA, 18 bp, Homo sapiens
atctgggttttgcctctg

SEQ ID NO: 570054 - DNA, 20 bp, Homo sapiens
atctgggttttgcctctgcc

SEQ ID NO: 570055 - DNA, 22 bp, Homo sapiens
atctgtctggaggggagctctg

SEQ ID NO: 570056 - DNA, 23 bp, Homo sapiens
atctgtgccttttttatatcttg

SEQ ID NO: 570057 - DNA, 12 bp, Homo sapiens
atctgttgtaat

SEQ ID NO: 570058 - DNA, 14 bp, Homo sapiens
atctgttgtaatat

SEQ ID NO: 570059 - DNA, 22 bp, Homo sapiens
atctgttgtaatatcagttaca

SEQ ID NO: 570060 - DNA, 16 bp, Homo sapiens
atctgtttgcttctaa

SEQ ID NO: 570061 - DNA, 15 bp, Homo sapiens
atcttagctggatat

SEQ ID NO: 570062 - DNA, 16 bp, Homo sapiens
atcttagctggatata

SEQ ID NO: 570063 - DNA, 22 bp, Homo sapiens
atcttagctggatataatgtat

SEQ ID NO: 570064 - DNA, 22 bp, Homo sapiens
atcttcatatctatcagagtat

SEQ ID NO: 570065 - DNA, 15 bp, Homo sapiens
atcttcctctgctaa

SEQ ID NO: 570066 - DNA, 19 bp, Homo sapiens
atcttcctctgctaaattg

SEQ ID NO: 570067 - DNA, 22 bp, Homo sapiens
atcttcctggtcgaaagttagt

SEQ ID NO: 570068 - DNA, 20 bp, Homo sapiens
atcttctcatcttttatcta

SEQ ID NO: 570069 - DNA, 23 bp, Homo sapiens
atcttcttttgggaggatttgat

SEQ ID NO: 570070 - DNA, 19 bp, Homo sapiens
atcttggccctgttaaggc

SEQ ID NO: 570071 - DNA, 16 bp, Homo sapiens
atctttagaaaaggca

SEQ ID NO: 570072 - DNA, 23 bp, Homo sapiens
atctttatacagattttctagaa

SEQ ID NO: 570073 - DNA, 21 bp, Homo sapiens
atctttctttccatttacagt

SEQ ID NO: 570074 - DNA, 19 bp, Homo sapiens
atctttttaacctctgttc

SEQ ID NO: 570075 - DNA, 15 bp, Homo sapiens
atgaaaattgtgtta

SEQ ID NO: 570076 - DNA, 16 bp, Homo sapiens
atgaaagctgtttcat

SEQ ID NO: 570077 - DNA, 18 bp, Homo sapiens
atgaaagctgtttcattt

SEQ ID NO: 570078 - DNA, 16 bp, Homo sapiens
atgaaagtcagtttaa

SEQ ID NO: 570079 - DNA, 12 bp, Homo sapiens
atgaaatgtttt

SEQ ID NO: 570080 - DNA, 15 bp, Homo sapiens
atgaaatttaagcac

SEQ ID NO: 570081 - DNA, 18 bp, Homo sapiens
atgaaatttaagcacaaa

SEQ ID NO: 570082 - DNA, 13 bp, Homo sapiens
atgaacacaaatt

SEQ ID NO: 570083 - DNA, 22 bp, Homo sapiens
atgaacagctctgagatcctgg

SEQ ID NO: 570084 - DNA, 15 bp, Homo sapiens
atgaagaaatttatg

SEQ ID NO: 570085 - DNA, 15 bp, Homo sapiens
atgaagcagatttat

SEQ ID NO: 570086 - DNA, 21 bp, Homo sapiens
atgaagccctaagtaaatcta

SEQ ID NO: 570087 - DNA, 20 bp, Homo sapiens
atgaatacgtaaactgcgta

SEQ ID NO: 570088 - DNA, 12 bp, Homo sapiens
atgaatagacat

SEQ ID NO: 570089 - DNA, 18 bp, Homo sapiens
atgaatagacataaattg

SEQ ID NO: 570090 - DNA, 12 bp, Homo sapiens
atgaatggtctg

SEQ ID NO: 570091 - DNA, 18 bp, Homo sapiens
atgaatggtctggcaata

SEQ ID NO: 570092 - DNA, 20 bp, Homo sapiens
atgaccataaaattagacat

SEQ ID NO: 570093 - DNA, 11 bp, Homo sapiens
atgaccctgga

SEQ ID NO: 570094 - DNA, 22 bp, Homo sapiens
atgacctcaccatttttgttct

SEQ ID NO: 570095 - DNA, 18 bp, Homo sapiens
atgaccttgtaatgtaac

SEQ ID NO: 570096 - DNA, 13 bp, Homo sapiens
atgaccttttgga

SEQ ID NO: 570097 - DNA, 23 bp, Homo sapiens
atgacgtgggtttgatttctaag

SEQ ID NO: 570098 - DNA, 15 bp, Homo sapiens
atgagactgtttatt

SEQ ID NO: 570099 - DNA, 20 bp, Homo sapiens
atgagaggggagagctgaac

SEQ ID NO: 570100 - DNA, 19 bp, Homo sapiens
atgagagttccttctcact

SEQ ID NO: 570101 - DNA, 12 bp, Homo sapiens
atgagattggaa

SEQ ID NO: 570102 - DNA, 15 bp, Homo sapiens
atgaggatgtatgtg

SEQ ID NO: 570103 - DNA, 16 bp, Homo sapiens
atgaggatgtatgtgt

SEQ ID NO: 570104 - DNA, 20 bp, Homo sapiens
atgaggcacgcctgccttct

SEQ ID NO: 570105 - DNA, 17 bp, Homo sapiens
atgagggcgtgaaacac

SEQ ID NO: 570106 - DNA, 18 bp, Homo sapiens
atgagggcgtgaaacaca

SEQ ID NO: 570107 - DNA, 16 bp, Homo sapiens
atgaggggaaagggag

SEQ ID NO: 570108 - DNA, 14 bp, Homo sapiens
atgagtatacaata

SEQ ID NO: 570109 - DNA, 20 bp, Homo sapiens
atgagtttccagctaagcct

SEQ ID NO: 570110 - DNA, 20 bp, Homo sapiens
atgataaaatcccattgtat

SEQ ID NO: 570111 - DNA, 14 bp, Homo sapiens
atgatatccctgat

SEQ ID NO: 570112 - DNA, 16 bp, Homo sapiens
atgatatgtctttaaa

SEQ ID NO: 570113 - DNA, 22 bp, Homo sapiens
atgatattccccatttcctgta

SEQ ID NO: 570114 - DNA, 15 bp, Homo sapiens
atgatctgtgccttt

SEQ ID NO: 570115 - DNA, 19 bp, Homo sapiens
atgatctgtgcctttttta

SEQ ID NO: 570116 - DNA, 16 bp, Homo sapiens
atgatgctctttccca

SEQ ID NO: 570117 - DNA, 13 bp, Homo sapiens
atgatgttctgaa

SEQ ID NO: 570118 - DNA, 19 bp, Homo sapiens
atgatgtttttaaaatctt

SEQ ID NO: 570119 - DNA, 22 bp, Homo sapiens
atgatgtttttaaaatcttatt

SEQ ID NO: 570120 - DNA, 22 bp, Homo sapiens
atgattaagtgcttgaggccaa

SEQ ID NO: 570121 - DNA, 15 bp, Homo sapiens
atgattaatacctga

SEQ ID NO: 570122 - DNA, 18 bp, Homo sapiens
atgattcacttttattgt

SEQ ID NO: 570123 - DNA, 21 bp, Homo sapiens
atgattgagagcagcctcttg

SEQ ID NO: 570124 - DNA, 15 bp, Homo sapiens
atgatttcacaaata

SEQ ID NO: 570125 - DNA, 16 bp, Homo sapiens
atgatttcacaaatat

SEQ ID NO: 570126 - DNA, 17 bp, Homo sapiens
atgattttttaaaagaa

SEQ ID NO: 570127 - DNA, 20 bp, Homo sapiens
atgattttttaaaagaaatt

SEQ ID NO: 570128 - DNA, 22 bp, Homo sapiens
atgattttttaaaagaaattta

SEQ ID NO: 570129 - DNA, 16 bp, Homo sapiens
atgcaagcagtttcaa

SEQ ID NO: 570130 - DNA, 22 bp, Homo sapiens
atgcaagcagtttcaataaagt

SEQ ID NO: 570131 - DNA, 23 bp, Homo sapiens
atgcaagcagtttcaataaagtt

SEQ ID NO: 570132 - DNA, 15 bp, Homo sapiens
atgcaatccttacaa

SEQ ID NO: 570133 - DNA, 16 bp, Homo sapiens
atgcaatccttacaaa

SEQ ID NO: 570134 - DNA, 17 bp, Homo sapiens
atgcaatccttacaaat

SEQ ID NO: 570135 - DNA, 18 bp, Homo sapiens
atgcaatccttacaaatg

SEQ ID NO: 570136 - DNA, 14 bp, Homo sapiens
atgttcttccagtt

SEQ ID NO: 570137 - DNA, 18 bp, Homo sapiens
atgttcttgagcagctga

SEQ ID NO: 570138 - DNA, 22 bp, Homo sapiens
atgttgatgcaatccttacaaa

SEQ ID NO: 570139 - DNA, 12 bp, Homo sapiens
atgttgatttct

SEQ ID NO: 570140 - DNA, 23 bp, Homo sapiens
atgtttaaaatggcatttagcac

SEQ ID NO: 570141 - DNA, 22 bp, Homo sapiens
atgtttaaagtaattgttccag

SEQ ID NO: 570142 - DNA, 14 bp, Homo sapiens
atgtttaagcagaa

SEQ ID NO: 570143 - DNA, 14 bp, Homo sapiens
atgtttacacaatt

SEQ ID NO: 570144 - DNA, 21 bp, Homo sapiens
atgtttaggttactaaaacag

SEQ ID NO: 570145 - DNA, 15 bp, Homo sapiens
atgtttatacacaca

SEQ ID NO: 570146 - DNA, 22 bp, Homo sapiens
atgtttccaggcatgaccctgg

SEQ ID NO: 570147 - DNA, 15 bp, Homo sapiens
atgttttaaggcttc

SEQ ID NO: 570148 - DNA, 12 bp, Homo sapiens
atgttttcagct

SEQ ID NO: 570149 - DNA, 23 bp, Homo sapiens
atgttttggtccacttttccagt

SEQ ID NO: 570150 - DNA, 17 bp, Homo sapiens
atgttttgtaaactttg

SEQ ID NO: 570151 - DNA, 20 bp, Homo sapiens
atgttttgtaaactttgaaa

SEQ ID NO: 570152 - DNA, 14 bp, Homo sapiens
atgtttttaaaatc

SEQ ID NO: 570153 - DNA, 20 bp, Homo sapiens
attaaaaacatttttttaag

SEQ ID NO: 570154 - DNA, 12 bp, Homo sapiens
attaaaaagtct

SEQ ID NO: 570155 - DNA, 15 bp, Homo sapiens
attaaaaagtctttt

SEQ ID NO: 570156 - DNA, 13 bp, Homo sapiens
attaaaaagttaa

SEQ ID NO: 570157 - DNA, 14 bp, Homo sapiens
attaaaatatgcac

SEQ ID NO: 570158 - DNA, 20 bp, Homo sapiens
attaaaatatgcactaagtc

SEQ ID NO: 570159 - DNA, 11 bp, Homo sapiens
attaaaattta

SEQ ID NO: 570160 - DNA, 15 bp, Homo sapiens
attaaagaaagtcat

SEQ ID NO: 570161 - DNA, 15 bp, Homo sapiens
attaaagtttcaaaa

SEQ ID NO: 570162 - DNA, 16 bp, Homo sapiens
attaaagtttcaaaaa

SEQ ID NO: 570163 - DNA, 19 bp, Homo sapiens
attaaagtttcaaaaatct

SEQ ID NO: 570164 - DNA, 21 bp, Homo sapiens
attaaagtttcaaaaatctga

SEQ ID NO: 570165 - DNA, 23 bp, Homo sapiens
attaaagtttcaaaaatctgaag

SEQ ID NO: 570166 - DNA, 13 bp, Homo sapiens
attaaatgaaata

SEQ ID NO: 570167 - DNA, 14 bp, Homo sapiens
attaaatgaaatac

SEQ ID NO: 570168 - DNA, 15 bp, Homo sapiens
attaaatgaaatact

SEQ ID NO: 570169 - DNA, 17 bp, Homo sapiens
attaaatgaaatacttg

SEQ ID NO: 570170 - DNA, 16 bp, Homo sapiens
attaatactaaaatat

SEQ ID NO: 570171 - DNA, 20 bp, Homo sapiens
attaatactaaaatatgtct

SEQ ID NO: 570172 - DNA, 15 bp, Homo sapiens
attaatggtctaaaa

SEQ ID NO: 570173 - DNA, 21 bp, Homo sapiens
attaatgtgtaaaattggatt

SEQ ID NO: 570174 - DNA, 14 bp, Homo sapiens
attaatgttgattt

SEQ ID NO: 570175 - DNA, 16 bp, Homo sapiens
attaatgttgatttct

SEQ ID NO: 570176 - DNA, 17 bp, Homo sapiens
attaatgttgatttcta

SEQ ID NO: 570177 - DNA, 12 bp, Homo sapiens
attacaatggaa

SEQ ID NO: 570178 - DNA, 17 bp, Homo sapiens
attacaatggaaacaat

SEQ ID NO: 570179 - DNA, 22 bp, Homo sapiens
attaccaccatcccgtgctttt

SEQ ID NO: 570180 - DNA, 23 bp, Homo sapiens
attaccagattcacttctgaatt

SEQ ID NO: 570181 - DNA, 16 bp, Homo sapiens
attacccttctttcca

SEQ ID NO: 570182 - DNA, 16 bp, Homo sapiens
attacctgaaagccct

SEQ ID NO: 570183 - DNA, 16 bp, Homo sapiens
attacctgtagctttg

SEQ ID NO: 570184 - DNA, 15 bp, Homo sapiens
attacggctcctctc

SEQ ID NO: 570185 - DNA, 16 bp, Homo sapiens
attacggctcctctct

SEQ ID NO: 570186 - DNA, 12 bp, Homo sapiens
attactaacttc

SEQ ID NO: 570187 - DNA, 22 bp, Homo sapiens
attactacaaaaccgtttagtc

SEQ ID NO: 570188 - DNA, 17 bp, Homo sapiens
attactgtttaagacac

SEQ ID NO: 570189 - DNA, 20 bp, Homo sapiens
attacttgttgcaaaggtct

SEQ ID NO: 570190 - DNA, 12 bp, Homo sapiens
attagaaaactt

SEQ ID NO: 570191 - DNA, 18 bp, Homo sapiens
attagaaaactttgttag

SEQ ID NO: 570192 - DNA, 15 bp, Homo sapiens
attagacttctgttt

SEQ ID NO: 570193 - DNA, 16 bp, Homo sapiens
attagaggggaaaagc

SEQ ID NO: 570194 - DNA, 20 bp, Homo sapiens
attagattttaaaacttcat

SEQ ID NO: 570195 - DNA, 17 bp, Homo sapiens
attagcaaaaaaagttg

SEQ ID NO: 570196 - DNA, 21 bp, Homo sapiens
attagcaaaaaaagttgtatg

SEQ ID NO: 570197 - DNA, 22 bp, Homo sapiens
attagcaaaaaaagttgtatga

SEQ ID NO: 570198 - DNA, 20 bp, Homo sapiens
attagcgacaacagattgga

SEQ ID NO: 570199 - DNA, 22 bp, Homo sapiens
attagctgtgatttttgttgat

SEQ ID NO: 570200 - DNA, 21 bp, Homo sapiens
attaggaggctcaacaataaa

SEQ ID NO: 570201 - DNA, 22 bp, Homo sapiens
attaggaggctcaacaataaaa

SEQ ID NO: 570202 - DNA, 15 bp, Homo sapiens
attagtactttatag

SEQ ID NO: 570203 - DNA, 18 bp, Homo sapiens
attagtactttatagaag

SEQ ID NO: 570204 - DNA, 21 bp, Homo sapiens
attagtactttatagaagaat

SEQ ID NO: 570205 - DNA, 17 bp, Homo sapiens
attataaactcattttg

SEQ ID NO: 570206 - DNA, 18 bp, Homo sapiens
attataatcaaagctcat

SEQ ID NO: 570207 - DNA, 15 bp, Homo sapiens
attatacctgttgct

SEQ ID NO: 570208 - DNA, 12 bp, Homo sapiens
attatcattgtt

SEQ ID NO: 570209 - DNA, 13 bp, Homo sapiens
attatcattgttt

SEQ ID NO: 570210 - DNA, 16 bp, Homo sapiens
attatcattgtttgtc

SEQ ID NO: 570211 - DNA, 16 bp, Homo sapiens
attatgccttgagaat

SEQ ID NO: 570212 - DNA, 16 bp, Homo sapiens
attatgctaagaattt

SEQ ID NO: 570213 - DNA, 14 bp, Homo sapiens
attatggaaatcca

SEQ ID NO: 570214 - DNA, 21 bp, Homo sapiens
attatggctttgtgcttgttc

SEQ ID NO: 570215 - DNA, 13 bp, Homo sapiens
attatgtgtgcat

SEQ ID NO: 570216 - DNA, 21 bp, Homo sapiens
attatgtgtgcatgtgtgtat

SEQ ID NO: 570217 - DNA, 12 bp, Homo sapiens
attatgttttca

SEQ ID NO: 570218 - DNA, 14 bp, Homo sapiens
attattactacaaa

SEQ ID NO: 570219 - DNA, 18 bp, Homo sapiens
attatttgcacagaagag

SEQ ID NO: 570220 - DNA, 14 bp, Homo sapiens
attattttcattac

SEQ ID NO: 570221 - DNA, 15 bp, Homo sapiens
attattttgtatgga

SEQ ID NO: 570222 - DNA, 20 bp, Homo sapiens
attcaaaccaatttcttcct

SEQ ID NO: 570223 - DNA, 14 bp, Homo sapiens
attcaaagaatcac

SEQ ID NO: 570224 - DNA, 21 bp, Homo sapiens
attcaaagaatcacctaatta

SEQ ID NO: 570225 - DNA, 23 bp, Homo sapiens
attcaaataaccctgaatcagag

SEQ ID NO: 570226 - DNA, 20 bp, Homo sapiens
attcaaatgggtgatatcct

SEQ ID NO: 570227 - DNA, 22 bp, Homo sapiens
attcaagaaagccagtcttaac

SEQ ID NO: 570228 - DNA, 21 bp, Homo sapiens
attcaagaagatagttgtaaa

SEQ ID NO: 570229 - DNA, 18 bp, Homo sapiens
attcaataactattgctg

SEQ ID NO: 570230 - DNA, 22 bp, Homo sapiens
attcaataactattgctgcttt

SEQ ID NO: 570231 - DNA, 13 bp, Homo sapiens
attcacttctgaa

SEQ ID NO: 570232 - DNA, 14 bp, Homo sapiens
attcacttttattg

SEQ ID NO: 570233 - DNA, 17 bp, Homo sapiens
attcacttttattgtat

SEQ ID NO: 570234 - DNA, 14 bp, Homo sapiens
attcagagaatatc

SEQ ID NO: 570235 - DNA, 15 bp, Homo sapiens
attcagataatggta

SEQ ID NO: 570236 - DNA, 16 bp, Homo sapiens
attcagataatggtaa

SEQ ID NO: 570237 - DNA, 19 bp, Homo sapiens
attcagataatggtaattt

SEQ ID NO: 570238 - DNA, 22 bp, Homo sapiens
attcagataatggtaatttagt

SEQ ID NO: 570239 - DNA, 20 bp, Homo sapiens
attcagcaaggcgctaactt

SEQ ID NO: 570240 - DNA, 13 bp, Homo sapiens
attcatattacaa

SEQ ID NO: 570241 - DNA, 18 bp, Homo sapiens
attcatattacaatattt

SEQ ID NO: 570242 - DNA, 19 bp, Homo sapiens
attcatattacaatatttg

SEQ ID NO: 570243 - DNA, 17 bp, Homo sapiens
attcatgcaacttgatt

SEQ ID NO: 570244 - DNA, 11 bp, Homo sapiens
attcattgtgt

SEQ ID NO: 570245 - DNA, 20 bp, Homo sapiens
attcatttcacattaatggt

SEQ ID NO: 570246 - DNA, 18 bp, Homo sapiens
attccaaagatctgaatg

SEQ ID NO: 570247 - DNA, 19 bp, Homo sapiens
attccatattagaaaactt

SEQ ID NO: 570248 - DNA, 23 bp, Homo sapiens
attccatattagaaaactttgtt

SEQ ID NO: 570249 - DNA, 17 bp, Homo sapiens
attcccaactagacatt

SEQ ID NO: 570250 - DNA, 16 bp, Homo sapiens
attcccaggcactctc

SEQ ID NO: 570251 - DNA, 20 bp, Homo sapiens
attcccatggtagactgtga

SEQ ID NO: 570252 - DNA, 22 bp, Homo sapiens
attcccatggtagactgtgaca

SEQ ID NO: 570253 - DNA, 16 bp, Homo sapiens
attccccaccctcccc

SEQ ID NO: 570254 - DNA, 15 bp, Homo sapiens
attccccggagctgg

SEQ ID NO: 570255 - DNA, 14 bp, Homo sapiens
attccctggaattg

SEQ ID NO: 570256 - DNA, 18 bp, Homo sapiens
attcccttcaatgcaaaa

SEQ ID NO: 570257 - DNA, 22 bp, Homo sapiens
attcctatgaagttggcacatt

SEQ ID NO: 570258 - DNA, 18 bp, Homo sapiens
attcctgacctccgccat

SEQ ID NO: 570259 - DNA, 18 bp, Homo sapiens
attcctttggccactgta

SEQ ID NO: 570260 - DNA, 19 bp, Homo sapiens
attcctttggccactgtat

SEQ ID NO: 570261 - DNA, 21 bp, Homo sapiens
attcctttggccactgtattt

SEQ ID NO: 570262 - DNA, 22 bp, Homo sapiens
attcctttggccactgtatttg

SEQ ID NO: 570263 - DNA, 14 bp, Homo sapiens
attcgagctatatt

SEQ ID NO: 570264 - DNA, 20 bp, Homo sapiens
attcgagctatatttaagta

SEQ ID NO: 570265 - DNA, 17 bp, Homo sapiens
attcgtgaatagtcttt

SEQ ID NO: 570266 - DNA, 13 bp, Homo sapiens
attctaatggtaa

SEQ ID NO: 570267 - DNA, 14 bp, Homo sapiens
attctaatggtaac

SEQ ID NO: 570268 - DNA, 16 bp, Homo sapiens
attctaatggtaactt

SEQ ID NO: 570269 - DNA, 13 bp, Homo sapiens
attctatgtaact

SEQ ID NO: 570270 - DNA, 15 bp, Homo sapiens
attctatgtaacttg

SEQ ID NO: 570271 - DNA, 17 bp, Homo sapiens
attctatgtaacttgtt

SEQ ID NO: 570272 - DNA, 15 bp, Homo sapiens
attctcaccagctgt

SEQ ID NO: 570273 - DNA, 21 bp, Homo sapiens
caacagattggattttatgtt

SEQ ID NO: 570274 - DNA, 21 bp, Homo sapiens
caacagcccaggcatctcctt

SEQ ID NO: 570275 - DNA, 23 bp, Homo sapiens
caacagcccaggcatctccttgg

SEQ ID NO: 570276 - DNA, 18 bp, Homo sapiens
caacagctggacaccccc

SEQ ID NO: 570277 - DNA, 13 bp, Homo sapiens
caacataatgaaa

SEQ ID NO: 570278 - DNA, 13 bp, Homo sapiens
caacatacaattt

SEQ ID NO: 570279 - DNA, 21 bp, Homo sapiens
caacatccatgtcctatgtgt

SEQ ID NO: 570280 - DNA, 20 bp, Homo sapiens
caacatgcctgctttagaat

SEQ ID NO: 570281 - DNA, 12 bp, Homo sapiens
caacatgtgtga

SEQ ID NO: 570282 - DNA, 20 bp, Homo sapiens
caaccacacttgtcggctcc

SEQ ID NO: 570283 - DNA, 16 bp, Homo sapiens
caacccaaacctggag

SEQ ID NO: 570284 - DNA, 17 bp, Homo sapiens
caacccaaacctggaga

SEQ ID NO: 570285 - DNA, 13 bp, Homo sapiens
caaccctgcccag

SEQ ID NO: 570286 - DNA, 19 bp, Homo sapiens
caacctcccctggtcctgc

SEQ ID NO: 570287 - DNA, 20 bp, Homo sapiens
caacctcccctggtcctgca

SEQ ID NO: 570288 - DNA, 23 bp, Homo sapiens
caacctgttcacgtgactcctca

SEQ ID NO: 570289 - DNA, 22 bp, Homo sapiens
caacggaagccccctcttcctc

SEQ ID NO: 570290 - DNA, 15 bp, Homo sapiens
caactagacattacc

SEQ ID NO: 570291 - DNA, 18 bp, Homo sapiens
caactcagagcacagcca

SEQ ID NO: 570292 - DNA, 11 bp, Homo sapiens
caactggatgt

SEQ ID NO: 570293 - DNA, 19 bp, Homo sapiens
caacttagtgtctctattt

SEQ ID NO: 570294 - DNA, 24 bp, Homo sapiens
caacttgaaattatatctgtggtc

SEQ ID NO: 570295 - DNA, 15 bp, Homo sapiens
caagaaaaaataaat

SEQ ID NO: 570296 - DNA, 17 bp, Homo sapiens
caagaaaaaataaatgg

SEQ ID NO: 570297 - DNA, 16 bp, Homo sapiens
caagaaagccagtctt

SEQ ID NO: 570298 - DNA, 19 bp, Homo sapiens
caagaaagccagtcttaac

SEQ ID NO: 570299 - DNA, 22 bp, Homo sapiens
caagaataaaggcagctgttgt

SEQ ID NO: 570300 - DNA, 15 bp, Homo sapiens
caagaccaaagagcc

SEQ ID NO: 570301 - DNA, 12 bp, Homo sapiens
caagcagaaaaa

SEQ ID NO: 570302 - DNA, 16 bp, Homo sapiens
caagcagacacacaca

SEQ ID NO: 570303 - DNA, 13 bp, Homo sapiens
caagcagtttcaa

SEQ ID NO: 570304 - DNA, 15 bp, Homo sapiens
caagcagtttcaata

SEQ ID NO: 570305 - DNA, 21 bp, Homo sapiens
caagcagtttcaataaagttt

SEQ ID NO: 570306 - DNA, 21 bp, Homo sapiens
caagcccagcctatctctctt

SEQ ID NO: 570307 - DNA, 18 bp, Homo sapiens
caagctataaaagcccat

SEQ ID NO: 570308 - DNA, 14 bp, Homo sapiens
caagctcacttgct

SEQ ID NO: 570309 - DNA, 23 bp, Homo sapiens
caagctgatgaagttaagcacaa

SEQ ID NO: 570310 - DNA, 21 bp, Homo sapiens
caagcttttacaacagtgctg

SEQ ID NO: 570311 - DNA, 22 bp, Homo sapiens
caaggaatgaattttttcctac

SEQ ID NO: 570312 - DNA, 15 bp, Homo sapiens
caaggacgcttcaca

SEQ ID NO: 570313 - DNA, 14 bp, Homo sapiens
caaggcaaaaacaa

SEQ ID NO: 570314 - DNA, 15 bp, Homo sapiens
caaggcaaaaacaaa

SEQ ID NO: 570315 - DNA, 16 bp, Homo sapiens
caaggcaatgatatgg

SEQ ID NO: 570316 - DNA, 20 bp, Homo sapiens
caaggccccctgcctgccct

SEQ ID NO: 570317 - DNA, 15 bp, Homo sapiens
caaggcgctaacttg

SEQ ID NO: 570318 - DNA, 15 bp, Homo sapiens
caaggcttgctgcag

SEQ ID NO: 570319 - DNA, 21 bp, Homo sapiens
caagggctttcctgtgccagg

SEQ ID NO: 570320 - DNA, 18 bp, Homo sapiens
caaggtagaatgaccttg

SEQ ID NO: 570321 - DNA, 20 bp, Homo sapiens
caaggtagaatgaccttgta

SEQ ID NO: 570322 - DNA, 15 bp, Homo sapiens
caaggtgcaggcagg

SEQ ID NO: 570323 - DNA, 18 bp, Homo sapiens
caagtatcatctaaatat

SEQ ID NO: 570324 - DNA, 15 bp, Homo sapiens
caagtcacagaaaat

SEQ ID NO: 570325 - DNA, 15 bp, Homo sapiens
caagtctagtggaac

SEQ ID NO: 570326 - DNA, 20 bp, Homo sapiens
caagtgaatgagtttccagc

SEQ ID NO: 570327 - DNA, 22 bp, Homo sapiens
caagttggtcttactttgttaa

SEQ ID NO: 570328 - DNA, 19 bp, Homo sapiens
caagttttgtgaaattttt

SEQ ID NO: 570329 - DNA, 12 bp, Homo sapiens
caataaaacatt

SEQ ID NO: 570330 - DNA, 21 bp, Homo sapiens
caataaaggaggaatcagacc

SEQ ID NO: 570331 - DNA, 23 bp, Homo sapiens
caataaagtttgatcttcctctg

SEQ ID NO: 570332 - DNA, 13 bp, Homo sapiens
caataagaaacag

SEQ ID NO: 570333 - DNA, 15 bp, Homo sapiens
caataagaaacagtt

SEQ ID NO: 570334 - DNA, 20 bp, Homo sapiens
caataagaaacagtttaaca

SEQ ID NO: 570335 - DNA, 18 bp, Homo sapiens
caatatataaaaatatat

SEQ ID NO: 570336 - DNA, 20 bp, Homo sapiens
caatatataaaaatatatat

SEQ ID NO: 570337 - DNA, 15 bp, Homo sapiens
caatatattttgtat

SEQ ID NO: 570338 - DNA, 22 bp, Homo sapiens
caatatattttgtatgcaagca

SEQ ID NO: 570339 - DNA, 18 bp, Homo sapiens
caatattctctgtacata

SEQ ID NO: 570340 - DNA, 16 bp, Homo sapiens
caatattctgtaacta

SEQ ID NO: 570341 - DNA, 23 bp, Homo sapiens
caatatttgtgtgctaaacgtgt

SEQ ID NO: 570342 - DNA, 21 bp, Homo sapiens
caatcagtagcttaagaaaaa

SEQ ID NO: 570343 - DNA, 18 bp, Homo sapiens
caatcatgaacagctctg

SEQ ID NO: 570344 - DNA, 23 bp, Homo sapiens
caatcatgaacagctctgagatc

SEQ ID NO: 570345 - DNA, 16 bp, Homo sapiens
caatccatcagtgcca

SEQ ID NO: 570346 - DNA, 19 bp, Homo sapiens
caatccccataatgcttct

SEQ ID NO: 570347 - DNA, 15 bp, Homo sapiens
caatccttacaaatg

SEQ ID NO: 570348 - DNA, 17 bp, Homo sapiens
caatccttacaaatgat

SEQ ID NO: 570349 - DNA, 20 bp, Homo sapiens
caatccttacaaatgattgc

SEQ ID NO: 570350 - DNA, 14 bp, Homo sapiens
caatcgggagtagc

SEQ ID NO: 570351 - DNA, 19 bp, Homo sapiens
caatcgggagtagcaagga

SEQ ID NO: 570352 - DNA, 21 bp, Homo sapiens
caatctcgtatagaagtcttc

SEQ ID NO: 570353 - DNA, 12 bp, Homo sapiens
caatgaatgtat

SEQ ID NO: 570354 - DNA, 13 bp, Homo sapiens
caatgcacatcca

SEQ ID NO: 570355 - DNA, 14 bp, Homo sapiens
caatgcacatccat

SEQ ID NO: 570356 - DNA, 14 bp, Homo sapiens
caatgtcttcccac

SEQ ID NO: 570357 - DNA, 14 bp, Homo sapiens
caatgtttgatgtc

SEQ ID NO: 570358 - DNA, 22 bp, Homo sapiens
caatgtttgatgtccccaaagt

SEQ ID NO: 570359 - DNA, 23 bp, Homo sapiens
caatgtttgatgtccccaaagta

SEQ ID NO: 570360 - DNA, 12 bp, Homo sapiens
caattacagagg

SEQ ID NO: 570361 - DNA, 15 bp, Homo sapiens
caattcactttagag

SEQ ID NO: 570362 - DNA, 16 bp, Homo sapiens
caattcatagaataac

SEQ ID NO: 570363 - DNA, 22 bp, Homo sapiens
caattccgtcttcttaatctga

SEQ ID NO: 570364 - DNA, 16 bp, Homo sapiens
caattctaatggtaac

SEQ ID NO: 570365 - DNA, 15 bp, Homo sapiens
caattgtatatatat

SEQ ID NO: 570366 - DNA, 17 bp, Homo sapiens
caattgtatatatatgt

SEQ ID NO: 570367 - DNA, 17 bp, Homo sapiens
caatttacttttaataa

SEQ ID NO: 570368 - DNA, 22 bp, Homo sapiens
caatttattgcacaaaatataa

SEQ ID NO: 570369 - DNA, 12 bp, Homo sapiens
caatttgtcttt

SEQ ID NO: 570370 - DNA, 19 bp, Homo sapiens
caatttgttaattcctatg

SEQ ID NO: 570371 - DNA, 22 bp, Homo sapiens
caatttgttaattcctatgaag

SEQ ID NO: 570372 - DNA, 14 bp, Homo sapiens
caattttcagattt

SEQ ID NO: 570373 - DNA, 19 bp, Homo sapiens
caattttcagatttgcaca

SEQ ID NO: 570374 - DNA, 15 bp, Homo sapiens
cacaaacatagacag

SEQ ID NO: 570375 - DNA, 18 bp, Homo sapiens
cacaaagctatttaagtg

SEQ ID NO: 570376 - DNA, 20 bp, Homo sapiens
cacaaattatgctaagaatt

SEQ ID NO: 570377 - DNA, 17 bp, Homo sapiens
cacaagcagacacacac

SEQ ID NO: 570378 - DNA, 15 bp, Homo sapiens
cacaatgaatgtata

SEQ ID NO: 570379 - DNA, 14 bp, Homo sapiens
cacaatgtcttggt

SEQ ID NO: 570380 - DNA, 19 bp, Homo sapiens
cacaattaattcatccctt

SEQ ID NO: 570381 - DNA, 11 bp, Homo sapiens
cacacacacaa

SEQ ID NO: 570382 - DNA, 12 bp, Homo sapiens
cacacacacaca

SEQ ID NO: 570383 - DNA, 14 bp, Homo sapiens
cacacacacacaca

SEQ ID NO: 570384 - DNA, 14 bp, Homo sapiens
cacacacacacata

SEQ ID NO: 570385 - DNA, 15 bp, Homo sapiens
cacacacacacatat

SEQ ID NO: 570386 - DNA, 15 bp, Homo sapiens
cacacacacacgcag

SEQ ID NO: 570387 - DNA, 12 bp, Homo sapiens
cacacacacata

SEQ ID NO: 570388 - DNA, 14 bp, Homo sapiens
cacacacatatata

SEQ ID NO: 570389 - DNA, 14 bp, Homo sapiens
cacacacgcagaca

SEQ ID NO: 570390 - DNA, 16 bp, Homo sapiens
cacacacgcagacaca

SEQ ID NO: 570391 - DNA, 16 bp, Homo sapiens
cacacagaaatatata

SEQ ID NO: 570392 - DNA, 18 bp, Homo sapiens
cacacagaaatatatata

SEQ ID NO: 570393 - DNA, 18 bp, Homo sapiens
cacacaggcccatgccct

SEQ ID NO: 570394 - DNA, 12 bp, Homo sapiens
cacacatatata

SEQ ID NO: 570395 - DNA, 15 bp, Homo sapiens
cacacatcatctgta

SEQ ID NO: 570396 - DNA, 22 bp, Homo sapiens
cacacatcatctgtaagctgtt

SEQ ID NO: 570397 - DNA, 22 bp, Homo sapiens
cacacatttcactgtctgtctg

SEQ ID NO: 570398 - DNA, 15 bp, Homo sapiens
cacaccctacagcag

SEQ ID NO: 570399 - DNA, 18 bp, Homo sapiens
cacaccctacagcagatc

SEQ ID NO: 570400 - DNA, 13 bp, Homo sapiens
cacacctggccct

SEQ ID NO: 570401 - DNA, 13 bp, Homo sapiens
cacacgcacgcac

SEQ ID NO: 570402 - DNA, 17 bp, Homo sapiens
cacacgcacgcacacac

SEQ ID NO: 570403 - DNA, 14 bp, Homo sapiens
cacacgctgcacct

SEQ ID NO: 570404 - DNA, 18 bp, Homo sapiens
cacacttgtcggctccag

SEQ ID NO: 570405 - DNA, 22 bp, Homo sapiens
cacacttgtcggctccagtccc

SEQ ID NO: 570406 - DNA, 23 bp, Homo sapiens
cacacttgtcggctccagtcccc

SEQ ID NO: 570407 - DNA, 18 bp, Homo sapiens
cacagaaatatatataca

SEQ ID NO: 570408 - DNA, 19 bp, Homo sapiens
cacagaaatatatatacat

SEQ ID NO: 570409 - DNA, 16 bp, Homo sapiens
cacagacaattctaat

SEQ ID NO: 570410 - DNA, 18 bp, Homo sapiens
cagccagaactctgtgtc

SEQ ID NO: 570411 - DNA, 20 bp, Homo sapiens
cagccataggccctttcagt

SEQ ID NO: 570412 - DNA, 20 bp, Homo sapiens
cagccccagacaacagccca

SEQ ID NO: 570413 - DNA, 16 bp, Homo sapiens
cagccccccagtgtcc

SEQ ID NO: 570414 - DNA, 21 bp, Homo sapiens
cagcccctccctcctctgaga

SEQ ID NO: 570415 - DNA, 12 bp, Homo sapiens
cagcccctgggg

SEQ ID NO: 570416 - DNA, 22 bp, Homo sapiens
cagcccctggggtacttctgtg

SEQ ID NO: 570417 - DNA, 21 bp, Homo sapiens
cagccggcgtggcaaatataa

SEQ ID NO: 570418 - DNA, 22 bp, Homo sapiens
cagccgtcccaaccctgcccag

SEQ ID NO: 570419 - DNA, 22 bp, Homo sapiens
cagcctactagggacctgggga

SEQ ID NO: 570420 - DNA, 21 bp, Homo sapiens
cagcctctgggcccacatccg

SEQ ID NO: 570421 - DNA, 15 bp, Homo sapiens
cagcctctttccctt

SEQ ID NO: 570422 - DNA, 18 bp, Homo sapiens
cagcctctttcccttcca

SEQ ID NO: 570423 - DNA, 18 bp, Homo sapiens
cagcctgccttgcccact

SEQ ID NO: 570424 - DNA, 20 bp, Homo sapiens
cagcctggaaacctgtctga

SEQ ID NO: 570425 - DNA, 18 bp, Homo sapiens
cagcctggccaacatggt

SEQ ID NO: 570426 - DNA, 14 bp, Homo sapiens
cagcctggtcgcct

SEQ ID NO: 570427 - DNA, 23 bp, Homo sapiens
cagcctggtcgccttccacctct

SEQ ID NO: 570428 - DNA, 21 bp, Homo sapiens
cagccttaaacagtgtccagg

SEQ ID NO: 570429 - DNA, 19 bp, Homo sapiens
cagccttagctctcccaac

SEQ ID NO: 570430 - DNA, 15 bp, Homo sapiens
cagcggcagcagcag

SEQ ID NO: 570431 - DNA, 18 bp, Homo sapiens
cagctaagcctgatgatg

SEQ ID NO: 570432 - DNA, 19 bp, Homo sapiens
cagctacaggggaggctga

SEQ ID NO: 570433 - DNA, 23 bp, Homo sapiens
cagctagaaagagaaaaagccct

SEQ ID NO: 570434 - DNA, 18 bp, Homo sapiens
cagctaggaacaaatctt

SEQ ID NO: 570435 - DNA, 20 bp, Homo sapiens
cagctaggaacaaatcttcc

SEQ ID NO: 570436 - DNA, 22 bp, Homo sapiens
cagctatggacaatttaccaca

SEQ ID NO: 570437 - DNA, 12 bp, Homo sapiens
cagctcagtgag

SEQ ID NO: 570438 - DNA, 20 bp, Homo sapiens
cagctcccgctccgggctcc

SEQ ID NO: 570439 - DNA, 21 bp, Homo sapiens
cagctccctgaatctgaccac

SEQ ID NO: 570440 - DNA, 12 bp, Homo sapiens
cagctcccttct

SEQ ID NO: 570441 - DNA, 13 bp, Homo sapiens
cagctcccttctg

SEQ ID NO: 570442 - DNA, 15 bp, Homo sapiens
cagctcccttctgtt

SEQ ID NO: 570443 - DNA, 15 bp, Homo sapiens
cagctctcatgctgc

SEQ ID NO: 570444 - DNA, 18 bp, Homo sapiens
cagctctcccctgcgcag

SEQ ID NO: 570445 - DNA, 21 bp, Homo sapiens
cagctctcccctgcgcaggcc

SEQ ID NO: 570446 - DNA, 18 bp, Homo sapiens
cagctctctgtataaaca

SEQ ID NO: 570447 - DNA, 16 bp, Homo sapiens
cagctgagccttctga

SEQ ID NO: 570448 - DNA, 13 bp, Homo sapiens
cagctgcccctcc

SEQ ID NO: 570449 - DNA, 15 bp, Homo sapiens
cagctgcccctccct

SEQ ID NO: 570450 - DNA, 19 bp, Homo sapiens
cagctgcccctccctgcca

SEQ ID NO: 570451 - DNA, 14 bp, Homo sapiens
cagctgttgtctct

SEQ ID NO: 570452 - DNA, 22 bp, Homo sapiens
cagctgttgtctcttctcctta

SEQ ID NO: 570453 - DNA, 13 bp, Homo sapiens
cagcttcaccaga

SEQ ID NO: 570454 - DNA, 16 bp, Homo sapiens
cagcttcaccagagca

SEQ ID NO: 570455 - DNA, 18 bp, Homo sapiens
cagcttgatgctgtttct

SEQ ID NO: 570456 - DNA, 15 bp, Homo sapiens
cagctttcctgggtc

SEQ ID NO: 570457 - DNA, 14 bp, Homo sapiens
caggaacacatgca

SEQ ID NO: 570458 - DNA, 15 bp, Homo sapiens
caggaacacatgcac

SEQ ID NO: 570459 - DNA, 20 bp, Homo sapiens
caggaacacatgcacacaca

SEQ ID NO: 570460 - DNA, 15 bp, Homo sapiens
caggaacacccagcc

SEQ ID NO: 570461 - DNA, 16 bp, Homo sapiens
caggaacacccagccc

SEQ ID NO: 570462 - DNA, 19 bp, Homo sapiens
caggaacacccagccccag

SEQ ID NO: 570463 - DNA, 23 bp, Homo sapiens
caggaaccatagttgacagttcc

SEQ ID NO: 570464 - DNA, 19 bp, Homo sapiens
caggaagcctcctgctgag

SEQ ID NO: 570465 - DNA, 22 bp, Homo sapiens
caggaagcctcctgctgagtgg

SEQ ID NO: 570466 - DNA, 14 bp, Homo sapiens
caggaaggaaacag

SEQ ID NO: 570467 - DNA, 20 bp, Homo sapiens
caggaagtccctgagaagcc

SEQ ID NO: 570468 - DNA, 21 bp, Homo sapiens
caggaagtccctgagaagcct

SEQ ID NO: 570469 - DNA, 21 bp, Homo sapiens
caggaatatgcatcccacagc

SEQ ID NO: 570470 - DNA, 23 bp, Homo sapiens
caggaatatgcatcccacagcca

SEQ ID NO: 570471 - DNA, 18 bp, Homo sapiens
caggaatcaaaaattgaa

SEQ ID NO: 570472 - DNA, 15 bp, Homo sapiens
caggaccccatctgc

SEQ ID NO: 570473 - DNA, 16 bp, Homo sapiens
caggaccccatctgct

SEQ ID NO: 570474 - DNA, 19 bp, Homo sapiens
caggaccccatctgctgag

SEQ ID NO: 570475 - DNA, 23 bp, Homo sapiens
caggaccccatctgctgagctct

SEQ ID NO: 570476 - DNA, 17 bp, Homo sapiens
caggaccctcgctggcc

SEQ ID NO: 570477 - DNA, 18 bp, Homo sapiens
caggaccctcgctggccc

SEQ ID NO: 570478 - DNA, 20 bp, Homo sapiens
caggaccctcgctggccccc

SEQ ID NO: 570479 - DNA, 20 bp, Homo sapiens
caggacgcagggagaccctg

SEQ ID NO: 570480 - DNA, 14 bp, Homo sapiens
caggactctgcctt

SEQ ID NO: 570481 - DNA, 17 bp, Homo sapiens
caggactctgccttcca

SEQ ID NO: 570482 - DNA, 17 bp, Homo sapiens
caggagacactggtctc

SEQ ID NO: 570483 - DNA, 19 bp, Homo sapiens
caggagacactggtctcag

SEQ ID NO: 570484 - DNA, 23 bp, Homo sapiens
caggagacactgtgctataaatc

SEQ ID NO: 570485 - DNA, 16 bp, Homo sapiens
caggagcgctcccttg

SEQ ID NO: 570486 - DNA, 17 bp, Homo sapiens
caggaggagacagtcag

SEQ ID NO: 570487 - DNA, 21 bp, Homo sapiens
caggaggagacagtcaggaag

SEQ ID NO: 570488 - DNA, 22 bp, Homo sapiens
caggaggagacagtcaggaagc

SEQ ID NO: 570489 - DNA, 22 bp, Homo sapiens
caggaggctgggacgctctgct

SEQ ID NO: 570490 - DNA, 23 bp, Homo sapiens
caggaggctgggacgctctgctg

SEQ ID NO: 570491 - DNA, 22 bp, Homo sapiens
caggagtcagtgcccatgtgta

SEQ ID NO: 570492 - DNA, 17 bp, Homo sapiens
caggagtgggtgggaca

SEQ ID NO: 570493 - DNA, 21 bp, Homo sapiens
caggagtgggtgggacacaga

SEQ ID NO: 570494 - DNA, 23 bp, Homo sapiens
caggagtgggtgggacacagaga

SEQ ID NO: 570495 - DNA, 22 bp, Homo sapiens
caggagttcaagaccagcctgg

SEQ ID NO: 570496 - DNA, 19 bp, Homo sapiens
caggatggcgtgtcccctg

SEQ ID NO: 570497 - DNA, 18 bp, Homo sapiens
caggatgggggagagggg

SEQ ID NO: 570498 - DNA, 21 bp, Homo sapiens
caggcaaggggaatctggagg

SEQ ID NO: 570499 - DNA, 12 bp, Homo sapiens
caggcacaggct

SEQ ID NO: 570500 - DNA, 22 bp, Homo sapiens
caggcagagctcagcacagcct

SEQ ID NO: 570501 - DNA, 21 bp, Homo sapiens
caggcaggggccctgcagctc

SEQ ID NO: 570502 - DNA, 22 bp, Homo sapiens
caggcaggggccctgcagctct

SEQ ID NO: 570503 - DNA, 16 bp, Homo sapiens
caggcatctccttggg

SEQ ID NO: 570504 - DNA, 15 bp, Homo sapiens
caggcatgaccctgg

SEQ ID NO: 570505 - DNA, 20 bp, Homo sapiens
caggcatgaccctggagccc

SEQ ID NO: 570506 - DNA, 17 bp, Homo sapiens
caggccaccctgtgcag

SEQ ID NO: 570507 - DNA, 12 bp, Homo sapiens
caggcccacatt

SEQ ID NO: 570508 - DNA, 14 bp, Homo sapiens
caggccgggcagag

SEQ ID NO: 570509 - DNA, 19 bp, Homo sapiens
caggccgtggctgcccaca

SEQ ID NO: 570510 - DNA, 13 bp, Homo sapiens
caggcctccctgc

SEQ ID NO: 570511 - DNA, 20 bp, Homo sapiens
caggcggtatccagaggtga

SEQ ID NO: 570512 - DNA, 16 bp, Homo sapiens
caggcgtagggccagg

SEQ ID NO: 570513 - DNA, 15 bp, Homo sapiens
caggctcccactgcc

SEQ ID NO: 570514 - DNA, 18 bp, Homo sapiens
caggctcccactgcccct

SEQ ID NO: 570515 - DNA, 22 bp, Homo sapiens
caggctcccactgcccctgcac

SEQ ID NO: 570516 - DNA, 13 bp, Homo sapiens
caggctccctccc

SEQ ID NO: 570517 - DNA, 22 bp, Homo sapiens
caggctccctccctcccagatc

SEQ ID NO: 570518 - DNA, 15 bp, Homo sapiens
caggctctctgggct

SEQ ID NO: 570519 - DNA, 15 bp, Homo sapiens
caggctgccccaccc

SEQ ID NO: 570520 - DNA, 14 bp, Homo sapiens
cagggaaccagagc

SEQ ID NO: 570521 - DNA, 18 bp, Homo sapiens
cagggagaccctgggaga

SEQ ID NO: 570522 - DNA, 12 bp, Homo sapiens
cagggagccctg

SEQ ID NO: 570523 - DNA, 22 bp, Homo sapiens
cagggaggtgtgaggcaggaga

SEQ ID NO: 570524 - DNA, 21 bp, Homo sapiens
cagggatgtagattaaggtga

SEQ ID NO: 570525 - DNA, 20 bp, Homo sapiens
cagggatttgtccttgggga

SEQ ID NO: 570526 - DNA, 17 bp, Homo sapiens
cagggcaggcagagctc

SEQ ID NO: 570527 - DNA, 15 bp, Homo sapiens
cagggcatgaaatga

SEQ ID NO: 570528 - DNA, 23 bp, Homo sapiens
cagggcatgaaatgaacacaaat

SEQ ID NO: 570529 - DNA, 19 bp, Homo sapiens
cagggccaaaagcttccct

SEQ ID NO: 570530 - DNA, 15 bp, Homo sapiens
cagggctctggcagg

SEQ ID NO: 570531 - DNA, 16 bp, Homo sapiens
cagggctctggcaggt

SEQ ID NO: 570532 - DNA, 15 bp, Homo sapiens
cagggctggggcagc

SEQ ID NO: 570533 - DNA, 18 bp, Homo sapiens
caggggacacccagaaac

SEQ ID NO: 570534 - DNA, 16 bp, Homo sapiens
caggggaggctgagac

SEQ ID NO: 570535 - DNA, 20 bp, Homo sapiens
caggggcacacttccccttg

SEQ ID NO: 570536 - DNA, 19 bp, Homo sapiens
caggggccctgcagctctc

SEQ ID NO: 570537 - DNA, 17 bp, Homo sapiens
caggggctccatgccag

SEQ ID NO: 570538 - DNA, 19 bp, Homo sapiens
cagggggccaggtgcacag

SEQ ID NO: 570539 - DNA, 17 bp, Homo sapiens
caggggtggaggagagc

SEQ ID NO: 570540 - DNA, 17 bp, Homo sapiens
cagggtctcgtcaggag

SEQ ID NO: 570541 - DNA, 13 bp, Homo sapiens
cagggtgacctgc

SEQ ID NO: 570542 - DNA, 17 bp, Homo sapiens
cagggtgggcaaactct

SEQ ID NO: 570543 - DNA, 23 bp, Homo sapiens
caggtaaactgatgctttcagat

SEQ ID NO: 570544 - DNA, 14 bp, Homo sapiens
caggtaccagttct

SEQ ID NO: 570545 - DNA, 13 bp, Homo sapiens
caggtactttgtc

SEQ ID NO: 570546 - DNA, 23 bp, Homo sapiens
caggtactttgtctaagaaacat

SEQ ID NO: 570547 - DNA, 19 bp, Homo sapiens
caggtagaacgccagggac

SEQ ID NO: 570548 - DNA, 20 bp, Homo sapiens
caggtaggaatattatattt

SEQ ID NO: 570549 - DNA, 22 bp, Homo sapiens
caggtatctgatgatgttctga

SEQ ID NO: 570550 - DNA, 15 bp, Homo sapiens
caggtcctgctcagc

SEQ ID NO: 570551 - DNA, 14 bp, Homo sapiens
caggtgaaggaggc

SEQ ID NO: 570552 - DNA, 19 bp, Homo sapiens
caggtgaaggaggctccag

SEQ ID NO: 570553 - DNA, 14 bp, Homo sapiens
caggtgacagtgag

SEQ ID NO: 570554 - DNA, 16 bp, Homo sapiens
caggtgacagtgaggt

SEQ ID NO: 570555 - DNA, 23 bp, Homo sapiens
caggtgcacagacgtccctccac

SEQ ID NO: 570556 - DNA, 15 bp, Homo sapiens
caggtggccagggct

SEQ ID NO: 570557 - DNA, 15 bp, Homo sapiens
caggttaaatgtttt

SEQ ID NO: 570558 - DNA, 20 bp, Homo sapiens
caggttaaatgttttgtaaa

SEQ ID NO: 570559 - DNA, 15 bp, Homo sapiens
caggttgaagaccta

SEQ ID NO: 570560 - DNA, 17 bp, Homo sapiens
cagtaaatgtatattga

SEQ ID NO: 570561 - DNA, 13 bp, Homo sapiens
cagtaacacaggc

SEQ ID NO: 570562 - DNA, 24 bp, Homo sapiens
cagtagagggtccagtcttctagt

SEQ ID NO: 570563 - DNA, 20 bp, Homo sapiens
cagtagctgtggggagctgg

SEQ ID NO: 570564 - DNA, 23 bp, Homo sapiens
cagtagctgtggggagctggtgg

SEQ ID NO: 570565 - DNA, 24 bp, Homo sapiens
cagtaggacaaggtgcaggcaggc

SEQ ID NO: 570566 - DNA, 14 bp, Homo sapiens
cagtagtgaccaat

SEQ ID NO: 570567 - DNA, 20 bp, Homo sapiens
cagtattaatactaaaatat

SEQ ID NO: 570568 - DNA, 13 bp, Homo sapiens
cagtatttaacat

SEQ ID NO: 570569 - DNA, 13 bp, Homo sapiens
cagtattttagtg

SEQ ID NO: 570570 - DNA, 17 bp, Homo sapiens
cagtcaaggagtggctt

SEQ ID NO: 570571 - DNA, 19 bp, Homo sapiens
cagtcaggctctctgggct

SEQ ID NO: 570572 - DNA, 22 bp, Homo sapiens
cagtcaggctctctgggctgac

SEQ ID NO: 570573 - DNA, 15 bp, Homo sapiens
cagtcaggttgaaga

SEQ ID NO: 570574 - DNA, 22 bp, Homo sapiens
cagtcatcgagtggcccaacag

SEQ ID NO: 570575 - DNA, 20 bp, Homo sapiens
cagtccccagaactctgcct

SEQ ID NO: 570576 - DNA, 21 bp, Homo sapiens
cagtcgtggttgggaacacag

SEQ ID NO: 570577 - DNA, 12 bp, Homo sapiens
cagtctcacatt

SEQ ID NO: 570578 - DNA, 17 bp, Homo sapiens
cagtctcactgacacag

SEQ ID NO: 570579 - DNA, 19 bp, Homo sapiens
cagtctcactgacacagga

SEQ ID NO: 570580 - DNA, 19 bp, Homo sapiens
cagtcttatgcttccagaa

SEQ ID NO: 570581 - DNA, 17 bp, Homo sapiens
cagtcttccacctggaa

SEQ ID NO: 570582 - DNA, 23 bp, Homo sapiens
cagtgacctggaaggcccagcac

SEQ ID NO: 570583 - DNA, 23 bp, Homo sapiens
cagtgagctggagatacttggtc

SEQ ID NO: 570584 - DNA, 18 bp, Homo sapiens
cagtgaggtcctgggggc

SEQ ID NO: 570585 - DNA, 19 bp, Homo sapiens
cagtgaggtcctgggggcc

SEQ ID NO: 570586 - DNA, 20 bp, Homo sapiens
cagtgaggtcctgggggcct

SEQ ID NO: 570587 - DNA, 21 bp, Homo sapiens
cagtgaggtcctgggggcctg

SEQ ID NO: 570588 - DNA, 18 bp, Homo sapiens
cagtgattcgagctatat

SEQ ID NO: 570589 - DNA, 18 bp, Homo sapiens
cagtgcaccccctaaaga

SEQ ID NO: 570590 - DNA, 16 bp, Homo sapiens
cagtgcccatgtgtat

SEQ ID NO: 570591 - DNA, 19 bp, Homo sapiens
cagtgcctaactccttaca

SEQ ID NO: 570592 - DNA, 16 bp, Homo sapiens
cagtgcgggtgcagac

SEQ ID NO: 570593 - DNA, 16 bp, Homo sapiens
cagtgctcacacaatc

SEQ ID NO: 570594 - DNA, 22 bp, Homo sapiens
cagtgctcacacaatcagacca

SEQ ID NO: 570595 - DNA, 23 bp, Homo sapiens
cagtgctcacacaatcagaccaa

SEQ ID NO: 570596 - DNA, 16 bp, Homo sapiens
cagtgctgatctaaaa

SEQ ID NO: 570597 - DNA, 13 bp, Homo sapiens
cagtggagcccag

SEQ ID NO: 570598 - DNA, 19 bp, Homo sapiens
cagtggagtgcaaaaggct

SEQ ID NO: 570599 - DNA, 15 bp, Homo sapiens
cagtggcaaaatatt

SEQ ID NO: 570600 - DNA, 17 bp, Homo sapiens
cagtggcaaaatattat

SEQ ID NO: 570601 - DNA, 15 bp, Homo sapiens
cagtggcagtattga

SEQ ID NO: 570602 - DNA, 21 bp, Homo sapiens
cagtggggcctgaggctcctt

SEQ ID NO: 570603 - DNA, 21 bp, Homo sapiens
cagtgtaccattaaaatatgc

SEQ ID NO: 570604 - DNA, 14 bp, Homo sapiens
cagtgttctgtgaa

SEQ ID NO: 570605 - DNA, 18 bp, Homo sapiens
cagtgttctgtgaatagc

SEQ ID NO: 570606 - DNA, 16 bp, Homo sapiens
cagtgtttactttaaa

SEQ ID NO: 570607 - DNA, 14 bp, Homo sapiens
cagttaagaagccc

SEQ ID NO: 570608 - DNA, 17 bp, Homo sapiens
cagttaagaagccctgc

SEQ ID NO: 570609 - DNA, 20 bp, Homo sapiens
cagttaagaagccctgcaga

SEQ ID NO: 570610 - DNA, 14 bp, Homo sapiens
cagttacagtggca

SEQ ID NO: 570611 - DNA, 15 bp, Homo sapiens
cagttatcctttgtg

SEQ ID NO: 570612 - DNA, 15 bp, Homo sapiens
cagttatcttagctg

SEQ ID NO: 570613 - DNA, 17 bp, Homo sapiens
cagttattgtccctggc

SEQ ID NO: 570614 - DNA, 20 bp, Homo sapiens
cagttattgtccctggcttc

SEQ ID NO: 570615 - DNA, 23 bp, Homo sapiens
cagttcaaagtcatgatgttttt

SEQ ID NO: 570616 - DNA, 23 bp, Homo sapiens
cagttccaatcagtagcttaaga

SEQ ID NO: 570617 - DNA, 21 bp, Homo sapiens
cagttccctcagccctcatta

SEQ ID NO: 570618 - DNA, 18 bp, Homo sapiens
cagttctaacctcctaag

SEQ ID NO: 570619 - DNA, 19 bp, Homo sapiens
cagttgagaggacactccc

SEQ ID NO: 570620 - DNA, 14 bp, Homo sapiens
cagttgcccagcct

SEQ ID NO: 570621 - DNA, 16 bp, Homo sapiens
cagttgcccagcctct

SEQ ID NO: 570622 - DNA, 22 bp, Homo sapiens
cagttggactgtggcctcagga

SEQ ID NO: 570623 - DNA, 17 bp, Homo sapiens
cagttggttttgcatgt

SEQ ID NO: 570624 - DNA, 13 bp, Homo sapiens
cagtttaaaaaaa

SEQ ID NO: 570625 - DNA, 13 bp, Homo sapiens
cagtttatgtttt

SEQ ID NO: 570626 - DNA, 23 bp, Homo sapiens
cagtttattccagagctgccagt

SEQ ID NO: 570627 - DNA, 12 bp, Homo sapiens
cagtttcaataa

SEQ ID NO: 570628 - DNA, 13 bp, Homo sapiens
cagtttcaataaa

SEQ ID NO: 570629 - DNA, 16 bp, Homo sapiens
cagtttttcttaatat

SEQ ID NO: 570630 - DNA, 22 bp, Homo sapiens
cataaaaactactgaataaatc

SEQ ID NO: 570631 - DNA, 20 bp, Homo sapiens
cataaaattaaaatttaaca

SEQ ID NO: 570632 - DNA, 11 bp, Homo sapiens
cataaacatca

SEQ ID NO: 570633 - DNA, 22 bp, Homo sapiens
cataaacatcaggttaggcagt

SEQ ID NO: 570634 - DNA, 16 bp, Homo sapiens
cataaatcttccaaag

SEQ ID NO: 570635 - DNA, 21 bp, Homo sapiens
cataagcaacaattttcagat

SEQ ID NO: 570636 - DNA, 16 bp, Homo sapiens
cataagctttttctct

SEQ ID NO: 570637 - DNA, 14 bp, Homo sapiens
cataagttagatgt

SEQ ID NO: 570638 - DNA, 18 bp, Homo sapiens
cataataatcctgcaaag

SEQ ID NO: 570639 - DNA, 14 bp, Homo sapiens
cataatatgcatat

SEQ ID NO: 570640 - DNA, 17 bp, Homo sapiens
cataatatgcatatata

SEQ ID NO: 570641 - DNA, 18 bp, Homo sapiens
cataatatgcatatatat

SEQ ID NO: 570642 - DNA, 18 bp, Homo sapiens
cataattctgaagttata

SEQ ID NO: 570643 - DNA, 19 bp, Homo sapiens
catacaatttacttttaat

SEQ ID NO: 570644 - DNA, 21 bp, Homo sapiens
catacacagaaatcctaacat

SEQ ID NO: 570645 - DNA, 15 bp, Homo sapiens
catacattttctggt

SEQ ID NO: 570646 - DNA, 18 bp, Homo sapiens
catacgcaattgtatata

SEQ ID NO: 570647 - DNA, 19 bp, Homo sapiens
catacgcaattgtatatat

SEQ ID NO: 570648 - DNA, 23 bp, Homo sapiens
catacgcaattgtatatatatgt

SEQ ID NO: 570649 - DNA, 16 bp, Homo sapiens
catacgttttctgcaa

SEQ ID NO: 570650 - DNA, 21 bp, Homo sapiens
catactcatttctaaaagaat

SEQ ID NO: 570651 - DNA, 16 bp, Homo sapiens
catagacagatgtgga

SEQ ID NO: 570652 - DNA, 12 bp, Homo sapiens
catagataccat

SEQ ID NO: 570653 - DNA, 14 bp, Homo sapiens
catagcataggaca

SEQ ID NO: 570654 - DNA, 21 bp, Homo sapiens
catagctacccaaaagagaaa

SEQ ID NO: 570655 - DNA, 17 bp, Homo sapiens
catagcttaagaagtat

SEQ ID NO: 570656 - DNA, 19 bp, Homo sapiens
catagtggtgggcacctat

SEQ ID NO: 570657 - DNA, 15 bp, Homo sapiens
catatacctataatg

SEQ ID NO: 570658 - DNA, 17 bp, Homo sapiens
catatacctataatgtg

SEQ ID NO: 570659 - DNA, 20 bp, Homo sapiens
catatacctataatgtgtgt

SEQ ID NO: 570660 - DNA, 14 bp, Homo sapiens
catatatataaaat

SEQ ID NO: 570661 - DNA, 16 bp, Homo sapiens
catatatataaaatac

SEQ ID NO: 570662 - DNA, 21 bp, Homo sapiens
catatatataaaatacacgtg

SEQ ID NO: 570663 - DNA, 13 bp, Homo sapiens
catatatatgtat

SEQ ID NO: 570664 - DNA, 16 bp, Homo sapiens
catatatatgtatatt

SEQ ID NO: 570665 - DNA, 21 bp, Homo sapiens
catatatgtgtccatttcctt

SEQ ID NO: 570666 - DNA, 11 bp, Homo sapiens
catatctaacc

SEQ ID NO: 570667 - DNA, 17 bp, Homo sapiens
catatgtagactatata

SEQ ID NO: 570668 - DNA, 19 bp, Homo sapiens
catattacaatatttgtgt

SEQ ID NO: 570669 - DNA, 15 bp, Homo sapiens
catattagaaaactt

SEQ ID NO: 570670 - DNA, 23 bp, Homo sapiens
catattagcgacaacagattgga

SEQ ID NO: 570671 - DNA, 21 bp, Homo sapiens
catatttcataagcacatcca

SEQ ID NO: 570672 - DNA, 14 bp, Homo sapiens
catattttaatttc

SEQ ID NO: 570673 - DNA, 15 bp, Homo sapiens
catattttaatttca

SEQ ID NO: 570674 - DNA, 22 bp, Homo sapiens
catatttttttccttacataaa

SEQ ID NO: 570675 - DNA, 11 bp, Homo sapiens
catcaattccc

SEQ ID NO: 570676 - DNA, 23 bp, Homo sapiens
catcactattcagaagacacaga

SEQ ID NO: 570677 - DNA, 23 bp, Homo sapiens
catcactattgggcccccaggtc

SEQ ID NO: 570678 - DNA, 16 bp, Homo sapiens
catcagcccctgctgc

SEQ ID NO: 570679 - DNA, 23 bp, Homo sapiens
catcaggttaggcagtataaaga

SEQ ID NO: 570680 - DNA, 17 bp, Homo sapiens
catccaccttcccttct

SEQ ID NO: 570681 - DNA, 16 bp, Homo sapiens
ccagctctcccctgcg

SEQ ID NO: 570682 - DNA, 19 bp, Homo sapiens
ccagctgcaggaatcaaaa

SEQ ID NO: 570683 - DNA, 16 bp, Homo sapiens
ccagctgcccctccct

SEQ ID NO: 570684 - DNA, 17 bp, Homo sapiens
ccagctgcccctccctg

SEQ ID NO: 570685 - DNA, 16 bp, Homo sapiens
ccaggaacacatgcac

SEQ ID NO: 570686 - DNA, 19 bp, Homo sapiens
ccaggaacacatgcacaca

SEQ ID NO: 570687 - DNA, 13 bp, Homo sapiens
ccaggaccctgag

SEQ ID NO: 570688 - DNA, 20 bp, Homo sapiens
ccaggacgcagggagaccct

SEQ ID NO: 570689 - DNA, 21 bp, Homo sapiens
ccaggacgcagggagaccctg

SEQ ID NO: 570690 - DNA, 13 bp, Homo sapiens
ccaggactctgcc

SEQ ID NO: 570691 - DNA, 14 bp, Homo sapiens
ccaggactctgcct

SEQ ID NO: 570692 - DNA, 18 bp, Homo sapiens
ccaggactctgccttcca

SEQ ID NO: 570693 - DNA, 20 bp, Homo sapiens
ccaggactctgccttccagg

SEQ ID NO: 570694 - DNA, 17 bp, Homo sapiens
ccaggagcgcagctgca

SEQ ID NO: 570695 - DNA, 19 bp, Homo sapiens
ccaggagtcccactccaag

SEQ ID NO: 570696 - DNA, 21 bp, Homo sapiens
ccaggagtgggtgggacacag

SEQ ID NO: 570697 - DNA, 15 bp, Homo sapiens
ccaggcaccatctcc

SEQ ID NO: 570698 - DNA, 15 bp, Homo sapiens
ccaggcatctccttg

SEQ ID NO: 570699 - DNA, 16 bp, Homo sapiens
ccaggcatgaccctgg

SEQ ID NO: 570700 - DNA, 22 bp, Homo sapiens
ccaggcatgaccctggagcccg

SEQ ID NO: 570701 - DNA, 16 bp, Homo sapiens
ccaggcgctagcacag

SEQ ID NO: 570702 - DNA, 20 bp, Homo sapiens
ccaggcgtagggccagggct

SEQ ID NO: 570703 - DNA, 12 bp, Homo sapiens
ccaggctccctc

SEQ ID NO: 570704 - DNA, 12 bp, Homo sapiens
ccagggctctgg

SEQ ID NO: 570705 - DNA, 16 bp, Homo sapiens
ccagggctctggcagg

SEQ ID NO: 570706 - DNA, 20 bp, Homo sapiens
ccagggtcctgggggctgct

SEQ ID NO: 570707 - DNA, 17 bp, Homo sapiens
ccagggtctcgtcagga

SEQ ID NO: 570708 - DNA, 20 bp, Homo sapiens
ccagggtctcgtcaggaggt

SEQ ID NO: 570709 - DNA, 13 bp, Homo sapiens
ccaggtgcacaga

SEQ ID NO: 570710 - DNA, 22 bp, Homo sapiens
ccaggtggtgggcattctctct

SEQ ID NO: 570711 - DNA, 23 bp, Homo sapiens
ccaggttttgcactcttgtttct

SEQ ID NO: 570712 - DNA, 20 bp, Homo sapiens
ccaggttttgttccgcccag

SEQ ID NO: 570713 - DNA, 17 bp, Homo sapiens
ccagtacattctcagtt

SEQ ID NO: 570714 - DNA, 19 bp, Homo sapiens
ccagtacattctcagtttt

SEQ ID NO: 570715 - DNA, 19 bp, Homo sapiens
ccagtacctgggtccccag

SEQ ID NO: 570716 - DNA, 12 bp, Homo sapiens
ccagtagtgacc

SEQ ID NO: 570717 - DNA, 19 bp, Homo sapiens
ccagtcataccaactttag

SEQ ID NO: 570718 - DNA, 16 bp, Homo sapiens
ccagtccccagaactc

SEQ ID NO: 570719 - DNA, 21 bp, Homo sapiens
ccagtccccagaactctgcct

SEQ ID NO: 570720 - DNA, 12 bp, Homo sapiens
ccagtgacctgg

SEQ ID NO: 570721 - DNA, 20 bp, Homo sapiens
ccagtgacctggaaggccca

SEQ ID NO: 570722 - DNA, 23 bp, Homo sapiens
ccagtgctcacacaatcagacca

SEQ ID NO: 570723 - DNA, 14 bp, Homo sapiens
ccagtggattccca

SEQ ID NO: 570724 - DNA, 22 bp, Homo sapiens
ccagtggattcttgttttgctt

SEQ ID NO: 570725 - DNA, 23 bp, Homo sapiens
ccagttactttccaattctcctt

SEQ ID NO: 570726 - DNA, 14 bp, Homo sapiens
ccagttctgatgag

SEQ ID NO: 570727 - DNA, 16 bp, Homo sapiens
ccagttggactgtggc

SEQ ID NO: 570728 - DNA, 23 bp, Homo sapiens
ccagtttagatttcaagaaaaaa

SEQ ID NO: 570729 - DNA, 18 bp, Homo sapiens
ccagtttattccagagct

SEQ ID NO: 570730 - DNA, 14 bp, Homo sapiens
ccatactcatttct

SEQ ID NO: 570731 - DNA, 15 bp, Homo sapiens
ccatagctgtggtgt

SEQ ID NO: 570732 - DNA, 15 bp, Homo sapiens
ccatagtcttaactg

SEQ ID NO: 570733 - DNA, 18 bp, Homo sapiens
ccatagtcttaactggtc

SEQ ID NO: 570734 - DNA, 14 bp, Homo sapiens
ccatattaaaatct

SEQ ID NO: 570735 - DNA, 11 bp, Homo sapiens
ccatattttca

SEQ ID NO: 570736 - DNA, 23 bp, Homo sapiens
ccatattttcacaggtgtggtgt

SEQ ID NO: 570737 - DNA, 15 bp, Homo sapiens
ccatccagccagggg

SEQ ID NO: 570738 - DNA, 16 bp, Homo sapiens
ccatccagccaggggt

SEQ ID NO: 570739 - DNA, 14 bp, Homo sapiens
ccatccttctcccc

SEQ ID NO: 570740 - DNA, 14 bp, Homo sapiens
ccatcggtcagcag

SEQ ID NO: 570741 - DNA, 20 bp, Homo sapiens
ccatctaggatgattttccc

SEQ ID NO: 570742 - DNA, 13 bp, Homo sapiens
ccatctgctgagc

SEQ ID NO: 570743 - DNA, 18 bp, Homo sapiens
ccatgaactggaggccag

SEQ ID NO: 570744 - DNA, 19 bp, Homo sapiens
ccatgagtgctaagagcct

SEQ ID NO: 570745 - DNA, 16 bp, Homo sapiens
ccatgccctcatcccg

SEQ ID NO: 570746 - DNA, 11 bp, Homo sapiens
ccatgccctcc

SEQ ID NO: 570747 - DNA, 16 bp, Homo sapiens
ccatgctcagctcagc

SEQ ID NO: 570748 - DNA, 15 bp, Homo sapiens
ccatggaagctggca

SEQ ID NO: 570749 - DNA, 18 bp, Homo sapiens
ccatggaagctggcagga

SEQ ID NO: 570750 - DNA, 20 bp, Homo sapiens
ccatggaggcacacagctgc

SEQ ID NO: 570751 - DNA, 20 bp, Homo sapiens
ccatggattcccctggacat

SEQ ID NO: 570752 - DNA, 15 bp, Homo sapiens
ccatggtagactgtg

SEQ ID NO: 570753 - DNA, 18 bp, Homo sapiens
ccatggtagactgtgaca

SEQ ID NO: 570754 - DNA, 16 bp, Homo sapiens
ccatggtgaactgaag

SEQ ID NO: 570755 - DNA, 11 bp, Homo sapiens
ccatgtatgca

SEQ ID NO: 570756 - DNA, 12 bp, Homo sapiens
ccatgtgctgct

SEQ ID NO: 570757 - DNA, 22 bp, Homo sapiens
ccattctggcactttaatgata

SEQ ID NO: 570758 - DNA, 14 bp, Homo sapiens
ccattggaaatttc

SEQ ID NO: 570759 - DNA, 15 bp, Homo sapiens
ccatttcctcctggg

SEQ ID NO: 570760 - DNA, 19 bp, Homo sapiens
ccattttggtgtctttctc

SEQ ID NO: 570761 - DNA, 20 bp, Homo sapiens
ccattttggtgtctttctct

SEQ ID NO: 570762 - DNA, 21 bp, Homo sapiens
ccattttggtgtctttctctt

SEQ ID NO: 570763 - DNA, 21 bp, Homo sapiens
cccaaagcacatgcttagctt

SEQ ID NO: 570764 - DNA, 16 bp, Homo sapiens
cccaaccctgcccagc

SEQ ID NO: 570765 - DNA, 23 bp, Homo sapiens
cccaactcttgcacagtcactgc

SEQ ID NO: 570766 - DNA, 19 bp, Homo sapiens
cccaagttttgtgaaattt

SEQ ID NO: 570767 - DNA, 21 bp, Homo sapiens
cccaagttttgtgaaattttt

SEQ ID NO: 570768 - DNA, 16 bp, Homo sapiens
cccaatccatcagtgc

SEQ ID NO: 570769 - DNA, 20 bp, Homo sapiens
cccaatgcacatccattccc

SEQ ID NO: 570770 - DNA, 15 bp, Homo sapiens
cccacaccctacagc

SEQ ID NO: 570771 - DNA, 18 bp, Homo sapiens
cccacaccctacagcaga

SEQ ID NO: 570772 - DNA, 15 bp, Homo sapiens
cccacacctggccct

SEQ ID NO: 570773 - DNA, 12 bp, Homo sapiens
cccacagccagt

SEQ ID NO: 570774 - DNA, 20 bp, Homo sapiens
cccacattgcccacacctgc

SEQ ID NO: 570775 - DNA, 15 bp, Homo sapiens
cccacccctccatga

SEQ ID NO: 570776 - DNA, 16 bp, Homo sapiens
cccacctgcagctccc

SEQ ID NO: 570777 - DNA, 22 bp, Homo sapiens
cccacgccctcattacggctcc

SEQ ID NO: 570778 - DNA, 18 bp, Homo sapiens
cccactccaagccagcaa

SEQ ID NO: 570779 - DNA, 12 bp, Homo sapiens
cccactcctgct

SEQ ID NO: 570780 - DNA, 16 bp, Homo sapiens
cccactgcccctgcac

SEQ ID NO: 570781 - DNA, 16 bp, Homo sapiens
cccactggctgtgggc

SEQ ID NO: 570782 - DNA, 16 bp, Homo sapiens
cccagaaatgccgctg

SEQ ID NO: 570783 - DNA, 18 bp, Homo sapiens
cccagaaatgccgctgtg

SEQ ID NO: 570784 - DNA, 14 bp, Homo sapiens
cccagaactctgcc

SEQ ID NO: 570785 - DNA, 21 bp, Homo sapiens
cccagaactctgcctgccctt

SEQ ID NO: 570786 - DNA, 16 bp, Homo sapiens
cccagacaacagccca

SEQ ID NO: 570787 - DNA, 20 bp, Homo sapiens
cccagacaacagcccaggca

SEQ ID NO: 570788 - DNA, 13 bp, Homo sapiens
cccagaccactgt

SEQ ID NO: 570789 - DNA, 16 bp, Homo sapiens
cccagaccagtagtga

SEQ ID NO: 570790 - DNA, 18 bp, Homo sapiens
cccagaccagtagtgacc

SEQ ID NO: 570791 - DNA, 14 bp, Homo sapiens
cccagaccccatcc

SEQ ID NO: 570792 - DNA, 20 bp, Homo sapiens
cccagaggccgagagctatg

SEQ ID NO: 570793 - DNA, 18 bp, Homo sapiens
cccagaggggcggggcca

SEQ ID NO: 570794 - DNA, 23 bp, Homo sapiens
cccagaggggcggggccaggatg

SEQ ID NO: 570795 - DNA, 15 bp, Homo sapiens
cccagatcagccaga

SEQ ID NO: 570796 - DNA, 11 bp, Homo sapiens
cccagatccag

SEQ ID NO: 570797 - DNA, 23 bp, Homo sapiens
cccagatccaggaacacatgcac

SEQ ID NO: 570798 - DNA, 18 bp, Homo sapiens
cccagcccctggtggtgg

SEQ ID NO: 570799 - DNA, 19 bp, Homo sapiens
cccagcccttcctctgctc

SEQ ID NO: 570800 - DNA, 23 bp, Homo sapiens
cccagcctgggataggggcagag

SEQ ID NO: 570801 - DNA, 15 bp, Homo sapiens
cccagcgagtctgga

SEQ ID NO: 570802 - DNA, 21 bp, Homo sapiens
cccagcgagtctggagaccag

SEQ ID NO: 570803 - DNA, 12 bp, Homo sapiens
cccagctgcccc

SEQ ID NO: 570804 - DNA, 15 bp, Homo sapiens
cccagctgcccctcc

SEQ ID NO: 570805 - DNA, 13 bp, Homo sapiens
cccaggacgcagg

SEQ ID NO: 570806 - DNA, 18 bp, Homo sapiens
cccaggacgcagggagac

SEQ ID NO: 570807 - DNA, 21 bp, Homo sapiens
cccaggacgcagggagaccct

SEQ ID NO: 570808 - DNA, 23 bp, Homo sapiens
cccaggacgcagggagaccctgg

SEQ ID NO: 570809 - DNA, 19 bp, Homo sapiens
cccaggaggactccctgct

SEQ ID NO: 570810 - DNA, 19 bp, Homo sapiens
cccagggtgaggtggcatg

SEQ ID NO: 570811 - DNA, 22 bp, Homo sapiens
cccagtgctcacacaatcagac

SEQ ID NO: 570812 - DNA, 14 bp, Homo sapiens
cccagtgtccccag

SEQ ID NO: 570813 - DNA, 16 bp, Homo sapiens
cccagtgtccccaggg

SEQ ID NO: 570814 - DNA, 23 bp, Homo sapiens
cccatattggcatggatttctgt

SEQ ID NO: 570815 - DNA, 12 bp, Homo sapiens
cccatcagccca

SEQ ID NO: 570816 - DNA, 17 bp, Homo sapiens
cccatccccatgccctc

SEQ ID NO: 570817 - DNA, 13 bp, Homo sapiens
cccatcctccagg

SEQ ID NO: 570818 - DNA, 15 bp, Homo sapiens
ccggcccaggagcgc

SEQ ID NO: 570819 - DNA, 16 bp, Homo sapiens
ccggcccaggagcgca

SEQ ID NO: 570820 - DNA, 18 bp, Homo sapiens
ccggcctggggccgggct

SEQ ID NO: 570821 - DNA, 17 bp, Homo sapiens
ccgggagatccgccctg

SEQ ID NO: 570822 - DNA, 24 bp, Homo sapiens
ccgggagatccgccctgggctctg

SEQ ID NO: 570823 - DNA, 22 bp, Homo sapiens
ccgggagcctgcgtggcctggg

SEQ ID NO: 570824 - DNA, 20 bp, Homo sapiens
ccgggctacccgtgagccct

SEQ ID NO: 570825 - DNA, 13 bp, Homo sapiens
ccgggtcttccta

SEQ ID NO: 570826 - DNA, 12 bp, Homo sapiens
ccgtaaaaactg

SEQ ID NO: 570827 - DNA, 20 bp, Homo sapiens
ccgtaaaaactgaagttctg

SEQ ID NO: 570828 - DNA, 19 bp, Homo sapiens
ccgtcccaaccctgcccag

SEQ ID NO: 570829 - DNA, 18 bp, Homo sapiens
ccgtcctggcagggcagg

SEQ ID NO: 570830 - DNA, 15 bp, Homo sapiens
ccgtctacagctccc

SEQ ID NO: 570831 - DNA, 21 bp, Homo sapiens
ccgtggtgaggttgtgctgcc

SEQ ID NO: 570832 - DNA, 14 bp, Homo sapiens
ccgtgtttgtctct

SEQ ID NO: 570833 - DNA, 21 bp, Homo sapiens
ccgtttagtcatatctatcta

SEQ ID NO: 570834 - DNA, 19 bp, Homo sapiens
cctaaagtagacttcattt

SEQ ID NO: 570835 - DNA, 14 bp, Homo sapiens
cctaattaatttca

SEQ ID NO: 570836 - DNA, 21 bp, Homo sapiens
cctacagaatactagccagag

SEQ ID NO: 570837 - DNA, 22 bp, Homo sapiens
cctacccagagattgcttctca

SEQ ID NO: 570838 - DNA, 20 bp, Homo sapiens
cctactagggacctggggaa

SEQ ID NO: 570839 - DNA, 13 bp, Homo sapiens
cctactcttctct

SEQ ID NO: 570840 - DNA, 13 bp, Homo sapiens
cctagttctttgc

SEQ ID NO: 570841 - DNA, 15 bp, Homo sapiens
cctataatgtgtgta

SEQ ID NO: 570842 - DNA, 21 bp, Homo sapiens
cctataatgtgtgtatgtgta

SEQ ID NO: 570843 - DNA, 15 bp, Homo sapiens
cctatcatcagttag

SEQ ID NO: 570844 - DNA, 23 bp, Homo sapiens
cctatcatcagttaggattaggt

SEQ ID NO: 570845 - DNA, 17 bp, Homo sapiens
cctatctggggagctcc

SEQ ID NO: 570846 - DNA, 16 bp, Homo sapiens
cctatgactcaaagat

SEQ ID NO: 570847 - DNA, 14 bp, Homo sapiens
cctcaaagaggcag

SEQ ID NO: 570848 - DNA, 21 bp, Homo sapiens
cctcacatagctacccaaaag

SEQ ID NO: 570849 - DNA, 18 bp, Homo sapiens
cctcacccctgcaggcgg

SEQ ID NO: 570850 - DNA, 16 bp, Homo sapiens
cctcagagaagtccag

SEQ ID NO: 570851 - DNA, 18 bp, Homo sapiens
cctcagcaaacccaaaga

SEQ ID NO: 570852 - DNA, 19 bp, Homo sapiens
cctcagcaaacccaaagat

SEQ ID NO: 570853 - DNA, 15 bp, Homo sapiens
cctcaggaccctcgc

SEQ ID NO: 570854 - DNA, 16 bp, Homo sapiens
cctcaggaccctcgct

SEQ ID NO: 570855 - DNA, 23 bp, Homo sapiens
cctcatgcctttatttctgtatc

SEQ ID NO: 570856 - DNA, 14 bp, Homo sapiens
cctcatgggagtca

SEQ ID NO: 570857 - DNA, 16 bp, Homo sapiens
cctccacctgggagat

SEQ ID NO: 570858 - DNA, 22 bp, Homo sapiens
cctccagggctcaacactgtga

SEQ ID NO: 570859 - DNA, 23 bp, Homo sapiens
cctccatgattccaagggcccag

SEQ ID NO: 570860 - DNA, 11 bp, Homo sapiens
cctcccacatc

SEQ ID NO: 570861 - DNA, 14 bp, Homo sapiens
cctcccagatccag

SEQ ID NO: 570862 - DNA, 15 bp, Homo sapiens
cctcccagatccagg

SEQ ID NO: 570863 - DNA, 17 bp, Homo sapiens
cctcccctggtcctgca

SEQ ID NO: 570864 - DNA, 17 bp, Homo sapiens
cctcccggccctgcctg

SEQ ID NO: 570865 - DNA, 18 bp, Homo sapiens
cctcccggccctgcctgc

SEQ ID NO: 570866 - DNA, 22 bp, Homo sapiens
cctcccggccctgcctgctggt

SEQ ID NO: 570867 - DNA, 14 bp, Homo sapiens
cctccctgctgtca

SEQ ID NO: 570868 - DNA, 17 bp, Homo sapiens
cctcccttgtccttgaa

SEQ ID NO: 570869 - DNA, 14 bp, Homo sapiens
cctccgccatccac

SEQ ID NO: 570870 - DNA, 13 bp, Homo sapiens
cctcctaggagta

SEQ ID NO: 570871 - DNA, 21 bp, Homo sapiens
cctcctccagttctgatgagg

SEQ ID NO: 570872 - DNA, 13 bp, Homo sapiens
cctcctccttcct

SEQ ID NO: 570873 - DNA, 14 bp, Homo sapiens
cctcctgctgagtg

SEQ ID NO: 570874 - DNA, 13 bp, Homo sapiens
cctcctgctttta

SEQ ID NO: 570875 - DNA, 17 bp, Homo sapiens
cctcctgtggcctgcca

SEQ ID NO: 570876 - DNA, 21 bp, Homo sapiens
cctccttcactccctgtcata

SEQ ID NO: 570877 - DNA, 16 bp, Homo sapiens
cctccttcccagctgc

SEQ ID NO: 570878 - DNA, 18 bp, Homo sapiens
cctccttcccagctgccc

SEQ ID NO: 570879 - DNA, 15 bp, Homo sapiens
cctcgctggccccca

SEQ ID NO: 570880 - DNA, 23 bp, Homo sapiens
cctcgctggcccccactggctgt

SEQ ID NO: 570881 - DNA, 17 bp, Homo sapiens
cctcggatcagctgagc

SEQ ID NO: 570882 - DNA, 20 bp, Homo sapiens
cctcggatcagctgagcctt

SEQ ID NO: 570883 - DNA, 14 bp, Homo sapiens
cctcggccagagct

SEQ ID NO: 570884 - DNA, 20 bp, Homo sapiens
cctcggccagagctcccagg

SEQ ID NO: 570885 - DNA, 16 bp, Homo sapiens
cctcggggcaggaagt

SEQ ID NO: 570886 - DNA, 19 bp, Homo sapiens
cctcggggcaggaagtccc

SEQ ID NO: 570887 - DNA, 17 bp, Homo sapiens
cctctagccctgcccgg

SEQ ID NO: 570888 - DNA, 23 bp, Homo sapiens
cctctaggtaaactagcaaaagg

SEQ ID NO: 570889 - DNA, 14 bp, Homo sapiens
cctctcactgcctc

SEQ ID NO: 570890 - DNA, 16 bp, Homo sapiens
cctctctaacctcctt

SEQ ID NO: 570891 - DNA, 17 bp, Homo sapiens
cctctgaactgctgctg

SEQ ID NO: 570892 - DNA, 13 bp, Homo sapiens
cctctgagaggcg

SEQ ID NO: 570893 - DNA, 16 bp, Homo sapiens
cctctgattctatgta

SEQ ID NO: 570894 - DNA, 17 bp, Homo sapiens
cctctgattctatgtaa

SEQ ID NO: 570895 - DNA, 21 bp, Homo sapiens
cctctgattctatgtaacttg

SEQ ID NO: 570896 - DNA, 19 bp, Homo sapiens
cctctgcacctttgcacgt

SEQ ID NO: 570897 - DNA, 19 bp, Homo sapiens
cctctgctcccccttttcc

SEQ ID NO: 570898 - DNA, 14 bp, Homo sapiens
cctctggaagggag

SEQ ID NO: 570899 - DNA, 11 bp, Homo sapiens
cctctgggccc

SEQ ID NO: 570900 - DNA, 22 bp, Homo sapiens
cctctgtccccgagccgagctc

SEQ ID NO: 570901 - DNA, 15 bp, Homo sapiens
cctcttcaatcccca

SEQ ID NO: 570902 - DNA, 17 bp, Homo sapiens
cctcttcctccctgggg

SEQ ID NO: 570903 - DNA, 16 bp, Homo sapiens
cctcttctgccaagag

SEQ ID NO: 570904 - DNA, 11 bp, Homo sapiens
cctctttcagt

SEQ ID NO: 570905 - DNA, 22 bp, Homo sapiens
cctgaaagcaacagctggacac

SEQ ID NO: 570906 - DNA, 21 bp, Homo sapiens
cctgaaagcccttctcaagac

SEQ ID NO: 570907 - DNA, 18 bp, Homo sapiens
cctgaaatgtgtgtgatg

SEQ ID NO: 570908 - DNA, 17 bp, Homo sapiens
cctgaacaacgagcctt

SEQ ID NO: 570909 - DNA, 15 bp, Homo sapiens
cctgaactcccagtc

SEQ ID NO: 570910 - DNA, 20 bp, Homo sapiens
cctgaactcccagtcatgtt

SEQ ID NO: 570911 - DNA, 18 bp, Homo sapiens
cctgaatctgaccacaga

SEQ ID NO: 570912 - DNA, 19 bp, Homo sapiens
cctgacactgtctgctgcc

SEQ ID NO: 570913 - DNA, 20 bp, Homo sapiens
cctgacactgtctgctgccc

SEQ ID NO: 570914 - DNA, 15 bp, Homo sapiens
cctgacagcaaacac

SEQ ID NO: 570915 - DNA, 17 bp, Homo sapiens
cctgacagcaaacacag

SEQ ID NO: 570916 - DNA, 19 bp, Homo sapiens
cctgacagcaaacacagtc

SEQ ID NO: 570917 - DNA, 20 bp, Homo sapiens
cctgacagccagaactctgt

SEQ ID NO: 570918 - DNA, 18 bp, Homo sapiens
cctgaggacatggcttct

SEQ ID NO: 570919 - DNA, 15 bp, Homo sapiens
cctgaggggcagcct

SEQ ID NO: 570920 - DNA, 17 bp, Homo sapiens
cctgaggggcagcctgc

SEQ ID NO: 570921 - DNA, 17 bp, Homo sapiens
cctgagggtttccacct

SEQ ID NO: 570922 - DNA, 19 bp, Homo sapiens
cctgatcccttccacctgc

SEQ ID NO: 570923 - DNA, 23 bp, Homo sapiens
cctgatcccttccacctgctctg

SEQ ID NO: 570924 - DNA, 19 bp, Homo sapiens
cctgatgtcttggtttcca

SEQ ID NO: 570925 - DNA, 20 bp, Homo sapiens
cctgattggtttctcttctc

SEQ ID NO: 570926 - DNA, 15 bp, Homo sapiens
cctgatttattctgg

SEQ ID NO: 570927 - DNA, 22 bp, Homo sapiens
cctgcaaagtacaggtactttg

SEQ ID NO: 570928 - DNA, 23 bp, Homo sapiens
cctgcaaagtacaggtactttgt

SEQ ID NO: 570929 - DNA, 14 bp, Homo sapiens
cctgcacaaacata

SEQ ID NO: 570930 - DNA, 12 bp, Homo sapiens
cctgcagctccc

SEQ ID NO: 570931 - DNA, 12 bp, Homo sapiens
cctgcagctctc

SEQ ID NO: 570932 - DNA, 19 bp, Homo sapiens
cctgcccagatcagccaga

SEQ ID NO: 570933 - DNA, 15 bp, Homo sapiens
cctgcccccacacct

SEQ ID NO: 570934 - DNA, 16 bp, Homo sapiens
cctgcccccacacctg

SEQ ID NO: 570935 - DNA, 16 bp, Homo sapiens
cctgcccggcccagga

SEQ ID NO: 570936 - DNA, 18 bp, Homo sapiens
cctgcccggcccaggagc

SEQ ID NO: 570937 - DNA, 19 bp, Homo sapiens
cctgcccggcccaggagcg

SEQ ID NO: 570938 - DNA, 16 bp, Homo sapiens
cctgcctgccctgtca

SEQ ID NO: 570939 - DNA, 12 bp, Homo sapiens
cctgcctgctgg

SEQ ID NO: 570940 - DNA, 14 bp, Homo sapiens
cctgcctggtctcc

SEQ ID NO: 570941 - DNA, 22 bp, Homo sapiens
cctgcgtggcctggggctgccg

SEQ ID NO: 570942 - DNA, 17 bp, Homo sapiens
cctgcgtggctgacccc

SEQ ID NO: 570943 - DNA, 21 bp, Homo sapiens
cctgctcagcagtgagagcag

SEQ ID NO: 570944 - DNA, 18 bp, Homo sapiens
cctgctccttcccttgct

SEQ ID NO: 570945 - DNA, 12 bp, Homo sapiens
cctgctctgctg

SEQ ID NO: 570946 - DNA, 12 bp, Homo sapiens
cctgctgccagg

SEQ ID NO: 570947 - DNA, 20 bp, Homo sapiens
cctgctgccaggctcccact

SEQ ID NO: 570948 - DNA, 20 bp, Homo sapiens
cctgctgtcattgcttcttc

SEQ ID NO: 570949 - DNA, 13 bp, Homo sapiens
cctgcttctcagc

SEQ ID NO: 570950 - DNA, 12 bp, Homo sapiens
cctgcttctctg

SEQ ID NO: 570951 - DNA, 17 bp, Homo sapiens
cctgcttctctgcccag

SEQ ID NO: 570952 - DNA, 14 bp, Homo sapiens
cctggacaggccag

SEQ ID NO: 570953 - DNA, 12 bp, Homo sapiens
cctggactctgt

SEQ ID NO: 570954 - DNA, 15 bp, Homo sapiens
cctggagatggggag

SEQ ID NO: 570955 - DNA, 19 bp, Homo sapiens
ctataaatagtgaaaattt

SEQ ID NO: 570956 - DNA, 17 bp, Homo sapiens
ctataataccagctact

SEQ ID NO: 570957 - DNA, 21 bp, Homo sapiens
ctataccatttccgtaattct

SEQ ID NO: 570958 - DNA, 13 bp, Homo sapiens
ctatagaaagtgt

SEQ ID NO: 570959 - DNA, 16 bp, Homo sapiens
ctatagaaagtgttct

SEQ ID NO: 570960 - DNA, 13 bp, Homo sapiens
ctatatacatgtg

SEQ ID NO: 570961 - DNA, 13 bp, Homo sapiens
ctatatatataaa

SEQ ID NO: 570962 - DNA, 14 bp, Homo sapiens
ctatatcatgcttt

SEQ ID NO: 570963 - DNA, 16 bp, Homo sapiens
ctatatgtacagctct

SEQ ID NO: 570964 - DNA, 18 bp, Homo sapiens
ctatatttaagtattcaa

SEQ ID NO: 570965 - DNA, 21 bp, Homo sapiens
ctatatttaagtattcaagaa

SEQ ID NO: 570966 - DNA, 22 bp, Homo sapiens
ctatcagcagcggcagcagcag

SEQ ID NO: 570967 - DNA, 19 bp, Homo sapiens
ctatctcgctagccatata

SEQ ID NO: 570968 - DNA, 20 bp, Homo sapiens
ctatctggaaaaaaaaaaat

SEQ ID NO: 570969 - DNA, 18 bp, Homo sapiens
ctatctggggagctcctg

SEQ ID NO: 570970 - DNA, 20 bp, Homo sapiens
ctatctggggagctcctggc

SEQ ID NO: 570971 - DNA, 21 bp, Homo sapiens
ctatctggggagctcctggcc

SEQ ID NO: 570972 - DNA, 16 bp, Homo sapiens
ctatgactcaaagatg

SEQ ID NO: 570973 - DNA, 16 bp, Homo sapiens
ctatgatgtccaaact

SEQ ID NO: 570974 - DNA, 13 bp, Homo sapiens
ctatgccttttgt

SEQ ID NO: 570975 - DNA, 18 bp, Homo sapiens
ctatggaagccacatcac

SEQ ID NO: 570976 - DNA, 14 bp, Homo sapiens
ctatggacaattta

SEQ ID NO: 570977 - DNA, 21 bp, Homo sapiens
ctatggacagcattgccagta

SEQ ID NO: 570978 - DNA, 16 bp, Homo sapiens
ctatggggacattcca

SEQ ID NO: 570979 - DNA, 17 bp, Homo sapiens
ctatgtaacttgttgca

SEQ ID NO: 570980 - DNA, 16 bp, Homo sapiens
ctatgtcatttcatgt

SEQ ID NO: 570981 - DNA, 21 bp, Homo sapiens
ctattctatccatctcctggt

SEQ ID NO: 570982 - DNA, 17 bp, Homo sapiens
ctattgagtcttcatgt

SEQ ID NO: 570983 - DNA, 15 bp, Homo sapiens
ctattgctgtaaata

SEQ ID NO: 570984 - DNA, 22 bp, Homo sapiens
ctattgctgtaaataaaaatag

SEQ ID NO: 570985 - DNA, 19 bp, Homo sapiens
ctatttaagtggactgtat

SEQ ID NO: 570986 - DNA, 14 bp, Homo sapiens
ctatttattaaaac

SEQ ID NO: 570987 - DNA, 18 bp, Homo sapiens
ctatttcaacttcaggaa

SEQ ID NO: 570988 - DNA, 13 bp, Homo sapiens
ctatttcattttt

SEQ ID NO: 570989 - DNA, 16 bp, Homo sapiens
ctatttccccctttct

SEQ ID NO: 570990 - DNA, 14 bp, Homo sapiens
ctattttactgtct

SEQ ID NO: 570991 - DNA, 17 bp, Homo sapiens
ctattttactgtcttaa

SEQ ID NO: 570992 - DNA, 21 bp, Homo sapiens
ctcaaaatgtggaccagttcc

SEQ ID NO: 570993 - DNA, 18 bp, Homo sapiens
ctcaaaggagctttctca

SEQ ID NO: 570994 - DNA, 20 bp, Homo sapiens
ctcaacaaggcaaaaacaaa

SEQ ID NO: 570995 - DNA, 14 bp, Homo sapiens
ctcaacaataaaac

SEQ ID NO: 570996 - DNA, 20 bp, Homo sapiens
ctcaaccaaatggtacaaaa

SEQ ID NO: 570997 - DNA, 13 bp, Homo sapiens
ctcaagccaccag

SEQ ID NO: 570998 - DNA, 21 bp, Homo sapiens
ctcaaggctgcagtgagccaa

SEQ ID NO: 570999 - DNA, 13 bp, Homo sapiens
ctcaattacagag

SEQ ID NO: 571000 - DNA, 15 bp, Homo sapiens
ctcaattccagggaa

SEQ ID NO: 571001 - DNA, 20 bp, Homo sapiens
ctcaattccagggaaccaga

SEQ ID NO: 571002 - DNA, 19 bp, Homo sapiens
ctcaccttccctagttctt

SEQ ID NO: 571003 - DNA, 15 bp, Homo sapiens
ctcaccttctgtttt

SEQ ID NO: 571004 - DNA, 23 bp, Homo sapiens
ctcacgcctgtaatcccagcact

SEQ ID NO: 571005 - DNA, 14 bp, Homo sapiens
ctcactgcctcccc

SEQ ID NO: 571006 - DNA, 19 bp, Homo sapiens
ctcagaagtgaaaaagact

SEQ ID NO: 571007 - DNA, 14 bp, Homo sapiens
ctcagagcacagcc

SEQ ID NO: 571008 - DNA, 19 bp, Homo sapiens
ctcagagtgaagagtgaag

SEQ ID NO: 571009 - DNA, 18 bp, Homo sapiens
ctcagcaaacccaaagat

SEQ ID NO: 571010 - DNA, 19 bp, Homo sapiens
ctcagcaaacccaaagatg

SEQ ID NO: 571011 - DNA, 17 bp, Homo sapiens
ctcagcagtgagagcag

SEQ ID NO: 571012 - DNA, 21 bp, Homo sapiens
ctcagcatatatataaaatac

SEQ ID NO: 571013 - DNA, 18 bp, Homo sapiens
ctcagctgtctgtggctt

SEQ ID NO: 571014 - DNA, 15 bp, Homo sapiens
ctcaggaccctcgct

SEQ ID NO: 571015 - DNA, 20 bp, Homo sapiens
ctcaggaccctcgctggccc

SEQ ID NO: 571016 - DNA, 21 bp, Homo sapiens
ctcatcaggtaaactgatgct

SEQ ID NO: 571017 - DNA, 19 bp, Homo sapiens
ctcatccccagtcccaatg

SEQ ID NO: 571018 - DNA, 17 bp, Homo sapiens
ctcatccttttctccta

SEQ ID NO: 571019 - DNA, 14 bp, Homo sapiens
ctcatgctgcccct

SEQ ID NO: 571020 - DNA, 13 bp, Homo sapiens
ctcatgttttata

SEQ ID NO: 571021 - DNA, 21 bp, Homo sapiens
ctcatgttttatatgattaaa

SEQ ID NO: 571022 - DNA, 18 bp, Homo sapiens
ctcattacggctcctctc

SEQ ID NO: 571023 - DNA, 21 bp, Homo sapiens
ctcattccctcgtctttccca

SEQ ID NO: 571024 - DNA, 23 bp, Homo sapiens
ctcatttaaacccaatcagatgc

SEQ ID NO: 571025 - DNA, 12 bp, Homo sapiens
ctcattttattc

SEQ ID NO: 571026 - DNA, 22 bp, Homo sapiens
ctcatttttttttttgtttctg

SEQ ID NO: 571027 - DNA, 20 bp, Homo sapiens
ctccaactcagagcacagcc

SEQ ID NO: 571028 - DNA, 23 bp, Homo sapiens
ctccacagggacacagtctggtg

SEQ ID NO: 571029 - DNA, 18 bp, Homo sapiens
ctccacctgggagatgct

SEQ ID NO: 571030 - DNA, 20 bp, Homo sapiens
ctccacgggggcctagtggc

SEQ ID NO: 571031 - DNA, 16 bp, Homo sapiens
ctccacgttcacccct

SEQ ID NO: 571032 - DNA, 19 bp, Homo sapiens
ctccagaaatgtccctttc

SEQ ID NO: 571033 - DNA, 16 bp, Homo sapiens
ctccagaactcttcct

SEQ ID NO: 571034 - DNA, 12 bp, Homo sapiens
ctccagaagcag

SEQ ID NO: 571035 - DNA, 14 bp, Homo sapiens
ctccagaagcagca

SEQ ID NO: 571036 - DNA, 22 bp, Homo sapiens
ctccagaagcagcagctagaaa

SEQ ID NO: 571037 - DNA, 16 bp, Homo sapiens
ctccagacttgggagc

SEQ ID NO: 571038 - DNA, 16 bp, Homo sapiens
ctccagctctggcatg

SEQ ID NO: 571039 - DNA, 15 bp, Homo sapiens
ctccagtacaataaa

SEQ ID NO: 571040 - DNA, 17 bp, Homo sapiens
ctccagtccccagaact

SEQ ID NO: 571041 - DNA, 19 bp, Homo sapiens
ctccatccttctccccaag

SEQ ID NO: 571042 - DNA, 18 bp, Homo sapiens
ctccatggtgaactgaag

SEQ ID NO: 571043 - DNA, 23 bp, Homo sapiens
ctccatggtgaactgaagcagag

SEQ ID NO: 571044 - DNA, 22 bp, Homo sapiens
ctccattttggtgtctttctct

SEQ ID NO: 571045 - DNA, 14 bp, Homo sapiens
ctcccacatccccc

SEQ ID NO: 571046 - DNA, 16 bp, Homo sapiens
ctcccagatccaggaa

SEQ ID NO: 571047 - DNA, 18 bp, Homo sapiens
ctcccagatccaggaaca

SEQ ID NO: 571048 - DNA, 21 bp, Homo sapiens
ctcccagatccaggaacacat

SEQ ID NO: 571049 - DNA, 22 bp, Homo sapiens
ctcccagatccaggaacacatg

SEQ ID NO: 571050 - DNA, 20 bp, Homo sapiens
ctcccaggacgcagggagac

SEQ ID NO: 571051 - DNA, 22 bp, Homo sapiens
ctccccaaggccccctgcctgc

SEQ ID NO: 571052 - DNA, 21 bp, Homo sapiens
ctccccaggccgtggctgccc

SEQ ID NO: 571053 - DNA, 13 bp, Homo sapiens
ctcccccatccta

SEQ ID NO: 571054 - DNA, 20 bp, Homo sapiens
ctccccctccttcccagctg

SEQ ID NO: 571055 - DNA, 13 bp, Homo sapiens
ctcccctcccttg

SEQ ID NO: 571056 - DNA, 22 bp, Homo sapiens
ctcccctcctggcgagttctct

SEQ ID NO: 571057 - DNA, 18 bp, Homo sapiens
ctcccctgtgccagccca

SEQ ID NO: 571058 - DNA, 14 bp, Homo sapiens
ctccccttccattt

SEQ ID NO: 571059 - DNA, 23 bp, Homo sapiens
ctccccttccccttccttctttg

SEQ ID NO: 571060 - DNA, 17 bp, Homo sapiens
ctcccgctccgggctcc

SEQ ID NO: 571061 - DNA, 21 bp, Homo sapiens
ctcccgtgtatctggacactg

SEQ ID NO: 571062 - DNA, 16 bp, Homo sapiens
ctccctcccagatcca

SEQ ID NO: 571063 - DNA, 21 bp, Homo sapiens
ctccctcccagatccaggaac

SEQ ID NO: 571064 - DNA, 16 bp, Homo sapiens
ctccctccctcccaga

SEQ ID NO: 571065 - DNA, 19 bp, Homo sapiens
ctccctccgggtcttccta

SEQ ID NO: 571066 - DNA, 20 bp, Homo sapiens
ctccctccgggtcttcctac

SEQ ID NO: 571067 - DNA, 23 bp, Homo sapiens
ctccctgaatctgaccacagaca

SEQ ID NO: 571068 - DNA, 15 bp, Homo sapiens
ctccctgatgtacag

SEQ ID NO: 571069 - DNA, 12 bp, Homo sapiens
ctccctgccagt

SEQ ID NO: 571070 - DNA, 13 bp, Homo sapiens
ctcccttcctccc

SEQ ID NO: 571071 - DNA, 14 bp, Homo sapiens
ctcccttctgttga

SEQ ID NO: 571072 - DNA, 19 bp, Homo sapiens
ctccctttatcatgtgttt

SEQ ID NO: 571073 - DNA, 20 bp, Homo sapiens
ctccgcccttccctgacact

SEQ ID NO: 571074 - DNA, 23 bp, Homo sapiens
ctccggaggctgaggcaggagaa

SEQ ID NO: 571075 - DNA, 20 bp, Homo sapiens
ctcctccagttctgatgagg

SEQ ID NO: 571076 - DNA, 16 bp, Homo sapiens
ctcctcccgaaaccca

SEQ ID NO: 571077 - DNA, 14 bp, Homo sapiens
ctcctccttcctag

SEQ ID NO: 571078 - DNA, 16 bp, Homo sapiens
ctcctcggccagagct

SEQ ID NO: 571079 - DNA, 21 bp, Homo sapiens
ctcctctcctgacaatactgt

SEQ ID NO: 571080 - DNA, 14 bp, Homo sapiens
ctcctgctctgctc

SEQ ID NO: 571081 - DNA, 14 bp, Homo sapiens
ctcctgctgagtgg

SEQ ID NO: 571082 - DNA, 13 bp, Homo sapiens
ctcctgctgccag

SEQ ID NO: 571083 - DNA, 18 bp, Homo sapiens
ctcctggcgagttctctt

SEQ ID NO: 571084 - DNA, 18 bp, Homo sapiens
ctcctggtgttctgcagt

SEQ ID NO: 571085 - DNA, 17 bp, Homo sapiens
ctcctgtggcctgccag

SEQ ID NO: 571086 - DNA, 12 bp, Homo sapiens
ctccttacagaa

SEQ ID NO: 571087 - DNA, 23 bp, Homo sapiens
ctccttatgggtagggctctgac

SEQ ID NO: 571088 - DNA, 22 bp, Homo sapiens
ctccttcaacaaggcttgctgc

SEQ ID NO: 571089 - DNA, 17 bp, Homo sapiens
ctccttcccactcttct

SEQ ID NO: 571090 - DNA, 18 bp, Homo sapiens
ctccttcccactcttctc

SEQ ID NO: 571091 - DNA, 13 bp, Homo sapiens
ctgaggaggtgct

SEQ ID NO: 571092 - DNA, 14 bp, Homo sapiens
ctgaggcaggagaa

SEQ ID NO: 571093 - DNA, 14 bp, Homo sapiens
ctgaggctggggct

SEQ ID NO: 571094 - DNA, 12 bp, Homo sapiens
ctgagggccctt

SEQ ID NO: 571095 - DNA, 18 bp, Homo sapiens
ctgagggcccttcccaac

SEQ ID NO: 571096 - DNA, 19 bp, Homo sapiens
ctgaggggcagcctgcctt

SEQ ID NO: 571097 - DNA, 23 bp, Homo sapiens
ctgaggggcagcctgccttgccc

SEQ ID NO: 571098 - DNA, 15 bp, Homo sapiens
ctgagtacaaatgtg

SEQ ID NO: 571099 - DNA, 13 bp, Homo sapiens
ctgagtccgacct

SEQ ID NO: 571100 - DNA, 20 bp, Homo sapiens
ctgagtcctcattgttcaga

SEQ ID NO: 571101 - DNA, 21 bp, Homo sapiens
ctgatacttatttataacatt

SEQ ID NO: 571102 - DNA, 17 bp, Homo sapiens
ctgatagcccctctccc

SEQ ID NO: 571103 - DNA, 12 bp, Homo sapiens
ctgatctgggtt

SEQ ID NO: 571104 - DNA, 16 bp, Homo sapiens
ctgatgaagttgtaca

SEQ ID NO: 571105 - DNA, 17 bp, Homo sapiens
ctgatgaccaattttaa

SEQ ID NO: 571106 - DNA, 22 bp, Homo sapiens
ctgatgacccccccagcttcac

SEQ ID NO: 571107 - DNA, 16 bp, Homo sapiens
ctgatgtaaatgaagt

SEQ ID NO: 571108 - DNA, 17 bp, Homo sapiens
ctgatgtaaatgaagta

SEQ ID NO: 571109 - DNA, 18 bp, Homo sapiens
ctgatgtacagttgggaa

SEQ ID NO: 571110 - DNA, 14 bp, Homo sapiens
ctgattctatgtaa

SEQ ID NO: 571111 - DNA, 15 bp, Homo sapiens
ctgattctatgtaac

SEQ ID NO: 571112 - DNA, 19 bp, Homo sapiens
ctgattctatgtaacttgt

SEQ ID NO: 571113 - DNA, 21 bp, Homo sapiens
ctgattggtttctcttctccc

SEQ ID NO: 571114 - DNA, 22 bp, Homo sapiens
ctgatttactaacagtaactgc

SEQ ID NO: 571115 - DNA, 16 bp, Homo sapiens
ctgcaaaaccaggttt

SEQ ID NO: 571116 - DNA, 23 bp, Homo sapiens
ctgcaaagtacaggtactttgtc

SEQ ID NO: 571117 - DNA, 21 bp, Homo sapiens
ctgcaaccaaactcccatcag

SEQ ID NO: 571118 - DNA, 22 bp, Homo sapiens
ctgcaagaacactggacctttg

SEQ ID NO: 571119 - DNA, 15 bp, Homo sapiens
ctgcaatgagccatg

SEQ ID NO: 571120 - DNA, 13 bp, Homo sapiens
ctgcacaaacata

SEQ ID NO: 571121 - DNA, 17 bp, Homo sapiens
ctgcacaaacatagaca

SEQ ID NO: 571122 - DNA, 21 bp, Homo sapiens
ctgcacaaacatagacagatg

SEQ ID NO: 571123 - DNA, 16 bp, Homo sapiens
ctgcacatgatttcac

SEQ ID NO: 571124 - DNA, 19 bp, Homo sapiens
ctgcaccaccgaccaactc

SEQ ID NO: 571125 - DNA, 18 bp, Homo sapiens
ctgcaccaggccatcagc

SEQ ID NO: 571126 - DNA, 22 bp, Homo sapiens
ctgcaccaggtagaacgccagg

SEQ ID NO: 571127 - DNA, 12 bp, Homo sapiens
ctgcactgccct

SEQ ID NO: 571128 - DNA, 14 bp, Homo sapiens
ctgcagagcacaaa

SEQ ID NO: 571129 - DNA, 20 bp, Homo sapiens
ctgcagatactactgaccag

SEQ ID NO: 571130 - DNA, 18 bp, Homo sapiens
ctgcagctctcatgctgc

SEQ ID NO: 571131 - DNA, 22 bp, Homo sapiens
ctgcaggaatcaaaaattgaag

SEQ ID NO: 571132 - DNA, 19 bp, Homo sapiens
ctgcaggattctcaccagc

SEQ ID NO: 571133 - DNA, 22 bp, Homo sapiens
ctgcaggcggtatccagaggtg

SEQ ID NO: 571134 - DNA, 23 bp, Homo sapiens
ctgcagtcatctcccctcctggc

SEQ ID NO: 571135 - DNA, 23 bp, Homo sapiens
ctgcatagcttgcacaacatcct

SEQ ID NO: 571136 - DNA, 15 bp, Homo sapiens
ctgccaagagtccaa

SEQ ID NO: 571137 - DNA, 21 bp, Homo sapiens
ctgccaggctcccactgcccc

SEQ ID NO: 571138 - DNA, 22 bp, Homo sapiens
ctgccaggctcccactgcccct

SEQ ID NO: 571139 - DNA, 19 bp, Homo sapiens
ctgccaggggatttcgaag

SEQ ID NO: 571140 - DNA, 17 bp, Homo sapiens
ctgccatcagcccctgc

SEQ ID NO: 571141 - DNA, 20 bp, Homo sapiens
ctgccatggaggcacacagc

SEQ ID NO: 571142 - DNA, 21 bp, Homo sapiens
ctgcccagatcagccagaagc

SEQ ID NO: 571143 - DNA, 17 bp, Homo sapiens
ctgccccacccctccat

SEQ ID NO: 571144 - DNA, 19 bp, Homo sapiens
ctgcccccacacctggccc

SEQ ID NO: 571145 - DNA, 13 bp, Homo sapiens
ctgcccctccctg

SEQ ID NO: 571146 - DNA, 20 bp, Homo sapiens
ctgcccggtgggggggcaga

SEQ ID NO: 571147 - DNA, 16 bp, Homo sapiens
ctgccctccgcccttc

SEQ ID NO: 571148 - DNA, 18 bp, Homo sapiens
ctgccctttgtcctcctg

SEQ ID NO: 571149 - DNA, 20 bp, Homo sapiens
ctgccctttgtcctcctgct

SEQ ID NO: 571150 - DNA, 19 bp, Homo sapiens
ctgccgtgcacggggccag

SEQ ID NO: 571151 - DNA, 21 bp, Homo sapiens
ctgccgtgcacggggccagca

SEQ ID NO: 571152 - DNA, 20 bp, Homo sapiens
ctgcctgaggggcagcctgc

SEQ ID NO: 571153 - DNA, 17 bp, Homo sapiens
ctgcctgccctttgtcc

SEQ ID NO: 571154 - DNA, 22 bp, Homo sapiens
ctgcctggtctcctgcccccac

SEQ ID NO: 571155 - DNA, 16 bp, Homo sapiens
ctgcctgtgagtgaca

SEQ ID NO: 571156 - DNA, 19 bp, Homo sapiens
ctgccttctcccctccaag

SEQ ID NO: 571157 - DNA, 18 bp, Homo sapiens
ctgcgtcccactgagtct

SEQ ID NO: 571158 - DNA, 21 bp, Homo sapiens
ctgcgtggcctggggctgccg

SEQ ID NO: 571159 - DNA, 13 bp, Homo sapiens
ctgcgtggctgac

SEQ ID NO: 571160 - DNA, 17 bp, Homo sapiens
ctgcgtggctgaccccc

SEQ ID NO: 571161 - DNA, 14 bp, Homo sapiens
ctgctaaattgatg

SEQ ID NO: 571162 - DNA, 18 bp, Homo sapiens
ctgctaaattgatgttga

SEQ ID NO: 571163 - DNA, 22 bp, Homo sapiens
ctgctaaattgatgttgatgca

SEQ ID NO: 571164 - DNA, 13 bp, Homo sapiens
ctgctcattgtgg

SEQ ID NO: 571165 - DNA, 22 bp, Homo sapiens
ctgctccctccgggtcttccta

SEQ ID NO: 571166 - DNA, 15 bp, Homo sapiens
ctgctcttgggcaat

SEQ ID NO: 571167 - DNA, 15 bp, Homo sapiens
ctgctgagaaggcaa

SEQ ID NO: 571168 - DNA, 13 bp, Homo sapiens
ctgctgagcacat

SEQ ID NO: 571169 - DNA, 15 bp, Homo sapiens
ctgctgagctctgac

SEQ ID NO: 571170 - DNA, 19 bp, Homo sapiens
ctgctgagctctgacctgc

SEQ ID NO: 571171 - DNA, 22 bp, Homo sapiens
ctgctgagtccgacctggcctg

SEQ ID NO: 571172 - DNA, 15 bp, Homo sapiens
ctgctgcccccagac

SEQ ID NO: 571173 - DNA, 18 bp, Homo sapiens
ctgctgcccccagacccc

SEQ ID NO: 571174 - DNA, 21 bp, Homo sapiens
ctgctgcccccagaccccatc

SEQ ID NO: 571175 - DNA, 14 bp, Homo sapiens
ctgctgctcctcgg

SEQ ID NO: 571176 - DNA, 23 bp, Homo sapiens
ctgctgctcctcggccagagctc

SEQ ID NO: 571177 - DNA, 14 bp, Homo sapiens
ctgctgctggtcac

SEQ ID NO: 571178 - DNA, 18 bp, Homo sapiens
ctgctggtcacttcttct

SEQ ID NO: 571179 - DNA, 23 bp, Homo sapiens
ctgctggtgggcttgtcatagcc

SEQ ID NO: 571180 - DNA, 15 bp, Homo sapiens
ctgctgtaaagcaaa

SEQ ID NO: 571181 - DNA, 19 bp, Homo sapiens
ctgctgtaagacggccttg

SEQ ID NO: 571182 - DNA, 20 bp, Homo sapiens
ctgctgtaagacggccttgg

SEQ ID NO: 571183 - DNA, 22 bp, Homo sapiens
ctgctgtaagacggccttggac

SEQ ID NO: 571184 - DNA, 23 bp, Homo sapiens
ctgctgtggcatcaggaaaggaa

SEQ ID NO: 571185 - DNA, 17 bp, Homo sapiens
ctgcttagtgtccctta

SEQ ID NO: 571186 - DNA, 19 bp, Homo sapiens
ctggaagagctaggcaggg

SEQ ID NO: 571187 - DNA, 13 bp, Homo sapiens
ctggaataagaag

SEQ ID NO: 571188 - DNA, 16 bp, Homo sapiens
ctggaatctactagaa

SEQ ID NO: 571189 - DNA, 18 bp, Homo sapiens
ctggacacccccttggtg

SEQ ID NO: 571190 - DNA, 14 bp, Homo sapiens
ctggacaggccagg

SEQ ID NO: 571191 - DNA, 15 bp, Homo sapiens
ctggacagtgcctaa

SEQ ID NO: 571192 - DNA, 17 bp, Homo sapiens
ctggactctgtggggcc

SEQ ID NO: 571193 - DNA, 21 bp, Homo sapiens
ctggactctgtggggccacac

SEQ ID NO: 571194 - DNA, 15 bp, Homo sapiens
ctggagatggggaga

SEQ ID NO: 571195 - DNA, 21 bp, Homo sapiens
ctggatggcggaagctgctac

SEQ ID NO: 571196 - DNA, 16 bp, Homo sapiens
ctggatggtggtgcat

SEQ ID NO: 571197 - DNA, 21 bp, Homo sapiens
ctggcaaatattttgtcactg

SEQ ID NO: 571198 - DNA, 19 bp, Homo sapiens
ctggcactaccaaaggaca

SEQ ID NO: 571199 - DNA, 14 bp, Homo sapiens
ctggcactttaatg

SEQ ID NO: 571200 - DNA, 22 bp, Homo sapiens
ctggcactttaatgataaaatc

SEQ ID NO: 571201 - DNA, 16 bp, Homo sapiens
ctggcaggagacactg

SEQ ID NO: 571202 - DNA, 17 bp, Homo sapiens
ctggcaggagacactgg

SEQ ID NO: 571203 - DNA, 11 bp, Homo sapiens
ctggcaggcag

SEQ ID NO: 571204 - DNA, 16 bp, Homo sapiens
ctggcagggcaggcag

SEQ ID NO: 571205 - DNA, 23 bp, Homo sapiens
ctggcatctttgctatggggaca

SEQ ID NO: 571206 - DNA, 14 bp, Homo sapiens
ctggcccccactgg

SEQ ID NO: 571207 - DNA, 21 bp, Homo sapiens
ctggcccccactggctgtggg

SEQ ID NO: 571208 - DNA, 22 bp, Homo sapiens
ctggcccccactggctgtgggc

SEQ ID NO: 571209 - DNA, 23 bp, Homo sapiens
ctggcccccactggctgtgggct

SEQ ID NO: 571210 - DNA, 18 bp, Homo sapiens
ctggcccctcccacatcc

SEQ ID NO: 571211 - DNA, 11 bp, Homo sapiens
ctggccctggg

SEQ ID NO: 571212 - DNA, 16 bp, Homo sapiens
ctggccctggggcctg

SEQ ID NO: 571213 - DNA, 19 bp, Homo sapiens
ctggccctggggcctgtac

SEQ ID NO: 571214 - DNA, 16 bp, Homo sapiens
ctggcctggggtcagg

SEQ ID NO: 571215 - DNA, 18 bp, Homo sapiens
ctggcctggggtcaggcc

SEQ ID NO: 571216 - DNA, 13 bp, Homo sapiens
ctggcctgtctgt

SEQ ID NO: 571217 - DNA, 15 bp, Homo sapiens
ctggcgagttctctt

SEQ ID NO: 571218 - DNA, 11 bp, Homo sapiens
ctggctccagc

SEQ ID NO: 571219 - DNA, 14 bp, Homo sapiens
ctggctccagcctg

SEQ ID NO: 571220 - DNA, 21 bp, Homo sapiens
ctggctctaggacccccagtg

SEQ ID NO: 571221 - DNA, 12 bp, Homo sapiens
ctggctgtgggc

SEQ ID NO: 571222 - DNA, 13 bp, Homo sapiens
ctggctgtgggct

SEQ ID NO: 571223 - DNA, 17 bp, Homo sapiens
ctggctgtgggctccct

SEQ ID NO: 571224 - DNA, 19 bp, Homo sapiens
ctggctgtgggctcccttc

SEQ ID NO: 571225 - DNA, 19 bp, Homo sapiens
ctggcttctccctggactc

SEQ ID NO: 571226 - DNA, 21 bp, Homo sapiens
ctggcttctccctggactctg

SEQ ID NO: 571227 - DNA, 20 bp, Homo sapiens
cttacagttaagaagccctg

SEQ ID NO: 571228 - DNA, 19 bp, Homo sapiens
cttacataaacatcaggtt

SEQ ID NO: 571229 - DNA, 14 bp, Homo sapiens
cttaccgacaagca

SEQ ID NO: 571230 - DNA, 11 bp, Homo sapiens
cttactttgtt

SEQ ID NO: 571231 - DNA, 19 bp, Homo sapiens
cttagctctcccaactctt

SEQ ID NO: 571232 - DNA, 14 bp, Homo sapiens
cttagcttatcttt

SEQ ID NO: 571233 - DNA, 14 bp, Homo sapiens
cttaggatgtctgt

SEQ ID NO: 571234 - DNA, 23 bp, Homo sapiens
cttagtaagcggctcaagcccag

SEQ ID NO: 571235 - DNA, 17 bp, Homo sapiens
cttagtatctcatcaac

SEQ ID NO: 571236 - DNA, 15 bp, Homo sapiens
cttagtctaggtcct

SEQ ID NO: 571237 - DNA, 20 bp, Homo sapiens
cttatatctaaatctgtcca

SEQ ID NO: 571238 - DNA, 22 bp, Homo sapiens
cttatcagctacttaagagaaa

SEQ ID NO: 571239 - DNA, 23 bp, Homo sapiens
cttatcagctacttaagagaaat

SEQ ID NO: 571240 - DNA, 15 bp, Homo sapiens
cttatctagctgcat

SEQ ID NO: 571241 - DNA, 14 bp, Homo sapiens
cttatctttctttc

SEQ ID NO: 571242 - DNA, 15 bp, Homo sapiens
cttatctttctttcc

SEQ ID NO: 571243 - DNA, 18 bp, Homo sapiens
cttatgaatagacataaa

SEQ ID NO: 571244 - DNA, 12 bp, Homo sapiens
cttatgcttcca

SEQ ID NO: 571245 - DNA, 13 bp, Homo sapiens
cttatgcttccag

SEQ ID NO: 571246 - DNA, 14 bp, Homo sapiens
cttatgcttccaga

SEQ ID NO: 571247 - DNA, 21 bp, Homo sapiens
cttatgggtagggctctgaca

SEQ ID NO: 571248 - DNA, 15 bp, Homo sapiens
cttattaaagtttca

SEQ ID NO: 571249 - DNA, 16 bp, Homo sapiens
cttattaaagtttcaa

SEQ ID NO: 571250 - DNA, 20 bp, Homo sapiens
cttattaaagtttcaaaaat

SEQ ID NO: 571251 - DNA, 18 bp, Homo sapiens
cttattttggagagatag

SEQ ID NO: 571252 - DNA, 21 bp, Homo sapiens
cttcaacaaggcttgctgcag

SEQ ID NO: 571253 - DNA, 12 bp, Homo sapiens
cttcaacatgtg

SEQ ID NO: 571254 - DNA, 19 bp, Homo sapiens
cttcaatttattgcacaaa

SEQ ID NO: 571255 - DNA, 19 bp, Homo sapiens
cttcaccagagcatttcca

SEQ ID NO: 571256 - DNA, 15 bp, Homo sapiens
cttcactcactgtca

SEQ ID NO: 571257 - DNA, 14 bp, Homo sapiens
cttcacttctgact

SEQ ID NO: 571258 - DNA, 13 bp, Homo sapiens
cttcagcccctgg

SEQ ID NO: 571259 - DNA, 17 bp, Homo sapiens
cttcaggatcaagtcct

SEQ ID NO: 571260 - DNA, 17 bp, Homo sapiens
cttcagggagtcagctg

SEQ ID NO: 571261 - DNA, 16 bp, Homo sapiens
cttcagggcagatttt

SEQ ID NO: 571262 - DNA, 14 bp, Homo sapiens
cttcagggggccag

SEQ ID NO: 571263 - DNA, 23 bp, Homo sapiens
cttcatacaaaggacagtacaca

SEQ ID NO: 571264 - DNA, 15 bp, Homo sapiens
cttcatgttcccact

SEQ ID NO: 571265 - DNA, 20 bp, Homo sapiens
cttcatgttcccacttcaaa

SEQ ID NO: 571266 - DNA, 13 bp, Homo sapiens
cttcatttaacac

SEQ ID NO: 571267 - DNA, 16 bp, Homo sapiens
cttcatttttcctaac

SEQ ID NO: 571268 - DNA, 21 bp, Homo sapiens
cttccacaggtctcagaatct

SEQ ID NO: 571269 - DNA, 17 bp, Homo sapiens
cttccacagttatctta

SEQ ID NO: 571270 - DNA, 17 bp, Homo sapiens
cttccacctgctctgct

SEQ ID NO: 571271 - DNA, 22 bp, Homo sapiens
cttccagatgatccttgcacag

SEQ ID NO: 571272 - DNA, 22 bp, Homo sapiens
cttccaggcgtagggccagggc

SEQ ID NO: 571273 - DNA, 23 bp, Homo sapiens
cttccaggcgtagggccagggct

SEQ ID NO: 571274 - DNA, 17 bp, Homo sapiens
cttccagttggactgtg

SEQ ID NO: 571275 - DNA, 19 bp, Homo sapiens
cttccagttggactgtggc

SEQ ID NO: 571276 - DNA, 20 bp, Homo sapiens
cttccagtttattccagagc

SEQ ID NO: 571277 - DNA, 23 bp, Homo sapiens
cttccagtttattccagagctgc

SEQ ID NO: 571278 - DNA, 16 bp, Homo sapiens
cttccatttctgcctt

SEQ ID NO: 571279 - DNA, 14 bp, Homo sapiens
cttcccactcttct

SEQ ID NO: 571280 - DNA, 16 bp, Homo sapiens
cttcccagctgcccct

SEQ ID NO: 571281 - DNA, 12 bp, Homo sapiens
cttcccagggca

SEQ ID NO: 571282 - DNA, 23 bp, Homo sapiens
cttccccaaaggccaacagcatt

SEQ ID NO: 571283 - DNA, 15 bp, Homo sapiens
cttcccccaccacca

SEQ ID NO: 571284 - DNA, 16 bp, Homo sapiens
cttcccccaccaccaa

SEQ ID NO: 571285 - DNA, 20 bp, Homo sapiens
cttcccccgcaatgtgcccc

SEQ ID NO: 571286 - DNA, 14 bp, Homo sapiens
cttccctagttctt

SEQ ID NO: 571287 - DNA, 14 bp, Homo sapiens
cttccctccctgct

SEQ ID NO: 571288 - DNA, 18 bp, Homo sapiens
cttccctccctgctgtca

SEQ ID NO: 571289 - DNA, 24 bp, Homo sapiens
cttccctgacactgtctgctgccc

SEQ ID NO: 571290 - DNA, 19 bp, Homo sapiens
cttcctactcttctctctg

SEQ ID NO: 571291 - DNA, 23 bp, Homo sapiens
cttcctactcttctctctgctct

SEQ ID NO: 571292 - DNA, 17 bp, Homo sapiens
cttcctagttcatccct

SEQ ID NO: 571293 - DNA, 14 bp, Homo sapiens
cttcctccatcctc

SEQ ID NO: 571294 - DNA, 17 bp, Homo sapiens
cttcctccatcctcctc

SEQ ID NO: 571295 - DNA, 15 bp, Homo sapiens
cttcctccccaggac

SEQ ID NO: 571296 - DNA, 22 bp, Homo sapiens
cttcctccccaggacttggtct

SEQ ID NO: 571297 - DNA, 13 bp, Homo sapiens
cttcctctgctcc

SEQ ID NO: 571298 - DNA, 13 bp, Homo sapiens
cttcctcttacct

SEQ ID NO: 571299 - DNA, 18 bp, Homo sapiens
cttcctgaactcccagtc

SEQ ID NO: 571300 - DNA, 19 bp, Homo sapiens
cttcctgattggtttctct

SEQ ID NO: 571301 - DNA, 23 bp, Homo sapiens
cttcctgattggtttctcttctc

SEQ ID NO: 571302 - DNA, 16 bp, Homo sapiens
cttcctgcctggtctc

SEQ ID NO: 571303 - DNA, 19 bp, Homo sapiens
cttcctgctacagtagctg

SEQ ID NO: 571304 - DNA, 23 bp, Homo sapiens
cttcctgggtcaagtgctaacct

SEQ ID NO: 571305 - DNA, 17 bp, Homo sapiens
cttcctggtcgaaagtt

SEQ ID NO: 571306 - DNA, 15 bp, Homo sapiens
cttcctgtgctaagt

SEQ ID NO: 571307 - DNA, 21 bp, Homo sapiens
cttcctgtgctaagtctttcc

SEQ ID NO: 571308 - DNA, 16 bp, Homo sapiens
cttcctgtgggagcag

SEQ ID NO: 571309 - DNA, 16 bp, Homo sapiens
cttcctgttctgtgtc

SEQ ID NO: 571310 - DNA, 18 bp, Homo sapiens
cttccttctttgcccttt

SEQ ID NO: 571311 - DNA, 17 bp, Homo sapiens
cttccttgccagtcttt

SEQ ID NO: 571312 - DNA, 19 bp, Homo sapiens
cttccttttgtatcctcca

SEQ ID NO: 571313 - DNA, 14 bp, Homo sapiens
cttctaaaactgta

SEQ ID NO: 571314 - DNA, 23 bp, Homo sapiens
cttctaaaggtttcactgttcat

SEQ ID NO: 571315 - DNA, 20 bp, Homo sapiens
cttctaatccatgtgctgct

SEQ ID NO: 571316 - DNA, 20 bp, Homo sapiens
cttctcaaatgctactcagt

SEQ ID NO: 571317 - DNA, 20 bp, Homo sapiens
cttctcatcttgacagagcc

SEQ ID NO: 571318 - DNA, 14 bp, Homo sapiens
cttctccccttcca

SEQ ID NO: 571319 - DNA, 20 bp, Homo sapiens
cttctccccttccatttctg

SEQ ID NO: 571320 - DNA, 14 bp, Homo sapiens
cttctctcagatgg

SEQ ID NO: 571321 - DNA, 16 bp, Homo sapiens
cttctctgctgagaag

SEQ ID NO: 571322 - DNA, 17 bp, Homo sapiens
cttctcttccaggcagc

SEQ ID NO: 571323 - DNA, 16 bp, Homo sapiens
cttctgactcttcccc

SEQ ID NO: 571324 - DNA, 23 bp, Homo sapiens
cttctgactcttccccaggaagg

SEQ ID NO: 571325 - DNA, 17 bp, Homo sapiens
cttctgtcgtccccaga

SEQ ID NO: 571326 - DNA, 22 bp, Homo sapiens
cttctgtcgtccccagaccagt

SEQ ID NO: 571327 - DNA, 17 bp, Homo sapiens
cttctgtgtttgaactg

SEQ ID NO: 571328 - DNA, 13 bp, Homo sapiens
cttctgttttcaa

SEQ ID NO: 571329 - DNA, 15 bp, Homo sapiens
cttcttacccaaagc

SEQ ID NO: 571330 - DNA, 15 bp, Homo sapiens
cttcttactgtattt

SEQ ID NO: 571331 - DNA, 18 bp, Homo sapiens
cttcttgtgcccttaaaa

SEQ ID NO: 571332 - DNA, 14 bp, Homo sapiens
cttctttcccttcc

SEQ ID NO: 571333 - DNA, 18 bp, Homo sapiens
cttctttcccttcctcca

SEQ ID NO: 571334 - DNA, 19 bp, Homo sapiens
cttctttcccttcctccat

SEQ ID NO: 571335 - DNA, 16 bp, Homo sapiens
cttctttctagagcag

SEQ ID NO: 571336 - DNA, 21 bp, Homo sapiens
cttgaaattatatctgtggtc

SEQ ID NO: 571337 - DNA, 13 bp, Homo sapiens
cttgaagaactga

SEQ ID NO: 571338 - DNA, 22 bp, Homo sapiens
cttgaagaactgacttcctgaa

SEQ ID NO: 571339 - DNA, 16 bp, Homo sapiens
cttgaagcctgctcct

SEQ ID NO: 571340 - DNA, 18 bp, Homo sapiens
cttgaatgcttaaatgat

SEQ ID NO: 571341 - DNA, 19 bp, Homo sapiens
cttgaatgcttaaatgatc

SEQ ID NO: 571342 - DNA, 21 bp, Homo sapiens
cttgaatggcaatgttttgct

SEQ ID NO: 571343 - DNA, 19 bp, Homo sapiens
cttgacagagcctgcccca

SEQ ID NO: 571344 - DNA, 22 bp, Homo sapiens
cttgaccttctgtcgtccccag

SEQ ID NO: 571345 - DNA, 16 bp, Homo sapiens
cttgagcagctgaatt

SEQ ID NO: 571346 - DNA, 15 bp, Homo sapiens
cttgaggacctccac

SEQ ID NO: 571347 - DNA, 13 bp, Homo sapiens
cttgatttttcaa

SEQ ID NO: 571348 - DNA, 18 bp, Homo sapiens
cttgatttttcaaagact

SEQ ID NO: 571349 - DNA, 15 bp, Homo sapiens
cttgcaatttgaagg

SEQ ID NO: 571350 - DNA, 15 bp, Homo sapiens
cttgcacagtcactg

SEQ ID NO: 571351 - DNA, 19 bp, Homo sapiens
cttgcacagtcactgctct

SEQ ID NO: 571352 - DNA, 15 bp, Homo sapiens
cttgcatacaaacaa

SEQ ID NO: 571353 - DNA, 20 bp, Homo sapiens
cttgcatacaaacaagcata

SEQ ID NO: 571354 - DNA, 21 bp, Homo sapiens
cttgcatacaaacaagcatat

SEQ ID NO: 571355 - DNA, 23 bp, Homo sapiens
cttgcccactcctgctctgctcg

SEQ ID NO: 571356 - DNA, 21 bp, Homo sapiens
cttgcccatgctgggctcccg

SEQ ID NO: 571357 - DNA, 22 bp, Homo sapiens
cttgctaccacggcctcctttc

SEQ ID NO: 571358 - DNA, 18 bp, Homo sapiens
cttgctgtgaaatgactg

SEQ ID NO: 571359 - DNA, 15 bp, Homo sapiens
cttgctgtgacttat

SEQ ID NO: 571360 - DNA, 13 bp, Homo sapiens
cttgcttaaatgt

SEQ ID NO: 571361 - DNA, 16 bp, Homo sapiens
cttgcttaaatgtgaa

SEQ ID NO: 571362 - DNA, 19 bp, Homo sapiens
cttgctttatttttcatta

SEQ ID NO: 571363 - DNA, 20 bp, Homo sapiens
cttgctttatttttcattac

SEQ ID NO: 571364 - DNA, 20 bp, Homo sapiens
gaattgccacataattcatt

SEQ ID NO: 571365 - DNA, 19 bp, Homo sapiens
gaattggtttaaactttta

SEQ ID NO: 571366 - DNA, 20 bp, Homo sapiens
gaattttcattttacagtta

SEQ ID NO: 571367 - DNA, 18 bp, Homo sapiens
gacaaaattttataagca

SEQ ID NO: 571368 - DNA, 18 bp, Homo sapiens
gacaaatacacatacata

SEQ ID NO: 571369 - DNA, 14 bp, Homo sapiens
gacaaatagtaggc

SEQ ID NO: 571370 - DNA, 17 bp, Homo sapiens
gacaaatagtaggcaag

SEQ ID NO: 571371 - DNA, 21 bp, Homo sapiens
gacaaatagtaggcaagatgg

SEQ ID NO: 571372 - DNA, 12 bp, Homo sapiens
gacaagcacagt

SEQ ID NO: 571373 - DNA, 21 bp, Homo sapiens
gacaagctgttgaccaggcac

SEQ ID NO: 571374 - DNA, 18 bp, Homo sapiens
gacaaggtgcaggcaggc

SEQ ID NO: 571375 - DNA, 18 bp, Homo sapiens
gacaataagaaacagttt

SEQ ID NO: 571376 - DNA, 11 bp, Homo sapiens
gacaattctaa

SEQ ID NO: 571377 - DNA, 16 bp, Homo sapiens
gacaattctaatggta

SEQ ID NO: 571378 - DNA, 14 bp, Homo sapiens
gacaatttaccaca

SEQ ID NO: 571379 - DNA, 23 bp, Homo sapiens
gacacaaacaaacaagctaggtg

SEQ ID NO: 571380 - DNA, 15 bp, Homo sapiens
gacacacacacgcac

SEQ ID NO: 571381 - DNA, 18 bp, Homo sapiens
gacacacacacgcacgca

SEQ ID NO: 571382 - DNA, 21 bp, Homo sapiens
gacacacacacgcacgcacac

SEQ ID NO: 571383 - DNA, 22 bp, Homo sapiens
gacacacacacgcacgcacaca

SEQ ID NO: 571384 - DNA, 23 bp, Homo sapiens
gacacacacacgcacgcacacac

SEQ ID NO: 571385 - DNA, 21 bp, Homo sapiens
gacacacacatatatacatac

SEQ ID NO: 571386 - DNA, 14 bp, Homo sapiens
gacacagagggccc

SEQ ID NO: 571387 - DNA, 19 bp, Homo sapiens
gacacagcagcttcaccag

SEQ ID NO: 571388 - DNA, 20 bp, Homo sapiens
gacacagcagcttcaccaga

SEQ ID NO: 571389 - DNA, 12 bp, Homo sapiens
gacacccagaaa

SEQ ID NO: 571390 - DNA, 14 bp, Homo sapiens
gacacccccttggt

SEQ ID NO: 571391 - DNA, 15 bp, Homo sapiens
gacacccccttggtg

SEQ ID NO: 571392 - DNA, 18 bp, Homo sapiens
gacacggcctctggggag

SEQ ID NO: 571393 - DNA, 19 bp, Homo sapiens
gacacggcctctggggaga

SEQ ID NO: 571394 - DNA, 22 bp, Homo sapiens
gacacgtttggccagtgacatt

SEQ ID NO: 571395 - DNA, 12 bp, Homo sapiens
gacactcctggg

SEQ ID NO: 571396 - DNA, 13 bp, Homo sapiens
gacactggtctca

SEQ ID NO: 571397 - DNA, 14 bp, Homo sapiens
gacactggtctcag

SEQ ID NO: 571398 - DNA, 13 bp, Homo sapiens
gacagagcctgcc

SEQ ID NO: 571399 - DNA, 17 bp, Homo sapiens
gacagagcgacagagca

SEQ ID NO: 571400 - DNA, 14 bp, Homo sapiens
gacagcaaacacag

SEQ ID NO: 571401 - DNA, 19 bp, Homo sapiens
gacagcagtcttatgcttc

SEQ ID NO: 571402 - DNA, 13 bp, Homo sapiens
gacagccagaact

SEQ ID NO: 571403 - DNA, 15 bp, Homo sapiens
gacagcccctccctc

SEQ ID NO: 571404 - DNA, 17 bp, Homo sapiens
gacagcccctccctcct

SEQ ID NO: 571405 - DNA, 15 bp, Homo sapiens
gacaggaacacccag

SEQ ID NO: 571406 - DNA, 20 bp, Homo sapiens
gacaggggagggggcaaagg

SEQ ID NO: 571407 - DNA, 23 bp, Homo sapiens
gacagtcaggaagcctcctgctg

SEQ ID NO: 571408 - DNA, 15 bp, Homo sapiens
gacagtgaggtcctg

SEQ ID NO: 571409 - DNA, 10 bp, Homo sapiens
gacagtgcct

SEQ ID NO: 571410 - DNA, 18 bp, Homo sapiens
gacatcggttcaggagga

SEQ ID NO: 571411 - DNA, 15 bp, Homo sapiens
gacatgcacccgcat

SEQ ID NO: 571412 - DNA, 22 bp, Homo sapiens
gacatgcacccgcatgtacaaa

SEQ ID NO: 571413 - DNA, 18 bp, Homo sapiens
gacatgcgggctgggcag

SEQ ID NO: 571414 - DNA, 20 bp, Homo sapiens
gacatgcgggctgggcagct

SEQ ID NO: 571415 - DNA, 13 bp, Homo sapiens
gacattatgtgtg

SEQ ID NO: 571416 - DNA, 16 bp, Homo sapiens
gacatttgtcattttc

SEQ ID NO: 571417 - DNA, 20 bp, Homo sapiens
gacatttgtcattttcatta

SEQ ID NO: 571418 - DNA, 13 bp, Homo sapiens
gaccaactccaga

SEQ ID NO: 571419 - DNA, 16 bp, Homo sapiens
gaccaaggaacaagac

SEQ ID NO: 571420 - DNA, 23 bp, Homo sapiens
gaccaaggaacaagacccccagg

SEQ ID NO: 571421 - DNA, 22 bp, Homo sapiens
gaccaatcgggagtagcaagga

SEQ ID NO: 571422 - DNA, 13 bp, Homo sapiens
gaccaattttaac

SEQ ID NO: 571423 - DNA, 13 bp, Homo sapiens
gaccacagacact

SEQ ID NO: 571424 - DNA, 16 bp, Homo sapiens
gaccacagacactcct

SEQ ID NO: 571425 - DNA, 11 bp, Homo sapiens
gaccactgtct

SEQ ID NO: 571426 - DNA, 22 bp, Homo sapiens
gaccactgtctccacccacctt

SEQ ID NO: 571427 - DNA, 12 bp, Homo sapiens
gaccagcctggc

SEQ ID NO: 571428 - DNA, 17 bp, Homo sapiens
gaccaggactctgcctt

SEQ ID NO: 571429 - DNA, 19 bp, Homo sapiens
gaccagggctggggcagcc

SEQ ID NO: 571430 - DNA, 13 bp, Homo sapiens
gaccaggtgacct

SEQ ID NO: 571431 - DNA, 14 bp, Homo sapiens
gaccagtagtgacc

SEQ ID NO: 571432 - DNA, 15 bp, Homo sapiens
gaccagtagtgacca

SEQ ID NO: 571433 - DNA, 16 bp, Homo sapiens
gaccagtagtgaccaa

SEQ ID NO: 571434 - DNA, 18 bp, Homo sapiens
gaccatggggtggaagga

SEQ ID NO: 571435 - DNA, 19 bp, Homo sapiens
gaccatggggtggaaggag

SEQ ID NO: 571436 - DNA, 17 bp, Homo sapiens
gaccatttaacatgcaa

SEQ ID NO: 571437 - DNA, 19 bp, Homo sapiens
gaccatttagtcctcacct

SEQ ID NO: 571438 - DNA, 20 bp, Homo sapiens
gaccatttctctgcaggcca

SEQ ID NO: 571439 - DNA, 13 bp, Homo sapiens
gaccattttcctg

SEQ ID NO: 571440 - DNA, 17 bp, Homo sapiens
gacccatgaaacagcag

SEQ ID NO: 571441 - DNA, 18 bp, Homo sapiens
gacccatgaaacagcagc

SEQ ID NO: 571442 - DNA, 11 bp, Homo sapiens
gaccccagaat

SEQ ID NO: 571443 - DNA, 16 bp, Homo sapiens
gaccccatccagccag

SEQ ID NO: 571444 - DNA, 14 bp, Homo sapiens
gaccccatctgctg

SEQ ID NO: 571445 - DNA, 15 bp, Homo sapiens
gaccccatctgctga

SEQ ID NO: 571446 - DNA, 12 bp, Homo sapiens
gacccccaggaa

SEQ ID NO: 571447 - DNA, 21 bp, Homo sapiens
gacccccaggaaggaaacaga

SEQ ID NO: 571448 - DNA, 22 bp, Homo sapiens
gacccccaggaaggaaacagat

SEQ ID NO: 571449 - DNA, 15 bp, Homo sapiens
gacccccccagcttc

SEQ ID NO: 571450 - DNA, 16 bp, Homo sapiens
gacccccctcaggacc

SEQ ID NO: 571451 - DNA, 18 bp, Homo sapiens
gacccccctcaggaccct

SEQ ID NO: 571452 - DNA, 15 bp, Homo sapiens
gaccctcgctggccc

SEQ ID NO: 571453 - DNA, 16 bp, Homo sapiens
gaccctcggggcagga

SEQ ID NO: 571454 - DNA, 20 bp, Homo sapiens
gaccctgagggtttccacct

SEQ ID NO: 571455 - DNA, 14 bp, Homo sapiens
gaccctggagcccg

SEQ ID NO: 571456 - DNA, 15 bp, Homo sapiens
gaccgaaggtgacag

SEQ ID NO: 571457 - DNA, 21 bp, Homo sapiens
gaccgagtgtggagctgcttc

SEQ ID NO: 571458 - DNA, 22 bp, Homo sapiens
gaccgagtgtggagctgcttcc

SEQ ID NO: 571459 - DNA, 18 bp, Homo sapiens
gaccggggtcctgaggct

SEQ ID NO: 571460 - DNA, 20 bp, Homo sapiens
gaccggggtcctgaggctgg

SEQ ID NO: 571461 - DNA, 15 bp, Homo sapiens
gacctaaccagggcc

SEQ ID NO: 571462 - DNA, 18 bp, Homo sapiens
gacctaaccagggccaga

SEQ ID NO: 571463 - DNA, 16 bp, Homo sapiens
gacctcacagagtatg

SEQ ID NO: 571464 - DNA, 16 bp, Homo sapiens
gacctccacctgggag

SEQ ID NO: 571465 - DNA, 17 bp, Homo sapiens
gacctccacctgggaga

SEQ ID NO: 571466 - DNA, 18 bp, Homo sapiens
gacctccacctgggagat

SEQ ID NO: 571467 - DNA, 12 bp, Homo sapiens
gacctccccctc

SEQ ID NO: 571468 - DNA, 15 bp, Homo sapiens
gacctccccctcctt

SEQ ID NO: 571469 - DNA, 14 bp, Homo sapiens
gacctcttagaaaa

SEQ ID NO: 571470 - DNA, 20 bp, Homo sapiens
gacctgcccccgctctgcca

SEQ ID NO: 571471 - DNA, 16 bp, Homo sapiens
gacctggcctgtctgt

SEQ ID NO: 571472 - DNA, 17 bp, Homo sapiens
gacctgggccctggttc

SEQ ID NO: 571473 - DNA, 18 bp, Homo sapiens
gacctgttaaaattatac

SEQ ID NO: 571474 - DNA, 23 bp, Homo sapiens
gacctgttctttccatctttaga

SEQ ID NO: 571475 - DNA, 22 bp, Homo sapiens
gaccttctgtcgtccccagacc

SEQ ID NO: 571476 - DNA, 16 bp, Homo sapiens
gaccttgtaatgtaac

SEQ ID NO: 571477 - DNA, 20 bp, Homo sapiens
gacctttgggttctttctgg

SEQ ID NO: 571478 - DNA, 20 bp, Homo sapiens
gacgaggccaagctgaggag

SEQ ID NO: 571479 - DNA, 18 bp, Homo sapiens
gacgcagggagaccctgg

SEQ ID NO: 571480 - DNA, 23 bp, Homo sapiens
gacgcagggagaccctgggagag

SEQ ID NO: 571481 - DNA, 18 bp, Homo sapiens
gacgcctgcttttgcaaa

SEQ ID NO: 571482 - DNA, 12 bp, Homo sapiens
gacgtccctcca

SEQ ID NO: 571483 - DNA, 23 bp, Homo sapiens
gactaagatcggttaacaaataa

SEQ ID NO: 571484 - DNA, 12 bp, Homo sapiens
gactatatacat

SEQ ID NO: 571485 - DNA, 20 bp, Homo sapiens
gactatccattttacacttg

SEQ ID NO: 571486 - DNA, 12 bp, Homo sapiens
gactcaaagatg

SEQ ID NO: 571487 - DNA, 11 bp, Homo sapiens
gactccagaaa

SEQ ID NO: 571488 - DNA, 22 bp, Homo sapiens
gactcgggctaagtccagctct

SEQ ID NO: 571489 - DNA, 21 bp, Homo sapiens
gactctaaaactatcagcagc

SEQ ID NO: 571490 - DNA, 22 bp, Homo sapiens
gactctaaaactatcagcagcg

SEQ ID NO: 571491 - DNA, 16 bp, Homo sapiens
gactctgtggggccac

SEQ ID NO: 571492 - DNA, 18 bp, Homo sapiens
gactctgtggggccacac

SEQ ID NO: 571493 - DNA, 10 bp, Homo sapiens
gactcttccc

SEQ ID NO: 571494 - DNA, 16 bp, Homo sapiens
gactgggccaggggag

SEQ ID NO: 571495 - DNA, 22 bp, Homo sapiens
gactgtaaattccaaagatctg

SEQ ID NO: 571496 - DNA, 15 bp, Homo sapiens
gactgtggcctcagg

SEQ ID NO: 571497 - DNA, 22 bp, Homo sapiens
gacttaactttaacttttgaaa

SEQ ID NO: 571498 - DNA, 19 bp, Homo sapiens
gacttagtggacaggggag

SEQ ID NO: 571499 - DNA, 22 bp, Homo sapiens
gacttcatttaacactgagtga

SEQ ID NO: 571500 - DNA, 15 bp, Homo sapiens
gacttcatttttcct

SEQ ID NO: 571501 - DNA, 22 bp, Homo sapiens
gacttcctgattggtttctctt

SEQ ID NO: 571502 - DNA, 17 bp, Homo sapiens
gacttctgttttcaatc

SEQ ID NO: 571503 - DNA, 11 bp, Homo sapiens
gacttcttacc

SEQ ID NO: 571504 - DNA, 23 bp, Homo sapiens
gacttggtcttttttctgggtct

SEQ ID NO: 571505 - DNA, 17 bp, Homo sapiens
gagaaaaccccttccca

SEQ ID NO: 571506 - DNA, 22 bp, Homo sapiens
gagaaccgagcaaagatcaaaa

SEQ ID NO: 571507 - DNA, 16 bp, Homo sapiens
gagaagcctcatggga

SEQ ID NO: 571508 - DNA, 23 bp, Homo sapiens
gagaatgagggcgtgaaacacaa

SEQ ID NO: 571509 - DNA, 16 bp, Homo sapiens
gagacagtcaggaagc

SEQ ID NO: 571510 - DNA, 17 bp, Homo sapiens
gagacagttatttatag

SEQ ID NO: 571511 - DNA, 15 bp, Homo sapiens
gagaccaggactctg

SEQ ID NO: 571512 - DNA, 20 bp, Homo sapiens
gagaccgagtgtggagctgc

SEQ ID NO: 571513 - DNA, 14 bp, Homo sapiens
gagactcaggccca

SEQ ID NO: 571514 - DNA, 15 bp, Homo sapiens
gagactcaggcccac

SEQ ID NO: 571515 - DNA, 15 bp, Homo sapiens
gagagagatgtgtaa

SEQ ID NO: 571516 - DNA, 18 bp, Homo sapiens
gagagaggctaaaatgtt

SEQ ID NO: 571517 - DNA, 20 bp, Homo sapiens
gagagaggctaaaatgtttt

SEQ ID NO: 571518 - DNA, 11 bp, Homo sapiens
gagagcctggt

SEQ ID NO: 571519 - DNA, 18 bp, Homo sapiens
gagagcttagcctggagc

SEQ ID NO: 571520 - DNA, 16 bp, Homo sapiens
gagaggctaaaatgtt

SEQ ID NO: 571521 - DNA, 18 bp, Homo sapiens
gagaggggagagctgaac

SEQ ID NO: 571522 - DNA, 16 bp, Homo sapiens
gagagtttagctgtaa

SEQ ID NO: 571523 - DNA, 21 bp, Homo sapiens
gagatacttggtcacagccag

SEQ ID NO: 571524 - DNA, 23 bp, Homo sapiens
gagatacttggtcacagccaggc

SEQ ID NO: 571525 - DNA, 21 bp, Homo sapiens
gagataggaaggtcatttcca

SEQ ID NO: 571526 - DNA, 15 bp, Homo sapiens
gagatcactgaactt

SEQ ID NO: 571527 - DNA, 21 bp, Homo sapiens
gagatcactgaacttttcaaa

SEQ ID NO: 571528 - DNA, 17 bp, Homo sapiens
gagatccgccctgggct

SEQ ID NO: 571529 - DNA, 19 bp, Homo sapiens
gagatccgccctgggctct

SEQ ID NO: 571530 - DNA, 16 bp, Homo sapiens
gagatgctgggaccct

SEQ ID NO: 571531 - DNA, 17 bp, Homo sapiens
gagatgtgtaatttttc

SEQ ID NO: 571532 - DNA, 22 bp, Homo sapiens
gagatttaccagggatgtagat

SEQ ID NO: 571533 - DNA, 22 bp, Homo sapiens
gagcaaaagcctcagaaaggga

SEQ ID NO: 571534 - DNA, 20 bp, Homo sapiens
gagcaaactgaagcccacag

SEQ ID NO: 571535 - DNA, 13 bp, Homo sapiens
gagcaaagatcaa

SEQ ID NO: 571536 - DNA, 19 bp, Homo sapiens
gagcacagccaatctccag

SEQ ID NO: 571537 - DNA, 21 bp, Homo sapiens
gagcacagccaatctccaggc

SEQ ID NO: 571538 - DNA, 15 bp, Homo sapiens
gagcattacaggcaa

SEQ ID NO: 571539 - DNA, 16 bp, Homo sapiens
gagcattacaggcaag

SEQ ID NO: 571540 - DNA, 23 bp, Homo sapiens
gagcattataatcaccagggcca

SEQ ID NO: 571541 - DNA, 17 bp, Homo sapiens
gagcatttggtacacac

SEQ ID NO: 571542 - DNA, 21 bp, Homo sapiens
gagccgagctctcctgggcca

SEQ ID NO: 571543 - DNA, 13 bp, Homo sapiens
gagcctctggaag

SEQ ID NO: 571544 - DNA, 18 bp, Homo sapiens
gagcctgcagggtgacct

SEQ ID NO: 571545 - DNA, 17 bp, Homo sapiens
gagcctgccccagcgct

SEQ ID NO: 571546 - DNA, 16 bp, Homo sapiens
gagcctgcgtggcctg

SEQ ID NO: 571547 - DNA, 14 bp, Homo sapiens
gagcgacagagcag

SEQ ID NO: 571548 - DNA, 16 bp, Homo sapiens
gagcgatgtgttcttt

SEQ ID NO: 571549 - DNA, 14 bp, Homo sapiens
gagcgcagctgcat

SEQ ID NO: 571550 - DNA, 20 bp, Homo sapiens
gagcggagacgggaggcctg

SEQ ID NO: 571551 - DNA, 16 bp, Homo sapiens
gagcggattgcaaagc

SEQ ID NO: 571552 - DNA, 13 bp, Homo sapiens
gagctaggcaggg

SEQ ID NO: 571553 - DNA, 18 bp, Homo sapiens
gagctcagcacagcctca

SEQ ID NO: 571554 - DNA, 13 bp, Homo sapiens
gagctcccaggac

SEQ ID NO: 571555 - DNA, 16 bp, Homo sapiens
gagctcctggccagga

SEQ ID NO: 571556 - DNA, 18 bp, Homo sapiens
gagctctcctgggccagg

SEQ ID NO: 571557 - DNA, 20 bp, Homo sapiens
gagctctcctgggccagggt

SEQ ID NO: 571558 - DNA, 17 bp, Homo sapiens
gagctgcttccagttgg

SEQ ID NO: 571559 - DNA, 14 bp, Homo sapiens
gagctttctcaatg

SEQ ID NO: 571560 - DNA, 13 bp, Homo sapiens
gaggaaaaatatg

SEQ ID NO: 571561 - DNA, 17 bp, Homo sapiens
gaggaaaaatatgtgaa

SEQ ID NO: 571562 - DNA, 16 bp, Homo sapiens
gaggaaaaggcttgag

SEQ ID NO: 571563 - DNA, 16 bp, Homo sapiens
gaggaaatcctacctt

SEQ ID NO: 571564 - DNA, 13 bp, Homo sapiens
gaggacaaggaaa

SEQ ID NO: 571565 - DNA, 13 bp, Homo sapiens
gaggacctgcccg

SEQ ID NO: 571566 - DNA, 18 bp, Homo sapiens
gaggacgtgggcggcaga

SEQ ID NO: 571567 - DNA, 16 bp, Homo sapiens
gaggagactcaggccc

SEQ ID NO: 571568 - DNA, 17 bp, Homo sapiens
gaggagactcaggccca

SEQ ID NO: 571569 - DNA, 21 bp, Homo sapiens
gaggaggccttgggctctgct

SEQ ID NO: 571570 - DNA, 20 bp, Homo sapiens
gaggcacacagctgcagaga

SEQ ID NO: 571571 - DNA, 18 bp, Homo sapiens
gaggcaggtgacagtgag

SEQ ID NO: 571572 - DNA, 21 bp, Homo sapiens
gaggcagtggcttggagcaga

SEQ ID NO: 571573 - DNA, 20 bp, Homo sapiens
gaggcagttgcccagcctct

SEQ ID NO: 571574 - DNA, 17 bp, Homo sapiens
gaggccaagctgaggag

SEQ ID NO: 571575 - DNA, 21 bp, Homo sapiens
gaggcggagagtgctgactgt

SEQ ID NO: 571576 - DNA, 13 bp, Homo sapiens
gaggctaaaatgt

SEQ ID NO: 571577 - DNA, 14 bp, Homo sapiens
gaggctccaggcag

SEQ ID NO: 571578 - DNA, 16 bp, Homo sapiens
gaggctccaggcagca

SEQ ID NO: 571579 - DNA, 21 bp, Homo sapiens
gaggctccatccttctcccca

SEQ ID NO: 571580 - DNA, 18 bp, Homo sapiens
gaggctgaggcaggagaa

SEQ ID NO: 571581 - DNA, 19 bp, Homo sapiens
gaggctgggacgctctgct

SEQ ID NO: 571582 - DNA, 21 bp, Homo sapiens
gaggctgggacgctctgctgt

SEQ ID NO: 571583 - DNA, 12 bp, Homo sapiens
gagggaggcctg

SEQ ID NO: 571584 - DNA, 13 bp, Homo sapiens
gagggaggcctga

SEQ ID NO: 571585 - DNA, 13 bp, Homo sapiens
gaggggagctctg

SEQ ID NO: 571586 - DNA, 18 bp, Homo sapiens
gaggggagctctgtctgt

SEQ ID NO: 571587 - DNA, 20 bp, Homo sapiens
gaggggcggggccaggatgg

SEQ ID NO: 571588 - DNA, 12 bp, Homo sapiens
gagggtttccac

SEQ ID NO: 571589 - DNA, 13 bp, Homo sapiens
gaggtcaggagtt

SEQ ID NO: 571590 - DNA, 14 bp, Homo sapiens
gaggtgcctgagag

SEQ ID NO: 571591 - DNA, 19 bp, Homo sapiens
gaggtgcctgagagcagaa

SEQ ID NO: 571592 - DNA, 14 bp, Homo sapiens
gagtagcaaggaag

SEQ ID NO: 571593 - DNA, 19 bp, Homo sapiens
gagtagcaaggaaggacac

SEQ ID NO: 571594 - DNA, 21 bp, Homo sapiens
gagtagtgaagactccagaaa

SEQ ID NO: 571595 - DNA, 18 bp, Homo sapiens
gagtatatgtaacagttt

SEQ ID NO: 571596 - DNA, 21 bp, Homo sapiens
gagtatggtgctgggtcctta

SEQ ID NO: 571597 - DNA, 20 bp, Homo sapiens
gagtcagcctcgcaggcctc

SEQ ID NO: 571598 - DNA, 14 bp, Homo sapiens
gagtcagggagccc

SEQ ID NO: 571599 - DNA, 17 bp, Homo sapiens
gagtcagggagccctgg

SEQ ID NO: 571600 - DNA, 15 bp, Homo sapiens
gagtcagtcgccttt

SEQ ID NO: 571601 - DNA, 22 bp, Homo sapiens
gagtccaacgtggggcagcaca

SEQ ID NO: 571602 - DNA, 18 bp, Homo sapiens
gagtccagacctgggccc

SEQ ID NO: 571603 - DNA, 20 bp, Homo sapiens
gagtccagacctgggccctg

SEQ ID NO: 571604 - DNA, 15 bp, Homo sapiens
gagtccaggagctca

SEQ ID NO: 571605 - DNA, 22 bp, Homo sapiens
gagtcctcattgttcagaaaag

SEQ ID NO: 571606 - DNA, 21 bp, Homo sapiens
gagtcctccagaactcttcct

SEQ ID NO: 571607 - DNA, 19 bp, Homo sapiens
gagtctagcgtagtgcagc

SEQ ID NO: 571608 - DNA, 16 bp, Homo sapiens
gagtctcattcctctg

SEQ ID NO: 571609 - DNA, 21 bp, Homo sapiens
gagtctggagaccaggactct

SEQ ID NO: 571610 - DNA, 13 bp, Homo sapiens
gagtgaagagcat

SEQ ID NO: 571611 - DNA, 16 bp, Homo sapiens
gagtgaagagtgaaga

SEQ ID NO: 571612 - DNA, 18 bp, Homo sapiens
gagtgaagagtgaagagc

SEQ ID NO: 571613 - DNA, 22 bp, Homo sapiens
gagtgacatcggttcaggagga

SEQ ID NO: 571614 - DNA, 16 bp, Homo sapiens
gagtgaggtcatcccg

SEQ ID NO: 571615 - DNA, 12 bp, Homo sapiens
gagtgccccaga

SEQ ID NO: 571616 - DNA, 13 bp, Homo sapiens
gagtgccccagaa

SEQ ID NO: 571617 - DNA, 17 bp, Homo sapiens
gagtgggtgggacacag

SEQ ID NO: 571618 - DNA, 20 bp, Homo sapiens
gagtggtccacattctgctg

SEQ ID NO: 571619 - DNA, 13 bp, Homo sapiens
gagttcatcccag

SEQ ID NO: 571620 - DNA, 18 bp, Homo sapiens
gagttcattcatattaca

SEQ ID NO: 571621 - DNA, 23 bp, Homo sapiens
gagtttgccccgttctgtttgta

SEQ ID NO: 571622 - DNA, 12 bp, Homo sapiens
gagtttgtttct

SEQ ID NO: 571623 - DNA, 15 bp, Homo sapiens
gataacagagtgatt

SEQ ID NO: 571624 - DNA, 14 bp, Homo sapiens
gataaccatagcat

SEQ ID NO: 571625 - DNA, 18 bp, Homo sapiens
gataagttggaaacacta

SEQ ID NO: 571626 - DNA, 19 bp, Homo sapiens
gataagttggaaacactaa

SEQ ID NO: 571627 - DNA, 22 bp, Homo sapiens
gataagttggaaacactaaatg

SEQ ID NO: 571628 - DNA, 17 bp, Homo sapiens
gataatggtaatttagt

SEQ ID NO: 571629 - DNA, 17 bp, Homo sapiens
gataccttaaaatttga

SEQ ID NO: 571630 - DNA, 21 bp, Homo sapiens
gatacgagttttggccgggtg

SEQ ID NO: 571631 - DNA, 13 bp, Homo sapiens
gatactgcctccc

SEQ ID NO: 571632 - DNA, 14 bp, Homo sapiens
gataggagaggaaa

SEQ ID NO: 571633 - DNA, 17 bp, Homo sapiens
gataggagaggaaaagg

SEQ ID NO: 571634 - DNA, 13 bp, Homo sapiens
gataggggcagag

SEQ ID NO: 571635 - DNA, 13 bp, Homo sapiens
gatataatgtatt

SEQ ID NO: 571636 - DNA, 21 bp, Homo sapiens
gatatcaggaaatatctgtga

SEQ ID NO: 571637 - DNA, 20 bp, Homo sapiens
gatatctgtttgcttctaaa

SEQ ID NO: 571638 - DNA, 20 bp, Homo sapiens
gatatgagaaatataaaaat

SEQ ID NO: 571639 - DNA, 11 bp, Homo sapiens
gccagtcttaa

SEQ ID NO: 571640 - DNA, 15 bp, Homo sapiens
gccagtttagagttc

SEQ ID NO: 571641 - DNA, 20 bp, Homo sapiens
gccataagcaacaattttca

SEQ ID NO: 571642 - DNA, 13 bp, Homo sapiens
gccatcagcccct

SEQ ID NO: 571643 - DNA, 14 bp, Homo sapiens
gccatcagcccctg

SEQ ID NO: 571644 - DNA, 20 bp, Homo sapiens
gccatgaactggaggccagg

SEQ ID NO: 571645 - DNA, 16 bp, Homo sapiens
gccatggaagctggca

SEQ ID NO: 571646 - DNA, 23 bp, Homo sapiens
gccatggaagctggcaggagaca

SEQ ID NO: 571647 - DNA, 15 bp, Homo sapiens
gccatggaggcacac

SEQ ID NO: 571648 - DNA, 18 bp, Homo sapiens
gccattctggcactttaa

SEQ ID NO: 571649 - DNA, 19 bp, Homo sapiens
gccattctggcactttaat

SEQ ID NO: 571650 - DNA, 21 bp, Homo sapiens
gcccaacaggggctccatgcc

SEQ ID NO: 571651 - DNA, 13 bp, Homo sapiens
gcccaaccacact

SEQ ID NO: 571652 - DNA, 23 bp, Homo sapiens
gcccacatccggggccagctccg

SEQ ID NO: 571653 - DNA, 21 bp, Homo sapiens
gcccaccaggcccccctgtca

SEQ ID NO: 571654 - DNA, 17 bp, Homo sapiens
gcccactcctgctctgc

SEQ ID NO: 571655 - DNA, 18 bp, Homo sapiens
gcccagaccctggaggaa

SEQ ID NO: 571656 - DNA, 18 bp, Homo sapiens
gcccagatcagccagaag

SEQ ID NO: 571657 - DNA, 21 bp, Homo sapiens
gcccagcctatctctcttctg

SEQ ID NO: 571658 - DNA, 11 bp, Homo sapiens
gcccaggagcg

SEQ ID NO: 571659 - DNA, 13 bp, Homo sapiens
gcccaggagcgca

SEQ ID NO: 571660 - DNA, 13 bp, Homo sapiens
gcccaggagggag

SEQ ID NO: 571661 - DNA, 18 bp, Homo sapiens
gcccaggcatctccttgg

SEQ ID NO: 571662 - DNA, 20 bp, Homo sapiens
gcccaggcatctccttgggc

SEQ ID NO: 571663 - DNA, 13 bp, Homo sapiens
gcccatgccctcc

SEQ ID NO: 571664 - DNA, 23 bp, Homo sapiens
gcccatgccctccgtcctggcag

SEQ ID NO: 571665 - DNA, 16 bp, Homo sapiens
gccccacctgcagctc

SEQ ID NO: 571666 - DNA, 16 bp, Homo sapiens
gccccactacaggccc

SEQ ID NO: 571667 - DNA, 20 bp, Homo sapiens
gccccagaaatgccgctgtg

SEQ ID NO: 571668 - DNA, 17 bp, Homo sapiens
gccccattttctttaca

SEQ ID NO: 571669 - DNA, 18 bp, Homo sapiens
gccccattttctttacag

SEQ ID NO: 571670 - DNA, 16 bp, Homo sapiens
gcccccacacctggcc

SEQ ID NO: 571671 - DNA, 18 bp, Homo sapiens
gcccccacacctggccct

SEQ ID NO: 571672 - DNA, 19 bp, Homo sapiens
gcccccactggctgtgggc

SEQ ID NO: 571673 - DNA, 17 bp, Homo sapiens
gcccccagaccccatcc

SEQ ID NO: 571674 - DNA, 12 bp, Homo sapiens
gcccccagacgc

SEQ ID NO: 571675 - DNA, 22 bp, Homo sapiens
gcccccaggtctgatctgggtt

SEQ ID NO: 571676 - DNA, 20 bp, Homo sapiens
gccccctggcccctcccaca

SEQ ID NO: 571677 - DNA, 13 bp, Homo sapiens
gcccctccctcct

SEQ ID NO: 571678 - DNA, 17 bp, Homo sapiens
gcccctccctcctctga

SEQ ID NO: 571679 - DNA, 17 bp, Homo sapiens
gccctcattacggctcc

SEQ ID NO: 571680 - DNA, 18 bp, Homo sapiens
gccctcattacggctcct

SEQ ID NO: 571681 - DNA, 20 bp, Homo sapiens
gccctcattacggctcctct

SEQ ID NO: 571682 - DNA, 21 bp, Homo sapiens
gccctcattacggctcctctc

SEQ ID NO: 571683 - DNA, 18 bp, Homo sapiens
gccctccgcccttccctg

SEQ ID NO: 571684 - DNA, 18 bp, Homo sapiens
gccctccgtcctggcagg

SEQ ID NO: 571685 - DNA, 14 bp, Homo sapiens
gccctggcaggcag

SEQ ID NO: 571686 - DNA, 15 bp, Homo sapiens
gccctgggctctggg

SEQ ID NO: 571687 - DNA, 14 bp, Homo sapiens
gccctggggcctgt

SEQ ID NO: 571688 - DNA, 17 bp, Homo sapiens
gccctggggcctgtaca

SEQ ID NO: 571689 - DNA, 21 bp, Homo sapiens
gccctggggtttccacacagg

SEQ ID NO: 571690 - DNA, 23 bp, Homo sapiens
gccctggggtttccacacaggcc

SEQ ID NO: 571691 - DNA, 17 bp, Homo sapiens
gccctgtcaggaggcag

SEQ ID NO: 571692 - DNA, 15 bp, Homo sapiens
gcccttccaaactct

SEQ ID NO: 571693 - DNA, 13 bp, Homo sapiens
gcccttcctctgc

SEQ ID NO: 571694 - DNA, 18 bp, Homo sapiens
gcccttgcttacctctca

SEQ ID NO: 571695 - DNA, 22 bp, Homo sapiens
gccctttgtcctcctgctgcca

SEQ ID NO: 571696 - DNA, 15 bp, Homo sapiens
gccgagtgccccaga

SEQ ID NO: 571697 - DNA, 11 bp, Homo sapiens
gccgctccaga

SEQ ID NO: 571698 - DNA, 12 bp, Homo sapiens
gccgctccagag

SEQ ID NO: 571699 - DNA, 22 bp, Homo sapiens
gccgtcccaaccctgcccagcc

SEQ ID NO: 571700 - DNA, 20 bp, Homo sapiens
gccgtgcacggggccagcat

SEQ ID NO: 571701 - DNA, 15 bp, Homo sapiens
gccgtggctgcggca

SEQ ID NO: 571702 - DNA, 20 bp, Homo sapiens
gcctaatattgaaaatgtca

SEQ ID NO: 571703 - DNA, 23 bp, Homo sapiens
gcctaatattgaaaatgtcactg

SEQ ID NO: 571704 - DNA, 19 bp, Homo sapiens
gcctactagggacctgggg

SEQ ID NO: 571705 - DNA, 21 bp, Homo sapiens
gcctagtggcttcagcccctg

SEQ ID NO: 571706 - DNA, 21 bp, Homo sapiens
gcctatagattgatttacctt

SEQ ID NO: 571707 - DNA, 11 bp, Homo sapiens
gcctcacccct

SEQ ID NO: 571708 - DNA, 17 bp, Homo sapiens
gcctcacccctgcaggc

SEQ ID NO: 571709 - DNA, 18 bp, Homo sapiens
gcctcacccctgcaggcg

SEQ ID NO: 571710 - DNA, 20 bp, Homo sapiens
gcctcagcaaacccaaagat

SEQ ID NO: 571711 - DNA, 20 bp, Homo sapiens
gcctcatcagtatttggact

SEQ ID NO: 571712 - DNA, 13 bp, Homo sapiens
gcctcatgggagt

SEQ ID NO: 571713 - DNA, 20 bp, Homo sapiens
gcctcatgggagtcagggag

SEQ ID NO: 571714 - DNA, 14 bp, Homo sapiens
gcctccctgccagt

SEQ ID NO: 571715 - DNA, 18 bp, Homo sapiens
gcctcctgtggcctgcca

SEQ ID NO: 571716 - DNA, 20 bp, Homo sapiens
gcctcctgtggcctgccagt

SEQ ID NO: 571717 - DNA, 18 bp, Homo sapiens
gcctcgcaggcctccctg

SEQ ID NO: 571718 - DNA, 21 bp, Homo sapiens
gcctcgcaggcctccctgcca

SEQ ID NO: 571719 - DNA, 22 bp, Homo sapiens
gcctcggttgcggacctaggac

SEQ ID NO: 571720 - DNA, 12 bp, Homo sapiens
gcctctgaactg

SEQ ID NO: 571721 - DNA, 18 bp, Homo sapiens
gcctctgaactgctgctg

SEQ ID NO: 571722 - DNA, 21 bp, Homo sapiens
gcctctgaactgctgctggtc

SEQ ID NO: 571723 - DNA, 23 bp, Homo sapiens
gcctctgattctatgtaacttgt

SEQ ID NO: 571724 - DNA, 12 bp, Homo sapiens
gcctctggggag

SEQ ID NO: 571725 - DNA, 15 bp, Homo sapiens
gcctctggggagacc

SEQ ID NO: 571726 - DNA, 12 bp, Homo sapiens
gcctctttccct

SEQ ID NO: 571727 - DNA, 19 bp, Homo sapiens
gcctgaaagcaacagctgg

SEQ ID NO: 571728 - DNA, 21 bp, Homo sapiens
gcctgaaggaggtgagagaag

SEQ ID NO: 571729 - DNA, 14 bp, Homo sapiens
gcctgacctccccc

SEQ ID NO: 571730 - DNA, 15 bp, Homo sapiens
gcctgacctccccct

SEQ ID NO: 571731 - DNA, 21 bp, Homo sapiens
gcctgactcccccagtcccct

SEQ ID NO: 571732 - DNA, 15 bp, Homo sapiens
gcctgagagcagaat

SEQ ID NO: 571733 - DNA, 14 bp, Homo sapiens
gcctgagatgcctg

SEQ ID NO: 571734 - DNA, 13 bp, Homo sapiens
gcctgaggggcag

SEQ ID NO: 571735 - DNA, 20 bp, Homo sapiens
gcctgaggggcagcctgcct

SEQ ID NO: 571736 - DNA, 22 bp, Homo sapiens
gcctgcagggtgacctgcttcc

SEQ ID NO: 571737 - DNA, 19 bp, Homo sapiens
gcctgccctttgtcctcct

SEQ ID NO: 571738 - DNA, 15 bp, Homo sapiens
gcctgcgtggcctgg

SEQ ID NO: 571739 - DNA, 19 bp, Homo sapiens
gcctgcgtggcctggggct

SEQ ID NO: 571740 - DNA, 22 bp, Homo sapiens
gcctgcgtggctgacccccctc

SEQ ID NO: 571741 - DNA, 18 bp, Homo sapiens
gcctgctctttggcctga

SEQ ID NO: 571742 - DNA, 12 bp, Homo sapiens
gcctggactcag

SEQ ID NO: 571743 - DNA, 23 bp, Homo sapiens
gcctggccagaccaggtgacctt

SEQ ID NO: 571744 - DNA, 17 bp, Homo sapiens
gcctgggataggggcag

SEQ ID NO: 571745 - DNA, 17 bp, Homo sapiens
gcctggtcgccttccac

SEQ ID NO: 571746 - DNA, 19 bp, Homo sapiens
gcctggtctcctgccccca

SEQ ID NO: 571747 - DNA, 23 bp, Homo sapiens
gcctgtgaccggggtcctgaggc

SEQ ID NO: 571748 - DNA, 19 bp, Homo sapiens
gcctgtggtgaggtcctgt

SEQ ID NO: 571749 - DNA, 17 bp, Homo sapiens
gccttcacaatctgtca

SEQ ID NO: 571750 - DNA, 21 bp, Homo sapiens
gccttccaggcgtagggccag

SEQ ID NO: 571751 - DNA, 17 bp, Homo sapiens
gccttgcccactcctgc

SEQ ID NO: 571752 - DNA, 22 bp, Homo sapiens
gccttgcccactcctgctctgc

SEQ ID NO: 571753 - DNA, 14 bp, Homo sapiens
gccttgggctctgc

SEQ ID NO: 571754 - DNA, 21 bp, Homo sapiens
gcctttcccaccgccctccct

SEQ ID NO: 571755 - DNA, 12 bp, Homo sapiens
gcctttgaagtg

SEQ ID NO: 571756 - DNA, 16 bp, Homo sapiens
gccttttgtagctgtc

SEQ ID NO: 571757 - DNA, 18 bp, Homo sapiens
gcgaaaggcgagtccagg

SEQ ID NO: 571758 - DNA, 13 bp, Homo sapiens
gcgacaacagatt

SEQ ID NO: 571759 - DNA, 18 bp, Homo sapiens
gcgagcaccaagtacaag

SEQ ID NO: 571760 - DNA, 15 bp, Homo sapiens
gcgcaaatacaaaat

SEQ ID NO: 571761 - DNA, 17 bp, Homo sapiens
gcgcaaatacaaaatga

SEQ ID NO: 571762 - DNA, 21 bp, Homo sapiens
gcgcacccggcagccccccag

SEQ ID NO: 571763 - DNA, 17 bp, Homo sapiens
gcgcagcatccgaccag

SEQ ID NO: 571764 - DNA, 15 bp, Homo sapiens
gcgcaggccctccgc

SEQ ID NO: 571765 - DNA, 13 bp, Homo sapiens
gcgcagtccccag

SEQ ID NO: 571766 - DNA, 23 bp, Homo sapiens
gcgcataggcctgctttgtctcc

SEQ ID NO: 571767 - DNA, 17 bp, Homo sapiens
gcgccttctacctgcag

SEQ ID NO: 571768 - DNA, 20 bp, Homo sapiens
gcgctaacttgcttaaatgt

SEQ ID NO: 571769 - DNA, 22 bp, Homo sapiens
gcgctaacttgcttaaatgtga

SEQ ID NO: 571770 - DNA, 13 bp, Homo sapiens
gcgctagaggcca

SEQ ID NO: 571771 - DNA, 18 bp, Homo sapiens
gcgctagcacagctccct

SEQ ID NO: 571772 - DNA, 14 bp, Homo sapiens
gcgctatcttcaca

SEQ ID NO: 571773 - DNA, 13 bp, Homo sapiens
gcggccggcctgg

SEQ ID NO: 571774 - DNA, 18 bp, Homo sapiens
gcggctcaagcccaggag

SEQ ID NO: 571775 - DNA, 19 bp, Homo sapiens
gcgggcgaatcacgaggtc

SEQ ID NO: 571776 - DNA, 15 bp, Homo sapiens
ggcaatcaatgttca

SEQ ID NO: 571777 - DNA, 16 bp, Homo sapiens
ggcaatgttttgcttt

SEQ ID NO: 571778 - DNA, 14 bp, Homo sapiens
ggcacactgagcaa

SEQ ID NO: 571779 - DNA, 15 bp, Homo sapiens
ggcacatttcatgag

SEQ ID NO: 571780 - DNA, 14 bp, Homo sapiens
ggcaccaataaagg

SEQ ID NO: 571781 - DNA, 16 bp, Homo sapiens
ggcaccaataaaggag

SEQ ID NO: 571782 - DNA, 13 bp, Homo sapiens
ggcacggaggctc

SEQ ID NO: 571783 - DNA, 20 bp, Homo sapiens
ggcagagccctgctccctcc

SEQ ID NO: 571784 - DNA, 18 bp, Homo sapiens
ggcagatgcagctcttcc

SEQ ID NO: 571785 - DNA, 14 bp, Homo sapiens
ggcagatttgcaac

SEQ ID NO: 571786 - DNA, 13 bp, Homo sapiens
ggcagcacccagg

SEQ ID NO: 571787 - DNA, 21 bp, Homo sapiens
ggcagcctactagggacctgg

SEQ ID NO: 571788 - DNA, 23 bp, Homo sapiens
ggcagcctgccttgcccactcct

SEQ ID NO: 571789 - DNA, 16 bp, Homo sapiens
ggcagctgttgtctct

SEQ ID NO: 571790 - DNA, 16 bp, Homo sapiens
ggcaggaagtccctga

SEQ ID NO: 571791 - DNA, 22 bp, Homo sapiens
ggcaggatgggggagaggggga

SEQ ID NO: 571792 - DNA, 14 bp, Homo sapiens
ggcaggcagagctc

SEQ ID NO: 571793 - DNA, 22 bp, Homo sapiens
ggcaggcagagctcagcacagc

SEQ ID NO: 571794 - DNA, 11 bp, Homo sapiens
ggcaggcaggg

SEQ ID NO: 571795 - DNA, 16 bp, Homo sapiens
ggcagtgcacccccta

SEQ ID NO: 571796 - DNA, 15 bp, Homo sapiens
ggcatccacttcaca

SEQ ID NO: 571797 - DNA, 21 bp, Homo sapiens
ggcatccccagccccctggcc

SEQ ID NO: 571798 - DNA, 19 bp, Homo sapiens
ggcatccttgaggacctcc

SEQ ID NO: 571799 - DNA, 13 bp, Homo sapiens
ggcatgaccctgg

SEQ ID NO: 571800 - DNA, 19 bp, Homo sapiens
ggcatgccgagtgccccag

SEQ ID NO: 571801 - DNA, 20 bp, Homo sapiens
ggccaagcagaaaaaaaagt

SEQ ID NO: 571802 - DNA, 22 bp, Homo sapiens
ggccaagctgaggaggtgctgc

SEQ ID NO: 571803 - DNA, 23 bp, Homo sapiens
ggccaagctgaggaggtgctgca

SEQ ID NO: 571804 - DNA, 13 bp, Homo sapiens
ggccagagctccc

SEQ ID NO: 571805 - DNA, 14 bp, Homo sapiens
ggccagagctccca

SEQ ID NO: 571806 - DNA, 15 bp, Homo sapiens
ggccagagctcccag

SEQ ID NO: 571807 - DNA, 20 bp, Homo sapiens
ggccagagctcccaggacgc

SEQ ID NO: 571808 - DNA, 17 bp, Homo sapiens
ggccagaggaaatctga

SEQ ID NO: 571809 - DNA, 19 bp, Homo sapiens
ggccagcatccatgcggcc

SEQ ID NO: 571810 - DNA, 11 bp, Homo sapiens
ggccagctccg

SEQ ID NO: 571811 - DNA, 22 bp, Homo sapiens
ggccaggatggcgtgtcccctg

SEQ ID NO: 571812 - DNA, 13 bp, Homo sapiens
ggccataagcaac

SEQ ID NO: 571813 - DNA, 23 bp, Homo sapiens
ggccataagcaacaattttcaga

SEQ ID NO: 571814 - DNA, 12 bp, Homo sapiens
ggcccaggagcg

SEQ ID NO: 571815 - DNA, 22 bp, Homo sapiens
ggcccatgccctccgtcctggc

SEQ ID NO: 571816 - DNA, 18 bp, Homo sapiens
ggcccccactggctgtgg

SEQ ID NO: 571817 - DNA, 11 bp, Homo sapiens
ggccctggggc

SEQ ID NO: 571818 - DNA, 12 bp, Homo sapiens
ggccctggggcc

SEQ ID NO: 571819 - DNA, 12 bp, Homo sapiens
ggccgggcagag

SEQ ID NO: 571820 - DNA, 14 bp, Homo sapiens
ggcctagtggcttc

SEQ ID NO: 571821 - DNA, 22 bp, Homo sapiens
ggcctagtggcttcagcccctg

SEQ ID NO: 571822 - DNA, 13 bp, Homo sapiens
ggcctcaggaggc

SEQ ID NO: 571823 - DNA, 20 bp, Homo sapiens
ggcctctcttggaactgcac

SEQ ID NO: 571824 - DNA, 21 bp, Homo sapiens
ggcctctttcagtgaatttgt

SEQ ID NO: 571825 - DNA, 16 bp, Homo sapiens
ggcctgaatccaaaag

SEQ ID NO: 571826 - DNA, 22 bp, Homo sapiens
ggcctgaatccaaaagaaaaac

SEQ ID NO: 571827 - DNA, 19 bp, Homo sapiens
ggcctgacctccccctcct

SEQ ID NO: 571828 - DNA, 14 bp, Homo sapiens
ggcctggccagacc

SEQ ID NO: 571829 - DNA, 19 bp, Homo sapiens
ggcctgtctcggaacctgt

SEQ ID NO: 571830 - DNA, 12 bp, Homo sapiens
ggccttcacaat

SEQ ID NO: 571831 - DNA, 21 bp, Homo sapiens
ggcctttatctcaacggaagc

SEQ ID NO: 571832 - DNA, 19 bp, Homo sapiens
ggcgccttctacctgcagg

SEQ ID NO: 571833 - DNA, 12 bp, Homo sapiens
ggcgctaacttg

SEQ ID NO: 571834 - DNA, 22 bp, Homo sapiens
ggcgctagcacagctcccttct

SEQ ID NO: 571835 - DNA, 20 bp, Homo sapiens
ggcgggcgaatcacgaggtc

SEQ ID NO: 571836 - DNA, 23 bp, Homo sapiens
ggcgtccctgagggcccttccca

SEQ ID NO: 571837 - DNA, 18 bp, Homo sapiens
ggctaagtccagctctcc

SEQ ID NO: 571838 - DNA, 21 bp, Homo sapiens
ggctatgtctcatgttttata

SEQ ID NO: 571839 - DNA, 18 bp, Homo sapiens
ggctcattctgcaatgag

SEQ ID NO: 571840 - DNA, 18 bp, Homo sapiens
ggctccacttcatccaga

SEQ ID NO: 571841 - DNA, 13 bp, Homo sapiens
ggctccaggcagc

SEQ ID NO: 571842 - DNA, 16 bp, Homo sapiens
ggctcccttcctccca

SEQ ID NO: 571843 - DNA, 14 bp, Homo sapiens
ggctcctcacatag

SEQ ID NO: 571844 - DNA, 18 bp, Homo sapiens
ggctctgcgtcccactga

SEQ ID NO: 571845 - DNA, 19 bp, Homo sapiens
ggctctgggttcgggaaga

SEQ ID NO: 571846 - DNA, 17 bp, Homo sapiens
ggctgacccccctcagg

SEQ ID NO: 571847 - DNA, 16 bp, Homo sapiens
ggctgcagagcctgca

SEQ ID NO: 571848 - DNA, 14 bp, Homo sapiens
ggctgcagtgagcc

SEQ ID NO: 571849 - DNA, 22 bp, Homo sapiens
ggctgccaagagtccaagccat

SEQ ID NO: 571850 - DNA, 20 bp, Homo sapiens
ggctgcccacacaccccaat

SEQ ID NO: 571851 - DNA, 16 bp, Homo sapiens
ggctggcttctccctg

SEQ ID NO: 571852 - DNA, 18 bp, Homo sapiens
ggctggcttctccctgga

SEQ ID NO: 571853 - DNA, 15 bp, Homo sapiens
ggctgggacttctta

SEQ ID NO: 571854 - DNA, 14 bp, Homo sapiens
ggctgggcagctgt

SEQ ID NO: 571855 - DNA, 19 bp, Homo sapiens
ggctggggcttttgtgcca

SEQ ID NO: 571856 - DNA, 19 bp, Homo sapiens
ggctgtcagtcgtgttgct

SEQ ID NO: 571857 - DNA, 16 bp, Homo sapiens
ggcttgtcatagccag

SEQ ID NO: 571858 - DNA, 19 bp, Homo sapiens
gggaatatccgtgccagga

SEQ ID NO: 571859 - DNA, 14 bp, Homo sapiens
gggacacccagaaa

SEQ ID NO: 571860 - DNA, 22 bp, Homo sapiens
gggacacggcctctggggagac

SEQ ID NO: 571861 - DNA, 21 bp, Homo sapiens
gggacaggaacacccagcccc

SEQ ID NO: 571862 - DNA, 21 bp, Homo sapiens
gggaccctcggggcaggaagt

SEQ ID NO: 571863 - DNA, 22 bp, Homo sapiens
gggactccagaagcagcagcta

SEQ ID NO: 571864 - DNA, 19 bp, Homo sapiens
gggacttcttacccaaagc

SEQ ID NO: 571865 - DNA, 21 bp, Homo sapiens
gggacttcttacccaaagcac

SEQ ID NO: 571866 - DNA, 19 bp, Homo sapiens
gggagaccgagtgtggagc

SEQ ID NO: 571867 - DNA, 18 bp, Homo sapiens
gggagagtgaggtcatcc

SEQ ID NO: 571868 - DNA, 16 bp, Homo sapiens
gggagatccgccctgg

SEQ ID NO: 571869 - DNA, 14 bp, Homo sapiens
gggagatgctggga

SEQ ID NO: 571870 - DNA, 12 bp, Homo sapiens
gggagcagcccc

SEQ ID NO: 571871 - DNA, 18 bp, Homo sapiens
gggagcctgcgtggcctg

SEQ ID NO: 571872 - DNA, 12 bp, Homo sapiens
gggagctcctgg

SEQ ID NO: 571873 - DNA, 23 bp, Homo sapiens
gggaggagaagaaaatgttcttc

SEQ ID NO: 571874 - DNA, 19 bp, Homo sapiens
gggagtgaggcaggtgaca

SEQ ID NO: 571875 - DNA, 16 bp, Homo sapiens
gggatgggcacaggct

SEQ ID NO: 571876 - DNA, 17 bp, Homo sapiens
gggatgggcacaggctg

SEQ ID NO: 571877 - DNA, 19 bp, Homo sapiens
gggatttgtccttggggac

SEQ ID NO: 571878 - DNA, 23 bp, Homo sapiens
gggcaacctgacagcaaacacag

SEQ ID NO: 571879 - DNA, 20 bp, Homo sapiens
gggcaatattctctgtacat

SEQ ID NO: 571880 - DNA, 22 bp, Homo sapiens
gggcacacttccccttgggatg

SEQ ID NO: 571881 - DNA, 23 bp, Homo sapiens
gggcacacttccccttgggatgg

SEQ ID NO: 571882 - DNA, 12 bp, Homo sapiens
gggcacaggctg

SEQ ID NO: 571883 - DNA, 19 bp, Homo sapiens
gggcacaggctgccccacc

SEQ ID NO: 571884 - DNA, 19 bp, Homo sapiens
gggcacccaccagttgctg

SEQ ID NO: 571885 - DNA, 16 bp, Homo sapiens
gggcagcacagagagg

SEQ ID NO: 571886 - DNA, 15 bp, Homo sapiens
gggcaggcagagctc

SEQ ID NO: 571887 - DNA, 20 bp, Homo sapiens
gggcagtgacgtgagtgggg

SEQ ID NO: 571888 - DNA, 14 bp, Homo sapiens
gggcatgcccagcc

SEQ ID NO: 571889 - DNA, 19 bp, Homo sapiens
gggccacctccccaggccg

SEQ ID NO: 571890 - DNA, 11 bp, Homo sapiens
gggccagctcc

SEQ ID NO: 571891 - DNA, 24 bp, Homo sapiens
gggccctggttcccccaggaccct

SEQ ID NO: 571892 - DNA, 21 bp, Homo sapiens
gggcccttcccaacctcccct

SEQ ID NO: 571893 - DNA, 17 bp, Homo sapiens
gggcctgaaagcaacag

SEQ ID NO: 571894 - DNA, 18 bp, Homo sapiens
gggcctgacctccccctc

SEQ ID NO: 571895 - DNA, 15 bp, Homo sapiens
gggcgtgaaacacaa

SEQ ID NO: 571896 - DNA, 14 bp, Homo sapiens
gggctagcactgga

SEQ ID NO: 571897 - DNA, 19 bp, Homo sapiens
gggctccacgggggcctag

SEQ ID NO: 571898 - DNA, 22 bp, Homo sapiens
gggctgccgtgcacggggccag

SEQ ID NO: 571899 - DNA, 14 bp, Homo sapiens
gggctgctgcactg

SEQ ID NO: 571900 - DNA, 17 bp, Homo sapiens
gggctggcttctccctg

SEQ ID NO: 571901 - DNA, 14 bp, Homo sapiens
gggctgggcagctg

SEQ ID NO: 571902 - DNA, 11 bp, Homo sapiens
gggctggggca

SEQ ID NO: 571903 - DNA, 17 bp, Homo sapiens
gggctttcctgtgccag

SEQ ID NO: 571904 - DNA, 10 bp, Homo sapiens
ggggagctcc

SEQ ID NO: 571905 - DNA, 12 bp, Homo sapiens
ggggagctcctg

SEQ ID NO: 571906 - DNA, 12 bp, Homo sapiens
ggggagctggac

SEQ ID NO: 571907 - DNA, 16 bp, Homo sapiens
ggggaggctgagacgc

SEQ ID NO: 571908 - DNA, 17 bp, Homo sapiens
ggggcagagccctgctc

SEQ ID NO: 571909 - DNA, 14 bp, Homo sapiens
ggggcagcctgcct

SEQ ID NO: 571910 - DNA, 17 bp, Homo sapiens
ggggcaggatgggggag

SEQ ID NO: 571911 - DNA, 18 bp, Homo sapiens
ggggcatccttgaggacc

SEQ ID NO: 571912 - DNA, 14 bp, Homo sapiens
ggggccatggaagc

SEQ ID NO: 571913 - DNA, 14 bp, Homo sapiens
gtcgtccccagacc

SEQ ID NO: 571914 - DNA, 17 bp, Homo sapiens
gtcgtccccagaccagt

SEQ ID NO: 571915 - DNA, 18 bp, Homo sapiens
gtcgtccccagaccagta

SEQ ID NO: 571916 - DNA, 22 bp, Homo sapiens
gtcgtccccagaccagtagtga

SEQ ID NO: 571917 - DNA, 12 bp, Homo sapiens
gtctaataaaca

SEQ ID NO: 571918 - DNA, 15 bp, Homo sapiens
gtctaatgtttaagc

SEQ ID NO: 571919 - DNA, 16 bp, Homo sapiens
gtctcactgacacagg

SEQ ID NO: 571920 - DNA, 20 bp, Homo sapiens
gtctcagaatctttccttcc

SEQ ID NO: 571921 - DNA, 17 bp, Homo sapiens
gtctcattcctctgtcc

SEQ ID NO: 571922 - DNA, 22 bp, Homo sapiens
gtctcccccacccttgttccag

SEQ ID NO: 571923 - DNA, 13 bp, Homo sapiens
gtctcctgccccc

SEQ ID NO: 571924 - DNA, 23 bp, Homo sapiens
gtctcggaacctgtgagctgcac

SEQ ID NO: 571925 - DNA, 18 bp, Homo sapiens
gtctcgtcaggaggtgcc

SEQ ID NO: 571926 - DNA, 20 bp, Homo sapiens
gtctcgtcaggaggtgcctg

SEQ ID NO: 571927 - DNA, 20 bp, Homo sapiens
gtctctacaaaaaaaatcaa

SEQ ID NO: 571928 - DNA, 16 bp, Homo sapiens
gtctctttcttccttt

SEQ ID NO: 571929 - DNA, 17 bp, Homo sapiens
gtctctttcttcctttc

SEQ ID NO: 571930 - DNA, 15 bp, Homo sapiens
gtctgcattttctga

SEQ ID NO: 571931 - DNA, 18 bp, Homo sapiens
gtctgccccaagttttgt

SEQ ID NO: 571932 - DNA, 16 bp, Homo sapiens
gtctgctccagctctg

SEQ ID NO: 571933 - DNA, 18 bp, Homo sapiens
gtctgctccagctctggc

SEQ ID NO: 571934 - DNA, 23 bp, Homo sapiens
gtctgtaaatcaagaccaaagag

SEQ ID NO: 571935 - DNA, 19 bp, Homo sapiens
gtctgtcatttctctttca

SEQ ID NO: 571936 - DNA, 20 bp, Homo sapiens
gtctgtcatttctctttcaa

SEQ ID NO: 571937 - DNA, 11 bp, Homo sapiens
gtctgtctctc

SEQ ID NO: 571938 - DNA, 24 bp, Homo sapiens
gtctgtctctcttttgctctctca

SEQ ID NO: 571939 - DNA, 13 bp, Homo sapiens
gtctgtgataaca

SEQ ID NO: 571940 - DNA, 13 bp, Homo sapiens
gtcttaaataaaa

SEQ ID NO: 571941 - DNA, 16 bp, Homo sapiens
gtcttaaataaaagaa

SEQ ID NO: 571942 - DNA, 20 bp, Homo sapiens
gtcttaattaagtaaactaa

SEQ ID NO: 571943 - DNA, 22 bp, Homo sapiens
gtcttactttgttaatttatct

SEQ ID NO: 571944 - DNA, 17 bp, Homo sapiens
gtcttatatagcagcaa

SEQ ID NO: 571945 - DNA, 15 bp, Homo sapiens
gtcttatgcttccag

SEQ ID NO: 571946 - DNA, 20 bp, Homo sapiens
gtcttcaaattgtcttttgt

SEQ ID NO: 571947 - DNA, 18 bp, Homo sapiens
gtcttcagggggccaggt

SEQ ID NO: 571948 - DNA, 15 bp, Homo sapiens
gtcttcatgaaatgc

SEQ ID NO: 571949 - DNA, 23 bp, Homo sapiens
gtcttcatgaaatgctatgtcat

SEQ ID NO: 571950 - DNA, 16 bp, Homo sapiens
gtcttccacctggaag

SEQ ID NO: 571951 - DNA, 15 bp, Homo sapiens
gtcttggtacttgct

SEQ ID NO: 571952 - DNA, 18 bp, Homo sapiens
gtcttgtattatcataag

SEQ ID NO: 571953 - DNA, 18 bp, Homo sapiens
gtcttgtttaatatttgt

SEQ ID NO: 571954 - DNA, 19 bp, Homo sapiens
gtctttctggggtttttct

SEQ ID NO: 571955 - DNA, 16 bp, Homo sapiens
gtctttggaaaattca

SEQ ID NO: 571956 - DNA, 18 bp, Homo sapiens
gtcttttgtgtctgtcat

SEQ ID NO: 571957 - DNA, 15 bp, Homo sapiens
gtgaaacacaatatc

SEQ ID NO: 571958 - DNA, 17 bp, Homo sapiens
gtgaaagtgccaaaata

SEQ ID NO: 571959 - DNA, 14 bp, Homo sapiens
gtgaaatttttcat

SEQ ID NO: 571960 - DNA, 16 bp, Homo sapiens
gtgaagactccagaaa

SEQ ID NO: 571961 - DNA, 14 bp, Homo sapiens
gtgaagagtgaaga

SEQ ID NO: 571962 - DNA, 15 bp, Homo sapiens
gtgaagagtgaagag

SEQ ID NO: 571963 - DNA, 17 bp, Homo sapiens
gtgaagagtgaagagca

SEQ ID NO: 571964 - DNA, 23 bp, Homo sapiens
gtgaaggaccttcactctaagat

SEQ ID NO: 571965 - DNA, 21 bp, Homo sapiens
gtgaaggaggctccaggcagc

SEQ ID NO: 571966 - DNA, 16 bp, Homo sapiens
gtgaattactaacttc

SEQ ID NO: 571967 - DNA, 18 bp, Homo sapiens
gtgacaaaattttataag

SEQ ID NO: 571968 - DNA, 12 bp, Homo sapiens
gtgacacagcag

SEQ ID NO: 571969 - DNA, 19 bp, Homo sapiens
gtgacacagcagcttcacc

SEQ ID NO: 571970 - DNA, 20 bp, Homo sapiens
gtgacacagctgagctggcc

SEQ ID NO: 571971 - DNA, 12 bp, Homo sapiens
gtgacagtgttg

SEQ ID NO: 571972 - DNA, 18 bp, Homo sapiens
gtgacatcggttcaggag

SEQ ID NO: 571973 - DNA, 21 bp, Homo sapiens
gtgacatgcgggctgggcagc

SEQ ID NO: 571974 - DNA, 20 bp, Homo sapiens
gtgacatttgtcattttcat

SEQ ID NO: 571975 - DNA, 16 bp, Homo sapiens
gtgaccggggtcctga

SEQ ID NO: 571976 - DNA, 23 bp, Homo sapiens
gtgacttatttgctcataagtaa

SEQ ID NO: 571977 - DNA, 13 bp, Homo sapiens
gtgagcctatgat

SEQ ID NO: 571978 - DNA, 13 bp, Homo sapiens
gtgagctgcacca

SEQ ID NO: 571979 - DNA, 19 bp, Homo sapiens
gtgagctgctgccatgaac

SEQ ID NO: 571980 - DNA, 16 bp, Homo sapiens
gtgaggcaggtgacag

SEQ ID NO: 571981 - DNA, 12 bp, Homo sapiens
gtgaggtcctgg

SEQ ID NO: 571982 - DNA, 13 bp, Homo sapiens
gtgaggtcctggg

SEQ ID NO: 571983 - DNA, 16 bp, Homo sapiens
gtgaggtcctgggggc

SEQ ID NO: 571984 - DNA, 19 bp, Homo sapiens
gtgaggtcctgtcctggct

SEQ ID NO: 571985 - DNA, 16 bp, Homo sapiens
gtgaggttgtgctgcc

SEQ ID NO: 571986 - DNA, 18 bp, Homo sapiens
gtgagtcctccagaactc

SEQ ID NO: 571987 - DNA, 15 bp, Homo sapiens
gtgagtttgtttctt

SEQ ID NO: 571988 - DNA, 13 bp, Homo sapiens
gtgatattctttg

SEQ ID NO: 571989 - DNA, 23 bp, Homo sapiens
gtgatctgttgtaatatcagtta

SEQ ID NO: 571990 - DNA, 19 bp, Homo sapiens
gtgatggcgaaagagggta

SEQ ID NO: 571991 - DNA, 19 bp, Homo sapiens
gtgattacctgaaagccct

SEQ ID NO: 571992 - DNA, 17 bp, Homo sapiens
gtgattccccggagctg

SEQ ID NO: 571993 - DNA, 15 bp, Homo sapiens
gtgattgactttttg

SEQ ID NO: 571994 - DNA, 17 bp, Homo sapiens
gtgattttcaaatatgt

SEQ ID NO: 571995 - DNA, 21 bp, Homo sapiens
gtgcaaaaggcttgcagaact

SEQ ID NO: 571996 - DNA, 16 bp, Homo sapiens
gtgcaatttgtctttg

SEQ ID NO: 571997 - DNA, 23 bp, Homo sapiens
gtgcacacagaaatatatataca

SEQ ID NO: 571998 - DNA, 22 bp, Homo sapiens
gtgcacagacgtccctccacgt

SEQ ID NO: 571999 - DNA, 12 bp, Homo sapiens
gtgcacaggcag

SEQ ID NO: 572000 - DNA, 17 bp, Homo sapiens
gtgcaggagcgctccct

SEQ ID NO: 572001 - DNA, 11 bp, Homo sapiens
gtgcaggcagg

SEQ ID NO: 572002 - DNA, 12 bp, Homo sapiens
gtgcaggcaggc

SEQ ID NO: 572003 - DNA, 23 bp, Homo sapiens
gtgccagcatacattttctggtg

SEQ ID NO: 572004 - DNA, 14 bp, Homo sapiens
gtgccaggagtggg

SEQ ID NO: 572005 - DNA, 13 bp, Homo sapiens
gtgccgagccctt

SEQ ID NO: 572006 - DNA, 20 bp, Homo sapiens
gtgcctaactccttacagaa

SEQ ID NO: 572007 - DNA, 16 bp, Homo sapiens
gtgcctctgattctat

SEQ ID NO: 572008 - DNA, 21 bp, Homo sapiens
gtgcgtggaatgcccttcact

SEQ ID NO: 572009 - DNA, 17 bp, Homo sapiens
gtgctaaacgtgtatgt

SEQ ID NO: 572010 - DNA, 14 bp, Homo sapiens
gtgctaagttgtct

SEQ ID NO: 572011 - DNA, 15 bp, Homo sapiens
gtgctcatcagaaac

SEQ ID NO: 572012 - DNA, 17 bp, Homo sapiens
gtgctgctgtggcatca

SEQ ID NO: 572013 - DNA, 14 bp, Homo sapiens
gtgctgggtcctta

SEQ ID NO: 572014 - DNA, 19 bp, Homo sapiens
gtgctgtgtttgctcccct

SEQ ID NO: 572015 - DNA, 17 bp, Homo sapiens
gtgcttagaaacctcac

SEQ ID NO: 572016 - DNA, 13 bp, Homo sapiens
gtggacccagctg

SEQ ID NO: 572017 - DNA, 18 bp, Homo sapiens
gtggaccctgaaatgtgt

SEQ ID NO: 572018 - DNA, 13 bp, Homo sapiens
gtggagctgcttc

SEQ ID NO: 572019 - DNA, 12 bp, Homo sapiens
gtggattgtttt

SEQ ID NO: 572020 - DNA, 14 bp, Homo sapiens
gtggattgtttttt

SEQ ID NO: 572021 - DNA, 13 bp, Homo sapiens
gtggcaaatataa

SEQ ID NO: 572022 - DNA, 13 bp, Homo sapiens
gtggcaactgtgg

SEQ ID NO: 572023 - DNA, 15 bp, Homo sapiens
gtggcacctgtctgc

SEQ ID NO: 572024 - DNA, 20 bp, Homo sapiens
gtggcacctgtctgctccag

SEQ ID NO: 572025 - DNA, 22 bp, Homo sapiens
gtggctgatttactaacagtaa

SEQ ID NO: 572026 - DNA, 23 bp, Homo sapiens
gtggctgatttactaacagtaac

SEQ ID NO: 572027 - DNA, 16 bp, Homo sapiens
gtggctgcccacacac

SEQ ID NO: 572028 - DNA, 18 bp, Homo sapiens
gtggctgcggcacccttg

SEQ ID NO: 572029 - DNA, 23 bp, Homo sapiens
gtggcttcagcccctggggtact

SEQ ID NO: 572030 - DNA, 20 bp, Homo sapiens
gtggcttggagcagaggtgg

SEQ ID NO: 572031 - DNA, 14 bp, Homo sapiens
gtgggtctggagga

SEQ ID NO: 572032 - DNA, 15 bp, Homo sapiens
gtggtacttggcacc

SEQ ID NO: 572033 - DNA, 22 bp, Homo sapiens
gtggtacttggcaccaataaag

SEQ ID NO: 572034 - DNA, 19 bp, Homo sapiens
gtggtccacattctgctgc

SEQ ID NO: 572035 - DNA, 19 bp, Homo sapiens
gtggtcttcaaattgtctt

SEQ ID NO: 572036 - DNA, 13 bp, Homo sapiens
gtggttgtttttt

SEQ ID NO: 572037 - DNA, 16 bp, Homo sapiens
gtgtatatatacatac

SEQ ID NO: 572038 - DNA, 17 bp, Homo sapiens
gtgtatatgtttataca

SEQ ID NO: 572039 - DNA, 22 bp, Homo sapiens
gtgtatatgtttatacacacag

SEQ ID NO: 572040 - DNA, 17 bp, Homo sapiens
gtgtatttattgaagaa

SEQ ID NO: 572041 - DNA, 19 bp, Homo sapiens
gtgtccccaggggcacact

SEQ ID NO: 572042 - DNA, 13 bp, Homo sapiens
gtgtctctattta

SEQ ID NO: 572043 - DNA, 13 bp, Homo sapiens
gtgtctgccccct

SEQ ID NO: 572044 - DNA, 22 bp, Homo sapiens
gtgtgctaaacgtgtatgtttt

SEQ ID NO: 572045 - DNA, 12 bp, Homo sapiens
gtgtggagggct

SEQ ID NO: 572046 - DNA, 18 bp, Homo sapiens
gtgtgggtttactctgtg

SEQ ID NO: 572047 - DNA, 14 bp, Homo sapiens
gtgtgtgcagagct

SEQ ID NO: 572048 - DNA, 17 bp, Homo sapiens
gtgtgtgcagagctgaa

SEQ ID NO: 572049 - DNA, 13 bp, Homo sapiens
gtgtgtgtgtgca

SEQ ID NO: 572050 - DNA, 21 bp, Homo sapiens
gtgttaatgagtatatgtaac

SEQ ID NO: 572051 - DNA, 18 bp, Homo sapiens
taagagatttatctttat

SEQ ID NO: 572052 - DNA, 13 bp, Homo sapiens
taagagcctctgg

SEQ ID NO: 572053 - DNA, 14 bp, Homo sapiens
taagagcctctgga

SEQ ID NO: 572054 - DNA, 17 bp, Homo sapiens
taagataattaaatgaa

SEQ ID NO: 572055 - DNA, 21 bp, Homo sapiens
taagataattaaatgaaatac

SEQ ID NO: 572056 - DNA, 15 bp, Homo sapiens
taagatgttatattt

SEQ ID NO: 572057 - DNA, 19 bp, Homo sapiens
taagatgttatatttttct

SEQ ID NO: 572058 - DNA, 19 bp, Homo sapiens
taagattgaagctaaaaca

SEQ ID NO: 572059 - DNA, 21 bp, Homo sapiens
taagcaaatttcaaaagacat

SEQ ID NO: 572060 - DNA, 23 bp, Homo sapiens
taagcaaatttcaaaagacatgt

SEQ ID NO: 572061 - DNA, 13 bp, Homo sapiens
taagcaacaattt

SEQ ID NO: 572062 - DNA, 14 bp, Homo sapiens
taagcctttgaagt

SEQ ID NO: 572063 - DNA, 13 bp, Homo sapiens
taagctaggaaaa

SEQ ID NO: 572064 - DNA, 18 bp, Homo sapiens
taagctgtttggttttaa

SEQ ID NO: 572065 - DNA, 21 bp, Homo sapiens
taagctgtttggttttaaaat

SEQ ID NO: 572066 - DNA, 22 bp, Homo sapiens
taagctgtttggttttaaaata

SEQ ID NO: 572067 - DNA, 14 bp, Homo sapiens
taaggacttcctga

SEQ ID NO: 572068 - DNA, 13 bp, Homo sapiens
taaggagaaatga

SEQ ID NO: 572069 - DNA, 14 bp, Homo sapiens
taaggcttcaattt

SEQ ID NO: 572070 - DNA, 22 bp, Homo sapiens
taaggggaattaacaattgcca

SEQ ID NO: 572071 - DNA, 19 bp, Homo sapiens
taaggtcagtgttataaaa

SEQ ID NO: 572072 - DNA, 12 bp, Homo sapiens
taagtaaactaa

SEQ ID NO: 572073 - DNA, 20 bp, Homo sapiens
taagtaaatgtcttcatgtt

SEQ ID NO: 572074 - DNA, 21 bp, Homo sapiens
taagtaaatgtcttcatgttg

SEQ ID NO: 572075 - DNA, 16 bp, Homo sapiens
taagtcattttcatgt

SEQ ID NO: 572076 - DNA, 20 bp, Homo sapiens
taagtcattttcatgtgtgt

SEQ ID NO: 572077 - DNA, 20 bp, Homo sapiens
taagtctcttttttacaaag

SEQ ID NO: 572078 - DNA, 21 bp, Homo sapiens
taagtctcttttttacaaagg

SEQ ID NO: 572079 - DNA, 12 bp, Homo sapiens
taagtgaaattt

SEQ ID NO: 572080 - DNA, 14 bp, Homo sapiens
taagtgaaatttat

SEQ ID NO: 572081 - DNA, 15 bp, Homo sapiens
taagtgcacacagaa

SEQ ID NO: 572082 - DNA, 17 bp, Homo sapiens
taagtggactgtatttc

SEQ ID NO: 572083 - DNA, 12 bp, Homo sapiens
taagttggaaac

SEQ ID NO: 572084 - DNA, 15 bp, Homo sapiens
taagttggaaacact

SEQ ID NO: 572085 - DNA, 16 bp, Homo sapiens
taagttggaaacacta

SEQ ID NO: 572086 - DNA, 23 bp, Homo sapiens
taagttggaaacactaaatgtta

SEQ ID NO: 572087 - DNA, 12 bp, Homo sapiens
taagttgtaaac

SEQ ID NO: 572088 - DNA, 13 bp, Homo sapiens
taagttgtaaacg

SEQ ID NO: 572089 - DNA, 14 bp, Homo sapiens
taataaagtatgaa

SEQ ID NO: 572090 - DNA, 15 bp, Homo sapiens
taataaccagacaca

SEQ ID NO: 572091 - DNA, 16 bp, Homo sapiens
taataatcctgcaaag

SEQ ID NO: 572092 - DNA, 21 bp, Homo sapiens
taatacctgacctcacagagt

SEQ ID NO: 572093 - DNA, 18 bp, Homo sapiens
taatactaaaatatgtct

SEQ ID NO: 572094 - DNA, 14 bp, Homo sapiens
taatagcctcacct

SEQ ID NO: 572095 - DNA, 13 bp, Homo sapiens
taatataatggaa

SEQ ID NO: 572096 - DNA, 18 bp, Homo sapiens
taatataatggaagagaa

SEQ ID NO: 572097 - DNA, 14 bp, Homo sapiens
taatatacagtgtg

SEQ ID NO: 572098 - DNA, 18 bp, Homo sapiens
taatatacagtgtgtagt

SEQ ID NO: 572099 - DNA, 12 bp, Homo sapiens
taatatactcct

SEQ ID NO: 572100 - DNA, 12 bp, Homo sapiens
taatatcagtta

SEQ ID NO: 572101 - DNA, 16 bp, Homo sapiens
taatatcagttacagt

SEQ ID NO: 572102 - DNA, 13 bp, Homo sapiens
taatatgcatata

SEQ ID NO: 572103 - DNA, 15 bp, Homo sapiens
taatatgtattttat

SEQ ID NO: 572104 - DNA, 16 bp, Homo sapiens
taatattgaaaatgtc

SEQ ID NO: 572105 - DNA, 17 bp, Homo sapiens
taatattgaaaatgtca

SEQ ID NO: 572106 - DNA, 16 bp, Homo sapiens
taatcactcagagcag

SEQ ID NO: 572107 - DNA, 13 bp, Homo sapiens
taatcagatcttc

SEQ ID NO: 572108 - DNA, 16 bp, Homo sapiens
taatcagatcttcttt

SEQ ID NO: 572109 - DNA, 14 bp, Homo sapiens
taatcatattagac

SEQ ID NO: 572110 - DNA, 22 bp, Homo sapiens
taatccatgtgctgctgtggca

SEQ ID NO: 572111 - DNA, 15 bp, Homo sapiens
taatcctatctgggg

SEQ ID NO: 572112 - DNA, 17 bp, Homo sapiens
taatgagcaatatctgc

SEQ ID NO: 572113 - DNA, 21 bp, Homo sapiens
taatgagcaatatctgctaga

SEQ ID NO: 572114 - DNA, 21 bp, Homo sapiens
taatgagtatatgtaacagtt

SEQ ID NO: 572115 - DNA, 22 bp, Homo sapiens
taatgagtatatgtaacagttt

SEQ ID NO: 572116 - DNA, 16 bp, Homo sapiens
taatgagtttctttta

SEQ ID NO: 572117 - DNA, 17 bp, Homo sapiens
taatggaaaaaaagact

SEQ ID NO: 572118 - DNA, 15 bp, Homo sapiens
taatggtaacttttg

SEQ ID NO: 572119 - DNA, 13 bp, Homo sapiens
taatggtaattta

SEQ ID NO: 572120 - DNA, 16 bp, Homo sapiens
taatggtaatttagtg

SEQ ID NO: 572121 - DNA, 13 bp, Homo sapiens
taatggtctaaaa

SEQ ID NO: 572122 - DNA, 21 bp, Homo sapiens
taatggtctaaaaataaacca

SEQ ID NO: 572123 - DNA, 15 bp, Homo sapiens
taatgtctcaaaata

SEQ ID NO: 572124 - DNA, 23 bp, Homo sapiens
taatgtgatggatggcacaatga

SEQ ID NO: 572125 - DNA, 16 bp, Homo sapiens
taatgtgtaaaattgg

SEQ ID NO: 572126 - DNA, 19 bp, Homo sapiens
taatgtgtgtatgtgtatt

SEQ ID NO: 572127 - DNA, 14 bp, Homo sapiens
taatgttgatttct

SEQ ID NO: 572128 - DNA, 22 bp, Homo sapiens
taatgtttaagcagaattggaa

SEQ ID NO: 572129 - DNA, 18 bp, Homo sapiens
taattaaaaagttaatct

SEQ ID NO: 572130 - DNA, 12 bp, Homo sapiens
taattaaatgaa

SEQ ID NO: 572131 - DNA, 11 bp, Homo sapiens
taattaatttc

SEQ ID NO: 572132 - DNA, 19 bp, Homo sapiens
taattacaatatttctgat

SEQ ID NO: 572133 - DNA, 23 bp, Homo sapiens
taattctgaagttatatttccta

SEQ ID NO: 572134 - DNA, 14 bp, Homo sapiens
taattcttattcca

SEQ ID NO: 572135 - DNA, 16 bp, Homo sapiens
taattcttattccata

SEQ ID NO: 572136 - DNA, 19 bp, Homo sapiens
taattcttattccatatta

SEQ ID NO: 572137 - DNA, 19 bp, Homo sapiens
taattgaaagggacaagta

SEQ ID NO: 572138 - DNA, 15 bp, Homo sapiens
taatttcttgcaatt

SEQ ID NO: 572139 - DNA, 19 bp, Homo sapiens
taatttcttgcaatttgaa

SEQ ID NO: 572140 - DNA, 20 bp, Homo sapiens
taatttcttgcaatttgaag

SEQ ID NO: 572141 - DNA, 21 bp, Homo sapiens
taatttcttgcaatttgaagg

SEQ ID NO: 572142 - DNA, 22 bp, Homo sapiens
taatttcttgcaatttgaaggt

SEQ ID NO: 572143 - DNA, 22 bp, Homo sapiens
tacaaaaaaaatcaaaaaatta

SEQ ID NO: 572144 - DNA, 23 bp, Homo sapiens
tacaaaaccacagtgtaccatta

SEQ ID NO: 572145 - DNA, 18 bp, Homo sapiens
tacaaaatgattgtcttt

SEQ ID NO: 572146 - DNA, 12 bp, Homo sapiens
tacaaaatgtaa

SEQ ID NO: 572147 - DNA, 14 bp, Homo sapiens
tacaaaatgtaact

SEQ ID NO: 572148 - DNA, 21 bp, Homo sapiens
tacaaaatgtgtgcttggaaa

SEQ ID NO: 572149 - DNA, 15 bp, Homo sapiens
tacaaacaagcatat

SEQ ID NO: 572150 - DNA, 19 bp, Homo sapiens
tacaaacaagcatataaaa

SEQ ID NO: 572151 - DNA, 13 bp, Homo sapiens
tacaaatgtgtga

SEQ ID NO: 572152 - DNA, 19 bp, Homo sapiens
tacaacacattgaaactgt

SEQ ID NO: 572153 - DNA, 20 bp, Homo sapiens
tacaacacattgaaactgta

SEQ ID NO: 572154 - DNA, 23 bp, Homo sapiens
tacaacacattgaaactgtattt

SEQ ID NO: 572155 - DNA, 15 bp, Homo sapiens
tacaagactgtaaat

SEQ ID NO: 572156 - DNA, 19 bp, Homo sapiens
tacaagactgtaaattcca

SEQ ID NO: 572157 - DNA, 17 bp, Homo sapiens
tacaatatataaaaata

SEQ ID NO: 572158 - DNA, 18 bp, Homo sapiens
tacaatatataaaaatat

SEQ ID NO: 572159 - DNA, 20 bp, Homo sapiens
tacaatatataaaaatatat

SEQ ID NO: 572160 - DNA, 17 bp, Homo sapiens
tacaatatttgtgtgct

SEQ ID NO: 572161 - DNA, 19 bp, Homo sapiens
tacaatcatgaacagctct

SEQ ID NO: 572162 - DNA, 23 bp, Homo sapiens
tacaatttgttaattcctatgaa

SEQ ID NO: 572163 - DNA, 21 bp, Homo sapiens
tacacaattaattcatccctt

SEQ ID NO: 572164 - DNA, 15 bp, Homo sapiens
tacacacacagatgt

SEQ ID NO: 572165 - DNA, 13 bp, Homo sapiens
tacacatacatat

SEQ ID NO: 572166 - DNA, 18 bp, Homo sapiens
tacacatatacctataat

SEQ ID NO: 572167 - DNA, 21 bp, Homo sapiens
tacacatatacctataatgtg

SEQ ID NO: 572168 - DNA, 14 bp, Homo sapiens
tacacatcttccac

SEQ ID NO: 572169 - DNA, 23 bp, Homo sapiens
tacaccactttcccacactgtga

SEQ ID NO: 572170 - DNA, 20 bp, Homo sapiens
tacacttctcaaatgctact

SEQ ID NO: 572171 - DNA, 15 bp, Homo sapiens
tacacttgctttatt

SEQ ID NO: 572172 - DNA, 16 bp, Homo sapiens
tacacttgctttattt

SEQ ID NO: 572173 - DNA, 21 bp, Homo sapiens
tacacttgtataaatgtatat

SEQ ID NO: 572174 - DNA, 22 bp, Homo sapiens
tacacttgtataaatgtatata

SEQ ID NO: 572175 - DNA, 20 bp, Homo sapiens
tacagaacactttgctagga

SEQ ID NO: 572176 - DNA, 15 bp, Homo sapiens
tacagagatgtctct

SEQ ID NO: 572177 - DNA, 13 bp, Homo sapiens
tacagcagatcca

SEQ ID NO: 572178 - DNA, 20 bp, Homo sapiens
tacagcagatccacctgcac

SEQ ID NO: 572179 - DNA, 21 bp, Homo sapiens
tacagcagatccacctgcaca

SEQ ID NO: 572180 - DNA, 20 bp, Homo sapiens
tacagctgaaagacagtaaa

SEQ ID NO: 572181 - DNA, 21 bp, Homo sapiens
tacagctttacacacacagat

SEQ ID NO: 572182 - DNA, 15 bp, Homo sapiens
tacaggggaggctga

SEQ ID NO: 572183 - DNA, 20 bp, Homo sapiens
tacagtagctgtggggagct

SEQ ID NO: 572184 - DNA, 23 bp, Homo sapiens
tacagtctctttcttcctttcta

SEQ ID NO: 572185 - DNA, 15 bp, Homo sapiens
tacagtggcagtatt

SEQ ID NO: 572186 - DNA, 16 bp, Homo sapiens
tacagttacttttcct

SEQ ID NO: 572187 - DNA, 21 bp, Homo sapiens
tacagttgggaaaatatgtcc

SEQ ID NO: 572188 - DNA, 18 bp, Homo sapiens
tagctttgggcagatttg

SEQ ID NO: 572189 - DNA, 22 bp, Homo sapiens
tagctttgggcagatttgcaac

SEQ ID NO: 572190 - DNA, 19 bp, Homo sapiens
taggaaagcctcactgata

SEQ ID NO: 572191 - DNA, 22 bp, Homo sapiens
taggaacaaatcttcctggtcg

SEQ ID NO: 572192 - DNA, 19 bp, Homo sapiens
taggaacccggcatgccga

SEQ ID NO: 572193 - DNA, 22 bp, Homo sapiens
taggaacccggcatgccgagtg

SEQ ID NO: 572194 - DNA, 17 bp, Homo sapiens
taggaaggcacttctgc

SEQ ID NO: 572195 - DNA, 19 bp, Homo sapiens
taggaaggcacttctgcct

SEQ ID NO: 572196 - DNA, 17 bp, Homo sapiens
taggaatattatatttg

SEQ ID NO: 572197 - DNA, 20 bp, Homo sapiens
taggaatattatatttggat

SEQ ID NO: 572198 - DNA, 20 bp, Homo sapiens
taggacaaggtgcaggcagg

SEQ ID NO: 572199 - DNA, 18 bp, Homo sapiens
taggacatctctgtaaaa

SEQ ID NO: 572200 - DNA, 23 bp, Homo sapiens
taggaccatttctctgcaggcca

SEQ ID NO: 572201 - DNA, 12 bp, Homo sapiens
taggagaggaaa

SEQ ID NO: 572202 - DNA, 14 bp, Homo sapiens
taggattgaagtgg

SEQ ID NO: 572203 - DNA, 17 bp, Homo sapiens
taggcagggtgtctgcc

SEQ ID NO: 572204 - DNA, 20 bp, Homo sapiens
taggcagggtgtctgccccc

SEQ ID NO: 572205 - DNA, 19 bp, Homo sapiens
taggcagtataaagaatag

SEQ ID NO: 572206 - DNA, 19 bp, Homo sapiens
tagggccagggctctggca

SEQ ID NO: 572207 - DNA, 18 bp, Homo sapiens
taggggagagatctccaa

SEQ ID NO: 572208 - DNA, 19 bp, Homo sapiens
taggtcgttttaaaaacaa

SEQ ID NO: 572209 - DNA, 19 bp, Homo sapiens
taggtctatgatgtccaaa

SEQ ID NO: 572210 - DNA, 14 bp, Homo sapiens
taggttcaattccc

SEQ ID NO: 572211 - DNA, 14 bp, Homo sapiens
tagtaggatatgcc

SEQ ID NO: 572212 - DNA, 12 bp, Homo sapiens
tagtatttgaaa

SEQ ID NO: 572213 - DNA, 23 bp, Homo sapiens
tagtcaaatgtaatgtggcttct

SEQ ID NO: 572214 - DNA, 20 bp, Homo sapiens
tagtcctcaccttctgtttt

SEQ ID NO: 572215 - DNA, 19 bp, Homo sapiens
tagtcttttgcatgtcgca

SEQ ID NO: 572216 - DNA, 19 bp, Homo sapiens
tagtgaaaattttattgaa

SEQ ID NO: 572217 - DNA, 21 bp, Homo sapiens
tagtgaccaatcgggagtagc

SEQ ID NO: 572218 - DNA, 14 bp, Homo sapiens
tagtgcaatatatt

SEQ ID NO: 572219 - DNA, 15 bp, Homo sapiens
tagtgcaatatattt

SEQ ID NO: 572220 - DNA, 18 bp, Homo sapiens
tagtggaccctgaaatgt

SEQ ID NO: 572221 - DNA, 21 bp, Homo sapiens
tagtggaccctgaaatgtgtg

SEQ ID NO: 572222 - DNA, 15 bp, Homo sapiens
tagtggatggaatat

SEQ ID NO: 572223 - DNA, 22 bp, Homo sapiens
tagtggcttcagcccctggggt

SEQ ID NO: 572224 - DNA, 18 bp, Homo sapiens
tagtgtatatgtgatttt

SEQ ID NO: 572225 - DNA, 11 bp, Homo sapiens
tagtgtctcta

SEQ ID NO: 572226 - DNA, 18 bp, Homo sapiens
tagtgtctctatttatga

SEQ ID NO: 572227 - DNA, 12 bp, Homo sapiens
tagttccctttg

SEQ ID NO: 572228 - DNA, 14 bp, Homo sapiens
tagttgttaagttt

SEQ ID NO: 572229 - DNA, 15 bp, Homo sapiens
tataaaaaaaatgaa

SEQ ID NO: 572230 - DNA, 16 bp, Homo sapiens
tataaaaaaaatgaaa

SEQ ID NO: 572231 - DNA, 23 bp, Homo sapiens
tataaaatacacgtgtatatgag

SEQ ID NO: 572232 - DNA, 19 bp, Homo sapiens
tataaaatagttgtccata

SEQ ID NO: 572233 - DNA, 16 bp, Homo sapiens
tataaaatggcaacaa

SEQ ID NO: 572234 - DNA, 20 bp, Homo sapiens
tataaaatggcaacaaactg

SEQ ID NO: 572235 - DNA, 16 bp, Homo sapiens
tataaacattaaatgt

SEQ ID NO: 572236 - DNA, 18 bp, Homo sapiens
tataaacattaaatgtct

SEQ ID NO: 572237 - DNA, 17 bp, Homo sapiens
tataaagaataggactt

SEQ ID NO: 572238 - DNA, 21 bp, Homo sapiens
tataaagaataggacttgttt

SEQ ID NO: 572239 - DNA, 15 bp, Homo sapiens
tataaagcatctaaa

SEQ ID NO: 572240 - DNA, 17 bp, Homo sapiens
tataaagcatctaaact

SEQ ID NO: 572241 - DNA, 19 bp, Homo sapiens
tataaatgtatatacacat

SEQ ID NO: 572242 - DNA, 15 bp, Homo sapiens
tataagcaaatttca

SEQ ID NO: 572243 - DNA, 20 bp, Homo sapiens
tataagcacagacaattcta

SEQ ID NO: 572244 - DNA, 23 bp, Homo sapiens
tataagcacagacaattctaatg

SEQ ID NO: 572245 - DNA, 17 bp, Homo sapiens
tataagtgcacacagaa

SEQ ID NO: 572246 - DNA, 21 bp, Homo sapiens
tataagtgcacacagaaatat

SEQ ID NO: 572247 - DNA, 22 bp, Homo sapiens
tataagtgcacacagaaatata

SEQ ID NO: 572248 - DNA, 17 bp, Homo sapiens
tataatggaagagaaat

SEQ ID NO: 572249 - DNA, 17 bp, Homo sapiens
tataatggcctcttaaa

SEQ ID NO: 572250 - DNA, 22 bp, Homo sapiens
tataatggcctcttaaaaatta

SEQ ID NO: 572251 - DNA, 14 bp, Homo sapiens
tataatgtgtgtat

SEQ ID NO: 572252 - DNA, 20 bp, Homo sapiens
tataatgtgtgtatgtgtat

SEQ ID NO: 572253 - DNA, 18 bp, Homo sapiens
tataattttattgctgga

SEQ ID NO: 572254 - DNA, 14 bp, Homo sapiens
tatacaatatataa

SEQ ID NO: 572255 - DNA, 19 bp, Homo sapiens
tatacaatatataaaaata

SEQ ID NO: 572256 - DNA, 12 bp, Homo sapiens
tatacacacagg

SEQ ID NO: 572257 - DNA, 15 bp, Homo sapiens
tatacacatatacct

SEQ ID NO: 572258 - DNA, 12 bp, Homo sapiens
tatacatgtgtg

SEQ ID NO: 572259 - DNA, 13 bp, Homo sapiens
tatacatgtgtgt

SEQ ID NO: 572260 - DNA, 20 bp, Homo sapiens
tatacatgtgtgtatatatg

SEQ ID NO: 572261 - DNA, 22 bp, Homo sapiens
tatacatgtgtgtatatatgtg

SEQ ID NO: 572262 - DNA, 12 bp, Homo sapiens
tatacctctaac

SEQ ID NO: 572263 - DNA, 17 bp, Homo sapiens
tatacctgtacacacac

SEQ ID NO: 572264 - DNA, 20 bp, Homo sapiens
tatacctgtacacacacaga

SEQ ID NO: 572265 - DNA, 13 bp, Homo sapiens
tatacctgttgct

SEQ ID NO: 572266 - DNA, 23 bp, Homo sapiens
tatacctgttgcttaattacaat

SEQ ID NO: 572267 - DNA, 23 bp, Homo sapiens
tatactatttattaaaaccattc

SEQ ID NO: 572268 - DNA, 12 bp, Homo sapiens
tatactccttaa

SEQ ID NO: 572269 - DNA, 14 bp, Homo sapiens
tatagaaagtgttc

SEQ ID NO: 572270 - DNA, 18 bp, Homo sapiens
tatagaagaatgcatgct

SEQ ID NO: 572271 - DNA, 20 bp, Homo sapiens
tatagaagaatgcatgcttt

SEQ ID NO: 572272 - DNA, 14 bp, Homo sapiens
tatagaagtcttca

SEQ ID NO: 572273 - DNA, 15 bp, Homo sapiens
tatagaagtcttcat

SEQ ID NO: 572274 - DNA, 22 bp, Homo sapiens
tatagaagtcttcatgaaatgc

SEQ ID NO: 572275 - DNA, 18 bp, Homo sapiens
tatagacaggagaagaaa

SEQ ID NO: 572276 - DNA, 15 bp, Homo sapiens
tatagtatttgaaaa

SEQ ID NO: 572277 - DNA, 14 bp, Homo sapiens
tatagtgcaatata

SEQ ID NO: 572278 - DNA, 15 bp, Homo sapiens
tatataaaaatatat

SEQ ID NO: 572279 - DNA, 21 bp, Homo sapiens
tatataaaaatatatatagtg

SEQ ID NO: 572280 - DNA, 17 bp, Homo sapiens
tatataaaatacacgtg

SEQ ID NO: 572281 - DNA, 22 bp, Homo sapiens
tatataaaatacacgtgtatat

SEQ ID NO: 572282 - DNA, 12 bp, Homo sapiens
tatatacacata

SEQ ID NO: 572283 - DNA, 13 bp, Homo sapiens
tatatacacatat

SEQ ID NO: 572284 - DNA, 18 bp, Homo sapiens
tatatacacatataccta

SEQ ID NO: 572285 - DNA, 21 bp, Homo sapiens
tatatacatacgcaattgtat

SEQ ID NO: 572286 - DNA, 15 bp, Homo sapiens
tatatacatatgtag

SEQ ID NO: 572287 - DNA, 17 bp, Homo sapiens
tatatacatatgtagac

SEQ ID NO: 572288 - DNA, 16 bp, Homo sapiens
tatatacatgtgtgta

SEQ ID NO: 572289 - DNA, 22 bp, Homo sapiens
tatatagcagcaaaaatataaa

SEQ ID NO: 572290 - DNA, 15 bp, Homo sapiens
tatatagcatttatg

SEQ ID NO: 572291 - DNA, 15 bp, Homo sapiens
tatatagtgctatat

SEQ ID NO: 572292 - DNA, 13 bp, Homo sapiens
tatatataaaata

SEQ ID NO: 572293 - DNA, 16 bp, Homo sapiens
tatatataaaatacac

SEQ ID NO: 572294 - DNA, 17 bp, Homo sapiens
tatatataaaatacacg

SEQ ID NO: 572295 - DNA, 13 bp, Homo sapiens
tatatataaataa

SEQ ID NO: 572296 - DNA, 14 bp, Homo sapiens
tatatatacataca

SEQ ID NO: 572297 - DNA, 15 bp, Homo sapiens
tatatatacatatgt

SEQ ID NO: 572298 - DNA, 18 bp, Homo sapiens
tatatatacatatgtaga

SEQ ID NO: 572299 - DNA, 13 bp, Homo sapiens
tatatatatatct

SEQ ID NO: 572300 - DNA, 20 bp, Homo sapiens
tatatatgtgtatatataca

SEQ ID NO: 572301 - DNA, 21 bp, Homo sapiens
tatatatgtgtatatatacat

SEQ ID NO: 572302 - DNA, 22 bp, Homo sapiens
tatatatgtgtatatatacata

SEQ ID NO: 572303 - DNA, 19 bp, Homo sapiens
tatatattttgaaaggaga

SEQ ID NO: 572304 - DNA, 15 bp, Homo sapiens
tatatctaaatctgt

SEQ ID NO: 572305 - DNA, 21 bp, Homo sapiens
tatatcttggcaggtaggaat

SEQ ID NO: 572306 - DNA, 14 bp, Homo sapiens
tatatgtgaacttt

SEQ ID NO: 572307 - DNA, 18 bp, Homo sapiens
tatatgtgtatatataca

SEQ ID NO: 572308 - DNA, 16 bp, Homo sapiens
tatatgtttacacaat

SEQ ID NO: 572309 - DNA, 18 bp, Homo sapiens
tatatgtttatacacaca

SEQ ID NO: 572310 - DNA, 19 bp, Homo sapiens
tatatgtttatacacacag

SEQ ID NO: 572311 - DNA, 22 bp, Homo sapiens
tatatttaagtattcaagaaag

SEQ ID NO: 572312 - DNA, 22 bp, Homo sapiens
tatatttgcagataattctgga

SEQ ID NO: 572313 - DNA, 21 bp, Homo sapiens
tatattttgtatgcaagcagt

SEQ ID NO: 572314 - DNA, 22 bp, Homo sapiens
tatatttttaaaggaaaaatca

SEQ ID NO: 572315 - DNA, 15 bp, Homo sapiens
tatatttttcttaaa

SEQ ID NO: 572316 - DNA, 18 bp, Homo sapiens
tatatttttcttaaaaag

SEQ ID NO: 572317 - DNA, 18 bp, Homo sapiens
tatcagagtatccactgt

SEQ ID NO: 572318 - DNA, 20 bp, Homo sapiens
tatcagctacttaagagaaa

SEQ ID NO: 572319 - DNA, 17 bp, Homo sapiens
tatcagttatcctttgt

SEQ ID NO: 572320 - DNA, 13 bp, Homo sapiens
tatcatgcttcta

SEQ ID NO: 572321 - DNA, 13 bp, Homo sapiens
tatcatgtgtttc

SEQ ID NO: 572322 - DNA, 18 bp, Homo sapiens
tatccacgagagcgcagc

SEQ ID NO: 572323 - DNA, 24 bp, Homo sapiens
tatccctgatttattctggtgtct

SEQ ID NO: 572324 - DNA, 14 bp, Homo sapiens
tcagtttatgtttt

SEQ ID NO: 572325 - DNA, 14 bp, Homo sapiens
tcagtttttgttct

SEQ ID NO: 572326 - DNA, 24 bp, Homo sapiens
tcataaattcaaacctaagttgct

SEQ ID NO: 572327 - DNA, 16 bp, Homo sapiens
tcataactgtgtcatt

SEQ ID NO: 572328 - DNA, 14 bp, Homo sapiens
tcataagtaaatgt

SEQ ID NO: 572329 - DNA, 20 bp, Homo sapiens
tcataccaactttagcagaa

SEQ ID NO: 572330 - DNA, 22 bp, Homo sapiens
tcatagataccattttgaaata

SEQ ID NO: 572331 - DNA, 14 bp, Homo sapiens
tcatattacaatat

SEQ ID NO: 572332 - DNA, 15 bp, Homo sapiens
tcatattacaatatt

SEQ ID NO: 572333 - DNA, 22 bp, Homo sapiens
tcatattagacttctgttttca

SEQ ID NO: 572334 - DNA, 21 bp, Homo sapiens
tcatattttaatttcaagctt

SEQ ID NO: 572335 - DNA, 24 bp, Homo sapiens
tcatattttcctttatgtgatgta

SEQ ID NO: 572336 - DNA, 16 bp, Homo sapiens
tcatcaacaaagaaat

SEQ ID NO: 572337 - DNA, 13 bp, Homo sapiens
tcatcagaagtgg

SEQ ID NO: 572338 - DNA, 14 bp, Homo sapiens
tcatcccttctctt

SEQ ID NO: 572339 - DNA, 16 bp, Homo sapiens
tcatcccttctcttcc

SEQ ID NO: 572340 - DNA, 21 bp, Homo sapiens
tcatcccttctcttccaggca

SEQ ID NO: 572341 - DNA, 23 bp, Homo sapiens
tcatcccttctcttccaggcagc

SEQ ID NO: 572342 - DNA, 18 bp, Homo sapiens
tcatccttcccactctgt

SEQ ID NO: 572343 - DNA, 18 bp, Homo sapiens
tcatcgaaaattcatttc

SEQ ID NO: 572344 - DNA, 21 bp, Homo sapiens
tcatcgaaaattcatttcaca

SEQ ID NO: 572345 - DNA, 13 bp, Homo sapiens
tcatctcccctcc

SEQ ID NO: 572346 - DNA, 17 bp, Homo sapiens
tcatctcccctcctggc

SEQ ID NO: 572347 - DNA, 11 bp, Homo sapiens
tcatctgagag

SEQ ID NO: 572348 - DNA, 18 bp, Homo sapiens
tcatgaaatgctatgtca

SEQ ID NO: 572349 - DNA, 21 bp, Homo sapiens
tcatgaaatgctatgtcattt

SEQ ID NO: 572350 - DNA, 19 bp, Homo sapiens
tcatgatgtttttaaaatc

SEQ ID NO: 572351 - DNA, 20 bp, Homo sapiens
tcatgatgtttttaaaatct

SEQ ID NO: 572352 - DNA, 24 bp, Homo sapiens
tcatgctcccctgtgccagcccag

SEQ ID NO: 572353 - DNA, 19 bp, Homo sapiens
tcatgctttaaagtgtaat

SEQ ID NO: 572354 - DNA, 21 bp, Homo sapiens
tcatggaattggtttaaactt

SEQ ID NO: 572355 - DNA, 22 bp, Homo sapiens
tcatggaattggtttaaacttt

SEQ ID NO: 572356 - DNA, 11 bp, Homo sapiens
tcatgtatttc

SEQ ID NO: 572357 - DNA, 18 bp, Homo sapiens
tcatgtatttctttagaa

SEQ ID NO: 572358 - DNA, 23 bp, Homo sapiens
tcatgtatttctttagaacaaca

SEQ ID NO: 572359 - DNA, 15 bp, Homo sapiens
tcatgtcctgtgtca

SEQ ID NO: 572360 - DNA, 17 bp, Homo sapiens
tcatgttggtaccctgg

SEQ ID NO: 572361 - DNA, 15 bp, Homo sapiens
tcattaaaaacattt

SEQ ID NO: 572362 - DNA, 21 bp, Homo sapiens
tcattaaaaacatttttttaa

SEQ ID NO: 572363 - DNA, 14 bp, Homo sapiens
tcattaatgtgttg

SEQ ID NO: 572364 - DNA, 18 bp, Homo sapiens
tcattagcaaaaaaagtt

SEQ ID NO: 572365 - DNA, 20 bp, Homo sapiens
tcattagcaaaaaaagttgt

SEQ ID NO: 572366 - DNA, 13 bp, Homo sapiens
tcattagctgtga

SEQ ID NO: 572367 - DNA, 18 bp, Homo sapiens
tcattagctgtgattttt

SEQ ID NO: 572368 - DNA, 17 bp, Homo sapiens
tcattcaccagtacatt

SEQ ID NO: 572369 - DNA, 22 bp, Homo sapiens
tcattcaccagtacattctcag

SEQ ID NO: 572370 - DNA, 20 bp, Homo sapiens
tcattcatattacaatattt

SEQ ID NO: 572371 - DNA, 22 bp, Homo sapiens
tcattcatattacaatatttgt

SEQ ID NO: 572372 - DNA, 19 bp, Homo sapiens
tcattccctcgtctttccc

SEQ ID NO: 572373 - DNA, 21 bp, Homo sapiens
tcattcgggccccacctgcag

SEQ ID NO: 572374 - DNA, 16 bp, Homo sapiens
tcattgcttcttctga

SEQ ID NO: 572375 - DNA, 15 bp, Homo sapiens
tcattgtccagagct

SEQ ID NO: 572376 - DNA, 22 bp, Homo sapiens
tcattgtccagagctgcttccc

SEQ ID NO: 572377 - DNA, 23 bp, Homo sapiens
tcatttaacactgagtgaaatat

SEQ ID NO: 572378 - DNA, 14 bp, Homo sapiens
tcatttcacattaa

SEQ ID NO: 572379 - DNA, 12 bp, Homo sapiens
tcatttccatgt

SEQ ID NO: 572380 - DNA, 17 bp, Homo sapiens
tcatttccatgtatgca

SEQ ID NO: 572381 - DNA, 10 bp, Homo sapiens
tcatttctaa

SEQ ID NO: 572382 - DNA, 17 bp, Homo sapiens
tcatttctaaaagaata

SEQ ID NO: 572383 - DNA, 14 bp, Homo sapiens
tcatttctctttca

SEQ ID NO: 572384 - DNA, 22 bp, Homo sapiens
tcattttacagttacttttcct

SEQ ID NO: 572385 - DNA, 11 bp, Homo sapiens
tcattttcatt

SEQ ID NO: 572386 - DNA, 12 bp, Homo sapiens
tcattttcatta

SEQ ID NO: 572387 - DNA, 13 bp, Homo sapiens
tcattttgagaac

SEQ ID NO: 572388 - DNA, 14 bp, Homo sapiens
tcattttgagaaca

SEQ ID NO: 572389 - DNA, 16 bp, Homo sapiens
tcattttgagaacatt

SEQ ID NO: 572390 - DNA, 14 bp, Homo sapiens
tccaaaagaaaaac

SEQ ID NO: 572391 - DNA, 22 bp, Homo sapiens
tccaaacatgaggttctctcta

SEQ ID NO: 572392 - DNA, 15 bp, Homo sapiens
tccaaagcagagagc

SEQ ID NO: 572393 - DNA, 16 bp, Homo sapiens
tccaaaggtttcaact

SEQ ID NO: 572394 - DNA, 16 bp, Homo sapiens
tccaacaccacagaca

SEQ ID NO: 572395 - DNA, 22 bp, Homo sapiens
tccaacaccacagacacacaca

SEQ ID NO: 572396 - DNA, 15 bp, Homo sapiens
tccaacatgtgatgt

SEQ ID NO: 572397 - DNA, 17 bp, Homo sapiens
tccaacgtggggcagca

SEQ ID NO: 572398 - DNA, 20 bp, Homo sapiens
tccaactcagagcacagcca

SEQ ID NO: 572399 - DNA, 15 bp, Homo sapiens
tccaagccagcaagc

SEQ ID NO: 572400 - DNA, 17 bp, Homo sapiens
tccaagggcccagaggg

SEQ ID NO: 572401 - DNA, 13 bp, Homo sapiens
tccacacacacaa

SEQ ID NO: 572402 - DNA, 21 bp, Homo sapiens
tccacagggacacagtctggt

SEQ ID NO: 572403 - DNA, 23 bp, Homo sapiens
tccacagggacacagtctggtgc

SEQ ID NO: 572404 - DNA, 14 bp, Homo sapiens
tccacattctgctg

SEQ ID NO: 572405 - DNA, 18 bp, Homo sapiens
tccacattctgctgcccc

SEQ ID NO: 572406 - DNA, 20 bp, Homo sapiens
tccacattctgctgccccca

SEQ ID NO: 572407 - DNA, 21 bp, Homo sapiens
tccacattctgctgcccccag

SEQ ID NO: 572408 - DNA, 23 bp, Homo sapiens
tccacattctgctgcccccagac

SEQ ID NO: 572409 - DNA, 23 bp, Homo sapiens
tccacattgcataagtggaccca

SEQ ID NO: 572410 - DNA, 23 bp, Homo sapiens
tccaccgtctttcttttatactg

SEQ ID NO: 572411 - DNA, 13 bp, Homo sapiens
tccacctctggga

SEQ ID NO: 572412 - DNA, 13 bp, Homo sapiens
tccacctgcacaa

SEQ ID NO: 572413 - DNA, 22 bp, Homo sapiens
tccacctgcacaaacatagaca

SEQ ID NO: 572414 - DNA, 15 bp, Homo sapiens
tccacctgctctgct

SEQ ID NO: 572415 - DNA, 18 bp, Homo sapiens
tccacctgctctgctgat

SEQ ID NO: 572416 - DNA, 17 bp, Homo sapiens
tccacctgggagatgct

SEQ ID NO: 572417 - DNA, 21 bp, Homo sapiens
tccacctgggagatgctggga

SEQ ID NO: 572418 - DNA, 22 bp, Homo sapiens
tccaccttggcgcgcagcccgg

SEQ ID NO: 572419 - DNA, 23 bp, Homo sapiens
tccaccttggcgcgcagcccggg

SEQ ID NO: 572420 - DNA, 17 bp, Homo sapiens
tccacgttcacccctcc

SEQ ID NO: 572421 - DNA, 22 bp, Homo sapiens
tccactgtttattcaacaacta

SEQ ID NO: 572422 - DNA, 15 bp, Homo sapiens
tccactttgtataaa

SEQ ID NO: 572423 - DNA, 18 bp, Homo sapiens
tccactttgtataaattt

SEQ ID NO: 572424 - DNA, 19 bp, Homo sapiens
tccactttgtataaatttt

SEQ ID NO: 572425 - DNA, 16 bp, Homo sapiens
tccagaaacttgttct

SEQ ID NO: 572426 - DNA, 17 bp, Homo sapiens
tccagaaacttgttctt

SEQ ID NO: 572427 - DNA, 20 bp, Homo sapiens
tccagaaacttgttcttcca

SEQ ID NO: 572428 - DNA, 19 bp, Homo sapiens
tccagaaatgtccctttct

SEQ ID NO: 572429 - DNA, 20 bp, Homo sapiens
tccagaaatgtccctttctt

SEQ ID NO: 572430 - DNA, 16 bp, Homo sapiens
tccagaagcagcagct

SEQ ID NO: 572431 - DNA, 13 bp, Homo sapiens
tccagacctgggc

SEQ ID NO: 572432 - DNA, 14 bp, Homo sapiens
tccagacctgggcc

SEQ ID NO: 572433 - DNA, 18 bp, Homo sapiens
tccagacctgggccctgg

SEQ ID NO: 572434 - DNA, 19 bp, Homo sapiens
tccagacctgggccctggt

SEQ ID NO: 572435 - DNA, 15 bp, Homo sapiens
tccagagctgcttcc

SEQ ID NO: 572436 - DNA, 16 bp, Homo sapiens
tccagagctgcttccc

SEQ ID NO: 572437 - DNA, 14 bp, Homo sapiens
tccagaggtgaggg

SEQ ID NO: 572438 - DNA, 21 bp, Homo sapiens
tccagatgatccttgcacaga

SEQ ID NO: 572439 - DNA, 16 bp, Homo sapiens
tccaggaacacatgca

SEQ ID NO: 572440 - DNA, 18 bp, Homo sapiens
tccaggcagcacccaggt

SEQ ID NO: 572441 - DNA, 15 bp, Homo sapiens
tccaggcatgaccct

SEQ ID NO: 572442 - DNA, 17 bp, Homo sapiens
tccaggcatgaccctgg

SEQ ID NO: 572443 - DNA, 19 bp, Homo sapiens
tccaggcgtagggccaggg

SEQ ID NO: 572444 - DNA, 20 bp, Homo sapiens
tccaggcgtagggccagggc

SEQ ID NO: 572445 - DNA, 23 bp, Homo sapiens
tccaggctccctccctcccagat

SEQ ID NO: 572446 - DNA, 16 bp, Homo sapiens
tccagggaaccagagc

SEQ ID NO: 572447 - DNA, 17 bp, Homo sapiens
tccagggctcaacactg

SEQ ID NO: 572448 - DNA, 12 bp, Homo sapiens
tccagtcaggct

SEQ ID NO: 572449 - DNA, 20 bp, Homo sapiens
tccagtcaggctctctgggc

SEQ ID NO: 572450 - DNA, 21 bp, Homo sapiens
tccagtccccagaactctgcc

SEQ ID NO: 572451 - DNA, 18 bp, Homo sapiens
tccagtcttccacctgga

SEQ ID NO: 572452 - DNA, 20 bp, Homo sapiens
tccagtcttccacctggaag

SEQ ID NO: 572453 - DNA, 19 bp, Homo sapiens
tccagtgctgctcccttta

SEQ ID NO: 572454 - DNA, 21 bp, Homo sapiens
tccagtgttcccttctggctg

SEQ ID NO: 572455 - DNA, 14 bp, Homo sapiens
tccagttctgatga

SEQ ID NO: 572456 - DNA, 15 bp, Homo sapiens
tccatacttctctca

SEQ ID NO: 572457 - DNA, 17 bp, Homo sapiens
tccatacttctctcaga

SEQ ID NO: 572458 - DNA, 17 bp, Homo sapiens
tccatattagaaaactt

SEQ ID NO: 572459 - DNA, 18 bp, Homo sapiens
tccatattttcacaggtg

SEQ ID NO: 572460 - DNA, 20 bp, Homo sapiens
tcctgtgctaagtctttccc

SEQ ID NO: 572461 - DNA, 16 bp, Homo sapiens
tcctgtttcaagttca

SEQ ID NO: 572462 - DNA, 18 bp, Homo sapiens
tccttaaaaatgtatgtt

SEQ ID NO: 572463 - DNA, 15 bp, Homo sapiens
tccttacaaatgatt

SEQ ID NO: 572464 - DNA, 18 bp, Homo sapiens
tccttacaaatgattgct

SEQ ID NO: 572465 - DNA, 20 bp, Homo sapiens
tccttacaaatgattgcttt

SEQ ID NO: 572466 - DNA, 15 bp, Homo sapiens
tccttacataaacat

SEQ ID NO: 572467 - DNA, 24 bp, Homo sapiens
tccttagggttttctctctatttc

SEQ ID NO: 572468 - DNA, 21 bp, Homo sapiens
tccttatgggtagggctctga

SEQ ID NO: 572469 - DNA, 20 bp, Homo sapiens
tccttcaacaaggcttgctg

SEQ ID NO: 572470 - DNA, 15 bp, Homo sapiens
tccttcaagccagca

SEQ ID NO: 572471 - DNA, 22 bp, Homo sapiens
tccttcactccctgtcatagtt

SEQ ID NO: 572472 - DNA, 17 bp, Homo sapiens
tccttccacagttatct

SEQ ID NO: 572473 - DNA, 15 bp, Homo sapiens
tccttcccactctgt

SEQ ID NO: 572474 - DNA, 14 bp, Homo sapiens
tccttcccactctt

SEQ ID NO: 572475 - DNA, 17 bp, Homo sapiens
tccttcccactcttctc

SEQ ID NO: 572476 - DNA, 17 bp, Homo sapiens
tccttcccttgctacca

SEQ ID NO: 572477 - DNA, 13 bp, Homo sapiens
tccttcctgttct

SEQ ID NO: 572478 - DNA, 18 bp, Homo sapiens
tccttcctgttctgtgtc

SEQ ID NO: 572479 - DNA, 14 bp, Homo sapiens
tccttctccccaag

SEQ ID NO: 572480 - DNA, 15 bp, Homo sapiens
tccttgggctgggac

SEQ ID NO: 572481 - DNA, 23 bp, Homo sapiens
tcctttattataatcaaagctca

SEQ ID NO: 572482 - DNA, 18 bp, Homo sapiens
tcctttcacttctttccc

SEQ ID NO: 572483 - DNA, 23 bp, Homo sapiens
tcctttggccactgtatttgtta

SEQ ID NO: 572484 - DNA, 14 bp, Homo sapiens
tccttttccagagc

SEQ ID NO: 572485 - DNA, 15 bp, Homo sapiens
tccttttgtatcctc

SEQ ID NO: 572486 - DNA, 19 bp, Homo sapiens
tccttttgtgttccaaaca

SEQ ID NO: 572487 - DNA, 20 bp, Homo sapiens
tcgaaagttagtaggatatg

SEQ ID NO: 572488 - DNA, 11 bp, Homo sapiens
tcgagaattgt

SEQ ID NO: 572489 - DNA, 15 bp, Homo sapiens
tcgatgagactgttt

SEQ ID NO: 572490 - DNA, 17 bp, Homo sapiens
tcgatgttcatggaatt

SEQ ID NO: 572491 - DNA, 19 bp, Homo sapiens
tcgcaggcctccctgccag

SEQ ID NO: 572492 - DNA, 14 bp, Homo sapiens
tcgccgtggctgcg

SEQ ID NO: 572493 - DNA, 23 bp, Homo sapiens
tcgcctcggatcagctgagcctt

SEQ ID NO: 572494 - DNA, 15 bp, Homo sapiens
tcgccttccacctct

SEQ ID NO: 572495 - DNA, 19 bp, Homo sapiens
tcgccttccacctctggga

SEQ ID NO: 572496 - DNA, 14 bp, Homo sapiens
tcgctggcccccac

SEQ ID NO: 572497 - DNA, 18 bp, Homo sapiens
tcgctggcccccactggc

SEQ ID NO: 572498 - DNA, 20 bp, Homo sapiens
tcgctggcccccactggctg

SEQ ID NO: 572499 - DNA, 21 bp, Homo sapiens
tcgctggcccccactggctgt

SEQ ID NO: 572500 - DNA, 18 bp, Homo sapiens
tcggaccgaaggtgacag

SEQ ID NO: 572501 - DNA, 12 bp, Homo sapiens
tcggagttcttc

SEQ ID NO: 572502 - DNA, 13 bp, Homo sapiens
tcggagttcttct

SEQ ID NO: 572503 - DNA, 18 bp, Homo sapiens
tcggcaactaagcagtcc

SEQ ID NO: 572504 - DNA, 13 bp, Homo sapiens
tcggccagagctc

SEQ ID NO: 572505 - DNA, 15 bp, Homo sapiens
tcggccagagctccc

SEQ ID NO: 572506 - DNA, 16 bp, Homo sapiens
tcggccagagctccca

SEQ ID NO: 572507 - DNA, 19 bp, Homo sapiens
tcggccagagctcccagga

SEQ ID NO: 572508 - DNA, 22 bp, Homo sapiens
tcggctccagtccccagaactc

SEQ ID NO: 572509 - DNA, 17 bp, Homo sapiens
tcgggccccacctgcag

SEQ ID NO: 572510 - DNA, 18 bp, Homo sapiens
tcgggctaagtccagctc

SEQ ID NO: 572511 - DNA, 23 bp, Homo sapiens
tcggtaaaccgaggacccatgaa

SEQ ID NO: 572512 - DNA, 12 bp, Homo sapiens
tcggtcagcagg

SEQ ID NO: 572513 - DNA, 17 bp, Homo sapiens
tcgtatagaagtcttca

SEQ ID NO: 572514 - DNA, 22 bp, Homo sapiens
tcgtcaggaggtgcctgagagc

SEQ ID NO: 572515 - DNA, 17 bp, Homo sapiens
tcgtccccagaccagta

SEQ ID NO: 572516 - DNA, 21 bp, Homo sapiens
tcgtctcggccttcacaatct

SEQ ID NO: 572517 - DNA, 19 bp, Homo sapiens
tctaaaactgtactttgat

SEQ ID NO: 572518 - DNA, 22 bp, Homo sapiens
tctaaaagaatattcagagaat

SEQ ID NO: 572519 - DNA, 14 bp, Homo sapiens
tctaaaattacata

SEQ ID NO: 572520 - DNA, 19 bp, Homo sapiens
tctaaactttaatatgtat

SEQ ID NO: 572521 - DNA, 13 bp, Homo sapiens
tctaaatattatg

SEQ ID NO: 572522 - DNA, 20 bp, Homo sapiens
tctaaattctttatttctgt

SEQ ID NO: 572523 - DNA, 22 bp, Homo sapiens
tctaactatatgtacagctctc

SEQ ID NO: 572524 - DNA, 16 bp, Homo sapiens
tctaactctgatgtaa

SEQ ID NO: 572525 - DNA, 18 bp, Homo sapiens
tctaagaaacattggaag

SEQ ID NO: 572526 - DNA, 12 bp, Homo sapiens
tctaagatgtta

SEQ ID NO: 572527 - DNA, 21 bp, Homo sapiens
tctaagtagagtatattgaaa

SEQ ID NO: 572528 - DNA, 14 bp, Homo sapiens
tctaagtgtttcac

SEQ ID NO: 572529 - DNA, 15 bp, Homo sapiens
tctaatggtaacttt

SEQ ID NO: 572530 - DNA, 17 bp, Homo sapiens
tctaatggtaacttttg

SEQ ID NO: 572531 - DNA, 20 bp, Homo sapiens
tctaatggtaacttttgtag

SEQ ID NO: 572532 - DNA, 12 bp, Homo sapiens
tctaatgtttaa

SEQ ID NO: 572533 - DNA, 12 bp, Homo sapiens
tctacagctccc

SEQ ID NO: 572534 - DNA, 16 bp, Homo sapiens
tctacagctcccccag

SEQ ID NO: 572535 - DNA, 17 bp, Homo sapiens
tctaccaactttcaaga

SEQ ID NO: 572536 - DNA, 15 bp, Homo sapiens
tctactttaaattgt

SEQ ID NO: 572537 - DNA, 20 bp, Homo sapiens
tctactttaaattgtggatg

SEQ ID NO: 572538 - DNA, 15 bp, Homo sapiens
tctagacactttttc

SEQ ID NO: 572539 - DNA, 14 bp, Homo sapiens
tctagccctgcccg

SEQ ID NO: 572540 - DNA, 15 bp, Homo sapiens
tctagcgtagtgcag

SEQ ID NO: 572541 - DNA, 14 bp, Homo sapiens
tctatagaaagtgt

SEQ ID NO: 572542 - DNA, 16 bp, Homo sapiens
tctatagaaagtgttc

SEQ ID NO: 572543 - DNA, 14 bp, Homo sapiens
tctatcagttatcc

SEQ ID NO: 572544 - DNA, 14 bp, Homo sapiens
tctatccatctcct

SEQ ID NO: 572545 - DNA, 19 bp, Homo sapiens
tctatctaatcagatcttc

SEQ ID NO: 572546 - DNA, 13 bp, Homo sapiens
tctatgtaacttg

SEQ ID NO: 572547 - DNA, 18 bp, Homo sapiens
tctatgtaacttgttgca

SEQ ID NO: 572548 - DNA, 20 bp, Homo sapiens
tctattagcttactgattaa

SEQ ID NO: 572549 - DNA, 19 bp, Homo sapiens
tctatttccccctttcttc

SEQ ID NO: 572550 - DNA, 22 bp, Homo sapiens
tctatttccccctttcttcctc

SEQ ID NO: 572551 - DNA, 20 bp, Homo sapiens
tctattttaccactaatttt

SEQ ID NO: 572552 - DNA, 11 bp, Homo sapiens
tctcaaaggag

SEQ ID NO: 572553 - DNA, 14 bp, Homo sapiens
tctcaaaggagctt

SEQ ID NO: 572554 - DNA, 23 bp, Homo sapiens
tctcaatgtcttcccacaaatgg

SEQ ID NO: 572555 - DNA, 16 bp, Homo sapiens
tctcagaatctttcct

SEQ ID NO: 572556 - DNA, 14 bp, Homo sapiens
tctcagatgggctg

SEQ ID NO: 572557 - DNA, 13 bp, Homo sapiens
tctcagcactttg

SEQ ID NO: 572558 - DNA, 15 bp, Homo sapiens
tctcagtttttctta

SEQ ID NO: 572559 - DNA, 22 bp, Homo sapiens
tctcagtttttcttaatatata

SEQ ID NO: 572560 - DNA, 16 bp, Homo sapiens
tctcatccttttctcc

SEQ ID NO: 572561 - DNA, 18 bp, Homo sapiens
tctcatccttttctccta

SEQ ID NO: 572562 - DNA, 19 bp, Homo sapiens
tctcatgctgcccctgcct

SEQ ID NO: 572563 - DNA, 16 bp, Homo sapiens
tctccacaacctcctc

SEQ ID NO: 572564 - DNA, 18 bp, Homo sapiens
tctccagtggattcccag

SEQ ID NO: 572565 - DNA, 17 bp, Homo sapiens
tctccatcagaggacac

SEQ ID NO: 572566 - DNA, 19 bp, Homo sapiens
tctccattttggtgtcttt

SEQ ID NO: 572567 - DNA, 22 bp, Homo sapiens
tctcccaactcttgcacagtca

SEQ ID NO: 572568 - DNA, 23 bp, Homo sapiens
tctcccccacccttgttccagtt

SEQ ID NO: 572569 - DNA, 22 bp, Homo sapiens
tctcccctcccttgtccttgaa

SEQ ID NO: 572570 - DNA, 17 bp, Homo sapiens
tctcccctttgctaacg

SEQ ID NO: 572571 - DNA, 12 bp, Homo sapiens
tctcctcactga

SEQ ID NO: 572572 - DNA, 21 bp, Homo sapiens
tctcctgcccccacacctggc

SEQ ID NO: 572573 - DNA, 15 bp, Homo sapiens
tctcctggtgttctg

SEQ ID NO: 572574 - DNA, 23 bp, Homo sapiens
tctcctttaatatactccttaaa

SEQ ID NO: 572575 - DNA, 20 bp, Homo sapiens
tctcctttagggacagctta

SEQ ID NO: 572576 - DNA, 20 bp, Homo sapiens
tctcctttggaaggtgacac

SEQ ID NO: 572577 - DNA, 21 bp, Homo sapiens
tctcggcaactaagcagtccc

SEQ ID NO: 572578 - DNA, 17 bp, Homo sapiens
tctcgtatggatttcta

SEQ ID NO: 572579 - DNA, 15 bp, Homo sapiens
tctctacccctttct

SEQ ID NO: 572580 - DNA, 17 bp, Homo sapiens
tctctattccccaccct

SEQ ID NO: 572581 - DNA, 22 bp, Homo sapiens
tctctatttatgagatcactga

SEQ ID NO: 572582 - DNA, 12 bp, Homo sapiens
tctctctccaag

SEQ ID NO: 572583 - DNA, 18 bp, Homo sapiens
tctctctggctctaggac

SEQ ID NO: 572584 - DNA, 13 bp, Homo sapiens
tctctctgtgctg

SEQ ID NO: 572585 - DNA, 15 bp, Homo sapiens
tctctctgtgctggt

SEQ ID NO: 572586 - DNA, 10 bp, Homo sapiens
tctctgccat

SEQ ID NO: 572587 - DNA, 17 bp, Homo sapiens
tctctggctaaggacag

SEQ ID NO: 572588 - DNA, 19 bp, Homo sapiens
tctctggctctaggacccc

SEQ ID NO: 572589 - DNA, 15 bp, Homo sapiens
tctctgtaaaaagca

SEQ ID NO: 572590 - DNA, 15 bp, Homo sapiens
tctctgtataaacat

SEQ ID NO: 572591 - DNA, 21 bp, Homo sapiens
tctctgtataaacattaaatg

SEQ ID NO: 572592 - DNA, 22 bp, Homo sapiens
tctctgtataaacattaaatgt

SEQ ID NO: 572593 - DNA, 16 bp, Homo sapiens
tctcttccaggcagcc

SEQ ID NO: 572594 - DNA, 18 bp, Homo sapiens
tctcttctccccttccat

SEQ ID NO: 572595 - DNA, 11 bp, Homo sapiens
tctcttctcct

SEQ ID NO: 572596 - DNA, 13 bp, Homo sapiens
tctcttctcctta

SEQ ID NO: 572597 - DNA, 21 bp, Homo sapiens
tgagcccatgtggagtcagcc

SEQ ID NO: 572598 - DNA, 22 bp, Homo sapiens
tgagcccatgtggagtcagcct

SEQ ID NO: 572599 - DNA, 19 bp, Homo sapiens
tgaggaaaaatatgtgaag

SEQ ID NO: 572600 - DNA, 14 bp, Homo sapiens
tgaggacaaggaaa

SEQ ID NO: 572601 - DNA, 17 bp, Homo sapiens
tgaggatgtatgtgtat

SEQ ID NO: 572602 - DNA, 15 bp, Homo sapiens
tgaggccaaatgagt

SEQ ID NO: 572603 - DNA, 20 bp, Homo sapiens
tgaggccaaatgagttccct

SEQ ID NO: 572604 - DNA, 14 bp, Homo sapiens
tgagggaggcctga

SEQ ID NO: 572605 - DNA, 15 bp, Homo sapiens
tgaggtcatcccggg

SEQ ID NO: 572606 - DNA, 19 bp, Homo sapiens
tgaggtcatcccggggcca

SEQ ID NO: 572607 - DNA, 13 bp, Homo sapiens
tgaggtcctgggg

SEQ ID NO: 572608 - DNA, 15 bp, Homo sapiens
tgaggtcctgggggc

SEQ ID NO: 572609 - DNA, 17 bp, Homo sapiens
tgagtacaaatgtgtga

SEQ ID NO: 572610 - DNA, 15 bp, Homo sapiens
tgagtagcatatata

SEQ ID NO: 572611 - DNA, 15 bp, Homo sapiens
tgagtatacaatata

SEQ ID NO: 572612 - DNA, 13 bp, Homo sapiens
tgagtatatgtaa

SEQ ID NO: 572613 - DNA, 14 bp, Homo sapiens
tgagtatatgtaac

SEQ ID NO: 572614 - DNA, 15 bp, Homo sapiens
tgagtcctccagaac

SEQ ID NO: 572615 - DNA, 16 bp, Homo sapiens
tgagtcctccagaact

SEQ ID NO: 572616 - DNA, 12 bp, Homo sapiens
tgagtctttttt

SEQ ID NO: 572617 - DNA, 21 bp, Homo sapiens
tgagtgctaagagcctctgga

SEQ ID NO: 572618 - DNA, 13 bp, Homo sapiens
tgagtttgtttct

SEQ ID NO: 572619 - DNA, 14 bp, Homo sapiens
tgagtttgtttctt

SEQ ID NO: 572620 - DNA, 20 bp, Homo sapiens
tgagtttgtttctttgaatt

SEQ ID NO: 572621 - DNA, 20 bp, Homo sapiens
tgataacaacccaaggcaat

SEQ ID NO: 572622 - DNA, 17 bp, Homo sapiens
tgatatatttaaaaaca

SEQ ID NO: 572623 - DNA, 18 bp, Homo sapiens
tgatatgagtatacaata

SEQ ID NO: 572624 - DNA, 14 bp, Homo sapiens
tgatatgatccaga

SEQ ID NO: 572625 - DNA, 16 bp, Homo sapiens
tgatatgtctttaaaa

SEQ ID NO: 572626 - DNA, 13 bp, Homo sapiens
tgatcaaatgtac

SEQ ID NO: 572627 - DNA, 15 bp, Homo sapiens
tgatcaaatgtacat

SEQ ID NO: 572628 - DNA, 16 bp, Homo sapiens
tgatcaaggagggaga

SEQ ID NO: 572629 - DNA, 20 bp, Homo sapiens
tgatctgtccttccaacctg

SEQ ID NO: 572630 - DNA, 23 bp, Homo sapiens
tgatctgtgccttttttatatct

SEQ ID NO: 572631 - DNA, 16 bp, Homo sapiens
tgatcttcctctgcta

SEQ ID NO: 572632 - DNA, 18 bp, Homo sapiens
tgatcttcctctgctaaa

SEQ ID NO: 572633 - DNA, 15 bp, Homo sapiens
tgatgaagaaattta

SEQ ID NO: 572634 - DNA, 18 bp, Homo sapiens
tgatgaccaattttaact

SEQ ID NO: 572635 - DNA, 14 bp, Homo sapiens
tgatgatggaaggg

SEQ ID NO: 572636 - DNA, 14 bp, Homo sapiens
tgatgatgttctga

SEQ ID NO: 572637 - DNA, 15 bp, Homo sapiens
tgatgatgttctgaa

SEQ ID NO: 572638 - DNA, 19 bp, Homo sapiens
tgatgcaatccttacaaat

SEQ ID NO: 572639 - DNA, 22 bp, Homo sapiens
tgatgctctttcccacccagcc

SEQ ID NO: 572640 - DNA, 17 bp, Homo sapiens
tgatggatggcacaatg

SEQ ID NO: 572641 - DNA, 15 bp, Homo sapiens
tgatgtaaatgaagt

SEQ ID NO: 572642 - DNA, 17 bp, Homo sapiens
tgatgtaaatgaagtaa

SEQ ID NO: 572643 - DNA, 17 bp, Homo sapiens
tgatgtcattaatgtgt

SEQ ID NO: 572644 - DNA, 15 bp, Homo sapiens
tgatgtccccaaagt

SEQ ID NO: 572645 - DNA, 12 bp, Homo sapiens
tgatgtgacatt

SEQ ID NO: 572646 - DNA, 14 bp, Homo sapiens
tgatgtgacatttg

SEQ ID NO: 572647 - DNA, 15 bp, Homo sapiens
tgatgtgacatttgt

SEQ ID NO: 572648 - DNA, 16 bp, Homo sapiens
tgatgtgacatttgtc

SEQ ID NO: 572649 - DNA, 18 bp, Homo sapiens
tgatgtgctcatcagaaa

SEQ ID NO: 572650 - DNA, 22 bp, Homo sapiens
tgatgtgtccgtgaaagttgtg

SEQ ID NO: 572651 - DNA, 18 bp, Homo sapiens
tgatgtgttgccactttc

SEQ ID NO: 572652 - DNA, 14 bp, Homo sapiens
tgatgttgatgcaa

SEQ ID NO: 572653 - DNA, 15 bp, Homo sapiens
tgatgtttttaaaat

SEQ ID NO: 572654 - DNA, 19 bp, Homo sapiens
tgatgtttttaaaatctta

SEQ ID NO: 572655 - DNA, 18 bp, Homo sapiens
tgattacctgaaagccct

SEQ ID NO: 572656 - DNA, 20 bp, Homo sapiens
tgattattttcattacaatg

SEQ ID NO: 572657 - DNA, 13 bp, Homo sapiens
tgattcaaataac

SEQ ID NO: 572658 - DNA, 22 bp, Homo sapiens
tgattcaaataaccctgaatca

SEQ ID NO: 572659 - DNA, 13 bp, Homo sapiens
tgattcacatgtt

SEQ ID NO: 572660 - DNA, 14 bp, Homo sapiens
tgattcacatgttt

SEQ ID NO: 572661 - DNA, 20 bp, Homo sapiens
tgattcacatgttttcaaat

SEQ ID NO: 572662 - DNA, 16 bp, Homo sapiens
tgattccaagggccca

SEQ ID NO: 572663 - DNA, 18 bp, Homo sapiens
tgattccccggagctggg

SEQ ID NO: 572664 - DNA, 13 bp, Homo sapiens
tgattctatgtaa

SEQ ID NO: 572665 - DNA, 11 bp, Homo sapiens
tgattctctcc

SEQ ID NO: 572666 - DNA, 20 bp, Homo sapiens
tgattgcttttaaaatttta

SEQ ID NO: 572667 - DNA, 17 bp, Homo sapiens
tgattggtttctcttct

SEQ ID NO: 572668 - DNA, 13 bp, Homo sapiens
tgatttaaacttc

SEQ ID NO: 572669 - DNA, 21 bp, Homo sapiens
tgatttaaacttcttaactgg

SEQ ID NO: 572670 - DNA, 13 bp, Homo sapiens
tgatttaacatta

SEQ ID NO: 572671 - DNA, 16 bp, Homo sapiens
tgatttacctttggaa

SEQ ID NO: 572672 - DNA, 18 bp, Homo sapiens
tgatttacctttggaatt

SEQ ID NO: 572673 - DNA, 19 bp, Homo sapiens
tgatttcacaaatattaaa

SEQ ID NO: 572674 - DNA, 13 bp, Homo sapiens
tgattttaacttt

SEQ ID NO: 572675 - DNA, 19 bp, Homo sapiens
tgattttcaaatatgtaaa

SEQ ID NO: 572676 - DNA, 20 bp, Homo sapiens
tgattttcaaatatgtaaac

SEQ ID NO: 572677 - DNA, 20 bp, Homo sapiens
tgatttttcaaagacttcat

SEQ ID NO: 572678 - DNA, 13 bp, Homo sapiens
tgattttttaaaa

SEQ ID NO: 572679 - DNA, 16 bp, Homo sapiens
tgattttttaaaagaa

SEQ ID NO: 572680 - DNA, 17 bp, Homo sapiens
tgattttttaaaagaaa

SEQ ID NO: 572681 - DNA, 21 bp, Homo sapiens
tgcaaagcagagtgaaattca

SEQ ID NO: 572682 - DNA, 22 bp, Homo sapiens
tgcaaaggtctttttaaaccag

SEQ ID NO: 572683 - DNA, 17 bp, Homo sapiens
tgcaaagtacaggtact

SEQ ID NO: 572684 - DNA, 15 bp, Homo sapiens
tgcaacagcaaatta

SEQ ID NO: 572685 - DNA, 17 bp, Homo sapiens
tgcaacttgattcttgt

SEQ ID NO: 572686 - DNA, 23 bp, Homo sapiens
tgcaagcagtttcaataaagttt

SEQ ID NO: 572687 - DNA, 23 bp, Homo sapiens
tgcaataaactcagtcaaatgta

SEQ ID NO: 572688 - DNA, 18 bp, Homo sapiens
tgcaatatattttgtatg

SEQ ID NO: 572689 - DNA, 14 bp, Homo sapiens
tgcaatccttacaa

SEQ ID NO: 572690 - DNA, 17 bp, Homo sapiens
tgcaatccttacaaatg

SEQ ID NO: 572691 - DNA, 13 bp, Homo sapiens
tgcaatttgtctt

SEQ ID NO: 572692 - DNA, 22 bp, Homo sapiens
tgcaattttataaggacttcct

SEQ ID NO: 572693 - DNA, 15 bp, Homo sapiens
tgcacaaacatagac

SEQ ID NO: 572694 - DNA, 20 bp, Homo sapiens
tgcacaaacatagacagatg

SEQ ID NO: 572695 - DNA, 22 bp, Homo sapiens
tgcacaaacatagacagatgtg

SEQ ID NO: 572696 - DNA, 17 bp, Homo sapiens
tgcacaacatcctcaga

SEQ ID NO: 572697 - DNA, 13 bp, Homo sapiens
tgcacaatgtctt

SEQ ID NO: 572698 - DNA, 17 bp, Homo sapiens
tgcacacagaaatatat

SEQ ID NO: 572699 - DNA, 23 bp, Homo sapiens
tgcacacagaaatatatatacat

SEQ ID NO: 572700 - DNA, 16 bp, Homo sapiens
tgcacacatcatctgt

SEQ ID NO: 572701 - DNA, 18 bp, Homo sapiens
tgcacactcactggcatc

SEQ ID NO: 572702 - DNA, 12 bp, Homo sapiens
tgcacaggcaga

SEQ ID NO: 572703 - DNA, 16 bp, Homo sapiens
tgcacatccattccca

SEQ ID NO: 572704 - DNA, 14 bp, Homo sapiens
tgcacatgatttca

SEQ ID NO: 572705 - DNA, 15 bp, Homo sapiens
tgcacatgatttcac

SEQ ID NO: 572706 - DNA, 16 bp, Homo sapiens
tgcacatgatttcaca

SEQ ID NO: 572707 - DNA, 17 bp, Homo sapiens
tgcacatgatttcacaa

SEQ ID NO: 572708 - DNA, 20 bp, Homo sapiens
tgcacatgatttcacaaata

SEQ ID NO: 572709 - DNA, 21 bp, Homo sapiens
tgcaccaccgaccaactccag

SEQ ID NO: 572710 - DNA, 14 bp, Homo sapiens
tgcacctcattcca

SEQ ID NO: 572711 - DNA, 15 bp, Homo sapiens
tgcacctgcttctca

SEQ ID NO: 572712 - DNA, 13 bp, Homo sapiens
tgcacggggccag

SEQ ID NO: 572713 - DNA, 16 bp, Homo sapiens
tgcactaagtctcttt

SEQ ID NO: 572714 - DNA, 23 bp, Homo sapiens
tgcactaagtctcttttttacaa

SEQ ID NO: 572715 - DNA, 23 bp, Homo sapiens
tgcactcttgtttctcccgtgct

SEQ ID NO: 572716 - DNA, 10 bp, Homo sapiens
tgcactgaag

SEQ ID NO: 572717 - DNA, 19 bp, Homo sapiens
tgcactgaagtttgataaa

SEQ ID NO: 572718 - DNA, 24 bp, Homo sapiens
tgcagagacagagaggacgtgggc

SEQ ID NO: 572719 - DNA, 20 bp, Homo sapiens
tgcagataattctggaccag

SEQ ID NO: 572720 - DNA, 15 bp, Homo sapiens
tgcagattcctttgg

SEQ ID NO: 572721 - DNA, 18 bp, Homo sapiens
tgcagctatggacaattt

SEQ ID NO: 572722 - DNA, 14 bp, Homo sapiens
tgcagctcttcctg

SEQ ID NO: 572723 - DNA, 19 bp, Homo sapiens
tgcaggaatcaaaaattga

SEQ ID NO: 572724 - DNA, 20 bp, Homo sapiens
tgcaggaatcaaaaattgaa

SEQ ID NO: 572725 - DNA, 21 bp, Homo sapiens
tgcaggaatcaaaaattgaag

SEQ ID NO: 572726 - DNA, 17 bp, Homo sapiens
tgcaggattctcaccag

SEQ ID NO: 572727 - DNA, 10 bp, Homo sapiens
tgcaggcagg

SEQ ID NO: 572728 - DNA, 21 bp, Homo sapiens
tgcaggcaggtgtgaacatgg

SEQ ID NO: 572729 - DNA, 19 bp, Homo sapiens
tgcaggcggtatccagagg

SEQ ID NO: 572730 - DNA, 24 bp, Homo sapiens
tgcaggcggtatccagaggtgagg

SEQ ID NO: 572731 - DNA, 17 bp, Homo sapiens
tgcagggtgacctgctt

SEQ ID NO: 572732 - DNA, 16 bp, Homo sapiens
tgcagtcatcagaagt

SEQ ID NO: 572733 - DNA, 18 bp, Homo sapiens
tgcagtgttctgtgaata

SEQ ID NO: 572734 - DNA, 19 bp, Homo sapiens
tgcagtgttctgtgaatag

SEQ ID NO: 572735 - DNA, 21 bp, Homo sapiens
tgggtcccgggtgccccccat

SEQ ID NO: 572736 - DNA, 10 bp, Homo sapiens
tggtaacttt

SEQ ID NO: 572737 - DNA, 20 bp, Homo sapiens
tggtaacttttgtagtctta

SEQ ID NO: 572738 - DNA, 24 bp, Homo sapiens
tggtaacttttgtagtcttatgaa

SEQ ID NO: 572739 - DNA, 22 bp, Homo sapiens
tggtaatttagtgtatatgtga

SEQ ID NO: 572740 - DNA, 16 bp, Homo sapiens
tggtaccttgcacaca

SEQ ID NO: 572741 - DNA, 18 bp, Homo sapiens
tggtacttgctgctattt

SEQ ID NO: 572742 - DNA, 13 bp, Homo sapiens
tggtacttggcac

SEQ ID NO: 572743 - DNA, 14 bp, Homo sapiens
tggtacttggcacc

SEQ ID NO: 572744 - DNA, 15 bp, Homo sapiens
tggtacttggcacca

SEQ ID NO: 572745 - DNA, 20 bp, Homo sapiens
tggtacttggcaccaataaa

SEQ ID NO: 572746 - DNA, 22 bp, Homo sapiens
tggtacttggcaccaataaagg

SEQ ID NO: 572747 - DNA, 16 bp, Homo sapiens
tggtactttctgtact

SEQ ID NO: 572748 - DNA, 16 bp, Homo sapiens
tggtcacaaagctatt

SEQ ID NO: 572749 - DNA, 15 bp, Homo sapiens
tggtcacccccaccc

SEQ ID NO: 572750 - DNA, 13 bp, Homo sapiens
tggtcactgccat

SEQ ID NO: 572751 - DNA, 14 bp, Homo sapiens
tggtcactgccatg

SEQ ID NO: 572752 - DNA, 15 bp, Homo sapiens
tggtcacttcttctg

SEQ ID NO: 572753 - DNA, 16 bp, Homo sapiens
tggtcacttcttctgt

SEQ ID NO: 572754 - DNA, 17 bp, Homo sapiens
tggtccacattctgctg

SEQ ID NO: 572755 - DNA, 20 bp, Homo sapiens
tggtccacattctgctgccc

SEQ ID NO: 572756 - DNA, 13 bp, Homo sapiens
tggtcctgcactg

SEQ ID NO: 572757 - DNA, 19 bp, Homo sapiens
tggtctaatgtttaagcag

SEQ ID NO: 572758 - DNA, 21 bp, Homo sapiens
tggtctaatgtttaagcagaa

SEQ ID NO: 572759 - DNA, 15 bp, Homo sapiens
tggtcttactttgtt

SEQ ID NO: 572760 - DNA, 16 bp, Homo sapiens
tggtcttactttgtta

SEQ ID NO: 572761 - DNA, 19 bp, Homo sapiens
tggtcttcaaattgtcttt

SEQ ID NO: 572762 - DNA, 19 bp, Homo sapiens
tggtcttttcctcgcttct

SEQ ID NO: 572763 - DNA, 20 bp, Homo sapiens
tggtcttttcctcgcttctt

SEQ ID NO: 572764 - DNA, 13 bp, Homo sapiens
tggtgaagagtag

SEQ ID NO: 572765 - DNA, 18 bp, Homo sapiens
tggtgctttcctgtttct

SEQ ID NO: 572766 - DNA, 21 bp, Homo sapiens
tggtgtctaataaacacagat

SEQ ID NO: 572767 - DNA, 20 bp, Homo sapiens
tggttcccccaggaccctga

SEQ ID NO: 572768 - DNA, 15 bp, Homo sapiens
tggttcctcacatat

SEQ ID NO: 572769 - DNA, 14 bp, Homo sapiens
tggttgtttcttcc

SEQ ID NO: 572770 - DNA, 13 bp, Homo sapiens
tggtttctcttct

SEQ ID NO: 572771 - DNA, 19 bp, Homo sapiens
tggtttctcttctcccctt

SEQ ID NO: 572772 - DNA, 12 bp, Homo sapiens
tggttttaaaat

SEQ ID NO: 572773 - DNA, 13 bp, Homo sapiens
tggttttaaaata

SEQ ID NO: 572774 - DNA, 20 bp, Homo sapiens
tgtaaacgtctttttaagcc

SEQ ID NO: 572775 - DNA, 17 bp, Homo sapiens
tgtaaactttaacttcc

SEQ ID NO: 572776 - DNA, 16 bp, Homo sapiens
tgtaaactttgaaata

SEQ ID NO: 572777 - DNA, 22 bp, Homo sapiens
tgtaaagatattgtatctcctt

SEQ ID NO: 572778 - DNA, 15 bp, Homo sapiens
tgtaaagcaaaatat

SEQ ID NO: 572779 - DNA, 17 bp, Homo sapiens
tgtaaataaaaatagct

SEQ ID NO: 572780 - DNA, 22 bp, Homo sapiens
tgtaaatgatatgtctttaaaa

SEQ ID NO: 572781 - DNA, 12 bp, Homo sapiens
tgtaactatgtt

SEQ ID NO: 572782 - DNA, 21 bp, Homo sapiens
tgtaactgttaccattggaaa

SEQ ID NO: 572783 - DNA, 17 bp, Homo sapiens
tgtaacttgttgcagac

SEQ ID NO: 572784 - DNA, 21 bp, Homo sapiens
tgtaagtactctaatatacag

SEQ ID NO: 572785 - DNA, 16 bp, Homo sapiens
tgtaatagcctcacct

SEQ ID NO: 572786 - DNA, 13 bp, Homo sapiens
tgtaatatcagtt

SEQ ID NO: 572787 - DNA, 17 bp, Homo sapiens
tgtaatatcagttacag

SEQ ID NO: 572788 - DNA, 18 bp, Homo sapiens
tgtaatatcagttacagt

SEQ ID NO: 572789 - DNA, 23 bp, Homo sapiens
tgtaatcacactctcttcttact

SEQ ID NO: 572790 - DNA, 13 bp, Homo sapiens
tgtaatgtaactg

SEQ ID NO: 572791 - DNA, 15 bp, Homo sapiens
tgtaatgtaactgct

SEQ ID NO: 572792 - DNA, 15 bp, Homo sapiens
tgtaatttataaaat

SEQ ID NO: 572793 - DNA, 16 bp, Homo sapiens
tgtaatttataaaatt

SEQ ID NO: 572794 - DNA, 19 bp, Homo sapiens
tgtaatttttctgtataga

SEQ ID NO: 572795 - DNA, 22 bp, Homo sapiens
tgtacaacaccagcaacattat

SEQ ID NO: 572796 - DNA, 23 bp, Homo sapiens
tgtacaatcatgaacagctctga

SEQ ID NO: 572797 - DNA, 16 bp, Homo sapiens
tgtacacacacagaca

SEQ ID NO: 572798 - DNA, 19 bp, Homo sapiens
tgtacacacacagacacac

SEQ ID NO: 572799 - DNA, 21 bp, Homo sapiens
tgtacatattagcgacaacag

SEQ ID NO: 572800 - DNA, 22 bp, Homo sapiens
tgtacatattagcgacaacaga

SEQ ID NO: 572801 - DNA, 20 bp, Homo sapiens
tgtacatttatgtgtgaagc

SEQ ID NO: 572802 - DNA, 23 bp, Homo sapiens
tgtacatttttgatcaaatgtac

SEQ ID NO: 572803 - DNA, 15 bp, Homo sapiens
tgtaccattaaaata

SEQ ID NO: 572804 - DNA, 20 bp, Homo sapiens
tgtacttgatttttcaaaga

SEQ ID NO: 572805 - DNA, 12 bp, Homo sapiens
tgtagactatat

SEQ ID NO: 572806 - DNA, 20 bp, Homo sapiens
tgtagactatatacatgtgt

SEQ ID NO: 572807 - DNA, 23 bp, Homo sapiens
tgtagactatatacatgtgtgta

SEQ ID NO: 572808 - DNA, 16 bp, Homo sapiens
tgtagtcttatgaata

SEQ ID NO: 572809 - DNA, 17 bp, Homo sapiens
tgtagtcttatgaatag

SEQ ID NO: 572810 - DNA, 15 bp, Homo sapiens
tgtataaatgtatat

SEQ ID NO: 572811 - DNA, 16 bp, Homo sapiens
tgtataaatgtatata

SEQ ID NO: 572812 - DNA, 20 bp, Homo sapiens
tgtataaatgtatatacaca

SEQ ID NO: 572813 - DNA, 21 bp, Homo sapiens
tgtataaatgtatatacacat

SEQ ID NO: 572814 - DNA, 16 bp, Homo sapiens
tgtatacgcacgcacc

SEQ ID NO: 572815 - DNA, 19 bp, Homo sapiens
tgtatagtatttgaaaaca

SEQ ID NO: 572816 - DNA, 20 bp, Homo sapiens
tgtatagtatttgaaaacag

SEQ ID NO: 572817 - DNA, 21 bp, Homo sapiens
tgtatagtatttgaaaacaga

SEQ ID NO: 572818 - DNA, 20 bp, Homo sapiens
tgtatatatacctgcgcttg

SEQ ID NO: 572819 - DNA, 13 bp, Homo sapiens
tgtatatatatgt

SEQ ID NO: 572820 - DNA, 16 bp, Homo sapiens
tgtatatatgtgtata

SEQ ID NO: 572821 - DNA, 21 bp, Homo sapiens
tgtatatatgtgtatatatac

SEQ ID NO: 572822 - DNA, 22 bp, Homo sapiens
tgtatatatgtgtatatataca

SEQ ID NO: 572823 - DNA, 23 bp, Homo sapiens
tgtatatatgtgtatatatacat

SEQ ID NO: 572824 - DNA, 19 bp, Homo sapiens
tgtatatgtgattttcaaa

SEQ ID NO: 572825 - DNA, 12 bp, Homo sapiens
tgtatctttgta

SEQ ID NO: 572826 - DNA, 19 bp, Homo sapiens
tgtatctttgtaagagcaa

SEQ ID NO: 572827 - DNA, 15 bp, Homo sapiens
tgtatgagactgtgt

SEQ ID NO: 572828 - DNA, 18 bp, Homo sapiens
tgtatgcaagcagtttca

SEQ ID NO: 572829 - DNA, 20 bp, Homo sapiens
tgtatgcaagcagtttcaat

SEQ ID NO: 572830 - DNA, 22 bp, Homo sapiens
tgtatgcataataatcctgcaa

SEQ ID NO: 572831 - DNA, 23 bp, Homo sapiens
tgtatggaagacaaatacacata

SEQ ID NO: 572832 - DNA, 14 bp, Homo sapiens
tgtatgtgtatatg

SEQ ID NO: 572833 - DNA, 16 bp, Homo sapiens
tgtatgtgtatatgtt

SEQ ID NO: 572834 - DNA, 12 bp, Homo sapiens
tgtatgttaata

SEQ ID NO: 572835 - DNA, 20 bp, Homo sapiens
tgtatgtttacactgtcaaa

SEQ ID NO: 572836 - DNA, 15 bp, Homo sapiens
tgtatgtttttcagt

SEQ ID NO: 572837 - DNA, 17 bp, Homo sapiens
tgtattcccatatcaaa

SEQ ID NO: 572838 - DNA, 17 bp, Homo sapiens
tgtattgtaactatgtt

SEQ ID NO: 572839 - DNA, 20 bp, Homo sapiens
tgtatttaaaacatttcatg

SEQ ID NO: 572840 - DNA, 21 bp, Homo sapiens
tgtatttaaaacatttcatgt

SEQ ID NO: 572841 - DNA, 22 bp, Homo sapiens
tgtatttacttgttatgttgta

SEQ ID NO: 572842 - DNA, 15 bp, Homo sapiens
tgtatttctttagaa

SEQ ID NO: 572843 - DNA, 22 bp, Homo sapiens
tgtatttggctgggctacaatt

SEQ ID NO: 572844 - DNA, 14 bp, Homo sapiens
tgtattttcagctc

SEQ ID NO: 572845 - DNA, 21 bp, Homo sapiens
tgtatttttcaaggcatttat

SEQ ID NO: 572846 - DNA, 21 bp, Homo sapiens
tgtatttttcctctttcactt

SEQ ID NO: 572847 - DNA, 17 bp, Homo sapiens
tgtcaagtggcaaagct

SEQ ID NO: 572848 - DNA, 17 bp, Homo sapiens
tgtcacctgcttctctg

SEQ ID NO: 572849 - DNA, 12 bp, Homo sapiens
tgtcactgctgt

SEQ ID NO: 572850 - DNA, 15 bp, Homo sapiens
tgtcactgctgtaaa

SEQ ID NO: 572851 - DNA, 14 bp, Homo sapiens
tgtcactgttataa

SEQ ID NO: 572852 - DNA, 17 bp, Homo sapiens
tgtcactgttataaatt

SEQ ID NO: 572853 - DNA, 21 bp, Homo sapiens
tgtcactgttataaattttgt

SEQ ID NO: 572854 - DNA, 11 bp, Homo sapiens
tgtcaggaggc

SEQ ID NO: 572855 - DNA, 20 bp, Homo sapiens
tgtcatctaccttttctctt

SEQ ID NO: 572856 - DNA, 20 bp, Homo sapiens
tgtcatggtgcaatttgtct

SEQ ID NO: 572857 - DNA, 18 bp, Homo sapiens
tgtcatgtgcgaacacag

SEQ ID NO: 572858 - DNA, 21 bp, Homo sapiens
tgtcattcaaatgggtgatat

SEQ ID NO: 572859 - DNA, 22 bp, Homo sapiens
tgtcatttcatgtcctgtgtca

SEQ ID NO: 572860 - DNA, 13 bp, Homo sapiens
tgtcattttcatt

SEQ ID NO: 572861 - DNA, 20 bp, Homo sapiens
tgtccagagctgcttccccg

SEQ ID NO: 572862 - DNA, 15 bp, Homo sapiens
tgtccctggcttcct

SEQ ID NO: 572863 - DNA, 13 bp, Homo sapiens
tgtcccttcccca

SEQ ID NO: 572864 - DNA, 18 bp, Homo sapiens
tgtcctcctgctgccagt

SEQ ID NO: 572865 - DNA, 21 bp, Homo sapiens
tgtcctggctcccagggtcct

SEQ ID NO: 572866 - DNA, 21 bp, Homo sapiens
tgtcctttatgtattctcttc

SEQ ID NO: 572867 - DNA, 21 bp, Homo sapiens
tgtcctttggtactatggtgt

SEQ ID NO: 572868 - DNA, 12 bp, Homo sapiens
tgtcgcacaatg

SEQ ID NO: 572869 - DNA, 18 bp, Homo sapiens
tgtcgtccccagaccagt

SEQ ID NO: 572870 - DNA, 15 bp, Homo sapiens
tgtctaagaaacatt

SEQ ID NO: 572871 - DNA, 16 bp, Homo sapiens
tgtttcatttgtgtca

SEQ ID NO: 572872 - DNA, 19 bp, Homo sapiens
tgtttccaggcatgaccct

SEQ ID NO: 572873 - DNA, 15 bp, Homo sapiens
tgtttctcccgtgct

SEQ ID NO: 572874 - DNA, 16 bp, Homo sapiens
tgtttctcccgtgctt

SEQ ID NO: 572875 - DNA, 18 bp, Homo sapiens
tgtttctttgaattttca

SEQ ID NO: 572876 - DNA, 23 bp, Homo sapiens
tgtttgctccccttccccttcct

SEQ ID NO: 572877 - DNA, 21 bp, Homo sapiens
tgtttggttttaaaatactgt

SEQ ID NO: 572878 - DNA, 19 bp, Homo sapiens
tgtttgtcctttatgtatt

SEQ ID NO: 572879 - DNA, 14 bp, Homo sapiens
tgtttgtctcttct

SEQ ID NO: 572880 - DNA, 15 bp, Homo sapiens
tgtttgtctcttctg

SEQ ID NO: 572881 - DNA, 13 bp, Homo sapiens
tgttttaaactgt

SEQ ID NO: 572882 - DNA, 21 bp, Homo sapiens
tgttttaaagtcagatttgta

SEQ ID NO: 572883 - DNA, 22 bp, Homo sapiens
tgttttcaatctcgtatagaag

SEQ ID NO: 572884 - DNA, 16 bp, Homo sapiens
tgttttcattaaagag

SEQ ID NO: 572885 - DNA, 21 bp, Homo sapiens
tgttttccccaattatcctcc

SEQ ID NO: 572886 - DNA, 19 bp, Homo sapiens
tgttttgtaaactttgaaa

SEQ ID NO: 572887 - DNA, 22 bp, Homo sapiens
tgttttgtgcggtgtgtctcca

SEQ ID NO: 572888 - DNA, 14 bp, Homo sapiens
tgttttgtggataa

SEQ ID NO: 572889 - DNA, 15 bp, Homo sapiens
tgtttttaaaatctt

SEQ ID NO: 572890 - DNA, 16 bp, Homo sapiens
tgtttttaaaatctta

SEQ ID NO: 572891 - DNA, 15 bp, Homo sapiens
tgtttttcagttcaa

SEQ ID NO: 572892 - DNA, 17 bp, Homo sapiens
tgtttttcagttcaaag

SEQ ID NO: 572893 - DNA, 9 bp, Homo sapiens
tgttttttg

SEQ ID NO: 572894 - DNA, 13 bp, Homo sapiens
tgttttttgaagt

SEQ ID NO: 572895 - DNA, 19 bp, Homo sapiens
ttaaaaacatttttttaag

SEQ ID NO: 572896 - DNA, 22 bp, Homo sapiens
ttaaaaagtattgccaaacatt

SEQ ID NO: 572897 - DNA, 23 bp, Homo sapiens
ttaaaaagtattgccaaacatta

SEQ ID NO: 572898 - DNA, 20 bp, Homo sapiens
ttaaaaattatctttaaaac

SEQ ID NO: 572899 - DNA, 16 bp, Homo sapiens
ttaaaacatttcatgt

SEQ ID NO: 572900 - DNA, 20 bp, Homo sapiens
ttaaaacatttcatgtattt

SEQ ID NO: 572901 - DNA, 9 bp, Homo sapiens
ttaaaagaa

SEQ ID NO: 572902 - DNA, 20 bp, Homo sapiens
ttaaaatactgtagataatt

SEQ ID NO: 572903 - DNA, 15 bp, Homo sapiens
ttaaaatatgcacta

SEQ ID NO: 572904 - DNA, 19 bp, Homo sapiens
ttaaaatcttattaaagtt

SEQ ID NO: 572905 - DNA, 23 bp, Homo sapiens
ttaaaatgattcacttttattgt

SEQ ID NO: 572906 - DNA, 20 bp, Homo sapiens
ttaaaatgtgtatttttcaa

SEQ ID NO: 572907 - DNA, 13 bp, Homo sapiens
ttaaaatttgaaa

SEQ ID NO: 572908 - DNA, 21 bp, Homo sapiens
ttaaaattttaagctaggaaa

SEQ ID NO: 572909 - DNA, 12 bp, Homo sapiens
ttaaacaaatgg

SEQ ID NO: 572910 - DNA, 11 bp, Homo sapiens
ttaaactgtga

SEQ ID NO: 572911 - DNA, 13 bp, Homo sapiens
ttaaactgtgagc

SEQ ID NO: 572912 - DNA, 19 bp, Homo sapiens
ttaaagaaaagttcttaaa

SEQ ID NO: 572913 - DNA, 15 bp, Homo sapiens
ttaaagatgtagcaa

SEQ ID NO: 572914 - DNA, 16 bp, Homo sapiens
ttaaagatgtagcaaa

SEQ ID NO: 572915 - DNA, 14 bp, Homo sapiens
ttaaagtttcaaaa

SEQ ID NO: 572916 - DNA, 19 bp, Homo sapiens
ttaaagtttcaaaaatctg

SEQ ID NO: 572917 - DNA, 13 bp, Homo sapiens
ttaaatgaaatac

SEQ ID NO: 572918 - DNA, 11 bp, Homo sapiens
ttaaatgtgaa

SEQ ID NO: 572919 - DNA, 12 bp, Homo sapiens
ttaaatgtgaat

SEQ ID NO: 572920 - DNA, 14 bp, Homo sapiens
ttaaatgttttgta

SEQ ID NO: 572921 - DNA, 23 bp, Homo sapiens
ttaaatgttttgtaaactttgaa

SEQ ID NO: 572922 - DNA, 16 bp, Homo sapiens
ttaacaccttcatcca

SEQ ID NO: 572923 - DNA, 20 bp, Homo sapiens
ttaacactgagtgaaatatt

SEQ ID NO: 572924 - DNA, 23 bp, Homo sapiens
ttaacactgagtgaaatattact

SEQ ID NO: 572925 - DNA, 24 bp, Homo sapiens
ttaacatctgcagtgttctgtgaa

SEQ ID NO: 572926 - DNA, 13 bp, Homo sapiens
ttaagagagaaat

SEQ ID NO: 572927 - DNA, 22 bp, Homo sapiens
ttaagctaggaaaagaaatcta

SEQ ID NO: 572928 - DNA, 21 bp, Homo sapiens
ttaagtcattttcatgtgtgt

SEQ ID NO: 572929 - DNA, 14 bp, Homo sapiens
ttaagtgaaattta

SEQ ID NO: 572930 - DNA, 16 bp, Homo sapiens
ttaagtggactgtatt

SEQ ID NO: 572931 - DNA, 15 bp, Homo sapiens
ttaataaagtatgaa

SEQ ID NO: 572932 - DNA, 23 bp, Homo sapiens
ttaatataactgccttaaaactt

SEQ ID NO: 572933 - DNA, 15 bp, Homo sapiens
ttaatatactcctta

SEQ ID NO: 572934 - DNA, 13 bp, Homo sapiens
ttaatatgtattt

SEQ ID NO: 572935 - DNA, 19 bp, Homo sapiens
ttaatatgtattttatgta

SEQ ID NO: 572936 - DNA, 23 bp, Homo sapiens
ttaatatgtattttatgtatgtt

SEQ ID NO: 572937 - DNA, 11 bp, Homo sapiens
ttaatgagtat

SEQ ID NO: 572938 - DNA, 22 bp, Homo sapiens
ttaatgtgatggatggcacaat

SEQ ID NO: 572939 - DNA, 13 bp, Homo sapiens
ttaatgtgtaaaa

SEQ ID NO: 572940 - DNA, 22 bp, Homo sapiens
ttaatgtgttgggaaaaaggcc

SEQ ID NO: 572941 - DNA, 17 bp, Homo sapiens
ttaatgttgatttctag

SEQ ID NO: 572942 - DNA, 21 bp, Homo sapiens
ttaatgttgatttctagttat

SEQ ID NO: 572943 - DNA, 16 bp, Homo sapiens
ttaattaagtaaacta

SEQ ID NO: 572944 - DNA, 21 bp, Homo sapiens
ttaattaagtaaactaatgag

SEQ ID NO: 572945 - DNA, 14 bp, Homo sapiens
ttaattcctatgaa

SEQ ID NO: 572946 - DNA, 15 bp, Homo sapiens
ttaattcctatgaag

SEQ ID NO: 572947 - DNA, 13 bp, Homo sapiens
ttaatttggacca

SEQ ID NO: 572948 - DNA, 18 bp, Homo sapiens
ttaatttggaccattttc

SEQ ID NO: 572949 - DNA, 19 bp, Homo sapiens
ttacaaaatgtaactgtta

SEQ ID NO: 572950 - DNA, 19 bp, Homo sapiens
ttacaaatgattgctttta

SEQ ID NO: 572951 - DNA, 20 bp, Homo sapiens
ttacaagactgtaaattcca

SEQ ID NO: 572952 - DNA, 16 bp, Homo sapiens
ttacagagatgtctct

SEQ ID NO: 572953 - DNA, 11 bp, Homo sapiens
ttacagctgaa

SEQ ID NO: 572954 - DNA, 15 bp, Homo sapiens
ttacagctttacaca

SEQ ID NO: 572955 - DNA, 22 bp, Homo sapiens
ttacagctttacacacacagat

SEQ ID NO: 572956 - DNA, 18 bp, Homo sapiens
ttacagttacttttcctt

SEQ ID NO: 572957 - DNA, 23 bp, Homo sapiens
ttaccaagttggtcttactttgt

SEQ ID NO: 572958 - DNA, 14 bp, Homo sapiens
ttaccactaatttt

SEQ ID NO: 572959 - DNA, 23 bp, Homo sapiens
ttaccactaattttgttttaaac

SEQ ID NO: 572960 - DNA, 15 bp, Homo sapiens
ttaccattggaaatt

SEQ ID NO: 572961 - DNA, 18 bp, Homo sapiens
ttaccattggaaatttca

SEQ ID NO: 572962 - DNA, 11 bp, Homo sapiens
ttacccaaagc

SEQ ID NO: 572963 - DNA, 13 bp, Homo sapiens
ttacctaattaga

SEQ ID NO: 572964 - DNA, 20 bp, Homo sapiens
ttactaacttctaaaactgt

SEQ ID NO: 572965 - DNA, 18 bp, Homo sapiens
ttactacatgtgggagct

SEQ ID NO: 572966 - DNA, 16 bp, Homo sapiens
ttactagataaaatgt

SEQ ID NO: 572967 - DNA, 15 bp, Homo sapiens
ttactcaatgtgtgc

SEQ ID NO: 572968 - DNA, 20 bp, Homo sapiens
ttactctaaggtaaaaccat

SEQ ID NO: 572969 - DNA, 23 bp, Homo sapiens
ttactgtatttgggatatgagtt

SEQ ID NO: 572970 - DNA, 23 bp, Homo sapiens
ttactttaggtagtagaatctca

SEQ ID NO: 572971 - DNA, 19 bp, Homo sapiens
ttactttccaattctcctt

SEQ ID NO: 572972 - DNA, 14 bp, Homo sapiens
ttactttgttaatt

SEQ ID NO: 572973 - DNA, 13 bp, Homo sapiens
ttagaaaactttg

SEQ ID NO: 572974 - DNA, 16 bp, Homo sapiens
ttagaaaactttgtta

SEQ ID NO: 572975 - DNA, 18 bp, Homo sapiens
ttagaaaataaatacaag

SEQ ID NO: 572976 - DNA, 17 bp, Homo sapiens
ttagaaagcaacttatc

SEQ ID NO: 572977 - DNA, 20 bp, Homo sapiens
ttagaatcaagtctgtgaaa

SEQ ID NO: 572978 - DNA, 23 bp, Homo sapiens
ttagacagtcaaggagtggctta

SEQ ID NO: 572979 - DNA, 24 bp, Homo sapiens
ttagagaaatacatgttgtaaatg

SEQ ID NO: 572980 - DNA, 21 bp, Homo sapiens
ttagagcagatgacccctccc

SEQ ID NO: 572981 - DNA, 15 bp, Homo sapiens
ttagatgtgagaaaa

SEQ ID NO: 572982 - DNA, 14 bp, Homo sapiens
ttagcacagtattt

SEQ ID NO: 572983 - DNA, 16 bp, Homo sapiens
ttagcgacaacagatt

SEQ ID NO: 572984 - DNA, 13 bp, Homo sapiens
ttagctgtaacag

SEQ ID NO: 572985 - DNA, 13 bp, Homo sapiens
ttagcttatcttt

SEQ ID NO: 572986 - DNA, 13 bp, Homo sapiens
ttaggattgaagt

SEQ ID NO: 572987 - DNA, 15 bp, Homo sapiens
ttagggctctaattt

SEQ ID NO: 572988 - DNA, 19 bp, Homo sapiens
ttagtactttatagaagaa

SEQ ID NO: 572989 - DNA, 23 bp, Homo sapiens
ttagtcagtgtactctgagtcct

SEQ ID NO: 572990 - DNA, 21 bp, Homo sapiens
ttagtggaccctgaaatgtgt

SEQ ID NO: 572991 - DNA, 15 bp, Homo sapiens
ttagtggatggaata

SEQ ID NO: 572992 - DNA, 18 bp, Homo sapiens
ttagttttgcttttagtt

SEQ ID NO: 572993 - DNA, 10 bp, Homo sapiens
ttataaaatt

SEQ ID NO: 572994 - DNA, 17 bp, Homo sapiens
ttataaaattagaaagc

SEQ ID NO: 572995 - DNA, 18 bp, Homo sapiens
ttataaactcattttgct

SEQ ID NO: 572996 - DNA, 17 bp, Homo sapiens
ttataatcaaagctcat

SEQ ID NO: 572997 - DNA, 11 bp, Homo sapiens
ttatacacaca

SEQ ID NO: 572998 - DNA, 18 bp, Homo sapiens
ttatacctgtacacacac

SEQ ID NO: 572999 - DNA, 13 bp, Homo sapiens
ttatagtgcaata

SEQ ID NO: 573000 - DNA, 17 bp, Homo sapiens
ttatagtgcaatatatt

SEQ ID NO: 573001 - DNA, 22 bp, Homo sapiens
ttatatcagactgctttgagaa

SEQ ID NO: 573002 - DNA, 18 bp, Homo sapiens
ttatatccagtaacacat

SEQ ID NO: 573003 - DNA, 20 bp, Homo sapiens
ttatattcccaaatctcaaa

SEQ ID NO: 573004 - DNA, 16 bp, Homo sapiens
ttatattctgcagaaa

SEQ ID NO: 573005 - DNA, 22 bp, Homo sapiens
ttatatttggatgcagagttca

SEQ ID NO: 573006 - DNA, 14 bp, Homo sapiens
ttatatttttctta

SEQ ID NO: 573007 - DNA, 15 bp, Homo sapiens
ttatatttttcttaa

SEQ ID NO: 573008 - DNA, 22 bp, Homo sapiens
ttgaggacctccacctgggaga

SEQ ID NO: 573009 - DNA, 13 bp, Homo sapiens
ttgagtcatttta

SEQ ID NO: 573010 - DNA, 15 bp, Homo sapiens
ttgataaatagtgtt

SEQ ID NO: 573011 - DNA, 12 bp, Homo sapiens
ttgatcaaatgt

SEQ ID NO: 573012 - DNA, 14 bp, Homo sapiens
ttgatcaaatgtac

SEQ ID NO: 573013 - DNA, 19 bp, Homo sapiens
ttgatcttcctctgctaaa

SEQ ID NO: 573014 - DNA, 19 bp, Homo sapiens
ttgatgcaatccttacaaa

SEQ ID NO: 573015 - DNA, 14 bp, Homo sapiens
ttgatgttgatgca

SEQ ID NO: 573016 - DNA, 13 bp, Homo sapiens
ttgattcaaataa

SEQ ID NO: 573017 - DNA, 13 bp, Homo sapiens
ttgattcacatgt

SEQ ID NO: 573018 - DNA, 14 bp, Homo sapiens
ttgattcacatgtt

SEQ ID NO: 573019 - DNA, 23 bp, Homo sapiens
ttgattcacatgttttcaaatgg

SEQ ID NO: 573020 - DNA, 13 bp, Homo sapiens
ttgattgcttttt

SEQ ID NO: 573021 - DNA, 19 bp, Homo sapiens
ttgatttacctttggaatt

SEQ ID NO: 573022 - DNA, 22 bp, Homo sapiens
ttgatttacctttggaattgtg

SEQ ID NO: 573023 - DNA, 20 bp, Homo sapiens
ttgatttttcaaagacttca

SEQ ID NO: 573024 - DNA, 17 bp, Homo sapiens
ttgcaacagcaaattaa

SEQ ID NO: 573025 - DNA, 18 bp, Homo sapiens
ttgcaacagcaaattaat

SEQ ID NO: 573026 - DNA, 22 bp, Homo sapiens
ttgcaacagcaaattaatgtgt

SEQ ID NO: 573027 - DNA, 16 bp, Homo sapiens
ttgcaacctttatagg

SEQ ID NO: 573028 - DNA, 17 bp, Homo sapiens
ttgcacacatcatctgt

SEQ ID NO: 573029 - DNA, 19 bp, Homo sapiens
ttgcacacatcatctgtaa

SEQ ID NO: 573030 - DNA, 21 bp, Homo sapiens
ttgcagaacttgaagcctgct

SEQ ID NO: 573031 - DNA, 17 bp, Homo sapiens
ttgcagataattctgga

SEQ ID NO: 573032 - DNA, 17 bp, Homo sapiens
ttgcagtcatcagaagt

SEQ ID NO: 573033 - DNA, 14 bp, Homo sapiens
ttgcagttatgtta

SEQ ID NO: 573034 - DNA, 20 bp, Homo sapiens
ttgcatacaaacaagcatat

SEQ ID NO: 573035 - DNA, 14 bp, Homo sapiens
ttgcatttgctttt

SEQ ID NO: 573036 - DNA, 14 bp, Homo sapiens
ttgccaaacattaa

SEQ ID NO: 573037 - DNA, 21 bp, Homo sapiens
ttgccaaacattaatgttgat

SEQ ID NO: 573038 - DNA, 24 bp, Homo sapiens
ttgccaaacattaatgttgatttc

SEQ ID NO: 573039 - DNA, 16 bp, Homo sapiens
ttgcccagcctctttc

SEQ ID NO: 573040 - DNA, 19 bp, Homo sapiens
ttgcccagcctctttccct

SEQ ID NO: 573041 - DNA, 20 bp, Homo sapiens
ttgcccatgctgggctcccg

SEQ ID NO: 573042 - DNA, 13 bp, Homo sapiens
ttgcctctgccct

SEQ ID NO: 573043 - DNA, 20 bp, Homo sapiens
ttgcgagcaccaagtacaag

SEQ ID NO: 573044 - DNA, 23 bp, Homo sapiens
ttgctaagataattaaatgaaat

SEQ ID NO: 573045 - DNA, 19 bp, Homo sapiens
ttgctaagtaaatctcttc

SEQ ID NO: 573046 - DNA, 21 bp, Homo sapiens
ttgctaagtaaatctcttctg

SEQ ID NO: 573047 - DNA, 22 bp, Homo sapiens
ttgctaagtaaatctcttctgt

SEQ ID NO: 573048 - DNA, 18 bp, Homo sapiens
ttgctcagagtgaagagt

SEQ ID NO: 573049 - DNA, 21 bp, Homo sapiens
ttgctcagagtgaagagtgaa

SEQ ID NO: 573050 - DNA, 14 bp, Homo sapiens
ttgctccccttccc

SEQ ID NO: 573051 - DNA, 22 bp, Homo sapiens
ttgctccccttccccttccttc

SEQ ID NO: 573052 - DNA, 18 bp, Homo sapiens
ttgctgcaattttataag

SEQ ID NO: 573053 - DNA, 20 bp, Homo sapiens
ttgctgctattttactgtct

SEQ ID NO: 573054 - DNA, 23 bp, Homo sapiens
ttgctgctattttactgtcttaa

SEQ ID NO: 573055 - DNA, 15 bp, Homo sapiens
ttgctggcatttgct

SEQ ID NO: 573056 - DNA, 15 bp, Homo sapiens
ttgctggtcactgcc

SEQ ID NO: 573057 - DNA, 14 bp, Homo sapiens
ttgcttaaatgtga

SEQ ID NO: 573058 - DNA, 15 bp, Homo sapiens
ttgcttaaatgtgaa

SEQ ID NO: 573059 - DNA, 17 bp, Homo sapiens
ttgcttaaatgtgaatt

SEQ ID NO: 573060 - DNA, 21 bp, Homo sapiens
ttgcttaattacaatatttct

SEQ ID NO: 573061 - DNA, 20 bp, Homo sapiens
ttgctttatttttcattacc

SEQ ID NO: 573062 - DNA, 15 bp, Homo sapiens
ttggaaacactaaat

SEQ ID NO: 573063 - DNA, 19 bp, Homo sapiens
ttggaaacactaaatgtta

SEQ ID NO: 573064 - DNA, 16 bp, Homo sapiens
ttggaactgcaccacc

SEQ ID NO: 573065 - DNA, 19 bp, Homo sapiens
ttggaagcaggttaaatgt

SEQ ID NO: 573066 - DNA, 18 bp, Homo sapiens
ttggagttcattcatatt

SEQ ID NO: 573067 - DNA, 18 bp, Homo sapiens
ttggattttatgttgaca

SEQ ID NO: 573068 - DNA, 22 bp, Homo sapiens
ttggattttatgttgacatttg

SEQ ID NO: 573069 - DNA, 14 bp, Homo sapiens
ttggcaccaataaa

SEQ ID NO: 573070 - DNA, 17 bp, Homo sapiens
ttggcaccaataaagga

SEQ ID NO: 573071 - DNA, 13 bp, Homo sapiens
ttggcagatgcag

SEQ ID NO: 573072 - DNA, 20 bp, Homo sapiens
ttggcagcctactagggacc

SEQ ID NO: 573073 - DNA, 23 bp, Homo sapiens
ttggccagaggaaatctgaatgt

SEQ ID NO: 573074 - DNA, 20 bp, Homo sapiens
ttggctcagacacctagact

SEQ ID NO: 573075 - DNA, 20 bp, Homo sapiens
ttggctgggctacaatttgt

SEQ ID NO: 573076 - DNA, 16 bp, Homo sapiens
ttggctttccagtcat

SEQ ID NO: 573077 - DNA, 21 bp, Homo sapiens
ttgggaggatttgatgtaagt

SEQ ID NO: 573078 - DNA, 11 bp, Homo sapiens
ttgggaggctg

SEQ ID NO: 573079 - DNA, 22 bp, Homo sapiens
ttgggcaatattctctgtacat

SEQ ID NO: 573080 - DNA, 12 bp, Homo sapiens
ttgggctcccaa

SEQ ID NO: 573081 - DNA, 12 bp, Homo sapiens
ttgggctctgcg

SEQ ID NO: 573082 - DNA, 13 bp, Homo sapiens
ttgggctctgctg

SEQ ID NO: 573083 - DNA, 19 bp, Homo sapiens
ttggggctacttatattct

SEQ ID NO: 573084 - DNA, 19 bp, Homo sapiens
ttgggttctttctgggggg

SEQ ID NO: 573085 - DNA, 13 bp, Homo sapiens
ttggtaccttgca

SEQ ID NO: 573086 - DNA, 17 bp, Homo sapiens
ttggtcacaaagctatt

SEQ ID NO: 573087 - DNA, 23 bp, Homo sapiens
ttggtcacaaagctatttaagtg

SEQ ID NO: 573088 - DNA, 17 bp, Homo sapiens
ttggtccacttttccag

SEQ ID NO: 573089 - DNA, 18 bp, Homo sapiens
ttggtctctatttcattt

SEQ ID NO: 573090 - DNA, 23 bp, Homo sapiens
ttggtcttactttgttaatttat

SEQ ID NO: 573091 - DNA, 19 bp, Homo sapiens
ttggtcttttttctgggtc

SEQ ID NO: 573092 - DNA, 23 bp, Homo sapiens
ttggttccacaatcatctattga

SEQ ID NO: 573093 - DNA, 15 bp, Homo sapiens
ttggttcctcacata

SEQ ID NO: 573094 - DNA, 22 bp, Homo sapiens
ttggtttagcccaagtggagcc

SEQ ID NO: 573095 - DNA, 15 bp, Homo sapiens
ttgtaaaacagtggt

SEQ ID NO: 573096 - DNA, 14 bp, Homo sapiens
ttgtaaacgtcttt

SEQ ID NO: 573097 - DNA, 13 bp, Homo sapiens
ttgtaaactttga

SEQ ID NO: 573098 - DNA, 14 bp, Homo sapiens
ttgtaaactttgaa

SEQ ID NO: 573099 - DNA, 17 bp, Homo sapiens
ttgtaaactttgaaata

SEQ ID NO: 573100 - DNA, 13 bp, Homo sapiens
ttgtaaagatatt

SEQ ID NO: 573101 - DNA, 21 bp, Homo sapiens
ttgtaaagatattgtatctcc

SEQ ID NO: 573102 - DNA, 15 bp, Homo sapiens
ttgtaatgtaactgc

SEQ ID NO: 573103 - DNA, 20 bp, Homo sapiens
ttgtaatgtaactgctcttg

SEQ ID NO: 573104 - DNA, 14 bp, Homo sapiens
ttgtacatttttga

SEQ ID NO: 573105 - DNA, 15 bp, Homo sapiens
ttgtagctgtcatgg

SEQ ID NO: 573106 - DNA, 15 bp, Homo sapiens
ttgtagtcttatgaa

SEQ ID NO: 573107 - DNA, 16 bp, Homo sapiens
ttgtagtcttatgaat

SEQ ID NO: 573108 - DNA, 22 bp, Homo sapiens
ttgtagtcttatgaatagacat

SEQ ID NO: 573109 - DNA, 19 bp, Homo sapiens
ttgtagtgttcagaaaaaa

SEQ ID NO: 573110 - DNA, 22 bp, Homo sapiens
ttgtataaatttttaagtgtca

SEQ ID NO: 573111 - DNA, 17 bp, Homo sapiens
ttgtatatatatgtgaa

SEQ ID NO: 573112 - DNA, 19 bp, Homo sapiens
ttgtatgatctgtgccttt

SEQ ID NO: 573113 - DNA, 15 bp, Homo sapiens
ttgtatttaaaacat

SEQ ID NO: 573114 - DNA, 19 bp, Homo sapiens
ttgtcacctgcttctctgc

SEQ ID NO: 573115 - DNA, 20 bp, Homo sapiens
ttgtcactgctgtaaagcaa

SEQ ID NO: 573116 - DNA, 13 bp, Homo sapiens
ttgtcatgtggct

SEQ ID NO: 573117 - DNA, 13 bp, Homo sapiens
ttgtcctcctgct

SEQ ID NO: 573118 - DNA, 15 bp, Homo sapiens
ttgtccttgaaagta

SEQ ID NO: 573119 - DNA, 13 bp, Homo sapiens
ttgtctaaagatc

SEQ ID NO: 573120 - DNA, 17 bp, Homo sapiens
ttgtctgccccaagttt

SEQ ID NO: 573121 - DNA, 13 bp, Homo sapiens
ttgtcttaaataa

SEQ ID NO: 573122 - DNA, 14 bp, Homo sapiens
ttgtctttctgggg

SEQ ID NO: 573123 - DNA, 17 bp, Homo sapiens
ttgtgaaatttttcata

SEQ ID NO: 573124 - DNA, 17 bp, Homo sapiens
ttgtgctccaaatgtct

SEQ ID NO: 573125 - DNA, 18 bp, Homo sapiens
ttgtgtcagcatgtctca

SEQ ID NO: 573126 - DNA, 21 bp, Homo sapiens
ttgtgtgctaaacgtgtatgt

SEQ ID NO: 573127 - DNA, 23 bp, Homo sapiens
ttgtgtgggtttactctgtgcta

SEQ ID NO: 573128 - DNA, 19 bp, Homo sapiens
ttgttaatttatctgttgt

SEQ ID NO: 573129 - DNA, 14 bp, Homo sapiens
ttgttaatttcttg

SEQ ID NO: 573130 - DNA, 23 bp, Homo sapiens
ttgttaatttcttgcaatttgaa

SEQ ID NO: 573131 - DNA, 15 bp, Homo sapiens
ttgttctgtgcaaca

SEQ ID NO: 573132 - DNA, 17 bp, Homo sapiens
ttgttgattctctccat

SEQ ID NO: 573133 - DNA, 17 bp, Homo sapiens
ttgttgcactgaagttt

SEQ ID NO: 573134 - DNA, 18 bp, Homo sapiens
ttgttgctccctgtgaca

SEQ ID NO: 573135 - DNA, 22 bp, Homo sapiens
ttgttgctccctgtgacaaaat

SEQ ID NO: 573136 - DNA, 15 bp, Homo sapiens
ttgttgtttcttgcc

SEQ ID NO: 573137 - DNA, 17 bp, Homo sapiens
ttgtttatctagatgta

SEQ ID NO: 573138 - DNA, 19 bp, Homo sapiens
ttgtttatctagatgtaaa

SEQ ID NO: 573139 - DNA, 18 bp, Homo sapiens
ttgtttctgagaaaagaa

SEQ ID NO: 573140 - DNA, 11 bp, Homo sapiens
ttgtttcttcc

SEQ ID NO: 573141 - DNA, 20 bp, Homo sapiens
ttgtttctttgaattttcat

SEQ ID NO: 573142 - DNA, 14 bp, Homo sapiens
ttgttttgcttccc

SEQ ID NO: 573143 - DNA, 14 bp, Homo sapiens
ttgttttgttgcac

SEQ ID NO: 573144 - DNA, 17 bp, Homo sapiens
ttgttttttcattgtgt

SEQ ID NO: 573145 - DNA, 20 bp, Homo sapiens
tttctcttctccccttccat

SEQ ID NO: 573146 - DNA, 18 bp, Homo sapiens
tttctgaaactaatgaaa

SEQ ID NO: 573147 - DNA, 12 bp, Homo sapiens
tttctgagaaaa

SEQ ID NO: 573148 - DNA, 22 bp, Homo sapiens
tttctgagtagcatatataatt

SEQ ID NO: 573149 - DNA, 15 bp, Homo sapiens
tttctggcaaatatt

SEQ ID NO: 573150 - DNA, 21 bp, Homo sapiens
tttctggcaaatattttgtca

SEQ ID NO: 573151 - DNA, 18 bp, Homo sapiens
tttctggggggatatttc

SEQ ID NO: 573152 - DNA, 20 bp, Homo sapiens
tttctgtactaaacatttcc

SEQ ID NO: 573153 - DNA, 12 bp, Homo sapiens
tttcttaaaaag

SEQ ID NO: 573154 - DNA, 22 bp, Homo sapiens
tttcttaatatatagcatttat

SEQ ID NO: 573155 - DNA, 16 bp, Homo sapiens
tttcttgcaatttgaa

SEQ ID NO: 573156 - DNA, 17 bp, Homo sapiens
tttcttgcaatttgaag

SEQ ID NO: 573157 - DNA, 17 bp, Homo sapiens
tttcttggtatgatcat

SEQ ID NO: 573158 - DNA, 17 bp, Homo sapiens
tttctttgaattttcat

SEQ ID NO: 573159 - DNA, 20 bp, Homo sapiens
tttcttttgttttttgaagt

SEQ ID NO: 573160 - DNA, 13 bp, Homo sapiens
tttcttttttaat

SEQ ID NO: 573161 - DNA, 14 bp, Homo sapiens
tttgaaaacagaaa

SEQ ID NO: 573162 - DNA, 16 bp, Homo sapiens
tttgaaaacagaaatt

SEQ ID NO: 573163 - DNA, 14 bp, Homo sapiens
tttgaaaactcatc

SEQ ID NO: 573164 - DNA, 13 bp, Homo sapiens
tttgaaacattgc

SEQ ID NO: 573165 - DNA, 15 bp, Homo sapiens
tttgaaacattgctt

SEQ ID NO: 573166 - DNA, 21 bp, Homo sapiens
tttgaaatatatggtctaatg

SEQ ID NO: 573167 - DNA, 19 bp, Homo sapiens
tttgagaccaacctgggta

SEQ ID NO: 573168 - DNA, 19 bp, Homo sapiens
tttgatatgagtatacaat

SEQ ID NO: 573169 - DNA, 13 bp, Homo sapiens
tttgatcagtgtt

SEQ ID NO: 573170 - DNA, 22 bp, Homo sapiens
tttgatcttcctctgctaaatt

SEQ ID NO: 573171 - DNA, 14 bp, Homo sapiens
tttgattcacatgt

SEQ ID NO: 573172 - DNA, 19 bp, Homo sapiens
tttgattcacatgttttca

SEQ ID NO: 573173 - DNA, 13 bp, Homo sapiens
tttgcaaataact

SEQ ID NO: 573174 - DNA, 18 bp, Homo sapiens
tttgcaaataacttacaa

SEQ ID NO: 573175 - DNA, 12 bp, Homo sapiens
tttgcacaaaaa

SEQ ID NO: 573176 - DNA, 17 bp, Homo sapiens
tttgcacaaaaagatac

SEQ ID NO: 573177 - DNA, 23 bp, Homo sapiens
tttgcactcttgtttctcccgtg

SEQ ID NO: 573178 - DNA, 13 bp, Homo sapiens
tttgcacttttct

SEQ ID NO: 573179 - DNA, 14 bp, Homo sapiens
tttgcatagaataa

SEQ ID NO: 573180 - DNA, 16 bp, Homo sapiens
tttgcatagaataatg

SEQ ID NO: 573181 - DNA, 14 bp, Homo sapiens
tttgcatgtctgca

SEQ ID NO: 573182 - DNA, 22 bp, Homo sapiens
tttgcccccaaacccccattct

SEQ ID NO: 573183 - DNA, 23 bp, Homo sapiens
tttgccctttacttgtctttctg

SEQ ID NO: 573184 - DNA, 21 bp, Homo sapiens
tttgctaagtaaatctcttct

SEQ ID NO: 573185 - DNA, 21 bp, Homo sapiens
tttgctcataagtaaatgtct

SEQ ID NO: 573186 - DNA, 22 bp, Homo sapiens
tttgctcataagtaaatgtctt

SEQ ID NO: 573187 - DNA, 21 bp, Homo sapiens
tttgctccccttccccttcct

SEQ ID NO: 573188 - DNA, 23 bp, Homo sapiens
tttgctccccttccccttccttc

SEQ ID NO: 573189 - DNA, 23 bp, Homo sapiens
tttgcttgtggctccacacacac

SEQ ID NO: 573190 - DNA, 14 bp, Homo sapiens
tttgctttttgctt

SEQ ID NO: 573191 - DNA, 21 bp, Homo sapiens
tttggaaaattcagataatgg

SEQ ID NO: 573192 - DNA, 15 bp, Homo sapiens
tttggaaggtgacac

SEQ ID NO: 573193 - DNA, 13 bp, Homo sapiens
tttggctcctgcc

SEQ ID NO: 573194 - DNA, 14 bp, Homo sapiens
tttggctcctgccc

SEQ ID NO: 573195 - DNA, 16 bp, Homo sapiens
tttgggcagatttgca

SEQ ID NO: 573196 - DNA, 16 bp, Homo sapiens
tttgggttctttctgg

SEQ ID NO: 573197 - DNA, 18 bp, Homo sapiens
tttggtccacttttccag

SEQ ID NO: 573198 - DNA, 16 bp, Homo sapiens
tttggtgtctttctct

SEQ ID NO: 573199 - DNA, 21 bp, Homo sapiens
tttggttatagtgcaatatat

SEQ ID NO: 573200 - DNA, 22 bp, Homo sapiens
tttggttttaaaatactgtaga

SEQ ID NO: 573201 - DNA, 15 bp, Homo sapiens
tttgtaaactttgaa

SEQ ID NO: 573202 - DNA, 19 bp, Homo sapiens
tttgtaaactttgaaatat

SEQ ID NO: 573203 - DNA, 21 bp, Homo sapiens
tttgtaaactttgaaatatat

SEQ ID NO: 573204 - DNA, 12 bp, Homo sapiens
tttgtacatttt

SEQ ID NO: 573205 - DNA, 13 bp, Homo sapiens
tttgtataaattt

SEQ ID NO: 573206 - DNA, 22 bp, Homo sapiens
tttgtatcctccattgtatctt

SEQ ID NO: 573207 - DNA, 21 bp, Homo sapiens
tttgtatgcaagcagtttcaa

SEQ ID NO: 573208 - DNA, 15 bp, Homo sapiens
tttgtcactgcttca

SEQ ID NO: 573209 - DNA, 18 bp, Homo sapiens
tttgtcattttcattagc

SEQ ID NO: 573210 - DNA, 13 bp, Homo sapiens
tttgtctaagaaa

SEQ ID NO: 573211 - DNA, 12 bp, Homo sapiens
tttgtctcttct

SEQ ID NO: 573212 - DNA, 21 bp, Homo sapiens
tttgtctgccccaagttttgt

SEQ ID NO: 573213 - DNA, 17 bp, Homo sapiens
tttgtgaaatttttcat

SEQ ID NO: 573214 - DNA, 21 bp, Homo sapiens
tttgtgaaatttttcatattt

SEQ ID NO: 573215 - DNA, 16 bp, Homo sapiens
tttgtgagcctatgat

SEQ ID NO: 573216 - DNA, 18 bp, Homo sapiens
tttgtggataagaaaaat

SEQ ID NO: 573217 - DNA, 17 bp, Homo sapiens
tttgttaataaagtgca

SEQ ID NO: 573218 - DNA, 23 bp, Homo sapiens
tttgttcatttcatcctttcact

SEQ ID NO: 573219 - DNA, 10 bp, Homo sapiens
tttgttgcac

SEQ ID NO: 573220 - DNA, 18 bp, Homo sapiens
tttgttgcactgaagttt

SEQ ID NO: 573221 - DNA, 21 bp, Homo sapiens
tttgttgcactgaagtttgat

SEQ ID NO: 573222 - DNA, 22 bp, Homo sapiens
tttgttgcactgaagtttgata

SEQ ID NO: 573223 - DNA, 23 bp, Homo sapiens
tttgttgcactgaagtttgataa

SEQ ID NO: 573224 - DNA, 17 bp, Homo sapiens
tttgttttcattaaaga

SEQ ID NO: 573225 - DNA, 14 bp, Homo sapiens
ttttaaaaaatgaa

SEQ ID NO: 573226 - DNA, 20 bp, Homo sapiens
ttttaaaaagtattgccaaa

SEQ ID NO: 573227 - DNA, 15 bp, Homo sapiens
ttttaaaactactta

SEQ ID NO: 573228 - DNA, 22 bp, Homo sapiens
ttttaaaatcttattaaagttt

SEQ ID NO: 573229 - DNA, 13 bp, Homo sapiens
ttttaaaatttta

SEQ ID NO: 573230 - DNA, 13 bp, Homo sapiens
ttttaaactgtga

SEQ ID NO: 573231 - DNA, 16 bp, Homo sapiens
ttttaagcctttgaag

SEQ ID NO: 573232 - DNA, 15 bp, Homo sapiens
ttttaagtgaaattt

SEQ ID NO: 573233 - DNA, 23 bp, Homo sapiens
ttttaattgaaagggacaagtat

SEQ ID NO: 573234 - DNA, 24 bp, Homo sapiens
ttttaattgatcagttttcatgtg

SEQ ID NO: 573235 - DNA, 18 bp, Homo sapiens
ttttacaaaggctgtatt

SEQ ID NO: 573236 - DNA, 22 bp, Homo sapiens
ttttactgtcttaattaagtaa

SEQ ID NO: 573237 - DNA, 21 bp, Homo sapiens
ttttagtggaccctgaaatgt

SEQ ID NO: 573238 - DNA, 23 bp, Homo sapiens
ttttagtggaccctgaaatgtgt

SEQ ID NO: 573239 - DNA, 14 bp, Homo sapiens
ttttatatgattaa

SEQ ID NO: 573240 - DNA, 13 bp, Homo sapiens
ttttatctcttct

SEQ ID NO: 573241 - DNA, 23 bp, Homo sapiens
ttttatgttgacatttgtttggt

SEQ ID NO: 573242 - DNA, 16 bp, Homo sapiens
ttttattttctaaagt

SEQ ID NO: 573243 - DNA, 14 bp, Homo sapiens
ttttcaaagagatg

SEQ ID NO: 573244 - DNA, 13 bp, Homo sapiens
ttttcaaatatgt

SEQ ID NO: 573245 - DNA, 19 bp, Homo sapiens
ttttcagctaggaacaaat

SEQ ID NO: 573246 - DNA, 17 bp, Homo sapiens
ttttcagctctctgtat

SEQ ID NO: 573247 - DNA, 23 bp, Homo sapiens
ttttcagttcaaagtcatgatgt

SEQ ID NO: 573248 - DNA, 24 bp, Homo sapiens
ttttcagttcaaagtcatgatgtt

SEQ ID NO: 573249 - DNA, 19 bp, Homo sapiens
ttttcatattttaatttca

SEQ ID NO: 573250 - DNA, 22 bp, Homo sapiens
ttttcattaaagagccattctg

SEQ ID NO: 573251 - DNA, 20 bp, Homo sapiens
ttttcattacctgtagcttt

SEQ ID NO: 573252 - DNA, 23 bp, Homo sapiens
ttttcattagcaaaaaaagttgt

SEQ ID NO: 573253 - DNA, 20 bp, Homo sapiens
ttttcatttctaacataagt

SEQ ID NO: 573254 - DNA, 21 bp, Homo sapiens
ttttccaacatacaatttact

SEQ ID NO: 573255 - DNA, 19 bp, Homo sapiens
ttttccagagcattccagt

SEQ ID NO: 573256 - DNA, 20 bp, Homo sapiens
ttttccagagcattccagtc

SEQ ID NO: 573257 - DNA, 17 bp, Homo sapiens
ttttccagtattttagt

SEQ ID NO: 573258 - DNA, 20 bp, Homo sapiens
ttttcccaaagcatccctct

SEQ ID NO: 573259 - DNA, 18 bp, Homo sapiens
ttttcctcgcttctttca

SEQ ID NO: 573260 - DNA, 12 bp, Homo sapiens
ttttccttacat

SEQ ID NO: 573261 - DNA, 14 bp, Homo sapiens
ttttccttgcatac

SEQ ID NO: 573262 - DNA, 12 bp, Homo sapiens
ttttctaaagta

SEQ ID NO: 573263 - DNA, 12 bp, Homo sapiens
ttttctacttta

SEQ ID NO: 573264 - DNA, 13 bp, Homo sapiens
ttttctgaaacta

SEQ ID NO: 573265 - DNA, 13 bp, Homo sapiens
ttttctgggtctt

SEQ ID NO: 573266 - DNA, 12 bp, Homo sapiens
ttttcttaaaaa

SEQ ID NO: 573267 - DNA, 12 bp, Homo sapiens
ttttctttacag

SEQ ID NO: 573268 - DNA, 14 bp, Homo sapiens
ttttgaaaactcat

SEQ ID NO: 573269 - DNA, 19 bp, Homo sapiens
ttttgaaacaaacatggat

SEQ ID NO: 573270 - DNA, 23 bp, Homo sapiens
ttttgagtcttttttttttaagt

SEQ ID NO: 573271 - DNA, 16 bp, Homo sapiens
ttttgatatgagtata

SEQ ID NO: 573272 - DNA, 17 bp, Homo sapiens
ttttgcagctatggaca

SEQ ID NO: 573273 - DNA, 12 bp, Homo sapiens
ttttgcctctgc

SEQ ID NO: 573274 - DNA, 22 bp, Homo sapiens
ttttggaaaacgatttaattta

SEQ ID NO: 573275 - DNA, 21 bp, Homo sapiens
ttttgggaaatgctgatttaa

SEQ ID NO: 573276 - DNA, 20 bp, Homo sapiens
ttttggtccacttttccagt

SEQ ID NO: 573277 - DNA, 12 bp, Homo sapiens
ttttgtgaaatt

SEQ ID NO: 573278 - DNA, 22 bp, Homo sapiens
ttttgtgaaatttttcatattt

SEQ ID NO: 573279 - DNA, 23 bp, Homo sapiens
ttttgtgagtttgtttctttgaa

SEQ ID NO: 573280 - DNA, 24 bp, Homo sapiens
ttttgttcatttcatcctttcact

SEQ ID NO: 573281 - DNA, 18 bp, Homo sapiens
tccagtcaaatctgggct

SEQ ID NO: 573282 - DNA, 12 bp, Homo sapiens
tcccactgccag

SEQ ID NO: 573283 - DNA, 18 bp, Homo sapiens
tccccacttctgtgccac

SEQ ID NO: 573284 - DNA, 19 bp, Homo sapiens
tccctcctggagctctgtg

SEQ ID NO: 573285 - DNA, 20 bp, Homo sapiens
tccctctgtcatcctcagga

SEQ ID NO: 573286 - DNA, 13 bp, Homo sapiens
tccctgggcctca

SEQ ID NO: 573287 - DNA, 12 bp, Homo sapiens
tcctctctctgt

SEQ ID NO: 573288 - DNA, 16 bp, Homo sapiens
tcctggagctctgtgg

SEQ ID NO: 573289 - DNA, 18 bp, Homo sapiens
tcctggagctctgtgggt

SEQ ID NO: 573290 - DNA, 15 bp, Homo sapiens
tcgagagctggccaa

SEQ ID NO: 573291 - DNA, 21 bp, Homo sapiens
tcgagagctggccaaagagcc

SEQ ID NO: 573292 - DNA, 14 bp, Homo sapiens
tcggcctttgggtg

SEQ ID NO: 573293 - DNA, 20 bp, Homo sapiens
tctcggcttggatcctgggc

SEQ ID NO: 573294 - DNA, 13 bp, Homo sapiens
tctcggggcttgc

SEQ ID NO: 573295 - DNA, 22 bp, Homo sapiens
tgagccagccaggccctgccag

SEQ ID NO: 573296 - DNA, 16 bp, Homo sapiens
tgagcctagccctggg

SEQ ID NO: 573297 - DNA, 16 bp, Homo sapiens
caaagagcctttccaa

SEQ ID NO: 573298 - DNA, 19 bp, Homo sapiens
caaagagcctttccaaaga

SEQ ID NO: 573299 - DNA, 21 bp, Homo sapiens
caactgcctaaggccctttgt

SEQ ID NO: 573300 - DNA, 17 bp, Homo sapiens
caactgctcagctctgg

SEQ ID NO: 573301 - DNA, 18 bp, Homo sapiens
caaggccttgcctggcct

SEQ ID NO: 573302 - DNA, 17 bp, Homo sapiens
cacatgtggccatggcc

SEQ ID NO: 573303 - DNA, 20 bp, Homo sapiens
cacggtgactctgtccagct

SEQ ID NO: 573304 - DNA, 22 bp, Homo sapiens
cactccctcctggagctctgtg

SEQ ID NO: 573305 - DNA, 12 bp, Homo sapiens
cactgccgctgc

SEQ ID NO: 573306 - DNA, 14 bp, Homo sapiens
cagaccctctgccg

SEQ ID NO: 573307 - DNA, 23 bp, Homo sapiens
cagatgactatgcagaggcctgg

SEQ ID NO: 573308 - DNA, 15 bp, Homo sapiens
caggagactgggctc

SEQ ID NO: 573309 - DNA, 22 bp, Homo sapiens
caggagactgggctctggctct

SEQ ID NO: 573310 - DNA, 13 bp, Homo sapiens
caggaggccctgg

SEQ ID NO: 573311 - DNA, 19 bp, Homo sapiens
catcttgccaagggtccct

SEQ ID NO: 573312 - DNA, 18 bp, Homo sapiens
catggaaggggcttctgg

SEQ ID NO: 573313 - DNA, 16 bp, Homo sapiens
catggcctctgcaact

SEQ ID NO: 573314 - DNA, 20 bp, Homo sapiens
ctgggacatcaggagactgg

SEQ ID NO: 573315 - DNA, 21 bp, Homo sapiens
ctgggacatcaggagactggg

SEQ ID NO: 573316 - DNA, 15 bp, Homo sapiens
ctgggctctggctct

SEQ ID NO: 573317 - DNA, 17 bp, Homo sapiens
ctgggctgcagagtctg

SEQ ID NO: 573318 - DNA, 22 bp, Homo sapiens
ctgggctgggtggcccctgtct

SEQ ID NO: 573319 - DNA, 16 bp, Homo sapiens
ctggggctccgaaatt

SEQ ID NO: 573320 - DNA, 21 bp, Homo sapiens
gagctctcaaatccctctcca

SEQ ID NO: 573321 - DNA, 22 bp, Homo sapiens
gagctggccaaagagcctttcc

SEQ ID NO: 573322 - DNA, 22 bp, Homo sapiens
gaggaaccaggagaagggctgg

SEQ ID NO: 573323 - DNA, 21 bp, Homo sapiens
gaggcatcatggaaagactgg

SEQ ID NO: 573324 - DNA, 21 bp, Homo sapiens
gaggccaagcagtgcctgcct

SEQ ID NO: 573325 - DNA, 18 bp, Homo sapiens
gaggcctgggggacccct

SEQ ID NO: 573326 - DNA, 19 bp, Homo sapiens
gagggacccttcgagatca

SEQ ID NO: 573327 - DNA, 23 bp, Homo sapiens
gagtctgccccacatgtggccat

SEQ ID NO: 573328 - DNA, 22 bp, Homo sapiens
gatgactatgcagaggcctggg

SEQ ID NO: 573329 - DNA, 18 bp, Homo sapiens
gatgtggggctgagctgg

SEQ ID NO: 573330 - DNA, 23 bp, Homo sapiens
gattcccactgccgctgcccgct

SEQ ID NO: 573331 - DNA, 20 bp, Homo sapiens
gcaactgctcagctctggtc

SEQ ID NO: 573332 - DNA, 23 bp, Homo sapiens
gcacaaggccttgcctggcctga

SEQ ID NO: 573333 - DNA, 13 bp, Homo sapiens
gcagaggcctggg

SEQ ID NO: 573334 - DNA, 15 bp, Homo sapiens
gccaaagagcctttc

SEQ ID NO: 573335 - DNA, 15 bp, Homo sapiens
gccagccaggccctg

SEQ ID NO: 573336 - DNA, 13 bp, Homo sapiens
gccaggggcgagg

SEQ ID NO: 573337 - DNA, 19 bp, Homo sapiens
gccaggggcgaggcccttc

SEQ ID NO: 573338 - DNA, 14 bp, Homo sapiens
gccatggcctctgc

SEQ ID NO: 573339 - DNA, 20 bp, Homo sapiens
gcccagaccggcttctcggc

SEQ ID NO: 573340 - DNA, 21 bp, Homo sapiens
gccccacatgtggccatggcc

SEQ ID NO: 573341 - DNA, 17 bp, Homo sapiens
gccccactctgcctgcc

SEQ ID NO: 573342 - DNA, 17 bp, Homo sapiens
gcccccatttcacccat

SEQ ID NO: 573343 - DNA, 13 bp, Homo sapiens
gcccctcggctct

SEQ ID NO: 573344 - DNA, 19 bp, Homo sapiens
gcccctgctgtctctctgg

SEQ ID NO: 573345 - DNA, 20 bp, Homo sapiens
gcccctgctgtctctctggg

SEQ ID NO: 573346 - DNA, 16 bp, Homo sapiens
gcccctgtctcggggc

SEQ ID NO: 573347 - DNA, 15 bp, Homo sapiens
gcccttcctctttgg

SEQ ID NO: 573348 - DNA, 19 bp, Homo sapiens
gccgcacgcctctccctgc

SEQ ID NO: 573349 - DNA, 16 bp, Homo sapiens
gcctcagtgtgcccat

SEQ ID NO: 573350 - DNA, 22 bp, Homo sapiens
gcctctgcaactgctcagctct

SEQ ID NO: 573351 - DNA, 20 bp, Homo sapiens
gcctgcctatgaaatttcaa

SEQ ID NO: 573352 - DNA, 23 bp, Homo sapiens
gcctggggctccgaaattccaag

SEQ ID NO: 573353 - DNA, 21 bp, Homo sapiens
gcctgggggacccctggctct

SEQ ID NO: 573354 - DNA, 23 bp, Homo sapiens
gcctgggggacccctggctctgg

SEQ ID NO: 573355 - DNA, 21 bp, Homo sapiens
gcgagcccctcggctctggag

SEQ ID NO: 573356 - DNA, 17 bp, Homo sapiens
gctctgtgggtctctgg

SEQ ID NO: 573357 - DNA, 18 bp, Homo sapiens
gctctgtgggtctctgga

SEQ ID NO: 573358 - DNA, 19 bp, Homo sapiens
gctgacagtttgtggcatc

SEQ ID NO: 573359 - DNA, 21 bp, Homo sapiens
gctgagggtgcccttttccag

SEQ ID NO: 573360 - DNA, 20 bp, Homo sapiens
gctgcccgctcagcccagct

SEQ ID NO: 573361 - DNA, 17 bp, Homo sapiens
gctgcttccaggctggg

SEQ ID NO: 573362 - DNA, 21 bp, Homo sapiens
gctgggcagcacaaggccttg

SEQ ID NO: 573363 - DNA, 19 bp, Homo sapiens
gctgtctctctgggctgca

SEQ ID NO: 573364 - DNA, 21 bp, Homo sapiens
gctgttggtcctctctctgtg

SEQ ID NO: 573365 - DNA, 15 bp, Homo sapiens
gcttccaggctgggc

SEQ ID NO: 573366 - DNA, 22 bp, Homo sapiens
gcttctcggcttggatcctggg

SEQ ID NO: 573367 - DNA, 22 bp, Homo sapiens
gcttgccccactctgcctgcct

SEQ ID NO: 573368 - DNA, 19 bp, Homo sapiens
ggacacacatggtgagcct

SEQ ID NO: 573369 - DNA, 14 bp, Homo sapiens
ggacccctggctct

SEQ ID NO: 573370 - DNA, 22 bp, Homo sapiens
ggaggccaagcagtgcctgcct

SEQ ID NO: 573371 - DNA, 15 bp, Homo sapiens
ggcagattcccactg

SEQ ID NO: 573372 - DNA, 15 bp, Homo sapiens
ggcatggaaggggct

SEQ ID NO: 573373 - DNA, 21 bp, Homo sapiens
ggcatttcaattcctggccct

SEQ ID NO: 573374 - DNA, 21 bp, Homo sapiens
ggccctgccagtggggaagga

SEQ ID NO: 573375 - DNA, 15 bp, Homo sapiens
ggccctgtggcagga

SEQ ID NO: 573376 - DNA, 14 bp, Homo sapiens
ggccgggcctgggg

SEQ ID NO: 573377 - DNA, 16 bp, Homo sapiens
ggctgagggtgccctt

SEQ ID NO: 573378 - DNA, 18 bp, Homo sapiens
ggctgtgtaaccttgggt

SEQ ID NO: 573379 - DNA, 17 bp, Homo sapiens
ggcttgccccactctgc

SEQ ID NO: 573380 - DNA, 17 bp, Homo sapiens
ggcttggatcctgggct

SEQ ID NO: 573381 - DNA, 19 bp, Homo sapiens
gggacatcaggagactggg

SEQ ID NO: 573382 - DNA, 22 bp, Homo sapiens
gggctccgaaattccaaggccc

SEQ ID NO: 573383 - DNA, 16 bp, Homo sapiens
gggctgagggtgccct

SEQ ID NO: 573384 - DNA, 21 bp, Homo sapiens
ggggcttctggacctagggtg

SEQ ID NO: 573385 - DNA, 16 bp, Homo sapiens
gggttcttgagccagc

SEQ ID NO: 573386 - DNA, 14 bp, Homo sapiens
ggtcctctctctgt

SEQ ID NO: 573387 - DNA, 22 bp, Homo sapiens
ggtcctctctctgtggggctga

SEQ ID NO: 573388 - DNA, 13 bp, Homo sapiens
ggtcctggcctcc

SEQ ID NO: 573389 - DNA, 19 bp, Homo sapiens
ggtctatgtcgagagctgg

SEQ ID NO: 573390 - DNA, 23 bp, Homo sapiens
ggtctatgtcgagagctggccaa

SEQ ID NO: 573391 - DNA, 22 bp, Homo sapiens
ggtggattctccctgggcctca

SEQ ID NO: 573392 - DNA, 23 bp, Homo sapiens
ggtggattctccctgggcctcag

SEQ ID NO: 573393 - DNA, 22 bp, Homo sapiens
ggttcttgagccagccaggccc

SEQ ID NO: 573394 - DNA, 22 bp, Homo sapiens
gtaccccctcaaaccctgccct

SEQ ID NO: 573395 - DNA, 17 bp, Homo sapiens
gtcatcctcaggaacca

SEQ ID NO: 573396 - DNA, 15 bp, Homo sapiens
gtccaggccctgtgg

SEQ ID NO: 573397 - DNA, 17 bp, Homo sapiens
gtccaggccctgtggca

SEQ ID NO: 573398 - DNA, 18 bp, Homo sapiens
gtcctctctctgtggggc

SEQ ID NO: 573399 - DNA, 14 bp, Homo sapiens
gtcgagagctggcc

SEQ ID NO: 573400 - DNA, 22 bp, Homo sapiens
gtctcggggcttgccccactct

SEQ ID NO: 573401 - DNA, 19 bp, Homo sapiens
gtgcccttttccagcctca

SEQ ID NO: 573402 - DNA, 13 bp, Homo sapiens
gtgctccctctgt

SEQ ID NO: 573403 - DNA, 16 bp, Homo sapiens
gtggattctccctggg

SEQ ID NO: 573404 - DNA, 16 bp, Homo sapiens
gtggccgcacgcctct

SEQ ID NO: 573405 - DNA, 17 bp, Homo sapiens
gtgtggagagagaggct

SEQ ID NO: 573406 - DNA, 14 bp, Homo sapiens
gttggtcctctctc

SEQ ID NO: 573407 - DNA, 16 bp, Homo sapiens
tcaaatccctctccaa

SEQ ID NO: 573408 - DNA, 14 bp, Homo sapiens
tcaaatctgggctc

SEQ ID NO: 573409 - DNA, 11 bp, Homo sapiens
tcagcccagct

SEQ ID NO: 573410 - DNA, 21 bp, Homo sapiens
tcagcctactccgctcactga

SEQ ID NO: 573411 - DNA, 19 bp, Homo sapiens
tcaggagactgggctctgg

SEQ ID NO: 573412 - DNA, 13 bp, Homo sapiens
tcatcctcaggaa

SEQ ID NO: 573413 - DNA, 16 bp, Homo sapiens
tccagtcaaatctggg

SEQ ID NO: 573414 - DNA, 21 bp, Homo sapiens
tccctcctggagctctgtggg

SEQ ID NO: 573415 - DNA, 19 bp, Homo sapiens
tccctgcactccctcctgg

SEQ ID NO: 573416 - DNA, 20 bp, Homo sapiens
tccctgcactccctcctgga

SEQ ID NO: 573417 - DNA, 11 bp, Homo sapiens
tcctctctctg

SEQ ID NO: 573418 - DNA, 13 bp, Homo sapiens
tcctctctctgtg

SEQ ID NO: 573419 - DNA, 15 bp, Homo sapiens
tcctggagctctgtg

SEQ ID NO: 573420 - DNA, 20 bp, Homo sapiens
tcctgggctgggtggcccct

SEQ ID NO: 573421 - DNA, 18 bp, Homo sapiens
tccttagacctgagggac

SEQ ID NO: 573422 - DNA, 13 bp, Homo sapiens
tcggctctggagg

SEQ ID NO: 573423 - DNA, 17 bp, Homo sapiens
tcggggcttgccccact

SEQ ID NO: 573424 - DNA, 14 bp, Homo sapiens
tctgcaactgctca

SEQ ID NO: 573425 - DNA, 17 bp, Homo sapiens
tctgcaactgctcagct

SEQ ID NO: 573426 - DNA, 21 bp, Homo sapiens
tctgtccagctcccgctgtgg

SEQ ID NO: 573427 - DNA, 16 bp, Homo sapiens
tctgtgggtctctgga

SEQ ID NO: 573428 - DNA, 17 bp, Homo sapiens
tgaactccttccccact

SEQ ID NO: 573429 - DNA, 20 bp, Homo sapiens
tgaccttcagagccagccgg

SEQ ID NO: 573430 - DNA, 19 bp, Homo sapiens
gaggacgtgttacccactg

SEQ ID NO: 573431 - DNA, 22 bp, Homo sapiens
gaggcatcatggaaagactggg

SEQ ID NO: 573432 - DNA, 20 bp, Homo sapiens
gaggccaagcagtgcctgcc

SEQ ID NO: 573433 - DNA, 19 bp, Homo sapiens
gaggccctggtcctggcct

SEQ ID NO: 573434 - DNA, 17 bp, Homo sapiens
gatcctgggctgggtgg

SEQ ID NO: 573435 - DNA, 21 bp, Homo sapiens
gcacaaggccttgcctggcct

SEQ ID NO: 573436 - DNA, 18 bp, Homo sapiens
gcacggtgactctgtcca

SEQ ID NO: 573437 - DNA, 11 bp, Homo sapiens
gcatggaaggg

SEQ ID NO: 573438 - DNA, 14 bp, Homo sapiens
gcatggaaggggct

SEQ ID NO: 573439 - DNA, 18 bp, Homo sapiens
gcatggaaggggcttctg

SEQ ID NO: 573440 - DNA, 19 bp, Homo sapiens
gccaaagagcctttccaaa

SEQ ID NO: 573441 - DNA, 14 bp, Homo sapiens
gccaccctgcccct

SEQ ID NO: 573442 - DNA, 16 bp, Homo sapiens
gccagccaggccctgc

SEQ ID NO: 573443 - DNA, 12 bp, Homo sapiens
gccatggcctct

SEQ ID NO: 573444 - DNA, 19 bp, Homo sapiens
gcccctcggctctggaggc

SEQ ID NO: 573445 - DNA, 18 bp, Homo sapiens
gcccctgctgtctctctg

SEQ ID NO: 573446 - DNA, 21 bp, Homo sapiens
gcccctgctgtctctctgggc

SEQ ID NO: 573447 - DNA, 19 bp, Homo sapiens
gcccctggccccgcctgcc

SEQ ID NO: 573448 - DNA, 20 bp, Homo sapiens
gcccctggccccgcctgcct

SEQ ID NO: 573449 - DNA, 15 bp, Homo sapiens
gcccctgtctcgggg

SEQ ID NO: 573450 - DNA, 13 bp, Homo sapiens
gccccttgccatc

SEQ ID NO: 573451 - DNA, 16 bp, Homo sapiens
gccctggtcctggcct

SEQ ID NO: 573452 - DNA, 19 bp, Homo sapiens
gccgagacagaccctctgc

SEQ ID NO: 573453 - DNA, 12 bp, Homo sapiens
gcctaaggccct

SEQ ID NO: 573454 - DNA, 20 bp, Homo sapiens
gcctctgcaactgctcagct

SEQ ID NO: 573455 - DNA, 23 bp, Homo sapiens
gcgagctctcaaatccctctcca

SEQ ID NO: 573456 - DNA, 13 bp, Homo sapiens
gctcactcacccc

SEQ ID NO: 573457 - DNA, 14 bp, Homo sapiens
gctcagctctggtc

SEQ ID NO: 573458 - DNA, 20 bp, Homo sapiens
gctcagctctggtccaggcc

SEQ ID NO: 573459 - DNA, 20 bp, Homo sapiens
gctccgaaattccaaggccc

SEQ ID NO: 573460 - DNA, 23 bp, Homo sapiens
gctctggtccaggccctgtggca

SEQ ID NO: 573461 - DNA, 14 bp, Homo sapiens
gctgagctggggaa

SEQ ID NO: 573462 - DNA, 16 bp, Homo sapiens
gctgcttccaggctgg

SEQ ID NO: 573463 - DNA, 18 bp, Homo sapiens
gctgcttccaggctgggc

SEQ ID NO: 573464 - DNA, 12 bp, Homo sapiens
gctgtctctctg

SEQ ID NO: 573465 - DNA, 19 bp, Homo sapiens
gcttccaggctgggcagca

SEQ ID NO: 573466 - DNA, 15 bp, Homo sapiens
gcttggatcctgggc

SEQ ID NO: 573467 - DNA, 18 bp, Homo sapiens
ggacatcaggagactggg

SEQ ID NO: 573468 - DNA, 21 bp, Homo sapiens
ggacgtgttacccactgccat

SEQ ID NO: 573469 - DNA, 18 bp, Homo sapiens
ggatcctgggctgggtgg

SEQ ID NO: 573470 - DNA, 20 bp, Homo sapiens
ggatgcattcgagatggcag

SEQ ID NO: 573471 - DNA, 22 bp, Homo sapiens
ggcagatgtggggctgagctgg

SEQ ID NO: 573472 - DNA, 16 bp, Homo sapiens
ggccaagcagtgcctg

SEQ ID NO: 573473 - DNA, 15 bp, Homo sapiens
ggccatggcctctgc

SEQ ID NO: 573474 - DNA, 19 bp, Homo sapiens
ggcccctgctgtctctctg

SEQ ID NO: 573475 - DNA, 15 bp, Homo sapiens
ggccctggtcctggc

SEQ ID NO: 573476 - DNA, 18 bp, Homo sapiens
ggccctggtcctggcctc

SEQ ID NO: 573477 - DNA, 19 bp, Homo sapiens
ggccctgttctcctcccca

SEQ ID NO: 573478 - DNA, 16 bp, Homo sapiens
ggcccttcctctttgg

SEQ ID NO: 573479 - DNA, 20 bp, Homo sapiens
ggcctgggggacccctggct

SEQ ID NO: 573480 - DNA, 15 bp, Homo sapiens
ggccttgcctggcct

SEQ ID NO: 573481 - DNA, 18 bp, Homo sapiens
ggcgggcccagaccggct

SEQ ID NO: 573482 - DNA, 12 bp, Homo sapiens
ggctctggctct

SEQ ID NO: 573483 - DNA, 19 bp, Homo sapiens
ggctctgggccgggcctgg

SEQ ID NO: 573484 - DNA, 23 bp, Homo sapiens
ggctgagggtgcccttttccagc

SEQ ID NO: 573485 - DNA, 21 bp, Homo sapiens
ggctgggcagcacaaggcctt

SEQ ID NO: 573486 - DNA, 14 bp, Homo sapiens
ggctgggtggcccc

SEQ ID NO: 573487 - DNA, 15 bp, Homo sapiens
ggcttggatcctggg

SEQ ID NO: 573488 - DNA, 19 bp, Homo sapiens
gggagacagttgagagcgg

SEQ ID NO: 573489 - DNA, 14 bp, Homo sapiens
gggatgtgacatgc

SEQ ID NO: 573490 - DNA, 13 bp, Homo sapiens
gggcctggggctc

SEQ ID NO: 573491 - DNA, 23 bp, Homo sapiens
gggtggcccctgctgtctctctg

SEQ ID NO: 573492 - DNA, 20 bp, Homo sapiens
ggtctatgtcgagagctggc

SEQ ID NO: 573493 - DNA, 12 bp, Homo sapiens
ggtgactctgtc

SEQ ID NO: 573494 - DNA, 15 bp, Homo sapiens
ggtgctccctctgtc

SEQ ID NO: 573495 - DNA, 14 bp, Homo sapiens
gtaggcagaggctg

SEQ ID NO: 573496 - DNA, 16 bp, Homo sapiens
gtcaaatctgggctca

SEQ ID NO: 573497 - DNA, 13 bp, Homo sapiens
gtcgagagctggc

SEQ ID NO: 573498 - DNA, 18 bp, Homo sapiens
gtctatgtcgagagctgg

SEQ ID NO: 573499 - DNA, 23 bp, Homo sapiens
gtggcatttcaattcctggccct

SEQ ID NO: 573500 - DNA, 19 bp, Homo sapiens
gtggccatggcctctgcaa

SEQ ID NO: 573501 - DNA, 20 bp, Homo sapiens
gtggcccctgctgtctctct

SEQ ID NO: 573502 - DNA, 22 bp, Homo sapiens
gtggcccctgctgtctctctgg

SEQ ID NO: 573503 - DNA, 12 bp, Homo sapiens
gtggggctgagc

SEQ ID NO: 573504 - DNA, 14 bp, Homo sapiens
gtgttacccactgc

SEQ ID NO: 573505 - DNA, 16 bp, Homo sapiens
gttacccactgccatg

SEQ ID NO: 573506 - DNA, 20 bp, Homo sapiens
taccccctcaaaccctgccc

SEQ ID NO: 573507 - DNA, 23 bp, Homo sapiens
tcagatgactatgcagaggcctg

SEQ ID NO: 573508 - DNA, 17 bp, Homo sapiens
tcagctctggtccaggc

SEQ ID NO: 573509 - DNA, 20 bp, Homo sapiens
tccagtcaaatctgggctca

SEQ ID NO: 573510 - DNA, 17 bp, Homo sapiens
tccccacttctgtgcca

SEQ ID NO: 573511 - DNA, 14 bp, Homo sapiens
tccctcctggagct

SEQ ID NO: 573512 - DNA, 23 bp, Homo sapiens
tccttagacctgagggacccttc

SEQ ID NO: 573513 - DNA, 22 bp, Homo sapiens
caggaggccctggtcctggcct

SEQ ID NO: 573514 - DNA, 12 bp, Homo sapiens
cagtgcctgcct

SEQ ID NO: 573515 - DNA, 14 bp, Homo sapiens
cagtgtgcccatct

SEQ ID NO: 573516 - DNA, 20 bp, Homo sapiens
cagtttgtggcatcttgcca

SEQ ID NO: 573517 - DNA, 14 bp, Homo sapiens
catcaggagactgg

SEQ ID NO: 573518 - DNA, 21 bp, Homo sapiens
catcatggaaagactgggaca

SEQ ID NO: 573519 - DNA, 21 bp, Homo sapiens
catggaaggggcttctggacc

SEQ ID NO: 573520 - DNA, 14 bp, Homo sapiens
catggcctctgcaa

SEQ ID NO: 573521 - DNA, 15 bp, Homo sapiens
catggtgagcctagc

SEQ ID NO: 573522 - DNA, 19 bp, Homo sapiens
catggtgagcctagccctg

SEQ ID NO: 573523 - DNA, 20 bp, Homo sapiens
catgtgtgcgtgtctccatg

SEQ ID NO: 573524 - DNA, 17 bp, Homo sapiens
catttcaattcctggcc

SEQ ID NO: 573525 - DNA, 17 bp, Homo sapiens
ccaaagagcctttccaa

SEQ ID NO: 573526 - DNA, 15 bp, Homo sapiens
ccagcgagctctcaa

SEQ ID NO: 573527 - DNA, 21 bp, Homo sapiens
ccagctcccgctgtggccgca

SEQ ID NO: 573528 - DNA, 23 bp, Homo sapiens
ccaggccctgccagtggggaagg

SEQ ID NO: 573529 - DNA, 22 bp, Homo sapiens
ccagtcaaatctgggctcactc

SEQ ID NO: 573530 - DNA, 15 bp, Homo sapiens
ccatccattctggaa

SEQ ID NO: 573531 - DNA, 22 bp, Homo sapiens
ccattccagtcaaatctgggct

SEQ ID NO: 573532 - DNA, 22 bp, Homo sapiens
cccacatgtggccatggcctct

SEQ ID NO: 573533 - DNA, 14 bp, Homo sapiens
cccactctgcctgc

SEQ ID NO: 573534 - DNA, 17 bp, Homo sapiens
cccactctgcctgcctg

SEQ ID NO: 573535 - DNA, 13 bp, Homo sapiens
cccagaccggctt

SEQ ID NO: 573536 - DNA, 16 bp, Homo sapiens
cccagaccggcttctc

SEQ ID NO: 573537 - DNA, 11 bp, Homo sapiens
ccccactctgc

SEQ ID NO: 573538 - DNA, 12 bp, Homo sapiens
ccccgcctgcct

SEQ ID NO: 573539 - DNA, 22 bp, Homo sapiens
cccctcatcatagcaataacat

SEQ ID NO: 573540 - DNA, 14 bp, Homo sapiens
cccctgctgtctct

SEQ ID NO: 573541 - DNA, 19 bp, Homo sapiens
cccctggccccgcctgcct

SEQ ID NO: 573542 - DNA, 12 bp, Homo sapiens
cccctggctctg

SEQ ID NO: 573543 - DNA, 14 bp, Homo sapiens
cccctggctctggg

SEQ ID NO: 573544 - DNA, 15 bp, Homo sapiens
cccctggctctgggc

SEQ ID NO: 573545 - DNA, 22 bp, Homo sapiens
cccggtctatgtcgagagctgg

SEQ ID NO: 573546 - DNA, 19 bp, Homo sapiens
ccctcctggagctctgtgg

SEQ ID NO: 573547 - DNA, 13 bp, Homo sapiens
ccctcggctctgg

SEQ ID NO: 573548 - DNA, 13 bp, Homo sapiens
ccctgctgtctct

SEQ ID NO: 573549 - DNA, 19 bp, Homo sapiens
ccctgctgtctctctgggc

SEQ ID NO: 573550 - DNA, 14 bp, Homo sapiens
ccctggctctgggc

SEQ ID NO: 573551 - DNA, 23 bp, Homo sapiens
ccctggtcctggcctccttcccc

SEQ ID NO: 573552 - DNA, 14 bp, Homo sapiens
ccggcttctcggct

SEQ ID NO: 573553 - DNA, 23 bp, Homo sapiens
ccggtctatgtcgagagctggcc

SEQ ID NO: 573554 - DNA, 23 bp, Homo sapiens
cctcctggagctctgtgggtctc

SEQ ID NO: 573555 - DNA, 17 bp, Homo sapiens
cctctctctgtggggct

SEQ ID NO: 573556 - DNA, 13 bp, Homo sapiens
cctgcctgccacc

SEQ ID NO: 573557 - DNA, 19 bp, Homo sapiens
cctgctgtctctctgggct

SEQ ID NO: 573558 - DNA, 18 bp, Homo sapiens
cctggccctgttctcctc

SEQ ID NO: 573559 - DNA, 13 bp, Homo sapiens
cctggctctgggc

SEQ ID NO: 573560 - DNA, 21 bp, Homo sapiens
cctgggctgggtggcccctgt

SEQ ID NO: 573561 - DNA, 14 bp, Homo sapiens
cctgtctcggggct

SEQ ID NO: 573562 - DNA, 19 bp, Homo sapiens
ccttcagagccagccggct

SEQ ID NO: 573563 - DNA, 12 bp, Homo sapiens
cctttgggtgtg

SEQ ID NO: 573564 - DNA, 23 bp, Homo sapiens
cgagagctggccaaagagccttt

SEQ ID NO: 573565 - DNA, 14 bp, Homo sapiens
cgagcccctcggct

SEQ ID NO: 573566 - DNA, 16 bp, Homo sapiens
cgagcccctcggctct

SEQ ID NO: 573567 - DNA, 14 bp, Homo sapiens
cgcctgcctgccac

SEQ ID NO: 573568 - DNA, 18 bp, Homo sapiens
cgcctgcctgccaccctg

SEQ ID NO: 573569 - DNA, 13 bp, Homo sapiens
cgctcagcccagc

SEQ ID NO: 573570 - DNA, 15 bp, Homo sapiens
cgctgcccgctcagc

SEQ ID NO: 573571 - DNA, 16 bp, Homo sapiens
cgctgcttccaggctg

SEQ ID NO: 573572 - DNA, 11 bp, Homo sapiens
cggctctggag

SEQ ID NO: 573573 - DNA, 14 bp, Homo sapiens
ctcaaatccctctc

SEQ ID NO: 573574 - DNA, 21 bp, Homo sapiens
ctcactcaccccagcgagctc

SEQ ID NO: 573575 - DNA, 22 bp, Homo sapiens
ctcactgaactccttccccact

SEQ ID NO: 573576 - DNA, 12 bp, Homo sapiens
ctcagcccagct

SEQ ID NO: 573577 - DNA, 17 bp, Homo sapiens
ctcggcttggatcctgg

SEQ ID NO: 573578 - DNA, 18 bp, Homo sapiens
ctctcaaatccctctcca

SEQ ID NO: 573579 - DNA, 21 bp, Homo sapiens
ctctccaactgcctaaggccc

SEQ ID NO: 573580 - DNA, 13 bp, Homo sapiens
ctctctgtggggc

SEQ ID NO: 573581 - DNA, 14 bp, Homo sapiens
ctctggctctgttc

SEQ ID NO: 573582 - DNA, 19 bp, Homo sapiens
ctctgtccagctcccgctg

SEQ ID NO: 573583 - DNA, 17 bp, Homo sapiens
ctctgtgggtctctgga

SEQ ID NO: 573584 - DNA, 20 bp, Homo sapiens
ctctgtgggtctctggaaga

SEQ ID NO: 573585 - DNA, 21 bp, Homo sapiens
ctctttggtggcatggaaggg

SEQ ID NO: 573586 - DNA, 15 bp, Homo sapiens
ctgagggtgcccttt

SEQ ID NO: 573587 - DNA, 21 bp, Homo sapiens
ctgcaactgctcagctctggt

SEQ ID NO: 573588 - DNA, 20 bp, Homo sapiens
ctgcactccctcctggagct

SEQ ID NO: 573589 - DNA, 17 bp, Homo sapiens
ctgcagagtctgcccca

SEQ ID NO: 573590 - DNA, 16 bp, Homo sapiens
ctgccgagacagaccc

SEQ ID NO: 573591 - DNA, 19 bp, Homo sapiens
ctgccgagacagaccctct

SEQ ID NO: 573592 - DNA, 17 bp, Homo sapiens
ctgctgtctctctgggc

SEQ ID NO: 573593 - DNA, 17 bp, Homo sapiens
ctgcttccaggctgggc

SEQ ID NO: 573594 - DNA, 17 bp, Homo sapiens
ctggccccgcctgcctg

SEQ ID NO: 573595 - DNA, 18 bp, Homo sapiens
ctggccccgcctgcctgc

SEQ ID NO: 573596 - DNA, 20 bp, Homo sapiens
ctggccccgcctgcctgcca

SEQ ID NO: 573597 - DNA, 14 bp, Homo sapiens
ctggctctgggccg

SEQ ID NO: 573598 - DNA, 20 bp, Homo sapiens
ctggctgtgtaaccttgggt

SEQ ID NO: 573599 - DNA, 15 bp, Homo sapiens
ctgggccgggcctgg

SEQ ID NO: 573600 - DNA, 17 bp, Homo sapiens
ctgggccgggcctgggg

SEQ ID NO: 573601 - DNA, 20 bp, Homo sapiens
ctgggccgggcctggggctc

SEQ ID NO: 573602 - DNA, 16 bp, Homo sapiens
ctggggccggggctga

SEQ ID NO: 573603 - DNA, 16 bp, Homo sapiens
ctggtccaggccctgt

SEQ ID NO: 573604 - DNA, 13 bp, Homo sapiens
ctggtcctggcct

SEQ ID NO: 573605 - DNA, 15 bp, Homo sapiens
ctgtctctctgggct

SEQ ID NO: 573606 - DNA, 15 bp, Homo sapiens
ctgtggccgcacgcc

SEQ ID NO: 573607 - DNA, 12 bp, Homo sapiens
ctgtggggctga

SEQ ID NO: 573608 - DNA, 17 bp, Homo sapiens
ctgttgggaacagcatg

SEQ ID NO: 573609 - DNA, 18 bp, Homo sapiens
ctgttgggaacagcatgg

SEQ ID NO: 573610 - DNA, 12 bp, Homo sapiens
cttccttgcccc

SEQ ID NO: 573611 - DNA, 18 bp, Homo sapiens
cttgccatccattctgga

SEQ ID NO: 573612 - DNA, 17 bp, Homo sapiens
cttgccccactctgcct

SEQ ID NO: 573613 - DNA, 22 bp, Homo sapiens
cttgccccactctgcctgcctg

SEQ ID NO: 573614 - DNA, 17 bp, Homo sapiens
cttggatcctgggctgg

SEQ ID NO: 573615 - DNA, 20 bp, Homo sapiens
gaaagactgggacagcccag

SEQ ID NO: 573616 - DNA, 17 bp, Homo sapiens
gaaccaggagaagggct

SEQ ID NO: 573617 - DNA, 22 bp, Homo sapiens
gaaccaggagaagggctggggc

SEQ ID NO: 573618 - DNA, 20 bp, Homo sapiens
gaacccggtgctccctctgt

SEQ ID NO: 573619 - DNA, 17 bp, Homo sapiens
gacctgagggacccttc

SEQ ID NO: 573620 - DNA, 22 bp, Homo sapiens
gacgtgttacccactgccatgc

SEQ ID NO: 573621 - DNA, 18 bp, Homo sapiens
gactatgcagaggcctgg

SEQ ID NO: 573622 - DNA, 15 bp, Homo sapiens
gactgggctctggct

SEQ ID NO: 573623 - DNA, 13 bp, Homo sapiens
gagcccctcggct

SEQ ID NO: 573624 - DNA, 20 bp, Homo sapiens
gagctctgtgggtctctgga

SEQ ID NO: 573625 - DNA, 18 bp, Homo sapiens
gagctggccaaagagcct

SEQ ID NO: 573626 - DNA, 17 bp, Homo sapiens
aactgcctaaggccctt

SEQ ID NO: 573627 - DNA, 16 bp, Homo sapiens
aaggccttgcctggcc

SEQ ID NO: 573628 - DNA, 21 bp, Homo sapiens
aagggctggggccggggctga

SEQ ID NO: 573629 - DNA, 13 bp, Homo sapiens
aaggggcttctgg

SEQ ID NO: 573630 - DNA, 17 bp, Homo sapiens
acacatggtgagcctag

SEQ ID NO: 573631 - DNA, 23 bp, Homo sapiens
acatcaggagactgggctctggc

SEQ ID NO: 573632 - DNA, 18 bp, Homo sapiens
acccggtgctccctctgt

SEQ ID NO: 573633 - DNA, 19 bp, Homo sapiens
acccggtgctccctctgtc

SEQ ID NO: 573634 - DNA, 17 bp, Homo sapiens
accctgccccttgccat

SEQ ID NO: 573635 - DNA, 16 bp, Homo sapiens
accttgggtggcccct

SEQ ID NO: 573636 - DNA, 19 bp, Homo sapiens
acggagcagttcagagtgg

SEQ ID NO: 573637 - DNA, 19 bp, Homo sapiens
actccttccccacttctgt

SEQ ID NO: 573638 - DNA, 14 bp, Homo sapiens
actctgcctgcctg

SEQ ID NO: 573639 - DNA, 20 bp, Homo sapiens
actgccatgcaccaggactg

SEQ ID NO: 573640 - DNA, 14 bp, Homo sapiens
actgctcagctctg

SEQ ID NO: 573641 - DNA, 21 bp, Homo sapiens
agaagagccaagagtccagga

SEQ ID NO: 573642 - DNA, 17 bp, Homo sapiens
agacctgagggaccctt

SEQ ID NO: 573643 - DNA, 11 bp, Homo sapiens
agagccagccg

SEQ ID NO: 573644 - DNA, 22 bp, Homo sapiens
agcaataacattcccactgcca

SEQ ID NO: 573645 - DNA, 15 bp, Homo sapiens
agcctcagcctactc

SEQ ID NO: 573646 - DNA, 19 bp, Homo sapiens
agcgatgggcccctggccc

SEQ ID NO: 573647 - DNA, 20 bp, Homo sapiens
agctctgtgggtctctggaa

SEQ ID NO: 573648 - DNA, 18 bp, Homo sapiens
agctggccaaagagcctt

SEQ ID NO: 573649 - DNA, 19 bp, Homo sapiens
agctggccaaagagccttt

SEQ ID NO: 573650 - DNA, 21 bp, Homo sapiens
aggaggccctggtcctggcct

SEQ ID NO: 573651 - DNA, 17 bp, Homo sapiens
aggcccttcctctttgg

SEQ ID NO: 573652 - DNA, 22 bp, Homo sapiens
aggcctgggggacccctggctc

SEQ ID NO: 573653 - DNA, 15 bp, Homo sapiens
aggccttgcctggcc

SEQ ID NO: 573654 - DNA, 18 bp, Homo sapiens
aggccttgcctggcctga

SEQ ID NO: 573655 - DNA, 18 bp, Homo sapiens
agggtgcccttttccagc

SEQ ID NO: 573656 - DNA, 23 bp, Homo sapiens
agtaccccctcaaaccctgccct

SEQ ID NO: 573657 - DNA, 19 bp, Homo sapiens
agtggaggcgggcttggaa

SEQ ID NO: 573658 - DNA, 21 bp, Homo sapiens
atcagggtaaaaggtgcaggt

SEQ ID NO: 573659 - DNA, 21 bp, Homo sapiens
atcctgggctgggtggcccct

SEQ ID NO: 573660 - DNA, 14 bp, Homo sapiens
atgtcgagagctgg

SEQ ID NO: 573661 - DNA, 22 bp, Homo sapiens
atgtgacatgcccaaggccacg

SEQ ID NO: 573662 - DNA, 18 bp, Homo sapiens
atgtggggctgagctggg

SEQ ID NO: 573663 - DNA, 22 bp, Homo sapiens
attccagtcaaatctgggctca

SEQ ID NO: 573664 - DNA, 17 bp, Homo sapiens
atttcaattcctggccc

SEQ ID NO: 573665 - DNA, 16 bp, Homo sapiens
caagcagtgcctgcct

SEQ ID NO: 573666 - DNA, 19 bp, Homo sapiens
cacctgtaggcagaggctg

SEQ ID NO: 573667 - DNA, 23 bp, Homo sapiens
cactccctcctggagctctgtgg

SEQ ID NO: 573668 - DNA, 17 bp, Homo sapiens
cactgaactccttcccc

SEQ ID NO: 573669 - DNA, 21 bp, Homo sapiens
cactgccaggggttcttgagc

SEQ ID NO: 573670 - DNA, 13 bp, Homo sapiens
cacttctgtgcca

SEQ ID NO: 573671 - DNA, 15 bp, Homo sapiens
cagatgtggggctga

SEQ ID NO: 573672 - DNA, 18 bp, Homo sapiens
cagatgtggggctgagct

SEQ ID NO: 573673 - DNA, 19 bp, Homo sapiens
cagatgtggggctgagctg

SEQ ID NO: 573674 - DNA, 21 bp, Homo sapiens
cagatgtggggctgagctggg

SEQ ID NO: 573675 - DNA, 23 bp, Homo sapiens
gactggctgtgtaaccttgggtg

SEQ ID NO: 573676 - DNA, 12 bp, Homo sapiens
gactgggctctg

SEQ ID NO: 573677 - DNA, 17 bp, Homo sapiens
gagactgggctctggct

SEQ ID NO: 573678 - DNA, 19 bp, Homo sapiens
gagactgggctctggctct

SEQ ID NO: 573679 - DNA, 19 bp, Homo sapiens
gagatggcagattcccact

SEQ ID NO: 573680 - DNA, 19 bp, Homo sapiens
gagcccctcggctctggag

SEQ ID NO: 573681 - DNA, 23 bp, Homo sapiens
gagctctcaaatccctctccaac

SEQ ID NO: 573682 - DNA, 19 bp, Homo sapiens
gagctggccaaagagcctt

SEQ ID NO: 573683 - DNA, 23 bp, Homo sapiens
gagctggccaaagagcctttcca

SEQ ID NO: 573684 - DNA, 15 bp, Homo sapiens
gaggatgcattcgag

SEQ ID NO: 573685 - DNA, 20 bp, Homo sapiens
gaggcagatgtggggctgag

SEQ ID NO: 573686 - DNA, 23 bp, Homo sapiens
gaggctgccgagacagaccctct

SEQ ID NO: 573687 - DNA, 19 bp, Homo sapiens
gatgtggggctgagctggg

SEQ ID NO: 573688 - DNA, 18 bp, Homo sapiens
gcaactgctcagctctgg

SEQ ID NO: 573689 - DNA, 14 bp, Homo sapiens
gcactccctcctgg

SEQ ID NO: 573690 - DNA, 15 bp, Homo sapiens
gcactccctcctgga

SEQ ID NO: 573691 - DNA, 21 bp, Homo sapiens
gcatggaaggggcttctggac

SEQ ID NO: 573692 - DNA, 22 bp, Homo sapiens
gccaaagagcctttccaaagag

SEQ ID NO: 573693 - DNA, 13 bp, Homo sapiens
gccaccctgcccc

SEQ ID NO: 573694 - DNA, 15 bp, Homo sapiens
gccatccattctgga

SEQ ID NO: 573695 - DNA, 16 bp, Homo sapiens
gcccagaccggcttct

SEQ ID NO: 573696 - DNA, 17 bp, Homo sapiens
gcccagaccggcttctc

SEQ ID NO: 573697 - DNA, 17 bp, Homo sapiens
gcccctgctgtctctct

SEQ ID NO: 573698 - DNA, 11 bp, Homo sapiens
gcccctggccc

SEQ ID NO: 573699 - DNA, 18 bp, Homo sapiens
gcccctggccccgcctgc

SEQ ID NO: 573700 - DNA, 14 bp, Homo sapiens
gccctggtcctggc

SEQ ID NO: 573701 - DNA, 17 bp, Homo sapiens
gccctggtcctggcctc

SEQ ID NO: 573702 - DNA, 14 bp, Homo sapiens
gccgcacgcctctc

SEQ ID NO: 573703 - DNA, 15 bp, Homo sapiens
gccgcacgcctctcc

SEQ ID NO: 573704 - DNA, 18 bp, Homo sapiens
gccgctgcccgctcagcc

SEQ ID NO: 573705 - DNA, 19 bp, Homo sapiens
gccgctgcttccaggctgg

SEQ ID NO: 573706 - DNA, 22 bp, Homo sapiens
gccggctatgaaagggagcgag

SEQ ID NO: 573707 - DNA, 14 bp, Homo sapiens
gcctcagcctactc

SEQ ID NO: 573708 - DNA, 15 bp, Homo sapiens
gcctcagcctactcc

SEQ ID NO: 573709 - DNA, 17 bp, Homo sapiens
gcctctgcaactgctca

SEQ ID NO: 573710 - DNA, 22 bp, Homo sapiens
gcctgctgttggtcctctctct

SEQ ID NO: 573711 - DNA, 20 bp, Homo sapiens
gcctgggggacccctggctc

SEQ ID NO: 573712 - DNA, 22 bp, Homo sapiens
gcctgggggacccctggctctg

SEQ ID NO: 573713 - DNA, 15 bp, Homo sapiens
gccttgcctggcctg

SEQ ID NO: 573714 - DNA, 16 bp, Homo sapiens
gctctcaaatccctct

SEQ ID NO: 573715 - DNA, 11 bp, Homo sapiens
gctctggctct

SEQ ID NO: 573716 - DNA, 16 bp, Homo sapiens
gctctggtccaggccc

SEQ ID NO: 573717 - DNA, 15 bp, Homo sapiens
gctctgtgggtctct

SEQ ID NO: 573718 - DNA, 13 bp, Homo sapiens
gctgagctgggga

SEQ ID NO: 573719 - DNA, 22 bp, Homo sapiens
gctgccgagacagaccctctgc

SEQ ID NO: 573720 - DNA, 20 bp, Homo sapiens
gctggccaaagagcctttcc

SEQ ID NO: 573721 - DNA, 18 bp, Homo sapiens
gctggggccggggctgag

SEQ ID NO: 573722 - DNA, 13 bp, Homo sapiens
gctgtctctctgg

SEQ ID NO: 573723 - DNA, 14 bp, Homo sapiens
gctgtctctctggg

SEQ ID NO: 573724 - DNA, 15 bp, Homo sapiens
gctgtctctctgggc

SEQ ID NO: 573725 - DNA, 21 bp, Homo sapiens
gctgtggccgcacgcctctcc

SEQ ID NO: 573726 - DNA, 22 bp, Homo sapiens
gctgttggtcctctctctgtgg

SEQ ID NO: 573727 - DNA, 22 bp, Homo sapiens
gcttcaatcggcttgtgggtga

SEQ ID NO: 573728 - DNA, 12 bp, Homo sapiens
gcttccaggctg

SEQ ID NO: 573729 - DNA, 21 bp, Homo sapiens
gcttgccccactctgcctgcc

SEQ ID NO: 573730 - DNA, 23 bp, Homo sapiens
ggaaccaggagaagggctggggc

SEQ ID NO: 573731 - DNA, 16 bp, Homo sapiens
ggaaggggcttctgga

SEQ ID NO: 573732 - DNA, 16 bp, Homo sapiens
ggacctagggtggcct

SEQ ID NO: 573733 - DNA, 13 bp, Homo sapiens
ggagaagggctgg

SEQ ID NO: 573734 - DNA, 14 bp, Homo sapiens
ggagaagggctggg

SEQ ID NO: 573735 - DNA, 18 bp, Homo sapiens
ggagaagggctggggccg

SEQ ID NO: 573736 - DNA, 17 bp, Homo sapiens
ggaggcatcatggaaag

SEQ ID NO: 573737 - DNA, 17 bp, Homo sapiens
ggatgcattcgagatgg

SEQ ID NO: 573738 - DNA, 19 bp, Homo sapiens
ggcatggaaggggcttctg

SEQ ID NO: 573739 - DNA, 19 bp, Homo sapiens
ggccaagcagtgcctgcct

SEQ ID NO: 573740 - DNA, 16 bp, Homo sapiens
ggccatggcctctgca

SEQ ID NO: 573741 - DNA, 18 bp, Homo sapiens
ggcccagaccggcttctc

SEQ ID NO: 573742 - DNA, 16 bp, Homo sapiens
ggcccctgctgtctct

SEQ ID NO: 573743 - DNA, 18 bp, Homo sapiens
ggcccctgctgtctctct

SEQ ID NO: 573744 - DNA, 13 bp, Homo sapiens
ggcccctggcccc

SEQ ID NO: 573745 - DNA, 17 bp, Homo sapiens
ggccctggtcctggcct

SEQ ID NO: 573746 - DNA, 16 bp, Homo sapiens
ggccgcacgcctctcc

SEQ ID NO: 573747 - DNA, 17 bp, Homo sapiens
ggccgcacgcctctccc

SEQ ID NO: 573748 - DNA, 22 bp, Homo sapiens
ggcctgggggacccctggctct

SEQ ID NO: 573749 - DNA, 18 bp, Homo sapiens
ggcgaggcccttcctctt

SEQ ID NO: 573750 - DNA, 23 bp, Homo sapiens
ggctctgttcggcctttgggtgt

SEQ ID NO: 573751 - DNA, 13 bp, Homo sapiens
ggctgagctgggg

SEQ ID NO: 573752 - DNA, 20 bp, Homo sapiens
ggctgcagagtctgccccac

SEQ ID NO: 573753 - DNA, 22 bp, Homo sapiens
ggctgccgagacagaccctctg

SEQ ID NO: 573754 - DNA, 13 bp, Homo sapiens
gggccggggctga

SEQ ID NO: 573755 - DNA, 20 bp, Homo sapiens
gggcctcagtgtgcccatct

SEQ ID NO: 573756 - DNA, 13 bp, Homo sapiens
gggctgagctggg

SEQ ID NO: 573757 - DNA, 16 bp, Homo sapiens
gggcttgccccactct

SEQ ID NO: 573758 - DNA, 21 bp, Homo sapiens
ggggacccctggctctgggcc

SEQ ID NO: 573759 - DNA, 23 bp, Homo sapiens
ggggctgaattgccaggggcgag

SEQ ID NO: 573760 - DNA, 18 bp, Homo sapiens
ggtccaggccctgtggca

SEQ ID NO: 573761 - DNA, 12 bp, Homo sapiens
ggtcctctctct

SEQ ID NO: 573762 - DNA, 22 bp, Homo sapiens
ggtctatgtcgagagctggcca

SEQ ID NO: 573763 - DNA, 21 bp, Homo sapiens
ggtgagcctagccctgggaca

SEQ ID NO: 573764 - DNA, 23 bp, Homo sapiens
gtaaggtgtcttaatactgtcct

SEQ ID NO: 573765 - DNA, 20 bp, Homo sapiens
gtactttgtcccgtggcatt

SEQ ID NO: 573766 - DNA, 18 bp, Homo sapiens
gtccagctcccgctgtgg

SEQ ID NO: 573767 - DNA, 16 bp, Homo sapiens
gtcgagagctggccaa

SEQ ID NO: 573768 - DNA, 15 bp, Homo sapiens
gtctctctgggctgc

SEQ ID NO: 573769 - DNA, 17 bp, Homo sapiens
gtctgccccacatgtgg

SEQ ID NO: 573770 - DNA, 17 bp, Homo sapiens
gtgacatgcccaaggcc

SEQ ID NO: 573771 - DNA, 17 bp, Homo sapiens
gtgagcctagccctggg

SEQ ID NO: 573772 - DNA, 21 bp, Homo sapiens
gtggcatttcaattcctggcc

SEQ ID NO: 573773 - DNA, 12 bp, Homo sapiens
gtggccatggcc

SEQ ID NO: 573774 - DNA, 18 bp, Homo sapiens
gtggccgcacgcctctcc

SEQ ID NO: 573775 - DNA, 18 bp, Homo sapiens
gtggggctgagctgggga

SEQ ID NO: 573776 - DNA, 17 bp, Homo sapiens
gtgggtatgcgagacca

SEQ ID NO: 573777 - DNA, 14 bp, Homo sapiens
gtgggtctctggaa

SEQ ID NO: 573778 - DNA, 17 bp, Homo sapiens
gttacccactgccatgc

SEQ ID NO: 573779 - DNA, 16 bp, Homo sapiens
taacattcccactgcc

SEQ ID NO: 573780 - DNA, 22 bp, Homo sapiens
tatgtcgagagctggccaaaga

SEQ ID NO: 573781 - DNA, 21 bp, Homo sapiens
tcaagcagacatagaagagcc

SEQ ID NO: 573782 - DNA, 11 bp, Homo sapiens
tcaccatggcc

SEQ ID NO: 573783 - DNA, 22 bp, Homo sapiens
tcatagcaataacattcccact

SEQ ID NO: 573784 - DNA, 21 bp, Homo sapiens
tccaactgcctaaggcccttt

SEQ ID NO: 573785 - DNA, 18 bp, Homo sapiens
tccagctcccgctgtggc

SEQ ID NO: 573786 - DNA, 17 bp, Homo sapiens
tccagtcaaatctgggc

SEQ ID NO: 573787 - DNA, 18 bp, Homo sapiens
aacccggtgctccctctg

SEQ ID NO: 573788 - DNA, 17 bp, Homo sapiens
aactgctcagctctggt

SEQ ID NO: 573789 - DNA, 19 bp, Homo sapiens
aaggccttgcctggcctga

SEQ ID NO: 573790 - DNA, 20 bp, Homo sapiens
aataacattcccactgccag

SEQ ID NO: 573791 - DNA, 15 bp, Homo sapiens
aatccctctccaact

SEQ ID NO: 573792 - DNA, 19 bp, Homo sapiens
acaaggccttgcctggcct

SEQ ID NO: 573793 - DNA, 21 bp, Homo sapiens
accaggagaagggctggggcc

SEQ ID NO: 573794 - DNA, 16 bp, Homo sapiens
actccctcctggagct

SEQ ID NO: 573795 - DNA, 18 bp, Homo sapiens
actgcctaaggccctttg

SEQ ID NO: 573796 - DNA, 16 bp, Homo sapiens
actgctcagctctggt

SEQ ID NO: 573797 - DNA, 17 bp, Homo sapiens
actgctcagctctggtc

SEQ ID NO: 573798 - DNA, 15 bp, Homo sapiens
agacagaccctctgc

SEQ ID NO: 573799 - DNA, 20 bp, Homo sapiens
agatgactatgcagaggcct

SEQ ID NO: 573800 - DNA, 22 bp, Homo sapiens
agatgtggggctgagctgggga

SEQ ID NO: 573801 - DNA, 19 bp, Homo sapiens
agcacggtgactctgtcca

SEQ ID NO: 573802 - DNA, 13 bp, Homo sapiens
agcagtgcctgcc

SEQ ID NO: 573803 - DNA, 14 bp, Homo sapiens
agcccctcggctct

SEQ ID NO: 573804 - DNA, 17 bp, Homo sapiens
agcccctcggctctgga

SEQ ID NO: 573805 - DNA, 22 bp, Homo sapiens
agcgagcccctcggctctggag

SEQ ID NO: 573806 - DNA, 22 bp, Homo sapiens
agctggccaaagagcctttcca

SEQ ID NO: 573807 - DNA, 15 bp, Homo sapiens
aggagaagggctggg

SEQ ID NO: 573808 - DNA, 23 bp, Homo sapiens
aggcagatgtggggctgagctgg

SEQ ID NO: 573809 - DNA, 18 bp, Homo sapiens
aggccctggtcctggcct

SEQ ID NO: 573810 - DNA, 16 bp, Homo sapiens
aggccttgcctggcct

SEQ ID NO: 573811 - DNA, 14 bp, Homo sapiens
aggcgggcttggaa

SEQ ID NO: 573812 - DNA, 20 bp, Homo sapiens
aggggttcttgagccagcca

SEQ ID NO: 573813 - DNA, 22 bp, Homo sapiens
atcaggagactgggctctggct

SEQ ID NO: 573814 - DNA, 21 bp, Homo sapiens
atggaaagactgggacagccc

SEQ ID NO: 573815 - DNA, 18 bp, Homo sapiens
atggaaggggcttctgga

SEQ ID NO: 573816 - DNA, 14 bp, Homo sapiens
atgggcccctggcc

SEQ ID NO: 573817 - DNA, 13 bp, Homo sapiens
atgtgtgtgcatg

SEQ ID NO: 573818 - DNA, 20 bp, Homo sapiens
attccagtcaaatctgggct

SEQ ID NO: 573819 - DNA, 17 bp, Homo sapiens
gtggggctgagctgggg

SEQ ID NO: 573820 - DNA, 18 bp, Homo sapiens
gttgggaacagcatggag

SEQ ID NO: 573821 - DNA, 16 bp, Homo sapiens
gttggtcctctctctg

SEQ ID NO: 573822 - DNA, 17 bp, Homo sapiens
taaaaggtgcaggtgtg

SEQ ID NO: 573823 - DNA, 13 bp, Homo sapiens
tacccactgccat

SEQ ID NO: 573824 - DNA, 14 bp, Homo sapiens
tacccactgccatg

SEQ ID NO: 573825 - DNA, 13 bp, Homo sapiens
taggcagaggctg

SEQ ID NO: 573826 - DNA, 18 bp, Homo sapiens
tatgtcgagagctggcca

SEQ ID NO: 573827 - DNA, 14 bp, Homo sapiens
tcacttccttgccc

SEQ ID NO: 573828 - DNA, 21 bp, Homo sapiens
tcatggaaagactgggacagc

SEQ ID NO: 573829 - DNA, 15 bp, Homo sapiens
tccaggctgggcagc

SEQ ID NO: 573830 - DNA, 12 bp, Homo sapiens
tcctggcctcct

SEQ ID NO: 573831 - DNA, 17 bp, Homo sapiens
tcctggcctccttcccc

SEQ ID NO: 573832 - DNA, 14 bp, Homo sapiens
tcgagagctggcca

SEQ ID NO: 573833 - DNA, 21 bp, Homo sapiens
tcgagatggcagattcccact

SEQ ID NO: 573834 - DNA, 21 bp, Homo sapiens
tctccaactgcctaaggccct

SEQ ID NO: 573835 - DNA, 21 bp, Homo sapiens
tctccctgcactccctcctgg

SEQ ID NO: 573836 - DNA, 23 bp, Homo sapiens
tctctggaagaggaaccaggaga

SEQ ID NO: 573837 - DNA, 12 bp, Homo sapiens
tctctgggctgc

SEQ ID NO: 573838 - DNA, 13 bp, Homo sapiens
tctgcctgcctgc

SEQ ID NO: 573839 - DNA, 17 bp, Homo sapiens
tctgtcatcctcaggaa

SEQ ID NO: 573840 - DNA, 16 bp, Homo sapiens
tcttgagccagccagg

SEQ ID NO: 573841 - DNA, 24 bp, Homo sapiens
tgactatgcagaggcctgggggac

SEQ ID NO: 573842 - DNA, 20 bp, Homo sapiens
tgagccagccaggccctgcc

SEQ ID NO: 573843 - DNA, 21 bp, Homo sapiens
tgcaactgctcagctctggtc

SEQ ID NO: 573844 - DNA, 14 bp, Homo sapiens
tgcagaggcctggg

SEQ ID NO: 573845 - DNA, 23 bp, Homo sapiens
tgcaggtgtggagagagaggctt

SEQ ID NO: 573846 - DNA, 22 bp, Homo sapiens
tgcatgtgtgcgtgtctccatg

SEQ ID NO: 573847 - DNA, 16 bp, Homo sapiens
tgccatccattctgga

SEQ ID NO: 573848 - DNA, 16 bp, Homo sapiens
tgccccactctgcctg

SEQ ID NO: 573849 - DNA, 17 bp, Homo sapiens
tgcccccatttcaccca

SEQ ID NO: 573850 - DNA, 13 bp, Homo sapiens
tgccccttgccat

SEQ ID NO: 573851 - DNA, 21 bp, Homo sapiens
tgctcagctctggtccaggcc

SEQ ID NO: 573852 - DNA, 12 bp, Homo sapiens
tgctccctctgt

SEQ ID NO: 573853 - DNA, 13 bp, Homo sapiens
tgctgtctctctg

SEQ ID NO: 573854 - DNA, 15 bp, Homo sapiens
tgctgtctctctggg

SEQ ID NO: 573855 - DNA, 20 bp, Homo sapiens
tgctgttggtcctctctctg

SEQ ID NO: 573856 - DNA, 13 bp, Homo sapiens
tggaaagactggg

SEQ ID NO: 573857 - DNA, 22 bp, Homo sapiens
tggagctctgtgggtctctgga

SEQ ID NO: 573858 - DNA, 23 bp, Homo sapiens
tggagctctgtgggtctctggaa

SEQ ID NO: 573859 - DNA, 21 bp, Homo sapiens
tggaggcagatgtggggctga

SEQ ID NO: 573860 - DNA, 14 bp, Homo sapiens
tggatcctgggctg

SEQ ID NO: 573861 - DNA, 20 bp, Homo sapiens
tggcagattcccactgccgc

SEQ ID NO: 573862 - DNA, 19 bp, Homo sapiens
tggcatggaaggggcttct

SEQ ID NO: 573863 - DNA, 19 bp, Homo sapiens
tggcatttcaattcctggc

SEQ ID NO: 573864 - DNA, 18 bp, Homo sapiens
tggccatggcctctgcaa

SEQ ID NO: 573865 - DNA, 19 bp, Homo sapiens
tggccccgcctgcctgcca

SEQ ID NO: 573866 - DNA, 19 bp, Homo sapiens
tggcctctgcaactgctca

SEQ ID NO: 573867 - DNA, 20 bp, Homo sapiens
tggctgtgtaaccttgggtg

SEQ ID NO: 573868 - DNA, 19 bp, Homo sapiens
tgggccgggcctggggctc

SEQ ID NO: 573869 - DNA, 19 bp, Homo sapiens
tgggcctcagtgtgcccat

SEQ ID NO: 573870 - DNA, 16 bp, Homo sapiens
tggggagacagttgag

SEQ ID NO: 573871 - DNA, 15 bp, Homo sapiens
tggggccggggctga

SEQ ID NO: 573872 - DNA, 21 bp, Homo sapiens
tgggtggcccctgctgtctct

SEQ ID NO: 573873 - DNA, 23 bp, Homo sapiens
tggtcctctctctgtggggctga

SEQ ID NO: 573874 - DNA, 12 bp, Homo sapiens
tggtcctggcct

SEQ ID NO: 573875 - DNA, 15 bp, Homo sapiens
tgtaaaggggcagct

SEQ ID NO: 573876 - DNA, 14 bp, Homo sapiens
tgtaaccttgggtg

SEQ ID NO: 573877 - DNA, 21 bp, Homo sapiens
tgtaaccttgggtggcccctg

SEQ ID NO: 573878 - DNA, 16 bp, Homo sapiens
tgtaggcagaggctgc

SEQ ID NO: 573879 - DNA, 14 bp, Homo sapiens
tgtgggtctctgga

SEQ ID NO: 573880 - DNA, 21 bp, Homo sapiens
tgtgtggtggattctccctgg

SEQ ID NO: 573881 - DNA, 22 bp, Homo sapiens
tgttgtacatttcaccatggcc

SEQ ID NO: 573882 - DNA, 16 bp, Homo sapiens
ttcaattcctggccct

SEQ ID NO: 573883 - DNA, 17 bp, Homo sapiens
ttcaccatggccccctc

SEQ ID NO: 573884 - DNA, 10 bp, Homo sapiens
ttcccactgc

SEQ ID NO: 573885 - DNA, 16 bp, Homo sapiens
ttcggcctttgggtgt

SEQ ID NO: 573886 - DNA, 11 bp, Homo sapiens
ttgccccactc

SEQ ID NO: 573887 - DNA, 22 bp, Homo sapiens
ttgggaacagcatggaggcaga

SEQ ID NO: 573888 - DNA, 14 bp, Homo sapiens
ttggtcctctctct

SEQ ID NO: 573889 - DNA, 19 bp, Homo sapiens
tcgagagctggccaaagag

SEQ ID NO: 573890 - DNA, 12 bp, Homo sapiens
tcggctctggag

SEQ ID NO: 573891 - DNA, 17 bp, Homo sapiens
tcggcttggatcctggg

SEQ ID NO: 573892 - DNA, 19 bp, Homo sapiens
tcggcttggatcctgggct

SEQ ID NO: 573893 - DNA, 23 bp, Homo sapiens
tctcaaatccctctccaactgcc

SEQ ID NO: 573894 - DNA, 13 bp, Homo sapiens
tctccctgggcct

SEQ ID NO: 573895 - DNA, 22 bp, Homo sapiens
tctgcaactgctcagctctggt

SEQ ID NO: 573896 - DNA, 15 bp, Homo sapiens
tctgtgggtctctgg

SEQ ID NO: 573897 - DNA, 17 bp, Homo sapiens
tctgtgggtctctggaa

SEQ ID NO: 573898 - DNA, 21 bp, Homo sapiens
tcttgagccagccaggccctg

SEQ ID NO: 573899 - DNA, 22 bp, Homo sapiens
tgaaagaggacgtgttacccac

SEQ ID NO: 573900 - DNA, 18 bp, Homo sapiens
tgaactccttccccactt

SEQ ID NO: 573901 - DNA, 17 bp, Homo sapiens
tgagcctagccctggga

SEQ ID NO: 573902 - DNA, 20 bp, Homo sapiens
tgagggtgcccttttccagc

SEQ ID NO: 573903 - DNA, 20 bp, Homo sapiens
tgcaactgctcagctctggt

SEQ ID NO: 573904 - DNA, 19 bp, Homo sapiens
tgccccactctgcctgcct

SEQ ID NO: 573905 - DNA, 14 bp, Homo sapiens
tgctgtctctctgg

SEQ ID NO: 573906 - DNA, 18 bp, Homo sapiens
tgctgtctctctgggctg

SEQ ID NO: 573907 - DNA, 15 bp, Homo sapiens
tgcttccaggctggg

SEQ ID NO: 573908 - DNA, 17 bp, Homo sapiens
tggaggcgggcttggaa

SEQ ID NO: 573909 - DNA, 19 bp, Homo sapiens
tggattctccctgggcctc

SEQ ID NO: 573910 - DNA, 15 bp, Homo sapiens
tggccaaagagcctt

SEQ ID NO: 573911 - DNA, 21 bp, Homo sapiens
tggccctgttctcctccccaa

SEQ ID NO: 573912 - DNA, 21 bp, Homo sapiens
tggccgcacgcctctccctgc

SEQ ID NO: 573913 - DNA, 14 bp, Homo sapiens
tgggcccctggccc

SEQ ID NO: 573914 - DNA, 15 bp, Homo sapiens
tgggcccctggcccc

SEQ ID NO: 573915 - DNA, 22 bp, Homo sapiens
tgggcctcagtgtgcccatctg

SEQ ID NO: 573916 - DNA, 18 bp, Homo sapiens
tgggctgggtggcccctg

SEQ ID NO: 573917 - DNA, 21 bp, Homo sapiens
tggggagacagttgagagcgg

SEQ ID NO: 573918 - DNA, 14 bp, Homo sapiens
aagagcctttccaa

SEQ ID NO: 573919 - DNA, 15 bp, Homo sapiens
aagagcctttccaaa

SEQ ID NO: 573920 - DNA, 15 bp, Homo sapiens
acatcaggagactgg

SEQ ID NO: 573921 - DNA, 18 bp, Homo sapiens
acatcaggagactgggct

SEQ ID NO: 573922 - DNA, 20 bp, Homo sapiens
acatggtgagcctagccctg

SEQ ID NO: 573923 - DNA, 14 bp, Homo sapiens
acatgttgtacatt

SEQ ID NO: 573924 - DNA, 16 bp, Homo sapiens
acatttcaccatggcc

SEQ ID NO: 573925 - DNA, 14 bp, Homo sapiens
acccaagtcttctc

SEQ ID NO: 573926 - DNA, 12 bp, Homo sapiens
acccctggctct

SEQ ID NO: 573927 - DNA, 17 bp, Homo sapiens
acccggtgctccctctg

SEQ ID NO: 573928 - DNA, 13 bp, Homo sapiens
accctgccctcct

SEQ ID NO: 573929 - DNA, 17 bp, Homo sapiens
actatgcagaggcctgg

SEQ ID NO: 573930 - DNA, 17 bp, Homo sapiens
actccgctcactgaact

SEQ ID NO: 573931 - DNA, 16 bp, Homo sapiens
actgggctctggctct

SEQ ID NO: 573932 - DNA, 18 bp, Homo sapiens
agactgggctctggctct

SEQ ID NO: 573933 - DNA, 15 bp, Homo sapiens
agagcctttccaaag

SEQ ID NO: 573934 - DNA, 21 bp, Homo sapiens
agagtccaggaggccctggtc

SEQ ID NO: 573935 - DNA, 19 bp, Homo sapiens
agcaataacattcccactg

SEQ ID NO: 573936 - DNA, 21 bp, Homo sapiens
agcacaaggccttgcctggcc

SEQ ID NO: 573937 - DNA, 18 bp, Homo sapiens
agcccctcggctctggag

SEQ ID NO: 573938 - DNA, 13 bp, Homo sapiens
agcctagccctgg

SEQ ID NO: 573939 - DNA, 19 bp, Homo sapiens
agctctgtgggtctctgga

SEQ ID NO: 573940 - DNA, 18 bp, Homo sapiens
aggagaagggctggggcc

SEQ ID NO: 573941 - DNA, 19 bp, Homo sapiens
aggccaagcagtgcctgcc

SEQ ID NO: 573942 - DNA, 13 bp, Homo sapiens
aggccctgccagt

SEQ ID NO: 573943 - DNA, 20 bp, Homo sapiens
aggccctggtcctggcctcc

SEQ ID NO: 573944 - DNA, 22 bp, Homo sapiens
aggctgggcagcacaaggcctt

SEQ ID NO: 573945 - DNA, 24 bp, Homo sapiens
agggtgcccttttccagcctcagc

SEQ ID NO: 573946 - DNA, 17 bp, Homo sapiens
agtcaaatctgggctca

SEQ ID NO: 573947 - DNA, 13 bp, Homo sapiens
agtgtgcccatct

SEQ ID NO: 573948 - DNA, 20 bp, Homo sapiens
agtttgtggcatcttgccaa

SEQ ID NO: 573949 - DNA, 12 bp, Homo sapiens
atcctgggctgg

SEQ ID NO: 573950 - DNA, 14 bp, Homo sapiens
atggaaggggcttc

SEQ ID NO: 573951 - DNA, 17 bp, Homo sapiens
atggaaggggcttctgg

SEQ ID NO: 573952 - DNA, 22 bp, Homo sapiens
atggggagacagttgagagcgg

SEQ ID NO: 573953 - DNA, 17 bp, Homo sapiens
atgtggggctgagctgg

SEQ ID NO: 573954 - DNA, 14 bp, Homo sapiens
attctccctgggcc

SEQ ID NO: 573955 - DNA, 13 bp, Homo sapiens
caaatctgggctc

SEQ ID NO: 573956 - DNA, 13 bp, Homo sapiens
caactgctcagct

SEQ ID NO: 573957 - DNA, 18 bp, Homo sapiens
caactgctcagctctggt

SEQ ID NO: 573958 - DNA, 18 bp, Homo sapiens
caagtcttctcccgtcca

SEQ ID NO: 573959 - DNA, 20 bp, Homo sapiens
cacggagcagttcagagtgg

SEQ ID NO: 573960 - DNA, 21 bp, Homo sapiens
cacggagcagttcagagtgga

SEQ ID NO: 573961 - DNA, 17 bp, Homo sapiens
cacggtgactctgtcca

SEQ ID NO: 573962 - DNA, 20 bp, Homo sapiens
cactgccaggggttcttgag

SEQ ID NO: 573963 - DNA, 22 bp, Homo sapiens
cactgccatgcaccaggactgg

SEQ ID NO: 573964 - DNA, 12 bp, Homo sapiens
cagagtggaggc

SEQ ID NO: 573965 - DNA, 22 bp, Homo sapiens
cagcacaaggccttgcctggcc

SEQ ID NO: 573966 - DNA, 17 bp, Homo sapiens
cagccaggccctgccag

SEQ ID NO: 573967 - DNA, 20 bp, Homo sapiens
cagcctactccgctcactga

SEQ ID NO: 573968 - DNA, 15 bp, Homo sapiens
caggagaagggctgg

SEQ ID NO: 573969 - DNA, 19 bp, Homo sapiens
caggagactgggctctggc

SEQ ID NO: 573970 - DNA, 23 bp, Homo sapiens
caggccctgccagtggggaagga

SEQ ID NO: 573971 - DNA, 17 bp, Homo sapiens
caggccctgtggcagga

SEQ ID NO: 573972 - DNA, 18 bp, Homo sapiens
caggcgggcccagaccgg

SEQ ID NO: 573973 - DNA, 19 bp, Homo sapiens
caggggttcttgagccagc

SEQ ID NO: 573974 - DNA, 16 bp, Homo sapiens
cagtcaaatctgggct

SEQ ID NO: 573975 - DNA, 21 bp, Homo sapiens
catcaggagactgggctctgg

SEQ ID NO: 573976 - DNA, 18 bp, Homo sapiens
catgcaccaggactggct

SEQ ID NO: 573977 - DNA, 20 bp, Homo sapiens
catgcaccaggactggctgt

SEQ ID NO: 573978 - DNA, 22 bp, Homo sapiens
catgcaccaggactggctgtgt

SEQ ID NO: 573979 - DNA, 14 bp, Homo sapiens
catggaaagactgg

SEQ ID NO: 573980 - DNA, 19 bp, Homo sapiens
catgtggccatggcctctg

SEQ ID NO: 573981 - DNA, 23 bp, Homo sapiens
cattccagtcaaatctgggctca

SEQ ID NO: 573982 - DNA, 19 bp, Homo sapiens
catttcaattcctggccct

SEQ ID NO: 573983 - DNA, 16 bp, Homo sapiens
ccaaagagcctttcca

SEQ ID NO: 573984 - DNA, 18 bp, Homo sapiens
ccaactgcctaaggccct

SEQ ID NO: 573985 - DNA, 17 bp, Homo sapiens
ccaagcagtgcctgcct

SEQ ID NO: 573986 - DNA, 14 bp, Homo sapiens
ccactctgcctgcc

SEQ ID NO: 573987 - DNA, 15 bp, Homo sapiens
ccactctgcctgcct

SEQ ID NO: 573988 - DNA, 11 bp, Homo sapiens
ccactgccatg

SEQ ID NO: 573989 - DNA, 21 bp, Homo sapiens
ccagcacggtgactctgtcca

SEQ ID NO: 573990 - DNA, 16 bp, Homo sapiens
ccaggagaagggctgg

SEQ ID NO: 573991 - DNA, 23 bp, Homo sapiens
ccaggaggccctggtcctggcct

SEQ ID NO: 573992 - DNA, 14 bp, Homo sapiens
ccaggggcgaggcc

SEQ ID NO: 573993 - DNA, 21 bp, Homo sapiens
ccatgcaccaggactggctgt

SEQ ID NO: 573994 - DNA, 19 bp, Homo sapiens
cccacatgtggccatggcc

SEQ ID NO: 573995 - DNA, 16 bp, Homo sapiens
cccactctgcctgcct

SEQ ID NO: 573996 - DNA, 22 bp, Homo sapiens
cccactgccaggggttcttgag

SEQ ID NO: 573997 - DNA, 16 bp, Homo sapiens
cccacttctgtgccac

SEQ ID NO: 573998 - DNA, 16 bp, Homo sapiens
cccctcggctctggag

SEQ ID NO: 573999 - DNA, 17 bp, Homo sapiens
cccctgctgtctctctg

SEQ ID NO: 574000 - DNA, 19 bp, Homo sapiens
cccctgctgtctctctggg

SEQ ID NO: 574001 - DNA, 11 bp, Homo sapiens
cccgcctgcct

SEQ ID NO: 574002 - DNA, 16 bp, Homo sapiens
cccgcctgcctgccac

SEQ ID NO: 574003 - DNA, 13 bp, Homo sapiens
cccggtgctccct

SEQ ID NO: 574004 - DNA, 16 bp, Homo sapiens
cccggtgctccctctg

SEQ ID NO: 574005 - DNA, 20 bp, Homo sapiens
ccctcctggagctctgtggg

SEQ ID NO: 574006 - DNA, 15 bp, Homo sapiens
ccctctgtcatcctc

SEQ ID NO: 574007 - DNA, 17 bp, Homo sapiens
ccctgttctcctcccca

SEQ ID NO: 574008 - DNA, 14 bp, Homo sapiens
cccttcctctttgg

SEQ ID NO: 574009 - DNA, 21 bp, Homo sapiens
tgagccagccaggccctgcca

SEQ ID NO: 574010 - DNA, 17 bp, Homo sapiens
tgcagaggcctggggga

SEQ ID NO: 574011 - DNA, 13 bp, Homo sapiens
tgcccaaggccac

SEQ ID NO: 574012 - DNA, 22 bp, Homo sapiens
tgccccacatgtggccatggcc

SEQ ID NO: 574013 - DNA, 15 bp, Homo sapiens
tgcccgctcagccca

SEQ ID NO: 574014 - DNA, 20 bp, Homo sapiens
tgccgagacagaccctctgc

SEQ ID NO: 574015 - DNA, 14 bp, Homo sapiens
tgctccctctgtca

SEQ ID NO: 574016 - DNA, 16 bp, Homo sapiens
tgctgtctctctgggc

SEQ ID NO: 574017 - DNA, 21 bp, Homo sapiens
tgctgttggtcctctctctgt

SEQ ID NO: 574018 - DNA, 16 bp, Homo sapiens
tggaggcagatgtggg

SEQ ID NO: 574019 - DNA, 17 bp, Homo sapiens
tggattctccctgggcc

SEQ ID NO: 574020 - DNA, 18 bp, Homo sapiens
tggcagattcccactgcc

SEQ ID NO: 574021 - DNA, 21 bp, Homo sapiens
tggcaggacacacatggtgag

SEQ ID NO: 574022 - DNA, 18 bp, Homo sapiens
tggcatggaaggggcttc

SEQ ID NO: 574023 - DNA, 21 bp, Homo sapiens
tggcatttcaattcctggccc

SEQ ID NO: 574024 - DNA, 23 bp, Homo sapiens
tggcatttcaattcctggccctg

SEQ ID NO: 574025 - DNA, 15 bp, Homo sapiens
tggccccgcctgcct

SEQ ID NO: 574026 - DNA, 21 bp, Homo sapiens
tggcccctgctgtctctctgg

SEQ ID NO: 574027 - DNA, 18 bp, Homo sapiens
tggcccctgtctcggggc

SEQ ID NO: 574028 - DNA, 19 bp, Homo sapiens
tggccctgttctcctcccc

SEQ ID NO: 574029 - DNA, 11 bp, Homo sapiens
tggctctgggc

SEQ ID NO: 574030 - DNA, 23 bp, Homo sapiens
tgggcccctggccccgcctgcct

SEQ ID NO: 574031 - DNA, 15 bp, Homo sapiens
tgggccgggcctggg

SEQ ID NO: 574032 - DNA, 20 bp, Homo sapiens
tgggctgcagagtctgcccc

SEQ ID NO: 574033 - DNA, 16 bp, Homo sapiens
tggtccaggccctgtg

SEQ ID NO: 574034 - DNA, 19 bp, Homo sapiens
tggtccaggccctgtggca

SEQ ID NO: 574035 - DNA, 16 bp, Homo sapiens
tggtcctctctctgtg

SEQ ID NO: 574036 - DNA, 22 bp, Homo sapiens
tggtcctctctctgtggggctg

SEQ ID NO: 574037 - DNA, 19 bp, Homo sapiens
tggtgagcctagccctggg

SEQ ID NO: 574038 - DNA, 20 bp, Homo sapiens
tggtgagcctagccctggga

SEQ ID NO: 574039 - DNA, 10 bp, Homo sapiens
tggtggcatg

SEQ ID NO: 574040 - DNA, 15 bp, Homo sapiens
tggtggcatggaagg

SEQ ID NO: 574041 - DNA, 17 bp, Homo sapiens
tgtccagctcccgctgt

SEQ ID NO: 574042 - DNA, 17 bp, Homo sapiens
tgtcttaatactgtcct

SEQ ID NO: 574043 - DNA, 17 bp, Homo sapiens
tgtggggctgagctggg

SEQ ID NO: 574044 - DNA, 18 bp, Homo sapiens
tgtggtggattctccctg

SEQ ID NO: 574045 - DNA, 14 bp, Homo sapiens
tgttctcctcccca

SEQ ID NO: 574046 - DNA, 18 bp, Homo sapiens
ttacccactgccatgcac

SEQ ID NO: 574047 - DNA, 19 bp, Homo sapiens
ttattacccaagtcttctc

SEQ ID NO: 574048 - DNA, 20 bp, Homo sapiens
ttgccccactctgcctgcct

SEQ ID NO: 574049 - DNA, 15 bp, Homo sapiens
ttggtcctctctctg

SEQ ID NO: 574050 - DNA, 11 bp, Homo sapiens
tttccaaagag

SEQ ID NO: 574051 - DNA, 19 bp, Homo sapiens
tgagggtgcccttttccag

SEQ ID NO: 574052 - DNA, 18 bp, Homo sapiens
tgcaccaggactggctgt

SEQ ID NO: 574053 - DNA, 18 bp, Homo sapiens
tgccccacatgtggccat

SEQ ID NO: 574054 - DNA, 15 bp, Homo sapiens
tgccccactctgcct

SEQ ID NO: 574055 - DNA, 20 bp, Homo sapiens
tgcctgctgttggtcctctc

SEQ ID NO: 574056 - DNA, 17 bp, Homo sapiens
tgctgttggtcctctct

SEQ ID NO: 574057 - DNA, 20 bp, Homo sapiens
tggaggcagatgtggggctg

SEQ ID NO: 574058 - DNA, 18 bp, Homo sapiens
tggatcctgggctgggtg

SEQ ID NO: 574059 - DNA, 19 bp, Homo sapiens
tggatcctgggctgggtgg

SEQ ID NO: 574060 - DNA, 13 bp, Homo sapiens
tggcatcttgcca

SEQ ID NO: 574061 - DNA, 16 bp, Homo sapiens
tggcatggaaggggct

SEQ ID NO: 574062 - DNA, 14 bp, Homo sapiens
tggccaaagagcct

SEQ ID NO: 574063 - DNA, 20 bp, Homo sapiens
tggccaaagagcctttccaa

SEQ ID NO: 574064 - DNA, 14 bp, Homo sapiens
tggccatggcctct

SEQ ID NO: 574065 - DNA, 16 bp, Homo sapiens
tggccatggcctctgc

SEQ ID NO: 574066 - DNA, 17 bp, Homo sapiens
tggccatggcctctgca

SEQ ID NO: 574067 - DNA, 16 bp, Homo sapiens
tggccccgcctgcctg

SEQ ID NO: 574068 - DNA, 20 bp, Homo sapiens
tggcccctgctgtctctctg

SEQ ID NO: 574069 - DNA, 22 bp, Homo sapiens
tggcccctgctgtctctctggg

SEQ ID NO: 574070 - DNA, 17 bp, Homo sapiens
tggccgcacgcctctcc

SEQ ID NO: 574071 - DNA, 19 bp, Homo sapiens
tggccgcacgcctctccct

SEQ ID NO: 574072 - DNA, 18 bp, Homo sapiens
tggcctgatgatggtggg

SEQ ID NO: 574073 - DNA, 21 bp, Homo sapiens
tgggaacagcatggaggcaga

SEQ ID NO: 574074 - DNA, 23 bp, Homo sapiens
tgggacatcaggagactgggctc

SEQ ID NO: 574075 - DNA, 17 bp, Homo sapiens
tgggcagcacaaggcct

SEQ ID NO: 574076 - DNA, 14 bp, Homo sapiens
tgggctctggctct

SEQ ID NO: 574077 - DNA, 16 bp, Homo sapiens
tgggctgcagagtctg

SEQ ID NO: 574078 - DNA, 15 bp, Homo sapiens
tggggctgagctggg

SEQ ID NO: 574079 - DNA, 12 bp, Homo sapiens
tgggtctctgga

SEQ ID NO: 574080 - DNA, 15 bp, Homo sapiens
tggtcctctctctgt

SEQ ID NO: 574081 - DNA, 17 bp, Homo sapiens
tgtaaaggggcagctga

SEQ ID NO: 574082 - DNA, 17 bp, Homo sapiens
tgtcgagagctggccaa

SEQ ID NO: 574083 - DNA, 12 bp, Homo sapiens
tgtctctctggg

SEQ ID NO: 574084 - DNA, 13 bp, Homo sapiens
tgtctctctgggc

SEQ ID NO: 574085 - DNA, 14 bp, Homo sapiens
tgtggccatggcct

SEQ ID NO: 574086 - DNA, 18 bp, Homo sapiens
tgttggtcctctctctgt

SEQ ID NO: 574087 - DNA, 21 bp, Homo sapiens
tgtttgaccttcagagccagc

SEQ ID NO: 574088 - DNA, 17 bp, Homo sapiens
ttacccaagtcttctcc

SEQ ID NO: 574089 - DNA, 15 bp, Homo sapiens
ttcaattcctggccc

SEQ ID NO: 574090 - DNA, 16 bp, Homo sapiens
ttcaccatggccccct

SEQ ID NO: 574091 - DNA, 22 bp, Homo sapiens
ttccccacttctgtgccacccc

SEQ ID NO: 574092 - DNA, 14 bp, Homo sapiens
cagattcccactgc

SEQ ID NO: 574093 - DNA, 18 bp, Homo sapiens
cagcacaaggccttgcct

SEQ ID NO: 574094 - DNA, 15 bp, Homo sapiens
cagccaggccctgcc

SEQ ID NO: 574095 - DNA, 15 bp, Homo sapiens
cagctcccgctgtgg

SEQ ID NO: 574096 - DNA, 13 bp, Homo sapiens
caggactggctgt

SEQ ID NO: 574097 - DNA, 16 bp, Homo sapiens
caggagactgggctct

SEQ ID NO: 574098 - DNA, 21 bp, Homo sapiens
caggaggccctggtcctggcc

SEQ ID NO: 574099 - DNA, 15 bp, Homo sapiens
cagtcaaatctgggc

SEQ ID NO: 574100 - DNA, 17 bp, Homo sapiens
cagtcaaatctgggctc

SEQ ID NO: 574101 - DNA, 22 bp, Homo sapiens
catcttgccaagggtccctgtg

SEQ ID NO: 574102 - DNA, 18 bp, Homo sapiens
catgtggccatggcctct

SEQ ID NO: 574103 - DNA, 14 bp, Homo sapiens
cattcccactgcca

SEQ ID NO: 574104 - DNA, 18 bp, Homo sapiens
catttcaattcctggccc

SEQ ID NO: 574105 - DNA, 15 bp, Homo sapiens
catttcaccatggcc

SEQ ID NO: 574106 - DNA, 18 bp, Homo sapiens
ccaagagtccaggaggcc

SEQ ID NO: 574107 - DNA, 15 bp, Homo sapiens
ccagccaggccctgc

SEQ ID NO: 574108 - DNA, 13 bp, Homo sapiens
ccagcctcagcct

SEQ ID NO: 574109 - DNA, 18 bp, Homo sapiens
ccagctcccgctgtggcc

SEQ ID NO: 574110 - DNA, 19 bp, Homo sapiens
ccaggagaagggctggggc

SEQ ID NO: 574111 - DNA, 17 bp, Homo sapiens
ccaggccctgtggcagg

SEQ ID NO: 574112 - DNA, 16 bp, Homo sapiens
ccagtcaaatctgggc

SEQ ID NO: 574113 - DNA, 20 bp, Homo sapiens
ccatgcaccaggactggctg

SEQ ID NO: 574114 - DNA, 14 bp, Homo sapiens
ccccactctgcctg

SEQ ID NO: 574115 - DNA, 17 bp, Homo sapiens
cccctcggctctggagg

SEQ ID NO: 574116 - DNA, 17 bp, Homo sapiens
cccctggctctgggccg

SEQ ID NO: 574117 - DNA, 22 bp, Homo sapiens
cccgtactttgtcccgtggcat

SEQ ID NO: 574118 - DNA, 17 bp, Homo sapiens
ccctgcactccctcctg

SEQ ID NO: 574119 - DNA, 15 bp, Homo sapiens
ccctgccccttgcca

SEQ ID NO: 574120 - DNA, 17 bp, Homo sapiens
ccctgctgtctctctgg

SEQ ID NO: 574121 - DNA, 18 bp, Homo sapiens
ccctgctgtctctctggg

SEQ ID NO: 574122 - DNA, 20 bp, Homo sapiens
ccctgctgtctctctgggct

SEQ ID NO: 574123 - DNA, 22 bp, Homo sapiens
ccctgctgtctctctgggctgc

SEQ ID NO: 574124 - DNA, 23 bp, Homo sapiens
ccctgggacatcaggagactggg

SEQ ID NO: 574125 - DNA, 17 bp, Homo sapiens
ccctggtcctggcctcc

SEQ ID NO: 574126 - DNA, 16 bp, Homo sapiens
cccttttccagcctca

SEQ ID NO: 574127 - DNA, 23 bp, Homo sapiens
ccgctgcttccaggctgggcagc

SEQ ID NO: 574128 - DNA, 21 bp, Homo sapiens
ccgctgtggccgcacgcctct

SEQ ID NO: 574129 - DNA, 22 bp, Homo sapiens
ccggtctatgtcgagagctggc

SEQ ID NO: 574130 - DNA, 15 bp, Homo sapiens
cctagccctgggaca

SEQ ID NO: 574131 - DNA, 22 bp, Homo sapiens
cctctccctgcactccctcctg

SEQ ID NO: 574132 - DNA, 13 bp, Homo sapiens
cctctctctgtgg

SEQ ID NO: 574133 - DNA, 23 bp, Homo sapiens
cctctgccgctgcttccaggctg

SEQ ID NO: 574134 - DNA, 15 bp, Homo sapiens
cctgctgtctctctg

SEQ ID NO: 574135 - DNA, 18 bp, Homo sapiens
cctgctgtctctctgggc

SEQ ID NO: 574136 - DNA, 22 bp, Homo sapiens
cctgctgttggtcctctctctg

SEQ ID NO: 574137 - DNA, 23 bp, Homo sapiens
cctgctgttggtcctctctctgt

SEQ ID NO: 574138 - DNA, 14 bp, Homo sapiens
cctggagctctgtg

SEQ ID NO: 574139 - DNA, 22 bp, Homo sapiens
cctggccccgcctgcctgccac

SEQ ID NO: 574140 - DNA, 11 bp, Homo sapiens
cctggcctcct

SEQ ID NO: 574141 - DNA, 14 bp, Homo sapiens
cctgggctgggtgg

SEQ ID NO: 574142 - DNA, 20 bp, Homo sapiens
cctgggggacccctggctct

SEQ ID NO: 574143 - DNA, 15 bp, Homo sapiens
cctggtcctggcctc

SEQ ID NO: 574144 - DNA, 20 bp, Homo sapiens
cctgtctcggggcttgcccc

SEQ ID NO: 574145 - DNA, 14 bp, Homo sapiens
cctgtgtgtgtgta

SEQ ID NO: 574146 - DNA, 18 bp, Homo sapiens
ccttgccatccattctgg

SEQ ID NO: 574147 - DNA, 12 bp, Homo sapiens
ccttgcctggcc

SEQ ID NO: 574148 - DNA, 16 bp, Homo sapiens
cctttaactcatgagg

SEQ ID NO: 574149 - DNA, 12 bp, Homo sapiens
cctttccaaaga

SEQ ID NO: 574150 - DNA, 13 bp, Homo sapiens
cctttccaaagag

SEQ ID NO: 574151 - DNA, 23 bp, Homo sapiens
cgagatggcagattcccactgcc

SEQ ID NO: 574152 - DNA, 22 bp, Homo sapiens
cgagcccctcggctctggaggc

SEQ ID NO: 574153 - DNA, 22 bp, Homo sapiens
cgagctctcaaatccctctcca

SEQ ID NO: 574154 - DNA, 17 bp, Homo sapiens
cgctgcttccaggctgg

SEQ ID NO: 574155 - DNA, 17 bp, Homo sapiens
cgtgttacccactgcca

SEQ ID NO: 574156 - DNA, 13 bp, Homo sapiens
ctagccctgggac

SEQ ID NO: 574157 - DNA, 19 bp, Homo sapiens
ctcagctctggtccaggcc

SEQ ID NO: 574158 - DNA, 22 bp, Homo sapiens
ctcagctctggtccaggccctg

SEQ ID NO: 574159 - DNA, 22 bp, Homo sapiens
ctccctgcactccctcctggag

SEQ ID NO: 574160 - DNA, 10 bp, Homo sapiens
ctccctgggc

SEQ ID NO: 574161 - DNA, 11 bp, Homo sapiens
ctccctgggcc

SEQ ID NO: 574162 - DNA, 19 bp, Homo sapiens
ctcctggagctctgtgggt

SEQ ID NO: 574163 - DNA, 18 bp, Homo sapiens
ctcggcttggatcctggg

SEQ ID NO: 574164 - DNA, 13 bp, Homo sapiens
ctctccctgcact

SEQ ID NO: 574165 - DNA, 14 bp, Homo sapiens
ctctctctgtgggg

SEQ ID NO: 574166 - DNA, 15 bp, Homo sapiens
ctctctgtggggctg

SEQ ID NO: 574167 - DNA, 23 bp, Homo sapiens
ctctctgtggggctgaattgcca

SEQ ID NO: 574168 - DNA, 21 bp, Homo sapiens
ctctgggccgggcctggggct

SEQ ID NO: 574169 - DNA, 18 bp, Homo sapiens
ctctgtgggtctctggaa

SEQ ID NO: 574170 - DNA, 12 bp, Homo sapiens
ctgagctgggga

SEQ ID NO: 574171 - DNA, 13 bp, Homo sapiens
ctgagggaccctt

SEQ ID NO: 574172 - DNA, 21 bp, Homo sapiens
ctgcactccctcctggagctc

SEQ ID NO: 574173 - DNA, 18 bp, Homo sapiens
ctgcagagtctgccccac

SEQ ID NO: 574174 - DNA, 19 bp, Homo sapiens
ctgcctaaggccctttgtg

SEQ ID NO: 574175 - DNA, 14 bp, Homo sapiens
ctgctcagctctgg

SEQ ID NO: 574176 - DNA, 23 bp, Homo sapiens
ctgctcagctctggtccaggccc

SEQ ID NO: 574177 - DNA, 11 bp, Homo sapiens
ctgctgtctct

SEQ ID NO: 574178 - DNA, 19 bp, Homo sapiens
ctgctgtctctctgggctg

SEQ ID NO: 574179 - DNA, 23 bp, Homo sapiens
ctgctgttggtcctctctctgtg

SEQ ID NO: 574180 - DNA, 20 bp, Homo sapiens
ctggacctagggtggcctga

SEQ ID NO: 574181 - DNA, 23 bp, Homo sapiens
ctggagctctgtgggtctctgga

SEQ ID NO: 574182 - DNA, 21 bp, Homo sapiens
ctggccaaagagcctttccaa

SEQ ID NO: 574183 - DNA, 14 bp, Homo sapiens
ctggccccgcctgc

SEQ ID NO: 574184 - DNA, 15 bp, Homo sapiens
ctggccccgcctgcc

SEQ ID NO: 574185 - DNA, 12 bp, Homo sapiens
ctggctctgggc

SEQ ID NO: 574186 - DNA, 19 bp, Homo sapiens
ctgggacatcaggagactg

SEQ ID NO: 574187 - DNA, 21 bp, Homo sapiens
ctgggcagcacaaggccttgc

SEQ ID NO: 574188 - DNA, 20 bp, Homo sapiens
ctgggcctcagtgtgcccat

SEQ ID NO: 574189 - DNA, 21 bp, Homo sapiens
ctgggggacccctggctctgg

SEQ ID NO: 574190 - DNA, 23 bp, Homo sapiens
ctgggggacccctggctctgggc

SEQ ID NO: 574191 - DNA, 17 bp, Homo sapiens
ctgtaggcagaggctgc

SEQ ID NO: 574192 - DNA, 14 bp, Homo sapiens
ctgtctctctgggc

SEQ ID NO: 574193 - DNA, 16 bp, Homo sapiens
ctgtctctctgggctg

SEQ ID NO: 574194 - DNA, 16 bp, Homo sapiens
ctgtgtaaccttgggt

SEQ ID NO: 574195 - DNA, 18 bp, Homo sapiens
ctgtgtaaccttgggtgg

SEQ ID NO: 574196 - DNA, 17 bp, Homo sapiens
cttcaatcggcttgtgg

SEQ ID NO: 574197 - DNA, 17 bp, Homo sapiens
gaactccttccccactt

SEQ ID NO: 574198 - DNA, 23 bp, Homo sapiens
gaagggctggggccggggctgag

SEQ ID NO: 574199 - DNA, 13 bp, Homo sapiens
gacccctggctct

SEQ ID NO: 574200 - DNA, 16 bp, Homo sapiens
gacccctggctctggg

SEQ ID NO: 574201 - DNA, 18 bp, Homo sapiens
gaccttcagagccagccg

SEQ ID NO: 574202 - DNA, 20 bp, Homo sapiens
gacgtgttacccactgccat

SEQ ID NO: 574203 - DNA, 22 bp, Homo sapiens
gactatgcagaggcctggggga

SEQ ID NO: 574204 - DNA, 16 bp, Homo sapiens
gactctgtccagctcc

SEQ ID NO: 574205 - DNA, 22 bp, Homo sapiens
aacatgttgtacatttcaccat

SEQ ID NO: 574206 - DNA, 12 bp, Homo sapiens
aacattcccact

SEQ ID NO: 574207 - DNA, 16 bp, Homo sapiens
aactgctcagctctgg

SEQ ID NO: 574208 - DNA, 21 bp, Homo sapiens
acatcaggagactgggctctg

SEQ ID NO: 574209 - DNA, 19 bp, Homo sapiens
acatgtggccatggcctct

SEQ ID NO: 574210 - DNA, 20 bp, Homo sapiens
acatttcaccatggccccct

SEQ ID NO: 574211 - DNA, 23 bp, Homo sapiens
accaggagaagggctggggccgg

SEQ ID NO: 574212 - DNA, 15 bp, Homo sapiens
acccctggctctggg

SEQ ID NO: 574213 - DNA, 17 bp, Homo sapiens
accttcagagccagccg

SEQ ID NO: 574214 - DNA, 19 bp, Homo sapiens
acggtgactctgtccagct

SEQ ID NO: 574215 - DNA, 16 bp, Homo sapiens
actgggacagcccagg

SEQ ID NO: 574216 - DNA, 14 bp, Homo sapiens
actgggctctggct

SEQ ID NO: 574217 - DNA, 14 bp, Homo sapiens
agacagaccctctg

SEQ ID NO: 574218 - DNA, 22 bp, Homo sapiens
agaggacgtgttacccactgcc

SEQ ID NO: 574219 - DNA, 21 bp, Homo sapiens
agaggcctgggggacccctgg

SEQ ID NO: 574220 - DNA, 22 bp, Homo sapiens
agaggcctgggggacccctggc

SEQ ID NO: 574221 - DNA, 15 bp, Homo sapiens
agagtggaggcgggc

SEQ ID NO: 574222 - DNA, 22 bp, Homo sapiens
agcacaaggccttgcctggcct

SEQ ID NO: 574223 - DNA, 16 bp, Homo sapiens
agcctagccctgggac

SEQ ID NO: 574224 - DNA, 18 bp, Homo sapiens
agcgatgggcccctggcc

SEQ ID NO: 574225 - DNA, 21 bp, Homo sapiens
agctggccaaagagcctttcc

SEQ ID NO: 574226 - DNA, 13 bp, Homo sapiens
aggcagaggctgc

SEQ ID NO: 574227 - DNA, 18 bp, Homo sapiens
aggcagatgtggggctga

SEQ ID NO: 574228 - DNA, 21 bp, Homo sapiens
aggcatcatggaaagactggg

SEQ ID NO: 574229 - DNA, 21 bp, Homo sapiens
aggccaagcagtgcctgccta

SEQ ID NO: 574230 - DNA, 23 bp, Homo sapiens
aggcctgggggacccctggctct

SEQ ID NO: 574231 - DNA, 19 bp, Homo sapiens
agtccaggaggccctggtc

SEQ ID NO: 574232 - DNA, 19 bp, Homo sapiens
agtggggaaggaggccaag

SEQ ID NO: 574233 - DNA, 15 bp, Homo sapiens
atgcagaggcctggg

SEQ ID NO: 574234 - DNA, 18 bp, Homo sapiens
atgcagaggcctggggga

SEQ ID NO: 574235 - DNA, 13 bp, Homo sapiens
atgtggggctgag

SEQ ID NO: 574236 - DNA, 14 bp, Homo sapiens
attcccactgccag

SEQ ID NO: 574237 - DNA, 15 bp, Homo sapiens
attcccactgccagg

SEQ ID NO: 574238 - DNA, 12 bp, Homo sapiens
attctccctggg

SEQ ID NO: 574239 - DNA, 16 bp, Homo sapiens
attctccctgggcctc

SEQ ID NO: 574240 - DNA, 17 bp, Homo sapiens
caaagagcctttccaaa

SEQ ID NO: 574241 - DNA, 14 bp, Homo sapiens
caattcctggccct

SEQ ID NO: 574242 - DNA, 16 bp, Homo sapiens
caattcctggccctgt

SEQ ID NO: 574243 - DNA, 16 bp, Homo sapiens
caccaggactggctgt

SEQ ID NO: 574244 - DNA, 13 bp, Homo sapiens
cactccctcctgg

SEQ ID NO: 574245 - DNA, 12 bp, Homo sapiens
cactctgcctgc

SEQ ID NO: 574246 - DNA, 13 bp, Homo sapiens
cactctgcctgcc

SEQ ID NO: 574247 - DNA, 14 bp, Homo sapiens
cactctgcctgcct

SEQ ID NO: 574248 - DNA, 15 bp, Homo sapiens
cactctgcctgcctg

SEQ ID NO: 574249 - DNA, 22 bp, Homo sapiens
cagacatagaagagccaagagt

SEQ ID NO: 574250 - DNA, 15 bp, Homo sapiens
cagaggcctggggga

SEQ ID NO: 574251 - DNA, 23 bp, Homo sapiens
cagaggcctgggggacccctggc

SEQ ID NO: 574252 - DNA, 23 bp, Homo sapiens
cagatgtggggctgagctgggga

SEQ ID NO: 574253 - DNA, 20 bp, Homo sapiens
cagctcccgctgtggccgca

SEQ ID NO: 574254 - DNA, 20 bp, Homo sapiens
cagctctggtccaggccctg

SEQ ID NO: 574255 - DNA, 23 bp, Homo sapiens
cagctctggtccaggccctgtgg

SEQ ID NO: 574256 - DNA, 22 bp, Homo sapiens
caggaaacaaggggtctgagga

SEQ ID NO: 574257 - DNA, 19 bp, Homo sapiens
caggagaagggctggggcc

SEQ ID NO: 574258 - DNA, 20 bp, Homo sapiens
caggaggccctggtcctggc

SEQ ID NO: 574259 - DNA, 14 bp, Homo sapiens
tgggtctctggaag

SEQ ID NO: 574260 - DNA, 14 bp, Homo sapiens
tggtcctctctctg

SEQ ID NO: 574261 - DNA, 21 bp, Homo sapiens
tgtcgagagctggccaaagag

SEQ ID NO: 574262 - DNA, 12 bp, Homo sapiens
tgtgacatgccc

SEQ ID NO: 574263 - DNA, 17 bp, Homo sapiens
tgtggccatggcctctg

SEQ ID NO: 574264 - DNA, 12 bp, Homo sapiens
ttcaccatggcc

SEQ ID NO: 574265 - DNA, 22 bp, Homo sapiens
ttcgagatcatcacttccttgc

SEQ ID NO: 574266 - DNA, 17 bp, Homo sapiens
ttgccatccattctgga

SEQ ID NO: 574267 - DNA, 15 bp, Homo sapiens
ttgccccactctgcc

SEQ ID NO: 574268 - DNA, 11 bp, Homo sapiens
ttgcctggcct

SEQ ID NO: 574269 - DNA, 23 bp, Homo sapiens
gtggcccctgctgtctctctggg

SEQ ID NO: 574270 - DNA, 15 bp, Homo sapiens
gtggggctgagctgg

SEQ ID NO: 574271 - DNA, 15 bp, Homo sapiens
ctgtaggcagaggct

SEQ ID NO: 574272 - DNA, 12 bp, Homo sapiens
ctgtctctctgg

SEQ ID NO: 574273 - DNA, 13 bp, Homo sapiens
ctgtctctctggg

SEQ ID NO: 574274 - DNA, 15 bp, Homo sapiens
ctgtgggtctctgga

SEQ ID NO: 574275 - DNA, 15 bp, Homo sapiens
ctgtgtaaccttggg

SEQ ID NO: 574276 - DNA, 21 bp, Homo sapiens
cttcaatcggcttgtgggtga

SEQ ID NO: 574277 - DNA, 21 bp, Homo sapiens
cttctcggcttggatcctggg

SEQ ID NO: 574278 - DNA, 14 bp, Homo sapiens
cttctgtgccaccc

SEQ ID NO: 574279 - DNA, 20 bp, Homo sapiens
cttgccaagggtccctgtgt

SEQ ID NO: 574280 - DNA, 21 bp, Homo sapiens
cttgccaagggtccctgtgtg

SEQ ID NO: 574281 - DNA, 12 bp, Homo sapiens
gaagaggaacca

SEQ ID NO: 574282 - DNA, 23 bp, Homo sapiens
gaattgccaggggcgaggccctt

SEQ ID NO: 574283 - DNA, 14 bp, Homo sapiens
gacagaccctctgc

SEQ ID NO: 574284 - DNA, 19 bp, Homo sapiens
gacatagaagagccaagag

SEQ ID NO: 574285 - DNA, 16 bp, Homo sapiens
gacatcaggagactgg

SEQ ID NO: 574286 - DNA, 15 bp, Homo sapiens
gagaagggctggggc

SEQ ID NO: 574287 - DNA, 16 bp, Homo sapiens
gagactgggctctggc

SEQ ID NO: 574288 - DNA, 22 bp, Homo sapiens
gagagggcggtgggtatgcgag

SEQ ID NO: 574289 - DNA, 16 bp, Homo sapiens
gagcagttcagagtgg

SEQ ID NO: 574290 - DNA, 15 bp, Homo sapiens
gagcccctcggctct

SEQ ID NO: 574291 - DNA, 13 bp, Homo sapiens
gagcctttccaaa

SEQ ID NO: 574292 - DNA, 19 bp, Homo sapiens
gagctctgtgggtctctgg

SEQ ID NO: 574293 - DNA, 20 bp, Homo sapiens
gagctggccaaagagccttt

SEQ ID NO: 574294 - DNA, 12 bp, Homo sapiens
gaggcccttcct

SEQ ID NO: 574295 - DNA, 21 bp, Homo sapiens
gatgactatgcagaggcctgg

SEQ ID NO: 574296 - DNA, 17 bp, Homo sapiens
gatgggcccctggcccc

SEQ ID NO: 574297 - DNA, 13 bp, Homo sapiens
gatgtggggctga

SEQ ID NO: 574298 - DNA, 13 bp, Homo sapiens
gattctccctggg

SEQ ID NO: 574299 - DNA, 20 bp, Homo sapiens
gcagacatagaagagccaag

SEQ ID NO: 574300 - DNA, 21 bp, Homo sapiens
gcatcatggaaagactgggac

SEQ ID NO: 574301 - DNA, 17 bp, Homo sapiens
gcatttcaattcctggc

SEQ ID NO: 574302 - DNA, 16 bp, Homo sapiens
gccaaagagcctttcc

SEQ ID NO: 574303 - DNA, 22 bp, Homo sapiens
gccatgcaccaggactggctgt

SEQ ID NO: 574304 - DNA, 21 bp, Homo sapiens
gcccagacttgcggggggtgg

SEQ ID NO: 574305 - DNA, 14 bp, Homo sapiens
gccccactctgcct

SEQ ID NO: 574306 - DNA, 18 bp, Homo sapiens
gccccgcctgcctgccac

SEQ ID NO: 574307 - DNA, 22 bp, Homo sapiens
gcccctggccccgcctgcctgc

SEQ ID NO: 574308 - DNA, 18 bp, Homo sapiens
gccctggtcctggcctcc

SEQ ID NO: 574309 - DNA, 19 bp, Homo sapiens
gccctggtcctggcctcct

SEQ ID NO: 574310 - DNA, 17 bp, Homo sapiens
gccctgttctcctcccc

SEQ ID NO: 574311 - DNA, 16 bp, Homo sapiens
gcccttttccagcctc

SEQ ID NO: 574312 - DNA, 14 bp, Homo sapiens
gccgctgcccgctc

SEQ ID NO: 574313 - DNA, 15 bp, Homo sapiens
gcctagccctgggac

SEQ ID NO: 574314 - DNA, 24 bp, Homo sapiens
gcctctccctgcactccctcctgg

SEQ ID NO: 574315 - DNA, 20 bp, Homo sapiens
gcctgctgttggtcctctct

SEQ ID NO: 574316 - DNA, 21 bp, Homo sapiens
gcctgctgttggtcctctctc

SEQ ID NO: 574317 - DNA, 12 bp, Homo sapiens
gcctggcctgat

SEQ ID NO: 574318 - DNA, 19 bp, Homo sapiens
gcgagcccctcggctctgg

SEQ ID NO: 574319 - DNA, 19 bp, Homo sapiens
gcgaggcccttcctctttg

SEQ ID NO: 574320 - DNA, 22 bp, Homo sapiens
gctcactgaactccttccccac

SEQ ID NO: 574321 - DNA, 14 bp, Homo sapiens
gctcccgctgtggc

SEQ ID NO: 574322 - DNA, 15 bp, Homo sapiens
gctccgaaattccaa

SEQ ID NO: 574323 - DNA, 21 bp, Homo sapiens
gctctgggccgggcctggggc

SEQ ID NO: 574324 - DNA, 21 bp, Homo sapiens
gctgccgagacagaccctctg

SEQ ID NO: 574325 - DNA, 15 bp, Homo sapiens
gctgcttccaggctg

SEQ ID NO: 574326 - DNA, 16 bp, Homo sapiens
gctggccaaagagcct

SEQ ID NO: 574327 - DNA, 17 bp, Homo sapiens
gctggggccggggctga

SEQ ID NO: 574328 - DNA, 17 bp, Homo sapiens
gctgggtggcccctgtc

SEQ ID NO: 574329 - DNA, 16 bp, Homo sapiens
gctgttggtcctctct

SEQ ID NO: 574330 - DNA, 19 bp, Homo sapiens
gctgttggtcctctctctg

SEQ ID NO: 574331 - DNA, 21 bp, Homo sapiens
gcttggaacccggtgctccct

SEQ ID NO: 574332 - DNA, 19 bp, Homo sapiens
gcttggatcctgggctggg

SEQ ID NO: 574333 - DNA, 21 bp, Homo sapiens
ggacacacatggtgagcctag

SEQ ID NO: 574334 - DNA, 21 bp, Homo sapiens
ggagctctgtgggtctctgga

SEQ ID NO: 574335 - DNA, 20 bp, Homo sapiens
ggaggcagatgtggggctga

SEQ ID NO: 574336 - DNA, 16 bp, Homo sapiens
ggcagatgtggggctg

SEQ ID NO: 574337 - DNA, 16 bp, Homo sapiens
ggcagattcccactgc

SEQ ID NO: 574338 - DNA, 17 bp, Homo sapiens
ggccaagcagtgcctgc

SEQ ID NO: 574339 - DNA, 13 bp, Homo sapiens
ggccatggcctct

SEQ ID NO: 574340 - DNA, 21 bp, Homo sapiens
ggcccctgctgtctctctggg

SEQ ID NO: 574341 - DNA, 12 bp, Homo sapiens
ggcccctggccc

SEQ ID NO: 574342 - DNA, 14 bp, Homo sapiens
ggccctgttctcct

SEQ ID NO: 574343 - DNA, 23 bp, Homo sapiens
ggcctctgcaactgctcagctct

SEQ ID NO: 574344 - DNA, 17 bp, Homo sapiens
ggccttgcctggcctga

SEQ ID NO: 574345 - DNA, 20 bp, Homo sapiens
ggctccgaaattccaaggcc

SEQ ID NO: 574346 - DNA, 19 bp, Homo sapiens
ggctgcagagtctgcccca

SEQ ID NO: 574347 - DNA, 19 bp, Homo sapiens
ggctgccgagacagaccct

SEQ ID NO: 574348 - DNA, 23 bp, Homo sapiens
ggcttgccccactctgcctgcct

SEQ ID NO: 574349 - DNA, 19 bp, Homo sapiens
ggcttggatcctgggctgg

SEQ ID NO: 574350 - DNA, 20 bp, Homo sapiens
gggagacagttgagagcggg

SEQ ID NO: 574351 - DNA, 14 bp, Homo sapiens
gggccgggcctggg

SEQ ID NO: 574352 - DNA, 21 bp, Homo sapiens
gggcctcagtgtgcccatctg

SEQ ID NO: 574353 - DNA, 12 bp, Homo sapiens
gggcctggggct

SEQ ID NO: 574354 - DNA, 13 bp, Homo sapiens
gggctctggctct

SEQ ID NO: 574355 - DNA, 16 bp, Homo sapiens
ggggagacagttgaga

SEQ ID NO: 574356 - DNA, 14 bp, Homo sapiens
ggggctgagctggg

SEQ ID NO: 574357 - DNA, 12 bp, Homo sapiens
gggtctctggaa

SEQ ID NO: 574358 - DNA, 14 bp, Homo sapiens
gggtgcccttttcc

SEQ ID NO: 574359 - DNA, 13 bp, Homo sapiens
ggtgactctgtcc

SEQ ID NO: 574360 - DNA, 22 bp, Homo sapiens
ggtggcccctgctgtctctctg

SEQ ID NO: 574361 - DNA, 23 bp, Homo sapiens
ggtggcccctgctgtctctctgg

SEQ ID NO: 574362 - DNA, 18 bp, Homo sapiens
gtacatttcaccatggcc

SEQ ID NO: 574363 - DNA, 15 bp, Homo sapiens
gtaggcagaggctgc

SEQ ID NO: 574364 - DNA, 23 bp, Homo sapiens
gtccagctcccgctgtggccgca

SEQ ID NO: 574365 - DNA, 24 bp, Homo sapiens
gtccagctcccgctgtggccgcac

SEQ ID NO: 574366 - DNA, 12 bp, Homo sapiens
gtcctctctctg

SEQ ID NO: 574367 - DNA, 13 bp, Homo sapiens
gtcctctctctgt

SEQ ID NO: 574368 - DNA, 14 bp, Homo sapiens
gtcctctctctgtg

SEQ ID NO: 574369 - DNA, 21 bp, Homo sapiens
gtcctctctctgtggggctga

SEQ ID NO: 574370 - DNA, 22 bp, Homo sapiens
gtctatgtcgagagctggccaa

SEQ ID NO: 574371 - DNA, 15 bp, Homo sapiens
gtctgccccacatgt

SEQ ID NO: 574372 - DNA, 19 bp, Homo sapiens
gtgacatgcccaaggccac

SEQ ID NO: 574373 - DNA, 16 bp, Homo sapiens
gtgactctgtccagct

SEQ ID NO: 574374 - DNA, 14 bp, Homo sapiens
gtgctccctctgtc

SEQ ID NO: 574375 - DNA, 19 bp, Homo sapiens
gtgctccctctgtcatcct

SEQ ID NO: 574376 - DNA, 14 bp, Homo sapiens
gtggcatggaaggg

SEQ ID NO: 574377 - DNA, 16 bp, Homo sapiens
gtggccatggcctctg

SEQ ID NO: 574378 - DNA, 15 bp, Homo sapiens
catgtggccatggcc

SEQ ID NO: 574379 - DNA, 20 bp, Homo sapiens
catgtggccatggcctctgc

SEQ ID NO: 574380 - DNA, 21 bp, Homo sapiens
catgtggccatggcctctgca

SEQ ID NO: 574381 - DNA, 12 bp, Homo sapiens
cattcccactgc

SEQ ID NO: 574382 - DNA, 16 bp, Homo sapiens
catttcaattcctggc

SEQ ID NO: 574383 - DNA, 18 bp, Homo sapiens
ccaagcagtgcctgccta

SEQ ID NO: 574384 - DNA, 20 bp, Homo sapiens
ccaagcagtgcctgcctatg

SEQ ID NO: 574385 - DNA, 17 bp, Homo sapiens
ccaagtcggcacccttt

SEQ ID NO: 574386 - DNA, 13 bp, Homo sapiens
ccaagtcttctcc

SEQ ID NO: 574387 - DNA, 22 bp, Homo sapiens
ccacggagcagttcagagtgga

SEQ ID NO: 574388 - DNA, 14 bp, Homo sapiens
ccacttctgtgcca

SEQ ID NO: 574389 - DNA, 14 bp, Homo sapiens
ccaggactggctgt

SEQ ID NO: 574390 - DNA, 20 bp, Homo sapiens
ccaggagaagggctggggcc

SEQ ID NO: 574391 - DNA, 14 bp, Homo sapiens
ccaggccctgccag

SEQ ID NO: 574392 - DNA, 17 bp, Homo sapiens
ccagtcaaatctgggct

SEQ ID NO: 574393 - DNA, 14 bp, Homo sapiens
ccatccattctgga

SEQ ID NO: 574394 - DNA, 19 bp, Homo sapiens
ccatctgtaaaggggcagc

SEQ ID NO: 574395 - DNA, 14 bp, Homo sapiens
cccaagtcttctcc

SEQ ID NO: 574396 - DNA, 13 bp, Homo sapiens
ccccacttctgtg

SEQ ID NO: 574397 - DNA, 22 bp, Homo sapiens
ccccctcaaaccctgccctcct

SEQ ID NO: 574398 - DNA, 18 bp, Homo sapiens
cccctgctgtctctctgg

SEQ ID NO: 574399 - DNA, 21 bp, Homo sapiens
cccctgctgtctctctgggct

SEQ ID NO: 574400 - DNA, 16 bp, Homo sapiens
cccctggccccgcctg

SEQ ID NO: 574401 - DNA, 11 bp, Homo sapiens
cccctggctct

SEQ ID NO: 574402 - DNA, 13 bp, Homo sapiens
cccgcctgcctgc

SEQ ID NO: 574403 - DNA, 17 bp, Homo sapiens
cccgctcagcccagctg

SEQ ID NO: 574404 - DNA, 15 bp, Homo sapiens
cccgctgtggccgca

SEQ ID NO: 574405 - DNA, 14 bp, Homo sapiens
cccggtgctccctc

SEQ ID NO: 574406 - DNA, 21 bp, Homo sapiens
ccctcctggagctctgtgggt

SEQ ID NO: 574407 - DNA, 23 bp, Homo sapiens
ccctctccaactgcctaaggccc

SEQ ID NO: 574408 - DNA, 14 bp, Homo sapiens
ccctgctgtctctc

SEQ ID NO: 574409 - DNA, 15 bp, Homo sapiens
ccctgctgtctctct

SEQ ID NO: 574410 - DNA, 18 bp, Homo sapiens
ccctggccccgcctgcct

SEQ ID NO: 574411 - DNA, 16 bp, Homo sapiens
ccctggctctgggccg

SEQ ID NO: 574412 - DNA, 15 bp, Homo sapiens
ccctggtcctggcct

SEQ ID NO: 574413 - DNA, 18 bp, Homo sapiens
ccctggtcctggcctcct

SEQ ID NO: 574414 - DNA, 15 bp, Homo sapiens
cccttcctctttggt

SEQ ID NO: 574415 - DNA, 20 bp, Homo sapiens
ccgagacagaccctctgccg

SEQ ID NO: 574416 - DNA, 15 bp, Homo sapiens
ccgcctgcctgccac

SEQ ID NO: 574417 - DNA, 16 bp, Homo sapiens
ccggtgctccctctgt

SEQ ID NO: 574418 - DNA, 13 bp, Homo sapiens
cctagccctggga

SEQ ID NO: 574419 - DNA, 15 bp, Homo sapiens
cctagggtggcctga

SEQ ID NO: 574420 - DNA, 11 bp, Homo sapiens
cctctctctgt

SEQ ID NO: 574421 - DNA, 16 bp, Homo sapiens
cctctgcaactgctca

SEQ ID NO: 574422 - DNA, 18 bp, Homo sapiens
cctgcactccctcctgga

SEQ ID NO: 574423 - DNA, 20 bp, Homo sapiens
cctgcactccctcctggagc

SEQ ID NO: 574424 - DNA, 16 bp, Homo sapiens
cctgctgtctctctgg

SEQ ID NO: 574425 - DNA, 17 bp, Homo sapiens
cctgctgtctctctggg

SEQ ID NO: 574426 - DNA, 17 bp, Homo sapiens
cctggccccgcctgcct

SEQ ID NO: 574427 - DNA, 23 bp, Homo sapiens
cctggctctgggccgggcctggg

SEQ ID NO: 574428 - DNA, 21 bp, Homo sapiens
cctgggacatcaggagactgg

SEQ ID NO: 574429 - DNA, 23 bp, Homo sapiens
cctgggacatcaggagactgggc

SEQ ID NO: 574430 - DNA, 19 bp, Homo sapiens
cctgggctgggtggcccct

SEQ ID NO: 574431 - DNA, 19 bp, Homo sapiens
cctgggggacccctggctc

SEQ ID NO: 574432 - DNA, 14 bp, Homo sapiens
ccttagacctgagg

SEQ ID NO: 574433 - DNA, 17 bp, Homo sapiens
cgaaattccaaggccca

SEQ ID NO: 574434 - DNA, 15 bp, Homo sapiens
cgagcccctcggctc

SEQ ID NO: 574435 - DNA, 18 bp, Homo sapiens
cgagcccctcggctctgg

SEQ ID NO: 574436 - DNA, 13 bp, Homo sapiens
cgcacgcctctcc

SEQ ID NO: 574437 - DNA, 16 bp, Homo sapiens
cgcacgcctctccctg

SEQ ID NO: 574438 - DNA, 14 bp, Homo sapiens
cgctcactgaactc

SEQ ID NO: 574439 - DNA, 15 bp, Homo sapiens
cgctcagcccagctg

SEQ ID NO: 574440 - DNA, 15 bp, Homo sapiens
cgtgttacccactgc

SEQ ID NO: 574441 - DNA, 17 bp, Homo sapiens
ctatgcagaggcctggg

SEQ ID NO: 574442 - DNA, 16 bp, Homo sapiens
ctatgtcgagagctgg

SEQ ID NO: 574443 - DNA, 17 bp, Homo sapiens
ctatgtcgagagctggc

SEQ ID NO: 574444 - DNA, 19 bp, Homo sapiens
ctcactgaactccttcccc

SEQ ID NO: 574445 - DNA, 22 bp, Homo sapiens
ctcagcctactccgctcactga

SEQ ID NO: 574446 - DNA, 20 bp, Homo sapiens
ctccctgcactccctcctgg

SEQ ID NO: 574447 - DNA, 17 bp, Homo sapiens
ctcctggagctctgtgg

SEQ ID NO: 574448 - DNA, 17 bp, Homo sapiens
ctctctgtggggctgaa

SEQ ID NO: 574449 - DNA, 14 bp, Homo sapiens
ctctgcaactgctc

SEQ ID NO: 574450 - DNA, 13 bp, Homo sapiens
ctctgtggggctg

SEQ ID NO: 574451 - DNA, 16 bp, Homo sapiens
ctctgtgggtctctgg

SEQ ID NO: 574452 - DNA, 17 bp, Homo sapiens
ctgaactccttccccac

SEQ ID NO: 574453 - DNA, 18 bp, Homo sapiens
ctgaactccttccccact

SEQ ID NO: 574454 - DNA, 13 bp, Homo sapiens
ctgagctggggaa

SEQ ID NO: 574455 - DNA, 17 bp, Homo sapiens
ctgcaactgctcagctc

SEQ ID NO: 574456 - DNA, 18 bp, Homo sapiens
ctgcactccctcctggag

SEQ ID NO: 574457 - DNA, 21 bp, Homo sapiens
ctgccaccctgccccttgcca

SEQ ID NO: 574458 - DNA, 21 bp, Homo sapiens
ctgccatgcaccaggactggc

SEQ ID NO: 574459 - DNA, 21 bp, Homo sapiens
ctgccccacatgtggccatgg

SEQ ID NO: 574460 - DNA, 22 bp, Homo sapiens
ctgccgctgcttccaggctggg

SEQ ID NO: 574461 - DNA, 17 bp, Homo sapiens
ctgcctgccaccctgcc

SEQ ID NO: 574462 - DNA, 15 bp, Homo sapiens
ctgctcagctctggt

SEQ ID NO: 574463 - DNA, 17 bp, Homo sapiens
ctgctcagctctggtcc

SEQ ID NO: 574464 - DNA, 14 bp, Homo sapiens
ctgctgtctctctg

SEQ ID NO: 574465 - DNA, 21 bp, Homo sapiens
ctgctgttggtcctctctctg

SEQ ID NO: 574466 - DNA, 22 bp, Homo sapiens
ctgctgttggtcctctctctgt

SEQ ID NO: 574467 - DNA, 19 bp, Homo sapiens
ctggccaaagagcctttcc

SEQ ID NO: 574468 - DNA, 20 bp, Homo sapiens
ctggccaaagagcctttcca

SEQ ID NO: 574469 - DNA, 21 bp, Homo sapiens
ctggccccgcctgcctgccac

SEQ ID NO: 574470 - DNA, 15 bp, Homo sapiens
ctggccctgttctcc

SEQ ID NO: 574471 - DNA, 18 bp, Homo sapiens
ctggctctgttcggcctt

SEQ ID NO: 574472 - DNA, 21 bp, Homo sapiens
ctggctctgttcggcctttgg

SEQ ID NO: 574473 - DNA, 15 bp, Homo sapiens
ctgggacagcccagg

SEQ ID NO: 574474 - DNA, 19 bp, Homo sapiens
cccttgccatccattctgg

SEQ ID NO: 574475 - DNA, 15 bp, Homo sapiens
cccttttccagcctc

SEQ ID NO: 574476 - DNA, 18 bp, Homo sapiens
ccgcacgcctctccctgc

SEQ ID NO: 574477 - DNA, 19 bp, Homo sapiens
ccgctgcttccaggctggg

SEQ ID NO: 574478 - DNA, 14 bp, Homo sapiens
ccgggcctggggct

SEQ ID NO: 574479 - DNA, 11 bp, Homo sapiens
ccggggctgag

SEQ ID NO: 574480 - DNA, 17 bp, Homo sapiens
cctactccgctcactga

SEQ ID NO: 574481 - DNA, 20 bp, Homo sapiens
cctcctggagctctgtgggt

SEQ ID NO: 574482 - DNA, 15 bp, Homo sapiens
cctcggctctggagg

SEQ ID NO: 574483 - DNA, 22 bp, Homo sapiens
cctctgccgctgcttccaggct

SEQ ID NO: 574484 - DNA, 21 bp, Homo sapiens
cctctttggtggcatggaagg

SEQ ID NO: 574485 - DNA, 17 bp, Homo sapiens
cctgcactccctcctgg

SEQ ID NO: 574486 - DNA, 21 bp, Homo sapiens
cctgcactccctcctggagct

SEQ ID NO: 574487 - DNA, 14 bp, Homo sapiens
cctgcctgccaccc

SEQ ID NO: 574488 - DNA, 15 bp, Homo sapiens
cctggagctctgtgg

SEQ ID NO: 574489 - DNA, 15 bp, Homo sapiens
cctggccccgcctgc

SEQ ID NO: 574490 - DNA, 18 bp, Homo sapiens
cctggccccgcctgcctg

SEQ ID NO: 574491 - DNA, 23 bp, Homo sapiens
cctggccctgttctcctccccaa

SEQ ID NO: 574492 - DNA, 17 bp, Homo sapiens
cctggtcctggcctcct

SEQ ID NO: 574493 - DNA, 23 bp, Homo sapiens
cctggtcctggcctccttccccg

SEQ ID NO: 574494 - DNA, 20 bp, Homo sapiens
cctgtaggcagaggctgccg

SEQ ID NO: 574495 - DNA, 13 bp, Homo sapiens
ccttgcctggcct

SEQ ID NO: 574496 - DNA, 15 bp, Homo sapiens
ccttgggtggcccct

SEQ ID NO: 574497 - DNA, 14 bp, Homo sapiens
cgagagctggccaa

SEQ ID NO: 574498 - DNA, 20 bp, Homo sapiens
cgagcccctcggctctggag

SEQ ID NO: 574499 - DNA, 21 bp, Homo sapiens
cgagcccctcggctctggagg

SEQ ID NO: 574500 - DNA, 18 bp, Homo sapiens
cgatgggcccctggcccc

SEQ ID NO: 574501 - DNA, 17 bp, Homo sapiens
cgcctctccctgcactc

SEQ ID NO: 574502 - DNA, 20 bp, Homo sapiens
cgctgcccgctcagcccagc

SEQ ID NO: 574503 - DNA, 15 bp, Homo sapiens
cgctgcttccaggct

SEQ ID NO: 574504 - DNA, 13 bp, Homo sapiens
cggctctggaggc

SEQ ID NO: 574505 - DNA, 18 bp, Homo sapiens
cggcttggatcctgggct

SEQ ID NO: 574506 - DNA, 19 bp, Homo sapiens
cggcttggatcctgggctg

SEQ ID NO: 574507 - DNA, 21 bp, Homo sapiens
cggcttggatcctgggctggg

SEQ ID NO: 574508 - DNA, 17 bp, Homo sapiens
cgggcccagaccggctt

SEQ ID NO: 574509 - DNA, 19 bp, Homo sapiens
cgggcccagaccggcttct

SEQ ID NO: 574510 - DNA, 22 bp, Homo sapiens
cgtggcatttcaattcctggcc

SEQ ID NO: 574511 - DNA, 18 bp, Homo sapiens
ctatgcagaggcctgggg

SEQ ID NO: 574512 - DNA, 13 bp, Homo sapiens
ctcagctctggtc

SEQ ID NO: 574513 - DNA, 19 bp, Homo sapiens
ctccaactgcctaaggccc

SEQ ID NO: 574514 - DNA, 12 bp, Homo sapiens
ctccctcctgga

SEQ ID NO: 574515 - DNA, 15 bp, Homo sapiens
ctccctcctggagct

SEQ ID NO: 574516 - DNA, 20 bp, Homo sapiens
ctccctcctggagctctgtg

SEQ ID NO: 574517 - DNA, 21 bp, Homo sapiens
ctccctcctggagctctgtgg

SEQ ID NO: 574518 - DNA, 12 bp, Homo sapiens
ctccctgggcct

SEQ ID NO: 574519 - DNA, 19 bp, Homo sapiens
ctccgaaattccaaggccc

SEQ ID NO: 574520 - DNA, 17 bp, Homo sapiens
ctccgtcccccaaacat

SEQ ID NO: 574521 - DNA, 19 bp, Homo sapiens
ctccttagacctgagggac

SEQ ID NO: 574522 - DNA, 15 bp, Homo sapiens
ctccttccccacttc

SEQ ID NO: 574523 - DNA, 13 bp, Homo sapiens
ctcggctctggag

SEQ ID NO: 574524 - DNA, 20 bp, Homo sapiens
ctcggcttggatcctgggct

SEQ ID NO: 574525 - DNA, 21 bp, Homo sapiens
ctcggcttggatcctgggctg

SEQ ID NO: 574526 - DNA, 16 bp, Homo sapiens
ctctcaaatccctctc

SEQ ID NO: 574527 - DNA, 22 bp, Homo sapiens
ctctccctgcactccctcctgg

SEQ ID NO: 574528 - DNA, 12 bp, Homo sapiens
ctctctgggctg

SEQ ID NO: 574529 - DNA, 16 bp, Homo sapiens
ctctctgtggggctga

SEQ ID NO: 574530 - DNA, 12 bp, Homo sapiens
ctctgcctgcct

SEQ ID NO: 574531 - DNA, 11 bp, Homo sapiens
ctctggctctg

SEQ ID NO: 574532 - DNA, 20 bp, Homo sapiens
ctctgggccgggcctggggc

SEQ ID NO: 574533 - DNA, 18 bp, Homo sapiens
ctctgttcggcctttggg

SEQ ID NO: 574534 - DNA, 11 bp, Homo sapiens
ctgagctgggg

SEQ ID NO: 574535 - DNA, 22 bp, Homo sapiens
ctgccaccctgccccttgccat

SEQ ID NO: 574536 - DNA, 19 bp, Homo sapiens
ctgccaggggttcttgagc

SEQ ID NO: 574537 - DNA, 21 bp, Homo sapiens
ctgccagtggggaaggaggcc

SEQ ID NO: 574538 - DNA, 21 bp, Homo sapiens
ctgccgagacagaccctctgc

SEQ ID NO: 574539 - DNA, 19 bp, Homo sapiens
ctgccgctgcttccaggct

SEQ ID NO: 574540 - DNA, 18 bp, Homo sapiens
ctgctcagctctggtcca

SEQ ID NO: 574541 - DNA, 15 bp, Homo sapiens
ctgctgtctctctgg

SEQ ID NO: 574542 - DNA, 16 bp, Homo sapiens
ctgctgtctctctggg

SEQ ID NO: 574543 - DNA, 15 bp, Homo sapiens
ctgcttccaggctgg

SEQ ID NO: 574544 - DNA, 19 bp, Homo sapiens
ctggacctagggtggcctg

SEQ ID NO: 574545 - DNA, 15 bp, Homo sapiens
ctggagctctgtggg

SEQ ID NO: 574546 - DNA, 16 bp, Homo sapiens
ctggagctctgtgggt

SEQ ID NO: 574547 - DNA, 16 bp, Homo sapiens
ctggccccgcctgcct

SEQ ID NO: 574548 - DNA, 15 bp, Homo sapiens
ctggcctccttcccc

SEQ ID NO: 574549 - DNA, 23 bp, Homo sapiens
ctggctctgttcggcctttgggt

SEQ ID NO: 574550 - DNA, 19 bp, Homo sapiens
ctggctgtgtaaccttggg

SEQ ID NO: 574551 - DNA, 16 bp, Homo sapiens
ctgggccgggcctggg

SEQ ID NO: 574552 - DNA, 14 bp, Homo sapiens
ctgggctctggctc

SEQ ID NO: 574553 - DNA, 17 bp, Homo sapiens
ctgggggacccctggct

SEQ ID NO: 574554 - DNA, 19 bp, Homo sapiens
ctgggggacccctggctct

SEQ ID NO: 574555 - DNA, 19 bp, Homo sapiens
ctgggtggcccctgtctcg

SEQ ID NO: 574556 - DNA, 15 bp, Homo sapiens
ctggtcctggcctcc

SEQ ID NO: 574557 - DNA, 21 bp, Homo sapiens
ctgtccagctcccgctgtggc

SEQ ID NO: 574558 - DNA, 18 bp, Homo sapiens
ctgtggccgcacgcctct

SEQ ID NO: 574559 - DNA, 22 bp, Homo sapiens
ctgtggccgcacgcctctccct

SEQ ID NO: 574560 - DNA, 18 bp, Homo sapiens
ctgttggtcctctctctg

SEQ ID NO: 574561 - DNA, 19 bp, Homo sapiens
ctgttggtcctctctctgt

SEQ ID NO: 574562 - DNA, 15 bp, Homo sapiens
cttccaggctgggca

SEQ ID NO: 574563 - DNA, 20 bp, Homo sapiens
cttccccacttctgtgccac

SEQ ID NO: 574564 - DNA, 20 bp, Homo sapiens
cttcctctttggtggcatgg

SEQ ID NO: 574565 - DNA, 23 bp, Homo sapiens
cttctcggcttggatcctgggct

SEQ ID NO: 574566 - DNA, 19 bp, Homo sapiens
cttgccaagggtccctgtg

SEQ ID NO: 574567 - DNA, 21 bp, Homo sapiens
cttgccccactctgcctgcct

SEQ ID NO: 574568 - DNA, 23 bp, Homo sapiens
cttgcccccatttcacccatggg

SEQ ID NO: 574569 - DNA, 13 bp, Homo sapiens
cttggatcctggg

SEQ ID NO: 574570 - DNA, 16 bp, Homo sapiens
cttggatcctgggctg

SEQ ID NO: 574571 - DNA, 11 bp, Homo sapiens
ctttccaaaga

SEQ ID NO: 574572 - DNA, 23 bp, Homo sapiens
gaaccaggagaagggctggggcc

SEQ ID NO: 574573 - DNA, 16 bp, Homo sapiens
gaactccttccccact

SEQ ID NO: 574574 - DNA, 17 bp, Homo sapiens
gacagaccctctgccgc

SEQ ID NO: 574575 - DNA, 17 bp, Homo sapiens
gacccctggctctgggc

SEQ ID NO: 574576 - DNA, 17 bp, Homo sapiens
gactatgcagaggcctg

SEQ ID NO: 574577 - DNA, 17 bp, Homo sapiens
gactgggctctggctct

SEQ ID NO: 574578 - DNA, 16 bp, Homo sapiens
gagaagggctggggcc

SEQ ID NO: 574579 - DNA, 17 bp, Homo sapiens
gagacagttgagagcgg

SEQ ID NO: 574580 - DNA, 14 bp, Homo sapiens
gagactgggctctg

SEQ ID NO: 574581 - DNA, 12 bp, Homo sapiens
gagagagaggct

SEQ ID NO: 574582 - DNA, 14 bp, Homo sapiens
gagccagccaggcc

SEQ ID NO: 574583 - DNA, 18 bp, Homo sapiens
gagcccctcggctctgga

SEQ ID NO: 574584 - DNA, 20 bp, Homo sapiens
gagcccctcggctctggagg

SEQ ID NO: 574585 - DNA, 13 bp, Homo sapiens
aaatataaaatta

SEQ ID NO: 574586 - DNA, 18 bp, Homo sapiens
aaatataaaattatgaga

SEQ ID NO: 574587 - DNA, 14 bp, Homo sapiens
aaatataacacatt

SEQ ID NO: 574588 - DNA, 12 bp, Homo sapiens
aaatgaggagag

SEQ ID NO: 574589 - DNA, 20 bp, Homo sapiens
aaatgcatatcctgagccat

SEQ ID NO: 574590 - DNA, 21 bp, Homo sapiens
aaatggaaagcagagttttca

SEQ ID NO: 574591 - DNA, 19 bp, Homo sapiens
aaatgtaatttaaatgaaa

SEQ ID NO: 574592 - DNA, 15 bp, Homo sapiens
aaatgtataaatata

SEQ ID NO: 574593 - DNA, 19 bp, Homo sapiens
aaatgtataaatatacagt

SEQ ID NO: 574594 - DNA, 14 bp, Homo sapiens
aaatgttaaaagtt

SEQ ID NO: 574595 - DNA, 18 bp, Homo sapiens
aaatgttaaaagttttat

SEQ ID NO: 574596 - DNA, 10 bp, Homo sapiens
aaatgtttct

SEQ ID NO: 574597 - DNA, 11 bp, Homo sapiens
aaattcctgta

SEQ ID NO: 574598 - DNA, 19 bp, Homo sapiens
aaattgagttgcacttatt

SEQ ID NO: 574599 - DNA, 16 bp, Homo sapiens
aaatttaaaaaataaa

SEQ ID NO: 574600 - DNA, 22 bp, Homo sapiens
aaatttgtccaatggctgtaaa

SEQ ID NO: 574601 - DNA, 17 bp, Homo sapiens
aaatttttatgtaatta

SEQ ID NO: 574602 - DNA, 12 bp, Homo sapiens
aacacactgtaa

SEQ ID NO: 574603 - DNA, 13 bp, Homo sapiens
aacacactgtaaa

SEQ ID NO: 574604 - DNA, 20 bp, Homo sapiens
aacacatttttttgcatgca

SEQ ID NO: 574605 - DNA, 18 bp, Homo sapiens
aacagataagcaagagag

SEQ ID NO: 574606 - DNA, 18 bp, Homo sapiens
aacagcctttgaatgtaa

SEQ ID NO: 574607 - DNA, 20 bp, Homo sapiens
aacagtatgtgggatattga

SEQ ID NO: 574608 - DNA, 22 bp, Homo sapiens
aacatcgaaaagttattttgta

SEQ ID NO: 574609 - DNA, 20 bp, Homo sapiens
aacatgttaatgacaatatt

SEQ ID NO: 574610 - DNA, 16 bp, Homo sapiens
aacatttgctgccatt

SEQ ID NO: 574611 - DNA, 23 bp, Homo sapiens
aacctgtcctaaggaaccttcct

SEQ ID NO: 574612 - DNA, 21 bp, Homo sapiens
aacctttgagtagatccattt

SEQ ID NO: 574613 - DNA, 16 bp, Homo sapiens
aacgaagagttccctt

SEQ ID NO: 574614 - DNA, 19 bp, Homo sapiens
aacgtgatttttaaattaa

SEQ ID NO: 574615 - DNA, 16 bp, Homo sapiens
aactataaactactgt

SEQ ID NO: 574616 - DNA, 17 bp, Homo sapiens
aactataaactactgta

SEQ ID NO: 574617 - DNA, 20 bp, Homo sapiens
aactgatgcgaaaacttgaa

SEQ ID NO: 574618 - DNA, 21 bp, Homo sapiens
aactgatgcgaaaacttgaat

SEQ ID NO: 574619 - DNA, 20 bp, Homo sapiens
aacttctgcaacaagcatgc

SEQ ID NO: 574620 - DNA, 18 bp, Homo sapiens
aactttgtaaaaatcttt

SEQ ID NO: 574621 - DNA, 15 bp, Homo sapiens
aagaaaaagttgcag

SEQ ID NO: 574622 - DNA, 20 bp, Homo sapiens
aagaaagccgtactgtctat

SEQ ID NO: 574623 - DNA, 13 bp, Homo sapiens
aagaagtaaattt

SEQ ID NO: 574624 - DNA, 17 bp, Homo sapiens
aagaagttcatgtccaa

SEQ ID NO: 574625 - DNA, 19 bp, Homo sapiens
aagaatgaaagctgttcct

SEQ ID NO: 574626 - DNA, 15 bp, Homo sapiens
aagaattgaaaagtt

SEQ ID NO: 574627 - DNA, 19 bp, Homo sapiens
aagaattgaaaagtttttg

SEQ ID NO: 574628 - DNA, 20 bp, Homo sapiens
aagaattgaaaagtttttgt

SEQ ID NO: 574629 - DNA, 14 bp, Homo sapiens
aagacacacctctg

SEQ ID NO: 574630 - DNA, 20 bp, Homo sapiens
aagactatatatataaatgt

SEQ ID NO: 574631 - DNA, 17 bp, Homo sapiens
aagactgtagatatgta

SEQ ID NO: 574632 - DNA, 16 bp, Homo sapiens
aagaggctgaaagagg

SEQ ID NO: 574633 - DNA, 15 bp, Homo sapiens
aagaggtgggagggc

SEQ ID NO: 574634 - DNA, 16 bp, Homo sapiens
aagagttcccttgaaa

SEQ ID NO: 574635 - DNA, 23 bp, Homo sapiens
aagatatgtaacaacaattattt

SEQ ID NO: 574636 - DNA, 21 bp, Homo sapiens
aagattttgaatgcttcctga

SEQ ID NO: 574637 - DNA, 19 bp, Homo sapiens
aagcaagaaagccgtactg

SEQ ID NO: 574638 - DNA, 15 bp, Homo sapiens
aagcaagagagatgt

SEQ ID NO: 574639 - DNA, 17 bp, Homo sapiens
aagcaagagagatgttt

SEQ ID NO: 574640 - DNA, 20 bp, Homo sapiens
aagcatagataatattgttt

SEQ ID NO: 574641 - DNA, 19 bp, Homo sapiens
aagccaatctacaatctct

SEQ ID NO: 574642 - DNA, 20 bp, Homo sapiens
aagcggccctaagggagtgt

SEQ ID NO: 574643 - DNA, 11 bp, Homo sapiens
aagctaaagag

SEQ ID NO: 574644 - DNA, 16 bp, Homo sapiens
aagcttcagttgcttg

SEQ ID NO: 574645 - DNA, 18 bp, Homo sapiens
aagcttcagttgcttgtc

SEQ ID NO: 574646 - DNA, 17 bp, Homo sapiens
aaggaacagcaatggtg

SEQ ID NO: 574647 - DNA, 16 bp, Homo sapiens
aaggaaccaccgaaga

SEQ ID NO: 574648 - DNA, 21 bp, Homo sapiens
aaggaaccttccttcctgctt

SEQ ID NO: 574649 - DNA, 13 bp, Homo sapiens
aaggaagactaga

SEQ ID NO: 574650 - DNA, 15 bp, Homo sapiens
aaggacatgtgctat

SEQ ID NO: 574651 - DNA, 17 bp, Homo sapiens
aaggacatgtgctattg

SEQ ID NO: 574652 - DNA, 22 bp, Homo sapiens
aaggaccctgttttccacacca

SEQ ID NO: 574653 - DNA, 20 bp, Homo sapiens
aaggatagtaagcatagaaa

SEQ ID NO: 574654 - DNA, 20 bp, Homo sapiens
aagggatggaaaaggaagac

SEQ ID NO: 574655 - DNA, 21 bp, Homo sapiens
aagggatggaaaaggaagact

SEQ ID NO: 574656 - DNA, 19 bp, Homo sapiens
aagtccgcagaagccctga

SEQ ID NO: 574657 - DNA, 15 bp, Homo sapiens
aagtctttcatggct

SEQ ID NO: 574658 - DNA, 22 bp, Homo sapiens
aagtgaagccccttgtcctctc

SEQ ID NO: 574659 - DNA, 18 bp, Homo sapiens
aagtgatctgtcccctct

SEQ ID NO: 574660 - DNA, 22 bp, Homo sapiens
aagtgatctgtcccctctcccc

SEQ ID NO: 574661 - DNA, 17 bp, Homo sapiens
aagtgtgtatatatttt

SEQ ID NO: 574662 - DNA, 19 bp, Homo sapiens
aagtgtgtatatattttgt

SEQ ID NO: 574663 - DNA, 13 bp, Homo sapiens
aagttttgttgta

SEQ ID NO: 574664 - DNA, 15 bp, Homo sapiens
aagtttttgtttgga

SEQ ID NO: 574665 - DNA, 12 bp, Homo sapiens
aataaaatttaa

SEQ ID NO: 574666 - DNA, 13 bp, Homo sapiens
aataaaatttaaa

SEQ ID NO: 574667 - DNA, 14 bp, Homo sapiens
aataaatatttatg

SEQ ID NO: 574668 - DNA, 19 bp, Homo sapiens
aataagcactgtaaacttc

SEQ ID NO: 574669 - DNA, 18 bp, Homo sapiens
aatacatgccacatcaaa

SEQ ID NO: 574670 - DNA, 23 bp, Homo sapiens
aataggaatcattcagaaatgtt

SEQ ID NO: 574671 - DNA, 20 bp, Homo sapiens
aatagtgcttaaaaatcatt

SEQ ID NO: 574672 - DNA, 20 bp, Homo sapiens
aatatagctttcataacatc

SEQ ID NO: 574673 - DNA, 21 bp, Homo sapiens
aatatgacggaagaacataga

SEQ ID NO: 574674 - DNA, 20 bp, Homo sapiens
aatattgattgggaaaacat

SEQ ID NO: 574675 - DNA, 13 bp, Homo sapiens
aatcattcagaaa

SEQ ID NO: 574676 - DNA, 15 bp, Homo sapiens
aatcattcagaaatg

SEQ ID NO: 574677 - DNA, 19 bp, Homo sapiens
aatcattcagaaatgttga

SEQ ID NO: 574678 - DNA, 17 bp, Homo sapiens
aatctctttttgtttgc

SEQ ID NO: 574679 - DNA, 17 bp, Homo sapiens
aatctgttactgaaatg

SEQ ID NO: 574680 - DNA, 16 bp, Homo sapiens
aatgaaagaaaattga

SEQ ID NO: 574681 - DNA, 19 bp, Homo sapiens
aatgaaagaaaattgagtt

SEQ ID NO: 574682 - DNA, 19 bp, Homo sapiens
aatgcatatcctgagccat

SEQ ID NO: 574683 - DNA, 16 bp, Homo sapiens
aatgctacaattttaa

SEQ ID NO: 574684 - DNA, 15 bp, Homo sapiens
aatgctacatgtgag

SEQ ID NO: 574685 - DNA, 16 bp, Homo sapiens
aatgtaatttaaatga

SEQ ID NO: 574686 - DNA, 15 bp, Homo sapiens
aatgtataaatatac

SEQ ID NO: 574687 - DNA, 16 bp, Homo sapiens
aatgtataaatataca

SEQ ID NO: 574688 - DNA, 23 bp, Homo sapiens
aatgtgacttggattcaatttta

SEQ ID NO: 574689 - DNA, 13 bp, Homo sapiens
aatgttaaaggga

SEQ ID NO: 574690 - DNA, 16 bp, Homo sapiens
aatgtttatgagccag

SEQ ID NO: 574691 - DNA, 21 bp, Homo sapiens
aatgtttcttttgtttggtaa

SEQ ID NO: 574692 - DNA, 23 bp, Homo sapiens
aattaagcaaatgttaaaagttt

SEQ ID NO: 574693 - DNA, 13 bp, Homo sapiens
aattatatatact

SEQ ID NO: 574694 - DNA, 14 bp, Homo sapiens
aattcaactttgta

SEQ ID NO: 574695 - DNA, 16 bp, Homo sapiens
aattcaactttgtaaa

SEQ ID NO: 574696 - DNA, 22 bp, Homo sapiens
aattcaactttgtaaaaatctt

SEQ ID NO: 574697 - DNA, 14 bp, Homo sapiens
tgaggccctgccca

SEQ ID NO: 574698 - DNA, 21 bp, Homo sapiens
tgagtagatccatttccattg

SEQ ID NO: 574699 - DNA, 12 bp, Homo sapiens
tgagtattgttt

SEQ ID NO: 574700 - DNA, 14 bp, Homo sapiens
tgagtgtatgagta

SEQ ID NO: 574701 - DNA, 24 bp, Homo sapiens
tgatagcagaagaaaaagttgcag

SEQ ID NO: 574702 - DNA, 18 bp, Homo sapiens
tgatcttgagatttcttt

SEQ ID NO: 574703 - DNA, 13 bp, Homo sapiens
tgatgactgcctt

SEQ ID NO: 574704 - DNA, 14 bp, Homo sapiens
tgatgactgccttg

SEQ ID NO: 574705 - DNA, 20 bp, Homo sapiens
tgatgactgccttgcctcct

SEQ ID NO: 574706 - DNA, 17 bp, Homo sapiens
tgatgcgaaaacttgaa

SEQ ID NO: 574707 - DNA, 18 bp, Homo sapiens
tgatgttttcctataata

SEQ ID NO: 574708 - DNA, 18 bp, Homo sapiens
tgattattttttttttct

SEQ ID NO: 574709 - DNA, 18 bp, Homo sapiens
tgattctggctttaagcc

SEQ ID NO: 574710 - DNA, 21 bp, Homo sapiens
tgattctggctttaagccttc

SEQ ID NO: 574711 - DNA, 19 bp, Homo sapiens
tgattctttgttacaggca

SEQ ID NO: 574712 - DNA, 15 bp, Homo sapiens
tgattgggaaaacat

SEQ ID NO: 574713 - DNA, 16 bp, Homo sapiens
tgattgggaaaacatt

SEQ ID NO: 574714 - DNA, 21 bp, Homo sapiens
tgatttcaaagttttgttgta

SEQ ID NO: 574715 - DNA, 16 bp, Homo sapiens
tgatttgaaaaatata

SEQ ID NO: 574716 - DNA, 16 bp, Homo sapiens
tgcaataaaatttaaa

SEQ ID NO: 574717 - DNA, 20 bp, Homo sapiens
tgcagagatttctcattgac

SEQ ID NO: 574718 - DNA, 23 bp, Homo sapiens
tgcagggttcaagccttccaggg

SEQ ID NO: 574719 - DNA, 22 bp, Homo sapiens
tgcagtattgccacaatgcctc

SEQ ID NO: 574720 - DNA, 13 bp, Homo sapiens
tgcagtctcagaa

SEQ ID NO: 574721 - DNA, 23 bp, Homo sapiens
tgcataataagctaaagaggctg

SEQ ID NO: 574722 - DNA, 22 bp, Homo sapiens
tgcatactttgtattttgatta

SEQ ID NO: 574723 - DNA, 13 bp, Homo sapiens
tgcatatcctgag

SEQ ID NO: 574724 - DNA, 18 bp, Homo sapiens
tgcatgtagaggcttgtt

SEQ ID NO: 574725 - DNA, 21 bp, Homo sapiens
tgcatgtagaggcttgtttac

SEQ ID NO: 574726 - DNA, 13 bp, Homo sapiens
tgcatttgaggtc

SEQ ID NO: 574727 - DNA, 19 bp, Homo sapiens
tgcatttttgtgaaatgaa

SEQ ID NO: 574728 - DNA, 17 bp, Homo sapiens
tgccacaatgcctctcc

SEQ ID NO: 574729 - DNA, 21 bp, Homo sapiens
tgccacaatgcctctcccacg

SEQ ID NO: 574730 - DNA, 23 bp, Homo sapiens
tgccagccccctaaaagcactcc

SEQ ID NO: 574731 - DNA, 21 bp, Homo sapiens
tgccaggaacctgtcctaagg

SEQ ID NO: 574732 - DNA, 16 bp, Homo sapiens
tgccatctatctagtt

SEQ ID NO: 574733 - DNA, 16 bp, Homo sapiens
tgccatgtgaagaggg

SEQ ID NO: 574734 - DNA, 22 bp, Homo sapiens
tgccattacagaggtattaaaa

SEQ ID NO: 574735 - DNA, 20 bp, Homo sapiens
tgcccaatgagactctaggg

SEQ ID NO: 574736 - DNA, 21 bp, Homo sapiens
tgcccaatgagactctagggt

SEQ ID NO: 574737 - DNA, 13 bp, Homo sapiens
tgcccccatccca

SEQ ID NO: 574738 - DNA, 14 bp, Homo sapiens
tgcccccatcccac

SEQ ID NO: 574739 - DNA, 20 bp, Homo sapiens
tgcctacatcccgggcctca

SEQ ID NO: 574740 - DNA, 21 bp, Homo sapiens
tgcctacatcccgggcctcag

SEQ ID NO: 574741 - DNA, 15 bp, Homo sapiens
tgcctcaccttgggg

SEQ ID NO: 574742 - DNA, 18 bp, Homo sapiens
tgcctcaccttggggcct

SEQ ID NO: 574743 - DNA, 12 bp, Homo sapiens
tgccttgcctcc

SEQ ID NO: 574744 - DNA, 15 bp, Homo sapiens
tgccttgcctcctca

SEQ ID NO: 574745 - DNA, 16 bp, Homo sapiens
tgccttgcctcctcag

SEQ ID NO: 574746 - DNA, 19 bp, Homo sapiens
tgcgaaaacttgaatctgt

SEQ ID NO: 574747 - DNA, 18 bp, Homo sapiens
tgcgcaacaacaaggacc

SEQ ID NO: 574748 - DNA, 13 bp, Homo sapiens
tgctactgttgta

SEQ ID NO: 574749 - DNA, 20 bp, Homo sapiens
tgctactgttgtaagaattc

SEQ ID NO: 574750 - DNA, 13 bp, Homo sapiens
tgctattgaactg

SEQ ID NO: 574751 - DNA, 16 bp, Homo sapiens
tgctgctgtccagtgc

SEQ ID NO: 574752 - DNA, 21 bp, Homo sapiens
tgctgctgtccagtgcctaca

SEQ ID NO: 574753 - DNA, 12 bp, Homo sapiens
tgctggcacctc

SEQ ID NO: 574754 - DNA, 13 bp, Homo sapiens
tgctggcacctca

SEQ ID NO: 574755 - DNA, 16 bp, Homo sapiens
tgctgtccagtgccta

SEQ ID NO: 574756 - DNA, 17 bp, Homo sapiens
tgctgtccagtgcctac

SEQ ID NO: 574757 - DNA, 12 bp, Homo sapiens
tgctgttgctta

SEQ ID NO: 574758 - DNA, 18 bp, Homo sapiens
tgcttaaaaatcattgat

SEQ ID NO: 574759 - DNA, 19 bp, Homo sapiens
tgcttaaaaatcattgatt

SEQ ID NO: 574760 - DNA, 20 bp, Homo sapiens
tgcttaatcttcaaagcctt

SEQ ID NO: 574761 - DNA, 18 bp, Homo sapiens
tgctttattaatgttttc

SEQ ID NO: 574762 - DNA, 23 bp, Homo sapiens
tgctttattaatgttttcaaaag

SEQ ID NO: 574763 - DNA, 18 bp, Homo sapiens
tggaaaaggaagactaga

SEQ ID NO: 574764 - DNA, 15 bp, Homo sapiens
tggaaagtaactgtg

SEQ ID NO: 574765 - DNA, 22 bp, Homo sapiens
tggaaattcctgtactgtgtct

SEQ ID NO: 574766 - DNA, 23 bp, Homo sapiens
tggaagaggaacagcactgggga

SEQ ID NO: 574767 - DNA, 20 bp, Homo sapiens
tggatgccacagcccagctt

SEQ ID NO: 574768 - DNA, 12 bp, Homo sapiens
tgtccagtgcct

SEQ ID NO: 574769 - DNA, 16 bp, Homo sapiens
tgtccagtgcctacat

SEQ ID NO: 574770 - DNA, 17 bp, Homo sapiens
tgtcccctctcccctca

SEQ ID NO: 574771 - DNA, 19 bp, Homo sapiens
tgtcctaaggaaccttcct

SEQ ID NO: 574772 - DNA, 23 bp, Homo sapiens
tgtcctcagggagcagggaaggc

SEQ ID NO: 574773 - DNA, 21 bp, Homo sapiens
tgtcctctcccctctgccctg

SEQ ID NO: 574774 - DNA, 21 bp, Homo sapiens
tgtctccttaagctgcagaga

SEQ ID NO: 574775 - DNA, 15 bp, Homo sapiens
tgtctttcagataca

SEQ ID NO: 574776 - DNA, 16 bp, Homo sapiens
tgtctttcagatacat

SEQ ID NO: 574777 - DNA, 22 bp, Homo sapiens
tgtgatacattttttaagcttc

SEQ ID NO: 574778 - DNA, 21 bp, Homo sapiens
tgtgcatttttgtgaaatgaa

SEQ ID NO: 574779 - DNA, 15 bp, Homo sapiens
tgtgctattgaactg

SEQ ID NO: 574780 - DNA, 17 bp, Homo sapiens
tgtgctattgaactgag

SEQ ID NO: 574781 - DNA, 23 bp, Homo sapiens
tgtggcataaattgcatcactgt

SEQ ID NO: 574782 - DNA, 12 bp, Homo sapiens
tgtggggcacag

SEQ ID NO: 574783 - DNA, 19 bp, Homo sapiens
tgtgtatatattttgtgtg

SEQ ID NO: 574784 - DNA, 19 bp, Homo sapiens
tgtgtatttccagtgcaat

SEQ ID NO: 574785 - DNA, 13 bp, Homo sapiens
tgtgtcctctccc

SEQ ID NO: 574786 - DNA, 15 bp, Homo sapiens
tgtgtgtgtgtatga

SEQ ID NO: 574787 - DNA, 24 bp, Homo sapiens
tgttaagtatcagctacaattgta

SEQ ID NO: 574788 - DNA, 12 bp, Homo sapiens
tgttactgaaat

SEQ ID NO: 574789 - DNA, 22 bp, Homo sapiens
tgtttaaaatgtaatttaaatg

SEQ ID NO: 574790 - DNA, 18 bp, Homo sapiens
tgtttcttttgtttggta

SEQ ID NO: 574791 - DNA, 21 bp, Homo sapiens
tgtttcttttgtttggtaaat

SEQ ID NO: 574792 - DNA, 16 bp, Homo sapiens
tgtttgccaggacatg

SEQ ID NO: 574793 - DNA, 12 bp, Homo sapiens
tgttttccacac

SEQ ID NO: 574794 - DNA, 15 bp, Homo sapiens
ttaaaacaatttatt

SEQ ID NO: 574795 - DNA, 13 bp, Homo sapiens
ttaaaactaaatt

SEQ ID NO: 574796 - DNA, 16 bp, Homo sapiens
ttaaaactaaatttca

SEQ ID NO: 574797 - DNA, 11 bp, Homo sapiens
ttaaaatgtaa

SEQ ID NO: 574798 - DNA, 19 bp, Homo sapiens
ttaaacgtgatttttaaat

SEQ ID NO: 574799 - DNA, 18 bp, Homo sapiens
ttaaagaagtaaatttgt

SEQ ID NO: 574800 - DNA, 20 bp, Homo sapiens
ttaaagaccctcctattcta

SEQ ID NO: 574801 - DNA, 14 bp, Homo sapiens
ttaaagagaatgag

SEQ ID NO: 574802 - DNA, 20 bp, Homo sapiens
ttaaataaaatttttatgta

SEQ ID NO: 574803 - DNA, 19 bp, Homo sapiens
ttaagctgcagagatttct

SEQ ID NO: 574804 - DNA, 18 bp, Homo sapiens
ttaaggggaagaatgaaa

SEQ ID NO: 574805 - DNA, 20 bp, Homo sapiens
ttaatccagttataagaaga

SEQ ID NO: 574806 - DNA, 16 bp, Homo sapiens
ttaatgttttcaaaag

SEQ ID NO: 574807 - DNA, 17 bp, Homo sapiens
ttacaataggagtggtg

SEQ ID NO: 574808 - DNA, 17 bp, Homo sapiens
ttacaggcaccgagaat

SEQ ID NO: 574809 - DNA, 24 bp, Homo sapiens
ttacaggcaccgagaatgttgtat

SEQ ID NO: 574810 - DNA, 13 bp, Homo sapiens
ttaccccgggaga

SEQ ID NO: 574811 - DNA, 14 bp, Homo sapiens
ttactgacatttct

SEQ ID NO: 574812 - DNA, 13 bp, Homo sapiens
ttactttgctgag

SEQ ID NO: 574813 - DNA, 19 bp, Homo sapiens
ttaggggaaggagaagtaa

SEQ ID NO: 574814 - DNA, 18 bp, Homo sapiens
ttagtttttggttgggaa

SEQ ID NO: 574815 - DNA, 17 bp, Homo sapiens
ttataaacagaaatgga

SEQ ID NO: 574816 - DNA, 20 bp, Homo sapiens
ttatatgctttattaatgtt

SEQ ID NO: 574817 - DNA, 19 bp, Homo sapiens
ttatattactgacatttct

SEQ ID NO: 574818 - DNA, 15 bp, Homo sapiens
ttatcgtttttgtat

SEQ ID NO: 574819 - DNA, 22 bp, Homo sapiens
ttatcgtttttgtattttcatg

SEQ ID NO: 574820 - DNA, 15 bp, Homo sapiens
ttatcttacaatatt

SEQ ID NO: 574821 - DNA, 20 bp, Homo sapiens
ttatgagattggttttcctg

SEQ ID NO: 574822 - DNA, 13 bp, Homo sapiens
ttattaatgtttt

SEQ ID NO: 574823 - DNA, 16 bp, Homo sapiens
ttatttttataattgt

SEQ ID NO: 574824 - DNA, 16 bp, Homo sapiens
ttatttttttaaaatt

SEQ ID NO: 574825 - DNA, 18 bp, Homo sapiens
ttcaaaatgtctgtagct

SEQ ID NO: 574826 - DNA, 17 bp, Homo sapiens
ttcaaagccttctccct

SEQ ID NO: 574827 - DNA, 20 bp, Homo sapiens
ttcagaaatataacacattt

SEQ ID NO: 574828 - DNA, 12 bp, Homo sapiens
ttcagatacatg

SEQ ID NO: 574829 - DNA, 15 bp, Homo sapiens
ttcatgaaaatacca

SEQ ID NO: 574830 - DNA, 19 bp, Homo sapiens
ttcatggctgctgttgctt

SEQ ID NO: 574831 - DNA, 21 bp, Homo sapiens
ttcatggctgctgttgcttaa

SEQ ID NO: 574832 - DNA, 18 bp, Homo sapiens
ttccagggatttgcctca

SEQ ID NO: 574833 - DNA, 21 bp, Homo sapiens
ttccagggatttgcctcacct

SEQ ID NO: 574834 - DNA, 23 bp, Homo sapiens
ttccagggatttgcctcaccttg

SEQ ID NO: 574835 - DNA, 15 bp, Homo sapiens
ttccaggggaacctg

SEQ ID NO: 574836 - DNA, 17 bp, Homo sapiens
ttccaggggaacctgcc

SEQ ID NO: 574837 - DNA, 18 bp, Homo sapiens
ttccaggggaacctgcca

SEQ ID NO: 574838 - DNA, 16 bp, Homo sapiens
ttccattatgattctt

SEQ ID NO: 574839 - DNA, 13 bp, Homo sapiens
ttccattgcttat

SEQ ID NO: 574840 - DNA, 14 bp, Homo sapiens
ttcccttctatgca

SEQ ID NO: 574841 - DNA, 15 bp, Homo sapiens
ttcccttctatgcag

SEQ ID NO: 574842 - DNA, 20 bp, Homo sapiens
ttcctataatataataaata

SEQ ID NO: 574843 - DNA, 16 bp, Homo sapiens
ttcctgtactgtgtct

SEQ ID NO: 574844 - DNA, 23 bp, Homo sapiens
ttctaaatacatgccacatcaaa

SEQ ID NO: 574845 - DNA, 23 bp, Homo sapiens
ttctaaatgcatatcctgagcca

SEQ ID NO: 574846 - DNA, 13 bp, Homo sapiens
ttctctctctaag

SEQ ID NO: 574847 - DNA, 23 bp, Homo sapiens
ttctgattctggctttaagcctt

SEQ ID NO: 574848 - DNA, 17 bp, Homo sapiens
ttctgcaacaagcatgc

SEQ ID NO: 574849 - DNA, 17 bp, Homo sapiens
ttctgctggcatcaaga

SEQ ID NO: 574850 - DNA, 15 bp, Homo sapiens
ttctggtactttctg

SEQ ID NO: 574851 - DNA, 17 bp, Homo sapiens
ttctggtactttctgtt

SEQ ID NO: 574852 - DNA, 16 bp, Homo sapiens
ttcttacatgcatttg

SEQ ID NO: 574853 - DNA, 20 bp, Homo sapiens
ttcttagtatgtgcatttaa

SEQ ID NO: 574854 - DNA, 19 bp, Homo sapiens
ttctttcagttctttggat

SEQ ID NO: 574855 - DNA, 17 bp, Homo sapiens
ttctttccattatgatt

SEQ ID NO: 574856 - DNA, 20 bp, Homo sapiens
ttctttccattatgattctt

SEQ ID NO: 574857 - DNA, 15 bp, Homo sapiens
ttctttgtaaaggtc

SEQ ID NO: 574858 - DNA, 16 bp, Homo sapiens
ttctttgttacaggca

SEQ ID NO: 574859 - DNA, 13 bp, Homo sapiens
ttcttttgtttgg

SEQ ID NO: 574860 - DNA, 19 bp, Homo sapiens
ttgaaaaatataaaattat

SEQ ID NO: 574861 - DNA, 18 bp, Homo sapiens
ttgaatctgttactgaaa

SEQ ID NO: 574862 - DNA, 19 bp, Homo sapiens
ttgaatctgttactgaaat

SEQ ID NO: 574863 - DNA, 11 bp, Homo sapiens
ttgaatgtaac

SEQ ID NO: 574864 - DNA, 14 bp, Homo sapiens
ttgaatgttaaagg

SEQ ID NO: 574865 - DNA, 18 bp, Homo sapiens
ttgacttttataaagcat

SEQ ID NO: 574866 - DNA, 21 bp, Homo sapiens
ttgacttttataaagcatgtt

SEQ ID NO: 574867 - DNA, 15 bp, Homo sapiens
ttgagatttctttta

SEQ ID NO: 574868 - DNA, 21 bp, Homo sapiens
ttgatgactgccttgcctcct

SEQ ID NO: 574869 - DNA, 20 bp, Homo sapiens
ttgatttcaaagttttgttg

SEQ ID NO: 574870 - DNA, 16 bp, Homo sapiens
ttgcagaactgtagct

SEQ ID NO: 574871 - DNA, 20 bp, Homo sapiens
ttgcataataagctaaagag

SEQ ID NO: 574872 - DNA, 21 bp, Homo sapiens
ttgccacaatgcctctcccac

SEQ ID NO: 574873 - DNA, 16 bp, Homo sapiens
ttgccaggacatgcaa

SEQ ID NO: 574874 - DNA, 17 bp, Homo sapiens
ttgccaggacatgcaat

SEQ ID NO: 574875 - DNA, 13 bp, Homo sapiens
ttgcctcaccttg

SEQ ID NO: 574876 - DNA, 14 bp, Homo sapiens
ttgcctcctcagta

SEQ ID NO: 574877 - DNA, 18 bp, Homo sapiens
ttgcttaaaccacttaaa

SEQ ID NO: 574878 - DNA, 11 bp, Homo sapiens
ttggaaattcc

SEQ ID NO: 574879 - DNA, 18 bp, Homo sapiens
ttggaaattcctgtactg

SEQ ID NO: 574880 - DNA, 12 bp, Homo sapiens
ttgggaaaacat

SEQ ID NO: 574881 - DNA, 12 bp, Homo sapiens
aaaacatttgct

SEQ ID NO: 574882 - DNA, 15 bp, Homo sapiens
aaaacttgaatctgt

SEQ ID NO: 574883 - DNA, 20 bp, Homo sapiens
aaaacttgaatctgttactg

SEQ ID NO: 574884 - DNA, 14 bp, Homo sapiens
aaaagcagctacca

SEQ ID NO: 574885 - DNA, 11 bp, Homo sapiens
aaaagcccagt

SEQ ID NO: 574886 - DNA, 14 bp, Homo sapiens
aaaaggaagactag

SEQ ID NO: 574887 - DNA, 15 bp, Homo sapiens
aaaaggaagactaga

SEQ ID NO: 574888 - DNA, 16 bp, Homo sapiens
aaaaggacacctttta

SEQ ID NO: 574889 - DNA, 21 bp, Homo sapiens
aaaagtgatctgtcccctctc

SEQ ID NO: 574890 - DNA, 17 bp, Homo sapiens
aaaagttgcagtctcag

SEQ ID NO: 574891 - DNA, 18 bp, Homo sapiens
aaaagttgcagtctcaga

SEQ ID NO: 574892 - DNA, 20 bp, Homo sapiens
aaaatatgggttgcatttgg

SEQ ID NO: 574893 - DNA, 12 bp, Homo sapiens
aaaatcattgat

SEQ ID NO: 574894 - DNA, 18 bp, Homo sapiens
aaaatttcaaaagtgatc

SEQ ID NO: 574895 - DNA, 22 bp, Homo sapiens
aaaattttgtatgttaaagaga

SEQ ID NO: 574896 - DNA, 20 bp, Homo sapiens
aaacacccgacgtcatgtat

SEQ ID NO: 574897 - DNA, 14 bp, Homo sapiens
aaacgtcctcttta

SEQ ID NO: 574898 - DNA, 23 bp, Homo sapiens
aaacgtcctctttagtttttggt

SEQ ID NO: 574899 - DNA, 19 bp, Homo sapiens
aaactactgtaattaagtg

SEQ ID NO: 574900 - DNA, 17 bp, Homo sapiens
aaactataaactactgt

SEQ ID NO: 574901 - DNA, 19 bp, Homo sapiens
aaactataaactactgtaa

SEQ ID NO: 574902 - DNA, 20 bp, Homo sapiens
aaactgatgcgaaaacttga

SEQ ID NO: 574903 - DNA, 17 bp, Homo sapiens
aaactttgggaaaacat

SEQ ID NO: 574904 - DNA, 20 bp, Homo sapiens
aaactttgggaaaacatgtt

SEQ ID NO: 574905 - DNA, 18 bp, Homo sapiens
aaagaagtaaatttgtcc

SEQ ID NO: 574906 - DNA, 20 bp, Homo sapiens
aaagaagtaaatttgtccaa

SEQ ID NO: 574907 - DNA, 20 bp, Homo sapiens
aaagagaatgagtccttgat

SEQ ID NO: 574908 - DNA, 14 bp, Homo sapiens
aaagctgttccttg

SEQ ID NO: 574909 - DNA, 22 bp, Homo sapiens
aaaggacaccttttaactcacc

SEQ ID NO: 574910 - DNA, 13 bp, Homo sapiens
aaagggatatttt

SEQ ID NO: 574911 - DNA, 16 bp, Homo sapiens
aaaggtaatgtgtgga

SEQ ID NO: 574912 - DNA, 14 bp, Homo sapiens
aaagtgatctgtcc

SEQ ID NO: 574913 - DNA, 17 bp, Homo sapiens
aaagtgggcttaatgga

SEQ ID NO: 574914 - DNA, 16 bp, Homo sapiens
aaagtgtgtatatatt

SEQ ID NO: 574915 - DNA, 12 bp, Homo sapiens
aaagttttgttg

SEQ ID NO: 574916 - DNA, 14 bp, Homo sapiens
aaagttttgttgta

SEQ ID NO: 574917 - DNA, 14 bp, Homo sapiens
aaagtttttgtttg

SEQ ID NO: 574918 - DNA, 12 bp, Homo sapiens
aaataacagtat

SEQ ID NO: 574919 - DNA, 15 bp, Homo sapiens
aaatacacatttgct

SEQ ID NO: 574920 - DNA, 23 bp, Homo sapiens
aaatacatgccacatcaaacctt

SEQ ID NO: 574921 - DNA, 17 bp, Homo sapiens
aaatccttttacctttt

SEQ ID NO: 574922 - DNA, 17 bp, Homo sapiens
aaatcttttgaagcata

SEQ ID NO: 574923 - DNA, 13 bp, Homo sapiens
aaatgtaatttaa

SEQ ID NO: 574924 - DNA, 13 bp, Homo sapiens
aaatgtataaata

SEQ ID NO: 574925 - DNA, 16 bp, Homo sapiens
aaatgtataaatatac

SEQ ID NO: 574926 - DNA, 17 bp, Homo sapiens
aaatgtataaatataca

SEQ ID NO: 574927 - DNA, 16 bp, Homo sapiens
aaatgttaaaagtttt

SEQ ID NO: 574928 - DNA, 23 bp, Homo sapiens
aaatgttaaaagttttatatgct

SEQ ID NO: 574929 - DNA, 13 bp, Homo sapiens
aaattaagcaaat

SEQ ID NO: 574930 - DNA, 16 bp, Homo sapiens
aaattaagcaaatgtt

SEQ ID NO: 574931 - DNA, 20 bp, Homo sapiens
aaattcaactttgtaaaaat

SEQ ID NO: 574932 - DNA, 12 bp, Homo sapiens
aaattgcatact

SEQ ID NO: 574933 - DNA, 18 bp, Homo sapiens
aaatttcactactagatt

SEQ ID NO: 574934 - DNA, 24 bp, Homo sapiens
aaatttgtccaatggctgtaaact

SEQ ID NO: 574935 - DNA, 21 bp, Homo sapiens
aacaaaagcgacccattcaga

SEQ ID NO: 574936 - DNA, 13 bp, Homo sapiens
aacaaaatttgaa

SEQ ID NO: 574937 - DNA, 14 bp, Homo sapiens
aacaaaatttgaat

SEQ ID NO: 574938 - DNA, 12 bp, Homo sapiens
aacaacaattat

SEQ ID NO: 574939 - DNA, 13 bp, Homo sapiens
aacaagcatgcag

SEQ ID NO: 574940 - DNA, 22 bp, Homo sapiens
aacacactgtaaatatccacag

SEQ ID NO: 574941 - DNA, 15 bp, Homo sapiens
aacagcctttgaatg

SEQ ID NO: 574942 - DNA, 16 bp, Homo sapiens
aacagcctttgaatgt

SEQ ID NO: 574943 - DNA, 19 bp, Homo sapiens
aacagcctttgaatgtaac

SEQ ID NO: 574944 - DNA, 21 bp, Homo sapiens
aacagtatgtgggatattgaa

SEQ ID NO: 574945 - DNA, 22 bp, Homo sapiens
aaccaatcctactaataaacca

SEQ ID NO: 574946 - DNA, 12 bp, Homo sapiens
aaccactagaaa

SEQ ID NO: 574947 - DNA, 14 bp, Homo sapiens
aaccataaattcaa

SEQ ID NO: 574948 - DNA, 17 bp, Homo sapiens
aacctagtactgccccc

SEQ ID NO: 574949 - DNA, 23 bp, Homo sapiens
aacgaagagttcccttgaaactt

SEQ ID NO: 574950 - DNA, 19 bp, Homo sapiens
aacgtcctctttagttttt

SEQ ID NO: 574951 - DNA, 21 bp, Homo sapiens
aacgtgatttttaaattaaat

SEQ ID NO: 574952 - DNA, 19 bp, Homo sapiens
acaagcatgcagctttgca

SEQ ID NO: 574953 - DNA, 21 bp, Homo sapiens
acaaggaccctgttttccaca

SEQ ID NO: 574954 - DNA, 17 bp, Homo sapiens
acaatattccagatctt

SEQ ID NO: 574955 - DNA, 14 bp, Homo sapiens
acaatccactctca

SEQ ID NO: 574956 - DNA, 15 bp, Homo sapiens
acaatccactctcag

SEQ ID NO: 574957 - DNA, 19 bp, Homo sapiens
acaatccactctcaggagg

SEQ ID NO: 574958 - DNA, 19 bp, Homo sapiens
acaatctctttttgtttgc

SEQ ID NO: 574959 - DNA, 12 bp, Homo sapiens
acacactgtaaa

SEQ ID NO: 574960 - DNA, 21 bp, Homo sapiens
acacactgtaaatatccacag

SEQ ID NO: 574961 - DNA, 15 bp, Homo sapiens
acacagcatgtgtat

SEQ ID NO: 574962 - DNA, 19 bp, Homo sapiens
acacatttgctactgttgt

SEQ ID NO: 574963 - DNA, 19 bp, Homo sapiens
acaccatcaccctctgggc

SEQ ID NO: 574964 - DNA, 17 bp, Homo sapiens
acacctctggatccctg

SEQ ID NO: 574965 - DNA, 19 bp, Homo sapiens
acacctctggatccctgga

SEQ ID NO: 574966 - DNA, 19 bp, Homo sapiens
acagaggtattaaaactaa

SEQ ID NO: 574967 - DNA, 15 bp, Homo sapiens
acagataagcaagag

SEQ ID NO: 574968 - DNA, 19 bp, Homo sapiens
acagataagcaagagagat

SEQ ID NO: 574969 - DNA, 17 bp, Homo sapiens
acagcacttacaatttt

SEQ ID NO: 574970 - DNA, 13 bp, Homo sapiens
acagcatgtgtat

SEQ ID NO: 574971 - DNA, 19 bp, Homo sapiens
acagcctttgaatgtaacc

SEQ ID NO: 574972 - DNA, 20 bp, Homo sapiens
acagcctttgaatgtaacca

SEQ ID NO: 574973 - DNA, 20 bp, Homo sapiens
acaggcaccgagaatgttgt

SEQ ID NO: 574974 - DNA, 16 bp, Homo sapiens
acagggttcaaaatgt

SEQ ID NO: 574975 - DNA, 13 bp, Homo sapiens
acatgcaataaaa

SEQ ID NO: 574976 - DNA, 16 bp, Homo sapiens
acatgcaataaaattt

SEQ ID NO: 574977 - DNA, 18 bp, Homo sapiens
acatgcaataaaatttaa

SEQ ID NO: 574978 - DNA, 21 bp, Homo sapiens
acatgcatttgaggtcaagta

SEQ ID NO: 574979 - DNA, 22 bp, Homo sapiens
acatgccacatcaaacctttga

SEQ ID NO: 574980 - DNA, 23 bp, Homo sapiens
acatgccagcttcctgtgggcca

SEQ ID NO: 574981 - DNA, 14 bp, Homo sapiens
acatgtgatacatt

SEQ ID NO: 574982 - DNA, 20 bp, Homo sapiens
acatgttaatgacaatattc

SEQ ID NO: 574983 - DNA, 15 bp, Homo sapiens
acatttgctgccatt

SEQ ID NO: 574984 - DNA, 23 bp, Homo sapiens
acatttttttgcatgcatgcaaa

SEQ ID NO: 574985 - DNA, 16 bp, Homo sapiens
accaagtggaccttga

SEQ ID NO: 574986 - DNA, 22 bp, Homo sapiens
accaatcctactaataaaccag

SEQ ID NO: 574987 - DNA, 13 bp, Homo sapiens
accacacttgaaa

SEQ ID NO: 574988 - DNA, 23 bp, Homo sapiens
accacagggttcaaaatgtctgt

SEQ ID NO: 574989 - DNA, 17 bp, Homo sapiens
accacatcaaataagaa

SEQ ID NO: 574990 - DNA, 14 bp, Homo sapiens
accacttacttcgt

SEQ ID NO: 574991 - DNA, 14 bp, Homo sapiens
accacttccagggg

SEQ ID NO: 574992 - DNA, 20 bp, Homo sapiens
accacttccaggggaacctg

SEQ ID NO: 574993 - DNA, 17 bp, Homo sapiens
accatcaccctctgggc

SEQ ID NO: 574994 - DNA, 20 bp, Homo sapiens
ataaattcaactttgtaaaa

SEQ ID NO: 574995 - DNA, 19 bp, Homo sapiens
ataacatcgaaaagttatt

SEQ ID NO: 574996 - DNA, 21 bp, Homo sapiens
ataagaaataatgctacaatt

SEQ ID NO: 574997 - DNA, 17 bp, Homo sapiens
ataagcactgtaaactt

SEQ ID NO: 574998 - DNA, 13 bp, Homo sapiens
ataagctaaagag

SEQ ID NO: 574999 - DNA, 22 bp, Homo sapiens
ataagcttccattttaatttta

SEQ ID NO: 575000 - DNA, 13 bp, Homo sapiens
ataataagctaaa

SEQ ID NO: 575001 - DNA, 17 bp, Homo sapiens
ataatactaaagtgtct

SEQ ID NO: 575002 - DNA, 22 bp, Homo sapiens
ataatattgtttggtaaatgtt

SEQ ID NO: 575003 - DNA, 13 bp, Homo sapiens
ataattgtacaaa

SEQ ID NO: 575004 - DNA, 14 bp, Homo sapiens
atacacatttgcta

SEQ ID NO: 575005 - DNA, 20 bp, Homo sapiens
atacattttttaagcttcag

SEQ ID NO: 575006 - DNA, 15 bp, Homo sapiens
ataccacatcaaata

SEQ ID NO: 575007 - DNA, 14 bp, Homo sapiens
atactaaagtgtct

SEQ ID NO: 575008 - DNA, 22 bp, Homo sapiens
atactatatttttctcaatgtt

SEQ ID NO: 575009 - DNA, 21 bp, Homo sapiens
atacttcatgaaatcctgggt

SEQ ID NO: 575010 - DNA, 13 bp, Homo sapiens
atagacatgaaag

SEQ ID NO: 575011 - DNA, 17 bp, Homo sapiens
atagcagccagttcaaa

SEQ ID NO: 575012 - DNA, 15 bp, Homo sapiens
atagccctatttatc

SEQ ID NO: 575013 - DNA, 16 bp, Homo sapiens
atagctaagatataat

SEQ ID NO: 575014 - DNA, 17 bp, Homo sapiens
atagtgcttaaaaatca

SEQ ID NO: 575015 - DNA, 14 bp, Homo sapiens
atataacacatttt

SEQ ID NO: 575016 - DNA, 16 bp, Homo sapiens
atataatactaaagtg

SEQ ID NO: 575017 - DNA, 12 bp, Homo sapiens
atatataaatgt

SEQ ID NO: 575018 - DNA, 13 bp, Homo sapiens
atatataaatgta

SEQ ID NO: 575019 - DNA, 14 bp, Homo sapiens
atatataaatgtat

SEQ ID NO: 575020 - DNA, 20 bp, Homo sapiens
atatattttgtgtgaaattg

SEQ ID NO: 575021 - DNA, 22 bp, Homo sapiens
atatattttgtgtgaaattgca

SEQ ID NO: 575022 - DNA, 15 bp, Homo sapiens
atatcctgagccatc

SEQ ID NO: 575023 - DNA, 18 bp, Homo sapiens
atatgacggaagaacata

SEQ ID NO: 575024 - DNA, 20 bp, Homo sapiens
atatgacggaagaacataga

SEQ ID NO: 575025 - DNA, 23 bp, Homo sapiens
atatgacggaagaacatagaact

SEQ ID NO: 575026 - DNA, 14 bp, Homo sapiens
atatgctttattaa

SEQ ID NO: 575027 - DNA, 20 bp, Homo sapiens
atatgctttattaatgtttt

SEQ ID NO: 575028 - DNA, 13 bp, Homo sapiens
atatgtattcttt

SEQ ID NO: 575029 - DNA, 14 bp, Homo sapiens
atatgtattctttt

SEQ ID NO: 575030 - DNA, 18 bp, Homo sapiens
atatgtattcttttctca

SEQ ID NO: 575031 - DNA, 15 bp, Homo sapiens
atattaggaaaatat

SEQ ID NO: 575032 - DNA, 17 bp, Homo sapiens
atattccagatctttca

SEQ ID NO: 575033 - DNA, 21 bp, Homo sapiens
atattccagatctttcagaaa

SEQ ID NO: 575034 - DNA, 16 bp, Homo sapiens
atattgtttggtaaat

SEQ ID NO: 575035 - DNA, 15 bp, Homo sapiens
atcaaacctttgagt

SEQ ID NO: 575036 - DNA, 18 bp, Homo sapiens
atcaatgataatgctaat

SEQ ID NO: 575037 - DNA, 23 bp, Homo sapiens
atcagtaacccccttaaatttaa

SEQ ID NO: 575038 - DNA, 12 bp, Homo sapiens
atcattcagaaa

SEQ ID NO: 575039 - DNA, 13 bp, Homo sapiens
atcattcagaaat

SEQ ID NO: 575040 - DNA, 16 bp, Homo sapiens
atcattcagaaatgtt

SEQ ID NO: 575041 - DNA, 18 bp, Homo sapiens
atcattgattgtcagcta

SEQ ID NO: 575042 - DNA, 21 bp, Homo sapiens
atccacagactccctcccctg

SEQ ID NO: 575043 - DNA, 13 bp, Homo sapiens
atcccctaaaata

SEQ ID NO: 575044 - DNA, 13 bp, Homo sapiens
atcccgggcctca

SEQ ID NO: 575045 - DNA, 19 bp, Homo sapiens
atcccgggcctcagtgccc

SEQ ID NO: 575046 - DNA, 23 bp, Homo sapiens
atcctaagtgggaagtgaagccc

SEQ ID NO: 575047 - DNA, 18 bp, Homo sapiens
atcctactaataaaccag

SEQ ID NO: 575048 - DNA, 23 bp, Homo sapiens
atccttcatcgaacaaactgatg

SEQ ID NO: 575049 - DNA, 19 bp, Homo sapiens
tgtttgccaggacatgcaa

SEQ ID NO: 575050 - DNA, 19 bp, Homo sapiens
tattgtgaagtacatatta

SEQ ID NO: 575051 - DNA, 16 bp, Homo sapiens
tattgtttaaaatgta

SEQ ID NO: 575052 - DNA, 17 bp, Homo sapiens
tattgtttaaaatgtaa

SEQ ID NO: 575053 - DNA, 16 bp, Homo sapiens
tattgtttggtaaatg

SEQ ID NO: 575054 - DNA, 14 bp, Homo sapiens
tatttaacaaaatt

SEQ ID NO: 575055 - DNA, 17 bp, Homo sapiens
tatttaggcagattgaa

SEQ ID NO: 575056 - DNA, 16 bp, Homo sapiens
tatttgaagatttaat

SEQ ID NO: 575057 - DNA, 16 bp, Homo sapiens
taaattgcatcactgt

SEQ ID NO: 575058 - DNA, 19 bp, Homo sapiens
taaattgcatcactgtatc

SEQ ID NO: 575059 - DNA, 18 bp, Homo sapiens
taacaacaattatttgaa

SEQ ID NO: 575060 - DNA, 19 bp, Homo sapiens
taacaacaattatttgaag

SEQ ID NO: 575061 - DNA, 17 bp, Homo sapiens
taacacagcatgtgtat

SEQ ID NO: 575062 - DNA, 19 bp, Homo sapiens
taaccaatcctactaataa

SEQ ID NO: 575063 - DNA, 19 bp, Homo sapiens
taacccccttaaatttaat

SEQ ID NO: 575064 - DNA, 22 bp, Homo sapiens
taagaagaagttcatgtccaaa

SEQ ID NO: 575065 - DNA, 15 bp, Homo sapiens
taagaagacatgaac

SEQ ID NO: 575066 - DNA, 22 bp, Homo sapiens
taagaataccacatcaaataag

SEQ ID NO: 575067 - DNA, 17 bp, Homo sapiens
taagacacacctctgga

SEQ ID NO: 575068 - DNA, 23 bp, Homo sapiens
taagactatatatataaatgtat

SEQ ID NO: 575069 - DNA, 23 bp, Homo sapiens
taagatataatttaaacgtgatt

SEQ ID NO: 575070 - DNA, 17 bp, Homo sapiens
taagatatctcaatgaa

SEQ ID NO: 575071 - DNA, 19 bp, Homo sapiens
taagcaaatgttaaaagtt

SEQ ID NO: 575072 - DNA, 21 bp, Homo sapiens
taagctaaagaggctgaaaga

SEQ ID NO: 575073 - DNA, 17 bp, Homo sapiens
taagcttcagttgcttg

SEQ ID NO: 575074 - DNA, 15 bp, Homo sapiens
taaggaaccttcctt

SEQ ID NO: 575075 - DNA, 19 bp, Homo sapiens
taaggaaccttccttcctg

SEQ ID NO: 575076 - DNA, 17 bp, Homo sapiens
taaggcatatttaacaa

SEQ ID NO: 575077 - DNA, 16 bp, Homo sapiens
taaggggaagaatgaa

SEQ ID NO: 575078 - DNA, 19 bp, Homo sapiens
taagtgggaagtgaagccc

SEQ ID NO: 575079 - DNA, 15 bp, Homo sapiens
taataaatatttatg

SEQ ID NO: 575080 - DNA, 15 bp, Homo sapiens
taataagcactgtaa

SEQ ID NO: 575081 - DNA, 16 bp, Homo sapiens
taatactaaagtgtct

SEQ ID NO: 575082 - DNA, 20 bp, Homo sapiens
taatattcagggtaaatagg

SEQ ID NO: 575083 - DNA, 19 bp, Homo sapiens
taatcccctaaaataacag

SEQ ID NO: 575084 - DNA, 17 bp, Homo sapiens
taatcttcaaagccttc

SEQ ID NO: 575085 - DNA, 21 bp, Homo sapiens
taatgtgacttggattcaatt

SEQ ID NO: 575086 - DNA, 23 bp, Homo sapiens
taatgtgtggattgcctctgaaa

SEQ ID NO: 575087 - DNA, 15 bp, Homo sapiens
taatgtttatgagcc

SEQ ID NO: 575088 - DNA, 17 bp, Homo sapiens
taatgtttatgagccag

SEQ ID NO: 575089 - DNA, 18 bp, Homo sapiens
taatgtttatgagccaga

SEQ ID NO: 575090 - DNA, 13 bp, Homo sapiens
taatgttttcaaa

SEQ ID NO: 575091 - DNA, 14 bp, Homo sapiens
taatgttttcaaaa

SEQ ID NO: 575092 - DNA, 17 bp, Homo sapiens
taattgtacaaaattaa

SEQ ID NO: 575093 - DNA, 20 bp, Homo sapiens
taatttacttgttttggatg

SEQ ID NO: 575094 - DNA, 23 bp, Homo sapiens
tacaatattgattgggaaaacat

SEQ ID NO: 575095 - DNA, 21 bp, Homo sapiens
tacaattttccctcttcactt

SEQ ID NO: 575096 - DNA, 13 bp, Homo sapiens
tacacatttgcta

SEQ ID NO: 575097 - DNA, 18 bp, Homo sapiens
tacatcaatgataatgct

SEQ ID NO: 575098 - DNA, 19 bp, Homo sapiens
tacatcccgggcctcagtg

SEQ ID NO: 575099 - DNA, 22 bp, Homo sapiens
tacatcccgggcctcagtgccc

SEQ ID NO: 575100 - DNA, 14 bp, Homo sapiens
tacatgcatttgag

SEQ ID NO: 575101 - DNA, 18 bp, Homo sapiens
tacatgtgatacattttt

SEQ ID NO: 575102 - DNA, 15 bp, Homo sapiens
tacattttttaagct

SEQ ID NO: 575103 - DNA, 14 bp, Homo sapiens
taccaggtgttcta

SEQ ID NO: 575104 - DNA, 17 bp, Homo sapiens
tacccatagacatgaaa

SEQ ID NO: 575105 - DNA, 18 bp, Homo sapiens
tacccatagacatgaaag

SEQ ID NO: 575106 - DNA, 14 bp, Homo sapiens
taccttatcttaca

SEQ ID NO: 575107 - DNA, 18 bp, Homo sapiens
tacctttctctctctaag

SEQ ID NO: 575108 - DNA, 13 bp, Homo sapiens
tactaaacatgta

SEQ ID NO: 575109 - DNA, 15 bp, Homo sapiens
tactaaagtgtctat

SEQ ID NO: 575110 - DNA, 19 bp, Homo sapiens
tactattcaggtaacacta

SEQ ID NO: 575111 - DNA, 15 bp, Homo sapiens
tactctacaaaatat

SEQ ID NO: 575112 - DNA, 16 bp, Homo sapiens
tactgacatttcttct

SEQ ID NO: 575113 - DNA, 19 bp, Homo sapiens
tactgtctattaatattca

SEQ ID NO: 575114 - DNA, 23 bp, Homo sapiens
tacttaaatggtaataagcactg

SEQ ID NO: 575115 - DNA, 13 bp, Homo sapiens
tacttgttttgga

SEQ ID NO: 575116 - DNA, 21 bp, Homo sapiens
tactttgtattttgattattt

SEQ ID NO: 575117 - DNA, 13 bp, Homo sapiens
tagataatattgt

SEQ ID NO: 575118 - DNA, 22 bp, Homo sapiens
tagatatgtattcttttctcag

SEQ ID NO: 575119 - DNA, 21 bp, Homo sapiens
tagatccatttccattgctta

SEQ ID NO: 575120 - DNA, 19 bp, Homo sapiens
tagctaagatataatttaa

SEQ ID NO: 575121 - DNA, 19 bp, Homo sapiens
tagctcctccccttcctct

SEQ ID NO: 575122 - DNA, 22 bp, Homo sapiens
tagctgaagaattgaaaagttt

SEQ ID NO: 575123 - DNA, 19 bp, Homo sapiens
tagggaagctggcctgaga

SEQ ID NO: 575124 - DNA, 20 bp, Homo sapiens
tagggactacccatagacat

SEQ ID NO: 575125 - DNA, 18 bp, Homo sapiens
taggggaaggagaagtaa

SEQ ID NO: 575126 - DNA, 11 bp, Homo sapiens
tagtaagaata

SEQ ID NO: 575127 - DNA, 22 bp, Homo sapiens
tagtaagaataccacatcaaat

SEQ ID NO: 575128 - DNA, 19 bp, Homo sapiens
tagtgatgatggttcacgt

SEQ ID NO: 575129 - DNA, 18 bp, Homo sapiens
tagttttctttgtaaagg

SEQ ID NO: 575130 - DNA, 12 bp, Homo sapiens
tataaaattatg

SEQ ID NO: 575131 - DNA, 17 bp, Homo sapiens
tataaacagaaatggaa

SEQ ID NO: 575132 - DNA, 18 bp, Homo sapiens
tataaacagaaatggaaa

SEQ ID NO: 575133 - DNA, 15 bp, Homo sapiens
tataaactactgtaa

SEQ ID NO: 575134 - DNA, 16 bp, Homo sapiens
tataaactactgtaat

SEQ ID NO: 575135 - DNA, 14 bp, Homo sapiens
tataacacattttt

SEQ ID NO: 575136 - DNA, 14 bp, Homo sapiens
tataattgtacaaa

SEQ ID NO: 575137 - DNA, 23 bp, Homo sapiens
tataattgtacaaaattaagcaa

SEQ ID NO: 575138 - DNA, 13 bp, Homo sapiens
tatataaatgtat

SEQ ID NO: 575139 - DNA, 14 bp, Homo sapiens
tatataatactaaa

SEQ ID NO: 575140 - DNA, 13 bp, Homo sapiens
tatatataaatgt

SEQ ID NO: 575141 - DNA, 16 bp, Homo sapiens
tatatattttgtgtga

SEQ ID NO: 575142 - DNA, 23 bp, Homo sapiens
tatatattttgtgtgaaattgca

SEQ ID NO: 575143 - DNA, 15 bp, Homo sapiens
tatattttatattac

SEQ ID NO: 575144 - DNA, 16 bp, Homo sapiens
tatattttgtgtgaaa

SEQ ID NO: 575145 - DNA, 18 bp, Homo sapiens
tatattttgtgtgaaatt

SEQ ID NO: 575146 - DNA, 20 bp, Homo sapiens
tatcattttcttttttaacc

SEQ ID NO: 575147 - DNA, 22 bp, Homo sapiens
tatccacagactccctcccctg

SEQ ID NO: 575148 - DNA, 20 bp, Homo sapiens
tatcgtttttgtattttcat

SEQ ID NO: 575149 - DNA, 16 bp, Homo sapiens
tatctcaatgaaccat

SEQ ID NO: 575150 - DNA, 16 bp, Homo sapiens
tatgacggaagaacat

SEQ ID NO: 575151 - DNA, 12 bp, Homo sapiens
tatgactaaaga

SEQ ID NO: 575152 - DNA, 13 bp, Homo sapiens
tatgactaaagag

SEQ ID NO: 575153 - DNA, 16 bp, Homo sapiens
tatgactaaagagaga

SEQ ID NO: 575154 - DNA, 19 bp, Homo sapiens
tatgactaaagagagaatg

SEQ ID NO: 575155 - DNA, 14 bp, Homo sapiens
tatgagtagccagg

SEQ ID NO: 575156 - DNA, 15 bp, Homo sapiens
tatgtaacaacaatt

SEQ ID NO: 575157 - DNA, 19 bp, Homo sapiens
tatgtaacaacaattattt

SEQ ID NO: 575158 - DNA, 19 bp, Homo sapiens
tatgtgggatattgaatgt

SEQ ID NO: 575159 - DNA, 19 bp, Homo sapiens
tatgtgggggcttcatctc

SEQ ID NO: 575160 - DNA, 14 bp, Homo sapiens
tatgttaaagagaa

SEQ ID NO: 575161 - DNA, 18 bp, Homo sapiens
tattaatgttttcaaaag

SEQ ID NO: 575162 - DNA, 16 bp, Homo sapiens
tattactgacatttct

SEQ ID NO: 575163 - DNA, 20 bp, Homo sapiens
tattagttttctttgtaaag

SEQ ID NO: 575164 - DNA, 21 bp, Homo sapiens
tattatacatgtgatacattt

SEQ ID NO: 575165 - DNA, 20 bp, Homo sapiens
tattatttttataattgtac

SEQ ID NO: 575166 - DNA, 20 bp, Homo sapiens
tattatttttttaaaatttt

SEQ ID NO: 575167 - DNA, 14 bp, Homo sapiens
tattgattgggaaa

SEQ ID NO: 575168 - DNA, 19 bp, Homo sapiens
tattgattgggaaaacatt

SEQ ID NO: 575169 - DNA, 20 bp, Homo sapiens
tattgattgggaaaacattt

SEQ ID NO: 575170 - DNA, 22 bp, Homo sapiens
tattgattgggaaaacatttgc

SEQ ID NO: 575171 - DNA, 21 bp, Homo sapiens
tattgccacaatgcctctccc

SEQ ID NO: 575172 - DNA, 15 bp, Homo sapiens
tattgtgaagtacat

SEQ ID NO: 575173 - DNA, 13 bp, Homo sapiens
ggtaaatgtttct

SEQ ID NO: 575174 - DNA, 16 bp, Homo sapiens
ggtaaatgtttctttt

SEQ ID NO: 575175 - DNA, 20 bp, Homo sapiens
ggtcaagtaagaagacatga

SEQ ID NO: 575176 - DNA, 22 bp, Homo sapiens
ggtccagcctcgttggaagagg

SEQ ID NO: 575177 - DNA, 18 bp, Homo sapiens
ggtccagtggatgccaca

SEQ ID NO: 575178 - DNA, 15 bp, Homo sapiens
ggttcaagccttcca

SEQ ID NO: 575179 - DNA, 17 bp, Homo sapiens
ggttttcttaaccatct

SEQ ID NO: 575180 - DNA, 22 bp, Homo sapiens
gtaaactataaactactgtaat

SEQ ID NO: 575181 - DNA, 23 bp, Homo sapiens
gtaaactataaactactgtaatt

SEQ ID NO: 575182 - DNA, 16 bp, Homo sapiens
gtaaacttctgcaaca

SEQ ID NO: 575183 - DNA, 14 bp, Homo sapiens
gtaaatgtttcttt

SEQ ID NO: 575184 - DNA, 22 bp, Homo sapiens
gtaagatatctcaatgaaccat

SEQ ID NO: 575185 - DNA, 13 bp, Homo sapiens
gtaataagcactg

SEQ ID NO: 575186 - DNA, 22 bp, Homo sapiens
gtaattaagtgcaatttcccct

SEQ ID NO: 575187 - DNA, 21 bp, Homo sapiens
gtaatttaaatgaaagaaaat

SEQ ID NO: 575188 - DNA, 23 bp, Homo sapiens
gtaatttaaatgaaagaaaattg

SEQ ID NO: 575189 - DNA, 14 bp, Homo sapiens
gtactgaaagcctt

SEQ ID NO: 575190 - DNA, 22 bp, Homo sapiens
gtactgaaagccttagggaagc

SEQ ID NO: 575191 - DNA, 19 bp, Homo sapiens
gtactgccccccatgagga

SEQ ID NO: 575192 - DNA, 22 bp, Homo sapiens
gtactgccccccatgaggaagg

SEQ ID NO: 575193 - DNA, 23 bp, Homo sapiens
gtacttaaatggtaataagcact

SEQ ID NO: 575194 - DNA, 17 bp, Homo sapiens
gtagatatgtattcttt

SEQ ID NO: 575195 - DNA, 15 bp, Homo sapiens
gtagatccatttcca

SEQ ID NO: 575196 - DNA, 22 bp, Homo sapiens
gtagatccatttccattgctta

SEQ ID NO: 575197 - DNA, 15 bp, Homo sapiens
gtaggggtgtgtgtg

SEQ ID NO: 575198 - DNA, 22 bp, Homo sapiens
gtatatattttgtgtgaaattg

SEQ ID NO: 575199 - DNA, 20 bp, Homo sapiens
gtatgactaaagagagaatg

SEQ ID NO: 575200 - DNA, 16 bp, Homo sapiens
gtatgtgcatttaatt

SEQ ID NO: 575201 - DNA, 20 bp, Homo sapiens
gtatgtgggatattgaatgt

SEQ ID NO: 575202 - DNA, 22 bp, Homo sapiens
gtattcagtgagggtcttctta

SEQ ID NO: 575203 - DNA, 23 bp, Homo sapiens
gtattgccacaatgcctctccca

SEQ ID NO: 575204 - DNA, 16 bp, Homo sapiens
gtatttccagtgcaat

SEQ ID NO: 575205 - DNA, 19 bp, Homo sapiens
gtattttcatgaaaatacc

SEQ ID NO: 575206 - DNA, 14 bp, Homo sapiens
gtcaagtaagaaga

SEQ ID NO: 575207 - DNA, 23 bp, Homo sapiens
gtcagagtaacatgccagcttcc

SEQ ID NO: 575208 - DNA, 19 bp, Homo sapiens
gtcagctactaatgatgtt

SEQ ID NO: 575209 - DNA, 19 bp, Homo sapiens
gtcatggaaaagcccagtg

SEQ ID NO: 575210 - DNA, 19 bp, Homo sapiens
gtcattgcacataagcttc

SEQ ID NO: 575211 - DNA, 22 bp, Homo sapiens
gtccaagcaacagcctttgaat

SEQ ID NO: 575212 - DNA, 12 bp, Homo sapiens
gtccagtgccta

SEQ ID NO: 575213 - DNA, 17 bp, Homo sapiens
gtccctgcttacctgac

SEQ ID NO: 575214 - DNA, 11 bp, Homo sapiens
gtcctctcccc

SEQ ID NO: 575215 - DNA, 23 bp, Homo sapiens
gtcctctcccgcgggcctggaca

SEQ ID NO: 575216 - DNA, 17 bp, Homo sapiens
gtcctgctggcacctca

SEQ ID NO: 575217 - DNA, 19 bp, Homo sapiens
gtccttgatttcaaagttt

SEQ ID NO: 575218 - DNA, 14 bp, Homo sapiens
gtctattagttttc

SEQ ID NO: 575219 - DNA, 13 bp, Homo sapiens
gtctgatttctta

SEQ ID NO: 575220 - DNA, 16 bp, Homo sapiens
gtctttcatggctgct

SEQ ID NO: 575221 - DNA, 19 bp, Homo sapiens
gtgaaactaacagataagc

SEQ ID NO: 575222 - DNA, 20 bp, Homo sapiens
gtgaaattgcatactttgta

SEQ ID NO: 575223 - DNA, 19 bp, Homo sapiens
gtgaagagggagaagcatg

SEQ ID NO: 575224 - DNA, 18 bp, Homo sapiens
gtgaagttttactgtcta

SEQ ID NO: 575225 - DNA, 22 bp, Homo sapiens
gtgatccttcatcgaacaaact

SEQ ID NO: 575226 - DNA, 19 bp, Homo sapiens
gtgatctgtcccctctccc

SEQ ID NO: 575227 - DNA, 23 bp, Homo sapiens
gtgatttgaaaaatataaaatta

SEQ ID NO: 575228 - DNA, 16 bp, Homo sapiens
gtgatttttaaattaa

SEQ ID NO: 575229 - DNA, 17 bp, Homo sapiens
gtgcactccctaagaaa

SEQ ID NO: 575230 - DNA, 18 bp, Homo sapiens
gtgcatttttgtgaaatg

SEQ ID NO: 575231 - DNA, 17 bp, Homo sapiens
gtgctattgaactgagc

SEQ ID NO: 575232 - DNA, 18 bp, Homo sapiens
gtgctattgaactgagcc

SEQ ID NO: 575233 - DNA, 21 bp, Homo sapiens
gtggatgccacagcccagctt

SEQ ID NO: 575234 - DNA, 14 bp, Homo sapiens
gtgggagacaagga

SEQ ID NO: 575235 - DNA, 17 bp, Homo sapiens
gtggggcacagatgcct

SEQ ID NO: 575236 - DNA, 14 bp, Homo sapiens
gtgtgtgtgtgtgt

SEQ ID NO: 575237 - DNA, 15 bp, Homo sapiens
gttaaagagaatgag

SEQ ID NO: 575238 - DNA, 21 bp, Homo sapiens
gttaaagggatatttttttct

SEQ ID NO: 575239 - DNA, 22 bp, Homo sapiens
gttacaggcaccgagaatgttg

SEQ ID NO: 575240 - DNA, 14 bp, Homo sapiens
gttcaagccttcca

SEQ ID NO: 575241 - DNA, 21 bp, Homo sapiens
gttccgaaaccaaagaagaaa

SEQ ID NO: 575242 - DNA, 15 bp, Homo sapiens
gttgagtctgtacta

SEQ ID NO: 575243 - DNA, 17 bp, Homo sapiens
gttgcagtctcagaaag

SEQ ID NO: 575244 - DNA, 18 bp, Homo sapiens
gttgctgctgtccagtgc

SEQ ID NO: 575245 - DNA, 14 bp, Homo sapiens
gttgcttgtcttct

SEQ ID NO: 575246 - DNA, 13 bp, Homo sapiens
gtttaaaatgtaa

SEQ ID NO: 575247 - DNA, 19 bp, Homo sapiens
gtttaaaatgtaatttaaa

SEQ ID NO: 575248 - DNA, 14 bp, Homo sapiens
gtttcttttaaaga

SEQ ID NO: 575249 - DNA, 14 bp, Homo sapiens
gtttcttttgtttg

SEQ ID NO: 575250 - DNA, 18 bp, Homo sapiens
gtttcttttgtttggtaa

SEQ ID NO: 575251 - DNA, 19 bp, Homo sapiens
gtttggtaaatgtttcttt

SEQ ID NO: 575252 - DNA, 13 bp, Homo sapiens
gtttgttggaaag

SEQ ID NO: 575253 - DNA, 15 bp, Homo sapiens
gttttactgtctatt

SEQ ID NO: 575254 - DNA, 16 bp, Homo sapiens
gttttcttaaccatct

SEQ ID NO: 575255 - DNA, 17 bp, Homo sapiens
gttttcttaaccatctt

SEQ ID NO: 575256 - DNA, 11 bp, Homo sapiens
taaaaatcttt

SEQ ID NO: 575257 - DNA, 18 bp, Homo sapiens
taaaaatcttttgaagca

SEQ ID NO: 575258 - DNA, 15 bp, Homo sapiens
taaaacaatttattt

SEQ ID NO: 575259 - DNA, 19 bp, Homo sapiens
taaaatgtaatttaaatga

SEQ ID NO: 575260 - DNA, 15 bp, Homo sapiens
taaaattatgagatt

SEQ ID NO: 575261 - DNA, 16 bp, Homo sapiens
taaaattttgtatgtt

SEQ ID NO: 575262 - DNA, 23 bp, Homo sapiens
taaaattttgtatgttaaagaga

SEQ ID NO: 575263 - DNA, 20 bp, Homo sapiens
taaaatttttatgtaattat

SEQ ID NO: 575264 - DNA, 12 bp, Homo sapiens
taaacagaaatg

SEQ ID NO: 575265 - DNA, 14 bp, Homo sapiens
taaacagaaatgga

SEQ ID NO: 575266 - DNA, 22 bp, Homo sapiens
taaaccacttaaacgaagagtt

SEQ ID NO: 575267 - DNA, 21 bp, Homo sapiens
taaacctaggacttccgagct

SEQ ID NO: 575268 - DNA, 13 bp, Homo sapiens
taaactactgtaa

SEQ ID NO: 575269 - DNA, 16 bp, Homo sapiens
taaactataaactact

SEQ ID NO: 575270 - DNA, 19 bp, Homo sapiens
taaactataaactactgta

SEQ ID NO: 575271 - DNA, 20 bp, Homo sapiens
taaactataaactactgtaa

SEQ ID NO: 575272 - DNA, 23 bp, Homo sapiens
taaacttctgcaacaagcatgca

SEQ ID NO: 575273 - DNA, 14 bp, Homo sapiens
taaagaagtaaatt

SEQ ID NO: 575274 - DNA, 21 bp, Homo sapiens
taaagaagtaaatttgtccaa

SEQ ID NO: 575275 - DNA, 23 bp, Homo sapiens
taaagaccctcctattctataaa

SEQ ID NO: 575276 - DNA, 12 bp, Homo sapiens
taaagagagaat

SEQ ID NO: 575277 - DNA, 17 bp, Homo sapiens
taaagaggctgaaagag

SEQ ID NO: 575278 - DNA, 22 bp, Homo sapiens
taaagggatatttttttctatt

SEQ ID NO: 575279 - DNA, 23 bp, Homo sapiens
taaagtgtctattagttttcttt

SEQ ID NO: 575280 - DNA, 19 bp, Homo sapiens
taaataaaaactaattaag

SEQ ID NO: 575281 - DNA, 20 bp, Homo sapiens
taaatacatgccacatcaaa

SEQ ID NO: 575282 - DNA, 16 bp, Homo sapiens
taaatatttatgtaga

SEQ ID NO: 575283 - DNA, 20 bp, Homo sapiens
taaatgcatatcctgagcca

SEQ ID NO: 575284 - DNA, 18 bp, Homo sapiens
taaatggtaataagcact

SEQ ID NO: 575285 - DNA, 19 bp, Homo sapiens
taaatggtaataagcactg

SEQ ID NO: 575286 - DNA, 19 bp, Homo sapiens
taaatgtataaatatacag

SEQ ID NO: 575287 - DNA, 19 bp, Homo sapiens
taaatgtttcttttgtttg

SEQ ID NO: 575288 - DNA, 13 bp, Homo sapiens
cttttataaagca

SEQ ID NO: 575289 - DNA, 16 bp, Homo sapiens
cttttataaagcatgt

SEQ ID NO: 575290 - DNA, 17 bp, Homo sapiens
cttttctcagtgttggt

SEQ ID NO: 575291 - DNA, 16 bp, Homo sapiens
cttttgtttggtaaat

SEQ ID NO: 575292 - DNA, 16 bp, Homo sapiens
cttttttttttcttgg

SEQ ID NO: 575293 - DNA, 16 bp, Homo sapiens
gaaaaagttgcagtct

SEQ ID NO: 575294 - DNA, 14 bp, Homo sapiens
gaaaacatgttaat

SEQ ID NO: 575295 - DNA, 16 bp, Homo sapiens
gaaaacatgttaatga

SEQ ID NO: 575296 - DNA, 12 bp, Homo sapiens
gaaaacttgaat

SEQ ID NO: 575297 - DNA, 12 bp, Homo sapiens
gaaaagcccagt

SEQ ID NO: 575298 - DNA, 13 bp, Homo sapiens
gaaaaggaagact

SEQ ID NO: 575299 - DNA, 15 bp, Homo sapiens
gaaaccaaagaagaa

SEQ ID NO: 575300 - DNA, 17 bp, Homo sapiens
gaaactttgggaaaaca

SEQ ID NO: 575301 - DNA, 22 bp, Homo sapiens
gaaagtgggcttaatggagttc

SEQ ID NO: 575302 - DNA, 19 bp, Homo sapiens
gaaagtttttttttattat

SEQ ID NO: 575303 - DNA, 21 bp, Homo sapiens
gaaataatgctacaattttaa

SEQ ID NO: 575304 - DNA, 23 bp, Homo sapiens
gaaataatgctacaattttaaga

SEQ ID NO: 575305 - DNA, 16 bp, Homo sapiens
gaaatgaaaacatgta

SEQ ID NO: 575306 - DNA, 16 bp, Homo sapiens
gaaatggaaagcagag

SEQ ID NO: 575307 - DNA, 16 bp, Homo sapiens
gaacctgtcctaagga

SEQ ID NO: 575308 - DNA, 13 bp, Homo sapiens
gaactgagccaaa

SEQ ID NO: 575309 - DNA, 16 bp, Homo sapiens
gaactgagccaaacac

SEQ ID NO: 575310 - DNA, 22 bp, Homo sapiens
gaactgagccaaacacactgta

SEQ ID NO: 575311 - DNA, 15 bp, Homo sapiens
gaactgcagggttca

SEQ ID NO: 575312 - DNA, 13 bp, Homo sapiens
gaagaacatagaa

SEQ ID NO: 575313 - DNA, 17 bp, Homo sapiens
gaagaattgaaaagttt

SEQ ID NO: 575314 - DNA, 18 bp, Homo sapiens
gaagaattgaaaagtttt

SEQ ID NO: 575315 - DNA, 21 bp, Homo sapiens
gaagaattgaaaagtttttgt

SEQ ID NO: 575316 - DNA, 22 bp, Homo sapiens
gaagaattgaaaagtttttgtt

SEQ ID NO: 575317 - DNA, 20 bp, Homo sapiens
gaagagggagaagcatgaaa

SEQ ID NO: 575318 - DNA, 12 bp, Homo sapiens
gaagatttaatt

SEQ ID NO: 575319 - DNA, 10 bp, Homo sapiens
gaagcccagt

SEQ ID NO: 575320 - DNA, 15 bp, Homo sapiens
gaagcccagtttccc

SEQ ID NO: 575321 - DNA, 21 bp, Homo sapiens
gaagccccttgtcctctcccg

SEQ ID NO: 575322 - DNA, 20 bp, Homo sapiens
gaagcggccctaagggagtg

SEQ ID NO: 575323 - DNA, 15 bp, Homo sapiens
gaagctggcctgaga

SEQ ID NO: 575324 - DNA, 17 bp, Homo sapiens
gaatatgacggaagaac

SEQ ID NO: 575325 - DNA, 19 bp, Homo sapiens
gaatatgacggaagaacat

SEQ ID NO: 575326 - DNA, 18 bp, Homo sapiens
gaatcattcagaaatgtt

SEQ ID NO: 575327 - DNA, 16 bp, Homo sapiens
gaatctgttactgaaa

SEQ ID NO: 575328 - DNA, 18 bp, Homo sapiens
gaatctgttactgaaatg

SEQ ID NO: 575329 - DNA, 23 bp, Homo sapiens
gaatctgttactgaaatgaggag

SEQ ID NO: 575330 - DNA, 23 bp, Homo sapiens
gaatgaggaaaattcttaaaagg

SEQ ID NO: 575331 - DNA, 13 bp, Homo sapiens
gaatgttaaaggg

SEQ ID NO: 575332 - DNA, 15 bp, Homo sapiens
gaattctgattgatt

SEQ ID NO: 575333 - DNA, 17 bp, Homo sapiens
gacaatcaactctaata

SEQ ID NO: 575334 - DNA, 12 bp, Homo sapiens
gacacacctctg

SEQ ID NO: 575335 - DNA, 19 bp, Homo sapiens
gacacttatggggacagca

SEQ ID NO: 575336 - DNA, 20 bp, Homo sapiens
gacagcataccttggactga

SEQ ID NO: 575337 - DNA, 17 bp, Homo sapiens
gacatgcaataaaattt

SEQ ID NO: 575338 - DNA, 21 bp, Homo sapiens
gaccacagggttcaaaatgtc

SEQ ID NO: 575339 - DNA, 23 bp, Homo sapiens
gaccacttccaggggaacctgcc

SEQ ID NO: 575340 - DNA, 17 bp, Homo sapiens
gaccctgttttccacac

SEQ ID NO: 575341 - DNA, 18 bp, Homo sapiens
gaccctgttttccacacc

SEQ ID NO: 575342 - DNA, 20 bp, Homo sapiens
gactaccagctaactccagt

SEQ ID NO: 575343 - DNA, 14 bp, Homo sapiens
gactccctcccctg

SEQ ID NO: 575344 - DNA, 17 bp, Homo sapiens
gactgccttgcctcctc

SEQ ID NO: 575345 - DNA, 23 bp, Homo sapiens
gagacgtttataaacagaaatgg

SEQ ID NO: 575346 - DNA, 16 bp, Homo sapiens
gagaggtccctgctta

SEQ ID NO: 575347 - DNA, 17 bp, Homo sapiens
gagattggttttcctgt

SEQ ID NO: 575348 - DNA, 23 bp, Homo sapiens
gagccaaacacactgtaaatatc

SEQ ID NO: 575349 - DNA, 23 bp, Homo sapiens
gaggaatatgacggaagaacata

SEQ ID NO: 575350 - DNA, 23 bp, Homo sapiens
gaggcttgtttacctttctctct

SEQ ID NO: 575351 - DNA, 16 bp, Homo sapiens
gaggtcaagtaagaag

SEQ ID NO: 575352 - DNA, 21 bp, Homo sapiens
gaggtgggagacaaggaacca

SEQ ID NO: 575353 - DNA, 13 bp, Homo sapiens
gagtgtatgagta

SEQ ID NO: 575354 - DNA, 13 bp, Homo sapiens
gatagtaagcata

SEQ ID NO: 575355 - DNA, 13 bp, Homo sapiens
gatataatttaaa

SEQ ID NO: 575356 - DNA, 17 bp, Homo sapiens
gatccatttccattgct

SEQ ID NO: 575357 - DNA, 22 bp, Homo sapiens
gatcctgggtactgaaagcctt

SEQ ID NO: 575358 - DNA, 23 bp, Homo sapiens
gatccttcatcgaacaaactgat

SEQ ID NO: 575359 - DNA, 19 bp, Homo sapiens
gatctgtcccctctcccct

SEQ ID NO: 575360 - DNA, 20 bp, Homo sapiens
gatctgtcccctctcccctc

SEQ ID NO: 575361 - DNA, 12 bp, Homo sapiens
gatctttcagaa

SEQ ID NO: 575362 - DNA, 15 bp, Homo sapiens
gatggaaaaggaaga

SEQ ID NO: 575363 - DNA, 19 bp, Homo sapiens
gatggctggaaggggtcca

SEQ ID NO: 575364 - DNA, 23 bp, Homo sapiens
gatgtgcatttttgtgaaatgaa

SEQ ID NO: 575365 - DNA, 19 bp, Homo sapiens
gattctttccattatgatt

SEQ ID NO: 575366 - DNA, 17 bp, Homo sapiens
gatttaagatatgtaac

SEQ ID NO: 575367 - DNA, 22 bp, Homo sapiens
gatttaagggatggaaaaggaa

SEQ ID NO: 575368 - DNA, 19 bp, Homo sapiens
gatttccagaaccacactt

SEQ ID NO: 575369 - DNA, 22 bp, Homo sapiens
gatttccagaaccacacttgaa

SEQ ID NO: 575370 - DNA, 15 bp, Homo sapiens
gatttctcattgact

SEQ ID NO: 575371 - DNA, 14 bp, Homo sapiens
gatttcttttaaag

SEQ ID NO: 575372 - DNA, 15 bp, Homo sapiens
gatttgaaaaatata

SEQ ID NO: 575373 - DNA, 12 bp, Homo sapiens
gatttgcctcac

SEQ ID NO: 575374 - DNA, 12 bp, Homo sapiens
gcatgtgtattt

SEQ ID NO: 575375 - DNA, 21 bp, Homo sapiens
gcatgttcacccttatagtct

SEQ ID NO: 575376 - DNA, 15 bp, Homo sapiens
gcattgagtattgtt

SEQ ID NO: 575377 - DNA, 17 bp, Homo sapiens
gcattgagtattgttta

SEQ ID NO: 575378 - DNA, 18 bp, Homo sapiens
gcatttttgtgaaatgaa

SEQ ID NO: 575379 - DNA, 21 bp, Homo sapiens
gcatttttgtgaaatgaaaac

SEQ ID NO: 575380 - DNA, 21 bp, Homo sapiens
gccaagtccgcagaagccctg

SEQ ID NO: 575381 - DNA, 16 bp, Homo sapiens
gccacatcaaaccttt

SEQ ID NO: 575382 - DNA, 22 bp, Homo sapiens
gccaggacatgcaataaaattt

SEQ ID NO: 575383 - DNA, 15 bp, Homo sapiens
gccatgtgaagaggg

SEQ ID NO: 575384 - DNA, 17 bp, Homo sapiens
gccatgtgaagagggag

SEQ ID NO: 575385 - DNA, 20 bp, Homo sapiens
gcccaatgagactctagggt

SEQ ID NO: 575386 - DNA, 17 bp, Homo sapiens
gcccagtgacctgaccg

SEQ ID NO: 575387 - DNA, 18 bp, Homo sapiens
gccccattctcactgcta

SEQ ID NO: 575388 - DNA, 17 bp, Homo sapiens
gccccttgtcctctccc

SEQ ID NO: 575389 - DNA, 13 bp, Homo sapiens
gcccgaagcccag

SEQ ID NO: 575390 - DNA, 18 bp, Homo sapiens
gcccgaagcccagtttcc

SEQ ID NO: 575391 - DNA, 21 bp, Homo sapiens
gcctcaccatgtgagctcttc

SEQ ID NO: 575392 - DNA, 20 bp, Homo sapiens
gcctcaccttggggccttga

SEQ ID NO: 575393 - DNA, 13 bp, Homo sapiens
gcctcagtgcccc

SEQ ID NO: 575394 - DNA, 14 bp, Homo sapiens
gcctctcccacgat

SEQ ID NO: 575395 - DNA, 15 bp, Homo sapiens
gccttagggaagctg

SEQ ID NO: 575396 - DNA, 21 bp, Homo sapiens
gccttccagggatttgcctca

SEQ ID NO: 575397 - DNA, 23 bp, Homo sapiens
gccttccagggatttgcctcacc

SEQ ID NO: 575398 - DNA, 15 bp, Homo sapiens
gccttgcctcctcag

SEQ ID NO: 575399 - DNA, 17 bp, Homo sapiens
gccttgcctcctcagta

SEQ ID NO: 575400 - DNA, 14 bp, Homo sapiens
gccttggaaattcc

SEQ ID NO: 575401 - DNA, 13 bp, Homo sapiens
gcctttgaatgta

SEQ ID NO: 575402 - DNA, 17 bp, Homo sapiens
gcctttgaatgtaacca

SEQ ID NO: 575403 - DNA, 15 bp, Homo sapiens
gcgcagcccgaagcc

SEQ ID NO: 575404 - DNA, 16 bp, Homo sapiens
gcgcagcccgaagccc

SEQ ID NO: 575405 - DNA, 23 bp, Homo sapiens
gctaactccagtctcctgacatt

SEQ ID NO: 575406 - DNA, 16 bp, Homo sapiens
gctgaagaattgaaaa

SEQ ID NO: 575407 - DNA, 18 bp, Homo sapiens
gctgcagagatttctcat

SEQ ID NO: 575408 - DNA, 11 bp, Homo sapiens
gctggcacctc

SEQ ID NO: 575409 - DNA, 14 bp, Homo sapiens
gctggcacctcaga

SEQ ID NO: 575410 - DNA, 15 bp, Homo sapiens
gctgtccagtgccta

SEQ ID NO: 575411 - DNA, 17 bp, Homo sapiens
gctgtccagtgcctaca

SEQ ID NO: 575412 - DNA, 18 bp, Homo sapiens
gctgtccagtgcctacat

SEQ ID NO: 575413 - DNA, 22 bp, Homo sapiens
gcttaatcttcaaagccttctc

SEQ ID NO: 575414 - DNA, 18 bp, Homo sapiens
gcttaatgctacatgtga

SEQ ID NO: 575415 - DNA, 23 bp, Homo sapiens
gcttcatacttcatgaaatcctg

SEQ ID NO: 575416 - DNA, 19 bp, Homo sapiens
gcttcatctctttagagaa

SEQ ID NO: 575417 - DNA, 19 bp, Homo sapiens
gcttccattttaattttaa

SEQ ID NO: 575418 - DNA, 11 bp, Homo sapiens
gcttgcagaac

SEQ ID NO: 575419 - DNA, 13 bp, Homo sapiens
gctttaagccttc

SEQ ID NO: 575420 - DNA, 18 bp, Homo sapiens
gcttttggggagccagaa

SEQ ID NO: 575421 - DNA, 13 bp, Homo sapiens
ggaaaagcccagt

SEQ ID NO: 575422 - DNA, 16 bp, Homo sapiens
ggaaattcctgtactg

SEQ ID NO: 575423 - DNA, 16 bp, Homo sapiens
ggaaccttccttcctg

SEQ ID NO: 575424 - DNA, 13 bp, Homo sapiens
ggaagaacataga

SEQ ID NO: 575425 - DNA, 11 bp, Homo sapiens
ggaagaatgaa

SEQ ID NO: 575426 - DNA, 21 bp, Homo sapiens
ggaagcggccctaagggagtg

SEQ ID NO: 575427 - DNA, 14 bp, Homo sapiens
ggaagtgaagcccc

SEQ ID NO: 575428 - DNA, 15 bp, Homo sapiens
ggaagtgaagcccct

SEQ ID NO: 575429 - DNA, 18 bp, Homo sapiens
ggacatgcaataaaattt

SEQ ID NO: 575430 - DNA, 19 bp, Homo sapiens
ggacatgcaataaaattta

SEQ ID NO: 575431 - DNA, 23 bp, Homo sapiens
ggacatgtgctattgaactgagc

SEQ ID NO: 575432 - DNA, 14 bp, Homo sapiens
ggacgtcctgctgg

SEQ ID NO: 575433 - DNA, 20 bp, Homo sapiens
ggaggcgcagcccgaagccc

SEQ ID NO: 575434 - DNA, 18 bp, Homo sapiens
ggatattgaatgttaaag

SEQ ID NO: 575435 - DNA, 15 bp, Homo sapiens
ggattctaaatacat

SEQ ID NO: 575436 - DNA, 20 bp, Homo sapiens
ggattctgaggccctgccca

SEQ ID NO: 575437 - DNA, 13 bp, Homo sapiens
ggcacagatgcct

SEQ ID NO: 575438 - DNA, 14 bp, Homo sapiens
ggcaccgagaatgt

SEQ ID NO: 575439 - DNA, 17 bp, Homo sapiens
ggcacctcagacaatcc

SEQ ID NO: 575440 - DNA, 22 bp, Homo sapiens
ggcatatttaacaaaatttgaa

SEQ ID NO: 575441 - DNA, 11 bp, Homo sapiens
ggcattgagta

SEQ ID NO: 575442 - DNA, 16 bp, Homo sapiens
ggccaagtccgcagaa

SEQ ID NO: 575443 - DNA, 14 bp, Homo sapiens
ggccaggagctcag

SEQ ID NO: 575444 - DNA, 18 bp, Homo sapiens
ggcccatagcagccagtt

SEQ ID NO: 575445 - DNA, 13 bp, Homo sapiens
ggcctcagtgccc

SEQ ID NO: 575446 - DNA, 14 bp, Homo sapiens
ggcctcagtgcccc

SEQ ID NO: 575447 - DNA, 17 bp, Homo sapiens
ggccttgatgactgcct

SEQ ID NO: 575448 - DNA, 18 bp, Homo sapiens
ggcgcagcccgaagccca

SEQ ID NO: 575449 - DNA, 16 bp, Homo sapiens
ggctggaaggggtcca

SEQ ID NO: 575450 - DNA, 12 bp, Homo sapiens
ggcttcatctct

SEQ ID NO: 575451 - DNA, 13 bp, Homo sapiens
ggcttcatctctt

SEQ ID NO: 575452 - DNA, 20 bp, Homo sapiens
ggcttcatctctttagagaa

SEQ ID NO: 575453 - DNA, 22 bp, Homo sapiens
ggcttgtctatactccttccct

SEQ ID NO: 575454 - DNA, 15 bp, Homo sapiens
gggaaggcctgactt

SEQ ID NO: 575455 - DNA, 15 bp, Homo sapiens
gggaagtgaagcccc

SEQ ID NO: 575456 - DNA, 22 bp, Homo sapiens
gggacgttcgtggtcctgcgct

SEQ ID NO: 575457 - DNA, 20 bp, Homo sapiens
gggactacccatagacatga

SEQ ID NO: 575458 - DNA, 15 bp, Homo sapiens
gggatggaaaaggaa

SEQ ID NO: 575459 - DNA, 15 bp, Homo sapiens
gggccaggagctcag

SEQ ID NO: 575460 - DNA, 14 bp, Homo sapiens
gggcctcagtgccc

SEQ ID NO: 575461 - DNA, 16 bp, Homo sapiens
gggcctcagtgcccca

SEQ ID NO: 575462 - DNA, 18 bp, Homo sapiens
gggccttgatgactgcct

SEQ ID NO: 575463 - DNA, 20 bp, Homo sapiens
gggcttcatctctttagaga

SEQ ID NO: 575464 - DNA, 22 bp, Homo sapiens
ggggaacctgccatgccaggaa

SEQ ID NO: 575465 - DNA, 14 bp, Homo sapiens
ggggactgtctttc

SEQ ID NO: 575466 - DNA, 11 bp, Homo sapiens
gggggcttcat

SEQ ID NO: 575467 - DNA, 20 bp, Homo sapiens
aaaaagttgcagtctcagaa

SEQ ID NO: 575468 - DNA, 13 bp, Homo sapiens
aaaacatttgctg

SEQ ID NO: 575469 - DNA, 14 bp, Homo sapiens
aaaactaaatttca

SEQ ID NO: 575470 - DNA, 21 bp, Homo sapiens
aaaagcccagtgacctgaccg

SEQ ID NO: 575471 - DNA, 15 bp, Homo sapiens
aaaagtatatgttag

SEQ ID NO: 575472 - DNA, 19 bp, Homo sapiens
aaaagtgtgtatatatttt

SEQ ID NO: 575473 - DNA, 20 bp, Homo sapiens
aaaagtgtgtatatattttg

SEQ ID NO: 575474 - DNA, 21 bp, Homo sapiens
aaaagtgtgtatatattttgt

SEQ ID NO: 575475 - DNA, 14 bp, Homo sapiens
aaaagttgcagtct

SEQ ID NO: 575476 - DNA, 16 bp, Homo sapiens
aaaagtttttgtttgg

SEQ ID NO: 575477 - DNA, 19 bp, Homo sapiens
aaaatgtaatttaaatgaa

SEQ ID NO: 575478 - DNA, 12 bp, Homo sapiens
aaaatgtctgta

SEQ ID NO: 575479 - DNA, 20 bp, Homo sapiens
aaaattaagcaaatgttaaa

SEQ ID NO: 575480 - DNA, 18 bp, Homo sapiens
aaaattttgtatgttaaa

SEQ ID NO: 575481 - DNA, 14 bp, Homo sapiens
aaacacactgtaaa

SEQ ID NO: 575482 - DNA, 22 bp, Homo sapiens
aaacacactgtaaatatccaca

SEQ ID NO: 575483 - DNA, 17 bp, Homo sapiens
aaacatgtatgtaaata

SEQ ID NO: 575484 - DNA, 16 bp, Homo sapiens
aaacatgttaatgaca

SEQ ID NO: 575485 - DNA, 14 bp, Homo sapiens
aaaccaaagaagaa

SEQ ID NO: 575486 - DNA, 14 bp, Homo sapiens
aaactactgtaatt

SEQ ID NO: 575487 - DNA, 22 bp, Homo sapiens
aaactataaactactgtaatta

SEQ ID NO: 575488 - DNA, 22 bp, Homo sapiens
aaactgcttcccttactttgct

SEQ ID NO: 575489 - DNA, 18 bp, Homo sapiens
aaacttgaatctgttact

SEQ ID NO: 575490 - DNA, 21 bp, Homo sapiens
aaacttgaatctgttactgaa

SEQ ID NO: 575491 - DNA, 22 bp, Homo sapiens
aaacttgaatctgttactgaaa

SEQ ID NO: 575492 - DNA, 12 bp, Homo sapiens
aaagaaaattga

SEQ ID NO: 575493 - DNA, 13 bp, Homo sapiens
aaagaaaattgag

SEQ ID NO: 575494 - DNA, 15 bp, Homo sapiens
aaagacccaggggga

SEQ ID NO: 575495 - DNA, 15 bp, Homo sapiens
aaagccttagggaag

SEQ ID NO: 575496 - DNA, 12 bp, Homo sapiens
aaaggaagacta

SEQ ID NO: 575497 - DNA, 14 bp, Homo sapiens
aaagtatatgttag

SEQ ID NO: 575498 - DNA, 13 bp, Homo sapiens
aaagttattttgt

SEQ ID NO: 575499 - DNA, 15 bp, Homo sapiens
aaataaaaactaatt

SEQ ID NO: 575500 - DNA, 13 bp, Homo sapiens
aaataatgctaca

SEQ ID NO: 575501 - DNA, 13 bp, Homo sapiens
aaatacacatttg

SEQ ID NO: 575502 - DNA, 14 bp, Homo sapiens
aaatacacatttgc

SEQ ID NO: 575503 - DNA, 20 bp, Homo sapiens
aaatagctaagatataattt

SEQ ID NO: 575504 - DNA, 20 bp, Homo sapiens
aaataggaatcattcagaaa

SEQ ID NO: 575505 - DNA, 16 bp, Homo sapiens
aaatataacacatttt

SEQ ID NO: 575506 - DNA, 17 bp, Homo sapiens
aaatataacacattttt

SEQ ID NO: 575507 - DNA, 13 bp, Homo sapiens
aaatcttcccatg

SEQ ID NO: 575508 - DNA, 20 bp, Homo sapiens
aaatgaaagaaaattgagtt

SEQ ID NO: 575509 - DNA, 15 bp, Homo sapiens
aaatgagctctgaaa

SEQ ID NO: 575510 - DNA, 19 bp, Homo sapiens
aaatgttaaaagttttata

SEQ ID NO: 575511 - DNA, 11 bp, Homo sapiens
aaatgtttctt

SEQ ID NO: 575512 - DNA, 18 bp, Homo sapiens
aaatgtttcttttaaaga

SEQ ID NO: 575513 - DNA, 14 bp, Homo sapiens
aaatgtttcttttg

SEQ ID NO: 575514 - DNA, 19 bp, Homo sapiens
aaatgtttcttttgtttgg

SEQ ID NO: 575515 - DNA, 16 bp, Homo sapiens
aaattcaactttgtaa

SEQ ID NO: 575516 - DNA, 14 bp, Homo sapiens
aaattgcatacttt

SEQ ID NO: 575517 - DNA, 17 bp, Homo sapiens
aaattgcatactttgta

SEQ ID NO: 575518 - DNA, 13 bp, Homo sapiens
aaatttaaaaaat

SEQ ID NO: 575519 - DNA, 14 bp, Homo sapiens
aacaacaaggaccc

SEQ ID NO: 575520 - DNA, 22 bp, Homo sapiens
aacaaggaccctgttttccaca

SEQ ID NO: 575521 - DNA, 14 bp, Homo sapiens
aacaattatttgaa

SEQ ID NO: 575522 - DNA, 16 bp, Homo sapiens
aacacagcatgtgtat

SEQ ID NO: 575523 - DNA, 22 bp, Homo sapiens
aacagcctttgaatgtaaccaa

SEQ ID NO: 575524 - DNA, 20 bp, Homo sapiens
aacagtgaagttttactgtc

SEQ ID NO: 575525 - DNA, 21 bp, Homo sapiens
aacagtgaagttttactgtct

SEQ ID NO: 575526 - DNA, 19 bp, Homo sapiens
ttcacagcacttacaattt

SEQ ID NO: 575527 - DNA, 22 bp, Homo sapiens
ttcacccttatagtctaagact

SEQ ID NO: 575528 - DNA, 21 bp, Homo sapiens
ttcagaaatataacacatttt

SEQ ID NO: 575529 - DNA, 22 bp, Homo sapiens
ttcagaaatataacacattttt

SEQ ID NO: 575530 - DNA, 17 bp, Homo sapiens
ttcagttgcttgtcttc

SEQ ID NO: 575531 - DNA, 19 bp, Homo sapiens
ttcagttgcttgtcttctg

SEQ ID NO: 575532 - DNA, 18 bp, Homo sapiens
ttcatcgaacaaactgat

SEQ ID NO: 575533 - DNA, 22 bp, Homo sapiens
ttcatggctgctgttgcttaaa

SEQ ID NO: 575534 - DNA, 21 bp, Homo sapiens
ttccagaaccacacttgaaac

SEQ ID NO: 575535 - DNA, 14 bp, Homo sapiens
ttccaggggaacct

SEQ ID NO: 575536 - DNA, 15 bp, Homo sapiens
ttccattatgattct

SEQ ID NO: 575537 - DNA, 18 bp, Homo sapiens
ttcccctctgtgtcctct

SEQ ID NO: 575538 - DNA, 20 bp, Homo sapiens
ttccgaaaccaaagaagaaa

SEQ ID NO: 575539 - DNA, 19 bp, Homo sapiens
ttcctaacacagcatgtgt

SEQ ID NO: 575540 - DNA, 12 bp, Homo sapiens
ttcctgtactgt

SEQ ID NO: 575541 - DNA, 22 bp, Homo sapiens
ttcctgtgggccaggagctcag

SEQ ID NO: 575542 - DNA, 13 bp, Homo sapiens
ttctaaatgcata

SEQ ID NO: 575543 - DNA, 21 bp, Homo sapiens
ttctataaaactctgcatgta

SEQ ID NO: 575544 - DNA, 19 bp, Homo sapiens
ttctattatttttataatt

SEQ ID NO: 575545 - DNA, 20 bp, Homo sapiens
ttctcattgacttttataaa

SEQ ID NO: 575546 - DNA, 22 bp, Homo sapiens
ttctggtcaagggctgtcattg

SEQ ID NO: 575547 - DNA, 14 bp, Homo sapiens
ttcttacatgcatt

SEQ ID NO: 575548 - DNA, 18 bp, Homo sapiens
ttcttaggggaaggagaa

SEQ ID NO: 575549 - DNA, 14 bp, Homo sapiens
ttctttccattatg

SEQ ID NO: 575550 - DNA, 14 bp, Homo sapiens
ttcttttaaagacc

SEQ ID NO: 575551 - DNA, 20 bp, Homo sapiens
ttgaaaaatataaaattatg

SEQ ID NO: 575552 - DNA, 22 bp, Homo sapiens
ttgaactgagccaaacacactg

SEQ ID NO: 575553 - DNA, 21 bp, Homo sapiens
ttgaatctgttactgaaatga

SEQ ID NO: 575554 - DNA, 15 bp, Homo sapiens
ttgaatgtaaccaat

SEQ ID NO: 575555 - DNA, 23 bp, Homo sapiens
ttgactaactcaaatacacattt

SEQ ID NO: 575556 - DNA, 16 bp, Homo sapiens
ttgaggtcaagtaaga

SEQ ID NO: 575557 - DNA, 13 bp, Homo sapiens
ttgagtattgttt

SEQ ID NO: 575558 - DNA, 14 bp, Homo sapiens
ttgagtattgttta

SEQ ID NO: 575559 - DNA, 15 bp, Homo sapiens
ttgagtattgtttaa

SEQ ID NO: 575560 - DNA, 22 bp, Homo sapiens
ttgagtattgtttaaaatgtaa

SEQ ID NO: 575561 - DNA, 19 bp, Homo sapiens
ttgattgggaaaacatttg

SEQ ID NO: 575562 - DNA, 15 bp, Homo sapiens
ttgattgtcagctac

SEQ ID NO: 575563 - DNA, 15 bp, Homo sapiens
ttgcataataagcta

SEQ ID NO: 575564 - DNA, 16 bp, Homo sapiens
ttgcatactttgtatt

SEQ ID NO: 575565 - DNA, 11 bp, Homo sapiens
ttgcatgcatg

SEQ ID NO: 575566 - DNA, 15 bp, Homo sapiens
ttgcatttggtcaag

SEQ ID NO: 575567 - DNA, 20 bp, Homo sapiens
ttgccacaatgcctctccca

SEQ ID NO: 575568 - DNA, 19 bp, Homo sapiens
ttgctgctgtccagtgcct

SEQ ID NO: 575569 - DNA, 22 bp, Homo sapiens
ttgctgctgtccagtgcctaca

SEQ ID NO: 575570 - DNA, 14 bp, Homo sapiens
ttgcttgtcttctg

SEQ ID NO: 575571 - DNA, 16 bp, Homo sapiens
ttggatggcttgtcta

SEQ ID NO: 575572 - DNA, 15 bp, Homo sapiens
ttggattcaatttta

SEQ ID NO: 575573 - DNA, 17 bp, Homo sapiens
ttggattctaaatacat

SEQ ID NO: 575574 - DNA, 13 bp, Homo sapiens
ttgggaaaacatg

SEQ ID NO: 575575 - DNA, 15 bp, Homo sapiens
ttgggaaaacatttg

SEQ ID NO: 575576 - DNA, 17 bp, Homo sapiens
ttgggaaaacatttgct

SEQ ID NO: 575577 - DNA, 17 bp, Homo sapiens
ttggtaaatgtttcttt

SEQ ID NO: 575578 - DNA, 20 bp, Homo sapiens
ttggtaatcccctaaaataa

SEQ ID NO: 575579 - DNA, 15 bp, Homo sapiens
ttgtaaaggtcagag

SEQ ID NO: 575580 - DNA, 16 bp, Homo sapiens
ttgtattttcatgaaa

SEQ ID NO: 575581 - DNA, 22 bp, Homo sapiens
ttgtccaatggctgtaaactat

SEQ ID NO: 575582 - DNA, 12 bp, Homo sapiens
ttgtcctctccc

SEQ ID NO: 575583 - DNA, 13 bp, Homo sapiens
ttgtcctctcccg

SEQ ID NO: 575584 - DNA, 16 bp, Homo sapiens
ttgtctgatttcttag

SEQ ID NO: 575585 - DNA, 12 bp, Homo sapiens
ttgtgtgaaatt

SEQ ID NO: 575586 - DNA, 14 bp, Homo sapiens
ttgtgtgaaattgc

SEQ ID NO: 575587 - DNA, 15 bp, Homo sapiens
ttgtgtgaaattgca

SEQ ID NO: 575588 - DNA, 13 bp, Homo sapiens
ttttcatgaaaat

SEQ ID NO: 575589 - DNA, 12 bp, Homo sapiens
ttttcttaacca

SEQ ID NO: 575590 - DNA, 16 bp, Homo sapiens
ttttctttgtaaaggt

SEQ ID NO: 575591 - DNA, 18 bp, Homo sapiens
ttttctttgtaaaggtca

SEQ ID NO: 575592 - DNA, 16 bp, Homo sapiens
ttttggggagccagaa

SEQ ID NO: 575593 - DNA, 15 bp, Homo sapiens
ttttgtttgccagga

SEQ ID NO: 575594 - DNA, 15 bp, Homo sapiens
ttttgtttggtaaat

SEQ ID NO: 575595 - DNA, 12 bp, Homo sapiens
tttttgtttgcc

SEQ ID NO: 575596 - DNA, 12 bp, Homo sapiens
tttttttctatt

SEQ ID NO: 575597 - DNA, 12 bp, Homo sapiens
tattaaaactaa

SEQ ID NO: 575598 - DNA, 19 bp, Homo sapiens
tattaaaactaaatttcac

SEQ ID NO: 575599 - DNA, 22 bp, Homo sapiens
tattaatattcagggtaaatag

SEQ ID NO: 575600 - DNA, 18 bp, Homo sapiens
tattactgacatttcttc

SEQ ID NO: 575601 - DNA, 14 bp, Homo sapiens
tattatacatgtga

SEQ ID NO: 575602 - DNA, 19 bp, Homo sapiens
tattatacatgtgatacat

SEQ ID NO: 575603 - DNA, 22 bp, Homo sapiens
tattccagatctttcagaaata

SEQ ID NO: 575604 - DNA, 15 bp, Homo sapiens
tattgaactgagcca

SEQ ID NO: 575605 - DNA, 22 bp, Homo sapiens
tattgccacaatgcctctccca

SEQ ID NO: 575606 - DNA, 17 bp, Homo sapiens
tattgtgaagtacatat

SEQ ID NO: 575607 - DNA, 16 bp, Homo sapiens
tatttaacaaaatttg

SEQ ID NO: 575608 - DNA, 14 bp, Homo sapiens
tattttcatgaaaa

SEQ ID NO: 575609 - DNA, 20 bp, Homo sapiens
tattttcatgaaaataccat

SEQ ID NO: 575610 - DNA, 17 bp, Homo sapiens
tattttgtgtgaaattg

SEQ ID NO: 575611 - DNA, 15 bp, Homo sapiens
tatttttttaaaatt

SEQ ID NO: 575612 - DNA, 16 bp, Homo sapiens
tatttttttaaaattt

SEQ ID NO: 575613 - DNA, 14 bp, Homo sapiens
tcaaaatgtctgta

SEQ ID NO: 575614 - DNA, 19 bp, Homo sapiens
tcaaaatttcaaaagtgat

SEQ ID NO: 575615 - DNA, 13 bp, Homo sapiens
tcaaataagaaat

SEQ ID NO: 575616 - DNA, 14 bp, Homo sapiens
tcaaatacacattt

SEQ ID NO: 575617 - DNA, 16 bp, Homo sapiens
tcaactcacctaatgt

SEQ ID NO: 575618 - DNA, 19 bp, Homo sapiens
tcaactcacctaatgttta

SEQ ID NO: 575619 - DNA, 19 bp, Homo sapiens
tcaagaggtgggagggccc

SEQ ID NO: 575620 - DNA, 18 bp, Homo sapiens
tcaagattttgaatgctt

SEQ ID NO: 575621 - DNA, 14 bp, Homo sapiens
tcaaggactcctgt

SEQ ID NO: 575622 - DNA, 16 bp, Homo sapiens
tcaagtaagaagacat

SEQ ID NO: 575623 - DNA, 22 bp, Homo sapiens
tcaagtaagaagacatgaacca

SEQ ID NO: 575624 - DNA, 22 bp, Homo sapiens
tcacccttatagtctaagacta

SEQ ID NO: 575625 - DNA, 21 bp, Homo sapiens
tcacctaatgtttatgagcca

SEQ ID NO: 575626 - DNA, 22 bp, Homo sapiens
tcacctaatgtttatgagccag

SEQ ID NO: 575627 - DNA, 14 bp, Homo sapiens
tcaccttggggcct

SEQ ID NO: 575628 - DNA, 13 bp, Homo sapiens
tcacttctaaatg

SEQ ID NO: 575629 - DNA, 19 bp, Homo sapiens
tcagaaatataacacattt

SEQ ID NO: 575630 - DNA, 20 bp, Homo sapiens
tcagaaatataacacatttt

SEQ ID NO: 575631 - DNA, 13 bp, Homo sapiens
tcagacaatccac

SEQ ID NO: 575632 - DNA, 16 bp, Homo sapiens
tcagacaatccactct

SEQ ID NO: 575633 - DNA, 22 bp, Homo sapiens
tcagacaatccactctcaggag

SEQ ID NO: 575634 - DNA, 20 bp, Homo sapiens
tcagccgtgcactccctaag

SEQ ID NO: 575635 - DNA, 17 bp, Homo sapiens
tcagctacaattgtaaa

SEQ ID NO: 575636 - DNA, 19 bp, Homo sapiens
tcagctacaattgtaaact

SEQ ID NO: 575637 - DNA, 18 bp, Homo sapiens
tcagtatgtgggggcttc

SEQ ID NO: 575638 - DNA, 15 bp, Homo sapiens
tcagtgttggtatat

SEQ ID NO: 575639 - DNA, 15 bp, Homo sapiens
tcagtttgttggaaa

SEQ ID NO: 575640 - DNA, 19 bp, Homo sapiens
tcagtttgttggaaagtaa

SEQ ID NO: 575641 - DNA, 15 bp, Homo sapiens
tcatcgaacaaactg

SEQ ID NO: 575642 - DNA, 17 bp, Homo sapiens
tcatcgaacaaactgat

SEQ ID NO: 575643 - DNA, 18 bp, Homo sapiens
tcatcgaacaaactgatg

SEQ ID NO: 575644 - DNA, 16 bp, Homo sapiens
tcatctctttagagaa

SEQ ID NO: 575645 - DNA, 22 bp, Homo sapiens
tcatggaaaagcccagtgacct

SEQ ID NO: 575646 - DNA, 11 bp, Homo sapiens
tcatggagaaa

SEQ ID NO: 575647 - DNA, 12 bp, Homo sapiens
tcattgactttt

SEQ ID NO: 575648 - DNA, 21 bp, Homo sapiens
tcattgacttttataaagcat

SEQ ID NO: 575649 - DNA, 18 bp, Homo sapiens
tcattgattgtcagctac

SEQ ID NO: 575650 - DNA, 16 bp, Homo sapiens
tcattttcttttttaa

SEQ ID NO: 575651 - DNA, 18 bp, Homo sapiens
tccaagcaacagcctttg

SEQ ID NO: 575652 - DNA, 16 bp, Homo sapiens
tccaatggctgtaaac

SEQ ID NO: 575653 - DNA, 23 bp, Homo sapiens
tccacaccatcaccctctgggca

SEQ ID NO: 575654 - DNA, 20 bp, Homo sapiens
tccaggctttgtacagagtg

SEQ ID NO: 575655 - DNA, 15 bp, Homo sapiens
tccattatgattctt

SEQ ID NO: 575656 - DNA, 15 bp, Homo sapiens
tccatttccattgct

SEQ ID NO: 575657 - DNA, 16 bp, Homo sapiens
tcccacgatgtcaagg

SEQ ID NO: 575658 - DNA, 16 bp, Homo sapiens
tcccctctgccctgta

SEQ ID NO: 575659 - DNA, 19 bp, Homo sapiens
tcccctctgccctgtatat

SEQ ID NO: 575660 - DNA, 12 bp, Homo sapiens
tcccgggcctca

SEQ ID NO: 575661 - DNA, 18 bp, Homo sapiens
tcccgggcctcagtgccc

SEQ ID NO: 575662 - DNA, 18 bp, Homo sapiens
tccctaagaaaccccagg

SEQ ID NO: 575663 - DNA, 18 bp, Homo sapiens
tccgaaaccaaagaagaa

SEQ ID NO: 575664 - DNA, 15 bp, Homo sapiens
tccgcagaagccctg

SEQ ID NO: 575665 - DNA, 16 bp, Homo sapiens
tcctaacacagcatgt

SEQ ID NO: 575666 - DNA, 22 bp, Homo sapiens
tcctaagtgggaagtgaagccc

SEQ ID NO: 575667 - DNA, 14 bp, Homo sapiens
tcctactaataaac

SEQ ID NO: 575668 - DNA, 18 bp, Homo sapiens
tcctactaataaaccagt

SEQ ID NO: 575669 - DNA, 14 bp, Homo sapiens
tcctagtaagaaga

SEQ ID NO: 575670 - DNA, 15 bp, Homo sapiens
tcctattctataaaa

SEQ ID NO: 575671 - DNA, 23 bp, Homo sapiens
tcctcaactcacctaatgtttat

SEQ ID NO: 575672 - DNA, 16 bp, Homo sapiens
tcctcagtatgtgggg

SEQ ID NO: 575673 - DNA, 19 bp, Homo sapiens
tcctctcccctctgccctg

SEQ ID NO: 575674 - DNA, 15 bp, Homo sapiens
tcctgctggcacctc

SEQ ID NO: 575675 - DNA, 17 bp, Homo sapiens
tcctgctggcacctcag

SEQ ID NO: 575676 - DNA, 20 bp, Homo sapiens
tcctgctggcacctcagaca

SEQ ID NO: 575677 - DNA, 18 bp, Homo sapiens
tcctgtctgtcctggagg

SEQ ID NO: 575678 - DNA, 18 bp, Homo sapiens
tcctgtgggccaggagct

SEQ ID NO: 575679 - DNA, 19 bp, Homo sapiens
tcgtgcgcaacaacaagga

SEQ ID NO: 575680 - DNA, 18 bp, Homo sapiens
gcttaatggagttcttgt

SEQ ID NO: 575681 - DNA, 15 bp, Homo sapiens
gcttcagttgcttgt

SEQ ID NO: 575682 - DNA, 17 bp, Homo sapiens
gcttcatctctttagag

SEQ ID NO: 575683 - DNA, 18 bp, Homo sapiens
gcttcatctctttagaga

SEQ ID NO: 575684 - DNA, 19 bp, Homo sapiens
gcttcctgtgggccaggag

SEQ ID NO: 575685 - DNA, 20 bp, Homo sapiens
gcttcctgtgggccaggagc

SEQ ID NO: 575686 - DNA, 15 bp, Homo sapiens
gcttgcataataagc

SEQ ID NO: 575687 - DNA, 23 bp, Homo sapiens
gcttgcataataagctaaagagg

SEQ ID NO: 575688 - DNA, 14 bp, Homo sapiens
gctttaagccttca

SEQ ID NO: 575689 - DNA, 12 bp, Homo sapiens
ggaaaacatttg

SEQ ID NO: 575690 - DNA, 14 bp, Homo sapiens
ggaaaacatttgct

SEQ ID NO: 575691 - DNA, 11 bp, Homo sapiens
ggaacctgcca

SEQ ID NO: 575692 - DNA, 13 bp, Homo sapiens
ggaacctgccatg

SEQ ID NO: 575693 - DNA, 21 bp, Homo sapiens
ggaaccttccttcctgcttga

SEQ ID NO: 575694 - DNA, 14 bp, Homo sapiens
ggaagaacatagaa

SEQ ID NO: 575695 - DNA, 17 bp, Homo sapiens
ggaatgaggaaaattct

SEQ ID NO: 575696 - DNA, 16 bp, Homo sapiens
ggacacttatggggac

SEQ ID NO: 575697 - DNA, 22 bp, Homo sapiens
ggacatgtgctattgaactgag

SEQ ID NO: 575698 - DNA, 18 bp, Homo sapiens
ggaccctgttttccacac

SEQ ID NO: 575699 - DNA, 20 bp, Homo sapiens
ggacgtcctgctggcacctc

SEQ ID NO: 575700 - DNA, 18 bp, Homo sapiens
ggagaagcatgaaaaagc

SEQ ID NO: 575701 - DNA, 17 bp, Homo sapiens
ggagcagggaaggcctg

SEQ ID NO: 575702 - DNA, 18 bp, Homo sapiens
ggagtggtgatttgaaaa

SEQ ID NO: 575703 - DNA, 14 bp, Homo sapiens
ggatggcttgtcta

SEQ ID NO: 575704 - DNA, 13 bp, Homo sapiens
ggatttgcctcac

SEQ ID NO: 575705 - DNA, 23 bp, Homo sapiens
ggatttgcctcaccttggggcct

SEQ ID NO: 575706 - DNA, 16 bp, Homo sapiens
ggcactagccaaagcg

SEQ ID NO: 575707 - DNA, 14 bp, Homo sapiens
ggcagggaaactgg

SEQ ID NO: 575708 - DNA, 16 bp, Homo sapiens
ggcctcagtgccccat

SEQ ID NO: 575709 - DNA, 18 bp, Homo sapiens
ggcctgagaggggaagcg

SEQ ID NO: 575710 - DNA, 18 bp, Homo sapiens
ggccttgatgactgcctt

SEQ ID NO: 575711 - DNA, 12 bp, Homo sapiens
ggccttggaaat

SEQ ID NO: 575712 - DNA, 20 bp, Homo sapiens
ggcgcagcccgaagcccagt

SEQ ID NO: 575713 - DNA, 22 bp, Homo sapiens
ggctgtaaactataaactactg

SEQ ID NO: 575714 - DNA, 16 bp, Homo sapiens
gggaagctggcctgag

SEQ ID NO: 575715 - DNA, 15 bp, Homo sapiens
gggagcagggaaggc

SEQ ID NO: 575716 - DNA, 11 bp, Homo sapiens
gggcctcagtg

SEQ ID NO: 575717 - DNA, 23 bp, Homo sapiens
gggccttgctacctcaaggggga

SEQ ID NO: 575718 - DNA, 17 bp, Homo sapiens
gggcttcatctctttag

SEQ ID NO: 575719 - DNA, 19 bp, Homo sapiens
ggggcattgagtattgttt

SEQ ID NO: 575720 - DNA, 19 bp, Homo sapiens
gggtccagtggatgccaca

SEQ ID NO: 575721 - DNA, 15 bp, Homo sapiens
gggtccttctccaca

SEQ ID NO: 575722 - DNA, 15 bp, Homo sapiens
ggtcctagtaagaag

SEQ ID NO: 575723 - DNA, 22 bp, Homo sapiens
ggtcttcttacatgcatttgag

SEQ ID NO: 575724 - DNA, 17 bp, Homo sapiens
ggtgtcagtatccaggc

SEQ ID NO: 575725 - DNA, 15 bp, Homo sapiens
ggtgtctccttaagc

SEQ ID NO: 575726 - DNA, 23 bp, Homo sapiens
ggtgttccgaaaccaaagaagaa

SEQ ID NO: 575727 - DNA, 21 bp, Homo sapiens
gtaaataggaatcattcagaa

SEQ ID NO: 575728 - DNA, 22 bp, Homo sapiens
gtaaatttgtccaatggctgta

SEQ ID NO: 575729 - DNA, 21 bp, Homo sapiens
gtaaccaatcctactaataaa

SEQ ID NO: 575730 - DNA, 23 bp, Homo sapiens
gtaaccaatcctactaataaacc

SEQ ID NO: 575731 - DNA, 13 bp, Homo sapiens
gtaagaattctga

SEQ ID NO: 575732 - DNA, 12 bp, Homo sapiens
gtacaaaattaa

SEQ ID NO: 575733 - DNA, 14 bp, Homo sapiens
gtacaaaattaagc

SEQ ID NO: 575734 - DNA, 23 bp, Homo sapiens
gtactgaaagccttagggaagct

SEQ ID NO: 575735 - DNA, 21 bp, Homo sapiens
gtactgccccccatgaggaag

SEQ ID NO: 575736 - DNA, 21 bp, Homo sapiens
gtactttctgttatgggcttt

SEQ ID NO: 575737 - DNA, 14 bp, Homo sapiens
gtagaggcttgttt

SEQ ID NO: 575738 - DNA, 18 bp, Homo sapiens
gtagatatgtattctttt

SEQ ID NO: 575739 - DNA, 12 bp, Homo sapiens
gtataaatatac

SEQ ID NO: 575740 - DNA, 20 bp, Homo sapiens
gtatataatactaaagtgtc

SEQ ID NO: 575741 - DNA, 13 bp, Homo sapiens
gtatatattttgt

SEQ ID NO: 575742 - DNA, 22 bp, Homo sapiens
gtatctagagcttaatgctaca

SEQ ID NO: 575743 - DNA, 14 bp, Homo sapiens
gtatgactaaagag

SEQ ID NO: 575744 - DNA, 18 bp, Homo sapiens
gtatgactaaagagagaa

SEQ ID NO: 575745 - DNA, 15 bp, Homo sapiens
gtatgtgggatattg

SEQ ID NO: 575746 - DNA, 23 bp, Homo sapiens
gtatgtgggggcttcatctcttt

SEQ ID NO: 575747 - DNA, 18 bp, Homo sapiens
gtattgtttaaaatgtaa

SEQ ID NO: 575748 - DNA, 15 bp, Homo sapiens
gtattttcatgaaaa

SEQ ID NO: 575749 - DNA, 14 bp, Homo sapiens
gtcatggaaaagcc

SEQ ID NO: 575750 - DNA, 17 bp, Homo sapiens
gtccaagcaacagcctt

SEQ ID NO: 575751 - DNA, 21 bp, Homo sapiens
gtccaagcaacagcctttgaa

SEQ ID NO: 575752 - DNA, 17 bp, Homo sapiens
gtccaatggctgtaaac

SEQ ID NO: 575753 - DNA, 11 bp, Homo sapiens
gtccagtgcct

SEQ ID NO: 575754 - DNA, 14 bp, Homo sapiens
gtccagtgcctaca

SEQ ID NO: 575755 - DNA, 13 bp, Homo sapiens
gtcccctctcccc

SEQ ID NO: 575756 - DNA, 15 bp, Homo sapiens
gtcccctctcccctc

SEQ ID NO: 575757 - DNA, 22 bp, Homo sapiens
gtcccctctcccctcatggaga

SEQ ID NO: 575758 - DNA, 13 bp, Homo sapiens
gtcctcagggagc

SEQ ID NO: 575759 - DNA, 22 bp, Homo sapiens
gtcctcagggagcagggaaggc

SEQ ID NO: 575760 - DNA, 21 bp, Homo sapiens
gtcctctcccctctgccctgt

SEQ ID NO: 575761 - DNA, 15 bp, Homo sapiens
gtcctgctggcacct

SEQ ID NO: 575762 - DNA, 16 bp, Homo sapiens
gtccttgatttcaaag

SEQ ID NO: 575763 - DNA, 18 bp, Homo sapiens
gtctgtcctggaggtggg

SEQ ID NO: 575764 - DNA, 23 bp, Homo sapiens
gtgaagccccttgtcctctcccg

SEQ ID NO: 575765 - DNA, 23 bp, Homo sapiens
gtgacctgaggatttaagggatg

SEQ ID NO: 575766 - DNA, 17 bp, Homo sapiens
gtgagaacccagtttcc

SEQ ID NO: 575767 - DNA, 18 bp, Homo sapiens
gtgagtgacgatgatgta

SEQ ID NO: 575768 - DNA, 16 bp, Homo sapiens
gtgatttaatccagtt

SEQ ID NO: 575769 - DNA, 14 bp, Homo sapiens
gtgatttgaaaaat

SEQ ID NO: 575770 - DNA, 22 bp, Homo sapiens
gtgcaattgtaggggtgtgtgt

SEQ ID NO: 575771 - DNA, 16 bp, Homo sapiens
gtgcaatttcccctct

SEQ ID NO: 575772 - DNA, 13 bp, Homo sapiens
gtgcacctgcccc

SEQ ID NO: 575773 - DNA, 14 bp, Homo sapiens
gtgcatttaattag

SEQ ID NO: 575774 - DNA, 16 bp, Homo sapiens
gttgtaagaattctga

SEQ ID NO: 575775 - DNA, 13 bp, Homo sapiens
gtttatgagccag

SEQ ID NO: 575776 - DNA, 22 bp, Homo sapiens
gttttcctataatataataaat

SEQ ID NO: 575777 - DNA, 18 bp, Homo sapiens
gttttctttgtaaaggtc

SEQ ID NO: 575778 - DNA, 19 bp, Homo sapiens
gttttctttgtaaaggtca

SEQ ID NO: 575779 - DNA, 16 bp, Homo sapiens
gttttggggactcatt

SEQ ID NO: 575780 - DNA, 10 bp, Homo sapiens
taaaatgtaa

SEQ ID NO: 575781 - DNA, 15 bp, Homo sapiens
taaaatgtaatttaa

SEQ ID NO: 575782 - DNA, 20 bp, Homo sapiens
taaaatgtaatttaaatgaa

SEQ ID NO: 575783 - DNA, 22 bp, Homo sapiens
taaaattatgagattggttttc

SEQ ID NO: 575784 - DNA, 19 bp, Homo sapiens
taaaattttgtatgttaaa

SEQ ID NO: 575785 - DNA, 18 bp, Homo sapiens
taaacatgtatgtaaata

SEQ ID NO: 575786 - DNA, 21 bp, Homo sapiens
taaacgtgatttttaaattaa

SEQ ID NO: 575787 - DNA, 23 bp, Homo sapiens
taaacgtgatttttaaattaaat

SEQ ID NO: 575788 - DNA, 14 bp, Homo sapiens
taaactactgtaat

SEQ ID NO: 575789 - DNA, 15 bp, Homo sapiens
taaactataaactac

SEQ ID NO: 575790 - DNA, 18 bp, Homo sapiens
taaactataaactactgt

SEQ ID NO: 575791 - DNA, 19 bp, Homo sapiens
taaagaccctcctattcta

SEQ ID NO: 575792 - DNA, 12 bp, Homo sapiens
taaagtgtctat

SEQ ID NO: 575793 - DNA, 23 bp, Homo sapiens
taaataggaatcattcagaaatg

SEQ ID NO: 575794 - DNA, 14 bp, Homo sapiens
taaatgaaagaaaa

SEQ ID NO: 575795 - DNA, 22 bp, Homo sapiens
taaatgaaagaaaattgagttg

SEQ ID NO: 575796 - DNA, 15 bp, Homo sapiens
taaattcaactttgt

SEQ ID NO: 575797 - DNA, 16 bp, Homo sapiens
taaattcaactttgta

SEQ ID NO: 575798 - DNA, 17 bp, Homo sapiens
taaatttaataccagat

SEQ ID NO: 575799 - DNA, 23 bp, Homo sapiens
taaatttgtccaatggctgtaaa

SEQ ID NO: 575800 - DNA, 15 bp, Homo sapiens
taacaaaatttgaat

SEQ ID NO: 575801 - DNA, 12 bp, Homo sapiens
taacacattttt

SEQ ID NO: 575802 - DNA, 19 bp, Homo sapiens
taacacatttttttgcatg

SEQ ID NO: 575803 - DNA, 21 bp, Homo sapiens
taacagtatgtgggatattga

SEQ ID NO: 575804 - DNA, 20 bp, Homo sapiens
taacatcgaaaagttatttt

SEQ ID NO: 575805 - DNA, 13 bp, Homo sapiens
taacatgccagct

SEQ ID NO: 575806 - DNA, 20 bp, Homo sapiens
taactccagtctcctgacat

SEQ ID NO: 575807 - DNA, 21 bp, Homo sapiens
taactccagtctcctgacatt

SEQ ID NO: 575808 - DNA, 17 bp, Homo sapiens
taagaagaagttcatgt

SEQ ID NO: 575809 - DNA, 13 bp, Homo sapiens
taagaattctgat

SEQ ID NO: 575810 - DNA, 17 bp, Homo sapiens
taagactgtagatatgt

SEQ ID NO: 575811 - DNA, 14 bp, Homo sapiens
taagatatgtaaca

SEQ ID NO: 575812 - DNA, 14 bp, Homo sapiens
taagcaaatgttaa

SEQ ID NO: 575813 - DNA, 18 bp, Homo sapiens
taagcaagagagatgttt

SEQ ID NO: 575814 - DNA, 14 bp, Homo sapiens
taagccttcaaaac

SEQ ID NO: 575815 - DNA, 16 bp, Homo sapiens
taagcttccattttaa

SEQ ID NO: 575816 - DNA, 15 bp, Homo sapiens
taaggggaagaatga

SEQ ID NO: 575817 - DNA, 14 bp, Homo sapiens
taagtctttcatgg

SEQ ID NO: 575818 - DNA, 21 bp, Homo sapiens
taatagtgcttaaaaatcatt

SEQ ID NO: 575819 - DNA, 21 bp, Homo sapiens
taatattcagggtaaatagga

SEQ ID NO: 575820 - DNA, 21 bp, Homo sapiens
taatattgtttggtaaatgtt

SEQ ID NO: 575821 - DNA, 16 bp, Homo sapiens
taatcttcaaagcctt

SEQ ID NO: 575822 - DNA, 11 bp, Homo sapiens
taatgatgttt

SEQ ID NO: 575823 - DNA, 14 bp, Homo sapiens
taatgctacaattt

SEQ ID NO: 575824 - DNA, 13 bp, Homo sapiens
taattaagtgcaa

SEQ ID NO: 575825 - DNA, 14 bp, Homo sapiens
taattatatatact

SEQ ID NO: 575826 - DNA, 16 bp, Homo sapiens
taatttacttgttttg

SEQ ID NO: 575827 - DNA, 12 bp, Homo sapiens
taattttaaagt

SEQ ID NO: 575828 - DNA, 14 bp, Homo sapiens
taattttaaagtgc

SEQ ID NO: 575829 - DNA, 14 bp, Homo sapiens
tacaaaattaagca

SEQ ID NO: 575830 - DNA, 15 bp, Homo sapiens
tacaaaattaagcaa

SEQ ID NO: 575831 - DNA, 23 bp, Homo sapiens
tacaaaattaagcaaatgttaaa

SEQ ID NO: 575832 - DNA, 13 bp, Homo sapiens
tacaattttaaga

SEQ ID NO: 575833 - DNA, 20 bp, Homo sapiens
tacaggcaccgagaatgttg

SEQ ID NO: 575834 - DNA, 23 bp, Homo sapiens
tacatattaggaaaatatgggtt

SEQ ID NO: 575835 - DNA, 16 bp, Homo sapiens
tacatggttgtgacct

SEQ ID NO: 575836 - DNA, 16 bp, Homo sapiens
tacatgtgatacattt

SEQ ID NO: 575837 - DNA, 19 bp, Homo sapiens
tacatgtgatacatttttt

SEQ ID NO: 575838 - DNA, 17 bp, Homo sapiens
taccacatcaaataaga

SEQ ID NO: 575839 - DNA, 18 bp, Homo sapiens
taccatttagtaagaata

SEQ ID NO: 575840 - DNA, 19 bp, Homo sapiens
taccatttagtaagaatac

SEQ ID NO: 575841 - DNA, 13 bp, Homo sapiens
tacctaacatctg

SEQ ID NO: 575842 - DNA, 20 bp, Homo sapiens
tacctgacggacgtcctgct

SEQ ID NO: 575843 - DNA, 16 bp, Homo sapiens
taccttttttttttct

SEQ ID NO: 575844 - DNA, 19 bp, Homo sapiens
tactaaacagtaagatatc

SEQ ID NO: 575845 - DNA, 13 bp, Homo sapiens
tactaatgatgtt

SEQ ID NO: 575846 - DNA, 14 bp, Homo sapiens
tactaatgatgttt

SEQ ID NO: 575847 - DNA, 15 bp, Homo sapiens
tactaatgatgtttt

SEQ ID NO: 575848 - DNA, 22 bp, Homo sapiens
tactgttgtaagaattctgatt

SEQ ID NO: 575849 - DNA, 12 bp, Homo sapiens
tagacatgaaag

SEQ ID NO: 575850 - DNA, 15 bp, Homo sapiens
tagagaagtccaagc

SEQ ID NO: 575851 - DNA, 15 bp, Homo sapiens
tagatccatttccat

SEQ ID NO: 575852 - DNA, 22 bp, Homo sapiens
tagcagaagaaaaagttgcagt

SEQ ID NO: 575853 - DNA, 15 bp, Homo sapiens
tagcagatttaagat

SEQ ID NO: 575854 - DNA, 16 bp, Homo sapiens
tagcagccagttcaaa

SEQ ID NO: 575855 - DNA, 18 bp, Homo sapiens
tagcagccagttcaaaaa

SEQ ID NO: 575856 - DNA, 15 bp, Homo sapiens
tagctgaagaattga

SEQ ID NO: 575857 - DNA, 20 bp, Homo sapiens
taggaatcattcagaaatgt

SEQ ID NO: 575858 - DNA, 11 bp, Homo sapiens
tagtaagcata

SEQ ID NO: 575859 - DNA, 13 bp, Homo sapiens
tagttttctttgt

SEQ ID NO: 575860 - DNA, 16 bp, Homo sapiens
tagttttctttgtaaa

SEQ ID NO: 575861 - DNA, 20 bp, Homo sapiens
tataaaattatgagattggt

SEQ ID NO: 575862 - DNA, 16 bp, Homo sapiens
tataaacagaaatgga

SEQ ID NO: 575863 - DNA, 20 bp, Homo sapiens
aactgagccaaacacactgt

SEQ ID NO: 575864 - DNA, 23 bp, Homo sapiens
aactgcttcccttactttgctga

SEQ ID NO: 575865 - DNA, 22 bp, Homo sapiens
aactggctgtttgatagcagaa

SEQ ID NO: 575866 - DNA, 19 bp, Homo sapiens
aacttctgcaacaagcatg

SEQ ID NO: 575867 - DNA, 22 bp, Homo sapiens
aacttctgcaacaagcatgcag

SEQ ID NO: 575868 - DNA, 13 bp, Homo sapiens
aacttgaatctgt

SEQ ID NO: 575869 - DNA, 12 bp, Homo sapiens
aactttgggaaa

SEQ ID NO: 575870 - DNA, 16 bp, Homo sapiens
aactttgggaaaacat

SEQ ID NO: 575871 - DNA, 17 bp, Homo sapiens
aagaagtaaatttgtcc

SEQ ID NO: 575872 - DNA, 13 bp, Homo sapiens
aagaatgaaagct

SEQ ID NO: 575873 - DNA, 17 bp, Homo sapiens
aagaatgaaagctgttc

SEQ ID NO: 575874 - DNA, 18 bp, Homo sapiens
aagaattgaaaagttttt

SEQ ID NO: 575875 - DNA, 22 bp, Homo sapiens
aagactatatatataaatgtat

SEQ ID NO: 575876 - DNA, 13 bp, Homo sapiens
aagagagaatgta

SEQ ID NO: 575877 - DNA, 20 bp, Homo sapiens
aagaggaacagcactgggga

SEQ ID NO: 575878 - DNA, 22 bp, Homo sapiens
aagaggaacagcactggggagt

SEQ ID NO: 575879 - DNA, 18 bp, Homo sapiens
aagagggagaagcatgaa

SEQ ID NO: 575880 - DNA, 16 bp, Homo sapiens
aagaggtgggagggcc

SEQ ID NO: 575881 - DNA, 15 bp, Homo sapiens
aagattttgaatgct

SEQ ID NO: 575882 - DNA, 19 bp, Homo sapiens
aagcaaatgttaaaagttt

SEQ ID NO: 575883 - DNA, 21 bp, Homo sapiens
aagcaacagcctttgaatgta

SEQ ID NO: 575884 - DNA, 18 bp, Homo sapiens
aagcaagagagatgtttt

SEQ ID NO: 575885 - DNA, 18 bp, Homo sapiens
aagcactttgggattctt

SEQ ID NO: 575886 - DNA, 21 bp, Homo sapiens
aagcatagataatattgtttg

SEQ ID NO: 575887 - DNA, 13 bp, Homo sapiens
aagcatgaaaaag

SEQ ID NO: 575888 - DNA, 18 bp, Homo sapiens
aagcccagtgacctgacc

SEQ ID NO: 575889 - DNA, 18 bp, Homo sapiens
aagccccttgtcctctcc

SEQ ID NO: 575890 - DNA, 13 bp, Homo sapiens
aagccttcaaaac

SEQ ID NO: 575891 - DNA, 13 bp, Homo sapiens
aagctggcctgag

SEQ ID NO: 575892 - DNA, 14 bp, Homo sapiens
aagctggcctgaga

SEQ ID NO: 575893 - DNA, 13 bp, Homo sapiens
aaggaaccttcct

SEQ ID NO: 575894 - DNA, 12 bp, Homo sapiens
aagggatatttt

SEQ ID NO: 575895 - DNA, 21 bp, Homo sapiens
aagggccagcgtggctctaaa

SEQ ID NO: 575896 - DNA, 16 bp, Homo sapiens
aaggtattatacatgt

SEQ ID NO: 575897 - DNA, 22 bp, Homo sapiens
aaggtattatacatgtgataca

SEQ ID NO: 575898 - DNA, 14 bp, Homo sapiens
aagtaagaagacat

SEQ ID NO: 575899 - DNA, 15 bp, Homo sapiens
aagtaagaagacatg

SEQ ID NO: 575900 - DNA, 19 bp, Homo sapiens
aagtccaagcaacagcctt

SEQ ID NO: 575901 - DNA, 20 bp, Homo sapiens
aagtccaagcaacagccttt

SEQ ID NO: 575902 - DNA, 18 bp, Homo sapiens
aagtccgcagaagccctg

SEQ ID NO: 575903 - DNA, 17 bp, Homo sapiens
aagtgaagccccttgtc

SEQ ID NO: 575904 - DNA, 19 bp, Homo sapiens
aagtgaagccccttgtcct

SEQ ID NO: 575905 - DNA, 18 bp, Homo sapiens
aagtgggaagtgaagccc

SEQ ID NO: 575906 - DNA, 16 bp, Homo sapiens
aagtgtgtatatattt

SEQ ID NO: 575907 - DNA, 16 bp, Homo sapiens
aagttgcagtctcaga

SEQ ID NO: 575908 - DNA, 13 bp, Homo sapiens
aagttttatatgc

SEQ ID NO: 575909 - DNA, 12 bp, Homo sapiens
aagttttgttgt

SEQ ID NO: 575910 - DNA, 22 bp, Homo sapiens
aagttttgttgtacttaaatgg

SEQ ID NO: 575911 - DNA, 14 bp, Homo sapiens
aataagctaaagag

SEQ ID NO: 575912 - DNA, 21 bp, Homo sapiens
aataatgctacaattttaaga

SEQ ID NO: 575913 - DNA, 14 bp, Homo sapiens
aatacacatttgct

SEQ ID NO: 575914 - DNA, 15 bp, Homo sapiens
aatacacatttgcta

SEQ ID NO: 575915 - DNA, 15 bp, Homo sapiens
aataccatttagtaa

SEQ ID NO: 575916 - DNA, 18 bp, Homo sapiens
aataccatttagtaagaa

SEQ ID NO: 575917 - DNA, 19 bp, Homo sapiens
aataggaatcattcagaaa

SEQ ID NO: 575918 - DNA, 21 bp, Homo sapiens
aataggagtggtgatttgaaa

SEQ ID NO: 575919 - DNA, 12 bp, Homo sapiens
aatataaaatta

SEQ ID NO: 575920 - DNA, 17 bp, Homo sapiens
aatatgacggaagaaca

SEQ ID NO: 575921 - DNA, 19 bp, Homo sapiens
aatatgacggaagaacata

SEQ ID NO: 575922 - DNA, 22 bp, Homo sapiens
aatattccagatctttcagaaa

SEQ ID NO: 575923 - DNA, 23 bp, Homo sapiens
aatattccagatctttcagaaat

SEQ ID NO: 575924 - DNA, 21 bp, Homo sapiens
aatattgattgggaaaacatt

SEQ ID NO: 575925 - DNA, 22 bp, Homo sapiens
aatattgattgggaaaacattt

SEQ ID NO: 575926 - DNA, 23 bp, Homo sapiens
aatattgattgggaaaacatttg

SEQ ID NO: 575927 - DNA, 20 bp, Homo sapiens
aatattgtttggtaaatgtt

SEQ ID NO: 575928 - DNA, 21 bp, Homo sapiens
aatattgtttggtaaatgttt

SEQ ID NO: 575929 - DNA, 22 bp, Homo sapiens
aatattgtttggtaaatgtttc

SEQ ID NO: 575930 - DNA, 13 bp, Homo sapiens
aatccactctcag

SEQ ID NO: 575931 - DNA, 16 bp, Homo sapiens
aatccagttataagaa

SEQ ID NO: 575932 - DNA, 19 bp, Homo sapiens
aatccagttataagaagaa

SEQ ID NO: 575933 - DNA, 14 bp, Homo sapiens
aatcccctaaaata

SEQ ID NO: 575934 - DNA, 17 bp, Homo sapiens
aatcctactaataaacc

SEQ ID NO: 575935 - DNA, 16 bp, Homo sapiens
aatcttcaaagccttc

SEQ ID NO: 575936 - DNA, 16 bp, Homo sapiens
aatgaaagctgttcct

SEQ ID NO: 575937 - DNA, 18 bp, Homo sapiens
aatgaaccataaattcaa

SEQ ID NO: 575938 - DNA, 18 bp, Homo sapiens
aatgaggagagaaggaca

SEQ ID NO: 575939 - DNA, 12 bp, Homo sapiens
aatgataatgct

SEQ ID NO: 575940 - DNA, 23 bp, Homo sapiens
aatgataatgctaattttattat

SEQ ID NO: 575941 - DNA, 20 bp, Homo sapiens
aatgctacaattttaagagg

SEQ ID NO: 575942 - DNA, 21 bp, Homo sapiens
aatgcttcctgacaatcaact

SEQ ID NO: 575943 - DNA, 13 bp, Homo sapiens
aatggctgtaaac

SEQ ID NO: 575944 - DNA, 16 bp, Homo sapiens
aatggctgtaaactat

SEQ ID NO: 575945 - DNA, 18 bp, Homo sapiens
aatggctgtaaactataa

SEQ ID NO: 575946 - DNA, 12 bp, Homo sapiens
aatgtaaccaat

SEQ ID NO: 575947 - DNA, 13 bp, Homo sapiens
aatgtaatttaaa

SEQ ID NO: 575948 - DNA, 19 bp, Homo sapiens
aatgtgacttggattcaat

SEQ ID NO: 575949 - DNA, 20 bp, Homo sapiens
aatgtttagcagatttaaga

SEQ ID NO: 575950 - DNA, 22 bp, Homo sapiens
aatgtttatgagccagacaaat

SEQ ID NO: 575951 - DNA, 17 bp, Homo sapiens
aatgtttcttttgtttg

SEQ ID NO: 575952 - DNA, 15 bp, Homo sapiens
aattaagcaaatgtt

SEQ ID NO: 575953 - DNA, 22 bp, Homo sapiens
aattaagcaaatgttaaaagtt

SEQ ID NO: 575954 - DNA, 13 bp, Homo sapiens
aattaagtgcaat

SEQ ID NO: 575955 - DNA, 23 bp, Homo sapiens
aattatgagattggttttcctgt

SEQ ID NO: 575956 - DNA, 19 bp, Homo sapiens
aattatttgaagatttaat

SEQ ID NO: 575957 - DNA, 15 bp, Homo sapiens
aattctgattgattt

SEQ ID NO: 575958 - DNA, 18 bp, Homo sapiens
aattgtacaaaattaagc

SEQ ID NO: 575959 - DNA, 16 bp, Homo sapiens
aattttgtatgttaaa

SEQ ID NO: 575960 - DNA, 15 bp, Homo sapiens
acaacaaggaccctg

SEQ ID NO: 575961 - DNA, 14 bp, Homo sapiens
acaaggaccctgtt

SEQ ID NO: 575962 - DNA, 19 bp, Homo sapiens
acaaggaccctgttttcca

SEQ ID NO: 575963 - DNA, 22 bp, Homo sapiens
acaataggagtggtgatttgaa

SEQ ID NO: 575964 - DNA, 13 bp, Homo sapiens
acaatgcctctcc

SEQ ID NO: 575965 - DNA, 13 bp, Homo sapiens
acacactgtaaat

SEQ ID NO: 575966 - DNA, 16 bp, Homo sapiens
acacatttgctactgt

SEQ ID NO: 575967 - DNA, 17 bp, Homo sapiens
ctcctccccttcctctt

SEQ ID NO: 575968 - DNA, 14 bp, Homo sapiens
ctcctgtctgtcct

SEQ ID NO: 575969 - DNA, 21 bp, Homo sapiens
ctcctgtctgtcctggaggtg

SEQ ID NO: 575970 - DNA, 19 bp, Homo sapiens
ctccttgagtgtatgagta

SEQ ID NO: 575971 - DNA, 22 bp, Homo sapiens
ctctaaaaggtaatgtgtggat

SEQ ID NO: 575972 - DNA, 12 bp, Homo sapiens
ctctcaggaggc

SEQ ID NO: 575973 - DNA, 15 bp, Homo sapiens
ctctcccctctgccc

SEQ ID NO: 575974 - DNA, 17 bp, Homo sapiens
ctctcccctctgccctg

SEQ ID NO: 575975 - DNA, 22 bp, Homo sapiens
ctctcctaactgccagccccct

SEQ ID NO: 575976 - DNA, 15 bp, Homo sapiens
ctctgccctgtatat

SEQ ID NO: 575977 - DNA, 18 bp, Homo sapiens
ctctgtgtcctctcccct

SEQ ID NO: 575978 - DNA, 20 bp, Homo sapiens
ctcttcctatccctctccta

SEQ ID NO: 575979 - DNA, 23 bp, Homo sapiens
ctgaaatcttcccatgcattctg

SEQ ID NO: 575980 - DNA, 21 bp, Homo sapiens
ctgaaatgaggagagaaggac

SEQ ID NO: 575981 - DNA, 18 bp, Homo sapiens
ctgacatttcttctagtg

SEQ ID NO: 575982 - DNA, 16 bp, Homo sapiens
ctgaccggcacctgcg

SEQ ID NO: 575983 - DNA, 20 bp, Homo sapiens
ctgacggacgtcctgctggc

SEQ ID NO: 575984 - DNA, 21 bp, Homo sapiens
ctgactaccagctaactccag

SEQ ID NO: 575985 - DNA, 22 bp, Homo sapiens
ctgaggatttaagggatggaaa

SEQ ID NO: 575986 - DNA, 16 bp, Homo sapiens
ctgaggccctgcccaa

SEQ ID NO: 575987 - DNA, 18 bp, Homo sapiens
ctgatgcgaaaacttgaa

SEQ ID NO: 575988 - DNA, 20 bp, Homo sapiens
ctgatgtgtcctcagggagc

SEQ ID NO: 575989 - DNA, 23 bp, Homo sapiens
ctgcagagatttctcattgactt

SEQ ID NO: 575990 - DNA, 16 bp, Homo sapiens
ctgccatgccaggaac

SEQ ID NO: 575991 - DNA, 13 bp, Homo sapiens
ctgccctgtatat

SEQ ID NO: 575992 - DNA, 14 bp, Homo sapiens
ctgccctgtatata

SEQ ID NO: 575993 - DNA, 14 bp, Homo sapiens
ctgccttgcctcct

SEQ ID NO: 575994 - DNA, 15 bp, Homo sapiens
ctgctggcatcaaga

SEQ ID NO: 575995 - DNA, 17 bp, Homo sapiens
ctgctgtccagtgccta

SEQ ID NO: 575996 - DNA, 23 bp, Homo sapiens
ctgcttaatcttcaaagccttct

SEQ ID NO: 575997 - DNA, 14 bp, Homo sapiens
ctgcttacctgacg

SEQ ID NO: 575998 - DNA, 22 bp, Homo sapiens
ctggacacttatggggacagca

SEQ ID NO: 575999 - DNA, 20 bp, Homo sapiens
ctggaggtgggagacaagga

SEQ ID NO: 576000 - DNA, 16 bp, Homo sapiens
ctggctttaagccttc

SEQ ID NO: 576001 - DNA, 17 bp, Homo sapiens
ctggctttaagccttca

SEQ ID NO: 576002 - DNA, 17 bp, Homo sapiens
ctgggctgccatgtgaa

SEQ ID NO: 576003 - DNA, 15 bp, Homo sapiens
ctggggagtgattac

SEQ ID NO: 576004 - DNA, 22 bp, Homo sapiens
ctggtttgtggggcacagatgc

SEQ ID NO: 576005 - DNA, 17 bp, Homo sapiens
ctgtaattaagtgcaat

SEQ ID NO: 576006 - DNA, 17 bp, Homo sapiens
ctgtactgtgtctcatg

SEQ ID NO: 576007 - DNA, 14 bp, Homo sapiens
ctgtagctgccatg

SEQ ID NO: 576008 - DNA, 20 bp, Homo sapiens
ctgtcatggaaaagcccagt

SEQ ID NO: 576009 - DNA, 17 bp, Homo sapiens
ctgtccagtgcctacat

SEQ ID NO: 576010 - DNA, 13 bp, Homo sapiens
ctgtcccctctcc

SEQ ID NO: 576011 - DNA, 15 bp, Homo sapiens
ctgtcccctctcccc

SEQ ID NO: 576012 - DNA, 13 bp, Homo sapiens
ctgtctgtcctgg

SEQ ID NO: 576013 - DNA, 14 bp, Homo sapiens
ctgtctgtcctgga

SEQ ID NO: 576014 - DNA, 20 bp, Homo sapiens
ctgtctttcagatacatggt

SEQ ID NO: 576015 - DNA, 14 bp, Homo sapiens
ctgtggcataaatt

SEQ ID NO: 576016 - DNA, 15 bp, Homo sapiens
ctgtgtcctctcccc

SEQ ID NO: 576017 - DNA, 13 bp, Homo sapiens
ctgttatgggctt

SEQ ID NO: 576018 - DNA, 21 bp, Homo sapiens
ctgttgtaagaattctgattg

SEQ ID NO: 576019 - DNA, 13 bp, Homo sapiens
ctgttttccacac

SEQ ID NO: 576020 - DNA, 12 bp, Homo sapiens
cttaaatttaat

SEQ ID NO: 576021 - DNA, 15 bp, Homo sapiens
cttacaatattgatt

SEQ ID NO: 576022 - DNA, 13 bp, Homo sapiens
cttagggaagctg

SEQ ID NO: 576023 - DNA, 23 bp, Homo sapiens
cttagggactacccatagacatg

SEQ ID NO: 576024 - DNA, 20 bp, Homo sapiens
cttagtatgtgcatttaatt

SEQ ID NO: 576025 - DNA, 22 bp, Homo sapiens
cttatggggacagcataccttg

SEQ ID NO: 576026 - DNA, 20 bp, Homo sapiens
cttattatgtaggtaagact

SEQ ID NO: 576027 - DNA, 16 bp, Homo sapiens
cttattgaccattttt

SEQ ID NO: 576028 - DNA, 15 bp, Homo sapiens
cttcaaagccttctc

SEQ ID NO: 576029 - DNA, 20 bp, Homo sapiens
cttccagggatttgcctcac

SEQ ID NO: 576030 - DNA, 13 bp, Homo sapiens
cttcccatgcatt

SEQ ID NO: 576031 - DNA, 14 bp, Homo sapiens
cttcctcttgtctg

SEQ ID NO: 576032 - DNA, 18 bp, Homo sapiens
cttcctcttgtctgattt

SEQ ID NO: 576033 - DNA, 14 bp, Homo sapiens
cttcttacatgcat

SEQ ID NO: 576034 - DNA, 18 bp, Homo sapiens
cttgaatctgttactgaa

SEQ ID NO: 576035 - DNA, 12 bp, Homo sapiens
cttgatgactgc

SEQ ID NO: 576036 - DNA, 16 bp, Homo sapiens
cttgatgactgccttg

SEQ ID NO: 576037 - DNA, 19 bp, Homo sapiens
cttgatttcaaagttttgt

SEQ ID NO: 576038 - DNA, 20 bp, Homo sapiens
cttgcataataagctaaaga

SEQ ID NO: 576039 - DNA, 14 bp, Homo sapiens
cttgcctcctcagt

SEQ ID NO: 576040 - DNA, 20 bp, Homo sapiens
cttggaaattcctgtactgt

SEQ ID NO: 576041 - DNA, 16 bp, Homo sapiens
cttggattcaatttta

SEQ ID NO: 576042 - DNA, 14 bp, Homo sapiens
cttggccctttcct

SEQ ID NO: 576043 - DNA, 13 bp, Homo sapiens
cttgtcctctccc

SEQ ID NO: 576044 - DNA, 21 bp, Homo sapiens
ctttagtttttggttgggaat

SEQ ID NO: 576045 - DNA, 15 bp, Homo sapiens
ctttattaatgtttt

SEQ ID NO: 576046 - DNA, 14 bp, Homo sapiens
ctttggattctaaa

SEQ ID NO: 576047 - DNA, 18 bp, Homo sapiens
ctttggattctaaataca

SEQ ID NO: 576048 - DNA, 20 bp, Homo sapiens
ctttggattctaaatacatg

SEQ ID NO: 576049 - DNA, 14 bp, Homo sapiens
ctttgggaaaacat

SEQ ID NO: 576050 - DNA, 21 bp, Homo sapiens
ctttgggaaaacatgttaatg

SEQ ID NO: 576051 - DNA, 14 bp, Homo sapiens
ctttgtaaaggtca

SEQ ID NO: 576052 - DNA, 15 bp, Homo sapiens
ctttgtaaaggtcag

SEQ ID NO: 576053 - DNA, 21 bp, Homo sapiens
cttttgaagcatagataatat

SEQ ID NO: 576054 - DNA, 14 bp, Homo sapiens
cttttgtttggtaa

SEQ ID NO: 576055 - DNA, 15 bp, Homo sapiens
cttttgtttggtaaa

SEQ ID NO: 576056 - DNA, 16 bp, Homo sapiens
gaaaaatataaaatta

SEQ ID NO: 576057 - DNA, 20 bp, Homo sapiens
gaaaacatgttaatgacaat

SEQ ID NO: 576058 - DNA, 14 bp, Homo sapiens
gaaaacttgaatct

SEQ ID NO: 576059 - DNA, 16 bp, Homo sapiens
gaaaacttgaatctgt

SEQ ID NO: 576060 - DNA, 11 bp, Homo sapiens
gaaaagcccag

SEQ ID NO: 576061 - DNA, 21 bp, Homo sapiens
gaaaagcccagtgacctgacc

SEQ ID NO: 576062 - DNA, 20 bp, Homo sapiens
gaaaaggaagactagaggct

SEQ ID NO: 576063 - DNA, 16 bp, Homo sapiens
gaaaccaaagaagaaa

SEQ ID NO: 576064 - DNA, 15 bp, Homo sapiens
gaaaccccagggcag

SEQ ID NO: 576065 - DNA, 17 bp, Homo sapiens
gaaagccgtactgtcta

SEQ ID NO: 576066 - DNA, 16 bp, Homo sapiens
gaaagccttagggaag

SEQ ID NO: 576067 - DNA, 18 bp, Homo sapiens
gaaatataacacattttt

SEQ ID NO: 576068 - DNA, 14 bp, Homo sapiens
gaattgaaaagttt

SEQ ID NO: 576069 - DNA, 17 bp, Homo sapiens
gaattgaaaagtttttg

SEQ ID NO: 576070 - DNA, 19 bp, Homo sapiens
gacatgcaataaaatttaa

SEQ ID NO: 576071 - DNA, 23 bp, Homo sapiens
gaccacagggttcaaaatgtctg

SEQ ID NO: 576072 - DNA, 22 bp, Homo sapiens
gaccacttccaggggaacctgc

SEQ ID NO: 576073 - DNA, 19 bp, Homo sapiens
gaccattttttaatttact

SEQ ID NO: 576074 - DNA, 20 bp, Homo sapiens
gaccattttttaatttactt

SEQ ID NO: 576075 - DNA, 13 bp, Homo sapiens
gacccagggggag

SEQ ID NO: 576076 - DNA, 13 bp, Homo sapiens
gacctgaccggca

SEQ ID NO: 576077 - DNA, 23 bp, Homo sapiens
gacgtttataaacagaaatggaa

SEQ ID NO: 576078 - DNA, 10 bp, Homo sapiens
gactaaagag

SEQ ID NO: 576079 - DNA, 20 bp, Homo sapiens
gactatatatataaatgtat

SEQ ID NO: 576080 - DNA, 13 bp, Homo sapiens
gagaagcatgaaa

SEQ ID NO: 576081 - DNA, 23 bp, Homo sapiens
gagaatgagtccttgatttcaaa

SEQ ID NO: 576082 - DNA, 15 bp, Homo sapiens
gagacaaggaaccac

SEQ ID NO: 576083 - DNA, 13 bp, Homo sapiens
gagactgtccctg

SEQ ID NO: 576084 - DNA, 12 bp, Homo sapiens
gagagaaggaca

SEQ ID NO: 576085 - DNA, 15 bp, Homo sapiens
gagaggtccctgctt

SEQ ID NO: 576086 - DNA, 23 bp, Homo sapiens
gagaggtccctgcttacctgacg

SEQ ID NO: 576087 - DNA, 16 bp, Homo sapiens
gagcagggaaggcctg

SEQ ID NO: 576088 - DNA, 22 bp, Homo sapiens
gagccatcggtgaaactaacag

SEQ ID NO: 576089 - DNA, 19 bp, Homo sapiens
gagctctgaaatcttccca

SEQ ID NO: 576090 - DNA, 21 bp, Homo sapiens
gagctcttcctatccctctcc

SEQ ID NO: 576091 - DNA, 13 bp, Homo sapiens
gaggaaaattctt

SEQ ID NO: 576092 - DNA, 19 bp, Homo sapiens
gaggaaggaacagcaatgg

SEQ ID NO: 576093 - DNA, 18 bp, Homo sapiens
gaggccctgcccaatgag

SEQ ID NO: 576094 - DNA, 22 bp, Homo sapiens
gaggcgcagcccgaagcccagt

SEQ ID NO: 576095 - DNA, 20 bp, Homo sapiens
gaggctgaaagaggccaatg

SEQ ID NO: 576096 - DNA, 13 bp, Homo sapiens
gaggtgggagggc

SEQ ID NO: 576097 - DNA, 20 bp, Homo sapiens
gagtattgtttaaaatgtaa

SEQ ID NO: 576098 - DNA, 20 bp, Homo sapiens
gagtatttaggcagattgaa

SEQ ID NO: 576099 - DNA, 16 bp, Homo sapiens
gagttttcattaaatc

SEQ ID NO: 576100 - DNA, 17 bp, Homo sapiens
gatagtgggatttccag

SEQ ID NO: 576101 - DNA, 19 bp, Homo sapiens
gatagtgggatttccagaa

SEQ ID NO: 576102 - DNA, 20 bp, Homo sapiens
gatatgtattcttttctcag

SEQ ID NO: 576103 - DNA, 16 bp, Homo sapiens
gatattgtgaagtaca

SEQ ID NO: 576104 - DNA, 23 bp, Homo sapiens
gatccatttccattgcttattat

SEQ ID NO: 576105 - DNA, 15 bp, Homo sapiens
gatctttcagaaata

SEQ ID NO: 576106 - DNA, 12 bp, Homo sapiens
gatgactgcctt

SEQ ID NO: 576107 - DNA, 13 bp, Homo sapiens
gatgactgccttg

SEQ ID NO: 576108 - DNA, 16 bp, Homo sapiens
gatgcgaaaacttgaa

SEQ ID NO: 576109 - DNA, 20 bp, Homo sapiens
gatgcgaaaacttgaatctg

SEQ ID NO: 576110 - DNA, 21 bp, Homo sapiens
gatgcgaaaacttgaatctgt

SEQ ID NO: 576111 - DNA, 15 bp, Homo sapiens
gatggcttgtctata

SEQ ID NO: 576112 - DNA, 17 bp, Homo sapiens
gattattttttttttct

SEQ ID NO: 576113 - DNA, 13 bp, Homo sapiens
gattctaaataca

SEQ ID NO: 576114 - DNA, 14 bp, Homo sapiens
gattctaaatacat

SEQ ID NO: 576115 - DNA, 16 bp, Homo sapiens
gattctggctttaagc

SEQ ID NO: 576116 - DNA, 20 bp, Homo sapiens
gattctggctttaagccttc

SEQ ID NO: 576117 - DNA, 14 bp, Homo sapiens
gattgcctctgaaa

SEQ ID NO: 576118 - DNA, 16 bp, Homo sapiens
gatttgaaaaatataa

SEQ ID NO: 576119 - DNA, 15 bp, Homo sapiens
gatttgcctcacctt

SEQ ID NO: 576120 - DNA, 19 bp, Homo sapiens
gatttggcactagccaaag

SEQ ID NO: 576121 - DNA, 15 bp, Homo sapiens
gcaacagcctttgaa

SEQ ID NO: 576122 - DNA, 19 bp, Homo sapiens
gcaacagcctttgaatgta

SEQ ID NO: 576123 - DNA, 23 bp, Homo sapiens
gcaacagcctttgaatgtaacca

SEQ ID NO: 576124 - DNA, 21 bp, Homo sapiens
gcaataaaatttaaaaaataa

SEQ ID NO: 576125 - DNA, 15 bp, Homo sapiens
gcaatttcccctctg

SEQ ID NO: 576126 - DNA, 12 bp, Homo sapiens
gcacctcagaca

SEQ ID NO: 576127 - DNA, 21 bp, Homo sapiens
gcacctgcgagaggtccctgc

SEQ ID NO: 576128 - DNA, 15 bp, Homo sapiens
gcactccctaagaaa

SEQ ID NO: 576129 - DNA, 18 bp, Homo sapiens
gcactccctaagaaaccc

SEQ ID NO: 576130 - DNA, 18 bp, Homo sapiens
gcacttattgaccatttt

SEQ ID NO: 576131 - DNA, 15 bp, Homo sapiens
gcagaagccctgatg

SEQ ID NO: 576132 - DNA, 16 bp, Homo sapiens
gcagagatttctcatt

SEQ ID NO: 576133 - DNA, 12 bp, Homo sapiens
gcagagttttca

SEQ ID NO: 576134 - DNA, 17 bp, Homo sapiens
gcagcccgaagcccagt

SEQ ID NO: 576135 - DNA, 23 bp, Homo sapiens
gcagctgtcatggaaaagcccag

SEQ ID NO: 576136 - DNA, 15 bp, Homo sapiens
gcagggaaggcctga

SEQ ID NO: 576137 - DNA, 23 bp, Homo sapiens
gcagtattgccacaatgcctctc

SEQ ID NO: 576138 - DNA, 14 bp, Homo sapiens
gcataataagctaa

SEQ ID NO: 576139 - DNA, 18 bp, Homo sapiens
gcataataagctaaagag

SEQ ID NO: 576140 - DNA, 19 bp, Homo sapiens
gcatagataatattgtttg

SEQ ID NO: 576141 - DNA, 23 bp, Homo sapiens
gcatagataatattgtttggtaa

SEQ ID NO: 576142 - DNA, 15 bp, Homo sapiens
gcatatcctgagcca

SEQ ID NO: 576143 - DNA, 23 bp, Homo sapiens
gcatcaagaggtgggagggccct

SEQ ID NO: 576144 - DNA, 14 bp, Homo sapiens
gcatgcagctttgc

SEQ ID NO: 576145 - DNA, 15 bp, Homo sapiens
gccacatcaaacctt

SEQ ID NO: 576146 - DNA, 18 bp, Homo sapiens
gccatgccaggaacctgt

SEQ ID NO: 576147 - DNA, 18 bp, Homo sapiens
gcccccatcccacatgat

SEQ ID NO: 576148 - DNA, 12 bp, Homo sapiens
gcccgaagccca

SEQ ID NO: 576149 - DNA, 14 bp, Homo sapiens
gcccgaagcccagt

SEQ ID NO: 576150 - DNA, 22 bp, Homo sapiens
gccctccgaccacttccagggg

SEQ ID NO: 576151 - DNA, 22 bp, Homo sapiens
gccctgatgtgtcctcagggag

SEQ ID NO: 576152 - DNA, 23 bp, Homo sapiens
gccgtgcactccctaagaaaccc

SEQ ID NO: 576153 - DNA, 21 bp, Homo sapiens
gcctacatcccgggcctcagt

SEQ ID NO: 576154 - DNA, 22 bp, Homo sapiens
gcctacatcccgggcctcagtg

SEQ ID NO: 576155 - DNA, 16 bp, Homo sapiens
gcctgagaggggaagc

SEQ ID NO: 576156 - DNA, 22 bp, Homo sapiens
gccttcaaaactatagcttgca

SEQ ID NO: 576157 - DNA, 22 bp, Homo sapiens
gccttccagggatttgcctcac

SEQ ID NO: 576158 - DNA, 17 bp, Homo sapiens
gccttgatgactgcctt

SEQ ID NO: 576159 - DNA, 12 bp, Homo sapiens
gccttgcctcct

SEQ ID NO: 576160 - DNA, 16 bp, Homo sapiens
gccttgcctcctcagt

SEQ ID NO: 576161 - DNA, 11 bp, Homo sapiens
gcctttgaatg

SEQ ID NO: 576162 - DNA, 15 bp, Homo sapiens
gcctttgaatgtaac

SEQ ID NO: 576163 - DNA, 20 bp, Homo sapiens
gcgaaaacttgaatctgtta

SEQ ID NO: 576164 - DNA, 18 bp, Homo sapiens
gcgagaggtccctgctta

SEQ ID NO: 576165 - DNA, 13 bp, Homo sapiens
aacatttgctgcc

SEQ ID NO: 576166 - DNA, 13 bp, Homo sapiens
aaccaaagaagaa

SEQ ID NO: 576167 - DNA, 23 bp, Homo sapiens
aaccaatcctactaataaaccag

SEQ ID NO: 576168 - DNA, 16 bp, Homo sapiens
aacccagtttcccgtc

SEQ ID NO: 576169 - DNA, 19 bp, Homo sapiens
aaccttccttcctgcttga

SEQ ID NO: 576170 - DNA, 22 bp, Homo sapiens
aactaaatttcactactagatt

SEQ ID NO: 576171 - DNA, 13 bp, Homo sapiens
aactactgtaatt

SEQ ID NO: 576172 - DNA, 20 bp, Homo sapiens
aactactgtaattaagtgca

SEQ ID NO: 576173 - DNA, 19 bp, Homo sapiens
aactataaactactgtaat

SEQ ID NO: 576174 - DNA, 18 bp, Homo sapiens
aactccagtctcctgaca

SEQ ID NO: 576175 - DNA, 20 bp, Homo sapiens
aactccagtctcctgacatt

SEQ ID NO: 576176 - DNA, 22 bp, Homo sapiens
aactgagccaaacacactgtaa

SEQ ID NO: 576177 - DNA, 19 bp, Homo sapiens
aactggctgtttgatagca

SEQ ID NO: 576178 - DNA, 14 bp, Homo sapiens
aactttgtaaaaat

SEQ ID NO: 576179 - DNA, 21 bp, Homo sapiens
aactttgtaaaaatcttttga

SEQ ID NO: 576180 - DNA, 14 bp, Homo sapiens
aagaaaattgagtt

SEQ ID NO: 576181 - DNA, 19 bp, Homo sapiens
aagaaataatgctacaatt

SEQ ID NO: 576182 - DNA, 12 bp, Homo sapiens
aagaacatagaa

SEQ ID NO: 576183 - DNA, 12 bp, Homo sapiens
aagaagacatga

SEQ ID NO: 576184 - DNA, 14 bp, Homo sapiens
aagaagtaaatttg

SEQ ID NO: 576185 - DNA, 20 bp, Homo sapiens
aagactagaggcttgcataa

SEQ ID NO: 576186 - DNA, 14 bp, Homo sapiens
aagactatatatat

SEQ ID NO: 576187 - DNA, 16 bp, Homo sapiens
aagagaatgagtcctt

SEQ ID NO: 576188 - DNA, 15 bp, Homo sapiens
aagagagatgttttg

SEQ ID NO: 576189 - DNA, 18 bp, Homo sapiens
aagaggctgaaagaggcc

SEQ ID NO: 576190 - DNA, 17 bp, Homo sapiens
aagagggagaagcatga

SEQ ID NO: 576191 - DNA, 17 bp, Homo sapiens
aagaggtgggagggccc

SEQ ID NO: 576192 - DNA, 18 bp, Homo sapiens
aagagtttcagtttgttg

SEQ ID NO: 576193 - DNA, 19 bp, Homo sapiens
aagagtttcagtttgttgg

SEQ ID NO: 576194 - DNA, 17 bp, Homo sapiens
aagcaagaaagccgtac

SEQ ID NO: 576195 - DNA, 23 bp, Homo sapiens
aagcactcctgcttaatcttcaa

SEQ ID NO: 576196 - DNA, 14 bp, Homo sapiens
aagcccagtttccc

SEQ ID NO: 576197 - DNA, 20 bp, Homo sapiens
aagccccttgtcctctcccg

SEQ ID NO: 576198 - DNA, 16 bp, Homo sapiens
aagccgtactgtctat

SEQ ID NO: 576199 - DNA, 15 bp, Homo sapiens
aagctgcagagattt

SEQ ID NO: 576200 - DNA, 17 bp, Homo sapiens
aagctgcagagatttct

SEQ ID NO: 576201 - DNA, 23 bp, Homo sapiens
aagctgcagagatttctcattga

SEQ ID NO: 576202 - DNA, 12 bp, Homo sapiens
aaggaaccttcc

SEQ ID NO: 576203 - DNA, 23 bp, Homo sapiens
aaggaaccttccttcctgcttga

SEQ ID NO: 576204 - DNA, 20 bp, Homo sapiens
aaggaccctgttttccacac

SEQ ID NO: 576205 - DNA, 14 bp, Homo sapiens
aaggatagtaagca

SEQ ID NO: 576206 - DNA, 16 bp, Homo sapiens
aaggcatatttaacaa

SEQ ID NO: 576207 - DNA, 15 bp, Homo sapiens
aagggaaagtttttt

SEQ ID NO: 576208 - DNA, 22 bp, Homo sapiens
aaggtgggccttgctacctcaa

SEQ ID NO: 576209 - DNA, 20 bp, Homo sapiens
aagtaagaagacatgaacca

SEQ ID NO: 576210 - DNA, 20 bp, Homo sapiens
aagtatcagctacaattgta

SEQ ID NO: 576211 - DNA, 19 bp, Homo sapiens
aagtgatctgtcccctctc

SEQ ID NO: 576212 - DNA, 21 bp, Homo sapiens
aagtgatctgtcccctctccc

SEQ ID NO: 576213 - DNA, 15 bp, Homo sapiens
aagtgtgtatatatt

SEQ ID NO: 576214 - DNA, 21 bp, Homo sapiens
aagttcatgtccaaacgtcct

SEQ ID NO: 576215 - DNA, 18 bp, Homo sapiens
aataaataaaaactaatt

SEQ ID NO: 576216 - DNA, 21 bp, Homo sapiens
aataccacatcaaataagaaa

SEQ ID NO: 576217 - DNA, 17 bp, Homo sapiens
aatagctaagatataat

SEQ ID NO: 576218 - DNA, 15 bp, Homo sapiens
aatataaaattatga

SEQ ID NO: 576219 - DNA, 14 bp, Homo sapiens
aatataacacattt

SEQ ID NO: 576220 - DNA, 15 bp, Homo sapiens
aatataacacatttt

SEQ ID NO: 576221 - DNA, 19 bp, Homo sapiens
aatatagctttcataacat

SEQ ID NO: 576222 - DNA, 14 bp, Homo sapiens
aatcattcagaaat

SEQ ID NO: 576223 - DNA, 23 bp, Homo sapiens
aatcattcagaaatgttgagtct

SEQ ID NO: 576224 - DNA, 13 bp, Homo sapiens
aatccagttataa

SEQ ID NO: 576225 - DNA, 18 bp, Homo sapiens
aatctctttttgtttgcc

SEQ ID NO: 576226 - DNA, 15 bp, Homo sapiens
aatctgttactgaaa

SEQ ID NO: 576227 - DNA, 17 bp, Homo sapiens
aatcttcaaagccttct

SEQ ID NO: 576228 - DNA, 17 bp, Homo sapiens
aatgaaccataaattca

SEQ ID NO: 576229 - DNA, 12 bp, Homo sapiens
aatgacaatatt

SEQ ID NO: 576230 - DNA, 17 bp, Homo sapiens
aatgaggaaaattctta

SEQ ID NO: 576231 - DNA, 17 bp, Homo sapiens
aatgccatctatctagt

SEQ ID NO: 576232 - DNA, 13 bp, Homo sapiens
aatgcctctccca

SEQ ID NO: 576233 - DNA, 14 bp, Homo sapiens
aatgctaattttat

SEQ ID NO: 576234 - DNA, 15 bp, Homo sapiens
aatggaggaatatga

SEQ ID NO: 576235 - DNA, 14 bp, Homo sapiens
aatggtaataagca

SEQ ID NO: 576236 - DNA, 17 bp, Homo sapiens
aatgttgtattcagtga

SEQ ID NO: 576237 - DNA, 18 bp, Homo sapiens
aattaagcaaatgttaaa

SEQ ID NO: 576238 - DNA, 14 bp, Homo sapiens
aattaagtgcaatt

SEQ ID NO: 576239 - DNA, 15 bp, Homo sapiens
aattaagtgcaattt

SEQ ID NO: 576240 - DNA, 18 bp, Homo sapiens
aattaagtgcaatttccc

SEQ ID NO: 576241 - DNA, 15 bp, Homo sapiens
aattcaactttgtaa

SEQ ID NO: 576242 - DNA, 18 bp, Homo sapiens
aattgagttgcacttatt

SEQ ID NO: 576243 - DNA, 16 bp, Homo sapiens
aattgcatactttgta

SEQ ID NO: 576244 - DNA, 16 bp, Homo sapiens
aatttacttgttttgg

SEQ ID NO: 576245 - DNA, 22 bp, Homo sapiens
aatttcactactagattgacta

SEQ ID NO: 576246 - DNA, 23 bp, Homo sapiens
aatttgtccaatggctgtaaact

SEQ ID NO: 576247 - DNA, 20 bp, Homo sapiens
aattttgtatgttaaagaga

SEQ ID NO: 576248 - DNA, 20 bp, Homo sapiens
aatttttatgtaattatata

SEQ ID NO: 576249 - DNA, 12 bp, Homo sapiens
acaaggaaccac

SEQ ID NO: 576250 - DNA, 24 bp, Homo sapiens
acaaggaaccaccgaagaggaagc

SEQ ID NO: 576251 - DNA, 23 bp, Homo sapiens
acaatcaactctaatagtgctta

SEQ ID NO: 576252 - DNA, 17 bp, Homo sapiens
acaatccactctcagga

SEQ ID NO: 576253 - DNA, 12 bp, Homo sapiens
acaattttaaga

SEQ ID NO: 576254 - DNA, 13 bp, Homo sapiens
acacacctctgga

SEQ ID NO: 576255 - DNA, 17 bp, Homo sapiens
acacatttgctactgtt

SEQ ID NO: 576256 - DNA, 13 bp, Homo sapiens
acacatttttttg

SEQ ID NO: 576257 - DNA, 18 bp, Homo sapiens
acactgtaaatatccaca

SEQ ID NO: 576258 - DNA, 19 bp, Homo sapiens
acactgtaaatatccacag

SEQ ID NO: 576259 - DNA, 16 bp, Homo sapiens
acagactccctcccct

SEQ ID NO: 576260 - DNA, 16 bp, Homo sapiens
acagagtgcttttctg

SEQ ID NO: 576261 - DNA, 20 bp, Homo sapiens
acagataagcaagagagatg

SEQ ID NO: 576262 - DNA, 20 bp, Homo sapiens
acagattctttcagttcttt

SEQ ID NO: 576263 - DNA, 21 bp, Homo sapiens
acagattctttcagttctttg

SEQ ID NO: 576264 - DNA, 16 bp, Homo sapiens
acagcctttgaatgta

SEQ ID NO: 576265 - DNA, 14 bp, Homo sapiens
acaggcaccgagaa

SEQ ID NO: 576266 - DNA, 21 bp, Homo sapiens
acaggcaccgagaatgttgta

SEQ ID NO: 576267 - DNA, 23 bp, Homo sapiens
acagtatgtgggatattgaatgt

SEQ ID NO: 576268 - DNA, 18 bp, Homo sapiens
acataagcttccatttta

SEQ ID NO: 576269 - DNA, 13 bp, Homo sapiens
acatcaaaccttt

SEQ ID NO: 576270 - DNA, 14 bp, Homo sapiens
acatcaaataagaa

SEQ ID NO: 576271 - DNA, 15 bp, Homo sapiens
acatcccgggcctca

SEQ ID NO: 576272 - DNA, 17 bp, Homo sapiens
acatcccgggcctcagt

SEQ ID NO: 576273 - DNA, 18 bp, Homo sapiens
acatctgacctggcatct

SEQ ID NO: 576274 - DNA, 17 bp, Homo sapiens
acatgcatttgaggtca

SEQ ID NO: 576275 - DNA, 17 bp, Homo sapiens
acatgtaataaaaagta

SEQ ID NO: 576276 - DNA, 23 bp, Homo sapiens
acatgtaataaaaagtatatgtt

SEQ ID NO: 576277 - DNA, 13 bp, Homo sapiens
acatgtatgtaaa

SEQ ID NO: 576278 - DNA, 23 bp, Homo sapiens
acatgtgatacattttttaagct

SEQ ID NO: 576279 - DNA, 11 bp, Homo sapiens
acatgtgctat

SEQ ID NO: 576280 - DNA, 22 bp, Homo sapiens
atataatactaaagtgtctatt

SEQ ID NO: 576281 - DNA, 16 bp, Homo sapiens
atataatttaaacgtg

SEQ ID NO: 576282 - DNA, 17 bp, Homo sapiens
atatacagtatagattt

SEQ ID NO: 576283 - DNA, 13 bp, Homo sapiens
atatactatattt

SEQ ID NO: 576284 - DNA, 16 bp, Homo sapiens
atatatataaatgtat

SEQ ID NO: 576285 - DNA, 16 bp, Homo sapiens
atatattttgtgtgaa

SEQ ID NO: 576286 - DNA, 19 bp, Homo sapiens
atatattttgtgtgaaatt

SEQ ID NO: 576287 - DNA, 14 bp, Homo sapiens
atatcctgagccat

SEQ ID NO: 576288 - DNA, 23 bp, Homo sapiens
atatctcaatgaaccataaattc

SEQ ID NO: 576289 - DNA, 22 bp, Homo sapiens
atatgggttgcatttggtcaag

SEQ ID NO: 576290 - DNA, 15 bp, Homo sapiens
atattactgacattt

SEQ ID NO: 576291 - DNA, 13 bp, Homo sapiens
atattgaatgtta

SEQ ID NO: 576292 - DNA, 18 bp, Homo sapiens
atattgtttggtaaatgt

SEQ ID NO: 576293 - DNA, 20 bp, Homo sapiens
atatttatgtagatgtgcat

SEQ ID NO: 576294 - DNA, 13 bp, Homo sapiens
atattttgtgtga

SEQ ID NO: 576295 - DNA, 22 bp, Homo sapiens
atattttgtgtgaaattgcata

SEQ ID NO: 576296 - DNA, 19 bp, Homo sapiens
atatttttctcaatgttta

SEQ ID NO: 576297 - DNA, 18 bp, Homo sapiens
atcactgtatcattttct

SEQ ID NO: 576298 - DNA, 19 bp, Homo sapiens
atcactgtatcattttctt

SEQ ID NO: 576299 - DNA, 22 bp, Homo sapiens
atcagtaacccccttaaattta

SEQ ID NO: 576300 - DNA, 14 bp, Homo sapiens
atcattcagaaatg

SEQ ID NO: 576301 - DNA, 16 bp, Homo sapiens
atccatttccattgct

SEQ ID NO: 576302 - DNA, 20 bp, Homo sapiens
atcctaagtgggaagtgaag

SEQ ID NO: 576303 - DNA, 17 bp, Homo sapiens
atcctactaataaacca

SEQ ID NO: 576304 - DNA, 17 bp, Homo sapiens
atcgaacaaactgatgc

SEQ ID NO: 576305 - DNA, 18 bp, Homo sapiens
atcgaacaaactgatgcg

SEQ ID NO: 576306 - DNA, 13 bp, Homo sapiens
atctaattctgat

SEQ ID NO: 576307 - DNA, 15 bp, Homo sapiens
atctaattctgattc

SEQ ID NO: 576308 - DNA, 16 bp, Homo sapiens
atctatctagttctaa

SEQ ID NO: 576309 - DNA, 16 bp, Homo sapiens
atctctttttgtttgc

SEQ ID NO: 576310 - DNA, 15 bp, Homo sapiens
atctgtcccctctcc

SEQ ID NO: 576311 - DNA, 16 bp, Homo sapiens
atctgtcccctctccc

SEQ ID NO: 576312 - DNA, 18 bp, Homo sapiens
atctgtcccctctcccct

SEQ ID NO: 576313 - DNA, 15 bp, Homo sapiens
atctgttactgaaat

SEQ ID NO: 576314 - DNA, 16 bp, Homo sapiens
atctgttactgaaatg

SEQ ID NO: 576315 - DNA, 15 bp, Homo sapiens
atcttcaaagccttc

SEQ ID NO: 576316 - DNA, 13 bp, Homo sapiens
atcttcacttcta

SEQ ID NO: 576317 - DNA, 16 bp, Homo sapiens
atctttcagaaatata

SEQ ID NO: 576318 - DNA, 15 bp, Homo sapiens
atgacggaagaacat

SEQ ID NO: 576319 - DNA, 21 bp, Homo sapiens
atgactaaagagagaatgtag

SEQ ID NO: 576320 - DNA, 23 bp, Homo sapiens
atgactaaagagagaatgtagat

SEQ ID NO: 576321 - DNA, 18 bp, Homo sapiens
atgactgccttgcctcct

SEQ ID NO: 576322 - DNA, 18 bp, Homo sapiens
atgagactctagggtcca

SEQ ID NO: 576323 - DNA, 14 bp, Homo sapiens
atgagccagacaaa

SEQ ID NO: 576324 - DNA, 19 bp, Homo sapiens
atgagctctgaaatcttcc

SEQ ID NO: 576325 - DNA, 22 bp, Homo sapiens
atgagctctgaaatcttcccat

SEQ ID NO: 576326 - DNA, 19 bp, Homo sapiens
atgagtccttgatttcaaa

SEQ ID NO: 576327 - DNA, 21 bp, Homo sapiens
atgagtccttgatttcaaagt

SEQ ID NO: 576328 - DNA, 14 bp, Homo sapiens
atgatggttcacgt

SEQ ID NO: 576329 - DNA, 14 bp, Homo sapiens
atgcaaatgagctc

SEQ ID NO: 576330 - DNA, 20 bp, Homo sapiens
atgcaaatgagctctgaaat

SEQ ID NO: 576331 - DNA, 23 bp, Homo sapiens
atgcaataaaatttaaaaaataa

SEQ ID NO: 576332 - DNA, 14 bp, Homo sapiens
atgcagctttgcaa

SEQ ID NO: 576333 - DNA, 20 bp, Homo sapiens
atgcagttagctgaagaatt

SEQ ID NO: 576334 - DNA, 18 bp, Homo sapiens
atgcgaaaacttgaatct

SEQ ID NO: 576335 - DNA, 15 bp, Homo sapiens
atgcttcctgacaat

SEQ ID NO: 576336 - DNA, 19 bp, Homo sapiens
atgctttattaatgttttc

SEQ ID NO: 576337 - DNA, 13 bp, Homo sapiens
atggaaaagccca

SEQ ID NO: 576338 - DNA, 14 bp, Homo sapiens
atggaaaagcccag

SEQ ID NO: 576339 - DNA, 15 bp, Homo sapiens
atggaaaagcccagt

SEQ ID NO: 576340 - DNA, 19 bp, Homo sapiens
atggaaaagcccagtgacc

SEQ ID NO: 576341 - DNA, 20 bp, Homo sapiens
atggaaaaggaagactagag

SEQ ID NO: 576342 - DNA, 19 bp, Homo sapiens
atggcagcctactctcctt

SEQ ID NO: 576343 - DNA, 13 bp, Homo sapiens
atggcttgtctat

SEQ ID NO: 576344 - DNA, 22 bp, Homo sapiens
atgggcttttggggagccagaa

SEQ ID NO: 576345 - DNA, 20 bp, Homo sapiens
atggtaataagcactgtaaa

SEQ ID NO: 576346 - DNA, 18 bp, Homo sapiens
atgtaaatagctaagata

SEQ ID NO: 576347 - DNA, 16 bp, Homo sapiens
atgtaacaacaattat

SEQ ID NO: 576348 - DNA, 17 bp, Homo sapiens
atgtaaccaatcctact

SEQ ID NO: 576349 - DNA, 12 bp, Homo sapiens
atgtaatttaaa

SEQ ID NO: 576350 - DNA, 13 bp, Homo sapiens
atgtaatttaaat

SEQ ID NO: 576351 - DNA, 16 bp, Homo sapiens
atgtaatttaaatgaa

SEQ ID NO: 576352 - DNA, 17 bp, Homo sapiens
atgtagatgtgcatttt

SEQ ID NO: 576353 - DNA, 14 bp, Homo sapiens
atgtataaatatac

SEQ ID NO: 576354 - DNA, 17 bp, Homo sapiens
atgtataaatatacagt

SEQ ID NO: 576355 - DNA, 17 bp, Homo sapiens
atgtcaaggactcctgt

SEQ ID NO: 576356 - DNA, 18 bp, Homo sapiens
atgtcaaggactcctgtc

SEQ ID NO: 576357 - DNA, 18 bp, Homo sapiens
atgtctgtagctcctcaa

SEQ ID NO: 576358 - DNA, 21 bp, Homo sapiens
atgtgatacattttttaagct

SEQ ID NO: 576359 - DNA, 22 bp, Homo sapiens
atgtgatacattttttaagctt

SEQ ID NO: 576360 - DNA, 21 bp, Homo sapiens
atgtgctattgaactgagcca

SEQ ID NO: 576361 - DNA, 19 bp, Homo sapiens
atgtgggatattgaatgtt

SEQ ID NO: 576362 - DNA, 14 bp, Homo sapiens
atgtgggggcttca

SEQ ID NO: 576363 - DNA, 18 bp, Homo sapiens
atgtgggggcttcatctc

SEQ ID NO: 576364 - DNA, 19 bp, Homo sapiens
atgtgggggcttcatctct

SEQ ID NO: 576365 - DNA, 17 bp, Homo sapiens
atgtgtcctcagggagc

SEQ ID NO: 576366 - DNA, 18 bp, Homo sapiens
atgtgtcctcagggagca

SEQ ID NO: 576367 - DNA, 21 bp, Homo sapiens
atgtttatgagccagacaaat

SEQ ID NO: 576368 - DNA, 21 bp, Homo sapiens
atgtttcttttgtttggtaaa

SEQ ID NO: 576369 - DNA, 14 bp, Homo sapiens
attaagcaaatgtt

SEQ ID NO: 576370 - DNA, 17 bp, Homo sapiens
attaagcaaatgttaaa

SEQ ID NO: 576371 - DNA, 17 bp, Homo sapiens
attaatgttttcaaaag

SEQ ID NO: 576372 - DNA, 21 bp, Homo sapiens
attacagaggtattaaaacta

SEQ ID NO: 576373 - DNA, 13 bp, Homo sapiens
attactgacattt

SEQ ID NO: 576374 - DNA, 16 bp, Homo sapiens
attactgacatttctt

SEQ ID NO: 576375 - DNA, 15 bp, Homo sapiens
attatacatgtgata

SEQ ID NO: 576376 - DNA, 15 bp, Homo sapiens
attatatatactata

SEQ ID NO: 576377 - DNA, 19 bp, Homo sapiens
attatttttttaaaatttt

SEQ ID NO: 576378 - DNA, 18 bp, Homo sapiens
attcaactttgtaaaaat

SEQ ID NO: 576379 - DNA, 21 bp, Homo sapiens
attcagtgagggtcttcttac

SEQ ID NO: 576380 - DNA, 16 bp, Homo sapiens
attccagatctttcag

SEQ ID NO: 576381 - DNA, 21 bp, Homo sapiens
attcctgtactgtgtctcatg

SEQ ID NO: 576382 - DNA, 13 bp, Homo sapiens
attctataaaact

SEQ ID NO: 576383 - DNA, 24 bp, Homo sapiens
attctataaaactctgcatgtaga

SEQ ID NO: 576384 - DNA, 13 bp, Homo sapiens
attctcactgcta

SEQ ID NO: 576385 - DNA, 15 bp, Homo sapiens
attctgaggccctgc

SEQ ID NO: 576386 - DNA, 17 bp, Homo sapiens
attctgaggccctgccc

SEQ ID NO: 576387 - DNA, 18 bp, Homo sapiens
attctgaggccctgccca

SEQ ID NO: 576388 - DNA, 16 bp, Homo sapiens
attctggctttaagcc

SEQ ID NO: 576389 - DNA, 17 bp, Homo sapiens
attctttccattatgat

SEQ ID NO: 576390 - DNA, 16 bp, Homo sapiens
attgaaaagtttttgt

SEQ ID NO: 576391 - DNA, 23 bp, Homo sapiens
attgaaaagtttttgtttggaga

SEQ ID NO: 576392 - DNA, 13 bp, Homo sapiens
attgaccattttt

SEQ ID NO: 576393 - DNA, 15 bp, Homo sapiens
attgagtattgttta

SEQ ID NO: 576394 - DNA, 21 bp, Homo sapiens
attgagtattgtttaaaatgt

SEQ ID NO: 576395 - DNA, 16 bp, Homo sapiens
catatttaacaaaatt

SEQ ID NO: 576396 - DNA, 22 bp, Homo sapiens
catatttaacaaaatttgaata

SEQ ID NO: 576397 - DNA, 15 bp, Homo sapiens
catcaccctctgggc

SEQ ID NO: 576398 - DNA, 16 bp, Homo sapiens
catcccgggcctcagt

SEQ ID NO: 576399 - DNA, 19 bp, Homo sapiens
catcctaagtgggaagtga

SEQ ID NO: 576400 - DNA, 13 bp, Homo sapiens
catctaattctga

SEQ ID NO: 576401 - DNA, 14 bp, Homo sapiens
catctaattctgat

SEQ ID NO: 576402 - DNA, 16 bp, Homo sapiens
catctaattctgattc

SEQ ID NO: 576403 - DNA, 12 bp, Homo sapiens
catctctttaga

SEQ ID NO: 576404 - DNA, 12 bp, Homo sapiens
catgaaaaagca

SEQ ID NO: 576405 - DNA, 15 bp, Homo sapiens
catgaaaaagcagct

SEQ ID NO: 576406 - DNA, 23 bp, Homo sapiens
catgaaaaagcagctaccaggtg

SEQ ID NO: 576407 - DNA, 15 bp, Homo sapiens
catgcaataaaattt

SEQ ID NO: 576408 - DNA, 16 bp, Homo sapiens
catggaaaagcccagt

SEQ ID NO: 576409 - DNA, 12 bp, Homo sapiens
catggagaaaca

SEQ ID NO: 576410 - DNA, 18 bp, Homo sapiens
catggctgctgttgctta

SEQ ID NO: 576411 - DNA, 22 bp, Homo sapiens
catgtaataaaaagtatatgtt

SEQ ID NO: 576412 - DNA, 17 bp, Homo sapiens
catgtatgtaaatagct

SEQ ID NO: 576413 - DNA, 14 bp, Homo sapiens
catgtatttgagca

SEQ ID NO: 576414 - DNA, 20 bp, Homo sapiens
catgtgctattgaactgagc

SEQ ID NO: 576415 - DNA, 20 bp, Homo sapiens
cattaagacacacctctgga

SEQ ID NO: 576416 - DNA, 13 bp, Homo sapiens
cattatgattctt

SEQ ID NO: 576417 - DNA, 21 bp, Homo sapiens
cattcctaacacagcatgtgt

SEQ ID NO: 576418 - DNA, 23 bp, Homo sapiens
cattctggtcaagggctgtcatt

SEQ ID NO: 576419 - DNA, 15 bp, Homo sapiens
cattgagtattgttt

SEQ ID NO: 576420 - DNA, 16 bp, Homo sapiens
cattgagtattgttta

SEQ ID NO: 576421 - DNA, 14 bp, Homo sapiens
catttagtaagaat

SEQ ID NO: 576422 - DNA, 18 bp, Homo sapiens
catttgctactgttgtaa

SEQ ID NO: 576423 - DNA, 14 bp, Homo sapiens
cattttaattttaa

SEQ ID NO: 576424 - DNA, 23 bp, Homo sapiens
cattttttaatttacttgttttg

SEQ ID NO: 576425 - DNA, 14 bp, Homo sapiens
catttttttgcatg

SEQ ID NO: 576426 - DNA, 17 bp, Homo sapiens
ccaaacacactgtaaat

SEQ ID NO: 576427 - DNA, 22 bp, Homo sapiens
ccaagcaacagcctttgaatgt

SEQ ID NO: 576428 - DNA, 23 bp, Homo sapiens
ccaatgagactctagggtccagt

SEQ ID NO: 576429 - DNA, 15 bp, Homo sapiens
ccaatggctgtaaac

SEQ ID NO: 576430 - DNA, 18 bp, Homo sapiens
ccaatggctgtaaactat

SEQ ID NO: 576431 - DNA, 14 bp, Homo sapiens
ccacaatgcctctc

SEQ ID NO: 576432 - DNA, 17 bp, Homo sapiens
ccacaatgcctctccca

SEQ ID NO: 576433 - DNA, 21 bp, Homo sapiens
ccacatgatcttgagatttct

SEQ ID NO: 576434 - DNA, 21 bp, Homo sapiens
ccaccgaagaggaagcaagaa

SEQ ID NO: 576435 - DNA, 23 bp, Homo sapiens
ccactctcaggaggcgcagcccg

SEQ ID NO: 576436 - DNA, 18 bp, Homo sapiens
ccacttccaggggaacct

SEQ ID NO: 576437 - DNA, 12 bp, Homo sapiens
ccagatcctggg

SEQ ID NO: 576438 - DNA, 13 bp, Homo sapiens
ccagatcctgggt

SEQ ID NO: 576439 - DNA, 21 bp, Homo sapiens
ccagatctttcagaaatataa

SEQ ID NO: 576440 - DNA, 22 bp, Homo sapiens
ccagcttcctgtgggccaggag

SEQ ID NO: 576441 - DNA, 17 bp, Homo sapiens
ccaggggaacctgccat

SEQ ID NO: 576442 - DNA, 24 bp, Homo sapiens
ccaggggaacctgccatgccagga

SEQ ID NO: 576443 - DNA, 13 bp, Homo sapiens
ccagtttcccttc

SEQ ID NO: 576444 - DNA, 14 bp, Homo sapiens
ccatgccaggaacc

SEQ ID NO: 576445 - DNA, 15 bp, Homo sapiens
ccatgccaggaacct

SEQ ID NO: 576446 - DNA, 20 bp, Homo sapiens
ccattaaggggaagaatgaa

SEQ ID NO: 576447 - DNA, 21 bp, Homo sapiens
ccattttaattttaaagtgca

SEQ ID NO: 576448 - DNA, 18 bp, Homo sapiens
ccattttttaatttactt

SEQ ID NO: 576449 - DNA, 23 bp, Homo sapiens
cccagatggctggaaggggtcca

SEQ ID NO: 576450 - DNA, 12 bp, Homo sapiens
cccagggcaggg

SEQ ID NO: 576451 - DNA, 16 bp, Homo sapiens
cccagtttcccttcta

SEQ ID NO: 576452 - DNA, 22 bp, Homo sapiens
cccagtttcccttctatgcagt

SEQ ID NO: 576453 - DNA, 21 bp, Homo sapiens
cccattaaggggaagaatgaa

SEQ ID NO: 576454 - DNA, 21 bp, Homo sapiens
cccctaaaagcactcctgctt

SEQ ID NO: 576455 - DNA, 23 bp, Homo sapiens
cccctcatggagaaacatcctaa

SEQ ID NO: 576456 - DNA, 11 bp, Homo sapiens
cccctctgtgt

SEQ ID NO: 576457 - DNA, 19 bp, Homo sapiens
cccctctgtgtcctctccc

SEQ ID NO: 576458 - DNA, 19 bp, Homo sapiens
ccccttcctcttgtctgat

SEQ ID NO: 576459 - DNA, 13 bp, Homo sapiens
cccgaagcccagt

SEQ ID NO: 576460 - DNA, 14 bp, Homo sapiens
cccgcgggcctgga

SEQ ID NO: 576461 - DNA, 20 bp, Homo sapiens
ccctaaaagcactcctgctt

SEQ ID NO: 576462 - DNA, 21 bp, Homo sapiens
ccctcatggagaaacatccta

SEQ ID NO: 576463 - DNA, 16 bp, Homo sapiens
ccctcccctgccccca

SEQ ID NO: 576464 - DNA, 17 bp, Homo sapiens
ccctctgccctgtatat

SEQ ID NO: 576465 - DNA, 19 bp, Homo sapiens
ccctctgggcagctgtcat

SEQ ID NO: 576466 - DNA, 20 bp, Homo sapiens
ccctctgggcagctgtcatg

SEQ ID NO: 576467 - DNA, 13 bp, Homo sapiens
ccctgcccccatc

SEQ ID NO: 576468 - DNA, 19 bp, Homo sapiens
ccctgtatataatactaaa

SEQ ID NO: 576469 - DNA, 21 bp, Homo sapiens
cccttactggcttacctcctc

SEQ ID NO: 576470 - DNA, 20 bp, Homo sapiens
cccttcctcttgtctgattt

SEQ ID NO: 576471 - DNA, 16 bp, Homo sapiens
cccttgtcctctcccg

SEQ ID NO: 576472 - DNA, 17 bp, Homo sapiens
ccgaccacttccagggg

SEQ ID NO: 576473 - DNA, 14 bp, Homo sapiens
ccgtgcactcccta

SEQ ID NO: 576474 - DNA, 23 bp, Homo sapiens
cctaagaaaccccagggcaggga

SEQ ID NO: 576475 - DNA, 13 bp, Homo sapiens
cctaaggaacctt

SEQ ID NO: 576476 - DNA, 16 bp, Homo sapiens
cctactaataaaccag

SEQ ID NO: 576477 - DNA, 20 bp, Homo sapiens
cctagctcctccccttcctc

SEQ ID NO: 576478 - DNA, 14 bp, Homo sapiens
cctatccctctcct

SEQ ID NO: 576479 - DNA, 15 bp, Homo sapiens
cctatccctctccta

SEQ ID NO: 576480 - DNA, 23 bp, Homo sapiens
cctcagacaatccactctcagga

SEQ ID NO: 576481 - DNA, 17 bp, Homo sapiens
cctcagggagcagggaa

SEQ ID NO: 576482 - DNA, 18 bp, Homo sapiens
cctcagtatgtgggggct

SEQ ID NO: 576483 - DNA, 23 bp, Homo sapiens
cctcagtatgtgggggcttcatc

SEQ ID NO: 576484 - DNA, 15 bp, Homo sapiens
cctcgttggaagagg

SEQ ID NO: 576485 - DNA, 14 bp, Homo sapiens
cctctcccacgatg

SEQ ID NO: 576486 - DNA, 19 bp, Homo sapiens
cctctcccctctgccctgt

SEQ ID NO: 576487 - DNA, 13 bp, Homo sapiens
cctctggatccct

SEQ ID NO: 576488 - DNA, 18 bp, Homo sapiens
cctctggatccctggagg

SEQ ID NO: 576489 - DNA, 20 bp, Homo sapiens
cctgaaacctagtactgccc

SEQ ID NO: 576490 - DNA, 13 bp, Homo sapiens
cctgaccggcacc

SEQ ID NO: 576491 - DNA, 18 bp, Homo sapiens
cctgaccggcacctgcga

SEQ ID NO: 576492 - DNA, 19 bp, Homo sapiens
cctgatgtgtcctcaggga

SEQ ID NO: 576493 - DNA, 15 bp, Homo sapiens
cctgccatgccagga

SEQ ID NO: 576494 - DNA, 19 bp, Homo sapiens
cctgccatgccaggaacct

SEQ ID NO: 576495 - DNA, 14 bp, Homo sapiens
cctgctggcacctc

SEQ ID NO: 576496 - DNA, 17 bp, Homo sapiens
cctgctggcacctcaga

SEQ ID NO: 576497 - DNA, 21 bp, Homo sapiens
cctgctggcacctcagacaat

SEQ ID NO: 576498 - DNA, 23 bp, Homo sapiens
cctgcttaatcttcaaagccttc

SEQ ID NO: 576499 - DNA, 14 bp, Homo sapiens
cctgcttacctgac

SEQ ID NO: 576500 - DNA, 18 bp, Homo sapiens
cctgtcctaaggaacctt

SEQ ID NO: 576501 - DNA, 21 bp, Homo sapiens
cctgtcctaaggaaccttcct

SEQ ID NO: 576502 - DNA, 13 bp, Homo sapiens
cctgttttccaca

SEQ ID NO: 576503 - DNA, 17 bp, Homo sapiens
ccttaagagtcatccag

SEQ ID NO: 576504 - DNA, 18 bp, Homo sapiens
ccttagggaagctggcct

SEQ ID NO: 576505 - DNA, 20 bp, Homo sapiens
ccttcaaaactatagcttgc

SEQ ID NO: 576506 - DNA, 21 bp, Homo sapiens
ccttcctcttgtctgatttct

SEQ ID NO: 576507 - DNA, 22 bp, Homo sapiens
ccttctccctagctcctcccct

SEQ ID NO: 576508 - DNA, 19 bp, Homo sapiens
ccttgaaactttgggaaaa

SEQ ID NO: 576509 - DNA, 18 bp, Homo sapiens
gccacaatgcctctccca

SEQ ID NO: 576510 - DNA, 19 bp, Homo sapiens
gccacaatgcctctcccac

SEQ ID NO: 576511 - DNA, 23 bp, Homo sapiens
gccagcttcctgtgggccaggag

SEQ ID NO: 576512 - DNA, 15 bp, Homo sapiens
gccaggaacctgtcc

SEQ ID NO: 576513 - DNA, 22 bp, Homo sapiens
gccaggaacctgtcctaaggaa

SEQ ID NO: 576514 - DNA, 15 bp, Homo sapiens
gccatgccaggaacc

SEQ ID NO: 576515 - DNA, 18 bp, Homo sapiens
gccccttgtcctctcccg

SEQ ID NO: 576516 - DNA, 14 bp, Homo sapiens
gccctaagggagtg

SEQ ID NO: 576517 - DNA, 17 bp, Homo sapiens
gccgtgcactccctaag

SEQ ID NO: 576518 - DNA, 19 bp, Homo sapiens
gcctacatcccgggcctca

SEQ ID NO: 576519 - DNA, 15 bp, Homo sapiens
gcctcaccttggggc

SEQ ID NO: 576520 - DNA, 16 bp, Homo sapiens
gcctgacttctgctgg

SEQ ID NO: 576521 - DNA, 15 bp, Homo sapiens
gccttgatgactgcc

SEQ ID NO: 576522 - DNA, 22 bp, Homo sapiens
gccttgatgactgccttgcctc

SEQ ID NO: 576523 - DNA, 23 bp, Homo sapiens
gccttgatgactgccttgcctcc

SEQ ID NO: 576524 - DNA, 13 bp, Homo sapiens
gccttggaaattc

SEQ ID NO: 576525 - DNA, 21 bp, Homo sapiens
gctaactccagtctcctgaca

SEQ ID NO: 576526 - DNA, 13 bp, Homo sapiens
gctacaattttaa

SEQ ID NO: 576527 - DNA, 18 bp, Homo sapiens
gctcctcaactcacctaa

SEQ ID NO: 576528 - DNA, 19 bp, Homo sapiens
gctcttcctatccctctcc

SEQ ID NO: 576529 - DNA, 17 bp, Homo sapiens
gctgccatgtgaagagg

SEQ ID NO: 576530 - DNA, 21 bp, Homo sapiens
gctgccatgtgaagagggaga

SEQ ID NO: 576531 - DNA, 21 bp, Homo sapiens
gctgtcatggaaaagcccagt

SEQ ID NO: 576532 - DNA, 19 bp, Homo sapiens
gctgttgcttaaaccactt

SEQ ID NO: 576533 - DNA, 13 bp, Homo sapiens
gcttacctcctca

SEQ ID NO: 576534 - DNA, 12 bp, Homo sapiens
gcttacctgacg

SEQ ID NO: 576535 - DNA, 15 bp, Homo sapiens
gcttcatctctttag

SEQ ID NO: 576536 - DNA, 15 bp, Homo sapiens
gcttcccttactttg

SEQ ID NO: 576537 - DNA, 16 bp, Homo sapiens
gcttgtttacctttct

SEQ ID NO: 576538 - DNA, 13 bp, Homo sapiens
ggaaaacatttgc

SEQ ID NO: 576539 - DNA, 17 bp, Homo sapiens
ggaacagcactggggag

SEQ ID NO: 576540 - DNA, 21 bp, Homo sapiens
ggaacagcactggggagtctt

SEQ ID NO: 576541 - DNA, 20 bp, Homo sapiens
ggaaccaccgaagaggaagc

SEQ ID NO: 576542 - DNA, 20 bp, Homo sapiens
ggaaccttccttcctgcttg

SEQ ID NO: 576543 - DNA, 16 bp, Homo sapiens
ggaagaacatagaact

SEQ ID NO: 576544 - DNA, 13 bp, Homo sapiens
ggaagaatgaaag

SEQ ID NO: 576545 - DNA, 16 bp, Homo sapiens
ggaagaatgaaagctg

SEQ ID NO: 576546 - DNA, 15 bp, Homo sapiens
ggaagcaagaaagcc

SEQ ID NO: 576547 - DNA, 16 bp, Homo sapiens
ggaaggagaagtaaga

SEQ ID NO: 576548 - DNA, 12 bp, Homo sapiens
ggaaggcctgac

SEQ ID NO: 576549 - DNA, 20 bp, Homo sapiens
ggaaggcctgacttctgctg

SEQ ID NO: 576550 - DNA, 17 bp, Homo sapiens
ggaagggaaagtttttt

SEQ ID NO: 576551 - DNA, 16 bp, Homo sapiens
ggaatgaggaaaattc

SEQ ID NO: 576552 - DNA, 17 bp, Homo sapiens
ggaccctgttttccaca

SEQ ID NO: 576553 - DNA, 24 bp, Homo sapiens
ggactcatttcattcctaacacag

SEQ ID NO: 576554 - DNA, 22 bp, Homo sapiens
ggagacgtttataaacagaaat

SEQ ID NO: 576555 - DNA, 13 bp, Homo sapiens
ggagcagggaagg

SEQ ID NO: 576556 - DNA, 16 bp, Homo sapiens
ggagcagggaaggcct

SEQ ID NO: 576557 - DNA, 19 bp, Homo sapiens
ggagcagggaaggcctgac

SEQ ID NO: 576558 - DNA, 21 bp, Homo sapiens
ggagcagggaaggcctgactt

SEQ ID NO: 576559 - DNA, 13 bp, Homo sapiens
ggaggcgcagccc

SEQ ID NO: 576560 - DNA, 19 bp, Homo sapiens
ggatggaaaaggaagacta

SEQ ID NO: 576561 - DNA, 14 bp, Homo sapiens
ggattcaattttaa

SEQ ID NO: 576562 - DNA, 14 bp, Homo sapiens
ggattctaaataca

SEQ ID NO: 576563 - DNA, 18 bp, Homo sapiens
ggatttgcctcaccttgg

SEQ ID NO: 576564 - DNA, 23 bp, Homo sapiens
ggcagctgtcatggaaaagccca

SEQ ID NO: 576565 - DNA, 21 bp, Homo sapiens
ggcatcaagaggtgggagggc

SEQ ID NO: 576566 - DNA, 13 bp, Homo sapiens
ggccagcgtggct

SEQ ID NO: 576567 - DNA, 15 bp, Homo sapiens
ggccaggagctcagc

SEQ ID NO: 576568 - DNA, 19 bp, Homo sapiens
ggcctcagctcaatgcagt

SEQ ID NO: 576569 - DNA, 14 bp, Homo sapiens
ggcctggacactta

SEQ ID NO: 576570 - DNA, 20 bp, Homo sapiens
ggctgaaagaggccaatgcc

SEQ ID NO: 576571 - DNA, 18 bp, Homo sapiens
ggctgccatgtgaagagg

SEQ ID NO: 576572 - DNA, 19 bp, Homo sapiens
ggcttcatctctttagaga

SEQ ID NO: 576573 - DNA, 17 bp, Homo sapiens
ggcttgtttacctttct

SEQ ID NO: 576574 - DNA, 15 bp, Homo sapiens
gggaagctggcctga

SEQ ID NO: 576575 - DNA, 13 bp, Homo sapiens
gggaaggcctgac

SEQ ID NO: 576576 - DNA, 14 bp, Homo sapiens
gggaagtgaagccc

SEQ ID NO: 576577 - DNA, 21 bp, Homo sapiens
gggactgtctttcagatacat

SEQ ID NO: 576578 - DNA, 14 bp, Homo sapiens
gggcacagatgcct

SEQ ID NO: 576579 - DNA, 16 bp, Homo sapiens
gggccaggagctcagc

SEQ ID NO: 576580 - DNA, 21 bp, Homo sapiens
gggccctccgaccacttccag

SEQ ID NO: 576581 - DNA, 16 bp, Homo sapiens
gggccttgatgactgc

SEQ ID NO: 576582 - DNA, 23 bp, Homo sapiens
gggccttgatgactgccttgcct

SEQ ID NO: 576583 - DNA, 18 bp, Homo sapiens
gggctgccatgtgaagag

SEQ ID NO: 576584 - DNA, 20 bp, Homo sapiens
gggcttaatggagttcttgt

SEQ ID NO: 576585 - DNA, 21 bp, Homo sapiens
ggtaaatgtttcttttaaaga

SEQ ID NO: 576586 - DNA, 14 bp, Homo sapiens
ggtccttctccaca

SEQ ID NO: 576587 - DNA, 19 bp, Homo sapiens
ggttcaagccttccaggga

SEQ ID NO: 576588 - DNA, 21 bp, Homo sapiens
ggttgctgctgtccagtgcct

SEQ ID NO: 576589 - DNA, 15 bp, Homo sapiens
gtaaactataaacta

SEQ ID NO: 576590 - DNA, 17 bp, Homo sapiens
gtaaataggaatcattc

SEQ ID NO: 576591 - DNA, 11 bp, Homo sapiens
gtaaatgtttc

SEQ ID NO: 576592 - DNA, 13 bp, Homo sapiens
gtaaatgtttctt

SEQ ID NO: 576593 - DNA, 16 bp, Homo sapiens
gtaagaagacaaactg

SEQ ID NO: 576594 - DNA, 21 bp, Homo sapiens
gtaataagcactgtaaacttc

SEQ ID NO: 576595 - DNA, 17 bp, Homo sapiens
gtaatcccctaaaataa

SEQ ID NO: 576596 - DNA, 19 bp, Homo sapiens
gtaattaagtgcaatttcc

SEQ ID NO: 576597 - DNA, 10 bp, Homo sapiens
gtaatttaaa

SEQ ID NO: 576598 - DNA, 23 bp, Homo sapiens
gtactgccccccatgaggaagga

SEQ ID NO: 576599 - DNA, 15 bp, Homo sapiens
gtagaggcttgttta

SEQ ID NO: 576600 - DNA, 21 bp, Homo sapiens
gtatataatactaaagtgtct

SEQ ID NO: 576601 - DNA, 16 bp, Homo sapiens
gtatcagctacaattg

SEQ ID NO: 576602 - DNA, 18 bp, Homo sapiens
gtatgttaaagagaatga

SEQ ID NO: 576603 - DNA, 20 bp, Homo sapiens
gtattaaaactaaatttcac

SEQ ID NO: 576604 - DNA, 22 bp, Homo sapiens
gtattatacatgtgatacattt

SEQ ID NO: 576605 - DNA, 16 bp, Homo sapiens
gtattttcatgaaaat

SEQ ID NO: 576606 - DNA, 14 bp, Homo sapiens
gtcagctactaatg

SEQ ID NO: 576607 - DNA, 17 bp, Homo sapiens
gtcagctactaatgatg

SEQ ID NO: 576608 - DNA, 14 bp, Homo sapiens
gtcagtatccaggc

SEQ ID NO: 576609 - DNA, 16 bp, Homo sapiens
gtcagtatccaggctt

SEQ ID NO: 576610 - DNA, 19 bp, Homo sapiens
gtccaatggctgtaaacta

SEQ ID NO: 576611 - DNA, 17 bp, Homo sapiens
gtcccctctcccctcat

SEQ ID NO: 576612 - DNA, 14 bp, Homo sapiens
gtcctagtaagaag

SEQ ID NO: 576613 - DNA, 17 bp, Homo sapiens
gtcctagtaagaagaca

SEQ ID NO: 576614 - DNA, 13 bp, Homo sapiens
gtcctctcccctc

SEQ ID NO: 576615 - DNA, 17 bp, Homo sapiens
gtcctctttagtttttg

SEQ ID NO: 576616 - DNA, 16 bp, Homo sapiens
gtcttcttacatgcat

SEQ ID NO: 576617 - DNA, 17 bp, Homo sapiens
gtgattaccccgggaga

SEQ ID NO: 576618 - DNA, 22 bp, Homo sapiens
gtgcaatttcccctctgtgtcc

SEQ ID NO: 576619 - DNA, 23 bp, Homo sapiens
gtgcaatttcccctctgtgtcct

SEQ ID NO: 576620 - DNA, 16 bp, Homo sapiens
gtgcatttttgtgaaa

SEQ ID NO: 576621 - DNA, 23 bp, Homo sapiens
gtgcctacatcccgggcctcagt

SEQ ID NO: 576622 - DNA, 14 bp, Homo sapiens
gtgctattgaactg

SEQ ID NO: 576623 - DNA, 18 bp, Homo sapiens
gtggattctgaggccctg

SEQ ID NO: 576624 - DNA, 21 bp, Homo sapiens
tgaaaaagcagctaccaggtg

SEQ ID NO: 576625 - DNA, 13 bp, Homo sapiens
tgaaaaatataaa

SEQ ID NO: 576626 - DNA, 22 bp, Homo sapiens
tgaaaaatataaaattatgaga

SEQ ID NO: 576627 - DNA, 14 bp, Homo sapiens
tgaaaacatgtaat

SEQ ID NO: 576628 - DNA, 17 bp, Homo sapiens
tgaaacctttttttatc

SEQ ID NO: 576629 - DNA, 19 bp, Homo sapiens
tgaaactttgggaaaacat

SEQ ID NO: 576630 - DNA, 17 bp, Homo sapiens
tgaaagaaaattgagtt

SEQ ID NO: 576631 - DNA, 22 bp, Homo sapiens
tgaaagccttagggaagctggc

SEQ ID NO: 576632 - DNA, 22 bp, Homo sapiens
tgaaatcctgggttttcttaac

SEQ ID NO: 576633 - DNA, 18 bp, Homo sapiens
tgaaatcttcccatgcat

SEQ ID NO: 576634 - DNA, 19 bp, Homo sapiens
tgaaatcttcccatgcatt

SEQ ID NO: 576635 - DNA, 14 bp, Homo sapiens
tgaaatgaaaacat

SEQ ID NO: 576636 - DNA, 20 bp, Homo sapiens
tgaaatgaaaacatgtaata

SEQ ID NO: 576637 - DNA, 22 bp, Homo sapiens
tgaactgagccaaacacactgt

SEQ ID NO: 576638 - DNA, 13 bp, Homo sapiens
tgaagatttaatt

SEQ ID NO: 576639 - DNA, 17 bp, Homo sapiens
tgaagcatagataatat

SEQ ID NO: 576640 - DNA, 22 bp, Homo sapiens
tgaagcatagataatattgttt

SEQ ID NO: 576641 - DNA, 13 bp, Homo sapiens
tgaagtacatatt

SEQ ID NO: 576642 - DNA, 16 bp, Homo sapiens
tgaagttttactgtct

SEQ ID NO: 576643 - DNA, 19 bp, Homo sapiens
tgaatctgttactgaaatg

SEQ ID NO: 576644 - DNA, 14 bp, Homo sapiens
tgaatgtaaccaat

SEQ ID NO: 576645 - DNA, 16 bp, Homo sapiens
tgacaatattccagat

SEQ ID NO: 576646 - DNA, 22 bp, Homo sapiens
tgacatttcttctagtgatgat

SEQ ID NO: 576647 - DNA, 15 bp, Homo sapiens
tgactaactcaaata

SEQ ID NO: 576648 - DNA, 21 bp, Homo sapiens
tgactaactcaaatacacatt

SEQ ID NO: 576649 - DNA, 22 bp, Homo sapiens
tgactaactcaaatacacattt

SEQ ID NO: 576650 - DNA, 16 bp, Homo sapiens
tgactgccttgcctcc

SEQ ID NO: 576651 - DNA, 20 bp, Homo sapiens
tgactgccttgcctcctcag

SEQ ID NO: 576652 - DNA, 21 bp, Homo sapiens
tgacttctgctggcatcaaga

SEQ ID NO: 576653 - DNA, 17 bp, Homo sapiens
tgacttttataaagcat

SEQ ID NO: 576654 - DNA, 22 bp, Homo sapiens
tgagactctagggtccagtgga

SEQ ID NO: 576655 - DNA, 12 bp, Homo sapiens
tgagaggggaag

SEQ ID NO: 576656 - DNA, 23 bp, Homo sapiens
tgagagtatttaggcagattgaa

SEQ ID NO: 576657 - DNA, 15 bp, Homo sapiens
tgagattggttttcc

SEQ ID NO: 576658 - DNA, 14 bp, Homo sapiens
tgagatttctttta

SEQ ID NO: 576659 - DNA, 21 bp, Homo sapiens
tgagatttcttttaaagaagt

SEQ ID NO: 576660 - DNA, 19 bp, Homo sapiens
tgagccaaacacactgtaa

SEQ ID NO: 576661 - DNA, 12 bp, Homo sapiens
tgagctctgaaa

SEQ ID NO: 576662 - DNA, 14 bp, Homo sapiens
tgaggagagaagga

SEQ ID NO: 576663 - DNA, 19 bp, Homo sapiens
tgagggtcttcttacatgc

SEQ ID NO: 576664 - DNA, 20 bp, Homo sapiens
tgaggtcaagtaagaagaca

SEQ ID NO: 576665 - DNA, 19 bp, Homo sapiens
tgagtagatccatttccat

SEQ ID NO: 576666 - DNA, 23 bp, Homo sapiens
tgagtattgtttaaaatgtaatt

SEQ ID NO: 576667 - DNA, 18 bp, Homo sapiens
tgatacattttttaagct

SEQ ID NO: 576668 - DNA, 17 bp, Homo sapiens
tgatgtacagattcttt

SEQ ID NO: 576669 - DNA, 21 bp, Homo sapiens
tgattattttttttttcttct

SEQ ID NO: 576670 - DNA, 18 bp, Homo sapiens
tgattgggaaaacatttg

SEQ ID NO: 576671 - DNA, 21 bp, Homo sapiens
tgattgggaaaacatttgctg

SEQ ID NO: 576672 - DNA, 14 bp, Homo sapiens
tgattgtcagctac

SEQ ID NO: 576673 - DNA, 20 bp, Homo sapiens
tgatttcaaagttttgttgt

SEQ ID NO: 576674 - DNA, 22 bp, Homo sapiens
tgatttcttaggggaaggagaa

SEQ ID NO: 576675 - DNA, 17 bp, Homo sapiens
tgatttttaaattaaat

SEQ ID NO: 576676 - DNA, 20 bp, Homo sapiens
tgcaaatgagctctgaaatc

SEQ ID NO: 576677 - DNA, 15 bp, Homo sapiens
tgcaacaagcatgca

SEQ ID NO: 576678 - DNA, 21 bp, Homo sapiens
tgcaattgtaggggtgtgtgt

SEQ ID NO: 576679 - DNA, 21 bp, Homo sapiens
tgcacataagcttccatttta

SEQ ID NO: 576680 - DNA, 22 bp, Homo sapiens
tgcacataagcttccattttaa

SEQ ID NO: 576681 - DNA, 14 bp, Homo sapiens
tgcactccctaaga

SEQ ID NO: 576682 - DNA, 23 bp, Homo sapiens
tgcacttattgaccattttttaa

SEQ ID NO: 576683 - DNA, 13 bp, Homo sapiens
tgcagagatttct

SEQ ID NO: 576684 - DNA, 14 bp, Homo sapiens
tgcagctttgcaaa

SEQ ID NO: 576685 - DNA, 15 bp, Homo sapiens
tgcagtattgccaca

SEQ ID NO: 576686 - DNA, 17 bp, Homo sapiens
tgcatatcctgagccat

SEQ ID NO: 576687 - DNA, 18 bp, Homo sapiens
tgcatatcctgagccatc

SEQ ID NO: 576688 - DNA, 15 bp, Homo sapiens
tgcatgcaaatgagc

SEQ ID NO: 576689 - DNA, 22 bp, Homo sapiens
tgcatgcaaatgagctctgaaa

SEQ ID NO: 576690 - DNA, 16 bp, Homo sapiens
tgcatttttgtgaaat

SEQ ID NO: 576691 - DNA, 17 bp, Homo sapiens
tgcatttttgtgaaatg

SEQ ID NO: 576692 - DNA, 19 bp, Homo sapiens
tgccagccccctaaaagca

SEQ ID NO: 576693 - DNA, 21 bp, Homo sapiens
tgccagcttcctgtgggccag

SEQ ID NO: 576694 - DNA, 15 bp, Homo sapiens
tgccatgtgaagagg

SEQ ID NO: 576695 - DNA, 20 bp, Homo sapiens
tgccctgtatataatactaa

SEQ ID NO: 576696 - DNA, 24 bp, Homo sapiens
tgccctgtatataatactaaagtg

SEQ ID NO: 576697 - DNA, 13 bp, Homo sapiens
tgcctcctcagta

SEQ ID NO: 576698 - DNA, 20 bp, Homo sapiens
tgcctctcccacgatgtcaa

SEQ ID NO: 576699 - DNA, 14 bp, Homo sapiens
tgcgaaaacttgaa

SEQ ID NO: 576700 - DNA, 19 bp, Homo sapiens
tgcgcaacaacaaggaccc

SEQ ID NO: 576701 - DNA, 21 bp, Homo sapiens
tgctaattttattatagtaat

SEQ ID NO: 576702 - DNA, 14 bp, Homo sapiens
tgctacaattttaa

SEQ ID NO: 576703 - DNA, 15 bp, Homo sapiens
tgctattgaactgag

SEQ ID NO: 576704 - DNA, 16 bp, Homo sapiens
tgctattgaactgagc

SEQ ID NO: 576705 - DNA, 19 bp, Homo sapiens
tgctgccattacagaggta

SEQ ID NO: 576706 - DNA, 19 bp, Homo sapiens
tgctgctgtccagtgccta

SEQ ID NO: 576707 - DNA, 13 bp, Homo sapiens
tgctgtccagtgc

SEQ ID NO: 576708 - DNA, 14 bp, Homo sapiens
tgcttaatcttcaa

SEQ ID NO: 576709 - DNA, 21 bp, Homo sapiens
tgcttaatcttcaaagccttc

SEQ ID NO: 576710 - DNA, 20 bp, Homo sapiens
tgctttattaatgttttcaa

SEQ ID NO: 576711 - DNA, 21 bp, Homo sapiens
tgctttattaatgttttcaaa

SEQ ID NO: 576712 - DNA, 20 bp, Homo sapiens
tggaaaaggaagactagagg

SEQ ID NO: 576713 - DNA, 16 bp, Homo sapiens
tggaccttgagaccac

SEQ ID NO: 576714 - DNA, 15 bp, Homo sapiens
tggattctaaataca

SEQ ID NO: 576715 - DNA, 21 bp, Homo sapiens
tggatttggcactagccaaag

SEQ ID NO: 576716 - DNA, 14 bp, Homo sapiens
tggcacctcagaca

SEQ ID NO: 576717 - DNA, 18 bp, Homo sapiens
tggccctttccttccaga

SEQ ID NO: 576718 - DNA, 18 bp, Homo sapiens
tggctggaaggggtccag

SEQ ID NO: 576719 - DNA, 21 bp, Homo sapiens
tggctgtaaactataaactac

SEQ ID NO: 576720 - DNA, 13 bp, Homo sapiens
tggcttgtctata

SEQ ID NO: 576721 - DNA, 23 bp, Homo sapiens
tggctttaagccttcaaaactat

SEQ ID NO: 576722 - DNA, 15 bp, Homo sapiens
tgggaagtgaagccc

SEQ ID NO: 576723 - DNA, 17 bp, Homo sapiens
tgggagacaaggaacca

SEQ ID NO: 576724 - DNA, 14 bp, Homo sapiens
tgggatgaatgcca

SEQ ID NO: 576725 - DNA, 21 bp, Homo sapiens
tgggcagctgtcatggaaaag

SEQ ID NO: 576726 - DNA, 17 bp, Homo sapiens
tgggccaggagctcagc

SEQ ID NO: 576727 - DNA, 13 bp, Homo sapiens
tgggccttgctac

SEQ ID NO: 576728 - DNA, 16 bp, Homo sapiens
tgggctgccatgtgaa

SEQ ID NO: 576729 - DNA, 18 bp, Homo sapiens
tggggcacagatgcctgg

SEQ ID NO: 576730 - DNA, 20 bp, Homo sapiens
tgggtggggggcattgagta

SEQ ID NO: 576731 - DNA, 13 bp, Homo sapiens
tggtaaatgtttc

SEQ ID NO: 576732 - DNA, 15 bp, Homo sapiens
tggtaaatgtttctt

SEQ ID NO: 576733 - DNA, 23 bp, Homo sapiens
tggtcaagggctgtcattgcaca

SEQ ID NO: 576734 - DNA, 17 bp, Homo sapiens
tggtcctagtaagaaga

SEQ ID NO: 576735 - DNA, 19 bp, Homo sapiens
tggtgatttgaaaaatata

SEQ ID NO: 576736 - DNA, 20 bp, Homo sapiens
tggtgatttgaaaaatataa

SEQ ID NO: 576737 - DNA, 13 bp, Homo sapiens
tggttttcctgtg

SEQ ID NO: 576738 - DNA, 18 bp, Homo sapiens
atttcaaagttttgttgt

SEQ ID NO: 576739 - DNA, 23 bp, Homo sapiens
atttcccctctgtgtcctctccc

SEQ ID NO: 576740 - DNA, 22 bp, Homo sapiens
atttctcattgacttttataaa

SEQ ID NO: 576741 - DNA, 18 bp, Homo sapiens
atttcttttaaagaagta

SEQ ID NO: 576742 - DNA, 13 bp, Homo sapiens
atttgaggtcaag

SEQ ID NO: 576743 - DNA, 18 bp, Homo sapiens
atttgattgggatgaatg

SEQ ID NO: 576744 - DNA, 20 bp, Homo sapiens
attttcatgaaaataccatt

SEQ ID NO: 576745 - DNA, 21 bp, Homo sapiens
attttcatgaaaataccattt

SEQ ID NO: 576746 - DNA, 20 bp, Homo sapiens
atttttgtgaaatgaaaaca

SEQ ID NO: 576747 - DNA, 12 bp, Homo sapiens
attttttaagct

SEQ ID NO: 576748 - DNA, 15 bp, Homo sapiens
atttttttaaaattt

SEQ ID NO: 576749 - DNA, 14 bp, Homo sapiens
caaaagtgatctgt

SEQ ID NO: 576750 - DNA, 13 bp, Homo sapiens
caaacacactgta

SEQ ID NO: 576751 - DNA, 16 bp, Homo sapiens
caaacacactgtaaat

SEQ ID NO: 576752 - DNA, 11 bp, Homo sapiens
caaagaagaaa

SEQ ID NO: 576753 - DNA, 22 bp, Homo sapiens
caaagttttgttgtacttaaat

SEQ ID NO: 576754 - DNA, 14 bp, Homo sapiens
caaataagaaataa

SEQ ID NO: 576755 - DNA, 14 bp, Homo sapiens
caaatacacatttg

SEQ ID NO: 576756 - DNA, 17 bp, Homo sapiens
caaatacacatttgcta

SEQ ID NO: 576757 - DNA, 16 bp, Homo sapiens
caaatgagctctgaaa

SEQ ID NO: 576758 - DNA, 20 bp, Homo sapiens
caaatgagctctgaaatctt

SEQ ID NO: 576759 - DNA, 21 bp, Homo sapiens
caaatgagctctgaaatcttc

SEQ ID NO: 576760 - DNA, 14 bp, Homo sapiens
caaatggaggaata

SEQ ID NO: 576761 - DNA, 20 bp, Homo sapiens
caacaaggaccctgttttcc

SEQ ID NO: 576762 - DNA, 14 bp, Homo sapiens
caacttcagtccaa

SEQ ID NO: 576763 - DNA, 22 bp, Homo sapiens
caactttgtaaaaatcttttga

SEQ ID NO: 576764 - DNA, 15 bp, Homo sapiens
caagagagatgtttt

SEQ ID NO: 576765 - DNA, 16 bp, Homo sapiens
caagaggtgggagggc

SEQ ID NO: 576766 - DNA, 15 bp, Homo sapiens
caagcaacagccttt

SEQ ID NO: 576767 - DNA, 17 bp, Homo sapiens
caagcatgcagctttgc

SEQ ID NO: 576768 - DNA, 21 bp, Homo sapiens
caaggaccctgttttccacac

SEQ ID NO: 576769 - DNA, 16 bp, Homo sapiens
caagtaagaagacatg

SEQ ID NO: 576770 - DNA, 22 bp, Homo sapiens
caagtaagaagacatgaaccaa

SEQ ID NO: 576771 - DNA, 19 bp, Homo sapiens
caagtggaccttgagacca

SEQ ID NO: 576772 - DNA, 18 bp, Homo sapiens
caagtgtggggggtcctt

SEQ ID NO: 576773 - DNA, 11 bp, Homo sapiens
caataaaattt

SEQ ID NO: 576774 - DNA, 15 bp, Homo sapiens
caatcaactctaata

SEQ ID NO: 576775 - DNA, 14 bp, Homo sapiens
caatccactctcag

SEQ ID NO: 576776 - DNA, 15 bp, Homo sapiens
caatccactctcagg

SEQ ID NO: 576777 - DNA, 20 bp, Homo sapiens
caatcctactaataaaccag

SEQ ID NO: 576778 - DNA, 14 bp, Homo sapiens
caatctctttttgt

SEQ ID NO: 576779 - DNA, 14 bp, Homo sapiens
caatgcctctccca

SEQ ID NO: 576780 - DNA, 21 bp, Homo sapiens
caatggtgtcagtatccaggc

SEQ ID NO: 576781 - DNA, 21 bp, Homo sapiens
caattatttgaagatttaatt

SEQ ID NO: 576782 - DNA, 16 bp, Homo sapiens
cacaatgcctctccca

SEQ ID NO: 576783 - DNA, 14 bp, Homo sapiens
cacaccatcaccct

SEQ ID NO: 576784 - DNA, 13 bp, Homo sapiens
cacactgtaaata

SEQ ID NO: 576785 - DNA, 22 bp, Homo sapiens
cacactgtaaatatccacagac

SEQ ID NO: 576786 - DNA, 15 bp, Homo sapiens
cacagactccctccc

SEQ ID NO: 576787 - DNA, 13 bp, Homo sapiens
cttctaaatgcat

SEQ ID NO: 576788 - DNA, 15 bp, Homo sapiens
cttctatgcagtatt

SEQ ID NO: 576789 - DNA, 21 bp, Homo sapiens
cttctatgcagtattgccaca

SEQ ID NO: 576790 - DNA, 15 bp, Homo sapiens
cttcttacatgcatt

SEQ ID NO: 576791 - DNA, 18 bp, Homo sapiens
cttgaaactttgggaaaa

SEQ ID NO: 576792 - DNA, 19 bp, Homo sapiens
cttgaatctgttactgaaa

SEQ ID NO: 576793 - DNA, 13 bp, Homo sapiens
cttgatgactgcc

SEQ ID NO: 576794 - DNA, 22 bp, Homo sapiens
cttgatgactgccttgcctcct

SEQ ID NO: 576795 - DNA, 15 bp, Homo sapiens
cttgcctcctcagta

SEQ ID NO: 576796 - DNA, 16 bp, Homo sapiens
cttggaaattcctgta

SEQ ID NO: 576797 - DNA, 15 bp, Homo sapiens
cttggattcaatttt

SEQ ID NO: 576798 - DNA, 15 bp, Homo sapiens
cttggccctttcctt

SEQ ID NO: 576799 - DNA, 14 bp, Homo sapiens
cttgtctgatttct

SEQ ID NO: 576800 - DNA, 23 bp, Homo sapiens
cttgtcttctggtactttctgtt

SEQ ID NO: 576801 - DNA, 22 bp, Homo sapiens
cttgtttacctttctctctcta

SEQ ID NO: 576802 - DNA, 17 bp, Homo sapiens
ctttaagccttcaaaac

SEQ ID NO: 576803 - DNA, 20 bp, Homo sapiens
ctttaagccttcaaaactat

SEQ ID NO: 576804 - DNA, 14 bp, Homo sapiens
ctttagtttttggt

SEQ ID NO: 576805 - DNA, 14 bp, Homo sapiens
ctttattaatgttt

SEQ ID NO: 576806 - DNA, 23 bp, Homo sapiens
ctttcagaaatataacacatttt

SEQ ID NO: 576807 - DNA, 14 bp, Homo sapiens
ctttgaatgtaacc

SEQ ID NO: 576808 - DNA, 15 bp, Homo sapiens
ctttgaatgtaacca

SEQ ID NO: 576809 - DNA, 21 bp, Homo sapiens
ctttgagtagatccatttcca

SEQ ID NO: 576810 - DNA, 13 bp, Homo sapiens
ctttgtaaaaatc

SEQ ID NO: 576811 - DNA, 16 bp, Homo sapiens
ctttgtaaaaatcttt

SEQ ID NO: 576812 - DNA, 20 bp, Homo sapiens
ctttgtggattctgaggccc

SEQ ID NO: 576813 - DNA, 15 bp, Homo sapiens
ctttgttacaggcac

SEQ ID NO: 576814 - DNA, 20 bp, Homo sapiens
cttttaaagaagtaaatttg

SEQ ID NO: 576815 - DNA, 12 bp, Homo sapiens
cttttaaagacc

SEQ ID NO: 576816 - DNA, 18 bp, Homo sapiens
cttttaaagaccctccta

SEQ ID NO: 576817 - DNA, 20 bp, Homo sapiens
cttttaccttttttttttct

SEQ ID NO: 576818 - DNA, 18 bp, Homo sapiens
cgagaggtccctgcttac

SEQ ID NO: 576819 - DNA, 17 bp, Homo sapiens
cgatgtcaaggactcct

SEQ ID NO: 576820 - DNA, 18 bp, Homo sapiens
cgcaacaacaaggaccct

SEQ ID NO: 576821 - DNA, 13 bp, Homo sapiens
cgcagaagccctg

SEQ ID NO: 576822 - DNA, 18 bp, Homo sapiens
cgcagcccgaagcccagt

SEQ ID NO: 576823 - DNA, 13 bp, Homo sapiens
cgggagactgaac

SEQ ID NO: 576824 - DNA, 22 bp, Homo sapiens
cgtcctgctggcacctcagaca

SEQ ID NO: 576825 - DNA, 22 bp, Homo sapiens
cgtgcactccctaagaaacccc

SEQ ID NO: 576826 - DNA, 18 bp, Homo sapiens
ctaaagagagaatgtaga

SEQ ID NO: 576827 - DNA, 19 bp, Homo sapiens
ctaaagagagaatgtagat

SEQ ID NO: 576828 - DNA, 17 bp, Homo sapiens
ctaacacagcatgtgta

SEQ ID NO: 576829 - DNA, 14 bp, Homo sapiens
ctaactcaaataca

SEQ ID NO: 576830 - DNA, 16 bp, Homo sapiens
ctaactcaaatacaca

SEQ ID NO: 576831 - DNA, 15 bp, Homo sapiens
ctaagaaaccccagg

SEQ ID NO: 576832 - DNA, 13 bp, Homo sapiens
ctaatgatgtttt

SEQ ID NO: 576833 - DNA, 13 bp, Homo sapiens
ctacaatctcttt

SEQ ID NO: 576834 - DNA, 18 bp, Homo sapiens
ctacaattgtaaactagt

SEQ ID NO: 576835 - DNA, 17 bp, Homo sapiens
ctacatcccgggcctca

SEQ ID NO: 576836 - DNA, 15 bp, Homo sapiens
ctaccaggtgttcta

SEQ ID NO: 576837 - DNA, 17 bp, Homo sapiens
ctactaataaaccagtt

SEQ ID NO: 576838 - DNA, 18 bp, Homo sapiens
ctactaataaaccagttc

SEQ ID NO: 576839 - DNA, 15 bp, Homo sapiens
ctactagattgacta

SEQ ID NO: 576840 - DNA, 12 bp, Homo sapiens
ctagattgacta

SEQ ID NO: 576841 - DNA, 15 bp, Homo sapiens
ctagctcctcccctt

SEQ ID NO: 576842 - DNA, 15 bp, Homo sapiens
ctatagcttgcagaa

SEQ ID NO: 576843 - DNA, 18 bp, Homo sapiens
ctatctagttctaacagt

SEQ ID NO: 576844 - DNA, 22 bp, Homo sapiens
ctattctataaaactctgcatg

SEQ ID NO: 576845 - DNA, 15 bp, Homo sapiens
ctattgaactgagcc

SEQ ID NO: 576846 - DNA, 16 bp, Homo sapiens
ctcaaatacacatttg

SEQ ID NO: 576847 - DNA, 17 bp, Homo sapiens
ctcaactcacctaatgt

SEQ ID NO: 576848 - DNA, 19 bp, Homo sapiens
ctcagggagcagggaaggc

SEQ ID NO: 576849 - DNA, 22 bp, Homo sapiens
ctcagggagcagggaaggcctg

SEQ ID NO: 576850 - DNA, 17 bp, Homo sapiens
ctcagtatgtgggggct

SEQ ID NO: 576851 - DNA, 20 bp, Homo sapiens
ctcagtatgtgggggcttca

SEQ ID NO: 576852 - DNA, 19 bp, Homo sapiens
ctcagtgttggtatatttt

SEQ ID NO: 576853 - DNA, 21 bp, Homo sapiens
ctcagtgttggtatattttat

SEQ ID NO: 576854 - DNA, 18 bp, Homo sapiens
ctcatcttagtgcctgag

SEQ ID NO: 576855 - DNA, 22 bp, Homo sapiens
ctcattgacttttataaagcat

SEQ ID NO: 576856 - DNA, 15 bp, Homo sapiens
ctccagtctcctgac

SEQ ID NO: 576857 - DNA, 16 bp, Homo sapiens
ctccagtctcctgaca

SEQ ID NO: 576858 - DNA, 14 bp, Homo sapiens
ctcccctctgccct

SEQ ID NO: 576859 - DNA, 15 bp, Homo sapiens
ctcccctctgccctg

SEQ ID NO: 576860 - DNA, 16 bp, Homo sapiens
ctcccctctgccctgt

SEQ ID NO: 576861 - DNA, 15 bp, Homo sapiens
ctccctaagaaaccc

SEQ ID NO: 576862 - DNA, 14 bp, Homo sapiens
ctccctagctcctc

SEQ ID NO: 576863 - DNA, 22 bp, Homo sapiens
ctcctcagtatgtgggggcttc

SEQ ID NO: 576864 - DNA, 20 bp, Homo sapiens
ctcctcatggcagcctactc

SEQ ID NO: 576865 - DNA, 15 bp, Homo sapiens
ctcctccccttcctc

SEQ ID NO: 576866 - DNA, 22 bp, Homo sapiens
ctcctgacattaagacacacct

SEQ ID NO: 576867 - DNA, 19 bp, Homo sapiens
ctcctgcttaatcttcaaa

SEQ ID NO: 576868 - DNA, 23 bp, Homo sapiens
ctccttaagctgcagagatttct

SEQ ID NO: 576869 - DNA, 19 bp, Homo sapiens
ctctcaggaggcgcagccc

SEQ ID NO: 576870 - DNA, 20 bp, Homo sapiens
ctctcaggaggcgcagcccg

SEQ ID NO: 576871 - DNA, 21 bp, Homo sapiens
ctctcccacgatgtcaaggac

SEQ ID NO: 576872 - DNA, 23 bp, Homo sapiens
ctctgaaatcttcccatgcattc

SEQ ID NO: 576873 - DNA, 17 bp, Homo sapiens
ctctggatccctggagg

SEQ ID NO: 576874 - DNA, 12 bp, Homo sapiens
ctctgggcagct

SEQ ID NO: 576875 - DNA, 18 bp, Homo sapiens
ctctgggcagctgtcatg

SEQ ID NO: 576876 - DNA, 17 bp, Homo sapiens
ctctgtgtcctctcccc

SEQ ID NO: 576877 - DNA, 13 bp, Homo sapiens
ctctttttgtttg

SEQ ID NO: 576878 - DNA, 22 bp, Homo sapiens
ctgaaaagtgtgtatatatttt

SEQ ID NO: 576879 - DNA, 14 bp, Homo sapiens
ctgaaagaggccaa

SEQ ID NO: 576880 - DNA, 20 bp, Homo sapiens
ctgaaagccttagggaagct

SEQ ID NO: 576881 - DNA, 13 bp, Homo sapiens
ctgaagaattgaa

SEQ ID NO: 576882 - DNA, 13 bp, Homo sapiens
ctgacaatcaact

SEQ ID NO: 576883 - DNA, 14 bp, Homo sapiens
ctgaccggcacctg

SEQ ID NO: 576884 - DNA, 23 bp, Homo sapiens
ctgacctggcatctaattctgat

SEQ ID NO: 576885 - DNA, 21 bp, Homo sapiens
ctgagccaaacacactgtaaa

SEQ ID NO: 576886 - DNA, 23 bp, Homo sapiens
ctgagccaaacacactgtaaata

SEQ ID NO: 576887 - DNA, 17 bp, Homo sapiens
ctgatgcgaaaacttga

SEQ ID NO: 576888 - DNA, 14 bp, Homo sapiens
ctgattctggcttt

SEQ ID NO: 576889 - DNA, 18 bp, Homo sapiens
ctgattctggctttaagc

SEQ ID NO: 576890 - DNA, 19 bp, Homo sapiens
ctgattctggctttaagcc

SEQ ID NO: 576891 - DNA, 14 bp, Homo sapiens
ctgcagagatttct

SEQ ID NO: 576892 - DNA, 18 bp, Homo sapiens
ctgccatgccaggaacct

SEQ ID NO: 576893 - DNA, 22 bp, Homo sapiens
ctgccattacagaggtattaaa

SEQ ID NO: 576894 - DNA, 12 bp, Homo sapiens
ctgcccccatcc

SEQ ID NO: 576895 - DNA, 20 bp, Homo sapiens
ctgcccccatcccacatgat

SEQ ID NO: 576896 - DNA, 19 bp, Homo sapiens
ctgccctgtatataatact

SEQ ID NO: 576897 - DNA, 15 bp, Homo sapiens
ctgctggcacctcag

SEQ ID NO: 576898 - DNA, 13 bp, Homo sapiens
ctgcttacctgac

SEQ ID NO: 576899 - DNA, 20 bp, Homo sapiens
ctgcttgagttcccagatgg

SEQ ID NO: 576900 - DNA, 21 bp, Homo sapiens
ctggcatctaattctgattct

SEQ ID NO: 576901 - DNA, 20 bp, Homo sapiens
ctggctgtttgatagcagaa

SEQ ID NO: 576902 - DNA, 16 bp, Homo sapiens
ctgggcagctgtcatg

SEQ ID NO: 576903 - DNA, 20 bp, Homo sapiens
ctgggctgccatgtgaagag

SEQ ID NO: 576904 - DNA, 17 bp, Homo sapiens
ctggtttgtggggcaca

SEQ ID NO: 576905 - DNA, 16 bp, Homo sapiens
ctgtaaactataaact

SEQ ID NO: 576906 - DNA, 18 bp, Homo sapiens
ctgtaaatatccacagac

SEQ ID NO: 576907 - DNA, 13 bp, Homo sapiens
ctgtaattaagtg

SEQ ID NO: 576908 - DNA, 15 bp, Homo sapiens
ctgtaattaagtgca

SEQ ID NO: 576909 - DNA, 16 bp, Homo sapiens
ctgtaattaagtgcaa

SEQ ID NO: 576910 - DNA, 18 bp, Homo sapiens
ctgtaattaagtgcaatt

SEQ ID NO: 576911 - DNA, 20 bp, Homo sapiens
ctgtagatatgtattctttt

SEQ ID NO: 576912 - DNA, 18 bp, Homo sapiens
ctgtatataatactaaag

SEQ ID NO: 576913 - DNA, 16 bp, Homo sapiens
ctgtatcattttcttt

SEQ ID NO: 576914 - DNA, 16 bp, Homo sapiens
ctgtcatggaaaagcc

SEQ ID NO: 576915 - DNA, 19 bp, Homo sapiens
ctgtcatggaaaagcccag

SEQ ID NO: 576916 - DNA, 15 bp, Homo sapiens
ctgtcattgcacata

SEQ ID NO: 576917 - DNA, 12 bp, Homo sapiens
ctgtccagtgcc

SEQ ID NO: 576918 - DNA, 14 bp, Homo sapiens
ctgtcccctctccc

SEQ ID NO: 576919 - DNA, 16 bp, Homo sapiens
ctgtctttcagataca

SEQ ID NO: 576920 - DNA, 14 bp, Homo sapiens
ctgtgtcctctccc

SEQ ID NO: 576921 - DNA, 14 bp, Homo sapiens
ctgttactgaaatg

SEQ ID NO: 576922 - DNA, 20 bp, Homo sapiens
cttaaaaatcattgattgtc

SEQ ID NO: 576923 - DNA, 20 bp, Homo sapiens
cttaaggggtatcatgtatg

SEQ ID NO: 576924 - DNA, 17 bp, Homo sapiens
cttaatggagttcttgt

SEQ ID NO: 576925 - DNA, 14 bp, Homo sapiens
cttacatgcatttg

SEQ ID NO: 576926 - DNA, 20 bp, Homo sapiens
cttagggaagctggcctgag

SEQ ID NO: 576927 - DNA, 15 bp, Homo sapiens
cttaggggaaggaga

SEQ ID NO: 576928 - DNA, 16 bp, Homo sapiens
cttatagtctaagact

SEQ ID NO: 576929 - DNA, 15 bp, Homo sapiens
cttcagttgcttgtc

SEQ ID NO: 576930 - DNA, 12 bp, Homo sapiens
cttccagatcct

SEQ ID NO: 576931 - DNA, 21 bp, Homo sapiens
cttccagggatttgcctcacc

SEQ ID NO: 576932 - DNA, 16 bp, Homo sapiens
cttccaggggaacctg

SEQ ID NO: 576933 - DNA, 19 bp, Homo sapiens
cttccaggggaacctgcca

SEQ ID NO: 576934 - DNA, 20 bp, Homo sapiens
cttcctgtgggccaggagct

SEQ ID NO: 576935 - DNA, 23 bp, Homo sapiens
agctgtcatggaaaagcccagtg

SEQ ID NO: 576936 - DNA, 20 bp, Homo sapiens
agctgttccttggtcctagt

SEQ ID NO: 576937 - DNA, 19 bp, Homo sapiens
agcttcagttgcttgtctt

SEQ ID NO: 576938 - DNA, 16 bp, Homo sapiens
agcttcatacttcatg

SEQ ID NO: 576939 - DNA, 22 bp, Homo sapiens
agcttcctgtgggccaggagct

SEQ ID NO: 576940 - DNA, 13 bp, Homo sapiens
aggaacctgtcct

SEQ ID NO: 576941 - DNA, 19 bp, Homo sapiens
aggaaccttccttcctgct

SEQ ID NO: 576942 - DNA, 20 bp, Homo sapiens
aggacatgcaataaaattta

SEQ ID NO: 576943 - DNA, 21 bp, Homo sapiens
aggacatgcaataaaatttaa

SEQ ID NO: 576944 - DNA, 20 bp, Homo sapiens
aggcatatttaacaaaattt

SEQ ID NO: 576945 - DNA, 20 bp, Homo sapiens
aggcgcagcccgaagcccag

SEQ ID NO: 576946 - DNA, 21 bp, Homo sapiens
aggcgcagcccgaagcccagt

SEQ ID NO: 576947 - DNA, 22 bp, Homo sapiens
aggcttgtttacctttctctct

SEQ ID NO: 576948 - DNA, 15 bp, Homo sapiens
agggaaagttttttt

SEQ ID NO: 576949 - DNA, 12 bp, Homo sapiens
agggaaggcctg

SEQ ID NO: 576950 - DNA, 19 bp, Homo sapiens
agggactacccatagacat

SEQ ID NO: 576951 - DNA, 16 bp, Homo sapiens
agggagcagggaaggc

SEQ ID NO: 576952 - DNA, 19 bp, Homo sapiens
agggagcagggaaggcctg

SEQ ID NO: 576953 - DNA, 12 bp, Homo sapiens
agggcagtgaga

SEQ ID NO: 576954 - DNA, 15 bp, Homo sapiens
agggctgtcattgca

SEQ ID NO: 576955 - DNA, 17 bp, Homo sapiens
aggggaaggagaagtaa

SEQ ID NO: 576956 - DNA, 21 bp, Homo sapiens
aggggtatcatgtatggtgat

SEQ ID NO: 576957 - DNA, 18 bp, Homo sapiens
agggttcaaaatgtctgt

SEQ ID NO: 576958 - DNA, 23 bp, Homo sapiens
aggtaacactagggccttggaaa

SEQ ID NO: 576959 - DNA, 17 bp, Homo sapiens
aggtcaagtaagaagac

SEQ ID NO: 576960 - DNA, 15 bp, Homo sapiens
aggtgggccttgcta

SEQ ID NO: 576961 - DNA, 21 bp, Homo sapiens
aggtgggccttgctacctcaa

SEQ ID NO: 576962 - DNA, 21 bp, Homo sapiens
agtaacccccttaaatttaat

SEQ ID NO: 576963 - DNA, 14 bp, Homo sapiens
agtaagaagacatg

SEQ ID NO: 576964 - DNA, 16 bp, Homo sapiens
agtaagaagacatgaa

SEQ ID NO: 576965 - DNA, 23 bp, Homo sapiens
agtaagaataccacatcaaataa

SEQ ID NO: 576966 - DNA, 20 bp, Homo sapiens
agtatgtgggggcttcatct

SEQ ID NO: 576967 - DNA, 13 bp, Homo sapiens
agtattgtttaaa

SEQ ID NO: 576968 - DNA, 23 bp, Homo sapiens
agtccaagcaacagcctttgaat

SEQ ID NO: 576969 - DNA, 18 bp, Homo sapiens
agtccgcagaagccctga

SEQ ID NO: 576970 - DNA, 18 bp, Homo sapiens
agtctcagaaagccttcc

SEQ ID NO: 576971 - DNA, 14 bp, Homo sapiens
agtctcctgacatt

SEQ ID NO: 576972 - DNA, 22 bp, Homo sapiens
agtctgtactaaacagtaagat

SEQ ID NO: 576973 - DNA, 17 bp, Homo sapiens
agtctttcatggctgct

SEQ ID NO: 576974 - DNA, 21 bp, Homo sapiens
agtgaagccccttgtcctctc

SEQ ID NO: 576975 - DNA, 12 bp, Homo sapiens
agtgacctgacc

SEQ ID NO: 576976 - DNA, 20 bp, Homo sapiens
agtgatctgtcccctctccc

SEQ ID NO: 576977 - DNA, 15 bp, Homo sapiens
agtgcaatttcccct

SEQ ID NO: 576978 - DNA, 16 bp, Homo sapiens
agtgcaatttcccctc

SEQ ID NO: 576979 - DNA, 18 bp, Homo sapiens
agtgccagcacctgccca

SEQ ID NO: 576980 - DNA, 15 bp, Homo sapiens
agtgggaagtgaagc

SEQ ID NO: 576981 - DNA, 18 bp, Homo sapiens
agtgggaagtgaagcccc

SEQ ID NO: 576982 - DNA, 21 bp, Homo sapiens
agtgttggtatattttatatt

SEQ ID NO: 576983 - DNA, 14 bp, Homo sapiens
agttataagaagaa

SEQ ID NO: 576984 - DNA, 17 bp, Homo sapiens
agttcccttgaaacttt

SEQ ID NO: 576985 - DNA, 23 bp, Homo sapiens
agttctaacagtgaagttttact

SEQ ID NO: 576986 - DNA, 22 bp, Homo sapiens
agttctttggattctaaataca

SEQ ID NO: 576987 - DNA, 13 bp, Homo sapiens
agttgcagtctca

SEQ ID NO: 576988 - DNA, 19 bp, Homo sapiens
agttgcttgtcttctggta

SEQ ID NO: 576989 - DNA, 13 bp, Homo sapiens
agtttcccttcta

SEQ ID NO: 576990 - DNA, 16 bp, Homo sapiens
agtttttgtttggaga

SEQ ID NO: 576991 - DNA, 12 bp, Homo sapiens
ataaaaccctta

SEQ ID NO: 576992 - DNA, 11 bp, Homo sapiens
ataaaactctg

SEQ ID NO: 576993 - DNA, 12 bp, Homo sapiens
ataaaatttaaa

SEQ ID NO: 576994 - DNA, 17 bp, Homo sapiens
ataaaatttttatgtaa

SEQ ID NO: 576995 - DNA, 13 bp, Homo sapiens
ataaacagaaatg

SEQ ID NO: 576996 - DNA, 19 bp, Homo sapiens
ataaatgtataaatataca

SEQ ID NO: 576997 - DNA, 16 bp, Homo sapiens
atgtacagattctttc

SEQ ID NO: 576998 - DNA, 18 bp, Homo sapiens
atgtaggtaagactgtag

SEQ ID NO: 576999 - DNA, 19 bp, Homo sapiens
atgtaggtaagactgtaga

SEQ ID NO: 577000 - DNA, 12 bp, Homo sapiens
atgtataaatat

SEQ ID NO: 577001 - DNA, 16 bp, Homo sapiens
atgtataaatatacag

SEQ ID NO: 577002 - DNA, 17 bp, Homo sapiens
atgtattcttttctcag

SEQ ID NO: 577003 - DNA, 15 bp, Homo sapiens
atgtgatacattttt

SEQ ID NO: 577004 - DNA, 14 bp, Homo sapiens
atgtgcatttaatt

SEQ ID NO: 577005 - DNA, 20 bp, Homo sapiens
atgtgcatttttgtgaaatg

SEQ ID NO: 577006 - DNA, 21 bp, Homo sapiens
atgtgcatttttgtgaaatga

SEQ ID NO: 577007 - DNA, 16 bp, Homo sapiens
atgtgggggcttcatc

SEQ ID NO: 577008 - DNA, 20 bp, Homo sapiens
atgtgtatttccagtgcaat

SEQ ID NO: 577009 - DNA, 17 bp, Homo sapiens
atgttaaagagaatgag

SEQ ID NO: 577010 - DNA, 22 bp, Homo sapiens
atgttaaagagaatgagtcctt

SEQ ID NO: 577011 - DNA, 15 bp, Homo sapiens
atgtttatgagccag

SEQ ID NO: 577012 - DNA, 16 bp, Homo sapiens
atgtttcttttaaaga

SEQ ID NO: 577013 - DNA, 16 bp, Homo sapiens
atgtttcttttgtttg

SEQ ID NO: 577014 - DNA, 16 bp, Homo sapiens
attaaaactaaatttc

SEQ ID NO: 577015 - DNA, 13 bp, Homo sapiens
attaaataaaatt

SEQ ID NO: 577016 - DNA, 20 bp, Homo sapiens
attaaataaaatttttatgt

SEQ ID NO: 577017 - DNA, 15 bp, Homo sapiens
attaaggggaagaat

SEQ ID NO: 577018 - DNA, 22 bp, Homo sapiens
attatacatgtgatacattttt

SEQ ID NO: 577019 - DNA, 23 bp, Homo sapiens
attatgagattggttttcctgtg

SEQ ID NO: 577020 - DNA, 14 bp, Homo sapiens
attatttttataat

SEQ ID NO: 577021 - DNA, 18 bp, Homo sapiens
attatttttataattgta

SEQ ID NO: 577022 - DNA, 17 bp, Homo sapiens
attatttttttaaaatt

SEQ ID NO: 577023 - DNA, 18 bp, Homo sapiens
attatttttttaaaattt

SEQ ID NO: 577024 - DNA, 21 bp, Homo sapiens
attatttttttaaaattttgt

SEQ ID NO: 577025 - DNA, 15 bp, Homo sapiens
attcaactttgtaaa

SEQ ID NO: 577026 - DNA, 18 bp, Homo sapiens
attcagggtaaataggaa

SEQ ID NO: 577027 - DNA, 15 bp, Homo sapiens
attcagtgagggtct

SEQ ID NO: 577028 - DNA, 20 bp, Homo sapiens
attccagatctttcagaaat

SEQ ID NO: 577029 - DNA, 14 bp, Homo sapiens
attctaaatacatg

SEQ ID NO: 577030 - DNA, 12 bp, Homo sapiens
attctcactgct

SEQ ID NO: 577031 - DNA, 19 bp, Homo sapiens
attctggctttaagccttc

SEQ ID NO: 577032 - DNA, 16 bp, Homo sapiens
attctttccattatga

SEQ ID NO: 577033 - DNA, 19 bp, Homo sapiens
attcttttctcagtgttgg

SEQ ID NO: 577034 - DNA, 13 bp, Homo sapiens
attgaaaaggaca

SEQ ID NO: 577035 - DNA, 18 bp, Homo sapiens
attgacttttataaagca

SEQ ID NO: 577036 - DNA, 16 bp, Homo sapiens
attgagtattgtttaa

SEQ ID NO: 577037 - DNA, 13 bp, Homo sapiens
attgattgggaaa

SEQ ID NO: 577038 - DNA, 20 bp, Homo sapiens
attgattgggaaaacatttg

SEQ ID NO: 577039 - DNA, 15 bp, Homo sapiens
attgcatactttgta

SEQ ID NO: 577040 - DNA, 14 bp, Homo sapiens
attgcatcactgta

SEQ ID NO: 577041 - DNA, 19 bp, Homo sapiens
attgccacaatgcctctcc

SEQ ID NO: 577042 - DNA, 20 bp, Homo sapiens
attgccacaatgcctctccc

SEQ ID NO: 577043 - DNA, 21 bp, Homo sapiens
attgtacaaaattaagcaaat

SEQ ID NO: 577044 - DNA, 13 bp, Homo sapiens
attgtcagctact

SEQ ID NO: 577045 - DNA, 19 bp, Homo sapiens
attgtcagctactaatgat

SEQ ID NO: 577046 - DNA, 14 bp, Homo sapiens
attgtttaaaatgt

SEQ ID NO: 577047 - DNA, 17 bp, Homo sapiens
attgtttaaaatgtaat

SEQ ID NO: 577048 - DNA, 17 bp, Homo sapiens
atttaaaaaataaataa

SEQ ID NO: 577049 - DNA, 23 bp, Homo sapiens
atttaaacgtgatttttaaatta

SEQ ID NO: 577050 - DNA, 17 bp, Homo sapiens
atttaaatgaaagaaaa

SEQ ID NO: 577051 - DNA, 15 bp, Homo sapiens
atttaagatatgtaa

SEQ ID NO: 577052 - DNA, 23 bp, Homo sapiens
atttaatccagttataagaagaa

SEQ ID NO: 577053 - DNA, 19 bp, Homo sapiens
atttaattacttcttagta

SEQ ID NO: 577054 - DNA, 12 bp, Homo sapiens
atttacttgttt

SEQ ID NO: 577055 - DNA, 16 bp, Homo sapiens
atttacttgttttgga

SEQ ID NO: 577056 - DNA, 16 bp, Homo sapiens
atttatccttgttaag

SEQ ID NO: 577057 - DNA, 14 bp, Homo sapiens
atttatgtagatgt

SEQ ID NO: 577058 - DNA, 18 bp, Homo sapiens
atttatgtagatgtgcat

SEQ ID NO: 577059 - DNA, 22 bp, Homo sapiens
aagccttcaaaactatagcttg

SEQ ID NO: 577060 - DNA, 21 bp, Homo sapiens
aagcggccctaagggagtgtc

SEQ ID NO: 577061 - DNA, 15 bp, Homo sapiens
aagcttcagttgctt

SEQ ID NO: 577062 - DNA, 15 bp, Homo sapiens
aaggatagtaagcat

SEQ ID NO: 577063 - DNA, 15 bp, Homo sapiens
aagggatggaaaagg

SEQ ID NO: 577064 - DNA, 13 bp, Homo sapiens
aaggggtaaaagg

SEQ ID NO: 577065 - DNA, 13 bp, Homo sapiens
aaggtaatgtgtg

SEQ ID NO: 577066 - DNA, 17 bp, Homo sapiens
aaggtgggccttgctac

SEQ ID NO: 577067 - DNA, 14 bp, Homo sapiens
aagtaactgtgaga

SEQ ID NO: 577068 - DNA, 13 bp, Homo sapiens
aagtaagaagaca

SEQ ID NO: 577069 - DNA, 20 bp, Homo sapiens
aagtacatattaggaaaata

SEQ ID NO: 577070 - DNA, 12 bp, Homo sapiens
aagtgaagcccc

SEQ ID NO: 577071 - DNA, 20 bp, Homo sapiens
aagtgatctgtcccctctcc

SEQ ID NO: 577072 - DNA, 17 bp, Homo sapiens
aagtgcaatttcccctc

SEQ ID NO: 577073 - DNA, 20 bp, Homo sapiens
aagtggaccttgagaccaca

SEQ ID NO: 577074 - DNA, 21 bp, Homo sapiens
aagtgtgtatatattttgtgt

SEQ ID NO: 577075 - DNA, 13 bp, Homo sapiens
aataagctaaaga

SEQ ID NO: 577076 - DNA, 19 bp, Homo sapiens
aataatgctacaattttaa

SEQ ID NO: 577077 - DNA, 19 bp, Homo sapiens
aataccacatcaaataaga

SEQ ID NO: 577078 - DNA, 16 bp, Homo sapiens
aatactaaagtgtcta

SEQ ID NO: 577079 - DNA, 20 bp, Homo sapiens
aataggaatcattcagaaat

SEQ ID NO: 577080 - DNA, 22 bp, Homo sapiens
aataggaatcattcagaaatgt

SEQ ID NO: 577081 - DNA, 20 bp, Homo sapiens
aatattcagggtaaatagga

SEQ ID NO: 577082 - DNA, 16 bp, Homo sapiens
aatattccagatcttt

SEQ ID NO: 577083 - DNA, 18 bp, Homo sapiens
aatattccagatctttca

SEQ ID NO: 577084 - DNA, 16 bp, Homo sapiens
aatattgattgggaaa

SEQ ID NO: 577085 - DNA, 16 bp, Homo sapiens
aatattgtttggtaaa

SEQ ID NO: 577086 - DNA, 23 bp, Homo sapiens
aatattgtttggtaaatgtttct

SEQ ID NO: 577087 - DNA, 14 bp, Homo sapiens
aatcaactctaata

SEQ ID NO: 577088 - DNA, 16 bp, Homo sapiens
aatcattcagaaatgt

SEQ ID NO: 577089 - DNA, 14 bp, Homo sapiens
aatccactctcagg

SEQ ID NO: 577090 - DNA, 15 bp, Homo sapiens
aatccactctcagga

SEQ ID NO: 577091 - DNA, 17 bp, Homo sapiens
aatcccctaaaataaca

SEQ ID NO: 577092 - DNA, 18 bp, Homo sapiens
aatcctactaataaacca

SEQ ID NO: 577093 - DNA, 20 bp, Homo sapiens
aatctacaatctctttttgt

SEQ ID NO: 577094 - DNA, 17 bp, Homo sapiens
aatcttcccatgcattc

SEQ ID NO: 577095 - DNA, 13 bp, Homo sapiens
aatcttttgaagc

SEQ ID NO: 577096 - DNA, 13 bp, Homo sapiens
aatgaaagaaaat

SEQ ID NO: 577097 - DNA, 19 bp, Homo sapiens
aatgagactctagggtcca

SEQ ID NO: 577098 - DNA, 14 bp, Homo sapiens
aatgagctctgaaa

SEQ ID NO: 577099 - DNA, 19 bp, Homo sapiens
aatgaggaaaattcttaaa

SEQ ID NO: 577100 - DNA, 18 bp, Homo sapiens
aatgcatatcctgagcca

SEQ ID NO: 577101 - DNA, 13 bp, Homo sapiens
aatgctaatttta

SEQ ID NO: 577102 - DNA, 20 bp, Homo sapiens
aatggtgtcagtatccaggc

SEQ ID NO: 577103 - DNA, 17 bp, Homo sapiens
aatgtaatttaaatgaa

SEQ ID NO: 577104 - DNA, 13 bp, Homo sapiens
aatgtataaatat

SEQ ID NO: 577105 - DNA, 14 bp, Homo sapiens
aatgtataaatata

SEQ ID NO: 577106 - DNA, 23 bp, Homo sapiens
aatgtctgtagctcctcaactca

SEQ ID NO: 577107 - DNA, 23 bp, Homo sapiens
aatgtgtggattgcctctgaaaa

SEQ ID NO: 577108 - DNA, 18 bp, Homo sapiens
aatgttaaagggatattt

SEQ ID NO: 577109 - DNA, 15 bp, Homo sapiens
aatgtttatgagcca

SEQ ID NO: 577110 - DNA, 17 bp, Homo sapiens
aatgtttatgagccaga

SEQ ID NO: 577111 - DNA, 18 bp, Homo sapiens
aatgtttatgagccagac

SEQ ID NO: 577112 - DNA, 16 bp, Homo sapiens
aatgttttcaaaaggt

SEQ ID NO: 577113 - DNA, 14 bp, Homo sapiens
aattaaataaaatt

SEQ ID NO: 577114 - DNA, 13 bp, Homo sapiens
aattaagcaaatg

SEQ ID NO: 577115 - DNA, 16 bp, Homo sapiens
aattacttcttagtat

SEQ ID NO: 577116 - DNA, 17 bp, Homo sapiens
aattatgagattggttt

SEQ ID NO: 577117 - DNA, 12 bp, Homo sapiens
aattatttgaag

SEQ ID NO: 577118 - DNA, 23 bp, Homo sapiens
aattctgattctggctttaagcc

SEQ ID NO: 577119 - DNA, 11 bp, Homo sapiens
aattcttaaaa

SEQ ID NO: 577120 - DNA, 12 bp, Homo sapiens
aattgtacaaaa

SEQ ID NO: 577121 - DNA, 13 bp, Homo sapiens
aattgtacaaaat

SEQ ID NO: 577122 - DNA, 19 bp, Homo sapiens
aattgtacaaaattaagca

SEQ ID NO: 577123 - DNA, 20 bp, Homo sapiens
aattgtacaaaattaagcaa

SEQ ID NO: 577124 - DNA, 18 bp, Homo sapiens
aattgtaggggtgtgtgt

SEQ ID NO: 577125 - DNA, 18 bp, Homo sapiens
aatttaaaaaataaataa

SEQ ID NO: 577126 - DNA, 18 bp, Homo sapiens
aatttaaatgaaagaaaa

SEQ ID NO: 577127 - DNA, 20 bp, Homo sapiens
aatttaataccagatacctt

SEQ ID NO: 577128 - DNA, 13 bp, Homo sapiens
aatttacttgttt

SEQ ID NO: 577129 - DNA, 15 bp, Homo sapiens
aatttacttgttttg

SEQ ID NO: 577130 - DNA, 13 bp, Homo sapiens
aattttaaagtgc

SEQ ID NO: 577131 - DNA, 21 bp, Homo sapiens
aattttaaggcatatttaaca

SEQ ID NO: 577132 - DNA, 21 bp, Homo sapiens
acaaactgatgcgaaaacttg

SEQ ID NO: 577133 - DNA, 13 bp, Homo sapiens
acaacaaggaccc

SEQ ID NO: 577134 - DNA, 23 bp, Homo sapiens
agactgtagatatgtattctttt

SEQ ID NO: 577135 - DNA, 10 bp, Homo sapiens
agagaatgag

SEQ ID NO: 577136 - DNA, 13 bp, Homo sapiens
agaggcagtgaga

SEQ ID NO: 577137 - DNA, 13 bp, Homo sapiens
agaggctgaaaga

SEQ ID NO: 577138 - DNA, 19 bp, Homo sapiens
agagggagaagcatgaaaa

SEQ ID NO: 577139 - DNA, 22 bp, Homo sapiens
agaggtccctgcttacctgacg

SEQ ID NO: 577140 - DNA, 19 bp, Homo sapiens
agagttgggtgtctcctta

SEQ ID NO: 577141 - DNA, 13 bp, Homo sapiens
agataagcaagag

SEQ ID NO: 577142 - DNA, 17 bp, Homo sapiens
agataagcaagagagat

SEQ ID NO: 577143 - DNA, 22 bp, Homo sapiens
agataagcaagagagatgtttt

SEQ ID NO: 577144 - DNA, 20 bp, Homo sapiens
agataatattgtttggtaaa

SEQ ID NO: 577145 - DNA, 22 bp, Homo sapiens
agataccttatcttacaatatt

SEQ ID NO: 577146 - DNA, 15 bp, Homo sapiens
agatatctcaatgaa

SEQ ID NO: 577147 - DNA, 19 bp, Homo sapiens
agatattgtgaagtacata

SEQ ID NO: 577148 - DNA, 21 bp, Homo sapiens
agatattgtgaagtacatatt

SEQ ID NO: 577149 - DNA, 14 bp, Homo sapiens
agatctttcagaaa

SEQ ID NO: 577150 - DNA, 17 bp, Homo sapiens
agatctttcagaaatat

SEQ ID NO: 577151 - DNA, 21 bp, Homo sapiens
agatctttcagaaatataaca

SEQ ID NO: 577152 - DNA, 19 bp, Homo sapiens
agattgactaactcaaata

SEQ ID NO: 577153 - DNA, 15 bp, Homo sapiens
agattggttttcctg

SEQ ID NO: 577154 - DNA, 14 bp, Homo sapiens
agattttgaatgct

SEQ ID NO: 577155 - DNA, 19 bp, Homo sapiens
agcaacagcctttgaatgt

SEQ ID NO: 577156 - DNA, 22 bp, Homo sapiens
agcaacagcctttgaatgtaac

SEQ ID NO: 577157 - DNA, 12 bp, Homo sapiens
agcaagaaagcc

SEQ ID NO: 577158 - DNA, 12 bp, Homo sapiens
agcaagagagat

SEQ ID NO: 577159 - DNA, 23 bp, Homo sapiens
agcaatggtgtcagtatccaggc

SEQ ID NO: 577160 - DNA, 16 bp, Homo sapiens
agcactcctgcttaat

SEQ ID NO: 577161 - DNA, 20 bp, Homo sapiens
agcactcctgcttaatcttc

SEQ ID NO: 577162 - DNA, 15 bp, Homo sapiens
agcagagttttcatt

SEQ ID NO: 577163 - DNA, 12 bp, Homo sapiens
agcagggaaggc

SEQ ID NO: 577164 - DNA, 23 bp, Homo sapiens
agcatcttcacttctaaatgcat

SEQ ID NO: 577165 - DNA, 17 bp, Homo sapiens
agcatgcagctttgcaa

SEQ ID NO: 577166 - DNA, 14 bp, Homo sapiens
agccaaacacactg

SEQ ID NO: 577167 - DNA, 15 bp, Homo sapiens
agccaaacacactgt

SEQ ID NO: 577168 - DNA, 19 bp, Homo sapiens
agccaatctacaatctctt

SEQ ID NO: 577169 - DNA, 22 bp, Homo sapiens
agccaatctacaatctcttttt

SEQ ID NO: 577170 - DNA, 14 bp, Homo sapiens
agcccagtgacctg

SEQ ID NO: 577171 - DNA, 23 bp, Homo sapiens
agcccagtttcccttctatgcag

SEQ ID NO: 577172 - DNA, 22 bp, Homo sapiens
agccttcaaaactatagcttgc

SEQ ID NO: 577173 - DNA, 23 bp, Homo sapiens
agcgaggcacccttactggctta

SEQ ID NO: 577174 - DNA, 19 bp, Homo sapiens
agctacaattgtaaactag

SEQ ID NO: 577175 - DNA, 13 bp, Homo sapiens
agctactaatgat

SEQ ID NO: 577176 - DNA, 13 bp, Homo sapiens
agctcctcccctt

SEQ ID NO: 577177 - DNA, 22 bp, Homo sapiens
agctcttcctatccctctccta

SEQ ID NO: 577178 - DNA, 12 bp, Homo sapiens
agctggcctgag

SEQ ID NO: 577179 - DNA, 21 bp, Homo sapiens
agctggcctgagaggggaagc

SEQ ID NO: 577180 - DNA, 10 bp, Homo sapiens
agctgtcatg

SEQ ID NO: 577181 - DNA, 20 bp, Homo sapiens
agctgtcatggaaaagccca

SEQ ID NO: 577182 - DNA, 15 bp, Homo sapiens
tgaggaaaattctta

SEQ ID NO: 577183 - DNA, 12 bp, Homo sapiens
tgagggtcttct

SEQ ID NO: 577184 - DNA, 15 bp, Homo sapiens
tgagtattgtttaaa

SEQ ID NO: 577185 - DNA, 19 bp, Homo sapiens
tgagtattgtttaaaatgt

SEQ ID NO: 577186 - DNA, 18 bp, Homo sapiens
tgagtgtatgagtagcca

SEQ ID NO: 577187 - DNA, 13 bp, Homo sapiens
tgatctgtcccct

SEQ ID NO: 577188 - DNA, 15 bp, Homo sapiens
tgatctgtcccctct

SEQ ID NO: 577189 - DNA, 21 bp, Homo sapiens
tgatgcgaaaacttgaatctg

SEQ ID NO: 577190 - DNA, 14 bp, Homo sapiens
tgattctggcttta

SEQ ID NO: 577191 - DNA, 17 bp, Homo sapiens
tgattctggctttaagc

SEQ ID NO: 577192 - DNA, 20 bp, Homo sapiens
tgattgggaaaacatttgct

SEQ ID NO: 577193 - DNA, 14 bp, Homo sapiens
tgatttttaaatta

SEQ ID NO: 577194 - DNA, 18 bp, Homo sapiens
tgcaaatgagctctgaaa

SEQ ID NO: 577195 - DNA, 14 bp, Homo sapiens
tgcaataaaattta

SEQ ID NO: 577196 - DNA, 17 bp, Homo sapiens
tgcaataaaatttaaaa

SEQ ID NO: 577197 - DNA, 22 bp, Homo sapiens
tgcaattgtaggggtgtgtgtg

SEQ ID NO: 577198 - DNA, 16 bp, Homo sapiens
tgcaatttcccctctg

SEQ ID NO: 577199 - DNA, 19 bp, Homo sapiens
tgcaatttcccctctgtgt

SEQ ID NO: 577200 - DNA, 15 bp, Homo sapiens
tgcagaactgtagct

SEQ ID NO: 577201 - DNA, 15 bp, Homo sapiens
tgcagagatttctca

SEQ ID NO: 577202 - DNA, 14 bp, Homo sapiens
tgcagtattgccac

SEQ ID NO: 577203 - DNA, 17 bp, Homo sapiens
tgcagtctcagaaagcc

SEQ ID NO: 577204 - DNA, 16 bp, Homo sapiens
tgcatatcctgagcca

SEQ ID NO: 577205 - DNA, 15 bp, Homo sapiens
tgccacaatgcctct

SEQ ID NO: 577206 - DNA, 16 bp, Homo sapiens
tgccacaatgcctctc

SEQ ID NO: 577207 - DNA, 23 bp, Homo sapiens
tgccacaatgcctctcccacgat

SEQ ID NO: 577208 - DNA, 14 bp, Homo sapiens
tgccaggaacctgt

SEQ ID NO: 577209 - DNA, 22 bp, Homo sapiens
tgccaggaacctgtcctaagga

SEQ ID NO: 577210 - DNA, 16 bp, Homo sapiens
tgcccccatcccacat

SEQ ID NO: 577211 - DNA, 23 bp, Homo sapiens
tgccccccatgaggaaggaacag

SEQ ID NO: 577212 - DNA, 23 bp, Homo sapiens
tgccctgtatataatactaaagt

SEQ ID NO: 577213 - DNA, 15 bp, Homo sapiens
tgcctacatcccggg

SEQ ID NO: 577214 - DNA, 22 bp, Homo sapiens
tgcctacatcccgggcctcagt

SEQ ID NO: 577215 - DNA, 21 bp, Homo sapiens
tgcgagaggtccctgcttacc

SEQ ID NO: 577216 - DNA, 17 bp, Homo sapiens
tgcgcaacaacaaggac

SEQ ID NO: 577217 - DNA, 16 bp, Homo sapiens
tgctaattttattata

SEQ ID NO: 577218 - DNA, 17 bp, Homo sapiens
tgctattgaactgagcc

SEQ ID NO: 577219 - DNA, 15 bp, Homo sapiens
tgctggcacctcaga

SEQ ID NO: 577220 - DNA, 17 bp, Homo sapiens
tgctggcacctcagaca

SEQ ID NO: 577221 - DNA, 15 bp, Homo sapiens
tgctgtccagtgcct

SEQ ID NO: 577222 - DNA, 14 bp, Homo sapiens
tgcttaaaccactt

SEQ ID NO: 577223 - DNA, 15 bp, Homo sapiens
tgcttaatcttcaaa

SEQ ID NO: 577224 - DNA, 16 bp, Homo sapiens
tgcttaatcttcaaag

SEQ ID NO: 577225 - DNA, 15 bp, Homo sapiens
tgcttgtcttctggt

SEQ ID NO: 577226 - DNA, 20 bp, Homo sapiens
tgcttgtcttctggtacttt

SEQ ID NO: 577227 - DNA, 13 bp, Homo sapiens
tggaaaagcccag

SEQ ID NO: 577228 - DNA, 23 bp, Homo sapiens
tggaaaagcccagtgacctgacc

SEQ ID NO: 577229 - DNA, 16 bp, Homo sapiens
tggaaaaggaagacta

SEQ ID NO: 577230 - DNA, 22 bp, Homo sapiens
tggaaaaggaagactagaggct

SEQ ID NO: 577231 - DNA, 14 bp, Homo sapiens
tggaaattcctgta

SEQ ID NO: 577232 - DNA, 19 bp, Homo sapiens
tggaaattcctgtactgtg

SEQ ID NO: 577233 - DNA, 11 bp, Homo sapiens
tggactgacta

SEQ ID NO: 577234 - DNA, 23 bp, Homo sapiens
tggatggcttgtctatactcctt

SEQ ID NO: 577235 - DNA, 13 bp, Homo sapiens
tggccctttcctt

SEQ ID NO: 577236 - DNA, 14 bp, Homo sapiens
tggctgctgttgct

SEQ ID NO: 577237 - DNA, 12 bp, Homo sapiens
tggctgtaaact

SEQ ID NO: 577238 - DNA, 15 bp, Homo sapiens
tggctttaagccttc

SEQ ID NO: 577239 - DNA, 14 bp, Homo sapiens
tgggaaaacatttg

SEQ ID NO: 577240 - DNA, 16 bp, Homo sapiens
tgggaatgaggaaaat

SEQ ID NO: 577241 - DNA, 20 bp, Homo sapiens
tgggcttttggggagccaga

SEQ ID NO: 577242 - DNA, 21 bp, Homo sapiens
tggggccttgatgactgcctt

SEQ ID NO: 577243 - DNA, 22 bp, Homo sapiens
tggggccttgatgactgccttg

SEQ ID NO: 577244 - DNA, 23 bp, Homo sapiens
tgggttgctgctgtccagtgcct

SEQ ID NO: 577245 - DNA, 14 bp, Homo sapiens
tggtaaatgtttct

SEQ ID NO: 577246 - DNA, 21 bp, Homo sapiens
tggtaatcccctaaaataaca

SEQ ID NO: 577247 - DNA, 14 bp, Homo sapiens
tggtgatttgaaaa

SEQ ID NO: 577248 - DNA, 21 bp, Homo sapiens
tggtgatttgaaaaatataaa

SEQ ID NO: 577249 - DNA, 16 bp, Homo sapiens
tggttgggaatgagga

SEQ ID NO: 577250 - DNA, 23 bp, Homo sapiens
tggttgggaatgaggaaaattct

SEQ ID NO: 577251 - DNA, 15 bp, Homo sapiens
tgtaaatatccacag

SEQ ID NO: 577252 - DNA, 15 bp, Homo sapiens
tgtaatttaaatgaa

SEQ ID NO: 577253 - DNA, 16 bp, Homo sapiens
tgtaatttaaatgaaa

SEQ ID NO: 577254 - DNA, 16 bp, Homo sapiens
tgtacaaaattaagca

SEQ ID NO: 577255 - DNA, 19 bp, Homo sapiens
tgtacagagtgcttttctg

SEQ ID NO: 577256 - DNA, 19 bp, Homo sapiens
tgtacagattctttcagtt

SEQ ID NO: 577257 - DNA, 20 bp, Homo sapiens
tgtactaaacagtaagatat

SEQ ID NO: 577258 - DNA, 15 bp, Homo sapiens
tgtactctacaaaat

SEQ ID NO: 577259 - DNA, 17 bp, Homo sapiens
tgtactctacaaaatat

SEQ ID NO: 577260 - DNA, 18 bp, Homo sapiens
tgtagatatgtattcttt

SEQ ID NO: 577261 - DNA, 22 bp, Homo sapiens
tgtagatattgtgaagtacata

SEQ ID NO: 577262 - DNA, 21 bp, Homo sapiens
tgtatataatactaaagtgtc

SEQ ID NO: 577263 - DNA, 15 bp, Homo sapiens
tgtatgactaaagag

SEQ ID NO: 577264 - DNA, 16 bp, Homo sapiens
tgtatgactaaagaga

SEQ ID NO: 577265 - DNA, 17 bp, Homo sapiens
tgtattcagtgagggtc

SEQ ID NO: 577266 - DNA, 21 bp, Homo sapiens
tgtcagctactaatgatgttt

SEQ ID NO: 577267 - DNA, 15 bp, Homo sapiens
tgtcagtatccaggc

SEQ ID NO: 577268 - DNA, 17 bp, Homo sapiens
tgtccaaacgtcctctt

SEQ ID NO: 577269 - DNA, 21 bp, Homo sapiens
tgtccaaacgtcctctttagt

SEQ ID NO: 577270 - DNA, 18 bp, Homo sapiens
tgtccaatggctgtaaac

SEQ ID NO: 577271 - DNA, 20 bp, Homo sapiens
tgtccaatggctgtaaacta

SEQ ID NO: 577272 - DNA, 21 bp, Homo sapiens
tgtccaatggctgtaaactat

SEQ ID NO: 577273 - DNA, 16 bp, Homo sapiens
tgtcctaaggaacctt

SEQ ID NO: 577274 - DNA, 14 bp, Homo sapiens
tgtcctcagggagc

SEQ ID NO: 577275 - DNA, 19 bp, Homo sapiens
tgtcctcagggagcaggga

SEQ ID NO: 577276 - DNA, 16 bp, Homo sapiens
tgtcctctcccctctg

SEQ ID NO: 577277 - DNA, 22 bp, Homo sapiens
tgtcctctcccctctgccctgt

SEQ ID NO: 577278 - DNA, 23 bp, Homo sapiens
tgtcctctcccgcgggcctggac

SEQ ID NO: 577279 - DNA, 18 bp, Homo sapiens
tgtgaaattgcatacttt

SEQ ID NO: 577280 - DNA, 22 bp, Homo sapiens
tgtgcatttttgtgaaatgaaa

SEQ ID NO: 577281 - DNA, 16 bp, Homo sapiens
tgtgctattgaactga

SEQ ID NO: 577282 - DNA, 22 bp, Homo sapiens
tgtggattctgaggccctgccc

SEQ ID NO: 577283 - DNA, 18 bp, Homo sapiens
tgtggggcacagatgcct

SEQ ID NO: 577284 - DNA, 19 bp, Homo sapiens
tgtgggggcttcatctctt

SEQ ID NO: 577285 - DNA, 14 bp, Homo sapiens
tgtgtcctctcccc

SEQ ID NO: 577286 - DNA, 14 bp, Homo sapiens
tgtgtgaaattgca

SEQ ID NO: 577287 - DNA, 11 bp, Homo sapiens
tgtgtgtgtgt

SEQ ID NO: 577288 - DNA, 20 bp, Homo sapiens
tgttaaaagttttatatgct

SEQ ID NO: 577289 - DNA, 23 bp, Homo sapiens
tgttactgaaatgaggagagaag

SEQ ID NO: 577290 - DNA, 16 bp, Homo sapiens
tgttgtaagaattctg

SEQ ID NO: 577291 - DNA, 16 bp, Homo sapiens
tgttgtacttaaatgg

SEQ ID NO: 577292 - DNA, 13 bp, Homo sapiens
tgtttaaaatgta

SEQ ID NO: 577293 - DNA, 23 bp, Homo sapiens
tgtttacctttctctctctaagg

SEQ ID NO: 577294 - DNA, 20 bp, Homo sapiens
tgtttagcagatttaagata

SEQ ID NO: 577295 - DNA, 13 bp, Homo sapiens
tgtttgccaggac

SEQ ID NO: 577296 - DNA, 18 bp, Homo sapiens
tgtttgccaggacatgca

SEQ ID NO: 577297 - DNA, 13 bp, Homo sapiens
gatttttaaatta

SEQ ID NO: 577298 - DNA, 11 bp, Homo sapiens
gcaagaaagcc

SEQ ID NO: 577299 - DNA, 14 bp, Homo sapiens
gcaagagagatgtt

SEQ ID NO: 577300 - DNA, 17 bp, Homo sapiens
gcaagagagatgttttg

SEQ ID NO: 577301 - DNA, 22 bp, Homo sapiens
gcaagtgtggggggtccttctc

SEQ ID NO: 577302 - DNA, 12 bp, Homo sapiens
gcaataaaattt

SEQ ID NO: 577303 - DNA, 13 bp, Homo sapiens
gcaataaaattta

SEQ ID NO: 577304 - DNA, 15 bp, Homo sapiens
gcaataaaatttaaa

SEQ ID NO: 577305 - DNA, 19 bp, Homo sapiens
gcaataaaatttaaaaaat

SEQ ID NO: 577306 - DNA, 14 bp, Homo sapiens
gcacctcagacaat

SEQ ID NO: 577307 - DNA, 21 bp, Homo sapiens
gcacctcagacaatccactct

SEQ ID NO: 577308 - DNA, 23 bp, Homo sapiens
gcacctgcgagaggtccctgctt

SEQ ID NO: 577309 - DNA, 13 bp, Homo sapiens
gcacttacaattt

SEQ ID NO: 577310 - DNA, 23 bp, Homo sapiens
gcacttattgaccattttttaat

SEQ ID NO: 577311 - DNA, 13 bp, Homo sapiens
gcagccagttcaa

SEQ ID NO: 577312 - DNA, 18 bp, Homo sapiens
gcagcccgaagcccagtt

SEQ ID NO: 577313 - DNA, 12 bp, Homo sapiens
gcagctgtcatg

SEQ ID NO: 577314 - DNA, 20 bp, Homo sapiens
gcagctgtcatggaaaagcc

SEQ ID NO: 577315 - DNA, 14 bp, Homo sapiens
gcagggaaggcctg

SEQ ID NO: 577316 - DNA, 15 bp, Homo sapiens
gcagtctcagaaagc

SEQ ID NO: 577317 - DNA, 22 bp, Homo sapiens
gcagttagctgaagaattgaaa

SEQ ID NO: 577318 - DNA, 15 bp, Homo sapiens
gcataaattgcatca

SEQ ID NO: 577319 - DNA, 18 bp, Homo sapiens
gcatactttgtattttga

SEQ ID NO: 577320 - DNA, 17 bp, Homo sapiens
gcatatttaacaaaatt

SEQ ID NO: 577321 - DNA, 17 bp, Homo sapiens
gcatgcagctttgcaaa

SEQ ID NO: 577322 - DNA, 14 bp, Homo sapiens
tattttgtgtgaaa

SEQ ID NO: 577323 - DNA, 21 bp, Homo sapiens
tcaaaaggtattatacatgtg

SEQ ID NO: 577324 - DNA, 11 bp, Homo sapiens
tcaaagccttc

SEQ ID NO: 577325 - DNA, 17 bp, Homo sapiens
tcaaatacacatttgct

SEQ ID NO: 577326 - DNA, 19 bp, Homo sapiens
tcaactttgtaaaaatctt

SEQ ID NO: 577327 - DNA, 13 bp, Homo sapiens
tcaagattttgaa

SEQ ID NO: 577328 - DNA, 16 bp, Homo sapiens
tcaagattttgaatgc

SEQ ID NO: 577329 - DNA, 19 bp, Homo sapiens
tcaagattttgaatgcttc

SEQ ID NO: 577330 - DNA, 15 bp, Homo sapiens
tcaagggctgtcatt

SEQ ID NO: 577331 - DNA, 20 bp, Homo sapiens
tcacgttggggtgatttaat

SEQ ID NO: 577332 - DNA, 18 bp, Homo sapiens
tcactgtatcattttctt

SEQ ID NO: 577333 - DNA, 16 bp, Homo sapiens
tcagctcaatgcagtt

SEQ ID NO: 577334 - DNA, 15 bp, Homo sapiens
tcaggaggcgcagcc

SEQ ID NO: 577335 - DNA, 18 bp, Homo sapiens
tcaggaggcgcagcccga

SEQ ID NO: 577336 - DNA, 23 bp, Homo sapiens
tcaggaggcgcagcccgaagccc

SEQ ID NO: 577337 - DNA, 21 bp, Homo sapiens
tcagggagcagggaaggcctg

SEQ ID NO: 577338 - DNA, 23 bp, Homo sapiens
tcagggagcagggaaggcctgac

SEQ ID NO: 577339 - DNA, 22 bp, Homo sapiens
tcagtatgtgggggcttcatct

SEQ ID NO: 577340 - DNA, 16 bp, Homo sapiens
tcagtttgttggaaag

SEQ ID NO: 577341 - DNA, 19 bp, Homo sapiens
tcatcgaacaaactgatgc

SEQ ID NO: 577342 - DNA, 13 bp, Homo sapiens
tcatctctttaga

SEQ ID NO: 577343 - DNA, 12 bp, Homo sapiens
tcatgaaaatac

SEQ ID NO: 577344 - DNA, 16 bp, Homo sapiens
tcatggctgctgttgc

SEQ ID NO: 577345 - DNA, 15 bp, Homo sapiens
tcatgtatttgagca

SEQ ID NO: 577346 - DNA, 18 bp, Homo sapiens
tcatgtatttgagcatat

SEQ ID NO: 577347 - DNA, 13 bp, Homo sapiens
tcattcagaaatg

SEQ ID NO: 577348 - DNA, 14 bp, Homo sapiens
tcattcagaaatgt

SEQ ID NO: 577349 - DNA, 17 bp, Homo sapiens
tcattgcacataagctt

SEQ ID NO: 577350 - DNA, 16 bp, Homo sapiens
tcatttcattcctaac

SEQ ID NO: 577351 - DNA, 17 bp, Homo sapiens
tccaagcaacagccttt

SEQ ID NO: 577352 - DNA, 21 bp, Homo sapiens
tccaagcaacagcctttgaat

SEQ ID NO: 577353 - DNA, 17 bp, Homo sapiens
tccaatggctgtaaact

SEQ ID NO: 577354 - DNA, 21 bp, Homo sapiens
tccaatggctgtaaactataa

SEQ ID NO: 577355 - DNA, 18 bp, Homo sapiens
tccagggatttgcctcac

SEQ ID NO: 577356 - DNA, 14 bp, Homo sapiens
tccaggggaacctg

SEQ ID NO: 577357 - DNA, 11 bp, Homo sapiens
tccagtgccta

SEQ ID NO: 577358 - DNA, 13 bp, Homo sapiens
tccagttataaga

SEQ ID NO: 577359 - DNA, 16 bp, Homo sapiens
tccagttataagaaga

SEQ ID NO: 577360 - DNA, 17 bp, Homo sapiens
tccattttaattttaaa

SEQ ID NO: 577361 - DNA, 13 bp, Homo sapiens
tcccctctcccct

SEQ ID NO: 577362 - DNA, 22 bp, Homo sapiens
tcccctgcccccatcccacatg

SEQ ID NO: 577363 - DNA, 18 bp, Homo sapiens
tcccgcgggcctggacac

SEQ ID NO: 577364 - DNA, 17 bp, Homo sapiens
tccctgcttacctgacg

SEQ ID NO: 577365 - DNA, 15 bp, Homo sapiens
tcccttactttgctg

SEQ ID NO: 577366 - DNA, 13 bp, Homo sapiens
tcctaaggaacct

SEQ ID NO: 577367 - DNA, 17 bp, Homo sapiens
tcctactaataaaccag

SEQ ID NO: 577368 - DNA, 18 bp, Homo sapiens
tcctctcccctctgccct

SEQ ID NO: 577369 - DNA, 20 bp, Homo sapiens
tcctcttgtctgatttctta

SEQ ID NO: 577370 - DNA, 18 bp, Homo sapiens
tcctctttagtttttggt

SEQ ID NO: 577371 - DNA, 16 bp, Homo sapiens
tcctgctggcacctca

SEQ ID NO: 577372 - DNA, 14 bp, Homo sapiens
tccttgatttcaaa

SEQ ID NO: 577373 - DNA, 22 bp, Homo sapiens
tccttgatttcaaagttttgtt

SEQ ID NO: 577374 - DNA, 14 bp, Homo sapiens
tcgaacaaactgat

SEQ ID NO: 577375 - DNA, 16 bp, Homo sapiens
tcgaacaaactgatgc

SEQ ID NO: 577376 - DNA, 23 bp, Homo sapiens
tctaaatgcatatcctgagccat

SEQ ID NO: 577377 - DNA, 12 bp, Homo sapiens
tctataaaactc

SEQ ID NO: 577378 - DNA, 16 bp, Homo sapiens
tctataaaactctgca

SEQ ID NO: 577379 - DNA, 16 bp, Homo sapiens
tctattaatattcagg

SEQ ID NO: 577380 - DNA, 19 bp, Homo sapiens
tctattagttttctttgta

SEQ ID NO: 577381 - DNA, 16 bp, Homo sapiens
tctattatttttataa

SEQ ID NO: 577382 - DNA, 18 bp, Homo sapiens
tctcccctctgccctgta

SEQ ID NO: 577383 - DNA, 15 bp, Homo sapiens
tctccctagctcctc

SEQ ID NO: 577384 - DNA, 12 bp, Homo sapiens
tctctttttgtt

SEQ ID NO: 577385 - DNA, 14 bp, Homo sapiens
tctctttttgtttg

SEQ ID NO: 577386 - DNA, 23 bp, Homo sapiens
tctgacctggcatctaattctga

SEQ ID NO: 577387 - DNA, 23 bp, Homo sapiens
tctgattctggctttaagccttc

SEQ ID NO: 577388 - DNA, 14 bp, Homo sapiens
tctgcaacaagcat

SEQ ID NO: 577389 - DNA, 16 bp, Homo sapiens
tctgcaacaagcatgc

SEQ ID NO: 577390 - DNA, 17 bp, Homo sapiens
tctgcaacaagcatgca

SEQ ID NO: 577391 - DNA, 13 bp, Homo sapiens
tctgccctgtata

SEQ ID NO: 577392 - DNA, 17 bp, Homo sapiens
tctggctttaagccttc

SEQ ID NO: 577393 - DNA, 12 bp, Homo sapiens
tctgggcagctg

SEQ ID NO: 577394 - DNA, 15 bp, Homo sapiens
tctggtactttctgt

SEQ ID NO: 577395 - DNA, 20 bp, Homo sapiens
tctggtcaagggctgtcatt

SEQ ID NO: 577396 - DNA, 14 bp, Homo sapiens
tctgtcccctctcc

SEQ ID NO: 577397 - DNA, 17 bp, Homo sapiens
tctgtcccctctcccct

SEQ ID NO: 577398 - DNA, 12 bp, Homo sapiens
tctgttactgaa

SEQ ID NO: 577399 - DNA, 17 bp, Homo sapiens
tcttcccatgcattctg

SEQ ID NO: 577400 - DNA, 19 bp, Homo sapiens
tcttctagtgatgatggtt

SEQ ID NO: 577401 - DNA, 22 bp, Homo sapiens
tcttctggtactttctgttatg

SEQ ID NO: 577402 - DNA, 10 bp, Homo sapiens
tctttcatgg

SEQ ID NO: 577403 - DNA, 16 bp, Homo sapiens
tctttggattctaaat

SEQ ID NO: 577404 - DNA, 19 bp, Homo sapiens
tctttgtaaaggtcagagt

SEQ ID NO: 577405 - DNA, 15 bp, Homo sapiens
tctttgttacaggca

SEQ ID NO: 577406 - DNA, 13 bp, Homo sapiens
tcttttaaagacc

SEQ ID NO: 577407 - DNA, 18 bp, Homo sapiens
tcttttaaagaccctcct

SEQ ID NO: 577408 - DNA, 12 bp, Homo sapiens
tcttttgtttgg

SEQ ID NO: 577409 - DNA, 12 bp, Homo sapiens
tctttttgtttg

SEQ ID NO: 577410 - DNA, 12 bp, Homo sapiens
tcttttttaacc

SEQ ID NO: 577411 - DNA, 21 bp, Homo sapiens
tgaaactttgggaaaacatgt

SEQ ID NO: 577412 - DNA, 15 bp, Homo sapiens
tgaaagaaaattgag

SEQ ID NO: 577413 - DNA, 13 bp, Homo sapiens
tgaaatgaaaaca

SEQ ID NO: 577414 - DNA, 19 bp, Homo sapiens
tgaaatgaaaacatgtaat

SEQ ID NO: 577415 - DNA, 21 bp, Homo sapiens
tgaaatgaggagagaaggaca

SEQ ID NO: 577416 - DNA, 17 bp, Homo sapiens
tgaaattgcatactttg

SEQ ID NO: 577417 - DNA, 22 bp, Homo sapiens
tgaaccataaattcaactttgt

SEQ ID NO: 577418 - DNA, 12 bp, Homo sapiens
tgaactgagcca

SEQ ID NO: 577419 - DNA, 18 bp, Homo sapiens
tgaagagggagaagcatg

SEQ ID NO: 577420 - DNA, 21 bp, Homo sapiens
tgaagagggagaagcatgaaa

SEQ ID NO: 577421 - DNA, 23 bp, Homo sapiens
tgaagccccttgtcctctcccgc

SEQ ID NO: 577422 - DNA, 21 bp, Homo sapiens
tgaatctgttactgaaatgag

SEQ ID NO: 577423 - DNA, 13 bp, Homo sapiens
tgacatttcttct

SEQ ID NO: 577424 - DNA, 13 bp, Homo sapiens
tgaccggcacctg

SEQ ID NO: 577425 - DNA, 21 bp, Homo sapiens
tgacctgaccggcacctgcga

SEQ ID NO: 577426 - DNA, 14 bp, Homo sapiens
tgacgatgatgtac

SEQ ID NO: 577427 - DNA, 22 bp, Homo sapiens
tgactgccttgcctcctcagta

SEQ ID NO: 577428 - DNA, 16 bp, Homo sapiens
tgagaggggaagcggc

SEQ ID NO: 577429 - DNA, 18 bp, Homo sapiens
tgagccaaacacactgta

SEQ ID NO: 577430 - DNA, 20 bp, Homo sapiens
tgagccaaacacactgtaaa

SEQ ID NO: 577431 - DNA, 21 bp, Homo sapiens
tgagccaaacacactgtaaat

SEQ ID NO: 577432 - DNA, 22 bp, Homo sapiens
tgagccaaacacactgtaaata

SEQ ID NO: 577433 - DNA, 20 bp, Homo sapiens
tttctcagtgttggtatatt

SEQ ID NO: 577434 - DNA, 12 bp, Homo sapiens
tttgaaaaatat

SEQ ID NO: 577435 - DNA, 18 bp, Homo sapiens
tttgaagatttaattact

SEQ ID NO: 577436 - DNA, 16 bp, Homo sapiens
tttgaatgtaaccaat

SEQ ID NO: 577437 - DNA, 20 bp, Homo sapiens
tttgaggtcaagtaagaaga

SEQ ID NO: 577438 - DNA, 21 bp, Homo sapiens
tttgatagcagaagaaaaagt

SEQ ID NO: 577439 - DNA, 14 bp, Homo sapiens
tttgtaaaaatctt

SEQ ID NO: 577440 - DNA, 23 bp, Homo sapiens
tttgtaaaaatcttttgaagcat

SEQ ID NO: 577441 - DNA, 13 bp, Homo sapiens
tttgtaaaggtca

SEQ ID NO: 577442 - DNA, 23 bp, Homo sapiens
tttgtaaaggtcagagtcaaaat

SEQ ID NO: 577443 - DNA, 18 bp, Homo sapiens
tttgtagcgtacatcaat

SEQ ID NO: 577444 - DNA, 14 bp, Homo sapiens
tttgtattttcatg

SEQ ID NO: 577445 - DNA, 15 bp, Homo sapiens
tttgtattttcatga

SEQ ID NO: 577446 - DNA, 20 bp, Homo sapiens
tttgtccaatggctgtaaac

SEQ ID NO: 577447 - DNA, 21 bp, Homo sapiens
ttttaaagaagtaaatttgtc

SEQ ID NO: 577448 - DNA, 12 bp, Homo sapiens
ttttaactcacc

SEQ ID NO: 577449 - DNA, 13 bp, Homo sapiens
ttttactgtctat

SEQ ID NO: 577450 - DNA, 19 bp, Homo sapiens
ttttatattactgacattt

SEQ ID NO: 577451 - DNA, 23 bp, Homo sapiens
ttttatcgtttttgtattttcat

SEQ ID NO: 577452 - DNA, 17 bp, Homo sapiens
ttttatgtaattatata

SEQ ID NO: 577453 - DNA, 17 bp, Homo sapiens
ttttcaaaaggtattat

SEQ ID NO: 577454 - DNA, 19 bp, Homo sapiens
ttttctattatttttataa

SEQ ID NO: 577455 - DNA, 16 bp, Homo sapiens
ttttcttcttgggata

SEQ ID NO: 577456 - DNA, 15 bp, Homo sapiens
ttttctttgtaaagg

SEQ ID NO: 577457 - DNA, 13 bp, Homo sapiens
ttttgaagcatag

SEQ ID NO: 577458 - DNA, 18 bp, Homo sapiens
ttttgaatgcttcctgac

SEQ ID NO: 577459 - DNA, 15 bp, Homo sapiens
ttttggggagccaga

SEQ ID NO: 577460 - DNA, 14 bp, Homo sapiens
ttttgtatgttaaa

SEQ ID NO: 577461 - DNA, 18 bp, Homo sapiens
ttttgtattttcatgaaa

SEQ ID NO: 577462 - DNA, 24 bp, Homo sapiens
ttttgtgaaatgaaaacatgtaat

SEQ ID NO: 577463 - DNA, 16 bp, Homo sapiens
tttttaatttacttgt

SEQ ID NO: 577464 - DNA, 12 bp, Homo sapiens
tgtttggtaaat

SEQ ID NO: 577465 - DNA, 14 bp, Homo sapiens
tgtttggtaaatgt

SEQ ID NO: 577466 - DNA, 17 bp, Homo sapiens
tgttttggatggcttgt

SEQ ID NO: 577467 - DNA, 21 bp, Homo sapiens
ttaaaatgtaatttaaatgaa

SEQ ID NO: 577468 - DNA, 16 bp, Homo sapiens
ttaaaattttgtatgt

SEQ ID NO: 577469 - DNA, 20 bp, Homo sapiens
ttaaaattttgtatgttaaa

SEQ ID NO: 577470 - DNA, 15 bp, Homo sapiens
ttaaatttaatacca

SEQ ID NO: 577471 - DNA, 16 bp, Homo sapiens
ttaagacacacctctg

SEQ ID NO: 577472 - DNA, 16 bp, Homo sapiens
ttaagccttcaaaact

SEQ ID NO: 577473 - DNA, 20 bp, Homo sapiens
ttaaggggaagaatgaaagc

SEQ ID NO: 577474 - DNA, 18 bp, Homo sapiens
ttaatccagttataagaa

SEQ ID NO: 577475 - DNA, 19 bp, Homo sapiens
ttaatccagttataagaag

SEQ ID NO: 577476 - DNA, 18 bp, Homo sapiens
ttaatcttcaaagccttc

SEQ ID NO: 577477 - DNA, 14 bp, Homo sapiens
ttaatgacaatatt

SEQ ID NO: 577478 - DNA, 14 bp, Homo sapiens
ttaatgctacatgt

SEQ ID NO: 577479 - DNA, 14 bp, Homo sapiens
ttaatgttttcaaa

SEQ ID NO: 577480 - DNA, 13 bp, Homo sapiens
ttaattttaaagt

SEQ ID NO: 577481 - DNA, 19 bp, Homo sapiens
ttaattttaaagtgcaaaa

SEQ ID NO: 577482 - DNA, 21 bp, Homo sapiens
ttacaatattgattgggaaaa

SEQ ID NO: 577483 - DNA, 15 bp, Homo sapiens
ttacaggcaccgaga

SEQ ID NO: 577484 - DNA, 13 bp, Homo sapiens
ttacatgcatttg

SEQ ID NO: 577485 - DNA, 13 bp, Homo sapiens
ttactgaaatgag

SEQ ID NO: 577486 - DNA, 18 bp, Homo sapiens
ttacttcgtgcgcaacaa

SEQ ID NO: 577487 - DNA, 15 bp, Homo sapiens
ttaggcagattgaaa

SEQ ID NO: 577488 - DNA, 23 bp, Homo sapiens
ttagtttttggttgggaatgagg

SEQ ID NO: 577489 - DNA, 13 bp, Homo sapiens
ttataaagcatgt

SEQ ID NO: 577490 - DNA, 20 bp, Homo sapiens
ttatacatgtgatacatttt

SEQ ID NO: 577491 - DNA, 13 bp, Homo sapiens
ttattgaccattt

SEQ ID NO: 577492 - DNA, 17 bp, Homo sapiens
ttatttttttaaaattt

SEQ ID NO: 577493 - DNA, 14 bp, Homo sapiens
ttcaaaatgtctgt

SEQ ID NO: 577494 - DNA, 12 bp, Homo sapiens
ttcaaagccttc

SEQ ID NO: 577495 - DNA, 20 bp, Homo sapiens
ttcaaagttttgttgtactt

SEQ ID NO: 577496 - DNA, 15 bp, Homo sapiens
ttcaagccttccagg

SEQ ID NO: 577497 - DNA, 17 bp, Homo sapiens
ttcacagcacttacaat

SEQ ID NO: 577498 - DNA, 12 bp, Homo sapiens
ttcagaaatgtt

SEQ ID NO: 577499 - DNA, 23 bp, Homo sapiens
ttcagggtaaataggaatcattc

SEQ ID NO: 577500 - DNA, 18 bp, Homo sapiens
ttcagttgcttgtcttct

SEQ ID NO: 577501 - DNA, 14 bp, Homo sapiens
ttcatctctttaga

SEQ ID NO: 577502 - DNA, 17 bp, Homo sapiens
ttcatctctttagagaa

SEQ ID NO: 577503 - DNA, 17 bp, Homo sapiens
ttcatgaaaataccatt

SEQ ID NO: 577504 - DNA, 13 bp, Homo sapiens
ttcatgaaatcct

SEQ ID NO: 577505 - DNA, 20 bp, Homo sapiens
ttccagggatttgcctcacc

SEQ ID NO: 577506 - DNA, 13 bp, Homo sapiens
ttccattttaatt

SEQ ID NO: 577507 - DNA, 18 bp, Homo sapiens
ttccattttaattttaaa

SEQ ID NO: 577508 - DNA, 23 bp, Homo sapiens
ttcccctctgtgtcctctcccct

SEQ ID NO: 577509 - DNA, 22 bp, Homo sapiens
ttcccttgaaactttgggaaaa

SEQ ID NO: 577510 - DNA, 14 bp, Homo sapiens
ttcctaacacagca

SEQ ID NO: 577511 - DNA, 18 bp, Homo sapiens
ttcctaacacagcatgtg

SEQ ID NO: 577512 - DNA, 23 bp, Homo sapiens
ttcctgtgggccaggagctcagc

SEQ ID NO: 577513 - DNA, 23 bp, Homo sapiens
ttccttggtcctagtaagaagac

SEQ ID NO: 577514 - DNA, 20 bp, Homo sapiens
ttctaaatgcatatcctgag

SEQ ID NO: 577515 - DNA, 18 bp, Homo sapiens
ttctggctttaagccttc

SEQ ID NO: 577516 - DNA, 21 bp, Homo sapiens
ttcttaaaaggcccatagcag

SEQ ID NO: 577517 - DNA, 13 bp, Homo sapiens
ttcttaaccatct

SEQ ID NO: 577518 - DNA, 14 bp, Homo sapiens
ttctttgtaaaggt

SEQ ID NO: 577519 - DNA, 16 bp, Homo sapiens
ttctttgtaaaggtca

SEQ ID NO: 577520 - DNA, 14 bp, Homo sapiens
ttcttttctcagtg

SEQ ID NO: 577521 - DNA, 14 bp, Homo sapiens
ttcttttgtttggt

SEQ ID NO: 577522 - DNA, 13 bp, Homo sapiens
ttgaaaaatataa

SEQ ID NO: 577523 - DNA, 20 bp, Homo sapiens
ttgaaactttgggaaaacat

SEQ ID NO: 577524 - DNA, 11 bp, Homo sapiens
ttgaagcatag

SEQ ID NO: 577525 - DNA, 19 bp, Homo sapiens
ttgaagcatagataatatt

SEQ ID NO: 577526 - DNA, 23 bp, Homo sapiens
ttgaagcatagataatattgttt

SEQ ID NO: 577527 - DNA, 22 bp, Homo sapiens
ttgaatgttaaagggatatttt

SEQ ID NO: 577528 - DNA, 20 bp, Homo sapiens
ttgactaactcaaatacaca

SEQ ID NO: 577529 - DNA, 22 bp, Homo sapiens
ttgactaactcaaatacacatt

SEQ ID NO: 577530 - DNA, 20 bp, Homo sapiens
ttgacttttataaagcatgt

SEQ ID NO: 577531 - DNA, 22 bp, Homo sapiens
ttgaggtcaagtaagaagacat

SEQ ID NO: 577532 - DNA, 17 bp, Homo sapiens
ttgagtctgtactaaac

SEQ ID NO: 577533 - DNA, 15 bp, Homo sapiens
ttgagtgtatgagta

SEQ ID NO: 577534 - DNA, 12 bp, Homo sapiens
ttgatgactgcc

SEQ ID NO: 577535 - DNA, 13 bp, Homo sapiens
ttgatgactgcct

SEQ ID NO: 577536 - DNA, 23 bp, Homo sapiens
ttgattattttttttttcttctt

SEQ ID NO: 577537 - DNA, 17 bp, Homo sapiens
ttgattgggaaaacatt

SEQ ID NO: 577538 - DNA, 22 bp, Homo sapiens
ttgattgggaaaacatttgctg

SEQ ID NO: 577539 - DNA, 17 bp, Homo sapiens
ttgattgtcagctacta

SEQ ID NO: 577540 - DNA, 21 bp, Homo sapiens
ttgattgtcagctactaatga

SEQ ID NO: 577541 - DNA, 18 bp, Homo sapiens
ttgatttgattgggatga

SEQ ID NO: 577542 - DNA, 21 bp, Homo sapiens
ttgcataataagctaaagagg

SEQ ID NO: 577543 - DNA, 17 bp, Homo sapiens
ttgcatactttgtattt

SEQ ID NO: 577544 - DNA, 13 bp, Homo sapiens
ttgcatgcatgca

SEQ ID NO: 577545 - DNA, 16 bp, Homo sapiens
ttgcatgcatgcaaat

SEQ ID NO: 577546 - DNA, 15 bp, Homo sapiens
ttgccaggacatgca

SEQ ID NO: 577547 - DNA, 18 bp, Homo sapiens
ttgctgctgtccagtgcc

SEQ ID NO: 577548 - DNA, 14 bp, Homo sapiens
ttggccctttcctt

SEQ ID NO: 577549 - DNA, 19 bp, Homo sapiens
ttggccctttccttccaga

SEQ ID NO: 577550 - DNA, 16 bp, Homo sapiens
ttgggaaaacatgtta

SEQ ID NO: 577551 - DNA, 23 bp, Homo sapiens
ttgggaatgaggaaaattcttaa

SEQ ID NO: 577552 - DNA, 21 bp, Homo sapiens
ttggggccttgatgactgcct

SEQ ID NO: 577553 - DNA, 17 bp, Homo sapiens
ttggttcttgtactcta

SEQ ID NO: 577554 - DNA, 22 bp, Homo sapiens
ttggttgggaatgaggaaaatt

SEQ ID NO: 577555 - DNA, 18 bp, Homo sapiens
ttgtaaaggtcagagtca

SEQ ID NO: 577556 - DNA, 15 bp, Homo sapiens
ttgtactctacaaaa

SEQ ID NO: 577557 - DNA, 23 bp, Homo sapiens
ttgtacttaaatggtaataagca

SEQ ID NO: 577558 - DNA, 17 bp, Homo sapiens
ttgtattttcatgaaaa

SEQ ID NO: 577559 - DNA, 18 bp, Homo sapiens
ttgtattttcatgaaaat

SEQ ID NO: 577560 - DNA, 18 bp, Homo sapiens
ttgtccaatggctgtaaa

SEQ ID NO: 577561 - DNA, 22 bp, Homo sapiens
ttgttaagtatcagctacaatt

SEQ ID NO: 577562 - DNA, 12 bp, Homo sapiens
ttgttgtactta

SEQ ID NO: 577563 - DNA, 19 bp, Homo sapiens
ttgtttggtaaatgtttct

SEQ ID NO: 577564 - DNA, 17 bp, Homo sapiens
ttgttttggatggcttg

SEQ ID NO: 577565 - DNA, 21 bp, Homo sapiens
tttaaacgtgatttttaaatt

SEQ ID NO: 577566 - DNA, 13 bp, Homo sapiens
tttaacaaaattt

SEQ ID NO: 577567 - DNA, 21 bp, Homo sapiens
tttaacatataatttctttaa

SEQ ID NO: 577568 - DNA, 23 bp, Homo sapiens
tttaaccggtaagagtttcagtt

SEQ ID NO: 577569 - DNA, 14 bp, Homo sapiens
tttaagcttcagtt

SEQ ID NO: 577570 - DNA, 21 bp, Homo sapiens
tttaagcttcagttgcttgtc

SEQ ID NO: 577571 - DNA, 15 bp, Homo sapiens
tttataattgtacaa

SEQ ID NO: 577572 - DNA, 17 bp, Homo sapiens
tttatgagccagacaaa

SEQ ID NO: 577573 - DNA, 12 bp, Homo sapiens
tttattaatgtt

SEQ ID NO: 577574 - DNA, 21 bp, Homo sapiens
tttcaaaaggtattatacatg

SEQ ID NO: 577575 - DNA, 17 bp, Homo sapiens
tttcaaaagtgatctgt

SEQ ID NO: 577576 - DNA, 20 bp, Homo sapiens
tttcacagcacttacaattt

SEQ ID NO: 577577 - DNA, 21 bp, Homo sapiens
tttcagaaatataacacattt

SEQ ID NO: 577578 - DNA, 16 bp, Homo sapiens
tttcattaaatccttt

SEQ ID NO: 577579 - DNA, 12 bp, Homo sapiens
tttccagtgcaa

SEQ ID NO: 577580 - DNA, 17 bp, Homo sapiens
tttctcagtgttggtat

SEQ ID NO: 577581 - DNA, 16 bp, Homo sapiens
aaaagcccagtgacct

SEQ ID NO: 577582 - DNA, 20 bp, Homo sapiens
aaaagcgacccattcagaga

SEQ ID NO: 577583 - DNA, 13 bp, Homo sapiens
aaaagtatatgtt

SEQ ID NO: 577584 - DNA, 14 bp, Homo sapiens
aaaagtatatgtta

SEQ ID NO: 577585 - DNA, 15 bp, Homo sapiens
aaaagttattttgta

SEQ ID NO: 577586 - DNA, 20 bp, Homo sapiens
aaaataaataaaaactaatt

SEQ ID NO: 577587 - DNA, 13 bp, Homo sapiens
aaaataacagtat

SEQ ID NO: 577588 - DNA, 14 bp, Homo sapiens
aaaatataaaatta

SEQ ID NO: 577589 - DNA, 16 bp, Homo sapiens
aaaatcttttgaagca

SEQ ID NO: 577590 - DNA, 18 bp, Homo sapiens
aaaatgtaatttaaatga

SEQ ID NO: 577591 - DNA, 21 bp, Homo sapiens
aaaatgtctgtagctcctcaa

SEQ ID NO: 577592 - DNA, 16 bp, Homo sapiens
aaaatttcaaaagtga

SEQ ID NO: 577593 - DNA, 21 bp, Homo sapiens
aaaattttgtatgttaaagag

SEQ ID NO: 577594 - DNA, 15 bp, Homo sapiens
aaacacactgtaaat

SEQ ID NO: 577595 - DNA, 14 bp, Homo sapiens
aaacagaaatggaa

SEQ ID NO: 577596 - DNA, 12 bp, Homo sapiens
aaacatttgctg

SEQ ID NO: 577597 - DNA, 15 bp, Homo sapiens
aaaccaaagaagaaa

SEQ ID NO: 577598 - DNA, 15 bp, Homo sapiens
aaaccactagaaagt

SEQ ID NO: 577599 - DNA, 16 bp, Homo sapiens
aaacctagtactgccc

SEQ ID NO: 577600 - DNA, 20 bp, Homo sapiens
aaactaacagataagcaaga

SEQ ID NO: 577601 - DNA, 13 bp, Homo sapiens
aaactactgtaat

SEQ ID NO: 577602 - DNA, 22 bp, Homo sapiens
aaactgatgcgaaaacttgaat

SEQ ID NO: 577603 - DNA, 13 bp, Homo sapiens
aaacttgaatctg

SEQ ID NO: 577604 - DNA, 14 bp, Homo sapiens
aaacttgaatctgt

SEQ ID NO: 577605 - DNA, 13 bp, Homo sapiens
aaactttgggaaa

SEQ ID NO: 577606 - DNA, 15 bp, Homo sapiens
aaagaagtaaatttg

SEQ ID NO: 577607 - DNA, 16 bp, Homo sapiens
aaagacccagggggag

SEQ ID NO: 577608 - DNA, 13 bp, Homo sapiens
aaagagagaatgt

SEQ ID NO: 577609 - DNA, 21 bp, Homo sapiens
aaagagttgggtgtctcctta

SEQ ID NO: 577610 - DNA, 21 bp, Homo sapiens
aaaggatagtaagcatagaaa

SEQ ID NO: 577611 - DNA, 20 bp, Homo sapiens
aaagtgatctgtcccctctc

SEQ ID NO: 577612 - DNA, 23 bp, Homo sapiens
aaagtgatctgtcccctctcccc

SEQ ID NO: 577613 - DNA, 18 bp, Homo sapiens
aaagtgtgtatatatttt

SEQ ID NO: 577614 - DNA, 19 bp, Homo sapiens
aaagtgtgtatatattttg

SEQ ID NO: 577615 - DNA, 23 bp, Homo sapiens
aaagtgtgtatatattttgtgtg

SEQ ID NO: 577616 - DNA, 17 bp, Homo sapiens
aaagttttatatgcttt

SEQ ID NO: 577617 - DNA, 14 bp, Homo sapiens
aaataagaaataat

SEQ ID NO: 577618 - DNA, 19 bp, Homo sapiens
aaataatgctacaatttta

SEQ ID NO: 577619 - DNA, 20 bp, Homo sapiens
aaataatgctacaattttaa

SEQ ID NO: 577620 - DNA, 12 bp, Homo sapiens
aaatacacattt

SEQ ID NO: 577621 - DNA, 12 bp, Homo sapiens
aaataccattta

SEQ ID NO: 577622 - DNA, 22 bp, Homo sapiens
aaataccatttagtaagaatac

SEQ ID NO: 577623 - DNA, 19 bp, Homo sapiens
aaataggaatcattcagaa

SEQ ID NO: 577624 - DNA, 23 bp, Homo sapiens
aattcttaaaaggcccatagcag

SEQ ID NO: 577625 - DNA, 22 bp, Homo sapiens
aattgcatactttgtattttga

SEQ ID NO: 577626 - DNA, 14 bp, Homo sapiens
aatttaaaaaataa

SEQ ID NO: 577627 - DNA, 12 bp, Homo sapiens
aatttaaatgaa

SEQ ID NO: 577628 - DNA, 16 bp, Homo sapiens
aatttaaatgaaagaa

SEQ ID NO: 577629 - DNA, 19 bp, Homo sapiens
aatttaaatgaaagaaaat

SEQ ID NO: 577630 - DNA, 22 bp, Homo sapiens
aatttaaatgaaagaaaattga

SEQ ID NO: 577631 - DNA, 19 bp, Homo sapiens
aatttcaaaagtgatctgt

SEQ ID NO: 577632 - DNA, 22 bp, Homo sapiens
aatttgtccaatggctgtaaac

SEQ ID NO: 577633 - DNA, 16 bp, Homo sapiens
aattttaaagtgcaaa

SEQ ID NO: 577634 - DNA, 17 bp, Homo sapiens
aattttaaagtgcaaaa

SEQ ID NO: 577635 - DNA, 13 bp, Homo sapiens
aattttattatag

SEQ ID NO: 577636 - DNA, 20 bp, Homo sapiens
acaaaattaagcaaatgtta

SEQ ID NO: 577637 - DNA, 20 bp, Homo sapiens
acaaactgatgcgaaaactt

SEQ ID NO: 577638 - DNA, 22 bp, Homo sapiens
acaaactgatgcgaaaacttga

SEQ ID NO: 577639 - DNA, 22 bp, Homo sapiens
acaaactgcttcccttactttg

SEQ ID NO: 577640 - DNA, 12 bp, Homo sapiens
acaacaaggacc

SEQ ID NO: 577641 - DNA, 14 bp, Homo sapiens
acaacaaggaccct

SEQ ID NO: 577642 - DNA, 22 bp, Homo sapiens
acaaggaccctgttttccacac

SEQ ID NO: 577643 - DNA, 23 bp, Homo sapiens
acaataggagtggtgatttgaaa

SEQ ID NO: 577644 - DNA, 18 bp, Homo sapiens
acaatattgattgggaaa

SEQ ID NO: 577645 - DNA, 13 bp, Homo sapiens
acaatccactctc

SEQ ID NO: 577646 - DNA, 18 bp, Homo sapiens
acaatccactctcaggag

SEQ ID NO: 577647 - DNA, 14 bp, Homo sapiens
acaatgcctctccc

SEQ ID NO: 577648 - DNA, 15 bp, Homo sapiens
acaatgcctctccca

SEQ ID NO: 577649 - DNA, 18 bp, Homo sapiens
acaatgcctctcccacga

SEQ ID NO: 577650 - DNA, 20 bp, Homo sapiens
acaatgcctctcccacgatg

SEQ ID NO: 577651 - DNA, 22 bp, Homo sapiens
acaattatttgaagatttaatt

SEQ ID NO: 577652 - DNA, 23 bp, Homo sapiens
acacacctctggatccctggagg

SEQ ID NO: 577653 - DNA, 14 bp, Homo sapiens
acacagcatgtgta

SEQ ID NO: 577654 - DNA, 17 bp, Homo sapiens
acaccttttaactcacc

SEQ ID NO: 577655 - DNA, 18 bp, Homo sapiens
acacttatggggacagca

SEQ ID NO: 577656 - DNA, 19 bp, Homo sapiens
acacttatggggacagcat

SEQ ID NO: 577657 - DNA, 20 bp, Homo sapiens
acacttatggggacagcata

SEQ ID NO: 577658 - DNA, 19 bp, Homo sapiens
acagactccctcccctgcc

SEQ ID NO: 577659 - DNA, 23 bp, Homo sapiens
acagactccctcccctgccccca

SEQ ID NO: 577660 - DNA, 13 bp, Homo sapiens
acagataagcaag

SEQ ID NO: 577661 - DNA, 19 bp, Homo sapiens
acagattctttcagttctt

SEQ ID NO: 577662 - DNA, 21 bp, Homo sapiens
acagcataccttggactgact

SEQ ID NO: 577663 - DNA, 13 bp, Homo sapiens
acagcctttgaat

SEQ ID NO: 577664 - DNA, 14 bp, Homo sapiens
acagcctttgaatg

SEQ ID NO: 577665 - DNA, 15 bp, Homo sapiens
acagcctttgaatgt

SEQ ID NO: 577666 - DNA, 17 bp, Homo sapiens
acagcctttgaatgtaa

SEQ ID NO: 577667 - DNA, 21 bp, Homo sapiens
acagcctttgaatgtaaccaa

SEQ ID NO: 577668 - DNA, 16 bp, Homo sapiens
acagtgaagttttact

SEQ ID NO: 577669 - DNA, 15 bp, Homo sapiens
acataagcttccatt

SEQ ID NO: 577670 - DNA, 18 bp, Homo sapiens
acatattaggaaaatatg

SEQ ID NO: 577671 - DNA, 22 bp, Homo sapiens
acatcaatgataatgctaattt

SEQ ID NO: 577672 - DNA, 19 bp, Homo sapiens
acatcccgggcctcagtgc

SEQ ID NO: 577673 - DNA, 14 bp, Homo sapiens
acatgcaataaaat

SEQ ID NO: 577674 - DNA, 15 bp, Homo sapiens
acatgcaataaaatt

SEQ ID NO: 577675 - DNA, 12 bp, Homo sapiens
acatgcatttga

SEQ ID NO: 577676 - DNA, 18 bp, Homo sapiens
acatgtatgtaaatagct

SEQ ID NO: 577677 - DNA, 22 bp, Homo sapiens
acatgtgctattgaactgagcc

SEQ ID NO: 577678 - DNA, 19 bp, Homo sapiens
acatttcttctagtgatga

SEQ ID NO: 577679 - DNA, 17 bp, Homo sapiens
acatttgctactgttgt

SEQ ID NO: 577680 - DNA, 19 bp, Homo sapiens
acatttgctactgttgtaa

SEQ ID NO: 577681 - DNA, 17 bp, Homo sapiens
acattttttaagcttca

SEQ ID NO: 577682 - DNA, 18 bp, Homo sapiens
acatttttttgcatgcat

SEQ ID NO: 577683 - DNA, 17 bp, Homo sapiens
accacacttgaaacctt

SEQ ID NO: 577684 - DNA, 22 bp, Homo sapiens
accacagggttcaaaatgtctg

SEQ ID NO: 577685 - DNA, 23 bp, Homo sapiens
accacttccaggggaacctgcca

SEQ ID NO: 577686 - DNA, 20 bp, Homo sapiens
accaggtgttctacactcat

SEQ ID NO: 577687 - DNA, 23 bp, Homo sapiens
accaggtgttctacactcatctt

SEQ ID NO: 577688 - DNA, 14 bp, Homo sapiens
accataaattcaac

SEQ ID NO: 577689 - DNA, 22 bp, Homo sapiens
accataaattcaactttgtaaa

SEQ ID NO: 577690 - DNA, 21 bp, Homo sapiens
acccattaaggggaagaatga

SEQ ID NO: 577691 - DNA, 22 bp, Homo sapiens
acccattaaggggaagaatgaa

SEQ ID NO: 577692 - DNA, 17 bp, Homo sapiens
acccccttaaatttaat

SEQ ID NO: 577693 - DNA, 16 bp, Homo sapiens
accctgttttccacac

SEQ ID NO: 577694 - DNA, 21 bp, Homo sapiens
accctgttttccacaccatca

SEQ ID NO: 577695 - DNA, 20 bp, Homo sapiens
acctaatgtttatgagccag

SEQ ID NO: 577696 - DNA, 21 bp, Homo sapiens
acctcaagggggactgtcttt

SEQ ID NO: 577697 - DNA, 19 bp, Homo sapiens
acctcagacaatccactct

SEQ ID NO: 577698 - DNA, 15 bp, Homo sapiens
acctgaccggcacct

SEQ ID NO: 577699 - DNA, 17 bp, Homo sapiens
acctgacggacgtcctg

SEQ ID NO: 577700 - DNA, 19 bp, Homo sapiens
acctgacggacgtcctgct

SEQ ID NO: 577701 - DNA, 23 bp, Homo sapiens
acctgcgagaggtccctgcttac

SEQ ID NO: 577702 - DNA, 20 bp, Homo sapiens
acctttgagtagatccattt

SEQ ID NO: 577703 - DNA, 15 bp, Homo sapiens
acgatgatgtacaga

SEQ ID NO: 577704 - DNA, 12 bp, Homo sapiens
acgtcatgtatt

SEQ ID NO: 577705 - DNA, 18 bp, Homo sapiens
acgtcatgtatttgagca

SEQ ID NO: 577706 - DNA, 13 bp, Homo sapiens
actaacagataag

SEQ ID NO: 577707 - DNA, 16 bp, Homo sapiens
actaacagataagcaa

SEQ ID NO: 577708 - DNA, 15 bp, Homo sapiens
actaactcaaataca

SEQ ID NO: 577709 - DNA, 18 bp, Homo sapiens
actaactcaaatacacat

SEQ ID NO: 577710 - DNA, 12 bp, Homo sapiens
actaataaacca

SEQ ID NO: 577711 - DNA, 13 bp, Homo sapiens
actaataaaccag

SEQ ID NO: 577712 - DNA, 21 bp, Homo sapiens
actactgtaattaagtgcaat

SEQ ID NO: 577713 - DNA, 16 bp, Homo sapiens
actatatatataaatg

SEQ ID NO: 577714 - DNA, 20 bp, Homo sapiens
actcacctaatgtttatgag

SEQ ID NO: 577715 - DNA, 22 bp, Homo sapiens
actcatcttagtgcctgagagt

SEQ ID NO: 577716 - DNA, 16 bp, Homo sapiens
actccagtctcctgac

SEQ ID NO: 577717 - DNA, 19 bp, Homo sapiens
actccctaagaaaccccag

SEQ ID NO: 577718 - DNA, 17 bp, Homo sapiens
actctcaggaggcgcag

SEQ ID NO: 577719 - DNA, 13 bp, Homo sapiens
actgacatttctt

SEQ ID NO: 577720 - DNA, 15 bp, Homo sapiens
actgacatttcttct

SEQ ID NO: 577721 - DNA, 19 bp, Homo sapiens
actgagccaaacacactgt

SEQ ID NO: 577722 - DNA, 20 bp, Homo sapiens
actgagccaaacacactgta

SEQ ID NO: 577723 - DNA, 13 bp, Homo sapiens
actgcagggttca

SEQ ID NO: 577724 - DNA, 19 bp, Homo sapiens
actgccccccatgaggaag

SEQ ID NO: 577725 - DNA, 22 bp, Homo sapiens
actgccccccatgaggaaggaa

SEQ ID NO: 577726 - DNA, 20 bp, Homo sapiens
actgccttgcctcctcagta

SEQ ID NO: 577727 - DNA, 16 bp, Homo sapiens
actgtaaatatccaca

SEQ ID NO: 577728 - DNA, 17 bp, Homo sapiens
actgtaattaagtgcaa

SEQ ID NO: 577729 - DNA, 14 bp, Homo sapiens
actgttgtaagaat

SEQ ID NO: 577730 - DNA, 22 bp, Homo sapiens
actgttgtaagaattctgattg

SEQ ID NO: 577731 - DNA, 18 bp, Homo sapiens
acttccaggggaacctgc

SEQ ID NO: 577732 - DNA, 20 bp, Homo sapiens
acttccaggggaacctgcca

SEQ ID NO: 577733 - DNA, 17 bp, Homo sapiens
acttctaaatgcatatc

SEQ ID NO: 577734 - DNA, 18 bp, Homo sapiens
acttctgcaacaagcatg

SEQ ID NO: 577735 - DNA, 24 bp, Homo sapiens
acttctgcaacaagcatgcagctt

SEQ ID NO: 577736 - DNA, 16 bp, Homo sapiens
agggaaggcctgactt

SEQ ID NO: 577737 - DNA, 15 bp, Homo sapiens
agggatggaaaagga

SEQ ID NO: 577738 - DNA, 17 bp, Homo sapiens
agggatttgcctcacct

SEQ ID NO: 577739 - DNA, 13 bp, Homo sapiens
aggggaagaatga

SEQ ID NO: 577740 - DNA, 15 bp, Homo sapiens
aggggaagaatgaaa

SEQ ID NO: 577741 - DNA, 14 bp, Homo sapiens
agggttcaaaatgt

SEQ ID NO: 577742 - DNA, 22 bp, Homo sapiens
agggttcaaaatgtctgtagct

SEQ ID NO: 577743 - DNA, 17 bp, Homo sapiens
agggttcaagccttcca

SEQ ID NO: 577744 - DNA, 15 bp, Homo sapiens
aggtatctagagctt

SEQ ID NO: 577745 - DNA, 19 bp, Homo sapiens
aggtattaaaactaaattt

SEQ ID NO: 577746 - DNA, 18 bp, Homo sapiens
aggtcaagtaagaagaca

SEQ ID NO: 577747 - DNA, 19 bp, Homo sapiens
aggtcaagtaagaagacat

SEQ ID NO: 577748 - DNA, 19 bp, Homo sapiens
aggtgggccttgctacctc

SEQ ID NO: 577749 - DNA, 20 bp, Homo sapiens
aggtgttctacactcatctt

SEQ ID NO: 577750 - DNA, 22 bp, Homo sapiens
aggtttacaataggagtggtga

SEQ ID NO: 577751 - DNA, 16 bp, Homo sapiens
agtaaatttgtccaat

SEQ ID NO: 577752 - DNA, 19 bp, Homo sapiens
agtaacccccttaaattta

SEQ ID NO: 577753 - DNA, 16 bp, Homo sapiens
agtagatccatttcca

SEQ ID NO: 577754 - DNA, 11 bp, Homo sapiens
agtatccaggc

SEQ ID NO: 577755 - DNA, 16 bp, Homo sapiens
agtatgtgcatttaat

SEQ ID NO: 577756 - DNA, 18 bp, Homo sapiens
agtatgtgggggcttcat

SEQ ID NO: 577757 - DNA, 21 bp, Homo sapiens
agtattgccacaatgcctctc

SEQ ID NO: 577758 - DNA, 22 bp, Homo sapiens
agtattgtttaaaatgtaattt

SEQ ID NO: 577759 - DNA, 13 bp, Homo sapiens
agtcaaaatttca

SEQ ID NO: 577760 - DNA, 18 bp, Homo sapiens
agtccaagcaacagcctt

SEQ ID NO: 577761 - DNA, 19 bp, Homo sapiens
agtctcagaaagccttcca

SEQ ID NO: 577762 - DNA, 15 bp, Homo sapiens
agtctttcatggctg

SEQ ID NO: 577763 - DNA, 18 bp, Homo sapiens
agtgaagccccttgtcct

SEQ ID NO: 577764 - DNA, 23 bp, Homo sapiens
agtgaagccccttgtcctctccc

SEQ ID NO: 577765 - DNA, 13 bp, Homo sapiens
agtgacctgaccg

SEQ ID NO: 577766 - DNA, 21 bp, Homo sapiens
agtgatctgtcccctctcccc

SEQ ID NO: 577767 - DNA, 21 bp, Homo sapiens
agtgcaatttcccctctgtgt

SEQ ID NO: 577768 - DNA, 22 bp, Homo sapiens
agtgcctacatcccgggcctca

SEQ ID NO: 577769 - DNA, 19 bp, Homo sapiens
agtgcttaaaaatcattga

SEQ ID NO: 577770 - DNA, 16 bp, Homo sapiens
agtgcttttctgttta

SEQ ID NO: 577771 - DNA, 23 bp, Homo sapiens
agtgtgtatatattttgtgtgaa

SEQ ID NO: 577772 - DNA, 13 bp, Homo sapiens
agtgtgtcagagt

SEQ ID NO: 577773 - DNA, 12 bp, Homo sapiens
agttataagaag

SEQ ID NO: 577774 - DNA, 23 bp, Homo sapiens
agttgcacttattgaccattttt

SEQ ID NO: 577775 - DNA, 20 bp, Homo sapiens
agtttcacagcacttacaat

SEQ ID NO: 577776 - DNA, 19 bp, Homo sapiens
agtttcagtttgttggaaa

SEQ ID NO: 577777 - DNA, 23 bp, Homo sapiens
agttttactgtctattaatattc

SEQ ID NO: 577778 - DNA, 13 bp, Homo sapiens
agttttgttgtac

SEQ ID NO: 577779 - DNA, 18 bp, Homo sapiens
agttttgttgtacttaaa

SEQ ID NO: 577780 - DNA, 23 bp, Homo sapiens
agttttgttgtacttaaatggta

SEQ ID NO: 577781 - DNA, 17 bp, Homo sapiens
agtttttggttgggaat

SEQ ID NO: 577782 - DNA, 23 bp, Homo sapiens
ataaaatttttatgtaattatat

SEQ ID NO: 577783 - DNA, 15 bp, Homo sapiens
ataaactactgtaat

SEQ ID NO: 577784 - DNA, 20 bp, Homo sapiens
ataaatgtataaatatacag

SEQ ID NO: 577785 - DNA, 12 bp, Homo sapiens
ataacacatttt

SEQ ID NO: 577786 - DNA, 23 bp, Homo sapiens
ataacatcgaaaagttattttgt

SEQ ID NO: 577787 - DNA, 14 bp, Homo sapiens
ataagcaagagaga

SEQ ID NO: 577788 - DNA, 17 bp, Homo sapiens
ataagcaagagagatgt

SEQ ID NO: 577789 - DNA, 13 bp, Homo sapiens
ataagcactgtaa

SEQ ID NO: 577790 - DNA, 16 bp, Homo sapiens
ataagctaaagaggct

SEQ ID NO: 577791 - DNA, 15 bp, Homo sapiens
ataataagctaaaga

SEQ ID NO: 577792 - DNA, 14 bp, Homo sapiens
ataatactaaagtg

SEQ ID NO: 577793 - DNA, 19 bp, Homo sapiens
ataatactaaagtgtctat

SEQ ID NO: 577794 - DNA, 14 bp, Homo sapiens
ataatattgtttgg

SEQ ID NO: 577795 - DNA, 15 bp, Homo sapiens
ataatgctaatttta

SEQ ID NO: 577796 - DNA, 14 bp, Homo sapiens
ataatgctacaatt

SEQ ID NO: 577797 - DNA, 15 bp, Homo sapiens
ataatgctacaattt

SEQ ID NO: 577798 - DNA, 20 bp, Homo sapiens
ataatgctacaattttaaga

SEQ ID NO: 577799 - DNA, 15 bp, Homo sapiens
ataattgtacaaaat

SEQ ID NO: 577800 - DNA, 21 bp, Homo sapiens
ataattgtacaaaattaagca

SEQ ID NO: 577801 - DNA, 22 bp, Homo sapiens
atacacatttgctactgttgta

SEQ ID NO: 577802 - DNA, 14 bp, Homo sapiens
atacatggttgtga

SEQ ID NO: 577803 - DNA, 16 bp, Homo sapiens
atacattttttaagct

SEQ ID NO: 577804 - DNA, 12 bp, Homo sapiens
atactccttccc

SEQ ID NO: 577805 - DNA, 13 bp, Homo sapiens
atactttgtattt

SEQ ID NO: 577806 - DNA, 15 bp, Homo sapiens
atagaactctgggct

SEQ ID NO: 577807 - DNA, 15 bp, Homo sapiens
atagataatattgtt

SEQ ID NO: 577808 - DNA, 21 bp, Homo sapiens
ataggaatcattcagaaatgt

SEQ ID NO: 577809 - DNA, 18 bp, Homo sapiens
atagtctaagactatata

SEQ ID NO: 577810 - DNA, 12 bp, Homo sapiens
atataaaattat

SEQ ID NO: 577811 - DNA, 19 bp, Homo sapiens
atataatactaaagtgtct

SEQ ID NO: 577812 - DNA, 15 bp, Homo sapiens
atatataaatgtata

SEQ ID NO: 577813 - DNA, 15 bp, Homo sapiens
atatatataaatgta

SEQ ID NO: 577814 - DNA, 23 bp, Homo sapiens
atatcagtaacccccttaaattt

SEQ ID NO: 577815 - DNA, 13 bp, Homo sapiens
atatcctgagcca

SEQ ID NO: 577816 - DNA, 16 bp, Homo sapiens
atatgacggaagaaca

SEQ ID NO: 577817 - DNA, 19 bp, Homo sapiens
atatgctttattaatgttt

SEQ ID NO: 577818 - DNA, 20 bp, Homo sapiens
atatgtattcttttctcagt

SEQ ID NO: 577819 - DNA, 14 bp, Homo sapiens
atattactgacatt

SEQ ID NO: 577820 - DNA, 16 bp, Homo sapiens
atattactgacatttc

SEQ ID NO: 577821 - DNA, 15 bp, Homo sapiens
atattgattgggaaa

SEQ ID NO: 577822 - DNA, 19 bp, Homo sapiens
atattgattgggaaaacat

SEQ ID NO: 577823 - DNA, 21 bp, Homo sapiens
atattgattgggaaaacattt

SEQ ID NO: 577824 - DNA, 13 bp, Homo sapiens
atattgtgaagta

SEQ ID NO: 577825 - DNA, 14 bp, Homo sapiens
atattgtttggtaa

SEQ ID NO: 577826 - DNA, 21 bp, Homo sapiens
atattgtttggtaaatgtttc

SEQ ID NO: 577827 - DNA, 14 bp, Homo sapiens
atattttatattac

SEQ ID NO: 577828 - DNA, 14 bp, Homo sapiens
atcaaataagaaat

SEQ ID NO: 577829 - DNA, 13 bp, Homo sapiens
atccacagactcc

SEQ ID NO: 577830 - DNA, 20 bp, Homo sapiens
atccacagactccctcccct

SEQ ID NO: 577831 - DNA, 19 bp, Homo sapiens
atccagttataagaagaag

SEQ ID NO: 577832 - DNA, 15 bp, Homo sapiens
atccctctcctaact

SEQ ID NO: 577833 - DNA, 22 bp, Homo sapiens
atcctaagtgggaagtgaagcc

SEQ ID NO: 577834 - DNA, 12 bp, Homo sapiens
atcctgagccat

SEQ ID NO: 577835 - DNA, 24 bp, Homo sapiens
atcctgagccatcggtgaaactaa

SEQ ID NO: 577836 - DNA, 14 bp, Homo sapiens
atcgaaaagttatt

SEQ ID NO: 577837 - DNA, 14 bp, Homo sapiens
atcgtttttgtatt

SEQ ID NO: 577838 - DNA, 14 bp, Homo sapiens
atctacaatctctt

SEQ ID NO: 577839 - DNA, 19 bp, Homo sapiens
atctacaatctctttttgt

SEQ ID NO: 577840 - DNA, 14 bp, Homo sapiens
atctctttagagaa

SEQ ID NO: 577841 - DNA, 15 bp, Homo sapiens
atctctttttgtttg

SEQ ID NO: 577842 - DNA, 17 bp, Homo sapiens
atctgtcccctctcccc

SEQ ID NO: 577843 - DNA, 14 bp, Homo sapiens
atcttcccatgcat

SEQ ID NO: 577844 - DNA, 17 bp, Homo sapiens
atctttcagaaatataa

SEQ ID NO: 577845 - DNA, 12 bp, Homo sapiens
atgaaagaaaat

SEQ ID NO: 577846 - DNA, 16 bp, Homo sapiens
atgaaagctgttcctt

SEQ ID NO: 577847 - DNA, 16 bp, Homo sapiens
atgacggaagaacata

SEQ ID NO: 577848 - DNA, 11 bp, Homo sapiens
atgactaaaga

SEQ ID NO: 577849 - DNA, 13 bp, Homo sapiens
atgactaaagaga

SEQ ID NO: 577850 - DNA, 15 bp, Homo sapiens
caatgataatgctaa

SEQ ID NO: 577851 - DNA, 13 bp, Homo sapiens
caatgcctctccc

SEQ ID NO: 577852 - DNA, 17 bp, Homo sapiens
caatgcctctcccacga

SEQ ID NO: 577853 - DNA, 14 bp, Homo sapiens
caatggctgtaaac

SEQ ID NO: 577854 - DNA, 17 bp, Homo sapiens
cacaccatcaccctctg

SEQ ID NO: 577855 - DNA, 12 bp, Homo sapiens
cacactgtaaat

SEQ ID NO: 577856 - DNA, 23 bp, Homo sapiens
cacagagcaagagataagtcttt

SEQ ID NO: 577857 - DNA, 15 bp, Homo sapiens
cacagcccagcttgg

SEQ ID NO: 577858 - DNA, 18 bp, Homo sapiens
cacatcaaataagaaata

SEQ ID NO: 577859 - DNA, 17 bp, Homo sapiens
caccatcaccctctggg

SEQ ID NO: 577860 - DNA, 19 bp, Homo sapiens
caccatcaccctctgggca

SEQ ID NO: 577861 - DNA, 21 bp, Homo sapiens
cacctcagacaatccactctc

SEQ ID NO: 577862 - DNA, 17 bp, Homo sapiens
caccttggggccttgat

SEQ ID NO: 577863 - DNA, 21 bp, Homo sapiens
cacgatgtcaaggactcctgt

SEQ ID NO: 577864 - DNA, 18 bp, Homo sapiens
cactagggccttggaaat

SEQ ID NO: 577865 - DNA, 21 bp, Homo sapiens
cactccctaagaaaccccagg

SEQ ID NO: 577866 - DNA, 21 bp, Homo sapiens
cactcctgcttaatcttcaaa

SEQ ID NO: 577867 - DNA, 17 bp, Homo sapiens
cacttccaggggaacct

SEQ ID NO: 577868 - DNA, 13 bp, Homo sapiens
cagaaagccttcc

SEQ ID NO: 577869 - DNA, 17 bp, Homo sapiens
cagaaatggaaagcaga

SEQ ID NO: 577870 - DNA, 15 bp, Homo sapiens
cagaagaaaaagttg

SEQ ID NO: 577871 - DNA, 23 bp, Homo sapiens
cagaagccaatctacaatctctt

SEQ ID NO: 577872 - DNA, 15 bp, Homo sapiens
cagacaatccactct

SEQ ID NO: 577873 - DNA, 22 bp, Homo sapiens
cagacaatccactctcaggagg

SEQ ID NO: 577874 - DNA, 17 bp, Homo sapiens
cagactccctcccctgc

SEQ ID NO: 577875 - DNA, 23 bp, Homo sapiens
cagaggtattaaaactaaatttc

SEQ ID NO: 577876 - DNA, 23 bp, Homo sapiens
cagataccttatcttacaatatt

SEQ ID NO: 577877 - DNA, 15 bp, Homo sapiens
cagatctttcagaaa

SEQ ID NO: 577878 - DNA, 17 bp, Homo sapiens
cagatctttcagaaata

SEQ ID NO: 577879 - DNA, 20 bp, Homo sapiens
cagatctttcagaaatataa

SEQ ID NO: 577880 - DNA, 14 bp, Homo sapiens
cagattgaaaagga

SEQ ID NO: 577881 - DNA, 16 bp, Homo sapiens
cagcacttacaatttt

SEQ ID NO: 577882 - DNA, 14 bp, Homo sapiens
cagcataccttgga

SEQ ID NO: 577883 - DNA, 15 bp, Homo sapiens
cagccagttcaaaaa

SEQ ID NO: 577884 - DNA, 16 bp, Homo sapiens
cagcctactctccttg

SEQ ID NO: 577885 - DNA, 16 bp, Homo sapiens
cagcgtggctctaaaa

SEQ ID NO: 577886 - DNA, 23 bp, Homo sapiens
cagctaactccagtctcctgaca

SEQ ID NO: 577887 - DNA, 20 bp, Homo sapiens
cagctgtcatggaaaagccc

SEQ ID NO: 577888 - DNA, 21 bp, Homo sapiens
caggaacctgtcctaaggaac

SEQ ID NO: 577889 - DNA, 15 bp, Homo sapiens
caggacatgcaataa

SEQ ID NO: 577890 - DNA, 14 bp, Homo sapiens
caggaggcgcagcc

SEQ ID NO: 577891 - DNA, 18 bp, Homo sapiens
caggaggcgcagcccgaa

SEQ ID NO: 577892 - DNA, 23 bp, Homo sapiens
caggaggcgcagcccgaagccca

SEQ ID NO: 577893 - DNA, 13 bp, Homo sapiens
caggatttaagtt

SEQ ID NO: 577894 - DNA, 17 bp, Homo sapiens
caggcaccgagaatgtt

SEQ ID NO: 577895 - DNA, 15 bp, Homo sapiens
cagggaaggcctgac

SEQ ID NO: 577896 - DNA, 20 bp, Homo sapiens
cagggagcagggaaggcctg

SEQ ID NO: 577897 - DNA, 21 bp, Homo sapiens
cagggagcagggaaggcctga

SEQ ID NO: 577898 - DNA, 21 bp, Homo sapiens
cagggatttgcctcaccttgg

SEQ ID NO: 577899 - DNA, 14 bp, Homo sapiens
caggggaacctgcc

SEQ ID NO: 577900 - DNA, 18 bp, Homo sapiens
cagggttcaaaatgtctg

SEQ ID NO: 577901 - DNA, 15 bp, Homo sapiens
cagtatgtgggatat

SEQ ID NO: 577902 - DNA, 19 bp, Homo sapiens
cagtatgtgggatattgaa

SEQ ID NO: 577903 - DNA, 18 bp, Homo sapiens
cagtatgtgggggcttca

SEQ ID NO: 577904 - DNA, 23 bp, Homo sapiens
cagtatgtgggggcttcatctct

SEQ ID NO: 577905 - DNA, 20 bp, Homo sapiens
cagtattgccacaatgcctc

SEQ ID NO: 577906 - DNA, 21 bp, Homo sapiens
cagtattgccacaatgcctct

SEQ ID NO: 577907 - DNA, 11 bp, Homo sapiens
cagtctcagaa

SEQ ID NO: 577908 - DNA, 17 bp, Homo sapiens
cagtctcctgacattaa

SEQ ID NO: 577909 - DNA, 23 bp, Homo sapiens
cagtgagggtcttcttacatgca

SEQ ID NO: 577910 - DNA, 22 bp, Homo sapiens
cagtgcctacatcccgggcctc

SEQ ID NO: 577911 - DNA, 15 bp, Homo sapiens
cagtttgttggaaag

SEQ ID NO: 577912 - DNA, 15 bp, Homo sapiens
cataccttggactga

SEQ ID NO: 577913 - DNA, 22 bp, Homo sapiens
cataccttggactgactaccag

SEQ ID NO: 577914 - DNA, 18 bp, Homo sapiens
catacttcatgaaatcct

SEQ ID NO: 577915 - DNA, 22 bp, Homo sapiens
catagataatattgtttggtaa

SEQ ID NO: 577916 - DNA, 24 bp, Homo sapiens
catagataatattgtttggtaaat

SEQ ID NO: 577917 - DNA, 17 bp, Homo sapiens
catcaaacctttgagta

SEQ ID NO: 577918 - DNA, 18 bp, Homo sapiens
catcaaacctttgagtag

SEQ ID NO: 577919 - DNA, 13 bp, Homo sapiens
catcaaataagaa

SEQ ID NO: 577920 - DNA, 17 bp, Homo sapiens
catcaatgataatgcta

SEQ ID NO: 577921 - DNA, 17 bp, Homo sapiens
catcaccctctgggcag

SEQ ID NO: 577922 - DNA, 12 bp, Homo sapiens
catcactgtatc

SEQ ID NO: 577923 - DNA, 12 bp, Homo sapiens
catcccacatga

SEQ ID NO: 577924 - DNA, 23 bp, Homo sapiens
catcccgggcctcagtgccccat

SEQ ID NO: 577925 - DNA, 21 bp, Homo sapiens
catcggtgaaactaacagata

SEQ ID NO: 577926 - DNA, 15 bp, Homo sapiens
catctaattctgatt

SEQ ID NO: 577927 - DNA, 17 bp, Homo sapiens
catctatctagttctaa

SEQ ID NO: 577928 - DNA, 15 bp, Homo sapiens
catgaggaaggaaca

SEQ ID NO: 577929 - DNA, 16 bp, Homo sapiens
catgcaaatgagctct

SEQ ID NO: 577930 - DNA, 20 bp, Homo sapiens
catgcaaatgagctctgaaa

SEQ ID NO: 577931 - DNA, 19 bp, Homo sapiens
catgcatgcaaatgagctc

SEQ ID NO: 577932 - DNA, 14 bp, Homo sapiens
catggaaaagccca

SEQ ID NO: 577933 - DNA, 12 bp, Homo sapiens
catgtaataaaa

SEQ ID NO: 577934 - DNA, 21 bp, Homo sapiens
catgtaataaaaagtatatgt

SEQ ID NO: 577935 - DNA, 14 bp, Homo sapiens
catgtgagctcttc

SEQ ID NO: 577936 - DNA, 15 bp, Homo sapiens
catgtgatacatttt

SEQ ID NO: 577937 - DNA, 16 bp, Homo sapiens
catgtgatacattttt

SEQ ID NO: 577938 - DNA, 22 bp, Homo sapiens
catgtgatacattttttaagct

SEQ ID NO: 577939 - DNA, 18 bp, Homo sapiens
cattaaggggaagaatga

SEQ ID NO: 577940 - DNA, 19 bp, Homo sapiens
cattaaggggaagaatgaa

SEQ ID NO: 577941 - DNA, 14 bp, Homo sapiens
cattatgattcttt

SEQ ID NO: 577942 - DNA, 20 bp, Homo sapiens
cattcagaaatgttgagtct

SEQ ID NO: 577943 - DNA, 23 bp, Homo sapiens
cattcagaaatgttgagtctgta

SEQ ID NO: 577944 - DNA, 23 bp, Homo sapiens
cattcctaacacagcatgtgtat

SEQ ID NO: 577945 - DNA, 21 bp, Homo sapiens
cattctggtcaagggctgtca

SEQ ID NO: 577946 - DNA, 9 bp, Homo sapiens
cattgagta

SEQ ID NO: 577947 - DNA, 14 bp, Homo sapiens
cattgagtattgtt

SEQ ID NO: 577948 - DNA, 22 bp, Homo sapiens
cattgagtattgtttaaaatgt

SEQ ID NO: 577949 - DNA, 16 bp, Homo sapiens
cattgattgtcagcta

SEQ ID NO: 577950 - DNA, 19 bp, Homo sapiens
cattgcacataagcttcca

SEQ ID NO: 577951 - DNA, 14 bp, Homo sapiens
catttccattgctt

SEQ ID NO: 577952 - DNA, 15 bp, Homo sapiens
catttccattgctta

SEQ ID NO: 577953 - DNA, 16 bp, Homo sapiens
catttccattgcttat

SEQ ID NO: 577954 - DNA, 20 bp, Homo sapiens
catttggtcaagattttgaa

SEQ ID NO: 577955 - DNA, 17 bp, Homo sapiens
cattttcttttttaacc

SEQ ID NO: 577956 - DNA, 21 bp, Homo sapiens
cattttttaatttacttgttt

SEQ ID NO: 577957 - DNA, 15 bp, Homo sapiens
ccaaacacactgtaa

SEQ ID NO: 577958 - DNA, 18 bp, Homo sapiens
ccaaacacactgtaaata

SEQ ID NO: 577959 - DNA, 21 bp, Homo sapiens
ccaagtccgcagaagccctga

SEQ ID NO: 577960 - DNA, 20 bp, Homo sapiens
ccaagtggaccttgagacca

SEQ ID NO: 577961 - DNA, 18 bp, Homo sapiens
ccaatgccccactggcag

SEQ ID NO: 577962 - DNA, 19 bp, Homo sapiens
ccacaatgcctctcccacg

SEQ ID NO: 577963 - DNA, 17 bp, Homo sapiens
ccacacttgaaaccttt

SEQ ID NO: 577964 - DNA, 20 bp, Homo sapiens
ccacagactccctcccctgc

SEQ ID NO: 577965 - DNA, 22 bp, Homo sapiens
ccacagggttcaaaatgtctgt

SEQ ID NO: 577966 - DNA, 15 bp, Homo sapiens
atgccagcttcctgt

SEQ ID NO: 577967 - DNA, 11 bp, Homo sapiens
atgcctctccc

SEQ ID NO: 577968 - DNA, 16 bp, Homo sapiens
atgcttcctgacaatc

SEQ ID NO: 577969 - DNA, 20 bp, Homo sapiens
atgcttcctgacaatcaact

SEQ ID NO: 577970 - DNA, 12 bp, Homo sapiens
atggaaaaggaa

SEQ ID NO: 577971 - DNA, 23 bp, Homo sapiens
atggaaagcagagttttcattaa

SEQ ID NO: 577972 - DNA, 15 bp, Homo sapiens
atggctgctgttgct

SEQ ID NO: 577973 - DNA, 17 bp, Homo sapiens
atggctgtaaactataa

SEQ ID NO: 577974 - DNA, 18 bp, Homo sapiens
atggctgtaaactataaa

SEQ ID NO: 577975 - DNA, 20 bp, Homo sapiens
atggctgtaaactataaact

SEQ ID NO: 577976 - DNA, 20 bp, Homo sapiens
atgtaaatagctaagatata

SEQ ID NO: 577977 - DNA, 17 bp, Homo sapiens
atgtaacaacaattatt

SEQ ID NO: 577978 - DNA, 15 bp, Homo sapiens
atgtaattatatata

SEQ ID NO: 577979 - DNA, 14 bp, Homo sapiens
atgtacagattctt

SEQ ID NO: 577980 - DNA, 23 bp, Homo sapiens
atgtagatattgtgaagtacata

SEQ ID NO: 577981 - DNA, 19 bp, Homo sapiens
atgtctgtagctcctcaac

SEQ ID NO: 577982 - DNA, 21 bp, Homo sapiens
atgtgacttggattcaatttt

SEQ ID NO: 577983 - DNA, 19 bp, Homo sapiens
atgtgcatttaattagaaa

SEQ ID NO: 577984 - DNA, 18 bp, Homo sapiens
atgtgctattgaactgag

SEQ ID NO: 577985 - DNA, 14 bp, Homo sapiens
atgtttatgagcca

SEQ ID NO: 577986 - DNA, 16 bp, Homo sapiens
atgtttatgagccaga

SEQ ID NO: 577987 - DNA, 20 bp, Homo sapiens
atgtttatgagccagacaaa

SEQ ID NO: 577988 - DNA, 16 bp, Homo sapiens
atgttttcaaaaggta

SEQ ID NO: 577989 - DNA, 17 bp, Homo sapiens
attaaaactaaatttca

SEQ ID NO: 577990 - DNA, 21 bp, Homo sapiens
attaaataaaatttttatgta

SEQ ID NO: 577991 - DNA, 23 bp, Homo sapiens
attaatattcagggtaaatagga

SEQ ID NO: 577992 - DNA, 15 bp, Homo sapiens
attaatgttttcaaa

SEQ ID NO: 577993 - DNA, 15 bp, Homo sapiens
attactgacatttct

SEQ ID NO: 577994 - DNA, 21 bp, Homo sapiens
attactgacatttcttctagt

SEQ ID NO: 577995 - DNA, 15 bp, Homo sapiens
attaggaaaatatgg

SEQ ID NO: 577996 - DNA, 15 bp, Homo sapiens
attagttttctttgt

SEQ ID NO: 577997 - DNA, 20 bp, Homo sapiens
attagttttctttgtaaagg

SEQ ID NO: 577998 - DNA, 16 bp, Homo sapiens
attcagtgagggtctt

SEQ ID NO: 577999 - DNA, 19 bp, Homo sapiens
attccagatctttcagaaa

SEQ ID NO: 578000 - DNA, 21 bp, Homo sapiens
attccagatctttcagaaata

SEQ ID NO: 578001 - DNA, 20 bp, Homo sapiens
attcctaacacagcatgtgt

SEQ ID NO: 578002 - DNA, 14 bp, Homo sapiens
attctataaaactc

SEQ ID NO: 578003 - DNA, 15 bp, Homo sapiens
attctataaaactct

SEQ ID NO: 578004 - DNA, 22 bp, Homo sapiens
attctgattctggctttaagcc

SEQ ID NO: 578005 - DNA, 15 bp, Homo sapiens
attctttcagttctt

SEQ ID NO: 578006 - DNA, 21 bp, Homo sapiens
attctttccattatgattctt

SEQ ID NO: 578007 - DNA, 22 bp, Homo sapiens
attctttccattatgattcttt

SEQ ID NO: 578008 - DNA, 14 bp, Homo sapiens
attgaactgagcca

SEQ ID NO: 578009 - DNA, 22 bp, Homo sapiens
attgaccattttttaatttact

SEQ ID NO: 578010 - DNA, 15 bp, Homo sapiens
attgacttttataaa

SEQ ID NO: 578011 - DNA, 20 bp, Homo sapiens
attgagtattgtttaaaatg

SEQ ID NO: 578012 - DNA, 14 bp, Homo sapiens
attgattgggaaaa

SEQ ID NO: 578013 - DNA, 21 bp, Homo sapiens
attgattgggaaaacatttgc

SEQ ID NO: 578014 - DNA, 22 bp, Homo sapiens
attgattgggaaaacatttgct

SEQ ID NO: 578015 - DNA, 14 bp, Homo sapiens
attgatttgattgg

SEQ ID NO: 578016 - DNA, 21 bp, Homo sapiens
attgcatactttgtattttga

SEQ ID NO: 578017 - DNA, 16 bp, Homo sapiens
attgcatcactgtatc

SEQ ID NO: 578018 - DNA, 19 bp, Homo sapiens
attgcatcactgtatcatt

SEQ ID NO: 578019 - DNA, 18 bp, Homo sapiens
attgcctctgaaaagtgt

SEQ ID NO: 578020 - DNA, 14 bp, Homo sapiens
attgtgaagtacat

SEQ ID NO: 578021 - DNA, 15 bp, Homo sapiens
attgtgaagtacata

SEQ ID NO: 578022 - DNA, 15 bp, Homo sapiens
attgtttaaaatgta

SEQ ID NO: 578023 - DNA, 17 bp, Homo sapiens
attgtttggtaaatgtt

SEQ ID NO: 578024 - DNA, 22 bp, Homo sapiens
atttaaaaaataaataaaaact

SEQ ID NO: 578025 - DNA, 13 bp, Homo sapiens
atttaaatgaaag

SEQ ID NO: 578026 - DNA, 20 bp, Homo sapiens
atttaatccagttataagaa

SEQ ID NO: 578027 - DNA, 15 bp, Homo sapiens
atttacttgttttgg

SEQ ID NO: 578028 - DNA, 22 bp, Homo sapiens
atttaggcagattgaaaaggac

SEQ ID NO: 578029 - DNA, 20 bp, Homo sapiens
atttatgtagatgtgcattt

SEQ ID NO: 578030 - DNA, 21 bp, Homo sapiens
atttatgtagatgtgcatttt

SEQ ID NO: 578031 - DNA, 18 bp, Homo sapiens
atttcactactagattga

SEQ ID NO: 578032 - DNA, 18 bp, Homo sapiens
atttcccctctgtgtcct

SEQ ID NO: 578033 - DNA, 22 bp, Homo sapiens
atttcccctctgtgtcctctcc

SEQ ID NO: 578034 - DNA, 15 bp, Homo sapiens
atttctcattgactt

SEQ ID NO: 578035 - DNA, 21 bp, Homo sapiens
atttcttttaaagaagtaaat

SEQ ID NO: 578036 - DNA, 15 bp, Homo sapiens
atttgaaaaatataa

SEQ ID NO: 578037 - DNA, 20 bp, Homo sapiens
atttgaaaaatataaaatta

SEQ ID NO: 578038 - DNA, 16 bp, Homo sapiens
atttgagcatatcagt

SEQ ID NO: 578039 - DNA, 22 bp, Homo sapiens
atttgaggtcaagtaagaagac

SEQ ID NO: 578040 - DNA, 14 bp, Homo sapiens
atttgcctcacctt

SEQ ID NO: 578041 - DNA, 20 bp, Homo sapiens
atttgcctcaccttggggcc

SEQ ID NO: 578042 - DNA, 21 bp, Homo sapiens
atttgcctcaccttggggcct

SEQ ID NO: 578043 - DNA, 16 bp, Homo sapiens
atttgctactgttgta

SEQ ID NO: 578044 - DNA, 23 bp, Homo sapiens
atttggtcaagattttgaatgct

SEQ ID NO: 578045 - DNA, 21 bp, Homo sapiens
atttgtccaatggctgtaaac

SEQ ID NO: 578046 - DNA, 22 bp, Homo sapiens
attttatattactgacatttct

SEQ ID NO: 578047 - DNA, 15 bp, Homo sapiens
atttttaaattaaat

SEQ ID NO: 578048 - DNA, 22 bp, Homo sapiens
atttttatgtaattatatatac

SEQ ID NO: 578049 - DNA, 23 bp, Homo sapiens
atttttttgcatgcatgcaaatg

SEQ ID NO: 578050 - DNA, 17 bp, Homo sapiens
caaaagtgatctgtccc

SEQ ID NO: 578051 - DNA, 21 bp, Homo sapiens
caaaagtgatctgtcccctct

SEQ ID NO: 578052 - DNA, 21 bp, Homo sapiens
caaaatttcaaaagtgatctg

SEQ ID NO: 578053 - DNA, 14 bp, Homo sapiens
caaacacactgtaa

SEQ ID NO: 578054 - DNA, 15 bp, Homo sapiens
caaacacactgtaaa

SEQ ID NO: 578055 - DNA, 17 bp, Homo sapiens
caaacacactgtaaata

SEQ ID NO: 578056 - DNA, 20 bp, Homo sapiens
caaactgatgcgaaaacttg

SEQ ID NO: 578057 - DNA, 16 bp, Homo sapiens
caaagccttctcccta

SEQ ID NO: 578058 - DNA, 13 bp, Homo sapiens
caaatacacattt

SEQ ID NO: 578059 - DNA, 16 bp, Homo sapiens
caaatacacatttgct

SEQ ID NO: 578060 - DNA, 13 bp, Homo sapiens
caacaaggaccct

SEQ ID NO: 578061 - DNA, 13 bp, Homo sapiens
ccacgatgtcaag

SEQ ID NO: 578062 - DNA, 14 bp, Homo sapiens
ccactctcaggagg

SEQ ID NO: 578063 - DNA, 19 bp, Homo sapiens
ccacttccaggggaacctg

SEQ ID NO: 578064 - DNA, 13 bp, Homo sapiens
ccactttgtccat

SEQ ID NO: 578065 - DNA, 22 bp, Homo sapiens
ccagaaccacacttgaaacctt

SEQ ID NO: 578066 - DNA, 22 bp, Homo sapiens
ccagatggctggaaggggtcca

SEQ ID NO: 578067 - DNA, 22 bp, Homo sapiens
ccagcctcgttggaagaggaac

SEQ ID NO: 578068 - DNA, 21 bp, Homo sapiens
ccagcttcctgtgggccagga

SEQ ID NO: 578069 - DNA, 20 bp, Homo sapiens
ccaggacatgcaataaaatt

SEQ ID NO: 578070 - DNA, 18 bp, Homo sapiens
ccaggctttgtacagagt

SEQ ID NO: 578071 - DNA, 12 bp, Homo sapiens
ccaggggaacct

SEQ ID NO: 578072 - DNA, 15 bp, Homo sapiens
ccagtctcctgacat

SEQ ID NO: 578073 - DNA, 12 bp, Homo sapiens
ccagttcaaaaa

SEQ ID NO: 578074 - DNA, 15 bp, Homo sapiens
ccattaaggggaaga

SEQ ID NO: 578075 - DNA, 17 bp, Homo sapiens
ccattgcttattatgta

SEQ ID NO: 578076 - DNA, 15 bp, Homo sapiens
ccatttccattgctt

SEQ ID NO: 578077 - DNA, 22 bp, Homo sapiens
cccaatgagactctagggtcca

SEQ ID NO: 578078 - DNA, 15 bp, Homo sapiens
cccagtttcccttct

SEQ ID NO: 578079 - DNA, 22 bp, Homo sapiens
ccccagggcagggaaactggct

SEQ ID NO: 578080 - DNA, 19 bp, Homo sapiens
cccctctcccctcatggag

SEQ ID NO: 578081 - DNA, 13 bp, Homo sapiens
cccctctgccctg

SEQ ID NO: 578082 - DNA, 16 bp, Homo sapiens
cccgcgggcctggaca

SEQ ID NO: 578083 - DNA, 18 bp, Homo sapiens
ccctcatggagaaacatc

SEQ ID NO: 578084 - DNA, 20 bp, Homo sapiens
ccctcatggagaaacatcct

SEQ ID NO: 578085 - DNA, 16 bp, Homo sapiens
ccctctgccctgtata

SEQ ID NO: 578086 - DNA, 15 bp, Homo sapiens
ccctctgggcagctg

SEQ ID NO: 578087 - DNA, 16 bp, Homo sapiens
ccctgcttacctgacg

SEQ ID NO: 578088 - DNA, 12 bp, Homo sapiens
ccctggaggggc

SEQ ID NO: 578089 - DNA, 14 bp, Homo sapiens
ccctgttttccaca

SEQ ID NO: 578090 - DNA, 23 bp, Homo sapiens
cccttctatgcagtattgccaca

SEQ ID NO: 578091 - DNA, 22 bp, Homo sapiens
ccgaagaggaagcaagaaagcc

SEQ ID NO: 578092 - DNA, 11 bp, Homo sapiens
ccgaagcccag

SEQ ID NO: 578093 - DNA, 15 bp, Homo sapiens
ccggcacctgcgaga

SEQ ID NO: 578094 - DNA, 14 bp, Homo sapiens
ccgggcctcagtgc

SEQ ID NO: 578095 - DNA, 19 bp, Homo sapiens
cctaaaataacagtatgtg

SEQ ID NO: 578096 - DNA, 23 bp, Homo sapiens
cctaaaataacagtatgtgggat

SEQ ID NO: 578097 - DNA, 22 bp, Homo sapiens
cctaagtgggaagtgaagcccc

SEQ ID NO: 578098 - DNA, 20 bp, Homo sapiens
cctacatcccgggcctcagt

SEQ ID NO: 578099 - DNA, 12 bp, Homo sapiens
cctactaataaa

SEQ ID NO: 578100 - DNA, 13 bp, Homo sapiens
cctagtactgccc

SEQ ID NO: 578101 - DNA, 15 bp, Homo sapiens
cctcagacaatccac

SEQ ID NO: 578102 - DNA, 19 bp, Homo sapiens
cctcagggagcagggaagg

SEQ ID NO: 578103 - DNA, 20 bp, Homo sapiens
cctcagggagcagggaaggc

SEQ ID NO: 578104 - DNA, 22 bp, Homo sapiens
cctcagggagcagggaaggcct

SEQ ID NO: 578105 - DNA, 21 bp, Homo sapiens
cctcagtatgtgggggcttca

SEQ ID NO: 578106 - DNA, 20 bp, Homo sapiens
cctcccctgcccccatccca

SEQ ID NO: 578107 - DNA, 21 bp, Homo sapiens
cctcctcagtatgtgggggct

SEQ ID NO: 578108 - DNA, 20 bp, Homo sapiens
cctcgttggaagaggaacag

SEQ ID NO: 578109 - DNA, 22 bp, Homo sapiens
cctctcccgcgggcctggacac

SEQ ID NO: 578110 - DNA, 22 bp, Homo sapiens
cctctgggcagctgtcatggaa

SEQ ID NO: 578111 - DNA, 19 bp, Homo sapiens
cctctgtgtcctctcccct

SEQ ID NO: 578112 - DNA, 21 bp, Homo sapiens
cctgacattaagacacacctc

SEQ ID NO: 578113 - DNA, 23 bp, Homo sapiens
cctgacattaagacacacctctg

SEQ ID NO: 578114 - DNA, 14 bp, Homo sapiens
cctgaccggcacct

SEQ ID NO: 578115 - DNA, 15 bp, Homo sapiens
cctgaccggcacctg

SEQ ID NO: 578116 - DNA, 16 bp, Homo sapiens
cctgctggcacctcag

SEQ ID NO: 578117 - DNA, 22 bp, Homo sapiens
cctgcttaatcttcaaagcctt

SEQ ID NO: 578118 - DNA, 18 bp, Homo sapiens
cctggaggggctgaatgt

SEQ ID NO: 578119 - DNA, 22 bp, Homo sapiens
cctgggttgctgctgtccagtg

SEQ ID NO: 578120 - DNA, 17 bp, Homo sapiens
cctgtatataatactaa

SEQ ID NO: 578121 - DNA, 20 bp, Homo sapiens
cctgtatataatactaaagt

SEQ ID NO: 578122 - DNA, 14 bp, Homo sapiens
cctgtgggccagga

SEQ ID NO: 578123 - DNA, 21 bp, Homo sapiens
cctgtgggccaggagctcagc

SEQ ID NO: 578124 - DNA, 14 bp, Homo sapiens
cctgttttccacac

SEQ ID NO: 578125 - DNA, 17 bp, Homo sapiens
ccttatagtctaagact

SEQ ID NO: 578126 - DNA, 20 bp, Homo sapiens
ccttccagggatttgcctca

SEQ ID NO: 578127 - DNA, 23 bp, Homo sapiens
ccttccagggatttgcctcacct

SEQ ID NO: 578128 - DNA, 15 bp, Homo sapiens
ccttctatgcagtat

SEQ ID NO: 578129 - DNA, 18 bp, Homo sapiens
ccttgaaactttgggaaa

SEQ ID NO: 578130 - DNA, 14 bp, Homo sapiens
ccttgcctcctcag

SEQ ID NO: 578131 - DNA, 15 bp, Homo sapiens
ccttgcctcctcagt

SEQ ID NO: 578132 - DNA, 21 bp, Homo sapiens
ccttggggccttgatgactgc

SEQ ID NO: 578133 - DNA, 16 bp, Homo sapiens
cgaaaccaaagaagaa

SEQ ID NO: 578134 - DNA, 15 bp, Homo sapiens
cgaagagttcccttg

SEQ ID NO: 578135 - DNA, 14 bp, Homo sapiens
cgaccacttccagg

SEQ ID NO: 578136 - DNA, 15 bp, Homo sapiens
cgagaggtccctgct

SEQ ID NO: 578137 - DNA, 16 bp, Homo sapiens
cgcagcccgaagccca

SEQ ID NO: 578138 - DNA, 15 bp, Homo sapiens
cggacgtcctgctgg

SEQ ID NO: 578139 - DNA, 18 bp, Homo sapiens
cgggcctcagtgccccat

SEQ ID NO: 578140 - DNA, 12 bp, Homo sapiens
cgtcctgctggc

SEQ ID NO: 578141 - DNA, 15 bp, Homo sapiens
cgtttttgtattttc

SEQ ID NO: 578142 - DNA, 15 bp, Homo sapiens
ctaaacatgtatgta

SEQ ID NO: 578143 - DNA, 22 bp, Homo sapiens
ctaaatgcatatcctgagccat

SEQ ID NO: 578144 - DNA, 12 bp, Homo sapiens
tatcatgtatgg

SEQ ID NO: 578145 - DNA, 18 bp, Homo sapiens
tatctagttctaacagtg

SEQ ID NO: 578146 - DNA, 14 bp, Homo sapiens
tatcttacaatatt

SEQ ID NO: 578147 - DNA, 20 bp, Homo sapiens
tatgacggaagaacatagaa

SEQ ID NO: 578148 - DNA, 14 bp, Homo sapiens
tatgactaaagaga

SEQ ID NO: 578149 - DNA, 17 bp, Homo sapiens
tatgactaaagagagaa

SEQ ID NO: 578150 - DNA, 18 bp, Homo sapiens
tatgactaaagagagaat

SEQ ID NO: 578151 - DNA, 21 bp, Homo sapiens
tatgagattggttttcctgtg

SEQ ID NO: 578152 - DNA, 12 bp, Homo sapiens
tatgtagatgtg

SEQ ID NO: 578153 - DNA, 14 bp, Homo sapiens
tatgtattcttttc

SEQ ID NO: 578154 - DNA, 18 bp, Homo sapiens
tatgtgggatattgaatg

SEQ ID NO: 578155 - DNA, 13 bp, Homo sapiens
tatgttaaagaga

SEQ ID NO: 578156 - DNA, 17 bp, Homo sapiens
tattaaaactaaatttc

SEQ ID NO: 578157 - DNA, 17 bp, Homo sapiens
tattactgacatttctt

SEQ ID NO: 578158 - DNA, 18 bp, Homo sapiens
tattatgtaggtaagact

SEQ ID NO: 578159 - DNA, 16 bp, Homo sapiens
tattcagggtaaatag

SEQ ID NO: 578160 - DNA, 19 bp, Homo sapiens
tattctataaaactctgca

SEQ ID NO: 578161 - DNA, 14 bp, Homo sapiens
tattgaatgttaaa

SEQ ID NO: 578162 - DNA, 14 bp, Homo sapiens
tattgaccattttt

SEQ ID NO: 578163 - DNA, 15 bp, Homo sapiens
tattgtttggtaaat

SEQ ID NO: 578164 - DNA, 17 bp, Homo sapiens
tattgtttggtaaatgt

SEQ ID NO: 578165 - DNA, 18 bp, Homo sapiens
tatttaacaaaatttgaa

SEQ ID NO: 578166 - DNA, 15 bp, Homo sapiens
tattttgtgtgaaat

SEQ ID NO: 578167 - DNA, 20 bp, Homo sapiens
tatttttataattgtacaaa

SEQ ID NO: 578168 - DNA, 16 bp, Homo sapiens
tattttttttttcttc

SEQ ID NO: 578169 - DNA, 17 bp, Homo sapiens
tattttttttttcttct

SEQ ID NO: 578170 - DNA, 19 bp, Homo sapiens
tattttttttttcttcttg

SEQ ID NO: 578171 - DNA, 21 bp, Homo sapiens
tattttttttttcttcttggg

SEQ ID NO: 578172 - DNA, 20 bp, Homo sapiens
tcaaaaggtattatacatgt

SEQ ID NO: 578173 - DNA, 22 bp, Homo sapiens
tcaaaagtgatctgtcccctct

SEQ ID NO: 578174 - DNA, 12 bp, Homo sapiens
tcaaataagaaa

SEQ ID NO: 578175 - DNA, 16 bp, Homo sapiens
tcaaatacacatttgc

SEQ ID NO: 578176 - DNA, 16 bp, Homo sapiens
tcaactttgtaaaaat

SEQ ID NO: 578177 - DNA, 23 bp, Homo sapiens
tcaagtaagaagacatgaaccaa

SEQ ID NO: 578178 - DNA, 17 bp, Homo sapiens
tcaatgaaccataaatt

SEQ ID NO: 578179 - DNA, 23 bp, Homo sapiens
tcaccctctgggcagctgtcatg

SEQ ID NO: 578180 - DNA, 13 bp, Homo sapiens
tcagaaatataac

SEQ ID NO: 578181 - DNA, 23 bp, Homo sapiens
tcagacaatccactctcaggagg

SEQ ID NO: 578182 - DNA, 10 bp, Homo sapiens
tcagccgtgc

SEQ ID NO: 578183 - DNA, 15 bp, Homo sapiens
tcagctactaatgat

SEQ ID NO: 578184 - DNA, 20 bp, Homo sapiens
tcagctactaatgatgtttt

SEQ ID NO: 578185 - DNA, 16 bp, Homo sapiens
tcaggaggcgcagccc

SEQ ID NO: 578186 - DNA, 19 bp, Homo sapiens
tcaggaggcgcagcccgaa

SEQ ID NO: 578187 - DNA, 17 bp, Homo sapiens
tcagggtaaataggaat

SEQ ID NO: 578188 - DNA, 21 bp, Homo sapiens
tcagtaacccccttaaattta

SEQ ID NO: 578189 - DNA, 23 bp, Homo sapiens
tcagtaacccccttaaatttaat

SEQ ID NO: 578190 - DNA, 21 bp, Homo sapiens
tcagtatgtgggggcttcatc

SEQ ID NO: 578191 - DNA, 23 bp, Homo sapiens
tcagtatgtgggggcttcatctc

SEQ ID NO: 578192 - DNA, 22 bp, Homo sapiens
tcagtgccccattctcactgct

SEQ ID NO: 578193 - DNA, 13 bp, Homo sapiens
tcagttgcttgtc

SEQ ID NO: 578194 - DNA, 15 bp, Homo sapiens
tcagttgcttgtctt

SEQ ID NO: 578195 - DNA, 15 bp, Homo sapiens
tcatctctttagaga

SEQ ID NO: 578196 - DNA, 14 bp, Homo sapiens
tcatgaaaatacca

SEQ ID NO: 578197 - DNA, 16 bp, Homo sapiens
tcatgaaaataccatt

SEQ ID NO: 578198 - DNA, 16 bp, Homo sapiens
tcatggaaaagcccag

SEQ ID NO: 578199 - DNA, 17 bp, Homo sapiens
tcattcctaacacagca

SEQ ID NO: 578200 - DNA, 18 bp, Homo sapiens
tcattcctaacacagcat

SEQ ID NO: 578201 - DNA, 14 bp, Homo sapiens
tcattgacttttat

SEQ ID NO: 578202 - DNA, 20 bp, Homo sapiens
tccaatggctgtaaactata

SEQ ID NO: 578203 - DNA, 15 bp, Homo sapiens
tccactctcaggagg

SEQ ID NO: 578204 - DNA, 19 bp, Homo sapiens
tccagaaccacacttgaaa

SEQ ID NO: 578205 - DNA, 17 bp, Homo sapiens
tccagatctttcagaaa

SEQ ID NO: 578206 - DNA, 15 bp, Homo sapiens
tccagtctcctgaca

SEQ ID NO: 578207 - DNA, 14 bp, Homo sapiens
tccagtgcaattgt

SEQ ID NO: 578208 - DNA, 15 bp, Homo sapiens
tccagttataagaag

SEQ ID NO: 578209 - DNA, 19 bp, Homo sapiens
tccatttccattgcttatt

SEQ ID NO: 578210 - DNA, 22 bp, Homo sapiens
tcccctcatggagaaacatcct

SEQ ID NO: 578211 - DNA, 13 bp, Homo sapiens
tcccctctgccct

SEQ ID NO: 578212 - DNA, 21 bp, Homo sapiens
tcccctctgtgtcctctcccc

SEQ ID NO: 578213 - DNA, 18 bp, Homo sapiens
tcccctgcccccatccca

SEQ ID NO: 578214 - DNA, 18 bp, Homo sapiens
tccccttcctcttgtctg

SEQ ID NO: 578215 - DNA, 19 bp, Homo sapiens
tccctaagaaaccccaggg

SEQ ID NO: 578216 - DNA, 13 bp, Homo sapiens
tccctcccctgcc

SEQ ID NO: 578217 - DNA, 20 bp, Homo sapiens
tcccttaaggggtatcatgt

SEQ ID NO: 578218 - DNA, 20 bp, Homo sapiens
tcccttgaaactttgggaaa

SEQ ID NO: 578219 - DNA, 19 bp, Homo sapiens
tccgaaaccaaagaagaaa

SEQ ID NO: 578220 - DNA, 16 bp, Homo sapiens
tcctactaataaacca

SEQ ID NO: 578221 - DNA, 13 bp, Homo sapiens
tcctagtaagaag

SEQ ID NO: 578222 - DNA, 20 bp, Homo sapiens
tcctataatataataaatat

SEQ ID NO: 578223 - DNA, 18 bp, Homo sapiens
tcctcagtatgtgggggc

SEQ ID NO: 578224 - DNA, 22 bp, Homo sapiens
tcctcagtatgtgggggcttca

SEQ ID NO: 578225 - DNA, 19 bp, Homo sapiens
tcctcatggcagcctactc

SEQ ID NO: 578226 - DNA, 22 bp, Homo sapiens
tcctcatggcagcctactctcc

SEQ ID NO: 578227 - DNA, 20 bp, Homo sapiens
tcctctcccctctgccctgt

SEQ ID NO: 578228 - DNA, 14 bp, Homo sapiens
tcctgacattaaga

SEQ ID NO: 578229 - DNA, 22 bp, Homo sapiens
tcctgacattaagacacacctc

SEQ ID NO: 578230 - DNA, 20 bp, Homo sapiens
tcctggaggtgggagacaag

SEQ ID NO: 578231 - DNA, 23 bp, Homo sapiens
tcctgggttttcttaaccatctt

SEQ ID NO: 578232 - DNA, 16 bp, Homo sapiens
tcctgtggcataaatt

SEQ ID NO: 578233 - DNA, 19 bp, Homo sapiens
tcctgtggcataaattgca

SEQ ID NO: 578234 - DNA, 16 bp, Homo sapiens
tcctgtgggccaggag

SEQ ID NO: 578235 - DNA, 17 bp, Homo sapiens
tccttaagctgcagaga

SEQ ID NO: 578236 - DNA, 19 bp, Homo sapiens
tccttggtcctagtaagaa

SEQ ID NO: 578237 - DNA, 12 bp, Homo sapiens
tcgaacaaactg

SEQ ID NO: 578238 - DNA, 22 bp, Homo sapiens
tcgtgcgcaacaacaaggaccc

SEQ ID NO: 578239 - DNA, 11 bp, Homo sapiens
tcgtttttgta

SEQ ID NO: 578240 - DNA, 16 bp, Homo sapiens
tctaagactatatata

SEQ ID NO: 578241 - DNA, 13 bp, Homo sapiens
tctaatagtgctt

SEQ ID NO: 578242 - DNA, 12 bp, Homo sapiens
tctagtgatgat

SEQ ID NO: 578243 - DNA, 20 bp, Homo sapiens
tctatgcagtattgccacaa

SEQ ID NO: 578244 - DNA, 19 bp, Homo sapiens
tctcaatgaaccataaatt

SEQ ID NO: 578245 - DNA, 19 bp, Homo sapiens
tctcaggaggcgcagcccg

SEQ ID NO: 578246 - DNA, 16 bp, Homo sapiens
tctcccctctgccctg

SEQ ID NO: 578247 - DNA, 15 bp, Homo sapiens
tctcccgcgggcctg

SEQ ID NO: 578248 - DNA, 20 bp, Homo sapiens
tctccctagctcctcccctt

SEQ ID NO: 578249 - DNA, 20 bp, Homo sapiens
tctccttaagctgcagagat

SEQ ID NO: 578250 - DNA, 22 bp, Homo sapiens
tctccttaagctgcagagattt

SEQ ID NO: 578251 - DNA, 16 bp, Homo sapiens
tctccttgagtgtatg

SEQ ID NO: 578252 - DNA, 17 bp, Homo sapiens
tctctaaggtttacaat

SEQ ID NO: 578253 - DNA, 15 bp, Homo sapiens
tctgaaaagtgtgta

SEQ ID NO: 578254 - DNA, 22 bp, Homo sapiens
tctgaaatcttcccatgcattc

SEQ ID NO: 578255 - DNA, 14 bp, Homo sapiens
tctgaggccctgcc

SEQ ID NO: 578256 - DNA, 15 bp, Homo sapiens
tctgattctggcttt

SEQ ID NO: 578257 - DNA, 19 bp, Homo sapiens
tctgattctggctttaagc

SEQ ID NO: 578258 - DNA, 22 bp, Homo sapiens
tctgattgatttgattgggatg

SEQ ID NO: 578259 - DNA, 23 bp, Homo sapiens
tctgctggcatcaagaggtggga

SEQ ID NO: 578260 - DNA, 18 bp, Homo sapiens
gtggtgatttgaaaaata

SEQ ID NO: 578261 - DNA, 21 bp, Homo sapiens
gtggtgatttgaaaaatataa

SEQ ID NO: 578262 - DNA, 15 bp, Homo sapiens
gtgtatgactaaaga

SEQ ID NO: 578263 - DNA, 19 bp, Homo sapiens
gtgtatttccagtgcaatt

SEQ ID NO: 578264 - DNA, 23 bp, Homo sapiens
gtgtggattgcctctgaaaagtg

SEQ ID NO: 578265 - DNA, 21 bp, Homo sapiens
gttaagtatcagctacaattg

SEQ ID NO: 578266 - DNA, 23 bp, Homo sapiens
gttactgaaatgaggagagaagg

SEQ ID NO: 578267 - DNA, 14 bp, Homo sapiens
gttcaaaatgtctg

SEQ ID NO: 578268 - DNA, 18 bp, Homo sapiens
gttcaagccttccaggga

SEQ ID NO: 578269 - DNA, 20 bp, Homo sapiens
gttccgaaaccaaagaagaa

SEQ ID NO: 578270 - DNA, 15 bp, Homo sapiens
gttggaagaggaaca

SEQ ID NO: 578271 - DNA, 23 bp, Homo sapiens
gttgggaatgaggaaaattctta

SEQ ID NO: 578272 - DNA, 15 bp, Homo sapiens
gttgtacttaaatgg

SEQ ID NO: 578273 - DNA, 16 bp, Homo sapiens
gtttagcagatttaag

SEQ ID NO: 578274 - DNA, 14 bp, Homo sapiens
gtttataaacagaa

SEQ ID NO: 578275 - DNA, 13 bp, Homo sapiens
gttttactgtcta

SEQ ID NO: 578276 - DNA, 16 bp, Homo sapiens
gttttctttgtaaagg

SEQ ID NO: 578277 - DNA, 15 bp, Homo sapiens
gtttttgtttggaga

SEQ ID NO: 578278 - DNA, 16 bp, Homo sapiens
taaaaagtatatgtta

SEQ ID NO: 578279 - DNA, 17 bp, Homo sapiens
taaaaatcattgattgt

SEQ ID NO: 578280 - DNA, 17 bp, Homo sapiens
taaaactaaatttcact

SEQ ID NO: 578281 - DNA, 22 bp, Homo sapiens
taaaaggcccatagcagccagt

SEQ ID NO: 578282 - DNA, 17 bp, Homo sapiens
taaaagttttatatgct

SEQ ID NO: 578283 - DNA, 16 bp, Homo sapiens
taaaatgtaatttaaa

SEQ ID NO: 578284 - DNA, 21 bp, Homo sapiens
taaaatgtaatttaaatgaaa

SEQ ID NO: 578285 - DNA, 22 bp, Homo sapiens
taaaatttttatgtaattatat

SEQ ID NO: 578286 - DNA, 14 bp, Homo sapiens
taaacatgtatgta

SEQ ID NO: 578287 - DNA, 16 bp, Homo sapiens
taaactactgtaatta

SEQ ID NO: 578288 - DNA, 17 bp, Homo sapiens
taaactataaactactg

SEQ ID NO: 578289 - DNA, 17 bp, Homo sapiens
taaagaagtaaatttgt

SEQ ID NO: 578290 - DNA, 18 bp, Homo sapiens
taaagaagtaaatttgtc

SEQ ID NO: 578291 - DNA, 20 bp, Homo sapiens
taaagaggctgaaagaggcc

SEQ ID NO: 578292 - DNA, 14 bp, Homo sapiens
taaataaaaactaa

SEQ ID NO: 578293 - DNA, 21 bp, Homo sapiens
taaataggaatcattcagaaa

SEQ ID NO: 578294 - DNA, 22 bp, Homo sapiens
taaatatccacagactccctcc

SEQ ID NO: 578295 - DNA, 17 bp, Homo sapiens
taaatatttatgtagat

SEQ ID NO: 578296 - DNA, 10 bp, Homo sapiens
taaatgcata

SEQ ID NO: 578297 - DNA, 21 bp, Homo sapiens
taaatgcatatcctgagccat

SEQ ID NO: 578298 - DNA, 15 bp, Homo sapiens
taaatgtataaatat

SEQ ID NO: 578299 - DNA, 18 bp, Homo sapiens
taaattcaactttgtaaa

SEQ ID NO: 578300 - DNA, 14 bp, Homo sapiens
taaatttaatacca

SEQ ID NO: 578301 - DNA, 15 bp, Homo sapiens
taaatttgtccaatg

SEQ ID NO: 578302 - DNA, 14 bp, Homo sapiens
taacaacaattatt

SEQ ID NO: 578303 - DNA, 15 bp, Homo sapiens
taacaacaattattt

SEQ ID NO: 578304 - DNA, 20 bp, Homo sapiens
taacacatttttttgcatgc

SEQ ID NO: 578305 - DNA, 19 bp, Homo sapiens
taacatcgaaaagttattt

SEQ ID NO: 578306 - DNA, 17 bp, Homo sapiens
taacatgccagcttcct

SEQ ID NO: 578307 - DNA, 15 bp, Homo sapiens
taactcaaatacaca

SEQ ID NO: 578308 - DNA, 21 bp, Homo sapiens
taactcaaatacacatttgct

SEQ ID NO: 578309 - DNA, 14 bp, Homo sapiens
taagaagacatgaa

SEQ ID NO: 578310 - DNA, 18 bp, Homo sapiens
taagaattctgattgatt

SEQ ID NO: 578311 - DNA, 20 bp, Homo sapiens
taagaattctgattgatttg

SEQ ID NO: 578312 - DNA, 18 bp, Homo sapiens
taagactatatatataaa

SEQ ID NO: 578313 - DNA, 16 bp, Homo sapiens
taataagcactgtaaa

SEQ ID NO: 578314 - DNA, 18 bp, Homo sapiens
taataagctaaagaggct

SEQ ID NO: 578315 - DNA, 20 bp, Homo sapiens
taatattgtttggtaaatgt

SEQ ID NO: 578316 - DNA, 16 bp, Homo sapiens
taatgtttatgagcca

SEQ ID NO: 578317 - DNA, 22 bp, Homo sapiens
taatgtttatgagccagacaaa

SEQ ID NO: 578318 - DNA, 15 bp, Homo sapiens
taattgtacaaaatt

SEQ ID NO: 578319 - DNA, 13 bp, Homo sapiens
taatttaaatgaa

SEQ ID NO: 578320 - DNA, 16 bp, Homo sapiens
taatttaaatgaaaga

SEQ ID NO: 578321 - DNA, 14 bp, Homo sapiens
tacaatattgattg

SEQ ID NO: 578322 - DNA, 17 bp, Homo sapiens
tacaatctctttttgtt

SEQ ID NO: 578323 - DNA, 17 bp, Homo sapiens
tacacatttgctactgt

SEQ ID NO: 578324 - DNA, 21 bp, Homo sapiens
tacacatttgctactgttgta

SEQ ID NO: 578325 - DNA, 19 bp, Homo sapiens
tacaggcaccgagaatgtt

SEQ ID NO: 578326 - DNA, 18 bp, Homo sapiens
tacatattaggaaaatat

SEQ ID NO: 578327 - DNA, 20 bp, Homo sapiens
tacatcaatgataatgctaa

SEQ ID NO: 578328 - DNA, 15 bp, Homo sapiens
tacatgtgatacatt

SEQ ID NO: 578329 - DNA, 17 bp, Homo sapiens
tacatgtgatacatttt

SEQ ID NO: 578330 - DNA, 21 bp, Homo sapiens
taccagctaactccagtctcc

SEQ ID NO: 578331 - DNA, 16 bp, Homo sapiens
tacccatagacatgaa

SEQ ID NO: 578332 - DNA, 23 bp, Homo sapiens
taccttatcttacaatattgatt

SEQ ID NO: 578333 - DNA, 18 bp, Homo sapiens
taccttttttttttcttg

SEQ ID NO: 578334 - DNA, 20 bp, Homo sapiens
taccttttttttttcttggt

SEQ ID NO: 578335 - DNA, 14 bp, Homo sapiens
tactaaacatgtat

SEQ ID NO: 578336 - DNA, 13 bp, Homo sapiens
tactaataaacca

SEQ ID NO: 578337 - DNA, 16 bp, Homo sapiens
tactaataaaccagtt

SEQ ID NO: 578338 - DNA, 16 bp, Homo sapiens
tactaatgatgttttc

SEQ ID NO: 578339 - DNA, 13 bp, Homo sapiens
tactgaaagcctt

SEQ ID NO: 578340 - DNA, 18 bp, Homo sapiens
tactggcttacctcctca

SEQ ID NO: 578341 - DNA, 15 bp, Homo sapiens
tactgtaattaagtg

SEQ ID NO: 578342 - DNA, 17 bp, Homo sapiens
tactgtctattaatatt

SEQ ID NO: 578343 - DNA, 18 bp, Homo sapiens
tactgtctattaatattc

SEQ ID NO: 578344 - DNA, 19 bp, Homo sapiens
tactgtgtctcatggattt

SEQ ID NO: 578345 - DNA, 16 bp, Homo sapiens
tactgttgtaagaatt

SEQ ID NO: 578346 - DNA, 17 bp, Homo sapiens
tactgttgtaagaattc

SEQ ID NO: 578347 - DNA, 11 bp, Homo sapiens
tagacatgaaa

SEQ ID NO: 578348 - DNA, 22 bp, Homo sapiens
tagattgactaactcaaataca

SEQ ID NO: 578349 - DNA, 16 bp, Homo sapiens
tagctcctccccttcc

SEQ ID NO: 578350 - DNA, 21 bp, Homo sapiens
tagctgaagaattgaaaagtt

SEQ ID NO: 578351 - DNA, 17 bp, Homo sapiens
tagcttgcagaactgta

SEQ ID NO: 578352 - DNA, 17 bp, Homo sapiens
taggaatcattcagaaa

SEQ ID NO: 578353 - DNA, 22 bp, Homo sapiens
taggaatcattcagaaatgttg

SEQ ID NO: 578354 - DNA, 18 bp, Homo sapiens
tagtaagaagacaaactg

SEQ ID NO: 578355 - DNA, 15 bp, Homo sapiens
tagtaagcatagaaa

SEQ ID NO: 578356 - DNA, 16 bp, Homo sapiens
tagtaagcatagaaac

SEQ ID NO: 578357 - DNA, 13 bp, Homo sapiens
tagtctaagacta

SEQ ID NO: 578358 - DNA, 17 bp, Homo sapiens
tagtctaagactatata

SEQ ID NO: 578359 - DNA, 22 bp, Homo sapiens
tagtgcctgagagtatttaggc

SEQ ID NO: 578360 - DNA, 22 bp, Homo sapiens
tagttactaaacatgtatgtaa

SEQ ID NO: 578361 - DNA, 16 bp, Homo sapiens
tataaatgtataaata

SEQ ID NO: 578362 - DNA, 13 bp, Homo sapiens
tataacacatttt

SEQ ID NO: 578363 - DNA, 13 bp, Homo sapiens
tataatactaaag

SEQ ID NO: 578364 - DNA, 18 bp, Homo sapiens
tatacatgtgatacattt

SEQ ID NO: 578365 - DNA, 20 bp, Homo sapiens
tatacatgtgatacattttt

SEQ ID NO: 578366 - DNA, 15 bp, Homo sapiens
tatagcttgcagaac

SEQ ID NO: 578367 - DNA, 19 bp, Homo sapiens
tatagtctaagactatata

SEQ ID NO: 578368 - DNA, 20 bp, Homo sapiens
tatagtctaagactatatat

SEQ ID NO: 578369 - DNA, 15 bp, Homo sapiens
tatataatactaaag

SEQ ID NO: 578370 - DNA, 19 bp, Homo sapiens
tatataatactaaagtgtc

SEQ ID NO: 578371 - DNA, 14 bp, Homo sapiens
tatatatataaatg

SEQ ID NO: 578372 - DNA, 19 bp, Homo sapiens
tatattttgtgtgaaattg

SEQ ID NO: 578373 - DNA, 22 bp, Homo sapiens
tatattttgtgtgaaattgcat

SEQ ID NO: 578374 - DNA, 16 bp, Homo sapiens
tatcagctacaattgt

SEQ ID NO: 578375 - DNA, 21 bp, Homo sapiens
tatcagtaacccccttaaatt

SEQ ID NO: 578376 - DNA, 20 bp, Homo sapiens
tggattctgaggccctgccc

SEQ ID NO: 578377 - DNA, 16 bp, Homo sapiens
tggattgcctctgaaa

SEQ ID NO: 578378 - DNA, 23 bp, Homo sapiens
tggcatcaagaggtgggagggcc

SEQ ID NO: 578379 - DNA, 13 bp, Homo sapiens
tggctggaagggg

SEQ ID NO: 578380 - DNA, 16 bp, Homo sapiens
tggctgtaaactataa

SEQ ID NO: 578381 - DNA, 21 bp, Homo sapiens
tgggaaaacatgttaatgaca

SEQ ID NO: 578382 - DNA, 16 bp, Homo sapiens
tgggaagtgaagcccc

SEQ ID NO: 578383 - DNA, 18 bp, Homo sapiens
tgggatattgaatgttaa

SEQ ID NO: 578384 - DNA, 22 bp, Homo sapiens
tgggatttccagaaccacactt

SEQ ID NO: 578385 - DNA, 16 bp, Homo sapiens
tgggccaggagctcag

SEQ ID NO: 578386 - DNA, 22 bp, Homo sapiens
tgggcttttggggagccagaag

SEQ ID NO: 578387 - DNA, 16 bp, Homo sapiens
tggggcacagatgcct

SEQ ID NO: 578388 - DNA, 23 bp, Homo sapiens
tgggggcttcatctctttagaga

SEQ ID NO: 578389 - DNA, 17 bp, Homo sapiens
tgggtgtctccttaagc

SEQ ID NO: 578390 - DNA, 16 bp, Homo sapiens
tggtaataagcactgt

SEQ ID NO: 578391 - DNA, 12 bp, Homo sapiens
tgtaaactataa

SEQ ID NO: 578392 - DNA, 21 bp, Homo sapiens
tgtaaactataaactactgta

SEQ ID NO: 578393 - DNA, 22 bp, Homo sapiens
tgtaaactataaactactgtaa

SEQ ID NO: 578394 - DNA, 23 bp, Homo sapiens
tgtaaactataaactactgtaat

SEQ ID NO: 578395 - DNA, 13 bp, Homo sapiens
tgtaaaggtcaga

SEQ ID NO: 578396 - DNA, 19 bp, Homo sapiens
tgtaaaggtcagagtcaaa

SEQ ID NO: 578397 - DNA, 14 bp, Homo sapiens
tgtaattaagtgca

SEQ ID NO: 578398 - DNA, 16 bp, Homo sapiens
tgtaattaagtgcaat

SEQ ID NO: 578399 - DNA, 13 bp, Homo sapiens
tgtacaaaattaa

SEQ ID NO: 578400 - DNA, 19 bp, Homo sapiens
tgtacaaaattaagcaaat

SEQ ID NO: 578401 - DNA, 14 bp, Homo sapiens
tgtactaaacagta

SEQ ID NO: 578402 - DNA, 22 bp, Homo sapiens
tgtacttaaatggtaataagca

SEQ ID NO: 578403 - DNA, 19 bp, Homo sapiens
tgtagatattgtgaagtac

SEQ ID NO: 578404 - DNA, 20 bp, Homo sapiens
tgtatatattttgtgtgaaa

SEQ ID NO: 578405 - DNA, 14 bp, Homo sapiens
tgtatgactaaaga

SEQ ID NO: 578406 - DNA, 13 bp, Homo sapiens
tgtatggggaggc

SEQ ID NO: 578407 - DNA, 18 bp, Homo sapiens
tgtattcttttctcagtg

SEQ ID NO: 578408 - DNA, 19 bp, Homo sapiens
tgtattcttttctcagtgt

SEQ ID NO: 578409 - DNA, 16 bp, Homo sapiens
tgtattttcatgaaaa

SEQ ID NO: 578410 - DNA, 18 bp, Homo sapiens
tgtcagctactaatgatg

SEQ ID NO: 578411 - DNA, 14 bp, Homo sapiens
tgtcagtatccagg

SEQ ID NO: 578412 - DNA, 19 bp, Homo sapiens
tgtcatggaaaagcccagt

SEQ ID NO: 578413 - DNA, 21 bp, Homo sapiens
tgtcattgcacataagcttcc

SEQ ID NO: 578414 - DNA, 21 bp, Homo sapiens
ttgggtggggggcattgagta

SEQ ID NO: 578415 - DNA, 12 bp, Homo sapiens
ttggtatatttt

SEQ ID NO: 578416 - DNA, 17 bp, Homo sapiens
ttggttttcctgtggca

SEQ ID NO: 578417 - DNA, 14 bp, Homo sapiens
ttgtaaaggtcaga

SEQ ID NO: 578418 - DNA, 20 bp, Homo sapiens
ttgtaaaggtcagagtcaaa

SEQ ID NO: 578419 - DNA, 20 bp, Homo sapiens
ttgtatggggaggcaagtgt

SEQ ID NO: 578420 - DNA, 18 bp, Homo sapiens
ttgtattttgattatttt

SEQ ID NO: 578421 - DNA, 17 bp, Homo sapiens
ttgtgaaatgaaaacat

SEQ ID NO: 578422 - DNA, 23 bp, Homo sapiens
ttgtgaaatgaaaacatgtaata

SEQ ID NO: 578423 - DNA, 16 bp, Homo sapiens
ttgtgtgaaattgcat

SEQ ID NO: 578424 - DNA, 17 bp, Homo sapiens
ttgtttggtaaatgttt

SEQ ID NO: 578425 - DNA, 22 bp, Homo sapiens
tttaaaatgtaatttaaatgaa

SEQ ID NO: 578426 - DNA, 21 bp, Homo sapiens
tttaaaattttgtatgttaaa

SEQ ID NO: 578427 - DNA, 17 bp, Homo sapiens
tttaaagaccctcctat

SEQ ID NO: 578428 - DNA, 17 bp, Homo sapiens
tttagcagatttaagat

SEQ ID NO: 578429 - DNA, 15 bp, Homo sapiens
tttataaacagaaat

SEQ ID NO: 578430 - DNA, 12 bp, Homo sapiens
tttataaagcat

SEQ ID NO: 578431 - DNA, 12 bp, Homo sapiens
tttatatgcttt

SEQ ID NO: 578432 - DNA, 18 bp, Homo sapiens
tttattaatgttttcaaa

SEQ ID NO: 578433 - DNA, 13 bp, Homo sapiens
tttcaaaagtgat

SEQ ID NO: 578434 - DNA, 13 bp, Homo sapiens
tttcagaaatata

SEQ ID NO: 578435 - DNA, 14 bp, Homo sapiens
tttcagtttgttgg

SEQ ID NO: 578436 - DNA, 12 bp, Homo sapiens
tttccacaccat

SEQ ID NO: 578437 - DNA, 21 bp, Homo sapiens
tttccagaaccacacttgaaa

SEQ ID NO: 578438 - DNA, 12 bp, Homo sapiens
tttctctctcta

SEQ ID NO: 578439 - DNA, 15 bp, Homo sapiens
tttcttaaccatctt

SEQ ID NO: 578440 - DNA, 16 bp, Homo sapiens
tttcttttaaagaagt

SEQ ID NO: 578441 - DNA, 16 bp, Homo sapiens
tttgaatgcttcctga

SEQ ID NO: 578442 - DNA, 17 bp, Homo sapiens
tttgattgggatgaatg

SEQ ID NO: 578443 - DNA, 18 bp, Homo sapiens
tttggattctaaatacat

SEQ ID NO: 578444 - DNA, 23 bp, Homo sapiens
tttgggtggggggcattgagtat

SEQ ID NO: 578445 - DNA, 22 bp, Homo sapiens
tttgtaaaaatcttttgaagca

SEQ ID NO: 578446 - DNA, 14 bp, Homo sapiens
tttgtacagagtgc

SEQ ID NO: 578447 - DNA, 13 bp, Homo sapiens
tttgtattttcat

SEQ ID NO: 578448 - DNA, 15 bp, Homo sapiens
ttttataaagcatgt

SEQ ID NO: 578449 - DNA, 22 bp, Homo sapiens
ttttgaatgcttcctgacaatc

SEQ ID NO: 578450 - DNA, 17 bp, Homo sapiens
ttttgtatgttaaagag

SEQ ID NO: 578451 - DNA, 22 bp, Homo sapiens
ttttgtgaaatgaaaacatgta

SEQ ID NO: 578452 - DNA, 14 bp, Homo sapiens
ttttgtgtgaaatt

SEQ ID NO: 578453 - DNA, 15 bp, Homo sapiens
ttttgtgtgaaattg

SEQ ID NO: 578454 - DNA, 19 bp, Homo sapiens
ttttgttgtacttaaatgg

SEQ ID NO: 578455 - DNA, 18 bp, Homo sapiens
ttttgtttggagacgttt

SEQ ID NO: 578456 - DNA, 16 bp, Homo sapiens
ttttgtttggtaaatg

SEQ ID NO: 578457 - DNA, 12 bp, Homo sapiens
tttttaaaattt

SEQ ID NO: 578458 - DNA, 16 bp, Homo sapiens
tttttaagcttcagtt

SEQ ID NO: 578459 - DNA, 23 bp, Homo sapiens
tttttataattgtacaaaattaa

SEQ ID NO: 578460 - DNA, 17 bp, Homo sapiens
tttttatgtaattatat

SEQ ID NO: 578461 - DNA, 14 bp, Homo sapiens
tttttggttgggaa

SEQ ID NO: 578462 - DNA, 11 bp, Homo sapiens
tttttgtttgg

SEQ ID NO: 578463 - DNA, 14 bp, Homo sapiens
tttttgtttggaga

SEQ ID NO: 578464 - DNA, 15 bp, Homo sapiens
ttttttaagcttcag

SEQ ID NO: 578465 - DNA, 23 bp, Homo sapiens
ttttttaagcttcagttgcttgt

SEQ ID NO: 578466 - DNA, 11 bp, Homo sapiens
ttttttattat

SEQ ID NO: 578467 - DNA, 13 bp, Homo sapiens
tctgtagctcctc

SEQ ID NO: 578468 - DNA, 13 bp, Homo sapiens
tctgttactgaaa

SEQ ID NO: 578469 - DNA, 14 bp, Homo sapiens
tctgttactgaaat

SEQ ID NO: 578470 - DNA, 21 bp, Homo sapiens
tctgttatgggcttttgggga

SEQ ID NO: 578471 - DNA, 21 bp, Homo sapiens
tcttacaatattgattgggaa

SEQ ID NO: 578472 - DNA, 21 bp, Homo sapiens
tcttagtatgtgcatttaatt

SEQ ID NO: 578473 - DNA, 17 bp, Homo sapiens
tcttcctatccctctcc

SEQ ID NO: 578474 - DNA, 16 bp, Homo sapiens
tcttgtctgatttctt

SEQ ID NO: 578475 - DNA, 23 bp, Homo sapiens
tctttagtttttggttgggaatg

SEQ ID NO: 578476 - DNA, 23 bp, Homo sapiens
tctttcagaaatataacacattt

SEQ ID NO: 578477 - DNA, 15 bp, Homo sapiens
tctttggattctaaa

SEQ ID NO: 578478 - DNA, 23 bp, Homo sapiens
tcttttaaagaagtaaatttgtc

SEQ ID NO: 578479 - DNA, 12 bp, Homo sapiens
tcttttgaagca

SEQ ID NO: 578480 - DNA, 16 bp, Homo sapiens
tcttttgtttggtaaa

SEQ ID NO: 578481 - DNA, 17 bp, Homo sapiens
tgaaaaatataaaatta

SEQ ID NO: 578482 - DNA, 19 bp, Homo sapiens
tgaaaaatataaaattatg

SEQ ID NO: 578483 - DNA, 20 bp, Homo sapiens
tgaaaaatataaaattatga

SEQ ID NO: 578484 - DNA, 14 bp, Homo sapiens
tgaaaagtgtgtat

SEQ ID NO: 578485 - DNA, 15 bp, Homo sapiens
tgaaaagtttttgtt

SEQ ID NO: 578486 - DNA, 13 bp, Homo sapiens
tgaaaataccatt

SEQ ID NO: 578487 - DNA, 18 bp, Homo sapiens
tgaaacctagtactgccc

SEQ ID NO: 578488 - DNA, 19 bp, Homo sapiens
tgaaacctagtactgcccc

SEQ ID NO: 578489 - DNA, 15 bp, Homo sapiens
tgaaactttgggaaa

SEQ ID NO: 578490 - DNA, 22 bp, Homo sapiens
tgaaactttgggaaaacatgtt

SEQ ID NO: 578491 - DNA, 14 bp, Homo sapiens
tgaaagaaaattga

SEQ ID NO: 578492 - DNA, 21 bp, Homo sapiens
tgaaataaagacccaggggga

SEQ ID NO: 578493 - DNA, 16 bp, Homo sapiens
tgaaattgcatacttt

SEQ ID NO: 578494 - DNA, 13 bp, Homo sapiens
tgaagaattgaaa

SEQ ID NO: 578495 - DNA, 17 bp, Homo sapiens
tgaagttttactgtcta

SEQ ID NO: 578496 - DNA, 13 bp, Homo sapiens
tgaatctgttact

SEQ ID NO: 578497 - DNA, 17 bp, Homo sapiens
tgaatctgttactgaaa

SEQ ID NO: 578498 - DNA, 18 bp, Homo sapiens
tgaatctgttactgaaat

SEQ ID NO: 578499 - DNA, 24 bp, Homo sapiens
tgacaatattccagatctttcaga

SEQ ID NO: 578500 - DNA, 21 bp, Homo sapiens
tgacattaagacacacctctg

SEQ ID NO: 578501 - DNA, 12 bp, Homo sapiens
tgaccatttttt

SEQ ID NO: 578502 - DNA, 18 bp, Homo sapiens
tgacggaagaacatagaa

SEQ ID NO: 578503 - DNA, 16 bp, Homo sapiens
tgactaaagagagaat

SEQ ID NO: 578504 - DNA, 16 bp, Homo sapiens
tgacttttataaagca

SEQ ID NO: 578505 - DNA, 18 bp, Homo sapiens
tgacttttataaagcatg

SEQ ID NO: 578506 - DNA, 13 bp, Homo sapiens
tgagattggtttt

SEQ ID NO: 578507 - DNA, 19 bp, Homo sapiens
tgagattggttttcctgtg

SEQ ID NO: 578508 - DNA, 22 bp, Homo sapiens
tgagattggttttcctgtggca

SEQ ID NO: 578509 - DNA, 15 bp, Homo sapiens
tgagatttcttttaa

SEQ ID NO: 578510 - DNA, 15 bp, Homo sapiens
tgagctctgaaatct

SEQ ID NO: 578511 - DNA, 21 bp, Homo sapiens
tgagctcttcctatccctctc

SEQ ID NO: 578512 - DNA, 13 bp, Homo sapiens
aaaaagcagctac

SEQ ID NO: 578513 - DNA, 21 bp, Homo sapiens
aaaaagcagctaccaggtgtt

SEQ ID NO: 578514 - DNA, 22 bp, Homo sapiens
aaaaatataaaattatgagatt

SEQ ID NO: 578515 - DNA, 22 bp, Homo sapiens
aaaacttgaatctgttactgaa

SEQ ID NO: 578516 - DNA, 15 bp, Homo sapiens
aaaagcactcctgct

SEQ ID NO: 578517 - DNA, 20 bp, Homo sapiens
aaaagcccagtgacctgacc

SEQ ID NO: 578518 - DNA, 13 bp, Homo sapiens
aaaaggaagacta

SEQ ID NO: 578519 - DNA, 14 bp, Homo sapiens
aaaaggtattatac

SEQ ID NO: 578520 - DNA, 22 bp, Homo sapiens
aaaatcattgattgtcagctac

SEQ ID NO: 578521 - DNA, 14 bp, Homo sapiens
aaaatgtaatttaa

SEQ ID NO: 578522 - DNA, 20 bp, Homo sapiens
aaaattgagttgcacttatt

SEQ ID NO: 578523 - DNA, 12 bp, Homo sapiens
aaaatttgaata

SEQ ID NO: 578524 - DNA, 18 bp, Homo sapiens
aaaatttttatgtaatta

SEQ ID NO: 578525 - DNA, 19 bp, Homo sapiens
aaaatttttatgtaattat

SEQ ID NO: 578526 - DNA, 13 bp, Homo sapiens
aaacacactgtaa

SEQ ID NO: 578527 - DNA, 21 bp, Homo sapiens
aaacatgttaatgacaatatt

SEQ ID NO: 578528 - DNA, 22 bp, Homo sapiens
aaaccacttaaacgaagagttc

SEQ ID NO: 578529 - DNA, 13 bp, Homo sapiens
aaactaaatttca

SEQ ID NO: 578530 - DNA, 15 bp, Homo sapiens
aaactaacagataag

SEQ ID NO: 578531 - DNA, 12 bp, Homo sapiens
aaactactgtaa

SEQ ID NO: 578532 - DNA, 22 bp, Homo sapiens
aaactagttactaaacatgtat

SEQ ID NO: 578533 - DNA, 18 bp, Homo sapiens
aaactataaactactgta

SEQ ID NO: 578534 - DNA, 21 bp, Homo sapiens
aaactataaactactgtaatt

SEQ ID NO: 578535 - DNA, 21 bp, Homo sapiens
aaactgatgcgaaaacttgaa

SEQ ID NO: 578536 - DNA, 16 bp, Homo sapiens
aaagaagtaaatttgt

SEQ ID NO: 578537 - DNA, 22 bp, Homo sapiens
aaagaccctcctattctataaa

SEQ ID NO: 578538 - DNA, 12 bp, Homo sapiens
aaagagaatgag

SEQ ID NO: 578539 - DNA, 14 bp, Homo sapiens
aaagagaatgagtc

SEQ ID NO: 578540 - DNA, 18 bp, Homo sapiens
aaagagagaatgtagata

SEQ ID NO: 578541 - DNA, 16 bp, Homo sapiens
aaagaggctgaaagag

SEQ ID NO: 578542 - DNA, 20 bp, Homo sapiens
aaagaggctgaaagaggcca

SEQ ID NO: 578543 - DNA, 22 bp, Homo sapiens
aaagcatgttcacccttatagt

SEQ ID NO: 578544 - DNA, 19 bp, Homo sapiens
aaagccttagggaagctgg

SEQ ID NO: 578545 - DNA, 13 bp, Homo sapiens
aaaggaagactag

SEQ ID NO: 578546 - DNA, 20 bp, Homo sapiens
aaaggtattatacatgtgat

SEQ ID NO: 578547 - DNA, 16 bp, Homo sapiens
aaagtaactgtgagaa

SEQ ID NO: 578548 - DNA, 22 bp, Homo sapiens
aaagtgatctgtcccctctccc

SEQ ID NO: 578549 - DNA, 20 bp, Homo sapiens
aaagtgtgtatatattttgt

SEQ ID NO: 578550 - DNA, 21 bp, Homo sapiens
aaagtgtgtatatattttgtg

SEQ ID NO: 578551 - DNA, 23 bp, Homo sapiens
aaagttttgttgtacttaaatgg

SEQ ID NO: 578552 - DNA, 13 bp, Homo sapiens
aaataaaattttt

SEQ ID NO: 578553 - DNA, 16 bp, Homo sapiens
aaataagaaataatgc

SEQ ID NO: 578554 - DNA, 22 bp, Homo sapiens
aaatacacatttgctactgttg

SEQ ID NO: 578555 - DNA, 19 bp, Homo sapiens
aaatacatgccacatcaaa

SEQ ID NO: 578556 - DNA, 15 bp, Homo sapiens
aaatcttttgaagca

SEQ ID NO: 578557 - DNA, 18 bp, Homo sapiens
aaatgaaaacatgtaata

SEQ ID NO: 578558 - DNA, 14 bp, Homo sapiens
aaatgaaagaaaat

SEQ ID NO: 578559 - DNA, 15 bp, Homo sapiens
aaatgaaagaaaatt

SEQ ID NO: 578560 - DNA, 19 bp, Homo sapiens
aaatgagctctgaaatctt

SEQ ID NO: 578561 - DNA, 19 bp, Homo sapiens
aaatgcatatcctgagcca

SEQ ID NO: 578562 - DNA, 14 bp, Homo sapiens
aaatgtaatttaaa

SEQ ID NO: 578563 - DNA, 17 bp, Homo sapiens
aaatgtaatttaaatga

SEQ ID NO: 578564 - DNA, 18 bp, Homo sapiens
aaatgtaatttaaatgaa

SEQ ID NO: 578565 - DNA, 21 bp, Homo sapiens
aaatgtataaatatacagtat

SEQ ID NO: 578566 - DNA, 15 bp, Homo sapiens
aaatgtttcttttaa

SEQ ID NO: 578567 - DNA, 18 bp, Homo sapiens
aaattaaataaaattttt

SEQ ID NO: 578568 - DNA, 17 bp, Homo sapiens
aaattaagcaaatgtta

SEQ ID NO: 578569 - DNA, 15 bp, Homo sapiens
aaattcaactttgta

SEQ ID NO: 578570 - DNA, 15 bp, Homo sapiens
aaattgcatactttg

SEQ ID NO: 578571 - DNA, 23 bp, Homo sapiens
aaattgcatactttgtattttga

SEQ ID NO: 578572 - DNA, 19 bp, Homo sapiens
aaatttaaaaaataaataa

SEQ ID NO: 578573 - DNA, 21 bp, Homo sapiens
aaatttaataccagatacctt

SEQ ID NO: 578574 - DNA, 15 bp, Homo sapiens
aacaaggaccctgtt

SEQ ID NO: 578575 - DNA, 14 bp, Homo sapiens
aacacactgtaaat

SEQ ID NO: 578576 - DNA, 15 bp, Homo sapiens
aacacactgtaaata

SEQ ID NO: 578577 - DNA, 18 bp, Homo sapiens
aacacagcatgtgtattt

SEQ ID NO: 578578 - DNA, 23 bp, Homo sapiens
aacactagggccttggaaattcc

SEQ ID NO: 578579 - DNA, 14 bp, Homo sapiens
aacagaaatggaaa

SEQ ID NO: 578580 - DNA, 19 bp, Homo sapiens
aacagataagcaagagaga

SEQ ID NO: 578581 - DNA, 14 bp, Homo sapiens
aacagcctttgaat

SEQ ID NO: 578582 - DNA, 22 bp, Homo sapiens
aacatgttaatgacaatattcc

SEQ ID NO: 578583 - DNA, 13 bp, Homo sapiens
agcatgaaaaagc

SEQ ID NO: 578584 - DNA, 14 bp, Homo sapiens
agcatgaaaaagca

SEQ ID NO: 578585 - DNA, 19 bp, Homo sapiens
agcatgtgtatttccagtg

SEQ ID NO: 578586 - DNA, 21 bp, Homo sapiens
agcccagcttggccctttcct

SEQ ID NO: 578587 - DNA, 16 bp, Homo sapiens
agcccagtgacctgac

SEQ ID NO: 578588 - DNA, 18 bp, Homo sapiens
agcccagtgacctgaccg

SEQ ID NO: 578589 - DNA, 15 bp, Homo sapiens
agccccttgtcctct

SEQ ID NO: 578590 - DNA, 13 bp, Homo sapiens
agcccgaagccca

SEQ ID NO: 578591 - DNA, 23 bp, Homo sapiens
agccctgatgtgtcctcagggag

SEQ ID NO: 578592 - DNA, 13 bp, Homo sapiens
agcctactctcct

SEQ ID NO: 578593 - DNA, 21 bp, Homo sapiens
agcctcgttggaagaggaaca

SEQ ID NO: 578594 - DNA, 14 bp, Homo sapiens
agccttagggaagc

SEQ ID NO: 578595 - DNA, 16 bp, Homo sapiens
agccttctccctagct

SEQ ID NO: 578596 - DNA, 17 bp, Homo sapiens
agcggccctaagggagt

SEQ ID NO: 578597 - DNA, 13 bp, Homo sapiens
agctaaagaggct

SEQ ID NO: 578598 - DNA, 23 bp, Homo sapiens
agctaactccagtctcctgacat

SEQ ID NO: 578599 - DNA, 18 bp, Homo sapiens
agctactaatgatgtttt

SEQ ID NO: 578600 - DNA, 23 bp, Homo sapiens
agctcctcaactcacctaatgtt

SEQ ID NO: 578601 - DNA, 19 bp, Homo sapiens
agctcctccccttcctctt

SEQ ID NO: 578602 - DNA, 13 bp, Homo sapiens
agctctgaaatct

SEQ ID NO: 578603 - DNA, 14 bp, Homo sapiens
agctgccatggcta

SEQ ID NO: 578604 - DNA, 15 bp, Homo sapiens
agctgccatggctag

SEQ ID NO: 578605 - DNA, 19 bp, Homo sapiens
agctgtcatggaaaagccc

SEQ ID NO: 578606 - DNA, 15 bp, Homo sapiens
agcttcagttgcttg

SEQ ID NO: 578607 - DNA, 16 bp, Homo sapiens
agcttcagttgcttgt

SEQ ID NO: 578608 - DNA, 23 bp, Homo sapiens
agcttcagttgcttgtcttctgg

SEQ ID NO: 578609 - DNA, 15 bp, Homo sapiens
agcttccattttaat

SEQ ID NO: 578610 - DNA, 17 bp, Homo sapiens
agcttggccctttcctt

SEQ ID NO: 578611 - DNA, 21 bp, Homo sapiens
agctttgcaaacccattaagg

SEQ ID NO: 578612 - DNA, 22 bp, Homo sapiens
aggaaccttccttcctgcttga

SEQ ID NO: 578613 - DNA, 16 bp, Homo sapiens
aggacatgcaataaaa

SEQ ID NO: 578614 - DNA, 22 bp, Homo sapiens
aggacatgcaataaaatttaaa

SEQ ID NO: 578615 - DNA, 14 bp, Homo sapiens
aggagagaaggaca

SEQ ID NO: 578616 - DNA, 19 bp, Homo sapiens
aggagctcagccgtgcact

SEQ ID NO: 578617 - DNA, 17 bp, Homo sapiens
aggaggcgcagcccgaa

SEQ ID NO: 578618 - DNA, 17 bp, Homo sapiens
aggagtggtgatttgaa

SEQ ID NO: 578619 - DNA, 15 bp, Homo sapiens
aggcaccgagaatgt

SEQ ID NO: 578620 - DNA, 18 bp, Homo sapiens
aggcaccgagaatgttgt

SEQ ID NO: 578621 - DNA, 13 bp, Homo sapiens
aggcccatagcag

SEQ ID NO: 578622 - DNA, 12 bp, Homo sapiens
aggccctgccca

SEQ ID NO: 578623 - DNA, 21 bp, Homo sapiens
aggcctgacttctgctggcat

SEQ ID NO: 578624 - DNA, 16 bp, Homo sapiens
aggcgcagcccgaagc

SEQ ID NO: 578625 - DNA, 19 bp, Homo sapiens
aggcgcagcccgaagccca

SEQ ID NO: 578626 - DNA, 17 bp, Homo sapiens
aggctgaaagaggccaa

SEQ ID NO: 578627 - DNA, 13 bp, Homo sapiens
agggaaggcctga

SEQ ID NO: 578628 - DNA, 14 bp, Homo sapiens
agggaaggcctgac

SEQ ID NO: 578629 - DNA, 22 bp, Homo sapiens
agggatggaaaaggaagactag

SEQ ID NO: 578630 - DNA, 15 bp, Homo sapiens
agggatttgcctcac

SEQ ID NO: 578631 - DNA, 16 bp, Homo sapiens
agggatttgcctcacc

SEQ ID NO: 578632 - DNA, 20 bp, Homo sapiens
agggatttgcctcaccttgg

SEQ ID NO: 578633 - DNA, 22 bp, Homo sapiens
agggatttgcctcaccttgggg

SEQ ID NO: 578634 - DNA, 16 bp, Homo sapiens
agggcagggaaactgg

SEQ ID NO: 578635 - DNA, 21 bp, Homo sapiens
agggccttggaaattcctgta

SEQ ID NO: 578636 - DNA, 13 bp, Homo sapiens
aggtattatacat

SEQ ID NO: 578637 - DNA, 22 bp, Homo sapiens
aggtcaagtaagaagacatgaa

SEQ ID NO: 578638 - DNA, 16 bp, Homo sapiens
aggtccctgcttacct

SEQ ID NO: 578639 - DNA, 20 bp, Homo sapiens
aggtccctgcttacctgacg

SEQ ID NO: 578640 - DNA, 16 bp, Homo sapiens
aggtgggagacaagga

SEQ ID NO: 578641 - DNA, 17 bp, Homo sapiens
aggtgttctacactcat

SEQ ID NO: 578642 - DNA, 15 bp, Homo sapiens
agtaacatgccagct

SEQ ID NO: 578643 - DNA, 15 bp, Homo sapiens
agtaagaagacatga

SEQ ID NO: 578644 - DNA, 21 bp, Homo sapiens
agtaagaataccacatcaaat

SEQ ID NO: 578645 - DNA, 17 bp, Homo sapiens
agtacatattaggaaaa

SEQ ID NO: 578646 - DNA, 18 bp, Homo sapiens
agtacatattaggaaaat

SEQ ID NO: 578647 - DNA, 15 bp, Homo sapiens
agtatcagctacaat

SEQ ID NO: 578648 - DNA, 19 bp, Homo sapiens
agtatcagctacaattgta

SEQ ID NO: 578649 - DNA, 23 bp, Homo sapiens
agtatccaggctttgtacagagt

SEQ ID NO: 578650 - DNA, 16 bp, Homo sapiens
agtatgtgggggcttc

SEQ ID NO: 578651 - DNA, 17 bp, Homo sapiens
agtatgtgggggcttca

SEQ ID NO: 578652 - DNA, 22 bp, Homo sapiens
agtatgtgggggcttcatctct

SEQ ID NO: 578653 - DNA, 22 bp, Homo sapiens
agtattgccacaatgcctctcc

SEQ ID NO: 578654 - DNA, 14 bp, Homo sapiens
agtattgtttaaaa

SEQ ID NO: 578655 - DNA, 16 bp, Homo sapiens
agtattgtttaaaatg

SEQ ID NO: 578656 - DNA, 15 bp, Homo sapiens
agtccgcagaagccc

SEQ ID NO: 578657 - DNA, 23 bp, Homo sapiens
agtccttgatttcaaagttttgt

SEQ ID NO: 578658 - DNA, 13 bp, Homo sapiens
agtctcctgacat

SEQ ID NO: 578659 - DNA, 20 bp, Homo sapiens
agtgacctgaccggcacctg

SEQ ID NO: 578660 - DNA, 19 bp, Homo sapiens
agtgatctgtcccctctcc

SEQ ID NO: 578661 - DNA, 10 bp, Homo sapiens
agtgcctaca

SEQ ID NO: 578662 - DNA, 15 bp, Homo sapiens
agtggtgatttgaaa

SEQ ID NO: 578663 - DNA, 15 bp, Homo sapiens
agtgtggggggtcct

SEQ ID NO: 578664 - DNA, 18 bp, Homo sapiens
agtgtgtatatattttgt

SEQ ID NO: 578665 - DNA, 18 bp, Homo sapiens
agttagctgaagaattga

SEQ ID NO: 578666 - DNA, 22 bp, Homo sapiens
agttcccttgaaactttgggaa

SEQ ID NO: 578667 - DNA, 19 bp, Homo sapiens
agttctaacagtgaagttt

SEQ ID NO: 578668 - DNA, 20 bp, Homo sapiens
agttgcagtctcagaaagcc

SEQ ID NO: 578669 - DNA, 15 bp, Homo sapiens
agttgggtgtctcct

SEQ ID NO: 578670 - DNA, 16 bp, Homo sapiens
agttgggtgtctcctt

SEQ ID NO: 578671 - DNA, 13 bp, Homo sapiens
agtttgttggaaa

SEQ ID NO: 578672 - DNA, 16 bp, Homo sapiens
agttttatatgcttta

SEQ ID NO: 578673 - DNA, 13 bp, Homo sapiens
agttttctttgta

SEQ ID NO: 578674 - DNA, 16 bp, Homo sapiens
agtttttggttgggaa

SEQ ID NO: 578675 - DNA, 16 bp, Homo sapiens
ataaagacccaggggg

SEQ ID NO: 578676 - DNA, 14 bp, Homo sapiens
ataaatatttatgt

SEQ ID NO: 578677 - DNA, 15 bp, Homo sapiens
ataaattcaactttg

SEQ ID NO: 578678 - DNA, 13 bp, Homo sapiens
ataacacattttt

SEQ ID NO: 578679 - DNA, 23 bp, Homo sapiens
ataacacatttttttgcatgcat

SEQ ID NO: 578680 - DNA, 22 bp, Homo sapiens
ataagaaataatgctacaattt

SEQ ID NO: 578681 - DNA, 23 bp, Homo sapiens
ataagaagaagttcatgtccaaa

SEQ ID NO: 578682 - DNA, 12 bp, Homo sapiens
ataagcaagaga

SEQ ID NO: 578683 - DNA, 15 bp, Homo sapiens
ataagcaagagagat

SEQ ID NO: 578684 - DNA, 17 bp, Homo sapiens
ataagctaaagaggctg

SEQ ID NO: 578685 - DNA, 17 bp, Homo sapiens
atacatgccacatcaaa

SEQ ID NO: 578686 - DNA, 21 bp, Homo sapiens
atacatgccacatcaaacctt

SEQ ID NO: 578687 - DNA, 20 bp, Homo sapiens
atacatggttgtgacctgag

SEQ ID NO: 578688 - DNA, 19 bp, Homo sapiens
atacatgtgatacattttt

SEQ ID NO: 578689 - DNA, 13 bp, Homo sapiens
ataccacatcaaa

SEQ ID NO: 578690 - DNA, 18 bp, Homo sapiens
atactaaagtgtctatta

SEQ ID NO: 578691 - DNA, 17 bp, Homo sapiens
atactttgtattttgat

SEQ ID NO: 578692 - DNA, 22 bp, Homo sapiens
atagctaagatataatttaaac

SEQ ID NO: 578693 - DNA, 21 bp, Homo sapiens
ataggagtggtgatttgaaaa

SEQ ID NO: 578694 - DNA, 12 bp, Homo sapiens
atataacacatt

SEQ ID NO: 578695 - DNA, 15 bp, Homo sapiens
atataacacattttt

SEQ ID NO: 578696 - DNA, 14 bp, Homo sapiens
atataatactaaag

SEQ ID NO: 578697 - DNA, 15 bp, Homo sapiens
atataatactaaagt

SEQ ID NO: 578698 - DNA, 16 bp, Homo sapiens
ccttgagaccacaggg

SEQ ID NO: 578699 - DNA, 14 bp, Homo sapiens
ccttgatgactgcc

SEQ ID NO: 578700 - DNA, 15 bp, Homo sapiens
ccttgatgactgcct

SEQ ID NO: 578701 - DNA, 16 bp, Homo sapiens
ccttgatgactgcctt

SEQ ID NO: 578702 - DNA, 23 bp, Homo sapiens
ccttgatgactgccttgcctcct

SEQ ID NO: 578703 - DNA, 12 bp, Homo sapiens
ccttgctacctc

SEQ ID NO: 578704 - DNA, 15 bp, Homo sapiens
ccttgtcctctcccg

SEQ ID NO: 578705 - DNA, 16 bp, Homo sapiens
ccttttttttttcttg

SEQ ID NO: 578706 - DNA, 11 bp, Homo sapiens
cgaagcccagt

SEQ ID NO: 578707 - DNA, 13 bp, Homo sapiens
cgagaggtccctg

SEQ ID NO: 578708 - DNA, 17 bp, Homo sapiens
cgagaggtccctgctta

SEQ ID NO: 578709 - DNA, 20 bp, Homo sapiens
cggacgtcctgctggcacct

SEQ ID NO: 578710 - DNA, 12 bp, Homo sapiens
cggccctaaggg

SEQ ID NO: 578711 - DNA, 14 bp, Homo sapiens
cgggcctcagtgcc

SEQ ID NO: 578712 - DNA, 15 bp, Homo sapiens
cgggcctcagtgccc

SEQ ID NO: 578713 - DNA, 13 bp, Homo sapiens
cgtccatctccct

SEQ ID NO: 578714 - DNA, 22 bp, Homo sapiens
cgtgcgcaacaacaaggaccct

SEQ ID NO: 578715 - DNA, 21 bp, Homo sapiens
cgtttttgtattttcatgaaa

SEQ ID NO: 578716 - DNA, 18 bp, Homo sapiens
ctaaagaggctgaaagag

SEQ ID NO: 578717 - DNA, 22 bp, Homo sapiens
ctaaagtgtctattagttttct

SEQ ID NO: 578718 - DNA, 13 bp, Homo sapiens
ctaaatttcacta

SEQ ID NO: 578719 - DNA, 18 bp, Homo sapiens
ctaacagataagcaagag

SEQ ID NO: 578720 - DNA, 20 bp, Homo sapiens
ctaacagtgaagttttactg

SEQ ID NO: 578721 - DNA, 17 bp, Homo sapiens
ctaagatataatttaaa

SEQ ID NO: 578722 - DNA, 20 bp, Homo sapiens
ctaagatataatttaaacgt

SEQ ID NO: 578723 - DNA, 14 bp, Homo sapiens
ctaaggaaccttcc

SEQ ID NO: 578724 - DNA, 17 bp, Homo sapiens
ctaagtgggaagtgaag

SEQ ID NO: 578725 - DNA, 19 bp, Homo sapiens
ctaagtgggaagtgaagcc

SEQ ID NO: 578726 - DNA, 12 bp, Homo sapiens
ctaatgatgttt

SEQ ID NO: 578727 - DNA, 17 bp, Homo sapiens
ctaatgtttatgagcca

SEQ ID NO: 578728 - DNA, 18 bp, Homo sapiens
ctaatgtttatgagccag

SEQ ID NO: 578729 - DNA, 13 bp, Homo sapiens
ctacaattgtaaa

SEQ ID NO: 578730 - DNA, 17 bp, Homo sapiens
ctacaattgtaaactag

SEQ ID NO: 578731 - DNA, 13 bp, Homo sapiens
ctacatgtgagtg

SEQ ID NO: 578732 - DNA, 15 bp, Homo sapiens
ctactaataaaccag

SEQ ID NO: 578733 - DNA, 19 bp, Homo sapiens
ctactgtaattaagtgcaa

SEQ ID NO: 578734 - DNA, 13 bp, Homo sapiens
ctataaaactctg

SEQ ID NO: 578735 - DNA, 18 bp, Homo sapiens
ctatgcagtattgccaca

SEQ ID NO: 578736 - DNA, 23 bp, Homo sapiens
ctatgcagtattgccacaatgcc

SEQ ID NO: 578737 - DNA, 24 bp, Homo sapiens
ctatgcagtattgccacaatgcct

SEQ ID NO: 578738 - DNA, 16 bp, Homo sapiens
ctattatttttataat

SEQ ID NO: 578739 - DNA, 18 bp, Homo sapiens
ctattatttttataattg

SEQ ID NO: 578740 - DNA, 19 bp, Homo sapiens
ctattatttttataattgt

SEQ ID NO: 578741 - DNA, 17 bp, Homo sapiens
ctcaaatacacatttgc

SEQ ID NO: 578742 - DNA, 18 bp, Homo sapiens
ctcaaatacacatttgct

SEQ ID NO: 578743 - DNA, 19 bp, Homo sapiens
ctcaaggtgggccttgcta

SEQ ID NO: 578744 - DNA, 19 bp, Homo sapiens
ctcaatgaaccataaattc

SEQ ID NO: 578745 - DNA, 20 bp, Homo sapiens
ctcaatgaaccataaattca

SEQ ID NO: 578746 - DNA, 23 bp, Homo sapiens
ctcaatgtttagcagatttaaga

SEQ ID NO: 578747 - DNA, 14 bp, Homo sapiens
ctcaccttggggcc

SEQ ID NO: 578748 - DNA, 17 bp, Homo sapiens
ctcagacaatccactct

SEQ ID NO: 578749 - DNA, 18 bp, Homo sapiens
ctcatggagaaacatcct

SEQ ID NO: 578750 - DNA, 14 bp, Homo sapiens
ctcattgactttta

SEQ ID NO: 578751 - DNA, 21 bp, Homo sapiens
ctcattgacttttataaagca

SEQ ID NO: 578752 - DNA, 19 bp, Homo sapiens
ctcccacgatgtcaaggac

SEQ ID NO: 578753 - DNA, 18 bp, Homo sapiens
ctcccgcgggcctggaca

SEQ ID NO: 578754 - DNA, 19 bp, Homo sapiens
ctccctaagaaaccccagg

SEQ ID NO: 578755 - DNA, 19 bp, Homo sapiens
ctcctgtctgtcctggagg

SEQ ID NO: 578756 - DNA, 18 bp, Homo sapiens
ctctcccctcatggagaa

SEQ ID NO: 578757 - DNA, 15 bp, Homo sapiens
ctctgaaatcttccc

SEQ ID NO: 578758 - DNA, 13 bp, Homo sapiens
ctctggatccctg

SEQ ID NO: 578759 - DNA, 20 bp, Homo sapiens
ctgaaacctagtactgcccc

SEQ ID NO: 578760 - DNA, 18 bp, Homo sapiens
ctgaagaattgaaaagtt

SEQ ID NO: 578761 - DNA, 14 bp, Homo sapiens
ctgacatttcttct

SEQ ID NO: 578762 - DNA, 19 bp, Homo sapiens
ctgagagtatttaggcaga

SEQ ID NO: 578763 - DNA, 15 bp, Homo sapiens
ctgattctggcttta

SEQ ID NO: 578764 - DNA, 20 bp, Homo sapiens
ctgcatgtagaggcttgttt

SEQ ID NO: 578765 - DNA, 14 bp, Homo sapiens
ctgccatgccagga

SEQ ID NO: 578766 - DNA, 22 bp, Homo sapiens
ctgccatgccaggaacctgtcc

SEQ ID NO: 578767 - DNA, 23 bp, Homo sapiens
ctgccatgccaggaacctgtcct

SEQ ID NO: 578768 - DNA, 23 bp, Homo sapiens
ctgccattacagaggtattaaaa

SEQ ID NO: 578769 - DNA, 11 bp, Homo sapiens
ctgccctgtat

SEQ ID NO: 578770 - DNA, 13 bp, Homo sapiens
ctgccttgcctcc

SEQ ID NO: 578771 - DNA, 19 bp, Homo sapiens
ctgccttgcctcctcagta

SEQ ID NO: 578772 - DNA, 20 bp, Homo sapiens
ctgctggcacctcagacaat

SEQ ID NO: 578773 - DNA, 23 bp, Homo sapiens
ctgctggcacctcagacaatcca

SEQ ID NO: 578774 - DNA, 14 bp, Homo sapiens
ctgctgtccagtgc

SEQ ID NO: 578775 - DNA, 15 bp, Homo sapiens
ctgctgtccagtgcc

SEQ ID NO: 578776 - DNA, 20 bp, Homo sapiens
ctgctgtccagtgcctacat

SEQ ID NO: 578777 - DNA, 12 bp, Homo sapiens
ctgcttacctga

SEQ ID NO: 578778 - DNA, 21 bp, Homo sapiens
ctgcttcccttactttgctga

SEQ ID NO: 578779 - DNA, 19 bp, Homo sapiens
ctggcctgagaggggaagc

SEQ ID NO: 578780 - DNA, 17 bp, Homo sapiens
ctgggtactgaaagcct

SEQ ID NO: 578781 - DNA, 20 bp, Homo sapiens
ctgggttttcttaaccatct

SEQ ID NO: 578782 - DNA, 15 bp, Homo sapiens
ctgtaaatatccaca

SEQ ID NO: 578783 - DNA, 18 bp, Homo sapiens
ctgtagatatgtattctt

SEQ ID NO: 578784 - DNA, 23 bp, Homo sapiens
ctgtatataatactaaagtgtct

SEQ ID NO: 578785 - DNA, 14 bp, Homo sapiens
ctgtccagtgccta

SEQ ID NO: 578786 - DNA, 20 bp, Homo sapiens
ctgtcctaaggaaccttcct

SEQ ID NO: 578787 - DNA, 19 bp, Homo sapiens
ctgtctatgttgtgatcct

SEQ ID NO: 578788 - DNA, 23 bp, Homo sapiens
ctgtgagaacccagtttcccgtc

SEQ ID NO: 578789 - DNA, 18 bp, Homo sapiens
ctgtggcataaattgcat

SEQ ID NO: 578790 - DNA, 14 bp, Homo sapiens
ctgtgggccaggag

SEQ ID NO: 578791 - DNA, 19 bp, Homo sapiens
ctgtgggccaggagctcag

SEQ ID NO: 578792 - DNA, 13 bp, Homo sapiens
ctgtgtcctctcc

SEQ ID NO: 578793 - DNA, 17 bp, Homo sapiens
ctgttgtaagaattctg

SEQ ID NO: 578794 - DNA, 12 bp, Homo sapiens
cttaaccatctt

SEQ ID NO: 578795 - DNA, 18 bp, Homo sapiens
cttaatggagttcttgtg

SEQ ID NO: 578796 - DNA, 21 bp, Homo sapiens
cttacaatattgattgggaaa

SEQ ID NO: 578797 - DNA, 15 bp, Homo sapiens
cttacctaacatctg

SEQ ID NO: 578798 - DNA, 11 bp, Homo sapiens
cttacctgacg

SEQ ID NO: 578799 - DNA, 12 bp, Homo sapiens
cttacctgacgg

SEQ ID NO: 578800 - DNA, 13 bp, Homo sapiens
cttactttgctga

SEQ ID NO: 578801 - DNA, 21 bp, Homo sapiens
cttatagtctaagactatata

SEQ ID NO: 578802 - DNA, 20 bp, Homo sapiens
cttatcttacaatattgatt

SEQ ID NO: 578803 - DNA, 14 bp, Homo sapiens
cttattgaccattt

SEQ ID NO: 578804 - DNA, 15 bp, Homo sapiens
cttcatctctttaga

SEQ ID NO: 578805 - DNA, 15 bp, Homo sapiens
cttccaggggaacct

SEQ ID NO: 578806 - DNA, 18 bp, Homo sapiens
cttcccatgcattctggt

SEQ ID NO: 578807 - DNA, 18 bp, Homo sapiens
cttcctgtgggccaggag

SEQ ID NO: 578808 - DNA, 15 bp, Homo sapiens
cttctaaatgcatat

SEQ ID NO: 578809 - DNA, 19 bp, Homo sapiens
cttctccctagctcctccc

SEQ ID NO: 578810 - DNA, 18 bp, Homo sapiens
cttctgcaacaagcatgc

SEQ ID NO: 578811 - DNA, 15 bp, Homo sapiens
cttctggtactttct

SEQ ID NO: 578812 - DNA, 23 bp, Homo sapiens
cttgaaactttgggaaaacatgt

SEQ ID NO: 578813 - DNA, 20 bp, Homo sapiens
tataatttaaacgtgatttt

SEQ ID NO: 578814 - DNA, 15 bp, Homo sapiens
tatacatgtgataca

SEQ ID NO: 578815 - DNA, 15 bp, Homo sapiens
tatactatatttttc

SEQ ID NO: 578816 - DNA, 20 bp, Homo sapiens
tatagtaatgtgacttggat

SEQ ID NO: 578817 - DNA, 18 bp, Homo sapiens
tatagtctaagactatat

SEQ ID NO: 578818 - DNA, 12 bp, Homo sapiens
tatataaatgta

SEQ ID NO: 578819 - DNA, 16 bp, Homo sapiens
tatatatataaatgta

SEQ ID NO: 578820 - DNA, 18 bp, Homo sapiens
tatatattttgtgtgaaa

SEQ ID NO: 578821 - DNA, 18 bp, Homo sapiens
tatatgctttattaatgt

SEQ ID NO: 578822 - DNA, 19 bp, Homo sapiens
tatgacggaagaacataga

SEQ ID NO: 578823 - DNA, 21 bp, Homo sapiens
tatgactaaagagagaatgta

SEQ ID NO: 578824 - DNA, 14 bp, Homo sapiens
tatgagattggttt

SEQ ID NO: 578825 - DNA, 13 bp, Homo sapiens
tatgctttattaa

SEQ ID NO: 578826 - DNA, 16 bp, Homo sapiens
tatgtaacaacaatta

SEQ ID NO: 578827 - DNA, 17 bp, Homo sapiens
tatgtaggtaagactgt

SEQ ID NO: 578828 - DNA, 21 bp, Homo sapiens
tatgtaggtaagactgtagat

SEQ ID NO: 578829 - DNA, 15 bp, Homo sapiens
tatgtcagtactatt

SEQ ID NO: 578830 - DNA, 14 bp, Homo sapiens
tatgtgcatttaat

SEQ ID NO: 578831 - DNA, 14 bp, Homo sapiens
tattaaaactaaat

SEQ ID NO: 578832 - DNA, 17 bp, Homo sapiens
tattaatgttttcaaaa

SEQ ID NO: 578833 - DNA, 18 bp, Homo sapiens
tattagttttctttgtaa

SEQ ID NO: 578834 - DNA, 21 bp, Homo sapiens
tattagttttctttgtaaagg

SEQ ID NO: 578835 - DNA, 15 bp, Homo sapiens
tattcagggtaaata

SEQ ID NO: 578836 - DNA, 13 bp, Homo sapiens
tattcttttctca

SEQ ID NO: 578837 - DNA, 15 bp, Homo sapiens
tattgattgggaaaa

SEQ ID NO: 578838 - DNA, 18 bp, Homo sapiens
tattgattgggaaaacat

SEQ ID NO: 578839 - DNA, 19 bp, Homo sapiens
tatttaacaaaatttgaat

SEQ ID NO: 578840 - DNA, 17 bp, Homo sapiens
tatttgaagatttaatt

SEQ ID NO: 578841 - DNA, 20 bp, Homo sapiens
tatttgaagatttaattact

SEQ ID NO: 578842 - DNA, 21 bp, Homo sapiens
tattttgtagcgtacatcaat

SEQ ID NO: 578843 - DNA, 17 bp, Homo sapiens
tcaaaagtgatctgtcc

SEQ ID NO: 578844 - DNA, 13 bp, Homo sapiens
tcaaagttttgtt

SEQ ID NO: 578845 - DNA, 13 bp, Homo sapiens
tcaactttgtaaa

SEQ ID NO: 578846 - DNA, 14 bp, Homo sapiens
tcaactttgtaaaa

SEQ ID NO: 578847 - DNA, 16 bp, Homo sapiens
tcaagccttccaggga

SEQ ID NO: 578848 - DNA, 16 bp, Homo sapiens
tcaagggggactgtct

SEQ ID NO: 578849 - DNA, 18 bp, Homo sapiens
tcaagtaagaagacatga

SEQ ID NO: 578850 - DNA, 16 bp, Homo sapiens
tcaatgaaccataaat

SEQ ID NO: 578851 - DNA, 19 bp, Homo sapiens
tcaatggtttaacatataa

SEQ ID NO: 578852 - DNA, 17 bp, Homo sapiens
tcaattttagttgtcaa

SEQ ID NO: 578853 - DNA, 18 bp, Homo sapiens
tcacagcacttacaattt

SEQ ID NO: 578854 - DNA, 20 bp, Homo sapiens
tcacagcacttacaattttc

SEQ ID NO: 578855 - DNA, 18 bp, Homo sapiens
tcaccatgtgagctcttc

SEQ ID NO: 578856 - DNA, 14 bp, Homo sapiens
tcacctaatgttta

SEQ ID NO: 578857 - DNA, 16 bp, Homo sapiens
tcacttctaaatgcat

SEQ ID NO: 578858 - DNA, 18 bp, Homo sapiens
tcagacaatccactctca

SEQ ID NO: 578859 - DNA, 16 bp, Homo sapiens
tcagccgtgcactccc

SEQ ID NO: 578860 - DNA, 22 bp, Homo sapiens
tcagtaacccccttaaatttaa

SEQ ID NO: 578861 - DNA, 13 bp, Homo sapiens
tcagtatccaggc

SEQ ID NO: 578862 - DNA, 17 bp, Homo sapiens
tcagtatccaggctttg

SEQ ID NO: 578863 - DNA, 16 bp, Homo sapiens
tcagtatgtgggggct

SEQ ID NO: 578864 - DNA, 19 bp, Homo sapiens
tcagtatgtgggggcttca

SEQ ID NO: 578865 - DNA, 14 bp, Homo sapiens
tcagtttgttggaa

SEQ ID NO: 578866 - DNA, 17 bp, Homo sapiens
tcatggaaaagcccagt

SEQ ID NO: 578867 - DNA, 21 bp, Homo sapiens
tcatgtccaaacgtcctcttt

SEQ ID NO: 578868 - DNA, 11 bp, Homo sapiens
tcattgacttt

SEQ ID NO: 578869 - DNA, 16 bp, Homo sapiens
tcattgacttttataa

SEQ ID NO: 578870 - DNA, 24 bp, Homo sapiens
tcattgacttttataaagcatgtt

SEQ ID NO: 578871 - DNA, 23 bp, Homo sapiens
tcattgcacataagcttccattt

SEQ ID NO: 578872 - DNA, 16 bp, Homo sapiens
tccaagcaacagcctt

SEQ ID NO: 578873 - DNA, 19 bp, Homo sapiens
tccaatggctgtaaactat

SEQ ID NO: 578874 - DNA, 12 bp, Homo sapiens
tccactctcagg

SEQ ID NO: 578875 - DNA, 16 bp, Homo sapiens
tccagtctcctgacat

SEQ ID NO: 578876 - DNA, 17 bp, Homo sapiens
tccagtctcctgacatt

SEQ ID NO: 578877 - DNA, 10 bp, Homo sapiens
tccagtgcct

SEQ ID NO: 578878 - DNA, 13 bp, Homo sapiens
tccagtgcctaca

SEQ ID NO: 578879 - DNA, 18 bp, Homo sapiens
tccattaaaacaatttat

SEQ ID NO: 578880 - DNA, 21 bp, Homo sapiens
tcccgcgggcctggacactta

SEQ ID NO: 578881 - DNA, 14 bp, Homo sapiens
tccctctcctaact

SEQ ID NO: 578882 - DNA, 14 bp, Homo sapiens
tcccttctatgcag

SEQ ID NO: 578883 - DNA, 18 bp, Homo sapiens
tccgaccacttccagggg

SEQ ID NO: 578884 - DNA, 23 bp, Homo sapiens
tcctaagtgggaagtgaagcccc

SEQ ID NO: 578885 - DNA, 18 bp, Homo sapiens
tcctattctataaaactc

SEQ ID NO: 578886 - DNA, 21 bp, Homo sapiens
tcctcagggagcagggaaggc

SEQ ID NO: 578887 - DNA, 16 bp, Homo sapiens
tcctccccttcctctt

SEQ ID NO: 578888 - DNA, 19 bp, Homo sapiens
tcctctttagtttttggtt

SEQ ID NO: 578889 - DNA, 12 bp, Homo sapiens
tcctgctggcac

SEQ ID NO: 578890 - DNA, 18 bp, Homo sapiens
tcctgctggcacctcaga

SEQ ID NO: 578891 - DNA, 20 bp, Homo sapiens
tcctgtggcataaattgcat

SEQ ID NO: 578892 - DNA, 21 bp, Homo sapiens
tcctgtgggccaggagctcag

SEQ ID NO: 578893 - DNA, 22 bp, Homo sapiens
tcctgtgggccaggagctcagc

SEQ ID NO: 578894 - DNA, 20 bp, Homo sapiens
tccttaagctgcagagattt

SEQ ID NO: 578895 - DNA, 21 bp, Homo sapiens
tccttcatcgaacaaactgat

SEQ ID NO: 578896 - DNA, 16 bp, Homo sapiens
tccttgagtgtatgag

SEQ ID NO: 578897 - DNA, 20 bp, Homo sapiens
tcgtttttgtattttcatga

SEQ ID NO: 578898 - DNA, 17 bp, Homo sapiens
tctaaaaggtaatgtgt

SEQ ID NO: 578899 - DNA, 18 bp, Homo sapiens
tctaaaaggtaatgtgtg

SEQ ID NO: 578900 - DNA, 21 bp, Homo sapiens
tctaagactatatatataaat

SEQ ID NO: 578901 - DNA, 23 bp, Homo sapiens
tctaagactatatatataaatgt

SEQ ID NO: 578902 - DNA, 12 bp, Homo sapiens
tctaattctgat

SEQ ID NO: 578903 - DNA, 14 bp, Homo sapiens
tctacaatctcttt

SEQ ID NO: 578904 - DNA, 19 bp, Homo sapiens
tctacaatctctttttgtt

SEQ ID NO: 578905 - DNA, 19 bp, Homo sapiens
tctatgcagtattgccaca

SEQ ID NO: 578906 - DNA, 13 bp, Homo sapiens
tctcagtgttggt

SEQ ID NO: 578907 - DNA, 22 bp, Homo sapiens
tctcattgacttttataaagca

SEQ ID NO: 578908 - DNA, 13 bp, Homo sapiens
tctcccctctgcc

SEQ ID NO: 578909 - DNA, 19 bp, Homo sapiens
tctcccgcgggcctggaca

SEQ ID NO: 578910 - DNA, 16 bp, Homo sapiens
tctccctagctcctcc

SEQ ID NO: 578911 - DNA, 12 bp, Homo sapiens
tctccttaagct

SEQ ID NO: 578912 - DNA, 14 bp, Homo sapiens
tctctctctaaggt

SEQ ID NO: 578913 - DNA, 15 bp, Homo sapiens
tctggatccctggag

SEQ ID NO: 578914 - DNA, 22 bp, Homo sapiens
tctgtactaaacagtaagatat

SEQ ID NO: 578915 - DNA, 14 bp, Homo sapiens
tctgtagctcctca

SEQ ID NO: 578916 - DNA, 16 bp, Homo sapiens
tctgtcccctctcccc

SEQ ID NO: 578917 - DNA, 14 bp, Homo sapiens
tcttagtgcctgag

SEQ ID NO: 578918 - DNA, 13 bp, Homo sapiens
tcttcccatgcat

SEQ ID NO: 578919 - DNA, 19 bp, Homo sapiens
tcttcctatccctctccta

SEQ ID NO: 578920 - DNA, 15 bp, Homo sapiens
tcttcttacatgcat

SEQ ID NO: 578921 - DNA, 12 bp, Homo sapiens
tctttagttttt

SEQ ID NO: 578922 - DNA, 19 bp, Homo sapiens
tctttccattatgattctt

SEQ ID NO: 578923 - DNA, 17 bp, Homo sapiens
tctttgtaaaggtcaga

SEQ ID NO: 578924 - DNA, 19 bp, Homo sapiens
tcttttaaagaagtaaatt

SEQ ID NO: 578925 - DNA, 22 bp, Homo sapiens
tcttttaaagaagtaaatttgt

SEQ ID NO: 578926 - DNA, 21 bp, Homo sapiens
tcttttttaaccggtaagagt

SEQ ID NO: 578927 - DNA, 23 bp, Homo sapiens
tcttttttaaccggtaagagttt

SEQ ID NO: 578928 - DNA, 21 bp, Homo sapiens
ttctttggattctaaatacat

SEQ ID NO: 578929 - DNA, 14 bp, Homo sapiens
ttcttttaaagaag

SEQ ID NO: 578930 - DNA, 15 bp, Homo sapiens
ttcttttgtttggta

SEQ ID NO: 578931 - DNA, 17 bp, Homo sapiens
ttgaaaaatataaaatt

SEQ ID NO: 578932 - DNA, 22 bp, Homo sapiens
ttgaaactttgggaaaacatgt

SEQ ID NO: 578933 - DNA, 16 bp, Homo sapiens
ttgaatgcttcctgac

SEQ ID NO: 578934 - DNA, 20 bp, Homo sapiens
ttgagtattgtttaaaatgt

SEQ ID NO: 578935 - DNA, 11 bp, Homo sapiens
ttgatgactgc

SEQ ID NO: 578936 - DNA, 14 bp, Homo sapiens
ttgatgactgcctt

SEQ ID NO: 578937 - DNA, 14 bp, Homo sapiens
ttgatttcaaagtt

SEQ ID NO: 578938 - DNA, 21 bp, Homo sapiens
ttgcatactttgtattttgat

SEQ ID NO: 578939 - DNA, 20 bp, Homo sapiens
ttgcatcactgtatcatttt

SEQ ID NO: 578940 - DNA, 15 bp, Homo sapiens
ttgcatgcatgcaaa

SEQ ID NO: 578941 - DNA, 17 bp, Homo sapiens
ttgcatgcatgcaaatg

SEQ ID NO: 578942 - DNA, 17 bp, Homo sapiens
ttgccacaatgcctctc

SEQ ID NO: 578943 - DNA, 19 bp, Homo sapiens
ttgccacaatgcctctccc

SEQ ID NO: 578944 - DNA, 22 bp, Homo sapiens
ttgccacaatgcctctcccacg

SEQ ID NO: 578945 - DNA, 19 bp, Homo sapiens
ttgctactgttgtaagaat

SEQ ID NO: 578946 - DNA, 20 bp, Homo sapiens
ttgctgccattacagaggta

SEQ ID NO: 578947 - DNA, 15 bp, Homo sapiens
ttgctgctgtccagt

SEQ ID NO: 578948 - DNA, 17 bp, Homo sapiens
ttgctgctgtccagtgc

SEQ ID NO: 578949 - DNA, 16 bp, Homo sapiens
ttgggaaaacatttgc

SEQ ID NO: 578950 - DNA, 20 bp, Homo sapiens
ttgggtgtctccttaagctg

SEQ ID NO: 578951 - DNA, 14 bp, Homo sapiens
ttggtaaatgtttc

SEQ ID NO: 578952 - DNA, 22 bp, Homo sapiens
ttgtaaaaatcttttgaagcat

SEQ ID NO: 578953 - DNA, 18 bp, Homo sapiens
ttgtacaaaattaagcaa

SEQ ID NO: 578954 - DNA, 20 bp, Homo sapiens
ttgtacaaaattaagcaaat

SEQ ID NO: 578955 - DNA, 15 bp, Homo sapiens
ttgtacttaaatggt

SEQ ID NO: 578956 - DNA, 12 bp, Homo sapiens
ttgtcagctact

SEQ ID NO: 578957 - DNA, 19 bp, Homo sapiens
ttgtccaatggctgtaaac

SEQ ID NO: 578958 - DNA, 14 bp, Homo sapiens
ttgtgaagtacata

SEQ ID NO: 578959 - DNA, 19 bp, Homo sapiens
ttgtggggcacagatgcct

SEQ ID NO: 578960 - DNA, 21 bp, Homo sapiens
ttgttacaggcaccgagaatg

SEQ ID NO: 578961 - DNA, 14 bp, Homo sapiens
ttgttgtacttaaa

SEQ ID NO: 578962 - DNA, 12 bp, Homo sapiens
ttgtttggagac

SEQ ID NO: 578963 - DNA, 12 bp, Homo sapiens
tttaaaaaataa

SEQ ID NO: 578964 - DNA, 12 bp, Homo sapiens
tttaaaatgtaa

SEQ ID NO: 578965 - DNA, 18 bp, Homo sapiens
tttaaaatgtaatttaaa

SEQ ID NO: 578966 - DNA, 10 bp, Homo sapiens
tttaaaattt

SEQ ID NO: 578967 - DNA, 19 bp, Homo sapiens
tttaaagaagtaaatttgt

SEQ ID NO: 578968 - DNA, 20 bp, Homo sapiens
tttaaagaagtaaatttgtc

SEQ ID NO: 578969 - DNA, 14 bp, Homo sapiens
tttaaagtgcaaaa

SEQ ID NO: 578970 - DNA, 15 bp, Homo sapiens
tttacttgttttgga

SEQ ID NO: 578971 - DNA, 16 bp, Homo sapiens
tttataaacagaaatg

SEQ ID NO: 578972 - DNA, 17 bp, Homo sapiens
tttataattgtacaaaa

SEQ ID NO: 578973 - DNA, 20 bp, Homo sapiens
tttataattgtacaaaatta

SEQ ID NO: 578974 - DNA, 14 bp, Homo sapiens
tttatcgtttttgt

SEQ ID NO: 578975 - DNA, 12 bp, Homo sapiens
tttatgagccag

SEQ ID NO: 578976 - DNA, 12 bp, Homo sapiens
tttatgtaatta

SEQ ID NO: 578977 - DNA, 20 bp, Homo sapiens
tttcagaaatataacacatt

SEQ ID NO: 578978 - DNA, 22 bp, Homo sapiens
tttcagttctttggattctaaa

SEQ ID NO: 578979 - DNA, 14 bp, Homo sapiens
tttcatgaaaatac

SEQ ID NO: 578980 - DNA, 19 bp, Homo sapiens
tttccacaccatcaccctc

SEQ ID NO: 578981 - DNA, 22 bp, Homo sapiens
tttcctgtggcataaattgcat

SEQ ID NO: 578982 - DNA, 13 bp, Homo sapiens
tttctttgtaaag

SEQ ID NO: 578983 - DNA, 20 bp, Homo sapiens
tttcttttaaagaagtaaat

SEQ ID NO: 578984 - DNA, 13 bp, Homo sapiens
tttgaaaaatata

SEQ ID NO: 578985 - DNA, 17 bp, Homo sapiens
tttgaagatttaattac

SEQ ID NO: 578986 - DNA, 15 bp, Homo sapiens
tttgaatgtaaccaa

SEQ ID NO: 578987 - DNA, 19 bp, Homo sapiens
tttggattctaaatacatg

SEQ ID NO: 578988 - DNA, 21 bp, Homo sapiens
tttgtattttcatgaaaatac

SEQ ID NO: 578989 - DNA, 18 bp, Homo sapiens
tttgttgtacttaaatgg

SEQ ID NO: 578990 - DNA, 17 bp, Homo sapiens
ttttaaagaagtaaatt

SEQ ID NO: 578991 - DNA, 23 bp, Homo sapiens
ttttaaagaccctcctattctat

SEQ ID NO: 578992 - DNA, 13 bp, Homo sapiens
ttttaaagtgcaa

SEQ ID NO: 578993 - DNA, 22 bp, Homo sapiens
ttttaaccggtaagagtttcag

SEQ ID NO: 578994 - DNA, 12 bp, Homo sapiens
ttttataaagca

SEQ ID NO: 578995 - DNA, 17 bp, Homo sapiens
ttttcttaaccatcttt

SEQ ID NO: 578996 - DNA, 22 bp, Homo sapiens
ttttgattattttttttttctt

SEQ ID NO: 578997 - DNA, 19 bp, Homo sapiens
ttttgcatgcatgcaaatg

SEQ ID NO: 578998 - DNA, 21 bp, Homo sapiens
ttttgcatgcatgcaaatgag

SEQ ID NO: 578999 - DNA, 14 bp, Homo sapiens
tttttaaattaaat

SEQ ID NO: 579000 - DNA, 13 bp, Homo sapiens
tttttataattgt

SEQ ID NO: 579001 - DNA, 18 bp, Homo sapiens
tttttataattgtacaaa

SEQ ID NO: 579002 - DNA, 19 bp, Homo sapiens
tttttgcatgcatgcaaat

SEQ ID NO: 579003 - DNA, 12 bp, Homo sapiens
ttttttaagctt

SEQ ID NO: 579004 - DNA, 20 bp, Homo sapiens
acacatttgctactgttgta

SEQ ID NO: 579005 - DNA, 15 bp, Homo sapiens
acaccttttaactca

SEQ ID NO: 579006 - DNA, 13 bp, Homo sapiens
acacttgaaacct

SEQ ID NO: 579007 - DNA, 14 bp, Homo sapiens
acacttgaaacctt

SEQ ID NO: 579008 - DNA, 17 bp, Homo sapiens
acagaaatggaaagcag

SEQ ID NO: 579009 - DNA, 22 bp, Homo sapiens
acagaggtattaaaactaaatt

SEQ ID NO: 579010 - DNA, 18 bp, Homo sapiens
acagataagcaagagaga

SEQ ID NO: 579011 - DNA, 21 bp, Homo sapiens
acagataagcaagagagatgt

SEQ ID NO: 579012 - DNA, 14 bp, Homo sapiens
agatatgtattctt

SEQ ID NO: 579013 - DNA, 19 bp, Homo sapiens
agatccatttccattgctt

SEQ ID NO: 579014 - DNA, 19 bp, Homo sapiens
agatctttcagaaatataa

SEQ ID NO: 579015 - DNA, 21 bp, Homo sapiens
agatgaaataaagacccaggg

SEQ ID NO: 579016 - DNA, 18 bp, Homo sapiens
tataaactactgtaatta

SEQ ID NO: 579017 - DNA, 12 bp, Homo sapiens
tataaatgtata

SEQ ID NO: 579018 - DNA, 22 bp, Homo sapiens
tataacacatttttttgcatgc

SEQ ID NO: 579019 - DNA, 16 bp, Homo sapiens
tataatactaaagtgt

SEQ ID NO: 579020 - DNA, 20 bp, Homo sapiens
tataatactaaagtgtctat

SEQ ID NO: 579021 - DNA, 16 bp, Homo sapiens
tataattgtacaaaat

SEQ ID NO: 579022 - DNA, 22 bp, Homo sapiens
tatacagtatagatttttgggt

SEQ ID NO: 579023 - DNA, 16 bp, Homo sapiens
tatagtctaagactat

SEQ ID NO: 579024 - DNA, 16 bp, Homo sapiens
tatataatactaaagt

SEQ ID NO: 579025 - DNA, 15 bp, Homo sapiens
tatatataaatgtat

SEQ ID NO: 579026 - DNA, 16 bp, Homo sapiens
tatattactgacattt

SEQ ID NO: 579027 - DNA, 23 bp, Homo sapiens
tatattactgacatttcttctag

SEQ ID NO: 579028 - DNA, 13 bp, Homo sapiens
tatcctgagccat

SEQ ID NO: 579029 - DNA, 12 bp, Homo sapiens
tatcgtttttgt

SEQ ID NO: 579030 - DNA, 18 bp, Homo sapiens
tatcgtttttgtattttc

SEQ ID NO: 579031 - DNA, 22 bp, Homo sapiens
tatctcaatgaaccataaattc

SEQ ID NO: 579032 - DNA, 15 bp, Homo sapiens
tatgactaaagagag

SEQ ID NO: 579033 - DNA, 20 bp, Homo sapiens
tatgactaaagagagaatgt

SEQ ID NO: 579034 - DNA, 20 bp, Homo sapiens
tatgagattggttttcctgt

SEQ ID NO: 579035 - DNA, 16 bp, Homo sapiens
tatgagccagacaaat

SEQ ID NO: 579036 - DNA, 17 bp, Homo sapiens
tatgagccagacaaatg

SEQ ID NO: 579037 - DNA, 19 bp, Homo sapiens
tatgagccagacaaatgga

SEQ ID NO: 579038 - DNA, 23 bp, Homo sapiens
tatgggcttttggggagccagaa

SEQ ID NO: 579039 - DNA, 23 bp, Homo sapiens
tatgtaacaacaattatttgaag

SEQ ID NO: 579040 - DNA, 16 bp, Homo sapiens
tatgtagatgtgcatt

SEQ ID NO: 579041 - DNA, 17 bp, Homo sapiens
tatgtagatgtgcattt

SEQ ID NO: 579042 - DNA, 21 bp, Homo sapiens
tatgtgggatattgaatgtta

SEQ ID NO: 579043 - DNA, 21 bp, Homo sapiens
tatgtgggggcttcatctctt

SEQ ID NO: 579044 - DNA, 22 bp, Homo sapiens
atttgtccaatggctgtaaact

SEQ ID NO: 579045 - DNA, 23 bp, Homo sapiens
atttttatgtaattatatatact

SEQ ID NO: 579046 - DNA, 21 bp, Homo sapiens
attttttaagcttcagttgct

SEQ ID NO: 579047 - DNA, 16 bp, Homo sapiens
tgaaccataaattcaa

SEQ ID NO: 579048 - DNA, 21 bp, Homo sapiens
tgaaccataaattcaactttg

SEQ ID NO: 579049 - DNA, 18 bp, Homo sapiens
tgaagccccttgtcctct

SEQ ID NO: 579050 - DNA, 21 bp, Homo sapiens
tgaagccccttgtcctctccc

SEQ ID NO: 579051 - DNA, 22 bp, Homo sapiens
tgaagccccttgtcctctcccg

SEQ ID NO: 579052 - DNA, 20 bp, Homo sapiens
tgaagtacatattaggaaaa

SEQ ID NO: 579053 - DNA, 15 bp, Homo sapiens
tgaatctgttactga

SEQ ID NO: 579054 - DNA, 21 bp, Homo sapiens
tgaatgttaaagggatatttt

SEQ ID NO: 579055 - DNA, 15 bp, Homo sapiens
tgacaatcaactcta

SEQ ID NO: 579056 - DNA, 18 bp, Homo sapiens
tgacaatcaactctaata

SEQ ID NO: 579057 - DNA, 22 bp, Homo sapiens
tgaccattttttaatttacttg

SEQ ID NO: 579058 - DNA, 15 bp, Homo sapiens
tgaccggcacctgcg

SEQ ID NO: 579059 - DNA, 16 bp, Homo sapiens
tgaccggcacctgcga

SEQ ID NO: 579060 - DNA, 22 bp, Homo sapiens
tgacctggcatctaattctgat

SEQ ID NO: 579061 - DNA, 21 bp, Homo sapiens
tgacgatgatgtacagattct

SEQ ID NO: 579062 - DNA, 14 bp, Homo sapiens
tgacggaagaacat

SEQ ID NO: 579063 - DNA, 16 bp, Homo sapiens
tgacggacgtcctgct

SEQ ID NO: 579064 - DNA, 17 bp, Homo sapiens
tgactaaagagagaatg

SEQ ID NO: 579065 - DNA, 20 bp, Homo sapiens
tgactaactcaaatacacat

SEQ ID NO: 579066 - DNA, 23 bp, Homo sapiens
tgactaactcaaatacacatttg

SEQ ID NO: 579067 - DNA, 14 bp, Homo sapiens
tgactgccttgcct

SEQ ID NO: 579068 - DNA, 21 bp, Homo sapiens
tgagactctagggtccagtgg

SEQ ID NO: 579069 - DNA, 14 bp, Homo sapiens
tgagccagacaaat

SEQ ID NO: 579070 - DNA, 20 bp, Homo sapiens
tgagccagacaaatggagga

SEQ ID NO: 579071 - DNA, 16 bp, Homo sapiens
tgagctctgaaatctt

SEQ ID NO: 579072 - DNA, 17 bp, Homo sapiens
tgagctctgaaatcttc

SEQ ID NO: 579073 - DNA, 16 bp, Homo sapiens
tgaggagagaaggaca

SEQ ID NO: 579074 - DNA, 21 bp, Homo sapiens
tgagtattgtttaaaatgtaa

SEQ ID NO: 579075 - DNA, 18 bp, Homo sapiens
tgagtccttgatttcaaa

SEQ ID NO: 579076 - DNA, 21 bp, Homo sapiens
tgagtctgtactaaacagtaa

SEQ ID NO: 579077 - DNA, 19 bp, Homo sapiens
tgatctgtcccctctcccc

SEQ ID NO: 579078 - DNA, 16 bp, Homo sapiens
tgatgcgaaaacttga

SEQ ID NO: 579079 - DNA, 14 bp, Homo sapiens
tgattctttgttac

SEQ ID NO: 579080 - DNA, 17 bp, Homo sapiens
tgattgggaaaacattt

SEQ ID NO: 579081 - DNA, 21 bp, Homo sapiens
tgcaaatgagctctgaaatct

SEQ ID NO: 579082 - DNA, 15 bp, Homo sapiens
tgcaataaaatttaa

SEQ ID NO: 579083 - DNA, 19 bp, Homo sapiens
tgcactccctaagaaaccc

SEQ ID NO: 579084 - DNA, 19 bp, Homo sapiens
tgcacttattgaccatttt

SEQ ID NO: 579085 - DNA, 15 bp, Homo sapiens
tgcagctttgcaaac

SEQ ID NO: 579086 - DNA, 16 bp, Homo sapiens
tgcagtattgccacaa

SEQ ID NO: 579087 - DNA, 19 bp, Homo sapiens
tgcataataagctaaagag

SEQ ID NO: 579088 - DNA, 22 bp, Homo sapiens
tgcataataagctaaagaggct

SEQ ID NO: 579089 - DNA, 24 bp, Homo sapiens
tgcataataagctaaagaggctga

SEQ ID NO: 579090 - DNA, 13 bp, Homo sapiens
tgcatactttgta

SEQ ID NO: 579091 - DNA, 20 bp, Homo sapiens
tgcatactttgtattttgat

SEQ ID NO: 579092 - DNA, 21 bp, Homo sapiens
tgcatcactgtatcattttct

SEQ ID NO: 579093 - DNA, 18 bp, Homo sapiens
tgcatgcatgcaaatgag

SEQ ID NO: 579094 - DNA, 16 bp, Homo sapiens
tgcatttggtcaagat

SEQ ID NO: 579095 - DNA, 14 bp, Homo sapiens
tgcatttttgtgaa

SEQ ID NO: 579096 - DNA, 19 bp, Homo sapiens
tgccacaatgcctctccca

SEQ ID NO: 579097 - DNA, 22 bp, Homo sapiens
tgccacatcaaacctttgagta

SEQ ID NO: 579098 - DNA, 21 bp, Homo sapiens
tgccagccccctaaaagcact

SEQ ID NO: 579099 - DNA, 22 bp, Homo sapiens
tgccagccccctaaaagcactc

SEQ ID NO: 579100 - DNA, 20 bp, Homo sapiens
tgccaggacatgcaataaaa

SEQ ID NO: 579101 - DNA, 23 bp, Homo sapiens
tgccaggacatgcaataaaattt

SEQ ID NO: 579102 - DNA, 22 bp, Homo sapiens
tgccatggctaggtagaagtga

SEQ ID NO: 579103 - DNA, 17 bp, Homo sapiens
tgccctgtatataatac

SEQ ID NO: 579104 - DNA, 19 bp, Homo sapiens
tgccctgtatataatacta

SEQ ID NO: 579105 - DNA, 18 bp, Homo sapiens
tgcctacatcccgggcct

SEQ ID NO: 579106 - DNA, 23 bp, Homo sapiens
tgcctacatcccgggcctcagtg

SEQ ID NO: 579107 - DNA, 23 bp, Homo sapiens
tgcctcaccttggggccttgatg

SEQ ID NO: 579108 - DNA, 13 bp, Homo sapiens
tgccttgcctcct

SEQ ID NO: 579109 - DNA, 17 bp, Homo sapiens
tgccttgcctcctcagt

SEQ ID NO: 579110 - DNA, 21 bp, Homo sapiens
tgcgaaaacttgaatctgtta

SEQ ID NO: 579111 - DNA, 21 bp, Homo sapiens
tgctactgttgtaagaattct

SEQ ID NO: 579112 - DNA, 23 bp, Homo sapiens
tgctactgttgtaagaattctga

SEQ ID NO: 579113 - DNA, 14 bp, Homo sapiens
tgctattgaactga

SEQ ID NO: 579114 - DNA, 17 bp, Homo sapiens
tgctgagggtttgaata

SEQ ID NO: 579115 - DNA, 18 bp, Homo sapiens
tgctggcatcaagaggtg

SEQ ID NO: 579116 - DNA, 14 bp, Homo sapiens
tgctgtccagtgcc

SEQ ID NO: 579117 - DNA, 17 bp, Homo sapiens
tgcttaaaaatcattga

SEQ ID NO: 579118 - DNA, 21 bp, Homo sapiens
tgcttaaaccacttaaacgaa

SEQ ID NO: 579119 - DNA, 13 bp, Homo sapiens
tgcttacctgacg

SEQ ID NO: 579120 - DNA, 17 bp, Homo sapiens
tgcttattatgtaggta

SEQ ID NO: 579121 - DNA, 15 bp, Homo sapiens
tgcttcccttacttt

SEQ ID NO: 579122 - DNA, 22 bp, Homo sapiens
tgcttgtcttctggtactttct

SEQ ID NO: 579123 - DNA, 15 bp, Homo sapiens
tgctttattaatgtt

SEQ ID NO: 579124 - DNA, 17 bp, Homo sapiens
tgctttattaatgtttt

SEQ ID NO: 579125 - DNA, 15 bp, Homo sapiens
ttgtttaaaatgtaa

SEQ ID NO: 579126 - DNA, 21 bp, Homo sapiens
ttgtttaaaatgtaatttaaa

SEQ ID NO: 579127 - DNA, 13 bp, Homo sapiens
ttgtttgccagga

SEQ ID NO: 579128 - DNA, 21 bp, Homo sapiens
ttgtttggagacgtttataaa

SEQ ID NO: 579129 - DNA, 22 bp, Homo sapiens
tttaaaaaataaataaaaacta

SEQ ID NO: 579130 - DNA, 21 bp, Homo sapiens
tttaaaatgtaatttaaatga

SEQ ID NO: 579131 - DNA, 23 bp, Homo sapiens
tttaaaatgtaatttaaatgaaa

SEQ ID NO: 579132 - DNA, 17 bp, Homo sapiens
tttaaaattttgtatgt

SEQ ID NO: 579133 - DNA, 12 bp, Homo sapiens
tttaaagaagta

SEQ ID NO: 579134 - DNA, 14 bp, Homo sapiens
tttaaagaagtaaa

SEQ ID NO: 579135 - DNA, 16 bp, Homo sapiens
tttaaataaaaccctt

SEQ ID NO: 579136 - DNA, 12 bp, Homo sapiens
tttaacaaaatt

SEQ ID NO: 579137 - DNA, 18 bp, Homo sapiens
tttaagccttcaaaacta

SEQ ID NO: 579138 - DNA, 19 bp, Homo sapiens
tttaaggcatatttaacaa

SEQ ID NO: 579139 - DNA, 12 bp, Homo sapiens
tttaatccagtt

SEQ ID NO: 579140 - DNA, 23 bp, Homo sapiens
tttactgtctattaatattcagg

SEQ ID NO: 579141 - DNA, 23 bp, Homo sapiens
tttataaacagaaatggaaagca

SEQ ID NO: 579142 - DNA, 18 bp, Homo sapiens
tttatattactgacattt

SEQ ID NO: 579143 - DNA, 19 bp, Homo sapiens
tttatgagccagacaaatg

SEQ ID NO: 579144 - DNA, 15 bp, Homo sapiens
tttatgtaattatat

SEQ ID NO: 579145 - DNA, 20 bp, Homo sapiens
tttcaaaaggtattatacat

SEQ ID NO: 579146 - DNA, 12 bp, Homo sapiens
tttcaaagtttt

SEQ ID NO: 579147 - DNA, 20 bp, Homo sapiens
tttcaaagttttgttgtact

SEQ ID NO: 579148 - DNA, 21 bp, Homo sapiens
tttcaaagttttgttgtactt

SEQ ID NO: 579149 - DNA, 14 bp, Homo sapiens
tttcagaaatataa

SEQ ID NO: 579150 - DNA, 22 bp, Homo sapiens
tttcagaaatataacacatttt

SEQ ID NO: 579151 - DNA, 17 bp, Homo sapiens
tttcatgaaaataccat

SEQ ID NO: 579152 - DNA, 19 bp, Homo sapiens
tttcatgaaaataccattt

SEQ ID NO: 579153 - DNA, 20 bp, Homo sapiens
tttcatggctgctgttgctt

SEQ ID NO: 579154 - DNA, 14 bp, Homo sapiens
tttccacaccatca

SEQ ID NO: 579155 - DNA, 20 bp, Homo sapiens
tttcccctctgtgtcctctc

SEQ ID NO: 579156 - DNA, 14 bp, Homo sapiens
tttcttaaccatct

SEQ ID NO: 579157 - DNA, 15 bp, Homo sapiens
tttctttgtaaaggt

SEQ ID NO: 579158 - DNA, 21 bp, Homo sapiens
tttgaaaaatataaaattatg

SEQ ID NO: 579159 - DNA, 13 bp, Homo sapiens
tttgaatgtaacc

SEQ ID NO: 579160 - DNA, 23 bp, Homo sapiens
tttgaggtcaagtaagaagacat

SEQ ID NO: 579161 - DNA, 13 bp, Homo sapiens
tttgcatgcatgc

SEQ ID NO: 579162 - DNA, 20 bp, Homo sapiens
tttgcatgcatgcaaatgag

SEQ ID NO: 579163 - DNA, 17 bp, Homo sapiens
tttgccaggacatgcaa

SEQ ID NO: 579164 - DNA, 17 bp, Homo sapiens
tttgcctcaccttgggg

SEQ ID NO: 579165 - DNA, 21 bp, Homo sapiens
tttgctactgttgtaagaatt

SEQ ID NO: 579166 - DNA, 15 bp, Homo sapiens
tttggattctaaata

SEQ ID NO: 579167 - DNA, 13 bp, Homo sapiens
tttggtaaatgtt

SEQ ID NO: 579168 - DNA, 16 bp, Homo sapiens
tttggtaaatgtttct

SEQ ID NO: 579169 - DNA, 16 bp, Homo sapiens
tttgtatgttaaagag

SEQ ID NO: 579170 - DNA, 22 bp, Homo sapiens
tttgtccaatggctgtaaacta

SEQ ID NO: 579171 - DNA, 14 bp, Homo sapiens
ttttaaagtgcaaa

SEQ ID NO: 579172 - DNA, 18 bp, Homo sapiens
ttttaatttacttgtttt

SEQ ID NO: 579173 - DNA, 16 bp, Homo sapiens
ttttataattgtacaa

SEQ ID NO: 579174 - DNA, 13 bp, Homo sapiens
ttttatatgcttt

SEQ ID NO: 579175 - DNA, 16 bp, Homo sapiens
tgtatgagtagccagg

SEQ ID NO: 579176 - DNA, 17 bp, Homo sapiens
tgtatgagtagccaggg

SEQ ID NO: 579177 - DNA, 15 bp, Homo sapiens
tgtatgttaaagaga

SEQ ID NO: 579178 - DNA, 22 bp, Homo sapiens
tgtatgttaaagagaatgagtc

SEQ ID NO: 579179 - DNA, 17 bp, Homo sapiens
tgtcagtactattcagg

SEQ ID NO: 579180 - DNA, 15 bp, Homo sapiens
tgtcatggaaaagcc

SEQ ID NO: 579181 - DNA, 17 bp, Homo sapiens
tgtcatggaaaagccca

SEQ ID NO: 579182 - DNA, 18 bp, Homo sapiens
tgtcatggaaaagcccag

SEQ ID NO: 579183 - DNA, 12 bp, Homo sapiens
tgtcctcaggga

SEQ ID NO: 579184 - DNA, 17 bp, Homo sapiens
tgtctccttaagctgca

SEQ ID NO: 579185 - DNA, 13 bp, Homo sapiens
tgtctgatttctt

SEQ ID NO: 579186 - DNA, 14 bp, Homo sapiens
tgtgaaatgaaaac

SEQ ID NO: 579187 - DNA, 15 bp, Homo sapiens
tgtgagctcttccta

SEQ ID NO: 579188 - DNA, 17 bp, Homo sapiens
tgtgggatattgaatgt

SEQ ID NO: 579189 - DNA, 13 bp, Homo sapiens
tgtgggggcttca

SEQ ID NO: 579190 - DNA, 15 bp, Homo sapiens
tgtgggggcttcatc

SEQ ID NO: 579191 - DNA, 16 bp, Homo sapiens
tgtgggggcttcatct

SEQ ID NO: 579192 - DNA, 12 bp, Homo sapiens
tgtgtgtgtgtg

SEQ ID NO: 579193 - DNA, 12 bp, Homo sapiens
tgttaaagagaa

SEQ ID NO: 579194 - DNA, 21 bp, Homo sapiens
tgttacaggcaccgagaatgt

SEQ ID NO: 579195 - DNA, 23 bp, Homo sapiens
tgttacaggcaccgagaatgttg

SEQ ID NO: 579196 - DNA, 15 bp, Homo sapiens
tgttactgaaatgag

SEQ ID NO: 579197 - DNA, 22 bp, Homo sapiens
tgttccgaaaccaaagaagaaa

SEQ ID NO: 579198 - DNA, 13 bp, Homo sapiens
tgttggaaagtaa

SEQ ID NO: 579199 - DNA, 14 bp, Homo sapiens
tgtttaaaatgtaa

SEQ ID NO: 579200 - DNA, 20 bp, Homo sapiens
tgtttaaaatgtaatttaaa

SEQ ID NO: 579201 - DNA, 15 bp, Homo sapiens
tgtttacctttctct

SEQ ID NO: 579202 - DNA, 16 bp, Homo sapiens
tgtttacctttctctc

SEQ ID NO: 579203 - DNA, 14 bp, Homo sapiens
tgtttatgagccag

SEQ ID NO: 579204 - DNA, 19 bp, Homo sapiens
tgtttggagacgtttataa

SEQ ID NO: 579205 - DNA, 11 bp, Homo sapiens
tgttttccaca

SEQ ID NO: 579206 - DNA, 13 bp, Homo sapiens
ttaaaatgtaatt

SEQ ID NO: 579207 - DNA, 19 bp, Homo sapiens
ttaaacgaagagttccctt

SEQ ID NO: 579208 - DNA, 15 bp, Homo sapiens
ttaaagagaatgagt

SEQ ID NO: 579209 - DNA, 21 bp, Homo sapiens
ttaaccggtaagagtttcagt

SEQ ID NO: 579210 - DNA, 23 bp, Homo sapiens
ttaagctgcagagatttctcatt

SEQ ID NO: 579211 - DNA, 21 bp, Homo sapiens
ttaagggatggaaaaggaaga

SEQ ID NO: 579212 - DNA, 15 bp, Homo sapiens
ttaatgttttcaaaa

SEQ ID NO: 579213 - DNA, 19 bp, Homo sapiens
ttaccttttttttttcttg

SEQ ID NO: 579214 - DNA, 19 bp, Homo sapiens
ttactgtctattaatattc

SEQ ID NO: 579215 - DNA, 18 bp, Homo sapiens
ttagtatgtgcatttaat

SEQ ID NO: 579216 - DNA, 14 bp, Homo sapiens
ttagttttctttgt

SEQ ID NO: 579217 - DNA, 21 bp, Homo sapiens
ttagttttctttgtaaaggtc

SEQ ID NO: 579218 - DNA, 13 bp, Homo sapiens
ttataaacagaaa

SEQ ID NO: 579219 - DNA, 18 bp, Homo sapiens
ttataagaagaagttcat

SEQ ID NO: 579220 - DNA, 21 bp, Homo sapiens
ttataagaagaagttcatgtc

SEQ ID NO: 579221 - DNA, 20 bp, Homo sapiens
ttatcttacaatattgattg

SEQ ID NO: 579222 - DNA, 14 bp, Homo sapiens
ttatgtaattatat

SEQ ID NO: 579223 - DNA, 16 bp, Homo sapiens
ttattaatgttttcaa

SEQ ID NO: 579224 - DNA, 14 bp, Homo sapiens
ttatttttataatt

SEQ ID NO: 579225 - DNA, 18 bp, Homo sapiens
ttatttttataattgtac

SEQ ID NO: 579226 - DNA, 21 bp, Homo sapiens
ttatttttataattgtacaaa

SEQ ID NO: 579227 - DNA, 20 bp, Homo sapiens
ttcaaaaggtattatacatg

SEQ ID NO: 579228 - DNA, 16 bp, Homo sapiens
ttcaaagttttgttgt

SEQ ID NO: 579229 - DNA, 20 bp, Homo sapiens
ttcaattttaaggcatattt

SEQ ID NO: 579230 - DNA, 13 bp, Homo sapiens
aactaaatttcac

SEQ ID NO: 579231 - DNA, 17 bp, Homo sapiens
aactcacctaatgttta

SEQ ID NO: 579232 - DNA, 21 bp, Homo sapiens
aactcacctaatgtttatgag

SEQ ID NO: 579233 - DNA, 17 bp, Homo sapiens
aactcacctctcaaggt

SEQ ID NO: 579234 - DNA, 15 bp, Homo sapiens
aactctgcatgtaga

SEQ ID NO: 579235 - DNA, 21 bp, Homo sapiens
aactgagccaaacacactgta

SEQ ID NO: 579236 - DNA, 23 bp, Homo sapiens
aactgagccaaacacactgtaaa

SEQ ID NO: 579237 - DNA, 24 bp, Homo sapiens
aactgagccaaacacactgtaaat

SEQ ID NO: 579238 - DNA, 22 bp, Homo sapiens
aactgcttcccttactttgctg

SEQ ID NO: 579239 - DNA, 16 bp, Homo sapiens
aacttgaatctgttac

SEQ ID NO: 579240 - DNA, 22 bp, Homo sapiens
aactttgggaaaacatgttaat

SEQ ID NO: 579241 - DNA, 16 bp, Homo sapiens
aagaacatagaactct

SEQ ID NO: 579242 - DNA, 13 bp, Homo sapiens
aagaagaagttca

SEQ ID NO: 579243 - DNA, 16 bp, Homo sapiens
aagaagacatgaacca

SEQ ID NO: 579244 - DNA, 19 bp, Homo sapiens
aagaattctgattgatttg

SEQ ID NO: 579245 - DNA, 20 bp, Homo sapiens
aagaattctgattgatttga

SEQ ID NO: 579246 - DNA, 22 bp, Homo sapiens
aagacacacctctggatccctg

SEQ ID NO: 579247 - DNA, 13 bp, Homo sapiens
aagacatgaacca

SEQ ID NO: 579248 - DNA, 21 bp, Homo sapiens
aagactatatatataaatgta

SEQ ID NO: 579249 - DNA, 16 bp, Homo sapiens
aagactgtagatatgt

SEQ ID NO: 579250 - DNA, 11 bp, Homo sapiens
aagagaatgag

SEQ ID NO: 579251 - DNA, 12 bp, Homo sapiens
aagagagaatgt

SEQ ID NO: 579252 - DNA, 15 bp, Homo sapiens
aagagataagtcttt

SEQ ID NO: 579253 - DNA, 15 bp, Homo sapiens
aagaggaagcaagaa

SEQ ID NO: 579254 - DNA, 15 bp, Homo sapiens
aagaggccaatgccc

SEQ ID NO: 579255 - DNA, 20 bp, Homo sapiens
aagagttcccttgaaacttt

SEQ ID NO: 579256 - DNA, 21 bp, Homo sapiens
aagagtttcagtttgttggaa

SEQ ID NO: 579257 - DNA, 17 bp, Homo sapiens
aagattttgaatgcttc

SEQ ID NO: 579258 - DNA, 17 bp, Homo sapiens
aagcaaatgttaaaagt

SEQ ID NO: 579259 - DNA, 19 bp, Homo sapiens
aagcaacagcctttgaatg

SEQ ID NO: 579260 - DNA, 20 bp, Homo sapiens
aagcaacagcctttgaatgt

SEQ ID NO: 579261 - DNA, 14 bp, Homo sapiens
aagcagagttttca

SEQ ID NO: 579262 - DNA, 15 bp, Homo sapiens
aagcagagttttcat

SEQ ID NO: 579263 - DNA, 22 bp, Homo sapiens
aagcatagataatattgtttgg

SEQ ID NO: 579264 - DNA, 17 bp, Homo sapiens
aagcccagtttcccttc

SEQ ID NO: 579265 - DNA, 14 bp, Homo sapiens
aagccttagggaag

SEQ ID NO: 579266 - DNA, 13 bp, Homo sapiens
acccattcagaga

SEQ ID NO: 579267 - DNA, 21 bp, Homo sapiens
accctctgggcagctgtcatg

SEQ ID NO: 579268 - DNA, 17 bp, Homo sapiens
accctgttttccacacc

SEQ ID NO: 579269 - DNA, 19 bp, Homo sapiens
accctgttttccacaccat

SEQ ID NO: 579270 - DNA, 12 bp, Homo sapiens
acctaatgttta

SEQ ID NO: 579271 - DNA, 15 bp, Homo sapiens
acctcctcatggcag

SEQ ID NO: 579272 - DNA, 19 bp, Homo sapiens
acctgccatgccaggaacc

SEQ ID NO: 579273 - DNA, 21 bp, Homo sapiens
acctggcatctaattctgatt

SEQ ID NO: 579274 - DNA, 16 bp, Homo sapiens
accttccttcctgctt

SEQ ID NO: 579275 - DNA, 22 bp, Homo sapiens
accttggggccttgatgactgc

SEQ ID NO: 579276 - DNA, 13 bp, Homo sapiens
acctttctctctc

SEQ ID NO: 579277 - DNA, 14 bp, Homo sapiens
accttttaactcac

SEQ ID NO: 579278 - DNA, 24 bp, Homo sapiens
acctttttttatcgtttttgtatt

SEQ ID NO: 579279 - DNA, 15 bp, Homo sapiens
acgatgtcaaggact

SEQ ID NO: 579280 - DNA, 20 bp, Homo sapiens
acgtcctgctggcacctcag

SEQ ID NO: 579281 - DNA, 23 bp, Homo sapiens
acgtcctgctggcacctcagaca

SEQ ID NO: 579282 - DNA, 16 bp, Homo sapiens
acgtgatttttaaatt

SEQ ID NO: 579283 - DNA, 11 bp, Homo sapiens
acgtttataaa

SEQ ID NO: 579284 - DNA, 16 bp, Homo sapiens
actaaacatgtatgta

SEQ ID NO: 579285 - DNA, 12 bp, Homo sapiens
actaaagagaga

SEQ ID NO: 579286 - DNA, 15 bp, Homo sapiens
actaataaaccagtt

SEQ ID NO: 579287 - DNA, 21 bp, Homo sapiens
actaccagctaactccagtct

SEQ ID NO: 579288 - DNA, 15 bp, Homo sapiens
actataaactactgt

SEQ ID NO: 579289 - DNA, 20 bp, Homo sapiens
actatagcttgcagaactgt

SEQ ID NO: 579290 - DNA, 15 bp, Homo sapiens
actcaaatacacatt

SEQ ID NO: 579291 - DNA, 19 bp, Homo sapiens
actcaaatacacatttgct

SEQ ID NO: 579292 - DNA, 17 bp, Homo sapiens
actcacctaatgtttat

SEQ ID NO: 579293 - DNA, 20 bp, Homo sapiens
actccagtctcctgacatta

SEQ ID NO: 579294 - DNA, 13 bp, Homo sapiens
actcctgcttaat

SEQ ID NO: 579295 - DNA, 21 bp, Homo sapiens
actcctgtctgtcctggaggt

SEQ ID NO: 579296 - DNA, 13 bp, Homo sapiens
actctcaggaggc

SEQ ID NO: 579297 - DNA, 14 bp, Homo sapiens
actctgcatgtaga

SEQ ID NO: 579298 - DNA, 20 bp, Homo sapiens
actctgcatgtagaggcttg

SEQ ID NO: 579299 - DNA, 20 bp, Homo sapiens
actgaaagccttagggaagc

SEQ ID NO: 579300 - DNA, 24 bp, Homo sapiens
actgagccaaacacactgtaaata

SEQ ID NO: 579301 - DNA, 22 bp, Homo sapiens
actgatgcgaaaacttgaatct

SEQ ID NO: 579302 - DNA, 23 bp, Homo sapiens
actgatgcgaaaacttgaatctg

SEQ ID NO: 579303 - DNA, 14 bp, Homo sapiens
actgcagggttcaa

SEQ ID NO: 579304 - DNA, 18 bp, Homo sapiens
actgccttgcctcctcag

SEQ ID NO: 579305 - DNA, 21 bp, Homo sapiens
actgcttcccttactttgctg

SEQ ID NO: 579306 - DNA, 14 bp, Homo sapiens
actggcagcatctt

SEQ ID NO: 579307 - DNA, 18 bp, Homo sapiens
actggcttacctcctcat

SEQ ID NO: 579308 - DNA, 15 bp, Homo sapiens
actggggagtctttg

SEQ ID NO: 579309 - DNA, 19 bp, Homo sapiens
actgtaattaagtgcaatt

SEQ ID NO: 579310 - DNA, 19 bp, Homo sapiens
acttaaatggtaataagca

SEQ ID NO: 579311 - DNA, 16 bp, Homo sapiens
acttccaggggaacct

SEQ ID NO: 579312 - DNA, 21 bp, Homo sapiens
acttccaggggaacctgccat

SEQ ID NO: 579313 - DNA, 14 bp, Homo sapiens
acttgaatctgtta

SEQ ID NO: 579314 - DNA, 20 bp, Homo sapiens
acttgaatctgttactgaaa

SEQ ID NO: 579315 - DNA, 18 bp, Homo sapiens
acttggattcaattttaa

SEQ ID NO: 579316 - DNA, 14 bp, Homo sapiens
actttctgttatgg

SEQ ID NO: 579317 - DNA, 18 bp, Homo sapiens
actttctgttatgggctt

SEQ ID NO: 579318 - DNA, 19 bp, Homo sapiens
actttgggattctttccat

SEQ ID NO: 579319 - DNA, 13 bp, Homo sapiens
agaaaccccaggg

SEQ ID NO: 579320 - DNA, 17 bp, Homo sapiens
agaaataatgctacaat

SEQ ID NO: 579321 - DNA, 19 bp, Homo sapiens
agaaatataacacattttt

SEQ ID NO: 579322 - DNA, 16 bp, Homo sapiens
agaagacatgaaccaa

SEQ ID NO: 579323 - DNA, 20 bp, Homo sapiens
agaagtaagaggctacctct

SEQ ID NO: 579324 - DNA, 17 bp, Homo sapiens
agaataccacatcaaat

SEQ ID NO: 579325 - DNA, 22 bp, Homo sapiens
agaatgagtccttgatttcaaa

SEQ ID NO: 579326 - DNA, 19 bp, Homo sapiens
agaatgttgtattcagtga

SEQ ID NO: 579327 - DNA, 18 bp, Homo sapiens
agaattctgattgatttg

SEQ ID NO: 579328 - DNA, 14 bp, Homo sapiens
agacaaatggagga

SEQ ID NO: 579329 - DNA, 18 bp, Homo sapiens
agacaaatggaggaatat

SEQ ID NO: 579330 - DNA, 18 bp, Homo sapiens
agacaatccactctcagg

SEQ ID NO: 579331 - DNA, 20 bp, Homo sapiens
agaccacagggttcaaaatg

SEQ ID NO: 579332 - DNA, 21 bp, Homo sapiens
agaccacagggttcaaaatgt

SEQ ID NO: 579333 - DNA, 19 bp, Homo sapiens
agactatatatataaatgt

SEQ ID NO: 579334 - DNA, 17 bp, Homo sapiens
catcccgggcctcagtg

SEQ ID NO: 579335 - DNA, 19 bp, Homo sapiens
catcgaacaaactgatgcg

SEQ ID NO: 579336 - DNA, 13 bp, Homo sapiens
catctatctagtt

SEQ ID NO: 579337 - DNA, 14 bp, Homo sapiens
catctctttagaga

SEQ ID NO: 579338 - DNA, 14 bp, Homo sapiens
catcttcacttcta

SEQ ID NO: 579339 - DNA, 21 bp, Homo sapiens
catcttcacttctaaatgcat

SEQ ID NO: 579340 - DNA, 13 bp, Homo sapiens
catgaaaaagcag

SEQ ID NO: 579341 - DNA, 18 bp, Homo sapiens
catgaaaaagcagctacc

SEQ ID NO: 579342 - DNA, 19 bp, Homo sapiens
catgaaaaagcagctacca

SEQ ID NO: 579343 - DNA, 22 bp, Homo sapiens
catgatcttgagatttctttta

SEQ ID NO: 579344 - DNA, 22 bp, Homo sapiens
catgcaaatgagctctgaaatc

SEQ ID NO: 579345 - DNA, 14 bp, Homo sapiens
catgcaataaaatt

SEQ ID NO: 579346 - DNA, 18 bp, Homo sapiens
catgcaataaaatttaaa

SEQ ID NO: 579347 - DNA, 14 bp, Homo sapiens
catgcatgcaaatg

SEQ ID NO: 579348 - DNA, 17 bp, Homo sapiens
catgcatttgaggtcaa

SEQ ID NO: 579349 - DNA, 13 bp, Homo sapiens
catgccaggaacc

SEQ ID NO: 579350 - DNA, 19 bp, Homo sapiens
catgccaggaacctgtcct

SEQ ID NO: 579351 - DNA, 17 bp, Homo sapiens
catggaaaagcccagtg

SEQ ID NO: 579352 - DNA, 22 bp, Homo sapiens
catgtatgtaaatagctaagat

SEQ ID NO: 579353 - DNA, 15 bp, Homo sapiens
catgtatttgagcat

SEQ ID NO: 579354 - DNA, 13 bp, Homo sapiens
catgtgaagaggg

SEQ ID NO: 579355 - DNA, 21 bp, Homo sapiens
catgtgagtgacgatgatgta

SEQ ID NO: 579356 - DNA, 12 bp, Homo sapiens
cattcagaaatg

SEQ ID NO: 579357 - DNA, 15 bp, Homo sapiens
cattcagaaatgttg

SEQ ID NO: 579358 - DNA, 20 bp, Homo sapiens
cattcctaacacagcatgtg

SEQ ID NO: 579359 - DNA, 13 bp, Homo sapiens
cattctcactgct

SEQ ID NO: 579360 - DNA, 16 bp, Homo sapiens
cattgacttttataaa

SEQ ID NO: 579361 - DNA, 18 bp, Homo sapiens
cattgacttttataaagc

SEQ ID NO: 579362 - DNA, 10 bp, Homo sapiens
cattgagtat

SEQ ID NO: 579363 - DNA, 17 bp, Homo sapiens
cattgattgtcagctac

SEQ ID NO: 579364 - DNA, 21 bp, Homo sapiens
cattgcacataagcttccatt

SEQ ID NO: 579365 - DNA, 21 bp, Homo sapiens
catttcattcctaacacagca

SEQ ID NO: 579366 - DNA, 22 bp, Homo sapiens
catttgctactgttgtaagaat

SEQ ID NO: 579367 - DNA, 16 bp, Homo sapiens
ccaaacacactgtaaa

SEQ ID NO: 579368 - DNA, 16 bp, Homo sapiens
ccaatcctactaataa

SEQ ID NO: 579369 - DNA, 20 bp, Homo sapiens
ccacaccatcaccctctggg

SEQ ID NO: 579370 - DNA, 16 bp, Homo sapiens
ccacacttgaaacctt

SEQ ID NO: 579371 - DNA, 16 bp, Homo sapiens
ccacatcaaataagaa

SEQ ID NO: 579372 - DNA, 20 bp, Homo sapiens
ccacgatgtcaaggactcct

SEQ ID NO: 579373 - DNA, 13 bp, Homo sapiens
ccactctcaggag

SEQ ID NO: 579374 - DNA, 13 bp, Homo sapiens
ccacttccagggg

SEQ ID NO: 579375 - DNA, 16 bp, Homo sapiens
ccagatctttcagaaa

SEQ ID NO: 579376 - DNA, 19 bp, Homo sapiens
ccagcctcgttggaagagg

SEQ ID NO: 579377 - DNA, 23 bp, Homo sapiens
ccagctaactccagtctcctgac

SEQ ID NO: 579378 - DNA, 14 bp, Homo sapiens
ccaggagctcagcc

SEQ ID NO: 579379 - DNA, 17 bp, Homo sapiens
ccagggatttgcctcac

SEQ ID NO: 579380 - DNA, 13 bp, Homo sapiens
ccaggggaacctg

SEQ ID NO: 579381 - DNA, 16 bp, Homo sapiens
ccaggggaacctgcca

SEQ ID NO: 579382 - DNA, 14 bp, Homo sapiens
ccagtgacctgacc

SEQ ID NO: 579383 - DNA, 18 bp, Homo sapiens
ccagtgacctgaccggca

SEQ ID NO: 579384 - DNA, 14 bp, Homo sapiens
ccagtgcctacatc

SEQ ID NO: 579385 - DNA, 19 bp, Homo sapiens
ccagtggatgccacagccc

SEQ ID NO: 579386 - DNA, 21 bp, Homo sapiens
ccagtggatgccacagcccag

SEQ ID NO: 579387 - DNA, 21 bp, Homo sapiens
ccatcaccctctgggcagctg

SEQ ID NO: 579388 - DNA, 17 bp, Homo sapiens
ccatgaggaaggaacag

SEQ ID NO: 579389 - DNA, 22 bp, Homo sapiens
ccattacagaggtattaaaact

SEQ ID NO: 579390 - DNA, 16 bp, Homo sapiens
cccagtgacctgaccg

SEQ ID NO: 579391 - DNA, 20 bp, Homo sapiens
cccatagcagccagttcaaa

SEQ ID NO: 579392 - DNA, 13 bp, Homo sapiens
ccccatcccacat

SEQ ID NO: 579393 - DNA, 16 bp, Homo sapiens
cccccttaaatttaat

SEQ ID NO: 579394 - DNA, 11 bp, Homo sapiens
cccctctcccc

SEQ ID NO: 579395 - DNA, 17 bp, Homo sapiens
cccctctgccctgtata

SEQ ID NO: 579396 - DNA, 16 bp, Homo sapiens
cccctctgtgtcctct

SEQ ID NO: 579397 - DNA, 16 bp, Homo sapiens
ccccttgtcctctccc

SEQ ID NO: 579398 - DNA, 13 bp, Homo sapiens
ccctctgccctgt

SEQ ID NO: 579399 - DNA, 19 bp, Homo sapiens
ccctctgtgtcctctcccc

SEQ ID NO: 579400 - DNA, 21 bp, Homo sapiens
ccctgaaacctagtactgccc

SEQ ID NO: 579401 - DNA, 17 bp, Homo sapiens
ccctgcttacctgacgg

SEQ ID NO: 579402 - DNA, 22 bp, Homo sapiens
ccctgtatataatactaaagtg

SEQ ID NO: 579403 - DNA, 15 bp, Homo sapiens
ccctgttttccacac

SEQ ID NO: 579404 - DNA, 19 bp, Homo sapiens
ccctgttttccacaccatc

SEQ ID NO: 579405 - DNA, 18 bp, Homo sapiens
cccttgaaactttgggaa

SEQ ID NO: 579406 - DNA, 12 bp, Homo sapiens
ccgaagcccagt

SEQ ID NO: 579407 - DNA, 18 bp, Homo sapiens
ccgaagcccagtttccct

SEQ ID NO: 579408 - DNA, 17 bp, Homo sapiens
ccgtgcactccctaaga

SEQ ID NO: 579409 - DNA, 18 bp, Homo sapiens
cctaacacagcatgtgta

SEQ ID NO: 579410 - DNA, 16 bp, Homo sapiens
cctaaggaaccttcct

SEQ ID NO: 579411 - DNA, 23 bp, Homo sapiens
cctaagtgggaagtgaagcccct

SEQ ID NO: 579412 - DNA, 18 bp, Homo sapiens
cctaatgtttatgagcca

SEQ ID NO: 579413 - DNA, 21 bp, Homo sapiens
cctactctccttgagtgtatg

SEQ ID NO: 579414 - DNA, 19 bp, Homo sapiens
cctcaagggggactgtctt

SEQ ID NO: 579415 - DNA, 18 bp, Homo sapiens
cctcagacaatccactct

SEQ ID NO: 579416 - DNA, 22 bp, Homo sapiens
cctcagacaatccactctcagg

SEQ ID NO: 579417 - DNA, 22 bp, Homo sapiens
cctcagtatgtgggggcttcat

SEQ ID NO: 579418 - DNA, 20 bp, Homo sapiens
cctccgaccacttccagggg

SEQ ID NO: 579419 - DNA, 22 bp, Homo sapiens
cctccgaccacttccaggggaa

SEQ ID NO: 579420 - DNA, 19 bp, Homo sapiens
cctcctattctataaaact

SEQ ID NO: 579421 - DNA, 16 bp, Homo sapiens
cctctcccacgatgtc

SEQ ID NO: 579422 - DNA, 13 bp, Homo sapiens
cctctgccctgta

SEQ ID NO: 579423 - DNA, 16 bp, Homo sapiens
cctctggatccctgga

SEQ ID NO: 579424 - DNA, 21 bp, Homo sapiens
cctctggatccctggaggggc

SEQ ID NO: 579425 - DNA, 14 bp, Homo sapiens
cctctgggcagctg

SEQ ID NO: 579426 - DNA, 19 bp, Homo sapiens
cctgacggacgtcctgctg

SEQ ID NO: 579427 - DNA, 15 bp, Homo sapiens
cctgagaggggaagc

SEQ ID NO: 579428 - DNA, 23 bp, Homo sapiens
cctgcccaatgagactctagggt

SEQ ID NO: 579429 - DNA, 12 bp, Homo sapiens
cctgctggcacc

SEQ ID NO: 579430 - DNA, 13 bp, Homo sapiens
cctgctggcacct

SEQ ID NO: 579431 - DNA, 15 bp, Homo sapiens
cctgcttacctgacg

SEQ ID NO: 579432 - DNA, 18 bp, Homo sapiens
cctgggtactgaaagcct

SEQ ID NO: 579433 - DNA, 14 bp, Homo sapiens
cctgggttgctgct

SEQ ID NO: 579434 - DNA, 22 bp, Homo sapiens
cctgtatataatactaaagtgt

SEQ ID NO: 579435 - DNA, 17 bp, Homo sapiens
cctgtcctaaggaacct

SEQ ID NO: 579436 - DNA, 13 bp, Homo sapiens
ccttaaatttaat

SEQ ID NO: 579437 - DNA, 13 bp, Homo sapiens
ccttactggctta

SEQ ID NO: 579438 - DNA, 18 bp, Homo sapiens
ccttactggcttacctcc

SEQ ID NO: 579439 - DNA, 20 bp, Homo sapiens
ccttagggaagctggcctga

SEQ ID NO: 579440 - DNA, 21 bp, Homo sapiens
ccttagggaagctggcctgag

SEQ ID NO: 579441 - DNA, 20 bp, Homo sapiens
ccttcatcgaacaaactgat

SEQ ID NO: 579442 - DNA, 21 bp, Homo sapiens
ccttccagggatttgcctcac

SEQ ID NO: 579443 - DNA, 11 bp, Homo sapiens
ccttgagacca

SEQ ID NO: 579444 - DNA, 17 bp, Homo sapiens
ccttgatgactgccttg

SEQ ID NO: 579445 - DNA, 11 bp, Homo sapiens
ccttgctacct

SEQ ID NO: 579446 - DNA, 17 bp, Homo sapiens
ccttgctacctcaaggg

SEQ ID NO: 579447 - DNA, 14 bp, Homo sapiens
ccttgtcctctccc

SEQ ID NO: 579448 - DNA, 15 bp, Homo sapiens
cctttctctctctaa

SEQ ID NO: 579449 - DNA, 17 bp, Homo sapiens
cctttgaatgtaaccaa

SEQ ID NO: 579450 - DNA, 14 bp, Homo sapiens
cgagaggtccctgc

SEQ ID NO: 579451 - DNA, 19 bp, Homo sapiens
atcgaaaagttattttgta

SEQ ID NO: 579452 - DNA, 13 bp, Homo sapiens
atcgaacaaactg

SEQ ID NO: 579453 - DNA, 15 bp, Homo sapiens
atcgtttttgtattt

SEQ ID NO: 579454 - DNA, 23 bp, Homo sapiens
atctacaatctctttttgtttgc

SEQ ID NO: 579455 - DNA, 23 bp, Homo sapiens
atctcaatgaaccataaattcaa

SEQ ID NO: 579456 - DNA, 11 bp, Homo sapiens
atctctttaga

SEQ ID NO: 579457 - DNA, 13 bp, Homo sapiens
atctctttagaga

SEQ ID NO: 579458 - DNA, 15 bp, Homo sapiens
atcttacaatattga

SEQ ID NO: 579459 - DNA, 17 bp, Homo sapiens
atcttacaatattgatt

SEQ ID NO: 579460 - DNA, 18 bp, Homo sapiens
atcttagtgcctgagagt

SEQ ID NO: 579461 - DNA, 21 bp, Homo sapiens
atcttagtgcctgagagtatt

SEQ ID NO: 579462 - DNA, 18 bp, Homo sapiens
atcttcaaagccttctcc

SEQ ID NO: 579463 - DNA, 16 bp, Homo sapiens
atcttttgaagcatag

SEQ ID NO: 579464 - DNA, 17 bp, Homo sapiens
atcttttgaagcataga

SEQ ID NO: 579465 - DNA, 13 bp, Homo sapiens
atgaaaacatgta

SEQ ID NO: 579466 - DNA, 15 bp, Homo sapiens
atgaaccataaattc

SEQ ID NO: 579467 - DNA, 21 bp, Homo sapiens
atgacggaagaacatagaact

SEQ ID NO: 579468 - DNA, 12 bp, Homo sapiens
atgactaaagag

SEQ ID NO: 579469 - DNA, 15 bp, Homo sapiens
atgactaaagagaga

SEQ ID NO: 579470 - DNA, 12 bp, Homo sapiens
atgactgccttg

SEQ ID NO: 579471 - DNA, 14 bp, Homo sapiens
atgactgccttgcc

SEQ ID NO: 579472 - DNA, 23 bp, Homo sapiens
atgactgccttgcctcctcagta

SEQ ID NO: 579473 - DNA, 17 bp, Homo sapiens
atgagctctgaaatctt

SEQ ID NO: 579474 - DNA, 19 bp, Homo sapiens
atgaggaaaattcttaaaa

SEQ ID NO: 579475 - DNA, 17 bp, Homo sapiens
atgaggagagaaggaca

SEQ ID NO: 579476 - DNA, 13 bp, Homo sapiens
atgagtagccagg

SEQ ID NO: 579477 - DNA, 22 bp, Homo sapiens
atgataatgctaattttattat

SEQ ID NO: 579478 - DNA, 22 bp, Homo sapiens
atgatcttgagatttcttttaa

SEQ ID NO: 579479 - DNA, 14 bp, Homo sapiens
atgatgtacagatt

SEQ ID NO: 579480 - DNA, 18 bp, Homo sapiens
atgatgtacagattcttt

SEQ ID NO: 579481 - DNA, 19 bp, Homo sapiens
atgcaaatgagctctgaaa

SEQ ID NO: 579482 - DNA, 18 bp, Homo sapiens
atgcaataaaatttaaaa

SEQ ID NO: 579483 - DNA, 20 bp, Homo sapiens
atgcagtattgccacaatgc

SEQ ID NO: 579484 - DNA, 22 bp, Homo sapiens
atgcagttagctgaagaattga

SEQ ID NO: 579485 - DNA, 17 bp, Homo sapiens
atgcatatcctgagcca

SEQ ID NO: 579486 - DNA, 18 bp, Homo sapiens
atgcatatcctgagccat

SEQ ID NO: 579487 - DNA, 13 bp, Homo sapiens
atgcatgcaaatg

SEQ ID NO: 579488 - DNA, 23 bp, Homo sapiens
atgcatttgaggtcaagtaagaa

SEQ ID NO: 579489 - DNA, 20 bp, Homo sapiens
atgccagcttcctgtgggcc

SEQ ID NO: 579490 - DNA, 22 bp, Homo sapiens
atgccagcttcctgtgggccag

SEQ ID NO: 579491 - DNA, 16 bp, Homo sapiens
atgcctctcccacgat

SEQ ID NO: 579492 - DNA, 14 bp, Homo sapiens
atgcgaaaacttga

SEQ ID NO: 579493 - DNA, 14 bp, Homo sapiens
atgctaattttatt

SEQ ID NO: 579494 - DNA, 22 bp, Homo sapiens
atgcttcctgacaatcaactct

SEQ ID NO: 579495 - DNA, 18 bp, Homo sapiens
atgctttattaatgtttt

SEQ ID NO: 579496 - DNA, 22 bp, Homo sapiens
atgctttattaatgttttcaaa

SEQ ID NO: 579497 - DNA, 22 bp, Homo sapiens
atggatttggcactagccaaag

SEQ ID NO: 579498 - DNA, 17 bp, Homo sapiens
atggggaggcaagtgtg

SEQ ID NO: 579499 - DNA, 21 bp, Homo sapiens
atggggaggcaagtgtggggg

SEQ ID NO: 579500 - DNA, 21 bp, Homo sapiens
atgggtgttgtatggggaggc

SEQ ID NO: 579501 - DNA, 14 bp, Homo sapiens
atgggttgcatttg

SEQ ID NO: 579502 - DNA, 13 bp, Homo sapiens
atggtaataagca

SEQ ID NO: 579503 - DNA, 11 bp, Homo sapiens
atgtaaccaat

SEQ ID NO: 579504 - DNA, 15 bp, Homo sapiens
atgtaatttaaatga

SEQ ID NO: 579505 - DNA, 15 bp, Homo sapiens
atgtacagattcttt

SEQ ID NO: 579506 - DNA, 18 bp, Homo sapiens
cacagactccctcccctg

SEQ ID NO: 579507 - DNA, 19 bp, Homo sapiens
cacagactccctcccctgc

SEQ ID NO: 579508 - DNA, 14 bp, Homo sapiens
cacatcaaaccttt

SEQ ID NO: 579509 - DNA, 14 bp, Homo sapiens
cacatcaaataaga

SEQ ID NO: 579510 - DNA, 21 bp, Homo sapiens
cacatttgctactgttgtaag

SEQ ID NO: 579511 - DNA, 20 bp, Homo sapiens
caccatcaccctctgggcag

SEQ ID NO: 579512 - DNA, 16 bp, Homo sapiens
caccgaagaggaagca

SEQ ID NO: 579513 - DNA, 13 bp, Homo sapiens
cacctcagacaat

SEQ ID NO: 579514 - DNA, 15 bp, Homo sapiens
caccttggggccttg

SEQ ID NO: 579515 - DNA, 18 bp, Homo sapiens
caccttttaactcacctc

SEQ ID NO: 579516 - DNA, 17 bp, Homo sapiens
cacgttggggtgattta

SEQ ID NO: 579517 - DNA, 17 bp, Homo sapiens
cactccctaagaaaccc

SEQ ID NO: 579518 - DNA, 20 bp, Homo sapiens
cactccctaagaaaccccag

SEQ ID NO: 579519 - DNA, 19 bp, Homo sapiens
cactcctgcttaatcttca

SEQ ID NO: 579520 - DNA, 12 bp, Homo sapiens
cactctcaggag

SEQ ID NO: 579521 - DNA, 12 bp, Homo sapiens
cacttccagggg

SEQ ID NO: 579522 - DNA, 14 bp, Homo sapiens
cacttccaggggaa

SEQ ID NO: 579523 - DNA, 14 bp, Homo sapiens
cacttgaaaccttt

SEQ ID NO: 579524 - DNA, 17 bp, Homo sapiens
cagaaagccttccatta

SEQ ID NO: 579525 - DNA, 22 bp, Homo sapiens
cagaaatgttgagtctgtacta

SEQ ID NO: 579526 - DNA, 22 bp, Homo sapiens
cagaagaaaaagttgcagtctc

SEQ ID NO: 579527 - DNA, 23 bp, Homo sapiens
cagaagccctgatgtgtcctcag

SEQ ID NO: 579528 - DNA, 13 bp, Homo sapiens
cagacaatccact

SEQ ID NO: 579529 - DNA, 18 bp, Homo sapiens
cagacaatccactctcag

SEQ ID NO: 579530 - DNA, 22 bp, Homo sapiens
cagaggtattaaaactaaattt

SEQ ID NO: 579531 - DNA, 22 bp, Homo sapiens
cagagttttcattaaatccttt

SEQ ID NO: 579532 - DNA, 20 bp, Homo sapiens
cagataagcaagagagatgt

SEQ ID NO: 579533 - DNA, 22 bp, Homo sapiens
cagataagcaagagagatgttt

SEQ ID NO: 579534 - DNA, 12 bp, Homo sapiens
cagattgaaaag

SEQ ID NO: 579535 - DNA, 20 bp, Homo sapiens
cagatttaagatatgtaaca

SEQ ID NO: 579536 - DNA, 19 bp, Homo sapiens
cagccccctaaaagcactc

SEQ ID NO: 579537 - DNA, 14 bp, Homo sapiens
cagcccgaagccca

SEQ ID NO: 579538 - DNA, 15 bp, Homo sapiens
cagcccgaagcccag

SEQ ID NO: 579539 - DNA, 16 bp, Homo sapiens
cagcccgaagcccagt

SEQ ID NO: 579540 - DNA, 16 bp, Homo sapiens
cagcctttgaatgtaa

SEQ ID NO: 579541 - DNA, 18 bp, Homo sapiens
cagctaactccagtctcc

SEQ ID NO: 579542 - DNA, 18 bp, Homo sapiens
cagctaccaggtgttcta

SEQ ID NO: 579543 - DNA, 17 bp, Homo sapiens
cagctactaatgatgtt

SEQ ID NO: 579544 - DNA, 23 bp, Homo sapiens
cagctgtcatggaaaagcccagt

SEQ ID NO: 579545 - DNA, 21 bp, Homo sapiens
caggacatgcaataaaattta

SEQ ID NO: 579546 - DNA, 18 bp, Homo sapiens
cagggagcagggaaggcc

SEQ ID NO: 579547 - DNA, 19 bp, Homo sapiens
cagggatttgcctcacctt

SEQ ID NO: 579548 - DNA, 16 bp, Homo sapiens
cagggggagaatgggt

SEQ ID NO: 579549 - DNA, 19 bp, Homo sapiens
cagtatgtgggggcttcat

SEQ ID NO: 579550 - DNA, 19 bp, Homo sapiens
cagtattgccacaatgcct

SEQ ID NO: 579551 - DNA, 14 bp, Homo sapiens
cagtctcctgacat

SEQ ID NO: 579552 - DNA, 13 bp, Homo sapiens
cagtgacctgacc

SEQ ID NO: 579553 - DNA, 15 bp, Homo sapiens
cagtgacctgaccgg

SEQ ID NO: 579554 - DNA, 20 bp, Homo sapiens
cagtgacctgaccggcacct

SEQ ID NO: 579555 - DNA, 21 bp, Homo sapiens
cagtgacctgaccggcacctg

SEQ ID NO: 579556 - DNA, 16 bp, Homo sapiens
cagtgagggtcttctt

SEQ ID NO: 579557 - DNA, 23 bp, Homo sapiens
cagtgcctacatcccgggcctca

SEQ ID NO: 579558 - DNA, 16 bp, Homo sapiens
cagtgttggtatattt

SEQ ID NO: 579559 - DNA, 13 bp, Homo sapiens
cagttgcttgtct

SEQ ID NO: 579560 - DNA, 14 bp, Homo sapiens
cagttgcttgtctt

SEQ ID NO: 579561 - DNA, 19 bp, Homo sapiens
cagtttcccttctatgcag

SEQ ID NO: 579562 - DNA, 14 bp, Homo sapiens
cagtttgttggaaa

SEQ ID NO: 579563 - DNA, 19 bp, Homo sapiens
cataaattcaactttgtaa

SEQ ID NO: 579564 - DNA, 13 bp, Homo sapiens
cataagcttccat

SEQ ID NO: 579565 - DNA, 17 bp, Homo sapiens
catactttgtattttga

SEQ ID NO: 579566 - DNA, 13 bp, Homo sapiens
catagacatgaaa

SEQ ID NO: 579567 - DNA, 14 bp, Homo sapiens
catagacatgaaag

SEQ ID NO: 579568 - DNA, 16 bp, Homo sapiens
catagataatattgtt

SEQ ID NO: 579569 - DNA, 17 bp, Homo sapiens
catagataatattgttt

SEQ ID NO: 579570 - DNA, 15 bp, Homo sapiens
catatcctgagccat

SEQ ID NO: 579571 - DNA, 21 bp, Homo sapiens
catcaagaggtgggagggccc

SEQ ID NO: 579572 - DNA, 20 bp, Homo sapiens
catcaccctctgggcagctg

SEQ ID NO: 579573 - DNA, 21 bp, Homo sapiens
catcaccctctgggcagctgt

SEQ ID NO: 579574 - DNA, 14 bp, Homo sapiens
acttctgctggcat

SEQ ID NO: 579575 - DNA, 13 bp, Homo sapiens
acttgaatctgtt

SEQ ID NO: 579576 - DNA, 17 bp, Homo sapiens
actttgtaaaaatcttt

SEQ ID NO: 579577 - DNA, 14 bp, Homo sapiens
actttgtattttga

SEQ ID NO: 579578 - DNA, 16 bp, Homo sapiens
acttttataaagcatg

SEQ ID NO: 579579 - DNA, 22 bp, Homo sapiens
agaaagtgggcttaatggagtt

SEQ ID NO: 579580 - DNA, 19 bp, Homo sapiens
agaaataatgctacaattt

SEQ ID NO: 579581 - DNA, 16 bp, Homo sapiens
agaaatataacacatt

SEQ ID NO: 579582 - DNA, 17 bp, Homo sapiens
agaaatataacacattt

SEQ ID NO: 579583 - DNA, 18 bp, Homo sapiens
agaaatataacacatttt

SEQ ID NO: 579584 - DNA, 22 bp, Homo sapiens
agaaatgttgagtctgtactaa

SEQ ID NO: 579585 - DNA, 11 bp, Homo sapiens
agaacatagaa

SEQ ID NO: 579586 - DNA, 16 bp, Homo sapiens
agaagaagttcatgtc

SEQ ID NO: 579587 - DNA, 15 bp, Homo sapiens
agaagacatgaacca

SEQ ID NO: 579588 - DNA, 15 bp, Homo sapiens
agaagcatgaaaaag

SEQ ID NO: 579589 - DNA, 22 bp, Homo sapiens
agaagccaatctacaatctctt

SEQ ID NO: 579590 - DNA, 13 bp, Homo sapiens
agaagccctgatg

SEQ ID NO: 579591 - DNA, 18 bp, Homo sapiens
agaaggacatgtgctatt

SEQ ID NO: 579592 - DNA, 15 bp, Homo sapiens
agaagtaaatttgtc

SEQ ID NO: 579593 - DNA, 17 bp, Homo sapiens
agaagtaaatttgtcca

SEQ ID NO: 579594 - DNA, 22 bp, Homo sapiens
agaagtccaagcaacagccttt

SEQ ID NO: 579595 - DNA, 16 bp, Homo sapiens
agaataccacatcaaa

SEQ ID NO: 579596 - DNA, 18 bp, Homo sapiens
agaataccacatcaaata

SEQ ID NO: 579597 - DNA, 21 bp, Homo sapiens
agaatgaaagctgttccttgg

SEQ ID NO: 579598 - DNA, 15 bp, Homo sapiens
agaattctgattgat

SEQ ID NO: 579599 - DNA, 23 bp, Homo sapiens
agaattctgattgatttgattgg

SEQ ID NO: 579600 - DNA, 19 bp, Homo sapiens
agaattgaaaagtttttgt

SEQ ID NO: 579601 - DNA, 13 bp, Homo sapiens
agacaaggaacca

SEQ ID NO: 579602 - DNA, 15 bp, Homo sapiens
agacaatccactctc

SEQ ID NO: 579603 - DNA, 19 bp, Homo sapiens
agacaatccactctcagga

SEQ ID NO: 579604 - DNA, 20 bp, Homo sapiens
agacaatccactctcaggag

SEQ ID NO: 579605 - DNA, 13 bp, Homo sapiens
agacgtttataaa

SEQ ID NO: 579606 - DNA, 21 bp, Homo sapiens
agacgtttataaacagaaatg

SEQ ID NO: 579607 - DNA, 13 bp, Homo sapiens
agaggccaatgcc

SEQ ID NO: 579608 - DNA, 16 bp, Homo sapiens
agaggctggttccaga

SEQ ID NO: 579609 - DNA, 14 bp, Homo sapiens
agaggcttgtttac

SEQ ID NO: 579610 - DNA, 16 bp, Homo sapiens
agaggtattaaaacta

SEQ ID NO: 579611 - DNA, 17 bp, Homo sapiens
agaggtattaaaactaa

SEQ ID NO: 579612 - DNA, 12 bp, Homo sapiens
agaggtccctgc

SEQ ID NO: 579613 - DNA, 15 bp, Homo sapiens
agaggtccctgctta

SEQ ID NO: 579614 - DNA, 17 bp, Homo sapiens
agaggtgggagggccct

SEQ ID NO: 579615 - DNA, 22 bp, Homo sapiens
agagttgggtgtctccttaagc

SEQ ID NO: 579616 - DNA, 20 bp, Homo sapiens
agagtttcagtttgttggaa

SEQ ID NO: 579617 - DNA, 21 bp, Homo sapiens
agagtttcagtttgttggaaa

SEQ ID NO: 579618 - DNA, 16 bp, Homo sapiens
agataagcaagagaga

SEQ ID NO: 579619 - DNA, 20 bp, Homo sapiens
agataagcaagagagatgtt

SEQ ID NO: 579620 - DNA, 17 bp, Homo sapiens
agataatattgtttggt

SEQ ID NO: 579621 - DNA, 21 bp, Homo sapiens
agatacatggttgtgacctga

SEQ ID NO: 579622 - DNA, 19 bp, Homo sapiens
agataccttatcttacaat

SEQ ID NO: 579623 - DNA, 18 bp, Homo sapiens
agatattgtgaagtacat

SEQ ID NO: 579624 - DNA, 12 bp, Homo sapiens
agatctttcaga

SEQ ID NO: 579625 - DNA, 17 bp, Homo sapiens
agattgactaactcaaa

SEQ ID NO: 579626 - DNA, 21 bp, Homo sapiens
agattgactaactcaaataca

SEQ ID NO: 579627 - DNA, 16 bp, Homo sapiens
agatttctcattgact

SEQ ID NO: 579628 - DNA, 13 bp, Homo sapiens
agatttcttttaa

SEQ ID NO: 579629 - DNA, 14 bp, Homo sapiens
agcaaaaaagagtt

SEQ ID NO: 579630 - DNA, 17 bp, Homo sapiens
agcaacagcctttgaat

SEQ ID NO: 579631 - DNA, 15 bp, Homo sapiens
agcactgtaaacttc

SEQ ID NO: 579632 - DNA, 21 bp, Homo sapiens
agcagaagaaaaagttgcagt

SEQ ID NO: 579633 - DNA, 11 bp, Homo sapiens
agcagctacca

SEQ ID NO: 579634 - DNA, 15 bp, Homo sapiens
agcagggaaggcctg

SEQ ID NO: 579635 - DNA, 16 bp, Homo sapiens
agcagggaaggcctga

SEQ ID NO: 579636 - DNA, 17 bp, Homo sapiens
agcagggaaggcctgac

SEQ ID NO: 579637 - DNA, 18 bp, Homo sapiens
agcataccttggactgac

SEQ ID NO: 579638 - DNA, 20 bp, Homo sapiens
agcatagaaaccactagaaa

SEQ ID NO: 579639 - DNA, 19 bp, Homo sapiens
agcatagataatattgttt

SEQ ID NO: 579640 - DNA, 18 bp, Homo sapiens
agccaaacacactgtaaa

SEQ ID NO: 579641 - DNA, 20 bp, Homo sapiens
agccaaacacactgtaaata

SEQ ID NO: 579642 - DNA, 22 bp, Homo sapiens
agccatcggtgaaactaacaga

SEQ ID NO: 579643 - DNA, 17 bp, Homo sapiens
agcccagtgacctgacc

SEQ ID NO: 579644 - DNA, 14 bp, Homo sapiens
agcccagtttccct

SEQ ID NO: 579645 - DNA, 17 bp, Homo sapiens
agcccagtttcccttct

SEQ ID NO: 579646 - DNA, 18 bp, Homo sapiens
agccccttgtcctctccc

SEQ ID NO: 579647 - DNA, 14 bp, Homo sapiens
agcccgaagcccag

SEQ ID NO: 579648 - DNA, 15 bp, Homo sapiens
agcccgaagcccagt

SEQ ID NO: 579649 - DNA, 18 bp, Homo sapiens
agcccgaagcccagtttc

SEQ ID NO: 579650 - DNA, 14 bp, Homo sapiens
agcctactctcctt

SEQ ID NO: 579651 - DNA, 15 bp, Homo sapiens
agccttagggaagct

SEQ ID NO: 579652 - DNA, 20 bp, Homo sapiens
agccttagggaagctggcct

SEQ ID NO: 579653 - DNA, 21 bp, Homo sapiens
agccttcaaaactatagcttg

SEQ ID NO: 579654 - DNA, 22 bp, Homo sapiens
agccttccagggatttgcctca

SEQ ID NO: 579655 - DNA, 23 bp, Homo sapiens
agccttccagggatttgcctcac

SEQ ID NO: 579656 - DNA, 16 bp, Homo sapiens
agcctttgaatgtaac

SEQ ID NO: 579657 - DNA, 19 bp, Homo sapiens
agcctttgaatgtaaccaa

SEQ ID NO: 579658 - DNA, 17 bp, Homo sapiens
agcgacccattcagaga

SEQ ID NO: 579659 - DNA, 15 bp, Homo sapiens
agctaaagaggctga

SEQ ID NO: 579660 - DNA, 16 bp, Homo sapiens
agctactaatgatgtt

SEQ ID NO: 579661 - DNA, 16 bp, Homo sapiens
agctctgaaatcttcc

SEQ ID NO: 579662 - DNA, 19 bp, Homo sapiens
agctcttcctatccctctc

SEQ ID NO: 579663 - DNA, 18 bp, Homo sapiens
agctgaagaattgaaaag

SEQ ID NO: 579664 - DNA, 19 bp, Homo sapiens
agctgcagagatttctcat

SEQ ID NO: 579665 - DNA, 22 bp, Homo sapiens
agctgtcatggaaaagcccagt

SEQ ID NO: 579666 - DNA, 14 bp, Homo sapiens
agcttaatgctaca

SEQ ID NO: 579667 - DNA, 20 bp, Homo sapiens
agcttccattttaattttaa

SEQ ID NO: 579668 - DNA, 16 bp, Homo sapiens
aggaaaattcttaaaa

SEQ ID NO: 579669 - DNA, 14 bp, Homo sapiens
aggaaccttccttc

SEQ ID NO: 579670 - DNA, 20 bp, Homo sapiens
aggaatatgacggaagaaca

SEQ ID NO: 579671 - DNA, 22 bp, Homo sapiens
aggaatatgacggaagaacata

SEQ ID NO: 579672 - DNA, 17 bp, Homo sapiens
aggaatcattcagaaat

SEQ ID NO: 579673 - DNA, 22 bp, Homo sapiens
aggaatcattcagaaatgttga

SEQ ID NO: 579674 - DNA, 20 bp, Homo sapiens
aggaccctgttttccacacc

SEQ ID NO: 579675 - DNA, 16 bp, Homo sapiens
aggaggcgcagcccga

SEQ ID NO: 579676 - DNA, 16 bp, Homo sapiens
aggcagattgaaaagg

SEQ ID NO: 579677 - DNA, 23 bp, Homo sapiens
aggccaagtccgcagaagccctg

SEQ ID NO: 579678 - DNA, 16 bp, Homo sapiens
aggcctgacttctgct

SEQ ID NO: 579679 - DNA, 19 bp, Homo sapiens
aggcctgacttctgctggc

SEQ ID NO: 579680 - DNA, 21 bp, Homo sapiens
aggcttgtttacctttctctc

SEQ ID NO: 579681 - DNA, 16 bp, Homo sapiens
agggaagctggcctga

SEQ ID NO: 579682 - DNA, 17 bp, Homo sapiens
agggaagctggcctgag

SEQ ID NO: 579683 - DNA, 23 bp, Homo sapiens
agggaagctggcctgagagggga

SEQ ID NO: 579684 - DNA, 14 bp, Homo sapiens
atgactaaagagag

SEQ ID NO: 579685 - DNA, 16 bp, Homo sapiens
atgactaaagagagaa

SEQ ID NO: 579686 - DNA, 17 bp, Homo sapiens
atgactaaagagagaat

SEQ ID NO: 579687 - DNA, 15 bp, Homo sapiens
atgagactctagggt

SEQ ID NO: 579688 - DNA, 17 bp, Homo sapiens
atgagactctagggtcc

SEQ ID NO: 579689 - DNA, 20 bp, Homo sapiens
atgagattggttttcctgtg

SEQ ID NO: 579690 - DNA, 15 bp, Homo sapiens
atgaggaaaattctt

SEQ ID NO: 579691 - DNA, 21 bp, Homo sapiens
atgaggaaaattcttaaaagg

SEQ ID NO: 579692 - DNA, 14 bp, Homo sapiens
atgaggagagaagg

SEQ ID NO: 579693 - DNA, 21 bp, Homo sapiens
atgatgtacagattctttcag

SEQ ID NO: 579694 - DNA, 20 bp, Homo sapiens
atgattctttgttacaggca

SEQ ID NO: 579695 - DNA, 23 bp, Homo sapiens
atgcaaatgagctctgaaatctt

SEQ ID NO: 579696 - DNA, 16 bp, Homo sapiens
atgcagtattgccaca

SEQ ID NO: 579697 - DNA, 17 bp, Homo sapiens
atgcagtattgccacaa

SEQ ID NO: 579698 - DNA, 19 bp, Homo sapiens
atgcagttagctgaagaat

SEQ ID NO: 579699 - DNA, 16 bp, Homo sapiens
atgcatgcaaatgagc

SEQ ID NO: 579700 - DNA, 18 bp, Homo sapiens
atgccacatcaaaccttt

SEQ ID NO: 579701 - DNA, 14 bp, Homo sapiens
caacaaggaccctg

SEQ ID NO: 579702 - DNA, 16 bp, Homo sapiens
caacaaggaccctgtt

SEQ ID NO: 579703 - DNA, 16 bp, Homo sapiens
caacagcctttgaatg

SEQ ID NO: 579704 - DNA, 23 bp, Homo sapiens
caacagcctttgaatgtaaccaa

SEQ ID NO: 579705 - DNA, 21 bp, Homo sapiens
caagaaagccgtactgtctat

SEQ ID NO: 579706 - DNA, 16 bp, Homo sapiens
caagagataagtcttt

SEQ ID NO: 579707 - DNA, 22 bp, Homo sapiens
caagattttgaatgcttcctga

SEQ ID NO: 579708 - DNA, 14 bp, Homo sapiens
caagcaacagcctt

SEQ ID NO: 579709 - DNA, 19 bp, Homo sapiens
caagccttccagggatttg

SEQ ID NO: 579710 - DNA, 19 bp, Homo sapiens
caaggactcctgtctgtcc

SEQ ID NO: 579711 - DNA, 22 bp, Homo sapiens
caaggtgggccttgctacctca

SEQ ID NO: 579712 - DNA, 16 bp, Homo sapiens
caagtccgcagaagcc

SEQ ID NO: 579713 - DNA, 19 bp, Homo sapiens
caagtccgcagaagccctg

SEQ ID NO: 579714 - DNA, 20 bp, Homo sapiens
caataaaatttaaaaaataa

SEQ ID NO: 579715 - DNA, 22 bp, Homo sapiens
caataggagtggtgatttgaaa

SEQ ID NO: 579716 - DNA, 19 bp, Homo sapiens
caatattccagatctttca

SEQ ID NO: 579717 - DNA, 20 bp, Homo sapiens
caatattgattgggaaaaca

SEQ ID NO: 579718 - DNA, 21 bp, Homo sapiens
caatattgattgggaaaacat

SEQ ID NO: 579719 - DNA, 16 bp, Homo sapiens
caatccactctcagga

SEQ ID NO: 579720 - DNA, 19 bp, Homo sapiens
caatgaaccataaattcaa

SEQ ID NO: 579721 - DNA, 16 bp, Homo sapiens
ctaacacagcatgtgt

SEQ ID NO: 579722 - DNA, 17 bp, Homo sapiens
ctaacagataagcaaga

SEQ ID NO: 579723 - DNA, 20 bp, Homo sapiens
ctaactcaaatacacatttg

SEQ ID NO: 579724 - DNA, 22 bp, Homo sapiens
ctaagactatatatataaatgt

SEQ ID NO: 579725 - DNA, 22 bp, Homo sapiens
ctaagtgggaagtgaagcccct

SEQ ID NO: 579726 - DNA, 14 bp, Homo sapiens
ctaataaaccagtt

SEQ ID NO: 579727 - DNA, 20 bp, Homo sapiens
ctaatgtttatgagccagac

SEQ ID NO: 579728 - DNA, 21 bp, Homo sapiens
ctacaatctctttttgtttgc

SEQ ID NO: 579729 - DNA, 20 bp, Homo sapiens
ctacatcccgggcctcagtg

SEQ ID NO: 579730 - DNA, 17 bp, Homo sapiens
ctaccagctaactccag

SEQ ID NO: 579731 - DNA, 12 bp, Homo sapiens
ctactaataaac

SEQ ID NO: 579732 - DNA, 16 bp, Homo sapiens
ctactaataaaccagt

SEQ ID NO: 579733 - DNA, 14 bp, Homo sapiens
ctactaatgatgtt

SEQ ID NO: 579734 - DNA, 12 bp, Homo sapiens
ctactgtaatta

SEQ ID NO: 579735 - DNA, 22 bp, Homo sapiens
ctactgttgtaagaattctgat

SEQ ID NO: 579736 - DNA, 22 bp, Homo sapiens
ctagaggcttgcataataagct

SEQ ID NO: 579737 - DNA, 16 bp, Homo sapiens
ctagggccttggaaat

SEQ ID NO: 579738 - DNA, 13 bp, Homo sapiens
ctagtaagaagac

SEQ ID NO: 579739 - DNA, 16 bp, Homo sapiens
ctagttctaacagtga

SEQ ID NO: 579740 - DNA, 16 bp, Homo sapiens
ctataaactactgtaa

SEQ ID NO: 579741 - DNA, 19 bp, Homo sapiens
ctataaactactgtaatta

SEQ ID NO: 579742 - DNA, 21 bp, Homo sapiens
ctatagcttgcagaactgtag

SEQ ID NO: 579743 - DNA, 14 bp, Homo sapiens
ctatatatataaat

SEQ ID NO: 579744 - DNA, 16 bp, Homo sapiens
ctatatatataaatgt

SEQ ID NO: 579745 - DNA, 17 bp, Homo sapiens
ctatatatataaatgta

SEQ ID NO: 579746 - DNA, 18 bp, Homo sapiens
ctatatatataaatgtat

SEQ ID NO: 579747 - DNA, 19 bp, Homo sapiens
ctatatttttctcaatgtt

SEQ ID NO: 579748 - DNA, 16 bp, Homo sapiens
ctatgttgtgatcctt

SEQ ID NO: 579749 - DNA, 13 bp, Homo sapiens
ctattgaactgag

SEQ ID NO: 579750 - DNA, 18 bp, Homo sapiens
ctattgaactgagccaaa

SEQ ID NO: 579751 - DNA, 15 bp, Homo sapiens
ctcaaatacacattt

SEQ ID NO: 579752 - DNA, 22 bp, Homo sapiens
ctcaatgcagttagctgaagaa

SEQ ID NO: 579753 - DNA, 23 bp, Homo sapiens
ctcacctaatgtttatgagccag

SEQ ID NO: 579754 - DNA, 15 bp, Homo sapiens
ctcagaaagccttcc

SEQ ID NO: 579755 - DNA, 16 bp, Homo sapiens
ctcagacaatccactc

SEQ ID NO: 579756 - DNA, 22 bp, Homo sapiens
ctcagacaatccactctcagga

SEQ ID NO: 579757 - DNA, 14 bp, Homo sapiens
ctcagctcaatgca

SEQ ID NO: 579758 - DNA, 16 bp, Homo sapiens
ctcaggaggcgcagcc

SEQ ID NO: 579759 - DNA, 19 bp, Homo sapiens
ctcaggaggcgcagcccga

SEQ ID NO: 579760 - DNA, 19 bp, Homo sapiens
ctcagtatgtgggggcttc

SEQ ID NO: 579761 - DNA, 22 bp, Homo sapiens
ctcagtatgtgggggcttcatc

SEQ ID NO: 579762 - DNA, 23 bp, Homo sapiens
ctcagtatgtgggggcttcatct

SEQ ID NO: 579763 - DNA, 17 bp, Homo sapiens
ctccagtctcctgacat

SEQ ID NO: 579764 - DNA, 18 bp, Homo sapiens
ctccagtctcctgacatt

SEQ ID NO: 579765 - DNA, 23 bp, Homo sapiens
ctcccacgatgtcaaggactcct

SEQ ID NO: 579766 - DNA, 18 bp, Homo sapiens
ctccctaagaaaccccag

SEQ ID NO: 579767 - DNA, 20 bp, Homo sapiens
ctcctaactgccagccccct

SEQ ID NO: 579768 - DNA, 15 bp, Homo sapiens
ctcctattctataaa

SEQ ID NO: 579769 - DNA, 20 bp, Homo sapiens
ctcctattctataaaactct

SEQ ID NO: 579770 - DNA, 21 bp, Homo sapiens
ctcctcagtatgtgggggctt

SEQ ID NO: 579771 - DNA, 18 bp, Homo sapiens
ctcgttggaagaggaaca

SEQ ID NO: 579772 - DNA, 12 bp, Homo sapiens
ctctagggtcca

SEQ ID NO: 579773 - DNA, 21 bp, Homo sapiens
ctctcaggaggcgcagcccga

SEQ ID NO: 579774 - DNA, 22 bp, Homo sapiens
ctctcaggaggcgcagcccgaa

SEQ ID NO: 579775 - DNA, 19 bp, Homo sapiens
ctctcccctctgccctgta

SEQ ID NO: 579776 - DNA, 14 bp, Homo sapiens
ctctccttgagtgt

SEQ ID NO: 579777 - DNA, 14 bp, Homo sapiens
ctctgccctgtata

SEQ ID NO: 579778 - DNA, 15 bp, Homo sapiens
ctctggatccctgga

SEQ ID NO: 579779 - DNA, 17 bp, Homo sapiens
ctctgggctgccatgtg

SEQ ID NO: 579780 - DNA, 21 bp, Homo sapiens
ctgaaatcttcccatgcattc

SEQ ID NO: 579781 - DNA, 22 bp, Homo sapiens
ctgaaatgaggagagaaggaca

SEQ ID NO: 579782 - DNA, 21 bp, Homo sapiens
ctgacaatcaactctaatagt

SEQ ID NO: 579783 - DNA, 14 bp, Homo sapiens
ctgagaggggaagc

SEQ ID NO: 579784 - DNA, 20 bp, Homo sapiens
ctgagagtatttaggcagat

SEQ ID NO: 579785 - DNA, 22 bp, Homo sapiens
ctgagccaaacacactgtaaat

SEQ ID NO: 579786 - DNA, 21 bp, Homo sapiens
ctgatgcgaaaacttgaatct

SEQ ID NO: 579787 - DNA, 22 bp, Homo sapiens
ctgattctggctttaagccttc

SEQ ID NO: 579788 - DNA, 17 bp, Homo sapiens
ctgccatgccaggaacc

SEQ ID NO: 579789 - DNA, 23 bp, Homo sapiens
ctgccatggctaggtagaagtga

SEQ ID NO: 579790 - DNA, 18 bp, Homo sapiens
ctgccttgcctcctcagt

SEQ ID NO: 579791 - DNA, 19 bp, Homo sapiens
ctgcgagaggtccctgctt

SEQ ID NO: 579792 - DNA, 16 bp, Homo sapiens
ctgctggcacctcaga

SEQ ID NO: 579793 - DNA, 16 bp, Homo sapiens
ctgctgtccagtgcct

SEQ ID NO: 579794 - DNA, 18 bp, Homo sapiens
ctgctgtccagtgcctac

SEQ ID NO: 579795 - DNA, 19 bp, Homo sapiens
ctgctgtccagtgcctaca

SEQ ID NO: 579796 - DNA, 22 bp, Homo sapiens
ctgcttaatcttcaaagccttc

SEQ ID NO: 579797 - DNA, 15 bp, Homo sapiens
ctgcttcccttactt

SEQ ID NO: 579798 - DNA, 20 bp, Homo sapiens
ctgcttcccttactttgctg

SEQ ID NO: 579799 - DNA, 12 bp, Homo sapiens
ctggcacctcag

SEQ ID NO: 579800 - DNA, 22 bp, Homo sapiens
ctggcatcaagaggtgggaggg

SEQ ID NO: 579801 - DNA, 23 bp, Homo sapiens
ctggcatcaagaggtgggagggc

SEQ ID NO: 579802 - DNA, 18 bp, Homo sapiens
ctgggtactgaaagcctt

SEQ ID NO: 579803 - DNA, 20 bp, Homo sapiens
ctgggttgctgctgtccagt

SEQ ID NO: 579804 - DNA, 23 bp, Homo sapiens
ctgggttgctgctgtccagtgcc

SEQ ID NO: 579805 - DNA, 18 bp, Homo sapiens
ctggtttgtggggcacag

SEQ ID NO: 579806 - DNA, 13 bp, Homo sapiens
ctgtaaactataa

SEQ ID NO: 579807 - DNA, 14 bp, Homo sapiens
ctgtaaactataaa

SEQ ID NO: 579808 - DNA, 16 bp, Homo sapiens
ctgtaaatatccacag

SEQ ID NO: 579809 - DNA, 14 bp, Homo sapiens
ctgtagatatgtat

SEQ ID NO: 579810 - DNA, 20 bp, Homo sapiens
ctgtatataatactaaagtg

SEQ ID NO: 579811 - DNA, 13 bp, Homo sapiens
ctgtccagtgcct

SEQ ID NO: 579812 - DNA, 15 bp, Homo sapiens
ctgtccctgaaacct

SEQ ID NO: 579813 - DNA, 17 bp, Homo sapiens
ctgtcctaaggaacctt

SEQ ID NO: 579814 - DNA, 17 bp, Homo sapiens
ctgtctgtcctggaggt

SEQ ID NO: 579815 - DNA, 15 bp, Homo sapiens
ctgtctttcagatac

SEQ ID NO: 579816 - DNA, 15 bp, Homo sapiens
ctgtggcataaattg

SEQ ID NO: 579817 - DNA, 17 bp, Homo sapiens
ctgtggcataaattgca

SEQ ID NO: 579818 - DNA, 13 bp, Homo sapiens
ctgtgggccagga

SEQ ID NO: 579819 - DNA, 20 bp, Homo sapiens
ctgtgggccaggagctcagc

SEQ ID NO: 579820 - DNA, 13 bp, Homo sapiens
ctgttactgaaat

SEQ ID NO: 579821 - DNA, 19 bp, Homo sapiens
ctgttgtaagaattctgat

SEQ ID NO: 579822 - DNA, 19 bp, Homo sapiens
cttaaacgaagagttccct

SEQ ID NO: 579823 - DNA, 16 bp, Homo sapiens
cttaaatttaatacca

SEQ ID NO: 579824 - DNA, 20 bp, Homo sapiens
cttacaatattgattgggaa

SEQ ID NO: 579825 - DNA, 17 bp, Homo sapiens
cttagggaagctggcct

SEQ ID NO: 579826 - DNA, 13 bp, Homo sapiens
cttcaaagccttc

SEQ ID NO: 579827 - DNA, 14 bp, Homo sapiens
cttcagttgcttgt

SEQ ID NO: 579828 - DNA, 23 bp, Homo sapiens
cttcagttgcttgtcttctggta

SEQ ID NO: 579829 - DNA, 19 bp, Homo sapiens
cttcatcgaacaaactgat

SEQ ID NO: 579830 - DNA, 20 bp, Homo sapiens
cttcatcgaacaaactgatg

SEQ ID NO: 579831 - DNA, 16 bp, Homo sapiens
cttccattttaatttt

SEQ ID NO: 579832 - DNA, 16 bp, Homo sapiens
cttcctcttgtctgat

SEQ ID NO: 579833 - DNA, 14 bp, Homo sapiens
cttccttcctgctt

SEQ ID NO: 579834 - DNA, 18 bp, Homo sapiens
cttctagtgatgatggtt

SEQ ID NO: 579835 - DNA, 16 bp, Homo sapiens
cttctccctagctcct

SEQ ID NO: 579836 - DNA, 13 bp, Homo sapiens
cttcttacatgca

SEQ ID NO: 579837 - DNA, 11 bp, Homo sapiens
cttcttgggat

SEQ ID NO: 579838 - DNA, 16 bp, Homo sapiens
cttgaaactttgggaa

SEQ ID NO: 579839 - DNA, 17 bp, Homo sapiens
cttgagttcccagatgg

SEQ ID NO: 579840 - DNA, 14 bp, Homo sapiens
cttgatgactgcct

SEQ ID NO: 579841 - DNA, 15 bp, Homo sapiens
cttgatgactgcctt

SEQ ID NO: 579842 - DNA, 21 bp, Homo sapiens
cttgatgactgccttgcctcc

SEQ ID NO: 579843 - DNA, 14 bp, Homo sapiens
cttgcagaactgta

SEQ ID NO: 579844 - DNA, 16 bp, Homo sapiens
cttgctacctcaaggg

SEQ ID NO: 579845 - DNA, 19 bp, Homo sapiens
cttggaaattcctgtactg

SEQ ID NO: 579846 - DNA, 20 bp, Homo sapiens
cttggccctttccttccaga

SEQ ID NO: 579847 - DNA, 13 bp, Homo sapiens
cttggggccttga

SEQ ID NO: 579848 - DNA, 18 bp, Homo sapiens
cttgtactctacaaaata

SEQ ID NO: 579849 - DNA, 19 bp, Homo sapiens
cttgtactctacaaaatat

SEQ ID NO: 579850 - DNA, 14 bp, Homo sapiens
cttgtcctctcccg

SEQ ID NO: 579851 - DNA, 21 bp, Homo sapiens
cttgtcttctggtactttctg

SEQ ID NO: 579852 - DNA, 17 bp, Homo sapiens
cttgttttggatggctt

SEQ ID NO: 579853 - DNA, 18 bp, Homo sapiens
ctttaagccttcaaaact

SEQ ID NO: 579854 - DNA, 23 bp, Homo sapiens
ctttagtttttggttgggaatga

SEQ ID NO: 579855 - DNA, 19 bp, Homo sapiens
ctttattaatgttttcaaa

SEQ ID NO: 579856 - DNA, 19 bp, Homo sapiens
ctttcagatacatggttgt

SEQ ID NO: 579857 - DNA, 22 bp, Homo sapiens
ctttcatggctgctgttgctta

SEQ ID NO: 579858 - DNA, 23 bp, Homo sapiens
ctttgagtagatccatttccatt

SEQ ID NO: 579859 - DNA, 16 bp, Homo sapiens
ctttgtaaaggtcaga

SEQ ID NO: 579860 - DNA, 17 bp, Homo sapiens
cttttaaagaagtaaat

SEQ ID NO: 579861 - DNA, 21 bp, Homo sapiens
cttttaccttttttttttctt

SEQ ID NO: 579862 - DNA, 14 bp, Homo sapiens
cttttataaagcat

SEQ ID NO: 579863 - DNA, 16 bp, Homo sapiens
gaaaattcttaaaagg

SEQ ID NO: 579864 - DNA, 12 bp, Homo sapiens
gaaaattgagtt

SEQ ID NO: 579865 - DNA, 17 bp, Homo sapiens
gaaacctagtactgccc

SEQ ID NO: 579866 - DNA, 18 bp, Homo sapiens
gaaacctagtactgcccc

SEQ ID NO: 579867 - DNA, 22 bp, Homo sapiens
gaaagcagagttttcattaaat

SEQ ID NO: 579868 - DNA, 11 bp, Homo sapiens
gaaagtttttt

SEQ ID NO: 579869 - DNA, 19 bp, Homo sapiens
gaaataatgctacaatttt

SEQ ID NO: 579870 - DNA, 17 bp, Homo sapiens
gaaatataacacatttt

SEQ ID NO: 579871 - DNA, 15 bp, Homo sapiens
gaaatggaaagcaga

SEQ ID NO: 579872 - DNA, 13 bp, Homo sapiens
gaaattgcatact

SEQ ID NO: 579873 - DNA, 13 bp, Homo sapiens
gaacaaactgatg

SEQ ID NO: 579874 - DNA, 19 bp, Homo sapiens
gaaccttccttcctgcttg

SEQ ID NO: 579875 - DNA, 21 bp, Homo sapiens
gaagagttcccttgaaacttt

SEQ ID NO: 579876 - DNA, 14 bp, Homo sapiens
gaagcaagaaagcc

SEQ ID NO: 579877 - DNA, 13 bp, Homo sapiens
gaagcatgaaaaa

SEQ ID NO: 579878 - DNA, 16 bp, Homo sapiens
gaagcatgaaaaagca

SEQ ID NO: 579879 - DNA, 22 bp, Homo sapiens
gaagctggcctgagaggggaag

SEQ ID NO: 579880 - DNA, 17 bp, Homo sapiens
gaaggagaagtaagagg

SEQ ID NO: 579881 - DNA, 13 bp, Homo sapiens
gaaggcctgactt

SEQ ID NO: 579882 - DNA, 20 bp, Homo sapiens
gaaggcctgacttctgctgg

SEQ ID NO: 579883 - DNA, 11 bp, Homo sapiens
gaagtaaattt

SEQ ID NO: 579884 - DNA, 16 bp, Homo sapiens
gaataccacatcaaat

SEQ ID NO: 579885 - DNA, 22 bp, Homo sapiens
gaataccacatcaaataagaaa

SEQ ID NO: 579886 - DNA, 15 bp, Homo sapiens
gaatgaaagctgttc

SEQ ID NO: 579887 - DNA, 19 bp, Homo sapiens
gaatgccatctatctagtt

SEQ ID NO: 579888 - DNA, 22 bp, Homo sapiens
gaattgaaaagtttttgtttgg

SEQ ID NO: 579889 - DNA, 20 bp, Homo sapiens
gacatgcaataaaatttaaa

SEQ ID NO: 579890 - DNA, 20 bp, Homo sapiens
gacatgtgctattgaactga

SEQ ID NO: 579891 - DNA, 15 bp, Homo sapiens
gaccacttccagggg

SEQ ID NO: 579892 - DNA, 23 bp, Homo sapiens
gaccattttttaatttacttgtt

SEQ ID NO: 579893 - DNA, 16 bp, Homo sapiens
gaccctgttttccaca

SEQ ID NO: 579894 - DNA, 16 bp, Homo sapiens
gacctgaccggcacct

SEQ ID NO: 579895 - DNA, 20 bp, Homo sapiens
gacctggcatctaattctga

SEQ ID NO: 579896 - DNA, 21 bp, Homo sapiens
gacgtcctgctggcacctcag

SEQ ID NO: 579897 - DNA, 13 bp, Homo sapiens
gactaaagagaga

SEQ ID NO: 579898 - DNA, 14 bp, Homo sapiens
gactaaagagagaa

SEQ ID NO: 579899 - DNA, 18 bp, Homo sapiens
gactaaagagagaatgta

SEQ ID NO: 579900 - DNA, 19 bp, Homo sapiens
gactatatatataaatgta

SEQ ID NO: 579901 - DNA, 21 bp, Homo sapiens
gactcctgtctgtcctggagg

SEQ ID NO: 579902 - DNA, 13 bp, Homo sapiens
gactgtctttcag

SEQ ID NO: 579903 - DNA, 21 bp, Homo sapiens
gagaatgtagatattgtgaag

SEQ ID NO: 579904 - DNA, 20 bp, Homo sapiens
gagacgtttataaacagaaa

SEQ ID NO: 579905 - DNA, 16 bp, Homo sapiens
gagactctagggtcca

SEQ ID NO: 579906 - DNA, 20 bp, Homo sapiens
gagactctagggtccagtgg

SEQ ID NO: 579907 - DNA, 22 bp, Homo sapiens
gagactgtccctgaaacctagt

SEQ ID NO: 579908 - DNA, 13 bp, Homo sapiens
gagcagggaaggc

SEQ ID NO: 579909 - DNA, 17 bp, Homo sapiens
gagcagggaaggcctga

SEQ ID NO: 579910 - DNA, 19 bp, Homo sapiens
gagccaaacacactgtaaa

SEQ ID NO: 579911 - DNA, 16 bp, Homo sapiens
gagctctgaaatcttc

SEQ ID NO: 579912 - DNA, 12 bp, Homo sapiens
gaggaagcaaga

SEQ ID NO: 579913 - DNA, 20 bp, Homo sapiens
gaggatttaagggatggaaa

SEQ ID NO: 579914 - DNA, 22 bp, Homo sapiens
gaggatttaagggatggaaaag

SEQ ID NO: 579915 - DNA, 15 bp, Homo sapiens
gaggcgcagcccgaa

SEQ ID NO: 579916 - DNA, 21 bp, Homo sapiens
gaggcgcagcccgaagcccag

SEQ ID NO: 579917 - DNA, 14 bp, Homo sapiens
gagggagaagcatg

SEQ ID NO: 579918 - DNA, 20 bp, Homo sapiens
gaggtccctgcttacctgac

SEQ ID NO: 579919 - DNA, 15 bp, Homo sapiens
gaggtgggagacaag

SEQ ID NO: 579920 - DNA, 22 bp, Homo sapiens
gagtcaaaatttcaaaagtgat

SEQ ID NO: 579921 - DNA, 22 bp, Homo sapiens
gagttcccttgaaactttggga

SEQ ID NO: 579922 - DNA, 14 bp, Homo sapiens
gatagtaagcatag

SEQ ID NO: 579923 - DNA, 13 bp, Homo sapiens
gatattgaatgtt

SEQ ID NO: 579924 - DNA, 17 bp, Homo sapiens
gatattgtgaagtacat

SEQ ID NO: 579925 - DNA, 18 bp, Homo sapiens
gatctgtcccctctcccc

SEQ ID NO: 579926 - DNA, 17 bp, Homo sapiens
gatggaaaaggaagact

SEQ ID NO: 579927 - DNA, 21 bp, Homo sapiens
gatgtgcatttttgtgaaatg

SEQ ID NO: 579928 - DNA, 18 bp, Homo sapiens
gatgtgtcctcagggagc

SEQ ID NO: 579929 - DNA, 20 bp, Homo sapiens
gattctttcagttctttgga

SEQ ID NO: 579930 - DNA, 23 bp, Homo sapiens
gattgactaactcaaatacacat

SEQ ID NO: 579931 - DNA, 13 bp, Homo sapiens
gattgcctctgaa

SEQ ID NO: 579932 - DNA, 22 bp, Homo sapiens
gatttctcattgacttttataa

SEQ ID NO: 579933 - DNA, 16 bp, Homo sapiens
gatttcttttaaagaa

SEQ ID NO: 579934 - DNA, 18 bp, Homo sapiens
gatttcttttaaagaagt

SEQ ID NO: 579935 - DNA, 14 bp, Homo sapiens
gatttttaaattaa

SEQ ID NO: 579936 - DNA, 16 bp, Homo sapiens
gcaaacccattaaggg

SEQ ID NO: 579937 - DNA, 16 bp, Homo sapiens
gcaaatgagctctgaa

SEQ ID NO: 579938 - DNA, 12 bp, Homo sapiens
gcaaatgttaaa

SEQ ID NO: 579939 - DNA, 23 bp, Homo sapiens
gcaaatgttaaaagttttatatg

SEQ ID NO: 579940 - DNA, 22 bp, Homo sapiens
gcaatggtgtcagtatccaggc

SEQ ID NO: 579941 - DNA, 23 bp, Homo sapiens
gcaatggtgtcagtatccaggct

SEQ ID NO: 579942 - DNA, 16 bp, Homo sapiens
gcacctcagacaatcc

SEQ ID NO: 579943 - DNA, 20 bp, Homo sapiens
gcacctcagacaatccactc

SEQ ID NO: 579944 - DNA, 22 bp, Homo sapiens
gcacctgcgagaggtccctgct

SEQ ID NO: 579945 - DNA, 21 bp, Homo sapiens
gcactccctaagaaaccccag

SEQ ID NO: 579946 - DNA, 19 bp, Homo sapiens
gcacttattgaccattttt

SEQ ID NO: 579947 - DNA, 14 bp, Homo sapiens
gcagagttttcatt

SEQ ID NO: 579948 - DNA, 19 bp, Homo sapiens
gcagagttttcattaaatc

SEQ ID NO: 579949 - DNA, 21 bp, Homo sapiens
gcagcccgaagcccagtttcc

SEQ ID NO: 579950 - DNA, 22 bp, Homo sapiens
gcagctgtcatggaaaagccca

SEQ ID NO: 579951 - DNA, 12 bp, Homo sapiens
gcagtctcagaa

SEQ ID NO: 579952 - DNA, 16 bp, Homo sapiens
gcatgcaaatgagctc

SEQ ID NO: 579953 - DNA, 18 bp, Homo sapiens
gcatgcaaatgagctctg

SEQ ID NO: 579954 - DNA, 14 bp, Homo sapiens
gcatgcatgcaaat

SEQ ID NO: 579955 - DNA, 20 bp, Homo sapiens
gcatgtgtatttccagtgca

SEQ ID NO: 579956 - DNA, 21 bp, Homo sapiens
gcatgtgtatttccagtgcaa

SEQ ID NO: 579957 - DNA, 10 bp, Homo sapiens
gcattgagta

SEQ ID NO: 579958 - DNA, 17 bp, Homo sapiens
gccaaacacactgtaaa

SEQ ID NO: 579959 - DNA, 18 bp, Homo sapiens
gccaatgccccactggca

SEQ ID NO: 579960 - DNA, 20 bp, Homo sapiens
gccacaatgcctctcccacg

SEQ ID NO: 579961 - DNA, 14 bp, Homo sapiens
gccaggagctcagc

SEQ ID NO: 579962 - DNA, 16 bp, Homo sapiens
gccatgccaggaacct

SEQ ID NO: 579963 - DNA, 15 bp, Homo sapiens
gcccagtgacctgac

SEQ ID NO: 579964 - DNA, 16 bp, Homo sapiens
gcccagtgacctgacc

SEQ ID NO: 579965 - DNA, 15 bp, Homo sapiens
gccgtactgtctatg

SEQ ID NO: 579966 - DNA, 13 bp, Homo sapiens
gcctcaccttggg

SEQ ID NO: 579967 - DNA, 12 bp, Homo sapiens
gcctcagtgccc

SEQ ID NO: 579968 - DNA, 15 bp, Homo sapiens
gcctcagtgccccat

SEQ ID NO: 579969 - DNA, 20 bp, Homo sapiens
gcctcgttggaagaggaaca

SEQ ID NO: 579970 - DNA, 16 bp, Homo sapiens
gcctctgaaaagtgtg

SEQ ID NO: 579971 - DNA, 19 bp, Homo sapiens
gcctgacttctgctggcat

SEQ ID NO: 579972 - DNA, 13 bp, Homo sapiens
gcctgagagtatt

SEQ ID NO: 579973 - DNA, 21 bp, Homo sapiens
gcctgagagtatttaggcaga

SEQ ID NO: 579974 - DNA, 22 bp, Homo sapiens
gccttagggaagctggcctgag

SEQ ID NO: 579975 - DNA, 19 bp, Homo sapiens
gccttcaaaactatagctt

SEQ ID NO: 579976 - DNA, 19 bp, Homo sapiens
gccttccagggatttgcct

SEQ ID NO: 579977 - DNA, 20 bp, Homo sapiens
gccttccagggatttgcctc

SEQ ID NO: 579978 - DNA, 16 bp, Homo sapiens
gccttgatgactgcct

SEQ ID NO: 579979 - DNA, 19 bp, Homo sapiens
gccttgctacctcaagggg

SEQ ID NO: 579980 - DNA, 18 bp, Homo sapiens
gcgcaacaacaaggaccc

SEQ ID NO: 579981 - DNA, 19 bp, Homo sapiens
gcgcagcccgaagcccagt

SEQ ID NO: 579982 - DNA, 23 bp, Homo sapiens
gcgtggctctaaaaggtaatgtg

SEQ ID NO: 579983 - DNA, 17 bp, Homo sapiens
gctacctcaagggggac

SEQ ID NO: 579984 - DNA, 14 bp, Homo sapiens
gctactaatgatgt

SEQ ID NO: 579985 - DNA, 18 bp, Homo sapiens
gctactaatgatgttttc

SEQ ID NO: 579986 - DNA, 18 bp, Homo sapiens
gctactgttgtaagaatt

SEQ ID NO: 579987 - DNA, 15 bp, Homo sapiens
gctatgtcagtacta

SEQ ID NO: 579988 - DNA, 15 bp, Homo sapiens
gctcctccccttcct

SEQ ID NO: 579989 - DNA, 23 bp, Homo sapiens
gctcctccccttcctcttgtctg

SEQ ID NO: 579990 - DNA, 14 bp, Homo sapiens
gctctaaaaggtaa

SEQ ID NO: 579991 - DNA, 16 bp, Homo sapiens
gctgctgtccagtgcc

SEQ ID NO: 579992 - DNA, 17 bp, Homo sapiens
gctgctgtccagtgcct

SEQ ID NO: 579993 - DNA, 21 bp, Homo sapiens
gctgctgtccagtgcctacat

SEQ ID NO: 579994 - DNA, 12 bp, Homo sapiens
gctggcacctca

SEQ ID NO: 579995 - DNA, 17 bp, Homo sapiens
gctgtcatggaaaagcc

SEQ ID NO: 579996 - DNA, 18 bp, Homo sapiens
gctgtcatggaaaagccc

SEQ ID NO: 579997 - DNA, 21 bp, Homo sapiens
gctgtcattgcacataagctt

SEQ ID NO: 579998 - DNA, 13 bp, Homo sapiens
gctgtccagtgcc

SEQ ID NO: 579999 - DNA, 14 bp, Homo sapiens
gctgtccagtgcct

SEQ ID NO: 580000 - DNA, 16 bp, Homo sapiens
gcttcatctctttaga

SEQ ID NO: 580001 - DNA, 18 bp, Homo sapiens
gcttcctgacaatcaact

SEQ ID NO: 580002 - DNA, 15 bp, Homo sapiens
gcttggccctttcct

SEQ ID NO: 580003 - DNA, 20 bp, Homo sapiens
gcttgtctatactccttccc

SEQ ID NO: 580004 - DNA, 18 bp, Homo sapiens
gcttgtttacctttctct

SEQ ID NO: 580005 - DNA, 16 bp, Homo sapiens
gctttattaatgtttt

SEQ ID NO: 580006 - DNA, 21 bp, Homo sapiens
ggaaaagcccagtgacctgac

SEQ ID NO: 580007 - DNA, 23 bp, Homo sapiens
ggaaccaccgaagaggaagcaag

SEQ ID NO: 580008 - DNA, 22 bp, Homo sapiens
ggaacctgtcctaaggaacctt

SEQ ID NO: 580009 - DNA, 19 bp, Homo sapiens
ggaaccttccttcctgctt

SEQ ID NO: 580010 - DNA, 15 bp, Homo sapiens
ggaagctggcctgag

SEQ ID NO: 580011 - DNA, 15 bp, Homo sapiens
ggaagggaaagtttt

SEQ ID NO: 580012 - DNA, 13 bp, Homo sapiens
ggaagtgaagccc

SEQ ID NO: 580013 - DNA, 16 bp, Homo sapiens
ggacatgcaataaaat

SEQ ID NO: 580014 - DNA, 22 bp, Homo sapiens
ggacatgcaataaaatttaaaa

SEQ ID NO: 580015 - DNA, 20 bp, Homo sapiens
ggactgtctttcagatacat

SEQ ID NO: 580016 - DNA, 13 bp, Homo sapiens
ggagaagcatgaa

SEQ ID NO: 580017 - DNA, 15 bp, Homo sapiens
ggagacaaggaacca

SEQ ID NO: 580018 - DNA, 14 bp, Homo sapiens
ggaggcgcagcccg

SEQ ID NO: 580019 - DNA, 23 bp, Homo sapiens
ggaggcgcagcccgaagcccagt

SEQ ID NO: 580020 - DNA, 14 bp, Homo sapiens
ggatccctggaggg

SEQ ID NO: 580021 - DNA, 21 bp, Homo sapiens
ggattctgaggccctgcccaa

SEQ ID NO: 580022 - DNA, 18 bp, Homo sapiens
ggattctttccattatga

SEQ ID NO: 580023 - DNA, 15 bp, Homo sapiens
ggattgcctctgaaa

SEQ ID NO: 580024 - DNA, 15 bp, Homo sapiens
ggcaccgagaatgtt

SEQ ID NO: 580025 - DNA, 23 bp, Homo sapiens
ggcacctcagacaatccactctc

SEQ ID NO: 580026 - DNA, 13 bp, Homo sapiens
ggcagattgaaaa

SEQ ID NO: 580027 - DNA, 21 bp, Homo sapiens
ggcagctgtcatggaaaagcc

SEQ ID NO: 580028 - DNA, 19 bp, Homo sapiens
ggcattgagtattgtttaa

SEQ ID NO: 580029 - DNA, 23 bp, Homo sapiens
ggccaagtccgcagaagccctga

SEQ ID NO: 580030 - DNA, 22 bp, Homo sapiens
ggccctccgaccacttccaggg

SEQ ID NO: 580031 - DNA, 19 bp, Homo sapiens
ggccctttccttccagatc

SEQ ID NO: 580032 - DNA, 16 bp, Homo sapiens
ggcgcagcccgaagcc

SEQ ID NO: 580033 - DNA, 19 bp, Homo sapiens
ggcgcagcccgaagcccag

SEQ ID NO: 580034 - DNA, 18 bp, Homo sapiens
ggctgtttgatagcagaa

SEQ ID NO: 580035 - DNA, 16 bp, Homo sapiens
ggcttcatctctttag

SEQ ID NO: 580036 - DNA, 18 bp, Homo sapiens
ggcttcatctctttagag

SEQ ID NO: 580037 - DNA, 18 bp, Homo sapiens
gggaggcaagtgtggggg

SEQ ID NO: 580038 - DNA, 15 bp, Homo sapiens
gggatatttttttct

SEQ ID NO: 580039 - DNA, 15 bp, Homo sapiens
gggatttgcctcacc

SEQ ID NO: 580040 - DNA, 21 bp, Homo sapiens
gggcttcatctctttagagaa

SEQ ID NO: 580041 - DNA, 21 bp, Homo sapiens
ggggaacctgccatgccagga

SEQ ID NO: 580042 - DNA, 14 bp, Homo sapiens
ggggcttcatctct

SEQ ID NO: 580043 - DNA, 21 bp, Homo sapiens
ggggcttcatctctttagaga

SEQ ID NO: 580044 - DNA, 18 bp, Homo sapiens
gggtgttgtatggggagg

SEQ ID NO: 580045 - DNA, 16 bp, Homo sapiens
gggttcaaaatgtctg

SEQ ID NO: 580046 - DNA, 12 bp, Homo sapiens
gggttttcttaa

SEQ ID NO: 580047 - DNA, 12 bp, Homo sapiens
ggtaaatgtttc

SEQ ID NO: 580048 - DNA, 19 bp, Homo sapiens
ggtattaaaactaaatttc

SEQ ID NO: 580049 - DNA, 20 bp, Homo sapiens
ggtcaagattttgaatgctt

SEQ ID NO: 580050 - DNA, 18 bp, Homo sapiens
ggttttcttaaccatctt

SEQ ID NO: 580051 - DNA, 13 bp, Homo sapiens
gtaacaacaatta

SEQ ID NO: 580052 - DNA, 15 bp, Homo sapiens
gtaacaacaattatt

SEQ ID NO: 580053 - DNA, 20 bp, Homo sapiens
gtaacactagggccttggaa

SEQ ID NO: 580054 - DNA, 18 bp, Homo sapiens
gtaacatgccagcttcct

SEQ ID NO: 580055 - DNA, 15 bp, Homo sapiens
gtaagaagacatgaa

SEQ ID NO: 580056 - DNA, 20 bp, Homo sapiens
gtaataagcactgtaaactt

SEQ ID NO: 580057 - DNA, 20 bp, Homo sapiens
gtaatcccctaaaataacag

SEQ ID NO: 580058 - DNA, 19 bp, Homo sapiens
gtaatttaaatgaaagaaa

SEQ ID NO: 580059 - DNA, 21 bp, Homo sapiens
gtagatgtgcatttttgtgaa

SEQ ID NO: 580060 - DNA, 23 bp, Homo sapiens
gtagctcctcaactcacctaatg

SEQ ID NO: 580061 - DNA, 13 bp, Homo sapiens
gtaggtaagactg

SEQ ID NO: 580062 - DNA, 19 bp, Homo sapiens
gtatataatactaaagtgt

SEQ ID NO: 580063 - DNA, 16 bp, Homo sapiens
gtatgtgggggcttca

SEQ ID NO: 580064 - DNA, 18 bp, Homo sapiens
gtattaaaactaaatttc

SEQ ID NO: 580065 - DNA, 20 bp, Homo sapiens
gtattatacatgtgatacat

SEQ ID NO: 580066 - DNA, 22 bp, Homo sapiens
gtattgccacaatgcctctccc

SEQ ID NO: 580067 - DNA, 14 bp, Homo sapiens
gtcaagattttgaa

SEQ ID NO: 580068 - DNA, 22 bp, Homo sapiens
gtcaagggctgtcattgcacat

SEQ ID NO: 580069 - DNA, 15 bp, Homo sapiens
gtcaagtaagaagac

SEQ ID NO: 580070 - DNA, 18 bp, Homo sapiens
gtcagagtaacatgccag

SEQ ID NO: 580071 - DNA, 17 bp, Homo sapiens
gtcatggaaaagcccag

SEQ ID NO: 580072 - DNA, 18 bp, Homo sapiens
gtcatggaaaagcccagt

SEQ ID NO: 580073 - DNA, 17 bp, Homo sapiens
gtccaaacgtcctcttt

SEQ ID NO: 580074 - DNA, 18 bp, Homo sapiens
gtccaatggctgtaaact

SEQ ID NO: 580075 - DNA, 20 bp, Homo sapiens
gtccaatggctgtaaactat

SEQ ID NO: 580076 - DNA, 18 bp, Homo sapiens
gtccctgcttacctgacg

SEQ ID NO: 580077 - DNA, 15 bp, Homo sapiens
gtcctaaggaacctt

SEQ ID NO: 580078 - DNA, 18 bp, Homo sapiens
gtcctaaggaaccttcct

SEQ ID NO: 580079 - DNA, 16 bp, Homo sapiens
gtcctcagggagcagg

SEQ ID NO: 580080 - DNA, 12 bp, Homo sapiens
gtcctctcccct

SEQ ID NO: 580081 - DNA, 16 bp, Homo sapiens
gtcctgctggcacctc

SEQ ID NO: 580082 - DNA, 14 bp, Homo sapiens
gtccttgatttcaa

SEQ ID NO: 580083 - DNA, 23 bp, Homo sapiens
gtctaagactatatatataaatg

SEQ ID NO: 580084 - DNA, 19 bp, Homo sapiens
gtctattagttttctttgt

SEQ ID NO: 580085 - DNA, 12 bp, Homo sapiens
gtctcctgacat

SEQ ID NO: 580086 - DNA, 14 bp, Homo sapiens
gtctgtcctggagg

SEQ ID NO: 580087 - DNA, 13 bp, Homo sapiens
gtctttcatggct

SEQ ID NO: 580088 - DNA, 19 bp, Homo sapiens
gtctttcatggctgctgtt

SEQ ID NO: 580089 - DNA, 23 bp, Homo sapiens
gtctttcatggctgctgttgctt

SEQ ID NO: 580090 - DNA, 22 bp, Homo sapiens
gtgaagccccttgtcctctccc

SEQ ID NO: 580091 - DNA, 19 bp, Homo sapiens
gtgacctgaccggcacctg

SEQ ID NO: 580092 - DNA, 23 bp, Homo sapiens
gtgagctcttcctatccctctcc

SEQ ID NO: 580093 - DNA, 15 bp, Homo sapiens
gtgatacatttttta

SEQ ID NO: 580094 - DNA, 20 bp, Homo sapiens
gtgatctgtcccctctcccc

SEQ ID NO: 580095 - DNA, 17 bp, Homo sapiens
gtgatttgaaaaatata

SEQ ID NO: 580096 - DNA, 22 bp, Homo sapiens
gtgatttgaaaaatataaaatt

SEQ ID NO: 580097 - DNA, 19 bp, Homo sapiens
gtgatttttaaattaaata

SEQ ID NO: 580098 - DNA, 22 bp, Homo sapiens
gtggcctcagctcaatgcagtt

SEQ ID NO: 580099 - DNA, 16 bp, Homo sapiens
gtgggaagtgaagccc

SEQ ID NO: 580100 - DNA, 13 bp, Homo sapiens
gtgggggcttcat

SEQ ID NO: 580101 - DNA, 13 bp, Homo sapiens
gtggggggtcctt

SEQ ID NO: 580102 - DNA, 22 bp, Homo sapiens
aacatcctaagtgggaagtgaa

SEQ ID NO: 580103 - DNA, 12 bp, Homo sapiens
aacatttgctgc

SEQ ID NO: 580104 - DNA, 19 bp, Homo sapiens
aaccacacttgaaaccttt

SEQ ID NO: 580105 - DNA, 23 bp, Homo sapiens
aacccattaaggggaagaatgaa

SEQ ID NO: 580106 - DNA, 15 bp, Homo sapiens
aacctgtcctaagga

SEQ ID NO: 580107 - DNA, 12 bp, Homo sapiens
aactactgtaat

SEQ ID NO: 580108 - DNA, 23 bp, Homo sapiens
aactactgtaattaagtgcaatt

SEQ ID NO: 580109 - DNA, 21 bp, Homo sapiens
aactagttactaaacatgtat

SEQ ID NO: 580110 - DNA, 18 bp, Homo sapiens
aactataaactactgtaa

SEQ ID NO: 580111 - DNA, 23 bp, Homo sapiens
aactatagcttgcagaactgtag

SEQ ID NO: 580112 - DNA, 13 bp, Homo sapiens
aactcaaatacac

SEQ ID NO: 580113 - DNA, 15 bp, Homo sapiens
aactctaatagtgct

SEQ ID NO: 580114 - DNA, 15 bp, Homo sapiens
acagattctttcagt

SEQ ID NO: 580115 - DNA, 14 bp, Homo sapiens
acagcactggggag

SEQ ID NO: 580116 - DNA, 22 bp, Homo sapiens
acagcctttgaatgtaaccaat

SEQ ID NO: 580117 - DNA, 17 bp, Homo sapiens
acaggcaccgagaatgt

SEQ ID NO: 580118 - DNA, 15 bp, Homo sapiens
acagtaagatatctc

SEQ ID NO: 580119 - DNA, 16 bp, Homo sapiens
acagtatagatttttg

SEQ ID NO: 580120 - DNA, 23 bp, Homo sapiens
acagtgaagttttactgtctatt

SEQ ID NO: 580121 - DNA, 17 bp, Homo sapiens
acataagcttccatttt

SEQ ID NO: 580122 - DNA, 17 bp, Homo sapiens
acatcaaacctttgagt

SEQ ID NO: 580123 - DNA, 13 bp, Homo sapiens
acatcaaataaga

SEQ ID NO: 580124 - DNA, 18 bp, Homo sapiens
acatcaaataagaaataa

SEQ ID NO: 580125 - DNA, 18 bp, Homo sapiens
acatcccgggcctcagtg

SEQ ID NO: 580126 - DNA, 19 bp, Homo sapiens
acatgcaataaaatttaaa

SEQ ID NO: 580127 - DNA, 19 bp, Homo sapiens
acatgccacatcaaacctt

SEQ ID NO: 580128 - DNA, 15 bp, Homo sapiens
acatgccagcttcct

SEQ ID NO: 580129 - DNA, 18 bp, Homo sapiens
acatggttgtgacctgag

SEQ ID NO: 580130 - DNA, 20 bp, Homo sapiens
acatggttgtgacctgagga

SEQ ID NO: 580131 - DNA, 19 bp, Homo sapiens
acatgtaataaaaagtata

SEQ ID NO: 580132 - DNA, 20 bp, Homo sapiens
acatgtaataaaaagtatat

SEQ ID NO: 580133 - DNA, 15 bp, Homo sapiens
acatgtgatacattt

SEQ ID NO: 580134 - DNA, 17 bp, Homo sapiens
acatgtgatacattttt

SEQ ID NO: 580135 - DNA, 23 bp, Homo sapiens
acatgtgctattgaactgagcca

SEQ ID NO: 580136 - DNA, 16 bp, Homo sapiens
acatgttaatgacaat

SEQ ID NO: 580137 - DNA, 14 bp, Homo sapiens
acattttttaagct

SEQ ID NO: 580138 - DNA, 12 bp, Homo sapiens
accaaagaagaa

SEQ ID NO: 580139 - DNA, 17 bp, Homo sapiens
accacagggttcaaaat

SEQ ID NO: 580140 - DNA, 14 bp, Homo sapiens
accatcaccctctg

SEQ ID NO: 580141 - DNA, 21 bp, Homo sapiens
accatcttttcctcattttca

SEQ ID NO: 580142 - DNA, 16 bp, Homo sapiens
accatgtgagctcttc

SEQ ID NO: 580143 - DNA, 17 bp, Homo sapiens
accattttttaatttac

SEQ ID NO: 580144 - DNA, 16 bp, Homo sapiens
accctctgggcagctg

SEQ ID NO: 580145 - DNA, 15 bp, Homo sapiens
accctgttttccaca

SEQ ID NO: 580146 - DNA, 14 bp, Homo sapiens
acctagtactgccc

SEQ ID NO: 580147 - DNA, 15 bp, Homo sapiens
acctcaagggggact

SEQ ID NO: 580148 - DNA, 20 bp, Homo sapiens
acctcaagggggactgtctt

SEQ ID NO: 580149 - DNA, 21 bp, Homo sapiens
acctcagacaatccactctca

SEQ ID NO: 580150 - DNA, 16 bp, Homo sapiens
acctgaccggcacctg

SEQ ID NO: 580151 - DNA, 16 bp, Homo sapiens
acctgccatgccagga

SEQ ID NO: 580152 - DNA, 23 bp, Homo sapiens
accttggggccttgatgactgcc

SEQ ID NO: 580153 - DNA, 15 bp, Homo sapiens
acgtcctgctggcac

SEQ ID NO: 580154 - DNA, 21 bp, Homo sapiens
acgtcctgctggcacctcaga

SEQ ID NO: 580155 - DNA, 13 bp, Homo sapiens
actaaacatgtat

SEQ ID NO: 580156 - DNA, 17 bp, Homo sapiens
actaaacatgtatgtaa

SEQ ID NO: 580157 - DNA, 14 bp, Homo sapiens
actaaagagagaat

SEQ ID NO: 580158 - DNA, 16 bp, Homo sapiens
actaaagagagaatgt

SEQ ID NO: 580159 - DNA, 17 bp, Homo sapiens
actaacagataagcaag

SEQ ID NO: 580160 - DNA, 22 bp, Homo sapiens
actaactcaaatacacatttgc

SEQ ID NO: 580161 - DNA, 13 bp, Homo sapiens
actaatgatgttt

SEQ ID NO: 580162 - DNA, 14 bp, Homo sapiens
actactagattgac

SEQ ID NO: 580163 - DNA, 11 bp, Homo sapiens
actactgtaat

SEQ ID NO: 580164 - DNA, 14 bp, Homo sapiens
actactgtaattaa

SEQ ID NO: 580165 - DNA, 17 bp, Homo sapiens
actataaactactgtaa

SEQ ID NO: 580166 - DNA, 18 bp, Homo sapiens
actataaactactgtaat

SEQ ID NO: 580167 - DNA, 17 bp, Homo sapiens
actatatatataaatgt

SEQ ID NO: 580168 - DNA, 16 bp, Homo sapiens
actccctaagaaaccc

SEQ ID NO: 580169 - DNA, 20 bp, Homo sapiens
actccctaagaaaccccagg

SEQ ID NO: 580170 - DNA, 15 bp, Homo sapiens
actccctcccctgcc

SEQ ID NO: 580171 - DNA, 21 bp, Homo sapiens
actctaatagtgcttaaaaat

SEQ ID NO: 580172 - DNA, 15 bp, Homo sapiens
actctcaggaggcgc

SEQ ID NO: 580173 - DNA, 22 bp, Homo sapiens
actctcaggaggcgcagcccga

SEQ ID NO: 580174 - DNA, 24 bp, Homo sapiens
actctcaggaggcgcagcccgaag

SEQ ID NO: 580175 - DNA, 21 bp, Homo sapiens
actgagccaaacacactgtaa

SEQ ID NO: 580176 - DNA, 22 bp, Homo sapiens
actgagccaaacacactgtaaa

SEQ ID NO: 580177 - DNA, 19 bp, Homo sapiens
actgatgcgaaaacttgaa

SEQ ID NO: 580178 - DNA, 20 bp, Homo sapiens
actgatgcgaaaacttgaat

SEQ ID NO: 580179 - DNA, 15 bp, Homo sapiens
actgccttgcctcct

SEQ ID NO: 580180 - DNA, 19 bp, Homo sapiens
actgccttgcctcctcagt

SEQ ID NO: 580181 - DNA, 19 bp, Homo sapiens
actgtaaatatccacagac

SEQ ID NO: 580182 - DNA, 20 bp, Homo sapiens
actgtaaatatccacagact

SEQ ID NO: 580183 - DNA, 15 bp, Homo sapiens
actgtagatatgtat

SEQ ID NO: 580184 - DNA, 20 bp, Homo sapiens
actgtagatatgtattcttt

SEQ ID NO: 580185 - DNA, 14 bp, Homo sapiens
actgtatcattttc

SEQ ID NO: 580186 - DNA, 17 bp, Homo sapiens
actgtctattaatattc

SEQ ID NO: 580187 - DNA, 21 bp, Homo sapiens
actgttgtaagaattctgatt

SEQ ID NO: 580188 - DNA, 13 bp, Homo sapiens
acttacaattttc

SEQ ID NO: 580189 - DNA, 15 bp, Homo sapiens
acttattgaccattt

SEQ ID NO: 580190 - DNA, 23 bp, Homo sapiens
acttcgtgcgcaacaacaaggac

SEQ ID NO: 580191 - DNA, 16 bp, Homo sapiens
acttctgcaacaagca

SEQ ID NO: 580192 - DNA, 16 bp, Homo sapiens
acttgaatctgttact

SEQ ID NO: 580193 - DNA, 22 bp, Homo sapiens
acttgaatctgttactgaaatg

SEQ ID NO: 580194 - DNA, 15 bp, Homo sapiens
acttggttcttgtac

SEQ ID NO: 580195 - DNA, 18 bp, Homo sapiens
acttgttttggatggctt

SEQ ID NO: 580196 - DNA, 19 bp, Homo sapiens
actttgggaaaacatgtta

SEQ ID NO: 580197 - DNA, 21 bp, Homo sapiens
actttgtaaaaatcttttgaa

SEQ ID NO: 580198 - DNA, 14 bp, Homo sapiens
acttttataaagca

SEQ ID NO: 580199 - DNA, 20 bp, Homo sapiens
agaaataatgctacaatttt

SEQ ID NO: 580200 - DNA, 22 bp, Homo sapiens
agaaataatgctacaattttaa

SEQ ID NO: 580201 - DNA, 21 bp, Homo sapiens
agaaccacacttgaaaccttt

SEQ ID NO: 580202 - DNA, 20 bp, Homo sapiens
agaactctgggctgccatgt

SEQ ID NO: 580203 - DNA, 12 bp, Homo sapiens
agaagacatgaa

SEQ ID NO: 580204 - DNA, 16 bp, Homo sapiens
agaagcatgaaaaagc

SEQ ID NO: 580205 - DNA, 21 bp, Homo sapiens
agaagtaagaggctacctctt

SEQ ID NO: 580206 - DNA, 20 bp, Homo sapiens
agaatgagtccttgatttca

SEQ ID NO: 580207 - DNA, 21 bp, Homo sapiens
agaatgagtccttgatttcaa

SEQ ID NO: 580208 - DNA, 15 bp, Homo sapiens
agaatgttgtattca

SEQ ID NO: 580209 - DNA, 18 bp, Homo sapiens
agaatgttgtattcagtg

SEQ ID NO: 580210 - DNA, 17 bp, Homo sapiens
agaattgaaaagttttt

SEQ ID NO: 580211 - DNA, 14 bp, Homo sapiens
agacaatccactct

SEQ ID NO: 580212 - DNA, 15 bp, Homo sapiens
agactccctcccctg

SEQ ID NO: 580213 - DNA, 17 bp, Homo sapiens
agactgtagatatgtat

SEQ ID NO: 580214 - DNA, 18 bp, Homo sapiens
agagaatgagtccttgat

SEQ ID NO: 580215 - DNA, 14 bp, Homo sapiens
agagagatgttttg

SEQ ID NO: 580216 - DNA, 14 bp, Homo sapiens
agaggaagcaagaa

SEQ ID NO: 580217 - DNA, 19 bp, Homo sapiens
agaggctgaaagaggccaa

SEQ ID NO: 580218 - DNA, 19 bp, Homo sapiens
agaggcttgtttacctttc

SEQ ID NO: 580219 - DNA, 14 bp, Homo sapiens
agaggtgggagggc

SEQ ID NO: 580220 - DNA, 20 bp, Homo sapiens
agagttcccttgaaactttg

SEQ ID NO: 580221 - DNA, 14 bp, Homo sapiens
agataatattgttt

SEQ ID NO: 580222 - DNA, 21 bp, Homo sapiens
agattctttcagttctttgga

SEQ ID NO: 580223 - DNA, 18 bp, Homo sapiens
agatttctcattgacttt

SEQ ID NO: 580224 - DNA, 24 bp, Homo sapiens
agcaacagcctttgaatgtaacca

SEQ ID NO: 580225 - DNA, 19 bp, Homo sapiens
agcagagttttcattaaat

SEQ ID NO: 580226 - DNA, 15 bp, Homo sapiens
agcatagataatatt

SEQ ID NO: 580227 - DNA, 18 bp, Homo sapiens
agcatcttcacttctaaa

SEQ ID NO: 580228 - DNA, 17 bp, Homo sapiens
agccaaacacactgtaa

SEQ ID NO: 580229 - DNA, 23 bp, Homo sapiens
agcccagcttggccctttccttc

SEQ ID NO: 580230 - DNA, 16 bp, Homo sapiens
agcccagtttcccttc

SEQ ID NO: 580231 - DNA, 19 bp, Homo sapiens
agccccttgtcctctcccg

SEQ ID NO: 580232 - DNA, 14 bp, Homo sapiens
agccgtactgtcta

SEQ ID NO: 580233 - DNA, 15 bp, Homo sapiens
agccgtactgtctat

SEQ ID NO: 580234 - DNA, 22 bp, Homo sapiens
agccttagggaagctggcctga

SEQ ID NO: 580235 - DNA, 20 bp, Homo sapiens
agccttcaaaactatagctt

SEQ ID NO: 580236 - DNA, 12 bp, Homo sapiens
agccttctccct

SEQ ID NO: 580237 - DNA, 20 bp, Homo sapiens
agccttctccctagctcctc

SEQ ID NO: 580238 - DNA, 14 bp, Homo sapiens
agcctttgaatgta

SEQ ID NO: 580239 - DNA, 15 bp, Homo sapiens
agcctttgaatgtaa

SEQ ID NO: 580240 - DNA, 17 bp, Homo sapiens
agcctttgaatgtaacc

SEQ ID NO: 580241 - DNA, 21 bp, Homo sapiens
agctaaagaggctgaaagagg

SEQ ID NO: 580242 - DNA, 13 bp, Homo sapiens
agctcaatgcagt

SEQ ID NO: 580243 - DNA, 16 bp, Homo sapiens
agctcctcaactcacc

SEQ ID NO: 580244 - DNA, 16 bp, Homo sapiens
agctgcagagatttct

SEQ ID NO: 580245 - DNA, 21 bp, Homo sapiens
agctgtcatggaaaagcccag

SEQ ID NO: 580246 - DNA, 20 bp, Homo sapiens
aggaaccttccttcctgctt

SEQ ID NO: 580247 - DNA, 16 bp, Homo sapiens
aggaagcaagaaagcc

SEQ ID NO: 580248 - DNA, 23 bp, Homo sapiens
aggaatcattcagaaatgttgag

SEQ ID NO: 580249 - DNA, 13 bp, Homo sapiens
aggacatgcaata

SEQ ID NO: 580250 - DNA, 22 bp, Homo sapiens
aggacatgtgctattgaactga

SEQ ID NO: 580251 - DNA, 19 bp, Homo sapiens
aggaccctgttttccacac

SEQ ID NO: 580252 - DNA, 22 bp, Homo sapiens
aggaggcgcagcccgaagccca

SEQ ID NO: 580253 - DNA, 23 bp, Homo sapiens
aggaggcgcagcccgaagcccag

SEQ ID NO: 580254 - DNA, 16 bp, Homo sapiens
aggcaccgagaatgtt

SEQ ID NO: 580255 - DNA, 15 bp, Homo sapiens
aggcagattgaaaag

SEQ ID NO: 580256 - DNA, 17 bp, Homo sapiens
aggcagattgaaaagga

SEQ ID NO: 580257 - DNA, 17 bp, Homo sapiens
aggcctgacttctgctg

SEQ ID NO: 580258 - DNA, 22 bp, Homo sapiens
aggcgcagcccgaagcccagtt

SEQ ID NO: 580259 - DNA, 13 bp, Homo sapiens
aggctgaaagagg

SEQ ID NO: 580260 - DNA, 16 bp, Homo sapiens
aggctgaaagaggcca

SEQ ID NO: 580261 - DNA, 18 bp, Homo sapiens
aggcttgcataataagct

SEQ ID NO: 580262 - DNA, 22 bp, Homo sapiens
agggactacccatagacatgaa

SEQ ID NO: 580263 - DNA, 13 bp, Homo sapiens
aggggaacctgcc

SEQ ID NO: 580264 - DNA, 14 bp, Homo sapiens
aggggaacctgcca

SEQ ID NO: 580265 - DNA, 15 bp, Homo sapiens
aggggaacctgccat

SEQ ID NO: 580266 - DNA, 20 bp, Homo sapiens
aggtattaaaactaaatttc

SEQ ID NO: 580267 - DNA, 22 bp, Homo sapiens
aggtgggccttgctacctcaag

SEQ ID NO: 580268 - DNA, 16 bp, Homo sapiens
agtaacatgccagctt

SEQ ID NO: 580269 - DNA, 14 bp, Homo sapiens
agtaagatatctca

SEQ ID NO: 580270 - DNA, 23 bp, Homo sapiens
agtagatccatttccattgctta

SEQ ID NO: 580271 - DNA, 16 bp, Homo sapiens
agtatcagctacaatt

SEQ ID NO: 580272 - DNA, 23 bp, Homo sapiens
agtatgtgggggcttcatctctt

SEQ ID NO: 580273 - DNA, 12 bp, Homo sapiens
agtattgtttaa

SEQ ID NO: 580274 - DNA, 19 bp, Homo sapiens
agtattgtttaaaatgtaa

SEQ ID NO: 580275 - DNA, 17 bp, Homo sapiens
agtccgcagaagccctg

SEQ ID NO: 580276 - DNA, 17 bp, Homo sapiens
agtctgtactaaacagt

SEQ ID NO: 580277 - DNA, 22 bp, Homo sapiens
agtgacctgaccggcacctgcg

SEQ ID NO: 580278 - DNA, 20 bp, Homo sapiens
agtgccccattctcactgct

SEQ ID NO: 580279 - DNA, 16 bp, Homo sapiens
agtgcttaaaaatcat

SEQ ID NO: 580280 - DNA, 17 bp, Homo sapiens
agtgcttaaaaatcatt

SEQ ID NO: 580281 - DNA, 18 bp, Homo sapiens
agtggaccttgagaccac

SEQ ID NO: 580282 - DNA, 19 bp, Homo sapiens
agtggaccttgagaccaca

SEQ ID NO: 580283 - DNA, 17 bp, Homo sapiens
agtgggaagtgaagccc

SEQ ID NO: 580284 - DNA, 22 bp, Homo sapiens
agtggtgatttgaaaaatataa

SEQ ID NO: 580285 - DNA, 22 bp, Homo sapiens
agtgtctattagttttctttgt

SEQ ID NO: 580286 - DNA, 12 bp, Homo sapiens
agttcaaaaaca

SEQ ID NO: 580287 - DNA, 15 bp, Homo sapiens
agttctttggattct

SEQ ID NO: 580288 - DNA, 22 bp, Homo sapiens
agtttcacagcacttacaattt

SEQ ID NO: 580289 - DNA, 18 bp, Homo sapiens
agtttcagtttgttggaa

SEQ ID NO: 580290 - DNA, 14 bp, Homo sapiens
agttttatatgctt

SEQ ID NO: 580291 - DNA, 15 bp, Homo sapiens
agttttatatgcttt

SEQ ID NO: 580292 - DNA, 17 bp, Homo sapiens
agttttatatgctttat

SEQ ID NO: 580293 - DNA, 15 bp, Homo sapiens
agttttcattaaatc

SEQ ID NO: 580294 - DNA, 16 bp, Homo sapiens
agttttctttgtaaag

SEQ ID NO: 580295 - DNA, 17 bp, Homo sapiens
agttttctttgtaaagg

SEQ ID NO: 580296 - DNA, 12 bp, Homo sapiens
agtttttgtttg

SEQ ID NO: 580297 - DNA, 20 bp, Homo sapiens
ataaaatttaaaaaataaat

SEQ ID NO: 580298 - DNA, 13 bp, Homo sapiens
ataaactactgta

SEQ ID NO: 580299 - DNA, 14 bp, Homo sapiens
ataaactactgtaa

SEQ ID NO: 580300 - DNA, 21 bp, Homo sapiens
ataaactactgtaattaagtg

SEQ ID NO: 580301 - DNA, 20 bp, Homo sapiens
ataaatatttatgtagatgt

SEQ ID NO: 580302 - DNA, 17 bp, Homo sapiens
ataaatgtataaatata

SEQ ID NO: 580303 - DNA, 16 bp, Homo sapiens
ataagcaagagagatg

SEQ ID NO: 580304 - DNA, 16 bp, Homo sapiens
ataatattgtttggta

SEQ ID NO: 580305 - DNA, 21 bp, Homo sapiens
ataatattgtttggtaaatgt

SEQ ID NO: 580306 - DNA, 17 bp, Homo sapiens
ataatgctacaatttta

SEQ ID NO: 580307 - DNA, 19 bp, Homo sapiens
ataattgtacaaaattaag

SEQ ID NO: 580308 - DNA, 24 bp, Homo sapiens
ataattgtacaaaattaagcaaat

SEQ ID NO: 580309 - DNA, 16 bp, Homo sapiens
atacatgtgatacatt

SEQ ID NO: 580310 - DNA, 18 bp, Homo sapiens
atacatgtgatacatttt

SEQ ID NO: 580311 - DNA, 18 bp, Homo sapiens
ataccatttagtaagaat

SEQ ID NO: 580312 - DNA, 22 bp, Homo sapiens
ataccatttagtaagaatacca

SEQ ID NO: 580313 - DNA, 15 bp, Homo sapiens
ataccttggactgac

SEQ ID NO: 580314 - DNA, 12 bp, Homo sapiens
atactaaagtgt

SEQ ID NO: 580315 - DNA, 12 bp, Homo sapiens
atagacatgaaa

SEQ ID NO: 580316 - DNA, 16 bp, Homo sapiens
atagataatattgttt

SEQ ID NO: 580317 - DNA, 20 bp, Homo sapiens
atagcagaagaaaaagttgc

SEQ ID NO: 580318 - DNA, 19 bp, Homo sapiens
atagcagccagttcaaaaa

SEQ ID NO: 580319 - DNA, 17 bp, Homo sapiens
atagcttgcagaactgt

SEQ ID NO: 580320 - DNA, 18 bp, Homo sapiens
ataggaatcattcagaaa

SEQ ID NO: 580321 - DNA, 20 bp, Homo sapiens
ataggaatcattcagaaatg

SEQ ID NO: 580322 - DNA, 13 bp, Homo sapiens
atagtaagcatag

SEQ ID NO: 580323 - DNA, 21 bp, Homo sapiens
atagtctaagactatatatat

SEQ ID NO: 580324 - DNA, 23 bp, Homo sapiens
atagtctaagactatatatataa

SEQ ID NO: 580325 - DNA, 15 bp, Homo sapiens
atagtgggatttcca

SEQ ID NO: 580326 - DNA, 18 bp, Homo sapiens
atataaatgtataaatat

SEQ ID NO: 580327 - DNA, 16 bp, Homo sapiens
atatataaatgtataa

SEQ ID NO: 580328 - DNA, 22 bp, Homo sapiens
atatccacagactccctcccct

SEQ ID NO: 580329 - DNA, 17 bp, Homo sapiens
atattactgacatttct

SEQ ID NO: 580330 - DNA, 19 bp, Homo sapiens
atattcagggtaaatagga

SEQ ID NO: 580331 - DNA, 20 bp, Homo sapiens
atattcagggtaaataggaa

SEQ ID NO: 580332 - DNA, 15 bp, Homo sapiens
atattccagatcttt

SEQ ID NO: 580333 - DNA, 12 bp, Homo sapiens
atattgaatgtt

SEQ ID NO: 580334 - DNA, 19 bp, Homo sapiens
atattgtttggtaaatgtt

SEQ ID NO: 580335 - DNA, 14 bp, Homo sapiens
atatttatgtagat

SEQ ID NO: 580336 - DNA, 18 bp, Homo sapiens
atattttgtgtgaaattg

SEQ ID NO: 580337 - DNA, 15 bp, Homo sapiens
atcaaataagaaata

SEQ ID NO: 580338 - DNA, 13 bp, Homo sapiens
atcaactctaata

SEQ ID NO: 580339 - DNA, 16 bp, Homo sapiens
atcaccctctgggcag

SEQ ID NO: 580340 - DNA, 16 bp, Homo sapiens
atcagctacaattgta

SEQ ID NO: 580341 - DNA, 15 bp, Homo sapiens
atcagtaaccccctt

SEQ ID NO: 580342 - DNA, 19 bp, Homo sapiens
atcagtaacccccttaaat

SEQ ID NO: 580343 - DNA, 17 bp, Homo sapiens
atccatttccattgctt

SEQ ID NO: 580344 - DNA, 14 bp, Homo sapiens
atcccacatgatct

SEQ ID NO: 580345 - DNA, 22 bp, Homo sapiens
atcccgggcctcagtgccccat

SEQ ID NO: 580346 - DNA, 16 bp, Homo sapiens
atccctggaggggctg

SEQ ID NO: 580347 - DNA, 16 bp, Homo sapiens
atcgaacaaactgatg

SEQ ID NO: 580348 - DNA, 18 bp, Homo sapiens
atcggtgaaactaacaga

SEQ ID NO: 580349 - DNA, 19 bp, Homo sapiens
atcggtgaaactaacagat

SEQ ID NO: 580350 - DNA, 21 bp, Homo sapiens
atcggtgaaactaacagataa

SEQ ID NO: 580351 - DNA, 14 bp, Homo sapiens
atctgttactgaaa

SEQ ID NO: 580352 - DNA, 23 bp, Homo sapiens
atcttcacttctaaatgcatatc

SEQ ID NO: 580353 - DNA, 12 bp, Homo sapiens
atctttcagaaa

SEQ ID NO: 580354 - DNA, 14 bp, Homo sapiens
atctttcagaaata

SEQ ID NO: 580355 - DNA, 22 bp, Homo sapiens
atctttcagaaatataacacat

SEQ ID NO: 580356 - DNA, 14 bp, Homo sapiens
atgaaaataccatt

SEQ ID NO: 580357 - DNA, 24 bp, Homo sapiens
atgaaaataccatttagtaagaat

SEQ ID NO: 580358 - DNA, 18 bp, Homo sapiens
atgaaagctgttccttgg

SEQ ID NO: 580359 - DNA, 22 bp, Homo sapiens
atgaaataaagacccaggggga

SEQ ID NO: 580360 - DNA, 19 bp, Homo sapiens
atgacggaagaacatagaa

SEQ ID NO: 580361 - DNA, 18 bp, Homo sapiens
atgactaaagagagaatg

SEQ ID NO: 580362 - DNA, 19 bp, Homo sapiens
atgactaaagagagaatgt

SEQ ID NO: 580363 - DNA, 20 bp, Homo sapiens
atgactaaagagagaatgta

SEQ ID NO: 580364 - DNA, 11 bp, Homo sapiens
atgactgcctt

SEQ ID NO: 580365 - DNA, 17 bp, Homo sapiens
atgactgccttgcctcc

SEQ ID NO: 580366 - DNA, 11 bp, Homo sapiens
atgagccagac

SEQ ID NO: 580367 - DNA, 21 bp, Homo sapiens
atgcaaatgagctctgaaatc

SEQ ID NO: 580368 - DNA, 14 bp, Homo sapiens
atgcaataaaattt

SEQ ID NO: 580369 - DNA, 15 bp, Homo sapiens
atgcagctttgcaaa

SEQ ID NO: 580370 - DNA, 20 bp, Homo sapiens
atgcatctggctcaccgggt

SEQ ID NO: 580371 - DNA, 13 bp, Homo sapiens
atgcatttgaggt

SEQ ID NO: 580372 - DNA, 17 bp, Homo sapiens
atgcatttgaggtcaag

SEQ ID NO: 580373 - DNA, 17 bp, Homo sapiens
atgcctgggttgctgct

SEQ ID NO: 580374 - DNA, 20 bp, Homo sapiens
atgcgaaaacttgaatctgt

SEQ ID NO: 580375 - DNA, 17 bp, Homo sapiens
atgctacaattttaaga

SEQ ID NO: 580376 - DNA, 14 bp, Homo sapiens
atggaaaaggaaga

SEQ ID NO: 580377 - DNA, 20 bp, Homo sapiens
atggagaaacatcctaagtg

SEQ ID NO: 580378 - DNA, 13 bp, Homo sapiens
atggaggaatatg

SEQ ID NO: 580379 - DNA, 14 bp, Homo sapiens
atggctgtaaacta

SEQ ID NO: 580380 - DNA, 20 bp, Homo sapiens
atggcttgtctatactcctt

SEQ ID NO: 580381 - DNA, 15 bp, Homo sapiens
atgtaacaacaatta

SEQ ID NO: 580382 - DNA, 19 bp, Homo sapiens
atgtaataaaaagtatatg

SEQ ID NO: 580383 - DNA, 21 bp, Homo sapiens
atgtaattatatatactatat

SEQ ID NO: 580384 - DNA, 17 bp, Homo sapiens
atgtaatttaaatgaaa

SEQ ID NO: 580385 - DNA, 20 bp, Homo sapiens
atgtaatttaaatgaaagaa

SEQ ID NO: 580386 - DNA, 18 bp, Homo sapiens
atgtacagattctttcag

SEQ ID NO: 580387 - DNA, 18 bp, Homo sapiens
atgtagaggcttgtttac

SEQ ID NO: 580388 - DNA, 22 bp, Homo sapiens
atgtagatattgtgaagtacat

SEQ ID NO: 580389 - DNA, 16 bp, Homo sapiens
atgtaggtaagactgt

SEQ ID NO: 580390 - DNA, 20 bp, Homo sapiens
atgtaggtaagactgtagat

SEQ ID NO: 580391 - DNA, 16 bp, Homo sapiens
atgtcaaggactcctg

SEQ ID NO: 580392 - DNA, 16 bp, Homo sapiens
atgtctgtagctcctc

SEQ ID NO: 580393 - DNA, 20 bp, Homo sapiens
atgtgacttggattcaattt

SEQ ID NO: 580394 - DNA, 15 bp, Homo sapiens
atgtgagctcttcct

SEQ ID NO: 580395 - DNA, 20 bp, Homo sapiens
atgtgagtgacgatgatgta

SEQ ID NO: 580396 - DNA, 15 bp, Homo sapiens
atgtgctattgaact

SEQ ID NO: 580397 - DNA, 17 bp, Homo sapiens
atgtgctattgaactga

SEQ ID NO: 580398 - DNA, 17 bp, Homo sapiens
atgtgggatattgaatg

SEQ ID NO: 580399 - DNA, 22 bp, Homo sapiens
atgtgggggcttcatctcttta

SEQ ID NO: 580400 - DNA, 16 bp, Homo sapiens
atgttaaagagaatga

SEQ ID NO: 580401 - DNA, 18 bp, Homo sapiens
atgttaaagagaatgagt

SEQ ID NO: 580402 - DNA, 22 bp, Homo sapiens
atgttttcaaaaggtattatac

SEQ ID NO: 580403 - DNA, 22 bp, Homo sapiens
attaaataaaatttttatgtaa

SEQ ID NO: 580404 - DNA, 18 bp, Homo sapiens
attaaggggaagaatgaa

SEQ ID NO: 580405 - DNA, 19 bp, Homo sapiens
attaaggggaagaatgaaa

SEQ ID NO: 580406 - DNA, 20 bp, Homo sapiens
attatacatgtgatacattt

SEQ ID NO: 580407 - DNA, 21 bp, Homo sapiens
attatacatgtgatacatttt

SEQ ID NO: 580408 - DNA, 22 bp, Homo sapiens
attatagtaatgtgacttggat

SEQ ID NO: 580409 - DNA, 18 bp, Homo sapiens
attatttgaagatttaat

SEQ ID NO: 580410 - DNA, 19 bp, Homo sapiens
attatttttataattgtac

SEQ ID NO: 580411 - DNA, 20 bp, Homo sapiens
attatttttttaaaattttg

SEQ ID NO: 580412 - DNA, 22 bp, Homo sapiens
attatttttttaaaattttgta

SEQ ID NO: 580413 - DNA, 13 bp, Homo sapiens
attcaactttgta

SEQ ID NO: 580414 - DNA, 14 bp, Homo sapiens
attcaactttgtaa

SEQ ID NO: 580415 - DNA, 21 bp, Homo sapiens
attcaattttaaggcatattt

SEQ ID NO: 580416 - DNA, 13 bp, Homo sapiens
attcagaaatgtt

SEQ ID NO: 580417 - DNA, 14 bp, Homo sapiens
attcaggtaacact

SEQ ID NO: 580418 - DNA, 21 bp, Homo sapiens
attctgattctggctttaagc

SEQ ID NO: 580419 - DNA, 14 bp, Homo sapiens
attctggctttaag

SEQ ID NO: 580420 - DNA, 23 bp, Homo sapiens
attcttaaaaggcccatagcagc

SEQ ID NO: 580421 - DNA, 17 bp, Homo sapiens
attctttcagttctttg

SEQ ID NO: 580422 - DNA, 13 bp, Homo sapiens
attcttttctcag

SEQ ID NO: 580423 - DNA, 19 bp, Homo sapiens
attgaaaagtttttgtttg

SEQ ID NO: 580424 - DNA, 20 bp, Homo sapiens
attgaaaagtttttgtttgg

SEQ ID NO: 580425 - DNA, 15 bp, Homo sapiens
attgaactgagccaa

SEQ ID NO: 580426 - DNA, 19 bp, Homo sapiens
attgactaactcaaataca

SEQ ID NO: 580427 - DNA, 23 bp, Homo sapiens
attgactaactcaaatacacatt

SEQ ID NO: 580428 - DNA, 13 bp, Homo sapiens
attgagtattgtt

SEQ ID NO: 580429 - DNA, 14 bp, Homo sapiens
attgagtattgttt

SEQ ID NO: 580430 - DNA, 19 bp, Homo sapiens
attgattgggaaaacattt

SEQ ID NO: 580431 - DNA, 13 bp, Homo sapiens
attgcctctgaaa

SEQ ID NO: 580432 - DNA, 19 bp, Homo sapiens
attgcttattatgtaggta

SEQ ID NO: 580433 - DNA, 15 bp, Homo sapiens
attgggaaaacattt

SEQ ID NO: 580434 - DNA, 15 bp, Homo sapiens
attggttttcctgtg

SEQ ID NO: 580435 - DNA, 22 bp, Homo sapiens
attgtacaaaattaagcaaatg

SEQ ID NO: 580436 - DNA, 19 bp, Homo sapiens
attgtttggtaaatgtttc

SEQ ID NO: 580437 - DNA, 23 bp, Homo sapiens
atttacttgttttggatggcttg

SEQ ID NO: 580438 - DNA, 15 bp, Homo sapiens
atttagtaagaatac

SEQ ID NO: 580439 - DNA, 19 bp, Homo sapiens
atttcaaagttttgttgta

SEQ ID NO: 580440 - DNA, 22 bp, Homo sapiens
atttccagaaccacacttgaaa

SEQ ID NO: 580441 - DNA, 17 bp, Homo sapiens
atttctcattgactttt

SEQ ID NO: 580442 - DNA, 22 bp, Homo sapiens
atttcttttaaagaagtaaatt

SEQ ID NO: 580443 - DNA, 14 bp, Homo sapiens
atttgaaaaatata

SEQ ID NO: 580444 - DNA, 17 bp, Homo sapiens
atttgaagatttaatta

SEQ ID NO: 580445 - DNA, 19 bp, Homo sapiens
atttgaagatttaattact

SEQ ID NO: 580446 - DNA, 12 bp, Homo sapiens
atttgcctcacc

SEQ ID NO: 580447 - DNA, 13 bp, Homo sapiens
atttttttctatt

SEQ ID NO: 580448 - DNA, 22 bp, Homo sapiens
atttttttgcatgcatgcaaat

SEQ ID NO: 580449 - DNA, 22 bp, Homo sapiens
caaaagtgatctgtcccctctc

SEQ ID NO: 580450 - DNA, 13 bp, Homo sapiens
caaaatgtctgta

SEQ ID NO: 580451 - DNA, 22 bp, Homo sapiens
caaaattaagcaaatgttaaaa

SEQ ID NO: 580452 - DNA, 21 bp, Homo sapiens
caaactgcttcccttactttg

SEQ ID NO: 580453 - DNA, 12 bp, Homo sapiens
caacaaggaccc

SEQ ID NO: 580454 - DNA, 19 bp, Homo sapiens
caactttgtaaaaatcttt

SEQ ID NO: 580455 - DNA, 13 bp, Homo sapiens
caagagagatgtt

SEQ ID NO: 580456 - DNA, 22 bp, Homo sapiens
caagcaacagcctttgaatgta

SEQ ID NO: 580457 - DNA, 19 bp, Homo sapiens
caaggaccctgttttccac

SEQ ID NO: 580458 - DNA, 20 bp, Homo sapiens
caaggaccctgttttccaca

SEQ ID NO: 580459 - DNA, 12 bp, Homo sapiens
caaggactcctg

SEQ ID NO: 580460 - DNA, 17 bp, Homo sapiens
caagggctgtcattgca

SEQ ID NO: 580461 - DNA, 15 bp, Homo sapiens
caagggggactgtct

SEQ ID NO: 580462 - DNA, 13 bp, Homo sapiens
caagtaagaagac

SEQ ID NO: 580463 - DNA, 13 bp, Homo sapiens
caataaaatttaa

SEQ ID NO: 580464 - DNA, 14 bp, Homo sapiens
caataaaatttaaa

SEQ ID NO: 580465 - DNA, 17 bp, Homo sapiens
caatattgattgggaaa

SEQ ID NO: 580466 - DNA, 23 bp, Homo sapiens
caatattgattgggaaaacattt

SEQ ID NO: 580467 - DNA, 17 bp, Homo sapiens
caatctctttttgtttg

SEQ ID NO: 580468 - DNA, 15 bp, Homo sapiens
caatgaaccataaat

SEQ ID NO: 580469 - DNA, 17 bp, Homo sapiens
caatgaaccataaattc

SEQ ID NO: 580470 - DNA, 15 bp, Homo sapiens
caatgcctctcccac

SEQ ID NO: 580471 - DNA, 16 bp, Homo sapiens
caatgcctctcccacg

SEQ ID NO: 580472 - DNA, 15 bp, Homo sapiens
caatggctgtaaact

SEQ ID NO: 580473 - DNA, 22 bp, Homo sapiens
caatgtttagcagatttaagat

SEQ ID NO: 580474 - DNA, 20 bp, Homo sapiens
caatttcccctctgtgtcct

SEQ ID NO: 580475 - DNA, 22 bp, Homo sapiens
caatttcccctctgtgtcctct

SEQ ID NO: 580476 - DNA, 22 bp, Homo sapiens
caattttaaggcatatttaaca

SEQ ID NO: 580477 - DNA, 21 bp, Homo sapiens
cacacctctggatccctggag

SEQ ID NO: 580478 - DNA, 11 bp, Homo sapiens
cacactgtaaa

SEQ ID NO: 580479 - DNA, 14 bp, Homo sapiens
cacactgtaaatat

SEQ ID NO: 580480 - DNA, 12 bp, Homo sapiens
cacagactccct

SEQ ID NO: 580481 - DNA, 13 bp, Homo sapiens
cacagactccctc

SEQ ID NO: 580482 - DNA, 22 bp, Homo sapiens
caccctctgggcagctgtcatg

SEQ ID NO: 580483 - DNA, 13 bp, Homo sapiens
caccgagaatgtt

SEQ ID NO: 580484 - DNA, 20 bp, Homo sapiens
cacctaatgtttatgagcca

SEQ ID NO: 580485 - DNA, 21 bp, Homo sapiens
cacctaatgtttatgagccag

SEQ ID NO: 580486 - DNA, 17 bp, Homo sapiens
cacctctggatccctgg

SEQ ID NO: 580487 - DNA, 22 bp, Homo sapiens
cacctgcgagaggtccctgctt

SEQ ID NO: 580488 - DNA, 20 bp, Homo sapiens
cacgttggggtgatttaatc

SEQ ID NO: 580489 - DNA, 18 bp, Homo sapiens
cactgtaaatatccacag

SEQ ID NO: 580490 - DNA, 19 bp, Homo sapiens
cactgtaaatatccacaga

SEQ ID NO: 580491 - DNA, 21 bp, Homo sapiens
cacttaaacgaagagttccct

SEQ ID NO: 580492 - DNA, 13 bp, Homo sapiens
cacttacaatttt

SEQ ID NO: 580493 - DNA, 20 bp, Homo sapiens
cacttccaggggaacctgcc

SEQ ID NO: 580494 - DNA, 21 bp, Homo sapiens
cacttgaaacctttttttatc

SEQ ID NO: 580495 - DNA, 20 bp, Homo sapiens
cagaaatataacacattttt

SEQ ID NO: 580496 - DNA, 15 bp, Homo sapiens
cagaaatggaaagca

SEQ ID NO: 580497 - DNA, 21 bp, Homo sapiens
cagaagaaaaagttgcagtct

SEQ ID NO: 580498 - DNA, 14 bp, Homo sapiens
cagacaatccactc

SEQ ID NO: 580499 - DNA, 19 bp, Homo sapiens
cagacaatccactctcagg

SEQ ID NO: 580500 - DNA, 20 bp, Homo sapiens
cagacaatccactctcagga

SEQ ID NO: 580501 - DNA, 20 bp, Homo sapiens
cagagatttctcattgactt

SEQ ID NO: 580502 - DNA, 15 bp, Homo sapiens
cagagtgcttttctg

SEQ ID NO: 580503 - DNA, 14 bp, Homo sapiens
cagagttttcatta

SEQ ID NO: 580504 - DNA, 17 bp, Homo sapiens
cagagttttcattaaat

SEQ ID NO: 580505 - DNA, 23 bp, Homo sapiens
cagagttttcattaaatcctttt

SEQ ID NO: 580506 - DNA, 18 bp, Homo sapiens
cagataccttatcttaca

SEQ ID NO: 580507 - DNA, 19 bp, Homo sapiens
cagataccttatcttacaa

SEQ ID NO: 580508 - DNA, 13 bp, Homo sapiens
cagcccgaagccc

SEQ ID NO: 580509 - DNA, 17 bp, Homo sapiens
cagcccgaagcccagtt

SEQ ID NO: 580510 - DNA, 15 bp, Homo sapiens
cagcctactctcctt

SEQ ID NO: 580511 - DNA, 23 bp, Homo sapiens
cagcctcgttggaagaggaacag

SEQ ID NO: 580512 - DNA, 15 bp, Homo sapiens
cagcctttgaatgta

SEQ ID NO: 580513 - DNA, 19 bp, Homo sapiens
cagctactaatgatgtttt

SEQ ID NO: 580514 - DNA, 15 bp, Homo sapiens
cagctgtcatggaaa

SEQ ID NO: 580515 - DNA, 21 bp, Homo sapiens
cagctgtcatggaaaagccca

SEQ ID NO: 580516 - DNA, 22 bp, Homo sapiens
cagctgtcatggaaaagcccag

SEQ ID NO: 580517 - DNA, 13 bp, Homo sapiens
cagcttcctgtgg

SEQ ID NO: 580518 - DNA, 12 bp, Homo sapiens
cagctttgcaaa

SEQ ID NO: 580519 - DNA, 19 bp, Homo sapiens
caggacatgcaataaaatt

SEQ ID NO: 580520 - DNA, 15 bp, Homo sapiens
caggaggcgcagccc

SEQ ID NO: 580521 - DNA, 16 bp, Homo sapiens
cagggagcagggaagg

SEQ ID NO: 580522 - DNA, 17 bp, Homo sapiens
cagggatttgcctcacc

SEQ ID NO: 580523 - DNA, 15 bp, Homo sapiens
caggggaacctgcca

SEQ ID NO: 580524 - DNA, 16 bp, Homo sapiens
caggggaacctgccat

SEQ ID NO: 580525 - DNA, 20 bp, Homo sapiens
caggtgttctacactcatct

SEQ ID NO: 580526 - DNA, 20 bp, Homo sapiens
cagtaacccccttaaattta

SEQ ID NO: 580527 - DNA, 21 bp, Homo sapiens
cagtaacccccttaaatttaa

SEQ ID NO: 580528 - DNA, 20 bp, Homo sapiens
cagtaagatatctcaatgaa

SEQ ID NO: 580529 - DNA, 15 bp, Homo sapiens
cagttataagaagaa

SEQ ID NO: 580530 - DNA, 18 bp, Homo sapiens
cataaattcaactttgta

SEQ ID NO: 580531 - DNA, 17 bp, Homo sapiens
cataataagctaaagag

SEQ ID NO: 580532 - DNA, 16 bp, Homo sapiens
cataccttggactgac

SEQ ID NO: 580533 - DNA, 19 bp, Homo sapiens
catagataatattgtttgg

SEQ ID NO: 580534 - DNA, 15 bp, Homo sapiens
catatttaacaaaat

SEQ ID NO: 580535 - DNA, 22 bp, Homo sapiens
catcaatgataatgctaatttt

SEQ ID NO: 580536 - DNA, 23 bp, Homo sapiens
catcctaagtgggaagtgaagcc

SEQ ID NO: 580537 - DNA, 15 bp, Homo sapiens
catcgaacaaactga

SEQ ID NO: 580538 - DNA, 22 bp, Homo sapiens
catcggtgaaactaacagataa

SEQ ID NO: 580539 - DNA, 15 bp, Homo sapiens
catctctttagagaa

SEQ ID NO: 580540 - DNA, 14 bp, Homo sapiens
catcttagtgcctg

SEQ ID NO: 580541 - DNA, 24 bp, Homo sapiens
catgaaaataccatttagtaagaa

SEQ ID NO: 580542 - DNA, 18 bp, Homo sapiens
catgccagcttcctgtgg

SEQ ID NO: 580543 - DNA, 15 bp, Homo sapiens
catggaaaagcccag

SEQ ID NO: 580544 - DNA, 20 bp, Homo sapiens
catggcagcctactctcctt

SEQ ID NO: 580545 - DNA, 15 bp, Homo sapiens
catggctgctgttgc

SEQ ID NO: 580546 - DNA, 19 bp, Homo sapiens
catgtccaaacgtcctctt

SEQ ID NO: 580547 - DNA, 18 bp, Homo sapiens
catgtgagctcttcctat

SEQ ID NO: 580548 - DNA, 18 bp, Homo sapiens
catgtgctattgaactga

SEQ ID NO: 580549 - DNA, 22 bp, Homo sapiens
catgtgctattgaactgagcca

SEQ ID NO: 580550 - DNA, 18 bp, Homo sapiens
cattaagacacacctctg

SEQ ID NO: 580551 - DNA, 21 bp, Homo sapiens
cattaaggggaagaatgaaag

SEQ ID NO: 580552 - DNA, 23 bp, Homo sapiens
cattaaggggaagaatgaaagct

SEQ ID NO: 580553 - DNA, 21 bp, Homo sapiens
cattacagaggtattaaaact

SEQ ID NO: 580554 - DNA, 14 bp, Homo sapiens
cattcagaaatgtt

SEQ ID NO: 580555 - DNA, 18 bp, Homo sapiens
cattgagtattgtttaaa

SEQ ID NO: 580556 - DNA, 18 bp, Homo sapiens
cattgattgtcagctact

SEQ ID NO: 580557 - DNA, 15 bp, Homo sapiens
catttagtaagaata

SEQ ID NO: 580558 - DNA, 15 bp, Homo sapiens
catttcattcctaac

SEQ ID NO: 580559 - DNA, 18 bp, Homo sapiens
catttcattcctaacaca

SEQ ID NO: 580560 - DNA, 15 bp, Homo sapiens
catttgctactgttg

SEQ ID NO: 580561 - DNA, 15 bp, Homo sapiens
cattttaattttaaa

SEQ ID NO: 580562 - DNA, 18 bp, Homo sapiens
cattttaattttaaagtg

SEQ ID NO: 580563 - DNA, 22 bp, Homo sapiens
gtgcatttttgtgaaatgaaaa

SEQ ID NO: 580564 - DNA, 12 bp, Homo sapiens
gtgcctgagagt

SEQ ID NO: 580565 - DNA, 17 bp, Homo sapiens
gtgcgcaacaacaagga

SEQ ID NO: 580566 - DNA, 17 bp, Homo sapiens
gtggattgcctctgaaa

SEQ ID NO: 580567 - DNA, 17 bp, Homo sapiens
gtgggaagtgaagcccc

SEQ ID NO: 580568 - DNA, 20 bp, Homo sapiens
gtgtcagagtaacatgccag

SEQ ID NO: 580569 - DNA, 16 bp, Homo sapiens
gtgtcagtatccaggc

SEQ ID NO: 580570 - DNA, 12 bp, Homo sapiens
gtgtcctctccc

SEQ ID NO: 580571 - DNA, 13 bp, Homo sapiens
gtgtcctctcccc

SEQ ID NO: 580572 - DNA, 15 bp, Homo sapiens
gtgtcctctcccctc

SEQ ID NO: 580573 - DNA, 23 bp, Homo sapiens
gtgtcctctcccctctgccctgt

SEQ ID NO: 580574 - DNA, 22 bp, Homo sapiens
gtgtctccttaagctgcagaga

SEQ ID NO: 580575 - DNA, 13 bp, Homo sapiens
gttataagaagaa

SEQ ID NO: 580576 - DNA, 13 bp, Homo sapiens
gttcaaaatgtct

SEQ ID NO: 580577 - DNA, 21 bp, Homo sapiens
gttcccttgaaactttgggaa

SEQ ID NO: 580578 - DNA, 22 bp, Homo sapiens
gttcccttgaaactttgggaaa

SEQ ID NO: 580579 - DNA, 16 bp, Homo sapiens
gttctacactcatctt

SEQ ID NO: 580580 - DNA, 14 bp, Homo sapiens
gttctttggattct

SEQ ID NO: 580581 - DNA, 19 bp, Homo sapiens
gttgcagtctcagaaagcc

SEQ ID NO: 580582 - DNA, 20 bp, Homo sapiens
gttgctgctgtccagtgcct

SEQ ID NO: 580583 - DNA, 13 bp, Homo sapiens
gttgcttgtcttc

SEQ ID NO: 580584 - DNA, 21 bp, Homo sapiens
gttgggtgtctccttaagctg

SEQ ID NO: 580585 - DNA, 18 bp, Homo sapiens
gttggtatattttatatt

SEQ ID NO: 580586 - DNA, 14 bp, Homo sapiens
tctaaatgcatatc

SEQ ID NO: 580587 - DNA, 22 bp, Homo sapiens
tctaacagtgaagttttactgt

SEQ ID NO: 580588 - DNA, 14 bp, Homo sapiens
tctaattctgattc

SEQ ID NO: 580589 - DNA, 22 bp, Homo sapiens
tctacaatctctttttgtttgc

SEQ ID NO: 580590 - DNA, 15 bp, Homo sapiens
tctacactcatctta

SEQ ID NO: 580591 - DNA, 21 bp, Homo sapiens
tctagagcttaatgctacatg

SEQ ID NO: 580592 - DNA, 20 bp, Homo sapiens
tctattagttttctttgtaa

SEQ ID NO: 580593 - DNA, 20 bp, Homo sapiens
tctcaaggtgggccttgcta

SEQ ID NO: 580594 - DNA, 21 bp, Homo sapiens
tctcaatgaaccataaattca

SEQ ID NO: 580595 - DNA, 14 bp, Homo sapiens
tctcagtgttggta

SEQ ID NO: 580596 - DNA, 17 bp, Homo sapiens
tctcccctctgccctgt

SEQ ID NO: 580597 - DNA, 23 bp, Homo sapiens
tctgaaaagtgtgtatatatttt

SEQ ID NO: 580598 - DNA, 14 bp, Homo sapiens
tctggctttaagcc

SEQ ID NO: 580599 - DNA, 23 bp, Homo sapiens
tctgtagctcctcaactcaccta

SEQ ID NO: 580600 - DNA, 15 bp, Homo sapiens
tctgttactgaaatg

SEQ ID NO: 580601 - DNA, 15 bp, Homo sapiens
tctgttatgggcttt

SEQ ID NO: 580602 - DNA, 12 bp, Homo sapiens
tcttaaccatct

SEQ ID NO: 580603 - DNA, 18 bp, Homo sapiens
tcttagtgcctgagagta

SEQ ID NO: 580604 - DNA, 14 bp, Homo sapiens
tcttcaaagccttc

SEQ ID NO: 580605 - DNA, 17 bp, Homo sapiens
tcttcaaagccttctcc

SEQ ID NO: 580606 - DNA, 22 bp, Homo sapiens
tcttcctatccctctcctaact

SEQ ID NO: 580607 - DNA, 22 bp, Homo sapiens
tctttagtttttggttgggaat

SEQ ID NO: 580608 - DNA, 18 bp, Homo sapiens
tctttcagaaatataaca

SEQ ID NO: 580609 - DNA, 14 bp, Homo sapiens
tcttttgaagcata

SEQ ID NO: 580610 - DNA, 12 bp, Homo sapiens
tgaaaaatataa

SEQ ID NO: 580611 - DNA, 18 bp, Homo sapiens
tgaaaagtgtgtatatat

SEQ ID NO: 580612 - DNA, 19 bp, Homo sapiens
tgaaaagtgtgtatatatt

SEQ ID NO: 580613 - DNA, 16 bp, Homo sapiens
tgaaactttgggaaaa

SEQ ID NO: 580614 - DNA, 23 bp, Homo sapiens
tgaaactttgggaaaacatgtta

SEQ ID NO: 580615 - DNA, 13 bp, Homo sapiens
tgaaagaaaattg

SEQ ID NO: 580616 - DNA, 22 bp, Homo sapiens
tgaaagaaaattgagttgcact

SEQ ID NO: 580617 - DNA, 17 bp, Homo sapiens
tgaaagccttagggaag

SEQ ID NO: 580618 - DNA, 22 bp, Homo sapiens
tgaaatcttcccatgcattctg

SEQ ID NO: 580619 - DNA, 13 bp, Homo sapiens
cattttttaagct

SEQ ID NO: 580620 - DNA, 16 bp, Homo sapiens
cattttttaatttact

SEQ ID NO: 580621 - DNA, 18 bp, Homo sapiens
ccaagcaacagcctttga

SEQ ID NO: 580622 - DNA, 21 bp, Homo sapiens
ccaatcctactaataaaccag

SEQ ID NO: 580623 - DNA, 21 bp, Homo sapiens
ccaatgagactctagggtcca

SEQ ID NO: 580624 - DNA, 16 bp, Homo sapiens
ccacaatgcctctccc

SEQ ID NO: 580625 - DNA, 18 bp, Homo sapiens
ccacaatgcctctcccac

SEQ ID NO: 580626 - DNA, 21 bp, Homo sapiens
ccacaatgcctctcccacgat

SEQ ID NO: 580627 - DNA, 21 bp, Homo sapiens
ccacaccatcaccctctgggc

SEQ ID NO: 580628 - DNA, 18 bp, Homo sapiens
ccacagggttcaaaatgt

SEQ ID NO: 580629 - DNA, 14 bp, Homo sapiens
ccacatcaaacctt

SEQ ID NO: 580630 - DNA, 21 bp, Homo sapiens
ccacttccaggggaacctgcc

SEQ ID NO: 580631 - DNA, 14 bp, Homo sapiens
ccagctaactccag

SEQ ID NO: 580632 - DNA, 14 bp, Homo sapiens
ccagcttcctgtgg

SEQ ID NO: 580633 - DNA, 15 bp, Homo sapiens
ccagcttcctgtggg

SEQ ID NO: 580634 - DNA, 23 bp, Homo sapiens
ccaggacatgcaataaaatttaa

SEQ ID NO: 580635 - DNA, 15 bp, Homo sapiens
ccaggggaacctgcc

SEQ ID NO: 580636 - DNA, 13 bp, Homo sapiens
ccagtgacctgac

SEQ ID NO: 580637 - DNA, 16 bp, Homo sapiens
ccatagacatgaaagg

SEQ ID NO: 580638 - DNA, 15 bp, Homo sapiens
ccatcaccctctggg

SEQ ID NO: 580639 - DNA, 19 bp, Homo sapiens
ccatcaccctctgggcagc

SEQ ID NO: 580640 - DNA, 23 bp, Homo sapiens
ccattacagaggtattaaaacta

SEQ ID NO: 580641 - DNA, 18 bp, Homo sapiens
ccattgcttattatgtag

SEQ ID NO: 580642 - DNA, 14 bp, Homo sapiens
ccattttaatttta

SEQ ID NO: 580643 - DNA, 15 bp, Homo sapiens
cccactggcagcatc

SEQ ID NO: 580644 - DNA, 15 bp, Homo sapiens
cccagtgacctgacc

SEQ ID NO: 580645 - DNA, 18 bp, Homo sapiens
cccattcagagactgtcc

SEQ ID NO: 580646 - DNA, 15 bp, Homo sapiens
ccccatgaggaagga

SEQ ID NO: 580647 - DNA, 18 bp, Homo sapiens
ccccatgaggaaggaaca

SEQ ID NO: 580648 - DNA, 11 bp, Homo sapiens
cccgaagccca

SEQ ID NO: 580649 - DNA, 12 bp, Homo sapiens
cccgaagcccag

SEQ ID NO: 580650 - DNA, 17 bp, Homo sapiens
ccctaagaaaccccagg

SEQ ID NO: 580651 - DNA, 21 bp, Homo sapiens
ccctccgaccacttccagggg

SEQ ID NO: 580652 - DNA, 14 bp, Homo sapiens
ccctctgccctgta

SEQ ID NO: 580653 - DNA, 20 bp, Homo sapiens
ccctgatgtgtcctcaggga

SEQ ID NO: 580654 - DNA, 13 bp, Homo sapiens
ccctgcttacctg

SEQ ID NO: 580655 - DNA, 17 bp, Homo sapiens
ccctgttttccacacca

SEQ ID NO: 580656 - DNA, 17 bp, Homo sapiens
ccgaaaccaaagaagaa

SEQ ID NO: 580657 - DNA, 18 bp, Homo sapiens
ccgaagaggaagcaagaa

SEQ ID NO: 580658 - DNA, 14 bp, Homo sapiens
ccgacgtcatgtat

SEQ ID NO: 580659 - DNA, 14 bp, Homo sapiens
ccgcagaagccctg

SEQ ID NO: 580660 - DNA, 13 bp, Homo sapiens
ccggcacctgcga

SEQ ID NO: 580661 - DNA, 13 bp, Homo sapiens
cctaaaagcactc

SEQ ID NO: 580662 - DNA, 21 bp, Homo sapiens
cctaacatctgacctggcatc

SEQ ID NO: 580663 - DNA, 22 bp, Homo sapiens
cctaagaaaccccagggcaggg

SEQ ID NO: 580664 - DNA, 20 bp, Homo sapiens
cctaagtgggaagtgaagcc

SEQ ID NO: 580665 - DNA, 19 bp, Homo sapiens
cctaatgtttatgagccag

SEQ ID NO: 580666 - DNA, 15 bp, Homo sapiens
cctactaataaacca

SEQ ID NO: 580667 - DNA, 14 bp, Homo sapiens
cctagtaagaagac

SEQ ID NO: 580668 - DNA, 16 bp, Homo sapiens
cctattctataaaact

SEQ ID NO: 580669 - DNA, 21 bp, Homo sapiens
cctcaactcacctaatgttta

SEQ ID NO: 580670 - DNA, 16 bp, Homo sapiens
cctcaccttggggcct

SEQ ID NO: 580671 - DNA, 20 bp, Homo sapiens
cctcaccttggggccttgat

SEQ ID NO: 580672 - DNA, 21 bp, Homo sapiens
cctcagggagcagggaaggcc

SEQ ID NO: 580673 - DNA, 23 bp, Homo sapiens
cctcagggagcagggaaggcctg

SEQ ID NO: 580674 - DNA, 13 bp, Homo sapiens
cctcagtgcccca

SEQ ID NO: 580675 - DNA, 16 bp, Homo sapiens
cctctcccctcatgga

SEQ ID NO: 580676 - DNA, 21 bp, Homo sapiens
cctctcccgcgggcctggaca

SEQ ID NO: 580677 - DNA, 18 bp, Homo sapiens
cctctgaaaagtgtgtat

SEQ ID NO: 580678 - DNA, 12 bp, Homo sapiens
cctctgccctgt

SEQ ID NO: 580679 - DNA, 14 bp, Homo sapiens
cctcttgtctgatt

SEQ ID NO: 580680 - DNA, 23 bp, Homo sapiens
cctctttagtttttggttgggaa

SEQ ID NO: 580681 - DNA, 19 bp, Homo sapiens
cctgaccggcacctgcgag

SEQ ID NO: 580682 - DNA, 20 bp, Homo sapiens
cctgagaggggaagcggccc

SEQ ID NO: 580683 - DNA, 21 bp, Homo sapiens
cctgatgtgtcctcagggagc

SEQ ID NO: 580684 - DNA, 15 bp, Homo sapiens
cctggaggtgggaga

SEQ ID NO: 580685 - DNA, 15 bp, Homo sapiens
cctgtggcataaatt

SEQ ID NO: 580686 - DNA, 18 bp, Homo sapiens
cctgtggcataaattgca

SEQ ID NO: 580687 - DNA, 20 bp, Homo sapiens
cctgtgggccaggagctcag

SEQ ID NO: 580688 - DNA, 18 bp, Homo sapiens
cctgttttccacaccatc

SEQ ID NO: 580689 - DNA, 18 bp, Homo sapiens
ccttcatcgaacaaactg

SEQ ID NO: 580690 - DNA, 17 bp, Homo sapiens
ccttctccctagctcct

SEQ ID NO: 580691 - DNA, 13 bp, Homo sapiens
ccttgatgactgc

SEQ ID NO: 580692 - DNA, 13 bp, Homo sapiens
ccttgatttcaaa

SEQ ID NO: 580693 - DNA, 14 bp, Homo sapiens
ccttgctacctcaa

SEQ ID NO: 580694 - DNA, 23 bp, Homo sapiens
ccttgttaagtatcagctacaat

SEQ ID NO: 580695 - DNA, 12 bp, Homo sapiens
cctttgaatgta

SEQ ID NO: 580696 - DNA, 13 bp, Homo sapiens
cctttgaatgtaa

SEQ ID NO: 580697 - DNA, 12 bp, Homo sapiens
cgaaaacttgaa

SEQ ID NO: 580698 - DNA, 10 bp, Homo sapiens
cgaagcccag

SEQ ID NO: 580699 - DNA, 16 bp, Homo sapiens
cgagaggtccctgctt

SEQ ID NO: 580700 - DNA, 16 bp, Homo sapiens
cgcaacaacaaggacc

SEQ ID NO: 580701 - DNA, 17 bp, Homo sapiens
cgcagcccgaagcccag

SEQ ID NO: 580702 - DNA, 16 bp, Homo sapiens
cggacgtcctgctggc

SEQ ID NO: 580703 - DNA, 21 bp, Homo sapiens
cggacgtcctgctggcacctc

SEQ ID NO: 580704 - DNA, 22 bp, Homo sapiens
cggcacctgcgagaggtccctg

SEQ ID NO: 580705 - DNA, 18 bp, Homo sapiens
cgtttataaacagaaatg

SEQ ID NO: 580706 - DNA, 23 bp, Homo sapiens
ctaaacatgtatgtaaatagcta

SEQ ID NO: 580707 - DNA, 16 bp, Homo sapiens
ctaaagagagaatgta

SEQ ID NO: 580708 - DNA, 13 bp, Homo sapiens
ctaaagtgtctat

SEQ ID NO: 580709 - DNA, 21 bp, Homo sapiens
ctaaatgcatatcctgagcca

SEQ ID NO: 580710 - DNA, 14 bp, Homo sapiens
ctaacacagcatgt

SEQ ID NO: 580711 - DNA, 20 bp, Homo sapiens
ctaactccagtctcctgaca

SEQ ID NO: 580712 - DNA, 13 bp, Homo sapiens
ctaagactatata

SEQ ID NO: 580713 - DNA, 15 bp, Homo sapiens
ctaaggaaccttcct

SEQ ID NO: 580714 - DNA, 12 bp, Homo sapiens
ctaataaaccag

SEQ ID NO: 580715 - DNA, 17 bp, Homo sapiens
ctaattttattatagta

SEQ ID NO: 580716 - DNA, 13 bp, Homo sapiens
ctactaatgatgt

SEQ ID NO: 580717 - DNA, 15 bp, Homo sapiens
ctactgtaattaagt

SEQ ID NO: 580718 - DNA, 18 bp, Homo sapiens
ctactgtaattaagtgca

SEQ ID NO: 580719 - DNA, 22 bp, Homo sapiens
ctactgtaattaagtgcaattt

SEQ ID NO: 580720 - DNA, 22 bp, Homo sapiens
ctagtaagaagacaaactgctt

SEQ ID NO: 580721 - DNA, 15 bp, Homo sapiens
ctataaaactctgca

SEQ ID NO: 580722 - DNA, 15 bp, Homo sapiens
ctataaactactgta

SEQ ID NO: 580723 - DNA, 17 bp, Homo sapiens
ctataaactactgtaat

SEQ ID NO: 580724 - DNA, 22 bp, Homo sapiens
ctataaactactgtaattaagt

SEQ ID NO: 580725 - DNA, 15 bp, Homo sapiens
ctcaccttggggcct

SEQ ID NO: 580726 - DNA, 18 bp, Homo sapiens
ctcaccttggggccttga

SEQ ID NO: 580727 - DNA, 18 bp, Homo sapiens
ctcagggagcagggaagg

SEQ ID NO: 580728 - DNA, 21 bp, Homo sapiens
ctcagggagcagggaaggcct

SEQ ID NO: 580729 - DNA, 23 bp, Homo sapiens
ctcagggagcagggaaggcctga

SEQ ID NO: 580730 - DNA, 22 bp, Homo sapiens
ctcagtgttggtatattttata

SEQ ID NO: 580731 - DNA, 12 bp, Homo sapiens
ctcattgacttt

SEQ ID NO: 580732 - DNA, 20 bp, Homo sapiens
ctccagtctcctgacattaa

SEQ ID NO: 580733 - DNA, 22 bp, Homo sapiens
ctcccctgcccccatcccacat

SEQ ID NO: 580734 - DNA, 16 bp, Homo sapiens
ctcctattctataaaa

SEQ ID NO: 580735 - DNA, 14 bp, Homo sapiens
ctcctcaactcacc

SEQ ID NO: 580736 - DNA, 14 bp, Homo sapiens
gaacaaactgatgc

SEQ ID NO: 580737 - DNA, 18 bp, Homo sapiens
gaacaaactgatgcgaaa

SEQ ID NO: 580738 - DNA, 15 bp, Homo sapiens
gaaccataaattcaa

SEQ ID NO: 580739 - DNA, 15 bp, Homo sapiens
gaaccttccttcctg

SEQ ID NO: 580740 - DNA, 18 bp, Homo sapiens
gaactctgggctgccatg

SEQ ID NO: 580741 - DNA, 20 bp, Homo sapiens
gaactgtagctgccatggct

SEQ ID NO: 580742 - DNA, 12 bp, Homo sapiens
gaagaatgaaag

SEQ ID NO: 580743 - DNA, 18 bp, Homo sapiens
gaagacatgaaccaagtg

SEQ ID NO: 580744 - DNA, 20 bp, Homo sapiens
gaagagttcccttgaaactt

SEQ ID NO: 580745 - DNA, 23 bp, Homo sapiens
gaagcactttgggattctttcca

SEQ ID NO: 580746 - DNA, 14 bp, Homo sapiens
gaagggaaagtttt

SEQ ID NO: 580747 - DNA, 15 bp, Homo sapiens
gaagtaaatttgtcc

SEQ ID NO: 580748 - DNA, 12 bp, Homo sapiens
gaagtgaagccc

SEQ ID NO: 580749 - DNA, 19 bp, Homo sapiens
gaataccacatcaaataag

SEQ ID NO: 580750 - DNA, 14 bp, Homo sapiens
gaatgaggaaaatt

SEQ ID NO: 580751 - DNA, 12 bp, Homo sapiens
gaatgtaaccaa

SEQ ID NO: 580752 - DNA, 18 bp, Homo sapiens
gcgcagcccgaagcccag

SEQ ID NO: 580753 - DNA, 13 bp, Homo sapiens
gctaagatataat

SEQ ID NO: 580754 - DNA, 17 bp, Homo sapiens
gctaagatataatttaa

SEQ ID NO: 580755 - DNA, 13 bp, Homo sapiens
gctacctcaaggg

SEQ ID NO: 580756 - DNA, 16 bp, Homo sapiens
gctactaatgatgttt

SEQ ID NO: 580757 - DNA, 19 bp, Homo sapiens
gctactgttgtaagaattc

SEQ ID NO: 580758 - DNA, 19 bp, Homo sapiens
gctcagccgtgcactccct

SEQ ID NO: 580759 - DNA, 20 bp, Homo sapiens
gctctaaaaggtaatgtgtg

SEQ ID NO: 580760 - DNA, 23 bp, Homo sapiens
gctctaaaaggtaatgtgtggat

SEQ ID NO: 580761 - DNA, 20 bp, Homo sapiens
gctcttcctatccctctcct

SEQ ID NO: 580762 - DNA, 14 bp, Homo sapiens
gctgagggtttgaa

SEQ ID NO: 580763 - DNA, 13 bp, Homo sapiens
gctgccatgtgaa

SEQ ID NO: 580764 - DNA, 14 bp, Homo sapiens
gctgctgtccagtg

SEQ ID NO: 580765 - DNA, 15 bp, Homo sapiens
gctgctgtccagtgc

SEQ ID NO: 580766 - DNA, 21 bp, Homo sapiens
gctgtaaactataaactactg

SEQ ID NO: 580767 - DNA, 20 bp, Homo sapiens
gctgtcatggaaaagcccag

SEQ ID NO: 580768 - DNA, 19 bp, Homo sapiens
gctgtccagtgcctacatc

SEQ ID NO: 580769 - DNA, 15 bp, Homo sapiens
gcttaaaaatcattg

SEQ ID NO: 580770 - DNA, 16 bp, Homo sapiens
gcttaatgctacatgt

SEQ ID NO: 580771 - DNA, 14 bp, Homo sapiens
tggaaaagcccagt

SEQ ID NO: 580772 - DNA, 15 bp, Homo sapiens
tggaaaagcccagtg

SEQ ID NO: 580773 - DNA, 21 bp, Homo sapiens
tggaaaagcccagtgacctga

SEQ ID NO: 580774 - DNA, 15 bp, Homo sapiens
tggaaaaggaagact

SEQ ID NO: 580775 - DNA, 19 bp, Homo sapiens
tggaaagcagagttttcat

SEQ ID NO: 580776 - DNA, 13 bp, Homo sapiens
tggaaattcctgt

SEQ ID NO: 580777 - DNA, 21 bp, Homo sapiens
tggactgactaccagctaact

SEQ ID NO: 580778 - DNA, 22 bp, Homo sapiens
tggagacgtttataaacagaaa

SEQ ID NO: 580779 - DNA, 23 bp, Homo sapiens
tggaggtgggagacaaggaacca

SEQ ID NO: 580780 - DNA, 18 bp, Homo sapiens
tggatttggcactagcca

SEQ ID NO: 580781 - DNA, 15 bp, Homo sapiens
tggcataaattgcat

SEQ ID NO: 580782 - DNA, 22 bp, Homo sapiens
tggcatcaagaggtgggagggc

SEQ ID NO: 580783 - DNA, 15 bp, Homo sapiens
tggcctgagagggga

SEQ ID NO: 580784 - DNA, 14 bp, Homo sapiens
tgggcagctgtcat

SEQ ID NO: 580785 - DNA, 21 bp, Homo sapiens
tgggcttttggggagccagaa

SEQ ID NO: 580786 - DNA, 18 bp, Homo sapiens
tggggccttgatgactgc

SEQ ID NO: 580787 - DNA, 20 bp, Homo sapiens
tggggccttgatgactgcct

SEQ ID NO: 580788 - DNA, 15 bp, Homo sapiens
tggggggcattgagt

SEQ ID NO: 580789 - DNA, 19 bp, Homo sapiens
tgggttttcttaaccatct

SEQ ID NO: 580790 - DNA, 23 bp, Homo sapiens
tggtaatcccctaaaataacagt

SEQ ID NO: 580791 - DNA, 15 bp, Homo sapiens
tggtcaagattttga

SEQ ID NO: 580792 - DNA, 22 bp, Homo sapiens
tggtcaagattttgaatgcttc

SEQ ID NO: 580793 - DNA, 22 bp, Homo sapiens
tggtgatttgaaaaatataaaa

SEQ ID NO: 580794 - DNA, 18 bp, Homo sapiens
tggtgtcagtatccaggc

SEQ ID NO: 580795 - DNA, 23 bp, Homo sapiens
tgtaaaaatcttttgaagcatag

SEQ ID NO: 580796 - DNA, 12 bp, Homo sapiens
tgtaacaacaat

SEQ ID NO: 580797 - DNA, 20 bp, Homo sapiens
tgtaattaagtgcaatttcc

SEQ ID NO: 580798 - DNA, 12 bp, Homo sapiens
tgtaattatata

SEQ ID NO: 580799 - DNA, 21 bp, Homo sapiens
tgtaattatatatactatatt

SEQ ID NO: 580800 - DNA, 17 bp, Homo sapiens
tgtaatttaaatgaaag

SEQ ID NO: 580801 - DNA, 14 bp, Homo sapiens
tgtacagattcttt

SEQ ID NO: 580802 - DNA, 18 bp, Homo sapiens
tgtacagattctttcagt

SEQ ID NO: 580803 - DNA, 19 bp, Homo sapiens
tgtactctacaaaatatag

SEQ ID NO: 580804 - DNA, 21 bp, Homo sapiens
tgtagatattgtgaagtacat

SEQ ID NO: 580805 - DNA, 14 bp, Homo sapiens
tgtaggtaagactg

SEQ ID NO: 580806 - DNA, 19 bp, Homo sapiens
tgtataaatatacagtata

SEQ ID NO: 580807 - DNA, 22 bp, Homo sapiens
tgtatatattttgtgtgaaatt

SEQ ID NO: 580808 - DNA, 16 bp, Homo sapiens
acatgtgctattgaac

SEQ ID NO: 580809 - DNA, 13 bp, Homo sapiens
accaaagaagaaa

SEQ ID NO: 580810 - DNA, 19 bp, Homo sapiens
accaatcctactaataaac

SEQ ID NO: 580811 - DNA, 17 bp, Homo sapiens
accaccgaagaggaagc

SEQ ID NO: 580812 - DNA, 22 bp, Homo sapiens
accagataccttatcttacaat

SEQ ID NO: 580813 - DNA, 15 bp, Homo sapiens
accagctaactccag

SEQ ID NO: 580814 - DNA, 19 bp, Homo sapiens
accaggtgttctacactca

SEQ ID NO: 580815 - DNA, 12 bp, Homo sapiens
accatcaccctc

SEQ ID NO: 580816 - DNA, 18 bp, Homo sapiens
accatcaccctctgggca

SEQ ID NO: 580817 - DNA, 18 bp, Homo sapiens
accatgtgagctcttcct

SEQ ID NO: 580818 - DNA, 19 bp, Homo sapiens
accatgtgagctcttccta

SEQ ID NO: 580819 - DNA, 23 bp, Homo sapiens
accattttttaatttacttgttt

SEQ ID NO: 580820 - DNA, 21 bp, Homo sapiens
acccattcagagactgtccct

SEQ ID NO: 580821 - DNA, 20 bp, Homo sapiens
accctgttttccacaccatc

SEQ ID NO: 580822 - DNA, 22 bp, Homo sapiens
acccttactggcttacctcctc

SEQ ID NO: 580823 - DNA, 11 bp, Homo sapiens
accggcacctg

SEQ ID NO: 580824 - DNA, 19 bp, Homo sapiens
acctaatgtttatgagcca

SEQ ID NO: 580825 - DNA, 10 bp, Homo sapiens
acctcaaggg

SEQ ID NO: 580826 - DNA, 18 bp, Homo sapiens
acctcagacaatccactc

SEQ ID NO: 580827 - DNA, 22 bp, Homo sapiens
acctcagacaatccactctcag

SEQ ID NO: 580828 - DNA, 17 bp, Homo sapiens
acctctggatccctgga

SEQ ID NO: 580829 - DNA, 17 bp, Homo sapiens
acctgaccggcacctgc

SEQ ID NO: 580830 - DNA, 18 bp, Homo sapiens
acctgaccggcacctgcg

SEQ ID NO: 580831 - DNA, 20 bp, Homo sapiens
acctgcgagaggtccctgct

SEQ ID NO: 580832 - DNA, 22 bp, Homo sapiens
acctgtcctaaggaaccttcct

SEQ ID NO: 580833 - DNA, 24 bp, Homo sapiens
accttggggccttgatgactgcct

SEQ ID NO: 580834 - DNA, 22 bp, Homo sapiens
acggacgtcctgctggcacctc

SEQ ID NO: 580835 - DNA, 14 bp, Homo sapiens
acgtttataaacag

SEQ ID NO: 580836 - DNA, 16 bp, Homo sapiens
acgtttataaacagaa

SEQ ID NO: 580837 - DNA, 19 bp, Homo sapiens
acgtttataaacagaaatg

SEQ ID NO: 580838 - DNA, 21 bp, Homo sapiens
acgtttataaacagaaatgga

SEQ ID NO: 580839 - DNA, 21 bp, Homo sapiens
actaaagagagaatgtagata

SEQ ID NO: 580840 - DNA, 14 bp, Homo sapiens
actaaagtgtctat

SEQ ID NO: 580841 - DNA, 18 bp, Homo sapiens
actaaagtgtctattagt

SEQ ID NO: 580842 - DNA, 14 bp, Homo sapiens
actaataaaccagt

SEQ ID NO: 580843 - DNA, 15 bp, Homo sapiens
actacccatagacat

SEQ ID NO: 580844 - DNA, 19 bp, Homo sapiens
actacccatagacatgaaa

SEQ ID NO: 580845 - DNA, 13 bp, Homo sapiens
actagattgacta

SEQ ID NO: 580846 - DNA, 16 bp, Homo sapiens
actataaactactgta

SEQ ID NO: 580847 - DNA, 19 bp, Homo sapiens
actataaactactgtaatt

SEQ ID NO: 580848 - DNA, 20 bp, Homo sapiens
actataaactactgtaatta

SEQ ID NO: 580849 - DNA, 20 bp, Homo sapiens
actatatatataaatgtata

SEQ ID NO: 580850 - DNA, 22 bp, Homo sapiens
actatatatataaatgtataaa

SEQ ID NO: 580851 - DNA, 20 bp, Homo sapiens
actatatttttctcaatgtt

SEQ ID NO: 580852 - DNA, 23 bp, Homo sapiens
actatatttttctcaatgtttag

SEQ ID NO: 580853 - DNA, 16 bp, Homo sapiens
actcaaatacacattt

SEQ ID NO: 580854 - DNA, 16 bp, Homo sapiens
actcacctaatgttta

SEQ ID NO: 580855 - DNA, 23 bp, Homo sapiens
actcacctaatgtttatgagcca

SEQ ID NO: 580856 - DNA, 18 bp, Homo sapiens
actcatcttagtgcctga

SEQ ID NO: 580857 - DNA, 14 bp, Homo sapiens
actccctcccctgc

SEQ ID NO: 580858 - DNA, 14 bp, Homo sapiens
actctaatagtgct

SEQ ID NO: 580859 - DNA, 18 bp, Homo sapiens
actgagccaaacacactg

SEQ ID NO: 580860 - DNA, 23 bp, Homo sapiens
actgagccaaacacactgtaaat

SEQ ID NO: 580861 - DNA, 17 bp, Homo sapiens
actgtaaacttctgcaa

SEQ ID NO: 580862 - DNA, 15 bp, Homo sapiens
actgtatcattttct

SEQ ID NO: 580863 - DNA, 16 bp, Homo sapiens
actgtatcattttctt

SEQ ID NO: 580864 - DNA, 12 bp, Homo sapiens
actgtctttcag

SEQ ID NO: 580865 - DNA, 17 bp, Homo sapiens
actgtgagaacccagtt

SEQ ID NO: 580866 - DNA, 15 bp, Homo sapiens
actgttgtaagaatt

SEQ ID NO: 580867 - DNA, 19 bp, Homo sapiens
acttctgcaacaagcatgc

SEQ ID NO: 580868 - DNA, 19 bp, Homo sapiens
acttgaatctgttactgaa

SEQ ID NO: 580869 - DNA, 21 bp, Homo sapiens
acttgaatctgttactgaaat

SEQ ID NO: 580870 - DNA, 23 bp, Homo sapiens
acttgaatctgttactgaaatga

SEQ ID NO: 580871 - DNA, 15 bp, Homo sapiens
acttggattcaattt

SEQ ID NO: 580872 - DNA, 19 bp, Homo sapiens
acttgttttggatggcttg

SEQ ID NO: 580873 - DNA, 20 bp, Homo sapiens
acttgttttggatggcttgt

SEQ ID NO: 580874 - DNA, 17 bp, Homo sapiens
acttttataaagcatgt

SEQ ID NO: 580875 - DNA, 21 bp, Homo sapiens
agaaaaagttgcagtctcaga

SEQ ID NO: 580876 - DNA, 13 bp, Homo sapiens
agaaaattgagtt

SEQ ID NO: 580877 - DNA, 22 bp, Homo sapiens
agaaaattgagttgcacttatt

SEQ ID NO: 580878 - DNA, 13 bp, Homo sapiens
agaaacttcgcct

SEQ ID NO: 580879 - DNA, 18 bp, Homo sapiens
agaaagccgtactgtcta

SEQ ID NO: 580880 - DNA, 16 bp, Homo sapiens
agaaatggaaagcaga

SEQ ID NO: 580881 - DNA, 16 bp, Homo sapiens
agaaccacacttgaaa

SEQ ID NO: 580882 - DNA, 19 bp, Homo sapiens
agaaccacacttgaaacct

SEQ ID NO: 580883 - DNA, 20 bp, Homo sapiens
agaaccacacttgaaacctt

SEQ ID NO: 580884 - DNA, 23 bp, Homo sapiens
agaagaaaaagttgcagtctcag

SEQ ID NO: 580885 - DNA, 15 bp, Homo sapiens
agaagacaaactgct

SEQ ID NO: 580886 - DNA, 13 bp, Homo sapiens
agaagcatgaaaa

SEQ ID NO: 580887 - DNA, 16 bp, Homo sapiens
agaagtaaatttgtcc

SEQ ID NO: 580888 - DNA, 19 bp, Homo sapiens
agaagtaaatttgtccaat

SEQ ID NO: 580889 - DNA, 20 bp, Homo sapiens
agaagtaaatttgtccaatg

SEQ ID NO: 580890 - DNA, 14 bp, Homo sapiens
agaagtgagcaaaa

SEQ ID NO: 580891 - DNA, 18 bp, Homo sapiens
agaagtgagcaaaaaaga

SEQ ID NO: 580892 - DNA, 17 bp, Homo sapiens
agaagttcatgtccaaa

SEQ ID NO: 580893 - DNA, 16 bp, Homo sapiens
agaatgaaagctgttc

SEQ ID NO: 580894 - DNA, 16 bp, Homo sapiens
agaattgaaaagtttt

SEQ ID NO: 580895 - DNA, 16 bp, Homo sapiens
agacgtttataaacag

SEQ ID NO: 580896 - DNA, 21 bp, Homo sapiens
agactatatatataaatgtat

SEQ ID NO: 580897 - DNA, 15 bp, Homo sapiens
agactctagggtcca

SEQ ID NO: 580898 - DNA, 20 bp, Homo sapiens
agactgaactgcagggttca

SEQ ID NO: 580899 - DNA, 17 bp, Homo sapiens
agagaatgtagatattg

SEQ ID NO: 580900 - DNA, 12 bp, Homo sapiens
agagatttctca

SEQ ID NO: 580901 - DNA, 13 bp, Homo sapiens
agagatttctcat

SEQ ID NO: 580902 - DNA, 20 bp, Homo sapiens
agagcaagagataagtcttt

SEQ ID NO: 580903 - DNA, 21 bp, Homo sapiens
agaggaacagcactggggagt

SEQ ID NO: 580904 - DNA, 16 bp, Homo sapiens
agagggagaagcatga

SEQ ID NO: 580905 - DNA, 13 bp, Homo sapiens
agaggtccctgct

SEQ ID NO: 580906 - DNA, 16 bp, Homo sapiens
agaggtccctgcttac

SEQ ID NO: 580907 - DNA, 18 bp, Homo sapiens
agaggtccctgcttacct

SEQ ID NO: 580908 - DNA, 19 bp, Homo sapiens
agagtaacatgccagcttc

SEQ ID NO: 580909 - DNA, 15 bp, Homo sapiens
agatatgtattcttt

SEQ ID NO: 580910 - DNA, 18 bp, Homo sapiens
agatccatttccattgct

SEQ ID NO: 580911 - DNA, 16 bp, Homo sapiens
agatctttcagaaata

SEQ ID NO: 580912 - DNA, 20 bp, Homo sapiens
agatctttcagaaatataac

SEQ ID NO: 580913 - DNA, 21 bp, Homo sapiens
agatggctggaaggggtccag

SEQ ID NO: 580914 - DNA, 20 bp, Homo sapiens
agattctttcagttctttgg

SEQ ID NO: 580915 - DNA, 23 bp, Homo sapiens
agcaacagcctttgaatgtaacc

SEQ ID NO: 580916 - DNA, 15 bp, Homo sapiens
agcaagagagatgtt

SEQ ID NO: 580917 - DNA, 13 bp, Homo sapiens
agcagagttttca

SEQ ID NO: 580918 - DNA, 23 bp, Homo sapiens
agcagagttttcattaaatcctt

SEQ ID NO: 580919 - DNA, 14 bp, Homo sapiens
agcagggaaggcct

SEQ ID NO: 580920 - DNA, 16 bp, Homo sapiens
agcatagaaaccacta

SEQ ID NO: 580921 - DNA, 20 bp, Homo sapiens
agcatcttcacttctaaatg

SEQ ID NO: 580922 - DNA, 23 bp, Homo sapiens
attgagtattgtttaaaatgtaa

SEQ ID NO: 580923 - DNA, 18 bp, Homo sapiens
attgattgggaaaacatt

SEQ ID NO: 580924 - DNA, 23 bp, Homo sapiens
attgattgggaaaacatttgctg

SEQ ID NO: 580925 - DNA, 15 bp, Homo sapiens
attgcatcactgtat

SEQ ID NO: 580926 - DNA, 21 bp, Homo sapiens
attgccacaatgcctctccca

SEQ ID NO: 580927 - DNA, 22 bp, Homo sapiens
attgccacaatgcctctcccac

SEQ ID NO: 580928 - DNA, 15 bp, Homo sapiens
attgtacaaaattaa

SEQ ID NO: 580929 - DNA, 18 bp, Homo sapiens
attgtacaaaattaagca

SEQ ID NO: 580930 - DNA, 16 bp, Homo sapiens
attgtttaaaatgtaa

SEQ ID NO: 580931 - DNA, 18 bp, Homo sapiens
attgtttggtaaatgttt

SEQ ID NO: 580932 - DNA, 19 bp, Homo sapiens
atttaataccagatacctt

SEQ ID NO: 580933 - DNA, 14 bp, Homo sapiens
atttagtaagaata

SEQ ID NO: 580934 - DNA, 12 bp, Homo sapiens
atttatgtagat

SEQ ID NO: 580935 - DNA, 14 bp, Homo sapiens
atttcattcctaac

SEQ ID NO: 580936 - DNA, 13 bp, Homo sapiens
atttccattgctt

SEQ ID NO: 580937 - DNA, 16 bp, Homo sapiens
atttcttttaaagaag

SEQ ID NO: 580938 - DNA, 17 bp, Homo sapiens
atttcttttaaagaagt

SEQ ID NO: 580939 - DNA, 11 bp, Homo sapiens
atttgcctcac

SEQ ID NO: 580940 - DNA, 17 bp, Homo sapiens
atttgctactgttgtaa

SEQ ID NO: 580941 - DNA, 13 bp, Homo sapiens
atttgctgccatt

SEQ ID NO: 580942 - DNA, 17 bp, Homo sapiens
attttaaagtgcaaaag

SEQ ID NO: 580943 - DNA, 14 bp, Homo sapiens
attttcatgaaaat

SEQ ID NO: 580944 - DNA, 17 bp, Homo sapiens
attttcatgaaaatacc

SEQ ID NO: 580945 - DNA, 10 bp, Homo sapiens
attttgtatg

SEQ ID NO: 580946 - DNA, 15 bp, Homo sapiens
attttgtatgttaaa

SEQ ID NO: 580947 - DNA, 12 bp, Homo sapiens
atttttataatt

SEQ ID NO: 580948 - DNA, 21 bp, Homo sapiens
atttttataattgtacaaaat

SEQ ID NO: 580949 - DNA, 17 bp, Homo sapiens
atttttttaaaattttg

SEQ ID NO: 580950 - DNA, 20 bp, Homo sapiens
caaaagtgatctgtcccctc

SEQ ID NO: 580951 - DNA, 22 bp, Homo sapiens
caaaatgtctgtagctcctcaa

SEQ ID NO: 580952 - DNA, 16 bp, Homo sapiens
caaaattaagcaaatg

SEQ ID NO: 580953 - DNA, 14 bp, Homo sapiens
caaacctttgagta

SEQ ID NO: 580954 - DNA, 15 bp, Homo sapiens
caaacctttgagtag

SEQ ID NO: 580955 - DNA, 21 bp, Homo sapiens
caaactgatgcgaaaacttga

SEQ ID NO: 580956 - DNA, 15 bp, Homo sapiens
caacaacaaggaccc

SEQ ID NO: 580957 - DNA, 17 bp, Homo sapiens
caacaacaaggaccctg

SEQ ID NO: 580958 - DNA, 19 bp, Homo sapiens
caacagcctttgaatgtaa

SEQ ID NO: 580959 - DNA, 15 bp, Homo sapiens
caagaggtgggaggg

SEQ ID NO: 580960 - DNA, 14 bp, Homo sapiens
caagtaagaagaca

SEQ ID NO: 580961 - DNA, 18 bp, Homo sapiens
caagtaagaagacatgaa

SEQ ID NO: 580962 - DNA, 16 bp, Homo sapiens
caatattgattgggaa

SEQ ID NO: 580963 - DNA, 16 bp, Homo sapiens
caatgaaccataaatt

SEQ ID NO: 580964 - DNA, 21 bp, Homo sapiens
caatgagactctagggtccag

SEQ ID NO: 580965 - DNA, 22 bp, Homo sapiens
caattatttgaagatttaatta

SEQ ID NO: 580966 - DNA, 15 bp, Homo sapiens
caattgtaaactagt

SEQ ID NO: 580967 - DNA, 22 bp, Homo sapiens
cacacctctggatccctggagg

SEQ ID NO: 580968 - DNA, 21 bp, Homo sapiens
cacactgtaaatatccacaga

SEQ ID NO: 580969 - DNA, 16 bp, Homo sapiens
cacacttgaaaccttt

SEQ ID NO: 580970 - DNA, 13 bp, Homo sapiens
cacagcatgtgta

SEQ ID NO: 580971 - DNA, 17 bp, Homo sapiens
caccatgtgagctcttc

SEQ ID NO: 580972 - DNA, 14 bp, Homo sapiens
caccctctgggcag

SEQ ID NO: 580973 - DNA, 17 bp, Homo sapiens
caccctctgggcagctg

SEQ ID NO: 580974 - DNA, 14 bp, Homo sapiens
cacctaatgtttat

SEQ ID NO: 580975 - DNA, 18 bp, Homo sapiens
cacctctggatccctgga

SEQ ID NO: 580976 - DNA, 19 bp, Homo sapiens
cacctgcgagaggtccctg

SEQ ID NO: 580977 - DNA, 21 bp, Homo sapiens
cacgttggggtgatttaatcc

SEQ ID NO: 580978 - DNA, 17 bp, Homo sapiens
cactagggccttggaaa

SEQ ID NO: 580979 - DNA, 22 bp, Homo sapiens
cacttacttcgtgcgcaacaac

SEQ ID NO: 580980 - DNA, 21 bp, Homo sapiens
cagaaatataacacatttttt

SEQ ID NO: 580981 - DNA, 16 bp, Homo sapiens
cagaaccacacttgaa

SEQ ID NO: 580982 - DNA, 21 bp, Homo sapiens
cagaaccacacttgaaacctt

SEQ ID NO: 580983 - DNA, 22 bp, Homo sapiens
cagaaccacacttgaaaccttt

SEQ ID NO: 580984 - DNA, 18 bp, Homo sapiens
cagactccctcccctgcc

SEQ ID NO: 580985 - DNA, 21 bp, Homo sapiens
cagagactgtccctgaaacct

SEQ ID NO: 580986 - DNA, 16 bp, Homo sapiens
cagagatttctcattg

SEQ ID NO: 580987 - DNA, 19 bp, Homo sapiens
cagagatttctcattgact

SEQ ID NO: 580988 - DNA, 21 bp, Homo sapiens
cagagatttctcattgacttt

SEQ ID NO: 580989 - DNA, 18 bp, Homo sapiens
cagagtaacatgccagct

SEQ ID NO: 580990 - DNA, 17 bp, Homo sapiens
cagatacatggttgtga

SEQ ID NO: 580991 - DNA, 22 bp, Homo sapiens
cagataccttatcttacaatat

SEQ ID NO: 580992 - DNA, 23 bp, Homo sapiens
cagatcctgggtactgaaagcct

SEQ ID NO: 580993 - DNA, 22 bp, Homo sapiens
cagcatgtgtatttccagtgca

SEQ ID NO: 580994 - DNA, 23 bp, Homo sapiens
cagcccagcttggccctttcctt

SEQ ID NO: 580995 - DNA, 15 bp, Homo sapiens
cagccgtgcactccc

SEQ ID NO: 580996 - DNA, 18 bp, Homo sapiens
cagcctcgttggaagagg

SEQ ID NO: 580997 - DNA, 22 bp, Homo sapiens
cagcctcgttggaagaggaaca

SEQ ID NO: 580998 - DNA, 22 bp, Homo sapiens
cagcttcctgtgggccaggagc

SEQ ID NO: 580999 - DNA, 17 bp, Homo sapiens
cagcttggccctttcct

SEQ ID NO: 581000 - DNA, 13 bp, Homo sapiens
caggagctcagcc

SEQ ID NO: 581001 - DNA, 16 bp, Homo sapiens
caggaggcgcagcccg

SEQ ID NO: 581002 - DNA, 17 bp, Homo sapiens
caggaggcgcagcccga

SEQ ID NO: 581003 - DNA, 22 bp, Homo sapiens
caggaggcgcagcccgaagccc

SEQ ID NO: 581004 - DNA, 13 bp, Homo sapiens
caggcaccgagaa

SEQ ID NO: 581005 - DNA, 16 bp, Homo sapiens
caggcaccgagaatgt

SEQ ID NO: 581006 - DNA, 19 bp, Homo sapiens
caggctttgtacagagtgc

SEQ ID NO: 581007 - DNA, 16 bp, Homo sapiens
cagggaaggcctgact

SEQ ID NO: 581008 - DNA, 23 bp, Homo sapiens
cagggaaggcctgacttctgctg

SEQ ID NO: 581009 - DNA, 14 bp, Homo sapiens
cagggagcagggaa

SEQ ID NO: 581010 - DNA, 16 bp, Homo sapiens
cagggatttgcctcac

SEQ ID NO: 581011 - DNA, 18 bp, Homo sapiens
cagggatttgcctcacct

SEQ ID NO: 581012 - DNA, 20 bp, Homo sapiens
cagggatttgcctcaccttg

SEQ ID NO: 581013 - DNA, 22 bp, Homo sapiens
cagggttcaagccttccaggga

SEQ ID NO: 581014 - DNA, 18 bp, Homo sapiens
cagtaacccccttaaatt

SEQ ID NO: 581015 - DNA, 22 bp, Homo sapiens
cagtactattcaggtaacacta

SEQ ID NO: 581016 - DNA, 15 bp, Homo sapiens
cagtatgtgggggct

SEQ ID NO: 581017 - DNA, 20 bp, Homo sapiens
cagtatgtgggggcttcatc

SEQ ID NO: 581018 - DNA, 13 bp, Homo sapiens
cagtattgccaca

SEQ ID NO: 581019 - DNA, 15 bp, Homo sapiens
cagtctcagaaagcc

SEQ ID NO: 581020 - DNA, 15 bp, Homo sapiens
cagtctcctgacatt

SEQ ID NO: 581021 - DNA, 14 bp, Homo sapiens
cagtgacctgaccg

SEQ ID NO: 581022 - DNA, 18 bp, Homo sapiens
cagtttcccttctatgca

SEQ ID NO: 581023 - DNA, 16 bp, Homo sapiens
cataaattcaactttg

SEQ ID NO: 581024 - DNA, 20 bp, Homo sapiens
cataaattcaactttgtaaa

SEQ ID NO: 581025 - DNA, 17 bp, Homo sapiens
cataagcttccatttta

SEQ ID NO: 581026 - DNA, 19 bp, Homo sapiens
cataagcttccattttaat

SEQ ID NO: 581027 - DNA, 16 bp, Homo sapiens
catactttgtattttg

SEQ ID NO: 581028 - DNA, 18 bp, Homo sapiens
catactttgtattttgat

SEQ ID NO: 581029 - DNA, 18 bp, Homo sapiens
catagaaaccactagaaa

SEQ ID NO: 581030 - DNA, 16 bp, Homo sapiens
catagacatgaaaggt

SEQ ID NO: 581031 - DNA, 23 bp, Homo sapiens
catagataatattgtttggtaaa

SEQ ID NO: 581032 - DNA, 14 bp, Homo sapiens
catatcctgagcca

SEQ ID NO: 581033 - DNA, 23 bp, Homo sapiens
catatcctgagccatcggtgaaa

SEQ ID NO: 581034 - DNA, 14 bp, Homo sapiens
catattaggaaaat

SEQ ID NO: 581035 - DNA, 20 bp, Homo sapiens
catattaggaaaatatgggt

SEQ ID NO: 581036 - DNA, 20 bp, Homo sapiens
cttgaatctgttactgaaat

SEQ ID NO: 581037 - DNA, 23 bp, Homo sapiens
cttgatttcaaagttttgttgta

SEQ ID NO: 581038 - DNA, 21 bp, Homo sapiens
cttgcataataagctaaagag

SEQ ID NO: 581039 - DNA, 22 bp, Homo sapiens
cttgcataataagctaaagagg

SEQ ID NO: 581040 - DNA, 22 bp, Homo sapiens
cttggggccttgatgactgcct

SEQ ID NO: 581041 - DNA, 18 bp, Homo sapiens
cttgtcttctggtacttt

SEQ ID NO: 581042 - DNA, 15 bp, Homo sapiens
cttgtttacctttct

SEQ ID NO: 581043 - DNA, 19 bp, Homo sapiens
cttgtttacctttctctct

SEQ ID NO: 581044 - DNA, 21 bp, Homo sapiens
cttgttttggatggcttgtct

SEQ ID NO: 581045 - DNA, 13 bp, Homo sapiens
ctttagtttttgg

SEQ ID NO: 581046 - DNA, 15 bp, Homo sapiens
ctttcagaaatataa

SEQ ID NO: 581047 - DNA, 21 bp, Homo sapiens
ctttcagaaatataacacatt

SEQ ID NO: 581048 - DNA, 22 bp, Homo sapiens
ctttcagaaatataacacattt

SEQ ID NO: 581049 - DNA, 16 bp, Homo sapiens
ctttgaatgtaaccaa

SEQ ID NO: 581050 - DNA, 21 bp, Homo sapiens
ctttggattctaaatacatgc

SEQ ID NO: 581051 - DNA, 15 bp, Homo sapiens
ctttgtacagagtgc

SEQ ID NO: 581052 - DNA, 19 bp, Homo sapiens
ctttgtacagagtgctttt

SEQ ID NO: 581053 - DNA, 13 bp, Homo sapiens
ctttgtattttga

SEQ ID NO: 581054 - DNA, 17 bp, Homo sapiens
ctttgtattttgattat

SEQ ID NO: 581055 - DNA, 18 bp, Homo sapiens
ctttgtattttgattatt

SEQ ID NO: 581056 - DNA, 12 bp, Homo sapiens
cttttgtttggt

SEQ ID NO: 581057 - DNA, 18 bp, Homo sapiens
cttttgtttggtaaatgt

SEQ ID NO: 581058 - DNA, 12 bp, Homo sapiens
gaaaaatataaa

SEQ ID NO: 581059 - DNA, 17 bp, Homo sapiens
gaaaaatataaaattat

SEQ ID NO: 581060 - DNA, 15 bp, Homo sapiens
gaaaacatgtaataa

SEQ ID NO: 581061 - DNA, 15 bp, Homo sapiens
gaaaacttgaatctg

SEQ ID NO: 581062 - DNA, 15 bp, Homo sapiens
gaaaaggaagactag

SEQ ID NO: 581063 - DNA, 12 bp, Homo sapiens
gaaactaacaga

SEQ ID NO: 581064 - DNA, 15 bp, Homo sapiens
gaaactaacagataa

SEQ ID NO: 581065 - DNA, 21 bp, Homo sapiens
gaaactttgggaaaacatgtt

SEQ ID NO: 581066 - DNA, 18 bp, Homo sapiens
gaaagtttttttttatta

SEQ ID NO: 581067 - DNA, 14 bp, Homo sapiens
gaaataatgctaca

SEQ ID NO: 581068 - DNA, 19 bp, Homo sapiens
gaaatgaaaacatgtaata

SEQ ID NO: 581069 - DNA, 16 bp, Homo sapiens
gaaattgcatactttg

SEQ ID NO: 581070 - DNA, 12 bp, Homo sapiens
gaacaaactgat

SEQ ID NO: 581071 - DNA, 23 bp, Homo sapiens
gaaccaagtggaccttgagacca

SEQ ID NO: 581072 - DNA, 24 bp, Homo sapiens
gaaccaagtggaccttgagaccac

SEQ ID NO: 581073 - DNA, 13 bp, Homo sapiens
gaaccataaattc

SEQ ID NO: 581074 - DNA, 21 bp, Homo sapiens
gaactgagccaaacacactgt

SEQ ID NO: 581075 - DNA, 16 bp, Homo sapiens
gaagaatgaaagctgt

SEQ ID NO: 581076 - DNA, 16 bp, Homo sapiens
gaagaggaagcaagaa

SEQ ID NO: 581077 - DNA, 14 bp, Homo sapiens
gaagctggcctgag

SEQ ID NO: 581078 - DNA, 19 bp, Homo sapiens
gaagctggcctgagagggg

SEQ ID NO: 581079 - DNA, 15 bp, Homo sapiens
gaatatgacggaaga

SEQ ID NO: 581080 - DNA, 12 bp, Homo sapiens
gaatctgttact

SEQ ID NO: 581081 - DNA, 15 bp, Homo sapiens
gaatctgttactgaa

SEQ ID NO: 581082 - DNA, 16 bp, Homo sapiens
gaatgaggaaaattct

SEQ ID NO: 581083 - DNA, 11 bp, Homo sapiens
gaatgtaacca

SEQ ID NO: 581084 - DNA, 13 bp, Homo sapiens
gaatgtaaccaat

SEQ ID NO: 581085 - DNA, 19 bp, Homo sapiens
gaatgtaaccaatcctact

SEQ ID NO: 581086 - DNA, 14 bp, Homo sapiens
gacaatccactctc

SEQ ID NO: 581087 - DNA, 21 bp, Homo sapiens
gacaatccactctcaggaggc

SEQ ID NO: 581088 - DNA, 21 bp, Homo sapiens
gacagcataccttggactgac

SEQ ID NO: 581089 - DNA, 22 bp, Homo sapiens
gacagcataccttggactgact

SEQ ID NO: 581090 - DNA, 15 bp, Homo sapiens
gacatgcaataaaat

SEQ ID NO: 581091 - DNA, 19 bp, Homo sapiens
gaccctgttttccacacca

SEQ ID NO: 581092 - DNA, 17 bp, Homo sapiens
gacctgaccggcacctg

SEQ ID NO: 581093 - DNA, 17 bp, Homo sapiens
gacggacgtcctgctgg

SEQ ID NO: 581094 - DNA, 19 bp, Homo sapiens
gacgtttataaacagaaat

SEQ ID NO: 581095 - DNA, 17 bp, Homo sapiens
gactaaagagagaatgt

SEQ ID NO: 581096 - DNA, 16 bp, Homo sapiens
gactaactcaaataca

SEQ ID NO: 581097 - DNA, 16 bp, Homo sapiens
gactagaggcttgcat

SEQ ID NO: 581098 - DNA, 18 bp, Homo sapiens
gactatatatataaatgt

SEQ ID NO: 581099 - DNA, 16 bp, Homo sapiens
gactgccttgcctcct

SEQ ID NO: 581100 - DNA, 20 bp, Homo sapiens
gactgtagatatgtattctt

SEQ ID NO: 581101 - DNA, 16 bp, Homo sapiens
gagaacccagtttccc

SEQ ID NO: 581102 - DNA, 19 bp, Homo sapiens
gagactctagggtccagtg

SEQ ID NO: 581103 - DNA, 14 bp, Homo sapiens
gagcagggaaggcc

SEQ ID NO: 581104 - DNA, 18 bp, Homo sapiens
gagcagggaaggcctgac

SEQ ID NO: 581105 - DNA, 18 bp, Homo sapiens
gagccaaacacactgtaa

SEQ ID NO: 581106 - DNA, 15 bp, Homo sapiens
gagctctgaaatctt

SEQ ID NO: 581107 - DNA, 12 bp, Homo sapiens
gagctcttccta

SEQ ID NO: 581108 - DNA, 21 bp, Homo sapiens
gagcttaatgctacatgtgag

SEQ ID NO: 581109 - DNA, 22 bp, Homo sapiens
gagcttaatgctacatgtgagt

SEQ ID NO: 581110 - DNA, 12 bp, Homo sapiens
gaggaaaattct

SEQ ID NO: 581111 - DNA, 12 bp, Homo sapiens
gaggagagaagg

SEQ ID NO: 581112 - DNA, 17 bp, Homo sapiens
gaggcgcagcccgaagc

SEQ ID NO: 581113 - DNA, 19 bp, Homo sapiens
gaggcttgtttacctttct

SEQ ID NO: 581114 - DNA, 13 bp, Homo sapiens
gaggggctgaatg

SEQ ID NO: 581115 - DNA, 14 bp, Homo sapiens
gaggtattaaaact

SEQ ID NO: 581116 - DNA, 14 bp, Homo sapiens
gaggtgggagggcc

SEQ ID NO: 581117 - DNA, 21 bp, Homo sapiens
gagtattgtttaaaatgtaat

SEQ ID NO: 581118 - DNA, 15 bp, Homo sapiens
gataatattgtttgg

SEQ ID NO: 581119 - DNA, 22 bp, Homo sapiens
gataatattgtttggtaaatgt

SEQ ID NO: 581120 - DNA, 16 bp, Homo sapiens
gatattgaatgttaaa

SEQ ID NO: 581121 - DNA, 17 bp, Homo sapiens
gatctgtcccctctccc

SEQ ID NO: 581122 - DNA, 19 bp, Homo sapiens
gatcttgagatttctttta

SEQ ID NO: 581123 - DNA, 16 bp, Homo sapiens
gatctttcagaaatat

SEQ ID NO: 581124 - DNA, 18 bp, Homo sapiens
gatctttcagaaatataa

SEQ ID NO: 581125 - DNA, 19 bp, Homo sapiens
gatgactgccttgcctcct

SEQ ID NO: 581126 - DNA, 22 bp, Homo sapiens
gatgactgccttgcctcctcag

SEQ ID NO: 581127 - DNA, 13 bp, Homo sapiens
gatggcttgtcta

SEQ ID NO: 581128 - DNA, 13 bp, Homo sapiens
gatgtgtcctcag

SEQ ID NO: 581129 - DNA, 16 bp, Homo sapiens
gatttctcattgactt

SEQ ID NO: 581130 - DNA, 21 bp, Homo sapiens
gatttgaaaaatataaaatta

SEQ ID NO: 581131 - DNA, 18 bp, Homo sapiens
gcaacagcctttgaatgt

SEQ ID NO: 581132 - DNA, 14 bp, Homo sapiens
gcaataaaatttaa

SEQ ID NO: 581133 - DNA, 22 bp, Homo sapiens
gcactccctaagaaaccccagg

SEQ ID NO: 581134 - DNA, 23 bp, Homo sapiens
gcagagatttctcattgactttt

SEQ ID NO: 581135 - DNA, 17 bp, Homo sapiens
gcagattgaaaaggaca

SEQ ID NO: 581136 - DNA, 19 bp, Homo sapiens
gcagcatcttcacttctaa

SEQ ID NO: 581137 - DNA, 16 bp, Homo sapiens
gcagcccgaagcccag

SEQ ID NO: 581138 - DNA, 16 bp, Homo sapiens
gcagggaaggcctgac

SEQ ID NO: 581139 - DNA, 19 bp, Homo sapiens
gcagggttcaagccttcca

SEQ ID NO: 581140 - DNA, 16 bp, Homo sapiens
gcagtctcagaaagcc

SEQ ID NO: 581141 - DNA, 19 bp, Homo sapiens
gcagtctcagaaagccttc

SEQ ID NO: 581142 - DNA, 21 bp, Homo sapiens
gcagtctcagaaagccttcca

SEQ ID NO: 581143 - DNA, 17 bp, Homo sapiens
gcagttagctgaagaat

SEQ ID NO: 581144 - DNA, 14 bp, Homo sapiens
gcatactttgtatt

SEQ ID NO: 581145 - DNA, 16 bp, Homo sapiens
gcatatcctgagccat

SEQ ID NO: 581146 - DNA, 21 bp, Homo sapiens
gcatgcaaatgagctctgaaa

SEQ ID NO: 581147 - DNA, 18 bp, Homo sapiens
gcatgtagaggcttgttt

SEQ ID NO: 581148 - DNA, 20 bp, Homo sapiens
gcatgtagaggcttgtttac

SEQ ID NO: 581149 - DNA, 20 bp, Homo sapiens
gcatgttcacccttatagtc

SEQ ID NO: 581150 - DNA, 17 bp, Homo sapiens
gccacaatgcctctccc

SEQ ID NO: 581151 - DNA, 20 bp, Homo sapiens
gtgggatttccagaaccaca

SEQ ID NO: 581152 - DNA, 13 bp, Homo sapiens
gtgggccaggagc

SEQ ID NO: 581153 - DNA, 19 bp, Homo sapiens
gtgggccaggagctcagcc

SEQ ID NO: 581154 - DNA, 16 bp, Homo sapiens
gtgtatgactaaagag

SEQ ID NO: 581155 - DNA, 19 bp, Homo sapiens
gtgtggattgcctctgaaa

SEQ ID NO: 581156 - DNA, 21 bp, Homo sapiens
gtgtgtatgactaaagagaga

SEQ ID NO: 581157 - DNA, 13 bp, Homo sapiens
gtgtgtgtgtgtg

SEQ ID NO: 581158 - DNA, 17 bp, Homo sapiens
gttagctgaagaattga

SEQ ID NO: 581159 - DNA, 21 bp, Homo sapiens
gttcccagatggctggaaggg

SEQ ID NO: 581160 - DNA, 21 bp, Homo sapiens
gttccttggtcctagtaagaa

SEQ ID NO: 581161 - DNA, 22 bp, Homo sapiens
gttctaacagtgaagttttact

SEQ ID NO: 581162 - DNA, 15 bp, Homo sapiens
gttgcagtctcagaa

SEQ ID NO: 581163 - DNA, 20 bp, Homo sapiens
gtttaaaatgtaatttaaat

SEQ ID NO: 581164 - DNA, 21 bp, Homo sapiens
gtttaaaatgtaatttaaatg

SEQ ID NO: 581165 - DNA, 13 bp, Homo sapiens
gtttacctttctc

SEQ ID NO: 581166 - DNA, 21 bp, Homo sapiens
gtttcacagcacttacaattt

SEQ ID NO: 581167 - DNA, 15 bp, Homo sapiens
gtttcagtttgttgg

SEQ ID NO: 581168 - DNA, 18 bp, Homo sapiens
gtttcagtttgttggaaa

SEQ ID NO: 581169 - DNA, 21 bp, Homo sapiens
gtttcagtttgttggaaagta

SEQ ID NO: 581170 - DNA, 16 bp, Homo sapiens
gtttggtaaatgtttc

SEQ ID NO: 581171 - DNA, 15 bp, Homo sapiens
gttttctttgtaaag

SEQ ID NO: 581172 - DNA, 15 bp, Homo sapiens
taaaaggtaatgtgt

SEQ ID NO: 581173 - DNA, 19 bp, Homo sapiens
taaaagttttatatgcttt

SEQ ID NO: 581174 - DNA, 17 bp, Homo sapiens
taaaatgtaatttaaat

SEQ ID NO: 581175 - DNA, 17 bp, Homo sapiens
taaacagtaagatatct

SEQ ID NO: 581176 - DNA, 18 bp, Homo sapiens
taaacgtgatttttaaat

SEQ ID NO: 581177 - DNA, 15 bp, Homo sapiens
taaactactgtaatt

SEQ ID NO: 581178 - DNA, 21 bp, Homo sapiens
taaactactgtaattaagtgc

SEQ ID NO: 581179 - DNA, 23 bp, Homo sapiens
taaactactgtaattaagtgcaa

SEQ ID NO: 581180 - DNA, 22 bp, Homo sapiens
taaacttctgcaacaagcatgc

SEQ ID NO: 581181 - DNA, 16 bp, Homo sapiens
taaagaagtaaatttg

SEQ ID NO: 581182 - DNA, 19 bp, Homo sapiens
taaagacccagggggagaa

SEQ ID NO: 581183 - DNA, 21 bp, Homo sapiens
taaagacccagggggagaatg

SEQ ID NO: 581184 - DNA, 12 bp, Homo sapiens
taaagagaatga

SEQ ID NO: 581185 - DNA, 13 bp, Homo sapiens
taaagagaatgag

SEQ ID NO: 581186 - DNA, 21 bp, Homo sapiens
taaagtgtctattagttttct

SEQ ID NO: 581187 - DNA, 14 bp, Homo sapiens
taaataaaaccctt

SEQ ID NO: 581188 - DNA, 13 bp, Homo sapiens
taaataaaatttt

SEQ ID NO: 581189 - DNA, 13 bp, Homo sapiens
taaatatccacag

SEQ ID NO: 581190 - DNA, 14 bp, Homo sapiens
taaatatccacaga

SEQ ID NO: 581191 - DNA, 22 bp, Homo sapiens
taaatgtataaatatacagtat

SEQ ID NO: 581192 - DNA, 21 bp, Homo sapiens
taaatgtttcttttaaagacc

SEQ ID NO: 581193 - DNA, 19 bp, Homo sapiens
taaattcaactttgtaaaa

SEQ ID NO: 581194 - DNA, 12 bp, Homo sapiens
taaattgcatca

SEQ ID NO: 581195 - DNA, 18 bp, Homo sapiens
taaattgcatcactgtat

SEQ ID NO: 581196 - DNA, 21 bp, Homo sapiens
taaatttcactactagattga

SEQ ID NO: 581197 - DNA, 21 bp, Homo sapiens
taacacatttttttgcatgca

SEQ ID NO: 581198 - DNA, 18 bp, Homo sapiens
taacagataagcaagaga

SEQ ID NO: 581199 - DNA, 18 bp, Homo sapiens
taactcaaatacacattt

SEQ ID NO: 581200 - DNA, 20 bp, Homo sapiens
taactcaaatacacatttgc

SEQ ID NO: 581201 - DNA, 19 bp, Homo sapiens
taactccagtctcctgaca

SEQ ID NO: 581202 - DNA, 18 bp, Homo sapiens
taagaacaaaagcgaccc

SEQ ID NO: 581203 - DNA, 18 bp, Homo sapiens
taagaataccacatcaaa

SEQ ID NO: 581204 - DNA, 23 bp, Homo sapiens
taagaataccacatcaaataaga

SEQ ID NO: 581205 - DNA, 19 bp, Homo sapiens
taagaattctgattgattt

SEQ ID NO: 581206 - DNA, 19 bp, Homo sapiens
taagactatatatataaat

SEQ ID NO: 581207 - DNA, 20 bp, Homo sapiens
taagactatatatataaatg

SEQ ID NO: 581208 - DNA, 18 bp, Homo sapiens
taagcaaatgttaaaagt

SEQ ID NO: 581209 - DNA, 13 bp, Homo sapiens
taagcaagagaga

SEQ ID NO: 581210 - DNA, 23 bp, Homo sapiens
taagcttccattttaattttaaa

SEQ ID NO: 581211 - DNA, 20 bp, Homo sapiens
taaggggaagaatgaaagct

SEQ ID NO: 581212 - DNA, 11 bp, Homo sapiens
taataaaccag

SEQ ID NO: 581213 - DNA, 12 bp, Homo sapiens
taataaaccagt

SEQ ID NO: 581214 - DNA, 13 bp, Homo sapiens
taataaaccagtt

SEQ ID NO: 581215 - DNA, 16 bp, Homo sapiens
taataaatatttatgt

SEQ ID NO: 581216 - DNA, 19 bp, Homo sapiens
taatccagttataagaaga

SEQ ID NO: 581217 - DNA, 23 bp, Homo sapiens
taatccagttataagaagaagtt

SEQ ID NO: 581218 - DNA, 15 bp, Homo sapiens
taatgctacaatttt

SEQ ID NO: 581219 - DNA, 15 bp, Homo sapiens
taatgtgtggattgc

SEQ ID NO: 581220 - DNA, 22 bp, Homo sapiens
taattgtacaaaattaagcaaa

SEQ ID NO: 581221 - DNA, 23 bp, Homo sapiens
taattgtacaaaattaagcaaat

SEQ ID NO: 581222 - DNA, 12 bp, Homo sapiens
taatttaaatga

SEQ ID NO: 581223 - DNA, 15 bp, Homo sapiens
tacaatattgattgg

SEQ ID NO: 581224 - DNA, 19 bp, Homo sapiens
tacaatattgattgggaaa

SEQ ID NO: 581225 - DNA, 16 bp, Homo sapiens
tacagaggtattaaaa

SEQ ID NO: 581226 - DNA, 14 bp, Homo sapiens
tacaggcaccgaga

SEQ ID NO: 581227 - DNA, 15 bp, Homo sapiens
tacagtatagatttt

SEQ ID NO: 581228 - DNA, 19 bp, Homo sapiens
tacatattaggaaaatatg

SEQ ID NO: 581229 - DNA, 17 bp, Homo sapiens
tacatgccacatcaaac

SEQ ID NO: 581230 - DNA, 22 bp, Homo sapiens
taccagctaactccagtctcct

SEQ ID NO: 581231 - DNA, 15 bp, Homo sapiens
tacccatagacatga

SEQ ID NO: 581232 - DNA, 14 bp, Homo sapiens
tactaaagtgtcta

SEQ ID NO: 581233 - DNA, 15 bp, Homo sapiens
tactaataaaccagt

SEQ ID NO: 581234 - DNA, 19 bp, Homo sapiens
tactctacaaaatatagct

SEQ ID NO: 581235 - DNA, 21 bp, Homo sapiens
tactctccttgagtgtatgag

SEQ ID NO: 581236 - DNA, 21 bp, Homo sapiens
tactgaaatgaggagagaagg

SEQ ID NO: 581237 - DNA, 14 bp, Homo sapiens
tactgacatttctt

SEQ ID NO: 581238 - DNA, 14 bp, Homo sapiens
tactgtaattaagt

SEQ ID NO: 581239 - DNA, 14 bp, Homo sapiens
tacttaaatggtaa

SEQ ID NO: 581240 - DNA, 21 bp, Homo sapiens
tacttaaatggtaataagcac

SEQ ID NO: 581241 - DNA, 24 bp, Homo sapiens
tacttaaatggtaataagcactgt

SEQ ID NO: 581242 - DNA, 16 bp, Homo sapiens
tactttgtattttgat

SEQ ID NO: 581243 - DNA, 20 bp, Homo sapiens
tagaagtgagcaaaaaagag

SEQ ID NO: 581244 - DNA, 15 bp, Homo sapiens
tagataatattgttt

SEQ ID NO: 581245 - DNA, 18 bp, Homo sapiens
tagatccatttccattgc

SEQ ID NO: 581246 - DNA, 22 bp, Homo sapiens
tagatgtgcatttttgtgaaat

SEQ ID NO: 581247 - DNA, 17 bp, Homo sapiens
tagctgaagaattgaaa

SEQ ID NO: 581248 - DNA, 19 bp, Homo sapiens
taggagtggtgatttgaaa

SEQ ID NO: 581249 - DNA, 20 bp, Homo sapiens
taggcagattgaaaaggaca

SEQ ID NO: 581250 - DNA, 19 bp, Homo sapiens
tagggactacccatagaca

SEQ ID NO: 581251 - DNA, 20 bp, Homo sapiens
taggtagaagtgagcaaaaa

SEQ ID NO: 581252 - DNA, 12 bp, Homo sapiens
tagtaagcatag

SEQ ID NO: 581253 - DNA, 23 bp, Homo sapiens
tagtatgtgcatttaattagaaa

SEQ ID NO: 581254 - DNA, 21 bp, Homo sapiens
tagtgcttaaaaatcattgat

SEQ ID NO: 581255 - DNA, 13 bp, Homo sapiens
tagtgtgtcagag

SEQ ID NO: 581256 - DNA, 21 bp, Homo sapiens
tataaacagaaatggaaagca

SEQ ID NO: 581257 - DNA, 14 bp, Homo sapiens
tataaatatacagt

SEQ ID NO: 581258 - DNA, 15 bp, Homo sapiens
tataaatatacagta

SEQ ID NO: 581259 - DNA, 14 bp, Homo sapiens
tataaatgtataaa

SEQ ID NO: 581260 - DNA, 20 bp, Homo sapiens
tataaatgtataaatataca

SEQ ID NO: 581261 - DNA, 23 bp, Homo sapiens
tataacacatttttttgcatgca

SEQ ID NO: 581262 - DNA, 15 bp, Homo sapiens
tataatactaaagtg

SEQ ID NO: 581263 - DNA, 18 bp, Homo sapiens
tataatactaaagtgtct

SEQ ID NO: 581264 - DNA, 13 bp, Homo sapiens
tataattgtacaa

SEQ ID NO: 581265 - DNA, 12 bp, Homo sapiens
tgtaaaaatctt

SEQ ID NO: 581266 - DNA, 16 bp, Homo sapiens
tgtaaaaatcttttga

SEQ ID NO: 581267 - DNA, 13 bp, Homo sapiens
tgtaaactataaa

SEQ ID NO: 581268 - DNA, 14 bp, Homo sapiens
tgtaaaggtcagag

SEQ ID NO: 581269 - DNA, 16 bp, Homo sapiens
tgtaacaacaattatt

SEQ ID NO: 581270 - DNA, 16 bp, Homo sapiens
tgtaaccaatcctact

SEQ ID NO: 581271 - DNA, 17 bp, Homo sapiens
tgtaagaattctgattg

SEQ ID NO: 581272 - DNA, 20 bp, Homo sapiens
tgtaataaaaagtatatgtt

SEQ ID NO: 581273 - DNA, 24 bp, Homo sapiens
tgtacaaaattaagcaaatgttaa

SEQ ID NO: 581274 - DNA, 15 bp, Homo sapiens
tgtacttaaatggta

SEQ ID NO: 581275 - DNA, 15 bp, Homo sapiens
tgtaggtaagactgt

SEQ ID NO: 581276 - DNA, 15 bp, Homo sapiens
tgtagtgtgtcagag

SEQ ID NO: 581277 - DNA, 12 bp, Homo sapiens
tgtataaatata

SEQ ID NO: 581278 - DNA, 13 bp, Homo sapiens
tgtataaatatac

SEQ ID NO: 581279 - DNA, 14 bp, Homo sapiens
tgtataaatataca

SEQ ID NO: 581280 - DNA, 18 bp, Homo sapiens
tgtatataatactaaagt

SEQ ID NO: 581281 - DNA, 19 bp, Homo sapiens
tgtatataatactaaagtg

SEQ ID NO: 581282 - DNA, 20 bp, Homo sapiens
tgtatgactaaagagagaat

SEQ ID NO: 581283 - DNA, 21 bp, Homo sapiens
tgtatgactaaagagagaatg

SEQ ID NO: 581284 - DNA, 12 bp, Homo sapiens
tgtatgtaaata

SEQ ID NO: 581285 - DNA, 16 bp, Homo sapiens
tgtattcttttctcag

SEQ ID NO: 581286 - DNA, 15 bp, Homo sapiens
tgtatttccagtgca

SEQ ID NO: 581287 - DNA, 15 bp, Homo sapiens
tgtatttgagcatat

SEQ ID NO: 581288 - DNA, 12 bp, Homo sapiens
tgtattttcatg

SEQ ID NO: 581289 - DNA, 14 bp, Homo sapiens
tgtattttgattat

SEQ ID NO: 581290 - DNA, 20 bp, Homo sapiens
tgtcagagtaacatgccagc

SEQ ID NO: 581291 - DNA, 19 bp, Homo sapiens
tgtcagctactaatgatgt

SEQ ID NO: 581292 - DNA, 17 bp, Homo sapiens
tgtcattgcacataagc

SEQ ID NO: 581293 - DNA, 15 bp, Homo sapiens
tgtccagtgcctaca

SEQ ID NO: 581294 - DNA, 17 bp, Homo sapiens
tgtccagtgcctacatc

SEQ ID NO: 581295 - DNA, 13 bp, Homo sapiens
tgtcccctctccc

SEQ ID NO: 581296 - DNA, 15 bp, Homo sapiens
tgtccctgaaaccta

SEQ ID NO: 581297 - DNA, 12 bp, Homo sapiens
tgtcctctcccc

SEQ ID NO: 581298 - DNA, 23 bp, Homo sapiens
tgtcctctcccctctgccctgta

SEQ ID NO: 581299 - DNA, 22 bp, Homo sapiens
tgtctattagttttctttgtaa

SEQ ID NO: 581300 - DNA, 17 bp, Homo sapiens
tgtctgtagctcctcaa

SEQ ID NO: 581301 - DNA, 23 bp, Homo sapiens
tgtctgtagctcctcaactcacc

SEQ ID NO: 581302 - DNA, 19 bp, Homo sapiens
tgtctttcagatacatggt

SEQ ID NO: 581303 - DNA, 20 bp, Homo sapiens
tgtctttcagatacatggtt

SEQ ID NO: 581304 - DNA, 13 bp, Homo sapiens
tgtgaaattgcat

SEQ ID NO: 581305 - DNA, 18 bp, Homo sapiens
tgtgaagagggagaagca

SEQ ID NO: 581306 - DNA, 21 bp, Homo sapiens
tgtgatacattttttaagctt

SEQ ID NO: 581307 - DNA, 13 bp, Homo sapiens
tgtgcatttaatt

SEQ ID NO: 581308 - DNA, 17 bp, Homo sapiens
tgtggattctgaggccc

SEQ ID NO: 581309 - DNA, 13 bp, Homo sapiens
tgtgggccaggag

SEQ ID NO: 581310 - DNA, 14 bp, Homo sapiens
tgtggggggtcctt

SEQ ID NO: 581311 - DNA, 22 bp, Homo sapiens
tgtgtatatattttgtgtgaaa

SEQ ID NO: 581312 - DNA, 14 bp, Homo sapiens
tgtgtcctcaggga

SEQ ID NO: 581313 - DNA, 12 bp, Homo sapiens
tgtgtcctctcc

SEQ ID NO: 581314 - DNA, 21 bp, Homo sapiens
tgtgtcctctcccctctgccc

SEQ ID NO: 581315 - DNA, 23 bp, Homo sapiens
tgtgtggattgcctctgaaaagt

SEQ ID NO: 581316 - DNA, 15 bp, Homo sapiens
tgttaaaagttttat

SEQ ID NO: 581317 - DNA, 16 bp, Homo sapiens
tgttaaagagaatgag

SEQ ID NO: 581318 - DNA, 20 bp, Homo sapiens
tgttaagtatcagctacaat

SEQ ID NO: 581319 - DNA, 15 bp, Homo sapiens
tgttgtaagaattct

SEQ ID NO: 581320 - DNA, 18 bp, Homo sapiens
tgttgtaagaattctgat

SEQ ID NO: 581321 - DNA, 15 bp, Homo sapiens
tgttgtacttaaatg

SEQ ID NO: 581322 - DNA, 16 bp, Homo sapiens
tgtttatgagccagac

SEQ ID NO: 581323 - DNA, 21 bp, Homo sapiens
tgtttatgagccagacaaatg

SEQ ID NO: 581324 - DNA, 15 bp, Homo sapiens
tgtttcttttgtttg

SEQ ID NO: 581325 - DNA, 15 bp, Homo sapiens
tgtttggtaaatgtt

SEQ ID NO: 581326 - DNA, 14 bp, Homo sapiens
ttaaaaaataaata

SEQ ID NO: 581327 - DNA, 17 bp, Homo sapiens
ttaaaatgtaatttaaa

SEQ ID NO: 581328 - DNA, 14 bp, Homo sapiens
ttaaaccacttaaa

SEQ ID NO: 581329 - DNA, 13 bp, Homo sapiens
ttaaatcctttta

SEQ ID NO: 581330 - DNA, 19 bp, Homo sapiens
ttaaatccttttacctttt

SEQ ID NO: 581331 - DNA, 12 bp, Homo sapiens
ttaaatgaaaga

SEQ ID NO: 581332 - DNA, 16 bp, Homo sapiens
ttaaatgaaagaaaat

SEQ ID NO: 581333 - DNA, 22 bp, Homo sapiens
ttaaatggtaataagcactgta

SEQ ID NO: 581334 - DNA, 19 bp, Homo sapiens
ttaagcaaatgttaaaagt

SEQ ID NO: 581335 - DNA, 17 bp, Homo sapiens
ttaaggggaagaatgaa

SEQ ID NO: 581336 - DNA, 18 bp, Homo sapiens
ttaaggggtatcatgtat

SEQ ID NO: 581337 - DNA, 23 bp, Homo sapiens
ttaataccagataccttatctta

SEQ ID NO: 581338 - DNA, 21 bp, Homo sapiens
ttaatccagttataagaagaa

SEQ ID NO: 581339 - DNA, 20 bp, Homo sapiens
ttaatcttcaaagccttctc

SEQ ID NO: 581340 - DNA, 16 bp, Homo sapiens
ttaattttaaagtgca

SEQ ID NO: 581341 - DNA, 18 bp, Homo sapiens
ttaattttaaagtgcaaa

SEQ ID NO: 581342 - DNA, 21 bp, Homo sapiens
ttacagaggtattaaaactaa

SEQ ID NO: 581343 - DNA, 18 bp, Homo sapiens
ttacaggcaccgagaatg

SEQ ID NO: 581344 - DNA, 20 bp, Homo sapiens
ttacctgacggacgtcctgc

SEQ ID NO: 581345 - DNA, 14 bp, Homo sapiens
ttacctttctctct

SEQ ID NO: 581346 - DNA, 15 bp, Homo sapiens
ttacttgttttggat

SEQ ID NO: 581347 - DNA, 16 bp, Homo sapiens
ttagctgaagaattga

SEQ ID NO: 581348 - DNA, 23 bp, Homo sapiens
ttagggactacccatagacatga

SEQ ID NO: 581349 - DNA, 13 bp, Homo sapiens
ttagtatgtgcat

SEQ ID NO: 581350 - DNA, 19 bp, Homo sapiens
ttagtttttggttgggaat

SEQ ID NO: 581351 - DNA, 20 bp, Homo sapiens
ttataattgtacaaaattaa

SEQ ID NO: 581352 - DNA, 20 bp, Homo sapiens
ttatagtctaagactatata

SEQ ID NO: 581353 - DNA, 15 bp, Homo sapiens
ttatgtagatgtgca

SEQ ID NO: 581354 - DNA, 16 bp, Homo sapiens
ttatgtagatgtgcat

SEQ ID NO: 581355 - DNA, 12 bp, Homo sapiens
ttattaatgttt

SEQ ID NO: 581356 - DNA, 17 bp, Homo sapiens
ttattaatgttttcaaa

SEQ ID NO: 581357 - DNA, 22 bp, Homo sapiens
ttattgaccattttttaattta

SEQ ID NO: 581358 - DNA, 21 bp, Homo sapiens
ttatttgaagatttaattact

SEQ ID NO: 581359 - DNA, 21 bp, Homo sapiens
ttcaaaaggtattatacatgt

SEQ ID NO: 581360 - DNA, 21 bp, Homo sapiens
ttcaaagttttgttgtactta

SEQ ID NO: 581361 - DNA, 15 bp, Homo sapiens
ttcagaaatataaca

SEQ ID NO: 581362 - DNA, 14 bp, Homo sapiens
ttcagggtaaatag

SEQ ID NO: 581363 - DNA, 20 bp, Homo sapiens
ttcagtgagggtcttcttac

SEQ ID NO: 581364 - DNA, 14 bp, Homo sapiens
ttcagttctttgga

SEQ ID NO: 581365 - DNA, 20 bp, Homo sapiens
ttcagttctttggattctaa

SEQ ID NO: 581366 - DNA, 16 bp, Homo sapiens
ttcatctctttagaga

SEQ ID NO: 581367 - DNA, 18 bp, Homo sapiens
ttcatggctgctgttgct

SEQ ID NO: 581368 - DNA, 18 bp, Homo sapiens
ttcattcctaacacagca

SEQ ID NO: 581369 - DNA, 16 bp, Homo sapiens
ttccagatctttcaga

SEQ ID NO: 581370 - DNA, 20 bp, Homo sapiens
ttccagatctttcagaaata

SEQ ID NO: 581371 - DNA, 19 bp, Homo sapiens
ttccagggatttgcctcac

SEQ ID NO: 581372 - DNA, 14 bp, Homo sapiens
ttccattatgattc

SEQ ID NO: 581373 - DNA, 22 bp, Homo sapiens
ttcccctctgtgtcctctcccc

SEQ ID NO: 581374 - DNA, 22 bp, Homo sapiens
ttcccttaaggggtatcatgta

SEQ ID NO: 581375 - DNA, 14 bp, Homo sapiens
ttcccttgaaactt

SEQ ID NO: 581376 - DNA, 15 bp, Homo sapiens
ttcctcttgtctgat

SEQ ID NO: 581377 - DNA, 17 bp, Homo sapiens
ttcctgtgggccaggag

SEQ ID NO: 581378 - DNA, 23 bp, Homo sapiens
ttctagtgatgatggttcacgtt

SEQ ID NO: 581379 - DNA, 19 bp, Homo sapiens
ttcttgtactctacaaaat

SEQ ID NO: 581380 - DNA, 13 bp, Homo sapiens
taattatgtaaat

SEQ ID NO: 581381 - DNA, 15 bp, Homo sapiens
taattatgtaaataa

SEQ ID NO: 581382 - DNA, 17 bp, Homo sapiens
taattgtacaaaattaa

SEQ ID NO: 581383 - DNA, 13 bp, Homo sapiens
taatttaaatgaa

SEQ ID NO: 581384 - DNA, 11 bp, Homo sapiens
taatttaactt

SEQ ID NO: 581385 - DNA, 13 bp, Homo sapiens
taatttaactttc

SEQ ID NO: 581386 - DNA, 17 bp, Homo sapiens
taatttaactttccagt

SEQ ID NO: 581387 - DNA, 17 bp, Homo sapiens
taatttgaactttggaa

SEQ ID NO: 581388 - DNA, 18 bp, Homo sapiens
taatttgaactttggaac

SEQ ID NO: 581389 - DNA, 12 bp, Homo sapiens
taattttaaagt

SEQ ID NO: 581390 - DNA, 14 bp, Homo sapiens
tacaaaattaagca

SEQ ID NO: 581391 - DNA, 19 bp, Homo sapiens
tacaatattgattgggaaa

SEQ ID NO: 581392 - DNA, 23 bp, Homo sapiens
tacaatattgattgggaaaacat

SEQ ID NO: 581393 - DNA, 13 bp, Homo sapiens
tacaattttaaga

SEQ ID NO: 581394 - DNA, 16 bp, Homo sapiens
tacacacacacacaca

SEQ ID NO: 581395 - DNA, 17 bp, Homo sapiens
tacagttttaactgtgg

SEQ ID NO: 581396 - DNA, 21 bp, Homo sapiens
tacagttttaactgtggatat

SEQ ID NO: 581397 - DNA, 16 bp, Homo sapiens
tacatgtgatacattt

SEQ ID NO: 581398 - DNA, 19 bp, Homo sapiens
tacatgtgatacatttttt

SEQ ID NO: 581399 - DNA, 14 bp, Homo sapiens
taccaatacaaaat

SEQ ID NO: 581400 - DNA, 17 bp, Homo sapiens
tacccatagacatgaaa

SEQ ID NO: 581401 - DNA, 18 bp, Homo sapiens
taccccttcctgtcctgc

SEQ ID NO: 581402 - DNA, 20 bp, Homo sapiens
taccccttcctgtcctgcct

SEQ ID NO: 581403 - DNA, 14 bp, Homo sapiens
tacccttaagctag

SEQ ID NO: 581404 - DNA, 18 bp, Homo sapiens
tacctactggtgtaatct

SEQ ID NO: 581405 - DNA, 10 bp, Homo sapiens
tacctccctc

SEQ ID NO: 581406 - DNA, 15 bp, Homo sapiens
tacctccctccctct

SEQ ID NO: 581407 - DNA, 16 bp, Homo sapiens
tacctccctccctctc

SEQ ID NO: 581408 - DNA, 21 bp, Homo sapiens
tacctgctcacgtcaaatgca

SEQ ID NO: 581409 - DNA, 18 bp, Homo sapiens
tacctggggactcctcaa

SEQ ID NO: 581410 - DNA, 22 bp, Homo sapiens
taccttcaaggctcttcttcct

SEQ ID NO: 581411 - DNA, 16 bp, Homo sapiens
taccttttttttttct

SEQ ID NO: 581412 - DNA, 18 bp, Homo sapiens
taccttttttttttcttg

SEQ ID NO: 581413 - DNA, 22 bp, Homo sapiens
tacgaacctacagttttaactg

SEQ ID NO: 581414 - DNA, 21 bp, Homo sapiens
tacgcatcccatctctcccac

SEQ ID NO: 581415 - DNA, 19 bp, Homo sapiens
tactaaacagtaagatatc

SEQ ID NO: 581416 - DNA, 14 bp, Homo sapiens
tactactactgtta

SEQ ID NO: 581417 - DNA, 17 bp, Homo sapiens
tactgccaaaacattta

SEQ ID NO: 581418 - DNA, 20 bp, Homo sapiens
tactgccaaaacatttatga

SEQ ID NO: 581419 - DNA, 12 bp, Homo sapiens
tactggtgtaat

SEQ ID NO: 581420 - DNA, 19 bp, Homo sapiens
tactggtgtaatctcaatg

SEQ ID NO: 581421 - DNA, 22 bp, Homo sapiens
tactgttgtaagaattctgatt

SEQ ID NO: 581422 - DNA, 18 bp, Homo sapiens
tgataccatatgaatgaa

SEQ ID NO: 581423 - DNA, 15 bp, Homo sapiens
tgatattgctgtgag

SEQ ID NO: 581424 - DNA, 14 bp, Homo sapiens
tgatctattgctca

SEQ ID NO: 581425 - DNA, 20 bp, Homo sapiens
tgatctattgctcatcagct

SEQ ID NO: 581426 - DNA, 13 bp, Homo sapiens
tgatgaggaccca

SEQ ID NO: 581427 - DNA, 14 bp, Homo sapiens
tgatgctttggaag

SEQ ID NO: 581428 - DNA, 23 bp, Homo sapiens
tgatgctttggaagatgcagaag

SEQ ID NO: 581429 - DNA, 14 bp, Homo sapiens
tgatggacctgccc

SEQ ID NO: 581430 - DNA, 15 bp, Homo sapiens
tgatggacctgcccc

SEQ ID NO: 581431 - DNA, 14 bp, Homo sapiens
tgatggtcagaggg

SEQ ID NO: 581432 - DNA, 15 bp, Homo sapiens
tgatggtcagagggc

SEQ ID NO: 581433 - DNA, 19 bp, Homo sapiens
tgattactgcaatcactgt

SEQ ID NO: 581434 - DNA, 23 bp, Homo sapiens
tgattagaaattacctgtggata

SEQ ID NO: 581435 - DNA, 18 bp, Homo sapiens
tgattattttttttttct

SEQ ID NO: 581436 - DNA, 17 bp, Homo sapiens
tgattctggctttaagc

SEQ ID NO: 581437 - DNA, 18 bp, Homo sapiens
tgattctggctttaagcc

SEQ ID NO: 581438 - DNA, 21 bp, Homo sapiens
tgattctggctttaagccttc

SEQ ID NO: 581439 - DNA, 17 bp, Homo sapiens
tgattgggaaaacattt

SEQ ID NO: 581440 - DNA, 20 bp, Homo sapiens
tgattgggaaaacatttgct

SEQ ID NO: 581441 - DNA, 20 bp, Homo sapiens
tgatttcaaagttttgttgt

SEQ ID NO: 581442 - DNA, 21 bp, Homo sapiens
tgatttcaaagttttgttgta

SEQ ID NO: 581443 - DNA, 20 bp, Homo sapiens
tgatttccctccagagaaag

SEQ ID NO: 581444 - DNA, 21 bp, Homo sapiens
tgatttccctccagagaaagc

SEQ ID NO: 581445 - DNA, 16 bp, Homo sapiens
tgcaaaaattatatat

SEQ ID NO: 581446 - DNA, 19 bp, Homo sapiens
tgcaaagtctccagaagaa

SEQ ID NO: 581447 - DNA, 16 bp, Homo sapiens
tggggacttgtgtctg

SEQ ID NO: 581448 - DNA, 16 bp, Homo sapiens
tggggcctcaggctcc

SEQ ID NO: 581449 - DNA, 17 bp, Homo sapiens
tggggcctcaggctccg

SEQ ID NO: 581450 - DNA, 14 bp, Homo sapiens
tgggggaaccagca

SEQ ID NO: 581451 - DNA, 12 bp, Homo sapiens
tgggtccaggga

SEQ ID NO: 581452 - DNA, 13 bp, Homo sapiens
tgggtccagggag

SEQ ID NO: 581453 - DNA, 14 bp, Homo sapiens
tgggtgcagaccct

SEQ ID NO: 581454 - DNA, 17 bp, Homo sapiens
tgggtgtctccttaagc

SEQ ID NO: 581455 - DNA, 14 bp, Homo sapiens
tggtaaatgtttct

SEQ ID NO: 581456 - DNA, 15 bp, Homo sapiens
tggtaaatgtttctt

SEQ ID NO: 581457 - DNA, 20 bp, Homo sapiens
tggtccctcttctctcctca

SEQ ID NO: 581458 - DNA, 21 bp, Homo sapiens
tggtccctcttctctcctcag

SEQ ID NO: 581459 - DNA, 22 bp, Homo sapiens
tggtccctcttctctcctcagt

SEQ ID NO: 581460 - DNA, 17 bp, Homo sapiens
tggtcctagtaagaaga

SEQ ID NO: 581461 - DNA, 23 bp, Homo sapiens
tggtctataagatgaaacatcat

SEQ ID NO: 581462 - DNA, 19 bp, Homo sapiens
tggtctgccaatctgtaca

SEQ ID NO: 581463 - DNA, 18 bp, Homo sapiens
tggtgaataactatgcca

SEQ ID NO: 581464 - DNA, 20 bp, Homo sapiens
tggtgatttgaaaaatataa

SEQ ID NO: 581465 - DNA, 21 bp, Homo sapiens
tggtgatttgaaaaatataaa

SEQ ID NO: 581466 - DNA, 18 bp, Homo sapiens
tggtggaaaaaacatttt

SEQ ID NO: 581467 - DNA, 22 bp, Homo sapiens
tggtggaaaaaacattttaagt

SEQ ID NO: 581468 - DNA, 17 bp, Homo sapiens
tggtgtccagctgagtt

SEQ ID NO: 581469 - DNA, 15 bp, Homo sapiens
tggtgtggtgaatgt

SEQ ID NO: 581470 - DNA, 22 bp, Homo sapiens
tggttcctgtgtgaccctgggc

SEQ ID NO: 581471 - DNA, 13 bp, Homo sapiens
tgtaaatgaagat

SEQ ID NO: 581472 - DNA, 17 bp, Homo sapiens
tgtaaatgaagatcttt

SEQ ID NO: 581473 - DNA, 22 bp, Homo sapiens
tgtaaatgaagatctttatatt

SEQ ID NO: 581474 - DNA, 22 bp, Homo sapiens
tgtaagacccttattgctgtcc

SEQ ID NO: 581475 - DNA, 13 bp, Homo sapiens
tgtaatctatgtt

SEQ ID NO: 581476 - DNA, 16 bp, Homo sapiens
tgtaatctcaatgcaa

SEQ ID NO: 581477 - DNA, 15 bp, Homo sapiens
tgtaattatgtaaat

SEQ ID NO: 581478 - DNA, 19 bp, Homo sapiens
tgtaattatgtaaataact

SEQ ID NO: 581479 - DNA, 20 bp, Homo sapiens
tgtaattgtgtggattcttt

SEQ ID NO: 581480 - DNA, 21 bp, Homo sapiens
tgtaattgtgtggattcttta

SEQ ID NO: 581481 - DNA, 15 bp, Homo sapiens
tgtaatttaaatgaa

SEQ ID NO: 581482 - DNA, 17 bp, Homo sapiens
tgtaatttaaatgaaag

SEQ ID NO: 581483 - DNA, 24 bp, Homo sapiens
tgtacaaaattaagcaaatgttaa

SEQ ID NO: 581484 - DNA, 21 bp, Homo sapiens
tgtacagaccacctttcacaa

SEQ ID NO: 581485 - DNA, 18 bp, Homo sapiens
tgtacagattctttcagt

SEQ ID NO: 581486 - DNA, 19 bp, Homo sapiens
tgtacagattctttcagtt

SEQ ID NO: 581487 - DNA, 14 bp, Homo sapiens
tgtactaaacagta

SEQ ID NO: 581488 - DNA, 20 bp, Homo sapiens
tgtactaaacagtaagatat

SEQ ID NO: 581489 - DNA, 17 bp, Homo sapiens
tgtagaggcataaacct

SEQ ID NO: 581490 - DNA, 18 bp, Homo sapiens
tgtagatatgtattcttt

SEQ ID NO: 581491 - DNA, 22 bp, Homo sapiens
tgtagctattagcggctcctcg

SEQ ID NO: 581492 - DNA, 13 bp, Homo sapiens
tgtataaaagtgt

SEQ ID NO: 581493 - DNA, 19 bp, Homo sapiens
tgtataaatatacagtata

SEQ ID NO: 581494 - DNA, 15 bp, Homo sapiens
tgtatatatgtattt

SEQ ID NO: 581495 - DNA, 22 bp, Homo sapiens
tgtatatattttgtgtgaaatt

SEQ ID NO: 581496 - DNA, 13 bp, Homo sapiens
tgtatatgactgc

SEQ ID NO: 581497 - DNA, 16 bp, Homo sapiens
tgtatgagtagccagg

SEQ ID NO: 581498 - DNA, 15 bp, Homo sapiens
tgtatgttaaagaga

SEQ ID NO: 581499 - DNA, 16 bp, Homo sapiens
tgtattcttttctcag

SEQ ID NO: 581500 - DNA, 18 bp, Homo sapiens
tgtatttttctaaactcc

SEQ ID NO: 581501 - DNA, 11 bp, Homo sapiens
tgtcagtgttg

SEQ ID NO: 581502 - DNA, 23 bp, Homo sapiens
tgtcagtgttgcctcttgcaatg

SEQ ID NO: 581503 - DNA, 21 bp, Homo sapiens
tgtcagttccaaacagacaaa

SEQ ID NO: 581504 - DNA, 15 bp, Homo sapiens
tgtcattaaacatga

SEQ ID NO: 581505 - DNA, 16 bp, Homo sapiens
tgtcattctgcctgct

SEQ ID NO: 581506 - DNA, 17 bp, Homo sapiens
tgtcattgcacataagc

SEQ ID NO: 581507 - DNA, 21 bp, Homo sapiens
tgtcattgcacataagcttcc

SEQ ID NO: 581508 - DNA, 13 bp, Homo sapiens
tgtccaaaattta

SEQ ID NO: 581509 - DNA, 16 bp, Homo sapiens
tgtccaaaatttatat

SEQ ID NO: 581510 - DNA, 12 bp, Homo sapiens
tgtccaggaagt

SEQ ID NO: 581511 - DNA, 16 bp, Homo sapiens
tgtcccctatcctccc

SEQ ID NO: 581512 - DNA, 22 bp, Homo sapiens
tgtccctaatttaacccagctc

SEQ ID NO: 581513 - DNA, 12 bp, Homo sapiens
tgtctaaaaaca

SEQ ID NO: 581514 - DNA, 21 bp, Homo sapiens
tgtctaagtagggccagggca

SEQ ID NO: 581515 - DNA, 18 bp, Homo sapiens
tgtctcctttgctcttgc

SEQ ID NO: 581516 - DNA, 11 bp, Homo sapiens
tgtctggcaga

SEQ ID NO: 581517 - DNA, 20 bp, Homo sapiens
tgtcttaaactaaatgtgca

SEQ ID NO: 581518 - DNA, 18 bp, Homo sapiens
tgtgaaattgcatacttt

SEQ ID NO: 581519 - DNA, 22 bp, Homo sapiens
tgtgaccagaaagcttcatcca

SEQ ID NO: 581520 - DNA, 15 bp, Homo sapiens
tgtgaccctgggcag

SEQ ID NO: 581521 - DNA, 17 bp, Homo sapiens
tgtgagcatggggccag

SEQ ID NO: 581522 - DNA, 20 bp, Homo sapiens
tgtgagcatggggccaggaa

SEQ ID NO: 581523 - DNA, 17 bp, Homo sapiens
tgtgagccatgcctccc

SEQ ID NO: 581524 - DNA, 23 bp, Homo sapiens
tgtgagccatgcctccctgggcc

SEQ ID NO: 581525 - DNA, 15 bp, Homo sapiens
tgtgagctcttccta

SEQ ID NO: 581526 - DNA, 15 bp, Homo sapiens
tgtgattactgcaat

SEQ ID NO: 581527 - DNA, 16 bp, Homo sapiens
tgtgctacccctttga

SEQ ID NO: 581528 - DNA, 13 bp, Homo sapiens
tgtgctgggtccc

SEQ ID NO: 581529 - DNA, 19 bp, Homo sapiens
tgtgcttgagccaggaggc

SEQ ID NO: 581530 - DNA, 13 bp, Homo sapiens
tgtggtctgccaa

SEQ ID NO: 581531 - DNA, 22 bp, Homo sapiens
tgtggtgtcccctatcctcccc

SEQ ID NO: 581532 - DNA, 17 bp, Homo sapiens
tgtgtaaataatttgca

SEQ ID NO: 581533 - DNA, 19 bp, Homo sapiens
tgtgtatatattttgtgtg

SEQ ID NO: 581534 - DNA, 22 bp, Homo sapiens
tgtgtatatattttgtgtgaaa

SEQ ID NO: 581535 - DNA, 12 bp, Homo sapiens
tgtgtgaagttt

SEQ ID NO: 581536 - DNA, 23 bp, Homo sapiens
tgtgtgagaaaaactaacttgat

SEQ ID NO: 581537 - DNA, 21 bp, Homo sapiens
ctgagaaacactatttgtgac

SEQ ID NO: 581538 - DNA, 18 bp, Homo sapiens
ctgagaaagctaaagttt

SEQ ID NO: 581539 - DNA, 16 bp, Homo sapiens
ctgagaagctctgaag

SEQ ID NO: 581540 - DNA, 17 bp, Homo sapiens
ctgagcaatctgaccct

SEQ ID NO: 581541 - DNA, 19 bp, Homo sapiens
ctgagcatggagacagcag

SEQ ID NO: 581542 - DNA, 15 bp, Homo sapiens
ctgagccagattggc

SEQ ID NO: 581543 - DNA, 22 bp, Homo sapiens
ctgagccagattggccaattaa

SEQ ID NO: 581544 - DNA, 15 bp, Homo sapiens
ctgaggcctagactc

SEQ ID NO: 581545 - DNA, 16 bp, Homo sapiens
ctgaggctgagaaagc

SEQ ID NO: 581546 - DNA, 17 bp, Homo sapiens
ctgaggctgagaaagct

SEQ ID NO: 581547 - DNA, 20 bp, Homo sapiens
ctgaggtgggcagatcacga

SEQ ID NO: 581548 - DNA, 22 bp, Homo sapiens
ctgagtttttaaaaatggacaa

SEQ ID NO: 581549 - DNA, 17 bp, Homo sapiens
ctgataataaaggaact

SEQ ID NO: 581550 - DNA, 18 bp, Homo sapiens
ctgataccatatgaatga

SEQ ID NO: 581551 - DNA, 20 bp, Homo sapiens
ctgataccatatgaatgaaa

SEQ ID NO: 581552 - DNA, 23 bp, Homo sapiens
ctgataccatatgaatgaaacat

SEQ ID NO: 581553 - DNA, 15 bp, Homo sapiens
ctgatctggctgcag

SEQ ID NO: 581554 - DNA, 16 bp, Homo sapiens
ctgatgaaagctttgg

SEQ ID NO: 581555 - DNA, 22 bp, Homo sapiens
ctgatgctggggacacagcatc

SEQ ID NO: 581556 - DNA, 15 bp, Homo sapiens
ctgatggacctgccc

SEQ ID NO: 581557 - DNA, 15 bp, Homo sapiens
ctgattctggcttta

SEQ ID NO: 581558 - DNA, 20 bp, Homo sapiens
ctgcacaccctccagagaca

SEQ ID NO: 581559 - DNA, 16 bp, Homo sapiens
ctgcactcagaaaatg

SEQ ID NO: 581560 - DNA, 15 bp, Homo sapiens
ctgcactccagcctg

SEQ ID NO: 581561 - DNA, 14 bp, Homo sapiens
ctgcagagatttct

SEQ ID NO: 581562 - DNA, 16 bp, Homo sapiens
ctgcagagcaggacct

SEQ ID NO: 581563 - DNA, 20 bp, Homo sapiens
ctgcagcagtcgcccaagca

SEQ ID NO: 581564 - DNA, 19 bp, Homo sapiens
ctgcagccttttctggtcc

SEQ ID NO: 581565 - DNA, 15 bp, Homo sapiens
ctgcagtgagctgtg

SEQ ID NO: 581566 - DNA, 15 bp, Homo sapiens
ctgcataatgtttct

SEQ ID NO: 581567 - DNA, 15 bp, Homo sapiens
ctgcatggattcagc

SEQ ID NO: 581568 - DNA, 17 bp, Homo sapiens
ctgcatggattcagcat

SEQ ID NO: 581569 - DNA, 19 bp, Homo sapiens
ctgccagctgcagcctggt

SEQ ID NO: 581570 - DNA, 14 bp, Homo sapiens
ctgcccacctggct

SEQ ID NO: 581571 - DNA, 16 bp, Homo sapiens
ctgcccacctggctgc

SEQ ID NO: 581572 - DNA, 18 bp, Homo sapiens
ctgcccacctggctgcca

SEQ ID NO: 581573 - DNA, 13 bp, Homo sapiens
ctgccctgggctc

SEQ ID NO: 581574 - DNA, 16 bp, Homo sapiens
ctgccctgggctcctc

SEQ ID NO: 581575 - DNA, 19 bp, Homo sapiens
ctgccctgggctcctctta

SEQ ID NO: 581576 - DNA, 15 bp, Homo sapiens
ctgccgtaatttaac

SEQ ID NO: 581577 - DNA, 19 bp, Homo sapiens
ctgccgtagcttcagccag

SEQ ID NO: 581578 - DNA, 21 bp, Homo sapiens
ctgccgtagcttcagccaggc

SEQ ID NO: 581579 - DNA, 15 bp, Homo sapiens
ctgccgttttctggg

SEQ ID NO: 581580 - DNA, 15 bp, Homo sapiens
ctgcctgctccatcg

SEQ ID NO: 581581 - DNA, 18 bp, Homo sapiens
ctgccttcgtttatattt

SEQ ID NO: 581582 - DNA, 21 bp, Homo sapiens
ctgctccatcggggcaggggg

SEQ ID NO: 581583 - DNA, 16 bp, Homo sapiens
ctgctgcacacactca

SEQ ID NO: 581584 - DNA, 18 bp, Homo sapiens
ctgctgggccccatctcc

SEQ ID NO: 581585 - DNA, 16 bp, Homo sapiens
ctgctgttgaactttt

SEQ ID NO: 581586 - DNA, 17 bp, Homo sapiens
ctgctgttgaacttttt

SEQ ID NO: 581587 - DNA, 22 bp, Homo sapiens
ctgcttaatcttcaaagccttc

SEQ ID NO: 581588 - DNA, 13 bp, Homo sapiens
ctgcttaattgct

SEQ ID NO: 581589 - DNA, 21 bp, Homo sapiens
ctgcttcccttactttgctga

SEQ ID NO: 581590 - DNA, 22 bp, Homo sapiens
ctgctttttccaactcagaaat

SEQ ID NO: 581591 - DNA, 17 bp, Homo sapiens
ctggaagcccctgggcc

SEQ ID NO: 581592 - DNA, 22 bp, Homo sapiens
ctggaatcagtatttccttcca

SEQ ID NO: 581593 - DNA, 15 bp, Homo sapiens
ctggacttgcctctg

SEQ ID NO: 581594 - DNA, 16 bp, Homo sapiens
ctggacttgcctctgc

SEQ ID NO: 581595 - DNA, 15 bp, Homo sapiens
ctggatttgcagaag

SEQ ID NO: 581596 - DNA, 13 bp, Homo sapiens
ctggcacagaggt

SEQ ID NO: 581597 - DNA, 17 bp, Homo sapiens
ctggcagatgagggctg

SEQ ID NO: 581598 - DNA, 19 bp, Homo sapiens
ctggcagatgagggctggc

SEQ ID NO: 581599 - DNA, 19 bp, Homo sapiens
ctggctcaaagcagcagga

SEQ ID NO: 581600 - DNA, 21 bp, Homo sapiens
ctggctcaaagcagcaggact

SEQ ID NO: 581601 - DNA, 19 bp, Homo sapiens
ctggctgccgttttctggg

SEQ ID NO: 581602 - DNA, 16 bp, Homo sapiens
ctggctttaagccttc

SEQ ID NO: 581603 - DNA, 15 bp, Homo sapiens
ctgggaggcagaggt

SEQ ID NO: 581604 - DNA, 13 bp, Homo sapiens
ctgggctcctctt

SEQ ID NO: 581605 - DNA, 14 bp, Homo sapiens
ctggggactcctca

SEQ ID NO: 581606 - DNA, 15 bp, Homo sapiens
ctggggactcctcaa

SEQ ID NO: 581607 - DNA, 20 bp, Homo sapiens
ctggggactcctcaaaccac

SEQ ID NO: 581608 - DNA, 13 bp, Homo sapiens
ctgggtccaggga

SEQ ID NO: 581609 - DNA, 15 bp, Homo sapiens
ctgggtccagggagg

SEQ ID NO: 581610 - DNA, 22 bp, Homo sapiens
ctggtaataaatgtgactcagc

SEQ ID NO: 581611 - DNA, 15 bp, Homo sapiens
ctggtccctcttctc

SEQ ID NO: 581612 - DNA, 19 bp, Homo sapiens
ctggtccctcttctctcct

SEQ ID NO: 581613 - DNA, 14 bp, Homo sapiens
ctggtgtccagctg

SEQ ID NO: 581614 - DNA, 19 bp, Homo sapiens
ctggtttgcaaagaccacc

SEQ ID NO: 581615 - DNA, 23 bp, Homo sapiens
ctggtttgcaaagaccacctcca

SEQ ID NO: 581616 - DNA, 12 bp, Homo sapiens
ctgtaaagatgt

SEQ ID NO: 581617 - DNA, 21 bp, Homo sapiens
ctgtaaggatccggaaagaag

SEQ ID NO: 581618 - DNA, 12 bp, Homo sapiens
ctgtaattgtgt

SEQ ID NO: 581619 - DNA, 15 bp, Homo sapiens
ctgtactgaataggt

SEQ ID NO: 581620 - DNA, 17 bp, Homo sapiens
ctgtactgtgtctcatg

SEQ ID NO: 581621 - DNA, 18 bp, Homo sapiens
ctgtagatatgtattctt

SEQ ID NO: 581622 - DNA, 23 bp, Homo sapiens
ctgtatgggggagattgaacttt

SEQ ID NO: 581623 - DNA, 15 bp, Homo sapiens
ctgtatttttctaaa

SEQ ID NO: 581624 - DNA, 13 bp, Homo sapiens
ctgtcctgcctcc

SEQ ID NO: 581625 - DNA, 17 bp, Homo sapiens
ctgtcctgcctcctcat

SEQ ID NO: 581626 - DNA, 21 bp, Homo sapiens
ctgtcttaaactaaatgtgca

SEQ ID NO: 581627 - DNA, 16 bp, Homo sapiens
ctgtgattactgcaat

SEQ ID NO: 581628 - DNA, 17 bp, Homo sapiens
ctgtgattactgcaatc

SEQ ID NO: 581629 - DNA, 14 bp, Homo sapiens
ctgtggcataaatt

SEQ ID NO: 581630 - DNA, 18 bp, Homo sapiens
ctgtgtcattagtccttt

SEQ ID NO: 581631 - DNA, 23 bp, Homo sapiens
ctgtgttactaaaaaaaagatga

SEQ ID NO: 581632 - DNA, 16 bp, Homo sapiens
ctgtgttttgaaagaa

SEQ ID NO: 581633 - DNA, 17 bp, Homo sapiens
ctgttatcagtaatgct

SEQ ID NO: 581634 - DNA, 19 bp, Homo sapiens
ctgttgcacttttgaatgt

SEQ ID NO: 581635 - DNA, 21 bp, Homo sapiens
ctgttgtaagaattctgattg

SEQ ID NO: 581636 - DNA, 18 bp, Homo sapiens
ctgtttgcatttgataca

SEQ ID NO: 581637 - DNA, 20 bp, Homo sapiens
cttaaaaggtactggtacta

SEQ ID NO: 581638 - DNA, 15 bp, Homo sapiens
cttaaactaaatgtg

SEQ ID NO: 581639 - DNA, 23 bp, Homo sapiens
cttaagctaggatgttgctcaga

SEQ ID NO: 581640 - DNA, 23 bp, Homo sapiens
cttaagtcctaaaagttctcaat

SEQ ID NO: 581641 - DNA, 17 bp, Homo sapiens
cttaatggagttcttgt

SEQ ID NO: 581642 - DNA, 20 bp, Homo sapiens
cttacaatattgattgggaa

SEQ ID NO: 581643 - DNA, 21 bp, Homo sapiens
cttacatgttcccaaaacaat

SEQ ID NO: 581644 - DNA, 15 bp, Homo sapiens
cttacctaacatctg

SEQ ID NO: 581645 - DNA, 18 bp, Homo sapiens
cttagctgaggctgagaa

SEQ ID NO: 581646 - DNA, 19 bp, Homo sapiens
cttagctgaggctgagaaa

SEQ ID NO: 581647 - DNA, 23 bp, Homo sapiens
cttagggactacccatagacatg

SEQ ID NO: 581648 - DNA, 15 bp, Homo sapiens
cttaggggaaggaga

SEQ ID NO: 581649 - DNA, 17 bp, Homo sapiens
cttaggtttcaggaagt

SEQ ID NO: 581650 - DNA, 14 bp, Homo sapiens
cttattgaccattt

SEQ ID NO: 581651 - DNA, 15 bp, Homo sapiens
cttcaaagccttctc

SEQ ID NO: 581652 - DNA, 23 bp, Homo sapiens
cttcaaggctcttcttcctcacc

SEQ ID NO: 581653 - DNA, 18 bp, Homo sapiens
cttcagagataggcctgt

SEQ ID NO: 581654 - DNA, 15 bp, Homo sapiens
cttcagcattgtaat

SEQ ID NO: 581655 - DNA, 11 bp, Homo sapiens
cttcagccagg

SEQ ID NO: 581656 - DNA, 23 bp, Homo sapiens
cttcagttgcttgtcttctggta

SEQ ID NO: 581657 - DNA, 19 bp, Homo sapiens
cttcagtttaatgtctcct

SEQ ID NO: 581658 - DNA, 16 bp, Homo sapiens
cttcatgacagcctcc

SEQ ID NO: 581659 - DNA, 16 bp, Homo sapiens
cttcatgcctgatgaa

SEQ ID NO: 581660 - DNA, 14 bp, Homo sapiens
cttccactgtagct

SEQ ID NO: 581661 - DNA, 17 bp, Homo sapiens
cttccagagaacctgtg

SEQ ID NO: 581662 - DNA, 18 bp, Homo sapiens
cttcccctttgtcctgcg

SEQ ID NO: 581663 - DNA, 14 bp, Homo sapiens
cttcctattctcct

SEQ ID NO: 581664 - DNA, 16 bp, Homo sapiens
cttcctattctcctgc

SEQ ID NO: 581665 - DNA, 17 bp, Homo sapiens
cttcctattctcctgcc

SEQ ID NO: 581666 - DNA, 19 bp, Homo sapiens
cttcctattctcctgccat

SEQ ID NO: 581667 - DNA, 22 bp, Homo sapiens
cttcctattctcctgccatggg

SEQ ID NO: 581668 - DNA, 13 bp, Homo sapiens
cttcctcctacct

SEQ ID NO: 581669 - DNA, 16 bp, Homo sapiens
cttcctcctacctggg

SEQ ID NO: 581670 - DNA, 23 bp, Homo sapiens
cttcctcctacctggggactcct

SEQ ID NO: 581671 - DNA, 14 bp, Homo sapiens
cttcctgtcctgcc

SEQ ID NO: 581672 - DNA, 16 bp, Homo sapiens
cttcctgtcctgcctc

SEQ ID NO: 581673 - DNA, 21 bp, Homo sapiens
cttcctgtcctgcctcctcat

SEQ ID NO: 581674 - DNA, 18 bp, Homo sapiens
cttctagtgatgatggtt

SEQ ID NO: 581675 - DNA, 14 bp, Homo sapiens
cttctcatgtatat

SEQ ID NO: 581676 - DNA, 19 bp, Homo sapiens
cttctccctagctcctccc

SEQ ID NO: 581677 - DNA, 20 bp, Homo sapiens
cttctctcctttctccctgc

SEQ ID NO: 581678 - DNA, 21 bp, Homo sapiens
cttctctcctttctccctgca

SEQ ID NO: 581679 - DNA, 15 bp, Homo sapiens
cttctgactacttgt

SEQ ID NO: 581680 - DNA, 16 bp, Homo sapiens
cttctgggtccaggga

SEQ ID NO: 581681 - DNA, 19 bp, Homo sapiens
cttctgggtccagggaggg

SEQ ID NO: 581682 - DNA, 20 bp, Homo sapiens
cttcttcccctttgtcctgc

SEQ ID NO: 581683 - DNA, 23 bp, Homo sapiens
cttgaaactttgggaaaacatgt

SEQ ID NO: 581684 - DNA, 13 bp, Homo sapiens
cttgaaagaaatg

SEQ ID NO: 581685 - DNA, 23 bp, Homo sapiens
cttgaaatacgtttgtgtttcta

SEQ ID NO: 581686 - DNA, 21 bp, Homo sapiens
cttgactacctactggtgtaa

SEQ ID NO: 581687 - DNA, 22 bp, Homo sapiens
cttgaggggctaccctgggaag

SEQ ID NO: 581688 - DNA, 23 bp, Homo sapiens
cttgatttcaaagttttgttgta

SEQ ID NO: 581689 - DNA, 13 bp, Homo sapiens
cttgcagagcttg

SEQ ID NO: 581690 - DNA, 19 bp, Homo sapiens
cttgcagcggctcctgcaa

SEQ ID NO: 581691 - DNA, 13 bp, Homo sapiens
cttgcatgcttgc

SEQ ID NO: 581692 - DNA, 12 bp, Homo sapiens
cttgccatcctg

SEQ ID NO: 581693 - DNA, 13 bp, Homo sapiens
cttgccatcctga

SEQ ID NO: 581694 - DNA, 18 bp, Homo sapiens
cttgccatcctgatggac

SEQ ID NO: 581695 - DNA, 14 bp, Homo sapiens
cttgcctctgcaca

SEQ ID NO: 581696 - DNA, 24 bp, Homo sapiens
cttgcctctgcacaccctccagag

SEQ ID NO: 581697 - DNA, 12 bp, Homo sapiens
cttgcctggggc

SEQ ID NO: 581698 - DNA, 16 bp, Homo sapiens
cttggtggcttttcct

SEQ ID NO: 581699 - DNA, 14 bp, Homo sapiens
cttgtaagaccctt

SEQ ID NO: 581700 - DNA, 10 bp, Homo sapiens
cttgtgtctg

SEQ ID NO: 581701 - DNA, 22 bp, Homo sapiens
cttgtttacctttctctctcta

SEQ ID NO: 581702 - DNA, 18 bp, Homo sapiens
ctttaagccttcaaaact

SEQ ID NO: 581703 - DNA, 20 bp, Homo sapiens
ctttaagccttcaaaactat

SEQ ID NO: 581704 - DNA, 20 bp, Homo sapiens
ctttaagtgtgctgggcaga

SEQ ID NO: 581705 - DNA, 13 bp, Homo sapiens
ctttagtttttgg

SEQ ID NO: 581706 - DNA, 14 bp, Homo sapiens
ctttatatttcaat

SEQ ID NO: 581707 - DNA, 19 bp, Homo sapiens
ctttatatttcaataaatg

SEQ ID NO: 581708 - DNA, 20 bp, Homo sapiens
ctttatatttcaataaatga

SEQ ID NO: 581709 - DNA, 22 bp, Homo sapiens
ctttatatttcaataaatgata

SEQ ID NO: 581710 - DNA, 23 bp, Homo sapiens
ctttcaaaatatattttcagtac

SEQ ID NO: 581711 - DNA, 20 bp, Homo sapiens
ctttcactaaaacacacagg

SEQ ID NO: 581712 - DNA, 15 bp, Homo sapiens
ctttctccctgcagc

SEQ ID NO: 581713 - DNA, 13 bp, Homo sapiens
ctttctcctcccc

SEQ ID NO: 581714 - DNA, 14 bp, Homo sapiens
ctttctcctcccca

SEQ ID NO: 581715 - DNA, 22 bp, Homo sapiens
ctttgacaattgggagctgcca

SEQ ID NO: 581716 - DNA, 21 bp, Homo sapiens
ctttgagtagatccatttcca

SEQ ID NO: 581717 - DNA, 23 bp, Homo sapiens
ctttgagtagatccatttccatt

SEQ ID NO: 581718 - DNA, 12 bp, Homo sapiens
ctttgctcttgc

SEQ ID NO: 581719 - DNA, 21 bp, Homo sapiens
ctttgctgccagctctcagga

SEQ ID NO: 581720 - DNA, 21 bp, Homo sapiens
ctttgggaaaacatgttaatg

SEQ ID NO: 581721 - DNA, 15 bp, Homo sapiens
ctttggtggccaggg

SEQ ID NO: 581722 - DNA, 13 bp, Homo sapiens
ctttgtattttga

SEQ ID NO: 581723 - DNA, 17 bp, Homo sapiens
ctttgtattttgattat

SEQ ID NO: 581724 - DNA, 18 bp, Homo sapiens
ctttgtattttgattatt

SEQ ID NO: 581725 - DNA, 23 bp, Homo sapiens
ctttgtcagtgttgcctcttgca

SEQ ID NO: 581726 - DNA, 11 bp, Homo sapiens
ctttgtcctgc

SEQ ID NO: 581727 - DNA, 24 bp, Homo sapiens
ctttgtctaagtagggccagggca

SEQ ID NO: 581728 - DNA, 14 bp, Homo sapiens
ctttgtgaccagaa

SEQ ID NO: 581729 - DNA, 12 bp, Homo sapiens
cttttaaagacc

SEQ ID NO: 581730 - DNA, 17 bp, Homo sapiens
cttttaagcatgtgatg

SEQ ID NO: 581731 - DNA, 18 bp, Homo sapiens
cttttcaatgtctaaaaa

SEQ ID NO: 581732 - DNA, 19 bp, Homo sapiens
cttttctggtccctcttct

SEQ ID NO: 581733 - DNA, 16 bp, Homo sapiens
cttttggcctcctgca

SEQ ID NO: 581734 - DNA, 22 bp, Homo sapiens
cttttggcctcctgcaaagtct

SEQ ID NO: 581735 - DNA, 18 bp, Homo sapiens
cttttgttaaaagttatt

SEQ ID NO: 581736 - DNA, 14 bp, Homo sapiens
cttttgtttggtaa

SEQ ID NO: 581737 - DNA, 15 bp, Homo sapiens
cttttgtttggtaaa

SEQ ID NO: 581738 - DNA, 16 bp, Homo sapiens
cttttgtttggtaaat

SEQ ID NO: 581739 - DNA, 18 bp, Homo sapiens
cttttgtttggtaaatgt

SEQ ID NO: 581740 - DNA, 21 bp, Homo sapiens
ctttttaaagaagtgcatgaa

SEQ ID NO: 581741 - DNA, 14 bp, Homo sapiens
ctttttcatagtaa

SEQ ID NO: 581742 - DNA, 18 bp, Homo sapiens
ctttttgttgatgaggac

SEQ ID NO: 581743 - DNA, 12 bp, Homo sapiens
gaaaaatataaa

SEQ ID NO: 581744 - DNA, 14 bp, Homo sapiens
gaaaacagaaaacc

SEQ ID NO: 581745 - DNA, 14 bp, Homo sapiens
gaaaaccactttat

SEQ ID NO: 581746 - DNA, 22 bp, Homo sapiens
gaaaattctaacccaggtatcc

SEQ ID NO: 581747 - DNA, 12 bp, Homo sapiens
gaaacaaagatg

SEQ ID NO: 581748 - DNA, 17 bp, Homo sapiens
gaaacactgactcctgt

SEQ ID NO: 581749 - DNA, 13 bp, Homo sapiens
gaaacactgactt

SEQ ID NO: 581750 - DNA, 23 bp, Homo sapiens
gaaacatgggctgtgattactgc

SEQ ID NO: 581751 - DNA, 16 bp, Homo sapiens
gagccatgcctccctg

SEQ ID NO: 581752 - DNA, 13 bp, Homo sapiens
gagccctccccca

SEQ ID NO: 581753 - DNA, 14 bp, Homo sapiens
gagccctcccccaa

SEQ ID NO: 581754 - DNA, 17 bp, Homo sapiens
gagccctcctgagggcc

SEQ ID NO: 581755 - DNA, 19 bp, Homo sapiens
gagccctcctgagggccgg

SEQ ID NO: 581756 - DNA, 22 bp, Homo sapiens
gagcttaatgctacatgtgagt

SEQ ID NO: 581757 - DNA, 12 bp, Homo sapiens
gaggaaaattct

SEQ ID NO: 581758 - DNA, 21 bp, Homo sapiens
gaggacttggttgatgtttaa

SEQ ID NO: 581759 - DNA, 22 bp, Homo sapiens
gaggagaaatttgataatgaca

SEQ ID NO: 581760 - DNA, 17 bp, Homo sapiens
gaggagataaggtggct

SEQ ID NO: 581761 - DNA, 21 bp, Homo sapiens
gaggagataaggtggcttctc

SEQ ID NO: 581762 - DNA, 22 bp, Homo sapiens
gaggaggacttggttgatgttt

SEQ ID NO: 581763 - DNA, 14 bp, Homo sapiens
gagggaaaacagaa

SEQ ID NO: 581764 - DNA, 17 bp, Homo sapiens
gagggaaaacagaaaac

SEQ ID NO: 581765 - DNA, 24 bp, Homo sapiens
gagggacataagataaaatgatgt

SEQ ID NO: 581766 - DNA, 11 bp, Homo sapiens
gaggggcgcgg

SEQ ID NO: 581767 - DNA, 19 bp, Homo sapiens
gaggggctaccctgggaag

SEQ ID NO: 581768 - DNA, 16 bp, Homo sapiens
gaggtatgggctgggg

SEQ ID NO: 581769 - DNA, 19 bp, Homo sapiens
gaggtccttaggcctctga

SEQ ID NO: 581770 - DNA, 18 bp, Homo sapiens
gaggttgtggggcctcag

SEQ ID NO: 581771 - DNA, 21 bp, Homo sapiens
gaggttgtggggcctcaggct

SEQ ID NO: 581772 - DNA, 21 bp, Homo sapiens
gagtattgtttaaaatgtaat

SEQ ID NO: 581773 - DNA, 13 bp, Homo sapiens
gagtgtatgagta

SEQ ID NO: 581774 - DNA, 20 bp, Homo sapiens
gagtttggatgttgtaaata

SEQ ID NO: 581775 - DNA, 12 bp, Homo sapiens
gataataaagga

SEQ ID NO: 581776 - DNA, 15 bp, Homo sapiens
gataatattgtttgg

SEQ ID NO: 581777 - DNA, 16 bp, Homo sapiens
gatactggcacagagg

SEQ ID NO: 581778 - DNA, 14 bp, Homo sapiens
gatattttgaaatg

SEQ ID NO: 581779 - DNA, 16 bp, Homo sapiens
gatattttgaaatgaa

SEQ ID NO: 581780 - DNA, 20 bp, Homo sapiens
gatattttgaaatgaacttt

SEQ ID NO: 581781 - DNA, 17 bp, Homo sapiens
gatccccgtctctgccc

SEQ ID NO: 581782 - DNA, 15 bp, Homo sapiens
gatcctcagttctca

SEQ ID NO: 581783 - DNA, 14 bp, Homo sapiens
gatcgcatttccta

SEQ ID NO: 581784 - DNA, 23 bp, Homo sapiens
gatctttatatttcaataaatga

SEQ ID NO: 581785 - DNA, 12 bp, Homo sapiens
gatctttcagaa

SEQ ID NO: 581786 - DNA, 16 bp, Homo sapiens
gatctttcagaaatat

SEQ ID NO: 581787 - DNA, 16 bp, Homo sapiens
gatgaaacatcatttc

SEQ ID NO: 581788 - DNA, 22 bp, Homo sapiens
gatgacttggtggcttttcctt

SEQ ID NO: 581789 - DNA, 21 bp, Homo sapiens
gatgaggacccagagctgctg

SEQ ID NO: 581790 - DNA, 14 bp, Homo sapiens
gatgagggctggct

SEQ ID NO: 581791 - DNA, 16 bp, Homo sapiens
gatgatgctttggaag

SEQ ID NO: 581792 - DNA, 21 bp, Homo sapiens
gcccccaggaacgctctcctc

SEQ ID NO: 581793 - DNA, 15 bp, Homo sapiens
gcccccattctccca

SEQ ID NO: 581794 - DNA, 16 bp, Homo sapiens
gcccccattctcccag

SEQ ID NO: 581795 - DNA, 12 bp, Homo sapiens
gccccctgccct

SEQ ID NO: 581796 - DNA, 21 bp, Homo sapiens
gccccctgcttggccaggagg

SEQ ID NO: 581797 - DNA, 18 bp, Homo sapiens
gcccctaccctggacttg

SEQ ID NO: 581798 - DNA, 12 bp, Homo sapiens
gccctcctgagg

SEQ ID NO: 581799 - DNA, 17 bp, Homo sapiens
gccctcctgagggccgg

SEQ ID NO: 581800 - DNA, 13 bp, Homo sapiens
gccctgggctcct

SEQ ID NO: 581801 - DNA, 16 bp, Homo sapiens
gccctgggctcctctt

SEQ ID NO: 581802 - DNA, 13 bp, Homo sapiens
gccctttcctggc

SEQ ID NO: 581803 - DNA, 14 bp, Homo sapiens
gccctttcctggca

SEQ ID NO: 581804 - DNA, 15 bp, Homo sapiens
gccggcctgagaaac

SEQ ID NO: 581805 - DNA, 23 bp, Homo sapiens
gcctaagggatcctgcctgcccc

SEQ ID NO: 581806 - DNA, 13 bp, Homo sapiens
gcctagactctgt

SEQ ID NO: 581807 - DNA, 13 bp, Homo sapiens
gcctatagtccca

SEQ ID NO: 581808 - DNA, 16 bp, Homo sapiens
gcctatgtctggcaga

SEQ ID NO: 581809 - DNA, 21 bp, Homo sapiens
gcctcagcctgctttcctgca

SEQ ID NO: 581810 - DNA, 21 bp, Homo sapiens
gcctcaggccaagggaccagg

SEQ ID NO: 581811 - DNA, 12 bp, Homo sapiens
gcctcaggctcc

SEQ ID NO: 581812 - DNA, 18 bp, Homo sapiens
gcctccctgggccacctc

SEQ ID NO: 581813 - DNA, 20 bp, Homo sapiens
gcctccctgggccacctcct

SEQ ID NO: 581814 - DNA, 12 bp, Homo sapiens
gcctcctcatca

SEQ ID NO: 581815 - DNA, 23 bp, Homo sapiens
gcctcctcatcagtgtgtaaata

SEQ ID NO: 581816 - DNA, 16 bp, Homo sapiens
gcctctgaaaagtgtg

SEQ ID NO: 581817 - DNA, 19 bp, Homo sapiens
gcctgcccagttgcactca

SEQ ID NO: 581818 - DNA, 21 bp, Homo sapiens
gcctggtttgcaaagaccacc

SEQ ID NO: 581819 - DNA, 19 bp, Homo sapiens
gccttcaaaactatagctt

SEQ ID NO: 581820 - DNA, 22 bp, Homo sapiens
gccttcaaaactatagcttgca

SEQ ID NO: 581821 - DNA, 19 bp, Homo sapiens
gccttgcagcggctcctgc

SEQ ID NO: 581822 - DNA, 20 bp, Homo sapiens
gccttgcagcggctcctgca

SEQ ID NO: 581823 - DNA, 21 bp, Homo sapiens
gcctttctcctccccacctgt

SEQ ID NO: 581824 - DNA, 19 bp, Homo sapiens
gccttttctggtccctctt

SEQ ID NO: 581825 - DNA, 16 bp, Homo sapiens
gcgaagactgagccag

SEQ ID NO: 581826 - DNA, 16 bp, Homo sapiens
gcgagactctgtctca

SEQ ID NO: 581827 - DNA, 13 bp, Homo sapiens
gcgccagcgacct

SEQ ID NO: 581828 - DNA, 15 bp, Homo sapiens
gcgccagcgacctct

SEQ ID NO: 581829 - DNA, 21 bp, Homo sapiens
gcggcatgaaccctcttgcca

SEQ ID NO: 581830 - DNA, 20 bp, Homo sapiens
gcggctcctcgcccccacca

SEQ ID NO: 581831 - DNA, 13 bp, Homo sapiens
gcgggagacccct

SEQ ID NO: 581832 - DNA, 20 bp, Homo sapiens
gcggtttactcactgctgca

SEQ ID NO: 581833 - DNA, 20 bp, Homo sapiens
gcgttctaaatatgaatgaa

SEQ ID NO: 581834 - DNA, 14 bp, Homo sapiens
gcgtttgcctcctg

SEQ ID NO: 581835 - DNA, 20 bp, Homo sapiens
gctaatttgttttggatata

SEQ ID NO: 581836 - DNA, 23 bp, Homo sapiens
gctacagggcgagactctgtctc

SEQ ID NO: 581837 - DNA, 17 bp, Homo sapiens
gctacttcccactgtat

SEQ ID NO: 581838 - DNA, 14 bp, Homo sapiens
gctatacacacaca

SEQ ID NO: 581839 - DNA, 15 bp, Homo sapiens
gctatcggcagatga

SEQ ID NO: 581840 - DNA, 20 bp, Homo sapiens
gctcaatccctgaggactga

SEQ ID NO: 581841 - DNA, 14 bp, Homo sapiens
gctcagactgggca

SEQ ID NO: 581842 - DNA, 13 bp, Homo sapiens
gctcagctgagca

SEQ ID NO: 581843 - DNA, 18 bp, Homo sapiens
gctcagctgagcatggag

SEQ ID NO: 581844 - DNA, 21 bp, Homo sapiens
gctcattataatgtcattaaa

SEQ ID NO: 581845 - DNA, 17 bp, Homo sapiens
gctccatcgcgccagcg

SEQ ID NO: 581846 - DNA, 22 bp, Homo sapiens
gctccatcgcgccagcgacctc

SEQ ID NO: 581847 - DNA, 15 bp, Homo sapiens
gctccgggcaccagg

SEQ ID NO: 581848 - DNA, 23 bp, Homo sapiens
gctcctccccttcctcttgtctg

SEQ ID NO: 581849 - DNA, 14 bp, Homo sapiens
gctcctcgccccca

SEQ ID NO: 581850 - DNA, 17 bp, Homo sapiens
gctcctcgcccccacca

SEQ ID NO: 581851 - DNA, 19 bp, Homo sapiens
gctcctcttagctcagctg

SEQ ID NO: 581852 - DNA, 15 bp, Homo sapiens
gctctagggcctcag

SEQ ID NO: 581853 - DNA, 19 bp, Homo sapiens
gctctcctcgagccctccc

SEQ ID NO: 581854 - DNA, 23 bp, Homo sapiens
ggctccgggcaccaggggccaac

SEQ ID NO: 581855 - DNA, 17 bp, Homo sapiens
ggctcctcgcccccacc

SEQ ID NO: 581856 - DNA, 20 bp, Homo sapiens
ggctcctcttagctcagctg

SEQ ID NO: 581857 - DNA, 23 bp, Homo sapiens
ggctcctgcaaaaggaggtgaaa

SEQ ID NO: 581858 - DNA, 15 bp, Homo sapiens
ggctcctgttttgca

SEQ ID NO: 581859 - DNA, 16 bp, Homo sapiens
ggctgagccctcctga

SEQ ID NO: 581860 - DNA, 12 bp, Homo sapiens
ggctgatgggtg

SEQ ID NO: 581861 - DNA, 21 bp, Homo sapiens
ggctgcccacctggctgccaa

SEQ ID NO: 581862 - DNA, 16 bp, Homo sapiens
ggctgctctgcctgtg

SEQ ID NO: 581863 - DNA, 20 bp, Homo sapiens
ggctggaaggacctgctccc

SEQ ID NO: 581864 - DNA, 21 bp, Homo sapiens
ggcttggtggctcacgcctgt

SEQ ID NO: 581865 - DNA, 10 bp, Homo sapiens
gggaaaacag

SEQ ID NO: 581866 - DNA, 15 bp, Homo sapiens
gggaaaacagaaaac

SEQ ID NO: 581867 - DNA, 20 bp, Homo sapiens
gggaagctgccgtagcttca

SEQ ID NO: 581868 - DNA, 13 bp, Homo sapiens
gggacttgtgtct

SEQ ID NO: 581869 - DNA, 14 bp, Homo sapiens
gggacttgtgtctg

SEQ ID NO: 581870 - DNA, 16 bp, Homo sapiens
gggagaagaaatacag

SEQ ID NO: 581871 - DNA, 14 bp, Homo sapiens
gggagattgaactt

SEQ ID NO: 581872 - DNA, 21 bp, Homo sapiens
gggaggtatgggctgggggct

SEQ ID NO: 581873 - DNA, 13 bp, Homo sapiens
gggatgggtcctc

SEQ ID NO: 581874 - DNA, 14 bp, Homo sapiens
gggcaccaggggcc

SEQ ID NO: 581875 - DNA, 21 bp, Homo sapiens
gggcaccgtattcctctccca

SEQ ID NO: 581876 - DNA, 11 bp, Homo sapiens
gggcagctgtg

SEQ ID NO: 581877 - DNA, 19 bp, Homo sapiens
gggcagggggtatgcagag

SEQ ID NO: 581878 - DNA, 22 bp, Homo sapiens
gggcagggggtatgcagagctt

SEQ ID NO: 581879 - DNA, 20 bp, Homo sapiens
gggccaacctcaggctccta

SEQ ID NO: 581880 - DNA, 19 bp, Homo sapiens
gggccgggggaggggcgcg

SEQ ID NO: 581881 - DNA, 14 bp, Homo sapiens
gggctaaataaaga

SEQ ID NO: 581882 - DNA, 11 bp, Homo sapiens
gggctcctctt

SEQ ID NO: 581883 - DNA, 22 bp, Homo sapiens
gggctttgtgaccagaaagctt

SEQ ID NO: 581884 - DNA, 14 bp, Homo sapiens
ggggcctcaggctc

SEQ ID NO: 581885 - DNA, 15 bp, Homo sapiens
ggggcctcaggctcc

SEQ ID NO: 581886 - DNA, 15 bp, Homo sapiens
gggggccgggggagg

SEQ ID NO: 581887 - DNA, 19 bp, Homo sapiens
gggggccgggggaggggcg

SEQ ID NO: 581888 - DNA, 20 bp, Homo sapiens
ggggttccttccacttctgg

SEQ ID NO: 581889 - DNA, 14 bp, Homo sapiens
gggtgaggataaca

SEQ ID NO: 581890 - DNA, 14 bp, Homo sapiens
gggtgcagaccctg

SEQ ID NO: 581891 - DNA, 18 bp, Homo sapiens
ggtaaaacagggccacat

SEQ ID NO: 581892 - DNA, 17 bp, Homo sapiens
ggtaataaatgtgactc

SEQ ID NO: 581893 - DNA, 17 bp, Homo sapiens
ggtaattcacttcagtt

SEQ ID NO: 581894 - DNA, 20 bp, Homo sapiens
ggtagtctcactgcttgaac

SEQ ID NO: 581895 - DNA, 14 bp, Homo sapiens
ggtatgcagagctt

SEQ ID NO: 581896 - DNA, 19 bp, Homo sapiens
ggtattaaaactaaatttc

SEQ ID NO: 581897 - DNA, 14 bp, Homo sapiens
ggtccctcttctct

SEQ ID NO: 581898 - DNA, 15 bp, Homo sapiens
ggtccctcttctctc

SEQ ID NO: 581899 - DNA, 16 bp, Homo sapiens
ggtccctcttctctcc

SEQ ID NO: 581900 - DNA, 20 bp, Homo sapiens
ggtccctcttctctcctcag

SEQ ID NO: 581901 - DNA, 21 bp, Homo sapiens
ggtcctcctaagtcccttcct

SEQ ID NO: 581902 - DNA, 22 bp, Homo sapiens
ggtcctcctaagtcccttccta

SEQ ID NO: 581903 - DNA, 23 bp, Homo sapiens
ggtccttgtttctgccctgccag

SEQ ID NO: 581904 - DNA, 14 bp, Homo sapiens
ggtctaggacacag

SEQ ID NO: 581905 - DNA, 23 bp, Homo sapiens
ggtctggcttgggtgaatttcag

SEQ ID NO: 581906 - DNA, 15 bp, Homo sapiens
tagtgagacccctgt

SEQ ID NO: 581907 - DNA, 18 bp, Homo sapiens
tagtgagacccctgtctc

SEQ ID NO: 581908 - DNA, 19 bp, Homo sapiens
tagttatacttatttgtat

SEQ ID NO: 581909 - DNA, 16 bp, Homo sapiens
tagtttgaattcagta

SEQ ID NO: 581910 - DNA, 17 bp, Homo sapiens
tagtttgaattcagtaa

SEQ ID NO: 581911 - DNA, 12 bp, Homo sapiens
tataaaattatg

SEQ ID NO: 581912 - DNA, 18 bp, Homo sapiens
tataaacagaaatggaaa

SEQ ID NO: 581913 - DNA, 16 bp, Homo sapiens
tataaatgtataaata

SEQ ID NO: 581914 - DNA, 22 bp, Homo sapiens
tataacacatttttttgcatgc

SEQ ID NO: 581915 - DNA, 16 bp, Homo sapiens
tataatactactactg

SEQ ID NO: 581916 - DNA, 23 bp, Homo sapiens
tataatgatcagcaaaaagactg

SEQ ID NO: 581917 - DNA, 14 bp, Homo sapiens
tataattgtacaaa

SEQ ID NO: 581918 - DNA, 16 bp, Homo sapiens
tatacatcaatatgta

SEQ ID NO: 581919 - DNA, 20 bp, Homo sapiens
tatacatgtgatacattttt

SEQ ID NO: 581920 - DNA, 19 bp, Homo sapiens
tatactaagatgttcactg

SEQ ID NO: 581921 - DNA, 21 bp, Homo sapiens
tatagacttggagaatactgc

SEQ ID NO: 581922 - DNA, 23 bp, Homo sapiens
tatagacttggagaatactgcca

SEQ ID NO: 581923 - DNA, 15 bp, Homo sapiens
tatatataaatgtat

SEQ ID NO: 581924 - DNA, 16 bp, Homo sapiens
tatatattttgtgtga

SEQ ID NO: 581925 - DNA, 18 bp, Homo sapiens
tatatattttgtgtgaaa

SEQ ID NO: 581926 - DNA, 15 bp, Homo sapiens
tatattaaataacat

SEQ ID NO: 581927 - DNA, 18 bp, Homo sapiens
tatattaaataacatgtt

SEQ ID NO: 581928 - DNA, 17 bp, Homo sapiens
tatattacccaatggaa

SEQ ID NO: 581929 - DNA, 22 bp, Homo sapiens
tatattcaggacttgaaagaaa

SEQ ID NO: 581930 - DNA, 22 bp, Homo sapiens
tatattttgtgtgaaattgcat

SEQ ID NO: 581931 - DNA, 17 bp, Homo sapiens
tatatttttttaactgt

SEQ ID NO: 581932 - DNA, 20 bp, Homo sapiens
tatatttttttaactgtgat

SEQ ID NO: 581933 - DNA, 21 bp, Homo sapiens
tatcagtaacccccttaaatt

SEQ ID NO: 581934 - DNA, 21 bp, Homo sapiens
tatcagtaatgctaaatgtgt

SEQ ID NO: 581935 - DNA, 15 bp, Homo sapiens
tatccacactgtcaa

SEQ ID NO: 581936 - DNA, 18 bp, Homo sapiens
tatccacactgtcaaaca

SEQ ID NO: 581937 - DNA, 21 bp, Homo sapiens
tatcctccttctcctgttcca

SEQ ID NO: 581938 - DNA, 14 bp, Homo sapiens
tatcttctttggac

SEQ ID NO: 581939 - DNA, 21 bp, Homo sapiens
tatgacaagctgtatcactgc

SEQ ID NO: 581940 - DNA, 10 bp, Homo sapiens
tatgatgaca

SEQ ID NO: 581941 - DNA, 16 bp, Homo sapiens
tatgatgacaatcaaa

SEQ ID NO: 581942 - DNA, 16 bp, Homo sapiens
tatgcaattcagtgtt

SEQ ID NO: 581943 - DNA, 12 bp, Homo sapiens
tatgcagagctt

SEQ ID NO: 581944 - DNA, 13 bp, Homo sapiens
tatgctttattaa

SEQ ID NO: 581945 - DNA, 11 bp, Homo sapiens
tatgggctggg

SEQ ID NO: 581946 - DNA, 14 bp, Homo sapiens
tatgggctgggggc

SEQ ID NO: 581947 - DNA, 23 bp, Homo sapiens
tatgggcttttggggagccagaa

SEQ ID NO: 581948 - DNA, 21 bp, Homo sapiens
tatggtatttattttttcttt

SEQ ID NO: 581949 - DNA, 15 bp, Homo sapiens
tatgtaaataactct

SEQ ID NO: 581950 - DNA, 18 bp, Homo sapiens
tatgtattttttgaatct

SEQ ID NO: 581951 - DNA, 18 bp, Homo sapiens
tatgtgggatattgaatg

SEQ ID NO: 581952 - DNA, 14 bp, Homo sapiens
tattaaaactaaat

SEQ ID NO: 581953 - DNA, 15 bp, Homo sapiens
tattaaataacatgt

SEQ ID NO: 581954 - DNA, 18 bp, Homo sapiens
tattaactatcttctttg

SEQ ID NO: 581955 - DNA, 18 bp, Homo sapiens
tattaatgttttcaaaag

SEQ ID NO: 581956 - DNA, 22 bp, Homo sapiens
tattacccaatggaaaatataa

SEQ ID NO: 581957 - DNA, 18 bp, Homo sapiens
tattactgacatttcttc

SEQ ID NO: 581958 - DNA, 14 bp, Homo sapiens
tattatacatgtga

SEQ ID NO: 581959 - DNA, 21 bp, Homo sapiens
tattatacatgtgatacattt

SEQ ID NO: 581960 - DNA, 20 bp, Homo sapiens
tattatttttataattgtac

SEQ ID NO: 581961 - DNA, 15 bp, Homo sapiens
tattcagggtaaata

SEQ ID NO: 581962 - DNA, 16 bp, Homo sapiens
tattcagggtaaatag

SEQ ID NO: 581963 - DNA, 22 bp, Homo sapiens
tattccagatctttcagaaata

SEQ ID NO: 581964 - DNA, 14 bp, Homo sapiens
tattcgcccacccg

SEQ ID NO: 581965 - DNA, 21 bp, Homo sapiens
tattctagcctgcattgagct

SEQ ID NO: 581966 - DNA, 13 bp, Homo sapiens
tattcttttctca

SEQ ID NO: 581967 - DNA, 20 bp, Homo sapiens
tattgattgggaaaacattt

SEQ ID NO: 581968 - DNA, 21 bp, Homo sapiens
tattgcaaggtgtgatggtct

SEQ ID NO: 581969 - DNA, 13 bp, Homo sapiens
tattgcaatgcag

SEQ ID NO: 581970 - DNA, 19 bp, Homo sapiens
tattgctgtgagccttgca

SEQ ID NO: 581971 - DNA, 22 bp, Homo sapiens
tattgtgctgggtcccagcctg

SEQ ID NO: 581972 - DNA, 16 bp, Homo sapiens
tattgtttaaaatgta

SEQ ID NO: 581973 - DNA, 23 bp, Homo sapiens
tatttattgtgctgggtcccagc

SEQ ID NO: 581974 - DNA, 22 bp, Homo sapiens
tatttgtataaaagtgtgaaat

SEQ ID NO: 581975 - DNA, 11 bp, Homo sapiens
tatttgtgact

SEQ ID NO: 581976 - DNA, 12 bp, Homo sapiens
tattttagaaat

SEQ ID NO: 581977 - DNA, 14 bp, Homo sapiens
tattttcatgaaaa

SEQ ID NO: 581978 - DNA, 17 bp, Homo sapiens
tattttgtgtgaaattg

SEQ ID NO: 581979 - DNA, 20 bp, Homo sapiens
tatttttataattgtacaaa

SEQ ID NO: 581980 - DNA, 14 bp, Homo sapiens
tatttttatgatga

SEQ ID NO: 581981 - DNA, 21 bp, Homo sapiens
tatttttgtgaagtattcaca

SEQ ID NO: 581982 - DNA, 12 bp, Homo sapiens
tattttttaaga

SEQ ID NO: 581983 - DNA, 15 bp, Homo sapiens
tatttttttaactgt

SEQ ID NO: 581984 - DNA, 22 bp, Homo sapiens
tcaaagactgtatttagatctc

SEQ ID NO: 581985 - DNA, 21 bp, Homo sapiens
tcaaagatgcgtttgcctcct

SEQ ID NO: 581986 - DNA, 23 bp, Homo sapiens
tcaaagatgcgtttgcctcctgg

SEQ ID NO: 581987 - DNA, 13 bp, Homo sapiens
tcaaagcagcagg

SEQ ID NO: 581988 - DNA, 22 bp, Homo sapiens
tcaaagcagcaggactgtggga

SEQ ID NO: 581989 - DNA, 17 bp, Homo sapiens
tcaaagccggcctgaga

SEQ ID NO: 581990 - DNA, 22 bp, Homo sapiens
tcaaagccggcctgagaaacac

SEQ ID NO: 581991 - DNA, 13 bp, Homo sapiens
tcaaataagaaat

SEQ ID NO: 581992 - DNA, 14 bp, Homo sapiens
tcaacaaagaaaca

SEQ ID NO: 581993 - DNA, 14 bp, Homo sapiens
tcaactttgtaaaa

SEQ ID NO: 581994 - DNA, 16 bp, Homo sapiens
tcaactttgtaaaaat

SEQ ID NO: 581995 - DNA, 23 bp, Homo sapiens
tcaagacccggttattcgcccac

SEQ ID NO: 581996 - DNA, 16 bp, Homo sapiens
tcaagcattctgttta

SEQ ID NO: 581997 - DNA, 13 bp, Homo sapiens
tcaatatgtatat

SEQ ID NO: 581998 - DNA, 17 bp, Homo sapiens
tcaatatgtatatatgt

SEQ ID NO: 581999 - DNA, 17 bp, Homo sapiens
tcaatgaaccataaatt

SEQ ID NO: 582000 - DNA, 15 bp, Homo sapiens
tcacagagcagagtc

SEQ ID NO: 582001 - DNA, 19 bp, Homo sapiens
tcacagatcgcatttccta

SEQ ID NO: 582002 - DNA, 21 bp, Homo sapiens
tcacagatcgcatttcctaag

SEQ ID NO: 582003 - DNA, 22 bp, Homo sapiens
tcacccttatagtctaagacta

SEQ ID NO: 582004 - DNA, 13 bp, Homo sapiens
tcacctgcactaa

SEQ ID NO: 582005 - DNA, 16 bp, Homo sapiens
tcacgccactgcactc

SEQ ID NO: 582006 - DNA, 14 bp, Homo sapiens
tcacttgagcccag

SEQ ID NO: 582007 - DNA, 21 bp, Homo sapiens
tcagactgggcactggggcct

SEQ ID NO: 582008 - DNA, 14 bp, Homo sapiens
tcagagcgcacagg

SEQ ID NO: 582009 - DNA, 15 bp, Homo sapiens
tcagaggctgaggtg

SEQ ID NO: 582010 - DNA, 22 bp, Homo sapiens
tcagcatgtccaacatggtaat

SEQ ID NO: 582011 - DNA, 19 bp, Homo sapiens
tccttcatgacagcctcca

SEQ ID NO: 582012 - DNA, 12 bp, Homo sapiens
tccttccactgt

SEQ ID NO: 582013 - DNA, 12 bp, Homo sapiens
tcgcatttccta

SEQ ID NO: 582014 - DNA, 18 bp, Homo sapiens
tcgcccccaggaacgctc

SEQ ID NO: 582015 - DNA, 21 bp, Homo sapiens
tcggcagatgatgctttggaa

SEQ ID NO: 582016 - DNA, 17 bp, Homo sapiens
tcgtattaaaaaacaat

SEQ ID NO: 582017 - DNA, 22 bp, Homo sapiens
tcgtttatatttttttaactgt

SEQ ID NO: 582018 - DNA, 23 bp, Homo sapiens
tcgtttatatttttttaactgtg

SEQ ID NO: 582019 - DNA, 16 bp, Homo sapiens
tctaaatatgaatgaa

SEQ ID NO: 582020 - DNA, 15 bp, Homo sapiens
ttatcgtttttgtat

SEQ ID NO: 582021 - DNA, 20 bp, Homo sapiens
ttatgagattggttttcctg

SEQ ID NO: 582022 - DNA, 17 bp, Homo sapiens
ttatgcaattcagtgtt

SEQ ID NO: 582023 - DNA, 21 bp, Homo sapiens
ttatgcaattcagtgttccaa

SEQ ID NO: 582024 - DNA, 16 bp, Homo sapiens
ttatgtaaataactct

SEQ ID NO: 582025 - DNA, 23 bp, Homo sapiens
ttatgttaactagaatgcttttg

SEQ ID NO: 582026 - DNA, 17 bp, Homo sapiens
ttattaatgttttcaaa

SEQ ID NO: 582027 - DNA, 23 bp, Homo sapiens
ttattgtgctgggtcccagcctg

SEQ ID NO: 582028 - DNA, 21 bp, Homo sapiens
ttatttttataattgtacaaa

SEQ ID NO: 582029 - DNA, 16 bp, Homo sapiens
ttatttttttaaaatt

SEQ ID NO: 582030 - DNA, 17 bp, Homo sapiens
ttcaaagccttctccct

SEQ ID NO: 582031 - DNA, 16 bp, Homo sapiens
ttcaaagttttgttgt

SEQ ID NO: 582032 - DNA, 20 bp, Homo sapiens
ttcaagaatcagacagcagg

SEQ ID NO: 582033 - DNA, 19 bp, Homo sapiens
ttcaaggacattggtgaga

SEQ ID NO: 582034 - DNA, 20 bp, Homo sapiens
ttcacttcagtttaatgtct

SEQ ID NO: 582035 - DNA, 15 bp, Homo sapiens
ttcagaaatataaca

SEQ ID NO: 582036 - DNA, 20 bp, Homo sapiens
ttcagaaatataacacattt

SEQ ID NO: 582037 - DNA, 21 bp, Homo sapiens
ttcagaaatataacacatttt

SEQ ID NO: 582038 - DNA, 19 bp, Homo sapiens
ttcagcaagttagaactag

SEQ ID NO: 582039 - DNA, 13 bp, Homo sapiens
ttcagcatgtcca

SEQ ID NO: 582040 - DNA, 14 bp, Homo sapiens
ttcagggtaaatag

SEQ ID NO: 582041 - DNA, 18 bp, Homo sapiens
ttcatacgcatcccatct

SEQ ID NO: 582042 - DNA, 21 bp, Homo sapiens
ttcatacgcatcccatctctc

SEQ ID NO: 582043 - DNA, 23 bp, Homo sapiens
ttcatagtaagtgcgaagactga

SEQ ID NO: 582044 - DNA, 23 bp, Homo sapiens
ttcatattgtaatctatgtttat

SEQ ID NO: 582045 - DNA, 17 bp, Homo sapiens
ttcatgaaaataccatt

SEQ ID NO: 582046 - DNA, 15 bp, Homo sapiens
ttcatgacagcctcc

SEQ ID NO: 582047 - DNA, 23 bp, Homo sapiens
ttcatgattagaaattacctgtg

SEQ ID NO: 582048 - DNA, 15 bp, Homo sapiens
ttcatgcctgatgaa

SEQ ID NO: 582049 - DNA, 18 bp, Homo sapiens
ttcatggctgctgttgct

SEQ ID NO: 582050 - DNA, 22 bp, Homo sapiens
ttcattggcattctttgcaata

SEQ ID NO: 582051 - DNA, 23 bp, Homo sapiens
ttccaaacagacaaaacagataa

SEQ ID NO: 582052 - DNA, 21 bp, Homo sapiens
ttccagaaccacacttgaaac

SEQ ID NO: 582053 - DNA, 13 bp, Homo sapiens
ttccagagagtgg

SEQ ID NO: 582054 - DNA, 14 bp, Homo sapiens
ttccagtcctaaca

SEQ ID NO: 582055 - DNA, 17 bp, Homo sapiens
ttccagtcctaacaaat

SEQ ID NO: 582056 - DNA, 13 bp, Homo sapiens
ttccattgcttat

SEQ ID NO: 582057 - DNA, 14 bp, Homo sapiens
ttcccttgaaactt

SEQ ID NO: 582058 - DNA, 22 bp, Homo sapiens
ttcccttgaaactttgggaaaa

SEQ ID NO: 582059 - DNA, 14 bp, Homo sapiens
ttcctactttctat

SEQ ID NO: 582060 - DNA, 13 bp, Homo sapiens
ttcctattctcct

SEQ ID NO: 582061 - DNA, 14 bp, Homo sapiens
ttcctattctcctg

SEQ ID NO: 582062 - DNA, 16 bp, Homo sapiens
ttcctattctcctgcc

SEQ ID NO: 582063 - DNA, 13 bp, Homo sapiens
ttcctcctacctg

SEQ ID NO: 582064 - DNA, 11 bp, Homo sapiens
ttcctctgccc

SEQ ID NO: 582065 - DNA, 14 bp, Homo sapiens
ttcctgataataaa

SEQ ID NO: 582066 - DNA, 17 bp, Homo sapiens
ttcctgataataaagga

SEQ ID NO: 582067 - DNA, 11 bp, Homo sapiens
ttcctggcagt

SEQ ID NO: 582068 - DNA, 17 bp, Homo sapiens
ttcctggcagtctcagt

SEQ ID NO: 582069 - DNA, 16 bp, Homo sapiens
ttcctgggaacatcac

SEQ ID NO: 582070 - DNA, 17 bp, Homo sapiens
ttccttccactgtagct

SEQ ID NO: 582071 - DNA, 23 bp, Homo sapiens
ttcgaggggttccttccacttct

SEQ ID NO: 582072 - DNA, 11 bp, Homo sapiens
ttcggaaacac

SEQ ID NO: 582073 - DNA, 14 bp, Homo sapiens
ttcggaaacactga

SEQ ID NO: 582074 - DNA, 13 bp, Homo sapiens
ttcgtaacacagc

SEQ ID NO: 582075 - DNA, 23 bp, Homo sapiens
ttctagtgatgatggttcacgtt

SEQ ID NO: 582076 - DNA, 21 bp, Homo sapiens
ttctatttttatgatgacaat

SEQ ID NO: 582077 - DNA, 15 bp, Homo sapiens
ttctattttttgttt

SEQ ID NO: 582078 - DNA, 15 bp, Homo sapiens
ttctcaaatgtgtgt

SEQ ID NO: 582079 - DNA, 11 bp, Homo sapiens
ttctcaatgta

SEQ ID NO: 582080 - DNA, 13 bp, Homo sapiens
ttctccgggtcct

SEQ ID NO: 582081 - DNA, 14 bp, Homo sapiens
ttctcctccccacc

SEQ ID NO: 582082 - DNA, 15 bp, Homo sapiens
ttctcctccccacct

SEQ ID NO: 582083 - DNA, 18 bp, Homo sapiens
ttctcctccccacctgta

SEQ ID NO: 582084 - DNA, 20 bp, Homo sapiens
ttctcctccccacctgtagc

SEQ ID NO: 582085 - DNA, 11 bp, Homo sapiens
ttctcctgcca

SEQ ID NO: 582086 - DNA, 17 bp, Homo sapiens
ttctctcctcagtttct

SEQ ID NO: 582087 - DNA, 11 bp, Homo sapiens
ttctctccttt

SEQ ID NO: 582088 - DNA, 20 bp, Homo sapiens
ttctgaagtatgaagtctga

SEQ ID NO: 582089 - DNA, 22 bp, Homo sapiens
ttctggtcaagggctgtcattg

SEQ ID NO: 582090 - DNA, 19 bp, Homo sapiens
ttcttcccctttgtcctgc

SEQ ID NO: 582091 - DNA, 12 bp, Homo sapiens
ttctttgcaata

SEQ ID NO: 582092 - DNA, 21 bp, Homo sapiens
ttctttggattctaaatacat

SEQ ID NO: 582093 - DNA, 22 bp, Homo sapiens
ttgaaatacgtttgtgtttcta

SEQ ID NO: 582094 - DNA, 16 bp, Homo sapiens
ttgaaatgaactttgt

SEQ ID NO: 582095 - DNA, 14 bp, Homo sapiens
ttgaacagctgtga

SEQ ID NO: 582096 - DNA, 14 bp, Homo sapiens
ttgaactttggaac

SEQ ID NO: 582097 - DNA, 21 bp, Homo sapiens
ttgaatctatgaacctgaaaa

SEQ ID NO: 582098 - DNA, 22 bp, Homo sapiens
ttgaatgtccaaaatttatatt

SEQ ID NO: 582099 - DNA, 14 bp, Homo sapiens
ttgaatgttaaagg

SEQ ID NO: 582100 - DNA, 19 bp, Homo sapiens
ttgacagtttttgacattt

SEQ ID NO: 582101 - DNA, 18 bp, Homo sapiens
ttgacttttataaagcat

SEQ ID NO: 582102 - DNA, 13 bp, Homo sapiens
ttgagtattgttt

SEQ ID NO: 582103 - DNA, 18 bp, Homo sapiens
ttgataaccttgaaaaaa

SEQ ID NO: 582104 - DNA, 12 bp, Homo sapiens
ttgataatgaca

SEQ ID NO: 582105 - DNA, 12 bp, Homo sapiens
tttttaactgta

SEQ ID NO: 582106 - DNA, 21 bp, Homo sapiens
tttttcttttcggaaatctta

SEQ ID NO: 582107 - DNA, 20 bp, Homo sapiens
tttttggcgtggctgactta

SEQ ID NO: 582108 - DNA, 12 bp, Homo sapiens
tttttgtttgcc

SEQ ID NO: 582109 - DNA, 14 bp, Homo sapiens
tttttgtttggaga

SEQ ID NO: 582110 - DNA, 12 bp, Homo sapiens
ttttttaagctt

SEQ ID NO: 582111 - DNA, 13 bp, Homo sapiens
tgactcttattta

SEQ ID NO: 582112 - DNA, 19 bp, Homo sapiens
tgactcttatttatagaat

SEQ ID NO: 582113 - DNA, 11 bp, Homo sapiens
tgactgtgtca

SEQ ID NO: 582114 - DNA, 17 bp, Homo sapiens
tgacttaggtttcagga

SEQ ID NO: 582115 - DNA, 21 bp, Homo sapiens
tgacttggtggcttttccttg

SEQ ID NO: 582116 - DNA, 17 bp, Homo sapiens
tgacttttataaagcat

SEQ ID NO: 582117 - DNA, 18 bp, Homo sapiens
tgagaaaaactaacttga

SEQ ID NO: 582118 - DNA, 15 bp, Homo sapiens
tgagaaacactattt

SEQ ID NO: 582119 - DNA, 20 bp, Homo sapiens
tgagaaacactatttgtgac

SEQ ID NO: 582120 - DNA, 23 bp, Homo sapiens
tgagaaacactatttgtgacttt

SEQ ID NO: 582121 - DNA, 18 bp, Homo sapiens
tgagaaagctaaagtttg

SEQ ID NO: 582122 - DNA, 17 bp, Homo sapiens
tgagattctgaagtatg

SEQ ID NO: 582123 - DNA, 19 bp, Homo sapiens
tgagattggttttcctgtg

SEQ ID NO: 582124 - DNA, 19 bp, Homo sapiens
tgagcaagaccctgtctct

SEQ ID NO: 582125 - DNA, 16 bp, Homo sapiens
tgagcatggagacagc

SEQ ID NO: 582126 - DNA, 18 bp, Homo sapiens
tgagcatggggccaggaa

SEQ ID NO: 582127 - DNA, 16 bp, Homo sapiens
tgagccatgcctccct

SEQ ID NO: 582128 - DNA, 20 bp, Homo sapiens
tgagccatgcctccctgggc

SEQ ID NO: 582129 - DNA, 21 bp, Homo sapiens
tgagctaaataaagatattgt

SEQ ID NO: 582130 - DNA, 12 bp, Homo sapiens
tgagctctgaaa

SEQ ID NO: 582131 - DNA, 14 bp, Homo sapiens
tgaggacccagagc

SEQ ID NO: 582132 - DNA, 18 bp, Homo sapiens
tgaggagaaatttgataa

SEQ ID NO: 582133 - DNA, 14 bp, Homo sapiens
tgaggctgagaaag

SEQ ID NO: 582134 - DNA, 12 bp, Homo sapiens
tgagtattgttt

SEQ ID NO: 582135 - DNA, 15 bp, Homo sapiens
tgagtattgtttaaa

SEQ ID NO: 582136 - DNA, 18 bp, Homo sapiens
tgagtccttgatttcaaa

SEQ ID NO: 582137 - DNA, 21 bp, Homo sapiens
tgagtctgtactaaacagtaa

SEQ ID NO: 582138 - DNA, 19 bp, Homo sapiens
tgagtgacaaagcctctga

SEQ ID NO: 582139 - DNA, 18 bp, Homo sapiens
tgagtgtatgagtagcca

SEQ ID NO: 582140 - DNA, 13 bp, Homo sapiens
tgataatgacact

SEQ ID NO: 582141 - DNA, 23 bp, Homo sapiens
tgatagggtctaccaatacaaaa

SEQ ID NO: 582142 - DNA, 16 bp, Homo sapiens
tgatatgcatttcctg

SEQ ID NO: 582143 - DNA, 21 bp, Homo sapiens
tgatccccgtctctgccctgg

SEQ ID NO: 582144 - DNA, 22 bp, Homo sapiens
tgatccccgtctctgccctggg

SEQ ID NO: 582145 - DNA, 20 bp, Homo sapiens
tgatcggccagttttcggaa

SEQ ID NO: 582146 - DNA, 18 bp, Homo sapiens
tgatctacttctgtaatt

SEQ ID NO: 582147 - DNA, 20 bp, Homo sapiens
tgatctacttctgtaattgt

SEQ ID NO: 582148 - DNA, 21 bp, Homo sapiens
tgatggacctgccccggacct

SEQ ID NO: 582149 - DNA, 18 bp, Homo sapiens
tgatgtccttaaaatgtg

SEQ ID NO: 582150 - DNA, 11 bp, Homo sapiens
tgatgtttaaa

SEQ ID NO: 582151 - DNA, 14 bp, Homo sapiens
tgattactgcaatc

SEQ ID NO: 582152 - DNA, 16 bp, Homo sapiens
tgattgggaaaacatt

SEQ ID NO: 582153 - DNA, 16 bp, Homo sapiens
tgatttgaaaaatata

SEQ ID NO: 582154 - DNA, 15 bp, Homo sapiens
tgcaaagaccacctc

SEQ ID NO: 582155 - DNA, 15 bp, Homo sapiens
tgcaaagtctccaga

SEQ ID NO: 582156 - DNA, 18 bp, Homo sapiens
tgcaaatgagctctgaaa

SEQ ID NO: 582157 - DNA, 15 bp, Homo sapiens
tgcaacaagcatgca

SEQ ID NO: 582158 - DNA, 16 bp, Homo sapiens
tgcaacagacttgaat

SEQ ID NO: 582159 - DNA, 13 bp, Homo sapiens
tgcaatcactgtg

SEQ ID NO: 582160 - DNA, 20 bp, Homo sapiens
tgcacaccctccagagacaa

SEQ ID NO: 582161 - DNA, 14 bp, Homo sapiens
tgcactccagcctg

SEQ ID NO: 582162 - DNA, 15 bp, Homo sapiens
tgcactccagcctgg

SEQ ID NO: 582163 - DNA, 14 bp, Homo sapiens
tgcactgccccctg

SEQ ID NO: 582164 - DNA, 16 bp, Homo sapiens
tgcacttttgaatgtc

SEQ ID NO: 582165 - DNA, 19 bp, Homo sapiens
tgcacttttgaatgtccaa

SEQ ID NO: 582166 - DNA, 21 bp, Homo sapiens
tgcagaagcaataataaagta

SEQ ID NO: 582167 - DNA, 17 bp, Homo sapiens
tgcagaccctgaaccca

SEQ ID NO: 582168 - DNA, 23 bp, Homo sapiens
tgcagaccctgaacccacacctg

SEQ ID NO: 582169 - DNA, 13 bp, Homo sapiens
tgcagagatttct

SEQ ID NO: 582170 - DNA, 13 bp, Homo sapiens
tgcagagcttgtg

SEQ ID NO: 582171 - DNA, 17 bp, Homo sapiens
tgcagaggttgagagga

SEQ ID NO: 582172 - DNA, 13 bp, Homo sapiens
tgcagcagtcgcc

SEQ ID NO: 582173 - DNA, 16 bp, Homo sapiens
tgcagcctggttggca

SEQ ID NO: 582174 - DNA, 14 bp, Homo sapiens
tgcagcggctcctg

SEQ ID NO: 582175 - DNA, 19 bp, Homo sapiens
tgcaggcaggaacaaacag

SEQ ID NO: 582176 - DNA, 17 bp, Homo sapiens
tgcataatgtttctgga

SEQ ID NO: 582177 - DNA, 15 bp, Homo sapiens
tgcatgaaaaaccat

SEQ ID NO: 582178 - DNA, 16 bp, Homo sapiens
tgcatggattcagcat

SEQ ID NO: 582179 - DNA, 21 bp, Homo sapiens
tgcatgtagaggcttgtttac

SEQ ID NO: 582180 - DNA, 15 bp, Homo sapiens
tgcatttaataaaga

SEQ ID NO: 582181 - DNA, 16 bp, Homo sapiens
tgcatttgatacattt

SEQ ID NO: 582182 - DNA, 17 bp, Homo sapiens
tgcattttgatattgct

SEQ ID NO: 582183 - DNA, 12 bp, Homo sapiens
tgccaagagcta

SEQ ID NO: 582184 - DNA, 22 bp, Homo sapiens
tgccacatcaaacctttgagta

SEQ ID NO: 582185 - DNA, 13 bp, Homo sapiens
tgccactgcactc

SEQ ID NO: 582186 - DNA, 22 bp, Homo sapiens
tgccagccccctaaaagcactc

SEQ ID NO: 582187 - DNA, 16 bp, Homo sapiens
tgccatctatctagtt

SEQ ID NO: 582188 - DNA, 16 bp, Homo sapiens
tgcccaagccctgaga

SEQ ID NO: 582189 - DNA, 18 bp, Homo sapiens
tgcccaagccctgagagt

SEQ ID NO: 582190 - DNA, 15 bp, Homo sapiens
tgcccacctggctgc

SEQ ID NO: 582191 - DNA, 16 bp, Homo sapiens
tgcccacctggctgcc

SEQ ID NO: 582192 - DNA, 18 bp, Homo sapiens
tgcccccattctcccagt

SEQ ID NO: 582193 - DNA, 22 bp, Homo sapiens
tgccccggacctacctccctcc

SEQ ID NO: 582194 - DNA, 15 bp, Homo sapiens
tgccctcctctccct

SEQ ID NO: 582195 - DNA, 23 bp, Homo sapiens
tgccctgccagctgcagcctggt

SEQ ID NO: 582196 - DNA, 15 bp, Homo sapiens
tgccctgggctcctc

SEQ ID NO: 582197 - DNA, 17 bp, Homo sapiens
tgccctgggctcctctt

SEQ ID NO: 582198 - DNA, 16 bp, Homo sapiens
tgccctttcctggcag

SEQ ID NO: 582199 - DNA, 14 bp, Homo sapiens
tgcctatagtccca

SEQ ID NO: 582200 - DNA, 22 bp, Homo sapiens
tgcctcaggccaagggaccagg

SEQ ID NO: 582201 - DNA, 19 bp, Homo sapiens
tgcctctcttcttcccctt

SEQ ID NO: 582202 - DNA, 21 bp, Homo sapiens
tgcctgcccctaccctggact

SEQ ID NO: 582203 - DNA, 21 bp, Homo sapiens
tgcctgtgagcatggggccag

SEQ ID NO: 582204 - DNA, 19 bp, Homo sapiens
tgcgaccttaatttaactt

SEQ ID NO: 582205 - DNA, 13 bp, Homo sapiens
tgcgtttgcctcc

SEQ ID NO: 582206 - DNA, 16 bp, Homo sapiens
tgtagctgaagcagga

SEQ ID NO: 582207 - DNA, 15 bp, Homo sapiens
tgtagctgaggaggc

SEQ ID NO: 582208 - DNA, 14 bp, Homo sapiens
tgtaggtaagactg

SEQ ID NO: 582209 - DNA, 15 bp, Homo sapiens
tgtaggtaagactgt

SEQ ID NO: 582210 - DNA, 21 bp, Homo sapiens
tgtataaaagtgtgaaataaa

SEQ ID NO: 582211 - DNA, 14 bp, Homo sapiens
tgtatatgactgca

SEQ ID NO: 582212 - DNA, 17 bp, Homo sapiens
tgtatgagtagccaggg

SEQ ID NO: 582213 - DNA, 22 bp, Homo sapiens
tgtatgttaaagagaatgagtc

SEQ ID NO: 582214 - DNA, 14 bp, Homo sapiens
tgtatttctatata

SEQ ID NO: 582215 - DNA, 16 bp, Homo sapiens
tgtattttcatgaaaa

SEQ ID NO: 582216 - DNA, 17 bp, Homo sapiens
tgtcagctgctgttgaa

SEQ ID NO: 582217 - DNA, 20 bp, Homo sapiens
tgtcagctgctgttgaactt

SEQ ID NO: 582218 - DNA, 22 bp, Homo sapiens
tgtcagctgctgttgaactttt

SEQ ID NO: 582219 - DNA, 17 bp, Homo sapiens
tgtcattctgcctgctc

SEQ ID NO: 582220 - DNA, 18 bp, Homo sapiens
tgtcattctgcctgctcc

SEQ ID NO: 582221 - DNA, 19 bp, Homo sapiens
tgtcattctgcctgctcca

SEQ ID NO: 582222 - DNA, 20 bp, Homo sapiens
tgtccaacatggtaattcac

SEQ ID NO: 582223 - DNA, 13 bp, Homo sapiens
tgtcctgcctcct

SEQ ID NO: 582224 - DNA, 15 bp, Homo sapiens
tgtcctgcctcctca

SEQ ID NO: 582225 - DNA, 15 bp, Homo sapiens
tgtccttaaaatgtg

SEQ ID NO: 582226 - DNA, 14 bp, Homo sapiens
tgtctaaaaacatt

SEQ ID NO: 582227 - DNA, 17 bp, Homo sapiens
tgtctaagtagggccag

SEQ ID NO: 582228 - DNA, 13 bp, Homo sapiens
tgtctcctttgct

SEQ ID NO: 582229 - DNA, 14 bp, Homo sapiens
tgtctcctttgctc

SEQ ID NO: 582230 - DNA, 17 bp, Homo sapiens
tgtctggcagatgaggg

SEQ ID NO: 582231 - DNA, 20 bp, Homo sapiens
tgtctgtgttttgaaagaat

SEQ ID NO: 582232 - DNA, 18 bp, Homo sapiens
tgtcttaaactaaatgtg

SEQ ID NO: 582233 - DNA, 23 bp, Homo sapiens
tgtgaagagggacataagataaa

SEQ ID NO: 582234 - DNA, 15 bp, Homo sapiens
tgtgaagtttggaga

SEQ ID NO: 582235 - DNA, 21 bp, Homo sapiens
tgtgaatacctgctcacgtca

SEQ ID NO: 582236 - DNA, 13 bp, Homo sapiens
tgtgaccctgggc

SEQ ID NO: 582237 - DNA, 15 bp, Homo sapiens
tgtgagccatgcctc

SEQ ID NO: 582238 - DNA, 14 bp, Homo sapiens
tgtgagccttgcat

SEQ ID NO: 582239 - DNA, 22 bp, Homo sapiens
tgtgatacattttttaagcttc

SEQ ID NO: 582240 - DNA, 16 bp, Homo sapiens
tgtgcaatagaaggtg

SEQ ID NO: 582241 - DNA, 17 bp, Homo sapiens
tgtgcctatagtcccag

SEQ ID NO: 582242 - DNA, 20 bp, Homo sapiens
tgtgcctatagtcccagcta

SEQ ID NO: 582243 - DNA, 17 bp, Homo sapiens
tgtgctatacacacaca

SEQ ID NO: 582244 - DNA, 12 bp, Homo sapiens
tgtggggctgga

SEQ ID NO: 582245 - DNA, 20 bp, Homo sapiens
tgtgtaaccagctcagtgtt

SEQ ID NO: 582246 - DNA, 23 bp, Homo sapiens
tgtgtggattgcctctgaaaagt

SEQ ID NO: 582247 - DNA, 12 bp, Homo sapiens
tgtgtgtgtttt

SEQ ID NO: 582248 - DNA, 23 bp, Homo sapiens
tgtgttactaaaaaaaagatgaa

SEQ ID NO: 582249 - DNA, 14 bp, Homo sapiens
tgttaaaaatgtca

SEQ ID NO: 582250 - DNA, 17 bp, Homo sapiens
tgttaaagagataaaga

SEQ ID NO: 582251 - DNA, 18 bp, Homo sapiens
tgttatcagtaatgctaa

SEQ ID NO: 582252 - DNA, 23 bp, Homo sapiens
tgttcaatgattatttgtattta

SEQ ID NO: 582253 - DNA, 20 bp, Homo sapiens
tgttctcctatatcctcctt

SEQ ID NO: 582254 - DNA, 15 bp, Homo sapiens
tgttctgcatggatt

SEQ ID NO: 582255 - DNA, 20 bp, Homo sapiens
tgttctgcatggattcagca

SEQ ID NO: 582256 - DNA, 20 bp, Homo sapiens
tgttgaactttttaaagaag

SEQ ID NO: 582257 - DNA, 16 bp, Homo sapiens
tgttgactgtgtcatt

SEQ ID NO: 582258 - DNA, 13 bp, Homo sapiens
tgttgcactgccc

SEQ ID NO: 582259 - DNA, 11 bp, Homo sapiens
tgttgcacttt

SEQ ID NO: 582260 - DNA, 18 bp, Homo sapiens
tgttgcacttttgaatgt

SEQ ID NO: 582261 - DNA, 22 bp, Homo sapiens
tgttgcacttttgaatgtccaa

SEQ ID NO: 582262 - DNA, 14 bp, Homo sapiens
tgttgcctcttgca

SEQ ID NO: 582263 - DNA, 15 bp, Homo sapiens
tgttggtgctttgca

SEQ ID NO: 582264 - DNA, 16 bp, Homo sapiens
tgtttacctttctctc

SEQ ID NO: 582265 - DNA, 14 bp, Homo sapiens
tgtttagattgtat

SEQ ID NO: 582266 - DNA, 13 bp, Homo sapiens
tgtttatttcagg

SEQ ID NO: 582267 - DNA, 19 bp, Homo sapiens
tgtttctctataaagtatg

SEQ ID NO: 582268 - DNA, 24 bp, Homo sapiens
tgtttctctataaagtatggtaat

SEQ ID NO: 582269 - DNA, 20 bp, Homo sapiens
tgtttgtacacaacaatcct

SEQ ID NO: 582270 - DNA, 20 bp, Homo sapiens
tgttttaaaacgtgtaaatg

SEQ ID NO: 582271 - DNA, 22 bp, Homo sapiens
tgttttaaaacgtgtaaatgaa

SEQ ID NO: 582272 - DNA, 21 bp, Homo sapiens
ttaaaaacgaaaacctgacta

SEQ ID NO: 582273 - DNA, 20 bp, Homo sapiens
ttaaaaataatagagcccca

SEQ ID NO: 582274 - DNA, 18 bp, Homo sapiens
ttaaaacgtgtaaatgaa

SEQ ID NO: 582275 - DNA, 20 bp, Homo sapiens
ttaaagaccctcctattcta

SEQ ID NO: 582276 - DNA, 19 bp, Homo sapiens
ttaaatccttttacctttt

SEQ ID NO: 582277 - DNA, 12 bp, Homo sapiens
ttaactgtactg

SEQ ID NO: 582278 - DNA, 13 bp, Homo sapiens
ttaactgtggata

SEQ ID NO: 582279 - DNA, 19 bp, Homo sapiens
ttaagcaaatgttaaaagt

SEQ ID NO: 582280 - DNA, 19 bp, Homo sapiens
ttaagctgcagagatttct

SEQ ID NO: 582281 - DNA, 23 bp, Homo sapiens
ttaagctgcagagatttctcatt

SEQ ID NO: 582282 - DNA, 19 bp, Homo sapiens
ttaaggacccttttaagca

SEQ ID NO: 582283 - DNA, 18 bp, Homo sapiens
ttaaggggaagaatgaaa

SEQ ID NO: 582284 - DNA, 23 bp, Homo sapiens
ttaataccagataccttatctta

SEQ ID NO: 582285 - DNA, 21 bp, Homo sapiens
ttaatccagttataagaagaa

SEQ ID NO: 582286 - DNA, 18 bp, Homo sapiens
ttaatgtctcctttgctc

SEQ ID NO: 582287 - DNA, 23 bp, Homo sapiens
ttaatgtctcctttgctcttgcc

SEQ ID NO: 582288 - DNA, 14 bp, Homo sapiens
ttaatgttttcaaa

SEQ ID NO: 582289 - DNA, 21 bp, Homo sapiens
ttacaatattgattgggaaaa

SEQ ID NO: 582290 - DNA, 18 bp, Homo sapiens
ttaccccaaagagaaaga

SEQ ID NO: 582291 - DNA, 12 bp, Homo sapiens
ttacctgtggat

SEQ ID NO: 582292 - DNA, 19 bp, Homo sapiens
ttaccttttttttttcttg

SEQ ID NO: 582293 - DNA, 21 bp, Homo sapiens
ttacgaatgcccctgttcatg

SEQ ID NO: 582294 - DNA, 12 bp, Homo sapiens
ttactcactgct

SEQ ID NO: 582295 - DNA, 20 bp, Homo sapiens
ttactcattaaaaataatag

SEQ ID NO: 582296 - DNA, 21 bp, Homo sapiens
tctctcccacttcctcctacc

SEQ ID NO: 582297 - DNA, 22 bp, Homo sapiens
tctctcccacttcctcctacct

SEQ ID NO: 582298 - DNA, 15 bp, Homo sapiens
tctctcctttctccc

SEQ ID NO: 582299 - DNA, 13 bp, Homo sapiens
tctctgccctggg

SEQ ID NO: 582300 - DNA, 21 bp, Homo sapiens
tctctgccctgggctcctctt

SEQ ID NO: 582301 - DNA, 14 bp, Homo sapiens
tctctgcctctctt

SEQ ID NO: 582302 - DNA, 17 bp, Homo sapiens
tctctgtcgtggagcca

SEQ ID NO: 582303 - DNA, 14 bp, Homo sapiens
tctcttcttcccct

SEQ ID NO: 582304 - DNA, 15 bp, Homo sapiens
tctgaaaagtgtgta

SEQ ID NO: 582305 - DNA, 15 bp, Homo sapiens
tctgcactcagaaaa

SEQ ID NO: 582306 - DNA, 16 bp, Homo sapiens
tctgcactcagaaaat

SEQ ID NO: 582307 - DNA, 22 bp, Homo sapiens
tctgcagaataaaatctctatt

SEQ ID NO: 582308 - DNA, 14 bp, Homo sapiens
tctgccaatctgta

SEQ ID NO: 582309 - DNA, 15 bp, Homo sapiens
tctgccaatctgtac

SEQ ID NO: 582310 - DNA, 22 bp, Homo sapiens
tctgcctctcttcttccccttt

SEQ ID NO: 582311 - DNA, 13 bp, Homo sapiens
tctgcctgctcca

SEQ ID NO: 582312 - DNA, 13 bp, Homo sapiens
tctgctggatatt

SEQ ID NO: 582313 - DNA, 16 bp, Homo sapiens
tctggatgtctggctc

SEQ ID NO: 582314 - DNA, 14 bp, Homo sapiens
tctggctttaagcc

SEQ ID NO: 582315 - DNA, 17 bp, Homo sapiens
tctggctttaagccttc

SEQ ID NO: 582316 - DNA, 14 bp, Homo sapiens
tctgggtccaggga

SEQ ID NO: 582317 - DNA, 20 bp, Homo sapiens
tctggtcaagggctgtcatt

SEQ ID NO: 582318 - DNA, 15 bp, Homo sapiens
tctgtagagccaatt

SEQ ID NO: 582319 - DNA, 21 bp, Homo sapiens
tctgtgagggtgctgactggc

SEQ ID NO: 582320 - DNA, 20 bp, Homo sapiens
tctgtgtaaccagctcagtg

SEQ ID NO: 582321 - DNA, 21 bp, Homo sapiens
tctgttatgggcttttgggga

SEQ ID NO: 582322 - DNA, 12 bp, Homo sapiens
tcttaaactaaa

SEQ ID NO: 582323 - DNA, 14 bp, Homo sapiens
tcttatttatagaa

SEQ ID NO: 582324 - DNA, 18 bp, Homo sapiens
tcttcatgcctgatgaaa

SEQ ID NO: 582325 - DNA, 17 bp, Homo sapiens
tcttcccatgcattctg

SEQ ID NO: 582326 - DNA, 13 bp, Homo sapiens
tcttctgcctccc

SEQ ID NO: 582327 - DNA, 15 bp, Homo sapiens
tcttgccatcctgat

SEQ ID NO: 582328 - DNA, 17 bp, Homo sapiens
tcttgccatcctgatgg

SEQ ID NO: 582329 - DNA, 20 bp, Homo sapiens
tcttgcttggggaacttgtg

SEQ ID NO: 582330 - DNA, 16 bp, Homo sapiens
tcttgtctgatttctt

SEQ ID NO: 582331 - DNA, 16 bp, Homo sapiens
tctttatatttcaata

SEQ ID NO: 582332 - DNA, 21 bp, Homo sapiens
tctttgacaattgggagctgc

SEQ ID NO: 582333 - DNA, 15 bp, Homo sapiens
tctttgcaatactgc

SEQ ID NO: 582334 - DNA, 13 bp, Homo sapiens
tcttttaaagacc

SEQ ID NO: 582335 - DNA, 12 bp, Homo sapiens
tcttttctttac

SEQ ID NO: 582336 - DNA, 12 bp, Homo sapiens
tcttttgtttgg

SEQ ID NO: 582337 - DNA, 16 bp, Homo sapiens
tcttttgtttggtaaa

SEQ ID NO: 582338 - DNA, 18 bp, Homo sapiens
tcttttttagtgttaaag

SEQ ID NO: 582339 - DNA, 16 bp, Homo sapiens
tgaaaaaaaacagtgg

SEQ ID NO: 582340 - DNA, 13 bp, Homo sapiens
tgaaaaatataaa

SEQ ID NO: 582341 - DNA, 17 bp, Homo sapiens
tgaaaaatataaaatta

SEQ ID NO: 582342 - DNA, 22 bp, Homo sapiens
tgaaaaatataaaattatgaga

SEQ ID NO: 582343 - DNA, 19 bp, Homo sapiens
tgaaaagggtcagaaggat

SEQ ID NO: 582344 - DNA, 20 bp, Homo sapiens
tgaaaagggtgttgggaggg

SEQ ID NO: 582345 - DNA, 21 bp, Homo sapiens
tgaaaagtatattgataacct

SEQ ID NO: 582346 - DNA, 19 bp, Homo sapiens
tgaaaagtgtgtatatatt

SEQ ID NO: 582347 - DNA, 13 bp, Homo sapiens
tgaaaataccatt

SEQ ID NO: 582348 - DNA, 18 bp, Homo sapiens
tgaaacatgggctgtgat

SEQ ID NO: 582349 - DNA, 15 bp, Homo sapiens
tgaaacctgatgtca

SEQ ID NO: 582350 - DNA, 18 bp, Homo sapiens
tgaaactcatagacactg

SEQ ID NO: 582351 - DNA, 14 bp, Homo sapiens
tgaaacttctcagt

SEQ ID NO: 582352 - DNA, 15 bp, Homo sapiens
tgaaacttctcagtc

SEQ ID NO: 582353 - DNA, 19 bp, Homo sapiens
tgaaactttgggaaaacat

SEQ ID NO: 582354 - DNA, 22 bp, Homo sapiens
tgaaactttgggaaaacatgtt

SEQ ID NO: 582355 - DNA, 23 bp, Homo sapiens
tgaaactttgggaaaacatgtta

SEQ ID NO: 582356 - DNA, 22 bp, Homo sapiens
tgaaagaaaattgagttgcact

SEQ ID NO: 582357 - DNA, 15 bp, Homo sapiens
tgaaagctactcata

SEQ ID NO: 582358 - DNA, 16 bp, Homo sapiens
tgaaagctgatttttt

SEQ ID NO: 582359 - DNA, 23 bp, Homo sapiens
tgaaataatgggattagaaacaa

SEQ ID NO: 582360 - DNA, 18 bp, Homo sapiens
tgaaatcttcccatgcat

SEQ ID NO: 582361 - DNA, 22 bp, Homo sapiens
tgaaatcttcccatgcattctg

SEQ ID NO: 582362 - DNA, 15 bp, Homo sapiens
tgaaatgaactttgt

SEQ ID NO: 582363 - DNA, 22 bp, Homo sapiens
tgaaatgaactttgtcagtgtt

SEQ ID NO: 582364 - DNA, 16 bp, Homo sapiens
tgaaattgcatacttt

SEQ ID NO: 582365 - DNA, 17 bp, Homo sapiens
tgaacagctgtgagcca

SEQ ID NO: 582366 - DNA, 23 bp, Homo sapiens
tgaacagctgtgagccatgcctc

SEQ ID NO: 582367 - DNA, 15 bp, Homo sapiens
tgaacataacttctc

SEQ ID NO: 582368 - DNA, 21 bp, Homo sapiens
tgaaccaggccagagcaaaca

SEQ ID NO: 582369 - DNA, 21 bp, Homo sapiens
tgaaccataaattcaactttg

SEQ ID NO: 582370 - DNA, 16 bp, Homo sapiens
tgaacccacacctggg

SEQ ID NO: 582371 - DNA, 21 bp, Homo sapiens
tgaacctgaaaagggtcagaa

SEQ ID NO: 582372 - DNA, 17 bp, Homo sapiens
tgaactaggctgagcaa

SEQ ID NO: 582373 - DNA, 18 bp, Homo sapiens
tgaactaggctgagcaat

SEQ ID NO: 582374 - DNA, 12 bp, Homo sapiens
tgaactttggaa

SEQ ID NO: 582375 - DNA, 13 bp, Homo sapiens
tgaactttgtgct

SEQ ID NO: 582376 - DNA, 16 bp, Homo sapiens
tgaagatctttatatt

SEQ ID NO: 582377 - DNA, 21 bp, Homo sapiens
tgaagatctttatatttcaat

SEQ ID NO: 582378 - DNA, 22 bp, Homo sapiens
tgaagcatagataatattgttt

SEQ ID NO: 582379 - DNA, 17 bp, Homo sapiens
tgaagtctgagggaaac

SEQ ID NO: 582380 - DNA, 18 bp, Homo sapiens
tgaagtttggagatagat

SEQ ID NO: 582381 - DNA, 13 bp, Homo sapiens
tgaataggttccc

SEQ ID NO: 582382 - DNA, 13 bp, Homo sapiens
tgaatgaaacatg

SEQ ID NO: 582383 - DNA, 14 bp, Homo sapiens
tgaatgtccaaaat

SEQ ID NO: 582384 - DNA, 12 bp, Homo sapiens
tgaatgtgtgag

SEQ ID NO: 582385 - DNA, 16 bp, Homo sapiens
tgaatgtgtgagaaaa

SEQ ID NO: 582386 - DNA, 18 bp, Homo sapiens
tgaatgtgtgagaaaaac

SEQ ID NO: 582387 - DNA, 15 bp, Homo sapiens
tgaatttgtatatga

SEQ ID NO: 582388 - DNA, 21 bp, Homo sapiens
tgacaagctgtatcactgcct

SEQ ID NO: 582389 - DNA, 24 bp, Homo sapiens
tgacaatattccagatctttcaga

SEQ ID NO: 582390 - DNA, 12 bp, Homo sapiens
tgacaatcaaag

SEQ ID NO: 582391 - DNA, 15 bp, Homo sapiens
tgacactgtttcctg

SEQ ID NO: 582392 - DNA, 17 bp, Homo sapiens
tgacactgtttcctgat

SEQ ID NO: 582393 - DNA, 14 bp, Homo sapiens
tgacaggttttcca

SEQ ID NO: 582394 - DNA, 22 bp, Homo sapiens
tgacaggttttccaaaagtaaa

SEQ ID NO: 582395 - DNA, 14 bp, Homo sapiens
tgacagtgttttta

SEQ ID NO: 582396 - DNA, 18 bp, Homo sapiens
tgacagttcccagagtgg

SEQ ID NO: 582397 - DNA, 15 bp, Homo sapiens
tgacagtttttgaca

SEQ ID NO: 582398 - DNA, 13 bp, Homo sapiens
tgacatttatatt

SEQ ID NO: 582399 - DNA, 13 bp, Homo sapiens
tgacatttcttct

SEQ ID NO: 582400 - DNA, 21 bp, Homo sapiens
tgactaactcaaatacacatt

SEQ ID NO: 582401 - DNA, 22 bp, Homo sapiens
tgactaactcaaatacacattt

SEQ ID NO: 582402 - DNA, 18 bp, Homo sapiens
tgactcagcatcacccac

SEQ ID NO: 582403 - DNA, 22 bp, Homo sapiens
tgactcttatttatagaattta

SEQ ID NO: 582404 - DNA, 19 bp, Homo sapiens
tgactgagcaagaccctgt

SEQ ID NO: 582405 - DNA, 16 bp, Homo sapiens
tgacttttataaagca

SEQ ID NO: 582406 - DNA, 20 bp, Homo sapiens
tgagagccctgaggcctaga

SEQ ID NO: 582407 - DNA, 20 bp, Homo sapiens
tgagaggaggacttggttga

SEQ ID NO: 582408 - DNA, 23 bp, Homo sapiens
tgcagcagtcgcccaagcagaca

SEQ ID NO: 582409 - DNA, 23 bp, Homo sapiens
tgcagccttttctggtccctctt

SEQ ID NO: 582410 - DNA, 16 bp, Homo sapiens
tgcagcggctcctgca

SEQ ID NO: 582411 - DNA, 14 bp, Homo sapiens
tgcagctttgcaaa

SEQ ID NO: 582412 - DNA, 14 bp, Homo sapiens
tgcaggcaggaaca

SEQ ID NO: 582413 - DNA, 20 bp, Homo sapiens
tgcaggcaggaacaaacagg

SEQ ID NO: 582414 - DNA, 16 bp, Homo sapiens
tgcatagtcccagcta

SEQ ID NO: 582415 - DNA, 15 bp, Homo sapiens
tgcatgcaaatgagc

SEQ ID NO: 582416 - DNA, 18 bp, Homo sapiens
tgcatgcatgcaaatgag

SEQ ID NO: 582417 - DNA, 17 bp, Homo sapiens
tgcatggattcagcatg

SEQ ID NO: 582418 - DNA, 21 bp, Homo sapiens
tgcatggattcagcatgtcca

SEQ ID NO: 582419 - DNA, 12 bp, Homo sapiens
tgcatttaataa

SEQ ID NO: 582420 - DNA, 14 bp, Homo sapiens
tgcatttaataaag

SEQ ID NO: 582421 - DNA, 23 bp, Homo sapiens
tgcatttaataaagatgagttgg

SEQ ID NO: 582422 - DNA, 19 bp, Homo sapiens
tgcattttgatattgctgt

SEQ ID NO: 582423 - DNA, 21 bp, Homo sapiens
tgccaagagctactcccacag

SEQ ID NO: 582424 - DNA, 22 bp, Homo sapiens
tgccaagagctactcccacagc

SEQ ID NO: 582425 - DNA, 17 bp, Homo sapiens
tgccaagagtgaaggga

SEQ ID NO: 582426 - DNA, 19 bp, Homo sapiens
tgccagccccctaaaagca

SEQ ID NO: 582427 - DNA, 21 bp, Homo sapiens
tgccagctgcagcctggttgg

SEQ ID NO: 582428 - DNA, 22 bp, Homo sapiens
tgccatcctgatggacctgccc

SEQ ID NO: 582429 - DNA, 19 bp, Homo sapiens
tgccatgggtgcagaccct

SEQ ID NO: 582430 - DNA, 22 bp, Homo sapiens
tgccattacagaggtattaaaa

SEQ ID NO: 582431 - DNA, 19 bp, Homo sapiens
tgccattggggtagttgtg

SEQ ID NO: 582432 - DNA, 19 bp, Homo sapiens
tgccccagggatgggaggt

SEQ ID NO: 582433 - DNA, 20 bp, Homo sapiens
tgccccctgcttggccagga

SEQ ID NO: 582434 - DNA, 12 bp, Homo sapiens
tgccctgggctc

SEQ ID NO: 582435 - DNA, 13 bp, Homo sapiens
tgccctttcctgg

SEQ ID NO: 582436 - DNA, 17 bp, Homo sapiens
tgcctatagtcccagct

SEQ ID NO: 582437 - DNA, 18 bp, Homo sapiens
tgcctatagtcccagcta

SEQ ID NO: 582438 - DNA, 20 bp, Homo sapiens
tgcctcagtagcatctcagt

SEQ ID NO: 582439 - DNA, 18 bp, Homo sapiens
tgcctccctgggccacct

SEQ ID NO: 582440 - DNA, 11 bp, Homo sapiens
tgcctcctcat

SEQ ID NO: 582441 - DNA, 13 bp, Homo sapiens
tgcctgctccatc

SEQ ID NO: 582442 - DNA, 17 bp, Homo sapiens
tgcctggggcggcatga

SEQ ID NO: 582443 - DNA, 19 bp, Homo sapiens
tgcctgtgagcatggggcc

SEQ ID NO: 582444 - DNA, 16 bp, Homo sapiens
tgcgggcacaataaat

SEQ ID NO: 582445 - DNA, 17 bp, Homo sapiens
tgcgggcacaataaatc

SEQ ID NO: 582446 - DNA, 15 bp, Homo sapiens
tgcgtttgcctcctg

SEQ ID NO: 582447 - DNA, 20 bp, Homo sapiens
tgcgttttctccgggtcctc

SEQ ID NO: 582448 - DNA, 13 bp, Homo sapiens
tgctaaatgtgta

SEQ ID NO: 582449 - DNA, 14 bp, Homo sapiens
tgctaaatgtgtaa

SEQ ID NO: 582450 - DNA, 15 bp, Homo sapiens
tgctaaatgtgtaat

SEQ ID NO: 582451 - DNA, 14 bp, Homo sapiens
tgctacaattttaa

SEQ ID NO: 582452 - DNA, 23 bp, Homo sapiens
tgctactgttgtaagaattctga

SEQ ID NO: 582453 - DNA, 12 bp, Homo sapiens
tgctacttccca

SEQ ID NO: 582454 - DNA, 21 bp, Homo sapiens
tgctagggttaggaggtcctt

SEQ ID NO: 582455 - DNA, 18 bp, Homo sapiens
tgctccaatgactgagca

SEQ ID NO: 582456 - DNA, 18 bp, Homo sapiens
tgctgactggcttcagca

SEQ ID NO: 582457 - DNA, 22 bp, Homo sapiens
tgctgcacacactcacctctaa

SEQ ID NO: 582458 - DNA, 17 bp, Homo sapiens
tgctgggtcccagcctg

SEQ ID NO: 582459 - DNA, 17 bp, Homo sapiens
tgggggagattgaactt

SEQ ID NO: 582460 - DNA, 15 bp, Homo sapiens
tggggggcattgagt

SEQ ID NO: 582461 - DNA, 15 bp, Homo sapiens
tggggtcggctcctg

SEQ ID NO: 582462 - DNA, 17 bp, Homo sapiens
tgggtcatttagaagcc

SEQ ID NO: 582463 - DNA, 16 bp, Homo sapiens
tgggtgccctttcctg

SEQ ID NO: 582464 - DNA, 23 bp, Homo sapiens
tggtaatcccctaaaataacagt

SEQ ID NO: 582465 - DNA, 12 bp, Homo sapiens
tggtctgccaat

SEQ ID NO: 582466 - DNA, 18 bp, Homo sapiens
tggtctggttcctgtgtg

SEQ ID NO: 582467 - DNA, 14 bp, Homo sapiens
tggtgatttgaaaa

SEQ ID NO: 582468 - DNA, 22 bp, Homo sapiens
tggtgatttgaaaaatataaaa

SEQ ID NO: 582469 - DNA, 19 bp, Homo sapiens
tggtgcgggcacaataaat

SEQ ID NO: 582470 - DNA, 17 bp, Homo sapiens
tggtgtcattctgcctg

SEQ ID NO: 582471 - DNA, 18 bp, Homo sapiens
tggtgtcattctgcctgc

SEQ ID NO: 582472 - DNA, 21 bp, Homo sapiens
tggtgtcccctatcctcccct

SEQ ID NO: 582473 - DNA, 15 bp, Homo sapiens
tggttgatgtttaaa

SEQ ID NO: 582474 - DNA, 18 bp, Homo sapiens
tggttgatgtttaaagag

SEQ ID NO: 582475 - DNA, 21 bp, Homo sapiens
tggtttgcaaagaccacctcc

SEQ ID NO: 582476 - DNA, 22 bp, Homo sapiens
tggtttgcaaagaccacctcca

SEQ ID NO: 582477 - DNA, 12 bp, Homo sapiens
tgtaaaaatctt

SEQ ID NO: 582478 - DNA, 13 bp, Homo sapiens
tgtaaataactct

SEQ ID NO: 582479 - DNA, 17 bp, Homo sapiens
tgtaaataatttgcact

SEQ ID NO: 582480 - DNA, 19 bp, Homo sapiens
tgtaaataatttgcactga

SEQ ID NO: 582481 - DNA, 16 bp, Homo sapiens
tgtaacatgatttccc

SEQ ID NO: 582482 - DNA, 16 bp, Homo sapiens
tgtaaccagctcagtg

SEQ ID NO: 582483 - DNA, 19 bp, Homo sapiens
tgtaaggatccggaaagaa

SEQ ID NO: 582484 - DNA, 21 bp, Homo sapiens
tgtaataatgtaacatgattt

SEQ ID NO: 582485 - DNA, 20 bp, Homo sapiens
tgtaatagggaaaattctaa

SEQ ID NO: 582486 - DNA, 13 bp, Homo sapiens
tgtaatctcaatg

SEQ ID NO: 582487 - DNA, 19 bp, Homo sapiens
tgtaatctcaatgcaagcc

SEQ ID NO: 582488 - DNA, 21 bp, Homo sapiens
tgtacaaaaattatgcaattc

SEQ ID NO: 582489 - DNA, 14 bp, Homo sapiens
tgtacagattcttt

SEQ ID NO: 582490 - DNA, 22 bp, Homo sapiens
tgtacttccctcttgaaacctg

SEQ ID NO: 582491 - DNA, 23 bp, Homo sapiens
tgtagctattagcggctcctcgc

SEQ ID NO: 582492 - DNA, 18 bp, Homo sapiens
tgtataaaagtgtgaaat

SEQ ID NO: 582493 - DNA, 14 bp, Homo sapiens
tgtataaatataca

SEQ ID NO: 582494 - DNA, 17 bp, Homo sapiens
tgtatatatgtatttct

SEQ ID NO: 582495 - DNA, 19 bp, Homo sapiens
tgtatatatgtatttctat

SEQ ID NO: 582496 - DNA, 15 bp, Homo sapiens
tgtatatgactgcat

SEQ ID NO: 582497 - DNA, 17 bp, Homo sapiens
tgtatatgactgcattt

SEQ ID NO: 582498 - DNA, 19 bp, Homo sapiens
tgtatattacccaatggaa

SEQ ID NO: 582499 - DNA, 14 bp, Homo sapiens
tgtatctgctggat

SEQ ID NO: 582500 - DNA, 21 bp, Homo sapiens
tgtatgggggagattgaactt

SEQ ID NO: 582501 - DNA, 22 bp, Homo sapiens
tgtatgggggagattgaacttt

SEQ ID NO: 582502 - DNA, 23 bp, Homo sapiens
tgtatgggggagattgaactttc

SEQ ID NO: 582503 - DNA, 19 bp, Homo sapiens
tgtattcttttctcagtgt

SEQ ID NO: 582504 - DNA, 19 bp, Homo sapiens
tgtattgatcaatgcatgt

SEQ ID NO: 582505 - DNA, 15 bp, Homo sapiens
tgtatttgagcatat

SEQ ID NO: 582506 - DNA, 14 bp, Homo sapiens
tgtattttgattat

SEQ ID NO: 582507 - DNA, 21 bp, Homo sapiens
tgtatttttgtgaagtattca

SEQ ID NO: 582508 - DNA, 21 bp, Homo sapiens
tgtcacatctatccacactgt

SEQ ID NO: 582509 - DNA, 16 bp, Homo sapiens
tgtcagctgctgttga

SEQ ID NO: 582510 - DNA, 18 bp, Homo sapiens
tgtcagctgctgttgaac

SEQ ID NO: 582511 - DNA, 13 bp, Homo sapiens
tgtcattctgcct

SEQ ID NO: 582512 - DNA, 15 bp, Homo sapiens
tgtcattctgcctgc

SEQ ID NO: 582513 - DNA, 17 bp, Homo sapiens
tgttgcactgccccctg

SEQ ID NO: 582514 - DNA, 14 bp, Homo sapiens
tgttgctcagaagt

SEQ ID NO: 582515 - DNA, 13 bp, Homo sapiens
tgttgtaaataaa

SEQ ID NO: 582516 - DNA, 16 bp, Homo sapiens
tgttgtaagaattctg

SEQ ID NO: 582517 - DNA, 18 bp, Homo sapiens
tgttgtaagaattctgat

SEQ ID NO: 582518 - DNA, 20 bp, Homo sapiens
tgtttaaaatgtaatttaaa

SEQ ID NO: 582519 - DNA, 21 bp, Homo sapiens
tgtttacaaaaatttctgtaa

SEQ ID NO: 582520 - DNA, 15 bp, Homo sapiens
tgtttacctttctct

SEQ ID NO: 582521 - DNA, 23 bp, Homo sapiens
tgtttagattgtattaactatct

SEQ ID NO: 582522 - DNA, 23 bp, Homo sapiens
tgtttccttttggcctcctgcaa

SEQ ID NO: 582523 - DNA, 15 bp, Homo sapiens
tgtttcttttgtttg

SEQ ID NO: 582524 - DNA, 18 bp, Homo sapiens
tgtttcttttgtttggta

SEQ ID NO: 582525 - DNA, 21 bp, Homo sapiens
tgtttcttttgtttggtaaat

SEQ ID NO: 582526 - DNA, 12 bp, Homo sapiens
tgtttggtaaat

SEQ ID NO: 582527 - DNA, 19 bp, Homo sapiens
tgttttaaaacgtgtaaat

SEQ ID NO: 582528 - DNA, 18 bp, Homo sapiens
tgttttgcacagccaaat

SEQ ID NO: 582529 - DNA, 20 bp, Homo sapiens
tgttttggtggaaaaaacat

SEQ ID NO: 582530 - DNA, 12 bp, Homo sapiens
ttaaaaaacaat

SEQ ID NO: 582531 - DNA, 13 bp, Homo sapiens
ttaaaactaaatt

SEQ ID NO: 582532 - DNA, 16 bp, Homo sapiens
ttaaaactaaatttca

SEQ ID NO: 582533 - DNA, 19 bp, Homo sapiens
ttaaaaggtactggtacta

SEQ ID NO: 582534 - DNA, 11 bp, Homo sapiens
ttaaaatgtaa

SEQ ID NO: 582535 - DNA, 21 bp, Homo sapiens
ttaaaatgtaatttaaatgaa

SEQ ID NO: 582536 - DNA, 16 bp, Homo sapiens
ttaaaattttgtatgt

SEQ ID NO: 582537 - DNA, 13 bp, Homo sapiens
ttaaagagataaa

SEQ ID NO: 582538 - DNA, 12 bp, Homo sapiens
ttaaatgaaaga

SEQ ID NO: 582539 - DNA, 16 bp, Homo sapiens
ttaaatgaaagaaaat

SEQ ID NO: 582540 - DNA, 15 bp, Homo sapiens
ttaaatttaatacca

SEQ ID NO: 582541 - DNA, 21 bp, Homo sapiens
ttaaccggtaagagtttcagt

SEQ ID NO: 582542 - DNA, 19 bp, Homo sapiens
ttaactgccgtaatttaac

SEQ ID NO: 582543 - DNA, 15 bp, Homo sapiens
ttaagaccagcctgg

SEQ ID NO: 582544 - DNA, 18 bp, Homo sapiens
ttaaggcccaacattaaa

SEQ ID NO: 582545 - DNA, 14 bp, Homo sapiens
ttaatagatttggg

SEQ ID NO: 582546 - DNA, 18 bp, Homo sapiens
ttaatccagttataagaa

SEQ ID NO: 582547 - DNA, 18 bp, Homo sapiens
ttaatcttcaaagccttc

SEQ ID NO: 582548 - DNA, 20 bp, Homo sapiens
ttaatcttcaaagccttctc

SEQ ID NO: 582549 - DNA, 22 bp, Homo sapiens
ttaatgccatctagctagcaat

SEQ ID NO: 582550 - DNA, 15 bp, Homo sapiens
ttaatgttttcaaaa

SEQ ID NO: 582551 - DNA, 16 bp, Homo sapiens
ttaatgttttcaaaag

SEQ ID NO: 582552 - DNA, 12 bp, Homo sapiens
ttaatttaactt

SEQ ID NO: 582553 - DNA, 16 bp, Homo sapiens
ttaattttaaagtgca

SEQ ID NO: 582554 - DNA, 17 bp, Homo sapiens
ttacaataggagtggtg

SEQ ID NO: 582555 - DNA, 14 bp, Homo sapiens
ttacctttctctct

SEQ ID NO: 582556 - DNA, 18 bp, Homo sapiens
ttactttagaagcctgca

SEQ ID NO: 582557 - DNA, 21 bp, Homo sapiens
ttactttggggctaatttaac

SEQ ID NO: 582558 - DNA, 21 bp, Homo sapiens
ttagaaacaaacaaaactctt

SEQ ID NO: 582559 - DNA, 13 bp, Homo sapiens
ttagaagcctgca

SEQ ID NO: 582560 - DNA, 11 bp, Homo sapiens
ttagcatggta

SEQ ID NO: 582561 - DNA, 15 bp, Homo sapiens
ttagcggctcctcgc

SEQ ID NO: 582562 - DNA, 21 bp, Homo sapiens
ttagcggctcctcgcccccac

SEQ ID NO: 582563 - DNA, 14 bp, Homo sapiens
ttaggcctctgaga

SEQ ID NO: 582564 - DNA, 19 bp, Homo sapiens
ttagtgaattaaatttagt

SEQ ID NO: 582565 - DNA, 19 bp, Homo sapiens
ttagtttttggttgggaat

SEQ ID NO: 582566 - DNA, 21 bp, Homo sapiens
ttataagaagaagttcatgtc

SEQ ID NO: 582567 - DNA, 21 bp, Homo sapiens
ttataatactactactgttat

SEQ ID NO: 582568 - DNA, 18 bp, Homo sapiens
ttatacatcaatatgtat

SEQ ID NO: 582569 - DNA, 19 bp, Homo sapiens
ttatacatcaatatgtata

SEQ ID NO: 582570 - DNA, 19 bp, Homo sapiens
ttatattactgacatttct

SEQ ID NO: 582571 - DNA, 13 bp, Homo sapiens
ttatatttcaata

SEQ ID NO: 582572 - DNA, 12 bp, Homo sapiens
ttgttgcactgc

SEQ ID NO: 582573 - DNA, 12 bp, Homo sapiens
ttgttgtactta

SEQ ID NO: 582574 - DNA, 14 bp, Homo sapiens
ttgttgtacttaaa

SEQ ID NO: 582575 - DNA, 17 bp, Homo sapiens
ttgtttggtaaatgttt

SEQ ID NO: 582576 - DNA, 18 bp, Homo sapiens
tttaaaatgtaatttaaa

SEQ ID NO: 582577 - DNA, 10 bp, Homo sapiens
tttaaaattt

SEQ ID NO: 582578 - DNA, 12 bp, Homo sapiens
tttaaagagaag

SEQ ID NO: 582579 - DNA, 12 bp, Homo sapiens
tttaaattgtgt

SEQ ID NO: 582580 - DNA, 12 bp, Homo sapiens
tttaagaaaaaa

SEQ ID NO: 582581 - DNA, 14 bp, Homo sapiens
tttaagaaatagaa

SEQ ID NO: 582582 - DNA, 15 bp, Homo sapiens
tttacttgttttgga

SEQ ID NO: 582583 - DNA, 16 bp, Homo sapiens
tttataaacagaaatg

SEQ ID NO: 582584 - DNA, 12 bp, Homo sapiens
tttatatgcttt

SEQ ID NO: 582585 - DNA, 20 bp, Homo sapiens
tttatattttagaaataata

SEQ ID NO: 582586 - DNA, 18 bp, Homo sapiens
tttatgatgacaatcaaa

SEQ ID NO: 582587 - DNA, 12 bp, Homo sapiens
tttattaatgtt

SEQ ID NO: 582588 - DNA, 21 bp, Homo sapiens
tttcaaaaggtattatacatg

SEQ ID NO: 582589 - DNA, 22 bp, Homo sapiens
tttcaaaatatattttcagtac

SEQ ID NO: 582590 - DNA, 21 bp, Homo sapiens
tttcaaagttttgttgtactt

SEQ ID NO: 582591 - DNA, 23 bp, Homo sapiens
tttcaacggaaagtgctgtctta

SEQ ID NO: 582592 - DNA, 22 bp, Homo sapiens
tttcaatcgtaaaatttcccat

SEQ ID NO: 582593 - DNA, 13 bp, Homo sapiens
tttcagaaatata

SEQ ID NO: 582594 - DNA, 15 bp, Homo sapiens
tttccctactcccca

SEQ ID NO: 582595 - DNA, 15 bp, Homo sapiens
tttcctgataataaa

SEQ ID NO: 582596 - DNA, 16 bp, Homo sapiens
tttcgtaacacagcat

SEQ ID NO: 582597 - DNA, 17 bp, Homo sapiens
tttctcctccccacctg

SEQ ID NO: 582598 - DNA, 20 bp, Homo sapiens
tttctcctccccacctgtag

SEQ ID NO: 582599 - DNA, 15 bp, Homo sapiens
tttctggtccctctt

SEQ ID NO: 582600 - DNA, 13 bp, Homo sapiens
tttgaaaaatata

SEQ ID NO: 582601 - DNA, 11 bp, Homo sapiens
tttgaactttg

SEQ ID NO: 582602 - DNA, 11 bp, Homo sapiens
aaagagaaaga

SEQ ID NO: 582603 - DNA, 12 bp, Homo sapiens
aaagagaaagag

SEQ ID NO: 582604 - DNA, 15 bp, Homo sapiens
aaagagaaagagttt

SEQ ID NO: 582605 - DNA, 23 bp, Homo sapiens
aaagatgcatcatctcttcctca

SEQ ID NO: 582606 - DNA, 16 bp, Homo sapiens
aaagatgcgtttgcct

SEQ ID NO: 582607 - DNA, 19 bp, Homo sapiens
aaagatgcgtttgcctcct

SEQ ID NO: 582608 - DNA, 21 bp, Homo sapiens
aaagcaaacttaagaaacact

SEQ ID NO: 582609 - DNA, 12 bp, Homo sapiens
aaagcagcagga

SEQ ID NO: 582610 - DNA, 12 bp, Homo sapiens
aaagcctgctca

SEQ ID NO: 582611 - DNA, 16 bp, Homo sapiens
aaaggtaatgtgtgga

SEQ ID NO: 582612 - DNA, 13 bp, Homo sapiens
aaagtacttgact

SEQ ID NO: 582613 - DNA, 21 bp, Homo sapiens
aaagtacttgactacctactg

SEQ ID NO: 582614 - DNA, 19 bp, Homo sapiens
aaagtctccagaagaaaat

SEQ ID NO: 582615 - DNA, 17 bp, Homo sapiens
aaagtgggcttaatgga

SEQ ID NO: 582616 - DNA, 23 bp, Homo sapiens
aaagtgtgtatatattttgtgtg

SEQ ID NO: 582617 - DNA, 23 bp, Homo sapiens
aaagttttgttgtacttaaatgg

SEQ ID NO: 582618 - DNA, 14 bp, Homo sapiens
aaataataaaaaga

SEQ ID NO: 582619 - DNA, 15 bp, Homo sapiens
aaataatttgaactt

SEQ ID NO: 582620 - DNA, 14 bp, Homo sapiens
aaataatttgcact

SEQ ID NO: 582621 - DNA, 15 bp, Homo sapiens
aaatacacatttgct

SEQ ID NO: 582622 - DNA, 20 bp, Homo sapiens
aaatactctgctatttctct

SEQ ID NO: 582623 - DNA, 13 bp, Homo sapiens
aaatataaaatta

SEQ ID NO: 582624 - DNA, 14 bp, Homo sapiens
aaatataacacatt

SEQ ID NO: 582625 - DNA, 17 bp, Homo sapiens
aaatataacacattttt

SEQ ID NO: 582626 - DNA, 13 bp, Homo sapiens
aaatatgaatgaa

SEQ ID NO: 582627 - DNA, 15 bp, Homo sapiens
aaatattgatgaaaa

SEQ ID NO: 582628 - DNA, 15 bp, Homo sapiens
aaatgaaagaaaatt

SEQ ID NO: 582629 - DNA, 11 bp, Homo sapiens
aaatgaacttt

SEQ ID NO: 582630 - DNA, 12 bp, Homo sapiens
aaatgaactttg

SEQ ID NO: 582631 - DNA, 18 bp, Homo sapiens
aaatgaagatctttatat

SEQ ID NO: 582632 - DNA, 20 bp, Homo sapiens
aaatgctcccacctgaattt

SEQ ID NO: 582633 - DNA, 22 bp, Homo sapiens
aaatggtcctatttttgtgaag

SEQ ID NO: 582634 - DNA, 23 bp, Homo sapiens
aaatggtcctatttttgtgaaga

SEQ ID NO: 582635 - DNA, 13 bp, Homo sapiens
aaatgtaatttaa

SEQ ID NO: 582636 - DNA, 18 bp, Homo sapiens
aaatgtaatttaaatgaa

SEQ ID NO: 582637 - DNA, 16 bp, Homo sapiens
aaatgtataaatatac

SEQ ID NO: 582638 - DNA, 13 bp, Homo sapiens
aaatgtgactcag

SEQ ID NO: 582639 - DNA, 23 bp, Homo sapiens
aaatgtggtctgccaatctgtac

SEQ ID NO: 582640 - DNA, 11 bp, Homo sapiens
aaatgtttctt

SEQ ID NO: 582641 - DNA, 14 bp, Homo sapiens
aaatgtttcttttg

SEQ ID NO: 582642 - DNA, 16 bp, Homo sapiens
aaattaagcaaatgtt

SEQ ID NO: 582643 - DNA, 17 bp, Homo sapiens
aaattaagcaaatgtta

SEQ ID NO: 582644 - DNA, 15 bp, Homo sapiens
aaattacctgtggat

SEQ ID NO: 582645 - DNA, 18 bp, Homo sapiens
aaattacctgtggatatt

SEQ ID NO: 582646 - DNA, 15 bp, Homo sapiens
aaattcaactttgta

SEQ ID NO: 582647 - DNA, 14 bp, Homo sapiens
aaattgcatacttt

SEQ ID NO: 582648 - DNA, 11 bp, Homo sapiens
aacaaagaaac

SEQ ID NO: 582649 - DNA, 19 bp, Homo sapiens
aacaaataatttgaacttt

SEQ ID NO: 582650 - DNA, 17 bp, Homo sapiens
aacaatccttactaagt

SEQ ID NO: 582651 - DNA, 13 bp, Homo sapiens
aacaatctttgct

SEQ ID NO: 582652 - DNA, 16 bp, Homo sapiens
aacaatggtgtggtga

SEQ ID NO: 582653 - DNA, 13 bp, Homo sapiens
aacaattaactgc

SEQ ID NO: 582654 - DNA, 21 bp, Homo sapiens
aacaattaactgccctctgaa

SEQ ID NO: 582655 - DNA, 19 bp, Homo sapiens
aacacattcttattgacaa

SEQ ID NO: 582656 - DNA, 23 bp, Homo sapiens
aacactagggccttggaaattcc

SEQ ID NO: 582657 - DNA, 22 bp, Homo sapiens
aacactatttgtgactttttaa

SEQ ID NO: 582658 - DNA, 22 bp, Homo sapiens
aacagctgtgagccatgcctcc

SEQ ID NO: 582659 - DNA, 23 bp, Homo sapiens
aacagctgtgagccatgcctccc

SEQ ID NO: 582660 - DNA, 16 bp, Homo sapiens
aacagggccacataga

SEQ ID NO: 582661 - DNA, 14 bp, Homo sapiens
aacagggctgcctt

SEQ ID NO: 582662 - DNA, 15 bp, Homo sapiens
aacagggttggcatt

SEQ ID NO: 582663 - DNA, 20 bp, Homo sapiens
aacagtatgtgggatattga

SEQ ID NO: 582664 - DNA, 18 bp, Homo sapiens
aacagtcttactgcaggc

SEQ ID NO: 582665 - DNA, 21 bp, Homo sapiens
aacataacttctcatgtatat

SEQ ID NO: 582666 - DNA, 15 bp, Homo sapiens
aacatcatttcaatc

SEQ ID NO: 582667 - DNA, 18 bp, Homo sapiens
aacatctccatggggagg

SEQ ID NO: 582668 - DNA, 19 bp, Homo sapiens
aacatgggctgtgattact

SEQ ID NO: 582669 - DNA, 20 bp, Homo sapiens
aacatgggctgtgattactg

SEQ ID NO: 582670 - DNA, 22 bp, Homo sapiens
aacatggtaattcacttcagtt

SEQ ID NO: 582671 - DNA, 20 bp, Homo sapiens
aacatgttaatgacaatatt

SEQ ID NO: 582672 - DNA, 14 bp, Homo sapiens
aaccacgcaggaag

SEQ ID NO: 582673 - DNA, 15 bp, Homo sapiens
aaccacttgcctggg

SEQ ID NO: 582674 - DNA, 20 bp, Homo sapiens
aaccagcagaaatgccccca

SEQ ID NO: 582675 - DNA, 15 bp, Homo sapiens
aaccatttttgaacc

SEQ ID NO: 582676 - DNA, 16 bp, Homo sapiens
aacccagtttcccgtc

SEQ ID NO: 582677 - DNA, 23 bp, Homo sapiens
aacccattaaggggaagaatgaa

SEQ ID NO: 582678 - DNA, 21 bp, Homo sapiens
aaccctcttgccatcctgatg

SEQ ID NO: 582679 - DNA, 15 bp, Homo sapiens
aacctcaggctccta

SEQ ID NO: 582680 - DNA, 19 bp, Homo sapiens
aacctctttgcgtttcctt

SEQ ID NO: 582681 - DNA, 12 bp, Homo sapiens
aacgctctcctc

SEQ ID NO: 582682 - DNA, 15 bp, Homo sapiens
aacggttcctggtga

SEQ ID NO: 582683 - DNA, 18 bp, Homo sapiens
aactagccaaaccaggac

SEQ ID NO: 582684 - DNA, 21 bp, Homo sapiens
aactagccaaaccaggaccct

SEQ ID NO: 582685 - DNA, 23 bp, Homo sapiens
aactatcttctttggacttctga

SEQ ID NO: 582686 - DNA, 16 bp, Homo sapiens
aactatttattgtgct

SEQ ID NO: 582687 - DNA, 16 bp, Homo sapiens
aactcacacccctgcc

SEQ ID NO: 582688 - DNA, 17 bp, Homo sapiens
aactcacacccctgccc

SEQ ID NO: 582689 - DNA, 21 bp, Homo sapiens
aactctaaccaaggctgtgtt

SEQ ID NO: 582690 - DNA, 17 bp, Homo sapiens
aactgccgtaatttaac

SEQ ID NO: 582691 - DNA, 23 bp, Homo sapiens
aactgtgataatccccacaggca

SEQ ID NO: 582692 - DNA, 18 bp, Homo sapiens
aactgtggatattgttac

SEQ ID NO: 582693 - DNA, 17 bp, Homo sapiens
aactgttgcacttttga

SEQ ID NO: 582694 - DNA, 21 bp, Homo sapiens
aacttaggcatgcacagctgt

SEQ ID NO: 582695 - DNA, 20 bp, Homo sapiens
aacttctgcaacaagcatgc

SEQ ID NO: 582696 - DNA, 16 bp, Homo sapiens
aactttggaacagggt

SEQ ID NO: 582697 - DNA, 18 bp, Homo sapiens
aactttgtaaaaatcttt

SEQ ID NO: 582698 - DNA, 21 bp, Homo sapiens
aactttgtaaaaatcttttga

SEQ ID NO: 582699 - DNA, 14 bp, Homo sapiens
aagaaacaaagatg

SEQ ID NO: 582700 - DNA, 15 bp, Homo sapiens
aagaaacaaagatgt

SEQ ID NO: 582701 - DNA, 12 bp, Homo sapiens
aagaaagcttcc

SEQ ID NO: 582702 - DNA, 15 bp, Homo sapiens
aagaaagcttccttc

SEQ ID NO: 582703 - DNA, 19 bp, Homo sapiens
aagaaataatgctacaatt

SEQ ID NO: 582704 - DNA, 13 bp, Homo sapiens
aagaaatggtgaa

SEQ ID NO: 582705 - DNA, 13 bp, Homo sapiens
aagaagaagttca

SEQ ID NO: 582706 - DNA, 19 bp, Homo sapiens
aagaagagcgagagatcaa

SEQ ID NO: 582707 - DNA, 22 bp, Homo sapiens
aagaagagcgagagatcaaaga

SEQ ID NO: 582708 - DNA, 20 bp, Homo sapiens
aagaattctgattgatttga

SEQ ID NO: 582709 - DNA, 12 bp, Homo sapiens
aagaccacctcc

SEQ ID NO: 582710 - DNA, 21 bp, Homo sapiens
aagacccggttattcgcccac

SEQ ID NO: 582711 - DNA, 13 bp, Homo sapiens
aagaccctgtctc

SEQ ID NO: 582712 - DNA, 21 bp, Homo sapiens
aatgtgtaagaacaactacct

SEQ ID NO: 582713 - DNA, 12 bp, Homo sapiens
aatgtgtgagaa

SEQ ID NO: 582714 - DNA, 13 bp, Homo sapiens
aatgttaaaggga

SEQ ID NO: 582715 - DNA, 17 bp, Homo sapiens
aatgtttcttttgtttg

SEQ ID NO: 582716 - DNA, 18 bp, Homo sapiens
aattaagcaaatgttaaa

SEQ ID NO: 582717 - DNA, 23 bp, Homo sapiens
aattaagcaaatgttaaaagttt

SEQ ID NO: 582718 - DNA, 22 bp, Homo sapiens
aattactttggggctaatttaa

SEQ ID NO: 582719 - DNA, 17 bp, Homo sapiens
aattatatattgcaagg

SEQ ID NO: 582720 - DNA, 21 bp, Homo sapiens
aattatgcaattcagtgttcc

SEQ ID NO: 582721 - DNA, 16 bp, Homo sapiens
aattatgtaaataact

SEQ ID NO: 582722 - DNA, 22 bp, Homo sapiens
aattcaactttgtaaaaatctt

SEQ ID NO: 582723 - DNA, 15 bp, Homo sapiens
aattccagatttgtt

SEQ ID NO: 582724 - DNA, 17 bp, Homo sapiens
aattctaacccaggtat

SEQ ID NO: 582725 - DNA, 15 bp, Homo sapiens
aattctgattgattt

SEQ ID NO: 582726 - DNA, 11 bp, Homo sapiens
aattcttaaaa

SEQ ID NO: 582727 - DNA, 21 bp, Homo sapiens
aattgctcatgcatagtccca

SEQ ID NO: 582728 - DNA, 23 bp, Homo sapiens
aattgctgataccatatgaatga

SEQ ID NO: 582729 - DNA, 18 bp, Homo sapiens
aattgtacaaaattaagc

SEQ ID NO: 582730 - DNA, 19 bp, Homo sapiens
aattgtgtggattctttaa

SEQ ID NO: 582731 - DNA, 14 bp, Homo sapiens
aatttaaaaaataa

SEQ ID NO: 582732 - DNA, 18 bp, Homo sapiens
aatttaaatgaaagaaaa

SEQ ID NO: 582733 - DNA, 19 bp, Homo sapiens
aatttaaatgaaagaaaat

SEQ ID NO: 582734 - DNA, 14 bp, Homo sapiens
aatttgataatgac

SEQ ID NO: 582735 - DNA, 17 bp, Homo sapiens
aatttgtatatgactgc

SEQ ID NO: 582736 - DNA, 16 bp, Homo sapiens
aattttaaagtgcaaa

SEQ ID NO: 582737 - DNA, 16 bp, Homo sapiens
aattttgtatgttaaa

SEQ ID NO: 582738 - DNA, 20 bp, Homo sapiens
aattttgtatgttaaagaga

SEQ ID NO: 582739 - DNA, 14 bp, Homo sapiens
aatttttaactgta

SEQ ID NO: 582740 - DNA, 18 bp, Homo sapiens
aatttttaactgtactga

SEQ ID NO: 582741 - DNA, 17 bp, Homo sapiens
aattttttataaaagtg

SEQ ID NO: 582742 - DNA, 14 bp, Homo sapiens
acaaaaattatgca

SEQ ID NO: 582743 - DNA, 13 bp, Homo sapiens
acaaaactcttaa

SEQ ID NO: 582744 - DNA, 20 bp, Homo sapiens
acaaacagggctgccttctg

SEQ ID NO: 582745 - DNA, 18 bp, Homo sapiens
acaaagaaacaaagatgt

SEQ ID NO: 582746 - DNA, 20 bp, Homo sapiens
acaaagtaaaagtagtgttg

SEQ ID NO: 582747 - DNA, 20 bp, Homo sapiens
acaaatgctcccacctgaat

SEQ ID NO: 582748 - DNA, 19 bp, Homo sapiens
acaaattgactcttattta

SEQ ID NO: 582749 - DNA, 16 bp, Homo sapiens
acaacaggtaaaacag

SEQ ID NO: 582750 - DNA, 16 bp, Homo sapiens
acaactcattttcata

SEQ ID NO: 582751 - DNA, 15 bp, Homo sapiens
acaagtaaaactgtg

SEQ ID NO: 582752 - DNA, 17 bp, Homo sapiens
acaagtgagacaaaaag

SEQ ID NO: 582753 - DNA, 12 bp, Homo sapiens
acaattaactgc

SEQ ID NO: 582754 - DNA, 21 bp, Homo sapiens
acaattgcttactcattaaaa

SEQ ID NO: 582755 - DNA, 20 bp, Homo sapiens
acaattgggagctgccaaga

SEQ ID NO: 582756 - DNA, 16 bp, Homo sapiens
acaatttatactgcga

SEQ ID NO: 582757 - DNA, 9 bp, Homo sapiens
acacacaca

SEQ ID NO: 582758 - DNA, 10 bp, Homo sapiens
acacacacac

SEQ ID NO: 582759 - DNA, 14 bp, Homo sapiens
acacacacgatgca

SEQ ID NO: 582760 - DNA, 13 bp, Homo sapiens
acacacgatgcat

SEQ ID NO: 582761 - DNA, 14 bp, Homo sapiens
acacacgatgcatt

SEQ ID NO: 582762 - DNA, 19 bp, Homo sapiens
acacacgatgcatttaata

SEQ ID NO: 582763 - DNA, 16 bp, Homo sapiens
acacagttcctgggaa

SEQ ID NO: 582764 - DNA, 19 bp, Homo sapiens
acacatttgctactgttgt

SEQ ID NO: 582765 - DNA, 14 bp, Homo sapiens
acaccctccagaga

SEQ ID NO: 582766 - DNA, 13 bp, Homo sapiens
acacgatgcattt

SEQ ID NO: 582767 - DNA, 14 bp, Homo sapiens
acacgatgcattta

SEQ ID NO: 582768 - DNA, 24 bp, Homo sapiens
acacgatgcatttaataaagatga

SEQ ID NO: 582769 - DNA, 23 bp, Homo sapiens
acactgacttaggtttcaggaag

SEQ ID NO: 582770 - DNA, 16 bp, Homo sapiens
acactgtcaaacaggt

SEQ ID NO: 582771 - DNA, 21 bp, Homo sapiens
acagaaaaagaaggttgaggg

SEQ ID NO: 582772 - DNA, 14 bp, Homo sapiens
acagacacaattta

SEQ ID NO: 582773 - DNA, 20 bp, Homo sapiens
acagagactgaatagatatg

SEQ ID NO: 582774 - DNA, 20 bp, Homo sapiens
acagattctttcagttcttt

SEQ ID NO: 582775 - DNA, 14 bp, Homo sapiens
acagcatcagctca

SEQ ID NO: 582776 - DNA, 12 bp, Homo sapiens
acagccctggca

SEQ ID NO: 582777 - DNA, 18 bp, Homo sapiens
acagctcaagcattctgt

SEQ ID NO: 582778 - DNA, 19 bp, Homo sapiens
acagctcctggaccaggcc

SEQ ID NO: 582779 - DNA, 21 bp, Homo sapiens
acagctgtgagccatgcctcc

SEQ ID NO: 582780 - DNA, 20 bp, Homo sapiens
acaggcacattaactgttgc

SEQ ID NO: 582781 - DNA, 19 bp, Homo sapiens
acagggccctggagctcag

SEQ ID NO: 582782 - DNA, 16 bp, Homo sapiens
acagggctgccttctg

SEQ ID NO: 582783 - DNA, 15 bp, Homo sapiens
acaggtaaaacaggg

SEQ ID NO: 582784 - DNA, 15 bp, Homo sapiens
acaggttataacagt

SEQ ID NO: 582785 - DNA, 23 bp, Homo sapiens
acagtgaagttttactgtctatt

SEQ ID NO: 582786 - DNA, 17 bp, Homo sapiens
acagtggatcacaaagt

SEQ ID NO: 582787 - DNA, 20 bp, Homo sapiens
acagttcccagagtgggctt

SEQ ID NO: 582788 - DNA, 13 bp, Homo sapiens
acagttcctggga

SEQ ID NO: 582789 - DNA, 13 bp, Homo sapiens
acagttttaactg

SEQ ID NO: 582790 - DNA, 19 bp, Homo sapiens
acagttttaactgtggata

SEQ ID NO: 582791 - DNA, 20 bp, Homo sapiens
acagtttttgacatttatat

SEQ ID NO: 582792 - DNA, 17 bp, Homo sapiens
acataacttctcatgta

SEQ ID NO: 582793 - DNA, 18 bp, Homo sapiens
acataacttctcatgtat

SEQ ID NO: 582794 - DNA, 20 bp, Homo sapiens
acataacttctcatgtatat

SEQ ID NO: 582795 - DNA, 17 bp, Homo sapiens
acataagcttccatttt

SEQ ID NO: 582796 - DNA, 18 bp, Homo sapiens
acataagcttccatttta

SEQ ID NO: 582797 - DNA, 17 bp, Homo sapiens
acatcaaacctttgagt

SEQ ID NO: 582798 - DNA, 13 bp, Homo sapiens
acatcaaataaga

SEQ ID NO: 582799 - DNA, 14 bp, Homo sapiens
acatcagcctcctt

SEQ ID NO: 582800 - DNA, 19 bp, Homo sapiens
acatctatccacactgtca

SEQ ID NO: 582801 - DNA, 22 bp, Homo sapiens
acatctccatggggaggcctca

SEQ ID NO: 582802 - DNA, 18 bp, Homo sapiens
acatctgacctggcatct

SEQ ID NO: 582803 - DNA, 18 bp, Homo sapiens
acatgatccccgtctctg

SEQ ID NO: 582804 - DNA, 22 bp, Homo sapiens
acatgatccccgtctctgccct

SEQ ID NO: 582805 - DNA, 14 bp, Homo sapiens
acatgcaataaaat

SEQ ID NO: 582806 - DNA, 19 bp, Homo sapiens
acatgcaataaaatttaaa

SEQ ID NO: 582807 - DNA, 19 bp, Homo sapiens
acatgccacatcaaacctt

SEQ ID NO: 582808 - DNA, 22 bp, Homo sapiens
acatgccacatcaaacctttga

SEQ ID NO: 582809 - DNA, 20 bp, Homo sapiens
acatgggctgtgattactgc

SEQ ID NO: 582810 - DNA, 21 bp, Homo sapiens
acatgggctgtgattactgca

SEQ ID NO: 582811 - DNA, 23 bp, Homo sapiens
acatgggctgtgattactgcaat

SEQ ID NO: 582812 - DNA, 21 bp, Homo sapiens
acatggggaggttgtggggcc

SEQ ID NO: 582813 - DNA, 15 bp, Homo sapiens
acatgtgatacattt

SEQ ID NO: 582814 - DNA, 19 bp, Homo sapiens
acatgttcccaaaacaatg

SEQ ID NO: 582815 - DNA, 22 bp, Homo sapiens
acatgtttctctataaagtatg

SEQ ID NO: 582816 - DNA, 11 bp, Homo sapiens
acattaactgt

SEQ ID NO: 582817 - DNA, 18 bp, Homo sapiens
acattcaacagagactga

SEQ ID NO: 582818 - DNA, 11 bp, Homo sapiens
acatttatatt

SEQ ID NO: 582819 - DNA, 19 bp, Homo sapiens
acatttcttctagtgatga

SEQ ID NO: 582820 - DNA, 15 bp, Homo sapiens
acatttgctgccatt

SEQ ID NO: 582821 - DNA, 17 bp, Homo sapiens
acattttttaagcttca

SEQ ID NO: 582822 - DNA, 16 bp, Homo sapiens
agcagccccaggagaa

SEQ ID NO: 582823 - DNA, 13 bp, Homo sapiens
agcagtttccagt

SEQ ID NO: 582824 - DNA, 15 bp, Homo sapiens
agcatccaccccacc

SEQ ID NO: 582825 - DNA, 18 bp, Homo sapiens
agcatctcagtggtgtgt

SEQ ID NO: 582826 - DNA, 14 bp, Homo sapiens
agcatggagacagc

SEQ ID NO: 582827 - DNA, 17 bp, Homo sapiens
agcatggagacagcagt

SEQ ID NO: 582828 - DNA, 16 bp, Homo sapiens
agcatggggccaggaa

SEQ ID NO: 582829 - DNA, 12 bp, Homo sapiens
agccaaaccagg

SEQ ID NO: 582830 - DNA, 12 bp, Homo sapiens
agccaaatttaa

SEQ ID NO: 582831 - DNA, 19 bp, Homo sapiens
agccaaatttaaaactgtt

SEQ ID NO: 582832 - DNA, 22 bp, Homo sapiens
agccaatctacaatctcttttt

SEQ ID NO: 582833 - DNA, 15 bp, Homo sapiens
agccagaccagcagg

SEQ ID NO: 582834 - DNA, 19 bp, Homo sapiens
agccaggaggcctgctagg

SEQ ID NO: 582835 - DNA, 14 bp, Homo sapiens
agccatagatgctg

SEQ ID NO: 582836 - DNA, 21 bp, Homo sapiens
agccatggcaggacagctcct

SEQ ID NO: 582837 - DNA, 20 bp, Homo sapiens
agccattgaacagctgtgag

SEQ ID NO: 582838 - DNA, 24 bp, Homo sapiens
agcccaggaatttgaagctgcagt

SEQ ID NO: 582839 - DNA, 19 bp, Homo sapiens
agcccaggatactggcaca

SEQ ID NO: 582840 - DNA, 21 bp, Homo sapiens
agcccaggatactggcacaga

SEQ ID NO: 582841 - DNA, 23 bp, Homo sapiens
agcccaggatactggcacagagg

SEQ ID NO: 582842 - DNA, 14 bp, Homo sapiens
agcccctgggccca

SEQ ID NO: 582843 - DNA, 15 bp, Homo sapiens
agccctcctgagggc

SEQ ID NO: 582844 - DNA, 20 bp, Homo sapiens
agccctcctgagggccggtt

SEQ ID NO: 582845 - DNA, 14 bp, Homo sapiens
agcctactatttaa

SEQ ID NO: 582846 - DNA, 13 bp, Homo sapiens
agcctactctcct

SEQ ID NO: 582847 - DNA, 17 bp, Homo sapiens
agcctagcctatgtctg

SEQ ID NO: 582848 - DNA, 13 bp, Homo sapiens
agcctatgtctgg

SEQ ID NO: 582849 - DNA, 23 bp, Homo sapiens
agcctggatcctcagttctcaaa

SEQ ID NO: 582850 - DNA, 22 bp, Homo sapiens
agcctggtttgcaaagaccacc

SEQ ID NO: 582851 - DNA, 12 bp, Homo sapiens
agccttctccct

SEQ ID NO: 582852 - DNA, 16 bp, Homo sapiens
agccttctccctagct

SEQ ID NO: 582853 - DNA, 19 bp, Homo sapiens
agccttgcagcggctcctg

SEQ ID NO: 582854 - DNA, 16 bp, Homo sapiens
agcgacctctctgcct

SEQ ID NO: 582855 - DNA, 17 bp, Homo sapiens
agcgacctctctgcctc

SEQ ID NO: 582856 - DNA, 23 bp, Homo sapiens
agcgaggcacccttactggctta

SEQ ID NO: 582857 - DNA, 15 bp, Homo sapiens
agcgttctaaatatg

SEQ ID NO: 582858 - DNA, 21 bp, Homo sapiens
agcgttctaaatatgaatgaa

SEQ ID NO: 582859 - DNA, 19 bp, Homo sapiens
agctcaagcattctgttta

SEQ ID NO: 582860 - DNA, 21 bp, Homo sapiens
agctcattataatgtcattaa

SEQ ID NO: 582861 - DNA, 18 bp, Homo sapiens
agctcctggaccaggccc

SEQ ID NO: 582862 - DNA, 20 bp, Homo sapiens
agctcctggaccaggcccat

SEQ ID NO: 582863 - DNA, 20 bp, Homo sapiens
agctctcaggaccgtgccct

SEQ ID NO: 582864 - DNA, 13 bp, Homo sapiens
agctgagcatgga

SEQ ID NO: 582865 - DNA, 16 bp, Homo sapiens
agctgagcatggagac

SEQ ID NO: 582866 - DNA, 22 bp, Homo sapiens
agctgagcatggagacagcagt

SEQ ID NO: 582867 - DNA, 16 bp, Homo sapiens
agctgcagagatttct

SEQ ID NO: 582868 - DNA, 13 bp, Homo sapiens
agctgcagtgagc

SEQ ID NO: 582869 - DNA, 14 bp, Homo sapiens
agctgccatggcta

SEQ ID NO: 582870 - DNA, 15 bp, Homo sapiens
agctgctgttgaact

SEQ ID NO: 582871 - DNA, 17 bp, Homo sapiens
agctgctgttgaacttt

SEQ ID NO: 582872 - DNA, 18 bp, Homo sapiens
agctgctgttgaactttt

SEQ ID NO: 582873 - DNA, 20 bp, Homo sapiens
agctgctgttgaacttttta

SEQ ID NO: 582874 - DNA, 18 bp, Homo sapiens
agctggctctgtgagggt

SEQ ID NO: 582875 - DNA, 21 bp, Homo sapiens
agctggctctgtgagggtgct

SEQ ID NO: 582876 - DNA, 16 bp, Homo sapiens
agctgtatcactgcct

SEQ ID NO: 582877 - DNA, 21 bp, Homo sapiens
agctgtgtgaatacctgctca

SEQ ID NO: 582878 - DNA, 20 bp, Homo sapiens
agctgttccttggtcctagt

SEQ ID NO: 582879 - DNA, 12 bp, Homo sapiens
agcttcagccag

SEQ ID NO: 582880 - DNA, 14 bp, Homo sapiens
agcttcagccaggc

SEQ ID NO: 582881 - DNA, 16 bp, Homo sapiens
agcttcagttgcttgt

SEQ ID NO: 582882 - DNA, 15 bp, Homo sapiens
agcttcatccacagc

SEQ ID NO: 582883 - DNA, 15 bp, Homo sapiens
agcttccattttaat

SEQ ID NO: 582884 - DNA, 20 bp, Homo sapiens
agcttccattttaattttaa

SEQ ID NO: 582885 - DNA, 17 bp, Homo sapiens
agcttctgccacataaa

SEQ ID NO: 582886 - DNA, 21 bp, Homo sapiens
agctttgcaaacccattaagg

SEQ ID NO: 582887 - DNA, 13 bp, Homo sapiens
aggaacaaacagg

SEQ ID NO: 582888 - DNA, 23 bp, Homo sapiens
aggaagtcagaatttttaactgt

SEQ ID NO: 582889 - DNA, 17 bp, Homo sapiens
aggaatcattcagaaat

SEQ ID NO: 582890 - DNA, 16 bp, Homo sapiens
aggacacagttcctgg

SEQ ID NO: 582891 - DNA, 13 bp, Homo sapiens
aggacatgcaata

SEQ ID NO: 582892 - DNA, 21 bp, Homo sapiens
aggacatgcaataaaatttaa

SEQ ID NO: 582893 - DNA, 14 bp, Homo sapiens
aggagaaggggctt

SEQ ID NO: 582894 - DNA, 16 bp, Homo sapiens
aggagataaggtggct

SEQ ID NO: 582895 - DNA, 18 bp, Homo sapiens
aggagataaggtggcttc

SEQ ID NO: 582896 - DNA, 21 bp, Homo sapiens
aggagattcccaccttccata

SEQ ID NO: 582897 - DNA, 18 bp, Homo sapiens
aggaggcacctacactca

SEQ ID NO: 582898 - DNA, 13 bp, Homo sapiens
aggaggctgaggt

SEQ ID NO: 582899 - DNA, 20 bp, Homo sapiens
aggaggtgaaatccctgcct

SEQ ID NO: 582900 - DNA, 22 bp, Homo sapiens
aggaggtgaaatccctgcctca

SEQ ID NO: 582901 - DNA, 19 bp, Homo sapiens
aggagtttaagaccagcct

SEQ ID NO: 582902 - DNA, 21 bp, Homo sapiens
aggagtttaagaccagcctgg

SEQ ID NO: 582903 - DNA, 18 bp, Homo sapiens
aggatactggcacagagg

SEQ ID NO: 582904 - DNA, 13 bp, Homo sapiens
aggatgggtcccc

SEQ ID NO: 582905 - DNA, 23 bp, Homo sapiens
aggcacctacactcacctgcact

SEQ ID NO: 582906 - DNA, 19 bp, Homo sapiens
aggcactcatgggtaataa

SEQ ID NO: 582907 - DNA, 21 bp, Homo sapiens
aggcagcctagcctatgtctg

SEQ ID NO: 582908 - DNA, 21 bp, Homo sapiens
aggccacagaaggtgaacttt

SEQ ID NO: 582909 - DNA, 13 bp, Homo sapiens
aggcccatagcag

SEQ ID NO: 582910 - DNA, 21 bp, Homo sapiens
aggcctagactctgtctacct

SEQ ID NO: 582911 - DNA, 19 bp, Homo sapiens
aggctcagactgggcactg

SEQ ID NO: 582912 - DNA, 19 bp, Homo sapiens
aggctccgggcaccagggg

SEQ ID NO: 582913 - DNA, 16 bp, Homo sapiens
aggctcttcttcctca

SEQ ID NO: 582914 - DNA, 16 bp, Homo sapiens
aggctgctctgcctgt

SEQ ID NO: 582915 - DNA, 11 bp, Homo sapiens
aggctgtgttt

SEQ ID NO: 582916 - DNA, 14 bp, Homo sapiens
agggaaaacagaaa

SEQ ID NO: 582917 - DNA, 16 bp, Homo sapiens
agggaaaacagaaaac

SEQ ID NO: 582918 - DNA, 16 bp, Homo sapiens
agggacataagataaa

SEQ ID NO: 582919 - DNA, 22 bp, Homo sapiens
agggactacccatagacatgaa

SEQ ID NO: 582920 - DNA, 16 bp, Homo sapiens
agggatacccagtgat

SEQ ID NO: 582921 - DNA, 17 bp, Homo sapiens
agggcaccgtattcctc

SEQ ID NO: 582922 - DNA, 18 bp, Homo sapiens
agggccctggagctcagg

SEQ ID NO: 582923 - DNA, 15 bp, Homo sapiens
agggcctcagtctgg

SEQ ID NO: 582924 - DNA, 21 bp, Homo sapiens
agggccttggaaattcctgta

SEQ ID NO: 582925 - DNA, 16 bp, Homo sapiens
agggcctttctcctcc

SEQ ID NO: 582926 - DNA, 17 bp, Homo sapiens
agggcctttctcctccc

SEQ ID NO: 582927 - DNA, 15 bp, Homo sapiens
agggctaaataaaga

SEQ ID NO: 582928 - DNA, 20 bp, Homo sapiens
agggctgccttctggccttg

SEQ ID NO: 582929 - DNA, 21 bp, Homo sapiens
aggggccaacctcaggctcct

SEQ ID NO: 582930 - DNA, 22 bp, Homo sapiens
aggggccaacctcaggctccta

SEQ ID NO: 582931 - DNA, 16 bp, Homo sapiens
aggggcgcgggagggg

SEQ ID NO: 582932 - DNA, 13 bp, Homo sapiens
atactttgtattt

SEQ ID NO: 582933 - DNA, 17 bp, Homo sapiens
atactttgtattttgat

SEQ ID NO: 582934 - DNA, 20 bp, Homo sapiens
atagaaatatagccaaaaat

SEQ ID NO: 582935 - DNA, 17 bp, Homo sapiens
atagcagccagttcaaa

SEQ ID NO: 582936 - DNA, 17 bp, Homo sapiens
atagcttgcagaactgt

SEQ ID NO: 582937 - DNA, 20 bp, Homo sapiens
ataggaatcattcagaaatg

SEQ ID NO: 582938 - DNA, 21 bp, Homo sapiens
ataggagtggtgatttgaaaa

SEQ ID NO: 582939 - DNA, 22 bp, Homo sapiens
atagggtctaccaatacaaaat

SEQ ID NO: 582940 - DNA, 21 bp, Homo sapiens
atagtctaagactatatatat

SEQ ID NO: 582941 - DNA, 22 bp, Homo sapiens
atatactaagatgttcactgtg

SEQ ID NO: 582942 - DNA, 12 bp, Homo sapiens
atatagacttgg

SEQ ID NO: 582943 - DNA, 15 bp, Homo sapiens
atatagacttggaga

SEQ ID NO: 582944 - DNA, 13 bp, Homo sapiens
atatataaatgta

SEQ ID NO: 582945 - DNA, 14 bp, Homo sapiens
atatataaatgtat

SEQ ID NO: 582946 - DNA, 15 bp, Homo sapiens
atatatataggttct

SEQ ID NO: 582947 - DNA, 20 bp, Homo sapiens
atatattttgtgtgaaattg

SEQ ID NO: 582948 - DNA, 23 bp, Homo sapiens
atatctcaatgaaccataaattc

SEQ ID NO: 582949 - DNA, 13 bp, Homo sapiens
atatgaaagctga

SEQ ID NO: 582950 - DNA, 17 bp, Homo sapiens
atatgaaagctgatttt

SEQ ID NO: 582951 - DNA, 14 bp, Homo sapiens
atatgtatatatgt

SEQ ID NO: 582952 - DNA, 16 bp, Homo sapiens
atatgtatatatgtat

SEQ ID NO: 582953 - DNA, 13 bp, Homo sapiens
atatgtattcttt

SEQ ID NO: 582954 - DNA, 18 bp, Homo sapiens
atatgtattttttgaatc

SEQ ID NO: 582955 - DNA, 22 bp, Homo sapiens
atattaaataacatgtttctct

SEQ ID NO: 582956 - DNA, 17 bp, Homo sapiens
atattacccaatggaaa

SEQ ID NO: 582957 - DNA, 21 bp, Homo sapiens
atattccagatctttcagaaa

SEQ ID NO: 582958 - DNA, 12 bp, Homo sapiens
atattgaatgtt

SEQ ID NO: 582959 - DNA, 15 bp, Homo sapiens
atattgattgggaaa

SEQ ID NO: 582960 - DNA, 19 bp, Homo sapiens
atattgtaatctatgttta

SEQ ID NO: 582961 - DNA, 18 bp, Homo sapiens
atattgtttggtaaatgt

SEQ ID NO: 582962 - DNA, 19 bp, Homo sapiens
atattgtttggtaaatgtt

SEQ ID NO: 582963 - DNA, 21 bp, Homo sapiens
atattgtttggtaaatgtttc

SEQ ID NO: 582964 - DNA, 18 bp, Homo sapiens
atatttcaataaatgata

SEQ ID NO: 582965 - DNA, 21 bp, Homo sapiens
atatttcaataaatgatatat

SEQ ID NO: 582966 - DNA, 14 bp, Homo sapiens
atattttatattac

SEQ ID NO: 582967 - DNA, 13 bp, Homo sapiens
atattttgtgtga

SEQ ID NO: 582968 - DNA, 14 bp, Homo sapiens
atatttttttaact

SEQ ID NO: 582969 - DNA, 17 bp, Homo sapiens
atatttttttaactgtg

SEQ ID NO: 582970 - DNA, 18 bp, Homo sapiens
atatttttttaactgtga

SEQ ID NO: 582971 - DNA, 15 bp, Homo sapiens
atcaaacctttgagt

SEQ ID NO: 582972 - DNA, 24 bp, Homo sapiens
atcaaagccggcctgagaaacact

SEQ ID NO: 582973 - DNA, 15 bp, Homo sapiens
atcacaaagtggaac

SEQ ID NO: 582974 - DNA, 19 bp, Homo sapiens
atcacagatcgcatttcct

SEQ ID NO: 582975 - DNA, 20 bp, Homo sapiens
atcacagatcgcatttccta

SEQ ID NO: 582976 - DNA, 18 bp, Homo sapiens
atcactgtatcattttct

SEQ ID NO: 582977 - DNA, 19 bp, Homo sapiens
atcactgtatcattttctt

SEQ ID NO: 582978 - DNA, 13 bp, Homo sapiens
atcagacagcagg

SEQ ID NO: 582979 - DNA, 17 bp, Homo sapiens
atcagagcgcacaggga

SEQ ID NO: 582980 - DNA, 18 bp, Homo sapiens
atcagggcctttctcctc

SEQ ID NO: 582981 - DNA, 20 bp, Homo sapiens
atcagggcctttctcctccc

SEQ ID NO: 582982 - DNA, 20 bp, Homo sapiens
atcagtaatgctaaatgtgt

SEQ ID NO: 582983 - DNA, 21 bp, Homo sapiens
atcagtaatgctaaatgtgta

SEQ ID NO: 582984 - DNA, 16 bp, Homo sapiens
atcagtgtgtaaataa

SEQ ID NO: 582985 - DNA, 14 bp, Homo sapiens
atcattcagaaatg

SEQ ID NO: 582986 - DNA, 15 bp, Homo sapiens
atccaagattctgct

SEQ ID NO: 582987 - DNA, 19 bp, Homo sapiens
atccagttataagaagaag

SEQ ID NO: 582988 - DNA, 12 bp, Homo sapiens
atcccatctctc

SEQ ID NO: 582989 - DNA, 15 bp, Homo sapiens
atcccatctctccca

SEQ ID NO: 582990 - DNA, 23 bp, Homo sapiens
atccccaaaacaggccaggtgtg

SEQ ID NO: 582991 - DNA, 23 bp, Homo sapiens
atcccgttcagaaaaccacttta

SEQ ID NO: 582992 - DNA, 12 bp, Homo sapiens
atccctctccac

SEQ ID NO: 582993 - DNA, 14 bp, Homo sapiens
atccctctccactc

SEQ ID NO: 582994 - DNA, 15 bp, Homo sapiens
atccctctccactct

SEQ ID NO: 582995 - DNA, 21 bp, Homo sapiens
atccctctccactcttctctc

SEQ ID NO: 582996 - DNA, 15 bp, Homo sapiens
atccctctcctaact

SEQ ID NO: 582997 - DNA, 18 bp, Homo sapiens
atccttgagattctgaag

SEQ ID NO: 582998 - DNA, 17 bp, Homo sapiens
atccttggcttcaggtt

SEQ ID NO: 582999 - DNA, 16 bp, Homo sapiens
atcgtattaaaaaaca

SEQ ID NO: 583000 - DNA, 18 bp, Homo sapiens
atcgtattaaaaaacaat

SEQ ID NO: 583001 - DNA, 19 bp, Homo sapiens
atcgtattaaaaaacaatt

SEQ ID NO: 583002 - DNA, 15 bp, Homo sapiens
atctaattctgattc

SEQ ID NO: 583003 - DNA, 23 bp, Homo sapiens
atctacttctgtaattgtgtgga

SEQ ID NO: 583004 - DNA, 15 bp, Homo sapiens
atctataaactataa

SEQ ID NO: 583005 - DNA, 19 bp, Homo sapiens
atctatccacactgtcaaa

SEQ ID NO: 583006 - DNA, 19 bp, Homo sapiens
atctatgaacctgaaaagg

SEQ ID NO: 583007 - DNA, 12 bp, Homo sapiens
atctattgctca

SEQ ID NO: 583008 - DNA, 14 bp, Homo sapiens
atctattgctcatc

SEQ ID NO: 583009 - DNA, 12 bp, Homo sapiens
atctcaatgcaa

SEQ ID NO: 583010 - DNA, 19 bp, Homo sapiens
atctcataatgctttgtta

SEQ ID NO: 583011 - DNA, 14 bp, Homo sapiens
atctgtacaaaatg

SEQ ID NO: 583012 - DNA, 15 bp, Homo sapiens
atcttacaatattga

SEQ ID NO: 583013 - DNA, 17 bp, Homo sapiens
atcttacaatattgatt

SEQ ID NO: 583014 - DNA, 15 bp, Homo sapiens
atcttcaaagccttc

SEQ ID NO: 583015 - DNA, 18 bp, Homo sapiens
atcttcaaagccttctcc

SEQ ID NO: 583016 - DNA, 14 bp, Homo sapiens
atcttcccatgcat

SEQ ID NO: 583017 - DNA, 12 bp, Homo sapiens
atcttcctctgc

SEQ ID NO: 583018 - DNA, 12 bp, Homo sapiens
atgaaacttctc

SEQ ID NO: 583019 - DNA, 12 bp, Homo sapiens
atgaaagaaaat

SEQ ID NO: 583020 - DNA, 15 bp, Homo sapiens
atgaacctgaaaagg

SEQ ID NO: 583021 - DNA, 18 bp, Homo sapiens
atgaactttgtcagtgtt

SEQ ID NO: 583022 - DNA, 20 bp, Homo sapiens
atgaatgggatattttgaaa

SEQ ID NO: 583023 - DNA, 17 bp, Homo sapiens
atgacaaataagtggaa

SEQ ID NO: 583024 - DNA, 14 bp, Homo sapiens
atgacaatcaaagc

SEQ ID NO: 583025 - DNA, 16 bp, Homo sapiens
atgactgcatttgtgt

SEQ ID NO: 583026 - DNA, 23 bp, Homo sapiens
atgacttggtggcttttccttga

SEQ ID NO: 583027 - DNA, 15 bp, Homo sapiens
atgaggaaaattctt

SEQ ID NO: 583028 - DNA, 19 bp, Homo sapiens
atgaggaaaattcttaaaa

SEQ ID NO: 583029 - DNA, 21 bp, Homo sapiens
atgaggaaaattcttaaaagg

SEQ ID NO: 583030 - DNA, 21 bp, Homo sapiens
atgatccccgtctctgccctg

SEQ ID NO: 583031 - DNA, 22 bp, Homo sapiens
atgatccccgtctctgccctgg

SEQ ID NO: 583032 - DNA, 12 bp, Homo sapiens
atgatgacaatc

SEQ ID NO: 583033 - DNA, 14 bp, Homo sapiens
atgatgctttggaa

SEQ ID NO: 583034 - DNA, 18 bp, Homo sapiens
atgatgtacagattcttt

SEQ ID NO: 583035 - DNA, 17 bp, Homo sapiens
atgatgttatacatcaa

SEQ ID NO: 583036 - DNA, 22 bp, Homo sapiens
atgatttccctccagagaaagc

SEQ ID NO: 583037 - DNA, 23 bp, Homo sapiens
atgatttccctccagagaaagca

SEQ ID NO: 583038 - DNA, 24 bp, Homo sapiens
atgatttccctccagagaaagcac

SEQ ID NO: 583039 - DNA, 14 bp, Homo sapiens
atgcaaatgagctc

SEQ ID NO: 583040 - DNA, 18 bp, Homo sapiens
atgcaataaaatttaaaa

SEQ ID NO: 583041 - DNA, 23 bp, Homo sapiens
atgcacaagatgccccagggatg

SEQ ID NO: 583042 - DNA, 16 bp, Homo sapiens
cacagccaaatttaaa

SEQ ID NO: 583043 - DNA, 19 bp, Homo sapiens
cacagccttgcagcggctc

SEQ ID NO: 583044 - DNA, 21 bp, Homo sapiens
cacagccttgcagcggctcct

SEQ ID NO: 583045 - DNA, 17 bp, Homo sapiens
cacaggcacattaactg

SEQ ID NO: 583046 - DNA, 20 bp, Homo sapiens
cacaggcacattaactgttg

SEQ ID NO: 583047 - DNA, 14 bp, Homo sapiens
cacatcaaaccttt

SEQ ID NO: 583048 - DNA, 18 bp, Homo sapiens
cacatcaaataagaaata

SEQ ID NO: 583049 - DNA, 21 bp, Homo sapiens
cacatttgctactgttgtaag

SEQ ID NO: 583050 - DNA, 19 bp, Homo sapiens
caccagtgtagcatcttcc

SEQ ID NO: 583051 - DNA, 16 bp, Homo sapiens
cacccatttagtgggg

SEQ ID NO: 583052 - DNA, 20 bp, Homo sapiens
caccccagggacagggccct

SEQ ID NO: 583053 - DNA, 15 bp, Homo sapiens
cacccgagtacctcc

SEQ ID NO: 583054 - DNA, 16 bp, Homo sapiens
cacccgagtacctcca

SEQ ID NO: 583055 - DNA, 15 bp, Homo sapiens
cacctgaatttgtat

SEQ ID NO: 583056 - DNA, 17 bp, Homo sapiens
cacctgaatttgtatat

SEQ ID NO: 583057 - DNA, 16 bp, Homo sapiens
cacctgcactaacaga

SEQ ID NO: 583058 - DNA, 21 bp, Homo sapiens
cacctgcactaacagagtggc

SEQ ID NO: 583059 - DNA, 15 bp, Homo sapiens
cacctggctgccaac

SEQ ID NO: 583060 - DNA, 23 bp, Homo sapiens
cacgagtttggatgttgtaaata

SEQ ID NO: 583061 - DNA, 15 bp, Homo sapiens
cacgatgcatttaat

SEQ ID NO: 583062 - DNA, 17 bp, Homo sapiens
cacgatgcatttaataa

SEQ ID NO: 583063 - DNA, 19 bp, Homo sapiens
cacgatgcatttaataaag

SEQ ID NO: 583064 - DNA, 20 bp, Homo sapiens
cacgatgcatttaataaaga

SEQ ID NO: 583065 - DNA, 13 bp, Homo sapiens
cactatttgtgac

SEQ ID NO: 583066 - DNA, 13 bp, Homo sapiens
cactcacctctaa

SEQ ID NO: 583067 - DNA, 14 bp, Homo sapiens
cactcacctctaac

SEQ ID NO: 583068 - DNA, 16 bp, Homo sapiens
cactccaatctgggtg

SEQ ID NO: 583069 - DNA, 15 bp, Homo sapiens
cactctcccttgtac

SEQ ID NO: 583070 - DNA, 16 bp, Homo sapiens
cactctcccttgtaca

SEQ ID NO: 583071 - DNA, 15 bp, Homo sapiens
cactcttctctcctt

SEQ ID NO: 583072 - DNA, 18 bp, Homo sapiens
cactcttctctcctttct

SEQ ID NO: 583073 - DNA, 22 bp, Homo sapiens
cactcttctctcctttctccct

SEQ ID NO: 583074 - DNA, 14 bp, Homo sapiens
cactgactcctgtg

SEQ ID NO: 583075 - DNA, 18 bp, Homo sapiens
cactgcactccagcctgg

SEQ ID NO: 583076 - DNA, 22 bp, Homo sapiens
cactgccttcgtttatattttt

SEQ ID NO: 583077 - DNA, 20 bp, Homo sapiens
cactggtctgtttgcatttg

SEQ ID NO: 583078 - DNA, 22 bp, Homo sapiens
cactgtagctattagcggctcc

SEQ ID NO: 583079 - DNA, 13 bp, Homo sapiens
cacttcctcctac

SEQ ID NO: 583080 - DNA, 15 bp, Homo sapiens
cacttgcctggggcg

SEQ ID NO: 583081 - DNA, 9 bp, Homo sapiens
cagaaaacc

SEQ ID NO: 583082 - DNA, 11 bp, Homo sapiens
cagaaaaccac

SEQ ID NO: 583083 - DNA, 21 bp, Homo sapiens
cagaaatataacacatttttt

SEQ ID NO: 583084 - DNA, 14 bp, Homo sapiens
cagaaatgccccca

SEQ ID NO: 583085 - DNA, 17 bp, Homo sapiens
cagaaatggaaagcaga

SEQ ID NO: 583086 - DNA, 22 bp, Homo sapiens
cagaaccacacttgaaaccttt

SEQ ID NO: 583087 - DNA, 19 bp, Homo sapiens
cagaacttcagcattgtaa

SEQ ID NO: 583088 - DNA, 13 bp, Homo sapiens
cagaagaaaattt

SEQ ID NO: 583089 - DNA, 23 bp, Homo sapiens
cagaagccaatctacaatctctt

SEQ ID NO: 583090 - DNA, 21 bp, Homo sapiens
cagaaggtgaactttgtgctt

SEQ ID NO: 583091 - DNA, 17 bp, Homo sapiens
cagaatttttaactgta

SEQ ID NO: 583092 - DNA, 18 bp, Homo sapiens
cagaccctgaacccacac

SEQ ID NO: 583093 - DNA, 18 bp, Homo sapiens
cagactgggcactggggc

SEQ ID NO: 583094 - DNA, 15 bp, Homo sapiens
cagagaaagcacaat

SEQ ID NO: 583095 - DNA, 14 bp, Homo sapiens
cagagacaacaggt

SEQ ID NO: 583096 - DNA, 22 bp, Homo sapiens
cagagacaacaggtaaaacagg

SEQ ID NO: 583097 - DNA, 16 bp, Homo sapiens
cagagatttctcattg

SEQ ID NO: 583098 - DNA, 19 bp, Homo sapiens
cagagatttctcattgact

SEQ ID NO: 583099 - DNA, 20 bp, Homo sapiens
cagagatttctcattgactt

SEQ ID NO: 583100 - DNA, 17 bp, Homo sapiens
cagagcaaacagaaaaa

SEQ ID NO: 583101 - DNA, 15 bp, Homo sapiens
cagagcgcacaggga

SEQ ID NO: 583102 - DNA, 15 bp, Homo sapiens
cagagcttgtggtgg

SEQ ID NO: 583103 - DNA, 21 bp, Homo sapiens
cagagcttgtggtggggcagg

SEQ ID NO: 583104 - DNA, 14 bp, Homo sapiens
cagagttttcatta

SEQ ID NO: 583105 - DNA, 16 bp, Homo sapiens
cagataaacaaacaag

SEQ ID NO: 583106 - DNA, 18 bp, Homo sapiens
cagataccttatcttaca

SEQ ID NO: 583107 - DNA, 23 bp, Homo sapiens
cagataccttatcttacaatatt

SEQ ID NO: 583108 - DNA, 14 bp, Homo sapiens
cagatcacgaggtc

SEQ ID NO: 583109 - DNA, 16 bp, Homo sapiens
cagatcgcatttccta

SEQ ID NO: 583110 - DNA, 17 bp, Homo sapiens
cagatcgcatttcctaa

SEQ ID NO: 583111 - DNA, 20 bp, Homo sapiens
cagatctttcagaaatataa

SEQ ID NO: 583112 - DNA, 16 bp, Homo sapiens
cagatgagggctggct

SEQ ID NO: 583113 - DNA, 19 bp, Homo sapiens
cagatgatgctttggaaga

SEQ ID NO: 583114 - DNA, 15 bp, Homo sapiens
cagattggccaatta

SEQ ID NO: 583115 - DNA, 14 bp, Homo sapiens
cagcaaacaggtgc

SEQ ID NO: 583116 - DNA, 23 bp, Homo sapiens
cagcaagttagaactagccaaac

SEQ ID NO: 583117 - DNA, 22 bp, Homo sapiens
cagcactttgggaggctgaggt

SEQ ID NO: 583118 - DNA, 16 bp, Homo sapiens
cagcagccccaggaga

SEQ ID NO: 583119 - DNA, 18 bp, Homo sapiens
cagcagtcgcccaagcag

SEQ ID NO: 583120 - DNA, 22 bp, Homo sapiens
cagcagtcgcccaagcagacag

SEQ ID NO: 583121 - DNA, 20 bp, Homo sapiens
cagcagtttccagagagtgg

SEQ ID NO: 583122 - DNA, 14 bp, Homo sapiens
cagcatcagctcaa

SEQ ID NO: 583123 - DNA, 22 bp, Homo sapiens
cagccaaatttaaaactgttgg

SEQ ID NO: 583124 - DNA, 16 bp, Homo sapiens
cagccagaccagcagg

SEQ ID NO: 583125 - DNA, 20 bp, Homo sapiens
cagccaggcaagaaagcttc

SEQ ID NO: 583126 - DNA, 21 bp, Homo sapiens
cagccctggcaaatgcctgac

SEQ ID NO: 583127 - DNA, 23 bp, Homo sapiens
cagcctagcctatgtctggcaga

SEQ ID NO: 583128 - DNA, 17 bp, Homo sapiens
cagcctgctttcctgca

SEQ ID NO: 583129 - DNA, 22 bp, Homo sapiens
cagcctggtttgcaaagaccac

SEQ ID NO: 583130 - DNA, 19 bp, Homo sapiens
cagccttgcagcggctcct

SEQ ID NO: 583131 - DNA, 22 bp, Homo sapiens
cagccttgcagcggctcctgca

SEQ ID NO: 583132 - DNA, 17 bp, Homo sapiens
cagccttttctggtccc

SEQ ID NO: 583133 - DNA, 18 bp, Homo sapiens
cagccttttctggtccct

SEQ ID NO: 583134 - DNA, 14 bp, Homo sapiens
cagcgacctctctg

SEQ ID NO: 583135 - DNA, 19 bp, Homo sapiens
cagcgacctctctgcctct

SEQ ID NO: 583136 - DNA, 20 bp, Homo sapiens
cagcgacctctctgcctctc

SEQ ID NO: 583137 - DNA, 24 bp, Homo sapiens
cagctacccaggaggctgaggtgg

SEQ ID NO: 583138 - DNA, 21 bp, Homo sapiens
cagctcctggaccaggcccat

SEQ ID NO: 583139 - DNA, 13 bp, Homo sapiens
cagctgcagcctg

SEQ ID NO: 583140 - DNA, 19 bp, Homo sapiens
cagctgcagcctggttggc

SEQ ID NO: 583141 - DNA, 13 bp, Homo sapiens
cagctgctgttga

SEQ ID NO: 583142 - DNA, 18 bp, Homo sapiens
cagctgctgttgaacttt

SEQ ID NO: 583143 - DNA, 19 bp, Homo sapiens
cagctgtgagccatgcctc

SEQ ID NO: 583144 - DNA, 15 bp, Homo sapiens
caggaacaaacaggg

SEQ ID NO: 583145 - DNA, 22 bp, Homo sapiens
caggaacgctctcctcgagccc

SEQ ID NO: 583146 - DNA, 22 bp, Homo sapiens
caggaacggtggaggcagaggt

SEQ ID NO: 583147 - DNA, 13 bp, Homo sapiens
caggacagctcct

SEQ ID NO: 583148 - DNA, 16 bp, Homo sapiens
caggacttctcaccag

SEQ ID NO: 583149 - DNA, 13 bp, Homo sapiens
caggagcccccct

SEQ ID NO: 583150 - DNA, 14 bp, Homo sapiens
caggaggctgaggt

SEQ ID NO: 583151 - DNA, 17 bp, Homo sapiens
ccttatagtctaagact

SEQ ID NO: 583152 - DNA, 20 bp, Homo sapiens
ccttcaaggctcttcttcct

SEQ ID NO: 583153 - DNA, 22 bp, Homo sapiens
ccttcaaggctcttcttcctca

SEQ ID NO: 583154 - DNA, 17 bp, Homo sapiens
ccttcatgacagcctcc

SEQ ID NO: 583155 - DNA, 12 bp, Homo sapiens
ccttccactgta

SEQ ID NO: 583156 - DNA, 14 bp, Homo sapiens
ccttccactgtagc

SEQ ID NO: 583157 - DNA, 16 bp, Homo sapiens
ccttcctgtcctgcct

SEQ ID NO: 583158 - DNA, 14 bp, Homo sapiens
ccttcgtttatatt

SEQ ID NO: 583159 - DNA, 15 bp, Homo sapiens
ccttgttgcactgcc

SEQ ID NO: 583160 - DNA, 23 bp, Homo sapiens
ccttgttgcactgccccctgctt

SEQ ID NO: 583161 - DNA, 19 bp, Homo sapiens
cctttcctggcagtctcag

SEQ ID NO: 583162 - DNA, 13 bp, Homo sapiens
cctttctccctgc

SEQ ID NO: 583163 - DNA, 14 bp, Homo sapiens
cctttctcctcccc

SEQ ID NO: 583164 - DNA, 12 bp, Homo sapiens
cctttgtcctgc

SEQ ID NO: 583165 - DNA, 14 bp, Homo sapiens
ccttttaagcatgt

SEQ ID NO: 583166 - DNA, 16 bp, Homo sapiens
ccttttaccactccca

SEQ ID NO: 583167 - DNA, 14 bp, Homo sapiens
ccttttctggtccc

SEQ ID NO: 583168 - DNA, 16 bp, Homo sapiens
ccttttttttttcttg

SEQ ID NO: 583169 - DNA, 14 bp, Homo sapiens
cgaaaacctgacta

SEQ ID NO: 583170 - DNA, 16 bp, Homo sapiens
cgaagactgagccaga

SEQ ID NO: 583171 - DNA, 15 bp, Homo sapiens
cgaagagagttctgg

SEQ ID NO: 583172 - DNA, 23 bp, Homo sapiens
cgaagagagttctggatgtctgg

SEQ ID NO: 583173 - DNA, 15 bp, Homo sapiens
cgaagagttcccttg

SEQ ID NO: 583174 - DNA, 17 bp, Homo sapiens
cgaatgcccctgttcat

SEQ ID NO: 583175 - DNA, 17 bp, Homo sapiens
cgagagatcaaagatga

SEQ ID NO: 583176 - DNA, 12 bp, Homo sapiens
cgagtacctcca

SEQ ID NO: 583177 - DNA, 21 bp, Homo sapiens
cgagtttggatgttgtaaata

SEQ ID NO: 583178 - DNA, 23 bp, Homo sapiens
cgagtttggatgttgtaaataaa

SEQ ID NO: 583179 - DNA, 13 bp, Homo sapiens
cgcatttcctaag

SEQ ID NO: 583180 - DNA, 19 bp, Homo sapiens
cgccagcgacctctctgcc

SEQ ID NO: 583181 - DNA, 22 bp, Homo sapiens
cgcccacccgagtacctccagt

SEQ ID NO: 583182 - DNA, 13 bp, Homo sapiens
cgcccactcctgg

SEQ ID NO: 583183 - DNA, 21 bp, Homo sapiens
cgcgccagcgacctctctgcc

SEQ ID NO: 583184 - DNA, 22 bp, Homo sapiens
cgcggacccttctgggtccagg

SEQ ID NO: 583185 - DNA, 14 bp, Homo sapiens
cgcggactcgcccc

SEQ ID NO: 583186 - DNA, 14 bp, Homo sapiens
cgctctcctcgagc

SEQ ID NO: 583187 - DNA, 21 bp, Homo sapiens
cgctgcgcggactcgccccca

SEQ ID NO: 583188 - DNA, 22 bp, Homo sapiens
cgctgcgcggactcgcccccag

SEQ ID NO: 583189 - DNA, 18 bp, Homo sapiens
cggaaagaagagcgagag

SEQ ID NO: 583190 - DNA, 18 bp, Homo sapiens
cggacctacctccctccc

SEQ ID NO: 583191 - DNA, 12 bp, Homo sapiens
cggcctgagaaa

SEQ ID NO: 583192 - DNA, 11 bp, Homo sapiens
cggctcctcgc

SEQ ID NO: 583193 - DNA, 12 bp, Homo sapiens
cggctcctgatg

SEQ ID NO: 583194 - DNA, 14 bp, Homo sapiens
cgggcaccaggggc

SEQ ID NO: 583195 - DNA, 14 bp, Homo sapiens
cggttcctggtgac

SEQ ID NO: 583196 - DNA, 18 bp, Homo sapiens
cggttcctggtgactcct

SEQ ID NO: 583197 - DNA, 17 bp, Homo sapiens
cgtagcttcagccaggc

SEQ ID NO: 583198 - DNA, 15 bp, Homo sapiens
cgtattaaaaaacaa

SEQ ID NO: 583199 - DNA, 23 bp, Homo sapiens
cgtattaaaaaacaattaactgc

SEQ ID NO: 583200 - DNA, 15 bp, Homo sapiens
cgtctctgccctggg

SEQ ID NO: 583201 - DNA, 23 bp, Homo sapiens
cgtggagccattgaacagctgtg

SEQ ID NO: 583202 - DNA, 20 bp, Homo sapiens
cgtggggaacggaggaggac

SEQ ID NO: 583203 - DNA, 18 bp, Homo sapiens
cgtttataaacagaaatg

SEQ ID NO: 583204 - DNA, 21 bp, Homo sapiens
cgtttttgtattttcatgaaa

SEQ ID NO: 583205 - DNA, 23 bp, Homo sapiens
ctaaatatgaatgaatgggatat

SEQ ID NO: 583206 - DNA, 13 bp, Homo sapiens
ctaaatgtgtaat

SEQ ID NO: 583207 - DNA, 23 bp, Homo sapiens
ctaaatgtgtaataatgtaacat

SEQ ID NO: 583208 - DNA, 20 bp, Homo sapiens
ctaacagtgaagttttactg

SEQ ID NO: 583209 - DNA, 20 bp, Homo sapiens
ctaaggcacccacaaataaa

SEQ ID NO: 583210 - DNA, 18 bp, Homo sapiens
ctaagtagggccagggca

SEQ ID NO: 583211 - DNA, 15 bp, Homo sapiens
ctacactcacctgca

SEQ ID NO: 583212 - DNA, 19 bp, Homo sapiens
ctacagttttaactgtgga

SEQ ID NO: 583213 - DNA, 17 bp, Homo sapiens
ctaccaatacaaaatgt

SEQ ID NO: 583214 - DNA, 20 bp, Homo sapiens
ctacccaggaggctgaggtg

SEQ ID NO: 583215 - DNA, 14 bp, Homo sapiens
ctaccccttcctgt

SEQ ID NO: 583216 - DNA, 16 bp, Homo sapiens
ctacctactggtgtaa

SEQ ID NO: 583217 - DNA, 12 bp, Homo sapiens
ctacctccctcc

SEQ ID NO: 583218 - DNA, 17 bp, Homo sapiens
ctacctccctccctctc

SEQ ID NO: 583219 - DNA, 16 bp, Homo sapiens
ctacctggggactcct

SEQ ID NO: 583220 - DNA, 17 bp, Homo sapiens
ctacctggggactcctc

SEQ ID NO: 583221 - DNA, 15 bp, Homo sapiens
ctactagattgacta

SEQ ID NO: 583222 - DNA, 20 bp, Homo sapiens
ctactcaggaggctgaggca

SEQ ID NO: 583223 - DNA, 23 bp, Homo sapiens
ctactgttatcagtaatgctaaa

SEQ ID NO: 583224 - DNA, 16 bp, Homo sapiens
ctacttcccactgtat

SEQ ID NO: 583225 - DNA, 22 bp, Homo sapiens
ctagcattgtaaaattatttca

SEQ ID NO: 583226 - DNA, 23 bp, Homo sapiens
ctagcattgtaaaattatttcat

SEQ ID NO: 583227 - DNA, 13 bp, Homo sapiens
ctagctggctctg

SEQ ID NO: 583228 - DNA, 14 bp, Homo sapiens
ctagctggctctgt

SEQ ID NO: 583229 - DNA, 23 bp, Homo sapiens
ctagctgtgtgaatacctgctca

SEQ ID NO: 583230 - DNA, 15 bp, Homo sapiens
ctaggacacagttcc

SEQ ID NO: 583231 - DNA, 20 bp, Homo sapiens
ctaggatgttgctcagaagt

SEQ ID NO: 583232 - DNA, 16 bp, Homo sapiens
ctagggccttggaaat

SEQ ID NO: 583233 - DNA, 19 bp, Homo sapiens
ctaggtacgatgacagtgt

SEQ ID NO: 583234 - DNA, 22 bp, Homo sapiens
ctagtaagaagacaaactgctt

SEQ ID NO: 583235 - DNA, 22 bp, Homo sapiens
ctagtggtatggggctgagccc

SEQ ID NO: 583236 - DNA, 16 bp, Homo sapiens
ctagttctaacagtga

SEQ ID NO: 583237 - DNA, 22 bp, Homo sapiens
ctataagatgaaacatcatttc

SEQ ID NO: 583238 - DNA, 13 bp, Homo sapiens
ctatacacacaca

SEQ ID NO: 583239 - DNA, 14 bp, Homo sapiens
ctatacacacacac

SEQ ID NO: 583240 - DNA, 15 bp, Homo sapiens
ctatacacacacaca

SEQ ID NO: 583241 - DNA, 13 bp, Homo sapiens
ctatactgcctct

SEQ ID NO: 583242 - DNA, 13 bp, Homo sapiens
ctatagtcccagc

SEQ ID NO: 583243 - DNA, 14 bp, Homo sapiens
ctatatatataaat

SEQ ID NO: 583244 - DNA, 17 bp, Homo sapiens
ctatatatataaatgta

SEQ ID NO: 583245 - DNA, 17 bp, Homo sapiens
ctatccacactgtcaaa

SEQ ID NO: 583246 - DNA, 15 bp, Homo sapiens
ctatcttctttggac

SEQ ID NO: 583247 - DNA, 22 bp, Homo sapiens
ctatcttctttggacttctgaa

SEQ ID NO: 583248 - DNA, 19 bp, Homo sapiens
ctatgggtctaggacacag

SEQ ID NO: 583249 - DNA, 13 bp, Homo sapiens
ctatgtctggcag

SEQ ID NO: 583250 - DNA, 15 bp, Homo sapiens
ctatgtctggcagat

SEQ ID NO: 583251 - DNA, 15 bp, Homo sapiens
ctattagcggctcct

SEQ ID NO: 583252 - DNA, 22 bp, Homo sapiens
ctattctataaaactctgcatg

SEQ ID NO: 583253 - DNA, 20 bp, Homo sapiens
ctatttaaatccttggcttc

SEQ ID NO: 583254 - DNA, 16 bp, Homo sapiens
ctatttttatgatgac

SEQ ID NO: 583255 - DNA, 17 bp, Homo sapiens
ctatttttatgatgaca

SEQ ID NO: 583256 - DNA, 13 bp, Homo sapiens
ctatttttgtgaa

SEQ ID NO: 583257 - DNA, 22 bp, Homo sapiens
ctcaaagatgcgtttgcctcct

SEQ ID NO: 583258 - DNA, 23 bp, Homo sapiens
ctcaaagatgcgtttgcctcctg

SEQ ID NO: 583259 - DNA, 15 bp, Homo sapiens
ctcaaagcagcagga

SEQ ID NO: 583260 - DNA, 15 bp, Homo sapiens
ctcaaatacacattt

SEQ ID NO: 583261 - DNA, 14 bp, Homo sapiens
cttctattggtctc

SEQ ID NO: 583262 - DNA, 23 bp, Homo sapiens
cttctcagtccagcagtttccag

SEQ ID NO: 583263 - DNA, 21 bp, Homo sapiens
cttctgaagagaccactcaat

SEQ ID NO: 583264 - DNA, 17 bp, Homo sapiens
cttctgggtccagggag

SEQ ID NO: 583265 - DNA, 20 bp, Homo sapiens
cttctgtaattgtgtggatt

SEQ ID NO: 583266 - DNA, 19 bp, Homo sapiens
cttcttcccctttgtcctg

SEQ ID NO: 583267 - DNA, 21 bp, Homo sapiens
cttcttcccctttgtcctgcg

SEQ ID NO: 583268 - DNA, 22 bp, Homo sapiens
cttcttcccctttgtcctgcgt

SEQ ID NO: 583269 - DNA, 19 bp, Homo sapiens
cttctttggacttctgaag

SEQ ID NO: 583270 - DNA, 20 bp, Homo sapiens
cttctttggacttctgaaga

SEQ ID NO: 583271 - DNA, 16 bp, Homo sapiens
cttgaaaaaaaacagt

SEQ ID NO: 583272 - DNA, 16 bp, Homo sapiens
cttgaaactttgggaa

SEQ ID NO: 583273 - DNA, 14 bp, Homo sapiens
cttgcagaactgta

SEQ ID NO: 583274 - DNA, 15 bp, Homo sapiens
cttgccactgcactc

SEQ ID NO: 583275 - DNA, 15 bp, Homo sapiens
cttgccatcctgatg

SEQ ID NO: 583276 - DNA, 15 bp, Homo sapiens
cttgcctctgcacac

SEQ ID NO: 583277 - DNA, 16 bp, Homo sapiens
cttggaaattcctgta

SEQ ID NO: 583278 - DNA, 17 bp, Homo sapiens
cttggagaatactgcca

SEQ ID NO: 583279 - DNA, 18 bp, Homo sapiens
cttggagaatactgccaa

SEQ ID NO: 583280 - DNA, 14 bp, Homo sapiens
cttgggtgaatttc

SEQ ID NO: 583281 - DNA, 19 bp, Homo sapiens
cttggtggcttttccttga

SEQ ID NO: 583282 - DNA, 20 bp, Homo sapiens
cttgtcagttccaaacagac

SEQ ID NO: 583283 - DNA, 14 bp, Homo sapiens
cttgtctgatttct

SEQ ID NO: 583284 - DNA, 21 bp, Homo sapiens
cttgtcttctggtactttctg

SEQ ID NO: 583285 - DNA, 15 bp, Homo sapiens
cttgtggtggggcag

SEQ ID NO: 583286 - DNA, 16 bp, Homo sapiens
cttgttgcactgcccc

SEQ ID NO: 583287 - DNA, 18 bp, Homo sapiens
cttgttgcactgccccct

SEQ ID NO: 583288 - DNA, 19 bp, Homo sapiens
cttgttgcactgccccctg

SEQ ID NO: 583289 - DNA, 19 bp, Homo sapiens
cttgtttacctttctctct

SEQ ID NO: 583290 - DNA, 17 bp, Homo sapiens
cttgttttggatggctt

SEQ ID NO: 583291 - DNA, 18 bp, Homo sapiens
ctttaacaacctctgagc

SEQ ID NO: 583292 - DNA, 14 bp, Homo sapiens
ctttagtttttggt

SEQ ID NO: 583293 - DNA, 23 bp, Homo sapiens
ctttagtttttggttgggaatga

SEQ ID NO: 583294 - DNA, 15 bp, Homo sapiens
ctttattaatgtttt

SEQ ID NO: 583295 - DNA, 14 bp, Homo sapiens
ctttattgcaatgc

SEQ ID NO: 583296 - DNA, 19 bp, Homo sapiens
ctttcaagaatcagacagc

SEQ ID NO: 583297 - DNA, 15 bp, Homo sapiens
ctttcagaaatataa

SEQ ID NO: 583298 - DNA, 21 bp, Homo sapiens
ctttcagaaatataacacatt

SEQ ID NO: 583299 - DNA, 23 bp, Homo sapiens
ctttctatttttatgatgacaat

SEQ ID NO: 583300 - DNA, 16 bp, Homo sapiens
ctttctccctgcagcc

SEQ ID NO: 583301 - DNA, 21 bp, Homo sapiens
ctttgacaattgggagctgcc

SEQ ID NO: 583302 - DNA, 23 bp, Homo sapiens
ctttgacaattgggagctgccaa

SEQ ID NO: 583303 - DNA, 21 bp, Homo sapiens
ctttgacctaaattatttact

SEQ ID NO: 583304 - DNA, 21 bp, Homo sapiens
ctttggaagatgcagaagcaa

SEQ ID NO: 583305 - DNA, 17 bp, Homo sapiens
ctttgggaggctgaggt

SEQ ID NO: 583306 - DNA, 18 bp, Homo sapiens
ctttggggctaatttaac

SEQ ID NO: 583307 - DNA, 21 bp, Homo sapiens
ctttggtgcgggcacaataaa

SEQ ID NO: 583308 - DNA, 14 bp, Homo sapiens
ctttgtcagtgttg

SEQ ID NO: 583309 - DNA, 13 bp, Homo sapiens
ctttgtgaccaga

SEQ ID NO: 583310 - DNA, 21 bp, Homo sapiens
cttttaaaaaatactctgcta

SEQ ID NO: 583311 - DNA, 18 bp, Homo sapiens
cttttaaagaccctccta

SEQ ID NO: 583312 - DNA, 16 bp, Homo sapiens
cttttaccactcccag

SEQ ID NO: 583313 - DNA, 15 bp, Homo sapiens
cttttctggtccctc

SEQ ID NO: 583314 - DNA, 21 bp, Homo sapiens
cttttgaagcatagataatat

SEQ ID NO: 583315 - DNA, 14 bp, Homo sapiens
cttttggcctcctg

SEQ ID NO: 583316 - DNA, 22 bp, Homo sapiens
ctttttaaagaagtgcatgaaa

SEQ ID NO: 583317 - DNA, 20 bp, Homo sapiens
ctttttcatagtaagtgcga

SEQ ID NO: 583318 - DNA, 16 bp, Homo sapiens
ctttttcccaataaat

SEQ ID NO: 583319 - DNA, 12 bp, Homo sapiens
gaaaacagaaaa

SEQ ID NO: 583320 - DNA, 16 bp, Homo sapiens
gaaaacatgttaatga

SEQ ID NO: 583321 - DNA, 20 bp, Homo sapiens
gaaaacatgttaatgacaat

SEQ ID NO: 583322 - DNA, 16 bp, Homo sapiens
gaaaatataatgatca

SEQ ID NO: 583323 - DNA, 15 bp, Homo sapiens
gaaaatttgccaatc

SEQ ID NO: 583324 - DNA, 20 bp, Homo sapiens
gaaacactatttgtgacttt

SEQ ID NO: 583325 - DNA, 23 bp, Homo sapiens
gaaacactatttgtgacttttta

SEQ ID NO: 583326 - DNA, 18 bp, Homo sapiens
gaaactcatagacactga

SEQ ID NO: 583327 - DNA, 21 bp, Homo sapiens
gaaactttgggaaaacatgtt

SEQ ID NO: 583328 - DNA, 13 bp, Homo sapiens
gaaagaatagaac

SEQ ID NO: 583329 - DNA, 22 bp, Homo sapiens
gaaagatgcatcatctcttcct

SEQ ID NO: 583330 - DNA, 23 bp, Homo sapiens
gaaagatgcatcatctcttcctc

SEQ ID NO: 583331 - DNA, 22 bp, Homo sapiens
gaaagcagagttttcattaaat

SEQ ID NO: 583332 - DNA, 15 bp, Homo sapiens
gaaagcttccttcaa

SEQ ID NO: 583333 - DNA, 19 bp, Homo sapiens
gaaagtttttttttattat

SEQ ID NO: 583334 - DNA, 23 bp, Homo sapiens
gaaataatgctacaattttaaga

SEQ ID NO: 583335 - DNA, 13 bp, Homo sapiens
gaaataatgggat

SEQ ID NO: 583336 - DNA, 22 bp, Homo sapiens
gaaatacgtttgtgtttctaga

SEQ ID NO: 583337 - DNA, 21 bp, Homo sapiens
gaaatgaactttgtcagtgtt

SEQ ID NO: 583338 - DNA, 15 bp, Homo sapiens
gaaatggaaagcaga

SEQ ID NO: 583339 - DNA, 15 bp, Homo sapiens
gaaattacctgtgga

SEQ ID NO: 583340 - DNA, 17 bp, Homo sapiens
gaaattacctgtggata

SEQ ID NO: 583341 - DNA, 18 bp, Homo sapiens
gaaattacctgtggatat

SEQ ID NO: 583342 - DNA, 17 bp, Homo sapiens
gaaatttgataatgaca

SEQ ID NO: 583343 - DNA, 23 bp, Homo sapiens
gaacaaagtaaaagtagtgttgt

SEQ ID NO: 583344 - DNA, 13 bp, Homo sapiens
gaacagctgtgag

SEQ ID NO: 583345 - DNA, 16 bp, Homo sapiens
gaacagctgtgagcca

SEQ ID NO: 583346 - DNA, 22 bp, Homo sapiens
gaacataacttctcatgtatat

SEQ ID NO: 583347 - DNA, 19 bp, Homo sapiens
gaaccagcagaaatgcccc

SEQ ID NO: 583348 - DNA, 14 bp, Homo sapiens
gaaccctcttgcca

SEQ ID NO: 583349 - DNA, 12 bp, Homo sapiens
gaacctgtgggc

SEQ ID NO: 583350 - DNA, 16 bp, Homo sapiens
gaacgaaaatgaaagc

SEQ ID NO: 583351 - DNA, 18 bp, Homo sapiens
gaactagccaaaccagga

SEQ ID NO: 583352 - DNA, 15 bp, Homo sapiens
gaactaggctgagca

SEQ ID NO: 583353 - DNA, 20 bp, Homo sapiens
gaactgtagctgccatggct

SEQ ID NO: 583354 - DNA, 20 bp, Homo sapiens
gaacttcagcattgtaatta

SEQ ID NO: 583355 - DNA, 13 bp, Homo sapiens
gaactttgtcagt

SEQ ID NO: 583356 - DNA, 15 bp, Homo sapiens
gaactttttaaagaa

SEQ ID NO: 583357 - DNA, 20 bp, Homo sapiens
gaactttttaaagaagtgca

SEQ ID NO: 583358 - DNA, 16 bp, Homo sapiens
gaagaatgaaagctgt

SEQ ID NO: 583359 - DNA, 15 bp, Homo sapiens
gaagactgagccaga

SEQ ID NO: 583360 - DNA, 11 bp, Homo sapiens
gaagagaccac

SEQ ID NO: 583361 - DNA, 14 bp, Homo sapiens
gaagagagttctgg

SEQ ID NO: 583362 - DNA, 21 bp, Homo sapiens
gaagagttcccttgaaacttt

SEQ ID NO: 583363 - DNA, 17 bp, Homo sapiens
gaagcaataataaagta

SEQ ID NO: 583364 - DNA, 21 bp, Homo sapiens
gaagccatagatgctggctgg

SEQ ID NO: 583365 - DNA, 14 bp, Homo sapiens
gaagcccctgggcc

SEQ ID NO: 583366 - DNA, 18 bp, Homo sapiens
gaagctgccgtagcttca

SEQ ID NO: 583367 - DNA, 20 bp, Homo sapiens
gaagctgccgtagcttcagc

SEQ ID NO: 583368 - DNA, 22 bp, Homo sapiens
gaagggcctgcccagttgcact

SEQ ID NO: 583369 - DNA, 14 bp, Homo sapiens
gaagtcagaatttt

SEQ ID NO: 583370 - DNA, 14 bp, Homo sapiens
ggcctcaggctccg

SEQ ID NO: 583371 - DNA, 12 bp, Homo sapiens
ggccttggaaat

SEQ ID NO: 583372 - DNA, 22 bp, Homo sapiens
ggcctttctcctccccacctgt

SEQ ID NO: 583373 - DNA, 15 bp, Homo sapiens
ggcggcatgaaccct

SEQ ID NO: 583374 - DNA, 12 bp, Homo sapiens
ggctaatttaac

SEQ ID NO: 583375 - DNA, 19 bp, Homo sapiens
ggctccgggcaccaggggc

SEQ ID NO: 583376 - DNA, 14 bp, Homo sapiens
ggctcctgttttgc

SEQ ID NO: 583377 - DNA, 14 bp, Homo sapiens
ggctcttcttcctc

SEQ ID NO: 583378 - DNA, 15 bp, Homo sapiens
ggctgccgttttctg

SEQ ID NO: 583379 - DNA, 23 bp, Homo sapiens
ggctggaaggacctgctcccaca

SEQ ID NO: 583380 - DNA, 20 bp, Homo sapiens
gggaccaggtttgcaggagc

SEQ ID NO: 583381 - DNA, 23 bp, Homo sapiens
gggagaccccttgttgcactgcc

SEQ ID NO: 583382 - DNA, 20 bp, Homo sapiens
gggaggcagaggttgcagtg

SEQ ID NO: 583383 - DNA, 16 bp, Homo sapiens
gggaggttgtggggcc

SEQ ID NO: 583384 - DNA, 23 bp, Homo sapiens
gggaggttgtggggcctcaggct

SEQ ID NO: 583385 - DNA, 22 bp, Homo sapiens
gggatattttgaaatgaacttt

SEQ ID NO: 583386 - DNA, 21 bp, Homo sapiens
gggcaagcctaagggatcctg

SEQ ID NO: 583387 - DNA, 19 bp, Homo sapiens
gggcaccgtattcctctcc

SEQ ID NO: 583388 - DNA, 22 bp, Homo sapiens
gggcaccgtattcctctcccag

SEQ ID NO: 583389 - DNA, 19 bp, Homo sapiens
gggccacatagatgctgat

SEQ ID NO: 583390 - DNA, 11 bp, Homo sapiens
gggccacctcc

SEQ ID NO: 583391 - DNA, 22 bp, Homo sapiens
gggccataaacggttcctggtg

SEQ ID NO: 583392 - DNA, 23 bp, Homo sapiens
gggccctggagctcagggtcctt

SEQ ID NO: 583393 - DNA, 15 bp, Homo sapiens
gggcctcaggctccg

SEQ ID NO: 583394 - DNA, 13 bp, Homo sapiens
gggctaatttaac

SEQ ID NO: 583395 - DNA, 17 bp, Homo sapiens
gggctgagccctcctga

SEQ ID NO: 583396 - DNA, 20 bp, Homo sapiens
gggctgcccacctggctgcc

SEQ ID NO: 583397 - DNA, 16 bp, Homo sapiens
gggctggaaggacctg

SEQ ID NO: 583398 - DNA, 22 bp, Homo sapiens
gggctggctgccgttttctggg

SEQ ID NO: 583399 - DNA, 20 bp, Homo sapiens
gggcttaatggagttcttgt

SEQ ID NO: 583400 - DNA, 20 bp, Homo sapiens
ggggactcctcaaaccactt

SEQ ID NO: 583401 - DNA, 17 bp, Homo sapiens
ggggaggttgtggggcc

SEQ ID NO: 583402 - DNA, 19 bp, Homo sapiens
ggggcattgagtattgttt

SEQ ID NO: 583403 - DNA, 17 bp, Homo sapiens
ggggccaacctcaggct

SEQ ID NO: 583404 - DNA, 19 bp, Homo sapiens
ggggccaacctcaggctcc

SEQ ID NO: 583405 - DNA, 20 bp, Homo sapiens
ggggccaacctcaggctcct

SEQ ID NO: 583406 - DNA, 14 bp, Homo sapiens
ggggccacctctgg

SEQ ID NO: 583407 - DNA, 12 bp, Homo sapiens
ggggccaggaaa

SEQ ID NO: 583408 - DNA, 21 bp, Homo sapiens
ggggccataaacggttcctgg

SEQ ID NO: 583409 - DNA, 14 bp, Homo sapiens
ggggctaatttaac

SEQ ID NO: 583410 - DNA, 18 bp, Homo sapiens
ggggctgagccctcctga

SEQ ID NO: 583411 - DNA, 23 bp, Homo sapiens
ggggctgagccctcctgagggcc

SEQ ID NO: 583412 - DNA, 12 bp, Homo sapiens
ggggtccctgca

SEQ ID NO: 583413 - DNA, 14 bp, Homo sapiens
ggggtcggctcctg

SEQ ID NO: 583414 - DNA, 14 bp, Homo sapiens
gggtcccctccgcc

SEQ ID NO: 583415 - DNA, 23 bp, Homo sapiens
gggtctaccaatacaaaatgtat

SEQ ID NO: 583416 - DNA, 12 bp, Homo sapiens
ggtaaatgtttc

SEQ ID NO: 583417 - DNA, 13 bp, Homo sapiens
ggtaaatgtttct

SEQ ID NO: 583418 - DNA, 15 bp, Homo sapiens
ggtagtctcactgct

SEQ ID NO: 583419 - DNA, 23 bp, Homo sapiens
ggtcctcctaagtcccttcctat

SEQ ID NO: 583420 - DNA, 18 bp, Homo sapiens
ggtctataagatgaaaca

SEQ ID NO: 583421 - DNA, 19 bp, Homo sapiens
ggtgccctttcctggcagt

SEQ ID NO: 583422 - DNA, 22 bp, Homo sapiens
ggtggaagtgtgtgccaagagc

SEQ ID NO: 583423 - DNA, 19 bp, Homo sapiens
ggtggctcacgcctgtaat

SEQ ID NO: 583424 - DNA, 20 bp, Homo sapiens
ggtgggcagatcacgaggtc

SEQ ID NO: 583425 - DNA, 23 bp, Homo sapiens
ggtggggccataaacggttcctg

SEQ ID NO: 583426 - DNA, 20 bp, Homo sapiens
ggtgtcattctgcctgctcc

SEQ ID NO: 583427 - DNA, 15 bp, Homo sapiens
ggtgtggtgaatgtg

SEQ ID NO: 583428 - DNA, 14 bp, Homo sapiens
ggtgtgtgaagttt

SEQ ID NO: 583429 - DNA, 23 bp, Homo sapiens
ggttcaacaaagaaacaaagatg

SEQ ID NO: 583430 - DNA, 17 bp, Homo sapiens
ggttcctggtgactcct

SEQ ID NO: 583431 - DNA, 18 bp, Homo sapiens
ggttcctggtgactcctg

SEQ ID NO: 583432 - DNA, 21 bp, Homo sapiens
ggttcggctctagggcctcag

SEQ ID NO: 583433 - DNA, 20 bp, Homo sapiens
ggttgagggcaatggacaag

SEQ ID NO: 583434 - DNA, 16 bp, Homo sapiens
ggttgctcacagctgt

SEQ ID NO: 583435 - DNA, 15 bp, Homo sapiens
ggttggcagcatctg

SEQ ID NO: 583436 - DNA, 19 bp, Homo sapiens
gtaaaatttcccattaaag

SEQ ID NO: 583437 - DNA, 17 bp, Homo sapiens
gtaaataatttgcactg

SEQ ID NO: 583438 - DNA, 20 bp, Homo sapiens
gtaacactagggccttggaa

SEQ ID NO: 583439 - DNA, 13 bp, Homo sapiens
gtaagaattctga

SEQ ID NO: 583440 - DNA, 18 bp, Homo sapiens
gtaaggatccggaaagaa

SEQ ID NO: 583441 - DNA, 13 bp, Homo sapiens
gtaataagcactg

SEQ ID NO: 583442 - DNA, 20 bp, Homo sapiens
gtaataagcactgtaaactt

SEQ ID NO: 583443 - DNA, 14 bp, Homo sapiens
gtaatctatgttta

SEQ ID NO: 583444 - DNA, 15 bp, Homo sapiens
gtaatctatgtttat

SEQ ID NO: 583445 - DNA, 20 bp, Homo sapiens
gtaatctatgtttataatac

SEQ ID NO: 583446 - DNA, 15 bp, Homo sapiens
gtaatctcaatgcaa

SEQ ID NO: 583447 - DNA, 20 bp, Homo sapiens
gtaattatgtaaataactct

SEQ ID NO: 583448 - DNA, 16 bp, Homo sapiens
gtacaaaatggtccta

SEQ ID NO: 583449 - DNA, 17 bp, Homo sapiens
gtacctagctggctctg

SEQ ID NO: 583450 - DNA, 18 bp, Homo sapiens
gtacctccagtcacactc

SEQ ID NO: 583451 - DNA, 14 bp, Homo sapiens
gtagagccaattag

SEQ ID NO: 583452 - DNA, 15 bp, Homo sapiens
gtagatccatttcca

SEQ ID NO: 583453 - DNA, 22 bp, Homo sapiens
gtagatccatttccattgctta

SEQ ID NO: 583454 - DNA, 16 bp, Homo sapiens
gtagcatcttcctctg

SEQ ID NO: 583455 - DNA, 18 bp, Homo sapiens
gtagcatcttcctctgca

SEQ ID NO: 583456 - DNA, 20 bp, Homo sapiens
gtagctattagcggctcctc

SEQ ID NO: 583457 - DNA, 15 bp, Homo sapiens
gtagctgaagcagga

SEQ ID NO: 583458 - DNA, 14 bp, Homo sapiens
gtagcttcagccag

SEQ ID NO: 583459 - DNA, 13 bp, Homo sapiens
gtatatattttgt

SEQ ID NO: 583460 - DNA, 22 bp, Homo sapiens
gtatatattttgtgtgaaattg

SEQ ID NO: 583461 - DNA, 20 bp, Homo sapiens
gtatatgactgcatttgtgt

SEQ ID NO: 583462 - DNA, 18 bp, Homo sapiens
gtatattacccaatggaa

SEQ ID NO: 583463 - DNA, 23 bp, Homo sapiens
gtatattcaggacttgaaagaaa

SEQ ID NO: 583464 - DNA, 11 bp, Homo sapiens
gtatgggctgg

SEQ ID NO: 583465 - DNA, 21 bp, Homo sapiens
gtattaaaaaacaattaactg

SEQ ID NO: 583466 - DNA, 21 bp, Homo sapiens
gtattcccaaaaattactttg

SEQ ID NO: 583467 - DNA, 18 bp, Homo sapiens
gtattgtttaaaatgtaa

SEQ ID NO: 583468 - DNA, 19 bp, Homo sapiens
gtatttattttttcttttc

SEQ ID NO: 583469 - DNA, 22 bp, Homo sapiens
gtcaaatgcatacaagtttcat

SEQ ID NO: 583470 - DNA, 22 bp, Homo sapiens
gtcaagggctgtcattgcacat

SEQ ID NO: 583471 - DNA, 19 bp, Homo sapiens
gtcagctgggatgtgaagt

SEQ ID NO: 583472 - DNA, 13 bp, Homo sapiens
gtcattctgcctg

SEQ ID NO: 583473 - DNA, 15 bp, Homo sapiens
gtcattctgcctgct

SEQ ID NO: 583474 - DNA, 19 bp, Homo sapiens
gtcattgcacataagcttc

SEQ ID NO: 583475 - DNA, 18 bp, Homo sapiens
gtccaaaatttatatttt

SEQ ID NO: 583476 - DNA, 21 bp, Homo sapiens
gtccaaaatttatattttaga

SEQ ID NO: 583477 - DNA, 13 bp, Homo sapiens
gtcccagcctggt

SEQ ID NO: 583478 - DNA, 13 bp, Homo sapiens
gtcccctccgcca

SEQ ID NO: 583479 - DNA, 18 bp, Homo sapiens
tagcagccagttcaaaaa

SEQ ID NO: 583480 - DNA, 13 bp, Homo sapiens
tagcatcttcctc

SEQ ID NO: 583481 - DNA, 20 bp, Homo sapiens
tagcctaaggctcctgtttt

SEQ ID NO: 583482 - DNA, 14 bp, Homo sapiens
tagcctatgtctgg

SEQ ID NO: 583483 - DNA, 20 bp, Homo sapiens
tagcctatgtctggcagatg

SEQ ID NO: 583484 - DNA, 23 bp, Homo sapiens
tagcggctcctcgcccccaccag

SEQ ID NO: 583485 - DNA, 16 bp, Homo sapiens
tagctcctccccttcc

SEQ ID NO: 583486 - DNA, 20 bp, Homo sapiens
tagctgaggctgagaaagct

SEQ ID NO: 583487 - DNA, 23 bp, Homo sapiens
tagctgaggctgagaaagctaaa

SEQ ID NO: 583488 - DNA, 22 bp, Homo sapiens
tagctggctctgtgagggtgct

SEQ ID NO: 583489 - DNA, 19 bp, Homo sapiens
taggacacagttcctggga

SEQ ID NO: 583490 - DNA, 19 bp, Homo sapiens
taggagtggtgatttgaaa

SEQ ID NO: 583491 - DNA, 22 bp, Homo sapiens
taggccacagaaggtgaacttt

SEQ ID NO: 583492 - DNA, 17 bp, Homo sapiens
taggtgttcaggccagt

SEQ ID NO: 583493 - DNA, 19 bp, Homo sapiens
taggttctgtagagccaat

SEQ ID NO: 583494 - DNA, 11 bp, Homo sapiens
tagtaagaata

SEQ ID NO: 583495 - DNA, 13 bp, Homo sapiens
tagtctaagacta

SEQ ID NO: 583496 - DNA, 19 bp, Homo sapiens
tagtctcactgcttgaact

SEQ ID NO: 583497 - DNA, 20 bp, Homo sapiens
tataaaattatgagattggt

SEQ ID NO: 583498 - DNA, 14 bp, Homo sapiens
tataaatatacagt

SEQ ID NO: 583499 - DNA, 14 bp, Homo sapiens
tataaatgtataaa

SEQ ID NO: 583500 - DNA, 23 bp, Homo sapiens
tataataggaacaatctttgctg

SEQ ID NO: 583501 - DNA, 14 bp, Homo sapiens
tatacacacacaca

SEQ ID NO: 583502 - DNA, 22 bp, Homo sapiens
tatacagtatagatttttgggt

SEQ ID NO: 583503 - DNA, 19 bp, Homo sapiens
tatacatcaatatgtatat

SEQ ID NO: 583504 - DNA, 21 bp, Homo sapiens
tatacatcaatatgtatatat

SEQ ID NO: 583505 - DNA, 18 bp, Homo sapiens
tatacatgtgatacattt

SEQ ID NO: 583506 - DNA, 18 bp, Homo sapiens
tatagtctaagactatat

SEQ ID NO: 583507 - DNA, 19 bp, Homo sapiens
tatagtctaagactatata

SEQ ID NO: 583508 - DNA, 12 bp, Homo sapiens
tatataaatgta

SEQ ID NO: 583509 - DNA, 21 bp, Homo sapiens
tatatagaatgatctattgct

SEQ ID NO: 583510 - DNA, 13 bp, Homo sapiens
tatatataaatgt

SEQ ID NO: 583511 - DNA, 11 bp, Homo sapiens
tatatatatat

SEQ ID NO: 583512 - DNA, 14 bp, Homo sapiens
tatatatatatata

SEQ ID NO: 583513 - DNA, 19 bp, Homo sapiens
tatatgactgcatttgtgt

SEQ ID NO: 583514 - DNA, 15 bp, Homo sapiens
tatatgtatttctat

SEQ ID NO: 583515 - DNA, 23 bp, Homo sapiens
tatattactgacatttcttctag

SEQ ID NO: 583516 - DNA, 15 bp, Homo sapiens
tatatttcaataaat

SEQ ID NO: 583517 - DNA, 14 bp, Homo sapiens
tatattttcagtac

SEQ ID NO: 583518 - DNA, 18 bp, Homo sapiens
tatattttgtgtgaaatt

SEQ ID NO: 583519 - DNA, 19 bp, Homo sapiens
tatattttgtgtgaaattg

SEQ ID NO: 583520 - DNA, 21 bp, Homo sapiens
tatatttttttaactgtgata

SEQ ID NO: 583521 - DNA, 23 bp, Homo sapiens
tatcactgccttcgtttatattt

SEQ ID NO: 583522 - DNA, 15 bp, Homo sapiens
tatcagtaatgctaa

SEQ ID NO: 583523 - DNA, 14 bp, Homo sapiens
tatccaactttttc

SEQ ID NO: 583524 - DNA, 17 bp, Homo sapiens
tatccaactttttcata

SEQ ID NO: 583525 - DNA, 23 bp, Homo sapiens
tatcggcagatgatgctttggaa

SEQ ID NO: 583526 - DNA, 12 bp, Homo sapiens
tatcgtttttgt

SEQ ID NO: 583527 - DNA, 22 bp, Homo sapiens
tatctcaatgaaccataaattc

SEQ ID NO: 583528 - DNA, 18 bp, Homo sapiens
tatctgggctgtgggcaa

SEQ ID NO: 583529 - DNA, 15 bp, Homo sapiens
tatgaatgaaacatg

SEQ ID NO: 583530 - DNA, 23 bp, Homo sapiens
tatgacaagctgtatcactgcct

SEQ ID NO: 583531 - DNA, 12 bp, Homo sapiens
tatgcaattcag

SEQ ID NO: 583532 - DNA, 19 bp, Homo sapiens
tatgccattggggtagttg

SEQ ID NO: 583533 - DNA, 21 bp, Homo sapiens
tatgtaggtaagactgtagat

SEQ ID NO: 583534 - DNA, 15 bp, Homo sapiens
tatgtcagtactatt

SEQ ID NO: 583535 - DNA, 19 bp, Homo sapiens
tatgtgggatattgaatgt

SEQ ID NO: 583536 - DNA, 21 bp, Homo sapiens
tatgtgggatattgaatgtta

SEQ ID NO: 583537 - DNA, 14 bp, Homo sapiens
tatgttaaagagaa

SEQ ID NO: 583538 - DNA, 17 bp, Homo sapiens
tattaaaactaaatttc

SEQ ID NO: 583539 - DNA, 23 bp, Homo sapiens
tattaaataacatgtttctctat

SEQ ID NO: 583540 - DNA, 16 bp, Homo sapiens
tattactgacatttct

SEQ ID NO: 583541 - DNA, 17 bp, Homo sapiens
tattactgacatttctt

SEQ ID NO: 583542 - DNA, 15 bp, Homo sapiens
tattagcggctcctc

SEQ ID NO: 583543 - DNA, 20 bp, Homo sapiens
tattcaggacttgaaagaaa

SEQ ID NO: 583544 - DNA, 18 bp, Homo sapiens
tattgattgggaaaacat

SEQ ID NO: 583545 - DNA, 19 bp, Homo sapiens
tattgattgggaaaacatt

SEQ ID NO: 583546 - DNA, 12 bp, Homo sapiens
tattgcaatgca

SEQ ID NO: 583547 - DNA, 23 bp, Homo sapiens
tattgctgtgagccttgcatgac

SEQ ID NO: 583548 - DNA, 22 bp, Homo sapiens
tattgttacgtagcctaaggct

SEQ ID NO: 583549 - DNA, 17 bp, Homo sapiens
tattgtttaaaatgtaa

SEQ ID NO: 583550 - DNA, 15 bp, Homo sapiens
tattgtttggtaaat

SEQ ID NO: 583551 - DNA, 16 bp, Homo sapiens
tattgtttggtaaatg

SEQ ID NO: 583552 - DNA, 17 bp, Homo sapiens
tattgtttggtaaatgt

SEQ ID NO: 583553 - DNA, 15 bp, Homo sapiens
tatttcaataaatga

SEQ ID NO: 583554 - DNA, 12 bp, Homo sapiens
tatttctatata

SEQ ID NO: 583555 - DNA, 13 bp, Homo sapiens
tatttgttcatta

SEQ ID NO: 583556 - DNA, 12 bp, Homo sapiens
tattttcagtac

SEQ ID NO: 583557 - DNA, 14 bp, Homo sapiens
tattttgaaatgaa

SEQ ID NO: 583558 - DNA, 15 bp, Homo sapiens
tattttgtgtgaaat

SEQ ID NO: 583559 - DNA, 13 bp, Homo sapiens
tattttttaagaa

SEQ ID NO: 583560 - DNA, 19 bp, Homo sapiens
tattttttgaatctatgaa

SEQ ID NO: 583561 - DNA, 16 bp, Homo sapiens
tatttttttaactgtg

SEQ ID NO: 583562 - DNA, 17 bp, Homo sapiens
tatttttttaactgtga

SEQ ID NO: 583563 - DNA, 19 bp, Homo sapiens
tattttttttttcttcttg

SEQ ID NO: 583564 - DNA, 21 bp, Homo sapiens
tattttttttttcttcttggg

SEQ ID NO: 583565 - DNA, 20 bp, Homo sapiens
tcaaaaggtattatacatgt

SEQ ID NO: 583566 - DNA, 20 bp, Homo sapiens
tcaaaatatattttcagtac

SEQ ID NO: 583567 - DNA, 19 bp, Homo sapiens
tcaaaccacttgcctgggg

SEQ ID NO: 583568 - DNA, 20 bp, Homo sapiens
tcaaaccacttgcctggggc

SEQ ID NO: 583569 - DNA, 19 bp, Homo sapiens
tcaaagccggcctgagaaa

SEQ ID NO: 583570 - DNA, 12 bp, Homo sapiens
tcaaataagaaa

SEQ ID NO: 583571 - DNA, 16 bp, Homo sapiens
tcaacagagactgaat

SEQ ID NO: 583572 - DNA, 14 bp, Homo sapiens
tcaagggctgtagg

SEQ ID NO: 583573 - DNA, 15 bp, Homo sapiens
tcaagggctgtcatt

SEQ ID NO: 583574 - DNA, 13 bp, Homo sapiens
tcaataaatgata

SEQ ID NO: 583575 - DNA, 16 bp, Homo sapiens
tcaataaatgatatat

SEQ ID NO: 583576 - DNA, 19 bp, Homo sapiens
tcaatatgtatatatgtat

SEQ ID NO: 583577 - DNA, 20 bp, Homo sapiens
tcaatccatccatgtacttc

SEQ ID NO: 583578 - DNA, 16 bp, Homo sapiens
tcaatgaaccataaat

SEQ ID NO: 583579 - DNA, 21 bp, Homo sapiens
tcaatgcaagccccaactttc

SEQ ID NO: 583580 - DNA, 17 bp, Homo sapiens
tcaatgtctaaaaacat

SEQ ID NO: 583581 - DNA, 18 bp, Homo sapiens
tcaatgtctaaaaacatt

SEQ ID NO: 583582 - DNA, 20 bp, Homo sapiens
tcacaaaatatattttgttt

SEQ ID NO: 583583 - DNA, 18 bp, Homo sapiens
tcaccatgtgagctcttc

SEQ ID NO: 583584 - DNA, 17 bp, Homo sapiens
tcacgccactgcactcc

SEQ ID NO: 583585 - DNA, 19 bp, Homo sapiens
tcactgcttgaactaggct

SEQ ID NO: 583586 - DNA, 19 bp, Homo sapiens
tcagaaatataacacattt

SEQ ID NO: 583587 - DNA, 20 bp, Homo sapiens
tcagaaatataacacatttt

SEQ ID NO: 583588 - DNA, 16 bp, Homo sapiens
tcagaatttttaactg

SEQ ID NO: 583589 - DNA, 23 bp, Homo sapiens
tgaacctgaaaagggtcagaagg

SEQ ID NO: 583590 - DNA, 16 bp, Homo sapiens
tgaagagggacataag

SEQ ID NO: 583591 - DNA, 20 bp, Homo sapiens
tgaagagggacataagataa

SEQ ID NO: 583592 - DNA, 21 bp, Homo sapiens
tgaagagggacataagataaa

SEQ ID NO: 583593 - DNA, 14 bp, Homo sapiens
tgaagctgcagtga

SEQ ID NO: 583594 - DNA, 15 bp, Homo sapiens
tgaagggaagagaca

SEQ ID NO: 583595 - DNA, 15 bp, Homo sapiens
tgaagtattcacaaa

SEQ ID NO: 583596 - DNA, 13 bp, Homo sapiens
tgaagtttggaga

SEQ ID NO: 583597 - DNA, 16 bp, Homo sapiens
tgaagtttggagatag

SEQ ID NO: 583598 - DNA, 17 bp, Homo sapiens
tgaagttttactgtcta

SEQ ID NO: 583599 - DNA, 14 bp, Homo sapiens
tgaatacctgctca

SEQ ID NO: 583600 - DNA, 15 bp, Homo sapiens
tgaatgtgtgagaaa

SEQ ID NO: 583601 - DNA, 18 bp, Homo sapiens
tgacaactcattttcata

SEQ ID NO: 583602 - DNA, 19 bp, Homo sapiens
tgacaagctgtatcactgc

SEQ ID NO: 583603 - DNA, 22 bp, Homo sapiens
tgacaagctgtatcactgcctt

SEQ ID NO: 583604 - DNA, 14 bp, Homo sapiens
tgacactgtttcct

SEQ ID NO: 583605 - DNA, 16 bp, Homo sapiens
tgacactgtttcctga

SEQ ID NO: 583606 - DNA, 19 bp, Homo sapiens
tgacactgtttcctgataa

SEQ ID NO: 583607 - DNA, 20 bp, Homo sapiens
tgacaggttttccaaaagta

SEQ ID NO: 583608 - DNA, 14 bp, Homo sapiens
tgacagttcccaga

SEQ ID NO: 583609 - DNA, 16 bp, Homo sapiens
tgacagttcccagagt

SEQ ID NO: 583610 - DNA, 17 bp, Homo sapiens
tgacagttcccagagtg

SEQ ID NO: 583611 - DNA, 19 bp, Homo sapiens
tgacagttcccagagtggg

SEQ ID NO: 583612 - DNA, 23 bp, Homo sapiens
tgacagtttttgacatttatatt

SEQ ID NO: 583613 - DNA, 14 bp, Homo sapiens
tgaccagaaagctt

SEQ ID NO: 583614 - DNA, 14 bp, Homo sapiens
tgaccagtgcctgt

SEQ ID NO: 583615 - DNA, 17 bp, Homo sapiens
tgactaacaggccaaag

SEQ ID NO: 583616 - DNA, 21 bp, Homo sapiens
tgactaacaggccaaagagtc

SEQ ID NO: 583617 - DNA, 15 bp, Homo sapiens
tgactaactcaaata

SEQ ID NO: 583618 - DNA, 13 bp, Homo sapiens
tgactacctactg

SEQ ID NO: 583619 - DNA, 22 bp, Homo sapiens
tgactacctactggtgtaatct

SEQ ID NO: 583620 - DNA, 17 bp, Homo sapiens
tgactaggttctgtaga

SEQ ID NO: 583621 - DNA, 18 bp, Homo sapiens
tgactaggttctgtagag

SEQ ID NO: 583622 - DNA, 14 bp, Homo sapiens
tgactcttatttat

SEQ ID NO: 583623 - DNA, 22 bp, Homo sapiens
tgactgagcaagaccctgtctc

SEQ ID NO: 583624 - DNA, 21 bp, Homo sapiens
tgacttaggtttcaggaagtt

SEQ ID NO: 583625 - DNA, 23 bp, Homo sapiens
tgactttttaaacgattagtgat

SEQ ID NO: 583626 - DNA, 13 bp, Homo sapiens
tgagaaaaactaa

SEQ ID NO: 583627 - DNA, 12 bp, Homo sapiens
tgagaagctctg

SEQ ID NO: 583628 - DNA, 14 bp, Homo sapiens
tgagattctgaagt

SEQ ID NO: 583629 - DNA, 18 bp, Homo sapiens
tgagattctgaagtatga

SEQ ID NO: 583630 - DNA, 21 bp, Homo sapiens
tgagattctgaagtatgaagt

SEQ ID NO: 583631 - DNA, 13 bp, Homo sapiens
tgagattggtttt

SEQ ID NO: 583632 - DNA, 15 bp, Homo sapiens
tgagattggttttcc

SEQ ID NO: 583633 - DNA, 17 bp, Homo sapiens
tgagcatagagaacaaa

SEQ ID NO: 583634 - DNA, 20 bp, Homo sapiens
tgagcatagagaacaaagta

SEQ ID NO: 583635 - DNA, 22 bp, Homo sapiens
tgagcatagagaacaaagtaaa

SEQ ID NO: 583636 - DNA, 13 bp, Homo sapiens
tgagccatgcctc

SEQ ID NO: 583637 - DNA, 19 bp, Homo sapiens
tgagccatgcctccctggg

SEQ ID NO: 583638 - DNA, 15 bp, Homo sapiens
tgagctgtgttcttg

SEQ ID NO: 583639 - DNA, 17 bp, Homo sapiens
tgaggactgatttcaga

SEQ ID NO: 583640 - DNA, 20 bp, Homo sapiens
tgaggttgggggaaccagca

SEQ ID NO: 583641 - DNA, 19 bp, Homo sapiens
tgagtagatccatttccat

SEQ ID NO: 583642 - DNA, 21 bp, Homo sapiens
tgagtagatccatttccattg

SEQ ID NO: 583643 - DNA, 23 bp, Homo sapiens
tgagtattgtttaaaatgtaatt

SEQ ID NO: 583644 - DNA, 20 bp, Homo sapiens
tgagttcaagggctgtaggt

SEQ ID NO: 583645 - DNA, 13 bp, Homo sapiens
tgataataaagga

SEQ ID NO: 583646 - DNA, 14 bp, Homo sapiens
tgatacatttttgt

SEQ ID NO: 583647 - DNA, 19 bp, Homo sapiens
tgataccatatgaatgaaa

SEQ ID NO: 583648 - DNA, 18 bp, Homo sapiens
tgatataatttccatagt

SEQ ID NO: 583649 - DNA, 12 bp, Homo sapiens
tgatattgctgt

SEQ ID NO: 583650 - DNA, 15 bp, Homo sapiens
tgatcagcaaaaaga

SEQ ID NO: 583651 - DNA, 19 bp, Homo sapiens
tgatccccgtctctgccct

SEQ ID NO: 583652 - DNA, 18 bp, Homo sapiens
tgatgaaagctttggcga

SEQ ID NO: 583653 - DNA, 13 bp, Homo sapiens
tgatgacaatcaa

SEQ ID NO: 583654 - DNA, 18 bp, Homo sapiens
tgatgaggacccagagct

SEQ ID NO: 583655 - DNA, 19 bp, Homo sapiens
tgatgaggacccagagctg

SEQ ID NO: 583656 - DNA, 18 bp, Homo sapiens
tgatgagtttgacagttt

SEQ ID NO: 583657 - DNA, 19 bp, Homo sapiens
tgatggtgtcattctgcct

SEQ ID NO: 583658 - DNA, 20 bp, Homo sapiens
tgatggtgtcattctgcctg

SEQ ID NO: 583659 - DNA, 22 bp, Homo sapiens
tgatggtgtcattctgcctgct

SEQ ID NO: 583660 - DNA, 17 bp, Homo sapiens
tgatgtacagattcttt

SEQ ID NO: 583661 - DNA, 23 bp, Homo sapiens
tgatgttatacatcaatatgtat

SEQ ID NO: 583662 - DNA, 15 bp, Homo sapiens
tgatgtttaaagaga

SEQ ID NO: 583663 - DNA, 18 bp, Homo sapiens
tgattactgcaatcactg

SEQ ID NO: 583664 - DNA, 13 bp, Homo sapiens
tgattatttgtat

SEQ ID NO: 583665 - DNA, 21 bp, Homo sapiens
tgattattttttttttcttct

SEQ ID NO: 583666 - DNA, 18 bp, Homo sapiens
tgattgggaaaacatttg

SEQ ID NO: 583667 - DNA, 21 bp, Homo sapiens
tgattgggaaaacatttgctg

SEQ ID NO: 583668 - DNA, 18 bp, Homo sapiens
tgatttccctccagagaa

SEQ ID NO: 583669 - DNA, 19 bp, Homo sapiens
tgatttccctccagagaaa

SEQ ID NO: 583670 - DNA, 22 bp, Homo sapiens
tgatttcttaggggaaggagaa

SEQ ID NO: 583671 - DNA, 17 bp, Homo sapiens
tgcaaaaattatatatt

SEQ ID NO: 583672 - DNA, 19 bp, Homo sapiens
tgcaaaactccaggcagga

SEQ ID NO: 583673 - DNA, 22 bp, Homo sapiens
tgcaaagtctccagaagaaaat

SEQ ID NO: 583674 - DNA, 23 bp, Homo sapiens
tgcaaatactgtatattcaggac

SEQ ID NO: 583675 - DNA, 20 bp, Homo sapiens
tgcaaatgagctctgaaatc

SEQ ID NO: 583676 - DNA, 21 bp, Homo sapiens
tgcaaatgagctctgaaatct

SEQ ID NO: 583677 - DNA, 20 bp, Homo sapiens
tgcaagccccaactttctta

SEQ ID NO: 583678 - DNA, 14 bp, Homo sapiens
tgcaatcactgtgc

SEQ ID NO: 583679 - DNA, 17 bp, Homo sapiens
tgcaatcactgtgctat

SEQ ID NO: 583680 - DNA, 14 bp, Homo sapiens
tgcaattcagtgtt

SEQ ID NO: 583681 - DNA, 20 bp, Homo sapiens
tgcacaagatgccccaggga

SEQ ID NO: 583682 - DNA, 21 bp, Homo sapiens
tgcacataagcttccatttta

SEQ ID NO: 583683 - DNA, 14 bp, Homo sapiens
tgcactccaatctg

SEQ ID NO: 583684 - DNA, 23 bp, Homo sapiens
tgcacttattgaccattttttaa

SEQ ID NO: 583685 - DNA, 20 bp, Homo sapiens
tgcacttttgaatgtccaaa

SEQ ID NO: 583686 - DNA, 15 bp, Homo sapiens
tgcagaactgtagct

SEQ ID NO: 583687 - DNA, 15 bp, Homo sapiens
tgcagaagcaataat

SEQ ID NO: 583688 - DNA, 18 bp, Homo sapiens
tgcagaagcaataataaa

SEQ ID NO: 583689 - DNA, 20 bp, Homo sapiens
tgcagagatttctcattgac

SEQ ID NO: 583690 - DNA, 10 bp, Homo sapiens
tgcagagctt

SEQ ID NO: 583691 - DNA, 13 bp, Homo sapiens
tgcagccttttct

SEQ ID NO: 583692 - DNA, 19 bp, Homo sapiens
tgcagccttttctggtccc

SEQ ID NO: 583693 - DNA, 15 bp, Homo sapiens
tgcaggagcccccct

SEQ ID NO: 583694 - DNA, 18 bp, Homo sapiens
tgcataatgtttctggat

SEQ ID NO: 583695 - DNA, 13 bp, Homo sapiens
tgcatactttgta

SEQ ID NO: 583696 - DNA, 20 bp, Homo sapiens
tgcatactttgtattttgat

SEQ ID NO: 583697 - DNA, 15 bp, Homo sapiens
tgcatagtcccagct

SEQ ID NO: 583698 - DNA, 20 bp, Homo sapiens
ttaactatcttctttggact

SEQ ID NO: 583699 - DNA, 21 bp, Homo sapiens
ttaactgttgcacttttgaat

SEQ ID NO: 583700 - DNA, 15 bp, Homo sapiens
ttaagaaatagaatt

SEQ ID NO: 583701 - DNA, 14 bp, Homo sapiens
ttaagaccagcctg

SEQ ID NO: 583702 - DNA, 20 bp, Homo sapiens
ttaaggacccttttaagcat

SEQ ID NO: 583703 - DNA, 17 bp, Homo sapiens
ttaaggggaagaatgaa

SEQ ID NO: 583704 - DNA, 20 bp, Homo sapiens
ttaaggggaagaatgaaagc

SEQ ID NO: 583705 - DNA, 23 bp, Homo sapiens
ttaagtcctaaaagttctcaatg

SEQ ID NO: 583706 - DNA, 14 bp, Homo sapiens
ttaataaagatgag

SEQ ID NO: 583707 - DNA, 19 bp, Homo sapiens
ttaatccagttataagaag

SEQ ID NO: 583708 - DNA, 14 bp, Homo sapiens
ttaatgacaatatt

SEQ ID NO: 583709 - DNA, 14 bp, Homo sapiens
ttaatgctacatgt

SEQ ID NO: 583710 - DNA, 13 bp, Homo sapiens
ttaattttaaagt

SEQ ID NO: 583711 - DNA, 19 bp, Homo sapiens
ttaattttaaagtgcaaaa

SEQ ID NO: 583712 - DNA, 17 bp, Homo sapiens
ttaccccaaagagaaag

SEQ ID NO: 583713 - DNA, 19 bp, Homo sapiens
ttaccccaaagagaaagag

SEQ ID NO: 583714 - DNA, 18 bp, Homo sapiens
ttactaaaaaaaagatga

SEQ ID NO: 583715 - DNA, 15 bp, Homo sapiens
ttactgcaatcactg

SEQ ID NO: 583716 - DNA, 19 bp, Homo sapiens
ttactgtctattaatattc

SEQ ID NO: 583717 - DNA, 13 bp, Homo sapiens
ttactttgctgag

SEQ ID NO: 583718 - DNA, 16 bp, Homo sapiens
ttaggtttcaggaagt

SEQ ID NO: 583719 - DNA, 23 bp, Homo sapiens
ttagtgatgtccttaaaatgtgg

SEQ ID NO: 583720 - DNA, 18 bp, Homo sapiens
ttagtttttggttgggaa

SEQ ID NO: 583721 - DNA, 23 bp, Homo sapiens
ttagtttttggttgggaatgagg

SEQ ID NO: 583722 - DNA, 16 bp, Homo sapiens
ttataaaagtgttcat

SEQ ID NO: 583723 - DNA, 13 bp, Homo sapiens
ttataaacagaaa

SEQ ID NO: 583724 - DNA, 17 bp, Homo sapiens
ttataaacagaaatgga

SEQ ID NO: 583725 - DNA, 23 bp, Homo sapiens
ttataaatgtaccagagagagtt

SEQ ID NO: 583726 - DNA, 17 bp, Homo sapiens
ttataactgtaaagatg

SEQ ID NO: 583727 - DNA, 18 bp, Homo sapiens
ttataactgtaaagatgt

SEQ ID NO: 583728 - DNA, 20 bp, Homo sapiens
ttataattgtacaaaattaa

SEQ ID NO: 583729 - DNA, 16 bp, Homo sapiens
ttatattttagaaata

SEQ ID NO: 583730 - DNA, 19 bp, Homo sapiens
ttatatttttttaactgtg

SEQ ID NO: 583731 - DNA, 20 bp, Homo sapiens
ttatcagtaatgctaaatgt

SEQ ID NO: 583732 - DNA, 22 bp, Homo sapiens
ttatcgtttttgtattttcatg

SEQ ID NO: 583733 - DNA, 15 bp, Homo sapiens
ttatcttacaatatt

SEQ ID NO: 583734 - DNA, 20 bp, Homo sapiens
ttatcttacaatattgattg

SEQ ID NO: 583735 - DNA, 17 bp, Homo sapiens
ttatgatgacaatcaaa

SEQ ID NO: 583736 - DNA, 16 bp, Homo sapiens
ttattaatgttttcaa

SEQ ID NO: 583737 - DNA, 22 bp, Homo sapiens
ttattgaccattttttaattta

SEQ ID NO: 583738 - DNA, 14 bp, Homo sapiens
ttattttttaagaa

SEQ ID NO: 583739 - DNA, 20 bp, Homo sapiens
ttcaaaaggtattatacatg

SEQ ID NO: 583740 - DNA, 21 bp, Homo sapiens
ttcaaaaggtattatacatgt

SEQ ID NO: 583741 - DNA, 20 bp, Homo sapiens
ttcaaagttttgttgtactt

SEQ ID NO: 583742 - DNA, 21 bp, Homo sapiens
ttcaaagttttgttgtactta

SEQ ID NO: 583743 - DNA, 21 bp, Homo sapiens
ttcaacaaagaaacaaagatg

SEQ ID NO: 583744 - DNA, 22 bp, Homo sapiens
ttcaacaaagaaacaaagatgt

SEQ ID NO: 583745 - DNA, 17 bp, Homo sapiens
ttcaataaatgatatat

SEQ ID NO: 583746 - DNA, 19 bp, Homo sapiens
ttcacagtacccaaactgc

SEQ ID NO: 583747 - DNA, 22 bp, Homo sapiens
ttcacccttatagtctaagact

SEQ ID NO: 583748 - DNA, 12 bp, Homo sapiens
ttcagaaatgtt

SEQ ID NO: 583749 - DNA, 16 bp, Homo sapiens
ttcagcaaattccaga

SEQ ID NO: 583750 - DNA, 12 bp, Homo sapiens
ttcagccaggca

SEQ ID NO: 583751 - DNA, 16 bp, Homo sapiens
ttcaggttagtgacat

SEQ ID NO: 583752 - DNA, 18 bp, Homo sapiens
ttcagttgcttgtcttct

SEQ ID NO: 583753 - DNA, 22 bp, Homo sapiens
ttcatacgcatcccatctctcc

SEQ ID NO: 583754 - DNA, 23 bp, Homo sapiens
ttcatacgcatcccatctctccc

SEQ ID NO: 583755 - DNA, 19 bp, Homo sapiens
ttcatagtaagtgcgaaga

SEQ ID NO: 583756 - DNA, 21 bp, Homo sapiens
ttcatggctgctgttgcttaa

SEQ ID NO: 583757 - DNA, 19 bp, Homo sapiens
ttccaagtctctgtgtaac

SEQ ID NO: 583758 - DNA, 12 bp, Homo sapiens
ttccacttctgg

SEQ ID NO: 583759 - DNA, 19 bp, Homo sapiens
ttccagagaacctgtgggc

SEQ ID NO: 583760 - DNA, 17 bp, Homo sapiens
ttccagagtttgtcatt

SEQ ID NO: 583761 - DNA, 13 bp, Homo sapiens
ttccattttaatt

SEQ ID NO: 583762 - DNA, 17 bp, Homo sapiens
ttcccaaaacaatggtg

SEQ ID NO: 583763 - DNA, 12 bp, Homo sapiens
ttcccaataaat

SEQ ID NO: 583764 - DNA, 13 bp, Homo sapiens
ttcccaccttcca

SEQ ID NO: 583765 - DNA, 18 bp, Homo sapiens
ttcccagcttctgccaca

SEQ ID NO: 583766 - DNA, 24 bp, Homo sapiens
ttccctccagagaaagcacaattt

SEQ ID NO: 583767 - DNA, 18 bp, Homo sapiens
ttccgcccactcctggga

SEQ ID NO: 583768 - DNA, 17 bp, Homo sapiens
ttcctaaggcacccaca

SEQ ID NO: 583769 - DNA, 14 bp, Homo sapiens
ttcctcctacctgg

SEQ ID NO: 583770 - DNA, 16 bp, Homo sapiens
ttcctcctacctgggg

SEQ ID NO: 583771 - DNA, 15 bp, Homo sapiens
ttcctcttgtctgat

SEQ ID NO: 583772 - DNA, 16 bp, Homo sapiens
ttcctgtactgtgtct

SEQ ID NO: 583773 - DNA, 16 bp, Homo sapiens
ttcctgtcctgcctcc

SEQ ID NO: 583774 - DNA, 17 bp, Homo sapiens
ttcctgtcctgcctcct

SEQ ID NO: 583775 - DNA, 18 bp, Homo sapiens
ttcctgtcctgcctcctc

SEQ ID NO: 583776 - DNA, 21 bp, Homo sapiens
ttcctgtgtgaccctgggcag

SEQ ID NO: 583777 - DNA, 14 bp, Homo sapiens
ttccttccactgta

SEQ ID NO: 583778 - DNA, 16 bp, Homo sapiens
ttccttccactgtagc

SEQ ID NO: 583779 - DNA, 20 bp, Homo sapiens
ttcggctctagggcctcagt

SEQ ID NO: 583780 - DNA, 23 bp, Homo sapiens
ttctaaactccctggctgttctg

SEQ ID NO: 583781 - DNA, 23 bp, Homo sapiens
ttctaaatacatgccacatcaaa

SEQ ID NO: 583782 - DNA, 21 bp, Homo sapiens
ttctataaaactctgcatgta

SEQ ID NO: 583783 - DNA, 23 bp, Homo sapiens
ttctattttttgttttgtttcct

SEQ ID NO: 583784 - DNA, 13 bp, Homo sapiens
ttctcaaatgtgt

SEQ ID NO: 583785 - DNA, 14 bp, Homo sapiens
ttctcaaatgtgtg

SEQ ID NO: 583786 - DNA, 21 bp, Homo sapiens
ttctcagtccagcagtttcca

SEQ ID NO: 583787 - DNA, 18 bp, Homo sapiens
ttctcccagtctctgtcg

SEQ ID NO: 583788 - DNA, 16 bp, Homo sapiens
ttctccgggtcctcct

SEQ ID NO: 583789 - DNA, 13 bp, Homo sapiens
ttctcctccccac

SEQ ID NO: 583790 - DNA, 16 bp, Homo sapiens
ttctcctccccacctg

SEQ ID NO: 583791 - DNA, 22 bp, Homo sapiens
ttctcctccccacctgtagctg

SEQ ID NO: 583792 - DNA, 11 bp, Homo sapiens
ttctctcctca

SEQ ID NO: 583793 - DNA, 22 bp, Homo sapiens
ttctctcctttctccctgcagc

SEQ ID NO: 583794 - DNA, 23 bp, Homo sapiens
ttctgattctggctttaagcctt

SEQ ID NO: 583795 - DNA, 19 bp, Homo sapiens
ttctgcatggattcagcat

SEQ ID NO: 583796 - DNA, 20 bp, Homo sapiens
ttctgcatggattcagcatg

SEQ ID NO: 583797 - DNA, 15 bp, Homo sapiens
ttctgccacataaaa

SEQ ID NO: 583798 - DNA, 12 bp, Homo sapiens
ttctttaactgc

SEQ ID NO: 583799 - DNA, 17 bp, Homo sapiens
ttctttgcaatactgct

SEQ ID NO: 583800 - DNA, 14 bp, Homo sapiens
ttcttttaaagacc

SEQ ID NO: 583801 - DNA, 13 bp, Homo sapiens
ttcttttgtttgg

SEQ ID NO: 583802 - DNA, 14 bp, Homo sapiens
ttcttttgtttggt

SEQ ID NO: 583803 - DNA, 15 bp, Homo sapiens
ttcttttgtttggta

SEQ ID NO: 583804 - DNA, 13 bp, Homo sapiens
ttgaaaaatataa

SEQ ID NO: 583805 - DNA, 20 bp, Homo sapiens
ttgaaactttgggaaaacat

SEQ ID NO: 583806 - DNA, 14 bp, Homo sapiens
ttgaaagaatagaa

SEQ ID NO: 583807 - DNA, 23 bp, Homo sapiens
tttgggtggggggcattgagtat

SEQ ID NO: 583808 - DNA, 13 bp, Homo sapiens
tttggtaaatgtt

SEQ ID NO: 583809 - DNA, 14 bp, Homo sapiens
tttgtataaaagtg

SEQ ID NO: 583810 - DNA, 18 bp, Homo sapiens
tttgtatatgactgcatt

SEQ ID NO: 583811 - DNA, 16 bp, Homo sapiens
tttgtatgttaaagag

SEQ ID NO: 583812 - DNA, 13 bp, Homo sapiens
tttgtattttcat

SEQ ID NO: 583813 - DNA, 18 bp, Homo sapiens
tttgtgaccagaaagctt

SEQ ID NO: 583814 - DNA, 19 bp, Homo sapiens
ttttaaaacgtgtaaatga

SEQ ID NO: 583815 - DNA, 11 bp, Homo sapiens
ttttaactgta

SEQ ID NO: 583816 - DNA, 19 bp, Homo sapiens
ttttagaaataataaaaag

SEQ ID NO: 583817 - DNA, 16 bp, Homo sapiens
ttttagtgttaaagag

SEQ ID NO: 583818 - DNA, 22 bp, Homo sapiens
ttttagtgttaaagagataaag

SEQ ID NO: 583819 - DNA, 23 bp, Homo sapiens
ttttatcgtttttgtattttcat

SEQ ID NO: 583820 - DNA, 17 bp, Homo sapiens
ttttcaaaaggtattat

SEQ ID NO: 583821 - DNA, 20 bp, Homo sapiens
ttttcaatgtctaaaaacat

SEQ ID NO: 583822 - DNA, 18 bp, Homo sapiens
ttttcagcaaattccaga

SEQ ID NO: 583823 - DNA, 17 bp, Homo sapiens
ttttccaaaagtaaaga

SEQ ID NO: 583824 - DNA, 13 bp, Homo sapiens
ttttccacattcc

SEQ ID NO: 583825 - DNA, 13 bp, Homo sapiens
ttttcccaataaa

SEQ ID NO: 583826 - DNA, 21 bp, Homo sapiens
ttttctccgggtcctcctaag

SEQ ID NO: 583827 - DNA, 16 bp, Homo sapiens
ttttcttcttgggata

SEQ ID NO: 583828 - DNA, 17 bp, Homo sapiens
ttttgcacagccaaatt

SEQ ID NO: 583829 - DNA, 15 bp, Homo sapiens
ttttggggagccaga

SEQ ID NO: 583830 - DNA, 14 bp, Homo sapiens
ttttgtgtgaaatt

SEQ ID NO: 583831 - DNA, 19 bp, Homo sapiens
ttttgttgtacttaaatgg

SEQ ID NO: 583832 - DNA, 15 bp, Homo sapiens
ttttgtttgccagga

SEQ ID NO: 583833 - DNA, 16 bp, Homo sapiens
ttttgtttggtaaatg

SEQ ID NO: 583834 - DNA, 12 bp, Homo sapiens
tttttaaaattt

SEQ ID NO: 583835 - DNA, 11 bp, Homo sapiens
tttttaactgt

SEQ ID NO: 583836 - DNA, 14 bp, Homo sapiens
tttttagtgttaaa

SEQ ID NO: 583837 - DNA, 11 bp, Homo sapiens
ttttttattat

SEQ ID NO: 583838 - DNA, 14 bp, Homo sapiens
tttttttaactgtg

SEQ ID NO: 583839 - DNA, 16 bp, Homo sapiens
aatttaaatgaaagaa

SEQ ID NO: 583840 - DNA, 12 bp, Homo sapiens
aatttgaacttt

SEQ ID NO: 583841 - DNA, 15 bp, Homo sapiens
aatttgaactttgga

SEQ ID NO: 583842 - DNA, 16 bp, Homo sapiens
aatttgaactttggaa

SEQ ID NO: 583843 - DNA, 17 bp, Homo sapiens
aatttgataatgacact

SEQ ID NO: 583844 - DNA, 12 bp, Homo sapiens
aatttgcactga

SEQ ID NO: 583845 - DNA, 12 bp, Homo sapiens
aatttggattta

SEQ ID NO: 583846 - DNA, 21 bp, Homo sapiens
aatttgtatatgactgcattt

SEQ ID NO: 583847 - DNA, 16 bp, Homo sapiens
acaaaatggtcctatt

SEQ ID NO: 583848 - DNA, 20 bp, Homo sapiens
acaaaattaagcaaatgtta

SEQ ID NO: 583849 - DNA, 20 bp, Homo sapiens
acaaagaaacaaagatgtta

SEQ ID NO: 583850 - DNA, 14 bp, Homo sapiens
acaacaatccttct

SEQ ID NO: 583851 - DNA, 20 bp, Homo sapiens
acaagatgccccagggatgg

SEQ ID NO: 583852 - DNA, 15 bp, Homo sapiens
acaagccccctgccc

SEQ ID NO: 583853 - DNA, 17 bp, Homo sapiens
acaagctgtatcactgc

SEQ ID NO: 583854 - DNA, 22 bp, Homo sapiens
acaataggagtggtgatttgaa

SEQ ID NO: 583855 - DNA, 18 bp, Homo sapiens
acaatattgattgggaaa

SEQ ID NO: 583856 - DNA, 19 bp, Homo sapiens
acaatctctttttgtttgc

SEQ ID NO: 583857 - DNA, 23 bp, Homo sapiens
acaatggtgtggtgaatgtgtga

SEQ ID NO: 583858 - DNA, 13 bp, Homo sapiens
acaattaactgcc

SEQ ID NO: 583859 - DNA, 21 bp, Homo sapiens
acaattaactgccctctgaaa

SEQ ID NO: 583860 - DNA, 24 bp, Homo sapiens
acaattgtgtataactggattgca

SEQ ID NO: 583861 - DNA, 22 bp, Homo sapiens
acaatttaaaacaatccttact

SEQ ID NO: 583862 - DNA, 19 bp, Homo sapiens
aagcacaatttaaaacaat

SEQ ID NO: 583863 - DNA, 21 bp, Homo sapiens
aagcatagataatattgtttg

SEQ ID NO: 583864 - DNA, 19 bp, Homo sapiens
aagccaatctacaatctct

SEQ ID NO: 583865 - DNA, 13 bp, Homo sapiens
aagccccctgccc

SEQ ID NO: 583866 - DNA, 15 bp, Homo sapiens
aagcctactatttaa

SEQ ID NO: 583867 - DNA, 22 bp, Homo sapiens
aagccttcaaaactatagcttg

SEQ ID NO: 583868 - DNA, 21 bp, Homo sapiens
aagctgcaaaaattatatatt

SEQ ID NO: 583869 - DNA, 15 bp, Homo sapiens
aagctgcagagattt

SEQ ID NO: 583870 - DNA, 18 bp, Homo sapiens
aagctgccgtagcttcag

SEQ ID NO: 583871 - DNA, 15 bp, Homo sapiens
aagctgtatcactgc

SEQ ID NO: 583872 - DNA, 17 bp, Homo sapiens
aagctgtatcactgcct

SEQ ID NO: 583873 - DNA, 18 bp, Homo sapiens
aagctgtatcactgcctt

SEQ ID NO: 583874 - DNA, 15 bp, Homo sapiens
aagcttcagttgctt

SEQ ID NO: 583875 - DNA, 15 bp, Homo sapiens
aaggacccttttaag

SEQ ID NO: 583876 - DNA, 20 bp, Homo sapiens
aaggacccttttaagcatgt

SEQ ID NO: 583877 - DNA, 16 bp, Homo sapiens
aaggatccggaaagaa

SEQ ID NO: 583878 - DNA, 18 bp, Homo sapiens
aaggctcagactgggcac

SEQ ID NO: 583879 - DNA, 21 bp, Homo sapiens
aaggctgtgtttagattgtat

SEQ ID NO: 583880 - DNA, 12 bp, Homo sapiens
aagggatatttt

SEQ ID NO: 583881 - DNA, 16 bp, Homo sapiens
aagggatcctgcctgc

SEQ ID NO: 583882 - DNA, 17 bp, Homo sapiens
acctggggactcctcaa

SEQ ID NO: 583883 - DNA, 12 bp, Homo sapiens
acctgtgggctg

SEQ ID NO: 583884 - DNA, 16 bp, Homo sapiens
accttaaaaggtactg

SEQ ID NO: 583885 - DNA, 22 bp, Homo sapiens
accttaatttaactttccagtc

SEQ ID NO: 583886 - DNA, 22 bp, Homo sapiens
accttgaaaaaaaacagtggat

SEQ ID NO: 583887 - DNA, 15 bp, Homo sapiens
acgatgatgtacaga

SEQ ID NO: 583888 - DNA, 14 bp, Homo sapiens
acgatgcatttaat

SEQ ID NO: 583889 - DNA, 21 bp, Homo sapiens
acgccactgcactccagcctg

SEQ ID NO: 583890 - DNA, 21 bp, Homo sapiens
acgctctcctcgagccctccc

SEQ ID NO: 583891 - DNA, 13 bp, Homo sapiens
acggttcctggtg

SEQ ID NO: 583892 - DNA, 12 bp, Homo sapiens
acgtcatgtatt

SEQ ID NO: 583893 - DNA, 20 bp, Homo sapiens
acgtccatcacgttagctgt

SEQ ID NO: 583894 - DNA, 14 bp, Homo sapiens
acgtttataaacag

SEQ ID NO: 583895 - DNA, 16 bp, Homo sapiens
acgtttataaacagaa

SEQ ID NO: 583896 - DNA, 21 bp, Homo sapiens
acgtttataaacagaaatgga

SEQ ID NO: 583897 - DNA, 19 bp, Homo sapiens
actaaatgatctctgaaag

SEQ ID NO: 583898 - DNA, 18 bp, Homo sapiens
actaacaggccaaagagt

SEQ ID NO: 583899 - DNA, 13 bp, Homo sapiens
actacacacagta

SEQ ID NO: 583900 - DNA, 22 bp, Homo sapiens
actactgttatcagtaatgcta

SEQ ID NO: 583901 - DNA, 16 bp, Homo sapiens
actatatatataaatg

SEQ ID NO: 583902 - DNA, 20 bp, Homo sapiens
actatatatataaatgtata

SEQ ID NO: 583903 - DNA, 22 bp, Homo sapiens
actatcttctttggacttctga

SEQ ID NO: 583904 - DNA, 20 bp, Homo sapiens
actatttattgtgctgggtc

SEQ ID NO: 583905 - DNA, 15 bp, Homo sapiens
actcaaatacacatt

SEQ ID NO: 583906 - DNA, 22 bp, Homo sapiens
actcacctgcactaacagagtg

SEQ ID NO: 583907 - DNA, 24 bp, Homo sapiens
actcagtgaccagtgcctgtgagc

SEQ ID NO: 583908 - DNA, 13 bp, Homo sapiens
actccaggcagga

SEQ ID NO: 583909 - DNA, 22 bp, Homo sapiens
actccataccccgccaaggaaa

SEQ ID NO: 583910 - DNA, 16 bp, Homo sapiens
actcccacagcagccc

SEQ ID NO: 583911 - DNA, 20 bp, Homo sapiens
actcccacagcagccccagg

SEQ ID NO: 583912 - DNA, 14 bp, Homo sapiens
actcctcaaaccac

SEQ ID NO: 583913 - DNA, 19 bp, Homo sapiens
actcctcaaaccacttgcc

SEQ ID NO: 583914 - DNA, 20 bp, Homo sapiens
actcctcaaaccacttgcct

SEQ ID NO: 583915 - DNA, 13 bp, Homo sapiens
actcctgcttaat

SEQ ID NO: 583916 - DNA, 15 bp, Homo sapiens
actctaaaattataa

SEQ ID NO: 583917 - DNA, 19 bp, Homo sapiens
actcttaagtcctaaaagt

SEQ ID NO: 583918 - DNA, 20 bp, Homo sapiens
actcttatttatagaattta

SEQ ID NO: 583919 - DNA, 13 bp, Homo sapiens
actgacttaggtt

SEQ ID NO: 583920 - DNA, 14 bp, Homo sapiens
actgcaatcactgt

SEQ ID NO: 583921 - DNA, 16 bp, Homo sapiens
actgcaatcactgtgc

SEQ ID NO: 583922 - DNA, 13 bp, Homo sapiens
actgcatttgtgt

SEQ ID NO: 583923 - DNA, 13 bp, Homo sapiens
actgccctctgaa

SEQ ID NO: 583924 - DNA, 14 bp, Homo sapiens
actgccctctgaaa

SEQ ID NO: 583925 - DNA, 16 bp, Homo sapiens
actgcttaattgctga

SEQ ID NO: 583926 - DNA, 15 bp, Homo sapiens
actgggcactggggc

SEQ ID NO: 583927 - DNA, 21 bp, Homo sapiens
actgggctgcccacctggctg

SEQ ID NO: 583928 - DNA, 16 bp, Homo sapiens
actggggcctcagcct

SEQ ID NO: 583929 - DNA, 17 bp, Homo sapiens
actggtgtaatctcaat

SEQ ID NO: 583930 - DNA, 20 bp, Homo sapiens
actggtgtaatctcaatgca

SEQ ID NO: 583931 - DNA, 21 bp, Homo sapiens
actggtgtaatctcaatgcaa

SEQ ID NO: 583932 - DNA, 20 bp, Homo sapiens
actgtagatatgtattcttt

SEQ ID NO: 583933 - DNA, 23 bp, Homo sapiens
actgtagctattagcggctcctc

SEQ ID NO: 583934 - DNA, 12 bp, Homo sapiens
actgttggaatg

SEQ ID NO: 583935 - DNA, 21 bp, Homo sapiens
actgttggaatggatttttct

SEQ ID NO: 583936 - DNA, 22 bp, Homo sapiens
actgttgtaagaattctgattg

SEQ ID NO: 583937 - DNA, 16 bp, Homo sapiens
acttaaccggagttcg

SEQ ID NO: 583938 - DNA, 21 bp, Homo sapiens
acttacatgttcccaaaacaa

SEQ ID NO: 583939 - DNA, 18 bp, Homo sapiens
acttaggcatgcacagct

SEQ ID NO: 583940 - DNA, 21 bp, Homo sapiens
acttaggcatgcacagctgta

SEQ ID NO: 583941 - DNA, 16 bp, Homo sapiens
acttcagcattgtaat

SEQ ID NO: 583942 - DNA, 20 bp, Homo sapiens
acttcagtttaatgtctcct

SEQ ID NO: 583943 - DNA, 15 bp, Homo sapiens
acttcccactgtatg

SEQ ID NO: 583944 - DNA, 14 bp, Homo sapiens
acttcctcctacct

SEQ ID NO: 583945 - DNA, 17 bp, Homo sapiens
acttcctcctacctggg

SEQ ID NO: 583946 - DNA, 23 bp, Homo sapiens
acttcctcctacctggggactcc

SEQ ID NO: 583947 - DNA, 20 bp, Homo sapiens
acttgaaatacgtttgtgtt

SEQ ID NO: 583948 - DNA, 24 bp, Homo sapiens
acttgaatgctagttatacttatt

SEQ ID NO: 583949 - DNA, 19 bp, Homo sapiens
acttgggggactgggcgca

SEQ ID NO: 583950 - DNA, 22 bp, Homo sapiens
acttgtgtccctaatgtgttta

SEQ ID NO: 583951 - DNA, 11 bp, Homo sapiens
acttgtgtctg

SEQ ID NO: 583952 - DNA, 16 bp, Homo sapiens
actttattgcaatgca

SEQ ID NO: 583953 - DNA, 12 bp, Homo sapiens
actttctatttt

SEQ ID NO: 583954 - DNA, 18 bp, Homo sapiens
actttctgttatgggctt

SEQ ID NO: 583955 - DNA, 18 bp, Homo sapiens
actttgacagtgttttta

SEQ ID NO: 583956 - DNA, 23 bp, Homo sapiens
actttggtgcgggcacaataaat

SEQ ID NO: 583957 - DNA, 17 bp, Homo sapiens
actttgtaaaaatcttt

SEQ ID NO: 583958 - DNA, 14 bp, Homo sapiens
actttgtcagtgtt

SEQ ID NO: 583959 - DNA, 13 bp, Homo sapiens
acttttgaatgtc

SEQ ID NO: 583960 - DNA, 13 bp, Homo sapiens
agaaaaaaaccat

SEQ ID NO: 583961 - DNA, 13 bp, Homo sapiens
agaaaaactaact

SEQ ID NO: 583962 - DNA, 14 bp, Homo sapiens
agaaaaactaactt

SEQ ID NO: 583963 - DNA, 15 bp, Homo sapiens
agaaaatctttataa

SEQ ID NO: 583964 - DNA, 12 bp, Homo sapiens
agaaaatggcac

SEQ ID NO: 583965 - DNA, 13 bp, Homo sapiens
agaaaattgagtt

SEQ ID NO: 583966 - DNA, 21 bp, Homo sapiens
agaaaatttgccaatctttcc

SEQ ID NO: 583967 - DNA, 21 bp, Homo sapiens
agaaagcttcatccacagcct

SEQ ID NO: 583968 - DNA, 17 bp, Homo sapiens
agaaatataacacattt

SEQ ID NO: 583969 - DNA, 22 bp, Homo sapiens
agaaatgttgagtctgtactaa

SEQ ID NO: 583970 - DNA, 18 bp, Homo sapiens
agaaattacctgtggata

SEQ ID NO: 583971 - DNA, 17 bp, Homo sapiens
agaaatttgataatgac

SEQ ID NO: 583972 - DNA, 20 bp, Homo sapiens
agaacaaagtaaaagtagtg

SEQ ID NO: 583973 - DNA, 21 bp, Homo sapiens
agaactctctggaagcccctg

SEQ ID NO: 583974 - DNA, 13 bp, Homo sapiens
agaagaaaatttg

SEQ ID NO: 583975 - DNA, 17 bp, Homo sapiens
agaagagggaaaacaga

SEQ ID NO: 583976 - DNA, 22 bp, Homo sapiens
agaagccaatctacaatctctt

SEQ ID NO: 583977 - DNA, 21 bp, Homo sapiens
agaagcctgcataatgtttct

SEQ ID NO: 583978 - DNA, 21 bp, Homo sapiens
agaagtaagaggctacctctt

SEQ ID NO: 583979 - DNA, 19 bp, Homo sapiens
agaagtgcatgaaaaacca

SEQ ID NO: 583980 - DNA, 17 bp, Homo sapiens
agaatagaacacagttt

SEQ ID NO: 583981 - DNA, 20 bp, Homo sapiens
agaatgagtccttgatttca

SEQ ID NO: 583982 - DNA, 18 bp, Homo sapiens
agaatgtgctcatgcatt

SEQ ID NO: 583983 - DNA, 15 bp, Homo sapiens
agaatttttaactgt

SEQ ID NO: 583984 - DNA, 22 bp, Homo sapiens
agaatttttaactgtactgaat

SEQ ID NO: 583985 - DNA, 19 bp, Homo sapiens
agacaacaggtaaaacagg

SEQ ID NO: 583986 - DNA, 23 bp, Homo sapiens
agacatcagcctccttctttcac

SEQ ID NO: 583987 - DNA, 23 bp, Homo sapiens
agacattttccgcccactcctgg

SEQ ID NO: 583988 - DNA, 12 bp, Homo sapiens
agaccagcctgg

SEQ ID NO: 583989 - DNA, 21 bp, Homo sapiens
agaccatcctggccaacatga

SEQ ID NO: 583990 - DNA, 23 bp, Homo sapiens
agacccctgtctttgctgagagc

SEQ ID NO: 583991 - DNA, 20 bp, Homo sapiens
agaccccttgttgcactgcc

SEQ ID NO: 583992 - DNA, 11 bp, Homo sapiens
acacacacaca

SEQ ID NO: 583993 - DNA, 14 bp, Homo sapiens
acacacacacacac

SEQ ID NO: 583994 - DNA, 13 bp, Homo sapiens
acacacacacacg

SEQ ID NO: 583995 - DNA, 14 bp, Homo sapiens
acacacacacacga

SEQ ID NO: 583996 - DNA, 16 bp, Homo sapiens
acacacacacacgatg

SEQ ID NO: 583997 - DNA, 15 bp, Homo sapiens
acacacacgatgcat

SEQ ID NO: 583998 - DNA, 22 bp, Homo sapiens
acacacacgatgcatttaataa

SEQ ID NO: 583999 - DNA, 20 bp, Homo sapiens
acacacgatgcatttaataa

SEQ ID NO: 584000 - DNA, 21 bp, Homo sapiens
acacacgatgcatttaataaa

SEQ ID NO: 584001 - DNA, 16 bp, Homo sapiens
acacagcatcagctca

SEQ ID NO: 584002 - DNA, 18 bp, Homo sapiens
acacagcattgtatatgt

SEQ ID NO: 584003 - DNA, 20 bp, Homo sapiens
acacagcattgtatatgtga

SEQ ID NO: 584004 - DNA, 17 bp, Homo sapiens
acacatttgctactgtt

SEQ ID NO: 584005 - DNA, 20 bp, Homo sapiens
acacatttgctactgttgta

SEQ ID NO: 584006 - DNA, 13 bp, Homo sapiens
acacccctgcccc

SEQ ID NO: 584007 - DNA, 19 bp, Homo sapiens
acacgatgcatttaataaa

SEQ ID NO: 584008 - DNA, 20 bp, Homo sapiens
acacgatgcatttaataaag

SEQ ID NO: 584009 - DNA, 21 bp, Homo sapiens
acactatttgtgactttttaa

SEQ ID NO: 584010 - DNA, 20 bp, Homo sapiens
acactgacttaggtttcagg

SEQ ID NO: 584011 - DNA, 15 bp, Homo sapiens
acactgtttcctgat

SEQ ID NO: 584012 - DNA, 13 bp, Homo sapiens
acacttgaaacct

SEQ ID NO: 584013 - DNA, 17 bp, Homo sapiens
acagaaatggaaagcag

SEQ ID NO: 584014 - DNA, 20 bp, Homo sapiens
acagaacttcagcattgtaa

SEQ ID NO: 584015 - DNA, 19 bp, Homo sapiens
acagaccacctttcacaaa

SEQ ID NO: 584016 - DNA, 16 bp, Homo sapiens
acagatcgcatttcct

SEQ ID NO: 584017 - DNA, 15 bp, Homo sapiens
acagattctttcagt

SEQ ID NO: 584018 - DNA, 19 bp, Homo sapiens
acagattctttcagttctt

SEQ ID NO: 584019 - DNA, 17 bp, Homo sapiens
acagcagccccaggaga

SEQ ID NO: 584020 - DNA, 14 bp, Homo sapiens
acagcagtttccag

SEQ ID NO: 584021 - DNA, 15 bp, Homo sapiens
acagcagtttccaga

SEQ ID NO: 584022 - DNA, 17 bp, Homo sapiens
acagccttgcagcggct

SEQ ID NO: 584023 - DNA, 16 bp, Homo sapiens
acagctcctggaccag

SEQ ID NO: 584024 - DNA, 20 bp, Homo sapiens
acagctgtgagccatgcctc

SEQ ID NO: 584025 - DNA, 23 bp, Homo sapiens
acagctgtgagccatgcctccct

SEQ ID NO: 584026 - DNA, 17 bp, Homo sapiens
acaggcacattaactgt

SEQ ID NO: 584027 - DNA, 18 bp, Homo sapiens
acaggttataacagtgtt

SEQ ID NO: 584028 - DNA, 15 bp, Homo sapiens
acagtaagatatctc

SEQ ID NO: 584029 - DNA, 15 bp, Homo sapiens
acagtggatcacaaa

SEQ ID NO: 584030 - DNA, 18 bp, Homo sapiens
acagtggatcacaaagtg

SEQ ID NO: 584031 - DNA, 17 bp, Homo sapiens
acagttttaactgtgga

SEQ ID NO: 584032 - DNA, 21 bp, Homo sapiens
acagttttaactgtggatatt

SEQ ID NO: 584033 - DNA, 20 bp, Homo sapiens
acataactcacacccctgcc

SEQ ID NO: 584034 - DNA, 21 bp, Homo sapiens
acataactcacacccctgccc

SEQ ID NO: 584035 - DNA, 18 bp, Homo sapiens
acatcaaataagaaataa

SEQ ID NO: 584036 - DNA, 13 bp, Homo sapiens
acatcaatatgta

SEQ ID NO: 584037 - DNA, 22 bp, Homo sapiens
acatcatttcaatcgtaaaatt

SEQ ID NO: 584038 - DNA, 15 bp, Homo sapiens
acatgcaataaaatt

SEQ ID NO: 584039 - DNA, 16 bp, Homo sapiens
acatgcaataaaattt

SEQ ID NO: 584040 - DNA, 13 bp, Homo sapiens
acatgggagttta

SEQ ID NO: 584041 - DNA, 14 bp, Homo sapiens
acatgtgatacatt

SEQ ID NO: 584042 - DNA, 17 bp, Homo sapiens
acatgtgatacattttt

SEQ ID NO: 584043 - DNA, 23 bp, Homo sapiens
acatgtgatacattttttaagct

SEQ ID NO: 584044 - DNA, 20 bp, Homo sapiens
acatgttaatgacaatattc

SEQ ID NO: 584045 - DNA, 18 bp, Homo sapiens
acatgttcccaaaacaat

SEQ ID NO: 584046 - DNA, 21 bp, Homo sapiens
acatgttcccaaaacaatggt

SEQ ID NO: 584047 - DNA, 12 bp, Homo sapiens
acattaaacaca

SEQ ID NO: 584048 - DNA, 12 bp, Homo sapiens
acattaactgtt

SEQ ID NO: 584049 - DNA, 20 bp, Homo sapiens
acatttatgacaagctgtat

SEQ ID NO: 584050 - DNA, 21 bp, Homo sapiens
acattttccgcccactcctgg

SEQ ID NO: 584051 - DNA, 14 bp, Homo sapiens
acattttttaagct

SEQ ID NO: 584052 - DNA, 21 bp, Homo sapiens
accactttattgcaatgcaga

SEQ ID NO: 584053 - DNA, 15 bp, Homo sapiens
accagagagagttgt

SEQ ID NO: 584054 - DNA, 20 bp, Homo sapiens
accagcagaaatgcccccat

SEQ ID NO: 584055 - DNA, 19 bp, Homo sapiens
accaggccagagcaaacag

SEQ ID NO: 584056 - DNA, 20 bp, Homo sapiens
accaggggccaacctcaggc

SEQ ID NO: 584057 - DNA, 23 bp, Homo sapiens
accaggggccaacctcaggctcc

SEQ ID NO: 584058 - DNA, 19 bp, Homo sapiens
accagtgtagcatcttcct

SEQ ID NO: 584059 - DNA, 21 bp, Homo sapiens
accagtgtagcatcttcctct

SEQ ID NO: 584060 - DNA, 22 bp, Homo sapiens
accagtgtagcatcttcctctg

SEQ ID NO: 584061 - DNA, 18 bp, Homo sapiens
accattgatttaatgtaa

SEQ ID NO: 584062 - DNA, 23 bp, Homo sapiens
accattttgttattgactaacag

SEQ ID NO: 584063 - DNA, 17 bp, Homo sapiens
accattttttaatttac

SEQ ID NO: 584064 - DNA, 14 bp, Homo sapiens
acccaatccctctc

SEQ ID NO: 584065 - DNA, 15 bp, Homo sapiens
acccaatccctctcc

SEQ ID NO: 584066 - DNA, 18 bp, Homo sapiens
acccaatccctctccact

SEQ ID NO: 584067 - DNA, 13 bp, Homo sapiens
acccacacctggg

SEQ ID NO: 584068 - DNA, 14 bp, Homo sapiens
accccaaagagaaa

SEQ ID NO: 584069 - DNA, 16 bp, Homo sapiens
accccaaagagaaaga

SEQ ID NO: 584070 - DNA, 18 bp, Homo sapiens
accccaatatatgtattt

SEQ ID NO: 584071 - DNA, 23 bp, Homo sapiens
accccaatatatgtattttttga

SEQ ID NO: 584072 - DNA, 23 bp, Homo sapiens
accccttaccccaaagagaaaga

SEQ ID NO: 584073 - DNA, 15 bp, Homo sapiens
accccttcctgtcct

SEQ ID NO: 584074 - DNA, 22 bp, Homo sapiens
accccttcctgtcctgcctcct

SEQ ID NO: 584075 - DNA, 18 bp, Homo sapiens
accccttgttgcactgcc

SEQ ID NO: 584076 - DNA, 14 bp, Homo sapiens
accctatgggtcta

SEQ ID NO: 584077 - DNA, 20 bp, Homo sapiens
ataaaactatttattgtgct

SEQ ID NO: 584078 - DNA, 22 bp, Homo sapiens
ataaaactatttattgtgctgg

SEQ ID NO: 584079 - DNA, 11 bp, Homo sapiens
ataaaactctg

SEQ ID NO: 584080 - DNA, 16 bp, Homo sapiens
ataaaatgatgttata

SEQ ID NO: 584081 - DNA, 20 bp, Homo sapiens
ataaaatttaaaaaataaat

SEQ ID NO: 584082 - DNA, 19 bp, Homo sapiens
ataaacggttcctggtgac

SEQ ID NO: 584083 - DNA, 16 bp, Homo sapiens
ataaagacctataaat

SEQ ID NO: 584084 - DNA, 20 bp, Homo sapiens
ataaagattatataaagacc

SEQ ID NO: 584085 - DNA, 18 bp, Homo sapiens
ataaatgtaccagagaga

SEQ ID NO: 584086 - DNA, 14 bp, Homo sapiens
ataaatgtgactca

SEQ ID NO: 584087 - DNA, 15 bp, Homo sapiens
ataaattttttataa

SEQ ID NO: 584088 - DNA, 12 bp, Homo sapiens
ataacacatttt

SEQ ID NO: 584089 - DNA, 22 bp, Homo sapiens
ataactctaaccaaggctgtgt

SEQ ID NO: 584090 - DNA, 17 bp, Homo sapiens
ataacttctcatgtata

SEQ ID NO: 584091 - DNA, 18 bp, Homo sapiens
ataacttctcatgtatat

SEQ ID NO: 584092 - DNA, 16 bp, Homo sapiens
ataagataaaatgatg

SEQ ID NO: 584093 - DNA, 18 bp, Homo sapiens
ataagataaaatgatgtt

SEQ ID NO: 584094 - DNA, 17 bp, Homo sapiens
ataagcactgtaaactt

SEQ ID NO: 584095 - DNA, 22 bp, Homo sapiens
ataagcttccattttaatttta

SEQ ID NO: 584096 - DNA, 19 bp, Homo sapiens
ataatactactactgttat

SEQ ID NO: 584097 - DNA, 21 bp, Homo sapiens
ataatattgtttggtaaatgt

SEQ ID NO: 584098 - DNA, 19 bp, Homo sapiens
ataatgacactgtttcctg

SEQ ID NO: 584099 - DNA, 14 bp, Homo sapiens
ataatgctacaatt

SEQ ID NO: 584100 - DNA, 14 bp, Homo sapiens
ataatgtaacatga

SEQ ID NO: 584101 - DNA, 19 bp, Homo sapiens
ataattgtacaaaattaag

SEQ ID NO: 584102 - DNA, 21 bp, Homo sapiens
ataattgtacaaaattaagca

SEQ ID NO: 584103 - DNA, 17 bp, Homo sapiens
ataatttgaactttgga

SEQ ID NO: 584104 - DNA, 14 bp, Homo sapiens
atacacatttgcta

SEQ ID NO: 584105 - DNA, 14 bp, Homo sapiens
atacatcaatatgt

SEQ ID NO: 584106 - DNA, 21 bp, Homo sapiens
atacatgccacatcaaacctt

SEQ ID NO: 584107 - DNA, 21 bp, Homo sapiens
ataccatatgaatgaaacatg

SEQ ID NO: 584108 - DNA, 23 bp, Homo sapiens
ataccatatgaatgaaacatggg

SEQ ID NO: 584109 - DNA, 17 bp, Homo sapiens
atacgcatcccatctct

SEQ ID NO: 584110 - DNA, 14 bp, Homo sapiens
atactactactgtt

SEQ ID NO: 584111 - DNA, 15 bp, Homo sapiens
atactactactgtta

SEQ ID NO: 584112 - DNA, 22 bp, Homo sapiens
atactctgctatttctcttgct

SEQ ID NO: 584113 - DNA, 13 bp, Homo sapiens
atactggcacaga

SEQ ID NO: 584114 - DNA, 19 bp, Homo sapiens
atactgtatattcaggact

SEQ ID NO: 584115 - DNA, 13 bp, Homo sapiens
atagaaggtgatg

SEQ ID NO: 584116 - DNA, 12 bp, Homo sapiens
atagacatgaaa

SEQ ID NO: 584117 - DNA, 19 bp, Homo sapiens
atagacttggagaatactg

SEQ ID NO: 584118 - DNA, 23 bp, Homo sapiens
atagacttggagaatactgccaa

SEQ ID NO: 584119 - DNA, 14 bp, Homo sapiens
atagagaacaaagt

SEQ ID NO: 584120 - DNA, 15 bp, Homo sapiens
atagataatattgtt

SEQ ID NO: 584121 - DNA, 19 bp, Homo sapiens
ataggaacaatctttgctg

SEQ ID NO: 584122 - DNA, 16 bp, Homo sapiens
atagggaaaattctaa

SEQ ID NO: 584123 - DNA, 23 bp, Homo sapiens
atagtctaagactatatatataa

SEQ ID NO: 584124 - DNA, 15 bp, Homo sapiens
atagtgggatttcca

SEQ ID NO: 584125 - DNA, 19 bp, Homo sapiens
atagtgtagctgaggaggc

SEQ ID NO: 584126 - DNA, 12 bp, Homo sapiens
atataaaattat

SEQ ID NO: 584127 - DNA, 15 bp, Homo sapiens
atataacacattttt

SEQ ID NO: 584128 - DNA, 17 bp, Homo sapiens
atatacagtatagattt

SEQ ID NO: 584129 - DNA, 22 bp, Homo sapiens
atatagacttggagaatactgc

SEQ ID NO: 584130 - DNA, 18 bp, Homo sapiens
atataggttcttttctct

SEQ ID NO: 584131 - DNA, 12 bp, Homo sapiens
atatataaatgt

SEQ ID NO: 584132 - DNA, 15 bp, Homo sapiens
atatatataaatgta

SEQ ID NO: 584133 - DNA, 12 bp, Homo sapiens
atatatatatat

SEQ ID NO: 584134 - DNA, 15 bp, Homo sapiens
atatatgtatttcta

SEQ ID NO: 584135 - DNA, 19 bp, Homo sapiens
atatattttgtgtgaaatt

SEQ ID NO: 584136 - DNA, 23 bp, Homo sapiens
atatcagtaacccccttaaattt

SEQ ID NO: 584137 - DNA, 12 bp, Homo sapiens
atatgaatgaat

SEQ ID NO: 584138 - DNA, 19 bp, Homo sapiens
atatgtatatatgtatttc

SEQ ID NO: 584139 - DNA, 16 bp, Homo sapiens
atatgtattttttgaa

SEQ ID NO: 584140 - DNA, 23 bp, Homo sapiens
atatgtattttttgaatctatga

SEQ ID NO: 584141 - DNA, 13 bp, Homo sapiens
atattaaataaca

SEQ ID NO: 584142 - DNA, 17 bp, Homo sapiens
atattaaataacatgtt

SEQ ID NO: 584143 - DNA, 14 bp, Homo sapiens
atattactgacatt

SEQ ID NO: 584144 - DNA, 16 bp, Homo sapiens
atattactgacatttc

SEQ ID NO: 584145 - DNA, 19 bp, Homo sapiens
atattgattgggaaaacat

SEQ ID NO: 584146 - DNA, 14 bp, Homo sapiens
atatttcaataaat

SEQ ID NO: 584147 - DNA, 13 bp, Homo sapiens
atattttcagtac

SEQ ID NO: 584148 - DNA, 19 bp, Homo sapiens
atattttgaaatgaacttt

SEQ ID NO: 584149 - DNA, 19 bp, Homo sapiens
atcaaagccggcctgagaa

SEQ ID NO: 584150 - DNA, 18 bp, Homo sapiens
atcaaattctacaacttt

SEQ ID NO: 584151 - DNA, 15 bp, Homo sapiens
atcaatatgtatata

SEQ ID NO: 584152 - DNA, 17 bp, Homo sapiens
atcacgccactgcactc

SEQ ID NO: 584153 - DNA, 20 bp, Homo sapiens
atcacgccactgcactccag

SEQ ID NO: 584154 - DNA, 19 bp, Homo sapiens
atcactgccttcgtttata

SEQ ID NO: 584155 - DNA, 20 bp, Homo sapiens
atcagcaaaaagactggatt

SEQ ID NO: 584156 - DNA, 17 bp, Homo sapiens
atcagggcctttctcct

SEQ ID NO: 584157 - DNA, 22 bp, Homo sapiens
atcagggcctttctcctcccca

SEQ ID NO: 584158 - DNA, 15 bp, Homo sapiens
atcagtaaccccctt

SEQ ID NO: 584159 - DNA, 19 bp, Homo sapiens
atcagtatttccttccact

SEQ ID NO: 584160 - DNA, 22 bp, Homo sapiens
atcagtgtgtaaataatttgca

SEQ ID NO: 584161 - DNA, 22 bp, Homo sapiens
atcagttgaggccaggagttta

SEQ ID NO: 584162 - DNA, 14 bp, Homo sapiens
atcatctcttcctc

SEQ ID NO: 584163 - DNA, 20 bp, Homo sapiens
atcatgaggccggatgaaac

SEQ ID NO: 584164 - DNA, 16 bp, Homo sapiens
atccaggcaccaggac

SEQ ID NO: 584165 - DNA, 13 bp, Homo sapiens
atccagtataaga

SEQ ID NO: 584166 - DNA, 17 bp, Homo sapiens
atccatttccattgctt

SEQ ID NO: 584167 - DNA, 14 bp, Homo sapiens
atcccatctctccc

SEQ ID NO: 584168 - DNA, 17 bp, Homo sapiens
atcccatctctcccact

SEQ ID NO: 584169 - DNA, 13 bp, Homo sapiens
atccccgtctctg

SEQ ID NO: 584170 - DNA, 19 bp, Homo sapiens
atccccgtctctgccctgg

SEQ ID NO: 584171 - DNA, 22 bp, Homo sapiens
atccccgtctctgccctgggct

SEQ ID NO: 584172 - DNA, 14 bp, Homo sapiens
atcccgtcttccag

SEQ ID NO: 584173 - DNA, 16 bp, Homo sapiens
atcccgttcagaaaac

SEQ ID NO: 584174 - DNA, 23 bp, Homo sapiens
atccctctccactcttctctcct

SEQ ID NO: 584175 - DNA, 21 bp, Homo sapiens
atcctcagttctcaaatgtgt

SEQ ID NO: 584176 - DNA, 19 bp, Homo sapiens
atcctccccttttaccact

SEQ ID NO: 584177 - DNA, 21 bp, Homo sapiens
atcctccttctcctgttccat

SEQ ID NO: 584178 - DNA, 19 bp, Homo sapiens
atcctgatggacctgcccc

SEQ ID NO: 584179 - DNA, 17 bp, Homo sapiens
atccttgagattctgaa

SEQ ID NO: 584180 - DNA, 14 bp, Homo sapiens
atcgcatttcctaa

SEQ ID NO: 584181 - DNA, 15 bp, Homo sapiens
atcgcatttcctaag

SEQ ID NO: 584182 - DNA, 18 bp, Homo sapiens
atcgcgccagcgacctct

SEQ ID NO: 584183 - DNA, 20 bp, Homo sapiens
atcgcgccagcgacctctct

SEQ ID NO: 584184 - DNA, 21 bp, Homo sapiens
atcgcgccagcgacctctctg

SEQ ID NO: 584185 - DNA, 19 bp, Homo sapiens
atctacaatctctttttgt

SEQ ID NO: 584186 - DNA, 20 bp, Homo sapiens
atctacttctgtaattgtgt

SEQ ID NO: 584187 - DNA, 11 bp, Homo sapiens
atctatgaacc

SEQ ID NO: 584188 - DNA, 18 bp, Homo sapiens
agctttagtgaattaaat

SEQ ID NO: 584189 - DNA, 23 bp, Homo sapiens
agctttcctttttcccaataaat

SEQ ID NO: 584190 - DNA, 15 bp, Homo sapiens
aggaacgctctcctc

SEQ ID NO: 584191 - DNA, 23 bp, Homo sapiens
aggaatcattcagaaatgttgag

SEQ ID NO: 584192 - DNA, 15 bp, Homo sapiens
aggacacagttcctg

SEQ ID NO: 584193 - DNA, 18 bp, Homo sapiens
aggacacagttcctggga

SEQ ID NO: 584194 - DNA, 21 bp, Homo sapiens
aggacacagttcctgggaaca

SEQ ID NO: 584195 - DNA, 19 bp, Homo sapiens
aggacagctcctggaccag

SEQ ID NO: 584196 - DNA, 18 bp, Homo sapiens
aggactgatttcagagtg

SEQ ID NO: 584197 - DNA, 23 bp, Homo sapiens
aggagagtgtatatgaatgaata

SEQ ID NO: 584198 - DNA, 15 bp, Homo sapiens
aggagattcccacct

SEQ ID NO: 584199 - DNA, 23 bp, Homo sapiens
aggaggtccttaggcctctgaga

SEQ ID NO: 584200 - DNA, 14 bp, Homo sapiens
aggcacattaactg

SEQ ID NO: 584201 - DNA, 16 bp, Homo sapiens
aggcacattaactgtt

SEQ ID NO: 584202 - DNA, 21 bp, Homo sapiens
aggcacctacactcacctgca

SEQ ID NO: 584203 - DNA, 22 bp, Homo sapiens
aggcagcctagcctatgtctgg

SEQ ID NO: 584204 - DNA, 18 bp, Homo sapiens
aggcaggacttctcacca

SEQ ID NO: 584205 - DNA, 14 bp, Homo sapiens
aggcataaacctgt

SEQ ID NO: 584206 - DNA, 18 bp, Homo sapiens
aggcataaacctgtgctg

SEQ ID NO: 584207 - DNA, 14 bp, Homo sapiens
aggcattggatatt

SEQ ID NO: 584208 - DNA, 15 bp, Homo sapiens
aggccaagggaccag

SEQ ID NO: 584209 - DNA, 22 bp, Homo sapiens
aggccacagaaggtgaactttg

SEQ ID NO: 584210 - DNA, 19 bp, Homo sapiens
aggccagagcaaacagaaa

SEQ ID NO: 584211 - DNA, 20 bp, Homo sapiens
aggccagagcaaacagaaaa

SEQ ID NO: 584212 - DNA, 14 bp, Homo sapiens
aggcctagactctg

SEQ ID NO: 584213 - DNA, 16 bp, Homo sapiens
aggcctagactctgtc

SEQ ID NO: 584214 - DNA, 17 bp, Homo sapiens
aggcctagactctgtct

SEQ ID NO: 584215 - DNA, 23 bp, Homo sapiens
aggctccgggcaccaggggccaa

SEQ ID NO: 584216 - DNA, 22 bp, Homo sapiens
aggctggatgtgcattagcctg

SEQ ID NO: 584217 - DNA, 20 bp, Homo sapiens
aggctgtgtttagattgtat

SEQ ID NO: 584218 - DNA, 21 bp, Homo sapiens
aggcttgtttacctttctctc

SEQ ID NO: 584219 - DNA, 22 bp, Homo sapiens
aggcttgtttacctttctctct

SEQ ID NO: 584220 - DNA, 13 bp, Homo sapiens
agggaaaacagaa

SEQ ID NO: 584221 - DNA, 15 bp, Homo sapiens
agggaaagttttttt

SEQ ID NO: 584222 - DNA, 19 bp, Homo sapiens
agggactacccatagacat

SEQ ID NO: 584223 - DNA, 22 bp, Homo sapiens
agggcaccgtattcctctccca

SEQ ID NO: 584224 - DNA, 14 bp, Homo sapiens
agggcagctgtgat

SEQ ID NO: 584225 - DNA, 15 bp, Homo sapiens
agggcctttctcctc

SEQ ID NO: 584226 - DNA, 19 bp, Homo sapiens
agggctaaataaagaggag

SEQ ID NO: 584227 - DNA, 23 bp, Homo sapiens
agggctaaataaagaggagataa

SEQ ID NO: 584228 - DNA, 15 bp, Homo sapiens
agggctgtcattgca

SEQ ID NO: 584229 - DNA, 13 bp, Homo sapiens
aggggaagaatga

SEQ ID NO: 584230 - DNA, 17 bp, Homo sapiens
aggggaaggagaagtaa

SEQ ID NO: 584231 - DNA, 16 bp, Homo sapiens
aggggccaacctcagg

SEQ ID NO: 584232 - DNA, 19 bp, Homo sapiens
aggggccaacctcaggctc

SEQ ID NO: 584233 - DNA, 19 bp, Homo sapiens
aggggccatgtcctctctt

SEQ ID NO: 584234 - DNA, 12 bp, Homo sapiens
aggggcgcggga

SEQ ID NO: 584235 - DNA, 14 bp, Homo sapiens
aggggcgcgggagg

SEQ ID NO: 584236 - DNA, 21 bp, Homo sapiens
aggggctaccctgggaagctg

SEQ ID NO: 584237 - DNA, 18 bp, Homo sapiens
aggggctggggacttgtg

SEQ ID NO: 584238 - DNA, 19 bp, Homo sapiens
aggggttccttccacttct

SEQ ID NO: 584239 - DNA, 15 bp, Homo sapiens
aggtatctagagctt

SEQ ID NO: 584240 - DNA, 16 bp, Homo sapiens
aggtatgggctggggg

SEQ ID NO: 584241 - DNA, 15 bp, Homo sapiens
aggtgaaatccctgc

SEQ ID NO: 584242 - DNA, 21 bp, Homo sapiens
aggtgcaacagacttgaatgc

SEQ ID NO: 584243 - DNA, 20 bp, Homo sapiens
aggtgctaatttgttttgga

SEQ ID NO: 584244 - DNA, 23 bp, Homo sapiens
aggtgctaatttgttttggatat

SEQ ID NO: 584245 - DNA, 22 bp, Homo sapiens
aggtggcactaccccaaaccca

SEQ ID NO: 584246 - DNA, 18 bp, Homo sapiens
aggtgtttgtggggctgg

SEQ ID NO: 584247 - DNA, 14 bp, Homo sapiens
aggttgcagtgagc

SEQ ID NO: 584248 - DNA, 22 bp, Homo sapiens
aggttgtggggcctcaggctcc

SEQ ID NO: 584249 - DNA, 22 bp, Homo sapiens
aggtttacaataggagtggtga

SEQ ID NO: 584250 - DNA, 22 bp, Homo sapiens
aggttttccaaaagtaaagatg

SEQ ID NO: 584251 - DNA, 21 bp, Homo sapiens
agtaagaataccacatcaaat

SEQ ID NO: 584252 - DNA, 21 bp, Homo sapiens
agtaagtgcgaagactgagcc

SEQ ID NO: 584253 - DNA, 16 bp, Homo sapiens
agtaatgctaaatgtg

SEQ ID NO: 584254 - DNA, 14 bp, Homo sapiens
agtaggtgatgagt

SEQ ID NO: 584255 - DNA, 13 bp, Homo sapiens
agtattgtttaaa

SEQ ID NO: 584256 - DNA, 22 bp, Homo sapiens
agtattgtttaaaatgtaattt

SEQ ID NO: 584257 - DNA, 16 bp, Homo sapiens
agtatttccttccact

SEQ ID NO: 584258 - DNA, 20 bp, Homo sapiens
agtcagaatttttaactgta

SEQ ID NO: 584259 - DNA, 21 bp, Homo sapiens
agtccctgtgaagactgggtg

SEQ ID NO: 584260 - DNA, 20 bp, Homo sapiens
agtcctaaaagttctcaatg

SEQ ID NO: 584261 - DNA, 22 bp, Homo sapiens
agtcctaaaagttctcaatgta

SEQ ID NO: 584262 - DNA, 23 bp, Homo sapiens
agtctggagtgggataggagcag

SEQ ID NO: 584263 - DNA, 15 bp, Homo sapiens
agtctttcatggctg

SEQ ID NO: 584264 - DNA, 17 bp, Homo sapiens
agtgacaaagcctctga

SEQ ID NO: 584265 - DNA, 21 bp, Homo sapiens
agtgagtgacaaagcctctga

SEQ ID NO: 584266 - DNA, 16 bp, Homo sapiens
agtgcatgaaaaacca

SEQ ID NO: 584267 - DNA, 23 bp, Homo sapiens
agtgcctgtgagcatggggccag

SEQ ID NO: 584268 - DNA, 24 bp, Homo sapiens
agtggaacgaaaatgaaagctact

SEQ ID NO: 584269 - DNA, 15 bp, Homo sapiens
agtggagagagcagg

SEQ ID NO: 584270 - DNA, 21 bp, Homo sapiens
agtgggctttggtggccaggg

SEQ ID NO: 584271 - DNA, 15 bp, Homo sapiens
agtggtgatttgaaa

SEQ ID NO: 584272 - DNA, 17 bp, Homo sapiens
agtggtgtgtgaagttt

SEQ ID NO: 584273 - DNA, 16 bp, Homo sapiens
agtgtagcatcttcct

SEQ ID NO: 584274 - DNA, 21 bp, Homo sapiens
agtgtagcatcttcctctgca

SEQ ID NO: 584275 - DNA, 15 bp, Homo sapiens
agtgtgtgccaagag

SEQ ID NO: 584276 - DNA, 15 bp, Homo sapiens
agtgttctgcatgga

SEQ ID NO: 584277 - DNA, 19 bp, Homo sapiens
agtgttgcctcttgcaatg

SEQ ID NO: 584278 - DNA, 20 bp, Homo sapiens
agtgttgcctcttgcaatgc

SEQ ID NO: 584279 - DNA, 14 bp, Homo sapiens
agttataagaagaa

SEQ ID NO: 584280 - DNA, 19 bp, Homo sapiens
agttccaaacagacaaaac

SEQ ID NO: 584281 - DNA, 17 bp, Homo sapiens
agttcccttgaaacttt

SEQ ID NO: 584282 - DNA, 22 bp, Homo sapiens
agttcccttgaaactttgggaa

SEQ ID NO: 584283 - DNA, 17 bp, Homo sapiens
agttctcaaatgtgtgt

SEQ ID NO: 584284 - DNA, 18 bp, Homo sapiens
agttctcaaatgtgtgtg

SEQ ID NO: 584285 - DNA, 19 bp, Homo sapiens
agttctcaaatgtgtgtgg

SEQ ID NO: 584286 - DNA, 17 bp, Homo sapiens
agttctggatgtctggc

SEQ ID NO: 584287 - DNA, 15 bp, Homo sapiens
agttgcactcaggtg

SEQ ID NO: 584288 - DNA, 20 bp, Homo sapiens
agttgccatgggaaacaaat

SEQ ID NO: 584289 - DNA, 19 bp, Homo sapiens
agttgcttgtcttctggta

SEQ ID NO: 584290 - DNA, 15 bp, Homo sapiens
agttgggtgtctcct

SEQ ID NO: 584291 - DNA, 17 bp, Homo sapiens
agtttaagaccagcctg

SEQ ID NO: 584292 - DNA, 23 bp, Homo sapiens
agtttaatgtctcctttgctctt

SEQ ID NO: 584293 - DNA, 15 bp, Homo sapiens
agtttggttttgaca

SEQ ID NO: 584294 - DNA, 15 bp, Homo sapiens
agttttcattaaatc

SEQ ID NO: 584295 - DNA, 15 bp, Homo sapiens
agttttgctgtctct

SEQ ID NO: 584296 - DNA, 23 bp, Homo sapiens
agttttgttgtacttaaatggta

SEQ ID NO: 584297 - DNA, 14 bp, Homo sapiens
agtttttgacattt

SEQ ID NO: 584298 - DNA, 14 bp, Homo sapiens
agccaattagactt

SEQ ID NO: 584299 - DNA, 18 bp, Homo sapiens
agccagattggccaatta

SEQ ID NO: 584300 - DNA, 19 bp, Homo sapiens
agccagattggccaattaa

SEQ ID NO: 584301 - DNA, 21 bp, Homo sapiens
agccagattggccaattaaaa

SEQ ID NO: 584302 - DNA, 14 bp, Homo sapiens
agccaggaggcctg

SEQ ID NO: 584303 - DNA, 17 bp, Homo sapiens
agccaggcaagaaagct

SEQ ID NO: 584304 - DNA, 18 bp, Homo sapiens
agccatgcctccctgggc

SEQ ID NO: 584305 - DNA, 23 bp, Homo sapiens
agccatgcctccctgggccacct

SEQ ID NO: 584306 - DNA, 19 bp, Homo sapiens
agccattgaacagctgtga

SEQ ID NO: 584307 - DNA, 22 bp, Homo sapiens
agccattgaacagctgtgagcc

SEQ ID NO: 584308 - DNA, 12 bp, Homo sapiens
agccccaggaga

SEQ ID NO: 584309 - DNA, 12 bp, Homo sapiens
agccctccccca

SEQ ID NO: 584310 - DNA, 17 bp, Homo sapiens
agccctcctgagggccg

SEQ ID NO: 584311 - DNA, 18 bp, Homo sapiens
agcctaaggctcctgttt

SEQ ID NO: 584312 - DNA, 12 bp, Homo sapiens
agcctaagggat

SEQ ID NO: 584313 - DNA, 16 bp, Homo sapiens
agcctagcctatgtct

SEQ ID NO: 584314 - DNA, 18 bp, Homo sapiens
agcctagcctatgtctgg

SEQ ID NO: 584315 - DNA, 22 bp, Homo sapiens
agcctagcctatgtctggcaga

SEQ ID NO: 584316 - DNA, 16 bp, Homo sapiens
agcctatgtctggcag

SEQ ID NO: 584317 - DNA, 15 bp, Homo sapiens
agcctgcattgagct

SEQ ID NO: 584318 - DNA, 22 bp, Homo sapiens
agcctgcattgagcttgcatgc

SEQ ID NO: 584319 - DNA, 18 bp, Homo sapiens
agcctgctttcctgcagc

SEQ ID NO: 584320 - DNA, 22 bp, Homo sapiens
agccttcaaaactatagcttgc

SEQ ID NO: 584321 - DNA, 20 bp, Homo sapiens
agccttctccctagctcctc

SEQ ID NO: 584322 - DNA, 14 bp, Homo sapiens
agccttgcagcggc

SEQ ID NO: 584323 - DNA, 18 bp, Homo sapiens
agccttgcagcggctcct

SEQ ID NO: 584324 - DNA, 22 bp, Homo sapiens
agccttgcagcggctcctgcaa

SEQ ID NO: 584325 - DNA, 20 bp, Homo sapiens
agccttttctggtccctctt

SEQ ID NO: 584326 - DNA, 21 bp, Homo sapiens
agccttttctggtccctcttc

SEQ ID NO: 584327 - DNA, 22 bp, Homo sapiens
agccttttctggtccctcttct

SEQ ID NO: 584328 - DNA, 20 bp, Homo sapiens
agcggctcctcgcccccacc

SEQ ID NO: 584329 - DNA, 19 bp, Homo sapiens
agctattagcggctcctcg

SEQ ID NO: 584330 - DNA, 17 bp, Homo sapiens
agctcaagcattctgtt

SEQ ID NO: 584331 - DNA, 23 bp, Homo sapiens
agctcagctgagcatggagacag

SEQ ID NO: 584332 - DNA, 19 bp, Homo sapiens
agctcctccccttcctctt

SEQ ID NO: 584333 - DNA, 16 bp, Homo sapiens
agctctgaaatcttcc

SEQ ID NO: 584334 - DNA, 21 bp, Homo sapiens
agctctgaagaactctctgga

SEQ ID NO: 584335 - DNA, 22 bp, Homo sapiens
agctctgaagaactctctggaa

SEQ ID NO: 584336 - DNA, 18 bp, Homo sapiens
agctgaagaattgaaaag

SEQ ID NO: 584337 - DNA, 18 bp, Homo sapiens
agctgagcatggagacag

SEQ ID NO: 584338 - DNA, 21 bp, Homo sapiens
agctgagcatggagacagcag

SEQ ID NO: 584339 - DNA, 18 bp, Homo sapiens
agctgaggctgagaaagc

SEQ ID NO: 584340 - DNA, 14 bp, Homo sapiens
agctggctctgtga

SEQ ID NO: 584341 - DNA, 17 bp, Homo sapiens
agctgtgagccatgcct

SEQ ID NO: 584342 - DNA, 19 bp, Homo sapiens
agctgtgagccatgcctcc

SEQ ID NO: 584343 - DNA, 13 bp, Homo sapiens
agcttcagccagg

SEQ ID NO: 584344 - DNA, 15 bp, Homo sapiens
agcttcagccaggca

SEQ ID NO: 584345 - DNA, 20 bp, Homo sapiens
agcttcagccaggcaagaaa

SEQ ID NO: 584346 - DNA, 23 bp, Homo sapiens
agcttcagccaggcaagaaagct

SEQ ID NO: 584347 - DNA, 16 bp, Homo sapiens
cttccattttaatttt

SEQ ID NO: 584348 - DNA, 11 bp, Homo sapiens
cttcccagctt

SEQ ID NO: 584349 - DNA, 13 bp, Homo sapiens
cttcccatgcatt

SEQ ID NO: 584350 - DNA, 18 bp, Homo sapiens
cttcccatgcattctggt

SEQ ID NO: 584351 - DNA, 17 bp, Homo sapiens
cttcccctttgtcctgc

SEQ ID NO: 584352 - DNA, 19 bp, Homo sapiens
cttcccctttgtcctgcgt

SEQ ID NO: 584353 - DNA, 18 bp, Homo sapiens
cttcctattctcctgcca

SEQ ID NO: 584354 - DNA, 12 bp, Homo sapiens
cttcctcctacc

SEQ ID NO: 584355 - DNA, 14 bp, Homo sapiens
cttcctcctacctg

SEQ ID NO: 584356 - DNA, 15 bp, Homo sapiens
cttcctcctacctgg

SEQ ID NO: 584357 - DNA, 19 bp, Homo sapiens
cttcctcctacctggggac

SEQ ID NO: 584358 - DNA, 19 bp, Homo sapiens
cttcctgtcctgcctcctc

SEQ ID NO: 584359 - DNA, 11 bp, Homo sapiens
cttccttcaac

SEQ ID NO: 584360 - DNA, 13 bp, Homo sapiens
cttctattctagc

SEQ ID NO: 584361 - DNA, 21 bp, Homo sapiens
cttctattctagcctgcattg

SEQ ID NO: 584362 - DNA, 16 bp, Homo sapiens
cttctccctagctcct

SEQ ID NO: 584363 - DNA, 13 bp, Homo sapiens
cttctggccttgt

SEQ ID NO: 584364 - DNA, 18 bp, Homo sapiens
cttctgggtccagggagg

SEQ ID NO: 584365 - DNA, 15 bp, Homo sapiens
cttctgtaattgtgt

SEQ ID NO: 584366 - DNA, 13 bp, Homo sapiens
cttgaaacctgat

SEQ ID NO: 584367 - DNA, 19 bp, Homo sapiens
cttgactacctactggtgt

SEQ ID NO: 584368 - DNA, 13 bp, Homo sapiens
cttgagattctga

SEQ ID NO: 584369 - DNA, 23 bp, Homo sapiens
cttgagattctgaagtatgaagt

SEQ ID NO: 584370 - DNA, 19 bp, Homo sapiens
cttgatttcaaagttttgt

SEQ ID NO: 584371 - DNA, 15 bp, Homo sapiens
cttgcagcggctcct

SEQ ID NO: 584372 - DNA, 16 bp, Homo sapiens
cttgcagcggctcctg

SEQ ID NO: 584373 - DNA, 17 bp, Homo sapiens
cttgcagcggctcctgc

SEQ ID NO: 584374 - DNA, 18 bp, Homo sapiens
cttgcagcggctcctgca

SEQ ID NO: 584375 - DNA, 17 bp, Homo sapiens
cttgccactgcactcca

SEQ ID NO: 584376 - DNA, 16 bp, Homo sapiens
cttgccatcctgatgg

SEQ ID NO: 584377 - DNA, 17 bp, Homo sapiens
cttgccatcctgatgga

SEQ ID NO: 584378 - DNA, 18 bp, Homo sapiens
cttgcttggggaacttgt

SEQ ID NO: 584379 - DNA, 19 bp, Homo sapiens
cttggaaattcctgtactg

SEQ ID NO: 584380 - DNA, 19 bp, Homo sapiens
cttggtggctcacgcctgt

SEQ ID NO: 584381 - DNA, 17 bp, Homo sapiens
cttggtggcttttcctt

SEQ ID NO: 584382 - DNA, 17 bp, Homo sapiens
cttggttgatgtttaaa

SEQ ID NO: 584383 - DNA, 23 bp, Homo sapiens
cttgttgcactgccccctgcttg

SEQ ID NO: 584384 - DNA, 21 bp, Homo sapiens
cttgttttggatggcttgtct

SEQ ID NO: 584385 - DNA, 13 bp, Homo sapiens
ctttaaattgtgt

SEQ ID NO: 584386 - DNA, 23 bp, Homo sapiens
ctttaactgccgtaatttaactt

SEQ ID NO: 584387 - DNA, 14 bp, Homo sapiens
ctttagaagcctgc

SEQ ID NO: 584388 - DNA, 15 bp, Homo sapiens
ctttagaagcctgca

SEQ ID NO: 584389 - DNA, 21 bp, Homo sapiens
ctttagtttttggttgggaat

SEQ ID NO: 584390 - DNA, 16 bp, Homo sapiens
ctttatatttcaataa

SEQ ID NO: 584391 - DNA, 13 bp, Homo sapiens
ctttattgcaatg

SEQ ID NO: 584392 - DNA, 22 bp, Homo sapiens
ctttcagaaatataacacattt

SEQ ID NO: 584393 - DNA, 13 bp, Homo sapiens
ctttcctttttcc

SEQ ID NO: 584394 - DNA, 21 bp, Homo sapiens
ctttcctttttcccaataaat

SEQ ID NO: 584395 - DNA, 17 bp, Homo sapiens
ctttctatttttatgat

SEQ ID NO: 584396 - DNA, 20 bp, Homo sapiens
ctttctcctccccacctgta

SEQ ID NO: 584397 - DNA, 21 bp, Homo sapiens
ctttctcctccccacctgtag

SEQ ID NO: 584398 - DNA, 18 bp, Homo sapiens
ctttgacaattgggagct

SEQ ID NO: 584399 - DNA, 16 bp, Homo sapiens
ctttgattatgcagac

SEQ ID NO: 584400 - DNA, 22 bp, Homo sapiens
ctttgcaatactgcttaattgc

SEQ ID NO: 584401 - DNA, 16 bp, Homo sapiens
ctttgcattttgatat

SEQ ID NO: 584402 - DNA, 18 bp, Homo sapiens
ctttggaagatgcagaag

SEQ ID NO: 584403 - DNA, 19 bp, Homo sapiens
ctttggaagatgcagaagc

SEQ ID NO: 584404 - DNA, 14 bp, Homo sapiens
ctttggacttctga

SEQ ID NO: 584405 - DNA, 17 bp, Homo sapiens
ctttggacttctgaaga

SEQ ID NO: 584406 - DNA, 16 bp, Homo sapiens
ctttggtggccaggga

SEQ ID NO: 584407 - DNA, 13 bp, Homo sapiens
ctttgtaaaaatc

SEQ ID NO: 584408 - DNA, 12 bp, Homo sapiens
ctttgtcctgcg

SEQ ID NO: 584409 - DNA, 23 bp, Homo sapiens
ctttgtctaagtagggccagggc

SEQ ID NO: 584410 - DNA, 16 bp, Homo sapiens
cttttataaagcatgt

SEQ ID NO: 584411 - DNA, 17 bp, Homo sapiens
cttttctcagtgttggt

SEQ ID NO: 584412 - DNA, 16 bp, Homo sapiens
cttttctggtccctct

SEQ ID NO: 584413 - DNA, 22 bp, Homo sapiens
ctttttccaactcagaaattca

SEQ ID NO: 584414 - DNA, 16 bp, Homo sapiens
cttttttttttcttgg

SEQ ID NO: 584415 - DNA, 9 bp, Homo sapiens
gaaaacaga

SEQ ID NO: 584416 - DNA, 14 bp, Homo sapiens
gaaaacatgttaat

SEQ ID NO: 584417 - DNA, 13 bp, Homo sapiens
gaaaaccacttta

SEQ ID NO: 584418 - DNA, 19 bp, Homo sapiens
gaaaatctttataaatgta

SEQ ID NO: 584419 - DNA, 13 bp, Homo sapiens
gaaaatgaaagct

SEQ ID NO: 584420 - DNA, 16 bp, Homo sapiens
gaaaattcttaaaagg

SEQ ID NO: 584421 - DNA, 12 bp, Homo sapiens
gaaaattgagtt

SEQ ID NO: 584422 - DNA, 19 bp, Homo sapiens
gaaacaaacaaaactctta

SEQ ID NO: 584423 - DNA, 20 bp, Homo sapiens
gaaacaaacaaaactcttaa

SEQ ID NO: 584424 - DNA, 18 bp, Homo sapiens
gaaacaaataatttgaac

SEQ ID NO: 584425 - DNA, 18 bp, Homo sapiens
gaaaccagagtctgtatt

SEQ ID NO: 584426 - DNA, 13 bp, Homo sapiens
gaaacttctcagt

SEQ ID NO: 584427 - DNA, 21 bp, Homo sapiens
gaaagagcctaacatctccat

SEQ ID NO: 584428 - DNA, 14 bp, Homo sapiens
gaaagctaaagttt

SEQ ID NO: 584429 - DNA, 19 bp, Homo sapiens
gaaagctaaagtttggttt

SEQ ID NO: 584430 - DNA, 11 bp, Homo sapiens
gaaagtttttt

SEQ ID NO: 584431 - DNA, 14 bp, Homo sapiens
gaaataatgctaca

SEQ ID NO: 584432 - DNA, 19 bp, Homo sapiens
gaaataatgctacaatttt

SEQ ID NO: 584433 - DNA, 14 bp, Homo sapiens
gaaatacgtttgtg

SEQ ID NO: 584434 - DNA, 16 bp, Homo sapiens
gaaatagaattataac

SEQ ID NO: 584435 - DNA, 12 bp, Homo sapiens
gaaatgaacttt

SEQ ID NO: 584436 - DNA, 20 bp, Homo sapiens
ctgcaaaactccaggcagga

SEQ ID NO: 584437 - DNA, 14 bp, Homo sapiens
ctgcaatcactgtg

SEQ ID NO: 584438 - DNA, 20 bp, Homo sapiens
ctgcacacactcacctctaa

SEQ ID NO: 584439 - DNA, 23 bp, Homo sapiens
ctgcagagatttctcattgactt

SEQ ID NO: 584440 - DNA, 21 bp, Homo sapiens
ctgcagcagtcgcccaagcag

SEQ ID NO: 584441 - DNA, 21 bp, Homo sapiens
ctgcagttttgctatctgggc

SEQ ID NO: 584442 - DNA, 14 bp, Homo sapiens
ctgcatagccggtg

SEQ ID NO: 584443 - DNA, 18 bp, Homo sapiens
ctgccaatctgtacaaaa

SEQ ID NO: 584444 - DNA, 19 bp, Homo sapiens
ctgccaatctgtacaaaat

SEQ ID NO: 584445 - DNA, 19 bp, Homo sapiens
ctgccagctctcaggaccg

SEQ ID NO: 584446 - DNA, 18 bp, Homo sapiens
ctgccagctgcagcctgg

SEQ ID NO: 584447 - DNA, 23 bp, Homo sapiens
ctgccatggctaggtagaagtga

SEQ ID NO: 584448 - DNA, 19 bp, Homo sapiens
ctgccatgggtgcagaccc

SEQ ID NO: 584449 - DNA, 20 bp, Homo sapiens
ctgccccggacctacctccc

SEQ ID NO: 584450 - DNA, 21 bp, Homo sapiens
ctgcccctaccctggacttgc

SEQ ID NO: 584451 - DNA, 18 bp, Homo sapiens
ctgccctgggctcctctt

SEQ ID NO: 584452 - DNA, 19 bp, Homo sapiens
ctgccgttttctgggctga

SEQ ID NO: 584453 - DNA, 12 bp, Homo sapiens
ctgcctcctcat

SEQ ID NO: 584454 - DNA, 12 bp, Homo sapiens
ctgcctctcttc

SEQ ID NO: 584455 - DNA, 20 bp, Homo sapiens
ctgcgcggactcgcccccag

SEQ ID NO: 584456 - DNA, 15 bp, Homo sapiens
ctgctatttctcttg

SEQ ID NO: 584457 - DNA, 16 bp, Homo sapiens
ctgctatttctcttgc

SEQ ID NO: 584458 - DNA, 17 bp, Homo sapiens
ctgctatttctcttgct

SEQ ID NO: 584459 - DNA, 20 bp, Homo sapiens
ctgctccaatgactgagcag

SEQ ID NO: 584460 - DNA, 12 bp, Homo sapiens
ctgctgttgaac

SEQ ID NO: 584461 - DNA, 17 bp, Homo sapiens
ctgctttcctgcagcag

SEQ ID NO: 584462 - DNA, 23 bp, Homo sapiens
ctggatcccgttcagaaaaccac

SEQ ID NO: 584463 - DNA, 19 bp, Homo sapiens
ctggattgcagactgttct

SEQ ID NO: 584464 - DNA, 18 bp, Homo sapiens
ctggatttgcagaagttt

SEQ ID NO: 584465 - DNA, 21 bp, Homo sapiens
ctggctgccgttttctgggct

SEQ ID NO: 584466 - DNA, 23 bp, Homo sapiens
ctggctgttctgatcggccagtt

SEQ ID NO: 584467 - DNA, 23 bp, Homo sapiens
ctgggaacatcacattcctctgc

SEQ ID NO: 584468 - DNA, 13 bp, Homo sapiens
ctgggcagaggga

SEQ ID NO: 584469 - DNA, 20 bp, Homo sapiens
ctgggcatcagggcctttct

SEQ ID NO: 584470 - DNA, 17 bp, Homo sapiens
ctgggccacctcctacc

SEQ ID NO: 584471 - DNA, 18 bp, Homo sapiens
ctgggccacctcctaccc

SEQ ID NO: 584472 - DNA, 19 bp, Homo sapiens
ctgggccacctcctacccc

SEQ ID NO: 584473 - DNA, 15 bp, Homo sapiens
ctgggctgtgggcaa

SEQ ID NO: 584474 - DNA, 22 bp, Homo sapiens
ctggggacacagcatcagctca

SEQ ID NO: 584475 - DNA, 23 bp, Homo sapiens
ctggggactcctcaaaccacttg

SEQ ID NO: 584476 - DNA, 17 bp, Homo sapiens
ctggggacttgtgtctg

SEQ ID NO: 584477 - DNA, 18 bp, Homo sapiens
ctggggacttgtgtctgc

SEQ ID NO: 584478 - DNA, 19 bp, Homo sapiens
ctggggcggcatgaaccct

SEQ ID NO: 584479 - DNA, 14 bp, Homo sapiens
ctgggtccagggag

SEQ ID NO: 584480 - DNA, 14 bp, Homo sapiens
ctgggtcccagcct

SEQ ID NO: 584481 - DNA, 12 bp, Homo sapiens
ctggtccctctt

SEQ ID NO: 584482 - DNA, 21 bp, Homo sapiens
ctggtctggttgggcagccag

SEQ ID NO: 584483 - DNA, 16 bp, Homo sapiens
ctggtgtccagctgag

SEQ ID NO: 584484 - DNA, 20 bp, Homo sapiens
ctggttcggctctagggcct

SEQ ID NO: 584485 - DNA, 15 bp, Homo sapiens
ctgtaaaacaggtta

SEQ ID NO: 584486 - DNA, 22 bp, Homo sapiens
ctgtaaagatgtttatttcagg

SEQ ID NO: 584487 - DNA, 17 bp, Homo sapiens
ctgtagagccaattaga

SEQ ID NO: 584488 - DNA, 14 bp, Homo sapiens
ctgtagatatgtat

SEQ ID NO: 584489 - DNA, 15 bp, Homo sapiens
ctgtcctgcctcctc

SEQ ID NO: 584490 - DNA, 16 bp, Homo sapiens
ctgtcgtggagccatt

SEQ ID NO: 584491 - DNA, 13 bp, Homo sapiens
ctgtctcaaaaaa

SEQ ID NO: 584492 - DNA, 21 bp, Homo sapiens
ctgtctcttaaaaaaataaaa

SEQ ID NO: 584493 - DNA, 15 bp, Homo sapiens
ctgtgagccatgcct

SEQ ID NO: 584494 - DNA, 19 bp, Homo sapiens
ctgtgagccatgcctccct

SEQ ID NO: 584495 - DNA, 20 bp, Homo sapiens
ctgtgagccatgcctccctg

SEQ ID NO: 584496 - DNA, 21 bp, Homo sapiens
ctgtgagccatgcctccctgg

SEQ ID NO: 584497 - DNA, 13 bp, Homo sapiens
ctgtgagccttgc

SEQ ID NO: 584498 - DNA, 17 bp, Homo sapiens
ctgtgagccttgcatga

SEQ ID NO: 584499 - DNA, 15 bp, Homo sapiens
ctgtgattactgcaa

SEQ ID NO: 584500 - DNA, 18 bp, Homo sapiens
ctgtgattactgcaatca

SEQ ID NO: 584501 - DNA, 23 bp, Homo sapiens
ctgtgattactgcaatcactgtg

SEQ ID NO: 584502 - DNA, 18 bp, Homo sapiens
ctgtggcataaattgcat

SEQ ID NO: 584503 - DNA, 17 bp, Homo sapiens
ctgtgggaaagagccta

SEQ ID NO: 584504 - DNA, 15 bp, Homo sapiens
ctgtgggccagattg

SEQ ID NO: 584505 - DNA, 23 bp, Homo sapiens
ctgtgtaaccagctcagtgtttt

SEQ ID NO: 584506 - DNA, 18 bp, Homo sapiens
ctgtgtgaccctgggcag

SEQ ID NO: 584507 - DNA, 18 bp, Homo sapiens
ctgtgttttgaaagaata

SEQ ID NO: 584508 - DNA, 14 bp, Homo sapiens
ctgttaagagagga

SEQ ID NO: 584509 - DNA, 22 bp, Homo sapiens
ctgttaaggacccttttaagca

SEQ ID NO: 584510 - DNA, 23 bp, Homo sapiens
ctgttaaggacccttttaagcat

SEQ ID NO: 584511 - DNA, 15 bp, Homo sapiens
ctgttgcacttttga

SEQ ID NO: 584512 - DNA, 16 bp, Homo sapiens
ctgttgcacttttgaa

SEQ ID NO: 584513 - DNA, 17 bp, Homo sapiens
ctgttgcacttttgaat

SEQ ID NO: 584514 - DNA, 17 bp, Homo sapiens
ctgttgtaagaattctg

SEQ ID NO: 584515 - DNA, 16 bp, Homo sapiens
ctgtttcctagctgtg

SEQ ID NO: 584516 - DNA, 22 bp, Homo sapiens
ctgtttgcatttgatacatttt

SEQ ID NO: 584517 - DNA, 14 bp, Homo sapiens
cttaaaaaaataaa

SEQ ID NO: 584518 - DNA, 19 bp, Homo sapiens
cttaaacgaagagttccct

SEQ ID NO: 584519 - DNA, 18 bp, Homo sapiens
ctcacacccctgccccca

SEQ ID NO: 584520 - DNA, 14 bp, Homo sapiens
ctcacgtcaaatgc

SEQ ID NO: 584521 - DNA, 19 bp, Homo sapiens
ctcagcctgctttcctgca

SEQ ID NO: 584522 - DNA, 13 bp, Homo sapiens
ctcaggaggctga

SEQ ID NO: 584523 - DNA, 18 bp, Homo sapiens
ctcaggccaagggaccag

SEQ ID NO: 584524 - DNA, 22 bp, Homo sapiens
ctcaggctccgggcaccagggg

SEQ ID NO: 584525 - DNA, 20 bp, Homo sapiens
ctcaggctcctaaagagaca

SEQ ID NO: 584526 - DNA, 21 bp, Homo sapiens
ctcagtgttggtatattttat

SEQ ID NO: 584527 - DNA, 18 bp, Homo sapiens
ctcagttctcaaatgtgt

SEQ ID NO: 584528 - DNA, 15 bp, Homo sapiens
ctcataatgctttgt

SEQ ID NO: 584529 - DNA, 18 bp, Homo sapiens
ctcatgcatagtcccagc

SEQ ID NO: 584530 - DNA, 21 bp, Homo sapiens
ctcattgacttttataaagca

SEQ ID NO: 584531 - DNA, 22 bp, Homo sapiens
ctcattgacttttataaagcat

SEQ ID NO: 584532 - DNA, 17 bp, Homo sapiens
ctccacaggagagactg

SEQ ID NO: 584533 - DNA, 13 bp, Homo sapiens
ctccactcttctc

SEQ ID NO: 584534 - DNA, 12 bp, Homo sapiens
ctccaggcagga

SEQ ID NO: 584535 - DNA, 15 bp, Homo sapiens
ctcccacttcctcct

SEQ ID NO: 584536 - DNA, 13 bp, Homo sapiens
ctcccagtctctg

SEQ ID NO: 584537 - DNA, 13 bp, Homo sapiens
ctccccacctgta

SEQ ID NO: 584538 - DNA, 16 bp, Homo sapiens
ctccccacctgtagct

SEQ ID NO: 584539 - DNA, 21 bp, Homo sapiens
ctcccctcacacacaaattga

SEQ ID NO: 584540 - DNA, 19 bp, Homo sapiens
ctccccttttaccactccc

SEQ ID NO: 584541 - DNA, 21 bp, Homo sapiens
ctccccttttaccactcccag

SEQ ID NO: 584542 - DNA, 12 bp, Homo sapiens
ctccctccctct

SEQ ID NO: 584543 - DNA, 16 bp, Homo sapiens
ctccctgggccacctc

SEQ ID NO: 584544 - DNA, 20 bp, Homo sapiens
ctccctgggccacctcctac

SEQ ID NO: 584545 - DNA, 22 bp, Homo sapiens
ctccgccatggggtcggctcct

SEQ ID NO: 584546 - DNA, 19 bp, Homo sapiens
ctccgcgggagaccccttg

SEQ ID NO: 584547 - DNA, 17 bp, Homo sapiens
ctccgggcaccaggggc

SEQ ID NO: 584548 - DNA, 20 bp, Homo sapiens
ctcctaactgccagccccct

SEQ ID NO: 584549 - DNA, 17 bp, Homo sapiens
ctcctaagtcccttcct

SEQ ID NO: 584550 - DNA, 18 bp, Homo sapiens
ctcctaagtcccttccta

SEQ ID NO: 584551 - DNA, 17 bp, Homo sapiens
ctcctaccccttcctgt

SEQ ID NO: 584552 - DNA, 18 bp, Homo sapiens
ctcctaccccttcctgtc

SEQ ID NO: 584553 - DNA, 14 bp, Homo sapiens
ctcctacctgggga

SEQ ID NO: 584554 - DNA, 19 bp, Homo sapiens
ctcctacctggggactcct

SEQ ID NO: 584555 - DNA, 22 bp, Homo sapiens
ctcctcaaaccacttgcctggg

SEQ ID NO: 584556 - DNA, 18 bp, Homo sapiens
ctcctcatcagtgtgtaa

SEQ ID NO: 584557 - DNA, 15 bp, Homo sapiens
ctcctccccttcctc

SEQ ID NO: 584558 - DNA, 17 bp, Homo sapiens
ctcctccccttcctctt

SEQ ID NO: 584559 - DNA, 13 bp, Homo sapiens
ctcctcgagccct

SEQ ID NO: 584560 - DNA, 16 bp, Homo sapiens
ctcctcgagccctccc

SEQ ID NO: 584561 - DNA, 18 bp, Homo sapiens
ctcctcgcccccaccagt

SEQ ID NO: 584562 - DNA, 19 bp, Homo sapiens
ctcctcgcccccaccagtg

SEQ ID NO: 584563 - DNA, 21 bp, Homo sapiens
ctcctcgcccccaccagtgta

SEQ ID NO: 584564 - DNA, 23 bp, Homo sapiens
ctcctcgcccccaccagtgtagc

SEQ ID NO: 584565 - DNA, 15 bp, Homo sapiens
ctcctctccctccca

SEQ ID NO: 584566 - DNA, 23 bp, Homo sapiens
ctcctgatggtgtcattctgcct

SEQ ID NO: 584567 - DNA, 22 bp, Homo sapiens
ctcctgccatgggtgcagaccc

SEQ ID NO: 584568 - DNA, 16 bp, Homo sapiens
ctcctggaccaggccc

SEQ ID NO: 584569 - DNA, 16 bp, Homo sapiens
ctcctttctccctgca

SEQ ID NO: 584570 - DNA, 14 bp, Homo sapiens
ctcctttgctcttg

SEQ ID NO: 584571 - DNA, 13 bp, Homo sapiens
ctcgagccctccc

SEQ ID NO: 584572 - DNA, 15 bp, Homo sapiens
ctctaaaattataaa

SEQ ID NO: 584573 - DNA, 15 bp, Homo sapiens
ctctacactcttgta

SEQ ID NO: 584574 - DNA, 19 bp, Homo sapiens
ctctagggcctcagtctgg

SEQ ID NO: 584575 - DNA, 13 bp, Homo sapiens
ctctataaagtat

SEQ ID NO: 584576 - DNA, 14 bp, Homo sapiens
ctctcccacttcct

SEQ ID NO: 584577 - DNA, 18 bp, Homo sapiens
ctctcccacttcctccta

SEQ ID NO: 584578 - DNA, 14 bp, Homo sapiens
ctctcctttctccc

SEQ ID NO: 584579 - DNA, 17 bp, Homo sapiens
ctctcctttctccctgc

SEQ ID NO: 584580 - DNA, 21 bp, Homo sapiens
ctctcctttctccctgcagcc

SEQ ID NO: 584581 - DNA, 22 bp, Homo sapiens
ctctcctttctccctgcagcct

SEQ ID NO: 584582 - DNA, 13 bp, Homo sapiens
ctctgaaataatg

SEQ ID NO: 584583 - DNA, 17 bp, Homo sapiens
ctctgaaataatgggat

SEQ ID NO: 584584 - DNA, 20 bp, Homo sapiens
ctctgcacaccctccagaga

SEQ ID NO: 584585 - DNA, 22 bp, Homo sapiens
ctctgcacaccctccagagaca

SEQ ID NO: 584586 - DNA, 19 bp, Homo sapiens
ctctgcctctcttcttccc

SEQ ID NO: 584587 - DNA, 22 bp, Homo sapiens
ctctgcctctcttcttcccctt

SEQ ID NO: 584588 - DNA, 24 bp, Homo sapiens
ctctggatcccgttcagaaaacca

SEQ ID NO: 584589 - DNA, 16 bp, Homo sapiens
ctctgtctacctggtc

SEQ ID NO: 584590 - DNA, 23 bp, Homo sapiens
ctcttatttatagaatttaatat

SEQ ID NO: 584591 - DNA, 13 bp, Homo sapiens
ctcttctctcctc

SEQ ID NO: 584592 - DNA, 12 bp, Homo sapiens
ctcttcttcccc

SEQ ID NO: 584593 - DNA, 12 bp, Homo sapiens
ctcttcttcctc

SEQ ID NO: 584594 - DNA, 12 bp, Homo sapiens
ctcttgccatcc

SEQ ID NO: 584595 - DNA, 16 bp, Homo sapiens
ctcttgccatcctgat

SEQ ID NO: 584596 - DNA, 13 bp, Homo sapiens
ctctttttgtttg

SEQ ID NO: 584597 - DNA, 22 bp, Homo sapiens
ctgaaacgtggatacagagcca

SEQ ID NO: 584598 - DNA, 12 bp, Homo sapiens
ggaaaacatttg

SEQ ID NO: 584599 - DNA, 14 bp, Homo sapiens
ggaaaacatttgct

SEQ ID NO: 584600 - DNA, 22 bp, Homo sapiens
ggaaacaaataatttgaacttt

SEQ ID NO: 584601 - DNA, 19 bp, Homo sapiens
ggaacgctctcctcgagcc

SEQ ID NO: 584602 - DNA, 20 bp, Homo sapiens
ggaagctgccgtagcttcag

SEQ ID NO: 584603 - DNA, 23 bp, Homo sapiens
ggaaggaataaagggagaagagg

SEQ ID NO: 584604 - DNA, 15 bp, Homo sapiens
ggaagggaaagtttt

SEQ ID NO: 584605 - DNA, 17 bp, Homo sapiens
ggaagggaaagtttttt

SEQ ID NO: 584606 - DNA, 16 bp, Homo sapiens
ggaatgaggaaaattc

SEQ ID NO: 584607 - DNA, 17 bp, Homo sapiens
ggaatgaggaaaattct

SEQ ID NO: 584608 - DNA, 18 bp, Homo sapiens
ggacacagcatcagctca

SEQ ID NO: 584609 - DNA, 14 bp, Homo sapiens
ggacacagttcctg

SEQ ID NO: 584610 - DNA, 21 bp, Homo sapiens
ggacacagttcctgggaacat

SEQ ID NO: 584611 - DNA, 16 bp, Homo sapiens
ggacatgcaataaaat

SEQ ID NO: 584612 - DNA, 19 bp, Homo sapiens
ggacatgcaataaaattta

SEQ ID NO: 584613 - DNA, 22 bp, Homo sapiens
ggacatgcaataaaatttaaaa

SEQ ID NO: 584614 - DNA, 13 bp, Homo sapiens
ggacccagagctg

SEQ ID NO: 584615 - DNA, 13 bp, Homo sapiens
ggaccctgtccaa

SEQ ID NO: 584616 - DNA, 17 bp, Homo sapiens
ggacccttctgggtcca

SEQ ID NO: 584617 - DNA, 22 bp, Homo sapiens
ggacccttctgggtccagggag

SEQ ID NO: 584618 - DNA, 23 bp, Homo sapiens
ggaccgtgccctcgtcagctggg

SEQ ID NO: 584619 - DNA, 14 bp, Homo sapiens
ggacctacctccct

SEQ ID NO: 584620 - DNA, 17 bp, Homo sapiens
ggacctacctccctccc

SEQ ID NO: 584621 - DNA, 20 bp, Homo sapiens
ggacctacctccctccctct

SEQ ID NO: 584622 - DNA, 22 bp, Homo sapiens
ggacctgccccggacctacctc

SEQ ID NO: 584623 - DNA, 14 bp, Homo sapiens
ggacgttgttttgg

SEQ ID NO: 584624 - DNA, 17 bp, Homo sapiens
ggagataaggtggcttc

SEQ ID NO: 584625 - DNA, 18 bp, Homo sapiens
ggagataaggtggcttct

SEQ ID NO: 584626 - DNA, 19 bp, Homo sapiens
ggagccattgaacagctgt

SEQ ID NO: 584627 - DNA, 22 bp, Homo sapiens
ggagccattgaacagctgtgag

SEQ ID NO: 584628 - DNA, 13 bp, Homo sapiens
ggagccttcccaa

SEQ ID NO: 584629 - DNA, 21 bp, Homo sapiens
ggagctgcagtcccatgcaca

SEQ ID NO: 584630 - DNA, 19 bp, Homo sapiens
ggaggctgaggtgggcaga

SEQ ID NO: 584631 - DNA, 16 bp, Homo sapiens
ggaggtatgggctggg

SEQ ID NO: 584632 - DNA, 20 bp, Homo sapiens
ggagtttaagaccagcctgg

SEQ ID NO: 584633 - DNA, 14 bp, Homo sapiens
ggatacagagccac

SEQ ID NO: 584634 - DNA, 15 bp, Homo sapiens
ggatacagagccacg

SEQ ID NO: 584635 - DNA, 15 bp, Homo sapiens
ggatactggcacaga

SEQ ID NO: 584636 - DNA, 13 bp, Homo sapiens
ggatatgtggaga

SEQ ID NO: 584637 - DNA, 18 bp, Homo sapiens
ggatattgaatgttaaag

SEQ ID NO: 584638 - DNA, 17 bp, Homo sapiens
ggatccaaactgatcca

SEQ ID NO: 584639 - DNA, 20 bp, Homo sapiens
ggatgaattgtcacatctat

SEQ ID NO: 584640 - DNA, 14 bp, Homo sapiens
ggatggcttgtcta

SEQ ID NO: 584641 - DNA, 14 bp, Homo sapiens
ggattctaaataca

SEQ ID NO: 584642 - DNA, 12 bp, Homo sapiens
ggattctttaaa

SEQ ID NO: 584643 - DNA, 16 bp, Homo sapiens
ggatttaaaagcctgc

SEQ ID NO: 584644 - DNA, 17 bp, Homo sapiens
ggcaaatgcctgactca

SEQ ID NO: 584645 - DNA, 21 bp, Homo sapiens
ggcacctacactcacctgcac

SEQ ID NO: 584646 - DNA, 11 bp, Homo sapiens
ggcagccagac

SEQ ID NO: 584647 - DNA, 23 bp, Homo sapiens
ggcagcctagcctatgtctggca

SEQ ID NO: 584648 - DNA, 12 bp, Homo sapiens
ggcagctgtgat

SEQ ID NO: 584649 - DNA, 15 bp, Homo sapiens
ggcaggaacaaacag

SEQ ID NO: 584650 - DNA, 15 bp, Homo sapiens
ggcaggacagctcct

SEQ ID NO: 584651 - DNA, 19 bp, Homo sapiens
ggcatcagggcctttctcc

SEQ ID NO: 584652 - DNA, 21 bp, Homo sapiens
ggcatcagggcctttctcctc

SEQ ID NO: 584653 - DNA, 22 bp, Homo sapiens
ggcatgaaccctcttgccatcc

SEQ ID NO: 584654 - DNA, 21 bp, Homo sapiens
ggcatgtgcctatagtcccag

SEQ ID NO: 584655 - DNA, 20 bp, Homo sapiens
ggcattctttgcaatactgc

SEQ ID NO: 584656 - DNA, 17 bp, Homo sapiens
ggccaacctcaggctcc

SEQ ID NO: 584657 - DNA, 13 bp, Homo sapiens
ggccaagggacca

SEQ ID NO: 584658 - DNA, 19 bp, Homo sapiens
ggccacagaaggtgaactt

SEQ ID NO: 584659 - DNA, 16 bp, Homo sapiens
ggccacatagatgctg

SEQ ID NO: 584660 - DNA, 13 bp, Homo sapiens
ggccacctcctac

SEQ ID NO: 584661 - DNA, 15 bp, Homo sapiens
ggccacctcctaccc

SEQ ID NO: 584662 - DNA, 18 bp, Homo sapiens
ggccacctcctacccctt

SEQ ID NO: 584663 - DNA, 17 bp, Homo sapiens
ggccataaacggttcct

SEQ ID NO: 584664 - DNA, 18 bp, Homo sapiens
ggccataaacggttcctg

SEQ ID NO: 584665 - DNA, 23 bp, Homo sapiens
ggccattttggggggttatttat

SEQ ID NO: 584666 - DNA, 13 bp, Homo sapiens
ggccgggggaggg

SEQ ID NO: 584667 - DNA, 15 bp, Homo sapiens
ggccgggggaggggc

SEQ ID NO: 584668 - DNA, 14 bp, Homo sapiens
ggcctatgtggtct

SEQ ID NO: 584669 - DNA, 23 bp, Homo sapiens
ggcctcagcctgctttcctgcag

SEQ ID NO: 584670 - DNA, 19 bp, Homo sapiens
ggcctcagctcaatgcagt

SEQ ID NO: 584671 - DNA, 13 bp, Homo sapiens
ggcctcaggctcc

SEQ ID NO: 584672 - DNA, 15 bp, Homo sapiens
ggcctttctcctccc

SEQ ID NO: 584673 - DNA, 21 bp, Homo sapiens
ggcgctgcgcggactcgcccc

SEQ ID NO: 584674 - DNA, 13 bp, Homo sapiens
ggctaatttaaca

SEQ ID NO: 584675 - DNA, 13 bp, Homo sapiens
ggctcctcgcccc

SEQ ID NO: 584676 - DNA, 16 bp, Homo sapiens
ggctcctcgcccccac

SEQ ID NO: 584677 - DNA, 20 bp, Homo sapiens
ggctcctcgcccccaccagt

SEQ ID NO: 584678 - DNA, 17 bp, Homo sapiens
ggctgagccctcctgag

SEQ ID NO: 584679 - DNA, 17 bp, Homo sapiens
ggctgcccacctggctg

SEQ ID NO: 584680 - DNA, 17 bp, Homo sapiens
ggctgccgttttctggg

SEQ ID NO: 584681 - DNA, 16 bp, Homo sapiens
ggctgccttctggcct

SEQ ID NO: 584682 - DNA, 17 bp, Homo sapiens
ggcttgtttacctttct

SEQ ID NO: 584683 - DNA, 23 bp, Homo sapiens
gggaaacaaataatttgaacttt

SEQ ID NO: 584684 - DNA, 16 bp, Homo sapiens
gggaagggcctgccca

SEQ ID NO: 584685 - DNA, 16 bp, Homo sapiens
gggacaggaaagagag

SEQ ID NO: 584686 - DNA, 19 bp, Homo sapiens
gggaccaggtttgcaggag

SEQ ID NO: 584687 - DNA, 20 bp, Homo sapiens
gggactacccatagacatga

SEQ ID NO: 584688 - DNA, 12 bp, Homo sapiens
gggactcctcaa

SEQ ID NO: 584689 - DNA, 19 bp, Homo sapiens
gggactcctcaaaccactt

SEQ ID NO: 584690 - DNA, 22 bp, Homo sapiens
gggactcctcaaaccacttgcc

SEQ ID NO: 584691 - DNA, 15 bp, Homo sapiens
gggacttgtgtctgc

SEQ ID NO: 584692 - DNA, 21 bp, Homo sapiens
gggagaccccttgttgcactg

SEQ ID NO: 584693 - DNA, 15 bp, Homo sapiens
gggagattgaacttt

SEQ ID NO: 584694 - DNA, 14 bp, Homo sapiens
gggatattttgaaa

SEQ ID NO: 584695 - DNA, 16 bp, Homo sapiens
gggatattttgaaatg

SEQ ID NO: 584696 - DNA, 18 bp, Homo sapiens
gggcaaaagggcagctgt

SEQ ID NO: 584697 - DNA, 20 bp, Homo sapiens
gggcaaaagggcagctgtga

SEQ ID NO: 584698 - DNA, 13 bp, Homo sapiens
gggcactggggcc

SEQ ID NO: 584699 - DNA, 23 bp, Homo sapiens
gggcaggaacggtggaggcagag

SEQ ID NO: 584700 - DNA, 20 bp, Homo sapiens
gggcatcagggcctttctcc

SEQ ID NO: 584701 - DNA, 18 bp, Homo sapiens
gggccaacctcaggctcc

SEQ ID NO: 584702 - DNA, 22 bp, Homo sapiens
gggccacctcctaccccttcct

SEQ ID NO: 584703 - DNA, 23 bp, Homo sapiens
gggccacctcctaccccttcctg

SEQ ID NO: 584704 - DNA, 21 bp, Homo sapiens
gggccataaacggttcctggt

SEQ ID NO: 584705 - DNA, 19 bp, Homo sapiens
gggccggttctaaggctca

SEQ ID NO: 584706 - DNA, 21 bp, Homo sapiens
gggcctttctcctccccacct

SEQ ID NO: 584707 - DNA, 16 bp, Homo sapiens
gggcgcgggagggggc

SEQ ID NO: 584708 - DNA, 19 bp, Homo sapiens
gggctcctcttagctcagc

SEQ ID NO: 584709 - DNA, 16 bp, Homo sapiens
gatatgttatactgaa

SEQ ID NO: 584710 - DNA, 13 bp, Homo sapiens
gatattgaatgtt

SEQ ID NO: 584711 - DNA, 16 bp, Homo sapiens
gatcagcaaaaagact

SEQ ID NO: 584712 - DNA, 23 bp, Homo sapiens
gatccatttccattgcttattat

SEQ ID NO: 584713 - DNA, 21 bp, Homo sapiens
gatccccgtctctgccctggg

SEQ ID NO: 584714 - DNA, 14 bp, Homo sapiens
gatccggaaagaag

SEQ ID NO: 584715 - DNA, 16 bp, Homo sapiens
gatgcatcatctcttc

SEQ ID NO: 584716 - DNA, 14 bp, Homo sapiens
gatgcatttaataa

SEQ ID NO: 584717 - DNA, 15 bp, Homo sapiens
gatgcatttaataaa

SEQ ID NO: 584718 - DNA, 17 bp, Homo sapiens
gatgcatttaataaaga

SEQ ID NO: 584719 - DNA, 18 bp, Homo sapiens
gatgcatttaataaagat

SEQ ID NO: 584720 - DNA, 19 bp, Homo sapiens
gatgcgtttgcctcctgga

SEQ ID NO: 584721 - DNA, 14 bp, Homo sapiens
gatgggtcccctcc

SEQ ID NO: 584722 - DNA, 17 bp, Homo sapiens
gatgtggaaatgaggtt

SEQ ID NO: 584723 - DNA, 22 bp, Homo sapiens
gatgttctattttttgttttgt

SEQ ID NO: 584724 - DNA, 20 bp, Homo sapiens
gattagaaattacctgtgga

SEQ ID NO: 584725 - DNA, 21 bp, Homo sapiens
gattatataaagacctataaa

SEQ ID NO: 584726 - DNA, 18 bp, Homo sapiens
gattatttgtatttacag

SEQ ID NO: 584727 - DNA, 20 bp, Homo sapiens
gattctttcagttctttgga

SEQ ID NO: 584728 - DNA, 11 bp, Homo sapiens
gattgaacttt

SEQ ID NO: 584729 - DNA, 13 bp, Homo sapiens
gattgcctctgaa

SEQ ID NO: 584730 - DNA, 22 bp, Homo sapiens
gatttccagaaccacacttgaa

SEQ ID NO: 584731 - DNA, 16 bp, Homo sapiens
gatttctcattgactt

SEQ ID NO: 584732 - DNA, 15 bp, Homo sapiens
gatttttctttaact

SEQ ID NO: 584733 - DNA, 19 bp, Homo sapiens
gcaaaagggcagctgtgat

SEQ ID NO: 584734 - DNA, 20 bp, Homo sapiens
gcaaacttaagaaacactga

SEQ ID NO: 584735 - DNA, 12 bp, Homo sapiens
gcaaagaccacc

SEQ ID NO: 584736 - DNA, 14 bp, Homo sapiens
gcaataaaatttaa

SEQ ID NO: 584737 - DNA, 21 bp, Homo sapiens
gcaataaaatttaaaaaataa

SEQ ID NO: 584738 - DNA, 21 bp, Homo sapiens
gcaattgcgaccttaatttaa

SEQ ID NO: 584739 - DNA, 19 bp, Homo sapiens
gcacaagatgccccaggga

SEQ ID NO: 584740 - DNA, 22 bp, Homo sapiens
gcacaagatgccccagggatgg

SEQ ID NO: 584741 - DNA, 14 bp, Homo sapiens
gcacatagagaggg

SEQ ID NO: 584742 - DNA, 14 bp, Homo sapiens
gcaccactctcctt

SEQ ID NO: 584743 - DNA, 14 bp, Homo sapiens
gcaccaggggccaa

SEQ ID NO: 584744 - DNA, 22 bp, Homo sapiens
gcacccacaaataaatgacaag

SEQ ID NO: 584745 - DNA, 22 bp, Homo sapiens
gcagaccctgaacccacacctg

SEQ ID NO: 584746 - DNA, 14 bp, Homo sapiens
gcagacgtccatca

SEQ ID NO: 584747 - DNA, 23 bp, Homo sapiens
gcagagcaggacctgggacagga

SEQ ID NO: 584748 - DNA, 16 bp, Homo sapiens
gcagcaggactgtggg

SEQ ID NO: 584749 - DNA, 22 bp, Homo sapiens
gcagcagtcgcccaagcagaca

SEQ ID NO: 584750 - DNA, 23 bp, Homo sapiens
gcagccaggatgactagatcctg

SEQ ID NO: 584751 - DNA, 16 bp, Homo sapiens
gcagccccaggagaag

SEQ ID NO: 584752 - DNA, 17 bp, Homo sapiens
gcagcctggttggcagc

SEQ ID NO: 584753 - DNA, 12 bp, Homo sapiens
gcagcggctcct

SEQ ID NO: 584754 - DNA, 14 bp, Homo sapiens
gcagcggctcctgc

SEQ ID NO: 584755 - DNA, 15 bp, Homo sapiens
gcagcggctcctgca

SEQ ID NO: 584756 - DNA, 11 bp, Homo sapiens
gcagctgtgat

SEQ ID NO: 584757 - DNA, 18 bp, Homo sapiens
gcaggaacaaacagggct

SEQ ID NO: 584758 - DNA, 22 bp, Homo sapiens
gcaggaacggtggaggcagagg

SEQ ID NO: 584759 - DNA, 21 bp, Homo sapiens
gcagggctaaataaagaggag

SEQ ID NO: 584760 - DNA, 20 bp, Homo sapiens
gcagggggtatgcagagctt

SEQ ID NO: 584761 - DNA, 22 bp, Homo sapiens
gcagttagctgaagaattgaaa

SEQ ID NO: 584762 - DNA, 14 bp, Homo sapiens
gcagtttccagaga

SEQ ID NO: 584763 - DNA, 15 bp, Homo sapiens
gcataaattgcatca

SEQ ID NO: 584764 - DNA, 14 bp, Homo sapiens
gcatactttgtatt

SEQ ID NO: 584765 - DNA, 23 bp, Homo sapiens
gcatagataatattgtttggtaa

SEQ ID NO: 584766 - DNA, 18 bp, Homo sapiens
gcatcccatctctcccac

SEQ ID NO: 584767 - DNA, 14 bp, Homo sapiens
gcatcttcctctgc

SEQ ID NO: 584768 - DNA, 22 bp, Homo sapiens
gcatgaaccctcttgccatcct

SEQ ID NO: 584769 - DNA, 23 bp, Homo sapiens
gcatgaaccctcttgccatcctg

SEQ ID NO: 584770 - DNA, 17 bp, Homo sapiens
gcatgcagctttgcaaa

SEQ ID NO: 584771 - DNA, 11 bp, Homo sapiens
gcatgcttccc

SEQ ID NO: 584772 - DNA, 15 bp, Homo sapiens
gcatggagacagcag

SEQ ID NO: 584773 - DNA, 13 bp, Homo sapiens
gcatggtggcatg

SEQ ID NO: 584774 - DNA, 20 bp, Homo sapiens
gcattctttgcaatactgct

SEQ ID NO: 584775 - DNA, 17 bp, Homo sapiens
gcatttaataaagatga

SEQ ID NO: 584776 - DNA, 12 bp, Homo sapiens
gcatttcctaag

SEQ ID NO: 584777 - DNA, 23 bp, Homo sapiens
gcatttgtgtgtgtgtgtgtgtt

SEQ ID NO: 584778 - DNA, 18 bp, Homo sapiens
gccaaaccaggaccctgt

SEQ ID NO: 584779 - DNA, 14 bp, Homo sapiens
gccaagggaccagg

SEQ ID NO: 584780 - DNA, 21 bp, Homo sapiens
gccaatctttcctactttcta

SEQ ID NO: 584781 - DNA, 19 bp, Homo sapiens
gccaattaaaaacgaaaac

SEQ ID NO: 584782 - DNA, 18 bp, Homo sapiens
gccaattagacttgaaat

SEQ ID NO: 584783 - DNA, 19 bp, Homo sapiens
gccacagaaggtgaacttt

SEQ ID NO: 584784 - DNA, 16 bp, Homo sapiens
gccacatcaaaccttt

SEQ ID NO: 584785 - DNA, 14 bp, Homo sapiens
gccacctcctaccc

SEQ ID NO: 584786 - DNA, 18 bp, Homo sapiens
gccacctcctaccccttc

SEQ ID NO: 584787 - DNA, 22 bp, Homo sapiens
gccacctcctaccccttcctgt

SEQ ID NO: 584788 - DNA, 16 bp, Homo sapiens
gccactgttgttttgg

SEQ ID NO: 584789 - DNA, 18 bp, Homo sapiens
gccagaccagcaggctgg

SEQ ID NO: 584790 - DNA, 16 bp, Homo sapiens
gccagagcaaacagaa

SEQ ID NO: 584791 - DNA, 17 bp, Homo sapiens
gccagagcaaacagaaa

SEQ ID NO: 584792 - DNA, 19 bp, Homo sapiens
gccagagcaaacagaaaaa

SEQ ID NO: 584793 - DNA, 21 bp, Homo sapiens
gccagcgacctctctgcctct

SEQ ID NO: 584794 - DNA, 12 bp, Homo sapiens
gccagctgcagc

SEQ ID NO: 584795 - DNA, 16 bp, Homo sapiens
gccataaacggttcct

SEQ ID NO: 584796 - DNA, 17 bp, Homo sapiens
gccataaacggttcctg

SEQ ID NO: 584797 - DNA, 19 bp, Homo sapiens
gccataaacggttcctggt

SEQ ID NO: 584798 - DNA, 23 bp, Homo sapiens
gccataaacggttcctggtgact

SEQ ID NO: 584799 - DNA, 12 bp, Homo sapiens
gccatcctgatg

SEQ ID NO: 584800 - DNA, 14 bp, Homo sapiens
gccatcctgatgga

SEQ ID NO: 584801 - DNA, 14 bp, Homo sapiens
gccatgcctccctg

SEQ ID NO: 584802 - DNA, 19 bp, Homo sapiens
gccatggcaggacagctcc

SEQ ID NO: 584803 - DNA, 18 bp, Homo sapiens
gccatggggtcggctcct

SEQ ID NO: 584804 - DNA, 19 bp, Homo sapiens
gccatggggtcggctcctg

SEQ ID NO: 584805 - DNA, 15 bp, Homo sapiens
gaagggaagagacag

SEQ ID NO: 584806 - DNA, 14 bp, Homo sapiens
gaagtattcacaaa

SEQ ID NO: 584807 - DNA, 17 bp, Homo sapiens
gaagtgtgtgccaagag

SEQ ID NO: 584808 - DNA, 19 bp, Homo sapiens
gaatagatatgaaagctga

SEQ ID NO: 584809 - DNA, 23 bp, Homo sapiens
gaatcacagctcaagcattctgt

SEQ ID NO: 584810 - DNA, 17 bp, Homo sapiens
gaatcagacagcaggaa

SEQ ID NO: 584811 - DNA, 16 bp, Homo sapiens
gaatcagtatttcctt

SEQ ID NO: 584812 - DNA, 18 bp, Homo sapiens
gaatcattcagaaatgtt

SEQ ID NO: 584813 - DNA, 16 bp, Homo sapiens
gaatctatgaacctga

SEQ ID NO: 584814 - DNA, 15 bp, Homo sapiens
gaatgaaagctgttc

SEQ ID NO: 584815 - DNA, 22 bp, Homo sapiens
gaatgaatgggatattttgaaa

SEQ ID NO: 584816 - DNA, 20 bp, Homo sapiens
gaatgcccctgttcatgttt

SEQ ID NO: 584817 - DNA, 22 bp, Homo sapiens
gaatgtccaaaatttatatttt

SEQ ID NO: 584818 - DNA, 13 bp, Homo sapiens
gaattataactgt

SEQ ID NO: 584819 - DNA, 21 bp, Homo sapiens
gaattataactgtaaagatgt

SEQ ID NO: 584820 - DNA, 16 bp, Homo sapiens
gaattgtcacatctat

SEQ ID NO: 584821 - DNA, 12 bp, Homo sapiens
gaatttaatata

SEQ ID NO: 584822 - DNA, 23 bp, Homo sapiens
gacaactcattttcatattgtaa

SEQ ID NO: 584823 - DNA, 16 bp, Homo sapiens
gacacagcatcagctc

SEQ ID NO: 584824 - DNA, 17 bp, Homo sapiens
gacacagcatcagctca

SEQ ID NO: 584825 - DNA, 14 bp, Homo sapiens
gacacagttcctgg

SEQ ID NO: 584826 - DNA, 15 bp, Homo sapiens
gacacagttcctggg

SEQ ID NO: 584827 - DNA, 16 bp, Homo sapiens
gacacagttcctggga

SEQ ID NO: 584828 - DNA, 16 bp, Homo sapiens
gacactattcactaaa

SEQ ID NO: 584829 - DNA, 14 bp, Homo sapiens
gacactgtttcctg

SEQ ID NO: 584830 - DNA, 16 bp, Homo sapiens
gacagttcccagagtg

SEQ ID NO: 584831 - DNA, 14 bp, Homo sapiens
gacagtttttgaca

SEQ ID NO: 584832 - DNA, 19 bp, Homo sapiens
gacataagataaaatgatg

SEQ ID NO: 584833 - DNA, 23 bp, Homo sapiens
gacatggggaggttgtggggcct

SEQ ID NO: 584834 - DNA, 19 bp, Homo sapiens
gaccattttttaatttact

SEQ ID NO: 584835 - DNA, 23 bp, Homo sapiens
gaccattttttaatttacttgtt

SEQ ID NO: 584836 - DNA, 17 bp, Homo sapiens
gacccagagctgctgca

SEQ ID NO: 584837 - DNA, 17 bp, Homo sapiens
gaccccttgttgcactg

SEQ ID NO: 584838 - DNA, 18 bp, Homo sapiens
gaccccttgttgcactgc

SEQ ID NO: 584839 - DNA, 21 bp, Homo sapiens
gacccggttattcgcccaccc

SEQ ID NO: 584840 - DNA, 17 bp, Homo sapiens
gaccctgaacccacacc

SEQ ID NO: 584841 - DNA, 12 bp, Homo sapiens
gaccctgggcag

SEQ ID NO: 584842 - DNA, 13 bp, Homo sapiens
gaccctgggcagt

SEQ ID NO: 584843 - DNA, 15 bp, Homo sapiens
gacccttctgggtcc

SEQ ID NO: 584844 - DNA, 14 bp, Homo sapiens
gacctacctccctc

SEQ ID NO: 584845 - DNA, 16 bp, Homo sapiens
gacctacctccctccc

SEQ ID NO: 584846 - DNA, 23 bp, Homo sapiens
gacctataaatcattaagacaac

SEQ ID NO: 584847 - DNA, 14 bp, Homo sapiens
gacctctctgcctc

SEQ ID NO: 584848 - DNA, 23 bp, Homo sapiens
gacctgccccggacctacctccc

SEQ ID NO: 584849 - DNA, 22 bp, Homo sapiens
gactacttgttgtatctgctgg

SEQ ID NO: 584850 - DNA, 20 bp, Homo sapiens
gactcctcaaaccacttgcc

SEQ ID NO: 584851 - DNA, 23 bp, Homo sapiens
gactcctcaaaccacttgcctgg

SEQ ID NO: 584852 - DNA, 22 bp, Homo sapiens
gactcctgtggagatgacttgg

SEQ ID NO: 584853 - DNA, 19 bp, Homo sapiens
gactcttatttatagaatt

SEQ ID NO: 584854 - DNA, 13 bp, Homo sapiens
gactgagccagat

SEQ ID NO: 584855 - DNA, 16 bp, Homo sapiens
gactgatttcagagtg

SEQ ID NO: 584856 - DNA, 12 bp, Homo sapiens
gactgcatttgt

SEQ ID NO: 584857 - DNA, 20 bp, Homo sapiens
gactggatttgcagaagttt

SEQ ID NO: 584858 - DNA, 17 bp, Homo sapiens
gactgggcactggggcc

SEQ ID NO: 584859 - DNA, 20 bp, Homo sapiens
gactgtagatatgtattctt

SEQ ID NO: 584860 - DNA, 15 bp, Homo sapiens
gacttctcaccagca

SEQ ID NO: 584861 - DNA, 13 bp, Homo sapiens
gacttgaggggct

SEQ ID NO: 584862 - DNA, 21 bp, Homo sapiens
gacttggagaatactgccaaa

SEQ ID NO: 584863 - DNA, 12 bp, Homo sapiens
gacttgtgtctg

SEQ ID NO: 584864 - DNA, 19 bp, Homo sapiens
gagaaacactatttgtgac

SEQ ID NO: 584865 - DNA, 21 bp, Homo sapiens
gagacagcagtttccagagag

SEQ ID NO: 584866 - DNA, 14 bp, Homo sapiens
gagacccctgtctc

SEQ ID NO: 584867 - DNA, 17 bp, Homo sapiens
gagagtggagagagcag

SEQ ID NO: 584868 - DNA, 15 bp, Homo sapiens
gagatcaaagatgaa

SEQ ID NO: 584869 - DNA, 20 bp, Homo sapiens
gagatcacgccactgcactc

SEQ ID NO: 584870 - DNA, 21 bp, Homo sapiens
gagatcacgccactgcactcc

SEQ ID NO: 584871 - DNA, 17 bp, Homo sapiens
gagattcccaccttcca

SEQ ID NO: 584872 - DNA, 13 bp, Homo sapiens
gagattgaacttt

SEQ ID NO: 584873 - DNA, 17 bp, Homo sapiens
gagattggttttcctgt

SEQ ID NO: 584874 - DNA, 18 bp, Homo sapiens
gagcaagaccctgtctct

SEQ ID NO: 584875 - DNA, 19 bp, Homo sapiens
gagcagggctaaataaaga

SEQ ID NO: 584876 - DNA, 19 bp, Homo sapiens
gagccaattagacttgaaa

SEQ ID NO: 584877 - DNA, 14 bp, Homo sapiens
gagccatgcctccc

SEQ ID NO: 584878 - DNA, 23 bp, Homo sapiens
gagccatgcctccctgggccacc

SEQ ID NO: 584879 - DNA, 16 bp, Homo sapiens
gagccattgaacagct

SEQ ID NO: 584880 - DNA, 20 bp, Homo sapiens
gagccattgaacagctgtga

SEQ ID NO: 584881 - DNA, 17 bp, Homo sapiens
gagccctgaggcctaga

SEQ ID NO: 584882 - DNA, 20 bp, Homo sapiens
gagccgagatcacgccactg

SEQ ID NO: 584883 - DNA, 17 bp, Homo sapiens
gagcgagagatcaaaga

SEQ ID NO: 584884 - DNA, 20 bp, Homo sapiens
gagcgagagatcaaagatga

SEQ ID NO: 584885 - DNA, 16 bp, Homo sapiens
gagctactcccacagc

SEQ ID NO: 584886 - DNA, 16 bp, Homo sapiens
gagctctgaaatcttc

SEQ ID NO: 584887 - DNA, 21 bp, Homo sapiens
gagctcttcctatccctctcc

SEQ ID NO: 584888 - DNA, 12 bp, Homo sapiens
gagctgccaaga

SEQ ID NO: 584889 - DNA, 13 bp, Homo sapiens
gaggaaaattctt

SEQ ID NO: 584890 - DNA, 20 bp, Homo sapiens
gaggagataaggtggcttct

SEQ ID NO: 584891 - DNA, 15 bp, Homo sapiens
gaggcctagactctg

SEQ ID NO: 584892 - DNA, 18 bp, Homo sapiens
gaggcctcaccccaggga

SEQ ID NO: 584893 - DNA, 14 bp, Homo sapiens
gaggctgagaaagc

SEQ ID NO: 584894 - DNA, 18 bp, Homo sapiens
gaggctgaggtgggcaga

SEQ ID NO: 584895 - DNA, 14 bp, Homo sapiens
gagggaaaccagag

SEQ ID NO: 584896 - DNA, 16 bp, Homo sapiens
gaggggcgcgggaggg

SEQ ID NO: 584897 - DNA, 23 bp, Homo sapiens
gaggggctggggacttgtgtctg

SEQ ID NO: 584898 - DNA, 22 bp, Homo sapiens
cctgccatgggtgcagaccctg

SEQ ID NO: 584899 - DNA, 16 bp, Homo sapiens
cctgcccagttgcact

SEQ ID NO: 584900 - DNA, 19 bp, Homo sapiens
cctgctcacgtcaaatgca

SEQ ID NO: 584901 - DNA, 14 bp, Homo sapiens
cctggaccaggccc

SEQ ID NO: 584902 - DNA, 13 bp, Homo sapiens
cctggacttgcct

SEQ ID NO: 584903 - DNA, 16 bp, Homo sapiens
cctggacttgcctctg

SEQ ID NO: 584904 - DNA, 12 bp, Homo sapiens
cctggagctcag

SEQ ID NO: 584905 - DNA, 19 bp, Homo sapiens
cctggaggggctggggact

SEQ ID NO: 584906 - DNA, 23 bp, Homo sapiens
cctggctacagggcgagactctg

SEQ ID NO: 584907 - DNA, 14 bp, Homo sapiens
cctggctgttctga

SEQ ID NO: 584908 - DNA, 12 bp, Homo sapiens
cctgggaagctg

SEQ ID NO: 584909 - DNA, 21 bp, Homo sapiens
cctgggcatcagggcctttct

SEQ ID NO: 584910 - DNA, 16 bp, Homo sapiens
cctgggccacctccta

SEQ ID NO: 584911 - DNA, 21 bp, Homo sapiens
cctgggctcctcttagctcag

SEQ ID NO: 584912 - DNA, 22 bp, Homo sapiens
cctggggcggcatgaaccctct

SEQ ID NO: 584913 - DNA, 14 bp, Homo sapiens
cctgtaatcccagc

SEQ ID NO: 584914 - DNA, 15 bp, Homo sapiens
cctgtcctgcctcct

SEQ ID NO: 584915 - DNA, 17 bp, Homo sapiens
cctgtcctgcctcctca

SEQ ID NO: 584916 - DNA, 19 bp, Homo sapiens
cctgtgagcatggggccag

SEQ ID NO: 584917 - DNA, 20 bp, Homo sapiens
cctgtgagcatggggccagg

SEQ ID NO: 584918 - DNA, 21 bp, Homo sapiens
cctgtgagcatggggccagga

SEQ ID NO: 584919 - DNA, 17 bp, Homo sapiens
cctgtgctgaacataac

SEQ ID NO: 584920 - DNA, 23 bp, Homo sapiens
cctgtgctgaacataacttctca

SEQ ID NO: 584921 - DNA, 15 bp, Homo sapiens
cctgtggcataaatt

SEQ ID NO: 584922 - DNA, 15 bp, Homo sapiens
cctgtgtgaccctgg

SEQ ID NO: 584923 - DNA, 20 bp, Homo sapiens
cctgtgtgaccctgggcagt

SEQ ID NO: 584924 - DNA, 21 bp, Homo sapiens
cctgttcatgtttttgtttta

SEQ ID NO: 584925 - DNA, 14 bp, Homo sapiens
ccttaatttaactt

SEQ ID NO: 584926 - DNA, 19 bp, Homo sapiens
ccttaccccaaagagaaag

SEQ ID NO: 584927 - DNA, 18 bp, Homo sapiens
ccttactggcttacctcc

SEQ ID NO: 584928 - DNA, 18 bp, Homo sapiens
ccttattgctgtcctgga

SEQ ID NO: 584929 - DNA, 21 bp, Homo sapiens
ccttcaacctgcatagccggt

SEQ ID NO: 584930 - DNA, 18 bp, Homo sapiens
ccttcatgacagcctcca

SEQ ID NO: 584931 - DNA, 13 bp, Homo sapiens
ccttccactgtag

SEQ ID NO: 584932 - DNA, 15 bp, Homo sapiens
ccttccactgtagct

SEQ ID NO: 584933 - DNA, 16 bp, Homo sapiens
ccttccactgtagcta

SEQ ID NO: 584934 - DNA, 16 bp, Homo sapiens
ccttcctattctcctg

SEQ ID NO: 584935 - DNA, 18 bp, Homo sapiens
ccttcctattctcctgcc

SEQ ID NO: 584936 - DNA, 20 bp, Homo sapiens
ccttcctattctcctgccat

SEQ ID NO: 584937 - DNA, 15 bp, Homo sapiens
ccttcctgtcctgcc

SEQ ID NO: 584938 - DNA, 17 bp, Homo sapiens
ccttcctgtcctgcctc

SEQ ID NO: 584939 - DNA, 19 bp, Homo sapiens
ccttcctgtcctgcctcct

SEQ ID NO: 584940 - DNA, 22 bp, Homo sapiens
ccttcctgtcctgcctcctcat

SEQ ID NO: 584941 - DNA, 15 bp, Homo sapiens
ccttctattctagcc

SEQ ID NO: 584942 - DNA, 20 bp, Homo sapiens
ccttctctacactcttgtaa

SEQ ID NO: 584943 - DNA, 20 bp, Homo sapiens
ccttgagattctgaagtatg

SEQ ID NO: 584944 - DNA, 18 bp, Homo sapiens
ccttgcagcggctcctgc

SEQ ID NO: 584945 - DNA, 13 bp, Homo sapiens
ccttgttgcactg

SEQ ID NO: 584946 - DNA, 14 bp, Homo sapiens
cctttctccctgca

SEQ ID NO: 584947 - DNA, 19 bp, Homo sapiens
cctttctcctccccacctg

SEQ ID NO: 584948 - DNA, 18 bp, Homo sapiens
ccttttaagcatgtgatg

SEQ ID NO: 584949 - DNA, 17 bp, Homo sapiens
cctttttcccaataaat

SEQ ID NO: 584950 - DNA, 22 bp, Homo sapiens
cgaagagagttctggatgtctg

SEQ ID NO: 584951 - DNA, 15 bp, Homo sapiens
cgacctctctgcctc

SEQ ID NO: 584952 - DNA, 16 bp, Homo sapiens
cgacctctctgcctct

SEQ ID NO: 584953 - DNA, 15 bp, Homo sapiens
cgagactctgtctca

SEQ ID NO: 584954 - DNA, 19 bp, Homo sapiens
cgatgcatttaataaagat

SEQ ID NO: 584955 - DNA, 13 bp, Homo sapiens
cgcatcccatctc

SEQ ID NO: 584956 - DNA, 17 bp, Homo sapiens
cgcatcccatctctccc

SEQ ID NO: 584957 - DNA, 13 bp, Homo sapiens
cgccactgcactc

SEQ ID NO: 584958 - DNA, 21 bp, Homo sapiens
cgccactgcactccagcctgg

SEQ ID NO: 584959 - DNA, 20 bp, Homo sapiens
cgccagcgacctctctgcct

SEQ ID NO: 584960 - DNA, 23 bp, Homo sapiens
cgccagcgacctctctgcctctc

SEQ ID NO: 584961 - DNA, 14 bp, Homo sapiens
cgcgggagggggcg

SEQ ID NO: 584962 - DNA, 10 bp, Homo sapiens
cgctgctggg

SEQ ID NO: 584963 - DNA, 17 bp, Homo sapiens
cggacccttctgggtcc

SEQ ID NO: 584964 - DNA, 21 bp, Homo sapiens
cggacctacctccctccctct

SEQ ID NO: 584965 - DNA, 20 bp, Homo sapiens
cggcagatgatgctttggaa

SEQ ID NO: 584966 - DNA, 14 bp, Homo sapiens
cggctcctcgcccc

SEQ ID NO: 584967 - DNA, 19 bp, Homo sapiens
cggctcctcgcccccacca

SEQ ID NO: 584968 - DNA, 17 bp, Homo sapiens
cggctttaagtgtgctg

SEQ ID NO: 584969 - DNA, 17 bp, Homo sapiens
cgggcaccaggggccaa

SEQ ID NO: 584970 - DNA, 16 bp, Homo sapiens
cgggggaggggcgcgg

SEQ ID NO: 584971 - DNA, 18 bp, Homo sapiens
cgggggaggggcgcggga

SEQ ID NO: 584972 - DNA, 17 bp, Homo sapiens
cggttattcgcccaccc

SEQ ID NO: 584973 - DNA, 11 bp, Homo sapiens
cggttcctggt

SEQ ID NO: 584974 - DNA, 19 bp, Homo sapiens
cggttcctggtgactcctg

SEQ ID NO: 584975 - DNA, 17 bp, Homo sapiens
cggttctaaggctcaga

SEQ ID NO: 584976 - DNA, 12 bp, Homo sapiens
cgtaatttaact

SEQ ID NO: 584977 - DNA, 15 bp, Homo sapiens
cgtagcttcagccag

SEQ ID NO: 584978 - DNA, 18 bp, Homo sapiens
cgtagcttcagccaggca

SEQ ID NO: 584979 - DNA, 17 bp, Homo sapiens
cgtctctgccctgggct

SEQ ID NO: 584980 - DNA, 18 bp, Homo sapiens
cgtggatacagagccacg

SEQ ID NO: 584981 - DNA, 21 bp, Homo sapiens
cgtttatatttttttaactgt

SEQ ID NO: 584982 - DNA, 23 bp, Homo sapiens
cgtttcctttttgttgatgagga

SEQ ID NO: 584983 - DNA, 12 bp, Homo sapiens
cgtttgcctcct

SEQ ID NO: 584984 - DNA, 20 bp, Homo sapiens
cgttttctccgggtcctcct

SEQ ID NO: 584985 - DNA, 14 bp, Homo sapiens
ctaaaaaaaagatg

SEQ ID NO: 584986 - DNA, 11 bp, Homo sapiens
ctaaataaaga

SEQ ID NO: 584987 - DNA, 14 bp, Homo sapiens
ctaaataaagagga

SEQ ID NO: 584988 - DNA, 15 bp, Homo sapiens
ctaaattatttactg

SEQ ID NO: 584989 - DNA, 19 bp, Homo sapiens
ctaaccaaggctgtgttta

SEQ ID NO: 584990 - DNA, 21 bp, Homo sapiens
ctaaccaaggctgtgtttaga

SEQ ID NO: 584991 - DNA, 17 bp, Homo sapiens
ctaacctcgggcctgct

SEQ ID NO: 584992 - DNA, 20 bp, Homo sapiens
ctaactcaaatacacatttg

SEQ ID NO: 584993 - DNA, 17 bp, Homo sapiens
ctaagatgttcactgtg

SEQ ID NO: 584994 - DNA, 15 bp, Homo sapiens
ctaagtcccttccta

SEQ ID NO: 584995 - DNA, 17 bp, Homo sapiens
ctaagtcccttcctatt

SEQ ID NO: 584996 - DNA, 17 bp, Homo sapiens
ctaatttaacccagctc

SEQ ID NO: 584997 - DNA, 20 bp, Homo sapiens
ctacagttttaactgtggat

SEQ ID NO: 584998 - DNA, 19 bp, Homo sapiens
ctacccaggaggctgaggt

SEQ ID NO: 584999 - DNA, 19 bp, Homo sapiens
ctaccccttcctgtcctgc

SEQ ID NO: 585000 - DNA, 13 bp, Homo sapiens
ctaccctggactt

SEQ ID NO: 585001 - DNA, 15 bp, Homo sapiens
ctacctccctccctc

SEQ ID NO: 585002 - DNA, 23 bp, Homo sapiens
ctactggtgtaatctcaatgcaa

SEQ ID NO: 585003 - DNA, 20 bp, Homo sapiens
ctactgttatcagtaatgct

SEQ ID NO: 585004 - DNA, 22 bp, Homo sapiens
ctactgttgtaagaattctgat

SEQ ID NO: 585005 - DNA, 17 bp, Homo sapiens
ctacttctgtaattgtg

SEQ ID NO: 585006 - DNA, 18 bp, Homo sapiens
ctacttctgtaattgtgt

SEQ ID NO: 585007 - DNA, 13 bp, Homo sapiens
ctagaatcacagc

SEQ ID NO: 585008 - DNA, 22 bp, Homo sapiens
ctagccatggcaggacagctcc

SEQ ID NO: 585009 - DNA, 21 bp, Homo sapiens
cattacagaggtattaaaact

SEQ ID NO: 585010 - DNA, 15 bp, Homo sapiens
cattagtcctttgtc

SEQ ID NO: 585011 - DNA, 13 bp, Homo sapiens
cattcaggaattc

SEQ ID NO: 585012 - DNA, 15 bp, Homo sapiens
cattctcccagtctc

SEQ ID NO: 585013 - DNA, 14 bp, Homo sapiens
cattctgcctgctc

SEQ ID NO: 585014 - DNA, 15 bp, Homo sapiens
cattctgcctgctcc

SEQ ID NO: 585015 - DNA, 21 bp, Homo sapiens
cattctggtcaagggctgtca

SEQ ID NO: 585016 - DNA, 17 bp, Homo sapiens
cattcttattgacaatt

SEQ ID NO: 585017 - DNA, 14 bp, Homo sapiens
cattgaacagctgt

SEQ ID NO: 585018 - DNA, 16 bp, Homo sapiens
cattgacttttataaa

SEQ ID NO: 585019 - DNA, 19 bp, Homo sapiens
cattgagcttgcatgcttg

SEQ ID NO: 585020 - DNA, 15 bp, Homo sapiens
cattgagtattgttt

SEQ ID NO: 585021 - DNA, 19 bp, Homo sapiens
cattgcacataagcttcca

SEQ ID NO: 585022 - DNA, 18 bp, Homo sapiens
cattggatattttttact

SEQ ID NO: 585023 - DNA, 14 bp, Homo sapiens
cattgtaattatgt

SEQ ID NO: 585024 - DNA, 16 bp, Homo sapiens
cattgtaattatgtaa

SEQ ID NO: 585025 - DNA, 21 bp, Homo sapiens
cattgtaattatgtaaataac

SEQ ID NO: 585026 - DNA, 14 bp, Homo sapiens
catttaataaagat

SEQ ID NO: 585027 - DNA, 21 bp, Homo sapiens
catttagaagcctgacaactc

SEQ ID NO: 585028 - DNA, 15 bp, Homo sapiens
catttagtaagaata

SEQ ID NO: 585029 - DNA, 18 bp, Homo sapiens
catttatgacaagctgta

SEQ ID NO: 585030 - DNA, 21 bp, Homo sapiens
catttatgacaagctgtatca

SEQ ID NO: 585031 - DNA, 15 bp, Homo sapiens
catttgctactgttg

SEQ ID NO: 585032 - DNA, 14 bp, Homo sapiens
cattttaattttaa

SEQ ID NO: 585033 - DNA, 18 bp, Homo sapiens
cattttaattttaaagtg

SEQ ID NO: 585034 - DNA, 11 bp, Homo sapiens
catttttgaac

SEQ ID NO: 585035 - DNA, 19 bp, Homo sapiens
ccaaaaatgtgtaagaaca

SEQ ID NO: 585036 - DNA, 19 bp, Homo sapiens
ccaaaaggtttaagaaata

SEQ ID NO: 585037 - DNA, 11 bp, Homo sapiens
ccaaagagaaa

SEQ ID NO: 585038 - DNA, 16 bp, Homo sapiens
ccaacatgatccccgt

SEQ ID NO: 585039 - DNA, 15 bp, Homo sapiens
ccaacctcaggctcc

SEQ ID NO: 585040 - DNA, 16 bp, Homo sapiens
ccaacctcaggctcct

SEQ ID NO: 585041 - DNA, 17 bp, Homo sapiens
ccaacctcaggctccta

SEQ ID NO: 585042 - DNA, 13 bp, Homo sapiens
ccaaccttgttta

SEQ ID NO: 585043 - DNA, 21 bp, Homo sapiens
ccaagagctactcccacagca

SEQ ID NO: 585044 - DNA, 15 bp, Homo sapiens
ccaagtctctgtgta

SEQ ID NO: 585045 - DNA, 17 bp, Homo sapiens
ccaatacaaaatgtatt

SEQ ID NO: 585046 - DNA, 15 bp, Homo sapiens
ccaataccttcaagg

SEQ ID NO: 585047 - DNA, 14 bp, Homo sapiens
ccaatatatgtatt

SEQ ID NO: 585048 - DNA, 14 bp, Homo sapiens
ccaatctgtacaaa

SEQ ID NO: 585049 - DNA, 14 bp, Homo sapiens
ccaatgactgagca

SEQ ID NO: 585050 - DNA, 18 bp, Homo sapiens
ccaattaaaaacgaaaac

SEQ ID NO: 585051 - DNA, 16 bp, Homo sapiens
ccacacttgaaacctt

SEQ ID NO: 585052 - DNA, 18 bp, Homo sapiens
ccacagaaggtgaacttt

SEQ ID NO: 585053 - DNA, 19 bp, Homo sapiens
cctaaaataacagtatgtg

SEQ ID NO: 585054 - DNA, 23 bp, Homo sapiens
cctaaaataacagtatgtgggat

SEQ ID NO: 585055 - DNA, 21 bp, Homo sapiens
cctaacatctgacctggcatc

SEQ ID NO: 585056 - DNA, 18 bp, Homo sapiens
cctaacctcgggcctgct

SEQ ID NO: 585057 - DNA, 15 bp, Homo sapiens
cctaagtcccttcct

SEQ ID NO: 585058 - DNA, 18 bp, Homo sapiens
cctaagtcccttcctatt

SEQ ID NO: 585059 - DNA, 13 bp, Homo sapiens
cctaatgtgttta

SEQ ID NO: 585060 - DNA, 15 bp, Homo sapiens
cctacagttttaact

SEQ ID NO: 585061 - DNA, 21 bp, Homo sapiens
cctacagttttaactgtggat

SEQ ID NO: 585062 - DNA, 22 bp, Homo sapiens
cctacagttttaactgtggata

SEQ ID NO: 585063 - DNA, 16 bp, Homo sapiens
cctaccccttcctgtc

SEQ ID NO: 585064 - DNA, 13 bp, Homo sapiens
cctacctggggac

SEQ ID NO: 585065 - DNA, 18 bp, Homo sapiens
cctacctggggactcctc

SEQ ID NO: 585066 - DNA, 20 bp, Homo sapiens
cctagactctgtctacctgg

SEQ ID NO: 585067 - DNA, 20 bp, Homo sapiens
cctagcctatgtctggcaga

SEQ ID NO: 585068 - DNA, 14 bp, Homo sapiens
cctagctggctctg

SEQ ID NO: 585069 - DNA, 20 bp, Homo sapiens
cctaggatcccgtcttccag

SEQ ID NO: 585070 - DNA, 21 bp, Homo sapiens
cctaggatcccgtcttccaga

SEQ ID NO: 585071 - DNA, 14 bp, Homo sapiens
cctatagtcccagc

SEQ ID NO: 585072 - DNA, 12 bp, Homo sapiens
cctatcctcccc

SEQ ID NO: 585073 - DNA, 13 bp, Homo sapiens
cctatcctcccct

SEQ ID NO: 585074 - DNA, 14 bp, Homo sapiens
cctatcctcccctt

SEQ ID NO: 585075 - DNA, 12 bp, Homo sapiens
cctatgtctggc

SEQ ID NO: 585076 - DNA, 15 bp, Homo sapiens
cctatgtctggcaga

SEQ ID NO: 585077 - DNA, 21 bp, Homo sapiens
cctatgtctggcagatgaggg

SEQ ID NO: 585078 - DNA, 13 bp, Homo sapiens
cctcaaaccactt

SEQ ID NO: 585079 - DNA, 18 bp, Homo sapiens
cctcaggccaagggacca

SEQ ID NO: 585080 - DNA, 12 bp, Homo sapiens
cctcaggctccg

SEQ ID NO: 585081 - DNA, 16 bp, Homo sapiens
cctcaggctcctaaag

SEQ ID NO: 585082 - DNA, 18 bp, Homo sapiens
cctccaaacatgttccca

SEQ ID NO: 585083 - DNA, 17 bp, Homo sapiens
cctccagagacaacagg

SEQ ID NO: 585084 - DNA, 15 bp, Homo sapiens
cctccagtcacactc

SEQ ID NO: 585085 - DNA, 16 bp, Homo sapiens
cctccagtcacactcc

SEQ ID NO: 585086 - DNA, 18 bp, Homo sapiens
cctcccccaaacagactc

SEQ ID NO: 585087 - DNA, 21 bp, Homo sapiens
cctccccttttaccactccca

SEQ ID NO: 585088 - DNA, 22 bp, Homo sapiens
cctccccttttaccactcccag

SEQ ID NO: 585089 - DNA, 15 bp, Homo sapiens
cctccctgggccacc

SEQ ID NO: 585090 - DNA, 19 bp, Homo sapiens
cctccctgggccacctcct

SEQ ID NO: 585091 - DNA, 21 bp, Homo sapiens
cctccctgggccacctcctac

SEQ ID NO: 585092 - DNA, 18 bp, Homo sapiens
cctcctaagtcccttcct

SEQ ID NO: 585093 - DNA, 23 bp, Homo sapiens
cctcctacctggggactcctcaa

SEQ ID NO: 585094 - DNA, 13 bp, Homo sapiens
cctcctcatcagt

SEQ ID NO: 585095 - DNA, 13 bp, Homo sapiens
cctccttctcctg

SEQ ID NO: 585096 - DNA, 13 bp, Homo sapiens
cctcgctgctggg

SEQ ID NO: 585097 - DNA, 21 bp, Homo sapiens
cctcggggagcgttctaaata

SEQ ID NO: 585098 - DNA, 18 bp, Homo sapiens
cctctccactcttctctc

SEQ ID NO: 585099 - DNA, 16 bp, Homo sapiens
cctctccgcgggagac

SEQ ID NO: 585100 - DNA, 20 bp, Homo sapiens
cctctccgcgggagacccct

SEQ ID NO: 585101 - DNA, 13 bp, Homo sapiens
cctctcttcttcc

SEQ ID NO: 585102 - DNA, 20 bp, Homo sapiens
cctctgagaagctctgaaga

SEQ ID NO: 585103 - DNA, 16 bp, Homo sapiens
cctctgagccttggtg

SEQ ID NO: 585104 - DNA, 19 bp, Homo sapiens
cctctgcccttcctgcagg

SEQ ID NO: 585105 - DNA, 14 bp, Homo sapiens
cctcttctctcctc

SEQ ID NO: 585106 - DNA, 16 bp, Homo sapiens
cctcttctctcctcag

SEQ ID NO: 585107 - DNA, 14 bp, Homo sapiens
cctcttgccatcct

SEQ ID NO: 585108 - DNA, 16 bp, Homo sapiens
cctcttgccatcctga

SEQ ID NO: 585109 - DNA, 18 bp, Homo sapiens
cctcttgccatcctgatg

SEQ ID NO: 585110 - DNA, 16 bp, Homo sapiens
cctgaacccacacctg

SEQ ID NO: 585111 - DNA, 17 bp, Homo sapiens
cctgaacccacacctgg

SEQ ID NO: 585112 - DNA, 14 bp, Homo sapiens
cctgaatttgtata

SEQ ID NO: 585113 - DNA, 22 bp, Homo sapiens
cctgacaactcattttcatatt

SEQ ID NO: 585114 - DNA, 19 bp, Homo sapiens
cctgactaggttctgtaga

SEQ ID NO: 585115 - DNA, 15 bp, Homo sapiens
cctgactcagtgacc

SEQ ID NO: 585116 - DNA, 19 bp, Homo sapiens
cctgagaaacactatttgt

SEQ ID NO: 585117 - DNA, 21 bp, Homo sapiens
cctgagaaacactatttgtga

SEQ ID NO: 585118 - DNA, 19 bp, Homo sapiens
cctgaggactgatttcaga

SEQ ID NO: 585119 - DNA, 18 bp, Homo sapiens
cctgatggacctgccccg

SEQ ID NO: 585120 - DNA, 17 bp, Homo sapiens
cctgatgtcagctgctg

SEQ ID NO: 585121 - DNA, 17 bp, Homo sapiens
cctgcactaacagagtg

SEQ ID NO: 585122 - DNA, 15 bp, Homo sapiens
cctgcagcagtcgcc

SEQ ID NO: 585123 - DNA, 20 bp, Homo sapiens
cctgcagccttttctggtcc

SEQ ID NO: 585124 - DNA, 23 bp, Homo sapiens
cctgcaggcaggaacaaacaggg

SEQ ID NO: 585125 - DNA, 22 bp, Homo sapiens
atctcaatgcaagccccaactt

SEQ ID NO: 585126 - DNA, 17 bp, Homo sapiens
atctcagtggtgtgtga

SEQ ID NO: 585127 - DNA, 18 bp, Homo sapiens
atctcagtggtgtgtgaa

SEQ ID NO: 585128 - DNA, 19 bp, Homo sapiens
atctccacaggagagactg

SEQ ID NO: 585129 - DNA, 16 bp, Homo sapiens
atctctcccacttcct

SEQ ID NO: 585130 - DNA, 23 bp, Homo sapiens
atctctcccacttcctcctacct

SEQ ID NO: 585131 - DNA, 15 bp, Homo sapiens
atctctttttgtttg

SEQ ID NO: 585132 - DNA, 22 bp, Homo sapiens
atctggctgcagttttgctatc

SEQ ID NO: 585133 - DNA, 15 bp, Homo sapiens
atctttataaatgta

SEQ ID NO: 585134 - DNA, 19 bp, Homo sapiens
atctttatatttcaataaa

SEQ ID NO: 585135 - DNA, 12 bp, Homo sapiens
atctttcagaaa

SEQ ID NO: 585136 - DNA, 14 bp, Homo sapiens
atctttcagaaata

SEQ ID NO: 585137 - DNA, 16 bp, Homo sapiens
atctttcagaaatata

SEQ ID NO: 585138 - DNA, 21 bp, Homo sapiens
atctttgaacttctgactact

SEQ ID NO: 585139 - DNA, 16 bp, Homo sapiens
atcttttgaagcatag

SEQ ID NO: 585140 - DNA, 17 bp, Homo sapiens
atcttttgaagcataga

SEQ ID NO: 585141 - DNA, 16 bp, Homo sapiens
atgaaaagtatattga

SEQ ID NO: 585142 - DNA, 17 bp, Homo sapiens
atgaaacatcatttcaa

SEQ ID NO: 585143 - DNA, 21 bp, Homo sapiens
atgaaacatgggctgtgatta

SEQ ID NO: 585144 - DNA, 15 bp, Homo sapiens
atgaaacttctcagt

SEQ ID NO: 585145 - DNA, 18 bp, Homo sapiens
atgaaagctgttccttgg

SEQ ID NO: 585146 - DNA, 15 bp, Homo sapiens
atgaaccataaattc

SEQ ID NO: 585147 - DNA, 15 bp, Homo sapiens
atgaaccctcttgcc

SEQ ID NO: 585148 - DNA, 16 bp, Homo sapiens
atgaaccctcttgcca

SEQ ID NO: 585149 - DNA, 21 bp, Homo sapiens
atgaaccctcttgccatcctg

SEQ ID NO: 585150 - DNA, 18 bp, Homo sapiens
atgaagtctgagggaaac

SEQ ID NO: 585151 - DNA, 22 bp, Homo sapiens
atgaagtctgagggaaaccaga

SEQ ID NO: 585152 - DNA, 19 bp, Homo sapiens
atgaatgggatattttgaa

SEQ ID NO: 585153 - DNA, 14 bp, Homo sapiens
atgacaagctgtat

SEQ ID NO: 585154 - DNA, 20 bp, Homo sapiens
atgacaagctgtatcactgc

SEQ ID NO: 585155 - DNA, 17 bp, Homo sapiens
atgacagtgttccccga

SEQ ID NO: 585156 - DNA, 22 bp, Homo sapiens
atgacttggtggcttttccttg

SEQ ID NO: 585157 - DNA, 22 bp, Homo sapiens
atgagctctgaaatcttcccat

SEQ ID NO: 585158 - DNA, 21 bp, Homo sapiens
atgagggctggctgccgtttt

SEQ ID NO: 585159 - DNA, 23 bp, Homo sapiens
atgaggttgggggaaccagcaga

SEQ ID NO: 585160 - DNA, 16 bp, Homo sapiens
atgatcagcaaaaaga

SEQ ID NO: 585161 - DNA, 17 bp, Homo sapiens
atgatctattgctcatc

SEQ ID NO: 585162 - DNA, 16 bp, Homo sapiens
atgatgacaatcaaag

SEQ ID NO: 585163 - DNA, 15 bp, Homo sapiens
atgatgctttggaag

SEQ ID NO: 585164 - DNA, 21 bp, Homo sapiens
atgatttccctccagagaaag

SEQ ID NO: 585165 - DNA, 20 bp, Homo sapiens
atgcaaatgagctctgaaat

SEQ ID NO: 585166 - DNA, 23 bp, Homo sapiens
atgcaaatgagctctgaaatctt

SEQ ID NO: 585167 - DNA, 14 bp, Homo sapiens
atgcaataaaattt

SEQ ID NO: 585168 - DNA, 14 bp, Homo sapiens
atgcacaagatgcc

SEQ ID NO: 585169 - DNA, 12 bp, Homo sapiens
atgcacagctgt

SEQ ID NO: 585170 - DNA, 14 bp, Homo sapiens
atgcagctttgcaa

SEQ ID NO: 585171 - DNA, 22 bp, Homo sapiens
atgcagttagctgaagaattga

SEQ ID NO: 585172 - DNA, 23 bp, Homo sapiens
atgcatagtcccagctacccagg

SEQ ID NO: 585173 - DNA, 18 bp, Homo sapiens
atgcatcatctcttcctc

SEQ ID NO: 585174 - DNA, 12 bp, Homo sapiens
atgcatttaata

SEQ ID NO: 585175 - DNA, 19 bp, Homo sapiens
atgcatttaataaagatga

SEQ ID NO: 585176 - DNA, 22 bp, Homo sapiens
atgcatttaataaagatgagtt

SEQ ID NO: 585177 - DNA, 20 bp, Homo sapiens
atgccccagggatgggaggt

SEQ ID NO: 585178 - DNA, 20 bp, Homo sapiens
cagcctagcctatgtctggc

SEQ ID NO: 585179 - DNA, 22 bp, Homo sapiens
cagccttattttgttggtgctt

SEQ ID NO: 585180 - DNA, 13 bp, Homo sapiens
cagcgacctctct

SEQ ID NO: 585181 - DNA, 12 bp, Homo sapiens
cagcggctcctg

SEQ ID NO: 585182 - DNA, 14 bp, Homo sapiens
cagcggctcctgca

SEQ ID NO: 585183 - DNA, 22 bp, Homo sapiens
cagctcattataatgtcattaa

SEQ ID NO: 585184 - DNA, 14 bp, Homo sapiens
cagctcctggacca

SEQ ID NO: 585185 - DNA, 19 bp, Homo sapiens
cagctcctggaccaggccc

SEQ ID NO: 585186 - DNA, 11 bp, Homo sapiens
cagctgagcat

SEQ ID NO: 585187 - DNA, 14 bp, Homo sapiens
cagctgagcatgga

SEQ ID NO: 585188 - DNA, 14 bp, Homo sapiens
cagctgcagcctgg

SEQ ID NO: 585189 - DNA, 19 bp, Homo sapiens
cagctgctgttgaactttt

SEQ ID NO: 585190 - DNA, 10 bp, Homo sapiens
cagctgtgat

SEQ ID NO: 585191 - DNA, 12 bp, Homo sapiens
cagctttgcaaa

SEQ ID NO: 585192 - DNA, 14 bp, Homo sapiens
caggaacaaacagg

SEQ ID NO: 585193 - DNA, 21 bp, Homo sapiens
caggaacgctctcctcgagcc

SEQ ID NO: 585194 - DNA, 20 bp, Homo sapiens
caggaacggtggaggcagag

SEQ ID NO: 585195 - DNA, 22 bp, Homo sapiens
caggaagccatagatgctggct

SEQ ID NO: 585196 - DNA, 20 bp, Homo sapiens
caggaatttgaagctgcagt

SEQ ID NO: 585197 - DNA, 19 bp, Homo sapiens
caggacatgcaataaaatt

SEQ ID NO: 585198 - DNA, 15 bp, Homo sapiens
caggacctgggacag

SEQ ID NO: 585199 - DNA, 23 bp, Homo sapiens
caggagaaggggctttgtgacca

SEQ ID NO: 585200 - DNA, 21 bp, Homo sapiens
caggagagactggttcggctc

SEQ ID NO: 585201 - DNA, 14 bp, Homo sapiens
caggagccccccta

SEQ ID NO: 585202 - DNA, 22 bp, Homo sapiens
caggagtttaagaccagcctgg

SEQ ID NO: 585203 - DNA, 15 bp, Homo sapiens
caggatactggcaca

SEQ ID NO: 585204 - DNA, 19 bp, Homo sapiens
caggatactggcacagagg

SEQ ID NO: 585205 - DNA, 16 bp, Homo sapiens
caggcacattaactgt

SEQ ID NO: 585206 - DNA, 15 bp, Homo sapiens
caggcattggatatt

SEQ ID NO: 585207 - DNA, 22 bp, Homo sapiens
caggccaaagagtctccagttt

SEQ ID NO: 585208 - DNA, 18 bp, Homo sapiens
caggccaagggaccaggt

SEQ ID NO: 585209 - DNA, 18 bp, Homo sapiens
caggctcctaaagagaca

SEQ ID NO: 585210 - DNA, 23 bp, Homo sapiens
cagggatgggaggtatgggctgg

SEQ ID NO: 585211 - DNA, 21 bp, Homo sapiens
cagggcaccgtattcctctcc

SEQ ID NO: 585212 - DNA, 21 bp, Homo sapiens
cagggcctttctcctccccac

SEQ ID NO: 585213 - DNA, 20 bp, Homo sapiens
cagggcgagactctgtctca

SEQ ID NO: 585214 - DNA, 18 bp, Homo sapiens
caggggccaacctcaggc

SEQ ID NO: 585215 - DNA, 21 bp, Homo sapiens
caggggccaacctcaggctcc

SEQ ID NO: 585216 - DNA, 23 bp, Homo sapiens
caggggccaacctcaggctccta

SEQ ID NO: 585217 - DNA, 19 bp, Homo sapiens
cagggggtatgcagagctt

SEQ ID NO: 585218 - DNA, 22 bp, Homo sapiens
cagggtccttgtttctgccctg

SEQ ID NO: 585219 - DNA, 15 bp, Homo sapiens
caggtaaaacagggc

SEQ ID NO: 585220 - DNA, 20 bp, Homo sapiens
caggtaaaacagggccacat

SEQ ID NO: 585221 - DNA, 15 bp, Homo sapiens
caggtatccaaaaat

SEQ ID NO: 585222 - DNA, 20 bp, Homo sapiens
caggtgctaatttgttttgg

SEQ ID NO: 585223 - DNA, 17 bp, Homo sapiens
caggttagtgacattta

SEQ ID NO: 585224 - DNA, 23 bp, Homo sapiens
gggctcctcttagctcagctgag

SEQ ID NO: 585225 - DNA, 22 bp, Homo sapiens
gggctgcccacctggctgccaa

SEQ ID NO: 585226 - DNA, 17 bp, Homo sapiens
gggctgccttctggcct

SEQ ID NO: 585227 - DNA, 14 bp, Homo sapiens
gggcttttttcttt

SEQ ID NO: 585228 - DNA, 13 bp, Homo sapiens
ggggactcctcaa

SEQ ID NO: 585229 - DNA, 21 bp, Homo sapiens
ggggccaacctcaggctccta

SEQ ID NO: 585230 - DNA, 15 bp, Homo sapiens
ttacttgttttggat

SEQ ID NO: 585231 - DNA, 20 bp, Homo sapiens
ttagaaacaaacaaaactct

SEQ ID NO: 585232 - DNA, 19 bp, Homo sapiens
ttagaaattacctgtggat

SEQ ID NO: 585233 - DNA, 23 bp, Homo sapiens
ttagaagcctgcataatgtttct

SEQ ID NO: 585234 - DNA, 23 bp, Homo sapiens
ttagcggctcctcgcccccacca

SEQ ID NO: 585235 - DNA, 23 bp, Homo sapiens
ttagctcagctgagcatggagac

SEQ ID NO: 585236 - DNA, 18 bp, Homo sapiens
ttaggcatgcacagctgt

SEQ ID NO: 585237 - DNA, 19 bp, Homo sapiens
ttaggggaaggagaagtaa

SEQ ID NO: 585238 - DNA, 15 bp, Homo sapiens
ttagtgacatttaat

SEQ ID NO: 585239 - DNA, 12 bp, Homo sapiens
ttagtgatgtcc

SEQ ID NO: 585240 - DNA, 13 bp, Homo sapiens
ttataaagcatgt

SEQ ID NO: 585241 - DNA, 18 bp, Homo sapiens
ttataagaagaagttcat

SEQ ID NO: 585242 - DNA, 14 bp, Homo sapiens
ttatacatcaatat

SEQ ID NO: 585243 - DNA, 20 bp, Homo sapiens
ttatacatgtgatacatttt

SEQ ID NO: 585244 - DNA, 20 bp, Homo sapiens
ttatagtctaagactatata

SEQ ID NO: 585245 - DNA, 20 bp, Homo sapiens
ttatatgctttattaatgtt

SEQ ID NO: 585246 - DNA, 18 bp, Homo sapiens
ttatattaaataacatgt

SEQ ID NO: 585247 - DNA, 16 bp, Homo sapiens
ttatatttcaataaat

SEQ ID NO: 585248 - DNA, 18 bp, Homo sapiens
ttatattttagaaataat

SEQ ID NO: 585249 - DNA, 20 bp, Homo sapiens
ttatatttttttaactgtga

SEQ ID NO: 585250 - DNA, 23 bp, Homo sapiens
ttatcagtaatgctaaatgtgta

SEQ ID NO: 585251 - DNA, 23 bp, Homo sapiens
ttgattattttttttttcttctt

SEQ ID NO: 585252 - DNA, 20 bp, Homo sapiens
ttgatttcaaagttttgttg

SEQ ID NO: 585253 - DNA, 11 bp, Homo sapiens
ttgcaatgcag

SEQ ID NO: 585254 - DNA, 16 bp, Homo sapiens
ttgcactatttccaca

SEQ ID NO: 585255 - DNA, 22 bp, Homo sapiens
ttgcactgccccctgcttggcc

SEQ ID NO: 585256 - DNA, 16 bp, Homo sapiens
ttgcacttttgaatgt

SEQ ID NO: 585257 - DNA, 16 bp, Homo sapiens
ttgcatactttgtatt

SEQ ID NO: 585258 - DNA, 21 bp, Homo sapiens
ttgcatactttgtattttgat

SEQ ID NO: 585259 - DNA, 17 bp, Homo sapiens
ttgccaggacatgcaat

SEQ ID NO: 585260 - DNA, 15 bp, Homo sapiens
ttgctcacagctgta

SEQ ID NO: 585261 - DNA, 23 bp, Homo sapiens
ttgctcatgcatagtcccagcta

SEQ ID NO: 585262 - DNA, 19 bp, Homo sapiens
ttgctgataccatatgaat

SEQ ID NO: 585263 - DNA, 17 bp, Homo sapiens
ttgctgtgagccttgca

SEQ ID NO: 585264 - DNA, 17 bp, Homo sapiens
ttggaagatgcagaagc

SEQ ID NO: 585265 - DNA, 12 bp, Homo sapiens
ttggacttctga

SEQ ID NO: 585266 - DNA, 15 bp, Homo sapiens
ttggacttctgaaga

SEQ ID NO: 585267 - DNA, 19 bp, Homo sapiens
ttggatattttttacttta

SEQ ID NO: 585268 - DNA, 21 bp, Homo sapiens
ttggatttaaaagcctgctca

SEQ ID NO: 585269 - DNA, 15 bp, Homo sapiens
ttggcattctttgca

SEQ ID NO: 585270 - DNA, 11 bp, Homo sapiens
ttggccaatta

SEQ ID NO: 585271 - DNA, 16 bp, Homo sapiens
ttggcctcctgcaaag

SEQ ID NO: 585272 - DNA, 12 bp, Homo sapiens
ttgggaaaacat

SEQ ID NO: 585273 - DNA, 15 bp, Homo sapiens
ttgggaaaacatttg

SEQ ID NO: 585274 - DNA, 23 bp, Homo sapiens
ttgggaatgaggaaaattcttaa

SEQ ID NO: 585275 - DNA, 15 bp, Homo sapiens
ttgggggaaccagca

SEQ ID NO: 585276 - DNA, 14 bp, Homo sapiens
ttggtaaatgtttc

SEQ ID NO: 585277 - DNA, 20 bp, Homo sapiens
ttggtaatcccctaaaataa

SEQ ID NO: 585278 - DNA, 22 bp, Homo sapiens
gcccccaccagtgtagcatctt

SEQ ID NO: 585279 - DNA, 19 bp, Homo sapiens
gcccccaggaacgctctcc

SEQ ID NO: 585280 - DNA, 16 bp, Homo sapiens
gccccggacctacctc

SEQ ID NO: 585281 - DNA, 18 bp, Homo sapiens
gccccggacctacctccc

SEQ ID NO: 585282 - DNA, 20 bp, Homo sapiens
gccctgaggcctagactctg

SEQ ID NO: 585283 - DNA, 14 bp, Homo sapiens
gccctggagctcag

SEQ ID NO: 585284 - DNA, 12 bp, Homo sapiens
gccctgggctcc

SEQ ID NO: 585285 - DNA, 12 bp, Homo sapiens
gccctttcctgg

SEQ ID NO: 585286 - DNA, 16 bp, Homo sapiens
gccctttcctggcagt

SEQ ID NO: 585287 - DNA, 18 bp, Homo sapiens
gccggatgaaacttctca

SEQ ID NO: 585288 - DNA, 20 bp, Homo sapiens
gccggatgaaacttctcagt

SEQ ID NO: 585289 - DNA, 17 bp, Homo sapiens
gccgggggaggggcgcg

SEQ ID NO: 585290 - DNA, 14 bp, Homo sapiens
gccgtaatttaact

SEQ ID NO: 585291 - DNA, 13 bp, Homo sapiens
gccgtagcttcag

SEQ ID NO: 585292 - DNA, 18 bp, Homo sapiens
gccgtagcttcagccagg

SEQ ID NO: 585293 - DNA, 23 bp, Homo sapiens
gccgtcctaacctcgggcctgct

SEQ ID NO: 585294 - DNA, 13 bp, Homo sapiens
gccgttttctggg

SEQ ID NO: 585295 - DNA, 18 bp, Homo sapiens
gcctagcctatgtctggc

SEQ ID NO: 585296 - DNA, 22 bp, Homo sapiens
gcctagcctatgtctggcagat

SEQ ID NO: 585297 - DNA, 19 bp, Homo sapiens
gcctcagcctgctttcctg

SEQ ID NO: 585298 - DNA, 17 bp, Homo sapiens
gcctcaggctccgggca

SEQ ID NO: 585299 - DNA, 19 bp, Homo sapiens
gcctccctgggccacctcc

SEQ ID NO: 585300 - DNA, 22 bp, Homo sapiens
gcctgagaaacactatttgtga

SEQ ID NO: 585301 - DNA, 22 bp, Homo sapiens
gcctgcagagcaggacctggga

SEQ ID NO: 585302 - DNA, 21 bp, Homo sapiens
gcctgcccctaccctggactt

SEQ ID NO: 585303 - DNA, 18 bp, Homo sapiens
gcctgtgagcatggggcc

SEQ ID NO: 585304 - DNA, 20 bp, Homo sapiens
gccttcccaagttgtgcttg

SEQ ID NO: 585305 - DNA, 21 bp, Homo sapiens
gccttcccaagttgtgcttga

SEQ ID NO: 585306 - DNA, 15 bp, Homo sapiens
gccttcgtttatatt

SEQ ID NO: 585307 - DNA, 14 bp, Homo sapiens
gccttggaaattcc

SEQ ID NO: 585308 - DNA, 14 bp, Homo sapiens
gcctttctcctccc

SEQ ID NO: 585309 - DNA, 19 bp, Homo sapiens
gcctttctcctccccacct

SEQ ID NO: 585310 - DNA, 17 bp, Homo sapiens
gcgacctctctgcctct

SEQ ID NO: 585311 - DNA, 19 bp, Homo sapiens
gcgagagatcaaagatgaa

SEQ ID NO: 585312 - DNA, 15 bp, Homo sapiens
gcgcgggagggggcg

SEQ ID NO: 585313 - DNA, 22 bp, Homo sapiens
gcggcatgaaccctcttgccat

SEQ ID NO: 585314 - DNA, 15 bp, Homo sapiens
gcggctcctcgcccc

SEQ ID NO: 585315 - DNA, 15 bp, Homo sapiens
gcgggcacaataaat

SEQ ID NO: 585316 - DNA, 23 bp, Homo sapiens
gcggggatcagagcgcacaggga

SEQ ID NO: 585317 - DNA, 16 bp, Homo sapiens
gctaaataaagaggag

SEQ ID NO: 585318 - DNA, 14 bp, Homo sapiens
gctaccaaaacagt

SEQ ID NO: 585319 - DNA, 19 bp, Homo sapiens
gctaccctgggaagctgcc

SEQ ID NO: 585320 - DNA, 18 bp, Homo sapiens
gctaggatgttgctcaga

SEQ ID NO: 585321 - DNA, 18 bp, Homo sapiens
gctattagcggctcctcg

SEQ ID NO: 585322 - DNA, 18 bp, Homo sapiens
gctcaaagcagcaggact

SEQ ID NO: 585323 - DNA, 17 bp, Homo sapiens
gctcaagcattctgttt

SEQ ID NO: 585324 - DNA, 19 bp, Homo sapiens
gctcaagcattctgtttat

SEQ ID NO: 585325 - DNA, 16 bp, Homo sapiens
gctcaatccctgagga

SEQ ID NO: 585326 - DNA, 15 bp, Homo sapiens
gctcagaagtgacca

SEQ ID NO: 585327 - DNA, 23 bp, Homo sapiens
gctccaatgactgagcagcatcc

SEQ ID NO: 585328 - DNA, 18 bp, Homo sapiens
gctcctcgcccccaccag

SEQ ID NO: 585329 - DNA, 20 bp, Homo sapiens
gctcctgcaaaaggaggtga

SEQ ID NO: 585330 - DNA, 14 bp, Homo sapiens
gctctaaaaggtaa

SEQ ID NO: 585331 - DNA, 23 bp, Homo sapiens
gctctaaaaggtaatgtgtggat

SEQ ID NO: 585332 - DNA, 19 bp, Homo sapiens
gctctaggtacgatgacag

SEQ ID NO: 585333 - DNA, 15 bp, Homo sapiens
gctctcctcgagccc

SEQ ID NO: 585334 - DNA, 21 bp, Homo sapiens
gctctcctcgagccctccccc

SEQ ID NO: 585335 - DNA, 22 bp, Homo sapiens
gctctgtgagggtgctgactgg

SEQ ID NO: 585336 - DNA, 19 bp, Homo sapiens
gctcttcctatccctctcc

SEQ ID NO: 585337 - DNA, 20 bp, Homo sapiens
gctcttcctatccctctcct

SEQ ID NO: 585338 - DNA, 12 bp, Homo sapiens
gctcttcttcct

SEQ ID NO: 585339 - DNA, 18 bp, Homo sapiens
gctgagcatggagacagc

SEQ ID NO: 585340 - DNA, 20 bp, Homo sapiens
gctgagcatggagacagcag

SEQ ID NO: 585341 - DNA, 16 bp, Homo sapiens
gctgagccctcctgag

SEQ ID NO: 585342 - DNA, 18 bp, Homo sapiens
gctgaggaggcacctaca

SEQ ID NO: 585343 - DNA, 17 bp, Homo sapiens
gctgaggctgagaaagc

SEQ ID NO: 585344 - DNA, 17 bp, Homo sapiens
gctgatggagccttccc

SEQ ID NO: 585345 - DNA, 19 bp, Homo sapiens
gctgccagctctcaggacc

SEQ ID NO: 585346 - DNA, 16 bp, Homo sapiens
gctgcccacctggctg

SEQ ID NO: 585347 - DNA, 15 bp, Homo sapiens
gctgcgatactggca

SEQ ID NO: 585348 - DNA, 19 bp, Homo sapiens
gctggctctgtgagggtgc

SEQ ID NO: 585349 - DNA, 17 bp, Homo sapiens
gctgggcagagggaggt

SEQ ID NO: 585350 - DNA, 15 bp, Homo sapiens
gctgggggctatgta

SEQ ID NO: 585351 - DNA, 14 bp, Homo sapiens
gctgtatcactgcc

SEQ ID NO: 585352 - DNA, 21 bp, Homo sapiens
gctgtcattgcacataagctt

SEQ ID NO: 585353 - DNA, 15 bp, Homo sapiens
gctgtcctggagggg

SEQ ID NO: 585354 - DNA, 23 bp, Homo sapiens
gctgtcctggaggggctggggac

SEQ ID NO: 585355 - DNA, 17 bp, Homo sapiens
gctgtgagccttgcatg

SEQ ID NO: 585356 - DNA, 22 bp, Homo sapiens
gcttaatcttcaaagccttctc

SEQ ID NO: 585357 - DNA, 12 bp, Homo sapiens
gcttcagccagg

SEQ ID NO: 585358 - DNA, 14 bp, Homo sapiens
gcttcagccaggca

SEQ ID NO: 585359 - DNA, 16 bp, Homo sapiens
gcttcagccaggcaag

SEQ ID NO: 585360 - DNA, 19 bp, Homo sapiens
gcttcagccaggcaagaaa

SEQ ID NO: 585361 - DNA, 14 bp, Homo sapiens
gcttcatccacagc

SEQ ID NO: 585362 - DNA, 15 bp, Homo sapiens
gcttctcacggcctg

SEQ ID NO: 585363 - DNA, 19 bp, Homo sapiens
gcttgaactaggctgagca

SEQ ID NO: 585364 - DNA, 21 bp, Homo sapiens
gcttgagagccctgaggccta

SEQ ID NO: 585365 - DNA, 15 bp, Homo sapiens
gcttgagccaggagg

SEQ ID NO: 585366 - DNA, 20 bp, Homo sapiens
gcttgtggtggggcaggaac

SEQ ID NO: 585367 - DNA, 14 bp, Homo sapiens
gctttaagccttca

SEQ ID NO: 585368 - DNA, 19 bp, Homo sapiens
gctttaagtgtgctgggca

SEQ ID NO: 585369 - DNA, 20 bp, Homo sapiens
gctttaagtgtgctgggcag

SEQ ID NO: 585370 - DNA, 16 bp, Homo sapiens
gctttattaatgtttt

SEQ ID NO: 585371 - DNA, 22 bp, Homo sapiens
gctttcctgcagcagtcgccca

SEQ ID NO: 585372 - DNA, 23 bp, Homo sapiens
gctttggcgaccccaatatatgt

SEQ ID NO: 585373 - DNA, 17 bp, Homo sapiens
gctttggtggccaggga

SEQ ID NO: 585374 - DNA, 21 bp, Homo sapiens
gctttggtggccagggaggca

SEQ ID NO: 585375 - DNA, 18 bp, Homo sapiens
gcttttggggagccagaa

SEQ ID NO: 585376 - DNA, 13 bp, Homo sapiens
ggaaaacagaaaa

SEQ ID NO: 585377 - DNA, 14 bp, Homo sapiens
ggaaaacagaaaac

SEQ ID NO: 585378 - DNA, 17 bp, Homo sapiens
acaagatgccccaggga

SEQ ID NO: 585379 - DNA, 18 bp, Homo sapiens
acaagatgccccagggat

SEQ ID NO: 585380 - DNA, 13 bp, Homo sapiens
acaagctgtatca

SEQ ID NO: 585381 - DNA, 19 bp, Homo sapiens
acaagtgagacaaaaagca

SEQ ID NO: 585382 - DNA, 17 bp, Homo sapiens
acaatattccagatctt

SEQ ID NO: 585383 - DNA, 13 bp, Homo sapiens
acaatctttgctg

SEQ ID NO: 585384 - DNA, 19 bp, Homo sapiens
acaatggtgtggtgaatgt

SEQ ID NO: 585385 - DNA, 14 bp, Homo sapiens
acaatttatactgc

SEQ ID NO: 585386 - DNA, 12 bp, Homo sapiens
acaattttaaga

SEQ ID NO: 585387 - DNA, 16 bp, Homo sapiens
acacaatttatactgc

SEQ ID NO: 585388 - DNA, 12 bp, Homo sapiens
acacacacacac

SEQ ID NO: 585389 - DNA, 17 bp, Homo sapiens
acacacacacacacgat

SEQ ID NO: 585390 - DNA, 14 bp, Homo sapiens
acacacacacgatg

SEQ ID NO: 585391 - DNA, 15 bp, Homo sapiens
acacacgatgcattt

SEQ ID NO: 585392 - DNA, 18 bp, Homo sapiens
acacagttcctgggaaca

SEQ ID NO: 585393 - DNA, 13 bp, Homo sapiens
acacatttttttg

SEQ ID NO: 585394 - DNA, 15 bp, Homo sapiens
acacgatgcatttaa

SEQ ID NO: 585395 - DNA, 16 bp, Homo sapiens
acactattcactaaaa

SEQ ID NO: 585396 - DNA, 13 bp, Homo sapiens
acactatttgtga

SEQ ID NO: 585397 - DNA, 14 bp, Homo sapiens
acactatttgtgac

SEQ ID NO: 585398 - DNA, 15 bp, Homo sapiens
acactatttgtgact

SEQ ID NO: 585399 - DNA, 14 bp, Homo sapiens
acacttgaaacctt

SEQ ID NO: 585400 - DNA, 13 bp, Homo sapiens
acagaaaaagaag

SEQ ID NO: 585401 - DNA, 9 bp, Homo sapiens
acagaaaac

SEQ ID NO: 585402 - DNA, 21 bp, Homo sapiens
acagaaaacctgatgctgggg

SEQ ID NO: 585403 - DNA, 22 bp, Homo sapiens
acagaaggtgaactttgtgctt

SEQ ID NO: 585404 - DNA, 22 bp, Homo sapiens
acagaggtattaaaactaaatt

SEQ ID NO: 585405 - DNA, 13 bp, Homo sapiens
acagataaacaaa

SEQ ID NO: 585406 - DNA, 15 bp, Homo sapiens
acagcaaacaggtgc

SEQ ID NO: 585407 - DNA, 22 bp, Homo sapiens
acagcaaacaggtgctaatttg

SEQ ID NO: 585408 - DNA, 18 bp, Homo sapiens
acagcagccccaggagaa

SEQ ID NO: 585409 - DNA, 14 bp, Homo sapiens
acagccaaatttaa

SEQ ID NO: 585410 - DNA, 15 bp, Homo sapiens
acagcccaggatact

SEQ ID NO: 585411 - DNA, 20 bp, Homo sapiens
acagcccaggatactggcac

SEQ ID NO: 585412 - DNA, 21 bp, Homo sapiens
acagcccaggatactggcaca

SEQ ID NO: 585413 - DNA, 15 bp, Homo sapiens
acagccttattttgt

SEQ ID NO: 585414 - DNA, 23 bp, Homo sapiens
acagccttattttgttggtgctt

SEQ ID NO: 585415 - DNA, 23 bp, Homo sapiens
acagccttgcagcggctcctgca

SEQ ID NO: 585416 - DNA, 15 bp, Homo sapiens
agaatgatctattgc

SEQ ID NO: 585417 - DNA, 15 bp, Homo sapiens
agaattctgattgat

SEQ ID NO: 585418 - DNA, 19 bp, Homo sapiens
agaattgaaaagtttttgt

SEQ ID NO: 585419 - DNA, 16 bp, Homo sapiens
agacacagaacacaga

SEQ ID NO: 585420 - DNA, 21 bp, Homo sapiens
agacagcagtttccagagagt

SEQ ID NO: 585421 - DNA, 22 bp, Homo sapiens
agacagcccaggatactggcac

SEQ ID NO: 585422 - DNA, 23 bp, Homo sapiens
agacagcccaggatactggcaca

SEQ ID NO: 585423 - DNA, 13 bp, Homo sapiens
agaccacctccaa

SEQ ID NO: 585424 - DNA, 13 bp, Homo sapiens
agacccctgtctc

SEQ ID NO: 585425 - DNA, 14 bp, Homo sapiens
agacccctgtctcc

SEQ ID NO: 585426 - DNA, 13 bp, Homo sapiens
agaccccttgttg

SEQ ID NO: 585427 - DNA, 19 bp, Homo sapiens
agaccccttgttgcactgc

SEQ ID NO: 585428 - DNA, 22 bp, Homo sapiens
agacccggttattcgcccaccc

SEQ ID NO: 585429 - DNA, 14 bp, Homo sapiens
agaccctgaaccca

SEQ ID NO: 585430 - DNA, 19 bp, Homo sapiens
agaccctgaacccacacct

SEQ ID NO: 585431 - DNA, 12 bp, Homo sapiens
agaccctgtctc

SEQ ID NO: 585432 - DNA, 13 bp, Homo sapiens
agacgtttataaa

SEQ ID NO: 585433 - DNA, 21 bp, Homo sapiens
agacgtttataaacagaaatg

SEQ ID NO: 585434 - DNA, 19 bp, Homo sapiens
agactatatatataaatgt

SEQ ID NO: 585435 - DNA, 21 bp, Homo sapiens
agactatatatataaatgtat

SEQ ID NO: 585436 - DNA, 18 bp, Homo sapiens
agactctgtctcaaaaaa

SEQ ID NO: 585437 - DNA, 16 bp, Homo sapiens
agactgaactgtgtga

SEQ ID NO: 585438 - DNA, 24 bp, Homo sapiens
agactgaatagatatgaaagctga

SEQ ID NO: 585439 - DNA, 17 bp, Homo sapiens
agactgagccagattgg

SEQ ID NO: 585440 - DNA, 17 bp, Homo sapiens
agactggatttgcagaa

SEQ ID NO: 585441 - DNA, 20 bp, Homo sapiens
agactggatttgcagaagtt

SEQ ID NO: 585442 - DNA, 23 bp, Homo sapiens
agactgtagatatgtattctttt

SEQ ID NO: 585443 - DNA, 15 bp, Homo sapiens
agacttcccagcttc

SEQ ID NO: 585444 - DNA, 18 bp, Homo sapiens
agacttggagaatactgc

SEQ ID NO: 585445 - DNA, 15 bp, Homo sapiens
agagaaagcacaatt

SEQ ID NO: 585446 - DNA, 10 bp, Homo sapiens
agagaatgag

SEQ ID NO: 585447 - DNA, 18 bp, Homo sapiens
agagaatgagtccttgat

SEQ ID NO: 585448 - DNA, 22 bp, Homo sapiens
agagactgaatagatatgaaag

SEQ ID NO: 585449 - DNA, 16 bp, Homo sapiens
agagagtggagagagc

SEQ ID NO: 585450 - DNA, 12 bp, Homo sapiens
agagatttctca

SEQ ID NO: 585451 - DNA, 13 bp, Homo sapiens
agagcaaacagaa

SEQ ID NO: 585452 - DNA, 15 bp, Homo sapiens
agagcaaacagaaaa

SEQ ID NO: 585453 - DNA, 21 bp, Homo sapiens
agagcagggctaaataaagag

SEQ ID NO: 585454 - DNA, 17 bp, Homo sapiens
agagccaattagacttg

SEQ ID NO: 585455 - DNA, 15 bp, Homo sapiens
agagtggagagagca

SEQ ID NO: 585456 - DNA, 23 bp, Homo sapiens
agagtgggctttggtggccaggg

SEQ ID NO: 585457 - DNA, 22 bp, Homo sapiens
agagttctggatgtctggctca

SEQ ID NO: 585458 - DNA, 20 bp, Homo sapiens
agagtttcagtttgttggaa

SEQ ID NO: 585459 - DNA, 22 bp, Homo sapiens
agagtttgaaactcgagaccat

SEQ ID NO: 585460 - DNA, 13 bp, Homo sapiens
agataaggtggct

SEQ ID NO: 585461 - DNA, 16 bp, Homo sapiens
agataaggtggcttct

SEQ ID NO: 585462 - DNA, 14 bp, Homo sapiens
agataatattgttt

SEQ ID NO: 585463 - DNA, 19 bp, Homo sapiens
agataccttatcttacaat

SEQ ID NO: 585464 - DNA, 22 bp, Homo sapiens
agataccttatcttacaatatt

SEQ ID NO: 585465 - DNA, 12 bp, Homo sapiens
agataggcctgt

SEQ ID NO: 585466 - DNA, 15 bp, Homo sapiens
agatatgaaagctga

SEQ ID NO: 585467 - DNA, 14 bp, Homo sapiens
agatatgtattctt

SEQ ID NO: 585468 - DNA, 13 bp, Homo sapiens
agatcaaagatga

SEQ ID NO: 585469 - DNA, 13 bp, Homo sapiens
agatcacgaggtc

SEQ ID NO: 585470 - DNA, 19 bp, Homo sapiens
agatccatttccattgctt

SEQ ID NO: 585471 - DNA, 16 bp, Homo sapiens
agatcgcatttcctaa

SEQ ID NO: 585472 - DNA, 21 bp, Homo sapiens
agatctcataatgctttgtta

SEQ ID NO: 585473 - DNA, 16 bp, Homo sapiens
agatctttcagaaata

SEQ ID NO: 585474 - DNA, 17 bp, Homo sapiens
agatctttcagaaatat

SEQ ID NO: 585475 - DNA, 19 bp, Homo sapiens
agatctttcagaaatataa

SEQ ID NO: 585476 - DNA, 19 bp, Homo sapiens
agatgcatcatctcttcct

SEQ ID NO: 585477 - DNA, 14 bp, Homo sapiens
agatgccccaggga

SEQ ID NO: 585478 - DNA, 16 bp, Homo sapiens
agatgccccagggatg

SEQ ID NO: 585479 - DNA, 17 bp, Homo sapiens
agatgccccagggatgg

SEQ ID NO: 585480 - DNA, 16 bp, Homo sapiens
agatgcgtttgcctcc

SEQ ID NO: 585481 - DNA, 13 bp, Homo sapiens
agattcccacctt

SEQ ID NO: 585482 - DNA, 13 bp, Homo sapiens
agattgaactttc

SEQ ID NO: 585483 - DNA, 19 bp, Homo sapiens
agattgactaactcaaata

SEQ ID NO: 585484 - DNA, 16 bp, Homo sapiens
agatttctcattgact

SEQ ID NO: 585485 - DNA, 18 bp, Homo sapiens
agatttctcattgacttt

SEQ ID NO: 585486 - DNA, 13 bp, Homo sapiens
agcaaacagaaaa

SEQ ID NO: 585487 - DNA, 16 bp, Homo sapiens
agcaaattccagattt

SEQ ID NO: 585488 - DNA, 22 bp, Homo sapiens
agcactttgggaggctgaggtg

SEQ ID NO: 585489 - DNA, 15 bp, Homo sapiens
agcagaaatgccccc

SEQ ID NO: 585490 - DNA, 22 bp, Homo sapiens
agcagaaatgcccccattctcc

SEQ ID NO: 585491 - DNA, 13 bp, Homo sapiens
agcagagttttca

SEQ ID NO: 585492 - DNA, 15 bp, Homo sapiens
agcagagttttcatt

SEQ ID NO: 585493 - DNA, 23 bp, Homo sapiens
agcagagttttcattaaatcctt

SEQ ID NO: 585494 - DNA, 15 bp, Homo sapiens
agcaggactgtggga

SEQ ID NO: 585495 - DNA, 13 bp, Homo sapiens
agcatagagaaca

SEQ ID NO: 585496 - DNA, 17 bp, Homo sapiens
agcatagagaacaaagt

SEQ ID NO: 585497 - DNA, 19 bp, Homo sapiens
agcatagataatattgttt

SEQ ID NO: 585498 - DNA, 23 bp, Homo sapiens
agcatctcagtggtgtgtgaagt

SEQ ID NO: 585499 - DNA, 13 bp, Homo sapiens
agcatcttcctct

SEQ ID NO: 585500 - DNA, 15 bp, Homo sapiens
agcatcttcctctgc

SEQ ID NO: 585501 - DNA, 17 bp, Homo sapiens
agcatgcagctttgcaa

SEQ ID NO: 585502 - DNA, 15 bp, Homo sapiens
agcatggggccagga

SEQ ID NO: 585503 - DNA, 13 bp, Homo sapiens
agcattgtaatta

SEQ ID NO: 585504 - DNA, 21 bp, Homo sapiens
agcattgtaattatgtaaata

SEQ ID NO: 585505 - DNA, 14 bp, Homo sapiens
agccaggcaagaaa

SEQ ID NO: 585506 - DNA, 16 bp, Homo sapiens
agccaggcaagaaagc

SEQ ID NO: 585507 - DNA, 13 bp, Homo sapiens
agccatgcctccc

SEQ ID NO: 585508 - DNA, 14 bp, Homo sapiens
agccatgcctccct

SEQ ID NO: 585509 - DNA, 16 bp, Homo sapiens
agccatgcctccctgg

SEQ ID NO: 585510 - DNA, 20 bp, Homo sapiens
agccatggcaggacagctcc

SEQ ID NO: 585511 - DNA, 14 bp, Homo sapiens
agccattgaacagc

SEQ ID NO: 585512 - DNA, 15 bp, Homo sapiens
agccattgaacagct

SEQ ID NO: 585513 - DNA, 18 bp, Homo sapiens
agccattgaacagctgtg

SEQ ID NO: 585514 - DNA, 13 bp, Homo sapiens
agccccctgccct

SEQ ID NO: 585515 - DNA, 16 bp, Homo sapiens
agcccctgggcccagt

SEQ ID NO: 585516 - DNA, 12 bp, Homo sapiens
agccctcctgag

SEQ ID NO: 585517 - DNA, 16 bp, Homo sapiens
agccctcctgagggcc

SEQ ID NO: 585518 - DNA, 18 bp, Homo sapiens
agccctggcaaatgcctg

SEQ ID NO: 585519 - DNA, 23 bp, Homo sapiens
agccctggcaaatgcctgactca

SEQ ID NO: 585520 - DNA, 20 bp, Homo sapiens
agccggggggccgggggagg

SEQ ID NO: 585521 - DNA, 16 bp, Homo sapiens
agcctaagggatcctg

SEQ ID NO: 585522 - DNA, 14 bp, Homo sapiens
agcctactctcctt

SEQ ID NO: 585523 - DNA, 14 bp, Homo sapiens
agcctatgtctggc

SEQ ID NO: 585524 - DNA, 17 bp, Homo sapiens
agcctatgtctggcaga

SEQ ID NO: 585525 - DNA, 22 bp, Homo sapiens
agcctccaccccacaacccaaa

SEQ ID NO: 585526 - DNA, 14 bp, Homo sapiens
agcctccttctttc

SEQ ID NO: 585527 - DNA, 23 bp, Homo sapiens
agcctgcattgagcttgcatgct

SEQ ID NO: 585528 - DNA, 14 bp, Homo sapiens
aaccacttgcctgg

SEQ ID NO: 585529 - DNA, 22 bp, Homo sapiens
aaccaggccagagcaaacagaa

SEQ ID NO: 585530 - DNA, 22 bp, Homo sapiens
aaccataggctgctctgcctgt

SEQ ID NO: 585531 - DNA, 17 bp, Homo sapiens
aaccatttttgaacctt

SEQ ID NO: 585532 - DNA, 18 bp, Homo sapiens
aaccctcttgccatcctg

SEQ ID NO: 585533 - DNA, 20 bp, Homo sapiens
aacctacagttttaactgtg

SEQ ID NO: 585534 - DNA, 20 bp, Homo sapiens
aaccttgaaaaaaaacagtg

SEQ ID NO: 585535 - DNA, 22 bp, Homo sapiens
aaccttgtttgtggtgtcccct

SEQ ID NO: 585536 - DNA, 16 bp, Homo sapiens
aacgaagagttccctt

SEQ ID NO: 585537 - DNA, 19 bp, Homo sapiens
aacggttcctggtgactcc

SEQ ID NO: 585538 - DNA, 19 bp, Homo sapiens
aacgtcctctttagttttt

SEQ ID NO: 585539 - DNA, 21 bp, Homo sapiens
aactaaatgtgcaatagaagg

SEQ ID NO: 585540 - DNA, 22 bp, Homo sapiens
aactaaatttcactactagatt

SEQ ID NO: 585541 - DNA, 18 bp, Homo sapiens
aactatcttctttggact

SEQ ID NO: 585542 - DNA, 17 bp, Homo sapiens
aactatttattgtgctg

SEQ ID NO: 585543 - DNA, 13 bp, Homo sapiens
aactcaaatacac

SEQ ID NO: 585544 - DNA, 12 bp, Homo sapiens
aactccaggcag

SEQ ID NO: 585545 - DNA, 20 bp, Homo sapiens
aactctctggaagcccctgg

SEQ ID NO: 585546 - DNA, 15 bp, Homo sapiens
aactctgcatgtaga

SEQ ID NO: 585547 - DNA, 21 bp, Homo sapiens
aactgatccagtataagacta

SEQ ID NO: 585548 - DNA, 14 bp, Homo sapiens
aactgtaaagatgt

SEQ ID NO: 585549 - DNA, 14 bp, Homo sapiens
aactgtggatattg

SEQ ID NO: 585550 - DNA, 19 bp, Homo sapiens
aactgttggaatggatttt

SEQ ID NO: 585551 - DNA, 18 bp, Homo sapiens
aactttccagtcttagct

SEQ ID NO: 585552 - DNA, 20 bp, Homo sapiens
aactttccagtcttagctga

SEQ ID NO: 585553 - DNA, 15 bp, Homo sapiens
aactttgtcagtgtt

SEQ ID NO: 585554 - DNA, 14 bp, Homo sapiens
aagaaagatactta

SEQ ID NO: 585555 - DNA, 12 bp, Homo sapiens
aagaaatacagt

SEQ ID NO: 585556 - DNA, 15 bp, Homo sapiens
aagaagtgcatgaaa

SEQ ID NO: 585557 - DNA, 11 bp, Homo sapiens
aagaatagaac

SEQ ID NO: 585558 - DNA, 18 bp, Homo sapiens
aagaatcagacagcagga

SEQ ID NO: 585559 - DNA, 13 bp, Homo sapiens
aagaatgaaagct

SEQ ID NO: 585560 - DNA, 17 bp, Homo sapiens
aagaatgaaagctgttc

SEQ ID NO: 585561 - DNA, 15 bp, Homo sapiens
aagaattgaaaagtt

SEQ ID NO: 585562 - DNA, 13 bp, Homo sapiens
aagaccacctcca

SEQ ID NO: 585563 - DNA, 22 bp, Homo sapiens
aagaccacctccaacccaaccc

SEQ ID NO: 585564 - DNA, 14 bp, Homo sapiens
aagacccctgtctt

SEQ ID NO: 585565 - DNA, 14 bp, Homo sapiens
aagactggatttgc

SEQ ID NO: 585566 - DNA, 16 bp, Homo sapiens
aagactgtagatatgt

SEQ ID NO: 585567 - DNA, 11 bp, Homo sapiens
aagagaaagag

SEQ ID NO: 585568 - DNA, 16 bp, Homo sapiens
aagagaatgagtcctt

SEQ ID NO: 585569 - DNA, 15 bp, Homo sapiens
aagagacagcccagg

SEQ ID NO: 585570 - DNA, 21 bp, Homo sapiens
aagagagttctggatgtctgg

SEQ ID NO: 585571 - DNA, 22 bp, Homo sapiens
aagagagttctggatgtctggc

SEQ ID NO: 585572 - DNA, 23 bp, Homo sapiens
aagagcgagagatcaaagatgaa

SEQ ID NO: 585573 - DNA, 14 bp, Homo sapiens
aagagcttaagaac

SEQ ID NO: 585574 - DNA, 14 bp, Homo sapiens
aagagggaaaacag

SEQ ID NO: 585575 - DNA, 20 bp, Homo sapiens
aagagttcccttgaaacttt

SEQ ID NO: 585576 - DNA, 19 bp, Homo sapiens
aagagtttcagtttgttgg

SEQ ID NO: 585577 - DNA, 15 bp, Homo sapiens
aagataaaatgatgt

SEQ ID NO: 585578 - DNA, 20 bp, Homo sapiens
aagataaaatgatgttatac

SEQ ID NO: 585579 - DNA, 15 bp, Homo sapiens
aagatattctttagt

SEQ ID NO: 585580 - DNA, 13 bp, Homo sapiens
aagatctttatat

SEQ ID NO: 585581 - DNA, 20 bp, Homo sapiens
aagatctttatatttcaata

SEQ ID NO: 585582 - DNA, 14 bp, Homo sapiens
aagatgaaacatca

SEQ ID NO: 585583 - DNA, 12 bp, Homo sapiens
aagatgcagaag

SEQ ID NO: 585584 - DNA, 21 bp, Homo sapiens
aagatgcatcatctcttcctc

SEQ ID NO: 585585 - DNA, 18 bp, Homo sapiens
aagatgcgtttgcctcct

SEQ ID NO: 585586 - DNA, 17 bp, Homo sapiens
aagcaaatgttaaaagt

SEQ ID NO: 585587 - DNA, 17 bp, Homo sapiens
aagcagacagccctggc

SEQ ID NO: 585588 - DNA, 14 bp, Homo sapiens
aagccccaactttc

SEQ ID NO: 585589 - DNA, 14 bp, Homo sapiens
aagcccctgggccc

SEQ ID NO: 585590 - DNA, 17 bp, Homo sapiens
aagcctaagggatcctg

SEQ ID NO: 585591 - DNA, 22 bp, Homo sapiens
aagcctaagggatcctgcctgc

SEQ ID NO: 585592 - DNA, 23 bp, Homo sapiens
aagctgcagagatttctcattga

SEQ ID NO: 585593 - DNA, 16 bp, Homo sapiens
aagcttcatccacagc

SEQ ID NO: 585594 - DNA, 16 bp, Homo sapiens
aaggaattatcaatta

SEQ ID NO: 585595 - DNA, 16 bp, Homo sapiens
aaggacccttttaagc

SEQ ID NO: 585596 - DNA, 12 bp, Homo sapiens
aatatgaatgaa

SEQ ID NO: 585597 - DNA, 17 bp, Homo sapiens
aatatgtatatatgtat

SEQ ID NO: 585598 - DNA, 23 bp, Homo sapiens
aatattgattgggaaaacatttg

SEQ ID NO: 585599 - DNA, 22 bp, Homo sapiens
aatattgtttggtaaatgtttc

SEQ ID NO: 585600 - DNA, 21 bp, Homo sapiens
aatcaaagccggcctgagaaa

SEQ ID NO: 585601 - DNA, 22 bp, Homo sapiens
aatcacagctcaagcattctgt

SEQ ID NO: 585602 - DNA, 14 bp, Homo sapiens
aatcagacagcagg

SEQ ID NO: 585603 - DNA, 17 bp, Homo sapiens
aatcattaagacaactg

SEQ ID NO: 585604 - DNA, 15 bp, Homo sapiens
aatcattcagaaatg

SEQ ID NO: 585605 - DNA, 19 bp, Homo sapiens
aatccagttataagaagaa

SEQ ID NO: 585606 - DNA, 16 bp, Homo sapiens
aatccctctccactct

SEQ ID NO: 585607 - DNA, 19 bp, Homo sapiens
aatctgctaccaaaacagt

SEQ ID NO: 585608 - DNA, 18 bp, Homo sapiens
aatctgtacaaaatggtc

SEQ ID NO: 585609 - DNA, 16 bp, Homo sapiens
aatcttcaaagccttc

SEQ ID NO: 585610 - DNA, 17 bp, Homo sapiens
aatcttcccatgcattc

SEQ ID NO: 585611 - DNA, 18 bp, Homo sapiens
aatctttcctactttcta

SEQ ID NO: 585612 - DNA, 21 bp, Homo sapiens
aatgaaacatgggctgtgatt

SEQ ID NO: 585613 - DNA, 18 bp, Homo sapiens
aatgaaccataaattcaa

SEQ ID NO: 585614 - DNA, 20 bp, Homo sapiens
aatgaactttgtcagtgttg

SEQ ID NO: 585615 - DNA, 14 bp, Homo sapiens
aatgaatgggatat

SEQ ID NO: 585616 - DNA, 21 bp, Homo sapiens
aatgaatgggatattttgaaa

SEQ ID NO: 585617 - DNA, 14 bp, Homo sapiens
aatgagctctgaaa

SEQ ID NO: 585618 - DNA, 20 bp, Homo sapiens
aatgatcagcaaaaagactg

SEQ ID NO: 585619 - DNA, 14 bp, Homo sapiens
aatgcccccattct

SEQ ID NO: 585620 - DNA, 16 bp, Homo sapiens
aatgctaaatgtgtaa

SEQ ID NO: 585621 - DNA, 16 bp, Homo sapiens
aatgctacaattttaa

SEQ ID NO: 585622 - DNA, 18 bp, Homo sapiens
aatggacaaaatccatga

SEQ ID NO: 585623 - DNA, 20 bp, Homo sapiens
aatggatttttctttaactg

SEQ ID NO: 585624 - DNA, 17 bp, Homo sapiens
aatggtgtggtgaatgt

SEQ ID NO: 585625 - DNA, 16 bp, Homo sapiens
aatgtaatagggaaaa

SEQ ID NO: 585626 - DNA, 16 bp, Homo sapiens
aatgtaatttaaatga

SEQ ID NO: 585627 - DNA, 17 bp, Homo sapiens
aatgtaatttaaatgaa

SEQ ID NO: 585628 - DNA, 15 bp, Homo sapiens
aatgtataaatatac

SEQ ID NO: 585629 - DNA, 20 bp, Homo sapiens
aatgtccaaaatttatattt

SEQ ID NO: 585630 - DNA, 21 bp, Homo sapiens
aatgtctcctttgctcttgcc

SEQ ID NO: 585631 - DNA, 23 bp, Homo sapiens
aatgtctcctttgctcttgccaa

SEQ ID NO: 585632 - DNA, 16 bp, Homo sapiens
aatgtggtctgccaat

SEQ ID NO: 585633 - DNA, 23 bp, Homo sapiens
aatgtggtctgccaatctgtaca

SEQ ID NO: 585634 - DNA, 23 bp, Homo sapiens
aatgtgtggattgcctctgaaaa

SEQ ID NO: 585635 - DNA, 21 bp, Homo sapiens
aatgtttcttttgtttggtaa

SEQ ID NO: 585636 - DNA, 20 bp, Homo sapiens
aattaaaaacgaaaacctga

SEQ ID NO: 585637 - DNA, 15 bp, Homo sapiens
aattaagcaaatgtt

SEQ ID NO: 585638 - DNA, 13 bp, Homo sapiens
aattataaatgac

SEQ ID NO: 585639 - DNA, 19 bp, Homo sapiens
aattatatattgcaaggtg

SEQ ID NO: 585640 - DNA, 19 bp, Homo sapiens
aattatgcaattcagtgtt

SEQ ID NO: 585641 - DNA, 14 bp, Homo sapiens
aattatgtaaataa

SEQ ID NO: 585642 - DNA, 21 bp, Homo sapiens
aattgactcttatttatagaa

SEQ ID NO: 585643 - DNA, 13 bp, Homo sapiens
aattgtacaaaat

SEQ ID NO: 585644 - DNA, 19 bp, Homo sapiens
aattgtacaaaattaagca

SEQ ID NO: 585645 - DNA, 20 bp, Homo sapiens
aattgtacaaaattaagcaa

SEQ ID NO: 585646 - DNA, 15 bp, Homo sapiens
aattgtcacatctat

SEQ ID NO: 585647 - DNA, 15 bp, Homo sapiens
aattgtgtggattct

SEQ ID NO: 585648 - DNA, 16 bp, Homo sapiens
aatttaactttccagt

SEQ ID NO: 585649 - DNA, 15 bp, Homo sapiens
aatttacttgttttg

SEQ ID NO: 585650 - DNA, 16 bp, Homo sapiens
aatttacttgttttgg

SEQ ID NO: 585651 - DNA, 22 bp, Homo sapiens
aatttagttgagcatagagaac

SEQ ID NO: 585652 - DNA, 15 bp, Homo sapiens
aatttatattttaga

SEQ ID NO: 585653 - DNA, 23 bp, Homo sapiens
aatttatattttagaaataataa

SEQ ID NO: 585654 - DNA, 15 bp, Homo sapiens
aatttgataatgaca

SEQ ID NO: 585655 - DNA, 16 bp, Homo sapiens
aatttgataatgacac

SEQ ID NO: 585656 - DNA, 23 bp, Homo sapiens
aatttggatttaaaagcctgctc

SEQ ID NO: 585657 - DNA, 14 bp, Homo sapiens
aatttgtatatgac

SEQ ID NO: 585658 - DNA, 17 bp, Homo sapiens
aatttgttttggatata

SEQ ID NO: 585659 - DNA, 13 bp, Homo sapiens
aattttaaagtgc

SEQ ID NO: 585660 - DNA, 13 bp, Homo sapiens
aatttttaactgt

SEQ ID NO: 585661 - DNA, 23 bp, Homo sapiens
acaaaatggtcctatttttgtga

SEQ ID NO: 585662 - DNA, 11 bp, Homo sapiens
acaaacaaaac

SEQ ID NO: 585663 - DNA, 22 bp, Homo sapiens
acaaactgcttcccttactttg

SEQ ID NO: 585664 - DNA, 17 bp, Homo sapiens
acaaagaaacaaagatg

SEQ ID NO: 585665 - DNA, 20 bp, Homo sapiens
acaaattgactcttatttat

SEQ ID NO: 585666 - DNA, 13 bp, Homo sapiens
ccgggtcctccta

SEQ ID NO: 585667 - DNA, 18 bp, Homo sapiens
ccggttattcgcccaccc

SEQ ID NO: 585668 - DNA, 14 bp, Homo sapiens
ccgtaatttaactt

SEQ ID NO: 585669 - DNA, 16 bp, Homo sapiens
ccgtattcctctccca

SEQ ID NO: 585670 - DNA, 13 bp, Homo sapiens
ccgtctctgccct

SEQ ID NO: 585671 - DNA, 14 bp, Homo sapiens
ccgtctctgccctg

SEQ ID NO: 585672 - DNA, 15 bp, Homo sapiens
ccgtctctgccctgg

SEQ ID NO: 585673 - DNA, 21 bp, Homo sapiens
ccgtctctgccctgggctcct

SEQ ID NO: 585674 - DNA, 14 bp, Homo sapiens
cctaagtcccttcc

SEQ ID NO: 585675 - DNA, 17 bp, Homo sapiens
cctacagttttaactgt

SEQ ID NO: 585676 - DNA, 19 bp, Homo sapiens
cctacagttttaactgtgg

SEQ ID NO: 585677 - DNA, 12 bp, Homo sapiens
cctacctccctc

SEQ ID NO: 585678 - DNA, 16 bp, Homo sapiens
cctacctccctccctc

SEQ ID NO: 585679 - DNA, 21 bp, Homo sapiens
cctactctccttgagtgtatg

SEQ ID NO: 585680 - DNA, 17 bp, Homo sapiens
cctactttctattttta

SEQ ID NO: 585681 - DNA, 14 bp, Homo sapiens
cctagcctatgtct

SEQ ID NO: 585682 - DNA, 16 bp, Homo sapiens
cctagcctatgtctgg

SEQ ID NO: 585683 - DNA, 13 bp, Homo sapiens
cctagctggctct

SEQ ID NO: 585684 - DNA, 17 bp, Homo sapiens
cctagctggctctgtga

SEQ ID NO: 585685 - DNA, 19 bp, Homo sapiens
cctaggatcccgtcttcca

SEQ ID NO: 585686 - DNA, 17 bp, Homo sapiens
cctatatcctccttctc

SEQ ID NO: 585687 - DNA, 13 bp, Homo sapiens
cctatgtctggca

SEQ ID NO: 585688 - DNA, 16 bp, Homo sapiens
cctattctataaaact

SEQ ID NO: 585689 - DNA, 15 bp, Homo sapiens
cctattctcctgcca

SEQ ID NO: 585690 - DNA, 12 bp, Homo sapiens
cctcaccgagca

SEQ ID NO: 585691 - DNA, 18 bp, Homo sapiens
cctcaggctcctaaagag

SEQ ID NO: 585692 - DNA, 21 bp, Homo sapiens
cctcaggctcctaaagagaca

SEQ ID NO: 585693 - DNA, 20 bp, Homo sapiens
cctcagttctcaaatgtgtg

SEQ ID NO: 585694 - DNA, 20 bp, Homo sapiens
cctccagtcacactccccgc

SEQ ID NO: 585695 - DNA, 13 bp, Homo sapiens
cctccccacctgt

SEQ ID NO: 585696 - DNA, 16 bp, Homo sapiens
cctccccacctgtagc

SEQ ID NO: 585697 - DNA, 20 bp, Homo sapiens
cctccccttttaccactccc

SEQ ID NO: 585698 - DNA, 17 bp, Homo sapiens
cctccctgggccacctc

SEQ ID NO: 585699 - DNA, 22 bp, Homo sapiens
cctccctgggccacctcctacc

SEQ ID NO: 585700 - DNA, 14 bp, Homo sapiens
cctccgccatgggg

SEQ ID NO: 585701 - DNA, 16 bp, Homo sapiens
cctcctaagtcccttc

SEQ ID NO: 585702 - DNA, 17 bp, Homo sapiens
cctcctaagtcccttcc

SEQ ID NO: 585703 - DNA, 19 bp, Homo sapiens
cctcctaagtcccttccta

SEQ ID NO: 585704 - DNA, 15 bp, Homo sapiens
cctcctaccccttcc

SEQ ID NO: 585705 - DNA, 19 bp, Homo sapiens
cctcctaccccttcctgtc

SEQ ID NO: 585706 - DNA, 23 bp, Homo sapiens
cctcctaccccttcctgtcctgc

SEQ ID NO: 585707 - DNA, 14 bp, Homo sapiens
cctcctacctgggg

SEQ ID NO: 585708 - DNA, 16 bp, Homo sapiens
cctcctacctggggac

SEQ ID NO: 585709 - DNA, 22 bp, Homo sapiens
cctcctacctggggactcctca

SEQ ID NO: 585710 - DNA, 19 bp, Homo sapiens
cctcctattctataaaact

SEQ ID NO: 585711 - DNA, 12 bp, Homo sapiens
cctccttctcct

SEQ ID NO: 585712 - DNA, 16 bp, Homo sapiens
cctcgagccctccccc

SEQ ID NO: 585713 - DNA, 20 bp, Homo sapiens
cctcgagccctcccccaaac

SEQ ID NO: 585714 - DNA, 13 bp, Homo sapiens
cctcgcccccacc

SEQ ID NO: 585715 - DNA, 14 bp, Homo sapiens
cctcgcccccacca

SEQ ID NO: 585716 - DNA, 21 bp, Homo sapiens
cctctccactcttctctcctt

SEQ ID NO: 585717 - DNA, 22 bp, Homo sapiens
cctctccgcgggagaccccttg

SEQ ID NO: 585718 - DNA, 23 bp, Homo sapiens
cctctccttcatgacagcctcca

SEQ ID NO: 585719 - DNA, 13 bp, Homo sapiens
cctctctgcctct

SEQ ID NO: 585720 - DNA, 20 bp, Homo sapiens
cctctgcacaccctccagag

SEQ ID NO: 585721 - DNA, 12 bp, Homo sapiens
cctcttctctcc

SEQ ID NO: 585722 - DNA, 15 bp, Homo sapiens
cctcttctctcctca

SEQ ID NO: 585723 - DNA, 23 bp, Homo sapiens
cctctttagtttttggttgggaa

SEQ ID NO: 585724 - DNA, 18 bp, Homo sapiens
cctgactcagtgaccagt

SEQ ID NO: 585725 - DNA, 14 bp, Homo sapiens
cctgagaaacacta

SEQ ID NO: 585726 - DNA, 18 bp, Homo sapiens
cctgaggcctagactctg

SEQ ID NO: 585727 - DNA, 24 bp, Homo sapiens
cctgatgctggggacacagcatca

SEQ ID NO: 585728 - DNA, 22 bp, Homo sapiens
cctgatggtgtcattctgcctg

SEQ ID NO: 585729 - DNA, 23 bp, Homo sapiens
cctgatggtgtcattctgcctgc

SEQ ID NO: 585730 - DNA, 21 bp, Homo sapiens
cctgcaaaactccaggcagga

SEQ ID NO: 585731 - DNA, 15 bp, Homo sapiens
cctgcagccttttct

SEQ ID NO: 585732 - DNA, 22 bp, Homo sapiens
cctgcataatgtttctggattt

SEQ ID NO: 585733 - DNA, 15 bp, Homo sapiens
cctgccagctgcagc

SEQ ID NO: 585734 - DNA, 20 bp, Homo sapiens
cctgccccggacctacctcc

SEQ ID NO: 585735 - DNA, 21 bp, Homo sapiens
cctgccccggacctacctccc

SEQ ID NO: 585736 - DNA, 22 bp, Homo sapiens
cctgccccggacctacctccct

SEQ ID NO: 585737 - DNA, 13 bp, Homo sapiens
cctgcctcctcat

SEQ ID NO: 585738 - DNA, 22 bp, Homo sapiens
cctgcttaatcttcaaagcctt

SEQ ID NO: 585739 - DNA, 22 bp, Homo sapiens
cctgctttcaagacccctgtct

SEQ ID NO: 585740 - DNA, 19 bp, Homo sapiens
cctggcaaatgcctgactc

SEQ ID NO: 585741 - DNA, 21 bp, Homo sapiens
cctggcaaatgcctgactcag

SEQ ID NO: 585742 - DNA, 12 bp, Homo sapiens
cctggctgccaa

SEQ ID NO: 585743 - DNA, 13 bp, Homo sapiens
cctgggccacctc

SEQ ID NO: 585744 - DNA, 17 bp, Homo sapiens
cctgggccacctcctac

SEQ ID NO: 585745 - DNA, 12 bp, Homo sapiens
cctgggctcctc

SEQ ID NO: 585746 - DNA, 14 bp, Homo sapiens
cctgggctcctctt

SEQ ID NO: 585747 - DNA, 14 bp, Homo sapiens
cctggggactcctc

SEQ ID NO: 585748 - DNA, 16 bp, Homo sapiens
cctggggactcctcaa

SEQ ID NO: 585749 - DNA, 22 bp, Homo sapiens
cctggtctggttgggcagccag

SEQ ID NO: 585750 - DNA, 22 bp, Homo sapiens
cctggtttgcaaagaccacctc

SEQ ID NO: 585751 - DNA, 16 bp, Homo sapiens
cctgtccaatctttga

SEQ ID NO: 585752 - DNA, 12 bp, Homo sapiens
cctgtcctgcct

SEQ ID NO: 585753 - DNA, 14 bp, Homo sapiens
cctgtcctgcctcc

SEQ ID NO: 585754 - DNA, 20 bp, Homo sapiens
cctgttcatgtttttgtttt

SEQ ID NO: 585755 - DNA, 19 bp, Homo sapiens
ccttattgctgtcctggag

SEQ ID NO: 585756 - DNA, 17 bp, Homo sapiens
ccttcaaggctcttctt

SEQ ID NO: 585757 - DNA, 21 bp, Homo sapiens
ccttcaaggctcttcttcctc

SEQ ID NO: 585758 - DNA, 11 bp, Homo sapiens
ccttcagaggc

SEQ ID NO: 585759 - DNA, 11 bp, Homo sapiens
ccttccactgt

SEQ ID NO: 585760 - DNA, 18 bp, Homo sapiens
ccttcctgtcctgcctcc

SEQ ID NO: 585761 - DNA, 21 bp, Homo sapiens
ccttcctgtcctgcctcctca

SEQ ID NO: 585762 - DNA, 24 bp, Homo sapiens
ccttcctgtcctgcctcctcatca

SEQ ID NO: 585763 - DNA, 15 bp, Homo sapiens
ccttctattggtctc

SEQ ID NO: 585764 - DNA, 17 bp, Homo sapiens
ccttctccctagctcct

SEQ ID NO: 585765 - DNA, 16 bp, Homo sapiens
ccttctggccttgtaa

SEQ ID NO: 585766 - DNA, 17 bp, Homo sapiens
ccttgaaaaaaaacagt

SEQ ID NO: 585767 - DNA, 18 bp, Homo sapiens
ccttgaatccagaacaca

SEQ ID NO: 585768 - DNA, 19 bp, Homo sapiens
ccttgcagcggctcctgca

SEQ ID NO: 585769 - DNA, 14 bp, Homo sapiens
ccttgttgcactgc

SEQ ID NO: 585770 - DNA, 19 bp, Homo sapiens
ccttgttgcactgccccct

SEQ ID NO: 585771 - DNA, 18 bp, Homo sapiens
cctttctcctccccacct

SEQ ID NO: 585772 - DNA, 15 bp, Homo sapiens
cctttctctctctaa

SEQ ID NO: 585773 - DNA, 12 bp, Homo sapiens
cctttgctcttg

SEQ ID NO: 585774 - DNA, 13 bp, Homo sapiens
cctttgctcttgc

SEQ ID NO: 585775 - DNA, 18 bp, Homo sapiens
ccttttctggtccctctt

SEQ ID NO: 585776 - DNA, 18 bp, Homo sapiens
cctttttgttgatgagga

SEQ ID NO: 585777 - DNA, 16 bp, Homo sapiens
cgaatgcccctgttca

SEQ ID NO: 585778 - DNA, 16 bp, Homo sapiens
cgagagatcaaagatg

SEQ ID NO: 585779 - DNA, 14 bp, Homo sapiens
cgagccctccccca

SEQ ID NO: 585780 - DNA, 22 bp, Homo sapiens
cgagtacctccagtcacactcc

SEQ ID NO: 585781 - DNA, 10 bp, Homo sapiens
cgatgcattt

SEQ ID NO: 585782 - DNA, 14 bp, Homo sapiens
cgatgcatttaata

SEQ ID NO: 585783 - DNA, 16 bp, Homo sapiens
cgatgcatttaataaa

SEQ ID NO: 585784 - DNA, 17 bp, Homo sapiens
cgatgcatttaataaag

SEQ ID NO: 585785 - DNA, 23 bp, Homo sapiens
cgatgcatttaataaagatgagt

SEQ ID NO: 585786 - DNA, 14 bp, Homo sapiens
cgcatcccatctct

SEQ ID NO: 585787 - DNA, 19 bp, Homo sapiens
cgcatcccatctctcccac

SEQ ID NO: 585788 - DNA, 12 bp, Homo sapiens
cgcatttcctaa

SEQ ID NO: 585789 - DNA, 23 bp, Homo sapiens
cgccaaggaaaggcatgtacaaa

SEQ ID NO: 585790 - DNA, 19 bp, Homo sapiens
cgccatggggtcggctcct

SEQ ID NO: 585791 - DNA, 16 bp, Homo sapiens
cgcgccagcgacctct

SEQ ID NO: 585792 - DNA, 12 bp, Homo sapiens
cggaaagaagag

SEQ ID NO: 585793 - DNA, 19 bp, Homo sapiens
cggacccttctgggtccag

SEQ ID NO: 585794 - DNA, 12 bp, Homo sapiens
cggacctacctc

SEQ ID NO: 585795 - DNA, 15 bp, Homo sapiens
cggacctacctccct

SEQ ID NO: 585796 - DNA, 16 bp, Homo sapiens
cggacctacctccctc

SEQ ID NO: 585797 - DNA, 17 bp, Homo sapiens
cggacctacctccctcc

SEQ ID NO: 585798 - DNA, 14 bp, Homo sapiens
cggcagatgatgct

SEQ ID NO: 585799 - DNA, 15 bp, Homo sapiens
cggcctgagaaacac

SEQ ID NO: 585800 - DNA, 13 bp, Homo sapiens
cggctcctcgccc

SEQ ID NO: 585801 - DNA, 11 bp, Homo sapiens
cggctcctgca

SEQ ID NO: 585802 - DNA, 23 bp, Homo sapiens
cggctctagggcctcagtctgga

SEQ ID NO: 585803 - DNA, 14 bp, Homo sapiens
cgggagaccccttg

SEQ ID NO: 585804 - DNA, 22 bp, Homo sapiens
cggggcagggggtatgcagagc

SEQ ID NO: 585805 - DNA, 18 bp, Homo sapiens
cggttattcgcccacccg

SEQ ID NO: 585806 - DNA, 17 bp, Homo sapiens
cggttcctggtgactcc

SEQ ID NO: 585807 - DNA, 13 bp, Homo sapiens
cgtccatctccct

SEQ ID NO: 585808 - DNA, 13 bp, Homo sapiens
cgtctctgccctg

SEQ ID NO: 585809 - DNA, 18 bp, Homo sapiens
cgtctctgccctgggctc

SEQ ID NO: 585810 - DNA, 23 bp, Homo sapiens
cgtcttccagagaacctgtgggc

SEQ ID NO: 585811 - DNA, 19 bp, Homo sapiens
cgtgccctcgtcagctggg

SEQ ID NO: 585812 - DNA, 22 bp, Homo sapiens
cgtggagccattgaacagctgt

SEQ ID NO: 585813 - DNA, 16 bp, Homo sapiens
cgtggatacagagcca

SEQ ID NO: 585814 - DNA, 21 bp, Homo sapiens
cgttctaaatatgaatgaatg

SEQ ID NO: 585815 - DNA, 22 bp, Homo sapiens
cgtttatatttttttaactgtg

SEQ ID NO: 585816 - DNA, 15 bp, Homo sapiens
ctaaaaaaaagatga

SEQ ID NO: 585817 - DNA, 13 bp, Homo sapiens
ctaaaaacatttg

SEQ ID NO: 585818 - DNA, 18 bp, Homo sapiens
ctaaaagttctcaatgta

SEQ ID NO: 585819 - DNA, 20 bp, Homo sapiens
ctaaaagttctcaatgtaga

SEQ ID NO: 585820 - DNA, 12 bp, Homo sapiens
ctaaataaagag

SEQ ID NO: 585821 - DNA, 21 bp, Homo sapiens
ctaaatgtgcaatagaaggtg

SEQ ID NO: 585822 - DNA, 15 bp, Homo sapiens
ctaaatgtgtaataa

SEQ ID NO: 585823 - DNA, 19 bp, Homo sapiens
ctaaatgtgtaataatgta

SEQ ID NO: 585824 - DNA, 14 bp, Homo sapiens
ctaaattatttact

SEQ ID NO: 585825 - DNA, 14 bp, Homo sapiens
ctaactcaaataca

SEQ ID NO: 585826 - DNA, 13 bp, Homo sapiens
ctaagactatata

SEQ ID NO: 585827 - DNA, 22 bp, Homo sapiens
ctaagactatatatataaatgt

SEQ ID NO: 585828 - DNA, 16 bp, Homo sapiens
ctaaggctcctgtttt

SEQ ID NO: 585829 - DNA, 16 bp, Homo sapiens
ctaagtcccttcctat

SEQ ID NO: 585830 - DNA, 22 bp, Homo sapiens
ctaagtcccttcctattctcct

SEQ ID NO: 585831 - DNA, 23 bp, Homo sapiens
ctaagtcccttcctattctcctg

SEQ ID NO: 585832 - DNA, 11 bp, Homo sapiens
ctaatttaaca

SEQ ID NO: 585833 - DNA, 19 bp, Homo sapiens
ctaatttgttttggatata

SEQ ID NO: 585834 - DNA, 13 bp, Homo sapiens
ctacaatctcttt

SEQ ID NO: 585835 - DNA, 22 bp, Homo sapiens
ctacagggcgagactctgtctc

SEQ ID NO: 585836 - DNA, 15 bp, Homo sapiens
ctacagttttaactg

SEQ ID NO: 585837 - DNA, 17 bp, Homo sapiens
ctacagttttaactgtg

SEQ ID NO: 585838 - DNA, 18 bp, Homo sapiens
ctacagttttaactgtgg

SEQ ID NO: 585839 - DNA, 20 bp, Homo sapiens
ctaccccttcctgtcctgcc

SEQ ID NO: 585840 - DNA, 21 bp, Homo sapiens
ctaccccttcctgtcctgcct

SEQ ID NO: 585841 - DNA, 23 bp, Homo sapiens
ctaccccttcctgtcctgcctcc

SEQ ID NO: 585842 - DNA, 16 bp, Homo sapiens
ctaccgtcttttcctg

SEQ ID NO: 585843 - DNA, 13 bp, Homo sapiens
ctacctccctccc

SEQ ID NO: 585844 - DNA, 19 bp, Homo sapiens
ctactatttaaatccttgg

SEQ ID NO: 585845 - DNA, 22 bp, Homo sapiens
ctactggtgtaatctcaatgca

SEQ ID NO: 585846 - DNA, 21 bp, Homo sapiens
ctagattgctaaggagctgat

SEQ ID NO: 585847 - DNA, 16 bp, Homo sapiens
ctagccaaaccaggac

SEQ ID NO: 585848 - DNA, 15 bp, Homo sapiens
ctagcctatgtctgg

SEQ ID NO: 585849 - DNA, 19 bp, Homo sapiens
ctagcctgcattgagcttg

SEQ ID NO: 585850 - DNA, 19 bp, Homo sapiens
ctaggacacagttcctggg

SEQ ID NO: 585851 - DNA, 20 bp, Homo sapiens
ctaggtacgatgacagtgtt

SEQ ID NO: 585852 - DNA, 20 bp, Homo sapiens
ctaggttctgtagagccaat

SEQ ID NO: 585853 - DNA, 21 bp, Homo sapiens
ctaggttctgtagagccaatt

SEQ ID NO: 585854 - DNA, 22 bp, Homo sapiens
ctaggttctgtagagccaatta

SEQ ID NO: 585855 - DNA, 10 bp, Homo sapiens
agcctgctca

SEQ ID NO: 585856 - DNA, 21 bp, Homo sapiens
agcctggtttgcaaagaccac

SEQ ID NO: 585857 - DNA, 20 bp, Homo sapiens
agccttcaaaactatagctt

SEQ ID NO: 585858 - DNA, 21 bp, Homo sapiens
agccttcaaaactatagcttg

SEQ ID NO: 585859 - DNA, 20 bp, Homo sapiens
agccttgcagcggctcctgc

SEQ ID NO: 585860 - DNA, 23 bp, Homo sapiens
agccttttctggtccctcttctc

SEQ ID NO: 585861 - DNA, 21 bp, Homo sapiens
agcgcggacccttctgggtcc

SEQ ID NO: 585862 - DNA, 23 bp, Homo sapiens
agcgcggacccttctgggtccag

SEQ ID NO: 585863 - DNA, 13 bp, Homo sapiens
agcggctcctcgc

SEQ ID NO: 585864 - DNA, 14 bp, Homo sapiens
agcggctcctcgcc

SEQ ID NO: 585865 - DNA, 15 bp, Homo sapiens
agcggctcctcgccc

SEQ ID NO: 585866 - DNA, 21 bp, Homo sapiens
agcggctcctcgcccccacca

SEQ ID NO: 585867 - DNA, 18 bp, Homo sapiens
agcgggggcctaaaaaaa

SEQ ID NO: 585868 - DNA, 20 bp, Homo sapiens
agcgttctaaatatgaatga

SEQ ID NO: 585869 - DNA, 13 bp, Homo sapiens
agctcaatgcagt

SEQ ID NO: 585870 - DNA, 13 bp, Homo sapiens
agctcctcccctt

SEQ ID NO: 585871 - DNA, 13 bp, Homo sapiens
agctctgaaatct

SEQ ID NO: 585872 - DNA, 22 bp, Homo sapiens
agctcttcctatccctctccta

SEQ ID NO: 585873 - DNA, 20 bp, Homo sapiens
agctgatactttgacagtgt

SEQ ID NO: 585874 - DNA, 19 bp, Homo sapiens
agctgcagagatttctcat

SEQ ID NO: 585875 - DNA, 13 bp, Homo sapiens
agctgcagcctgg

SEQ ID NO: 585876 - DNA, 18 bp, Homo sapiens
agctgcagcctggttggc

SEQ ID NO: 585877 - DNA, 21 bp, Homo sapiens
agctgcagcctggttggcagc

SEQ ID NO: 585878 - DNA, 22 bp, Homo sapiens
agctgcagcctggttggcagca

SEQ ID NO: 585879 - DNA, 15 bp, Homo sapiens
agctgccatggctag

SEQ ID NO: 585880 - DNA, 23 bp, Homo sapiens
agctgccgtagcttcagccaggc

SEQ ID NO: 585881 - DNA, 13 bp, Homo sapiens
agctgctgttgaa

SEQ ID NO: 585882 - DNA, 20 bp, Homo sapiens
agctggctctgtgagggtgc

SEQ ID NO: 585883 - DNA, 22 bp, Homo sapiens
agctggctctgtgagggtgctg

SEQ ID NO: 585884 - DNA, 18 bp, Homo sapiens
agcttcacagtacccaaa

SEQ ID NO: 585885 - DNA, 19 bp, Homo sapiens
agcttcagccaggcaagaa

SEQ ID NO: 585886 - DNA, 15 bp, Homo sapiens
agcttcagttgcttg

SEQ ID NO: 585887 - DNA, 19 bp, Homo sapiens
agcttcagttgcttgtctt

SEQ ID NO: 585888 - DNA, 23 bp, Homo sapiens
agcttcagttgcttgtcttctgg

SEQ ID NO: 585889 - DNA, 14 bp, Homo sapiens
agcttccttcaacc

SEQ ID NO: 585890 - DNA, 16 bp, Homo sapiens
agcttgtggtggggca

SEQ ID NO: 585891 - DNA, 19 bp, Homo sapiens
agcttgtggtggggcagga

SEQ ID NO: 585892 - DNA, 21 bp, Homo sapiens
agctttagtgaattaaattta

SEQ ID NO: 585893 - DNA, 16 bp, Homo sapiens
aggaaaattcttaaaa

SEQ ID NO: 585894 - DNA, 18 bp, Homo sapiens
aggaaaggcatgtacaaa

SEQ ID NO: 585895 - DNA, 18 bp, Homo sapiens
aggaaagtgatatgcatt

SEQ ID NO: 585896 - DNA, 14 bp, Homo sapiens
aggaacaaacaggg

SEQ ID NO: 585897 - DNA, 19 bp, Homo sapiens
aggaacaatctttgctgta

SEQ ID NO: 585898 - DNA, 20 bp, Homo sapiens
aggaacggtggaggcagagg

SEQ ID NO: 585899 - DNA, 22 bp, Homo sapiens
aggaatcattcagaaatgttga

SEQ ID NO: 585900 - DNA, 19 bp, Homo sapiens
aggaatttgaagctgcagt

SEQ ID NO: 585901 - DNA, 16 bp, Homo sapiens
aggacatgcaataaaa

SEQ ID NO: 585902 - DNA, 20 bp, Homo sapiens
aggacatgcaataaaattta

SEQ ID NO: 585903 - DNA, 17 bp, Homo sapiens
aggacccttttaagcat

SEQ ID NO: 585904 - DNA, 13 bp, Homo sapiens
aggacttgaaaga

SEQ ID NO: 585905 - DNA, 18 bp, Homo sapiens
aggacttggttgatgttt

SEQ ID NO: 585906 - DNA, 16 bp, Homo sapiens
aggagaaatttgataa

SEQ ID NO: 585907 - DNA, 21 bp, Homo sapiens
aggagaaatttgataatgaca

SEQ ID NO: 585908 - DNA, 13 bp, Homo sapiens
aggagaattgctt

SEQ ID NO: 585909 - DNA, 19 bp, Homo sapiens
aggagataaggtggcttct

SEQ ID NO: 585910 - DNA, 15 bp, Homo sapiens
aggagctgatacttt

SEQ ID NO: 585911 - DNA, 18 bp, Homo sapiens
aggataacacaagtaaaa

SEQ ID NO: 585912 - DNA, 15 bp, Homo sapiens
aggatatttgcacta

SEQ ID NO: 585913 - DNA, 16 bp, Homo sapiens
aggatccggaaagaag

SEQ ID NO: 585914 - DNA, 19 bp, Homo sapiens
aggatgaattgtcacatct

SEQ ID NO: 585915 - DNA, 20 bp, Homo sapiens
aggatgggtcccctccgcca

SEQ ID NO: 585916 - DNA, 14 bp, Homo sapiens
aggcaagaaagctt

SEQ ID NO: 585917 - DNA, 18 bp, Homo sapiens
aggcaagaaagcttcctt

SEQ ID NO: 585918 - DNA, 20 bp, Homo sapiens
aggcaagaaagcttccttca

SEQ ID NO: 585919 - DNA, 13 bp, Homo sapiens
aggcattggatat

SEQ ID NO: 585920 - DNA, 21 bp, Homo sapiens
aggccaaagagtctccagttt

SEQ ID NO: 585921 - DNA, 23 bp, Homo sapiens
aggccccactttcaagaatcaga

SEQ ID NO: 585922 - DNA, 18 bp, Homo sapiens
aggctccgggcaccaggg

SEQ ID NO: 585923 - DNA, 22 bp, Homo sapiens
aggctccgggcaccaggggcca

SEQ ID NO: 585924 - DNA, 22 bp, Homo sapiens
aggctcctgttttgcacagcca

SEQ ID NO: 585925 - DNA, 15 bp, Homo sapiens
aggctcttcttcctc

SEQ ID NO: 585926 - DNA, 13 bp, Homo sapiens
aggctgagaaagc

SEQ ID NO: 585927 - DNA, 21 bp, Homo sapiens
aggctggcctatgtggtctaa

SEQ ID NO: 585928 - DNA, 15 bp, Homo sapiens
agggaaaacagaaaa

SEQ ID NO: 585929 - DNA, 21 bp, Homo sapiens
agggaaaccagagtctgtatt

SEQ ID NO: 585930 - DNA, 14 bp, Homo sapiens
agggaagagacagc

SEQ ID NO: 585931 - DNA, 19 bp, Homo sapiens
agggaagagacagcccagg

SEQ ID NO: 585932 - DNA, 20 bp, Homo sapiens
agggaccaggtttgcaggag

SEQ ID NO: 585933 - DNA, 20 bp, Homo sapiens
agggcaaaagggcagctgtg

SEQ ID NO: 585934 - DNA, 19 bp, Homo sapiens
agggcctcagtctggagtg

SEQ ID NO: 585935 - DNA, 20 bp, Homo sapiens
agggcctttctcctccccac

SEQ ID NO: 585936 - DNA, 22 bp, Homo sapiens
agggcctttctcctccccacct

SEQ ID NO: 585937 - DNA, 23 bp, Homo sapiens
agggcctttctcctccccacctg

SEQ ID NO: 585938 - DNA, 19 bp, Homo sapiens
agggcgagactctgtctca

SEQ ID NO: 585939 - DNA, 15 bp, Homo sapiens
aggggaagaatgaaa

SEQ ID NO: 585940 - DNA, 15 bp, Homo sapiens
aggggccatgtcctc

SEQ ID NO: 585941 - DNA, 19 bp, Homo sapiens
aggggctaccctgggaagc

SEQ ID NO: 585942 - DNA, 14 bp, Homo sapiens
aggggctggggact

SEQ ID NO: 585943 - DNA, 23 bp, Homo sapiens
aggggtccctgcaaaactccagg

SEQ ID NO: 585944 - DNA, 21 bp, Homo sapiens
aggggttccttccacttctgg

SEQ ID NO: 585945 - DNA, 20 bp, Homo sapiens
agggtctaccaatacaaaat

SEQ ID NO: 585946 - DNA, 22 bp, Homo sapiens
agggtctaccaatacaaaatgt

SEQ ID NO: 585947 - DNA, 20 bp, Homo sapiens
agggtggttcaacaaagaaa

SEQ ID NO: 585948 - DNA, 23 bp, Homo sapiens
aggtaacactagggccttggaaa

SEQ ID NO: 585949 - DNA, 19 bp, Homo sapiens
aggtacgatgacagtgttc

SEQ ID NO: 585950 - DNA, 13 bp, Homo sapiens
aggtatgggctgg

SEQ ID NO: 585951 - DNA, 14 bp, Homo sapiens
aggtatgggctggg

SEQ ID NO: 585952 - DNA, 20 bp, Homo sapiens
aggtccttaggcctctgaga

SEQ ID NO: 585953 - DNA, 17 bp, Homo sapiens
aggtgctaatttgtttt

SEQ ID NO: 585954 - DNA, 21 bp, Homo sapiens
aggttgagaggaggacttggt

SEQ ID NO: 585955 - DNA, 14 bp, Homo sapiens
aggttgtggggcct

SEQ ID NO: 585956 - DNA, 19 bp, Homo sapiens
agtaaatagtttgaattca

SEQ ID NO: 585957 - DNA, 23 bp, Homo sapiens
agtaaatagtttgaattcagtaa

SEQ ID NO: 585958 - DNA, 21 bp, Homo sapiens
agtaacccccttaaatttaat

SEQ ID NO: 585959 - DNA, 14 bp, Homo sapiens
agtaagtgcgaaga

SEQ ID NO: 585960 - DNA, 17 bp, Homo sapiens
agtaagtgcgaagactg

SEQ ID NO: 585961 - DNA, 21 bp, Homo sapiens
agtacctagctggctctgtga

SEQ ID NO: 585962 - DNA, 16 bp, Homo sapiens
agtacgaacctacagt

SEQ ID NO: 585963 - DNA, 16 bp, Homo sapiens
agtagatccatttcca

SEQ ID NO: 585964 - DNA, 17 bp, Homo sapiens
agtagcatctcagtggt

SEQ ID NO: 585965 - DNA, 18 bp, Homo sapiens
acctgggacaggaaagag

SEQ ID NO: 585966 - DNA, 14 bp, Homo sapiens
acctgtggatattt

SEQ ID NO: 585967 - DNA, 13 bp, Homo sapiens
acctgtgggctga

SEQ ID NO: 585968 - DNA, 15 bp, Homo sapiens
accttaatttaactt

SEQ ID NO: 585969 - DNA, 17 bp, Homo sapiens
accttaatttaactttc

SEQ ID NO: 585970 - DNA, 18 bp, Homo sapiens
accttcaaggctcttctt

SEQ ID NO: 585971 - DNA, 18 bp, Homo sapiens
accttgaaaaaaaacagt

SEQ ID NO: 585972 - DNA, 12 bp, Homo sapiens
acctttcacaaa

SEQ ID NO: 585973 - DNA, 13 bp, Homo sapiens
acctttctctctc

SEQ ID NO: 585974 - DNA, 24 bp, Homo sapiens
acctttttttatcgtttttgtatt

SEQ ID NO: 585975 - DNA, 20 bp, Homo sapiens
acgaggtcaagagatcgaga

SEQ ID NO: 585976 - DNA, 23 bp, Homo sapiens
acgagtttggatgttgtaaataa

SEQ ID NO: 585977 - DNA, 19 bp, Homo sapiens
acgatgcatttaataaaga

SEQ ID NO: 585978 - DNA, 20 bp, Homo sapiens
acgatgcatttaataaagat

SEQ ID NO: 585979 - DNA, 20 bp, Homo sapiens
acgcatcccatctctcccac

SEQ ID NO: 585980 - DNA, 14 bp, Homo sapiens
acgccactgcactc

SEQ ID NO: 585981 - DNA, 21 bp, Homo sapiens
acgcctgtaatcccagcactt

SEQ ID NO: 585982 - DNA, 11 bp, Homo sapiens
acgctctcctc

SEQ ID NO: 585983 - DNA, 11 bp, Homo sapiens
acggttcctgg

SEQ ID NO: 585984 - DNA, 18 bp, Homo sapiens
acgtggatacagagccac

SEQ ID NO: 585985 - DNA, 11 bp, Homo sapiens
acgtttataaa

SEQ ID NO: 585986 - DNA, 15 bp, Homo sapiens
actaaaaaaaagatg

SEQ ID NO: 585987 - DNA, 18 bp, Homo sapiens
actaactcaaatacacat

SEQ ID NO: 585988 - DNA, 14 bp, Homo sapiens
actactagattgac

SEQ ID NO: 585989 - DNA, 23 bp, Homo sapiens
actaggctgagcaatctgaccct

SEQ ID NO: 585990 - DNA, 22 bp, Homo sapiens
actatatatataaatgtataaa

SEQ ID NO: 585991 - DNA, 14 bp, Homo sapiens
actatttgtgactt

SEQ ID NO: 585992 - DNA, 16 bp, Homo sapiens
actcaaatacacattt

SEQ ID NO: 585993 - DNA, 15 bp, Homo sapiens
actcacacccctgcc

SEQ ID NO: 585994 - DNA, 22 bp, Homo sapiens
actcattttcatattgtaatct

SEQ ID NO: 585995 - DNA, 17 bp, Homo sapiens
actcctcaaaccacttg

SEQ ID NO: 585996 - DNA, 18 bp, Homo sapiens
actcctcaaaccacttgc

SEQ ID NO: 585997 - DNA, 21 bp, Homo sapiens
actcctcaaaccacttgcctg

SEQ ID NO: 585998 - DNA, 22 bp, Homo sapiens
actctctggaagcccctgggcc

SEQ ID NO: 585999 - DNA, 20 bp, Homo sapiens
actctgcatgtagaggcttg

SEQ ID NO: 586000 - DNA, 18 bp, Homo sapiens
atgtcagctgctgttgaa

SEQ ID NO: 586001 - DNA, 21 bp, Homo sapiens
atgtcagctgctgttgaactt

SEQ ID NO: 586002 - DNA, 23 bp, Homo sapiens
atgtcagctgctgttgaactttt

SEQ ID NO: 586003 - DNA, 14 bp, Homo sapiens
atgtccaaaattta

SEQ ID NO: 586004 - DNA, 15 bp, Homo sapiens
atgtccaaaatttat

SEQ ID NO: 586005 - DNA, 16 bp, Homo sapiens
atgtctcctttgctct

SEQ ID NO: 586006 - DNA, 17 bp, Homo sapiens
atgtctcctttgctctt

SEQ ID NO: 586007 - DNA, 18 bp, Homo sapiens
atgtctcctttgctcttg

SEQ ID NO: 586008 - DNA, 19 bp, Homo sapiens
atgtctggcagatgagggc

SEQ ID NO: 586009 - DNA, 23 bp, Homo sapiens
atgtctggctcaaagcagcagga

SEQ ID NO: 586010 - DNA, 18 bp, Homo sapiens
atgtgactcagcatcacc

SEQ ID NO: 586011 - DNA, 21 bp, Homo sapiens
attttagaaataataaaaaga

SEQ ID NO: 586012 - DNA, 14 bp, Homo sapiens
attttcatgaaaat

SEQ ID NO: 586013 - DNA, 17 bp, Homo sapiens
attttcatgaaaatacc

SEQ ID NO: 586014 - DNA, 21 bp, Homo sapiens
attttcatgaaaataccattt

SEQ ID NO: 586015 - DNA, 12 bp, Homo sapiens
attttgaaatga

SEQ ID NO: 586016 - DNA, 15 bp, Homo sapiens
attttgaaatgaact

SEQ ID NO: 586017 - DNA, 19 bp, Homo sapiens
attttgaaatgaactttgt

SEQ ID NO: 586018 - DNA, 12 bp, Homo sapiens
attttgatattg

SEQ ID NO: 586019 - DNA, 12 bp, Homo sapiens
cactcacctcta

SEQ ID NO: 586020 - DNA, 19 bp, Homo sapiens
cactcctgcttaatcttca

SEQ ID NO: 586021 - DNA, 21 bp, Homo sapiens
cactcctgcttaatcttcaaa

SEQ ID NO: 586022 - DNA, 13 bp, Homo sapiens
cactcttctctcc

SEQ ID NO: 586023 - DNA, 22 bp, Homo sapiens
cactgacttaggtttcaggaag

SEQ ID NO: 586024 - DNA, 12 bp, Homo sapiens
cagtttccagtc

SEQ ID NO: 586025 - DNA, 18 bp, Homo sapiens
cagtttgtagtgccactg

SEQ ID NO: 586026 - DNA, 15 bp, Homo sapiens
cagtttgttggaaag

SEQ ID NO: 586027 - DNA, 13 bp, Homo sapiens
cagttttaactgt

SEQ ID NO: 586028 - DNA, 23 bp, Homo sapiens
cagttttaactgtggatattgtt

SEQ ID NO: 586029 - DNA, 15 bp, Homo sapiens
cataaacggttcctg

SEQ ID NO: 586030 - DNA, 17 bp, Homo sapiens
cataaacggttcctggt

SEQ ID NO: 586031 - DNA, 20 bp, Homo sapiens
cataaattcaactttgtaaa

SEQ ID NO: 586032 - DNA, 18 bp, Homo sapiens
cataactcacacccctgc

SEQ ID NO: 586033 - DNA, 19 bp, Homo sapiens
cataactcacacccctgcc

SEQ ID NO: 586034 - DNA, 23 bp, Homo sapiens
cataactcacacccctgccccca

SEQ ID NO: 586035 - DNA, 17 bp, Homo sapiens
cataagcttccatttta

SEQ ID NO: 586036 - DNA, 19 bp, Homo sapiens
cataagcttccattttaat

SEQ ID NO: 586037 - DNA, 18 bp, Homo sapiens
cataatgtttctggattt

SEQ ID NO: 586038 - DNA, 22 bp, Homo sapiens
cataatgtttctggatttcata

SEQ ID NO: 586039 - DNA, 16 bp, Homo sapiens
catacgcatcccatct

SEQ ID NO: 586040 - DNA, 18 bp, Homo sapiens
catacgcatcccatctct

SEQ ID NO: 586041 - DNA, 16 bp, Homo sapiens
catactttgtattttg

SEQ ID NO: 586042 - DNA, 16 bp, Homo sapiens
catagacatgaaaggt

SEQ ID NO: 586043 - DNA, 17 bp, Homo sapiens
catagagaacaaagtaa

SEQ ID NO: 586044 - DNA, 12 bp, Homo sapiens
catatgaatgaa

SEQ ID NO: 586045 - DNA, 14 bp, Homo sapiens
catattgtaatcta

SEQ ID NO: 586046 - DNA, 18 bp, Homo sapiens
catattgtaatctatgtt

SEQ ID NO: 586047 - DNA, 20 bp, Homo sapiens
catattgtaatctatgttta

SEQ ID NO: 586048 - DNA, 22 bp, Homo sapiens
catattgtaatctatgtttata

SEQ ID NO: 586049 - DNA, 18 bp, Homo sapiens
catcaaacctttgagtag

SEQ ID NO: 586050 - DNA, 13 bp, Homo sapiens
catcaatatgtat

SEQ ID NO: 586051 - DNA, 15 bp, Homo sapiens
catcaatatgtatat

SEQ ID NO: 586052 - DNA, 16 bp, Homo sapiens
catcaatatgtatata

SEQ ID NO: 586053 - DNA, 20 bp, Homo sapiens
catcacagatcgcatttcct

SEQ ID NO: 586054 - DNA, 13 bp, Homo sapiens
catcacccacctt

SEQ ID NO: 586055 - DNA, 19 bp, Homo sapiens
catcacgttagctgtccca

SEQ ID NO: 586056 - DNA, 12 bp, Homo sapiens
catcactgtatc

SEQ ID NO: 586057 - DNA, 21 bp, Homo sapiens
catcagggcctttctcctccc

SEQ ID NO: 586058 - DNA, 18 bp, Homo sapiens
catcagtgtgtaaataat

SEQ ID NO: 586059 - DNA, 16 bp, Homo sapiens
catcatctcttcctca

SEQ ID NO: 586060 - DNA, 23 bp, Homo sapiens
catcatgaggccggatgaaactt

SEQ ID NO: 586061 - DNA, 17 bp, Homo sapiens
catcctccagatagtgt

SEQ ID NO: 586062 - DNA, 14 bp, Homo sapiens
catctaattctgat

SEQ ID NO: 586063 - DNA, 13 bp, Homo sapiens
catctatctagtt

SEQ ID NO: 586064 - DNA, 17 bp, Homo sapiens
catctctcccacttcct

SEQ ID NO: 586065 - DNA, 15 bp, Homo sapiens
catgaaccctcttgc

SEQ ID NO: 586066 - DNA, 22 bp, Homo sapiens
catgaaccctcttgccatcctg

SEQ ID NO: 586067 - DNA, 22 bp, Homo sapiens
catgatttccctccagagaaag

SEQ ID NO: 586068 - DNA, 23 bp, Homo sapiens
catgatttccctccagagaaagc

SEQ ID NO: 586069 - DNA, 18 bp, Homo sapiens
catgcatagtcccagcta

SEQ ID NO: 586070 - DNA, 14 bp, Homo sapiens
catgcatgcaaatg

SEQ ID NO: 586071 - DNA, 21 bp, Homo sapiens
catgcccccaccctcccctca

SEQ ID NO: 586072 - DNA, 12 bp, Homo sapiens
catgcctccctg

SEQ ID NO: 586073 - DNA, 22 bp, Homo sapiens
catgcctccctgggccacctcc

SEQ ID NO: 586074 - DNA, 16 bp, Homo sapiens
catgcttcacaatgtt

SEQ ID NO: 586075 - DNA, 18 bp, Homo sapiens
catggctgctgttgctta

SEQ ID NO: 586076 - DNA, 21 bp, Homo sapiens
catgggtgcagaccctgaacc

SEQ ID NO: 586077 - DNA, 19 bp, Homo sapiens
catgtacttccctcttgaa

SEQ ID NO: 586078 - DNA, 15 bp, Homo sapiens
catgtatttgagcat

SEQ ID NO: 586079 - DNA, 19 bp, Homo sapiens
catgtccaaacgtcctctt

SEQ ID NO: 586080 - DNA, 18 bp, Homo sapiens
catgtgagctcttcctat

SEQ ID NO: 586081 - DNA, 15 bp, Homo sapiens
catgtgatacatttt

SEQ ID NO: 586082 - DNA, 22 bp, Homo sapiens
catgtgatacattttttaagct

SEQ ID NO: 586083 - DNA, 21 bp, Homo sapiens
catgtgatgttgtcttagcat

SEQ ID NO: 586084 - DNA, 23 bp, Homo sapiens
cattaactgttgcacttttgaat

SEQ ID NO: 586085 - DNA, 21 bp, Homo sapiens
cattaaggggaagaatgaaag

SEQ ID NO: 586086 - DNA, 19 bp, Homo sapiens
cattagtcctttgtctaag

SEQ ID NO: 586087 - DNA, 18 bp, Homo sapiens
cattcaacagagactgaa

SEQ ID NO: 586088 - DNA, 15 bp, Homo sapiens
cattcagaaatgttg

SEQ ID NO: 586089 - DNA, 23 bp, Homo sapiens
cattcagaaatgttgagtctgta

SEQ ID NO: 586090 - DNA, 11 bp, Homo sapiens
cattctcccag

SEQ ID NO: 586091 - DNA, 19 bp, Homo sapiens
cattctcccagtctctgtc

SEQ ID NO: 586092 - DNA, 23 bp, Homo sapiens
cattctgcactcagaaaatggca

SEQ ID NO: 586093 - DNA, 19 bp, Homo sapiens
cattctgcctgctccatcg

SEQ ID NO: 586094 - DNA, 23 bp, Homo sapiens
cattctggtcaagggctgtcatt

SEQ ID NO: 586095 - DNA, 18 bp, Homo sapiens
cattctttgcaatactgc

SEQ ID NO: 586096 - DNA, 13 bp, Homo sapiens
cattgaacagctg

SEQ ID NO: 586097 - DNA, 15 bp, Homo sapiens
cattgaacagctgtg

SEQ ID NO: 586098 - DNA, 17 bp, Homo sapiens
cattgaacagctgtgag

SEQ ID NO: 586099 - DNA, 14 bp, Homo sapiens
cattgagtattgtt

SEQ ID NO: 586100 - DNA, 23 bp, Homo sapiens
cattggggtagttgtgtttcaac

SEQ ID NO: 586101 - DNA, 14 bp, Homo sapiens
cattgtatatgtga

SEQ ID NO: 586102 - DNA, 17 bp, Homo sapiens
catttaataaagatgag

SEQ ID NO: 586103 - DNA, 15 bp, Homo sapiens
catttagaagcctga

SEQ ID NO: 586104 - DNA, 21 bp, Homo sapiens
catttatattaaataacatgt

SEQ ID NO: 586105 - DNA, 14 bp, Homo sapiens
catttccattgctt

SEQ ID NO: 586106 - DNA, 16 bp, Homo sapiens
catttccattgcttat

SEQ ID NO: 586107 - DNA, 18 bp, Homo sapiens
catttgctactgttgtaa

SEQ ID NO: 586108 - DNA, 17 bp, Homo sapiens
cattttcttttttaacc

SEQ ID NO: 586109 - DNA, 20 bp, Homo sapiens
catttttgtactaactagca

SEQ ID NO: 586110 - DNA, 16 bp, Homo sapiens
cattttttaatttact

SEQ ID NO: 586111 - DNA, 23 bp, Homo sapiens
cattttttaatttacttgttttg

SEQ ID NO: 586112 - DNA, 18 bp, Homo sapiens
ccaaaagtaaagatgcta

SEQ ID NO: 586113 - DNA, 21 bp, Homo sapiens
ccaaaagtgttgactgtgtca

SEQ ID NO: 586114 - DNA, 11 bp, Homo sapiens
ccaaatttaaa

SEQ ID NO: 586115 - DNA, 18 bp, Homo sapiens
ccaacccaatccctctcc

SEQ ID NO: 586116 - DNA, 21 bp, Homo sapiens
ccaagcatagagaagagtctg

SEQ ID NO: 586117 - DNA, 21 bp, Homo sapiens
ccaaggaaaggcatgtacaaa

SEQ ID NO: 586118 - DNA, 17 bp, Homo sapiens
ccaagttgtgcttgagc

SEQ ID NO: 586119 - DNA, 22 bp, Homo sapiens
ccaagttgtgcttgagccagga

SEQ ID NO: 586120 - DNA, 17 bp, Homo sapiens
ccaatatatgtattttt

SEQ ID NO: 586121 - DNA, 19 bp, Homo sapiens
ccaatccatcgtattaaaa

SEQ ID NO: 586122 - DNA, 15 bp, Homo sapiens
ccaatccctctccac

SEQ ID NO: 586123 - DNA, 16 bp, Homo sapiens
ccaatccctctccact

SEQ ID NO: 586124 - DNA, 19 bp, Homo sapiens
ccaatccctctccactctt

SEQ ID NO: 586125 - DNA, 11 bp, Homo sapiens
ccaatctgtac

SEQ ID NO: 586126 - DNA, 17 bp, Homo sapiens
ccaatctttcctacttt

SEQ ID NO: 586127 - DNA, 20 bp, Homo sapiens
ccaatctttcctactttcta

SEQ ID NO: 586128 - DNA, 21 bp, Homo sapiens
ccaattaaaaacgaaaacctg

SEQ ID NO: 586129 - DNA, 20 bp, Homo sapiens
ccacagaagacttcccagct

SEQ ID NO: 586130 - DNA, 21 bp, Homo sapiens
ccacagaagacttcccagctt

SEQ ID NO: 586131 - DNA, 20 bp, Homo sapiens
ccacagcagccccaggagaa

SEQ ID NO: 586132 - DNA, 21 bp, Homo sapiens
ccacagccttgcagcggctcc

SEQ ID NO: 586133 - DNA, 23 bp, Homo sapiens
ccaccagtgtagcatcttcctct

SEQ ID NO: 586134 - DNA, 13 bp, Homo sapiens
ccacctcctaccc

SEQ ID NO: 586135 - DNA, 20 bp, Homo sapiens
ccacctcctaccccttcctg

SEQ ID NO: 586136 - DNA, 14 bp, Homo sapiens
ccactcttctctcc

SEQ ID NO: 586137 - DNA, 20 bp, Homo sapiens
ccactgcactccagcctggc

SEQ ID NO: 586138 - DNA, 11 bp, Homo sapiens
ccactgtagct

SEQ ID NO: 586139 - DNA, 18 bp, Homo sapiens
ccactttattgcaatgca

SEQ ID NO: 586140 - DNA, 22 bp, Homo sapiens
ccagaaccacacttgaaacctt

SEQ ID NO: 586141 - DNA, 15 bp, Homo sapiens
ccagaagaaaatttg

SEQ ID NO: 586142 - DNA, 18 bp, Homo sapiens
ccagagagtggagagagc

SEQ ID NO: 586143 - DNA, 19 bp, Homo sapiens
ccagagagtggagagagca

SEQ ID NO: 586144 - DNA, 20 bp, Homo sapiens
ccagagagtggagagagcag

SEQ ID NO: 586145 - DNA, 21 bp, Homo sapiens
ccagagagtggagagagcagg

SEQ ID NO: 586146 - DNA, 19 bp, Homo sapiens
ccagagtgggctttggtgg

SEQ ID NO: 586147 - DNA, 20 bp, Homo sapiens
ccagatagtgtagctgagga

SEQ ID NO: 586148 - DNA, 18 bp, Homo sapiens
ccagattggccaattaaa

SEQ ID NO: 586149 - DNA, 18 bp, Homo sapiens
ccagcagaaatgccccca

SEQ ID NO: 586150 - DNA, 23 bp, Homo sapiens
ccagcagaaatgcccccattctc

SEQ ID NO: 586151 - DNA, 15 bp, Homo sapiens
ccagcgacctctctg

SEQ ID NO: 586152 - DNA, 18 bp, Homo sapiens
ccagcgacctctctgcct

SEQ ID NO: 586153 - DNA, 15 bp, Homo sapiens
ccagctgcagcctgg

SEQ ID NO: 586154 - DNA, 20 bp, Homo sapiens
ccagctgcagcctggttggc

SEQ ID NO: 586155 - DNA, 23 bp, Homo sapiens
ccaggacatgcaataaaatttaa

SEQ ID NO: 586156 - DNA, 21 bp, Homo sapiens
ccaggagtttaagaccagcct

SEQ ID NO: 586157 - DNA, 17 bp, Homo sapiens
ccaggatactggcacag

SEQ ID NO: 586158 - DNA, 16 bp, Homo sapiens
ccaggcaagaaagctt

SEQ ID NO: 586159 - DNA, 21 bp, Homo sapiens
ccaggcaagaaagcttccttc

SEQ ID NO: 586160 - DNA, 17 bp, Homo sapiens
ccagggaggcagcctag

SEQ ID NO: 586161 - DNA, 23 bp, Homo sapiens
ccagggaggcagcctagcctatg

SEQ ID NO: 586162 - DNA, 19 bp, Homo sapiens
ccagggatgggaggtatgg

SEQ ID NO: 586163 - DNA, 20 bp, Homo sapiens
ccaggggccaacctcaggct

SEQ ID NO: 586164 - DNA, 15 bp, Homo sapiens
ccagtcacactcccc

SEQ ID NO: 586165 - DNA, 14 bp, Homo sapiens
ccagtctctgtcgt

SEQ ID NO: 586166 - DNA, 20 bp, Homo sapiens
ccataaacggttcctggtga

SEQ ID NO: 586167 - DNA, 16 bp, Homo sapiens
ccatagacatgaaagg

SEQ ID NO: 586168 - DNA, 17 bp, Homo sapiens
ccatagatgctggctgg

SEQ ID NO: 586169 - DNA, 18 bp, Homo sapiens
ccatctccacaggagaga

SEQ ID NO: 586170 - DNA, 19 bp, Homo sapiens
ccatctccacaggagagac

SEQ ID NO: 586171 - DNA, 18 bp, Homo sapiens
ccatctctcccacttcct

SEQ ID NO: 586172 - DNA, 23 bp, Homo sapiens
ccatgcacaagatgccccaggga

SEQ ID NO: 586173 - DNA, 13 bp, Homo sapiens
ccatgcctccctg

SEQ ID NO: 586174 - DNA, 23 bp, Homo sapiens
ccatgcctccctgggccacctcc

SEQ ID NO: 586175 - DNA, 19 bp, Homo sapiens
ccatggcaggacagctcct

SEQ ID NO: 586176 - DNA, 20 bp, Homo sapiens
ccatggggtcggctcctgat

SEQ ID NO: 586177 - DNA, 20 bp, Homo sapiens
ccattaaggggaagaatgaa

SEQ ID NO: 586178 - DNA, 20 bp, Homo sapiens
ccattctttattcttttact

SEQ ID NO: 586179 - DNA, 16 bp, Homo sapiens
ccattgaacagctgtg

SEQ ID NO: 586180 - DNA, 15 bp, Homo sapiens
ccatttccattgctt

SEQ ID NO: 586181 - DNA, 23 bp, Homo sapiens
ccattttgttattgactaacagg

SEQ ID NO: 586182 - DNA, 15 bp, Homo sapiens
cccaacccaatccct

SEQ ID NO: 586183 - DNA, 14 bp, Homo sapiens
cccaatccctctcc

SEQ ID NO: 586184 - DNA, 23 bp, Homo sapiens
cccaccagtgtagcatcttcctc

SEQ ID NO: 586185 - DNA, 16 bp, Homo sapiens
cccacccgagtacctc

SEQ ID NO: 586186 - DNA, 18 bp, Homo sapiens
cccacccgagtacctcca

SEQ ID NO: 586187 - DNA, 15 bp, Homo sapiens
cccacctggctgcca

SEQ ID NO: 586188 - DNA, 16 bp, Homo sapiens
cccacctgtagctgaa

SEQ ID NO: 586189 - DNA, 12 bp, Homo sapiens
cccacttcctcc

SEQ ID NO: 586190 - DNA, 11 bp, Homo sapiens
cccagcctggt

SEQ ID NO: 586191 - DNA, 17 bp, Homo sapiens
cccaggaacgctctcct

SEQ ID NO: 586192 - DNA, 21 bp, Homo sapiens
cccagtacctagctggctctg

SEQ ID NO: 586193 - DNA, 20 bp, Homo sapiens
cccagttgcactcaggtgac

SEQ ID NO: 586194 - DNA, 22 bp, Homo sapiens
cccatctctcccacttcctcct

SEQ ID NO: 586195 - DNA, 21 bp, Homo sapiens
cccattaaggggaagaatgaa

SEQ ID NO: 586196 - DNA, 14 bp, Homo sapiens
cccattctcccagt

SEQ ID NO: 586197 - DNA, 17 bp, Homo sapiens
ccccattctcccagtct

SEQ ID NO: 586198 - DNA, 22 bp, Homo sapiens
cccccaggaacgctctcctcga

SEQ ID NO: 586199 - DNA, 19 bp, Homo sapiens
cccccattctcccagtctc

SEQ ID NO: 586200 - DNA, 22 bp, Homo sapiens
cccccattctcccagtctctgt

SEQ ID NO: 586201 - DNA, 16 bp, Homo sapiens
cccccttaaatttaat

SEQ ID NO: 586202 - DNA, 23 bp, Homo sapiens
ccccgcggttcatacgcatccca

SEQ ID NO: 586203 - DNA, 13 bp, Homo sapiens
cccctatcctccc

SEQ ID NO: 586204 - DNA, 14 bp, Homo sapiens
cccctatcctcccc

SEQ ID NO: 586205 - DNA, 16 bp, Homo sapiens
ccccttcctgtcctgc

SEQ ID NO: 586206 - DNA, 20 bp, Homo sapiens
ccccttcctgtcctgcctcc

SEQ ID NO: 586207 - DNA, 19 bp, Homo sapiens
ccccttgttgcactgcccc

SEQ ID NO: 586208 - DNA, 13 bp, Homo sapiens
cccgagtacctcc

SEQ ID NO: 586209 - DNA, 14 bp, Homo sapiens
cccgagtacctcca

SEQ ID NO: 586210 - DNA, 14 bp, Homo sapiens
cccgtctctgccct

SEQ ID NO: 586211 - DNA, 16 bp, Homo sapiens
cccgtctctgccctgg

SEQ ID NO: 586212 - DNA, 14 bp, Homo sapiens
ccctccagagaaag

SEQ ID NO: 586213 - DNA, 13 bp, Homo sapiens
ccctccctctccg

SEQ ID NO: 586214 - DNA, 13 bp, Homo sapiens
ccctcttctctcc

SEQ ID NO: 586215 - DNA, 17 bp, Homo sapiens
ccctcttctctcctcag

SEQ ID NO: 586216 - DNA, 18 bp, Homo sapiens
ccctcttctctcctcagt

SEQ ID NO: 586217 - DNA, 14 bp, Homo sapiens
ccctcttgccatcc

SEQ ID NO: 586218 - DNA, 19 bp, Homo sapiens
ccctcttgccatcctgatg

SEQ ID NO: 586219 - DNA, 21 bp, Homo sapiens
ccctcttgccatcctgatgga

SEQ ID NO: 586220 - DNA, 17 bp, Homo sapiens
ccctgaacccacacctg

SEQ ID NO: 586221 - DNA, 19 bp, Homo sapiens
ccctgcaaaactccaggca

SEQ ID NO: 586222 - DNA, 23 bp, Homo sapiens
ccctgcctcaggccaagggacca

SEQ ID NO: 586223 - DNA, 17 bp, Homo sapiens
ccctggacttgcctctg

SEQ ID NO: 586224 - DNA, 23 bp, Homo sapiens
ccctggagctcagggtccttgtt

SEQ ID NO: 586225 - DNA, 20 bp, Homo sapiens
ccctgggccacctcctaccc

SEQ ID NO: 586226 - DNA, 13 bp, Homo sapiens
ccctgggctcctc

SEQ ID NO: 586227 - DNA, 14 bp, Homo sapiens
ccctgttcatgttt

SEQ ID NO: 586228 - DNA, 16 bp, Homo sapiens
ccctgttcatgttttt

SEQ ID NO: 586229 - DNA, 19 bp, Homo sapiens
cccttcctattctcctgcc

SEQ ID NO: 586230 - DNA, 15 bp, Homo sapiens
cccttcctgtcctgc

SEQ ID NO: 586231 - DNA, 17 bp, Homo sapiens
cccttcctgtcctgcct

SEQ ID NO: 586232 - DNA, 13 bp, Homo sapiens
cccttctgggtcc

SEQ ID NO: 586233 - DNA, 14 bp, Homo sapiens
cccttctgggtcca

SEQ ID NO: 586234 - DNA, 18 bp, Homo sapiens
cccttgaaactttgggaa

SEQ ID NO: 586235 - DNA, 17 bp, Homo sapiens
cccttgttgcactgccc

SEQ ID NO: 586236 - DNA, 21 bp, Homo sapiens
cccttgttgcactgccccctg

SEQ ID NO: 586237 - DNA, 23 bp, Homo sapiens
cccttgttgcactgccccctgct

SEQ ID NO: 586238 - DNA, 15 bp, Homo sapiens
ccctttcctggcagt

SEQ ID NO: 586239 - DNA, 14 bp, Homo sapiens
ccctttgtcctgcg

SEQ ID NO: 586240 - DNA, 13 bp, Homo sapiens
ccgcccactcctg

SEQ ID NO: 586241 - DNA, 16 bp, Homo sapiens
ccgcccactcctggga

SEQ ID NO: 586242 - DNA, 18 bp, Homo sapiens
gttctaaatatgaatgaa

SEQ ID NO: 586243 - DNA, 14 bp, Homo sapiens
gttctcaaatgtgt

SEQ ID NO: 586244 - DNA, 18 bp, Homo sapiens
gttctgtagagccaatta

SEQ ID NO: 586245 - DNA, 19 bp, Homo sapiens
gttcttgccactgcactcc

SEQ ID NO: 586246 - DNA, 14 bp, Homo sapiens
gttctttggattct

SEQ ID NO: 586247 - DNA, 16 bp, Homo sapiens
gttgaagcgcggaccc

SEQ ID NO: 586248 - DNA, 16 bp, Homo sapiens
gttgagaggaggactt

SEQ ID NO: 586249 - DNA, 21 bp, Homo sapiens
gttgatgaggacccagagctg

SEQ ID NO: 586250 - DNA, 17 bp, Homo sapiens
gttgcacttttgaatgt

SEQ ID NO: 586251 - DNA, 18 bp, Homo sapiens
gttgcacttttgaatgtc

SEQ ID NO: 586252 - DNA, 23 bp, Homo sapiens
gttgggaatgaggaaaattctta

SEQ ID NO: 586253 - DNA, 19 bp, Homo sapiens
gttgggcagccagaccagc

SEQ ID NO: 586254 - DNA, 18 bp, Homo sapiens
gttggtatattttatatt

SEQ ID NO: 586255 - DNA, 13 bp, Homo sapiens
gttgtgcttgagc

SEQ ID NO: 586256 - DNA, 19 bp, Homo sapiens
gtttaaaatgtaatttaaa

SEQ ID NO: 586257 - DNA, 20 bp, Homo sapiens
gtttaaaatgtaatttaaat

SEQ ID NO: 586258 - DNA, 20 bp, Homo sapiens
gtttacaaaaatttctgtaa

SEQ ID NO: 586259 - DNA, 11 bp, Homo sapiens
gtttatatttt

SEQ ID NO: 586260 - DNA, 22 bp, Homo sapiens
gtttatatttttttaactgtga

SEQ ID NO: 586261 - DNA, 23 bp, Homo sapiens
gtttatatttttttaactgtgat

SEQ ID NO: 586262 - DNA, 12 bp, Homo sapiens
gtttcaggaagt

SEQ ID NO: 586263 - DNA, 16 bp, Homo sapiens
gtttctctataaagta

SEQ ID NO: 586264 - DNA, 14 bp, Homo sapiens
gtttcttttaaaga

SEQ ID NO: 586265 - DNA, 18 bp, Homo sapiens
gtttcttttgtttggtaa

SEQ ID NO: 586266 - DNA, 16 bp, Homo sapiens
gtttgcaaagaccacc

SEQ ID NO: 586267 - DNA, 18 bp, Homo sapiens
gtttgcaggagcccccct

SEQ ID NO: 586268 - DNA, 16 bp, Homo sapiens
gtttggtaaatgtttc

SEQ ID NO: 586269 - DNA, 13 bp, Homo sapiens
gtttgttggaaag

SEQ ID NO: 586270 - DNA, 21 bp, Homo sapiens
gttttaaaacgtgtaaatgaa

SEQ ID NO: 586271 - DNA, 15 bp, Homo sapiens
gttttaactgtggat

SEQ ID NO: 586272 - DNA, 15 bp, Homo sapiens
gttttactgtctatt

SEQ ID NO: 586273 - DNA, 19 bp, Homo sapiens
gttttcagcaaattccaga

SEQ ID NO: 586274 - DNA, 16 bp, Homo sapiens
gttttctccgggtcct

SEQ ID NO: 586275 - DNA, 15 bp, Homo sapiens
gttttgcacagccaa

SEQ ID NO: 586276 - DNA, 15 bp, Homo sapiens
gtttttgacatttat

SEQ ID NO: 586277 - DNA, 18 bp, Homo sapiens
gtttttgacatttatatt

SEQ ID NO: 586278 - DNA, 12 bp, Homo sapiens
taaaaagaaaga

SEQ ID NO: 586279 - DNA, 15 bp, Homo sapiens
taaaaatggacaaaa

SEQ ID NO: 586280 - DNA, 14 bp, Homo sapiens
taaaacacacaggt

SEQ ID NO: 586281 - DNA, 20 bp, Homo sapiens
taaaagtagtgttgtccagg

SEQ ID NO: 586282 - DNA, 17 bp, Homo sapiens
taaaagttctcaatgta

SEQ ID NO: 586283 - DNA, 17 bp, Homo sapiens
taaaagttttatatgct

SEQ ID NO: 586284 - DNA, 10 bp, Homo sapiens
taaaatgtaa

SEQ ID NO: 586285 - DNA, 19 bp, Homo sapiens
taaaattttgtatgttaaa

SEQ ID NO: 586286 - DNA, 22 bp, Homo sapiens
taaacgattagtgatgtcctta

SEQ ID NO: 586287 - DNA, 16 bp, Homo sapiens
taaacggttcctggtg

SEQ ID NO: 586288 - DNA, 14 bp, Homo sapiens
ctcagctcaatgca

SEQ ID NO: 586289 - DNA, 14 bp, Homo sapiens
ctcaggccaaggga

SEQ ID NO: 586290 - DNA, 16 bp, Homo sapiens
ctcaggccaagggacc

SEQ ID NO: 586291 - DNA, 18 bp, Homo sapiens
ctcagtagcatctcagtg

SEQ ID NO: 586292 - DNA, 14 bp, Homo sapiens
ctcagtgaccagtg

SEQ ID NO: 586293 - DNA, 20 bp, Homo sapiens
ctcagtggtgtgtgaagttt

SEQ ID NO: 586294 - DNA, 15 bp, Homo sapiens
ctcagttctcaaatg

SEQ ID NO: 586295 - DNA, 17 bp, Homo sapiens
ctcagttctcaaatgtg

SEQ ID NO: 586296 - DNA, 19 bp, Homo sapiens
ctcatgcatagtcccagct

SEQ ID NO: 586297 - DNA, 14 bp, Homo sapiens
ctcattgactttta

SEQ ID NO: 586298 - DNA, 13 bp, Homo sapiens
ctccagaagaaaa

SEQ ID NO: 586299 - DNA, 14 bp, Homo sapiens
ctccagagaaagca

SEQ ID NO: 586300 - DNA, 14 bp, Homo sapiens
ctccagtcacactc

SEQ ID NO: 586301 - DNA, 19 bp, Homo sapiens
ctccatggggaggcctcac

SEQ ID NO: 586302 - DNA, 13 bp, Homo sapiens
ctcccacttcctc

SEQ ID NO: 586303 - DNA, 14 bp, Homo sapiens
ctcccacttcctcc

SEQ ID NO: 586304 - DNA, 12 bp, Homo sapiens
ctccccacctgt

SEQ ID NO: 586305 - DNA, 14 bp, Homo sapiens
ctccctccctctcc

SEQ ID NO: 586306 - DNA, 14 bp, Homo sapiens
ctccctgcagcctt

SEQ ID NO: 586307 - DNA, 19 bp, Homo sapiens
ctccctgggccacctccta

SEQ ID NO: 586308 - DNA, 15 bp, Homo sapiens
ctccctttcactaaa

SEQ ID NO: 586309 - DNA, 16 bp, Homo sapiens
ctccgcgggagacccc

SEQ ID NO: 586310 - DNA, 14 bp, Homo sapiens
ctccgggtcctcct

SEQ ID NO: 586311 - DNA, 15 bp, Homo sapiens
ctccgggtcctccta

SEQ ID NO: 586312 - DNA, 15 bp, Homo sapiens
ctcctaagtcccttc

SEQ ID NO: 586313 - DNA, 15 bp, Homo sapiens
ctcctaccccttcct

SEQ ID NO: 586314 - DNA, 22 bp, Homo sapiens
ctcctaccccttcctgtcctgc

SEQ ID NO: 586315 - DNA, 16 bp, Homo sapiens
ctcctatatcctcctt

SEQ ID NO: 586316 - DNA, 16 bp, Homo sapiens
ctcctattctataaaa

SEQ ID NO: 586317 - DNA, 18 bp, Homo sapiens
ctcctcaaaccacttgcc

SEQ ID NO: 586318 - DNA, 19 bp, Homo sapiens
ctcctcaaaccacttgcct

SEQ ID NO: 586319 - DNA, 20 bp, Homo sapiens
ctcctcatggcagcctactc

SEQ ID NO: 586320 - DNA, 14 bp, Homo sapiens
ctcctccccacctg

SEQ ID NO: 586321 - DNA, 18 bp, Homo sapiens
ctcctccccacctgtagc

SEQ ID NO: 586322 - DNA, 19 bp, Homo sapiens
ctcctccccacctgtagct

SEQ ID NO: 586323 - DNA, 20 bp, Homo sapiens
ctcctccccacctgtagctg

SEQ ID NO: 586324 - DNA, 12 bp, Homo sapiens
ctcctcgagccc

SEQ ID NO: 586325 - DNA, 14 bp, Homo sapiens
ctcctcttagctca

SEQ ID NO: 586326 - DNA, 14 bp, Homo sapiens
ctcctgcaaagtct

SEQ ID NO: 586327 - DNA, 14 bp, Homo sapiens
ctcctgccatgggt

SEQ ID NO: 586328 - DNA, 19 bp, Homo sapiens
ctcctgcttaatcttcaaa

SEQ ID NO: 586329 - DNA, 19 bp, Homo sapiens
ctcctgttttgcacagcca

SEQ ID NO: 586330 - DNA, 19 bp, Homo sapiens
ctcgcccccaccagtgtag

SEQ ID NO: 586331 - DNA, 23 bp, Homo sapiens
ctcgcccccaggaacgctctcct

SEQ ID NO: 586332 - DNA, 12 bp, Homo sapiens
ctcgctgctggg

SEQ ID NO: 586333 - DNA, 17 bp, Homo sapiens
ctctaaaattataaatg

SEQ ID NO: 586334 - DNA, 14 bp, Homo sapiens
ctctccactcttct

SEQ ID NO: 586335 - DNA, 13 bp, Homo sapiens
ctctcccacttcc

SEQ ID NO: 586336 - DNA, 15 bp, Homo sapiens
ctctcccacttcctc

SEQ ID NO: 586337 - DNA, 21 bp, Homo sapiens
ctctcctcgagccctccccca

SEQ ID NO: 586338 - DNA, 23 bp, Homo sapiens
ctctcctttctccctgcagcctt

SEQ ID NO: 586339 - DNA, 20 bp, Homo sapiens
ctctctgcctctcttcttcc

SEQ ID NO: 586340 - DNA, 20 bp, Homo sapiens
ctctctggaagcccctgggc

SEQ ID NO: 586341 - DNA, 23 bp, Homo sapiens
ctctgaaatcttcccatgcattc

SEQ ID NO: 586342 - DNA, 19 bp, Homo sapiens
ctctgaagaactctctgga

SEQ ID NO: 586343 - DNA, 16 bp, Homo sapiens
ctctgagaagctctga

SEQ ID NO: 586344 - DNA, 11 bp, Homo sapiens
ctctgccctgg

SEQ ID NO: 586345 - DNA, 12 bp, Homo sapiens
ctctgccctggg

SEQ ID NO: 586346 - DNA, 14 bp, Homo sapiens
ctctgccctgggct

SEQ ID NO: 586347 - DNA, 13 bp, Homo sapiens
ctctgcctctctt

SEQ ID NO: 586348 - DNA, 18 bp, Homo sapiens
ctctgcctctcttcttcc

SEQ ID NO: 586349 - DNA, 15 bp, Homo sapiens
ctctgctatttctct

SEQ ID NO: 586350 - DNA, 18 bp, Homo sapiens
ctctgctatttctcttgc

SEQ ID NO: 586351 - DNA, 19 bp, Homo sapiens
ctctgctatttctcttgct

SEQ ID NO: 586352 - DNA, 23 bp, Homo sapiens
ctcttaagtcctaaaagttctca

SEQ ID NO: 586353 - DNA, 16 bp, Homo sapiens
ctcttagctcagctga

SEQ ID NO: 586354 - DNA, 19 bp, Homo sapiens
ctcttagctcagctgagca

SEQ ID NO: 586355 - DNA, 22 bp, Homo sapiens
ctcttatttatagaatttaata

SEQ ID NO: 586356 - DNA, 14 bp, Homo sapiens
ctcttctctcctca

SEQ ID NO: 586357 - DNA, 17 bp, Homo sapiens
ctcttctctcctcagtt

SEQ ID NO: 586358 - DNA, 15 bp, Homo sapiens
ctcttcttccccttt

SEQ ID NO: 586359 - DNA, 13 bp, Homo sapiens
ctcttgccatcct

SEQ ID NO: 586360 - DNA, 15 bp, Homo sapiens
ctcttgccatcctga

SEQ ID NO: 586361 - DNA, 14 bp, Homo sapiens
ctgaaataatggga

SEQ ID NO: 586362 - DNA, 13 bp, Homo sapiens
ctgaaccaggcca

SEQ ID NO: 586363 - DNA, 14 bp, Homo sapiens
ctgaagtatgaagt

SEQ ID NO: 586364 - DNA, 16 bp, Homo sapiens
ctgaagtatgaagtct

SEQ ID NO: 586365 - DNA, 14 bp, Homo sapiens
ctgaatttgtatat

SEQ ID NO: 586366 - DNA, 14 bp, Homo sapiens
ctgacatttcttct

SEQ ID NO: 586367 - DNA, 17 bp, Homo sapiens
ctgaccctatgggtcta

SEQ ID NO: 586368 - DNA, 16 bp, Homo sapiens
ctgactgccctccgaa

SEQ ID NO: 586369 - DNA, 21 bp, Homo sapiens
ctgacttaggtttcaggaagt

SEQ ID NO: 586370 - DNA, 19 bp, Homo sapiens
gatgcatttaataaagatg

SEQ ID NO: 586371 - DNA, 22 bp, Homo sapiens
gatgcatttaataaagatgagt

SEQ ID NO: 586372 - DNA, 16 bp, Homo sapiens
gatgccccagggatgg

SEQ ID NO: 586373 - DNA, 16 bp, Homo sapiens
gatgcgtttgcctcct

SEQ ID NO: 586374 - DNA, 17 bp, Homo sapiens
gatgcgtttgcctcctg

SEQ ID NO: 586375 - DNA, 14 bp, Homo sapiens
gatgctgatggagc

SEQ ID NO: 586376 - DNA, 13 bp, Homo sapiens
gatgctggctggg

SEQ ID NO: 586377 - DNA, 18 bp, Homo sapiens
gatgctttggaagatgca

SEQ ID NO: 586378 - DNA, 21 bp, Homo sapiens
gatggtgtcattctgcctgct

SEQ ID NO: 586379 - DNA, 22 bp, Homo sapiens
gatgttatacatcaatatgtat

SEQ ID NO: 586380 - DNA, 14 bp, Homo sapiens
gattactgcaatca

SEQ ID NO: 586381 - DNA, 20 bp, Homo sapiens
gattagaaacaaacaaaact

SEQ ID NO: 586382 - DNA, 15 bp, Homo sapiens
gattagtgatgtcct

SEQ ID NO: 586383 - DNA, 17 bp, Homo sapiens
gattattttttttttct

SEQ ID NO: 586384 - DNA, 20 bp, Homo sapiens
gattctggctttaagccttc

SEQ ID NO: 586385 - DNA, 23 bp, Homo sapiens
gattgactaactcaaatacacat

SEQ ID NO: 586386 - DNA, 16 bp, Homo sapiens
gatttaaaagcctgct

SEQ ID NO: 586387 - DNA, 20 bp, Homo sapiens
gatttccctccagagaaagc

SEQ ID NO: 586388 - DNA, 21 bp, Homo sapiens
gatttccctccagagaaagca

SEQ ID NO: 586389 - DNA, 22 bp, Homo sapiens
gatttctcattgacttttataa

SEQ ID NO: 586390 - DNA, 21 bp, Homo sapiens
gatttgaaaaatataaaatta

SEQ ID NO: 586391 - DNA, 16 bp, Homo sapiens
gcaaaacccacagaag

SEQ ID NO: 586392 - DNA, 17 bp, Homo sapiens
gcaaaagggcagctgtg

SEQ ID NO: 586393 - DNA, 16 bp, Homo sapiens
gcaaacccattaaggg

SEQ ID NO: 586394 - DNA, 12 bp, Homo sapiens
gcaaatgttaaa

SEQ ID NO: 586395 - DNA, 17 bp, Homo sapiens
gcaaattccagatttgt

SEQ ID NO: 586396 - DNA, 15 bp, Homo sapiens
gcaagaaagcttcct

SEQ ID NO: 586397 - DNA, 12 bp, Homo sapiens
gcaataaaattt

SEQ ID NO: 586398 - DNA, 13 bp, Homo sapiens
gcaataaaattta

SEQ ID NO: 586399 - DNA, 15 bp, Homo sapiens
gcaataaaatttaaa

SEQ ID NO: 586400 - DNA, 19 bp, Homo sapiens
gcaataaaatttaaaaaat

SEQ ID NO: 586401 - DNA, 14 bp, Homo sapiens
gcaatactgcttaa

SEQ ID NO: 586402 - DNA, 13 bp, Homo sapiens
gcacattaactgt

SEQ ID NO: 586403 - DNA, 14 bp, Homo sapiens
gcacattaactgtt

SEQ ID NO: 586404 - DNA, 21 bp, Homo sapiens
gcacattaactgttgcacttt

SEQ ID NO: 586405 - DNA, 14 bp, Homo sapiens
gcactccagcctgg

SEQ ID NO: 586406 - DNA, 21 bp, Homo sapiens
gcactgccccctgcttggcca

SEQ ID NO: 586407 - DNA, 23 bp, Homo sapiens
gcacttattgaccattttttaat

SEQ ID NO: 586408 - DNA, 16 bp, Homo sapiens
gcagacagccctggca

SEQ ID NO: 586409 - DNA, 16 bp, Homo sapiens
gcagaccctgaaccca

SEQ ID NO: 586410 - DNA, 23 bp, Homo sapiens
gcagagatttctcattgactttt

SEQ ID NO: 586411 - DNA, 23 bp, Homo sapiens
gcagagcttgtggtggggcagga

SEQ ID NO: 586412 - DNA, 17 bp, Homo sapiens
gcagcaggactgtggga

SEQ ID NO: 586413 - DNA, 17 bp, Homo sapiens
gcagcagtcgcccaagc

SEQ ID NO: 586414 - DNA, 18 bp, Homo sapiens
gcagcatccaccccaccc

SEQ ID NO: 586415 - DNA, 17 bp, Homo sapiens
gcagcatctgctccatc

SEQ ID NO: 586416 - DNA, 19 bp, Homo sapiens
gcagccagaccagcaggct

SEQ ID NO: 586417 - DNA, 15 bp, Homo sapiens
gcagccccaggagaa

SEQ ID NO: 586418 - DNA, 22 bp, Homo sapiens
gcagcctagcctatgtctggca

SEQ ID NO: 586419 - DNA, 23 bp, Homo sapiens
gcagcctagcctatgtctggcag

SEQ ID NO: 586420 - DNA, 18 bp, Homo sapiens
gcagcctggttggcagca

SEQ ID NO: 586421 - DNA, 15 bp, Homo sapiens
gcaggacagctcctg

SEQ ID NO: 586422 - DNA, 18 bp, Homo sapiens
gcaggacctgggacagga

SEQ ID NO: 586423 - DNA, 18 bp, Homo sapiens
gcaggcaggaacaaacag

SEQ ID NO: 586424 - DNA, 22 bp, Homo sapiens
gcaggcaggaacaaacagggct

SEQ ID NO: 586425 - DNA, 17 bp, Homo sapiens
gcaggctggcctatgtg

SEQ ID NO: 586426 - DNA, 14 bp, Homo sapiens
gcagtgagctgtgt

SEQ ID NO: 586427 - DNA, 18 bp, Homo sapiens
gcagtgtctgtgttttga

SEQ ID NO: 586428 - DNA, 17 bp, Homo sapiens
gcagttagctgaagaat

SEQ ID NO: 586429 - DNA, 20 bp, Homo sapiens
gcatacaagtttcattctcc

SEQ ID NO: 586430 - DNA, 18 bp, Homo sapiens
gcatactttgtattttga

SEQ ID NO: 586431 - DNA, 19 bp, Homo sapiens
gcatagataatattgtttg

SEQ ID NO: 586432 - DNA, 20 bp, Homo sapiens
gcatagccggtgggtgagga

SEQ ID NO: 586433 - DNA, 19 bp, Homo sapiens
gcatcagggcctttctcct

SEQ ID NO: 586434 - DNA, 20 bp, Homo sapiens
gcatcagggcctttctcctc

SEQ ID NO: 586435 - DNA, 21 bp, Homo sapiens
gcatcagggcctttctcctcc

SEQ ID NO: 586436 - DNA, 13 bp, Homo sapiens
gctcttcttcctc

SEQ ID NO: 586437 - DNA, 15 bp, Homo sapiens
gctgagcatggagac

SEQ ID NO: 586438 - DNA, 16 bp, Homo sapiens
gctgagcatggagaca

SEQ ID NO: 586439 - DNA, 19 bp, Homo sapiens
gctgagccctcctgagggc

SEQ ID NO: 586440 - DNA, 15 bp, Homo sapiens
gctgaggtgagagga

SEQ ID NO: 586441 - DNA, 13 bp, Homo sapiens
gctgataccatat

SEQ ID NO: 586442 - DNA, 20 bp, Homo sapiens
gctgataccatatgaatgaa

SEQ ID NO: 586443 - DNA, 16 bp, Homo sapiens
gctgcaaaaattatat

SEQ ID NO: 586444 - DNA, 19 bp, Homo sapiens
gctgcaaaaattatatatt

SEQ ID NO: 586445 - DNA, 21 bp, Homo sapiens
gctgcagttttgctatctggg

SEQ ID NO: 586446 - DNA, 20 bp, Homo sapiens
gctgccaagagtgaagggaa

SEQ ID NO: 586447 - DNA, 16 bp, Homo sapiens
gctgccgttttctggg

SEQ ID NO: 586448 - DNA, 17 bp, Homo sapiens
gctgcgcggactcgccc

SEQ ID NO: 586449 - DNA, 15 bp, Homo sapiens
gctgctgttgaactt

SEQ ID NO: 586450 - DNA, 14 bp, Homo sapiens
gctgggcagaggga

SEQ ID NO: 586451 - DNA, 19 bp, Homo sapiens
gctgggccccatctccaca

SEQ ID NO: 586452 - DNA, 16 bp, Homo sapiens
gctgggtcccagcctg

SEQ ID NO: 586453 - DNA, 21 bp, Homo sapiens
gctgtcttaaactaaatgtgc

SEQ ID NO: 586454 - DNA, 16 bp, Homo sapiens
gctgtgagccatgcct

SEQ ID NO: 586455 - DNA, 20 bp, Homo sapiens
gctgtgagccatgcctccct

SEQ ID NO: 586456 - DNA, 18 bp, Homo sapiens
gctgtgtgaatacctgct

SEQ ID NO: 586457 - DNA, 16 bp, Homo sapiens
gctgttgaacttttta

SEQ ID NO: 586458 - DNA, 19 bp, Homo sapiens
gctgttgcttaaaccactt

SEQ ID NO: 586459 - DNA, 18 bp, Homo sapiens
gcttaatgctacatgtga

SEQ ID NO: 586460 - DNA, 18 bp, Homo sapiens
gcttaatggagttcttgt

SEQ ID NO: 586461 - DNA, 13 bp, Homo sapiens
gcttcagccaggc

SEQ ID NO: 586462 - DNA, 16 bp, Homo sapiens
gcttctgccacataaa

SEQ ID NO: 586463 - DNA, 20 bp, Homo sapiens
gcttgaactaggctgagcaa

SEQ ID NO: 586464 - DNA, 22 bp, Homo sapiens
gcttgggtgaatttcaggggaa

SEQ ID NO: 586465 - DNA, 16 bp, Homo sapiens
gcttgtttacctttct

SEQ ID NO: 586466 - DNA, 13 bp, Homo sapiens
gctttaagccttc

SEQ ID NO: 586467 - DNA, 14 bp, Homo sapiens
gctttcctgcagca

SEQ ID NO: 586468 - DNA, 22 bp, Homo sapiens
gctttcctttttcccaataaat

SEQ ID NO: 586469 - DNA, 20 bp, Homo sapiens
gctttgtgaccagaaagctt

SEQ ID NO: 586470 - DNA, 21 bp, Homo sapiens
gctttgtgaccagaaagcttc

SEQ ID NO: 586471 - DNA, 20 bp, Homo sapiens
ggaaaccagagtctgtattt

SEQ ID NO: 586472 - DNA, 19 bp, Homo sapiens
ggaaagtgctgtcttaaac

SEQ ID NO: 586473 - DNA, 13 bp, Homo sapiens
ggaaatcttaaac

SEQ ID NO: 586474 - DNA, 16 bp, Homo sapiens
ggaaattcctgtactg

SEQ ID NO: 586475 - DNA, 15 bp, Homo sapiens
ggaacggaggaggac

SEQ ID NO: 586476 - DNA, 11 bp, Homo sapiens
ggaagaatgaa

SEQ ID NO: 586477 - DNA, 16 bp, Homo sapiens
ggaagagacagcccag

SEQ ID NO: 586478 - DNA, 14 bp, Homo sapiens
ggaagcccctgggc

SEQ ID NO: 586479 - DNA, 15 bp, Homo sapiens
ggaagcccctgggcc

SEQ ID NO: 586480 - DNA, 18 bp, Homo sapiens
ggaagcccctgggcccag

SEQ ID NO: 586481 - DNA, 17 bp, Homo sapiens
ggaaggacctgctccca

SEQ ID NO: 586482 - DNA, 20 bp, Homo sapiens
ggaagtcagaatttttaact

SEQ ID NO: 586483 - DNA, 18 bp, Homo sapiens
ggaagtgtgtgccaagag

SEQ ID NO: 586484 - DNA, 19 bp, Homo sapiens
ggaatggatttttctttaa

SEQ ID NO: 586485 - DNA, 15 bp, Homo sapiens
gtctctgtgtaacca

SEQ ID NO: 586486 - DNA, 17 bp, Homo sapiens
gtctcttaaaaaaataa

SEQ ID NO: 586487 - DNA, 13 bp, Homo sapiens
gtctttcatggct

SEQ ID NO: 586488 - DNA, 19 bp, Homo sapiens
gtctttcatggctgctgtt

SEQ ID NO: 586489 - DNA, 18 bp, Homo sapiens
gtgaagactgggtgagga

SEQ ID NO: 586490 - DNA, 18 bp, Homo sapiens
gtgaatgtgtgagaaaaa

SEQ ID NO: 586491 - DNA, 21 bp, Homo sapiens
gtgaatgtgtgagaaaaacta

SEQ ID NO: 586492 - DNA, 15 bp, Homo sapiens
gtgaccagaaagctt

SEQ ID NO: 586493 - DNA, 15 bp, Homo sapiens
gtgaccctgggcagt

SEQ ID NO: 586494 - DNA, 19 bp, Homo sapiens
gtgagcatggggccaggaa

SEQ ID NO: 586495 - DNA, 15 bp, Homo sapiens
gtgagccatgcctcc

SEQ ID NO: 586496 - DNA, 18 bp, Homo sapiens
gtgagccatgcctccctg

SEQ ID NO: 586497 - DNA, 15 bp, Homo sapiens
gtgatacatttttta

SEQ ID NO: 586498 - DNA, 20 bp, Homo sapiens
gtgatgtccttaaaatgtgg

SEQ ID NO: 586499 - DNA, 12 bp, Homo sapiens
gtgcaatagaag

SEQ ID NO: 586500 - DNA, 22 bp, Homo sapiens
gtgcacatatccaggcaccagg

SEQ ID NO: 586501 - DNA, 18 bp, Homo sapiens
gtgccctttcctggcagt

SEQ ID NO: 586502 - DNA, 18 bp, Homo sapiens
gtgcctatagtcccagct

SEQ ID NO: 586503 - DNA, 17 bp, Homo sapiens
gtgcgggcacaataaat

SEQ ID NO: 586504 - DNA, 16 bp, Homo sapiens
gtgctgggtcccagcc

SEQ ID NO: 586505 - DNA, 18 bp, Homo sapiens
gtgctgggtcccagcctg

SEQ ID NO: 586506 - DNA, 14 bp, Homo sapiens
gtgcttgagccagg

SEQ ID NO: 586507 - DNA, 16 bp, Homo sapiens
gtggaaaaaacatttt

SEQ ID NO: 586508 - DNA, 18 bp, Homo sapiens
gtggagagagcagggcta

SEQ ID NO: 586509 - DNA, 18 bp, Homo sapiens
gtggagccattgaacagc

SEQ ID NO: 586510 - DNA, 15 bp, Homo sapiens
gtggatacagagcca

SEQ ID NO: 586511 - DNA, 19 bp, Homo sapiens
gtggggaacggaggaggac

SEQ ID NO: 586512 - DNA, 22 bp, Homo sapiens
gtggggccataaacggttcctg

SEQ ID NO: 586513 - DNA, 18 bp, Homo sapiens
gtggggcctcaggctccg

SEQ ID NO: 586514 - DNA, 21 bp, Homo sapiens
gtggtctgccaatctgtacaa

SEQ ID NO: 586515 - DNA, 19 bp, Homo sapiens
gtggtgaatgtgtgagaaa

SEQ ID NO: 586516 - DNA, 16 bp, Homo sapiens
gtgtaaccagctcagt

SEQ ID NO: 586517 - DNA, 17 bp, Homo sapiens
gtgtcattctgcctgct

SEQ ID NO: 586518 - DNA, 14 bp, Homo sapiens
gtgtccctaatgtg

SEQ ID NO: 586519 - DNA, 22 bp, Homo sapiens
gtgtctccttaagctgcagaga

SEQ ID NO: 586520 - DNA, 16 bp, Homo sapiens
gtgtgaagtttggaga

SEQ ID NO: 586521 - DNA, 18 bp, Homo sapiens
gtgtgaagtttggagata

SEQ ID NO: 586522 - DNA, 18 bp, Homo sapiens
gtgtggttgctcacagct

SEQ ID NO: 586523 - DNA, 14 bp, Homo sapiens
gtgttcattgtttc

SEQ ID NO: 586524 - DNA, 16 bp, Homo sapiens
gtgttttaattgtaaa

SEQ ID NO: 586525 - DNA, 21 bp, Homo sapiens
gttaaggacccttttaagcat

SEQ ID NO: 586526 - DNA, 17 bp, Homo sapiens
gttacccattcaaccat

SEQ ID NO: 586527 - DNA, 17 bp, Homo sapiens
gttagctgaagaattga

SEQ ID NO: 586528 - DNA, 16 bp, Homo sapiens
gttagtgacatttaat

SEQ ID NO: 586529 - DNA, 18 bp, Homo sapiens
gttatacatcaatatgta

SEQ ID NO: 586530 - DNA, 20 bp, Homo sapiens
gttatacatcaatatgtata

SEQ ID NO: 586531 - DNA, 14 bp, Homo sapiens
gttatactgaacca

SEQ ID NO: 586532 - DNA, 21 bp, Homo sapiens
gttatcagtaatgctaaatgt

SEQ ID NO: 586533 - DNA, 16 bp, Homo sapiens
gttattcgcccacccg

SEQ ID NO: 586534 - DNA, 23 bp, Homo sapiens
gttatttattttttaagaaaaaa

SEQ ID NO: 586535 - DNA, 22 bp, Homo sapiens
gttcattggcattctttgcaat

SEQ ID NO: 586536 - DNA, 19 bp, Homo sapiens
gttcccaaaacaatggtgt

SEQ ID NO: 586537 - DNA, 16 bp, Homo sapiens
gttcctggtgactcct

SEQ ID NO: 586538 - DNA, 17 bp, Homo sapiens
gttcctggtgactcctg

SEQ ID NO: 586539 - DNA, 21 bp, Homo sapiens
gttccttggtcctagtaagaa

SEQ ID NO: 586540 - DNA, 14 bp, Homo sapiens
tatgagtagccagg

SEQ ID NO: 586541 - DNA, 15 bp, Homo sapiens
tatgcagagcttgtg

SEQ ID NO: 586542 - DNA, 18 bp, Homo sapiens
tatgctctacccttgtgt

SEQ ID NO: 586543 - DNA, 21 bp, Homo sapiens
tatgggctgggggctatgtat

SEQ ID NO: 586544 - DNA, 20 bp, Homo sapiens
tatgggggagattgaacttt

SEQ ID NO: 586545 - DNA, 17 bp, Homo sapiens
tatggtggatccaaact

SEQ ID NO: 586546 - DNA, 14 bp, Homo sapiens
tatgtattcttttc

SEQ ID NO: 586547 - DNA, 16 bp, Homo sapiens
tatgtattttttgaat

SEQ ID NO: 586548 - DNA, 13 bp, Homo sapiens
tatgtctggcaga

SEQ ID NO: 586549 - DNA, 19 bp, Homo sapiens
tatgtgctatacacacaca

SEQ ID NO: 586550 - DNA, 13 bp, Homo sapiens
tatgttaaagaga

SEQ ID NO: 586551 - DNA, 14 bp, Homo sapiens
tattaaaaaacaat

SEQ ID NO: 586552 - DNA, 22 bp, Homo sapiens
tattaaaaaacaattaactgcc

SEQ ID NO: 586553 - DNA, 19 bp, Homo sapiens
tattaaaactaaatttcac

SEQ ID NO: 586554 - DNA, 19 bp, Homo sapiens
tattatacatgtgatacat

SEQ ID NO: 586555 - DNA, 20 bp, Homo sapiens
tattatttttttaaaatttt

SEQ ID NO: 586556 - DNA, 13 bp, Homo sapiens
tattctcctgcca

SEQ ID NO: 586557 - DNA, 17 bp, Homo sapiens
tattctcctgccatggg

SEQ ID NO: 586558 - DNA, 22 bp, Homo sapiens
tattgactaacaggccaaagag

SEQ ID NO: 586559 - DNA, 14 bp, Homo sapiens
tattgattgggaaa

SEQ ID NO: 586560 - DNA, 15 bp, Homo sapiens
tattgattgggaaaa

SEQ ID NO: 586561 - DNA, 22 bp, Homo sapiens
tattgtgtggtctggttcctgt

SEQ ID NO: 586562 - DNA, 15 bp, Homo sapiens
tatttacttctgtat

SEQ ID NO: 586563 - DNA, 17 bp, Homo sapiens
tatttatagaatttaat

SEQ ID NO: 586564 - DNA, 13 bp, Homo sapiens
tatttctcttgct

SEQ ID NO: 586565 - DNA, 20 bp, Homo sapiens
tatttgcactatttccacat

SEQ ID NO: 586566 - DNA, 18 bp, Homo sapiens
tatttgtataaaagtgtg

SEQ ID NO: 586567 - DNA, 14 bp, Homo sapiens
tattttgtgtgaaa

SEQ ID NO: 586568 - DNA, 19 bp, Homo sapiens
tattttttcttttctttac

SEQ ID NO: 586569 - DNA, 16 bp, Homo sapiens
tatttttttaaaattt

SEQ ID NO: 586570 - DNA, 17 bp, Homo sapiens
tcaaaccacttgcctgg

SEQ ID NO: 586571 - DNA, 11 bp, Homo sapiens
tcaaagccttc

SEQ ID NO: 586572 - DNA, 13 bp, Homo sapiens
tcaaagttttgtt

SEQ ID NO: 586573 - DNA, 16 bp, Homo sapiens
tcaaatacacatttgc

SEQ ID NO: 586574 - DNA, 13 bp, Homo sapiens
tcaactttgtaaa

SEQ ID NO: 586575 - DNA, 19 bp, Homo sapiens
tcaactttgtaaaaatctt

SEQ ID NO: 586576 - DNA, 20 bp, Homo sapiens
tcaagaatcagacagcagga

SEQ ID NO: 586577 - DNA, 16 bp, Homo sapiens
tcaagacccctgtctt

SEQ ID NO: 586578 - DNA, 18 bp, Homo sapiens
tcctatatcctccttctc

SEQ ID NO: 586579 - DNA, 15 bp, Homo sapiens
tcctattctataaaa

SEQ ID NO: 586580 - DNA, 17 bp, Homo sapiens
tcctatttttgtgaaga

SEQ ID NO: 586581 - DNA, 21 bp, Homo sapiens
tcctcaaaccacttgcctggg

SEQ ID NO: 586582 - DNA, 23 bp, Homo sapiens
tcctcaaaccacttgcctggggc

SEQ ID NO: 586583 - DNA, 14 bp, Homo sapiens
tcctccccacctgt

SEQ ID NO: 586584 - DNA, 16 bp, Homo sapiens
tcctccccacctgtag

SEQ ID NO: 586585 - DNA, 16 bp, Homo sapiens
tcctccccttcctctt

SEQ ID NO: 586586 - DNA, 20 bp, Homo sapiens
tcctccccttttaccactcc

SEQ ID NO: 586587 - DNA, 21 bp, Homo sapiens
tcctcctacctggggactcct

SEQ ID NO: 586588 - DNA, 14 bp, Homo sapiens
tcctcgcccccacc

SEQ ID NO: 586589 - DNA, 18 bp, Homo sapiens
tcctctcaccttgtccct

SEQ ID NO: 586590 - DNA, 17 bp, Homo sapiens
tcctcttagctcagctg

SEQ ID NO: 586591 - DNA, 18 bp, Homo sapiens
tcctgataataaaggaac

SEQ ID NO: 586592 - DNA, 19 bp, Homo sapiens
tcctgatggacctgccccg

SEQ ID NO: 586593 - DNA, 22 bp, Homo sapiens
tcctgatggtgtcattctgcct

SEQ ID NO: 586594 - DNA, 22 bp, Homo sapiens
tcctgccatgggtgcagaccct

SEQ ID NO: 586595 - DNA, 14 bp, Homo sapiens
tcctggaccaggcc

SEQ ID NO: 586596 - DNA, 17 bp, Homo sapiens
tcctggaccaggcccat

SEQ ID NO: 586597 - DNA, 19 bp, Homo sapiens
tcctggaggggctggggac

SEQ ID NO: 586598 - DNA, 15 bp, Homo sapiens
tcctgtcctgcctcc

SEQ ID NO: 586599 - DNA, 19 bp, Homo sapiens
tcctgtcctgcctcctcat

SEQ ID NO: 586600 - DNA, 16 bp, Homo sapiens
tcctgtggcataaatt

SEQ ID NO: 586601 - DNA, 20 bp, Homo sapiens
tcctgtggcataaattgcat

SEQ ID NO: 586602 - DNA, 20 bp, Homo sapiens
tcctgtgtgaccctgggcag

SEQ ID NO: 586603 - DNA, 20 bp, Homo sapiens
tccttaagctgcagagattt

SEQ ID NO: 586604 - DNA, 13 bp, Homo sapiens
tccttccactgta

SEQ ID NO: 586605 - DNA, 18 bp, Homo sapiens
tcctttctccctgcagcc

SEQ ID NO: 586606 - DNA, 13 bp, Homo sapiens
tcctttgctcttg

SEQ ID NO: 586607 - DNA, 18 bp, Homo sapiens
tcctttttcccaataaat

SEQ ID NO: 586608 - DNA, 15 bp, Homo sapiens
tcgagccctccccca

SEQ ID NO: 586609 - DNA, 16 bp, Homo sapiens
tcgagccctcccccaa

SEQ ID NO: 586610 - DNA, 21 bp, Homo sapiens
tcgcccacccgagtacctcca

SEQ ID NO: 586611 - DNA, 22 bp, Homo sapiens
tcgcccacccgagtacctccag

SEQ ID NO: 586612 - DNA, 19 bp, Homo sapiens
tcgcccccaggaacgctct

SEQ ID NO: 586613 - DNA, 23 bp, Homo sapiens
tcgcgccagcgacctctctgcct

SEQ ID NO: 586614 - DNA, 13 bp, Homo sapiens
tcggaaacactga

SEQ ID NO: 586615 - DNA, 16 bp, Homo sapiens
tcggaaacactgactt

SEQ ID NO: 586616 - DNA, 13 bp, Homo sapiens
tcgtggagccatt

SEQ ID NO: 586617 - DNA, 20 bp, Homo sapiens
tcgtttttgtattttcatga

SEQ ID NO: 586618 - DNA, 20 bp, Homo sapiens
tctaaccaaggctgtgttta

SEQ ID NO: 586619 - DNA, 21 bp, Homo sapiens
tctaagactatatatataaat

SEQ ID NO: 586620 - DNA, 23 bp, Homo sapiens
tctaagactatatatataaatgt

SEQ ID NO: 586621 - DNA, 19 bp, Homo sapiens
tctacaatctctttttgtt

SEQ ID NO: 586622 - DNA, 14 bp, Homo sapiens
tctaccaatacaaa

SEQ ID NO: 586623 - DNA, 15 bp, Homo sapiens
tctacctggtctggt

SEQ ID NO: 586624 - DNA, 23 bp, Homo sapiens
tctaggacacagttcctgggaac

SEQ ID NO: 586625 - DNA, 21 bp, Homo sapiens
tctagggcctcagtctggagt

SEQ ID NO: 586626 - DNA, 14 bp, Homo sapiens
tctataaactataa

SEQ ID NO: 586627 - DNA, 21 bp, Homo sapiens
tctataaactataacctctcc

SEQ ID NO: 586628 - DNA, 14 bp, Homo sapiens
tctatatagacttg

SEQ ID NO: 586629 - DNA, 22 bp, Homo sapiens
tctcaaatgtgtgtggcagcca

SEQ ID NO: 586630 - DNA, 18 bp, Homo sapiens
tctcactgcttgaactag

SEQ ID NO: 586631 - DNA, 18 bp, Homo sapiens
tctcagtggtgtgtgaag

SEQ ID NO: 586632 - DNA, 13 bp, Homo sapiens
tctcagtgttggt

SEQ ID NO: 586633 - DNA, 14 bp, Homo sapiens
tctcagtgttggta

SEQ ID NO: 586634 - DNA, 15 bp, Homo sapiens
tctcataatgctttg

SEQ ID NO: 586635 - DNA, 22 bp, Homo sapiens
tctccactcttctctcctttct

SEQ ID NO: 586636 - DNA, 12 bp, Homo sapiens
tctcccacttcc

SEQ ID NO: 586637 - DNA, 14 bp, Homo sapiens
tctcccacttcctc

SEQ ID NO: 586638 - DNA, 18 bp, Homo sapiens
tctcccacttcctcctac

SEQ ID NO: 586639 - DNA, 20 bp, Homo sapiens
tctcccacttcctcctacct

SEQ ID NO: 586640 - DNA, 14 bp, Homo sapiens
tctcccagtctctg

SEQ ID NO: 586641 - DNA, 15 bp, Homo sapiens
tctcccagtctctgt

SEQ ID NO: 586642 - DNA, 15 bp, Homo sapiens
tctccctagctcctc

SEQ ID NO: 586643 - DNA, 19 bp, Homo sapiens
tctccctgcagccttttct

SEQ ID NO: 586644 - DNA, 18 bp, Homo sapiens
tctccgcgggagacccct

SEQ ID NO: 586645 - DNA, 16 bp, Homo sapiens
tctcctccccacctgt

SEQ ID NO: 586646 - DNA, 21 bp, Homo sapiens
tctcctccccacctgtagctg

SEQ ID NO: 586647 - DNA, 16 bp, Homo sapiens
tctcctgccatgggtg

SEQ ID NO: 586648 - DNA, 22 bp, Homo sapiens
tctccttaagctgcagagattt

SEQ ID NO: 586649 - DNA, 21 bp, Homo sapiens
tctccttcatgacagcctcca

SEQ ID NO: 586650 - DNA, 14 bp, Homo sapiens
tctcctttgctctt

SEQ ID NO: 586651 - DNA, 16 bp, Homo sapiens
tctcctttgctcttgc

SEQ ID NO: 586652 - DNA, 14 bp, Homo sapiens
tctctcccacttcc

SEQ ID NO: 586653 - DNA, 15 bp, Homo sapiens
tctctcccacttcct

SEQ ID NO: 586654 - DNA, 14 bp, Homo sapiens
tctctctctaaggt

SEQ ID NO: 586655 - DNA, 15 bp, Homo sapiens
tctctgcctctcttc

SEQ ID NO: 586656 - DNA, 19 bp, Homo sapiens
tctgaagtatgaagtctga

SEQ ID NO: 586657 - DNA, 19 bp, Homo sapiens
tctgattctggctttaagc

SEQ ID NO: 586658 - DNA, 18 bp, Homo sapiens
tctgccaatctgtacaaa

SEQ ID NO: 586659 - DNA, 14 bp, Homo sapiens
tctgccctgggctc

SEQ ID NO: 586660 - DNA, 16 bp, Homo sapiens
tctgccctgggctcct

SEQ ID NO: 586661 - DNA, 17 bp, Homo sapiens
tctgccctgggctcctc

SEQ ID NO: 586662 - DNA, 14 bp, Homo sapiens
tctgcctctcttct

SEQ ID NO: 586663 - DNA, 19 bp, Homo sapiens
tctgctccatcggggcagg

SEQ ID NO: 586664 - DNA, 17 bp, Homo sapiens
tctggaagcccctgggc

SEQ ID NO: 586665 - DNA, 13 bp, Homo sapiens
tctggatgtctgg

SEQ ID NO: 586666 - DNA, 15 bp, Homo sapiens
tctgggttgccttta

SEQ ID NO: 586667 - DNA, 21 bp, Homo sapiens
tctggtccctcttctctcctc

SEQ ID NO: 586668 - DNA, 13 bp, Homo sapiens
tctgtaattgtgt

SEQ ID NO: 586669 - DNA, 15 bp, Homo sapiens
tctgtatttttctaa

SEQ ID NO: 586670 - DNA, 17 bp, Homo sapiens
tctgtcgtggagccatt

SEQ ID NO: 586671 - DNA, 21 bp, Homo sapiens
tctgtgcaggatatttgcact

SEQ ID NO: 586672 - DNA, 22 bp, Homo sapiens
tctgtgcaggatatttgcacta

SEQ ID NO: 586673 - DNA, 22 bp, Homo sapiens
tctgtgtaaccagctcagtgtt

SEQ ID NO: 586674 - DNA, 15 bp, Homo sapiens
tctgttatgggcttt

SEQ ID NO: 586675 - DNA, 23 bp, Homo sapiens
tcttagctgaggctgagaaagct

SEQ ID NO: 586676 - DNA, 24 bp, Homo sapiens
tcttatccaactttttcatagtaa

SEQ ID NO: 586677 - DNA, 14 bp, Homo sapiens
tcttcaaagccttc

SEQ ID NO: 586678 - DNA, 17 bp, Homo sapiens
tcttcaaagccttctcc

SEQ ID NO: 586679 - DNA, 13 bp, Homo sapiens
tcttcccatgcat

SEQ ID NO: 586680 - DNA, 18 bp, Homo sapiens
tcttcccctttgtcctgc

SEQ ID NO: 586681 - DNA, 22 bp, Homo sapiens
tcttcctatccctctcctaact

SEQ ID NO: 586682 - DNA, 13 bp, Homo sapiens
tcttctctccttt

SEQ ID NO: 586683 - DNA, 13 bp, Homo sapiens
tcttgaaacctga

SEQ ID NO: 586684 - DNA, 18 bp, Homo sapiens
tcttgaaacctgatgtca

SEQ ID NO: 586685 - DNA, 18 bp, Homo sapiens
tgtttgccaggacatgca

SEQ ID NO: 586686 - DNA, 19 bp, Homo sapiens
tgtttgccaggacatgcaa

SEQ ID NO: 586687 - DNA, 19 bp, Homo sapiens
tgtttggagacgtttataa

SEQ ID NO: 586688 - DNA, 17 bp, Homo sapiens
tgttttggatggcttgt

SEQ ID NO: 586689 - DNA, 15 bp, Homo sapiens
tgttttggtggaaaa

SEQ ID NO: 586690 - DNA, 22 bp, Homo sapiens
ttaaaaaacaattaactgccct

SEQ ID NO: 586691 - DNA, 14 bp, Homo sapiens
ttaaaaaataaata

SEQ ID NO: 586692 - DNA, 18 bp, Homo sapiens
ttaaaacaatccttacta

SEQ ID NO: 586693 - DNA, 13 bp, Homo sapiens
ttaaaagcctgct

SEQ ID NO: 586694 - DNA, 15 bp, Homo sapiens
ttaaacgattagtga

SEQ ID NO: 586695 - DNA, 13 bp, Homo sapiens
ttaaataacatgt

SEQ ID NO: 586696 - DNA, 13 bp, Homo sapiens
ttaaatcctttta

SEQ ID NO: 586697 - DNA, 22 bp, Homo sapiens
ttaaatggtaataagcactgta

SEQ ID NO: 586698 - DNA, 14 bp, Homo sapiens
ttaacaagaacttt

SEQ ID NO: 586699 - DNA, 12 bp, Homo sapiens
ttaactgtggat

SEQ ID NO: 586700 - DNA, 15 bp, Homo sapiens
ttaactgtggatatt

SEQ ID NO: 586701 - DNA, 12 bp, Homo sapiens
ttaagaaacact

SEQ ID NO: 586702 - DNA, 14 bp, Homo sapiens
ttaagaaacactga

SEQ ID NO: 586703 - DNA, 16 bp, Homo sapiens
ttaagccttcaaaact

SEQ ID NO: 586704 - DNA, 17 bp, Homo sapiens
ttaaggacccttttaag

SEQ ID NO: 586705 - DNA, 23 bp, Homo sapiens
ttaaggacccttttaagcatgtg

SEQ ID NO: 586706 - DNA, 18 bp, Homo sapiens
ttaaggggtatcatgtat

SEQ ID NO: 586707 - DNA, 15 bp, Homo sapiens
ttaataaagatgagt

SEQ ID NO: 586708 - DNA, 16 bp, Homo sapiens
ttaataaagatgagtt

SEQ ID NO: 586709 - DNA, 20 bp, Homo sapiens
ttaatccagttataagaaga

SEQ ID NO: 586710 - DNA, 21 bp, Homo sapiens
ttaatttaactttccagtctt

SEQ ID NO: 586711 - DNA, 18 bp, Homo sapiens
ttaattttaaagtgcaaa

SEQ ID NO: 586712 - DNA, 21 bp, Homo sapiens
ttacagaggtattaaaactaa

SEQ ID NO: 586713 - DNA, 13 bp, Homo sapiens
ttacctgtggata

SEQ ID NO: 586714 - DNA, 20 bp, Homo sapiens
ttacctgtggatatttgtat

SEQ ID NO: 586715 - DNA, 17 bp, Homo sapiens
ttactaaaaaaaagatg

SEQ ID NO: 586716 - DNA, 14 bp, Homo sapiens
ttactgacatttct

SEQ ID NO: 586717 - DNA, 13 bp, Homo sapiens
ttactgcaatcac

SEQ ID NO: 586718 - DNA, 16 bp, Homo sapiens
ttactgcaatcactgt

SEQ ID NO: 586719 - DNA, 14 bp, Homo sapiens
ttagaaataataaa

SEQ ID NO: 586720 - DNA, 23 bp, Homo sapiens
ttagaaataataaaaagaaagat

SEQ ID NO: 586721 - DNA, 23 bp, Homo sapiens
ttagaaattacctgtggatattt

SEQ ID NO: 586722 - DNA, 16 bp, Homo sapiens
ttagaagcctgacaac

SEQ ID NO: 586723 - DNA, 16 bp, Homo sapiens
ttagacctgtgttact

SEQ ID NO: 586724 - DNA, 20 bp, Homo sapiens
ttagatgggaggatgaattg

SEQ ID NO: 586725 - DNA, 18 bp, Homo sapiens
ttagattgtattaactat

SEQ ID NO: 586726 - DNA, 14 bp, Homo sapiens
ttagcggctcctcg

SEQ ID NO: 586727 - DNA, 20 bp, Homo sapiens
ttagcggctcctcgccccca

SEQ ID NO: 586728 - DNA, 16 bp, Homo sapiens
ttagctgaagaattga

SEQ ID NO: 586729 - DNA, 20 bp, Homo sapiens
ttagctgaggctgagaaagc

SEQ ID NO: 586730 - DNA, 10 bp, Homo sapiens
ttagctgtgc

SEQ ID NO: 586731 - DNA, 23 bp, Homo sapiens
ttagggactacccatagacatga

SEQ ID NO: 586732 - DNA, 12 bp, Homo sapiens
ttataaaagtgt

SEQ ID NO: 586733 - DNA, 15 bp, Homo sapiens
ttatatttcaataaa

SEQ ID NO: 586734 - DNA, 19 bp, Homo sapiens
ttatatttcaataaatgat

SEQ ID NO: 586735 - DNA, 22 bp, Homo sapiens
ttatattttagaaataataaaa

SEQ ID NO: 586736 - DNA, 17 bp, Homo sapiens
ttatatttttttaactg

SEQ ID NO: 586737 - DNA, 18 bp, Homo sapiens
ttatatttttttaactgt

SEQ ID NO: 586738 - DNA, 21 bp, Homo sapiens
ttatcagtaatgctaaatgtg

SEQ ID NO: 586739 - DNA, 22 bp, Homo sapiens
ttatgacaagctgtatcactgc

SEQ ID NO: 586740 - DNA, 13 bp, Homo sapiens
ttattaatgtttt

SEQ ID NO: 586741 - DNA, 14 bp, Homo sapiens
ttattcgcccaccc

SEQ ID NO: 586742 - DNA, 15 bp, Homo sapiens
ttattcgcccacccg

SEQ ID NO: 586743 - DNA, 13 bp, Homo sapiens
ttattgaccattt

SEQ ID NO: 586744 - DNA, 22 bp, Homo sapiens
ttattgtgctgggtcccagcct

SEQ ID NO: 586745 - DNA, 14 bp, Homo sapiens
ttatttttataatt

SEQ ID NO: 586746 - DNA, 16 bp, Homo sapiens
ttatttttataattgt

SEQ ID NO: 586747 - DNA, 18 bp, Homo sapiens
ttatttttataattgtac

SEQ ID NO: 586748 - DNA, 13 bp, Homo sapiens
ttattttttaaga

SEQ ID NO: 586749 - DNA, 19 bp, Homo sapiens
ttcaaggctcttcttcctc

SEQ ID NO: 586750 - DNA, 19 bp, Homo sapiens
ttcaatgattatttgtatt

SEQ ID NO: 586751 - DNA, 23 bp, Homo sapiens
ttcacagtacccaaactgctttt

SEQ ID NO: 586752 - DNA, 22 bp, Homo sapiens
ttcagaaatataacacattttt

SEQ ID NO: 586753 - DNA, 16 bp, Homo sapiens
ttcagaggctgaggtg

SEQ ID NO: 586754 - DNA, 17 bp, Homo sapiens
ttcagccaggcaagaaa

SEQ ID NO: 586755 - DNA, 14 bp, Homo sapiens
ttcagttctttgga

SEQ ID NO: 586756 - DNA, 20 bp, Homo sapiens
ttcagttctttggattctaa

SEQ ID NO: 586757 - DNA, 19 bp, Homo sapiens
ttcagttgcttgtcttctg

SEQ ID NO: 586758 - DNA, 17 bp, Homo sapiens
ttcagtttaatgtctcc

SEQ ID NO: 586759 - DNA, 22 bp, Homo sapiens
ttcatactgtaacattcaggaa

SEQ ID NO: 586760 - DNA, 14 bp, Homo sapiens
ttcatattgtaatc

SEQ ID NO: 586761 - DNA, 15 bp, Homo sapiens
ttcatgaaaatacca

SEQ ID NO: 586762 - DNA, 15 bp, Homo sapiens
ttcatgattagaaat

SEQ ID NO: 586763 - DNA, 17 bp, Homo sapiens
ttcatgcctgatgaaag

SEQ ID NO: 586764 - DNA, 19 bp, Homo sapiens
ttcatggctgctgttgctt

SEQ ID NO: 586765 - DNA, 18 bp, Homo sapiens
ttcattctccctttcact

SEQ ID NO: 586766 - DNA, 19 bp, Homo sapiens
ttcattggcattctttgca

SEQ ID NO: 586767 - DNA, 13 bp, Homo sapiens
ttccactgtagct

SEQ ID NO: 586768 - DNA, 17 bp, Homo sapiens
ttccagagagtggagag

SEQ ID NO: 586769 - DNA, 23 bp, Homo sapiens
ttccagagagtggagagagcagg

SEQ ID NO: 586770 - DNA, 20 bp, Homo sapiens
ttccagatctttcagaaata

SEQ ID NO: 586771 - DNA, 22 bp, Homo sapiens
ttccagtgatgtgtgagctatg

SEQ ID NO: 586772 - DNA, 18 bp, Homo sapiens
ttccattttaattttaaa

SEQ ID NO: 586773 - DNA, 17 bp, Homo sapiens
ttcccctttgtcctgcg

SEQ ID NO: 586774 - DNA, 22 bp, Homo sapiens
ttccctaggatcccgtcttcca

SEQ ID NO: 586775 - DNA, 22 bp, Homo sapiens
ttcccttaaggggtatcatgta

SEQ ID NO: 586776 - DNA, 15 bp, Homo sapiens
ttcctattctcctgc

SEQ ID NO: 586777 - DNA, 17 bp, Homo sapiens
ttcctattctcctgcca

SEQ ID NO: 586778 - DNA, 12 bp, Homo sapiens
ttcctctcccag

SEQ ID NO: 586779 - DNA, 17 bp, Homo sapiens
tttaaaattttgtatgt

SEQ ID NO: 586780 - DNA, 17 bp, Homo sapiens
tttaaagaccctcctat

SEQ ID NO: 586781 - DNA, 18 bp, Homo sapiens
tttaaagtctcagtttct

SEQ ID NO: 586782 - DNA, 11 bp, Homo sapiens
tttaaattgtg

SEQ ID NO: 586783 - DNA, 21 bp, Homo sapiens
tttaactgccgtaatttaact

SEQ ID NO: 586784 - DNA, 13 bp, Homo sapiens
tttaactgtggat

SEQ ID NO: 586785 - DNA, 15 bp, Homo sapiens
tttaactgtggatat

SEQ ID NO: 586786 - DNA, 18 bp, Homo sapiens
tttaactgtggatattgt

SEQ ID NO: 586787 - DNA, 16 bp, Homo sapiens
tttaagaaaaaaagct

SEQ ID NO: 586788 - DNA, 21 bp, Homo sapiens
tttaagcttcagttgcttgtc

SEQ ID NO: 586789 - DNA, 20 bp, Homo sapiens
cgctctcctcgagccctccc

SEQ ID NO: 586790 - DNA, 19 bp, Homo sapiens
cgctgcgcggactcgcccc

SEQ ID NO: 586791 - DNA, 22 bp, Homo sapiens
cggacccttctgggtccaggga

SEQ ID NO: 586792 - DNA, 23 bp, Homo sapiens
cggacccttctgggtccagggag

SEQ ID NO: 586793 - DNA, 14 bp, Homo sapiens
cggacctacctccc

SEQ ID NO: 586794 - DNA, 23 bp, Homo sapiens
cggagttcggaaaccgtcctgtg

SEQ ID NO: 586795 - DNA, 22 bp, Homo sapiens
cggcagatgatgctttggaaga

SEQ ID NO: 586796 - DNA, 19 bp, Homo sapiens
cggcatgaaccctcttgcc

SEQ ID NO: 586797 - DNA, 13 bp, Homo sapiens
cggctcctgatgg

SEQ ID NO: 586798 - DNA, 14 bp, Homo sapiens
cgggcacaataaat

SEQ ID NO: 586799 - DNA, 15 bp, Homo sapiens
cgggcacaataaatc

SEQ ID NO: 586800 - DNA, 20 bp, Homo sapiens
cggggcagggggtatgcaga

SEQ ID NO: 586801 - DNA, 18 bp, Homo sapiens
cggggggccgggggaggg

SEQ ID NO: 586802 - DNA, 15 bp, Homo sapiens
cggtggaggcagagg

SEQ ID NO: 586803 - DNA, 13 bp, Homo sapiens
cggttcctggtga

SEQ ID NO: 586804 - DNA, 15 bp, Homo sapiens
cggttctaaggctca

SEQ ID NO: 586805 - DNA, 16 bp, Homo sapiens
cgtattaaaaaacaat

SEQ ID NO: 586806 - DNA, 23 bp, Homo sapiens
cgtccatcacgttagctgtccca

SEQ ID NO: 586807 - DNA, 14 bp, Homo sapiens
cgtctctgccctgg

SEQ ID NO: 586808 - DNA, 18 bp, Homo sapiens
cgtcttttcctgtttcct

SEQ ID NO: 586809 - DNA, 14 bp, Homo sapiens
cgttctaaatatga

SEQ ID NO: 586810 - DNA, 15 bp, Homo sapiens
cgttctaaatatgaa

SEQ ID NO: 586811 - DNA, 13 bp, Homo sapiens
cgtttgcctcctg

SEQ ID NO: 586812 - DNA, 14 bp, Homo sapiens
cgtttgcctcctgg

SEQ ID NO: 586813 - DNA, 14 bp, Homo sapiens
cgtttgtgtttcta

SEQ ID NO: 586814 - DNA, 15 bp, Homo sapiens
cgtttttgtattttc

SEQ ID NO: 586815 - DNA, 16 bp, Homo sapiens
ctaaataaagatattg

SEQ ID NO: 586816 - DNA, 15 bp, Homo sapiens
ctaaatatgaatgaa

SEQ ID NO: 586817 - DNA, 18 bp, Homo sapiens
ctaaatgtgcaatagaag

SEQ ID NO: 586818 - DNA, 23 bp, Homo sapiens
ctaaattatttactgcaaaaaga

SEQ ID NO: 586819 - DNA, 13 bp, Homo sapiens
ctaaatttcacta

SEQ ID NO: 586820 - DNA, 19 bp, Homo sapiens
ctaacccaggtatccaaaa

SEQ ID NO: 586821 - DNA, 16 bp, Homo sapiens
ctaactcaaatacaca

SEQ ID NO: 586822 - DNA, 14 bp, Homo sapiens
ctaagtcccttcct

SEQ ID NO: 586823 - DNA, 21 bp, Homo sapiens
ctacaatctctttttgtttgc

SEQ ID NO: 586824 - DNA, 23 bp, Homo sapiens
ctacactcttgtaataaaatgtc

SEQ ID NO: 586825 - DNA, 13 bp, Homo sapiens
ctacatgtgagtg

SEQ ID NO: 586826 - DNA, 13 bp, Homo sapiens
ctaccccttcctg

SEQ ID NO: 586827 - DNA, 15 bp, Homo sapiens
ctaccccttcctgtc

SEQ ID NO: 586828 - DNA, 16 bp, Homo sapiens
ctaccccttcctgtcc

SEQ ID NO: 586829 - DNA, 17 bp, Homo sapiens
ctaccccttcctgtcct

SEQ ID NO: 586830 - DNA, 11 bp, Homo sapiens
ctacctccctc

SEQ ID NO: 586831 - DNA, 14 bp, Homo sapiens
ctacctgagctaaa

SEQ ID NO: 586832 - DNA, 19 bp, Homo sapiens
ctacctggggactcctcaa

SEQ ID NO: 586833 - DNA, 19 bp, Homo sapiens
ctagatcctgggtttccat

SEQ ID NO: 586834 - DNA, 12 bp, Homo sapiens
ctagattgacta

SEQ ID NO: 586835 - DNA, 20 bp, Homo sapiens
ctagccaaaccaggaccctg

SEQ ID NO: 586836 - DNA, 19 bp, Homo sapiens
ctagcctatgtctggcaga

SEQ ID NO: 586837 - DNA, 22 bp, Homo sapiens
ctagcctatgtctggcagatga

SEQ ID NO: 586838 - DNA, 15 bp, Homo sapiens
ctagctcctcccctt

SEQ ID NO: 586839 - DNA, 19 bp, Homo sapiens
ctagggttaggaggtcctt

SEQ ID NO: 586840 - DNA, 14 bp, Homo sapiens
ctaggttctgtaga

SEQ ID NO: 586841 - DNA, 13 bp, Homo sapiens
ctagtaagaagac

SEQ ID NO: 586842 - DNA, 15 bp, Homo sapiens
ctagtgatggtcaga

SEQ ID NO: 586843 - DNA, 19 bp, Homo sapiens
ctagtggtatggggctgag

SEQ ID NO: 586844 - DNA, 14 bp, Homo sapiens
ctatagtcccagct

SEQ ID NO: 586845 - DNA, 18 bp, Homo sapiens
ctatatcctccttctcct

SEQ ID NO: 586846 - DNA, 20 bp, Homo sapiens
ctcctaagtcccttcctatt

SEQ ID NO: 586847 - DNA, 16 bp, Homo sapiens
ctcctaccccttcctg

SEQ ID NO: 586848 - DNA, 20 bp, Homo sapiens
ctcctaccccttcctgtcct

SEQ ID NO: 586849 - DNA, 21 bp, Homo sapiens
ctcctaccccttcctgtcctg

SEQ ID NO: 586850 - DNA, 13 bp, Homo sapiens
ctcctacctgggg

SEQ ID NO: 586851 - DNA, 20 bp, Homo sapiens
ctcctacctggggactcctc

SEQ ID NO: 586852 - DNA, 21 bp, Homo sapiens
ctcctacctggggactcctca

SEQ ID NO: 586853 - DNA, 17 bp, Homo sapiens
ctcctatatcctccttc

SEQ ID NO: 586854 - DNA, 19 bp, Homo sapiens
ctcctatatcctccttctc

SEQ ID NO: 586855 - DNA, 20 bp, Homo sapiens
ctcctattctataaaactct

SEQ ID NO: 586856 - DNA, 21 bp, Homo sapiens
ctcctcatcagtgtgtaaata

SEQ ID NO: 586857 - DNA, 14 bp, Homo sapiens
ctcctcgagccctc

SEQ ID NO: 586858 - DNA, 19 bp, Homo sapiens
ctcctcgagccctccccca

SEQ ID NO: 586859 - DNA, 22 bp, Homo sapiens
ctcctcgcccccaccagtgtag

SEQ ID NO: 586860 - DNA, 21 bp, Homo sapiens
ctcctggaatcagtatttcct

SEQ ID NO: 586861 - DNA, 13 bp, Homo sapiens
ctcgcccccacca

SEQ ID NO: 586862 - DNA, 22 bp, Homo sapiens
ctcgtcagctgggatgtgaagt

SEQ ID NO: 586863 - DNA, 22 bp, Homo sapiens
ctctaaaaggtaatgtgtggat

SEQ ID NO: 586864 - DNA, 22 bp, Homo sapiens
ctctccactcttctctcctttc

SEQ ID NO: 586865 - DNA, 16 bp, Homo sapiens
ctctcccacttcctcc

SEQ ID NO: 586866 - DNA, 17 bp, Homo sapiens
ctctcccacttcctcct

SEQ ID NO: 586867 - DNA, 21 bp, Homo sapiens
ctctcccacttcctcctacct

SEQ ID NO: 586868 - DNA, 22 bp, Homo sapiens
ctctccttcatgacagcctcca

SEQ ID NO: 586869 - DNA, 14 bp, Homo sapiens
ctctccttgagtgt

SEQ ID NO: 586870 - DNA, 16 bp, Homo sapiens
ctctcctttctccctg

SEQ ID NO: 586871 - DNA, 18 bp, Homo sapiens
ctctcctttctccctgca

SEQ ID NO: 586872 - DNA, 11 bp, Homo sapiens
ctctctgcctc

SEQ ID NO: 586873 - DNA, 12 bp, Homo sapiens
ctctctgcctct

SEQ ID NO: 586874 - DNA, 22 bp, Homo sapiens
ctctctgcctctcttcttcccc

SEQ ID NO: 586875 - DNA, 15 bp, Homo sapiens
ctctgccctgggctc

SEQ ID NO: 586876 - DNA, 16 bp, Homo sapiens
ctctgccctgggctcc

SEQ ID NO: 586877 - DNA, 20 bp, Homo sapiens
ctctgccctgggctcctctt

SEQ ID NO: 586878 - DNA, 15 bp, Homo sapiens
ctctgcctctcttct

SEQ ID NO: 586879 - DNA, 21 bp, Homo sapiens
ctctgtgtaaccagctcagtg

SEQ ID NO: 586880 - DNA, 16 bp, Homo sapiens
ctcttatttatagaat

SEQ ID NO: 586881 - DNA, 20 bp, Homo sapiens
ctcttcctatccctctccta

SEQ ID NO: 586882 - DNA, 15 bp, Homo sapiens
ctcttctctcctcag

SEQ ID NO: 586883 - DNA, 21 bp, Homo sapiens
ctcttctctcctttctccctg

SEQ ID NO: 586884 - DNA, 15 bp, Homo sapiens
ctcttcttcctcacc

SEQ ID NO: 586885 - DNA, 19 bp, Homo sapiens
ctcttgccatcctgatgga

SEQ ID NO: 586886 - DNA, 23 bp, Homo sapiens
ctgaaccaggccagagcaaacag

SEQ ID NO: 586887 - DNA, 14 bp, Homo sapiens
ctgaacccacacct

SEQ ID NO: 586888 - DNA, 15 bp, Homo sapiens
ctgaacccacacctg

SEQ ID NO: 586889 - DNA, 18 bp, Homo sapiens
ctgaacccacacctgggc

SEQ ID NO: 586890 - DNA, 18 bp, Homo sapiens
ctgaagaattgaaaagtt

SEQ ID NO: 586891 - DNA, 20 bp, Homo sapiens
ctgaagagaccactcaatcc

SEQ ID NO: 586892 - DNA, 17 bp, Homo sapiens
ctgaatctgctaccaaa

SEQ ID NO: 586893 - DNA, 20 bp, Homo sapiens
ctgaatttgtatatgactgc

SEQ ID NO: 586894 - DNA, 22 bp, Homo sapiens
ctgaatttgtatatgactgcat

SEQ ID NO: 586895 - DNA, 23 bp, Homo sapiens
ctgacctggcatctaattctgat

SEQ ID NO: 586896 - DNA, 18 bp, Homo sapiens
ctgagcaagaccctgtct

SEQ ID NO: 586897 - DNA, 20 bp, Homo sapiens
ctgagcaagaccctgtctct

SEQ ID NO: 586898 - DNA, 17 bp, Homo sapiens
ctgagcatggagacagc

SEQ ID NO: 586899 - DNA, 18 bp, Homo sapiens
ctgagcatggagacagca

SEQ ID NO: 586900 - DNA, 15 bp, Homo sapiens
ctgagccctcctgag

SEQ ID NO: 586901 - DNA, 17 bp, Homo sapiens
ctgagccctcctgaggg

SEQ ID NO: 586902 - DNA, 14 bp, Homo sapiens
ctgaggactgattt

SEQ ID NO: 586903 - DNA, 22 bp, Homo sapiens
ctgaggactgatttcagagtga

SEQ ID NO: 586904 - DNA, 17 bp, Homo sapiens
ctgataccatatgaatg

SEQ ID NO: 586905 - DNA, 19 bp, Homo sapiens
ctgataccatatgaatgaa

SEQ ID NO: 586906 - DNA, 15 bp, Homo sapiens
ctgatggagccttcc

SEQ ID NO: 586907 - DNA, 15 bp, Homo sapiens
cctagctggctctgt

SEQ ID NO: 586908 - DNA, 16 bp, Homo sapiens
cctagctgtgtgaata

SEQ ID NO: 586909 - DNA, 22 bp, Homo sapiens
cctagctgtgtgaatacctgct

SEQ ID NO: 586910 - DNA, 14 bp, Homo sapiens
cctagtaagaagac

SEQ ID NO: 586911 - DNA, 15 bp, Homo sapiens
cctatagtcccagct

SEQ ID NO: 586912 - DNA, 14 bp, Homo sapiens
cctatccctctcct

SEQ ID NO: 586913 - DNA, 15 bp, Homo sapiens
cctatcctccccttt

SEQ ID NO: 586914 - DNA, 14 bp, Homo sapiens
cctattctcctgcc

SEQ ID NO: 586915 - DNA, 16 bp, Homo sapiens
cctattctcctgccat

SEQ ID NO: 586916 - DNA, 14 bp, Homo sapiens
cctatttttgtgaa

SEQ ID NO: 586917 - DNA, 18 bp, Homo sapiens
cctcaaaccacttgcctg

SEQ ID NO: 586918 - DNA, 21 bp, Homo sapiens
cctcaccgagcatgcttccct

SEQ ID NO: 586919 - DNA, 21 bp, Homo sapiens
cctcagcctgctttcctgcag

SEQ ID NO: 586920 - DNA, 23 bp, Homo sapiens
cctcagcctgctttcctgcagca

SEQ ID NO: 586921 - DNA, 19 bp, Homo sapiens
cctcaggccaagggaccag

SEQ ID NO: 586922 - DNA, 11 bp, Homo sapiens
cctcaggctcc

SEQ ID NO: 586923 - DNA, 13 bp, Homo sapiens
cctcaggctccta

SEQ ID NO: 586924 - DNA, 21 bp, Homo sapiens
cctcagtctggagtgggatag

SEQ ID NO: 586925 - DNA, 14 bp, Homo sapiens
cctcagttctcaaa

SEQ ID NO: 586926 - DNA, 22 bp, Homo sapiens
cctcagttctcaaatgtgtgtg

SEQ ID NO: 586927 - DNA, 13 bp, Homo sapiens
cctccagagaaag

SEQ ID NO: 586928 - DNA, 14 bp, Homo sapiens
cctccagagaaagc

SEQ ID NO: 586929 - DNA, 12 bp, Homo sapiens
cctccagtcaca

SEQ ID NO: 586930 - DNA, 19 bp, Homo sapiens
cctccccttttaccactcc

SEQ ID NO: 586931 - DNA, 15 bp, Homo sapiens
cctcctacctgggga

SEQ ID NO: 586932 - DNA, 20 bp, Homo sapiens
cctcctacctggggactcct

SEQ ID NO: 586933 - DNA, 16 bp, Homo sapiens
cctcctcatcagtgtg

SEQ ID NO: 586934 - DNA, 22 bp, Homo sapiens
cctcctcatcagtgtgtaaata

SEQ ID NO: 586935 - DNA, 20 bp, Homo sapiens
cctcctggaatcagtatttc

SEQ ID NO: 586936 - DNA, 16 bp, Homo sapiens
cctcgcccccaccagt

SEQ ID NO: 586937 - DNA, 13 bp, Homo sapiens
cctcgggcctgct

SEQ ID NO: 586938 - DNA, 15 bp, Homo sapiens
cctctcaccttgtcc

SEQ ID NO: 586939 - DNA, 13 bp, Homo sapiens
cctctccactctt

SEQ ID NO: 586940 - DNA, 20 bp, Homo sapiens
cctctccactcttctctcct

SEQ ID NO: 586941 - DNA, 15 bp, Homo sapiens
cctctcccaggtgtt

SEQ ID NO: 586942 - DNA, 17 bp, Homo sapiens
cctctctgcctctcttc

SEQ ID NO: 586943 - DNA, 19 bp, Homo sapiens
cctctctgcctctcttctt

SEQ ID NO: 586944 - DNA, 19 bp, Homo sapiens
cctctgcacaccctccaga

SEQ ID NO: 586945 - DNA, 15 bp, Homo sapiens
cctctgcccttcctg

SEQ ID NO: 586946 - DNA, 14 bp, Homo sapiens
cctcttgtctgatt

SEQ ID NO: 586947 - DNA, 16 bp, Homo sapiens
cctgacaactcatttt

SEQ ID NO: 586948 - DNA, 19 bp, Homo sapiens
cctgaggcctagactctgt

SEQ ID NO: 586949 - DNA, 21 bp, Homo sapiens
cctgagggccggttctaaggc

SEQ ID NO: 586950 - DNA, 17 bp, Homo sapiens
cctgatggacctgcccc

SEQ ID NO: 586951 - DNA, 19 bp, Homo sapiens
cctgcaaaactccaggcag

SEQ ID NO: 586952 - DNA, 22 bp, Homo sapiens
cctgcagcagtcgcccaagcag

SEQ ID NO: 586953 - DNA, 14 bp, Homo sapiens
cctgcagccttttc

SEQ ID NO: 586954 - DNA, 23 bp, Homo sapiens
cctgcatagccggtgggtgagga

SEQ ID NO: 586955 - DNA, 19 bp, Homo sapiens
cctgccccggacctacctc

SEQ ID NO: 586956 - DNA, 11 bp, Homo sapiens
cctgcctcctc

SEQ ID NO: 586957 - DNA, 14 bp, Homo sapiens
cctgcctcctcatc

SEQ ID NO: 586958 - DNA, 16 bp, Homo sapiens
cctgcctcctcatcag

SEQ ID NO: 586959 - DNA, 12 bp, Homo sapiens
cctgctggtcaa

SEQ ID NO: 586960 - DNA, 18 bp, Homo sapiens
ctggcaaatgcctgactc

SEQ ID NO: 586961 - DNA, 21 bp, Homo sapiens
ctggcatctaattctgattct

SEQ ID NO: 586962 - DNA, 18 bp, Homo sapiens
ctggctcaaagcagcagg

SEQ ID NO: 586963 - DNA, 18 bp, Homo sapiens
ctgggcactggggcctca

SEQ ID NO: 586964 - DNA, 15 bp, Homo sapiens
ctgggcagagggagg

SEQ ID NO: 586965 - DNA, 15 bp, Homo sapiens
ctgggccacctccta

SEQ ID NO: 586966 - DNA, 16 bp, Homo sapiens
ctgggccacctcctac

SEQ ID NO: 586967 - DNA, 20 bp, Homo sapiens
ctgggctgcccacctggctg

SEQ ID NO: 586968 - DNA, 13 bp, Homo sapiens
ctggggacttgtg

SEQ ID NO: 586969 - DNA, 14 bp, Homo sapiens
ctggggcctcagcc

SEQ ID NO: 586970 - DNA, 15 bp, Homo sapiens
ctgggtcccagcctg

SEQ ID NO: 586971 - DNA, 16 bp, Homo sapiens
ctgggtcccagcctgg

SEQ ID NO: 586972 - DNA, 17 bp, Homo sapiens
ctgggttgcctttattt

SEQ ID NO: 586973 - DNA, 21 bp, Homo sapiens
ctggtaataaatgtgactcag

SEQ ID NO: 586974 - DNA, 22 bp, Homo sapiens
ctggtccctcttctctcctcag

SEQ ID NO: 586975 - DNA, 16 bp, Homo sapiens
ctggtgtaatctcaat

SEQ ID NO: 586976 - DNA, 17 bp, Homo sapiens
ctggtgtaatctcaatg

SEQ ID NO: 586977 - DNA, 20 bp, Homo sapiens
ctggtgtaatctcaatgcaa

SEQ ID NO: 586978 - DNA, 13 bp, Homo sapiens
ctggttcctgtgt

SEQ ID NO: 586979 - DNA, 17 bp, Homo sapiens
ctggttgggcagccaga

SEQ ID NO: 586980 - DNA, 22 bp, Homo sapiens
ctggtttgcaaagaccacctcc

SEQ ID NO: 586981 - DNA, 21 bp, Homo sapiens
ctgtaaagatgtttatttcag

SEQ ID NO: 586982 - DNA, 13 bp, Homo sapiens
ctgtacaaaatgg

SEQ ID NO: 586983 - DNA, 14 bp, Homo sapiens
ctgtacaaaatggt

SEQ ID NO: 586984 - DNA, 15 bp, Homo sapiens
ctgtagagccaatta

SEQ ID NO: 586985 - DNA, 16 bp, Homo sapiens
ctgtagagccaattag

SEQ ID NO: 586986 - DNA, 20 bp, Homo sapiens
ctgtagatatgtattctttt

SEQ ID NO: 586987 - DNA, 21 bp, Homo sapiens
ctgtagctattagcggctcct

SEQ ID NO: 586988 - DNA, 22 bp, Homo sapiens
ctgtagctattagcggctcctc

SEQ ID NO: 586989 - DNA, 14 bp, Homo sapiens
ctgtagctgccatg

SEQ ID NO: 586990 - DNA, 20 bp, Homo sapiens
ctgtaggttcatgcccaagc

SEQ ID NO: 586991 - DNA, 16 bp, Homo sapiens
ctgtatcattttcttt

SEQ ID NO: 586992 - DNA, 22 bp, Homo sapiens
ctgtatgggggagattgaactt

SEQ ID NO: 586993 - DNA, 16 bp, Homo sapiens
ctgtcctgcctcctca

SEQ ID NO: 586994 - DNA, 23 bp, Homo sapiens
ctgtgagaacccagtttcccgtc

SEQ ID NO: 586995 - DNA, 17 bp, Homo sapiens
ctgtgagcatggggcca

SEQ ID NO: 586996 - DNA, 18 bp, Homo sapiens
ctgtgagcatggggccag

SEQ ID NO: 586997 - DNA, 21 bp, Homo sapiens
ctgtgagcatggggccaggaa

SEQ ID NO: 586998 - DNA, 16 bp, Homo sapiens
ctgtgagccatgcctc

SEQ ID NO: 586999 - DNA, 18 bp, Homo sapiens
ctgtgagccatgcctccc

SEQ ID NO: 587000 - DNA, 22 bp, Homo sapiens
ctgtgctgaacataacttctca

SEQ ID NO: 587001 - DNA, 17 bp, Homo sapiens
ctgtggcataaattgca

SEQ ID NO: 587002 - DNA, 15 bp, Homo sapiens
ctgtgggctgactgc

SEQ ID NO: 587003 - DNA, 21 bp, Homo sapiens
ctgtgtaaccagctcagtgtt

SEQ ID NO: 587004 - DNA, 18 bp, Homo sapiens
ctgtgtgaatacctgctc

SEQ ID NO: 587005 - DNA, 19 bp, Homo sapiens
ctgtgtgaatacctgctca

SEQ ID NO: 587006 - DNA, 17 bp, Homo sapiens
ctgtgtgaccctgggca

SEQ ID NO: 587007 - DNA, 19 bp, Homo sapiens
ctgtgtttagattgtatta

SEQ ID NO: 587008 - DNA, 22 bp, Homo sapiens
ctgtgttttgaaagaatagaac

SEQ ID NO: 587009 - DNA, 20 bp, Homo sapiens
ctgttatcagtaatgctaaa

SEQ ID NO: 587010 - DNA, 12 bp, Homo sapiens
ctgttgaacttt

SEQ ID NO: 587011 - DNA, 12 bp, Homo sapiens
ctgttgcacttt

SEQ ID NO: 587012 - DNA, 23 bp, Homo sapiens
ctgttggaatggatttttcttta

SEQ ID NO: 587013 - DNA, 14 bp, Homo sapiens
cttaaactaaatgt

SEQ ID NO: 587014 - DNA, 18 bp, Homo sapiens
cttaatggagttcttgtg

SEQ ID NO: 587015 - DNA, 18 bp, Homo sapiens
cttaccccaaagagaaag

SEQ ID NO: 587016 - DNA, 18 bp, Homo sapiens
cttagctcagctgagcat

SEQ ID NO: 587017 - DNA, 15 bp, Homo sapiens
cttagctgaggctga

SEQ ID NO: 587018 - DNA, 21 bp, Homo sapiens
cttagctgaggctgagaaagc

SEQ ID NO: 587019 - DNA, 16 bp, Homo sapiens
cttatagtctaagact

SEQ ID NO: 587020 - DNA, 13 bp, Homo sapiens
cttatccaacttt

SEQ ID NO: 587021 - DNA, 20 bp, Homo sapiens
cttatcttacaatattgatt

SEQ ID NO: 587022 - DNA, 18 bp, Homo sapiens
cttcaaggacattggtga

SEQ ID NO: 587023 - DNA, 16 bp, Homo sapiens
cttcaaggctcttctt

SEQ ID NO: 587024 - DNA, 19 bp, Homo sapiens
cttcaaggctcttcttcct

SEQ ID NO: 587025 - DNA, 10 bp, Homo sapiens
cttcagaggc

SEQ ID NO: 587026 - DNA, 18 bp, Homo sapiens
atacatgtgatacatttt

SEQ ID NO: 587027 - DNA, 16 bp, Homo sapiens
atacattttttaagct

SEQ ID NO: 587028 - DNA, 13 bp, Homo sapiens
ataccacatcaaa

SEQ ID NO: 587029 - DNA, 15 bp, Homo sapiens
ataccatatgaatga

SEQ ID NO: 587030 - DNA, 16 bp, Homo sapiens
ataccatatgaatgaa

SEQ ID NO: 587031 - DNA, 22 bp, Homo sapiens
atacgcatcccatctctcccac

SEQ ID NO: 587032 - DNA, 20 bp, Homo sapiens
atactaagatgttcactgtg

SEQ ID NO: 587033 - DNA, 22 bp, Homo sapiens
atactgccaaaacatttatgac

SEQ ID NO: 587034 - DNA, 23 bp, Homo sapiens
atactgccaaaacatttatgaca

SEQ ID NO: 587035 - DNA, 18 bp, Homo sapiens
atactgcttaattgctga

SEQ ID NO: 587036 - DNA, 18 bp, Homo sapiens
atacttatttgtatatgg

SEQ ID NO: 587037 - DNA, 20 bp, Homo sapiens
atagacttggagaatactgc

SEQ ID NO: 587038 - DNA, 19 bp, Homo sapiens
atagcagccagttcaaaaa

SEQ ID NO: 587039 - DNA, 14 bp, Homo sapiens
atagctttagtgaa

SEQ ID NO: 587040 - DNA, 22 bp, Homo sapiens
ataggccacagaaggtgaactt

SEQ ID NO: 587041 - DNA, 22 bp, Homo sapiens
atagggaaaattctaacccagg

SEQ ID NO: 587042 - DNA, 20 bp, Homo sapiens
atagggtctaccaatacaaa

SEQ ID NO: 587043 - DNA, 13 bp, Homo sapiens
atagtaagcatag

SEQ ID NO: 587044 - DNA, 18 bp, Homo sapiens
atagtctaagactatata

SEQ ID NO: 587045 - DNA, 13 bp, Homo sapiens
atagtgtgaggga

SEQ ID NO: 587046 - DNA, 18 bp, Homo sapiens
atataaatgtataaatat

SEQ ID NO: 587047 - DNA, 13 bp, Homo sapiens
atataatttaaag

SEQ ID NO: 587048 - DNA, 16 bp, Homo sapiens
atatataaatgtataa

SEQ ID NO: 587049 - DNA, 16 bp, Homo sapiens
atatattttgtgtgaa

SEQ ID NO: 587050 - DNA, 18 bp, Homo sapiens
atatcctccttctcctgt

SEQ ID NO: 587051 - DNA, 20 bp, Homo sapiens
atatcctccttctcctgttc

SEQ ID NO: 587052 - DNA, 13 bp, Homo sapiens
atatgaatgaaac

SEQ ID NO: 587053 - DNA, 16 bp, Homo sapiens
atatgactgcatttgt

SEQ ID NO: 587054 - DNA, 14 bp, Homo sapiens
atatgtattctttt

SEQ ID NO: 587055 - DNA, 18 bp, Homo sapiens
atatgtattcttttctca

SEQ ID NO: 587056 - DNA, 19 bp, Homo sapiens
atatgtattttttgaatct

SEQ ID NO: 587057 - DNA, 16 bp, Homo sapiens
atattacccaatggaa

SEQ ID NO: 587058 - DNA, 17 bp, Homo sapiens
atattactgacatttct

SEQ ID NO: 587059 - DNA, 19 bp, Homo sapiens
atattcagggtaaatagga

SEQ ID NO: 587060 - DNA, 21 bp, Homo sapiens
atattgattgggaaaacattt

SEQ ID NO: 587061 - DNA, 22 bp, Homo sapiens
atattgcaaggtgtgatggtct

SEQ ID NO: 587062 - DNA, 23 bp, Homo sapiens
atattgtaatctatgtttataat

SEQ ID NO: 587063 - DNA, 14 bp, Homo sapiens
atattgtttggtaa

SEQ ID NO: 587064 - DNA, 16 bp, Homo sapiens
atattgtttggtaaat

SEQ ID NO: 587065 - DNA, 18 bp, Homo sapiens
atattttgtgtgaaattg

SEQ ID NO: 587066 - DNA, 15 bp, Homo sapiens
atatttttttaactg

SEQ ID NO: 587067 - DNA, 16 bp, Homo sapiens
atatttttttaactgt

SEQ ID NO: 587068 - DNA, 12 bp, Homo sapiens
atcaaagatgaa

SEQ ID NO: 587069 - DNA, 23 bp, Homo sapiens
atcaaagccggcctgagaaacac

SEQ ID NO: 587070 - DNA, 15 bp, Homo sapiens
atcaaataagaaata

SEQ ID NO: 587071 - DNA, 14 bp, Homo sapiens
atcacaaagtggaa

SEQ ID NO: 587072 - DNA, 17 bp, Homo sapiens
atcactgccttcgttta

SEQ ID NO: 587073 - DNA, 14 bp, Homo sapiens
atcagacagcagga

SEQ ID NO: 587074 - DNA, 19 bp, Homo sapiens
atcagggcctttctcctcc

SEQ ID NO: 587075 - DNA, 19 bp, Homo sapiens
atcagtaacccccttaaat

SEQ ID NO: 587076 - DNA, 22 bp, Homo sapiens
atcagtaacccccttaaattta

SEQ ID NO: 587077 - DNA, 16 bp, Homo sapiens
atcagtatttccttcc

SEQ ID NO: 587078 - DNA, 17 bp, Homo sapiens
atcagtatttccttcca

SEQ ID NO: 587079 - DNA, 18 bp, Homo sapiens
atcagtatttccttccac

SEQ ID NO: 587080 - DNA, 15 bp, Homo sapiens
atcagtgtgtaaata

SEQ ID NO: 587081 - DNA, 17 bp, Homo sapiens
atcagtgtgtaaataat

SEQ ID NO: 587082 - DNA, 21 bp, Homo sapiens
atcatctcttcctcacaccca

SEQ ID NO: 587083 - DNA, 12 bp, Homo sapiens
atcattcagaaa

SEQ ID NO: 587084 - DNA, 16 bp, Homo sapiens
atcattcagaaatgtt

SEQ ID NO: 587085 - DNA, 16 bp, Homo sapiens
atccaactttttcata

SEQ ID NO: 587086 - DNA, 22 bp, Homo sapiens
atccacagccttgcagcggctc

SEQ ID NO: 587087 - DNA, 16 bp, Homo sapiens
atccatttccattgct

SEQ ID NO: 587088 - DNA, 13 bp, Homo sapiens
atcccatctctcc

SEQ ID NO: 587089 - DNA, 22 bp, Homo sapiens
atcccatctctcccacttcctc

SEQ ID NO: 587090 - DNA, 22 bp, Homo sapiens
atccccacaggcacattaactg

SEQ ID NO: 587091 - DNA, 13 bp, Homo sapiens
atcccctaaaata

SEQ ID NO: 587092 - DNA, 13 bp, Homo sapiens
atccctctccact

SEQ ID NO: 587093 - DNA, 15 bp, Homo sapiens
atccctgaggactga

SEQ ID NO: 587094 - DNA, 18 bp, Homo sapiens
atccctgaggactgattt

SEQ ID NO: 587095 - DNA, 17 bp, Homo sapiens
atcctcagttctcaaat

SEQ ID NO: 587096 - DNA, 21 bp, Homo sapiens
atccttgagattctgaagtat

SEQ ID NO: 587097 - DNA, 15 bp, Homo sapiens
atcgtttttgtattt

SEQ ID NO: 587098 - DNA, 13 bp, Homo sapiens
atctaattctgat

SEQ ID NO: 587099 - DNA, 14 bp, Homo sapiens
atctacaatctctt

SEQ ID NO: 587100 - DNA, 23 bp, Homo sapiens
atctacaatctctttttgtttgc

SEQ ID NO: 587101 - DNA, 19 bp, Homo sapiens
atctacttctgtaattgtg

SEQ ID NO: 587102 - DNA, 15 bp, Homo sapiens
atctatccacactgt

SEQ ID NO: 587103 - DNA, 16 bp, Homo sapiens
atctatctagttctaa

SEQ ID NO: 587104 - DNA, 14 bp, Homo sapiens
atctcaatgcaagc

SEQ ID NO: 587105 - DNA, 16 bp, Homo sapiens
atctcagtggtgtgtg

SEQ ID NO: 587106 - DNA, 20 bp, Homo sapiens
atctcagtggtgtgtgaagt

SEQ ID NO: 587107 - DNA, 20 bp, Homo sapiens
atctccacaggagagactgg

SEQ ID NO: 587108 - DNA, 16 bp, Homo sapiens
atctccatggggaggc

SEQ ID NO: 587109 - DNA, 15 bp, Homo sapiens
atctctcccacttcc

SEQ ID NO: 587110 - DNA, 17 bp, Homo sapiens
atctctcccacttcctc

SEQ ID NO: 587111 - DNA, 18 bp, Homo sapiens
atctctcccacttcctcc

SEQ ID NO: 587112 - DNA, 19 bp, Homo sapiens
atctctcccacttcctcct

SEQ ID NO: 587113 - DNA, 16 bp, Homo sapiens
atctctttttgtttgc

SEQ ID NO: 587114 - DNA, 21 bp, Homo sapiens
atctgaccctatgggtctagg

SEQ ID NO: 587115 - DNA, 21 bp, Homo sapiens
atctggctgcagttttgctat

SEQ ID NO: 587116 - DNA, 17 bp, Homo sapiens
atctgggctgtgggcaa

SEQ ID NO: 587117 - DNA, 16 bp, Homo sapiens
atctgtacaaaatggt

SEQ ID NO: 587118 - DNA, 22 bp, Homo sapiens
atcttctttggacttctgaaga

SEQ ID NO: 587119 - DNA, 20 bp, Homo sapiens
atctttatatttcaataaat

SEQ ID NO: 587120 - DNA, 17 bp, Homo sapiens
atctttcagaaatataa

SEQ ID NO: 587121 - DNA, 10 bp, Homo sapiens
atctttgctg

SEQ ID NO: 587122 - DNA, 16 bp, Homo sapiens
atctttgctgtatact

SEQ ID NO: 587123 - DNA, 18 bp, Homo sapiens
atcttttttagtgttaaa

SEQ ID NO: 587124 - DNA, 21 bp, Homo sapiens
atcttttttagtgttaaagag

SEQ ID NO: 587125 - DNA, 14 bp, Homo sapiens
atgaaaataccatt

SEQ ID NO: 587126 - DNA, 15 bp, Homo sapiens
atgaaacatcatttc

SEQ ID NO: 587127 - DNA, 16 bp, Homo sapiens
atgaaagctgttcctt

SEQ ID NO: 587128 - DNA, 14 bp, Homo sapiens
atgaacctgaaaag

SEQ ID NO: 587129 - DNA, 19 bp, Homo sapiens
atgaagatctttatatttc

SEQ ID NO: 587130 - DNA, 20 bp, Homo sapiens
atgaagtctgagggaaacca

SEQ ID NO: 587131 - DNA, 16 bp, Homo sapiens
atgacaagctgtatca

SEQ ID NO: 587132 - DNA, 16 bp, Homo sapiens
atgacactgtttcctg

SEQ ID NO: 587133 - DNA, 17 bp, Homo sapiens
atgacactgtttcctga

SEQ ID NO: 587134 - DNA, 17 bp, Homo sapiens
atgcccccattctccca

SEQ ID NO: 587135 - DNA, 20 bp, Homo sapiens
atgcccccattctcccagtc

SEQ ID NO: 587136 - DNA, 23 bp, Homo sapiens
atgcccccattctcccagtctct

SEQ ID NO: 587137 - DNA, 16 bp, Homo sapiens
atgcctatggtggatc

SEQ ID NO: 587138 - DNA, 21 bp, Homo sapiens
atgcctccctgggccacctcc

SEQ ID NO: 587139 - DNA, 17 bp, Homo sapiens
atgcgtttgcctcctgg

SEQ ID NO: 587140 - DNA, 12 bp, Homo sapiens
atgctggctggg

SEQ ID NO: 587141 - DNA, 17 bp, Homo sapiens
atgcttgcataagagct

SEQ ID NO: 587142 - DNA, 18 bp, Homo sapiens
atgcttgcataagagctt

SEQ ID NO: 587143 - DNA, 18 bp, Homo sapiens
atgctttattaatgtttt

SEQ ID NO: 587144 - DNA, 19 bp, Homo sapiens
atggcagcctactctcctt

SEQ ID NO: 587145 - DNA, 17 bp, Homo sapiens
atggcaggacagctcct

SEQ ID NO: 587146 - DNA, 24 bp, Homo sapiens
atggcagggggtggaattattact

SEQ ID NO: 587147 - DNA, 19 bp, Homo sapiens
atgggaggtatgggctggg

SEQ ID NO: 587148 - DNA, 20 bp, Homo sapiens
atgggaggtatgggctgggg

SEQ ID NO: 587149 - DNA, 23 bp, Homo sapiens
atgggatattttgaaatgaactt

SEQ ID NO: 587150 - DNA, 15 bp, Homo sapiens
atgggattagaaaca

SEQ ID NO: 587151 - DNA, 17 bp, Homo sapiens
atgggattagaaacaaa

SEQ ID NO: 587152 - DNA, 13 bp, Homo sapiens
atgggctgggggc

SEQ ID NO: 587153 - DNA, 20 bp, Homo sapiens
atgggctgggggctatgtat

SEQ ID NO: 587154 - DNA, 13 bp, Homo sapiens
atgggctgtgatt

SEQ ID NO: 587155 - DNA, 20 bp, Homo sapiens
atgggctgtgattactgcaa

SEQ ID NO: 587156 - DNA, 21 bp, Homo sapiens
atgggctgtgattactgcaat

SEQ ID NO: 587157 - DNA, 18 bp, Homo sapiens
atgggggagattgaactt

SEQ ID NO: 587158 - DNA, 13 bp, Homo sapiens
atgggtcccctcc

SEQ ID NO: 587159 - DNA, 23 bp, Homo sapiens
atgggtgccctttcctggcagtc

SEQ ID NO: 587160 - DNA, 21 bp, Homo sapiens
atggtaattcacttcagttta

SEQ ID NO: 587161 - DNA, 18 bp, Homo sapiens
atggtgtcattctgcctg

SEQ ID NO: 587162 - DNA, 17 bp, Homo sapiens
atggtgtggtgaatgtg

SEQ ID NO: 587163 - DNA, 14 bp, Homo sapiens
atgtaaataactct

SEQ ID NO: 587164 - DNA, 23 bp, Homo sapiens
atgtaacatgatttccctccaga

SEQ ID NO: 587165 - DNA, 12 bp, Homo sapiens
atgtaatttaaa

SEQ ID NO: 587166 - DNA, 16 bp, Homo sapiens
atgtaatttaaatgaa

SEQ ID NO: 587167 - DNA, 20 bp, Homo sapiens
atgtaatttaaatgaaagaa

SEQ ID NO: 587168 - DNA, 19 bp, Homo sapiens
atgtacttccctcttgaaa

SEQ ID NO: 587169 - DNA, 16 bp, Homo sapiens
atgtataaatatacag

SEQ ID NO: 587170 - DNA, 17 bp, Homo sapiens
atgtataaatatacagt

SEQ ID NO: 587171 - DNA, 17 bp, Homo sapiens
atgtatatatgtatttc

SEQ ID NO: 587172 - DNA, 18 bp, Homo sapiens
atgtattttttgaatcta

SEQ ID NO: 587173 - DNA, 19 bp, Homo sapiens
atgtctcctttgctcttgc

SEQ ID NO: 587174 - DNA, 21 bp, Homo sapiens
atgtctggcagatgagggctg

SEQ ID NO: 587175 - DNA, 22 bp, Homo sapiens
atgtctggctcaaagcagcagg

SEQ ID NO: 587176 - DNA, 21 bp, Homo sapiens
atgtgatacattttttaagct

SEQ ID NO: 587177 - DNA, 22 bp, Homo sapiens
atgtgatacattttttaagctt

SEQ ID NO: 587178 - DNA, 17 bp, Homo sapiens
atgtgctatacacacac

SEQ ID NO: 587179 - DNA, 18 bp, Homo sapiens
atgtgctatacacacaca

SEQ ID NO: 587180 - DNA, 19 bp, Homo sapiens
atgtggtctgccaatctgt

SEQ ID NO: 587181 - DNA, 21 bp, Homo sapiens
atgtggtctgccaatctgtac

SEQ ID NO: 587182 - DNA, 22 bp, Homo sapiens
atgtggtctgccaatctgtaca

SEQ ID NO: 587183 - DNA, 18 bp, Homo sapiens
atgtgtaataatgtaaca

SEQ ID NO: 587184 - DNA, 16 bp, Homo sapiens
atgttaaagagaatga

SEQ ID NO: 587185 - DNA, 22 bp, Homo sapiens
atgttatactgaaccaggccag

SEQ ID NO: 587186 - DNA, 14 bp, Homo sapiens
atgttgtaaataaa

SEQ ID NO: 587187 - DNA, 14 bp, Homo sapiens
atgtttatttcagg

SEQ ID NO: 587188 - DNA, 12 bp, Homo sapiens
atgtttctggat

SEQ ID NO: 587189 - DNA, 16 bp, Homo sapiens
atgttttcaaaaggta

SEQ ID NO: 587190 - DNA, 18 bp, Homo sapiens
attaaaaaacaattaact

SEQ ID NO: 587191 - DNA, 18 bp, Homo sapiens
attaaaaacgaaaacctg

SEQ ID NO: 587192 - DNA, 22 bp, Homo sapiens
attaaaaacgaaaacctgacta

SEQ ID NO: 587193 - DNA, 17 bp, Homo sapiens
attaaaactaaatttca

SEQ ID NO: 587194 - DNA, 14 bp, Homo sapiens
attaactatcttct

SEQ ID NO: 587195 - DNA, 22 bp, Homo sapiens
attaactatcttctttggactt

SEQ ID NO: 587196 - DNA, 16 bp, Homo sapiens
attaactgttgcactt

SEQ ID NO: 587197 - DNA, 21 bp, Homo sapiens
attaactgttgcacttttgaa

SEQ ID NO: 587198 - DNA, 17 bp, Homo sapiens
attaagcaaatgttaaa

SEQ ID NO: 587199 - DNA, 21 bp, Homo sapiens
attacagaggtattaaaacta

SEQ ID NO: 587200 - DNA, 14 bp, Homo sapiens
attacctgtggata

SEQ ID NO: 587201 - DNA, 13 bp, Homo sapiens
attactgcaatca

SEQ ID NO: 587202 - DNA, 15 bp, Homo sapiens
attactgcaatcact

SEQ ID NO: 587203 - DNA, 21 bp, Homo sapiens
attactgcaatcactgtgcta

SEQ ID NO: 587204 - DNA, 12 bp, Homo sapiens
attagacttgaa

SEQ ID NO: 587205 - DNA, 15 bp, Homo sapiens
attagcggctcctcg

SEQ ID NO: 587206 - DNA, 15 bp, Homo sapiens
attataaatgacaac

SEQ ID NO: 587207 - DNA, 21 bp, Homo sapiens
attataataggaacaatcttt

SEQ ID NO: 587208 - DNA, 21 bp, Homo sapiens
attatacatgtgatacatttt

SEQ ID NO: 587209 - DNA, 22 bp, Homo sapiens
attatacatgtgatacattttt

SEQ ID NO: 587210 - DNA, 23 bp, Homo sapiens
attatgagattggttttcctgtg

SEQ ID NO: 587211 - DNA, 18 bp, Homo sapiens
attatgcaattcagtgtt

SEQ ID NO: 587212 - DNA, 14 bp, Homo sapiens
attatttttataat

SEQ ID NO: 587213 - DNA, 17 bp, Homo sapiens
attatttttttaaaatt

SEQ ID NO: 587214 - DNA, 20 bp, Homo sapiens
attatttttttaaaattttg

SEQ ID NO: 587215 - DNA, 14 bp, Homo sapiens
attcaactttgtaa

SEQ ID NO: 587216 - DNA, 22 bp, Homo sapiens
cagcctagcctatgtctggcag

SEQ ID NO: 587217 - DNA, 21 bp, Homo sapiens
cagcctgctttcctgcagcag

SEQ ID NO: 587218 - DNA, 16 bp, Homo sapiens
cagcctggttggcagc

SEQ ID NO: 587219 - DNA, 24 bp, Homo sapiens
cagcctggtttgcaaagaccacct

SEQ ID NO: 587220 - DNA, 23 bp, Homo sapiens
cagccttttctggtccctcttct

SEQ ID NO: 587221 - DNA, 18 bp, Homo sapiens
cagcgacctctctgcctc

SEQ ID NO: 587222 - DNA, 21 bp, Homo sapiens
cagcgacctctctgcctctct

SEQ ID NO: 587223 - DNA, 16 bp, Homo sapiens
cagcgtggctctaaaa

SEQ ID NO: 587224 - DNA, 13 bp, Homo sapiens
cagctcagtgttt

SEQ ID NO: 587225 - DNA, 15 bp, Homo sapiens
cagctcctggaccag

SEQ ID NO: 587226 - DNA, 20 bp, Homo sapiens
cagctgagcatggagacagc

SEQ ID NO: 587227 - DNA, 23 bp, Homo sapiens
cagctgagcatggagacagcagt

SEQ ID NO: 587228 - DNA, 21 bp, Homo sapiens
cagctgtgagccatgcctccc

SEQ ID NO: 587229 - DNA, 22 bp, Homo sapiens
cagctgtgagccatgcctccct

SEQ ID NO: 587230 - DNA, 19 bp, Homo sapiens
caggaacggtggaggcaga

SEQ ID NO: 587231 - DNA, 24 bp, Homo sapiens
caggaacggtggaggcagaggtga

SEQ ID NO: 587232 - DNA, 20 bp, Homo sapiens
caggaagcctactatttaaa

SEQ ID NO: 587233 - DNA, 18 bp, Homo sapiens
caggacagctcctggacc

SEQ ID NO: 587234 - DNA, 20 bp, Homo sapiens
caggatactggcacagaggt

SEQ ID NO: 587235 - DNA, 17 bp, Homo sapiens
caggcacattaactgtt

SEQ ID NO: 587236 - DNA, 20 bp, Homo sapiens
caggcaccaggactagggct

SEQ ID NO: 587237 - DNA, 16 bp, Homo sapiens
caggccaagggaccag

SEQ ID NO: 587238 - DNA, 21 bp, Homo sapiens
caggccagagcaaacagaaaa

SEQ ID NO: 587239 - DNA, 14 bp, Homo sapiens
cagggacagggccc

SEQ ID NO: 587240 - DNA, 16 bp, Homo sapiens
cagggacagggccctg

SEQ ID NO: 587241 - DNA, 20 bp, Homo sapiens
cagggacagggccctggagc

SEQ ID NO: 587242 - DNA, 21 bp, Homo sapiens
cagggcaaaagggcagctgtg

SEQ ID NO: 587243 - DNA, 17 bp, Homo sapiens
cagggcctttctcctcc

SEQ ID NO: 587244 - DNA, 18 bp, Homo sapiens
cagggcctttctcctccc

SEQ ID NO: 587245 - DNA, 20 bp, Homo sapiens
cagggctaaataaagaggag

SEQ ID NO: 587246 - DNA, 20 bp, Homo sapiens
caggggccaacctcaggctc

SEQ ID NO: 587247 - DNA, 14 bp, Homo sapiens
caggtaaaacaggg

SEQ ID NO: 587248 - DNA, 18 bp, Homo sapiens
caggtgtttgtggggctg

SEQ ID NO: 587249 - DNA, 15 bp, Homo sapiens
caggtttgcaggagc

SEQ ID NO: 587250 - DNA, 12 bp, Homo sapiens
gaaccaggccag

SEQ ID NO: 587251 - DNA, 21 bp, Homo sapiens
gaacctacagttttaactgtg

SEQ ID NO: 587252 - DNA, 14 bp, Homo sapiens
gaacgctctcctcg

SEQ ID NO: 587253 - DNA, 15 bp, Homo sapiens
gaacggaggaggaca

SEQ ID NO: 587254 - DNA, 16 bp, Homo sapiens
gaactttgtcagtgtt

SEQ ID NO: 587255 - DNA, 12 bp, Homo sapiens
gaagaaaatttg

SEQ ID NO: 587256 - DNA, 19 bp, Homo sapiens
gaagaaaatttgccaatct

SEQ ID NO: 587257 - DNA, 17 bp, Homo sapiens
gaagaattgaaaagttt

SEQ ID NO: 587258 - DNA, 18 bp, Homo sapiens
gaagaattgaaaagtttt

SEQ ID NO: 587259 - DNA, 21 bp, Homo sapiens
gaagaattgaaaagtttttgt

SEQ ID NO: 587260 - DNA, 15 bp, Homo sapiens
gaagacttcccagct

SEQ ID NO: 587261 - DNA, 15 bp, Homo sapiens
gaagagacagcccag

SEQ ID NO: 587262 - DNA, 22 bp, Homo sapiens
gaagagagttctggatgtctgg

SEQ ID NO: 587263 - DNA, 18 bp, Homo sapiens
gaagagggaaaacagaaa

SEQ ID NO: 587264 - DNA, 16 bp, Homo sapiens
gaagagtctggaggga

SEQ ID NO: 587265 - DNA, 17 bp, Homo sapiens
gaagatctttatatttc

SEQ ID NO: 587266 - DNA, 19 bp, Homo sapiens
gaagccatagatgctggct

SEQ ID NO: 587267 - DNA, 18 bp, Homo sapiens
gaaggatgggtcccctcc

SEQ ID NO: 587268 - DNA, 19 bp, Homo sapiens
gaaggtgaactttgtgctt

SEQ ID NO: 587269 - DNA, 20 bp, Homo sapiens
gaagtcagaatttttaactg

SEQ ID NO: 587270 - DNA, 22 bp, Homo sapiens
gaagtcagaatttttaactgta

SEQ ID NO: 587271 - DNA, 17 bp, Homo sapiens
gaagtttggagatagat

SEQ ID NO: 587272 - DNA, 17 bp, Homo sapiens
gaatcagtatttccttc

SEQ ID NO: 587273 - DNA, 19 bp, Homo sapiens
gaatcagtatttccttcca

SEQ ID NO: 587274 - DNA, 16 bp, Homo sapiens
gaatgaggaaaattct

SEQ ID NO: 587275 - DNA, 19 bp, Homo sapiens
gaatgccatctatctagtt

SEQ ID NO: 587276 - DNA, 15 bp, Homo sapiens
gaatgtccaaaattt

SEQ ID NO: 587277 - DNA, 20 bp, Homo sapiens
gaatgtccaaaatttatatt

SEQ ID NO: 587278 - DNA, 22 bp, Homo sapiens
gaattgaatcgctgcgatactg

SEQ ID NO: 587279 - DNA, 19 bp, Homo sapiens
gaatttgaagctgcagtga

SEQ ID NO: 587280 - DNA, 22 bp, Homo sapiens
gaatttgtatatgactgcattt

SEQ ID NO: 587281 - DNA, 15 bp, Homo sapiens
gaatttttaactgta

SEQ ID NO: 587282 - DNA, 21 bp, Homo sapiens
gacagcccaggatactggcac

SEQ ID NO: 587283 - DNA, 22 bp, Homo sapiens
gacagcccaggatactggcaca

SEQ ID NO: 587284 - DNA, 16 bp, Homo sapiens
gacagctcctggacca

SEQ ID NO: 587285 - DNA, 21 bp, Homo sapiens
gacagctcctggaccaggccc

SEQ ID NO: 587286 - DNA, 16 bp, Homo sapiens
gacagggccctggagc

SEQ ID NO: 587287 - DNA, 16 bp, Homo sapiens
gacagtgcctatactg

SEQ ID NO: 587288 - DNA, 20 bp, Homo sapiens
gacagtgttccccgatacca

SEQ ID NO: 587289 - DNA, 21 bp, Homo sapiens
gacagtgttccccgataccat

SEQ ID NO: 587290 - DNA, 20 bp, Homo sapiens
gacagttcccagagtgggct

SEQ ID NO: 587291 - DNA, 14 bp, Homo sapiens
gacatttatattaa

SEQ ID NO: 587292 - DNA, 16 bp, Homo sapiens
gaccagaaatcaaaaa

SEQ ID NO: 587293 - DNA, 17 bp, Homo sapiens
gaccagcaggctggcct

SEQ ID NO: 587294 - DNA, 18 bp, Homo sapiens
gaccaggtttgcaggagc

SEQ ID NO: 587295 - DNA, 15 bp, Homo sapiens
gaccagtgcctgtga

SEQ ID NO: 587296 - DNA, 20 bp, Homo sapiens
gaccatcctggccaacatga

SEQ ID NO: 587297 - DNA, 20 bp, Homo sapiens
gaccattttttaatttactt

SEQ ID NO: 587298 - DNA, 12 bp, Homo sapiens
gacccagagctg

SEQ ID NO: 587299 - DNA, 13 bp, Homo sapiens
gacccctgtctcc

SEQ ID NO: 587300 - DNA, 20 bp, Homo sapiens
gaccccttgttgcactgccc

SEQ ID NO: 587301 - DNA, 21 bp, Homo sapiens
gaccccttgttgcactgcccc

SEQ ID NO: 587302 - DNA, 22 bp, Homo sapiens
gaccccttgttgcactgccccc

SEQ ID NO: 587303 - DNA, 23 bp, Homo sapiens
gaccccttgttgcactgccccct

SEQ ID NO: 587304 - DNA, 19 bp, Homo sapiens
gaccctgaacccacacctg

SEQ ID NO: 587305 - DNA, 20 bp, Homo sapiens
gacccttctgggtccaggga

SEQ ID NO: 587306 - DNA, 13 bp, Homo sapiens
gacccttttaagc

SEQ ID NO: 587307 - DNA, 12 bp, Homo sapiens
gacctacctccc

SEQ ID NO: 587308 - DNA, 22 bp, Homo sapiens
gacctacctccctccctctccg

SEQ ID NO: 587309 - DNA, 15 bp, Homo sapiens
gacctctctgcctct

SEQ ID NO: 587310 - DNA, 17 bp, Homo sapiens
gacctctctgcctctct

SEQ ID NO: 587311 - DNA, 19 bp, Homo sapiens
gacctctctgcctctcttc

SEQ ID NO: 587312 - DNA, 21 bp, Homo sapiens
gacctgccccggacctacctc

SEQ ID NO: 587313 - DNA, 19 bp, Homo sapiens
gacgtttataaacagaaat

SEQ ID NO: 587314 - DNA, 18 bp, Homo sapiens
gactaaatgatctctgaa

SEQ ID NO: 587315 - DNA, 21 bp, Homo sapiens
gactacctactggtgtaatct

SEQ ID NO: 587316 - DNA, 22 bp, Homo sapiens
gactacctactggtgtaatctc

SEQ ID NO: 587317 - DNA, 18 bp, Homo sapiens
gactcagtgaccagtgcc

SEQ ID NO: 587318 - DNA, 18 bp, Homo sapiens
gactcctcaaaccacttg

SEQ ID NO: 587319 - DNA, 21 bp, Homo sapiens
gactcctcaaaccacttgcct

SEQ ID NO: 587320 - DNA, 22 bp, Homo sapiens
gactcctcaaaccacttgcctg

SEQ ID NO: 587321 - DNA, 14 bp, Homo sapiens
gactcctgtggaga

SEQ ID NO: 587322 - DNA, 16 bp, Homo sapiens
gactctgtctcaaaaa

SEQ ID NO: 587323 - DNA, 18 bp, Homo sapiens
gactgagcaagaccctgt

SEQ ID NO: 587324 - DNA, 21 bp, Homo sapiens
gactgagcaagaccctgtctc

SEQ ID NO: 587325 - DNA, 13 bp, Homo sapiens
gacttcccagctt

SEQ ID NO: 587326 - DNA, 13 bp, Homo sapiens
gacttgaaagaaa

SEQ ID NO: 587327 - DNA, 21 bp, Homo sapiens
gacttgaaatacgtttgtgtt

SEQ ID NO: 587328 - DNA, 18 bp, Homo sapiens
gacttggagaatactgcc

SEQ ID NO: 587329 - DNA, 20 bp, Homo sapiens
gacttggagaatactgccaa

SEQ ID NO: 587330 - DNA, 21 bp, Homo sapiens
gagaaacactatttgtgactt

SEQ ID NO: 587331 - DNA, 23 bp, Homo sapiens
gagaatgagtccttgatttcaaa

SEQ ID NO: 587332 - DNA, 22 bp, Homo sapiens
gagacagcagtttccagagagt

SEQ ID NO: 587333 - DNA, 13 bp, Homo sapiens
gagacagcccagg

SEQ ID NO: 587334 - DNA, 19 bp, Homo sapiens
gagaccccttgttgcactg

SEQ ID NO: 587335 - DNA, 13 bp, Homo sapiens
gagagagcagggc

SEQ ID NO: 587336 - DNA, 14 bp, Homo sapiens
gagagagcagggct

SEQ ID NO: 587337 - DNA, 14 bp, Homo sapiens
gagagccctgaggc

SEQ ID NO: 587338 - DNA, 19 bp, Homo sapiens
gagagccctgaggcctaga

SEQ ID NO: 587339 - DNA, 13 bp, Homo sapiens
gagagtggagaga

SEQ ID NO: 587340 - DNA, 21 bp, Homo sapiens
gagagttctggatgtctggct

SEQ ID NO: 587341 - DNA, 17 bp, Homo sapiens
gagataaggtggcttct

SEQ ID NO: 587342 - DNA, 14 bp, Homo sapiens
gagatcaaagatga

SEQ ID NO: 587343 - DNA, 15 bp, Homo sapiens
gagcaaacagaaaaa

SEQ ID NO: 587344 - DNA, 14 bp, Homo sapiens
gagcaggacctggg

SEQ ID NO: 587345 - DNA, 22 bp, Homo sapiens
gagcaggacctgggacaggaaa

SEQ ID NO: 587346 - DNA, 16 bp, Homo sapiens
gagcatggagacagca

SEQ ID NO: 587347 - DNA, 17 bp, Homo sapiens
gagcatggagacagcag

SEQ ID NO: 587348 - DNA, 15 bp, Homo sapiens
gagccaattagactt

SEQ ID NO: 587349 - DNA, 18 bp, Homo sapiens
gagccaattagacttgaa

SEQ ID NO: 587350 - DNA, 17 bp, Homo sapiens
gagccatgcctccctgg

SEQ ID NO: 587351 - DNA, 22 bp, Homo sapiens
gagcccccctagtggtatgggg

SEQ ID NO: 587352 - DNA, 12 bp, Homo sapiens
gagccctcctga

SEQ ID NO: 587353 - DNA, 19 bp, Homo sapiens
gagccgagatcacgccact

SEQ ID NO: 587354 - DNA, 19 bp, Homo sapiens
gagcgagagatcaaagatg

SEQ ID NO: 587355 - DNA, 21 bp, Homo sapiens
gagcgcacagggagtgcacat

SEQ ID NO: 587356 - DNA, 15 bp, Homo sapiens
gagctctgaaatctt

SEQ ID NO: 587357 - DNA, 19 bp, Homo sapiens
gagctctgaaatcttccca

SEQ ID NO: 587358 - DNA, 12 bp, Homo sapiens
gagctcttccta

SEQ ID NO: 587359 - DNA, 21 bp, Homo sapiens
gagcttaatgctacatgtgag

SEQ ID NO: 587360 - DNA, 15 bp, Homo sapiens
cttgttgcactgccc

SEQ ID NO: 587361 - DNA, 15 bp, Homo sapiens
cttgtttacctttct

SEQ ID NO: 587362 - DNA, 21 bp, Homo sapiens
ctttaactgccgtaatttaac

SEQ ID NO: 587363 - DNA, 17 bp, Homo sapiens
ctttaagccttcaaaac

SEQ ID NO: 587364 - DNA, 18 bp, Homo sapiens
ctttaagtgtgctgggca

SEQ ID NO: 587365 - DNA, 13 bp, Homo sapiens
ctttataaatgta

SEQ ID NO: 587366 - DNA, 11 bp, Homo sapiens
ctttatatttc

SEQ ID NO: 587367 - DNA, 14 bp, Homo sapiens
ctttattaatgttt

SEQ ID NO: 587368 - DNA, 19 bp, Homo sapiens
ctttattaatgttttcaaa

SEQ ID NO: 587369 - DNA, 16 bp, Homo sapiens
ctttattgcaatgcag

SEQ ID NO: 587370 - DNA, 23 bp, Homo sapiens
ctttcagaaatataacacatttt

SEQ ID NO: 587371 - DNA, 22 bp, Homo sapiens
ctttcatggctgctgttgctta

SEQ ID NO: 587372 - DNA, 15 bp, Homo sapiens
ctttcctactttcta

SEQ ID NO: 587373 - DNA, 16 bp, Homo sapiens
ctttcctactttctat

SEQ ID NO: 587374 - DNA, 13 bp, Homo sapiens
ctttcctggcagt

SEQ ID NO: 587375 - DNA, 14 bp, Homo sapiens
ctttcctggcagtc

SEQ ID NO: 587376 - DNA, 17 bp, Homo sapiens
ctttctcctccccacct

SEQ ID NO: 587377 - DNA, 23 bp, Homo sapiens
ctttctcctccccacctgtagct

SEQ ID NO: 587378 - DNA, 19 bp, Homo sapiens
ctttgcattttgatattgc

SEQ ID NO: 587379 - DNA, 13 bp, Homo sapiens
ctttgctcttgcc

SEQ ID NO: 587380 - DNA, 14 bp, Homo sapiens
ctttgctgagagct

SEQ ID NO: 587381 - DNA, 22 bp, Homo sapiens
ctttggaacagggttggcattc

SEQ ID NO: 587382 - DNA, 17 bp, Homo sapiens
ctttggaagatgcagaa

SEQ ID NO: 587383 - DNA, 16 bp, Homo sapiens
ctttggacttctgaag

SEQ ID NO: 587384 - DNA, 14 bp, Homo sapiens
ctttggattctaaa

SEQ ID NO: 587385 - DNA, 18 bp, Homo sapiens
ctttggattctaaataca

SEQ ID NO: 587386 - DNA, 20 bp, Homo sapiens
ctttggattctaaatacatg

SEQ ID NO: 587387 - DNA, 21 bp, Homo sapiens
ctttggattctaaatacatgc

SEQ ID NO: 587388 - DNA, 14 bp, Homo sapiens
ctttgggaaaacat

SEQ ID NO: 587389 - DNA, 16 bp, Homo sapiens
ctttgtaaaaatcttt

SEQ ID NO: 587390 - DNA, 13 bp, Homo sapiens
ctttgtcagtgtt

SEQ ID NO: 587391 - DNA, 22 bp, Homo sapiens
ctttgtctaagtagggccaggg

SEQ ID NO: 587392 - DNA, 22 bp, Homo sapiens
cttttaaaaaatactctgctat

SEQ ID NO: 587393 - DNA, 23 bp, Homo sapiens
cttttaagcatgtgatgttgtct

SEQ ID NO: 587394 - DNA, 14 bp, Homo sapiens
cttttaccactccc

SEQ ID NO: 587395 - DNA, 15 bp, Homo sapiens
cttttaccactccca

SEQ ID NO: 587396 - DNA, 20 bp, Homo sapiens
cttttaccttttttttttct

SEQ ID NO: 587397 - DNA, 21 bp, Homo sapiens
cttttaccttttttttttctt

SEQ ID NO: 587398 - DNA, 13 bp, Homo sapiens
cttttataaagca

SEQ ID NO: 587399 - DNA, 14 bp, Homo sapiens
cttttataaagcat

SEQ ID NO: 587400 - DNA, 17 bp, Homo sapiens
cttttcaatgtctaaaa

SEQ ID NO: 587401 - DNA, 20 bp, Homo sapiens
cttttcaatgtctaaaaaca

SEQ ID NO: 587402 - DNA, 18 bp, Homo sapiens
cttttctggtccctcttc

SEQ ID NO: 587403 - DNA, 16 bp, Homo sapiens
cttttgaatgtccaaa

SEQ ID NO: 587404 - DNA, 19 bp, Homo sapiens
cttttgaatgtccaaaatt

SEQ ID NO: 587405 - DNA, 12 bp, Homo sapiens
cttttgtttggt

SEQ ID NO: 587406 - DNA, 17 bp, Homo sapiens
ctttttcccaataaatt

SEQ ID NO: 587407 - DNA, 16 bp, Homo sapiens
gaaaaaaaacagtgga

SEQ ID NO: 587408 - DNA, 18 bp, Homo sapiens
gaaaaaaagctgcaaaaa

SEQ ID NO: 587409 - DNA, 16 bp, Homo sapiens
gaaaaatataaaatta

SEQ ID NO: 587410 - DNA, 17 bp, Homo sapiens
gaaaaatataaaattat

SEQ ID NO: 587411 - DNA, 13 bp, Homo sapiens
gaaaacagaaaac

SEQ ID NO: 587412 - DNA, 20 bp, Homo sapiens
gaaaagtatattgataacct

SEQ ID NO: 587413 - DNA, 14 bp, Homo sapiens
gaaacaaacaaaac

SEQ ID NO: 587414 - DNA, 15 bp, Homo sapiens
gaaacaaataatttg

SEQ ID NO: 587415 - DNA, 20 bp, Homo sapiens
gaaacaaataatttgaactt

SEQ ID NO: 587416 - DNA, 21 bp, Homo sapiens
gaaacaaataatttgaacttt

SEQ ID NO: 587417 - DNA, 17 bp, Homo sapiens
gaaacactatttgtgac

SEQ ID NO: 587418 - DNA, 18 bp, Homo sapiens
gaaacatgggctgtgatt

SEQ ID NO: 587419 - DNA, 15 bp, Homo sapiens
gaaacctgatgtcag

SEQ ID NO: 587420 - DNA, 22 bp, Homo sapiens
gaaagtgggcttaatggagttc

SEQ ID NO: 587421 - DNA, 13 bp, Homo sapiens
gaaataataaaaa

SEQ ID NO: 587422 - DNA, 21 bp, Homo sapiens
gaaataatgctacaattttaa

SEQ ID NO: 587423 - DNA, 21 bp, Homo sapiens
gaaataatgggattagaaaca

SEQ ID NO: 587424 - DNA, 16 bp, Homo sapiens
gaaatacgtttgtgtt

SEQ ID NO: 587425 - DNA, 18 bp, Homo sapiens
gaaatgcccccattctcc

SEQ ID NO: 587426 - DNA, 16 bp, Homo sapiens
gaaattacctgtggat

SEQ ID NO: 587427 - DNA, 16 bp, Homo sapiens
gaaattgcatactttg

SEQ ID NO: 587428 - DNA, 19 bp, Homo sapiens
gaacagctgtgagccatgc

SEQ ID NO: 587429 - DNA, 22 bp, Homo sapiens
gaaccagcagaaatgcccccat

SEQ ID NO: 587430 - DNA, 21 bp, Homo sapiens
gagtttgacagtttttgacat

SEQ ID NO: 587431 - DNA, 16 bp, Homo sapiens
gataaccttgaaaaaa

SEQ ID NO: 587432 - DNA, 22 bp, Homo sapiens
gataatattgtttggtaaatgt

SEQ ID NO: 587433 - DNA, 13 bp, Homo sapiens
gatacagagccac

SEQ ID NO: 587434 - DNA, 18 bp, Homo sapiens
gataccatatgaatgaaa

SEQ ID NO: 587435 - DNA, 13 bp, Homo sapiens
gatactaaggacg

SEQ ID NO: 587436 - DNA, 14 bp, Homo sapiens
gatacttacatgtt

SEQ ID NO: 587437 - DNA, 17 bp, Homo sapiens
gatagtgggatttccag

SEQ ID NO: 587438 - DNA, 19 bp, Homo sapiens
gatagtgggatttccagaa

SEQ ID NO: 587439 - DNA, 13 bp, Homo sapiens
gatatttgcacta

SEQ ID NO: 587440 - DNA, 12 bp, Homo sapiens
gatcaaagatga

SEQ ID NO: 587441 - DNA, 16 bp, Homo sapiens
gatcaaattctacaac

SEQ ID NO: 587442 - DNA, 14 bp, Homo sapiens
gatcagcaaaaaga

SEQ ID NO: 587443 - DNA, 18 bp, Homo sapiens
gatcagcaaaaagactgg

SEQ ID NO: 587444 - DNA, 17 bp, Homo sapiens
gatccatttccattgct

SEQ ID NO: 587445 - DNA, 15 bp, Homo sapiens
gatcctgggtttcca

SEQ ID NO: 587446 - DNA, 15 bp, Homo sapiens
gatcgcatttcctaa

SEQ ID NO: 587447 - DNA, 16 bp, Homo sapiens
gatctcataatgcttt

SEQ ID NO: 587448 - DNA, 13 bp, Homo sapiens
gatctggctgcag

SEQ ID NO: 587449 - DNA, 18 bp, Homo sapiens
gatctttcagaaatataa

SEQ ID NO: 587450 - DNA, 21 bp, Homo sapiens
gatgaaaagtatattgataac

SEQ ID NO: 587451 - DNA, 23 bp, Homo sapiens
gatgaaaagtatattgataacct

SEQ ID NO: 587452 - DNA, 14 bp, Homo sapiens
gatgaaacttctca

SEQ ID NO: 587453 - DNA, 18 bp, Homo sapiens
gatgaggacccagagctg

SEQ ID NO: 587454 - DNA, 20 bp, Homo sapiens
gatgaggacccagagctgct

SEQ ID NO: 587455 - DNA, 18 bp, Homo sapiens
gatgcatcatctcttcct

SEQ ID NO: 587456 - DNA, 19 bp, Homo sapiens
gatgcatcatctcttcctc

SEQ ID NO: 587457 - DNA, 14 bp, Homo sapiens
gatgctttggaaga

SEQ ID NO: 587458 - DNA, 24 bp, Homo sapiens
gatggacctgccccggacctacct

SEQ ID NO: 587459 - DNA, 19 bp, Homo sapiens
gatgggaggtatgggctgg

SEQ ID NO: 587460 - DNA, 20 bp, Homo sapiens
gatgggaggtatgggctggg

SEQ ID NO: 587461 - DNA, 18 bp, Homo sapiens
gatgggtcccctccgcca

SEQ ID NO: 587462 - DNA, 22 bp, Homo sapiens
gatgggtgccctttcctggcag

SEQ ID NO: 587463 - DNA, 23 bp, Homo sapiens
gatgggtgccctttcctggcagt

SEQ ID NO: 587464 - DNA, 18 bp, Homo sapiens
gatgtccttaaaatgtgg

SEQ ID NO: 587465 - DNA, 19 bp, Homo sapiens
gatgtccttaaaatgtggt

SEQ ID NO: 587466 - DNA, 15 bp, Homo sapiens
gatgttgtaaataaa

SEQ ID NO: 587467 - DNA, 15 bp, Homo sapiens
gattagaaattacct

SEQ ID NO: 587468 - DNA, 22 bp, Homo sapiens
gattagaaattacctgtggata

SEQ ID NO: 587469 - DNA, 14 bp, Homo sapiens
gattctaaatacat

SEQ ID NO: 587470 - DNA, 16 bp, Homo sapiens
gattctggctttaagc

SEQ ID NO: 587471 - DNA, 14 bp, Homo sapiens
gattgcctctgaaa

SEQ ID NO: 587472 - DNA, 18 bp, Homo sapiens
gatttaaaagcctgctca

SEQ ID NO: 587473 - DNA, 19 bp, Homo sapiens
gatttccctccagagaaag

SEQ ID NO: 587474 - DNA, 15 bp, Homo sapiens
gatttctcattgact

SEQ ID NO: 587475 - DNA, 19 bp, Homo sapiens
gatttggcactagccaaag

SEQ ID NO: 587476 - DNA, 13 bp, Homo sapiens
gatttttctttaa

SEQ ID NO: 587477 - DNA, 18 bp, Homo sapiens
gcaaaactccaggcagga

SEQ ID NO: 587478 - DNA, 13 bp, Homo sapiens
gcaaacagaaaaa

SEQ ID NO: 587479 - DNA, 14 bp, Homo sapiens
gcaaacagaaaaag

SEQ ID NO: 587480 - DNA, 15 bp, Homo sapiens
gcaaagaccacctcc

SEQ ID NO: 587481 - DNA, 21 bp, Homo sapiens
gcaaagtctccagaagaaaat

SEQ ID NO: 587482 - DNA, 16 bp, Homo sapiens
gcaaatgagctctgaa

SEQ ID NO: 587483 - DNA, 16 bp, Homo sapiens
gcaagaccctgtctct

SEQ ID NO: 587484 - DNA, 19 bp, Homo sapiens
gcaagcctaagggatcctg

SEQ ID NO: 587485 - DNA, 17 bp, Homo sapiens
gcaaggtgtgatggtct

SEQ ID NO: 587486 - DNA, 15 bp, Homo sapiens
gcaataataaagtac

SEQ ID NO: 587487 - DNA, 13 bp, Homo sapiens
gcaattcagtgtt

SEQ ID NO: 587488 - DNA, 20 bp, Homo sapiens
gcacaagatgccccagggat

SEQ ID NO: 587489 - DNA, 11 bp, Homo sapiens
gcacaataaat

SEQ ID NO: 587490 - DNA, 17 bp, Homo sapiens
gcacagccaaatttaaa

SEQ ID NO: 587491 - DNA, 17 bp, Homo sapiens
gcacagggagtgcacat

SEQ ID NO: 587492 - DNA, 22 bp, Homo sapiens
gcacagggagtgcacatatcca

SEQ ID NO: 587493 - DNA, 13 bp, Homo sapiens
gcaccgtattcct

SEQ ID NO: 587494 - DNA, 13 bp, Homo sapiens
gcactcagaaaat

SEQ ID NO: 587495 - DNA, 14 bp, Homo sapiens
gcactcagaaaatg

SEQ ID NO: 587496 - DNA, 12 bp, Homo sapiens
gcactgccccct

SEQ ID NO: 587497 - DNA, 18 bp, Homo sapiens
gcacttattgaccatttt

SEQ ID NO: 587498 - DNA, 19 bp, Homo sapiens
gcacttattgaccattttt

SEQ ID NO: 587499 - DNA, 15 bp, Homo sapiens
gcagaagcaataata

SEQ ID NO: 587500 - DNA, 17 bp, Homo sapiens
gcagaagcaataataaa

SEQ ID NO: 587501 - DNA, 20 bp, Homo sapiens
gcagagcttgtggtggggca

SEQ ID NO: 587502 - DNA, 19 bp, Homo sapiens
gcagagttttcattaaatc

SEQ ID NO: 587503 - DNA, 18 bp, Homo sapiens
gcagatgatgctttggaa

SEQ ID NO: 587504 - DNA, 13 bp, Homo sapiens
gcagccagttcaa

SEQ ID NO: 587505 - DNA, 14 bp, Homo sapiens
gcagccccaggaga

SEQ ID NO: 587506 - DNA, 21 bp, Homo sapiens
gcagccttttctggtccctct

SEQ ID NO: 587507 - DNA, 13 bp, Homo sapiens
gcagcggctcctg

SEQ ID NO: 587508 - DNA, 14 bp, Homo sapiens
gcaggacagctcct

SEQ ID NO: 587509 - DNA, 14 bp, Homo sapiens
gcaggagcccccct

SEQ ID NO: 587510 - DNA, 17 bp, Homo sapiens
gcagggctaaataaaga

SEQ ID NO: 587511 - DNA, 19 bp, Homo sapiens
gcagtcgcccaagcagaca

SEQ ID NO: 587512 - DNA, 23 bp, Homo sapiens
gcagtcgtggggaacggaggagg

SEQ ID NO: 587513 - DNA, 22 bp, Homo sapiens
gcagtttccagtcctaacaaat

SEQ ID NO: 587514 - DNA, 22 bp, Homo sapiens
gcatcagggcctttctcctccc

SEQ ID NO: 587515 - DNA, 16 bp, Homo sapiens
gcatcatctcttcctc

SEQ ID NO: 587516 - DNA, 13 bp, Homo sapiens
gcatcttcctctg

SEQ ID NO: 587517 - DNA, 18 bp, Homo sapiens
gcatgcaaatgagctctg

SEQ ID NO: 587518 - DNA, 14 bp, Homo sapiens
gcatgcacagctgt

SEQ ID NO: 587519 - DNA, 14 bp, Homo sapiens
gcatgcagctttgc

SEQ ID NO: 587520 - DNA, 16 bp, Homo sapiens
gcatggagacagcagt

SEQ ID NO: 587521 - DNA, 20 bp, Homo sapiens
gcatgtagaggcttgtttac

SEQ ID NO: 587522 - DNA, 13 bp, Homo sapiens
gcattctgtttat

SEQ ID NO: 587523 - DNA, 13 bp, Homo sapiens
gcattctttgcaa

SEQ ID NO: 587524 - DNA, 16 bp, Homo sapiens
gcattctttgcaatac

SEQ ID NO: 587525 - DNA, 17 bp, Homo sapiens
gcattgagtattgttta

SEQ ID NO: 587526 - DNA, 13 bp, Homo sapiens
gcatttaataaag

SEQ ID NO: 587527 - DNA, 20 bp, Homo sapiens
gcatttaataaagatgagtt

SEQ ID NO: 587528 - DNA, 20 bp, Homo sapiens
gtgggatttccagaaccaca

SEQ ID NO: 587529 - DNA, 17 bp, Homo sapiens
gtggggaacggaggagg

SEQ ID NO: 587530 - DNA, 18 bp, Homo sapiens
gtggtgatttgaaaaata

SEQ ID NO: 587531 - DNA, 20 bp, Homo sapiens
gtggtgtcccctatcctccc

SEQ ID NO: 587532 - DNA, 14 bp, Homo sapiens
gtggtgtgtgaagt

SEQ ID NO: 587533 - DNA, 19 bp, Homo sapiens
gtgtaaataatttgcactg

SEQ ID NO: 587534 - DNA, 17 bp, Homo sapiens
gtgtaaatgaagatctt

SEQ ID NO: 587535 - DNA, 18 bp, Homo sapiens
gtgtaaatgaagatcttt

SEQ ID NO: 587536 - DNA, 19 bp, Homo sapiens
gtgtaataatgtaacatga

SEQ ID NO: 587537 - DNA, 14 bp, Homo sapiens
tcatattgtaatct

SEQ ID NO: 587538 - DNA, 21 bp, Homo sapiens
tcatcactttgacctaaatta

SEQ ID NO: 587539 - DNA, 18 bp, Homo sapiens
tcatcagtgtgtaaataa

SEQ ID NO: 587540 - DNA, 12 bp, Homo sapiens
tcatgaaaatac

SEQ ID NO: 587541 - DNA, 16 bp, Homo sapiens
tcatgaaaataccatt

SEQ ID NO: 587542 - DNA, 23 bp, Homo sapiens
tcatgattagaaattacctgtgg

SEQ ID NO: 587543 - DNA, 18 bp, Homo sapiens
tcatgcatagtcccagct

SEQ ID NO: 587544 - DNA, 15 bp, Homo sapiens
tcatgcctgatgaaa

SEQ ID NO: 587545 - DNA, 21 bp, Homo sapiens
tcatgcctgatgaaagctttg

SEQ ID NO: 587546 - DNA, 23 bp, Homo sapiens
tcatgtatattacccaatggaaa

SEQ ID NO: 587547 - DNA, 21 bp, Homo sapiens
tcatgtccaaacgtcctcttt

SEQ ID NO: 587548 - DNA, 17 bp, Homo sapiens
tcatgtttttgttttaa

SEQ ID NO: 587549 - DNA, 16 bp, Homo sapiens
tcattagtcctttgtc

SEQ ID NO: 587550 - DNA, 14 bp, Homo sapiens
tcattctgcctgct

SEQ ID NO: 587551 - DNA, 16 bp, Homo sapiens
tcattgacttttataa

SEQ ID NO: 587552 - DNA, 17 bp, Homo sapiens
tcattgcacataagctt

SEQ ID NO: 587553 - DNA, 18 bp, Homo sapiens
tcatttcaatcgtaaaat

SEQ ID NO: 587554 - DNA, 17 bp, Homo sapiens
tccaaaaatgtgtaaga

SEQ ID NO: 587555 - DNA, 21 bp, Homo sapiens
tccaaaaatgtgtaagaacaa

SEQ ID NO: 587556 - DNA, 21 bp, Homo sapiens
tccaaacagacaaaacagata

SEQ ID NO: 587557 - DNA, 17 bp, Homo sapiens
tccaacagacacaattt

SEQ ID NO: 587558 - DNA, 20 bp, Homo sapiens
tccaacccaacccaatccct

SEQ ID NO: 587559 - DNA, 23 bp, Homo sapiens
tccaacccaacccaatccctctc

SEQ ID NO: 587560 - DNA, 17 bp, Homo sapiens
tccaagtctctgtgtaa

SEQ ID NO: 587561 - DNA, 14 bp, Homo sapiens
tccacactgtcaaa

SEQ ID NO: 587562 - DNA, 15 bp, Homo sapiens
ggtctggttcctgtg

SEQ ID NO: 587563 - DNA, 16 bp, Homo sapiens
ggtctggttcctgtgt

SEQ ID NO: 587564 - DNA, 12 bp, Homo sapiens
ggtctgtttgca

SEQ ID NO: 587565 - DNA, 14 bp, Homo sapiens
ggtgccctttcctg

SEQ ID NO: 587566 - DNA, 17 bp, Homo sapiens
ggtgctttgcattttga

SEQ ID NO: 587567 - DNA, 19 bp, Homo sapiens
aacttcagcattgtaatta

SEQ ID NO: 587568 - DNA, 23 bp, Homo sapiens
aacttcagcattgtaattatgta

SEQ ID NO: 587569 - DNA, 19 bp, Homo sapiens
aacttctgcaacaagcatg

SEQ ID NO: 587570 - DNA, 12 bp, Homo sapiens
aactttgggaaa

SEQ ID NO: 587571 - DNA, 22 bp, Homo sapiens
aactttgggaaaacatgttaat

SEQ ID NO: 587572 - DNA, 14 bp, Homo sapiens
aagaaaattgagtt

SEQ ID NO: 587573 - DNA, 18 bp, Homo sapiens
aagaaaatttgccaatct

SEQ ID NO: 587574 - DNA, 12 bp, Homo sapiens
aagaaacactga

SEQ ID NO: 587575 - DNA, 13 bp, Homo sapiens
aagaaagcttcct

SEQ ID NO: 587576 - DNA, 12 bp, Homo sapiens
aagaaatagaat

SEQ ID NO: 587577 - DNA, 14 bp, Homo sapiens
aagaacaacggcaa

SEQ ID NO: 587578 - DNA, 17 bp, Homo sapiens
aagaagttcatgtccaa

SEQ ID NO: 587579 - DNA, 19 bp, Homo sapiens
aagaattctgattgatttg

SEQ ID NO: 587580 - DNA, 19 bp, Homo sapiens
aagaattgaaaagtttttg

SEQ ID NO: 587581 - DNA, 12 bp, Homo sapiens
aagaccagcctg

SEQ ID NO: 587582 - DNA, 23 bp, Homo sapiens
aagacccggttattcgcccaccc

SEQ ID NO: 587583 - DNA, 20 bp, Homo sapiens
aagactatatatataaatgt

SEQ ID NO: 587584 - DNA, 21 bp, Homo sapiens
aagactatatatataaatgta

SEQ ID NO: 587585 - DNA, 22 bp, Homo sapiens
aagactatatatataaatgtat

SEQ ID NO: 587586 - DNA, 19 bp, Homo sapiens
aagactgagccagattggc

SEQ ID NO: 587587 - DNA, 19 bp, Homo sapiens
aagactggatttgcagaag

SEQ ID NO: 587588 - DNA, 17 bp, Homo sapiens
aagactgtagatatgta

SEQ ID NO: 587589 - DNA, 14 bp, Homo sapiens
aagacttcccagct

SEQ ID NO: 587590 - DNA, 18 bp, Homo sapiens
aagagaaagagtttgaaa

SEQ ID NO: 587591 - DNA, 11 bp, Homo sapiens
aagagaatgag

SEQ ID NO: 587592 - DNA, 16 bp, Homo sapiens
aaagtgtgtatatatt

SEQ ID NO: 587593 - DNA, 12 bp, Homo sapiens
aaagttttgttg

SEQ ID NO: 587594 - DNA, 12 bp, Homo sapiens
aaataaagagga

SEQ ID NO: 587595 - DNA, 14 bp, Homo sapiens
aaataagaaataat

SEQ ID NO: 587596 - DNA, 16 bp, Homo sapiens
aaataagaaataatgc

SEQ ID NO: 587597 - DNA, 13 bp, Homo sapiens
aaataatgctaca

SEQ ID NO: 587598 - DNA, 12 bp, Homo sapiens
aaatacacattt

SEQ ID NO: 587599 - DNA, 13 bp, Homo sapiens
aaatacacatttg

SEQ ID NO: 587600 - DNA, 14 bp, Homo sapiens
aaatacacatttgc

SEQ ID NO: 587601 - DNA, 22 bp, Homo sapiens
aaatacacatttgctactgttg

SEQ ID NO: 587602 - DNA, 19 bp, Homo sapiens
aaatacatgccacatcaaa

SEQ ID NO: 587603 - DNA, 23 bp, Homo sapiens
aaatacatgccacatcaaacctt

SEQ ID NO: 587604 - DNA, 12 bp, Homo sapiens
aaataccattta

SEQ ID NO: 587605 - DNA, 22 bp, Homo sapiens
aaataccatttagtaagaatac

SEQ ID NO: 587606 - DNA, 19 bp, Homo sapiens
aaatacgtttgtgtttcta

SEQ ID NO: 587607 - DNA, 20 bp, Homo sapiens
aaatagtttgaattcagtaa

SEQ ID NO: 587608 - DNA, 18 bp, Homo sapiens
aaatataaaattatgaga

SEQ ID NO: 587609 - DNA, 17 bp, Homo sapiens
aaatatattttcagtac

SEQ ID NO: 587610 - DNA, 15 bp, Homo sapiens
aaatcttttgaagca

SEQ ID NO: 587611 - DNA, 17 bp, Homo sapiens
aaatgaagatctttata

SEQ ID NO: 587612 - DNA, 19 bp, Homo sapiens
aaatgaagatctttatatt

SEQ ID NO: 587613 - DNA, 15 bp, Homo sapiens
aaatgagctctgaaa

SEQ ID NO: 587614 - DNA, 18 bp, Homo sapiens
aaatgcccccattctccc

SEQ ID NO: 587615 - DNA, 15 bp, Homo sapiens
aaatgtataaatata

SEQ ID NO: 587616 - DNA, 17 bp, Homo sapiens
aaatgtataaatataca

SEQ ID NO: 587617 - DNA, 24 bp, Homo sapiens
aaatgtgactcagcatcacccacc

SEQ ID NO: 587618 - DNA, 14 bp, Homo sapiens
aaatgtggtctgcc

SEQ ID NO: 587619 - DNA, 16 bp, Homo sapiens
aaatgttaaaagtttt

SEQ ID NO: 587620 - DNA, 18 bp, Homo sapiens
aaatgttaaaagttttat

SEQ ID NO: 587621 - DNA, 19 bp, Homo sapiens
aaatgttaaaagttttata

SEQ ID NO: 587622 - DNA, 10 bp, Homo sapiens
aaatgtttct

SEQ ID NO: 587623 - DNA, 11 bp, Homo sapiens
aaattcctgta

SEQ ID NO: 587624 - DNA, 12 bp, Homo sapiens
aaattgcatact

SEQ ID NO: 587625 - DNA, 13 bp, Homo sapiens
aaatttaaaaaat

SEQ ID NO: 587626 - DNA, 16 bp, Homo sapiens
aaatttgataatgaca

SEQ ID NO: 587627 - DNA, 17 bp, Homo sapiens
aaatttgccaatctttc

SEQ ID NO: 587628 - DNA, 15 bp, Homo sapiens
aacaaacaaaactct

SEQ ID NO: 587629 - DNA, 12 bp, Homo sapiens
aacaaagtaaaa

SEQ ID NO: 587630 - DNA, 20 bp, Homo sapiens
aacaaataatttgaactttg

SEQ ID NO: 587631 - DNA, 14 bp, Homo sapiens
aacaatctttgctg

SEQ ID NO: 587632 - DNA, 18 bp, Homo sapiens
aacaatggtgtggtgaat

SEQ ID NO: 587633 - DNA, 21 bp, Homo sapiens
aacacacaggtgcaacagact

SEQ ID NO: 587634 - DNA, 20 bp, Homo sapiens
aacacatttttttgcatgca

SEQ ID NO: 587635 - DNA, 21 bp, Homo sapiens
aacagctgtgagccatgcctc

SEQ ID NO: 587636 - DNA, 14 bp, Homo sapiens
aacagtggatcaca

SEQ ID NO: 587637 - DNA, 23 bp, Homo sapiens
aacatctccatggggaggcctca

SEQ ID NO: 587638 - DNA, 22 bp, Homo sapiens
aacatgatccccgtctctgccc

SEQ ID NO: 587639 - DNA, 17 bp, Homo sapiens
aacatgggctgtgatta

SEQ ID NO: 587640 - DNA, 20 bp, Homo sapiens
aacatgttcccaaggcccca

SEQ ID NO: 587641 - DNA, 21 bp, Homo sapiens
aacattttaagttttactgat

SEQ ID NO: 587642 - DNA, 22 bp, Homo sapiens
aaccacgcaggaagcctactat

SEQ ID NO: 587643 - DNA, 12 bp, Homo sapiens
aaccactagaaa

SEQ ID NO: 587644 - DNA, 12 bp, Homo sapiens
aaccacttgcct

SEQ ID NO: 587645 - DNA, 13 bp, Homo sapiens
aaccacttgcctg

SEQ ID NO: 587646 - DNA, 17 bp, Homo sapiens
aaccacttgcctggggc

SEQ ID NO: 587647 - DNA, 15 bp, Homo sapiens
aaccacttttcaatg

SEQ ID NO: 587648 - DNA, 16 bp, Homo sapiens
aaccagctcagtgttt

SEQ ID NO: 587649 - DNA, 21 bp, Homo sapiens
aaccaggccagagcaaacaga

SEQ ID NO: 587650 - DNA, 14 bp, Homo sapiens
aaccataaattcaa

SEQ ID NO: 587651 - DNA, 12 bp, Homo sapiens
aaccatttttga

SEQ ID NO: 587652 - DNA, 16 bp, Homo sapiens
aacccaatccctctcc

SEQ ID NO: 587653 - DNA, 17 bp, Homo sapiens
aacccaatccctctcca

SEQ ID NO: 587654 - DNA, 14 bp, Homo sapiens
aacccacacctggg

SEQ ID NO: 587655 - DNA, 15 bp, Homo sapiens
aaccctcttgccatc

SEQ ID NO: 587656 - DNA, 16 bp, Homo sapiens
aaccctcttgccatcc

SEQ ID NO: 587657 - DNA, 16 bp, Homo sapiens
aacctcgggcctgctg

SEQ ID NO: 587658 - DNA, 22 bp, Homo sapiens
aacctctttgcgtttccttttt

SEQ ID NO: 587659 - DNA, 21 bp, Homo sapiens
aacctgatgctggggacacag

SEQ ID NO: 587660 - DNA, 22 bp, Homo sapiens
aacctgctttcaagacccctgt

SEQ ID NO: 587661 - DNA, 17 bp, Homo sapiens
aaccttgaaaaaaaaca

SEQ ID NO: 587662 - DNA, 14 bp, Homo sapiens
aacgaaaacctgac

SEQ ID NO: 587663 - DNA, 17 bp, Homo sapiens
aacgaaaacctgactag

SEQ ID NO: 587664 - DNA, 23 bp, Homo sapiens
aacgaagagttcccttgaaactt

SEQ ID NO: 587665 - DNA, 20 bp, Homo sapiens
aacgctctaggtacgatgac

SEQ ID NO: 587666 - DNA, 13 bp, Homo sapiens
aactaaatttcac

SEQ ID NO: 587667 - DNA, 18 bp, Homo sapiens
aactcattttcatattgt

SEQ ID NO: 587668 - DNA, 22 bp, Homo sapiens
aactgcttcccttactttgctg

SEQ ID NO: 587669 - DNA, 11 bp, Homo sapiens
aactgtggata

SEQ ID NO: 587670 - DNA, 18 bp, Homo sapiens
aactgttgcacttttgaa

SEQ ID NO: 587671 - DNA, 22 bp, Homo sapiens
aactgttgcacttttgaatgtc

SEQ ID NO: 587672 - DNA, 15 bp, Homo sapiens
aacttatccatcttt

SEQ ID NO: 587673 - DNA, 16 bp, Homo sapiens
aacttcagcattgtaa

SEQ ID NO: 587674 - DNA, 13 bp, Homo sapiens
aaaaaaaagcttc

SEQ ID NO: 587675 - DNA, 18 bp, Homo sapiens
aaaaaaacagtggatcac

SEQ ID NO: 587676 - DNA, 12 bp, Homo sapiens
aaaaaaagctgc

SEQ ID NO: 587677 - DNA, 20 bp, Homo sapiens
aaaaagctgcaaaaattata

SEQ ID NO: 587678 - DNA, 17 bp, Homo sapiens
aaaaattatatattgca

SEQ ID NO: 587679 - DNA, 11 bp, Homo sapiens
aaaacagaaaa

SEQ ID NO: 587680 - DNA, 15 bp, Homo sapiens
aaaacagataaacaa

SEQ ID NO: 587681 - DNA, 18 bp, Homo sapiens
aaaacagggccacataga

SEQ ID NO: 587682 - DNA, 23 bp, Homo sapiens
aaaacagggccacatagatgctg

SEQ ID NO: 587683 - DNA, 18 bp, Homo sapiens
aaaactcttaagtcctaa

SEQ ID NO: 587684 - DNA, 21 bp, Homo sapiens
aaaagactggatttgcagaag

SEQ ID NO: 587685 - DNA, 11 bp, Homo sapiens
aaaagcctgct

SEQ ID NO: 587686 - DNA, 14 bp, Homo sapiens
aaaaggtattatac

SEQ ID NO: 587687 - DNA, 19 bp, Homo sapiens
aaaagtgtgtatatatttt

SEQ ID NO: 587688 - DNA, 20 bp, Homo sapiens
aaaagtgtgtatatattttg

SEQ ID NO: 587689 - DNA, 19 bp, Homo sapiens
aaaagtgttgactgtgtca

SEQ ID NO: 587690 - DNA, 16 bp, Homo sapiens
aaaagtttttgtttgg

SEQ ID NO: 587691 - DNA, 13 bp, Homo sapiens
aaaataacagtat

SEQ ID NO: 587692 - DNA, 14 bp, Homo sapiens
aaaatgaaagctac

SEQ ID NO: 587693 - DNA, 13 bp, Homo sapiens
aaaatgatgttat

SEQ ID NO: 587694 - DNA, 16 bp, Homo sapiens
aaaatgatgttataca

SEQ ID NO: 587695 - DNA, 14 bp, Homo sapiens
aaaatgtaatttaa

SEQ ID NO: 587696 - DNA, 21 bp, Homo sapiens
aaaattatatattgcaaggtg

SEQ ID NO: 587697 - DNA, 20 bp, Homo sapiens
aaaattgagttgcacttatt

SEQ ID NO: 587698 - DNA, 20 bp, Homo sapiens
aaaatttgccaatctttcct

SEQ ID NO: 587699 - DNA, 16 bp, Homo sapiens
aaacaagccccctgcc

SEQ ID NO: 587700 - DNA, 19 bp, Homo sapiens
aaacactatttgtgacttt

SEQ ID NO: 587701 - DNA, 14 bp, Homo sapiens
aaacagacaaaaca

SEQ ID NO: 587702 - DNA, 18 bp, Homo sapiens
aatgaaagctactcatag

SEQ ID NO: 587703 - DNA, 17 bp, Homo sapiens
aatgaaccataaattca

SEQ ID NO: 587704 - DNA, 12 bp, Homo sapiens
aatgacaatatt

SEQ ID NO: 587705 - DNA, 17 bp, Homo sapiens
aatgacactgtttcctg

SEQ ID NO: 587706 - DNA, 18 bp, Homo sapiens
aatgacactgtttcctga

SEQ ID NO: 587707 - DNA, 14 bp, Homo sapiens
aatgatctattgct

SEQ ID NO: 587708 - DNA, 12 bp, Homo sapiens
aatgatgttata

SEQ ID NO: 587709 - DNA, 14 bp, Homo sapiens
aatgatgttataca

SEQ ID NO: 587710 - DNA, 14 bp, Homo sapiens
aatgcatacaagtt

SEQ ID NO: 587711 - DNA, 15 bp, Homo sapiens
aatgctacatgtgag

SEQ ID NO: 587712 - DNA, 21 bp, Homo sapiens
aatgctcccacctgaatttgt

SEQ ID NO: 587713 - DNA, 23 bp, Homo sapiens
aatgctcccacctgaatttgtat

SEQ ID NO: 587714 - DNA, 17 bp, Homo sapiens
aatggatttttctttaa

SEQ ID NO: 587715 - DNA, 18 bp, Homo sapiens
aatggtgtggtgaatgtg

SEQ ID NO: 587716 - DNA, 16 bp, Homo sapiens
aatgtaacatgatttc

SEQ ID NO: 587717 - DNA, 13 bp, Homo sapiens
aatgtccaaaatt

SEQ ID NO: 587718 - DNA, 18 bp, Homo sapiens
aatgtctaaaaacatttg

SEQ ID NO: 587719 - DNA, 16 bp, Homo sapiens
aatgtctcctttgctc

SEQ ID NO: 587720 - DNA, 16 bp, Homo sapiens
aatgtgtgagaaaaac

SEQ ID NO: 587721 - DNA, 18 bp, Homo sapiens
aatgtgtgagaaaaacta

SEQ ID NO: 587722 - DNA, 18 bp, Homo sapiens
aatgttaaagggatattt

SEQ ID NO: 587723 - DNA, 18 bp, Homo sapiens
aatgtttacaagtaaata

SEQ ID NO: 587724 - DNA, 23 bp, Homo sapiens
accagtgtagcatcttcctctgc

SEQ ID NO: 587725 - DNA, 14 bp, Homo sapiens
accataaattcaac

SEQ ID NO: 587726 - DNA, 18 bp, Homo sapiens
accatgtgagctcttcct

SEQ ID NO: 587727 - DNA, 20 bp, Homo sapiens
accattttatagactaccaa

SEQ ID NO: 587728 - DNA, 18 bp, Homo sapiens
acccaacccaatccctct

SEQ ID NO: 587729 - DNA, 11 bp, Homo sapiens
acccagagctg

SEQ ID NO: 587730 - DNA, 22 bp, Homo sapiens
acccattaaggggaagaatgaa

SEQ ID NO: 587731 - DNA, 15 bp, Homo sapiens
accccaaagagaaag

SEQ ID NO: 587732 - DNA, 13 bp, Homo sapiens
accccttcctgtc

SEQ ID NO: 587733 - DNA, 17 bp, Homo sapiens
accccttcctgtcctgc

SEQ ID NO: 587734 - DNA, 18 bp, Homo sapiens
accccttcctgtcctgcc

SEQ ID NO: 587735 - DNA, 21 bp, Homo sapiens
accccttgttgcactgccccc

SEQ ID NO: 587736 - DNA, 15 bp, Homo sapiens
acccgagtacctcca

SEQ ID NO: 587737 - DNA, 14 bp, Homo sapiens
accctcttgccatc

SEQ ID NO: 587738 - DNA, 16 bp, Homo sapiens
accctcttgccatcct

SEQ ID NO: 587739 - DNA, 18 bp, Homo sapiens
accctgaacccacacctg

SEQ ID NO: 587740 - DNA, 19 bp, Homo sapiens
accctgaacccacacctgg

SEQ ID NO: 587741 - DNA, 19 bp, Homo sapiens
acccttctgggtccaggga

SEQ ID NO: 587742 - DNA, 14 bp, Homo sapiens
acccttttaagcat

SEQ ID NO: 587743 - DNA, 11 bp, Homo sapiens
acctacagttt

SEQ ID NO: 587744 - DNA, 16 bp, Homo sapiens
acctacagttttaact

SEQ ID NO: 587745 - DNA, 17 bp, Homo sapiens
acctacagttttaactg

SEQ ID NO: 587746 - DNA, 18 bp, Homo sapiens
acctagctggctctgtga

SEQ ID NO: 587747 - DNA, 12 bp, Homo sapiens
acctccctccct

SEQ ID NO: 587748 - DNA, 15 bp, Homo sapiens
acctccctccctctc

SEQ ID NO: 587749 - DNA, 19 bp, Homo sapiens
acctcctaccccttcctgt

SEQ ID NO: 587750 - DNA, 22 bp, Homo sapiens
acctcctaccccttcctgtcct

SEQ ID NO: 587751 - DNA, 23 bp, Homo sapiens
acctcctaccccttcctgtcctg

SEQ ID NO: 587752 - DNA, 15 bp, Homo sapiens
acctcgggcctgctg

SEQ ID NO: 587753 - DNA, 14 bp, Homo sapiens
acctctctgcctct

SEQ ID NO: 587754 - DNA, 16 bp, Homo sapiens
acctctctgcctctct

SEQ ID NO: 587755 - DNA, 18 bp, Homo sapiens
acctctctgcctctcttc

SEQ ID NO: 587756 - DNA, 23 bp, Homo sapiens
acctctctgcctctcttcttccc

SEQ ID NO: 587757 - DNA, 18 bp, Homo sapiens
acctctttgcgtttcctt

SEQ ID NO: 587758 - DNA, 13 bp, Homo sapiens
acctgatgctggg

SEQ ID NO: 587759 - DNA, 20 bp, Homo sapiens
acctgatgtcagctgctgtt

SEQ ID NO: 587760 - DNA, 16 bp, Homo sapiens
acctgctcacgtcaaa

SEQ ID NO: 587761 - DNA, 15 bp, Homo sapiens
acctgctttcaagac

SEQ ID NO: 587762 - DNA, 15 bp, Homo sapiens
acctggctgccaaca

SEQ ID NO: 587763 - DNA, 22 bp, Homo sapiens
acctgtgctgaacataacttct

SEQ ID NO: 587764 - DNA, 14 bp, Homo sapiens
accttaatttaact

SEQ ID NO: 587765 - DNA, 21 bp, Homo sapiens
accttcaaggctcttcttcct

SEQ ID NO: 587766 - DNA, 22 bp, Homo sapiens
accttcaaggctcttcttcctc

SEQ ID NO: 587767 - DNA, 21 bp, Homo sapiens
acgagtttggatgttgtaaat

SEQ ID NO: 587768 - DNA, 14 bp, Homo sapiens
acgatgacagtgtt

SEQ ID NO: 587769 - DNA, 18 bp, Homo sapiens
acgcctgtaatcccagca

SEQ ID NO: 587770 - DNA, 16 bp, Homo sapiens
acgctctcctcgagcc

SEQ ID NO: 587771 - DNA, 15 bp, Homo sapiens
acggaaagtgctgtc

SEQ ID NO: 587772 - DNA, 12 bp, Homo sapiens
acggttcctggt

SEQ ID NO: 587773 - DNA, 18 bp, Homo sapiens
acgtcatgtatttgagca

SEQ ID NO: 587774 - DNA, 22 bp, Homo sapiens
acgtgtaaatgaagatctttat

SEQ ID NO: 587775 - DNA, 19 bp, Homo sapiens
acgtttataaacagaaatg

SEQ ID NO: 587776 - DNA, 17 bp, Homo sapiens
actaaaaaaaagatgaa

SEQ ID NO: 587777 - DNA, 15 bp, Homo sapiens
actaactcaaataca

SEQ ID NO: 587778 - DNA, 22 bp, Homo sapiens
actaactcaaatacacatttgc

SEQ ID NO: 587779 - DNA, 15 bp, Homo sapiens
actacccatagacat

SEQ ID NO: 587780 - DNA, 16 bp, Homo sapiens
actactactgttatca

SEQ ID NO: 587781 - DNA, 23 bp, Homo sapiens
actactgttatcagtaatgctaa

SEQ ID NO: 587782 - DNA, 13 bp, Homo sapiens
actagattgacta

SEQ ID NO: 587783 - DNA, 14 bp, Homo sapiens
actagccaaaccag

SEQ ID NO: 587784 - DNA, 18 bp, Homo sapiens
actagccaaaccaggacc

SEQ ID NO: 587785 - DNA, 13 bp, Homo sapiens
actaggttctgta

SEQ ID NO: 587786 - DNA, 20 bp, Homo sapiens
actatagcttgcagaactgt

SEQ ID NO: 587787 - DNA, 17 bp, Homo sapiens
actatatatataaatgt

SEQ ID NO: 587788 - DNA, 13 bp, Homo sapiens
actatcttctttg

SEQ ID NO: 587789 - DNA, 23 bp, Homo sapiens
actatttattgtgctgggtccca

SEQ ID NO: 587790 - DNA, 19 bp, Homo sapiens
actatttgtgactttttaa

SEQ ID NO: 587791 - DNA, 13 bp, Homo sapiens
actcagaaattca

SEQ ID NO: 587792 - DNA, 21 bp, Homo sapiens
actctaaaattataaatgaca

SEQ ID NO: 587793 - DNA, 20 bp, Homo sapiens
actctaaccaaggctgtgtt

SEQ ID NO: 587794 - DNA, 18 bp, Homo sapiens
actctgccctactcactc

SEQ ID NO: 587795 - DNA, 15 bp, Homo sapiens
actctgctatttctc

SEQ ID NO: 587796 - DNA, 16 bp, Homo sapiens
actctgctatttctct

SEQ ID NO: 587797 - DNA, 19 bp, Homo sapiens
actctgctatttctcttgc

SEQ ID NO: 587798 - DNA, 20 bp, Homo sapiens
actctgctatttctcttgct

SEQ ID NO: 587799 - DNA, 14 bp, Homo sapiens
actcttctctcctt

SEQ ID NO: 587800 - DNA, 17 bp, Homo sapiens
actcttctctcctttct

SEQ ID NO: 587801 - DNA, 23 bp, Homo sapiens
actcttctctcctttctccctgc

SEQ ID NO: 587802 - DNA, 14 bp, Homo sapiens
actgaaccaggcca

SEQ ID NO: 587803 - DNA, 15 bp, Homo sapiens
actgaaccaggccag

SEQ ID NO: 587804 - DNA, 13 bp, Homo sapiens
actgacatttctt

SEQ ID NO: 587805 - DNA, 15 bp, Homo sapiens
actgacatttcttct

SEQ ID NO: 587806 - DNA, 22 bp, Homo sapiens
actgcaaaaagaaaatctttat

SEQ ID NO: 587807 - DNA, 17 bp, Homo sapiens
actgcactccagcctgg

SEQ ID NO: 587808 - DNA, 15 bp, Homo sapiens
actgccgtaatttaa

SEQ ID NO: 587809 - DNA, 19 bp, Homo sapiens
actgccttcgtttatattt

SEQ ID NO: 587810 - DNA, 23 bp, Homo sapiens
actgcttgaactaggctgagcaa

SEQ ID NO: 587811 - DNA, 13 bp, Homo sapiens
actggcttcagca

SEQ ID NO: 587812 - DNA, 15 bp, Homo sapiens
actggcttcagcaag

SEQ ID NO: 587813 - DNA, 16 bp, Homo sapiens
actgggcactggggcc

SEQ ID NO: 587814 - DNA, 13 bp, Homo sapiens
actggtgtaatct

SEQ ID NO: 587815 - DNA, 15 bp, Homo sapiens
actgtatcattttct

SEQ ID NO: 587816 - DNA, 17 bp, Homo sapiens
actgtgagaacccagtt

SEQ ID NO: 587817 - DNA, 23 bp, Homo sapiens
actgttaaggacccttttaagca

SEQ ID NO: 587818 - DNA, 21 bp, Homo sapiens
actgttatcagtaatgctaaa

SEQ ID NO: 587819 - DNA, 22 bp, Homo sapiens
actgttcaatgattatttgtat

SEQ ID NO: 587820 - DNA, 16 bp, Homo sapiens
actgttgcacttttga

SEQ ID NO: 587821 - DNA, 20 bp, Homo sapiens
actgttgcacttttgaatgt

SEQ ID NO: 587822 - DNA, 19 bp, Homo sapiens
acttaaatggtaataagca

SEQ ID NO: 587823 - DNA, 16 bp, Homo sapiens
acttaagaaacactga

SEQ ID NO: 587824 - DNA, 20 bp, Homo sapiens
acttacatgttcccaaaaca

SEQ ID NO: 587825 - DNA, 22 bp, Homo sapiens
acttacatgttcccaaaacaat

SEQ ID NO: 587826 - DNA, 18 bp, Homo sapiens
acttaggtttcaggaagt

SEQ ID NO: 587827 - DNA, 18 bp, Homo sapiens
atgacactgtttcctgat

SEQ ID NO: 587828 - DNA, 20 bp, Homo sapiens
atgagattggttttcctgtg

SEQ ID NO: 587829 - DNA, 17 bp, Homo sapiens
atgagctctgaaatctt

SEQ ID NO: 587830 - DNA, 19 bp, Homo sapiens
atgagctctgaaatcttcc

SEQ ID NO: 587831 - DNA, 17 bp, Homo sapiens
atgaggacccagagctg

SEQ ID NO: 587832 - DNA, 19 bp, Homo sapiens
atgagtccttgatttcaaa

SEQ ID NO: 587833 - DNA, 23 bp, Homo sapiens
atgatccccgtctctgccctggg

SEQ ID NO: 587834 - DNA, 13 bp, Homo sapiens
atgatctattgct

SEQ ID NO: 587835 - DNA, 11 bp, Homo sapiens
atgatgacaat

SEQ ID NO: 587836 - DNA, 14 bp, Homo sapiens
atgatgtacagatt

SEQ ID NO: 587837 - DNA, 21 bp, Homo sapiens
atgatgtacagattctttcag

SEQ ID NO: 587838 - DNA, 22 bp, Homo sapiens
atgattagaaattacctgtgga

SEQ ID NO: 587839 - DNA, 13 bp, Homo sapiens
atgattatttgta

SEQ ID NO: 587840 - DNA, 17 bp, Homo sapiens
atgattatttgtattta

SEQ ID NO: 587841 - DNA, 19 bp, Homo sapiens
atgatttccctccagagaa

SEQ ID NO: 587842 - DNA, 21 bp, Homo sapiens
atgcaaatgagctctgaaatc

SEQ ID NO: 587843 - DNA, 17 bp, Homo sapiens
atgcaagccccaacttt

SEQ ID NO: 587844 - DNA, 19 bp, Homo sapiens
atgcaattcagtgttccaa

SEQ ID NO: 587845 - DNA, 15 bp, Homo sapiens
atgcacaagatgccc

SEQ ID NO: 587846 - DNA, 13 bp, Homo sapiens
atgcagaagcaat

SEQ ID NO: 587847 - DNA, 15 bp, Homo sapiens
atgcagctttgcaaa

SEQ ID NO: 587848 - DNA, 17 bp, Homo sapiens
atgcatttaataaagat

SEQ ID NO: 587849 - DNA, 22 bp, Homo sapiens
atgcccagacatcagcctcctt

SEQ ID NO: 587850 - DNA, 14 bp, Homo sapiens
attcaggtaacact

SEQ ID NO: 587851 - DNA, 19 bp, Homo sapiens
attccagatctttcagaaa

SEQ ID NO: 587852 - DNA, 21 bp, Homo sapiens
attcctgtactgtgtctcatg

SEQ ID NO: 587853 - DNA, 13 bp, Homo sapiens
attctataaaact

SEQ ID NO: 587854 - DNA, 15 bp, Homo sapiens
attctataaaactct

SEQ ID NO: 587855 - DNA, 22 bp, Homo sapiens
attctgattctggctttaagcc

SEQ ID NO: 587856 - DNA, 15 bp, Homo sapiens
attctgcctgctcca

SEQ ID NO: 587857 - DNA, 13 bp, Homo sapiens
attcttttctcag

SEQ ID NO: 587858 - DNA, 19 bp, Homo sapiens
attcttttctcagtgttgg

SEQ ID NO: 587859 - DNA, 16 bp, Homo sapiens
attgaaaagtttttgt

SEQ ID NO: 587860 - DNA, 19 bp, Homo sapiens
attgaaaagtttttgtttg

SEQ ID NO: 587861 - DNA, 15 bp, Homo sapiens
attgacttttataaa

SEQ ID NO: 587862 - DNA, 14 bp, Homo sapiens
attgagtattgttt

SEQ ID NO: 587863 - DNA, 15 bp, Homo sapiens
attgcatcactgtat

SEQ ID NO: 587864 - DNA, 16 bp, Homo sapiens
attgcatcactgtatc

SEQ ID NO: 587865 - DNA, 20 bp, Homo sapiens
attgctgataccatatgaat

SEQ ID NO: 587866 - DNA, 17 bp, Homo sapiens
attgctgtgagccttgc

SEQ ID NO: 587867 - DNA, 18 bp, Homo sapiens
attgtacaaaattaagca

SEQ ID NO: 587868 - DNA, 16 bp, Homo sapiens
attgtttaaaatgtaa

SEQ ID NO: 587869 - DNA, 19 bp, Homo sapiens
attgtttggtaaatgtttc

SEQ ID NO: 587870 - DNA, 22 bp, Homo sapiens
atttaaaaaataaataaaaact

SEQ ID NO: 587871 - DNA, 13 bp, Homo sapiens
atttaaaacaatc

SEQ ID NO: 587872 - DNA, 17 bp, Homo sapiens
atttaaaagcctgctca

SEQ ID NO: 587873 - DNA, 13 bp, Homo sapiens
atttaaatgaaag

SEQ ID NO: 587874 - DNA, 14 bp, Homo sapiens
atttaataaagatg

SEQ ID NO: 587875 - DNA, 15 bp, Homo sapiens
atttaataaagatga

SEQ ID NO: 587876 - DNA, 17 bp, Homo sapiens
atttaataaagatgagt

SEQ ID NO: 587877 - DNA, 19 bp, Homo sapiens
atttaataccagatacctt

SEQ ID NO: 587878 - DNA, 20 bp, Homo sapiens
atttaatccagttataagaa

SEQ ID NO: 587879 - DNA, 18 bp, Homo sapiens
caatctgtacaaaatggt

SEQ ID NO: 587880 - DNA, 23 bp, Homo sapiens
caatctttaacaacctctgagcc

SEQ ID NO: 587881 - DNA, 20 bp, Homo sapiens
caatctttcctactttctat

SEQ ID NO: 587882 - DNA, 13 bp, Homo sapiens
caatctttgctgt

SEQ ID NO: 587883 - DNA, 16 bp, Homo sapiens
caatgaaccataaatt

SEQ ID NO: 587884 - DNA, 16 bp, Homo sapiens
caatggaaaatataat

SEQ ID NO: 587885 - DNA, 22 bp, Homo sapiens
caatgtagaggcataaacctgt

SEQ ID NO: 587886 - DNA, 15 bp, Homo sapiens
caatgtctaaaaaca

SEQ ID NO: 587887 - DNA, 17 bp, Homo sapiens
caattagacttgaaata

SEQ ID NO: 587888 - DNA, 13 bp, Homo sapiens
caattcagtgttc

SEQ ID NO: 587889 - DNA, 18 bp, Homo sapiens
caattgcgaccttaattt

SEQ ID NO: 587890 - DNA, 23 bp, Homo sapiens
caattgcgaccttaatttaactt

SEQ ID NO: 587891 - DNA, 17 bp, Homo sapiens
caatttcttttatgtta

SEQ ID NO: 587892 - DNA, 19 bp, Homo sapiens
cacaagatgccccagggat

SEQ ID NO: 587893 - DNA, 16 bp, Homo sapiens
cacaatttaaaacaat

SEQ ID NO: 587894 - DNA, 12 bp, Homo sapiens
cacacacacaca

SEQ ID NO: 587895 - DNA, 15 bp, Homo sapiens
cacacacacacgatg

SEQ ID NO: 587896 - DNA, 11 bp, Homo sapiens
cacacgatgca

SEQ ID NO: 587897 - DNA, 18 bp, Homo sapiens
cacacgatgcatttaata

SEQ ID NO: 587898 - DNA, 20 bp, Homo sapiens
cacacgatgcatttaataaa

SEQ ID NO: 587899 - DNA, 22 bp, Homo sapiens
cacacgatgcatttaataaaga

SEQ ID NO: 587900 - DNA, 15 bp, Homo sapiens
cacacttttccacat

SEQ ID NO: 587901 - DNA, 20 bp, Homo sapiens
cacagaaggtgaactttgtg

SEQ ID NO: 587902 - DNA, 22 bp, Homo sapiens
cacagaaggtgaactttgtgct

SEQ ID NO: 587903 - DNA, 15 bp, Homo sapiens
cacagcatcagctca

SEQ ID NO: 587904 - DNA, 15 bp, Homo sapiens
cacaggagagactgg

SEQ ID NO: 587905 - DNA, 14 bp, Homo sapiens
cacagttcctggga

SEQ ID NO: 587906 - DNA, 19 bp, Homo sapiens
cacatatccaggcaccagg

SEQ ID NO: 587907 - DNA, 14 bp, Homo sapiens
cacatcaaataaga

SEQ ID NO: 587908 - DNA, 20 bp, Homo sapiens
cacatcacaagactatgcca

SEQ ID NO: 587909 - DNA, 21 bp, Homo sapiens
cacatctatccacactgtcaa

SEQ ID NO: 587910 - DNA, 14 bp, Homo sapiens
cacattaactgttg

SEQ ID NO: 587911 - DNA, 20 bp, Homo sapiens
cagtaatgctaaatgtgtaa

SEQ ID NO: 587912 - DNA, 15 bp, Homo sapiens
cagtatgtgggatat

SEQ ID NO: 587913 - DNA, 15 bp, Homo sapiens
cagtatttcagactg

SEQ ID NO: 587914 - DNA, 17 bp, Homo sapiens
cagtatttccttccact

SEQ ID NO: 587915 - DNA, 20 bp, Homo sapiens
cagtcgtggggaacggagga

SEQ ID NO: 587916 - DNA, 14 bp, Homo sapiens
cagtgaccagtgcc

SEQ ID NO: 587917 - DNA, 23 bp, Homo sapiens
cagtggtgtgtgaagtttggaga

SEQ ID NO: 587918 - DNA, 18 bp, Homo sapiens
cagtgtagcatcttcctc

SEQ ID NO: 587919 - DNA, 23 bp, Homo sapiens
cagtgtctgtgttttgaaagaat

SEQ ID NO: 587920 - DNA, 15 bp, Homo sapiens
cagtgtgtaaataat

SEQ ID NO: 587921 - DNA, 23 bp, Homo sapiens
cagtgttccaagtctctgtgtaa

SEQ ID NO: 587922 - DNA, 16 bp, Homo sapiens
cagtgttggtatattt

SEQ ID NO: 587923 - DNA, 21 bp, Homo sapiens
cagtgttttggtggaaaaaac

SEQ ID NO: 587924 - DNA, 15 bp, Homo sapiens
cagttataagaagaa

SEQ ID NO: 587925 - DNA, 14 bp, Homo sapiens
cagttcccagagtg

SEQ ID NO: 587926 - DNA, 15 bp, Homo sapiens
cagttcccagagtgg

SEQ ID NO: 587927 - DNA, 17 bp, Homo sapiens
cagttcccagagtgggc

SEQ ID NO: 587928 - DNA, 21 bp, Homo sapiens
cagttgccaaagttttgctgt

SEQ ID NO: 587929 - DNA, 13 bp, Homo sapiens
cagttgcttgtct

SEQ ID NO: 587930 - DNA, 20 bp, Homo sapiens
cagttggtctttaaccactt

SEQ ID NO: 587931 - DNA, 20 bp, Homo sapiens
cagtttccagagagtggaga

SEQ ID NO: 587932 - DNA, 14 bp, Homo sapiens
cagtttgttggaaa

SEQ ID NO: 587933 - DNA, 14 bp, Homo sapiens
cagttttaactgtg

SEQ ID NO: 587934 - DNA, 15 bp, Homo sapiens
cagttttaactgtgg

SEQ ID NO: 587935 - DNA, 16 bp, Homo sapiens
cagttttaactgtgga

SEQ ID NO: 587936 - DNA, 18 bp, Homo sapiens
cagttttaactgtggata

SEQ ID NO: 587937 - DNA, 18 bp, Homo sapiens
cagttttcggaaacactg

SEQ ID NO: 587938 - DNA, 14 bp, Homo sapiens
cagtttttgacatt

SEQ ID NO: 587939 - DNA, 16 bp, Homo sapiens
cagtttttgacattta

SEQ ID NO: 587940 - DNA, 22 bp, Homo sapiens
cagtttttgacatttatattaa

SEQ ID NO: 587941 - DNA, 20 bp, Homo sapiens
cataactcacacccctgccc

SEQ ID NO: 587942 - DNA, 21 bp, Homo sapiens
cataactcacacccctgcccc

SEQ ID NO: 587943 - DNA, 12 bp, Homo sapiens
cataagataaaa

SEQ ID NO: 587944 - DNA, 22 bp, Homo sapiens
cataagataaaatgatgttata

SEQ ID NO: 587945 - DNA, 24 bp, Homo sapiens
cataagataaaatgatgttataca

SEQ ID NO: 587946 - DNA, 12 bp, Homo sapiens
cataatgctttg

SEQ ID NO: 587947 - DNA, 15 bp, Homo sapiens
cataatgctttgtta

SEQ ID NO: 587948 - DNA, 21 bp, Homo sapiens
cataatgtttctggatttcat

SEQ ID NO: 587949 - DNA, 23 bp, Homo sapiens
cataatgtttctggatttcatac

SEQ ID NO: 587950 - DNA, 17 bp, Homo sapiens
catactgtaacattcag

SEQ ID NO: 587951 - DNA, 17 bp, Homo sapiens
catactttgtattttga

SEQ ID NO: 587952 - DNA, 14 bp, Homo sapiens
catagacatgaaag

SEQ ID NO: 587953 - DNA, 13 bp, Homo sapiens
catagagaacaaa

SEQ ID NO: 587954 - DNA, 16 bp, Homo sapiens
catagataatattgtt

SEQ ID NO: 587955 - DNA, 17 bp, Homo sapiens
catagataatattgttt

SEQ ID NO: 587956 - DNA, 24 bp, Homo sapiens
catagataatattgtttggtaaat

SEQ ID NO: 587957 - DNA, 18 bp, Homo sapiens
catagcgggggcctaaaa

SEQ ID NO: 587958 - DNA, 21 bp, Homo sapiens
catagtgagacccctgtctcc

SEQ ID NO: 587959 - DNA, 13 bp, Homo sapiens
catatgaatgaaa

SEQ ID NO: 587960 - DNA, 17 bp, Homo sapiens
catatgaatgaaacatg

SEQ ID NO: 587961 - DNA, 13 bp, Homo sapiens
catattgtaatct

SEQ ID NO: 587962 - DNA, 14 bp, Homo sapiens
catcaatatgtata

SEQ ID NO: 587963 - DNA, 16 bp, Homo sapiens
catcagcctccttctt

SEQ ID NO: 587964 - DNA, 19 bp, Homo sapiens
catcagggcctttctcctc

SEQ ID NO: 587965 - DNA, 14 bp, Homo sapiens
catcatctcttcct

SEQ ID NO: 587966 - DNA, 18 bp, Homo sapiens
catcatctcttcctcaca

SEQ ID NO: 587967 - DNA, 17 bp, Homo sapiens
catccatgtacttccct

SEQ ID NO: 587968 - DNA, 14 bp, Homo sapiens
catcccatctctcc

SEQ ID NO: 587969 - DNA, 16 bp, Homo sapiens
catcccatctctccca

SEQ ID NO: 587970 - DNA, 21 bp, Homo sapiens
catcccatctctcccacttcc

SEQ ID NO: 587971 - DNA, 13 bp, Homo sapiens
catctaattctga

SEQ ID NO: 587972 - DNA, 15 bp, Homo sapiens
catctaattctgatt

SEQ ID NO: 587973 - DNA, 19 bp, Homo sapiens
catctatccacactgtcaa

SEQ ID NO: 587974 - DNA, 19 bp, Homo sapiens
catctccacaggagagact

SEQ ID NO: 587975 - DNA, 18 bp, Homo sapiens
cattgagtattgtttaaa

SEQ ID NO: 587976 - DNA, 21 bp, Homo sapiens
cattgcacataagcttccatt

SEQ ID NO: 587977 - DNA, 15 bp, Homo sapiens
cattgtaattatgta

SEQ ID NO: 587978 - DNA, 17 bp, Homo sapiens
cattgtttcgtaacaca

SEQ ID NO: 587979 - DNA, 18 bp, Homo sapiens
catttaataaagatgagt

SEQ ID NO: 587980 - DNA, 13 bp, Homo sapiens
catttaatgccat

SEQ ID NO: 587981 - DNA, 20 bp, Homo sapiens
catttagaagcctgacaact

SEQ ID NO: 587982 - DNA, 15 bp, Homo sapiens
catttatattaaata

SEQ ID NO: 587983 - DNA, 19 bp, Homo sapiens
catttatgacaagctgtat

SEQ ID NO: 587984 - DNA, 15 bp, Homo sapiens
catttccattgctta

SEQ ID NO: 587985 - DNA, 19 bp, Homo sapiens
cattttcatattgtaatct

SEQ ID NO: 587986 - DNA, 13 bp, Homo sapiens
cattttttaagct

SEQ ID NO: 587987 - DNA, 14 bp, Homo sapiens
catttttttgcatg

SEQ ID NO: 587988 - DNA, 17 bp, Homo sapiens
ccaaaatttatatttta

SEQ ID NO: 587989 - DNA, 14 bp, Homo sapiens
ccaaacagacaaaa

SEQ ID NO: 587990 - DNA, 16 bp, Homo sapiens
ccaaaccaggaccctg

SEQ ID NO: 587991 - DNA, 17 bp, Homo sapiens
ccaaactgatccagtat

SEQ ID NO: 587992 - DNA, 12 bp, Homo sapiens
ccaaagagaaag

SEQ ID NO: 587993 - DNA, 18 bp, Homo sapiens
ccaaatttaaaactgttg

SEQ ID NO: 587994 - DNA, 17 bp, Homo sapiens
ccaacagacacaattta

SEQ ID NO: 587995 - DNA, 14 bp, Homo sapiens
ccaaccttgtttaa

SEQ ID NO: 587996 - DNA, 17 bp, Homo sapiens
ccaaggctgtgtttaga

SEQ ID NO: 587997 - DNA, 13 bp, Homo sapiens
ccaagggaccagg

SEQ ID NO: 587998 - DNA, 20 bp, Homo sapiens
ccaagttgtgcttgagccag

SEQ ID NO: 587999 - DNA, 13 bp, Homo sapiens
ccaatatatgtat

SEQ ID NO: 588000 - DNA, 22 bp, Homo sapiens
ccaatccctctccactcttctc

SEQ ID NO: 588001 - DNA, 23 bp, Homo sapiens
ccacagccttgcagcggctcctg

SEQ ID NO: 588002 - DNA, 16 bp, Homo sapiens
ccacatcaaataagaa

SEQ ID NO: 588003 - DNA, 18 bp, Homo sapiens
ccacccgagtacctccag

SEQ ID NO: 588004 - DNA, 22 bp, Homo sapiens
ccacccgagtacctccagtcac

SEQ ID NO: 588005 - DNA, 24 bp, Homo sapiens
ccacctcctaccccttcctgtcct

SEQ ID NO: 588006 - DNA, 13 bp, Homo sapiens
ccacctgtagctg

SEQ ID NO: 588007 - DNA, 18 bp, Homo sapiens
ccacctgtagctgaagca

SEQ ID NO: 588008 - DNA, 20 bp, Homo sapiens
ccactcttctctcctttctc

SEQ ID NO: 588009 - DNA, 23 bp, Homo sapiens
ccactcttctctcctttctccct

SEQ ID NO: 588010 - DNA, 11 bp, Homo sapiens
ccactgcactc

SEQ ID NO: 588011 - DNA, 17 bp, Homo sapiens
ccacttcctcctacctg

SEQ ID NO: 588012 - DNA, 14 bp, Homo sapiens
ccacttgcctgggg

SEQ ID NO: 588013 - DNA, 16 bp, Homo sapiens
ccagagagtggagaga

SEQ ID NO: 588014 - DNA, 13 bp, Homo sapiens
ccagagcaaacag

SEQ ID NO: 588015 - DNA, 18 bp, Homo sapiens
ccagagcaaacagaaaaa

SEQ ID NO: 588016 - DNA, 20 bp, Homo sapiens
ccagagtgggctttggtggc

SEQ ID NO: 588017 - DNA, 17 bp, Homo sapiens
ccagatagtgtagctga

SEQ ID NO: 588018 - DNA, 14 bp, Homo sapiens
ccagattggccaat

SEQ ID NO: 588019 - DNA, 16 bp, Homo sapiens
ccagatttgtttcctt

SEQ ID NO: 588020 - DNA, 17 bp, Homo sapiens
ccagcagaaatgccccc

SEQ ID NO: 588021 - DNA, 17 bp, Homo sapiens
ccagcgacctctctgcc

SEQ ID NO: 588022 - DNA, 20 bp, Homo sapiens
ccagcgacctctctgcctct

SEQ ID NO: 588023 - DNA, 14 bp, Homo sapiens
ccagctcagtgttt

SEQ ID NO: 588024 - DNA, 14 bp, Homo sapiens
ccagctgcagcctg

SEQ ID NO: 588025 - DNA, 19 bp, Homo sapiens
ccaggaacgctctcctcga

SEQ ID NO: 588026 - DNA, 16 bp, Homo sapiens
ccaggaggctgaggtg

SEQ ID NO: 588027 - DNA, 19 bp, Homo sapiens
ccaggatgactagatcctg

SEQ ID NO: 588028 - DNA, 17 bp, Homo sapiens
ccaggcaccaggactag

SEQ ID NO: 588029 - DNA, 13 bp, Homo sapiens
ccaggccagagca

SEQ ID NO: 588030 - DNA, 13 bp, Homo sapiens
ccagggaggggtc

SEQ ID NO: 588031 - DNA, 14 bp, Homo sapiens
ccagggaggggtcc

SEQ ID NO: 588032 - DNA, 18 bp, Homo sapiens
ccaggggccaacctcagg

SEQ ID NO: 588033 - DNA, 15 bp, Homo sapiens
ccagtcctaacaaat

SEQ ID NO: 588034 - DNA, 18 bp, Homo sapiens
ccagtgtagcatcttcct

SEQ ID NO: 588035 - DNA, 22 bp, Homo sapiens
ccagtgtagcatcttcctctgc

SEQ ID NO: 588036 - DNA, 15 bp, Homo sapiens
cctgggaagctgccg

SEQ ID NO: 588037 - DNA, 15 bp, Homo sapiens
cctgggccacctcct

SEQ ID NO: 588038 - DNA, 15 bp, Homo sapiens
cctggggactcctca

SEQ ID NO: 588039 - DNA, 18 bp, Homo sapiens
cctggttggcagcatctg

SEQ ID NO: 588040 - DNA, 21 bp, Homo sapiens
cctggtttgcaaagaccacct

SEQ ID NO: 588041 - DNA, 15 bp, Homo sapiens
cctgtaatcccagca

SEQ ID NO: 588042 - DNA, 18 bp, Homo sapiens
cctgtaatcccagcactt

SEQ ID NO: 588043 - DNA, 16 bp, Homo sapiens
cctgtcctgcctcctc

SEQ ID NO: 588044 - DNA, 18 bp, Homo sapiens
cctgtcctgcctcctcat

SEQ ID NO: 588045 - DNA, 12 bp, Homo sapiens
cctgtggatatt

SEQ ID NO: 588046 - DNA, 22 bp, Homo sapiens
cctgttcatgtttttgttttaa

SEQ ID NO: 588047 - DNA, 13 bp, Homo sapiens
ccttaaatttaat

SEQ ID NO: 588048 - DNA, 20 bp, Homo sapiens
ccttaatttaactttccagt

SEQ ID NO: 588049 - DNA, 13 bp, Homo sapiens
ccttactggctta

SEQ ID NO: 588050 - DNA, 20 bp, Homo sapiens
ccttcaaaactatagcttgc

SEQ ID NO: 588051 - DNA, 19 bp, Homo sapiens
ccttcctattctcctgcca

SEQ ID NO: 588052 - DNA, 21 bp, Homo sapiens
ccttcctattctcctgccatg

SEQ ID NO: 588053 - DNA, 21 bp, Homo sapiens
ccttcctcttgtctgatttct

SEQ ID NO: 588054 - DNA, 13 bp, Homo sapiens
ccttcctgtcctg

SEQ ID NO: 588055 - DNA, 14 bp, Homo sapiens
ccttcctgtcctgc

SEQ ID NO: 588056 - DNA, 22 bp, Homo sapiens
ccttctccctagctcctcccct

SEQ ID NO: 588057 - DNA, 10 bp, Homo sapiens
ccttctggcc

SEQ ID NO: 588058 - DNA, 14 bp, Homo sapiens
ccttctgggtccag

SEQ ID NO: 588059 - DNA, 18 bp, Homo sapiens
ccttctgggtccagggag

SEQ ID NO: 588060 - DNA, 18 bp, Homo sapiens
ccttgaaactttgggaaa

SEQ ID NO: 588061 - DNA, 19 bp, Homo sapiens
ccttgaaactttgggaaaa

SEQ ID NO: 588062 - DNA, 13 bp, Homo sapiens
ccttgatttcaaa

SEQ ID NO: 588063 - DNA, 15 bp, Homo sapiens
ccttgcagcggctcc

SEQ ID NO: 588064 - DNA, 17 bp, Homo sapiens
ccttgttgcactgcccc

SEQ ID NO: 588065 - DNA, 18 bp, Homo sapiens
ccttgttgcactgccccc

SEQ ID NO: 588066 - DNA, 22 bp, Homo sapiens
ccttgttgcactgccccctgct

SEQ ID NO: 588067 - DNA, 21 bp, Homo sapiens
ccttgtttctgccctgccagc

SEQ ID NO: 588068 - DNA, 22 bp, Homo sapiens
ccttgtttctgccctgccagct

SEQ ID NO: 588069 - DNA, 11 bp, Homo sapiens
cctttcctggc

SEQ ID NO: 588070 - DNA, 24 bp, Homo sapiens
cctttcctggcagtctcagtccaa

SEQ ID NO: 588071 - DNA, 20 bp, Homo sapiens
cctttctccctgcagccttt

SEQ ID NO: 588072 - DNA, 13 bp, Homo sapiens
cctttctcctccc

SEQ ID NO: 588073 - DNA, 15 bp, Homo sapiens
cctttctcctcccca

SEQ ID NO: 588074 - DNA, 14 bp, Homo sapiens
cctttgattatgca

SEQ ID NO: 588075 - DNA, 14 bp, Homo sapiens
cctttgctcttgcc

SEQ ID NO: 588076 - DNA, 20 bp, Homo sapiens
ccttttctggtccctcttct

SEQ ID NO: 588077 - DNA, 21 bp, Homo sapiens
ccttttctggtccctcttctc

SEQ ID NO: 588078 - DNA, 20 bp, Homo sapiens
cgaatgcccctgttcatgtt

SEQ ID NO: 588079 - DNA, 14 bp, Homo sapiens
cgacctctctgcct

SEQ ID NO: 588080 - DNA, 22 bp, Homo sapiens
cgagtttggatgttgtaaataa

SEQ ID NO: 588081 - DNA, 15 bp, Homo sapiens
cgatgcatttaataa

SEQ ID NO: 588082 - DNA, 24 bp, Homo sapiens
cgatgcatttaataaagatgagtt

SEQ ID NO: 588083 - DNA, 15 bp, Homo sapiens
cgattagtgatgtcc

SEQ ID NO: 588084 - DNA, 20 bp, Homo sapiens
cgccatggggtcggctcctg

SEQ ID NO: 588085 - DNA, 21 bp, Homo sapiens
cgccatggggtcggctcctga

SEQ ID NO: 588086 - DNA, 22 bp, Homo sapiens
cgccatggggtcggctcctgat

SEQ ID NO: 588087 - DNA, 23 bp, Homo sapiens
cgccatggggtcggctcctgatg

SEQ ID NO: 588088 - DNA, 16 bp, Homo sapiens
cgcccacccgagtacc

SEQ ID NO: 588089 - DNA, 22 bp, Homo sapiens
cgcgccagcgacctctctgcct

SEQ ID NO: 588090 - DNA, 15 bp, Homo sapiens
ctatccacactgtca

SEQ ID NO: 588091 - DNA, 21 bp, Homo sapiens
ctatccacactgtcaaacagg

SEQ ID NO: 588092 - DNA, 11 bp, Homo sapiens
ctatcctcccc

SEQ ID NO: 588093 - DNA, 16 bp, Homo sapiens
ctattagcggctcctc

SEQ ID NO: 588094 - DNA, 19 bp, Homo sapiens
ctattatttttataattgt

SEQ ID NO: 588095 - DNA, 15 bp, Homo sapiens
ctattctagcctgca

SEQ ID NO: 588096 - DNA, 14 bp, Homo sapiens
ctattctcctgcca

SEQ ID NO: 588097 - DNA, 16 bp, Homo sapiens
ctattctcctgccatg

SEQ ID NO: 588098 - DNA, 14 bp, Homo sapiens
ctattgctcatcag

SEQ ID NO: 588099 - DNA, 14 bp, Homo sapiens
ctatttctcttgct

SEQ ID NO: 588100 - DNA, 15 bp, Homo sapiens
ctatttgtgactttt

SEQ ID NO: 588101 - DNA, 15 bp, Homo sapiens
ctatttttatgatga

SEQ ID NO: 588102 - DNA, 17 bp, Homo sapiens
ctcaaaccacttgcctg

SEQ ID NO: 588103 - DNA, 16 bp, Homo sapiens
ctcaaatacacatttg

SEQ ID NO: 588104 - DNA, 15 bp, Homo sapiens
ctcaatccctgagga

SEQ ID NO: 588105 - DNA, 16 bp, Homo sapiens
ctcacagctgtaataa

SEQ ID NO: 588106 - DNA, 21 bp, Homo sapiens
ctcagctgagcatggagacag

SEQ ID NO: 588107 - DNA, 19 bp, Homo sapiens
ctcaggccaagggaccagg

SEQ ID NO: 588108 - DNA, 11 bp, Homo sapiens
ctcaggctccg

SEQ ID NO: 588109 - DNA, 18 bp, Homo sapiens
ctcagtggtgtgtgaagt

SEQ ID NO: 588110 - DNA, 19 bp, Homo sapiens
ctcagtgttggtatatttt

SEQ ID NO: 588111 - DNA, 22 bp, Homo sapiens
ctcagtgttggtatattttata

SEQ ID NO: 588112 - DNA, 21 bp, Homo sapiens
ctcagtgttttggtggaaaaa

SEQ ID NO: 588113 - DNA, 12 bp, Homo sapiens
ctcagttctcaa

SEQ ID NO: 588114 - DNA, 14 bp, Homo sapiens
ctcatagacactga

SEQ ID NO: 588115 - DNA, 18 bp, Homo sapiens
ctcatagacactgatctg

SEQ ID NO: 588116 - DNA, 18 bp, Homo sapiens
ctcatcagtgtgtaaata

SEQ ID NO: 588117 - DNA, 20 bp, Homo sapiens
ctcatgcatagtcccagcta

SEQ ID NO: 588118 - DNA, 17 bp, Homo sapiens
ctccactcttctctcct

SEQ ID NO: 588119 - DNA, 13 bp, Homo sapiens
ctccagagaaagc

SEQ ID NO: 588120 - DNA, 22 bp, Homo sapiens
ctccagagaaagcacaatttaa

SEQ ID NO: 588121 - DNA, 23 bp, Homo sapiens
ctccagagaaagcacaatttaaa

SEQ ID NO: 588122 - DNA, 15 bp, Homo sapiens
ctccagtcacactcc

SEQ ID NO: 588123 - DNA, 21 bp, Homo sapiens
ctccatcgcgccagcgacctc

SEQ ID NO: 588124 - DNA, 15 bp, Homo sapiens
ctcccacagcagccc

SEQ ID NO: 588125 - DNA, 22 bp, Homo sapiens
ctcccacagcagccccaggaga

SEQ ID NO: 588126 - DNA, 23 bp, Homo sapiens
ctcccacaggggccatgtcctct

SEQ ID NO: 588127 - DNA, 19 bp, Homo sapiens
ctcccacttcctcctacct

SEQ ID NO: 588128 - DNA, 20 bp, Homo sapiens
ctcccacttcctcctacctg

SEQ ID NO: 588129 - DNA, 22 bp, Homo sapiens
ctcccaggtgtttgtggggctg

SEQ ID NO: 588130 - DNA, 16 bp, Homo sapiens
ctcccagtctctgtcg

SEQ ID NO: 588131 - DNA, 18 bp, Homo sapiens
ctccccttttaccactcc

SEQ ID NO: 588132 - DNA, 14 bp, Homo sapiens
ctccctagctcctc

SEQ ID NO: 588133 - DNA, 13 bp, Homo sapiens
ctccctccctctc

SEQ ID NO: 588134 - DNA, 18 bp, Homo sapiens
ctccctgcagccttttct

SEQ ID NO: 588135 - DNA, 17 bp, Homo sapiens
ctccctgggccacctcc

SEQ ID NO: 588136 - DNA, 21 bp, Homo sapiens
ctccctgggccacctcctacc

SEQ ID NO: 588137 - DNA, 22 bp, Homo sapiens
ctccctgggccacctcctaccc

SEQ ID NO: 588138 - DNA, 19 bp, Homo sapiens
ctccgggcaccaggggcca

SEQ ID NO: 588139 - DNA, 20 bp, Homo sapiens
cttcagcaagttagaactag

SEQ ID NO: 588140 - DNA, 18 bp, Homo sapiens
cttcaggttggtttaatc

SEQ ID NO: 588141 - DNA, 15 bp, Homo sapiens
cttcagttgcttgtc

SEQ ID NO: 588142 - DNA, 18 bp, Homo sapiens
cttcagtttaatgtctcc

SEQ ID NO: 588143 - DNA, 19 bp, Homo sapiens
cttcatgcctgatgaaagc

SEQ ID NO: 588144 - DNA, 20 bp, Homo sapiens
cttcatgcctgatgaaagct

SEQ ID NO: 588145 - DNA, 16 bp, Homo sapiens
cttcccctttgtcctg

SEQ ID NO: 588146 - DNA, 17 bp, Homo sapiens
cttcctcctacctgggg

SEQ ID NO: 588147 - DNA, 14 bp, Homo sapiens
cttcctcttgtctg

SEQ ID NO: 588148 - DNA, 18 bp, Homo sapiens
cttcctcttgtctgattt

SEQ ID NO: 588149 - DNA, 21 bp, Homo sapiens
cttcctgcaggcaggaacaaa

SEQ ID NO: 588150 - DNA, 13 bp, Homo sapiens
cttcctgtcctgc

SEQ ID NO: 588151 - DNA, 15 bp, Homo sapiens
cttcctgtcctgcct

SEQ ID NO: 588152 - DNA, 17 bp, Homo sapiens
cttcctgtcctgcctcc

SEQ ID NO: 588153 - DNA, 20 bp, Homo sapiens
cttcctgtcctgcctcctca

SEQ ID NO: 588154 - DNA, 20 bp, Homo sapiens
cttctattctagcctgcatt

SEQ ID NO: 588155 - DNA, 14 bp, Homo sapiens
cttctcaccagcag

SEQ ID NO: 588156 - DNA, 14 bp, Homo sapiens
cttctcacggcctg

SEQ ID NO: 588157 - DNA, 13 bp, Homo sapiens
cttctctcctcag

SEQ ID NO: 588158 - DNA, 19 bp, Homo sapiens
cttctctcctttctccctg

SEQ ID NO: 588159 - DNA, 18 bp, Homo sapiens
cttctgcaacaagcatgc

SEQ ID NO: 588160 - DNA, 19 bp, Homo sapiens
cttctgcctcccactccat

SEQ ID NO: 588161 - DNA, 15 bp, Homo sapiens
cttctggtactttct

SEQ ID NO: 588162 - DNA, 11 bp, Homo sapiens
cttcttgggat

SEQ ID NO: 588163 - DNA, 17 bp, Homo sapiens
cttctttggacttctga

SEQ ID NO: 588164 - DNA, 14 bp, Homo sapiens
cttgaaaaaaaaca

SEQ ID NO: 588165 - DNA, 18 bp, Homo sapiens
cttgaaaaaaaacagtgg

SEQ ID NO: 588166 - DNA, 20 bp, Homo sapiens
cttgaaaaaaaacagtggat

SEQ ID NO: 588167 - DNA, 14 bp, Homo sapiens
cttgaaacctgatg

SEQ ID NO: 588168 - DNA, 17 bp, Homo sapiens
cttgaaacctgatgtca

SEQ ID NO: 588169 - DNA, 18 bp, Homo sapiens
cttgaaactttgggaaaa

SEQ ID NO: 588170 - DNA, 15 bp, Homo sapiens
cttgactacctactg

SEQ ID NO: 588171 - DNA, 18 bp, Homo sapiens
cttgagccaggaggcctg

SEQ ID NO: 588172 - DNA, 20 bp, Homo sapiens
cttgccaaaaaatagcacac

SEQ ID NO: 588173 - DNA, 20 bp, Homo sapiens
cttggaaattcctgtactgt

SEQ ID NO: 588174 - DNA, 23 bp, Homo sapiens
cttggttgatgtttaaagagaag

SEQ ID NO: 588175 - DNA, 18 bp, Homo sapiens
cttgtaagctatctgtgc

SEQ ID NO: 588176 - DNA, 18 bp, Homo sapiens
cttgtcttctggtacttt

SEQ ID NO: 588177 - DNA, 23 bp, Homo sapiens
cttgtcttctggtactttctgtt

SEQ ID NO: 588178 - DNA, 14 bp, Homo sapiens
cttgtggtggggca

SEQ ID NO: 588179 - DNA, 12 bp, Homo sapiens
cttgttgcactg

SEQ ID NO: 588180 - DNA, 18 bp, Homo sapiens
ctgattctggctttaagc

SEQ ID NO: 588181 - DNA, 19 bp, Homo sapiens
ctgcaaatactgtatattc

SEQ ID NO: 588182 - DNA, 18 bp, Homo sapiens
ctgcacaccctccagaga

SEQ ID NO: 588183 - DNA, 17 bp, Homo sapiens
ctgcactaacagagtgg

SEQ ID NO: 588184 - DNA, 16 bp, Homo sapiens
ctgcactccagcctgg

SEQ ID NO: 588185 - DNA, 18 bp, Homo sapiens
ctgcagaataaaatctct

SEQ ID NO: 588186 - DNA, 22 bp, Homo sapiens
ctgcaggcaggaacaaacaggg

SEQ ID NO: 588187 - DNA, 16 bp, Homo sapiens
ctgcagttttgctatc

SEQ ID NO: 588188 - DNA, 22 bp, Homo sapiens
ctgcagttttgctatctgggct

SEQ ID NO: 588189 - DNA, 13 bp, Homo sapiens
ctgcatagccggt

SEQ ID NO: 588190 - DNA, 20 bp, Homo sapiens
ctgcatgtagaggcttgttt

SEQ ID NO: 588191 - DNA, 22 bp, Homo sapiens
ctgccattacagaggtattaaa

SEQ ID NO: 588192 - DNA, 17 bp, Homo sapiens
ctgcccacctggctgcc

SEQ ID NO: 588193 - DNA, 13 bp, Homo sapiens
ctgcccagttgca

SEQ ID NO: 588194 - DNA, 15 bp, Homo sapiens
ctgccccctgcttgg

SEQ ID NO: 588195 - DNA, 19 bp, Homo sapiens
ctgccccggacctacctcc

SEQ ID NO: 588196 - DNA, 16 bp, Homo sapiens
ctgccctactcactct

SEQ ID NO: 588197 - DNA, 20 bp, Homo sapiens
ctgccgtagcttcagccagg

SEQ ID NO: 588198 - DNA, 13 bp, Homo sapiens
ctgccgttttctg

SEQ ID NO: 588199 - DNA, 15 bp, Homo sapiens
ctgcctcaggccaag

SEQ ID NO: 588200 - DNA, 16 bp, Homo sapiens
ctgcctcccactccat

SEQ ID NO: 588201 - DNA, 15 bp, Homo sapiens
ctgcctctcttcttc

SEQ ID NO: 588202 - DNA, 18 bp, Homo sapiens
ctgcctctcttcttcccc

SEQ ID NO: 588203 - DNA, 20 bp, Homo sapiens
ctgcctctcttcttcccctt

SEQ ID NO: 588204 - DNA, 14 bp, Homo sapiens
ctgcctgctccatc

SEQ ID NO: 588205 - DNA, 13 bp, Homo sapiens
ctgcctgtggagt

SEQ ID NO: 588206 - DNA, 13 bp, Homo sapiens
ctgccttcgttta

SEQ ID NO: 588207 - DNA, 20 bp, Homo sapiens
ctgcgttttctccgggtcct

SEQ ID NO: 588208 - DNA, 22 bp, Homo sapiens
ctgcgttttctccgggtcctcc

SEQ ID NO: 588209 - DNA, 18 bp, Homo sapiens
ctgctcacgtcaaatgca

SEQ ID NO: 588210 - DNA, 19 bp, Homo sapiens
ctgctccaatgactgagca

SEQ ID NO: 588211 - DNA, 17 bp, Homo sapiens
ctgctcccacaggggcc

SEQ ID NO: 588212 - DNA, 13 bp, Homo sapiens
ctgctggatattt

SEQ ID NO: 588213 - DNA, 21 bp, Homo sapiens
ctgctgggccccatctccaca

SEQ ID NO: 588214 - DNA, 23 bp, Homo sapiens
ctgcttaatcttcaaagccttct

SEQ ID NO: 588215 - DNA, 16 bp, Homo sapiens
ctgcttaattgctgat

SEQ ID NO: 588216 - DNA, 15 bp, Homo sapiens
ctgcttcccttactt

SEQ ID NO: 588217 - DNA, 20 bp, Homo sapiens
ctgcttcccttactttgctg

SEQ ID NO: 588218 - DNA, 21 bp, Homo sapiens
ctggaagcccctgggcccagt

SEQ ID NO: 588219 - DNA, 12 bp, Homo sapiens
ctggaaggacct

SEQ ID NO: 588220 - DNA, 21 bp, Homo sapiens
ctggaaggacctgctcccaca

SEQ ID NO: 588221 - DNA, 19 bp, Homo sapiens
ctggaatcagtatttcctt

SEQ ID NO: 588222 - DNA, 15 bp, Homo sapiens
ctggaccaggcccat

SEQ ID NO: 588223 - DNA, 12 bp, Homo sapiens
ctggatgtctgg

SEQ ID NO: 588224 - DNA, 14 bp, Homo sapiens
ctggatgtctggct

SEQ ID NO: 588225 - DNA, 21 bp, Homo sapiens
gccaaatttaaaactgttgga

SEQ ID NO: 588226 - DNA, 18 bp, Homo sapiens
gccaacctcaggctccta

SEQ ID NO: 588227 - DNA, 21 bp, Homo sapiens
gccaacctcaggctcctaaag

SEQ ID NO: 588228 - DNA, 15 bp, Homo sapiens
gccacatcaaacctt

SEQ ID NO: 588229 - DNA, 18 bp, Homo sapiens
gccagagcaaacagaaaa

SEQ ID NO: 588230 - DNA, 15 bp, Homo sapiens
gccagattgccatcc

SEQ ID NO: 588231 - DNA, 16 bp, Homo sapiens
gccagctgcagcctgg

SEQ ID NO: 588232 - DNA, 13 bp, Homo sapiens
gccaggatgacta

SEQ ID NO: 588233 - DNA, 18 bp, Homo sapiens
gccataaacggttcctgg

SEQ ID NO: 588234 - DNA, 21 bp, Homo sapiens
gccataaacggttcctggtga

SEQ ID NO: 588235 - DNA, 16 bp, Homo sapiens
gtgtaatctcaatgca

SEQ ID NO: 588236 - DNA, 16 bp, Homo sapiens
gtgtagcatcttcctc

SEQ ID NO: 588237 - DNA, 18 bp, Homo sapiens
gtgtcattctgcctgctc

SEQ ID NO: 588238 - DNA, 19 bp, Homo sapiens
gtgtcccctatcctcccct

SEQ ID NO: 588239 - DNA, 16 bp, Homo sapiens
gtgtgaccctgggcag

SEQ ID NO: 588240 - DNA, 15 bp, Homo sapiens
gtgtgagctatgcaa

SEQ ID NO: 588241 - DNA, 20 bp, Homo sapiens
gtgtgctgggcagagggagg

SEQ ID NO: 588242 - DNA, 20 bp, Homo sapiens
gtgtggcagccaggatgact

SEQ ID NO: 588243 - DNA, 11 bp, Homo sapiens
gtgtgtaaata

SEQ ID NO: 588244 - DNA, 21 bp, Homo sapiens
gtgtgtggcagccaggatgac

SEQ ID NO: 588245 - DNA, 20 bp, Homo sapiens
gtgttccaagtctctgtgta

SEQ ID NO: 588246 - DNA, 16 bp, Homo sapiens
gtgttgtccaggaagt

SEQ ID NO: 588247 - DNA, 15 bp, Homo sapiens
gtgtttctagaatca

SEQ ID NO: 588248 - DNA, 14 bp, Homo sapiens
gtgttttaattgta

SEQ ID NO: 588249 - DNA, 22 bp, Homo sapiens
gttaaggacccttttaagcatg

SEQ ID NO: 588250 - DNA, 13 bp, Homo sapiens
gttaggaggtcct

SEQ ID NO: 588251 - DNA, 13 bp, Homo sapiens
gttataagaagaa

SEQ ID NO: 588252 - DNA, 18 bp, Homo sapiens
gttatcagtaatgctaaa

SEQ ID NO: 588253 - DNA, 12 bp, Homo sapiens
gttattcgccca

SEQ ID NO: 588254 - DNA, 16 bp, Homo sapiens
gttatttgttcattat

SEQ ID NO: 588255 - DNA, 16 bp, Homo sapiens
gttcagaaaaccactt

SEQ ID NO: 588256 - DNA, 15 bp, Homo sapiens
gttcctggtgactcc

SEQ ID NO: 588257 - DNA, 21 bp, Homo sapiens
gttcggctctagggcctcagt

SEQ ID NO: 588258 - DNA, 20 bp, Homo sapiens
gttctcctatatcctccttc

SEQ ID NO: 588259 - DNA, 22 bp, Homo sapiens
gttgagcatagagaacaaagta

SEQ ID NO: 588260 - DNA, 16 bp, Homo sapiens
gttgatgtttaaagag

SEQ ID NO: 588261 - DNA, 20 bp, Homo sapiens
gttgcacttttgaatgtcca

SEQ ID NO: 588262 - DNA, 22 bp, Homo sapiens
gttgcacttttgaatgtccaaa

SEQ ID NO: 588263 - DNA, 23 bp, Homo sapiens
gttgccatcctaccgtcttttcc

SEQ ID NO: 588264 - DNA, 16 bp, Homo sapiens
gttgcctcttgcaatg

SEQ ID NO: 588265 - DNA, 18 bp, Homo sapiens
gttgcctcttgcaatgcc

SEQ ID NO: 588266 - DNA, 14 bp, Homo sapiens
gttgcttgtcttct

SEQ ID NO: 588267 - DNA, 22 bp, Homo sapiens
gttggaatggatttttctttaa

SEQ ID NO: 588268 - DNA, 18 bp, Homo sapiens
gttggggaagggcctgcc

SEQ ID NO: 588269 - DNA, 15 bp, Homo sapiens
gttgtacttaaatgg

SEQ ID NO: 588270 - DNA, 21 bp, Homo sapiens
gttgtattgatcaatgcatgt

SEQ ID NO: 588271 - DNA, 14 bp, Homo sapiens
gttgtccaggaagt

SEQ ID NO: 588272 - DNA, 14 bp, Homo sapiens
gttgtcttagcatg

SEQ ID NO: 588273 - DNA, 22 bp, Homo sapiens
gtttataatactactactgtta

SEQ ID NO: 588274 - DNA, 18 bp, Homo sapiens
gtttccagagagtggaga

SEQ ID NO: 588275 - DNA, 19 bp, Homo sapiens
gtttccagagagtggagag

SEQ ID NO: 588276 - DNA, 22 bp, Homo sapiens
gtttctgccctgccagctgcag

SEQ ID NO: 588277 - DNA, 13 bp, Homo sapiens
gtttgaattcagt

SEQ ID NO: 588278 - DNA, 19 bp, Homo sapiens
gtttgcaaagaccacctcc

SEQ ID NO: 588279 - DNA, 11 bp, Homo sapiens
gtttgcctcct

SEQ ID NO: 588280 - DNA, 12 bp, Homo sapiens
gtttgcctcctg

SEQ ID NO: 588281 - DNA, 22 bp, Homo sapiens
gttttaactgtggatattgtta

SEQ ID NO: 588282 - DNA, 13 bp, Homo sapiens
gttttactgtcta

SEQ ID NO: 588283 - DNA, 19 bp, Homo sapiens
gttttgacaggttttccaa

SEQ ID NO: 588284 - DNA, 14 bp, Homo sapiens
gtttttgacattta

SEQ ID NO: 588285 - DNA, 21 bp, Homo sapiens
gtttttgacatttatattaaa

SEQ ID NO: 588286 - DNA, 15 bp, Homo sapiens
gtttttgtttggaga

SEQ ID NO: 588287 - DNA, 15 bp, Homo sapiens
taaaaaaaagatgaa

SEQ ID NO: 588288 - DNA, 17 bp, Homo sapiens
taaaaaacaattaactg

SEQ ID NO: 588289 - DNA, 17 bp, Homo sapiens
taaaacaatccttacta

SEQ ID NO: 588290 - DNA, 17 bp, Homo sapiens
taaaactaaatttcact

SEQ ID NO: 588291 - DNA, 20 bp, Homo sapiens
taaaaggtactggtactata

SEQ ID NO: 588292 - DNA, 15 bp, Homo sapiens
taaaagttctcaatg

SEQ ID NO: 588293 - DNA, 17 bp, Homo sapiens
taaaatgtaatttaaat

SEQ ID NO: 588294 - DNA, 22 bp, Homo sapiens
taaaattatgagattggttttc

SEQ ID NO: 588295 - DNA, 16 bp, Homo sapiens
taaaattttgtatgtt

SEQ ID NO: 588296 - DNA, 12 bp, Homo sapiens
taaacagaaatg

SEQ ID NO: 588297 - DNA, 22 bp, Homo sapiens
taaaccacttaaacgaagagtt

SEQ ID NO: 588298 - DNA, 21 bp, Homo sapiens
taaacctaggacttccgagct

SEQ ID NO: 588299 - DNA, 22 bp, Homo sapiens
taaacggttcctggtgactcct

SEQ ID NO: 588300 - DNA, 21 bp, Homo sapiens
taaactccctggctgttctga

SEQ ID NO: 588301 - DNA, 23 bp, Homo sapiens
taaacttctgcaacaagcatgca

SEQ ID NO: 588302 - DNA, 15 bp, Homo sapiens
taaagagataaagaa

SEQ ID NO: 588303 - DNA, 12 bp, Homo sapiens
taaagaggagat

SEQ ID NO: 588304 - DNA, 13 bp, Homo sapiens
taaagatgagttg

SEQ ID NO: 588305 - DNA, 23 bp, Homo sapiens
taaagggagaagagggaaaacag

SEQ ID NO: 588306 - DNA, 11 bp, Homo sapiens
taaataaagag

SEQ ID NO: 588307 - DNA, 16 bp, Homo sapiens
taaataatttgcactg

SEQ ID NO: 588308 - DNA, 13 bp, Homo sapiens
taaatatgaatga

SEQ ID NO: 588309 - DNA, 14 bp, Homo sapiens
taaatgtccctaat

SEQ ID NO: 588310 - DNA, 14 bp, Homo sapiens
taaatgtgtaataa

SEQ ID NO: 588311 - DNA, 15 bp, Homo sapiens
taaattcaactttgt

SEQ ID NO: 588312 - DNA, 15 bp, Homo sapiens
taacaggccaaagag

SEQ ID NO: 588313 - DNA, 14 bp, Homo sapiens
taacagtgtttaaa

SEQ ID NO: 588314 - DNA, 13 bp, Homo sapiens
taacatgtttctc

SEQ ID NO: 588315 - DNA, 21 bp, Homo sapiens
taacatgtttctctataaagt

SEQ ID NO: 588316 - DNA, 15 bp, Homo sapiens
taaccaaccttgttt

SEQ ID NO: 588317 - DNA, 17 bp, Homo sapiens
taaccagctcagtgttt

SEQ ID NO: 588318 - DNA, 20 bp, Homo sapiens
taactcaaatacacatttgc

SEQ ID NO: 588319 - DNA, 18 bp, Homo sapiens
taactcacacccctgccc

SEQ ID NO: 588320 - DNA, 20 bp, Homo sapiens
taactctaaccaaggctgtg

SEQ ID NO: 588321 - DNA, 15 bp, Homo sapiens
taactgtaaagatgt

SEQ ID NO: 588322 - DNA, 21 bp, Homo sapiens
taagaaaaaaagctgcaaaaa

SEQ ID NO: 588323 - DNA, 22 bp, Homo sapiens
taagacccttattgctgtcctg

SEQ ID NO: 588324 - DNA, 17 bp, Homo sapiens
taagataaaatgatgtt

SEQ ID NO: 588325 - DNA, 14 bp, Homo sapiens
taagatgaaacatc

SEQ ID NO: 588326 - DNA, 18 bp, Homo sapiens
taagcaaatgttaaaagt

SEQ ID NO: 588327 - DNA, 18 bp, Homo sapiens
taagcagtgtctgtgttt

SEQ ID NO: 588328 - DNA, 17 bp, Homo sapiens
taaggatccggaaagaa

SEQ ID NO: 588329 - DNA, 18 bp, Homo sapiens
taaggatccggaaagaag

SEQ ID NO: 588330 - DNA, 16 bp, Homo sapiens
taaggggaagaatgaa

SEQ ID NO: 588331 - DNA, 20 bp, Homo sapiens
taaggggaagaatgaaagct

SEQ ID NO: 588332 - DNA, 14 bp, Homo sapiens
taataaaaagaaag

SEQ ID NO: 588333 - DNA, 19 bp, Homo sapiens
taataaaaagaaagatact

SEQ ID NO: 588334 - DNA, 23 bp, Homo sapiens
tataattgtacaaaattaagcaa

SEQ ID NO: 588335 - DNA, 18 bp, Homo sapiens
tatacatcaatatgtata

SEQ ID NO: 588336 - DNA, 15 bp, Homo sapiens
tatacatgtgataca

SEQ ID NO: 588337 - DNA, 16 bp, Homo sapiens
tatactgaaccaggcc

SEQ ID NO: 588338 - DNA, 15 bp, Homo sapiens
tatagcttgcagaac

SEQ ID NO: 588339 - DNA, 13 bp, Homo sapiens
tataggttctttt

SEQ ID NO: 588340 - DNA, 23 bp, Homo sapiens
tatatattttgtgtgaaattgca

SEQ ID NO: 588341 - DNA, 13 bp, Homo sapiens
tatatgactgcat

SEQ ID NO: 588342 - DNA, 21 bp, Homo sapiens
tatatgtattttttgaatcta

SEQ ID NO: 588343 - DNA, 18 bp, Homo sapiens
tatattacccaatggaaa

SEQ ID NO: 588344 - DNA, 14 bp, Homo sapiens
tatatttcaataaa

SEQ ID NO: 588345 - DNA, 16 bp, Homo sapiens
tatattttgtgtgaaa

SEQ ID NO: 588346 - DNA, 18 bp, Homo sapiens
tatatttttttaactgtg

SEQ ID NO: 588347 - DNA, 21 bp, Homo sapiens
tatcactgccttcgtttatat

SEQ ID NO: 588348 - DNA, 12 bp, Homo sapiens
tatcatgtatgg

SEQ ID NO: 588349 - DNA, 20 bp, Homo sapiens
tatcattttcttttttaacc

SEQ ID NO: 588350 - DNA, 15 bp, Homo sapiens
tccttccactgtagc

SEQ ID NO: 588351 - DNA, 16 bp, Homo sapiens
tccttccactgtagct

SEQ ID NO: 588352 - DNA, 15 bp, Homo sapiens
tccttctattctagc

SEQ ID NO: 588353 - DNA, 14 bp, Homo sapiens
tccttgatttcaaa

SEQ ID NO: 588354 - DNA, 22 bp, Homo sapiens
tccttgatttcaaagttttgtt

SEQ ID NO: 588355 - DNA, 19 bp, Homo sapiens
tccttggtcctagtaagaa

SEQ ID NO: 588356 - DNA, 15 bp, Homo sapiens
tcctttctccctgca

SEQ ID NO: 588357 - DNA, 17 bp, Homo sapiens
tcctttctccctgcagc

SEQ ID NO: 588358 - DNA, 14 bp, Homo sapiens
tcgcccccaccagt

SEQ ID NO: 588359 - DNA, 20 bp, Homo sapiens
tcgcccccaccagtgtagca

SEQ ID NO: 588360 - DNA, 21 bp, Homo sapiens
tcgcgccagcgacctctctgc

SEQ ID NO: 588361 - DNA, 13 bp, Homo sapiens
tcgctagcactca

SEQ ID NO: 588362 - DNA, 23 bp, Homo sapiens
tcggccagttttcggaaacactg

SEQ ID NO: 588363 - DNA, 12 bp, Homo sapiens
tcggctcctgat

SEQ ID NO: 588364 - DNA, 11 bp, Homo sapiens
tcgtttttgta

SEQ ID NO: 588365 - DNA, 18 bp, Homo sapiens
tctaaaaggtaatgtgtg

SEQ ID NO: 588366 - DNA, 23 bp, Homo sapiens
tctaaactccctggctgttctga

SEQ ID NO: 588367 - DNA, 12 bp, Homo sapiens
tctaattctgat

SEQ ID NO: 588368 - DNA, 14 bp, Homo sapiens
tctaattctgattc

SEQ ID NO: 588369 - DNA, 22 bp, Homo sapiens
tctacaatctctttttgtttgc

SEQ ID NO: 588370 - DNA, 19 bp, Homo sapiens
tctacactcttgtaataaa

SEQ ID NO: 588371 - DNA, 19 bp, Homo sapiens
tctagaatcacagctcaag

SEQ ID NO: 588372 - DNA, 21 bp, Homo sapiens
tctaggtacgatgacagtgtt

SEQ ID NO: 588373 - DNA, 12 bp, Homo sapiens
tctagtgatgat

SEQ ID NO: 588374 - DNA, 20 bp, Homo sapiens
tctatatagacttggagaat

SEQ ID NO: 588375 - DNA, 13 bp, Homo sapiens
tctatgaacctga

SEQ ID NO: 588376 - DNA, 12 bp, Homo sapiens
tctattggtctc

SEQ ID NO: 588377 - DNA, 19 bp, Homo sapiens
tctatttttatgatgacaa

SEQ ID NO: 588378 - DNA, 20 bp, Homo sapiens
tctcaaagatgcgtttgcct

SEQ ID NO: 588379 - DNA, 19 bp, Homo sapiens
tctcaatgaaccataaatt

SEQ ID NO: 588380 - DNA, 16 bp, Homo sapiens
tctcactgcttgaact

SEQ ID NO: 588381 - DNA, 16 bp, Homo sapiens
tctcagtggtgtgtga

SEQ ID NO: 588382 - DNA, 15 bp, Homo sapiens
tctccagaagaaaat

SEQ ID NO: 588383 - DNA, 20 bp, Homo sapiens
tctccctagctcctcccctt

SEQ ID NO: 588384 - DNA, 16 bp, Homo sapiens
tctccgggtcctccta

SEQ ID NO: 588385 - DNA, 23 bp, Homo sapiens
tctccgggtcctcctaagtccct

SEQ ID NO: 588386 - DNA, 15 bp, Homo sapiens
tctcctcagtttctc

SEQ ID NO: 588387 - DNA, 14 bp, Homo sapiens
tctcctccccacct

SEQ ID NO: 588388 - DNA, 16 bp, Homo sapiens
tctcctcgagccctcc

SEQ ID NO: 588389 - DNA, 20 bp, Homo sapiens
tctccttaagctgcagagat

SEQ ID NO: 588390 - DNA, 12 bp, Homo sapiens
tctcctttgctc

SEQ ID NO: 588391 - DNA, 15 bp, Homo sapiens
tatccaggcaccagg

SEQ ID NO: 588392 - DNA, 18 bp, Homo sapiens
tatccaggcaccaggact

SEQ ID NO: 588393 - DNA, 18 bp, Homo sapiens
tatcgtttttgtattttc

SEQ ID NO: 588394 - DNA, 20 bp, Homo sapiens
tatcgtttttgtattttcat

SEQ ID NO: 588395 - DNA, 18 bp, Homo sapiens
tatctagttctaacagtg

SEQ ID NO: 588396 - DNA, 14 bp, Homo sapiens
tatcttacaatatt

SEQ ID NO: 588397 - DNA, 18 bp, Homo sapiens
tatcttttttagtgttaa

SEQ ID NO: 588398 - DNA, 16 bp, Homo sapiens
tatgaatgaatgggat

SEQ ID NO: 588399 - DNA, 22 bp, Homo sapiens
tatgacaagctgtatcactgcc

SEQ ID NO: 588400 - DNA, 20 bp, Homo sapiens
tatgagattggttttcctgt

SEQ ID NO: 588401 - DNA, 17 bp, Homo sapiens
tatgcaattcagtgttc

SEQ ID NO: 588402 - DNA, 12 bp, Homo sapiens
tatgggctgggg

SEQ ID NO: 588403 - DNA, 19 bp, Homo sapiens
tatgggggagattgaactt

SEQ ID NO: 588404 - DNA, 14 bp, Homo sapiens
tatgggtctaggac

SEQ ID NO: 588405 - DNA, 22 bp, Homo sapiens
tatggtaatagctttagtgaat

SEQ ID NO: 588406 - DNA, 16 bp, Homo sapiens
tatgtaaataactcta

SEQ ID NO: 588407 - DNA, 17 bp, Homo sapiens
tatgtaggtaagactgt

SEQ ID NO: 588408 - DNA, 21 bp, Homo sapiens
tattaaaaaacaattaactgc

SEQ ID NO: 588409 - DNA, 12 bp, Homo sapiens
tattaaaactaa

SEQ ID NO: 588410 - DNA, 22 bp, Homo sapiens
tattaatattcagggtaaatag

SEQ ID NO: 588411 - DNA, 17 bp, Homo sapiens
tattaatgttttcaaaa

SEQ ID NO: 588412 - DNA, 18 bp, Homo sapiens
tattatgtaggtaagact

SEQ ID NO: 588413 - DNA, 13 bp, Homo sapiens
tattcgcccaccc

SEQ ID NO: 588414 - DNA, 16 bp, Homo sapiens
tattctagcctgcatt

SEQ ID NO: 588415 - DNA, 19 bp, Homo sapiens
tattctataaaactctgca

SEQ ID NO: 588416 - DNA, 14 bp, Homo sapiens
tattgaatgttaaa

SEQ ID NO: 588417 - DNA, 14 bp, Homo sapiens
tattgaccattttt

SEQ ID NO: 588418 - DNA, 22 bp, Homo sapiens
tattgattgggaaaacatttgc

SEQ ID NO: 588419 - DNA, 11 bp, Homo sapiens
tattgcaatgc

SEQ ID NO: 588420 - DNA, 19 bp, Homo sapiens
tattgctgtgtaacactgt

SEQ ID NO: 588421 - DNA, 19 bp, Homo sapiens
tattgtaatctatgtttat

SEQ ID NO: 588422 - DNA, 21 bp, Homo sapiens
tatttcaggcattggatattt

SEQ ID NO: 588423 - DNA, 19 bp, Homo sapiens
tatttctatatagacttgg

SEQ ID NO: 588424 - DNA, 14 bp, Homo sapiens
tatttgttcattat

SEQ ID NO: 588425 - DNA, 20 bp, Homo sapiens
tatttgttcattatttgtgc

SEQ ID NO: 588426 - DNA, 20 bp, Homo sapiens
tattttcatgaaaataccat

SEQ ID NO: 588427 - DNA, 13 bp, Homo sapiens
tattttgaaatga

SEQ ID NO: 588428 - DNA, 18 bp, Homo sapiens
tattttgaaatgaacttt

SEQ ID NO: 588429 - DNA, 22 bp, Homo sapiens
tatttttgtgaagtattcacaa

SEQ ID NO: 588430 - DNA, 15 bp, Homo sapiens
tatttttttaaaatt

SEQ ID NO: 588431 - DNA, 19 bp, Homo sapiens
tatttttttaactgtgata

SEQ ID NO: 588432 - DNA, 16 bp, Homo sapiens
tattttttttttcttc

SEQ ID NO: 588433 - DNA, 17 bp, Homo sapiens
tattttttttttcttct

SEQ ID NO: 588434 - DNA, 21 bp, Homo sapiens
tcaaaaggtattatacatgtg

SEQ ID NO: 588435 - DNA, 18 bp, Homo sapiens
tcaaagatgcgtttgcct

SEQ ID NO: 588436 - DNA, 22 bp, Homo sapiens
tcaaagatgcgtttgcctcctg

SEQ ID NO: 588437 - DNA, 14 bp, Homo sapiens
tcaaatacacattt

SEQ ID NO: 588438 - DNA, 17 bp, Homo sapiens
tcaaatacacatttgct

SEQ ID NO: 588439 - DNA, 17 bp, Homo sapiens
tcaaatgtgtgtggcag

SEQ ID NO: 588440 - DNA, 20 bp, Homo sapiens
tcaacaaagaaacaaagatg

SEQ ID NO: 588441 - DNA, 21 bp, Homo sapiens
tcaacaaagaaacaaagatgt

SEQ ID NO: 588442 - DNA, 21 bp, Homo sapiens
tcaacggaaagtgctgtctta

SEQ ID NO: 588443 - DNA, 16 bp, Homo sapiens
tcaaggacattggtga

SEQ ID NO: 588444 - DNA, 17 bp, Homo sapiens
tcaaggctcttcttcct

SEQ ID NO: 588445 - DNA, 18 bp, Homo sapiens
tcaaggctcttcttcctc

SEQ ID NO: 588446 - DNA, 20 bp, Homo sapiens
tcaatgtctaaaaacatttg

SEQ ID NO: 588447 - DNA, 17 bp, Homo sapiens
tcacaaagtggaacgaa

SEQ ID NO: 588448 - DNA, 13 bp, Homo sapiens
tcacacccctgcc

SEQ ID NO: 588449 - DNA, 18 bp, Homo sapiens
tcacagatcgcatttcct

SEQ ID NO: 588450 - DNA, 20 bp, Homo sapiens
tcacatctatccacactgtc

SEQ ID NO: 588451 - DNA, 22 bp, Homo sapiens
tcacattcctctgcccttcctg

SEQ ID NO: 588452 - DNA, 18 bp, Homo sapiens
tcactgtatcattttctt

SEQ ID NO: 588453 - DNA, 14 bp, Homo sapiens
tcagaaaaccactt

SEQ ID NO: 588454 - DNA, 18 bp, Homo sapiens
tcagaatttttaactgta

SEQ ID NO: 588455 - DNA, 12 bp, Homo sapiens
tcagacagcagg

SEQ ID NO: 588456 - DNA, 13 bp, Homo sapiens
tcagacagcagga

SEQ ID NO: 588457 - DNA, 20 bp, Homo sapiens
tcagagggcccaaatggcag

SEQ ID NO: 588458 - DNA, 21 bp, Homo sapiens
tcagcaagttagaactagcca

SEQ ID NO: 588459 - DNA, 22 bp, Homo sapiens
tcagccaggcaagaaagcttcc

SEQ ID NO: 588460 - DNA, 18 bp, Homo sapiens
tcagcctgctttcctgca

SEQ ID NO: 588461 - DNA, 13 bp, Homo sapiens
tcagctgagcatg

SEQ ID NO: 588462 - DNA, 16 bp, Homo sapiens
tcagctgagcatggag

SEQ ID NO: 588463 - DNA, 22 bp, Homo sapiens
tcagctgagcatggagacagca

SEQ ID NO: 588464 - DNA, 15 bp, Homo sapiens
tcagctgctgttgaa

SEQ ID NO: 588465 - DNA, 23 bp, Homo sapiens
tcagctgctgttgaactttttaa

SEQ ID NO: 588466 - DNA, 16 bp, Homo sapiens
tcaggacttgaaagaa

SEQ ID NO: 588467 - DNA, 18 bp, Homo sapiens
tcagggcctttctcctcc

SEQ ID NO: 588468 - DNA, 22 bp, Homo sapiens
tcagtaacccccttaaatttaa

SEQ ID NO: 588469 - DNA, 17 bp, Homo sapiens
tcagtagcatctcagtg

SEQ ID NO: 588470 - DNA, 14 bp, Homo sapiens
tcagtatttccttc

SEQ ID NO: 588471 - DNA, 16 bp, Homo sapiens
tcagtatttccttcca

SEQ ID NO: 588472 - DNA, 19 bp, Homo sapiens
tcagtatttccttccactg

SEQ ID NO: 588473 - DNA, 15 bp, Homo sapiens
tcagtgtgtaaataa

SEQ ID NO: 588474 - DNA, 13 bp, Homo sapiens
tcagttgcttgtc

SEQ ID NO: 588475 - DNA, 22 bp, Homo sapiens
tcagtttaatgtctcctttgct

SEQ ID NO: 588476 - DNA, 18 bp, Homo sapiens
tcatagtaagtgcgaaga

SEQ ID NO: 588477 - DNA, 19 bp, Homo sapiens
taacagtcttactgcaggc

SEQ ID NO: 588478 - DNA, 21 bp, Homo sapiens
taacattcaggaattcttgga

SEQ ID NO: 588479 - DNA, 18 bp, Homo sapiens
taaccagctcagtgtttt

SEQ ID NO: 588480 - DNA, 19 bp, Homo sapiens
taacccccttaaatttaat

SEQ ID NO: 588481 - DNA, 18 bp, Homo sapiens
taactatcttctttggac

SEQ ID NO: 588482 - DNA, 15 bp, Homo sapiens
taactcaaatacaca

SEQ ID NO: 588483 - DNA, 12 bp, Homo sapiens
taactgtgataa

SEQ ID NO: 588484 - DNA, 15 bp, Homo sapiens
taactgttgcacttt

SEQ ID NO: 588485 - DNA, 23 bp, Homo sapiens
taactgttgcacttttgaatgtc

SEQ ID NO: 588486 - DNA, 16 bp, Homo sapiens
taacttctcatgtata

SEQ ID NO: 588487 - DNA, 13 bp, Homo sapiens
taactttccagtc

SEQ ID NO: 588488 - DNA, 18 bp, Homo sapiens
taagaaccattgatttaa

SEQ ID NO: 588489 - DNA, 13 bp, Homo sapiens
taagaattctgat

SEQ ID NO: 588490 - DNA, 18 bp, Homo sapiens
taagaattctgattgatt

SEQ ID NO: 588491 - DNA, 13 bp, Homo sapiens
taagaccagcctg

SEQ ID NO: 588492 - DNA, 14 bp, Homo sapiens
taagaccagcctgg

SEQ ID NO: 588493 - DNA, 14 bp, Homo sapiens
taagccttcaaaac

SEQ ID NO: 588494 - DNA, 16 bp, Homo sapiens
taagcttccattttaa

SEQ ID NO: 588495 - DNA, 20 bp, Homo sapiens
taagttttactgataatttg

SEQ ID NO: 588496 - DNA, 15 bp, Homo sapiens
taataagcactgtaa

SEQ ID NO: 588497 - DNA, 17 bp, Homo sapiens
taataatgtaacatgat

SEQ ID NO: 588498 - DNA, 20 bp, Homo sapiens
taatagctttagtgaattaa

SEQ ID NO: 588499 - DNA, 23 bp, Homo sapiens
taataggaacaatctttgctgta

SEQ ID NO: 588500 - DNA, 16 bp, Homo sapiens
taatcttcaaagcctt

SEQ ID NO: 588501 - DNA, 21 bp, Homo sapiens
taatgatcagcaaaaagactg

SEQ ID NO: 588502 - DNA, 13 bp, Homo sapiens
taatgtaacatga

SEQ ID NO: 588503 - DNA, 13 bp, Homo sapiens
taatgttttcaaa

SEQ ID NO: 588504 - DNA, 22 bp, Homo sapiens
taattgtacaaaattaagcaaa

SEQ ID NO: 588505 - DNA, 14 bp, Homo sapiens
taattgtgtggatt

SEQ ID NO: 588506 - DNA, 12 bp, Homo sapiens
taatttaaatga

SEQ ID NO: 588507 - DNA, 15 bp, Homo sapiens
taatttgaactttgg

SEQ ID NO: 588508 - DNA, 20 bp, Homo sapiens
tacaaaaattatgcaattca

SEQ ID NO: 588509 - DNA, 21 bp, Homo sapiens
tacacatttgctactgttgta

SEQ ID NO: 588510 - DNA, 13 bp, Homo sapiens
tacagccttattt

SEQ ID NO: 588511 - DNA, 23 bp, Homo sapiens
tacagggcaaaagggcagctgtg

SEQ ID NO: 588512 - DNA, 22 bp, Homo sapiens
tacagggcgagactctgtctca

SEQ ID NO: 588513 - DNA, 20 bp, Homo sapiens
tacagttttaactgtggata

SEQ ID NO: 588514 - DNA, 17 bp, Homo sapiens
tacatcaatatgtatat

SEQ ID NO: 588515 - DNA, 18 bp, Homo sapiens
tacatgtgatacattttt

SEQ ID NO: 588516 - DNA, 15 bp, Homo sapiens
tacatgttcccaaaa

SEQ ID NO: 588517 - DNA, 15 bp, Homo sapiens
tacattttttaagct

SEQ ID NO: 588518 - DNA, 17 bp, Homo sapiens
taccacatcaaataaga

SEQ ID NO: 588519 - DNA, 15 bp, Homo sapiens
taccatatgaatgaa

SEQ ID NO: 588520 - DNA, 19 bp, Homo sapiens
taccatatgaatgaaacat

SEQ ID NO: 588521 - DNA, 18 bp, Homo sapiens
taccatgcttcacaatgt

SEQ ID NO: 588522 - DNA, 15 bp, Homo sapiens
tacccaaactgcttt

SEQ ID NO: 588523 - DNA, 16 bp, Homo sapiens
tacccatagacatgaa

SEQ ID NO: 588524 - DNA, 18 bp, Homo sapiens
tacccatagacatgaaag

SEQ ID NO: 588525 - DNA, 15 bp, Homo sapiens
taccccttcctgtcc

SEQ ID NO: 588526 - DNA, 16 bp, Homo sapiens
taccccttcctgtcct

SEQ ID NO: 588527 - DNA, 17 bp, Homo sapiens
taccccttcctgtcctg

SEQ ID NO: 588528 - DNA, 21 bp, Homo sapiens
taccccttcctgtcctgcctc

SEQ ID NO: 588529 - DNA, 23 bp, Homo sapiens
taccccttcctgtcctgcctcct

SEQ ID NO: 588530 - DNA, 18 bp, Homo sapiens
taccctgggaagctgccg

SEQ ID NO: 588531 - DNA, 16 bp, Homo sapiens
tacctactggtgtaat

SEQ ID NO: 588532 - DNA, 22 bp, Homo sapiens
tacctccagtcacactccccgc

SEQ ID NO: 588533 - DNA, 11 bp, Homo sapiens
tacctccctcc

SEQ ID NO: 588534 - DNA, 12 bp, Homo sapiens
tacctgtggata

SEQ ID NO: 588535 - DNA, 19 bp, Homo sapiens
taccttcaaggctcttctt

SEQ ID NO: 588536 - DNA, 20 bp, Homo sapiens
taccttttttttttcttggt

SEQ ID NO: 588537 - DNA, 16 bp, Homo sapiens
tactaaaaaaaagatg

SEQ ID NO: 588538 - DNA, 16 bp, Homo sapiens
tactaaggacgttgtt

SEQ ID NO: 588539 - DNA, 19 bp, Homo sapiens
tactattcaggtaacacta

SEQ ID NO: 588540 - DNA, 21 bp, Homo sapiens
tactctccttgagtgtatgag

SEQ ID NO: 588541 - DNA, 16 bp, Homo sapiens
tactgaaccaggccag

SEQ ID NO: 588542 - DNA, 13 bp, Homo sapiens
tactgaatctgct

SEQ ID NO: 588543 - DNA, 15 bp, Homo sapiens
tactgcaatcactgt

SEQ ID NO: 588544 - DNA, 18 bp, Homo sapiens
tactgccaaaacatttat

SEQ ID NO: 588545 - DNA, 20 bp, Homo sapiens
tactggtgtaatctcaatgc

SEQ ID NO: 588546 - DNA, 15 bp, Homo sapiens
tactgtatattcagg

SEQ ID NO: 588547 - DNA, 17 bp, Homo sapiens
tactgtctattaatatt

SEQ ID NO: 588548 - DNA, 18 bp, Homo sapiens
tactgtctattaatattc

SEQ ID NO: 588549 - DNA, 21 bp, Homo sapiens
tacttaaatggtaataagcac

SEQ ID NO: 588550 - DNA, 23 bp, Homo sapiens
tacttaaatggtaataagcactg

SEQ ID NO: 588551 - DNA, 24 bp, Homo sapiens
tacttaaatggtaataagcactgt

SEQ ID NO: 588552 - DNA, 16 bp, Homo sapiens
tacttccctcttgaaa

SEQ ID NO: 588553 - DNA, 21 bp, Homo sapiens
tactttagaagcctgcataat

SEQ ID NO: 588554 - DNA, 21 bp, Homo sapiens
tacttttaaaaaatactctgc

SEQ ID NO: 588555 - DNA, 12 bp, Homo sapiens
tagaagcctgca

SEQ ID NO: 588556 - DNA, 12 bp, Homo sapiens
tagaatgatcta

SEQ ID NO: 588557 - DNA, 17 bp, Homo sapiens
tagaatgatctattgct

SEQ ID NO: 588558 - DNA, 18 bp, Homo sapiens
tagaatgatctattgctc

SEQ ID NO: 588559 - DNA, 22 bp, Homo sapiens
tagaattataactgtaaagatg

SEQ ID NO: 588560 - DNA, 17 bp, Homo sapiens
tagaatttaatatatat

SEQ ID NO: 588561 - DNA, 11 bp, Homo sapiens
tagacatgaaa

SEQ ID NO: 588562 - DNA, 22 bp, Homo sapiens
tagactctgtctacctggtctg

SEQ ID NO: 588563 - DNA, 18 bp, Homo sapiens
tagacttggagaatactg

SEQ ID NO: 588564 - DNA, 15 bp, Homo sapiens
tagataatattgttt

SEQ ID NO: 588565 - DNA, 15 bp, Homo sapiens
tagatatgaaagctg

SEQ ID NO: 588566 - DNA, 18 bp, Homo sapiens
tagatccatttccattgc

SEQ ID NO: 588567 - DNA, 21 bp, Homo sapiens
tagatccatttccattgctta

SEQ ID NO: 588568 - DNA, 16 bp, Homo sapiens
tagatgggaggatgaa

SEQ ID NO: 588569 - DNA, 20 bp, Homo sapiens
tagccaaaaatgtctaaaag

SEQ ID NO: 588570 - DNA, 18 bp, Homo sapiens
tagctattagcggctcct

SEQ ID NO: 588571 - DNA, 19 bp, Homo sapiens
tagctattagcggctcctc

SEQ ID NO: 588572 - DNA, 19 bp, Homo sapiens
tagctcctccccttcctct

SEQ ID NO: 588573 - DNA, 15 bp, Homo sapiens
tagctgaagaattga

SEQ ID NO: 588574 - DNA, 17 bp, Homo sapiens
tagctgaagaattgaaa

SEQ ID NO: 588575 - DNA, 22 bp, Homo sapiens
tagctgaagaattgaaaagttt

SEQ ID NO: 588576 - DNA, 16 bp, Homo sapiens
tagctgaggctgagaa

SEQ ID NO: 588577 - DNA, 22 bp, Homo sapiens
tagctgtgtgaatacctgctca

SEQ ID NO: 588578 - DNA, 14 bp, Homo sapiens
tagcttcagccagg

SEQ ID NO: 588579 - DNA, 17 bp, Homo sapiens
taggaatcattcagaaa

SEQ ID NO: 588580 - DNA, 20 bp, Homo sapiens
taggaatcattcagaaatgt

SEQ ID NO: 588581 - DNA, 21 bp, Homo sapiens
taggccacagaaggtgaactt

SEQ ID NO: 588582 - DNA, 19 bp, Homo sapiens
tagggactacccatagaca

SEQ ID NO: 588583 - DNA, 17 bp, Homo sapiens
tagggcctcagtctgga

SEQ ID NO: 588584 - DNA, 14 bp, Homo sapiens
tcagcattgtaatt

SEQ ID NO: 588585 - DNA, 18 bp, Homo sapiens
tcagctgagcatggagac

SEQ ID NO: 588586 - DNA, 18 bp, Homo sapiens
tcagctgctgttgaactt

SEQ ID NO: 588587 - DNA, 19 bp, Homo sapiens
tcagctgctgttgaacttt

SEQ ID NO: 588588 - DNA, 18 bp, Homo sapiens
tcaggaattcttggagaa

SEQ ID NO: 588589 - DNA, 11 bp, Homo sapiens
tcaggctccta

SEQ ID NO: 588590 - DNA, 20 bp, Homo sapiens
tgctactgttgtaagaattc

SEQ ID NO: 588591 - DNA, 20 bp, Homo sapiens
tgctagggttaggaggtcct

SEQ ID NO: 588592 - DNA, 14 bp, Homo sapiens
tgctatacacacac

SEQ ID NO: 588593 - DNA, 15 bp, Homo sapiens
tgctatacacacaca

SEQ ID NO: 588594 - DNA, 20 bp, Homo sapiens
tgctatcggcagatgatgct

SEQ ID NO: 588595 - DNA, 17 bp, Homo sapiens
tgctccaatgactgagc

SEQ ID NO: 588596 - DNA, 22 bp, Homo sapiens
tgctgataccatatgaatgaaa

SEQ ID NO: 588597 - DNA, 15 bp, Homo sapiens
tgctgatggagcctt

SEQ ID NO: 588598 - DNA, 16 bp, Homo sapiens
tgctgatggagccttc

SEQ ID NO: 588599 - DNA, 17 bp, Homo sapiens
tgctgatggagccttcc

SEQ ID NO: 588600 - DNA, 15 bp, Homo sapiens
tgctgggcagaggga

SEQ ID NO: 588601 - DNA, 11 bp, Homo sapiens
tgctggggaca

SEQ ID NO: 588602 - DNA, 12 bp, Homo sapiens
tgctgggtccca

SEQ ID NO: 588603 - DNA, 16 bp, Homo sapiens
tgctgggtcccagcct

SEQ ID NO: 588604 - DNA, 16 bp, Homo sapiens
tgctgtgtaacactgt

SEQ ID NO: 588605 - DNA, 22 bp, Homo sapiens
tgctgttgaactttttaaagaa

SEQ ID NO: 588606 - DNA, 14 bp, Homo sapiens
tgcttaatcttcaa

SEQ ID NO: 588607 - DNA, 15 bp, Homo sapiens
tgcttaatcttcaaa

SEQ ID NO: 588608 - DNA, 15 bp, Homo sapiens
tgcttaattgctgat

SEQ ID NO: 588609 - DNA, 15 bp, Homo sapiens
tgcttcccttacttt

SEQ ID NO: 588610 - DNA, 22 bp, Homo sapiens
tgcttgtcttctggtactttct

SEQ ID NO: 588611 - DNA, 23 bp, Homo sapiens
tgctttattaatgttttcaaaag

SEQ ID NO: 588612 - DNA, 21 bp, Homo sapiens
tgctttttccaactcagaaat

SEQ ID NO: 588613 - DNA, 13 bp, Homo sapiens
tggaaaaaacatt

SEQ ID NO: 588614 - DNA, 22 bp, Homo sapiens
tggaagatgcagaagcaataat

SEQ ID NO: 588615 - DNA, 15 bp, Homo sapiens
tggaatggatttttc

SEQ ID NO: 588616 - DNA, 18 bp, Homo sapiens
tggacctgccccggacct

SEQ ID NO: 588617 - DNA, 23 bp, Homo sapiens
tggacctgccccggacctacctc

SEQ ID NO: 588618 - DNA, 15 bp, Homo sapiens
tggacttctgaagag

SEQ ID NO: 588619 - DNA, 22 bp, Homo sapiens
tggagaaaatgggtttattcac

SEQ ID NO: 588620 - DNA, 12 bp, Homo sapiens
tggagaatactg

SEQ ID NO: 588621 - DNA, 13 bp, Homo sapiens
tggagaatactgc

SEQ ID NO: 588622 - DNA, 18 bp, Homo sapiens
tggagaatactgccaaaa

SEQ ID NO: 588623 - DNA, 13 bp, Homo sapiens
tggagacagcagt

SEQ ID NO: 588624 - DNA, 17 bp, Homo sapiens
tggagacagcagtttcc

SEQ ID NO: 588625 - DNA, 18 bp, Homo sapiens
tggagccattgaacagct

SEQ ID NO: 588626 - DNA, 20 bp, Homo sapiens
tggagggaaacaccaaactc

SEQ ID NO: 588627 - DNA, 14 bp, Homo sapiens
tggatattgttacg

SEQ ID NO: 588628 - DNA, 19 bp, Homo sapiens
tggatcctcagttctcaaa

SEQ ID NO: 588629 - DNA, 17 bp, Homo sapiens
tggatgttgtaaataaa

SEQ ID NO: 588630 - DNA, 17 bp, Homo sapiens
tggattgcagactgttc

SEQ ID NO: 588631 - DNA, 16 bp, Homo sapiens
tggattgcctctgaaa

SEQ ID NO: 588632 - DNA, 16 bp, Homo sapiens
tggatttaaaagcctg

SEQ ID NO: 588633 - DNA, 18 bp, Homo sapiens
tggatttaaaagcctgct

SEQ ID NO: 588634 - DNA, 20 bp, Homo sapiens
tggatttaaaagcctgctca

SEQ ID NO: 588635 - DNA, 13 bp, Homo sapiens
tggatttgcagaa

SEQ ID NO: 588636 - DNA, 23 bp, Homo sapiens
tggcacagaggtagtctcactgc

SEQ ID NO: 588637 - DNA, 15 bp, Homo sapiens
tggcataaattgcat

SEQ ID NO: 588638 - DNA, 15 bp, Homo sapiens
tggcatttccctact

SEQ ID NO: 588639 - DNA, 16 bp, Homo sapiens
tggccagggaggcagc

SEQ ID NO: 588640 - DNA, 16 bp, Homo sapiens
tggcctatgtggtcta

SEQ ID NO: 588641 - DNA, 19 bp, Homo sapiens
tggcctatgtggtctaagg

SEQ ID NO: 588642 - DNA, 18 bp, Homo sapiens
tggccttgtaagaccctt

SEQ ID NO: 588643 - DNA, 18 bp, Homo sapiens
tggctgccgttttctggg

SEQ ID NO: 588644 - DNA, 21 bp, Homo sapiens
tgggaaaacatgttaatgaca

SEQ ID NO: 588645 - DNA, 16 bp, Homo sapiens
tgggacaggaaagaga

SEQ ID NO: 588646 - DNA, 19 bp, Homo sapiens
tgggaggtatgggctgggg

SEQ ID NO: 588647 - DNA, 22 bp, Homo sapiens
tgggaggtatgggctgggggct

SEQ ID NO: 588648 - DNA, 18 bp, Homo sapiens
tgggatattgaatgttaa

SEQ ID NO: 588649 - DNA, 13 bp, Homo sapiens
tgggattagaaac

SEQ ID NO: 588650 - DNA, 22 bp, Homo sapiens
tgggatttccagaaccacactt

SEQ ID NO: 588651 - DNA, 14 bp, Homo sapiens
tgggcactggggcc

SEQ ID NO: 588652 - DNA, 21 bp, Homo sapiens
tgggcagccagaccagcaggc

SEQ ID NO: 588653 - DNA, 18 bp, Homo sapiens
tgggccacctcctacccc

SEQ ID NO: 588654 - DNA, 12 bp, Homo sapiens
tgggctcctctt

SEQ ID NO: 588655 - DNA, 20 bp, Homo sapiens
tgggcttttggggagccaga

SEQ ID NO: 588656 - DNA, 21 bp, Homo sapiens
tgggcttttggggagccagaa

SEQ ID NO: 588657 - DNA, 19 bp, Homo sapiens
tggggaacggaggaggaca

SEQ ID NO: 588658 - DNA, 14 bp, Homo sapiens
tggggactcctcaa

SEQ ID NO: 588659 - DNA, 23 bp, Homo sapiens
tggggccataaacggttcctggt

SEQ ID NO: 588660 - DNA, 16 bp, Homo sapiens
tggggcctcagcctgc

SEQ ID NO: 588661 - DNA, 14 bp, Homo sapiens
tggggcctcaggct

SEQ ID NO: 588662 - DNA, 15 bp, Homo sapiens
tggggcctcaggctc

SEQ ID NO: 588663 - DNA, 15 bp, Homo sapiens
tggggctgagccctc

SEQ ID NO: 588664 - DNA, 14 bp, Homo sapiens
tgggtcccagcctg

SEQ ID NO: 588665 - DNA, 15 bp, Homo sapiens
tgggtcccagcctgg

SEQ ID NO: 588666 - DNA, 21 bp, Homo sapiens
tgggtctaggacacagttcct

SEQ ID NO: 588667 - DNA, 22 bp, Homo sapiens
tgggtctaggacacagttcctg

SEQ ID NO: 588668 - DNA, 20 bp, Homo sapiens
tgggtgccctttcctggcag

SEQ ID NO: 588669 - DNA, 13 bp, Homo sapiens
tggtaaatgtttc

SEQ ID NO: 588670 - DNA, 16 bp, Homo sapiens
tggtaataagcactgt

SEQ ID NO: 588671 - DNA, 21 bp, Homo sapiens
tggtaatcccctaaaataaca

SEQ ID NO: 588672 - DNA, 12 bp, Homo sapiens
tggtaattcact

SEQ ID NO: 588673 - DNA, 18 bp, Homo sapiens
tggtatggggctgagccc

SEQ ID NO: 588674 - DNA, 19 bp, Homo sapiens
tggtccctcttctctcctc

SEQ ID NO: 588675 - DNA, 20 bp, Homo sapiens
tggtcctatttttgtgaaga

SEQ ID NO: 588676 - DNA, 22 bp, Homo sapiens
tggtcctatttttgtgaagagg

SEQ ID NO: 588677 - DNA, 18 bp, Homo sapiens
tggtctgccaatctgtac

SEQ ID NO: 588678 - DNA, 16 bp, Homo sapiens
tggtctggttgggcag

SEQ ID NO: 588679 - DNA, 17 bp, Homo sapiens
tggtctggttgggcagc

SEQ ID NO: 588680 - DNA, 19 bp, Homo sapiens
tggtgaatgtgtgagaaaa

SEQ ID NO: 588681 - DNA, 16 bp, Homo sapiens
tggtgtaatctcaatg

SEQ ID NO: 588682 - DNA, 18 bp, Homo sapiens
tggtgtaatctcaatgca

SEQ ID NO: 588683 - DNA, 21 bp, Homo sapiens
tggtgtaatctcaatgcaagc

SEQ ID NO: 588684 - DNA, 16 bp, Homo sapiens
tggtgtcattctgcct

SEQ ID NO: 588685 - DNA, 13 bp, Homo sapiens
tggtgtccagctg

SEQ ID NO: 588686 - DNA, 16 bp, Homo sapiens
tggtgtggtgaatgtg

SEQ ID NO: 588687 - DNA, 14 bp, Homo sapiens
tggtgtgtgaagtt

SEQ ID NO: 588688 - DNA, 16 bp, Homo sapiens
tggttgggaatgagga

SEQ ID NO: 588689 - DNA, 23 bp, Homo sapiens
tggttgggaatgaggaaaattct

SEQ ID NO: 588690 - DNA, 19 bp, Homo sapiens
tgtaaataaaactatttat

SEQ ID NO: 588691 - DNA, 19 bp, Homo sapiens
tgtaaatgaagatctttat

SEQ ID NO: 588692 - DNA, 11 bp, Homo sapiens
tgtaacactgt

SEQ ID NO: 588693 - DNA, 18 bp, Homo sapiens
tgtaaccagctcagtgtt

SEQ ID NO: 588694 - DNA, 21 bp, Homo sapiens
tgtaagaacaactacctgagc

SEQ ID NO: 588695 - DNA, 17 bp, Homo sapiens
tgtaagaattctgattg

SEQ ID NO: 588696 - DNA, 18 bp, Homo sapiens
tgtaagacccttattgct

SEQ ID NO: 588697 - DNA, 21 bp, Homo sapiens
tgtaaggatccggaaagaaga

SEQ ID NO: 588698 - DNA, 17 bp, Homo sapiens
tgtaataatgtaacatg

SEQ ID NO: 588699 - DNA, 22 bp, Homo sapiens
tgtaataatgtaacatgatttc

SEQ ID NO: 588700 - DNA, 17 bp, Homo sapiens
tgtaatctatgtttata

SEQ ID NO: 588701 - DNA, 16 bp, Homo sapiens
tgtaattatgtaaata

SEQ ID NO: 588702 - DNA, 16 bp, Homo sapiens
tgtaattgtgtggatt

SEQ ID NO: 588703 - DNA, 16 bp, Homo sapiens
tgtaatttaaatgaaa

SEQ ID NO: 588704 - DNA, 20 bp, Homo sapiens
tgtacaaaaattatgcaatt

SEQ ID NO: 588705 - DNA, 14 bp, Homo sapiens
tgtacaaaatggtc

SEQ ID NO: 588706 - DNA, 13 bp, Homo sapiens
tgtacaaaattaa

SEQ ID NO: 588707 - DNA, 16 bp, Homo sapiens
tgtacaaaattaagca

SEQ ID NO: 588708 - DNA, 19 bp, Homo sapiens
tgtacaaaattaagcaaat

SEQ ID NO: 588709 - DNA, 22 bp, Homo sapiens
tgtacacatgggagtttagtgt

SEQ ID NO: 588710 - DNA, 20 bp, Homo sapiens
tgtacagaccacctttcaca

SEQ ID NO: 588711 - DNA, 16 bp, Homo sapiens
tgtactaactagcatt

SEQ ID NO: 588712 - DNA, 15 bp, Homo sapiens
tgtacttaaatggta

SEQ ID NO: 588713 - DNA, 19 bp, Homo sapiens
tgtagaggcataaacctgt

SEQ ID NO: 588714 - DNA, 16 bp, Homo sapiens
tgtagcatcttcctct

SEQ ID NO: 588715 - DNA, 18 bp, Homo sapiens
tgtagcatcttcctctgc

SEQ ID NO: 588716 - DNA, 19 bp, Homo sapiens
tgtagcatcttcctctgca

SEQ ID NO: 588717 - DNA, 21 bp, Homo sapiens
tgtagctattagcggctcctc

SEQ ID NO: 588718 - DNA, 14 bp, Homo sapiens
agacgccttactgg

SEQ ID NO: 588719 - DNA, 14 bp, Homo sapiens
agacttcccagctt

SEQ ID NO: 588720 - DNA, 18 bp, Homo sapiens
agacttcccagcttctgc

SEQ ID NO: 588721 - DNA, 22 bp, Homo sapiens
agacttgaaatacgtttgtgtt

SEQ ID NO: 588722 - DNA, 22 bp, Homo sapiens
agacttggagaatactgccaaa

SEQ ID NO: 588723 - DNA, 14 bp, Homo sapiens
agagacagcccagg

SEQ ID NO: 588724 - DNA, 19 bp, Homo sapiens
agagagtggagagagcagg

SEQ ID NO: 588725 - DNA, 22 bp, Homo sapiens
agagagtggagagagcagggct

SEQ ID NO: 588726 - DNA, 19 bp, Homo sapiens
agagagttctggatgtctg

SEQ ID NO: 588727 - DNA, 16 bp, Homo sapiens
agagcaaacagaaaaa

SEQ ID NO: 588728 - DNA, 21 bp, Homo sapiens
agagcaggacctgggacagga

SEQ ID NO: 588729 - DNA, 20 bp, Homo sapiens
agagcagggctaaataaaga

SEQ ID NO: 588730 - DNA, 18 bp, Homo sapiens
agagccctgaggcctaga

SEQ ID NO: 588731 - DNA, 16 bp, Homo sapiens
agagctgctgcacaca

SEQ ID NO: 588732 - DNA, 18 bp, Homo sapiens
agagcttgtggtggggca

SEQ ID NO: 588733 - DNA, 17 bp, Homo sapiens
agaggagataaggtggc

SEQ ID NO: 588734 - DNA, 17 bp, Homo sapiens
agagggaaaacagaaaa

SEQ ID NO: 588735 - DNA, 18 bp, Homo sapiens
agagggaaaacagaaaac

SEQ ID NO: 588736 - DNA, 23 bp, Homo sapiens
agagggacataagataaaatgat

SEQ ID NO: 588737 - DNA, 16 bp, Homo sapiens
agaggtattaaaacta

SEQ ID NO: 588738 - DNA, 22 bp, Homo sapiens
agagttgggtgtctccttaagc

SEQ ID NO: 588739 - DNA, 21 bp, Homo sapiens
agagtttcagtttgttggaaa

SEQ ID NO: 588740 - DNA, 15 bp, Homo sapiens
agataaggtggcttc

SEQ ID NO: 588741 - DNA, 15 bp, Homo sapiens
agatatgtattcttt

SEQ ID NO: 588742 - DNA, 12 bp, Homo sapiens
agatcaaagatg

SEQ ID NO: 588743 - DNA, 18 bp, Homo sapiens
agatccatttccattgct

SEQ ID NO: 588744 - DNA, 21 bp, Homo sapiens
agatccccaaaacaggccagg

SEQ ID NO: 588745 - DNA, 15 bp, Homo sapiens
agatctttatatttc

SEQ ID NO: 588746 - DNA, 14 bp, Homo sapiens
agatctttcagaaa

SEQ ID NO: 588747 - DNA, 21 bp, Homo sapiens
agatctttcagaaatataaca

SEQ ID NO: 588748 - DNA, 13 bp, Homo sapiens
agatgagggctgg

SEQ ID NO: 588749 - DNA, 16 bp, Homo sapiens
agatgatgctttggaa

SEQ ID NO: 588750 - DNA, 22 bp, Homo sapiens
agatgctacttcccactgtatg

SEQ ID NO: 588751 - DNA, 14 bp, Homo sapiens
agatgctggctggg

SEQ ID NO: 588752 - DNA, 11 bp, Homo sapiens
agattctgaag

SEQ ID NO: 588753 - DNA, 20 bp, Homo sapiens
agattctttcagttctttgg

SEQ ID NO: 588754 - DNA, 21 bp, Homo sapiens
agattctttcagttctttgga

SEQ ID NO: 588755 - DNA, 21 bp, Homo sapiens
agattgactaactcaaataca

SEQ ID NO: 588756 - DNA, 18 bp, Homo sapiens
agatttgggtcatttaga

SEQ ID NO: 588757 - DNA, 13 bp, Homo sapiens
agatttgtttcct

SEQ ID NO: 588758 - DNA, 14 bp, Homo sapiens
agcaaacagaaaaa

SEQ ID NO: 588759 - DNA, 23 bp, Homo sapiens
agcaattccatgctataaaaact

SEQ ID NO: 588760 - DNA, 17 bp, Homo sapiens
agcacaatttaaaacaa

SEQ ID NO: 588761 - DNA, 20 bp, Homo sapiens
agcagaaatgcccccattct

SEQ ID NO: 588762 - DNA, 15 bp, Homo sapiens
agcagacagccctgg

SEQ ID NO: 588763 - DNA, 16 bp, Homo sapiens
agcagcaggactgtgg

SEQ ID NO: 588764 - DNA, 21 bp, Homo sapiens
agcaggaagccatagatgctg

SEQ ID NO: 588765 - DNA, 22 bp, Homo sapiens
agcagggctaaataaagaggag

SEQ ID NO: 588766 - DNA, 15 bp, Homo sapiens
agcagtttccagaga

SEQ ID NO: 588767 - DNA, 16 bp, Homo sapiens
agcatagaaaccacta

SEQ ID NO: 588768 - DNA, 15 bp, Homo sapiens
agcatagataatatt

SEQ ID NO: 588769 - DNA, 14 bp, Homo sapiens
agcatcacccacct

SEQ ID NO: 588770 - DNA, 16 bp, Homo sapiens
agcatccaccccaccc

SEQ ID NO: 588771 - DNA, 13 bp, Homo sapiens
agcatggagacag

SEQ ID NO: 588772 - DNA, 15 bp, Homo sapiens
agcatggagacagca

SEQ ID NO: 588773 - DNA, 16 bp, Homo sapiens
agcatggagacagcag

SEQ ID NO: 588774 - DNA, 14 bp, Homo sapiens
agcatggggccagg

SEQ ID NO: 588775 - DNA, 19 bp, Homo sapiens
agcatgtgatgttgtctta

SEQ ID NO: 588776 - DNA, 22 bp, Homo sapiens
agcattgtaaaattatttcatg

SEQ ID NO: 588777 - DNA, 16 bp, Homo sapiens
agcattgtaattatgt

SEQ ID NO: 588778 - DNA, 16 bp, Homo sapiens
agccaagggcctcggg

SEQ ID NO: 588779 - DNA, 16 bp, Homo sapiens
tgacaaagcctctgaa

SEQ ID NO: 588780 - DNA, 20 bp, Homo sapiens
tgacaactcattttcatatt

SEQ ID NO: 588781 - DNA, 14 bp, Homo sapiens
tgacaattgggagc

SEQ ID NO: 588782 - DNA, 17 bp, Homo sapiens
tgacatttaatgccatc

SEQ ID NO: 588783 - DNA, 17 bp, Homo sapiens
tgaccagtgcctgtgag

SEQ ID NO: 588784 - DNA, 22 bp, Homo sapiens
tgaccattttttaatttacttg

SEQ ID NO: 588785 - DNA, 21 bp, Homo sapiens
tgaccctatgggtctaggaca

SEQ ID NO: 588786 - DNA, 11 bp, Homo sapiens
tgaccctgggc

SEQ ID NO: 588787 - DNA, 22 bp, Homo sapiens
tgacctggcatctaattctgat

SEQ ID NO: 588788 - DNA, 14 bp, Homo sapiens
tgacgatgatgtac

SEQ ID NO: 588789 - DNA, 20 bp, Homo sapiens
tgactaactcaaatacacat

SEQ ID NO: 588790 - DNA, 23 bp, Homo sapiens
tgactaactcaaatacacatttg

SEQ ID NO: 588791 - DNA, 12 bp, Homo sapiens
aaaaaaagatga

SEQ ID NO: 588792 - DNA, 11 bp, Homo sapiens
aaaaaagatga

SEQ ID NO: 588793 - DNA, 19 bp, Homo sapiens
aaaaacaattaactgccct

SEQ ID NO: 588794 - DNA, 17 bp, Homo sapiens
aaaaagcactagtataa

SEQ ID NO: 588795 - DNA, 21 bp, Homo sapiens
aaaaagctgcaaaaattatat

SEQ ID NO: 588796 - DNA, 12 bp, Homo sapiens
aaaacagaaaac

SEQ ID NO: 588797 - DNA, 12 bp, Homo sapiens
aaaacatttgct

SEQ ID NO: 588798 - DNA, 20 bp, Homo sapiens
aaaacattttaagttttact

SEQ ID NO: 588799 - DNA, 15 bp, Homo sapiens
aaaacgtgtaaatga

SEQ ID NO: 588800 - DNA, 20 bp, Homo sapiens
aaaagaaagatacttacatg

SEQ ID NO: 588801 - DNA, 17 bp, Homo sapiens
aaaagggtcagaaggat

SEQ ID NO: 588802 - DNA, 21 bp, Homo sapiens
aaaagtgtgtatatattttgt

SEQ ID NO: 588803 - DNA, 18 bp, Homo sapiens
aaaatatattttcagtac

SEQ ID NO: 588804 - DNA, 14 bp, Homo sapiens
aaaatccatgaaca

SEQ ID NO: 588805 - DNA, 23 bp, Homo sapiens
aaaatggtcctatttttgtgaag

SEQ ID NO: 588806 - DNA, 24 bp, Homo sapiens
aaaatggtcctatttttgtgaaga

SEQ ID NO: 588807 - DNA, 19 bp, Homo sapiens
aaaatgtaatttaaatgaa

SEQ ID NO: 588808 - DNA, 17 bp, Homo sapiens
aaacaaataatttgaac

SEQ ID NO: 588809 - DNA, 17 bp, Homo sapiens
aaacaagccccctgccc

SEQ ID NO: 588810 - DNA, 13 bp, Homo sapiens
aaacagacaaaac

SEQ ID NO: 588811 - DNA, 20 bp, Homo sapiens
aaacagacaaaacagataaa

SEQ ID NO: 588812 - DNA, 21 bp, Homo sapiens
aaacatgttaatgacaatatt

SEQ ID NO: 588813 - DNA, 16 bp, Homo sapiens
aaacatttatgacaag

SEQ ID NO: 588814 - DNA, 22 bp, Homo sapiens
aaaccacttaaacgaagagttc

SEQ ID NO: 588815 - DNA, 12 bp, Homo sapiens
aaaccacttgcc

SEQ ID NO: 588816 - DNA, 14 bp, Homo sapiens
aaaccacttgcctg

SEQ ID NO: 588817 - DNA, 17 bp, Homo sapiens
aaaccagagtctgtatt

SEQ ID NO: 588818 - DNA, 16 bp, Homo sapiens
aaacgattagtgatgt

SEQ ID NO: 588819 - DNA, 23 bp, Homo sapiens
aaacgtcctctttagtttttggt

SEQ ID NO: 588820 - DNA, 22 bp, Homo sapiens
aaactcgagaccataaagatat

SEQ ID NO: 588821 - DNA, 19 bp, Homo sapiens
aaactgttggaatggattt

SEQ ID NO: 588822 - DNA, 14 bp, Homo sapiens
aaacttaagaaaca

SEQ ID NO: 588823 - DNA, 20 bp, Homo sapiens
aaactttgggaaaacatgtt

SEQ ID NO: 588824 - DNA, 13 bp, Homo sapiens
aaagaaaattgag

SEQ ID NO: 588825 - DNA, 12 bp, Homo sapiens
aaagaccacctc

SEQ ID NO: 588826 - DNA, 13 bp, Homo sapiens
aaagaccacctcc

SEQ ID NO: 588827 - DNA, 12 bp, Homo sapiens
aaagagaatgag

SEQ ID NO: 588828 - DNA, 11 bp, Homo sapiens
aaagatgagtt

SEQ ID NO: 588829 - DNA, 21 bp, Homo sapiens
aaagatgcgtttgcctcctgg

SEQ ID NO: 588830 - DNA, 23 bp, Homo sapiens
aaagcaaacttaagaaacactga

SEQ ID NO: 588831 - DNA, 16 bp, Homo sapiens
aaagcttcacagtacc

SEQ ID NO: 588832 - DNA, 15 bp, Homo sapiens
aaaggcatgtacaaa

SEQ ID NO: 588833 - DNA, 13 bp, Homo sapiens
aaagggatatttt

SEQ ID NO: 588834 - DNA, 16 bp, Homo sapiens
aaagtaactgtgagaa

SEQ ID NO: 588835 - DNA, 13 bp, Homo sapiens
aaagtggaacgaa

SEQ ID NO: 588836 - DNA, 21 bp, Homo sapiens
aaagtgtgaaataaatttttt

SEQ ID NO: 588837 - DNA, 21 bp, Homo sapiens
aaagtgtgtatatattttgtg

SEQ ID NO: 588838 - DNA, 15 bp, Homo sapiens
aaagttctcaatgta

SEQ ID NO: 588839 - DNA, 17 bp, Homo sapiens
aaagtttggttttgaca

SEQ ID NO: 588840 - DNA, 17 bp, Homo sapiens
aaagttttatatgcttt

SEQ ID NO: 588841 - DNA, 14 bp, Homo sapiens
aaagttttgttgta

SEQ ID NO: 588842 - DNA, 12 bp, Homo sapiens
aaataacagtat

SEQ ID NO: 588843 - DNA, 20 bp, Homo sapiens
aaataatgctacaattttaa

SEQ ID NO: 588844 - DNA, 14 bp, Homo sapiens
aaataatttgaact

SEQ ID NO: 588845 - DNA, 19 bp, Homo sapiens
aaataatttgaactttgga

SEQ ID NO: 588846 - DNA, 20 bp, Homo sapiens
aaataatttgaactttggaa

SEQ ID NO: 588847 - DNA, 13 bp, Homo sapiens
aaatactctgcta

SEQ ID NO: 588848 - DNA, 20 bp, Homo sapiens
aaataggaatcattcagaaa

SEQ ID NO: 588849 - DNA, 17 bp, Homo sapiens
aaatccctgcctcaggc

SEQ ID NO: 588850 - DNA, 13 bp, Homo sapiens
aaatcttcccatg

SEQ ID NO: 588851 - DNA, 17 bp, Homo sapiens
aaatcttttgaagcata

SEQ ID NO: 588852 - DNA, 14 bp, Homo sapiens
aaatgaaagaaaat

SEQ ID NO: 588853 - DNA, 20 bp, Homo sapiens
aaatgaaagaaaattgagtt

SEQ ID NO: 588854 - DNA, 13 bp, Homo sapiens
aaatgaaagctac

SEQ ID NO: 588855 - DNA, 14 bp, Homo sapiens
aaatgaaagctact

SEQ ID NO: 588856 - DNA, 12 bp, Homo sapiens
aaatgatgttat

SEQ ID NO: 588857 - DNA, 21 bp, Homo sapiens
aaatggtcctatttttgtgaa

SEQ ID NO: 588858 - DNA, 14 bp, Homo sapiens
aaatgtaatttaaa

SEQ ID NO: 588859 - DNA, 17 bp, Homo sapiens
aaatgtaatttaaatga

SEQ ID NO: 588860 - DNA, 19 bp, Homo sapiens
aaatgtaatttaaatgaaa

SEQ ID NO: 588861 - DNA, 21 bp, Homo sapiens
aaatgtataaatatacagtat

SEQ ID NO: 588862 - DNA, 22 bp, Homo sapiens
aaatgtggtctgccaatctgta

SEQ ID NO: 588863 - DNA, 23 bp, Homo sapiens
aaatgttaaaagttttatatgct

SEQ ID NO: 588864 - DNA, 15 bp, Homo sapiens
aaatgtttcttttaa

SEQ ID NO: 588865 - DNA, 13 bp, Homo sapiens
aaattaagcaaat

SEQ ID NO: 588866 - DNA, 23 bp, Homo sapiens
aaattatatattgcaaggtgtga

SEQ ID NO: 588867 - DNA, 19 bp, Homo sapiens
aaattgagttgcacttatt

SEQ ID NO: 588868 - DNA, 17 bp, Homo sapiens
aaattgcatactttgta

SEQ ID NO: 588869 - DNA, 23 bp, Homo sapiens
aaattgcatactttgtattttga

SEQ ID NO: 588870 - DNA, 19 bp, Homo sapiens
aaatttaaaaaataaataa

SEQ ID NO: 588871 - DNA, 21 bp, Homo sapiens
aaatttaataccagatacctt

SEQ ID NO: 588872 - DNA, 18 bp, Homo sapiens
aaatttctgtaaaacagg

SEQ ID NO: 588873 - DNA, 12 bp, Homo sapiens
aaggtggcttct

SEQ ID NO: 588874 - DNA, 16 bp, Homo sapiens
aagtaaaagtagtgtt

SEQ ID NO: 588875 - DNA, 17 bp, Homo sapiens
aagtagtgttgtccagg

SEQ ID NO: 588876 - DNA, 11 bp, Homo sapiens
aagtattcaca

SEQ ID NO: 588877 - DNA, 17 bp, Homo sapiens
aagtcccttcctattct

SEQ ID NO: 588878 - DNA, 22 bp, Homo sapiens
aagtcccttcctattctcctgc

SEQ ID NO: 588879 - DNA, 17 bp, Homo sapiens
aagtctccagaagaaaa

SEQ ID NO: 588880 - DNA, 18 bp, Homo sapiens
aagtctccagaagaaaat

SEQ ID NO: 588881 - DNA, 15 bp, Homo sapiens
aagtctttcatggct

SEQ ID NO: 588882 - DNA, 14 bp, Homo sapiens
aagtgcatgaaaaa

SEQ ID NO: 588883 - DNA, 20 bp, Homo sapiens
aagtggaacgaaaatgaaag

SEQ ID NO: 588884 - DNA, 15 bp, Homo sapiens
aagtgtgtatatatt

SEQ ID NO: 588885 - DNA, 16 bp, Homo sapiens
aagtgtgtatatattt

SEQ ID NO: 588886 - DNA, 21 bp, Homo sapiens
aagtgtgtatatattttgtgt

SEQ ID NO: 588887 - DNA, 22 bp, Homo sapiens
aagttagaactagccaaaccag

SEQ ID NO: 588888 - DNA, 13 bp, Homo sapiens
aagttttatatgc

SEQ ID NO: 588889 - DNA, 12 bp, Homo sapiens
aataaaatttaa

SEQ ID NO: 588890 - DNA, 13 bp, Homo sapiens
aataaaatttaaa

SEQ ID NO: 588891 - DNA, 22 bp, Homo sapiens
aataaattttttataaaagtgt

SEQ ID NO: 588892 - DNA, 14 bp, Homo sapiens
aataacatgtttct

SEQ ID NO: 588893 - DNA, 15 bp, Homo sapiens
aataataaagtactt

SEQ ID NO: 588894 - DNA, 19 bp, Homo sapiens
aataatgctacaattttaa

SEQ ID NO: 588895 - DNA, 21 bp, Homo sapiens
aataatgctacaattttaaga

SEQ ID NO: 588896 - DNA, 14 bp, Homo sapiens
aataatttgaactt

SEQ ID NO: 588897 - DNA, 14 bp, Homo sapiens
aatacacatttgct

SEQ ID NO: 588898 - DNA, 21 bp, Homo sapiens
aataccttcaaggctcttctt

SEQ ID NO: 588899 - DNA, 13 bp, Homo sapiens
aatacgtttgtgt

SEQ ID NO: 588900 - DNA, 17 bp, Homo sapiens
aatacgtttgtgtttct

SEQ ID NO: 588901 - DNA, 20 bp, Homo sapiens
aatactgccaaaacatttat

SEQ ID NO: 588902 - DNA, 22 bp, Homo sapiens
aatactgccaaaacatttatga

SEQ ID NO: 588903 - DNA, 23 bp, Homo sapiens
aatactgccaaaacatttatgac

SEQ ID NO: 588904 - DNA, 13 bp, Homo sapiens
aatagaaggtgat

SEQ ID NO: 588905 - DNA, 22 bp, Homo sapiens
aatagctttagtgaattaaatt

SEQ ID NO: 588906 - DNA, 20 bp, Homo sapiens
aataggaacaatctttgctg

SEQ ID NO: 588907 - DNA, 23 bp, Homo sapiens
aataggaatcattcagaaatgtt

SEQ ID NO: 588908 - DNA, 19 bp, Homo sapiens
aatagtttgaattcagtaa

SEQ ID NO: 588909 - DNA, 23 bp, Homo sapiens
aatatatagaatgatctattgct

SEQ ID NO: 588910 - DNA, 19 bp, Homo sapiens
aatatattttgtttacaaa

SEQ ID NO: 588911 - DNA, 18 bp, Homo sapiens
aatattccagatctttca

SEQ ID NO: 588912 - DNA, 20 bp, Homo sapiens
aatattgattgggaaaacat

SEQ ID NO: 588913 - DNA, 22 bp, Homo sapiens
aatattgattgggaaaacattt

SEQ ID NO: 588914 - DNA, 21 bp, Homo sapiens
aatcaatctttaacaacctct

SEQ ID NO: 588915 - DNA, 15 bp, Homo sapiens
aatcagacagcagga

SEQ ID NO: 588916 - DNA, 16 bp, Homo sapiens
aatcagtatttccttc

SEQ ID NO: 588917 - DNA, 18 bp, Homo sapiens
aatcagtatttccttcca

SEQ ID NO: 588918 - DNA, 23 bp, Homo sapiens
aatcattcagaaatgttgagtct

SEQ ID NO: 588919 - DNA, 14 bp, Homo sapiens
aatcccctaaaata

SEQ ID NO: 588920 - DNA, 10 bp, Homo sapiens
aatccctctc

SEQ ID NO: 588921 - DNA, 23 bp, Homo sapiens
aatccttactaagtaggtgatga

SEQ ID NO: 588922 - DNA, 19 bp, Homo sapiens
aatccttctattctagcct

SEQ ID NO: 588923 - DNA, 22 bp, Homo sapiens
aatccttctattctagcctgca

SEQ ID NO: 588924 - DNA, 17 bp, Homo sapiens
aatcttcaaagccttct

SEQ ID NO: 588925 - DNA, 11 bp, Homo sapiens
aatgaactttg

SEQ ID NO: 588926 - DNA, 23 bp, Homo sapiens
aatgaactttgtcagtgttgcct

SEQ ID NO: 588927 - DNA, 19 bp, Homo sapiens
aatgacactgtttcctgat

SEQ ID NO: 588928 - DNA, 19 bp, Homo sapiens
aatgaggaaaattcttaaa

SEQ ID NO: 588929 - DNA, 17 bp, Homo sapiens
aatgatcagcaaaaaga

SEQ ID NO: 588930 - DNA, 19 bp, Homo sapiens
aatgatcagcaaaaagact

SEQ ID NO: 588931 - DNA, 19 bp, Homo sapiens
aatgatgttatacatcaat

SEQ ID NO: 588932 - DNA, 19 bp, Homo sapiens
aatgcccctgttcatgttt

SEQ ID NO: 588933 - DNA, 14 bp, Homo sapiens
aatgctaaatgtgt

SEQ ID NO: 588934 - DNA, 15 bp, Homo sapiens
aatgctaaatgtgta

SEQ ID NO: 588935 - DNA, 20 bp, Homo sapiens
aatgctacaattttaagagg

SEQ ID NO: 588936 - DNA, 17 bp, Homo sapiens
aatgctcccacctgaat

SEQ ID NO: 588937 - DNA, 13 bp, Homo sapiens
aatggatttttct

SEQ ID NO: 588938 - DNA, 18 bp, Homo sapiens
aatggatttttctttaac

SEQ ID NO: 588939 - DNA, 18 bp, Homo sapiens
aatgggactggagtccct

SEQ ID NO: 588940 - DNA, 17 bp, Homo sapiens
aatgggatattttgaaa

SEQ ID NO: 588941 - DNA, 16 bp, Homo sapiens
aatgggattagaaaca

SEQ ID NO: 588942 - DNA, 17 bp, Homo sapiens
aatggtcctatttttgt

SEQ ID NO: 588943 - DNA, 13 bp, Homo sapiens
aatgtaatttaaa

SEQ ID NO: 588944 - DNA, 13 bp, Homo sapiens
aatgtataaatat

SEQ ID NO: 588945 - DNA, 14 bp, Homo sapiens
aatgtataaatata

SEQ ID NO: 588946 - DNA, 16 bp, Homo sapiens
aatgtataaatataca

SEQ ID NO: 588947 - DNA, 18 bp, Homo sapiens
aatgtccaaaatttatat

SEQ ID NO: 588948 - DNA, 15 bp, Homo sapiens
aatgtgcaatagaag

SEQ ID NO: 588949 - DNA, 17 bp, Homo sapiens
aatgtgcaatagaaggt

SEQ ID NO: 588950 - DNA, 13 bp, Homo sapiens
aatgtgtaagaac

SEQ ID NO: 588951 - DNA, 15 bp, Homo sapiens
aatgtgtgagaaaaa

SEQ ID NO: 588952 - DNA, 16 bp, Homo sapiens
aatgtttctggatttc

SEQ ID NO: 588953 - DNA, 14 bp, Homo sapiens
aattacctgtggat

SEQ ID NO: 588954 - DNA, 14 bp, Homo sapiens
aattaccttctatt

SEQ ID NO: 588955 - DNA, 23 bp, Homo sapiens
aattactttggggctaatttaac

SEQ ID NO: 588956 - DNA, 17 bp, Homo sapiens
aattatgagattggttt

SEQ ID NO: 588957 - DNA, 22 bp, Homo sapiens
aattatttcatgattagaaatt

SEQ ID NO: 588958 - DNA, 15 bp, Homo sapiens
aattcaactttgtaa

SEQ ID NO: 588959 - DNA, 12 bp, Homo sapiens
aattgtacaaaa

SEQ ID NO: 588960 - DNA, 12 bp, Homo sapiens
aatttaaatgaa

SEQ ID NO: 588961 - DNA, 16 bp, Homo sapiens
accctatgggtctagg

SEQ ID NO: 588962 - DNA, 15 bp, Homo sapiens
accctccagagacaa

SEQ ID NO: 588963 - DNA, 17 bp, Homo sapiens
accctcttgccatcctg

SEQ ID NO: 588964 - DNA, 20 bp, Homo sapiens
accctcttgccatcctgatg

SEQ ID NO: 588965 - DNA, 22 bp, Homo sapiens
acccttactggcttacctcctc

SEQ ID NO: 588966 - DNA, 15 bp, Homo sapiens
acccttattgctgtc

SEQ ID NO: 588967 - DNA, 17 bp, Homo sapiens
acccttattgctgtcct

SEQ ID NO: 588968 - DNA, 19 bp, Homo sapiens
acccttattgctgtcctgg

SEQ ID NO: 588969 - DNA, 21 bp, Homo sapiens
acccttattgctgtcctggag

SEQ ID NO: 588970 - DNA, 14 bp, Homo sapiens
acccttctgggtcc

SEQ ID NO: 588971 - DNA, 23 bp, Homo sapiens
acccttttaagcatgtgatgttg

SEQ ID NO: 588972 - DNA, 14 bp, Homo sapiens
acctacctccctcc

SEQ ID NO: 588973 - DNA, 17 bp, Homo sapiens
acctactggtgtaatct

SEQ ID NO: 588974 - DNA, 22 bp, Homo sapiens
acctactggtgtaatctcaatg

SEQ ID NO: 588975 - DNA, 18 bp, Homo sapiens
acctcctaccccttcctg

SEQ ID NO: 588976 - DNA, 20 bp, Homo sapiens
acctcctaccccttcctgtc

SEQ ID NO: 588977 - DNA, 15 bp, Homo sapiens
acctctctgcctctc

SEQ ID NO: 588978 - DNA, 12 bp, Homo sapiens
acctgagctaaa

SEQ ID NO: 588979 - DNA, 17 bp, Homo sapiens
acctgcactaacagagt

SEQ ID NO: 588980 - DNA, 19 bp, Homo sapiens
acctgccccggacctacct

SEQ ID NO: 588981 - DNA, 21 bp, Homo sapiens
acctgccccggacctacctcc

SEQ ID NO: 588982 - DNA, 20 bp, Homo sapiens
acctgctcacgtcaaatgca

SEQ ID NO: 588983 - DNA, 21 bp, Homo sapiens
acctggcatctaattctgatt

SEQ ID NO: 588984 - DNA, 11 bp, Homo sapiens
acctggctgcc

SEQ ID NO: 588985 - DNA, 18 bp, Homo sapiens
acctgggcatcagggcct

SEQ ID NO: 588986 - DNA, 16 bp, Homo sapiens
acctggggactcctca

SEQ ID NO: 588987 - DNA, 16 bp, Homo sapiens
aacaaacaaaactctt

SEQ ID NO: 588988 - DNA, 12 bp, Homo sapiens
aacaaacaagcc

SEQ ID NO: 588989 - DNA, 18 bp, Homo sapiens
aacaaataatttgaactt

SEQ ID NO: 588990 - DNA, 23 bp, Homo sapiens
aacaaataatttgaactttggaa

SEQ ID NO: 588991 - DNA, 13 bp, Homo sapiens
aacaagcatgcag

SEQ ID NO: 588992 - DNA, 22 bp, Homo sapiens
aacaatggtgtggtgaatgtgt

SEQ ID NO: 588993 - DNA, 22 bp, Homo sapiens
aacaccttcagaggctgaggtg

SEQ ID NO: 588994 - DNA, 14 bp, Homo sapiens
aacactatttgtga

SEQ ID NO: 588995 - DNA, 15 bp, Homo sapiens
aacactatttgtgac

SEQ ID NO: 588996 - DNA, 16 bp, Homo sapiens
aacactatttgtgact

SEQ ID NO: 588997 - DNA, 18 bp, Homo sapiens
aacactatttgtgacttt

SEQ ID NO: 588998 - DNA, 14 bp, Homo sapiens
aacagaaatggaaa

SEQ ID NO: 588999 - DNA, 17 bp, Homo sapiens
aacagacacaatttata

SEQ ID NO: 589000 - DNA, 19 bp, Homo sapiens
aacagagactgaatagata

SEQ ID NO: 589001 - DNA, 20 bp, Homo sapiens
aacagggccacatagatgct

SEQ ID NO: 589002 - DNA, 21 bp, Homo sapiens
aacagggctgccttctggcct

SEQ ID NO: 589003 - DNA, 19 bp, Homo sapiens
aacaggttataacagtgtt

SEQ ID NO: 589004 - DNA, 21 bp, Homo sapiens
aacagtatgtgggatattgaa

SEQ ID NO: 589005 - DNA, 14 bp, Homo sapiens
aacatgatgaaacc

SEQ ID NO: 589006 - DNA, 22 bp, Homo sapiens
aacatgttaatgacaatattcc

SEQ ID NO: 589007 - DNA, 23 bp, Homo sapiens
aacatgttcccaaggccccactt

SEQ ID NO: 589008 - DNA, 17 bp, Homo sapiens
aacatgtttctctataa

SEQ ID NO: 589009 - DNA, 12 bp, Homo sapiens
aacatttgctgc

SEQ ID NO: 589010 - DNA, 13 bp, Homo sapiens
aacattttaagtt

SEQ ID NO: 589011 - DNA, 17 bp, Homo sapiens
aacattttaagttttac

SEQ ID NO: 589012 - DNA, 22 bp, Homo sapiens
aacattttaagttttactgata

SEQ ID NO: 589013 - DNA, 19 bp, Homo sapiens
aaccaaggctgtgtttaga

SEQ ID NO: 589014 - DNA, 17 bp, Homo sapiens
aaccagagtctgtattt

SEQ ID NO: 589015 - DNA, 15 bp, Homo sapiens
aaccagctcagtgtt

SEQ ID NO: 589016 - DNA, 19 bp, Homo sapiens
aaccagctcagtgttttgg

SEQ ID NO: 589017 - DNA, 18 bp, Homo sapiens
aaccatttttgaacctta

SEQ ID NO: 589018 - DNA, 15 bp, Homo sapiens
aacccaatccctctc

SEQ ID NO: 589019 - DNA, 13 bp, Homo sapiens
aacccacacctgg

SEQ ID NO: 589020 - DNA, 17 bp, Homo sapiens
aaccctcttgccatcct

SEQ ID NO: 589021 - DNA, 19 bp, Homo sapiens
aaccctcttgccatcctga

SEQ ID NO: 589022 - DNA, 23 bp, Homo sapiens
aacctgatgctggggacacagca

SEQ ID NO: 589023 - DNA, 17 bp, Homo sapiens
aaccttaaaaggtactg

SEQ ID NO: 589024 - DNA, 13 bp, Homo sapiens
aaccttaagatac

SEQ ID NO: 589025 - DNA, 22 bp, Homo sapiens
aaccttgtttaatagatttggg

SEQ ID NO: 589026 - DNA, 21 bp, Homo sapiens
aacctttgagtagatccattt

SEQ ID NO: 589027 - DNA, 16 bp, Homo sapiens
aacgaaaatgaaagct

SEQ ID NO: 589028 - DNA, 21 bp, Homo sapiens
aacgctctcctcgagccctcc

SEQ ID NO: 589029 - DNA, 14 bp, Homo sapiens
aacggttcctggtg

SEQ ID NO: 589030 - DNA, 21 bp, Homo sapiens
aacggttcctggtgactcctg

SEQ ID NO: 589031 - DNA, 15 bp, Homo sapiens
aactacctgagctaa

SEQ ID NO: 589032 - DNA, 15 bp, Homo sapiens
aactagcattgtaaa

SEQ ID NO: 589033 - DNA, 15 bp, Homo sapiens
aactaggctgagcaa

SEQ ID NO: 589034 - DNA, 23 bp, Homo sapiens
aactatagcttgcagaactgtag

SEQ ID NO: 589035 - DNA, 19 bp, Homo sapiens
aactatcttctttggactt

SEQ ID NO: 589036 - DNA, 22 bp, Homo sapiens
aactatttattgtgctgggtcc

SEQ ID NO: 589037 - DNA, 23 bp, Homo sapiens
aactcattttcatattgtaatct

SEQ ID NO: 589038 - DNA, 23 bp, Homo sapiens
aactctaaccaaggctgtgttta

SEQ ID NO: 589039 - DNA, 16 bp, Homo sapiens
aactgccgtaatttaa

SEQ ID NO: 589040 - DNA, 18 bp, Homo sapiens
aactgccgtaatttaact

SEQ ID NO: 589041 - DNA, 23 bp, Homo sapiens
aactgcttcccttactttgctga

SEQ ID NO: 589042 - DNA, 13 bp, Homo sapiens
aactgtactgaat

SEQ ID NO: 589043 - DNA, 13 bp, Homo sapiens
aactgtggatatt

SEQ ID NO: 589044 - DNA, 19 bp, Homo sapiens
aactgttgcacttttgaat

SEQ ID NO: 589045 - DNA, 15 bp, Homo sapiens
aacttaagaaacact

SEQ ID NO: 589046 - DNA, 22 bp, Homo sapiens
aacttctgcaacaagcatgcag

SEQ ID NO: 589047 - DNA, 21 bp, Homo sapiens
aacttgatagggtctaccaat

SEQ ID NO: 589048 - DNA, 19 bp, Homo sapiens
aacttgtgtccctaatgtg

SEQ ID NO: 589049 - DNA, 14 bp, Homo sapiens
aactttccagtctt

SEQ ID NO: 589050 - DNA, 16 bp, Homo sapiens
aactttgggaaaacat

SEQ ID NO: 589051 - DNA, 14 bp, Homo sapiens
aactttgtaaaaat

SEQ ID NO: 589052 - DNA, 13 bp, Homo sapiens
aagaaaaaaagct

SEQ ID NO: 589053 - DNA, 15 bp, Homo sapiens
aagaaaatctttata

SEQ ID NO: 589054 - DNA, 23 bp, Homo sapiens
aagaaaatttgccaatctttcct

SEQ ID NO: 589055 - DNA, 13 bp, Homo sapiens
aagaactctctgg

SEQ ID NO: 589056 - DNA, 14 bp, Homo sapiens
aagaactctctgga

SEQ ID NO: 589057 - DNA, 17 bp, Homo sapiens
aagaactttaaattgtg

SEQ ID NO: 589058 - DNA, 23 bp, Homo sapiens
aagaagagcgagagatcaaagat

SEQ ID NO: 589059 - DNA, 19 bp, Homo sapiens
aagaatgaaagctgttcct

SEQ ID NO: 589060 - DNA, 18 bp, Homo sapiens
aagaattgaaaagttttt

SEQ ID NO: 589061 - DNA, 20 bp, Homo sapiens
aagaattgaaaagtttttgt

SEQ ID NO: 589062 - DNA, 14 bp, Homo sapiens
aagactgagccaga

SEQ ID NO: 589063 - DNA, 23 bp, Homo sapiens
aagagagttctggatgtctggct

SEQ ID NO: 589064 - DNA, 18 bp, Homo sapiens
aagagcgagagatcaaag

SEQ ID NO: 589065 - DNA, 19 bp, Homo sapiens
aagagggacataagataaa

SEQ ID NO: 589066 - DNA, 23 bp, Homo sapiens
aagagggacataagataaaatga

SEQ ID NO: 589067 - DNA, 18 bp, Homo sapiens
aagagtttcagtttgttg

SEQ ID NO: 589068 - DNA, 17 bp, Homo sapiens
aagatacttacatgttc

SEQ ID NO: 589069 - DNA, 22 bp, Homo sapiens
aagatctttatatttcaataaa

SEQ ID NO: 589070 - DNA, 14 bp, Homo sapiens
aagatgcagaagca

SEQ ID NO: 589071 - DNA, 23 bp, Homo sapiens
aagatgcatcatctcttcctcac

SEQ ID NO: 589072 - DNA, 16 bp, Homo sapiens
aagatgccccagggat

SEQ ID NO: 589073 - DNA, 19 bp, Homo sapiens
aagatgcgtttgcctcctg

SEQ ID NO: 589074 - DNA, 21 bp, Homo sapiens
aagatgcgtttgcctcctgga

SEQ ID NO: 589075 - DNA, 20 bp, Homo sapiens
aagatgttatggtgtttaga

SEQ ID NO: 589076 - DNA, 12 bp, Homo sapiens
aagattctgctg

SEQ ID NO: 589077 - DNA, 17 bp, Homo sapiens
tacttctgtaattgtgt

SEQ ID NO: 589078 - DNA, 22 bp, Homo sapiens
tacttctgtaattgtgtggatt

SEQ ID NO: 589079 - DNA, 17 bp, Homo sapiens
tacttgactacctactg

SEQ ID NO: 589080 - DNA, 22 bp, Homo sapiens
tacttgactacctactggtgta

SEQ ID NO: 589081 - DNA, 13 bp, Homo sapiens
tacttgttttgga

SEQ ID NO: 589082 - DNA, 17 bp, Homo sapiens
tactttagaagcctgca

SEQ ID NO: 589083 - DNA, 21 bp, Homo sapiens
tactttctatttttatgatga

SEQ ID NO: 589084 - DNA, 22 bp, Homo sapiens
tactttctatttttatgatgac

SEQ ID NO: 589085 - DNA, 15 bp, Homo sapiens
tactttgacagtgtt

SEQ ID NO: 589086 - DNA, 20 bp, Homo sapiens
tactttgacagtgtttttag

SEQ ID NO: 589087 - DNA, 17 bp, Homo sapiens
tactttggaattcttag

SEQ ID NO: 589088 - DNA, 22 bp, Homo sapiens
tagacttggagaatactgccaa

SEQ ID NO: 589089 - DNA, 15 bp, Homo sapiens
tagatccatttccat

SEQ ID NO: 589090 - DNA, 22 bp, Homo sapiens
tagatcgatgatatgaccagaa

SEQ ID NO: 589091 - DNA, 11 bp, Homo sapiens
tagatttatgg

SEQ ID NO: 589092 - DNA, 14 bp, Homo sapiens
tagcatcttcctct

SEQ ID NO: 589093 - DNA, 16 bp, Homo sapiens
tagcatcttcctctgc

SEQ ID NO: 589094 - DNA, 21 bp, Homo sapiens
tagcctaaggctcctgttttg

SEQ ID NO: 589095 - DNA, 16 bp, Homo sapiens
tagcctatgtctggca

SEQ ID NO: 589096 - DNA, 17 bp, Homo sapiens
tagcctatgtctggcag

SEQ ID NO: 589097 - DNA, 18 bp, Homo sapiens
tagcctatgtctggcaga

SEQ ID NO: 589098 - DNA, 12 bp, Homo sapiens
tagcggctcctc

SEQ ID NO: 589099 - DNA, 13 bp, Homo sapiens
tagcggctcctcg

SEQ ID NO: 589100 - DNA, 21 bp, Homo sapiens
tagctgaggctgagaaagcta

SEQ ID NO: 589101 - DNA, 17 bp, Homo sapiens
tagcttgcagaactgta

SEQ ID NO: 589102 - DNA, 20 bp, Homo sapiens
tagggactacccatagacat

SEQ ID NO: 589103 - DNA, 18 bp, Homo sapiens
taggggaaggagaagtaa

SEQ ID NO: 589104 - DNA, 15 bp, Homo sapiens
taggtttcaggaagt

SEQ ID NO: 589105 - DNA, 16 bp, Homo sapiens
tagtaagcatagaaac

SEQ ID NO: 589106 - DNA, 17 bp, Homo sapiens
tagtctaagactatata

SEQ ID NO: 589107 - DNA, 17 bp, Homo sapiens
tagtgacatttaatgcc

SEQ ID NO: 589108 - DNA, 19 bp, Homo sapiens
tagtgatgatggttcacgt

SEQ ID NO: 589109 - DNA, 21 bp, Homo sapiens
tagtgatgtccttaaaatgtg

SEQ ID NO: 589110 - DNA, 22 bp, Homo sapiens
tagtgatgtccttaaaatgtgg

SEQ ID NO: 589111 - DNA, 22 bp, Homo sapiens
tagtgggggatgggtcctctag

SEQ ID NO: 589112 - DNA, 14 bp, Homo sapiens
tagtgttaaagaga

SEQ ID NO: 589113 - DNA, 14 bp, Homo sapiens
tagtgttgtccagg

SEQ ID NO: 589114 - DNA, 15 bp, Homo sapiens
tagttgtgtttcaac

SEQ ID NO: 589115 - DNA, 15 bp, Homo sapiens
tagtttgaattcagt

SEQ ID NO: 589116 - DNA, 17 bp, Homo sapiens
tataaacagaaatggaa

SEQ ID NO: 589117 - DNA, 21 bp, Homo sapiens
tataaacagaaatggaaagca

SEQ ID NO: 589118 - DNA, 12 bp, Homo sapiens
tataaatgtata

SEQ ID NO: 589119 - DNA, 13 bp, Homo sapiens
tataatactacta

SEQ ID NO: 589120 - DNA, 20 bp, Homo sapiens
tataatgtcattaaacatga

SEQ ID NO: 589121 - DNA, 20 bp, Homo sapiens
tatacatcaatatgtatata

SEQ ID NO: 589122 - DNA, 17 bp, Homo sapiens
tatactgaaccaggcca

SEQ ID NO: 589123 - DNA, 16 bp, Homo sapiens
tatagtctaagactat

SEQ ID NO: 589124 - DNA, 20 bp, Homo sapiens
tatagtctaagactatatat

SEQ ID NO: 589125 - DNA, 13 bp, Homo sapiens
tatataaatgtat

SEQ ID NO: 589126 - DNA, 14 bp, Homo sapiens
tatatatataaatg

SEQ ID NO: 589127 - DNA, 16 bp, Homo sapiens
tatatatataaatgta

SEQ ID NO: 589128 - DNA, 16 bp, Homo sapiens
tatatatgtatttcta

SEQ ID NO: 589129 - DNA, 18 bp, Homo sapiens
tatatcctccttctcctg

SEQ ID NO: 589130 - DNA, 12 bp, Homo sapiens
tatatgactgca

SEQ ID NO: 589131 - DNA, 18 bp, Homo sapiens
tatatgctttattaatgt

SEQ ID NO: 589132 - DNA, 16 bp, Homo sapiens
tatatgtattttttga

SEQ ID NO: 589133 - DNA, 16 bp, Homo sapiens
tatattactgacattt

SEQ ID NO: 589134 - DNA, 15 bp, Homo sapiens
tatattttatattac

SEQ ID NO: 589135 - DNA, 17 bp, Homo sapiens
tatattttgtttacaaa

SEQ ID NO: 589136 - DNA, 16 bp, Homo sapiens
tatatttttttaactg

SEQ ID NO: 589137 - DNA, 19 bp, Homo sapiens
tatatttttttaactgtga

SEQ ID NO: 589138 - DNA, 19 bp, Homo sapiens
tatcactgccttcgtttat

SEQ ID NO: 589139 - DNA, 23 bp, Homo sapiens
tatcagtaatgctaaatgtgtaa

SEQ ID NO: 589140 - DNA, 16 bp, Homo sapiens
tatccacactgtcaaa

SEQ ID NO: 589141 - DNA, 17 bp, Homo sapiens
tatccaggcaccaggac

SEQ ID NO: 589142 - DNA, 17 bp, Homo sapiens
tatcggcagatgatgct

SEQ ID NO: 589143 - DNA, 16 bp, Homo sapiens
tatctcaatgaaccat

SEQ ID NO: 589144 - DNA, 17 bp, Homo sapiens
tatgacaagctgtatca

SEQ ID NO: 589145 - DNA, 14 bp, Homo sapiens
tatgagattggttt

SEQ ID NO: 589146 - DNA, 21 bp, Homo sapiens
tatgagattggttttcctgtg

SEQ ID NO: 589147 - DNA, 16 bp, Homo sapiens
tggatcccgttcagaa

SEQ ID NO: 589148 - DNA, 18 bp, Homo sapiens
tggatcctcagttctcaa

SEQ ID NO: 589149 - DNA, 13 bp, Homo sapiens
tggatgtctggct

SEQ ID NO: 589150 - DNA, 14 bp, Homo sapiens
tggatttgcagaag

SEQ ID NO: 589151 - DNA, 15 bp, Homo sapiens
tggatttgcagaagt

SEQ ID NO: 589152 - DNA, 15 bp, Homo sapiens
tggatttttctttaa

SEQ ID NO: 589153 - DNA, 18 bp, Homo sapiens
tggatttttctttaactg

SEQ ID NO: 589154 - DNA, 16 bp, Homo sapiens
tggcattctttgcaat

SEQ ID NO: 589155 - DNA, 16 bp, Homo sapiens
tggctcaaagcagcag

SEQ ID NO: 589156 - DNA, 15 bp, Homo sapiens
tggctttaagccttc

SEQ ID NO: 589157 - DNA, 14 bp, Homo sapiens
tgggaaaacatttg

SEQ ID NO: 589158 - DNA, 16 bp, Homo sapiens
tgggaatgaggaaaat

SEQ ID NO: 589159 - DNA, 13 bp, Homo sapiens
tgggactggagtc

SEQ ID NO: 589160 - DNA, 18 bp, Homo sapiens
tgggatattttgaaatga

SEQ ID NO: 589161 - DNA, 15 bp, Homo sapiens
tgggattagaaacaa

SEQ ID NO: 589162 - DNA, 21 bp, Homo sapiens
tgggcatcagggcctttctcc

SEQ ID NO: 589163 - DNA, 20 bp, Homo sapiens
tgggccacctcctacccctt

SEQ ID NO: 589164 - DNA, 10 bp, Homo sapiens
tgggctcctc

SEQ ID NO: 589165 - DNA, 19 bp, Homo sapiens
tgggctgggggctatgtat

SEQ ID NO: 589166 - DNA, 15 bp, Homo sapiens
tggggaacggaggag

SEQ ID NO: 589167 - DNA, 20 bp, Homo sapiens
tggggacacagcatcagctc

SEQ ID NO: 589168 - DNA, 21 bp, Homo sapiens
tcccacagcagccccaggaga

SEQ ID NO: 589169 - DNA, 22 bp, Homo sapiens
tcccacagcagccccaggagaa

SEQ ID NO: 589170 - DNA, 21 bp, Homo sapiens
tcccacttcctcctacctggg

SEQ ID NO: 589171 - DNA, 11 bp, Homo sapiens
tcccagagtgg

SEQ ID NO: 589172 - DNA, 13 bp, Homo sapiens
tcccagtctctgt

SEQ ID NO: 589173 - DNA, 14 bp, Homo sapiens
tcccatctctccca

SEQ ID NO: 589174 - DNA, 20 bp, Homo sapiens
tcccatctctcccacttcct

SEQ ID NO: 589175 - DNA, 22 bp, Homo sapiens
tcccatctctcccacttcctcc

SEQ ID NO: 589176 - DNA, 22 bp, Homo sapiens
tccccgcggttcatacgcatcc

SEQ ID NO: 589177 - DNA, 14 bp, Homo sapiens
tcccctatcctccc

SEQ ID NO: 589178 - DNA, 15 bp, Homo sapiens
tcccctttgtcctgc

SEQ ID NO: 589179 - DNA, 16 bp, Homo sapiens
tcccctttgtcctgcg

SEQ ID NO: 589180 - DNA, 14 bp, Homo sapiens
tccctaatgtgttt

SEQ ID NO: 589181 - DNA, 14 bp, Homo sapiens
tccctctccactct

SEQ ID NO: 589182 - DNA, 20 bp, Homo sapiens
tccctctccactcttctctc

SEQ ID NO: 589183 - DNA, 22 bp, Homo sapiens
tccctctccactcttctctcct

SEQ ID NO: 589184 - DNA, 15 bp, Homo sapiens
tccctcttctctcct

SEQ ID NO: 589185 - DNA, 18 bp, Homo sapiens
tccctcttctctcctcag

SEQ ID NO: 589186 - DNA, 21 bp, Homo sapiens
tccctgaggactgatttcaga

SEQ ID NO: 589187 - DNA, 18 bp, Homo sapiens
tccctgcctcaggccaag

SEQ ID NO: 589188 - DNA, 19 bp, Homo sapiens
tccctgggccacctcctac

SEQ ID NO: 589189 - DNA, 20 bp, Homo sapiens
tccctgggccacctcctacc

SEQ ID NO: 589190 - DNA, 22 bp, Homo sapiens
tccctgggccacctcctacccc

SEQ ID NO: 589191 - DNA, 15 bp, Homo sapiens
tcccttactttgctg

SEQ ID NO: 589192 - DNA, 20 bp, Homo sapiens
tcccttgaaactttgggaaa

SEQ ID NO: 589193 - DNA, 22 bp, Homo sapiens
tcccttgtcagttccaaacaga

SEQ ID NO: 589194 - DNA, 18 bp, Homo sapiens
tccgcgggagaccccttg

SEQ ID NO: 589195 - DNA, 20 bp, Homo sapiens
tcctaaaagttctcaatgta

SEQ ID NO: 589196 - DNA, 21 bp, Homo sapiens
tcctaaggcacccacaaataa

SEQ ID NO: 589197 - DNA, 17 bp, Homo sapiens
tcctaagtcccttccta

SEQ ID NO: 589198 - DNA, 19 bp, Homo sapiens
tcctaagtcccttcctatt

SEQ ID NO: 589199 - DNA, 12 bp, Homo sapiens
tcctaccccttc

SEQ ID NO: 589200 - DNA, 18 bp, Homo sapiens
tcctacctggggactcct

SEQ ID NO: 589201 - DNA, 13 bp, Homo sapiens
tcttgccatcctg

SEQ ID NO: 589202 - DNA, 20 bp, Homo sapiens
tctttaactgccgtaattta

SEQ ID NO: 589203 - DNA, 21 bp, Homo sapiens
tctttaactgccgtaatttaa

SEQ ID NO: 589204 - DNA, 23 bp, Homo sapiens
tctttagtttttggttgggaatg

SEQ ID NO: 589205 - DNA, 15 bp, Homo sapiens
tctttatatttcaat

SEQ ID NO: 589206 - DNA, 10 bp, Homo sapiens
tctttcatgg

SEQ ID NO: 589207 - DNA, 16 bp, Homo sapiens
tctttggattctaaat

SEQ ID NO: 589208 - DNA, 19 bp, Homo sapiens
tcttttgttctcctatatc

SEQ ID NO: 589209 - DNA, 23 bp, Homo sapiens
tcttttttaaccggtaagagttt

SEQ ID NO: 589210 - DNA, 20 bp, Homo sapiens
tgaaaaatataaaattatga

SEQ ID NO: 589211 - DNA, 14 bp, Homo sapiens
tgaaaagtgtgtat

SEQ ID NO: 589212 - DNA, 18 bp, Homo sapiens
tgaaaagtgtgtatatat

SEQ ID NO: 589213 - DNA, 15 bp, Homo sapiens
tgaaaagtttttgtt

SEQ ID NO: 589214 - DNA, 19 bp, Homo sapiens
tgaaacatgggctgtgatt

SEQ ID NO: 589215 - DNA, 22 bp, Homo sapiens
tgaaacgtggatacagagccac

SEQ ID NO: 589216 - DNA, 15 bp, Homo sapiens
tgaaactttgggaaa

SEQ ID NO: 589217 - DNA, 16 bp, Homo sapiens
tgaaactttgggaaaa

SEQ ID NO: 589218 - DNA, 21 bp, Homo sapiens
tgaaactttgggaaaacatgt

SEQ ID NO: 589219 - DNA, 13 bp, Homo sapiens
tgaaagaaaattg

SEQ ID NO: 589220 - DNA, 17 bp, Homo sapiens
tgaaagaaaattgagtt

SEQ ID NO: 589221 - DNA, 12 bp, Homo sapiens
tgaaatccctgc

SEQ ID NO: 589222 - DNA, 13 bp, Homo sapiens
tgaaatgaacttt

SEQ ID NO: 589223 - DNA, 16 bp, Homo sapiens
tgaacataacttctca

SEQ ID NO: 589224 - DNA, 20 bp, Homo sapiens
tgaacataacttctcatgta

SEQ ID NO: 589225 - DNA, 14 bp, Homo sapiens
tgaaccaggccaga

SEQ ID NO: 589226 - DNA, 14 bp, Homo sapiens
tgaacccacacctg

SEQ ID NO: 589227 - DNA, 15 bp, Homo sapiens
tgaacccacacctgg

SEQ ID NO: 589228 - DNA, 18 bp, Homo sapiens
tgaaccctcttgccatcc

SEQ ID NO: 589229 - DNA, 19 bp, Homo sapiens
tgaaccctcttgccatcct

SEQ ID NO: 589230 - DNA, 23 bp, Homo sapiens
tgaaccctcttgccatcctgatg

SEQ ID NO: 589231 - DNA, 19 bp, Homo sapiens
tgaaccttaaaaggtactg

SEQ ID NO: 589232 - DNA, 19 bp, Homo sapiens
tgaactttttaaagaagtg

SEQ ID NO: 589233 - DNA, 13 bp, Homo sapiens
tgaagaattgaaa

SEQ ID NO: 589234 - DNA, 22 bp, Homo sapiens
tgaagagggacataagataaaa

SEQ ID NO: 589235 - DNA, 22 bp, Homo sapiens
tgaagcaaactctaaaattata

SEQ ID NO: 589236 - DNA, 17 bp, Homo sapiens
tgaagtatgaagtctga

SEQ ID NO: 589237 - DNA, 16 bp, Homo sapiens
tgaagttttactgtct

SEQ ID NO: 589238 - DNA, 18 bp, Homo sapiens
tgaatagatatgaaagct

SEQ ID NO: 589239 - DNA, 21 bp, Homo sapiens
tgaatgggatattttgaaatg

SEQ ID NO: 589240 - DNA, 14 bp, Homo sapiens
tgaatgtgtgagaa

SEQ ID NO: 589241 - DNA, 21 bp, Homo sapiens
tgaatgttaaagggatatttt

SEQ ID NO: 589242 - DNA, 14 bp, Homo sapiens
tgaatttgtatatg

SEQ ID NO: 589243 - DNA, 22 bp, Homo sapiens
tgacaactcattttcatattgt

SEQ ID NO: 589244 - DNA, 16 bp, Homo sapiens
tgacaagctgtatcac

SEQ ID NO: 589245 - DNA, 16 bp, Homo sapiens
tgacaatattccagat

SEQ ID NO: 589246 - DNA, 23 bp, Homo sapiens
tgacactgtttcctgataataaa

SEQ ID NO: 589247 - DNA, 16 bp, Homo sapiens
tgacaggttttccaaa

SEQ ID NO: 589248 - DNA, 17 bp, Homo sapiens
tgacagtttttgacatt

SEQ ID NO: 589249 - DNA, 16 bp, Homo sapiens
tgacatttaatgccat

SEQ ID NO: 589250 - DNA, 22 bp, Homo sapiens
tgacatttcttctagtgatgat

SEQ ID NO: 589251 - DNA, 23 bp, Homo sapiens
tgaccagaaagcttcatccacag

SEQ ID NO: 589252 - DNA, 18 bp, Homo sapiens
tgaccagtgcctgtgagc

SEQ ID NO: 589253 - DNA, 12 bp, Homo sapiens
tgaccatttttt

SEQ ID NO: 589254 - DNA, 21 bp, Homo sapiens
tgaccctgggcagttccttac

SEQ ID NO: 589255 - DNA, 17 bp, Homo sapiens
tgacctaaattatttac

SEQ ID NO: 589256 - DNA, 21 bp, Homo sapiens
tgacgatgatgtacagattct

SEQ ID NO: 589257 - DNA, 15 bp, Homo sapiens
tgactgccctccgaa

SEQ ID NO: 589258 - DNA, 17 bp, Homo sapiens
tgactggcttcagcaag

SEQ ID NO: 589259 - DNA, 20 bp, Homo sapiens
tgacttaggtttcaggaagt

SEQ ID NO: 589260 - DNA, 23 bp, Homo sapiens
tgacttggtggcttttccttgaa

SEQ ID NO: 589261 - DNA, 18 bp, Homo sapiens
tgacttttataaagcatg

SEQ ID NO: 589262 - DNA, 15 bp, Homo sapiens
tgagacccctgtctc

SEQ ID NO: 589263 - DNA, 16 bp, Homo sapiens
tgagacccctgtctcc

SEQ ID NO: 589264 - DNA, 16 bp, Homo sapiens
tgagattctgaagtat

SEQ ID NO: 589265 - DNA, 16 bp, Homo sapiens
tgagcatagagaacaa

SEQ ID NO: 589266 - DNA, 14 bp, Homo sapiens
tgagcatggggcca

SEQ ID NO: 589267 - DNA, 15 bp, Homo sapiens
tgagccatgcctccc

SEQ ID NO: 589268 - DNA, 19 bp, Homo sapiens
tgagccctcctgagggccg

SEQ ID NO: 589269 - DNA, 15 bp, Homo sapiens
tgagctctgaaatct

SEQ ID NO: 589270 - DNA, 16 bp, Homo sapiens
tgagctctgaaatctt

SEQ ID NO: 589271 - DNA, 17 bp, Homo sapiens
tgagctctgaaatcttc

SEQ ID NO: 589272 - DNA, 21 bp, Homo sapiens
tgagctcttcctatccctctc

SEQ ID NO: 589273 - DNA, 23 bp, Homo sapiens
tgaggagaaatttgataatgaca

SEQ ID NO: 589274 - DNA, 15 bp, Homo sapiens
tgaggctgagaaagc

SEQ ID NO: 589275 - DNA, 20 bp, Homo sapiens
tgaggtgggcagatcacgag

SEQ ID NO: 589276 - DNA, 21 bp, Homo sapiens
tgagtattgtttaaaatgtaa

SEQ ID NO: 589277 - DNA, 12 bp, Homo sapiens
tgataataaagg

SEQ ID NO: 589278 - DNA, 19 bp, Homo sapiens
tgataataaaggaactgca

SEQ ID NO: 589279 - DNA, 12 bp, Homo sapiens
tgataatgacac

SEQ ID NO: 589280 - DNA, 15 bp, Homo sapiens
tgataatgacactgt

SEQ ID NO: 589281 - DNA, 16 bp, Homo sapiens
tgataatgacactgtt

SEQ ID NO: 589282 - DNA, 22 bp, Homo sapiens
tgataatgacactgtttcctga

SEQ ID NO: 589283 - DNA, 15 bp, Homo sapiens
ttcctggtgactcct

SEQ ID NO: 589284 - DNA, 12 bp, Homo sapiens
ttcctgtactgt

SEQ ID NO: 589285 - DNA, 13 bp, Homo sapiens
ttcctgtcctgcc

SEQ ID NO: 589286 - DNA, 15 bp, Homo sapiens
ttcctgtcctgcctc

SEQ ID NO: 589287 - DNA, 20 bp, Homo sapiens
ttcctgtcctgcctcctcat

SEQ ID NO: 589288 - DNA, 13 bp, Homo sapiens
ttccttccactgt

SEQ ID NO: 589289 - DNA, 15 bp, Homo sapiens
ttccttccactgtag

SEQ ID NO: 589290 - DNA, 21 bp, Homo sapiens
ttccttccactgtagctatta

SEQ ID NO: 589291 - DNA, 17 bp, Homo sapiens
ttctaaatatgaatgaa

SEQ ID NO: 589292 - DNA, 20 bp, Homo sapiens
ttctactaaaaatacaaaaa

SEQ ID NO: 589293 - DNA, 19 bp, Homo sapiens
ttctattatttttataatt

SEQ ID NO: 589294 - DNA, 15 bp, Homo sapiens
ttctccctgcagcct

SEQ ID NO: 589295 - DNA, 16 bp, Homo sapiens
ttctccctgcagcctt

SEQ ID NO: 589296 - DNA, 15 bp, Homo sapiens
ttctccgggtcctcc

SEQ ID NO: 589297 - DNA, 15 bp, Homo sapiens
tttaataaagatgag

SEQ ID NO: 589298 - DNA, 17 bp, Homo sapiens
tttaataaagatgagtt

SEQ ID NO: 589299 - DNA, 12 bp, Homo sapiens
tttaatccagtt

SEQ ID NO: 589300 - DNA, 18 bp, Homo sapiens
tttactttagaagcctgc

SEQ ID NO: 589301 - DNA, 23 bp, Homo sapiens
tttagaagcctgacaactcattt

SEQ ID NO: 589302 - DNA, 15 bp, Homo sapiens
tttataaacagaaat

SEQ ID NO: 589303 - DNA, 20 bp, Homo sapiens
tttataattgtacaaaatta

SEQ ID NO: 589304 - DNA, 18 bp, Homo sapiens
tttatattaaataacatg

SEQ ID NO: 589305 - DNA, 19 bp, Homo sapiens
tttatattaaataacatgt

SEQ ID NO: 589306 - DNA, 20 bp, Homo sapiens
tttatatttcaataaatgat

SEQ ID NO: 589307 - DNA, 16 bp, Homo sapiens
tttatgatgacaatca

SEQ ID NO: 589308 - DNA, 18 bp, Homo sapiens
tttattaatgttttcaaa

SEQ ID NO: 589309 - DNA, 16 bp, Homo sapiens
tttattgcaatgcaga

SEQ ID NO: 589310 - DNA, 16 bp, Homo sapiens
tttattttttaagaaa

SEQ ID NO: 589311 - DNA, 20 bp, Homo sapiens
tttcaaaaggtattatacat

SEQ ID NO: 589312 - DNA, 21 bp, Homo sapiens
tttcaaaatatattttcagta

SEQ ID NO: 589313 - DNA, 18 bp, Homo sapiens
tttcaagacccctgtctt

SEQ ID NO: 589314 - DNA, 13 bp, Homo sapiens
tttcaataaatga

SEQ ID NO: 589315 - DNA, 22 bp, Homo sapiens
tttcagagtgactacacacagt

SEQ ID NO: 589316 - DNA, 19 bp, Homo sapiens
tttcaggcattggatattt

SEQ ID NO: 589317 - DNA, 14 bp, Homo sapiens
tttcagtttgttgg

SEQ ID NO: 589318 - DNA, 17 bp, Homo sapiens
tttcatgaaaataccat

SEQ ID NO: 589319 - DNA, 20 bp, Homo sapiens
tttcatggctgctgttgctt

SEQ ID NO: 589320 - DNA, 21 bp, Homo sapiens
tttccagaaccacacttgaaa

SEQ ID NO: 589321 - DNA, 19 bp, Homo sapiens
tttccgcccactcctggga

SEQ ID NO: 589322 - DNA, 12 bp, Homo sapiens
tttcctggcagt

SEQ ID NO: 589323 - DNA, 14 bp, Homo sapiens
tttccttccactgt

SEQ ID NO: 589324 - DNA, 14 bp, Homo sapiens
tttctaaactccct

SEQ ID NO: 589325 - DNA, 22 bp, Homo sapiens
tttctatttttatgatgacaat

SEQ ID NO: 589326 - DNA, 12 bp, Homo sapiens
tttctcctcccc

SEQ ID NO: 589327 - DNA, 13 bp, Homo sapiens
tttctcctcccca

SEQ ID NO: 589328 - DNA, 23 bp, Homo sapiens
tttctcctccccacctgtagctg

SEQ ID NO: 589329 - DNA, 12 bp, Homo sapiens
tttctctctcta

SEQ ID NO: 589330 - DNA, 17 bp, Homo sapiens
tttcttatccaactttt

SEQ ID NO: 589331 - DNA, 20 bp, Homo sapiens
tttcttcatgcctgatgaaa

SEQ ID NO: 589332 - DNA, 13 bp, Homo sapiens
tttctttaactgc

SEQ ID NO: 589333 - DNA, 12 bp, Homo sapiens
tttgaaaaatat

SEQ ID NO: 589334 - DNA, 17 bp, Homo sapiens
tttgaaactcgagacca

SEQ ID NO: 589335 - DNA, 14 bp, Homo sapiens
tttgaaatgaactt

SEQ ID NO: 589336 - DNA, 15 bp, Homo sapiens
tttgacatttatatt

SEQ ID NO: 589337 - DNA, 13 bp, Homo sapiens
tttgataatgaca

SEQ ID NO: 589338 - DNA, 23 bp, Homo sapiens
tttgataatgacactgtttcctg

SEQ ID NO: 589339 - DNA, 19 bp, Homo sapiens
tttgcaaagaccacctcca

SEQ ID NO: 589340 - DNA, 13 bp, Homo sapiens
tttgcaatactgc

SEQ ID NO: 589341 - DNA, 15 bp, Homo sapiens
tttgcaatactgctt

SEQ ID NO: 589342 - DNA, 10 bp, Homo sapiens
tttgcactga

SEQ ID NO: 589343 - DNA, 13 bp, Homo sapiens
tttgcatgcatgc

SEQ ID NO: 589344 - DNA, 18 bp, Homo sapiens
tttggacttctgaagaga

SEQ ID NO: 589345 - DNA, 14 bp, Homo sapiens
tttgtaaaaatctt

SEQ ID NO: 589346 - DNA, 22 bp, Homo sapiens
tttgtaaaaatcttttgaagca

SEQ ID NO: 589347 - DNA, 21 bp, Homo sapiens
tttgtattttcatgaaaatac

SEQ ID NO: 589348 - DNA, 23 bp, Homo sapiens
tttgttttaaaacgtgtaaatga

SEQ ID NO: 589349 - DNA, 23 bp, Homo sapiens
ttttaaaaaatactctgctattt

SEQ ID NO: 589350 - DNA, 23 bp, Homo sapiens
ttttaaagaccctcctattctat

SEQ ID NO: 589351 - DNA, 12 bp, Homo sapiens
ttttaactgtga

SEQ ID NO: 589352 - DNA, 14 bp, Homo sapiens
ttttaactgtggat

SEQ ID NO: 589353 - DNA, 13 bp, Homo sapiens
ttttatatgcttt

SEQ ID NO: 589354 - DNA, 23 bp, Homo sapiens
ttttcatagtaagtgcgaagact

SEQ ID NO: 589355 - DNA, 14 bp, Homo sapiens
ttttcccaataaat

SEQ ID NO: 589356 - DNA, 16 bp, Homo sapiens
ttttcggaaacactga

SEQ ID NO: 589357 - DNA, 19 bp, Homo sapiens
ttttctattatttttataa

SEQ ID NO: 589358 - DNA, 20 bp, Homo sapiens
ttttcttcatgcctgatgaa

SEQ ID NO: 589359 - DNA, 13 bp, Homo sapiens
ttttgaagcatag

SEQ ID NO: 589360 - DNA, 19 bp, Homo sapiens
ttttgacaggttttccaaa

SEQ ID NO: 589361 - DNA, 21 bp, Homo sapiens
ttttgcatgcatgcaaatgag

SEQ ID NO: 589362 - DNA, 16 bp, Homo sapiens
ttttggggagccagaa

SEQ ID NO: 589363 - DNA, 18 bp, Homo sapiens
ttttgtgaagtattcaca

SEQ ID NO: 589364 - DNA, 16 bp, Homo sapiens
ttttgttggtgctttg

SEQ ID NO: 589365 - DNA, 16 bp, Homo sapiens
ttttgtttcatcctgt

SEQ ID NO: 589366 - DNA, 18 bp, Homo sapiens
ttttgtttggagacgttt

SEQ ID NO: 589367 - DNA, 15 bp, Homo sapiens
ttttgtttggtaaat

SEQ ID NO: 589368 - DNA, 16 bp, Homo sapiens
tttttaatttacttgt

SEQ ID NO: 589369 - DNA, 17 bp, Homo sapiens
tttttagtgttaaagag

SEQ ID NO: 589370 - DNA, 13 bp, Homo sapiens
tttttataattgt

SEQ ID NO: 589371 - DNA, 18 bp, Homo sapiens
tttttataattgtacaaa

SEQ ID NO: 589372 - DNA, 23 bp, Homo sapiens
tttttataattgtacaaaattaa

SEQ ID NO: 589373 - DNA, 19 bp, Homo sapiens
tttttgcatgcatgcaaat

SEQ ID NO: 589374 - DNA, 14 bp, Homo sapiens
tttttggttgggaa

SEQ ID NO: 589375 - DNA, 12 bp, Homo sapiens
tttttgtgaaga

SEQ ID NO: 589376 - DNA, 11 bp, Homo sapiens
tttttgtttgg

SEQ ID NO: 589377 - DNA, 18 bp, Homo sapiens
ttttttaaaaggccattt

SEQ ID NO: 589378 - DNA, 23 bp, Homo sapiens
ttttttaagcttcagttgcttgt

SEQ ID NO: 589379 - DNA, 13 bp, Homo sapiens
tttttttaactgt

SEQ ID NO: 589380 - DNA, 18 bp, Homo sapiens
ttcttaggggaaggagaa

SEQ ID NO: 589381 - DNA, 19 bp, Homo sapiens
ttctttaactgccgtaatt

SEQ ID NO: 589382 - DNA, 18 bp, Homo sapiens
ttctttggacttctgaag

SEQ ID NO: 589383 - DNA, 17 bp, Homo sapiens
ttgaaaaatataaaatt

SEQ ID NO: 589384 - DNA, 20 bp, Homo sapiens
ttgaaaaatataaaattatg

SEQ ID NO: 589385 - DNA, 23 bp, Homo sapiens
ttgaaatgaactttgtcagtgtt

SEQ ID NO: 589386 - DNA, 13 bp, Homo sapiens
ttgaactttggaa

SEQ ID NO: 589387 - DNA, 13 bp, Homo sapiens
ttgaactttttaa

SEQ ID NO: 589388 - DNA, 11 bp, Homo sapiens
ttgaagcatag

SEQ ID NO: 589389 - DNA, 16 bp, Homo sapiens
ttgacaattgggagct

SEQ ID NO: 589390 - DNA, 18 bp, Homo sapiens
ttgacaggttttccaaaa

SEQ ID NO: 589391 - DNA, 20 bp, Homo sapiens
ttgacaggttttccaaaagt

SEQ ID NO: 589392 - DNA, 14 bp, Homo sapiens
ttgacagtgttttt

SEQ ID NO: 589393 - DNA, 15 bp, Homo sapiens
ttgacatttatatta

SEQ ID NO: 589394 - DNA, 24 bp, Homo sapiens
ttgacatttatattaaataacatg

SEQ ID NO: 589395 - DNA, 20 bp, Homo sapiens
ttgactaactcaaatacaca

SEQ ID NO: 589396 - DNA, 23 bp, Homo sapiens
ttgactaactcaaatacacattt

SEQ ID NO: 589397 - DNA, 18 bp, Homo sapiens
ttgagaggaggacttggt

SEQ ID NO: 589398 - DNA, 17 bp, Homo sapiens
ttgagtctgtactaaac

SEQ ID NO: 589399 - DNA, 22 bp, Homo sapiens
ttgataatgacactgtttcctg

SEQ ID NO: 589400 - DNA, 19 bp, Homo sapiens
ttgattgggaaaacatttg

SEQ ID NO: 589401 - DNA, 22 bp, Homo sapiens
ttgattgggaaaacatttgctg

SEQ ID NO: 589402 - DNA, 14 bp, Homo sapiens
ttgatttcaaagtt

SEQ ID NO: 589403 - DNA, 17 bp, Homo sapiens
ttgcaaagaccacctcc

SEQ ID NO: 589404 - DNA, 19 bp, Homo sapiens
ttgcaaggtgtgatggtct

SEQ ID NO: 589405 - DNA, 13 bp, Homo sapiens
ttgcaatgcagag

SEQ ID NO: 589406 - DNA, 16 bp, Homo sapiens
ttgcagaactgtagct

SEQ ID NO: 589407 - DNA, 17 bp, Homo sapiens
ttgcatactttgtattt

SEQ ID NO: 589408 - DNA, 13 bp, Homo sapiens
ttgcatgcatgca

SEQ ID NO: 589409 - DNA, 15 bp, Homo sapiens
ttgcatgcatgcaaa

SEQ ID NO: 589410 - DNA, 22 bp, Homo sapiens
ttgccaaagttttgctgtctct

SEQ ID NO: 589411 - DNA, 23 bp, Homo sapiens
ttgccatcccctatggaccagaa

SEQ ID NO: 589412 - DNA, 22 bp, Homo sapiens
ttgccatcctgatggacctgcc

SEQ ID NO: 589413 - DNA, 19 bp, Homo sapiens
ttgctactgttgtaagaat

SEQ ID NO: 589414 - DNA, 11 bp, Homo sapiens
ttgctgagagc

SEQ ID NO: 589415 - DNA, 13 bp, Homo sapiens
ttgctgtctctta

SEQ ID NO: 589416 - DNA, 14 bp, Homo sapiens
ttgcttgtcttctg

SEQ ID NO: 589417 - DNA, 11 bp, Homo sapiens
ttggaaattcc

SEQ ID NO: 589418 - DNA, 16 bp, Homo sapiens
ttggaagatgcagaag

SEQ ID NO: 589419 - DNA, 23 bp, Homo sapiens
ttggaagatgcagaagcaataat

SEQ ID NO: 589420 - DNA, 19 bp, Homo sapiens
ttggatttaaaagcctgct

SEQ ID NO: 589421 - DNA, 16 bp, Homo sapiens
ttggcattctttgcaa

SEQ ID NO: 589422 - DNA, 18 bp, Homo sapiens
ttggcctcctgcaaagtc

SEQ ID NO: 589423 - DNA, 18 bp, Homo sapiens
ttggggaagggcctgccc

SEQ ID NO: 589424 - DNA, 21 bp, Homo sapiens
ttgggtcatttagaagcctga

SEQ ID NO: 589425 - DNA, 17 bp, Homo sapiens
ttggtaaatgtttcttt

SEQ ID NO: 589426 - DNA, 12 bp, Homo sapiens
ttggtatatttt

SEQ ID NO: 589427 - DNA, 16 bp, Homo sapiens
ttggtgctttgcattt

SEQ ID NO: 589428 - DNA, 13 bp, Homo sapiens
ttggtggccaggg

SEQ ID NO: 589429 - DNA, 17 bp, Homo sapiens
ttggtggcttttccttg

SEQ ID NO: 589430 - DNA, 17 bp, Homo sapiens
ttggttttcctgtggca

SEQ ID NO: 589431 - DNA, 12 bp, Homo sapiens
ttggttttgaca

SEQ ID NO: 589432 - DNA, 17 bp, Homo sapiens
ttgtaaaattatttcat

SEQ ID NO: 589433 - DNA, 15 bp, Homo sapiens
ttgtaattatgtaaa

SEQ ID NO: 589434 - DNA, 17 bp, Homo sapiens
ttgtaattatgtaaata

SEQ ID NO: 589435 - DNA, 18 bp, Homo sapiens
ttgtacaaaattaagcaa

SEQ ID NO: 589436 - DNA, 14 bp, Homo sapiens
ttgtacagccttat

SEQ ID NO: 589437 - DNA, 16 bp, Homo sapiens
ttgtattttcatgaaa

SEQ ID NO: 589438 - DNA, 14 bp, Homo sapiens
ttgtgactttttaa

SEQ ID NO: 589439 - DNA, 19 bp, Homo sapiens
ttgtggggcctcaggctcc

SEQ ID NO: 589440 - DNA, 14 bp, Homo sapiens
ttgtgtgaaattgc

SEQ ID NO: 589441 - DNA, 16 bp, Homo sapiens
ttgtgtggattcttta

SEQ ID NO: 589442 - DNA, 10 bp, Homo sapiens
aaaaaacatt

SEQ ID NO: 589443 - DNA, 14 bp, Homo sapiens
aaaaacaattaact

SEQ ID NO: 589444 - DNA, 16 bp, Homo sapiens
aaaaacaattaactgc

SEQ ID NO: 589445 - DNA, 22 bp, Homo sapiens
aaaaatataaaattatgagatt

SEQ ID NO: 589446 - DNA, 12 bp, Homo sapiens
aaaaattatgca

SEQ ID NO: 589447 - DNA, 13 bp, Homo sapiens
aaaacacacaggt

SEQ ID NO: 589448 - DNA, 19 bp, Homo sapiens
aaaacagtggatcacaaag

SEQ ID NO: 589449 - DNA, 13 bp, Homo sapiens
aaaacatttatga

SEQ ID NO: 589450 - DNA, 13 bp, Homo sapiens
aaaacatttgctg

SEQ ID NO: 589451 - DNA, 21 bp, Homo sapiens
aaaaccatttttgaaccttaa

SEQ ID NO: 589452 - DNA, 14 bp, Homo sapiens
aaaactaaatttca

SEQ ID NO: 589453 - DNA, 19 bp, Homo sapiens
aaaactatttattgtgctg

SEQ ID NO: 589454 - DNA, 15 bp, Homo sapiens
aaaagcactcctgct

SEQ ID NO: 589455 - DNA, 14 bp, Homo sapiens
aaaatactctgcta

SEQ ID NO: 589456 - DNA, 16 bp, Homo sapiens
aaaatcttttgaagca

SEQ ID NO: 589457 - DNA, 22 bp, Homo sapiens
aaaatggtcctatttttgtgaa

SEQ ID NO: 589458 - DNA, 13 bp, Homo sapiens
aaaatttatattt

SEQ ID NO: 589459 - DNA, 22 bp, Homo sapiens
aaaattttgtatgttaaagaga

SEQ ID NO: 589460 - DNA, 15 bp, Homo sapiens
aaacaaaactcttaa

SEQ ID NO: 589461 - DNA, 12 bp, Homo sapiens
aaacaaagatgt

SEQ ID NO: 589462 - DNA, 22 bp, Homo sapiens
aaacaatggtgtggtgaatgtg

SEQ ID NO: 589463 - DNA, 13 bp, Homo sapiens
aaacactatttgt

SEQ ID NO: 589464 - DNA, 15 bp, Homo sapiens
aaacactatttgtga

SEQ ID NO: 589465 - DNA, 23 bp, Homo sapiens
aaacactatttgtgactttttaa

SEQ ID NO: 589466 - DNA, 11 bp, Homo sapiens
aaacagaaaaa

SEQ ID NO: 589467 - DNA, 11 bp, Homo sapiens
aaacagaaaac

SEQ ID NO: 589468 - DNA, 14 bp, Homo sapiens
aaacagaaatggaa

SEQ ID NO: 589469 - DNA, 17 bp, Homo sapiens
aaacagggccacataga

SEQ ID NO: 589470 - DNA, 22 bp, Homo sapiens
aaacagggctgccttctggcct

SEQ ID NO: 589471 - DNA, 23 bp, Homo sapiens
aaacagtggatcacaaagtggaa

SEQ ID NO: 589472 - DNA, 17 bp, Homo sapiens
aaacatgggctgtgatt

SEQ ID NO: 589473 - DNA, 20 bp, Homo sapiens
aaacatgttcccaaggcccc

SEQ ID NO: 589474 - DNA, 22 bp, Homo sapiens
aaacatttatgacaagctgtat

SEQ ID NO: 589475 - DNA, 12 bp, Homo sapiens
aaacatttgctg

SEQ ID NO: 589476 - DNA, 15 bp, Homo sapiens
aaaccactagaaagt

SEQ ID NO: 589477 - DNA, 19 bp, Homo sapiens
aaaccactttattgcaatg

SEQ ID NO: 589478 - DNA, 22 bp, Homo sapiens
aaactgcttcccttactttgct

SEQ ID NO: 589479 - DNA, 22 bp, Homo sapiens
aaagaagagcgagagatcaaag

SEQ ID NO: 589480 - DNA, 18 bp, Homo sapiens
acatttttttgcatgcat

SEQ ID NO: 589481 - DNA, 16 bp, Homo sapiens
accaaaacagttaatc

SEQ ID NO: 589482 - DNA, 17 bp, Homo sapiens
accacatcaaataagaa

SEQ ID NO: 589483 - DNA, 13 bp, Homo sapiens
accacctccaacc

SEQ ID NO: 589484 - DNA, 14 bp, Homo sapiens
accacgcaggaagc

SEQ ID NO: 589485 - DNA, 17 bp, Homo sapiens
accactttattgcaatg

SEQ ID NO: 589486 - DNA, 18 bp, Homo sapiens
accactttattgcaatgc

SEQ ID NO: 589487 - DNA, 17 bp, Homo sapiens
accagaaagcttcatcc

SEQ ID NO: 589488 - DNA, 19 bp, Homo sapiens
accagcagaaatgccccca

SEQ ID NO: 589489 - DNA, 14 bp, Homo sapiens
accagtgcctgtga

SEQ ID NO: 589490 - DNA, 22 bp, Homo sapiens
accataaattcaactttgtaaa

SEQ ID NO: 589491 - DNA, 14 bp, Homo sapiens
accatatgaatgaa

SEQ ID NO: 589492 - DNA, 15 bp, Homo sapiens
accatatgaatgaaa

SEQ ID NO: 589493 - DNA, 19 bp, Homo sapiens
accatcctggccaacatga

SEQ ID NO: 589494 - DNA, 19 bp, Homo sapiens
accatgtgagctcttccta

SEQ ID NO: 589495 - DNA, 23 bp, Homo sapiens
accattttttaatttacttgttt

SEQ ID NO: 589496 - DNA, 16 bp, Homo sapiens
acccaatccctctcca

SEQ ID NO: 589497 - DNA, 19 bp, Homo sapiens
acccatcttttgttctcct

SEQ ID NO: 589498 - DNA, 16 bp, Homo sapiens
accccaatatatgtat

SEQ ID NO: 589499 - DNA, 19 bp, Homo sapiens
accccaatatatgtatttt

SEQ ID NO: 589500 - DNA, 17 bp, Homo sapiens
acccccttaaatttaat

SEQ ID NO: 589501 - DNA, 14 bp, Homo sapiens
accccttcctgtcc

SEQ ID NO: 589502 - DNA, 19 bp, Homo sapiens
accccttcctgtcctgcct

SEQ ID NO: 589503 - DNA, 16 bp, Homo sapiens
accccttgttgcactg

SEQ ID NO: 589504 - DNA, 17 bp, Homo sapiens
accccttgttgcactgc

SEQ ID NO: 589505 - DNA, 20 bp, Homo sapiens
accccttgttgcactgcccc

SEQ ID NO: 589506 - DNA, 22 bp, Homo sapiens
accccttgttgcactgccccct

SEQ ID NO: 589507 - DNA, 23 bp, Homo sapiens
accccttgttgcactgccccctg

SEQ ID NO: 589508 - DNA, 12 bp, Homo sapiens
acccctttgatt

SEQ ID NO: 589509 - DNA, 18 bp, Homo sapiens
acccgagtacctccagtc

SEQ ID NO: 589510 - DNA, 20 bp, Homo sapiens
acccggttattcgcccaccc

SEQ ID NO: 589511 - DNA, 19 bp, Homo sapiens
accctatgggtctaggaca

SEQ ID NO: 589512 - DNA, 18 bp, Homo sapiens
accctcttgccatcctga

SEQ ID NO: 589513 - DNA, 19 bp, Homo sapiens
accctcttgccatcctgat

SEQ ID NO: 589514 - DNA, 16 bp, Homo sapiens
accctgaacccacacc

SEQ ID NO: 589515 - DNA, 17 bp, Homo sapiens
accctgaacccacacct

SEQ ID NO: 589516 - DNA, 20 bp, Homo sapiens
accctgaacccacacctggg

SEQ ID NO: 589517 - DNA, 14 bp, Homo sapiens
accctgggaagctg

SEQ ID NO: 589518 - DNA, 20 bp, Homo sapiens
acccttctgggtccagggag

SEQ ID NO: 589519 - DNA, 13 bp, Homo sapiens
acccttttaagca

SEQ ID NO: 589520 - DNA, 19 bp, Homo sapiens
acctacagttttaactgtg

SEQ ID NO: 589521 - DNA, 12 bp, Homo sapiens
acctacctccct

SEQ ID NO: 589522 - DNA, 22 bp, Homo sapiens
acctcaggctcctaaagagaca

SEQ ID NO: 589523 - DNA, 14 bp, Homo sapiens
acctccctccctct

SEQ ID NO: 589524 - DNA, 15 bp, Homo sapiens
acctcctcatggcag

SEQ ID NO: 589525 - DNA, 13 bp, Homo sapiens
acctctctgcctc

SEQ ID NO: 589526 - DNA, 17 bp, Homo sapiens
acctctctgcctctctt

SEQ ID NO: 589527 - DNA, 15 bp, Homo sapiens
acctgaatttgtata

SEQ ID NO: 589528 - DNA, 20 bp, Homo sapiens
acctgactaggttctgtaga

SEQ ID NO: 589529 - DNA, 21 bp, Homo sapiens
acctgatgtcagctgctgttg

SEQ ID NO: 589530 - DNA, 18 bp, Homo sapiens
acctgcactaacagagtg

SEQ ID NO: 589531 - DNA, 20 bp, Homo sapiens
acctgccccggacctacctc

SEQ ID NO: 589532 - DNA, 11 bp, Homo sapiens
acctgtagctg

SEQ ID NO: 589533 - DNA, 12 bp, Homo sapiens
acctgtcaatac

SEQ ID NO: 589534 - DNA, 14 bp, Homo sapiens
acctgtcaatacta

SEQ ID NO: 589535 - DNA, 10 bp, Homo sapiens
acctgtggat

SEQ ID NO: 589536 - DNA, 13 bp, Homo sapiens
acctgtggatatt

SEQ ID NO: 589537 - DNA, 16 bp, Homo sapiens
accttccatagcctcc

SEQ ID NO: 589538 - DNA, 16 bp, Homo sapiens
accttgaaaaaaaaca

SEQ ID NO: 589539 - DNA, 23 bp, Homo sapiens
accttgaaaaaaaacagtggatc

SEQ ID NO: 589540 - DNA, 20 bp, Homo sapiens
acctttgagtagatccattt

SEQ ID NO: 589541 - DNA, 19 bp, Homo sapiens
acgaacctacagttttaac

SEQ ID NO: 589542 - DNA, 22 bp, Homo sapiens
acgagtttggatgttgtaaata

SEQ ID NO: 589543 - DNA, 23 bp, Homo sapiens
acgatgcatttaataaagatgag

SEQ ID NO: 589544 - DNA, 15 bp, Homo sapiens
acgcaggaagcctac

SEQ ID NO: 589545 - DNA, 18 bp, Homo sapiens
acgcatcccatctctccc

SEQ ID NO: 589546 - DNA, 19 bp, Homo sapiens
acgcatcccatctctccca

SEQ ID NO: 589547 - DNA, 19 bp, Homo sapiens
acggttcctggtgactcct

SEQ ID NO: 589548 - DNA, 16 bp, Homo sapiens
actaaaaaaaagatga

SEQ ID NO: 589549 - DNA, 18 bp, Homo sapiens
actaagatgttcactgtg

SEQ ID NO: 589550 - DNA, 19 bp, Homo sapiens
actacccatagacatgaaa

SEQ ID NO: 589551 - DNA, 14 bp, Homo sapiens
actacctactggtg

SEQ ID NO: 589552 - DNA, 17 bp, Homo sapiens
actacctactggtgtaa

SEQ ID NO: 589553 - DNA, 13 bp, Homo sapiens
actactactgtta

SEQ ID NO: 589554 - DNA, 14 bp, Homo sapiens
actaggctgagcaa

SEQ ID NO: 589555 - DNA, 23 bp, Homo sapiens
actagtttttagaaaagaaagca

SEQ ID NO: 589556 - DNA, 18 bp, Homo sapiens
actatcttctttggactt

SEQ ID NO: 589557 - DNA, 19 bp, Homo sapiens
actatttaaatccttggct

SEQ ID NO: 589558 - DNA, 11 bp, Homo sapiens
actatttgtga

SEQ ID NO: 589559 - DNA, 19 bp, Homo sapiens
actcaaatacacatttgct

SEQ ID NO: 589560 - DNA, 18 bp, Homo sapiens
actcaatccatccatgta

SEQ ID NO: 589561 - DNA, 15 bp, Homo sapiens
actcagcatcaccca

SEQ ID NO: 589562 - DNA, 19 bp, Homo sapiens
actcagtgaccagtgcctg

SEQ ID NO: 589563 - DNA, 18 bp, Homo sapiens
actcatagacactgatct

SEQ ID NO: 589564 - DNA, 15 bp, Homo sapiens
actcatgggtaataa

SEQ ID NO: 589565 - DNA, 19 bp, Homo sapiens
actcattttcatattgtaa

SEQ ID NO: 589566 - DNA, 18 bp, Homo sapiens
actccctggctgttctga

SEQ ID NO: 589567 - DNA, 15 bp, Homo sapiens
actcctcaaaccact

SEQ ID NO: 589568 - DNA, 18 bp, Homo sapiens
actcgagaccataaagat

SEQ ID NO: 589569 - DNA, 12 bp, Homo sapiens
actcgcccccag

SEQ ID NO: 589570 - DNA, 14 bp, Homo sapiens
actctgcatgtaga

SEQ ID NO: 589571 - DNA, 15 bp, Homo sapiens
actcttatttataga

SEQ ID NO: 589572 - DNA, 15 bp, Homo sapiens
actcttctctccttt

SEQ ID NO: 589573 - DNA, 15 bp, Homo sapiens
actgatttcagagtg

SEQ ID NO: 589574 - DNA, 18 bp, Homo sapiens
actgcaatcactgtgcta

SEQ ID NO: 589575 - DNA, 16 bp, Homo sapiens
actgcactccagcctg

SEQ ID NO: 589576 - DNA, 16 bp, Homo sapiens
actgccgtaatttaac

SEQ ID NO: 589577 - DNA, 17 bp, Homo sapiens
actgccgtaatttaact

SEQ ID NO: 589578 - DNA, 21 bp, Homo sapiens
actgcttcccttactttgctg

SEQ ID NO: 589579 - DNA, 13 bp, Homo sapiens
actggattgcaga

SEQ ID NO: 589580 - DNA, 12 bp, Homo sapiens
actggcacagag

SEQ ID NO: 589581 - DNA, 14 bp, Homo sapiens
actggcacagaggt

SEQ ID NO: 589582 - DNA, 17 bp, Homo sapiens
actgggcactggggcct

SEQ ID NO: 589583 - DNA, 22 bp, Homo sapiens
actgggctgcccacctggctgc

SEQ ID NO: 589584 - DNA, 19 bp, Homo sapiens
actggtgtaatctcaatgc

SEQ ID NO: 589585 - DNA, 14 bp, Homo sapiens
actggtgtccagct

SEQ ID NO: 589586 - DNA, 17 bp, Homo sapiens
actgtaaacttctgcaa

SEQ ID NO: 589587 - DNA, 13 bp, Homo sapiens
actgtaaagatgt

SEQ ID NO: 589588 - DNA, 12 bp, Homo sapiens
actgtactgaat

SEQ ID NO: 589589 - DNA, 14 bp, Homo sapiens
actgtatattcagg

SEQ ID NO: 589590 - DNA, 16 bp, Homo sapiens
actgtatcattttctt

SEQ ID NO: 589591 - DNA, 21 bp, Homo sapiens
aggggctggggacttgtgtct

SEQ ID NO: 589592 - DNA, 23 bp, Homo sapiens
aggggggggtatttcaattacct

SEQ ID NO: 589593 - DNA, 21 bp, Homo sapiens
aggggtatcatgtatggtgat

SEQ ID NO: 589594 - DNA, 13 bp, Homo sapiens
aggtattatacat

SEQ ID NO: 589595 - DNA, 21 bp, Homo sapiens
aggtgaaatccctgcctcagg

SEQ ID NO: 589596 - DNA, 13 bp, Homo sapiens
aggtgatgagttt

SEQ ID NO: 589597 - DNA, 11 bp, Homo sapiens
aggtggcttct

SEQ ID NO: 589598 - DNA, 16 bp, Homo sapiens
aggtgtgatggtctgg

SEQ ID NO: 589599 - DNA, 15 bp, Homo sapiens
aggttagtgacattt

SEQ ID NO: 589600 - DNA, 14 bp, Homo sapiens
aggttatggggaga

SEQ ID NO: 589601 - DNA, 15 bp, Homo sapiens
aggttcatgcccaag

SEQ ID NO: 589602 - DNA, 15 bp, Homo sapiens
aggttccccaatcca

SEQ ID NO: 589603 - DNA, 19 bp, Homo sapiens
aggttctgtagagccaatt

SEQ ID NO: 589604 - DNA, 20 bp, Homo sapiens
aggttctgtagagccaatta

SEQ ID NO: 589605 - DNA, 18 bp, Homo sapiens
aggttgtggggcctcagg

SEQ ID NO: 589606 - DNA, 13 bp, Homo sapiens
aggtttgcaggag

SEQ ID NO: 589607 - DNA, 23 bp, Homo sapiens
agtaagaataccacatcaaataa

SEQ ID NO: 589608 - DNA, 17 bp, Homo sapiens
agtaatgctaaatgtgt

SEQ ID NO: 589609 - DNA, 19 bp, Homo sapiens
agtaatgctaaatgtgtaa

SEQ ID NO: 589610 - DNA, 21 bp, Homo sapiens
agtaatgctaaatgtgtaata

SEQ ID NO: 589611 - DNA, 23 bp, Homo sapiens
agtagcatctcagtggtgtgtga

SEQ ID NO: 589612 - DNA, 21 bp, Homo sapiens
agtatattgataaccttgaaa

SEQ ID NO: 589613 - DNA, 16 bp, Homo sapiens
agtattgtttaaaatg

SEQ ID NO: 589614 - DNA, 19 bp, Homo sapiens
agtattgtttaaaatgtaa

SEQ ID NO: 589615 - DNA, 14 bp, Homo sapiens
agtatttccttcca

SEQ ID NO: 589616 - DNA, 18 bp, Homo sapiens
agtatttccttccactgt

SEQ ID NO: 589617 - DNA, 23 bp, Homo sapiens
agtatttccttccactgtagcta

SEQ ID NO: 589618 - DNA, 23 bp, Homo sapiens
agtcactggtctgtttgcatttg

SEQ ID NO: 589619 - DNA, 18 bp, Homo sapiens
agtcagaatttttaactg

SEQ ID NO: 589620 - DNA, 19 bp, Homo sapiens
agtcagaatttttaactgt

SEQ ID NO: 589621 - DNA, 16 bp, Homo sapiens
agtccagcagtttcca

SEQ ID NO: 589622 - DNA, 23 bp, Homo sapiens
agtcccttcctattctcctgcca

SEQ ID NO: 589623 - DNA, 16 bp, Homo sapiens
agtctccagaagaaaa

SEQ ID NO: 589624 - DNA, 21 bp, Homo sapiens
agtctccagaagaaaatttgc

SEQ ID NO: 589625 - DNA, 16 bp, Homo sapiens
agtctctgtgtaacca

SEQ ID NO: 589626 - DNA, 19 bp, Homo sapiens
agtctggagtgggatagga

SEQ ID NO: 589627 - DNA, 17 bp, Homo sapiens
agtctgtactaaacagt

SEQ ID NO: 589628 - DNA, 22 bp, Homo sapiens
agtctgtactaaacagtaagat

SEQ ID NO: 589629 - DNA, 23 bp, Homo sapiens
agtcttagctgaggctgagaaag

SEQ ID NO: 589630 - DNA, 17 bp, Homo sapiens
agtctttcatggctgct

SEQ ID NO: 589631 - DNA, 18 bp, Homo sapiens
agtgacaaagcctctgaa

SEQ ID NO: 589632 - DNA, 18 bp, Homo sapiens
agtgagacccctgtctcc

SEQ ID NO: 589633 - DNA, 13 bp, Homo sapiens
agtgatggtcaga

SEQ ID NO: 589634 - DNA, 20 bp, Homo sapiens
agtgatgtccttaaaatgtg

SEQ ID NO: 589635 - DNA, 17 bp, Homo sapiens
agtgccactgttgtttt

SEQ ID NO: 589636 - DNA, 19 bp, Homo sapiens
agtgcggtttactcactgc

SEQ ID NO: 589637 - DNA, 23 bp, Homo sapiens
agtgctgtcttaaactaaatgtg

SEQ ID NO: 589638 - DNA, 17 bp, Homo sapiens
agtggagagagcagggc

SEQ ID NO: 589639 - DNA, 16 bp, Homo sapiens
agtgtctgtgttttga

SEQ ID NO: 589640 - DNA, 15 bp, Homo sapiens
agtgtgctgggcaga

SEQ ID NO: 589641 - DNA, 13 bp, Homo sapiens
agtgtgtaaataa

SEQ ID NO: 589642 - DNA, 13 bp, Homo sapiens
agtgtgtgccaag

SEQ ID NO: 589643 - DNA, 17 bp, Homo sapiens
agtgttccaagtctctg

SEQ ID NO: 589644 - DNA, 20 bp, Homo sapiens
agttatacttatttgtatat

SEQ ID NO: 589645 - DNA, 12 bp, Homo sapiens
agttcaaaaaca

SEQ ID NO: 589646 - DNA, 13 bp, Homo sapiens
agttcctgggaac

SEQ ID NO: 589647 - DNA, 23 bp, Homo sapiens
agttctaacagtgaagttttact

SEQ ID NO: 589648 - DNA, 16 bp, Homo sapiens
agttctcaaatgtgtg

SEQ ID NO: 589649 - DNA, 15 bp, Homo sapiens
agttctcaatgtaga

SEQ ID NO: 589650 - DNA, 18 bp, Homo sapiens
agttctggatgtctggct

SEQ ID NO: 589651 - DNA, 15 bp, Homo sapiens
agttctttggattct

SEQ ID NO: 589652 - DNA, 22 bp, Homo sapiens
agttctttggattctaaataca

SEQ ID NO: 589653 - DNA, 20 bp, Homo sapiens
agttgccaaagttttgctgt

SEQ ID NO: 589654 - DNA, 15 bp, Homo sapiens
agtttaatgtctcct

SEQ ID NO: 589655 - DNA, 18 bp, Homo sapiens
agtttcagtttgttggaa

SEQ ID NO: 589656 - DNA, 16 bp, Homo sapiens
agtttgaattcagtaa

SEQ ID NO: 589657 - DNA, 21 bp, Homo sapiens
agtttggatgttgtaaataaa

SEQ ID NO: 589658 - DNA, 14 bp, Homo sapiens
agttttatatgctt

SEQ ID NO: 589659 - DNA, 16 bp, Homo sapiens
agttttatatgcttta

SEQ ID NO: 589660 - DNA, 17 bp, Homo sapiens
agttttatatgctttat

SEQ ID NO: 589661 - DNA, 22 bp, Homo sapiens
agttttcggaaacactgactta

SEQ ID NO: 589662 - DNA, 14 bp, Homo sapiens
agttttgctgtctc

SEQ ID NO: 589663 - DNA, 16 bp, Homo sapiens
agtttttgacatttat

SEQ ID NO: 589664 - DNA, 16 bp, Homo sapiens
agtttttggttgggaa

SEQ ID NO: 589665 - DNA, 13 bp, Homo sapiens
ataaacagaaatg

SEQ ID NO: 589666 - DNA, 23 bp, Homo sapiens
ataaacggttcctggtgactcct

SEQ ID NO: 589667 - DNA, 13 bp, Homo sapiens
ataaagatgagtt

SEQ ID NO: 589668 - DNA, 14 bp, Homo sapiens
ataaagatgagttg

SEQ ID NO: 589669 - DNA, 18 bp, Homo sapiens
ataaagattatataaaga

SEQ ID NO: 589670 - DNA, 16 bp, Homo sapiens
ataaagtacttgacta

SEQ ID NO: 589671 - DNA, 19 bp, Homo sapiens
ataaatgtataaatataca

SEQ ID NO: 589672 - DNA, 19 bp, Homo sapiens
ataacagtcttactgcagg

SEQ ID NO: 589673 - DNA, 23 bp, Homo sapiens
ataagaagaagttcatgtccaaa

SEQ ID NO: 589674 - DNA, 16 bp, Homo sapiens
ataagatgaaacatca

SEQ ID NO: 589675 - DNA, 13 bp, Homo sapiens
ataagcactgtaa

SEQ ID NO: 589676 - DNA, 17 bp, Homo sapiens
ataataaaaagaaagat

SEQ ID NO: 589677 - DNA, 23 bp, Homo sapiens
ataataaaaagaaagatacttac

SEQ ID NO: 589678 - DNA, 12 bp, Homo sapiens
ataataaaggaa

SEQ ID NO: 589679 - DNA, 16 bp, Homo sapiens
ataataaagtacttga

SEQ ID NO: 589680 - DNA, 18 bp, Homo sapiens
ataataaagtacttgact

SEQ ID NO: 589681 - DNA, 15 bp, Homo sapiens
ataataggccacaga

SEQ ID NO: 589682 - DNA, 14 bp, Homo sapiens
ataatattgtttgg

SEQ ID NO: 589683 - DNA, 20 bp, Homo sapiens
ataatgacactgtttcctga

SEQ ID NO: 589684 - DNA, 22 bp, Homo sapiens
ataatgatcagcaaaaagactg

SEQ ID NO: 589685 - DNA, 17 bp, Homo sapiens
ataatgctacaatttta

SEQ ID NO: 589686 - DNA, 15 bp, Homo sapiens
ataatgtaacatgat

SEQ ID NO: 589687 - DNA, 22 bp, Homo sapiens
ataattaaccaaccttgtttaa

SEQ ID NO: 589688 - DNA, 15 bp, Homo sapiens
ataattgtacaaaat

SEQ ID NO: 589689 - DNA, 24 bp, Homo sapiens
ataattgtacaaaattaagcaaat

SEQ ID NO: 589690 - DNA, 18 bp, Homo sapiens
ataatttgaactttggaa

SEQ ID NO: 589691 - DNA, 22 bp, Homo sapiens
atacacatttgctactgttgta

SEQ ID NO: 589692 - DNA, 17 bp, Homo sapiens
atacatgccacatcaaa

SEQ ID NO: 589693 - DNA, 18 bp, Homo sapiens
ataccatttagtaagaat

SEQ ID NO: 589694 - DNA, 22 bp, Homo sapiens
ataccatttagtaagaatacca

SEQ ID NO: 589695 - DNA, 12 bp, Homo sapiens
atactccttccc

SEQ ID NO: 589696 - DNA, 12 bp, Homo sapiens
atactgaaccag

SEQ ID NO: 589697 - DNA, 17 bp, Homo sapiens
atactgaaccaggccag

SEQ ID NO: 589698 - DNA, 21 bp, Homo sapiens
atactgccaaaacatttatga

SEQ ID NO: 589699 - DNA, 17 bp, Homo sapiens
atacttacatgttccca

SEQ ID NO: 589700 - DNA, 15 bp, Homo sapiens
attgtttaaaatgta

SEQ ID NO: 589701 - DNA, 16 bp, Homo sapiens
atttaataaagatgag

SEQ ID NO: 589702 - DNA, 15 bp, Homo sapiens
atttacttgttttgg

SEQ ID NO: 589703 - DNA, 23 bp, Homo sapiens
atttacttgttttggatggcttg

SEQ ID NO: 589704 - DNA, 15 bp, Homo sapiens
atttagtaagaatac

SEQ ID NO: 589705 - DNA, 13 bp, Homo sapiens
atttatattaaat

SEQ ID NO: 589706 - DNA, 24 bp, Homo sapiens
atttatgacaagctgtatcactgc

SEQ ID NO: 589707 - DNA, 17 bp, Homo sapiens
atttattttttaagaaa

SEQ ID NO: 589708 - DNA, 19 bp, Homo sapiens
atttcaaagttttgttgta

SEQ ID NO: 589709 - DNA, 17 bp, Homo sapiens
atttcaataaatgatat

SEQ ID NO: 589710 - DNA, 23 bp, Homo sapiens
atttcagagtgactacacacagt

SEQ ID NO: 589711 - DNA, 13 bp, Homo sapiens
atttccattgctt

SEQ ID NO: 589712 - DNA, 20 bp, Homo sapiens
atttccctccagagaaagca

SEQ ID NO: 589713 - DNA, 15 bp, Homo sapiens
atttccttccactgt

SEQ ID NO: 589714 - DNA, 20 bp, Homo sapiens
atttccttccactgtagcta

SEQ ID NO: 589715 - DNA, 17 bp, Homo sapiens
atttctcattgactttt

SEQ ID NO: 589716 - DNA, 18 bp, Homo sapiens
atttgattgggatgaatg

SEQ ID NO: 589717 - DNA, 11 bp, Homo sapiens
atttgcactga

SEQ ID NO: 589718 - DNA, 20 bp, Homo sapiens
atttggatttaaaagcctgc

SEQ ID NO: 589719 - DNA, 22 bp, Homo sapiens
attttatattactgacatttct

SEQ ID NO: 589720 - DNA, 17 bp, Homo sapiens
attttgaaatgaacttt

SEQ ID NO: 589721 - DNA, 14 bp, Homo sapiens
attttgttgaaatt

SEQ ID NO: 589722 - DNA, 12 bp, Homo sapiens
attttgtttaca

SEQ ID NO: 589723 - DNA, 16 bp, Homo sapiens
atttttctttaactgc

SEQ ID NO: 589724 - DNA, 13 bp, Homo sapiens
atttttgtgaaga

SEQ ID NO: 589725 - DNA, 16 bp, Homo sapiens
attttttaagaaaaaa

SEQ ID NO: 589726 - DNA, 15 bp, Homo sapiens
atttttttaaaattt

SEQ ID NO: 589727 - DNA, 17 bp, Homo sapiens
atttttttaactgtgat

SEQ ID NO: 589728 - DNA, 18 bp, Homo sapiens
atttttttaactgtgata

SEQ ID NO: 589729 - DNA, 21 bp, Homo sapiens
atttttttaactgtgataatc

SEQ ID NO: 589730 - DNA, 14 bp, Homo sapiens
caaaacaatggtgt

SEQ ID NO: 589731 - DNA, 18 bp, Homo sapiens
caaaacatttatgacaag

SEQ ID NO: 589732 - DNA, 17 bp, Homo sapiens
caaaactccaggcagga

SEQ ID NO: 589733 - DNA, 15 bp, Homo sapiens
caaaaggaggtgaaa

SEQ ID NO: 589734 - DNA, 17 bp, Homo sapiens
caaaagggcagctgtga

SEQ ID NO: 589735 - DNA, 19 bp, Homo sapiens
caaaatatattttcagtac

SEQ ID NO: 589736 - DNA, 14 bp, Homo sapiens
caaacaaaactctt

SEQ ID NO: 589737 - DNA, 16 bp, Homo sapiens
caaacaagccccctgc

SEQ ID NO: 589738 - DNA, 18 bp, Homo sapiens
caaacaagccccctgccc

SEQ ID NO: 589739 - DNA, 14 bp, Homo sapiens
caaacagacaaaac

SEQ ID NO: 589740 - DNA, 14 bp, Homo sapiens
caaaccacttgcct

SEQ ID NO: 589741 - DNA, 15 bp, Homo sapiens
caaacctttgagtag

SEQ ID NO: 589742 - DNA, 17 bp, Homo sapiens
caaacttaagaaacact

SEQ ID NO: 589743 - DNA, 16 bp, Homo sapiens
caaagccggcctgaga

SEQ ID NO: 589744 - DNA, 18 bp, Homo sapiens
caaagtctccagaagaaa

SEQ ID NO: 589745 - DNA, 11 bp, Homo sapiens
caaagtggaac

SEQ ID NO: 589746 - DNA, 14 bp, Homo sapiens
caaagttttgctgt

SEQ ID NO: 589747 - DNA, 22 bp, Homo sapiens
caaagttttgttgtacttaaat

SEQ ID NO: 589748 - DNA, 14 bp, Homo sapiens
caaataagaaataa

SEQ ID NO: 589749 - DNA, 16 bp, Homo sapiens
caaataatttgaactt

SEQ ID NO: 589750 - DNA, 20 bp, Homo sapiens
caaataatttgaactttgga

SEQ ID NO: 589751 - DNA, 21 bp, Homo sapiens
caaataatttgaactttggaa

SEQ ID NO: 589752 - DNA, 16 bp, Homo sapiens
caaatacacatttgct

SEQ ID NO: 589753 - DNA, 18 bp, Homo sapiens
caaatactgtatattcag

SEQ ID NO: 589754 - DNA, 19 bp, Homo sapiens
caaatttaaaactgttgga

SEQ ID NO: 589755 - DNA, 23 bp, Homo sapiens
caacaccttcagaggctgaggtg

SEQ ID NO: 589756 - DNA, 21 bp, Homo sapiens
caacagacacaatttatactg

SEQ ID NO: 589757 - DNA, 15 bp, Homo sapiens
caacattaaacacaa

SEQ ID NO: 589758 - DNA, 15 bp, Homo sapiens
caacccaatccctct

SEQ ID NO: 589759 - DNA, 13 bp, Homo sapiens
caaccttgtttaa

SEQ ID NO: 589760 - DNA, 14 bp, Homo sapiens
caaccttgtttaat

SEQ ID NO: 589761 - DNA, 14 bp, Homo sapiens
caacggcaagacag

SEQ ID NO: 589762 - DNA, 15 bp, Homo sapiens
caagacccctgtctt

SEQ ID NO: 589763 - DNA, 15 bp, Homo sapiens
caagaccctgtctct

SEQ ID NO: 589764 - DNA, 20 bp, Homo sapiens
caagatgccccagggatggg

SEQ ID NO: 589765 - DNA, 17 bp, Homo sapiens
caagcattctgtttatc

SEQ ID NO: 589766 - DNA, 14 bp, Homo sapiens
caagccccaacttt

SEQ ID NO: 589767 - DNA, 14 bp, Homo sapiens
caagccctgagagt

SEQ ID NO: 589768 - DNA, 22 bp, Homo sapiens
caaggctgtgtttagattgtat

SEQ ID NO: 589769 - DNA, 21 bp, Homo sapiens
caagtaaatagtttgaattca

SEQ ID NO: 589770 - DNA, 11 bp, Homo sapiens
caataaaattt

SEQ ID NO: 589771 - DNA, 13 bp, Homo sapiens
caataaaatttaa

SEQ ID NO: 589772 - DNA, 14 bp, Homo sapiens
caataaaatttaaa

SEQ ID NO: 589773 - DNA, 15 bp, Homo sapiens
caataataaagtact

SEQ ID NO: 589774 - DNA, 14 bp, Homo sapiens
caatacaaaatgta

SEQ ID NO: 589775 - DNA, 11 bp, Homo sapiens
caatactgctt

SEQ ID NO: 589776 - DNA, 12 bp, Homo sapiens
caatatatgtat

SEQ ID NO: 589777 - DNA, 20 bp, Homo sapiens
caatatatgtattttttgaa

SEQ ID NO: 589778 - DNA, 16 bp, Homo sapiens
caatattgattgggaa

SEQ ID NO: 589779 - DNA, 15 bp, Homo sapiens
caatcactgtgctat

SEQ ID NO: 589780 - DNA, 11 bp, Homo sapiens
caatccctctc

SEQ ID NO: 589781 - DNA, 16 bp, Homo sapiens
caatccctctccactc

SEQ ID NO: 589782 - DNA, 22 bp, Homo sapiens
caatccctctccactcttctct

SEQ ID NO: 589783 - DNA, 14 bp, Homo sapiens
caatctctttttgt

SEQ ID NO: 589784 - DNA, 15 bp, Homo sapiens
caatgaaccataaat

SEQ ID NO: 589785 - DNA, 17 bp, Homo sapiens
caatgaaccataaattc

SEQ ID NO: 589786 - DNA, 14 bp, Homo sapiens
caatgactgagcag

SEQ ID NO: 589787 - DNA, 22 bp, Homo sapiens
caatgattatttgtatttacag

SEQ ID NO: 589788 - DNA, 15 bp, Homo sapiens
caatgcctcagtagc

SEQ ID NO: 589789 - DNA, 17 bp, Homo sapiens
caatgtctaaaaacatt

SEQ ID NO: 589790 - DNA, 11 bp, Homo sapiens
caattaactgc

SEQ ID NO: 589791 - DNA, 15 bp, Homo sapiens
caattagacttgaaa

SEQ ID NO: 589792 - DNA, 20 bp, Homo sapiens
caattgcttactcattaaaa

SEQ ID NO: 589793 - DNA, 17 bp, Homo sapiens
caattgggagctgccaa

SEQ ID NO: 589794 - DNA, 21 bp, Homo sapiens
caattgggagctgccaagagt

SEQ ID NO: 589795 - DNA, 13 bp, Homo sapiens
caatttaaaacaa

SEQ ID NO: 589796 - DNA, 14 bp, Homo sapiens
caatttaaaacaat

SEQ ID NO: 589797 - DNA, 13 bp, Homo sapiens
caatttatactgc

SEQ ID NO: 589798 - DNA, 23 bp, Homo sapiens
caatttggatttaaaagcctgct

SEQ ID NO: 589799 - DNA, 22 bp, Homo sapiens
cacaaaatatattttgtttaca

SEQ ID NO: 589800 - DNA, 9 bp, Homo sapiens
cacacacac

SEQ ID NO: 589801 - DNA, 16 bp, Homo sapiens
cacacacacacacaca

SEQ ID NO: 589802 - DNA, 14 bp, Homo sapiens
cacacacacacacg

SEQ ID NO: 589803 - DNA, 10 bp, Homo sapiens
cacacgatgc

SEQ ID NO: 589804 - DNA, 18 bp, Homo sapiens
cacagaaggtgaactttg

SEQ ID NO: 589805 - DNA, 19 bp, Homo sapiens
cacagaaggtgaactttgt

SEQ ID NO: 589806 - DNA, 23 bp, Homo sapiens
cacagaggtagtctcactgcttg

SEQ ID NO: 589807 - DNA, 18 bp, Homo sapiens
cacagatcgcatttccta

SEQ ID NO: 589808 - DNA, 19 bp, Homo sapiens
cacagatcgcatttcctaa

SEQ ID NO: 589809 - DNA, 20 bp, Homo sapiens
cacagatcgcatttcctaag

SEQ ID NO: 589810 - DNA, 16 bp, Homo sapiens
cacagcattgtatatg

SEQ ID NO: 589811 - DNA, 22 bp, Homo sapiens
catttgctactgttgtaagaat

SEQ ID NO: 589812 - DNA, 17 bp, Homo sapiens
cattttaagttttactg

SEQ ID NO: 589813 - DNA, 15 bp, Homo sapiens
cattttaattttaaa

SEQ ID NO: 589814 - DNA, 16 bp, Homo sapiens
cattttcatattgtaa

SEQ ID NO: 589815 - DNA, 21 bp, Homo sapiens
cattttttaatttacttgttt

SEQ ID NO: 589816 - DNA, 23 bp, Homo sapiens
ccaaaaggtttaagaaatagaat

SEQ ID NO: 589817 - DNA, 23 bp, Homo sapiens
ccaacatgatccccgtctctgcc

SEQ ID NO: 589818 - DNA, 13 bp, Homo sapiens
ccaacccaatccc

SEQ ID NO: 589819 - DNA, 16 bp, Homo sapiens
ccaacccaatccctct

SEQ ID NO: 589820 - DNA, 17 bp, Homo sapiens
ccaactttttcatagta

SEQ ID NO: 589821 - DNA, 13 bp, Homo sapiens
ccaagcatagaga

SEQ ID NO: 589822 - DNA, 18 bp, Homo sapiens
ccaaggaaaggcatgtac

SEQ ID NO: 589823 - DNA, 20 bp, Homo sapiens
ccaatccatcgtattaaaaa

SEQ ID NO: 589824 - DNA, 13 bp, Homo sapiens
ccaatccctctcc

SEQ ID NO: 589825 - DNA, 17 bp, Homo sapiens
ccacaaataaatgacaa

SEQ ID NO: 589826 - DNA, 17 bp, Homo sapiens
ccacacttgaaaccttt

SEQ ID NO: 589827 - DNA, 19 bp, Homo sapiens
ccacagcagccccaggaga

SEQ ID NO: 589828 - DNA, 18 bp, Homo sapiens
ccacagccttgcagcggc

SEQ ID NO: 589829 - DNA, 20 bp, Homo sapiens
ccacaggcacattaactgtt

SEQ ID NO: 589830 - DNA, 15 bp, Homo sapiens
ccaccagtgtagcat

SEQ ID NO: 589831 - DNA, 21 bp, Homo sapiens
ccaccagtgtagcatcttcct

SEQ ID NO: 589832 - DNA, 15 bp, Homo sapiens
ccacctcctacccct

SEQ ID NO: 589833 - DNA, 12 bp, Homo sapiens
ccacctggctgc

SEQ ID NO: 589834 - DNA, 13 bp, Homo sapiens
ccacctggctgcc

SEQ ID NO: 589835 - DNA, 12 bp, Homo sapiens
ccacctgtagct

SEQ ID NO: 589836 - DNA, 21 bp, Homo sapiens
ccactcaatccatccatgtac

SEQ ID NO: 589837 - DNA, 12 bp, Homo sapiens
ccactcctggga

SEQ ID NO: 589838 - DNA, 16 bp, Homo sapiens
ccactcttctctcctt

SEQ ID NO: 589839 - DNA, 18 bp, Homo sapiens
ccactgcactccagcctg

SEQ ID NO: 589840 - DNA, 12 bp, Homo sapiens
ccacttcctcct

SEQ ID NO: 589841 - DNA, 14 bp, Homo sapiens
ccacttcctcctac

SEQ ID NO: 589842 - DNA, 18 bp, Homo sapiens
ccacttcctcctacctgg

SEQ ID NO: 589843 - DNA, 19 bp, Homo sapiens
ccacttcctcctacctggg

SEQ ID NO: 589844 - DNA, 21 bp, Homo sapiens
ccacttcctcctacctgggga

SEQ ID NO: 589845 - DNA, 22 bp, Homo sapiens
ccacttcctcctacctggggac

SEQ ID NO: 589846 - DNA, 13 bp, Homo sapiens
ccacttgcctggg

SEQ ID NO: 589847 - DNA, 19 bp, Homo sapiens
ccagagaacctgtgggctg

SEQ ID NO: 589848 - DNA, 17 bp, Homo sapiens
ccagagcaaacagaaaa

SEQ ID NO: 589849 - DNA, 16 bp, Homo sapiens
ccagatctttcagaaa

SEQ ID NO: 589850 - DNA, 23 bp, Homo sapiens
ccagctgcagcctggttggcagc

SEQ ID NO: 589851 - DNA, 17 bp, Homo sapiens
ccaggaacgctctcctc

SEQ ID NO: 589852 - DNA, 20 bp, Homo sapiens
ccaggacatgcaataaaatt

SEQ ID NO: 589853 - DNA, 23 bp, Homo sapiens
ccaggagtttaagaccagcctgg

SEQ ID NO: 589854 - DNA, 20 bp, Homo sapiens
ccaggatactggcacagagg

SEQ ID NO: 589855 - DNA, 21 bp, Homo sapiens
ccaggatactggcacagaggt

SEQ ID NO: 589856 - DNA, 20 bp, Homo sapiens
ccaggcaagaaagcttcctt

SEQ ID NO: 589857 - DNA, 14 bp, Homo sapiens
ccagggatgggagg

SEQ ID NO: 589858 - DNA, 22 bp, Homo sapiens
ccagggcaccgtattcctctcc

SEQ ID NO: 589859 - DNA, 19 bp, Homo sapiens
ccaggtatccaaaaatgtg

SEQ ID NO: 589860 - DNA, 22 bp, Homo sapiens
ccaggtgtggttgctcacagct

SEQ ID NO: 589861 - DNA, 23 bp, Homo sapiens
ccagtgcctgtgagcatggggcc

SEQ ID NO: 589862 - DNA, 19 bp, Homo sapiens
ccagtgtagcatcttcctc

SEQ ID NO: 589863 - DNA, 21 bp, Homo sapiens
ccagtgtagcatcttcctctg

SEQ ID NO: 589864 - DNA, 19 bp, Homo sapiens
ccagtgttctgcatggatt

SEQ ID NO: 589865 - DNA, 12 bp, Homo sapiens
ccagttcaaaaa

SEQ ID NO: 589866 - DNA, 17 bp, Homo sapiens
ccataaacggttcctgg

SEQ ID NO: 589867 - DNA, 14 bp, Homo sapiens
ccatagatgctggc

SEQ ID NO: 589868 - DNA, 11 bp, Homo sapiens
ccatcctgatg

SEQ ID NO: 589869 - DNA, 14 bp, Homo sapiens
ccatcgcgccagcg

SEQ ID NO: 589870 - DNA, 12 bp, Homo sapiens
ccatctctccca

SEQ ID NO: 589871 - DNA, 14 bp, Homo sapiens
ccatctctcccact

SEQ ID NO: 589872 - DNA, 15 bp, Homo sapiens
ccatctctcccactt

SEQ ID NO: 589873 - DNA, 19 bp, Homo sapiens
ccatctctcccacttcctc

SEQ ID NO: 589874 - DNA, 22 bp, Homo sapiens
ccatctctcccacttcctccta

SEQ ID NO: 589875 - DNA, 11 bp, Homo sapiens
ccatgccccca

SEQ ID NO: 589876 - DNA, 11 bp, Homo sapiens
ccatgcctccc

SEQ ID NO: 589877 - DNA, 14 bp, Homo sapiens
ccatgcctccctgg

SEQ ID NO: 589878 - DNA, 20 bp, Homo sapiens
ccatgcctccctgggccacc

SEQ ID NO: 589879 - DNA, 18 bp, Homo sapiens
ccatggggtcggctcctg

SEQ ID NO: 589880 - DNA, 21 bp, Homo sapiens
ccatggggtcggctcctgatg

SEQ ID NO: 589881 - DNA, 23 bp, Homo sapiens
ccattacagaggtattaaaacta

SEQ ID NO: 589882 - DNA, 14 bp, Homo sapiens
ccattctcccagtc

SEQ ID NO: 589883 - DNA, 17 bp, Homo sapiens
ccattctcccagtctct

SEQ ID NO: 589884 - DNA, 20 bp, Homo sapiens
ccattctgcactcagaaaat

SEQ ID NO: 589885 - DNA, 17 bp, Homo sapiens
ccattgaacagctgtga

SEQ ID NO: 589886 - DNA, 18 bp, Homo sapiens
ccattgcttattatgtag

SEQ ID NO: 589887 - DNA, 14 bp, Homo sapiens
cccaaagagaaaga

SEQ ID NO: 589888 - DNA, 14 bp, Homo sapiens
cccaacccaatccc

SEQ ID NO: 589889 - DNA, 12 bp, Homo sapiens
cccaatccctct

SEQ ID NO: 589890 - DNA, 17 bp, Homo sapiens
cccaatccctctccact

SEQ ID NO: 589891 - DNA, 20 bp, Homo sapiens
cccacaggcacattaactgt

SEQ ID NO: 589892 - DNA, 21 bp, Homo sapiens
cccacaggcacattaactgtt

SEQ ID NO: 589893 - DNA, 16 bp, Homo sapiens
cccaccagtgtagcat

SEQ ID NO: 589894 - DNA, 12 bp, Homo sapiens
cccacctggctg

SEQ ID NO: 589895 - DNA, 13 bp, Homo sapiens
cccacctgtagct

SEQ ID NO: 589896 - DNA, 13 bp, Homo sapiens
cccactcctggga

SEQ ID NO: 589897 - DNA, 16 bp, Homo sapiens
cccacttcctcctacc

SEQ ID NO: 589898 - DNA, 18 bp, Homo sapiens
cccacttcctcctacctg

SEQ ID NO: 589899 - DNA, 23 bp, Homo sapiens
cccactttcaagaatcagacagc

SEQ ID NO: 589900 - DNA, 10 bp, Homo sapiens
cccagagctg

SEQ ID NO: 589901 - DNA, 22 bp, Homo sapiens
cccaggaatttgaagctgcagt

SEQ ID NO: 589902 - DNA, 13 bp, Homo sapiens
cccaggaggctga

SEQ ID NO: 589903 - DNA, 17 bp, Homo sapiens
cccaggatactggcaca

SEQ ID NO: 589904 - DNA, 19 bp, Homo sapiens
cccaggatactggcacaga

SEQ ID NO: 589905 - DNA, 20 bp, Homo sapiens
cccaggtgtttgtggggctg

SEQ ID NO: 589906 - DNA, 17 bp, Homo sapiens
cccattctcccagtctc

SEQ ID NO: 589907 - DNA, 20 bp, Homo sapiens
cccattctcccagtctctgt

SEQ ID NO: 589908 - DNA, 15 bp, Homo sapiens
ccccaaacagactcg

SEQ ID NO: 589909 - DNA, 14 bp, Homo sapiens
ccccaccctcccct

SEQ ID NO: 589910 - DNA, 15 bp, Homo sapiens
ccccggacctacctc

SEQ ID NO: 589911 - DNA, 13 bp, Homo sapiens
ccccgtctctgcc

SEQ ID NO: 589912 - DNA, 14 bp, Homo sapiens
ccccgtctctgccc

SEQ ID NO: 589913 - DNA, 17 bp, Homo sapiens
ccccgtctctgccctgg

SEQ ID NO: 589914 - DNA, 15 bp, Homo sapiens
cccctatcctcccct

SEQ ID NO: 589915 - DNA, 14 bp, Homo sapiens
ccccttcctgtcct

SEQ ID NO: 589916 - DNA, 21 bp, Homo sapiens
ccccttcctgtcctgcctcct

SEQ ID NO: 589917 - DNA, 15 bp, Homo sapiens
cccggacctacctcc

SEQ ID NO: 589918 - DNA, 21 bp, Homo sapiens
cccgtttgtcaaagaggatgg

SEQ ID NO: 589919 - DNA, 19 bp, Homo sapiens
ccctaatttaacccagctc

SEQ ID NO: 589920 - DNA, 20 bp, Homo sapiens
ccctaggatcccgtcttcca

SEQ ID NO: 589921 - DNA, 21 bp, Homo sapiens
ccctaggatcccgtcttccag

SEQ ID NO: 589922 - DNA, 22 bp, Homo sapiens
ccctaggatcccgtcttccaga

SEQ ID NO: 589923 - DNA, 12 bp, Homo sapiens
ccctatcctccc

SEQ ID NO: 589924 - DNA, 13 bp, Homo sapiens
ccctccagagaca

SEQ ID NO: 589925 - DNA, 23 bp, Homo sapiens
ccctccattctgcactcagaaaa

SEQ ID NO: 589926 - DNA, 14 bp, Homo sapiens
ccctccctctccgc

SEQ ID NO: 589927 - DNA, 13 bp, Homo sapiens
ccctctccactct

SEQ ID NO: 589928 - DNA, 15 bp, Homo sapiens
ccctcttctctcctc

SEQ ID NO: 589929 - DNA, 13 bp, Homo sapiens
ccctcttgccatc

SEQ ID NO: 589930 - DNA, 12 bp, Homo sapiens
ccctgaggccta

SEQ ID NO: 589931 - DNA, 17 bp, Homo sapiens
ccctgcaaaactccagg

SEQ ID NO: 589932 - DNA, 22 bp, Homo sapiens
ccctgcaaaactccaggcagga

SEQ ID NO: 589933 - DNA, 22 bp, Homo sapiens
ccctgccagctgcagcctggtt

SEQ ID NO: 589934 - DNA, 15 bp, Homo sapiens
ccctgcccccacccc

SEQ ID NO: 589935 - DNA, 24 bp, Homo sapiens
ccctgcctcaggccaagggaccag

SEQ ID NO: 589936 - DNA, 16 bp, Homo sapiens
ccctgggccacctcct

SEQ ID NO: 589937 - DNA, 17 bp, Homo sapiens
ccctgggccacctccta

SEQ ID NO: 589938 - DNA, 21 bp, Homo sapiens
cccttactggcttacctcctc

SEQ ID NO: 589939 - DNA, 18 bp, Homo sapiens
cccttcctattctcctgc

SEQ ID NO: 589940 - DNA, 22 bp, Homo sapiens
cccttcctattctcctgccatg

SEQ ID NO: 589941 - DNA, 19 bp, Homo sapiens
cccttcctgtcctgcctcc

SEQ ID NO: 589942 - DNA, 20 bp, Homo sapiens
cccttcctgtcctgcctcct

SEQ ID NO: 589943 - DNA, 14 bp, Homo sapiens
cccttgttgcactg

SEQ ID NO: 589944 - DNA, 16 bp, Homo sapiens
cccttgttgcactgcc

SEQ ID NO: 589945 - DNA, 13 bp, Homo sapiens
ccctttgtcctgc

SEQ ID NO: 589946 - DNA, 21 bp, Homo sapiens
ccgagcatgcttccctaggat

SEQ ID NO: 589947 - DNA, 14 bp, Homo sapiens
ccgagtacctccag

SEQ ID NO: 589948 - DNA, 19 bp, Homo sapiens
ccggatgaaacttctcagt

SEQ ID NO: 589949 - DNA, 20 bp, Homo sapiens
ccgggggaggggcgcgggag

SEQ ID NO: 589950 - DNA, 13 bp, Homo sapiens
ccgtaatttaact

SEQ ID NO: 589951 - DNA, 16 bp, Homo sapiens
ccgtctctgccctggg

SEQ ID NO: 589952 - DNA, 22 bp, Homo sapiens
ccgtctctgccctgggctcctc

SEQ ID NO: 589953 - DNA, 15 bp, Homo sapiens
cctaaattatttact

SEQ ID NO: 589954 - DNA, 18 bp, Homo sapiens
cctaagggatcctgcctg

SEQ ID NO: 589955 - DNA, 23 bp, Homo sapiens
cctaagtcccttcctattctcct

SEQ ID NO: 589956 - DNA, 14 bp, Homo sapiens
cctaccccttcctg

SEQ ID NO: 589957 - DNA, 18 bp, Homo sapiens
cctaccccttcctgtcct

SEQ ID NO: 589958 - DNA, 23 bp, Homo sapiens
cctaccccttcctgtcctgcctc

SEQ ID NO: 589959 - DNA, 14 bp, Homo sapiens
cctaccctggactt

SEQ ID NO: 589960 - DNA, 17 bp, Homo sapiens
cctacctccctccctct

SEQ ID NO: 589961 - DNA, 20 bp, Homo sapiens
cctacctggggactcctcaa

SEQ ID NO: 589962 - DNA, 16 bp, Homo sapiens
cctactggtgtaatct

SEQ ID NO: 589963 - DNA, 14 bp, Homo sapiens
cctactttctattt

SEQ ID NO: 589964 - DNA, 17 bp, Homo sapiens
cctagcctatgtctggc

SEQ ID NO: 589965 - DNA, 20 bp, Homo sapiens
cctagctcctccccttcctc

SEQ ID NO: 589966 - DNA, 15 bp, Homo sapiens
cctatccctctccta

SEQ ID NO: 589967 - DNA, 11 bp, Homo sapiens
cctatgtctgg

SEQ ID NO: 589968 - DNA, 13 bp, Homo sapiens
cctattctcctgc

SEQ ID NO: 589969 - DNA, 13 bp, Homo sapiens
cctcagcctgctt

SEQ ID NO: 589970 - DNA, 15 bp, Homo sapiens
cctcaggccaaggga

SEQ ID NO: 589971 - DNA, 20 bp, Homo sapiens
cctcaggccaagggaccagg

SEQ ID NO: 589972 - DNA, 21 bp, Homo sapiens
cctcaggctccgggcaccagg

SEQ ID NO: 589973 - DNA, 12 bp, Homo sapiens
cctcaggctcct

SEQ ID NO: 589974 - DNA, 20 bp, Homo sapiens
cctcagtagcatctcagtgg

SEQ ID NO: 589975 - DNA, 14 bp, Homo sapiens
cctccaacccaacc

SEQ ID NO: 589976 - DNA, 18 bp, Homo sapiens
cctccccttttaccactc

SEQ ID NO: 589977 - DNA, 14 bp, Homo sapiens
cctccctccctctc

SEQ ID NO: 589978 - DNA, 15 bp, Homo sapiens
cctccctccctctcc

SEQ ID NO: 589979 - DNA, 18 bp, Homo sapiens
cctccctgggccacctcc

SEQ ID NO: 589980 - DNA, 21 bp, Homo sapiens
cctccgccatggggtcggctc

SEQ ID NO: 589981 - DNA, 17 bp, Homo sapiens
cctcctaccccttcctg

SEQ ID NO: 589982 - DNA, 11 bp, Homo sapiens
cctcctacctg

SEQ ID NO: 589983 - DNA, 22 bp, Homo sapiens
cctcctggaatcagtatttcct

SEQ ID NO: 589984 - DNA, 14 bp, Homo sapiens
cctcgagccctccc

SEQ ID NO: 589985 - DNA, 20 bp, Homo sapiens
cctcgcccccaccagtgtag

SEQ ID NO: 589986 - DNA, 12 bp, Homo sapiens
cctctccactct

SEQ ID NO: 589987 - DNA, 16 bp, Homo sapiens
cctctccactcttctc

SEQ ID NO: 589988 - DNA, 22 bp, Homo sapiens
cctctccactcttctctccttt

SEQ ID NO: 589989 - DNA, 18 bp, Homo sapiens
cctctccgcgggagaccc

SEQ ID NO: 589990 - DNA, 12 bp, Homo sapiens
cctctctgcctc

SEQ ID NO: 589991 - DNA, 14 bp, Homo sapiens
cctctctgcctctc

SEQ ID NO: 589992 - DNA, 16 bp, Homo sapiens
cctctctgcctctctt

SEQ ID NO: 589993 - DNA, 18 bp, Homo sapiens
cctctgaaaagtgtgtat

SEQ ID NO: 589994 - DNA, 22 bp, Homo sapiens
cctctgaaagatgcatcatctc

SEQ ID NO: 589995 - DNA, 14 bp, Homo sapiens
cctctgagccttgg

SEQ ID NO: 589996 - DNA, 13 bp, Homo sapiens
cctcttagctcag

SEQ ID NO: 589997 - DNA, 13 bp, Homo sapiens
cctcttctctcct

SEQ ID NO: 589998 - DNA, 16 bp, Homo sapiens
cctcttgaaacctgat

SEQ ID NO: 589999 - DNA, 13 bp, Homo sapiens
cctcttgccatcc

SEQ ID NO: 590000 - DNA, 15 bp, Homo sapiens
cctcttgccatcctg

SEQ ID NO: 590001 - DNA, 16 bp, Homo sapiens
cctctttgcgtttcct

SEQ ID NO: 590002 - DNA, 17 bp, Homo sapiens
cctctttgcgtttcctt

SEQ ID NO: 590003 - DNA, 18 bp, Homo sapiens
cctgaacccacacctggg

SEQ ID NO: 590004 - DNA, 15 bp, Homo sapiens
cctgaatttgtatat

SEQ ID NO: 590005 - DNA, 17 bp, Homo sapiens
cctgactaggttctgta

SEQ ID NO: 590006 - DNA, 23 bp, Homo sapiens
cctgaggactgatttcagagtga

SEQ ID NO: 590007 - DNA, 13 bp, Homo sapiens
cctgaggcctaga

SEQ ID NO: 590008 - DNA, 20 bp, Homo sapiens
cctgatggtgtcattctgcc

SEQ ID NO: 590009 - DNA, 21 bp, Homo sapiens
cctgatgtcagctgctgttga

SEQ ID NO: 590010 - DNA, 22 bp, Homo sapiens
cctgcaggcaggaacaaacagg

SEQ ID NO: 590011 - DNA, 15 bp, Homo sapiens
cctgcatagccggtg

SEQ ID NO: 590012 - DNA, 20 bp, Homo sapiens
cctgccagctgcagcctggt

SEQ ID NO: 590013 - DNA, 22 bp, Homo sapiens
cctgcccagttgcactcaggtg

SEQ ID NO: 590014 - DNA, 23 bp, Homo sapiens
cctgccccggacctacctccctc

SEQ ID NO: 590015 - DNA, 19 bp, Homo sapiens
cctgctcaatccctgagga

SEQ ID NO: 590016 - DNA, 13 bp, Homo sapiens
cctgctccatcgc

SEQ ID NO: 590017 - DNA, 23 bp, Homo sapiens
cctgcttaatcttcaaagccttc

SEQ ID NO: 590018 - DNA, 14 bp, Homo sapiens
cctgggccacctcc

SEQ ID NO: 590019 - DNA, 13 bp, Homo sapiens
cctggggactcct

SEQ ID NO: 590020 - DNA, 13 bp, Homo sapiens
cctggtgactcct

SEQ ID NO: 590021 - DNA, 14 bp, Homo sapiens
cctggtgactcctg

SEQ ID NO: 590022 - DNA, 14 bp, Homo sapiens
cctggttggcagca

SEQ ID NO: 590023 - DNA, 19 bp, Homo sapiens
cctggtttgcaaagaccac

SEQ ID NO: 590024 - DNA, 20 bp, Homo sapiens
cctggtttgcaaagaccacc

SEQ ID NO: 590025 - DNA, 23 bp, Homo sapiens
cctggtttgcaaagaccacctcc

SEQ ID NO: 590026 - DNA, 13 bp, Homo sapiens
cctgtcctgcctc

SEQ ID NO: 590027 - DNA, 18 bp, Homo sapiens
cctgtggcataaattgca

SEQ ID NO: 590028 - DNA, 14 bp, Homo sapiens
cctgttcatgtttt

SEQ ID NO: 590029 - DNA, 14 bp, Homo sapiens
ccttaggcctctga

SEQ ID NO: 590030 - DNA, 16 bp, Homo sapiens
ccttaggcctctgaga

SEQ ID NO: 590031 - DNA, 13 bp, Homo sapiens
ctgcaatcactgt

SEQ ID NO: 590032 - DNA, 16 bp, Homo sapiens
ctgcaatcactgtgct

SEQ ID NO: 590033 - DNA, 14 bp, Homo sapiens
ctgcactcagaaaa

SEQ ID NO: 590034 - DNA, 15 bp, Homo sapiens
ctgcactcagaaaat

SEQ ID NO: 590035 - DNA, 20 bp, Homo sapiens
ctgcactccaatctgggtga

SEQ ID NO: 590036 - DNA, 14 bp, Homo sapiens
ctgcagcagtcgcc

SEQ ID NO: 590037 - DNA, 14 bp, Homo sapiens
ctgcagccttttct

SEQ ID NO: 590038 - DNA, 14 bp, Homo sapiens
ctgcaggcaggaac

SEQ ID NO: 590039 - DNA, 15 bp, Homo sapiens
ctgcaggcaggaaca

SEQ ID NO: 590040 - DNA, 15 bp, Homo sapiens
ctgcagttttgctat

SEQ ID NO: 590041 - DNA, 22 bp, Homo sapiens
ctgcataatgtttctggatttc

SEQ ID NO: 590042 - DNA, 17 bp, Homo sapiens
ctgcattgagcttgcat

SEQ ID NO: 590043 - DNA, 23 bp, Homo sapiens
ctgcattgagcttgcatgcttgc

SEQ ID NO: 590044 - DNA, 21 bp, Homo sapiens
ctgccaatctgtacaaaatgg

SEQ ID NO: 590045 - DNA, 23 bp, Homo sapiens
ctgccattacagaggtattaaaa

SEQ ID NO: 590046 - DNA, 15 bp, Homo sapiens
ctgcccacctggctg

SEQ ID NO: 590047 - DNA, 13 bp, Homo sapiens
ctgccccggacct

SEQ ID NO: 590048 - DNA, 17 bp, Homo sapiens
ctgccccggacctacct

SEQ ID NO: 590049 - DNA, 18 bp, Homo sapiens
ctgccccggacctacctc

SEQ ID NO: 590050 - DNA, 17 bp, Homo sapiens
ctgcccctaccctggac

SEQ ID NO: 590051 - DNA, 21 bp, Homo sapiens
ctgccctccgaagagagttct

SEQ ID NO: 590052 - DNA, 12 bp, Homo sapiens
ctgccctgggct

SEQ ID NO: 590053 - DNA, 14 bp, Homo sapiens
ctgccctgggctcc

SEQ ID NO: 590054 - DNA, 15 bp, Homo sapiens
ctgccctgggctcct

SEQ ID NO: 590055 - DNA, 23 bp, Homo sapiens
ctgccctgggctcctcttagctc

SEQ ID NO: 590056 - DNA, 15 bp, Homo sapiens
ctgcccttcctgcag

SEQ ID NO: 590057 - DNA, 18 bp, Homo sapiens
ctgccgttttctgggctg

SEQ ID NO: 590058 - DNA, 13 bp, Homo sapiens
ctgcctcaggcca

SEQ ID NO: 590059 - DNA, 11 bp, Homo sapiens
ctgcctcctca

SEQ ID NO: 590060 - DNA, 20 bp, Homo sapiens
ctgcctcctcatcagtgtgt

SEQ ID NO: 590061 - DNA, 18 bp, Homo sapiens
ctgccttctggccttgta

SEQ ID NO: 590062 - DNA, 16 bp, Homo sapiens
ctgcgcggactcgccc

SEQ ID NO: 590063 - DNA, 19 bp, Homo sapiens
ctgcgcggactcgccccca

SEQ ID NO: 590064 - DNA, 14 bp, Homo sapiens
ctgctgttgaactt

SEQ ID NO: 590065 - DNA, 15 bp, Homo sapiens
ctgctgttgaacttt

SEQ ID NO: 590066 - DNA, 20 bp, Homo sapiens
ctggaagcccctgggcccag

SEQ ID NO: 590067 - DNA, 23 bp, Homo sapiens
ctggaatcagtatttccttccac

SEQ ID NO: 590068 - DNA, 14 bp, Homo sapiens
ctggagtccctgtg

SEQ ID NO: 590069 - DNA, 13 bp, Homo sapiens
ctggatgtctggc

SEQ ID NO: 590070 - DNA, 17 bp, Homo sapiens
ctggatttgcagaagtt

SEQ ID NO: 590071 - DNA, 12 bp, Homo sapiens
ctggcacagagg

SEQ ID NO: 590072 - DNA, 16 bp, Homo sapiens
ctggcagatgagggct

SEQ ID NO: 590073 - DNA, 12 bp, Homo sapiens
ctggctctgtga

SEQ ID NO: 590074 - DNA, 14 bp, Homo sapiens
ctggctgttctgat

SEQ ID NO: 590075 - DNA, 17 bp, Homo sapiens
ctggctttaagccttca

SEQ ID NO: 590076 - DNA, 23 bp, Homo sapiens
ctgggaggcagaggttgcagtga

SEQ ID NO: 590077 - DNA, 14 bp, Homo sapiens
ctgggcactggggc

SEQ ID NO: 590078 - DNA, 19 bp, Homo sapiens
ctgggcactggggcctcag

SEQ ID NO: 590079 - DNA, 13 bp, Homo sapiens
ctgggccacctcc

SEQ ID NO: 590080 - DNA, 14 bp, Homo sapiens
ctgggccacctcct

SEQ ID NO: 590081 - DNA, 11 bp, Homo sapiens
ctgggctcctc

SEQ ID NO: 590082 - DNA, 15 bp, Homo sapiens
ctgggctcctcttag

SEQ ID NO: 590083 - DNA, 12 bp, Homo sapiens
ctggggactcct

SEQ ID NO: 590084 - DNA, 21 bp, Homo sapiens
ctggggactcctcaaaccact

SEQ ID NO: 590085 - DNA, 15 bp, Homo sapiens
ctgggggctatgtat

SEQ ID NO: 590086 - DNA, 13 bp, Homo sapiens
ctgggtgtttttt

SEQ ID NO: 590087 - DNA, 20 bp, Homo sapiens
ctggtccctcttctctcctc

SEQ ID NO: 590088 - DNA, 13 bp, Homo sapiens
ctggtgactcctg

SEQ ID NO: 590089 - DNA, 22 bp, Homo sapiens
ctggttcggctctagggcctca

SEQ ID NO: 590090 - DNA, 13 bp, Homo sapiens
ctggttgggcagc

SEQ ID NO: 590091 - DNA, 16 bp, Homo sapiens
ctgtaaagatgtttat

SEQ ID NO: 590092 - DNA, 15 bp, Homo sapiens
ctgtaacattcagga

SEQ ID NO: 590093 - DNA, 20 bp, Homo sapiens
ctgtagctattagcggctcc

SEQ ID NO: 590094 - DNA, 14 bp, Homo sapiens
ctgtatattcagga

SEQ ID NO: 590095 - DNA, 14 bp, Homo sapiens
ctgtatcactgcct

SEQ ID NO: 590096 - DNA, 15 bp, Homo sapiens
ctgtcattgcacata

SEQ ID NO: 590097 - DNA, 11 bp, Homo sapiens
ctgtcctgcct

SEQ ID NO: 590098 - DNA, 12 bp, Homo sapiens
ctgtcctgcctc

SEQ ID NO: 590099 - DNA, 14 bp, Homo sapiens
ctgtcctgcctcct

SEQ ID NO: 590100 - DNA, 14 bp, Homo sapiens
ctgtctacctggtc

SEQ ID NO: 590101 - DNA, 19 bp, Homo sapiens
ctgtcttaaactaaatgtg

SEQ ID NO: 590102 - DNA, 19 bp, Homo sapiens
ctgtgagcatggggccagg

SEQ ID NO: 590103 - DNA, 17 bp, Homo sapiens
ctgtgagccatgcctcc

SEQ ID NO: 590104 - DNA, 15 bp, Homo sapiens
ctgtgcaggatattt

SEQ ID NO: 590105 - DNA, 21 bp, Homo sapiens
ctgtgctatcggcagatgatg

SEQ ID NO: 590106 - DNA, 23 bp, Homo sapiens
ctgtgctatcggcagatgatgct

SEQ ID NO: 590107 - DNA, 11 bp, Homo sapiens
ctgtgctgaac

SEQ ID NO: 590108 - DNA, 15 bp, Homo sapiens
ctgtggcataaattg

SEQ ID NO: 590109 - DNA, 14 bp, Homo sapiens
ctgtgggaaagagc

SEQ ID NO: 590110 - DNA, 16 bp, Homo sapiens
ctgtgggaaagagcct

SEQ ID NO: 590111 - DNA, 15 bp, Homo sapiens
ctgtgtaacactgtt

SEQ ID NO: 590112 - DNA, 19 bp, Homo sapiens
ctgtgtcattagtcctttg

SEQ ID NO: 590113 - DNA, 22 bp, Homo sapiens
ctgtgttactaaaaaaaagatg

SEQ ID NO: 590114 - DNA, 22 bp, Homo sapiens
ctgtgttcttgccactgcactc

SEQ ID NO: 590115 - DNA, 17 bp, Homo sapiens
ctgtgttttgaaagaat

SEQ ID NO: 590116 - DNA, 13 bp, Homo sapiens
ctgttatgggctt

SEQ ID NO: 590117 - DNA, 22 bp, Homo sapiens
ctgttctgatcggccagttttc

SEQ ID NO: 590118 - DNA, 18 bp, Homo sapiens
ctgttgcacttttgaatg

SEQ ID NO: 590119 - DNA, 19 bp, Homo sapiens
ctgttgtaagaattctgat

SEQ ID NO: 590120 - DNA, 17 bp, Homo sapiens
ctgtttcctagctgtgt

SEQ ID NO: 590121 - DNA, 12 bp, Homo sapiens
ctgtttcctgat

SEQ ID NO: 590122 - DNA, 12 bp, Homo sapiens
cttaaatttaat

SEQ ID NO: 590123 - DNA, 20 bp, Homo sapiens
cttaaggggtatcatgtatg

SEQ ID NO: 590124 - DNA, 17 bp, Homo sapiens
cttaagtcctaaaagtt

SEQ ID NO: 590125 - DNA, 15 bp, Homo sapiens
cttacaatattgatt

SEQ ID NO: 590126 - DNA, 19 bp, Homo sapiens
cttaccccaaagagaaaga

SEQ ID NO: 590127 - DNA, 17 bp, Homo sapiens
cttaggcatgcacagct

SEQ ID NO: 590128 - DNA, 16 bp, Homo sapiens
cttattgaccattttt

SEQ ID NO: 590129 - DNA, 21 bp, Homo sapiens
cttatttatagaatttaatat

SEQ ID NO: 590130 - DNA, 16 bp, Homo sapiens
cttatttgtatatggt

SEQ ID NO: 590131 - DNA, 22 bp, Homo sapiens
cttattttgttggtgctttgca

SEQ ID NO: 590132 - DNA, 13 bp, Homo sapiens
cttcaaagccttc

SEQ ID NO: 590133 - DNA, 13 bp, Homo sapiens
cttcagccaggca

SEQ ID NO: 590134 - DNA, 15 bp, Homo sapiens
cttcagccaggcaag

SEQ ID NO: 590135 - DNA, 16 bp, Homo sapiens
cttcagccaggcaaga

SEQ ID NO: 590136 - DNA, 14 bp, Homo sapiens
cttcatgcctgatg

SEQ ID NO: 590137 - DNA, 17 bp, Homo sapiens
cttcatgcctgatgaaa

SEQ ID NO: 590138 - DNA, 16 bp, Homo sapiens
cttcctcttgtctgat

SEQ ID NO: 590139 - DNA, 20 bp, Homo sapiens
cttcctgcaggcaggaacaa

SEQ ID NO: 590140 - DNA, 18 bp, Homo sapiens
cttcctgtcctgcctcct

SEQ ID NO: 590141 - DNA, 15 bp, Homo sapiens
cttcgtttatatttt

SEQ ID NO: 590142 - DNA, 13 bp, Homo sapiens
gatggacctgccc

SEQ ID NO: 590143 - DNA, 13 bp, Homo sapiens
gatggcttgtcta

SEQ ID NO: 590144 - DNA, 15 bp, Homo sapiens
gatggcttgtctata

SEQ ID NO: 590145 - DNA, 16 bp, Homo sapiens
gatgggtgccctttcc

SEQ ID NO: 590146 - DNA, 22 bp, Homo sapiens
gatgtcagctgctgttgaactt

SEQ ID NO: 590147 - DNA, 23 bp, Homo sapiens
gatgtcagctgctgttgaacttt

SEQ ID NO: 590148 - DNA, 18 bp, Homo sapiens
gatgttcactgtggcatt

SEQ ID NO: 590149 - DNA, 23 bp, Homo sapiens
gatgttgtcttagcatggtacct

SEQ ID NO: 590150 - DNA, 20 bp, Homo sapiens
gattatttgtatttacagtt

SEQ ID NO: 590151 - DNA, 13 bp, Homo sapiens
gattctaaataca

SEQ ID NO: 590152 - DNA, 11 bp, Homo sapiens
gattctgctgg

SEQ ID NO: 590153 - DNA, 15 bp, Homo sapiens
gatttcatactgtaa

SEQ ID NO: 590154 - DNA, 19 bp, Homo sapiens
gatttccagaaccacactt

SEQ ID NO: 590155 - DNA, 23 bp, Homo sapiens
gatttccctccagagaaagcaca

SEQ ID NO: 590156 - DNA, 15 bp, Homo sapiens
gatttgaaaaatata

SEQ ID NO: 590157 - DNA, 16 bp, Homo sapiens
gatttgaaaaatataa

SEQ ID NO: 590158 - DNA, 15 bp, Homo sapiens
gcaaaaattatatat

SEQ ID NO: 590159 - DNA, 18 bp, Homo sapiens
gcaaaagggcagctgtga

SEQ ID NO: 590160 - DNA, 23 bp, Homo sapiens
gcaaatgttaaaagttttatatg

SEQ ID NO: 590161 - DNA, 16 bp, Homo sapiens
gcaagaaagcttcctt

SEQ ID NO: 590162 - DNA, 17 bp, Homo sapiens
gcaagaaagcttccttc

SEQ ID NO: 590163 - DNA, 16 bp, Homo sapiens
gcaataataaagtact

SEQ ID NO: 590164 - DNA, 22 bp, Homo sapiens
gcaatctgaccctatgggtcta

SEQ ID NO: 590165 - DNA, 15 bp, Homo sapiens
gcacaatttaaaaca

SEQ ID NO: 590166 - DNA, 16 bp, Homo sapiens
gcacacttttccacat

SEQ ID NO: 590167 - DNA, 21 bp, Homo sapiens
gcaccaggggccaacctcagg

SEQ ID NO: 590168 - DNA, 22 bp, Homo sapiens
gcaccaggggccaacctcaggc

SEQ ID NO: 590169 - DNA, 13 bp, Homo sapiens
gcactccagcctg

SEQ ID NO: 590170 - DNA, 21 bp, Homo sapiens
gcactttgggaggctgaggtg

SEQ ID NO: 590171 - DNA, 13 bp, Homo sapiens
gcacttttgaatg

SEQ ID NO: 590172 - DNA, 16 bp, Homo sapiens
gcagagatttctcatt

SEQ ID NO: 590173 - DNA, 12 bp, Homo sapiens
gcagagttttca

SEQ ID NO: 590174 - DNA, 14 bp, Homo sapiens
gcagagttttcatt

SEQ ID NO: 590175 - DNA, 13 bp, Homo sapiens
gcagatgagggct

SEQ ID NO: 590176 - DNA, 14 bp, Homo sapiens
gcagatgagggctg

SEQ ID NO: 590177 - DNA, 19 bp, Homo sapiens
gcagcagtcgcccaagcag

SEQ ID NO: 590178 - DNA, 20 bp, Homo sapiens
gcagccttttctggtccctc

SEQ ID NO: 590179 - DNA, 10 bp, Homo sapiens
gcagctgtga

SEQ ID NO: 590180 - DNA, 16 bp, Homo sapiens
gcaggaacaaacaggg

SEQ ID NO: 590181 - DNA, 20 bp, Homo sapiens
gcaggacagctcctggacca

SEQ ID NO: 590182 - DNA, 18 bp, Homo sapiens
gcagggctaaataaagag

SEQ ID NO: 590183 - DNA, 23 bp, Homo sapiens
gcatcagggcctttctcctcccc

SEQ ID NO: 590184 - DNA, 14 bp, Homo sapiens
gcatcatctcttcc

SEQ ID NO: 590185 - DNA, 14 bp, Homo sapiens
gcatcccatctctc

SEQ ID NO: 590186 - DNA, 17 bp, Homo sapiens
gcatcccatctctccca

SEQ ID NO: 590187 - DNA, 21 bp, Homo sapiens
gcatcccatctctcccacttc

SEQ ID NO: 590188 - DNA, 23 bp, Homo sapiens
gcatcccatctctcccacttcct

SEQ ID NO: 590189 - DNA, 22 bp, Homo sapiens
gcatctcagtggtgtgtgaagt

SEQ ID NO: 590190 - DNA, 20 bp, Homo sapiens
gcatgaaaaaccatttttga

SEQ ID NO: 590191 - DNA, 22 bp, Homo sapiens
gcatgaaaaaccatttttgaac

SEQ ID NO: 590192 - DNA, 18 bp, Homo sapiens
gcatgaaccctcttgcca

SEQ ID NO: 590193 - DNA, 14 bp, Homo sapiens
gcatggagacagca

SEQ ID NO: 590194 - DNA, 17 bp, Homo sapiens
gcatggagacagcagtt

SEQ ID NO: 590195 - DNA, 18 bp, Homo sapiens
gcatggagacagcagttt

SEQ ID NO: 590196 - DNA, 13 bp, Homo sapiens
gcatggggccagg

SEQ ID NO: 590197 - DNA, 14 bp, Homo sapiens
gcatggggccagga

SEQ ID NO: 590198 - DNA, 15 bp, Homo sapiens
gcatggggccaggaa

SEQ ID NO: 590199 - DNA, 18 bp, Homo sapiens
gcatgtagaggcttgttt

SEQ ID NO: 590200 - DNA, 21 bp, Homo sapiens
gcatgttcacccttatagtct

SEQ ID NO: 590201 - DNA, 21 bp, Homo sapiens
gcattagcctggatcctcagt

SEQ ID NO: 590202 - DNA, 10 bp, Homo sapiens
gcattgagta

SEQ ID NO: 590203 - DNA, 12 bp, Homo sapiens
gcattggatatt

SEQ ID NO: 590204 - DNA, 14 bp, Homo sapiens
gcatttaataaaga

SEQ ID NO: 590205 - DNA, 18 bp, Homo sapiens
gcattttgatattgctgt

SEQ ID NO: 590206 - DNA, 22 bp, Homo sapiens
gccaacctctttgcgtttcctt

SEQ ID NO: 590207 - DNA, 22 bp, Homo sapiens
gccaaggaaaggcatgtacaaa

SEQ ID NO: 590208 - DNA, 18 bp, Homo sapiens
gccacagaaggtgaactt

SEQ ID NO: 590209 - DNA, 16 bp, Homo sapiens
gccagaccagcaggct

SEQ ID NO: 590210 - DNA, 17 bp, Homo sapiens
gccagattggccaatta

SEQ ID NO: 590211 - DNA, 19 bp, Homo sapiens
gccagcgacctctctgcct

SEQ ID NO: 590212 - DNA, 17 bp, Homo sapiens
gccagctgcagcctggt

SEQ ID NO: 590213 - DNA, 22 bp, Homo sapiens
gccaggacatgcaataaaattt

SEQ ID NO: 590214 - DNA, 20 bp, Homo sapiens
gccagttttcggaaacactg

SEQ ID NO: 590215 - DNA, 22 bp, Homo sapiens
gccataaacggttcctggtgac

SEQ ID NO: 590216 - DNA, 19 bp, Homo sapiens
gccatagatgctggctggg

SEQ ID NO: 590217 - DNA, 21 bp, Homo sapiens
gccatcctgatggacctgccc

SEQ ID NO: 590218 - DNA, 12 bp, Homo sapiens
gccatgcctccc

SEQ ID NO: 590219 - DNA, 20 bp, Homo sapiens
gccatggcaggacagctcct

SEQ ID NO: 590220 - DNA, 19 bp, Homo sapiens
gcccacccgagtacctcca

SEQ ID NO: 590221 - DNA, 23 bp, Homo sapiens
gcccacccgagtacctccagtca

SEQ ID NO: 590222 - DNA, 12 bp, Homo sapiens
gcccactcctgg

SEQ ID NO: 590223 - DNA, 22 bp, Homo sapiens
gcccagtacctagctggctctg

SEQ ID NO: 590224 - DNA, 11 bp, Homo sapiens
gccccaggaga

SEQ ID NO: 590225 - DNA, 13 bp, Homo sapiens
gccccaggagaag

SEQ ID NO: 590226 - DNA, 20 bp, Homo sapiens
gccccctgcttggccaggag

SEQ ID NO: 590227 - DNA, 21 bp, Homo sapiens
gccccggacctacctccctcc

SEQ ID NO: 590228 - DNA, 20 bp, Homo sapiens
gccctcccccaaacagactc

SEQ ID NO: 590229 - DNA, 17 bp, Homo sapiens
gccctgccagctgcagc

SEQ ID NO: 590230 - DNA, 21 bp, Homo sapiens
gccctgccagctgcagcctgg

SEQ ID NO: 590231 - DNA, 11 bp, Homo sapiens
gccctgggctc

SEQ ID NO: 590232 - DNA, 15 bp, Homo sapiens
gccggtgggtgagga

SEQ ID NO: 590233 - DNA, 17 bp, Homo sapiens
gcctagcctatgtctgg

SEQ ID NO: 590234 - DNA, 12 bp, Homo sapiens
gcctatgtctgg

SEQ ID NO: 590235 - DNA, 14 bp, Homo sapiens
gcctatgtctggca

SEQ ID NO: 590236 - DNA, 18 bp, Homo sapiens
gcctatgtggtctaaggt

SEQ ID NO: 590237 - DNA, 21 bp, Homo sapiens
gcctcaccatgtgagctcttc

SEQ ID NO: 590238 - DNA, 13 bp, Homo sapiens
gcctcaggctccg

SEQ ID NO: 590239 - DNA, 21 bp, Homo sapiens
gcctccctgggccacctccta

SEQ ID NO: 590240 - DNA, 19 bp, Homo sapiens
gcctctgagaagctctgaa

SEQ ID NO: 590241 - DNA, 21 bp, Homo sapiens
gcctctgcacaccctccagag

SEQ ID NO: 590242 - DNA, 12 bp, Homo sapiens
gcctgagaaaca

SEQ ID NO: 590243 - DNA, 23 bp, Homo sapiens
gcctgagaaacactatttgtgac

SEQ ID NO: 590244 - DNA, 22 bp, Homo sapiens
gcctgcccctaccctggacttg

SEQ ID NO: 590245 - DNA, 18 bp, Homo sapiens
gcctgctccatcgcgcca

SEQ ID NO: 590246 - DNA, 15 bp, Homo sapiens
gcctgctttcctgca

SEQ ID NO: 590247 - DNA, 22 bp, Homo sapiens
gcctgggcaacatagtgagacc

SEQ ID NO: 590248 - DNA, 20 bp, Homo sapiens
gcctggtttgcaaagaccac

SEQ ID NO: 590249 - DNA, 22 bp, Homo sapiens
gcctggtttgcaaagaccacct

SEQ ID NO: 590250 - DNA, 21 bp, Homo sapiens
gccttcgccccagtgttctgc

SEQ ID NO: 590251 - DNA, 20 bp, Homo sapiens
gtccctgcaaaactccaggc

SEQ ID NO: 590252 - DNA, 14 bp, Homo sapiens
gtcctggaggggct

SEQ ID NO: 590253 - DNA, 13 bp, Homo sapiens
gtccttaaaatgt

SEQ ID NO: 590254 - DNA, 14 bp, Homo sapiens
gtccttaaaatgtg

SEQ ID NO: 590255 - DNA, 15 bp, Homo sapiens
gtctaccaatacaaa

SEQ ID NO: 590256 - DNA, 13 bp, Homo sapiens
gtctcctttgctc

SEQ ID NO: 590257 - DNA, 15 bp, Homo sapiens
gtctcctttgctctt

SEQ ID NO: 590258 - DNA, 18 bp, Homo sapiens
gtctctgccctgggctcc

SEQ ID NO: 590259 - DNA, 20 bp, Homo sapiens
gtctctgccctgggctcctc

SEQ ID NO: 590260 - DNA, 20 bp, Homo sapiens
gtctctgtcgtggagccatt

SEQ ID NO: 590261 - DNA, 15 bp, Homo sapiens
gtctgccaatctgta

SEQ ID NO: 590262 - DNA, 22 bp, Homo sapiens
gtctgccaatctgtacaaaatg

SEQ ID NO: 590263 - DNA, 18 bp, Homo sapiens
gtctggcagatgagggct

SEQ ID NO: 590264 - DNA, 18 bp, Homo sapiens
gtctggttgggcagccag

SEQ ID NO: 590265 - DNA, 18 bp, Homo sapiens
gtctgtaatgacaaataa

SEQ ID NO: 590266 - DNA, 22 bp, Homo sapiens
gtcttaaactaaatgtgcaata

SEQ ID NO: 590267 - DNA, 22 bp, Homo sapiens
gtcttcagagataggcctgtgg

SEQ ID NO: 590268 - DNA, 23 bp, Homo sapiens
gtctttcatggctgctgttgctt

SEQ ID NO: 590269 - DNA, 18 bp, Homo sapiens
gtgaagagggacataaga

SEQ ID NO: 590270 - DNA, 18 bp, Homo sapiens
gtgaagttttactgtcta

SEQ ID NO: 590271 - DNA, 17 bp, Homo sapiens
gtgaatgtgtgagaaaa

SEQ ID NO: 590272 - DNA, 20 bp, Homo sapiens
gtgactcagcatcacccacc

SEQ ID NO: 590273 - DNA, 18 bp, Homo sapiens
gtgagcatggggccagga

SEQ ID NO: 590274 - DNA, 23 bp, Homo sapiens
gtgagccttgcatgacatcatga

SEQ ID NO: 590275 - DNA, 14 bp, Homo sapiens
gtgatttgaaaaat

SEQ ID NO: 590276 - DNA, 14 bp, Homo sapiens
gtgccaacctcttt

SEQ ID NO: 590277 - DNA, 14 bp, Homo sapiens
gtgcgaagactgag

SEQ ID NO: 590278 - DNA, 17 bp, Homo sapiens
gtggaaaaaacatttta

SEQ ID NO: 590279 - DNA, 13 bp, Homo sapiens
gtggtctgccaat

SEQ ID NO: 590280 - DNA, 19 bp, Homo sapiens
gtgtaaccagctcagtgtt

SEQ ID NO: 590281 - DNA, 17 bp, Homo sapiens
gtgtagcatcttcctct

SEQ ID NO: 590282 - DNA, 15 bp, Homo sapiens
gtgtcccctatcctc

SEQ ID NO: 590283 - DNA, 18 bp, Homo sapiens
gtgtcccctatcctcccc

SEQ ID NO: 590284 - DNA, 19 bp, Homo sapiens
gtgtggattgcctctgaaa

SEQ ID NO: 590285 - DNA, 15 bp, Homo sapiens
gtgtgtgccaagagc

SEQ ID NO: 590286 - DNA, 21 bp, Homo sapiens
gtgttactaaaaaaaagatga

SEQ ID NO: 590287 - DNA, 15 bp, Homo sapiens
gtgttttgaaagaat

SEQ ID NO: 590288 - DNA, 15 bp, Homo sapiens
gttaaagagaatgag

SEQ ID NO: 590289 - DNA, 18 bp, Homo sapiens
gttaaatgtttacaagta

SEQ ID NO: 590290 - DNA, 14 bp, Homo sapiens
gttagtgacattta

SEQ ID NO: 590291 - DNA, 19 bp, Homo sapiens
gttatactgaaccaggcca

SEQ ID NO: 590292 - DNA, 15 bp, Homo sapiens
gttattcgcccaccc

SEQ ID NO: 590293 - DNA, 19 bp, Homo sapiens
gttatttattttttaagaa

SEQ ID NO: 590294 - DNA, 22 bp, Homo sapiens
gttcaacaaagaaacaaagatg

SEQ ID NO: 590295 - DNA, 17 bp, Homo sapiens
gttcatacgcatcccat

SEQ ID NO: 590296 - DNA, 22 bp, Homo sapiens
gttcatacgcatcccatctctc

SEQ ID NO: 590297 - DNA, 21 bp, Homo sapiens
gttcattggcattctttgcaa

SEQ ID NO: 590298 - DNA, 18 bp, Homo sapiens
gttccaaacagacaaaac

SEQ ID NO: 590299 - DNA, 18 bp, Homo sapiens
gttccatttcagttcagt

SEQ ID NO: 590300 - DNA, 21 bp, Homo sapiens
gttcccttgaaactttgggaa

SEQ ID NO: 590301 - DNA, 20 bp, Homo sapiens
gttcctgtgtgaccctgggc

SEQ ID NO: 590302 - DNA, 21 bp, Homo sapiens
gttcctgtgtgaccctgggca

SEQ ID NO: 590303 - DNA, 22 bp, Homo sapiens
gttcctgtgtgaccctgggcag

SEQ ID NO: 590304 - DNA, 13 bp, Homo sapiens
gttctaaggctca

SEQ ID NO: 590305 - DNA, 19 bp, Homo sapiens
gttctcctatatcctcctt

SEQ ID NO: 590306 - DNA, 15 bp, Homo sapiens
gttcttttctctctt

SEQ ID NO: 590307 - DNA, 18 bp, Homo sapiens
gttgagaggaggacttgg

SEQ ID NO: 590308 - DNA, 15 bp, Homo sapiens
gttgagtctgtacta

SEQ ID NO: 590309 - DNA, 17 bp, Homo sapiens
gttgcactgccccctgc

SEQ ID NO: 590310 - DNA, 19 bp, Homo sapiens
gttgcacttttgaatgtcc

SEQ ID NO: 590311 - DNA, 13 bp, Homo sapiens
gttgcttgtcttc

SEQ ID NO: 590312 - DNA, 17 bp, Homo sapiens
gttggaatggatttttc

SEQ ID NO: 590313 - DNA, 16 bp, Homo sapiens
gttgtaagaattctga

SEQ ID NO: 590314 - DNA, 20 bp, Homo sapiens
gttgtggggcctcaggctcc

SEQ ID NO: 590315 - DNA, 21 bp, Homo sapiens
gtttaaaatgtaatttaaatg

SEQ ID NO: 590316 - DNA, 14 bp, Homo sapiens
gtttaatagatttg

SEQ ID NO: 590317 - DNA, 13 bp, Homo sapiens
gtttacctttctc

SEQ ID NO: 590318 - DNA, 20 bp, Homo sapiens
gtttatatttttttaactgt

SEQ ID NO: 590319 - DNA, 15 bp, Homo sapiens
gtttcagtttgttgg

SEQ ID NO: 590320 - DNA, 17 bp, Homo sapiens
gtttccagagtttgtca

SEQ ID NO: 590321 - DNA, 19 bp, Homo sapiens
gtttggtaaatgtttcttt

SEQ ID NO: 590322 - DNA, 22 bp, Homo sapiens
gtttgtagtgccactgttgttt

SEQ ID NO: 590323 - DNA, 17 bp, Homo sapiens
gtttgtggggctggaag

SEQ ID NO: 590324 - DNA, 20 bp, Homo sapiens
gttttaaaacgtgtaaatga

SEQ ID NO: 590325 - DNA, 19 bp, Homo sapiens
gttttatttacttctgtat

SEQ ID NO: 590326 - DNA, 14 bp, Homo sapiens
gttttccaaaagta

SEQ ID NO: 590327 - DNA, 18 bp, Homo sapiens
gttttccaaaagtaaaga

SEQ ID NO: 590328 - DNA, 19 bp, Homo sapiens
gttttctccgggtcctcct

SEQ ID NO: 590329 - DNA, 22 bp, Homo sapiens
gttttgcacagccaaatttaaa

SEQ ID NO: 590330 - DNA, 18 bp, Homo sapiens
taaaaacgaaaacctgac

SEQ ID NO: 590331 - DNA, 11 bp, Homo sapiens
taaaaatcttt

SEQ ID NO: 590332 - DNA, 18 bp, Homo sapiens
taaaaatcttttgaagca

SEQ ID NO: 590333 - DNA, 23 bp, Homo sapiens
taaaaatggcagggggtggaatt

SEQ ID NO: 590334 - DNA, 21 bp, Homo sapiens
taaaacaggttataacagtgt

SEQ ID NO: 590335 - DNA, 16 bp, Homo sapiens
taaaacgtgtaaatga

SEQ ID NO: 590336 - DNA, 17 bp, Homo sapiens
taaaacgtgtaaatgaa

SEQ ID NO: 590337 - DNA, 12 bp, Homo sapiens
taaaagcctgct

SEQ ID NO: 590338 - DNA, 15 bp, Homo sapiens
taaaaggtaatgtgt

SEQ ID NO: 590339 - DNA, 14 bp, Homo sapiens
taaaagttctcaat

SEQ ID NO: 590340 - DNA, 19 bp, Homo sapiens
taaaagttttatatgcttt

SEQ ID NO: 590341 - DNA, 15 bp, Homo sapiens
taaaatgtaatttaa

SEQ ID NO: 590342 - DNA, 20 bp, Homo sapiens
taaaatgtaatttaaatgaa

SEQ ID NO: 590343 - DNA, 15 bp, Homo sapiens
taaaattatgagatt

SEQ ID NO: 590344 - DNA, 12 bp, Homo sapiens
taaacaaacaag

SEQ ID NO: 590345 - DNA, 14 bp, Homo sapiens
taaacagaaatgga

SEQ ID NO: 590346 - DNA, 17 bp, Homo sapiens
taaacagtaagatatct

SEQ ID NO: 590347 - DNA, 14 bp, Homo sapiens
taaacgattagtga

SEQ ID NO: 590348 - DNA, 19 bp, Homo sapiens
taaacgattagtgatgtcc

SEQ ID NO: 590349 - DNA, 14 bp, Homo sapiens
taaacggttcctgg

SEQ ID NO: 590350 - DNA, 14 bp, Homo sapiens
taaactaaatgtgc

SEQ ID NO: 590351 - DNA, 22 bp, Homo sapiens
taaacttctgcaacaagcatgc

SEQ ID NO: 590352 - DNA, 19 bp, Homo sapiens
taaagaccctcctattcta

SEQ ID NO: 590353 - DNA, 13 bp, Homo sapiens
taaagagaatgag

SEQ ID NO: 590354 - DNA, 23 bp, Homo sapiens
taaagaggagataaggtggcttc

SEQ ID NO: 590355 - DNA, 22 bp, Homo sapiens
taaagtacttgactacctactg

SEQ ID NO: 590356 - DNA, 14 bp, Homo sapiens
taaataaaaactaa

SEQ ID NO: 590357 - DNA, 13 bp, Homo sapiens
taaataaagagga

SEQ ID NO: 590358 - DNA, 17 bp, Homo sapiens
taaataatttgcactga

SEQ ID NO: 590359 - DNA, 20 bp, Homo sapiens
taaatacatgccacatcaaa

SEQ ID NO: 590360 - DNA, 14 bp, Homo sapiens
taaatatgaatgaa

SEQ ID NO: 590361 - DNA, 17 bp, Homo sapiens
tcagaatttttaactgt

SEQ ID NO: 590362 - DNA, 16 bp, Homo sapiens
tcagagataggcctgt

SEQ ID NO: 590363 - DNA, 14 bp, Homo sapiens
tcagcaaaaagact

SEQ ID NO: 590364 - DNA, 16 bp, Homo sapiens
tcagctcaatgcagtt

SEQ ID NO: 590365 - DNA, 20 bp, Homo sapiens
tcagctgagcatggagacag

SEQ ID NO: 590366 - DNA, 21 bp, Homo sapiens
tcagctgagcatggagacagc

SEQ ID NO: 590367 - DNA, 22 bp, Homo sapiens
tcagctgctgttgaacttttta

SEQ ID NO: 590368 - DNA, 22 bp, Homo sapiens
tcaggctccgggcaccaggggc

SEQ ID NO: 590369 - DNA, 19 bp, Homo sapiens
tcagggcctttctcctccc

SEQ ID NO: 590370 - DNA, 21 bp, Homo sapiens
tcagggcctttctcctcccca

SEQ ID NO: 590371 - DNA, 21 bp, Homo sapiens
tcagtaacccccttaaattta

SEQ ID NO: 590372 - DNA, 19 bp, Homo sapiens
tcagtaatgctaaatgtgt

SEQ ID NO: 590373 - DNA, 21 bp, Homo sapiens
tcagtaatgctaaatgtgtaa

SEQ ID NO: 590374 - DNA, 17 bp, Homo sapiens
tcagtatttccttccac

SEQ ID NO: 590375 - DNA, 18 bp, Homo sapiens
tcagtccagcagtttcca

SEQ ID NO: 590376 - DNA, 21 bp, Homo sapiens
tcagtccagcagtttccagtc

SEQ ID NO: 590377 - DNA, 16 bp, Homo sapiens
tcagtgtgtaaataat

SEQ ID NO: 590378 - DNA, 12 bp, Homo sapiens
tcagttctcaaa

SEQ ID NO: 590379 - DNA, 19 bp, Homo sapiens
tcagtttgttggaaagtaa

SEQ ID NO: 590380 - DNA, 14 bp, Homo sapiens
tcatacgcatccca

SEQ ID NO: 590381 - DNA, 22 bp, Homo sapiens
tcatacgcatcccatctctccc

SEQ ID NO: 590382 - DNA, 23 bp, Homo sapiens
tcatacgcatcccatctctccca

SEQ ID NO: 590383 - DNA, 14 bp, Homo sapiens
tcatgacagcctcc

SEQ ID NO: 590384 - DNA, 17 bp, Homo sapiens
tcatgcatagtcccagc

SEQ ID NO: 590385 - DNA, 18 bp, Homo sapiens
tcatgtatttgagcatat

SEQ ID NO: 590386 - DNA, 13 bp, Homo sapiens
tcattcagaaatg

SEQ ID NO: 590387 - DNA, 17 bp, Homo sapiens
tcattctgcctgctcca

SEQ ID NO: 590388 - DNA, 12 bp, Homo sapiens
tcattgactttt

SEQ ID NO: 590389 - DNA, 23 bp, Homo sapiens
tcattgcacataagcttccattt

SEQ ID NO: 590390 - DNA, 22 bp, Homo sapiens
tcattggcattctttgcaatac

SEQ ID NO: 590391 - DNA, 17 bp, Homo sapiens
tccaaaatttatatttt

SEQ ID NO: 590392 - DNA, 21 bp, Homo sapiens
tccactcttctctcctttctc

SEQ ID NO: 590393 - DNA, 16 bp, Homo sapiens
tccagaacacaacctt

SEQ ID NO: 590394 - DNA, 17 bp, Homo sapiens
tccagagaaagcacaat

SEQ ID NO: 590395 - DNA, 20 bp, Homo sapiens
tccagagaaagcacaattta

SEQ ID NO: 590396 - DNA, 18 bp, Homo sapiens
tccagagagtggagagag

SEQ ID NO: 590397 - DNA, 15 bp, Homo sapiens
tccagggaggggtcc

SEQ ID NO: 590398 - DNA, 14 bp, Homo sapiens
tccagtcacactcc

SEQ ID NO: 590399 - DNA, 15 bp, Homo sapiens
tccagtcacactccc

SEQ ID NO: 590400 - DNA, 16 bp, Homo sapiens
tccagtcacactcccc

SEQ ID NO: 590401 - DNA, 16 bp, Homo sapiens
tccagttataagaaga

SEQ ID NO: 590402 - DNA, 23 bp, Homo sapiens
tccatcgcgccagcgacctctct

SEQ ID NO: 590403 - DNA, 14 bp, Homo sapiens
tccatctttgaact

SEQ ID NO: 590404 - DNA, 17 bp, Homo sapiens
tccatgctataaaaact

SEQ ID NO: 590405 - DNA, 12 bp, Homo sapiens
tccatggggagg

SEQ ID NO: 590406 - DNA, 13 bp, Homo sapiens
tcccacttcctcc

SEQ ID NO: 590407 - DNA, 15 bp, Homo sapiens
tcccacttcctccta

SEQ ID NO: 590408 - DNA, 16 bp, Homo sapiens
tcccacttcctcctac

SEQ ID NO: 590409 - DNA, 18 bp, Homo sapiens
tcccacttcctcctacct

SEQ ID NO: 590410 - DNA, 15 bp, Homo sapiens
tcccatctctcccac

SEQ ID NO: 590411 - DNA, 16 bp, Homo sapiens
tcccatctctcccact

SEQ ID NO: 590412 - DNA, 22 bp, Homo sapiens
tccccacaggcacattaactgt

SEQ ID NO: 590413 - DNA, 16 bp, Homo sapiens
tccccacctgtagctg

SEQ ID NO: 590414 - DNA, 14 bp, Homo sapiens
tccccgtctctgcc

SEQ ID NO: 590415 - DNA, 15 bp, Homo sapiens
tccccgtctctgccc

SEQ ID NO: 590416 - DNA, 23 bp, Homo sapiens
tccccgtctctgccctgggctcc

SEQ ID NO: 590417 - DNA, 15 bp, Homo sapiens
tcccctatcctcccc

SEQ ID NO: 590418 - DNA, 22 bp, Homo sapiens
tcccctttgtcctgcgttttct

SEQ ID NO: 590419 - DNA, 20 bp, Homo sapiens
tccctaatttaacccagctc

SEQ ID NO: 590420 - DNA, 15 bp, Homo sapiens
tccctccctctccgc

SEQ ID NO: 590421 - DNA, 20 bp, Homo sapiens
tccctctccgcgggagaccc

SEQ ID NO: 590422 - DNA, 15 bp, Homo sapiens
tccctgcaaaactcc

SEQ ID NO: 590423 - DNA, 19 bp, Homo sapiens
tccctgcaaaactccaggc

SEQ ID NO: 590424 - DNA, 21 bp, Homo sapiens
tccctgggccacctcctaccc

SEQ ID NO: 590425 - DNA, 14 bp, Homo sapiens
tcccttcctattct

SEQ ID NO: 590426 - DNA, 20 bp, Homo sapiens
tcccttcctattctcctgcc

SEQ ID NO: 590427 - DNA, 23 bp, Homo sapiens
tcccttcctattctcctgccatg

SEQ ID NO: 590428 - DNA, 21 bp, Homo sapiens
tccgccatggggtcggctcct

SEQ ID NO: 590429 - DNA, 22 bp, Homo sapiens
tccgccatggggtcggctcctg

SEQ ID NO: 590430 - DNA, 17 bp, Homo sapiens
tccgcgggagacccctt

SEQ ID NO: 590431 - DNA, 12 bp, Homo sapiens
tccggaaagaag

SEQ ID NO: 590432 - DNA, 19 bp, Homo sapiens
tcctaaaagttctcaatgt

SEQ ID NO: 590433 - DNA, 15 bp, Homo sapiens
tcctaagtcccttcc

SEQ ID NO: 590434 - DNA, 16 bp, Homo sapiens
tcctaccccttcctgt

SEQ ID NO: 590435 - DNA, 19 bp, Homo sapiens
tcctaccccttcctgtcct

SEQ ID NO: 590436 - DNA, 17 bp, Homo sapiens
tcctagctgtgtgaata

SEQ ID NO: 590437 - DNA, 13 bp, Homo sapiens
tcctagtaagaag

SEQ ID NO: 590438 - DNA, 17 bp, Homo sapiens
tcctattctcctgccat

SEQ ID NO: 590439 - DNA, 14 bp, Homo sapiens
tcctatttttgtga

SEQ ID NO: 590440 - DNA, 16 bp, Homo sapiens
tcctatttttgtgaag

SEQ ID NO: 590441 - DNA, 13 bp, Homo sapiens
tcctcaaaccact

SEQ ID NO: 590442 - DNA, 21 bp, Homo sapiens
tcctcatcagtgtgtaaataa

SEQ ID NO: 590443 - DNA, 19 bp, Homo sapiens
tcctcatggcagcctactc

SEQ ID NO: 590444 - DNA, 15 bp, Homo sapiens
tcctccccacctgta

SEQ ID NO: 590445 - DNA, 19 bp, Homo sapiens
tcctcctaagtcccttcct

SEQ ID NO: 590446 - DNA, 12 bp, Homo sapiens
tcctcctacctg

SEQ ID NO: 590447 - DNA, 14 bp, Homo sapiens
tcctcgagccctcc

SEQ ID NO: 590448 - DNA, 18 bp, Homo sapiens
tcctcgagccctccccca

SEQ ID NO: 590449 - DNA, 15 bp, Homo sapiens
tcctcgcccccacca

SEQ ID NO: 590450 - DNA, 19 bp, Homo sapiens
tcctgatggtgtcattctg

SEQ ID NO: 590451 - DNA, 23 bp, Homo sapiens
tcctgatggtgtcattctgcctg

SEQ ID NO: 590452 - DNA, 11 bp, Homo sapiens
tcctgcaaagt

SEQ ID NO: 590453 - DNA, 18 bp, Homo sapiens
tcctgcaaagtctccaga

SEQ ID NO: 590454 - DNA, 22 bp, Homo sapiens
tcctgcaggcaggaacaaacag

SEQ ID NO: 590455 - DNA, 21 bp, Homo sapiens
tcctgccatgggtgcagaccc

SEQ ID NO: 590456 - DNA, 12 bp, Homo sapiens
tcctgcctcctc

SEQ ID NO: 590457 - DNA, 16 bp, Homo sapiens
tcctgcctcctcatca

SEQ ID NO: 590458 - DNA, 14 bp, Homo sapiens
tcctggtgactcct

SEQ ID NO: 590459 - DNA, 18 bp, Homo sapiens
tcctgtcctgcctcctca

SEQ ID NO: 590460 - DNA, 19 bp, Homo sapiens
tcctgtgtgaccctgggca

SEQ ID NO: 590461 - DNA, 18 bp, Homo sapiens
tcctgtttcctagctgtg

SEQ ID NO: 590462 - DNA, 17 bp, Homo sapiens
tccttaggcctctgaga

SEQ ID NO: 590463 - DNA, 22 bp, Homo sapiens
tccttcaacctgcatagccggt

SEQ ID NO: 590464 - DNA, 23 bp, Homo sapiens
tccttcaacctgcatagccggtg

SEQ ID NO: 590465 - DNA, 17 bp, Homo sapiens
tccttccactgtagcta

SEQ ID NO: 590466 - DNA, 17 bp, Homo sapiens
tccttgagattctgaag

SEQ ID NO: 590467 - DNA, 16 bp, Homo sapiens
tccttgagtgtatgag

SEQ ID NO: 590468 - DNA, 14 bp, Homo sapiens
tcctttctccctgc

SEQ ID NO: 590469 - DNA, 14 bp, Homo sapiens
tcgagccctccccc

SEQ ID NO: 590470 - DNA, 13 bp, Homo sapiens
tcgcatttcctaa

SEQ ID NO: 590471 - DNA, 17 bp, Homo sapiens
tgcatcatctcttcctc

SEQ ID NO: 590472 - DNA, 22 bp, Homo sapiens
tgcattagcctggatcctcagt

SEQ ID NO: 590473 - DNA, 13 bp, Homo sapiens
tgcatttaataaa

SEQ ID NO: 590474 - DNA, 18 bp, Homo sapiens
tgcatttaataaagatga

SEQ ID NO: 590475 - DNA, 20 bp, Homo sapiens
tgcatttaataaagatgagt

SEQ ID NO: 590476 - DNA, 14 bp, Homo sapiens
tgcattttgatatt

SEQ ID NO: 590477 - DNA, 19 bp, Homo sapiens
tgccaaaacatttatgaca

SEQ ID NO: 590478 - DNA, 23 bp, Homo sapiens
tgccaagagctactcccacagca

SEQ ID NO: 590479 - DNA, 16 bp, Homo sapiens
tgccaatctgtacaaa

SEQ ID NO: 590480 - DNA, 20 bp, Homo sapiens
tgccaatctgtacaaaatgg

SEQ ID NO: 590481 - DNA, 21 bp, Homo sapiens
tgccagccccctaaaagcact

SEQ ID NO: 590482 - DNA, 23 bp, Homo sapiens
tgccaggacatgcaataaaattt

SEQ ID NO: 590483 - DNA, 13 bp, Homo sapiens
tgccatcctgatg

SEQ ID NO: 590484 - DNA, 21 bp, Homo sapiens
tgccatcctgatggacctgcc

SEQ ID NO: 590485 - DNA, 22 bp, Homo sapiens
tgccatggctaggtagaagtga

SEQ ID NO: 590486 - DNA, 18 bp, Homo sapiens
tgccatgggtgcagaccc

SEQ ID NO: 590487 - DNA, 18 bp, Homo sapiens
tgccccctgcttggccag

SEQ ID NO: 590488 - DNA, 17 bp, Homo sapiens
tgccccggacctacctc

SEQ ID NO: 590489 - DNA, 16 bp, Homo sapiens
tgcccctgttcatgtt

SEQ ID NO: 590490 - DNA, 15 bp, Homo sapiens
tgccctactcactct

SEQ ID NO: 590491 - DNA, 21 bp, Homo sapiens
tgccctccgaagagagttctg

SEQ ID NO: 590492 - DNA, 12 bp, Homo sapiens
tgccctcctctc

SEQ ID NO: 590493 - DNA, 21 bp, Homo sapiens
tgccctcctctccctcccact

SEQ ID NO: 590494 - DNA, 14 bp, Homo sapiens
tgccgtaatttaac

SEQ ID NO: 590495 - DNA, 14 bp, Homo sapiens
tgccgttttctggg

SEQ ID NO: 590496 - DNA, 21 bp, Homo sapiens
tgcctccctgggccacctcct

SEQ ID NO: 590497 - DNA, 22 bp, Homo sapiens
tgcctccctgggccacctccta

SEQ ID NO: 590498 - DNA, 22 bp, Homo sapiens
tgcctgcccctaccctggactt

SEQ ID NO: 590499 - DNA, 14 bp, Homo sapiens
tgcgtttgcctcct

SEQ ID NO: 590500 - DNA, 13 bp, Homo sapiens
tgctaatttgttt

SEQ ID NO: 590501 - DNA, 21 bp, Homo sapiens
tgctactgttgtaagaattct

SEQ ID NO: 590502 - DNA, 23 bp, Homo sapiens
tgctatcggcagatgatgctttg

SEQ ID NO: 590503 - DNA, 22 bp, Homo sapiens
tgctatcttttttagtgttaaa

SEQ ID NO: 590504 - DNA, 14 bp, Homo sapiens
tgctcacagctgta

SEQ ID NO: 590505 - DNA, 19 bp, Homo sapiens
tgctgaacataacttctca

SEQ ID NO: 590506 - DNA, 17 bp, Homo sapiens
tgctgagggtttgaata

SEQ ID NO: 590507 - DNA, 20 bp, Homo sapiens
tgctgataccatatgaatga

SEQ ID NO: 590508 - DNA, 17 bp, Homo sapiens
tgctgggcagagggagg

SEQ ID NO: 590509 - DNA, 18 bp, Homo sapiens
tgctgggccccatctcca

SEQ ID NO: 590510 - DNA, 12 bp, Homo sapiens
tgctgttgctta

SEQ ID NO: 590511 - DNA, 14 bp, Homo sapiens
tgcttaaaccactt

SEQ ID NO: 590512 - DNA, 21 bp, Homo sapiens
tgcttaaaccacttaaacgaa

SEQ ID NO: 590513 - DNA, 17 bp, Homo sapiens
tgcttattatgtaggta

SEQ ID NO: 590514 - DNA, 17 bp, Homo sapiens
tgcttgcataagagctt

SEQ ID NO: 590515 - DNA, 20 bp, Homo sapiens
tgcttgtcttctggtacttt

SEQ ID NO: 590516 - DNA, 20 bp, Homo sapiens
tgctttattaatgttttcaa

SEQ ID NO: 590517 - DNA, 14 bp, Homo sapiens
tggaaaaaacattt

SEQ ID NO: 590518 - DNA, 16 bp, Homo sapiens
tggaaaatataatgat

SEQ ID NO: 590519 - DNA, 19 bp, Homo sapiens
tggaaagcagagttttcat

SEQ ID NO: 590520 - DNA, 19 bp, Homo sapiens
tggaaattcctgtactgtg

SEQ ID NO: 590521 - DNA, 21 bp, Homo sapiens
tggaagatgcagaagcaataa

SEQ ID NO: 590522 - DNA, 20 bp, Homo sapiens
tggaagcccctgggcccagt

SEQ ID NO: 590523 - DNA, 18 bp, Homo sapiens
tggaatcagtatttcctt

SEQ ID NO: 590524 - DNA, 19 bp, Homo sapiens
tggaatcagtatttccttc

SEQ ID NO: 590525 - DNA, 22 bp, Homo sapiens
tggaattcttagtcacaaaata

SEQ ID NO: 590526 - DNA, 11 bp, Homo sapiens
tggacttctga

SEQ ID NO: 590527 - DNA, 13 bp, Homo sapiens
tggagaaaatggg

SEQ ID NO: 590528 - DNA, 16 bp, Homo sapiens
tggagaatactgccaa

SEQ ID NO: 590529 - DNA, 21 bp, Homo sapiens
tggagccattgaacagctgtg

SEQ ID NO: 590530 - DNA, 23 bp, Homo sapiens
tggagccattgaacagctgtgag

SEQ ID NO: 590531 - DNA, 17 bp, Homo sapiens
tggagctcagggtcctt

SEQ ID NO: 590532 - DNA, 16 bp, Homo sapiens
tggaggggctggggac

SEQ ID NO: 590533 - DNA, 14 bp, Homo sapiens
tggatacagagcca

SEQ ID NO: 590534 - DNA, 11 bp, Homo sapiens
tggatatttgt

SEQ ID NO: 590535 - DNA, 13 bp, Homo sapiens
tggatatttgtat

SEQ ID NO: 590536 - DNA, 14 bp, Homo sapiens
tggatcacaaagtg

SEQ ID NO: 590537 - DNA, 20 bp, Homo sapiens
tggatcccgttcagaaaacc

SEQ ID NO: 590538 - DNA, 11 bp, Homo sapiens
tggatgtctgg

SEQ ID NO: 590539 - DNA, 12 bp, Homo sapiens
tggatgtctggc

SEQ ID NO: 590540 - DNA, 15 bp, Homo sapiens
tggattctaaataca

SEQ ID NO: 590541 - DNA, 21 bp, Homo sapiens
tggatttggcactagccaaag

SEQ ID NO: 590542 - DNA, 13 bp, Homo sapiens
tggcaccactctc

SEQ ID NO: 590543 - DNA, 16 bp, Homo sapiens
tggcacttgggggact

SEQ ID NO: 590544 - DNA, 21 bp, Homo sapiens
tggcagatgagggctggctgc

SEQ ID NO: 590545 - DNA, 23 bp, Homo sapiens
tggcattcaaccacgcaggaagc

SEQ ID NO: 590546 - DNA, 18 bp, Homo sapiens
tggcattctttgcaatac

SEQ ID NO: 590547 - DNA, 20 bp, Homo sapiens
tggcattctttgcaatactg

SEQ ID NO: 590548 - DNA, 18 bp, Homo sapiens
tggccaattaaaaacgaa

SEQ ID NO: 590549 - DNA, 21 bp, Homo sapiens
tggccagggaggcagcctagc

SEQ ID NO: 590550 - DNA, 14 bp, Homo sapiens
tggctcaaagcagc

SEQ ID NO: 590551 - DNA, 20 bp, Homo sapiens
tggctgacttacatcatgtg

SEQ ID NO: 590552 - DNA, 14 bp, Homo sapiens
tggctgctgttgct

SEQ ID NO: 590553 - DNA, 18 bp, Homo sapiens
tgggaaacaaataatttg

SEQ ID NO: 590554 - DNA, 23 bp, Homo sapiens
tgggaaacaaataatttgaactt

SEQ ID NO: 590555 - DNA, 14 bp, Homo sapiens
tgggaaagagccta

SEQ ID NO: 590556 - DNA, 16 bp, Homo sapiens
tgggagctgccaagag

SEQ ID NO: 590557 - DNA, 17 bp, Homo sapiens
tgggaggtatgggctgg

SEQ ID NO: 590558 - DNA, 20 bp, Homo sapiens
tgggataaaggcccagactc

SEQ ID NO: 590559 - DNA, 14 bp, Homo sapiens
tgggataggagcag

SEQ ID NO: 590560 - DNA, 16 bp, Homo sapiens
tgggatattttgaaat

SEQ ID NO: 590561 - DNA, 22 bp, Homo sapiens
tgggatattttgaaatgaactt

SEQ ID NO: 590562 - DNA, 14 bp, Homo sapiens
tgggatgaatgcca

SEQ ID NO: 590563 - DNA, 13 bp, Homo sapiens
tgggcactggggc

SEQ ID NO: 590564 - DNA, 12 bp, Homo sapiens
tgggcagccaga

SEQ ID NO: 590565 - DNA, 23 bp, Homo sapiens
tgggcatcagggcctttctcctc

SEQ ID NO: 590566 - DNA, 16 bp, Homo sapiens
tgggccacctcctacc

SEQ ID NO: 590567 - DNA, 17 bp, Homo sapiens
tgggccacctcctaccc

SEQ ID NO: 590568 - DNA, 23 bp, Homo sapiens
tgggccacctcctaccccttcct

SEQ ID NO: 590569 - DNA, 16 bp, Homo sapiens
tgggccccatctccac

SEQ ID NO: 590570 - DNA, 19 bp, Homo sapiens
tgggctgcccacctggctg

SEQ ID NO: 590571 - DNA, 21 bp, Homo sapiens
tgggctgcccacctggctgcc

SEQ ID NO: 590572 - DNA, 16 bp, Homo sapiens
tggggaagggcctgcc

SEQ ID NO: 590573 - DNA, 21 bp, Homo sapiens
tggggactcctcaaaccactt

SEQ ID NO: 590574 - DNA, 16 bp, Homo sapiens
tggggaggttgtgggg

SEQ ID NO: 590575 - DNA, 22 bp, Homo sapiens
tggggccataaacggttcctgg

SEQ ID NO: 590576 - DNA, 24 bp, Homo sapiens
tggggctgagccctcctgagggcc

SEQ ID NO: 590577 - DNA, 18 bp, Homo sapiens
tgggggagattgaacttt

SEQ ID NO: 590578 - DNA, 12 bp, Homo sapiens
tgggtcccctcc

SEQ ID NO: 590579 - DNA, 21 bp, Homo sapiens
tgggtgccctttcctggcagt

SEQ ID NO: 590580 - DNA, 18 bp, Homo sapiens
ttgaaatgaactttgtca

SEQ ID NO: 590581 - DNA, 23 bp, Homo sapiens
ttgaacagctgtgagccatgcct

SEQ ID NO: 590582 - DNA, 19 bp, Homo sapiens
ttgaagcatagataatatt

SEQ ID NO: 590583 - DNA, 23 bp, Homo sapiens
ttgaagcatagataatattgttt

SEQ ID NO: 590584 - DNA, 13 bp, Homo sapiens
ttgaatgtccaaa

SEQ ID NO: 590585 - DNA, 17 bp, Homo sapiens
ttgaatgtccaaaattt

SEQ ID NO: 590586 - DNA, 18 bp, Homo sapiens
ttgactcttatttataga

SEQ ID NO: 590587 - DNA, 19 bp, Homo sapiens
ttgactcttatttatagaa

SEQ ID NO: 590588 - DNA, 20 bp, Homo sapiens
ttgacttttataaagcatgt

SEQ ID NO: 590589 - DNA, 21 bp, Homo sapiens
ttgacttttataaagcatgtt

SEQ ID NO: 590590 - DNA, 15 bp, Homo sapiens
ttgagtattgtttaa

SEQ ID NO: 590591 - DNA, 15 bp, Homo sapiens
ttgagtgtatgagta

SEQ ID NO: 590592 - DNA, 22 bp, Homo sapiens
ttgatagggtctaccaatacaa

SEQ ID NO: 590593 - DNA, 23 bp, Homo sapiens
ttgatagggtctaccaatacaaa

SEQ ID NO: 590594 - DNA, 19 bp, Homo sapiens
ttgatgaggacccagagct

SEQ ID NO: 590595 - DNA, 20 bp, Homo sapiens
ttgcaatgcagaggttgaga

SEQ ID NO: 590596 - DNA, 15 bp, Homo sapiens
ttgcactgccccctg

SEQ ID NO: 590597 - DNA, 14 bp, Homo sapiens
ttgcacttttgaat

SEQ ID NO: 590598 - DNA, 22 bp, Homo sapiens
ttgcacttttgaatgtccaaaa

SEQ ID NO: 590599 - DNA, 20 bp, Homo sapiens
ttgcatcactgtatcatttt

SEQ ID NO: 590600 - DNA, 11 bp, Homo sapiens
ttgcatgcatg

SEQ ID NO: 590601 - DNA, 17 bp, Homo sapiens
ttgcatgcatgcaaatg

SEQ ID NO: 590602 - DNA, 15 bp, Homo sapiens
ttgccaggacatgca

SEQ ID NO: 590603 - DNA, 14 bp, Homo sapiens
ttgccatcctgatg

SEQ ID NO: 590604 - DNA, 19 bp, Homo sapiens
ttgcgaccttaatttaact

SEQ ID NO: 590605 - DNA, 20 bp, Homo sapiens
ttgctgccattacagaggta

SEQ ID NO: 590606 - DNA, 18 bp, Homo sapiens
ttgcttaaaccacttaaa

SEQ ID NO: 590607 - DNA, 16 bp, Homo sapiens
ttggatggcttgtcta

SEQ ID NO: 590608 - DNA, 16 bp, Homo sapiens
ttggatgttgtaaata

SEQ ID NO: 590609 - DNA, 17 bp, Homo sapiens
ttggatgttgtaaataa

SEQ ID NO: 590610 - DNA, 23 bp, Homo sapiens
ttggcattcaaccacgcaggaag

SEQ ID NO: 590611 - DNA, 20 bp, Homo sapiens
ttggcattctttgcaatact

SEQ ID NO: 590612 - DNA, 13 bp, Homo sapiens
ttgggaaaacatg

SEQ ID NO: 590613 - DNA, 14 bp, Homo sapiens
ttgggtgaatttca

SEQ ID NO: 590614 - DNA, 15 bp, Homo sapiens
ttgggtgaatttcag

SEQ ID NO: 590615 - DNA, 21 bp, Homo sapiens
ttgggtggggggcattgagta

SEQ ID NO: 590616 - DNA, 20 bp, Homo sapiens
ttggtgcgggcacaataaat

SEQ ID NO: 590617 - DNA, 22 bp, Homo sapiens
ttggtgtacagaccacctttca

SEQ ID NO: 590618 - DNA, 22 bp, Homo sapiens
ttggttgggaatgaggaaaatt

SEQ ID NO: 590619 - DNA, 16 bp, Homo sapiens
ttgtaattatgtaaat

SEQ ID NO: 590620 - DNA, 13 bp, Homo sapiens
ttgtccaggaagt

SEQ ID NO: 590621 - DNA, 23 bp, Homo sapiens
ttgtcttagcatggtacctgctg

SEQ ID NO: 590622 - DNA, 21 bp, Homo sapiens
ttgtgctgggtcccagcctgg

SEQ ID NO: 590623 - DNA, 20 bp, Homo sapiens
ttgtggggcctcaggctccg

SEQ ID NO: 590624 - DNA, 15 bp, Homo sapiens
ttgtgtgaaattgca

SEQ ID NO: 590625 - DNA, 13 bp, Homo sapiens
ttgtgtttctaga

SEQ ID NO: 590626 - DNA, 21 bp, Homo sapiens
ttgtttaaaatgtaatttaaa

SEQ ID NO: 590627 - DNA, 19 bp, Homo sapiens
ttgtttggtaaatgtttct

SEQ ID NO: 590628 - DNA, 15 bp, Homo sapiens
tttaaaactgttgga

SEQ ID NO: 590629 - DNA, 12 bp, Homo sapiens
tttaaaatgtaa

SEQ ID NO: 590630 - DNA, 21 bp, Homo sapiens
tttaaaatgtaatttaaatga

SEQ ID NO: 590631 - DNA, 22 bp, Homo sapiens
tttaaaatgtaatttaaatgaa

SEQ ID NO: 590632 - DNA, 21 bp, Homo sapiens
tttaaaattttgtatgttaaa

SEQ ID NO: 590633 - DNA, 20 bp, Homo sapiens
tttaaagaagtgcatgaaaa

SEQ ID NO: 590634 - DNA, 14 bp, Homo sapiens
tttaaagtgcaaaa

SEQ ID NO: 590635 - DNA, 23 bp, Homo sapiens
tttaaccggtaagagtttcagtt

SEQ ID NO: 590636 - DNA, 13 bp, Homo sapiens
tttaactgtgata

SEQ ID NO: 590637 - DNA, 12 bp, Homo sapiens
tttaactgtgga

SEQ ID NO: 590638 - DNA, 17 bp, Homo sapiens
tttaactgtggatattg

SEQ ID NO: 590639 - DNA, 18 bp, Homo sapiens
tttaagaaaaaaagctgc

SEQ ID NO: 590640 - DNA, 16 bp, Homo sapiens
tttaagaccagcctgg

SEQ ID NO: 590641 - DNA, 16 bp, Homo sapiens
tttaataaagatgagt

SEQ ID NO: 590642 - DNA, 21 bp, Homo sapiens
tttaatgtaatagggaaaatt

SEQ ID NO: 590643 - DNA, 19 bp, Homo sapiens
tttaatgtctcctttgctc

SEQ ID NO: 590644 - DNA, 13 bp, Homo sapiens
tttacccttcagg

SEQ ID NO: 590645 - DNA, 15 bp, Homo sapiens
tttagaaataataaa

SEQ ID NO: 590646 - DNA, 14 bp, Homo sapiens
tttagaagcctgca

SEQ ID NO: 590647 - DNA, 15 bp, Homo sapiens
tttagtgaattaaat

SEQ ID NO: 590648 - DNA, 12 bp, Homo sapiens
tttataaagcat

SEQ ID NO: 590649 - DNA, 15 bp, Homo sapiens
tttataatactacta

SEQ ID NO: 590650 - DNA, 17 bp, Homo sapiens
tttataattgtacaaaa

SEQ ID NO: 590651 - DNA, 17 bp, Homo sapiens
tttatagaatttaatat

SEQ ID NO: 590652 - DNA, 16 bp, Homo sapiens
tttatatttcaataaa

SEQ ID NO: 590653 - DNA, 18 bp, Homo sapiens
tttatatttcaataaatg

SEQ ID NO: 590654 - DNA, 19 bp, Homo sapiens
tttatatttttttaactgt

SEQ ID NO: 590655 - DNA, 14 bp, Homo sapiens
tttatcgtttttgt

SEQ ID NO: 590656 - DNA, 12 bp, Homo sapiens
tttattgcaatg

SEQ ID NO: 590657 - DNA, 19 bp, Homo sapiens
tttattgctgtgtaacact

SEQ ID NO: 590658 - DNA, 14 bp, Homo sapiens
tttattgtgctggg

SEQ ID NO: 590659 - DNA, 15 bp, Homo sapiens
tttcaacggaaagtg

SEQ ID NO: 590660 - DNA, 10 bp, Homo sapiens
tttcaagaat

SEQ ID NO: 590661 - DNA, 18 bp, Homo sapiens
tttcaatcgtaaaatttc

SEQ ID NO: 590662 - DNA, 22 bp, Homo sapiens
tttcaatgtctaaaaacatttg

SEQ ID NO: 590663 - DNA, 20 bp, Homo sapiens
tttcagaaatataacacatt

SEQ ID NO: 590664 - DNA, 22 bp, Homo sapiens
tttcagaaatataacacatttt

SEQ ID NO: 590665 - DNA, 22 bp, Homo sapiens
tttcagttctttggattctaaa

SEQ ID NO: 590666 - DNA, 15 bp, Homo sapiens
tttcatattgtaatc

SEQ ID NO: 590667 - DNA, 19 bp, Homo sapiens
tttcatgaaaataccattt

SEQ ID NO: 590668 - DNA, 16 bp, Homo sapiens
tttcattaaatccttt

SEQ ID NO: 590669 - DNA, 12 bp, Homo sapiens
tttccaaaagta

SEQ ID NO: 590670 - DNA, 14 bp, Homo sapiens
tttcctactttcta

SEQ ID NO: 590671 - DNA, 22 bp, Homo sapiens
tttcctgtggcataaattgcat

SEQ ID NO: 590672 - DNA, 16 bp, Homo sapiens
tttccttccactgtag

SEQ ID NO: 590673 - DNA, 22 bp, Homo sapiens
tttccttttggcctcctgcaaa

SEQ ID NO: 590674 - DNA, 15 bp, Homo sapiens
tttcggaaacactga

SEQ ID NO: 590675 - DNA, 17 bp, Homo sapiens
tttctcagtgttggtat

SEQ ID NO: 590676 - DNA, 20 bp, Homo sapiens
tttctccgggtcctcctaag

SEQ ID NO: 590677 - DNA, 16 bp, Homo sapiens
tttctcctccccacct

SEQ ID NO: 590678 - DNA, 15 bp, Homo sapiens
tttctggatttcata

SEQ ID NO: 590679 - DNA, 18 bp, Homo sapiens
tttctgggctgatgggtg

SEQ ID NO: 590680 - DNA, 22 bp, Homo sapiens
tttctggtccctcttctctcct

SEQ ID NO: 590681 - DNA, 12 bp, Homo sapiens
tttctttaactg

SEQ ID NO: 590682 - DNA, 21 bp, Homo sapiens
tttgaaagaatagaacacagt

SEQ ID NO: 590683 - DNA, 16 bp, Homo sapiens
tttgaaatgaactttg

SEQ ID NO: 590684 - DNA, 13 bp, Homo sapiens
tttgacagtgttt

SEQ ID NO: 590685 - DNA, 14 bp, Homo sapiens
tttgatacattttt

SEQ ID NO: 590686 - DNA, 17 bp, Homo sapiens
tttgattgggatgaatg

SEQ ID NO: 590687 - DNA, 16 bp, Homo sapiens
tttgctatctgggctg

SEQ ID NO: 590688 - DNA, 14 bp, Homo sapiens
tttgctgtctctta

SEQ ID NO: 590689 - DNA, 20 bp, Homo sapiens
tttggatttaaaagcctgct

SEQ ID NO: 590690 - DNA, 19 bp, Homo sapiens
aaataatgctacaatttta

SEQ ID NO: 590691 - DNA, 19 bp, Homo sapiens
aaataggaatcattcagaa

SEQ ID NO: 590692 - DNA, 16 bp, Homo sapiens
aaatataacacatttt

SEQ ID NO: 590693 - DNA, 17 bp, Homo sapiens
aaatccttttacctttt

SEQ ID NO: 590694 - DNA, 13 bp, Homo sapiens
aaatgaactttgt

SEQ ID NO: 590695 - DNA, 19 bp, Homo sapiens
aaatgagctctgaaatctt

SEQ ID NO: 590696 - DNA, 15 bp, Homo sapiens
aaatgcctgactcag

SEQ ID NO: 590697 - DNA, 23 bp, Homo sapiens
aaatgctcccacctgaatttgta

SEQ ID NO: 590698 - DNA, 21 bp, Homo sapiens
aaatggaaagcagagttttca

SEQ ID NO: 590699 - DNA, 20 bp, Homo sapiens
aaatggtcctatttttgtga

SEQ ID NO: 590700 - DNA, 13 bp, Homo sapiens
aaatgtataaata

SEQ ID NO: 590701 - DNA, 19 bp, Homo sapiens
aaatgtataaatatacagt

SEQ ID NO: 590702 - DNA, 16 bp, Homo sapiens
aaatgtgtaataatgt

SEQ ID NO: 590703 - DNA, 14 bp, Homo sapiens
aaatgttaaaagtt

SEQ ID NO: 590704 - DNA, 18 bp, Homo sapiens
aaatgtttcttttaaaga

SEQ ID NO: 590705 - DNA, 19 bp, Homo sapiens
aaatgtttcttttgtttgg

SEQ ID NO: 590706 - DNA, 21 bp, Homo sapiens
aaattatgcaattcagtgttc

SEQ ID NO: 590707 - DNA, 16 bp, Homo sapiens
aaattcaactttgtaa

SEQ ID NO: 590708 - DNA, 20 bp, Homo sapiens
aaattcaactttgtaaaaat

SEQ ID NO: 590709 - DNA, 15 bp, Homo sapiens
aaattgcatactttg

SEQ ID NO: 590710 - DNA, 16 bp, Homo sapiens
aaatttaaaaaataaa

SEQ ID NO: 590711 - DNA, 18 bp, Homo sapiens
aaatttcactactagatt

SEQ ID NO: 590712 - DNA, 15 bp, Homo sapiens
aaatttgataatgac

SEQ ID NO: 590713 - DNA, 20 bp, Homo sapiens
aaatttgccaatctttccta

SEQ ID NO: 590714 - DNA, 14 bp, Homo sapiens
aacaaaactcttaa

SEQ ID NO: 590715 - DNA, 18 bp, Homo sapiens
aacaaacaagccccctgc

SEQ ID NO: 590716 - DNA, 21 bp, Homo sapiens
aacaatggtgtggtgaatgtg

SEQ ID NO: 590717 - DNA, 18 bp, Homo sapiens
aacacattcttattgaca

SEQ ID NO: 590718 - DNA, 13 bp, Homo sapiens
aacagacacaatt

SEQ ID NO: 590719 - DNA, 20 bp, Homo sapiens
aacagctgtgagccatgcct

SEQ ID NO: 590720 - DNA, 20 bp, Homo sapiens
aacagtgaagttttactgtc

SEQ ID NO: 590721 - DNA, 21 bp, Homo sapiens
aacagtgaagttttactgtct

SEQ ID NO: 590722 - DNA, 13 bp, Homo sapiens
aacagtgtttaaa

SEQ ID NO: 590723 - DNA, 21 bp, Homo sapiens
aacataactcacacccctgcc

SEQ ID NO: 590724 - DNA, 21 bp, Homo sapiens
aacatagtgagacccctgtct

SEQ ID NO: 590725 - DNA, 13 bp, Homo sapiens
aacatcatttcaa

SEQ ID NO: 590726 - DNA, 23 bp, Homo sapiens
aacatgatccccgtctctgccct

SEQ ID NO: 590727 - DNA, 15 bp, Homo sapiens
aacatgggctgtgat

SEQ ID NO: 590728 - DNA, 21 bp, Homo sapiens
aacatgggctgtgattactgc

SEQ ID NO: 590729 - DNA, 22 bp, Homo sapiens
aacatgggctgtgattactgca

SEQ ID NO: 590730 - DNA, 13 bp, Homo sapiens
aacatttgctgcc

SEQ ID NO: 590731 - DNA, 16 bp, Homo sapiens
aacatttgctgccatt

SEQ ID NO: 590732 - DNA, 19 bp, Homo sapiens
aaccacacttgaaaccttt

SEQ ID NO: 590733 - DNA, 14 bp, Homo sapiens
aaggatagtaagca

SEQ ID NO: 590734 - DNA, 21 bp, Homo sapiens
aaggatgggtcccctccgcca

SEQ ID NO: 590735 - DNA, 19 bp, Homo sapiens
aaggcacccacaaataaat

SEQ ID NO: 590736 - DNA, 20 bp, Homo sapiens
aaggcacccacaaataaatg

SEQ ID NO: 590737 - DNA, 15 bp, Homo sapiens
aagggaaagtttttt

SEQ ID NO: 590738 - DNA, 14 bp, Homo sapiens
aagggaatgcatta

SEQ ID NO: 590739 - DNA, 23 bp, Homo sapiens
aagggcctgcccagttgcactca

SEQ ID NO: 590740 - DNA, 23 bp, Homo sapiens
aaggggtttctatccttccagaa

SEQ ID NO: 590741 - DNA, 13 bp, Homo sapiens
aaggtaatgtgtg

SEQ ID NO: 590742 - DNA, 12 bp, Homo sapiens
aagtattcacaa

SEQ ID NO: 590743 - DNA, 13 bp, Homo sapiens
aagtcagaatttt

SEQ ID NO: 590744 - DNA, 19 bp, Homo sapiens
aagtcagaatttttaactg

SEQ ID NO: 590745 - DNA, 11 bp, Homo sapiens
aagtcccttcc

SEQ ID NO: 590746 - DNA, 16 bp, Homo sapiens
aagtgtgctgggcaga

SEQ ID NO: 590747 - DNA, 17 bp, Homo sapiens
aagtgtgctgggcagag

SEQ ID NO: 590748 - DNA, 15 bp, Homo sapiens
aagttatttgttcat

SEQ ID NO: 590749 - DNA, 20 bp, Homo sapiens
aagttatttgttcattattt

SEQ ID NO: 590750 - DNA, 21 bp, Homo sapiens
aagttcatgtccaaacgtcct

SEQ ID NO: 590751 - DNA, 23 bp, Homo sapiens
aagtttcattctccctttcacta

SEQ ID NO: 590752 - DNA, 17 bp, Homo sapiens
aagttttactgataatt

SEQ ID NO: 590753 - DNA, 12 bp, Homo sapiens
aagttttgttgt

SEQ ID NO: 590754 - DNA, 13 bp, Homo sapiens
aagttttgttgta

SEQ ID NO: 590755 - DNA, 15 bp, Homo sapiens
aagtttttgtttgga

SEQ ID NO: 590756 - DNA, 12 bp, Homo sapiens
aataaagaggag

SEQ ID NO: 590757 - DNA, 15 bp, Homo sapiens
aataaagatgagttg

SEQ ID NO: 590758 - DNA, 12 bp, Homo sapiens
aataacatgttt

SEQ ID NO: 590759 - DNA, 19 bp, Homo sapiens
aataataaagtacttgact

SEQ ID NO: 590760 - DNA, 15 bp, Homo sapiens
aataatgtaacatga

SEQ ID NO: 590761 - DNA, 16 bp, Homo sapiens
aataatgtaacatgat

SEQ ID NO: 590762 - DNA, 17 bp, Homo sapiens
aataatgtaacatgatt

SEQ ID NO: 590763 - DNA, 15 bp, Homo sapiens
aataatttgcactga

SEQ ID NO: 590764 - DNA, 21 bp, Homo sapiens
aataccacatcaaataagaaa

SEQ ID NO: 590765 - DNA, 15 bp, Homo sapiens
aataccatttagtaa

SEQ ID NO: 590766 - DNA, 18 bp, Homo sapiens
aataccatttagtaagaa

SEQ ID NO: 590767 - DNA, 12 bp, Homo sapiens
aatacctgctca

SEQ ID NO: 590768 - DNA, 15 bp, Homo sapiens
aatacgtttgtgttt

SEQ ID NO: 590769 - DNA, 20 bp, Homo sapiens
aatactgcttaattgctgat

SEQ ID NO: 590770 - DNA, 14 bp, Homo sapiens
aatagaaggtgatg

SEQ ID NO: 590771 - DNA, 14 bp, Homo sapiens
aatataacacattt

SEQ ID NO: 590772 - DNA, 11 bp, Homo sapiens
aatatatgtat

SEQ ID NO: 590773 - DNA, 23 bp, Homo sapiens
aatatatgtattttttgaatcta

SEQ ID NO: 590774 - DNA, 21 bp, Homo sapiens
acagctcaagcattctgttta

SEQ ID NO: 590775 - DNA, 15 bp, Homo sapiens
acagctgtgagccat

SEQ ID NO: 590776 - DNA, 16 bp, Homo sapiens
acagctgtgagccatg

SEQ ID NO: 590777 - DNA, 22 bp, Homo sapiens
acagctgtgagccatgcctccc

SEQ ID NO: 590778 - DNA, 15 bp, Homo sapiens
acagggccacataga

SEQ ID NO: 590779 - DNA, 14 bp, Homo sapiens
acaggtaaaacagg

SEQ ID NO: 590780 - DNA, 22 bp, Homo sapiens
acaggtaaaacagggccacata

SEQ ID NO: 590781 - DNA, 18 bp, Homo sapiens
acaggtgctaatttgttt

SEQ ID NO: 590782 - DNA, 21 bp, Homo sapiens
acaggttttccaaaagtaaag

SEQ ID NO: 590783 - DNA, 23 bp, Homo sapiens
acagtatgtgggatattgaatgt

SEQ ID NO: 590784 - DNA, 16 bp, Homo sapiens
acagtgaagttttact

SEQ ID NO: 590785 - DNA, 16 bp, Homo sapiens
acagtttttgacattt

SEQ ID NO: 590786 - DNA, 21 bp, Homo sapiens
acagtttttgacatttatatt

SEQ ID NO: 590787 - DNA, 14 bp, Homo sapiens
acatcaaataagaa

SEQ ID NO: 590788 - DNA, 14 bp, Homo sapiens
acatcaatatgtat

SEQ ID NO: 590789 - DNA, 14 bp, Homo sapiens
acatcacaagacta

SEQ ID NO: 590790 - DNA, 20 bp, Homo sapiens
acatcagcctccttctttca

SEQ ID NO: 590791 - DNA, 14 bp, Homo sapiens
acatcatttcaatc

SEQ ID NO: 590792 - DNA, 21 bp, Homo sapiens
acatgatccccgtctctgccc

SEQ ID NO: 590793 - DNA, 18 bp, Homo sapiens
acatgcaataaaatttaa

SEQ ID NO: 590794 - DNA, 23 bp, Homo sapiens
acatgttcccaaaacaatggtgt

SEQ ID NO: 590795 - DNA, 11 bp, Homo sapiens
acatgtttctc

SEQ ID NO: 590796 - DNA, 19 bp, Homo sapiens
acattaactgttgcacttt

SEQ ID NO: 590797 - DNA, 19 bp, Homo sapiens
acattcaggaattcttgga

SEQ ID NO: 590798 - DNA, 19 bp, Homo sapiens
acatttatattaaataaca

SEQ ID NO: 590799 - DNA, 22 bp, Homo sapiens
acatttatgacaagctgtatca

SEQ ID NO: 590800 - DNA, 17 bp, Homo sapiens
acatttgctactgttgt

SEQ ID NO: 590801 - DNA, 11 bp, Homo sapiens
accaatacaaa

SEQ ID NO: 590802 - DNA, 18 bp, Homo sapiens
accaataccttcaaggct

SEQ ID NO: 590803 - DNA, 14 bp, Homo sapiens
accacttgcctggg

SEQ ID NO: 590804 - DNA, 16 bp, Homo sapiens
accagaaatcaaaaag

SEQ ID NO: 590805 - DNA, 17 bp, Homo sapiens
accagagtctgtatttt

SEQ ID NO: 590806 - DNA, 22 bp, Homo sapiens
accagagtctgtatttttctaa

SEQ ID NO: 590807 - DNA, 12 bp, Homo sapiens
accaggggccaa

SEQ ID NO: 590808 - DNA, 13 bp, Homo sapiens
accaggggccaac

SEQ ID NO: 590809 - DNA, 16 bp, Homo sapiens
accatgtgagctcttc

SEQ ID NO: 590810 - DNA, 20 bp, Homo sapiens
acccaatccctctccactct

SEQ ID NO: 590811 - DNA, 12 bp, Homo sapiens
acccagagctgc

SEQ ID NO: 590812 - DNA, 21 bp, Homo sapiens
acccattaaggggaagaatga

SEQ ID NO: 590813 - DNA, 17 bp, Homo sapiens
accccaaagagaaagag

SEQ ID NO: 590814 - DNA, 22 bp, Homo sapiens
accccttaccccaaagagaaag

SEQ ID NO: 590815 - DNA, 16 bp, Homo sapiens
accccttcctgtcctg

SEQ ID NO: 590816 - DNA, 20 bp, Homo sapiens
accccttcctgtcctgcctc

SEQ ID NO: 590817 - DNA, 21 bp, Homo sapiens
accccttcctgtcctgcctcc

SEQ ID NO: 590818 - DNA, 23 bp, Homo sapiens
accccttcctgtcctgcctcctc

SEQ ID NO: 590819 - DNA, 19 bp, Homo sapiens
accccttgttgcactgccc

SEQ ID NO: 590820 - DNA, 22 bp, Homo sapiens
acccggttattcgcccacccga

SEQ ID NO: 590821 - DNA, 23 bp, Homo sapiens
accctatgggtctaggacacagt

SEQ ID NO: 590822 - DNA, 12 bp, Homo sapiens
accctcttgcca

SEQ ID NO: 590823 - DNA, 21 bp, Homo sapiens
accctgaacccacacctgggc

SEQ ID NO: 590824 - DNA, 18 bp, Homo sapiens
acctacagttttaactgt

SEQ ID NO: 590825 - DNA, 13 bp, Homo sapiens
acctacctccctc

SEQ ID NO: 590826 - DNA, 15 bp, Homo sapiens
acctacctccctccc

SEQ ID NO: 590827 - DNA, 16 bp, Homo sapiens
acctacctccctccct

SEQ ID NO: 590828 - DNA, 18 bp, Homo sapiens
acctacctccctccctct

SEQ ID NO: 590829 - DNA, 12 bp, Homo sapiens
acctcaggctcc

SEQ ID NO: 590830 - DNA, 13 bp, Homo sapiens
acctcaggctcct

SEQ ID NO: 590831 - DNA, 14 bp, Homo sapiens
acctcaggctccta

SEQ ID NO: 590832 - DNA, 23 bp, Homo sapiens
acctccaacccaacccaatccct

SEQ ID NO: 590833 - DNA, 17 bp, Homo sapiens
acctccagtcacactcc

SEQ ID NO: 590834 - DNA, 19 bp, Homo sapiens
acctccagtcacactcccc

SEQ ID NO: 590835 - DNA, 14 bp, Homo sapiens
acctcctacccctt

SEQ ID NO: 590836 - DNA, 15 bp, Homo sapiens
acctcctaccccttc

SEQ ID NO: 590837 - DNA, 17 bp, Homo sapiens
acctcctaccccttcct

SEQ ID NO: 590838 - DNA, 19 bp, Homo sapiens
acctctctgcctctcttct

SEQ ID NO: 590839 - DNA, 20 bp, Homo sapiens
acctctctgcctctcttctt

SEQ ID NO: 590840 - DNA, 13 bp, Homo sapiens
acctgaatttgta

SEQ ID NO: 590841 - DNA, 14 bp, Homo sapiens
acctgaatttgtat

SEQ ID NO: 590842 - DNA, 20 bp, Homo sapiens
acctgaatttgtatatgact

SEQ ID NO: 590843 - DNA, 22 bp, Homo sapiens
acctgaatttgtatatgactgc

SEQ ID NO: 590844 - DNA, 22 bp, Homo sapiens
acctgagctaaataaagatatt

SEQ ID NO: 590845 - DNA, 22 bp, Homo sapiens
acctgatgtcagctgctgttga

SEQ ID NO: 590846 - DNA, 23 bp, Homo sapiens
acctgccccggacctacctccct

SEQ ID NO: 590847 - DNA, 12 bp, Homo sapiens
aaaaaaaacagt

SEQ ID NO: 590848 - DNA, 11 bp, Homo sapiens
aaaaacatttt

SEQ ID NO: 590849 - DNA, 16 bp, Homo sapiens
aaaaattatgcaattc

SEQ ID NO: 590850 - DNA, 22 bp, Homo sapiens
aaaacaatggtgtggtgaatgt

SEQ ID NO: 590851 - DNA, 22 bp, Homo sapiens
aaaagaaaatctttataaatgt

SEQ ID NO: 590852 - DNA, 18 bp, Homo sapiens
aaaagctgcaaaaattat

SEQ ID NO: 590853 - DNA, 17 bp, Homo sapiens
aaaagggcagctgtgat

SEQ ID NO: 590854 - DNA, 13 bp, Homo sapiens
aaaagtaaagatg

SEQ ID NO: 590855 - DNA, 22 bp, Homo sapiens
aaaagtagtgttgtccaggaag

SEQ ID NO: 590856 - DNA, 20 bp, Homo sapiens
aaaataaataaaaactaatt

SEQ ID NO: 590857 - DNA, 14 bp, Homo sapiens
aaaatataaaatta

SEQ ID NO: 590858 - DNA, 19 bp, Homo sapiens
aaaatgaaagctactcata

SEQ ID NO: 590859 - DNA, 21 bp, Homo sapiens
aaaatggcagggggtggaatt

SEQ ID NO: 590860 - DNA, 18 bp, Homo sapiens
aaaatgtaatttaaatga

SEQ ID NO: 590861 - DNA, 22 bp, Homo sapiens
aaaatgtggtctgccaatctgt

SEQ ID NO: 590862 - DNA, 20 bp, Homo sapiens
aaaattaagcaaatgttaaa

SEQ ID NO: 590863 - DNA, 23 bp, Homo sapiens
aaaattatgcaattcagtgttcc

SEQ ID NO: 590864 - DNA, 18 bp, Homo sapiens
aaaatttcccattaaaga

SEQ ID NO: 590865 - DNA, 18 bp, Homo sapiens
aaaattttgtatgttaaa

SEQ ID NO: 590866 - DNA, 21 bp, Homo sapiens
aaaattttgtatgttaaagag

SEQ ID NO: 590867 - DNA, 22 bp, Homo sapiens
aaacaaataatttgaactttgg

SEQ ID NO: 590868 - DNA, 20 bp, Homo sapiens
aaacacccgacgtcatgtat

SEQ ID NO: 590869 - DNA, 15 bp, Homo sapiens
aaacagggctgcctt

SEQ ID NO: 590870 - DNA, 15 bp, Homo sapiens
aaacatgggctgtga

SEQ ID NO: 590871 - DNA, 22 bp, Homo sapiens
aaacatgggctgtgattactgc

SEQ ID NO: 590872 - DNA, 16 bp, Homo sapiens
aaacatgttaatgaca

SEQ ID NO: 590873 - DNA, 14 bp, Homo sapiens
aaacatttatgaca

SEQ ID NO: 590874 - DNA, 23 bp, Homo sapiens
aaaccactttattgcaatgcaga

SEQ ID NO: 590875 - DNA, 16 bp, Homo sapiens
aaaccaggaccctgtc

SEQ ID NO: 590876 - DNA, 22 bp, Homo sapiens
aaacctgactaggttctgtaga

SEQ ID NO: 590877 - DNA, 22 bp, Homo sapiens
aaacctgatgctggggacacag

SEQ ID NO: 590878 - DNA, 23 bp, Homo sapiens
aaacctgatgtcagctgctgttg

SEQ ID NO: 590879 - DNA, 15 bp, Homo sapiens
aaacggttcctggtg

SEQ ID NO: 590880 - DNA, 17 bp, Homo sapiens
aaactatttattgtgct

SEQ ID NO: 590881 - DNA, 17 bp, Homo sapiens
aaactttgggaaaacat

SEQ ID NO: 590882 - DNA, 18 bp, Homo sapiens
aaagacacagaacacaga

SEQ ID NO: 590883 - DNA, 23 bp, Homo sapiens
aaagaccacctccaacccaaccc

SEQ ID NO: 590884 - DNA, 22 bp, Homo sapiens
aaagaccctcctattctataaa

SEQ ID NO: 590885 - DNA, 19 bp, Homo sapiens
aaagactggatttgcagaa

SEQ ID NO: 590886 - DNA, 20 bp, Homo sapiens
aaagagaatgagtccttgat

SEQ ID NO: 590887 - DNA, 14 bp, Homo sapiens
aaagagtttgaaac

SEQ ID NO: 590888 - DNA, 12 bp, Homo sapiens
aaagatgagttg

SEQ ID NO: 590889 - DNA, 20 bp, Homo sapiens
aaagcacaatttaaaacaat

SEQ ID NO: 590890 - DNA, 13 bp, Homo sapiens
aaagcctgctcaa

SEQ ID NO: 590891 - DNA, 15 bp, Homo sapiens
aaagctaaagtttgg

SEQ ID NO: 590892 - DNA, 14 bp, Homo sapiens
aaagctgatttttt

SEQ ID NO: 590893 - DNA, 20 bp, Homo sapiens
aaagctgcaaaaattatata

SEQ ID NO: 590894 - DNA, 14 bp, Homo sapiens
aaagctgttccttg

SEQ ID NO: 590895 - DNA, 13 bp, Homo sapiens
aaaggaggtgaaa

SEQ ID NO: 590896 - DNA, 18 bp, Homo sapiens
aaagtgtgtatatatttt

SEQ ID NO: 590897 - DNA, 19 bp, Homo sapiens
aaagtgtgtatatattttg

SEQ ID NO: 590898 - DNA, 20 bp, Homo sapiens
aaagtgtgtatatattttgt

SEQ ID NO: 590899 - DNA, 14 bp, Homo sapiens
aaagtttttgtttg

SEQ ID NO: 590900 - DNA, 15 bp, Homo sapiens
aaataaaaactaatt

SEQ ID NO: 590901 - DNA, 21 bp, Homo sapiens
aaataacatgtttctctataa

SEQ ID NO: 590902 - DNA, 12 bp, Homo sapiens
cactgcactcca

SEQ ID NO: 590903 - DNA, 15 bp, Homo sapiens
cactgccccctgctt

SEQ ID NO: 590904 - DNA, 16 bp, Homo sapiens
cactgccccctgcttg

SEQ ID NO: 590905 - DNA, 19 bp, Homo sapiens
cactgccttcgtttatatt

SEQ ID NO: 590906 - DNA, 20 bp, Homo sapiens
cactgccttcgtttatattt

SEQ ID NO: 590907 - DNA, 12 bp, Homo sapiens
cactgtttcctg

SEQ ID NO: 590908 - DNA, 14 bp, Homo sapiens
cactgtttcctgat

SEQ ID NO: 590909 - DNA, 21 bp, Homo sapiens
cacttaaacgaagagttccct

SEQ ID NO: 590910 - DNA, 11 bp, Homo sapiens
cacttcctcct

SEQ ID NO: 590911 - DNA, 12 bp, Homo sapiens
cacttcctccta

SEQ ID NO: 590912 - DNA, 15 bp, Homo sapiens
cacttcctcctacct

SEQ ID NO: 590913 - DNA, 18 bp, Homo sapiens
cacttcctcctacctggg

SEQ ID NO: 590914 - DNA, 14 bp, Homo sapiens
cacttgaaaccttt

SEQ ID NO: 590915 - DNA, 19 bp, Homo sapiens
cacttttccacattccagt

SEQ ID NO: 590916 - DNA, 13 bp, Homo sapiens
cagaaagcttcat

SEQ ID NO: 590917 - DNA, 22 bp, Homo sapiens
cagaaatgcccccattctccca

SEQ ID NO: 590918 - DNA, 15 bp, Homo sapiens
cagaaatggaaagca

SEQ ID NO: 590919 - DNA, 18 bp, Homo sapiens
cagaacacaaccttgttt

SEQ ID NO: 590920 - DNA, 18 bp, Homo sapiens
cagaagacttcccagctt

SEQ ID NO: 590921 - DNA, 14 bp, Homo sapiens
cagaaggtgaactt

SEQ ID NO: 590922 - DNA, 20 bp, Homo sapiens
cagaaggtgaactttgtgct

SEQ ID NO: 590923 - DNA, 18 bp, Homo sapiens
cagaatttttaactgtac

SEQ ID NO: 590924 - DNA, 15 bp, Homo sapiens
cagacgccttactgg

SEQ ID NO: 590925 - DNA, 19 bp, Homo sapiens
cagactgggcactggggcc

SEQ ID NO: 590926 - DNA, 19 bp, Homo sapiens
cagagaacctgtgggctga

SEQ ID NO: 590927 - DNA, 23 bp, Homo sapiens
cagagacaacaggtaaaacaggg

SEQ ID NO: 590928 - DNA, 23 bp, Homo sapiens
cagagagtggagagagcagggct

SEQ ID NO: 590929 - DNA, 21 bp, Homo sapiens
cagagatttctcattgacttt

SEQ ID NO: 590930 - DNA, 16 bp, Homo sapiens
cagagcaaacagaaaa

SEQ ID NO: 590931 - DNA, 13 bp, Homo sapiens
cagagcgcacagg

SEQ ID NO: 590932 - DNA, 15 bp, Homo sapiens
cagagctgctgcaca

SEQ ID NO: 590933 - DNA, 17 bp, Homo sapiens
cagagttttcattaaat

SEQ ID NO: 590934 - DNA, 22 bp, Homo sapiens
cagataccttatcttacaatat

SEQ ID NO: 590935 - DNA, 18 bp, Homo sapiens
cagatagtgtagctgagg

SEQ ID NO: 590936 - DNA, 13 bp, Homo sapiens
cagatgagggctg

SEQ ID NO: 590937 - DNA, 14 bp, Homo sapiens
cagatgagggctgg

SEQ ID NO: 590938 - DNA, 16 bp, Homo sapiens
cagattggccaattaa

SEQ ID NO: 590939 - DNA, 16 bp, Homo sapiens
cagcaaattccagatt

SEQ ID NO: 590940 - DNA, 16 bp, Homo sapiens
cagcagaaatgccccc

SEQ ID NO: 590941 - DNA, 18 bp, Homo sapiens
cagcagaaatgcccccat

SEQ ID NO: 590942 - DNA, 22 bp, Homo sapiens
cagcaggactgtgggaaagagc

SEQ ID NO: 590943 - DNA, 19 bp, Homo sapiens
cagcagtttccagagagtg

SEQ ID NO: 590944 - DNA, 21 bp, Homo sapiens
cagcagtttccagagagtgga

SEQ ID NO: 590945 - DNA, 13 bp, Homo sapiens
cagcatcagctca

SEQ ID NO: 590946 - DNA, 16 bp, Homo sapiens
cagcatctgctccatc

SEQ ID NO: 590947 - DNA, 13 bp, Homo sapiens
cagcattgtaatt

SEQ ID NO: 590948 - DNA, 17 bp, Homo sapiens
cagcattgtaattatgt

SEQ ID NO: 590949 - DNA, 16 bp, Homo sapiens
cagcattgtatatgtg

SEQ ID NO: 590950 - DNA, 14 bp, Homo sapiens
cagccaaatttaaa

SEQ ID NO: 590951 - DNA, 14 bp, Homo sapiens
cagccaggcaagaa

SEQ ID NO: 590952 - DNA, 19 bp, Homo sapiens
cagccaggcaagaaagctt

SEQ ID NO: 590953 - DNA, 15 bp, Homo sapiens
cagccagttcaaaaa

SEQ ID NO: 590954 - DNA, 19 bp, Homo sapiens
cagcctagcctatgtctgg

SEQ ID NO: 590955 - DNA, 21 bp, Homo sapiens
cagcctagcctatgtctggca

SEQ ID NO: 590956 - DNA, 20 bp, Homo sapiens
cagcctgctttcctgcagca

SEQ ID NO: 590957 - DNA, 20 bp, Homo sapiens
cagccttgcagcggctcctg

SEQ ID NO: 590958 - DNA, 21 bp, Homo sapiens
cagccttgcagcggctcctgc

SEQ ID NO: 590959 - DNA, 15 bp, Homo sapiens
cagccttttctggtc

SEQ ID NO: 590960 - DNA, 21 bp, Homo sapiens
cagccttttctggtccctctt

SEQ ID NO: 590961 - DNA, 22 bp, Homo sapiens
cagccttttctggtccctcttc

SEQ ID NO: 590962 - DNA, 15 bp, Homo sapiens
cagcggctcctgcaa

SEQ ID NO: 590963 - DNA, 18 bp, Homo sapiens
cagcggtgccaacctctt

SEQ ID NO: 590964 - DNA, 19 bp, Homo sapiens
cagctgagcatggagacag

SEQ ID NO: 590965 - DNA, 17 bp, Homo sapiens
cagctgctgttgaactt

SEQ ID NO: 590966 - DNA, 18 bp, Homo sapiens
cagctgtgagccatgcct

SEQ ID NO: 590967 - DNA, 20 bp, Homo sapiens
cagctgtgagccatgcctcc

SEQ ID NO: 590968 - DNA, 23 bp, Homo sapiens
cagctgtgagccatgcctccctg

SEQ ID NO: 590969 - DNA, 19 bp, Homo sapiens
cagcttctgccacataaaa

SEQ ID NO: 590970 - DNA, 22 bp, Homo sapiens
caggaacaaacagggctgcctt

SEQ ID NO: 590971 - DNA, 16 bp, Homo sapiens
caggaacgctctcctc

SEQ ID NO: 590972 - DNA, 23 bp, Homo sapiens
caggaagttgccatgggaaacaa

SEQ ID NO: 590973 - DNA, 21 bp, Homo sapiens
caggaattcttggagaaaatg

SEQ ID NO: 590974 - DNA, 12 bp, Homo sapiens
caggacagctcc

SEQ ID NO: 590975 - DNA, 15 bp, Homo sapiens
caggacatgcaataa

SEQ ID NO: 590976 - DNA, 21 bp, Homo sapiens
caggacatgcaataaaattta

SEQ ID NO: 590977 - DNA, 16 bp, Homo sapiens
caggacttgaaagaaa

SEQ ID NO: 590978 - DNA, 14 bp, Homo sapiens
caggagagactggt

SEQ ID NO: 590979 - DNA, 17 bp, Homo sapiens
caggatactggcacaga

SEQ ID NO: 590980 - DNA, 15 bp, Homo sapiens
caggcaagaaagctt

SEQ ID NO: 590981 - DNA, 21 bp, Homo sapiens
caggcaagaaagcttccttca

SEQ ID NO: 590982 - DNA, 20 bp, Homo sapiens
caggcaggaacaaacagggc

SEQ ID NO: 590983 - DNA, 22 bp, Homo sapiens
caggccagagcaaacagaaaaa

SEQ ID NO: 590984 - DNA, 22 bp, Homo sapiens
caggctccgggcaccaggggcc

SEQ ID NO: 590985 - DNA, 20 bp, Homo sapiens
cagggccctggagctcaggg

SEQ ID NO: 590986 - DNA, 15 bp, Homo sapiens
cagggcctttctcct

SEQ ID NO: 590987 - DNA, 20 bp, Homo sapiens
cagggcctttctcctcccca

SEQ ID NO: 590988 - DNA, 18 bp, Homo sapiens
cagggtccttgtttctgc

SEQ ID NO: 590989 - DNA, 17 bp, Homo sapiens
caggttataacagtgtt

SEQ ID NO: 590990 - DNA, 21 bp, Homo sapiens
caggtttgcaggagcccccct

SEQ ID NO: 590991 - DNA, 18 bp, Homo sapiens
cagtaacccccttaaatt

SEQ ID NO: 590992 - DNA, 21 bp, Homo sapiens
cagtaacccccttaaatttaa

SEQ ID NO: 590993 - DNA, 20 bp, Homo sapiens
cagtaagatatctcaatgaa

SEQ ID NO: 590994 - DNA, 19 bp, Homo sapiens
cagtatgtgggatattgaa

SEQ ID NO: 590995 - DNA, 13 bp, Homo sapiens
cagtatttccttc

SEQ ID NO: 590996 - DNA, 18 bp, Homo sapiens
cagtatttccttccactg

SEQ ID NO: 590997 - DNA, 21 bp, Homo sapiens
cagtctcagtccaaaagtgtt

SEQ ID NO: 590998 - DNA, 14 bp, Homo sapiens
cagtctctgtcgtg

SEQ ID NO: 590999 - DNA, 23 bp, Homo sapiens
cagtgagtgacaaagcctctgaa

SEQ ID NO: 591000 - DNA, 16 bp, Homo sapiens
cagtggtgtgtgaagt

SEQ ID NO: 591001 - DNA, 20 bp, Homo sapiens
cagtggtgtgtgaagtttgg

SEQ ID NO: 591002 - DNA, 13 bp, Homo sapiens
cagtgtgtaaata

SEQ ID NO: 591003 - DNA, 19 bp, Homo sapiens
cagtgttttggtggaaaaa

SEQ ID NO: 591004 - DNA, 21 bp, Homo sapiens
cagtgtttttagacctgtgtt

SEQ ID NO: 591005 - DNA, 15 bp, Homo sapiens
cagttcctgggaaca

SEQ ID NO: 591006 - DNA, 16 bp, Homo sapiens
cagttctcaaatgtgt

SEQ ID NO: 591007 - DNA, 22 bp, Homo sapiens
cagtttaatgtctcctttgctc

SEQ ID NO: 591008 - DNA, 16 bp, Homo sapiens
ccggacctacctccct

SEQ ID NO: 591009 - DNA, 18 bp, Homo sapiens
ccggacctacctccctcc

SEQ ID NO: 591010 - DNA, 15 bp, Homo sapiens
ccgggggaggggcgc

SEQ ID NO: 591011 - DNA, 20 bp, Homo sapiens
ccttgttgcactgccccctg

SEQ ID NO: 591012 - DNA, 21 bp, Homo sapiens
cctttatttttggcgtggctg

SEQ ID NO: 591013 - DNA, 21 bp, Homo sapiens
cctttcacagagcagagtctg

SEQ ID NO: 591014 - DNA, 14 bp, Homo sapiens
cctttcctggcagt

SEQ ID NO: 591015 - DNA, 17 bp, Homo sapiens
cctttctccctgcagcc

SEQ ID NO: 591016 - DNA, 17 bp, Homo sapiens
cctttctcctccccacc

SEQ ID NO: 591017 - DNA, 13 bp, Homo sapiens
actcttctctcct

SEQ ID NO: 591018 - DNA, 21 bp, Homo sapiens
actcttctctcctttctccct

SEQ ID NO: 591019 - DNA, 22 bp, Homo sapiens
actcttctctcctttctccctg

SEQ ID NO: 591020 - DNA, 21 bp, Homo sapiens
actgagcaagaccctgtctct

SEQ ID NO: 591021 - DNA, 13 bp, Homo sapiens
actgagccagatt

SEQ ID NO: 591022 - DNA, 22 bp, Homo sapiens
actgagccagattggccaatta

SEQ ID NO: 591023 - DNA, 12 bp, Homo sapiens
actgatttcaga

SEQ ID NO: 591024 - DNA, 15 bp, Homo sapiens
actgccaaaacattt

SEQ ID NO: 591025 - DNA, 13 bp, Homo sapiens
actgccctccgaa

SEQ ID NO: 591026 - DNA, 18 bp, Homo sapiens
actggatttgcagaagtt

SEQ ID NO: 591027 - DNA, 18 bp, Homo sapiens
actggcttacctcctcat

SEQ ID NO: 591028 - DNA, 23 bp, Homo sapiens
actgggctgcccacctggctgcc

SEQ ID NO: 591029 - DNA, 15 bp, Homo sapiens
actgtaacattcagg

SEQ ID NO: 591030 - DNA, 15 bp, Homo sapiens
actgtagatatgtat

SEQ ID NO: 591031 - DNA, 21 bp, Homo sapiens
actgtagctattagcggctcc

SEQ ID NO: 591032 - DNA, 14 bp, Homo sapiens
actgtatcattttc

SEQ ID NO: 591033 - DNA, 23 bp, Homo sapiens
actgtatgggggagattgaactt

SEQ ID NO: 591034 - DNA, 17 bp, Homo sapiens
actgtctattaatattc

SEQ ID NO: 591035 - DNA, 13 bp, Homo sapiens
actgtgggaaaga

SEQ ID NO: 591036 - DNA, 14 bp, Homo sapiens
actgttgtaagaat

SEQ ID NO: 591037 - DNA, 15 bp, Homo sapiens
actgttgtaagaatt

SEQ ID NO: 591038 - DNA, 21 bp, Homo sapiens
actgttgtaagaattctgatt

SEQ ID NO: 591039 - DNA, 15 bp, Homo sapiens
acttacatcatgtgt

SEQ ID NO: 591040 - DNA, 23 bp, Homo sapiens
acttacatgttcccaaaacaatg

SEQ ID NO: 591041 - DNA, 18 bp, Homo sapiens
acttatccatctttgaac

SEQ ID NO: 591042 - DNA, 15 bp, Homo sapiens
acttccctcttgaaa

SEQ ID NO: 591043 - DNA, 13 bp, Homo sapiens
acttcctcctacc

SEQ ID NO: 591044 - DNA, 16 bp, Homo sapiens
acttcctcctacctgg

SEQ ID NO: 591045 - DNA, 18 bp, Homo sapiens
acttctgcaacaagcatg

SEQ ID NO: 591046 - DNA, 17 bp, Homo sapiens
acttctggggccacctc

SEQ ID NO: 591047 - DNA, 21 bp, Homo sapiens
acttctggggccacctctgga

SEQ ID NO: 591048 - DNA, 15 bp, Homo sapiens
acttctgtaattgtg

SEQ ID NO: 591049 - DNA, 12 bp, Homo sapiens
acttgaaagaaa

SEQ ID NO: 591050 - DNA, 13 bp, Homo sapiens
acttgcctggggc

SEQ ID NO: 591051 - DNA, 16 bp, Homo sapiens
acttggagaatactgc

SEQ ID NO: 591052 - DNA, 19 bp, Homo sapiens
acttggagaatactgccaa

SEQ ID NO: 591053 - DNA, 17 bp, Homo sapiens
acttggtggcttttcct

SEQ ID NO: 591054 - DNA, 19 bp, Homo sapiens
acttggtggcttttccttg

SEQ ID NO: 591055 - DNA, 18 bp, Homo sapiens
acttgttttggatggctt

SEQ ID NO: 591056 - DNA, 15 bp, Homo sapiens
actttagaagcctgc

SEQ ID NO: 591057 - DNA, 13 bp, Homo sapiens
actttattgcaat

SEQ ID NO: 591058 - DNA, 17 bp, Homo sapiens
actttattgcaatgcag

SEQ ID NO: 591059 - DNA, 19 bp, Homo sapiens
actttcaagaatcagacag

SEQ ID NO: 591060 - DNA, 20 bp, Homo sapiens
actttctatttttatgatga

SEQ ID NO: 591061 - DNA, 14 bp, Homo sapiens
actttctgttatgg

SEQ ID NO: 591062 - DNA, 14 bp, Homo sapiens
actttgtattttga

SEQ ID NO: 591063 - DNA, 22 bp, Homo sapiens
actttgtcagtgttgcctcttg

SEQ ID NO: 591064 - DNA, 16 bp, Homo sapiens
acttttataaagcatg

SEQ ID NO: 591065 - DNA, 17 bp, Homo sapiens
acttttataaagcatgt

SEQ ID NO: 591066 - DNA, 21 bp, Homo sapiens
actttttcatagtaagtgcga

SEQ ID NO: 591067 - DNA, 22 bp, Homo sapiens
agaaaattgagttgcacttatt

SEQ ID NO: 591068 - DNA, 13 bp, Homo sapiens
agaaacaaagatg

SEQ ID NO: 591069 - DNA, 17 bp, Homo sapiens
agaaacaaagatgttat

SEQ ID NO: 591070 - DNA, 13 bp, Homo sapiens
agaaacacattct

SEQ ID NO: 591071 - DNA, 18 bp, Homo sapiens
agaaacactatttgtgac

SEQ ID NO: 591072 - DNA, 13 bp, Homo sapiens
agaaagcttcctt

SEQ ID NO: 591073 - DNA, 14 bp, Homo sapiens
agaaagcttccttc

SEQ ID NO: 591074 - DNA, 22 bp, Homo sapiens
agaaataatgctacaattttaa

SEQ ID NO: 591075 - DNA, 16 bp, Homo sapiens
agaaatagaattataa

SEQ ID NO: 591076 - DNA, 16 bp, Homo sapiens
agaaatggaaagcaga

SEQ ID NO: 591077 - DNA, 20 bp, Homo sapiens
agaaattacctgtggatatt

SEQ ID NO: 591078 - DNA, 19 bp, Homo sapiens
agaaccacacttgaaacct

SEQ ID NO: 591079 - DNA, 15 bp, Homo sapiens
agaacctgtgggctg

SEQ ID NO: 591080 - DNA, 21 bp, Homo sapiens
agaactagccaaaccaggacc

SEQ ID NO: 591081 - DNA, 16 bp, Homo sapiens
agaactctctggaagc

SEQ ID NO: 591082 - DNA, 16 bp, Homo sapiens
agaagaagttcatgtc

SEQ ID NO: 591083 - DNA, 20 bp, Homo sapiens
agaagagggaaaacagaaaa

SEQ ID NO: 591084 - DNA, 19 bp, Homo sapiens
agaagcctgacaactcatt

SEQ ID NO: 591085 - DNA, 11 bp, Homo sapiens
agaagcctgca

SEQ ID NO: 591086 - DNA, 19 bp, Homo sapiens
agaaggatgggtcccctcc

SEQ ID NO: 591087 - DNA, 17 bp, Homo sapiens
agaagttcatgtccaaa

SEQ ID NO: 591088 - DNA, 18 bp, Homo sapiens
agaataccacatcaaata

SEQ ID NO: 591089 - DNA, 13 bp, Homo sapiens
agaatactgccaa

SEQ ID NO: 591090 - DNA, 22 bp, Homo sapiens
agaatactgccaaaacatttat

SEQ ID NO: 591091 - DNA, 15 bp, Homo sapiens
agaatcacagctcaa

SEQ ID NO: 591092 - DNA, 16 bp, Homo sapiens
agaatcagacagcagg

SEQ ID NO: 591093 - DNA, 21 bp, Homo sapiens
agaatgagtccttgatttcaa

SEQ ID NO: 591094 - DNA, 19 bp, Homo sapiens
agtataagactactgaatc

SEQ ID NO: 591095 - DNA, 22 bp, Homo sapiens
agtatgtgctatacacacacac

SEQ ID NO: 591096 - DNA, 12 bp, Homo sapiens
agtattgtttaa

SEQ ID NO: 591097 - DNA, 12 bp, Homo sapiens
agtatttccttc

SEQ ID NO: 591098 - DNA, 22 bp, Homo sapiens
agtatttccttccactgtagct

SEQ ID NO: 591099 - DNA, 11 bp, Homo sapiens
agtcccagcta

SEQ ID NO: 591100 - DNA, 19 bp, Homo sapiens
agtcccttcctattctcct

SEQ ID NO: 591101 - DNA, 20 bp, Homo sapiens
agtcccttcctattctcctg

SEQ ID NO: 591102 - DNA, 24 bp, Homo sapiens
agtcctaaaagttctcaatgtaga

SEQ ID NO: 591103 - DNA, 23 bp, Homo sapiens
agtccttgatttcaaagttttgt

SEQ ID NO: 591104 - DNA, 20 bp, Homo sapiens
agtctccagaagaaaatttg

SEQ ID NO: 591105 - DNA, 23 bp, Homo sapiens
agtgaagggaagagacagcccag

SEQ ID NO: 591106 - DNA, 16 bp, Homo sapiens
agtgacatttaatgcc

SEQ ID NO: 591107 - DNA, 16 bp, Homo sapiens
agtgaccagtgcctgt

SEQ ID NO: 591108 - DNA, 21 bp, Homo sapiens
agtgatgtccttaaaatgtgg

SEQ ID NO: 591109 - DNA, 21 bp, Homo sapiens
agtgcatgaaaaaccattttt

SEQ ID NO: 591110 - DNA, 19 bp, Homo sapiens
agtgcctgtgagcatgggg

SEQ ID NO: 591111 - DNA, 14 bp, Homo sapiens
agtggagagagcag

SEQ ID NO: 591112 - DNA, 17 bp, Homo sapiens
agtggtatggggctgag

SEQ ID NO: 591113 - DNA, 22 bp, Homo sapiens
agtggtgatttgaaaaatataa

SEQ ID NO: 591114 - DNA, 19 bp, Homo sapiens
agtgtagcatcttcctctg

SEQ ID NO: 591115 - DNA, 22 bp, Homo sapiens
agtgtctgtgttttgaaagaat

SEQ ID NO: 591116 - DNA, 21 bp, Homo sapiens
agtgttgcctcttgcaatgcc

SEQ ID NO: 591117 - DNA, 11 bp, Homo sapiens
agtgttgtcca

SEQ ID NO: 591118 - DNA, 12 bp, Homo sapiens
agttataagaag

SEQ ID NO: 591119 - DNA, 15 bp, Homo sapiens
agttctcaaatgtgt

SEQ ID NO: 591120 - DNA, 16 bp, Homo sapiens
agttctggatgtctgg

SEQ ID NO: 591121 - DNA, 20 bp, Homo sapiens
agttctggatgtctggctca

SEQ ID NO: 591122 - DNA, 14 bp, Homo sapiens
agttgtgcttgagc

SEQ ID NO: 591123 - DNA, 14 bp, Homo sapiens
agttgtgtttcaac

SEQ ID NO: 591124 - DNA, 14 bp, Homo sapiens
agtttaatgtctcc

SEQ ID NO: 591125 - DNA, 20 bp, Homo sapiens
agtttagtgtgataaaggca

SEQ ID NO: 591126 - DNA, 23 bp, Homo sapiens
agtttcagcggtgccaacctctt

SEQ ID NO: 591127 - DNA, 19 bp, Homo sapiens
agtttcagtttgttggaaa

SEQ ID NO: 591128 - DNA, 19 bp, Homo sapiens
agtttgacagtttttgaca

SEQ ID NO: 591129 - DNA, 16 bp, Homo sapiens
agtttggttttgacag

SEQ ID NO: 591130 - DNA, 14 bp, Homo sapiens
agtttgtcattata

SEQ ID NO: 591131 - DNA, 13 bp, Homo sapiens
agtttgttggaaa

SEQ ID NO: 591132 - DNA, 13 bp, Homo sapiens
agttttaactgtg

SEQ ID NO: 591133 - DNA, 23 bp, Homo sapiens
agttttactgtctattaatattc

SEQ ID NO: 591134 - DNA, 17 bp, Homo sapiens
agttttcggaaacactg

SEQ ID NO: 591135 - DNA, 13 bp, Homo sapiens
agttttgttgtac

SEQ ID NO: 591136 - DNA, 12 bp, Homo sapiens
agtttttgtttg

SEQ ID NO: 591137 - DNA, 16 bp, Homo sapiens
agtttttgtttggaga

SEQ ID NO: 591138 - DNA, 19 bp, Homo sapiens
ataaaactatttattgtgc

SEQ ID NO: 591139 - DNA, 14 bp, Homo sapiens
ataaaagacacaga

SEQ ID NO: 591140 - DNA, 15 bp, Homo sapiens
ataaaatgatgttat

SEQ ID NO: 591141 - DNA, 18 bp, Homo sapiens
ataaaatgatgttataca

SEQ ID NO: 591142 - DNA, 12 bp, Homo sapiens
ataaagatgagt

SEQ ID NO: 591143 - DNA, 20 bp, Homo sapiens
ataaatgtataaatatacag

SEQ ID NO: 591144 - DNA, 15 bp, Homo sapiens
ataaattcaactttg

SEQ ID NO: 591145 - DNA, 20 bp, Homo sapiens
ataaattcaactttgtaaaa

SEQ ID NO: 591146 - DNA, 19 bp, Homo sapiens
ataactcacacccctgccc

SEQ ID NO: 591147 - DNA, 21 bp, Homo sapiens
ataagaaataatgctacaatt

SEQ ID NO: 591148 - DNA, 14 bp, Homo sapiens
ataaggtggcttct

SEQ ID NO: 591149 - DNA, 22 bp, Homo sapiens
ataatattgtttggtaaatgtt

SEQ ID NO: 591150 - DNA, 18 bp, Homo sapiens
ataatgggattagaaaca

SEQ ID NO: 591151 - DNA, 23 bp, Homo sapiens
ataatgggattagaaacaaacaa

SEQ ID NO: 591152 - DNA, 13 bp, Homo sapiens
ataattgtacaaa

SEQ ID NO: 591153 - DNA, 13 bp, Homo sapiens
ataatttgaactt

SEQ ID NO: 591154 - DNA, 19 bp, Homo sapiens
ataatttgaactttggaac

SEQ ID NO: 591155 - DNA, 11 bp, Homo sapiens
atacaaaatgt

SEQ ID NO: 591156 - DNA, 14 bp, Homo sapiens
atacacacacacac

SEQ ID NO: 591157 - DNA, 12 bp, Homo sapiens
atacagagccac

SEQ ID NO: 591158 - DNA, 13 bp, Homo sapiens
atacagagccacg

SEQ ID NO: 591159 - DNA, 21 bp, Homo sapiens
atacagagccacgagtttgga

SEQ ID NO: 591160 - DNA, 15 bp, Homo sapiens
atacatcaatatgta

SEQ ID NO: 591161 - DNA, 16 bp, Homo sapiens
atacatcaatatgtat

SEQ ID NO: 591162 - DNA, 19 bp, Homo sapiens
atacatgtgatacattttt

SEQ ID NO: 591163 - DNA, 20 bp, Homo sapiens
atacattttttaagcttcag

SEQ ID NO: 591164 - DNA, 15 bp, Homo sapiens
ataccacatcaaata

SEQ ID NO: 591165 - DNA, 14 bp, Homo sapiens
atacctgtcaatac

SEQ ID NO: 591166 - DNA, 18 bp, Homo sapiens
atactactactgttatca

SEQ ID NO: 591167 - DNA, 13 bp, Homo sapiens
atactctgctatt

SEQ ID NO: 591168 - DNA, 15 bp, Homo sapiens
atactggcacagagg

SEQ ID NO: 591169 - DNA, 13 bp, Homo sapiens
atagacatgaaag

SEQ ID NO: 591170 - DNA, 22 bp, Homo sapiens
atagacttggagaatactgcca

SEQ ID NO: 591171 - DNA, 16 bp, Homo sapiens
atagataatattgttt

SEQ ID NO: 591172 - DNA, 12 bp, Homo sapiens
atagccaaaaat

SEQ ID NO: 591173 - DNA, 15 bp, Homo sapiens
atagctttagtgaat

SEQ ID NO: 591174 - DNA, 18 bp, Homo sapiens
ataggaacaatctttgct

SEQ ID NO: 591175 - DNA, 18 bp, Homo sapiens
ataggaatcattcagaaa

SEQ ID NO: 591176 - DNA, 21 bp, Homo sapiens
ataggaatcattcagaaatgt

SEQ ID NO: 591177 - DNA, 23 bp, Homo sapiens
atagggtctaccaatacaaaatg

SEQ ID NO: 591178 - DNA, 18 bp, Homo sapiens
atataaagacctataaat

SEQ ID NO: 591179 - DNA, 12 bp, Homo sapiens
atataacacatt

SEQ ID NO: 591180 - DNA, 14 bp, Homo sapiens
atataacacatttt

SEQ ID NO: 591181 - DNA, 19 bp, Homo sapiens
atataatgatcagcaaaaa

SEQ ID NO: 591182 - DNA, 21 bp, Homo sapiens
atataatgatcagcaaaaaga

SEQ ID NO: 591183 - DNA, 16 bp, Homo sapiens
atatagacttggagaa

SEQ ID NO: 591184 - DNA, 15 bp, Homo sapiens
atatataaatgtata

SEQ ID NO: 591185 - DNA, 16 bp, Homo sapiens
atatatataaatgtat

SEQ ID NO: 591186 - DNA, 11 bp, Homo sapiens
atatatatata

SEQ ID NO: 591187 - DNA, 15 bp, Homo sapiens
atatattttcagtac

SEQ ID NO: 591188 - DNA, 16 bp, Homo sapiens
atatattttcagtaca

SEQ ID NO: 591189 - DNA, 22 bp, Homo sapiens
atatattttgtgtgaaattgca

SEQ ID NO: 591190 - DNA, 16 bp, Homo sapiens
atatattttgtttaca

SEQ ID NO: 591191 - DNA, 14 bp, Homo sapiens
atatgctttattaa

SEQ ID NO: 591192 - DNA, 19 bp, Homo sapiens
atatgctttattaatgttt

SEQ ID NO: 591193 - DNA, 20 bp, Homo sapiens
atatgctttattaatgtttt

SEQ ID NO: 591194 - DNA, 20 bp, Homo sapiens
atatgtattcttttctcagt

SEQ ID NO: 591195 - DNA, 14 bp, Homo sapiens
atattaaataacat

SEQ ID NO: 591196 - DNA, 16 bp, Homo sapiens
atattaaataacatgt

SEQ ID NO: 591197 - DNA, 19 bp, Homo sapiens
atattaaataacatgtttc

SEQ ID NO: 591198 - DNA, 21 bp, Homo sapiens
atattaaataacatgtttctc

SEQ ID NO: 591199 - DNA, 15 bp, Homo sapiens
atattactgacattt

SEQ ID NO: 591200 - DNA, 20 bp, Homo sapiens
atattcagggtaaataggaa

SEQ ID NO: 591201 - DNA, 15 bp, Homo sapiens
atattccagatcttt

SEQ ID NO: 591202 - DNA, 17 bp, Homo sapiens
atattccagatctttca

SEQ ID NO: 591203 - DNA, 13 bp, Homo sapiens
atattgaatgtta

SEQ ID NO: 591204 - DNA, 12 bp, Homo sapiens
atattgtaatct

SEQ ID NO: 591205 - DNA, 18 bp, Homo sapiens
atattgtaatctatgttt

SEQ ID NO: 591206 - DNA, 15 bp, Homo sapiens
atattttgaaatgaa

SEQ ID NO: 591207 - DNA, 22 bp, Homo sapiens
atattttgtgtgaaattgcata

SEQ ID NO: 591208 - DNA, 21 bp, Homo sapiens
atatttttttaactgtgataa

SEQ ID NO: 591209 - DNA, 14 bp, Homo sapiens
atcaaataagaaat

SEQ ID NO: 591210 - DNA, 24 bp, Homo sapiens
atcacaaagtggaacgaaaatgaa

SEQ ID NO: 591211 - DNA, 22 bp, Homo sapiens
atcacagctcaagcattctgtt

SEQ ID NO: 591212 - DNA, 20 bp, Homo sapiens
atcactgccttcgtttatat

SEQ ID NO: 591213 - DNA, 14 bp, Homo sapiens
atcagcaaaaagac

SEQ ID NO: 591214 - DNA, 15 bp, Homo sapiens
atcagcaaaaagact

SEQ ID NO: 591215 - DNA, 23 bp, Homo sapiens
atcagtaacccccttaaatttaa

SEQ ID NO: 591216 - DNA, 19 bp, Homo sapiens
atcagtaatgctaaatgtg

SEQ ID NO: 591217 - DNA, 14 bp, Homo sapiens
atcagtatttcctt

SEQ ID NO: 591218 - DNA, 15 bp, Homo sapiens
atcagtatttccttc

SEQ ID NO: 591219 - DNA, 21 bp, Homo sapiens
atcagtatttccttccactgt

SEQ ID NO: 591220 - DNA, 14 bp, Homo sapiens
atcagtgtgtaaat

SEQ ID NO: 591221 - DNA, 13 bp, Homo sapiens
atcatctcttcct

SEQ ID NO: 591222 - DNA, 15 bp, Homo sapiens
atcattaagacaact

SEQ ID NO: 591223 - DNA, 13 bp, Homo sapiens
atcattcagaaat

SEQ ID NO: 591224 - DNA, 17 bp, Homo sapiens
atccacagccttgcagc

SEQ ID NO: 591225 - DNA, 15 bp, Homo sapiens
atccaggcaccagga

SEQ ID NO: 591226 - DNA, 16 bp, Homo sapiens
atccatccatgtactt

SEQ ID NO: 591227 - DNA, 20 bp, Homo sapiens
atccatcgtattaaaaaaca

SEQ ID NO: 591228 - DNA, 16 bp, Homo sapiens
atcccatctctcccac

SEQ ID NO: 591229 - DNA, 20 bp, Homo sapiens
atcccatctctcccacttcc

SEQ ID NO: 591230 - DNA, 16 bp, Homo sapiens
atccccgtctctgccc

SEQ ID NO: 591231 - DNA, 23 bp, Homo sapiens
atccccgtctctgccctgggctc

SEQ ID NO: 591232 - DNA, 13 bp, Homo sapiens
atcccgtcttcca

SEQ ID NO: 591233 - DNA, 24 bp, Homo sapiens
atccctctccactcttctctcctt

SEQ ID NO: 591234 - DNA, 22 bp, Homo sapiens
atccctgaggactgatttcaga

SEQ ID NO: 591235 - DNA, 15 bp, Homo sapiens
atccctgcctcaggc

SEQ ID NO: 591236 - DNA, 20 bp, Homo sapiens
atccctgcctcaggccaagg

SEQ ID NO: 591237 - DNA, 13 bp, Homo sapiens
atccggaaagaag

SEQ ID NO: 591238 - DNA, 23 bp, Homo sapiens
atcctcagttctcaaatgtgtgt

SEQ ID NO: 591239 - DNA, 20 bp, Homo sapiens
atcctccttctcctgttcca

SEQ ID NO: 591240 - DNA, 18 bp, Homo sapiens
atcctgatggacctgccc

SEQ ID NO: 591241 - DNA, 12 bp, Homo sapiens
atcctgcctgcc

SEQ ID NO: 591242 - DNA, 16 bp, Homo sapiens
atccttgagattctga

SEQ ID NO: 591243 - DNA, 17 bp, Homo sapiens
atcggcagatgatgctt

SEQ ID NO: 591244 - DNA, 14 bp, Homo sapiens
atcgtttttgtatt

SEQ ID NO: 591245 - DNA, 14 bp, Homo sapiens
atctatgaacctga

SEQ ID NO: 591246 - DNA, 15 bp, Homo sapiens
atctatgaacctgaa

SEQ ID NO: 591247 - DNA, 15 bp, Homo sapiens
atctatgtttataat

SEQ ID NO: 591248 - DNA, 21 bp, Homo sapiens
atctatgtttataatactact

SEQ ID NO: 591249 - DNA, 23 bp, Homo sapiens
atctcaatgaaccataaattcaa

SEQ ID NO: 591250 - DNA, 20 bp, Homo sapiens
atctccatggggaggcctca

SEQ ID NO: 591251 - DNA, 21 bp, Homo sapiens
atctctcccacttcctcctac

SEQ ID NO: 591252 - DNA, 22 bp, Homo sapiens
atctctcccacttcctcctacc

SEQ ID NO: 591253 - DNA, 18 bp, Homo sapiens
atctgctaccaaaacagt

SEQ ID NO: 591254 - DNA, 15 bp, Homo sapiens
atctgggtgactgag

SEQ ID NO: 591255 - DNA, 12 bp, Homo sapiens
atctgtgcagga

SEQ ID NO: 591256 - DNA, 19 bp, Homo sapiens
atcttaaaccttaagatac

SEQ ID NO: 591257 - DNA, 14 bp, Homo sapiens
atcttcctctgcag

SEQ ID NO: 591258 - DNA, 21 bp, Homo sapiens
atcttctttggacttctgaag

SEQ ID NO: 591259 - DNA, 22 bp, Homo sapiens
atctttcagaaatataacacat

SEQ ID NO: 591260 - DNA, 15 bp, Homo sapiens
atcttttgttctcct

SEQ ID NO: 591261 - DNA, 15 bp, Homo sapiens
atcttttttagtgtt

SEQ ID NO: 591262 - DNA, 13 bp, Homo sapiens
atgaaaaaccatt

SEQ ID NO: 591263 - DNA, 24 bp, Homo sapiens
atgaaaataccatttagtaagaat

SEQ ID NO: 591264 - DNA, 13 bp, Homo sapiens
atgaaacttctca

SEQ ID NO: 591265 - DNA, 13 bp, Homo sapiens
atgaactttgtca

SEQ ID NO: 591266 - DNA, 20 bp, Homo sapiens
atgaactttgtcagtgttgc

SEQ ID NO: 591267 - DNA, 15 bp, Homo sapiens
atgaatgaatgggat

SEQ ID NO: 591268 - DNA, 19 bp, Homo sapiens
atgacaagctgtatcactg

SEQ ID NO: 591269 - DNA, 19 bp, Homo sapiens
atgacaagtgagacaaaaa

SEQ ID NO: 591270 - DNA, 15 bp, Homo sapiens
atgacactgtttcct

SEQ ID NO: 591271 - DNA, 20 bp, Homo sapiens
atgactgcatttgtgtgtgt

SEQ ID NO: 591272 - DNA, 16 bp, Homo sapiens
atgagactgaactgtg

SEQ ID NO: 591273 - DNA, 13 bp, Homo sapiens
atgagtagccagg

SEQ ID NO: 591274 - DNA, 21 bp, Homo sapiens
atgagtccttgatttcaaagt

SEQ ID NO: 591275 - DNA, 19 bp, Homo sapiens
atgatccccgtctctgccc

SEQ ID NO: 591276 - DNA, 16 bp, Homo sapiens
atgatgctttggaaga

SEQ ID NO: 591277 - DNA, 14 bp, Homo sapiens
atgatggttcacgt

SEQ ID NO: 591278 - DNA, 22 bp, Homo sapiens
atgatgttatacatcaatatgt

SEQ ID NO: 591279 - DNA, 23 bp, Homo sapiens
atgattagaaattacctgtggat

SEQ ID NO: 591280 - DNA, 19 bp, Homo sapiens
atgcaaatgagctctgaaa

SEQ ID NO: 591281 - DNA, 18 bp, Homo sapiens
atgcaagccccaactttc

SEQ ID NO: 591282 - DNA, 23 bp, Homo sapiens
atgcaataaaatttaaaaaataa

SEQ ID NO: 591283 - DNA, 15 bp, Homo sapiens
atgcaattcagtgtt

SEQ ID NO: 591284 - DNA, 11 bp, Homo sapiens
atgcagagctt

SEQ ID NO: 591285 - DNA, 15 bp, Homo sapiens
atgcagagcttgtgg

SEQ ID NO: 591286 - DNA, 19 bp, Homo sapiens
atgcagttagctgaagaat

SEQ ID NO: 591287 - DNA, 19 bp, Homo sapiens
atgcatcatctcttcctca

SEQ ID NO: 591288 - DNA, 13 bp, Homo sapiens
atgcatttaataa

SEQ ID NO: 591289 - DNA, 18 bp, Homo sapiens
atgccacatcaaaccttt

SEQ ID NO: 591290 - DNA, 17 bp, Homo sapiens
atgcccaagccctgaga

SEQ ID NO: 591291 - DNA, 21 bp, Homo sapiens
atgcctatggtggatccaaac

SEQ ID NO: 591292 - DNA, 13 bp, Homo sapiens
atgctaaatgtgt

SEQ ID NO: 591293 - DNA, 18 bp, Homo sapiens
atgctacttcccactgta

SEQ ID NO: 591294 - DNA, 19 bp, Homo sapiens
atgctacttcccactgtat

SEQ ID NO: 591295 - DNA, 13 bp, Homo sapiens
atgctgatggagc

SEQ ID NO: 591296 - DNA, 19 bp, Homo sapiens
atgctttattaatgttttc

SEQ ID NO: 591297 - DNA, 11 bp, Homo sapiens
atggagacagc

SEQ ID NO: 591298 - DNA, 12 bp, Homo sapiens
atggattcagca

SEQ ID NO: 591299 - DNA, 22 bp, Homo sapiens
atggatttggcactagccaaag

SEQ ID NO: 591300 - DNA, 15 bp, Homo sapiens
atggatttttcttta

SEQ ID NO: 591301 - DNA, 16 bp, Homo sapiens
atggcaggacagctcc

SEQ ID NO: 591302 - DNA, 15 bp, Homo sapiens
atggctgctgttgct

SEQ ID NO: 591303 - DNA, 20 bp, Homo sapiens
atggcttgtctatactcctt

SEQ ID NO: 591304 - DNA, 21 bp, Homo sapiens
atgggactggagtccctgtga

SEQ ID NO: 591305 - DNA, 16 bp, Homo sapiens
atgggctgtgattact

SEQ ID NO: 591306 - DNA, 18 bp, Homo sapiens
atgggctgtgattactgc

SEQ ID NO: 591307 - DNA, 16 bp, Homo sapiens
atggggtcggctcctg

SEQ ID NO: 591308 - DNA, 19 bp, Homo sapiens
atggggtcggctcctgatg

SEQ ID NO: 591309 - DNA, 23 bp, Homo sapiens
atggtcctatttttgtgaagagg

SEQ ID NO: 591310 - DNA, 22 bp, Homo sapiens
atggtgtcattctgcctgctcc

SEQ ID NO: 591311 - DNA, 18 bp, Homo sapiens
atggtgtggtgaatgtgt

SEQ ID NO: 591312 - DNA, 18 bp, Homo sapiens
atgtacagattctttcag

SEQ ID NO: 591313 - DNA, 16 bp, Homo sapiens
atgtaggtaagactgt

SEQ ID NO: 591314 - DNA, 18 bp, Homo sapiens
atgtaggtaagactgtag

SEQ ID NO: 591315 - DNA, 14 bp, Homo sapiens
atgtataaatatac

SEQ ID NO: 591316 - DNA, 16 bp, Homo sapiens
atgtcagctgctgttg

SEQ ID NO: 591317 - DNA, 20 bp, Homo sapiens
atgtgagtgacgatgatgta

SEQ ID NO: 591318 - DNA, 15 bp, Homo sapiens
atgtgctatacacac

SEQ ID NO: 591319 - DNA, 17 bp, Homo sapiens
atgtgggatattgaatg

SEQ ID NO: 591320 - DNA, 14 bp, Homo sapiens
atgttaagttatat

SEQ ID NO: 591321 - DNA, 14 bp, Homo sapiens
atgttacccattca

SEQ ID NO: 591322 - DNA, 21 bp, Homo sapiens
atgttatacatcaatatgtat

SEQ ID NO: 591323 - DNA, 23 bp, Homo sapiens
atgttatacatcaatatgtatat

SEQ ID NO: 591324 - DNA, 21 bp, Homo sapiens
atgttatactgaaccaggcca

SEQ ID NO: 591325 - DNA, 16 bp, Homo sapiens
atgttcccaaaacaat

SEQ ID NO: 591326 - DNA, 20 bp, Homo sapiens
atgttctattttttgttttg

SEQ ID NO: 591327 - DNA, 12 bp, Homo sapiens
atgttgtaaata

SEQ ID NO: 591328 - DNA, 15 bp, Homo sapiens
atgtttaaagagaag

SEQ ID NO: 591329 - DNA, 16 bp, Homo sapiens
atgtttcttttaaaga

SEQ ID NO: 591330 - DNA, 12 bp, Homo sapiens
attaaaaaacaa

SEQ ID NO: 591331 - DNA, 16 bp, Homo sapiens
attaaaactaaatttc

SEQ ID NO: 591332 - DNA, 14 bp, Homo sapiens
attaaataacatgt

SEQ ID NO: 591333 - DNA, 22 bp, Homo sapiens
attaactgccctctgaaataat

SEQ ID NO: 591334 - DNA, 17 bp, Homo sapiens
attaatgttttcaaaag

SEQ ID NO: 591335 - DNA, 16 bp, Homo sapiens
attacctgtggatatt

SEQ ID NO: 591336 - DNA, 16 bp, Homo sapiens
attactgcaatcactg

SEQ ID NO: 591337 - DNA, 17 bp, Homo sapiens
attactgcaatcactgt

SEQ ID NO: 591338 - DNA, 23 bp, Homo sapiens
attactttggggctaatttaaca

SEQ ID NO: 591339 - DNA, 19 bp, Homo sapiens
attagaaacaaacaaaact

SEQ ID NO: 591340 - DNA, 18 bp, Homo sapiens
attagacttgaaatacgt

SEQ ID NO: 591341 - DNA, 23 bp, Homo sapiens
attagtgatgtccttaaaatgtg

SEQ ID NO: 591342 - DNA, 18 bp, Homo sapiens
attatatattgcaaggtg

SEQ ID NO: 591343 - DNA, 15 bp, Homo sapiens
attatgtaaataact

SEQ ID NO: 591344 - DNA, 19 bp, Homo sapiens
attatttttataattgtac

SEQ ID NO: 591345 - DNA, 19 bp, Homo sapiens
attatttttttaaaatttt

SEQ ID NO: 591346 - DNA, 13 bp, Homo sapiens
attcaactttgta

SEQ ID NO: 591347 - DNA, 18 bp, Homo sapiens
attcaactttgtaaaaat

SEQ ID NO: 591348 - DNA, 19 bp, Homo sapiens
attcagcatgtccaacatg

SEQ ID NO: 591349 - DNA, 19 bp, Homo sapiens
attcaggacttgaaagaaa

SEQ ID NO: 591350 - DNA, 18 bp, Homo sapiens
attcagggtaaataggaa

SEQ ID NO: 591351 - DNA, 20 bp, Homo sapiens
attccagatctttcagaaat

SEQ ID NO: 591352 - DNA, 14 bp, Homo sapiens
attccagatttgtt

SEQ ID NO: 591353 - DNA, 14 bp, Homo sapiens
attctaaatacatg

SEQ ID NO: 591354 - DNA, 21 bp, Homo sapiens
attctcccagtctctgtcgtg

SEQ ID NO: 591355 - DNA, 19 bp, Homo sapiens
attctgaagtatgaagtct

SEQ ID NO: 591356 - DNA, 17 bp, Homo sapiens
attctgcactcagaaaa

SEQ ID NO: 591357 - DNA, 11 bp, Homo sapiens
attctgcctgc

SEQ ID NO: 591358 - DNA, 14 bp, Homo sapiens
attctgcctgctcc

SEQ ID NO: 591359 - DNA, 19 bp, Homo sapiens
attctggctttaagccttc

SEQ ID NO: 591360 - DNA, 15 bp, Homo sapiens
attctttcagttctt

SEQ ID NO: 591361 - DNA, 17 bp, Homo sapiens
attctttcagttctttg

SEQ ID NO: 591362 - DNA, 16 bp, Homo sapiens
attctttgcaatactg

SEQ ID NO: 591363 - DNA, 19 bp, Homo sapiens
attctttgcaatactgctt

SEQ ID NO: 591364 - DNA, 14 bp, Homo sapiens
attgaacagctgtg

SEQ ID NO: 591365 - DNA, 11 bp, Homo sapiens
attgaactttc

SEQ ID NO: 591366 - DNA, 13 bp, Homo sapiens
attgaccattttt

SEQ ID NO: 591367 - DNA, 22 bp, Homo sapiens
attgaccattttttaatttact

SEQ ID NO: 591368 - DNA, 23 bp, Homo sapiens
attgactaactcaaatacacatt

SEQ ID NO: 591369 - DNA, 17 bp, Homo sapiens
attgactcttatttata

SEQ ID NO: 591370 - DNA, 19 bp, Homo sapiens
attgactcttatttataga

SEQ ID NO: 591371 - DNA, 16 bp, Homo sapiens
attgagtattgtttaa

SEQ ID NO: 591372 - DNA, 23 bp, Homo sapiens
attgagtattgtttaaaatgtaa

SEQ ID NO: 591373 - DNA, 19 bp, Homo sapiens
attgataaccttgaaaaaa

SEQ ID NO: 591374 - DNA, 18 bp, Homo sapiens
attgattgggaaaacatt

SEQ ID NO: 591375 - DNA, 19 bp, Homo sapiens
attgattgggaaaacattt

SEQ ID NO: 591376 - DNA, 21 bp, Homo sapiens
attgattgggaaaacatttgc

SEQ ID NO: 591377 - DNA, 23 bp, Homo sapiens
attgattgggaaaacatttgctg

SEQ ID NO: 591378 - DNA, 15 bp, Homo sapiens
attgcatactttgta

SEQ ID NO: 591379 - DNA, 22 bp, Homo sapiens
attggatattttttactttaga

SEQ ID NO: 591380 - DNA, 12 bp, Homo sapiens
attggccaatta

SEQ ID NO: 591381 - DNA, 15 bp, Homo sapiens
attggccaattaaaa

SEQ ID NO: 591382 - DNA, 13 bp, Homo sapiens
attggggtagttg

SEQ ID NO: 591383 - DNA, 13 bp, Homo sapiens
attgtaatctatg

SEQ ID NO: 591384 - DNA, 15 bp, Homo sapiens
attgtaatctatgtt

SEQ ID NO: 591385 - DNA, 18 bp, Homo sapiens
attgtaattatgtaaata

SEQ ID NO: 591386 - DNA, 21 bp, Homo sapiens
attgtacaaaattaagcaaat

SEQ ID NO: 591387 - DNA, 23 bp, Homo sapiens
attgtcacatctatccacactgt

SEQ ID NO: 591388 - DNA, 18 bp, Homo sapiens
attgtgtataactggatt

SEQ ID NO: 591389 - DNA, 17 bp, Homo sapiens
attgtttggtaaatgtt

SEQ ID NO: 591390 - DNA, 18 bp, Homo sapiens
attgtttggtaaatgttt

SEQ ID NO: 591391 - DNA, 17 bp, Homo sapiens
atttaaaaaataaataa

SEQ ID NO: 591392 - DNA, 13 bp, Homo sapiens
atttaaaactgtt

SEQ ID NO: 591393 - DNA, 14 bp, Homo sapiens
atttaaaagcctgc

SEQ ID NO: 591394 - DNA, 13 bp, Homo sapiens
atttaataaagat

SEQ ID NO: 591395 - DNA, 23 bp, Homo sapiens
atttaatccagttataagaagaa

SEQ ID NO: 591396 - DNA, 16 bp, Homo sapiens
atttatagaatttaat

SEQ ID NO: 591397 - DNA, 20 bp, Homo sapiens
atttatattaaataacatgt

SEQ ID NO: 591398 - DNA, 22 bp, Homo sapiens
atttattgctgtgtaacactgt

SEQ ID NO: 591399 - DNA, 15 bp, Homo sapiens
atttattttttaaga

SEQ ID NO: 591400 - DNA, 16 bp, Homo sapiens
atttattttttaagaa

SEQ ID NO: 591401 - DNA, 21 bp, Homo sapiens
atttattttttaagaaaaaaa

SEQ ID NO: 591402 - DNA, 18 bp, Homo sapiens
atttcaaagttttgttgt

SEQ ID NO: 591403 - DNA, 18 bp, Homo sapiens
atttcactactagattga

SEQ ID NO: 591404 - DNA, 19 bp, Homo sapiens
atttcaggcattggatatt

SEQ ID NO: 591405 - DNA, 11 bp, Homo sapiens
atttccttcca

SEQ ID NO: 591406 - DNA, 22 bp, Homo sapiens
atttctatatagacttggagaa

SEQ ID NO: 591407 - DNA, 15 bp, Homo sapiens
atttctcattgactt

SEQ ID NO: 591408 - DNA, 12 bp, Homo sapiens
atttctcttgct

SEQ ID NO: 591409 - DNA, 14 bp, Homo sapiens
atttgaaaaatata

SEQ ID NO: 591410 - DNA, 23 bp, Homo sapiens
atttgaagctgcagtgagctgtg

SEQ ID NO: 591411 - DNA, 16 bp, Homo sapiens
atttgataatgacact

SEQ ID NO: 591412 - DNA, 17 bp, Homo sapiens
atttgctactgttgtaa

SEQ ID NO: 591413 - DNA, 23 bp, Homo sapiens
atttggatttaaaagcctgctca

SEQ ID NO: 591414 - DNA, 14 bp, Homo sapiens
atttgtgacttttt

SEQ ID NO: 591415 - DNA, 15 bp, Homo sapiens
atttgtgacttttta

SEQ ID NO: 591416 - DNA, 16 bp, Homo sapiens
atttgttttggatata

SEQ ID NO: 591417 - DNA, 11 bp, Homo sapiens
attttgtttac

SEQ ID NO: 591418 - DNA, 12 bp, Homo sapiens
atttttaactgt

SEQ ID NO: 591419 - DNA, 13 bp, Homo sapiens
atttttaactgta

SEQ ID NO: 591420 - DNA, 12 bp, Homo sapiens
atttttataatt

SEQ ID NO: 591421 - DNA, 21 bp, Homo sapiens
atttttataattgtacaaaat

SEQ ID NO: 591422 - DNA, 15 bp, Homo sapiens
atttttctttaactg

SEQ ID NO: 591423 - DNA, 20 bp, Homo sapiens
atttttgtgaagtattcaca

SEQ ID NO: 591424 - DNA, 11 bp, Homo sapiens
attttttaaga

SEQ ID NO: 591425 - DNA, 13 bp, Homo sapiens
attttttaagaaa

SEQ ID NO: 591426 - DNA, 12 bp, Homo sapiens
attttttaagct

SEQ ID NO: 591427 - DNA, 11 bp, Homo sapiens
attttttgaat

SEQ ID NO: 591428 - DNA, 16 bp, Homo sapiens
attttttgaatctatg

SEQ ID NO: 591429 - DNA, 14 bp, Homo sapiens
atttttttaactgt

SEQ ID NO: 591430 - DNA, 15 bp, Homo sapiens
atttttttaactgtg

SEQ ID NO: 591431 - DNA, 22 bp, Homo sapiens
atttttttgcatgcatgcaaat

SEQ ID NO: 591432 - DNA, 15 bp, Homo sapiens
caaaaattatatatt

SEQ ID NO: 591433 - DNA, 22 bp, Homo sapiens
caaaaatttctgtaaaacaggt

SEQ ID NO: 591434 - DNA, 20 bp, Homo sapiens
caaaatatattttgtttaca

SEQ ID NO: 591435 - DNA, 22 bp, Homo sapiens
caaaatatattttgtttacaaa

SEQ ID NO: 591436 - DNA, 19 bp, Homo sapiens
caaaatggtcctatttttg

SEQ ID NO: 591437 - DNA, 22 bp, Homo sapiens
caaaattaagcaaatgttaaaa

SEQ ID NO: 591438 - DNA, 18 bp, Homo sapiens
caaaatttatattttaga

SEQ ID NO: 591439 - DNA, 17 bp, Homo sapiens
caaacaagccccctgcc

SEQ ID NO: 591440 - DNA, 19 bp, Homo sapiens
caaacagacaaaacagata

SEQ ID NO: 591441 - DNA, 14 bp, Homo sapiens
caaaccaggaccct

SEQ ID NO: 591442 - DNA, 16 bp, Homo sapiens
caaagaaacaaagatg

SEQ ID NO: 591443 - DNA, 16 bp, Homo sapiens
caaagaccacctccaa

SEQ ID NO: 591444 - DNA, 18 bp, Homo sapiens
caaagaccacctccaacc

SEQ ID NO: 591445 - DNA, 19 bp, Homo sapiens
caaagatgcgtttgcctcc

SEQ ID NO: 591446 - DNA, 20 bp, Homo sapiens
caaagatgcgtttgcctcct

SEQ ID NO: 591447 - DNA, 13 bp, Homo sapiens
caaagcagcagga

SEQ ID NO: 591448 - DNA, 15 bp, Homo sapiens
caaagtggaacgaaa

SEQ ID NO: 591449 - DNA, 22 bp, Homo sapiens
caaataatttgaactttggaac

SEQ ID NO: 591450 - DNA, 23 bp, Homo sapiens
caaataatttgaactttggaaca

SEQ ID NO: 591451 - DNA, 14 bp, Homo sapiens
caaatacacatttg

SEQ ID NO: 591452 - DNA, 21 bp, Homo sapiens
caaatgagctctgaaatcttc

SEQ ID NO: 591453 - DNA, 15 bp, Homo sapiens
caaatgcctgactca

SEQ ID NO: 591454 - DNA, 15 bp, Homo sapiens
caacaaagaaacaaa

SEQ ID NO: 591455 - DNA, 22 bp, Homo sapiens
caacaccttcagaggctgaggt

SEQ ID NO: 591456 - DNA, 22 bp, Homo sapiens
caacatgatccccgtctctgcc

SEQ ID NO: 591457 - DNA, 15 bp, Homo sapiens
caacatggtaattca

SEQ ID NO: 591458 - DNA, 14 bp, Homo sapiens
caacctcaggctcc

SEQ ID NO: 591459 - DNA, 15 bp, Homo sapiens
caacctcaggctcct

SEQ ID NO: 591460 - DNA, 20 bp, Homo sapiens
caacctctttgcgtttcctt

SEQ ID NO: 591461 - DNA, 22 bp, Homo sapiens
caacctgcatagccggtgggtg

SEQ ID NO: 591462 - DNA, 20 bp, Homo sapiens
caacggaaagtgctgtctta

SEQ ID NO: 591463 - DNA, 14 bp, Homo sapiens
caagaaagcttcct

SEQ ID NO: 591464 - DNA, 19 bp, Homo sapiens
caagagctactcccacagc

SEQ ID NO: 591465 - DNA, 20 bp, Homo sapiens
caagagctactcccacagca

SEQ ID NO: 591466 - DNA, 21 bp, Homo sapiens
caagagctactcccacagcag

SEQ ID NO: 591467 - DNA, 15 bp, Homo sapiens
caagcagacagccct

SEQ ID NO: 591468 - DNA, 15 bp, Homo sapiens
caagccccctgccct

SEQ ID NO: 591469 - DNA, 18 bp, Homo sapiens
caagcctaagggatcctg

SEQ ID NO: 591470 - DNA, 15 bp, Homo sapiens
caaggctcttcttcc

SEQ ID NO: 591471 - DNA, 18 bp, Homo sapiens
caaggctcttcttcctca

SEQ ID NO: 591472 - DNA, 20 bp, Homo sapiens
caagtatatatgaatgaata

SEQ ID NO: 591473 - DNA, 18 bp, Homo sapiens
caagttgtgcttgagcca

SEQ ID NO: 591474 - DNA, 20 bp, Homo sapiens
caataaaatttaaaaaataa

SEQ ID NO: 591475 - DNA, 13 bp, Homo sapiens
caatacaaaatgt

SEQ ID NO: 591476 - DNA, 23 bp, Homo sapiens
caatattgattgggaaaacattt

SEQ ID NO: 591477 - DNA, 21 bp, Homo sapiens
caatccatcgtattaaaaaac

SEQ ID NO: 591478 - DNA, 15 bp, Homo sapiens
caatctgtacaaaat

SEQ ID NO: 591479 - DNA, 16 bp, Homo sapiens
caatctgtacaaaatg

SEQ ID NO: 591480 - DNA, 17 bp, Homo sapiens
caatctgtacaaaatgg

SEQ ID NO: 591481 - DNA, 12 bp, Homo sapiens
caatctttgctg

SEQ ID NO: 591482 - DNA, 12 bp, Homo sapiens
caatgcctcagt

SEQ ID NO: 591483 - DNA, 21 bp, Homo sapiens
caattaaaaacgaaaacctga

SEQ ID NO: 591484 - DNA, 18 bp, Homo sapiens
caattccatgctataaaa

SEQ ID NO: 591485 - DNA, 20 bp, Homo sapiens
caattgggagctgccaagag

SEQ ID NO: 591486 - DNA, 21 bp, Homo sapiens
caatttggatttaaaagcctg

SEQ ID NO: 591487 - DNA, 20 bp, Homo sapiens
cacaagatgccccagggatg

SEQ ID NO: 591488 - DNA, 13 bp, Homo sapiens
cacacacacacac

SEQ ID NO: 591489 - DNA, 14 bp, Homo sapiens
cacacacacacaca

SEQ ID NO: 591490 - DNA, 15 bp, Homo sapiens
cacacacacacacac

SEQ ID NO: 591491 - DNA, 15 bp, Homo sapiens
cacacacacacacga

SEQ ID NO: 591492 - DNA, 16 bp, Homo sapiens
cacacacacgatgcat

SEQ ID NO: 591493 - DNA, 22 bp, Homo sapiens
cacacacgatgcatttaataaa

SEQ ID NO: 591494 - DNA, 23 bp, Homo sapiens
cacacctgggcatcagggccttt

SEQ ID NO: 591495 - DNA, 13 bp, Homo sapiens
cacacgatgcatt

SEQ ID NO: 591496 - DNA, 19 bp, Homo sapiens
cacacgatgcatttaataa

SEQ ID NO: 591497 - DNA, 13 bp, Homo sapiens
cacactcacctct

SEQ ID NO: 591498 - DNA, 15 bp, Homo sapiens
cacactcacctctaa

SEQ ID NO: 591499 - DNA, 16 bp, Homo sapiens
cacacttgaaaccttt

SEQ ID NO: 591500 - DNA, 17 bp, Homo sapiens
cacagaaggtgaacttt

SEQ ID NO: 591501 - DNA, 19 bp, Homo sapiens
cacagacgccttactggca

SEQ ID NO: 591502 - DNA, 21 bp, Homo sapiens
cacagctcaagcattctgttt

SEQ ID NO: 591503 - DNA, 20 bp, Homo sapiens
cacagggagtgcacatatcc

SEQ ID NO: 591504 - DNA, 15 bp, Homo sapiens
cacatatccaggcac

SEQ ID NO: 591505 - DNA, 16 bp, Homo sapiens
cacattaactgttgca

SEQ ID NO: 591506 - DNA, 16 bp, Homo sapiens
caccaggactagggct

SEQ ID NO: 591507 - DNA, 15 bp, Homo sapiens
caccagtgtagcatc

SEQ ID NO: 591508 - DNA, 23 bp, Homo sapiens
caccccatctttgctgccagctc

SEQ ID NO: 591509 - DNA, 23 bp, Homo sapiens
caccccttaccccaaagagaaag

SEQ ID NO: 591510 - DNA, 17 bp, Homo sapiens
cacccgagtacctccag

SEQ ID NO: 591511 - DNA, 19 bp, Homo sapiens
cacccgagtacctccagtc

SEQ ID NO: 591512 - DNA, 12 bp, Homo sapiens
cacctcctaccc

SEQ ID NO: 591513 - DNA, 20 bp, Homo sapiens
cacctcctaccccttcctgt

SEQ ID NO: 591514 - DNA, 12 bp, Homo sapiens
cacctgtagctg

SEQ ID NO: 591515 - DNA, 20 bp, Homo sapiens
caccttcagaggctgaggtg

SEQ ID NO: 591516 - DNA, 21 bp, Homo sapiens
cacgatgcatttaataaagat

SEQ ID NO: 591517 - DNA, 22 bp, Homo sapiens
cacgatgcatttaataaagatg

SEQ ID NO: 591518 - DNA, 20 bp, Homo sapiens
cacgttggggtgatttaatc

SEQ ID NO: 591519 - DNA, 14 bp, Homo sapiens
cactaacagagtgg

SEQ ID NO: 591520 - DNA, 22 bp, Homo sapiens
gaaacgtggatacagagccacg

SEQ ID NO: 591521 - DNA, 17 bp, Homo sapiens
gaaactttgggaaaaca

SEQ ID NO: 591522 - DNA, 15 bp, Homo sapiens
gaaagagaggaacca

SEQ ID NO: 591523 - DNA, 15 bp, Homo sapiens
gaaagatacttacat

SEQ ID NO: 591524 - DNA, 18 bp, Homo sapiens
gaaagtttttttttatta

SEQ ID NO: 591525 - DNA, 20 bp, Homo sapiens
gaaatacgtttgtgtttcta

SEQ ID NO: 591526 - DNA, 17 bp, Homo sapiens
gaaatataacacatttt

SEQ ID NO: 591527 - DNA, 18 bp, Homo sapiens
gaaatataacacattttt

SEQ ID NO: 591528 - DNA, 16 bp, Homo sapiens
gaaatggaaagcagag

SEQ ID NO: 591529 - DNA, 15 bp, Homo sapiens
gaaatttgataatga

SEQ ID NO: 591530 - DNA, 23 bp, Homo sapiens
gaacagctgtgagccatgcctcc

SEQ ID NO: 591531 - DNA, 16 bp, Homo sapiens
gaacataacttctcat

SEQ ID NO: 591532 - DNA, 17 bp, Homo sapiens
gaacatcacattcctct

SEQ ID NO: 591533 - DNA, 21 bp, Homo sapiens
gaaccagcagaaatgccccca

SEQ ID NO: 591534 - DNA, 23 bp, Homo sapiens
gaaccaggccagagcaaacagaa

SEQ ID NO: 591535 - DNA, 13 bp, Homo sapiens
gaaccataaattc

SEQ ID NO: 591536 - DNA, 15 bp, Homo sapiens
gaaccataaattcaa

SEQ ID NO: 591537 - DNA, 19 bp, Homo sapiens
gaaccctcttgccatcctg

SEQ ID NO: 591538 - DNA, 22 bp, Homo sapiens
gaaccctcttgccatcctgatg

SEQ ID NO: 591539 - DNA, 18 bp, Homo sapiens
gaacctacagttttaact

SEQ ID NO: 591540 - DNA, 19 bp, Homo sapiens
gaacctacagttttaactg

SEQ ID NO: 591541 - DNA, 13 bp, Homo sapiens
gaacgctctcctc

SEQ ID NO: 591542 - DNA, 20 bp, Homo sapiens
gaacggtggaggcagaggtg

SEQ ID NO: 591543 - DNA, 17 bp, Homo sapiens
gaactaggctgagcaat

SEQ ID NO: 591544 - DNA, 17 bp, Homo sapiens
gaacttcagcattgtaa

SEQ ID NO: 591545 - DNA, 19 bp, Homo sapiens
gaacttcagcattgtaatt

SEQ ID NO: 591546 - DNA, 16 bp, Homo sapiens
gaacttctgactactt

SEQ ID NO: 591547 - DNA, 21 bp, Homo sapiens
gaagaaaatttgccaatcttt

SEQ ID NO: 591548 - DNA, 22 bp, Homo sapiens
gaagaattgaaaagtttttgtt

SEQ ID NO: 591549 - DNA, 14 bp, Homo sapiens
gaagagaccactca

SEQ ID NO: 591550 - DNA, 22 bp, Homo sapiens
gaagagcgagagatcaaagatg

SEQ ID NO: 591551 - DNA, 19 bp, Homo sapiens
gaagagggaaaacagaaaa

SEQ ID NO: 591552 - DNA, 23 bp, Homo sapiens
gaagctgccgtagcttcagccag

SEQ ID NO: 591553 - DNA, 17 bp, Homo sapiens
gaaggagaagtaagagg

SEQ ID NO: 591554 - DNA, 14 bp, Homo sapiens
gaagggaaagtttt

SEQ ID NO: 591555 - DNA, 13 bp, Homo sapiens
gaaggtgaacttt

SEQ ID NO: 591556 - DNA, 19 bp, Homo sapiens
gaaggtgatgttgccatcc

SEQ ID NO: 591557 - DNA, 17 bp, Homo sapiens
gaagtcagaatttttaa

SEQ ID NO: 591558 - DNA, 22 bp, Homo sapiens
gaagttgccatgggaaacaaat

SEQ ID NO: 591559 - DNA, 16 bp, Homo sapiens
gaataccacatcaaat

SEQ ID NO: 591560 - DNA, 19 bp, Homo sapiens
gaataccacatcaaataag

SEQ ID NO: 591561 - DNA, 17 bp, Homo sapiens
gaatactgccaaaacat

SEQ ID NO: 591562 - DNA, 22 bp, Homo sapiens
gaatactgccaaaacatttatg

SEQ ID NO: 591563 - DNA, 22 bp, Homo sapiens
gaatcagtatttccttccactg

SEQ ID NO: 591564 - DNA, 21 bp, Homo sapiens
gaatgaatgggatattttgaa

SEQ ID NO: 591565 - DNA, 14 bp, Homo sapiens
gaatgaggaaaatt

SEQ ID NO: 591566 - DNA, 21 bp, Homo sapiens
gaatggatttttctttaactg

SEQ ID NO: 591567 - DNA, 16 bp, Homo sapiens
gaatgggatattttga

SEQ ID NO: 591568 - DNA, 20 bp, Homo sapiens
gaatgggatattttgaaatg

SEQ ID NO: 591569 - DNA, 18 bp, Homo sapiens
gaatgtccaaaatttata

SEQ ID NO: 591570 - DNA, 13 bp, Homo sapiens
gaatgttaaaggg

SEQ ID NO: 591571 - DNA, 14 bp, Homo sapiens
gaattataactgta

SEQ ID NO: 591572 - DNA, 11 bp, Homo sapiens
gaattcagtaa

SEQ ID NO: 591573 - DNA, 17 bp, Homo sapiens
gaattgaaaagtttttg

SEQ ID NO: 591574 - DNA, 14 bp, Homo sapiens
gaatttttaactgt

SEQ ID NO: 591575 - DNA, 21 bp, Homo sapiens
gacaactcattttcatattgt

SEQ ID NO: 591576 - DNA, 15 bp, Homo sapiens
gacactgtttcctga

SEQ ID NO: 591577 - DNA, 19 bp, Homo sapiens
gacagaacttcagcattgt

SEQ ID NO: 591578 - DNA, 16 bp, Homo sapiens
gacaggaaagagagga

SEQ ID NO: 591579 - DNA, 19 bp, Homo sapiens
gacagtttttgacatttat

SEQ ID NO: 591580 - DNA, 15 bp, Homo sapiens
gacataagataaaat

SEQ ID NO: 591581 - DNA, 15 bp, Homo sapiens
gacatgcaataaaat

SEQ ID NO: 591582 - DNA, 17 bp, Homo sapiens
gacatgcaataaaattt

SEQ ID NO: 591583 - DNA, 19 bp, Homo sapiens
gacatgcaataaaatttaa

SEQ ID NO: 591584 - DNA, 20 bp, Homo sapiens
gacatttatattaaataaca

SEQ ID NO: 591585 - DNA, 11 bp, Homo sapiens
gaccacctcca

SEQ ID NO: 591586 - DNA, 16 bp, Homo sapiens
gaccacctttcacaaa

SEQ ID NO: 591587 - DNA, 21 bp, Homo sapiens
gaccagaaatcaaaaagggaa

SEQ ID NO: 591588 - DNA, 19 bp, Homo sapiens
gaccaggtttgcaggagcc

SEQ ID NO: 591589 - DNA, 12 bp, Homo sapiens
gacccctgtctt

SEQ ID NO: 591590 - DNA, 22 bp, Homo sapiens
gacccggttattcgcccacccg

SEQ ID NO: 591591 - DNA, 18 bp, Homo sapiens
gaccctatgggtctagga

SEQ ID NO: 591592 - DNA, 16 bp, Homo sapiens
gacccttattgctgtc

SEQ ID NO: 591593 - DNA, 20 bp, Homo sapiens
gacccttattgctgtcctgg

SEQ ID NO: 591594 - DNA, 13 bp, Homo sapiens
gacctacctccct

SEQ ID NO: 591595 - DNA, 18 bp, Homo sapiens
gacctacctccctccctc

SEQ ID NO: 591596 - DNA, 19 bp, Homo sapiens
gacctacctccctccctct

SEQ ID NO: 591597 - DNA, 13 bp, Homo sapiens
gacctctctgcct

SEQ ID NO: 591598 - DNA, 16 bp, Homo sapiens
gacctctctgcctctc

SEQ ID NO: 591599 - DNA, 22 bp, Homo sapiens
gacctgccccggacctacctcc

SEQ ID NO: 591600 - DNA, 20 bp, Homo sapiens
gacctggcatctaattctga

SEQ ID NO: 591601 - DNA, 18 bp, Homo sapiens
gaccttaatttaactttc

SEQ ID NO: 591602 - DNA, 22 bp, Homo sapiens
gaccttaatttaactttccagt

SEQ ID NO: 591603 - DNA, 23 bp, Homo sapiens
gacgtttataaacagaaatggaa

SEQ ID NO: 591604 - DNA, 18 bp, Homo sapiens
gactatatatataaatgt

SEQ ID NO: 591605 - DNA, 15 bp, Homo sapiens
gactcagtgaccagt

SEQ ID NO: 591606 - DNA, 21 bp, Homo sapiens
gactcgcccccaggaacgctc

SEQ ID NO: 591607 - DNA, 14 bp, Homo sapiens
gactgcatttgtgt

SEQ ID NO: 591608 - DNA, 15 bp, Homo sapiens
gactggagtccctgt

SEQ ID NO: 591609 - DNA, 18 bp, Homo sapiens
gactgggcactggggcct

SEQ ID NO: 591610 - DNA, 18 bp, Homo sapiens
gagaaagcacaatttaaa

SEQ ID NO: 591611 - DNA, 14 bp, Homo sapiens
gagaacctgtgggc

SEQ ID NO: 591612 - DNA, 20 bp, Homo sapiens
gagaagagggaaaacagaaa

SEQ ID NO: 591613 - DNA, 16 bp, Homo sapiens
gagaatactgccaaaa

SEQ ID NO: 591614 - DNA, 20 bp, Homo sapiens
gagacagcagtttccagaga

SEQ ID NO: 591615 - DNA, 21 bp, Homo sapiens
gagacattttccgcccactcc

SEQ ID NO: 591616 - DNA, 13 bp, Homo sapiens
gagacccctgtct

SEQ ID NO: 591617 - DNA, 15 bp, Homo sapiens
gagacccctgtctcc

SEQ ID NO: 591618 - DNA, 14 bp, Homo sapiens
gagactctgtctca

SEQ ID NO: 591619 - DNA, 14 bp, Homo sapiens
gagagatcaaagat

SEQ ID NO: 591620 - DNA, 15 bp, Homo sapiens
gagagatcaaagatg

SEQ ID NO: 591621 - DNA, 13 bp, Homo sapiens
gagatcaaagatg

SEQ ID NO: 591622 - DNA, 12 bp, Homo sapiens
gagattgaactt

SEQ ID NO: 591623 - DNA, 18 bp, Homo sapiens
gagcaggacctgggacag

SEQ ID NO: 591624 - DNA, 15 bp, Homo sapiens
gagcatggagacagc

SEQ ID NO: 591625 - DNA, 13 bp, Homo sapiens
gagcatggggcca

SEQ ID NO: 591626 - DNA, 17 bp, Homo sapiens
gagcatggggccaggaa

SEQ ID NO: 591627 - DNA, 20 bp, Homo sapiens
gagccaattagacttgaaat

SEQ ID NO: 591628 - DNA, 15 bp, Homo sapiens
gcatcatctcttcct

SEQ ID NO: 591629 - DNA, 15 bp, Homo sapiens
gcatcccatctctcc

SEQ ID NO: 591630 - DNA, 20 bp, Homo sapiens
gcatctcagtggtgtgtgaa

SEQ ID NO: 591631 - DNA, 15 bp, Homo sapiens
gcatcttcctctgca

SEQ ID NO: 591632 - DNA, 21 bp, Homo sapiens
gcatgaaccctcttgccatcc

SEQ ID NO: 591633 - DNA, 16 bp, Homo sapiens
gcatgcaaatgagctc

SEQ ID NO: 591634 - DNA, 21 bp, Homo sapiens
gcatgcaaatgagctctgaaa

SEQ ID NO: 591635 - DNA, 14 bp, Homo sapiens
gcatgcatgcaaat

SEQ ID NO: 591636 - DNA, 13 bp, Homo sapiens
gcatggagacagc

SEQ ID NO: 591637 - DNA, 16 bp, Homo sapiens
gcatggggccaggaaa

SEQ ID NO: 591638 - DNA, 18 bp, Homo sapiens
gcatgtacaaaaattatg

SEQ ID NO: 591639 - DNA, 20 bp, Homo sapiens
gcatgttcacccttatagtc

SEQ ID NO: 591640 - DNA, 21 bp, Homo sapiens
gcattcaaccacgcaggaagc

SEQ ID NO: 591641 - DNA, 16 bp, Homo sapiens
gcattgagcttgcatg

SEQ ID NO: 591642 - DNA, 15 bp, Homo sapiens
gcattgagtattgtt

SEQ ID NO: 591643 - DNA, 18 bp, Homo sapiens
gcattggatattttttac

SEQ ID NO: 591644 - DNA, 21 bp, Homo sapiens
gcattgtaattatgtaaataa

SEQ ID NO: 591645 - DNA, 12 bp, Homo sapiens
gcatttaataaa

SEQ ID NO: 591646 - DNA, 15 bp, Homo sapiens
gcatttaataaagat

SEQ ID NO: 591647 - DNA, 19 bp, Homo sapiens
gcatttaataaagatgagt

SEQ ID NO: 591648 - DNA, 18 bp, Homo sapiens
gcatttcctgctggtcaa

SEQ ID NO: 591649 - DNA, 14 bp, Homo sapiens
gccaaaacatttat

SEQ ID NO: 591650 - DNA, 21 bp, Homo sapiens
gccaaaccaggaccctgtcca

SEQ ID NO: 591651 - DNA, 16 bp, Homo sapiens
gccaacctcaggctcc

SEQ ID NO: 591652 - DNA, 17 bp, Homo sapiens
gccaacctcaggctcct

SEQ ID NO: 591653 - DNA, 17 bp, Homo sapiens
gccaatctgtacaaaat

SEQ ID NO: 591654 - DNA, 22 bp, Homo sapiens
gccaatctttcctactttctat

SEQ ID NO: 591655 - DNA, 14 bp, Homo sapiens
gccaattagacttg

SEQ ID NO: 591656 - DNA, 19 bp, Homo sapiens
gccaattgaataggatcaa

SEQ ID NO: 591657 - DNA, 15 bp, Homo sapiens
gccacagaaggtgaa

SEQ ID NO: 591658 - DNA, 13 bp, Homo sapiens
gccacctcctacc

SEQ ID NO: 591659 - DNA, 12 bp, Homo sapiens
gccactgcactc

SEQ ID NO: 591660 - DNA, 19 bp, Homo sapiens
gccactgcactccaatctg

SEQ ID NO: 591661 - DNA, 20 bp, Homo sapiens
gccactgcactccagcctgg

SEQ ID NO: 591662 - DNA, 16 bp, Homo sapiens
gccagattggccaatt

SEQ ID NO: 591663 - DNA, 19 bp, Homo sapiens
gccagattggccaattaaa

SEQ ID NO: 591664 - DNA, 21 bp, Homo sapiens
gccagattggccaattaaaaa

SEQ ID NO: 591665 - DNA, 20 bp, Homo sapiens
gccataaacggttcctggtg

SEQ ID NO: 591666 - DNA, 18 bp, Homo sapiens
gccatagatgctggctgg

SEQ ID NO: 591667 - DNA, 21 bp, Homo sapiens
gccatgcctccctgggccacc

SEQ ID NO: 591668 - DNA, 13 bp, Homo sapiens
gcccaagccctga

SEQ ID NO: 591669 - DNA, 13 bp, Homo sapiens
gcccacctggctg

SEQ ID NO: 591670 - DNA, 16 bp, Homo sapiens
gcccacctggctgcca

SEQ ID NO: 591671 - DNA, 22 bp, Homo sapiens
gcccaggatactggcacagagg

SEQ ID NO: 591672 - DNA, 23 bp, Homo sapiens
gcccaggatactggcacagaggt

SEQ ID NO: 591673 - DNA, 16 bp, Homo sapiens
ctagttatacttattt

SEQ ID NO: 591674 - DNA, 23 bp, Homo sapiens
ctagttatacttatttgtatatg

SEQ ID NO: 591675 - DNA, 15 bp, Homo sapiens
ctataaaactctgca

SEQ ID NO: 591676 - DNA, 15 bp, Homo sapiens
ctatagcattttgct

SEQ ID NO: 591677 - DNA, 21 bp, Homo sapiens
ctatagcttgcagaactgtag

SEQ ID NO: 591678 - DNA, 15 bp, Homo sapiens
ctatagtcccagcta

SEQ ID NO: 591679 - DNA, 14 bp, Homo sapiens
ctatatagacttgg

SEQ ID NO: 591680 - DNA, 16 bp, Homo sapiens
ctatatatataaatgt

SEQ ID NO: 591681 - DNA, 18 bp, Homo sapiens
ctatatatataaatgtat

SEQ ID NO: 591682 - DNA, 15 bp, Homo sapiens
ctatcttttttagtg

SEQ ID NO: 591683 - DNA, 19 bp, Homo sapiens
ctatcttttttagtgttaa

SEQ ID NO: 591684 - DNA, 12 bp, Homo sapiens
ctatgtctggca

SEQ ID NO: 591685 - DNA, 17 bp, Homo sapiens
ctatgtctggcagatga

SEQ ID NO: 591686 - DNA, 17 bp, Homo sapiens
ctattctagcctgcatt

SEQ ID NO: 591687 - DNA, 23 bp, Homo sapiens
ctattctagcctgcattgagctt

SEQ ID NO: 591688 - DNA, 17 bp, Homo sapiens
ctatttattgtgctggg

SEQ ID NO: 591689 - DNA, 19 bp, Homo sapiens
ctatttttaatgtttgtac

SEQ ID NO: 591690 - DNA, 23 bp, Homo sapiens
ctatttttatgatgacaatcaaa

SEQ ID NO: 591691 - DNA, 15 bp, Homo sapiens
ctatttttgtgaaga

SEQ ID NO: 591692 - DNA, 15 bp, Homo sapiens
ctcaaaccacttgcc

SEQ ID NO: 591693 - DNA, 14 bp, Homo sapiens
ctcaaagcagcagg

SEQ ID NO: 591694 - DNA, 17 bp, Homo sapiens
ctcaagcattctgttta

SEQ ID NO: 591695 - DNA, 19 bp, Homo sapiens
ctcaatgaaccataaattc

SEQ ID NO: 591696 - DNA, 20 bp, Homo sapiens
ctcaatgaaccataaattca

SEQ ID NO: 591697 - DNA, 17 bp, Homo sapiens
ctcacctgcactaacag

SEQ ID NO: 591698 - DNA, 16 bp, Homo sapiens
ctcactgcttgaacta

SEQ ID NO: 591699 - DNA, 22 bp, Homo sapiens
ctcagactgggcactggggcct

SEQ ID NO: 591700 - DNA, 16 bp, Homo sapiens
ggacacagttcctggg

SEQ ID NO: 591701 - DNA, 18 bp, Homo sapiens
ggacagggccctggagct

SEQ ID NO: 591702 - DNA, 18 bp, Homo sapiens
ggacataagataaaatga

SEQ ID NO: 591703 - DNA, 21 bp, Homo sapiens
ggacataagataaaatgatgt

SEQ ID NO: 591704 - DNA, 22 bp, Homo sapiens
ggacataagataaaatgatgtt

SEQ ID NO: 591705 - DNA, 18 bp, Homo sapiens
ggaccaggtttgcaggag

SEQ ID NO: 591706 - DNA, 15 bp, Homo sapiens
ggacctacctccctc

SEQ ID NO: 591707 - DNA, 14 bp, Homo sapiens
ggacctgggacagg

SEQ ID NO: 591708 - DNA, 18 bp, Homo sapiens
ggactcctcaaaccactt

SEQ ID NO: 591709 - DNA, 17 bp, Homo sapiens
ggactggagtccctgtg

SEQ ID NO: 591710 - DNA, 22 bp, Homo sapiens
ggagaaatttgataatgacact

SEQ ID NO: 591711 - DNA, 18 bp, Homo sapiens
ggagaagagggaaaacag

SEQ ID NO: 591712 - DNA, 16 bp, Homo sapiens
ggagacagcagtttcc

SEQ ID NO: 591713 - DNA, 14 bp, Homo sapiens
ggagagagcagggc

SEQ ID NO: 591714 - DNA, 15 bp, Homo sapiens
ggagataaggtggct

SEQ ID NO: 591715 - DNA, 17 bp, Homo sapiens
ggagcagtgagtgacaa

SEQ ID NO: 591716 - DNA, 18 bp, Homo sapiens
ggagccattgaacagctg

SEQ ID NO: 591717 - DNA, 23 bp, Homo sapiens
ggagccttcccaagttgtgcttg

SEQ ID NO: 591718 - DNA, 23 bp, Homo sapiens
ggagcgttctaaatatgaatgaa

SEQ ID NO: 591719 - DNA, 23 bp, Homo sapiens
ggaggacttggttgatgtttaaa

SEQ ID NO: 591720 - DNA, 13 bp, Homo sapiens
ggaggcagaggtg

SEQ ID NO: 591721 - DNA, 20 bp, Homo sapiens
ggaggtccttaggcctctga

SEQ ID NO: 591722 - DNA, 17 bp, Homo sapiens
ggagtaccatgtggcaa

SEQ ID NO: 591723 - DNA, 13 bp, Homo sapiens
ggatattttgaaa

SEQ ID NO: 591724 - DNA, 17 bp, Homo sapiens
ggatcacttgagcccag

SEQ ID NO: 591725 - DNA, 19 bp, Homo sapiens
ggatcagagcgcacaggga

SEQ ID NO: 591726 - DNA, 16 bp, Homo sapiens
ggatcccgtcttccag

SEQ ID NO: 591727 - DNA, 19 bp, Homo sapiens
ggatcccgttcagaaaacc

SEQ ID NO: 591728 - DNA, 18 bp, Homo sapiens
ggatgggtcccctccgcc

SEQ ID NO: 591729 - DNA, 14 bp, Homo sapiens
ggatgttgctcaga

SEQ ID NO: 591730 - DNA, 14 bp, Homo sapiens
ggatgttgtaaata

SEQ ID NO: 591731 - DNA, 16 bp, Homo sapiens
ggattcagcatgtcca

SEQ ID NO: 591732 - DNA, 17 bp, Homo sapiens
ggatttaaaagcctgct

SEQ ID NO: 591733 - DNA, 20 bp, Homo sapiens
ggcaaaagggcagctgtgat

SEQ ID NO: 591734 - DNA, 11 bp, Homo sapiens
ggcacaataaa

SEQ ID NO: 591735 - DNA, 12 bp, Homo sapiens
ggcacatagaga

SEQ ID NO: 591736 - DNA, 14 bp, Homo sapiens
ggcacattaactgt

SEQ ID NO: 591737 - DNA, 21 bp, Homo sapiens
ggcacattaactgttgcactt

SEQ ID NO: 591738 - DNA, 16 bp, Homo sapiens
ggcacccacaaataaa

SEQ ID NO: 591739 - DNA, 14 bp, Homo sapiens
ggcagaggtgacag

SEQ ID NO: 591740 - DNA, 21 bp, Homo sapiens
ggcagaggttgcagtgagccg

SEQ ID NO: 591741 - DNA, 12 bp, Homo sapiens
ggcagatgaggg

SEQ ID NO: 591742 - DNA, 16 bp, Homo sapiens
ggcagatgagggctgg

SEQ ID NO: 591743 - DNA, 14 bp, Homo sapiens
ggcagccagaccag

SEQ ID NO: 591744 - DNA, 21 bp, Homo sapiens
ggcaggacttctcaccagcag

SEQ ID NO: 591745 - DNA, 20 bp, Homo sapiens
ggcagttccttacctccctg

SEQ ID NO: 591746 - DNA, 19 bp, Homo sapiens
ggcatgaaccctcttgcca

SEQ ID NO: 591747 - DNA, 24 bp, Homo sapiens
ggcatgaaccctcttgccatcctg

SEQ ID NO: 591748 - DNA, 15 bp, Homo sapiens
ggcatgcacagctgt

SEQ ID NO: 591749 - DNA, 11 bp, Homo sapiens
ggcattgagta

SEQ ID NO: 591750 - DNA, 15 bp, Homo sapiens
ggccaacctcaggct

SEQ ID NO: 591751 - DNA, 18 bp, Homo sapiens
ggccaacctcaggctcct

SEQ ID NO: 591752 - DNA, 16 bp, Homo sapiens
ggccacctcctacccc

SEQ ID NO: 591753 - DNA, 20 bp, Homo sapiens
ggccacctcctaccccttcc

SEQ ID NO: 591754 - DNA, 23 bp, Homo sapiens
ggccaggagtttaagaccagcct

SEQ ID NO: 591755 - DNA, 22 bp, Homo sapiens
ggccataaacggttcctggtga

SEQ ID NO: 591756 - DNA, 23 bp, Homo sapiens
ggccataaacggttcctggtgac

SEQ ID NO: 591757 - DNA, 15 bp, Homo sapiens
ggcctgcccagttgc

SEQ ID NO: 591758 - DNA, 15 bp, Homo sapiens
ggcgcgggagggggc

SEQ ID NO: 591759 - DNA, 15 bp, Homo sapiens
ggtctggttgggcag

SEQ ID NO: 591760 - DNA, 14 bp, Homo sapiens
ggtgtaatctcaat

SEQ ID NO: 591761 - DNA, 19 bp, Homo sapiens
ggttatttattttttaaga

SEQ ID NO: 591762 - DNA, 20 bp, Homo sapiens
ggttcatacgcatcccatct

SEQ ID NO: 591763 - DNA, 21 bp, Homo sapiens
ggttcatacgcatcccatctc

SEQ ID NO: 591764 - DNA, 17 bp, Homo sapiens
ggtttaagaaatagaat

SEQ ID NO: 591765 - DNA, 18 bp, Homo sapiens
ggtttactcactgctgca

SEQ ID NO: 591766 - DNA, 19 bp, Homo sapiens
ggtttgcaaagaccacctc

SEQ ID NO: 591767 - DNA, 16 bp, Homo sapiens
gtaaatgaagatcttt

SEQ ID NO: 591768 - DNA, 13 bp, Homo sapiens
gtaaatgtttctt

SEQ ID NO: 591769 - DNA, 14 bp, Homo sapiens
gtaaatgtttcttt

SEQ ID NO: 591770 - DNA, 21 bp, Homo sapiens
gtaataagcactgtaaacttc

SEQ ID NO: 591771 - DNA, 15 bp, Homo sapiens
gtaatagctttagtg

SEQ ID NO: 591772 - DNA, 16 bp, Homo sapiens
gtaatgctaaatgtgt

SEQ ID NO: 591773 - DNA, 15 bp, Homo sapiens
gtaattgtgtggatt

SEQ ID NO: 591774 - DNA, 21 bp, Homo sapiens
gtaattgtgtggattctttaa

SEQ ID NO: 591775 - DNA, 10 bp, Homo sapiens
gtaatttaaa

SEQ ID NO: 591776 - DNA, 14 bp, Homo sapiens
gtacaaaatggtcc

SEQ ID NO: 591777 - DNA, 13 bp, Homo sapiens
gtagagccaatta

SEQ ID NO: 591778 - DNA, 20 bp, Homo sapiens
gtagagccaattagacttga

SEQ ID NO: 591779 - DNA, 15 bp, Homo sapiens
gtagcatcttcctct

SEQ ID NO: 591780 - DNA, 17 bp, Homo sapiens
gtagcatcttcctctgc

SEQ ID NO: 591781 - DNA, 21 bp, Homo sapiens
gtagctattagcggctcctcg

SEQ ID NO: 591782 - DNA, 16 bp, Homo sapiens
gtagcttcagccaggc

SEQ ID NO: 591783 - DNA, 13 bp, Homo sapiens
gtaggtaagactg

SEQ ID NO: 591784 - DNA, 17 bp, Homo sapiens
gtatatatgtatttcta

SEQ ID NO: 591785 - DNA, 19 bp, Homo sapiens
gtatatgactgcatttgtg

SEQ ID NO: 591786 - DNA, 16 bp, Homo sapiens
gtatatggtatttatt

SEQ ID NO: 591787 - DNA, 12 bp, Homo sapiens
gtatattcagga

SEQ ID NO: 591788 - DNA, 22 bp, Homo sapiens
gtatctagagcttaatgctaca

SEQ ID NO: 591789 - DNA, 22 bp, Homo sapiens
gtattaaaaaacaattaactgc

SEQ ID NO: 591790 - DNA, 18 bp, Homo sapiens
gtattaaaactaaatttc

SEQ ID NO: 591791 - DNA, 20 bp, Homo sapiens
gtattaaaactaaatttcac

SEQ ID NO: 591792 - DNA, 20 bp, Homo sapiens
gtatttccttccactgtagc

SEQ ID NO: 591793 - DNA, 19 bp, Homo sapiens
gtattttcatgaaaatacc

SEQ ID NO: 591794 - DNA, 17 bp, Homo sapiens
gtcagaatttttaactg

SEQ ID NO: 591795 - DNA, 15 bp, Homo sapiens
gtcattagtcctttg

SEQ ID NO: 591796 - DNA, 16 bp, Homo sapiens
gtcattctgcctgctc

SEQ ID NO: 591797 - DNA, 18 bp, Homo sapiens
gtcattctgcctgctcca

SEQ ID NO: 591798 - DNA, 17 bp, Homo sapiens
gtccagcagtttccagt

SEQ ID NO: 591799 - DNA, 19 bp, Homo sapiens
gtccctcttctctcctcag

SEQ ID NO: 591800 - DNA, 22 bp, Homo sapiens
gtccctgcaaaactccaggcag

SEQ ID NO: 591801 - DNA, 19 bp, Homo sapiens
gtcccttcctattctcctg

SEQ ID NO: 591802 - DNA, 23 bp, Homo sapiens
gtcccttcctattctcctgccat

SEQ ID NO: 591803 - DNA, 17 bp, Homo sapiens
gtcctaaaagttctcaa

SEQ ID NO: 591804 - DNA, 19 bp, Homo sapiens
gtcctaaaagttctcaatg

SEQ ID NO: 591805 - DNA, 13 bp, Homo sapiens
gtcctcctaagtc

SEQ ID NO: 591806 - DNA, 12 bp, Homo sapiens
gtcctgcctcct

SEQ ID NO: 591807 - DNA, 13 bp, Homo sapiens
gtcctgcctcctc

SEQ ID NO: 591808 - DNA, 23 bp, Homo sapiens
gtctaagactatatatataaatg

SEQ ID NO: 591809 - DNA, 15 bp, Homo sapiens
gtctaagtagggcca

SEQ ID NO: 591810 - DNA, 14 bp, Homo sapiens
gtctaggacacagt

SEQ ID NO: 591811 - DNA, 14 bp, Homo sapiens
gtctcagtttcttg

SEQ ID NO: 591812 - DNA, 14 bp, Homo sapiens
gtctcctttgctct

SEQ ID NO: 591813 - DNA, 14 bp, Homo sapiens
gtctctgccctggg

SEQ ID NO: 591814 - DNA, 17 bp, Homo sapiens
gtctctgccctgggctc

SEQ ID NO: 591815 - DNA, 17 bp, Homo sapiens
taaacggttcctggtga

SEQ ID NO: 591816 - DNA, 23 bp, Homo sapiens
taaagaccctcctattctataaa

SEQ ID NO: 591817 - DNA, 12 bp, Homo sapiens
taaagagaatga

SEQ ID NO: 591818 - DNA, 21 bp, Homo sapiens
taaagaggagataaggtggct

SEQ ID NO: 591819 - DNA, 16 bp, Homo sapiens
taaagatattctttag

SEQ ID NO: 591820 - DNA, 15 bp, Homo sapiens
taaagtacttgacta

SEQ ID NO: 591821 - DNA, 17 bp, Homo sapiens
taaagtacttgactacc

SEQ ID NO: 591822 - DNA, 19 bp, Homo sapiens
taaataaaaactaattaag

SEQ ID NO: 591823 - DNA, 13 bp, Homo sapiens
taaataacatgtt

SEQ ID NO: 591824 - DNA, 23 bp, Homo sapiens
taaataggaatcattcagaaatg

SEQ ID NO: 591825 - DNA, 18 bp, Homo sapiens
taaatgaagatctttata

SEQ ID NO: 591826 - DNA, 19 bp, Homo sapiens
taaatggtaataagcactg

SEQ ID NO: 591827 - DNA, 19 bp, Homo sapiens
taaatgtataaatatacag

SEQ ID NO: 591828 - DNA, 22 bp, Homo sapiens
taaatgtgcaatagaaggtgat

SEQ ID NO: 591829 - DNA, 22 bp, Homo sapiens
taaatgtgtaataatgtaacat

SEQ ID NO: 591830 - DNA, 18 bp, Homo sapiens
taaattgcatcactgtat

SEQ ID NO: 591831 - DNA, 21 bp, Homo sapiens
taaatttcactactagattga

SEQ ID NO: 591832 - DNA, 19 bp, Homo sapiens
taacaagaactttaaattg

SEQ ID NO: 591833 - DNA, 12 bp, Homo sapiens
taacacattttt

SEQ ID NO: 591834 - DNA, 21 bp, Homo sapiens
taacagtatgtgggatattga

SEQ ID NO: 591835 - DNA, 17 bp, Homo sapiens
taacatgtttctctata

SEQ ID NO: 591836 - DNA, 22 bp, Homo sapiens
taacatgtttctctataaagta

SEQ ID NO: 591837 - DNA, 17 bp, Homo sapiens
taaccaaggctgtgttt

SEQ ID NO: 591838 - DNA, 18 bp, Homo sapiens
taactcaaatacacattt

SEQ ID NO: 591839 - DNA, 21 bp, Homo sapiens
taactgccctctgaaataatg

SEQ ID NO: 591840 - DNA, 17 bp, Homo sapiens
taactgccgtaatttaa

SEQ ID NO: 591841 - DNA, 23 bp, Homo sapiens
taactgtaaagatgtttatttca

SEQ ID NO: 591842 - DNA, 14 bp, Homo sapiens
taactgtactgaat

SEQ ID NO: 591843 - DNA, 17 bp, Homo sapiens
taacttctcatgtatat

SEQ ID NO: 591844 - DNA, 23 bp, Homo sapiens
taacttgatagggtctaccaata

SEQ ID NO: 591845 - DNA, 13 bp, Homo sapiens
taagaaatagaat

SEQ ID NO: 591846 - DNA, 16 bp, Homo sapiens
taagaacaactacctg

SEQ ID NO: 591847 - DNA, 17 bp, Homo sapiens
taagaagaagttcatgt

SEQ ID NO: 591848 - DNA, 22 bp, Homo sapiens
taagaagaagttcatgtccaaa

SEQ ID NO: 591849 - DNA, 18 bp, Homo sapiens
taagaataccacatcaaa

SEQ ID NO: 591850 - DNA, 22 bp, Homo sapiens
taagaataccacatcaaataag

SEQ ID NO: 591851 - DNA, 17 bp, Homo sapiens
taagactgtagatatgt

SEQ ID NO: 591852 - DNA, 22 bp, Homo sapiens
taagataaaatgatgttataca

SEQ ID NO: 591853 - DNA, 17 bp, Homo sapiens
taagatatctcaatgaa

SEQ ID NO: 591854 - DNA, 21 bp, Homo sapiens
taagatgaaacatcatttcaa

SEQ ID NO: 591855 - DNA, 17 bp, Homo sapiens
taagcttcagttgcttg

SEQ ID NO: 591856 - DNA, 23 bp, Homo sapiens
taagcttccattttaattttaaa

SEQ ID NO: 591857 - DNA, 17 bp, Homo sapiens
taaggacccttttaagc

SEQ ID NO: 591858 - DNA, 15 bp, Homo sapiens
taaggggaagaatga

SEQ ID NO: 591859 - DNA, 10 bp, Homo sapiens
taaggtggct

SEQ ID NO: 591860 - DNA, 14 bp, Homo sapiens
taagtaggtgatga

SEQ ID NO: 591861 - DNA, 14 bp, Homo sapiens
taagtcccttccta

SEQ ID NO: 591862 - DNA, 14 bp, Homo sapiens
taagtctttcatgg

SEQ ID NO: 591863 - DNA, 23 bp, Homo sapiens
taagtgcgaagactgagccagat

SEQ ID NO: 591864 - DNA, 15 bp, Homo sapiens
taataaaaagaaaga

SEQ ID NO: 591865 - DNA, 12 bp, Homo sapiens
taataaagtact

SEQ ID NO: 591866 - DNA, 23 bp, Homo sapiens
taataaatgtgactcagcatcac

SEQ ID NO: 591867 - DNA, 15 bp, Homo sapiens
taatactactactgt

SEQ ID NO: 591868 - DNA, 16 bp, Homo sapiens
taataggaacaatctt

SEQ ID NO: 591869 - DNA, 20 bp, Homo sapiens
taatattcagggtaaatagg

SEQ ID NO: 591870 - DNA, 21 bp, Homo sapiens
taatattcagggtaaatagga

SEQ ID NO: 591871 - DNA, 21 bp, Homo sapiens
taatattgtttggtaaatgtt

SEQ ID NO: 591872 - DNA, 23 bp, Homo sapiens
taatccagttataagaagaagtt

SEQ ID NO: 591873 - DNA, 15 bp, Homo sapiens
taatctatgtttata

SEQ ID NO: 591874 - DNA, 14 bp, Homo sapiens
taatctcaatgcaa

SEQ ID NO: 591875 - DNA, 15 bp, Homo sapiens
taatgctaaatgtgt

SEQ ID NO: 591876 - DNA, 22 bp, Homo sapiens
taatgctaaatgtgtaataatg

SEQ ID NO: 591877 - DNA, 14 bp, Homo sapiens
taatgctacaattt

SEQ ID NO: 591878 - DNA, 23 bp, Homo sapiens
taatgtgtggattgcctctgaaa

SEQ ID NO: 591879 - DNA, 22 bp, Homo sapiens
taatgtttctggatttcatact

SEQ ID NO: 591880 - DNA, 21 bp, Homo sapiens
tgcaaagtctccagaagaaaa

SEQ ID NO: 591881 - DNA, 21 bp, Homo sapiens
tgcaagccccaactttcttat

SEQ ID NO: 591882 - DNA, 16 bp, Homo sapiens
tgcaataaaatttaaa

SEQ ID NO: 591883 - DNA, 17 bp, Homo sapiens
tgcaataaaatttaaaa

SEQ ID NO: 591884 - DNA, 19 bp, Homo sapiens
tgcacagctgtagtacccc

SEQ ID NO: 591885 - DNA, 17 bp, Homo sapiens
tgcactaacagagtggc

SEQ ID NO: 591886 - DNA, 18 bp, Homo sapiens
tgcagcagtcgcccaagc

SEQ ID NO: 591887 - DNA, 21 bp, Homo sapiens
tgcagccttttctggtccctc

SEQ ID NO: 591888 - DNA, 15 bp, Homo sapiens
tgcagctttgcaaac

SEQ ID NO: 591889 - DNA, 16 bp, Homo sapiens
tgcagtcccatgcaca

SEQ ID NO: 591890 - DNA, 22 bp, Homo sapiens
tgcatactttgtattttgatta

SEQ ID NO: 591891 - DNA, 20 bp, Homo sapiens
tgcatagtcccagctaccca

SEQ ID NO: 591892 - DNA, 21 bp, Homo sapiens
tgcatcactgtatcattttct

SEQ ID NO: 591893 - DNA, 22 bp, Homo sapiens
tgcatgcaaatgagctctgaaa

SEQ ID NO: 591894 - DNA, 18 bp, Homo sapiens
tgcatgtagaggcttgtt

SEQ ID NO: 591895 - DNA, 22 bp, Homo sapiens
tgcatttaataaagatgagttg

SEQ ID NO: 591896 - DNA, 14 bp, Homo sapiens
tgccactgcactcc

SEQ ID NO: 591897 - DNA, 12 bp, Homo sapiens
tgccactgttgt

SEQ ID NO: 591898 - DNA, 16 bp, Homo sapiens
tgccagcaaccttgta

SEQ ID NO: 591899 - DNA, 23 bp, Homo sapiens
tgccagccccctaaaagcactcc

SEQ ID NO: 591900 - DNA, 17 bp, Homo sapiens
tgccagctgcagcctgg

SEQ ID NO: 591901 - DNA, 20 bp, Homo sapiens
tgccaggacatgcaataaaa

SEQ ID NO: 591902 - DNA, 14 bp, Homo sapiens
tgccatcctgatgg

SEQ ID NO: 591903 - DNA, 15 bp, Homo sapiens
tgccatgggaaacaa

SEQ ID NO: 591904 - DNA, 18 bp, Homo sapiens
tgccatgttttgccaccc

SEQ ID NO: 591905 - DNA, 21 bp, Homo sapiens
tgccatgttttgccaccccct

SEQ ID NO: 591906 - DNA, 14 bp, Homo sapiens
tgcccacctggctg

SEQ ID NO: 591907 - DNA, 21 bp, Homo sapiens
tgcccagacatcagcctcctt

SEQ ID NO: 591908 - DNA, 14 bp, Homo sapiens
tgccccagggatgg

SEQ ID NO: 591909 - DNA, 23 bp, Homo sapiens
tgcccccaccccatgcccccacc

SEQ ID NO: 591910 - DNA, 17 bp, Homo sapiens
tgcccccattctcccag

SEQ ID NO: 591911 - DNA, 20 bp, Homo sapiens
tgcccccattctcccagtct

SEQ ID NO: 591912 - DNA, 16 bp, Homo sapiens
tgccccggacctacct

SEQ ID NO: 591913 - DNA, 17 bp, Homo sapiens
tgcccctaccctggact

SEQ ID NO: 591914 - DNA, 13 bp, Homo sapiens
tgcccctgttcat

SEQ ID NO: 591915 - DNA, 13 bp, Homo sapiens
tgccctgccagct

SEQ ID NO: 591916 - DNA, 17 bp, Homo sapiens
tgccctgccagctgcag

SEQ ID NO: 591917 - DNA, 14 bp, Homo sapiens
tgccctgggctcct

SEQ ID NO: 591918 - DNA, 14 bp, Homo sapiens
tgccctttcctggc

SEQ ID NO: 591919 - DNA, 17 bp, Homo sapiens
tgccctttcctggcagt

SEQ ID NO: 591920 - DNA, 19 bp, Homo sapiens
tgccgtagcttcagccagg

SEQ ID NO: 591921 - DNA, 20 bp, Homo sapiens
tgccgtagcttcagccaggc

SEQ ID NO: 591922 - DNA, 13 bp, Homo sapiens
tgcctccctgggc

SEQ ID NO: 591923 - DNA, 19 bp, Homo sapiens
tgcctccctgggccacctc

SEQ ID NO: 591924 - DNA, 20 bp, Homo sapiens
tgcctccctgggccacctcc

SEQ ID NO: 591925 - DNA, 11 bp, Homo sapiens
tgcctcctgga

SEQ ID NO: 591926 - DNA, 22 bp, Homo sapiens
tgcctggggcggcatgaaccct

SEQ ID NO: 591927 - DNA, 16 bp, Homo sapiens
tgccttcgtttatatt

SEQ ID NO: 591928 - DNA, 16 bp, Homo sapiens
tgcgtttgcctcctgg

SEQ ID NO: 591929 - DNA, 13 bp, Homo sapiens
tgctactgttgta

SEQ ID NO: 591930 - DNA, 19 bp, Homo sapiens
tgctacttcccactgtatg

SEQ ID NO: 591931 - DNA, 17 bp, Homo sapiens
tgctatcggcagatgat

SEQ ID NO: 591932 - DNA, 19 bp, Homo sapiens
tgctatcttttttagtgtt

SEQ ID NO: 591933 - DNA, 13 bp, Homo sapiens
tgctcacagctgt

SEQ ID NO: 591934 - DNA, 17 bp, Homo sapiens
tgctcacgtcaaatgca

SEQ ID NO: 591935 - DNA, 22 bp, Homo sapiens
tgctgaacataacttctcatgt

SEQ ID NO: 591936 - DNA, 21 bp, Homo sapiens
tgctgataccatatgaatgaa

SEQ ID NO: 591937 - DNA, 21 bp, Homo sapiens
tgctgcacacactcacctcta

SEQ ID NO: 591938 - DNA, 19 bp, Homo sapiens
tgctgccattacagaggta

SEQ ID NO: 591939 - DNA, 14 bp, Homo sapiens
tgctggggacacag

SEQ ID NO: 591940 - DNA, 21 bp, Homo sapiens
tgctgtcttaaactaaatgtg

SEQ ID NO: 591941 - DNA, 21 bp, Homo sapiens
tgcttaatcttcaaagccttc

SEQ ID NO: 591942 - DNA, 21 bp, Homo sapiens
tgcttgagccaggaggcctgc

SEQ ID NO: 591943 - DNA, 15 bp, Homo sapiens
tgcttgtcttctggt

SEQ ID NO: 591944 - DNA, 17 bp, Homo sapiens
tgctttattaatgtttt

SEQ ID NO: 591945 - DNA, 21 bp, Homo sapiens
tgctttattaatgttttcaaa

SEQ ID NO: 591946 - DNA, 15 bp, Homo sapiens
tgctttgcattttga

SEQ ID NO: 591947 - DNA, 16 bp, Homo sapiens
tgctttgcattttgat

SEQ ID NO: 591948 - DNA, 21 bp, Homo sapiens
tgctttggaagatgcagaagc

SEQ ID NO: 591949 - DNA, 14 bp, Homo sapiens
tggaaattcctgta

SEQ ID NO: 591950 - DNA, 22 bp, Homo sapiens
tggaaattcctgtactgtgtct

SEQ ID NO: 591951 - DNA, 17 bp, Homo sapiens
tggaacagggttggcat

SEQ ID NO: 591952 - DNA, 17 bp, Homo sapiens
tggaagatgcagaagca

SEQ ID NO: 591953 - DNA, 19 bp, Homo sapiens
tggaaggacctgctcccac

SEQ ID NO: 591954 - DNA, 19 bp, Homo sapiens
tggaagtgtgtgccaagag

SEQ ID NO: 591955 - DNA, 14 bp, Homo sapiens
tggaatcagtattt

SEQ ID NO: 591956 - DNA, 21 bp, Homo sapiens
tggaatcagtatttccttcca

SEQ ID NO: 591957 - DNA, 22 bp, Homo sapiens
tggacctgccccggacctacct

SEQ ID NO: 591958 - DNA, 16 bp, Homo sapiens
tggacttctgaagaga

SEQ ID NO: 591959 - DNA, 14 bp, Homo sapiens
tggacttgcctctg

SEQ ID NO: 591960 - DNA, 17 bp, Homo sapiens
tggagaatactgccaaa

SEQ ID NO: 591961 - DNA, 22 bp, Homo sapiens
tggagacgtttataaacagaaa

SEQ ID NO: 591962 - DNA, 14 bp, Homo sapiens
tggagagagcaggg

SEQ ID NO: 591963 - DNA, 17 bp, Homo sapiens
tggagagagcagggcta

SEQ ID NO: 591964 - DNA, 14 bp, Homo sapiens
tggaggcagaggtg

SEQ ID NO: 591965 - DNA, 15 bp, Homo sapiens
tggatcacaaagtgg

SEQ ID NO: 591966 - DNA, 16 bp, Homo sapiens
tgtgtgccaagagcta

SEQ ID NO: 591967 - DNA, 14 bp, Homo sapiens
tgtgtggattcttt

SEQ ID NO: 591968 - DNA, 16 bp, Homo sapiens
tgttaaagagaatgag

SEQ ID NO: 591969 - DNA, 19 bp, Homo sapiens
tgttaaagagataaagaat

SEQ ID NO: 591970 - DNA, 20 bp, Homo sapiens
tgttatacatcaatatgtat

SEQ ID NO: 591971 - DNA, 21 bp, Homo sapiens
tgttatacatcaatatgtata

SEQ ID NO: 591972 - DNA, 21 bp, Homo sapiens
tgttatactgaaccaggccag

SEQ ID NO: 591973 - DNA, 16 bp, Homo sapiens
tgttcccaaggcccca

SEQ ID NO: 591974 - DNA, 22 bp, Homo sapiens
tgttgatgaggacccagagctg

SEQ ID NO: 591975 - DNA, 13 bp, Homo sapiens
tgttggaaagtaa

SEQ ID NO: 591976 - DNA, 20 bp, Homo sapiens
tgttggggaagggcctgccc

SEQ ID NO: 591977 - DNA, 15 bp, Homo sapiens
tgttgtaagaattct

SEQ ID NO: 591978 - DNA, 16 bp, Homo sapiens
tgttgtacttaaatgg

SEQ ID NO: 591979 - DNA, 16 bp, Homo sapiens
tgtttcctagctgtgt

SEQ ID NO: 591980 - DNA, 17 bp, Homo sapiens
tgtttctggatttcata

SEQ ID NO: 591981 - DNA, 13 bp, Homo sapiens
tgtttgccaggac

SEQ ID NO: 591982 - DNA, 16 bp, Homo sapiens
tgtttgccaggacatg

SEQ ID NO: 591983 - DNA, 17 bp, Homo sapiens
ttctccgggtcctccta

SEQ ID NO: 591984 - DNA, 17 bp, Homo sapiens
ttctcctccccacctgt

SEQ ID NO: 591985 - DNA, 21 bp, Homo sapiens
ttctcctccccacctgtagct

SEQ ID NO: 591986 - DNA, 12 bp, Homo sapiens
ttctctcctcag

SEQ ID NO: 591987 - DNA, 13 bp, Homo sapiens
ttctctctctaag

SEQ ID NO: 591988 - DNA, 16 bp, Homo sapiens
ttctgaagtatgaagt

SEQ ID NO: 591989 - DNA, 18 bp, Homo sapiens
ttctgaagtatgaagtct

SEQ ID NO: 591990 - DNA, 18 bp, Homo sapiens
ttctgcatggattcagca

SEQ ID NO: 591991 - DNA, 14 bp, Homo sapiens
ttctgccacataaa

SEQ ID NO: 591992 - DNA, 12 bp, Homo sapiens
ttctgcctgctc

SEQ ID NO: 591993 - DNA, 17 bp, Homo sapiens
ttctgcctgctccatcg

SEQ ID NO: 591994 - DNA, 14 bp, Homo sapiens
ttctggatgtctgg

SEQ ID NO: 591995 - DNA, 15 bp, Homo sapiens
ttctggatgtctggc

SEQ ID NO: 591996 - DNA, 17 bp, Homo sapiens
ttctggccttgtaagac

SEQ ID NO: 591997 - DNA, 18 bp, Homo sapiens
ttctggctttaagccttc

SEQ ID NO: 591998 - DNA, 15 bp, Homo sapiens
ttctgggtccaggga

SEQ ID NO: 591999 - DNA, 17 bp, Homo sapiens
ttctggtactttctgtt

SEQ ID NO: 592000 - DNA, 14 bp, Homo sapiens
ttctggtccctctt

SEQ ID NO: 592001 - DNA, 19 bp, Homo sapiens
ttctggtccctcttctctc

SEQ ID NO: 592002 - DNA, 13 bp, Homo sapiens
ttctgtaattgtg

SEQ ID NO: 592003 - DNA, 17 bp, Homo sapiens
ttctgtagagccaatta

SEQ ID NO: 592004 - DNA, 21 bp, Homo sapiens
ttcttaaaaggcccatagcag

SEQ ID NO: 592005 - DNA, 19 bp, Homo sapiens
ttctttcagttctttggat

SEQ ID NO: 592006 - DNA, 14 bp, Homo sapiens
ttcttttctcagtg

SEQ ID NO: 592007 - DNA, 19 bp, Homo sapiens
ttgaaaaatataaaattat

SEQ ID NO: 592008 - DNA, 22 bp, Homo sapiens
ttgaaactttgggaaaacatgt

SEQ ID NO: 592009 - DNA, 14 bp, Homo sapiens
ttgaaatgaacttt

SEQ ID NO: 592010 - DNA, 15 bp, Homo sapiens
ttgaacagctgtgag

SEQ ID NO: 592011 - DNA, 24 bp, Homo sapiens
ttgaacagctgtgagccatgcctc

SEQ ID NO: 592012 - DNA, 17 bp, Homo sapiens
ttgaaccttaaaaggta

SEQ ID NO: 592013 - DNA, 20 bp, Homo sapiens
ttgaaccttaaaaggtactg

SEQ ID NO: 592014 - DNA, 23 bp, Homo sapiens
ttgaatgtccaaaatttatattt

SEQ ID NO: 592015 - DNA, 22 bp, Homo sapiens
ttgaatgttaaagggatatttt

SEQ ID NO: 592016 - DNA, 13 bp, Homo sapiens
ttgaattcagtaa

SEQ ID NO: 592017 - DNA, 17 bp, Homo sapiens
ttgacaggttttccaaa

SEQ ID NO: 592018 - DNA, 16 bp, Homo sapiens
ttgacagtttttgaca

SEQ ID NO: 592019 - DNA, 14 bp, Homo sapiens
ttgacatttatatt

SEQ ID NO: 592020 - DNA, 17 bp, Homo sapiens
ttgacatttatattaaa

SEQ ID NO: 592021 - DNA, 22 bp, Homo sapiens
ttgactaactcaaatacacatt

SEQ ID NO: 592022 - DNA, 12 bp, Homo sapiens
ttgagattctga

SEQ ID NO: 592023 - DNA, 14 bp, Homo sapiens
ttgagtattgttta

SEQ ID NO: 592024 - DNA, 20 bp, Homo sapiens
ttgagtattgtttaaaatgt

SEQ ID NO: 592025 - DNA, 22 bp, Homo sapiens
ttgagtattgtttaaaatgtaa

SEQ ID NO: 592026 - DNA, 19 bp, Homo sapiens
ttgatagggtctaccaata

SEQ ID NO: 592027 - DNA, 21 bp, Homo sapiens
ttgatataatttccatagtgt

SEQ ID NO: 592028 - DNA, 17 bp, Homo sapiens
ttgattgggaaaacatt

SEQ ID NO: 592029 - DNA, 18 bp, Homo sapiens
ttgatttgattgggatga

SEQ ID NO: 592030 - DNA, 15 bp, Homo sapiens
ttgcaaagaccacct

SEQ ID NO: 592031 - DNA, 16 bp, Homo sapiens
ttgcaaagaccacctc

SEQ ID NO: 592032 - DNA, 19 bp, Homo sapiens
ttgcaaagaccacctccaa

SEQ ID NO: 592033 - DNA, 18 bp, Homo sapiens
ttgcacagccaaatttaa

SEQ ID NO: 592034 - DNA, 19 bp, Homo sapiens
ttgcacagccaaatttaaa

SEQ ID NO: 592035 - DNA, 15 bp, Homo sapiens
ttgcagcggctcctg

SEQ ID NO: 592036 - DNA, 13 bp, Homo sapiens
ttgcataagagct

SEQ ID NO: 592037 - DNA, 16 bp, Homo sapiens
ttgcatgcatgcaaat

SEQ ID NO: 592038 - DNA, 12 bp, Homo sapiens
ttgcattttgat

SEQ ID NO: 592039 - DNA, 15 bp, Homo sapiens
ttgcattttgatatt

SEQ ID NO: 592040 - DNA, 16 bp, Homo sapiens
ttgccaggacatgcaa

SEQ ID NO: 592041 - DNA, 18 bp, Homo sapiens
ttggaaattcctgtactg

SEQ ID NO: 592042 - DNA, 14 bp, Homo sapiens
ttggagaatactgc

SEQ ID NO: 592043 - DNA, 18 bp, Homo sapiens
ttggagaatactgccaaa

SEQ ID NO: 592044 - DNA, 17 bp, Homo sapiens
ttggattctaaatacat

SEQ ID NO: 592045 - DNA, 16 bp, Homo sapiens
ttgggaaaacatgtta

SEQ ID NO: 592046 - DNA, 16 bp, Homo sapiens
ttgggaaaacatttgc

SEQ ID NO: 592047 - DNA, 17 bp, Homo sapiens
ttgggaaaacatttgct

SEQ ID NO: 592048 - DNA, 23 bp, Homo sapiens
ttgggcagccagaccagcaggct

SEQ ID NO: 592049 - DNA, 20 bp, Homo sapiens
ttgggtgtctccttaagctg

SEQ ID NO: 592050 - DNA, 22 bp, Homo sapiens
ttggtctcccttctctacactc

SEQ ID NO: 592051 - DNA, 18 bp, Homo sapiens
ttggtggctcacgcctgt

SEQ ID NO: 592052 - DNA, 14 bp, Homo sapiens
ttgtaataaaatgt

SEQ ID NO: 592053 - DNA, 20 bp, Homo sapiens
ttgtacaaaattaagcaaat

SEQ ID NO: 592054 - DNA, 15 bp, Homo sapiens
ttgtacttaaatggt

SEQ ID NO: 592055 - DNA, 23 bp, Homo sapiens
ttgtacttaaatggtaataagca

SEQ ID NO: 592056 - DNA, 19 bp, Homo sapiens
ttgtagtgccactgttgtt

SEQ ID NO: 592057 - DNA, 14 bp, Homo sapiens
ttgtatatgactgc

SEQ ID NO: 592058 - DNA, 18 bp, Homo sapiens
ttgtatatgactgcattt

SEQ ID NO: 592059 - DNA, 19 bp, Homo sapiens
ttgtatatgactgcatttg

SEQ ID NO: 592060 - DNA, 17 bp, Homo sapiens
ttgtattttcatgaaaa

SEQ ID NO: 592061 - DNA, 18 bp, Homo sapiens
ttgtattttcatgaaaat

SEQ ID NO: 592062 - DNA, 16 bp, Homo sapiens
ttgtctgatttcttag

SEQ ID NO: 592063 - DNA, 18 bp, Homo sapiens
ttgtgaagtattcacaaa

SEQ ID NO: 592064 - DNA, 20 bp, Homo sapiens
ttgtgctgggtcccagcctg

SEQ ID NO: 592065 - DNA, 19 bp, Homo sapiens
ttgtggtgtcccctatcct

SEQ ID NO: 592066 - DNA, 16 bp, Homo sapiens
ttgtgtccctaatgtg

SEQ ID NO: 592067 - DNA, 12 bp, Homo sapiens
ttgtgtgaaatt

SEQ ID NO: 592068 - DNA, 21 bp, Homo sapiens
ttgtgtttctagaatcacagc

SEQ ID NO: 592069 - DNA, 15 bp, Homo sapiens
ttgttaaaaatgtca

SEQ ID NO: 592070 - DNA, 14 bp, Homo sapiens
ttgttgcactgccc

SEQ ID NO: 592071 - DNA, 15 bp, Homo sapiens
ttgtttaaaatgtaa

SEQ ID NO: 592072 - DNA, 16 bp, Homo sapiens
ttgtttaatagatttg

SEQ ID NO: 592073 - DNA, 23 bp, Homo sapiens
ttgtttcctcccctatctgtatt

SEQ ID NO: 592074 - DNA, 17 bp, Homo sapiens
ttgttttggatggcttg

SEQ ID NO: 592075 - DNA, 22 bp, Homo sapiens
tttaaaaaataaataaaaacta

SEQ ID NO: 592076 - DNA, 15 bp, Homo sapiens
tttaaaacgtgtaaa

SEQ ID NO: 592077 - DNA, 17 bp, Homo sapiens
tttaaaacgtgtaaatg

SEQ ID NO: 592078 - DNA, 22 bp, Homo sapiens
tttaaaactgttggaatggatt

SEQ ID NO: 592079 - DNA, 13 bp, Homo sapiens
tttaaaagcctgc

SEQ ID NO: 592080 - DNA, 23 bp, Homo sapiens
tttaaaatgtaatttaaatgaaa

SEQ ID NO: 592081 - DNA, 15 bp, Homo sapiens
tcaagcattctgttt

SEQ ID NO: 592082 - DNA, 19 bp, Homo sapiens
tcaatgtctaaaaacattt

SEQ ID NO: 592083 - DNA, 14 bp, Homo sapiens
tcacacccctgccc

SEQ ID NO: 592084 - DNA, 15 bp, Homo sapiens
tcacacccctgcccc

SEQ ID NO: 592085 - DNA, 13 bp, Homo sapiens
tcacactccccgc

SEQ ID NO: 592086 - DNA, 17 bp, Homo sapiens
tcacactccccgcggtt

SEQ ID NO: 592087 - DNA, 20 bp, Homo sapiens
tcacagatcgcatttcctaa

SEQ ID NO: 592088 - DNA, 17 bp, Homo sapiens
tcaccgagcatgcttcc

SEQ ID NO: 592089 - DNA, 20 bp, Homo sapiens
tcacgttggggtgatttaat

SEQ ID NO: 592090 - DNA, 14 bp, Homo sapiens
tcactgccttcgtt

SEQ ID NO: 592091 - DNA, 18 bp, Homo sapiens
tcactgccttcgtttata

SEQ ID NO: 592092 - DNA, 19 bp, Homo sapiens
tcactgccttcgtttatat

SEQ ID NO: 592093 - DNA, 13 bp, Homo sapiens
tcagaaatataac

SEQ ID NO: 592094 - DNA, 17 bp, Homo sapiens
tcagaaggatgcccaga

SEQ ID NO: 592095 - DNA, 22 bp, Homo sapiens
tcagaattagagcatgggaggt

SEQ ID NO: 592096 - DNA, 16 bp, Homo sapiens
tcagagcgcacaggga

SEQ ID NO: 592097 - DNA, 14 bp, Homo sapiens
tcagagggcccaaa

SEQ ID NO: 592098 - DNA, 20 bp, Homo sapiens
tcagagtgactacacacagt

SEQ ID NO: 592099 - DNA, 15 bp, Homo sapiens
tcagcaaattccaga

SEQ ID NO: 592100 - DNA, 19 bp, Homo sapiens
tcagcaagttagaactagc

SEQ ID NO: 592101 - DNA, 16 bp, Homo sapiens
tcagcatcacccacct

SEQ ID NO: 592102 - DNA, 17 bp, Homo sapiens
tcagcattgtaattatg

SEQ ID NO: 592103 - DNA, 19 bp, Homo sapiens
tcagccaggcaagaaagct

SEQ ID NO: 592104 - DNA, 17 bp, Homo sapiens
tcagcctgctttcctgc

SEQ ID NO: 592105 - DNA, 21 bp, Homo sapiens
tcagcctgctttcctgcagca

SEQ ID NO: 592106 - DNA, 16 bp, Homo sapiens
tcagctgctgttgaac

SEQ ID NO: 592107 - DNA, 16 bp, Homo sapiens
tcaggaattcttggag

SEQ ID NO: 592108 - DNA, 17 bp, Homo sapiens
tcaggacttgaaagaaa

SEQ ID NO: 592109 - DNA, 20 bp, Homo sapiens
tcaggcattggatatttttt

SEQ ID NO: 592110 - DNA, 17 bp, Homo sapiens
tcagggcctttctcctc

SEQ ID NO: 592111 - DNA, 20 bp, Homo sapiens
tcagtccagcagtttccagt

SEQ ID NO: 592112 - DNA, 20 bp, Homo sapiens
tcagttccaaacagacaaaa

SEQ ID NO: 592113 - DNA, 14 bp, Homo sapiens
tcagttctcaaatg

SEQ ID NO: 592114 - DNA, 17 bp, Homo sapiens
tcagttctcaaatgtgt

SEQ ID NO: 592115 - DNA, 15 bp, Homo sapiens
tcagttgcttgtctt

SEQ ID NO: 592116 - DNA, 14 bp, Homo sapiens
tcagtttgttggaa

SEQ ID NO: 592117 - DNA, 16 bp, Homo sapiens
tcagtttgttggaaag

SEQ ID NO: 592118 - DNA, 16 bp, Homo sapiens
tcataatgctttgtta

SEQ ID NO: 592119 - DNA, 17 bp, Homo sapiens
tcatacgcatcccatct

SEQ ID NO: 592120 - DNA, 17 bp, Homo sapiens
tcatcagtgtgtaaata

SEQ ID NO: 592121 - DNA, 21 bp, Homo sapiens
tcatcagtgtgtaaataattt

SEQ ID NO: 592122 - DNA, 12 bp, Homo sapiens
tcatctcttcct

SEQ ID NO: 592123 - DNA, 13 bp, Homo sapiens
tcatctcttcctc

SEQ ID NO: 592124 - DNA, 21 bp, Homo sapiens
tcatggatatgttatactgaa

SEQ ID NO: 592125 - DNA, 16 bp, Homo sapiens
tcatggctgctgttgc

SEQ ID NO: 592126 - DNA, 22 bp, Homo sapiens
tcattataatgtcattaaacat

SEQ ID NO: 592127 - DNA, 12 bp, Homo sapiens
tcattctgcctg

SEQ ID NO: 592128 - DNA, 15 bp, Homo sapiens
tcattctgcctgctc

SEQ ID NO: 592129 - DNA, 11 bp, Homo sapiens
tcattgacttt

SEQ ID NO: 592130 - DNA, 19 bp, Homo sapiens
tcattggcattctttgcaa

SEQ ID NO: 592131 - DNA, 21 bp, Homo sapiens
tcattggcattctttgcaata

SEQ ID NO: 592132 - DNA, 16 bp, Homo sapiens
tcattttcttttttaa

SEQ ID NO: 592133 - DNA, 20 bp, Homo sapiens
tccacagccttgcagcggct

SEQ ID NO: 592134 - DNA, 15 bp, Homo sapiens
tccactcttctctcc

SEQ ID NO: 592135 - DNA, 16 bp, Homo sapiens
tccactcttctctcct

SEQ ID NO: 592136 - DNA, 20 bp, Homo sapiens
tccactcttctctcctttct

SEQ ID NO: 592137 - DNA, 22 bp, Homo sapiens
tccactcttctctcctttctcc

SEQ ID NO: 592138 - DNA, 22 bp, Homo sapiens
tccagagaaagcacaatttaaa

SEQ ID NO: 592139 - DNA, 13 bp, Homo sapiens
tccagagaacctg

SEQ ID NO: 592140 - DNA, 21 bp, Homo sapiens
tccagagagtggagagagcag

SEQ ID NO: 592141 - DNA, 22 bp, Homo sapiens
tccagagagtggagagagcagg

SEQ ID NO: 592142 - DNA, 22 bp, Homo sapiens
tccagatagtgtagctgaggag

SEQ ID NO: 592143 - DNA, 21 bp, Homo sapiens
tccaggcaccaggactagggc

SEQ ID NO: 592144 - DNA, 17 bp, Homo sapiens
tccaggttatggggaga

SEQ ID NO: 592145 - DNA, 15 bp, Homo sapiens
tccagtcttagctga

SEQ ID NO: 592146 - DNA, 13 bp, Homo sapiens
tccagttataaga

SEQ ID NO: 592147 - DNA, 15 bp, Homo sapiens
tccagttataagaag

SEQ ID NO: 592148 - DNA, 19 bp, Homo sapiens
tccatcacgttagctgtcc

SEQ ID NO: 592149 - DNA, 16 bp, Homo sapiens
tccatcgtattaaaaa

SEQ ID NO: 592150 - DNA, 22 bp, Homo sapiens
tccatcgtattaaaaaacaatt

SEQ ID NO: 592151 - DNA, 21 bp, Homo sapiens
tccatgtacttccctcttgaa

SEQ ID NO: 592152 - DNA, 15 bp, Homo sapiens
tccatttccattgct

SEQ ID NO: 592153 - DNA, 18 bp, Homo sapiens
tcccacagcagccccagg

SEQ ID NO: 592154 - DNA, 20 bp, Homo sapiens
tcccacagcagccccaggag

SEQ ID NO: 592155 - DNA, 13 bp, Homo sapiens
gtggaaaaaacat

SEQ ID NO: 592156 - DNA, 16 bp, Homo sapiens
gtggaacgaaaatgaa

SEQ ID NO: 592157 - DNA, 12 bp, Homo sapiens
gtggaggcagag

SEQ ID NO: 592158 - DNA, 16 bp, Homo sapiens
gtggatacagagccac

SEQ ID NO: 592159 - DNA, 16 bp, Homo sapiens
gtggatatttgtataa

SEQ ID NO: 592160 - DNA, 23 bp, Homo sapiens
gtggatcacaaagtggaacgaaa

SEQ ID NO: 592161 - DNA, 13 bp, Homo sapiens
gtggattctttaa

SEQ ID NO: 592162 - DNA, 17 bp, Homo sapiens
gtggattgcctctgaaa

SEQ ID NO: 592163 - DNA, 22 bp, Homo sapiens
gtggcctcagctcaatgcagtt

SEQ ID NO: 592164 - DNA, 15 bp, Homo sapiens
gtgggctttggtggc

SEQ ID NO: 592165 - DNA, 23 bp, Homo sapiens
gtggggccataaacggttcctgg

SEQ ID NO: 592166 - DNA, 22 bp, Homo sapiens
gtggggcctcaggctccgggca

SEQ ID NO: 592167 - DNA, 21 bp, Homo sapiens
gtggtctataagatgaaacat

SEQ ID NO: 592168 - DNA, 14 bp, Homo sapiens
gtggtctgccaatc

SEQ ID NO: 592169 - DNA, 19 bp, Homo sapiens
gtggtctgccaatctgtac

SEQ ID NO: 592170 - DNA, 21 bp, Homo sapiens
gtggtgatttgaaaaatataa

SEQ ID NO: 592171 - DNA, 22 bp, Homo sapiens
gtggtgtcccctatcctcccct

SEQ ID NO: 592172 - DNA, 17 bp, Homo sapiens
gtgtgaagtttggagat

SEQ ID NO: 592173 - DNA, 15 bp, Homo sapiens
gtgtgaccctgggca

SEQ ID NO: 592174 - DNA, 23 bp, Homo sapiens
gtgtggattgcctctgaaaagtg

SEQ ID NO: 592175 - DNA, 17 bp, Homo sapiens
gtgtgttttcagcaaat

SEQ ID NO: 592176 - DNA, 20 bp, Homo sapiens
gtgttactaaaaaaaagatg

SEQ ID NO: 592177 - DNA, 15 bp, Homo sapiens
gtgttgcctcttgca

SEQ ID NO: 592178 - DNA, 20 bp, Homo sapiens
gtgttttgaaagaatagaac

SEQ ID NO: 592179 - DNA, 23 bp, Homo sapiens
gttaaaagttatttgttcattat

SEQ ID NO: 592180 - DNA, 21 bp, Homo sapiens
gttaaagggatatttttttct

SEQ ID NO: 592181 - DNA, 19 bp, Homo sapiens
gttaaggacccttttaagc

SEQ ID NO: 592182 - DNA, 23 bp, Homo sapiens
gttaaggacccttttaagcatgt

SEQ ID NO: 592183 - DNA, 18 bp, Homo sapiens
gttacgtagcctaaggct

SEQ ID NO: 592184 - DNA, 20 bp, Homo sapiens
gttagatgggaggatgaatt

SEQ ID NO: 592185 - DNA, 17 bp, Homo sapiens
gttagtgacatttaatg

SEQ ID NO: 592186 - DNA, 19 bp, Homo sapiens
gttatacatcaatatgtat

SEQ ID NO: 592187 - DNA, 20 bp, Homo sapiens
gttatactgaaccaggccag

SEQ ID NO: 592188 - DNA, 13 bp, Homo sapiens
gttcaacaaagaa

SEQ ID NO: 592189 - DNA, 23 bp, Homo sapiens
gttcaacaaagaaacaaagatgt

SEQ ID NO: 592190 - DNA, 15 bp, Homo sapiens
gttcagaaaaccact

SEQ ID NO: 592191 - DNA, 18 bp, Homo sapiens
gttcatgtttttgtttta

SEQ ID NO: 592192 - DNA, 22 bp, Homo sapiens
gttcccttgaaactttgggaaa

SEQ ID NO: 592193 - DNA, 22 bp, Homo sapiens
gttctaacagtgaagttttact

SEQ ID NO: 592194 - DNA, 15 bp, Homo sapiens
gttctggatgtctgg

SEQ ID NO: 592195 - DNA, 16 bp, Homo sapiens
gttctgtagagccaat

SEQ ID NO: 592196 - DNA, 16 bp, Homo sapiens
gttgcactgccccctg

SEQ ID NO: 592197 - DNA, 15 bp, Homo sapiens
gttgcacttttgaat

SEQ ID NO: 592198 - DNA, 16 bp, Homo sapiens
gttgcacttttgaatg

SEQ ID NO: 592199 - DNA, 19 bp, Homo sapiens
gttgccaaagttttgctgt

SEQ ID NO: 592200 - DNA, 15 bp, Homo sapiens
gttggaatggatttt

SEQ ID NO: 592201 - DNA, 14 bp, Homo sapiens
gttgggcagccaga

SEQ ID NO: 592202 - DNA, 18 bp, Homo sapiens
gttgggggaaccagcaga

SEQ ID NO: 592203 - DNA, 21 bp, Homo sapiens
gttgggtgtctccttaagctg

SEQ ID NO: 592204 - DNA, 18 bp, Homo sapiens
gttgtactttggaattct

SEQ ID NO: 592205 - DNA, 13 bp, Homo sapiens
gtttaaaatgtaa

SEQ ID NO: 592206 - DNA, 17 bp, Homo sapiens
gtttaagaccagcctgg

SEQ ID NO: 592207 - DNA, 13 bp, Homo sapiens
gtttagattgtat

SEQ ID NO: 592208 - DNA, 20 bp, Homo sapiens
gtttagattgtattaactat

SEQ ID NO: 592209 - DNA, 20 bp, Homo sapiens
gtttagatttatggttgtta

SEQ ID NO: 592210 - DNA, 14 bp, Homo sapiens
gtttataaacagaa

SEQ ID NO: 592211 - DNA, 21 bp, Homo sapiens
gtttatatttttttaactgtg

SEQ ID NO: 592212 - DNA, 18 bp, Homo sapiens
gtttcaacggaaagtgct

SEQ ID NO: 592213 - DNA, 18 bp, Homo sapiens
gtttcagtttgttggaaa

SEQ ID NO: 592214 - DNA, 21 bp, Homo sapiens
gtttcagtttgttggaaagta

SEQ ID NO: 592215 - DNA, 14 bp, Homo sapiens
gtttctggatttca

SEQ ID NO: 592216 - DNA, 14 bp, Homo sapiens
gtttcttttgtttg

SEQ ID NO: 592217 - DNA, 14 bp, Homo sapiens
gtttgaattcagta

SEQ ID NO: 592218 - DNA, 15 bp, Homo sapiens
gtttgaattcagtaa

SEQ ID NO: 592219 - DNA, 19 bp, Homo sapiens
gtttgacagtttttgacat

SEQ ID NO: 592220 - DNA, 18 bp, Homo sapiens
gtttgcaaagaccacctc

SEQ ID NO: 592221 - DNA, 11 bp, Homo sapiens
gtttgcaggag

SEQ ID NO: 592222 - DNA, 15 bp, Homo sapiens
gtttgtggggctgga

SEQ ID NO: 592223 - DNA, 19 bp, Homo sapiens
gttttaaaacgtgtaaatg

SEQ ID NO: 592224 - DNA, 16 bp, Homo sapiens
gttttaactgtggata

SEQ ID NO: 592225 - DNA, 17 bp, Homo sapiens
gtttttgacatttatat

SEQ ID NO: 592226 - DNA, 17 bp, Homo sapiens
taaaaaatactctgcta

SEQ ID NO: 592227 - DNA, 15 bp, Homo sapiens
taaaacaatccttac

SEQ ID NO: 592228 - DNA, 20 bp, Homo sapiens
taaaactatttattgtgctg

SEQ ID NO: 592229 - DNA, 14 bp, Homo sapiens
taaaagcctgctca

SEQ ID NO: 592230 - DNA, 22 bp, Homo sapiens
taaaaggcccatagcagccagt

SEQ ID NO: 592231 - DNA, 22 bp, Homo sapiens
taaaatagaaatatagccaaaa

SEQ ID NO: 592232 - DNA, 16 bp, Homo sapiens
taaaatgatgttatac

SEQ ID NO: 592233 - DNA, 16 bp, Homo sapiens
taaaatgtaatttaaa

SEQ ID NO: 592234 - DNA, 19 bp, Homo sapiens
taaaatgtaatttaaatga

SEQ ID NO: 592235 - DNA, 21 bp, Homo sapiens
taaaatgtaatttaaatgaaa

SEQ ID NO: 592236 - DNA, 13 bp, Homo sapiens
taaaattatttca

SEQ ID NO: 592237 - DNA, 15 bp, Homo sapiens
taaaattatttcatg

SEQ ID NO: 592238 - DNA, 23 bp, Homo sapiens
taaaattttgtatgttaaagaga

SEQ ID NO: 592239 - DNA, 14 bp, Homo sapiens
taaacaaacaagcc

SEQ ID NO: 592240 - DNA, 22 bp, Homo sapiens
taaacaaacaagccccctgccc

SEQ ID NO: 592241 - DNA, 13 bp, Homo sapiens
taaactaaatgtg

SEQ ID NO: 592242 - DNA, 15 bp, Homo sapiens
taaagaagtgcatga

SEQ ID NO: 592243 - DNA, 16 bp, Homo sapiens
taaagaagtgcatgaa

SEQ ID NO: 592244 - DNA, 17 bp, Homo sapiens
taaagaagtgcatgaaa

SEQ ID NO: 592245 - DNA, 18 bp, Homo sapiens
taaagagataaagaataa

SEQ ID NO: 592246 - DNA, 22 bp, Homo sapiens
taaagggatatttttttctatt

SEQ ID NO: 592247 - DNA, 16 bp, Homo sapiens
taaagtttggttttga

SEQ ID NO: 592248 - DNA, 18 bp, Homo sapiens
taaagtttggttttgaca

SEQ ID NO: 592249 - DNA, 15 bp, Homo sapiens
taaataaaactattt

SEQ ID NO: 592250 - DNA, 21 bp, Homo sapiens
taaataggaatcattcagaaa

SEQ ID NO: 592251 - DNA, 14 bp, Homo sapiens
taaatgaaagaaaa

SEQ ID NO: 592252 - DNA, 15 bp, Homo sapiens
taaatgaagatcttt

SEQ ID NO: 592253 - DNA, 15 bp, Homo sapiens
taaatgtataaatat

SEQ ID NO: 592254 - DNA, 22 bp, Homo sapiens
taaatgtataaatatacagtat

SEQ ID NO: 592255 - DNA, 19 bp, Homo sapiens
taaatgtgcaatagaaggt

SEQ ID NO: 592256 - DNA, 18 bp, Homo sapiens
taaatgtgtaataatgta

SEQ ID NO: 592257 - DNA, 19 bp, Homo sapiens
taaatgtttcttttgtttg

SEQ ID NO: 592258 - DNA, 16 bp, Homo sapiens
taaattcaactttgta

SEQ ID NO: 592259 - DNA, 12 bp, Homo sapiens
taaattgcatca

SEQ ID NO: 592260 - DNA, 19 bp, Homo sapiens
taaattgcatcactgtatc

SEQ ID NO: 592261 - DNA, 19 bp, Homo sapiens
taacacatttttttgcatg

SEQ ID NO: 592262 - DNA, 20 bp, Homo sapiens
taacacatttttttgcatgc

SEQ ID NO: 592263 - DNA, 21 bp, Homo sapiens
taacacatttttttgcatgca

SEQ ID NO: 592264 - DNA, 15 bp, Homo sapiens
taacactgttaagag

SEQ ID NO: 592265 - DNA, 15 bp, Homo sapiens
taacagtcttactgc

SEQ ID NO: 592266 - DNA, 17 bp, Homo sapiens
gccatgggtgcagaccc

SEQ ID NO: 592267 - DNA, 20 bp, Homo sapiens
gccattgaacagctgtgagc

SEQ ID NO: 592268 - DNA, 22 bp, Homo sapiens
gccattttggggggttatttat

SEQ ID NO: 592269 - DNA, 20 bp, Homo sapiens
gcccaagcagacagccctgg

SEQ ID NO: 592270 - DNA, 14 bp, Homo sapiens
gcccacctggctgc

SEQ ID NO: 592271 - DNA, 13 bp, Homo sapiens
gcccactcctggg

SEQ ID NO: 592272 - DNA, 20 bp, Homo sapiens
gcccaggaatttgaagctgc

SEQ ID NO: 592273 - DNA, 15 bp, Homo sapiens
gcccaggatactggc

SEQ ID NO: 592274 - DNA, 16 bp, Homo sapiens
gccccactttcaagaa

SEQ ID NO: 592275 - DNA, 12 bp, Homo sapiens
gccccaggagaa

SEQ ID NO: 592276 - DNA, 21 bp, Homo sapiens
gccccatctccacaggagaga

SEQ ID NO: 592277 - DNA, 12 bp, Homo sapiens
gggggaaccagc

SEQ ID NO: 592278 - DNA, 20 bp, Homo sapiens
ggggtatttcaattaccttc

SEQ ID NO: 592279 - DNA, 22 bp, Homo sapiens
gggtcctcctaagtcccttcct

SEQ ID NO: 592280 - DNA, 16 bp, Homo sapiens
ggtaaatgtttctttt

SEQ ID NO: 592281 - DNA, 21 bp, Homo sapiens
ggtaaatgtttcttttaaaga

SEQ ID NO: 592282 - DNA, 17 bp, Homo sapiens
ggtatgcagagcttgtg

SEQ ID NO: 592283 - DNA, 23 bp, Homo sapiens
ggtatgggctgggggctatgtat

SEQ ID NO: 592284 - DNA, 21 bp, Homo sapiens
ggtccagggaggggtccctgc

SEQ ID NO: 592285 - DNA, 13 bp, Homo sapiens
ggtcccagcctgg

SEQ ID NO: 592286 - DNA, 11 bp, Homo sapiens
ggtcccctccg

SEQ ID NO: 592287 - DNA, 19 bp, Homo sapiens
ggtccctcttctctcctca

SEQ ID NO: 592288 - DNA, 15 bp, Homo sapiens
ggtcctagtaagaag

SEQ ID NO: 592289 - DNA, 21 bp, Homo sapiens
ggtctcccttctctacactct

SEQ ID NO: 592290 - DNA, 22 bp, Homo sapiens
ggtctttaaccacttttcaatg

SEQ ID NO: 592291 - DNA, 12 bp, Homo sapiens
ggtgaactttgt

SEQ ID NO: 592292 - DNA, 19 bp, Homo sapiens
ggtgacagttcccagagtg

SEQ ID NO: 592293 - DNA, 15 bp, Homo sapiens
ggtgccctttcctgg

SEQ ID NO: 592294 - DNA, 16 bp, Homo sapiens
ggtgccctttcctggc

SEQ ID NO: 592295 - DNA, 19 bp, Homo sapiens
ggtgctgactggcttcagc

SEQ ID NO: 592296 - DNA, 19 bp, Homo sapiens
ggtggcatgtgcctatagt

SEQ ID NO: 592297 - DNA, 14 bp, Homo sapiens
ggtggctcacgcct

SEQ ID NO: 592298 - DNA, 17 bp, Homo sapiens
ggtgtaatctcaatgca

SEQ ID NO: 592299 - DNA, 15 bp, Homo sapiens
ggtgtctccttaagc

SEQ ID NO: 592300 - DNA, 13 bp, Homo sapiens
ggtgtgatggtct

SEQ ID NO: 592301 - DNA, 22 bp, Homo sapiens
ggttcatacgcatcccatctct

SEQ ID NO: 592302 - DNA, 13 bp, Homo sapiens
ggttctaaggctc

SEQ ID NO: 592303 - DNA, 21 bp, Homo sapiens
ggttgggcagccagaccagca

SEQ ID NO: 592304 - DNA, 17 bp, Homo sapiens
gtaaaacagggccacat

SEQ ID NO: 592305 - DNA, 12 bp, Homo sapiens
gtaaaagtagtg

SEQ ID NO: 592306 - DNA, 21 bp, Homo sapiens
gtaaagatgtttatttcaggc

SEQ ID NO: 592307 - DNA, 13 bp, Homo sapiens
gtaaataatttgc

SEQ ID NO: 592308 - DNA, 21 bp, Homo sapiens
gtaaataggaatcattcagaa

SEQ ID NO: 592309 - DNA, 18 bp, Homo sapiens
gtaaatgaagatctttat

SEQ ID NO: 592310 - DNA, 21 bp, Homo sapiens
gtaaatgaagatctttatatt

SEQ ID NO: 592311 - DNA, 11 bp, Homo sapiens
gtaaatgtttc

SEQ ID NO: 592312 - DNA, 17 bp, Homo sapiens
gtaaccagctcagtgtt

SEQ ID NO: 592313 - DNA, 23 bp, Homo sapiens
gtaagaacaactacctgagctaa

SEQ ID NO: 592314 - DNA, 16 bp, Homo sapiens
gtaagaagacaaactg

SEQ ID NO: 592315 - DNA, 19 bp, Homo sapiens
gtaaggatccggaaagaag

SEQ ID NO: 592316 - DNA, 12 bp, Homo sapiens
gtaatcccagca

SEQ ID NO: 592317 - DNA, 16 bp, Homo sapiens
gtaatctatgtttata

SEQ ID NO: 592318 - DNA, 19 bp, Homo sapiens
gtaatttaaatgaaagaaa

SEQ ID NO: 592319 - DNA, 12 bp, Homo sapiens
gtaatttaactt

SEQ ID NO: 592320 - DNA, 14 bp, Homo sapiens
gtacaaaattaagc

SEQ ID NO: 592321 - DNA, 23 bp, Homo sapiens
gtacgaacctacagttttaactg

SEQ ID NO: 592322 - DNA, 22 bp, Homo sapiens
gtacttgactacctactggtgt

SEQ ID NO: 592323 - DNA, 21 bp, Homo sapiens
gtactttctgttatgggcttt

SEQ ID NO: 592324 - DNA, 15 bp, Homo sapiens
gtagaggcttgttta

SEQ ID NO: 592325 - DNA, 17 bp, Homo sapiens
gtagatatgtattcttt

SEQ ID NO: 592326 - DNA, 14 bp, Homo sapiens
gtagcatcttcctc

SEQ ID NO: 592327 - DNA, 19 bp, Homo sapiens
gtagctattagcggctcct

SEQ ID NO: 592328 - DNA, 20 bp, Homo sapiens
gtagtctcactgcttgaact

SEQ ID NO: 592329 - DNA, 12 bp, Homo sapiens
gtataaatatac

SEQ ID NO: 592330 - DNA, 16 bp, Homo sapiens
gtatatgactgcattt

SEQ ID NO: 592331 - DNA, 15 bp, Homo sapiens
gtatgggctgggggc

SEQ ID NO: 592332 - DNA, 21 bp, Homo sapiens
gtatgggctgggggctatgta

SEQ ID NO: 592333 - DNA, 20 bp, Homo sapiens
gtatgtgggatattgaatgt

SEQ ID NO: 592334 - DNA, 19 bp, Homo sapiens
gtatttccttccactgtag

SEQ ID NO: 592335 - DNA, 21 bp, Homo sapiens
gtatttccttccactgtagct

SEQ ID NO: 592336 - DNA, 16 bp, Homo sapiens
gtattttcatgaaaat

SEQ ID NO: 592337 - DNA, 20 bp, Homo sapiens
gtatttttgtgaagtattca

SEQ ID NO: 592338 - DNA, 23 bp, Homo sapiens
gtatttttgtgaagtattcacaa

SEQ ID NO: 592339 - DNA, 19 bp, Homo sapiens
gtcagaatttttaactgta

SEQ ID NO: 592340 - DNA, 15 bp, Homo sapiens
gtccagcagtttcca

SEQ ID NO: 592341 - DNA, 14 bp, Homo sapiens
gtcccctatcctcc

SEQ ID NO: 592342 - DNA, 18 bp, Homo sapiens
gtcccctccgccatgggg

SEQ ID NO: 592343 - DNA, 12 bp, Homo sapiens
gtccctcttctc

SEQ ID NO: 592344 - DNA, 16 bp, Homo sapiens
gtccctcttctctcct

SEQ ID NO: 592345 - DNA, 18 bp, Homo sapiens
gtccctcttctctcctca

SEQ ID NO: 592346 - DNA, 21 bp, Homo sapiens
gtcccttcctattctcctgcc

SEQ ID NO: 592347 - DNA, 17 bp, Homo sapiens
gtcctaacaaatgctcc

SEQ ID NO: 592348 - DNA, 14 bp, Homo sapiens
gtcctagtaagaag

SEQ ID NO: 592349 - DNA, 17 bp, Homo sapiens
gtcctagtaagaagaca

SEQ ID NO: 592350 - DNA, 15 bp, Homo sapiens
gtcctatttttgtga

SEQ ID NO: 592351 - DNA, 17 bp, Homo sapiens
gtcctctttagtttttg

SEQ ID NO: 592352 - DNA, 14 bp, Homo sapiens
gtccttgatttcaa

SEQ ID NO: 592353 - DNA, 19 bp, Homo sapiens
gtccttgatttcaaagttt

SEQ ID NO: 592354 - DNA, 11 bp, Homo sapiens
gtcggctcctg

SEQ ID NO: 592355 - DNA, 13 bp, Homo sapiens
gtctaaaaacatt

SEQ ID NO: 592356 - DNA, 18 bp, Homo sapiens
gtctaccaatacaaaatg

SEQ ID NO: 592357 - DNA, 17 bp, Homo sapiens
gtctccagaagaaaatt

SEQ ID NO: 592358 - DNA, 13 bp, Homo sapiens
gtctctgccctgg

SEQ ID NO: 592359 - DNA, 22 bp, Homo sapiens
gtctctgccctgggctcctctt

SEQ ID NO: 592360 - DNA, 13 bp, Homo sapiens
gtctgatttctta

SEQ ID NO: 592361 - DNA, 20 bp, Homo sapiens
gtctggctcaaagcagcagg

SEQ ID NO: 592362 - DNA, 15 bp, Homo sapiens
gtctggttcctgtgt

SEQ ID NO: 592363 - DNA, 17 bp, Homo sapiens
gtctgtgttttgaaaga

SEQ ID NO: 592364 - DNA, 17 bp, Homo sapiens
gtcttaaactaaatgtg

SEQ ID NO: 592365 - DNA, 23 bp, Homo sapiens
gtcttagctgaggctgagaaagc

SEQ ID NO: 592366 - DNA, 16 bp, Homo sapiens
gtctttcatggctgct

SEQ ID NO: 592367 - DNA, 18 bp, Homo sapiens
gtgaagggaagagacagc

SEQ ID NO: 592368 - DNA, 15 bp, Homo sapiens
gtgaatacctgctca

SEQ ID NO: 592369 - DNA, 23 bp, Homo sapiens
gtgactgagcaagaccctgtctc

SEQ ID NO: 592370 - DNA, 16 bp, Homo sapiens
gtgagcatggggccag

SEQ ID NO: 592371 - DNA, 16 bp, Homo sapiens
gtgagccatgcctccc

SEQ ID NO: 592372 - DNA, 19 bp, Homo sapiens
gtgagtgacaaagcctctg

SEQ ID NO: 592373 - DNA, 18 bp, Homo sapiens
gtgagtgacgatgatgta

SEQ ID NO: 592374 - DNA, 17 bp, Homo sapiens
gtgatttgaaaaatata

SEQ ID NO: 592375 - DNA, 22 bp, Homo sapiens
gtgatttgaaaaatataaaatt

SEQ ID NO: 592376 - DNA, 23 bp, Homo sapiens
gtgatttgaaaaatataaaatta

SEQ ID NO: 592377 - DNA, 23 bp, Homo sapiens
gtgcagaccctgaacccacacct

SEQ ID NO: 592378 - DNA, 17 bp, Homo sapiens
gtgccaagagctactcc

SEQ ID NO: 592379 - DNA, 17 bp, Homo sapiens
gtgccctttcctggcag

SEQ ID NO: 592380 - DNA, 23 bp, Homo sapiens
gtgcctgtgagcatggggccagg

SEQ ID NO: 592381 - DNA, 12 bp, Homo sapiens
gtgctgggcaga

SEQ ID NO: 592382 - DNA, 20 bp, Homo sapiens
tcagggcctttctcctcccc

SEQ ID NO: 592383 - DNA, 23 bp, Homo sapiens
tcagggcctttctcctccccacc

SEQ ID NO: 592384 - DNA, 17 bp, Homo sapiens
tcagggtaaataggaat

SEQ ID NO: 592385 - DNA, 23 bp, Homo sapiens
tcagtaacccccttaaatttaat

SEQ ID NO: 592386 - DNA, 15 bp, Homo sapiens
tcagtatttccttcc

SEQ ID NO: 592387 - DNA, 20 bp, Homo sapiens
tcagtatttccttccactgt

SEQ ID NO: 592388 - DNA, 15 bp, Homo sapiens
tcagtgttggtatat

SEQ ID NO: 592389 - DNA, 15 bp, Homo sapiens
tcagtttgttggaaa

SEQ ID NO: 592390 - DNA, 19 bp, Homo sapiens
tcatacgcatcccatctct

SEQ ID NO: 592391 - DNA, 22 bp, Homo sapiens
tcatagtaagtgcgaagactga

SEQ ID NO: 592392 - DNA, 19 bp, Homo sapiens
tcatcagtgtgtaaataat

SEQ ID NO: 592393 - DNA, 14 bp, Homo sapiens
tcatgaaaatacca

SEQ ID NO: 592394 - DNA, 17 bp, Homo sapiens
tcatgcccaagccctga

SEQ ID NO: 592395 - DNA, 15 bp, Homo sapiens
tcatgtatttgagca

SEQ ID NO: 592396 - DNA, 14 bp, Homo sapiens
tcattcagaaatgt

SEQ ID NO: 592397 - DNA, 14 bp, Homo sapiens
tcattgacttttat

SEQ ID NO: 592398 - DNA, 21 bp, Homo sapiens
tcattgacttttataaagcat

SEQ ID NO: 592399 - DNA, 24 bp, Homo sapiens
tcattgacttttataaagcatgtt

SEQ ID NO: 592400 - DNA, 16 bp, Homo sapiens
tccaaaagtaaagatg

SEQ ID NO: 592401 - DNA, 20 bp, Homo sapiens
tccaagtctctgtgtaacca

SEQ ID NO: 592402 - DNA, 21 bp, Homo sapiens
tccaatgactgagcagcatcc

SEQ ID NO: 592403 - DNA, 14 bp, Homo sapiens
tccacagccttgca

SEQ ID NO: 592404 - DNA, 12 bp, Homo sapiens
tccactcttctc

SEQ ID NO: 592405 - DNA, 17 bp, Homo sapiens
tccactcttctctcctt

SEQ ID NO: 592406 - DNA, 19 bp, Homo sapiens
tccagagaaagcacaattt

SEQ ID NO: 592407 - DNA, 14 bp, Homo sapiens
tccagagacaacag

SEQ ID NO: 592408 - DNA, 15 bp, Homo sapiens
tccagagacaacagg

SEQ ID NO: 592409 - DNA, 16 bp, Homo sapiens
tccagagacaacaggt

SEQ ID NO: 592410 - DNA, 15 bp, Homo sapiens
tccagatagtgtagc

SEQ ID NO: 592411 - DNA, 13 bp, Homo sapiens
tccaggcaccagg

SEQ ID NO: 592412 - DNA, 20 bp, Homo sapiens
tccagggaggggtccctgca

SEQ ID NO: 592413 - DNA, 20 bp, Homo sapiens
tccataccccgccaaggaaa

SEQ ID NO: 592414 - DNA, 22 bp, Homo sapiens
tccatgtacttccctcttgaaa

SEQ ID NO: 592415 - DNA, 21 bp, Homo sapiens
tccattctgcactcagaaaat

SEQ ID NO: 592416 - DNA, 17 bp, Homo sapiens
tccattttaattttaaa

SEQ ID NO: 592417 - DNA, 12 bp, Homo sapiens
tcccaaaacaat

SEQ ID NO: 592418 - DNA, 23 bp, Homo sapiens
tcccacagcagccccaggagaag

SEQ ID NO: 592419 - DNA, 17 bp, Homo sapiens
tcccacttcctcctacc

SEQ ID NO: 592420 - DNA, 19 bp, Homo sapiens
tcccacttcctcctacctg

SEQ ID NO: 592421 - DNA, 20 bp, Homo sapiens
tcccacttcctcctacctgg

SEQ ID NO: 592422 - DNA, 16 bp, Homo sapiens
tcccagctactcagga

SEQ ID NO: 592423 - DNA, 21 bp, Homo sapiens
tcccatctctcccacttcctc

SEQ ID NO: 592424 - DNA, 16 bp, Homo sapiens
tcccccaaacagactc

SEQ ID NO: 592425 - DNA, 23 bp, Homo sapiens
tccccgataccatgctgtaagga

SEQ ID NO: 592426 - DNA, 16 bp, Homo sapiens
tccccgtctctgccct

SEQ ID NO: 592427 - DNA, 17 bp, Homo sapiens
tccccgtctctgccctg

SEQ ID NO: 592428 - DNA, 18 bp, Homo sapiens
tccccgtctctgccctgg

SEQ ID NO: 592429 - DNA, 22 bp, Homo sapiens
tccccgtctctgccctgggctc

SEQ ID NO: 592430 - DNA, 16 bp, Homo sapiens
tcccctatcctcccct

SEQ ID NO: 592431 - DNA, 18 bp, Homo sapiens
tccccttcctcttgtctg

SEQ ID NO: 592432 - DNA, 16 bp, Homo sapiens
tcccgtcttccagaga

SEQ ID NO: 592433 - DNA, 12 bp, Homo sapiens
tccctccctctc

SEQ ID NO: 592434 - DNA, 15 bp, Homo sapiens
tccctctccactctt

SEQ ID NO: 592435 - DNA, 21 bp, Homo sapiens
tccctctccactcttctctcc

SEQ ID NO: 592436 - DNA, 17 bp, Homo sapiens
tccctcttctctcctca

SEQ ID NO: 592437 - DNA, 19 bp, Homo sapiens
tccctcttctctcctcagt

SEQ ID NO: 592438 - DNA, 15 bp, Homo sapiens
tccctgaggactgat

SEQ ID NO: 592439 - DNA, 20 bp, Homo sapiens
tccctgaggactgatttcag

SEQ ID NO: 592440 - DNA, 21 bp, Homo sapiens
tccctgcaaaactccaggcag

SEQ ID NO: 592441 - DNA, 14 bp, Homo sapiens
tccctgggccacct

SEQ ID NO: 592442 - DNA, 16 bp, Homo sapiens
tccctgggccacctcc

SEQ ID NO: 592443 - DNA, 18 bp, Homo sapiens
tcctaaaagttctcaatg

SEQ ID NO: 592444 - DNA, 14 bp, Homo sapiens
tcctaccccttcct

SEQ ID NO: 592445 - DNA, 15 bp, Homo sapiens
tcctaccccttcctg

SEQ ID NO: 592446 - DNA, 18 bp, Homo sapiens
tcctaccccttcctgtcc

SEQ ID NO: 592447 - DNA, 20 bp, Homo sapiens
tcctacctggggactcctca

SEQ ID NO: 592448 - DNA, 21 bp, Homo sapiens
tcctacctggggactcctcaa

SEQ ID NO: 592449 - DNA, 13 bp, Homo sapiens
tcctactttctat

SEQ ID NO: 592450 - DNA, 21 bp, Homo sapiens
tcctactttctatttttatga

SEQ ID NO: 592451 - DNA, 22 bp, Homo sapiens
tcctactttctatttttatgat

SEQ ID NO: 592452 - DNA, 18 bp, Homo sapiens
tcctattctataaaactc

SEQ ID NO: 592453 - DNA, 13 bp, Homo sapiens
tcctattctcctg

SEQ ID NO: 592454 - DNA, 15 bp, Homo sapiens
tcctatttttgtgaa

SEQ ID NO: 592455 - DNA, 17 bp, Homo sapiens
tcctcaaaccacttgcc

SEQ ID NO: 592456 - DNA, 19 bp, Homo sapiens
tcctcaaaccacttgcctg

SEQ ID NO: 592457 - DNA, 13 bp, Homo sapiens
tcctcatcagtgt

SEQ ID NO: 592458 - DNA, 22 bp, Homo sapiens
tcctcatggcagcctactctcc

SEQ ID NO: 592459 - DNA, 12 bp, Homo sapiens
tcctccccacct

SEQ ID NO: 592460 - DNA, 18 bp, Homo sapiens
tcctccccacctgtagct

SEQ ID NO: 592461 - DNA, 22 bp, Homo sapiens
tcctccccttttaccactccca

SEQ ID NO: 592462 - DNA, 16 bp, Homo sapiens
tcctcctacctgggga

SEQ ID NO: 592463 - DNA, 12 bp, Homo sapiens
tcctcgagccct

SEQ ID NO: 592464 - DNA, 20 bp, Homo sapiens
tcctcgcccccaccagtgta

SEQ ID NO: 592465 - DNA, 16 bp, Homo sapiens
tcctcttagctcagct

SEQ ID NO: 592466 - DNA, 20 bp, Homo sapiens
tcctcttgtctgatttctta

SEQ ID NO: 592467 - DNA, 18 bp, Homo sapiens
tcctctttagtttttggt

SEQ ID NO: 592468 - DNA, 19 bp, Homo sapiens
tcctctttagtttttggtt

SEQ ID NO: 592469 - DNA, 17 bp, Homo sapiens
tcctgatggacctgccc

SEQ ID NO: 592470 - DNA, 24 bp, Homo sapiens
tcctgatggtgtcattctgcctgc

SEQ ID NO: 592471 - DNA, 20 bp, Homo sapiens
tcctgcaaaaggaggtgaaa

SEQ ID NO: 592472 - DNA, 17 bp, Homo sapiens
tcctgcaggcaggaaca

SEQ ID NO: 592473 - DNA, 13 bp, Homo sapiens
tcctgcctcctca

SEQ ID NO: 592474 - DNA, 14 bp, Homo sapiens
tcctgcgttttctc

SEQ ID NO: 592475 - DNA, 22 bp, Homo sapiens
tcctgcgttttctccgggtcct

SEQ ID NO: 592476 - DNA, 10 bp, Homo sapiens
tcctggcagt

SEQ ID NO: 592477 - DNA, 19 bp, Homo sapiens
tcctggcagtctcagtcca

SEQ ID NO: 592478 - DNA, 14 bp, Homo sapiens
tcctgtcctgcctc

SEQ ID NO: 592479 - DNA, 17 bp, Homo sapiens
tcctgtcctgcctcctc

SEQ ID NO: 592480 - DNA, 18 bp, Homo sapiens
tcctgtggagatgacttg

SEQ ID NO: 592481 - DNA, 19 bp, Homo sapiens
tcctgtggcataaattgca

SEQ ID NO: 592482 - DNA, 13 bp, Homo sapiens
tccttaaaatgtg

SEQ ID NO: 592483 - DNA, 17 bp, Homo sapiens
tccttaagctgcagaga

SEQ ID NO: 592484 - DNA, 21 bp, Homo sapiens
taggttctgtagagccaatta

SEQ ID NO: 592485 - DNA, 18 bp, Homo sapiens
tagtaagaagacaaactg

SEQ ID NO: 592486 - DNA, 12 bp, Homo sapiens
tagtaagcatag

SEQ ID NO: 592487 - DNA, 15 bp, Homo sapiens
tagtaagcatagaaa

SEQ ID NO: 592488 - DNA, 18 bp, Homo sapiens
tctaaccaaggctgtgtt

SEQ ID NO: 592489 - DNA, 16 bp, Homo sapiens
tctaagactatatata

SEQ ID NO: 592490 - DNA, 19 bp, Homo sapiens
tctaagtagggccagggca

SEQ ID NO: 592491 - DNA, 20 bp, Homo sapiens
tctactaaaaatacaaaaat

SEQ ID NO: 592492 - DNA, 21 bp, Homo sapiens
tctagagcttaatgctacatg

SEQ ID NO: 592493 - DNA, 12 bp, Homo sapiens
tctataaaactc

SEQ ID NO: 592494 - DNA, 16 bp, Homo sapiens
tctatccttccagaaa

SEQ ID NO: 592495 - DNA, 12 bp, Homo sapiens
tctatttttatg

SEQ ID NO: 592496 - DNA, 14 bp, Homo sapiens
tctatttttatgat

SEQ ID NO: 592497 - DNA, 18 bp, Homo sapiens
tctatttttatgatgaca

SEQ ID NO: 592498 - DNA, 21 bp, Homo sapiens
tctcaatgaaccataaattca

SEQ ID NO: 592499 - DNA, 14 bp, Homo sapiens
tctcactgcttgaa

SEQ ID NO: 592500 - DNA, 17 bp, Homo sapiens
tctcagtggtgtgtgaa

SEQ ID NO: 592501 - DNA, 19 bp, Homo sapiens
tctcagtggtgtgtgaagt

SEQ ID NO: 592502 - DNA, 14 bp, Homo sapiens
tctcataatgcttt

SEQ ID NO: 592503 - DNA, 17 bp, Homo sapiens
tctccacaggagagact

SEQ ID NO: 592504 - DNA, 16 bp, Homo sapiens
tctccactcttctctc

SEQ ID NO: 592505 - DNA, 19 bp, Homo sapiens
tctccatggggaggcctca

SEQ ID NO: 592506 - DNA, 13 bp, Homo sapiens
tctcccacttcct

SEQ ID NO: 592507 - DNA, 19 bp, Homo sapiens
tctcccacttcctcctacc

SEQ ID NO: 592508 - DNA, 21 bp, Homo sapiens
tctcccacttcctcctacctg

SEQ ID NO: 592509 - DNA, 13 bp, Homo sapiens
tctcccagtctct

SEQ ID NO: 592510 - DNA, 16 bp, Homo sapiens
tctccctagctcctcc

SEQ ID NO: 592511 - DNA, 15 bp, Homo sapiens
tctccgggtcctcct

SEQ ID NO: 592512 - DNA, 15 bp, Homo sapiens
tctcctccccacctg

SEQ ID NO: 592513 - DNA, 17 bp, Homo sapiens
tctcctccccacctgta

SEQ ID NO: 592514 - DNA, 20 bp, Homo sapiens
tctcctccccacctgtagct

SEQ ID NO: 592515 - DNA, 12 bp, Homo sapiens
tctccttaagct

SEQ ID NO: 592516 - DNA, 15 bp, Homo sapiens
tctcctttctccctg

SEQ ID NO: 592517 - DNA, 17 bp, Homo sapiens
tctctaaggtttacaat

SEQ ID NO: 592518 - DNA, 18 bp, Homo sapiens
tctctcctttctccctgc

SEQ ID NO: 592519 - DNA, 12 bp, Homo sapiens
tctctgcctctc

SEQ ID NO: 592520 - DNA, 15 bp, Homo sapiens
tctctgtcgtggagc

SEQ ID NO: 592521 - DNA, 22 bp, Homo sapiens
tctcttcttcccctttgtcctg

SEQ ID NO: 592522 - DNA, 12 bp, Homo sapiens
tctctttttgtt

SEQ ID NO: 592523 - DNA, 23 bp, Homo sapiens
tctgaaaagtgtgtatatatttt

SEQ ID NO: 592524 - DNA, 23 bp, Homo sapiens
tctgacctggcatctaattctga

SEQ ID NO: 592525 - DNA, 16 bp, Homo sapiens
tctgatcggccagttt

SEQ ID NO: 592526 - DNA, 22 bp, Homo sapiens
tctgattgatttgattgggatg

SEQ ID NO: 592527 - DNA, 15 bp, Homo sapiens
tctgcatggattcag

SEQ ID NO: 592528 - DNA, 16 bp, Homo sapiens
tctgcctctcttcttc

SEQ ID NO: 592529 - DNA, 18 bp, Homo sapiens
tctggaagcccctgggcc

SEQ ID NO: 592530 - DNA, 16 bp, Homo sapiens
tctggagggaaacacc

SEQ ID NO: 592531 - DNA, 21 bp, Homo sapiens
tctggatcccgttcagaaaac

SEQ ID NO: 592532 - DNA, 12 bp, Homo sapiens
tctggcagatga

SEQ ID NO: 592533 - DNA, 22 bp, Homo sapiens
tctggtccctcttctctcctca

SEQ ID NO: 592534 - DNA, 23 bp, Homo sapiens
tctggtccctcttctctcctcag

SEQ ID NO: 592535 - DNA, 22 bp, Homo sapiens
tctgtacaaaatggtcctattt

SEQ ID NO: 592536 - DNA, 22 bp, Homo sapiens
tctgtactaaacagtaagatat

SEQ ID NO: 592537 - DNA, 14 bp, Homo sapiens
tctgtagagccaat

SEQ ID NO: 592538 - DNA, 18 bp, Homo sapiens
tctgtcgtggagccattg

SEQ ID NO: 592539 - DNA, 23 bp, Homo sapiens
tctgtgtaaccagctcagtgttt

SEQ ID NO: 592540 - DNA, 21 bp, Homo sapiens
tcttacaatattgattgggaa

SEQ ID NO: 592541 - DNA, 15 bp, Homo sapiens
tcttatttatagaat

SEQ ID NO: 592542 - DNA, 17 bp, Homo sapiens
tcttcccctttgtcctg

SEQ ID NO: 592543 - DNA, 17 bp, Homo sapiens
tcttcctatccctctcc

SEQ ID NO: 592544 - DNA, 19 bp, Homo sapiens
tcttcctatccctctccta

SEQ ID NO: 592545 - DNA, 19 bp, Homo sapiens
tcttctagtgatgatggtt

SEQ ID NO: 592546 - DNA, 12 bp, Homo sapiens
tcttctctcctc

SEQ ID NO: 592547 - DNA, 19 bp, Homo sapiens
tcttctctcctcagtttct

SEQ ID NO: 592548 - DNA, 22 bp, Homo sapiens
tcttctggtactttctgttatg

SEQ ID NO: 592549 - DNA, 18 bp, Homo sapiens
tcttgccatcctgatgga

SEQ ID NO: 592550 - DNA, 12 bp, Homo sapiens
tctttagttttt

SEQ ID NO: 592551 - DNA, 22 bp, Homo sapiens
tctttagtttttggttgggaat

SEQ ID NO: 592552 - DNA, 18 bp, Homo sapiens
tctttcagaaatataaca

SEQ ID NO: 592553 - DNA, 23 bp, Homo sapiens
tctttcagaaatataacacattt

SEQ ID NO: 592554 - DNA, 17 bp, Homo sapiens
tctttcctactttctat

SEQ ID NO: 592555 - DNA, 18 bp, Homo sapiens
tctttgcgtttccttttt

SEQ ID NO: 592556 - DNA, 18 bp, Homo sapiens
tcttttaaagaccctcct

SEQ ID NO: 592557 - DNA, 14 bp, Homo sapiens
tcttttgaagcata

SEQ ID NO: 592558 - DNA, 12 bp, Homo sapiens
tctttttgtttg

SEQ ID NO: 592559 - DNA, 12 bp, Homo sapiens
tcttttttaacc

SEQ ID NO: 592560 - DNA, 17 bp, Homo sapiens
tcttttttagtgttaaa

SEQ ID NO: 592561 - DNA, 12 bp, Homo sapiens
tgaaaaatataa

SEQ ID NO: 592562 - DNA, 23 bp, Homo sapiens
tgaaacttctcagtccagcagtt

SEQ ID NO: 592563 - DNA, 15 bp, Homo sapiens
tgaaagaaaattgag

SEQ ID NO: 592564 - DNA, 20 bp, Homo sapiens
tgaaagaatagaacacagtt

SEQ ID NO: 592565 - DNA, 20 bp, Homo sapiens
tgaaatccctgcctcaggcc

SEQ ID NO: 592566 - DNA, 17 bp, Homo sapiens
tgaaatgaactttgtca

SEQ ID NO: 592567 - DNA, 13 bp, Homo sapiens
tgaacagctgtga

SEQ ID NO: 592568 - DNA, 22 bp, Homo sapiens
tgaacagctgtgagccatgcct

SEQ ID NO: 592569 - DNA, 17 bp, Homo sapiens
tgaacataacttctcat

SEQ ID NO: 592570 - DNA, 21 bp, Homo sapiens
tgaacataacttctcatgtat

SEQ ID NO: 592571 - DNA, 23 bp, Homo sapiens
tgaacataacttctcatgtatat

SEQ ID NO: 592572 - DNA, 22 bp, Homo sapiens
tgaaccataaattcaactttgt

SEQ ID NO: 592573 - DNA, 21 bp, Homo sapiens
tgaaccctcttgccatcctga

SEQ ID NO: 592574 - DNA, 22 bp, Homo sapiens
tgaaccctcttgccatcctgat

SEQ ID NO: 592575 - DNA, 14 bp, Homo sapiens
tgaactttgtcagt

SEQ ID NO: 592576 - DNA, 18 bp, Homo sapiens
tgaactttgtcagtgttg

SEQ ID NO: 592577 - DNA, 17 bp, Homo sapiens
tgaagatctttatattt

SEQ ID NO: 592578 - DNA, 17 bp, Homo sapiens
tgaagcatagataatat

SEQ ID NO: 592579 - DNA, 16 bp, Homo sapiens
tgaagtatgaagtctg

SEQ ID NO: 592580 - DNA, 21 bp, Homo sapiens
tgaatagatatgaaagctgat

SEQ ID NO: 592581 - DNA, 13 bp, Homo sapiens
tgaatgaatggga

SEQ ID NO: 592582 - DNA, 19 bp, Homo sapiens
tgaatgcctatggtggatc

SEQ ID NO: 592583 - DNA, 17 bp, Homo sapiens
tgaatgtccaaaattta

SEQ ID NO: 592584 - DNA, 17 bp, Homo sapiens
tgaatgtgtgagaaaaa

SEQ ID NO: 592585 - DNA, 12 bp, Homo sapiens
tgaattcagtaa

SEQ ID NO: 592586 - DNA, 19 bp, Homo sapiens
tgaatttgtatatgactgc

SEQ ID NO: 592587 - DNA, 13 bp, Homo sapiens
ttggtgctttgca

SEQ ID NO: 592588 - DNA, 22 bp, Homo sapiens
ttgtaaaaatcttttgaagcat

SEQ ID NO: 592589 - DNA, 11 bp, Homo sapiens
ttgtaaataaa

SEQ ID NO: 592590 - DNA, 18 bp, Homo sapiens
ttgtattttgattatttt

SEQ ID NO: 592591 - DNA, 17 bp, Homo sapiens
ttgtccaggaagtcaga

SEQ ID NO: 592592 - DNA, 9 bp, Homo sapiens
ttgtcctgc

SEQ ID NO: 592593 - DNA, 20 bp, Homo sapiens
ttgtctaagtagggccaggg

SEQ ID NO: 592594 - DNA, 21 bp, Homo sapiens
ttgtgaccagaaagcttcatc

SEQ ID NO: 592595 - DNA, 20 bp, Homo sapiens
ttgtggggctggaaggacct

SEQ ID NO: 592596 - DNA, 16 bp, Homo sapiens
ttgtgtgaaattgcat

SEQ ID NO: 592597 - DNA, 13 bp, Homo sapiens
ttgtgtggattct

SEQ ID NO: 592598 - DNA, 19 bp, Homo sapiens
ttgtgtggtctggttcctg

SEQ ID NO: 592599 - DNA, 16 bp, Homo sapiens
ttgttacgtagcctaa

SEQ ID NO: 592600 - DNA, 11 bp, Homo sapiens
ttgttgcactg

SEQ ID NO: 592601 - DNA, 13 bp, Homo sapiens
ttgtttgccagga

SEQ ID NO: 592602 - DNA, 12 bp, Homo sapiens
ttgtttggagac

SEQ ID NO: 592603 - DNA, 21 bp, Homo sapiens
ttgtttggagacgtttataaa

SEQ ID NO: 592604 - DNA, 12 bp, Homo sapiens
tttaaaaaataa

SEQ ID NO: 592605 - DNA, 22 bp, Homo sapiens
tttaaaacgtgtaaatgaagat

SEQ ID NO: 592606 - DNA, 14 bp, Homo sapiens
tttaaaagcctgct

SEQ ID NO: 592607 - DNA, 12 bp, Homo sapiens
tttaactgccgt

SEQ ID NO: 592608 - DNA, 12 bp, Homo sapiens
tttaactgtgat

SEQ ID NO: 592609 - DNA, 18 bp, Homo sapiens
tttaagccttcaaaacta

SEQ ID NO: 592610 - DNA, 14 bp, Homo sapiens
tttaagcttcagtt

SEQ ID NO: 592611 - DNA, 14 bp, Homo sapiens
tttaagtgtgctgg

SEQ ID NO: 592612 - DNA, 13 bp, Homo sapiens
tttaatatatata

SEQ ID NO: 592613 - DNA, 23 bp, Homo sapiens
tttactgtctattaatattcagg

SEQ ID NO: 592614 - DNA, 13 bp, Homo sapiens
tttagcaccccca

SEQ ID NO: 592615 - DNA, 23 bp, Homo sapiens
tttagtgggggatgggtcctcta

SEQ ID NO: 592616 - DNA, 22 bp, Homo sapiens
tttataaaagtgttcattgttt

SEQ ID NO: 592617 - DNA, 23 bp, Homo sapiens
tttataaacagaaatggaaagca

SEQ ID NO: 592618 - DNA, 15 bp, Homo sapiens
tttataattgtacaa

SEQ ID NO: 592619 - DNA, 22 bp, Homo sapiens
tttatagaatttaatatatata

SEQ ID NO: 592620 - DNA, 18 bp, Homo sapiens
tttatattactgacattt

SEQ ID NO: 592621 - DNA, 12 bp, Homo sapiens
tttcaaagtttt

SEQ ID NO: 592622 - DNA, 20 bp, Homo sapiens
tttcaaagttttgttgtact

SEQ ID NO: 592623 - DNA, 14 bp, Homo sapiens
tttcaataaatgat

SEQ ID NO: 592624 - DNA, 19 bp, Homo sapiens
tttcaatgtctaaaaacat

SEQ ID NO: 592625 - DNA, 14 bp, Homo sapiens
tttcagaaatataa

SEQ ID NO: 592626 - DNA, 21 bp, Homo sapiens
tttcagaaatataacacattt

SEQ ID NO: 592627 - DNA, 13 bp, Homo sapiens
tttcatattgtaa

SEQ ID NO: 592628 - DNA, 14 bp, Homo sapiens
tttcatgaaaatac

SEQ ID NO: 592629 - DNA, 16 bp, Homo sapiens
tttcatgattagaaat

SEQ ID NO: 592630 - DNA, 17 bp, Homo sapiens
tttccctccagagaaag

SEQ ID NO: 592631 - DNA, 12 bp, Homo sapiens
tttccttccact

SEQ ID NO: 592632 - DNA, 20 bp, Homo sapiens
tttctcagtgttggtatatt

SEQ ID NO: 592633 - DNA, 17 bp, Homo sapiens
tttctccgggtcctcct

SEQ ID NO: 592634 - DNA, 15 bp, Homo sapiens
tttctctataaagta

SEQ ID NO: 592635 - DNA, 11 bp, Homo sapiens
tttctcttgct

SEQ ID NO: 592636 - DNA, 12 bp, Homo sapiens
tttctggtccct

SEQ ID NO: 592637 - DNA, 9 bp, Homo sapiens
tttcttttc

SEQ ID NO: 592638 - DNA, 21 bp, Homo sapiens
tttgaaaaatataaaattatg

SEQ ID NO: 592639 - DNA, 15 bp, Homo sapiens
tttgaactttggaac

SEQ ID NO: 592640 - DNA, 17 bp, Homo sapiens
tttgacaggttttccaa

SEQ ID NO: 592641 - DNA, 17 bp, Homo sapiens
tttgataatgacactgt

SEQ ID NO: 592642 - DNA, 18 bp, Homo sapiens
tttgataatgacactgtt

SEQ ID NO: 592643 - DNA, 16 bp, Homo sapiens
tttgcaaagaccacct

SEQ ID NO: 592644 - DNA, 17 bp, Homo sapiens
tttgccaggacatgcaa

SEQ ID NO: 592645 - DNA, 13 bp, Homo sapiens
tttgcctcctgga

SEQ ID NO: 592646 - DNA, 19 bp, Homo sapiens
tttggatgttgtaaataaa

SEQ ID NO: 592647 - DNA, 15 bp, Homo sapiens
tttggattctaaata

SEQ ID NO: 592648 - DNA, 18 bp, Homo sapiens
tttggattctaaatacat

SEQ ID NO: 592649 - DNA, 19 bp, Homo sapiens
tttggattctaaatacatg

SEQ ID NO: 592650 - DNA, 20 bp, Homo sapiens
tttgtataaaagtgtgaaat

SEQ ID NO: 592651 - DNA, 14 bp, Homo sapiens
tttgtattttcatg

SEQ ID NO: 592652 - DNA, 18 bp, Homo sapiens
tttgtgaagtattcacaa

SEQ ID NO: 592653 - DNA, 18 bp, Homo sapiens
tttgttgtacttaaatgg

SEQ ID NO: 592654 - DNA, 14 bp, Homo sapiens
ttttaaaacgtgta

SEQ ID NO: 592655 - DNA, 13 bp, Homo sapiens
ttttaaagtgcaa

SEQ ID NO: 592656 - DNA, 14 bp, Homo sapiens
ttttaaagtgcaaa

SEQ ID NO: 592657 - DNA, 22 bp, Homo sapiens
ttttaaccggtaagagtttcag

SEQ ID NO: 592658 - DNA, 13 bp, Homo sapiens
ttttactgtctat

SEQ ID NO: 592659 - DNA, 12 bp, Homo sapiens
ttttataaagca

SEQ ID NO: 592660 - DNA, 16 bp, Homo sapiens
ttttcaatgtctaaaa

SEQ ID NO: 592661 - DNA, 16 bp, Homo sapiens
ttttccaaaagtaaag

SEQ ID NO: 592662 - DNA, 20 bp, Homo sapiens
ttttccacattccagtgatg

SEQ ID NO: 592663 - DNA, 14 bp, Homo sapiens
ttttctttaactgc

SEQ ID NO: 592664 - DNA, 18 bp, Homo sapiens
ttttctttaactgccgta

SEQ ID NO: 592665 - DNA, 18 bp, Homo sapiens
ttttgtattttcatgaaa

SEQ ID NO: 592666 - DNA, 14 bp, Homo sapiens
ttttgtgaagtatt

SEQ ID NO: 592667 - DNA, 15 bp, Homo sapiens
ttttgtgtgaaattg

SEQ ID NO: 592668 - DNA, 14 bp, Homo sapiens
ctagcctatgtctg

SEQ ID NO: 592669 - DNA, 16 bp, Homo sapiens
ctagcctatgtctggc

SEQ ID NO: 592670 - DNA, 17 bp, Homo sapiens
ctagcctatgtctggca

SEQ ID NO: 592671 - DNA, 18 bp, Homo sapiens
ctagcctatgtctggcag

SEQ ID NO: 592672 - DNA, 20 bp, Homo sapiens
ctaggacacagttcctggga

SEQ ID NO: 592673 - DNA, 14 bp, Homo sapiens
ctaggtacgatgac

SEQ ID NO: 592674 - DNA, 13 bp, Homo sapiens
ctataaaactctg

SEQ ID NO: 592675 - DNA, 15 bp, Homo sapiens
ctataagatgaaaca

SEQ ID NO: 592676 - DNA, 15 bp, Homo sapiens
ctatagcttgcagaa

SEQ ID NO: 592677 - DNA, 17 bp, Homo sapiens
ctatatagacttggaga

SEQ ID NO: 592678 - DNA, 13 bp, Homo sapiens
ctatccacactgt

SEQ ID NO: 592679 - DNA, 23 bp, Homo sapiens
ctatcctccccttttaccactcc

SEQ ID NO: 592680 - DNA, 18 bp, Homo sapiens
ctatctagttctaacagt

SEQ ID NO: 592681 - DNA, 12 bp, Homo sapiens
ctatctgtattc

SEQ ID NO: 592682 - DNA, 17 bp, Homo sapiens
ctatctgtattcccaaa

SEQ ID NO: 592683 - DNA, 18 bp, Homo sapiens
ctatcttctttggacttc

SEQ ID NO: 592684 - DNA, 20 bp, Homo sapiens
ctatcttttttagtgttaaa

SEQ ID NO: 592685 - DNA, 21 bp, Homo sapiens
ctatcttttttagtgttaaag

SEQ ID NO: 592686 - DNA, 16 bp, Homo sapiens
ctatgactgtatcttg

SEQ ID NO: 592687 - DNA, 14 bp, Homo sapiens
ctatgtctggcaga

SEQ ID NO: 592688 - DNA, 22 bp, Homo sapiens
ctatgtctggcagatgagggct

SEQ ID NO: 592689 - DNA, 17 bp, Homo sapiens
ctattagcggctcctcg

SEQ ID NO: 592690 - DNA, 16 bp, Homo sapiens
ctattatttttataat

SEQ ID NO: 592691 - DNA, 18 bp, Homo sapiens
ctattatttttataattg

SEQ ID NO: 592692 - DNA, 15 bp, Homo sapiens
ctatttattgtgctg

SEQ ID NO: 592693 - DNA, 14 bp, Homo sapiens
ctatttgtgacttt

SEQ ID NO: 592694 - DNA, 17 bp, Homo sapiens
ctatttgtgacttttta

SEQ ID NO: 592695 - DNA, 19 bp, Homo sapiens
ctatttttatgatgacaat

SEQ ID NO: 592696 - DNA, 14 bp, Homo sapiens
ctatttttgtgaag

SEQ ID NO: 592697 - DNA, 20 bp, Homo sapiens
ctcaaagatgcgtttgcctc

SEQ ID NO: 592698 - DNA, 21 bp, Homo sapiens
ctcaatgcaagccccaacttt

SEQ ID NO: 592699 - DNA, 22 bp, Homo sapiens
ctcaatgcaagccccaactttc

SEQ ID NO: 592700 - DNA, 20 bp, Homo sapiens
cccatagcagccagttcaaa

SEQ ID NO: 592701 - DNA, 15 bp, Homo sapiens
cccatctctcccact

SEQ ID NO: 592702 - DNA, 20 bp, Homo sapiens
ccccacaggcacattaactg

SEQ ID NO: 592703 - DNA, 21 bp, Homo sapiens
ccccacaggcacattaactgt

SEQ ID NO: 592704 - DNA, 22 bp, Homo sapiens
ccccacaggcacattaactgtt

SEQ ID NO: 592705 - DNA, 11 bp, Homo sapiens
ccccacctgta

SEQ ID NO: 592706 - DNA, 20 bp, Homo sapiens
ccccactttcaagaatcaga

SEQ ID NO: 592707 - DNA, 22 bp, Homo sapiens
ccccagggacagggccctggag

SEQ ID NO: 592708 - DNA, 14 bp, Homo sapiens
ccccggacctacct

SEQ ID NO: 592709 - DNA, 15 bp, Homo sapiens
ccccttcctgtcctg

SEQ ID NO: 592710 - DNA, 17 bp, Homo sapiens
ccccttcctgtcctgcc

SEQ ID NO: 592711 - DNA, 18 bp, Homo sapiens
ccccttcctgtcctgcct

SEQ ID NO: 592712 - DNA, 23 bp, Homo sapiens
ccccttcctgtcctgcctcctca

SEQ ID NO: 592713 - DNA, 16 bp, Homo sapiens
ccccttgttgcactgc

SEQ ID NO: 592714 - DNA, 13 bp, Homo sapiens
cccctttgtcctg

SEQ ID NO: 592715 - DNA, 14 bp, Homo sapiens
cccctttgtcctgc

SEQ ID NO: 592716 - DNA, 15 bp, Homo sapiens
cccctttgtcctgcg

SEQ ID NO: 592717 - DNA, 14 bp, Homo sapiens
ccccttttaccact

SEQ ID NO: 592718 - DNA, 14 bp, Homo sapiens
cccggacctacctc

SEQ ID NO: 592719 - DNA, 13 bp, Homo sapiens
cccgtctctgccc

SEQ ID NO: 592720 - DNA, 14 bp, Homo sapiens
ccctatcctcccct

SEQ ID NO: 592721 - DNA, 14 bp, Homo sapiens
ccctatctgtattc

SEQ ID NO: 592722 - DNA, 23 bp, Homo sapiens
ccctccagagaaagcacaattta

SEQ ID NO: 592723 - DNA, 13 bp, Homo sapiens
ccctcctgagggc

SEQ ID NO: 592724 - DNA, 19 bp, Homo sapiens
ccctgaggcctagactctg

SEQ ID NO: 592725 - DNA, 13 bp, Homo sapiens
ccctgggccacct

SEQ ID NO: 592726 - DNA, 19 bp, Homo sapiens
ccctgggccacctcctacc

SEQ ID NO: 592727 - DNA, 12 bp, Homo sapiens
ccctgggctcct

SEQ ID NO: 592728 - DNA, 15 bp, Homo sapiens
ccctgggctcctctt

SEQ ID NO: 592729 - DNA, 21 bp, Homo sapiens
cccttcctattctcctgccat

SEQ ID NO: 592730 - DNA, 20 bp, Homo sapiens
cccttcctcttgtctgattt

SEQ ID NO: 592731 - DNA, 12 bp, Homo sapiens
ccctttcctggc

SEQ ID NO: 592732 - DNA, 12 bp, Homo sapiens
ccctttgtcctg

SEQ ID NO: 592733 - DNA, 21 bp, Homo sapiens
ccgcggttcatacgcatccca

SEQ ID NO: 592734 - DNA, 13 bp, Homo sapiens
ccggacctacctc

SEQ ID NO: 592735 - DNA, 15 bp, Homo sapiens
ccggacctacctccc

SEQ ID NO: 592736 - DNA, 17 bp, Homo sapiens
ccggatgaaacttctca

SEQ ID NO: 592737 - DNA, 16 bp, Homo sapiens
ccgggcaccaggggcc

SEQ ID NO: 592738 - DNA, 16 bp, Homo sapiens
ccgggggaggggcgcg

SEQ ID NO: 592739 - DNA, 12 bp, Homo sapiens
ccgtctctgccc

SEQ ID NO: 592740 - DNA, 16 bp, Homo sapiens
cttaaatttaatacca

SEQ ID NO: 592741 - DNA, 22 bp, Homo sapiens
cttaagtcctaaaagttctcaa

SEQ ID NO: 592742 - DNA, 18 bp, Homo sapiens
cttaatttaactttccag

SEQ ID NO: 592743 - DNA, 21 bp, Homo sapiens
cttacaatattgattgggaaa

SEQ ID NO: 592744 - DNA, 13 bp, Homo sapiens
cttactttgctga

SEQ ID NO: 592745 - DNA, 12 bp, Homo sapiens
cttagcatggta

SEQ ID NO: 592746 - DNA, 14 bp, Homo sapiens
cttagcatggtacc

SEQ ID NO: 592747 - DNA, 22 bp, Homo sapiens
cttagctgaggctgagaaagct

SEQ ID NO: 592748 - DNA, 21 bp, Homo sapiens
cttatagtctaagactatata

SEQ ID NO: 592749 - DNA, 14 bp, Homo sapiens
cttatccaactttt

SEQ ID NO: 592750 - DNA, 20 bp, Homo sapiens
cttattatgtaggtaagact

SEQ ID NO: 592751 - DNA, 20 bp, Homo sapiens
cttattttgttggtgctttg

SEQ ID NO: 592752 - DNA, 13 bp, Homo sapiens
cttcagaggctga

SEQ ID NO: 592753 - DNA, 16 bp, Homo sapiens
cttcagaggctgaggt

SEQ ID NO: 592754 - DNA, 16 bp, Homo sapiens
cttcagcattgtaatt

SEQ ID NO: 592755 - DNA, 23 bp, Homo sapiens
cttcagcattgtaattatgtaaa

SEQ ID NO: 592756 - DNA, 14 bp, Homo sapiens
cttcagttgcttgt

SEQ ID NO: 592757 - DNA, 23 bp, Homo sapiens
cttcagtttaatgtctcctttgc

SEQ ID NO: 592758 - DNA, 12 bp, Homo sapiens
cttccactgtag

SEQ ID NO: 592759 - DNA, 16 bp, Homo sapiens
cttccactgtagctat

SEQ ID NO: 592760 - DNA, 18 bp, Homo sapiens
cttccactgtagctatta

SEQ ID NO: 592761 - DNA, 13 bp, Homo sapiens
cttccacttctgg

SEQ ID NO: 592762 - DNA, 22 bp, Homo sapiens
cttccagagaacctgtgggctg

SEQ ID NO: 592763 - DNA, 19 bp, Homo sapiens
ctgaaactcatagacactg

SEQ ID NO: 592764 - DNA, 19 bp, Homo sapiens
ctgaacataacttctcatg

SEQ ID NO: 592765 - DNA, 14 bp, Homo sapiens
ctgaaccaggccag

SEQ ID NO: 592766 - DNA, 17 bp, Homo sapiens
ctgaacccacacctggg

SEQ ID NO: 592767 - DNA, 17 bp, Homo sapiens
ctgaagaactctctgga

SEQ ID NO: 592768 - DNA, 13 bp, Homo sapiens
ctgaagtatgaag

SEQ ID NO: 592769 - DNA, 18 bp, Homo sapiens
ctgaattatctatttcat

SEQ ID NO: 592770 - DNA, 17 bp, Homo sapiens
ctgaatttgtatatgac

SEQ ID NO: 592771 - DNA, 14 bp, Homo sapiens
ctgactcagtgacc

SEQ ID NO: 592772 - DNA, 20 bp, Homo sapiens
ctgactcagtgaccagtgcc

SEQ ID NO: 592773 - DNA, 14 bp, Homo sapiens
ctgacttaggtttc

SEQ ID NO: 592774 - DNA, 13 bp, Homo sapiens
ctgagaagctctg

SEQ ID NO: 592775 - DNA, 15 bp, Homo sapiens
ctgagcatggagaca

SEQ ID NO: 592776 - DNA, 20 bp, Homo sapiens
ctgagcatggagacagcagt

SEQ ID NO: 592777 - DNA, 21 bp, Homo sapiens
ctgagccagattggccaatta

SEQ ID NO: 592778 - DNA, 17 bp, Homo sapiens
ctgaggcctagactctg

SEQ ID NO: 592779 - DNA, 19 bp, Homo sapiens
ctgaggcctagactctgtc

SEQ ID NO: 592780 - DNA, 20 bp, Homo sapiens
ctgatactttgacagtgttt

SEQ ID NO: 592781 - DNA, 16 bp, Homo sapiens
ctgatgggtgcccttt

SEQ ID NO: 592782 - DNA, 20 bp, Homo sapiens
ctgatggtgtcattctgcct

SEQ ID NO: 592783 - DNA, 21 bp, Homo sapiens
ctgatggtgtcattctgcctg

SEQ ID NO: 592784 - DNA, 21 bp, Homo sapiens
ctgatgtcagctgctgttgaa

SEQ ID NO: 592785 - DNA, 22 bp, Homo sapiens
ctgattctggctttaagccttc

SEQ ID NO: 592786 - DNA, 14 bp, Homo sapiens
ctgcaaaaagaaaa

SEQ ID NO: 592787 - DNA, 15 bp, Homo sapiens
ctgcaaaaattatat

SEQ ID NO: 592788 - DNA, 15 bp, Homo sapiens
ctgcaaaactccagg

SEQ ID NO: 592789 - DNA, 18 bp, Homo sapiens
ctgcaaaactccaggcag

SEQ ID NO: 592790 - DNA, 20 bp, Homo sapiens
gaggggttccttccacttct

SEQ ID NO: 592791 - DNA, 18 bp, Homo sapiens
gaggtatgggctgggggc

SEQ ID NO: 592792 - DNA, 14 bp, Homo sapiens
gaggtattaaaact

SEQ ID NO: 592793 - DNA, 19 bp, Homo sapiens
gaggttgggggaaccagca

SEQ ID NO: 592794 - DNA, 16 bp, Homo sapiens
gagtgactacacacag

SEQ ID NO: 592795 - DNA, 17 bp, Homo sapiens
gagtttaagaccagcct

SEQ ID NO: 592796 - DNA, 19 bp, Homo sapiens
gagtttaagaccagcctgg

SEQ ID NO: 592797 - DNA, 12 bp, Homo sapiens
gataaaatgatg

SEQ ID NO: 592798 - DNA, 14 bp, Homo sapiens
gataaggtggcttc

SEQ ID NO: 592799 - DNA, 16 bp, Homo sapiens
gataaggtggcttctc

SEQ ID NO: 592800 - DNA, 19 bp, Homo sapiens
gataccatgctgtaaggat

SEQ ID NO: 592801 - DNA, 20 bp, Homo sapiens
gataggcacatagagaggga

SEQ ID NO: 592802 - DNA, 23 bp, Homo sapiens
gataggcctgtgggccagattgc

SEQ ID NO: 592803 - DNA, 15 bp, Homo sapiens
gatatgaaagctgat

SEQ ID NO: 592804 - DNA, 20 bp, Homo sapiens
gatatgtattcttttctcag

SEQ ID NO: 592805 - DNA, 19 bp, Homo sapiens
gaaattacctgtggatatt

SEQ ID NO: 592806 - DNA, 13 bp, Homo sapiens
gaaattgcatact

SEQ ID NO: 592807 - DNA, 13 bp, Homo sapiens
gaaccctcttgcc

SEQ ID NO: 592808 - DNA, 18 bp, Homo sapiens
gaaccctcttgccatcct

SEQ ID NO: 592809 - DNA, 24 bp, Homo sapiens
gaaccctcttgccatcctgatgga

SEQ ID NO: 592810 - DNA, 23 bp, Homo sapiens
gaacctacagttttaactgtgga

SEQ ID NO: 592811 - DNA, 23 bp, Homo sapiens
gaacgctctcctcgagccctccc

SEQ ID NO: 592812 - DNA, 14 bp, Homo sapiens
gaactatgaaatca

SEQ ID NO: 592813 - DNA, 20 bp, Homo sapiens
gaacttgtgtccctaatgtg

SEQ ID NO: 592814 - DNA, 15 bp, Homo sapiens
gaactttgtcagtgt

SEQ ID NO: 592815 - DNA, 13 bp, Homo sapiens
gaactttgtgctt

SEQ ID NO: 592816 - DNA, 22 bp, Homo sapiens
gaactttgtgcttcaaggacat

SEQ ID NO: 592817 - DNA, 12 bp, Homo sapiens
gaagaatgaaag

SEQ ID NO: 592818 - DNA, 20 bp, Homo sapiens
gaagagggaaaacagaaaac

SEQ ID NO: 592819 - DNA, 20 bp, Homo sapiens
gaagagttcccttgaaactt

SEQ ID NO: 592820 - DNA, 19 bp, Homo sapiens
gaagcaataataaagtact

SEQ ID NO: 592821 - DNA, 18 bp, Homo sapiens
gaagcccctgggcccagt

SEQ ID NO: 592822 - DNA, 19 bp, Homo sapiens
gaagctgccgtagcttcag

SEQ ID NO: 592823 - DNA, 19 bp, Homo sapiens
ccacagaaggtgaactttg

SEQ ID NO: 592824 - DNA, 16 bp, Homo sapiens
ccacagcagccccagg

SEQ ID NO: 592825 - DNA, 18 bp, Homo sapiens
ccacaggcacattaactg

SEQ ID NO: 592826 - DNA, 19 bp, Homo sapiens
ccacaggcacattaactgt

SEQ ID NO: 592827 - DNA, 14 bp, Homo sapiens
ccacatcaaacctt

SEQ ID NO: 592828 - DNA, 22 bp, Homo sapiens
ccaccagtgtagcatcttcctc

SEQ ID NO: 592829 - DNA, 21 bp, Homo sapiens
ccacctcctaccccttcctgt

SEQ ID NO: 592830 - DNA, 11 bp, Homo sapiens
ccacctggctg

SEQ ID NO: 592831 - DNA, 14 bp, Homo sapiens
ccacctggctgcca

SEQ ID NO: 592832 - DNA, 12 bp, Homo sapiens
ccactcttctct

SEQ ID NO: 592833 - DNA, 15 bp, Homo sapiens
ccactcttctctcct

SEQ ID NO: 592834 - DNA, 22 bp, Homo sapiens
ccactcttctctcctttctccc

SEQ ID NO: 592835 - DNA, 12 bp, Homo sapiens
ccactgtagcta

SEQ ID NO: 592836 - DNA, 23 bp, Homo sapiens
ccacttgacactattcactaaaa

SEQ ID NO: 592837 - DNA, 15 bp, Homo sapiens
ccacttgcctggggc

SEQ ID NO: 592838 - DNA, 21 bp, Homo sapiens
ccagagaaagcacaatttaaa

SEQ ID NO: 592839 - DNA, 23 bp, Homo sapiens
ccagagagtggagagagcagggc

SEQ ID NO: 592840 - DNA, 17 bp, Homo sapiens
ccagagtctgtattttt

SEQ ID NO: 592841 - DNA, 21 bp, Homo sapiens
ccagatctttcagaaatataa

SEQ ID NO: 592842 - DNA, 19 bp, Homo sapiens
ccagcgacctctctgcctc

SEQ ID NO: 592843 - DNA, 15 bp, Homo sapiens
ccaggaggctgaggt

SEQ ID NO: 592844 - DNA, 15 bp, Homo sapiens
ccaggatactggcac

SEQ ID NO: 592845 - DNA, 20 bp, Homo sapiens
ccaggccagagcaaacagaa

SEQ ID NO: 592846 - DNA, 16 bp, Homo sapiens
ccagggacagggccct

SEQ ID NO: 592847 - DNA, 18 bp, Homo sapiens
ccagggaggcagcctagc

SEQ ID NO: 592848 - DNA, 22 bp, Homo sapiens
ccaggggccaacctcaggctcc

SEQ ID NO: 592849 - DNA, 22 bp, Homo sapiens
ccaggtatccaaaaatgtgtaa

SEQ ID NO: 592850 - DNA, 19 bp, Homo sapiens
ccaggtgtttgtggggctg

SEQ ID NO: 592851 - DNA, 17 bp, Homo sapiens
ccaggtttgcaggagcc

SEQ ID NO: 592852 - DNA, 18 bp, Homo sapiens
ccagtacctagctggctc

SEQ ID NO: 592853 - DNA, 14 bp, Homo sapiens
ccagtcacactccc

SEQ ID NO: 592854 - DNA, 23 bp, Homo sapiens
ccagtctctgtcgtggagccatt

SEQ ID NO: 592855 - DNA, 24 bp, Homo sapiens
ccagtgtagcatcttcctctgcag

SEQ ID NO: 592856 - DNA, 22 bp, Homo sapiens
ccagttgccaaagttttgctgt

SEQ ID NO: 592857 - DNA, 19 bp, Homo sapiens
ccagttttcggaaacactg

SEQ ID NO: 592858 - DNA, 16 bp, Homo sapiens
ccataaacggttcctg

SEQ ID NO: 592859 - DNA, 18 bp, Homo sapiens
ccataaacggttcctggt

SEQ ID NO: 592860 - DNA, 22 bp, Homo sapiens
ccataaacggttcctggtgact

SEQ ID NO: 592861 - DNA, 16 bp, Homo sapiens
ccatagatgctggctg

SEQ ID NO: 592862 - DNA, 13 bp, Homo sapiens
ccatatgaatgaa

SEQ ID NO: 592863 - DNA, 22 bp, Homo sapiens
ccatcacagatcgcatttccta

SEQ ID NO: 592864 - DNA, 17 bp, Homo sapiens
ccatcccctatggacca

SEQ ID NO: 592865 - DNA, 18 bp, Homo sapiens
ccatcctgatggacctgc

SEQ ID NO: 592866 - DNA, 21 bp, Homo sapiens
ccatcctgatggacctgcccc

SEQ ID NO: 592867 - DNA, 17 bp, Homo sapiens
ccatcgtattaaaaaac

SEQ ID NO: 592868 - DNA, 13 bp, Homo sapiens
ccatctctcccac

SEQ ID NO: 592869 - DNA, 20 bp, Homo sapiens
ccatctctcccacttcctcc

SEQ ID NO: 592870 - DNA, 21 bp, Homo sapiens
ccatctctcccacttcctcct

SEQ ID NO: 592871 - DNA, 14 bp, Homo sapiens
ccatctttgaactt

SEQ ID NO: 592872 - DNA, 15 bp, Homo sapiens
ccatgcctccctggg

SEQ ID NO: 592873 - DNA, 22 bp, Homo sapiens
ccatgcctccctgggccacctc

SEQ ID NO: 592874 - DNA, 19 bp, Homo sapiens
ccatggggtcggctcctga

SEQ ID NO: 592875 - DNA, 15 bp, Homo sapiens
ccattaaggggaaga

SEQ ID NO: 592876 - DNA, 22 bp, Homo sapiens
ccattacagaggtattaaaact

SEQ ID NO: 592877 - DNA, 19 bp, Homo sapiens
ccattctcccagtctctgt

SEQ ID NO: 592878 - DNA, 19 bp, Homo sapiens
ccattgaacagctgtgagc

SEQ ID NO: 592879 - DNA, 14 bp, Homo sapiens
ccattttaatttta

SEQ ID NO: 592880 - DNA, 21 bp, Homo sapiens
ccattttaattttaaagtgca

SEQ ID NO: 592881 - DNA, 14 bp, Homo sapiens
cccaatatatgtat

SEQ ID NO: 592882 - DNA, 19 bp, Homo sapiens
cccacaacccaaaaggttt

SEQ ID NO: 592883 - DNA, 22 bp, Homo sapiens
cccacaggggccatgtcctctc

SEQ ID NO: 592884 - DNA, 22 bp, Homo sapiens
cccaccagtgtagcatcttcct

SEQ ID NO: 592885 - DNA, 17 bp, Homo sapiens
cccacccgagtacctcc

SEQ ID NO: 592886 - DNA, 14 bp, Homo sapiens
cccacctggctgcc

SEQ ID NO: 592887 - DNA, 14 bp, Homo sapiens
cccagagtgggctt

SEQ ID NO: 592888 - DNA, 14 bp, Homo sapiens
cccagggacagggc

SEQ ID NO: 592889 - DNA, 11 bp, Homo sapiens
cccagggatgg

SEQ ID NO: 592890 - DNA, 20 bp, Homo sapiens
caggttagtgacatttaatg

SEQ ID NO: 592891 - DNA, 16 bp, Homo sapiens
caggttataacagtgt

SEQ ID NO: 592892 - DNA, 18 bp, Homo sapiens
cagtaatgctaaatgtgt

SEQ ID NO: 592893 - DNA, 19 bp, Homo sapiens
cagtaatgctaaatgtgta

SEQ ID NO: 592894 - DNA, 22 bp, Homo sapiens
cagtaatgctaaatgtgtaata

SEQ ID NO: 592895 - DNA, 20 bp, Homo sapiens
cagtacctagctggctctgt

SEQ ID NO: 592896 - DNA, 14 bp, Homo sapiens
cagtatttccttcc

SEQ ID NO: 592897 - DNA, 19 bp, Homo sapiens
cagtatttccttccactgt

SEQ ID NO: 592898 - DNA, 20 bp, Homo sapiens
cagtatttccttccactgta

SEQ ID NO: 592899 - DNA, 14 bp, Homo sapiens
cagtcacactcccc

SEQ ID NO: 592900 - DNA, 16 bp, Homo sapiens
cagtccaaaagtgttg

SEQ ID NO: 592901 - DNA, 18 bp, Homo sapiens
cagtcgcccaagcagaca

SEQ ID NO: 592902 - DNA, 16 bp, Homo sapiens
cagtgaccagtgcctg

SEQ ID NO: 592903 - DNA, 13 bp, Homo sapiens
cagtgagctgtgt

SEQ ID NO: 592904 - DNA, 16 bp, Homo sapiens
cagtgagtgacaaagc

SEQ ID NO: 592905 - DNA, 21 bp, Homo sapiens
cagtgagtgacaaagcctctg

SEQ ID NO: 592906 - DNA, 22 bp, Homo sapiens
cagtgagtgacaaagcctctga

SEQ ID NO: 592907 - DNA, 13 bp, Homo sapiens
cagtgcctgtgag

SEQ ID NO: 592908 - DNA, 21 bp, Homo sapiens
cagtgcctgtgagcatggggc

SEQ ID NO: 592909 - DNA, 14 bp, Homo sapiens
cagtgtgtaaataa

SEQ ID NO: 592910 - DNA, 23 bp, Homo sapiens
cagtgttttggtggaaaaaacat

SEQ ID NO: 592911 - DNA, 14 bp, Homo sapiens
cagttctcaaatgt

SEQ ID NO: 592912 - DNA, 18 bp, Homo sapiens
cagttctcaaatgtgtgt

SEQ ID NO: 592913 - DNA, 12 bp, Homo sapiens
cagttttaactg

SEQ ID NO: 592914 - DNA, 20 bp, Homo sapiens
cagttttaactgtggatatt

SEQ ID NO: 592915 - DNA, 22 bp, Homo sapiens
cagttttaactgtggatattgt

SEQ ID NO: 592916 - DNA, 17 bp, Homo sapiens
cataaacctgtgctgaa

SEQ ID NO: 592917 - DNA, 19 bp, Homo sapiens
cataaacggttcctggtga

SEQ ID NO: 592918 - DNA, 16 bp, Homo sapiens
cataaattcaactttg

SEQ ID NO: 592919 - DNA, 18 bp, Homo sapiens
cataaattcaactttgta

SEQ ID NO: 592920 - DNA, 13 bp, Homo sapiens
cataagcttccat

SEQ ID NO: 592921 - DNA, 14 bp, Homo sapiens
cataatgctttgtt

SEQ ID NO: 592922 - DNA, 18 bp, Homo sapiens
catactttgtattttgat

SEQ ID NO: 592923 - DNA, 18 bp, Homo sapiens
catagaaaccactagaaa

SEQ ID NO: 592924 - DNA, 19 bp, Homo sapiens
catagataatattgtttgg

SEQ ID NO: 592925 - DNA, 23 bp, Homo sapiens
catagcctccaaacatgttccca

SEQ ID NO: 592926 - DNA, 21 bp, Homo sapiens
catagtaagtgcgaagactga

SEQ ID NO: 592927 - DNA, 13 bp, Homo sapiens
catagtcccagct

SEQ ID NO: 592928 - DNA, 17 bp, Homo sapiens
catcaaacctttgagta

SEQ ID NO: 592929 - DNA, 13 bp, Homo sapiens
catcaaataagaa

SEQ ID NO: 592930 - DNA, 15 bp, Homo sapiens
catcactttgaccta

SEQ ID NO: 592931 - DNA, 19 bp, Homo sapiens
catcccatctctcccactt

SEQ ID NO: 592932 - DNA, 23 bp, Homo sapiens
catcccatctctcccacttcctc

SEQ ID NO: 592933 - DNA, 24 bp, Homo sapiens
catcccatctctcccacttcctcc

SEQ ID NO: 592934 - DNA, 17 bp, Homo sapiens
catccttgagattctga

SEQ ID NO: 592935 - DNA, 19 bp, Homo sapiens
catccttgagattctgaag

SEQ ID NO: 592936 - DNA, 16 bp, Homo sapiens
catctatccacactgt

SEQ ID NO: 592937 - DNA, 17 bp, Homo sapiens
catctatctagttctaa

SEQ ID NO: 592938 - DNA, 13 bp, Homo sapiens
catctccatgggg

SEQ ID NO: 592939 - DNA, 12 bp, Homo sapiens
catctctcccac

SEQ ID NO: 592940 - DNA, 20 bp, Homo sapiens
catctctcccacttcctcct

SEQ ID NO: 592941 - DNA, 17 bp, Homo sapiens
catcttttgttctccta

SEQ ID NO: 592942 - DNA, 24 bp, Homo sapiens
catgaaaataccatttagtaagaa

SEQ ID NO: 592943 - DNA, 19 bp, Homo sapiens
catgaaccctcttgccatc

SEQ ID NO: 592944 - DNA, 21 bp, Homo sapiens
catgaaccctcttgccatcct

SEQ ID NO: 592945 - DNA, 22 bp, Homo sapiens
catgcacaagatgccccaggga

SEQ ID NO: 592946 - DNA, 13 bp, Homo sapiens
catgcctgatgaa

SEQ ID NO: 592947 - DNA, 20 bp, Homo sapiens
catggcagcctactctcctt

SEQ ID NO: 592948 - DNA, 23 bp, Homo sapiens
catggggaggttgtggggcctca

SEQ ID NO: 592949 - DNA, 21 bp, Homo sapiens
catgtacaaaaattatgcaat

SEQ ID NO: 592950 - DNA, 20 bp, Homo sapiens
catgtacttccctcttgaaa

SEQ ID NO: 592951 - DNA, 21 bp, Homo sapiens
catgtgagtgacgatgatgta

SEQ ID NO: 592952 - DNA, 14 bp, Homo sapiens
cattaactgttgca

SEQ ID NO: 592953 - DNA, 23 bp, Homo sapiens
cattaaggggaagaatgaaagct

SEQ ID NO: 592954 - DNA, 22 bp, Homo sapiens
caaatgctcccacctgaatttg

SEQ ID NO: 592955 - DNA, 20 bp, Homo sapiens
caaattctacaacttttcct

SEQ ID NO: 592956 - DNA, 21 bp, Homo sapiens
caaattgactcttatttatag

SEQ ID NO: 592957 - DNA, 22 bp, Homo sapiens
caacatggtaattcacttcagt

SEQ ID NO: 592958 - DNA, 16 bp, Homo sapiens
caaccacgcaggaagc

SEQ ID NO: 592959 - DNA, 17 bp, Homo sapiens
caacccaatccctctcc

SEQ ID NO: 592960 - DNA, 21 bp, Homo sapiens
caacccaatccctctccactc

SEQ ID NO: 592961 - DNA, 22 bp, Homo sapiens
caacccaatccctctccactct

SEQ ID NO: 592962 - DNA, 19 bp, Homo sapiens
caactttgtaaaaatcttt

SEQ ID NO: 592963 - DNA, 22 bp, Homo sapiens
caactttgtaaaaatcttttga

SEQ ID NO: 592964 - DNA, 19 bp, Homo sapiens
caagaatcagacagcagga

SEQ ID NO: 592965 - DNA, 14 bp, Homo sapiens
caagaccctgtctc

SEQ ID NO: 592966 - DNA, 16 bp, Homo sapiens
caagatgccccaggga

SEQ ID NO: 592967 - DNA, 18 bp, Homo sapiens
caagccccaactttctta

SEQ ID NO: 592968 - DNA, 13 bp, Homo sapiens
caaggctcttctt

SEQ ID NO: 592969 - DNA, 22 bp, Homo sapiens
caagggaccaggtttgcaggag

SEQ ID NO: 592970 - DNA, 17 bp, Homo sapiens
caagggctgtcattgca

SEQ ID NO: 592971 - DNA, 13 bp, Homo sapiens
caataataaagta

SEQ ID NO: 592972 - DNA, 23 bp, Homo sapiens
caataataaagtacttgactacc

SEQ ID NO: 592973 - DNA, 22 bp, Homo sapiens
caataccttcaaggctcttctt

SEQ ID NO: 592974 - DNA, 22 bp, Homo sapiens
caataggagtggtgatttgaaa

SEQ ID NO: 592975 - DNA, 12 bp, Homo sapiens
caatatgtatat

SEQ ID NO: 592976 - DNA, 14 bp, Homo sapiens
caatatgtatatat

SEQ ID NO: 592977 - DNA, 17 bp, Homo sapiens
caatatgtatatatgta

SEQ ID NO: 592978 - DNA, 23 bp, Homo sapiens
caatatgtatatatgtatttcta

SEQ ID NO: 592979 - DNA, 17 bp, Homo sapiens
caatattgattgggaaa

SEQ ID NO: 592980 - DNA, 20 bp, Homo sapiens
caatattgattgggaaaaca

SEQ ID NO: 592981 - DNA, 21 bp, Homo sapiens
caatattgattgggaaaacat

SEQ ID NO: 592982 - DNA, 14 bp, Homo sapiens
caatccctctccac

SEQ ID NO: 592983 - DNA, 24 bp, Homo sapiens
caatccctctccactcttctctcc

SEQ ID NO: 592984 - DNA, 17 bp, Homo sapiens
caatctctttttgtttg

SEQ ID NO: 592985 - DNA, 19 bp, Homo sapiens
caatgaaccataaattcaa

SEQ ID NO: 592986 - DNA, 20 bp, Homo sapiens
caatggtgtggtgaatgtgt

SEQ ID NO: 592987 - DNA, 21 bp, Homo sapiens
caatggtgtggtgaatgtgtg

SEQ ID NO: 592988 - DNA, 16 bp, Homo sapiens
caatgtctaaaaacat

SEQ ID NO: 592989 - DNA, 16 bp, Homo sapiens
caattaaaaacgaaaa

SEQ ID NO: 592990 - DNA, 20 bp, Homo sapiens
caattaaaaacgaaaacctg

SEQ ID NO: 592991 - DNA, 13 bp, Homo sapiens
caattagacttga

SEQ ID NO: 592992 - DNA, 14 bp, Homo sapiens
caattagacttgaa

SEQ ID NO: 592993 - DNA, 18 bp, Homo sapiens
cacaagatgccccaggga

SEQ ID NO: 592994 - DNA, 16 bp, Homo sapiens
cacacacacacacacg

SEQ ID NO: 592995 - DNA, 11 bp, Homo sapiens
cacacacacga

SEQ ID NO: 592996 - DNA, 15 bp, Homo sapiens
cacacacacgatgca

SEQ ID NO: 592997 - DNA, 13 bp, Homo sapiens
cacacacgatgca

SEQ ID NO: 592998 - DNA, 21 bp, Homo sapiens
cacacacgatgcatttaataa

SEQ ID NO: 592999 - DNA, 21 bp, Homo sapiens
cacacgatgcatttaataaag

SEQ ID NO: 593000 - DNA, 24 bp, Homo sapiens
cacacgatgcatttaataaagatg

SEQ ID NO: 593001 - DNA, 19 bp, Homo sapiens
cacagaagacttcccagct

SEQ ID NO: 593002 - DNA, 20 bp, Homo sapiens
cacagaagacttcccagctt

SEQ ID NO: 593003 - DNA, 23 bp, Homo sapiens
cacagagcaagagataagtcttt

SEQ ID NO: 593004 - DNA, 18 bp, Homo sapiens
cacagcagccccaggaga

SEQ ID NO: 593005 - DNA, 20 bp, Homo sapiens
cacagcagccccaggagaag

SEQ ID NO: 593006 - DNA, 17 bp, Homo sapiens
cacagccttgcagcggc

SEQ ID NO: 593007 - DNA, 23 bp, Homo sapiens
cacagccttgcagcggctcctgc

SEQ ID NO: 593008 - DNA, 21 bp, Homo sapiens
cacaggggccatgtcctctct

SEQ ID NO: 593009 - DNA, 19 bp, Homo sapiens
cacaggtgcaacagacttg

SEQ ID NO: 593010 - DNA, 19 bp, Homo sapiens
cacagtacgaacctacagt

SEQ ID NO: 593011 - DNA, 18 bp, Homo sapiens
cacatatccaggcaccag

SEQ ID NO: 593012 - DNA, 13 bp, Homo sapiens
cacattaactgtt

SEQ ID NO: 593013 - DNA, 21 bp, Homo sapiens
caccaggggccaacctcaggc

SEQ ID NO: 593014 - DNA, 22 bp, Homo sapiens
caccagtgtagcatcttcctct

SEQ ID NO: 593015 - DNA, 23 bp, Homo sapiens
caccagtgtagcatcttcctctg

SEQ ID NO: 593016 - DNA, 24 bp, Homo sapiens
caccagtgtagcatcttcctctgc

SEQ ID NO: 593017 - DNA, 15 bp, Homo sapiens
cacctgcactaacag

SEQ ID NO: 593018 - DNA, 17 bp, Homo sapiens
cacgttggggtgattta

SEQ ID NO: 593019 - DNA, 17 bp, Homo sapiens
cactagggccttggaaa

SEQ ID NO: 593020 - DNA, 14 bp, Homo sapiens
cactatttccacat

SEQ ID NO: 593021 - DNA, 15 bp, Homo sapiens
cactatttgtgactt

SEQ ID NO: 593022 - DNA, 19 bp, Homo sapiens
cactcaatccatccatgta

SEQ ID NO: 593023 - DNA, 12 bp, Homo sapiens
cactcagaaaat

SEQ ID NO: 593024 - DNA, 13 bp, Homo sapiens
cactccagcctgg

SEQ ID NO: 593025 - DNA, 12 bp, Homo sapiens
cactcctgggac

SEQ ID NO: 593026 - DNA, 14 bp, Homo sapiens
cactcttctctcct

SEQ ID NO: 593027 - DNA, 21 bp, Homo sapiens
cactcttctctcctttctccc

SEQ ID NO: 593028 - DNA, 13 bp, Homo sapiens
cactgtttcctga

SEQ ID NO: 593029 - DNA, 23 bp, Homo sapiens
cacttatgttactggtgtccagc

SEQ ID NO: 593030 - DNA, 16 bp, Homo sapiens
cacttcctcctacctg

SEQ ID NO: 593031 - DNA, 17 bp, Homo sapiens
cacttcctcctacctgg

SEQ ID NO: 593032 - DNA, 20 bp, Homo sapiens
cacttcctcctacctgggga

SEQ ID NO: 593033 - DNA, 16 bp, Homo sapiens
cacttgggggactggg

SEQ ID NO: 593034 - DNA, 13 bp, Homo sapiens
cactttcaagaat

SEQ ID NO: 593035 - DNA, 20 bp, Homo sapiens
cagaaatataacacattttt

SEQ ID NO: 593036 - DNA, 16 bp, Homo sapiens
cagaaattcaatttgg

SEQ ID NO: 593037 - DNA, 20 bp, Homo sapiens
cagaaattcaatttggattt

SEQ ID NO: 593038 - DNA, 16 bp, Homo sapiens
cagaaggatgcccaga

SEQ ID NO: 593039 - DNA, 15 bp, Homo sapiens
cagaaggtgaacttt

SEQ ID NO: 593040 - DNA, 16 bp, Homo sapiens
cagacagccctggcaa

SEQ ID NO: 593041 - DNA, 17 bp, Homo sapiens
cagactcgctagcactc

SEQ ID NO: 593042 - DNA, 17 bp, Homo sapiens
cagagagtggagagagc

SEQ ID NO: 593043 - DNA, 15 bp, Homo sapiens
cagagataggcctgt

SEQ ID NO: 593044 - DNA, 14 bp, Homo sapiens
cagagcaaacagaa

SEQ ID NO: 593045 - DNA, 19 bp, Homo sapiens
cagagcaggacctgggaca

SEQ ID NO: 593046 - DNA, 13 bp, Homo sapiens
cagaggctgaggt

SEQ ID NO: 593047 - DNA, 22 bp, Homo sapiens
cagaggtattaaaactaaattt

SEQ ID NO: 593048 - DNA, 23 bp, Homo sapiens
cagaggtattaaaactaaatttc

SEQ ID NO: 593049 - DNA, 19 bp, Homo sapiens
cagagtgggctttggtggc

SEQ ID NO: 593050 - DNA, 23 bp, Homo sapiens
cagagttttcattaaatcctttt

SEQ ID NO: 593051 - DNA, 20 bp, Homo sapiens
cagatagtgtagctgaggag

SEQ ID NO: 593052 - DNA, 18 bp, Homo sapiens
cagatcgcatttcctaag

SEQ ID NO: 593053 - DNA, 17 bp, Homo sapiens
cagattggccaattaaa

SEQ ID NO: 593054 - DNA, 14 bp, Homo sapiens
cagcaaattccaga

SEQ ID NO: 593055 - DNA, 21 bp, Homo sapiens
cagcagaaatgcccccattct

SEQ ID NO: 593056 - DNA, 15 bp, Homo sapiens
cagcagccccaggag

SEQ ID NO: 593057 - DNA, 17 bp, Homo sapiens
cagcagccccaggagaa

SEQ ID NO: 593058 - DNA, 18 bp, Homo sapiens
cagcagccccaggagaag

SEQ ID NO: 593059 - DNA, 14 bp, Homo sapiens
cagcaggctggcct

SEQ ID NO: 593060 - DNA, 18 bp, Homo sapiens
cagcagtttccagagagt

SEQ ID NO: 593061 - DNA, 13 bp, Homo sapiens
cagccccaggaga

SEQ ID NO: 593062 - DNA, 19 bp, Homo sapiens
cagccccctaaaagcactc

SEQ ID NO: 593063 - DNA, 15 bp, Homo sapiens
cagcctactctcctt

SEQ ID NO: 593064 - DNA, 15 bp, Homo sapiens
attaatgttttcaaa

SEQ ID NO: 593065 - DNA, 15 bp, Homo sapiens
attacaacagtgaga

SEQ ID NO: 593066 - DNA, 15 bp, Homo sapiens
attacctgtggatat

SEQ ID NO: 593067 - DNA, 15 bp, Homo sapiens
attactgacatttct

SEQ ID NO: 593068 - DNA, 21 bp, Homo sapiens
attactttggggctaatttaa

SEQ ID NO: 593069 - DNA, 18 bp, Homo sapiens
attagaaacaaacaaaac

SEQ ID NO: 593070 - DNA, 23 bp, Homo sapiens
attagaaacaaacaaaactctta

SEQ ID NO: 593071 - DNA, 22 bp, Homo sapiens
attagaaattacctgtggatat

SEQ ID NO: 593072 - DNA, 15 bp, Homo sapiens
attatacatgtgata

SEQ ID NO: 593073 - DNA, 20 bp, Homo sapiens
attatacatgtgatacattt

SEQ ID NO: 593074 - DNA, 19 bp, Homo sapiens
attatatattgcaaggtgt

SEQ ID NO: 593075 - DNA, 23 bp, Homo sapiens
attatatattgcaaggtgtgatg

SEQ ID NO: 593076 - DNA, 18 bp, Homo sapiens
attatttttttaaaattt

SEQ ID NO: 593077 - DNA, 15 bp, Homo sapiens
attcaactttgtaaa

SEQ ID NO: 593078 - DNA, 21 bp, Homo sapiens
attccagatctttcagaaata

SEQ ID NO: 593079 - DNA, 13 bp, Homo sapiens
attcgcccacccg

SEQ ID NO: 593080 - DNA, 12 bp, Homo sapiens
attctcctgcca

SEQ ID NO: 593081 - DNA, 14 bp, Homo sapiens
attctgaagtatga

SEQ ID NO: 593082 - DNA, 17 bp, Homo sapiens
attctgcctgctccatc

SEQ ID NO: 593083 - DNA, 16 bp, Homo sapiens
attctggctttaagcc

SEQ ID NO: 593084 - DNA, 21 bp, Homo sapiens
attcttattgacaattgtgta

SEQ ID NO: 593085 - DNA, 17 bp, Homo sapiens
attctttgcaatactgc

SEQ ID NO: 593086 - DNA, 20 bp, Homo sapiens
attgaaaagtttttgtttgg

SEQ ID NO: 593087 - DNA, 16 bp, Homo sapiens
attgaacagctgtgag

SEQ ID NO: 593088 - DNA, 19 bp, Homo sapiens
attgactaactcaaataca

SEQ ID NO: 593089 - DNA, 18 bp, Homo sapiens
attgacttttataaagca

SEQ ID NO: 593090 - DNA, 14 bp, Homo sapiens
attgagcttgcatg

SEQ ID NO: 593091 - DNA, 13 bp, Homo sapiens
attgagtattgtt

SEQ ID NO: 593092 - DNA, 21 bp, Homo sapiens
attgagtattgtttaaaatgt

SEQ ID NO: 593093 - DNA, 14 bp, Homo sapiens
attgattgggaaaa

SEQ ID NO: 593094 - DNA, 14 bp, Homo sapiens
attgatttgattgg

SEQ ID NO: 593095 - DNA, 17 bp, Homo sapiens
attgcagactgttctta

SEQ ID NO: 593096 - DNA, 14 bp, Homo sapiens
attgcatcactgta

SEQ ID NO: 593097 - DNA, 18 bp, Homo sapiens
attgcctctgaaaagtgt

SEQ ID NO: 593098 - DNA, 22 bp, Homo sapiens
attgctgataccatatgaatga

SEQ ID NO: 593099 - DNA, 23 bp, Homo sapiens
attgctgataccatatgaatgaa

SEQ ID NO: 593100 - DNA, 14 bp, Homo sapiens
attgctgtcctgga

SEQ ID NO: 593101 - DNA, 11 bp, Homo sapiens
attggatattt

SEQ ID NO: 593102 - DNA, 18 bp, Homo sapiens
attggcattctttgcaat

SEQ ID NO: 593103 - DNA, 23 bp, Homo sapiens
attggcattctttgcaatactgc

SEQ ID NO: 593104 - DNA, 15 bp, Homo sapiens
attgggaaaacattt

SEQ ID NO: 593105 - DNA, 17 bp, Homo sapiens
attggttgttgtattga

SEQ ID NO: 593106 - DNA, 15 bp, Homo sapiens
attgtacaaaattaa

SEQ ID NO: 593107 - DNA, 21 bp, Homo sapiens
attgtgctgggtcccagcctg

SEQ ID NO: 593108 - DNA, 23 bp, Homo sapiens
attgtgctgggtcccagcctggt

SEQ ID NO: 593109 - DNA, 23 bp, Homo sapiens
attgtgtggtctggttcctgtgt

SEQ ID NO: 593110 - DNA, 14 bp, Homo sapiens
attgtttaaaatgt

SEQ ID NO: 593111 - DNA, 17 bp, Homo sapiens
attgtttaaaatgtaat

SEQ ID NO: 593112 - DNA, 20 bp, Homo sapiens
atttaaaacaatccttacta

SEQ ID NO: 593113 - DNA, 21 bp, Homo sapiens
atttaaaacaatccttactaa

SEQ ID NO: 593114 - DNA, 15 bp, Homo sapiens
atttaaaagcctgct

SEQ ID NO: 593115 - DNA, 16 bp, Homo sapiens
atttaaatccttggct

SEQ ID NO: 593116 - DNA, 17 bp, Homo sapiens
atttaaatgaaagaaaa

SEQ ID NO: 593117 - DNA, 14 bp, Homo sapiens
atttaacccagctc

SEQ ID NO: 593118 - DNA, 15 bp, Homo sapiens
atttaactttccagt

SEQ ID NO: 593119 - DNA, 22 bp, Homo sapiens
atttaactttccagtcttagct

SEQ ID NO: 593120 - DNA, 11 bp, Homo sapiens
atttaataaag

SEQ ID NO: 593121 - DNA, 14 bp, Homo sapiens
atttaatatatata

SEQ ID NO: 593122 - DNA, 19 bp, Homo sapiens
atttagaagcctgacaact

SEQ ID NO: 593123 - DNA, 18 bp, Homo sapiens
atttatagaatttaatat

SEQ ID NO: 593124 - DNA, 17 bp, Homo sapiens
atttattttttcttttc

SEQ ID NO: 593125 - DNA, 22 bp, Homo sapiens
atttattttttcttttctttac

SEQ ID NO: 593126 - DNA, 23 bp, Homo sapiens
atttcatactgtaacattcagga

SEQ ID NO: 593127 - DNA, 15 bp, Homo sapiens
atttcatgattagaa

SEQ ID NO: 593128 - DNA, 23 bp, Homo sapiens
atttccacatggaatcaatcttt

SEQ ID NO: 593129 - DNA, 19 bp, Homo sapiens
atttccctccagagaaagc

SEQ ID NO: 593130 - DNA, 14 bp, Homo sapiens
atttccttccactg

SEQ ID NO: 593131 - DNA, 19 bp, Homo sapiens
atttccttccactgtagct

SEQ ID NO: 593132 - DNA, 22 bp, Homo sapiens
atttctcattgacttttataaa

SEQ ID NO: 593133 - DNA, 15 bp, Homo sapiens
atttgaaaaatataa

SEQ ID NO: 593134 - DNA, 20 bp, Homo sapiens
atttgaaaaatataaaatta

SEQ ID NO: 593135 - DNA, 11 bp, Homo sapiens
atttgaacttt

SEQ ID NO: 593136 - DNA, 14 bp, Homo sapiens
atttgccaatcttt

SEQ ID NO: 593137 - DNA, 16 bp, Homo sapiens
atttgctactgttgta

SEQ ID NO: 593138 - DNA, 13 bp, Homo sapiens
atttgctgccatt

SEQ ID NO: 593139 - DNA, 16 bp, Homo sapiens
atttgtatatggtatt

SEQ ID NO: 593140 - DNA, 23 bp, Homo sapiens
atttgtttccttttggcctcctg

SEQ ID NO: 593141 - DNA, 15 bp, Homo sapiens
atttgttttggatat

SEQ ID NO: 593142 - DNA, 18 bp, Homo sapiens
attttcatattgtaatct

SEQ ID NO: 593143 - DNA, 20 bp, Homo sapiens
attttgaaatgaactttgtc

SEQ ID NO: 593144 - DNA, 10 bp, Homo sapiens
attttgtatg

SEQ ID NO: 593145 - DNA, 15 bp, Homo sapiens
attttgtatgttaaa

SEQ ID NO: 593146 - DNA, 17 bp, Homo sapiens
atttttttaaaattttg

SEQ ID NO: 593147 - DNA, 23 bp, Homo sapiens
atttttttgcatgcatgcaaatg

SEQ ID NO: 593148 - DNA, 15 bp, Homo sapiens
caaaaattatgcaat

SEQ ID NO: 593149 - DNA, 21 bp, Homo sapiens
caaaaatttctgtaaaacagg

SEQ ID NO: 593150 - DNA, 15 bp, Homo sapiens
caaaactccaggcag

SEQ ID NO: 593151 - DNA, 16 bp, Homo sapiens
caaaagggcagctgtg

SEQ ID NO: 593152 - DNA, 23 bp, Homo sapiens
caaaatggtcctatttttgtgaa

SEQ ID NO: 593153 - DNA, 16 bp, Homo sapiens
caaaattaagcaaatg

SEQ ID NO: 593154 - DNA, 13 bp, Homo sapiens
caaaatttatatt

SEQ ID NO: 593155 - DNA, 15 bp, Homo sapiens
caaaatttatatttt

SEQ ID NO: 593156 - DNA, 19 bp, Homo sapiens
caaacaagccccctgccct

SEQ ID NO: 593157 - DNA, 12 bp, Homo sapiens
caaacagaaaaa

SEQ ID NO: 593158 - DNA, 22 bp, Homo sapiens
caaacatgttcccaaggcccca

SEQ ID NO: 593159 - DNA, 23 bp, Homo sapiens
caaactcataacagtcttactgc

SEQ ID NO: 593160 - DNA, 19 bp, Homo sapiens
caaacttaagaaacactga

SEQ ID NO: 593161 - DNA, 13 bp, Homo sapiens
caaagaccacctc

SEQ ID NO: 593162 - DNA, 14 bp, Homo sapiens
caaagaccacctcc

SEQ ID NO: 593163 - DNA, 15 bp, Homo sapiens
caaagaccacctcca

SEQ ID NO: 593164 - DNA, 22 bp, Homo sapiens
caaagagaaagagtttgaaact

SEQ ID NO: 593165 - DNA, 22 bp, Homo sapiens
caaagatgcgtttgcctcctgg

SEQ ID NO: 593166 - DNA, 19 bp, Homo sapiens
caaagccggcctgagaaac

SEQ ID NO: 593167 - DNA, 23 bp, Homo sapiens
caaagccggcctgagaaacacta

SEQ ID NO: 593168 - DNA, 13 bp, Homo sapiens
caaagcctctgaa

SEQ ID NO: 593169 - DNA, 16 bp, Homo sapiens
caaagccttctcccta

SEQ ID NO: 593170 - DNA, 13 bp, Homo sapiens
caaagtctccaga

SEQ ID NO: 593171 - DNA, 14 bp, Homo sapiens
caaagtggaacgaa

SEQ ID NO: 593172 - DNA, 18 bp, Homo sapiens
caaataatttgaactttg

SEQ ID NO: 593173 - DNA, 16 bp, Homo sapiens
caaatgagctctgaaa

SEQ ID NO: 593174 - DNA, 20 bp, Homo sapiens
caaatgagctctgaaatctt

SEQ ID NO: 593175 - DNA, 18 bp, Homo sapiens
atgcccccattctcccag

SEQ ID NO: 593176 - DNA, 19 bp, Homo sapiens
atgcctatggtggatccaa

SEQ ID NO: 593177 - DNA, 12 bp, Homo sapiens
atgcctccctgg

SEQ ID NO: 593178 - DNA, 19 bp, Homo sapiens
atgcctccctgggccacct

SEQ ID NO: 593179 - DNA, 20 bp, Homo sapiens
atgcctccctgggccacctc

SEQ ID NO: 593180 - DNA, 15 bp, Homo sapiens
atgcgtttgcctcct

SEQ ID NO: 593181 - DNA, 15 bp, Homo sapiens
atgctaaatgtgtaa

SEQ ID NO: 593182 - DNA, 16 bp, Homo sapiens
atgctaaatgtgtaat

SEQ ID NO: 593183 - DNA, 13 bp, Homo sapiens
atgctacttccca

SEQ ID NO: 593184 - DNA, 23 bp, Homo sapiens
atggacctgccccggacctacct

SEQ ID NO: 593185 - DNA, 14 bp, Homo sapiens
atggagacagcagt

SEQ ID NO: 593186 - DNA, 19 bp, Homo sapiens
atggatttttctttaactg

SEQ ID NO: 593187 - DNA, 20 bp, Homo sapiens
atggatttttctttaactgc

SEQ ID NO: 593188 - DNA, 18 bp, Homo sapiens
atggcacttgggggactg

SEQ ID NO: 593189 - DNA, 17 bp, Homo sapiens
atggcagggggtggaat

SEQ ID NO: 593190 - DNA, 13 bp, Homo sapiens
atggcttgtctat

SEQ ID NO: 593191 - DNA, 14 bp, Homo sapiens
atgggctgggggct

SEQ ID NO: 593192 - DNA, 22 bp, Homo sapiens
atgggtgccctttcctggcagt

SEQ ID NO: 593193 - DNA, 13 bp, Homo sapiens
atggtaataagca

SEQ ID NO: 593194 - DNA, 20 bp, Homo sapiens
atggtaataagcactgtaaa

SEQ ID NO: 593195 - DNA, 15 bp, Homo sapiens
atgtaaataactcta

SEQ ID NO: 593196 - DNA, 12 bp, Homo sapiens
atgtaacatgat

SEQ ID NO: 593197 - DNA, 15 bp, Homo sapiens
atgtaatttaaatga

SEQ ID NO: 593198 - DNA, 20 bp, Homo sapiens
atgtacaaaaattatgcaat

SEQ ID NO: 593199 - DNA, 14 bp, Homo sapiens
atgtacagattctt

SEQ ID NO: 593200 - DNA, 15 bp, Homo sapiens
atgtacagattcttt

SEQ ID NO: 593201 - DNA, 12 bp, Homo sapiens
atgtacttccct

SEQ ID NO: 593202 - DNA, 20 bp, Homo sapiens
atgtaggtaagactgtagat

SEQ ID NO: 593203 - DNA, 12 bp, Homo sapiens
atgtataaatat

SEQ ID NO: 593204 - DNA, 17 bp, Homo sapiens
atgtattcttttctcag

SEQ ID NO: 593205 - DNA, 15 bp, Homo sapiens
atgtattttttgaat

SEQ ID NO: 593206 - DNA, 21 bp, Homo sapiens
atgtattttttgaatctatga

SEQ ID NO: 593207 - DNA, 13 bp, Homo sapiens
atgtcctctctta

SEQ ID NO: 593208 - DNA, 15 bp, Homo sapiens
atgtctcctttgctc

SEQ ID NO: 593209 - DNA, 12 bp, Homo sapiens
atgtctggcaga

SEQ ID NO: 593210 - DNA, 13 bp, Homo sapiens
atgtctggcagat

SEQ ID NO: 593211 - DNA, 14 bp, Homo sapiens
atgtctggcagatg

SEQ ID NO: 593212 - DNA, 18 bp, Homo sapiens
atgtctggcagatgaggg

SEQ ID NO: 593213 - DNA, 13 bp, Homo sapiens
atgtgcaatagaa

SEQ ID NO: 593214 - DNA, 18 bp, Homo sapiens
atgtgcaatagaaggtga

SEQ ID NO: 593215 - DNA, 19 bp, Homo sapiens
atgtgggatattgaatgtt

SEQ ID NO: 593216 - DNA, 15 bp, Homo sapiens
atgtggtctgccaat

SEQ ID NO: 593217 - DNA, 15 bp, Homo sapiens
atgtgtaataatgta

SEQ ID NO: 593218 - DNA, 22 bp, Homo sapiens
atgtgtaataatgtaacatgat

SEQ ID NO: 593219 - DNA, 16 bp, Homo sapiens
atgtgtgagaaaaact

SEQ ID NO: 593220 - DNA, 22 bp, Homo sapiens
atgtgttggggaagggcctgcc

SEQ ID NO: 593221 - DNA, 17 bp, Homo sapiens
atgttaaagagaatgag

SEQ ID NO: 593222 - DNA, 22 bp, Homo sapiens
atgttaaagagaatgagtcctt

SEQ ID NO: 593223 - DNA, 22 bp, Homo sapiens
atgttgccatcctaccgtcttt

SEQ ID NO: 593224 - DNA, 16 bp, Homo sapiens
atgtttcttttgtttg

SEQ ID NO: 593225 - DNA, 22 bp, Homo sapiens
atgttttcaaaaggtattatac

SEQ ID NO: 593226 - DNA, 13 bp, Homo sapiens
attaaaaaacaat

SEQ ID NO: 593227 - DNA, 19 bp, Homo sapiens
attaaaaaacaattaactg

SEQ ID NO: 593228 - DNA, 21 bp, Homo sapiens
attaaaaacgaaaacctgact

SEQ ID NO: 593229 - DNA, 21 bp, Homo sapiens
attaactatcttctttggact

SEQ ID NO: 593230 - DNA, 13 bp, Homo sapiens
attaactgttgca

SEQ ID NO: 593231 - DNA, 19 bp, Homo sapiens
attaaggggaagaatgaaa

SEQ ID NO: 593232 - DNA, 23 bp, Homo sapiens
attaatattcagggtaaatagga

SEQ ID NO: 593233 - DNA, 22 bp, Homo sapiens
ttatatttttttaactgtgata

SEQ ID NO: 593234 - DNA, 23 bp, Homo sapiens
ttatatttttttaactgtgataa

SEQ ID NO: 593235 - DNA, 19 bp, Homo sapiens
ttatcaattacaacagtga

SEQ ID NO: 593236 - DNA, 18 bp, Homo sapiens
ttatcagtaatgctaaat

SEQ ID NO: 593237 - DNA, 12 bp, Homo sapiens
ttattaatgttt

SEQ ID NO: 593238 - DNA, 19 bp, Homo sapiens
ttatttcatgattagaaat

SEQ ID NO: 593239 - DNA, 23 bp, Homo sapiens
ttatttttggcgtggctgactta

SEQ ID NO: 593240 - DNA, 17 bp, Homo sapiens
ttatttttttaaaattt

SEQ ID NO: 593241 - DNA, 12 bp, Homo sapiens
ttcaaagccttc

SEQ ID NO: 593242 - DNA, 17 bp, Homo sapiens
ttcaaccacgcaggaag

SEQ ID NO: 593243 - DNA, 18 bp, Homo sapiens
ttcaaccacgcaggaagc

SEQ ID NO: 593244 - DNA, 16 bp, Homo sapiens
ttcaacggaaagtgct

SEQ ID NO: 593245 - DNA, 17 bp, Homo sapiens
ttcaagaatcagacagc

SEQ ID NO: 593246 - DNA, 16 bp, Homo sapiens
ttcaataaatgatata

SEQ ID NO: 593247 - DNA, 13 bp, Homo sapiens
ttcacaatgttaa

SEQ ID NO: 593248 - DNA, 23 bp, Homo sapiens
ttcagggtaaataggaatcattc

SEQ ID NO: 593249 - DNA, 17 bp, Homo sapiens
ttcagttgcttgtcttc

SEQ ID NO: 593250 - DNA, 18 bp, Homo sapiens
ttcagtttaatgtctcct

SEQ ID NO: 593251 - DNA, 20 bp, Homo sapiens
ttcatacgcatcccatctct

SEQ ID NO: 593252 - DNA, 13 bp, Homo sapiens
ttcatattgtaat

SEQ ID NO: 593253 - DNA, 16 bp, Homo sapiens
ttcatgacagcctcca

SEQ ID NO: 593254 - DNA, 22 bp, Homo sapiens
ttcatggctgctgttgcttaaa

SEQ ID NO: 593255 - DNA, 15 bp, Homo sapiens
ttccaaacagacaaa

SEQ ID NO: 593256 - DNA, 21 bp, Homo sapiens
ttccaaacagacaaaacagat

SEQ ID NO: 593257 - DNA, 21 bp, Homo sapiens
ttccagagagtggagagagca

SEQ ID NO: 593258 - DNA, 16 bp, Homo sapiens
ttccagatctttcaga

SEQ ID NO: 593259 - DNA, 20 bp, Homo sapiens
ttccagtcctaacaaatgct

SEQ ID NO: 593260 - DNA, 12 bp, Homo sapiens
ttcccagagtgg

SEQ ID NO: 593261 - DNA, 16 bp, Homo sapiens
ttcccctttgtcctgc

SEQ ID NO: 593262 - DNA, 18 bp, Homo sapiens
ttcctagctgtgtgaata

SEQ ID NO: 593263 - DNA, 20 bp, Homo sapiens
ttcctctgcccttcctgcag

SEQ ID NO: 593264 - DNA, 21 bp, Homo sapiens
ttcctgcaggcaggaacaaac

SEQ ID NO: 593265 - DNA, 16 bp, Homo sapiens
ttcctggtgactcctg

SEQ ID NO: 593266 - DNA, 12 bp, Homo sapiens
ttcctgtcctgc

SEQ ID NO: 593267 - DNA, 14 bp, Homo sapiens
ttcctgtcctgcct

SEQ ID NO: 593268 - DNA, 23 bp, Homo sapiens
ttccttggtcctagtaagaagac

SEQ ID NO: 593269 - DNA, 17 bp, Homo sapiens
ttccttttggcctcctg

SEQ ID NO: 593270 - DNA, 13 bp, Homo sapiens
ttcggaaacactg

SEQ ID NO: 593271 - DNA, 13 bp, Homo sapiens
ttcgtttatattt

SEQ ID NO: 593272 - DNA, 23 bp, Homo sapiens
ttcgtttatatttttttaactgt

SEQ ID NO: 593273 - DNA, 19 bp, Homo sapiens
ttctatccttccagaaaaa

SEQ ID NO: 593274 - DNA, 20 bp, Homo sapiens
ttctcattgacttttataaa

SEQ ID NO: 593275 - DNA, 13 bp, Homo sapiens
ttctccctgcagc

SEQ ID NO: 593276 - DNA, 17 bp, Homo sapiens
ttctgcaacaagcatgc

SEQ ID NO: 593277 - DNA, 15 bp, Homo sapiens
ttctgccctgccagc

SEQ ID NO: 593278 - DNA, 14 bp, Homo sapiens
ttctgggctgatgg

SEQ ID NO: 593279 - DNA, 15 bp, Homo sapiens
ttctggtactttctg

SEQ ID NO: 593280 - DNA, 18 bp, Homo sapiens
ttctggtccctcttctct

SEQ ID NO: 593281 - DNA, 21 bp, Homo sapiens
ttctggtccctcttctctcct

SEQ ID NO: 593282 - DNA, 21 bp, Homo sapiens
aagagcgagagatcaaagatg

SEQ ID NO: 593283 - DNA, 19 bp, Homo sapiens
aagaggagataaggtggct

SEQ ID NO: 593284 - DNA, 15 bp, Homo sapiens
aagaggtataaagct

SEQ ID NO: 593285 - DNA, 16 bp, Homo sapiens
aagagttcccttgaaa

SEQ ID NO: 593286 - DNA, 14 bp, Homo sapiens
aagataaaatgatg

SEQ ID NO: 593287 - DNA, 20 bp, Homo sapiens
aagatactaaggacgttgtt

SEQ ID NO: 593288 - DNA, 16 bp, Homo sapiens
aagatacttacatgtt

SEQ ID NO: 593289 - DNA, 16 bp, Homo sapiens
aagatgcagaagcaat

SEQ ID NO: 593290 - DNA, 15 bp, Homo sapiens
aagatgccccaggga

SEQ ID NO: 593291 - DNA, 22 bp, Homo sapiens
aagatgccccagggatgggagg

SEQ ID NO: 593292 - DNA, 21 bp, Homo sapiens
aagcaaactctaaaattataa

SEQ ID NO: 593293 - DNA, 23 bp, Homo sapiens
aagcactcctgcttaatcttcaa

SEQ ID NO: 593294 - DNA, 14 bp, Homo sapiens
aagcagagttttca

SEQ ID NO: 593295 - DNA, 20 bp, Homo sapiens
aagcatagataatattgttt

SEQ ID NO: 593296 - DNA, 22 bp, Homo sapiens
aagcatagataatattgtttgg

SEQ ID NO: 593297 - DNA, 20 bp, Homo sapiens
aagcatgtgatgttgtctta

SEQ ID NO: 593298 - DNA, 15 bp, Homo sapiens
aagcattctgtttat

SEQ ID NO: 593299 - DNA, 18 bp, Homo sapiens
aagccatagatgctggct

SEQ ID NO: 593300 - DNA, 20 bp, Homo sapiens
aagccatagatgctggctgg

SEQ ID NO: 593301 - DNA, 12 bp, Homo sapiens
aagcctgacaac

SEQ ID NO: 593302 - DNA, 17 bp, Homo sapiens
aagctgcagagatttct

SEQ ID NO: 593303 - DNA, 15 bp, Homo sapiens
aaggatagtaagcat

SEQ ID NO: 593304 - DNA, 20 bp, Homo sapiens
aaggatagtaagcatagaaa

SEQ ID NO: 593305 - DNA, 17 bp, Homo sapiens
aaggatccggaaagaag

SEQ ID NO: 593306 - DNA, 20 bp, Homo sapiens
aaggcatgtacaaaaattat

SEQ ID NO: 593307 - DNA, 20 bp, Homo sapiens
aaggctgtgtttagattgta

SEQ ID NO: 593308 - DNA, 23 bp, Homo sapiens
aaggctgtgtttagattgtatta

SEQ ID NO: 593309 - DNA, 15 bp, Homo sapiens
aagggcagctgtgat

SEQ ID NO: 593310 - DNA, 12 bp, Homo sapiens
aaggtgaacttt

SEQ ID NO: 593311 - DNA, 14 bp, Homo sapiens
aaggtgaactttgt

SEQ ID NO: 593312 - DNA, 14 bp, Homo sapiens
aaggtgtgatggtc

SEQ ID NO: 593313 - DNA, 12 bp, Homo sapiens
aagtaaagatgc

SEQ ID NO: 593314 - DNA, 18 bp, Homo sapiens
aagtatggtaatagcttt

SEQ ID NO: 593315 - DNA, 18 bp, Homo sapiens
aagtcagaatttttaact

SEQ ID NO: 593316 - DNA, 13 bp, Homo sapiens
aagtcccttccta

SEQ ID NO: 593317 - DNA, 15 bp, Homo sapiens
aagtcctaaaagttc

SEQ ID NO: 593318 - DNA, 13 bp, Homo sapiens
aagtctctgtgta

SEQ ID NO: 593319 - DNA, 14 bp, Homo sapiens
aagtctctgtgtaa

SEQ ID NO: 593320 - DNA, 15 bp, Homo sapiens
aagtgtgctgggcag

SEQ ID NO: 593321 - DNA, 20 bp, Homo sapiens
aagtgtgctgggcagaggga

SEQ ID NO: 593322 - DNA, 14 bp, Homo sapiens
aagtgttcattgtt

SEQ ID NO: 593323 - DNA, 20 bp, Homo sapiens
aagttgtgcttgagccagga

SEQ ID NO: 593324 - DNA, 12 bp, Homo sapiens
aagttttgctgt

SEQ ID NO: 593325 - DNA, 13 bp, Homo sapiens
aataaagatgagt

SEQ ID NO: 593326 - DNA, 12 bp, Homo sapiens
aataaagtactt

SEQ ID NO: 593327 - DNA, 18 bp, Homo sapiens
aataaataaaaactaatt

SEQ ID NO: 593328 - DNA, 14 bp, Homo sapiens
aataactatgccag

SEQ ID NO: 593329 - DNA, 16 bp, Homo sapiens
aatacaaaatgtatta

SEQ ID NO: 593330 - DNA, 15 bp, Homo sapiens
aatacacatttgcta

SEQ ID NO: 593331 - DNA, 18 bp, Homo sapiens
aatacatgccacatcaaa

SEQ ID NO: 593332 - DNA, 17 bp, Homo sapiens
aatactactactgttat

SEQ ID NO: 593333 - DNA, 23 bp, Homo sapiens
aatactctgctatttctcttgct

SEQ ID NO: 593334 - DNA, 19 bp, Homo sapiens
aatagagttgggacaattg

SEQ ID NO: 593335 - DNA, 18 bp, Homo sapiens
aatagatatgaaagctga

SEQ ID NO: 593336 - DNA, 19 bp, Homo sapiens
aatagatatgaaagctgat

SEQ ID NO: 593337 - DNA, 21 bp, Homo sapiens
aatagatttgggtcatttaga

SEQ ID NO: 593338 - DNA, 19 bp, Homo sapiens
aataggaatcattcagaaa

SEQ ID NO: 593339 - DNA, 13 bp, Homo sapiens
aataggccacaga

SEQ ID NO: 593340 - DNA, 15 bp, Homo sapiens
aatataaaattatga

SEQ ID NO: 593341 - DNA, 16 bp, Homo sapiens
aatatattttcagtac

SEQ ID NO: 593342 - DNA, 13 bp, Homo sapiens
aatatgaatgaat

SEQ ID NO: 593343 - DNA, 13 bp, Homo sapiens
aatatgaccattt

SEQ ID NO: 593344 - DNA, 16 bp, Homo sapiens
aatattccagatcttt

SEQ ID NO: 593345 - DNA, 16 bp, Homo sapiens
aatattgattgggaaa

SEQ ID NO: 593346 - DNA, 21 bp, Homo sapiens
aatattgattgggaaaacatt

SEQ ID NO: 593347 - DNA, 20 bp, Homo sapiens
aatattgtttggtaaatgtt

SEQ ID NO: 593348 - DNA, 21 bp, Homo sapiens
aatattgtttggtaaatgttt

SEQ ID NO: 593349 - DNA, 13 bp, Homo sapiens
aatcagaattaga

SEQ ID NO: 593350 - DNA, 17 bp, Homo sapiens
aatcagtatttccttcc

SEQ ID NO: 593351 - DNA, 16 bp, Homo sapiens
aatcattcagaaatgt

SEQ ID NO: 593352 - DNA, 19 bp, Homo sapiens
aatcattcagaaatgttga

SEQ ID NO: 593353 - DNA, 16 bp, Homo sapiens
aatccaagattctgct

SEQ ID NO: 593354 - DNA, 13 bp, Homo sapiens
aatccagttataa

SEQ ID NO: 593355 - DNA, 18 bp, Homo sapiens
aatccatccatgtacttc

SEQ ID NO: 593356 - DNA, 23 bp, Homo sapiens
aatccatcgtattaaaaaacaat

SEQ ID NO: 593357 - DNA, 17 bp, Homo sapiens
aatcccctaaaataaca

SEQ ID NO: 593358 - DNA, 23 bp, Homo sapiens
aatccctctccactcttctctcc

SEQ ID NO: 593359 - DNA, 22 bp, Homo sapiens
aatctatgaacctgaaaagggt

SEQ ID NO: 593360 - DNA, 13 bp, Homo sapiens
aatctcaatgcaa

SEQ ID NO: 593361 - DNA, 14 bp, Homo sapiens
aatctcaatgcaag

SEQ ID NO: 593362 - DNA, 16 bp, Homo sapiens
aatctgtacaaaatgg

SEQ ID NO: 593363 - DNA, 21 bp, Homo sapiens
aatctttaacaacctctgagc

SEQ ID NO: 593364 - DNA, 16 bp, Homo sapiens
aatctttataaatgta

SEQ ID NO: 593365 - DNA, 12 bp, Homo sapiens
aatctttgctgt

SEQ ID NO: 593366 - DNA, 13 bp, Homo sapiens
aatgaaacatggg

SEQ ID NO: 593367 - DNA, 13 bp, Homo sapiens
aatgaaagaaaat

SEQ ID NO: 593368 - DNA, 16 bp, Homo sapiens
aatgaaagaaaattga

SEQ ID NO: 593369 - DNA, 16 bp, Homo sapiens
aatgttttcaaaaggt

SEQ ID NO: 593370 - DNA, 18 bp, Homo sapiens
aattaaaaacgaaaacct

SEQ ID NO: 593371 - DNA, 13 bp, Homo sapiens
aattaagcaaatg

SEQ ID NO: 593372 - DNA, 22 bp, Homo sapiens
aattaagcaaatgttaaaagtt

SEQ ID NO: 593373 - DNA, 21 bp, Homo sapiens
aattaccatgcttcacaatgt

SEQ ID NO: 593374 - DNA, 17 bp, Homo sapiens
aattagacttgaaatac

SEQ ID NO: 593375 - DNA, 20 bp, Homo sapiens
aattataactgtaaagatgt

SEQ ID NO: 593376 - DNA, 23 bp, Homo sapiens
aattatgagattggttttcctgt

SEQ ID NO: 593377 - DNA, 17 bp, Homo sapiens
aattatgtaaataactc

SEQ ID NO: 593378 - DNA, 14 bp, Homo sapiens
aattcaactttgta

SEQ ID NO: 593379 - DNA, 16 bp, Homo sapiens
aattcaactttgtaaa

SEQ ID NO: 593380 - DNA, 17 bp, Homo sapiens
aattcaatttggattta

SEQ ID NO: 593381 - DNA, 14 bp, Homo sapiens
aattcacttcagtt

SEQ ID NO: 593382 - DNA, 14 bp, Homo sapiens
aattccagatttgt

SEQ ID NO: 593383 - DNA, 23 bp, Homo sapiens
aattctgattctggctttaagcc

SEQ ID NO: 593384 - DNA, 23 bp, Homo sapiens
aattcttaaaaggcccatagcag

SEQ ID NO: 593385 - DNA, 17 bp, Homo sapiens
aattgactcttatttat

SEQ ID NO: 593386 - DNA, 20 bp, Homo sapiens
aattgactcttatttataga

SEQ ID NO: 593387 - DNA, 18 bp, Homo sapiens
aattgagttgcacttatt

SEQ ID NO: 593388 - DNA, 16 bp, Homo sapiens
aattgcatactttgta

SEQ ID NO: 593389 - DNA, 22 bp, Homo sapiens
aattgcatactttgtattttga

SEQ ID NO: 593390 - DNA, 21 bp, Homo sapiens
aattgctgataccatatgaat

SEQ ID NO: 593391 - DNA, 19 bp, Homo sapiens
aattgcttactcattaaaa

SEQ ID NO: 593392 - DNA, 20 bp, Homo sapiens
aattgtgttttaattgtaaa

SEQ ID NO: 593393 - DNA, 18 bp, Homo sapiens
aatttaaaaaataaataa

SEQ ID NO: 593394 - DNA, 22 bp, Homo sapiens
aatttaaatgaaagaaaattga

SEQ ID NO: 593395 - DNA, 20 bp, Homo sapiens
aatttaataccagatacctt

SEQ ID NO: 593396 - DNA, 15 bp, Homo sapiens
aatttaatatatata

SEQ ID NO: 593397 - DNA, 13 bp, Homo sapiens
aatttacttgttt

SEQ ID NO: 593398 - DNA, 17 bp, Homo sapiens
aatttatattttagaaa

SEQ ID NO: 593399 - DNA, 22 bp, Homo sapiens
aatttcactactagattgacta

SEQ ID NO: 593400 - DNA, 17 bp, Homo sapiens
aattttaaagtgcaaaa

SEQ ID NO: 593401 - DNA, 12 bp, Homo sapiens
aatttttaactg

SEQ ID NO: 593402 - DNA, 15 bp, Homo sapiens
acaaacaaaactctt

SEQ ID NO: 593403 - DNA, 18 bp, Homo sapiens
acaaacaagccccctgcc

SEQ ID NO: 593404 - DNA, 17 bp, Homo sapiens
acaaataatttgaactt

SEQ ID NO: 593405 - DNA, 23 bp, Homo sapiens
acaaatgctcccacctgaatttg

SEQ ID NO: 593406 - DNA, 19 bp, Homo sapiens
acaagcatgcagctttgca

SEQ ID NO: 593407 - DNA, 19 bp, Homo sapiens
acaagctgtatcactgcct

SEQ ID NO: 593408 - DNA, 16 bp, Homo sapiens
acaagtaaaactgtgg

SEQ ID NO: 593409 - DNA, 21 bp, Homo sapiens
acaagtgagacaaaaagcact

SEQ ID NO: 593410 - DNA, 23 bp, Homo sapiens
acaataggagtggtgatttgaaa

SEQ ID NO: 593411 - DNA, 20 bp, Homo sapiens
acaatggtgtggtgaatgtg

SEQ ID NO: 593412 - DNA, 15 bp, Homo sapiens
acaattaactgccct

SEQ ID NO: 593413 - DNA, 13 bp, Homo sapiens
acaattgggagct

SEQ ID NO: 593414 - DNA, 13 bp, Homo sapiens
acaatttaaaaca

SEQ ID NO: 593415 - DNA, 14 bp, Homo sapiens
acacaagtaaaact

SEQ ID NO: 593416 - DNA, 15 bp, Homo sapiens
acacacacacgatgc

SEQ ID NO: 593417 - DNA, 16 bp, Homo sapiens
acacacacacgatgca

SEQ ID NO: 593418 - DNA, 16 bp, Homo sapiens
acacacacgatgcatt

SEQ ID NO: 593419 - DNA, 12 bp, Homo sapiens
acacacagtacg

SEQ ID NO: 593420 - DNA, 11 bp, Homo sapiens
acacacgatgc

SEQ ID NO: 593421 - DNA, 18 bp, Homo sapiens
acacacgatgcatttaat

SEQ ID NO: 593422 - DNA, 22 bp, Homo sapiens
acacacgatgcatttaataaag

SEQ ID NO: 593423 - DNA, 17 bp, Homo sapiens
acacagcattgtatatg

SEQ ID NO: 593424 - DNA, 15 bp, Homo sapiens
acacagttcctggga

SEQ ID NO: 593425 - DNA, 16 bp, Homo sapiens
acacatttgctactgt

SEQ ID NO: 593426 - DNA, 21 bp, Homo sapiens
acacgatgcatttaataaaga

SEQ ID NO: 593427 - DNA, 16 bp, Homo sapiens
acactatttgtgactt

SEQ ID NO: 593428 - DNA, 14 bp, Homo sapiens
acactgtttcctga

SEQ ID NO: 593429 - DNA, 16 bp, Homo sapiens
acagaaggtgaacttt

SEQ ID NO: 593430 - DNA, 24 bp, Homo sapiens
acagaggtagtctcactgcttgaa

SEQ ID NO: 593431 - DNA, 19 bp, Homo sapiens
acagaggtattaaaactaa

SEQ ID NO: 593432 - DNA, 14 bp, Homo sapiens
acagagtggccgtc

SEQ ID NO: 593433 - DNA, 17 bp, Homo sapiens
acagatcgcatttccta

SEQ ID NO: 593434 - DNA, 18 bp, Homo sapiens
acagatcgcatttcctaa

SEQ ID NO: 593435 - DNA, 21 bp, Homo sapiens
acagattctttcagttctttg

SEQ ID NO: 593436 - DNA, 19 bp, Homo sapiens
acagcagccccaggagaag

SEQ ID NO: 593437 - DNA, 15 bp, Homo sapiens
acagccaaatttaaa

SEQ ID NO: 593438 - DNA, 20 bp, Homo sapiens
acagccctggcaaatgcctg

SEQ ID NO: 593439 - DNA, 19 bp, Homo sapiens
acagccttgcagcggctcc

SEQ ID NO: 593440 - DNA, 22 bp, Homo sapiens
acagccttgcagcggctcctgc

SEQ ID NO: 593441 - DNA, 21 bp, Homo sapiens
acagctcctggaccaggccca

SEQ ID NO: 593442 - DNA, 17 bp, Homo sapiens
acagctgtgagccatgc

SEQ ID NO: 593443 - DNA, 18 bp, Homo sapiens
acaggcacattaactgtt

SEQ ID NO: 593444 - DNA, 16 bp, Homo sapiens
acaggtaaaacagggc

SEQ ID NO: 593445 - DNA, 15 bp, Homo sapiens
acagtacccaaactg

SEQ ID NO: 593446 - DNA, 16 bp, Homo sapiens
acagtatagatttttg

SEQ ID NO: 593447 - DNA, 21 bp, Homo sapiens
acagttcctgggaacatcaca

SEQ ID NO: 593448 - DNA, 15 bp, Homo sapiens
acataagcttccatt

SEQ ID NO: 593449 - DNA, 13 bp, Homo sapiens
acatcaaaccttt

SEQ ID NO: 593450 - DNA, 13 bp, Homo sapiens
acatgcaataaaa

SEQ ID NO: 593451 - DNA, 16 bp, Homo sapiens
acatgttaatgacaat

SEQ ID NO: 593452 - DNA, 16 bp, Homo sapiens
acatgtttctctataa

SEQ ID NO: 593453 - DNA, 13 bp, Homo sapiens
acattaactgttg

SEQ ID NO: 593454 - DNA, 19 bp, Homo sapiens
acatttgctactgttgtaa

SEQ ID NO: 593455 - DNA, 23 bp, Homo sapiens
acatttttttgcatgcatgcaaa

SEQ ID NO: 593456 - DNA, 14 bp, Homo sapiens
accaaggctgtgtt

SEQ ID NO: 593457 - DNA, 16 bp, Homo sapiens
accaaggctgtgttta

SEQ ID NO: 593458 - DNA, 20 bp, Homo sapiens
accaatacaaaatgtattac

SEQ ID NO: 593459 - DNA, 13 bp, Homo sapiens
accacacttgaaa

SEQ ID NO: 593460 - DNA, 17 bp, Homo sapiens
accacacttgaaacctt

SEQ ID NO: 593461 - DNA, 13 bp, Homo sapiens
accacttgcctgg

SEQ ID NO: 593462 - DNA, 16 bp, Homo sapiens
accacttgcctggggc

SEQ ID NO: 593463 - DNA, 15 bp, Homo sapiens
accactttattgcaa

SEQ ID NO: 593464 - DNA, 22 bp, Homo sapiens
accagataccttatcttacaat

SEQ ID NO: 593465 - DNA, 12 bp, Homo sapiens
accaggaccctg

SEQ ID NO: 593466 - DNA, 22 bp, Homo sapiens
accaggactagggctggagtga

SEQ ID NO: 593467 - DNA, 22 bp, Homo sapiens
accaggggccaacctcaggctc

SEQ ID NO: 593468 - DNA, 20 bp, Homo sapiens
accagtgtagcatcttcctc

SEQ ID NO: 593469 - DNA, 20 bp, Homo sapiens
aaacagactcgctagcactc

SEQ ID NO: 593470 - DNA, 17 bp, Homo sapiens
aaaccacttgcctgggg

SEQ ID NO: 593471 - DNA, 15 bp, Homo sapiens
aaaccatttttgaac

SEQ ID NO: 593472 - DNA, 15 bp, Homo sapiens
aaacccatcttttgt

SEQ ID NO: 593473 - DNA, 19 bp, Homo sapiens
aaaccgtcctgtgtacaca

SEQ ID NO: 593474 - DNA, 18 bp, Homo sapiens
aaacgaaaacctgactag

SEQ ID NO: 593475 - DNA, 17 bp, Homo sapiens
aaacggttcctggtgac

SEQ ID NO: 593476 - DNA, 22 bp, Homo sapiens
aaacggttcctggtgactcctg

SEQ ID NO: 593477 - DNA, 14 bp, Homo sapiens
aaacgtcctcttta

SEQ ID NO: 593478 - DNA, 13 bp, Homo sapiens
aaactaaatttca

SEQ ID NO: 593479 - DNA, 19 bp, Homo sapiens
aaactatttattgtgctgg

SEQ ID NO: 593480 - DNA, 21 bp, Homo sapiens
aaactatttattgtgctgggt

SEQ ID NO: 593481 - DNA, 16 bp, Homo sapiens
aaactccctggctgtt

SEQ ID NO: 593482 - DNA, 22 bp, Homo sapiens
aaactgatccagtataagacta

SEQ ID NO: 593483 - DNA, 13 bp, Homo sapiens
aaactttgggaaa

SEQ ID NO: 593484 - DNA, 12 bp, Homo sapiens
aaagaaaattga

SEQ ID NO: 593485 - DNA, 19 bp, Homo sapiens
aaagaccacctccaaccca

SEQ ID NO: 593486 - DNA, 14 bp, Homo sapiens
aaagagaatgagtc

SEQ ID NO: 593487 - DNA, 21 bp, Homo sapiens
aaagagttgggtgtctcctta

SEQ ID NO: 593488 - DNA, 13 bp, Homo sapiens
aaagatacttaca

SEQ ID NO: 593489 - DNA, 21 bp, Homo sapiens
aaagatgcatcatctcttcct

SEQ ID NO: 593490 - DNA, 18 bp, Homo sapiens
aaagatgcgtttgcctcc

SEQ ID NO: 593491 - DNA, 20 bp, Homo sapiens
aaagatgcgtttgcctcctg

SEQ ID NO: 593492 - DNA, 22 bp, Homo sapiens
aaagcatgttcacccttatagt

SEQ ID NO: 593493 - DNA, 18 bp, Homo sapiens
aaagctgcaaaaattata

SEQ ID NO: 593494 - DNA, 21 bp, Homo sapiens
aaaggatagtaagcatagaaa

SEQ ID NO: 593495 - DNA, 20 bp, Homo sapiens
aaaggtattatacatgtgat

SEQ ID NO: 593496 - DNA, 20 bp, Homo sapiens
aaaggtttaagaaatagaat

SEQ ID NO: 593497 - DNA, 18 bp, Homo sapiens
aaagtagtgttgtccagg

SEQ ID NO: 593498 - DNA, 20 bp, Homo sapiens
aaagtggaacgaaaatgaaa

SEQ ID NO: 593499 - DNA, 18 bp, Homo sapiens
agatgatgctttggaaga

SEQ ID NO: 593500 - DNA, 20 bp, Homo sapiens
agatgcatcatctcttcctc

SEQ ID NO: 593501 - DNA, 21 bp, Homo sapiens
agatgcatcatctcttcctca

SEQ ID NO: 593502 - DNA, 15 bp, Homo sapiens
agatgccccagggat

SEQ ID NO: 593503 - DNA, 17 bp, Homo sapiens
agatgcgtttgcctcct

SEQ ID NO: 593504 - DNA, 21 bp, Homo sapiens
agatgctacttcccactgtat

SEQ ID NO: 593505 - DNA, 20 bp, Homo sapiens
agatgctgatggagccttcc

SEQ ID NO: 593506 - DNA, 13 bp, Homo sapiens
agatgctggctgg

SEQ ID NO: 593507 - DNA, 13 bp, Homo sapiens
agatggagtccct

SEQ ID NO: 593508 - DNA, 16 bp, Homo sapiens
agatgtttatttcagg

SEQ ID NO: 593509 - DNA, 11 bp, Homo sapiens
agattgaactt

SEQ ID NO: 593510 - DNA, 17 bp, Homo sapiens
agattgactaactcaaa

SEQ ID NO: 593511 - DNA, 15 bp, Homo sapiens
agattggttttcctg

SEQ ID NO: 593512 - DNA, 23 bp, Homo sapiens
agcaaattccagatttgtttcct

SEQ ID NO: 593513 - DNA, 16 bp, Homo sapiens
agcaatctgaccctat

SEQ ID NO: 593514 - DNA, 20 bp, Homo sapiens
agcaattccatgctataaaa

SEQ ID NO: 593515 - DNA, 16 bp, Homo sapiens
agcactcctgcttaat

SEQ ID NO: 593516 - DNA, 19 bp, Homo sapiens
agcagagttttcattaaat

SEQ ID NO: 593517 - DNA, 14 bp, Homo sapiens
agcagccccaggag

SEQ ID NO: 593518 - DNA, 23 bp, Homo sapiens
agcagggctaaataaagaggaga

SEQ ID NO: 593519 - DNA, 20 bp, Homo sapiens
agcagtcgcccaagcagaca

SEQ ID NO: 593520 - DNA, 22 bp, Homo sapiens
agcagtttccagagagtggaga

SEQ ID NO: 593521 - DNA, 20 bp, Homo sapiens
agcatagaaaccactagaaa

SEQ ID NO: 593522 - DNA, 13 bp, Homo sapiens
agcatggggccag

SEQ ID NO: 593523 - DNA, 23 bp, Homo sapiens
agcatgtccaacatggtaattca

SEQ ID NO: 593524 - DNA, 13 bp, Homo sapiens
agccaaatttaaa

SEQ ID NO: 593525 - DNA, 19 bp, Homo sapiens
agccaatctacaatctctt

SEQ ID NO: 593526 - DNA, 16 bp, Homo sapiens
agccaggaggcctgct

SEQ ID NO: 593527 - DNA, 21 bp, Homo sapiens
agccaggcaagaaagcttcct

SEQ ID NO: 593528 - DNA, 15 bp, Homo sapiens
agccatgcctccctg

SEQ ID NO: 593529 - DNA, 13 bp, Homo sapiens
agccctcccccaa

SEQ ID NO: 593530 - DNA, 19 bp, Homo sapiens
agccctggcaaatgcctga

SEQ ID NO: 593531 - DNA, 18 bp, Homo sapiens
agccggcctgagaaacac

SEQ ID NO: 593532 - DNA, 16 bp, Homo sapiens
agccggtgggtgagga

SEQ ID NO: 593533 - DNA, 19 bp, Homo sapiens
agcctaaggctcctgtttt

SEQ ID NO: 593534 - DNA, 21 bp, Homo sapiens
agcctaagggatcctgcctgc

SEQ ID NO: 593535 - DNA, 15 bp, Homo sapiens
agcctatgtctggca

SEQ ID NO: 593536 - DNA, 18 bp, Homo sapiens
agcctatgtctggcagat

SEQ ID NO: 593537 - DNA, 19 bp, Homo sapiens
agcctatgtctggcagatg

SEQ ID NO: 593538 - DNA, 17 bp, Homo sapiens
agcctgctttcctgcag

SEQ ID NO: 593539 - DNA, 20 bp, Homo sapiens
agcctggtttgcaaagacca

SEQ ID NO: 593540 - DNA, 18 bp, Homo sapiens
agcgacctctctgcctct

SEQ ID NO: 593541 - DNA, 19 bp, Homo sapiens
agcgacctctctgcctctc

SEQ ID NO: 593542 - DNA, 21 bp, Homo sapiens
agctaaagtttggttttgaca

SEQ ID NO: 593543 - DNA, 22 bp, Homo sapiens
agctacccaggaggctgaggtg

SEQ ID NO: 593544 - DNA, 18 bp, Homo sapiens
agctattagcggctcctc

SEQ ID NO: 593545 - DNA, 21 bp, Homo sapiens
agctctcaggaccgtgccctc

SEQ ID NO: 593546 - DNA, 19 bp, Homo sapiens
agctcttcctatccctctc

SEQ ID NO: 593547 - DNA, 15 bp, Homo sapiens
agctgagcatggaga

SEQ ID NO: 593548 - DNA, 19 bp, Homo sapiens
agctgaggctgagaaagct

SEQ ID NO: 593549 - DNA, 18 bp, Homo sapiens
agctgcaaaaattatata

SEQ ID NO: 593550 - DNA, 14 bp, Homo sapiens
agctgccaagagtg

SEQ ID NO: 593551 - DNA, 21 bp, Homo sapiens
agctgccgtagcttcagccag

SEQ ID NO: 593552 - DNA, 22 bp, Homo sapiens
agctgccgtagcttcagccagg

SEQ ID NO: 593553 - DNA, 16 bp, Homo sapiens
agctgctgttgaactt

SEQ ID NO: 593554 - DNA, 14 bp, Homo sapiens
agctgtatcactgc

SEQ ID NO: 593555 - DNA, 18 bp, Homo sapiens
agctgtgagccatgcctc

SEQ ID NO: 593556 - DNA, 20 bp, Homo sapiens
agctgtgagccatgcctccc

SEQ ID NO: 593557 - DNA, 21 bp, Homo sapiens
agctgtgagccatgcctccct

SEQ ID NO: 593558 - DNA, 14 bp, Homo sapiens
agcttaatgctaca

SEQ ID NO: 593559 - DNA, 17 bp, Homo sapiens
agcttgtggtggggcag

SEQ ID NO: 593560 - DNA, 22 bp, Homo sapiens
agcttgttttgtttcatcctgt

SEQ ID NO: 593561 - DNA, 22 bp, Homo sapiens
agctttcctttttcccaataaa

SEQ ID NO: 593562 - DNA, 17 bp, Homo sapiens
aggaaagagaggaacca

SEQ ID NO: 593563 - DNA, 17 bp, Homo sapiens
aggaacaatctttgctg

SEQ ID NO: 593564 - DNA, 20 bp, Homo sapiens
aggaagccatagatgctggc

SEQ ID NO: 593565 - DNA, 21 bp, Homo sapiens
aggaagccatagatgctggct

SEQ ID NO: 593566 - DNA, 12 bp, Homo sapiens
aggacagctcct

SEQ ID NO: 593567 - DNA, 22 bp, Homo sapiens
aggacatgcaataaaatttaaa

SEQ ID NO: 593568 - DNA, 14 bp, Homo sapiens
aggacccagagctg

SEQ ID NO: 593569 - DNA, 15 bp, Homo sapiens
aggacccagagctgc

SEQ ID NO: 593570 - DNA, 16 bp, Homo sapiens
aggacccagagctgct

SEQ ID NO: 593571 - DNA, 13 bp, Homo sapiens
aggaccgtgccct

SEQ ID NO: 593572 - DNA, 16 bp, Homo sapiens
aggacttgaaagaaat

SEQ ID NO: 593573 - DNA, 20 bp, Homo sapiens
aggagaattgcttgaacctg

SEQ ID NO: 593574 - DNA, 17 bp, Homo sapiens
aggagataaggtggctt

SEQ ID NO: 593575 - DNA, 18 bp, Homo sapiens
aggaggtccttaggcctc

SEQ ID NO: 593576 - DNA, 17 bp, Homo sapiens
aggagtggtgatttgaa

SEQ ID NO: 593577 - DNA, 19 bp, Homo sapiens
aggatcacttgagcccagg

SEQ ID NO: 593578 - DNA, 16 bp, Homo sapiens
aggatcccgtcttcca

SEQ ID NO: 593579 - DNA, 14 bp, Homo sapiens
aggatccggaaaga

SEQ ID NO: 593580 - DNA, 19 bp, Homo sapiens
aggatgcccagacatcagc

SEQ ID NO: 593581 - DNA, 16 bp, Homo sapiens
aggatgggtcccctcc

SEQ ID NO: 593582 - DNA, 15 bp, Homo sapiens
aggcacattaactgt

SEQ ID NO: 593583 - DNA, 23 bp, Homo sapiens
aggcagcctagcctatgtctggc

SEQ ID NO: 593584 - DNA, 19 bp, Homo sapiens
aggcaggaacaaacagggc

SEQ ID NO: 593585 - DNA, 16 bp, Homo sapiens
aggcatgtacaaaaat

SEQ ID NO: 593586 - DNA, 18 bp, Homo sapiens
aggcatgtacaaaaatta

SEQ ID NO: 593587 - DNA, 23 bp, Homo sapiens
aggccacagaaggtgaactttgt

SEQ ID NO: 593588 - DNA, 21 bp, Homo sapiens
aggccagagcaaacagaaaaa

SEQ ID NO: 593589 - DNA, 17 bp, Homo sapiens
aggctccgggcaccagg

SEQ ID NO: 593590 - DNA, 16 bp, Homo sapiens
aggctcctgttttgca

SEQ ID NO: 593591 - DNA, 21 bp, Homo sapiens
aggctgagaaagctaaagttt

SEQ ID NO: 593592 - DNA, 17 bp, Homo sapiens
aggctgtgtttagattg

SEQ ID NO: 593593 - DNA, 21 bp, Homo sapiens
agggaataataggccacagaa

SEQ ID NO: 593594 - DNA, 16 bp, Homo sapiens
agggaggcagcctagc

SEQ ID NO: 593595 - DNA, 14 bp, Homo sapiens
agggcaatggacaa

SEQ ID NO: 593596 - DNA, 18 bp, Homo sapiens
agggccacatagatgctg

SEQ ID NO: 593597 - DNA, 17 bp, Homo sapiens
agggctaaataaagagg

SEQ ID NO: 593598 - DNA, 20 bp, Homo sapiens
agggctaaataaagaggaga

SEQ ID NO: 593599 - DNA, 18 bp, Homo sapiens
agggggtatgcagagctt

SEQ ID NO: 593600 - DNA, 23 bp, Homo sapiens
agggtctaccaatacaaaatgta

SEQ ID NO: 593601 - DNA, 14 bp, Homo sapiens
agggtgctgactgg

SEQ ID NO: 593602 - DNA, 14 bp, Homo sapiens
aggtaaaacagggc

SEQ ID NO: 593603 - DNA, 15 bp, Homo sapiens
aggtagtctcactgc

SEQ ID NO: 593604 - DNA, 17 bp, Homo sapiens
aggtatgggctgggggc

SEQ ID NO: 593605 - DNA, 18 bp, Homo sapiens
aggtatgggctgggggct

SEQ ID NO: 593606 - DNA, 19 bp, Homo sapiens
aggtattaaaactaaattt

SEQ ID NO: 593607 - DNA, 20 bp, Homo sapiens
aggtattaaaactaaatttc

SEQ ID NO: 593608 - DNA, 19 bp, Homo sapiens
aggtggcttctcacggcct

SEQ ID NO: 593609 - DNA, 23 bp, Homo sapiens
acttatgttactggtgtccagct

SEQ ID NO: 593610 - DNA, 15 bp, Homo sapiens
acttcctcctacctg

SEQ ID NO: 593611 - DNA, 19 bp, Homo sapiens
acttcctcctacctgggga

SEQ ID NO: 593612 - DNA, 20 bp, Homo sapiens
acttctgaagagaccactca

SEQ ID NO: 593613 - DNA, 16 bp, Homo sapiens
acttctgcaacaagca

SEQ ID NO: 593614 - DNA, 19 bp, Homo sapiens
acttctgcaacaagcatgc

SEQ ID NO: 593615 - DNA, 21 bp, Homo sapiens
acttctgtaattgtgtggatt

SEQ ID NO: 593616 - DNA, 13 bp, Homo sapiens
acttgcctctgca

SEQ ID NO: 593617 - DNA, 20 bp, Homo sapiens
acttggagaatactgccaaa

SEQ ID NO: 593618 - DNA, 17 bp, Homo sapiens
acttggttgatgtttaa

SEQ ID NO: 593619 - DNA, 19 bp, Homo sapiens
acttgttttggatggcttg

SEQ ID NO: 593620 - DNA, 20 bp, Homo sapiens
acttgttttggatggcttgt

SEQ ID NO: 593621 - DNA, 13 bp, Homo sapiens
actttaaattgtg

SEQ ID NO: 593622 - DNA, 16 bp, Homo sapiens
actttagaagcctgca

SEQ ID NO: 593623 - DNA, 15 bp, Homo sapiens
actttattgcaatgc

SEQ ID NO: 593624 - DNA, 22 bp, Homo sapiens
actttctatttttatgatgaca

SEQ ID NO: 593625 - DNA, 20 bp, Homo sapiens
actttcttatccaacttttt

SEQ ID NO: 593626 - DNA, 14 bp, Homo sapiens
actttgacagtgtt

SEQ ID NO: 593627 - DNA, 22 bp, Homo sapiens
actttgacctaaattatttact

SEQ ID NO: 593628 - DNA, 19 bp, Homo sapiens
actttgggaaaacatgtta

SEQ ID NO: 593629 - DNA, 19 bp, Homo sapiens
actttgggaggctgaggtg

SEQ ID NO: 593630 - DNA, 21 bp, Homo sapiens
actttgtaaaaatcttttgaa

SEQ ID NO: 593631 - DNA, 19 bp, Homo sapiens
acttttcaatgtctaaaaa

SEQ ID NO: 593632 - DNA, 18 bp, Homo sapiens
actttttaaagaagtgca

SEQ ID NO: 593633 - DNA, 19 bp, Homo sapiens
agaaaaaaagctgcaaaaa

SEQ ID NO: 593634 - DNA, 12 bp, Homo sapiens
agaaaaccactt

SEQ ID NO: 593635 - DNA, 23 bp, Homo sapiens
agaaaaccactttattgcaatgc

SEQ ID NO: 593636 - DNA, 23 bp, Homo sapiens
agaaaacctgatgctggggacac

SEQ ID NO: 593637 - DNA, 23 bp, Homo sapiens
agaaaatggcacttgggggactg

SEQ ID NO: 593638 - DNA, 19 bp, Homo sapiens
agaaacactatttgtgact

SEQ ID NO: 593639 - DNA, 11 bp, Homo sapiens
agaaacactga

SEQ ID NO: 593640 - DNA, 22 bp, Homo sapiens
agaaagagtttgaaactcgaga

SEQ ID NO: 593641 - DNA, 21 bp, Homo sapiens
agaaagcacaatttaaaacaa

SEQ ID NO: 593642 - DNA, 22 bp, Homo sapiens
agaaagcacaatttaaaacaat

SEQ ID NO: 593643 - DNA, 22 bp, Homo sapiens
agaaagtgggcttaatggagtt

SEQ ID NO: 593644 - DNA, 17 bp, Homo sapiens
agaaataataaaaagaa

SEQ ID NO: 593645 - DNA, 21 bp, Homo sapiens
agaaataataaaaagaaagat

SEQ ID NO: 593646 - DNA, 20 bp, Homo sapiens
agaaataatgctacaatttt

SEQ ID NO: 593647 - DNA, 19 bp, Homo sapiens
agaaatataacacattttt

SEQ ID NO: 593648 - DNA, 22 bp, Homo sapiens
agaaatgcccccattctcccag

SEQ ID NO: 593649 - DNA, 19 bp, Homo sapiens
agaaattcaatttggattt

SEQ ID NO: 593650 - DNA, 22 bp, Homo sapiens
agaaattcaatttggatttaaa

SEQ ID NO: 593651 - DNA, 11 bp, Homo sapiens
agaacacagtt

SEQ ID NO: 593652 - DNA, 16 bp, Homo sapiens
agaaccacacttgaaa

SEQ ID NO: 593653 - DNA, 20 bp, Homo sapiens
agaaccacacttgaaacctt

SEQ ID NO: 593654 - DNA, 21 bp, Homo sapiens
agaaccacacttgaaaccttt

SEQ ID NO: 593655 - DNA, 15 bp, Homo sapiens
agaactatgaaatca

SEQ ID NO: 593656 - DNA, 13 bp, Homo sapiens
agaactctctgga

SEQ ID NO: 593657 - DNA, 16 bp, Homo sapiens
agaagagggaaaacag

SEQ ID NO: 593658 - DNA, 18 bp, Homo sapiens
agaagagggaaaacagaa

SEQ ID NO: 593659 - DNA, 19 bp, Homo sapiens
agaaggggctttgtgacca

SEQ ID NO: 593660 - DNA, 14 bp, Homo sapiens
agaagtgagcaaaa

SEQ ID NO: 593661 - DNA, 19 bp, Homo sapiens
agaagtttctttaaagacg

SEQ ID NO: 593662 - DNA, 16 bp, Homo sapiens
agaataataattaacc

SEQ ID NO: 593663 - DNA, 16 bp, Homo sapiens
agaataccacatcaaa

SEQ ID NO: 593664 - DNA, 17 bp, Homo sapiens
agaatactgccaaaaca

SEQ ID NO: 593665 - DNA, 13 bp, Homo sapiens
agaatcagacagc

SEQ ID NO: 593666 - DNA, 16 bp, Homo sapiens
agaattgaaaagtttt

SEQ ID NO: 593667 - DNA, 17 bp, Homo sapiens
agaattgaaaagttttt

SEQ ID NO: 593668 - DNA, 13 bp, Homo sapiens
agaatttaatata

SEQ ID NO: 593669 - DNA, 15 bp, Homo sapiens
agacaaaacagataa

SEQ ID NO: 593670 - DNA, 23 bp, Homo sapiens
agacaacaggtaaaacagggcca

SEQ ID NO: 593671 - DNA, 14 bp, Homo sapiens
agacacagaacaca

SEQ ID NO: 593672 - DNA, 17 bp, Homo sapiens
agacagcagtttccaga

SEQ ID NO: 593673 - DNA, 17 bp, Homo sapiens
agacagcccaggatact

SEQ ID NO: 593674 - DNA, 11 bp, Homo sapiens
agaccacctcc

SEQ ID NO: 593675 - DNA, 19 bp, Homo sapiens
agaccataaagatattctt

SEQ ID NO: 593676 - DNA, 20 bp, Homo sapiens
agaccctgaacccacacctg

SEQ ID NO: 593677 - DNA, 13 bp, Homo sapiens
agaccctgtctct

SEQ ID NO: 593678 - DNA, 22 bp, Homo sapiens
agactgaatagatatgaaagct

SEQ ID NO: 593679 - DNA, 21 bp, Homo sapiens
agactggatttgcagaagttt

SEQ ID NO: 593680 - DNA, 18 bp, Homo sapiens
agactgggcactggggcc

SEQ ID NO: 593681 - DNA, 16 bp, Homo sapiens
agactggttcggctct

SEQ ID NO: 593682 - DNA, 20 bp, Homo sapiens
agacttggagaatactgcca

SEQ ID NO: 593683 - DNA, 13 bp, Homo sapiens
agagaacctgtgg

SEQ ID NO: 593684 - DNA, 17 bp, Homo sapiens
agagaacctgtgggctg

SEQ ID NO: 593685 - DNA, 21 bp, Homo sapiens
agagaaggatgggtcccctcc

SEQ ID NO: 593686 - DNA, 16 bp, Homo sapiens
agagacagcccaggat

SEQ ID NO: 593687 - DNA, 18 bp, Homo sapiens
agagacagcccaggatac

SEQ ID NO: 593688 - DNA, 14 bp, Homo sapiens
agagagcagggcta

SEQ ID NO: 593689 - DNA, 13 bp, Homo sapiens
agagagtggagag

SEQ ID NO: 593690 - DNA, 14 bp, Homo sapiens
agagatcaaagatg

SEQ ID NO: 593691 - DNA, 20 bp, Homo sapiens
agagcaagagataagtcttt

SEQ ID NO: 593692 - DNA, 14 bp, Homo sapiens
agagccctgaggcc

SEQ ID NO: 593693 - DNA, 14 bp, Homo sapiens
agagcgcacaggga

SEQ ID NO: 593694 - DNA, 17 bp, Homo sapiens
agagctactcccacagc

SEQ ID NO: 593695 - DNA, 20 bp, Homo sapiens
agagctgctgcacacactca

SEQ ID NO: 593696 - DNA, 19 bp, Homo sapiens
agaggagataaggtggctt

SEQ ID NO: 593697 - DNA, 20 bp, Homo sapiens
agaggagataaggtggcttc

SEQ ID NO: 593698 - DNA, 22 bp, Homo sapiens
agaggcataaacctgtgctgaa

SEQ ID NO: 593699 - DNA, 19 bp, Homo sapiens
agaggcttgtttacctttc

SEQ ID NO: 593700 - DNA, 14 bp, Homo sapiens
agagtgaagggaag

SEQ ID NO: 593701 - DNA, 16 bp, Homo sapiens
agagtggagagagcag

SEQ ID NO: 593702 - DNA, 19 bp, Homo sapiens
agagttgggacaattgctt

SEQ ID NO: 593703 - DNA, 19 bp, Homo sapiens
agagttgggtgtctcctta

SEQ ID NO: 593704 - DNA, 14 bp, Homo sapiens
agagtttgaaactc

SEQ ID NO: 593705 - DNA, 14 bp, Homo sapiens
agataaaatgatgt

SEQ ID NO: 593706 - DNA, 15 bp, Homo sapiens
agataaaatgatgtt

SEQ ID NO: 593707 - DNA, 17 bp, Homo sapiens
agataaggtggcttctc

SEQ ID NO: 593708 - DNA, 17 bp, Homo sapiens
agataatattgtttggt

SEQ ID NO: 593709 - DNA, 20 bp, Homo sapiens
agataatattgtttggtaaa

SEQ ID NO: 593710 - DNA, 18 bp, Homo sapiens
agatactaaggacgttgt

SEQ ID NO: 593711 - DNA, 16 bp, Homo sapiens
agatacttacatgttc

SEQ ID NO: 593712 - DNA, 15 bp, Homo sapiens
agatatctcaatgaa

SEQ ID NO: 593713 - DNA, 16 bp, Homo sapiens
agatcctgggtttcca

SEQ ID NO: 593714 - DNA, 13 bp, Homo sapiens
agatctttatatt

SEQ ID NO: 593715 - DNA, 12 bp, Homo sapiens
agatctttcaga

SEQ ID NO: 593716 - DNA, 17 bp, Homo sapiens
agatgaatgtcctgaaa

SEQ ID NO: 593717 - DNA, 17 bp, Homo sapiens
aggtgtttgtggggctg

SEQ ID NO: 593718 - DNA, 22 bp, Homo sapiens
aggttctgtagagccaattaga

SEQ ID NO: 593719 - DNA, 18 bp, Homo sapiens
aggttgggggaaccagca

SEQ ID NO: 593720 - DNA, 19 bp, Homo sapiens
aggtttcaggaagttgcca

SEQ ID NO: 593721 - DNA, 19 bp, Homo sapiens
agtaacccccttaaattta

SEQ ID NO: 593722 - DNA, 14 bp, Homo sapiens
agtaagatatctca

SEQ ID NO: 593723 - DNA, 18 bp, Homo sapiens
agtacgaacctacagttt

SEQ ID NO: 593724 - DNA, 23 bp, Homo sapiens
agtagatccatttccattgctta

SEQ ID NO: 593725 - DNA, 13 bp, Homo sapiens
agtagggccaggg

SEQ ID NO: 593726 - DNA, 13 bp, Homo sapiens
agtaggtgatgag

SEQ ID NO: 593727 - DNA, 14 bp, Homo sapiens
agtattgtttaaaa

SEQ ID NO: 593728 - DNA, 22 bp, Homo sapiens
agtcagaatttttaactgtact

SEQ ID NO: 593729 - DNA, 12 bp, Homo sapiens
agtcccttccta

SEQ ID NO: 593730 - DNA, 14 bp, Homo sapiens
agtcccttcctatt

SEQ ID NO: 593731 - DNA, 19 bp, Homo sapiens
agtcctaaaagttctcaat

SEQ ID NO: 593732 - DNA, 13 bp, Homo sapiens
agtcctaacaaat

SEQ ID NO: 593733 - DNA, 14 bp, Homo sapiens
agtcgtggggaacg

SEQ ID NO: 593734 - DNA, 18 bp, Homo sapiens
agtctcactgcttgaact

SEQ ID NO: 593735 - DNA, 17 bp, Homo sapiens
agtctccagaagaaaat

SEQ ID NO: 593736 - DNA, 16 bp, Homo sapiens
agtctgagggaaacca

SEQ ID NO: 593737 - DNA, 16 bp, Homo sapiens
agtctgtatttttcta

SEQ ID NO: 593738 - DNA, 23 bp, Homo sapiens
agtgacaaagcctctgaaagatg

SEQ ID NO: 593739 - DNA, 17 bp, Homo sapiens
agtgacatttaatgcca

SEQ ID NO: 593740 - DNA, 15 bp, Homo sapiens
agtgaccagtgcctg

SEQ ID NO: 593741 - DNA, 22 bp, Homo sapiens
agtgcctgtgagcatggggcca

SEQ ID NO: 593742 - DNA, 16 bp, Homo sapiens
agtggaacgaaaatga

SEQ ID NO: 593743 - DNA, 15 bp, Homo sapiens
agtggatcacaaagt

SEQ ID NO: 593744 - DNA, 16 bp, Homo sapiens
agtggatcacaaagtg

SEQ ID NO: 593745 - DNA, 22 bp, Homo sapiens
agtgggataaaggcccagactc

SEQ ID NO: 593746 - DNA, 16 bp, Homo sapiens
agtgggctttggtggc

SEQ ID NO: 593747 - DNA, 22 bp, Homo sapiens
agtgggggatgggtcctctaga

SEQ ID NO: 593748 - DNA, 22 bp, Homo sapiens
agtgtgtaaataatttgcactg

SEQ ID NO: 593749 - DNA, 23 bp, Homo sapiens
agtgtgtaaataatttgcactga

SEQ ID NO: 593750 - DNA, 18 bp, Homo sapiens
agtgtgtatatattttgt

SEQ ID NO: 593751 - DNA, 23 bp, Homo sapiens
agtgtgtatatattttgtgtgaa

SEQ ID NO: 593752 - DNA, 19 bp, Homo sapiens
agtgttctgcatggattca

SEQ ID NO: 593753 - DNA, 23 bp, Homo sapiens
agtgttctgcatggattcagcat

SEQ ID NO: 593754 - DNA, 21 bp, Homo sapiens
agtgttggtatattttatatt

SEQ ID NO: 593755 - DNA, 22 bp, Homo sapiens
agtgttttggtggaaaaaacat

SEQ ID NO: 593756 - DNA, 18 bp, Homo sapiens
agttagctgaagaattga

SEQ ID NO: 593757 - DNA, 13 bp, Homo sapiens
agttcccagagtg

SEQ ID NO: 593758 - DNA, 14 bp, Homo sapiens
agttcccagagtgg

SEQ ID NO: 593759 - DNA, 18 bp, Homo sapiens
agttcccagagtgggctt

SEQ ID NO: 593760 - DNA, 19 bp, Homo sapiens
agttctaacagtgaagttt

SEQ ID NO: 593761 - DNA, 15 bp, Homo sapiens
agttctggatgtctg

SEQ ID NO: 593762 - DNA, 19 bp, Homo sapiens
agttctggatgtctggctc

SEQ ID NO: 593763 - DNA, 16 bp, Homo sapiens
agttgaggccaggagt

SEQ ID NO: 593764 - DNA, 23 bp, Homo sapiens
agttgcacttattgaccattttt

SEQ ID NO: 593765 - DNA, 16 bp, Homo sapiens
agttgggtgtctcctt

SEQ ID NO: 593766 - DNA, 23 bp, Homo sapiens
agttgtgtttcaacggaaagtgc

SEQ ID NO: 593767 - DNA, 13 bp, Homo sapiens
agtttaatgtctc

SEQ ID NO: 593768 - DNA, 16 bp, Homo sapiens
agtttccagagagtgg

SEQ ID NO: 593769 - DNA, 13 bp, Homo sapiens
agtttcttgcttg

SEQ ID NO: 593770 - DNA, 14 bp, Homo sapiens
agtttgaattcagt

SEQ ID NO: 593771 - DNA, 15 bp, Homo sapiens
agtttgaattcagta

SEQ ID NO: 593772 - DNA, 18 bp, Homo sapiens
agtttgacagtttttgac

SEQ ID NO: 593773 - DNA, 18 bp, Homo sapiens
agttttaactgtggatat

SEQ ID NO: 593774 - DNA, 15 bp, Homo sapiens
agttttatatgcttt

SEQ ID NO: 593775 - DNA, 18 bp, Homo sapiens
agttttgttgtacttaaa

SEQ ID NO: 593776 - DNA, 17 bp, Homo sapiens
agtttttggttgggaat

SEQ ID NO: 593777 - DNA, 12 bp, Homo sapiens
ataaaagacaca

SEQ ID NO: 593778 - DNA, 12 bp, Homo sapiens
ataaaatttaaa

SEQ ID NO: 593779 - DNA, 16 bp, Homo sapiens
ataaacggttcctggt

SEQ ID NO: 593780 - DNA, 16 bp, Homo sapiens
ataaagatattgttca

SEQ ID NO: 593781 - DNA, 15 bp, Homo sapiens
ataaagatgagttgg

SEQ ID NO: 593782 - DNA, 15 bp, Homo sapiens
ataaagtacttgact

SEQ ID NO: 593783 - DNA, 17 bp, Homo sapiens
ataaatgtataaatata

SEQ ID NO: 593784 - DNA, 13 bp, Homo sapiens
ataacacattttt

SEQ ID NO: 593785 - DNA, 23 bp, Homo sapiens
ataacacatttttttgcatgcat

SEQ ID NO: 593786 - DNA, 15 bp, Homo sapiens
ataacttctcatgta

SEQ ID NO: 593787 - DNA, 20 bp, Homo sapiens
ataacttctcatgtatatta

SEQ ID NO: 593788 - DNA, 22 bp, Homo sapiens
ataagaaataatgctacaattt

SEQ ID NO: 593789 - DNA, 15 bp, Homo sapiens
ataagataaaatgat

SEQ ID NO: 593790 - DNA, 13 bp, Homo sapiens
ataaggtggcttc

SEQ ID NO: 593791 - DNA, 16 bp, Homo sapiens
ataataaaaagaaaga

SEQ ID NO: 593792 - DNA, 13 bp, Homo sapiens
ataataaaggaac

SEQ ID NO: 593793 - DNA, 14 bp, Homo sapiens
ataatactactact

SEQ ID NO: 593794 - DNA, 16 bp, Homo sapiens
ataatactactactgt

SEQ ID NO: 593795 - DNA, 22 bp, Homo sapiens
ataataggaacaatctttgctg

SEQ ID NO: 593796 - DNA, 16 bp, Homo sapiens
ataatattgtttggta

SEQ ID NO: 593797 - DNA, 21 bp, Homo sapiens
ataatgacactgtttcctgat

SEQ ID NO: 593798 - DNA, 15 bp, Homo sapiens
ataatgctacaattt

SEQ ID NO: 593799 - DNA, 20 bp, Homo sapiens
ataatgctacaattttaaga

SEQ ID NO: 593800 - DNA, 14 bp, Homo sapiens
ataatgctttgtta

SEQ ID NO: 593801 - DNA, 19 bp, Homo sapiens
ataatgggattagaaacaa

SEQ ID NO: 593802 - DNA, 21 bp, Homo sapiens
ataattaaccaaccttgttta

SEQ ID NO: 593803 - DNA, 13 bp, Homo sapiens
ataatttaaagtt

SEQ ID NO: 593804 - DNA, 14 bp, Homo sapiens
ataatttgaacttt

SEQ ID NO: 593805 - DNA, 13 bp, Homo sapiens
ataatttgcactg

SEQ ID NO: 593806 - DNA, 14 bp, Homo sapiens
ataatttgcactga

SEQ ID NO: 593807 - DNA, 17 bp, Homo sapiens
atacatcaatatgtata

SEQ ID NO: 593808 - DNA, 16 bp, Homo sapiens
atacatgtgatacatt

SEQ ID NO: 593809 - DNA, 12 bp, Homo sapiens
atttacttgttt

SEQ ID NO: 593810 - DNA, 16 bp, Homo sapiens
atttacttgttttgga

SEQ ID NO: 593811 - DNA, 14 bp, Homo sapiens
atttagtaagaata

SEQ ID NO: 593812 - DNA, 17 bp, Homo sapiens
atttatagaatttaata

SEQ ID NO: 593813 - DNA, 15 bp, Homo sapiens
atttatggttgttaa

SEQ ID NO: 593814 - DNA, 23 bp, Homo sapiens
atttatggttgttaaaaatgtca

SEQ ID NO: 593815 - DNA, 15 bp, Homo sapiens
atttcaataaatgat

SEQ ID NO: 593816 - DNA, 22 bp, Homo sapiens
atttcaataaatgatatataat

SEQ ID NO: 593817 - DNA, 22 bp, Homo sapiens
atttccagaaccacacttgaaa

SEQ ID NO: 593818 - DNA, 18 bp, Homo sapiens
atttccctccagagaaag

SEQ ID NO: 593819 - DNA, 15 bp, Homo sapiens
atttgaactttggaa

SEQ ID NO: 593820 - DNA, 16 bp, Homo sapiens
atttgaactttggaac

SEQ ID NO: 593821 - DNA, 16 bp, Homo sapiens
atttgagcatatcagt

SEQ ID NO: 593822 - DNA, 18 bp, Homo sapiens
atttggatttaaaagcct

SEQ ID NO: 593823 - DNA, 16 bp, Homo sapiens
atttgtatatgactgc

SEQ ID NO: 593824 - DNA, 21 bp, Homo sapiens
atttgtatatgactgcatttg

SEQ ID NO: 593825 - DNA, 13 bp, Homo sapiens
atttgtgactttt

SEQ ID NO: 593826 - DNA, 21 bp, Homo sapiens
atttgtgtgtgtgtgtgtgtt

SEQ ID NO: 593827 - DNA, 17 bp, Homo sapiens
attttaaagtgcaaaag

SEQ ID NO: 593828 - DNA, 14 bp, Homo sapiens
attttagaaataat

SEQ ID NO: 593829 - DNA, 20 bp, Homo sapiens
attttagaaataataaaaag

SEQ ID NO: 593830 - DNA, 11 bp, Homo sapiens
attttcagtac

SEQ ID NO: 593831 - DNA, 16 bp, Homo sapiens
attttcatattgtaat

SEQ ID NO: 593832 - DNA, 20 bp, Homo sapiens
attttcatgaaaataccatt

SEQ ID NO: 593833 - DNA, 21 bp, Homo sapiens
attttccgcccactcctggga

SEQ ID NO: 593834 - DNA, 16 bp, Homo sapiens
attttgaaatgaactt

SEQ ID NO: 593835 - DNA, 19 bp, Homo sapiens
attttggggggttatttat

SEQ ID NO: 593836 - DNA, 11 bp, Homo sapiens
atttttatgat

SEQ ID NO: 593837 - DNA, 21 bp, Homo sapiens
atttttgtgaagtattcacaa

SEQ ID NO: 593838 - DNA, 21 bp, Homo sapiens
attttttaagcttcagttgct

SEQ ID NO: 593839 - DNA, 13 bp, Homo sapiens
atttttttctatt

SEQ ID NO: 593840 - DNA, 14 bp, Homo sapiens
caaaaattatatat

SEQ ID NO: 593841 - DNA, 22 bp, Homo sapiens
caaaaattatgcaattcagtgt

SEQ ID NO: 593842 - DNA, 16 bp, Homo sapiens
caaaccacttgcctgg

SEQ ID NO: 593843 - DNA, 14 bp, Homo sapiens
caaacctttgagta

SEQ ID NO: 593844 - DNA, 21 bp, Homo sapiens
caaactgcttcccttactttg

SEQ ID NO: 593845 - DNA, 17 bp, Homo sapiens
caaagaaacaaagatgt

SEQ ID NO: 593846 - DNA, 19 bp, Homo sapiens
caaagaccacctccaaccc

SEQ ID NO: 593847 - DNA, 12 bp, Homo sapiens
caaagatgaaaa

SEQ ID NO: 593848 - DNA, 21 bp, Homo sapiens
caaagatgcgtttgcctcctg

SEQ ID NO: 593849 - DNA, 23 bp, Homo sapiens
caaagatgcgtttgcctcctgga

SEQ ID NO: 593850 - DNA, 18 bp, Homo sapiens
caaagtaaaagtagtgtt

SEQ ID NO: 593851 - DNA, 19 bp, Homo sapiens
caaagtctccagaagaaaa

SEQ ID NO: 593852 - DNA, 20 bp, Homo sapiens
caaagtctccagaagaaaat

SEQ ID NO: 593853 - DNA, 17 bp, Homo sapiens
caaataatttgaacttt

SEQ ID NO: 593854 - DNA, 13 bp, Homo sapiens
caaatacacattt

SEQ ID NO: 593855 - DNA, 17 bp, Homo sapiens
caaatacacatttgcta

SEQ ID NO: 593856 - DNA, 20 bp, Homo sapiens
caaattgactcttatttata

SEQ ID NO: 593857 - DNA, 20 bp, Homo sapiens
caacaaagaaacaaagatgt

SEQ ID NO: 593858 - DNA, 20 bp, Homo sapiens
caacagagactgaatagata

SEQ ID NO: 593859 - DNA, 15 bp, Homo sapiens
caacagcaaacaggt

SEQ ID NO: 593860 - DNA, 17 bp, Homo sapiens
caacagcaaacaggtgc

SEQ ID NO: 593861 - DNA, 17 bp, Homo sapiens
caacaggtaaaacaggg

SEQ ID NO: 593862 - DNA, 23 bp, Homo sapiens
caacaggtaaaacagggccacat

SEQ ID NO: 593863 - DNA, 23 bp, Homo sapiens
caacatagtgagacccctgtctc

SEQ ID NO: 593864 - DNA, 23 bp, Homo sapiens
caacatgatccccgtctctgccc

SEQ ID NO: 593865 - DNA, 16 bp, Homo sapiens
caacccaatccctctc

SEQ ID NO: 593866 - DNA, 21 bp, Homo sapiens
caacctctttgcgtttccttt

SEQ ID NO: 593867 - DNA, 11 bp, Homo sapiens
caactacctga

SEQ ID NO: 593868 - DNA, 15 bp, Homo sapiens
caactacctgagcta

SEQ ID NO: 593869 - DNA, 21 bp, Homo sapiens
caactacctgagctaaataaa

SEQ ID NO: 593870 - DNA, 15 bp, Homo sapiens
caactttttcatagt

SEQ ID NO: 593871 - DNA, 21 bp, Homo sapiens
caagacccggttattcgccca

SEQ ID NO: 593872 - DNA, 22 bp, Homo sapiens
caagacccggttattcgcccac

SEQ ID NO: 593873 - DNA, 16 bp, Homo sapiens
caagagataagtcttt

SEQ ID NO: 593874 - DNA, 17 bp, Homo sapiens
caagcatgcagctttgc

SEQ ID NO: 593875 - DNA, 13 bp, Homo sapiens
caagccccctgcc

SEQ ID NO: 593876 - DNA, 16 bp, Homo sapiens
caagctgtatcactgc

SEQ ID NO: 593877 - DNA, 22 bp, Homo sapiens
caaggaaaggcatgtacaaaaa

SEQ ID NO: 593878 - DNA, 17 bp, Homo sapiens
caaggctcttcttcctc

SEQ ID NO: 593879 - DNA, 14 bp, Homo sapiens
caagggctgtaggt

SEQ ID NO: 593880 - DNA, 15 bp, Homo sapiens
caaggtgtgatggtc

SEQ ID NO: 593881 - DNA, 13 bp, Homo sapiens
caataaagcaatg

SEQ ID NO: 593882 - DNA, 12 bp, Homo sapiens
caatacaaaatg

SEQ ID NO: 593883 - DNA, 13 bp, Homo sapiens
caataccttcaag

SEQ ID NO: 593884 - DNA, 19 bp, Homo sapiens
caatattccagatctttca

SEQ ID NO: 593885 - DNA, 15 bp, Homo sapiens
caatccatccatgta

SEQ ID NO: 593886 - DNA, 13 bp, Homo sapiens
caatccctctcca

SEQ ID NO: 593887 - DNA, 19 bp, Homo sapiens
caatccctctccactcttc

SEQ ID NO: 593888 - DNA, 15 bp, Homo sapiens
cacattaactgttgc

SEQ ID NO: 593889 - DNA, 20 bp, Homo sapiens
caccagtgtagcatcttcct

SEQ ID NO: 593890 - DNA, 21 bp, Homo sapiens
caccagtgtagcatcttcctc

SEQ ID NO: 593891 - DNA, 17 bp, Homo sapiens
caccatgtgagctcttc

SEQ ID NO: 593892 - DNA, 16 bp, Homo sapiens
caccctccagagacaa

SEQ ID NO: 593893 - DNA, 19 bp, Homo sapiens
caccctccattctgcactc

SEQ ID NO: 593894 - DNA, 14 bp, Homo sapiens
caccgtattcctct

SEQ ID NO: 593895 - DNA, 19 bp, Homo sapiens
cacctcctaccccttcctg

SEQ ID NO: 593896 - DNA, 12 bp, Homo sapiens
cacctggctgcc

SEQ ID NO: 593897 - DNA, 13 bp, Homo sapiens
cacctggctgcca

SEQ ID NO: 593898 - DNA, 11 bp, Homo sapiens
cacctgtagct

SEQ ID NO: 593899 - DNA, 17 bp, Homo sapiens
cacctgtagctgaagca

SEQ ID NO: 593900 - DNA, 18 bp, Homo sapiens
cacgatgcatttaataaa

SEQ ID NO: 593901 - DNA, 12 bp, Homo sapiens
cacgcaggaagc

SEQ ID NO: 593902 - DNA, 20 bp, Homo sapiens
cacgtcaaatgcatacaagt

SEQ ID NO: 593903 - DNA, 21 bp, Homo sapiens
cacgttggggtgatttaatcc

SEQ ID NO: 593904 - DNA, 19 bp, Homo sapiens
cactaaaacacacaggtgc

SEQ ID NO: 593905 - DNA, 18 bp, Homo sapiens
cactagggccttggaaat

SEQ ID NO: 593906 - DNA, 14 bp, Homo sapiens
cactatttgtgact

SEQ ID NO: 593907 - DNA, 16 bp, Homo sapiens
cactcaagacccggtt

SEQ ID NO: 593908 - DNA, 12 bp, Homo sapiens
cactcacctgca

SEQ ID NO: 593909 - DNA, 14 bp, Homo sapiens
cactccccgcggtt

SEQ ID NO: 593910 - DNA, 14 bp, Homo sapiens
cactccgtctgctc

SEQ ID NO: 593911 - DNA, 17 bp, Homo sapiens
cactgccccctgcttgg

SEQ ID NO: 593912 - DNA, 18 bp, Homo sapiens
cactgccttcgtttatat

SEQ ID NO: 593913 - DNA, 17 bp, Homo sapiens
cactgcttgaactaggc

SEQ ID NO: 593914 - DNA, 20 bp, Homo sapiens
cactgcttgaactaggctga

SEQ ID NO: 593915 - DNA, 11 bp, Homo sapiens
cactgtagcta

SEQ ID NO: 593916 - DNA, 14 bp, Homo sapiens
cacttcctcctacc

SEQ ID NO: 593917 - DNA, 21 bp, Homo sapiens
cacttcctcctacctggggac

SEQ ID NO: 593918 - DNA, 21 bp, Homo sapiens
cacttgaaacctttttttatc

SEQ ID NO: 593919 - DNA, 14 bp, Homo sapiens
cacttgcctggggc

SEQ ID NO: 593920 - DNA, 21 bp, Homo sapiens
cactttcaagaatcagacagc

SEQ ID NO: 593921 - DNA, 17 bp, Homo sapiens
cagaaaacctgatgctg

SEQ ID NO: 593922 - DNA, 20 bp, Homo sapiens
cagaaagcttcatccacagc

SEQ ID NO: 593923 - DNA, 21 bp, Homo sapiens
cagaaagcttcatccacagcc

SEQ ID NO: 593924 - DNA, 23 bp, Homo sapiens
cagaaatgcccccattctcccag

SEQ ID NO: 593925 - DNA, 22 bp, Homo sapiens
cagaaatgttgagtctgtacta

SEQ ID NO: 593926 - DNA, 16 bp, Homo sapiens
cagaaccacacttgaa

SEQ ID NO: 593927 - DNA, 21 bp, Homo sapiens
cagaaccacacttgaaacctt

SEQ ID NO: 593928 - DNA, 16 bp, Homo sapiens
cagaatttttaactgt

SEQ ID NO: 593929 - DNA, 16 bp, Homo sapiens
cagacaacctcatcag

SEQ ID NO: 593930 - DNA, 15 bp, Homo sapiens
cagacagccctggca

SEQ ID NO: 593931 - DNA, 14 bp, Homo sapiens
cagaccctgaaccc

SEQ ID NO: 593932 - DNA, 20 bp, Homo sapiens
cagaccctgaacccacacct

SEQ ID NO: 593933 - DNA, 16 bp, Homo sapiens
cagactgggcactggg

SEQ ID NO: 593934 - DNA, 17 bp, Homo sapiens
cagagaacctgtgggct

SEQ ID NO: 593935 - DNA, 12 bp, Homo sapiens
cagagagtggag

SEQ ID NO: 593936 - DNA, 19 bp, Homo sapiens
cagagagtggagagagcag

SEQ ID NO: 593937 - DNA, 20 bp, Homo sapiens
cagagagtggagagagcagg

SEQ ID NO: 593938 - DNA, 22 bp, Homo sapiens
cagagcttgtggtggggcagga

SEQ ID NO: 593939 - DNA, 22 bp, Homo sapiens
cagaggtagtctcactgcttga

SEQ ID NO: 593940 - DNA, 20 bp, Homo sapiens
cagagtctgtatttttctaa

SEQ ID NO: 593941 - DNA, 15 bp, Homo sapiens
cagagtgggctttgg

SEQ ID NO: 593942 - DNA, 18 bp, Homo sapiens
cagagtgggctttggtgg

SEQ ID NO: 593943 - DNA, 22 bp, Homo sapiens
cagagttttcattaaatccttt

SEQ ID NO: 593944 - DNA, 19 bp, Homo sapiens
cagataccttatcttacaa

SEQ ID NO: 593945 - DNA, 15 bp, Homo sapiens
cagatctttcagaaa

SEQ ID NO: 593946 - DNA, 17 bp, Homo sapiens
cagatctttcagaaata

SEQ ID NO: 593947 - DNA, 15 bp, Homo sapiens
cagatgagggctggc

SEQ ID NO: 593948 - DNA, 17 bp, Homo sapiens
cagatgatgctttggaa

SEQ ID NO: 593949 - DNA, 18 bp, Homo sapiens
cagatgatgctttggaag

SEQ ID NO: 593950 - DNA, 23 bp, Homo sapiens
cagcactttgggaggctgaggtg

SEQ ID NO: 593951 - DNA, 17 bp, Homo sapiens
cagcagaaatgccccca

SEQ ID NO: 593952 - DNA, 23 bp, Homo sapiens
cagcaggaagccatagatgctgg

SEQ ID NO: 593953 - DNA, 21 bp, Homo sapiens
cagcagtcgcccaagcagaca

SEQ ID NO: 593954 - DNA, 17 bp, Homo sapiens
cagcatccaccccaccc

SEQ ID NO: 593955 - DNA, 12 bp, Homo sapiens
cagcatctgctc

SEQ ID NO: 593956 - DNA, 14 bp, Homo sapiens
cagcatctgctcca

SEQ ID NO: 593957 - DNA, 22 bp, Homo sapiens
cagcatgtccaacatggtaatt

SEQ ID NO: 593958 - DNA, 18 bp, Homo sapiens
cagcattgtaattatgta

SEQ ID NO: 593959 - DNA, 20 bp, Homo sapiens
cagcccaggatactggcaca

SEQ ID NO: 593960 - DNA, 22 bp, Homo sapiens
cagcccaggatactggcacaga

SEQ ID NO: 593961 - DNA, 12 bp, Homo sapiens
cagccctggcaa

SEQ ID NO: 593962 - DNA, 16 bp, Homo sapiens
cagcctactctccttg

SEQ ID NO: 593963 - DNA, 16 bp, Homo sapiens
cagcctagcctatgtc

SEQ ID NO: 593964 - DNA, 21 bp, Homo sapiens
catctccatggggaggcctca

SEQ ID NO: 593965 - DNA, 18 bp, Homo sapiens
catctctcccacttcctc

SEQ ID NO: 593966 - DNA, 12 bp, Homo sapiens
catctcttcctc

SEQ ID NO: 593967 - DNA, 17 bp, Homo sapiens
catgaaaaaccattttt

SEQ ID NO: 593968 - DNA, 17 bp, Homo sapiens
catgaaccctcttgcca

SEQ ID NO: 593969 - DNA, 23 bp, Homo sapiens
catgaaccctcttgccatcctga

SEQ ID NO: 593970 - DNA, 13 bp, Homo sapiens
catgacagcctcc

SEQ ID NO: 593971 - DNA, 21 bp, Homo sapiens
catgatccccgtctctgccct

SEQ ID NO: 593972 - DNA, 23 bp, Homo sapiens
catgatccccgtctctgccctgg

SEQ ID NO: 593973 - DNA, 21 bp, Homo sapiens
catgatttccctccagagaaa

SEQ ID NO: 593974 - DNA, 16 bp, Homo sapiens
catgcaaatgagctct

SEQ ID NO: 593975 - DNA, 22 bp, Homo sapiens
catgcaaatgagctctgaaatc

SEQ ID NO: 593976 - DNA, 15 bp, Homo sapiens
catgcaataaaattt

SEQ ID NO: 593977 - DNA, 17 bp, Homo sapiens
catgcatagtcccagct

SEQ ID NO: 593978 - DNA, 19 bp, Homo sapiens
catgcatgcaaatgagctc

SEQ ID NO: 593979 - DNA, 11 bp, Homo sapiens
catgcctccct

SEQ ID NO: 593980 - DNA, 20 bp, Homo sapiens
catgcctccctgggccacct

SEQ ID NO: 593981 - DNA, 13 bp, Homo sapiens
catggagacagca

SEQ ID NO: 593982 - DNA, 22 bp, Homo sapiens
catggatatgttatactgaacc

SEQ ID NO: 593983 - DNA, 17 bp, Homo sapiens
catggcaggacagctcc

SEQ ID NO: 593984 - DNA, 13 bp, Homo sapiens
catggggccagga

SEQ ID NO: 593985 - DNA, 14 bp, Homo sapiens
catggggccaggaa

SEQ ID NO: 593986 - DNA, 15 bp, Homo sapiens
catggggccaggaaa

SEQ ID NO: 593987 - DNA, 19 bp, Homo sapiens
catggggtcggctcctgat

SEQ ID NO: 593988 - DNA, 20 bp, Homo sapiens
catggggtcggctcctgatg

SEQ ID NO: 593989 - DNA, 19 bp, Homo sapiens
catgtacaaaaattatgca

SEQ ID NO: 593990 - DNA, 14 bp, Homo sapiens
catgtatttgagca

SEQ ID NO: 593991 - DNA, 14 bp, Homo sapiens
catgtgagctcttc

SEQ ID NO: 593992 - DNA, 22 bp, Homo sapiens
catgtgcctatagtcccagcta

SEQ ID NO: 593993 - DNA, 16 bp, Homo sapiens
catgttcccaaaacaa

SEQ ID NO: 593994 - DNA, 17 bp, Homo sapiens
catgttcccaaaacaat

SEQ ID NO: 593995 - DNA, 18 bp, Homo sapiens
catgttcccaaaacaatg

SEQ ID NO: 593996 - DNA, 11 bp, Homo sapiens
cattaactgtt

SEQ ID NO: 593997 - DNA, 22 bp, Homo sapiens
cattaactgttgcacttttgaa

SEQ ID NO: 593998 - DNA, 18 bp, Homo sapiens
cattaaggggaagaatga

SEQ ID NO: 593999 - DNA, 19 bp, Homo sapiens
cattaaggggaagaatgaa

SEQ ID NO: 594000 - DNA, 12 bp, Homo sapiens
cattcagaaatg

SEQ ID NO: 594001 - DNA, 14 bp, Homo sapiens
cattcagaaatgtt

SEQ ID NO: 594002 - DNA, 20 bp, Homo sapiens
cattcagaaatgttgagtct

SEQ ID NO: 594003 - DNA, 19 bp, Homo sapiens
cattcaggaattcttggag

SEQ ID NO: 594004 - DNA, 14 bp, Homo sapiens
cattcctctgccct

SEQ ID NO: 594005 - DNA, 12 bp, Homo sapiens
cattctcccagt

SEQ ID NO: 594006 - DNA, 19 bp, Homo sapiens
cattctgcactcagaaaat

SEQ ID NO: 594007 - DNA, 17 bp, Homo sapiens
cattctgcctgctccat

SEQ ID NO: 594008 - DNA, 23 bp, Homo sapiens
cattgaacagctgtgagccatgc

SEQ ID NO: 594009 - DNA, 9 bp, Homo sapiens
cattgagta

SEQ ID NO: 594010 - DNA, 10 bp, Homo sapiens
cattgagtat

SEQ ID NO: 594011 - DNA, 18 bp, Homo sapiens
ccagttgcactcaggtga

SEQ ID NO: 594012 - DNA, 12 bp, Homo sapiens
ccatcctgatgg

SEQ ID NO: 594013 - DNA, 19 bp, Homo sapiens
ccatcctgatggacctgcc

SEQ ID NO: 594014 - DNA, 23 bp, Homo sapiens
ccatcgtattaaaaaacaattaa

SEQ ID NO: 594015 - DNA, 21 bp, Homo sapiens
ccatgcctccctgggccacct

SEQ ID NO: 594016 - DNA, 16 bp, Homo sapiens
ccattctcccagtctc

SEQ ID NO: 594017 - DNA, 18 bp, Homo sapiens
ccattgaacagctgtgag

SEQ ID NO: 594018 - DNA, 17 bp, Homo sapiens
ccattgcttattatgta

SEQ ID NO: 594019 - DNA, 18 bp, Homo sapiens
ccattttgttattgacta

SEQ ID NO: 594020 - DNA, 22 bp, Homo sapiens
ccattttgttattgactaacag

SEQ ID NO: 594021 - DNA, 18 bp, Homo sapiens
ccattttttaatttactt

SEQ ID NO: 594022 - DNA, 22 bp, Homo sapiens
cccaacccaatccctctccact

SEQ ID NO: 594023 - DNA, 15 bp, Homo sapiens
cccaatccatcgtat

SEQ ID NO: 594024 - DNA, 13 bp, Homo sapiens
cccaatccctctc

SEQ ID NO: 594025 - DNA, 12 bp, Homo sapiens
cccacacctggg

SEQ ID NO: 594026 - DNA, 23 bp, Homo sapiens
cccacccgagtacctccagtcac

SEQ ID NO: 594027 - DNA, 13 bp, Homo sapiens
cccacctggctgc

SEQ ID NO: 594028 - DNA, 14 bp, Homo sapiens
cccacctgtagctg

SEQ ID NO: 594029 - DNA, 13 bp, Homo sapiens
cccacttcctcct

SEQ ID NO: 594030 - DNA, 17 bp, Homo sapiens
cccacttcctcctacct

SEQ ID NO: 594031 - DNA, 20 bp, Homo sapiens
cccacttcctcctacctggg

SEQ ID NO: 594032 - DNA, 23 bp, Homo sapiens
cccacttcctcctacctggggac

SEQ ID NO: 594033 - DNA, 13 bp, Homo sapiens
cccagagctgctg

SEQ ID NO: 594034 - DNA, 21 bp, Homo sapiens
cccagcactttgggaggctga

SEQ ID NO: 594035 - DNA, 18 bp, Homo sapiens
cccaggaacgctctcctc

SEQ ID NO: 594036 - DNA, 22 bp, Homo sapiens
cccagtgttctgcatggattca

SEQ ID NO: 594037 - DNA, 19 bp, Homo sapiens
cccagttgcactcaggtga

SEQ ID NO: 594038 - DNA, 12 bp, Homo sapiens
cccatctctccc

SEQ ID NO: 594039 - DNA, 18 bp, Homo sapiens
cccatctctcccacttcc

SEQ ID NO: 594040 - DNA, 19 bp, Homo sapiens
cccatctctcccacttcct

SEQ ID NO: 594041 - DNA, 20 bp, Homo sapiens
cccatctctcccacttcctc

SEQ ID NO: 594042 - DNA, 21 bp, Homo sapiens
cccatctttgctgccagctct

SEQ ID NO: 594043 - DNA, 19 bp, Homo sapiens
cccattctcccagtctctg

SEQ ID NO: 594044 - DNA, 12 bp, Homo sapiens
ccccattctccc

SEQ ID NO: 594045 - DNA, 15 bp, Homo sapiens
ccccattctcccagt

SEQ ID NO: 594046 - DNA, 14 bp, Homo sapiens
cccccaccagtgta

SEQ ID NO: 594047 - DNA, 13 bp, Homo sapiens
cccccattctccc

SEQ ID NO: 594048 - DNA, 14 bp, Homo sapiens
cccccattctccca

SEQ ID NO: 594049 - DNA, 18 bp, Homo sapiens
cccccattctcccagtct

SEQ ID NO: 594050 - DNA, 20 bp, Homo sapiens
cccccattctcccagtctct

SEQ ID NO: 594051 - DNA, 15 bp, Homo sapiens
ccccgtctctgccct

SEQ ID NO: 594052 - DNA, 22 bp, Homo sapiens
ccccgtctctgccctgggctcc

SEQ ID NO: 594053 - DNA, 21 bp, Homo sapiens
cccctaaaagcactcctgctt

SEQ ID NO: 594054 - DNA, 21 bp, Homo sapiens
ccccttaccccaaagagaaag

SEQ ID NO: 594055 - DNA, 19 bp, Homo sapiens
ccccttcctcttgtctgat

SEQ ID NO: 594056 - DNA, 19 bp, Homo sapiens
ccccttcctgtcctgcctc

SEQ ID NO: 594057 - DNA, 17 bp, Homo sapiens
ccccttgttgcactgcc

SEQ ID NO: 594058 - DNA, 22 bp, Homo sapiens
cccctttgtcctgcgttttctc

SEQ ID NO: 594059 - DNA, 15 bp, Homo sapiens
cccgagtacctccag

SEQ ID NO: 594060 - DNA, 13 bp, Homo sapiens
cccggacctacct

SEQ ID NO: 594061 - DNA, 23 bp, Homo sapiens
cccggacctacctccctccctct

SEQ ID NO: 594062 - DNA, 19 bp, Homo sapiens
cccggttattcgcccaccc

SEQ ID NO: 594063 - DNA, 23 bp, Homo sapiens
cccgtctctgccctgggctcctc

SEQ ID NO: 594064 - DNA, 20 bp, Homo sapiens
ccctaaaagcactcctgctt

SEQ ID NO: 594065 - DNA, 14 bp, Homo sapiens
ccctaccctggact

SEQ ID NO: 594066 - DNA, 17 bp, Homo sapiens
ccctccattctgcactc

SEQ ID NO: 594067 - DNA, 12 bp, Homo sapiens
ccctctccactc

SEQ ID NO: 594068 - DNA, 14 bp, Homo sapiens
ccctctccactctt

SEQ ID NO: 594069 - DNA, 22 bp, Homo sapiens
ccctctccactcttctctcctt

SEQ ID NO: 594070 - DNA, 23 bp, Homo sapiens
ccctctccgcgggagaccccttg

SEQ ID NO: 594071 - DNA, 14 bp, Homo sapiens
ccctcttctctcct

SEQ ID NO: 594072 - DNA, 11 bp, Homo sapiens
ccctcttgcca

SEQ ID NO: 594073 - DNA, 15 bp, Homo sapiens
ccctcttgccatcct

SEQ ID NO: 594074 - DNA, 16 bp, Homo sapiens
ccctcttgccatcctg

SEQ ID NO: 594075 - DNA, 17 bp, Homo sapiens
ccctcttgccatcctga

SEQ ID NO: 594076 - DNA, 16 bp, Homo sapiens
ccctgaacccacacct

SEQ ID NO: 594077 - DNA, 19 bp, Homo sapiens
ccctgaacccacacctggg

SEQ ID NO: 594078 - DNA, 16 bp, Homo sapiens
ccctgaggcctagact

SEQ ID NO: 594079 - DNA, 17 bp, Homo sapiens
ccctgcttggccaggag

SEQ ID NO: 594080 - DNA, 15 bp, Homo sapiens
ccctgggccacctcc

SEQ ID NO: 594081 - DNA, 18 bp, Homo sapiens
ccctgggccacctcctac

SEQ ID NO: 594082 - DNA, 19 bp, Homo sapiens
cccttattgctgtcctgga

SEQ ID NO: 594083 - DNA, 16 bp, Homo sapiens
cccttcctgtcctgcc

SEQ ID NO: 594084 - DNA, 21 bp, Homo sapiens
cccttcctgtcctgcctcctc

SEQ ID NO: 594085 - DNA, 18 bp, Homo sapiens
cccttctgggtccaggga

SEQ ID NO: 594086 - DNA, 19 bp, Homo sapiens
cccttgttgcactgccccc

SEQ ID NO: 594087 - DNA, 15 bp, Homo sapiens
cccttttaccactcc

SEQ ID NO: 594088 - DNA, 17 bp, Homo sapiens
cccttttaccactccca

SEQ ID NO: 594089 - DNA, 14 bp, Homo sapiens
ccgacgtcatgtat

SEQ ID NO: 594090 - DNA, 20 bp, Homo sapiens
ccgccatggggtcggctcct

SEQ ID NO: 594091 - DNA, 21 bp, Homo sapiens
ccgccatggggtcggctcctg

SEQ ID NO: 594092 - DNA, 22 bp, Homo sapiens
ccgccatggggtcggctcctga

SEQ ID NO: 594093 - DNA, 14 bp, Homo sapiens
ccgcccactcctgg

SEQ ID NO: 594094 - DNA, 11 bp, Homo sapiens
ccggaaagaag

SEQ ID NO: 594095 - DNA, 19 bp, Homo sapiens
ccggacctacctccctccc

SEQ ID NO: 594096 - DNA, 19 bp, Homo sapiens
ccggttattcgcccacccg

SEQ ID NO: 594097 - DNA, 12 bp, Homo sapiens
ccgtaatttaac

SEQ ID NO: 594098 - DNA, 16 bp, Homo sapiens
ccgtagcttcagccag

SEQ ID NO: 594099 - DNA, 17 bp, Homo sapiens
ccgtagcttcagccagg

SEQ ID NO: 594100 - DNA, 18 bp, Homo sapiens
ccgtagcttcagccaggc

SEQ ID NO: 594101 - DNA, 13 bp, Homo sapiens
ccgtattcctctc

SEQ ID NO: 594102 - DNA, 17 bp, Homo sapiens
ccgtctctgccctgggc

SEQ ID NO: 594103 - DNA, 20 bp, Homo sapiens
ccgtctctgccctgggctcc

SEQ ID NO: 594104 - DNA, 16 bp, Homo sapiens
ccgtcttttcctgttt

SEQ ID NO: 594105 - DNA, 13 bp, Homo sapiens
cctaaaagcactc

SEQ ID NO: 594106 - DNA, 23 bp, Homo sapiens
cctaaggcacccacaaataaatg

SEQ ID NO: 594107 - DNA, 16 bp, Homo sapiens
cctaagtcccttccta

SEQ ID NO: 594108 - DNA, 18 bp, Homo sapiens
cctacactcacctgcact

SEQ ID NO: 594109 - DNA, 20 bp, Homo sapiens
cctacagttttaactgtgga

SEQ ID NO: 594110 - DNA, 13 bp, Homo sapiens
cctaccccttcct

SEQ ID NO: 594111 - DNA, 15 bp, Homo sapiens
cctaccccttcctgt

SEQ ID NO: 594112 - DNA, 20 bp, Homo sapiens
cctaccccttcctgtcctgc

SEQ ID NO: 594113 - DNA, 13 bp, Homo sapiens
cctacctccctcc

SEQ ID NO: 594114 - DNA, 14 bp, Homo sapiens
cctacctccctccc

SEQ ID NO: 594115 - DNA, 17 bp, Homo sapiens
cctacctggggactcct

SEQ ID NO: 594116 - DNA, 19 bp, Homo sapiens
cctacctggggactcctca

SEQ ID NO: 594117 - DNA, 13 bp, Homo sapiens
cctactatttaaa

SEQ ID NO: 594118 - DNA, 21 bp, Homo sapiens
cctactggtgtaatctcaatg

SEQ ID NO: 594119 - DNA, 13 bp, Homo sapiens
cctactttctatt
